United States Patent 7,888,497 (BIOINFORMATICALLY DETECTABLE GROUP OF NOVEL REGULATORY OLIGONUCLEOTIDES AND USES THEREOF) - sequence listing, part 97

SEQ ID NO: 4100793 - DNA, 18 bp, Homo sapiens
tcccaaggtcctctcagt

SEQ ID NO: 4100794 - DNA, 17 bp, Homo sapiens
tcccaaggttggagccc

SEQ ID NO: 4100795 - DNA, 22 bp, Homo sapiens
tcccaagtttccatagcaacag

SEQ ID NO: 4100796 - DNA, 16 bp, Homo sapiens
tcccaataaaagtgac

SEQ ID NO: 4100797 - DNA, 17 bp, Homo sapiens
tcccaataaaagtgact

SEQ ID NO: 4100798 - DNA, 20 bp, Homo sapiens
tcccaattagcttggcctac

SEQ ID NO: 4100799 - DNA, 14 bp, Homo sapiens
tcccaattaggaag

SEQ ID NO: 4100800 - DNA, 15 bp, Homo sapiens
tcccaattaggaagt

SEQ ID NO: 4100801 - DNA, 20 bp, Homo sapiens
tcccaattaggaagtgtaac

SEQ ID NO: 4100802 - DNA, 22 bp, Homo sapiens
tcccacaaatgcaggtgtcctg

SEQ ID NO: 4100803 - DNA, 17 bp, Homo sapiens
tcccacacttgctgggg

SEQ ID NO: 4100804 - DNA, 15 bp, Homo sapiens
tcccacaggcccttc

SEQ ID NO: 4100805 - DNA, 17 bp, Homo sapiens
tcccacaggcccttcct

SEQ ID NO: 4100806 - DNA, 14 bp, Homo sapiens
tcccacatgaggcc

SEQ ID NO: 4100807 - DNA, 21 bp, Homo sapiens
tcccacccacacagctgccct

SEQ ID NO: 4100808 - DNA, 22 bp, Homo sapiens
tcccacccacacagctgcccta

SEQ ID NO: 4100809 - DNA, 18 bp, Homo sapiens
tcccaccccatcctccag

SEQ ID NO: 4100810 - DNA, 22 bp, Homo sapiens
tcccacccccttctctgctcca

SEQ ID NO: 4100811 - DNA, 17 bp, Homo sapiens
tcccacccctacacaca

SEQ ID NO: 4100812 - DNA, 22 bp, Homo sapiens
tcccacccctacacacacactc

SEQ ID NO: 4100813 - DNA, 23 bp, Homo sapiens
tcccacccctacacacacactcc

SEQ ID NO: 4100814 - DNA, 19 bp, Homo sapiens
tcccacccctagccaccag

SEQ ID NO: 4100815 - DNA, 24 bp, Homo sapiens
tcccacccctagccaccagtgtcc

SEQ ID NO: 4100816 - DNA, 14 bp, Homo sapiens
tcccacccgtggtg

SEQ ID NO: 4100817 - DNA, 14 bp, Homo sapiens
tcccaccctcctgc

SEQ ID NO: 4100818 - DNA, 17 bp, Homo sapiens
tcccaccctcctgcccc

SEQ ID NO: 4100819 - DNA, 20 bp, Homo sapiens
tcccaccctgacccccttcc

SEQ ID NO: 4100820 - DNA, 12 bp, Homo sapiens
tcccaccctgta

SEQ ID NO: 4100821 - DNA, 20 bp, Homo sapiens
tcccaccctgtacctcatcc

SEQ ID NO: 4100822 - DNA, 21 bp, Homo sapiens
tcccaccgggagcctccccct

SEQ ID NO: 4100823 - DNA, 17 bp, Homo sapiens
tcccacctagcagcacc

SEQ ID NO: 4100824 - DNA, 17 bp, Homo sapiens
tcccacctcacccggcc

SEQ ID NO: 4100825 - DNA, 15 bp, Homo sapiens
tcccacctctccttt

SEQ ID NO: 4100826 - DNA, 20 bp, Homo sapiens
tcccacctctccttttgagg

SEQ ID NO: 4100827 - DNA, 20 bp, Homo sapiens
tcccacctgcatctggggcc

SEQ ID NO: 4100828 - DNA, 15 bp, Homo sapiens
tcccacgaatttgct

SEQ ID NO: 4100829 - DNA, 18 bp, Homo sapiens
tcccacgaatttgctggg

SEQ ID NO: 4100830 - DNA, 15 bp, Homo sapiens
tcccacgtctggcca

SEQ ID NO: 4100831 - DNA, 17 bp, Homo sapiens
tcccacgtctggccagg

SEQ ID NO: 4100832 - DNA, 22 bp, Homo sapiens
tcccacgtcttcttgctgcagc

SEQ ID NO: 4100833 - DNA, 14 bp, Homo sapiens
tcccacgtgggaga

SEQ ID NO: 4100834 - DNA, 14 bp, Homo sapiens
tcccacgtgtcttc

SEQ ID NO: 4100835 - DNA, 17 bp, Homo sapiens
tcccacgtgtcttccac

SEQ ID NO: 4100836 - DNA, 18 bp, Homo sapiens
tcccacgtgtcttccact

SEQ ID NO: 4100837 - DNA, 16 bp, Homo sapiens
tcccactacatctggg

SEQ ID NO: 4100838 - DNA, 15 bp, Homo sapiens
tcccactcttctcat

SEQ ID NO: 4100839 - DNA, 17 bp, Homo sapiens
tcccacttcaaaacaaa

SEQ ID NO: 4100840 - DNA, 16 bp, Homo sapiens
tcccagactactattt

SEQ ID NO: 4100841 - DNA, 20 bp, Homo sapiens
tcccagactactattttctt

SEQ ID NO: 4100842 - DNA, 12 bp, Homo sapiens
tcccagagggag

SEQ ID NO: 4100843 - DNA, 13 bp, Homo sapiens
tcccagagggagc

SEQ ID NO: 4100844 - DNA, 14 bp, Homo sapiens
tcccagagggagca

SEQ ID NO: 4100845 - DNA, 21 bp, Homo sapiens
tcccagaggtgggatcctccc

SEQ ID NO: 4100846 - DNA, 23 bp, Homo sapiens
tcccagaggtgggatcctccctc

SEQ ID NO: 4100847 - DNA, 15 bp, Homo sapiens
tcccagagtgctggg

SEQ ID NO: 4100848 - DNA, 15 bp, Homo sapiens
tcccagcacctgcct

SEQ ID NO: 4100849 - DNA, 23 bp, Homo sapiens
tcccagcactttgggaggccaag

SEQ ID NO: 4100850 - DNA, 18 bp, Homo sapiens
tcccagcagccctaagga

SEQ ID NO: 4100851 - DNA, 15 bp, Homo sapiens
tcccagcatccctgg

SEQ ID NO: 4100852 - DNA, 17 bp, Homo sapiens
tcccagcatccctggag

SEQ ID NO: 4100853 - DNA, 20 bp, Homo sapiens
tccagcctgggcaacagagc

SEQ ID NO: 4100854 - DNA, 23 bp, Homo sapiens
tccagcctgggcagccaggctgc

SEQ ID NO: 4100855 - DNA, 12 bp, Homo sapiens
tccagcctgggt

SEQ ID NO: 4100856 - DNA, 13 bp, Homo sapiens
tccagctcctgta

SEQ ID NO: 4100857 - DNA, 11 bp, Homo sapiens
tccagctcttg

SEQ ID NO: 4100858 - DNA, 14 bp, Homo sapiens
tccagctcttggcc

SEQ ID NO: 4100859 - DNA, 15 bp, Homo sapiens
tccagctcttggccc

SEQ ID NO: 4100860 - DNA, 14 bp, Homo sapiens
tccagctgcaccag

SEQ ID NO: 4100861 - DNA, 17 bp, Homo sapiens
tccagctgcaccagagc

SEQ ID NO: 4100862 - DNA, 13 bp, Homo sapiens
tccagctgccccg

SEQ ID NO: 4100863 - DNA, 13 bp, Homo sapiens
tccagctgcctgg

SEQ ID NO: 4100864 - DNA, 15 bp, Homo sapiens
tccagctgcctgggc

SEQ ID NO: 4100865 - DNA, 15 bp, Homo sapiens
tccagctgctgtctt

SEQ ID NO: 4100866 - DNA, 13 bp, Homo sapiens
tccagctggggcc

SEQ ID NO: 4100867 - DNA, 19 bp, Homo sapiens
tccagctggggccagaggc

SEQ ID NO: 4100868 - DNA, 19 bp, Homo sapiens
tccagctgtgcagcacgtc

SEQ ID NO: 4100869 - DNA, 23 bp, Homo sapiens
tccaggaaactccacatctgcct

SEQ ID NO: 4100870 - DNA, 11 bp, Homo sapiens
tccaggaaaga

SEQ ID NO: 4100871 - DNA, 22 bp, Homo sapiens
tccaggaatgcctcctccctgg

SEQ ID NO: 4100872 - DNA, 20 bp, Homo sapiens
tccaggaattcctcttttgc

SEQ ID NO: 4100873 - DNA, 21 bp, Homo sapiens
tccaggaattcctcttttgct

SEQ ID NO: 4100874 - DNA, 20 bp, Homo sapiens
tccaggactatatttgggcc

SEQ ID NO: 4100875 - DNA, 16 bp, Homo sapiens
tccaggagcttcttgt

SEQ ID NO: 4100876 - DNA, 23 bp, Homo sapiens
tccaggataaggagactgaggct

SEQ ID NO: 4100877 - DNA, 19 bp, Homo sapiens
tccaggatgctaacatcta

SEQ ID NO: 4100878 - DNA, 17 bp, Homo sapiens
tccaggcaccctcaggg

SEQ ID NO: 4100879 - DNA, 18 bp, Homo sapiens
tccaggcaccctcaggga

SEQ ID NO: 4100880 - DNA, 20 bp, Homo sapiens
tccaggcaccctcagggagc

SEQ ID NO: 4100881 - DNA, 13 bp, Homo sapiens
tccaggcagatcc

SEQ ID NO: 4100882 - DNA, 14 bp, Homo sapiens
tccaggcagatcca

SEQ ID NO: 4100883 - DNA, 15 bp, Homo sapiens
tccaggcagatccag

SEQ ID NO: 4100884 - DNA, 16 bp, Homo sapiens
tccaggcagatccagg

SEQ ID NO: 4100885 - DNA, 18 bp, Homo sapiens
tccaggcagatccaggac

SEQ ID NO: 4100886 - DNA, 19 bp, Homo sapiens
tccaggcagatccaggact

SEQ ID NO: 4100887 - DNA, 11 bp, Homo sapiens
tccaggcccaa

SEQ ID NO: 4100888 - DNA, 15 bp, Homo sapiens
tccaggcccaaggct

SEQ ID NO: 4100889 - DNA, 16 bp, Homo sapiens
tccaggcctgatcttg

SEQ ID NO: 4100890 - DNA, 20 bp, Homo sapiens
tccaggcctgcagcaggagt

SEQ ID NO: 4100891 - DNA, 14 bp, Homo sapiens
tccaggcctgcctc

SEQ ID NO: 4100892 - DNA, 15 bp, Homo sapiens
tccaggcctgcctcc

SEQ ID NO: 4100893 - DNA, 18 bp, Homo sapiens
tccaggcctgcctcccac

SEQ ID NO: 4100894 - DNA, 19 bp, Homo sapiens
tccaggcctgcctcccact

SEQ ID NO: 4100895 - DNA, 17 bp, Homo sapiens
tccaggcttcacagtct

SEQ ID NO: 4100896 - DNA, 23 bp, Homo sapiens
tccagggaagctggccgagggtc

SEQ ID NO: 4100897 - DNA, 19 bp, Homo sapiens
tccagggaaggtggccaca

SEQ ID NO: 4100898 - DNA, 22 bp, Homo sapiens
tccagggaaggtggccacagca

SEQ ID NO: 4100899 - DNA, 14 bp, Homo sapiens
tccagggacagagg

SEQ ID NO: 4100900 - DNA, 23 bp, Homo sapiens
tccagggacagaggccccagcct

SEQ ID NO: 4100901 - DNA, 16 bp, Homo sapiens
tccagggcctgacacc

SEQ ID NO: 4100902 - DNA, 18 bp, Homo sapiens
tccaggggagatggggag

SEQ ID NO: 4100903 - DNA, 19 bp, Homo sapiens
tccaggggagatggggagg

SEQ ID NO: 4100904 - DNA, 20 bp, Homo sapiens
tccaggggcccttgggacag

SEQ ID NO: 4100905 - DNA, 23 bp, Homo sapiens
tccaggggcccttgggacagcca

SEQ ID NO: 4100906 - DNA, 18 bp, Homo sapiens
tccagggttgatcacact

SEQ ID NO: 4100907 - DNA, 15 bp, Homo sapiens
tccaggtatctccag

SEQ ID NO: 4100908 - DNA, 17 bp, Homo sapiens
tccaggtatctccagga

SEQ ID NO: 4100909 - DNA, 13 bp, Homo sapiens
tccaggtgctcat

SEQ ID NO: 4100910 - DNA, 16 bp, Homo sapiens
tccaggtgttactgta

SEQ ID NO: 4100911 - DNA, 20 bp, Homo sapiens
tccaggttcaacccacagct

SEQ ID NO: 4100912 - DNA, 13 bp, Homo sapiens
tccagtcaggctc

SEQ ID NO: 4100913 - DNA, 20 bp, Homo sapiens
tccagtcaggctctctgggc

SEQ ID NO: 4100914 - DNA, 12 bp, Homo sapiens
tccagtccccag

SEQ ID NO: 4100915 - DNA, 22 bp, Homo sapiens
tccagtccccagaactctgcct

SEQ ID NO: 4100916 - DNA, 20 bp, Homo sapiens
tccagtgacaaaccatccag

SEQ ID NO: 4100917 - DNA, 14 bp, Homo sapiens
tccagtgcaattgt

SEQ ID NO: 4100918 - DNA, 17 bp, Homo sapiens
tccagtgccagcaatga

SEQ ID NO: 4100919 - DNA, 15 bp, Homo sapiens
tccagtgctctgcct

SEQ ID NO: 4100920 - DNA, 21 bp, Homo sapiens
tccagtgtcacctctctcaga

SEQ ID NO: 4100921 - DNA, 21 bp, Homo sapiens
tccagtgtccttagaacattt

SEQ ID NO: 4100922 - DNA, 19 bp, Homo sapiens
tccagtgtgggcttgacca

SEQ ID NO: 4100923 - DNA, 16 bp, Homo sapiens
tccagttactttccaa

SEQ ID NO: 4100924 - DNA, 13 bp, Homo sapiens
tccagttcccact

SEQ ID NO: 4100925 - DNA, 15 bp, Homo sapiens
tccagttcctttaga

SEQ ID NO: 4100926 - DNA, 12 bp, Homo sapiens
tccataatgtat

SEQ ID NO: 4100927 - DNA, 12 bp, Homo sapiens
tccataattatg

SEQ ID NO: 4100928 - DNA, 15 bp, Homo sapiens
tccatacacagagga

SEQ ID NO: 4100929 - DNA, 22 bp, Homo sapiens
tccatacactttgttgcaagat

SEQ ID NO: 4100930 - DNA, 13 bp, Homo sapiens
tccataccttttc

SEQ ID NO: 4100931 - DNA, 19 bp, Homo sapiens
tccataggtttctctccct

SEQ ID NO: 4100932 - DNA, 21 bp, Homo sapiens
tccataggtttctctccctcc

SEQ ID NO: 4100933 - DNA, 20 bp, Homo sapiens
tccatatcagaactgtgcca

SEQ ID NO: 4100934 - DNA, 14 bp, Homo sapiens
tccatatcctggtg

SEQ ID NO: 4100935 - DNA, 18 bp, Homo sapiens
tccatatccttctggctg

SEQ ID NO: 4100936 - DNA, 18 bp, Homo sapiens
tccatatggattttctat

SEQ ID NO: 4100937 - DNA, 14 bp, Homo sapiens
tccatcagctccct

SEQ ID NO: 4100938 - DNA, 12 bp, Homo sapiens
tccatcatttta

SEQ ID NO: 4100939 - DNA, 18 bp, Homo sapiens
tccatcattttacagtga

SEQ ID NO: 4100940 - DNA, 17 bp, Homo sapiens
tccatccatccttccaa

SEQ ID NO: 4100941 - DNA, 14 bp, Homo sapiens
tccatccatctcca

SEQ ID NO: 4100942 - DNA, 12 bp, Homo sapiens
tccatccatctt

SEQ ID NO: 4100943 - DNA, 19 bp, Homo sapiens
tccatcccaacagccatgc

SEQ ID NO: 4100944 - DNA, 13 bp, Homo sapiens
tccatccctccat

SEQ ID NO: 4100945 - DNA, 16 bp, Homo sapiens
tccatctcctgctcac

SEQ ID NO: 4100946 - DNA, 14 bp, Homo sapiens
tccatctctcatcc

SEQ ID NO: 4100947 - DNA, 16 bp, Homo sapiens
tccatctctcatcctc

SEQ ID NO: 4100948 - DNA, 18 bp, Homo sapiens
tccatctctcatcctcca

SEQ ID NO: 4100949 - DNA, 18 bp, Homo sapiens
tccatctttctacagaga

SEQ ID NO: 4100950 - DNA, 11 bp, Homo sapiens
tccatgaaaac

SEQ ID NO: 4100951 - DNA, 15 bp, Homo sapiens
tccatgaaaacgttt

SEQ ID NO: 4100952 - DNA, 19 bp, Homo sapiens
tccatgaaaacgttttatt

SEQ ID NO: 4100953 - DNA, 22 bp, Homo sapiens
tccatgaaaacgttttattgtg

SEQ ID NO: 4100954 - DNA, 12 bp, Homo sapiens
tccatgaatgta

SEQ ID NO: 4100955 - DNA, 14 bp, Homo sapiens
tccatgaatgtatc

SEQ ID NO: 4100956 - DNA, 21 bp, Homo sapiens
tccatgcaccctcatacacag

SEQ ID NO: 4100957 - DNA, 15 bp, Homo sapiens
tcagcgtaaaatggt

SEQ ID NO: 4100958 - DNA, 18 bp, Homo sapiens
tcagctaaagcccaacct

SEQ ID NO: 4100959 - DNA, 19 bp, Homo sapiens
tcagctaagggaagacatt

SEQ ID NO: 4100960 - DNA, 20 bp, Homo sapiens
tcagctactaatgatgtttt

SEQ ID NO: 4100961 - DNA, 18 bp, Homo sapiens
tcagctagcttttaggaa

SEQ ID NO: 4100962 - DNA, 19 bp, Homo sapiens
tcagctatttactgccaaa

SEQ ID NO: 4100963 - DNA, 20 bp, Homo sapiens
tcagctatttactgccaaag

SEQ ID NO: 4100964 - DNA, 18 bp, Homo sapiens
tcagctcagcgccagcct

SEQ ID NO: 4100965 - DNA, 23 bp, Homo sapiens
tcagctcccccaggctgttctcc

SEQ ID NO: 4100966 - DNA, 24 bp, Homo sapiens
tcagctcccccaggctgttctcca

SEQ ID NO: 4100967 - DNA, 17 bp, Homo sapiens
tcagctcctacctctgt

SEQ ID NO: 4100968 - DNA, 14 bp, Homo sapiens
tcagctctctgccc

SEQ ID NO: 4100969 - DNA, 22 bp, Homo sapiens
tcagctctctgggacctcctta

SEQ ID NO: 4100970 - DNA, 12 bp, Homo sapiens
tcagctctggga

SEQ ID NO: 4100971 - DNA, 16 bp, Homo sapiens
tcagctctgggagagg

SEQ ID NO: 4100972 - DNA, 21 bp, Homo sapiens
tcagctgaatgcctcctgtgg

SEQ ID NO: 4100973 - DNA, 22 bp, Homo sapiens
tcagctgaatgcctcctgtggg

SEQ ID NO: 4100974 - DNA, 23 bp, Homo sapiens
tcagctgaatgcctcctgtgggg

SEQ ID NO: 4100975 - DNA, 16 bp, Homo sapiens
tcagctgacccggcct

SEQ ID NO: 4100976 - DNA, 16 bp, Homo sapiens
tcagctgagccctggg

SEQ ID NO: 4100977 - DNA, 23 bp, Homo sapiens
tcagctgagccctggggactgtt

SEQ ID NO: 4100978 - DNA, 13 bp, Homo sapiens
tcagctgcctgaa

SEQ ID NO: 4100979 - DNA, 15 bp, Homo sapiens
tcagctgctccctgg

SEQ ID NO: 4100980 - DNA, 22 bp, Homo sapiens
tcagctgggtcacatccatccc

SEQ ID NO: 4100981 - DNA, 23 bp, Homo sapiens
tcagctgggtcacatccatccct

SEQ ID NO: 4100982 - DNA, 17 bp, Homo sapiens
tcagctggttactcagg

SEQ ID NO: 4100983 - DNA, 19 bp, Homo sapiens
tcagctggttactcagggt

SEQ ID NO: 4100984 - DNA, 22 bp, Homo sapiens
tcagctggttactcagggttca

SEQ ID NO: 4100985 - DNA, 20 bp, Homo sapiens
tcagctgtaagaagagactg

SEQ ID NO: 4100986 - DNA, 15 bp, Homo sapiens
tcagctgtttgtcat

SEQ ID NO: 4100987 - DNA, 16 bp, Homo sapiens
tcagctgtttgtcata

SEQ ID NO: 4100988 - DNA, 21 bp, Homo sapiens
tcagcttaaaataaacagttg

SEQ ID NO: 4100989 - DNA, 23 bp, Homo sapiens
tcagcttcctacccacacctctg

SEQ ID NO: 4100990 - DNA, 15 bp, Homo sapiens
tcagctttcagggcc

SEQ ID NO: 4100991 - DNA, 14 bp, Homo sapiens
tcaggaaagacgga

SEQ ID NO: 4100992 - DNA, 16 bp, Homo sapiens
tcaggaacagaaggat

SEQ ID NO: 4100993 - DNA, 18 bp, Homo sapiens
tcaggaacagctatggga

SEQ ID NO: 4100994 - DNA, 17 bp, Homo sapiens
tcaggaacagtggctgg

SEQ ID NO: 4100995 - DNA, 23 bp, Homo sapiens
tcaggaagagctatggcccagaa

SEQ ID NO: 4100996 - DNA, 20 bp, Homo sapiens
tcaggaagatgaaagaggag

SEQ ID NO: 4100997 - DNA, 21 bp, Homo sapiens
tcaggacctctgtaggcagca

SEQ ID NO: 4100998 - DNA, 15 bp, Homo sapiens
tcaggacggctcctc

SEQ ID NO: 4100999 - DNA, 17 bp, Homo sapiens
tcaggacggctcctcag

SEQ ID NO: 4101000 - DNA, 18 bp, Homo sapiens
tcaggacggctcctcaga

SEQ ID NO: 4101001 - DNA, 19 bp, Homo sapiens
tcaggacggctcctcagag

SEQ ID NO: 4101002 - DNA, 20 bp, Homo sapiens
tcaggacggctcctcagagc

SEQ ID NO: 4101003 - DNA, 22 bp, Homo sapiens
tcaggagatcgagaccatcctg

SEQ ID NO: 4101004 - DNA, 14 bp, Homo sapiens
tcaggagcttgggc

SEQ ID NO: 4101005 - DNA, 21 bp, Homo sapiens
tcaggaggctggaggaagggg

SEQ ID NO: 4101006 - DNA, 19 bp, Homo sapiens
tcaggagtcccaaggaaag

SEQ ID NO: 4101007 - DNA, 15 bp, Homo sapiens
tcaggatacatgtgc

SEQ ID NO: 4101008 - DNA, 22 bp, Homo sapiens
tcaggatatccttatcagagct

SEQ ID NO: 4101009 - DNA, 17 bp, Homo sapiens
tcaggatcaagaaagtg

SEQ ID NO: 4101010 - DNA, 20 bp, Homo sapiens
tcaggatgatacactatgaa

SEQ ID NO: 4101011 - DNA, 14 bp, Homo sapiens
tcaggcacacagct

SEQ ID NO: 4101012 - DNA, 16 bp, Homo sapiens
tcaggcaccagcatcc

SEQ ID NO: 4101013 - DNA, 13 bp, Homo sapiens
tcaggcagctcaa

SEQ ID NO: 4101014 - DNA, 15 bp, Homo sapiens
tcaggcataggcctg

SEQ ID NO: 4101015 - DNA, 16 bp, Homo sapiens
tcaggcataggcctgg

SEQ ID NO: 4101016 - DNA, 17 bp, Homo sapiens
tcaggcatggctcagag

SEQ ID NO: 4101017 - DNA, 20 bp, Homo sapiens
tcaggcatggctcagagctt

SEQ ID NO: 4101018 - DNA, 12 bp, Homo sapiens
tcaggcccccag

SEQ ID NO: 4101019 - DNA, 18 bp, Homo sapiens
tcaggcccccagtgggac

SEQ ID NO: 4101020 - DNA, 16 bp, Homo sapiens
tcaggcccggcagggc

SEQ ID NO: 4101021 - DNA, 18 bp, Homo sapiens
tcaggccctgactcctct

SEQ ID NO: 4101022 - DNA, 21 bp, Homo sapiens
tccagaagatgccagcttctc

SEQ ID NO: 4101023 - DNA, 16 bp, Homo sapiens
tccagaagcctctggc

SEQ ID NO: 4101024 - DNA, 17 bp, Homo sapiens
tccagaagcctctggct

SEQ ID NO: 4101025 - DNA, 18 bp, Homo sapiens
tccagaagcctctggcta

SEQ ID NO: 4101026 - DNA, 19 bp, Homo sapiens
tccagaatcttgactttct

SEQ ID NO: 4101027 - DNA, 13 bp, Homo sapiens
tccagaatgctgt

SEQ ID NO: 4101028 - DNA, 18 bp, Homo sapiens
tccagaatgctgtacatc

SEQ ID NO: 4101029 - DNA, 14 bp, Homo sapiens
tccagaatgtaaga

SEQ ID NO: 4101030 - DNA, 15 bp, Homo sapiens
tccagaatgtaagaa

SEQ ID NO: 4101031 - DNA, 21 bp, Homo sapiens
tccagacatcatgaattttac

SEQ ID NO: 4101032 - DNA, 17 bp, Homo sapiens
tccagacccctggcttt

SEQ ID NO: 4101033 - DNA, 21 bp, Homo sapiens
tccagacctggctccactctt

SEQ ID NO: 4101034 - DNA, 19 bp, Homo sapiens
tccagacttccttgagaca

SEQ ID NO: 4101035 - DNA, 17 bp, Homo sapiens
tccagagaaacccaggg

SEQ ID NO: 4101036 - DNA, 17 bp, Homo sapiens
tccagagagcagctccc

SEQ ID NO: 4101037 - DNA, 22 bp, Homo sapiens
tccagagagtggctcctcccgg

SEQ ID NO: 4101038 - DNA, 12 bp, Homo sapiens
tccagagcattc

SEQ ID NO: 4101039 - DNA, 13 bp, Homo sapiens
tccagagctgcca

SEQ ID NO: 4101040 - DNA, 15 bp, Homo sapiens
tccagagctgcttcc

SEQ ID NO: 4101041 - DNA, 13 bp, Homo sapiens
tccagagcttgtg

SEQ ID NO: 4101042 - DNA, 18 bp, Homo sapiens
tccagagcttgtgctcct

SEQ ID NO: 4101043 - DNA, 14 bp, Homo sapiens
tccagaggtcctcc

SEQ ID NO: 4101044 - DNA, 16 bp, Homo sapiens
tccagagtgctgaggc

SEQ ID NO: 4101045 - DNA, 14 bp, Homo sapiens
tccagatagagaaa

SEQ ID NO: 4101046 - DNA, 16 bp, Homo sapiens
tccagatgcagggcag

SEQ ID NO: 4101047 - DNA, 17 bp, Homo sapiens
tccagatgcagggcagt

SEQ ID NO: 4101048 - DNA, 18 bp, Homo sapiens
tccagatgtttccagact

SEQ ID NO: 4101049 - DNA, 22 bp, Homo sapiens
tccagattattggctgctttgc

SEQ ID NO: 4101050 - DNA, 13 bp, Homo sapiens
tccagcaataaga

SEQ ID NO: 4101051 - DNA, 19 bp, Homo sapiens
tccagcaataagaaatgaa

SEQ ID NO: 4101052 - DNA, 23 bp, Homo sapiens
tccagcaataagaaatgaacaaa

SEQ ID NO: 4101053 - DNA, 19 bp, Homo sapiens
tccagcagtgttgctcagc

SEQ ID NO: 4101054 - DNA, 14 bp, Homo sapiens
tccagcagttttca

SEQ ID NO: 4101055 - DNA, 23 bp, Homo sapiens
tccagccagcaatgatgtccaga

SEQ ID NO: 4101056 - DNA, 15 bp, Homo sapiens
tccagcccacattgg

SEQ ID NO: 4101057 - DNA, 13 bp, Homo sapiens
tccagcccatcca

SEQ ID NO: 4101058 - DNA, 16 bp, Homo sapiens
tccagcccctgtccca

SEQ ID NO: 4101059 - DNA, 19 bp, Homo sapiens
tccagccgccattgccacc

SEQ ID NO: 4101060 - DNA, 21 bp, Homo sapiens
tccagccgccattgccaccag

SEQ ID NO: 4101061 - DNA, 22 bp, Homo sapiens
tccagccgccattgccaccagg

SEQ ID NO: 4101062 - DNA, 23 bp, Homo sapiens
tccagccgccattgccaccagga

SEQ ID NO: 4101063 - DNA, 20 bp, Homo sapiens
tccagcctccctgtctccag

SEQ ID NO: 4101064 - DNA, 21 bp, Homo sapiens
tccagcctccctgtctccagc

SEQ ID NO: 4101065 - DNA, 12 bp, Homo sapiens
tccagcctgggc

SEQ ID NO: 4101066 - DNA, 13 bp, Homo sapiens
tccagcctgggca

SEQ ID NO: 4101067 - DNA, 22 bp, Homo sapiens
tcagactccgccctcctcgggc

SEQ ID NO: 4101068 - DNA, 15 bp, Homo sapiens
tcagacttaccagga

SEQ ID NO: 4101069 - DNA, 16 bp, Homo sapiens
tcagactttaaagaat

SEQ ID NO: 4101070 - DNA, 17 bp, Homo sapiens
tcagactttaaagaata

SEQ ID NO: 4101071 - DNA, 20 bp, Homo sapiens
tcagagaaggaaaagactga

SEQ ID NO: 4101072 - DNA, 23 bp, Homo sapiens
tcagagacaggaagtcttcaggg

SEQ ID NO: 4101073 - DNA, 22 bp, Homo sapiens
tcagagactgcaagctgcttgc

SEQ ID NO: 4101074 - DNA, 22 bp, Homo sapiens
tcagagagcgagcgctacccac

SEQ ID NO: 4101075 - DNA, 18 bp, Homo sapiens
tcagagatttatataaat

SEQ ID NO: 4101076 - DNA, 19 bp, Homo sapiens
tcagagatttatataaatg

SEQ ID NO: 4101077 - DNA, 14 bp, Homo sapiens
tcagagcaggggtc

SEQ ID NO: 4101078 - DNA, 15 bp, Homo sapiens
tcagagcatgtgtca

SEQ ID NO: 4101079 - DNA, 17 bp, Homo sapiens
tcagagcatgtgtcaga

SEQ ID NO: 4101080 - DNA, 22 bp, Homo sapiens
tcagagccaagccttaaactgt

SEQ ID NO: 4101081 - DNA, 23 bp, Homo sapiens
tcagagccaagccttaaactgta

SEQ ID NO: 4101082 - DNA, 18 bp, Homo sapiens
tcagagccaagtcctccc

SEQ ID NO: 4101083 - DNA, 15 bp, Homo sapiens
tcagagccctggctg

SEQ ID NO: 4101084 - DNA, 19 bp, Homo sapiens
tcagagccctggctgggtt

SEQ ID NO: 4101085 - DNA, 20 bp, Homo sapiens
tcagagccctggctgggttc

SEQ ID NO: 4101086 - DNA, 19 bp, Homo sapiens
tcagagcgccaggaagcca

SEQ ID NO: 4101087 - DNA, 20 bp, Homo sapiens
tcagagcgccaggaagccag

SEQ ID NO: 4101088 - DNA, 22 bp, Homo sapiens
tcagagctaaactccttcctgg

SEQ ID NO: 4101089 - DNA, 23 bp, Homo sapiens
tcagagctaagggtgggtgctca

SEQ ID NO: 4101090 - DNA, 14 bp, Homo sapiens
tcagagcttgaaga

SEQ ID NO: 4101091 - DNA, 16 bp, Homo sapiens
tcagagcttgaagatt

SEQ ID NO: 4101092 - DNA, 18 bp, Homo sapiens
tcagaggcacaaaagggt

SEQ ID NO: 4101093 - DNA, 20 bp, Homo sapiens
tcagaggcagcttcaagtgc

SEQ ID NO: 4101094 - DNA, 22 bp, Homo sapiens
tcagaggcagcttcaagtgcct

SEQ ID NO: 4101095 - DNA, 16 bp, Homo sapiens
tcagaggcgcactgtg

SEQ ID NO: 4101096 - DNA, 15 bp, Homo sapiens
tcagaggctcagaga

SEQ ID NO: 4101097 - DNA, 21 bp, Homo sapiens
tcagagggaaagtaaatattt

SEQ ID NO: 4101098 - DNA, 20 bp, Homo sapiens
tcagaggtgtacactaacat

SEQ ID NO: 4101099 - DNA, 13 bp, Homo sapiens
tcagagtagaaat

SEQ ID NO: 4101100 - DNA, 14 bp, Homo sapiens
tcagagtagaaata

SEQ ID NO: 4101101 - DNA, 15 bp, Homo sapiens
tcagagtagaaataa

SEQ ID NO: 4101102 - DNA, 19 bp, Homo sapiens
tcagagtccagtgctctgc

SEQ ID NO: 4101103 - DNA, 20 bp, Homo sapiens
tcagagtccagtgctctgcc

SEQ ID NO: 4101104 - DNA, 16 bp, Homo sapiens
tcagagtgaagaatct

SEQ ID NO: 4101105 - DNA, 14 bp, Homo sapiens
tcagatacatcact

SEQ ID NO: 4101106 - DNA, 16 bp, Homo sapiens
tcagatatatttttca

SEQ ID NO: 4101107 - DNA, 13 bp, Homo sapiens
tcagatatttata

SEQ ID NO: 4101108 - DNA, 21 bp, Homo sapiens
tcagatattttttcagaaata

SEQ ID NO: 4101109 - DNA, 15 bp, Homo sapiens
tcagatccagggaca

SEQ ID NO: 4101110 - DNA, 14 bp, Homo sapiens
tcagatctgtctga

SEQ ID NO: 4101111 - DNA, 18 bp, Homo sapiens
tcagatgagcaaggacat

SEQ ID NO: 4101112 - DNA, 22 bp, Homo sapiens
tcagatgagcaaggacattgcc

SEQ ID NO: 4101113 - DNA, 23 bp, Homo sapiens
tcagatgagcaaggacattgccc

SEQ ID NO: 4101114 - DNA, 14 bp, Homo sapiens
tcagatgcttctgg

SEQ ID NO: 4101115 - DNA, 19 bp, Homo sapiens
tcagatggaaatattttga

SEQ ID NO: 4101116 - DNA, 16 bp, Homo sapiens
tcagatggactgggag

SEQ ID NO: 4101117 - DNA, 13 bp, Homo sapiens
tcagatggaggtt

SEQ ID NO: 4101118 - DNA, 17 bp, Homo sapiens
tcagatggctgaggcag

SEQ ID NO: 4101119 - DNA, 19 bp, Homo sapiens
tcagattgtcttgcaactt

SEQ ID NO: 4101120 - DNA, 19 bp, Homo sapiens
tcagatttctggttgttat

SEQ ID NO: 4101121 - DNA, 21 bp, Homo sapiens
tcagatttgaactcttcaatc

SEQ ID NO: 4101122 - DNA, 21 bp, Homo sapiens
tcagattttaaaaagtcttca

SEQ ID NO: 4101123 - DNA, 22 bp, Homo sapiens
tcagcaaaccatttttaaagta

SEQ ID NO: 4101124 - DNA, 12 bp, Homo sapiens
tcagcaagagaa

SEQ ID NO: 4101125 - DNA, 21 bp, Homo sapiens
tcagcaagccctacagagctg

SEQ ID NO: 4101126 - DNA, 19 bp, Homo sapiens
tcagcaatttaactagaca

SEQ ID NO: 4101127 - DNA, 19 bp, Homo sapiens
tcagcacaaggccatctgg

SEQ ID NO: 4101128 - DNA, 21 bp, Homo sapiens
tcagcacatagggttcccacg

SEQ ID NO: 4101129 - DNA, 24 bp, Homo sapiens
tcagcacatagggttcccacgaag

SEQ ID NO: 4101130 - DNA, 15 bp, Homo sapiens
tcagcaccaccctag

SEQ ID NO: 4101131 - DNA, 19 bp, Homo sapiens
tcagcacccccacccacct

SEQ ID NO: 4101132 - DNA, 20 bp, Homo sapiens
tcagcactgatttcacaaca

SEQ ID NO: 4101133 - DNA, 21 bp, Homo sapiens
tcagcactgtcccttgcctca

SEQ ID NO: 4101134 - DNA, 12 bp, Homo sapiens
tcagcaggcagc

SEQ ID NO: 4101135 - DNA, 13 bp, Homo sapiens
tcagcagtgacca

SEQ ID NO: 4101136 - DNA, 15 bp, Homo sapiens
tcagcatgcttccca

SEQ ID NO: 4101137 - DNA, 21 bp, Homo sapiens
tcagcatgcttcccagaggga

SEQ ID NO: 4101138 - DNA, 20 bp, Homo sapiens
tcagcattctcactcctacc

SEQ ID NO: 4101139 - DNA, 23 bp, Homo sapiens
tcagcattctcactcctacctgg

SEQ ID NO: 4101140 - DNA, 20 bp, Homo sapiens
tcagcatttccttccagccc

SEQ ID NO: 4101141 - DNA, 19 bp, Homo sapiens
tcagcatttccttgtcccg

SEQ ID NO: 4101142 - DNA, 13 bp, Homo sapiens
tcagcatttcttt

SEQ ID NO: 4101143 - DNA, 19 bp, Homo sapiens
tcagcatttcttttctggc

SEQ ID NO: 4101144 - DNA, 22 bp, Homo sapiens
tcagcatttcttttctggccaa

SEQ ID NO: 4101145 - DNA, 16 bp, Homo sapiens
tcagccaaatgcaggg

SEQ ID NO: 4101146 - DNA, 16 bp, Homo sapiens
tcagccaaatgtaatt

SEQ ID NO: 4101147 - DNA, 22 bp, Homo sapiens
tcagccaaatgtaattgaataa

SEQ ID NO: 4101148 - DNA, 19 bp, Homo sapiens
tcagcccaatccctgatcc

SEQ ID NO: 4101149 - DNA, 13 bp, Homo sapiens
tcagcccccagcc

SEQ ID NO: 4101150 - DNA, 19 bp, Homo sapiens
tcagccccgagctgtcccc

SEQ ID NO: 4101151 - DNA, 13 bp, Homo sapiens
tcagccctcagtt

SEQ ID NO: 4101152 - DNA, 13 bp, Homo sapiens
tcagccctccctg

SEQ ID NO: 4101153 - DNA, 15 bp, Homo sapiens
tcagccctccctgcc

SEQ ID NO: 4101154 - DNA, 22 bp, Homo sapiens
tcagccgagccgggcctggggc

SEQ ID NO: 4101155 - DNA, 14 bp, Homo sapiens
tcagcctcagagga

SEQ ID NO: 4101156 - DNA, 13 bp, Homo sapiens
tcagcctcctgag

SEQ ID NO: 4101157 - DNA, 22 bp, Homo sapiens
tcagcctcctgagcctgtgggt

SEQ ID NO: 4101158 - DNA, 15 bp, Homo sapiens
tcagcctgagtctcc

SEQ ID NO: 4101159 - DNA, 16 bp, Homo sapiens
tcagcctgagtctcct

SEQ ID NO: 4101160 - DNA, 19 bp, Homo sapiens
tcagcctgagtctcctgtg

SEQ ID NO: 4101161 - DNA, 12 bp, Homo sapiens
tcagcctggcca

SEQ ID NO: 4101162 - DNA, 16 bp, Homo sapiens
tcagcctggccagaca

SEQ ID NO: 4101163 - DNA, 19 bp, Homo sapiens
tcagcctggccagacacag

SEQ ID NO: 4101164 - DNA, 16 bp, Homo sapiens
tcagcctggcctgccc

SEQ ID NO: 4101165 - DNA, 21 bp, Homo sapiens
tcagcctggcctgcccgtgcc

SEQ ID NO: 4101166 - DNA, 15 bp, Homo sapiens
tcagccttacatttg

SEQ ID NO: 4101167 - DNA, 16 bp, Homo sapiens
tcagccttacatttgt

SEQ ID NO: 4101168 - DNA, 18 bp, Homo sapiens
tcagcggggcgagctgag

SEQ ID NO: 4101169 - DNA, 17 bp, Homo sapiens
tcactctaaaaaacatt

SEQ ID NO: 4101170 - DNA, 20 bp, Homo sapiens
tcactctacttagcatgtcc

SEQ ID NO: 4101171 - DNA, 14 bp, Homo sapiens
tcactctggcctca

SEQ ID NO: 4101172 - DNA, 13 bp, Homo sapiens
tcactctgggctg

SEQ ID NO: 4101173 - DNA, 18 bp, Homo sapiens
tcactctgtcagccagcc

SEQ ID NO: 4101174 - DNA, 18 bp, Homo sapiens
tcactctgtgcctttcta

SEQ ID NO: 4101175 - DNA, 14 bp, Homo sapiens
tcactgaaacatgg

SEQ ID NO: 4101176 - DNA, 23 bp, Homo sapiens
tcactgaacaaactaaaggtgca

SEQ ID NO: 4101177 - DNA, 16 bp, Homo sapiens
tcactgaaggacctga

SEQ ID NO: 4101178 - DNA, 19 bp, Homo sapiens
tcactgaaggacctgagct

SEQ ID NO: 4101179 - DNA, 20 bp, Homo sapiens
tcactgaaggacctgagctg

SEQ ID NO: 4101180 - DNA, 20 bp, Homo sapiens
tcactgaccctaactgcaga

SEQ ID NO: 4101181 - DNA, 15 bp, Homo sapiens
tcactgactctgact

SEQ ID NO: 4101182 - DNA, 14 bp, Homo sapiens
tcactgagctcccc

SEQ ID NO: 4101183 - DNA, 17 bp, Homo sapiens
tcactgcaacctctgcc

SEQ ID NO: 4101184 - DNA, 18 bp, Homo sapiens
tcactgcaagctctgcct

SEQ ID NO: 4101185 - DNA, 15 bp, Homo sapiens
tcactgcacagtgca

SEQ ID NO: 4101186 - DNA, 20 bp, Homo sapiens
tcactgcacagtgcatctca

SEQ ID NO: 4101187 - DNA, 14 bp, Homo sapiens
tcactgcagcctca

SEQ ID NO: 4101188 - DNA, 18 bp, Homo sapiens
tcactgcattattctctt

SEQ ID NO: 4101189 - DNA, 15 bp, Homo sapiens
tcactgccaggccag

SEQ ID NO: 4101190 - DNA, 19 bp, Homo sapiens
tcactgccaggccagcctc

SEQ ID NO: 4101191 - DNA, 15 bp, Homo sapiens
tcactgcttgatgaa

SEQ ID NO: 4101192 - DNA, 23 bp, Homo sapiens
tcactggaaaggggagagcctgc

SEQ ID NO: 4101193 - DNA, 21 bp, Homo sapiens
tcactggagttacattaatgt

SEQ ID NO: 4101194 - DNA, 19 bp, Homo sapiens
tcactggatgaagattctc

SEQ ID NO: 4101195 - DNA, 13 bp, Homo sapiens
tcactggctggct

SEQ ID NO: 4101196 - DNA, 18 bp, Homo sapiens
tcactggctggctcctag

SEQ ID NO: 4101197 - DNA, 20 bp, Homo sapiens
tcactgggtggggtgaggac

SEQ ID NO: 4101198 - DNA, 18 bp, Homo sapiens
tcactgtataaacttttt

SEQ ID NO: 4101199 - DNA, 14 bp, Homo sapiens
tcactgtataaata

SEQ ID NO: 4101200 - DNA, 18 bp, Homo sapiens
tcactgtatagacatgct

SEQ ID NO: 4101201 - DNA, 14 bp, Homo sapiens
tcactgtctgtctg

SEQ ID NO: 4101202 - DNA, 19 bp, Homo sapiens
tcactgtctttaattctgt

SEQ ID NO: 4101203 - DNA, 16 bp, Homo sapiens
tcactgttccctctgc

SEQ ID NO: 4101204 - DNA, 18 bp, Homo sapiens
tcactgttccctctgctc

SEQ ID NO: 4101205 - DNA, 22 bp, Homo sapiens
tcactgttccctctgctcctgg

SEQ ID NO: 4101206 - DNA, 14 bp, Homo sapiens
tcactgttctgcaa

SEQ ID NO: 4101207 - DNA, 17 bp, Homo sapiens
tcactgtttctctgctg

SEQ ID NO: 4101208 - DNA, 18 bp, Homo sapiens
tcactgtttctctgctgt

SEQ ID NO: 4101209 - DNA, 13 bp, Homo sapiens
tcacttactattg

SEQ ID NO: 4101210 - DNA, 19 bp, Homo sapiens
tcacttagaacctttctgt

SEQ ID NO: 4101211 - DNA, 21 bp, Homo sapiens
tcacttagaacctttctgtgt

SEQ ID NO: 4101212 - DNA, 15 bp, Homo sapiens
tcacttagcagcaac

SEQ ID NO: 4101213 - DNA, 17 bp, Homo sapiens
tcacttagtcctttatc

SEQ ID NO: 4101214 - DNA, 14 bp, Homo sapiens
tcacttcaccatca

SEQ ID NO: 4101215 - DNA, 18 bp, Homo sapiens
tcacttccatacagctct

SEQ ID NO: 4101216 - DNA, 19 bp, Homo sapiens
tcacttccatacagctcta

SEQ ID NO: 4101217 - DNA, 19 bp, Homo sapiens
tcacttcccgagcgctggt

SEQ ID NO: 4101218 - DNA, 17 bp, Homo sapiens
tcacttcctacaagagc

SEQ ID NO: 4101219 - DNA, 16 bp, Homo sapiens
tcacttctaaatgcat

SEQ ID NO: 4101220 - DNA, 13 bp, Homo sapiens
tcacttcttctgt

SEQ ID NO: 4101221 - DNA, 21 bp, Homo sapiens
tcacttcttctgtccaagcag

SEQ ID NO: 4101222 - DNA, 18 bp, Homo sapiens
tcacttgatgtgccattt

SEQ ID NO: 4101223 - DNA, 17 bp, Homo sapiens
tcacttgcactggggga

SEQ ID NO: 4101224 - DNA, 13 bp, Homo sapiens
tcacttgtgcttt

SEQ ID NO: 4101225 - DNA, 16 bp, Homo sapiens
tcacttgtgctttgct

SEQ ID NO: 4101226 - DNA, 13 bp, Homo sapiens
tcactttaaacct

SEQ ID NO: 4101227 - DNA, 18 bp, Homo sapiens
tcactttcacatagatgt

SEQ ID NO: 4101228 - DNA, 17 bp, Homo sapiens
tcactttgctctgggtg

SEQ ID NO: 4101229 - DNA, 17 bp, Homo sapiens
tcacttttgttctgctt

SEQ ID NO: 4101230 - DNA, 18 bp, Homo sapiens
tcagaaaactttaaaaaa

SEQ ID NO: 4101231 - DNA, 22 bp, Homo sapiens
tcagaaaactttaaaaaatatt

SEQ ID NO: 4101232 - DNA, 20 bp, Homo sapiens
tcagaaaatattatgtgttt

SEQ ID NO: 4101233 - DNA, 16 bp, Homo sapiens
tcagaaacttgtgaag

SEQ ID NO: 4101234 - DNA, 17 bp, Homo sapiens
tcagaaatttttatcag

SEQ ID NO: 4101235 - DNA, 16 bp, Homo sapiens
tcagaacctcttcccc

SEQ ID NO: 4101236 - DNA, 20 bp, Homo sapiens
tcagaacctcttccccagaa

SEQ ID NO: 4101237 - DNA, 18 bp, Homo sapiens
tcagaacttgctgctgtc

SEQ ID NO: 4101238 - DNA, 19 bp, Homo sapiens
tcagaacttgctgctgtct

SEQ ID NO: 4101239 - DNA, 14 bp, Homo sapiens
tcagaagataactt

SEQ ID NO: 4101240 - DNA, 17 bp, Homo sapiens
tcagaagcaagccagac

SEQ ID NO: 4101241 - DNA, 20 bp, Homo sapiens
tcagaagcacagaatatttt

SEQ ID NO: 4101242 - DNA, 22 bp, Homo sapiens
tcagaagcctccaagcctgcct

SEQ ID NO: 4101243 - DNA, 22 bp, Homo sapiens
tcagaataaattaatattgtat

SEQ ID NO: 4101244 - DNA, 15 bp, Homo sapiens
tcagaataaggcagg

SEQ ID NO: 4101245 - DNA, 21 bp, Homo sapiens
tcagaataaggcaggcattga

SEQ ID NO: 4101246 - DNA, 22 bp, Homo sapiens
tcagaatagccacatttggaat

SEQ ID NO: 4101247 - DNA, 23 bp, Homo sapiens
tcagaatagccacatttggaata

SEQ ID NO: 4101248 - DNA, 18 bp, Homo sapiens
tcagaatattgtctgcct

SEQ ID NO: 4101249 - DNA, 18 bp, Homo sapiens
tcagaatgtaaaagaact

SEQ ID NO: 4101250 - DNA, 20 bp, Homo sapiens
tcagaattaaacttttaatt

SEQ ID NO: 4101251 - DNA, 23 bp, Homo sapiens
tcagaattaaacttttaattcat

SEQ ID NO: 4101252 - DNA, 20 bp, Homo sapiens
tcagaattatttttaaaaag

SEQ ID NO: 4101253 - DNA, 12 bp, Homo sapiens
tcagaattctca

SEQ ID NO: 4101254 - DNA, 20 bp, Homo sapiens
tcagaattctcagaatctca

SEQ ID NO: 4101255 - DNA, 21 bp, Homo sapiens
tcagaattgatcattttcccc

SEQ ID NO: 4101256 - DNA, 20 bp, Homo sapiens
tcagacaagtgttttggaaa

SEQ ID NO: 4101257 - DNA, 17 bp, Homo sapiens
tcagacaccctcaacct

SEQ ID NO: 4101258 - DNA, 20 bp, Homo sapiens
tcagacacctgttcacagaa

SEQ ID NO: 4101259 - DNA, 15 bp, Homo sapiens
tcagacagaacttga

SEQ ID NO: 4101260 - DNA, 22 bp, Homo sapiens
tcagacagggtctgaaggactg

SEQ ID NO: 4101261 - DNA, 14 bp, Homo sapiens
tcagacatgttttc

SEQ ID NO: 4101262 - DNA, 18 bp, Homo sapiens
tcagacctgtcttccaag

SEQ ID NO: 4101263 - DNA, 14 bp, Homo sapiens
tcagacggcggcca

SEQ ID NO: 4101264 - DNA, 15 bp, Homo sapiens
tcagacggcggccag

SEQ ID NO: 4101265 - DNA, 21 bp, Homo sapiens
tcagacggcggccaggcacag

SEQ ID NO: 4101266 - DNA, 22 bp, Homo sapiens
tcagacggcggccaggcacagg

SEQ ID NO: 4101267 - DNA, 23 bp, Homo sapiens
tcagacggcggccaggcacaggg

SEQ ID NO: 4101268 - DNA, 21 bp, Homo sapiens
tcagactaagaaatattccaa

SEQ ID NO: 4101269 - DNA, 21 bp, Homo sapiens
tcagactcaagtacccattct

SEQ ID NO: 4101270 - DNA, 22 bp, Homo sapiens
tcagactcccattcctgaagaa

SEQ ID NO: 4101271 - DNA, 21 bp, Homo sapiens
tcacagtctctttaatcttca

SEQ ID NO: 4101272 - DNA, 15 bp, Homo sapiens
tcacagtctggtgct

SEQ ID NO: 4101273 - DNA, 11 bp, Homo sapiens
tcacagtgttt

SEQ ID NO: 4101274 - DNA, 14 bp, Homo sapiens
tcacagtgtttgca

SEQ ID NO: 4101275 - DNA, 16 bp, Homo sapiens
tcacatagatgtccct

SEQ ID NO: 4101276 - DNA, 13 bp, Homo sapiens
tcacatcagataa

SEQ ID NO: 4101277 - DNA, 18 bp, Homo sapiens
tcacatcagataagacat

SEQ ID NO: 4101278 - DNA, 14 bp, Homo sapiens
tcacatccatccct

SEQ ID NO: 4101279 - DNA, 13 bp, Homo sapiens
tcacatctcacct

SEQ ID NO: 4101280 - DNA, 14 bp, Homo sapiens
tcacatctcacctc

SEQ ID NO: 4101281 - DNA, 15 bp, Homo sapiens
tcacatctcacctcc

SEQ ID NO: 4101282 - DNA, 18 bp, Homo sapiens
tcacatctcacctccgaa

SEQ ID NO: 4101283 - DNA, 13 bp, Homo sapiens
tcacatgacctga

SEQ ID NO: 4101284 - DNA, 20 bp, Homo sapiens
tcacatgacctgatcactag

SEQ ID NO: 4101285 - DNA, 15 bp, Homo sapiens
tcacattatttgcat

SEQ ID NO: 4101286 - DNA, 23 bp, Homo sapiens
tcacattgagctgatataaattc

SEQ ID NO: 4101287 - DNA, 16 bp, Homo sapiens
tcacattgcattctat

SEQ ID NO: 4101288 - DNA, 16 bp, Homo sapiens
tcacattgttaagaaa

SEQ ID NO: 4101289 - DNA, 18 bp, Homo sapiens
tcacattgttaagaaaaa

SEQ ID NO: 4101290 - DNA, 11 bp, Homo sapiens
tcacattgttt

SEQ ID NO: 4101291 - DNA, 19 bp, Homo sapiens
tcacattgtttgctgctat

SEQ ID NO: 4101292 - DNA, 20 bp, Homo sapiens
tcaccaaatcagctgctact

SEQ ID NO: 4101293 - DNA, 21 bp, Homo sapiens
tcaccaaatcagctgctacta

SEQ ID NO: 4101294 - DNA, 14 bp, Homo sapiens
tcaccaagcagtgg

SEQ ID NO: 4101295 - DNA, 21 bp, Homo sapiens
tcaccacttcaatagatcaaa

SEQ ID NO: 4101296 - DNA, 20 bp, Homo sapiens
tcaccagagcccatgctcaa

SEQ ID NO: 4101297 - DNA, 19 bp, Homo sapiens
tcaccagctatctgtcatc

SEQ ID NO: 4101298 - DNA, 17 bp, Homo sapiens
tcaccaggacttggggt

SEQ ID NO: 4101299 - DNA, 20 bp, Homo sapiens
tcaccaggacttggggtcag

SEQ ID NO: 4101300 - DNA, 18 bp, Homo sapiens
tcaccaggtgcatgcatg

SEQ ID NO: 4101301 - DNA, 13 bp, Homo sapiens
tcaccagtgtccc

SEQ ID NO: 4101302 - DNA, 15 bp, Homo sapiens
tcaccatgtaagcac

SEQ ID NO: 4101303 - DNA, 17 bp, Homo sapiens
tcaccatgtaagcactc

SEQ ID NO: 4101304 - DNA, 22 bp, Homo sapiens
tcaccattgtgaagcacctact

SEQ ID NO: 4101305 - DNA, 13 bp, Homo sapiens
tcacccacctctt

SEQ ID NO: 4101306 - DNA, 21 bp, Homo sapiens
tcacccagctaatctgtaggg

SEQ ID NO: 4101307 - DNA, 18 bp, Homo sapiens
tcacccagtcacctcccc

SEQ ID NO: 4101308 - DNA, 23 bp, Homo sapiens
tcacccagtcacctccccacatc

SEQ ID NO: 4101309 - DNA, 13 bp, Homo sapiens
tcacccccactcc

SEQ ID NO: 4101310 - DNA, 15 bp, Homo sapiens
tcacccctgggcagg

SEQ ID NO: 4101311 - DNA, 21 bp, Homo sapiens
tcacccgatcgccagcaaaac

SEQ ID NO: 4101312 - DNA, 13 bp, Homo sapiens
tcacccggcctct

SEQ ID NO: 4101313 - DNA, 22 bp, Homo sapiens
tcacccggcctcttcgcctttc

SEQ ID NO: 4101314 - DNA, 20 bp, Homo sapiens
tcaccctccacctcttcacc

SEQ ID NO: 4101315 - DNA, 20 bp, Homo sapiens
tcaccctgcattacatgtgt

SEQ ID NO: 4101316 - DNA, 13 bp, Homo sapiens
tcaccctgggagc

SEQ ID NO: 4101317 - DNA, 18 bp, Homo sapiens
tcaccctttgccttagca

SEQ ID NO: 4101318 - DNA, 13 bp, Homo sapiens
tcaccgcccatca

SEQ ID NO: 4101319 - DNA, 15 bp, Homo sapiens
tcaccggtcagtgcc

SEQ ID NO: 4101320 - DNA, 17 bp, Homo sapiens
tcaccggtcagtgcctt

SEQ ID NO: 4101321 - DNA, 15 bp, Homo sapiens
tcacctagaaattga

SEQ ID NO: 4101322 - DNA, 20 bp, Homo sapiens
tcacctcatgcccaccccct

SEQ ID NO: 4101323 - DNA, 22 bp, Homo sapiens
tcacctccccacatcgcacact

SEQ ID NO: 4101324 - DNA, 12 bp, Homo sapiens
tcacctcctcta

SEQ ID NO: 4101325 - DNA, 22 bp, Homo sapiens
tcacctcctctaaggttgggca

SEQ ID NO: 4101326 - DNA, 13 bp, Homo sapiens
tcacctctctcag

SEQ ID NO: 4101327 - DNA, 16 bp, Homo sapiens
tcacctctctcagagc

SEQ ID NO: 4101328 - DNA, 19 bp, Homo sapiens
tcacctctggactggctag

SEQ ID NO: 4101329 - DNA, 13 bp, Homo sapiens
tcacctctgttaa

SEQ ID NO: 4101330 - DNA, 13 bp, Homo sapiens
tcacctgctccag

SEQ ID NO: 4101331 - DNA, 13 bp, Homo sapiens
tcacctgcttctc

SEQ ID NO: 4101332 - DNA, 23 bp, Homo sapiens
tcacctgcttctctgcccagctt

SEQ ID NO: 4101333 - DNA, 16 bp, Homo sapiens
tcacctggctgagcag

SEQ ID NO: 4101334 - DNA, 17 bp, Homo sapiens
tcacctggctgagcagt

SEQ ID NO: 4101335 - DNA, 19 bp, Homo sapiens
tcacctggctgagcagttc

SEQ ID NO: 4101336 - DNA, 17 bp, Homo sapiens
tcacctgttatgtatga

SEQ ID NO: 4101337 - DNA, 21 bp, Homo sapiens
tcacctgtttttaagctgttt

SEQ ID NO: 4101338 - DNA, 15 bp, Homo sapiens
tcaccttcctgtggg

SEQ ID NO: 4101339 - DNA, 18 bp, Homo sapiens
tcaccttggcaccagaca

SEQ ID NO: 4101340 - DNA, 13 bp, Homo sapiens
tcacgacgctgca

SEQ ID NO: 4101341 - DNA, 15 bp, Homo sapiens
tcacgcaacttgaaa

SEQ ID NO: 4101342 - DNA, 18 bp, Homo sapiens
tcacgcaggctgagtcca

SEQ ID NO: 4101343 - DNA, 20 bp, Homo sapiens
tcacgctcacccagtcacct

SEQ ID NO: 4101344 - DNA, 22 bp, Homo sapiens
tcacgctcacccagtcacctcc

SEQ ID NO: 4101345 - DNA, 17 bp, Homo sapiens
tcacgctggggctctct

SEQ ID NO: 4101346 - DNA, 18 bp, Homo sapiens
tcacgctggggctctctg

SEQ ID NO: 4101347 - DNA, 23 bp, Homo sapiens
tcacgctggggctctctgagact

SEQ ID NO: 4101348 - DNA, 22 bp, Homo sapiens
tcacgggagatttcttgttgct

SEQ ID NO: 4101349 - DNA, 13 bp, Homo sapiens
tcacggggcctcc

SEQ ID NO: 4101350 - DNA, 14 bp, Homo sapiens
tcacggggcctcca

SEQ ID NO: 4101351 - DNA, 17 bp, Homo sapiens
tcacggggcctccaacc

SEQ ID NO: 4101352 - DNA, 20 bp, Homo sapiens
tcacggggttccctcctagc

SEQ ID NO: 4101353 - DNA, 17 bp, Homo sapiens
tcacgtaagatacaagt

SEQ ID NO: 4101354 - DNA, 18 bp, Homo sapiens
tcacgtaccccactgggc

SEQ ID NO: 4101355 - DNA, 21 bp, Homo sapiens
tcacgtaccccactgggccag

SEQ ID NO: 4101356 - DNA, 19 bp, Homo sapiens
tcactacaagtcagctcca

SEQ ID NO: 4101357 - DNA, 19 bp, Homo sapiens
tcactactcacagtctctt

SEQ ID NO: 4101358 - DNA, 16 bp, Homo sapiens
tcactagaagaaaagc

SEQ ID NO: 4101359 - DNA, 17 bp, Homo sapiens
tcactagaatggataaa

SEQ ID NO: 4101360 - DNA, 14 bp, Homo sapiens
tcactaggtaactt

SEQ ID NO: 4101361 - DNA, 17 bp, Homo sapiens
tcactaggtaacttatt

SEQ ID NO: 4101362 - DNA, 14 bp, Homo sapiens
tcactatgacactg

SEQ ID NO: 4101363 - DNA, 15 bp, Homo sapiens
tcactatgacactga

SEQ ID NO: 4101364 - DNA, 22 bp, Homo sapiens
tcactatggtatgctggccagc

SEQ ID NO: 4101365 - DNA, 21 bp, Homo sapiens
tcactattcttggaccatgcc

SEQ ID NO: 4101366 - DNA, 15 bp, Homo sapiens
tcactcattgctgag

SEQ ID NO: 4101367 - DNA, 18 bp, Homo sapiens
tcactcattgctgagcct

SEQ ID NO: 4101368 - DNA, 14 bp, Homo sapiens
tcactccacagagt

SEQ ID NO: 4101369 - DNA, 14 bp, Homo sapiens
tcactcccagtcca

SEQ ID NO: 4101370 - DNA, 17 bp, Homo sapiens
tcactccccagggagct

SEQ ID NO: 4101371 - DNA, 20 bp, Homo sapiens
tcactccccagggagctctg

SEQ ID NO: 4101372 - DNA, 11 bp, Homo sapiens
tcactcctggg

SEQ ID NO: 4101373 - DNA, 20 bp, Homo sapiens
tcactcctggggcctcttgg

SEQ ID NO: 4101374 - DNA, 10 bp, Homo sapiens
tcactcctgt

SEQ ID NO: 4101375 - DNA, 19 bp, Homo sapiens
tcaatagtaaaagataaca

SEQ ID NO: 4101376 - DNA, 17 bp, Homo sapiens
tcaatatattgaacttt

SEQ ID NO: 4101377 - DNA, 20 bp, Homo sapiens
tcaatatattgaacttttgt

SEQ ID NO: 4101378 - DNA, 22 bp, Homo sapiens
tcaatatattgaacttttgtac

SEQ ID NO: 4101379 - DNA, 14 bp, Homo sapiens
tcaatattaaatac

SEQ ID NO: 4101380 - DNA, 15 bp, Homo sapiens
tcaatattaaataca

SEQ ID NO: 4101381 - DNA, 17 bp, Homo sapiens
tcaatattaaatacaga

SEQ ID NO: 4101382 - DNA, 19 bp, Homo sapiens
tcaatattaaatacagaca

SEQ ID NO: 4101383 - DNA, 21 bp, Homo sapiens
tcaatattaaatacagacact

SEQ ID NO: 4101384 - DNA, 17 bp, Homo sapiens
tcaatattcctgaatga

SEQ ID NO: 4101385 - DNA, 18 bp, Homo sapiens
tcaatattcctgaatgaa

SEQ ID NO: 4101386 - DNA, 22 bp, Homo sapiens
tcaatattcctgaatgaaatat

SEQ ID NO: 4101387 - DNA, 18 bp, Homo sapiens
tcaatattgacatttgta

SEQ ID NO: 4101388 - DNA, 19 bp, Homo sapiens
tcaatattgacatttgtag

SEQ ID NO: 4101389 - DNA, 11 bp, Homo sapiens
tcaatatttat

SEQ ID NO: 4101390 - DNA, 13 bp, Homo sapiens
tcaatatttatta

SEQ ID NO: 4101391 - DNA, 13 bp, Homo sapiens
tcaatcatttcta

SEQ ID NO: 4101392 - DNA, 16 bp, Homo sapiens
tcaatcatttctatta

SEQ ID NO: 4101393 - DNA, 13 bp, Homo sapiens
tcaatcatttctc

SEQ ID NO: 4101394 - DNA, 19 bp, Homo sapiens
tcaatcatttctcactgtg

SEQ ID NO: 4101395 - DNA, 20 bp, Homo sapiens
tcaatccaccttcaggcccc

SEQ ID NO: 4101396 - DNA, 21 bp, Homo sapiens
tcaatccagagagcttaaatt

SEQ ID NO: 4101397 - DNA, 14 bp, Homo sapiens
tcaatcctctaagc

SEQ ID NO: 4101398 - DNA, 22 bp, Homo sapiens
tcaatcctgggcaatcagacac

SEQ ID NO: 4101399 - DNA, 17 bp, Homo sapiens
tcaatcctgttaagaga

SEQ ID NO: 4101400 - DNA, 21 bp, Homo sapiens
tcaatctcctctctctttcct

SEQ ID NO: 4101401 - DNA, 11 bp, Homo sapiens
tcaatgaaaaa

SEQ ID NO: 4101402 - DNA, 15 bp, Homo sapiens
tcaatgaatattgaa

SEQ ID NO: 4101403 - DNA, 16 bp, Homo sapiens
tcaatgaggtgtccaa

SEQ ID NO: 4101404 - DNA, 17 bp, Homo sapiens
tcaatgaggtgtccaac

SEQ ID NO: 4101405 - DNA, 23 bp, Homo sapiens
tcaatgagttcttctcaaaaaat

SEQ ID NO: 4101406 - DNA, 22 bp, Homo sapiens
tcaatgcaagagtgattgcagc

SEQ ID NO: 4101407 - DNA, 20 bp, Homo sapiens
tcaatggagaatataaacat

SEQ ID NO: 4101408 - DNA, 23 bp, Homo sapiens
tcaatggcctaaaactggcctga

SEQ ID NO: 4101409 - DNA, 17 bp, Homo sapiens
tcaatgggctcttccaa

SEQ ID NO: 4101410 - DNA, 11 bp, Homo sapiens
tcaatgtcact

SEQ ID NO: 4101411 - DNA, 16 bp, Homo sapiens
tcaatgttcattgtaa

SEQ ID NO: 4101412 - DNA, 18 bp, Homo sapiens
tcaatgttcattgtaatg

SEQ ID NO: 4101413 - DNA, 22 bp, Homo sapiens
tcaatgtttatgcaaggaagga

SEQ ID NO: 4101414 - DNA, 21 bp, Homo sapiens
tcaattaaagtctattcaaaa

SEQ ID NO: 4101415 - DNA, 14 bp, Homo sapiens
tcaattaaatgtag

SEQ ID NO: 4101416 - DNA, 16 bp, Homo sapiens
tcaattaaatgtaggt

SEQ ID NO: 4101417 - DNA, 11 bp, Homo sapiens
tcaattaataa

SEQ ID NO: 4101418 - DNA, 19 bp, Homo sapiens
tcaattagaatagtgttct

SEQ ID NO: 4101419 - DNA, 14 bp, Homo sapiens
tcaattccctctct

SEQ ID NO: 4101420 - DNA, 16 bp, Homo sapiens
tcaattggcagtgact

SEQ ID NO: 4101421 - DNA, 17 bp, Homo sapiens
tcaattggcagtgactt

SEQ ID NO: 4101422 - DNA, 22 bp, Homo sapiens
tcaattggcagtgactttgtat

SEQ ID NO: 4101423 - DNA, 18 bp, Homo sapiens
tcaattgtaaattgaatc

SEQ ID NO: 4101424 - DNA, 15 bp, Homo sapiens
tcaatttaaataacc

SEQ ID NO: 4101425 - DNA, 19 bp, Homo sapiens
tcaatttcaattttgtctg

SEQ ID NO: 4101426 - DNA, 12 bp, Homo sapiens
tcaatttccctc

SEQ ID NO: 4101427 - DNA, 18 bp, Homo sapiens
tcaatttccctcaggttc

SEQ ID NO: 4101428 - DNA, 19 bp, Homo sapiens
tcaatttccctcaggttct

SEQ ID NO: 4101429 - DNA, 20 bp, Homo sapiens
tcaatttgtaattgcttaca

SEQ ID NO: 4101430 - DNA, 13 bp, Homo sapiens
tcaattttaaaga

SEQ ID NO: 4101431 - DNA, 14 bp, Homo sapiens
tcaattttcattaa

SEQ ID NO: 4101432 - DNA, 13 bp, Homo sapiens
tcaattttgactt

SEQ ID NO: 4101433 - DNA, 21 bp, Homo sapiens
tcacaaaaatttgaacactgg

SEQ ID NO: 4101434 - DNA, 23 bp, Homo sapiens
tcacaaaaatttgaacactggct

SEQ ID NO: 4101435 - DNA, 21 bp, Homo sapiens
tcacaaaacctggcacaatgg

SEQ ID NO: 4101436 - DNA, 21 bp, Homo sapiens
tcacaaacttttatactcttt

SEQ ID NO: 4101437 - DNA, 19 bp, Homo sapiens
tcacaaccaccgttacaag

SEQ ID NO: 4101438 - DNA, 14 bp, Homo sapiens
tcacaaccttctgt

SEQ ID NO: 4101439 - DNA, 14 bp, Homo sapiens
tcacaatacagata

SEQ ID NO: 4101440 - DNA, 20 bp, Homo sapiens
tcacacagctagtgaagacc

SEQ ID NO: 4101441 - DNA, 22 bp, Homo sapiens
tcacacatccagacatcatgaa

SEQ ID NO: 4101442 - DNA, 23 bp, Homo sapiens
tcacacattcccccaccagctgc

SEQ ID NO: 4101443 - DNA, 13 bp, Homo sapiens
tcacaccagccat

SEQ ID NO: 4101444 - DNA, 19 bp, Homo sapiens
tcacaccattcattctggt

SEQ ID NO: 4101445 - DNA, 13 bp, Homo sapiens
tcacacccactcc

SEQ ID NO: 4101446 - DNA, 16 bp, Homo sapiens
tcacaccccaggccct

SEQ ID NO: 4101447 - DNA, 20 bp, Homo sapiens
tcacaccccaggcccttcag

SEQ ID NO: 4101448 - DNA, 18 bp, Homo sapiens
tcacactaagagggcaga

SEQ ID NO: 4101449 - DNA, 21 bp, Homo sapiens
tcacactgggtggtggcctgg

SEQ ID NO: 4101450 - DNA, 22 bp, Homo sapiens
tcacactgggtggtggcctggt

SEQ ID NO: 4101451 - DNA, 21 bp, Homo sapiens
tcacactgttactccacagcg

SEQ ID NO: 4101452 - DNA, 23 bp, Homo sapiens
tcacactgttactccacagcgga

SEQ ID NO: 4101453 - DNA, 23 bp, Homo sapiens
tcacacttctgtgagacccccac

SEQ ID NO: 4101454 - DNA, 22 bp, Homo sapiens
tcacactttttatttaattaaa

SEQ ID NO: 4101455 - DNA, 23 bp, Homo sapiens
tcacactttttatttaattaaat

SEQ ID NO: 4101456 - DNA, 19 bp, Homo sapiens
tcacagaaaaagcatgatg

SEQ ID NO: 4101457 - DNA, 23 bp, Homo sapiens
tcacagaaaaagcatgatgggaa

SEQ ID NO: 4101458 - DNA, 17 bp, Homo sapiens
tcacagcagcctccaac

SEQ ID NO: 4101459 - DNA, 19 bp, Homo sapiens
tcacagcctcctctgtctg

SEQ ID NO: 4101460 - DNA, 22 bp, Homo sapiens
tcacagcctcctctgtctgccc

SEQ ID NO: 4101461 - DNA, 11 bp, Homo sapiens
tcacagctcct

SEQ ID NO: 4101462 - DNA, 14 bp, Homo sapiens
tcacagctcctccc

SEQ ID NO: 4101463 - DNA, 12 bp, Homo sapiens
tcacagctggat

SEQ ID NO: 4101464 - DNA, 11 bp, Homo sapiens
tcacaggaggc

SEQ ID NO: 4101465 - DNA, 14 bp, Homo sapiens
tcacaggaggccag

SEQ ID NO: 4101466 - DNA, 15 bp, Homo sapiens
tcacaggaggccagt

SEQ ID NO: 4101467 - DNA, 16 bp, Homo sapiens
tcacaggaggccagtg

SEQ ID NO: 4101468 - DNA, 12 bp, Homo sapiens
tcacagggccaa

SEQ ID NO: 4101469 - DNA, 14 bp, Homo sapiens
tcacagggccaact

SEQ ID NO: 4101470 - DNA, 22 bp, Homo sapiens
tcacagggccaacttgagggcc

SEQ ID NO: 4101471 - DNA, 14 bp, Homo sapiens
tcacagggttgggc

SEQ ID NO: 4101472 - DNA, 17 bp, Homo sapiens
tcacagggttgggccca

SEQ ID NO: 4101473 - DNA, 23 bp, Homo sapiens
tcacagggttgggcccagatctg

SEQ ID NO: 4101474 - DNA, 18 bp, Homo sapiens
tcacagtacagcatgtgc

SEQ ID NO: 4101475 - DNA, 19 bp, Homo sapiens
tcacagtacagcatgtgcc

SEQ ID NO: 4101476 - DNA, 20 bp, Homo sapiens
tcacagtacagcatgtgcct

SEQ ID NO: 4101477 - DNA, 18 bp, Homo sapiens
tcacagtctctttaatct

SEQ ID NO: 4101478 - DNA, 15 bp, Homo sapiens
tcaaatctattcaga

SEQ ID NO: 4101479 - DNA, 17 bp, Homo sapiens
tcaaatctattcagaca

SEQ ID NO: 4101480 - DNA, 18 bp, Homo sapiens
tcaaatctattcagacaa

SEQ ID NO: 4101481 - DNA, 22 bp, Homo sapiens
tcaaatgagtaacatttgctgt

SEQ ID NO: 4101482 - DNA, 23 bp, Homo sapiens
tcaaattaatctttctttacctg

SEQ ID NO: 4101483 - DNA, 20 bp, Homo sapiens
tcaaattgtcagcaatttaa

SEQ ID NO: 4101484 - DNA, 20 bp, Homo sapiens
tcaaatttattttaatgtaa

SEQ ID NO: 4101485 - DNA, 21 bp, Homo sapiens
tcaaatttattttaatgtaaa

SEQ ID NO: 4101486 - DNA, 16 bp, Homo sapiens
tcaaattttttgactt

SEQ ID NO: 4101487 - DNA, 16 bp, Homo sapiens
tcaacaaagaaatatt

SEQ ID NO: 4101488 - DNA, 16 bp, Homo sapiens
tcaacaaggcttgctg

SEQ ID NO: 4101489 - DNA, 17 bp, Homo sapiens
tcaacaagggagagacc

SEQ ID NO: 4101490 - DNA, 19 bp, Homo sapiens
tcaacaagggagagacctc

SEQ ID NO: 4101491 - DNA, 12 bp, Homo sapiens
tcaacaggccca

SEQ ID NO: 4101492 - DNA, 14 bp, Homo sapiens
tcaacaggcccagg

SEQ ID NO: 4101493 - DNA, 23 bp, Homo sapiens
tcaacaggggcgtgaggtcccag

SEQ ID NO: 4101494 - DNA, 20 bp, Homo sapiens
tcaacatcaatgttcattgt

SEQ ID NO: 4101495 - DNA, 14 bp, Homo sapiens
tcaacatcctgcca

SEQ ID NO: 4101496 - DNA, 17 bp, Homo sapiens
tcaacatcctgccagcc

SEQ ID NO: 4101497 - DNA, 20 bp, Homo sapiens
tcaacatcctgccagcccca

SEQ ID NO: 4101498 - DNA, 15 bp, Homo sapiens
tcaacatgttactga

SEQ ID NO: 4101499 - DNA, 20 bp, Homo sapiens
tcaacatgttactgaccagc

SEQ ID NO: 4101500 - DNA, 21 bp, Homo sapiens
tcaacatgttactgaccagca

SEQ ID NO: 4101501 - DNA, 16 bp, Homo sapiens
tcaaccacgtggagaa

SEQ ID NO: 4101502 - DNA, 22 bp, Homo sapiens
tcaaccacgtggagaaaatcaa

SEQ ID NO: 4101503 - DNA, 13 bp, Homo sapiens
tcaaccactgtgg

SEQ ID NO: 4101504 - DNA, 14 bp, Homo sapiens
tcaaccagcagatg

SEQ ID NO: 4101505 - DNA, 18 bp, Homo sapiens
tcaacctggcaaaaatgc

SEQ ID NO: 4101506 - DNA, 23 bp, Homo sapiens
tcaacgcctcactgaaacatggc

SEQ ID NO: 4101507 - DNA, 15 bp, Homo sapiens
tcaacgtattgtttc

SEQ ID NO: 4101508 - DNA, 14 bp, Homo sapiens
tcaactaaatgaga

SEQ ID NO: 4101509 - DNA, 13 bp, Homo sapiens
tcaactatgtagg

SEQ ID NO: 4101510 - DNA, 14 bp, Homo sapiens
tcaactatgtaggt

SEQ ID NO: 4101511 - DNA, 19 bp, Homo sapiens
tcaactcacctaatgttta

SEQ ID NO: 4101512 - DNA, 11 bp, Homo sapiens
tcaactcccaa

SEQ ID NO: 4101513 - DNA, 20 bp, Homo sapiens
tcaactcccaacttcttcct

SEQ ID NO: 4101514 - DNA, 16 bp, Homo sapiens
tcaactctacccctgc

SEQ ID NO: 4101515 - DNA, 23 bp, Homo sapiens
tcaactctacccctgctcccatt

SEQ ID NO: 4101516 - DNA, 20 bp, Homo sapiens
tcaactctccaatgttctat

SEQ ID NO: 4101517 - DNA, 22 bp, Homo sapiens
tcaactctttgttatttgaaaa

SEQ ID NO: 4101518 - DNA, 23 bp, Homo sapiens
tcaactgacctgaccccattcct

SEQ ID NO: 4101519 - DNA, 21 bp, Homo sapiens
tcaactgtaggttatttaaaa

SEQ ID NO: 4101520 - DNA, 23 bp, Homo sapiens
tcaactgtcttcctcaaaataaa

SEQ ID NO: 4101521 - DNA, 16 bp, Homo sapiens
tcaacttattctttga

SEQ ID NO: 4101522 - DNA, 13 bp, Homo sapiens
tcaagaaacagcc

SEQ ID NO: 4101523 - DNA, 18 bp, Homo sapiens
tcaagaaacagccagcaa

SEQ ID NO: 4101524 - DNA, 13 bp, Homo sapiens
tcaagaaaggaaa

SEQ ID NO: 4101525 - DNA, 20 bp, Homo sapiens
tcaagaaataaaaggaagcc

SEQ ID NO: 4101526 - DNA, 21 bp, Homo sapiens
tcaagaaataaaaggaagcca

SEQ ID NO: 4101527 - DNA, 18 bp, Homo sapiens
tcaagaagaaaaaggttt

SEQ ID NO: 4101528 - DNA, 11 bp, Homo sapiens
tcaagaagaat

SEQ ID NO: 4101529 - DNA, 15 bp, Homo sapiens
tcaagaagaatgaac

SEQ ID NO: 4101530 - DNA, 19 bp, Homo sapiens
tcaagactttagcttttcc

SEQ ID NO: 4101531 - DNA, 21 bp, Homo sapiens
tcaagagggcactggtggccc

SEQ ID NO: 4101532 - DNA, 21 bp, Homo sapiens
tcaagatactgctactgtaat

SEQ ID NO: 4101533 - DNA, 19 bp, Homo sapiens
tcaagatgggggcagggct

SEQ ID NO: 4101534 - DNA, 21 bp, Homo sapiens
tcaagatgggggcagggctgt

SEQ ID NO: 4101535 - DNA, 15 bp, Homo sapiens
tcaagattttagggc

SEQ ID NO: 4101536 - DNA, 16 bp, Homo sapiens
tcaagattttgaatgc

SEQ ID NO: 4101537 - DNA, 18 bp, Homo sapiens
tcaagattttgaatgctt

SEQ ID NO: 4101538 - DNA, 15 bp, Homo sapiens
tcaagatttttttcc

SEQ ID NO: 4101539 - DNA, 19 bp, Homo sapiens
tcaagcaatccacctgcct

SEQ ID NO: 4101540 - DNA, 17 bp, Homo sapiens
tcaagcaatcctcctgc

SEQ ID NO: 4101541 - DNA, 21 bp, Homo sapiens
tcaagcaatcctcctgcctca

SEQ ID NO: 4101542 - DNA, 13 bp, Homo sapiens
tcaagcccaggag

SEQ ID NO: 4101543 - DNA, 18 bp, Homo sapiens
tcaagccccagcagccct

SEQ ID NO: 4101544 - DNA, 20 bp, Homo sapiens
tcaagccccagcagccctca

SEQ ID NO: 4101545 - DNA, 18 bp, Homo sapiens
tcaagcctttatggctgc

SEQ ID NO: 4101546 - DNA, 14 bp, Homo sapiens
tcaagctagtgttt

SEQ ID NO: 4101547 - DNA, 17 bp, Homo sapiens
tcaagctagtgtttcta

SEQ ID NO: 4101548 - DNA, 21 bp, Homo sapiens
tcaagctggaagaagtgagca

SEQ ID NO: 4101549 - DNA, 22 bp, Homo sapiens
tcaagcttttgcttgatccaga

SEQ ID NO: 4101550 - DNA, 22 bp, Homo sapiens
tcaaggactctggtttctcatt

SEQ ID NO: 4101551 - DNA, 19 bp, Homo sapiens
tcaaggactgaattgtttt

SEQ ID NO: 4101552 - DNA, 19 bp, Homo sapiens
tcaaggacttgaaagcatc

SEQ ID NO: 4101553 - DNA, 20 bp, Homo sapiens
tcaagggaaaaccccgtctc

SEQ ID NO: 4101554 - DNA, 17 bp, Homo sapiens
tcaagggagaatataga

SEQ ID NO: 4101555 - DNA, 16 bp, Homo sapiens
tcaagggggactgtct

SEQ ID NO: 4101556 - DNA, 18 bp, Homo sapiens
tcaagtaagaagacatga

SEQ ID NO: 4101557 - DNA, 16 bp, Homo sapiens
tcaagtaattgtgaaa

SEQ ID NO: 4101558 - DNA, 19 bp, Homo sapiens
tcaagtacccattctgttt

SEQ ID NO: 4101559 - DNA, 15 bp, Homo sapiens
tcaagtcaaattaat

SEQ ID NO: 4101560 - DNA, 17 bp, Homo sapiens
tcaagtctctgctggcc

SEQ ID NO: 4101561 - DNA, 19 bp, Homo sapiens
tcaagtctctgctggccca

SEQ ID NO: 4101562 - DNA, 14 bp, Homo sapiens
tcaagtggcaaagc

SEQ ID NO: 4101563 - DNA, 18 bp, Homo sapiens
tcaagttgagatttttaa

SEQ ID NO: 4101564 - DNA, 16 bp, Homo sapiens
tcaagttgtaaaaatg

SEQ ID NO: 4101565 - DNA, 20 bp, Homo sapiens
tcaagtttgggtctgtgctg

SEQ ID NO: 4101566 - DNA, 21 bp, Homo sapiens
tcaagttttgggtatgtttaa

SEQ ID NO: 4101567 - DNA, 19 bp, Homo sapiens
tcaataaaatgtgattttt

SEQ ID NO: 4101568 - DNA, 22 bp, Homo sapiens
tcaataaaatgtgatttttctg

SEQ ID NO: 4101569 - DNA, 17 bp, Homo sapiens
tcaataaacaacagctg

SEQ ID NO: 4101570 - DNA, 18 bp, Homo sapiens
tcaataaacaacagctga

SEQ ID NO: 4101571 - DNA, 14 bp, Homo sapiens
tcaataaacacttg

SEQ ID NO: 4101572 - DNA, 16 bp, Homo sapiens
tcaataaagaaaactt

SEQ ID NO: 4101573 - DNA, 21 bp, Homo sapiens
tcaataaagaaaacttccata

SEQ ID NO: 4101574 - DNA, 19 bp, Homo sapiens
tcaataaagcatttataaa

SEQ ID NO: 4101575 - DNA, 15 bp, Homo sapiens
tcaataaatctttca

SEQ ID NO: 4101576 - DNA, 14 bp, Homo sapiens
tcaataaattgcaa

SEQ ID NO: 4101577 - DNA, 18 bp, Homo sapiens
tcaataacagccgctcca

SEQ ID NO: 4101578 - DNA, 14 bp, Homo sapiens
tcaataatataata

SEQ ID NO: 4101579 - DNA, 18 bp, Homo sapiens
tcaatacactagttgttt

SEQ ID NO: 4101580 - DNA, 17 bp, Homo sapiens
tcaatagctaagcatct

SEQ ID NO: 4101581 - DNA, 15 bp, Homo sapiens
tatttctgtatataa

SEQ ID NO: 4101582 - DNA, 14 bp, Homo sapiens
tatttcttccctgc

SEQ ID NO: 4101583 - DNA, 14 bp, Homo sapiens
tatttcttgtttgt

SEQ ID NO: 4101584 - DNA, 13 bp, Homo sapiens
tatttctttgtta

SEQ ID NO: 4101585 - DNA, 21 bp, Homo sapiens
tatttgaaatactaaaagcaa

SEQ ID NO: 4101586 - DNA, 16 bp, Homo sapiens
tatttgaaccaataaa

SEQ ID NO: 4101587 - DNA, 14 bp, Homo sapiens
tatttgaatgaaaa

SEQ ID NO: 4101588 - DNA, 19 bp, Homo sapiens
tatttgaatgaaaacattt

SEQ ID NO: 4101589 - DNA, 16 bp, Homo sapiens
tatttgaattaaaact

SEQ ID NO: 4101590 - DNA, 18 bp, Homo sapiens
tatttgaattaaaacttc

SEQ ID NO: 4101591 - DNA, 17 bp, Homo sapiens
tatttgacttgcatgaa

SEQ ID NO: 4101592 - DNA, 15 bp, Homo sapiens
tatttgagagttcta

SEQ ID NO: 4101593 - DNA, 16 bp, Homo sapiens
tatttgcaacatttac

SEQ ID NO: 4101594 - DNA, 17 bp, Homo sapiens
tatttgcaacatttaca

SEQ ID NO: 4101595 - DNA, 16 bp, Homo sapiens
tatttgccttctgaaa

SEQ ID NO: 4101596 - DNA, 14 bp, Homo sapiens
tatttgggaagtga

SEQ ID NO: 4101597 - DNA, 17 bp, Homo sapiens
tatttggtactgtattt

SEQ ID NO: 4101598 - DNA, 23 bp, Homo sapiens
tatttgtaaaagaacagtaaaca

SEQ ID NO: 4101599 - DNA, 17 bp, Homo sapiens
tatttgtaaatctgcca

SEQ ID NO: 4101600 - DNA, 20 bp, Homo sapiens
tatttgtcatgctgggattt

SEQ ID NO: 4101601 - DNA, 18 bp, Homo sapiens
tatttgtgatagcacttt

SEQ ID NO: 4101602 - DNA, 17 bp, Homo sapiens
tatttgtttttcattca

SEQ ID NO: 4101603 - DNA, 14 bp, Homo sapiens
tattttaaaaatat

SEQ ID NO: 4101604 - DNA, 13 bp, Homo sapiens
tattttaatcctg

SEQ ID NO: 4101605 - DNA, 12 bp, Homo sapiens
tattttactatt

SEQ ID NO: 4101606 - DNA, 13 bp, Homo sapiens
tattttactttgt

SEQ ID NO: 4101607 - DNA, 13 bp, Homo sapiens
tattttactttta

SEQ ID NO: 4101608 - DNA, 14 bp, Homo sapiens
tattttacttttat

SEQ ID NO: 4101609 - DNA, 20 bp, Homo sapiens
tattttatttagacaagaga

SEQ ID NO: 4101610 - DNA, 17 bp, Homo sapiens
tattttatttttttcta

SEQ ID NO: 4101611 - DNA, 22 bp, Homo sapiens
tattttcaaattgtatctagtg

SEQ ID NO: 4101612 - DNA, 11 bp, Homo sapiens
tattttcaaga

SEQ ID NO: 4101613 - DNA, 12 bp, Homo sapiens
tattttcaagag

SEQ ID NO: 4101614 - DNA, 16 bp, Homo sapiens
tattttcccctatcat

SEQ ID NO: 4101615 - DNA, 15 bp, Homo sapiens
tattttcttaaacca

SEQ ID NO: 4101616 - DNA, 19 bp, Homo sapiens
tattttcttcatccaactt

SEQ ID NO: 4101617 - DNA, 16 bp, Homo sapiens
tattttcttttgaatt

SEQ ID NO: 4101618 - DNA, 17 bp, Homo sapiens
tattttgaagaatattt

SEQ ID NO: 4101619 - DNA, 20 bp, Homo sapiens
tattttgaagaatatttaag

SEQ ID NO: 4101620 - DNA, 22 bp, Homo sapiens
tattttgaagaatatttaagaa

SEQ ID NO: 4101621 - DNA, 11 bp, Homo sapiens
tattttgaagt

SEQ ID NO: 4101622 - DNA, 12 bp, Homo sapiens
tattttggaaac

SEQ ID NO: 4101623 - DNA, 13 bp, Homo sapiens
tattttggaaact

SEQ ID NO: 4101624 - DNA, 16 bp, Homo sapiens
tattttggaaactgct

SEQ ID NO: 4101625 - DNA, 19 bp, Homo sapiens
tattttggaaactgctaaa

SEQ ID NO: 4101626 - DNA, 23 bp, Homo sapiens
tattttggatatattattgtaag

SEQ ID NO: 4101627 - DNA, 23 bp, Homo sapiens
tattttggattgtatattgtgtt

SEQ ID NO: 4101628 - DNA, 19 bp, Homo sapiens
tattttgggaagaaaacct

SEQ ID NO: 4101629 - DNA, 14 bp, Homo sapiens
tattttggtacttt

SEQ ID NO: 4101630 - DNA, 15 bp, Homo sapiens
tattttgtactttgt

SEQ ID NO: 4101631 - DNA, 15 bp, Homo sapiens
tattttgtgtacaag

SEQ ID NO: 4101632 - DNA, 15 bp, Homo sapiens
tatttttaaagatag

SEQ ID NO: 4101633 - DNA, 22 bp, Homo sapiens
tatttttataaatataagcctt

SEQ ID NO: 4101634 - DNA, 20 bp, Homo sapiens
tatttttatatcatgcaaaa

SEQ ID NO: 4101635 - DNA, 18 bp, Homo sapiens
tatttttatcatgaattc

SEQ ID NO: 4101636 - DNA, 18 bp, Homo sapiens
tatttttcaataaagcat

SEQ ID NO: 4101637 - DNA, 14 bp, Homo sapiens
tatttttgtaatgt

SEQ ID NO: 4101638 - DNA, 22 bp, Homo sapiens
tatttttgtaatgtgaaaagta

SEQ ID NO: 4101639 - DNA, 23 bp, Homo sapiens
tatttttgtaatgtgaaaagtat

SEQ ID NO: 4101640 - DNA, 12 bp, Homo sapiens
tatttttgtact

SEQ ID NO: 4101641 - DNA, 15 bp, Homo sapiens
tatttttgtacttga

SEQ ID NO: 4101642 - DNA, 23 bp, Homo sapiens
tatttttgtagtgacctgtttat

SEQ ID NO: 4101643 - DNA, 23 bp, Homo sapiens
tattttttaatttgatgaaagct

SEQ ID NO: 4101644 - DNA, 19 bp, Homo sapiens
tatttttttgtaattgctt

SEQ ID NO: 4101645 - DNA, 14 bp, Homo sapiens
tcaaaaaaacacta

SEQ ID NO: 4101646 - DNA, 17 bp, Homo sapiens
tcaaaaactttggagtc

SEQ ID NO: 4101647 - DNA, 13 bp, Homo sapiens
tcaaaaatataac

SEQ ID NO: 4101648 - DNA, 14 bp, Homo sapiens
tcaaaaatataact

SEQ ID NO: 4101649 - DNA, 20 bp, Homo sapiens
tcaaaaattatctatagcta

SEQ ID NO: 4101650 - DNA, 22 bp, Homo sapiens
tcaaaacaaacagatgctctga

SEQ ID NO: 4101651 - DNA, 16 bp, Homo sapiens
tcaaaactacaaatca

SEQ ID NO: 4101652 - DNA, 12 bp, Homo sapiens
tcaaaataaaaa

SEQ ID NO: 4101653 - DNA, 23 bp, Homo sapiens
tcaaaataaaaagtgacacagca

SEQ ID NO: 4101654 - DNA, 13 bp, Homo sapiens
tcaaaataattct

SEQ ID NO: 4101655 - DNA, 16 bp, Homo sapiens
tcaaaatccttccaaa

SEQ ID NO: 4101656 - DNA, 12 bp, Homo sapiens
tcaaaatgcttt

SEQ ID NO: 4101657 - DNA, 17 bp, Homo sapiens
tcaaaatgctttttatt

SEQ ID NO: 4101658 - DNA, 13 bp, Homo sapiens
tcaaaatgtagct

SEQ ID NO: 4101659 - DNA, 15 bp, Homo sapiens
tcaaaattaaatctg

SEQ ID NO: 4101660 - DNA, 22 bp, Homo sapiens
tcaaacagtaatctaggtgtgg

SEQ ID NO: 4101661 - DNA, 15 bp, Homo sapiens
tcaaaccctagcctt

SEQ ID NO: 4101662 - DNA, 16 bp, Homo sapiens
tcaaaccctagccttg

SEQ ID NO: 4101663 - DNA, 20 bp, Homo sapiens
tcaaaccctagccttgcttg

SEQ ID NO: 4101664 - DNA, 14 bp, Homo sapiens
tcaaactaaaagac

SEQ ID NO: 4101665 - DNA, 17 bp, Homo sapiens
tcaaactaattctcaca

SEQ ID NO: 4101666 - DNA, 14 bp, Homo sapiens
tcaaactggggcct

SEQ ID NO: 4101667 - DNA, 19 bp, Homo sapiens
tcaaactggggcctccaga

SEQ ID NO: 4101668 - DNA, 14 bp, Homo sapiens
tcaaactgtagaaa

SEQ ID NO: 4101669 - DNA, 17 bp, Homo sapiens
tcaaacttactattttg

SEQ ID NO: 4101670 - DNA, 19 bp, Homo sapiens
tcaaacttgtggcctcaag

SEQ ID NO: 4101671 - DNA, 20 bp, Homo sapiens
tcaaagagagaaaataaaga

SEQ ID NO: 4101672 - DNA, 21 bp, Homo sapiens
tcaaagaggctgaggctggca

SEQ ID NO: 4101673 - DNA, 17 bp, Homo sapiens
tcaaagccacattattt

SEQ ID NO: 4101674 - DNA, 23 bp, Homo sapiens
tcaaagtaaggctggtaagagaa

SEQ ID NO: 4101675 - DNA, 20 bp, Homo sapiens
tcaaagtgttgtgttcctgg

SEQ ID NO: 4101676 - DNA, 14 bp, Homo sapiens
tcaaagttttgaaa

SEQ ID NO: 4101677 - DNA, 20 bp, Homo sapiens
tcaaagttttgaaaagctat

SEQ ID NO: 4101678 - DNA, 23 bp, Homo sapiens
tcaaataaaactagtgacagctt

SEQ ID NO: 4101679 - DNA, 18 bp, Homo sapiens
tcaaataactaaaaggta

SEQ ID NO: 4101680 - DNA, 19 bp, Homo sapiens
tcaaataagtatttataat

SEQ ID NO: 4101681 - DNA, 20 bp, Homo sapiens
tcaaataagtatttataata

SEQ ID NO: 4101682 - DNA, 14 bp, Homo sapiens
tcaaatacaaagta

SEQ ID NO: 4101683 - DNA, 12 bp, Homo sapiens
tcaaatacttta

SEQ ID NO: 4101684 - DNA, 14 bp, Homo sapiens
tcaaatctattcag

SEQ ID NO: 4101685 - DNA, 16 bp, Homo sapiens
tattgctagtatttga

SEQ ID NO: 4101686 - DNA, 20 bp, Homo sapiens
tattgctagtatttgaatta

SEQ ID NO: 4101687 - DNA, 15 bp, Homo sapiens
tattgctgagagaaa

SEQ ID NO: 4101688 - DNA, 15 bp, Homo sapiens
tattggaattaacct

SEQ ID NO: 4101689 - DNA, 13 bp, Homo sapiens
tattggcaaagtt

SEQ ID NO: 4101690 - DNA, 16 bp, Homo sapiens
tattgggttcattatt

SEQ ID NO: 4101691 - DNA, 20 bp, Homo sapiens
tattgggttcattattggaa

SEQ ID NO: 4101692 - DNA, 14 bp, Homo sapiens
tattggtatatcct

SEQ ID NO: 4101693 - DNA, 17 bp, Homo sapiens
tattggtatatcctttt

SEQ ID NO: 4101694 - DNA, 15 bp, Homo sapiens
tattggtgcgttttt

SEQ ID NO: 4101695 - DNA, 21 bp, Homo sapiens
tattgtaagttgtacaaatgt

SEQ ID NO: 4101696 - DNA, 17 bp, Homo sapiens
tattgtacataaaagaa

SEQ ID NO: 4101697 - DNA, 17 bp, Homo sapiens
tattgtaccattttcta

SEQ ID NO: 4101698 - DNA, 13 bp, Homo sapiens
tattgtacctctc

SEQ ID NO: 4101699 - DNA, 16 bp, Homo sapiens
tattgtattgctgctg

SEQ ID NO: 4101700 - DNA, 15 bp, Homo sapiens
tattgtgattctgtt

SEQ ID NO: 4101701 - DNA, 20 bp, Homo sapiens
tattgtgggacttattacaa

SEQ ID NO: 4101702 - DNA, 22 bp, Homo sapiens
tattgtgggacttattacaatt

SEQ ID NO: 4101703 - DNA, 16 bp, Homo sapiens
tattgttatgttctcc

SEQ ID NO: 4101704 - DNA, 16 bp, Homo sapiens
tattgttcaaacaata

SEQ ID NO: 4101705 - DNA, 20 bp, Homo sapiens
tattgttccaagacattgtc

SEQ ID NO: 4101706 - DNA, 17 bp, Homo sapiens
tattgttcccagtgaca

SEQ ID NO: 4101707 - DNA, 15 bp, Homo sapiens
tattgttctcacact

SEQ ID NO: 4101708 - DNA, 20 bp, Homo sapiens
tattgttgacaactgtgact

SEQ ID NO: 4101709 - DNA, 23 bp, Homo sapiens
tattgttgacaactgtgactgta

SEQ ID NO: 4101710 - DNA, 17 bp, Homo sapiens
tattgttgcattgcttt

SEQ ID NO: 4101711 - DNA, 11 bp, Homo sapiens
tattgtttaaa

SEQ ID NO: 4101712 - DNA, 15 bp, Homo sapiens
tattgtttaaaattc

SEQ ID NO: 4101713 - DNA, 15 bp, Homo sapiens
tattgtttctgcatt

SEQ ID NO: 4101714 - DNA, 12 bp, Homo sapiens
tattgttttcag

SEQ ID NO: 4101715 - DNA, 20 bp, Homo sapiens
tattgttttcagtgtacatg

SEQ ID NO: 4101716 - DNA, 22 bp, Homo sapiens
tattgttttcagtgtacatgga

SEQ ID NO: 4101717 - DNA, 13 bp, Homo sapiens
tatttaaaaacaa

SEQ ID NO: 4101718 - DNA, 13 bp, Homo sapiens
tatttaaaacttg

SEQ ID NO: 4101719 - DNA, 15 bp, Homo sapiens
tatttaaaattccat

SEQ ID NO: 4101720 - DNA, 22 bp, Homo sapiens
tatttaaagacagggaagagca

SEQ ID NO: 4101721 - DNA, 13 bp, Homo sapiens
tatttaaagcatt

SEQ ID NO: 4101722 - DNA, 21 bp, Homo sapiens
tatttaactgccttgtgtaca

SEQ ID NO: 4101723 - DNA, 18 bp, Homo sapiens
tatttaagaaaagcactt

SEQ ID NO: 4101724 - DNA, 23 bp, Homo sapiens
tatttaagaaaagcacttttgtt

SEQ ID NO: 4101725 - DNA, 13 bp, Homo sapiens
tatttaagaaaat

SEQ ID NO: 4101726 - DNA, 14 bp, Homo sapiens
tatttaagaaaata

SEQ ID NO: 4101727 - DNA, 20 bp, Homo sapiens
tatttaagaaaatacaataa

SEQ ID NO: 4101728 - DNA, 17 bp, Homo sapiens
tatttaagccttataaa

SEQ ID NO: 4101729 - DNA, 16 bp, Homo sapiens
tatttaagcttatgtc

SEQ ID NO: 4101730 - DNA, 14 bp, Homo sapiens
tatttaagttatca

SEQ ID NO: 4101731 - DNA, 13 bp, Homo sapiens
tatttaataacat

SEQ ID NO: 4101732 - DNA, 20 bp, Homo sapiens
tatttaccgttgcttgaaat

SEQ ID NO: 4101733 - DNA, 14 bp, Homo sapiens
tatttacgctttga

SEQ ID NO: 4101734 - DNA, 22 bp, Homo sapiens
tatttactgagcttctctgtga

SEQ ID NO: 4101735 - DNA, 20 bp, Homo sapiens
tatttacttctaatcttaaa

SEQ ID NO: 4101736 - DNA, 19 bp, Homo sapiens
tatttagacaagagatggg

SEQ ID NO: 4101737 - DNA, 14 bp, Homo sapiens
tatttagctgtaaa

SEQ ID NO: 4101738 - DNA, 20 bp, Homo sapiens
tatttagtgttagttataaa

SEQ ID NO: 4101739 - DNA, 19 bp, Homo sapiens
tatttataaatatatttaa

SEQ ID NO: 4101740 - DNA, 22 bp, Homo sapiens
tatttataactcatcataaaat

SEQ ID NO: 4101741 - DNA, 20 bp, Homo sapiens
tatttatacaagattgaaaa

SEQ ID NO: 4101742 - DNA, 14 bp, Homo sapiens
tatttatatatatt

SEQ ID NO: 4101743 - DNA, 19 bp, Homo sapiens
tatttatatatttataact

SEQ ID NO: 4101744 - DNA, 14 bp, Homo sapiens
tatttatatttcac

SEQ ID NO: 4101745 - DNA, 16 bp, Homo sapiens
tatttatatttcacta

SEQ ID NO: 4101746 - DNA, 21 bp, Homo sapiens
tatttatatttttattttatt

SEQ ID NO: 4101747 - DNA, 16 bp, Homo sapiens
tatttatcaaaatgta

SEQ ID NO: 4101748 - DNA, 17 bp, Homo sapiens
tatttatcaaaatgtag

SEQ ID NO: 4101749 - DNA, 20 bp, Homo sapiens
tatttatcaaaatgtagctt

SEQ ID NO: 4101750 - DNA, 18 bp, Homo sapiens
tatttatcagtgacagag

SEQ ID NO: 4101751 - DNA, 19 bp, Homo sapiens
tatttatgaagtttaaaac

SEQ ID NO: 4101752 - DNA, 22 bp, Homo sapiens
tatttatggaattaaccattta

SEQ ID NO: 4101753 - DNA, 13 bp, Homo sapiens
tatttattaagat

SEQ ID NO: 4101754 - DNA, 17 bp, Homo sapiens
tatttattaatatttaa

SEQ ID NO: 4101755 - DNA, 14 bp, Homo sapiens
tatttattactatg

SEQ ID NO: 4101756 - DNA, 12 bp, Homo sapiens
tatttattactg

SEQ ID NO: 4101757 - DNA, 19 bp, Homo sapiens
tatttattattttcacctg

SEQ ID NO: 4101758 - DNA, 19 bp, Homo sapiens
tatttattcctctgtccta

SEQ ID NO: 4101759 - DNA, 11 bp, Homo sapiens
tatttattgtt

SEQ ID NO: 4101760 - DNA, 20 bp, Homo sapiens
tatttattgttagaaaatga

SEQ ID NO: 4101761 - DNA, 11 bp, Homo sapiens
tatttatttaa

SEQ ID NO: 4101762 - DNA, 12 bp, Homo sapiens
tatttatttaaa

SEQ ID NO: 4101763 - DNA, 17 bp, Homo sapiens
tatttatttaaagcatt

SEQ ID NO: 4101764 - DNA, 14 bp, Homo sapiens
tatttatttattta

SEQ ID NO: 4101765 - DNA, 13 bp, Homo sapiens
tatttattttgta

SEQ ID NO: 4101766 - DNA, 16 bp, Homo sapiens
tatttattttgtaatt

SEQ ID NO: 4101767 - DNA, 19 bp, Homo sapiens
tatttattttgtaattatg

SEQ ID NO: 4101768 - DNA, 20 bp, Homo sapiens
tatttattttgtaattatga

SEQ ID NO: 4101769 - DNA, 18 bp, Homo sapiens
tatttatttttacaagaa

SEQ ID NO: 4101770 - DNA, 18 bp, Homo sapiens
tatttcactatcttcttc

SEQ ID NO: 4101771 - DNA, 20 bp, Homo sapiens
tatttcactatcttcttcaa

SEQ ID NO: 4101772 - DNA, 16 bp, Homo sapiens
tatttcacttgatgat

SEQ ID NO: 4101773 - DNA, 19 bp, Homo sapiens
tatttcagtgttacctgtg

SEQ ID NO: 4101774 - DNA, 13 bp, Homo sapiens
tatttcatgtttt

SEQ ID NO: 4101775 - DNA, 21 bp, Homo sapiens
tatttcatgtttttgatcaaa

SEQ ID NO: 4101776 - DNA, 14 bp, Homo sapiens
tatttcatttcttg

SEQ ID NO: 4101777 - DNA, 18 bp, Homo sapiens
tatttccattcaacaaga

SEQ ID NO: 4101778 - DNA, 23 bp, Homo sapiens
tatttcctatattgttttcagtg

SEQ ID NO: 4101779 - DNA, 17 bp, Homo sapiens
tatttcctgacttgagt

SEQ ID NO: 4101780 - DNA, 11 bp, Homo sapiens
tatttccttta

SEQ ID NO: 4101781 - DNA, 14 bp, Homo sapiens
tatttcctttatgt

SEQ ID NO: 4101782 - DNA, 17 bp, Homo sapiens
tatttcctttatgtgaa

SEQ ID NO: 4101783 - DNA, 19 bp, Homo sapiens
tatttcgaaactgccaagg

SEQ ID NO: 4101784 - DNA, 21 bp, Homo sapiens
tatttctagtccaaaattaca

SEQ ID NO: 4101785 - DNA, 13 bp, Homo sapiens
tatttctgatcta

SEQ ID NO: 4101786 - DNA, 17 bp, Homo sapiens
tatttctgcatatgttg

SEQ ID NO: 4101787 - DNA, 17 bp, Homo sapiens
tatttctgggtcttttg

SEQ ID NO: 4101788 - DNA, 18 bp, Homo sapiens
tatttctgggtcttttgc

SEQ ID NO: 4101789 - DNA, 23 bp, Homo sapiens
tattaaacagatttttacaaatg

SEQ ID NO: 4101790 - DNA, 17 bp, Homo sapiens
tattaaagcatttccta

SEQ ID NO: 4101791 - DNA, 14 bp, Homo sapiens
tattaaagtattct

SEQ ID NO: 4101792 - DNA, 18 bp, Homo sapiens
tattaaagtctaaacaaa

SEQ ID NO: 4101793 - DNA, 12 bp, Homo sapiens
tattaaagtgac

SEQ ID NO: 4101794 - DNA, 15 bp, Homo sapiens
tattaaataaaatca

SEQ ID NO: 4101795 - DNA, 12 bp, Homo sapiens
tattaaatacag

SEQ ID NO: 4101796 - DNA, 18 bp, Homo sapiens
tattaaatacagacacta

SEQ ID NO: 4101797 - DNA, 18 bp, Homo sapiens
tattaacaaattatgtta

SEQ ID NO: 4101798 - DNA, 23 bp, Homo sapiens
tattaacaacaataacactgtct

SEQ ID NO: 4101799 - DNA, 18 bp, Homo sapiens
tattaactttaatgtttt

SEQ ID NO: 4101800 - DNA, 13 bp, Homo sapiens
tattaagatggat

SEQ ID NO: 4101801 - DNA, 16 bp, Homo sapiens
tattaagatggattct

SEQ ID NO: 4101802 - DNA, 18 bp, Homo sapiens
tattaagatggattctca

SEQ ID NO: 4101803 - DNA, 20 bp, Homo sapiens
tattaagatggattctcaga

SEQ ID NO: 4101804 - DNA, 21 bp, Homo sapiens
tattaagatggattctcagat

SEQ ID NO: 4101805 - DNA, 15 bp, Homo sapiens
tattaatactggtat

SEQ ID NO: 4101806 - DNA, 13 bp, Homo sapiens
tattaatatttgt

SEQ ID NO: 4101807 - DNA, 12 bp, Homo sapiens
tattaatcaaaa

SEQ ID NO: 4101808 - DNA, 13 bp, Homo sapiens
tattaattcttca

SEQ ID NO: 4101809 - DNA, 20 bp, Homo sapiens
tattaattttccaatgcaca

SEQ ID NO: 4101810 - DNA, 18 bp, Homo sapiens
tattacacatttgtacag

SEQ ID NO: 4101811 - DNA, 22 bp, Homo sapiens
tattacataaaggctaactatg

SEQ ID NO: 4101812 - DNA, 20 bp, Homo sapiens
tattaccaccatcccgtgct

SEQ ID NO: 4101813 - DNA, 22 bp, Homo sapiens
tattaccccctccttcagacac

SEQ ID NO: 4101814 - DNA, 19 bp, Homo sapiens
tattacctctgatacctca

SEQ ID NO: 4101815 - DNA, 14 bp, Homo sapiens
tattactcagttta

SEQ ID NO: 4101816 - DNA, 18 bp, Homo sapiens
tattactgtttatttctg

SEQ ID NO: 4101817 - DNA, 21 bp, Homo sapiens
tattactgtttatttctgttt

SEQ ID NO: 4101818 - DNA, 13 bp, Homo sapiens
tattagccaggat

SEQ ID NO: 4101819 - DNA, 23 bp, Homo sapiens
tattagctgtattatccattttt

SEQ ID NO: 4101820 - DNA, 15 bp, Homo sapiens
tattagggagaaaat

SEQ ID NO: 4101821 - DNA, 24 bp, Homo sapiens
tattataaaagggggtccgtggaa

SEQ ID NO: 4101822 - DNA, 13 bp, Homo sapiens
tattataaatgtt

SEQ ID NO: 4101823 - DNA, 16 bp, Homo sapiens
tattataaatgttagt

SEQ ID NO: 4101824 - DNA, 18 bp, Homo sapiens
tattataaatgttagttc

SEQ ID NO: 4101825 - DNA, 20 bp, Homo sapiens
tattataacaagtgtgtctt

SEQ ID NO: 4101826 - DNA, 17 bp, Homo sapiens
tattataagcattgaaa

SEQ ID NO: 4101827 - DNA, 21 bp, Homo sapiens
tattataagcattgaaattat

SEQ ID NO: 4101828 - DNA, 21 bp, Homo sapiens
tattataagggagagctgagc

SEQ ID NO: 4101829 - DNA, 19 bp, Homo sapiens
tattataatttttttcaat

SEQ ID NO: 4101830 - DNA, 14 bp, Homo sapiens
tattatatcttgta

SEQ ID NO: 4101831 - DNA, 15 bp, Homo sapiens
tattatcataagaat

SEQ ID NO: 4101832 - DNA, 17 bp, Homo sapiens
tattatctgtgttaaaa

SEQ ID NO: 4101833 - DNA, 22 bp, Homo sapiens
tattatgaagaattgccaatct

SEQ ID NO: 4101834 - DNA, 20 bp, Homo sapiens
tattatggaaaactgtgttg

SEQ ID NO: 4101835 - DNA, 12 bp, Homo sapiens
tattattatctt

SEQ ID NO: 4101836 - DNA, 12 bp, Homo sapiens
tattattatgaa

SEQ ID NO: 4101837 - DNA, 15 bp, Homo sapiens
tattattctgcagca

SEQ ID NO: 4101838 - DNA, 14 bp, Homo sapiens
tattattctgtttt

SEQ ID NO: 4101839 - DNA, 15 bp, Homo sapiens
tattattctgttttg

SEQ ID NO: 4101840 - DNA, 23 bp, Homo sapiens
tattattctgttttgcacagtta

SEQ ID NO: 4101841 - DNA, 13 bp, Homo sapiens
tattatttatata

SEQ ID NO: 4101842 - DNA, 14 bp, Homo sapiens
tattatttctatta

SEQ ID NO: 4101843 - DNA, 15 bp, Homo sapiens
tattattttcacctg

SEQ ID NO: 4101844 - DNA, 18 bp, Homo sapiens
tattattttggggtctct

SEQ ID NO: 4101845 - DNA, 13 bp, Homo sapiens
tattatttttacc

SEQ ID NO: 4101846 - DNA, 20 bp, Homo sapiens
tattatttttacctaaagac

SEQ ID NO: 4101847 - DNA, 22 bp, Homo sapiens
tattatttttacctaaagacgt

SEQ ID NO: 4101848 - DNA, 23 bp, Homo sapiens
tattcaaaaattatctatagcta

SEQ ID NO: 4101849 - DNA, 23 bp, Homo sapiens
tattcacgccattggttggaagc

SEQ ID NO: 4101850 - DNA, 23 bp, Homo sapiens
tattcagcagactttctctgtgt

SEQ ID NO: 4101851 - DNA, 12 bp, Homo sapiens
tattcaggactt

SEQ ID NO: 4101852 - DNA, 14 bp, Homo sapiens
tattcaggagttgg

SEQ ID NO: 4101853 - DNA, 13 bp, Homo sapiens
tattcagtaaaca

SEQ ID NO: 4101854 - DNA, 21 bp, Homo sapiens
tattcagtaaacaacttgtac

SEQ ID NO: 4101855 - DNA, 20 bp, Homo sapiens
tattcagtaataactctacc

SEQ ID NO: 4101856 - DNA, 22 bp, Homo sapiens
tattcatagtatactgatttaa

SEQ ID NO: 4101857 - DNA, 15 bp, Homo sapiens
tattcatccagagtt

SEQ ID NO: 4101858 - DNA, 22 bp, Homo sapiens
tattcatccagagttcttaaag

SEQ ID NO: 4101859 - DNA, 20 bp, Homo sapiens
tattcattctgtgatcattt

SEQ ID NO: 4101860 - DNA, 12 bp, Homo sapiens
tattcatttaaa

SEQ ID NO: 4101861 - DNA, 13 bp, Homo sapiens
tattcatttaaaa

SEQ ID NO: 4101862 - DNA, 21 bp, Homo sapiens
tattccaaaaaggttgctgtt

SEQ ID NO: 4101863 - DNA, 22 bp, Homo sapiens
tattccccaccctccccttccc

SEQ ID NO: 4101864 - DNA, 22 bp, Homo sapiens
tattcccctatctctagaattt

SEQ ID NO: 4101865 - DNA, 11 bp, Homo sapiens
tattccctttg

SEQ ID NO: 4101866 - DNA, 21 bp, Homo sapiens
tattcctaatggctatttttg

SEQ ID NO: 4101867 - DNA, 15 bp, Homo sapiens
tattcctctaggcaa

SEQ ID NO: 4101868 - DNA, 14 bp, Homo sapiens
tattcctgaatgaa

SEQ ID NO: 4101869 - DNA, 21 bp, Homo sapiens
tattccttttgtgtacagtgt

SEQ ID NO: 4101870 - DNA, 17 bp, Homo sapiens
tattctatatgaattta

SEQ ID NO: 4101871 - DNA, 13 bp, Homo sapiens
tattctattaact

SEQ ID NO: 4101872 - DNA, 17 bp, Homo sapiens
tattctcagagcatgtg

SEQ ID NO: 4101873 - DNA, 16 bp, Homo sapiens
tattctgaagcaacat

SEQ ID NO: 4101874 - DNA, 23 bp, Homo sapiens
tattctgagcatactcaacaaaa

SEQ ID NO: 4101875 - DNA, 21 bp, Homo sapiens
tattctgtgttgcattattca

SEQ ID NO: 4101876 - DNA, 22 bp, Homo sapiens
tattctgtgttgcattattcat

SEQ ID NO: 4101877 - DNA, 15 bp, Homo sapiens
tattcttttgtttcc

SEQ ID NO: 4101878 - DNA, 16 bp, Homo sapiens
tattcttttgtttcca

SEQ ID NO: 4101879 - DNA, 17 bp, Homo sapiens
tattgaagacaatttga

SEQ ID NO: 4101880 - DNA, 20 bp, Homo sapiens
tattgacacagaaaatgttg

SEQ ID NO: 4101881 - DNA, 16 bp, Homo sapiens
tattgacactgaactt

SEQ ID NO: 4101882 - DNA, 24 bp, Homo sapiens
tattgacactgaacttaataactg

SEQ ID NO: 4101883 - DNA, 14 bp, Homo sapiens
tattgacttgtata

SEQ ID NO: 4101884 - DNA, 20 bp, Homo sapiens
tattgagaatcccttaaaat

SEQ ID NO: 4101885 - DNA, 18 bp, Homo sapiens
tattgagaattttaaatt

SEQ ID NO: 4101886 - DNA, 18 bp, Homo sapiens
tattgagatttcttaaat

SEQ ID NO: 4101887 - DNA, 19 bp, Homo sapiens
tattgagatttcttaaata

SEQ ID NO: 4101888 - DNA, 19 bp, Homo sapiens
tattgaggctttgtgttgt

SEQ ID NO: 4101889 - DNA, 21 bp, Homo sapiens
tattgatatgcttatacactt

SEQ ID NO: 4101890 - DNA, 13 bp, Homo sapiens
tattgcacattgt

SEQ ID NO: 4101891 - DNA, 15 bp, Homo sapiens
tattgccttctttga

SEQ ID NO: 4101892 - DNA, 21 bp, Homo sapiens
taatagcaacttttgtgtaat

SEQ ID NO: 4101893 - DNA, 17 bp, Homo sapiens
taataggtagtttggat

SEQ ID NO: 4101894 - DNA, 14 bp, Homo sapiens
taatagtgcttttt

SEQ ID NO: 4101895 - DNA, 23 bp, Homo sapiens
taatagtgcttttttttttttga

SEQ ID NO: 4101896 - DNA, 14 bp, Homo sapiens
taatagttattatt

SEQ ID NO: 4101897 - DNA, 19 bp, Homo sapiens
taatagtttacatgtagta

SEQ ID NO: 4101898 - DNA, 20 bp, Homo sapiens
taatagtttgtctattttaa

SEQ ID NO: 4101899 - DNA, 16 bp, Homo sapiens
taatatactatattta

SEQ ID NO: 4101900 - DNA, 17 bp, Homo sapiens
taatatccctacatgta

SEQ ID NO: 4101901 - DNA, 13 bp, Homo sapiens
taatatctgtgag

SEQ ID NO: 4101902 - DNA, 15 bp, Homo sapiens
taatatctgtgaggt

SEQ ID NO: 4101903 - DNA, 21 bp, Homo sapiens
taatatctgtgaggtgctgat

SEQ ID NO: 4101904 - DNA, 12 bp, Homo sapiens
taatatggattt

SEQ ID NO: 4101905 - DNA, 20 bp, Homo sapiens
taatatggctatgcttaaaa

SEQ ID NO: 4101906 - DNA, 21 bp, Homo sapiens
taatatggctatgcttaaaag

SEQ ID NO: 4101907 - DNA, 19 bp, Homo sapiens
taatatgggcattgtagtt

SEQ ID NO: 4101908 - DNA, 20 bp, Homo sapiens
taatatgggcattgtagtta

SEQ ID NO: 4101909 - DNA, 20 bp, Homo sapiens
taatatgttaacctcagtgt

SEQ ID NO: 4101910 - DNA, 23 bp, Homo sapiens
taatatgttaacctcagtgtcat

SEQ ID NO: 4101911 - DNA, 16 bp, Homo sapiens
taatattgacttgtat

SEQ ID NO: 4101912 - DNA, 19 bp, Homo sapiens
taatattgttgtataattt

SEQ ID NO: 4101913 - DNA, 15 bp, Homo sapiens
taatcaaaattgtct

SEQ ID NO: 4101914 - DNA, 18 bp, Homo sapiens
taatcaaagccagggtct

SEQ ID NO: 4101915 - DNA, 22 bp, Homo sapiens
taatcaactgtaggttatttaa

SEQ ID NO: 4101916 - DNA, 11 bp, Homo sapiens
taatcaagatt

SEQ ID NO: 4101917 - DNA, 14 bp, Homo sapiens
taatcaagttgaat

SEQ ID NO: 4101918 - DNA, 17 bp, Homo sapiens
taatcaagttgtaactt

SEQ ID NO: 4101919 - DNA, 17 bp, Homo sapiens
taatcaatgaatattga

SEQ ID NO: 4101920 - DNA, 18 bp, Homo sapiens
taatcaatgtttcttcta

SEQ ID NO: 4101921 - DNA, 21 bp, Homo sapiens
taatcaccagggccaaaagct

SEQ ID NO: 4101922 - DNA, 16 bp, Homo sapiens
taatcactcagagcag

SEQ ID NO: 4101923 - DNA, 13 bp, Homo sapiens
taatcagaaattt

SEQ ID NO: 4101924 - DNA, 15 bp, Homo sapiens
taatcaggctgaggt

SEQ ID NO: 4101925 - DNA, 19 bp, Homo sapiens
taatcagggaggtcatttt

SEQ ID NO: 4101926 - DNA, 14 bp, Homo sapiens
taatcagtgactga

SEQ ID NO: 4101927 - DNA, 15 bp, Homo sapiens
taatcagtgactgaa

SEQ ID NO: 4101928 - DNA, 23 bp, Homo sapiens
taatcagtgactgaaaccatttt

SEQ ID NO: 4101929 - DNA, 22 bp, Homo sapiens
taatcatataataaatgtacat

SEQ ID NO: 4101930 - DNA, 17 bp, Homo sapiens
taatcatctataaagaa

SEQ ID NO: 4101931 - DNA, 18 bp, Homo sapiens
taatcatgtgaaatgttt

SEQ ID NO: 4101932 - DNA, 20 bp, Homo sapiens
taatcatgtgggtgagccag

SEQ ID NO: 4101933 - DNA, 18 bp, Homo sapiens
taatccaggcagatccag

SEQ ID NO: 4101934 - DNA, 23 bp, Homo sapiens
taatccaggcagatccaggacta

SEQ ID NO: 4101935 - DNA, 19 bp, Homo sapiens
taatcccagctacttggga

SEQ ID NO: 4101936 - DNA, 21 bp, Homo sapiens
taatcctgtaccaaatctgac

SEQ ID NO: 4101937 - DNA, 19 bp, Homo sapiens
taatccttcctcagatgat

SEQ ID NO: 4101938 - DNA, 22 bp, Homo sapiens
taatccttctttgtaatacttt

SEQ ID NO: 4101939 - DNA, 17 bp, Homo sapiens
taatcctttctgccgac

SEQ ID NO: 4101940 - DNA, 20 bp, Homo sapiens
taatcctttctgccgacccc

SEQ ID NO: 4101941 - DNA, 20 bp, Homo sapiens
taatcctttgttttctgact

SEQ ID NO: 4101942 - DNA, 22 bp, Homo sapiens
taatcctttgttttctgactaa

SEQ ID NO: 4101943 - DNA, 23 bp, Homo sapiens
taatcctttgttttctgactaat

SEQ ID NO: 4101944 - DNA, 13 bp, Homo sapiens
taatcgaaagaaa

SEQ ID NO: 4101945 - DNA, 16 bp, Homo sapiens
taatctattgggttca

SEQ ID NO: 4101946 - DNA, 18 bp, Homo sapiens
taatctattgggttcatt

SEQ ID NO: 4101947 - DNA, 19 bp, Homo sapiens
taatctattgggttcatta

SEQ ID NO: 4101948 - DNA, 20 bp, Homo sapiens
taatctattgggttcattat

SEQ ID NO: 4101949 - DNA, 22 bp, Homo sapiens
taatctattgggttcattattg

SEQ ID NO: 4101950 - DNA, 21 bp, Homo sapiens
taatctgaaaggatgtggaag

SEQ ID NO: 4101951 - DNA, 20 bp, Homo sapiens
taatctgaagatatatttca

SEQ ID NO: 4101952 - DNA, 23 bp, Homo sapiens
taatctgaagatatatttcactt

SEQ ID NO: 4101953 - DNA, 22 bp, Homo sapiens
taatctgaataaagtgtaacaa

SEQ ID NO: 4101954 - DNA, 17 bp, Homo sapiens
taatcttaaatcagaat

SEQ ID NO: 4101955 - DNA, 20 bp, Homo sapiens
taatcttaggggagagcttt

SEQ ID NO: 4101956 - DNA, 13 bp, Homo sapiens
taatcttattagg

SEQ ID NO: 4101957 - DNA, 16 bp, Homo sapiens
taatcttcagttttat

SEQ ID NO: 4101958 - DNA, 18 bp, Homo sapiens
taatctttctttacctga

SEQ ID NO: 4101959 - DNA, 21 bp, Homo sapiens
taatctttctttacctgagac

SEQ ID NO: 4101960 - DNA, 16 bp, Homo sapiens
taatctttgtgacagg

SEQ ID NO: 4101961 - DNA, 13 bp, Homo sapiens
taatgaaaatgtc

SEQ ID NO: 4101962 - DNA, 19 bp, Homo sapiens
taatgaaagactgtacaaa

SEQ ID NO: 4101963 - DNA, 14 bp, Homo sapiens
taatgaaataatca

SEQ ID NO: 4101964 - DNA, 11 bp, Homo sapiens
taatgaagaca

SEQ ID NO: 4101965 - DNA, 15 bp, Homo sapiens
taatgaataaactga

SEQ ID NO: 4101966 - DNA, 23 bp, Homo sapiens
taatgaataaactgaatattttg

SEQ ID NO: 4101967 - DNA, 21 bp, Homo sapiens
taatgagcaatatctgctaga

SEQ ID NO: 4101968 - DNA, 22 bp, Homo sapiens
taatgagccatcactagaagaa

SEQ ID NO: 4101969 - DNA, 17 bp, Homo sapiens
taatgataaaataaata

SEQ ID NO: 4101970 - DNA, 11 bp, Homo sapiens
taatgatgttt

SEQ ID NO: 4101971 - DNA, 23 bp, Homo sapiens
taatgcagccacgattggagaat

SEQ ID NO: 4101972 - DNA, 17 bp, Homo sapiens
taatgcagttgcttact

SEQ ID NO: 4101973 - DNA, 17 bp, Homo sapiens
taatgcatgaagcaacg

SEQ ID NO: 4101974 - DNA, 14 bp, Homo sapiens
taatgccccaagga

SEQ ID NO: 4101975 - DNA, 21 bp, Homo sapiens
taatgcgatttcttccttgtt

SEQ ID NO: 4101976 - DNA, 16 bp, Homo sapiens
taatgcttaatttcta

SEQ ID NO: 4101977 - DNA, 14 bp, Homo sapiens
taatgcttcagata

SEQ ID NO: 4101978 - DNA, 14 bp, Homo sapiens
taatgcttcattca

SEQ ID NO: 4101979 - DNA, 14 bp, Homo sapiens
taatgcttccaatc

SEQ ID NO: 4101980 - DNA, 19 bp, Homo sapiens
taatgcttgtttatgatat

SEQ ID NO: 4101981 - DNA, 19 bp, Homo sapiens
taatgctttcacaacattt

SEQ ID NO: 4101982 - DNA, 19 bp, Homo sapiens
taatggaagtgtatttatt

SEQ ID NO: 4101983 - DNA, 23 bp, Homo sapiens
taatggaagtgtatttattttac

SEQ ID NO: 4101984 - DNA, 14 bp, Homo sapiens
taatggattaaatt

SEQ ID NO: 4101985 - DNA, 20 bp, Homo sapiens
taatggcagctagtgccttt

SEQ ID NO: 4101986 - DNA, 19 bp, Homo sapiens
taatgtaaagaacttaaat

SEQ ID NO: 4101987 - DNA, 18 bp, Homo sapiens
taatgtaataactgtgaa

SEQ ID NO: 4101988 - DNA, 13 bp, Homo sapiens
taatgtactgcat

SEQ ID NO: 4101989 - DNA, 22 bp, Homo sapiens
taatgtagcgtgtttacatgtg

SEQ ID NO: 4101990 - DNA, 16 bp, Homo sapiens
taatgtcatgttgctt

SEQ ID NO: 4101991 - DNA, 15 bp, Homo sapiens
taatgtctcactgtt

SEQ ID NO: 4101992 - DNA, 17 bp, Homo sapiens
taatgtctcactgttct

SEQ ID NO: 4101993 - DNA, 18 bp, Homo sapiens
taatgtctcactgttctg

SEQ ID NO: 4101994 - DNA, 12 bp, Homo sapiens
taaagctggccc

SEQ ID NO: 4101995 - DNA, 13 bp, Homo sapiens
taaagctggccct

SEQ ID NO: 4101996 - DNA, 16 bp, Homo sapiens
taaagctggccctgcc

SEQ ID NO: 4101997 - DNA, 22 bp, Homo sapiens
taaagcttactctgtccattta

SEQ ID NO: 4101998 - DNA, 20 bp, Homo sapiens
taaagcttatttttctgtga

SEQ ID NO: 4101999 - DNA, 11 bp, Homo sapiens
taaagcttcag

SEQ ID NO: 4102000 - DNA, 19 bp, Homo sapiens
taaagcttgcaacaaaatt

SEQ ID NO: 4102001 - DNA, 15 bp, Homo sapiens
taaagcttttattcg

SEQ ID NO: 4102002 - DNA, 23 bp, Homo sapiens
taaaggagcatttttttattcag

SEQ ID NO: 4102003 - DNA, 20 bp, Homo sapiens
taaaggagttaagagtagca

SEQ ID NO: 4102004 - DNA, 22 bp, Homo sapiens
taaaggatgtgattgtggaatg

SEQ ID NO: 4102005 - DNA, 20 bp, Homo sapiens
taaaggcagctgttgtctct

SEQ ID NO: 4102006 - DNA, 17 bp, Homo sapiens
taaaggcttaggcatgt

SEQ ID NO: 4102007 - DNA, 23 bp, Homo sapiens
taaagggacacccctacacacac

SEQ ID NO: 4102008 - DNA, 14 bp, Homo sapiens
taaaggggggaggg

SEQ ID NO: 4102009 - DNA, 21 bp, Homo sapiens
taaagggttgaaaatgtgttt

SEQ ID NO: 4102010 - DNA, 15 bp, Homo sapiens
taaaggtttttaaat

SEQ ID NO: 4102011 - DNA, 15 bp, Homo sapiens
taaagtaaagctaaa

SEQ ID NO: 4102012 - DNA, 18 bp, Homo sapiens
taaagtacagcctggacc

SEQ ID NO: 4102013 - DNA, 18 bp, Homo sapiens
taaagtagaagagggttt

SEQ ID NO: 4102014 - DNA, 14 bp, Homo sapiens
taaagtatatattt

SEQ ID NO: 4102015 - DNA, 17 bp, Homo sapiens
taaagtatatatttatt

SEQ ID NO: 4102016 - DNA, 21 bp, Homo sapiens
taaagtatttttataaatata

SEQ ID NO: 4102017 - DNA, 23 bp, Homo sapiens
taaagtatttttataaatataag

SEQ ID NO: 4102018 - DNA, 17 bp, Homo sapiens
taaagtcaggtccaatt

SEQ ID NO: 4102019 - DNA, 18 bp, Homo sapiens
taaagtctaaacaaaatt

SEQ ID NO: 4102020 - DNA, 14 bp, Homo sapiens
taaagtctgaatca

SEQ ID NO: 4102021 - DNA, 15 bp, Homo sapiens
taaagtgcttgcttt

SEQ ID NO: 4102022 - DNA, 21 bp, Homo sapiens
taaagtgggttattctggagt

SEQ ID NO: 4102023 - DNA, 22 bp, Homo sapiens
taaagtgggttattctggagtt

SEQ ID NO: 4102024 - DNA, 22 bp, Homo sapiens
taaagtgtaaatcctttttctt

SEQ ID NO: 4102025 - DNA, 13 bp, Homo sapiens
taaagtgttactt

SEQ ID NO: 4102026 - DNA, 14 bp, Homo sapiens
taaagttgcacatg

SEQ ID NO: 4102027 - DNA, 19 bp, Homo sapiens
taaagtttttaaagtgtgt

SEQ ID NO: 4102028 - DNA, 17 bp, Homo sapiens
taaataaaaaaagacaa

SEQ ID NO: 4102029 - DNA, 13 bp, Homo sapiens
taaataaaactga

SEQ ID NO: 4102030 - DNA, 14 bp, Homo sapiens
taaataaaagcagc

SEQ ID NO: 4102031 - DNA, 19 bp, Homo sapiens
taaataaaagcagcatctg

SEQ ID NO: 4102032 - DNA, 14 bp, Homo sapiens
taaataaaatcaat

SEQ ID NO: 4102033 - DNA, 15 bp, Homo sapiens
taaataaaatcaatt

SEQ ID NO: 4102034 - DNA, 22 bp, Homo sapiens
taaataaacctcaaaatgtcta

SEQ ID NO: 4102035 - DNA, 19 bp, Homo sapiens
taaataatgaataaactga

SEQ ID NO: 4102036 - DNA, 21 bp, Homo sapiens
taaataatgaataaactgaat

SEQ ID NO: 4102037 - DNA, 13 bp, Homo sapiens
taaataatgtagt

SEQ ID NO: 4102038 - DNA, 14 bp, Homo sapiens
taaataatttctac

SEQ ID NO: 4102039 - DNA, 15 bp, Homo sapiens
taaatacaaatctgt

SEQ ID NO: 4102040 - DNA, 18 bp, Homo sapiens
taaatacaagactgttgt

SEQ ID NO: 4102041 - DNA, 22 bp, Homo sapiens
taaatacagacactaagttata

SEQ ID NO: 4102042 - DNA, 13 bp, Homo sapiens
taaatactgtgca

SEQ ID NO: 4102043 - DNA, 17 bp, Homo sapiens
taaatactgtgcagaat

SEQ ID NO: 4102044 - DNA, 19 bp, Homo sapiens
taaatactgtgcagaataa

SEQ ID NO: 4102045 - DNA, 22 bp, Homo sapiens
taaatactgtgcagaataatgg

SEQ ID NO: 4102046 - DNA, 23 bp, Homo sapiens
taaatacttcatgagcattcata

SEQ ID NO: 4102047 - DNA, 17 bp, Homo sapiens
taaatagctatatccat

SEQ ID NO: 4102048 - DNA, 21 bp, Homo sapiens
taaataggagaggatgagagc

SEQ ID NO: 4102049 - DNA, 13 bp, Homo sapiens
taaatataattct

SEQ ID NO: 4102050 - DNA, 15 bp, Homo sapiens
taaatataattctgt

SEQ ID NO: 4102051 - DNA, 16 bp, Homo sapiens
taaatatatgtctgat

SEQ ID NO: 4102052 - DNA, 22 bp, Homo sapiens
taaatatatttaagataattat

SEQ ID NO: 4102053 - DNA, 19 bp, Homo sapiens
taaatatcacagtattatc

SEQ ID NO: 4102054 - DNA, 20 bp, Homo sapiens
taaatatcacagtattatct

SEQ ID NO: 4102055 - DNA, 14 bp, Homo sapiens
taaatatcttttat

SEQ ID NO: 4102056 - DNA, 22 bp, Homo sapiens
taaatatcttttatgtttgaat

SEQ ID NO: 4102057 - DNA, 13 bp, Homo sapiens
taaatatgcagtg

SEQ ID NO: 4102058 - DNA, 18 bp, Homo sapiens
taaatatgtacatttgtc

SEQ ID NO: 4102059 - DNA, 19 bp, Homo sapiens
taaatattctatatgaatt

SEQ ID NO: 4102060 - DNA, 12 bp, Homo sapiens
taaatattgagg

SEQ ID NO: 4102061 - DNA, 21 bp, Homo sapiens
taaatattgaggctttgtgtt

SEQ ID NO: 4102062 - DNA, 17 bp, Homo sapiens
taaatatttatgtagat

SEQ ID NO: 4102063 - DNA, 12 bp, Homo sapiens
taaatatttcct

SEQ ID NO: 4102064 - DNA, 13 bp, Homo sapiens
taaatatttcctt

SEQ ID NO: 4102065 - DNA, 15 bp, Homo sapiens
taaatatttccttaa

SEQ ID NO: 4102066 - DNA, 13 bp, Homo sapiens
taaatcagaataa

SEQ ID NO: 4102067 - DNA, 14 bp, Homo sapiens
taaatcagaataaa

SEQ ID NO: 4102068 - DNA, 12 bp, Homo sapiens
taaatcagacca

SEQ ID NO: 4102069 - DNA, 12 bp, Homo sapiens
taaatcatgtat

SEQ ID NO: 4102070 - DNA, 16 bp, Homo sapiens
taaatcatgtatgtta

SEQ ID NO: 4102071 - DNA, 14 bp, Homo sapiens
taaatcattaatac

SEQ ID NO: 4102072 - DNA, 15 bp, Homo sapiens
taaatcatttcagta

SEQ ID NO: 4102073 - DNA, 14 bp, Homo sapiens
taaatctaaatcta

SEQ ID NO: 4102074 - DNA, 15 bp, Homo sapiens
taaatctaaatctat

SEQ ID NO: 4102075 - DNA, 16 bp, Homo sapiens
taaatctatttattaa

SEQ ID NO: 4102076 - DNA, 15 bp, Homo sapiens
taaatctcttctttg

SEQ ID NO: 4102077 - DNA, 17 bp, Homo sapiens
taaatctgacccagtgc

SEQ ID NO: 4102078 - DNA, 20 bp, Homo sapiens
taaatctgctggagtttcat

SEQ ID NO: 4102079 - DNA, 12 bp, Homo sapiens
taaatcttcctt

SEQ ID NO: 4102080 - DNA, 16 bp, Homo sapiens
taaatcttccttgtga

SEQ ID NO: 4102081 - DNA, 14 bp, Homo sapiens
taaatcttttacaa

SEQ ID NO: 4102082 - DNA, 23 bp, Homo sapiens
taaatgaatctcgttcccaaaga

SEQ ID NO: 4102083 - DNA, 19 bp, Homo sapiens
taaatgattttaattttat

SEQ ID NO: 4102084 - DNA, 14 bp, Homo sapiens
taaatgcaataatt

SEQ ID NO: 4102085 - DNA, 15 bp, Homo sapiens
taaatgcaataattt

SEQ ID NO: 4102086 - DNA, 16 bp, Homo sapiens
taaatgcaccaagaaa

SEQ ID NO: 4102087 - DNA, 22 bp, Homo sapiens
taaatgccctcttctcgtgcct

SEQ ID NO: 4102088 - DNA, 15 bp, Homo sapiens
taaatgctatttttt

SEQ ID NO: 4102089 - DNA, 23 bp, Homo sapiens
taaatgctattttttattttact

SEQ ID NO: 4102090 - DNA, 20 bp, Homo sapiens
taaatgctcattttctggtt

SEQ ID NO: 4102091 - DNA, 17 bp, Homo sapiens
taaatggcagtatttca

SEQ ID NO: 4102092 - DNA, 19 bp, Homo sapiens
taaatgggtgtatataatt

SEQ ID NO: 4102093 - DNA, 17 bp, Homo sapiens
taaatggtcgcccagga

SEQ ID NO: 4102094 - DNA, 18 bp, Homo sapiens
taaatggtgctgcagatt

SEQ ID NO: 4102095 - DNA, 21 bp, Homo sapiens
taaatggtgtacataatgtat

SEQ ID NO: 4102096 - DNA, 18 bp, Homo sapiens
taaatggtttctgaaaat

SEQ ID NO: 4102097 - DNA, 17 bp, Homo sapiens
taaatgtacctgatgta

SEQ ID NO: 4102098 - DNA, 17 bp, Homo sapiens
taacctagaagtatttt

SEQ ID NO: 4102099 - DNA, 13 bp, Homo sapiens
taacctcagctct

SEQ ID NO: 4102100 - DNA, 14 bp, Homo sapiens
taacctcagctctg

SEQ ID NO: 4102101 - DNA, 14 bp, Homo sapiens
taacctctgcacta

SEQ ID NO: 4102102 - DNA, 13 bp, Homo sapiens
taacctctgggga

SEQ ID NO: 4102103 - DNA, 18 bp, Homo sapiens
taacctggtgctggatat

SEQ ID NO: 4102104 - DNA, 22 bp, Homo sapiens
taacctggtgctggatattttc

SEQ ID NO: 4102105 - DNA, 17 bp, Homo sapiens
taaccttatatttacaa

SEQ ID NO: 4102106 - DNA, 18 bp, Homo sapiens
taaccttatatttacaat

SEQ ID NO: 4102107 - DNA, 18 bp, Homo sapiens
taaccttgaatgctgcca

SEQ ID NO: 4102108 - DNA, 16 bp, Homo sapiens
taacctttttgtaaat

SEQ ID NO: 4102109 - DNA, 17 bp, Homo sapiens
taacctttttgtaaata

SEQ ID NO: 4102110 - DNA, 23 bp, Homo sapiens
taacgacttcagggcagggctct

SEQ ID NO: 4102111 - DNA, 23 bp, Homo sapiens
taacgcaccgactagacacacaa

SEQ ID NO: 4102112 - DNA, 16 bp, Homo sapiens
taacgcgtcttcctga

SEQ ID NO: 4102113 - DNA, 12 bp, Homo sapiens
taacggctccag

SEQ ID NO: 4102114 - DNA, 18 bp, Homo sapiens
taacggctccaggatttt

SEQ ID NO: 4102115 - DNA, 16 bp, Homo sapiens
taacgggaggctgggc

SEQ ID NO: 4102116 - DNA, 15 bp, Homo sapiens
taacgtgtgctgtgt

SEQ ID NO: 4102117 - DNA, 15 bp, Homo sapiens
taacgtttttccttt

SEQ ID NO: 4102118 - DNA, 14 bp, Homo sapiens
taactaaaaggtat

SEQ ID NO: 4102119 - DNA, 15 bp, Homo sapiens
taactaactggcagg

SEQ ID NO: 4102120 - DNA, 23 bp, Homo sapiens
taactaatttgaatgtggttact

SEQ ID NO: 4102121 - DNA, 12 bp, Homo sapiens
taactacattta

SEQ ID NO: 4102122 - DNA, 15 bp, Homo sapiens
taactactagttttt

SEQ ID NO: 4102123 - DNA, 16 bp, Homo sapiens
taactactgtgttcct

SEQ ID NO: 4102124 - DNA, 16 bp, Homo sapiens
taactaggctcagaga

SEQ ID NO: 4102125 - DNA, 17 bp, Homo sapiens
taactatatttgctttt

SEQ ID NO: 4102126 - DNA, 18 bp, Homo sapiens
taactatatttgcttttt

SEQ ID NO: 4102127 - DNA, 15 bp, Homo sapiens
taactattgcattta

SEQ ID NO: 4102128 - DNA, 15 bp, Homo sapiens
taactcatcataaaa

SEQ ID NO: 4102129 - DNA, 19 bp, Homo sapiens
taactcctgtcccttttcc

SEQ ID NO: 4102130 - DNA, 13 bp, Homo sapiens
taactgaaaatgt

SEQ ID NO: 4102131 - DNA, 15 bp, Homo sapiens
taactgaaaatgtaa

SEQ ID NO: 4102132 - DNA, 21 bp, Homo sapiens
taactgtaggtatgatctctt

SEQ ID NO: 4102133 - DNA, 15 bp, Homo sapiens
taactgtgctgaatg

SEQ ID NO: 4102134 - DNA, 16 bp, Homo sapiens
taactgtgctgaatgc

SEQ ID NO: 4102135 - DNA, 15 bp, Homo sapiens
taactgtgtactgtt

SEQ ID NO: 4102136 - DNA, 22 bp, Homo sapiens
taactgtgtatgtacatatata

SEQ ID NO: 4102137 - DNA, 17 bp, Homo sapiens
taacttaaaaatgtaaa

SEQ ID NO: 4102138 - DNA, 22 bp, Homo sapiens
taacttcacattaaaaaatgaa

SEQ ID NO: 4102139 - DNA, 13 bp, Homo sapiens
taacttcctgctg

SEQ ID NO: 4102140 - DNA, 14 bp, Homo sapiens
taacttcctgtact

SEQ ID NO: 4102141 - DNA, 18 bp, Homo sapiens
taacttctatattttaat

SEQ ID NO: 4102142 - DNA, 17 bp, Homo sapiens
taacttcttatggaatt

SEQ ID NO: 4102143 - DNA, 18 bp, Homo sapiens
taacttcttatggaattg

SEQ ID NO: 4102144 - DNA, 19 bp, Homo sapiens
taacttcttatggaattga

SEQ ID NO: 4102145 - DNA, 23 bp, Homo sapiens
taacttcttatggaattgatttg

SEQ ID NO: 4102146 - DNA, 15 bp, Homo sapiens
taacttgagttttat

SEQ ID NO: 4102147 - DNA, 19 bp, Homo sapiens
taacttgcttaaatttctt

SEQ ID NO: 4102148 - DNA, 20 bp, Homo sapiens
taacttgcttaaatttctta

SEQ ID NO: 4102149 - DNA, 14 bp, Homo sapiens
taacttggggaggc

SEQ ID NO: 4102150 - DNA, 15 bp, Homo sapiens
taactttatcacatt

SEQ ID NO: 4102151 - DNA, 23 bp, Homo sapiens
taactttcagaagagatgggctt

SEQ ID NO: 4102152 - DNA, 15 bp, Homo sapiens
taactttcagaggca

SEQ ID NO: 4102153 - DNA, 20 bp, Homo sapiens
taacttttcaatgacatttt

SEQ ID NO: 4102154 - DNA, 21 bp, Homo sapiens
taagaaaagatacgactttat

SEQ ID NO: 4102155 - DNA, 13 bp, Homo sapiens
taagaaaagcact

SEQ ID NO: 4102156 - DNA, 14 bp, Homo sapiens
taagaaaagcactt

SEQ ID NO: 4102157 - DNA, 14 bp, Homo sapiens
taagaaaagtattt

SEQ ID NO: 4102158 - DNA, 20 bp, Homo sapiens
taagaaaagtattttgaagt

SEQ ID NO: 4102159 - DNA, 21 bp, Homo sapiens
taagaaaagtattttgaagtt

SEQ ID NO: 4102160 - DNA, 17 bp, Homo sapiens
taagaacttcattttta

SEQ ID NO: 4102161 - DNA, 14 bp, Homo sapiens
taagaagacatgaa

SEQ ID NO: 4102162 - DNA, 14 bp, Homo sapiens
taagaagagactgg

SEQ ID NO: 4102163 - DNA, 18 bp, Homo sapiens
taagaagctgttgtacat

SEQ ID NO: 4102164 - DNA, 19 bp, Homo sapiens
taagaagctgttgtacatt

SEQ ID NO: 4102165 - DNA, 22 bp, Homo sapiens
taagaagctgttgtacatttat

SEQ ID NO: 4102166 - DNA, 20 bp, Homo sapiens
taagaaggcaatattaacct

SEQ ID NO: 4102167 - DNA, 19 bp, Homo sapiens
taagaatatctgtaatggt

SEQ ID NO: 4102168 - DNA, 21 bp, Homo sapiens
taagaatatgtttccttgttt

SEQ ID NO: 4102169 - DNA, 14 bp, Homo sapiens
taagaatctttaga

SEQ ID NO: 4102170 - DNA, 15 bp, Homo sapiens
taagaatgctggttt

SEQ ID NO: 4102171 - DNA, 22 bp, Homo sapiens
taagaatgctggttttcctaaa

SEQ ID NO: 4102172 - DNA, 18 bp, Homo sapiens
taagaattcaaactgggg

SEQ ID NO: 4102173 - DNA, 19 bp, Homo sapiens
taagaattgagtaatggtg

SEQ ID NO: 4102174 - DNA, 13 bp, Homo sapiens
taagaattgttta

SEQ ID NO: 4102175 - DNA, 19 bp, Homo sapiens
taagacagtcccatcaaaa

SEQ ID NO: 4102176 - DNA, 16 bp, Homo sapiens
taagacataacgtttt

SEQ ID NO: 4102177 - DNA, 17 bp, Homo sapiens
taagacataacgttttt

SEQ ID NO: 4102178 - DNA, 17 bp, Homo sapiens
taagacctggcagctct

SEQ ID NO: 4102179 - DNA, 22 bp, Homo sapiens
taagactgaatgttttatttat

SEQ ID NO: 4102180 - DNA, 20 bp, Homo sapiens
taagagaaaattgcactaaa

SEQ ID NO: 4102181 - DNA, 13 bp, Homo sapiens
taagagaaacttt

SEQ ID NO: 4102182 - DNA, 14 bp, Homo sapiens
taagagaaacttta

SEQ ID NO: 4102183 - DNA, 18 bp, Homo sapiens
taagagaaagaaaatgaa

SEQ ID NO: 4102184 - DNA, 15 bp, Homo sapiens
taagagcaccttcct

SEQ ID NO: 4102185 - DNA, 18 bp, Homo sapiens
taagaggtgttatttgga

SEQ ID NO: 4102186 - DNA, 14 bp, Homo sapiens
taagagtactggga

SEQ ID NO: 4102187 - DNA, 23 bp, Homo sapiens
taagagtattttaagaagacata

SEQ ID NO: 4102188 - DNA, 12 bp, Homo sapiens
taagagtgtaga

SEQ ID NO: 4102189 - DNA, 18 bp, Homo sapiens
taagagtgtagaagcatt

SEQ ID NO: 4102190 - DNA, 23 bp, Homo sapiens
taagataatagtttacatgtagt

SEQ ID NO: 4102191 - DNA, 14 bp, Homo sapiens
taagatacaaatta

SEQ ID NO: 4102192 - DNA, 22 bp, Homo sapiens
taagatacaaattaattttact

SEQ ID NO: 4102193 - DNA, 18 bp, Homo sapiens
taagatacatatactgat

SEQ ID NO: 4102194 - DNA, 20 bp, Homo sapiens
taagatacatatactgattc

SEQ ID NO: 4102195 - DNA, 20 bp, Homo sapiens
taagatagtgtaacttgctt

SEQ ID NO: 4102196 - DNA, 21 bp, Homo sapiens
taagatatccatctttttctt

SEQ ID NO: 4102197 - DNA, 20 bp, Homo sapiens
taagatgccagcatatactg

SEQ ID NO: 4102198 - DNA, 15 bp, Homo sapiens
taagatggattctca

SEQ ID NO: 4102199 - DNA, 17 bp, Homo sapiens
taagatggattctcaga

SEQ ID NO: 4102200 - DNA, 21 bp, Homo sapiens
taagatggattctcagatatt

SEQ ID NO: 4102201 - DNA, 21 bp, Homo sapiens
taagattccagagagtggctc

SEQ ID NO: 4102202 - DNA, 23 bp, Homo sapiens
taagatttgtgtttttctttttc

SEQ ID NO: 4102203 - DNA, 12 bp, Homo sapiens
taagattttaca

SEQ ID NO: 4102204 - DNA, 16 bp, Homo sapiens
taagatttttctcaaa

SEQ ID NO: 4102205 - DNA, 22 bp, Homo sapiens
taagcaaaggggacagctgtgt

SEQ ID NO: 4102206 - DNA, 15 bp, Homo sapiens
taagcagcatggaaa

SEQ ID NO: 4102207 - DNA, 21 bp, Homo sapiens
taagcaggagagaaatttctc

SEQ ID NO: 4102208 - DNA, 15 bp, Homo sapiens
taagcagtaaaaact

SEQ ID NO: 4102209 - DNA, 22 bp, Homo sapiens
taagcatgctttctttgagttt

SEQ ID NO: 4102210 - DNA, 17 bp, Homo sapiens
taagcatgtgtcccagg

SEQ ID NO: 4102211 - DNA, 12 bp, Homo sapiens
taagcattgttt

SEQ ID NO: 4102212 - DNA, 15 bp, Homo sapiens
taagcattgtttgct

SEQ ID NO: 4102213 - DNA, 19 bp, Homo sapiens
taagccagttttcattttg

SEQ ID NO: 4102214 - DNA, 20 bp, Homo sapiens
taagccctgtcgagacactt

SEQ ID NO: 4102215 - DNA, 16 bp, Homo sapiens
taagcctaaaagtggg

SEQ ID NO: 4102216 - DNA, 19 bp, Homo sapiens
taagcctccatttagttct

SEQ ID NO: 4102217 - DNA, 15 bp, Homo sapiens
taagcctttccataa

SEQ ID NO: 4102218 - DNA, 23 bp, Homo sapiens
taagcggaataaactagagaagg

SEQ ID NO: 4102219 - DNA, 21 bp, Homo sapiens
taagctaaagaggctgaaaga

SEQ ID NO: 4102220 - DNA, 21 bp, Homo sapiens
taagctattcagtaataactc

SEQ ID NO: 4102221 - DNA, 15 bp, Homo sapiens
taagctcagtgctct

SEQ ID NO: 4102222 - DNA, 20 bp, Homo sapiens
taagctggctctgtttgatg

SEQ ID NO: 4102223 - DNA, 19 bp, Homo sapiens
taagctgtgccttcagctg

SEQ ID NO: 4102224 - DNA, 11 bp, Homo sapiens
taagctgtttc

SEQ ID NO: 4102225 - DNA, 17 bp, Homo sapiens
taaggaaaaaaagacaa

SEQ ID NO: 4102226 - DNA, 16 bp, Homo sapiens
taaggaaagcaataaa

SEQ ID NO: 4102227 - DNA, 18 bp, Homo sapiens
taaggaaagcaataaatg

SEQ ID NO: 4102228 - DNA, 15 bp, Homo sapiens
taaggacacactaat

SEQ ID NO: 4102229 - DNA, 13 bp, Homo sapiens
taaggacttcctg

SEQ ID NO: 4102230 - DNA, 20 bp, Homo sapiens
taaggatgtcacagggccaa

SEQ ID NO: 4102231 - DNA, 21 bp, Homo sapiens
taaggctgagggctgccagca

SEQ ID NO: 4102232 - DNA, 22 bp, Homo sapiens
taaggctgagggctgccagcag

SEQ ID NO: 4102233 - DNA, 15 bp, Homo sapiens
taagggaagacattt

SEQ ID NO: 4102234 - DNA, 20 bp, Homo sapiens
taagggttagtttacaatca

SEQ ID NO: 4102235 - DNA, 13 bp, Homo sapiens
taagggttttaga

SEQ ID NO: 4102236 - DNA, 20 bp, Homo sapiens
taaggtatttcgaaactgcc

SEQ ID NO: 4102237 - DNA, 15 bp, Homo sapiens
taaggtcaagggaaa

SEQ ID NO: 4102238 - DNA, 19 bp, Homo sapiens
taaggtccaacaagaatgc

SEQ ID NO: 4102239 - DNA, 20 bp, Homo sapiens
taaggtgatatatttaaaaa

SEQ ID NO: 4102240 - DNA, 22 bp, Homo sapiens
taagtaaatctcttctgtgttt

SEQ ID NO: 4102241 - DNA, 16 bp, Homo sapiens
taagtaattcaagaaa

SEQ ID NO: 4102242 - DNA, 19 bp, Homo sapiens
taagtactacacattttta

SEQ ID NO: 4102243 - DNA, 22 bp, Homo sapiens
taagtactagatgcatcactgg

SEQ ID NO: 4102244 - DNA, 12 bp, Homo sapiens
taagtagtttct

SEQ ID NO: 4102245 - DNA, 14 bp, Homo sapiens
taagtatgttattt

SEQ ID NO: 4102246 - DNA, 21 bp, Homo sapiens
taagtattcttatttaatgaa

SEQ ID NO: 4102247 - DNA, 13 bp, Homo sapiens
taagtatttatat

SEQ ID NO: 4102248 - DNA, 14 bp, Homo sapiens
taagtatttatata

SEQ ID NO: 4102249 - DNA, 13 bp, Homo sapiens
taagtatttctga

SEQ ID NO: 4102250 - DNA, 13 bp, Homo sapiens
taagtcagtgttg

SEQ ID NO: 4102251 - DNA, 15 bp, Homo sapiens
taagtcagtgttgag

SEQ ID NO: 4102252 - DNA, 17 bp, Homo sapiens
taagtcagtgttgagat

SEQ ID NO: 4102253 - DNA, 18 bp, Homo sapiens
taagtctaaatatttcct

SEQ ID NO: 4102254 - DNA, 14 bp, Homo sapiens
taagtctcctgtct

SEQ ID NO: 4102255 - DNA, 13 bp, Homo sapiens
taagtgaatttat

SEQ ID NO: 4102256 - DNA, 16 bp, Homo sapiens
taagtgcgtgtgtaga

SEQ ID NO: 4102257 - DNA, 21 bp, Homo sapiens
taagtgcgtgtgtagagttaa

SEQ ID NO: 4102258 - DNA, 13 bp, Homo sapiens
taagtgctttgta

SEQ ID NO: 4102259 - DNA, 15 bp, Homo sapiens
taagtggaggcactt

SEQ ID NO: 4102260 - DNA, 18 bp, Homo sapiens
taagtgtatttttcaata

SEQ ID NO: 4102261 - DNA, 21 bp, Homo sapiens
taagtgtgtggtagaaacaaa

SEQ ID NO: 4102262 - DNA, 17 bp, Homo sapiens
taagttaataatgtatt

SEQ ID NO: 4102263 - DNA, 14 bp, Homo sapiens
taagttatagtata

SEQ ID NO: 4102264 - DNA, 18 bp, Homo sapiens
taagttatttttgtacat

SEQ ID NO: 4102265 - DNA, 12 bp, Homo sapiens
taagttgtacaa

SEQ ID NO: 4102266 - DNA, 22 bp, Homo sapiens
taagttgtacaaatgtattttg

SEQ ID NO: 4102267 - DNA, 16 bp, Homo sapiens
taagtttacaccttta

SEQ ID NO: 4102268 - DNA, 17 bp, Homo sapiens
taagtttcaggtgacat

SEQ ID NO: 4102269 - DNA, 20 bp, Homo sapiens
taagtttcaggtgacatgtg

SEQ ID NO: 4102270 - DNA, 22 bp, Homo sapiens
taagtttcaggtgacatgtgaa

SEQ ID NO: 4102271 - DNA, 22 bp, Homo sapiens
taagttttttttttctcctctc

SEQ ID NO: 4102272 - DNA, 17 bp, Homo sapiens
taataaaaaaagaaagc

SEQ ID NO: 4102273 - DNA, 19 bp, Homo sapiens
taataaaaaaagaaagcat

SEQ ID NO: 4102274 - DNA, 19 bp, Homo sapiens
taataaaaaatggaaagaa

SEQ ID NO: 4102275 - DNA, 23 bp, Homo sapiens
taataaaaagctttttcctcctg

SEQ ID NO: 4102276 - DNA, 13 bp, Homo sapiens
taataaaaggaaa

SEQ ID NO: 4102277 - DNA, 13 bp, Homo sapiens
taataaaataatt

SEQ ID NO: 4102278 - DNA, 21 bp, Homo sapiens
taataaagaaatatttaccta

SEQ ID NO: 4102279 - DNA, 22 bp, Homo sapiens
taataaagaaatatttacctaa

SEQ ID NO: 4102280 - DNA, 20 bp, Homo sapiens
taataaagaattaacagaga

SEQ ID NO: 4102281 - DNA, 21 bp, Homo sapiens
taataaagacactggcagaga

SEQ ID NO: 4102282 - DNA, 12 bp, Homo sapiens
taataaaggact

SEQ ID NO: 4102283 - DNA, 14 bp, Homo sapiens
taataaagtatata

SEQ ID NO: 4102284 - DNA, 15 bp, Homo sapiens
taataaatatttatg

SEQ ID NO: 4102285 - DNA, 14 bp, Homo sapiens
taataaatcacaca

SEQ ID NO: 4102286 - DNA, 14 bp, Homo sapiens
taataaatgccctc

SEQ ID NO: 4102287 - DNA, 13 bp, Homo sapiens
taataaattcaga

SEQ ID NO: 4102288 - DNA, 15 bp, Homo sapiens
taataaattcagata

SEQ ID NO: 4102289 - DNA, 13 bp, Homo sapiens
taataaattgaaa

SEQ ID NO: 4102290 - DNA, 13 bp, Homo sapiens
taataaccagaca

SEQ ID NO: 4102291 - DNA, 15 bp, Homo sapiens
taataaccagacaca

SEQ ID NO: 4102292 - DNA, 13 bp, Homo sapiens
taataactgtgta

SEQ ID NO: 4102293 - DNA, 17 bp, Homo sapiens
taataactgtgtactgt

SEQ ID NO: 4102294 - DNA, 12 bp, Homo sapiens
taataagacata

SEQ ID NO: 4102295 - DNA, 20 bp, Homo sapiens
taataagacataacgttttt

SEQ ID NO: 4102296 - DNA, 15 bp, Homo sapiens
taataagattagttg

SEQ ID NO: 4102297 - DNA, 20 bp, Homo sapiens
taataatagttattatttaa

SEQ ID NO: 4102298 - DNA, 14 bp, Homo sapiens
taataatgtattgt

SEQ ID NO: 4102299 - DNA, 17 bp, Homo sapiens
taataattattattaaa

SEQ ID NO: 4102300 - DNA, 21 bp, Homo sapiens
taatacaggacttttaaatgg

SEQ ID NO: 4102301 - DNA, 14 bp, Homo sapiens
taatactaccttga

SEQ ID NO: 4102302 - DNA, 19 bp, Homo sapiens
taatactggaataatttgt

SEQ ID NO: 4102303 - DNA, 22 bp, Homo sapiens
taatactggaataatttgtaaa

SEQ ID NO: 4102304 - DNA, 19 bp, Homo sapiens
taatagactgagtcagatg

SEQ ID NO: 4102305 - DNA, 19 bp, Homo sapiens
tacaaaaaaaaagttttat

SEQ ID NO: 4102306 - DNA, 19 bp, Homo sapiens
tacaaaacctgatgttaaa

SEQ ID NO: 4102307 - DNA, 12 bp, Homo sapiens
tacaaaacttcc

SEQ ID NO: 4102308 - DNA, 23 bp, Homo sapiens
tacaaaagaggagcacttccaaa

SEQ ID NO: 4102309 - DNA, 13 bp, Homo sapiens
tacaaactgcaat

SEQ ID NO: 4102310 - DNA, 22 bp, Homo sapiens
tacaaactgcaatagagactgt

SEQ ID NO: 4102311 - DNA, 22 bp, Homo sapiens
tacaaagtaaatacaagactgt

SEQ ID NO: 4102312 - DNA, 16 bp, Homo sapiens
tacaaagtaatttctt

SEQ ID NO: 4102313 - DNA, 17 bp, Homo sapiens
tacaaagtaatttcttt

SEQ ID NO: 4102314 - DNA, 18 bp, Homo sapiens
tacaaagtagaagtctta

SEQ ID NO: 4102315 - DNA, 19 bp, Homo sapiens
tacaaatactcttaggaag

SEQ ID NO: 4102316 - DNA, 13 bp, Homo sapiens
tacaaatgcctta

SEQ ID NO: 4102317 - DNA, 20 bp, Homo sapiens
tacaaatgccttaaaatgga

SEQ ID NO: 4102318 - DNA, 14 bp, Homo sapiens
tacaaatgtatttt

SEQ ID NO: 4102319 - DNA, 16 bp, Homo sapiens
tacaaatgtattttga

SEQ ID NO: 4102320 - DNA, 17 bp, Homo sapiens
tacaaatgtattttgaa

SEQ ID NO: 4102321 - DNA, 20 bp, Homo sapiens
tacaaatgtattttgaagaa

SEQ ID NO: 4102322 - DNA, 14 bp, Homo sapiens
tacaaattagaaaa

SEQ ID NO: 4102323 - DNA, 15 bp, Homo sapiens
tacaaattataaaaa

SEQ ID NO: 4102324 - DNA, 19 bp, Homo sapiens
tacaaattataaaaagcca

SEQ ID NO: 4102325 - DNA, 21 bp, Homo sapiens
tacaaattataaaaagccact

SEQ ID NO: 4102326 - DNA, 13 bp, Homo sapiens
tacaaccagagcc

SEQ ID NO: 4102327 - DNA, 19 bp, Homo sapiens
tacaaccatccctgccaca

SEQ ID NO: 4102328 - DNA, 17 bp, Homo sapiens
tacaactgattgcaaca

SEQ ID NO: 4102329 - DNA, 15 bp, Homo sapiens
tacaacttaatggaa

SEQ ID NO: 4102330 - DNA, 14 bp, Homo sapiens
tacaacttcagcag

SEQ ID NO: 4102331 - DNA, 17 bp, Homo sapiens
tacaacttgattttttc

SEQ ID NO: 4102332 - DNA, 17 bp, Homo sapiens
tacaagatattgatgat

SEQ ID NO: 4102333 - DNA, 22 bp, Homo sapiens
tacaagatccatttgcctttct

SEQ ID NO: 4102334 - DNA, 23 bp, Homo sapiens
tacaagccaaaagtccctccctg

SEQ ID NO: 4102335 - DNA, 21 bp, Homo sapiens
tacaagccattctaaggaaat

SEQ ID NO: 4102336 - DNA, 22 bp, Homo sapiens
tacaaggtggggattgcccctg

SEQ ID NO: 4102337 - DNA, 20 bp, Homo sapiens
tacaagtatacttatatttc

SEQ ID NO: 4102338 - DNA, 18 bp, Homo sapiens
tacaagtcagctccagct

SEQ ID NO: 4102339 - DNA, 12 bp, Homo sapiens
tacaagtttcag

SEQ ID NO: 4102340 - DNA, 13 bp, Homo sapiens
tacaagtttcaga

SEQ ID NO: 4102341 - DNA, 17 bp, Homo sapiens
tacaagtttcagacagg

SEQ ID NO: 4102342 - DNA, 18 bp, Homo sapiens
tacaagtttcagacaggg

SEQ ID NO: 4102343 - DNA, 16 bp, Homo sapiens
tacaatcagttgactt

SEQ ID NO: 4102344 - DNA, 22 bp, Homo sapiens
tacaatcattgctgaaaatggt

SEQ ID NO: 4102345 - DNA, 14 bp, Homo sapiens
tacaatcctgttta

SEQ ID NO: 4102346 - DNA, 18 bp, Homo sapiens
tacaatcgcaaatcaaaa

SEQ ID NO: 4102347 - DNA, 15 bp, Homo sapiens
tacaatgaacactta

SEQ ID NO: 4102348 - DNA, 17 bp, Homo sapiens
tacaatgtcatatactg

SEQ ID NO: 4102349 - DNA, 16 bp, Homo sapiens
tacaatgtgaacttta

SEQ ID NO: 4102350 - DNA, 17 bp, Homo sapiens
tacaatgtgaactttat

SEQ ID NO: 4102351 - DNA, 21 bp, Homo sapiens
tacaatgtgaactttattaaa

SEQ ID NO: 4102352 - DNA, 12 bp, Homo sapiens
tacaattaaagg

SEQ ID NO: 4102353 - DNA, 22 bp, Homo sapiens
tacaattaaaggtcctgccctc

SEQ ID NO: 4102354 - DNA, 18 bp, Homo sapiens
tacaattctacattgtca

SEQ ID NO: 4102355 - DNA, 13 bp, Homo sapiens
tacacaattctta

SEQ ID NO: 4102356 - DNA, 10 bp, Homo sapiens
tacacacaca

SEQ ID NO: 4102357 - DNA, 14 bp, Homo sapiens
tacacacacactcc

SEQ ID NO: 4102358 - DNA, 19 bp, Homo sapiens
tacacacacactccctgct

SEQ ID NO: 4102359 - DNA, 20 bp, Homo sapiens
tacacactcaggcctgtgcc

SEQ ID NO: 4102360 - DNA, 22 bp, Homo sapiens
tacacactcaggcctgtgccca

SEQ ID NO: 4102361 - DNA, 20 bp, Homo sapiens
tacacactgtcatgcttcat

SEQ ID NO: 4102362 - DNA, 14 bp, Homo sapiens
tacacagcctggac

SEQ ID NO: 4102363 - DNA, 14 bp, Homo sapiens
tacacattagattt

SEQ ID NO: 4102364 - DNA, 23 bp, Homo sapiens
tacacattagattttattttact

SEQ ID NO: 4102365 - DNA, 13 bp, Homo sapiens
tacacatttgtac

SEQ ID NO: 4102366 - DNA, 15 bp, Homo sapiens
tacacatttgtacag

SEQ ID NO: 4102367 - DNA, 23 bp, Homo sapiens
tacacatttttaaattgttagct

SEQ ID NO: 4102368 - DNA, 19 bp, Homo sapiens
tacaccattatcttggaaa

SEQ ID NO: 4102369 - DNA, 14 bp, Homo sapiens
tacacccagacccc

SEQ ID NO: 4102370 - DNA, 15 bp, Homo sapiens
tacaccgggcctgga

SEQ ID NO: 4102371 - DNA, 12 bp, Homo sapiens
tacacctggctg

SEQ ID NO: 4102372 - DNA, 13 bp, Homo sapiens
tacacctggctga

SEQ ID NO: 4102373 - DNA, 14 bp, Homo sapiens
tacacctggctgag

SEQ ID NO: 4102374 - DNA, 15 bp, Homo sapiens
tacacctggctgagg

SEQ ID NO: 4102375 - DNA, 22 bp, Homo sapiens
tacacctggctgaggttcctct

SEQ ID NO: 4102376 - DNA, 23 bp, Homo sapiens
tacacctggctgaggttcctctg

SEQ ID NO: 4102377 - DNA, 20 bp, Homo sapiens
tacaccttgccttgctgttt

SEQ ID NO: 4102378 - DNA, 14 bp, Homo sapiens
tacactaacatttc

SEQ ID NO: 4102379 - DNA, 15 bp, Homo sapiens
tacactaacatttcc

SEQ ID NO: 4102380 - DNA, 14 bp, Homo sapiens
tacactagttgttt

SEQ ID NO: 4102381 - DNA, 14 bp, Homo sapiens
tacactctgctgtt

SEQ ID NO: 4102382 - DNA, 16 bp, Homo sapiens
tacactctttgtaaga

SEQ ID NO: 4102383 - DNA, 17 bp, Homo sapiens
tacactgctgtacccag

SEQ ID NO: 4102384 - DNA, 20 bp, Homo sapiens
tacactgctgtacccagatg

SEQ ID NO: 4102385 - DNA, 23 bp, Homo sapiens
tacactgctgtacccagatgcct

SEQ ID NO: 4102386 - DNA, 14 bp, Homo sapiens
tacactttgttgca

SEQ ID NO: 4102387 - DNA, 19 bp, Homo sapiens
tacagaaatactataacat

SEQ ID NO: 4102388 - DNA, 19 bp, Homo sapiens
tacagaacttcagaaagac

SEQ ID NO: 4102389 - DNA, 21 bp, Homo sapiens
tacagaatatttctattgaat

SEQ ID NO: 4102390 - DNA, 14 bp, Homo sapiens
tacagaatttccac

SEQ ID NO: 4102391 - DNA, 18 bp, Homo sapiens
tacagacaaggttctgcc

SEQ ID NO: 4102392 - DNA, 17 bp, Homo sapiens
tacagacctcagtttta

SEQ ID NO: 4102393 - DNA, 17 bp, Homo sapiens
tacagactccatctctt

SEQ ID NO: 4102394 - DNA, 16 bp, Homo sapiens
tacagagaggagaaac

SEQ ID NO: 4102395 - DNA, 18 bp, Homo sapiens
tacagagaggagaaacac

SEQ ID NO: 4102396 - DNA, 20 bp, Homo sapiens
tacagagaggagaaacacat

SEQ ID NO: 4102397 - DNA, 15 bp, Homo sapiens
tacagagatgtctct

SEQ ID NO: 4102398 - DNA, 12 bp, Homo sapiens
tacagataacat

SEQ ID NO: 4102399 - DNA, 15 bp, Homo sapiens
tacagataacattag

SEQ ID NO: 4102400 - DNA, 17 bp, Homo sapiens
tacagatcctttttcca

SEQ ID NO: 4102401 - DNA, 13 bp, Homo sapiens
tacagatgaaaat

SEQ ID NO: 4102402 - DNA, 14 bp, Homo sapiens
tacagatgaaaatt

SEQ ID NO: 4102403 - DNA, 18 bp, Homo sapiens
tacagatgaatgtattta

SEQ ID NO: 4102404 - DNA, 13 bp, Homo sapiens
tacagccacatcc

SEQ ID NO: 4102405 - DNA, 19 bp, Homo sapiens
tacagcccctttttcatat

SEQ ID NO: 4102406 - DNA, 20 bp, Homo sapiens
tacagcgagaggcagagaaa

SEQ ID NO: 4102407 - DNA, 16 bp, Homo sapiens
tacagctcattaaact

SEQ ID NO: 4102408 - DNA, 17 bp, Homo sapiens
tacagctcccccagctc

SEQ ID NO: 4102409 - DNA, 18 bp, Homo sapiens
tacagctcccccagctcc

SEQ ID NO: 4102410 - DNA, 18 bp, Homo sapiens
tacagctgtattgtctga

SEQ ID NO: 4102411 - DNA, 19 bp, Homo sapiens
tacagctttgatccctgac

SEQ ID NO: 4102412 - DNA, 13 bp, Homo sapiens
tacaggaacttca

SEQ ID NO: 4102413 - DNA, 14 bp, Homo sapiens
tacaggacttttaa

SEQ ID NO: 4102414 - DNA, 17 bp, Homo sapiens
tacaggacttttaaatg

SEQ ID NO: 4102415 - DNA, 20 bp, Homo sapiens
tacaggatttgaactcagat

SEQ ID NO: 4102416 - DNA, 23 bp, Homo sapiens
tacaggatttgaactcagatctg

SEQ ID NO: 4102417 - DNA, 14 bp, Homo sapiens
tacaggcaccgaga

SEQ ID NO: 4102418 - DNA, 15 bp, Homo sapiens
tacaggccctgctcc

SEQ ID NO: 4102419 - DNA, 16 bp, Homo sapiens
tacaggccctgctcct

SEQ ID NO: 4102420 - DNA, 16 bp, Homo sapiens
tacagggagctgggac

SEQ ID NO: 4102421 - DNA, 20 bp, Homo sapiens
tacagggtaactgtgctgaa

SEQ ID NO: 4102422 - DNA, 12 bp, Homo sapiens
tacaggtgctca

SEQ ID NO: 4102423 - DNA, 18 bp, Homo sapiens
tacagtacacagatacct

SEQ ID NO: 4102424 - DNA, 15 bp, Homo sapiens
tacagtccttcaaaa

SEQ ID NO: 4102425 - DNA, 15 bp, Homo sapiens
tacagtcgtaaaaga

SEQ ID NO: 4102426 - DNA, 17 bp, Homo sapiens
tacagtgaccttttctt

SEQ ID NO: 4102427 - DNA, 14 bp, Homo sapiens
tacagtgcagacag

SEQ ID NO: 4102428 - DNA, 15 bp, Homo sapiens
tacagtgcagacagg

SEQ ID NO: 4102429 - DNA, 21 bp, Homo sapiens
tacagtggttttatactgaag

SEQ ID NO: 4102430 - DNA, 23 bp, Homo sapiens
tacagtgtctgtgccatggattt

SEQ ID NO: 4102431 - DNA, 18 bp, Homo sapiens
tacagttagggttttgca

SEQ ID NO: 4102432 - DNA, 13 bp, Homo sapiens
tacagttctgctc

SEQ ID NO: 4102433 - DNA, 16 bp, Homo sapiens
tacataactcctgtcc

SEQ ID NO: 4102434 - DNA, 19 bp, Homo sapiens
tacataactcctgtccctt

SEQ ID NO: 4102435 - DNA, 23 bp, Homo sapiens
tacataactcctgtcccttttcc

SEQ ID NO: 4102436 - DNA, 15 bp, Homo sapiens
tacataagtaattca

SEQ ID NO: 4102437 - DNA, 16 bp, Homo sapiens
tacataagtaattcaa

SEQ ID NO: 4102438 - DNA, 17 bp, Homo sapiens
tacataagtaattcaag

SEQ ID NO: 4102439 - DNA, 21 bp, Homo sapiens
tacataatgcttaatttctaa

SEQ ID NO: 4102440 - DNA, 14 bp, Homo sapiens
tacatagagctcta

SEQ ID NO: 4102441 - DNA, 12 bp, Homo sapiens
tacatagtgtaa

SEQ ID NO: 4102442 - DNA, 15 bp, Homo sapiens
tacatagttttaaac

SEQ ID NO: 4102443 - DNA, 22 bp, Homo sapiens
tacatataaatgaatctggtgt

SEQ ID NO: 4102444 - DNA, 14 bp, Homo sapiens
tacatatatatatt

SEQ ID NO: 4102445 - DNA, 15 bp, Homo sapiens
tacatatatttttaa

SEQ ID NO: 4102446 - DNA, 12 bp, Homo sapiens
tacatatcttta

SEQ ID NO: 4102447 - DNA, 13 bp, Homo sapiens
tacatatgtaaac

SEQ ID NO: 4102448 - DNA, 18 bp, Homo sapiens
tacatattaggaaaatat

SEQ ID NO: 4102449 - DNA, 20 bp, Homo sapiens
tacatcaattggaaatcaat

SEQ ID NO: 4102450 - DNA, 15 bp, Homo sapiens
tacatcactgcttga

SEQ ID NO: 4102451 - DNA, 18 bp, Homo sapiens
tacatcagttattcattc

SEQ ID NO: 4102452 - DNA, 23 bp, Homo sapiens
tacatccaaagcagacagctcca

SEQ ID NO: 4102453 - DNA, 19 bp, Homo sapiens
tacatctattttggattgt

SEQ ID NO: 4102454 - DNA, 22 bp, Homo sapiens
tacatctattttggattgtata

SEQ ID NO: 4102455 - DNA, 22 bp, Homo sapiens
tacatctgtgcagggctggttt

SEQ ID NO: 4102456 - DNA, 20 bp, Homo sapiens
tacatcttctgtgaaatata

SEQ ID NO: 4102457 - DNA, 17 bp, Homo sapiens
tacatcttcttcccagt

SEQ ID NO: 4102458 - DNA, 21 bp, Homo sapiens
tacatgaagaatagaaacaag

SEQ ID NO: 4102459 - DNA, 14 bp, Homo sapiens
tacatgactgggcc

SEQ ID NO: 4102460 - DNA, 19 bp, Homo sapiens
tacatgcaaaaagaaatga

SEQ ID NO: 4102461 - DNA, 17 bp, Homo sapiens
tacatgcagcccatgcc

SEQ ID NO: 4102462 - DNA, 12 bp, Homo sapiens
tacatgcataaa

SEQ ID NO: 4102463 - DNA, 17 bp, Homo sapiens
tacatgcatacaaagag

SEQ ID NO: 4102464 - DNA, 14 bp, Homo sapiens
tacatgctggggtc

SEQ ID NO: 4102465 - DNA, 15 bp, Homo sapiens
tacatggctttgata

SEQ ID NO: 4102466 - DNA, 19 bp, Homo sapiens
tacatgtaaaacattatct

SEQ ID NO: 4102467 - DNA, 19 bp, Homo sapiens
tacatgtgccgaatgtgca

SEQ ID NO: 4102468 - DNA, 16 bp, Homo sapiens
tacatgtgtaaaggtt

SEQ ID NO: 4102469 - DNA, 14 bp, Homo sapiens
tacatgtgtagcct

SEQ ID NO: 4102470 - DNA, 23 bp, Homo sapiens
tacattaatgttaattcagcact

SEQ ID NO: 4102471 - DNA, 19 bp, Homo sapiens
tacattagtaaatgtcttt

SEQ ID NO: 4102472 - DNA, 20 bp, Homo sapiens
tacattagtaaatgtctttg

SEQ ID NO: 4102473 - DNA, 13 bp, Homo sapiens
tacattataaacg

SEQ ID NO: 4102474 - DNA, 17 bp, Homo sapiens
tacattgcctgactaaa

SEQ ID NO: 4102475 - DNA, 15 bp, Homo sapiens
tacattgttcaatta

SEQ ID NO: 4102476 - DNA, 13 bp, Homo sapiens
tacattgttgagc

SEQ ID NO: 4102477 - DNA, 19 bp, Homo sapiens
tacattgtttgtctgtctt

SEQ ID NO: 4102478 - DNA, 23 bp, Homo sapiens
tacattgtttgtctgtcttcata

SEQ ID NO: 4102479 - DNA, 18 bp, Homo sapiens
tacatttaaaattgctat

SEQ ID NO: 4102480 - DNA, 17 bp, Homo sapiens
tacatttaaagcattgc

SEQ ID NO: 4102481 - DNA, 16 bp, Homo sapiens
tacatttatgatttaa

SEQ ID NO: 4102482 - DNA, 16 bp, Homo sapiens
tacatttatttattac

SEQ ID NO: 4102483 - DNA, 14 bp, Homo sapiens
tacatttcgatgtt

SEQ ID NO: 4102484 - DNA, 16 bp, Homo sapiens
tacatttctatcagta

SEQ ID NO: 4102485 - DNA, 23 bp, Homo sapiens
tacatttgagggcccagccagga

SEQ ID NO: 4102486 - DNA, 16 bp, Homo sapiens
tacatttgtgagattc

SEQ ID NO: 4102487 - DNA, 19 bp, Homo sapiens
tacatttttacaataaata

SEQ ID NO: 4102488 - DNA, 21 bp, Homo sapiens
tacatttttacaataaataat

SEQ ID NO: 4102489 - DNA, 17 bp, Homo sapiens
tacatttttatttatga

SEQ ID NO: 4102490 - DNA, 19 bp, Homo sapiens
tacatttttatttatgaag

SEQ ID NO: 4102491 - DNA, 22 bp, Homo sapiens
tacatttttatttatgaagttt

SEQ ID NO: 4102492 - DNA, 12 bp, Homo sapiens
taccaaatctga

SEQ ID NO: 4102493 - DNA, 14 bp, Homo sapiens
taccaaatctgaca

SEQ ID NO: 4102494 - DNA, 20 bp, Homo sapiens
taccaaatctgacatattat

SEQ ID NO: 4102495 - DNA, 15 bp, Homo sapiens
taccaatcattttaa

SEQ ID NO: 4102496 - DNA, 20 bp, Homo sapiens
taccaatcattttaattatt

SEQ ID NO: 4102497 - DNA, 14 bp, Homo sapiens
taccacaaggaaaa

SEQ ID NO: 4102498 - DNA, 17 bp, Homo sapiens
taccacacatctatgat

SEQ ID NO: 4102499 - DNA, 12 bp, Homo sapiens
taccacagcagc

SEQ ID NO: 4102500 - DNA, 14 bp, Homo sapiens
taccacagtgtctg

SEQ ID NO: 4102501 - DNA, 20 bp, Homo sapiens
taccacccttcagaccccag

SEQ ID NO: 4102502 - DNA, 19 bp, Homo sapiens
taccactaactcctgagaa

SEQ ID NO: 4102503 - DNA, 15 bp, Homo sapiens
taccaggttgaaaga

SEQ ID NO: 4102504 - DNA, 11 bp, Homo sapiens
taccagtgtgg

SEQ ID NO: 4102505 - DNA, 18 bp, Homo sapiens
taccagttcagacactac

SEQ ID NO: 4102506 - DNA, 14 bp, Homo sapiens
taccagttgccttt

SEQ ID NO: 4102507 - DNA, 17 bp, Homo sapiens
taccagttggcagacag

SEQ ID NO: 4102508 - DNA, 20 bp, Homo sapiens
taccagttggcagacagccg

SEQ ID NO: 4102509 - DNA, 14 bp, Homo sapiens
taccatatgatctg

SEQ ID NO: 4102510 - DNA, 18 bp, Homo sapiens
taccatcagggacaggat

SEQ ID NO: 4102511 - DNA, 12 bp, Homo sapiens
taccatcatctc

SEQ ID NO: 4102512 - DNA, 18 bp, Homo sapiens
taccatctctaccatcat

SEQ ID NO: 4102513 - DNA, 19 bp, Homo sapiens
taatgtctcactgttctgc

SEQ ID NO: 4102514 - DNA, 22 bp, Homo sapiens
taatgtctcactgttctgcaaa

SEQ ID NO: 4102515 - DNA, 15 bp, Homo sapiens
taatgtgaagacatt

SEQ ID NO: 4102516 - DNA, 18 bp, Homo sapiens
taatgttaaatttgtaag

SEQ ID NO: 4102517 - DNA, 15 bp, Homo sapiens
taatgttactgatca

SEQ ID NO: 4102518 - DNA, 23 bp, Homo sapiens
taatgttactgatcatgcattgt

SEQ ID NO: 4102519 - DNA, 14 bp, Homo sapiens
taatgttgttattt

SEQ ID NO: 4102520 - DNA, 18 bp, Homo sapiens
taatgttttgtatataca

SEQ ID NO: 4102521 - DNA, 19 bp, Homo sapiens
taatgttttgtatatacag

SEQ ID NO: 4102522 - DNA, 21 bp, Homo sapiens
taatgttttgtatatacagtt

SEQ ID NO: 4102523 - DNA, 15 bp, Homo sapiens
taattaaaaagttaa

SEQ ID NO: 4102524 - DNA, 15 bp, Homo sapiens
taattaaaacacttt

SEQ ID NO: 4102525 - DNA, 15 bp, Homo sapiens
taattaaaactattt

SEQ ID NO: 4102526 - DNA, 19 bp, Homo sapiens
taattaaaactatttagtg

SEQ ID NO: 4102527 - DNA, 16 bp, Homo sapiens
taattaaaatttatct

SEQ ID NO: 4102528 - DNA, 17 bp, Homo sapiens
taattaaagactcaaga

SEQ ID NO: 4102529 - DNA, 13 bp, Homo sapiens
taattaaatgtat

SEQ ID NO: 4102530 - DNA, 14 bp, Homo sapiens
taattaaatttaac

SEQ ID NO: 4102531 - DNA, 16 bp, Homo sapiens
taattaactgaaacat

SEQ ID NO: 4102532 - DNA, 20 bp, Homo sapiens
taattaagtactatgtatca

SEQ ID NO: 4102533 - DNA, 13 bp, Homo sapiens
taattaatgtcat

SEQ ID NO: 4102534 - DNA, 14 bp, Homo sapiens
taattaattgtaat

SEQ ID NO: 4102535 - DNA, 19 bp, Homo sapiens
taattagggtacatttata

SEQ ID NO: 4102536 - DNA, 21 bp, Homo sapiens
taattatcgggaacagtgttt

SEQ ID NO: 4102537 - DNA, 14 bp, Homo sapiens
taattattatttgt

SEQ ID NO: 4102538 - DNA, 17 bp, Homo sapiens
taattattatttgtgtt

SEQ ID NO: 4102539 - DNA, 13 bp, Homo sapiens
taattatttaaat

SEQ ID NO: 4102540 - DNA, 14 bp, Homo sapiens
taattattttaaaa

SEQ ID NO: 4102541 - DNA, 18 bp, Homo sapiens
taattattttaaaatatt

SEQ ID NO: 4102542 - DNA, 13 bp, Homo sapiens
taattattttggt

SEQ ID NO: 4102543 - DNA, 16 bp, Homo sapiens
taattattttggtact

SEQ ID NO: 4102544 - DNA, 13 bp, Homo sapiens
taattcaagaaaa

SEQ ID NO: 4102545 - DNA, 20 bp, Homo sapiens
taattcaaggagaatatgat

SEQ ID NO: 4102546 - DNA, 16 bp, Homo sapiens
taattcaatgtgaaca

SEQ ID NO: 4102547 - DNA, 16 bp, Homo sapiens
taattcacctatgtta

SEQ ID NO: 4102548 - DNA, 17 bp, Homo sapiens
taattcacctatgttat

SEQ ID NO: 4102549 - DNA, 23 bp, Homo sapiens
taattcacctatgttattttgtg

SEQ ID NO: 4102550 - DNA, 19 bp, Homo sapiens
taattcagcactgatttca

SEQ ID NO: 4102551 - DNA, 17 bp, Homo sapiens
taattcccattttgcaa

SEQ ID NO: 4102552 - DNA, 20 bp, Homo sapiens
taattcccattttgcaaaat

SEQ ID NO: 4102553 - DNA, 15 bp, Homo sapiens
taattccctatcttt

SEQ ID NO: 4102554 - DNA, 16 bp, Homo sapiens
taattcctacagcact

SEQ ID NO: 4102555 - DNA, 18 bp, Homo sapiens
taattctaaatgaatgtt

SEQ ID NO: 4102556 - DNA, 19 bp, Homo sapiens
taattctcacatccctcta

SEQ ID NO: 4102557 - DNA, 12 bp, Homo sapiens
taattctgtaaa

SEQ ID NO: 4102558 - DNA, 15 bp, Homo sapiens
taattctgtaaatgt

SEQ ID NO: 4102559 - DNA, 15 bp, Homo sapiens
taattcttcacctgt

SEQ ID NO: 4102560 - DNA, 16 bp, Homo sapiens
taattcttgtatatta

SEQ ID NO: 4102561 - DNA, 16 bp, Homo sapiens
taattgaaactagtta

SEQ ID NO: 4102562 - DNA, 22 bp, Homo sapiens
taattgaaactagttattttat

SEQ ID NO: 4102563 - DNA, 20 bp, Homo sapiens
taattgacaggattattgga

SEQ ID NO: 4102564 - DNA, 18 bp, Homo sapiens
taattgatcaaattcatt

SEQ ID NO: 4102565 - DNA, 17 bp, Homo sapiens
taattgatttttcttct

SEQ ID NO: 4102566 - DNA, 22 bp, Homo sapiens
taattgcagataactttgactt

SEQ ID NO: 4102567 - DNA, 12 bp, Homo sapiens
taattgctattt

SEQ ID NO: 4102568 - DNA, 21 bp, Homo sapiens
taattgcttacatttttacaa

SEQ ID NO: 4102569 - DNA, 18 bp, Homo sapiens
taattggtccgatctttg

SEQ ID NO: 4102570 - DNA, 19 bp, Homo sapiens
taattgtgtaaaaaatgga

SEQ ID NO: 4102571 - DNA, 22 bp, Homo sapiens
taattgttgaaattttgcaaat

SEQ ID NO: 4102572 - DNA, 14 bp, Homo sapiens
taattgttgtttct

SEQ ID NO: 4102573 - DNA, 15 bp, Homo sapiens
taattgttgtttctt

SEQ ID NO: 4102574 - DNA, 16 bp, Homo sapiens
taattgttgtttcttt

SEQ ID NO: 4102575 - DNA, 22 bp, Homo sapiens
taattgttgtttctttctagtg

SEQ ID NO: 4102576 - DNA, 11 bp, Homo sapiens
taatttaaaca

SEQ ID NO: 4102577 - DNA, 12 bp, Homo sapiens
taatttagaaac

SEQ ID NO: 4102578 - DNA, 18 bp, Homo sapiens
taatttagggtactaaat

SEQ ID NO: 4102579 - DNA, 14 bp, Homo sapiens
taatttatctaaat

SEQ ID NO: 4102580 - DNA, 15 bp, Homo sapiens
taatttatctaaatt

SEQ ID NO: 4102581 - DNA, 18 bp, Homo sapiens
taatttatctaaattaaa

SEQ ID NO: 4102582 - DNA, 20 bp, Homo sapiens
taatttatttaatatttaat

SEQ ID NO: 4102583 - DNA, 14 bp, Homo sapiens
taatttatttatta

SEQ ID NO: 4102584 - DNA, 20 bp, Homo sapiens
taatttcaaaaatataactt

SEQ ID NO: 4102585 - DNA, 15 bp, Homo sapiens
taatttcaaaatgct

SEQ ID NO: 4102586 - DNA, 20 bp, Homo sapiens
taatttcaaaatgcttttta

SEQ ID NO: 4102587 - DNA, 20 bp, Homo sapiens
taatttcatgtaaaacagaa

SEQ ID NO: 4102588 - DNA, 10 bp, Homo sapiens
taatttcctt

SEQ ID NO: 4102589 - DNA, 22 bp, Homo sapiens
taatttcctttttgacactgaa

SEQ ID NO: 4102590 - DNA, 13 bp, Homo sapiens
taatttctcctcc

SEQ ID NO: 4102591 - DNA, 19 bp, Homo sapiens
taatttctcctcccttcct

SEQ ID NO: 4102592 - DNA, 12 bp, Homo sapiens
taatttgaactg

SEQ ID NO: 4102593 - DNA, 13 bp, Homo sapiens
taatttgaatgtg

SEQ ID NO: 4102594 - DNA, 18 bp, Homo sapiens
taatttgatgaaagctga

SEQ ID NO: 4102595 - DNA, 16 bp, Homo sapiens
taatttgattaacaaa

SEQ ID NO: 4102596 - DNA, 19 bp, Homo sapiens
taatttgcatattctattg

SEQ ID NO: 4102597 - DNA, 16 bp, Homo sapiens
taatttgcattaaatt

SEQ ID NO: 4102598 - DNA, 17 bp, Homo sapiens
taatttgcattaaattc

SEQ ID NO: 4102599 - DNA, 21 bp, Homo sapiens
taatttggcttttcttattta

SEQ ID NO: 4102600 - DNA, 13 bp, Homo sapiens
taatttgtaaatg

SEQ ID NO: 4102601 - DNA, 23 bp, Homo sapiens
taattttagtattcattctgcat

SEQ ID NO: 4102602 - DNA, 23 bp, Homo sapiens
taattttatggtggaaaagaact

SEQ ID NO: 4102603 - DNA, 18 bp, Homo sapiens
taattttcacaaaatgtc

SEQ ID NO: 4102604 - DNA, 21 bp, Homo sapiens
taattttctagattttctact

SEQ ID NO: 4102605 - DNA, 19 bp, Homo sapiens
taattttctcaaaagcatt

SEQ ID NO: 4102606 - DNA, 15 bp, Homo sapiens
taatttttaatttgg

SEQ ID NO: 4102607 - DNA, 17 bp, Homo sapiens
taatttttaatttggct

SEQ ID NO: 4102608 - DNA, 20 bp, Homo sapiens
taatttttaccctaatgtct

SEQ ID NO: 4102609 - DNA, 13 bp, Homo sapiens
taatttttgggga

SEQ ID NO: 4102610 - DNA, 14 bp, Homo sapiens
taatttttggggaa

SEQ ID NO: 4102611 - DNA, 24 bp, Homo sapiens
taatttttggggaaaaaagcacat

SEQ ID NO: 4102612 - DNA, 14 bp, Homo sapiens
taatttttgtaatt

SEQ ID NO: 4102613 - DNA, 20 bp, Homo sapiens
taattttttgtacttttagt

SEQ ID NO: 4102614 - DNA, 16 bp, Homo sapiens
taatttttttcaatat

SEQ ID NO: 4102615 - DNA, 22 bp, Homo sapiens
taatttttttcaatatttatta

SEQ ID NO: 4102616 - DNA, 21 bp, Homo sapiens
taatttttttcacctagattt

SEQ ID NO: 4102617 - DNA, 20 bp, Homo sapiens
taccatgagaagagggcctg

SEQ ID NO: 4102618 - DNA, 14 bp, Homo sapiens
taccatgtcactgt

SEQ ID NO: 4102619 - DNA, 15 bp, Homo sapiens
taccatgtcactgtg

SEQ ID NO: 4102620 - DNA, 16 bp, Homo sapiens
taccatgtcactgtgg

SEQ ID NO: 4102621 - DNA, 22 bp, Homo sapiens
taccattcagatcactgaattt

SEQ ID NO: 4102622 - DNA, 14 bp, Homo sapiens
taccattcagtgat

SEQ ID NO: 4102623 - DNA, 22 bp, Homo sapiens
taccattcagttaattcaatgt

SEQ ID NO: 4102624 - DNA, 23 bp, Homo sapiens
taccatttcctcagcttatctct

SEQ ID NO: 4102625 - DNA, 14 bp, Homo sapiens
tacccacccgacct

SEQ ID NO: 4102626 - DNA, 19 bp, Homo sapiens
tacccacccgacctggctg

SEQ ID NO: 4102627 - DNA, 20 bp, Homo sapiens
tacccagagaatatatacat

SEQ ID NO: 4102628 - DNA, 13 bp, Homo sapiens
tacccagagcatt

SEQ ID NO: 4102629 - DNA, 21 bp, Homo sapiens
tacccatctagtacttgaaaa

SEQ ID NO: 4102630 - DNA, 14 bp, Homo sapiens
tacccatgagcctg

SEQ ID NO: 4102631 - DNA, 16 bp, Homo sapiens
tacccatgagcctgcc

SEQ ID NO: 4102632 - DNA, 22 bp, Homo sapiens
tacccattctgttttcccccag

SEQ ID NO: 4102633 - DNA, 19 bp, Homo sapiens
tacccattgccccagacct

SEQ ID NO: 4102634 - DNA, 14 bp, Homo sapiens
taccccacaccagc

SEQ ID NO: 4102635 - DNA, 16 bp, Homo sapiens
taccccacaccagcct

SEQ ID NO: 4102636 - DNA, 14 bp, Homo sapiens
taccccactgggca

SEQ ID NO: 4102637 - DNA, 21 bp, Homo sapiens
taccccactgggcacacgcac

SEQ ID NO: 4102638 - DNA, 21 bp, Homo sapiens
taccccactgggccagccctg

SEQ ID NO: 4102639 - DNA, 16 bp, Homo sapiens
taccccagggccctgg

SEQ ID NO: 4102640 - DNA, 17 bp, Homo sapiens
taccccagggccctggc

SEQ ID NO: 4102641 - DNA, 19 bp, Homo sapiens
taccccagggccctggcca

SEQ ID NO: 4102642 - DNA, 22 bp, Homo sapiens
taccccatatacacctggaaca

SEQ ID NO: 4102643 - DNA, 16 bp, Homo sapiens
taccccctaagagcca

SEQ ID NO: 4102644 - DNA, 21 bp, Homo sapiens
tacccccttttcagctgagcc

SEQ ID NO: 4102645 - DNA, 21 bp, Homo sapiens
tacccctcccggccctgcctg

SEQ ID NO: 4102646 - DNA, 23 bp, Homo sapiens
tacccctcccggccctgcctgct

SEQ ID NO: 4102647 - DNA, 22 bp, Homo sapiens
tacccctgctcccattcctccc

SEQ ID NO: 4102648 - DNA, 14 bp, Homo sapiens
taccctaatgtctt

SEQ ID NO: 4102649 - DNA, 19 bp, Homo sapiens
taccctaatgtcttcataa

SEQ ID NO: 4102650 - DNA, 22 bp, Homo sapiens
taccctaatgtcttcataaagt

SEQ ID NO: 4102651 - DNA, 16 bp, Homo sapiens
taccctattctctctt

SEQ ID NO: 4102652 - DNA, 14 bp, Homo sapiens
taccctcccacccc

SEQ ID NO: 4102653 - DNA, 15 bp, Homo sapiens
taccctcccaccccc

SEQ ID NO: 4102654 - DNA, 21 bp, Homo sapiens
taccctctcagctccaggtgg

SEQ ID NO: 4102655 - DNA, 14 bp, Homo sapiens
taccctctggaggg

SEQ ID NO: 4102656 - DNA, 22 bp, Homo sapiens
taccctcttcatggatggggga

SEQ ID NO: 4102657 - DNA, 17 bp, Homo sapiens
taccctgagttcatcca

SEQ ID NO: 4102658 - DNA, 16 bp, Homo sapiens
taccctgctccctgct

SEQ ID NO: 4102659 - DNA, 22 bp, Homo sapiens
taccctggcactataatgtaag

SEQ ID NO: 4102660 - DNA, 22 bp, Homo sapiens
taccctttcctcctttatcaca

SEQ ID NO: 4102661 - DNA, 13 bp, Homo sapiens
tacccttttcccc

SEQ ID NO: 4102662 - DNA, 17 bp, Homo sapiens
taccctttttctccagc

SEQ ID NO: 4102663 - DNA, 21 bp, Homo sapiens
taccgagtctcttctccactg

SEQ ID NO: 4102664 - DNA, 17 bp, Homo sapiens
taccgccctgggctgga

SEQ ID NO: 4102665 - DNA, 20 bp, Homo sapiens
taccggcaagcagcgggcta

SEQ ID NO: 4102666 - DNA, 23 bp, Homo sapiens
tacctaaaaggaaatctcacccc

SEQ ID NO: 4102667 - DNA, 14 bp, Homo sapiens
tacctaaacagata

SEQ ID NO: 4102668 - DNA, 15 bp, Homo sapiens
tacctaaacagatat

SEQ ID NO: 4102669 - DNA, 21 bp, Homo sapiens
tacctaatgtctcactgttct

SEQ ID NO: 4102670 - DNA, 22 bp, Homo sapiens
tacctaatgtctcactgttctg

SEQ ID NO: 4102671 - DNA, 16 bp, Homo sapiens
tacctaccacagtgtc

SEQ ID NO: 4102672 - DNA, 14 bp, Homo sapiens
tacctactgtgtgc

SEQ ID NO: 4102673 - DNA, 16 bp, Homo sapiens
tacctagatttacagc

SEQ ID NO: 4102674 - DNA, 21 bp, Homo sapiens
tacctatggaagtggttctat

SEQ ID NO: 4102675 - DNA, 19 bp, Homo sapiens
tacctcaaccatcctggct

SEQ ID NO: 4102676 - DNA, 15 bp, Homo sapiens
tacctcaccctgcta

SEQ ID NO: 4102677 - DNA, 14 bp, Homo sapiens
tacctcaggcagct

SEQ ID NO: 4102678 - DNA, 20 bp, Homo sapiens
tacctccaacagaactaaat

SEQ ID NO: 4102679 - DNA, 20 bp, Homo sapiens
tacctccatccatccttcca

SEQ ID NO: 4102680 - DNA, 15 bp, Homo sapiens
tacctcccttgcctt

SEQ ID NO: 4102681 - DNA, 14 bp, Homo sapiens
tacctcctctcagt

SEQ ID NO: 4102682 - DNA, 14 bp, Homo sapiens
tacctctctgtccc

SEQ ID NO: 4102683 - DNA, 23 bp, Homo sapiens
tacctctcttatagaatatttat

SEQ ID NO: 4102684 - DNA, 13 bp, Homo sapiens
tacctctgtatag

SEQ ID NO: 4102685 - DNA, 18 bp, Homo sapiens
tacctctgtatagaaatc

SEQ ID NO: 4102686 - DNA, 19 bp, Homo sapiens
tacctctgtgccagggcag

SEQ ID NO: 4102687 - DNA, 16 bp, Homo sapiens
tacctcttactttgct

SEQ ID NO: 4102688 - DNA, 16 bp, Homo sapiens
tacctgacctcttgct

SEQ ID NO: 4102689 - DNA, 18 bp, Homo sapiens
tacctgacctcttgctgt

SEQ ID NO: 4102690 - DNA, 13 bp, Homo sapiens
tacctgcacgttc

SEQ ID NO: 4102691 - DNA, 23 bp, Homo sapiens
tacctgcacgttcataaccaaca

SEQ ID NO: 4102692 - DNA, 22 bp, Homo sapiens
tacctgcaggctgagccactct

SEQ ID NO: 4102693 - DNA, 19 bp, Homo sapiens
tacctgctgccccagctga

SEQ ID NO: 4102694 - DNA, 15 bp, Homo sapiens
tacctggagcagagg

SEQ ID NO: 4102695 - DNA, 19 bp, Homo sapiens
tacctggagcagaggaggg

SEQ ID NO: 4102696 - DNA, 19 bp, Homo sapiens
tacctgggtccccagccct

SEQ ID NO: 4102697 - DNA, 12 bp, Homo sapiens
tacctgtataca

SEQ ID NO: 4102698 - DNA, 20 bp, Homo sapiens
tacctgtgcgttactaattg

SEQ ID NO: 4102699 - DNA, 14 bp, Homo sapiens
tacctgtgtacata

SEQ ID NO: 4102700 - DNA, 19 bp, Homo sapiens
taccttccatacacagagg

SEQ ID NO: 4102701 - DNA, 21 bp, Homo sapiens
taccttccatacacagaggag

SEQ ID NO: 4102702 - DNA, 14 bp, Homo sapiens
taccttcctgtccc

SEQ ID NO: 4102703 - DNA, 14 bp, Homo sapiens
taccttgtatactg

SEQ ID NO: 4102704 - DNA, 14 bp, Homo sapiens
tacctttatggttt

SEQ ID NO: 4102705 - DNA, 20 bp, Homo sapiens
tacgagcaagcttttacaac

SEQ ID NO: 4102706 - DNA, 20 bp, Homo sapiens
tacgagtaattgcatttgct

SEQ ID NO: 4102707 - DNA, 14 bp, Homo sapiens
tacgatacgctact

SEQ ID NO: 4102708 - DNA, 16 bp, Homo sapiens
tacgcccatctcagga

SEQ ID NO: 4102709 - DNA, 17 bp, Homo sapiens
tacgcccatctcaggac

SEQ ID NO: 4102710 - DNA, 14 bp, Homo sapiens
tacgctttgattca

SEQ ID NO: 4102711 - DNA, 20 bp, Homo sapiens
tacgctttgtcacacaaaaa

SEQ ID NO: 4102712 - DNA, 21 bp, Homo sapiens
tacggttttataaaagccttg

SEQ ID NO: 4102713 - DNA, 22 bp, Homo sapiens
tacgttcctattgtcattaaag

SEQ ID NO: 4102714 - DNA, 12 bp, Homo sapiens
tactaaaagcaa

SEQ ID NO: 4102715 - DNA, 14 bp, Homo sapiens
tactaaatttaaat

SEQ ID NO: 4102716 - DNA, 14 bp, Homo sapiens
tactaagttcacat

SEQ ID NO: 4102717 - DNA, 14 bp, Homo sapiens
tactaatgatgttt

SEQ ID NO: 4102718 - DNA, 18 bp, Homo sapiens
tactacaaaatttgaaat

SEQ ID NO: 4102719 - DNA, 22 bp, Homo sapiens
tactacacatttttaaattgtt

SEQ ID NO: 4102720 - DNA, 15 bp, Homo sapiens
tactacactgaggag

SEQ ID NO: 4102721 - DNA, 14 bp, Homo sapiens
tactaccacaagga

SEQ ID NO: 4102722 - DNA, 16 bp, Homo sapiens
tactaccacaaggaaa

SEQ ID NO: 4102723 - DNA, 17 bp, Homo sapiens
tactacccatagaaaac

SEQ ID NO: 4102724 - DNA, 20 bp, Homo sapiens
tactaccttgaaaataagaa

SEQ ID NO: 4102725 - DNA, 21 bp, Homo sapiens
tactactgaaacagatttcat

SEQ ID NO: 4102726 - DNA, 20 bp, Homo sapiens
tactactgaccagacaagct

SEQ ID NO: 4102727 - DNA, 13 bp, Homo sapiens
tactagaatgctt

SEQ ID NO: 4102728 - DNA, 19 bp, Homo sapiens
tactagatgtctttaggca

SEQ ID NO: 4102729 - DNA, 19 bp, Homo sapiens
tactaggtaacttcatatt

SEQ ID NO: 4102730 - DNA, 19 bp, Homo sapiens
tactagttacacatcttca

SEQ ID NO: 4102731 - DNA, 12 bp, Homo sapiens
tactatagtacc

SEQ ID NO: 4102732 - DNA, 14 bp, Homo sapiens
tactatatttacaa

SEQ ID NO: 4102733 - DNA, 14 bp, Homo sapiens
tactatatttgcta

SEQ ID NO: 4102734 - DNA, 15 bp, Homo sapiens
tactatatttgctag

SEQ ID NO: 4102735 - DNA, 17 bp, Homo sapiens
tactatccagttactgc

SEQ ID NO: 4102736 - DNA, 16 bp, Homo sapiens
tactatggctgagttc

SEQ ID NO: 4102737 - DNA, 13 bp, Homo sapiens
tactatgtatcaa

SEQ ID NO: 4102738 - DNA, 14 bp, Homo sapiens
tactatgtatcaat

SEQ ID NO: 4102739 - DNA, 16 bp, Homo sapiens
tactatgtatcaatga

SEQ ID NO: 4102740 - DNA, 20 bp, Homo sapiens
tactatgtgccagttcctgt

SEQ ID NO: 4102741 - DNA, 21 bp, Homo sapiens
tactatgtgccagttcctgta

SEQ ID NO: 4102742 - DNA, 15 bp, Homo sapiens
tactatgtgctgggt

SEQ ID NO: 4102743 - DNA, 17 bp, Homo sapiens
tactattaagcagtaaa

SEQ ID NO: 4102744 - DNA, 22 bp, Homo sapiens
tactattaagcagtaaaaactg

SEQ ID NO: 4102745 - DNA, 18 bp, Homo sapiens
tactattccctttgactt

SEQ ID NO: 4102746 - DNA, 22 bp, Homo sapiens
tactattccctttgacttcagc

SEQ ID NO: 4102747 - DNA, 15 bp, Homo sapiens
tactattgttacatt

SEQ ID NO: 4102748 - DNA, 12 bp, Homo sapiens
tactatttaaag

SEQ ID NO: 4102749 - DNA, 19 bp, Homo sapiens
tactatttaaagcctcctc

SEQ ID NO: 4102750 - DNA, 13 bp, Homo sapiens
tactatttagata

SEQ ID NO: 4102751 - DNA, 11 bp, Homo sapiens
tactatttcca

SEQ ID NO: 4102752 - DNA, 18 bp, Homo sapiens
tactcaaatgagtaacat

SEQ ID NO: 4102753 - DNA, 22 bp, Homo sapiens
tactcaatgcctggagacagat

SEQ ID NO: 4102754 - DNA, 19 bp, Homo sapiens
tactcagtgttagagaaat

SEQ ID NO: 4102755 - DNA, 12 bp, Homo sapiens
tactccacagcg

SEQ ID NO: 4102756 - DNA, 19 bp, Homo sapiens
tactccagtggtgaagaaa

SEQ ID NO: 4102757 - DNA, 15 bp, Homo sapiens
tactcccttgcccta

SEQ ID NO: 4102758 - DNA, 12 bp, Homo sapiens
tactcctcccag

SEQ ID NO: 4102759 - DNA, 17 bp, Homo sapiens
tactcctctttacactg

SEQ ID NO: 4102760 - DNA, 11 bp, Homo sapiens
tactcctgact

SEQ ID NO: 4102761 - DNA, 12 bp, Homo sapiens
tactcctgcaaa

SEQ ID NO: 4102762 - DNA, 14 bp, Homo sapiens
tactcctgcaaaat

SEQ ID NO: 4102763 - DNA, 16 bp, Homo sapiens
tactcctgcaaaattt

SEQ ID NO: 4102764 - DNA, 21 bp, Homo sapiens
tactccttaagaacacaaagc

SEQ ID NO: 4102765 - DNA, 14 bp, Homo sapiens
tactccttgcttcc

SEQ ID NO: 4102766 - DNA, 15 bp, Homo sapiens
tactccttgcttcct

SEQ ID NO: 4102767 - DNA, 17 bp, Homo sapiens
tactccttgcttcctga

SEQ ID NO: 4102768 - DNA, 15 bp, Homo sapiens
tactctcacatgtgg

SEQ ID NO: 4102769 - DNA, 22 bp, Homo sapiens
tactctccccacgagggctggc

SEQ ID NO: 4102770 - DNA, 22 bp, Homo sapiens
tactctcctggaaatattaaga

SEQ ID NO: 4102771 - DNA, 23 bp, Homo sapiens
tactctggaatgtttttccctcc

SEQ ID NO: 4102772 - DNA, 21 bp, Homo sapiens
tactctggggtgctgcctgaa

SEQ ID NO: 4102773 - DNA, 23 bp, Homo sapiens
tactctggggtgctgcctgaatc

SEQ ID NO: 4102774 - DNA, 19 bp, Homo sapiens
tactctgtccatttatcca

SEQ ID NO: 4102775 - DNA, 16 bp, Homo sapiens
tactcttggtttttat

SEQ ID NO: 4102776 - DNA, 15 bp, Homo sapiens
tactctttctgtata

SEQ ID NO: 4102777 - DNA, 14 bp, Homo sapiens
tactgaaacagatt

SEQ ID NO: 4102778 - DNA, 23 bp, Homo sapiens
tactgaaggaaaaacacaagcaa

SEQ ID NO: 4102779 - DNA, 20 bp, Homo sapiens
tactgaagtcttttctgtca

SEQ ID NO: 4102780 - DNA, 18 bp, Homo sapiens
tactgaatttttttgtaa

SEQ ID NO: 4102781 - DNA, 19 bp, Homo sapiens
tactgaatttttttgtaat

SEQ ID NO: 4102782 - DNA, 23 bp, Homo sapiens
tactgacactttgccagaaagca

SEQ ID NO: 4102783 - DNA, 19 bp, Homo sapiens
tactgagccttgtaattct

SEQ ID NO: 4102784 - DNA, 16 bp, Homo sapiens
tactgagctgagacca

SEQ ID NO: 4102785 - DNA, 22 bp, Homo sapiens
tactgagctgagaccactgagt

SEQ ID NO: 4102786 - DNA, 17 bp, Homo sapiens
tactgagcttctctgtg

SEQ ID NO: 4102787 - DNA, 23 bp, Homo sapiens
tactgagggaccaactgggccca

SEQ ID NO: 4102788 - DNA, 15 bp, Homo sapiens
tactgaggtgctatg

SEQ ID NO: 4102789 - DNA, 13 bp, Homo sapiens
tactgatttaatt

SEQ ID NO: 4102790 - DNA, 21 bp, Homo sapiens
tactgatttcctttggagctt

SEQ ID NO: 4102791 - DNA, 14 bp, Homo sapiens
tactgcaagaaaat

SEQ ID NO: 4102792 - DNA, 16 bp, Homo sapiens
tactgcactccagcct

SEQ ID NO: 4102793 - DNA, 17 bp, Homo sapiens
tactgcactccagcctg

SEQ ID NO: 4102794 - DNA, 19 bp, Homo sapiens
tactgccatgtactagttt

SEQ ID NO: 4102795 - DNA, 21 bp, Homo sapiens
tactgccatgtactagtttta

SEQ ID NO: 4102796 - DNA, 14 bp, Homo sapiens
tactgcctccccca

SEQ ID NO: 4102797 - DNA, 19 bp, Homo sapiens
tactgcttaattcaaataa

SEQ ID NO: 4102798 - DNA, 22 bp, Homo sapiens
tactgcttgaccgtactctcac

SEQ ID NO: 4102799 - DNA, 17 bp, Homo sapiens
tactggaagttttgcat

SEQ ID NO: 4102800 - DNA, 14 bp, Homo sapiens
tactggaataattt

SEQ ID NO: 4102801 - DNA, 18 bp, Homo sapiens
tactggaataatttgtaa

SEQ ID NO: 4102802 - DNA, 16 bp, Homo sapiens
tactggaattcttctg

SEQ ID NO: 4102803 - DNA, 23 bp, Homo sapiens
tactgggccttagtgggccaggg

SEQ ID NO: 4102804 - DNA, 14 bp, Homo sapiens
tactgtaattttat

SEQ ID NO: 4102805 - DNA, 12 bp, Homo sapiens
tactgtagtttt

SEQ ID NO: 4102806 - DNA, 13 bp, Homo sapiens
tactgtagttttt

SEQ ID NO: 4102807 - DNA, 17 bp, Homo sapiens
tactgtatggaaacact

SEQ ID NO: 4102808 - DNA, 11 bp, Homo sapiens
tactgtcaata

SEQ ID NO: 4102809 - DNA, 13 bp, Homo sapiens
tactgtcaataaa

SEQ ID NO: 4102810 - DNA, 15 bp, Homo sapiens
tactgtcaataaaca

SEQ ID NO: 4102811 - DNA, 13 bp, Homo sapiens
tactgtgactgat

SEQ ID NO: 4102812 - DNA, 23 bp, Homo sapiens
tactgtgcagaataatggaaaca

SEQ ID NO: 4102813 - DNA, 16 bp, Homo sapiens
tactgtggaggaagga

SEQ ID NO: 4102814 - DNA, 18 bp, Homo sapiens
tactgtggaggaaggatt

SEQ ID NO: 4102815 - DNA, 22 bp, Homo sapiens
tactgtggaggaaggattgtaa

SEQ ID NO: 4102816 - DNA, 23 bp, Homo sapiens
tactgtggaggaaggattgtaaa

SEQ ID NO: 4102817 - DNA, 17 bp, Homo sapiens
tactgtgtgtgtgaatg

SEQ ID NO: 4102818 - DNA, 21 bp, Homo sapiens
tactgtgtgtgtgaatgaaca

SEQ ID NO: 4102819 - DNA, 22 bp, Homo sapiens
tactgtgtgtgtgaatgaacac

SEQ ID NO: 4102820 - DNA, 13 bp, Homo sapiens
tactgtgttccaa

SEQ ID NO: 4102821 - DNA, 15 bp, Homo sapiens
tactgttaaccattt

SEQ ID NO: 4102822 - DNA, 19 bp, Homo sapiens
tactgttaaccatttaagt

SEQ ID NO: 4102823 - DNA, 16 bp, Homo sapiens
tactgttatctatctg

SEQ ID NO: 4102824 - DNA, 14 bp, Homo sapiens
tactgttctgtgtc

SEQ ID NO: 4102825 - DNA, 15 bp, Homo sapiens
tactgtttatttctg

SEQ ID NO: 4102826 - DNA, 23 bp, Homo sapiens
tactgtttatttctgtttctcat

SEQ ID NO: 4102827 - DNA, 17 bp, Homo sapiens
tacttaaatgaaagcat

SEQ ID NO: 4102828 - DNA, 13 bp, Homo sapiens
tacttaactattc

SEQ ID NO: 4102829 - DNA, 16 bp, Homo sapiens
tacttactataatttg

SEQ ID NO: 4102830 - DNA, 18 bp, Homo sapiens
tacttagcaaagttttac

SEQ ID NO: 4102831 - DNA, 19 bp, Homo sapiens
tacttagcatcctaagaaa

SEQ ID NO: 4102832 - DNA, 20 bp, Homo sapiens
tacttagcatcctaagaaat

SEQ ID NO: 4102833 - DNA, 15 bp, Homo sapiens
tacttatttttctga

SEQ ID NO: 4102834 - DNA, 16 bp, Homo sapiens
tacttcaaaaataatg

SEQ ID NO: 4102835 - DNA, 17 bp, Homo sapiens
tacttcaaaaataatgt

SEQ ID NO: 4102836 - DNA, 18 bp, Homo sapiens
tacttcaagttaaagtga

SEQ ID NO: 4102837 - DNA, 21 bp, Homo sapiens
tacttccataggacatactgc

SEQ ID NO: 4102838 - DNA, 13 bp, Homo sapiens
tacttcctttctc

SEQ ID NO: 4102839 - DNA, 17 bp, Homo sapiens
tacttcgtcttctaatt

SEQ ID NO: 4102840 - DNA, 23 bp, Homo sapiens
tacttctaatcttaaatcagaat

SEQ ID NO: 4102841 - DNA, 16 bp, Homo sapiens
tacttcttatacattt

SEQ ID NO: 4102842 - DNA, 14 bp, Homo sapiens
tacttcttgaaggt

SEQ ID NO: 4102843 - DNA, 16 bp, Homo sapiens
tacttgaaaagaaagt

SEQ ID NO: 4102844 - DNA, 21 bp, Homo sapiens
tacttgaaaagaaagtgtttt

SEQ ID NO: 4102845 - DNA, 18 bp, Homo sapiens
tacttgaagaaacagagt

SEQ ID NO: 4102846 - DNA, 15 bp, Homo sapiens
tacttgaagggccag

SEQ ID NO: 4102847 - DNA, 20 bp, Homo sapiens
tacttgaagggccagagcca

SEQ ID NO: 4102848 - DNA, 22 bp, Homo sapiens
tacttgaagggccagagccagg

SEQ ID NO: 4102849 - DNA, 12 bp, Homo sapiens
tacttgaatttc

SEQ ID NO: 4102850 - DNA, 14 bp, Homo sapiens
tacttgacctccta

SEQ ID NO: 4102851 - DNA, 16 bp, Homo sapiens
tacttggaactaggct

SEQ ID NO: 4102852 - DNA, 23 bp, Homo sapiens
tacttgggagacctgtaatcata

SEQ ID NO: 4102853 - DNA, 13 bp, Homo sapiens
tacttgtcaatat

SEQ ID NO: 4102854 - DNA, 19 bp, Homo sapiens
tacttgtgaaacacagctg

SEQ ID NO: 4102855 - DNA, 17 bp, Homo sapiens
tacttgtggttttcaaa

SEQ ID NO: 4102856 - DNA, 15 bp, Homo sapiens
tacttgtgtttgctt

SEQ ID NO: 4102857 - DNA, 16 bp, Homo sapiens
tacttgtgtttgctta

SEQ ID NO: 4102858 - DNA, 21 bp, Homo sapiens
tacttgtgtttgcttaaacaa

SEQ ID NO: 4102859 - DNA, 22 bp, Homo sapiens
tacttgtgtttgcttaaacaaa

SEQ ID NO: 4102860 - DNA, 14 bp, Homo sapiens
tactttaaacttgt

SEQ ID NO: 4102861 - DNA, 15 bp, Homo sapiens
tactttaaaggaaaa

SEQ ID NO: 4102862 - DNA, 15 bp, Homo sapiens
tactttctatgtgac

SEQ ID NO: 4102863 - DNA, 18 bp, Homo sapiens
tactttggtttctgtctg

SEQ ID NO: 4102864 - DNA, 12 bp, Homo sapiens
tactttgtaatt

SEQ ID NO: 4102865 - DNA, 17 bp, Homo sapiens
tacttttaccactattt

SEQ ID NO: 4102866 - DNA, 18 bp, Homo sapiens
tacttttaccactattta

SEQ ID NO: 4102867 - DNA, 19 bp, Homo sapiens
tacttttagttgactcaca

SEQ ID NO: 4102868 - DNA, 16 bp, Homo sapiens
tacttttattaatatt

SEQ ID NO: 4102869 - DNA, 23 bp, Homo sapiens
tacttttcccctgttaaacagta

SEQ ID NO: 4102870 - DNA, 15 bp, Homo sapiens
tagaaaacaatgcaa

SEQ ID NO: 4102871 - DNA, 21 bp, Homo sapiens
tagaaaacttgacatgtagct

SEQ ID NO: 4102872 - DNA, 21 bp, Homo sapiens
tagaaaatagagcttttaaaa

SEQ ID NO: 4102873 - DNA, 12 bp, Homo sapiens
tagaaaatggtc

SEQ ID NO: 4102874 - DNA, 12 bp, Homo sapiens
tagaaaatgtgt

SEQ ID NO: 4102875 - DNA, 15 bp, Homo sapiens
tagaaagaagccata

SEQ ID NO: 4102876 - DNA, 23 bp, Homo sapiens
tagaaagaagcccaatattataa

SEQ ID NO: 4102877 - DNA, 18 bp, Homo sapiens
tagaaagagatacagagg

SEQ ID NO: 4102878 - DNA, 11 bp, Homo sapiens
tagaaagctat

SEQ ID NO: 4102879 - DNA, 21 bp, Homo sapiens
tagaaaggaagccttgctcat

SEQ ID NO: 4102880 - DNA, 23 bp, Homo sapiens
tagaaataaaagtgaatgaaaga

SEQ ID NO: 4102881 - DNA, 20 bp, Homo sapiens
tagaaataaaggatgtgatt

SEQ ID NO: 4102882 - DNA, 19 bp, Homo sapiens
tagaaataaatagctatat

SEQ ID NO: 4102883 - DNA, 15 bp, Homo sapiens
tagaaatcaagcata

SEQ ID NO: 4102884 - DNA, 23 bp, Homo sapiens
tagaaatcaagcataaatcactt

SEQ ID NO: 4102885 - DNA, 20 bp, Homo sapiens
tagaaatctaaaagaatttt

SEQ ID NO: 4102886 - DNA, 15 bp, Homo sapiens
tagaaatgtgaatga

SEQ ID NO: 4102887 - DNA, 16 bp, Homo sapiens
tagaacactaattcat

SEQ ID NO: 4102888 - DNA, 18 bp, Homo sapiens
tagaacactaattcataa

SEQ ID NO: 4102889 - DNA, 15 bp, Homo sapiens
tagaaccactatgaa

SEQ ID NO: 4102890 - DNA, 16 bp, Homo sapiens
tagaaccactatgaag

SEQ ID NO: 4102891 - DNA, 12 bp, Homo sapiens
tagaaccacttc

SEQ ID NO: 4102892 - DNA, 15 bp, Homo sapiens
tagaactcactctgg

SEQ ID NO: 4102893 - DNA, 16 bp, Homo sapiens
tagaactcactctggg

SEQ ID NO: 4102894 - DNA, 18 bp, Homo sapiens
tagaactcactctgggct

SEQ ID NO: 4102895 - DNA, 20 bp, Homo sapiens
tagaactcactctgggctgt

SEQ ID NO: 4102896 - DNA, 22 bp, Homo sapiens
tagaactcagttttaactagaa

SEQ ID NO: 4102897 - DNA, 16 bp, Homo sapiens
tagaactccaggccct

SEQ ID NO: 4102898 - DNA, 19 bp, Homo sapiens
tagaactccaggccctcct

SEQ ID NO: 4102899 - DNA, 23 bp, Homo sapiens
tagaactctccatcttattttca

SEQ ID NO: 4102900 - DNA, 17 bp, Homo sapiens
tagaactttaagtctca

SEQ ID NO: 4102901 - DNA, 12 bp, Homo sapiens
tagaagaaaagc

SEQ ID NO: 4102902 - DNA, 22 bp, Homo sapiens
tagaagagagaggttgaaaaac

SEQ ID NO: 4102903 - DNA, 22 bp, Homo sapiens
tagaagcactacaccttgcctt

SEQ ID NO: 4102904 - DNA, 14 bp, Homo sapiens
tagaagcattcctt

SEQ ID NO: 4102905 - DNA, 12 bp, Homo sapiens
tagaagccaagg

SEQ ID NO: 4102906 - DNA, 16 bp, Homo sapiens
tagaagccaagggaaa

SEQ ID NO: 4102907 - DNA, 19 bp, Homo sapiens
tagaagccaagggaaaggg

SEQ ID NO: 4102908 - DNA, 21 bp, Homo sapiens
tagaaggaaaacctagaaaac

SEQ ID NO: 4102909 - DNA, 17 bp, Homo sapiens
tagaagtcttagatgta

SEQ ID NO: 4102910 - DNA, 23 bp, Homo sapiens
tagaatagtgttctgcaaaaata

SEQ ID NO: 4102911 - DNA, 15 bp, Homo sapiens
tagaatataattatc

SEQ ID NO: 4102912 - DNA, 18 bp, Homo sapiens
tagaatataattatcgga

SEQ ID NO: 4102913 - DNA, 20 bp, Homo sapiens
tagaatatttattacctctg

SEQ ID NO: 4102914 - DNA, 15 bp, Homo sapiens
tagaatcaatcagta

SEQ ID NO: 4102915 - DNA, 23 bp, Homo sapiens
tagaatccaaacttggatttttg

SEQ ID NO: 4102916 - DNA, 15 bp, Homo sapiens
tagaatgtcagattt

SEQ ID NO: 4102917 - DNA, 12 bp, Homo sapiens
tagaatgtggat

SEQ ID NO: 4102918 - DNA, 13 bp, Homo sapiens
tagaattgcattg

SEQ ID NO: 4102919 - DNA, 14 bp, Homo sapiens
tagaattgcattga

SEQ ID NO: 4102920 - DNA, 15 bp, Homo sapiens
tagaattgcattgac

SEQ ID NO: 4102921 - DNA, 15 bp, Homo sapiens
tagaatttattcaat

SEQ ID NO: 4102922 - DNA, 22 bp, Homo sapiens
tagacaaacaagggagaagagt

SEQ ID NO: 4102923 - DNA, 20 bp, Homo sapiens
tagacaaatagaaaatggtc

SEQ ID NO: 4102924 - DNA, 20 bp, Homo sapiens
tagacaacgatgaatttctt

SEQ ID NO: 4102925 - DNA, 21 bp, Homo sapiens
tagacaacgatgaatttcttc

SEQ ID NO: 4102926 - DNA, 14 bp, Homo sapiens
tagacaagatattg

SEQ ID NO: 4102927 - DNA, 17 bp, Homo sapiens
tagacaagatattgtac

SEQ ID NO: 4102928 - DNA, 21 bp, Homo sapiens
tagacaagatattgtacataa

SEQ ID NO: 4102929 - DNA, 15 bp, Homo sapiens
tagacacacaaagca

SEQ ID NO: 4102930 - DNA, 21 bp, Homo sapiens
tagacactccccgaagtcttt

SEQ ID NO: 4102931 - DNA, 22 bp, Homo sapiens
tagacagtatgagtcaatgtgc

SEQ ID NO: 4102932 - DNA, 18 bp, Homo sapiens
tagacagtctcactttgt

SEQ ID NO: 4102933 - DNA, 13 bp, Homo sapiens
tagaccaaagcaa

SEQ ID NO: 4102934 - DNA, 17 bp, Homo sapiens
tagaccaaagcaaagaa

SEQ ID NO: 4102935 - DNA, 23 bp, Homo sapiens
tagaccatgtcttatcttgtttc

SEQ ID NO: 4102936 - DNA, 23 bp, Homo sapiens
tagacccaggtggagggcacagc

SEQ ID NO: 4102937 - DNA, 16 bp, Homo sapiens
tagaccctgggtgggc

SEQ ID NO: 4102938 - DNA, 22 bp, Homo sapiens
tagactattccttttctgtata

SEQ ID NO: 4102939 - DNA, 13 bp, Homo sapiens
tagactgtgccag

SEQ ID NO: 4102940 - DNA, 23 bp, Homo sapiens
tagacttcagggagtcagctgtt

SEQ ID NO: 4102941 - DNA, 24 bp, Homo sapiens
tagacttcagggagtcagctgttt

SEQ ID NO: 4102942 - DNA, 22 bp, Homo sapiens
tagacttcgactcaggatccag

SEQ ID NO: 4102943 - DNA, 17 bp, Homo sapiens
tagactttagaaataaa

SEQ ID NO: 4102944 - DNA, 14 bp, Homo sapiens
tagagaagataatt

SEQ ID NO: 4102945 - DNA, 22 bp, Homo sapiens
tagagacagagcgacagagcag

SEQ ID NO: 4102946 - DNA, 16 bp, Homo sapiens
tagagacggagatcct

SEQ ID NO: 4102947 - DNA, 13 bp, Homo sapiens
tagagagaacagg

SEQ ID NO: 4102948 - DNA, 18 bp, Homo sapiens
tagagagaggaggcagcc

SEQ ID NO: 4102949 - DNA, 21 bp, Homo sapiens
tagagagaggaggcagccccc

SEQ ID NO: 4102950 - DNA, 14 bp, Homo sapiens
tagagattgtacat

SEQ ID NO: 4102951 - DNA, 16 bp, Homo sapiens
tagagatttgtctaat

SEQ ID NO: 4102952 - DNA, 22 bp, Homo sapiens
tagagcaaaattgatgtgttta

SEQ ID NO: 4102953 - DNA, 23 bp, Homo sapiens
tagagcagggattaacctctgca

SEQ ID NO: 4102954 - DNA, 19 bp, Homo sapiens
tagagcctcgtccctccct

SEQ ID NO: 4102955 - DNA, 22 bp, Homo sapiens
tagagccttttatctgcagaac

SEQ ID NO: 4102956 - DNA, 17 bp, Homo sapiens
tagaggaaaaaaatgac

SEQ ID NO: 4102957 - DNA, 15 bp, Homo sapiens
tagaggcattgttag

SEQ ID NO: 4102958 - DNA, 18 bp, Homo sapiens
tagaggccagccccaccc

SEQ ID NO: 4102959 - DNA, 20 bp, Homo sapiens
tagaggcttctccgccagcc

SEQ ID NO: 4102960 - DNA, 22 bp, Homo sapiens
tagaggcttctccgccagcctc

SEQ ID NO: 4102961 - DNA, 18 bp, Homo sapiens
tagagtaaatacaggtag

SEQ ID NO: 4102962 - DNA, 23 bp, Homo sapiens
tagagtcatctccatcagctgta

SEQ ID NO: 4102963 - DNA, 13 bp, Homo sapiens
tagagtcctcact

SEQ ID NO: 4102964 - DNA, 17 bp, Homo sapiens
tagagtctgaacagctg

SEQ ID NO: 4102965 - DNA, 17 bp, Homo sapiens
tagagtgtagactgtgg

SEQ ID NO: 4102966 - DNA, 13 bp, Homo sapiens
tagagttaagaag

SEQ ID NO: 4102967 - DNA, 17 bp, Homo sapiens
tagagttaagaagctgt

SEQ ID NO: 4102968 - DNA, 23 bp, Homo sapiens
tagagttcggtctgacagtcctt

SEQ ID NO: 4102969 - DNA, 14 bp, Homo sapiens
tagagttgctgaga

SEQ ID NO: 4102970 - DNA, 23 bp, Homo sapiens
tagagtttctgtttgattctttt

SEQ ID NO: 4102971 - DNA, 15 bp, Homo sapiens
tagataaaagctgaa

SEQ ID NO: 4102972 - DNA, 19 bp, Homo sapiens
tagataaatatttgacttg

SEQ ID NO: 4102973 - DNA, 11 bp, Homo sapiens
tagatagaaat

SEQ ID NO: 4102974 - DNA, 12 bp, Homo sapiens
tagatagaaata

SEQ ID NO: 4102975 - DNA, 16 bp, Homo sapiens
tagatatcctctcccc

SEQ ID NO: 4102976 - DNA, 21 bp, Homo sapiens
tagatattgtcctaagtgtca

SEQ ID NO: 4102977 - DNA, 13 bp, Homo sapiens
tagatattgtttt

SEQ ID NO: 4102978 - DNA, 18 bp, Homo sapiens
tagatattgttttctgta

SEQ ID NO: 4102979 - DNA, 12 bp, Homo sapiens
tagatattttca

SEQ ID NO: 4102980 - DNA, 15 bp, Homo sapiens
tagatattttcacaa

SEQ ID NO: 4102981 - DNA, 20 bp, Homo sapiens
tagatattttcacaatgtca

SEQ ID NO: 4102982 - DNA, 13 bp, Homo sapiens
tagatcaaatact

SEQ ID NO: 4102983 - DNA, 12 bp, Homo sapiens
tagatctccagc

SEQ ID NO: 4102984 - DNA, 13 bp, Homo sapiens
tagatctccagcg

SEQ ID NO: 4102985 - DNA, 19 bp, Homo sapiens
tagatgcaagatatttata

SEQ ID NO: 4102986 - DNA, 12 bp, Homo sapiens
tagatgcagaaa

SEQ ID NO: 4102987 - DNA, 13 bp, Homo sapiens
tagatgcagaaaa

SEQ ID NO: 4102988 - DNA, 20 bp, Homo sapiens
tagatgcagaaaaagaaaaa

SEQ ID NO: 4102989 - DNA, 17 bp, Homo sapiens
tagatgcatcactgggt

SEQ ID NO: 4102990 - DNA, 14 bp, Homo sapiens
tagatgctggccca

SEQ ID NO: 4102991 - DNA, 18 bp, Homo sapiens
tagatggcctcttactaa

SEQ ID NO: 4102992 - DNA, 19 bp, Homo sapiens
tagatggtttgagcctgag

SEQ ID NO: 4102993 - DNA, 12 bp, Homo sapiens
tagatgtatata

SEQ ID NO: 4102994 - DNA, 18 bp, Homo sapiens
tagatgtccctttcttgg

SEQ ID NO: 4102995 - DNA, 16 bp, Homo sapiens
tagatgtgattaacat

SEQ ID NO: 4102996 - DNA, 20 bp, Homo sapiens
tagatgtgccaataaccaag

SEQ ID NO: 4102997 - DNA, 22 bp, Homo sapiens
tagatgtttcaactgtgctctt

SEQ ID NO: 4102998 - DNA, 16 bp, Homo sapiens
tagatgttttggtaga

SEQ ID NO: 4102999 - DNA, 21 bp, Homo sapiens
tagatgttttggtagattaaa

SEQ ID NO: 4103000 - DNA, 15 bp, Homo sapiens
tagattaaatataga

SEQ ID NO: 4103001 - DNA, 16 bp, Homo sapiens
tagattgcttctgtag

SEQ ID NO: 4103002 - DNA, 14 bp, Homo sapiens
tagatttagtgtaa

SEQ ID NO: 4103003 - DNA, 16 bp, Homo sapiens
tagatttcatagttca

SEQ ID NO: 4103004 - DNA, 23 bp, Homo sapiens
tagatttcatagttcagaattta

SEQ ID NO: 4103005 - DNA, 17 bp, Homo sapiens
tagattttcatgttctt

SEQ ID NO: 4103006 - DNA, 14 bp, Homo sapiens
tagcaaaaacatgt

SEQ ID NO: 4103007 - DNA, 22 bp, Homo sapiens
tagcaaatgagacagcagtctt

SEQ ID NO: 4103008 - DNA, 18 bp, Homo sapiens
tagcaacaacaattggta

SEQ ID NO: 4103009 - DNA, 12 bp, Homo sapiens
tagcaacaggaa

SEQ ID NO: 4103010 - DNA, 12 bp, Homo sapiens
tagcaagacaca

SEQ ID NO: 4103011 - DNA, 14 bp, Homo sapiens
tagcaagctggcct

SEQ ID NO: 4103012 - DNA, 16 bp, Homo sapiens
tagcaaggcatgatgt

SEQ ID NO: 4103013 - DNA, 14 bp, Homo sapiens
tagcaaggctgggt

SEQ ID NO: 4103014 - DNA, 19 bp, Homo sapiens
tagcaaggtcatttcttca

SEQ ID NO: 4103015 - DNA, 18 bp, Homo sapiens
tagcaagttacagtgatg

SEQ ID NO: 4103016 - DNA, 18 bp, Homo sapiens
tagcaagttctagagaag

SEQ ID NO: 4103017 - DNA, 19 bp, Homo sapiens
tagcaagttctagagaaga

SEQ ID NO: 4103018 - DNA, 14 bp, Homo sapiens
tagcaatctcttca

SEQ ID NO: 4103019 - DNA, 18 bp, Homo sapiens
tagcaccttcagggctga

SEQ ID NO: 4103020 - DNA, 21 bp, Homo sapiens
tagcacttccttgccagtctt

SEQ ID NO: 4103021 - DNA, 16 bp, Homo sapiens
tagcacttgacctttt

SEQ ID NO: 4103022 - DNA, 18 bp, Homo sapiens
tagcagacagaaactgga

SEQ ID NO: 4103023 - DNA, 22 bp, Homo sapiens
tagcagaggggtaagagaggat

SEQ ID NO: 4103024 - DNA, 20 bp, Homo sapiens
tagcagattttaattttgaa

SEQ ID NO: 4103025 - DNA, 14 bp, Homo sapiens
tagcagcaactgaa

SEQ ID NO: 4103026 - DNA, 16 bp, Homo sapiens
tagcagcaactgaaga

SEQ ID NO: 4103027 - DNA, 17 bp, Homo sapiens
tagcagcaactgaagac

SEQ ID NO: 4103028 - DNA, 19 bp, Homo sapiens
tagcagcaactgaagacaa

SEQ ID NO: 4103029 - DNA, 17 bp, Homo sapiens
taggggatggtccagga

SEQ ID NO: 4103030 - DNA, 15 bp, Homo sapiens
tagggggctttctgg

SEQ ID NO: 4103031 - DNA, 14 bp, Homo sapiens
taggggtcactgta

SEQ ID NO: 4103032 - DNA, 16 bp, Homo sapiens
tagggtactaaattta

SEQ ID NO: 4103033 - DNA, 20 bp, Homo sapiens
tagggtactaaatttaaatt

SEQ ID NO: 4103034 - DNA, 18 bp, Homo sapiens
tagggtagaatgattaat

SEQ ID NO: 4103035 - DNA, 22 bp, Homo sapiens
tagggtgaaccacttcattctg

SEQ ID NO: 4103036 - DNA, 17 bp, Homo sapiens
tagggttataataatgt

SEQ ID NO: 4103037 - DNA, 16 bp, Homo sapiens
taggtaagctgtgcct

SEQ ID NO: 4103038 - DNA, 20 bp, Homo sapiens
taggtaatcaatgaatattg

SEQ ID NO: 4103039 - DNA, 13 bp, Homo sapiens
taggtaatgtttt

SEQ ID NO: 4103040 - DNA, 16 bp, Homo sapiens
taggtaatgttttgta

SEQ ID NO: 4103041 - DNA, 22 bp, Homo sapiens
taggtaatgttttgtatataca

SEQ ID NO: 4103042 - DNA, 15 bp, Homo sapiens
taggtagactttgct

SEQ ID NO: 4103043 - DNA, 19 bp, Homo sapiens
taggtagtttggatatttt

SEQ ID NO: 4103044 - DNA, 21 bp, Homo sapiens
taggtatttctaacgccagca

SEQ ID NO: 4103045 - DNA, 11 bp, Homo sapiens
taggtattttg

SEQ ID NO: 4103046 - DNA, 15 bp, Homo sapiens
taggtcactcctggg

SEQ ID NO: 4103047 - DNA, 21 bp, Homo sapiens
taggtccgtccggtgtgtcag

SEQ ID NO: 4103048 - DNA, 15 bp, Homo sapiens
taggtctcctcaggg

SEQ ID NO: 4103049 - DNA, 22 bp, Homo sapiens
taggtgatgtttgctcttgttt

SEQ ID NO: 4103050 - DNA, 16 bp, Homo sapiens
taggtgtcatttccat

SEQ ID NO: 4103051 - DNA, 15 bp, Homo sapiens
taggttcccctgtca

SEQ ID NO: 4103052 - DNA, 20 bp, Homo sapiens
taggttccctgttcttcctc

SEQ ID NO: 4103053 - DNA, 13 bp, Homo sapiens
taggttgggacac

SEQ ID NO: 4103054 - DNA, 15 bp, Homo sapiens
taggtttctctccct

SEQ ID NO: 4103055 - DNA, 20 bp, Homo sapiens
taggtttttctcatgtatct

SEQ ID NO: 4103056 - DNA, 18 bp, Homo sapiens
tagtaacttcttatggaa

SEQ ID NO: 4103057 - DNA, 21 bp, Homo sapiens
tagtaagaaatttgcagtttt

SEQ ID NO: 4103058 - DNA, 17 bp, Homo sapiens
tagtaagatgcactgaa

SEQ ID NO: 4103059 - DNA, 14 bp, Homo sapiens
tagtaatagagcaa

SEQ ID NO: 4103060 - DNA, 20 bp, Homo sapiens
tagtaatagagcaaaattga

SEQ ID NO: 4103061 - DNA, 14 bp, Homo sapiens
tagtaattgacatg

SEQ ID NO: 4103062 - DNA, 15 bp, Homo sapiens
tagtacaaattataa

SEQ ID NO: 4103063 - DNA, 20 bp, Homo sapiens
tagtaccatttatacaaatt

SEQ ID NO: 4103064 - DNA, 19 bp, Homo sapiens
tagtactcctgcaaaattt

SEQ ID NO: 4103065 - DNA, 18 bp, Homo sapiens
tagtagattttaaagaca

SEQ ID NO: 4103066 - DNA, 19 bp, Homo sapiens
tagtagttcctgctacaac

SEQ ID NO: 4103067 - DNA, 16 bp, Homo sapiens
tagtataaagaaaagt

SEQ ID NO: 4103068 - DNA, 20 bp, Homo sapiens
tagtattaatactacccata

SEQ ID NO: 4103069 - DNA, 17 bp, Homo sapiens
tagtattcattctgcat

SEQ ID NO: 4103070 - DNA, 22 bp, Homo sapiens
tagtattggagcacatgttact

SEQ ID NO: 4103071 - DNA, 16 bp, Homo sapiens
tagtatttatttaatg

SEQ ID NO: 4103072 - DNA, 14 bp, Homo sapiens
tagtatttctcagg

SEQ ID NO: 4103073 - DNA, 23 bp, Homo sapiens
tagtcaaatgtaatgtggcttct

SEQ ID NO: 4103074 - DNA, 19 bp, Homo sapiens
tagtcaatttctacttctg

SEQ ID NO: 4103075 - DNA, 13 bp, Homo sapiens
tagtcaggtgctc

SEQ ID NO: 4103076 - DNA, 14 bp, Homo sapiens
tagtcaggtgctca

SEQ ID NO: 4103077 - DNA, 16 bp, Homo sapiens
tagtcaggtgctcaat

SEQ ID NO: 4103078 - DNA, 17 bp, Homo sapiens
tagtcatccaacaagaa

SEQ ID NO: 4103079 - DNA, 18 bp, Homo sapiens
tagtcatccaacaagaag

SEQ ID NO: 4103080 - DNA, 23 bp, Homo sapiens
tagtcatccaacaagaagaaata

SEQ ID NO: 4103081 - DNA, 19 bp, Homo sapiens
tagtcatttactaaacata

SEQ ID NO: 4103082 - DNA, 23 bp, Homo sapiens
tagtcccagctacttgggaggct

SEQ ID NO: 4103083 - DNA, 14 bp, Homo sapiens
tagtcccttcccct

SEQ ID NO: 4103084 - DNA, 19 bp, Homo sapiens
tagtctcagtttgtgtgtc

SEQ ID NO: 4103085 - DNA, 22 bp, Homo sapiens
tagtctcagtttgtgtgtctta

SEQ ID NO: 4103086 - DNA, 18 bp, Homo sapiens
tagtctcctttgcactga

SEQ ID NO: 4103087 - DNA, 21 bp, Homo sapiens
tagtctcctttgcactgaggg

SEQ ID NO: 4103088 - DNA, 22 bp, Homo sapiens
tagtctcctttgcactgagggc

SEQ ID NO: 4103089 - DNA, 14 bp, Homo sapiens
tagtctgaaactgg

SEQ ID NO: 4103090 - DNA, 15 bp, Homo sapiens
tagtctgaaactggc

SEQ ID NO: 4103091 - DNA, 22 bp, Homo sapiens
tagtcttctcaaattagaaagt

SEQ ID NO: 4103092 - DNA, 14 bp, Homo sapiens
tagtcttctcatag

SEQ ID NO: 4103093 - DNA, 19 bp, Homo sapiens
tagtcttctcatagcatta

SEQ ID NO: 4103094 - DNA, 24 bp, Homo sapiens
tagtgaaaccccatctctactgaa

SEQ ID NO: 4103095 - DNA, 23 bp, Homo sapiens
tagtgaaataaattctgattctt

SEQ ID NO: 4103096 - DNA, 18 bp, Homo sapiens
tagtgaatactgctacag

SEQ ID NO: 4103097 - DNA, 18 bp, Homo sapiens
tagtgatggttcccctgt

SEQ ID NO: 4103098 - DNA, 15 bp, Homo sapiens
tagtgcagcagggca

SEQ ID NO: 4103099 - DNA, 15 bp, Homo sapiens
tagtgcagctgattt

SEQ ID NO: 4103100 - DNA, 19 bp, Homo sapiens
tagtgccaatgatgtgacc

SEQ ID NO: 4103101 - DNA, 14 bp, Homo sapiens
tagtggatgactgt

SEQ ID NO: 4103102 - DNA, 23 bp, Homo sapiens
tagtggatgactgttgatgaagt

SEQ ID NO: 4103103 - DNA, 16 bp, Homo sapiens
tagtggtctttgtaag

SEQ ID NO: 4103104 - DNA, 18 bp, Homo sapiens
tagtggtctttgtaagag

SEQ ID NO: 4103105 - DNA, 23 bp, Homo sapiens
tagtggtctttgtaagagtgtag

SEQ ID NO: 4103106 - DNA, 17 bp, Homo sapiens
tagtgtaataagactta

SEQ ID NO: 4103107 - DNA, 15 bp, Homo sapiens
tagtgtaatatacca

SEQ ID NO: 4103108 - DNA, 17 bp, Homo sapiens
tagtgtagtcaggtgct

SEQ ID NO: 4103109 - DNA, 14 bp, Homo sapiens
tagtgtataaaaac

SEQ ID NO: 4103110 - DNA, 17 bp, Homo sapiens
tagtgtcacttacctag

SEQ ID NO: 4103111 - DNA, 23 bp, Homo sapiens
tagtgtgtgtgcagagtccattt

SEQ ID NO: 4103112 - DNA, 20 bp, Homo sapiens
tagtgtgttctgattagaaa

SEQ ID NO: 4103113 - DNA, 15 bp, Homo sapiens
tagtgttctgctcct

SEQ ID NO: 4103114 - DNA, 17 bp, Homo sapiens
tagtgttctgctcctgc

SEQ ID NO: 4103115 - DNA, 19 bp, Homo sapiens
tagtgttctgctcctgctt

SEQ ID NO: 4103116 - DNA, 12 bp, Homo sapiens
tagtgttctgtt

SEQ ID NO: 4103117 - DNA, 19 bp, Homo sapiens
tagttaacctagaagtatt

SEQ ID NO: 4103118 - DNA, 23 bp, Homo sapiens
tagttaagacatgatttccttga

SEQ ID NO: 4103119 - DNA, 23 bp, Homo sapiens
tagttaatattgtgaagaaaaat

SEQ ID NO: 4103120 - DNA, 19 bp, Homo sapiens
tagttaatggattaaattt

SEQ ID NO: 4103121 - DNA, 17 bp, Homo sapiens
tagttacctactgagta

SEQ ID NO: 4103122 - DNA, 15 bp, Homo sapiens
tagttataaatagcc

SEQ ID NO: 4103123 - DNA, 13 bp, Homo sapiens
tagttattattta

SEQ ID NO: 4103124 - DNA, 15 bp, Homo sapiens
tagttattatttaat

SEQ ID NO: 4103125 - DNA, 23 bp, Homo sapiens
tagttattttataatcaatgaat

SEQ ID NO: 4103126 - DNA, 19 bp, Homo sapiens
tagttcaatatttgttact

SEQ ID NO: 4103127 - DNA, 23 bp, Homo sapiens
tagttcagaatttagtgtatcca

SEQ ID NO: 4103128 - DNA, 17 bp, Homo sapiens
tagttctgaggtccctg

SEQ ID NO: 4103129 - DNA, 14 bp, Homo sapiens
tagttctgccaggc

SEQ ID NO: 4103130 - DNA, 16 bp, Homo sapiens
tagttctttcctcccc

SEQ ID NO: 4103131 - DNA, 20 bp, Homo sapiens
tagttctttcctccccctgc

SEQ ID NO: 4103132 - DNA, 20 bp, Homo sapiens
tagcagcaccgttctgtgca

SEQ ID NO: 4103133 - DNA, 14 bp, Homo sapiens
tagcagcttccaga

SEQ ID NO: 4103134 - DNA, 22 bp, Homo sapiens
tagcaggtggtcctgagacctg

SEQ ID NO: 4103135 - DNA, 20 bp, Homo sapiens
tagcagtaaaagatgaagtt

SEQ ID NO: 4103136 - DNA, 18 bp, Homo sapiens
tagcataaataaaactga

SEQ ID NO: 4103137 - DNA, 20 bp, Homo sapiens
tagcatgttgagccaggcct

SEQ ID NO: 4103138 - DNA, 22 bp, Homo sapiens
tagcatgtttatatctgcaaaa

SEQ ID NO: 4103139 - DNA, 14 bp, Homo sapiens
tagccaatgtggga

SEQ ID NO: 4103140 - DNA, 15 bp, Homo sapiens
tagccacagctgctg

SEQ ID NO: 4103141 - DNA, 16 bp, Homo sapiens
tagccacagctgctgt

SEQ ID NO: 4103142 - DNA, 22 bp, Homo sapiens
tagccacagctgctgttctcag

SEQ ID NO: 4103143 - DNA, 20 bp, Homo sapiens
tagccaccagtgtcctccaa

SEQ ID NO: 4103144 - DNA, 20 bp, Homo sapiens
tagccagcacacagggcagt

SEQ ID NO: 4103145 - DNA, 18 bp, Homo sapiens
tagccagcccctcttccc

SEQ ID NO: 4103146 - DNA, 15 bp, Homo sapiens
tagccaggatcatgg

SEQ ID NO: 4103147 - DNA, 18 bp, Homo sapiens
tagccaggatcatggtgt

SEQ ID NO: 4103148 - DNA, 13 bp, Homo sapiens
tagccatctgcac

SEQ ID NO: 4103149 - DNA, 14 bp, Homo sapiens
tagccatggctggg

SEQ ID NO: 4103150 - DNA, 15 bp, Homo sapiens
tagcccagactctga

SEQ ID NO: 4103151 - DNA, 16 bp, Homo sapiens
tagcccagcactgtga

SEQ ID NO: 4103152 - DNA, 17 bp, Homo sapiens
tagccccctggcctctg

SEQ ID NO: 4103153 - DNA, 23 bp, Homo sapiens
tagcccctctccccgcagtgttt

SEQ ID NO: 4103154 - DNA, 22 bp, Homo sapiens
tagcccctggggtggccaccag

SEQ ID NO: 4103155 - DNA, 15 bp, Homo sapiens
tagccctccccctca

SEQ ID NO: 4103156 - DNA, 15 bp, Homo sapiens
tagccttgcttgtta

SEQ ID NO: 4103157 - DNA, 13 bp, Homo sapiens
tagcctttcttgt

SEQ ID NO: 4103158 - DNA, 17 bp, Homo sapiens
tagcctttttgtataaa

SEQ ID NO: 4103159 - DNA, 15 bp, Homo sapiens
tagcggagcccagcc

SEQ ID NO: 4103160 - DNA, 18 bp, Homo sapiens
tagcggagcccagcctgg

SEQ ID NO: 4103161 - DNA, 20 bp, Homo sapiens
tagctaaacggattccaaag

SEQ ID NO: 4103162 - DNA, 15 bp, Homo sapiens
tagctaagtacacaa

SEQ ID NO: 4103163 - DNA, 19 bp, Homo sapiens
tagctaatgtaataactgt

SEQ ID NO: 4103164 - DNA, 19 bp, Homo sapiens
tagctaatttatttcccca

SEQ ID NO: 4103165 - DNA, 18 bp, Homo sapiens
tagctactgtatgcaaag

SEQ ID NO: 4103166 - DNA, 20 bp, Homo sapiens
tagctatatccatgtactgt

SEQ ID NO: 4103167 - DNA, 18 bp, Homo sapiens
tagctcactgcagcctca

SEQ ID NO: 4103168 - DNA, 19 bp, Homo sapiens
tagctccttggagcaggca

SEQ ID NO: 4103169 - DNA, 14 bp, Homo sapiens
tagctctctaggcc

SEQ ID NO: 4103170 - DNA, 17 bp, Homo sapiens
tagctctctaggcctct

SEQ ID NO: 4103171 - DNA, 21 bp, Homo sapiens
tagctgacccagccccttgag

SEQ ID NO: 4103172 - DNA, 17 bp, Homo sapiens
tagctgagcgtggtggc

SEQ ID NO: 4103173 - DNA, 16 bp, Homo sapiens
tagctgccagtgctgg

SEQ ID NO: 4103174 - DNA, 16 bp, Homo sapiens
tagctgttgagctgtt

SEQ ID NO: 4103175 - DNA, 19 bp, Homo sapiens
tagcttaactaatttgaat

SEQ ID NO: 4103176 - DNA, 12 bp, Homo sapiens
tagcttaagaaa

SEQ ID NO: 4103177 - DNA, 15 bp, Homo sapiens
tagcttaagaaaaaa

SEQ ID NO: 4103178 - DNA, 22 bp, Homo sapiens
tagcttctgcttttctgccctg

SEQ ID NO: 4103179 - DNA, 23 bp, Homo sapiens
tagcttgacacagtcagcatgct

SEQ ID NO: 4103180 - DNA, 15 bp, Homo sapiens
tagctttattcttca

SEQ ID NO: 4103181 - DNA, 17 bp, Homo sapiens
tagctttttaaaacatt

SEQ ID NO: 4103182 - DNA, 15 bp, Homo sapiens
tagctttttaattgt

SEQ ID NO: 4103183 - DNA, 16 bp, Homo sapiens
tagctttttaattgtt

SEQ ID NO: 4103184 - DNA, 19 bp, Homo sapiens
taggaaaagtacatttaat

SEQ ID NO: 4103185 - DNA, 20 bp, Homo sapiens
taggaaactgaagcataaag

SEQ ID NO: 4103186 - DNA, 14 bp, Homo sapiens
taggaacttcagag

SEQ ID NO: 4103187 - DNA, 17 bp, Homo sapiens
taggaaggcacttctgc

SEQ ID NO: 4103188 - DNA, 21 bp, Homo sapiens
taggaaggtctcattcttcca

SEQ ID NO: 4103189 - DNA, 18 bp, Homo sapiens
taggaagtgtaacagctg

SEQ ID NO: 4103190 - DNA, 19 bp, Homo sapiens
taggaagtgtaacagctga

SEQ ID NO: 4103191 - DNA, 17 bp, Homo sapiens
taggaagttgacttata

SEQ ID NO: 4103192 - DNA, 16 bp, Homo sapiens
taggaagttttctgta

SEQ ID NO: 4103193 - DNA, 17 bp, Homo sapiens
taggaagttttctgtag

SEQ ID NO: 4103194 - DNA, 17 bp, Homo sapiens
taggaatgtacatgaag

SEQ ID NO: 4103195 - DNA, 12 bp, Homo sapiens
taggagaagcca

SEQ ID NO: 4103196 - DNA, 14 bp, Homo sapiens
taggagaggatgag

SEQ ID NO: 4103197 - DNA, 22 bp, Homo sapiens
taggagataccaggttgaaaga

SEQ ID NO: 4103198 - DNA, 21 bp, Homo sapiens
taggagggagttatctaaaag

SEQ ID NO: 4103199 - DNA, 22 bp, Homo sapiens
taggagtggttctcatttggtc

SEQ ID NO: 4103200 - DNA, 17 bp, Homo sapiens
taggagtgtgtgatttt

SEQ ID NO: 4103201 - DNA, 13 bp, Homo sapiens
taggatgtttttc

SEQ ID NO: 4103202 - DNA, 21 bp, Homo sapiens
taggatttaacagtcatttaa

SEQ ID NO: 4103203 - DNA, 14 bp, Homo sapiens
taggcaagcaggac

SEQ ID NO: 4103204 - DNA, 19 bp, Homo sapiens
taggcaaggctatgtgatt

SEQ ID NO: 4103205 - DNA, 20 bp, Homo sapiens
taggcagggtgtctgccccc

SEQ ID NO: 4103206 - DNA, 19 bp, Homo sapiens
taggccaccccctatcctc

SEQ ID NO: 4103207 - DNA, 12 bp, Homo sapiens
taggcccaggat

SEQ ID NO: 4103208 - DNA, 13 bp, Homo sapiens
taggcccaggcct

SEQ ID NO: 4103209 - DNA, 19 bp, Homo sapiens
taggcccaggcctgggttt

SEQ ID NO: 4103210 - DNA, 15 bp, Homo sapiens
taggcccctggggct

SEQ ID NO: 4103211 - DNA, 14 bp, Homo sapiens
taggccctttcagt

SEQ ID NO: 4103212 - DNA, 16 bp, Homo sapiens
taggcctgggtgctgg

SEQ ID NO: 4103213 - DNA, 15 bp, Homo sapiens
taggcctgtcccttg

SEQ ID NO: 4103214 - DNA, 14 bp, Homo sapiens
taggcgagtgccag

SEQ ID NO: 4103215 - DNA, 16 bp, Homo sapiens
taggctatttgtaaat

SEQ ID NO: 4103216 - DNA, 20 bp, Homo sapiens
taggctccttcaacaaggct

SEQ ID NO: 4103217 - DNA, 15 bp, Homo sapiens
taggctctgcacaga

SEQ ID NO: 4103218 - DNA, 18 bp, Homo sapiens
taggctctgcacagatgg

SEQ ID NO: 4103219 - DNA, 21 bp, Homo sapiens
taggctctgcacagatggatt

SEQ ID NO: 4103220 - DNA, 21 bp, Homo sapiens
taggctcttatgtgtgccttt

SEQ ID NO: 4103221 - DNA, 19 bp, Homo sapiens
taggctggagaagctcacc

SEQ ID NO: 4103222 - DNA, 18 bp, Homo sapiens
tagggacctcagaggttt

SEQ ID NO: 4103223 - DNA, 14 bp, Homo sapiens
tagggacttaaaaa

SEQ ID NO: 4103224 - DNA, 16 bp, Homo sapiens
tagggagaaatgttgt

SEQ ID NO: 4103225 - DNA, 17 bp, Homo sapiens
tagggagcctcccctcc

SEQ ID NO: 4103226 - DNA, 22 bp, Homo sapiens
tagggaggaccttatctgtgcg

SEQ ID NO: 4103227 - DNA, 16 bp, Homo sapiens
tagggaggcagcctcc

SEQ ID NO: 4103228 - DNA, 22 bp, Homo sapiens
tagggagttcatctggagggtt

SEQ ID NO: 4103229 - DNA, 13 bp, Homo sapiens
tagggcactgggc

SEQ ID NO: 4103230 - DNA, 15 bp, Homo sapiens
tagggcactgggctg

SEQ ID NO: 4103231 - DNA, 15 bp, Homo sapiens
tagggccaggcaggt

SEQ ID NO: 4103232 - DNA, 14 bp, Homo sapiens
tagggctgtaaaat

SEQ ID NO: 4103233 - DNA, 20 bp, Homo sapiens
tagggcttttattttttctt

SEQ ID NO: 4103234 - DNA, 19 bp, Homo sapiens
taggggaacagaccagtga

SEQ ID NO: 4103235 - DNA, 20 bp, Homo sapiens
tatgagtacaaatgccttaa

SEQ ID NO: 4103236 - DNA, 23 bp, Homo sapiens
tatgagtcaatgtgcagtgtagc

SEQ ID NO: 4103237 - DNA, 22 bp, Homo sapiens
tatgagtttttgatagctttat

SEQ ID NO: 4103238 - DNA, 13 bp, Homo sapiens
tatgatcagtgtt

SEQ ID NO: 4103239 - DNA, 14 bp, Homo sapiens
tatgatctctctag

SEQ ID NO: 4103240 - DNA, 13 bp, Homo sapiens
tatgatgtatatt

SEQ ID NO: 4103241 - DNA, 17 bp, Homo sapiens
tatgatttataaacaga

SEQ ID NO: 4103242 - DNA, 16 bp, Homo sapiens
tatgatttgttttgaa

SEQ ID NO: 4103243 - DNA, 20 bp, Homo sapiens
tatgatttgttttgaatttt

SEQ ID NO: 4103244 - DNA, 17 bp, Homo sapiens
tatgcaaggaaggaaag

SEQ ID NO: 4103245 - DNA, 22 bp, Homo sapiens
tatgcaatggattttcaaccag

SEQ ID NO: 4103246 - DNA, 19 bp, Homo sapiens
tatgcagtgatatggcaga

SEQ ID NO: 4103247 - DNA, 22 bp, Homo sapiens
tatgcagtgatatggcagaaga

SEQ ID NO: 4103248 - DNA, 18 bp, Homo sapiens
tatgcatggtgccccagg

SEQ ID NO: 4103249 - DNA, 17 bp, Homo sapiens
tatgccagctcagtccc

SEQ ID NO: 4103250 - DNA, 17 bp, Homo sapiens
tatgccatgatggaaat

SEQ ID NO: 4103251 - DNA, 23 bp, Homo sapiens
tatgccccttcttgggccccaga

SEQ ID NO: 4103252 - DNA, 13 bp, Homo sapiens
tatgcctgaatga

SEQ ID NO: 4103253 - DNA, 20 bp, Homo sapiens
tatgcgactgcgaacactga

SEQ ID NO: 4103254 - DNA, 13 bp, Homo sapiens
tatgctaatcagg

SEQ ID NO: 4103255 - DNA, 13 bp, Homo sapiens
tatgctatttctg

SEQ ID NO: 4103256 - DNA, 11 bp, Homo sapiens
tatgctcaggt

SEQ ID NO: 4103257 - DNA, 18 bp, Homo sapiens
tatgctctgcatgttaca

SEQ ID NO: 4103258 - DNA, 15 bp, Homo sapiens
tatgctgatttattt

SEQ ID NO: 4103259 - DNA, 16 bp, Homo sapiens
tatgctgccaaatttt

SEQ ID NO: 4103260 - DNA, 20 bp, Homo sapiens
tatgctgccaaattttggcc

SEQ ID NO: 4103261 - DNA, 12 bp, Homo sapiens
tatgctggccag

SEQ ID NO: 4103262 - DNA, 18 bp, Homo sapiens
tatgctggccagcaccct

SEQ ID NO: 4103263 - DNA, 20 bp, Homo sapiens
tatgctggccagcaccctct

SEQ ID NO: 4103264 - DNA, 19 bp, Homo sapiens
tatgcttaaaataagcagg

SEQ ID NO: 4103265 - DNA, 17 bp, Homo sapiens
tatgcttccagaaacac

SEQ ID NO: 4103266 - DNA, 23 bp, Homo sapiens
tatgcttccagaaacacccacag

SEQ ID NO: 4103267 - DNA, 13 bp, Homo sapiens
tatggaaaactgt

SEQ ID NO: 4103268 - DNA, 16 bp, Homo sapiens
tatggaaacactgatt

SEQ ID NO: 4103269 - DNA, 17 bp, Homo sapiens
tatggaactctctccac

SEQ ID NO: 4103270 - DNA, 19 bp, Homo sapiens
tatggaagggtttgtggct

SEQ ID NO: 4103271 - DNA, 16 bp, Homo sapiens
tatggaaggtggagcg

SEQ ID NO: 4103272 - DNA, 19 bp, Homo sapiens
tatggaaggtggagcgttc

SEQ ID NO: 4103273 - DNA, 18 bp, Homo sapiens
tatggaagttgcataatt

SEQ ID NO: 4103274 - DNA, 14 bp, Homo sapiens
tatggaattacatg

SEQ ID NO: 4103275 - DNA, 22 bp, Homo sapiens
tatggacaacttatttaaaaat

SEQ ID NO: 4103276 - DNA, 19 bp, Homo sapiens
tatggatgattcagaaatt

SEQ ID NO: 4103277 - DNA, 14 bp, Homo sapiens
tatggatttaagag

SEQ ID NO: 4103278 - DNA, 16 bp, Homo sapiens
tatggatttgaagttt

SEQ ID NO: 4103279 - DNA, 12 bp, Homo sapiens
tatggcagaaga

SEQ ID NO: 4103280 - DNA, 22 bp, Homo sapiens
tatggcagaagacaccagagca

SEQ ID NO: 4103281 - DNA, 23 bp, Homo sapiens
tatggcagaagacaccagagcag

SEQ ID NO: 4103282 - DNA, 19 bp, Homo sapiens
tatggccacatttaatatc

SEQ ID NO: 4103283 - DNA, 12 bp, Homo sapiens
tatggcccagaa

SEQ ID NO: 4103284 - DNA, 18 bp, Homo sapiens
tatggcccagaaacaaca

SEQ ID NO: 4103285 - DNA, 19 bp, Homo sapiens
tatgggggcatctcttccc

SEQ ID NO: 4103286 - DNA, 12 bp, Homo sapiens
tatggggtgggg

SEQ ID NO: 4103287 - DNA, 15 bp, Homo sapiens
tatgggtcctgcaat

SEQ ID NO: 4103288 - DNA, 20 bp, Homo sapiens
tatgggtgggattttgcaaa

SEQ ID NO: 4103289 - DNA, 19 bp, Homo sapiens
tatggtaactgctttctgt

SEQ ID NO: 4103290 - DNA, 19 bp, Homo sapiens
tatggtatgctggccagca

SEQ ID NO: 4103291 - DNA, 20 bp, Homo sapiens
tatggtgcagagaagctgga

SEQ ID NO: 4103292 - DNA, 20 bp, Homo sapiens
tatggttacttcttctctta

SEQ ID NO: 4103293 - DNA, 22 bp, Homo sapiens
tatggttacttcttctcttaga

SEQ ID NO: 4103294 - DNA, 17 bp, Homo sapiens
tatggttcccaataaaa

SEQ ID NO: 4103295 - DNA, 19 bp, Homo sapiens
tatggttcccaataaaagt

SEQ ID NO: 4103296 - DNA, 20 bp, Homo sapiens
tatggttcccaataaaagtg

SEQ ID NO: 4103297 - DNA, 21 bp, Homo sapiens
tatgtaagaattcagaagacc

SEQ ID NO: 4103298 - DNA, 14 bp, Homo sapiens
tatgtaatttatgc

SEQ ID NO: 4103299 - DNA, 14 bp, Homo sapiens
tatgtacatatata

SEQ ID NO: 4103300 - DNA, 15 bp, Homo sapiens
tatgtacatgagaag

SEQ ID NO: 4103301 - DNA, 16 bp, Homo sapiens
tatgtaccatgtacat

SEQ ID NO: 4103302 - DNA, 14 bp, Homo sapiens
tatgtactagtgtt

SEQ ID NO: 4103303 - DNA, 16 bp, Homo sapiens
tatgtagatgtgcatt

SEQ ID NO: 4103304 - DNA, 12 bp, Homo sapiens
tatgtataaaca

SEQ ID NO: 4103305 - DNA, 21 bp, Homo sapiens
tatgtataaacataagttgca

SEQ ID NO: 4103306 - DNA, 19 bp, Homo sapiens
tatgtatatttttttaatt

SEQ ID NO: 4103307 - DNA, 13 bp, Homo sapiens
tatgtatgaagga

SEQ ID NO: 4103308 - DNA, 13 bp, Homo sapiens
tatgtatgtttac

SEQ ID NO: 4103309 - DNA, 13 bp, Homo sapiens
tatgtattattta

SEQ ID NO: 4103310 - DNA, 12 bp, Homo sapiens
tatgtattcttt

SEQ ID NO: 4103311 - DNA, 14 bp, Homo sapiens
tatgtattttccta

SEQ ID NO: 4103312 - DNA, 21 bp, Homo sapiens
tatgtcaataaacaacagctg

SEQ ID NO: 4103313 - DNA, 13 bp, Homo sapiens
tatgtcctaagga

SEQ ID NO: 4103314 - DNA, 20 bp, Homo sapiens
tatgtcgtcgagctcccccc

SEQ ID NO: 4103315 - DNA, 15 bp, Homo sapiens
tatgtctatttaagc

SEQ ID NO: 4103316 - DNA, 13 bp, Homo sapiens
tatgtctgtttaa

SEQ ID NO: 4103317 - DNA, 20 bp, Homo sapiens
tatgtctgtttaagaaaagt

SEQ ID NO: 4103318 - DNA, 12 bp, Homo sapiens
tatgtgaatgat

SEQ ID NO: 4103319 - DNA, 19 bp, Homo sapiens
tatgtgacaattttgtaca

SEQ ID NO: 4103320 - DNA, 14 bp, Homo sapiens
tatgtgacatttta

SEQ ID NO: 4103321 - DNA, 12 bp, Homo sapiens
tatgtgcactgt

SEQ ID NO: 4103322 - DNA, 17 bp, Homo sapiens
tatgtgcactgtcactt

SEQ ID NO: 4103323 - DNA, 22 bp, Homo sapiens
tatgtgcactgtcactttgctc

SEQ ID NO: 4103324 - DNA, 19 bp, Homo sapiens
tatgtgggttgcctggtga

SEQ ID NO: 4103325 - DNA, 16 bp, Homo sapiens
tatgtgtctttataga

SEQ ID NO: 4103326 - DNA, 16 bp, Homo sapiens
tatgtgtgaggagctg

SEQ ID NO: 4103327 - DNA, 16 bp, Homo sapiens
tatgtgtttactttaa

SEQ ID NO: 4103328 - DNA, 12 bp, Homo sapiens
tatgttaaatac

SEQ ID NO: 4103329 - DNA, 15 bp, Homo sapiens
tatgttactattttc

SEQ ID NO: 4103330 - DNA, 20 bp, Homo sapiens
tatgttatgatattgtttaa

SEQ ID NO: 4103331 - DNA, 16 bp, Homo sapiens
tatgttattttgtgta

SEQ ID NO: 4103332 - DNA, 14 bp, Homo sapiens
tatgttcttataga

SEQ ID NO: 4103333 - DNA, 12 bp, Homo sapiens
tatgttgaatac

SEQ ID NO: 4103334 - DNA, 21 bp, Homo sapiens
tatgttgctataataaagaag

SEQ ID NO: 4103335 - DNA, 14 bp, Homo sapiens
tatgtttacatatc

SEQ ID NO: 4103336 - DNA, 17 bp, Homo sapiens
tatgtttgaatatggac

SEQ ID NO: 4103337 - DNA, 18 bp, Homo sapiens
tatgtttttaatatgcat

SEQ ID NO: 4103338 - DNA, 13 bp, Homo sapiens
tattaaaaaacaa

SEQ ID NO: 4103339 - DNA, 18 bp, Homo sapiens
tatcatcaagcaggaatt

SEQ ID NO: 4103340 - DNA, 14 bp, Homo sapiens
tatcatgcaaaata

SEQ ID NO: 4103341 - DNA, 13 bp, Homo sapiens
tatcatgctaaaa

SEQ ID NO: 4103342 - DNA, 22 bp, Homo sapiens
tatcatgctaaaattctataga

SEQ ID NO: 4103343 - DNA, 23 bp, Homo sapiens
tatccaaagaacttgatttgcat

SEQ ID NO: 4103344 - DNA, 17 bp, Homo sapiens
tatccaaatctgaagat

SEQ ID NO: 4103345 - DNA, 20 bp, Homo sapiens
tatccaaatctgaagattgc

SEQ ID NO: 4103346 - DNA, 21 bp, Homo sapiens
tatccaagatcaattccctct

SEQ ID NO: 4103347 - DNA, 22 bp, Homo sapiens
tatccaagatcaattccctctc

SEQ ID NO: 4103348 - DNA, 24 bp, Homo sapiens
tatccataatgcattcttctctgt

SEQ ID NO: 4103349 - DNA, 23 bp, Homo sapiens
tatccataggtttctctccctcc

SEQ ID NO: 4103350 - DNA, 17 bp, Homo sapiens
tatccatattgagtcaa

SEQ ID NO: 4103351 - DNA, 12 bp, Homo sapiens
tatccatctttt

SEQ ID NO: 4103352 - DNA, 13 bp, Homo sapiens
tatccatgtactg

SEQ ID NO: 4103353 - DNA, 15 bp, Homo sapiens
tatccatgtacttgt

SEQ ID NO: 4103354 - DNA, 21 bp, Homo sapiens
tatcccagctttaaaaagaaa

SEQ ID NO: 4103355 - DNA, 18 bp, Homo sapiens
tatccccaatcagctcct

SEQ ID NO: 4103356 - DNA, 18 bp, Homo sapiens
tatccccatccaggtctt

SEQ ID NO: 4103357 - DNA, 13 bp, Homo sapiens
tatccccatctcc

SEQ ID NO: 4103358 - DNA, 15 bp, Homo sapiens
tatccctcacctgta

SEQ ID NO: 4103359 - DNA, 16 bp, Homo sapiens
tatccctctcttcccc

SEQ ID NO: 4103360 - DNA, 15 bp, Homo sapiens
tatccctcttgtaag

SEQ ID NO: 4103361 - DNA, 14 bp, Homo sapiens
tatcccttcctttt

SEQ ID NO: 4103362 - DNA, 14 bp, Homo sapiens
tatccgctgccagc

SEQ ID NO: 4103363 - DNA, 23 bp, Homo sapiens
tatcctgacttctaatatcattc

SEQ ID NO: 4103364 - DNA, 21 bp, Homo sapiens
tatcctgcgggttttaattta

SEQ ID NO: 4103365 - DNA, 21 bp, Homo sapiens
tatccttataggcctgtccct

SEQ ID NO: 4103366 - DNA, 13 bp, Homo sapiens
tatccttccttca

SEQ ID NO: 4103367 - DNA, 23 bp, Homo sapiens
tatccttgggggctcccagggca

SEQ ID NO: 4103368 - DNA, 17 bp, Homo sapiens
tatcctttctaacaaaa

SEQ ID NO: 4103369 - DNA, 15 bp, Homo sapiens
tatccttttctgtgt

SEQ ID NO: 4103370 - DNA, 20 bp, Homo sapiens
tatcgaaataacaatgttaa

SEQ ID NO: 4103371 - DNA, 14 bp, Homo sapiens
tatcgagtttgcaa

SEQ ID NO: 4103372 - DNA, 22 bp, Homo sapiens
tatcgagtttgcaatgtcacaa

SEQ ID NO: 4103373 - DNA, 20 bp, Homo sapiens
tatcgctgacttcatggaat

SEQ ID NO: 4103374 - DNA, 18 bp, Homo sapiens
tatcgtattcaccttcag

SEQ ID NO: 4103375 - DNA, 12 bp, Homo sapiens
tatctaaatgat

SEQ ID NO: 4103376 - DNA, 12 bp, Homo sapiens
tatctaaattaa

SEQ ID NO: 4103377 - DNA, 18 bp, Homo sapiens
tatctaatatatatgaat

SEQ ID NO: 4103378 - DNA, 20 bp, Homo sapiens
tatctactgataaagaaaga

SEQ ID NO: 4103379 - DNA, 13 bp, Homo sapiens
tatctatagctaa

SEQ ID NO: 4103380 - DNA, 23 bp, Homo sapiens
tatctatcttccaaatgcaattt

SEQ ID NO: 4103381 - DNA, 17 bp, Homo sapiens
tatctattaatatatgt

SEQ ID NO: 4103382 - DNA, 10 bp, Homo sapiens
tatctcagaa

SEQ ID NO: 4103383 - DNA, 23 bp, Homo sapiens
tatctccaggattgaagagcatt

SEQ ID NO: 4103384 - DNA, 15 bp, Homo sapiens
tatctccatggccct

SEQ ID NO: 4103385 - DNA, 17 bp, Homo sapiens
tatctccatggccctgt

SEQ ID NO: 4103386 - DNA, 17 bp, Homo sapiens
tatctccttcccacccc

SEQ ID NO: 4103387 - DNA, 18 bp, Homo sapiens
tatctctatttaatattt

SEQ ID NO: 4103388 - DNA, 14 bp, Homo sapiens
tatctctgaggcta

SEQ ID NO: 4103389 - DNA, 11 bp, Homo sapiens
tatctctgtgt

SEQ ID NO: 4103390 - DNA, 21 bp, Homo sapiens
tatctcttttatatttgtagg

SEQ ID NO: 4103391 - DNA, 12 bp, Homo sapiens
tatctgaaaact

SEQ ID NO: 4103392 - DNA, 13 bp, Homo sapiens
tatctgaaaactg

SEQ ID NO: 4103393 - DNA, 14 bp, Homo sapiens
tatctgcagaacat

SEQ ID NO: 4103394 - DNA, 22 bp, Homo sapiens
tatctggaatattgtgattctg

SEQ ID NO: 4103395 - DNA, 18 bp, Homo sapiens
tatctggacaagccaact

SEQ ID NO: 4103396 - DNA, 23 bp, Homo sapiens
tatctggaggccttccagctgct

SEQ ID NO: 4103397 - DNA, 23 bp, Homo sapiens
tatctggccctcgacactcacca

SEQ ID NO: 4103398 - DNA, 19 bp, Homo sapiens
tatctgggattctacttta

SEQ ID NO: 4103399 - DNA, 18 bp, Homo sapiens
tatctgtgaggtgctgat

SEQ ID NO: 4103400 - DNA, 17 bp, Homo sapiens
tatctgtgcgtgaaaca

SEQ ID NO: 4103401 - DNA, 20 bp, Homo sapiens
tatctgtgtttttgaaatat

SEQ ID NO: 4103402 - DNA, 12 bp, Homo sapiens
tatctgttcttg

SEQ ID NO: 4103403 - DNA, 18 bp, Homo sapiens
tatctgtttaaagcatat

SEQ ID NO: 4103404 - DNA, 14 bp, Homo sapiens
tatcttaaatttga

SEQ ID NO: 4103405 - DNA, 18 bp, Homo sapiens
tatcttagttacatttct

SEQ ID NO: 4103406 - DNA, 15 bp, Homo sapiens
tatcttattttctca

SEQ ID NO: 4103407 - DNA, 18 bp, Homo sapiens
tatcttcaaactttcact

SEQ ID NO: 4103408 - DNA, 14 bp, Homo sapiens
tatcttccatattt

SEQ ID NO: 4103409 - DNA, 15 bp, Homo sapiens
tatcttcttcaaata

SEQ ID NO: 4103410 - DNA, 17 bp, Homo sapiens
tatcttggactgacatt

SEQ ID NO: 4103411 - DNA, 20 bp, Homo sapiens
tatcttggactgacatttag

SEQ ID NO: 4103412 - DNA, 20 bp, Homo sapiens
tatcttggggcaagactgca

SEQ ID NO: 4103413 - DNA, 19 bp, Homo sapiens
tatcttgtatggtttgcaa

SEQ ID NO: 4103414 - DNA, 20 bp, Homo sapiens
tatctttaaaaagcagtcct

SEQ ID NO: 4103415 - DNA, 21 bp, Homo sapiens
tatctttacaagcaggcactg

SEQ ID NO: 4103416 - DNA, 20 bp, Homo sapiens
tatctttccatgggagccag

SEQ ID NO: 4103417 - DNA, 22 bp, Homo sapiens
tatctttccatgggagccagct

SEQ ID NO: 4103418 - DNA, 18 bp, Homo sapiens
tatgaagagtattaatgt

SEQ ID NO: 4103419 - DNA, 19 bp, Homo sapiens
tatgaagagtattaatgta

SEQ ID NO: 4103420 - DNA, 17 bp, Homo sapiens
tatgaaggaatcattcc

SEQ ID NO: 4103421 - DNA, 22 bp, Homo sapiens
tatgaagtttaaaacagtattt

SEQ ID NO: 4103422 - DNA, 21 bp, Homo sapiens
tatgaataagcacttgaatca

SEQ ID NO: 4103423 - DNA, 21 bp, Homo sapiens
tatgaattcaagaaaggaaat

SEQ ID NO: 4103424 - DNA, 17 bp, Homo sapiens
tatgaatttaaatataa

SEQ ID NO: 4103425 - DNA, 23 bp, Homo sapiens
tatgaatttaaatataattctgt

SEQ ID NO: 4103426 - DNA, 15 bp, Homo sapiens
tatgacagatatatt

SEQ ID NO: 4103427 - DNA, 15 bp, Homo sapiens
tatgacagttatact

SEQ ID NO: 4103428 - DNA, 22 bp, Homo sapiens
tatgacatttaaatgtaactta

SEQ ID NO: 4103429 - DNA, 13 bp, Homo sapiens
tatgactaaagag

SEQ ID NO: 4103430 - DNA, 18 bp, Homo sapiens
tatgactaaagagagaat

SEQ ID NO: 4103431 - DNA, 19 bp, Homo sapiens
tatgactaaagagagaatg

SEQ ID NO: 4103432 - DNA, 16 bp, Homo sapiens
tatgactatgtaaact

SEQ ID NO: 4103433 - DNA, 21 bp, Homo sapiens
tatgactgagcgtagcataca

SEQ ID NO: 4103434 - DNA, 18 bp, Homo sapiens
tatgactgctccccagcc

SEQ ID NO: 4103435 - DNA, 15 bp, Homo sapiens
tatgagactttatgt

SEQ ID NO: 4103436 - DNA, 17 bp, Homo sapiens
tatgagccagacaaatg

SEQ ID NO: 4103437 - DNA, 19 bp, Homo sapiens
tatgagccagacaaatgga

SEQ ID NO: 4103438 - DNA, 12 bp, Homo sapiens
tatgagctgagg

SEQ ID NO: 4103439 - DNA, 16 bp, Homo sapiens
tatgagctgagggggg

SEQ ID NO: 4103440 - DNA, 18 bp, Homo sapiens
tatgagcttgctcattaa

SEQ ID NO: 4103441 - DNA, 18 bp, Homo sapiens
tatgagtaactattatta

SEQ ID NO: 4103442 - DNA, 22 bp, Homo sapiens
tatactgaaggaaaaacacaag

SEQ ID NO: 4103443 - DNA, 15 bp, Homo sapiens
tatactgatttaatt

SEQ ID NO: 4103444 - DNA, 16 bp, Homo sapiens
tatactgtacttaata

SEQ ID NO: 4103445 - DNA, 18 bp, Homo sapiens
tatactgtgtgcttgttt

SEQ ID NO: 4103446 - DNA, 22 bp, Homo sapiens
tatacttgtggttttcaaattg

SEQ ID NO: 4103447 - DNA, 19 bp, Homo sapiens
tatacttttcccctgttaa

SEQ ID NO: 4103448 - DNA, 20 bp, Homo sapiens
tatacttttcccctgttaaa

SEQ ID NO: 4103449 - DNA, 22 bp, Homo sapiens
tatacttttcccctgttaaaca

SEQ ID NO: 4103450 - DNA, 17 bp, Homo sapiens
tatacttttttcttatt

SEQ ID NO: 4103451 - DNA, 19 bp, Homo sapiens
tatacttttttcttattta

SEQ ID NO: 4103452 - DNA, 21 bp, Homo sapiens
tatagaatatttattacctct

SEQ ID NO: 4103453 - DNA, 17 bp, Homo sapiens
tatagagattgtacatt

SEQ ID NO: 4103454 - DNA, 22 bp, Homo sapiens
tatagatgcaagatatttatat

SEQ ID NO: 4103455 - DNA, 21 bp, Homo sapiens
tatagattagaaaaattccta

SEQ ID NO: 4103456 - DNA, 15 bp, Homo sapiens
tataggccagggcat

SEQ ID NO: 4103457 - DNA, 23 bp, Homo sapiens
tataggccagggcatgtgtatgt

SEQ ID NO: 4103458 - DNA, 23 bp, Homo sapiens
tataggcctgtcccttgcctctg

SEQ ID NO: 4103459 - DNA, 14 bp, Homo sapiens
tataggtcactcct

SEQ ID NO: 4103460 - DNA, 13 bp, Homo sapiens
tatagtatatctg

SEQ ID NO: 4103461 - DNA, 18 bp, Homo sapiens
tatagtatatctggacaa

SEQ ID NO: 4103462 - DNA, 14 bp, Homo sapiens
tatagtttaaaaca

SEQ ID NO: 4103463 - DNA, 18 bp, Homo sapiens
tatataaaaagaaaagat

SEQ ID NO: 4103464 - DNA, 20 bp, Homo sapiens
tatataagagcatgaaattt

SEQ ID NO: 4103465 - DNA, 23 bp, Homo sapiens
tatataagtgtacatatgtgctg

SEQ ID NO: 4103466 - DNA, 14 bp, Homo sapiens
tatataattttatg

SEQ ID NO: 4103467 - DNA, 22 bp, Homo sapiens
tatataatttttttatgttttg

SEQ ID NO: 4103468 - DNA, 11 bp, Homo sapiens
tatatacagtt

SEQ ID NO: 4103469 - DNA, 21 bp, Homo sapiens
tatatacagttattttggata

SEQ ID NO: 4103470 - DNA, 14 bp, Homo sapiens
tatatagaatgctg

SEQ ID NO: 4103471 - DNA, 13 bp, Homo sapiens
tatatataaaacg

SEQ ID NO: 4103472 - DNA, 13 bp, Homo sapiens
tatatatagaatc

SEQ ID NO: 4103473 - DNA, 14 bp, Homo sapiens
tatatattctatta

SEQ ID NO: 4103474 - DNA, 15 bp, Homo sapiens
tatatatttataact

SEQ ID NO: 4103475 - DNA, 22 bp, Homo sapiens
tatatatttttggttgtcaata

SEQ ID NO: 4103476 - DNA, 22 bp, Homo sapiens
tatatcaacagatagttgtgtt

SEQ ID NO: 4103477 - DNA, 15 bp, Homo sapiens
tatatcagcctgagt

SEQ ID NO: 4103478 - DNA, 18 bp, Homo sapiens
tatatcagtttcatgaaa

SEQ ID NO: 4103479 - DNA, 14 bp, Homo sapiens
tatatccatgtact

SEQ ID NO: 4103480 - DNA, 15 bp, Homo sapiens
tatatcctgtgactg

SEQ ID NO: 4103481 - DNA, 17 bp, Homo sapiens
tatatcctgtgactgtc

SEQ ID NO: 4103482 - DNA, 18 bp, Homo sapiens
tatatcctgtgactgtct

SEQ ID NO: 4103483 - DNA, 13 bp, Homo sapiens
tatatccttttct

SEQ ID NO: 4103484 - DNA, 19 bp, Homo sapiens
tatatccttttctgtgttt

SEQ ID NO: 4103485 - DNA, 19 bp, Homo sapiens
tatatctaaatctgtccaa

SEQ ID NO: 4103486 - DNA, 19 bp, Homo sapiens
tatatctcttttggtccca

SEQ ID NO: 4103487 - DNA, 16 bp, Homo sapiens
tatatctgaaaactgg

SEQ ID NO: 4103488 - DNA, 17 bp, Homo sapiens
tatatctgaaaactgga

SEQ ID NO: 4103489 - DNA, 18 bp, Homo sapiens
tatatctgaaaactggaa

SEQ ID NO: 4103490 - DNA, 20 bp, Homo sapiens
tatatctgggttaagtgttt

SEQ ID NO: 4103491 - DNA, 18 bp, Homo sapiens
tatatctgtggtcttcaa

SEQ ID NO: 4103492 - DNA, 14 bp, Homo sapiens
tatatgaccagaag

SEQ ID NO: 4103493 - DNA, 22 bp, Homo sapiens
tatatggatgattcagaaattg

SEQ ID NO: 4103494 - DNA, 19 bp, Homo sapiens
tatatgtctgataatgatt

SEQ ID NO: 4103495 - DNA, 19 bp, Homo sapiens
tatatgtgaaaaaaatgag

SEQ ID NO: 4103496 - DNA, 13 bp, Homo sapiens
tatatgtgaaaca

SEQ ID NO: 4103497 - DNA, 20 bp, Homo sapiens
tatatgtggactaaatatct

SEQ ID NO: 4103498 - DNA, 14 bp, Homo sapiens
tatatgtgtgccta

SEQ ID NO: 4103499 - DNA, 20 bp, Homo sapiens
tatattacacatttgtacag

SEQ ID NO: 4103500 - DNA, 16 bp, Homo sapiens
tatattatcataagaa

SEQ ID NO: 4103501 - DNA, 14 bp, Homo sapiens
tatattattgtaag

SEQ ID NO: 4103502 - DNA, 21 bp, Homo sapiens
tatattattgtaagttgtaca

SEQ ID NO: 4103503 - DNA, 13 bp, Homo sapiens
tatattgaacttt

SEQ ID NO: 4103504 - DNA, 22 bp, Homo sapiens
tatattgaacttttgtactgaa

SEQ ID NO: 4103505 - DNA, 17 bp, Homo sapiens
tatattgaagacaattt

SEQ ID NO: 4103506 - DNA, 19 bp, Homo sapiens
tatattgcacaattataaa

SEQ ID NO: 4103507 - DNA, 14 bp, Homo sapiens
tatatttaaaaaca

SEQ ID NO: 4103508 - DNA, 23 bp, Homo sapiens
tatatttacaataaatgaagatt

SEQ ID NO: 4103509 - DNA, 21 bp, Homo sapiens
tatatttataactcatcataa

SEQ ID NO: 4103510 - DNA, 12 bp, Homo sapiens
tatatttattga

SEQ ID NO: 4103511 - DNA, 12 bp, Homo sapiens
tatatttattta

SEQ ID NO: 4103512 - DNA, 16 bp, Homo sapiens
tatatttatttaaagc

SEQ ID NO: 4103513 - DNA, 22 bp, Homo sapiens
tatatttatttaaagcattgct

SEQ ID NO: 4103514 - DNA, 21 bp, Homo sapiens
tatatttcacttttgttctgc

SEQ ID NO: 4103515 - DNA, 20 bp, Homo sapiens
tatatttccctaaaatacat

SEQ ID NO: 4103516 - DNA, 14 bp, Homo sapiens
tatatttcctttat

SEQ ID NO: 4103517 - DNA, 19 bp, Homo sapiens
tatatttcctttatgtgaa

SEQ ID NO: 4103518 - DNA, 14 bp, Homo sapiens
tatatttgcttttt

SEQ ID NO: 4103519 - DNA, 22 bp, Homo sapiens
tatatttggcccaaactcatct

SEQ ID NO: 4103520 - DNA, 12 bp, Homo sapiens
tatatttgtaca

SEQ ID NO: 4103521 - DNA, 15 bp, Homo sapiens
tatatttgtacaaaa

SEQ ID NO: 4103522 - DNA, 22 bp, Homo sapiens
tatatttgtgatagcactttct

SEQ ID NO: 4103523 - DNA, 22 bp, Homo sapiens
tatcaaaatgtagcttttgggg

SEQ ID NO: 4103524 - DNA, 19 bp, Homo sapiens
tatcaaaccctagccttgc

SEQ ID NO: 4103525 - DNA, 21 bp, Homo sapiens
tatcaaaccctagccttgctt

SEQ ID NO: 4103526 - DNA, 22 bp, Homo sapiens
tatcaaaccctagccttgcttg

SEQ ID NO: 4103527 - DNA, 14 bp, Homo sapiens
tatcaaactgctgt

SEQ ID NO: 4103528 - DNA, 17 bp, Homo sapiens
tatcaagtcaatcattt

SEQ ID NO: 4103529 - DNA, 17 bp, Homo sapiens
tatcaagtggcatgtgc

SEQ ID NO: 4103530 - DNA, 14 bp, Homo sapiens
tatcaatatctaat

SEQ ID NO: 4103531 - DNA, 16 bp, Homo sapiens
tatcacagtattatct

SEQ ID NO: 4103532 - DNA, 13 bp, Homo sapiens
tatcacattattt

SEQ ID NO: 4103533 - DNA, 17 bp, Homo sapiens
tatcactctaaaaaaca

SEQ ID NO: 4103534 - DNA, 18 bp, Homo sapiens
tatcactctaaaaaacat

SEQ ID NO: 4103535 - DNA, 19 bp, Homo sapiens
tatcactctaaaaaacatt

SEQ ID NO: 4103536 - DNA, 23 bp, Homo sapiens
tatcactctaaaaaacattttta

SEQ ID NO: 4103537 - DNA, 10 bp, Homo sapiens
tatcagaatt

SEQ ID NO: 4103538 - DNA, 19 bp, Homo sapiens
tatcagatacatcactgct

SEQ ID NO: 4103539 - DNA, 14 bp, Homo sapiens
tatcaggggtgcat

SEQ ID NO: 4103540 - DNA, 14 bp, Homo sapiens
tatcaggtcaggga

SEQ ID NO: 4103541 - DNA, 15 bp, Homo sapiens
tatcaggtctcccac

SEQ ID NO: 4103542 - DNA, 16 bp, Homo sapiens
tatcagtgacagagtt

SEQ ID NO: 4103543 - DNA, 17 bp, Homo sapiens
tatcagtttcatgaaat

SEQ ID NO: 4103544 - DNA, 23 bp, Homo sapiens
tatcagtttgctagcagaaatct

SEQ ID NO: 4103545 - DNA, 18 bp, Homo sapiens
tagttgacaacctagaat

SEQ ID NO: 4103546 - DNA, 13 bp, Homo sapiens
tagttgtgctttt

SEQ ID NO: 4103547 - DNA, 13 bp, Homo sapiens
tagtttaggagaa

SEQ ID NO: 4103548 - DNA, 22 bp, Homo sapiens
tagtttctccaagtacttttgt

SEQ ID NO: 4103549 - DNA, 12 bp, Homo sapiens
tagtttcttgtg

SEQ ID NO: 4103550 - DNA, 12 bp, Homo sapiens
tagtttgcagtt

SEQ ID NO: 4103551 - DNA, 17 bp, Homo sapiens
tagtttggatatttttg

SEQ ID NO: 4103552 - DNA, 12 bp, Homo sapiens
tagtttgtctat

SEQ ID NO: 4103553 - DNA, 15 bp, Homo sapiens
tagtttgtctatttt

SEQ ID NO: 4103554 - DNA, 22 bp, Homo sapiens
tagtttgtctattttaaaataa

SEQ ID NO: 4103555 - DNA, 14 bp, Homo sapiens
tagttttaaactca

SEQ ID NO: 4103556 - DNA, 14 bp, Homo sapiens
tagttttagaggca

SEQ ID NO: 4103557 - DNA, 20 bp, Homo sapiens
tagttttagaggcattgtta

SEQ ID NO: 4103558 - DNA, 14 bp, Homo sapiens
tagttttagttttc

SEQ ID NO: 4103559 - DNA, 15 bp, Homo sapiens
tagttttgtcaaact

SEQ ID NO: 4103560 - DNA, 14 bp, Homo sapiens
tagttttgtttatg

SEQ ID NO: 4103561 - DNA, 18 bp, Homo sapiens
tagtttttacctaccaca

SEQ ID NO: 4103562 - DNA, 11 bp, Homo sapiens
tataaaaacaa

SEQ ID NO: 4103563 - DNA, 15 bp, Homo sapiens
tataaaaacatttgt

SEQ ID NO: 4103564 - DNA, 16 bp, Homo sapiens
tataaaaacatttgta

SEQ ID NO: 4103565 - DNA, 23 bp, Homo sapiens
tataaaaagaaaagataaagatg

SEQ ID NO: 4103566 - DNA, 12 bp, Homo sapiens
tataaaaagcca

SEQ ID NO: 4103567 - DNA, 15 bp, Homo sapiens
tataaaactttcctc

SEQ ID NO: 4103568 - DNA, 14 bp, Homo sapiens
tataaaagaaacac

SEQ ID NO: 4103569 - DNA, 12 bp, Homo sapiens
tataaaatgtgc

SEQ ID NO: 4103570 - DNA, 15 bp, Homo sapiens
tataaacacattgaa

SEQ ID NO: 4103571 - DNA, 17 bp, Homo sapiens
tataaacatcacacaca

SEQ ID NO: 4103572 - DNA, 18 bp, Homo sapiens
tataaacatcacacacac

SEQ ID NO: 4103573 - DNA, 23 bp, Homo sapiens
tataaacttagtgcggacaagtt

SEQ ID NO: 4103574 - DNA, 19 bp, Homo sapiens
tataaagaagaacttgcat

SEQ ID NO: 4103575 - DNA, 19 bp, Homo sapiens
tataaagaaggataaattg

SEQ ID NO: 4103576 - DNA, 23 bp, Homo sapiens
tataaagcgatatacagatgaaa

SEQ ID NO: 4103577 - DNA, 16 bp, Homo sapiens
tataaagtaaagctaa

SEQ ID NO: 4103578 - DNA, 23 bp, Homo sapiens
tataaagtacccatctagtactt

SEQ ID NO: 4103579 - DNA, 15 bp, Homo sapiens
tataaatacaaatct

SEQ ID NO: 4103580 - DNA, 13 bp, Homo sapiens
tataaataggaga

SEQ ID NO: 4103581 - DNA, 17 bp, Homo sapiens
tataaatataagccttt

SEQ ID NO: 4103582 - DNA, 15 bp, Homo sapiens
tataaatcaatgtca

SEQ ID NO: 4103583 - DNA, 16 bp, Homo sapiens
tataaatcaatgtcac

SEQ ID NO: 4103584 - DNA, 14 bp, Homo sapiens
tataaatcatattg

SEQ ID NO: 4103585 - DNA, 16 bp, Homo sapiens
tataaatgctattttt

SEQ ID NO: 4103586 - DNA, 12 bp, Homo sapiens
tataaatgtcta

SEQ ID NO: 4103587 - DNA, 14 bp, Homo sapiens
tataaatgtctatt

SEQ ID NO: 4103588 - DNA, 11 bp, Homo sapiens
tataaattctg

SEQ ID NO: 4103589 - DNA, 12 bp, Homo sapiens
tataaattctgt

SEQ ID NO: 4103590 - DNA, 13 bp, Homo sapiens
tataaattctgtg

SEQ ID NO: 4103591 - DNA, 14 bp, Homo sapiens
tataaccatgagaa

SEQ ID NO: 4103592 - DNA, 23 bp, Homo sapiens
tataaccccaccttgccaagctt

SEQ ID NO: 4103593 - DNA, 14 bp, Homo sapiens
tataaccccagcct

SEQ ID NO: 4103594 - DNA, 15 bp, Homo sapiens
tataaccccagcctg

SEQ ID NO: 4103595 - DNA, 16 bp, Homo sapiens
tataaccccagcctga

SEQ ID NO: 4103596 - DNA, 20 bp, Homo sapiens
tataaccctaggaatttaga

SEQ ID NO: 4103597 - DNA, 16 bp, Homo sapiens
tataactcatcataaa

SEQ ID NO: 4103598 - DNA, 18 bp, Homo sapiens
tataactcatcataaaat

SEQ ID NO: 4103599 - DNA, 18 bp, Homo sapiens
tataacttaaaaaaatga

SEQ ID NO: 4103600 - DNA, 17 bp, Homo sapiens
tataagaaatgcatatg

SEQ ID NO: 4103601 - DNA, 15 bp, Homo sapiens
tataagcactgaaaa

SEQ ID NO: 4103602 - DNA, 18 bp, Homo sapiens
tataagcactgaaaaaca

SEQ ID NO: 4103603 - DNA, 19 bp, Homo sapiens
tataagcattgaaattata

SEQ ID NO: 4103604 - DNA, 16 bp, Homo sapiens
tataagcccactgtta

SEQ ID NO: 4103605 - DNA, 17 bp, Homo sapiens
tataagggagagctgag

SEQ ID NO: 4103606 - DNA, 20 bp, Homo sapiens
tataagggagagctgagcca

SEQ ID NO: 4103607 - DNA, 14 bp, Homo sapiens
tataagtcacaaag

SEQ ID NO: 4103608 - DNA, 18 bp, Homo sapiens
tataagtgaagtgatact

SEQ ID NO: 4103609 - DNA, 19 bp, Homo sapiens
tataagtggaggcacttta

SEQ ID NO: 4103610 - DNA, 21 bp, Homo sapiens
tataagttatttttgtacatg

SEQ ID NO: 4103611 - DNA, 14 bp, Homo sapiens
tataataaaaggaa

SEQ ID NO: 4103612 - DNA, 22 bp, Homo sapiens
tataataaagaaaacctttcta

SEQ ID NO: 4103613 - DNA, 19 bp, Homo sapiens
tataataaaggactgtaat

SEQ ID NO: 4103614 - DNA, 16 bp, Homo sapiens
tataataaatgtacat

SEQ ID NO: 4103615 - DNA, 17 bp, Homo sapiens
tataataatagttatta

SEQ ID NO: 4103616 - DNA, 21 bp, Homo sapiens
tataataatagttattattta

SEQ ID NO: 4103617 - DNA, 17 bp, Homo sapiens
tataatcaatgaatttg

SEQ ID NO: 4103618 - DNA, 21 bp, Homo sapiens
tataatcattagttttagagg

SEQ ID NO: 4103619 - DNA, 13 bp, Homo sapiens
tataatctgaaga

SEQ ID NO: 4103620 - DNA, 20 bp, Homo sapiens
tataatgaatgaaacatttt

SEQ ID NO: 4103621 - DNA, 17 bp, Homo sapiens
tataatgttgttattta

SEQ ID NO: 4103622 - DNA, 19 bp, Homo sapiens
tataatgttgttatttaaa

SEQ ID NO: 4103623 - DNA, 15 bp, Homo sapiens
tataatgtttgctat

SEQ ID NO: 4103624 - DNA, 19 bp, Homo sapiens
tataattatcggaagcagt

SEQ ID NO: 4103625 - DNA, 23 bp, Homo sapiens
tataattcactcaagcactgata

SEQ ID NO: 4103626 - DNA, 22 bp, Homo sapiens
tataattcctatatcctgtgac

SEQ ID NO: 4103627 - DNA, 17 bp, Homo sapiens
tataattctactttgag

SEQ ID NO: 4103628 - DNA, 16 bp, Homo sapiens
tataattctgtaaatg

SEQ ID NO: 4103629 - DNA, 15 bp, Homo sapiens
tataattttttaaag

SEQ ID NO: 4103630 - DNA, 20 bp, Homo sapiens
tataatttttttattactga

SEQ ID NO: 4103631 - DNA, 13 bp, Homo sapiens
tatacaaattaga

SEQ ID NO: 4103632 - DNA, 14 bp, Homo sapiens
tatacaaattagaa

SEQ ID NO: 4103633 - DNA, 23 bp, Homo sapiens
tatacaaggtgagtgtgacttcc

SEQ ID NO: 4103634 - DNA, 13 bp, Homo sapiens
tatacagaaaaat

SEQ ID NO: 4103635 - DNA, 12 bp, Homo sapiens
tatacagatgaa

SEQ ID NO: 4103636 - DNA, 17 bp, Homo sapiens
tatacagtgcagagcct

SEQ ID NO: 4103637 - DNA, 18 bp, Homo sapiens
tatacagtgcagagcctt

SEQ ID NO: 4103638 - DNA, 20 bp, Homo sapiens
tatacagttcaataaactta

SEQ ID NO: 4103639 - DNA, 15 bp, Homo sapiens
tatacatatctttat

SEQ ID NO: 4103640 - DNA, 14 bp, Homo sapiens
tataccatttcctc

SEQ ID NO: 4103641 - DNA, 18 bp, Homo sapiens
tataccatttcctcagct

SEQ ID NO: 4103642 - DNA, 23 bp, Homo sapiens
tatacctgcacgttcataaccaa

SEQ ID NO: 4103643 - DNA, 13 bp, Homo sapiens
tatacgtttcaaa

SEQ ID NO: 4103644 - DNA, 17 bp, Homo sapiens
tatactatagtaccagt

SEQ ID NO: 4103645 - DNA, 20 bp, Homo sapiens
tatactatagtaccagtagg

SEQ ID NO: 4103646 - DNA, 16 bp, Homo sapiens
tatactatatttatgg

SEQ ID NO: 4103647 - DNA, 22 bp, Homo sapiens
tatactccagtgtacatagtgt

SEQ ID NO: 4103648 - DNA, 22 bp, Homo sapiens
tatactctttctgtatatactt

SEQ ID NO: 4103649 - DNA, 17 bp, Homo sapiens
gtctcctaaaactggga

SEQ ID NO: 4103650 - DNA, 23 bp, Homo sapiens
gtctcctcaatttttgtctcaga

SEQ ID NO: 4103651 - DNA, 19 bp, Homo sapiens
gtctcctccctcagctctc

SEQ ID NO: 4103652 - DNA, 14 bp, Homo sapiens
gtctcctctctgag

SEQ ID NO: 4103653 - DNA, 16 bp, Homo sapiens
gtctcctctctgagac

SEQ ID NO: 4103654 - DNA, 21 bp, Homo sapiens
gtctcctgtgcccacatccca

SEQ ID NO: 4103655 - DNA, 20 bp, Homo sapiens
gtctcctttgcactgagggc

SEQ ID NO: 4103656 - DNA, 23 bp, Homo sapiens
gtctcctttgcactgagggccac

SEQ ID NO: 4103657 - DNA, 17 bp, Homo sapiens
gtctcgctttgttgccc

SEQ ID NO: 4103658 - DNA, 19 bp, Homo sapiens
gtctcgctttgttgcccag

SEQ ID NO: 4103659 - DNA, 19 bp, Homo sapiens
gtctcggaacctgtgagct

SEQ ID NO: 4103660 - DNA, 22 bp, Homo sapiens
gtctcggatgacaccctggcct

SEQ ID NO: 4103661 - DNA, 20 bp, Homo sapiens
gtctcgttttgttgccaaag

SEQ ID NO: 4103662 - DNA, 18 bp, Homo sapiens
gtctctagagcagggatt

SEQ ID NO: 4103663 - DNA, 17 bp, Homo sapiens
gtctctatgccagctca

SEQ ID NO: 4103664 - DNA, 15 bp, Homo sapiens
gtctctccctcaggt

SEQ ID NO: 4103665 - DNA, 15 bp, Homo sapiens
gtctctcctggctgg

SEQ ID NO: 4103666 - DNA, 17 bp, Homo sapiens
gtctctcctggctgggc

SEQ ID NO: 4103667 - DNA, 18 bp, Homo sapiens
gtctctcctggctgggcc

SEQ ID NO: 4103668 - DNA, 22 bp, Homo sapiens
gtctctcgtagtgttaagttat

SEQ ID NO: 4103669 - DNA, 11 bp, Homo sapiens
gtctctctgtg

SEQ ID NO: 4103670 - DNA, 22 bp, Homo sapiens
gtctctctgtgaatacaattaa

SEQ ID NO: 4103671 - DNA, 22 bp, Homo sapiens
gtctctgccacccactcaggat

SEQ ID NO: 4103672 - DNA, 22 bp, Homo sapiens
gtctctgctcgccctcctttct

SEQ ID NO: 4103673 - DNA, 15 bp, Homo sapiens
gtctctgctggccca

SEQ ID NO: 4103674 - DNA, 17 bp, Homo sapiens
gtctctggggcagatcc

SEQ ID NO: 4103675 - DNA, 11 bp, Homo sapiens
gtctcttcaga

SEQ ID NO: 4103676 - DNA, 14 bp, Homo sapiens
gtctcttctccact

SEQ ID NO: 4103677 - DNA, 17 bp, Homo sapiens
gtctcttctccactgga

SEQ ID NO: 4103678 - DNA, 18 bp, Homo sapiens
gtctcttctccactggat

SEQ ID NO: 4103679 - DNA, 22 bp, Homo sapiens
gtctctttaaaaggaaagaaaa

SEQ ID NO: 4103680 - DNA, 17 bp, Homo sapiens
gtctctttaatcttcag

SEQ ID NO: 4103681 - DNA, 21 bp, Homo sapiens
gtctgaaggactggattggcc

SEQ ID NO: 4103682 - DNA, 21 bp, Homo sapiens
gtctgagactcacaggaagga

SEQ ID NO: 4103683 - DNA, 17 bp, Homo sapiens
gtctgaggttgggagag

SEQ ID NO: 4103684 - DNA, 18 bp, Homo sapiens
gtctgatattaatcaaaa

SEQ ID NO: 4103685 - DNA, 23 bp, Homo sapiens
gtctgattttctcactgaactcc

SEQ ID NO: 4103686 - DNA, 15 bp, Homo sapiens
gtctgccccctcctg

SEQ ID NO: 4103687 - DNA, 20 bp, Homo sapiens
gtctgcctggagtgctgtgc

SEQ ID NO: 4103688 - DNA, 19 bp, Homo sapiens
gtctgcgccttgggatggg

SEQ ID NO: 4103689 - DNA, 18 bp, Homo sapiens
gtctgctaggcgctgggg

SEQ ID NO: 4103690 - DNA, 14 bp, Homo sapiens
gtctgctccagctc

SEQ ID NO: 4103691 - DNA, 19 bp, Homo sapiens
gtctgctctttctctgcca

SEQ ID NO: 4103692 - DNA, 22 bp, Homo sapiens
gtctgctctttctctgccagtg

SEQ ID NO: 4103693 - DNA, 19 bp, Homo sapiens
gtctggagtgggcagagcc

SEQ ID NO: 4103694 - DNA, 22 bp, Homo sapiens
gtctggcagcctcccatccagg

SEQ ID NO: 4103695 - DNA, 14 bp, Homo sapiens
gtctggccaggcac

SEQ ID NO: 4103696 - DNA, 15 bp, Homo sapiens
gtctggcctgaggtc

SEQ ID NO: 4103697 - DNA, 23 bp, Homo sapiens
gtctggctttttcctctgagccc

SEQ ID NO: 4103698 - DNA, 23 bp, Homo sapiens
gtctgggaacttgcgagtccaag

SEQ ID NO: 4103699 - DNA, 19 bp, Homo sapiens
gtctgggatatggctgccc

SEQ ID NO: 4103700 - DNA, 11 bp, Homo sapiens
gtctgggcctc

SEQ ID NO: 4103701 - DNA, 14 bp, Homo sapiens
gtctgggcctctga

SEQ ID NO: 4103702 - DNA, 14 bp, Homo sapiens
gtctggtttctaga

SEQ ID NO: 4103703 - DNA, 20 bp, Homo sapiens
gtctgtatcggagacagtga

SEQ ID NO: 4103704 - DNA, 17 bp, Homo sapiens
gtctgtatttcatgtgg

SEQ ID NO: 4103705 - DNA, 18 bp, Homo sapiens
gtctgtatttcatgtggc

SEQ ID NO: 4103706 - DNA, 20 bp, Homo sapiens
gtctgtatttcatgtggctg

SEQ ID NO: 4103707 - DNA, 21 bp, Homo sapiens
gtctgtatttcatgtggctgt

SEQ ID NO: 4103708 - DNA, 14 bp, Homo sapiens
gtctgtctgctttg

SEQ ID NO: 4103709 - DNA, 18 bp, Homo sapiens
gtctgtgaacagagagac

SEQ ID NO: 4103710 - DNA, 13 bp, Homo sapiens
gtctgtgccatgg

SEQ ID NO: 4103711 - DNA, 18 bp, Homo sapiens
gtctgtgtcatttcttca

SEQ ID NO: 4103712 - DNA, 15 bp, Homo sapiens
gtctgtgttcaatcc

SEQ ID NO: 4103713 - DNA, 14 bp, Homo sapiens
gtctgtttgtttca

SEQ ID NO: 4103714 - DNA, 17 bp, Homo sapiens
gtctgtttgtttcaaga

SEQ ID NO: 4103715 - DNA, 18 bp, Homo sapiens
gtcttaaatgctcatttt

SEQ ID NO: 4103716 - DNA, 22 bp, Homo sapiens
gtcttaacaaaccaacatcttt

SEQ ID NO: 4103717 - DNA, 23 bp, Homo sapiens
gtcttaagccttttgctcacaaa

SEQ ID NO: 4103718 - DNA, 21 bp, Homo sapiens
gtcttaattattatttgtgtt

SEQ ID NO: 4103719 - DNA, 22 bp, Homo sapiens
gtcttaatttttgaaaaaagta

SEQ ID NO: 4103720 - DNA, 20 bp, Homo sapiens
gtcttcaaattgtcttttgt

SEQ ID NO: 4103721 - DNA, 18 bp, Homo sapiens
gtcttcaacatcctgcca

SEQ ID NO: 4103722 - DNA, 13 bp, Homo sapiens
gtcttccaaggag

SEQ ID NO: 4103723 - DNA, 13 bp, Homo sapiens
gtcttccataatg

SEQ ID NO: 4103724 - DNA, 15 bp, Homo sapiens
gtcttccataatgta

SEQ ID NO: 4103725 - DNA, 23 bp, Homo sapiens
gtcttcctcaaaataaagaagta

SEQ ID NO: 4103726 - DNA, 22 bp, Homo sapiens
gtcttcggccgagctggtttcc

SEQ ID NO: 4103727 - DNA, 18 bp, Homo sapiens
gtcttctgggcacagtgg

SEQ ID NO: 4103728 - DNA, 17 bp, Homo sapiens
gtcttcttgctgcagcc

SEQ ID NO: 4103729 - DNA, 20 bp, Homo sapiens
gtcttgactcatggcagctg

SEQ ID NO: 4103730 - DNA, 22 bp, Homo sapiens
gtcttgactcatggcagctgtt

SEQ ID NO: 4103731 - DNA, 22 bp, Homo sapiens
gtcttgactctaaatgcagttt

SEQ ID NO: 4103732 - DNA, 18 bp, Homo sapiens
gtcttgatgaccaaagtc

SEQ ID NO: 4103733 - DNA, 14 bp, Homo sapiens
gtcttgctctgtcc

SEQ ID NO: 4103734 - DNA, 15 bp, Homo sapiens
gtcttggggtcccac

SEQ ID NO: 4103735 - DNA, 21 bp, Homo sapiens
gtcttggggtcccactgctcg

SEQ ID NO: 4103736 - DNA, 15 bp, Homo sapiens
gtcttggtgtaattt

SEQ ID NO: 4103737 - DNA, 18 bp, Homo sapiens
gtcttggtttctctctac

SEQ ID NO: 4103738 - DNA, 15 bp, Homo sapiens
gtctttcacagctcc

SEQ ID NO: 4103739 - DNA, 12 bp, Homo sapiens
gtctttctgggg

SEQ ID NO: 4103740 - DNA, 13 bp, Homo sapiens
gtctttgtaagag

SEQ ID NO: 4103741 - DNA, 15 bp, Homo sapiens
gtctttgtaagagtg

SEQ ID NO: 4103742 - DNA, 20 bp, Homo sapiens
gtctttgtaagagtgtagaa

SEQ ID NO: 4103743 - DNA, 21 bp, Homo sapiens
gtctttgtaagagtgtagaag

SEQ ID NO: 4103744 - DNA, 21 bp, Homo sapiens
gtctttgtaagtcagtgttga

SEQ ID NO: 4103745 - DNA, 19 bp, Homo sapiens
gtcttttatatttgtatcg

SEQ ID NO: 4103746 - DNA, 17 bp, Homo sapiens
gtcttttcctcgcttct

SEQ ID NO: 4103747 - DNA, 15 bp, Homo sapiens
gtgaaaacggagctg

SEQ ID NO: 4103748 - DNA, 19 bp, Homo sapiens
gtgaaaagtccttgattgt

SEQ ID NO: 4103749 - DNA, 17 bp, Homo sapiens
gtgaaacacaccaggct

SEQ ID NO: 4103750 - DNA, 18 bp, Homo sapiens
gtgaaacacaccaggctg

SEQ ID NO: 4103751 - DNA, 23 bp, Homo sapiens
gtcctctcagttctctcccttcc

SEQ ID NO: 4103752 - DNA, 21 bp, Homo sapiens
gtcctctcccctccagccttt

SEQ ID NO: 4103753 - DNA, 16 bp, Homo sapiens
gtcctctcgagcccag

SEQ ID NO: 4103754 - DNA, 17 bp, Homo sapiens
gtcctctcgagcccaga

SEQ ID NO: 4103755 - DNA, 18 bp, Homo sapiens
gtcctctgtcagtcacag

SEQ ID NO: 4103756 - DNA, 20 bp, Homo sapiens
gtcctctgtcagtcacagcc

SEQ ID NO: 4103757 - DNA, 18 bp, Homo sapiens
gtcctcttaactgtggtg

SEQ ID NO: 4103758 - DNA, 12 bp, Homo sapiens
gtcctcttctgc

SEQ ID NO: 4103759 - DNA, 22 bp, Homo sapiens
gtcctcttctgctcttttcctg

SEQ ID NO: 4103760 - DNA, 16 bp, Homo sapiens
gtcctgactgggctgg

SEQ ID NO: 4103761 - DNA, 17 bp, Homo sapiens
gtcctgactgggctggg

SEQ ID NO: 4103762 - DNA, 13 bp, Homo sapiens
gtcctgagacctg

SEQ ID NO: 4103763 - DNA, 16 bp, Homo sapiens
gtcctgaggagaggag

SEQ ID NO: 4103764 - DNA, 18 bp, Homo sapiens
gtcctgagggtccccacc

SEQ ID NO: 4103765 - DNA, 21 bp, Homo sapiens
gtcctgagggtccccacctgg

SEQ ID NO: 4103766 - DNA, 15 bp, Homo sapiens
gtcctgatctgtgat

SEQ ID NO: 4103767 - DNA, 21 bp, Homo sapiens
gtcctgcagcaaacactccac

SEQ ID NO: 4103768 - DNA, 14 bp, Homo sapiens
gtcctgcccatgcc

SEQ ID NO: 4103769 - DNA, 13 bp, Homo sapiens
gtcctgcccatgt

SEQ ID NO: 4103770 - DNA, 17 bp, Homo sapiens
gtcctgcccatgtgtcc

SEQ ID NO: 4103771 - DNA, 15 bp, Homo sapiens
gtcctgcctcagcct

SEQ ID NO: 4103772 - DNA, 14 bp, Homo sapiens
gtcctgcctggcac

SEQ ID NO: 4103773 - DNA, 13 bp, Homo sapiens
gtcctgcctggcc

SEQ ID NO: 4103774 - DNA, 15 bp, Homo sapiens
gtcctgcctggccag

SEQ ID NO: 4103775 - DNA, 16 bp, Homo sapiens
gtcctgcctgtctgcc

SEQ ID NO: 4103776 - DNA, 21 bp, Homo sapiens
gtcctgctcattatgccactt

SEQ ID NO: 4103777 - DNA, 23 bp, Homo sapiens
gtcctgctggcttccagcttcag

SEQ ID NO: 4103778 - DNA, 15 bp, Homo sapiens
gtcctggctacatcc

SEQ ID NO: 4103779 - DNA, 17 bp, Homo sapiens
gtcctggctacatccca

SEQ ID NO: 4103780 - DNA, 19 bp, Homo sapiens
gtcctggctacatcccagc

SEQ ID NO: 4103781 - DNA, 19 bp, Homo sapiens
gtcctgggcatgggtccag

SEQ ID NO: 4103782 - DNA, 20 bp, Homo sapiens
gtcctgggcatgggtccagg

SEQ ID NO: 4103783 - DNA, 14 bp, Homo sapiens
gtcctgggcctgcc

SEQ ID NO: 4103784 - DNA, 14 bp, Homo sapiens
gtcctgtcctgctc

SEQ ID NO: 4103785 - DNA, 17 bp, Homo sapiens
gtcctgtcctttcttgc

SEQ ID NO: 4103786 - DNA, 16 bp, Homo sapiens
gtccttatctagctgc

SEQ ID NO: 4103787 - DNA, 18 bp, Homo sapiens
gtccttatctagctgcat

SEQ ID NO: 4103788 - DNA, 22 bp, Homo sapiens
gtccttccctcaaagaggcctt

SEQ ID NO: 4103789 - DNA, 19 bp, Homo sapiens
gtccttgagtgctcttgct

SEQ ID NO: 4103790 - DNA, 19 bp, Homo sapiens
gtccttgcacccctcactc

SEQ ID NO: 4103791 - DNA, 20 bp, Homo sapiens
gtccttggactgttttgaaa

SEQ ID NO: 4103792 - DNA, 22 bp, Homo sapiens
gtccttggtgtgaccctctgaa

SEQ ID NO: 4103793 - DNA, 22 bp, Homo sapiens
gtcctttgacaaaagtaaatgg

SEQ ID NO: 4103794 - DNA, 13 bp, Homo sapiens
gtcgagctccccc

SEQ ID NO: 4103795 - DNA, 15 bp, Homo sapiens
gtcgaggggctctca

SEQ ID NO: 4103796 - DNA, 13 bp, Homo sapiens
gtcgatgcacagt

SEQ ID NO: 4103797 - DNA, 19 bp, Homo sapiens
gtcgcagaccagagctgtc

SEQ ID NO: 4103798 - DNA, 12 bp, Homo sapiens
gtcgcccaggag

SEQ ID NO: 4103799 - DNA, 20 bp, Homo sapiens
gtcgcccaggctggagtgca

SEQ ID NO: 4103800 - DNA, 13 bp, Homo sapiens
gtcgccccaggcc

SEQ ID NO: 4103801 - DNA, 15 bp, Homo sapiens
gtcgccccaggccct

SEQ ID NO: 4103802 - DNA, 16 bp, Homo sapiens
gtcgccccaggccctc

SEQ ID NO: 4103803 - DNA, 20 bp, Homo sapiens
gtcgcctttcagcaggcagc

SEQ ID NO: 4103804 - DNA, 21 bp, Homo sapiens
gtcgcctttcagcaggcagcc

SEQ ID NO: 4103805 - DNA, 17 bp, Homo sapiens
gtcgctttctcagtgtg

SEQ ID NO: 4103806 - DNA, 15 bp, Homo sapiens
gtcggaacagcagat

SEQ ID NO: 4103807 - DNA, 20 bp, Homo sapiens
gtcggagaggctgtctgggg

SEQ ID NO: 4103808 - DNA, 14 bp, Homo sapiens
gtcggccccatctc

SEQ ID NO: 4103809 - DNA, 14 bp, Homo sapiens
gtcggccctgccca

SEQ ID NO: 4103810 - DNA, 12 bp, Homo sapiens
gtcggctccagt

SEQ ID NO: 4103811 - DNA, 17 bp, Homo sapiens
gtcgggatgtcagcaga

SEQ ID NO: 4103812 - DNA, 18 bp, Homo sapiens
gtcgggcaccagccagcg

SEQ ID NO: 4103813 - DNA, 22 bp, Homo sapiens
gtcgggcatggtggctcatgcc

SEQ ID NO: 4103814 - DNA, 14 bp, Homo sapiens
gtcgtaaagatttg

SEQ ID NO: 4103815 - DNA, 16 bp, Homo sapiens
gtcgttgttgtggaag

SEQ ID NO: 4103816 - DNA, 14 bp, Homo sapiens
gtctaaacaaaatt

SEQ ID NO: 4103817 - DNA, 16 bp, Homo sapiens
gtctaaacaatgctga

SEQ ID NO: 4103818 - DNA, 16 bp, Homo sapiens
gtctaaatatttcctt

SEQ ID NO: 4103819 - DNA, 23 bp, Homo sapiens
gtctaaatatttccttaaactgt

SEQ ID NO: 4103820 - DNA, 15 bp, Homo sapiens
gtctacaaatataag

SEQ ID NO: 4103821 - DNA, 23 bp, Homo sapiens
gtctacccctcccggccctgcct

SEQ ID NO: 4103822 - DNA, 21 bp, Homo sapiens
gtctagcgtagtgcagcaggg

SEQ ID NO: 4103823 - DNA, 15 bp, Homo sapiens
gtctaggtctcctca

SEQ ID NO: 4103824 - DNA, 17 bp, Homo sapiens
gtctataaaagaaacac

SEQ ID NO: 4103825 - DNA, 20 bp, Homo sapiens
gtctataatcccagcacttt

SEQ ID NO: 4103826 - DNA, 17 bp, Homo sapiens
gtctatatgaaaaacaa

SEQ ID NO: 4103827 - DNA, 18 bp, Homo sapiens
gtctatcaagtcaatcat

SEQ ID NO: 4103828 - DNA, 21 bp, Homo sapiens
gtctatgacttatttccttca

SEQ ID NO: 4103829 - DNA, 10 bp, Homo sapiens
gtctatttaa

SEQ ID NO: 4103830 - DNA, 12 bp, Homo sapiens
gtctatttaagc

SEQ ID NO: 4103831 - DNA, 16 bp, Homo sapiens
gtctatttaagcctca

SEQ ID NO: 4103832 - DNA, 11 bp, Homo sapiens
gtctattttaa

SEQ ID NO: 4103833 - DNA, 17 bp, Homo sapiens
gtctcaaaaatacaaaa

SEQ ID NO: 4103834 - DNA, 20 bp, Homo sapiens
gtctcaaactcctgggctca

SEQ ID NO: 4103835 - DNA, 15 bp, Homo sapiens
gtctcaagagggcac

SEQ ID NO: 4103836 - DNA, 22 bp, Homo sapiens
gtctcacttgtgcagtgttgac

SEQ ID NO: 4103837 - DNA, 21 bp, Homo sapiens
gtctcagaaactcccctgggg

SEQ ID NO: 4103838 - DNA, 17 bp, Homo sapiens
gtctcagggtgcagagg

SEQ ID NO: 4103839 - DNA, 22 bp, Homo sapiens
gtctcagtggcttcatctgtca

SEQ ID NO: 4103840 - DNA, 19 bp, Homo sapiens
gtctcagtttgtgtgtctt

SEQ ID NO: 4103841 - DNA, 13 bp, Homo sapiens
gtctcatccccag

SEQ ID NO: 4103842 - DNA, 14 bp, Homo sapiens
gtctcatccccagg

SEQ ID NO: 4103843 - DNA, 15 bp, Homo sapiens
gtctcatccccaggg

SEQ ID NO: 4103844 - DNA, 15 bp, Homo sapiens
gtctcatgtaacaca

SEQ ID NO: 4103845 - DNA, 16 bp, Homo sapiens
gtctcatgtcctgctg

SEQ ID NO: 4103846 - DNA, 10 bp, Homo sapiens
gtctccagct

SEQ ID NO: 4103847 - DNA, 11 bp, Homo sapiens
gtctccagctg

SEQ ID NO: 4103848 - DNA, 12 bp, Homo sapiens
gtctccagctgc

SEQ ID NO: 4103849 - DNA, 14 bp, Homo sapiens
gtctccagctgcct

SEQ ID NO: 4103850 - DNA, 18 bp, Homo sapiens
gtctccagctgcctgggc

SEQ ID NO: 4103851 - DNA, 15 bp, Homo sapiens
gtctccaggccatga

SEQ ID NO: 4103852 - DNA, 17 bp, Homo sapiens
gtctcccaggccccctg

SEQ ID NO: 4103853 - DNA, 18 bp, Homo sapiens
gtctcccccacccttgtt

SEQ ID NO: 4103854 - DNA, 20 bp, Homo sapiens
gtctcccccacccttgttcc

SEQ ID NO: 4103855 - DNA, 14 bp, Homo sapiens
gtccagctccaacc

SEQ ID NO: 4103856 - DNA, 13 bp, Homo sapiens
gtccagctcttgg

SEQ ID NO: 4103857 - DNA, 19 bp, Homo sapiens
gtccagctcttggcccctg

SEQ ID NO: 4103858 - DNA, 20 bp, Homo sapiens
gtccagctggggccagaggc

SEQ ID NO: 4103859 - DNA, 21 bp, Homo sapiens
gtccaggatgctaacatctaa

SEQ ID NO: 4103860 - DNA, 23 bp, Homo sapiens
gtccagggaagagaaagtgattt

SEQ ID NO: 4103861 - DNA, 16 bp, Homo sapiens
gtccagggtttctctg

SEQ ID NO: 4103862 - DNA, 20 bp, Homo sapiens
gtccagggtttctctgcaga

SEQ ID NO: 4103863 - DNA, 19 bp, Homo sapiens
gtccagtgctctgcctcag

SEQ ID NO: 4103864 - DNA, 17 bp, Homo sapiens
gtccagtgtcacctctc

SEQ ID NO: 4103865 - DNA, 15 bp, Homo sapiens
gtccagtgtttcttt

SEQ ID NO: 4103866 - DNA, 15 bp, Homo sapiens
gtccatacactttgt

SEQ ID NO: 4103867 - DNA, 20 bp, Homo sapiens
gtccatcagggatctcagag

SEQ ID NO: 4103868 - DNA, 16 bp, Homo sapiens
gtccatgcccactgct

SEQ ID NO: 4103869 - DNA, 17 bp, Homo sapiens
gtccatgcccactgctg

SEQ ID NO: 4103870 - DNA, 13 bp, Homo sapiens
gtccattctcaag

SEQ ID NO: 4103871 - DNA, 23 bp, Homo sapiens
gtccatttatatatgaaaactat

SEQ ID NO: 4103872 - DNA, 21 bp, Homo sapiens
gtccatttatccacaggaaag

SEQ ID NO: 4103873 - DNA, 18 bp, Homo sapiens
gtcccaaggttctgggtg

SEQ ID NO: 4103874 - DNA, 15 bp, Homo sapiens
gtcccaattctgccc

SEQ ID NO: 4103875 - DNA, 14 bp, Homo sapiens
gtcccacccacaca

SEQ ID NO: 4103876 - DNA, 20 bp, Homo sapiens
gtcccacccacacagctgcc

SEQ ID NO: 4103877 - DNA, 23 bp, Homo sapiens
gtcccacccacacagctgcccta

SEQ ID NO: 4103878 - DNA, 15 bp, Homo sapiens
gtcccacccccaccc

SEQ ID NO: 4103879 - DNA, 20 bp, Homo sapiens
gtcccacgaatttgctgggg

SEQ ID NO: 4103880 - DNA, 16 bp, Homo sapiens
gtcccacgtgtcttcc

SEQ ID NO: 4103881 - DNA, 18 bp, Homo sapiens
gtcccacgtgtcttccac

SEQ ID NO: 4103882 - DNA, 15 bp, Homo sapiens
gtcccagcatccctg

SEQ ID NO: 4103883 - DNA, 15 bp, Homo sapiens
gtcccagccaccccg

SEQ ID NO: 4103884 - DNA, 22 bp, Homo sapiens
gtcccagccccggcaagccaca

SEQ ID NO: 4103885 - DNA, 14 bp, Homo sapiens
gtcccagctactcg

SEQ ID NO: 4103886 - DNA, 19 bp, Homo sapiens
gtcccaggcagcacagtgt

SEQ ID NO: 4103887 - DNA, 19 bp, Homo sapiens
gtcccagtattctcagagc

SEQ ID NO: 4103888 - DNA, 23 bp, Homo sapiens
gtcccagtgctcaccagccctgc

SEQ ID NO: 4103889 - DNA, 21 bp, Homo sapiens
gtcccatgtgagctgctgcca

SEQ ID NO: 4103890 - DNA, 13 bp, Homo sapiens
gtcccatgtggtg

SEQ ID NO: 4103891 - DNA, 21 bp, Homo sapiens
gtcccattgttggcgctgagg

SEQ ID NO: 4103892 - DNA, 23 bp, Homo sapiens
gtcccattgttggcgctgaggtg

SEQ ID NO: 4103893 - DNA, 13 bp, Homo sapiens
gtcccatttcctt

SEQ ID NO: 4103894 - DNA, 14 bp, Homo sapiens
gtcccatttccttg

SEQ ID NO: 4103895 - DNA, 18 bp, Homo sapiens
gtcccatttccttggagg

SEQ ID NO: 4103896 - DNA, 15 bp, Homo sapiens
gtccccaaaatgtga

SEQ ID NO: 4103897 - DNA, 22 bp, Homo sapiens
gtccccaaccgtgtctgtctgg

SEQ ID NO: 4103898 - DNA, 17 bp, Homo sapiens
gtccccaccctccactc

SEQ ID NO: 4103899 - DNA, 18 bp, Homo sapiens
gtccccaccctccactca

SEQ ID NO: 4103900 - DNA, 14 bp, Homo sapiens
gtccccactcaccc

SEQ ID NO: 4103901 - DNA, 15 bp, Homo sapiens
gtccccactcacccc

SEQ ID NO: 4103902 - DNA, 21 bp, Homo sapiens
gtccccagacccttcttgcct

SEQ ID NO: 4103903 - DNA, 18 bp, Homo sapiens
gtccccagagaccaggct

SEQ ID NO: 4103904 - DNA, 17 bp, Homo sapiens
gtccccatccccaccag

SEQ ID NO: 4103905 - DNA, 12 bp, Homo sapiens
gtccccatttct

SEQ ID NO: 4103906 - DNA, 14 bp, Homo sapiens
gtccccatttctgc

SEQ ID NO: 4103907 - DNA, 16 bp, Homo sapiens
gtccccatttctgcct

SEQ ID NO: 4103908 - DNA, 18 bp, Homo sapiens
gtccccatttctgcctcg

SEQ ID NO: 4103909 - DNA, 13 bp, Homo sapiens
gtccccctcagca

SEQ ID NO: 4103910 - DNA, 15 bp, Homo sapiens
gtcccctaaggaaat

SEQ ID NO: 4103911 - DNA, 12 bp, Homo sapiens
gtcccctcacct

SEQ ID NO: 4103912 - DNA, 23 bp, Homo sapiens
gtcccctcactctgtcagccagc

SEQ ID NO: 4103913 - DNA, 16 bp, Homo sapiens
gtcccctccaggaaga

SEQ ID NO: 4103914 - DNA, 23 bp, Homo sapiens
gtcccctccttccctcaccccca

SEQ ID NO: 4103915 - DNA, 17 bp, Homo sapiens
gtcccggggccagcact

SEQ ID NO: 4103916 - DNA, 23 bp, Homo sapiens
gtccctaagcatgtgtcccagga

SEQ ID NO: 4103917 - DNA, 23 bp, Homo sapiens
gtccctaccgagtctcttctcca

SEQ ID NO: 4103918 - DNA, 23 bp, Homo sapiens
gtccctatctattaaagtgactt

SEQ ID NO: 4103919 - DNA, 15 bp, Homo sapiens
gtccctccctgcctg

SEQ ID NO: 4103920 - DNA, 19 bp, Homo sapiens
gtccctccctgcctgaggg

SEQ ID NO: 4103921 - DNA, 16 bp, Homo sapiens
gtccctggcttcctta

SEQ ID NO: 4103922 - DNA, 18 bp, Homo sapiens
gtccctgggccagggtct

SEQ ID NO: 4103923 - DNA, 20 bp, Homo sapiens
gtccctgtgtgtaggctggg

SEQ ID NO: 4103924 - DNA, 22 bp, Homo sapiens
gtccctgtgtgtaggctggggc

SEQ ID NO: 4103925 - DNA, 19 bp, Homo sapiens
gtcccttcccctccctggc

SEQ ID NO: 4103926 - DNA, 13 bp, Homo sapiens
gtcccttgcctca

SEQ ID NO: 4103927 - DNA, 23 bp, Homo sapiens
gtcccttgcctctgccctggatt

SEQ ID NO: 4103928 - DNA, 17 bp, Homo sapiens
gtccctttcagagacag

SEQ ID NO: 4103929 - DNA, 20 bp, Homo sapiens
gtccctttcttctcccccat

SEQ ID NO: 4103930 - DNA, 22 bp, Homo sapiens
gtccctttcttggccagttatc

SEQ ID NO: 4103931 - DNA, 22 bp, Homo sapiens
gtccgctgggtggtaccctctg

SEQ ID NO: 4103932 - DNA, 17 bp, Homo sapiens
gtccggacactcctaga

SEQ ID NO: 4103933 - DNA, 13 bp, Homo sapiens
gtcctaaaacacc

SEQ ID NO: 4103934 - DNA, 19 bp, Homo sapiens
gtcctaaggacacactaat

SEQ ID NO: 4103935 - DNA, 20 bp, Homo sapiens
gtcctaagtgtcaagtcctg

SEQ ID NO: 4103936 - DNA, 16 bp, Homo sapiens
gtcctacgtccaaggt

SEQ ID NO: 4103937 - DNA, 17 bp, Homo sapiens
gtcctagacttcaggga

SEQ ID NO: 4103938 - DNA, 23 bp, Homo sapiens
gtcctagcttgggaggcttcccc

SEQ ID NO: 4103939 - DNA, 19 bp, Homo sapiens
gtcctatggacaacttatt

SEQ ID NO: 4103940 - DNA, 12 bp, Homo sapiens
gtcctcaataaa

SEQ ID NO: 4103941 - DNA, 14 bp, Homo sapiens
gtcctcactcccag

SEQ ID NO: 4103942 - DNA, 16 bp, Homo sapiens
gtcctcacttggggga

SEQ ID NO: 4103943 - DNA, 21 bp, Homo sapiens
gtcctcacttgggggaaaaaa

SEQ ID NO: 4103944 - DNA, 12 bp, Homo sapiens
gtcctcagcctt

SEQ ID NO: 4103945 - DNA, 22 bp, Homo sapiens
gtcctcagggagcagggaaggc

SEQ ID NO: 4103946 - DNA, 18 bp, Homo sapiens
gtcctcagtccatttata

SEQ ID NO: 4103947 - DNA, 22 bp, Homo sapiens
gtcctccaacaccaagcacagc

SEQ ID NO: 4103948 - DNA, 15 bp, Homo sapiens
gtcctccaagtgccc

SEQ ID NO: 4103949 - DNA, 20 bp, Homo sapiens
gtcctccactcgacccagaa

SEQ ID NO: 4103950 - DNA, 21 bp, Homo sapiens
gtcctccactcgacccagaat

SEQ ID NO: 4103951 - DNA, 14 bp, Homo sapiens
gtcctccagaagcc

SEQ ID NO: 4103952 - DNA, 19 bp, Homo sapiens
gtcctccagaagcctctgg

SEQ ID NO: 4103953 - DNA, 14 bp, Homo sapiens
gtcctccaggagct

SEQ ID NO: 4103954 - DNA, 23 bp, Homo sapiens
gtcctccatcccaacagccatgc

SEQ ID NO: 4103955 - DNA, 19 bp, Homo sapiens
gtcctcccatcccctggac

SEQ ID NO: 4103956 - DNA, 15 bp, Homo sapiens
gtcctcctcacctca

SEQ ID NO: 4103957 - DNA, 17 bp, Homo sapiens
gtcactggctggctcct

SEQ ID NO: 4103958 - DNA, 21 bp, Homo sapiens
gtcactggctggctcctaggg

SEQ ID NO: 4103959 - DNA, 13 bp, Homo sapiens
gtcactgtttctc

SEQ ID NO: 4103960 - DNA, 15 bp, Homo sapiens
gtcactgtttctctg

SEQ ID NO: 4103961 - DNA, 20 bp, Homo sapiens
gtcacttacctagatttaca

SEQ ID NO: 4103962 - DNA, 13 bp, Homo sapiens
gtcacttcaccat

SEQ ID NO: 4103963 - DNA, 18 bp, Homo sapiens
gtcacttcgcgtgccctc

SEQ ID NO: 4103964 - DNA, 24 bp, Homo sapiens
gtcacttcgcgtgccctcgctgct

SEQ ID NO: 4103965 - DNA, 14 bp, Homo sapiens
gtcacttcttctgt

SEQ ID NO: 4103966 - DNA, 16 bp, Homo sapiens
gtcactttgctctggg

SEQ ID NO: 4103967 - DNA, 17 bp, Homo sapiens
gtcactttgctctgggt

SEQ ID NO: 4103968 - DNA, 15 bp, Homo sapiens
gtcagactaagaaat

SEQ ID NO: 4103969 - DNA, 12 bp, Homo sapiens
gtcagagccctg

SEQ ID NO: 4103970 - DNA, 16 bp, Homo sapiens
gtcagagtccagtgct

SEQ ID NO: 4103971 - DNA, 20 bp, Homo sapiens
gtcagagtccagtgctctgc

SEQ ID NO: 4103972 - DNA, 22 bp, Homo sapiens
gtcagagtccagtgctctgcct

SEQ ID NO: 4103973 - DNA, 13 bp, Homo sapiens
gtcagatttctgg

SEQ ID NO: 4103974 - DNA, 15 bp, Homo sapiens
gtcagatttctggtt

SEQ ID NO: 4103975 - DNA, 18 bp, Homo sapiens
gtcagcagacacacatgg

SEQ ID NO: 4103976 - DNA, 15 bp, Homo sapiens
gtcagcatgcttccc

SEQ ID NO: 4103977 - DNA, 20 bp, Homo sapiens
gtcagcatgcttcccagagg

SEQ ID NO: 4103978 - DNA, 15 bp, Homo sapiens
gtcagccaaatgtaa

SEQ ID NO: 4103979 - DNA, 11 bp, Homo sapiens
gtcagccagcc

SEQ ID NO: 4103980 - DNA, 12 bp, Homo sapiens
gtcagccagccg

SEQ ID NO: 4103981 - DNA, 12 bp, Homo sapiens
gtcagccaggct

SEQ ID NO: 4103982 - DNA, 14 bp, Homo sapiens
gtcagccagggcca

SEQ ID NO: 4103983 - DNA, 23 bp, Homo sapiens
gtcagcctcgcaggcctccctgc

SEQ ID NO: 4103984 - DNA, 21 bp, Homo sapiens
gtcagcgttctaccaggcaaa

SEQ ID NO: 4103985 - DNA, 14 bp, Homo sapiens
gtcagctactaatg

SEQ ID NO: 4103986 - DNA, 18 bp, Homo sapiens
gtcagctctctgccctgt

SEQ ID NO: 4103987 - DNA, 12 bp, Homo sapiens
gtcagctgaggc

SEQ ID NO: 4103988 - DNA, 23 bp, Homo sapiens
gtcagctgaggctgggggagagc

SEQ ID NO: 4103989 - DNA, 17 bp, Homo sapiens
gtcagctgctccctggc

SEQ ID NO: 4103990 - DNA, 19 bp, Homo sapiens
gtcagcttttgttgtttat

SEQ ID NO: 4103991 - DNA, 15 bp, Homo sapiens
gtcaggaacagaagg

SEQ ID NO: 4103992 - DNA, 20 bp, Homo sapiens
gtcaggaagcaggggtgggg

SEQ ID NO: 4103993 - DNA, 17 bp, Homo sapiens
gtcaggaggcagaagga

SEQ ID NO: 4103994 - DNA, 13 bp, Homo sapiens
gtcaggcagggtg

SEQ ID NO: 4103995 - DNA, 15 bp, Homo sapiens
gtcaggccgggcaga

SEQ ID NO: 4103996 - DNA, 18 bp, Homo sapiens
gtcaggcggggtgctgtg

SEQ ID NO: 4103997 - DNA, 19 bp, Homo sapiens
gtcaggctctctgggctga

SEQ ID NO: 4103998 - DNA, 20 bp, Homo sapiens
gtcaggctctctgggctgac

SEQ ID NO: 4103999 - DNA, 22 bp, Homo sapiens
gtcaggctgggcagccccagag

SEQ ID NO: 4104000 - DNA, 14 bp, Homo sapiens
gtcagggagtgctg

SEQ ID NO: 4104001 - DNA, 19 bp, Homo sapiens
gtcagggagtgctggctca

SEQ ID NO: 4104002 - DNA, 15 bp, Homo sapiens
gtcagggtgagccca

SEQ ID NO: 4104003 - DNA, 16 bp, Homo sapiens
gtcagtatccaggctt

SEQ ID NO: 4104004 - DNA, 14 bp, Homo sapiens
gtcagtcacagcca

SEQ ID NO: 4104005 - DNA, 22 bp, Homo sapiens
gtcagtcatgatggcaccactg

SEQ ID NO: 4104006 - DNA, 21 bp, Homo sapiens
gtcagtccaaggggtcccctc

SEQ ID NO: 4104007 - DNA, 14 bp, Homo sapiens
gtcagtcgcctttc

SEQ ID NO: 4104008 - DNA, 22 bp, Homo sapiens
gtcagttcttggtgctctgtgt

SEQ ID NO: 4104009 - DNA, 20 bp, Homo sapiens
gtcatagcaagcttttgctc

SEQ ID NO: 4104010 - DNA, 15 bp, Homo sapiens
gtcataggttaatat

SEQ ID NO: 4104011 - DNA, 21 bp, Homo sapiens
gtcatataagattcatattta

SEQ ID NO: 4104012 - DNA, 17 bp, Homo sapiens
gtcatatactgccatgt

SEQ ID NO: 4104013 - DNA, 18 bp, Homo sapiens
gtcatcatcagggcctgg

SEQ ID NO: 4104014 - DNA, 20 bp, Homo sapiens
gtcatcatcagggcctgggg

SEQ ID NO: 4104015 - DNA, 22 bp, Homo sapiens
gtcatccaacaagaagaaatat

SEQ ID NO: 4104016 - DNA, 21 bp, Homo sapiens
gtcatcccatcattttccata

SEQ ID NO: 4104017 - DNA, 17 bp, Homo sapiens
gtcatctcattccactg

SEQ ID NO: 4104018 - DNA, 17 bp, Homo sapiens
gtcatctgattggacag

SEQ ID NO: 4104019 - DNA, 19 bp, Homo sapiens
gtcatctgattggacaggc

SEQ ID NO: 4104020 - DNA, 16 bp, Homo sapiens
gtcatgatgctctttc

SEQ ID NO: 4104021 - DNA, 15 bp, Homo sapiens
gtcatgatggcacca

SEQ ID NO: 4104022 - DNA, 18 bp, Homo sapiens
gtcatgcataaatatgca

SEQ ID NO: 4104023 - DNA, 19 bp, Homo sapiens
gtcatgcataaatatgcag

SEQ ID NO: 4104024 - DNA, 15 bp, Homo sapiens
gtcatgctcccctgt

SEQ ID NO: 4104025 - DNA, 20 bp, Homo sapiens
gtcatgctcccctgtgccag

SEQ ID NO: 4104026 - DNA, 16 bp, Homo sapiens
gtcatggactgttgcc

SEQ ID NO: 4104027 - DNA, 14 bp, Homo sapiens
gtcatgtgtgaaca

SEQ ID NO: 4104028 - DNA, 14 bp, Homo sapiens
gtcatgttgcttgt

SEQ ID NO: 4104029 - DNA, 16 bp, Homo sapiens
gtcatgtttgcagggg

SEQ ID NO: 4104030 - DNA, 23 bp, Homo sapiens
gtcatgtttgcaggggtgacggc

SEQ ID NO: 4104031 - DNA, 21 bp, Homo sapiens
gtcattatgggttaggcatta

SEQ ID NO: 4104032 - DNA, 19 bp, Homo sapiens
gtcattctaggatgtggag

SEQ ID NO: 4104033 - DNA, 21 bp, Homo sapiens
gtcattctaggatgtggagct

SEQ ID NO: 4104034 - DNA, 18 bp, Homo sapiens
gtcattgctgttgtccct

SEQ ID NO: 4104035 - DNA, 12 bp, Homo sapiens
gtcattgcttct

SEQ ID NO: 4104036 - DNA, 17 bp, Homo sapiens
gtcatttactaaacata

SEQ ID NO: 4104037 - DNA, 14 bp, Homo sapiens
gtcatttatgagca

SEQ ID NO: 4104038 - DNA, 20 bp, Homo sapiens
gtcatttcattccattgcct

SEQ ID NO: 4104039 - DNA, 13 bp, Homo sapiens
gtcatttccccca

SEQ ID NO: 4104040 - DNA, 17 bp, Homo sapiens
gtcatttgaacctggat

SEQ ID NO: 4104041 - DNA, 21 bp, Homo sapiens
gtcatttgctgagcatgtact

SEQ ID NO: 4104042 - DNA, 16 bp, Homo sapiens
gtcatttgttaaaata

SEQ ID NO: 4104043 - DNA, 17 bp, Homo sapiens
gtcatttgttgtgatgt

SEQ ID NO: 4104044 - DNA, 15 bp, Homo sapiens
gtccaaaaaaaggaa

SEQ ID NO: 4104045 - DNA, 17 bp, Homo sapiens
gtccaaaaaaaggaaaa

SEQ ID NO: 4104046 - DNA, 18 bp, Homo sapiens
gtccaaaaaaaggaaaaa

SEQ ID NO: 4104047 - DNA, 15 bp, Homo sapiens
gtccaacaagaatgc

SEQ ID NO: 4104048 - DNA, 14 bp, Homo sapiens
gtccaagcagagtg

SEQ ID NO: 4104049 - DNA, 13 bp, Homo sapiens
gtccaaggccagt

SEQ ID NO: 4104050 - DNA, 19 bp, Homo sapiens
gtccaagttcttcacctct

SEQ ID NO: 4104051 - DNA, 20 bp, Homo sapiens
gtccacccacctatgtgcca

SEQ ID NO: 4104052 - DNA, 13 bp, Homo sapiens
gtccacctgtggg

SEQ ID NO: 4104053 - DNA, 14 bp, Homo sapiens
gtccacctgtgggt

SEQ ID NO: 4104054 - DNA, 23 bp, Homo sapiens
gtccacctgtgggtgtagccagg

SEQ ID NO: 4104055 - DNA, 17 bp, Homo sapiens
gtccactccctgctcca

SEQ ID NO: 4104056 - DNA, 21 bp, Homo sapiens
gtccagaaactcctgtttctc

SEQ ID NO: 4104057 - DNA, 22 bp, Homo sapiens
gtccagagcttgtgctcctctt

SEQ ID NO: 4104058 - DNA, 15 bp, Homo sapiens
gtccagcacagaagg

SEQ ID NO: 4104059 - DNA, 13 bp, Homo sapiens
gtccagcctgggc

SEQ ID NO: 4104060 - DNA, 16 bp, Homo sapiens
gtatggaagttttcct

SEQ ID NO: 4104061 - DNA, 17 bp, Homo sapiens
gtatggaatacagtgtt

SEQ ID NO: 4104062 - DNA, 21 bp, Homo sapiens
gtatggctctgcacccctctg

SEQ ID NO: 4104063 - DNA, 23 bp, Homo sapiens
gtatgtaatgtgtggtggcctca

SEQ ID NO: 4104064 - DNA, 16 bp, Homo sapiens
gtatgtaatttatgca

SEQ ID NO: 4104065 - DNA, 23 bp, Homo sapiens
gtatgtgacaccaaagccacctc

SEQ ID NO: 4104066 - DNA, 22 bp, Homo sapiens
gtatgttatgatattgtttaaa

SEQ ID NO: 4104067 - DNA, 21 bp, Homo sapiens
gtatgtttgcacacttgtgtg

SEQ ID NO: 4104068 - DNA, 24 bp, Homo sapiens
gtattaaaacacattatgtatctt

SEQ ID NO: 4104069 - DNA, 13 bp, Homo sapiens
gtattaaagacag

SEQ ID NO: 4104070 - DNA, 14 bp, Homo sapiens
gtattaaagggggg

SEQ ID NO: 4104071 - DNA, 19 bp, Homo sapiens
gtattaaaggggggagggg

SEQ ID NO: 4104072 - DNA, 23 bp, Homo sapiens
gtattatccacaattattggcaa

SEQ ID NO: 4104073 - DNA, 17 bp, Homo sapiens
gtattatctgtgttaaa

SEQ ID NO: 4104074 - DNA, 15 bp, Homo sapiens
gtattattattattg

SEQ ID NO: 4104075 - DNA, 17 bp, Homo sapiens
gtattattctgttttgc

SEQ ID NO: 4104076 - DNA, 22 bp, Homo sapiens
gtattcagtgagggtcttctta

SEQ ID NO: 4104077 - DNA, 19 bp, Homo sapiens
gtattcatccagagttctt

SEQ ID NO: 4104078 - DNA, 22 bp, Homo sapiens
gtattctcagagcatgtgtcag

SEQ ID NO: 4104079 - DNA, 15 bp, Homo sapiens
gtattcttcaacctc

SEQ ID NO: 4104080 - DNA, 18 bp, Homo sapiens
gtattcttctgtatttct

SEQ ID NO: 4104081 - DNA, 15 bp, Homo sapiens
gtattgactgtacca

SEQ ID NO: 4104082 - DNA, 16 bp, Homo sapiens
gtattgagatttctta

SEQ ID NO: 4104083 - DNA, 16 bp, Homo sapiens
gtattgcacattgtaa

SEQ ID NO: 4104084 - DNA, 18 bp, Homo sapiens
gtattgcacattgtaaaa

SEQ ID NO: 4104085 - DNA, 20 bp, Homo sapiens
gtattggctttttcagagtc

SEQ ID NO: 4104086 - DNA, 13 bp, Homo sapiens
gtattgtaatctt

SEQ ID NO: 4104087 - DNA, 14 bp, Homo sapiens
gtattgttcccagt

SEQ ID NO: 4104088 - DNA, 13 bp, Homo sapiens
gtatttaattaaa

SEQ ID NO: 4104089 - DNA, 16 bp, Homo sapiens
gtatttatatatttat

SEQ ID NO: 4104090 - DNA, 17 bp, Homo sapiens
gtatttattaatttgaa

SEQ ID NO: 4104091 - DNA, 18 bp, Homo sapiens
gtatttattaatttgaaa

SEQ ID NO: 4104092 - DNA, 15 bp, Homo sapiens
gtatttattttgtaa

SEQ ID NO: 4104093 - DNA, 21 bp, Homo sapiens
gtatttcagtgtagttaattt

SEQ ID NO: 4104094 - DNA, 16 bp, Homo sapiens
gtatttcatgtggctg

SEQ ID NO: 4104095 - DNA, 16 bp, Homo sapiens
gtatttccagtgcaat

SEQ ID NO: 4104096 - DNA, 11 bp, Homo sapiens
gtatttctcag

SEQ ID NO: 4104097 - DNA, 15 bp, Homo sapiens
gtatttctgattttg

SEQ ID NO: 4104098 - DNA, 19 bp, Homo sapiens
gtatttgagagttctaaat

SEQ ID NO: 4104099 - DNA, 24 bp, Homo sapiens
gtattttaatcctgtaccaaatct

SEQ ID NO: 4104100 - DNA, 13 bp, Homo sapiens
gtattttgaagtt

SEQ ID NO: 4104101 - DNA, 13 bp, Homo sapiens
gtattttgacact

SEQ ID NO: 4104102 - DNA, 15 bp, Homo sapiens
gtattttgtgtcctc

SEQ ID NO: 4104103 - DNA, 24 bp, Homo sapiens
gtattttgtgtcctccaggagctt

SEQ ID NO: 4104104 - DNA, 18 bp, Homo sapiens
gtatttttcaataaagca

SEQ ID NO: 4104105 - DNA, 21 bp, Homo sapiens
gtatttttcaataaagcattt

SEQ ID NO: 4104106 - DNA, 17 bp, Homo sapiens
gtatttttcagagattt

SEQ ID NO: 4104107 - DNA, 13 bp, Homo sapiens
gtatttttgttag

SEQ ID NO: 4104108 - DNA, 18 bp, Homo sapiens
gtattttttaaaacacta

SEQ ID NO: 4104109 - DNA, 16 bp, Homo sapiens
gtatttttttttctaa

SEQ ID NO: 4104110 - DNA, 14 bp, Homo sapiens
gtcaaacagtgcca

SEQ ID NO: 4104111 - DNA, 20 bp, Homo sapiens
gtcaaacattcgtgagctgg

SEQ ID NO: 4104112 - DNA, 18 bp, Homo sapiens
gtcaaactaattctcaca

SEQ ID NO: 4104113 - DNA, 13 bp, Homo sapiens
gtcaaacttggat

SEQ ID NO: 4104114 - DNA, 21 bp, Homo sapiens
gtcaacaagtatgaataaaga

SEQ ID NO: 4104115 - DNA, 22 bp, Homo sapiens
gtcaacacttaagggttttaga

SEQ ID NO: 4104116 - DNA, 15 bp, Homo sapiens
gtcaacttctggctc

SEQ ID NO: 4104117 - DNA, 17 bp, Homo sapiens
gtcaacttctggctcct

SEQ ID NO: 4104118 - DNA, 12 bp, Homo sapiens
gtcaagaagaat

SEQ ID NO: 4104119 - DNA, 14 bp, Homo sapiens
gtcaagctgctctg

SEQ ID NO: 4104120 - DNA, 20 bp, Homo sapiens
gtcaagctgctctgagccac

SEQ ID NO: 4104121 - DNA, 23 bp, Homo sapiens
gtcaagctgctctgagccacagt

SEQ ID NO: 4104122 - DNA, 20 bp, Homo sapiens
gtcaagggcttactatttct

SEQ ID NO: 4104123 - DNA, 20 bp, Homo sapiens
gtcaagtcctgactgggctg

SEQ ID NO: 4104124 - DNA, 17 bp, Homo sapiens
gtcaagtctctgctggc

SEQ ID NO: 4104125 - DNA, 20 bp, Homo sapiens
gtcaagtggcaaagctgttc

SEQ ID NO: 4104126 - DNA, 14 bp, Homo sapiens
gtcaagtgggatct

SEQ ID NO: 4104127 - DNA, 22 bp, Homo sapiens
gtcaataaacaacagctgaagc

SEQ ID NO: 4104128 - DNA, 13 bp, Homo sapiens
gtcaataaacagc

SEQ ID NO: 4104129 - DNA, 21 bp, Homo sapiens
gtcaataaacttagaggaaaa

SEQ ID NO: 4104130 - DNA, 17 bp, Homo sapiens
gtcaatacaaatagatt

SEQ ID NO: 4104131 - DNA, 15 bp, Homo sapiens
gtcaatattaaatac

SEQ ID NO: 4104132 - DNA, 18 bp, Homo sapiens
gtcaatattaaatacaga

SEQ ID NO: 4104133 - DNA, 15 bp, Homo sapiens
gtcaatcatttctca

SEQ ID NO: 4104134 - DNA, 18 bp, Homo sapiens
gtcaatgtgcagtgtagc

SEQ ID NO: 4104135 - DNA, 22 bp, Homo sapiens
gtcaatttccctgactcctcta

SEQ ID NO: 4104136 - DNA, 14 bp, Homo sapiens
gtcacaaagagttc

SEQ ID NO: 4104137 - DNA, 20 bp, Homo sapiens
gtcacaatgagattgaattt

SEQ ID NO: 4104138 - DNA, 13 bp, Homo sapiens
gtcacacactgat

SEQ ID NO: 4104139 - DNA, 13 bp, Homo sapiens
gtcacaccagcca

SEQ ID NO: 4104140 - DNA, 18 bp, Homo sapiens
gtcacacggccacccgcc

SEQ ID NO: 4104141 - DNA, 14 bp, Homo sapiens
gtcacagcctcctc

SEQ ID NO: 4104142 - DNA, 23 bp, Homo sapiens
gtcacagcctcctctgtctgccc

SEQ ID NO: 4104143 - DNA, 12 bp, Homo sapiens
gtcacagctgga

SEQ ID NO: 4104144 - DNA, 12 bp, Homo sapiens
gtcacagggcca

SEQ ID NO: 4104145 - DNA, 15 bp, Homo sapiens
gtcacatccatccct

SEQ ID NO: 4104146 - DNA, 13 bp, Homo sapiens
gtcacattgcatt

SEQ ID NO: 4104147 - DNA, 19 bp, Homo sapiens
gtcaccacgactggccagg

SEQ ID NO: 4104148 - DNA, 19 bp, Homo sapiens
gtcaccggtcagtgccttt

SEQ ID NO: 4104149 - DNA, 15 bp, Homo sapiens
gtcacctctctcaga

SEQ ID NO: 4104150 - DNA, 16 bp, Homo sapiens
gtcacctctctcagag

SEQ ID NO: 4104151 - DNA, 19 bp, Homo sapiens
gtcacctctctcagagcat

SEQ ID NO: 4104152 - DNA, 20 bp, Homo sapiens
gtcacctctctcagagcatc

SEQ ID NO: 4104153 - DNA, 13 bp, Homo sapiens
gtcacctgctcca

SEQ ID NO: 4104154 - DNA, 22 bp, Homo sapiens
gtcaccttttctgtggctggct

SEQ ID NO: 4104155 - DNA, 18 bp, Homo sapiens
gtcacgctggggctctct

SEQ ID NO: 4104156 - DNA, 17 bp, Homo sapiens
gtcactactcacagtct

SEQ ID NO: 4104157 - DNA, 20 bp, Homo sapiens
gtcactatgggatgagaaaa

SEQ ID NO: 4104158 - DNA, 20 bp, Homo sapiens
gtcactcattgctgagcctc

SEQ ID NO: 4104159 - DNA, 19 bp, Homo sapiens
gtcactccctctgccttca

SEQ ID NO: 4104160 - DNA, 20 bp, Homo sapiens
gtcactgcacagtgcatctc

SEQ ID NO: 4104161 - DNA, 20 bp, Homo sapiens
gtcactggaggttgaagcca

SEQ ID NO: 4104162 - DNA, 15 bp, Homo sapiens
gtcactggctggctc

SEQ ID NO: 4104163 - DNA, 19 bp, Homo sapiens
gtagaaggttgacacagtt

SEQ ID NO: 4104164 - DNA, 16 bp, Homo sapiens
gtagagcaaaactata

SEQ ID NO: 4104165 - DNA, 15 bp, Homo sapiens
gtagagttaagaagc

SEQ ID NO: 4104166 - DNA, 18 bp, Homo sapiens
gtagagttaagaagctgt

SEQ ID NO: 4104167 - DNA, 15 bp, Homo sapiens
gtagagttgctgaga

SEQ ID NO: 4104168 - DNA, 12 bp, Homo sapiens
gtagatagaaat

SEQ ID NO: 4104169 - DNA, 14 bp, Homo sapiens
gtagatagaaataa

SEQ ID NO: 4104170 - DNA, 19 bp, Homo sapiens
gtagatattgttttctgta

SEQ ID NO: 4104171 - DNA, 13 bp, Homo sapiens
gtagattgcagaa

SEQ ID NO: 4104172 - DNA, 23 bp, Homo sapiens
gtagattgcagaaaattctgtgc

SEQ ID NO: 4104173 - DNA, 16 bp, Homo sapiens
gtagattgcttctgta

SEQ ID NO: 4104174 - DNA, 17 bp, Homo sapiens
gtagcaaatgagacagc

SEQ ID NO: 4104175 - DNA, 21 bp, Homo sapiens
gtagcataaataaaactgaat

SEQ ID NO: 4104176 - DNA, 15 bp, Homo sapiens
gtagccacagctgct

SEQ ID NO: 4104177 - DNA, 15 bp, Homo sapiens
gtagccagcacacag

SEQ ID NO: 4104178 - DNA, 13 bp, Homo sapiens
gtagccagctgtg

SEQ ID NO: 4104179 - DNA, 18 bp, Homo sapiens
gtagccaggtatggctct

SEQ ID NO: 4104180 - DNA, 18 bp, Homo sapiens
gtagccatctgcacacac

SEQ ID NO: 4104181 - DNA, 13 bp, Homo sapiens
gtagccatggctg

SEQ ID NO: 4104182 - DNA, 15 bp, Homo sapiens
gtagccatggctggg

SEQ ID NO: 4104183 - DNA, 21 bp, Homo sapiens
gtagcccacacttgagaggat

SEQ ID NO: 4104184 - DNA, 13 bp, Homo sapiens
gtagcccagcact

SEQ ID NO: 4104185 - DNA, 16 bp, Homo sapiens
gtagccccctggcctc

SEQ ID NO: 4104186 - DNA, 16 bp, Homo sapiens
gtagcctatgttgtgg

SEQ ID NO: 4104187 - DNA, 23 bp, Homo sapiens
gtagcggaaaagttgtcttaaaa

SEQ ID NO: 4104188 - DNA, 17 bp, Homo sapiens
gtagcgttttttaaatg

SEQ ID NO: 4104189 - DNA, 22 bp, Homo sapiens
gtagctctaggagggctggcaa

SEQ ID NO: 4104190 - DNA, 10 bp, Homo sapiens
gtagctgcga

SEQ ID NO: 4104191 - DNA, 17 bp, Homo sapiens
gtagctgggatgacagg

SEQ ID NO: 4104192 - DNA, 22 bp, Homo sapiens
gtagctgtctaacccccagctg

SEQ ID NO: 4104193 - DNA, 19 bp, Homo sapiens
gtaggaaaaataaaaacag

SEQ ID NO: 4104194 - DNA, 21 bp, Homo sapiens
gtaggacaaggtgcaggcagg

SEQ ID NO: 4104195 - DNA, 23 bp, Homo sapiens
gtaggagctgccttggctcagac

SEQ ID NO: 4104196 - DNA, 18 bp, Homo sapiens
gtaggatttttttcctcc

SEQ ID NO: 4104197 - DNA, 14 bp, Homo sapiens
gtaggcatttccta

SEQ ID NO: 4104198 - DNA, 17 bp, Homo sapiens
gtaggcggcgatttttg

SEQ ID NO: 4104199 - DNA, 20 bp, Homo sapiens
gtaggctggggcggggccca

SEQ ID NO: 4104200 - DNA, 21 bp, Homo sapiens
gtagggaagaaaactatcctg

SEQ ID NO: 4104201 - DNA, 15 bp, Homo sapiens
gtagggaggcagcct

SEQ ID NO: 4104202 - DNA, 15 bp, Homo sapiens
gtagggaggtcagtg

SEQ ID NO: 4104203 - DNA, 18 bp, Homo sapiens
gtagggctctgacaaagc

SEQ ID NO: 4104204 - DNA, 22 bp, Homo sapiens
gtaggggcttataataaaggac

SEQ ID NO: 4104205 - DNA, 22 bp, Homo sapiens
gtagggtaaatcagtaagaggt

SEQ ID NO: 4104206 - DNA, 16 bp, Homo sapiens
gtagggttataataat

SEQ ID NO: 4104207 - DNA, 20 bp, Homo sapiens
gtaggtaaaagtagaagcat

SEQ ID NO: 4104208 - DNA, 15 bp, Homo sapiens
gtagtaattgacatg

SEQ ID NO: 4104209 - DNA, 21 bp, Homo sapiens
gtagtactcctgcaaaatttt

SEQ ID NO: 4104210 - DNA, 16 bp, Homo sapiens
gtagtcaggtgctcaa

SEQ ID NO: 4104211 - DNA, 17 bp, Homo sapiens
gtagtcatttactaaac

SEQ ID NO: 4104212 - DNA, 12 bp, Homo sapiens
gtagtccccaac

SEQ ID NO: 4104213 - DNA, 16 bp, Homo sapiens
gtagtcttgatgacca

SEQ ID NO: 4104214 - DNA, 22 bp, Homo sapiens
gtagtgaaataatagaatgagc

SEQ ID NO: 4104215 - DNA, 21 bp, Homo sapiens
gtagtttatggcagaagggaa

SEQ ID NO: 4104216 - DNA, 18 bp, Homo sapiens
gtagtttggatatttttg

SEQ ID NO: 4104217 - DNA, 19 bp, Homo sapiens
gtagtttggatatttttgt

SEQ ID NO: 4104218 - DNA, 20 bp, Homo sapiens
gtagtttggatatttttgta

SEQ ID NO: 4104219 - DNA, 21 bp, Homo sapiens
gtataaaactttcctcgcctg

SEQ ID NO: 4104220 - DNA, 21 bp, Homo sapiens
gtataaacataagttgcattt

SEQ ID NO: 4104221 - DNA, 14 bp, Homo sapiens
gtataaagaaaagt

SEQ ID NO: 4104222 - DNA, 15 bp, Homo sapiens
gtataaatgtctatt

SEQ ID NO: 4104223 - DNA, 17 bp, Homo sapiens
gtataagcactgaaaaa

SEQ ID NO: 4104224 - DNA, 12 bp, Homo sapiens
gtataagttatt

SEQ ID NO: 4104225 - DNA, 17 bp, Homo sapiens
gtataatttcgagattt

SEQ ID NO: 4104226 - DNA, 15 bp, Homo sapiens
gtatactgtaggcac

SEQ ID NO: 4104227 - DNA, 15 bp, Homo sapiens
gtatagaccaaagca

SEQ ID NO: 4104228 - DNA, 21 bp, Homo sapiens
gtatagaccaaagcaaagaaa

SEQ ID NO: 4104229 - DNA, 18 bp, Homo sapiens
gtatagatgcaagatatt

SEQ ID NO: 4104230 - DNA, 12 bp, Homo sapiens
gtatataatttt

SEQ ID NO: 4104231 - DNA, 18 bp, Homo sapiens
gtatatacagttattttg

SEQ ID NO: 4104232 - DNA, 20 bp, Homo sapiens
gtatataggacaaaatgtta

SEQ ID NO: 4104233 - DNA, 24 bp, Homo sapiens
gtatatcatgtaaagaaatgtctt

SEQ ID NO: 4104234 - DNA, 16 bp, Homo sapiens
gtatatcattctacag

SEQ ID NO: 4104235 - DNA, 21 bp, Homo sapiens
gtatatcattctacagaataa

SEQ ID NO: 4104236 - DNA, 17 bp, Homo sapiens
gtatatctggacaagcc

SEQ ID NO: 4104237 - DNA, 15 bp, Homo sapiens
gtatatgacatttaa

SEQ ID NO: 4104238 - DNA, 21 bp, Homo sapiens
gtatatggcttcaagttgtaa

SEQ ID NO: 4104239 - DNA, 22 bp, Homo sapiens
gtatatgtcaagccataattgt

SEQ ID NO: 4104240 - DNA, 22 bp, Homo sapiens
gtatattctttggttgtgaatc

SEQ ID NO: 4104241 - DNA, 14 bp, Homo sapiens
gtatatttgtacaa

SEQ ID NO: 4104242 - DNA, 14 bp, Homo sapiens
gtatatttgtatat

SEQ ID NO: 4104243 - DNA, 21 bp, Homo sapiens
gtatatttgtgatagcacttt

SEQ ID NO: 4104244 - DNA, 18 bp, Homo sapiens
gtatcactctaaaaaaca

SEQ ID NO: 4104245 - DNA, 18 bp, Homo sapiens
gtatcaggtcagggactt

SEQ ID NO: 4104246 - DNA, 17 bp, Homo sapiens
gtatcagtgttttaaat

SEQ ID NO: 4104247 - DNA, 14 bp, Homo sapiens
gtatcatctccatc

SEQ ID NO: 4104248 - DNA, 18 bp, Homo sapiens
gtatcatgccctgtgcaa

SEQ ID NO: 4104249 - DNA, 18 bp, Homo sapiens
gtatcctgcccagtgttg

SEQ ID NO: 4104250 - DNA, 14 bp, Homo sapiens
gtatcgatgtttta

SEQ ID NO: 4104251 - DNA, 17 bp, Homo sapiens
gtatcgtaaccagccag

SEQ ID NO: 4104252 - DNA, 17 bp, Homo sapiens
gtatcgtattcaccttc

SEQ ID NO: 4104253 - DNA, 24 bp, Homo sapiens
gtatctagcaatcacaacactggc

SEQ ID NO: 4104254 - DNA, 18 bp, Homo sapiens
gtatctagtgcagctgat

SEQ ID NO: 4104255 - DNA, 11 bp, Homo sapiens
gtatctcagaa

SEQ ID NO: 4104256 - DNA, 21 bp, Homo sapiens
gtatctcagaaagtgcctgac

SEQ ID NO: 4104257 - DNA, 13 bp, Homo sapiens
gtatctccaggat

SEQ ID NO: 4104258 - DNA, 19 bp, Homo sapiens
gtatcttccatatttggaa

SEQ ID NO: 4104259 - DNA, 22 bp, Homo sapiens
gtatcttctatttttatcatga

SEQ ID NO: 4104260 - DNA, 18 bp, Homo sapiens
gtatcttttatcctggga

SEQ ID NO: 4104261 - DNA, 14 bp, Homo sapiens
gtatcttttctttc

SEQ ID NO: 4104262 - DNA, 18 bp, Homo sapiens
gtatcttttttataacca

SEQ ID NO: 4104263 - DNA, 19 bp, Homo sapiens
gtatgaactttatctaaag

SEQ ID NO: 4104264 - DNA, 12 bp, Homo sapiens
gtatgagctgag

SEQ ID NO: 4104265 - DNA, 20 bp, Homo sapiens
gtatggaaggtggagcgttc

SEQ ID NO: 4104266 - DNA, 20 bp, Homo sapiens
gtaatgcttccaatcttgct

SEQ ID NO: 4104267 - DNA, 14 bp, Homo sapiens
gtaatggtgtagaa

SEQ ID NO: 4104268 - DNA, 18 bp, Homo sapiens
gtaatgtagcgtgtttac

SEQ ID NO: 4104269 - DNA, 16 bp, Homo sapiens
gtaatgtgaaaagtat

SEQ ID NO: 4104270 - DNA, 20 bp, Homo sapiens
gtaatgttaatgttatatca

SEQ ID NO: 4104271 - DNA, 22 bp, Homo sapiens
gtaatgttactgatcatgcatt

SEQ ID NO: 4104272 - DNA, 14 bp, Homo sapiens
gtaatgttttgtat

SEQ ID NO: 4104273 - DNA, 16 bp, Homo sapiens
gtaatgttttgtatat

SEQ ID NO: 4104274 - DNA, 20 bp, Homo sapiens
gtaattaagtactatgtatc

SEQ ID NO: 4104275 - DNA, 18 bp, Homo sapiens
gtaattctaaatgaatgt

SEQ ID NO: 4104276 - DNA, 22 bp, Homo sapiens
gtaattctaaatgaatgtttac

SEQ ID NO: 4104277 - DNA, 12 bp, Homo sapiens
gtaattgcttac

SEQ ID NO: 4104278 - DNA, 16 bp, Homo sapiens
gtaattgcttacattt

SEQ ID NO: 4104279 - DNA, 23 bp, Homo sapiens
gtaatttaaacatttgttcctgg

SEQ ID NO: 4104280 - DNA, 19 bp, Homo sapiens
gtaatttagaaactgattt

SEQ ID NO: 4104281 - DNA, 13 bp, Homo sapiens
gtaatttgaagat

SEQ ID NO: 4104282 - DNA, 21 bp, Homo sapiens
gtaatttttggggaaaaaagc

SEQ ID NO: 4104283 - DNA, 23 bp, Homo sapiens
gtaatttttggggaaaaaagcac

SEQ ID NO: 4104284 - DNA, 20 bp, Homo sapiens
gtacaaaaaaaaagttttat

SEQ ID NO: 4104285 - DNA, 14 bp, Homo sapiens
gtacaaatgtattt

SEQ ID NO: 4104286 - DNA, 15 bp, Homo sapiens
gtacaaatgtatttt

SEQ ID NO: 4104287 - DNA, 22 bp, Homo sapiens
gtacaataagtgtttttgtatt

SEQ ID NO: 4104288 - DNA, 13 bp, Homo sapiens
gtacactctgctg

SEQ ID NO: 4104289 - DNA, 11 bp, Homo sapiens
gtacactgctg

SEQ ID NO: 4104290 - DNA, 12 bp, Homo sapiens
gtacactgctgt

SEQ ID NO: 4104291 - DNA, 23 bp, Homo sapiens
gtacagcggctcccctctgcttc

SEQ ID NO: 4104292 - DNA, 13 bp, Homo sapiens
gtacagctgggct

SEQ ID NO: 4104293 - DNA, 16 bp, Homo sapiens
gtacagtgtgtaaagt

SEQ ID NO: 4104294 - DNA, 12 bp, Homo sapiens
gtacataaaaga

SEQ ID NO: 4104295 - DNA, 23 bp, Homo sapiens
gtacataaattgcataaagcata

SEQ ID NO: 4104296 - DNA, 17 bp, Homo sapiens
gtacataactcctgtcc

SEQ ID NO: 4104297 - DNA, 18 bp, Homo sapiens
gtacataactcctgtccc

SEQ ID NO: 4104298 - DNA, 20 bp, Homo sapiens
gtacataactcctgtccctt

SEQ ID NO: 4104299 - DNA, 16 bp, Homo sapiens
gtacataactctgtaa

SEQ ID NO: 4104300 - DNA, 22 bp, Homo sapiens
gtacatagttatttttctcttt

SEQ ID NO: 4104301 - DNA, 14 bp, Homo sapiens
gtacatatgtgctg

SEQ ID NO: 4104302 - DNA, 20 bp, Homo sapiens
gtacatctattttggattgt

SEQ ID NO: 4104303 - DNA, 15 bp, Homo sapiens
gtacatctgcaatat

SEQ ID NO: 4104304 - DNA, 14 bp, Homo sapiens
gtacatctggcctt

SEQ ID NO: 4104305 - DNA, 11 bp, Homo sapiens
gtacatgagaa

SEQ ID NO: 4104306 - DNA, 12 bp, Homo sapiens
gtacatttataa

SEQ ID NO: 4104307 - DNA, 13 bp, Homo sapiens
gtacatttataat

SEQ ID NO: 4104308 - DNA, 14 bp, Homo sapiens
gtacatttataatt

SEQ ID NO: 4104309 - DNA, 20 bp, Homo sapiens
gtacatttatgatttaataa

SEQ ID NO: 4104310 - DNA, 21 bp, Homo sapiens
gtacatttatgatttaataaa

SEQ ID NO: 4104311 - DNA, 15 bp, Homo sapiens
gtaccaatcatttta

SEQ ID NO: 4104312 - DNA, 22 bp, Homo sapiens
gtaccaatgcagaactcccaag

SEQ ID NO: 4104313 - DNA, 21 bp, Homo sapiens
gtaccacagacacaatatgta

SEQ ID NO: 4104314 - DNA, 16 bp, Homo sapiens
gtaccagccccaccct

SEQ ID NO: 4104315 - DNA, 21 bp, Homo sapiens
gtaccaggtattattatcttt

SEQ ID NO: 4104316 - DNA, 20 bp, Homo sapiens
gtaccatgaaacaaagctgc

SEQ ID NO: 4104317 - DNA, 13 bp, Homo sapiens
gtacccagatgcc

SEQ ID NO: 4104318 - DNA, 15 bp, Homo sapiens
gtacccagatgccta

SEQ ID NO: 4104319 - DNA, 20 bp, Homo sapiens
gtacccgcctgagctcctgc

SEQ ID NO: 4104320 - DNA, 19 bp, Homo sapiens
gtaccctctcagctccagg

SEQ ID NO: 4104321 - DNA, 13 bp, Homo sapiens
gtacctataaagt

SEQ ID NO: 4104322 - DNA, 14 bp, Homo sapiens
gtacctataaagta

SEQ ID NO: 4104323 - DNA, 19 bp, Homo sapiens
gtacctataaagtaaagct

SEQ ID NO: 4104324 - DNA, 19 bp, Homo sapiens
gtacctcaagccccatttc

SEQ ID NO: 4104325 - DNA, 16 bp, Homo sapiens
gtacctcatcccatga

SEQ ID NO: 4104326 - DNA, 13 bp, Homo sapiens
gtacctcctctca

SEQ ID NO: 4104327 - DNA, 15 bp, Homo sapiens
gtacctctgtataga

SEQ ID NO: 4104328 - DNA, 18 bp, Homo sapiens
gtacctctgtatagaaat

SEQ ID NO: 4104329 - DNA, 19 bp, Homo sapiens
gtacctgctgccccagctg

SEQ ID NO: 4104330 - DNA, 11 bp, Homo sapiens
gtaccttgctt

SEQ ID NO: 4104331 - DNA, 21 bp, Homo sapiens
gtaccttttgaggagccccag

SEQ ID NO: 4104332 - DNA, 15 bp, Homo sapiens
gtacgtcctgcctgg

SEQ ID NO: 4104333 - DNA, 13 bp, Homo sapiens
gtactaaatttaa

SEQ ID NO: 4104334 - DNA, 17 bp, Homo sapiens
gtactaaatttaaattt

SEQ ID NO: 4104335 - DNA, 15 bp, Homo sapiens
gtactaaggaatctt

SEQ ID NO: 4104336 - DNA, 20 bp, Homo sapiens
gtactactagatgtctttag

SEQ ID NO: 4104337 - DNA, 17 bp, Homo sapiens
gtactagttacacatct

SEQ ID NO: 4104338 - DNA, 15 bp, Homo sapiens
gtactcactgaagcc

SEQ ID NO: 4104339 - DNA, 20 bp, Homo sapiens
gtactcactgaagcctgcgt

SEQ ID NO: 4104340 - DNA, 15 bp, Homo sapiens
gtactcctgcaaaat

SEQ ID NO: 4104341 - DNA, 14 bp, Homo sapiens
gtactctgaaacac

SEQ ID NO: 4104342 - DNA, 18 bp, Homo sapiens
gtactcttgatgtgaaga

SEQ ID NO: 4104343 - DNA, 12 bp, Homo sapiens
gtactgaatttt

SEQ ID NO: 4104344 - DNA, 19 bp, Homo sapiens
gtactgaatttttttgtaa

SEQ ID NO: 4104345 - DNA, 20 bp, Homo sapiens
gtactgaatttttttgtaat

SEQ ID NO: 4104346 - DNA, 22 bp, Homo sapiens
gtactgccccccatgaggaagg

SEQ ID NO: 4104347 - DNA, 23 bp, Homo sapiens
gtactgccccccatgaggaagga

SEQ ID NO: 4104348 - DNA, 18 bp, Homo sapiens
gtactgggagaatcacta

SEQ ID NO: 4104349 - DNA, 15 bp, Homo sapiens
gtactgtctgttatg

SEQ ID NO: 4104350 - DNA, 19 bp, Homo sapiens
gtactgtctgttatgattt

SEQ ID NO: 4104351 - DNA, 15 bp, Homo sapiens
gtacttaataaattc

SEQ ID NO: 4104352 - DNA, 20 bp, Homo sapiens
gtacttcccgggccagggct

SEQ ID NO: 4104353 - DNA, 13 bp, Homo sapiens
gtacttgatttga

SEQ ID NO: 4104354 - DNA, 22 bp, Homo sapiens
gtacttggtttttttttttctt

SEQ ID NO: 4104355 - DNA, 21 bp, Homo sapiens
gtacttgtgaaacacagctgt

SEQ ID NO: 4104356 - DNA, 20 bp, Homo sapiens
gtacttgtttcatctggttt

SEQ ID NO: 4104357 - DNA, 20 bp, Homo sapiens
gtacttttatgatgtatatt

SEQ ID NO: 4104358 - DNA, 18 bp, Homo sapiens
gtacttttgagtgtgtgt

SEQ ID NO: 4104359 - DNA, 12 bp, Homo sapiens
gtagaaaaacat

SEQ ID NO: 4104360 - DNA, 21 bp, Homo sapiens
gtagaaaggaagccttgctca

SEQ ID NO: 4104361 - DNA, 17 bp, Homo sapiens
gtagaaataatatgcat

SEQ ID NO: 4104362 - DNA, 14 bp, Homo sapiens
gtagaaatgatgat

SEQ ID NO: 4104363 - DNA, 14 bp, Homo sapiens
gtagaacaaaaaac

SEQ ID NO: 4104364 - DNA, 22 bp, Homo sapiens
gtagaacgccagggaccccaga

SEQ ID NO: 4104365 - DNA, 17 bp, Homo sapiens
gtagaactcactctggg

SEQ ID NO: 4104366 - DNA, 18 bp, Homo sapiens
gtagaactcactctgggc

SEQ ID NO: 4104367 - DNA, 19 bp, Homo sapiens
gtagaactcactctgggct

SEQ ID NO: 4104368 - DNA, 15 bp, Homo sapiens
gtagaagcattcctt

SEQ ID NO: 4104369 - DNA, 13 bp, Homo sapiens
ggtttctcttctc

SEQ ID NO: 4104370 - DNA, 14 bp, Homo sapiens
ggtttggctcctgc

SEQ ID NO: 4104371 - DNA, 19 bp, Homo sapiens
ggtttgggcccctcagagc

SEQ ID NO: 4104372 - DNA, 23 bp, Homo sapiens
ggtttgtcgggcaccagccagcg

SEQ ID NO: 4104373 - DNA, 13 bp, Homo sapiens
ggttttaaacttt

SEQ ID NO: 4104374 - DNA, 16 bp, Homo sapiens
ggttttatactgaagg

SEQ ID NO: 4104375 - DNA, 13 bp, Homo sapiens
ggttttgtatttt

SEQ ID NO: 4104376 - DNA, 13 bp, Homo sapiens
ggtttttacctgt

SEQ ID NO: 4104377 - DNA, 13 bp, Homo sapiens
ggtttttattatt

SEQ ID NO: 4104378 - DNA, 17 bp, Homo sapiens
ggtttttatttctcctt

SEQ ID NO: 4104379 - DNA, 16 bp, Homo sapiens
ggtttttatttctcgg

SEQ ID NO: 4104380 - DNA, 22 bp, Homo sapiens
ggttttttttcagttgttcttt

SEQ ID NO: 4104381 - DNA, 23 bp, Homo sapiens
gtaaaaaaaaaaaaaatgttctt

SEQ ID NO: 4104382 - DNA, 19 bp, Homo sapiens
gtaaaaaaaaaaacaatta

SEQ ID NO: 4104383 - DNA, 13 bp, Homo sapiens
gtaaaaaaaaatg

SEQ ID NO: 4104384 - DNA, 23 bp, Homo sapiens
gtaaaaaaaaatgcctttgagac

SEQ ID NO: 4104385 - DNA, 17 bp, Homo sapiens
gtaaaaatggaaactat

SEQ ID NO: 4104386 - DNA, 22 bp, Homo sapiens
gtaaaacaataataataataaa

SEQ ID NO: 4104387 - DNA, 20 bp, Homo sapiens
gtaaaagaaatcatgtccat

SEQ ID NO: 4104388 - DNA, 17 bp, Homo sapiens
gtaaaagataacaagat

SEQ ID NO: 4104389 - DNA, 22 bp, Homo sapiens
gtaaaatacttttactctgcct

SEQ ID NO: 4104390 - DNA, 19 bp, Homo sapiens
gtaaaatgtgaagtgaatg

SEQ ID NO: 4104391 - DNA, 20 bp, Homo sapiens
gtaaaatgtgaagtgaatga

SEQ ID NO: 4104392 - DNA, 19 bp, Homo sapiens
gtaaacacagtcaaaataa

SEQ ID NO: 4104393 - DNA, 16 bp, Homo sapiens
gtaaagaaatgtctta

SEQ ID NO: 4104394 - DNA, 14 bp, Homo sapiens
gtaaagactggttt

SEQ ID NO: 4104395 - DNA, 15 bp, Homo sapiens
gtaaagttaaaagaa

SEQ ID NO: 4104396 - DNA, 15 bp, Homo sapiens
gtaaatactgcttga

SEQ ID NO: 4104397 - DNA, 16 bp, Homo sapiens
gtaaatcctgccattt

SEQ ID NO: 4104398 - DNA, 16 bp, Homo sapiens
gtaaatcctttttctt

SEQ ID NO: 4104399 - DNA, 22 bp, Homo sapiens
gtaaatcctttttctttataaa

SEQ ID NO: 4104400 - DNA, 19 bp, Homo sapiens
gtaaatctcttctgtgttt

SEQ ID NO: 4104401 - DNA, 15 bp, Homo sapiens
gtaaatgattttaat

SEQ ID NO: 4104402 - DNA, 16 bp, Homo sapiens
gtaaatgattttaatt

SEQ ID NO: 4104403 - DNA, 21 bp, Homo sapiens
gtaaatgattttaattttata

SEQ ID NO: 4104404 - DNA, 20 bp, Homo sapiens
gtaaatggtgtacataatgt

SEQ ID NO: 4104405 - DNA, 15 bp, Homo sapiens
gtaaatgtctttgta

SEQ ID NO: 4104406 - DNA, 18 bp, Homo sapiens
gtaaatgtctttgtaagt

SEQ ID NO: 4104407 - DNA, 19 bp, Homo sapiens
gtaaattaaacataaaaca

SEQ ID NO: 4104408 - DNA, 16 bp, Homo sapiens
gtaaattatttgctaa

SEQ ID NO: 4104409 - DNA, 14 bp, Homo sapiens
gtaaattgctctgt

SEQ ID NO: 4104410 - DNA, 19 bp, Homo sapiens
gtaaatttagcatatcaat

SEQ ID NO: 4104411 - DNA, 14 bp, Homo sapiens
gtaacaatacaaat

SEQ ID NO: 4104412 - DNA, 17 bp, Homo sapiens
gtaacaatgaagataaa

SEQ ID NO: 4104413 - DNA, 14 bp, Homo sapiens
gtaacacaggccac

SEQ ID NO: 4104414 - DNA, 15 bp, Homo sapiens
gtaacagaacagctt

SEQ ID NO: 4104415 - DNA, 22 bp, Homo sapiens
gtaacagaacagcttcaggtta

SEQ ID NO: 4104416 - DNA, 22 bp, Homo sapiens
gtaacaggaaaattttaaaaat

SEQ ID NO: 4104417 - DNA, 22 bp, Homo sapiens
gtaacaggtattttgtttcttt

SEQ ID NO: 4104418 - DNA, 17 bp, Homo sapiens
gtaacagttcatgtttg

SEQ ID NO: 4104419 - DNA, 15 bp, Homo sapiens
gtaacctcagctctg

SEQ ID NO: 4104420 - DNA, 16 bp, Homo sapiens
gtaaccttatatttac

SEQ ID NO: 4104421 - DNA, 20 bp, Homo sapiens
gtaactaggtttttgcttct

SEQ ID NO: 4104422 - DNA, 14 bp, Homo sapiens
gtaactgctttctg

SEQ ID NO: 4104423 - DNA, 22 bp, Homo sapiens
gtaactgctttctgttccaaat

SEQ ID NO: 4104424 - DNA, 23 bp, Homo sapiens
gtaactgtagtgtagtcaggtgc

SEQ ID NO: 4104425 - DNA, 13 bp, Homo sapiens
gtaactgtcctgt

SEQ ID NO: 4104426 - DNA, 16 bp, Homo sapiens
gtaactgttttttaag

SEQ ID NO: 4104427 - DNA, 20 bp, Homo sapiens
gtaacttcacattaaaaaat

SEQ ID NO: 4104428 - DNA, 12 bp, Homo sapiens
gtaacttcctgc

SEQ ID NO: 4104429 - DNA, 16 bp, Homo sapiens
gtaacttcctgctgca

SEQ ID NO: 4104430 - DNA, 20 bp, Homo sapiens
gtaacttcttatggaattga

SEQ ID NO: 4104431 - DNA, 20 bp, Homo sapiens
gtaacttgcttaaatttctt

SEQ ID NO: 4104432 - DNA, 18 bp, Homo sapiens
gtaagaaaccgaggcgat

SEQ ID NO: 4104433 - DNA, 15 bp, Homo sapiens
gtaagaagacatgaa

SEQ ID NO: 4104434 - DNA, 17 bp, Homo sapiens
gtaagaattcagaagac

SEQ ID NO: 4104435 - DNA, 17 bp, Homo sapiens
gtaagagcaccttcctc

SEQ ID NO: 4104436 - DNA, 15 bp, Homo sapiens
gtaagagtgtagaag

SEQ ID NO: 4104437 - DNA, 15 bp, Homo sapiens
gtaagcggaataaac

SEQ ID NO: 4104438 - DNA, 21 bp, Homo sapiens
gtaagcggctcaagcccagga

SEQ ID NO: 4104439 - DNA, 17 bp, Homo sapiens
gtaagtcagtgttgaga

SEQ ID NO: 4104440 - DNA, 13 bp, Homo sapiens
gtaagtcatctac

SEQ ID NO: 4104441 - DNA, 22 bp, Homo sapiens
gtaagtggggttgcaaccactg

SEQ ID NO: 4104442 - DNA, 18 bp, Homo sapiens
gtaagttaataatgtatt

SEQ ID NO: 4104443 - DNA, 15 bp, Homo sapiens
gtaagttgtacaaat

SEQ ID NO: 4104444 - DNA, 13 bp, Homo sapiens
gtaagtttcaggt

SEQ ID NO: 4104445 - DNA, 16 bp, Homo sapiens
gtaataaactgtgttt

SEQ ID NO: 4104446 - DNA, 14 bp, Homo sapiens
gtaataaagtatat

SEQ ID NO: 4104447 - DNA, 12 bp, Homo sapiens
gtaataaatact

SEQ ID NO: 4104448 - DNA, 14 bp, Homo sapiens
gtaataagacataa

SEQ ID NO: 4104449 - DNA, 16 bp, Homo sapiens
gtaatactggaataat

SEQ ID NO: 4104450 - DNA, 22 bp, Homo sapiens
gtaatactggaataatttgtaa

SEQ ID NO: 4104451 - DNA, 15 bp, Homo sapiens
gtaatagagcaaaat

SEQ ID NO: 4104452 - DNA, 20 bp, Homo sapiens
gtaatattgacttgtatatt

SEQ ID NO: 4104453 - DNA, 13 bp, Homo sapiens
gtaatatttttat

SEQ ID NO: 4104454 - DNA, 20 bp, Homo sapiens
gtaatcaagcctttatggct

SEQ ID NO: 4104455 - DNA, 21 bp, Homo sapiens
gtaatcaatacagacaaggtt

SEQ ID NO: 4104456 - DNA, 18 bp, Homo sapiens
gtaatcaatgaatattga

SEQ ID NO: 4104457 - DNA, 19 bp, Homo sapiens
gtaatcaatgaatattgaa

SEQ ID NO: 4104458 - DNA, 21 bp, Homo sapiens
gtaatcatatgtgtctttata

SEQ ID NO: 4104459 - DNA, 14 bp, Homo sapiens
gtaatcccagcact

SEQ ID NO: 4104460 - DNA, 16 bp, Homo sapiens
gtaatcccagcacttt

SEQ ID NO: 4104461 - DNA, 12 bp, Homo sapiens
gtaatcccagct

SEQ ID NO: 4104462 - DNA, 16 bp, Homo sapiens
gtaatcccagctactt

SEQ ID NO: 4104463 - DNA, 20 bp, Homo sapiens
gtaatcccagctacttggga

SEQ ID NO: 4104464 - DNA, 22 bp, Homo sapiens
gtaatctatgaattctaagtga

SEQ ID NO: 4104465 - DNA, 14 bp, Homo sapiens
gtaatctctctgca

SEQ ID NO: 4104466 - DNA, 18 bp, Homo sapiens
gtaatctctctgcagctg

SEQ ID NO: 4104467 - DNA, 19 bp, Homo sapiens
gtaatctctctgcagctgc

SEQ ID NO: 4104468 - DNA, 21 bp, Homo sapiens
gtaatctctctgcagctgccg

SEQ ID NO: 4104469 - DNA, 22 bp, Homo sapiens
gtaatctgaataaagtgtaaca

SEQ ID NO: 4104470 - DNA, 20 bp, Homo sapiens
gtaatctttacctgtataca

SEQ ID NO: 4104471 - DNA, 21 bp, Homo sapiens
gtaatgaatttttatgatatt

SEQ ID NO: 4104472 - DNA, 17 bp, Homo sapiens
ggtggcccgacagcctg

SEQ ID NO: 4104473 - DNA, 22 bp, Homo sapiens
ggtggcgctagaggccatggag

SEQ ID NO: 4104474 - DNA, 18 bp, Homo sapiens
ggtgggcatgccaccctc

SEQ ID NO: 4104475 - DNA, 14 bp, Homo sapiens
ggtgggcccagaac

SEQ ID NO: 4104476 - DNA, 16 bp, Homo sapiens
ggtgggctggtatctc

SEQ ID NO: 4104477 - DNA, 22 bp, Homo sapiens
ggtgggcttgtcatagccagtg

SEQ ID NO: 4104478 - DNA, 13 bp, Homo sapiens
ggtggggaatgtt

SEQ ID NO: 4104479 - DNA, 14 bp, Homo sapiens
ggtgggggagggag

SEQ ID NO: 4104480 - DNA, 20 bp, Homo sapiens
ggtgggtgaaggcctggctg

SEQ ID NO: 4104481 - DNA, 14 bp, Homo sapiens
ggtgggtgctcaga

SEQ ID NO: 4104482 - DNA, 16 bp, Homo sapiens
ggtgggtgtgggtgga

SEQ ID NO: 4104483 - DNA, 21 bp, Homo sapiens
ggtggtggatctgtccaagga

SEQ ID NO: 4104484 - DNA, 19 bp, Homo sapiens
ggtgtaaagctggccctgc

SEQ ID NO: 4104485 - DNA, 16 bp, Homo sapiens
ggtgtaacttcctgct

SEQ ID NO: 4104486 - DNA, 24 bp, Homo sapiens
ggtgtaacttcctgctgcaccctg

SEQ ID NO: 4104487 - DNA, 18 bp, Homo sapiens
ggtgtaataagacataac

SEQ ID NO: 4104488 - DNA, 16 bp, Homo sapiens
ggtgtacactaacatt

SEQ ID NO: 4104489 - DNA, 12 bp, Homo sapiens
ggtgtagccagg

SEQ ID NO: 4104490 - DNA, 13 bp, Homo sapiens
ggtgtatttaaac

SEQ ID NO: 4104491 - DNA, 20 bp, Homo sapiens
ggtgtcaataaagctgtgct

SEQ ID NO: 4104492 - DNA, 17 bp, Homo sapiens
ggtgtcatttcattcca

SEQ ID NO: 4104493 - DNA, 16 bp, Homo sapiens
ggtgtccatgtgcacc

SEQ ID NO: 4104494 - DNA, 13 bp, Homo sapiens
ggtgtcctgagca

SEQ ID NO: 4104495 - DNA, 19 bp, Homo sapiens
ggtgtcctgcctgtctgcc

SEQ ID NO: 4104496 - DNA, 20 bp, Homo sapiens
ggtgtcctgcctgtctgccc

SEQ ID NO: 4104497 - DNA, 21 bp, Homo sapiens
ggtgtcctgcctgtctgcccc

SEQ ID NO: 4104498 - DNA, 15 bp, Homo sapiens
ggtgtctggcctgag

SEQ ID NO: 4104499 - DNA, 20 bp, Homo sapiens
ggtgtctggcctgaggtcaa

SEQ ID NO: 4104500 - DNA, 16 bp, Homo sapiens
ggtgtgaacatgttct

SEQ ID NO: 4104501 - DNA, 16 bp, Homo sapiens
ggtgtgaacccgggag

SEQ ID NO: 4104502 - DNA, 20 bp, Homo sapiens
ggtgtgaactcaccctggga

SEQ ID NO: 4104503 - DNA, 16 bp, Homo sapiens
ggtgtgaggcaggaga

SEQ ID NO: 4104504 - DNA, 20 bp, Homo sapiens
ggtgtgcaatgtctgagtga

SEQ ID NO: 4104505 - DNA, 12 bp, Homo sapiens
ggtgtggcctca

SEQ ID NO: 4104506 - DNA, 14 bp, Homo sapiens
ggtgtggcctcagc

SEQ ID NO: 4104507 - DNA, 19 bp, Homo sapiens
ggtgtggcctcagccctca

SEQ ID NO: 4104508 - DNA, 12 bp, Homo sapiens
ggtgtggctcct

SEQ ID NO: 4104509 - DNA, 14 bp, Homo sapiens
ggtgtggggggctg

SEQ ID NO: 4104510 - DNA, 19 bp, Homo sapiens
ggtgtgggtggaagggctg

SEQ ID NO: 4104511 - DNA, 15 bp, Homo sapiens
ggtgtgggtgtcctg

SEQ ID NO: 4104512 - DNA, 15 bp, Homo sapiens
ggtgtggtgcagtgt

SEQ ID NO: 4104513 - DNA, 19 bp, Homo sapiens
ggtgttctttcctgccctg

SEQ ID NO: 4104514 - DNA, 22 bp, Homo sapiens
ggtgttgccaaatatgtcctgg

SEQ ID NO: 4104515 - DNA, 19 bp, Homo sapiens
ggtgttttttatgaagtgc

SEQ ID NO: 4104516 - DNA, 22 bp, Homo sapiens
ggttaaacggtgcccatcctgc

SEQ ID NO: 4104517 - DNA, 15 bp, Homo sapiens
ggttaataccagctt

SEQ ID NO: 4104518 - DNA, 16 bp, Homo sapiens
ggttaatttttccttc

SEQ ID NO: 4104519 - DNA, 14 bp, Homo sapiens
ggttacaaactgca

SEQ ID NO: 4104520 - DNA, 23 bp, Homo sapiens
ggttacaatcattgctgaaaatg

SEQ ID NO: 4104521 - DNA, 18 bp, Homo sapiens
ggttacagtgcagacagg

SEQ ID NO: 4104522 - DNA, 22 bp, Homo sapiens
ggttactcagggttcatctgtc

SEQ ID NO: 4104523 - DNA, 17 bp, Homo sapiens
ggttatcgaaataacaa

SEQ ID NO: 4104524 - DNA, 21 bp, Homo sapiens
ggttatgaaagaatatattta

SEQ ID NO: 4104525 - DNA, 19 bp, Homo sapiens
ggttattagcaaggctggg

SEQ ID NO: 4104526 - DNA, 15 bp, Homo sapiens
ggttcactaaagcag

SEQ ID NO: 4104527 - DNA, 14 bp, Homo sapiens
ggttcagcctggcc

SEQ ID NO: 4104528 - DNA, 12 bp, Homo sapiens
ggttcaggcccg

SEQ ID NO: 4104529 - DNA, 13 bp, Homo sapiens
ggttcaggcccgg

SEQ ID NO: 4104530 - DNA, 14 bp, Homo sapiens
ggttcatctgtcca

SEQ ID NO: 4104531 - DNA, 16 bp, Homo sapiens
ggttcattattggaat

SEQ ID NO: 4104532 - DNA, 20 bp, Homo sapiens
ggttccagcaattctcctgc

SEQ ID NO: 4104533 - DNA, 15 bp, Homo sapiens
ggttccatgcctgag

SEQ ID NO: 4104534 - DNA, 13 bp, Homo sapiens
ggttcccaagctc

SEQ ID NO: 4104535 - DNA, 16 bp, Homo sapiens
ggttcccaagctcaga

SEQ ID NO: 4104536 - DNA, 16 bp, Homo sapiens
ggttccctgttcttcc

SEQ ID NO: 4104537 - DNA, 21 bp, Homo sapiens
ggttccgcactttccacttct

SEQ ID NO: 4104538 - DNA, 17 bp, Homo sapiens
ggttcctctgcctgccc

SEQ ID NO: 4104539 - DNA, 18 bp, Homo sapiens
ggttcctctgcctgcccc

SEQ ID NO: 4104540 - DNA, 20 bp, Homo sapiens
ggttccttcctatgcccagg

SEQ ID NO: 4104541 - DNA, 13 bp, Homo sapiens
ggttccttctctg

SEQ ID NO: 4104542 - DNA, 17 bp, Homo sapiens
ggttcgatacctggagc

SEQ ID NO: 4104543 - DNA, 21 bp, Homo sapiens
ggttctaggcatctctgtact

SEQ ID NO: 4104544 - DNA, 23 bp, Homo sapiens
ggttctagtctcctttgcactga

SEQ ID NO: 4104545 - DNA, 12 bp, Homo sapiens
ggttctatttta

SEQ ID NO: 4104546 - DNA, 17 bp, Homo sapiens
ggttctctccaggaagg

SEQ ID NO: 4104547 - DNA, 13 bp, Homo sapiens
ggttctgcctgct

SEQ ID NO: 4104548 - DNA, 19 bp, Homo sapiens
ggttctgcttcaaggcttc

SEQ ID NO: 4104549 - DNA, 23 bp, Homo sapiens
ggttcttattttgcattccagaa

SEQ ID NO: 4104550 - DNA, 13 bp, Homo sapiens
ggttcttcatgat

SEQ ID NO: 4104551 - DNA, 21 bp, Homo sapiens
ggttcttgcaaatgggagctg

SEQ ID NO: 4104552 - DNA, 17 bp, Homo sapiens
ggttctttggaaggagt

SEQ ID NO: 4104553 - DNA, 13 bp, Homo sapiens
ggttctttgtgta

SEQ ID NO: 4104554 - DNA, 20 bp, Homo sapiens
ggttgaaaatgtgtttgctg

SEQ ID NO: 4104555 - DNA, 16 bp, Homo sapiens
ggttgaactctggtgg

SEQ ID NO: 4104556 - DNA, 22 bp, Homo sapiens
ggttgaactctggtggcacagg

SEQ ID NO: 4104557 - DNA, 11 bp, Homo sapiens
ggttggagccc

SEQ ID NO: 4104558 - DNA, 17 bp, Homo sapiens
ggttggagcccagggca

SEQ ID NO: 4104559 - DNA, 14 bp, Homo sapiens
ggttggcagcccac

SEQ ID NO: 4104560 - DNA, 17 bp, Homo sapiens
ggttggcagcccactgc

SEQ ID NO: 4104561 - DNA, 23 bp, Homo sapiens
ggttggccgtggtccagctcttg

SEQ ID NO: 4104562 - DNA, 13 bp, Homo sapiens
ggttggctcccgc

SEQ ID NO: 4104563 - DNA, 15 bp, Homo sapiens
ggttggggtgacagt

SEQ ID NO: 4104564 - DNA, 16 bp, Homo sapiens
ggttggtagggtggga

SEQ ID NO: 4104565 - DNA, 14 bp, Homo sapiens
ggttgtgaggcctg

SEQ ID NO: 4104566 - DNA, 16 bp, Homo sapiens
ggttgtgaggcctggc

SEQ ID NO: 4104567 - DNA, 15 bp, Homo sapiens
ggttgtgttgaggtt

SEQ ID NO: 4104568 - DNA, 20 bp, Homo sapiens
ggttgttttttcctttgctc

SEQ ID NO: 4104569 - DNA, 12 bp, Homo sapiens
ggtttacattta

SEQ ID NO: 4104570 - DNA, 20 bp, Homo sapiens
ggtttagtcatccaacaaga

SEQ ID NO: 4104571 - DNA, 14 bp, Homo sapiens
ggtttatgactctt

SEQ ID NO: 4104572 - DNA, 14 bp, Homo sapiens
ggtttatttgttgt

SEQ ID NO: 4104573 - DNA, 18 bp, Homo sapiens
ggtttatttgttgttttc

SEQ ID NO: 4104574 - DNA, 21 bp, Homo sapiens
ggtttcaattcagattgtctt

SEQ ID NO: 4104575 - DNA, 15 bp, Homo sapiens
ggtttcacctgggcc

SEQ ID NO: 4104576 - DNA, 23 bp, Homo sapiens
ggtctcatgtcctgctggcttcc

SEQ ID NO: 4104577 - DNA, 15 bp, Homo sapiens
ggtctccccaattct

SEQ ID NO: 4104578 - DNA, 11 bp, Homo sapiens
ggtctccctgg

SEQ ID NO: 4104579 - DNA, 12 bp, Homo sapiens
ggtctccctggc

SEQ ID NO: 4104580 - DNA, 13 bp, Homo sapiens
ggtctccctggct

SEQ ID NO: 4104581 - DNA, 22 bp, Homo sapiens
ggtctcgctgtcactggctggc

SEQ ID NO: 4104582 - DNA, 23 bp, Homo sapiens
ggtctcgctgtcactggctggct

SEQ ID NO: 4104583 - DNA, 12 bp, Homo sapiens
ggtctgaaatgg

SEQ ID NO: 4104584 - DNA, 11 bp, Homo sapiens
ggtctgaatgt

SEQ ID NO: 4104585 - DNA, 12 bp, Homo sapiens
ggtctgaatgtt

SEQ ID NO: 4104586 - DNA, 18 bp, Homo sapiens
ggtctgctctttctctgc

SEQ ID NO: 4104587 - DNA, 19 bp, Homo sapiens
ggtctgctctttctctgcc

SEQ ID NO: 4104588 - DNA, 15 bp, Homo sapiens
ggtctggctgagctg

SEQ ID NO: 4104589 - DNA, 16 bp, Homo sapiens
ggtctgggatatggct

SEQ ID NO: 4104590 - DNA, 20 bp, Homo sapiens
ggtctgggatatggctgccc

SEQ ID NO: 4104591 - DNA, 14 bp, Homo sapiens
ggtctgtagggatt

SEQ ID NO: 4104592 - DNA, 18 bp, Homo sapiens
ggtctgtgtctcttttct

SEQ ID NO: 4104593 - DNA, 15 bp, Homo sapiens
ggtctgtgtgaatgt

SEQ ID NO: 4104594 - DNA, 16 bp, Homo sapiens
ggtctgtgtgaatgtg

SEQ ID NO: 4104595 - DNA, 24 bp, Homo sapiens
ggtctgtgtgaatgtgggcactgg

SEQ ID NO: 4104596 - DNA, 21 bp, Homo sapiens
ggtcttcctactcttctctct

SEQ ID NO: 4104597 - DNA, 21 bp, Homo sapiens
ggtcttgggggtcagggggga

SEQ ID NO: 4104598 - DNA, 19 bp, Homo sapiens
ggtctttcctatcatggag

SEQ ID NO: 4104599 - DNA, 14 bp, Homo sapiens
ggtctttgtaagag

SEQ ID NO: 4104600 - DNA, 19 bp, Homo sapiens
ggtctttgtaagagtgtag

SEQ ID NO: 4104601 - DNA, 20 bp, Homo sapiens
ggtctttgtaagagtgtaga

SEQ ID NO: 4104602 - DNA, 14 bp, Homo sapiens
ggtctttgtatctt

SEQ ID NO: 4104603 - DNA, 17 bp, Homo sapiens
ggtctttttatgcattt

SEQ ID NO: 4104604 - DNA, 24 bp, Homo sapiens
ggtcttttttcatttcttcctcag

SEQ ID NO: 4104605 - DNA, 17 bp, Homo sapiens
ggtgaaccacttcattc

SEQ ID NO: 4104606 - DNA, 16 bp, Homo sapiens
ggtgaagaaaactcct

SEQ ID NO: 4104607 - DNA, 20 bp, Homo sapiens
ggtgaagaaccctctgtccc

SEQ ID NO: 4104608 - DNA, 18 bp, Homo sapiens
ggtgaagctatttatctg

SEQ ID NO: 4104609 - DNA, 18 bp, Homo sapiens
ggtgaaggaggctccagg

SEQ ID NO: 4104610 - DNA, 23 bp, Homo sapiens
ggtgaaggcctggctggaagagg

SEQ ID NO: 4104611 - DNA, 18 bp, Homo sapiens
ggtgaagggagagccagc

SEQ ID NO: 4104612 - DNA, 18 bp, Homo sapiens
ggtgacagtgccttctct

SEQ ID NO: 4104613 - DNA, 21 bp, Homo sapiens
ggtgacctctagccctgcccg

SEQ ID NO: 4104614 - DNA, 23 bp, Homo sapiens
ggtgactttgtctctcctggctg

SEQ ID NO: 4104615 - DNA, 14 bp, Homo sapiens
ggtgagacagttgc

SEQ ID NO: 4104616 - DNA, 19 bp, Homo sapiens
ggtgagcagaagtggagct

SEQ ID NO: 4104617 - DNA, 12 bp, Homo sapiens
ggtgagccagtg

SEQ ID NO: 4104618 - DNA, 16 bp, Homo sapiens
ggtgagctgcacctga

SEQ ID NO: 4104619 - DNA, 13 bp, Homo sapiens
ggtgagggatgtg

SEQ ID NO: 4104620 - DNA, 23 bp, Homo sapiens
ggtgaggtctgttccttttatat

SEQ ID NO: 4104621 - DNA, 16 bp, Homo sapiens
ggtgagtaaggcatgt

SEQ ID NO: 4104622 - DNA, 15 bp, Homo sapiens
ggtgagtcctccaga

SEQ ID NO: 4104623 - DNA, 14 bp, Homo sapiens
ggtgatcctctatt

SEQ ID NO: 4104624 - DNA, 23 bp, Homo sapiens
ggtgatgcattaattaatggctt

SEQ ID NO: 4104625 - DNA, 16 bp, Homo sapiens
ggtgatggccagcccc

SEQ ID NO: 4104626 - DNA, 12 bp, Homo sapiens
ggtgcaaatcct

SEQ ID NO: 4104627 - DNA, 16 bp, Homo sapiens
ggtgcaggtgggcact

SEQ ID NO: 4104628 - DNA, 15 bp, Homo sapiens
ggtgcatctcctccc

SEQ ID NO: 4104629 - DNA, 19 bp, Homo sapiens
ggtgcatgcatgccctctc

SEQ ID NO: 4104630 - DNA, 19 bp, Homo sapiens
ggtgcattacagagaggag

SEQ ID NO: 4104631 - DNA, 21 bp, Homo sapiens
ggtgcatttgagagaagccac

SEQ ID NO: 4104632 - DNA, 20 bp, Homo sapiens
ggtgccaaaaccaggcctct

SEQ ID NO: 4104633 - DNA, 23 bp, Homo sapiens
ggtgccaaacaaaaaggttctca

SEQ ID NO: 4104634 - DNA, 17 bp, Homo sapiens
ggtgccagcctgaggca

SEQ ID NO: 4104635 - DNA, 15 bp, Homo sapiens
ggtgccagggtgggt

SEQ ID NO: 4104636 - DNA, 21 bp, Homo sapiens
ggtgcccacaccggggacagg

SEQ ID NO: 4104637 - DNA, 15 bp, Homo sapiens
ggtgcccatcctgcc

SEQ ID NO: 4104638 - DNA, 16 bp, Homo sapiens
ggtgcccatcctgcca

SEQ ID NO: 4104639 - DNA, 21 bp, Homo sapiens
ggtgccccaggaccagctcag

SEQ ID NO: 4104640 - DNA, 23 bp, Homo sapiens
ggtgccccaggaccagctcagga

SEQ ID NO: 4104641 - DNA, 15 bp, Homo sapiens
ggtgcctgagaggca

SEQ ID NO: 4104642 - DNA, 17 bp, Homo sapiens
ggtgcctgagaggcagg

SEQ ID NO: 4104643 - DNA, 17 bp, Homo sapiens
ggtgcctgtcccacccc

SEQ ID NO: 4104644 - DNA, 22 bp, Homo sapiens
ggtgcgcgccaccgtgcctggc

SEQ ID NO: 4104645 - DNA, 13 bp, Homo sapiens
ggtgcgtttttac

SEQ ID NO: 4104646 - DNA, 16 bp, Homo sapiens
ggtgcgtttttacagt

SEQ ID NO: 4104647 - DNA, 21 bp, Homo sapiens
ggtgctaaatggtcgcccagg

SEQ ID NO: 4104648 - DNA, 22 bp, Homo sapiens
ggtgctaaatggtcgcccagga

SEQ ID NO: 4104649 - DNA, 23 bp, Homo sapiens
ggtgctaaatggtcgcccaggag

SEQ ID NO: 4104650 - DNA, 19 bp, Homo sapiens
ggtgctataggctggagaa

SEQ ID NO: 4104651 - DNA, 14 bp, Homo sapiens
ggtgctcctgcatc

SEQ ID NO: 4104652 - DNA, 16 bp, Homo sapiens
ggtgctgacggccagg

SEQ ID NO: 4104653 - DNA, 12 bp, Homo sapiens
ggtgctgatgag

SEQ ID NO: 4104654 - DNA, 16 bp, Homo sapiens
ggtgctgcctgaatcc

SEQ ID NO: 4104655 - DNA, 11 bp, Homo sapiens
ggtgctgtcca

SEQ ID NO: 4104656 - DNA, 15 bp, Homo sapiens
ggtgcttctggaaac

SEQ ID NO: 4104657 - DNA, 21 bp, Homo sapiens
ggtgcttgttccctctccctg

SEQ ID NO: 4104658 - DNA, 21 bp, Homo sapiens
ggtggaaagcgattcactgta

SEQ ID NO: 4104659 - DNA, 15 bp, Homo sapiens
ggtggaaggatggga

SEQ ID NO: 4104660 - DNA, 16 bp, Homo sapiens
ggtggaagggctgggt

SEQ ID NO: 4104661 - DNA, 17 bp, Homo sapiens
ggtggaagggctgggtg

SEQ ID NO: 4104662 - DNA, 22 bp, Homo sapiens
ggtggaccttttaaagtgtttc

SEQ ID NO: 4104663 - DNA, 14 bp, Homo sapiens
ggtggagggcacag

SEQ ID NO: 4104664 - DNA, 15 bp, Homo sapiens
ggtggagggcacagc

SEQ ID NO: 4104665 - DNA, 20 bp, Homo sapiens
ggtggagggtggggggcgct

SEQ ID NO: 4104666 - DNA, 14 bp, Homo sapiens
ggtggcacacgcct

SEQ ID NO: 4104667 - DNA, 12 bp, Homo sapiens
ggtggcaccaga

SEQ ID NO: 4104668 - DNA, 20 bp, Homo sapiens
ggtggcaggcacacagcagc

SEQ ID NO: 4104669 - DNA, 15 bp, Homo sapiens
ggtggcagtggaggt

SEQ ID NO: 4104670 - DNA, 18 bp, Homo sapiens
ggtggcagtggaggtggg

SEQ ID NO: 4104671 - DNA, 15 bp, Homo sapiens
ggtggcatacgcctg

SEQ ID NO: 4104672 - DNA, 20 bp, Homo sapiens
ggtggccactccagacccct

SEQ ID NO: 4104673 - DNA, 21 bp, Homo sapiens
ggtggccactccagacccctg

SEQ ID NO: 4104674 - DNA, 22 bp, Homo sapiens
ggtggccactccagacccctgg

SEQ ID NO: 4104675 - DNA, 18 bp, Homo sapiens
ggtggccatccctgggcc

SEQ ID NO: 4104676 - DNA, 19 bp, Homo sapiens
ggtggccatccctgggccc

SEQ ID NO: 4104677 - DNA, 22 bp, Homo sapiens
ggtggccatccctgggcccctc

SEQ ID NO: 4104678 - DNA, 23 bp, Homo sapiens
ggtggccatccctgggcccctcc

SEQ ID NO: 4104679 - DNA, 17 bp, Homo sapiens
ggtaaccttatatttac

SEQ ID NO: 4104680 - DNA, 13 bp, Homo sapiens
ggtaactgtcctg

SEQ ID NO: 4104681 - DNA, 21 bp, Homo sapiens
ggtaagaaaaagcaaaaggca

SEQ ID NO: 4104682 - DNA, 20 bp, Homo sapiens
ggtaatcaatgaatattgaa

SEQ ID NO: 4104683 - DNA, 19 bp, Homo sapiens
ggtaatgttttgtatatac

SEQ ID NO: 4104684 - DNA, 12 bp, Homo sapiens
ggtaccagctgc

SEQ ID NO: 4104685 - DNA, 14 bp, Homo sapiens
ggtaccagctgcgc

SEQ ID NO: 4104686 - DNA, 15 bp, Homo sapiens
ggtaccagctgcgct

SEQ ID NO: 4104687 - DNA, 14 bp, Homo sapiens
ggtaccctcctggc

SEQ ID NO: 4104688 - DNA, 16 bp, Homo sapiens
ggtacctcaagcccca

SEQ ID NO: 4104689 - DNA, 17 bp, Homo sapiens
ggtacctcaagccccat

SEQ ID NO: 4104690 - DNA, 14 bp, Homo sapiens
ggtactatatttgc

SEQ ID NO: 4104691 - DNA, 15 bp, Homo sapiens
ggtactcttgttgag

SEQ ID NO: 4104692 - DNA, 23 bp, Homo sapiens
ggtagaacgccagggaccccaga

SEQ ID NO: 4104693 - DNA, 16 bp, Homo sapiens
ggtagaatgattaatc

SEQ ID NO: 4104694 - DNA, 19 bp, Homo sapiens
ggtagaccaggatttctaa

SEQ ID NO: 4104695 - DNA, 17 bp, Homo sapiens
ggtagagccacaaaaga

SEQ ID NO: 4104696 - DNA, 19 bp, Homo sapiens
ggtaggaggtttggatggg

SEQ ID NO: 4104697 - DNA, 17 bp, Homo sapiens
ggtagggaggcagcctc

SEQ ID NO: 4104698 - DNA, 14 bp, Homo sapiens
ggtagggctctgac

SEQ ID NO: 4104699 - DNA, 19 bp, Homo sapiens
ggtaggggtagggagcctc

SEQ ID NO: 4104700 - DNA, 19 bp, Homo sapiens
ggtaggttgggacaccagg

SEQ ID NO: 4104701 - DNA, 23 bp, Homo sapiens
ggtagtactcctgcaaaatttta

SEQ ID NO: 4104702 - DNA, 14 bp, Homo sapiens
ggtataatgtttaa

SEQ ID NO: 4104703 - DNA, 19 bp, Homo sapiens
ggtatatccttttctgtgt

SEQ ID NO: 4104704 - DNA, 19 bp, Homo sapiens
ggtatcattcaactctcca

SEQ ID NO: 4104705 - DNA, 17 bp, Homo sapiens
ggtatcctgcccagtgt

SEQ ID NO: 4104706 - DNA, 19 bp, Homo sapiens
ggtatctcagaaagtgcct

SEQ ID NO: 4104707 - DNA, 12 bp, Homo sapiens
ggtatctccagg

SEQ ID NO: 4104708 - DNA, 15 bp, Homo sapiens
ggtatgagctgaggg

SEQ ID NO: 4104709 - DNA, 14 bp, Homo sapiens
ggtatgcaatcaaa

SEQ ID NO: 4104710 - DNA, 16 bp, Homo sapiens
ggtatgctggccagca

SEQ ID NO: 4104711 - DNA, 21 bp, Homo sapiens
ggtatgctggccagcaccctc

SEQ ID NO: 4104712 - DNA, 15 bp, Homo sapiens
ggtatggaactctct

SEQ ID NO: 4104713 - DNA, 16 bp, Homo sapiens
ggtatgtagccagctg

SEQ ID NO: 4104714 - DNA, 13 bp, Homo sapiens
ggtatgtctgcca

SEQ ID NO: 4104715 - DNA, 22 bp, Homo sapiens
ggtattaatatatagtccagac

SEQ ID NO: 4104716 - DNA, 18 bp, Homo sapiens
ggtattccttttgtgtac

SEQ ID NO: 4104717 - DNA, 19 bp, Homo sapiens
ggtatttttcagagattta

SEQ ID NO: 4104718 - DNA, 19 bp, Homo sapiens
ggtcaacatggtgaaaccc

SEQ ID NO: 4104719 - DNA, 14 bp, Homo sapiens
ggtcaagaaacagc

SEQ ID NO: 4104720 - DNA, 19 bp, Homo sapiens
ggtcaagaaacagccagca

SEQ ID NO: 4104721 - DNA, 23 bp, Homo sapiens
ggtcaaggcagtagaactccagg

SEQ ID NO: 4104722 - DNA, 22 bp, Homo sapiens
ggtcacaaatcctaaaagaagc

SEQ ID NO: 4104723 - DNA, 13 bp, Homo sapiens
ggtcacagccagg

SEQ ID NO: 4104724 - DNA, 14 bp, Homo sapiens
ggtcacagccaggc

SEQ ID NO: 4104725 - DNA, 16 bp, Homo sapiens
ggtcacagcctcctct

SEQ ID NO: 4104726 - DNA, 17 bp, Homo sapiens
ggtcacattcaggaaga

SEQ ID NO: 4104727 - DNA, 16 bp, Homo sapiens
ggtcaccaagcagtgg

SEQ ID NO: 4104728 - DNA, 16 bp, Homo sapiens
ggtcactgtgcactgc

SEQ ID NO: 4104729 - DNA, 17 bp, Homo sapiens
ggtcagaagagagggtg

SEQ ID NO: 4104730 - DNA, 12 bp, Homo sapiens
ggtcagatggag

SEQ ID NO: 4104731 - DNA, 13 bp, Homo sapiens
ggtcagccagggc

SEQ ID NO: 4104732 - DNA, 15 bp, Homo sapiens
ggtcagccagggcca

SEQ ID NO: 4104733 - DNA, 19 bp, Homo sapiens
ggtcaggaacagtggctgg

SEQ ID NO: 4104734 - DNA, 20 bp, Homo sapiens
ggtcaggaacagtggctggg

SEQ ID NO: 4104735 - DNA, 19 bp, Homo sapiens
ggtcaggaagcaggggtgg

SEQ ID NO: 4104736 - DNA, 21 bp, Homo sapiens
ggtcaggagttcctaaccagc

SEQ ID NO: 4104737 - DNA, 21 bp, Homo sapiens
ggtcaggcggggtgctgtggt

SEQ ID NO: 4104738 - DNA, 13 bp, Homo sapiens
ggtcaggctccat

SEQ ID NO: 4104739 - DNA, 21 bp, Homo sapiens
ggtcaggctgggcagccccag

SEQ ID NO: 4104740 - DNA, 23 bp, Homo sapiens
ggtcaggctgggcagccccagag

SEQ ID NO: 4104741 - DNA, 20 bp, Homo sapiens
ggtcagggagtgctggctca

SEQ ID NO: 4104742 - DNA, 19 bp, Homo sapiens
ggtcaggttgacaggaggt

SEQ ID NO: 4104743 - DNA, 14 bp, Homo sapiens
ggtcatcctgcccc

SEQ ID NO: 4104744 - DNA, 18 bp, Homo sapiens
ggtcatgatgctctttcc

SEQ ID NO: 4104745 - DNA, 17 bp, Homo sapiens
ggtcattgacctctcag

SEQ ID NO: 4104746 - DNA, 22 bp, Homo sapiens
ggtcattgacctctcagggcct

SEQ ID NO: 4104747 - DNA, 21 bp, Homo sapiens
ggtccaaaaaaaggaaaaata

SEQ ID NO: 4104748 - DNA, 13 bp, Homo sapiens
ggtccaaatgttt

SEQ ID NO: 4104749 - DNA, 22 bp, Homo sapiens
ggtccagcctcgttggaagagg

SEQ ID NO: 4104750 - DNA, 14 bp, Homo sapiens
ggtccagctcttgg

SEQ ID NO: 4104751 - DNA, 20 bp, Homo sapiens
ggtccagctcttggcccctg

SEQ ID NO: 4104752 - DNA, 23 bp, Homo sapiens
ggtccagctcttggcccctgtgt

SEQ ID NO: 4104753 - DNA, 21 bp, Homo sapiens
ggtccagggcctgacaccccc

SEQ ID NO: 4104754 - DNA, 12 bp, Homo sapiens
ggtccagggcta

SEQ ID NO: 4104755 - DNA, 13 bp, Homo sapiens
ggtccagggttga

SEQ ID NO: 4104756 - DNA, 18 bp, Homo sapiens
ggtccagtggatgccaca

SEQ ID NO: 4104757 - DNA, 14 bp, Homo sapiens
ggtccatttgttcc

SEQ ID NO: 4104758 - DNA, 22 bp, Homo sapiens
ggtcccacgaatttgctgggga

SEQ ID NO: 4104759 - DNA, 15 bp, Homo sapiens
ggtcccagccacccc

SEQ ID NO: 4104760 - DNA, 14 bp, Homo sapiens
ggtcccaggcagag

SEQ ID NO: 4104761 - DNA, 21 bp, Homo sapiens
ggtccccactcaccccctttg

SEQ ID NO: 4104762 - DNA, 22 bp, Homo sapiens
ggtccccagcccttcctctgct

SEQ ID NO: 4104763 - DNA, 13 bp, Homo sapiens
ggtccccatcccc

SEQ ID NO: 4104764 - DNA, 13 bp, Homo sapiens
ggtccccctcagc

SEQ ID NO: 4104765 - DNA, 20 bp, Homo sapiens
ggtccccctcagcaagccct

SEQ ID NO: 4104766 - DNA, 19 bp, Homo sapiens
ggtcccctccacatcccag

SEQ ID NO: 4104767 - DNA, 22 bp, Homo sapiens
ggtcccggttcagacccctgcc

SEQ ID NO: 4104768 - DNA, 21 bp, Homo sapiens
ggtccctccaccccacagaac

SEQ ID NO: 4104769 - DNA, 23 bp, Homo sapiens
ggtcccttgcagctagttttcta

SEQ ID NO: 4104770 - DNA, 18 bp, Homo sapiens
ggtccggacactcctaga

SEQ ID NO: 4104771 - DNA, 21 bp, Homo sapiens
ggtcctctcagttctctccct

SEQ ID NO: 4104772 - DNA, 23 bp, Homo sapiens
ggtcctctgtcagtcacagccac

SEQ ID NO: 4104773 - DNA, 22 bp, Homo sapiens
ggtcctcttctgggcctgacca

SEQ ID NO: 4104774 - DNA, 17 bp, Homo sapiens
ggtcctgagggtcccca

SEQ ID NO: 4104775 - DNA, 12 bp, Homo sapiens
ggtcctgggctg

SEQ ID NO: 4104776 - DNA, 16 bp, Homo sapiens
ggtcctgggctggggc

SEQ ID NO: 4104777 - DNA, 17 bp, Homo sapiens
ggtcctgggctggggcc

SEQ ID NO: 4104778 - DNA, 10 bp, Homo sapiens
ggtccttcaa

SEQ ID NO: 4104779 - DNA, 16 bp, Homo sapiens
ggtcgaggagtaacaa

SEQ ID NO: 4104780 - DNA, 22 bp, Homo sapiens
ggtcgcttactttgagtgatcc

SEQ ID NO: 4104781 - DNA, 14 bp, Homo sapiens
ggtcgggcagccag

SEQ ID NO: 4104782 - DNA, 20 bp, Homo sapiens
gggggccgggcaggtcctgc

SEQ ID NO: 4104783 - DNA, 22 bp, Homo sapiens
gggggctatagctacaggaagc

SEQ ID NO: 4104784 - DNA, 13 bp, Homo sapiens
gggggctggccat

SEQ ID NO: 4104785 - DNA, 12 bp, Homo sapiens
gggggctttctg

SEQ ID NO: 4104786 - DNA, 13 bp, Homo sapiens
ggggggcagagcc

SEQ ID NO: 4104787 - DNA, 10 bp, Homo sapiens
gggggtggca

SEQ ID NO: 4104788 - DNA, 19 bp, Homo sapiens
gggggttgcagtggagagg

SEQ ID NO: 4104789 - DNA, 20 bp, Homo sapiens
ggggtcaggaacagtggctg

SEQ ID NO: 4104790 - DNA, 22 bp, Homo sapiens
ggggtcaggccgggcagagcac

SEQ ID NO: 4104791 - DNA, 18 bp, Homo sapiens
ggggtccctccaccccac

SEQ ID NO: 4104792 - DNA, 19 bp, Homo sapiens
ggggtcctggagcagacca

SEQ ID NO: 4104793 - DNA, 19 bp, Homo sapiens
ggggtctcatgtcctgctg

SEQ ID NO: 4104794 - DNA, 15 bp, Homo sapiens
ggggtgaggagctgg

SEQ ID NO: 4104795 - DNA, 17 bp, Homo sapiens
ggggtgatttcagagag

SEQ ID NO: 4104796 - DNA, 17 bp, Homo sapiens
ggggtgcatctcctccc

SEQ ID NO: 4104797 - DNA, 20 bp, Homo sapiens
ggggtgcttttatagaggct

SEQ ID NO: 4104798 - DNA, 17 bp, Homo sapiens
ggggtggggagacctgg

SEQ ID NO: 4104799 - DNA, 19 bp, Homo sapiens
ggggtgtggctccttccca

SEQ ID NO: 4104800 - DNA, 15 bp, Homo sapiens
ggggttatctctgtg

SEQ ID NO: 4104801 - DNA, 13 bp, Homo sapiens
ggggttccctcct

SEQ ID NO: 4104802 - DNA, 21 bp, Homo sapiens
ggggttccctcctagctctcc

SEQ ID NO: 4104803 - DNA, 21 bp, Homo sapiens
ggggttcgagaccagtctggc

SEQ ID NO: 4104804 - DNA, 15 bp, Homo sapiens
gggtaaaatactttt

SEQ ID NO: 4104805 - DNA, 21 bp, Homo sapiens
gggtaaaatacttttactctg

SEQ ID NO: 4104806 - DNA, 18 bp, Homo sapiens
gggtaatgtgaaggccca

SEQ ID NO: 4104807 - DNA, 20 bp, Homo sapiens
gggtactcttgatgtgaaga

SEQ ID NO: 4104808 - DNA, 20 bp, Homo sapiens
gggtagaatgattaatcaaa

SEQ ID NO: 4104809 - DNA, 15 bp, Homo sapiens
gggtagggtaaatca

SEQ ID NO: 4104810 - DNA, 17 bp, Homo sapiens
gggtcagccagggccag

SEQ ID NO: 4104811 - DNA, 21 bp, Homo sapiens
gggtcaggccgggcagagcac

SEQ ID NO: 4104812 - DNA, 15 bp, Homo sapiens
gggtcattgacctct

SEQ ID NO: 4104813 - DNA, 19 bp, Homo sapiens
gggtcattgacctctcagg

SEQ ID NO: 4104814 - DNA, 24 bp, Homo sapiens
gggtcattgacctctcagggcctg

SEQ ID NO: 4104815 - DNA, 20 bp, Homo sapiens
gggtccacccagcaaagagt

SEQ ID NO: 4104816 - DNA, 19 bp, Homo sapiens
gggtccagtggatgccaca

SEQ ID NO: 4104817 - DNA, 15 bp, Homo sapiens
gggtcctagcccttc

SEQ ID NO: 4104818 - DNA, 20 bp, Homo sapiens
gggtcctagcccttccctga

SEQ ID NO: 4104819 - DNA, 13 bp, Homo sapiens
gggtcctggctcc

SEQ ID NO: 4104820 - DNA, 22 bp, Homo sapiens
gggtcgtttgcttttcagggtt

SEQ ID NO: 4104821 - DNA, 18 bp, Homo sapiens
gggtctccctggctccct

SEQ ID NO: 4104822 - DNA, 22 bp, Homo sapiens
gggtctccctggctccctcctc

SEQ ID NO: 4104823 - DNA, 22 bp, Homo sapiens
gggtctcgctgtcactggctgg

SEQ ID NO: 4104824 - DNA, 21 bp, Homo sapiens
gggtctcttttgtaaattaaa

SEQ ID NO: 4104825 - DNA, 14 bp, Homo sapiens
gggtctgattttct

SEQ ID NO: 4104826 - DNA, 23 bp, Homo sapiens
gggtctgggcggcgggcggctgg

SEQ ID NO: 4104827 - DNA, 15 bp, Homo sapiens
gggtctgtgtctctt

SEQ ID NO: 4104828 - DNA, 18 bp, Homo sapiens
gggtcttgctctgtcccc

SEQ ID NO: 4104829 - DNA, 22 bp, Homo sapiens
gggtcttttttcatttcttcct

SEQ ID NO: 4104830 - DNA, 15 bp, Homo sapiens
gggtgaaaggcaggg

SEQ ID NO: 4104831 - DNA, 21 bp, Homo sapiens
gggtgaaggcctggctggaag

SEQ ID NO: 4104832 - DNA, 13 bp, Homo sapiens
gggtgaagggaga

SEQ ID NO: 4104833 - DNA, 18 bp, Homo sapiens
gggtgacagtgccttctc

SEQ ID NO: 4104834 - DNA, 13 bp, Homo sapiens
gggtgacggccct

SEQ ID NO: 4104835 - DNA, 17 bp, Homo sapiens
gggtgagggtcccatgt

SEQ ID NO: 4104836 - DNA, 23 bp, Homo sapiens
gggtgattttatgatcagtgttg

SEQ ID NO: 4104837 - DNA, 18 bp, Homo sapiens
gggtgcaggtgggcactg

SEQ ID NO: 4104838 - DNA, 23 bp, Homo sapiens
gggtgcaggtgggcactggagca

SEQ ID NO: 4104839 - DNA, 12 bp, Homo sapiens
gggtgctcagaa

SEQ ID NO: 4104840 - DNA, 18 bp, Homo sapiens
gggtgctcagaataaggc

SEQ ID NO: 4104841 - DNA, 21 bp, Homo sapiens
gggtgctcagaataaggcagg

SEQ ID NO: 4104842 - DNA, 13 bp, Homo sapiens
gggtgctgccctg

SEQ ID NO: 4104843 - DNA, 19 bp, Homo sapiens
gggtgctggctgcccagac

SEQ ID NO: 4104844 - DNA, 15 bp, Homo sapiens
gggtgctgggaggag

SEQ ID NO: 4104845 - DNA, 14 bp, Homo sapiens
gggtggaggggtgt

SEQ ID NO: 4104846 - DNA, 22 bp, Homo sapiens
gggtggcaggcacacagcagcc

SEQ ID NO: 4104847 - DNA, 20 bp, Homo sapiens
gggtggcatcattccaggcc

SEQ ID NO: 4104848 - DNA, 13 bp, Homo sapiens
gggtggggagatg

SEQ ID NO: 4104849 - DNA, 20 bp, Homo sapiens
gggtggggggtgcaggtggg

SEQ ID NO: 4104850 - DNA, 12 bp, Homo sapiens
gggtggggtgga

SEQ ID NO: 4104851 - DNA, 14 bp, Homo sapiens
gggtgggtgctcag

SEQ ID NO: 4104852 - DNA, 15 bp, Homo sapiens
gggtgggtgctcaga

SEQ ID NO: 4104853 - DNA, 16 bp, Homo sapiens
gggtgtaacttcctgc

SEQ ID NO: 4104854 - DNA, 24 bp, Homo sapiens
gggtgtcaaacattcgtgagctgg

SEQ ID NO: 4104855 - DNA, 18 bp, Homo sapiens
gggtgtcatttcattcca

SEQ ID NO: 4104856 - DNA, 11 bp, Homo sapiens
gggtgtgggtt

SEQ ID NO: 4104857 - DNA, 19 bp, Homo sapiens
gggtgttctttcctgccct

SEQ ID NO: 4104858 - DNA, 21 bp, Homo sapiens
gggtgttctttcctgccctgt

SEQ ID NO: 4104859 - DNA, 18 bp, Homo sapiens
gggtgttgtatggggagg

SEQ ID NO: 4104860 - DNA, 16 bp, Homo sapiens
gggttcaaaatgtctg

SEQ ID NO: 4104861 - DNA, 14 bp, Homo sapiens
gggttcagcctggc

SEQ ID NO: 4104862 - DNA, 15 bp, Homo sapiens
gggttcagcctggcc

SEQ ID NO: 4104863 - DNA, 18 bp, Homo sapiens
gggttcagcctggcctgc

SEQ ID NO: 4104864 - DNA, 17 bp, Homo sapiens
gggttcattattggaat

SEQ ID NO: 4104865 - DNA, 21 bp, Homo sapiens
gggttccctttccttccatcc

SEQ ID NO: 4104866 - DNA, 21 bp, Homo sapiens
gggttcgcaccattctcctgc

SEQ ID NO: 4104867 - DNA, 20 bp, Homo sapiens
gggttgcgtcctgacggcgc

SEQ ID NO: 4104868 - DNA, 14 bp, Homo sapiens
gggttggcagccca

SEQ ID NO: 4104869 - DNA, 21 bp, Homo sapiens
gggttgggttcatctgagcaa

SEQ ID NO: 4104870 - DNA, 15 bp, Homo sapiens
gggttggtgggaggg

SEQ ID NO: 4104871 - DNA, 14 bp, Homo sapiens
gggttggtgtgctg

SEQ ID NO: 4104872 - DNA, 15 bp, Homo sapiens
gggttggtgtgctga

SEQ ID NO: 4104873 - DNA, 21 bp, Homo sapiens
gggttgtgaggcctggccagg

SEQ ID NO: 4104874 - DNA, 23 bp, Homo sapiens
gggttgtgaggcctggccaggca

SEQ ID NO: 4104875 - DNA, 20 bp, Homo sapiens
gggtttgggcccctcagagc

SEQ ID NO: 4104876 - DNA, 12 bp, Homo sapiens
gggttttctctc

SEQ ID NO: 4104877 - DNA, 13 bp, Homo sapiens
gggttttgtaatg

SEQ ID NO: 4104878 - DNA, 23 bp, Homo sapiens
ggtaaaagtgtgagcagtgagtt

SEQ ID NO: 4104879 - DNA, 15 bp, Homo sapiens
ggtaaataaaccact

SEQ ID NO: 4104880 - DNA, 14 bp, Homo sapiens
ggtaaattcttaat

SEQ ID NO: 4104881 - DNA, 18 bp, Homo sapiens
ggtaacagaacagcttca

SEQ ID NO: 4104882 - DNA, 21 bp, Homo sapiens
ggtaacagaacagcttcaggt

SEQ ID NO: 4104883 - DNA, 14 bp, Homo sapiens
ggtaacagtggctg

SEQ ID NO: 4104884 - DNA, 21 bp, Homo sapiens
ggtaacagttcatgtttgctt

SEQ ID NO: 4104885 - DNA, 17 bp, Homo sapiens
gggctgccagcagcccc

SEQ ID NO: 4104886 - DNA, 14 bp, Homo sapiens
gggctgccctgaga

SEQ ID NO: 4104887 - DNA, 16 bp, Homo sapiens
gggctgccctgagaag

SEQ ID NO: 4104888 - DNA, 13 bp, Homo sapiens
gggctgccctggt

SEQ ID NO: 4104889 - DNA, 15 bp, Homo sapiens
gggctgccctggtgc

SEQ ID NO: 4104890 - DNA, 21 bp, Homo sapiens
gggctgccctggtgctgccac

SEQ ID NO: 4104891 - DNA, 20 bp, Homo sapiens
gggctgctcacccacctctt

SEQ ID NO: 4104892 - DNA, 14 bp, Homo sapiens
gggctgctgcaggc

SEQ ID NO: 4104893 - DNA, 18 bp, Homo sapiens
gggctggactggaggtgg

SEQ ID NO: 4104894 - DNA, 14 bp, Homo sapiens
gggctggaggccca

SEQ ID NO: 4104895 - DNA, 12 bp, Homo sapiens
gggctggccatg

SEQ ID NO: 4104896 - DNA, 18 bp, Homo sapiens
gggctggccccagggcac

SEQ ID NO: 4104897 - DNA, 19 bp, Homo sapiens
gggctggcctctggctctc

SEQ ID NO: 4104898 - DNA, 22 bp, Homo sapiens
gggctggctccccctccccagg

SEQ ID NO: 4104899 - DNA, 12 bp, Homo sapiens
gggctggggagg

SEQ ID NO: 4104900 - DNA, 14 bp, Homo sapiens
gggctgggtgctgg

SEQ ID NO: 4104901 - DNA, 14 bp, Homo sapiens
gggctggttctgta

SEQ ID NO: 4104902 - DNA, 23 bp, Homo sapiens
gggctggttctgtaattgtgtgt

SEQ ID NO: 4104903 - DNA, 17 bp, Homo sapiens
gggctgtcatctgtgca

SEQ ID NO: 4104904 - DNA, 13 bp, Homo sapiens
gggctgtcccagc

SEQ ID NO: 4104905 - DNA, 23 bp, Homo sapiens
gggctgtgcttgaaggccctgct

SEQ ID NO: 4104906 - DNA, 18 bp, Homo sapiens
gggcttagtatttctcag

SEQ ID NO: 4104907 - DNA, 23 bp, Homo sapiens
gggcttcctgcccttccctctgg

SEQ ID NO: 4104908 - DNA, 15 bp, Homo sapiens
gggcttgaagccaaa

SEQ ID NO: 4104909 - DNA, 14 bp, Homo sapiens
gggcttggccagcg

SEQ ID NO: 4104910 - DNA, 15 bp, Homo sapiens
gggcttggcccagcg

SEQ ID NO: 4104911 - DNA, 16 bp, Homo sapiens
gggcttggcctgctgt

SEQ ID NO: 4104912 - DNA, 15 bp, Homo sapiens
gggcttgggccctgc

SEQ ID NO: 4104913 - DNA, 17 bp, Homo sapiens
gggctttcctgtgccag

SEQ ID NO: 4104914 - DNA, 21 bp, Homo sapiens
gggctttcctgtgccaggtga

SEQ ID NO: 4104915 - DNA, 12 bp, Homo sapiens
gggctttctctt

SEQ ID NO: 4104916 - DNA, 14 bp, Homo sapiens
gggctttctcttcc

SEQ ID NO: 4104917 - DNA, 21 bp, Homo sapiens
gggctttctcttccccttcct

SEQ ID NO: 4104918 - DNA, 22 bp, Homo sapiens
gggctttctcttccccttcctg

SEQ ID NO: 4104919 - DNA, 23 bp, Homo sapiens
gggctttctcttccccttcctgt

SEQ ID NO: 4104920 - DNA, 17 bp, Homo sapiens
gggctttgccttgcagc

SEQ ID NO: 4104921 - DNA, 21 bp, Homo sapiens
gggctttggttccttctctgg

SEQ ID NO: 4104922 - DNA, 22 bp, Homo sapiens
gggctttggttccttctctggg

SEQ ID NO: 4104923 - DNA, 21 bp, Homo sapiens
ggggaacctgccatgccagga

SEQ ID NO: 4104924 - DNA, 21 bp, Homo sapiens
ggggaactcagatccagggac

SEQ ID NO: 4104925 - DNA, 12 bp, Homo sapiens
ggggaactgagg

SEQ ID NO: 4104926 - DNA, 15 bp, Homo sapiens
ggggaaggagccagt

SEQ ID NO: 4104927 - DNA, 15 bp, Homo sapiens
ggggaaggccctgag

SEQ ID NO: 4104928 - DNA, 13 bp, Homo sapiens
ggggaagggccag

SEQ ID NO: 4104929 - DNA, 22 bp, Homo sapiens
ggggaagggccagtctgggctg

SEQ ID NO: 4104930 - DNA, 23 bp, Homo sapiens
ggggaagggccagtctgggctgc

SEQ ID NO: 4104931 - DNA, 14 bp, Homo sapiens
ggggaaggggcggt

SEQ ID NO: 4104932 - DNA, 16 bp, Homo sapiens
ggggactcagccctga

SEQ ID NO: 4104933 - DNA, 21 bp, Homo sapiens
ggggactctgagcgggaggca

SEQ ID NO: 4104934 - DNA, 18 bp, Homo sapiens
ggggactgggggactggg

SEQ ID NO: 4104935 - DNA, 14 bp, Homo sapiens
ggggactgtctttc

SEQ ID NO: 4104936 - DNA, 18 bp, Homo sapiens
ggggagagacaggcagcc

SEQ ID NO: 4104937 - DNA, 23 bp, Homo sapiens
ggggagagacaggcagcccagca

SEQ ID NO: 4104938 - DNA, 14 bp, Homo sapiens
ggggagagcctgct

SEQ ID NO: 4104939 - DNA, 18 bp, Homo sapiens
ggggagagcctgctggca

SEQ ID NO: 4104940 - DNA, 18 bp, Homo sapiens
ggggagcaggaggccaat

SEQ ID NO: 4104941 - DNA, 19 bp, Homo sapiens
ggggagcccactgtcctgg

SEQ ID NO: 4104942 - DNA, 18 bp, Homo sapiens
ggggaggaatcctggacc

SEQ ID NO: 4104943 - DNA, 12 bp, Homo sapiens
ggggaggcaaga

SEQ ID NO: 4104944 - DNA, 13 bp, Homo sapiens
ggggaggggaagt

SEQ ID NO: 4104945 - DNA, 15 bp, Homo sapiens
ggggaggtgggtgtg

SEQ ID NO: 4104946 - DNA, 20 bp, Homo sapiens
ggggaggtgggtgtgggtgg

SEQ ID NO: 4104947 - DNA, 21 bp, Homo sapiens
ggggagtccagggctcccgga

SEQ ID NO: 4104948 - DNA, 21 bp, Homo sapiens
ggggatagaggggctgcaggg

SEQ ID NO: 4104949 - DNA, 14 bp, Homo sapiens
ggggatgggccagg

SEQ ID NO: 4104950 - DNA, 14 bp, Homo sapiens
ggggatgtgggagg

SEQ ID NO: 4104951 - DNA, 16 bp, Homo sapiens
ggggattctgagcagt

SEQ ID NO: 4104952 - DNA, 13 bp, Homo sapiens
ggggcacagggag

SEQ ID NO: 4104953 - DNA, 12 bp, Homo sapiens
ggggcagcctct

SEQ ID NO: 4104954 - DNA, 17 bp, Homo sapiens
ggggcaggactgagtcc

SEQ ID NO: 4104955 - DNA, 20 bp, Homo sapiens
ggggcatctgcccctccccc

SEQ ID NO: 4104956 - DNA, 19 bp, Homo sapiens
ggggccacttttgactagg

SEQ ID NO: 4104957 - DNA, 23 bp, Homo sapiens
ggggccagaggaactgtccagag

SEQ ID NO: 4104958 - DNA, 17 bp, Homo sapiens
ggggccagatccagcct

SEQ ID NO: 4104959 - DNA, 21 bp, Homo sapiens
ggggccagtggggaactgagg

SEQ ID NO: 4104960 - DNA, 18 bp, Homo sapiens
ggggccccgccagggctg

SEQ ID NO: 4104961 - DNA, 19 bp, Homo sapiens
ggggccccgccagggctgg

SEQ ID NO: 4104962 - DNA, 20 bp, Homo sapiens
ggggccccgccagggctggg

SEQ ID NO: 4104963 - DNA, 20 bp, Homo sapiens
ggggccccgggttcagcctg

SEQ ID NO: 4104964 - DNA, 22 bp, Homo sapiens
ggggccccgggttcagcctggc

SEQ ID NO: 4104965 - DNA, 14 bp, Homo sapiens
ggggccctgccctg

SEQ ID NO: 4104966 - DNA, 16 bp, Homo sapiens
ggggccctggccagga

SEQ ID NO: 4104967 - DNA, 16 bp, Homo sapiens
ggggcctggacctgcc

SEQ ID NO: 4104968 - DNA, 12 bp, Homo sapiens
ggggcctgtgga

SEQ ID NO: 4104969 - DNA, 17 bp, Homo sapiens
ggggccttatcgggctc

SEQ ID NO: 4104970 - DNA, 14 bp, Homo sapiens
ggggcgaggcaggc

SEQ ID NO: 4104971 - DNA, 23 bp, Homo sapiens
ggggcgtgcgtgtaactgtagtg

SEQ ID NO: 4104972 - DNA, 22 bp, Homo sapiens
ggggctcctttctccagccagc

SEQ ID NO: 4104973 - DNA, 20 bp, Homo sapiens
ggggctgctcacccacctct

SEQ ID NO: 4104974 - DNA, 12 bp, Homo sapiens
ggggctgggggg

SEQ ID NO: 4104975 - DNA, 22 bp, Homo sapiens
ggggctgtggccgtctcctccc

SEQ ID NO: 4104976 - DNA, 20 bp, Homo sapiens
ggggcttataataaaggact

SEQ ID NO: 4104977 - DNA, 15 bp, Homo sapiens
ggggctttgccttgc

SEQ ID NO: 4104978 - DNA, 13 bp, Homo sapiens
gggggaacagatg

SEQ ID NO: 4104979 - DNA, 17 bp, Homo sapiens
gggggaactcagatcca

SEQ ID NO: 4104980 - DNA, 21 bp, Homo sapiens
gggggaatgagcccagagaac

SEQ ID NO: 4104981 - DNA, 15 bp, Homo sapiens
gggggaccctgcctc

SEQ ID NO: 4104982 - DNA, 10 bp, Homo sapiens
gggggagccc

SEQ ID NO: 4104983 - DNA, 12 bp, Homo sapiens
gggggaggtggg

SEQ ID NO: 4104984 - DNA, 16 bp, Homo sapiens
gggggagtagccaagc

SEQ ID NO: 4104985 - DNA, 20 bp, Homo sapiens
gggggcatctcttccccaga

SEQ ID NO: 4104986 - DNA, 14 bp, Homo sapiens
gggggccaaggtcc

SEQ ID NO: 4104987 - DNA, 12 bp, Homo sapiens
gggggccgggca

SEQ ID NO: 4104988 - DNA, 13 bp, Homo sapiens
gggccaggcaggt

SEQ ID NO: 4104989 - DNA, 20 bp, Homo sapiens
gggccaggcaggtgcctgga

SEQ ID NO: 4104990 - DNA, 17 bp, Homo sapiens
gggccaggcccaggcct

SEQ ID NO: 4104991 - DNA, 12 bp, Homo sapiens
gggccagggctg

SEQ ID NO: 4104992 - DNA, 13 bp, Homo sapiens
gggccagggctgc

SEQ ID NO: 4104993 - DNA, 16 bp, Homo sapiens
gggccagggctgcccc

SEQ ID NO: 4104994 - DNA, 18 bp, Homo sapiens
gggccagggtctgtgtga

SEQ ID NO: 4104995 - DNA, 15 bp, Homo sapiens
gggccagtcaggctg

SEQ ID NO: 4104996 - DNA, 19 bp, Homo sapiens
gggccagtggggcctgtgg

SEQ ID NO: 4104997 - DNA, 23 bp, Homo sapiens
gggccatgatggcaacagatctg

SEQ ID NO: 4104998 - DNA, 14 bp, Homo sapiens
gggccatgtccaaa

SEQ ID NO: 4104999 - DNA, 19 bp, Homo sapiens
gggcccaagacagatgccc

SEQ ID NO: 4105000 - DNA, 21 bp, Homo sapiens
gggcccacccaagcaggaggc

SEQ ID NO: 4105001 - DNA, 16 bp, Homo sapiens
gggcccaccccagcct

SEQ ID NO: 4105002 - DNA, 17 bp, Homo sapiens
gggcccaccccagcctc

SEQ ID NO: 4105003 - DNA, 20 bp, Homo sapiens
gggcccagaactgcccccac

SEQ ID NO: 4105004 - DNA, 15 bp, Homo sapiens
gggcccagagcccag

SEQ ID NO: 4105005 - DNA, 14 bp, Homo sapiens
gggcccagattcta

SEQ ID NO: 4105006 - DNA, 18 bp, Homo sapiens
gggcccagccaggagcag

SEQ ID NO: 4105007 - DNA, 13 bp, Homo sapiens
gggcccagcccag

SEQ ID NO: 4105008 - DNA, 16 bp, Homo sapiens
gggcccagcccagagc

SEQ ID NO: 4105009 - DNA, 12 bp, Homo sapiens
gggccccacctg

SEQ ID NO: 4105010 - DNA, 22 bp, Homo sapiens
gggccccatcctcatccctgac

SEQ ID NO: 4105011 - DNA, 18 bp, Homo sapiens
gggccccgccagggctgg

SEQ ID NO: 4105012 - DNA, 19 bp, Homo sapiens
gggccccgccagggctggg

SEQ ID NO: 4105013 - DNA, 16 bp, Homo sapiens
gggcccctcagagccc

SEQ ID NO: 4105014 - DNA, 14 bp, Homo sapiens
gggcccctccacgc

SEQ ID NO: 4105015 - DNA, 12 bp, Homo sapiens
gggcccctggga

SEQ ID NO: 4105016 - DNA, 14 bp, Homo sapiens
gggcccctgggatg

SEQ ID NO: 4105017 - DNA, 14 bp, Homo sapiens
gggcccctgggctt

SEQ ID NO: 4105018 - DNA, 21 bp, Homo sapiens
gggccctccgaccacttccag

SEQ ID NO: 4105019 - DNA, 12 bp, Homo sapiens
gggccctgcaca

SEQ ID NO: 4105020 - DNA, 21 bp, Homo sapiens
gggccctgcagctctcatgct

SEQ ID NO: 4105021 - DNA, 13 bp, Homo sapiens
gggccctggccag

SEQ ID NO: 4105022 - DNA, 14 bp, Homo sapiens
gggccctggccagg

SEQ ID NO: 4105023 - DNA, 15 bp, Homo sapiens
gggccctgggcctca

SEQ ID NO: 4105024 - DNA, 17 bp, Homo sapiens
gggccctgggcctcagt

SEQ ID NO: 4105025 - DNA, 14 bp, Homo sapiens
gggccgaggcccag

SEQ ID NO: 4105026 - DNA, 15 bp, Homo sapiens
gggccgaggcccagc

SEQ ID NO: 4105027 - DNA, 19 bp, Homo sapiens
gggccgaggcccagcgggc

SEQ ID NO: 4105028 - DNA, 21 bp, Homo sapiens
gggccgaggcccagcgggcag

SEQ ID NO: 4105029 - DNA, 22 bp, Homo sapiens
gggccgaggcccagcgggcaga

SEQ ID NO: 4105030 - DNA, 21 bp, Homo sapiens
gggccgggcaggtcctgccca

SEQ ID NO: 4105031 - DNA, 23 bp, Homo sapiens
gggccgggcaggtcctgcccatg

SEQ ID NO: 4105032 - DNA, 20 bp, Homo sapiens
gggccgggcgcggtggctca

SEQ ID NO: 4105033 - DNA, 17 bp, Homo sapiens
gggccggggaagctgcc

SEQ ID NO: 4105034 - DNA, 23 bp, Homo sapiens
gggccggggaagctgccagccca

SEQ ID NO: 4105035 - DNA, 14 bp, Homo sapiens
gggccgtgcccagg

SEQ ID NO: 4105036 - DNA, 19 bp, Homo sapiens
gggccgttacatctgtgca

SEQ ID NO: 4105037 - DNA, 17 bp, Homo sapiens
gggcctactagagtctg

SEQ ID NO: 4105038 - DNA, 19 bp, Homo sapiens
gggcctcaaaggcccgctc

SEQ ID NO: 4105039 - DNA, 20 bp, Homo sapiens
gggcctcaaaggcccgctct

SEQ ID NO: 4105040 - DNA, 20 bp, Homo sapiens
gggcctcaccgagtgggggc

SEQ ID NO: 4105041 - DNA, 13 bp, Homo sapiens
gggcctccagggc

SEQ ID NO: 4105042 - DNA, 14 bp, Homo sapiens
gggcctcgggacct

SEQ ID NO: 4105043 - DNA, 15 bp, Homo sapiens
gggcctgacaccccc

SEQ ID NO: 4105044 - DNA, 18 bp, Homo sapiens
gggcctgacaccccctcc

SEQ ID NO: 4105045 - DNA, 17 bp, Homo sapiens
gggcctgaggctcctta

SEQ ID NO: 4105046 - DNA, 18 bp, Homo sapiens
gggcctgaggctccttag

SEQ ID NO: 4105047 - DNA, 13 bp, Homo sapiens
gggcctgcccctg

SEQ ID NO: 4105048 - DNA, 14 bp, Homo sapiens
gggcctgccgggct

SEQ ID NO: 4105049 - DNA, 13 bp, Homo sapiens
gggcctgcctggc

SEQ ID NO: 4105050 - DNA, 14 bp, Homo sapiens
gggcctgcctggcc

SEQ ID NO: 4105051 - DNA, 14 bp, Homo sapiens
gggcctgctccaga

SEQ ID NO: 4105052 - DNA, 21 bp, Homo sapiens
gggcctgctggaggcctcagg

SEQ ID NO: 4105053 - DNA, 14 bp, Homo sapiens
gggcctggacctgc

SEQ ID NO: 4105054 - DNA, 14 bp, Homo sapiens
gggcctggagcccc

SEQ ID NO: 4105055 - DNA, 10 bp, Homo sapiens
gggcctggca

SEQ ID NO: 4105056 - DNA, 22 bp, Homo sapiens
gggcctggcagccgtgccttca

SEQ ID NO: 4105057 - DNA, 14 bp, Homo sapiens
gggcctgggcctct

SEQ ID NO: 4105058 - DNA, 16 bp, Homo sapiens
gggcctggtccctggg

SEQ ID NO: 4105059 - DNA, 16 bp, Homo sapiens
gggcctgtcgtgccag

SEQ ID NO: 4105060 - DNA, 15 bp, Homo sapiens
gggccttgctgctgc

SEQ ID NO: 4105061 - DNA, 12 bp, Homo sapiens
gggcgaggcagg

SEQ ID NO: 4105062 - DNA, 20 bp, Homo sapiens
gggcgaggggttggtgggag

SEQ ID NO: 4105063 - DNA, 15 bp, Homo sapiens
gggcgatgctccctc

SEQ ID NO: 4105064 - DNA, 22 bp, Homo sapiens
gggcgcctgtagtcccagccac

SEQ ID NO: 4105065 - DNA, 18 bp, Homo sapiens
gggcgcgatcccacacag

SEQ ID NO: 4105066 - DNA, 16 bp, Homo sapiens
gggcgcggtggctcac

SEQ ID NO: 4105067 - DNA, 13 bp, Homo sapiens
gggcgctcagacg

SEQ ID NO: 4105068 - DNA, 15 bp, Homo sapiens
gggcgctcagacggc

SEQ ID NO: 4105069 - DNA, 22 bp, Homo sapiens
gggcgtgctagaggttgcagca

SEQ ID NO: 4105070 - DNA, 18 bp, Homo sapiens
gggctaacgggaggctgg

SEQ ID NO: 4105071 - DNA, 13 bp, Homo sapiens
gggctaaggcccc

SEQ ID NO: 4105072 - DNA, 20 bp, Homo sapiens
gggctacccgtgagcccttc

SEQ ID NO: 4105073 - DNA, 19 bp, Homo sapiens
gggctcaagcaatcctcct

SEQ ID NO: 4105074 - DNA, 22 bp, Homo sapiens
gggctcaagcaatcctcctgcc

SEQ ID NO: 4105075 - DNA, 15 bp, Homo sapiens
gggctcacggggcct

SEQ ID NO: 4105076 - DNA, 20 bp, Homo sapiens
gggctcacggggcctccaac

SEQ ID NO: 4105077 - DNA, 19 bp, Homo sapiens
gggctcagatggactggga

SEQ ID NO: 4105078 - DNA, 13 bp, Homo sapiens
gggctcagcaatg

SEQ ID NO: 4105079 - DNA, 13 bp, Homo sapiens
gggctcccagggc

SEQ ID NO: 4105080 - DNA, 14 bp, Homo sapiens
gggctcccaggggt

SEQ ID NO: 4105081 - DNA, 13 bp, Homo sapiens
gggctccccccag

SEQ ID NO: 4105082 - DNA, 20 bp, Homo sapiens
gggctccccccagtgggatg

SEQ ID NO: 4105083 - DNA, 20 bp, Homo sapiens
gggctcctttctccagccag

SEQ ID NO: 4105084 - DNA, 20 bp, Homo sapiens
gggctcgaggggtgggctgg

SEQ ID NO: 4105085 - DNA, 15 bp, Homo sapiens
gggctcggaggctgc

SEQ ID NO: 4105086 - DNA, 13 bp, Homo sapiens
gggctctcagctc

SEQ ID NO: 4105087 - DNA, 13 bp, Homo sapiens
gggctctctgaga

SEQ ID NO: 4105088 - DNA, 16 bp, Homo sapiens
gggctctgcacccacg

SEQ ID NO: 4105089 - DNA, 16 bp, Homo sapiens
gggctctgtgcagtca

SEQ ID NO: 4105090 - DNA, 20 bp, Homo sapiens
gggctgactgggccagggga

SEQ ID NO: 4105091 - DNA, 17 bp, Homo sapiens
gggctgagtgacacaag

SEQ ID NO: 4105092 - DNA, 19 bp, Homo sapiens
gggagcccactgtcctggg

SEQ ID NO: 4105093 - DNA, 16 bp, Homo sapiens
gggagcccccaccaca

SEQ ID NO: 4105094 - DNA, 20 bp, Homo sapiens
gggagccctgaccttggctg

SEQ ID NO: 4105095 - DNA, 14 bp, Homo sapiens
gggagcctccccat

SEQ ID NO: 4105096 - DNA, 21 bp, Homo sapiens
gggagcctttggttctggcca

SEQ ID NO: 4105097 - DNA, 18 bp, Homo sapiens
gggagctcctctcctgga

SEQ ID NO: 4105098 - DNA, 20 bp, Homo sapiens
gggagctcctctcctggagg

SEQ ID NO: 4105099 - DNA, 18 bp, Homo sapiens
gggagctgagcagcctct

SEQ ID NO: 4105100 - DNA, 19 bp, Homo sapiens
gggagctgagcagcctctg

SEQ ID NO: 4105101 - DNA, 24 bp, Homo sapiens
gggaggaaatttgaatgggtccat

SEQ ID NO: 4105102 - DNA, 20 bp, Homo sapiens
gggaggacctgaccctactc

SEQ ID NO: 4105103 - DNA, 23 bp, Homo sapiens
gggaggagaagaaaatgttcttc

SEQ ID NO: 4105104 - DNA, 21 bp, Homo sapiens
gggaggagaggggaagggcca

SEQ ID NO: 4105105 - DNA, 14 bp, Homo sapiens
gggaggagggagag

SEQ ID NO: 4105106 - DNA, 14 bp, Homo sapiens
gggaggagggggag

SEQ ID NO: 4105107 - DNA, 17 bp, Homo sapiens
gggaggctgagacagga

SEQ ID NO: 4105108 - DNA, 18 bp, Homo sapiens
gggaggctgaggcagaag

SEQ ID NO: 4105109 - DNA, 17 bp, Homo sapiens
gggagggagggcggtgg

SEQ ID NO: 4105110 - DNA, 11 bp, Homo sapiens
gggagggatta

SEQ ID NO: 4105111 - DNA, 13 bp, Homo sapiens
gggaggggaaatg

SEQ ID NO: 4105112 - DNA, 13 bp, Homo sapiens
gggagggggaggg

SEQ ID NO: 4105113 - DNA, 15 bp, Homo sapiens
gggaggtcactggaa

SEQ ID NO: 4105114 - DNA, 17 bp, Homo sapiens
gggagtacctgctgccc

SEQ ID NO: 4105115 - DNA, 14 bp, Homo sapiens
gggagtagccaagc

SEQ ID NO: 4105116 - DNA, 12 bp, Homo sapiens
gggagtcagagc

SEQ ID NO: 4105117 - DNA, 15 bp, Homo sapiens
gggagtgctggctca

SEQ ID NO: 4105118 - DNA, 19 bp, Homo sapiens
gggagtgctggctcacagt

SEQ ID NO: 4105119 - DNA, 19 bp, Homo sapiens
gggagtgggcacctcagaa

SEQ ID NO: 4105120 - DNA, 15 bp, Homo sapiens
gggagttaagacctg

SEQ ID NO: 4105121 - DNA, 20 bp, Homo sapiens
gggagttaagacctggcagc

SEQ ID NO: 4105122 - DNA, 22 bp, Homo sapiens
gggatacaggcccctgggtttc

SEQ ID NO: 4105123 - DNA, 15 bp, Homo sapiens
gggataggggcagag

SEQ ID NO: 4105124 - DNA, 22 bp, Homo sapiens
gggatagtgttctgctcctgct

SEQ ID NO: 4105125 - DNA, 15 bp, Homo sapiens
gggatataggagagg

SEQ ID NO: 4105126 - DNA, 23 bp, Homo sapiens
gggatatctttacaagcaggcac

SEQ ID NO: 4105127 - DNA, 14 bp, Homo sapiens
gggatatggctgcc

SEQ ID NO: 4105128 - DNA, 22 bp, Homo sapiens
gggatcaaccagctaagaaaag

SEQ ID NO: 4105129 - DNA, 20 bp, Homo sapiens
gggatccctcccccccatgc

SEQ ID NO: 4105130 - DNA, 17 bp, Homo sapiens
gggatgggacagggagg

SEQ ID NO: 4105131 - DNA, 14 bp, Homo sapiens
gggatgggccaggg

SEQ ID NO: 4105132 - DNA, 20 bp, Homo sapiens
gggatgggggatgggccagg

SEQ ID NO: 4105133 - DNA, 18 bp, Homo sapiens
gggatggtccaggatctc

SEQ ID NO: 4105134 - DNA, 22 bp, Homo sapiens
gggatgtgaattgcctgcagag

SEQ ID NO: 4105135 - DNA, 13 bp, Homo sapiens
gggatgtttttct

SEQ ID NO: 4105136 - DNA, 20 bp, Homo sapiens
gggattaatatgaaaactta

SEQ ID NO: 4105137 - DNA, 20 bp, Homo sapiens
gggattacaggcgtgagcca

SEQ ID NO: 4105138 - DNA, 15 bp, Homo sapiens
gggattcccaccaag

SEQ ID NO: 4105139 - DNA, 19 bp, Homo sapiens
gggattctgagcagtgcct

SEQ ID NO: 4105140 - DNA, 18 bp, Homo sapiens
gggcaaagccacaaggct

SEQ ID NO: 4105141 - DNA, 15 bp, Homo sapiens
gggcaacgaagaaaa

SEQ ID NO: 4105142 - DNA, 17 bp, Homo sapiens
gggcaacgaagaaaaaa

SEQ ID NO: 4105143 - DNA, 15 bp, Homo sapiens
gggcacagggcacca

SEQ ID NO: 4105144 - DNA, 20 bp, Homo sapiens
gggcacagggcaccagaggc

SEQ ID NO: 4105145 - DNA, 13 bp, Homo sapiens
gggcacaggtcag

SEQ ID NO: 4105146 - DNA, 15 bp, Homo sapiens
gggcacaggtcaggc

SEQ ID NO: 4105147 - DNA, 14 bp, Homo sapiens
gggcacagtccaga

SEQ ID NO: 4105148 - DNA, 18 bp, Homo sapiens
gggcacagtccagaccca

SEQ ID NO: 4105149 - DNA, 15 bp, Homo sapiens
gggcaccagccagcg

SEQ ID NO: 4105150 - DNA, 20 bp, Homo sapiens
gggcaccctgtggccctggc

SEQ ID NO: 4105151 - DNA, 22 bp, Homo sapiens
gggcacgtcgcccgctgagctg

SEQ ID NO: 4105152 - DNA, 14 bp, Homo sapiens
gggcactggcccag

SEQ ID NO: 4105153 - DNA, 21 bp, Homo sapiens
gggcagagcccccaggaagcc

SEQ ID NO: 4105154 - DNA, 16 bp, Homo sapiens
gggcagatccccactg

SEQ ID NO: 4105155 - DNA, 16 bp, Homo sapiens
gggcagcaatttaaat

SEQ ID NO: 4105156 - DNA, 15 bp, Homo sapiens
gggcagcacctctgc

SEQ ID NO: 4105157 - DNA, 20 bp, Homo sapiens
gggcagcatagcaagacaca

SEQ ID NO: 4105158 - DNA, 11 bp, Homo sapiens
gggcagccagc

SEQ ID NO: 4105159 - DNA, 12 bp, Homo sapiens
gggcagccagca

SEQ ID NO: 4105160 - DNA, 14 bp, Homo sapiens
gggcagccaggctg

SEQ ID NO: 4105161 - DNA, 13 bp, Homo sapiens
gggcagccccaga

SEQ ID NO: 4105162 - DNA, 15 bp, Homo sapiens
gggcagccccagaga

SEQ ID NO: 4105163 - DNA, 13 bp, Homo sapiens
gggcagcgccagg

SEQ ID NO: 4105164 - DNA, 15 bp, Homo sapiens
gggcagcgccaggct

SEQ ID NO: 4105165 - DNA, 15 bp, Homo sapiens
gggcagcgggccagg

SEQ ID NO: 4105166 - DNA, 17 bp, Homo sapiens
gggcagcgggccaggcc

SEQ ID NO: 4105167 - DNA, 21 bp, Homo sapiens
gggcagcgggccaggcccgca

SEQ ID NO: 4105168 - DNA, 18 bp, Homo sapiens
gggcaggagggccctacc

SEQ ID NO: 4105169 - DNA, 19 bp, Homo sapiens
gggcaggcggtccccatcc

SEQ ID NO: 4105170 - DNA, 16 bp, Homo sapiens
gggcaggctgggccat

SEQ ID NO: 4105171 - DNA, 14 bp, Homo sapiens
gggcagtgccccag

SEQ ID NO: 4105172 - DNA, 18 bp, Homo sapiens
gggcagtgccccagggag

SEQ ID NO: 4105173 - DNA, 21 bp, Homo sapiens
gggcagtggtaagctctggct

SEQ ID NO: 4105174 - DNA, 23 bp, Homo sapiens
gggcagttctcactcctaggaga

SEQ ID NO: 4105175 - DNA, 20 bp, Homo sapiens
gggcatctcttccccagaga

SEQ ID NO: 4105176 - DNA, 15 bp, Homo sapiens
gggcatggccaggtg

SEQ ID NO: 4105177 - DNA, 15 bp, Homo sapiens
gggcatgtctgcctg

SEQ ID NO: 4105178 - DNA, 16 bp, Homo sapiens
gggcatgtgtatgtgt

SEQ ID NO: 4105179 - DNA, 18 bp, Homo sapiens
gggcattcgggccacagg

SEQ ID NO: 4105180 - DNA, 20 bp, Homo sapiens
gggcattcgggccacagggc

SEQ ID NO: 4105181 - DNA, 18 bp, Homo sapiens
gggcattctctctccaag

SEQ ID NO: 4105182 - DNA, 14 bp, Homo sapiens
gggcattgctttcc

SEQ ID NO: 4105183 - DNA, 16 bp, Homo sapiens
gggccaaacctgggac

SEQ ID NO: 4105184 - DNA, 22 bp, Homo sapiens
gggccaacttgagggcccagag

SEQ ID NO: 4105185 - DNA, 13 bp, Homo sapiens
gggccacagggcg

SEQ ID NO: 4105186 - DNA, 16 bp, Homo sapiens
gggccacagggcggtg

SEQ ID NO: 4105187 - DNA, 17 bp, Homo sapiens
gggccacgccccagccc

SEQ ID NO: 4105188 - DNA, 21 bp, Homo sapiens
gggccacgccccagcccgaca

SEQ ID NO: 4105189 - DNA, 24 bp, Homo sapiens
gggccacggaggagggatgctgct

SEQ ID NO: 4105190 - DNA, 12 bp, Homo sapiens
gggccagagcca

SEQ ID NO: 4105191 - DNA, 13 bp, Homo sapiens
gggccagagccag

SEQ ID NO: 4105192 - DNA, 19 bp, Homo sapiens
gggccagaggctgggagtc

SEQ ID NO: 4105193 - DNA, 12 bp, Homo sapiens
gggccagaggga

SEQ ID NO: 4105194 - DNA, 18 bp, Homo sapiens
gggccagatccagcctgg

SEQ ID NO: 4105195 - DNA, 12 bp, Homo sapiens
gggccaggcact

SEQ ID NO: 4105196 - DNA, 20 bp, Homo sapiens
ggcttccagcttcaggcacc

SEQ ID NO: 4105197 - DNA, 12 bp, Homo sapiens
ggcttccaggta

SEQ ID NO: 4105198 - DNA, 23 bp, Homo sapiens
ggcttccccactcccccgtttct

SEQ ID NO: 4105199 - DNA, 15 bp, Homo sapiens
ggcttcccgctcagc

SEQ ID NO: 4105200 - DNA, 18 bp, Homo sapiens
ggcttcccgctcagccct

SEQ ID NO: 4105201 - DNA, 19 bp, Homo sapiens
ggcttcccgctcagccctc

SEQ ID NO: 4105202 - DNA, 13 bp, Homo sapiens
ggcttcctgccct

SEQ ID NO: 4105203 - DNA, 19 bp, Homo sapiens
ggcttcctgcccttccctc

SEQ ID NO: 4105204 - DNA, 22 bp, Homo sapiens
ggcttcctgcccttccctctgg

SEQ ID NO: 4105205 - DNA, 20 bp, Homo sapiens
ggcttcctgcgtcctcctca

SEQ ID NO: 4105206 - DNA, 15 bp, Homo sapiens
ggcttcctgtggctt

SEQ ID NO: 4105207 - DNA, 16 bp, Homo sapiens
ggcttcctgtggcttt

SEQ ID NO: 4105208 - DNA, 17 bp, Homo sapiens
ggcttcgttaattaatg

SEQ ID NO: 4105209 - DNA, 16 bp, Homo sapiens
ggcttctccgccagcc

SEQ ID NO: 4105210 - DNA, 17 bp, Homo sapiens
ggcttctccgccagcct

SEQ ID NO: 4105211 - DNA, 21 bp, Homo sapiens
ggcttctccgccagcctcctc

SEQ ID NO: 4105212 - DNA, 21 bp, Homo sapiens
ggcttctccttctccttccca

SEQ ID NO: 4105213 - DNA, 12 bp, Homo sapiens
ggcttgaagcca

SEQ ID NO: 4105214 - DNA, 20 bp, Homo sapiens
ggcttgaagccaaagaaaaa

SEQ ID NO: 4105215 - DNA, 20 bp, Homo sapiens
ggcttgacagcatgaggtgt

SEQ ID NO: 4105216 - DNA, 17 bp, Homo sapiens
ggcttgactttggctga

SEQ ID NO: 4105217 - DNA, 15 bp, Homo sapiens
ggcttgcactctctt

SEQ ID NO: 4105218 - DNA, 14 bp, Homo sapiens
ggcttggcctgctg

SEQ ID NO: 4105219 - DNA, 15 bp, Homo sapiens
ggcttgggaaaaaaa

SEQ ID NO: 4105220 - DNA, 17 bp, Homo sapiens
ggcttgggatttgctgt

SEQ ID NO: 4105221 - DNA, 15 bp, Homo sapiens
ggcttggggcttcct

SEQ ID NO: 4105222 - DNA, 16 bp, Homo sapiens
ggcttggggtgtgggg

SEQ ID NO: 4105223 - DNA, 16 bp, Homo sapiens
ggcttgtcatagccag

SEQ ID NO: 4105224 - DNA, 12 bp, Homo sapiens
ggctttctcttc

SEQ ID NO: 4105225 - DNA, 16 bp, Homo sapiens
ggctttctcttcccct

SEQ ID NO: 4105226 - DNA, 18 bp, Homo sapiens
ggctttgcccacccctca

SEQ ID NO: 4105227 - DNA, 13 bp, Homo sapiens
ggctttgcctctt

SEQ ID NO: 4105228 - DNA, 15 bp, Homo sapiens
ggctttgccttgcag

SEQ ID NO: 4105229 - DNA, 18 bp, Homo sapiens
ggctttgccttgcagcca

SEQ ID NO: 4105230 - DNA, 12 bp, Homo sapiens
ggctttggattt

SEQ ID NO: 4105231 - DNA, 14 bp, Homo sapiens
ggcttttcactgct

SEQ ID NO: 4105232 - DNA, 15 bp, Homo sapiens
ggcttttcactgctg

SEQ ID NO: 4105233 - DNA, 17 bp, Homo sapiens
ggcttttgttttgcttt

SEQ ID NO: 4105234 - DNA, 21 bp, Homo sapiens
ggctttttcctctgagcccag

SEQ ID NO: 4105235 - DNA, 23 bp, Homo sapiens
ggctttttcctctgagcccagct

SEQ ID NO: 4105236 - DNA, 21 bp, Homo sapiens
gggaaaaaaaaaaaagaaaag

SEQ ID NO: 4105237 - DNA, 13 bp, Homo sapiens
gggaaaaaagcac

SEQ ID NO: 4105238 - DNA, 13 bp, Homo sapiens
gggaaaatatttc

SEQ ID NO: 4105239 - DNA, 15 bp, Homo sapiens
gggaaagccacctct

SEQ ID NO: 4105240 - DNA, 22 bp, Homo sapiens
gggaaagtgtgagctcttccct

SEQ ID NO: 4105241 - DNA, 16 bp, Homo sapiens
gggaaatgtaatactg

SEQ ID NO: 4105242 - DNA, 23 bp, Homo sapiens
gggaaatgtaatactggaataat

SEQ ID NO: 4105243 - DNA, 18 bp, Homo sapiens
gggaaccatgaagacagg

SEQ ID NO: 4105244 - DNA, 21 bp, Homo sapiens
gggaagctgaggcgggagaat

SEQ ID NO: 4105245 - DNA, 15 bp, Homo sapiens
gggaagctgccagcc

SEQ ID NO: 4105246 - DNA, 13 bp, Homo sapiens
gggaagctggctt

SEQ ID NO: 4105247 - DNA, 18 bp, Homo sapiens
gggaaggacttggcgcgc

SEQ ID NO: 4105248 - DNA, 13 bp, Homo sapiens
gggaaggagccag

SEQ ID NO: 4105249 - DNA, 15 bp, Homo sapiens
gggaaggcctgactt

SEQ ID NO: 4105250 - DNA, 16 bp, Homo sapiens
gggaaggcgagtctgg

SEQ ID NO: 4105251 - DNA, 22 bp, Homo sapiens
gggaagggccagtctgggctgc

SEQ ID NO: 4105252 - DNA, 14 bp, Homo sapiens
gggaaggggcggtg

SEQ ID NO: 4105253 - DNA, 21 bp, Homo sapiens
gggaagggggggctacattat

SEQ ID NO: 4105254 - DNA, 12 bp, Homo sapiens
gggaaggtcacc

SEQ ID NO: 4105255 - DNA, 19 bp, Homo sapiens
gggaaggtcaccagcacca

SEQ ID NO: 4105256 - DNA, 19 bp, Homo sapiens
gggaagtccctgggaggcc

SEQ ID NO: 4105257 - DNA, 14 bp, Homo sapiens
gggaagtcctccct

SEQ ID NO: 4105258 - DNA, 20 bp, Homo sapiens
gggaatgtattattctgcag

SEQ ID NO: 4105259 - DNA, 21 bp, Homo sapiens
gggaatgtattattctgcagc

SEQ ID NO: 4105260 - DNA, 13 bp, Homo sapiens
gggacaagggatt

SEQ ID NO: 4105261 - DNA, 19 bp, Homo sapiens
gggacaagtggactcaggg

SEQ ID NO: 4105262 - DNA, 19 bp, Homo sapiens
gggacacacttagctggag

SEQ ID NO: 4105263 - DNA, 11 bp, Homo sapiens
gggacagagaa

SEQ ID NO: 4105264 - DNA, 15 bp, Homo sapiens
gggacagaggcctgc

SEQ ID NO: 4105265 - DNA, 17 bp, Homo sapiens
gggacagccagagctgg

SEQ ID NO: 4105266 - DNA, 21 bp, Homo sapiens
gggacagcccagagcctggct

SEQ ID NO: 4105267 - DNA, 14 bp, Homo sapiens
gggacagcttcctc

SEQ ID NO: 4105268 - DNA, 15 bp, Homo sapiens
gggacagggaggcca

SEQ ID NO: 4105269 - DNA, 17 bp, Homo sapiens
gggacatgctcacctct

SEQ ID NO: 4105270 - DNA, 18 bp, Homo sapiens
gggaccaaccctggggaa

SEQ ID NO: 4105271 - DNA, 16 bp, Homo sapiens
gggaccaactgggccc

SEQ ID NO: 4105272 - DNA, 22 bp, Homo sapiens
gggaccccaacctcagaggcag

SEQ ID NO: 4105273 - DNA, 20 bp, Homo sapiens
gggacccctgctcccagcct

SEQ ID NO: 4105274 - DNA, 18 bp, Homo sapiens
gggacctgccaggcaggg

SEQ ID NO: 4105275 - DNA, 20 bp, Homo sapiens
gggacgacgctgactgccct

SEQ ID NO: 4105276 - DNA, 14 bp, Homo sapiens
gggacgtggctcag

SEQ ID NO: 4105277 - DNA, 19 bp, Homo sapiens
gggacgtggctcagccagc

SEQ ID NO: 4105278 - DNA, 20 bp, Homo sapiens
gggactatctttgctgcaga

SEQ ID NO: 4105279 - DNA, 15 bp, Homo sapiens
gggactcagggaccg

SEQ ID NO: 4105280 - DNA, 19 bp, Homo sapiens
gggactctgaagcctctgg

SEQ ID NO: 4105281 - DNA, 21 bp, Homo sapiens
gggactctgagcgggaggcag

SEQ ID NO: 4105282 - DNA, 17 bp, Homo sapiens
gggactgggagtcagag

SEQ ID NO: 4105283 - DNA, 18 bp, Homo sapiens
gggactgggagtcagagc

SEQ ID NO: 4105284 - DNA, 12 bp, Homo sapiens
gggacttttatt

SEQ ID NO: 4105285 - DNA, 13 bp, Homo sapiens
gggagaaaattca

SEQ ID NO: 4105286 - DNA, 15 bp, Homo sapiens
gggagaatcatgtga

SEQ ID NO: 4105287 - DNA, 19 bp, Homo sapiens
gggagacactggcccctca

SEQ ID NO: 4105288 - DNA, 15 bp, Homo sapiens
gggagacatgtgaca

SEQ ID NO: 4105289 - DNA, 22 bp, Homo sapiens
gggagagagagagagagaggac

SEQ ID NO: 4105290 - DNA, 12 bp, Homo sapiens
gggagagccagc

SEQ ID NO: 4105291 - DNA, 15 bp, Homo sapiens
gggagagccagctcc

SEQ ID NO: 4105292 - DNA, 15 bp, Homo sapiens
gggagagctgagcca

SEQ ID NO: 4105293 - DNA, 21 bp, Homo sapiens
gggagatgcttctctccttgc

SEQ ID NO: 4105294 - DNA, 14 bp, Homo sapiens
gggagcactgcgtt

SEQ ID NO: 4105295 - DNA, 16 bp, Homo sapiens
gggagcactggagtgc

SEQ ID NO: 4105296 - DNA, 15 bp, Homo sapiens
gggagcaggaggcca

SEQ ID NO: 4105297 - DNA, 22 bp, Homo sapiens
gggagcaggccggaaccacagg

SEQ ID NO: 4105298 - DNA, 13 bp, Homo sapiens
gggagccagctgc

SEQ ID NO: 4105299 - DNA, 20 bp, Homo sapiens
gggagccagctgctttttgt

SEQ ID NO: 4105300 - DNA, 12 bp, Homo sapiens
taaatgtatact

SEQ ID NO: 4105301 - DNA, 15 bp, Homo sapiens
taaatgtattttaca

SEQ ID NO: 4105302 - DNA, 14 bp, Homo sapiens
taaatgtgaatttt

SEQ ID NO: 4105303 - DNA, 21 bp, Homo sapiens
taaatgtgaatttttatttct

SEQ ID NO: 4105304 - DNA, 22 bp, Homo sapiens
taaatgttaatggatttcagaa

SEQ ID NO: 4105305 - DNA, 23 bp, Homo sapiens
taaatgttaatggatttcagaag

SEQ ID NO: 4105306 - DNA, 16 bp, Homo sapiens
taaatgttagttctag

SEQ ID NO: 4105307 - DNA, 18 bp, Homo sapiens
taaatgttagttctagct

SEQ ID NO: 4105308 - DNA, 20 bp, Homo sapiens
taaatgttatgactatgtaa

SEQ ID NO: 4105309 - DNA, 23 bp, Homo sapiens
taaatgttatgactatgtaaact

SEQ ID NO: 4105310 - DNA, 13 bp, Homo sapiens
taaatgttctatg

SEQ ID NO: 4105311 - DNA, 15 bp, Homo sapiens
taaatgttgaaagat

SEQ ID NO: 4105312 - DNA, 19 bp, Homo sapiens
taaatgttttataagttca

SEQ ID NO: 4105313 - DNA, 22 bp, Homo sapiens
taaatgttttataagttcacaa

SEQ ID NO: 4105314 - DNA, 18 bp, Homo sapiens
taaattaaagcctttagt

SEQ ID NO: 4105315 - DNA, 20 bp, Homo sapiens
taaattaaagcctttagtat

SEQ ID NO: 4105316 - DNA, 17 bp, Homo sapiens
taaattataacttaaaa

SEQ ID NO: 4105317 - DNA, 17 bp, Homo sapiens
taaattatgtataaaca

SEQ ID NO: 4105318 - DNA, 13 bp, Homo sapiens
taaattatttatg

SEQ ID NO: 4105319 - DNA, 13 bp, Homo sapiens
taaattatttgct

SEQ ID NO: 4105320 - DNA, 20 bp, Homo sapiens
taaattatttgctaagcata

SEQ ID NO: 4105321 - DNA, 23 bp, Homo sapiens
taaattcaaccactgtaaaatga

SEQ ID NO: 4105322 - DNA, 17 bp, Homo sapiens
taaattcacaatagaaa

SEQ ID NO: 4105323 - DNA, 18 bp, Homo sapiens
taaattcagatatatttt

SEQ ID NO: 4105324 - DNA, 18 bp, Homo sapiens
taaattcccaacttctct

SEQ ID NO: 4105325 - DNA, 18 bp, Homo sapiens
taaattctatgttaaata

SEQ ID NO: 4105326 - DNA, 19 bp, Homo sapiens
taaattctatgttaaatac

SEQ ID NO: 4105327 - DNA, 15 bp, Homo sapiens
taaattctgattctt

SEQ ID NO: 4105328 - DNA, 16 bp, Homo sapiens
taaattctgattcttc

SEQ ID NO: 4105329 - DNA, 16 bp, Homo sapiens
taaattgcataaagca

SEQ ID NO: 4105330 - DNA, 21 bp, Homo sapiens
taaattgtaccatcattttat

SEQ ID NO: 4105331 - DNA, 23 bp, Homo sapiens
taaattgtagggctttagctttc

SEQ ID NO: 4105332 - DNA, 18 bp, Homo sapiens
taaatttaaacttacaaa

SEQ ID NO: 4105333 - DNA, 15 bp, Homo sapiens
taaatttaaagatat

SEQ ID NO: 4105334 - DNA, 16 bp, Homo sapiens
taaatttaaagatatt

SEQ ID NO: 4105335 - DNA, 21 bp, Homo sapiens
taaatttaaagatattgttca

SEQ ID NO: 4105336 - DNA, 18 bp, Homo sapiens
taaatttaaatttaaaga

SEQ ID NO: 4105337 - DNA, 14 bp, Homo sapiens
taaatttaatcctt

SEQ ID NO: 4105338 - DNA, 15 bp, Homo sapiens
taaatttaattcttc

SEQ ID NO: 4105339 - DNA, 15 bp, Homo sapiens
taaatttatttcaaa

SEQ ID NO: 4105340 - DNA, 22 bp, Homo sapiens
taaatttgatttacatatatta

SEQ ID NO: 4105341 - DNA, 12 bp, Homo sapiens
taaatttgtaag

SEQ ID NO: 4105342 - DNA, 18 bp, Homo sapiens
taaatttgtaagtttcag

SEQ ID NO: 4105343 - DNA, 20 bp, Homo sapiens
taaatttttaggcaaagata

SEQ ID NO: 4105344 - DNA, 15 bp, Homo sapiens
taacaaaagatgaaa

SEQ ID NO: 4105345 - DNA, 18 bp, Homo sapiens
taacaaaagatgaaagca

SEQ ID NO: 4105346 - DNA, 11 bp, Homo sapiens
taacaaaatgg

SEQ ID NO: 4105347 - DNA, 17 bp, Homo sapiens
taacaaaccaacatctt

SEQ ID NO: 4105348 - DNA, 14 bp, Homo sapiens
taacaaactaaaaa

SEQ ID NO: 4105349 - DNA, 13 bp, Homo sapiens
taacaaagacaaa

SEQ ID NO: 4105350 - DNA, 21 bp, Homo sapiens
taacaaatggagctttctgta

SEQ ID NO: 4105351 - DNA, 19 bp, Homo sapiens
taacaaggaatgcctgtgc

SEQ ID NO: 4105352 - DNA, 21 bp, Homo sapiens
taacaaggaatgcctgtgcca

SEQ ID NO: 4105353 - DNA, 21 bp, Homo sapiens
taacaagtaccaaagttttat

SEQ ID NO: 4105354 - DNA, 14 bp, Homo sapiens
taacaatacaaatg

SEQ ID NO: 4105355 - DNA, 18 bp, Homo sapiens
taacaatacaaatggatt

SEQ ID NO: 4105356 - DNA, 16 bp, Homo sapiens
taacaatgttaaggaa

SEQ ID NO: 4105357 - DNA, 19 bp, Homo sapiens
taacaattgtgtagccttt

SEQ ID NO: 4105358 - DNA, 23 bp, Homo sapiens
taacaattgtgtagcctttttgt

SEQ ID NO: 4105359 - DNA, 14 bp, Homo sapiens
taacaatttctgtc

SEQ ID NO: 4105360 - DNA, 16 bp, Homo sapiens
taacaatttctgtcct

SEQ ID NO: 4105361 - DNA, 20 bp, Homo sapiens
taacacacacagaaaagcat

SEQ ID NO: 4105362 - DNA, 17 bp, Homo sapiens
taacacagcatgtgtat

SEQ ID NO: 4105363 - DNA, 23 bp, Homo sapiens
taacaccaatcccagggctggct

SEQ ID NO: 4105364 - DNA, 16 bp, Homo sapiens
taacactataaaggtt

SEQ ID NO: 4105365 - DNA, 16 bp, Homo sapiens
taacagaacagcttca

SEQ ID NO: 4105366 - DNA, 18 bp, Homo sapiens
taacagaacagcttcagg

SEQ ID NO: 4105367 - DNA, 21 bp, Homo sapiens
taacagatgcaatgtgctact

SEQ ID NO: 4105368 - DNA, 19 bp, Homo sapiens
taacaggtattttgtttct

SEQ ID NO: 4105369 - DNA, 20 bp, Homo sapiens
taacaggtattttgtttctt

SEQ ID NO: 4105370 - DNA, 23 bp, Homo sapiens
taacaggtattttgtttctttta

SEQ ID NO: 4105371 - DNA, 13 bp, Homo sapiens
taacagtcattta

SEQ ID NO: 4105372 - DNA, 18 bp, Homo sapiens
taacagtggctgcttctc

SEQ ID NO: 4105373 - DNA, 19 bp, Homo sapiens
taacagttttccatgaaaa

SEQ ID NO: 4105374 - DNA, 18 bp, Homo sapiens
taacatacacgttaactg

SEQ ID NO: 4105375 - DNA, 20 bp, Homo sapiens
taacatattctgtatgaact

SEQ ID NO: 4105376 - DNA, 21 bp, Homo sapiens
taacatgaacacccttagaaa

SEQ ID NO: 4105377 - DNA, 19 bp, Homo sapiens
taacatgaggggacatttt

SEQ ID NO: 4105378 - DNA, 17 bp, Homo sapiens
taacatgtaattaagta

SEQ ID NO: 4105379 - DNA, 19 bp, Homo sapiens
taacatgtaattaagtact

SEQ ID NO: 4105380 - DNA, 16 bp, Homo sapiens
taacattatttatatg

SEQ ID NO: 4105381 - DNA, 23 bp, Homo sapiens
taacattcgatctcattcagtat

SEQ ID NO: 4105382 - DNA, 22 bp, Homo sapiens
taacattctgtaaaatgtctgt

SEQ ID NO: 4105383 - DNA, 22 bp, Homo sapiens
taacattgaccaagaactgcat

SEQ ID NO: 4105384 - DNA, 14 bp, Homo sapiens
taacatttgctgtt

SEQ ID NO: 4105385 - DNA, 22 bp, Homo sapiens
taacatttgctgttttaaacat

SEQ ID NO: 4105386 - DNA, 19 bp, Homo sapiens
taaccaagctgagtttcct

SEQ ID NO: 4105387 - DNA, 18 bp, Homo sapiens
taaccaagtttattcagt

SEQ ID NO: 4105388 - DNA, 23 bp, Homo sapiens
taaccaagtttattcagtaaaca

SEQ ID NO: 4105389 - DNA, 13 bp, Homo sapiens
taaccacaaggtc

SEQ ID NO: 4105390 - DNA, 15 bp, Homo sapiens
taaccacaaggtcca

SEQ ID NO: 4105391 - DNA, 22 bp, Homo sapiens
taaccacaaggtccactccctg

SEQ ID NO: 4105392 - DNA, 23 bp, Homo sapiens
taaccacagctccttttccagag

SEQ ID NO: 4105393 - DNA, 16 bp, Homo sapiens
taaccagggccagaag

SEQ ID NO: 4105394 - DNA, 20 bp, Homo sapiens
taaccatggagtagaggtac

SEQ ID NO: 4105395 - DNA, 14 bp, Homo sapiens
taacccaactgact

SEQ ID NO: 4105396 - DNA, 14 bp, Homo sapiens
taacccacctctcc

SEQ ID NO: 4105397 - DNA, 15 bp, Homo sapiens
taacccacctctcct

SEQ ID NO: 4105398 - DNA, 13 bp, Homo sapiens
taacccagatttt

SEQ ID NO: 4105399 - DNA, 15 bp, Homo sapiens
taacccccagctggg

SEQ ID NO: 4105400 - DNA, 17 bp, Homo sapiens
taacccccagctgggtc

SEQ ID NO: 4105401 - DNA, 22 bp, Homo sapiens
taacctaatcaccatgtaagca

SEQ ID NO: 4105402 - DNA, 19 bp, Homo sapiens
taaaataaaatgaaaattg

SEQ ID NO: 4105403 - DNA, 20 bp, Homo sapiens
taaaataaaatgaaaattgt

SEQ ID NO: 4105404 - DNA, 13 bp, Homo sapiens
taaaataaagtat

SEQ ID NO: 4105405 - DNA, 15 bp, Homo sapiens
taaaataaattccta

SEQ ID NO: 4105406 - DNA, 21 bp, Homo sapiens
taaaataagcaggtggatcta

SEQ ID NO: 4105407 - DNA, 15 bp, Homo sapiens
taaaataatgggatt

SEQ ID NO: 4105408 - DNA, 16 bp, Homo sapiens
taaaataattctaaag

SEQ ID NO: 4105409 - DNA, 22 bp, Homo sapiens
taaaatagaaattttgtaagaa

SEQ ID NO: 4105410 - DNA, 19 bp, Homo sapiens
taaaataggggatatttaa

SEQ ID NO: 4105411 - DNA, 21 bp, Homo sapiens
taaaatagtttatttttcaca

SEQ ID NO: 4105412 - DNA, 17 bp, Homo sapiens
taaaatatatttcagat

SEQ ID NO: 4105413 - DNA, 17 bp, Homo sapiens
taaaatcaaaacaagtg

SEQ ID NO: 4105414 - DNA, 22 bp, Homo sapiens
taaaatcttggaagtacatgaa

SEQ ID NO: 4105415 - DNA, 16 bp, Homo sapiens
taaaatgactacttag

SEQ ID NO: 4105416 - DNA, 20 bp, Homo sapiens
taaaatgaggttcaactgtt

SEQ ID NO: 4105417 - DNA, 14 bp, Homo sapiens
taaaatgattttat

SEQ ID NO: 4105418 - DNA, 17 bp, Homo sapiens
taaaatgattttatctg

SEQ ID NO: 4105419 - DNA, 16 bp, Homo sapiens
taaaatgcatgatttt

SEQ ID NO: 4105420 - DNA, 23 bp, Homo sapiens
taaaatggaattgaaaaactctt

SEQ ID NO: 4105421 - DNA, 18 bp, Homo sapiens
taaaatggtttgtcctga

SEQ ID NO: 4105422 - DNA, 19 bp, Homo sapiens
taaaatgtgatttttctga

SEQ ID NO: 4105423 - DNA, 18 bp, Homo sapiens
taaaattacaaaagagca

SEQ ID NO: 4105424 - DNA, 19 bp, Homo sapiens
taaaattacaactaagtga

SEQ ID NO: 4105425 - DNA, 17 bp, Homo sapiens
taaaattaggactgtat

SEQ ID NO: 4105426 - DNA, 18 bp, Homo sapiens
taaaattaggactgtata

SEQ ID NO: 4105427 - DNA, 15 bp, Homo sapiens
taaaattatacctgt

SEQ ID NO: 4105428 - DNA, 21 bp, Homo sapiens
taaaattatatagctgctcct

SEQ ID NO: 4105429 - DNA, 23 bp, Homo sapiens
taaaattcaagaaaataaaacta

SEQ ID NO: 4105430 - DNA, 18 bp, Homo sapiens
taaaattcagtttttgta

SEQ ID NO: 4105431 - DNA, 19 bp, Homo sapiens
taaaattcagtttttgtat

SEQ ID NO: 4105432 - DNA, 12 bp, Homo sapiens
taaaattccact

SEQ ID NO: 4105433 - DNA, 14 bp, Homo sapiens
taaaattggcacca

SEQ ID NO: 4105434 - DNA, 22 bp, Homo sapiens
taaaattgtaacctgcattttt

SEQ ID NO: 4105435 - DNA, 22 bp, Homo sapiens
taaaattgtcacctctgttaag

SEQ ID NO: 4105436 - DNA, 14 bp, Homo sapiens
taaacaaaattgca

SEQ ID NO: 4105437 - DNA, 15 bp, Homo sapiens
taaacaaagttacta

SEQ ID NO: 4105438 - DNA, 17 bp, Homo sapiens
taaacaaagttactagg

SEQ ID NO: 4105439 - DNA, 21 bp, Homo sapiens
taaacaaattcatattctgtc

SEQ ID NO: 4105440 - DNA, 15 bp, Homo sapiens
taaacaacttgtact

SEQ ID NO: 4105441 - DNA, 16 bp, Homo sapiens
taaacacagtcaaaat

SEQ ID NO: 4105442 - DNA, 18 bp, Homo sapiens
taaacacctgacacatct

SEQ ID NO: 4105443 - DNA, 16 bp, Homo sapiens
taaacagactgttaat

SEQ ID NO: 4105444 - DNA, 19 bp, Homo sapiens
taaacagatgatgagaatt

SEQ ID NO: 4105445 - DNA, 20 bp, Homo sapiens
taaacagatgatgagaattt

SEQ ID NO: 4105446 - DNA, 18 bp, Homo sapiens
taaacagatttttacaaa

SEQ ID NO: 4105447 - DNA, 20 bp, Homo sapiens
taaacagatttttacaaatg

SEQ ID NO: 4105448 - DNA, 22 bp, Homo sapiens
taaacagcagtgttccccatct

SEQ ID NO: 4105449 - DNA, 23 bp, Homo sapiens
taaacagcttcatgcctttgtaa

SEQ ID NO: 4105450 - DNA, 20 bp, Homo sapiens
taaacagtaatgactctctg

SEQ ID NO: 4105451 - DNA, 19 bp, Homo sapiens
taaacagtagttgtattct

SEQ ID NO: 4105452 - DNA, 15 bp, Homo sapiens
taaacataagtgtac

SEQ ID NO: 4105453 - DNA, 20 bp, Homo sapiens
taaacataattcttgtatat

SEQ ID NO: 4105454 - DNA, 16 bp, Homo sapiens
taaacatggttacaat

SEQ ID NO: 4105455 - DNA, 18 bp, Homo sapiens
taaacatggttacaatca

SEQ ID NO: 4105456 - DNA, 20 bp, Homo sapiens
taaacattaatagcagcctt

SEQ ID NO: 4105457 - DNA, 22 bp, Homo sapiens
taaacattaatagcagcctttc

SEQ ID NO: 4105458 - DNA, 14 bp, Homo sapiens
taaacccctgtccc

SEQ ID NO: 4105459 - DNA, 17 bp, Homo sapiens
taaaccgataatgcatg

SEQ ID NO: 4105460 - DNA, 18 bp, Homo sapiens
taaacctcaaaatgtcta

SEQ ID NO: 4105461 - DNA, 16 bp, Homo sapiens
taaacctttttcttga

SEQ ID NO: 4105462 - DNA, 22 bp, Homo sapiens
taaacctttttcttgatcttaa

SEQ ID NO: 4105463 - DNA, 15 bp, Homo sapiens
taaactccttcctgg

SEQ ID NO: 4105464 - DNA, 20 bp, Homo sapiens
taaactccttcctggcctga

SEQ ID NO: 4105465 - DNA, 21 bp, Homo sapiens
taaactccttcctggcctgag

SEQ ID NO: 4105466 - DNA, 15 bp, Homo sapiens
taaactctgttgcaa

SEQ ID NO: 4105467 - DNA, 20 bp, Homo sapiens
taaactcttcacaaaatctg

SEQ ID NO: 4105468 - DNA, 16 bp, Homo sapiens
taaactgactttatcc

SEQ ID NO: 4105469 - DNA, 17 bp, Homo sapiens
taaactgcaaacagaaa

SEQ ID NO: 4105470 - DNA, 20 bp, Homo sapiens
taaactgtacagaatttcca

SEQ ID NO: 4105471 - DNA, 22 bp, Homo sapiens
taaactgtgtggactgtgatgc

SEQ ID NO: 4105472 - DNA, 13 bp, Homo sapiens
taaactgttgctc

SEQ ID NO: 4105473 - DNA, 14 bp, Homo sapiens
taaacttaacttta

SEQ ID NO: 4105474 - DNA, 18 bp, Homo sapiens
taaacttagaggaaaatg

SEQ ID NO: 4105475 - DNA, 21 bp, Homo sapiens
taaacttagaggaaaatgagt

SEQ ID NO: 4105476 - DNA, 16 bp, Homo sapiens
taaacttataaatcat

SEQ ID NO: 4105477 - DNA, 18 bp, Homo sapiens
taaacttataaatcatat

SEQ ID NO: 4105478 - DNA, 14 bp, Homo sapiens
taaacttcacctac

SEQ ID NO: 4105479 - DNA, 16 bp, Homo sapiens
taaacttttaattcat

SEQ ID NO: 4105480 - DNA, 17 bp, Homo sapiens
taaagaagttgaagttt

SEQ ID NO: 4105481 - DNA, 15 bp, Homo sapiens
taaagacagaggcag

SEQ ID NO: 4105482 - DNA, 13 bp, Homo sapiens
taaagactggttt

SEQ ID NO: 4105483 - DNA, 22 bp, Homo sapiens
taaagactggttttctgccaat

SEQ ID NO: 4105484 - DNA, 12 bp, Homo sapiens
taaagagagaat

SEQ ID NO: 4105485 - DNA, 15 bp, Homo sapiens
taaagagcccttgcc

SEQ ID NO: 4105486 - DNA, 16 bp, Homo sapiens
taaagagcccttgcct

SEQ ID NO: 4105487 - DNA, 17 bp, Homo sapiens
taaagaggctgaaagag

SEQ ID NO: 4105488 - DNA, 14 bp, Homo sapiens
taaagataattgct

SEQ ID NO: 4105489 - DNA, 17 bp, Homo sapiens
taaagataattgctatt

SEQ ID NO: 4105490 - DNA, 17 bp, Homo sapiens
taaagatattgttcaaa

SEQ ID NO: 4105491 - DNA, 21 bp, Homo sapiens
taaagatgcaaggaccaggac

SEQ ID NO: 4105492 - DNA, 17 bp, Homo sapiens
taaagcataagtataca

SEQ ID NO: 4105493 - DNA, 22 bp, Homo sapiens
taaagcatgaatggtatggaac

SEQ ID NO: 4105494 - DNA, 15 bp, Homo sapiens
taaagcattgctgtt

SEQ ID NO: 4105495 - DNA, 21 bp, Homo sapiens
taaagcattgctgttatgtct

SEQ ID NO: 4105496 - DNA, 13 bp, Homo sapiens
taaagcattgctt

SEQ ID NO: 4105497 - DNA, 13 bp, Homo sapiens
taaagcatttata

SEQ ID NO: 4105498 - DNA, 17 bp, Homo sapiens
taaagccagcctgacct

SEQ ID NO: 4105499 - DNA, 23 bp, Homo sapiens
taaagcctgtgggtttggtcctt

SEQ ID NO: 4105500 - DNA, 17 bp, Homo sapiens
taaagcgatatacagat

SEQ ID NO: 4105501 - DNA, 23 bp, Homo sapiens
taaagcgatatacagatgaaaat

SEQ ID NO: 4105502 - DNA, 23 bp, Homo sapiens
taaagctaaaatgattttatctg

SEQ ID NO: 4105503 - DNA, 16 bp, Homo sapiens
taaagctgaatgtcaa

SEQ ID NO: 4105504 - DNA, 14 bp, Homo sapiens
gttttgcaataact

SEQ ID NO: 4105505 - DNA, 13 bp, Homo sapiens
gttttgcactttt

SEQ ID NO: 4105506 - DNA, 16 bp, Homo sapiens
gttttggggactcatt

SEQ ID NO: 4105507 - DNA, 17 bp, Homo sapiens
gttttggggtcctgggc

SEQ ID NO: 4105508 - DNA, 16 bp, Homo sapiens
gttttggttaataaaa

SEQ ID NO: 4105509 - DNA, 15 bp, Homo sapiens
gttttgtacactgct

SEQ ID NO: 4105510 - DNA, 17 bp, Homo sapiens
gttttgtatatacagtt

SEQ ID NO: 4105511 - DNA, 20 bp, Homo sapiens
gttttgtattttttaaaaca

SEQ ID NO: 4105512 - DNA, 17 bp, Homo sapiens
gttttgtcccatttcct

SEQ ID NO: 4105513 - DNA, 15 bp, Homo sapiens
gttttgtttctgaaa

SEQ ID NO: 4105514 - DNA, 19 bp, Homo sapiens
gtttttaaataaagaacaa

SEQ ID NO: 4105515 - DNA, 22 bp, Homo sapiens
gtttttaaataaagaacaattg

SEQ ID NO: 4105516 - DNA, 17 bp, Homo sapiens
gtttttactttctgttg

SEQ ID NO: 4105517 - DNA, 16 bp, Homo sapiens
gtttttatttctcctt

SEQ ID NO: 4105518 - DNA, 21 bp, Homo sapiens
gtttttcagcacccccaccca

SEQ ID NO: 4105519 - DNA, 17 bp, Homo sapiens
gtttttccctccccaga

SEQ ID NO: 4105520 - DNA, 13 bp, Homo sapiens
gtttttcctccca

SEQ ID NO: 4105521 - DNA, 15 bp, Homo sapiens
gtttttctcatgtat

SEQ ID NO: 4105522 - DNA, 17 bp, Homo sapiens
gtttttctgccagggag

SEQ ID NO: 4105523 - DNA, 23 bp, Homo sapiens
gtttttcttcaacatcaatgttc

SEQ ID NO: 4105524 - DNA, 12 bp, Homo sapiens
gtttttgctctc

SEQ ID NO: 4105525 - DNA, 13 bp, Homo sapiens
gtttttgcttctc

SEQ ID NO: 4105526 - DNA, 18 bp, Homo sapiens
gttttttaagatagtgta

SEQ ID NO: 4105527 - DNA, 19 bp, Homo sapiens
gttttttaagatagtgtaa

SEQ ID NO: 4105528 - DNA, 19 bp, Homo sapiens
gttttttagatcaaatact

SEQ ID NO: 4105529 - DNA, 13 bp, Homo sapiens
gttttttcctttg

SEQ ID NO: 4105530 - DNA, 16 bp, Homo sapiens
gttttttcctttgctc

SEQ ID NO: 4105531 - DNA, 12 bp, Homo sapiens
gttttttgaaaa

SEQ ID NO: 4105532 - DNA, 23 bp, Homo sapiens
gttttttgccacagcttttgcaa

SEQ ID NO: 4105533 - DNA, 18 bp, Homo sapiens
gtttttttacaacattca

SEQ ID NO: 4105534 - DNA, 16 bp, Homo sapiens
gttttttttttctcct

SEQ ID NO: 4105535 - DNA, 22 bp, Homo sapiens
taaaaaaaaaaaaaatgttctt

SEQ ID NO: 4105536 - DNA, 17 bp, Homo sapiens
taaaaaaaaaagttaca

SEQ ID NO: 4105537 - DNA, 10 bp, Homo sapiens
taaaaaaaga

SEQ ID NO: 4105538 - DNA, 15 bp, Homo sapiens
taaaaaaagaaaaaa

SEQ ID NO: 4105539 - DNA, 15 bp, Homo sapiens
taaaaaaagagaatt

SEQ ID NO: 4105540 - DNA, 20 bp, Homo sapiens
taaaaaaataataataatgt

SEQ ID NO: 4105541 - DNA, 13 bp, Homo sapiens
taaaaaaattggt

SEQ ID NO: 4105542 - DNA, 12 bp, Homo sapiens
taaaaaaattta

SEQ ID NO: 4105543 - DNA, 15 bp, Homo sapiens
taaaaaaatttaagt

SEQ ID NO: 4105544 - DNA, 16 bp, Homo sapiens
taaaaaaatttaagtg

SEQ ID NO: 4105545 - DNA, 17 bp, Homo sapiens
taaaaaaatttaagtgc

SEQ ID NO: 4105546 - DNA, 15 bp, Homo sapiens
taaaaaacttgtaaa

SEQ ID NO: 4105547 - DNA, 18 bp, Homo sapiens
taaaaaagctcttttaat

SEQ ID NO: 4105548 - DNA, 12 bp, Homo sapiens
taaaaaatggaa

SEQ ID NO: 4105549 - DNA, 19 bp, Homo sapiens
taaaaaatggttcagaatt

SEQ ID NO: 4105550 - DNA, 18 bp, Homo sapiens
taaaaacattttgaagtg

SEQ ID NO: 4105551 - DNA, 19 bp, Homo sapiens
taaaaacattttgaagtgt

SEQ ID NO: 4105552 - DNA, 14 bp, Homo sapiens
taaaaactcctttt

SEQ ID NO: 4105553 - DNA, 16 bp, Homo sapiens
taaaaagattagcaag

SEQ ID NO: 4105554 - DNA, 21 bp, Homo sapiens
taaaaagcagaattttaatgt

SEQ ID NO: 4105555 - DNA, 20 bp, Homo sapiens
taaaaagggcagggcatctc

SEQ ID NO: 4105556 - DNA, 15 bp, Homo sapiens
taaaaagtaagttaa

SEQ ID NO: 4105557 - DNA, 17 bp, Homo sapiens
taaaaagtgacacagca

SEQ ID NO: 4105558 - DNA, 18 bp, Homo sapiens
taaaaagtgacacagcag

SEQ ID NO: 4105559 - DNA, 12 bp, Homo sapiens
taaaaagttaat

SEQ ID NO: 4105560 - DNA, 14 bp, Homo sapiens
taaaaataaatccc

SEQ ID NO: 4105561 - DNA, 19 bp, Homo sapiens
taaaaatattgtttctgca

SEQ ID NO: 4105562 - DNA, 14 bp, Homo sapiens
taaaaatcacactg

SEQ ID NO: 4105563 - DNA, 18 bp, Homo sapiens
taaaaatgaaagtgactt

SEQ ID NO: 4105564 - DNA, 17 bp, Homo sapiens
taaaaatggcaaatgca

SEQ ID NO: 4105565 - DNA, 18 bp, Homo sapiens
taaaaatggcaaatgcac

SEQ ID NO: 4105566 - DNA, 13 bp, Homo sapiens
taaaaatgtaaat

SEQ ID NO: 4105567 - DNA, 18 bp, Homo sapiens
taaaaatgtaaatattct

SEQ ID NO: 4105568 - DNA, 22 bp, Homo sapiens
taaaaattgttaatttttccta

SEQ ID NO: 4105569 - DNA, 14 bp, Homo sapiens
taaaacaaaatctg

SEQ ID NO: 4105570 - DNA, 15 bp, Homo sapiens
taaaacaaaatctga

SEQ ID NO: 4105571 - DNA, 22 bp, Homo sapiens
taaaacagtatttattttgtaa

SEQ ID NO: 4105572 - DNA, 20 bp, Homo sapiens
taaaacattatagattttca

SEQ ID NO: 4105573 - DNA, 11 bp, Homo sapiens
taaaaccaaag

SEQ ID NO: 4105574 - DNA, 11 bp, Homo sapiens
taaaactaaga

SEQ ID NO: 4105575 - DNA, 20 bp, Homo sapiens
taaaactaagctctttgaga

SEQ ID NO: 4105576 - DNA, 23 bp, Homo sapiens
taaaactaggtaatgttttgtat

SEQ ID NO: 4105577 - DNA, 16 bp, Homo sapiens
taaaactcactgtgat

SEQ ID NO: 4105578 - DNA, 19 bp, Homo sapiens
taaaacttcttaaatatct

SEQ ID NO: 4105579 - DNA, 21 bp, Homo sapiens
taaaacttcttaaatatcttt

SEQ ID NO: 4105580 - DNA, 22 bp, Homo sapiens
taaaacttcttaaatatctttt

SEQ ID NO: 4105581 - DNA, 20 bp, Homo sapiens
taaaacttgatgtgttatct

SEQ ID NO: 4105582 - DNA, 13 bp, Homo sapiens
taaaactttcctc

SEQ ID NO: 4105583 - DNA, 14 bp, Homo sapiens
taaaactttgctgc

SEQ ID NO: 4105584 - DNA, 16 bp, Homo sapiens
taaaactttgctgcca

SEQ ID NO: 4105585 - DNA, 16 bp, Homo sapiens
taaaacttttctgctg

SEQ ID NO: 4105586 - DNA, 18 bp, Homo sapiens
taaaagaacttactgatt

SEQ ID NO: 4105587 - DNA, 18 bp, Homo sapiens
taaaagaattttaccatt

SEQ ID NO: 4105588 - DNA, 16 bp, Homo sapiens
taaaagagagagagag

SEQ ID NO: 4105589 - DNA, 22 bp, Homo sapiens
taaaagatgaagttttatacac

SEQ ID NO: 4105590 - DNA, 17 bp, Homo sapiens
taaaagcataaatgcaa

SEQ ID NO: 4105591 - DNA, 12 bp, Homo sapiens
taaaagctgtgg

SEQ ID NO: 4105592 - DNA, 14 bp, Homo sapiens
taaaagctgtggaa

SEQ ID NO: 4105593 - DNA, 15 bp, Homo sapiens
taaaagctgtggaat

SEQ ID NO: 4105594 - DNA, 14 bp, Homo sapiens
taaaaggaaaagca

SEQ ID NO: 4105595 - DNA, 19 bp, Homo sapiens
taaaagggtcaaacctgta

SEQ ID NO: 4105596 - DNA, 20 bp, Homo sapiens
taaaagggtcaaacctgtag

SEQ ID NO: 4105597 - DNA, 19 bp, Homo sapiens
taaaaggtgaccaatgatg

SEQ ID NO: 4105598 - DNA, 20 bp, Homo sapiens
taaaaggtggagtttctctg

SEQ ID NO: 4105599 - DNA, 13 bp, Homo sapiens
taaaagtaaacat

SEQ ID NO: 4105600 - DNA, 13 bp, Homo sapiens
taaaagtgatcaa

SEQ ID NO: 4105601 - DNA, 19 bp, Homo sapiens
taaaagtgggcttgattct

SEQ ID NO: 4105602 - DNA, 23 bp, Homo sapiens
taaaagtgggcttgattctgcag

SEQ ID NO: 4105603 - DNA, 16 bp, Homo sapiens
taaaagtttacaactt

SEQ ID NO: 4105604 - DNA, 20 bp, Homo sapiens
taaaagtttacaacttgatt

SEQ ID NO: 4105605 - DNA, 14 bp, Homo sapiens
taaaataaaatgaa

SEQ ID NO: 4105606 - DNA, 16 bp, Homo sapiens
taaaataaaatgaaaa

SEQ ID NO: 4105607 - DNA, 17 bp, Homo sapiens
taaaataaaatgaaaat

SEQ ID NO: 4105608 - DNA, 16 bp, Homo sapiens
gtttatttatcagtga

SEQ ID NO: 4105609 - DNA, 19 bp, Homo sapiens
gtttatttatcagtgacag

SEQ ID NO: 4105610 - DNA, 18 bp, Homo sapiens
gtttatttgttgttttct

SEQ ID NO: 4105611 - DNA, 14 bp, Homo sapiens
gtttatttttgtaa

SEQ ID NO: 4105612 - DNA, 22 bp, Homo sapiens
gtttcaaagtgatagaaaagtg

SEQ ID NO: 4105613 - DNA, 23 bp, Homo sapiens
gtttcaaccaagtcatgtgcatt

SEQ ID NO: 4105614 - DNA, 21 bp, Homo sapiens
gtttcactttcacatagatgt

SEQ ID NO: 4105615 - DNA, 12 bp, Homo sapiens
gtttcagacagg

SEQ ID NO: 4105616 - DNA, 13 bp, Homo sapiens
gtttcagaccccc

SEQ ID NO: 4105617 - DNA, 14 bp, Homo sapiens
gtttcagacccccc

SEQ ID NO: 4105618 - DNA, 21 bp, Homo sapiens
gtttcagctaagggaagacat

SEQ ID NO: 4105619 - DNA, 19 bp, Homo sapiens
gtttcaggatacatgtgcc

SEQ ID NO: 4105620 - DNA, 14 bp, Homo sapiens
gtttcaggtgacat

SEQ ID NO: 4105621 - DNA, 15 bp, Homo sapiens
gtttcaggtgacatg

SEQ ID NO: 4105622 - DNA, 12 bp, Homo sapiens
gtttcagtttga

SEQ ID NO: 4105623 - DNA, 19 bp, Homo sapiens
gtttcatttctactgtgac

SEQ ID NO: 4105624 - DNA, 16 bp, Homo sapiens
gtttccacagcctgca

SEQ ID NO: 4105625 - DNA, 19 bp, Homo sapiens
gtttccagacttccttgag

SEQ ID NO: 4105626 - DNA, 20 bp, Homo sapiens
gtttccagacttccttgaga

SEQ ID NO: 4105627 - DNA, 21 bp, Homo sapiens
gtttcccataattttcttcat

SEQ ID NO: 4105628 - DNA, 14 bp, Homo sapiens
gtttcccctctggc

SEQ ID NO: 4105629 - DNA, 17 bp, Homo sapiens
gtttcccctctggcttg

SEQ ID NO: 4105630 - DNA, 15 bp, Homo sapiens
gtttcccttgctttg

SEQ ID NO: 4105631 - DNA, 20 bp, Homo sapiens
gtttcctcattcctgaaaga

SEQ ID NO: 4105632 - DNA, 21 bp, Homo sapiens
gtttccttgaggggagccagg

SEQ ID NO: 4105633 - DNA, 18 bp, Homo sapiens
gtttctagctagaaatat

SEQ ID NO: 4105634 - DNA, 14 bp, Homo sapiens
gtttctcattcttg

SEQ ID NO: 4105635 - DNA, 20 bp, Homo sapiens
gtttctccttagttggctgg

SEQ ID NO: 4105636 - DNA, 19 bp, Homo sapiens
gtttctccttttcctatcc

SEQ ID NO: 4105637 - DNA, 16 bp, Homo sapiens
gtttctctctacagtg

SEQ ID NO: 4105638 - DNA, 19 bp, Homo sapiens
gtttctctctacagtgcca

SEQ ID NO: 4105639 - DNA, 12 bp, Homo sapiens
gtttctctgctg

SEQ ID NO: 4105640 - DNA, 13 bp, Homo sapiens
gtttctctgctgt

SEQ ID NO: 4105641 - DNA, 22 bp, Homo sapiens
gtttctgaaaatgtttaagtat

SEQ ID NO: 4105642 - DNA, 22 bp, Homo sapiens
gtttctgcatgaatatcataca

SEQ ID NO: 4105643 - DNA, 19 bp, Homo sapiens
gtttctgggtcctgaagaa

SEQ ID NO: 4105644 - DNA, 13 bp, Homo sapiens
gtttcttagcttt

SEQ ID NO: 4105645 - DNA, 16 bp, Homo sapiens
gtttctttgtgtttgc

SEQ ID NO: 4105646 - DNA, 22 bp, Homo sapiens
gtttcttttttttttttttaca

SEQ ID NO: 4105647 - DNA, 14 bp, Homo sapiens
gtttgaaaacttca

SEQ ID NO: 4105648 - DNA, 21 bp, Homo sapiens
gtttgaaaacttcagaagcaa

SEQ ID NO: 4105649 - DNA, 18 bp, Homo sapiens
gtttgaatatggacaaga

SEQ ID NO: 4105650 - DNA, 16 bp, Homo sapiens
gtttgactagatgatg

SEQ ID NO: 4105651 - DNA, 11 bp, Homo sapiens
gtttgagaaat

SEQ ID NO: 4105652 - DNA, 13 bp, Homo sapiens
gtttgagctgcct

SEQ ID NO: 4105653 - DNA, 19 bp, Homo sapiens
gtttgatgctatttatgca

SEQ ID NO: 4105654 - DNA, 18 bp, Homo sapiens
gtttgattgaggagctgc

SEQ ID NO: 4105655 - DNA, 15 bp, Homo sapiens
gtttgatttcattaa

SEQ ID NO: 4105656 - DNA, 20 bp, Homo sapiens
gtttgcaacctctttgctca

SEQ ID NO: 4105657 - DNA, 15 bp, Homo sapiens
gtttgcacctgtccc

SEQ ID NO: 4105658 - DNA, 11 bp, Homo sapiens
gtttgcagcct

SEQ ID NO: 4105659 - DNA, 18 bp, Homo sapiens
gtttgccacccctgtcca

SEQ ID NO: 4105660 - DNA, 20 bp, Homo sapiens
gtttgctcttttaagcagtc

SEQ ID NO: 4105661 - DNA, 12 bp, Homo sapiens
gtttgctgctat

SEQ ID NO: 4105662 - DNA, 18 bp, Homo sapiens
gtttgggcccctcagagc

SEQ ID NO: 4105663 - DNA, 22 bp, Homo sapiens
gtttggttcacttacagatagt

SEQ ID NO: 4105664 - DNA, 22 bp, Homo sapiens
gtttggtttttatttctccttt

SEQ ID NO: 4105665 - DNA, 10 bp, Homo sapiens
gtttgtaaat

SEQ ID NO: 4105666 - DNA, 15 bp, Homo sapiens
gtttgtaaataagag

SEQ ID NO: 4105667 - DNA, 17 bp, Homo sapiens
gtttgtaaataagagat

SEQ ID NO: 4105668 - DNA, 13 bp, Homo sapiens
gtttgtaaattat

SEQ ID NO: 4105669 - DNA, 20 bp, Homo sapiens
gtttgtcatcagatggaaat

SEQ ID NO: 4105670 - DNA, 14 bp, Homo sapiens
gtttgtctcttctg

SEQ ID NO: 4105671 - DNA, 15 bp, Homo sapiens
gtttgtctgtcttca

SEQ ID NO: 4105672 - DNA, 18 bp, Homo sapiens
gtttgtctgtcttcatag

SEQ ID NO: 4105673 - DNA, 14 bp, Homo sapiens
gtttgtggcctcag

SEQ ID NO: 4105674 - DNA, 16 bp, Homo sapiens
gtttgtggcctcagaa

SEQ ID NO: 4105675 - DNA, 19 bp, Homo sapiens
gtttgtggcgtctccctcg

SEQ ID NO: 4105676 - DNA, 13 bp, Homo sapiens
gtttgtggctggg

SEQ ID NO: 4105677 - DNA, 20 bp, Homo sapiens
gtttgtggctgggggcagga

SEQ ID NO: 4105678 - DNA, 15 bp, Homo sapiens
gtttgtgtgtcttaa

SEQ ID NO: 4105679 - DNA, 17 bp, Homo sapiens
gtttgttacataggtat

SEQ ID NO: 4105680 - DNA, 12 bp, Homo sapiens
gtttgttctccg

SEQ ID NO: 4105681 - DNA, 18 bp, Homo sapiens
gtttgtttcaagaacctg

SEQ ID NO: 4105682 - DNA, 23 bp, Homo sapiens
gtttgtttcatatatacaggcat

SEQ ID NO: 4105683 - DNA, 11 bp, Homo sapiens
gtttgtttgtc

SEQ ID NO: 4105684 - DNA, 17 bp, Homo sapiens
gtttgtttgtttgtctg

SEQ ID NO: 4105685 - DNA, 17 bp, Homo sapiens
gtttgtttttgctttct

SEQ ID NO: 4105686 - DNA, 17 bp, Homo sapiens
gtttgtttttttgccac

SEQ ID NO: 4105687 - DNA, 24 bp, Homo sapiens
gttttaaaataaaaattctgaatg

SEQ ID NO: 4105688 - DNA, 21 bp, Homo sapiens
gttttaaattatgtataaaca

SEQ ID NO: 4105689 - DNA, 14 bp, Homo sapiens
gttttaaattctga

SEQ ID NO: 4105690 - DNA, 20 bp, Homo sapiens
gttttaaccgcacatgcaca

SEQ ID NO: 4105691 - DNA, 16 bp, Homo sapiens
gttttaagtactacac

SEQ ID NO: 4105692 - DNA, 14 bp, Homo sapiens
gttttaatctgaaa

SEQ ID NO: 4105693 - DNA, 16 bp, Homo sapiens
gttttaatctgaaatt

SEQ ID NO: 4105694 - DNA, 21 bp, Homo sapiens
gttttacattgttgagctatt

SEQ ID NO: 4105695 - DNA, 13 bp, Homo sapiens
gttttatttttgc

SEQ ID NO: 4105696 - DNA, 17 bp, Homo sapiens
gttttcaaaataaaaat

SEQ ID NO: 4105697 - DNA, 17 bp, Homo sapiens
gttttcagtgtacatgg

SEQ ID NO: 4105698 - DNA, 22 bp, Homo sapiens
gttttcataataaaactttaaa

SEQ ID NO: 4105699 - DNA, 20 bp, Homo sapiens
gttttcattcattggtgaag

SEQ ID NO: 4105700 - DNA, 15 bp, Homo sapiens
gttttccatgaaaac

SEQ ID NO: 4105701 - DNA, 17 bp, Homo sapiens
gttttccatgaaaacgt

SEQ ID NO: 4105702 - DNA, 22 bp, Homo sapiens
gttttcctctatacatctctcc

SEQ ID NO: 4105703 - DNA, 17 bp, Homo sapiens
gttttctctcggctccc

SEQ ID NO: 4105704 - DNA, 15 bp, Homo sapiens
gttttctgtttgtaa

SEQ ID NO: 4105705 - DNA, 16 bp, Homo sapiens
gttttctgtttgtaaa

SEQ ID NO: 4105706 - DNA, 20 bp, Homo sapiens
gttttctttctttaaatgtt

SEQ ID NO: 4105707 - DNA, 21 bp, Homo sapiens
gttttgaaaagctattagcca

SEQ ID NO: 4105708 - DNA, 23 bp, Homo sapiens
gttttgaactaataaaagcataa

SEQ ID NO: 4105709 - DNA, 12 bp, Homo sapiens
gttttgaatttt

SEQ ID NO: 4105710 - DNA, 12 bp, Homo sapiens
gttttgagccct

SEQ ID NO: 4105711 - DNA, 22 bp, Homo sapiens
gttttgatttgtagcactgagg

SEQ ID NO: 4105712 - DNA, 18 bp, Homo sapiens
gttgcattagtaactttg

SEQ ID NO: 4105713 - DNA, 19 bp, Homo sapiens
gttgcatttagaaatcaag

SEQ ID NO: 4105714 - DNA, 13 bp, Homo sapiens
gttgcatttagct

SEQ ID NO: 4105715 - DNA, 22 bp, Homo sapiens
gttgcatttagcttctttccct

SEQ ID NO: 4105716 - DNA, 21 bp, Homo sapiens
gttgcccagcctctttccctt

SEQ ID NO: 4105717 - DNA, 20 bp, Homo sapiens
gttgcccgaaactaagccag

SEQ ID NO: 4105718 - DNA, 18 bp, Homo sapiens
gttgccctagcccagact

SEQ ID NO: 4105719 - DNA, 16 bp, Homo sapiens
gttgcctaataaacat

SEQ ID NO: 4105720 - DNA, 20 bp, Homo sapiens
gttgcctttatttgctgtta

SEQ ID NO: 4105721 - DNA, 16 bp, Homo sapiens
gttgcgacggagagaa

SEQ ID NO: 4105722 - DNA, 17 bp, Homo sapiens
gttgcgacggagagaaa

SEQ ID NO: 4105723 - DNA, 18 bp, Homo sapiens
gttgctcaaaaaatgagc

SEQ ID NO: 4105724 - DNA, 12 bp, Homo sapiens
gttgctcagctc

SEQ ID NO: 4105725 - DNA, 14 bp, Homo sapiens
gttgctcagctcct

SEQ ID NO: 4105726 - DNA, 22 bp, Homo sapiens
gttgctcagtctccctttccct

SEQ ID NO: 4105727 - DNA, 19 bp, Homo sapiens
gttgctgtgtttaatttga

SEQ ID NO: 4105728 - DNA, 15 bp, Homo sapiens
gttggaaaagaatac

SEQ ID NO: 4105729 - DNA, 20 bp, Homo sapiens
gttggaaaagaatacagaaa

SEQ ID NO: 4105730 - DNA, 13 bp, Homo sapiens
gttggaaccgtgt

SEQ ID NO: 4105731 - DNA, 14 bp, Homo sapiens
gttggaaccgtgtc

SEQ ID NO: 4105732 - DNA, 20 bp, Homo sapiens
gttggacatttttttcgaat

SEQ ID NO: 4105733 - DNA, 18 bp, Homo sapiens
gttggagtactatattta

SEQ ID NO: 4105734 - DNA, 19 bp, Homo sapiens
gttggatgggagtgggcac

SEQ ID NO: 4105735 - DNA, 18 bp, Homo sapiens
gttggatttataaatgct

SEQ ID NO: 4105736 - DNA, 13 bp, Homo sapiens
gttggcacctgca

SEQ ID NO: 4105737 - DNA, 16 bp, Homo sapiens
gttggcacctgcacac

SEQ ID NO: 4105738 - DNA, 15 bp, Homo sapiens
gttggccggcggcta

SEQ ID NO: 4105739 - DNA, 19 bp, Homo sapiens
gttggccgtggtccagctc

SEQ ID NO: 4105740 - DNA, 14 bp, Homo sapiens
gttggctatttgaa

SEQ ID NO: 4105741 - DNA, 12 bp, Homo sapiens
gttggctggggt

SEQ ID NO: 4105742 - DNA, 14 bp, Homo sapiens
gttgggactcagga

SEQ ID NO: 4105743 - DNA, 14 bp, Homo sapiens
gttgggagcactgg

SEQ ID NO: 4105744 - DNA, 15 bp, Homo sapiens
gttgggagcactgga

SEQ ID NO: 4105745 - DNA, 16 bp, Homo sapiens
gttgggagcctagctc

SEQ ID NO: 4105746 - DNA, 22 bp, Homo sapiens
gttgggcagggtgaccctgaag

SEQ ID NO: 4105747 - DNA, 21 bp, Homo sapiens
gttgggctatagcacacagtt

SEQ ID NO: 4105748 - DNA, 17 bp, Homo sapiens
gttggggagggatgaag

SEQ ID NO: 4105749 - DNA, 17 bp, Homo sapiens
gttgggggcagattggg

SEQ ID NO: 4105750 - DNA, 13 bp, Homo sapiens
gttggggtgacag

SEQ ID NO: 4105751 - DNA, 15 bp, Homo sapiens
gttggggtgacagtc

SEQ ID NO: 4105752 - DNA, 14 bp, Homo sapiens
gttggtaaacagtt

SEQ ID NO: 4105753 - DNA, 22 bp, Homo sapiens
gttggtccagagcggaggctgt

SEQ ID NO: 4105754 - DNA, 13 bp, Homo sapiens
gttggtgttggct

SEQ ID NO: 4105755 - DNA, 16 bp, Homo sapiens
gttggttgtgtctttt

SEQ ID NO: 4105756 - DNA, 14 bp, Homo sapiens
gttgtaaatattta

SEQ ID NO: 4105757 - DNA, 18 bp, Homo sapiens
gttgtaactaggctcaga

SEQ ID NO: 4105758 - DNA, 19 bp, Homo sapiens
gttgtaactaggctcagag

SEQ ID NO: 4105759 - DNA, 14 bp, Homo sapiens
gttgtacaaatgta

SEQ ID NO: 4105760 - DNA, 16 bp, Homo sapiens
gttgtacatttatgat

SEQ ID NO: 4105761 - DNA, 21 bp, Homo sapiens
gttgtcaatattaaatacaga

SEQ ID NO: 4105762 - DNA, 13 bp, Homo sapiens
gttgtccctctgc

SEQ ID NO: 4105763 - DNA, 17 bp, Homo sapiens
gttgtccctctgctacg

SEQ ID NO: 4105764 - DNA, 23 bp, Homo sapiens
gttgtcctatggacaacttattt

SEQ ID NO: 4105765 - DNA, 12 bp, Homo sapiens
gttgtctcttct

SEQ ID NO: 4105766 - DNA, 14 bp, Homo sapiens
gttgtctcttctcc

SEQ ID NO: 4105767 - DNA, 15 bp, Homo sapiens
gttgtcttattgcac

SEQ ID NO: 4105768 - DNA, 23 bp, Homo sapiens
gttgtgactctaagctcagtgct

SEQ ID NO: 4105769 - DNA, 13 bp, Homo sapiens
gttgtgaggcctg

SEQ ID NO: 4105770 - DNA, 14 bp, Homo sapiens
gttgtgaggcctgg

SEQ ID NO: 4105771 - DNA, 14 bp, Homo sapiens
gttgtggttaatct

SEQ ID NO: 4105772 - DNA, 12 bp, Homo sapiens
gttgtgttcctg

SEQ ID NO: 4105773 - DNA, 13 bp, Homo sapiens
gttgtgttcctgg

SEQ ID NO: 4105774 - DNA, 17 bp, Homo sapiens
gttgtgttcctggctga

SEQ ID NO: 4105775 - DNA, 16 bp, Homo sapiens
gttgttaatgaaaatg

SEQ ID NO: 4105776 - DNA, 18 bp, Homo sapiens
gttgttaatgaaaatgtc

SEQ ID NO: 4105777 - DNA, 19 bp, Homo sapiens
gttgttaatgaaaatgtca

SEQ ID NO: 4105778 - DNA, 17 bp, Homo sapiens
gttgttatgtgatcatg

SEQ ID NO: 4105779 - DNA, 13 bp, Homo sapiens
gttgtttgctttg

SEQ ID NO: 4105780 - DNA, 20 bp, Homo sapiens
gttgttttttcctttgctct

SEQ ID NO: 4105781 - DNA, 16 bp, Homo sapiens
gtttaaaaagtttcac

SEQ ID NO: 4105782 - DNA, 13 bp, Homo sapiens
gtttaaaacagta

SEQ ID NO: 4105783 - DNA, 13 bp, Homo sapiens
gtttaaaattcag

SEQ ID NO: 4105784 - DNA, 16 bp, Homo sapiens
gtttaaaattcagttt

SEQ ID NO: 4105785 - DNA, 20 bp, Homo sapiens
gtttaaaattcagtttttgt

SEQ ID NO: 4105786 - DNA, 14 bp, Homo sapiens
gtttaaatcatgta

SEQ ID NO: 4105787 - DNA, 17 bp, Homo sapiens
gtttaaatcatgtatgt

SEQ ID NO: 4105788 - DNA, 18 bp, Homo sapiens
gtttaagaaaagtatttt

SEQ ID NO: 4105789 - DNA, 15 bp, Homo sapiens
gtttaatagactgag

SEQ ID NO: 4105790 - DNA, 17 bp, Homo sapiens
gtttaatattgagaaag

SEQ ID NO: 4105791 - DNA, 19 bp, Homo sapiens
gtttaatattgagaaagaa

SEQ ID NO: 4105792 - DNA, 12 bp, Homo sapiens
gtttaatattta

SEQ ID NO: 4105793 - DNA, 18 bp, Homo sapiens
gtttaatgggtatgctca

SEQ ID NO: 4105794 - DNA, 21 bp, Homo sapiens
gtttaatgggtatgctcaggt

SEQ ID NO: 4105795 - DNA, 19 bp, Homo sapiens
gtttaattgtttgtcctca

SEQ ID NO: 4105796 - DNA, 20 bp, Homo sapiens
gtttaatttttatttcttcc

SEQ ID NO: 4105797 - DNA, 13 bp, Homo sapiens
gtttacatgtgta

SEQ ID NO: 4105798 - DNA, 11 bp, Homo sapiens
gtttacattta

SEQ ID NO: 4105799 - DNA, 14 bp, Homo sapiens
gtttacatttaaag

SEQ ID NO: 4105800 - DNA, 18 bp, Homo sapiens
gtttaccatttgtaataa

SEQ ID NO: 4105801 - DNA, 16 bp, Homo sapiens
gtttacccatgaagat

SEQ ID NO: 4105802 - DNA, 21 bp, Homo sapiens
gtttactatgtgccagttcct

SEQ ID NO: 4105803 - DNA, 19 bp, Homo sapiens
gtttacttttcagggcatc

SEQ ID NO: 4105804 - DNA, 15 bp, Homo sapiens
gtttagaagctgaga

SEQ ID NO: 4105805 - DNA, 18 bp, Homo sapiens
gtttataatctgaagata

SEQ ID NO: 4105806 - DNA, 19 bp, Homo sapiens
gtttataatctgaagatat

SEQ ID NO: 4105807 - DNA, 22 bp, Homo sapiens
gtttatatacagtacacagata

SEQ ID NO: 4105808 - DNA, 12 bp, Homo sapiens
gtttatatactg

SEQ ID NO: 4105809 - DNA, 23 bp, Homo sapiens
gtttatcagatacatcactgctt

SEQ ID NO: 4105810 - DNA, 15 bp, Homo sapiens
gtttatgatatttct

SEQ ID NO: 4105811 - DNA, 21 bp, Homo sapiens
gtttatgatatttcttgcttt

SEQ ID NO: 4105812 - DNA, 18 bp, Homo sapiens
gtttatgtaaatgtttgt

SEQ ID NO: 4105813 - DNA, 18 bp, Homo sapiens
gtttattaacaaattatg

SEQ ID NO: 4105814 - DNA, 15 bp, Homo sapiens
gtttattcagtaaac

SEQ ID NO: 4105815 - DNA, 17 bp, Homo sapiens
gtttattcatccagcag

SEQ ID NO: 4105816 - DNA, 22 bp, Homo sapiens
gttcccaggtacctcatgggaa

SEQ ID NO: 4105817 - DNA, 19 bp, Homo sapiens
gttcccatgtagccccctg

SEQ ID NO: 4105818 - DNA, 19 bp, Homo sapiens
gttcccgtttctccaccta

SEQ ID NO: 4105819 - DNA, 19 bp, Homo sapiens
gttccctcctagctctccc

SEQ ID NO: 4105820 - DNA, 21 bp, Homo sapiens
gttccctcctagctctcccag

SEQ ID NO: 4105821 - DNA, 15 bp, Homo sapiens
gttccctctgctcag

SEQ ID NO: 4105822 - DNA, 16 bp, Homo sapiens
gttccctgttcttcct

SEQ ID NO: 4105823 - DNA, 16 bp, Homo sapiens
gttcccttggcctcag

SEQ ID NO: 4105824 - DNA, 14 bp, Homo sapiens
gttccgcactttcc

SEQ ID NO: 4105825 - DNA, 23 bp, Homo sapiens
gttccgcactttccacttcttcc

SEQ ID NO: 4105826 - DNA, 15 bp, Homo sapiens
gttcctcaaattttt

SEQ ID NO: 4105827 - DNA, 14 bp, Homo sapiens
gttcctctgcctgc

SEQ ID NO: 4105828 - DNA, 23 bp, Homo sapiens
gttcctctgctcaccgcccatca

SEQ ID NO: 4105829 - DNA, 23 bp, Homo sapiens
gttcctggctgatgatccagaac

SEQ ID NO: 4105830 - DNA, 15 bp, Homo sapiens
gttccttatccctct

SEQ ID NO: 4105831 - DNA, 19 bp, Homo sapiens
gttcctttgtgtgtactca

SEQ ID NO: 4105832 - DNA, 16 bp, Homo sapiens
gttcctttttaaatgt

SEQ ID NO: 4105833 - DNA, 18 bp, Homo sapiens
gttcctttttaaatgtga

SEQ ID NO: 4105834 - DNA, 19 bp, Homo sapiens
gttcctttttaaatgtgaa

SEQ ID NO: 4105835 - DNA, 21 bp, Homo sapiens
gttcgaaatagatatcctctc

SEQ ID NO: 4105836 - DNA, 20 bp, Homo sapiens
gttcgcatggtcacacactg

SEQ ID NO: 4105837 - DNA, 16 bp, Homo sapiens
gttcgggtgtgcaatg

SEQ ID NO: 4105838 - DNA, 18 bp, Homo sapiens
gttctaattttggatgga

SEQ ID NO: 4105839 - DNA, 20 bp, Homo sapiens
gttctacagtcgtaaaagag

SEQ ID NO: 4105840 - DNA, 20 bp, Homo sapiens
gttctacctcaggcagctca

SEQ ID NO: 4105841 - DNA, 15 bp, Homo sapiens
gttctagaaccactt

SEQ ID NO: 4105842 - DNA, 23 bp, Homo sapiens
gttctaggggagaagagccctgg

SEQ ID NO: 4105843 - DNA, 14 bp, Homo sapiens
gttctagtctcctt

SEQ ID NO: 4105844 - DNA, 18 bp, Homo sapiens
gttctatgaagagtatta

SEQ ID NO: 4105845 - DNA, 16 bp, Homo sapiens
gttctatggttatgaa

SEQ ID NO: 4105846 - DNA, 20 bp, Homo sapiens
gttctatggttatgaaagaa

SEQ ID NO: 4105847 - DNA, 22 bp, Homo sapiens
gttctattaatcacctctctgt

SEQ ID NO: 4105848 - DNA, 13 bp, Homo sapiens
gttctattttctt

SEQ ID NO: 4105849 - DNA, 21 bp, Homo sapiens
gttctcacactggtctgctgt

SEQ ID NO: 4105850 - DNA, 12 bp, Homo sapiens
gttctcagagcc

SEQ ID NO: 4105851 - DNA, 16 bp, Homo sapiens
gttctcagagccaagt

SEQ ID NO: 4105852 - DNA, 17 bp, Homo sapiens
gttctcaggtgttgcca

SEQ ID NO: 4105853 - DNA, 20 bp, Homo sapiens
gttctccgggtgtggcctca

SEQ ID NO: 4105854 - DNA, 13 bp, Homo sapiens
gttctccttttcc

SEQ ID NO: 4105855 - DNA, 16 bp, Homo sapiens
gttctctccaggaagg

SEQ ID NO: 4105856 - DNA, 21 bp, Homo sapiens
gttctctctactggtcctctt

SEQ ID NO: 4105857 - DNA, 17 bp, Homo sapiens
gttctgacattaacagt

SEQ ID NO: 4105858 - DNA, 23 bp, Homo sapiens
gttctgacattaacagttttcca

SEQ ID NO: 4105859 - DNA, 15 bp, Homo sapiens
gttctgaggtccctg

SEQ ID NO: 4105860 - DNA, 18 bp, Homo sapiens
gttctgattagaaatgac

SEQ ID NO: 4105861 - DNA, 20 bp, Homo sapiens
gttctgattagaaatgacca

SEQ ID NO: 4105862 - DNA, 21 bp, Homo sapiens
gttctgcagacacgccttccc

SEQ ID NO: 4105863 - DNA, 15 bp, Homo sapiens
gttctgccagatctt

SEQ ID NO: 4105864 - DNA, 23 bp, Homo sapiens
gttctgcctgccagctgcactga

SEQ ID NO: 4105865 - DNA, 12 bp, Homo sapiens
gttctgctcctg

SEQ ID NO: 4105866 - DNA, 14 bp, Homo sapiens
gttctgctcctgct

SEQ ID NO: 4105867 - DNA, 15 bp, Homo sapiens
gttctgctgcccctg

SEQ ID NO: 4105868 - DNA, 17 bp, Homo sapiens
gttctgctgcccctgca

SEQ ID NO: 4105869 - DNA, 19 bp, Homo sapiens
gttctgctggcctggatct

SEQ ID NO: 4105870 - DNA, 17 bp, Homo sapiens
gttctgctttatctttt

SEQ ID NO: 4105871 - DNA, 20 bp, Homo sapiens
gttctggaaaagaactgttt

SEQ ID NO: 4105872 - DNA, 17 bp, Homo sapiens
gttctggacctgggcat

SEQ ID NO: 4105873 - DNA, 13 bp, Homo sapiens
gttctggccagaa

SEQ ID NO: 4105874 - DNA, 17 bp, Homo sapiens
gttctggcctcagacca

SEQ ID NO: 4105875 - DNA, 13 bp, Homo sapiens
gttctgggctcag

SEQ ID NO: 4105876 - DNA, 15 bp, Homo sapiens
gttctgtgaagagga

SEQ ID NO: 4105877 - DNA, 18 bp, Homo sapiens
gttctgtttgttattgtt

SEQ ID NO: 4105878 - DNA, 15 bp, Homo sapiens
gttcttaaaaaggaa

SEQ ID NO: 4105879 - DNA, 23 bp, Homo sapiens
gttcttaaagtttaaagttgcac

SEQ ID NO: 4105880 - DNA, 14 bp, Homo sapiens
gttcttccaaagca

SEQ ID NO: 4105881 - DNA, 19 bp, Homo sapiens
gttcttctttctctgtatt

SEQ ID NO: 4105882 - DNA, 18 bp, Homo sapiens
gttcttggtgactgtccc

SEQ ID NO: 4105883 - DNA, 15 bp, Homo sapiens
gttcttggtgctctg

SEQ ID NO: 4105884 - DNA, 17 bp, Homo sapiens
gttctttaggagatttt

SEQ ID NO: 4105885 - DNA, 19 bp, Homo sapiens
gttctttcctccccctgca

SEQ ID NO: 4105886 - DNA, 13 bp, Homo sapiens
gttctttcctgcc

SEQ ID NO: 4105887 - DNA, 17 bp, Homo sapiens
gttctttcctgccctgt

SEQ ID NO: 4105888 - DNA, 19 bp, Homo sapiens
gttctttcctgccctgtcc

SEQ ID NO: 4105889 - DNA, 15 bp, Homo sapiens
gttctttgggccaga

SEQ ID NO: 4105890 - DNA, 16 bp, Homo sapiens
gttctttgggccagac

SEQ ID NO: 4105891 - DNA, 17 bp, Homo sapiens
gttctttgggccagaca

SEQ ID NO: 4105892 - DNA, 18 bp, Homo sapiens
gttgaaaggcctcaagaa

SEQ ID NO: 4105893 - DNA, 14 bp, Homo sapiens
gttgaaaggttttt

SEQ ID NO: 4105894 - DNA, 16 bp, Homo sapiens
gttgaagactttgttt

SEQ ID NO: 4105895 - DNA, 22 bp, Homo sapiens
gttgaagctaagatttagagat

SEQ ID NO: 4105896 - DNA, 22 bp, Homo sapiens
gttgaagggaggtggcaagagt

SEQ ID NO: 4105897 - DNA, 16 bp, Homo sapiens
gttgaagtcatgctcc

SEQ ID NO: 4105898 - DNA, 19 bp, Homo sapiens
gttgaagtcatgctcccct

SEQ ID NO: 4105899 - DNA, 13 bp, Homo sapiens
gttgaatactttt

SEQ ID NO: 4105900 - DNA, 17 bp, Homo sapiens
gttgaatactttttaca

SEQ ID NO: 4105901 - DNA, 19 bp, Homo sapiens
gttgacacagttgtagggt

SEQ ID NO: 4105902 - DNA, 22 bp, Homo sapiens
gttgactcacaggccctggaga

SEQ ID NO: 4105903 - DNA, 19 bp, Homo sapiens
gttgagaatcccaaatttg

SEQ ID NO: 4105904 - DNA, 18 bp, Homo sapiens
gttgagaggacactcccg

SEQ ID NO: 4105905 - DNA, 21 bp, Homo sapiens
gttgagcttcatataccagca

SEQ ID NO: 4105906 - DNA, 23 bp, Homo sapiens
gttgaggtggtctgaatgttctg

SEQ ID NO: 4105907 - DNA, 16 bp, Homo sapiens
gttgaggtttttaaat

SEQ ID NO: 4105908 - DNA, 14 bp, Homo sapiens
gttgagtctcctct

SEQ ID NO: 4105909 - DNA, 20 bp, Homo sapiens
gttgagtctcctctctgaga

SEQ ID NO: 4105910 - DNA, 23 bp, Homo sapiens
gttgagtctcctctctgagactg

SEQ ID NO: 4105911 - DNA, 20 bp, Homo sapiens
gttgatatttcgaaagctgc

SEQ ID NO: 4105912 - DNA, 14 bp, Homo sapiens
gttgatgactttct

SEQ ID NO: 4105913 - DNA, 13 bp, Homo sapiens
gttgatggaaaat

SEQ ID NO: 4105914 - DNA, 14 bp, Homo sapiens
gttgatggaaaata

SEQ ID NO: 4105915 - DNA, 19 bp, Homo sapiens
gttgatgggggccaggaca

SEQ ID NO: 4105916 - DNA, 13 bp, Homo sapiens
gttgcaaccactg

SEQ ID NO: 4105917 - DNA, 14 bp, Homo sapiens
gttgcaagatgtga

SEQ ID NO: 4105918 - DNA, 16 bp, Homo sapiens
gttgcattagtaactt

SEQ ID NO: 4105919 - DNA, 17 bp, Homo sapiens
gtggatgacagggcaga

SEQ ID NO: 4105920 - DNA, 13 bp, Homo sapiens
gtggatgactgtt

SEQ ID NO: 4105921 - DNA, 18 bp, Homo sapiens
gtggattcttgttttgct

SEQ ID NO: 4105922 - DNA, 22 bp, Homo sapiens
gtggattcttgttttgcttccc

SEQ ID NO: 4105923 - DNA, 12 bp, Homo sapiens
gtggattttcta

SEQ ID NO: 4105924 - DNA, 15 bp, Homo sapiens
gtggatttttttgtc

SEQ ID NO: 4105925 - DNA, 14 bp, Homo sapiens
gtggcaccagatgc

SEQ ID NO: 4105926 - DNA, 20 bp, Homo sapiens
gtggcaccagatgcaacctc

SEQ ID NO: 4105927 - DNA, 18 bp, Homo sapiens
gtggcacctgtctgctcc

SEQ ID NO: 4105928 - DNA, 19 bp, Homo sapiens
gtggcactcaactctgagc

SEQ ID NO: 4105929 - DNA, 21 bp, Homo sapiens
gtggcactggtaggttgggac

SEQ ID NO: 4105930 - DNA, 22 bp, Homo sapiens
gtggcactggtaggttgggaca

SEQ ID NO: 4105931 - DNA, 19 bp, Homo sapiens
gtggcagattttacaaaag

SEQ ID NO: 4105932 - DNA, 22 bp, Homo sapiens
gtggcagattttacaaaagatg

SEQ ID NO: 4105933 - DNA, 13 bp, Homo sapiens
gtggcaggaccag

SEQ ID NO: 4105934 - DNA, 21 bp, Homo sapiens
gtggcaggcacacagcagccc

SEQ ID NO: 4105935 - DNA, 22 bp, Homo sapiens
gtggcaggcacacagcagcccc

SEQ ID NO: 4105936 - DNA, 22 bp, Homo sapiens
gtggcagggggccccgccaggg

SEQ ID NO: 4105937 - DNA, 21 bp, Homo sapiens
gtggcatctttgccttgggct

SEQ ID NO: 4105938 - DNA, 16 bp, Homo sapiens
gtggcatgtgctgtga

SEQ ID NO: 4105939 - DNA, 21 bp, Homo sapiens
gtggcattggggggccgggca

SEQ ID NO: 4105940 - DNA, 11 bp, Homo sapiens
gtggccacagc

SEQ ID NO: 4105941 - DNA, 13 bp, Homo sapiens
gtggccaccagta

SEQ ID NO: 4105942 - DNA, 21 bp, Homo sapiens
gtggccactccagacccctgg

SEQ ID NO: 4105943 - DNA, 18 bp, Homo sapiens
gtggcccgacagcctggc

SEQ ID NO: 4105944 - DNA, 18 bp, Homo sapiens
gtggccgtctcctccctc

SEQ ID NO: 4105945 - DNA, 12 bp, Homo sapiens
gtggcctcagaa

SEQ ID NO: 4105946 - DNA, 11 bp, Homo sapiens
gtggcctcagc

SEQ ID NO: 4105947 - DNA, 13 bp, Homo sapiens
gtggcctcagccc

SEQ ID NO: 4105948 - DNA, 23 bp, Homo sapiens
gtggcctcagctgaatgcctcct

SEQ ID NO: 4105949 - DNA, 21 bp, Homo sapiens
gtggcctcttgagcagtggct

SEQ ID NO: 4105950 - DNA, 20 bp, Homo sapiens
gtggcctggccaggagctct

SEQ ID NO: 4105951 - DNA, 21 bp, Homo sapiens
gtggcctgtttctgcagccct

SEQ ID NO: 4105952 - DNA, 14 bp, Homo sapiens
gtggcctttgtgct

SEQ ID NO: 4105953 - DNA, 20 bp, Homo sapiens
gtggcgactctatagactct

SEQ ID NO: 4105954 - DNA, 15 bp, Homo sapiens
gtggcgggcgcctgt

SEQ ID NO: 4105955 - DNA, 21 bp, Homo sapiens
gtggctcaagtctggccccac

SEQ ID NO: 4105956 - DNA, 15 bp, Homo sapiens
gtggctcagccagca

SEQ ID NO: 4105957 - DNA, 20 bp, Homo sapiens
gtggctcctcccggtgccca

SEQ ID NO: 4105958 - DNA, 18 bp, Homo sapiens
gtggctgaggaggcctcc

SEQ ID NO: 4105959 - DNA, 19 bp, Homo sapiens
gtggctgccacacccaggg

SEQ ID NO: 4105960 - DNA, 22 bp, Homo sapiens
gtggctggctctaccttcctgt

SEQ ID NO: 4105961 - DNA, 12 bp, Homo sapiens
gtggctgggcag

SEQ ID NO: 4105962 - DNA, 11 bp, Homo sapiens
gtggctggggg

SEQ ID NO: 4105963 - DNA, 16 bp, Homo sapiens
gtggctgggggcagga

SEQ ID NO: 4105964 - DNA, 17 bp, Homo sapiens
gtggctgggggcaggag

SEQ ID NO: 4105965 - DNA, 12 bp, Homo sapiens
gtggctgggtgg

SEQ ID NO: 4105966 - DNA, 17 bp, Homo sapiens
gtggctggtccagggct

SEQ ID NO: 4105967 - DNA, 18 bp, Homo sapiens
gtggcttcccgctcagcc

SEQ ID NO: 4105968 - DNA, 16 bp, Homo sapiens
gtggctttccaggcac

SEQ ID NO: 4105969 - DNA, 18 bp, Homo sapiens
gtggctttggcagtgttt

SEQ ID NO: 4105970 - DNA, 21 bp, Homo sapiens
gtgggaagagggggctggcca

SEQ ID NO: 4105971 - DNA, 23 bp, Homo sapiens
gtgggaaggacttggcgcgccct

SEQ ID NO: 4105972 - DNA, 21 bp, Homo sapiens
gtgggacagcccagagcctgg

SEQ ID NO: 4105973 - DNA, 14 bp, Homo sapiens
gtgggacagtggtg

SEQ ID NO: 4105974 - DNA, 15 bp, Homo sapiens
gtgggagggagcaga

SEQ ID NO: 4105975 - DNA, 17 bp, Homo sapiens
gtgggaggtggaagaag

SEQ ID NO: 4105976 - DNA, 15 bp, Homo sapiens
gtgggatcctccctc

SEQ ID NO: 4105977 - DNA, 16 bp, Homo sapiens
gtgggatcctccctca

SEQ ID NO: 4105978 - DNA, 20 bp, Homo sapiens
gtgggatcctccctcatggc

SEQ ID NO: 4105979 - DNA, 21 bp, Homo sapiens
gtgggcagagcccccaggaag

SEQ ID NO: 4105980 - DNA, 17 bp, Homo sapiens
gtgggcagcaccctccc

SEQ ID NO: 4105981 - DNA, 23 bp, Homo sapiens
gtgggcagcctatgggggctctc

SEQ ID NO: 4105982 - DNA, 19 bp, Homo sapiens
gtgggcatgccaccctcac

SEQ ID NO: 4105983 - DNA, 17 bp, Homo sapiens
gtgggcattctctctcc

SEQ ID NO: 4105984 - DNA, 17 bp, Homo sapiens
gtgggccaacaaagaac

SEQ ID NO: 4105985 - DNA, 22 bp, Homo sapiens
gtgggcccagaactgcccccac

SEQ ID NO: 4105986 - DNA, 18 bp, Homo sapiens
gtgggccccttagcaatg

SEQ ID NO: 4105987 - DNA, 18 bp, Homo sapiens
gtgggcgttgggagccta

SEQ ID NO: 4105988 - DNA, 20 bp, Homo sapiens
gtgggcgttgggagcctagc

SEQ ID NO: 4105989 - DNA, 16 bp, Homo sapiens
gtgggctacatgctgg

SEQ ID NO: 4105990 - DNA, 15 bp, Homo sapiens
gtgggctgcatctgg

SEQ ID NO: 4105991 - DNA, 15 bp, Homo sapiens
gtgggcttcctgccc

SEQ ID NO: 4105992 - DNA, 14 bp, Homo sapiens
gtgggcttgattct

SEQ ID NO: 4105993 - DNA, 18 bp, Homo sapiens
gtggggacacagcagtga

SEQ ID NO: 4105994 - DNA, 17 bp, Homo sapiens
gtggggagatgcttctc

SEQ ID NO: 4105995 - DNA, 14 bp, Homo sapiens
gtggggcgaggcag

SEQ ID NO: 4105996 - DNA, 13 bp, Homo sapiens
gtggggctccccg

SEQ ID NO: 4105997 - DNA, 21 bp, Homo sapiens
gtgggggccaaacctgggacc

SEQ ID NO: 4105998 - DNA, 14 bp, Homo sapiens
gtgggggggcagag

SEQ ID NO: 4105999 - DNA, 14 bp, Homo sapiens
gtgggggtggccat

SEQ ID NO: 4106000 - DNA, 18 bp, Homo sapiens
gtgggggttgctgtataa

SEQ ID NO: 4106001 - DNA, 23 bp, Homo sapiens
gtggggtggagtcgcagaccaga

SEQ ID NO: 4106002 - DNA, 19 bp, Homo sapiens
gtgggtctatgttccccag

SEQ ID NO: 4106003 - DNA, 13 bp, Homo sapiens
gtgggtctgggag

SEQ ID NO: 4106004 - DNA, 20 bp, Homo sapiens
gtgggtgaaggcctggctgg

SEQ ID NO: 4106005 - DNA, 16 bp, Homo sapiens
gtgggtgctgccctgt

SEQ ID NO: 4106006 - DNA, 20 bp, Homo sapiens
gtgggtgttctttcctgccc

SEQ ID NO: 4106007 - DNA, 16 bp, Homo sapiens
gtgggttattctggag

SEQ ID NO: 4106008 - DNA, 12 bp, Homo sapiens
gtggtagaaaca

SEQ ID NO: 4106009 - DNA, 13 bp, Homo sapiens
gtggtagaaacaa

SEQ ID NO: 4106010 - DNA, 13 bp, Homo sapiens
gtggtatgtgaca

SEQ ID NO: 4106011 - DNA, 14 bp, Homo sapiens
gtggtcactgtgca

SEQ ID NO: 4106012 - DNA, 19 bp, Homo sapiens
gtggtcactgtgcactgcc

SEQ ID NO: 4106013 - DNA, 13 bp, Homo sapiens
gtggtcagatgca

SEQ ID NO: 4106014 - DNA, 18 bp, Homo sapiens
gtggtccaaccaggagct

SEQ ID NO: 4106015 - DNA, 12 bp, Homo sapiens
gtggtccagctc

SEQ ID NO: 4106016 - DNA, 15 bp, Homo sapiens
gtggtccagctcttg

SEQ ID NO: 4106017 - DNA, 21 bp, Homo sapiens
gtggtccatgcccactgctgg

SEQ ID NO: 4106018 - DNA, 12 bp, Homo sapiens
gtggtctcagga

SEQ ID NO: 4106019 - DNA, 13 bp, Homo sapiens
gtggtctcaggat

SEQ ID NO: 4106020 - DNA, 13 bp, Homo sapiens
gtggtctgaatgt

SEQ ID NO: 4106021 - DNA, 20 bp, Homo sapiens
gtggtctgaatgttctgaca

SEQ ID NO: 4106022 - DNA, 14 bp, Homo sapiens
gtgccggctgtgga

SEQ ID NO: 4106023 - DNA, 22 bp, Homo sapiens
gtgccgtagggagtacctgctg

SEQ ID NO: 4106024 - DNA, 18 bp, Homo sapiens
gtgccgtgtgagtgtgac

SEQ ID NO: 4106025 - DNA, 13 bp, Homo sapiens
gtgcctcccagct

SEQ ID NO: 4106026 - DNA, 20 bp, Homo sapiens
gtgcctcctcagaggacagt

SEQ ID NO: 4106027 - DNA, 21 bp, Homo sapiens
gtgcctccttccacctccctc

SEQ ID NO: 4106028 - DNA, 18 bp, Homo sapiens
gtgcctctgcggggcagg

SEQ ID NO: 4106029 - DNA, 21 bp, Homo sapiens
gtgcctctgcggggcagggcc

SEQ ID NO: 4106030 - DNA, 13 bp, Homo sapiens
gtgcctctgggac

SEQ ID NO: 4106031 - DNA, 15 bp, Homo sapiens
gtgcctctgggactg

SEQ ID NO: 4106032 - DNA, 14 bp, Homo sapiens
gtgcctgagaggca

SEQ ID NO: 4106033 - DNA, 18 bp, Homo sapiens
gtgcctgagaggcaggca

SEQ ID NO: 4106034 - DNA, 12 bp, Homo sapiens
gtgcctgagagt

SEQ ID NO: 4106035 - DNA, 16 bp, Homo sapiens
gtgcctgagctgggga

SEQ ID NO: 4106036 - DNA, 16 bp, Homo sapiens
gtgcctgcactgagag

SEQ ID NO: 4106037 - DNA, 20 bp, Homo sapiens
gtgcctggccccagcctggg

SEQ ID NO: 4106038 - DNA, 12 bp, Homo sapiens
gtgcctggcctc

SEQ ID NO: 4106039 - DNA, 17 bp, Homo sapiens
gtgcctgggaatgtatt

SEQ ID NO: 4106040 - DNA, 20 bp, Homo sapiens
gtgcctgtcccacccccacc

SEQ ID NO: 4106041 - DNA, 22 bp, Homo sapiens
gtgccttcagctgttgcagatg

SEQ ID NO: 4106042 - DNA, 19 bp, Homo sapiens
gtgccttctccttccccag

SEQ ID NO: 4106043 - DNA, 20 bp, Homo sapiens
gtgccttctccttccccagg

SEQ ID NO: 4106044 - DNA, 14 bp, Homo sapiens
gtgcctttggcctg

SEQ ID NO: 4106045 - DNA, 21 bp, Homo sapiens
gtgccttttgcagaagagggt

SEQ ID NO: 4106046 - DNA, 19 bp, Homo sapiens
gtgccttttgctgcgcacc

SEQ ID NO: 4106047 - DNA, 18 bp, Homo sapiens
gtgccttttgtgtgatgc

SEQ ID NO: 4106048 - DNA, 20 bp, Homo sapiens
gtgcgtcagtccaaggggtc

SEQ ID NO: 4106049 - DNA, 14 bp, Homo sapiens
gtgcgtgaaacaca

SEQ ID NO: 4106050 - DNA, 13 bp, Homo sapiens
gtgcgtgaatgta

SEQ ID NO: 4106051 - DNA, 16 bp, Homo sapiens
gtgcgtgccgtgtgag

SEQ ID NO: 4106052 - DNA, 16 bp, Homo sapiens
gtgctataggctggag

SEQ ID NO: 4106053 - DNA, 18 bp, Homo sapiens
gtgctataggctggagaa

SEQ ID NO: 4106054 - DNA, 13 bp, Homo sapiens
gtgctatgaattt

SEQ ID NO: 4106055 - DNA, 12 bp, Homo sapiens
gtgctatgttct

SEQ ID NO: 4106056 - DNA, 18 bp, Homo sapiens
gtgctcaccagccctgca

SEQ ID NO: 4106057 - DNA, 20 bp, Homo sapiens
gtgctcattgtaaccatttc

SEQ ID NO: 4106058 - DNA, 14 bp, Homo sapiens
gtgctcccacggcc

SEQ ID NO: 4106059 - DNA, 12 bp, Homo sapiens
gtgctccccaaa

SEQ ID NO: 4106060 - DNA, 19 bp, Homo sapiens
gtgctcctcttgattcctg

SEQ ID NO: 4106061 - DNA, 13 bp, Homo sapiens
gtgctcttggctg

SEQ ID NO: 4106062 - DNA, 20 bp, Homo sapiens
gtgctcttggctgacccctc

SEQ ID NO: 4106063 - DNA, 22 bp, Homo sapiens
gtgctcttggctgacccctctg

SEQ ID NO: 4106064 - DNA, 20 bp, Homo sapiens
gtgctgaatggttttcaaaa

SEQ ID NO: 4106065 - DNA, 16 bp, Homo sapiens
gtgctgacggccaggg

SEQ ID NO: 4106066 - DNA, 18 bp, Homo sapiens
gtgctgacggccagggag

SEQ ID NO: 4106067 - DNA, 22 bp, Homo sapiens
gtgctgatcgtgctaaattttc

SEQ ID NO: 4106068 - DNA, 12 bp, Homo sapiens
gtgctgcaggag

SEQ ID NO: 4106069 - DNA, 23 bp, Homo sapiens
gtgctgcaggagtgtcctgccca

SEQ ID NO: 4106070 - DNA, 12 bp, Homo sapiens
gtgctgccctgt

SEQ ID NO: 4106071 - DNA, 16 bp, Homo sapiens
gtgctgcgcctgcagg

SEQ ID NO: 4106072 - DNA, 19 bp, Homo sapiens
gtgctgcgcctgcaggcag

SEQ ID NO: 4106073 - DNA, 15 bp, Homo sapiens
gtgctggagccctgt

SEQ ID NO: 4106074 - DNA, 23 bp, Homo sapiens
gtgctggatggacagtgggcatc

SEQ ID NO: 4106075 - DNA, 20 bp, Homo sapiens
gtgctggctcacagtacagc

SEQ ID NO: 4106076 - DNA, 13 bp, Homo sapiens
gtgctgggaccag

SEQ ID NO: 4106077 - DNA, 18 bp, Homo sapiens
gtgctgggaccagagcca

SEQ ID NO: 4106078 - DNA, 15 bp, Homo sapiens
gtgctgggaggaggg

SEQ ID NO: 4106079 - DNA, 20 bp, Homo sapiens
gtgctgggattacaggcgtg

SEQ ID NO: 4106080 - DNA, 17 bp, Homo sapiens
gtgctgggtgcctccca

SEQ ID NO: 4106081 - DNA, 20 bp, Homo sapiens
gtgctgggtgcctcccacac

SEQ ID NO: 4106082 - DNA, 15 bp, Homo sapiens
gtgctgtgaccattt

SEQ ID NO: 4106083 - DNA, 14 bp, Homo sapiens
gtgctgtgagggag

SEQ ID NO: 4106084 - DNA, 15 bp, Homo sapiens
gtgctgtgagggagg

SEQ ID NO: 4106085 - DNA, 15 bp, Homo sapiens
gtgctgtggccaggg

SEQ ID NO: 4106086 - DNA, 23 bp, Homo sapiens
gtgctgtggccagggtgagagct

SEQ ID NO: 4106087 - DNA, 17 bp, Homo sapiens
gtgctgtgggcagcacc

SEQ ID NO: 4106088 - DNA, 21 bp, Homo sapiens
gtgcttatcccatagccagga

SEQ ID NO: 4106089 - DNA, 23 bp, Homo sapiens
gtgcttgctggtgcctgccacct

SEQ ID NO: 4106090 - DNA, 18 bp, Homo sapiens
gtgcttttatagaggcta

SEQ ID NO: 4106091 - DNA, 19 bp, Homo sapiens
gtgcttttatagaggctag

SEQ ID NO: 4106092 - DNA, 13 bp, Homo sapiens
gtggaaagcactt

SEQ ID NO: 4106093 - DNA, 21 bp, Homo sapiens
gtggaacataaaaaggacatc

SEQ ID NO: 4106094 - DNA, 14 bp, Homo sapiens
gtggaacctctgtc

SEQ ID NO: 4106095 - DNA, 24 bp, Homo sapiens
gtggaacctctgtctcatcctcct

SEQ ID NO: 4106096 - DNA, 20 bp, Homo sapiens
gtggaagaagggagaagaaa

SEQ ID NO: 4106097 - DNA, 15 bp, Homo sapiens
gtggaagagtgtgtg

SEQ ID NO: 4106098 - DNA, 13 bp, Homo sapiens
gtggaagcttcta

SEQ ID NO: 4106099 - DNA, 20 bp, Homo sapiens
gtggaaggcagacagcaggc

SEQ ID NO: 4106100 - DNA, 19 bp, Homo sapiens
gtggaaggcctccctctgt

SEQ ID NO: 4106101 - DNA, 14 bp, Homo sapiens
gtggaagggctggg

SEQ ID NO: 4106102 - DNA, 14 bp, Homo sapiens
gtggaatgagtgtg

SEQ ID NO: 4106103 - DNA, 16 bp, Homo sapiens
gtggaccgtggacagg

SEQ ID NO: 4106104 - DNA, 18 bp, Homo sapiens
gtggaccttaggccttcc

SEQ ID NO: 4106105 - DNA, 21 bp, Homo sapiens
gtggaccttaggccttcctct

SEQ ID NO: 4106106 - DNA, 19 bp, Homo sapiens
gtggactaaatatctgtca

SEQ ID NO: 4106107 - DNA, 20 bp, Homo sapiens
gtggactaaatatctgtcat

SEQ ID NO: 4106108 - DNA, 21 bp, Homo sapiens
gtggactcagggcagcgccag

SEQ ID NO: 4106109 - DNA, 23 bp, Homo sapiens
gtggagaagagtgccctgctttg

SEQ ID NO: 4106110 - DNA, 15 bp, Homo sapiens
gtggagaccctgcca

SEQ ID NO: 4106111 - DNA, 14 bp, Homo sapiens
gtggagcaaaaggc

SEQ ID NO: 4106112 - DNA, 20 bp, Homo sapiens
gtggagcaaaaggcagctca

SEQ ID NO: 4106113 - DNA, 15 bp, Homo sapiens
gtggagcccaggagt

SEQ ID NO: 4106114 - DNA, 14 bp, Homo sapiens
gtggagctcagccc

SEQ ID NO: 4106115 - DNA, 20 bp, Homo sapiens
gtggaggaaggattgtaaaa

SEQ ID NO: 4106116 - DNA, 15 bp, Homo sapiens
gtggaggcttcctgc

SEQ ID NO: 4106117 - DNA, 12 bp, Homo sapiens
gtggaggggtgt

SEQ ID NO: 4106118 - DNA, 18 bp, Homo sapiens
gtggaggtgggctgggcc

SEQ ID NO: 4106119 - DNA, 16 bp, Homo sapiens
gtggatataaaatgtg

SEQ ID NO: 4106120 - DNA, 23 bp, Homo sapiens
gtggatcccctgcggtcaggctg

SEQ ID NO: 4106121 - DNA, 18 bp, Homo sapiens
gtggatctccaaggacca

SEQ ID NO: 4106122 - DNA, 19 bp, Homo sapiens
gtggatctccaaggaccag

SEQ ID NO: 4106123 - DNA, 20 bp, Homo sapiens
gtggatcttgccacatttct

SEQ ID NO: 4106124 - DNA, 21 bp, Homo sapiens
gtggatcttgccacatttctg

SEQ ID NO: 4106125 - DNA, 22 bp, Homo sapiens
gtgaggggctttctcttcccct

SEQ ID NO: 4106126 - DNA, 18 bp, Homo sapiens
gtgaggtgctgatgagtg

SEQ ID NO: 4106127 - DNA, 22 bp, Homo sapiens
gtgagtcatttaaatgtgtaca

SEQ ID NO: 4106128 - DNA, 12 bp, Homo sapiens
gtgagtgccttt

SEQ ID NO: 4106129 - DNA, 15 bp, Homo sapiens
gtgagtggcctgcta

SEQ ID NO: 4106130 - DNA, 19 bp, Homo sapiens
gtgagtgtgacagggccag

SEQ ID NO: 4106131 - DNA, 20 bp, Homo sapiens
gtgagtgtgacagggccagt

SEQ ID NO: 4106132 - DNA, 17 bp, Homo sapiens
gtgagttacagcgagag

SEQ ID NO: 4106133 - DNA, 20 bp, Homo sapiens
gtgatacccatagcttccat

SEQ ID NO: 4106134 - DNA, 13 bp, Homo sapiens
gtgatagcacttt

SEQ ID NO: 4106135 - DNA, 21 bp, Homo sapiens
gtgatatataagtgtacatat

SEQ ID NO: 4106136 - DNA, 16 bp, Homo sapiens
gtgatcaataaaatgt

SEQ ID NO: 4106137 - DNA, 17 bp, Homo sapiens
gtgatcaataaaatgtg

SEQ ID NO: 4106138 - DNA, 19 bp, Homo sapiens
gtgatcaataaaatgtgat

SEQ ID NO: 4106139 - DNA, 17 bp, Homo sapiens
gtgatcaattaaatgta

SEQ ID NO: 4106140 - DNA, 20 bp, Homo sapiens
gtgatcagaccataatgtta

SEQ ID NO: 4106141 - DNA, 16 bp, Homo sapiens
gtgatcatgtgtggaa

SEQ ID NO: 4106142 - DNA, 13 bp, Homo sapiens
gtgatccatccat

SEQ ID NO: 4106143 - DNA, 14 bp, Homo sapiens
gtgatcctctattt

SEQ ID NO: 4106144 - DNA, 15 bp, Homo sapiens
gtgatctcagatcag

SEQ ID NO: 4106145 - DNA, 21 bp, Homo sapiens
gtgatcttgcattcattttct

SEQ ID NO: 4106146 - DNA, 22 bp, Homo sapiens
gtgatcttggcttactgcagcc

SEQ ID NO: 4106147 - DNA, 15 bp, Homo sapiens
gtgatcttttaaagt

SEQ ID NO: 4106148 - DNA, 22 bp, Homo sapiens
gtgatgatcagctgtttgtcat

SEQ ID NO: 4106149 - DNA, 17 bp, Homo sapiens
gtgatgatttgggggag

SEQ ID NO: 4106150 - DNA, 14 bp, Homo sapiens
gtgatggttcccct

SEQ ID NO: 4106151 - DNA, 22 bp, Homo sapiens
gtgatggttcccctgttcactc

SEQ ID NO: 4106152 - DNA, 23 bp, Homo sapiens
gtgatggttcccctgttcactct

SEQ ID NO: 4106153 - DNA, 19 bp, Homo sapiens
gtgatggttgccaggacga

SEQ ID NO: 4106154 - DNA, 21 bp, Homo sapiens
gtgatgtgaactgactttaag

SEQ ID NO: 4106155 - DNA, 15 bp, Homo sapiens
gtgatgtgaagccaa

SEQ ID NO: 4106156 - DNA, 23 bp, Homo sapiens
gtgattccactacacctggctga

SEQ ID NO: 4106157 - DNA, 21 bp, Homo sapiens
gtgattcctaagccacttgaa

SEQ ID NO: 4106158 - DNA, 18 bp, Homo sapiens
gtgattctgtttattctt

SEQ ID NO: 4106159 - DNA, 12 bp, Homo sapiens
gtgattgcagct

SEQ ID NO: 4106160 - DNA, 12 bp, Homo sapiens
gtgattttcctt

SEQ ID NO: 4106161 - DNA, 19 bp, Homo sapiens
gtgcaaaagcttcaaatta

SEQ ID NO: 4106162 - DNA, 21 bp, Homo sapiens
gtgcaaaaggcttgcagaact

SEQ ID NO: 4106163 - DNA, 14 bp, Homo sapiens
gtgcaacccttacc

SEQ ID NO: 4106164 - DNA, 19 bp, Homo sapiens
gtgcaacctcgctgagggc

SEQ ID NO: 4106165 - DNA, 23 bp, Homo sapiens
gtgcacaacccaccacccccttt

SEQ ID NO: 4106166 - DNA, 22 bp, Homo sapiens
gtgcacctgggacagggagcag

SEQ ID NO: 4106167 - DNA, 13 bp, Homo sapiens
gtgcactccagct

SEQ ID NO: 4106168 - DNA, 15 bp, Homo sapiens
gtgcactccagcttc

SEQ ID NO: 4106169 - DNA, 13 bp, Homo sapiens
gtgcactgccctg

SEQ ID NO: 4106170 - DNA, 14 bp, Homo sapiens
gtgcactgccctgt

SEQ ID NO: 4106171 - DNA, 23 bp, Homo sapiens
gtgcagaagggagctggctccag

SEQ ID NO: 4106172 - DNA, 18 bp, Homo sapiens
gtgcagaataatggaaac

SEQ ID NO: 4106173 - DNA, 19 bp, Homo sapiens
gtgcagaataatggaaaca

SEQ ID NO: 4106174 - DNA, 16 bp, Homo sapiens
gtgcagacagaagtct

SEQ ID NO: 4106175 - DNA, 22 bp, Homo sapiens
gtgcagacaggccatgtgagcc

SEQ ID NO: 4106176 - DNA, 17 bp, Homo sapiens
gtgcagagaagctggac

SEQ ID NO: 4106177 - DNA, 19 bp, Homo sapiens
gtgcagagaagctggactt

SEQ ID NO: 4106178 - DNA, 19 bp, Homo sapiens
gtgcagatgcaattgtttg

SEQ ID NO: 4106179 - DNA, 19 bp, Homo sapiens
gtgcagcacgtctcagaga

SEQ ID NO: 4106180 - DNA, 18 bp, Homo sapiens
gtgcagctgattttaaca

SEQ ID NO: 4106181 - DNA, 17 bp, Homo sapiens
gtgcaggagcgctccct

SEQ ID NO: 4106182 - DNA, 12 bp, Homo sapiens
gtgcaggcaggc

SEQ ID NO: 4106183 - DNA, 21 bp, Homo sapiens
gtgcagggctggtttgttctg

SEQ ID NO: 4106184 - DNA, 19 bp, Homo sapiens
gtgcataagttaacttcca

SEQ ID NO: 4106185 - DNA, 16 bp, Homo sapiens
gtgcatagtgctggga

SEQ ID NO: 4106186 - DNA, 13 bp, Homo sapiens
gtgcatctcagcc

SEQ ID NO: 4106187 - DNA, 12 bp, Homo sapiens
gtgcatctcctc

SEQ ID NO: 4106188 - DNA, 21 bp, Homo sapiens
gtgcatggaggccctcctgtg

SEQ ID NO: 4106189 - DNA, 18 bp, Homo sapiens
gtgcatgggtgaagggag

SEQ ID NO: 4106190 - DNA, 14 bp, Homo sapiens
gtgcatgtcctttg

SEQ ID NO: 4106191 - DNA, 18 bp, Homo sapiens
gtgcatttgagagaagcc

SEQ ID NO: 4106192 - DNA, 19 bp, Homo sapiens
gtgcatttgttcagctccc

SEQ ID NO: 4106193 - DNA, 17 bp, Homo sapiens
gtgcattttcccagata

SEQ ID NO: 4106194 - DNA, 18 bp, Homo sapiens
gtgcatttttgtgaaatg

SEQ ID NO: 4106195 - DNA, 22 bp, Homo sapiens
gtgcatttttgtgaaatgaaaa

SEQ ID NO: 4106196 - DNA, 19 bp, Homo sapiens
gtgccaaaaccaggcctct

SEQ ID NO: 4106197 - DNA, 22 bp, Homo sapiens
gtgccaaaaccaggcctctgct

SEQ ID NO: 4106198 - DNA, 15 bp, Homo sapiens
gtgccaaatgctggg

SEQ ID NO: 4106199 - DNA, 17 bp, Homo sapiens
gtgccactgcccgagct

SEQ ID NO: 4106200 - DNA, 18 bp, Homo sapiens
gtgccagcccagaggccg

SEQ ID NO: 4106201 - DNA, 22 bp, Homo sapiens
gtgccagccgtgatgctcaggc

SEQ ID NO: 4106202 - DNA, 18 bp, Homo sapiens
gtgccaggactccccagg

SEQ ID NO: 4106203 - DNA, 23 bp, Homo sapiens
gtgccaggactccccaggccagg

SEQ ID NO: 4106204 - DNA, 11 bp, Homo sapiens
gtgccaggagc

SEQ ID NO: 4106205 - DNA, 18 bp, Homo sapiens
gtgccaggagcaatggga

SEQ ID NO: 4106206 - DNA, 21 bp, Homo sapiens
gtgccaggagcaatgggactg

SEQ ID NO: 4106207 - DNA, 18 bp, Homo sapiens
gtgccagggcccacccca

SEQ ID NO: 4106208 - DNA, 19 bp, Homo sapiens
gtgccagggcccaccccag

SEQ ID NO: 4106209 - DNA, 21 bp, Homo sapiens
gtgccagggcccaccccagcc

SEQ ID NO: 4106210 - DNA, 22 bp, Homo sapiens
gtgccagttcctgtaacaggtg

SEQ ID NO: 4106211 - DNA, 23 bp, Homo sapiens
gtgccatgctgggccactgggga

SEQ ID NO: 4106212 - DNA, 11 bp, Homo sapiens
gtgccattcca

SEQ ID NO: 4106213 - DNA, 23 bp, Homo sapiens
gtgccattccactccactcaggt

SEQ ID NO: 4106214 - DNA, 20 bp, Homo sapiens
gtgcccacatcccaggcttc

SEQ ID NO: 4106215 - DNA, 23 bp, Homo sapiens
gtgcccaccctgggagacagacc

SEQ ID NO: 4106216 - DNA, 23 bp, Homo sapiens
gtgcccactccctatctccttcc

SEQ ID NO: 4106217 - DNA, 12 bp, Homo sapiens
gtgccccacagc

SEQ ID NO: 4106218 - DNA, 14 bp, Homo sapiens
gtgccccacagcta

SEQ ID NO: 4106219 - DNA, 22 bp, Homo sapiens
gtgccccacagctacctgagac

SEQ ID NO: 4106220 - DNA, 12 bp, Homo sapiens
gtgccccaggac

SEQ ID NO: 4106221 - DNA, 16 bp, Homo sapiens
gtgccccatgcctgtc

SEQ ID NO: 4106222 - DNA, 13 bp, Homo sapiens
gtgcccccactga

SEQ ID NO: 4106223 - DNA, 19 bp, Homo sapiens
gtgcccccactgaccagaa

SEQ ID NO: 4106224 - DNA, 23 bp, Homo sapiens
gtgcccgactgactggaggaggc

SEQ ID NO: 4106225 - DNA, 15 bp, Homo sapiens
gtgccctcgctgctt

SEQ ID NO: 4106226 - DNA, 22 bp, Homo sapiens
gtgccctggtgaatcacctggc

SEQ ID NO: 4106227 - DNA, 22 bp, Homo sapiens
gtgaaaccttttttaagatttt

SEQ ID NO: 4106228 - DNA, 16 bp, Homo sapiens
gtgaaacttcctaagt

SEQ ID NO: 4106229 - DNA, 14 bp, Homo sapiens
gtgaaactttcatt

SEQ ID NO: 4106230 - DNA, 12 bp, Homo sapiens
gtgaaagaaagc

SEQ ID NO: 4106231 - DNA, 16 bp, Homo sapiens
gtgaaataaattctga

SEQ ID NO: 4106232 - DNA, 17 bp, Homo sapiens
gtgaaataccagtgtgg

SEQ ID NO: 4106233 - DNA, 14 bp, Homo sapiens
gtgaaatataattg

SEQ ID NO: 4106234 - DNA, 15 bp, Homo sapiens
gtgaaatggatacta

SEQ ID NO: 4106235 - DNA, 11 bp, Homo sapiens
gtgaaatgtga

SEQ ID NO: 4106236 - DNA, 18 bp, Homo sapiens
gtgaaccacttcattctg

SEQ ID NO: 4106237 - DNA, 21 bp, Homo sapiens
gtgaaccctggggcctgactg

SEQ ID NO: 4106238 - DNA, 22 bp, Homo sapiens
gtgaacctacctgccttggaga

SEQ ID NO: 4106239 - DNA, 16 bp, Homo sapiens
gtgaacctaccttcat

SEQ ID NO: 4106240 - DNA, 14 bp, Homo sapiens
gtgaactcctgcca

SEQ ID NO: 4106241 - DNA, 17 bp, Homo sapiens
gtgaagaccagagcagt

SEQ ID NO: 4106242 - DNA, 16 bp, Homo sapiens
gtgaagacccagcagg

SEQ ID NO: 4106243 - DNA, 16 bp, Homo sapiens
gtgaagactccagaaa

SEQ ID NO: 4106244 - DNA, 16 bp, Homo sapiens
gtgaagagcaagagag

SEQ ID NO: 4106245 - DNA, 21 bp, Homo sapiens
gtgaagagtgactagtacaaa

SEQ ID NO: 4106246 - DNA, 17 bp, Homo sapiens
gtgaagataatttgcat

SEQ ID NO: 4106247 - DNA, 18 bp, Homo sapiens
gtgaagataatttgcata

SEQ ID NO: 4106248 - DNA, 10 bp, Homo sapiens
gtgaagccaa

SEQ ID NO: 4106249 - DNA, 22 bp, Homo sapiens
gtgaagccaattcagacaggca

SEQ ID NO: 4106250 - DNA, 12 bp, Homo sapiens
gtgaaggaccct

SEQ ID NO: 4106251 - DNA, 13 bp, Homo sapiens
gtgaaggaccctt

SEQ ID NO: 4106252 - DNA, 23 bp, Homo sapiens
gtgaaggcccaagagcagagtct

SEQ ID NO: 4106253 - DNA, 16 bp, Homo sapiens
gtgaaggcctggctgg

SEQ ID NO: 4106254 - DNA, 14 bp, Homo sapiens
gtgaagttacatgc

SEQ ID NO: 4106255 - DNA, 23 bp, Homo sapiens
gtgaataatcatgtgaaatgttt

SEQ ID NO: 4106256 - DNA, 16 bp, Homo sapiens
gtgaatcacctggctg

SEQ ID NO: 4106257 - DNA, 11 bp, Homo sapiens
gtgaatgaaag

SEQ ID NO: 4106258 - DNA, 19 bp, Homo sapiens
gtgaatgaaagattaaaca

SEQ ID NO: 4106259 - DNA, 20 bp, Homo sapiens
gtgaatggattggattattt

SEQ ID NO: 4106260 - DNA, 19 bp, Homo sapiens
gtgaatgtatgtttctgca

SEQ ID NO: 4106261 - DNA, 23 bp, Homo sapiens
gtgaatgtgggcactggcccagg

SEQ ID NO: 4106262 - DNA, 22 bp, Homo sapiens
gtgaattcttgaaggaaaatga

SEQ ID NO: 4106263 - DNA, 22 bp, Homo sapiens
gtgaattgcctgcagagagaag

SEQ ID NO: 4106264 - DNA, 23 bp, Homo sapiens
gtgaattgcctgcagagagaagc

SEQ ID NO: 4106265 - DNA, 19 bp, Homo sapiens
gtgaattgtgaccaagtta

SEQ ID NO: 4106266 - DNA, 17 bp, Homo sapiens
gtgaatttttaagctgc

SEQ ID NO: 4106267 - DNA, 12 bp, Homo sapiens
gtgacaaaccat

SEQ ID NO: 4106268 - DNA, 16 bp, Homo sapiens
gtgacaaaccatccag

SEQ ID NO: 4106269 - DNA, 14 bp, Homo sapiens
gtgacaataaaaca

SEQ ID NO: 4106270 - DNA, 21 bp, Homo sapiens
gtgacaataatattgttgtat

SEQ ID NO: 4106271 - DNA, 16 bp, Homo sapiens
gtgacaattttgtaca

SEQ ID NO: 4106272 - DNA, 22 bp, Homo sapiens
gtgacacttcagagagctggta

SEQ ID NO: 4106273 - DNA, 16 bp, Homo sapiens
gtgacagacaggctct

SEQ ID NO: 4106274 - DNA, 23 bp, Homo sapiens
gtgacagaccacatctttatctg

SEQ ID NO: 4106275 - DNA, 18 bp, Homo sapiens
gtgacagagttcactata

SEQ ID NO: 4106276 - DNA, 16 bp, Homo sapiens
gtgacaggaaagccct

SEQ ID NO: 4106277 - DNA, 12 bp, Homo sapiens
gtgacagggcca

SEQ ID NO: 4106278 - DNA, 20 bp, Homo sapiens
gtgacagggccagtggggcc

SEQ ID NO: 4106279 - DNA, 21 bp, Homo sapiens
gtgacagggccagtggggcct

SEQ ID NO: 4106280 - DNA, 19 bp, Homo sapiens
gtgacagtcatcatcaggg

SEQ ID NO: 4106281 - DNA, 21 bp, Homo sapiens
gtgacagtcatcatcagggcc

SEQ ID NO: 4106282 - DNA, 22 bp, Homo sapiens
gtgacagtcatcatcagggcct

SEQ ID NO: 4106283 - DNA, 20 bp, Homo sapiens
gtgacatctctattccccac

SEQ ID NO: 4106284 - DNA, 20 bp, Homo sapiens
gtgacatggtgcctgagagg

SEQ ID NO: 4106285 - DNA, 12 bp, Homo sapiens
gtgacatttctc

SEQ ID NO: 4106286 - DNA, 17 bp, Homo sapiens
gtgaccaatgatggtca

SEQ ID NO: 4106287 - DNA, 16 bp, Homo sapiens
gtgaccaccttctgtc

SEQ ID NO: 4106288 - DNA, 15 bp, Homo sapiens
gtgaccatttataat

SEQ ID NO: 4106289 - DNA, 17 bp, Homo sapiens
gtgacccccagctccgg

SEQ ID NO: 4106290 - DNA, 16 bp, Homo sapiens
gtgacctttgacctcg

SEQ ID NO: 4106291 - DNA, 16 bp, Homo sapiens
gtgacggccctcatct

SEQ ID NO: 4106292 - DNA, 19 bp, Homo sapiens
gtgactctaagctcagtgc

SEQ ID NO: 4106293 - DNA, 14 bp, Homo sapiens
gtgactgaaaccat

SEQ ID NO: 4106294 - DNA, 21 bp, Homo sapiens
gtgactgatgttacatcacag

SEQ ID NO: 4106295 - DNA, 17 bp, Homo sapiens
gtgactgcgatcttcag

SEQ ID NO: 4106296 - DNA, 11 bp, Homo sapiens
gtgactttaaa

SEQ ID NO: 4106297 - DNA, 22 bp, Homo sapiens
gtgagaaaaagctcctgtcctc

SEQ ID NO: 4106298 - DNA, 16 bp, Homo sapiens
gtgagaaaatgcctca

SEQ ID NO: 4106299 - DNA, 17 bp, Homo sapiens
gtgagaaaatgcctcaa

SEQ ID NO: 4106300 - DNA, 13 bp, Homo sapiens
gtgagaaagaaag

SEQ ID NO: 4106301 - DNA, 17 bp, Homo sapiens
gtgagaagtgccttctc

SEQ ID NO: 4106302 - DNA, 12 bp, Homo sapiens
gtgagagcccat

SEQ ID NO: 4106303 - DNA, 12 bp, Homo sapiens
gtgagaggcagc

SEQ ID NO: 4106304 - DNA, 20 bp, Homo sapiens
gtgagatcacagcctccagg

SEQ ID NO: 4106305 - DNA, 15 bp, Homo sapiens
gtgagattttttatt

SEQ ID NO: 4106306 - DNA, 19 bp, Homo sapiens
gtgagattttttattgcta

SEQ ID NO: 4106307 - DNA, 21 bp, Homo sapiens
gtgagattttttattgctagt

SEQ ID NO: 4106308 - DNA, 16 bp, Homo sapiens
gtgagccacagaccac

SEQ ID NO: 4106309 - DNA, 14 bp, Homo sapiens
gtgagccaccgctg

SEQ ID NO: 4106310 - DNA, 20 bp, Homo sapiens
gtgagccaccgctgccagca

SEQ ID NO: 4106311 - DNA, 22 bp, Homo sapiens
gtgagccaccgtgcctggccag

SEQ ID NO: 4106312 - DNA, 20 bp, Homo sapiens
gtgagccaggtaatgaggga

SEQ ID NO: 4106313 - DNA, 12 bp, Homo sapiens
gtgagccagtga

SEQ ID NO: 4106314 - DNA, 17 bp, Homo sapiens
gtgagcccctggtcctg

SEQ ID NO: 4106315 - DNA, 21 bp, Homo sapiens
gtgagccgcggggcacatgct

SEQ ID NO: 4106316 - DNA, 15 bp, Homo sapiens
gtgagcctcctgtgc

SEQ ID NO: 4106317 - DNA, 19 bp, Homo sapiens
gtgagcctcctgtgcctgg

SEQ ID NO: 4106318 - DNA, 16 bp, Homo sapiens
gtgagcggagatcgca

SEQ ID NO: 4106319 - DNA, 13 bp, Homo sapiens
gtgagctgcacca

SEQ ID NO: 4106320 - DNA, 11 bp, Homo sapiens
gtgagctggag

SEQ ID NO: 4106321 - DNA, 14 bp, Homo sapiens
gtgagctggggact

SEQ ID NO: 4106322 - DNA, 20 bp, Homo sapiens
gtgaggaaatccattgttta

SEQ ID NO: 4106323 - DNA, 22 bp, Homo sapiens
gtgaggagaatgaaatgtatgt

SEQ ID NO: 4106324 - DNA, 11 bp, Homo sapiens
gtgaggagctg

SEQ ID NO: 4106325 - DNA, 18 bp, Homo sapiens
gtgaggagctgctggctt

SEQ ID NO: 4106326 - DNA, 20 bp, Homo sapiens
gtgaggaggaaaaggaaaaa

SEQ ID NO: 4106327 - DNA, 20 bp, Homo sapiens
gtgaggattatgggtcctgc

SEQ ID NO: 4106328 - DNA, 16 bp, Homo sapiens
gtgaggcctggccagg

SEQ ID NO: 4106329 - DNA, 15 bp, Homo sapiens
gtgaggggctttctc

SEQ ID NO: 4106330 - DNA, 14 bp, Homo sapiens
gtgtggtgcagtgt

SEQ ID NO: 4106331 - DNA, 18 bp, Homo sapiens
gtgtggtgcagtgtgaaa

SEQ ID NO: 4106332 - DNA, 15 bp, Homo sapiens
gtgtggtggcctcag

SEQ ID NO: 4106333 - DNA, 23 bp, Homo sapiens
gtgtggtggcctcagctgaatgc

SEQ ID NO: 4106334 - DNA, 15 bp, Homo sapiens
gtgtgtactctgtcc

SEQ ID NO: 4106335 - DNA, 13 bp, Homo sapiens
gtgtgtcagattt

SEQ ID NO: 4106336 - DNA, 17 bp, Homo sapiens
gtgtgtgaatgaacact

SEQ ID NO: 4106337 - DNA, 17 bp, Homo sapiens
gtgtgtgcagagctgaa

SEQ ID NO: 4106338 - DNA, 19 bp, Homo sapiens
gtgtgtgcagagtccattt

SEQ ID NO: 4106339 - DNA, 21 bp, Homo sapiens
gtgtgtgcagagtccatttcc

SEQ ID NO: 4106340 - DNA, 17 bp, Homo sapiens
gtgtgtggcagagagag

SEQ ID NO: 4106341 - DNA, 17 bp, Homo sapiens
gtgtgtgtatgtttgca

SEQ ID NO: 4106342 - DNA, 9 bp, Homo sapiens
gtgtgtgtg

SEQ ID NO: 4106343 - DNA, 13 bp, Homo sapiens
gtgtgtgtgaatg

SEQ ID NO: 4106344 - DNA, 15 bp, Homo sapiens
gtgtgtgtggcaggg

SEQ ID NO: 4106345 - DNA, 13 bp, Homo sapiens
gtgtgtgtgtggc

SEQ ID NO: 4106346 - DNA, 15 bp, Homo sapiens
gtgttactgtaattc

SEQ ID NO: 4106347 - DNA, 11 bp, Homo sapiens
gtgttctcctt

SEQ ID NO: 4106348 - DNA, 12 bp, Homo sapiens
gtgttctgctcc

SEQ ID NO: 4106349 - DNA, 13 bp, Homo sapiens
gtgttctgctcct

SEQ ID NO: 4106350 - DNA, 16 bp, Homo sapiens
gtgttctttcctgccc

SEQ ID NO: 4106351 - DNA, 17 bp, Homo sapiens
gtgttctttcctgccct

SEQ ID NO: 4106352 - DNA, 19 bp, Homo sapiens
gtgttgagccttttccctc

SEQ ID NO: 4106353 - DNA, 19 bp, Homo sapiens
gtgttgattttctgttgta

SEQ ID NO: 4106354 - DNA, 16 bp, Homo sapiens
gtgttgctcagctcct

SEQ ID NO: 4106355 - DNA, 18 bp, Homo sapiens
gtgttggctggggtgtca

SEQ ID NO: 4106356 - DNA, 20 bp, Homo sapiens
gtgttgtaattcttcagttg

SEQ ID NO: 4106357 - DNA, 14 bp, Homo sapiens
gtgttgtgttcctg

SEQ ID NO: 4106358 - DNA, 17 bp, Homo sapiens
gtgttgttgctctagga

SEQ ID NO: 4106359 - DNA, 22 bp, Homo sapiens
gtgtttaaaaagtaagttaata

SEQ ID NO: 4106360 - DNA, 14 bp, Homo sapiens
gtgtttacagagat

SEQ ID NO: 4106361 - DNA, 21 bp, Homo sapiens
gtgtttattcatccagcagtg

SEQ ID NO: 4106362 - DNA, 12 bp, Homo sapiens
gtgtttctgggg

SEQ ID NO: 4106363 - DNA, 20 bp, Homo sapiens
gtgtttgcagcctgctctag

SEQ ID NO: 4106364 - DNA, 10 bp, Homo sapiens
gtgtttgctt

SEQ ID NO: 4106365 - DNA, 19 bp, Homo sapiens
gtgtttgcttaaacaaagt

SEQ ID NO: 4106366 - DNA, 15 bp, Homo sapiens
gtgtttggtttacat

SEQ ID NO: 4106367 - DNA, 17 bp, Homo sapiens
gtgtttgtctcttctgg

SEQ ID NO: 4106368 - DNA, 20 bp, Homo sapiens
gtgttttaagactgaatgtt

SEQ ID NO: 4106369 - DNA, 15 bp, Homo sapiens
gtgttttcataataa

SEQ ID NO: 4106370 - DNA, 13 bp, Homo sapiens
gtgttttctgaat

SEQ ID NO: 4106371 - DNA, 19 bp, Homo sapiens
gtgttttctgaataacatt

SEQ ID NO: 4106372 - DNA, 15 bp, Homo sapiens
gtgtttttcatttct

SEQ ID NO: 4106373 - DNA, 17 bp, Homo sapiens
gtgttttttaaaaaagc

SEQ ID NO: 4106374 - DNA, 11 bp, Homo sapiens
gttaaaaataa

SEQ ID NO: 4106375 - DNA, 13 bp, Homo sapiens
gttaaaattatac

SEQ ID NO: 4106376 - DNA, 23 bp, Homo sapiens
gttaaacggtgcccatcctgcca

SEQ ID NO: 4106377 - DNA, 15 bp, Homo sapiens
gttaaagctgccggc

SEQ ID NO: 4106378 - DNA, 15 bp, Homo sapiens
gttaaatactgtgca

SEQ ID NO: 4106379 - DNA, 19 bp, Homo sapiens
gttaaatactgtgcagaat

SEQ ID NO: 4106380 - DNA, 13 bp, Homo sapiens
gttaaatttgtaa

SEQ ID NO: 4106381 - DNA, 14 bp, Homo sapiens
gttaaatttgtaag

SEQ ID NO: 4106382 - DNA, 13 bp, Homo sapiens
gttaacaaggaat

SEQ ID NO: 4106383 - DNA, 15 bp, Homo sapiens
gttaacaaggaatgc

SEQ ID NO: 4106384 - DNA, 19 bp, Homo sapiens
gttaacaaggaatgcctgt

SEQ ID NO: 4106385 - DNA, 22 bp, Homo sapiens
gttaacaaggaatgcctgtgcc

SEQ ID NO: 4106386 - DNA, 23 bp, Homo sapiens
gttaacagagacagataactctc

SEQ ID NO: 4106387 - DNA, 15 bp, Homo sapiens
gttaacattgaccaa

SEQ ID NO: 4106388 - DNA, 21 bp, Homo sapiens
gttaacattgaccaagaactg

SEQ ID NO: 4106389 - DNA, 15 bp, Homo sapiens
gttaaccatttaagt

SEQ ID NO: 4106390 - DNA, 18 bp, Homo sapiens
gttaactatgacagatat

SEQ ID NO: 4106391 - DNA, 20 bp, Homo sapiens
gttaagaagctgttgtacat

SEQ ID NO: 4106392 - DNA, 21 bp, Homo sapiens
gttaagaagctgttgtacatt

SEQ ID NO: 4106393 - DNA, 10 bp, Homo sapiens
gttaagagaa

SEQ ID NO: 4106394 - DNA, 19 bp, Homo sapiens
gttaagagaaactttatac

SEQ ID NO: 4106395 - DNA, 20 bp, Homo sapiens
gttaagcattaccactcagg

SEQ ID NO: 4106396 - DNA, 14 bp, Homo sapiens
gttaaggaaactct

SEQ ID NO: 4106397 - DNA, 19 bp, Homo sapiens
gttaaggacttctgcagct

SEQ ID NO: 4106398 - DNA, 22 bp, Homo sapiens
gttaagggaaggaactctggct

SEQ ID NO: 4106399 - DNA, 22 bp, Homo sapiens
gttaagtctaaatatttcctta

SEQ ID NO: 4106400 - DNA, 13 bp, Homo sapiens
gttaataccagct

SEQ ID NO: 4106401 - DNA, 14 bp, Homo sapiens
gttaatcttcatgg

SEQ ID NO: 4106402 - DNA, 22 bp, Homo sapiens
gttaatgatggttgatgggttc

SEQ ID NO: 4106403 - DNA, 15 bp, Homo sapiens
gttaattaatgtcat

SEQ ID NO: 4106404 - DNA, 17 bp, Homo sapiens
gttaatttatctaaatt

SEQ ID NO: 4106405 - DNA, 18 bp, Homo sapiens
gttaatttttccttcctc

SEQ ID NO: 4106406 - DNA, 19 bp, Homo sapiens
gttaatttttccttcctct

SEQ ID NO: 4106407 - DNA, 14 bp, Homo sapiens
gttacaaactgcaa

SEQ ID NO: 4106408 - DNA, 16 bp, Homo sapiens
gttacaaactgcaata

SEQ ID NO: 4106409 - DNA, 19 bp, Homo sapiens
gttacaaactgcaatagag

SEQ ID NO: 4106410 - DNA, 21 bp, Homo sapiens
gttacaaactgcaatagagac

SEQ ID NO: 4106411 - DNA, 23 bp, Homo sapiens
gttacaaactgcaatagagactg

SEQ ID NO: 4106412 - DNA, 18 bp, Homo sapiens
gttacaatcattgctgaa

SEQ ID NO: 4106413 - DNA, 22 bp, Homo sapiens
gttacagagacctatgtaagaa

SEQ ID NO: 4106414 - DNA, 23 bp, Homo sapiens
gttacagccaagtgccaaatgct

SEQ ID NO: 4106415 - DNA, 21 bp, Homo sapiens
gttacagcctgttagtaacat

SEQ ID NO: 4106416 - DNA, 19 bp, Homo sapiens
gttacagcgagaggcagag

SEQ ID NO: 4106417 - DNA, 21 bp, Homo sapiens
gttacagcgagaggcagagaa

SEQ ID NO: 4106418 - DNA, 22 bp, Homo sapiens
gttacaggcaccgagaatgttg

SEQ ID NO: 4106419 - DNA, 23 bp, Homo sapiens
gttaccacacatctatgatataa

SEQ ID NO: 4106420 - DNA, 15 bp, Homo sapiens
gttaccatgtcactg

SEQ ID NO: 4106421 - DNA, 21 bp, Homo sapiens
gttaccatttttctggattta

SEQ ID NO: 4106422 - DNA, 17 bp, Homo sapiens
gttaccctcctgtaaat

SEQ ID NO: 4106423 - DNA, 15 bp, Homo sapiens
gttacctcctataaa

SEQ ID NO: 4106424 - DNA, 14 bp, Homo sapiens
gttacctgtgtgct

SEQ ID NO: 4106425 - DNA, 23 bp, Homo sapiens
gttactaattggcctctttaaga

SEQ ID NO: 4106426 - DNA, 16 bp, Homo sapiens
gttactaggtaacttc

SEQ ID NO: 4106427 - DNA, 13 bp, Homo sapiens
gttactgtaattc

SEQ ID NO: 4106428 - DNA, 18 bp, Homo sapiens
gttactgttaaccattta

SEQ ID NO: 4106429 - DNA, 17 bp, Homo sapiens
gttacttacctaaacag

SEQ ID NO: 4106430 - DNA, 10 bp, Homo sapiens
gttactttgt

SEQ ID NO: 4106431 - DNA, 11 bp, Homo sapiens
gttactttgta

SEQ ID NO: 4106432 - DNA, 14 bp, Homo sapiens
gttactttgtaatt

SEQ ID NO: 4106433 - DNA, 16 bp, Homo sapiens
gttactttgtaatttt

SEQ ID NO: 4106434 - DNA, 23 bp, Homo sapiens
gtggtctgaatgttctgacatta

SEQ ID NO: 4106435 - DNA, 24 bp, Homo sapiens
gtggtctgaatgttctgacattaa

SEQ ID NO: 4106436 - DNA, 23 bp, Homo sapiens
gtggtcttcaaattgtcttttgt

SEQ ID NO: 4106437 - DNA, 19 bp, Homo sapiens
gtggtctttgtaagagtgt

SEQ ID NO: 4106438 - DNA, 14 bp, Homo sapiens
gtggtcttttcctc

SEQ ID NO: 4106439 - DNA, 17 bp, Homo sapiens
gtggtgaggggctttct

SEQ ID NO: 4106440 - DNA, 19 bp, Homo sapiens
gtggtgaggggctttctct

SEQ ID NO: 4106441 - DNA, 22 bp, Homo sapiens
gtggtgaggggctttctcttcc

SEQ ID NO: 4106442 - DNA, 17 bp, Homo sapiens
gtggtggagtggagtga

SEQ ID NO: 4106443 - DNA, 13 bp, Homo sapiens
gtggtggcctggt

SEQ ID NO: 4106444 - DNA, 18 bp, Homo sapiens
gtggtggctcacgcctgt

SEQ ID NO: 4106445 - DNA, 20 bp, Homo sapiens
gtggttacagtgcagacagg

SEQ ID NO: 4106446 - DNA, 21 bp, Homo sapiens
gtggttacagtgcagacaggc

SEQ ID NO: 4106447 - DNA, 18 bp, Homo sapiens
gtggttccccaccgaagt

SEQ ID NO: 4106448 - DNA, 20 bp, Homo sapiens
gtggttggggccctgccctg

SEQ ID NO: 4106449 - DNA, 20 bp, Homo sapiens
gtggttttatactgaaggaa

SEQ ID NO: 4106450 - DNA, 16 bp, Homo sapiens
gtgtaaaaaatggaaa

SEQ ID NO: 4106451 - DNA, 15 bp, Homo sapiens
gtgtaaaccaaagcc

SEQ ID NO: 4106452 - DNA, 22 bp, Homo sapiens
gtgtaaaccaaagccctaaaat

SEQ ID NO: 4106453 - DNA, 19 bp, Homo sapiens
gtgtaaatatatgtctgat

SEQ ID NO: 4106454 - DNA, 14 bp, Homo sapiens
gtgtaacttcctgc

SEQ ID NO: 4106455 - DNA, 17 bp, Homo sapiens
gtgtaacttcctgctgc

SEQ ID NO: 4106456 - DNA, 19 bp, Homo sapiens
gtgtaacttcctgctgcac

SEQ ID NO: 4106457 - DNA, 22 bp, Homo sapiens
gtgtaagtgtgagtaagagctg

SEQ ID NO: 4106458 - DNA, 19 bp, Homo sapiens
gtgtaatccaggggtgtag

SEQ ID NO: 4106459 - DNA, 14 bp, Homo sapiens
gtgtaatttgaaga

SEQ ID NO: 4106460 - DNA, 20 bp, Homo sapiens
gtgtacaatgtacacactgg

SEQ ID NO: 4106461 - DNA, 17 bp, Homo sapiens
gtgtaccatttgcctcc

SEQ ID NO: 4106462 - DNA, 23 bp, Homo sapiens
gtgtacttcccgggccagggctg

SEQ ID NO: 4106463 - DNA, 14 bp, Homo sapiens
gtgtagaacactaa

SEQ ID NO: 4106464 - DNA, 19 bp, Homo sapiens
gtgtagaacactaattcat

SEQ ID NO: 4106465 - DNA, 19 bp, Homo sapiens
gtgtagaagcattccttct

SEQ ID NO: 4106466 - DNA, 20 bp, Homo sapiens
gtgtagagttaagaagctgt

SEQ ID NO: 4106467 - DNA, 12 bp, Homo sapiens
gtgtagcctttt

SEQ ID NO: 4106468 - DNA, 20 bp, Homo sapiens
gtgtagcctttttgtataaa

SEQ ID NO: 4106469 - DNA, 13 bp, Homo sapiens
gtgtaggctgggg

SEQ ID NO: 4106470 - DNA, 17 bp, Homo sapiens
gtgtagtcaggtgctca

SEQ ID NO: 4106471 - DNA, 14 bp, Homo sapiens
gtgtagttaattta

SEQ ID NO: 4106472 - DNA, 15 bp, Homo sapiens
gtgtatataatttta

SEQ ID NO: 4106473 - DNA, 17 bp, Homo sapiens
gtgtatataattttatg

SEQ ID NO: 4106474 - DNA, 14 bp, Homo sapiens
gtgtatatccttcc

SEQ ID NO: 4106475 - DNA, 21 bp, Homo sapiens
gtgtatcaggtcagggacttg

SEQ ID NO: 4106476 - DNA, 17 bp, Homo sapiens
gtgtatgtacatatata

SEQ ID NO: 4106477 - DNA, 18 bp, Homo sapiens
gtgtatgtgtctgctaat

SEQ ID NO: 4106478 - DNA, 22 bp, Homo sapiens
gtgtatgtttgcacacttgtgt

SEQ ID NO: 4106479 - DNA, 12 bp, Homo sapiens
gtgtattgttcc

SEQ ID NO: 4106480 - DNA, 17 bp, Homo sapiens
gtgtatttacgctttga

SEQ ID NO: 4106481 - DNA, 21 bp, Homo sapiens
gtgtatttacgctttgattca

SEQ ID NO: 4106482 - DNA, 19 bp, Homo sapiens
gtgtcaactctttgttatt

SEQ ID NO: 4106483 - DNA, 21 bp, Homo sapiens
gtgtcaagctgctctgagcca

SEQ ID NO: 4106484 - DNA, 14 bp, Homo sapiens
gtgtcaagtcctga

SEQ ID NO: 4106485 - DNA, 17 bp, Homo sapiens
gtgtcaagtggcaaagc

SEQ ID NO: 4106486 - DNA, 16 bp, Homo sapiens
gtgtcaatttccctca

SEQ ID NO: 4106487 - DNA, 20 bp, Homo sapiens
gtgtcacctctctcagagca

SEQ ID NO: 4106488 - DNA, 16 bp, Homo sapiens
gtgtcagctgaggctg

SEQ ID NO: 4106489 - DNA, 18 bp, Homo sapiens
gtgtcagctgaggctggg

SEQ ID NO: 4106490 - DNA, 16 bp, Homo sapiens
gtgtcatttcattcca

SEQ ID NO: 4106491 - DNA, 16 bp, Homo sapiens
gtgtccacctgtgggt

SEQ ID NO: 4106492 - DNA, 17 bp, Homo sapiens
gtgtccagcacagaagg

SEQ ID NO: 4106493 - DNA, 16 bp, Homo sapiens
gtgtccatgtgcaccc

SEQ ID NO: 4106494 - DNA, 20 bp, Homo sapiens
gtgtcccccccaggccttgt

SEQ ID NO: 4106495 - DNA, 21 bp, Homo sapiens
gtgtcccctcactctgtcagc

SEQ ID NO: 4106496 - DNA, 23 bp, Homo sapiens
gtgtcccctcactctgtcagcca

SEQ ID NO: 4106497 - DNA, 16 bp, Homo sapiens
gtgtcctgcccatgcc

SEQ ID NO: 4106498 - DNA, 16 bp, Homo sapiens
gtgtccttagaacatt

SEQ ID NO: 4106499 - DNA, 21 bp, Homo sapiens
gtgtctgcacccaggggtggg

SEQ ID NO: 4106500 - DNA, 21 bp, Homo sapiens
gtgtctgctttaaagggcctg

SEQ ID NO: 4106501 - DNA, 12 bp, Homo sapiens
gtgtctggcctg

SEQ ID NO: 4106502 - DNA, 18 bp, Homo sapiens
gtgtctggcctgaggtca

SEQ ID NO: 4106503 - DNA, 21 bp, Homo sapiens
gtgtctgtatttcatgtggct

SEQ ID NO: 4106504 - DNA, 15 bp, Homo sapiens
gtgtctgtgccatgg

SEQ ID NO: 4106505 - DNA, 15 bp, Homo sapiens
gtgtcttaattatta

SEQ ID NO: 4106506 - DNA, 15 bp, Homo sapiens
gtgtcttccataatg

SEQ ID NO: 4106507 - DNA, 15 bp, Homo sapiens
gtgtgaatgaacact

SEQ ID NO: 4106508 - DNA, 11 bp, Homo sapiens
gtgtgaatgtg

SEQ ID NO: 4106509 - DNA, 23 bp, Homo sapiens
gtgtgaatgtgggcactggccca

SEQ ID NO: 4106510 - DNA, 13 bp, Homo sapiens
gtgtgacagggcc

SEQ ID NO: 4106511 - DNA, 14 bp, Homo sapiens
gtgtgacattccag

SEQ ID NO: 4106512 - DNA, 13 bp, Homo sapiens
gtgtgacctgagg

SEQ ID NO: 4106513 - DNA, 15 bp, Homo sapiens
gtgtgacctgagggc

SEQ ID NO: 4106514 - DNA, 14 bp, Homo sapiens
gtgtgagaagtgcc

SEQ ID NO: 4106515 - DNA, 17 bp, Homo sapiens
gtgtgagaagtgccttc

SEQ ID NO: 4106516 - DNA, 21 bp, Homo sapiens
gtgtgagaagtgccttctcct

SEQ ID NO: 4106517 - DNA, 13 bp, Homo sapiens
gtgtgagcagtga

SEQ ID NO: 4106518 - DNA, 13 bp, Homo sapiens
gtgtgagcgcctt

SEQ ID NO: 4106519 - DNA, 16 bp, Homo sapiens
gtgtgaggagctgctg

SEQ ID NO: 4106520 - DNA, 19 bp, Homo sapiens
gtgtgaggagctgctggct

SEQ ID NO: 4106521 - DNA, 17 bp, Homo sapiens
gtgtgagtaagagctgg

SEQ ID NO: 4106522 - DNA, 15 bp, Homo sapiens
gtgtgagtgtgacag

SEQ ID NO: 4106523 - DNA, 18 bp, Homo sapiens
gtgtgagtgtgacagggc

SEQ ID NO: 4106524 - DNA, 21 bp, Homo sapiens
gtgtgatcttaatatatttga

SEQ ID NO: 4106525 - DNA, 15 bp, Homo sapiens
gtgtgcacgagtggg

SEQ ID NO: 4106526 - DNA, 22 bp, Homo sapiens
gtgtgcatggaggccctcctgt

SEQ ID NO: 4106527 - DNA, 13 bp, Homo sapiens
gtgtgcctggaag

SEQ ID NO: 4106528 - DNA, 16 bp, Homo sapiens
gtgtgcctgggggagt

SEQ ID NO: 4106529 - DNA, 15 bp, Homo sapiens
gtgtggattttctac

SEQ ID NO: 4106530 - DNA, 12 bp, Homo sapiens
gtgtggcagtgg

SEQ ID NO: 4106531 - DNA, 21 bp, Homo sapiens
gtgtggcctcagccctcagaa

SEQ ID NO: 4106532 - DNA, 20 bp, Homo sapiens
gtgtggggacacagcagtga

SEQ ID NO: 4106533 - DNA, 19 bp, Homo sapiens
gtgtggggggctgggggag

SEQ ID NO: 4106534 - DNA, 13 bp, Homo sapiens
gtgtggggtgggg

SEQ ID NO: 4106535 - DNA, 23 bp, Homo sapiens
gtgtgggtgatgggactcattgt

SEQ ID NO: 4106536 - DNA, 20 bp, Homo sapiens
gtgtggtgaggggctttctc

SEQ ID NO: 4106537 - DNA, 16 bp, Homo sapiens
gttagaaaatgactta

SEQ ID NO: 4106538 - DNA, 23 bp, Homo sapiens
gttagactgacttgtttgtcttc

SEQ ID NO: 4106539 - DNA, 22 bp, Homo sapiens
gttagagagggaccatgtgtca

SEQ ID NO: 4106540 - DNA, 23 bp, Homo sapiens
gttagagagggaccatgtgtcac

SEQ ID NO: 4106541 - DNA, 18 bp, Homo sapiens
gttagcagacaggccccg

SEQ ID NO: 4106542 - DNA, 13 bp, Homo sapiens
gttagcctcttgc

SEQ ID NO: 4106543 - DNA, 11 bp, Homo sapiens
gttagctgagc

SEQ ID NO: 4106544 - DNA, 19 bp, Homo sapiens
gttagctttttaaaacatt

SEQ ID NO: 4106545 - DNA, 21 bp, Homo sapiens
gttaggagtggttctcatttg

SEQ ID NO: 4106546 - DNA, 15 bp, Homo sapiens
gttaggatttaacag

SEQ ID NO: 4106547 - DNA, 14 bp, Homo sapiens
gttaggcagcaagc

SEQ ID NO: 4106548 - DNA, 18 bp, Homo sapiens
gttaggtagagggagttg

SEQ ID NO: 4106549 - DNA, 22 bp, Homo sapiens
gttaggtcctcacttgggggaa

SEQ ID NO: 4106550 - DNA, 23 bp, Homo sapiens
gttagtaacatgaggggacattt

SEQ ID NO: 4106551 - DNA, 17 bp, Homo sapiens
gttagtatctaacatgt

SEQ ID NO: 4106552 - DNA, 22 bp, Homo sapiens
gttagtcatttgctgagcatgt

SEQ ID NO: 4106553 - DNA, 14 bp, Homo sapiens
gttagtttacaata

SEQ ID NO: 4106554 - DNA, 15 bp, Homo sapiens
gttagtttagtgtgt

SEQ ID NO: 4106555 - DNA, 13 bp, Homo sapiens
gttataaatagcc

SEQ ID NO: 4106556 - DNA, 15 bp, Homo sapiens
gttataaatagcctt

SEQ ID NO: 4106557 - DNA, 17 bp, Homo sapiens
gttataaatcaatgtca

SEQ ID NO: 4106558 - DNA, 17 bp, Homo sapiens
gttataggtcactcctg

SEQ ID NO: 4106559 - DNA, 16 bp, Homo sapiens
gttatagtatatctgg

SEQ ID NO: 4106560 - DNA, 19 bp, Homo sapiens
gttatagtatatctggaca

SEQ ID NO: 4106561 - DNA, 18 bp, Homo sapiens
gttatattagtgaagatg

SEQ ID NO: 4106562 - DNA, 17 bp, Homo sapiens
gttatattatttacatt

SEQ ID NO: 4106563 - DNA, 18 bp, Homo sapiens
gttatcccaatcattgtt

SEQ ID NO: 4106564 - DNA, 21 bp, Homo sapiens
gttatcccttccttttagcct

SEQ ID NO: 4106565 - DNA, 14 bp, Homo sapiens
gttatcgaaataac

SEQ ID NO: 4106566 - DNA, 21 bp, Homo sapiens
gttatcgaaataacaatgtta

SEQ ID NO: 4106567 - DNA, 18 bp, Homo sapiens
gttatgaaagaatatatt

SEQ ID NO: 4106568 - DNA, 22 bp, Homo sapiens
gttatgatattgtttaaaattc

SEQ ID NO: 4106569 - DNA, 22 bp, Homo sapiens
gttatgtaccatatgatctgtt

SEQ ID NO: 4106570 - DNA, 17 bp, Homo sapiens
gttatgtactagtgttc

SEQ ID NO: 4106571 - DNA, 18 bp, Homo sapiens
gttatgtctgtttaagaa

SEQ ID NO: 4106572 - DNA, 22 bp, Homo sapiens
gttatgtgaatgatctctctga

SEQ ID NO: 4106573 - DNA, 21 bp, Homo sapiens
gttattaactttaatgttttt

SEQ ID NO: 4106574 - DNA, 22 bp, Homo sapiens
gttattcattctgtgatcattt

SEQ ID NO: 4106575 - DNA, 23 bp, Homo sapiens
gttattcattctgtgatcattta

SEQ ID NO: 4106576 - DNA, 12 bp, Homo sapiens
gttattccatca

SEQ ID NO: 4106577 - DNA, 18 bp, Homo sapiens
gttattccttgatcattt

SEQ ID NO: 4106578 - DNA, 13 bp, Homo sapiens
gttattctggagt

SEQ ID NO: 4106579 - DNA, 15 bp, Homo sapiens
gttatttcttccctg

SEQ ID NO: 4106580 - DNA, 22 bp, Homo sapiens
gttatttgaaaacatgtttatt

SEQ ID NO: 4106581 - DNA, 16 bp, Homo sapiens
gttatttgcacactgc

SEQ ID NO: 4106582 - DNA, 13 bp, Homo sapiens
gttattttggata

SEQ ID NO: 4106583 - DNA, 18 bp, Homo sapiens
gttatttttcaaggaagg

SEQ ID NO: 4106584 - DNA, 14 bp, Homo sapiens
gttatttttctctt

SEQ ID NO: 4106585 - DNA, 16 bp, Homo sapiens
gttattttttaattat

SEQ ID NO: 4106586 - DNA, 13 bp, Homo sapiens
gttcaaaatgtct

SEQ ID NO: 4106587 - DNA, 16 bp, Homo sapiens
gttcaacccacagcta

SEQ ID NO: 4106588 - DNA, 20 bp, Homo sapiens
gttcaacctggtggcaccag

SEQ ID NO: 4106589 - DNA, 12 bp, Homo sapiens
gttcaagttttg

SEQ ID NO: 4106590 - DNA, 23 bp, Homo sapiens
gttcaataaagcactgagcaagt

SEQ ID NO: 4106591 - DNA, 18 bp, Homo sapiens
gttcaatctcccgctgct

SEQ ID NO: 4106592 - DNA, 11 bp, Homo sapiens
gttcacaggag

SEQ ID NO: 4106593 - DNA, 12 bp, Homo sapiens
gttcacaggagg

SEQ ID NO: 4106594 - DNA, 21 bp, Homo sapiens
gttcacaggaggccagtgggc

SEQ ID NO: 4106595 - DNA, 16 bp, Homo sapiens
gttcacatagtgaaat

SEQ ID NO: 4106596 - DNA, 15 bp, Homo sapiens
gttcaccctgcatta

SEQ ID NO: 4106597 - DNA, 16 bp, Homo sapiens
gttcaccctgcattac

SEQ ID NO: 4106598 - DNA, 15 bp, Homo sapiens
gttcacgctcaccca

SEQ ID NO: 4106599 - DNA, 18 bp, Homo sapiens
gttcacgtaagatacaag

SEQ ID NO: 4106600 - DNA, 20 bp, Homo sapiens
gttcactgaaggtgattcac

SEQ ID NO: 4106601 - DNA, 21 bp, Homo sapiens
gttcactgagctccccagatc

SEQ ID NO: 4106602 - DNA, 24 bp, Homo sapiens
gttcactggacacttcacgccctt

SEQ ID NO: 4106603 - DNA, 21 bp, Homo sapiens
gttcagaaaaaaggttctttg

SEQ ID NO: 4106604 - DNA, 12 bp, Homo sapiens
gttcagaattta

SEQ ID NO: 4106605 - DNA, 18 bp, Homo sapiens
gttcagcactgtcccttg

SEQ ID NO: 4106606 - DNA, 12 bp, Homo sapiens
gttcagcctggc

SEQ ID NO: 4106607 - DNA, 18 bp, Homo sapiens
gttcaggagtcccaagga

SEQ ID NO: 4106608 - DNA, 20 bp, Homo sapiens
gttcaggagtcccaaggaaa

SEQ ID NO: 4106609 - DNA, 21 bp, Homo sapiens
gttcaggagtcccaaggaaag

SEQ ID NO: 4106610 - DNA, 23 bp, Homo sapiens
gttcagtgagatatcatagagac

SEQ ID NO: 4106611 - DNA, 16 bp, Homo sapiens
gttcagtgtcccaggc

SEQ ID NO: 4106612 - DNA, 17 bp, Homo sapiens
gttcagtgtttctgggg

SEQ ID NO: 4106613 - DNA, 19 bp, Homo sapiens
gttcataaccaacaatata

SEQ ID NO: 4106614 - DNA, 17 bp, Homo sapiens
gttcatagggtctcttc

SEQ ID NO: 4106615 - DNA, 20 bp, Homo sapiens
gttcatagggtctcttcagg

SEQ ID NO: 4106616 - DNA, 19 bp, Homo sapiens
gttcatccaatcctcactg

SEQ ID NO: 4106617 - DNA, 16 bp, Homo sapiens
gttcatcccttctctt

SEQ ID NO: 4106618 - DNA, 17 bp, Homo sapiens
gttcatcctattgttga

SEQ ID NO: 4106619 - DNA, 18 bp, Homo sapiens
gttcatcctattgttgat

SEQ ID NO: 4106620 - DNA, 24 bp, Homo sapiens
gttcatctgtccatggcctttcta

SEQ ID NO: 4106621 - DNA, 16 bp, Homo sapiens
gttcatgtagagaaaa

SEQ ID NO: 4106622 - DNA, 15 bp, Homo sapiens
gttcatgtttgcttc

SEQ ID NO: 4106623 - DNA, 18 bp, Homo sapiens
gttcattgtaatgttact

SEQ ID NO: 4106624 - DNA, 17 bp, Homo sapiens
gttccaaacatgaggtt

SEQ ID NO: 4106625 - DNA, 23 bp, Homo sapiens
gttccaaacatgaggttctctct

SEQ ID NO: 4106626 - DNA, 16 bp, Homo sapiens
gttccaaagccagtga

SEQ ID NO: 4106627 - DNA, 17 bp, Homo sapiens
gttccaaagccagtgaa

SEQ ID NO: 4106628 - DNA, 20 bp, Homo sapiens
gttccaaattcagtttcata

SEQ ID NO: 4106629 - DNA, 14 bp, Homo sapiens
gttccaagacattg

SEQ ID NO: 4106630 - DNA, 15 bp, Homo sapiens
gttccaagacattgt

SEQ ID NO: 4106631 - DNA, 17 bp, Homo sapiens
gttccaagacattgtca

SEQ ID NO: 4106632 - DNA, 17 bp, Homo sapiens
gttccaagtccaataag

SEQ ID NO: 4106633 - DNA, 18 bp, Homo sapiens
gttccacagttgccacca

SEQ ID NO: 4106634 - DNA, 21 bp, Homo sapiens
gttccagaaggatccaagaca

SEQ ID NO: 4106635 - DNA, 23 bp, Homo sapiens
gttccatgaagaccacatccaca

SEQ ID NO: 4106636 - DNA, 14 bp, Homo sapiens
gttccatgcctgag

SEQ ID NO: 4106637 - DNA, 20 bp, Homo sapiens
gttccatgttctatttttga

SEQ ID NO: 4106638 - DNA, 15 bp, Homo sapiens
gttcccaataaaagt

SEQ ID NO: 4106639 - DNA, 13 bp, Homo sapiens
gttcccagcaggg

SEQ ID NO: 4106640 - DNA, 15 bp, Homo sapiens
ctcacacacacagct

SEQ ID NO: 4106641 - DNA, 16 bp, Homo sapiens
ctcacacaccctgagg

SEQ ID NO: 4106642 - DNA, 17 bp, Homo sapiens
ctcacacaccctgaggt

SEQ ID NO: 4106643 - DNA, 20 bp, Homo sapiens
ctcacacattcccccaccag

SEQ ID NO: 4106644 - DNA, 15 bp, Homo sapiens
ctcacacccctgtcc

SEQ ID NO: 4106645 - DNA, 16 bp, Homo sapiens
ctcacacccctgtccc

SEQ ID NO: 4106646 - DNA, 20 bp, Homo sapiens
ctcacacccctgtcccaccc

SEQ ID NO: 4106647 - DNA, 18 bp, Homo sapiens
ctcacactcccctagggg

SEQ ID NO: 4106648 - DNA, 20 bp, Homo sapiens
ctcacagatgtgactgtata

SEQ ID NO: 4106649 - DNA, 18 bp, Homo sapiens
ctcacaggccctggagaa

SEQ ID NO: 4106650 - DNA, 19 bp, Homo sapiens
ctcacatgggactgggata

SEQ ID NO: 4106651 - DNA, 20 bp, Homo sapiens
ctcacatgtggcaaaatatg

SEQ ID NO: 4106652 - DNA, 15 bp, Homo sapiens
ctcacattcctaggg

SEQ ID NO: 4106653 - DNA, 22 bp, Homo sapiens
ctcacattcgacataccccact

SEQ ID NO: 4106654 - DNA, 23 bp, Homo sapiens
ctcaccaaggatcggactctgcc

SEQ ID NO: 4106655 - DNA, 12 bp, Homo sapiens
ctcaccacctgc

SEQ ID NO: 4106656 - DNA, 18 bp, Homo sapiens
ctcaccacctgcctctaa

SEQ ID NO: 4106657 - DNA, 17 bp, Homo sapiens
ctcaccagccctgcagc

SEQ ID NO: 4106658 - DNA, 13 bp, Homo sapiens
ctcaccagctgtg

SEQ ID NO: 4106659 - DNA, 20 bp, Homo sapiens
ctcaccagtgtcccctccac

SEQ ID NO: 4106660 - DNA, 17 bp, Homo sapiens
ctcaccattgtgaagca

SEQ ID NO: 4106661 - DNA, 15 bp, Homo sapiens
ctcacccagtcacct

SEQ ID NO: 4106662 - DNA, 21 bp, Homo sapiens
ctcacccatcccacccctcca

SEQ ID NO: 4106663 - DNA, 16 bp, Homo sapiens
ctcacccatgtgccaa

SEQ ID NO: 4106664 - DNA, 14 bp, Homo sapiens
ctcacccccagcac

SEQ ID NO: 4106665 - DNA, 21 bp, Homo sapiens
ctcacccccagcacaggggga

SEQ ID NO: 4106666 - DNA, 14 bp, Homo sapiens
ctcacccctgggca

SEQ ID NO: 4106667 - DNA, 15 bp, Homo sapiens
ctcacccggcctctt

SEQ ID NO: 4106668 - DNA, 15 bp, Homo sapiens
ctcaccctgccttat

SEQ ID NO: 4106669 - DNA, 15 bp, Homo sapiens
ctcaccctgctacac

SEQ ID NO: 4106670 - DNA, 16 bp, Homo sapiens
ctcaccgcccatcagg

SEQ ID NO: 4106671 - DNA, 21 bp, Homo sapiens
ctcaccgctggcccttagaga

SEQ ID NO: 4106672 - DNA, 23 bp, Homo sapiens
ctcacctaatgtttatgagccag

SEQ ID NO: 4106673 - DNA, 14 bp, Homo sapiens
ctcacctctggact

SEQ ID NO: 4106674 - DNA, 22 bp, Homo sapiens
ctcacctctggactggctagag

SEQ ID NO: 4106675 - DNA, 15 bp, Homo sapiens
ctcaccttcctgtgg

SEQ ID NO: 4106676 - DNA, 16 bp, Homo sapiens
ctcaccttggcaccag

SEQ ID NO: 4106677 - DNA, 22 bp, Homo sapiens
ctcacctttgttttttgttgga

SEQ ID NO: 4106678 - DNA, 13 bp, Homo sapiens
ctcacgcaggctg

SEQ ID NO: 4106679 - DNA, 13 bp, Homo sapiens
ctcacgcctgtaa

SEQ ID NO: 4106680 - DNA, 18 bp, Homo sapiens
ctcacgcctgtaatccca

SEQ ID NO: 4106681 - DNA, 21 bp, Homo sapiens
ctcacgcctgtaatcccagca

SEQ ID NO: 4106682 - DNA, 14 bp, Homo sapiens
ctcactattcttgg

SEQ ID NO: 4106683 - DNA, 20 bp, Homo sapiens
ctcactcagaagtccagagt

SEQ ID NO: 4106684 - DNA, 15 bp, Homo sapiens
ctcactccccaggga

SEQ ID NO: 4106685 - DNA, 13 bp, Homo sapiens
ctcactcctacct

SEQ ID NO: 4106686 - DNA, 15 bp, Homo sapiens
ctcactcctacctgg

SEQ ID NO: 4106687 - DNA, 16 bp, Homo sapiens
ctcactcctacctggt

SEQ ID NO: 4106688 - DNA, 14 bp, Homo sapiens
ctcactctggcctc

SEQ ID NO: 4106689 - DNA, 15 bp, Homo sapiens
ctcactctggcctca

SEQ ID NO: 4106690 - DNA, 13 bp, Homo sapiens
ctcactgaactcc

SEQ ID NO: 4106691 - DNA, 17 bp, Homo sapiens
ctcactgaactccaccg

SEQ ID NO: 4106692 - DNA, 16 bp, Homo sapiens
ctcactgaagcctgcg

SEQ ID NO: 4106693 - DNA, 13 bp, Homo sapiens
ctcactgccaggc

SEQ ID NO: 4106694 - DNA, 14 bp, Homo sapiens
ctcactgccaggcc

SEQ ID NO: 4106695 - DNA, 19 bp, Homo sapiens
ctcactgccaggccagcct

SEQ ID NO: 4106696 - DNA, 12 bp, Homo sapiens
ctcactgctcaa

SEQ ID NO: 4106697 - DNA, 20 bp, Homo sapiens
ctcactgctcaagaagacat

SEQ ID NO: 4106698 - DNA, 12 bp, Homo sapiens
ctcactgtgatc

SEQ ID NO: 4106699 - DNA, 18 bp, Homo sapiens
ctcacttccatacagctc

SEQ ID NO: 4106700 - DNA, 20 bp, Homo sapiens
ctcactttcctcctgaggct

SEQ ID NO: 4106701 - DNA, 16 bp, Homo sapiens
ctcagaaactcccctg

SEQ ID NO: 4106702 - DNA, 19 bp, Homo sapiens
ctcagaaactcccctgggg

SEQ ID NO: 4106703 - DNA, 16 bp, Homo sapiens
ctcagaaagtgcctga

SEQ ID NO: 4106704 - DNA, 17 bp, Homo sapiens
ctcagaaagtgcctgac

SEQ ID NO: 4106705 - DNA, 17 bp, Homo sapiens
ctcagaaatttttattt

SEQ ID NO: 4106706 - DNA, 17 bp, Homo sapiens
ctcagaacttgctgctg

SEQ ID NO: 4106707 - DNA, 22 bp, Homo sapiens
ctcagaagtgaaaatcttggag

SEQ ID NO: 4106708 - DNA, 18 bp, Homo sapiens
ctcagaatattgtctgcc

SEQ ID NO: 4106709 - DNA, 17 bp, Homo sapiens
ctcagaattatttttaa

SEQ ID NO: 4106710 - DNA, 19 bp, Homo sapiens
ctcagacatgttttccgtg

SEQ ID NO: 4106711 - DNA, 20 bp, Homo sapiens
ctcagacatgttttccgtga

SEQ ID NO: 4106712 - DNA, 17 bp, Homo sapiens
ctcagacattggcacct

SEQ ID NO: 4106713 - DNA, 13 bp, Homo sapiens
ctcagaccaactc

SEQ ID NO: 4106714 - DNA, 18 bp, Homo sapiens
ctcagacggcggccaggc

SEQ ID NO: 4106715 - DNA, 22 bp, Homo sapiens
ctcagacggcggccaggcacag

SEQ ID NO: 4106716 - DNA, 19 bp, Homo sapiens
ctcagagaaaaatgctccc

SEQ ID NO: 4106717 - DNA, 23 bp, Homo sapiens
ctcagagaaaaatgctccccaca

SEQ ID NO: 4106718 - DNA, 21 bp, Homo sapiens
ctcagagactgcaagctgctt

SEQ ID NO: 4106719 - DNA, 17 bp, Homo sapiens
ctcagagcatctggctg

SEQ ID NO: 4106720 - DNA, 11 bp, Homo sapiens
ctcagagccaa

SEQ ID NO: 4106721 - DNA, 15 bp, Homo sapiens
ctcagagccaagtcc

SEQ ID NO: 4106722 - DNA, 15 bp, Homo sapiens
ctcagagccacccct

SEQ ID NO: 4106723 - DNA, 19 bp, Homo sapiens
ctcagagcgccaggaagcc

SEQ ID NO: 4106724 - DNA, 22 bp, Homo sapiens
ctcagagcgccaggaagccaga

SEQ ID NO: 4106725 - DNA, 23 bp, Homo sapiens
ctcagagcgccaggaagccagag

SEQ ID NO: 4106726 - DNA, 16 bp, Homo sapiens
ctcagagcttgaagat

SEQ ID NO: 4106727 - DNA, 21 bp, Homo sapiens
ctcagaggcagcttcaagtgc

SEQ ID NO: 4106728 - DNA, 22 bp, Homo sapiens
ctcagaggcagcttcaagtgcc

SEQ ID NO: 4106729 - DNA, 15 bp, Homo sapiens
ctcagaggcccagga

SEQ ID NO: 4106730 - DNA, 13 bp, Homo sapiens
ctcagaggcctgc

SEQ ID NO: 4106731 - DNA, 23 bp, Homo sapiens
ctcagaggtttacctagagaaca

SEQ ID NO: 4106732 - DNA, 14 bp, Homo sapiens
ctcagatatttata

SEQ ID NO: 4106733 - DNA, 15 bp, Homo sapiens
ctcagatccagggac

SEQ ID NO: 4106734 - DNA, 18 bp, Homo sapiens
ctcagatccagggacaga

SEQ ID NO: 4106735 - DNA, 22 bp, Homo sapiens
ctcagatccagggacagaggcc

SEQ ID NO: 4106736 - DNA, 15 bp, Homo sapiens
ctcagatctgtctga

SEQ ID NO: 4106737 - DNA, 20 bp, Homo sapiens
ctcagatgatctctccacgg

SEQ ID NO: 4106738 - DNA, 22 bp, Homo sapiens
ctcagatggactgggaggaggg

SEQ ID NO: 4106739 - DNA, 12 bp, Homo sapiens
ctcagattcttc

SEQ ID NO: 4106740 - DNA, 22 bp, Homo sapiens
ctcagattcttcattgaggatt

SEQ ID NO: 4106741 - DNA, 17 bp, Homo sapiens
ctcagcaattcagaccc

SEQ ID NO: 4106742 - DNA, 17 bp, Homo sapiens
ctcagcatttccttcca

SEQ ID NO: 4106743 - DNA, 19 bp, Homo sapiens
ctataatcccagcactttg

SEQ ID NO: 4106744 - DNA, 16 bp, Homo sapiens
ctataatgtaagctct

SEQ ID NO: 4106745 - DNA, 21 bp, Homo sapiens
ctataatgtaagctctactga

SEQ ID NO: 4106746 - DNA, 22 bp, Homo sapiens
ctataattccctatcttttagt

SEQ ID NO: 4106747 - DNA, 14 bp, Homo sapiens
ctatacatatcttt

SEQ ID NO: 4106748 - DNA, 16 bp, Homo sapiens
ctatacatctctcccc

SEQ ID NO: 4106749 - DNA, 17 bp, Homo sapiens
ctatacctgcacgttca

SEQ ID NO: 4106750 - DNA, 16 bp, Homo sapiens
ctatagcactgagctc

SEQ ID NO: 4106751 - DNA, 15 bp, Homo sapiens
ctataggctggagaa

SEQ ID NO: 4106752 - DNA, 17 bp, Homo sapiens
ctataggctggagaagc

SEQ ID NO: 4106753 - DNA, 14 bp, Homo sapiens
ctatataatttatt

SEQ ID NO: 4106754 - DNA, 16 bp, Homo sapiens
ctatataatttatttc

SEQ ID NO: 4106755 - DNA, 20 bp, Homo sapiens
ctatataatttatttccact

SEQ ID NO: 4106756 - DNA, 18 bp, Homo sapiens
ctatatagaatgctgcac

SEQ ID NO: 4106757 - DNA, 15 bp, Homo sapiens
ctatatccatgtact

SEQ ID NO: 4106758 - DNA, 18 bp, Homo sapiens
ctatatccatgtactgta

SEQ ID NO: 4106759 - DNA, 19 bp, Homo sapiens
ctatatccatgtactgtag

SEQ ID NO: 4106760 - DNA, 20 bp, Homo sapiens
ctatatccatgtactgtagt

SEQ ID NO: 4106761 - DNA, 17 bp, Homo sapiens
ctatatcctgtgactgt

SEQ ID NO: 4106762 - DNA, 15 bp, Homo sapiens
ctatatgaaaaacaa

SEQ ID NO: 4106763 - DNA, 20 bp, Homo sapiens
ctatatgtgaaacatttttt

SEQ ID NO: 4106764 - DNA, 22 bp, Homo sapiens
ctatatgtgaaacattttttct

SEQ ID NO: 4106765 - DNA, 21 bp, Homo sapiens
ctatattatcataagaatttt

SEQ ID NO: 4106766 - DNA, 18 bp, Homo sapiens
ctatattgattgtccttt

SEQ ID NO: 4106767 - DNA, 12 bp, Homo sapiens
ctatatttgcta

SEQ ID NO: 4106768 - DNA, 23 bp, Homo sapiens
ctatatttgctagactctagaca

SEQ ID NO: 4106769 - DNA, 15 bp, Homo sapiens
ctatcaagtcaatca

SEQ ID NO: 4106770 - DNA, 21 bp, Homo sapiens
ctatcaagtcaatcatttctc

SEQ ID NO: 4106771 - DNA, 23 bp, Homo sapiens
ctatcaagtgtgctttagcttga

SEQ ID NO: 4106772 - DNA, 13 bp, Homo sapiens
ctatcaatgagtt

SEQ ID NO: 4106773 - DNA, 14 bp, Homo sapiens
ctatcagtactttt

SEQ ID NO: 4106774 - DNA, 20 bp, Homo sapiens
ctatcagtacttttattaat

SEQ ID NO: 4106775 - DNA, 14 bp, Homo sapiens
ctatcatggagtga

SEQ ID NO: 4106776 - DNA, 13 bp, Homo sapiens
ctatcatggcata

SEQ ID NO: 4106777 - DNA, 18 bp, Homo sapiens
ctatccaaagaacttgat

SEQ ID NO: 4106778 - DNA, 17 bp, Homo sapiens
ctatccccaatcagctc

SEQ ID NO: 4106779 - DNA, 23 bp, Homo sapiens
ctatccccatctccctgcctggc

SEQ ID NO: 4106780 - DNA, 18 bp, Homo sapiens
ctatccctaggcacttaa

SEQ ID NO: 4106781 - DNA, 23 bp, Homo sapiens
ctatcctgacttctaatatcatt

SEQ ID NO: 4106782 - DNA, 17 bp, Homo sapiens
ctatcctgcgggtttta

SEQ ID NO: 4106783 - DNA, 17 bp, Homo sapiens
ctatcctgggcttttgt

SEQ ID NO: 4106784 - DNA, 18 bp, Homo sapiens
ctatccttataggcctgt

SEQ ID NO: 4106785 - DNA, 20 bp, Homo sapiens
ctatcgagtttgcaatgtca

SEQ ID NO: 4106786 - DNA, 18 bp, Homo sapiens
ctatcgttattataaatg

SEQ ID NO: 4106787 - DNA, 22 bp, Homo sapiens
ctatctaggtggagttgaaaga

SEQ ID NO: 4106788 - DNA, 16 bp, Homo sapiens
ctatctattaaagtga

SEQ ID NO: 4106789 - DNA, 17 bp, Homo sapiens
ctatctattaaagtgac

SEQ ID NO: 4106790 - DNA, 21 bp, Homo sapiens
ctatctattaaagtgactttc

SEQ ID NO: 4106791 - DNA, 17 bp, Homo sapiens
ctatctcgtgggagagc

SEQ ID NO: 4106792 - DNA, 17 bp, Homo sapiens
ctatctctcaaaacttg

SEQ ID NO: 4106793 - DNA, 15 bp, Homo sapiens
ctatctgcactctaa

SEQ ID NO: 4106794 - DNA, 18 bp, Homo sapiens
ctatctgcactctaaact

SEQ ID NO: 4106795 - DNA, 21 bp, Homo sapiens
ctatctgtcatctctctgggg

SEQ ID NO: 4106796 - DNA, 13 bp, Homo sapiens
ctatcttccaaat

SEQ ID NO: 4106797 - DNA, 14 bp, Homo sapiens
ctatcttccaaatg

SEQ ID NO: 4106798 - DNA, 15 bp, Homo sapiens
ctatcttcttcaaat

SEQ ID NO: 4106799 - DNA, 20 bp, Homo sapiens
ctatcttcttcaaatacaaa

SEQ ID NO: 4106800 - DNA, 13 bp, Homo sapiens
ctatgaactacaa

SEQ ID NO: 4106801 - DNA, 17 bp, Homo sapiens
ctatgaattctaagtga

SEQ ID NO: 4106802 - DNA, 16 bp, Homo sapiens
ctatgacactgagcaa

SEQ ID NO: 4106803 - DNA, 20 bp, Homo sapiens
ctatgatatggtaaaagtta

SEQ ID NO: 4106804 - DNA, 20 bp, Homo sapiens
ctatgcatggtgccccagga

SEQ ID NO: 4106805 - DNA, 19 bp, Homo sapiens
ctatgccagctcagtccca

SEQ ID NO: 4106806 - DNA, 14 bp, Homo sapiens
ctatggacaactta

SEQ ID NO: 4106807 - DNA, 17 bp, Homo sapiens
ctatggacaacttattt

SEQ ID NO: 4106808 - DNA, 21 bp, Homo sapiens
ctatggacagcattgccagta

SEQ ID NO: 4106809 - DNA, 14 bp, Homo sapiens
ctatggatggcttc

SEQ ID NO: 4106810 - DNA, 15 bp, Homo sapiens
ctatggatggcttct

SEQ ID NO: 4106811 - DNA, 15 bp, Homo sapiens
ctatggcccagaaac

SEQ ID NO: 4106812 - DNA, 13 bp, Homo sapiens
ctatgggaacaat

SEQ ID NO: 4106813 - DNA, 13 bp, Homo sapiens
ctatgggcctgcc

SEQ ID NO: 4106814 - DNA, 23 bp, Homo sapiens
ctatgggcctgccgggctgaggg

SEQ ID NO: 4106815 - DNA, 22 bp, Homo sapiens
ctatggtatgctggccagcacc

SEQ ID NO: 4106816 - DNA, 16 bp, Homo sapiens
ctatggttatgaaaga

SEQ ID NO: 4106817 - DNA, 23 bp, Homo sapiens
ctatggttcccaataaaagtgac

SEQ ID NO: 4106818 - DNA, 16 bp, Homo sapiens
ctatgtatcaatgagt

SEQ ID NO: 4106819 - DNA, 14 bp, Homo sapiens
ctatgtatggaata

SEQ ID NO: 4106820 - DNA, 15 bp, Homo sapiens
ctatgtcctaaggac

SEQ ID NO: 4106821 - DNA, 23 bp, Homo sapiens
ctatgtcctaaggacacactaat

SEQ ID NO: 4106822 - DNA, 12 bp, Homo sapiens
ctatgtgacaat

SEQ ID NO: 4106823 - DNA, 15 bp, Homo sapiens
ctatgtgctgggtgc

SEQ ID NO: 4106824 - DNA, 16 bp, Homo sapiens
ctatgttaaatactgt

SEQ ID NO: 4106825 - DNA, 22 bp, Homo sapiens
ctatgttaaatactgtgcagaa

SEQ ID NO: 4106826 - DNA, 22 bp, Homo sapiens
ctatgttactattttctacaat

SEQ ID NO: 4106827 - DNA, 22 bp, Homo sapiens
ctatgttgggggggaccctgcc

SEQ ID NO: 4106828 - DNA, 22 bp, Homo sapiens
ctattaagcagtaaaaactgtt

SEQ ID NO: 4106829 - DNA, 21 bp, Homo sapiens
ctattaaggtgatatatttaa

SEQ ID NO: 4106830 - DNA, 12 bp, Homo sapiens
ctattaatatat

SEQ ID NO: 4106831 - DNA, 15 bp, Homo sapiens
ctattaatatatgta

SEQ ID NO: 4106832 - DNA, 17 bp, Homo sapiens
ctattacattttcagtg

SEQ ID NO: 4106833 - DNA, 18 bp, Homo sapiens
ctattatagccacatccc

SEQ ID NO: 4106834 - DNA, 13 bp, Homo sapiens
ctattattatgaa

SEQ ID NO: 4106835 - DNA, 21 bp, Homo sapiens
ctattcaggagagtagaacag

SEQ ID NO: 4106836 - DNA, 12 bp, Homo sapiens
ctattccaggaa

SEQ ID NO: 4106837 - DNA, 19 bp, Homo sapiens
ctattccaggaattcctct

SEQ ID NO: 4106838 - DNA, 17 bp, Homo sapiens
ctattccctttgacttc

SEQ ID NO: 4106839 - DNA, 19 bp, Homo sapiens
ctattctcaaagtttccta

SEQ ID NO: 4106840 - DNA, 21 bp, Homo sapiens
ctattctcaaagtttcctaat

SEQ ID NO: 4106841 - DNA, 12 bp, Homo sapiens
ctattctctctt

SEQ ID NO: 4106842 - DNA, 22 bp, Homo sapiens
ctattctgtcagtgttaaagat

SEQ ID NO: 4106843 - DNA, 19 bp, Homo sapiens
ctattctgtgttgcattat

SEQ ID NO: 4106844 - DNA, 24 bp, Homo sapiens
ctattctgtgttgcattattcatt

SEQ ID NO: 4106845 - DNA, 23 bp, Homo sapiens
ctattcttggaccatgccagatt

SEQ ID NO: 4106846 - DNA, 16 bp, Homo sapiens
ctattgagtcttcatg

SEQ ID NO: 4106847 - DNA, 14 bp, Homo sapiens
ctattgatactctt

SEQ ID NO: 4106848 - DNA, 18 bp, Homo sapiens
ctattgatttttacttca

SEQ ID NO: 4106849 - DNA, 12 bp, Homo sapiens
ctattgccttct

SEQ ID NO: 4106850 - DNA, 20 bp, Homo sapiens
ctattgccttctttgaagaa

SEQ ID NO: 4106851 - DNA, 16 bp, Homo sapiens
ctattgcgctctcaag

SEQ ID NO: 4106852 - DNA, 15 bp, Homo sapiens
ctattgggttcatta

SEQ ID NO: 4106853 - DNA, 16 bp, Homo sapiens
ctattgggttcattat

SEQ ID NO: 4106854 - DNA, 23 bp, Homo sapiens
ctattgggttcattattggaatt

SEQ ID NO: 4106855 - DNA, 16 bp, Homo sapiens
ctattgtgccaactgc

SEQ ID NO: 4106856 - DNA, 21 bp, Homo sapiens
ctattgtgggacttattacaa

SEQ ID NO: 4106857 - DNA, 15 bp, Homo sapiens
ctatttaaaaaagag

SEQ ID NO: 4106858 - DNA, 20 bp, Homo sapiens
ctatttaaacttataaatca

SEQ ID NO: 4106859 - DNA, 15 bp, Homo sapiens
ctatttaaagcctcc

SEQ ID NO: 4106860 - DNA, 19 bp, Homo sapiens
ctatttacaagatggactt

SEQ ID NO: 4106861 - DNA, 22 bp, Homo sapiens
ctatttatctgtgtttttgaaa

SEQ ID NO: 4106862 - DNA, 14 bp, Homo sapiens
ctatttatgccttg

SEQ ID NO: 4106863 - DNA, 20 bp, Homo sapiens
ctatttatgccttgatgatt

SEQ ID NO: 4106864 - DNA, 14 bp, Homo sapiens
ctatttattaatat

SEQ ID NO: 4106865 - DNA, 17 bp, Homo sapiens
ctatttattaatattta

SEQ ID NO: 4106866 - DNA, 20 bp, Homo sapiens
ctatttattaatatttaaca

SEQ ID NO: 4106867 - DNA, 21 bp, Homo sapiens
ctatttattaatatttaacat

SEQ ID NO: 4106868 - DNA, 19 bp, Homo sapiens
ctatttcagtgttacctgt

SEQ ID NO: 4106869 - DNA, 21 bp, Homo sapiens
ctatttccccaggggaaaatg

SEQ ID NO: 4106870 - DNA, 19 bp, Homo sapiens
ctatttccccctttcttcc

SEQ ID NO: 4106871 - DNA, 15 bp, Homo sapiens
ctatttgaaatacta

SEQ ID NO: 4106872 - DNA, 22 bp, Homo sapiens
ctatttgaaatactaaaagcaa

SEQ ID NO: 4106873 - DNA, 22 bp, Homo sapiens
ctatttgccatgggcttcactg

SEQ ID NO: 4106874 - DNA, 23 bp, Homo sapiens
ctatttgccatgggcttcactgt

SEQ ID NO: 4106875 - DNA, 18 bp, Homo sapiens
ctatttgtaaatctgcca

SEQ ID NO: 4106876 - DNA, 23 bp, Homo sapiens
ctatttgttttcttctgtatgtt

SEQ ID NO: 4106877 - DNA, 19 bp, Homo sapiens
ctattttactttgtacttg

SEQ ID NO: 4106878 - DNA, 15 bp, Homo sapiens
ctattttagaataaa

SEQ ID NO: 4106879 - DNA, 14 bp, Homo sapiens
ctattttcctctgg

SEQ ID NO: 4106880 - DNA, 12 bp, Homo sapiens
ctattttcttaa

SEQ ID NO: 4106881 - DNA, 15 bp, Homo sapiens
ctattttctttttta

SEQ ID NO: 4106882 - DNA, 19 bp, Homo sapiens
ctattttgacagttatttt

SEQ ID NO: 4106883 - DNA, 23 bp, Homo sapiens
ctattttgggtattaatatatag

SEQ ID NO: 4106884 - DNA, 11 bp, Homo sapiens
ctattttgtga

SEQ ID NO: 4106885 - DNA, 16 bp, Homo sapiens
ctatttttatttatat

SEQ ID NO: 4106886 - DNA, 14 bp, Homo sapiens
ctatttttgactgt

SEQ ID NO: 4106887 - DNA, 20 bp, Homo sapiens
ctattttttattttactttt

SEQ ID NO: 4106888 - DNA, 20 bp, Homo sapiens
ctcaaaagcacccttgacgt

SEQ ID NO: 4106889 - DNA, 12 bp, Homo sapiens
ctcaaaagcatt

SEQ ID NO: 4106890 - DNA, 13 bp, Homo sapiens
ctcaaaaggaaac

SEQ ID NO: 4106891 - DNA, 18 bp, Homo sapiens
ctcaaaaggaaaccaagt

SEQ ID NO: 4106892 - DNA, 16 bp, Homo sapiens
ctcaaaagtctatttt

SEQ ID NO: 4106893 - DNA, 20 bp, Homo sapiens
ctcaaactaaaagacatttg

SEQ ID NO: 4106894 - DNA, 13 bp, Homo sapiens
ctcaaacttgtgg

SEQ ID NO: 4106895 - DNA, 14 bp, Homo sapiens
ctcaaagaggcagt

SEQ ID NO: 4106896 - DNA, 19 bp, Homo sapiens
ctcaaagttttgaaaagct

SEQ ID NO: 4106897 - DNA, 20 bp, Homo sapiens
ctcaaatgctagaagctgtc

SEQ ID NO: 4106898 - DNA, 17 bp, Homo sapiens
ctcaaattgtcagcaat

SEQ ID NO: 4106899 - DNA, 12 bp, Homo sapiens
ctcaaatttatt

SEQ ID NO: 4106900 - DNA, 21 bp, Homo sapiens
ctcaaatttattttaatgtaa

SEQ ID NO: 4106901 - DNA, 21 bp, Homo sapiens
ctcaaattttttgactttttt

SEQ ID NO: 4106902 - DNA, 21 bp, Homo sapiens
ctcaacaaaaaaccgaggccc

SEQ ID NO: 4106903 - DNA, 22 bp, Homo sapiens
ctcaacaaaaaaccgaggccct

SEQ ID NO: 4106904 - DNA, 15 bp, Homo sapiens
ctcaacaagggagag

SEQ ID NO: 4106905 - DNA, 13 bp, Homo sapiens
ctcaacaggccca

SEQ ID NO: 4106906 - DNA, 14 bp, Homo sapiens
ctcaacaggcccag

SEQ ID NO: 4106907 - DNA, 16 bp, Homo sapiens
ctcaacaggcccaggg

SEQ ID NO: 4106908 - DNA, 16 bp, Homo sapiens
ctcaacattgcatggt

SEQ ID NO: 4106909 - DNA, 12 bp, Homo sapiens
ctcaaccactgt

SEQ ID NO: 4106910 - DNA, 13 bp, Homo sapiens
ctcaaccactgtg

SEQ ID NO: 4106911 - DNA, 19 bp, Homo sapiens
ctcaacccccatttctatt

SEQ ID NO: 4106912 - DNA, 13 bp, Homo sapiens
ctcaacctcacca

SEQ ID NO: 4106913 - DNA, 16 bp, Homo sapiens
ctcaacgcctccccct

SEQ ID NO: 4106914 - DNA, 22 bp, Homo sapiens
ctcaacgcctccccctccccca

SEQ ID NO: 4106915 - DNA, 20 bp, Homo sapiens
ctcaactctacccctgctcc

SEQ ID NO: 4106916 - DNA, 17 bp, Homo sapiens
ctcaactctgagcccat

SEQ ID NO: 4106917 - DNA, 15 bp, Homo sapiens
ctcaagaacaaacac

SEQ ID NO: 4106918 - DNA, 19 bp, Homo sapiens
ctcaagaagacatggagac

SEQ ID NO: 4106919 - DNA, 20 bp, Homo sapiens
ctcaagaagacatggagact

SEQ ID NO: 4106920 - DNA, 12 bp, Homo sapiens
ctcaagaccccc

SEQ ID NO: 4106921 - DNA, 13 bp, Homo sapiens
ctcaagactttag

SEQ ID NO: 4106922 - DNA, 15 bp, Homo sapiens
ctcaagactttagct

SEQ ID NO: 4106923 - DNA, 17 bp, Homo sapiens
ctcaagagaaaatgtgt

SEQ ID NO: 4106924 - DNA, 17 bp, Homo sapiens
ctcaagatactgctact

SEQ ID NO: 4106925 - DNA, 16 bp, Homo sapiens
ctcaagatgaaggcaa

SEQ ID NO: 4106926 - DNA, 15 bp, Homo sapiens
ctcaagatgggggca

SEQ ID NO: 4106927 - DNA, 21 bp, Homo sapiens
ctcaagatgggggcagggctg

SEQ ID NO: 4106928 - DNA, 22 bp, Homo sapiens
ctcaagcaatccacctgccttg

SEQ ID NO: 4106929 - DNA, 18 bp, Homo sapiens
ctcaagcaatcctcctgc

SEQ ID NO: 4106930 - DNA, 22 bp, Homo sapiens
ctcaagcagcgaccgccccctc

SEQ ID NO: 4106931 - DNA, 15 bp, Homo sapiens
ctcaagcccaggagg

SEQ ID NO: 4106932 - DNA, 21 bp, Homo sapiens
ctcaagccccagcagccctca

SEQ ID NO: 4106933 - DNA, 17 bp, Homo sapiens
ctcaagccccatttcct

SEQ ID NO: 4106934 - DNA, 16 bp, Homo sapiens
ctcaagcgattctcct

SEQ ID NO: 4106935 - DNA, 17 bp, Homo sapiens
ctcaagcgattctcctg

SEQ ID NO: 4106936 - DNA, 16 bp, Homo sapiens
ctcaaggactttgcag

SEQ ID NO: 4106937 - DNA, 19 bp, Homo sapiens
ctcaagtatcttctatttt

SEQ ID NO: 4106938 - DNA, 18 bp, Homo sapiens
ctcaataaattgcaacat

SEQ ID NO: 4106939 - DNA, 15 bp, Homo sapiens
ctcaatcaagaaaat

SEQ ID NO: 4106940 - DNA, 16 bp, Homo sapiens
ctcaatgaagccagct

SEQ ID NO: 4106941 - DNA, 18 bp, Homo sapiens
ctcaatgcctggagacag

SEQ ID NO: 4106942 - DNA, 19 bp, Homo sapiens
ctcaatgcctggagacaga

SEQ ID NO: 4106943 - DNA, 13 bp, Homo sapiens
ctcaatggactgg

SEQ ID NO: 4106944 - DNA, 16 bp, Homo sapiens
ctcaatggagaatata

SEQ ID NO: 4106945 - DNA, 22 bp, Homo sapiens
ctcaatggcctaaaactggcct

SEQ ID NO: 4106946 - DNA, 18 bp, Homo sapiens
ctcaatgtttgtaataat

SEQ ID NO: 4106947 - DNA, 17 bp, Homo sapiens
ctcacaacttgggttct

SEQ ID NO: 4106948 - DNA, 17 bp, Homo sapiens
ctcacaatccttgccac

SEQ ID NO: 4106949 - DNA, 21 bp, Homo sapiens
ctagcaaccgcctcaaaatgt

SEQ ID NO: 4106950 - DNA, 14 bp, Homo sapiens
ctagcaagctggcc

SEQ ID NO: 4106951 - DNA, 17 bp, Homo sapiens
ctagcaagctggcctct

SEQ ID NO: 4106952 - DNA, 15 bp, Homo sapiens
ctagcaagtgagaga

SEQ ID NO: 4106953 - DNA, 19 bp, Homo sapiens
ctagcaatctcttcattat

SEQ ID NO: 4106954 - DNA, 14 bp, Homo sapiens
ctagcacagctccc

SEQ ID NO: 4106955 - DNA, 17 bp, Homo sapiens
ctagcagaaatctagaa

SEQ ID NO: 4106956 - DNA, 12 bp, Homo sapiens
ctagcagcaccg

SEQ ID NO: 4106957 - DNA, 21 bp, Homo sapiens
ctagcagcaccgttctgtgca

SEQ ID NO: 4106958 - DNA, 22 bp, Homo sapiens
ctagcagcaccgttctgtgcac

SEQ ID NO: 4106959 - DNA, 15 bp, Homo sapiens
ctagcaggctgttcc

SEQ ID NO: 4106960 - DNA, 19 bp, Homo sapiens
ctagcaggctgttccatgt

SEQ ID NO: 4106961 - DNA, 17 bp, Homo sapiens
ctagcagtaaaagatga

SEQ ID NO: 4106962 - DNA, 22 bp, Homo sapiens
ctagcagtgatgaaaatgaatc

SEQ ID NO: 4106963 - DNA, 15 bp, Homo sapiens
ctagccaccagtgtc

SEQ ID NO: 4106964 - DNA, 22 bp, Homo sapiens
ctagccaccagtgtcctccaag

SEQ ID NO: 4106965 - DNA, 18 bp, Homo sapiens
ctagccagcccctcttcc

SEQ ID NO: 4106966 - DNA, 13 bp, Homo sapiens
ctagcccagactc

SEQ ID NO: 4106967 - DNA, 19 bp, Homo sapiens
ctagcccagactctgagct

SEQ ID NO: 4106968 - DNA, 18 bp, Homo sapiens
ctagcctatttacctgca

SEQ ID NO: 4106969 - DNA, 21 bp, Homo sapiens
ctagcctgtgcctctgggact

SEQ ID NO: 4106970 - DNA, 16 bp, Homo sapiens
ctagcgatctctcctg

SEQ ID NO: 4106971 - DNA, 17 bp, Homo sapiens
ctagcggagcccagcct

SEQ ID NO: 4106972 - DNA, 16 bp, Homo sapiens
ctagcgtagtgcagca

SEQ ID NO: 4106973 - DNA, 15 bp, Homo sapiens
ctagctaaataaatg

SEQ ID NO: 4106974 - DNA, 15 bp, Homo sapiens
ctagctctctaggcc

SEQ ID NO: 4106975 - DNA, 13 bp, Homo sapiens
ctagctgaccccg

SEQ ID NO: 4106976 - DNA, 20 bp, Homo sapiens
ctagctgaccccgagaagtg

SEQ ID NO: 4106977 - DNA, 16 bp, Homo sapiens
ctagctgtatgatttg

SEQ ID NO: 4106978 - DNA, 14 bp, Homo sapiens
ctagctgtgggggt

SEQ ID NO: 4106979 - DNA, 16 bp, Homo sapiens
ctagcttctgcttttc

SEQ ID NO: 4106980 - DNA, 18 bp, Homo sapiens
ctagcttgacacagtcag

SEQ ID NO: 4106981 - DNA, 20 bp, Homo sapiens
ctagcttgggaggcttcccc

SEQ ID NO: 4106982 - DNA, 18 bp, Homo sapiens
ctagctttagaccctggg

SEQ ID NO: 4106983 - DNA, 14 bp, Homo sapiens
ctagcttttaggaa

SEQ ID NO: 4106984 - DNA, 16 bp, Homo sapiens
ctaggaatcccagagg

SEQ ID NO: 4106985 - DNA, 16 bp, Homo sapiens
ctaggagaccaaggcg

SEQ ID NO: 4106986 - DNA, 13 bp, Homo sapiens
ctaggagagccaa

SEQ ID NO: 4106987 - DNA, 17 bp, Homo sapiens
ctaggagagccaacctc

SEQ ID NO: 4106988 - DNA, 18 bp, Homo sapiens
ctaggagggagacactgg

SEQ ID NO: 4106989 - DNA, 19 bp, Homo sapiens
ctaggcaagcaggacctgg

SEQ ID NO: 4106990 - DNA, 17 bp, Homo sapiens
ctaggcagggtgtctgc

SEQ ID NO: 4106991 - DNA, 18 bp, Homo sapiens
ctaggcagggtgtctgcc

SEQ ID NO: 4106992 - DNA, 20 bp, Homo sapiens
ctaggcccctcctagaccca

SEQ ID NO: 4106993 - DNA, 21 bp, Homo sapiens
ctaggcccctcctagacccag

SEQ ID NO: 4106994 - DNA, 22 bp, Homo sapiens
ctaggcccctcctagacccagg

SEQ ID NO: 4106995 - DNA, 16 bp, Homo sapiens
ctaggcctctccagtt

SEQ ID NO: 4106996 - DNA, 16 bp, Homo sapiens
ctaggcgagtgccagg

SEQ ID NO: 4106997 - DNA, 17 bp, Homo sapiens
ctaggcgagtgccagga

SEQ ID NO: 4106998 - DNA, 12 bp, Homo sapiens
ctaggctcagag

SEQ ID NO: 4106999 - DNA, 20 bp, Homo sapiens
ctaggctcagagatgtgcac

SEQ ID NO: 4107000 - DNA, 16 bp, Homo sapiens
ctagggattcaggctg

SEQ ID NO: 4107001 - DNA, 20 bp, Homo sapiens
ctagggattcaggctgcttg

SEQ ID NO: 4107002 - DNA, 20 bp, Homo sapiens
ctagggatttaaagggacac

SEQ ID NO: 4107003 - DNA, 21 bp, Homo sapiens
ctagggatttaaagggacacc

SEQ ID NO: 4107004 - DNA, 17 bp, Homo sapiens
ctaggggaacagaccag

SEQ ID NO: 4107005 - DNA, 19 bp, Homo sapiens
ctaggggaacagaccagtg

SEQ ID NO: 4107006 - DNA, 16 bp, Homo sapiens
ctaggggagaagagcc

SEQ ID NO: 4107007 - DNA, 19 bp, Homo sapiens
ctaggtaatgttttgtata

SEQ ID NO: 4107008 - DNA, 15 bp, Homo sapiens
ctaggtaatttttac

SEQ ID NO: 4107009 - DNA, 19 bp, Homo sapiens
ctaggtagccccctcttcc

SEQ ID NO: 4107010 - DNA, 20 bp, Homo sapiens
ctaggtatcattcaactctc

SEQ ID NO: 4107011 - DNA, 21 bp, Homo sapiens
ctaggttccctgttcttcctc

SEQ ID NO: 4107012 - DNA, 22 bp, Homo sapiens
ctagtacttgggagacctgtaa

SEQ ID NO: 4107013 - DNA, 21 bp, Homo sapiens
ctagtatcttcaaactttcac

SEQ ID NO: 4107014 - DNA, 23 bp, Homo sapiens
ctagtatcttcaaactttcactt

SEQ ID NO: 4107015 - DNA, 20 bp, Homo sapiens
ctagtatttgaattaaaact

SEQ ID NO: 4107016 - DNA, 21 bp, Homo sapiens
ctagtcccttcccctccctgg

SEQ ID NO: 4107017 - DNA, 19 bp, Homo sapiens
ctagtgaagaccagagcag

SEQ ID NO: 4107018 - DNA, 16 bp, Homo sapiens
ctagtgacagcttgtg

SEQ ID NO: 4107019 - DNA, 18 bp, Homo sapiens
ctagtgacttgtgtccca

SEQ ID NO: 4107020 - DNA, 19 bp, Homo sapiens
ctagtgacttgtgtcccat

SEQ ID NO: 4107021 - DNA, 15 bp, Homo sapiens
ctagtgcagctgatt

SEQ ID NO: 4107022 - DNA, 23 bp, Homo sapiens
ctagtgggacagcccagagcctg

SEQ ID NO: 4107023 - DNA, 14 bp, Homo sapiens
ctagtggtctttgt

SEQ ID NO: 4107024 - DNA, 20 bp, Homo sapiens
ctagtggtctttgtaagagt

SEQ ID NO: 4107025 - DNA, 18 bp, Homo sapiens
ctagtgtcaggcccccag

SEQ ID NO: 4107026 - DNA, 21 bp, Homo sapiens
ctagttaacctagaagtattt

SEQ ID NO: 4107027 - DNA, 16 bp, Homo sapiens
ctagttattttataat

SEQ ID NO: 4107028 - DNA, 20 bp, Homo sapiens
ctagttattttataatcaat

SEQ ID NO: 4107029 - DNA, 13 bp, Homo sapiens
ctagttcagagcc

SEQ ID NO: 4107030 - DNA, 18 bp, Homo sapiens
ctagttcatccaatcctc

SEQ ID NO: 4107031 - DNA, 20 bp, Homo sapiens
ctagttcatccaatcctcac

SEQ ID NO: 4107032 - DNA, 18 bp, Homo sapiens
ctagttcatcccttctct

SEQ ID NO: 4107033 - DNA, 20 bp, Homo sapiens
ctagttccctctgctcagcc

SEQ ID NO: 4107034 - DNA, 21 bp, Homo sapiens
ctagttctttcctccccctgc

SEQ ID NO: 4107035 - DNA, 22 bp, Homo sapiens
ctagttctttcctccccctgca

SEQ ID NO: 4107036 - DNA, 23 bp, Homo sapiens
ctagttctttcctccccctgcaa

SEQ ID NO: 4107037 - DNA, 13 bp, Homo sapiens
ctagttttacaga

SEQ ID NO: 4107038 - DNA, 14 bp, Homo sapiens
ctagttttacagat

SEQ ID NO: 4107039 - DNA, 21 bp, Homo sapiens
ctagttttacagattgcctcc

SEQ ID NO: 4107040 - DNA, 23 bp, Homo sapiens
ctataaagaagaacttgcatgga

SEQ ID NO: 4107041 - DNA, 12 bp, Homo sapiens
ctataaatacaa

SEQ ID NO: 4107042 - DNA, 19 bp, Homo sapiens
ctataaatacaaatctgta

SEQ ID NO: 4107043 - DNA, 21 bp, Homo sapiens
ctataaatacaaatctgtata

SEQ ID NO: 4107044 - DNA, 22 bp, Homo sapiens
ctataaatacaaatctgtataa

SEQ ID NO: 4107045 - DNA, 16 bp, Homo sapiens
ctataaatggtgtttt

SEQ ID NO: 4107046 - DNA, 23 bp, Homo sapiens
ctataaatggtgtttttttaata

SEQ ID NO: 4107047 - DNA, 21 bp, Homo sapiens
ctataagagaattatatattt

SEQ ID NO: 4107048 - DNA, 21 bp, Homo sapiens
ctataagaggaatttcttttc

SEQ ID NO: 4107049 - DNA, 12 bp, Homo sapiens
ctataatcatta

SEQ ID NO: 4107050 - DNA, 18 bp, Homo sapiens
ctataatcattagtttta

SEQ ID NO: 4107051 - DNA, 22 bp, Homo sapiens
ctaccgagtctcttctccactg

SEQ ID NO: 4107052 - DNA, 23 bp, Homo sapiens
ctaccgagtctcttctccactgg

SEQ ID NO: 4107053 - DNA, 12 bp, Homo sapiens
ctaccgccctgg

SEQ ID NO: 4107054 - DNA, 16 bp, Homo sapiens
ctaccgccctgggctg

SEQ ID NO: 4107055 - DNA, 17 bp, Homo sapiens
ctaccgccctgggctgg

SEQ ID NO: 4107056 - DNA, 13 bp, Homo sapiens
ctacctcaggcag

SEQ ID NO: 4107057 - DNA, 18 bp, Homo sapiens
ctacctcaggcagctcaa

SEQ ID NO: 4107058 - DNA, 15 bp, Homo sapiens
ctacctcctctcctg

SEQ ID NO: 4107059 - DNA, 13 bp, Homo sapiens
ctacctctgtgcc

SEQ ID NO: 4107060 - DNA, 15 bp, Homo sapiens
ctacctctgtgccag

SEQ ID NO: 4107061 - DNA, 15 bp, Homo sapiens
ctacctgaggccagg

SEQ ID NO: 4107062 - DNA, 12 bp, Homo sapiens
ctacctgccctc

SEQ ID NO: 4107063 - DNA, 14 bp, Homo sapiens
ctacctgccctcaa

SEQ ID NO: 4107064 - DNA, 14 bp, Homo sapiens
ctacctgccttgga

SEQ ID NO: 4107065 - DNA, 16 bp, Homo sapiens
ctacctgccttggaga

SEQ ID NO: 4107066 - DNA, 12 bp, Homo sapiens
ctaccttcctgt

SEQ ID NO: 4107067 - DNA, 23 bp, Homo sapiens
ctaccttgaggtcttttgacatg

SEQ ID NO: 4107068 - DNA, 22 bp, Homo sapiens
ctacctttaatcaggtcctgct

SEQ ID NO: 4107069 - DNA, 15 bp, Homo sapiens
ctacgccaatcaagg

SEQ ID NO: 4107070 - DNA, 19 bp, Homo sapiens
ctacgcctcttctgtccct

SEQ ID NO: 4107071 - DNA, 13 bp, Homo sapiens
ctacgtccaaggt

SEQ ID NO: 4107072 - DNA, 15 bp, Homo sapiens
ctactaaaaatgcaa

SEQ ID NO: 4107073 - DNA, 20 bp, Homo sapiens
ctactaagttcacattagaa

SEQ ID NO: 4107074 - DNA, 13 bp, Homo sapiens
ctactaatgatgt

SEQ ID NO: 4107075 - DNA, 15 bp, Homo sapiens
ctactaattccacac

SEQ ID NO: 4107076 - DNA, 19 bp, Homo sapiens
ctactaccacaaggaaaat

SEQ ID NO: 4107077 - DNA, 15 bp, Homo sapiens
ctactagatgtcttt

SEQ ID NO: 4107078 - DNA, 18 bp, Homo sapiens
ctactatgccagatgcct

SEQ ID NO: 4107079 - DNA, 18 bp, Homo sapiens
ctactatggctgagttct

SEQ ID NO: 4107080 - DNA, 17 bp, Homo sapiens
ctactcacagtctcttt

SEQ ID NO: 4107081 - DNA, 22 bp, Homo sapiens
ctactctagagaagtggactgg

SEQ ID NO: 4107082 - DNA, 17 bp, Homo sapiens
ctactctccccacgagg

SEQ ID NO: 4107083 - DNA, 19 bp, Homo sapiens
ctactctccccacgagggc

SEQ ID NO: 4107084 - DNA, 13 bp, Homo sapiens
ctactctggaatg

SEQ ID NO: 4107085 - DNA, 23 bp, Homo sapiens
ctactctggaatgtttttccctc

SEQ ID NO: 4107086 - DNA, 17 bp, Homo sapiens
ctactgataaagaaaga

SEQ ID NO: 4107087 - DNA, 16 bp, Homo sapiens
ctactgattgtttcat

SEQ ID NO: 4107088 - DNA, 17 bp, Homo sapiens
ctactgattgtttcatt

SEQ ID NO: 4107089 - DNA, 20 bp, Homo sapiens
ctactgcactccagcctggg

SEQ ID NO: 4107090 - DNA, 20 bp, Homo sapiens
ctactgcagcacctccaggc

SEQ ID NO: 4107091 - DNA, 22 bp, Homo sapiens
ctactgcagcacctccaggcct

SEQ ID NO: 4107092 - DNA, 20 bp, Homo sapiens
ctactgctgtgaaccctggg

SEQ ID NO: 4107093 - DNA, 17 bp, Homo sapiens
ctactgggtgtagactg

SEQ ID NO: 4107094 - DNA, 16 bp, Homo sapiens
ctactgggtgtcattt

SEQ ID NO: 4107095 - DNA, 13 bp, Homo sapiens
ctactgtgactga

SEQ ID NO: 4107096 - DNA, 15 bp, Homo sapiens
ctactgtgtgtgtga

SEQ ID NO: 4107097 - DNA, 17 bp, Homo sapiens
ctactgtgtgtgtgaat

SEQ ID NO: 4107098 - DNA, 19 bp, Homo sapiens
ctactgtgtgtgtgaatga

SEQ ID NO: 4107099 - DNA, 20 bp, Homo sapiens
ctactgtgttcctggcaata

SEQ ID NO: 4107100 - DNA, 23 bp, Homo sapiens
ctacttagcatcctaagaaatat

SEQ ID NO: 4107101 - DNA, 17 bp, Homo sapiens
ctacttagcatgtccct

SEQ ID NO: 4107102 - DNA, 20 bp, Homo sapiens
ctacttcctcctccccactt

SEQ ID NO: 4107103 - DNA, 12 bp, Homo sapiens
ctacttgggagg

SEQ ID NO: 4107104 - DNA, 15 bp, Homo sapiens
ctacttggtttgtgt

SEQ ID NO: 4107105 - DNA, 15 bp, Homo sapiens
ctactttaagcacta

SEQ ID NO: 4107106 - DNA, 15 bp, Homo sapiens
ctactttaagtgata

SEQ ID NO: 4107107 - DNA, 21 bp, Homo sapiens
ctactttggtttctgtctgta

SEQ ID NO: 4107108 - DNA, 23 bp, Homo sapiens
ctagaaaacattttttttttaaa

SEQ ID NO: 4107109 - DNA, 22 bp, Homo sapiens
ctagaaaacttgactccatttc

SEQ ID NO: 4107110 - DNA, 13 bp, Homo sapiens
ctagaaatatgat

SEQ ID NO: 4107111 - DNA, 15 bp, Homo sapiens
ctagaaatatgattt

SEQ ID NO: 4107112 - DNA, 16 bp, Homo sapiens
ctagaaccacttcctg

SEQ ID NO: 4107113 - DNA, 13 bp, Homo sapiens
ctagaagaaaagc

SEQ ID NO: 4107114 - DNA, 18 bp, Homo sapiens
ctagaagaaaagcccatt

SEQ ID NO: 4107115 - DNA, 13 bp, Homo sapiens
ctagaagccaagg

SEQ ID NO: 4107116 - DNA, 16 bp, Homo sapiens
ctagaagccaagggaa

SEQ ID NO: 4107117 - DNA, 21 bp, Homo sapiens
ctagaagccaagggaaagggg

SEQ ID NO: 4107118 - DNA, 18 bp, Homo sapiens
ctagaagtttcccttcct

SEQ ID NO: 4107119 - DNA, 19 bp, Homo sapiens
ctagaatgtcagatttctg

SEQ ID NO: 4107120 - DNA, 15 bp, Homo sapiens
ctagacaagatattg

SEQ ID NO: 4107121 - DNA, 20 bp, Homo sapiens
ctagacaagatattgtacat

SEQ ID NO: 4107122 - DNA, 12 bp, Homo sapiens
ctagacacacaa

SEQ ID NO: 4107123 - DNA, 18 bp, Homo sapiens
ctagacagatccccgttc

SEQ ID NO: 4107124 - DNA, 14 bp, Homo sapiens
ctagacccaggtgg

SEQ ID NO: 4107125 - DNA, 15 bp, Homo sapiens
ctagacccaggtgga

SEQ ID NO: 4107126 - DNA, 15 bp, Homo sapiens
ctagactctagacaa

SEQ ID NO: 4107127 - DNA, 16 bp, Homo sapiens
ctagacttcccaacag

SEQ ID NO: 4107128 - DNA, 20 bp, Homo sapiens
ctagacttcccaacagcctt

SEQ ID NO: 4107129 - DNA, 18 bp, Homo sapiens
ctagagaaatcagctgct

SEQ ID NO: 4107130 - DNA, 18 bp, Homo sapiens
ctagagaagataattgtt

SEQ ID NO: 4107131 - DNA, 20 bp, Homo sapiens
ctagagaagataattgttga

SEQ ID NO: 4107132 - DNA, 21 bp, Homo sapiens
ctagagaagataattgttgaa

SEQ ID NO: 4107133 - DNA, 21 bp, Homo sapiens
ctagagaagtggactggagga

SEQ ID NO: 4107134 - DNA, 14 bp, Homo sapiens
ctagagcctgcctg

SEQ ID NO: 4107135 - DNA, 17 bp, Homo sapiens
ctagagcctgcctggag

SEQ ID NO: 4107136 - DNA, 18 bp, Homo sapiens
ctagagcctgcctggagc

SEQ ID NO: 4107137 - DNA, 19 bp, Homo sapiens
ctagagcctgcctggagcg

SEQ ID NO: 4107138 - DNA, 17 bp, Homo sapiens
ctagaggccagccccac

SEQ ID NO: 4107139 - DNA, 18 bp, Homo sapiens
ctagaggccagccccacc

SEQ ID NO: 4107140 - DNA, 20 bp, Homo sapiens
ctagaggccagccccaccca

SEQ ID NO: 4107141 - DNA, 21 bp, Homo sapiens
ctagaggccagccccacccag

SEQ ID NO: 4107142 - DNA, 22 bp, Homo sapiens
ctagagggatacactgaagtta

SEQ ID NO: 4107143 - DNA, 15 bp, Homo sapiens
ctagagggttcctgt

SEQ ID NO: 4107144 - DNA, 19 bp, Homo sapiens
ctagagggttcctgtagac

SEQ ID NO: 4107145 - DNA, 15 bp, Homo sapiens
ctagagtcctcactc

SEQ ID NO: 4107146 - DNA, 22 bp, Homo sapiens
ctagagtctcagaaactcccct

SEQ ID NO: 4107147 - DNA, 20 bp, Homo sapiens
ctagagtctgaacagctgta

SEQ ID NO: 4107148 - DNA, 16 bp, Homo sapiens
ctagataaaaagatgg

SEQ ID NO: 4107149 - DNA, 12 bp, Homo sapiens
ctagatagttta

SEQ ID NO: 4107150 - DNA, 19 bp, Homo sapiens
ctagattaggtagactttg

SEQ ID NO: 4107151 - DNA, 23 bp, Homo sapiens
ctagattaggtagactttgctta

SEQ ID NO: 4107152 - DNA, 12 bp, Homo sapiens
ctagatttatta

SEQ ID NO: 4107153 - DNA, 21 bp, Homo sapiens
ctagatttattagtcctaatt

SEQ ID NO: 4107154 - DNA, 15 bp, Homo sapiens
ctaaaggatccagag

SEQ ID NO: 4107155 - DNA, 20 bp, Homo sapiens
ctaaaggatccagagagcag

SEQ ID NO: 4107156 - DNA, 16 bp, Homo sapiens
ctaaataatgaataaa

SEQ ID NO: 4107157 - DNA, 21 bp, Homo sapiens
ctaaataatgaataaactgaa

SEQ ID NO: 4107158 - DNA, 13 bp, Homo sapiens
ctaaatatttcct

SEQ ID NO: 4107159 - DNA, 22 bp, Homo sapiens
ctaaatatttccttaaactgtg

SEQ ID NO: 4107160 - DNA, 16 bp, Homo sapiens
ctaaatctatttatta

SEQ ID NO: 4107161 - DNA, 19 bp, Homo sapiens
ctaaatctatttattaata

SEQ ID NO: 4107162 - DNA, 13 bp, Homo sapiens
ctaaatcttcctt

SEQ ID NO: 4107163 - DNA, 19 bp, Homo sapiens
ctaaatcttccttgtgagg

SEQ ID NO: 4107164 - DNA, 15 bp, Homo sapiens
ctaaatgaatgttta

SEQ ID NO: 4107165 - DNA, 15 bp, Homo sapiens
ctaaatgagctcctg

SEQ ID NO: 4107166 - DNA, 16 bp, Homo sapiens
ctaaatgcaccaagaa

SEQ ID NO: 4107167 - DNA, 18 bp, Homo sapiens
ctaaatgcctaataaaca

SEQ ID NO: 4107168 - DNA, 15 bp, Homo sapiens
ctaaatgctgaaaaa

SEQ ID NO: 4107169 - DNA, 18 bp, Homo sapiens
ctaaatggtcgcccagga

SEQ ID NO: 4107170 - DNA, 19 bp, Homo sapiens
ctaaatggtcgcccaggag

SEQ ID NO: 4107171 - DNA, 14 bp, Homo sapiens
ctaaattccacact

SEQ ID NO: 4107172 - DNA, 17 bp, Homo sapiens
ctaaattctatgttaaa

SEQ ID NO: 4107173 - DNA, 15 bp, Homo sapiens
ctaaatttaaattta

SEQ ID NO: 4107174 - DNA, 17 bp, Homo sapiens
ctaaatttaaatttaaa

SEQ ID NO: 4107175 - DNA, 17 bp, Homo sapiens
ctaacaaaagatgaaag

SEQ ID NO: 4107176 - DNA, 17 bp, Homo sapiens
ctaacacagcatgtgta

SEQ ID NO: 4107177 - DNA, 18 bp, Homo sapiens
ctaacagataagcaagag

SEQ ID NO: 4107178 - DNA, 12 bp, Homo sapiens
ctaacatataat

SEQ ID NO: 4107179 - DNA, 23 bp, Homo sapiens
ctaacatataatgttgttattta

SEQ ID NO: 4107180 - DNA, 11 bp, Homo sapiens
ctaacatttcc

SEQ ID NO: 4107181 - DNA, 22 bp, Homo sapiens
ctaaccaaatctctcaaatctg

SEQ ID NO: 4107182 - DNA, 15 bp, Homo sapiens
ctaaccacagctcct

SEQ ID NO: 4107183 - DNA, 20 bp, Homo sapiens
ctaaccattaagtcatgtgt

SEQ ID NO: 4107184 - DNA, 14 bp, Homo sapiens
ctaacccaactgac

SEQ ID NO: 4107185 - DNA, 16 bp, Homo sapiens
ctaaccttgaatgctg

SEQ ID NO: 4107186 - DNA, 20 bp, Homo sapiens
ctaaccttgaatgctgccag

SEQ ID NO: 4107187 - DNA, 21 bp, Homo sapiens
ctaaccttgaatgctgccagt

SEQ ID NO: 4107188 - DNA, 16 bp, Homo sapiens
ctaacgggaggctggg

SEQ ID NO: 4107189 - DNA, 15 bp, Homo sapiens
ctaactaactggcag

SEQ ID NO: 4107190 - DNA, 17 bp, Homo sapiens
ctaactcagaattattt

SEQ ID NO: 4107191 - DNA, 14 bp, Homo sapiens
ctaactcctgagaa

SEQ ID NO: 4107192 - DNA, 22 bp, Homo sapiens
ctaactttagaagtgcatttct

SEQ ID NO: 4107193 - DNA, 19 bp, Homo sapiens
ctaacttttcttaaggttt

SEQ ID NO: 4107194 - DNA, 15 bp, Homo sapiens
ctaagaaaagatttt

SEQ ID NO: 4107195 - DNA, 20 bp, Homo sapiens
ctaagaaaagattttaatca

SEQ ID NO: 4107196 - DNA, 20 bp, Homo sapiens
ctaagaaatatgtgagattt

SEQ ID NO: 4107197 - DNA, 21 bp, Homo sapiens
ctaagaaatatgtgagatttt

SEQ ID NO: 4107198 - DNA, 15 bp, Homo sapiens
ctaagaaatattcca

SEQ ID NO: 4107199 - DNA, 17 bp, Homo sapiens
ctaagaattcaaactgg

SEQ ID NO: 4107200 - DNA, 21 bp, Homo sapiens
ctaagacacctgaaccctcca

SEQ ID NO: 4107201 - DNA, 22 bp, Homo sapiens
ctaagacatgtgaggaggaaaa

SEQ ID NO: 4107202 - DNA, 18 bp, Homo sapiens
ctaagagaaaattgcact

SEQ ID NO: 4107203 - DNA, 19 bp, Homo sapiens
ctaagagaaaattgcacta

SEQ ID NO: 4107204 - DNA, 11 bp, Homo sapiens
ctaagagaagt

SEQ ID NO: 4107205 - DNA, 22 bp, Homo sapiens
ctaagagaagttattttctaca

SEQ ID NO: 4107206 - DNA, 11 bp, Homo sapiens
ctaagagccat

SEQ ID NO: 4107207 - DNA, 20 bp, Homo sapiens
ctaagagccatttaggggcc

SEQ ID NO: 4107208 - DNA, 22 bp, Homo sapiens
ctaagccaggcctggctggagg

SEQ ID NO: 4107209 - DNA, 18 bp, Homo sapiens
ctaagccagttttcattt

SEQ ID NO: 4107210 - DNA, 19 bp, Homo sapiens
ctaagcccccagggcctcc

SEQ ID NO: 4107211 - DNA, 22 bp, Homo sapiens
ctaagcccccagggcctccagg

SEQ ID NO: 4107212 - DNA, 21 bp, Homo sapiens
ctaagccctgtcgagacactt

SEQ ID NO: 4107213 - DNA, 16 bp, Homo sapiens
ctaagcctacctgctc

SEQ ID NO: 4107214 - DNA, 17 bp, Homo sapiens
ctaagcctacctgctct

SEQ ID NO: 4107215 - DNA, 20 bp, Homo sapiens
ctaagcctacctgctctcca

SEQ ID NO: 4107216 - DNA, 17 bp, Homo sapiens
ctaagcctttccataag

SEQ ID NO: 4107217 - DNA, 19 bp, Homo sapiens
ctaagctattcagtaataa

SEQ ID NO: 4107218 - DNA, 20 bp, Homo sapiens
ctaagctttgccagctgctg

SEQ ID NO: 4107219 - DNA, 22 bp, Homo sapiens
ctaagctttgccagctgctgct

SEQ ID NO: 4107220 - DNA, 14 bp, Homo sapiens
ctaaggaaccttcc

SEQ ID NO: 4107221 - DNA, 11 bp, Homo sapiens
ctaaggacaca

SEQ ID NO: 4107222 - DNA, 14 bp, Homo sapiens
ctaaggacacacta

SEQ ID NO: 4107223 - DNA, 22 bp, Homo sapiens
ctaaggataatgaaataatcag

SEQ ID NO: 4107224 - DNA, 17 bp, Homo sapiens
ctaaggatctctcagga

SEQ ID NO: 4107225 - DNA, 18 bp, Homo sapiens
ctaaggatgtcacagggc

SEQ ID NO: 4107226 - DNA, 19 bp, Homo sapiens
ctaaggatgtcacagggcc

SEQ ID NO: 4107227 - DNA, 15 bp, Homo sapiens
ctaaggctcctcctt

SEQ ID NO: 4107228 - DNA, 18 bp, Homo sapiens
ctaagggggaggggaagt

SEQ ID NO: 4107229 - DNA, 14 bp, Homo sapiens
ctaagggtgggtgc

SEQ ID NO: 4107230 - DNA, 18 bp, Homo sapiens
ctaagggtgggtgctcag

SEQ ID NO: 4107231 - DNA, 22 bp, Homo sapiens
ctaagggtgggtgctcagaata

SEQ ID NO: 4107232 - DNA, 18 bp, Homo sapiens
ctaagggtgtaagtaatt

SEQ ID NO: 4107233 - DNA, 17 bp, Homo sapiens
ctaagtaaatctcttct

SEQ ID NO: 4107234 - DNA, 19 bp, Homo sapiens
ctaagtacacaataagcaa

SEQ ID NO: 4107235 - DNA, 16 bp, Homo sapiens
ctaagtgacatttgta

SEQ ID NO: 4107236 - DNA, 17 bp, Homo sapiens
ctaagtgacatttgtag

SEQ ID NO: 4107237 - DNA, 16 bp, Homo sapiens
ctaagtgatataaatc

SEQ ID NO: 4107238 - DNA, 20 bp, Homo sapiens
ctaagtggctgccttctttc

SEQ ID NO: 4107239 - DNA, 20 bp, Homo sapiens
ctaagttatagtatatctgg

SEQ ID NO: 4107240 - DNA, 14 bp, Homo sapiens
ctaagttcacatta

SEQ ID NO: 4107241 - DNA, 13 bp, Homo sapiens
ctaataaaagcat

SEQ ID NO: 4107242 - DNA, 13 bp, Homo sapiens
ctaatatatatga

SEQ ID NO: 4107243 - DNA, 15 bp, Homo sapiens
ctaatatatatgaat

SEQ ID NO: 4107244 - DNA, 13 bp, Homo sapiens
ctaatcaaagcca

SEQ ID NO: 4107245 - DNA, 16 bp, Homo sapiens
ctaatcaaagccaggg

SEQ ID NO: 4107246 - DNA, 22 bp, Homo sapiens
ctaatcagaaatttttatcagt

SEQ ID NO: 4107247 - DNA, 19 bp, Homo sapiens
ctaatcagcattctcactc

SEQ ID NO: 4107248 - DNA, 21 bp, Homo sapiens
ctaatcagggaggtcattttg

SEQ ID NO: 4107249 - DNA, 20 bp, Homo sapiens
ctaatcatgtgggtgagcca

SEQ ID NO: 4107250 - DNA, 21 bp, Homo sapiens
ctaatcatgtgggtgagccag

SEQ ID NO: 4107251 - DNA, 20 bp, Homo sapiens
ctaatccctgggcattgctt

SEQ ID NO: 4107252 - DNA, 23 bp, Homo sapiens
ctaatccctgggcattgctttcc

SEQ ID NO: 4107253 - DNA, 13 bp, Homo sapiens
ctaatccttttcc

SEQ ID NO: 4107254 - DNA, 15 bp, Homo sapiens
ctaatccttttcctt

SEQ ID NO: 4107255 - DNA, 17 bp, Homo sapiens
ctaatccttttccttat

SEQ ID NO: 4107256 - DNA, 22 bp, Homo sapiens
ctaatccttttccttatttgcc

SEQ ID NO: 4107257 - DNA, 22 bp, Homo sapiens
ctaatctattgggttcattatt

SEQ ID NO: 4107258 - DNA, 13 bp, Homo sapiens
ctaatctgtaggg

SEQ ID NO: 4107259 - DNA, 21 bp, Homo sapiens
ctaatctgtagggctggacct

SEQ ID NO: 4107260 - DNA, 17 bp, Homo sapiens
ctaatcttaaatcagaa

SEQ ID NO: 4107261 - DNA, 15 bp, Homo sapiens
ctaatgaagacaatg

SEQ ID NO: 4107262 - DNA, 23 bp, Homo sapiens
ctaatgaagggaaaggatatttt

SEQ ID NO: 4107263 - DNA, 17 bp, Homo sapiens
ctaatgagggtgtgaga

SEQ ID NO: 4107264 - DNA, 21 bp, Homo sapiens
ctaatgcagccacgattggag

SEQ ID NO: 4107265 - DNA, 15 bp, Homo sapiens
ctaatgcttgattta

SEQ ID NO: 4107266 - DNA, 16 bp, Homo sapiens
ctaatgcttgtttatg

SEQ ID NO: 4107267 - DNA, 16 bp, Homo sapiens
ctaatgtactgcatat

SEQ ID NO: 4107268 - DNA, 15 bp, Homo sapiens
ctaatgtcttcataa

SEQ ID NO: 4107269 - DNA, 16 bp, Homo sapiens
ctaatgtcttcataaa

SEQ ID NO: 4107270 - DNA, 20 bp, Homo sapiens
ctaattaaaacactttcaaa

SEQ ID NO: 4107271 - DNA, 19 bp, Homo sapiens
ctaattaattgtaatctga

SEQ ID NO: 4107272 - DNA, 10 bp, Homo sapiens
ctaattcata

SEQ ID NO: 4107273 - DNA, 17 bp, Homo sapiens
ctaattccacacctttt

SEQ ID NO: 4107274 - DNA, 17 bp, Homo sapiens
ctaattcccattttgca

SEQ ID NO: 4107275 - DNA, 20 bp, Homo sapiens
ctaattcccattttgcaaaa

SEQ ID NO: 4107276 - DNA, 17 bp, Homo sapiens
ctaattcgatgaaggct

SEQ ID NO: 4107277 - DNA, 13 bp, Homo sapiens
ctaattctcacat

SEQ ID NO: 4107278 - DNA, 15 bp, Homo sapiens
ctaatttaaagagac

SEQ ID NO: 4107279 - DNA, 15 bp, Homo sapiens
ctaatttatattatc

SEQ ID NO: 4107280 - DNA, 16 bp, Homo sapiens
ctaatttatattatcc

SEQ ID NO: 4107281 - DNA, 19 bp, Homo sapiens
ctaatttatattatccata

SEQ ID NO: 4107282 - DNA, 15 bp, Homo sapiens
ctaatttctcctccc

SEQ ID NO: 4107283 - DNA, 14 bp, Homo sapiens
ctaattttaaataa

SEQ ID NO: 4107284 - DNA, 20 bp, Homo sapiens
ctaattttacacattagatt

SEQ ID NO: 4107285 - DNA, 17 bp, Homo sapiens
ctaattttagtattcat

SEQ ID NO: 4107286 - DNA, 19 bp, Homo sapiens
ctaattttctcaaaagcat

SEQ ID NO: 4107287 - DNA, 15 bp, Homo sapiens
ctaattttggatgga

SEQ ID NO: 4107288 - DNA, 22 bp, Homo sapiens
ctaatttttaagaattgagtaa

SEQ ID NO: 4107289 - DNA, 14 bp, Homo sapiens
ctaatttttgtaat

SEQ ID NO: 4107290 - DNA, 15 bp, Homo sapiens
ctaatttttgtattt

SEQ ID NO: 4107291 - DNA, 23 bp, Homo sapiens
ctacaaaaaattagaaattggct

SEQ ID NO: 4107292 - DNA, 21 bp, Homo sapiens
ctacaaaacctgatgttaaaa

SEQ ID NO: 4107293 - DNA, 17 bp, Homo sapiens
ctacaaaatttgaaatt

SEQ ID NO: 4107294 - DNA, 10 bp, Homo sapiens
ctacaaatca

SEQ ID NO: 4107295 - DNA, 15 bp, Homo sapiens
ctacaaccatccctg

SEQ ID NO: 4107296 - DNA, 17 bp, Homo sapiens
ctacaacttaatggaaa

SEQ ID NO: 4107297 - DNA, 17 bp, Homo sapiens
ctacaacttcagcagta

SEQ ID NO: 4107298 - DNA, 20 bp, Homo sapiens
ctacaagagcagcctgtggc

SEQ ID NO: 4107299 - DNA, 23 bp, Homo sapiens
ctacaagagcagcctgtggcatc

SEQ ID NO: 4107300 - DNA, 18 bp, Homo sapiens
ctacaagtatatgtgaaa

SEQ ID NO: 4107301 - DNA, 21 bp, Homo sapiens
ctacaattaatagtttgtcta

SEQ ID NO: 4107302 - DNA, 11 bp, Homo sapiens
ctacacacacc

SEQ ID NO: 4107303 - DNA, 14 bp, Homo sapiens
ctacacacacccag

SEQ ID NO: 4107304 - DNA, 22 bp, Homo sapiens
ctacacactgtcatgcttcatc

SEQ ID NO: 4107305 - DNA, 21 bp, Homo sapiens
ctacacatatgtattcctgat

SEQ ID NO: 4107306 - DNA, 13 bp, Homo sapiens
ctacacattttta

SEQ ID NO: 4107307 - DNA, 17 bp, Homo sapiens
ctacacatttttaaatt

SEQ ID NO: 4107308 - DNA, 15 bp, Homo sapiens
ctacaccttgccttg

SEQ ID NO: 4107309 - DNA, 13 bp, Homo sapiens
ctacactgaggag

SEQ ID NO: 4107310 - DNA, 17 bp, Homo sapiens
ctacagaacttcagaaa

SEQ ID NO: 4107311 - DNA, 19 bp, Homo sapiens
ctacagaacttcagaaaga

SEQ ID NO: 4107312 - DNA, 12 bp, Homo sapiens
ctacagaataat

SEQ ID NO: 4107313 - DNA, 12 bp, Homo sapiens
ctacagaatttt

SEQ ID NO: 4107314 - DNA, 16 bp, Homo sapiens
ctacagactccatctc

SEQ ID NO: 4107315 - DNA, 21 bp, Homo sapiens
ctacagacttctccagaccca

SEQ ID NO: 4107316 - DNA, 18 bp, Homo sapiens
ctacagagcagctcccca

SEQ ID NO: 4107317 - DNA, 22 bp, Homo sapiens
ctacagagcagctccccaggag

SEQ ID NO: 4107318 - DNA, 21 bp, Homo sapiens
ctacagagccgagcaatattt

SEQ ID NO: 4107319 - DNA, 20 bp, Homo sapiens
ctacagatcctttttccatc

SEQ ID NO: 4107320 - DNA, 15 bp, Homo sapiens
ctacagcactactgg

SEQ ID NO: 4107321 - DNA, 19 bp, Homo sapiens
ctacagcactactgggtgt

SEQ ID NO: 4107322 - DNA, 15 bp, Homo sapiens
ctacagccacatccc

SEQ ID NO: 4107323 - DNA, 21 bp, Homo sapiens
ctacagctaatcagcattctc

SEQ ID NO: 4107324 - DNA, 17 bp, Homo sapiens
ctacagctttcttgctc

SEQ ID NO: 4107325 - DNA, 19 bp, Homo sapiens
ctacagctttgatccctga

SEQ ID NO: 4107326 - DNA, 18 bp, Homo sapiens
ctacaggagagggaagag

SEQ ID NO: 4107327 - DNA, 20 bp, Homo sapiens
ctacagttgttttttgaaaa

SEQ ID NO: 4107328 - DNA, 22 bp, Homo sapiens
ctacataaactgactttatcct

SEQ ID NO: 4107329 - DNA, 15 bp, Homo sapiens
ctacatcccagcctg

SEQ ID NO: 4107330 - DNA, 19 bp, Homo sapiens
ctacatcccagcctgtggt

SEQ ID NO: 4107331 - DNA, 14 bp, Homo sapiens
ctacatcttctgcc

SEQ ID NO: 4107332 - DNA, 16 bp, Homo sapiens
ctacatcttcttccca

SEQ ID NO: 4107333 - DNA, 15 bp, Homo sapiens
ctacatgactgggcc

SEQ ID NO: 4107334 - DNA, 17 bp, Homo sapiens
ctacatgagaacaaaca

SEQ ID NO: 4107335 - DNA, 14 bp, Homo sapiens
ctacatgcagccca

SEQ ID NO: 4107336 - DNA, 20 bp, Homo sapiens
ctacatggagtatatgtcaa

SEQ ID NO: 4107337 - DNA, 15 bp, Homo sapiens
ctacatggctttgat

SEQ ID NO: 4107338 - DNA, 22 bp, Homo sapiens
ctacatgtattgcacattgtaa

SEQ ID NO: 4107339 - DNA, 22 bp, Homo sapiens
ctacattccctctcctgcccag

SEQ ID NO: 4107340 - DNA, 20 bp, Homo sapiens
ctaccaaggtcttcttaata

SEQ ID NO: 4107341 - DNA, 14 bp, Homo sapiens
ctaccacagtgtct

SEQ ID NO: 4107342 - DNA, 18 bp, Homo sapiens
ctaccacggcctcctttc

SEQ ID NO: 4107343 - DNA, 21 bp, Homo sapiens
ctaccacggcctcctttccgt

SEQ ID NO: 4107344 - DNA, 20 bp, Homo sapiens
ctaccactggtacttccttt

SEQ ID NO: 4107345 - DNA, 19 bp, Homo sapiens
ctaccaggtgtgcctggaa

SEQ ID NO: 4107346 - DNA, 15 bp, Homo sapiens
ctaccatcagggaca

SEQ ID NO: 4107347 - DNA, 13 bp, Homo sapiens
ctaccattcagtg

SEQ ID NO: 4107348 - DNA, 19 bp, Homo sapiens
ctacccacctttcccagaa

SEQ ID NO: 4107349 - DNA, 19 bp, Homo sapiens
ctacccactatccttcgtg

SEQ ID NO: 4107350 - DNA, 14 bp, Homo sapiens
ctacccacttctaa

SEQ ID NO: 4107351 - DNA, 16 bp, Homo sapiens
ctacccatgagcctgc

SEQ ID NO: 4107352 - DNA, 13 bp, Homo sapiens
ctaccccagggcc

SEQ ID NO: 4107353 - DNA, 16 bp, Homo sapiens
ctaccccagggccctg

SEQ ID NO: 4107354 - DNA, 15 bp, Homo sapiens
ctacccctgctccca

SEQ ID NO: 4107355 - DNA, 23 bp, Homo sapiens
ctacccctgctcccattcctccc

SEQ ID NO: 4107356 - DNA, 19 bp, Homo sapiens
ctaccctcccacccccttc

SEQ ID NO: 4107357 - DNA, 16 bp, Homo sapiens
ctaccctgctccctgc

SEQ ID NO: 4107358 - DNA, 19 bp, Homo sapiens
ctaccctttttctccagct

SEQ ID NO: 4107359 - DNA, 19 bp, Homo sapiens
ctaccgagtctcttctcca

SEQ ID NO: 4107360 - DNA, 22 bp, Homo sapiens
ctcatccccaggggtcccagcc

SEQ ID NO: 4107361 - DNA, 23 bp, Homo sapiens
ctcatccccaggggtcccagcca

SEQ ID NO: 4107362 - DNA, 18 bp, Homo sapiens
ctcatccctgactggcca

SEQ ID NO: 4107363 - DNA, 22 bp, Homo sapiens
ctcatcctccagtaccttgctt

SEQ ID NO: 4107364 - DNA, 19 bp, Homo sapiens
ctcatctatgaggaaaggt

SEQ ID NO: 4107365 - DNA, 17 bp, Homo sapiens
ctcatctctctgcccaa

SEQ ID NO: 4107366 - DNA, 20 bp, Homo sapiens
ctcatctgagaggctctccg

SEQ ID NO: 4107367 - DNA, 24 bp, Homo sapiens
ctcatctgagaggctctccgtgca

SEQ ID NO: 4107368 - DNA, 14 bp, Homo sapiens
ctcatctttttact

SEQ ID NO: 4107369 - DNA, 18 bp, Homo sapiens
ctcatgagtgtgccccat

SEQ ID NO: 4107370 - DNA, 17 bp, Homo sapiens
ctcatgcacccctgagc

SEQ ID NO: 4107371 - DNA, 18 bp, Homo sapiens
ctcatgcacccctgagcc

SEQ ID NO: 4107372 - DNA, 20 bp, Homo sapiens
ctcatgcccaccccctgccc

SEQ ID NO: 4107373 - DNA, 22 bp, Homo sapiens
ctcatgcccaccccctgccctg

SEQ ID NO: 4107374 - DNA, 16 bp, Homo sapiens
ctcatgcccgccagtg

SEQ ID NO: 4107375 - DNA, 22 bp, Homo sapiens
ctcatgcccgccagtgcacagg

SEQ ID NO: 4107376 - DNA, 18 bp, Homo sapiens
ctcatgctgcccctgcct

SEQ ID NO: 4107377 - DNA, 20 bp, Homo sapiens
ctcatgctgcccctgccttg

SEQ ID NO: 4107378 - DNA, 18 bp, Homo sapiens
ctcatggcccccaggggc

SEQ ID NO: 4107379 - DNA, 20 bp, Homo sapiens
ctcatggcccccaggggcag

SEQ ID NO: 4107380 - DNA, 22 bp, Homo sapiens
ctcatggcccccaggggcagga

SEQ ID NO: 4107381 - DNA, 23 bp, Homo sapiens
ctcatggcccccaggggcaggac

SEQ ID NO: 4107382 - DNA, 17 bp, Homo sapiens
ctcatggcccctctgac

SEQ ID NO: 4107383 - DNA, 20 bp, Homo sapiens
ctcatggcccctctgacctg

SEQ ID NO: 4107384 - DNA, 23 bp, Homo sapiens
ctcatgggtcctagcccttccct

SEQ ID NO: 4107385 - DNA, 19 bp, Homo sapiens
ctcatgtaacacataaaca

SEQ ID NO: 4107386 - DNA, 18 bp, Homo sapiens
ctcatgtcctgctggctt

SEQ ID NO: 4107387 - DNA, 23 bp, Homo sapiens
ctcattaggcatggttttgggct

SEQ ID NO: 4107388 - DNA, 18 bp, Homo sapiens
ctcattatgccacttcct

SEQ ID NO: 4107389 - DNA, 17 bp, Homo sapiens
ctcattccactgttggt

SEQ ID NO: 4107390 - DNA, 18 bp, Homo sapiens
ctcattgacaagaactga

SEQ ID NO: 4107391 - DNA, 16 bp, Homo sapiens
ctcattgctgagcctc

SEQ ID NO: 4107392 - DNA, 18 bp, Homo sapiens
ctcattgctgagcctctg

SEQ ID NO: 4107393 - DNA, 19 bp, Homo sapiens
ctcattgctgagcctctgc

SEQ ID NO: 4107394 - DNA, 20 bp, Homo sapiens
ctcattgctgagcctctgct

SEQ ID NO: 4107395 - DNA, 15 bp, Homo sapiens
ctcatttgttctcac

SEQ ID NO: 4107396 - DNA, 16 bp, Homo sapiens
ctcatttgttctcaca

SEQ ID NO: 4107397 - DNA, 13 bp, Homo sapiens
ctcattttctggt

SEQ ID NO: 4107398 - DNA, 18 bp, Homo sapiens
ctccaaacctccagcctc

SEQ ID NO: 4107399 - DNA, 15 bp, Homo sapiens
ctccaaaggccccct

SEQ ID NO: 4107400 - DNA, 21 bp, Homo sapiens
ctccaacacaaggctccaaga

SEQ ID NO: 4107401 - DNA, 13 bp, Homo sapiens
ctccaacctgcaa

SEQ ID NO: 4107402 - DNA, 16 bp, Homo sapiens
ctccaagacctaggct

SEQ ID NO: 4107403 - DNA, 16 bp, Homo sapiens
ctccaagcacagagcc

SEQ ID NO: 4107404 - DNA, 13 bp, Homo sapiens
ctccaagccagca

SEQ ID NO: 4107405 - DNA, 15 bp, Homo sapiens
ctccaagcctgcctc

SEQ ID NO: 4107406 - DNA, 20 bp, Homo sapiens
ctccaaggacagaaggctcc

SEQ ID NO: 4107407 - DNA, 14 bp, Homo sapiens
ctccaagtactttt

SEQ ID NO: 4107408 - DNA, 17 bp, Homo sapiens
ctccaagtctcagtggc

SEQ ID NO: 4107409 - DNA, 15 bp, Homo sapiens
ctccaagtctctctg

SEQ ID NO: 4107410 - DNA, 17 bp, Homo sapiens
ctccaagtctctctgtg

SEQ ID NO: 4107411 - DNA, 15 bp, Homo sapiens
ctccaagtgccccct

SEQ ID NO: 4107412 - DNA, 22 bp, Homo sapiens
ctccaagtgccccctcacctct

SEQ ID NO: 4107413 - DNA, 19 bp, Homo sapiens
ctccaatgtctgctgagga

SEQ ID NO: 4107414 - DNA, 19 bp, Homo sapiens
ctccacaaatgatgttttc

SEQ ID NO: 4107415 - DNA, 17 bp, Homo sapiens
ctccacaccagtggcct

SEQ ID NO: 4107416 - DNA, 17 bp, Homo sapiens
ctccacagagtgagcca

SEQ ID NO: 4107417 - DNA, 15 bp, Homo sapiens
ctccacagcggagga

SEQ ID NO: 4107418 - DNA, 19 bp, Homo sapiens
ctccacatcccagcagccc

SEQ ID NO: 4107419 - DNA, 13 bp, Homo sapiens
ctccaccacatcc

SEQ ID NO: 4107420 - DNA, 17 bp, Homo sapiens
ctccaccacatctgcca

SEQ ID NO: 4107421 - DNA, 21 bp, Homo sapiens
ctccaccacatctgccagacc

SEQ ID NO: 4107422 - DNA, 23 bp, Homo sapiens
ctccaccacatctgccagacctt

SEQ ID NO: 4107423 - DNA, 16 bp, Homo sapiens
ctccaccagcagcatg

SEQ ID NO: 4107424 - DNA, 12 bp, Homo sapiens
ctccacccagcc

SEQ ID NO: 4107425 - DNA, 17 bp, Homo sapiens
ctccacccagcccctgg

SEQ ID NO: 4107426 - DNA, 17 bp, Homo sapiens
ctccaccccacagaacc

SEQ ID NO: 4107427 - DNA, 16 bp, Homo sapiens
ctccaccctcctcctc

SEQ ID NO: 4107428 - DNA, 17 bp, Homo sapiens
ctccaccgaccaactgc

SEQ ID NO: 4107429 - DNA, 19 bp, Homo sapiens
ctccaccgaccaactgccc

SEQ ID NO: 4107430 - DNA, 20 bp, Homo sapiens
ctccaccgaccaactgccct

SEQ ID NO: 4107431 - DNA, 21 bp, Homo sapiens
ctccaccgaccaactgcccta

SEQ ID NO: 4107432 - DNA, 16 bp, Homo sapiens
ctccacctcccaccct

SEQ ID NO: 4107433 - DNA, 22 bp, Homo sapiens
ctccacctcttcaccccccact

SEQ ID NO: 4107434 - DNA, 15 bp, Homo sapiens
ctccacgcctcctgg

SEQ ID NO: 4107435 - DNA, 19 bp, Homo sapiens
ctccactaaatgagctcct

SEQ ID NO: 4107436 - DNA, 22 bp, Homo sapiens
ctccactaccccacaccagcct

SEQ ID NO: 4107437 - DNA, 14 bp, Homo sapiens
ctccactcagctgt

SEQ ID NO: 4107438 - DNA, 19 bp, Homo sapiens
ctccactccagctctgaga

SEQ ID NO: 4107439 - DNA, 20 bp, Homo sapiens
ctccactcccacctcacccg

SEQ ID NO: 4107440 - DNA, 14 bp, Homo sapiens
ctccactcgaccca

SEQ ID NO: 4107441 - DNA, 16 bp, Homo sapiens
ctccactgcctctgga

SEQ ID NO: 4107442 - DNA, 14 bp, Homo sapiens
ctccactgccttcg

SEQ ID NO: 4107443 - DNA, 16 bp, Homo sapiens
ctccactgccttcgat

SEQ ID NO: 4107444 - DNA, 23 bp, Homo sapiens
ctccactggggaggaatcctgga

SEQ ID NO: 4107445 - DNA, 13 bp, Homo sapiens
ctccactgtcaca

SEQ ID NO: 4107446 - DNA, 16 bp, Homo sapiens
ctccactgtcacattg

SEQ ID NO: 4107447 - DNA, 18 bp, Homo sapiens
ctccactgtcaccctcca

SEQ ID NO: 4107448 - DNA, 20 bp, Homo sapiens
ctccagaaatgtccctttct

SEQ ID NO: 4107449 - DNA, 18 bp, Homo sapiens
ctccagaagcctctggct

SEQ ID NO: 4107450 - DNA, 19 bp, Homo sapiens
ctccagaatgtaagaaaac

SEQ ID NO: 4107451 - DNA, 16 bp, Homo sapiens
ctccagaccaccagcc

SEQ ID NO: 4107452 - DNA, 15 bp, Homo sapiens
ctccagacccctggc

SEQ ID NO: 4107453 - DNA, 19 bp, Homo sapiens
ctccagacccctggctttt

SEQ ID NO: 4107454 - DNA, 11 bp, Homo sapiens
ctccagacctg

SEQ ID NO: 4107455 - DNA, 19 bp, Homo sapiens
ctccagacctgatcctgga

SEQ ID NO: 4107456 - DNA, 23 bp, Homo sapiens
ctccagacctgatcctggaggcc

SEQ ID NO: 4107457 - DNA, 13 bp, Homo sapiens
ctccagatagaga

SEQ ID NO: 4107458 - DNA, 21 bp, Homo sapiens
ctccagatgcagggcagtcat

SEQ ID NO: 4107459 - DNA, 20 bp, Homo sapiens
ctccagcctccctgtctcca

SEQ ID NO: 4107460 - DNA, 21 bp, Homo sapiens
ctccagcctccctgtctccag

SEQ ID NO: 4107461 - DNA, 23 bp, Homo sapiens
ctccagcctccctgtctccagct

SEQ ID NO: 4107462 - DNA, 11 bp, Homo sapiens
ctccagcctga

SEQ ID NO: 4107463 - DNA, 12 bp, Homo sapiens
ctccagcctgaa

SEQ ID NO: 4107464 - DNA, 16 bp, Homo sapiens
ctccagcctgggggac

SEQ ID NO: 4107465 - DNA, 18 bp, Homo sapiens
ctccagcgtcagctgctc

SEQ ID NO: 4107466 - DNA, 23 bp, Homo sapiens
ctccagcgtcagctgctccctgg

SEQ ID NO: 4107467 - DNA, 12 bp, Homo sapiens
ctccagctctga

SEQ ID NO: 4107468 - DNA, 13 bp, Homo sapiens
ctccagctgcccc

SEQ ID NO: 4107469 - DNA, 13 bp, Homo sapiens
ctccagctgcctg

SEQ ID NO: 4107470 - DNA, 21 bp, Homo sapiens
ctccaggaaagagcagtcaga

SEQ ID NO: 4107471 - DNA, 19 bp, Homo sapiens
ctccaggaaggtagcccag

SEQ ID NO: 4107472 - DNA, 20 bp, Homo sapiens
ctccaggaaggtagcccagc

SEQ ID NO: 4107473 - DNA, 20 bp, Homo sapiens
ctccaggaatgcctcctccc

SEQ ID NO: 4107474 - DNA, 19 bp, Homo sapiens
ctccaggattgaagagcat

SEQ ID NO: 4107475 - DNA, 12 bp, Homo sapiens
ctccaggcagca

SEQ ID NO: 4107476 - DNA, 18 bp, Homo sapiens
ctccaggccctcctctcc

SEQ ID NO: 4107477 - DNA, 15 bp, Homo sapiens
ctccaggcctctagt

SEQ ID NO: 4107478 - DNA, 22 bp, Homo sapiens
ctccaggcctgcagcaggagtg

SEQ ID NO: 4107479 - DNA, 22 bp, Homo sapiens
ctccaggcctgcctcccacttc

SEQ ID NO: 4107480 - DNA, 19 bp, Homo sapiens
ctccaggcttcacagtctg

SEQ ID NO: 4107481 - DNA, 19 bp, Homo sapiens
ctccagggagcaagacaga

SEQ ID NO: 4107482 - DNA, 17 bp, Homo sapiens
ctccagggatggcccct

SEQ ID NO: 4107483 - DNA, 14 bp, Homo sapiens
ctccagggcccagg

SEQ ID NO: 4107484 - DNA, 15 bp, Homo sapiens
ctccagggcccccca

SEQ ID NO: 4107485 - DNA, 16 bp, Homo sapiens
ctccagggccccccaa

SEQ ID NO: 4107486 - DNA, 17 bp, Homo sapiens
ctccaggtcagctgccc

SEQ ID NO: 4107487 - DNA, 16 bp, Homo sapiens
ctccagtaccttgctt

SEQ ID NO: 4107488 - DNA, 15 bp, Homo sapiens
ctccagtccccagaa

SEQ ID NO: 4107489 - DNA, 22 bp, Homo sapiens
ctccagtgaagcagcctcctta

SEQ ID NO: 4107490 - DNA, 17 bp, Homo sapiens
ctccagttgggactcag

SEQ ID NO: 4107491 - DNA, 17 bp, Homo sapiens
ctccagtttgcacctgt

SEQ ID NO: 4107492 - DNA, 20 bp, Homo sapiens
ctccagtttgcacctgtccc

SEQ ID NO: 4107493 - DNA, 17 bp, Homo sapiens
ctccagttttcagttga

SEQ ID NO: 4107494 - DNA, 15 bp, Homo sapiens
ctccataaacagact

SEQ ID NO: 4107495 - DNA, 14 bp, Homo sapiens
ctccataccttttc

SEQ ID NO: 4107496 - DNA, 21 bp, Homo sapiens
ctccataccttttctcttttc

SEQ ID NO: 4107497 - DNA, 23 bp, Homo sapiens
ctccataccttttctcttttctt

SEQ ID NO: 4107498 - DNA, 20 bp, Homo sapiens
ctccatatctccatggccct

SEQ ID NO: 4107499 - DNA, 18 bp, Homo sapiens
ctccatcatatgcctgac

SEQ ID NO: 4107500 - DNA, 20 bp, Homo sapiens
ctccatcatatgcctgaccc

SEQ ID NO: 4107501 - DNA, 13 bp, Homo sapiens
ctccatccatcct

SEQ ID NO: 4107502 - DNA, 15 bp, Homo sapiens
ctccatccatccttc

SEQ ID NO: 4107503 - DNA, 19 bp, Homo sapiens
ctccatcctcctccttcct

SEQ ID NO: 4107504 - DNA, 13 bp, Homo sapiens
ctccatctcctgc

SEQ ID NO: 4107505 - DNA, 23 bp, Homo sapiens
ctccatctcctgctcaccacctg

SEQ ID NO: 4107506 - DNA, 20 bp, Homo sapiens
ctccatctctcatcctccag

SEQ ID NO: 4107507 - DNA, 16 bp, Homo sapiens
ctccatctcttctgca

SEQ ID NO: 4107508 - DNA, 23 bp, Homo sapiens
ctccatctcttctgcaagcctca

SEQ ID NO: 4107509 - DNA, 17 bp, Homo sapiens
ctccatgaagagcttgt

SEQ ID NO: 4107510 - DNA, 15 bp, Homo sapiens
ctccatggccctgtc

SEQ ID NO: 4107511 - DNA, 19 bp, Homo sapiens
ctccatggccctgtcccag

SEQ ID NO: 4107512 - DNA, 20 bp, Homo sapiens
ctccatggccctgtcccagg

SEQ ID NO: 4107513 - DNA, 21 bp, Homo sapiens
ctccatggccctgtcccaggc

SEQ ID NO: 4107514 - DNA, 16 bp, Homo sapiens
ctccattaaagtctga

SEQ ID NO: 4107515 - DNA, 20 bp, Homo sapiens
ctccattaaagtctgaatca

SEQ ID NO: 4107516 - DNA, 15 bp, Homo sapiens
ctccattcatccttc

SEQ ID NO: 4107517 - DNA, 21 bp, Homo sapiens
ctccattcatccttccatcca

SEQ ID NO: 4107518 - DNA, 14 bp, Homo sapiens
ctccattctatttt

SEQ ID NO: 4107519 - DNA, 21 bp, Homo sapiens
ctccatttataaccccagcct

SEQ ID NO: 4107520 - DNA, 22 bp, Homo sapiens
ctccatttataaccccagcctg

SEQ ID NO: 4107521 - DNA, 22 bp, Homo sapiens
ctccattttggtgtctttctct

SEQ ID NO: 4107522 - DNA, 12 bp, Homo sapiens
ctccatttttct

SEQ ID NO: 4107523 - DNA, 20 bp, Homo sapiens
ctccatttttctcccaagaa

SEQ ID NO: 4107524 - DNA, 16 bp, Homo sapiens
ctcccaaccctggctt

SEQ ID NO: 4107525 - DNA, 16 bp, Homo sapiens
ctcccaacttcttcct

SEQ ID NO: 4107526 - DNA, 21 bp, Homo sapiens
ctcccaagggtgccctttggg

SEQ ID NO: 4107527 - DNA, 23 bp, Homo sapiens
ctcccaagtcacacccactccct

SEQ ID NO: 4107528 - DNA, 21 bp, Homo sapiens
ctcccaatttcagactcccat

SEQ ID NO: 4107529 - DNA, 17 bp, Homo sapiens
ctcccacaaccacatgt

SEQ ID NO: 4107530 - DNA, 14 bp, Homo sapiens
ctcccacaggccct

SEQ ID NO: 4107531 - DNA, 20 bp, Homo sapiens
ctcccacaggcccttcctct

SEQ ID NO: 4107532 - DNA, 21 bp, Homo sapiens
ctcccacatgaggccatctca

SEQ ID NO: 4107533 - DNA, 19 bp, Homo sapiens
ctcccacccccatctctcc

SEQ ID NO: 4107534 - DNA, 22 bp, Homo sapiens
ctcccacccccatctctccctc

SEQ ID NO: 4107535 - DNA, 13 bp, Homo sapiens
ctcccaccctgta

SEQ ID NO: 4107536 - DNA, 21 bp, Homo sapiens
ctcccacgtgggagacaagaa

SEQ ID NO: 4107537 - DNA, 12 bp, Homo sapiens
ctcccagcctgc

SEQ ID NO: 4107538 - DNA, 14 bp, Homo sapiens
ctcccagcctgctg

SEQ ID NO: 4107539 - DNA, 21 bp, Homo sapiens
ctcccagcttaaatcctagca

SEQ ID NO: 4107540 - DNA, 18 bp, Homo sapiens
ctcccaggccccctgcat

SEQ ID NO: 4107541 - DNA, 13 bp, Homo sapiens
ctcccaggggtct

SEQ ID NO: 4107542 - DNA, 20 bp, Homo sapiens
ctcccaggggtctccctggc

SEQ ID NO: 4107543 - DNA, 22 bp, Homo sapiens
ctcccaggggtctccctggctc

SEQ ID NO: 4107544 - DNA, 23 bp, Homo sapiens
ctcccaggggtctccctggctcc

SEQ ID NO: 4107545 - DNA, 19 bp, Homo sapiens
ctcccaggtaccagctgcg

SEQ ID NO: 4107546 - DNA, 24 bp, Homo sapiens
ctcccaggtaccagctgcgcttgc

SEQ ID NO: 4107547 - DNA, 19 bp, Homo sapiens
ctcccaggttcccccagca

SEQ ID NO: 4107548 - DNA, 22 bp, Homo sapiens
ctcccaggttcccccagcaagc

SEQ ID NO: 4107549 - DNA, 14 bp, Homo sapiens
ctcccagtcctcca

SEQ ID NO: 4107550 - DNA, 15 bp, Homo sapiens
ctcccagtcctccag

SEQ ID NO: 4107551 - DNA, 15 bp, Homo sapiens
ctcccagtgaactcc

SEQ ID NO: 4107552 - DNA, 21 bp, Homo sapiens
ctcccagtgaactcctgccag

SEQ ID NO: 4107553 - DNA, 16 bp, Homo sapiens
ctcccatcacttccct

SEQ ID NO: 4107554 - DNA, 15 bp, Homo sapiens
ctcccatccagggcc

SEQ ID NO: 4107555 - DNA, 15 bp, Homo sapiens
ctcccatccttccct

SEQ ID NO: 4107556 - DNA, 21 bp, Homo sapiens
ctcccatgaccatactgaggg

SEQ ID NO: 4107557 - DNA, 22 bp, Homo sapiens
ctcccatgggggcacttgagtt

SEQ ID NO: 4107558 - DNA, 14 bp, Homo sapiens
ctcccatgtatgga

SEQ ID NO: 4107559 - DNA, 14 bp, Homo sapiens
ctccccacccgccc

SEQ ID NO: 4107560 - DNA, 23 bp, Homo sapiens
ctccccacggggcctcgggacct

SEQ ID NO: 4107561 - DNA, 10 bp, Homo sapiens
ctccccagaa

SEQ ID NO: 4107562 - DNA, 16 bp, Homo sapiens
ctccccagatctccca

SEQ ID NO: 4107563 - DNA, 16 bp, Homo sapiens
ctccccagccctggct

SEQ ID NO: 4107564 - DNA, 12 bp, Homo sapiens
ctccccaggcca

SEQ ID NO: 4107565 - DNA, 23 bp, Homo sapiens
ctcagcatttccttccagcccat

SEQ ID NO: 4107566 - DNA, 19 bp, Homo sapiens
ctcagcatttccttgtccc

SEQ ID NO: 4107567 - DNA, 13 bp, Homo sapiens
ctcagccagcact

SEQ ID NO: 4107568 - DNA, 19 bp, Homo sapiens
ctcagcccacatagtgatg

SEQ ID NO: 4107569 - DNA, 21 bp, Homo sapiens
ctcagcccacatagtgatggt

SEQ ID NO: 4107570 - DNA, 19 bp, Homo sapiens
ctcagccccgagctgtccc

SEQ ID NO: 4107571 - DNA, 12 bp, Homo sapiens
ctcagccctcag

SEQ ID NO: 4107572 - DNA, 13 bp, Homo sapiens
ctcagccctcaga

SEQ ID NO: 4107573 - DNA, 17 bp, Homo sapiens
ctcagccctcagaacaa

SEQ ID NO: 4107574 - DNA, 20 bp, Homo sapiens
ctcagccctccctgcccctc

SEQ ID NO: 4107575 - DNA, 11 bp, Homo sapiens
ctcagccctga

SEQ ID NO: 4107576 - DNA, 14 bp, Homo sapiens
ctcagcctcagagg

SEQ ID NO: 4107577 - DNA, 15 bp, Homo sapiens
ctcagcctcagagga

SEQ ID NO: 4107578 - DNA, 20 bp, Homo sapiens
ctcagcctccggagtagctg

SEQ ID NO: 4107579 - DNA, 16 bp, Homo sapiens
ctcagcctcctgagcc

SEQ ID NO: 4107580 - DNA, 19 bp, Homo sapiens
ctcagcctcctgagcctgt

SEQ ID NO: 4107581 - DNA, 20 bp, Homo sapiens
ctcagcctcctgagcctgtg

SEQ ID NO: 4107582 - DNA, 16 bp, Homo sapiens
ctcagcctctcgaagt

SEQ ID NO: 4107583 - DNA, 19 bp, Homo sapiens
ctcagcctggccagacaca

SEQ ID NO: 4107584 - DNA, 20 bp, Homo sapiens
ctcagccttccaactagctg

SEQ ID NO: 4107585 - DNA, 23 bp, Homo sapiens
ctcagcgtttttttgtttttaat

SEQ ID NO: 4107586 - DNA, 16 bp, Homo sapiens
ctcagctcagcgccag

SEQ ID NO: 4107587 - DNA, 17 bp, Homo sapiens
ctcagctcagcgccagc

SEQ ID NO: 4107588 - DNA, 20 bp, Homo sapiens
ctcagctcctacctctgtgc

SEQ ID NO: 4107589 - DNA, 21 bp, Homo sapiens
ctcagctcctacctctgtgcc

SEQ ID NO: 4107590 - DNA, 15 bp, Homo sapiens
ctcagctctctggga

SEQ ID NO: 4107591 - DNA, 21 bp, Homo sapiens
ctcagctctctgggacctcct

SEQ ID NO: 4107592 - DNA, 18 bp, Homo sapiens
ctcagctctgggagagga

SEQ ID NO: 4107593 - DNA, 23 bp, Homo sapiens
ctcagctctgggccattctccac

SEQ ID NO: 4107594 - DNA, 15 bp, Homo sapiens
ctcagctgacccggc

SEQ ID NO: 4107595 - DNA, 16 bp, Homo sapiens
ctcagctgcctcactt

SEQ ID NO: 4107596 - DNA, 15 bp, Homo sapiens
ctcagctgcctcctg

SEQ ID NO: 4107597 - DNA, 20 bp, Homo sapiens
ctcagctgcctcctgcgccc

SEQ ID NO: 4107598 - DNA, 19 bp, Homo sapiens
ctcagctggttactcaggg

SEQ ID NO: 4107599 - DNA, 18 bp, Homo sapiens
ctcagctgtctgtggctt

SEQ ID NO: 4107600 - DNA, 16 bp, Homo sapiens
ctcagcttcctaccca

SEQ ID NO: 4107601 - DNA, 14 bp, Homo sapiens
ctcaggaagagcta

SEQ ID NO: 4107602 - DNA, 21 bp, Homo sapiens
ctcaggaagagctatggccca

SEQ ID NO: 4107603 - DNA, 16 bp, Homo sapiens
ctcaggacagcatccc

SEQ ID NO: 4107604 - DNA, 23 bp, Homo sapiens
ctcaggacagcatcccttcccac

SEQ ID NO: 4107605 - DNA, 22 bp, Homo sapiens
ctcaggacctctgtaggcagca

SEQ ID NO: 4107606 - DNA, 23 bp, Homo sapiens
ctcaggacctctgtaggcagcag

SEQ ID NO: 4107607 - DNA, 16 bp, Homo sapiens
ctcaggactcctctcc

SEQ ID NO: 4107608 - DNA, 15 bp, Homo sapiens
ctcaggagcacaggc

SEQ ID NO: 4107609 - DNA, 18 bp, Homo sapiens
ctcaggagcacaggcagc

SEQ ID NO: 4107610 - DNA, 22 bp, Homo sapiens
ctcaggaggctgaggcaggagg

SEQ ID NO: 4107611 - DNA, 13 bp, Homo sapiens
ctcaggcacacag

SEQ ID NO: 4107612 - DNA, 15 bp, Homo sapiens
ctcaggcacacagct

SEQ ID NO: 4107613 - DNA, 16 bp, Homo sapiens
ctcaggcacacagcta

SEQ ID NO: 4107614 - DNA, 23 bp, Homo sapiens
ctcaggcataggcctgggtgctg

SEQ ID NO: 4107615 - DNA, 13 bp, Homo sapiens
ctcaggcctgtgc

SEQ ID NO: 4107616 - DNA, 19 bp, Homo sapiens
ctcaggcctgtgcccactc

SEQ ID NO: 4107617 - DNA, 23 bp, Homo sapiens
ctcaggcctgtgcccactcccta

SEQ ID NO: 4107618 - DNA, 14 bp, Homo sapiens
ctcagggacagagc

SEQ ID NO: 4107619 - DNA, 15 bp, Homo sapiens
ctcagggacagagcc

SEQ ID NO: 4107620 - DNA, 23 bp, Homo sapiens
ctcagggaccggtgctgcaggag

SEQ ID NO: 4107621 - DNA, 18 bp, Homo sapiens
ctcagggagcagggaagg

SEQ ID NO: 4107622 - DNA, 19 bp, Homo sapiens
ctcagggagcagggaaggc

SEQ ID NO: 4107623 - DNA, 18 bp, Homo sapiens
ctcagggattctgggctt

SEQ ID NO: 4107624 - DNA, 20 bp, Homo sapiens
ctcagggcagcgccaggctg

SEQ ID NO: 4107625 - DNA, 19 bp, Homo sapiens
ctcagggccaggcccaggc

SEQ ID NO: 4107626 - DNA, 14 bp, Homo sapiens
ctcagggcctggca

SEQ ID NO: 4107627 - DNA, 16 bp, Homo sapiens
ctcagggcctggcagg

SEQ ID NO: 4107628 - DNA, 17 bp, Homo sapiens
ctcagggcctggcaggc

SEQ ID NO: 4107629 - DNA, 18 bp, Homo sapiens
ctcagggcctggcaggcc

SEQ ID NO: 4107630 - DNA, 13 bp, Homo sapiens
ctcagggctgtcc

SEQ ID NO: 4107631 - DNA, 17 bp, Homo sapiens
ctcagggctgtcccagc

SEQ ID NO: 4107632 - DNA, 18 bp, Homo sapiens
ctcaggggaaaactgtta

SEQ ID NO: 4107633 - DNA, 18 bp, Homo sapiens
ctcagggtggggggtgac

SEQ ID NO: 4107634 - DNA, 17 bp, Homo sapiens
ctcagggttcatctgtc

SEQ ID NO: 4107635 - DNA, 23 bp, Homo sapiens
ctcaggtagaaggttgacacagt

SEQ ID NO: 4107636 - DNA, 14 bp, Homo sapiens
ctcaggtgctgtcc

SEQ ID NO: 4107637 - DNA, 18 bp, Homo sapiens
ctcaggtggggagtccag

SEQ ID NO: 4107638 - DNA, 15 bp, Homo sapiens
ctcaggtgttgccaa

SEQ ID NO: 4107639 - DNA, 20 bp, Homo sapiens
ctcagtaaatgtacaactgc

SEQ ID NO: 4107640 - DNA, 18 bp, Homo sapiens
ctcagtatgctgcccctg

SEQ ID NO: 4107641 - DNA, 22 bp, Homo sapiens
ctcagtcatgcataaatatgca

SEQ ID NO: 4107642 - DNA, 13 bp, Homo sapiens
ctcagtctccctt

SEQ ID NO: 4107643 - DNA, 15 bp, Homo sapiens
ctcagtctccctttc

SEQ ID NO: 4107644 - DNA, 18 bp, Homo sapiens
ctcagtgagcctcctgtg

SEQ ID NO: 4107645 - DNA, 17 bp, Homo sapiens
ctcagtgctctctccac

SEQ ID NO: 4107646 - DNA, 21 bp, Homo sapiens
ctcagtggcttcatctgtcaa

SEQ ID NO: 4107647 - DNA, 14 bp, Homo sapiens
ctcagtgtcattta

SEQ ID NO: 4107648 - DNA, 17 bp, Homo sapiens
ctcagtgtcatttatga

SEQ ID NO: 4107649 - DNA, 22 bp, Homo sapiens
ctcagtgtcatttatgaaaaga

SEQ ID NO: 4107650 - DNA, 20 bp, Homo sapiens
ctcagtgttagagaaatcct

SEQ ID NO: 4107651 - DNA, 16 bp, Homo sapiens
ctcagttaaaatgtga

SEQ ID NO: 4107652 - DNA, 21 bp, Homo sapiens
ctcagttcaacctggtggcac

SEQ ID NO: 4107653 - DNA, 14 bp, Homo sapiens
ctcagttcccttgg

SEQ ID NO: 4107654 - DNA, 19 bp, Homo sapiens
ctcagttcccttggcctca

SEQ ID NO: 4107655 - DNA, 13 bp, Homo sapiens
ctcagttccttca

SEQ ID NO: 4107656 - DNA, 22 bp, Homo sapiens
ctcagttctctcccttcctctc

SEQ ID NO: 4107657 - DNA, 23 bp, Homo sapiens
ctcagttctctcccttcctctct

SEQ ID NO: 4107658 - DNA, 13 bp, Homo sapiens
ctcagtttgtcag

SEQ ID NO: 4107659 - DNA, 18 bp, Homo sapiens
ctcagttttatgccccat

SEQ ID NO: 4107660 - DNA, 16 bp, Homo sapiens
ctcagttttcagctat

SEQ ID NO: 4107661 - DNA, 21 bp, Homo sapiens
ctcataaaaagcctgcaattt

SEQ ID NO: 4107662 - DNA, 18 bp, Homo sapiens
ctcatcaacaaagaaata

SEQ ID NO: 4107663 - DNA, 16 bp, Homo sapiens
ctcatcaggatgaacc

SEQ ID NO: 4107664 - DNA, 14 bp, Homo sapiens
ctcatcatttgtgg

SEQ ID NO: 4107665 - DNA, 13 bp, Homo sapiens
ctcatccacccca

SEQ ID NO: 4107666 - DNA, 19 bp, Homo sapiens
ctcatccaccccatccctc

SEQ ID NO: 4107667 - DNA, 24 bp, Homo sapiens
ctcatccaccccatccctccccag

SEQ ID NO: 4107668 - DNA, 17 bp, Homo sapiens
ctcctgtgcatgggtga

SEQ ID NO: 4107669 - DNA, 16 bp, Homo sapiens
ctcctgtgcctggccc

SEQ ID NO: 4107670 - DNA, 15 bp, Homo sapiens
ctcctgtggcctgcc

SEQ ID NO: 4107671 - DNA, 17 bp, Homo sapiens
ctcctgtggcctgccag

SEQ ID NO: 4107672 - DNA, 20 bp, Homo sapiens
ctcctgtggcctgccagtca

SEQ ID NO: 4107673 - DNA, 17 bp, Homo sapiens
ctccttagtcttctcat

SEQ ID NO: 4107674 - DNA, 17 bp, Homo sapiens
ctccttagttggctgga

SEQ ID NO: 4107675 - DNA, 23 bp, Homo sapiens
ctccttcaacaaggcttgctgca

SEQ ID NO: 4107676 - DNA, 12 bp, Homo sapiens
ctccttcagaca

SEQ ID NO: 4107677 - DNA, 15 bp, Homo sapiens
ctccttcccactctt

SEQ ID NO: 4107678 - DNA, 17 bp, Homo sapiens
ctccttcccactcttct

SEQ ID NO: 4107679 - DNA, 18 bp, Homo sapiens
ctccttcccactcttctc

SEQ ID NO: 4107680 - DNA, 19 bp, Homo sapiens
ctccttcccactcttctca

SEQ ID NO: 4107681 - DNA, 22 bp, Homo sapiens
ctccttcccatttctctacact

SEQ ID NO: 4107682 - DNA, 13 bp, Homo sapiens
ctccttccctcac

SEQ ID NO: 4107683 - DNA, 23 bp, Homo sapiens
ctccttccctcacccccagcaca

SEQ ID NO: 4107684 - DNA, 20 bp, Homo sapiens
ctccttcctagttcatccct

SEQ ID NO: 4107685 - DNA, 13 bp, Homo sapiens
ctccttctccctt

SEQ ID NO: 4107686 - DNA, 20 bp, Homo sapiens
ctccttggcttacctgacct

SEQ ID NO: 4107687 - DNA, 18 bp, Homo sapiens
ctcctttctccagccagc

SEQ ID NO: 4107688 - DNA, 12 bp, Homo sapiens
ctcctttctgtg

SEQ ID NO: 4107689 - DNA, 13 bp, Homo sapiens
ctcctttctgtgc

SEQ ID NO: 4107690 - DNA, 15 bp, Homo sapiens
ctcctttgcactgag

SEQ ID NO: 4107691 - DNA, 16 bp, Homo sapiens
ctcctttgcactgagg

SEQ ID NO: 4107692 - DNA, 18 bp, Homo sapiens
ctcctttgcactgagggc

SEQ ID NO: 4107693 - DNA, 13 bp, Homo sapiens
ctccttttgtgtt

SEQ ID NO: 4107694 - DNA, 21 bp, Homo sapiens
ctcgacccagaatggagcctg

SEQ ID NO: 4107695 - DNA, 23 bp, Homo sapiens
ctcgagcagtcctgcctcagcct

SEQ ID NO: 4107696 - DNA, 14 bp, Homo sapiens
ctcgatgcagacag

SEQ ID NO: 4107697 - DNA, 14 bp, Homo sapiens
ctcgatttctccag

SEQ ID NO: 4107698 - DNA, 16 bp, Homo sapiens
ctcgcacccccctgtt

SEQ ID NO: 4107699 - DNA, 17 bp, Homo sapiens
ctcgcacccccctgttc

SEQ ID NO: 4107700 - DNA, 21 bp, Homo sapiens
ctcgcacccccctgttctaag

SEQ ID NO: 4107701 - DNA, 23 bp, Homo sapiens
ctcgcacccccctgttctaaggg

SEQ ID NO: 4107702 - DNA, 15 bp, Homo sapiens
ctcgcacctgtgctg

SEQ ID NO: 4107703 - DNA, 22 bp, Homo sapiens
ctcgcatttgtcaatgacagtt

SEQ ID NO: 4107704 - DNA, 12 bp, Homo sapiens
ctcgccatctcc

SEQ ID NO: 4107705 - DNA, 15 bp, Homo sapiens
ctcgccctcctttct

SEQ ID NO: 4107706 - DNA, 17 bp, Homo sapiens
ctcgccctcctttctgt

SEQ ID NO: 4107707 - DNA, 20 bp, Homo sapiens
ctcgccctgcggtagatggg

SEQ ID NO: 4107708 - DNA, 23 bp, Homo sapiens
ctcgcctgacaaccactggtctg

SEQ ID NO: 4107709 - DNA, 17 bp, Homo sapiens
ctcgcctgtcaccccca

SEQ ID NO: 4107710 - DNA, 19 bp, Homo sapiens
ctcgcgggcagcgggccag

SEQ ID NO: 4107711 - DNA, 23 bp, Homo sapiens
ctcgcgggcagcgggccaggccc

SEQ ID NO: 4107712 - DNA, 18 bp, Homo sapiens
ctcgctcaccgctggccc

SEQ ID NO: 4107713 - DNA, 15 bp, Homo sapiens
ctcgctgcttctgtg

SEQ ID NO: 4107714 - DNA, 17 bp, Homo sapiens
ctcgctgtcactggctg

SEQ ID NO: 4107715 - DNA, 18 bp, Homo sapiens
ctcgctgtcactggctgg

SEQ ID NO: 4107716 - DNA, 19 bp, Homo sapiens
ctcgctgtcactggctggc

SEQ ID NO: 4107717 - DNA, 22 bp, Homo sapiens
ctcggacagcccatctgcctgt

SEQ ID NO: 4107718 - DNA, 13 bp, Homo sapiens
ctcggaggaagcc

SEQ ID NO: 4107719 - DNA, 16 bp, Homo sapiens
ctcggagttcttcttg

SEQ ID NO: 4107720 - DNA, 14 bp, Homo sapiens
ctcggatcagctga

SEQ ID NO: 4107721 - DNA, 15 bp, Homo sapiens
ctcggctcaggctct

SEQ ID NO: 4107722 - DNA, 21 bp, Homo sapiens
ctcggctcaggctctgctggt

SEQ ID NO: 4107723 - DNA, 19 bp, Homo sapiens
ctcggctccccatgtgtcc

SEQ ID NO: 4107724 - DNA, 18 bp, Homo sapiens
ctcggcttgtgggctggt

SEQ ID NO: 4107725 - DNA, 20 bp, Homo sapiens
ctcggcttgtgggctggtgc

SEQ ID NO: 4107726 - DNA, 19 bp, Homo sapiens
ctcgggaggctgagacagg

SEQ ID NO: 4107727 - DNA, 21 bp, Homo sapiens
ctcgggaggctgagacaggag

SEQ ID NO: 4107728 - DNA, 22 bp, Homo sapiens
ctcgggccgaggcccagcgggc

SEQ ID NO: 4107729 - DNA, 14 bp, Homo sapiens
ctcgtaactggttt

SEQ ID NO: 4107730 - DNA, 13 bp, Homo sapiens
ctcgtccaccccc

SEQ ID NO: 4107731 - DNA, 15 bp, Homo sapiens
ctcgtccacccccca

SEQ ID NO: 4107732 - DNA, 17 bp, Homo sapiens
ctcgtccctccctcact

SEQ ID NO: 4107733 - DNA, 16 bp, Homo sapiens
ctcgtgcatccctgag

SEQ ID NO: 4107734 - DNA, 17 bp, Homo sapiens
ctcgtgcatccctgaga

SEQ ID NO: 4107735 - DNA, 20 bp, Homo sapiens
ctcgtgcattaaaatttctt

SEQ ID NO: 4107736 - DNA, 19 bp, Homo sapiens
ctcgtgccatgatctgtat

SEQ ID NO: 4107737 - DNA, 12 bp, Homo sapiens
ctcgttcccaaa

SEQ ID NO: 4107738 - DNA, 14 bp, Homo sapiens
ctcgttcctttctc

SEQ ID NO: 4107739 - DNA, 16 bp, Homo sapiens
ctcgtttttcagcacc

SEQ ID NO: 4107740 - DNA, 21 bp, Homo sapiens
ctcgtttttcttcttaagact

SEQ ID NO: 4107741 - DNA, 23 bp, Homo sapiens
ctctaaaaaacatttttaattta

SEQ ID NO: 4107742 - DNA, 13 bp, Homo sapiens
ctctaaaagcacc

SEQ ID NO: 4107743 - DNA, 19 bp, Homo sapiens
ctctaaactgcaaacagaa

SEQ ID NO: 4107744 - DNA, 11 bp, Homo sapiens
ctctaaagcac

SEQ ID NO: 4107745 - DNA, 19 bp, Homo sapiens
ctctaaatcttccttgtga

SEQ ID NO: 4107746 - DNA, 21 bp, Homo sapiens
ctctaaatgcagttttaagaa

SEQ ID NO: 4107747 - DNA, 13 bp, Homo sapiens
ctctaacatttcc

SEQ ID NO: 4107748 - DNA, 21 bp, Homo sapiens
ctctaacttattttatttcca

SEQ ID NO: 4107749 - DNA, 19 bp, Homo sapiens
ctctaagccactcttccaa

SEQ ID NO: 4107750 - DNA, 18 bp, Homo sapiens
ctctaagtgtttgctgca

SEQ ID NO: 4107751 - DNA, 16 bp, Homo sapiens
ctctaatctgagctgc

SEQ ID NO: 4107752 - DNA, 18 bp, Homo sapiens
ctctacatcttctgcctt

SEQ ID NO: 4107753 - DNA, 18 bp, Homo sapiens
ctctaccagttggcagac

SEQ ID NO: 4107754 - DNA, 20 bp, Homo sapiens
ctctaccagttggcagacag

SEQ ID NO: 4107755 - DNA, 18 bp, Homo sapiens
ctctaccatcatccggtt

SEQ ID NO: 4107756 - DNA, 19 bp, Homo sapiens
ctctacccatattacagat

SEQ ID NO: 4107757 - DNA, 15 bp, Homo sapiens
ctctacccatgagcc

SEQ ID NO: 4107758 - DNA, 18 bp, Homo sapiens
ctctacccatgagcctgc

SEQ ID NO: 4107759 - DNA, 19 bp, Homo sapiens
ctctacccatgagcctgcc

SEQ ID NO: 4107760 - DNA, 14 bp, Homo sapiens
ctctaccctgctcc

SEQ ID NO: 4107761 - DNA, 13 bp, Homo sapiens
ctctaccctggca

SEQ ID NO: 4107762 - DNA, 17 bp, Homo sapiens
ctctacctaatgtctca

SEQ ID NO: 4107763 - DNA, 20 bp, Homo sapiens
ctctacctcatatcagtttg

SEQ ID NO: 4107764 - DNA, 18 bp, Homo sapiens
ctctacgccactccacaa

SEQ ID NO: 4107765 - DNA, 22 bp, Homo sapiens
ctctacgccactccacaaatga

SEQ ID NO: 4107766 - DNA, 15 bp, Homo sapiens
ctctacttaatgaga

SEQ ID NO: 4107767 - DNA, 16 bp, Homo sapiens
ctctacttagcatgtc

SEQ ID NO: 4107768 - DNA, 12 bp, Homo sapiens
ctctagaaattt

SEQ ID NO: 4107769 - DNA, 19 bp, Homo sapiens
ctctagaagccaagggaaa

SEQ ID NO: 4107770 - DNA, 18 bp, Homo sapiens
ctctagagaagtggactg

SEQ ID NO: 4107771 - DNA, 19 bp, Homo sapiens
ctctagtaagatgcactga

SEQ ID NO: 4107772 - DNA, 16 bp, Homo sapiens
ctctagtgggacagcc

SEQ ID NO: 4107773 - DNA, 18 bp, Homo sapiens
ctctagtgggacagccca

SEQ ID NO: 4107774 - DNA, 22 bp, Homo sapiens
ctctatccaaagaacttgattt

SEQ ID NO: 4107775 - DNA, 21 bp, Homo sapiens
ctctatccccatccaggtctt

SEQ ID NO: 4107776 - DNA, 14 bp, Homo sapiens
ctctatctctcaaa

SEQ ID NO: 4107777 - DNA, 14 bp, Homo sapiens
ctctattaaaatgc

SEQ ID NO: 4107778 - DNA, 23 bp, Homo sapiens
ctctattagactttagaaataaa

SEQ ID NO: 4107779 - DNA, 20 bp, Homo sapiens
ctctattccccaccctcccc

SEQ ID NO: 4107780 - DNA, 22 bp, Homo sapiens
ctctattgggcacagcctaggg

SEQ ID NO: 4107781 - DNA, 17 bp, Homo sapiens
ctctatttaatatttat

SEQ ID NO: 4107782 - DNA, 17 bp, Homo sapiens
ctctatttatgtttgca

SEQ ID NO: 4107783 - DNA, 17 bp, Homo sapiens
ctctatttccccctttc

SEQ ID NO: 4107784 - DNA, 18 bp, Homo sapiens
ctctattttgtgatgatg

SEQ ID NO: 4107785 - DNA, 17 bp, Homo sapiens
ctctcaaaagtctattt

SEQ ID NO: 4107786 - DNA, 14 bp, Homo sapiens
ctctcagctccggg

SEQ ID NO: 4107787 - DNA, 13 bp, Homo sapiens
ctctcaggagcac

SEQ ID NO: 4107788 - DNA, 21 bp, Homo sapiens
ctctcagggcctggcaggcca

SEQ ID NO: 4107789 - DNA, 22 bp, Homo sapiens
ctctcagggcctggcaggccag

SEQ ID NO: 4107790 - DNA, 18 bp, Homo sapiens
ctctcagttaaaatgtga

SEQ ID NO: 4107791 - DNA, 13 bp, Homo sapiens
ctctcatctcagg

SEQ ID NO: 4107792 - DNA, 22 bp, Homo sapiens
ctctcatgctgcccctgccttg

SEQ ID NO: 4107793 - DNA, 17 bp, Homo sapiens
ctctccaagtctcagtg

SEQ ID NO: 4107794 - DNA, 16 bp, Homo sapiens
ctctccaagtctctct

SEQ ID NO: 4107795 - DNA, 23 bp, Homo sapiens
ctctccactaccccacaccagcc

SEQ ID NO: 4107796 - DNA, 14 bp, Homo sapiens
ctctccactgcctt

SEQ ID NO: 4107797 - DNA, 15 bp, Homo sapiens
ctctccactgccttc

SEQ ID NO: 4107798 - DNA, 22 bp, Homo sapiens
ctctccaggaaggtagcccagc

SEQ ID NO: 4107799 - DNA, 12 bp, Homo sapiens
ctctccagggtg

SEQ ID NO: 4107800 - DNA, 14 bp, Homo sapiens
ctctccaggtgctc

SEQ ID NO: 4107801 - DNA, 23 bp, Homo sapiens
ctctccagtttgcacctgtcccc

SEQ ID NO: 4107802 - DNA, 20 bp, Homo sapiens
ctctccatatcccttcctct

SEQ ID NO: 4107803 - DNA, 22 bp, Homo sapiens
ctctccattttggtgtctttct

SEQ ID NO: 4107804 - DNA, 19 bp, Homo sapiens
ctctcccagtgaactcctg

SEQ ID NO: 4107805 - DNA, 22 bp, Homo sapiens
ctctcccagtgaactcctgcca

SEQ ID NO: 4107806 - DNA, 17 bp, Homo sapiens
ctctcccatttcaggaa

SEQ ID NO: 4107807 - DNA, 12 bp, Homo sapiens
ctctccccacac

SEQ ID NO: 4107808 - DNA, 13 bp, Homo sapiens
ctctccccagccc

SEQ ID NO: 4107809 - DNA, 16 bp, Homo sapiens
ctctcccctccagcct

SEQ ID NO: 4107810 - DNA, 18 bp, Homo sapiens
ctctcccctccagccttt

SEQ ID NO: 4107811 - DNA, 15 bp, Homo sapiens
ctctcccctgacctg

SEQ ID NO: 4107812 - DNA, 17 bp, Homo sapiens
ctctcccgcaccaggcc

SEQ ID NO: 4107813 - DNA, 23 bp, Homo sapiens
ctctcccggaggttgggtgggcc

SEQ ID NO: 4107814 - DNA, 23 bp, Homo sapiens
ctctccctcaacaagggagagac

SEQ ID NO: 4107815 - DNA, 13 bp, Homo sapiens
ctctccctcccct

SEQ ID NO: 4107816 - DNA, 16 bp, Homo sapiens
ctctccctgccagagg

SEQ ID NO: 4107817 - DNA, 12 bp, Homo sapiens
ctctccctgttg

SEQ ID NO: 4107818 - DNA, 11 bp, Homo sapiens
ctctcctcccc

SEQ ID NO: 4107819 - DNA, 15 bp, Homo sapiens
ctctcctctggctag

SEQ ID NO: 4107820 - DNA, 13 bp, Homo sapiens
ctctcctgccctg

SEQ ID NO: 4107821 - DNA, 17 bp, Homo sapiens
ctctcctggctgggcca

SEQ ID NO: 4107822 - DNA, 22 bp, Homo sapiens
ctctcctgtataaccccacctt

SEQ ID NO: 4107823 - DNA, 15 bp, Homo sapiens
ctctccttgcccccc

SEQ ID NO: 4107824 - DNA, 22 bp, Homo sapiens
ctctccttttgaggcttctcct

SEQ ID NO: 4107825 - DNA, 23 bp, Homo sapiens
ctctccttttgaggcttctcctt

SEQ ID NO: 4107826 - DNA, 16 bp, Homo sapiens
ctctcggctccccatg

SEQ ID NO: 4107827 - DNA, 15 bp, Homo sapiens
ctctctacagtgcca

SEQ ID NO: 4107828 - DNA, 18 bp, Homo sapiens
ctctctagctttgtcata

SEQ ID NO: 4107829 - DNA, 19 bp, Homo sapiens
ctctctaggcctctccagt

SEQ ID NO: 4107830 - DNA, 13 bp, Homo sapiens
ctctctattgtca

SEQ ID NO: 4107831 - DNA, 21 bp, Homo sapiens
ctctctatttccccctttctt

SEQ ID NO: 4107832 - DNA, 17 bp, Homo sapiens
ctctctcagagcatctg

SEQ ID NO: 4107833 - DNA, 21 bp, Homo sapiens
ctctctcagagcatctggctg

SEQ ID NO: 4107834 - DNA, 22 bp, Homo sapiens
ctctctcagagcatctggctgt

SEQ ID NO: 4107835 - DNA, 23 bp, Homo sapiens
ctctctcagagcatctggctgtt

SEQ ID NO: 4107836 - DNA, 13 bp, Homo sapiens
ctctctcagcaca

SEQ ID NO: 4107837 - DNA, 14 bp, Homo sapiens
ctctctcagcacag

SEQ ID NO: 4107838 - DNA, 17 bp, Homo sapiens
ctctctcccatttcagg

SEQ ID NO: 4107839 - DNA, 12 bp, Homo sapiens
ctctctctgggc

SEQ ID NO: 4107840 - DNA, 12 bp, Homo sapiens
ctctctcttctg

SEQ ID NO: 4107841 - DNA, 18 bp, Homo sapiens
ctctctcttctgctccac

SEQ ID NO: 4107842 - DNA, 16 bp, Homo sapiens
ctctctgagactcttt

SEQ ID NO: 4107843 - DNA, 15 bp, Homo sapiens
ctctctgagactgct

SEQ ID NO: 4107844 - DNA, 23 bp, Homo sapiens
ctctctgatcttgtgctcagcat

SEQ ID NO: 4107845 - DNA, 19 bp, Homo sapiens
ctctctgatgtcccagtgc

SEQ ID NO: 4107846 - DNA, 14 bp, Homo sapiens
ctctctgcagctgc

SEQ ID NO: 4107847 - DNA, 13 bp, Homo sapiens
ctctctgccccac

SEQ ID NO: 4107848 - DNA, 12 bp, Homo sapiens
ctctctgccctg

SEQ ID NO: 4107849 - DNA, 14 bp, Homo sapiens
ctctctgccctgtg

SEQ ID NO: 4107850 - DNA, 15 bp, Homo sapiens
ctctctgccctgtgt

SEQ ID NO: 4107851 - DNA, 17 bp, Homo sapiens
ctctctgggacctcctt

SEQ ID NO: 4107852 - DNA, 20 bp, Homo sapiens
ctctctgggcccaggggctg

SEQ ID NO: 4107853 - DNA, 22 bp, Homo sapiens
ctctctggggccctgggcctca

SEQ ID NO: 4107854 - DNA, 18 bp, Homo sapiens
ctctctgtcccttgctgt

SEQ ID NO: 4107855 - DNA, 16 bp, Homo sapiens
ctctctgtgaatacaa

SEQ ID NO: 4107856 - DNA, 19 bp, Homo sapiens
ctctcttatagaatattta

SEQ ID NO: 4107857 - DNA, 19 bp, Homo sapiens
ctctcttccccttccctta

SEQ ID NO: 4107858 - DNA, 15 bp, Homo sapiens
ctctcttccctttcc

SEQ ID NO: 4107859 - DNA, 22 bp, Homo sapiens
ctctcttccctttccccagcat

SEQ ID NO: 4107860 - DNA, 17 bp, Homo sapiens
ctctcttctgctccacc

SEQ ID NO: 4107861 - DNA, 17 bp, Homo sapiens
ctctctttatacagctg

SEQ ID NO: 4107862 - DNA, 13 bp, Homo sapiens
ctctcttttcctg

SEQ ID NO: 4107863 - DNA, 14 bp, Homo sapiens
ctctgaacacaggc

SEQ ID NO: 4107864 - DNA, 15 bp, Homo sapiens
ctctgaacacaggca

SEQ ID NO: 4107865 - DNA, 16 bp, Homo sapiens
ctctgaacacaggcag

SEQ ID NO: 4107866 - DNA, 17 bp, Homo sapiens
ctctgaacacaggcagc

SEQ ID NO: 4107867 - DNA, 20 bp, Homo sapiens
ctctgaacacaggcagcttt

SEQ ID NO: 4107868 - DNA, 15 bp, Homo sapiens
ctctgaagcctctgg

SEQ ID NO: 4107869 - DNA, 17 bp, Homo sapiens
ctctgaagcctctggga

SEQ ID NO: 4107870 - DNA, 15 bp, Homo sapiens
ctctgacctgcactg

SEQ ID NO: 4107871 - DNA, 23 bp, Homo sapiens
ctctgactcatccccacagctgg

SEQ ID NO: 4107872 - DNA, 15 bp, Homo sapiens
ctctgactctgagtc

SEQ ID NO: 4107873 - DNA, 20 bp, Homo sapiens
ctctgagacccttttctcag

SEQ ID NO: 4107874 - DNA, 18 bp, Homo sapiens
ctccgcatcacctcacca

SEQ ID NO: 4107875 - DNA, 20 bp, Homo sapiens
ctccgcatcacctcaccaag

SEQ ID NO: 4107876 - DNA, 13 bp, Homo sapiens
ctccgccagcctc

SEQ ID NO: 4107877 - DNA, 15 bp, Homo sapiens
ctccgccagcctcct

SEQ ID NO: 4107878 - DNA, 13 bp, Homo sapiens
ctccgcccctgcc

SEQ ID NO: 4107879 - DNA, 16 bp, Homo sapiens
ctccgccctcctcggg

SEQ ID NO: 4107880 - DNA, 14 bp, Homo sapiens
ctccggactggtgc

SEQ ID NO: 4107881 - DNA, 15 bp, Homo sapiens
ctccgggtcttccta

SEQ ID NO: 4107882 - DNA, 19 bp, Homo sapiens
ctccgggtgtggcctcagc

SEQ ID NO: 4107883 - DNA, 21 bp, Homo sapiens
ctccgggtgtggcctcagccc

SEQ ID NO: 4107884 - DNA, 22 bp, Homo sapiens
ctccgggtgtggcctcagccct

SEQ ID NO: 4107885 - DNA, 17 bp, Homo sapiens
ctccgtagggtctttct

SEQ ID NO: 4107886 - DNA, 21 bp, Homo sapiens
ctccgtagggtctttcttggg

SEQ ID NO: 4107887 - DNA, 22 bp, Homo sapiens
ctccgtccagccgccattgcca

SEQ ID NO: 4107888 - DNA, 21 bp, Homo sapiens
ctccgtgatccatccatctcc

SEQ ID NO: 4107889 - DNA, 19 bp, Homo sapiens
ctccgttccatctgggctt

SEQ ID NO: 4107890 - DNA, 16 bp, Homo sapiens
ctcctacctctgtgcc

SEQ ID NO: 4107891 - DNA, 17 bp, Homo sapiens
ctcctacctgccctgga

SEQ ID NO: 4107892 - DNA, 14 bp, Homo sapiens
ctcctactcctgac

SEQ ID NO: 4107893 - DNA, 17 bp, Homo sapiens
ctcctagacccaggtgg

SEQ ID NO: 4107894 - DNA, 21 bp, Homo sapiens
ctcctagagaacgcagcccta

SEQ ID NO: 4107895 - DNA, 13 bp, Homo sapiens
ctcctaggagagc

SEQ ID NO: 4107896 - DNA, 19 bp, Homo sapiens
ctcctaggagagccaacct

SEQ ID NO: 4107897 - DNA, 23 bp, Homo sapiens
ctcctaggagagccaacctcggc

SEQ ID NO: 4107898 - DNA, 21 bp, Homo sapiens
ctcctaggggaacagaccagt

SEQ ID NO: 4107899 - DNA, 15 bp, Homo sapiens
ctcctcacacaccct

SEQ ID NO: 4107900 - DNA, 19 bp, Homo sapiens
ctcctcacacaccctgagg

SEQ ID NO: 4107901 - DNA, 15 bp, Homo sapiens
ctcctcacctcatgc

SEQ ID NO: 4107902 - DNA, 19 bp, Homo sapiens
ctcctcacctcatgcccac

SEQ ID NO: 4107903 - DNA, 13 bp, Homo sapiens
ctcctcacctctg

SEQ ID NO: 4107904 - DNA, 14 bp, Homo sapiens
ctcctcacctctgg

SEQ ID NO: 4107905 - DNA, 21 bp, Homo sapiens
ctcctcacctctggactggct

SEQ ID NO: 4107906 - DNA, 12 bp, Homo sapiens
ctcctcacctgt

SEQ ID NO: 4107907 - DNA, 15 bp, Homo sapiens
ctcctcacctgtcta

SEQ ID NO: 4107908 - DNA, 23 bp, Homo sapiens
ctcctcaggcacacagctactct

SEQ ID NO: 4107909 - DNA, 14 bp, Homo sapiens
ctcctcagggtggg

SEQ ID NO: 4107910 - DNA, 15 bp, Homo sapiens
ctcctcagggtgggg

SEQ ID NO: 4107911 - DNA, 16 bp, Homo sapiens
ctcctcagggtggggg

SEQ ID NO: 4107912 - DNA, 11 bp, Homo sapiens
ctcctcatgta

SEQ ID NO: 4107913 - DNA, 18 bp, Homo sapiens
ctcctccaaaggccccct

SEQ ID NO: 4107914 - DNA, 21 bp, Homo sapiens
ctcctccaggcctgcctccca

SEQ ID NO: 4107915 - DNA, 13 bp, Homo sapiens
ctcctccagggtg

SEQ ID NO: 4107916 - DNA, 21 bp, Homo sapiens
ctcctccagggtgattttatg

SEQ ID NO: 4107917 - DNA, 23 bp, Homo sapiens
ctcctccagtgtgggcttgacca

SEQ ID NO: 4107918 - DNA, 22 bp, Homo sapiens
ctcctcccaggcgccccttccc

SEQ ID NO: 4107919 - DNA, 14 bp, Homo sapiens
ctcctcccttcctt

SEQ ID NO: 4107920 - DNA, 18 bp, Homo sapiens
ctcctcctcttcaccagg

SEQ ID NO: 4107921 - DNA, 14 bp, Homo sapiens
ctcctccttcctag

SEQ ID NO: 4107922 - DNA, 13 bp, Homo sapiens
ctcctccttgccc

SEQ ID NO: 4107923 - DNA, 19 bp, Homo sapiens
ctcctcggagagcagcagc

SEQ ID NO: 4107924 - DNA, 21 bp, Homo sapiens
ctcctcggagagcagcagcac

SEQ ID NO: 4107925 - DNA, 23 bp, Homo sapiens
ctcctcggagagcagcagcacca

SEQ ID NO: 4107926 - DNA, 15 bp, Homo sapiens
ctcctcgggccgagg

SEQ ID NO: 4107927 - DNA, 19 bp, Homo sapiens
ctcctctagctgtgggggt

SEQ ID NO: 4107928 - DNA, 17 bp, Homo sapiens
ctcctctatcctgggct

SEQ ID NO: 4107929 - DNA, 20 bp, Homo sapiens
ctcctctccccagcccagag

SEQ ID NO: 4107930 - DNA, 11 bp, Homo sapiens
ctcctctctga

SEQ ID NO: 4107931 - DNA, 12 bp, Homo sapiens
ctcctctctggg

SEQ ID NO: 4107932 - DNA, 16 bp, Homo sapiens
ctcctctctgggcctt

SEQ ID NO: 4107933 - DNA, 22 bp, Homo sapiens
ctcctctgcctacagccaggtt

SEQ ID NO: 4107934 - DNA, 12 bp, Homo sapiens
ctcctctggcta

SEQ ID NO: 4107935 - DNA, 22 bp, Homo sapiens
ctcctctggctttcccaggaga

SEQ ID NO: 4107936 - DNA, 17 bp, Homo sapiens
ctcctcttcaccaggtg

SEQ ID NO: 4107937 - DNA, 23 bp, Homo sapiens
ctcctcttcaccaggtgcatgca

SEQ ID NO: 4107938 - DNA, 17 bp, Homo sapiens
ctcctcttgattcctgg

SEQ ID NO: 4107939 - DNA, 22 bp, Homo sapiens
ctcctgaggggcatctgcccct

SEQ ID NO: 4107940 - DNA, 23 bp, Homo sapiens
ctcctgaggggcatctgcccctc

SEQ ID NO: 4107941 - DNA, 14 bp, Homo sapiens
ctcctgcagcatgg

SEQ ID NO: 4107942 - DNA, 22 bp, Homo sapiens
ctcctgccacatggagccccct

SEQ ID NO: 4107943 - DNA, 15 bp, Homo sapiens
ctcctgccaggcaca

SEQ ID NO: 4107944 - DNA, 22 bp, Homo sapiens
ctcctgccaggcacacacagcc

SEQ ID NO: 4107945 - DNA, 23 bp, Homo sapiens
ctcctgccaggcacacacagccc

SEQ ID NO: 4107946 - DNA, 12 bp, Homo sapiens
ctcctgcccaga

SEQ ID NO: 4107947 - DNA, 17 bp, Homo sapiens
ctcctgccccacactcc

SEQ ID NO: 4107948 - DNA, 12 bp, Homo sapiens
ctcctgcccctt

SEQ ID NO: 4107949 - DNA, 21 bp, Homo sapiens
ctcctgcccctttcaggccta

SEQ ID NO: 4107950 - DNA, 13 bp, Homo sapiens
ctcctgccctgtg

SEQ ID NO: 4107951 - DNA, 14 bp, Homo sapiens
ctcctgctgccaca

SEQ ID NO: 4107952 - DNA, 14 bp, Homo sapiens
ctcctgctgccagt

SEQ ID NO: 4107953 - DNA, 20 bp, Homo sapiens
ctcctgcttttctgtcctgg

SEQ ID NO: 4107954 - DNA, 21 bp, Homo sapiens
ctcctgcttttctgtcctggg

SEQ ID NO: 4107955 - DNA, 23 bp, Homo sapiens
ctcctgcttttctgtcctgggca

SEQ ID NO: 4107956 - DNA, 14 bp, Homo sapiens
ctcctggaaatatt

SEQ ID NO: 4107957 - DNA, 22 bp, Homo sapiens
ctcctggaacagaagacagctg

SEQ ID NO: 4107958 - DNA, 16 bp, Homo sapiens
ctcctggaaccaatcc

SEQ ID NO: 4107959 - DNA, 21 bp, Homo sapiens
ctcctggaaccttgctgtcct

SEQ ID NO: 4107960 - DNA, 20 bp, Homo sapiens
ctcctggacacattggaatg

SEQ ID NO: 4107961 - DNA, 12 bp, Homo sapiens
ctcctggagcct

SEQ ID NO: 4107962 - DNA, 13 bp, Homo sapiens
ctcctggcctttt

SEQ ID NO: 4107963 - DNA, 22 bp, Homo sapiens
ctcctggctcttgatacccccc

SEQ ID NO: 4107964 - DNA, 19 bp, Homo sapiens
ctcctggctgggccatcct

SEQ ID NO: 4107965 - DNA, 17 bp, Homo sapiens
ctcctgggaagatgagg

SEQ ID NO: 4107966 - DNA, 20 bp, Homo sapiens
ctcctgggaagatgaggttc

SEQ ID NO: 4107967 - DNA, 15 bp, Homo sapiens
ctcctgggggtggca

SEQ ID NO: 4107968 - DNA, 16 bp, Homo sapiens
ctcctgggggtggcag

SEQ ID NO: 4107969 - DNA, 17 bp, Homo sapiens
ctcctgggggtggcagg

SEQ ID NO: 4107970 - DNA, 18 bp, Homo sapiens
ctcctgggggtggcaggc

SEQ ID NO: 4107971 - DNA, 17 bp, Homo sapiens
ctcctgtcccttttccc

SEQ ID NO: 4107972 - DNA, 20 bp, Homo sapiens
ctcctgtcccttttccctta

SEQ ID NO: 4107973 - DNA, 20 bp, Homo sapiens
ctcctgtcctcccatcccct

SEQ ID NO: 4107974 - DNA, 21 bp, Homo sapiens
ctcctgtcctcccatcccctg

SEQ ID NO: 4107975 - DNA, 18 bp, Homo sapiens
ctcctgtcttatggtcca

SEQ ID NO: 4107976 - DNA, 19 bp, Homo sapiens
ctcctgtcttatggtccag

SEQ ID NO: 4107977 - DNA, 11 bp, Homo sapiens
ctccccaggga

SEQ ID NO: 4107978 - DNA, 18 bp, Homo sapiens
ctccccagggagctctgg

SEQ ID NO: 4107979 - DNA, 16 bp, Homo sapiens
ctccccatctgtccag

SEQ ID NO: 4107980 - DNA, 18 bp, Homo sapiens
ctccccatttcccatctg

SEQ ID NO: 4107981 - DNA, 21 bp, Homo sapiens
ctcccccaggctgttctccag

SEQ ID NO: 4107982 - DNA, 13 bp, Homo sapiens
ctcccccatccta

SEQ ID NO: 4107983 - DNA, 14 bp, Homo sapiens
ctccccccagtggg

SEQ ID NO: 4107984 - DNA, 18 bp, Homo sapiens
ctcccccccatgcactgt

SEQ ID NO: 4107985 - DNA, 20 bp, Homo sapiens
ctcccccccatgcactgtga

SEQ ID NO: 4107986 - DNA, 14 bp, Homo sapiens
ctcccccgccactc

SEQ ID NO: 4107987 - DNA, 15 bp, Homo sapiens
ctcccccgccactcc

SEQ ID NO: 4107988 - DNA, 13 bp, Homo sapiens
ctccccctcaacc

SEQ ID NO: 4107989 - DNA, 19 bp, Homo sapiens
ctccccctcaacctcacca

SEQ ID NO: 4107990 - DNA, 14 bp, Homo sapiens
ctccccctcagatg

SEQ ID NO: 4107991 - DNA, 15 bp, Homo sapiens
ctccccctccccagg

SEQ ID NO: 4107992 - DNA, 15 bp, Homo sapiens
ctcccccttttccct

SEQ ID NO: 4107993 - DNA, 20 bp, Homo sapiens
ctccccgcagtgtttgtgtg

SEQ ID NO: 4107994 - DNA, 14 bp, Homo sapiens
ctccccgcccctgt

SEQ ID NO: 4107995 - DNA, 15 bp, Homo sapiens
ctccccgcccctgtg

SEQ ID NO: 4107996 - DNA, 19 bp, Homo sapiens
ctccccgccttagagcctc

SEQ ID NO: 4107997 - DNA, 20 bp, Homo sapiens
ctccccgccttagagcctcg

SEQ ID NO: 4107998 - DNA, 20 bp, Homo sapiens
ctcccctaacctcttttctg

SEQ ID NO: 4107999 - DNA, 14 bp, Homo sapiens
ctcccctccagcct

SEQ ID NO: 4108000 - DNA, 17 bp, Homo sapiens
ctcccctgacctgtgag

SEQ ID NO: 4108001 - DNA, 14 bp, Homo sapiens
ctcccctgccattt

SEQ ID NO: 4108002 - DNA, 12 bp, Homo sapiens
ctcccctgccct

SEQ ID NO: 4108003 - DNA, 14 bp, Homo sapiens
ctcccctgccctgg

SEQ ID NO: 4108004 - DNA, 14 bp, Homo sapiens
ctcccctgtgccag

SEQ ID NO: 4108005 - DNA, 23 bp, Homo sapiens
ctcccctgtgccagcccagaggc

SEQ ID NO: 4108006 - DNA, 18 bp, Homo sapiens
ctccccttcccagggcaa

SEQ ID NO: 4108007 - DNA, 12 bp, Homo sapiens
ctccccttcccc

SEQ ID NO: 4108008 - DNA, 22 bp, Homo sapiens
ctcccgagcaatggcgcctgct

SEQ ID NO: 4108009 - DNA, 15 bp, Homo sapiens
ctcccgcccttccat

SEQ ID NO: 4108010 - DNA, 22 bp, Homo sapiens
ctcccgcccttccatgtgcctt

SEQ ID NO: 4108011 - DNA, 21 bp, Homo sapiens
ctcccgcctcagggccaggcc

SEQ ID NO: 4108012 - DNA, 17 bp, Homo sapiens
ctcccgctccgggctcc

SEQ ID NO: 4108013 - DNA, 15 bp, Homo sapiens
ctcccgctgctgctg

SEQ ID NO: 4108014 - DNA, 16 bp, Homo sapiens
ctcccgctgctgctgc

SEQ ID NO: 4108015 - DNA, 20 bp, Homo sapiens
ctcccggagagggagtcagt

SEQ ID NO: 4108016 - DNA, 18 bp, Homo sapiens
ctcccggagcctgtgcag

SEQ ID NO: 4108017 - DNA, 14 bp, Homo sapiens
ctccctacacacac

SEQ ID NO: 4108018 - DNA, 18 bp, Homo sapiens
ctccctaccccagggccc

SEQ ID NO: 4108019 - DNA, 20 bp, Homo sapiens
ctccctaccccagggccctg

SEQ ID NO: 4108020 - DNA, 15 bp, Homo sapiens
ctccctagactgcat

SEQ ID NO: 4108021 - DNA, 13 bp, Homo sapiens
ctccctatctcct

SEQ ID NO: 4108022 - DNA, 15 bp, Homo sapiens
ctccctatctccttc

SEQ ID NO: 4108023 - DNA, 16 bp, Homo sapiens
ctccctatcttgtgaa

SEQ ID NO: 4108024 - DNA, 11 bp, Homo sapiens
ctccctcagcc

SEQ ID NO: 4108025 - DNA, 14 bp, Homo sapiens
ctccctcagcctca

SEQ ID NO: 4108026 - DNA, 16 bp, Homo sapiens
ctccctcagcctcaga

SEQ ID NO: 4108027 - DNA, 17 bp, Homo sapiens
ctccctcagcctcagag

SEQ ID NO: 4108028 - DNA, 16 bp, Homo sapiens
ctccctcaggctctgt

SEQ ID NO: 4108029 - DNA, 14 bp, Homo sapiens
ctccctcatggctc

SEQ ID NO: 4108030 - DNA, 19 bp, Homo sapiens
ctccctcatggctctggca

SEQ ID NO: 4108031 - DNA, 22 bp, Homo sapiens
ctccctccagaatggaactcaa

SEQ ID NO: 4108032 - DNA, 16 bp, Homo sapiens
ctccctccccgtctca

SEQ ID NO: 4108033 - DNA, 18 bp, Homo sapiens
ctccctcccctgccattt

SEQ ID NO: 4108034 - DNA, 20 bp, Homo sapiens
ctccctccgggtcttcctac

SEQ ID NO: 4108035 - DNA, 17 bp, Homo sapiens
ctccctcctcacctctg

SEQ ID NO: 4108036 - DNA, 18 bp, Homo sapiens
ctccctcctcacctctgg

SEQ ID NO: 4108037 - DNA, 19 bp, Homo sapiens
ctccctcctcacctctgga

SEQ ID NO: 4108038 - DNA, 21 bp, Homo sapiens
ctccctcctcacctctggact

SEQ ID NO: 4108039 - DNA, 16 bp, Homo sapiens
ctccctcctccaggcc

SEQ ID NO: 4108040 - DNA, 16 bp, Homo sapiens
ctccctccttctcctt

SEQ ID NO: 4108041 - DNA, 22 bp, Homo sapiens
ctccctccttgggtcattgacc

SEQ ID NO: 4108042 - DNA, 14 bp, Homo sapiens
ctccctctatttat

SEQ ID NO: 4108043 - DNA, 20 bp, Homo sapiens
ctccctctctcttctgctcc

SEQ ID NO: 4108044 - DNA, 14 bp, Homo sapiens
ctccctctgccttc

SEQ ID NO: 4108045 - DNA, 22 bp, Homo sapiens
ctccctctgccttcaggcttct

SEQ ID NO: 4108046 - DNA, 23 bp, Homo sapiens
ctccctgaaaatgtttttctgcc

SEQ ID NO: 4108047 - DNA, 17 bp, Homo sapiens
ctccctgactccctgtg

SEQ ID NO: 4108048 - DNA, 18 bp, Homo sapiens
ctccctgactccctgtgg

SEQ ID NO: 4108049 - DNA, 19 bp, Homo sapiens
ctccctgccagaggggaag

SEQ ID NO: 4108050 - DNA, 12 bp, Homo sapiens
ctccctgccagt

SEQ ID NO: 4108051 - DNA, 17 bp, Homo sapiens
ctccctgcccctccctt

SEQ ID NO: 4108052 - DNA, 15 bp, Homo sapiens
ctccctgcctggccc

SEQ ID NO: 4108053 - DNA, 20 bp, Homo sapiens
ctccctgcgggccaggcact

SEQ ID NO: 4108054 - DNA, 23 bp, Homo sapiens
ctccctgctgtgccatgctgggc

SEQ ID NO: 4108055 - DNA, 19 bp, Homo sapiens
ctccctgctttggctgagg

SEQ ID NO: 4108056 - DNA, 22 bp, Homo sapiens
ctccctggagtgtggctgagga

SEQ ID NO: 4108057 - DNA, 12 bp, Homo sapiens
ctccctggctcc

SEQ ID NO: 4108058 - DNA, 18 bp, Homo sapiens
ctccctgtatcaccccct

SEQ ID NO: 4108059 - DNA, 14 bp, Homo sapiens
ctccctgtctccag

SEQ ID NO: 4108060 - DNA, 17 bp, Homo sapiens
ctccctgtctccagctg

SEQ ID NO: 4108061 - DNA, 18 bp, Homo sapiens
ctccctgtctccagctgc

SEQ ID NO: 4108062 - DNA, 19 bp, Homo sapiens
ctccctgtctccagctgcc

SEQ ID NO: 4108063 - DNA, 20 bp, Homo sapiens
ctccctgtctccagctgcct

SEQ ID NO: 4108064 - DNA, 23 bp, Homo sapiens
ctccctgtctccagctgcctggg

SEQ ID NO: 4108065 - DNA, 17 bp, Homo sapiens
ctccctgtgggggtggc

SEQ ID NO: 4108066 - DNA, 23 bp, Homo sapiens
ctccctgtgggggtggccatccc

SEQ ID NO: 4108067 - DNA, 16 bp, Homo sapiens
ctccctgttccccaga

SEQ ID NO: 4108068 - DNA, 17 bp, Homo sapiens
ctccctgttccccagag

SEQ ID NO: 4108069 - DNA, 12 bp, Homo sapiens
ctcccttcaacc

SEQ ID NO: 4108070 - DNA, 22 bp, Homo sapiens
ctcccttcaaccattccccatg

SEQ ID NO: 4108071 - DNA, 23 bp, Homo sapiens
ctcccttcaaccattccccatgg

SEQ ID NO: 4108072 - DNA, 13 bp, Homo sapiens
ctcccttcagccc

SEQ ID NO: 4108073 - DNA, 12 bp, Homo sapiens
ctcccttccttt

SEQ ID NO: 4108074 - DNA, 14 bp, Homo sapiens
ctcccttctgttga

SEQ ID NO: 4108075 - DNA, 14 bp, Homo sapiens
ctcccttgggctgg

SEQ ID NO: 4108076 - DNA, 17 bp, Homo sapiens
ctcccttgggttctgat

SEQ ID NO: 4108077 - DNA, 20 bp, Homo sapiens
ctcccttggtggcaagagcc

SEQ ID NO: 4108078 - DNA, 17 bp, Homo sapiens
ctccctttctcaggagc

SEQ ID NO: 4108079 - DNA, 22 bp, Homo sapiens
ctccgaactgttcaagtgtccc

SEQ ID NO: 4108080 - DNA, 16 bp, Homo sapiens
ctccgaccctcatggc

SEQ ID NO: 4108081 - DNA, 23 bp, Homo sapiens
ctgacacactaaccaagctgagt

SEQ ID NO: 4108082 - DNA, 17 bp, Homo sapiens
ctgacaccccctccccg

SEQ ID NO: 4108083 - DNA, 18 bp, Homo sapiens
ctgacagatgtcagccga

SEQ ID NO: 4108084 - DNA, 12 bp, Homo sapiens
ctgacagcctcc

SEQ ID NO: 4108085 - DNA, 14 bp, Homo sapiens
ctgacagcctccca

SEQ ID NO: 4108086 - DNA, 20 bp, Homo sapiens
ctgacatattatgcctgaat

SEQ ID NO: 4108087 - DNA, 14 bp, Homo sapiens
ctgacattaacagt

SEQ ID NO: 4108088 - DNA, 17 bp, Homo sapiens
ctgaccaattgtgctgc

SEQ ID NO: 4108089 - DNA, 21 bp, Homo sapiens
ctgaccaattgtgctgccatt

SEQ ID NO: 4108090 - DNA, 12 bp, Homo sapiens
ctgaccacagca

SEQ ID NO: 4108091 - DNA, 13 bp, Homo sapiens
ctgaccagaacta

SEQ ID NO: 4108092 - DNA, 21 bp, Homo sapiens
ctgaccaggcttcttcctaca

SEQ ID NO: 4108093 - DNA, 19 bp, Homo sapiens
ctgaccatccactctaccc

SEQ ID NO: 4108094 - DNA, 23 bp, Homo sapiens
ctgaccatccactctaccctccc

SEQ ID NO: 4108095 - DNA, 20 bp, Homo sapiens
ctgaccccaaagagcctgga

SEQ ID NO: 4108096 - DNA, 21 bp, Homo sapiens
ctgaccccagtggtatcctgt

SEQ ID NO: 4108097 - DNA, 16 bp, Homo sapiens
ctgaccccattcctga

SEQ ID NO: 4108098 - DNA, 22 bp, Homo sapiens
ctgaccccgagaagtgctcttg

SEQ ID NO: 4108099 - DNA, 15 bp, Homo sapiens
ctgacccctctggtg

SEQ ID NO: 4108100 - DNA, 14 bp, Homo sapiens
ctgaccccttgctc

SEQ ID NO: 4108101 - DNA, 22 bp, Homo sapiens
ctgacccggcctctctgcccca

SEQ ID NO: 4108102 - DNA, 14 bp, Homo sapiens
ctgacccttgggcc

SEQ ID NO: 4108103 - DNA, 20 bp, Homo sapiens
ctgacccttgggcctgggcc

SEQ ID NO: 4108104 - DNA, 21 bp, Homo sapiens
ctgacctccctctaatttatc

SEQ ID NO: 4108105 - DNA, 15 bp, Homo sapiens
ctgacctcttgctgt

SEQ ID NO: 4108106 - DNA, 17 bp, Homo sapiens
ctgacctcttgctgtct

SEQ ID NO: 4108107 - DNA, 23 bp, Homo sapiens
ctgacctcttgctgtctctgctc

SEQ ID NO: 4108108 - DNA, 17 bp, Homo sapiens
ctgacctgtgagcccag

SEQ ID NO: 4108109 - DNA, 12 bp, Homo sapiens
ctgacgattctt

SEQ ID NO: 4108110 - DNA, 15 bp, Homo sapiens
ctgacggccagggag

SEQ ID NO: 4108111 - DNA, 21 bp, Homo sapiens
ctgacgtctgaagcttgactc

SEQ ID NO: 4108112 - DNA, 22 bp, Homo sapiens
ctgacgtctgaagcttgactcc

SEQ ID NO: 4108113 - DNA, 18 bp, Homo sapiens
ctgactcaacatgttact

SEQ ID NO: 4108114 - DNA, 17 bp, Homo sapiens
ctgactcaattatttgc

SEQ ID NO: 4108115 - DNA, 17 bp, Homo sapiens
ctgactcccccagtccc

SEQ ID NO: 4108116 - DNA, 14 bp, Homo sapiens
ctgactccctgtgg

SEQ ID NO: 4108117 - DNA, 21 bp, Homo sapiens
ctgactccctgtgggggtggc

SEQ ID NO: 4108118 - DNA, 18 bp, Homo sapiens
ctgactcctacctgccct

SEQ ID NO: 4108119 - DNA, 20 bp, Homo sapiens
ctgactcctacctgccctgg

SEQ ID NO: 4108120 - DNA, 19 bp, Homo sapiens
ctgactcctctaagccact

SEQ ID NO: 4108121 - DNA, 12 bp, Homo sapiens
ctgactctgccc

SEQ ID NO: 4108122 - DNA, 21 bp, Homo sapiens
ctgactgaaagtagggggctt

SEQ ID NO: 4108123 - DNA, 13 bp, Homo sapiens
ctgactgctcaga

SEQ ID NO: 4108124 - DNA, 16 bp, Homo sapiens
ctgactggccaaaccc

SEQ ID NO: 4108125 - DNA, 15 bp, Homo sapiens
ctgactgggccaggg

SEQ ID NO: 4108126 - DNA, 13 bp, Homo sapiens
ctgactgggctgg

SEQ ID NO: 4108127 - DNA, 21 bp, Homo sapiens
ctgactgtcctctcccctcca

SEQ ID NO: 4108128 - DNA, 21 bp, Homo sapiens
ctgactgtcgggctttaaaaa

SEQ ID NO: 4108129 - DNA, 13 bp, Homo sapiens
ctgacttcatctg

SEQ ID NO: 4108130 - DNA, 18 bp, Homo sapiens
ctgacttctaatatcatt

SEQ ID NO: 4108131 - DNA, 21 bp, Homo sapiens
ctgacttgagtgttccttttt

SEQ ID NO: 4108132 - DNA, 15 bp, Homo sapiens
ctgacttgtttgtct

SEQ ID NO: 4108133 - DNA, 17 bp, Homo sapiens
ctgacttgtttgtcttc

SEQ ID NO: 4108134 - DNA, 14 bp, Homo sapiens
ctgactttgcttgc

SEQ ID NO: 4108135 - DNA, 15 bp, Homo sapiens
ctgactttgcttgct

SEQ ID NO: 4108136 - DNA, 15 bp, Homo sapiens
ctgactttttgtttc

SEQ ID NO: 4108137 - DNA, 13 bp, Homo sapiens
ctgagaactcctg

SEQ ID NO: 4108138 - DNA, 14 bp, Homo sapiens
ctgagaactcctga

SEQ ID NO: 4108139 - DNA, 15 bp, Homo sapiens
ctgagaactcctgac

SEQ ID NO: 4108140 - DNA, 23 bp, Homo sapiens
ctgagaagctgctccaggcctgc

SEQ ID NO: 4108141 - DNA, 15 bp, Homo sapiens
ctgagaattccaagg

SEQ ID NO: 4108142 - DNA, 17 bp, Homo sapiens
ctgagaccactgagtac

SEQ ID NO: 4108143 - DNA, 19 bp, Homo sapiens
ctgagaccagttgggagca

SEQ ID NO: 4108144 - DNA, 23 bp, Homo sapiens
ctgagaccagttgggagcactgg

SEQ ID NO: 4108145 - DNA, 12 bp, Homo sapiens
ctgagactcaca

SEQ ID NO: 4108146 - DNA, 19 bp, Homo sapiens
ctgagactcacaggaagga

SEQ ID NO: 4108147 - DNA, 18 bp, Homo sapiens
ctgagactctttagagca

SEQ ID NO: 4108148 - DNA, 19 bp, Homo sapiens
ctgagactctttagagcag

SEQ ID NO: 4108149 - DNA, 20 bp, Homo sapiens
ctgagactgtcggagaggct

SEQ ID NO: 4108150 - DNA, 13 bp, Homo sapiens
ctgagaggcaggc

SEQ ID NO: 4108151 - DNA, 15 bp, Homo sapiens
ctgagaggcaggcat

SEQ ID NO: 4108152 - DNA, 16 bp, Homo sapiens
ctgagagggcaaggaa

SEQ ID NO: 4108153 - DNA, 19 bp, Homo sapiens
ctgagagtatttaggcaga

SEQ ID NO: 4108154 - DNA, 14 bp, Homo sapiens
ctgagagtcagctc

SEQ ID NO: 4108155 - DNA, 17 bp, Homo sapiens
ctgagagtcagctctct

SEQ ID NO: 4108156 - DNA, 21 bp, Homo sapiens
ctgagatcccctgagccccag

SEQ ID NO: 4108157 - DNA, 18 bp, Homo sapiens
ctgagatgagaggtagcc

SEQ ID NO: 4108158 - DNA, 19 bp, Homo sapiens
ctgagatgctcactttatt

SEQ ID NO: 4108159 - DNA, 21 bp, Homo sapiens
ctgagatttttttgtgtatgt

SEQ ID NO: 4108160 - DNA, 18 bp, Homo sapiens
ctgagcaacatctcggga

SEQ ID NO: 4108161 - DNA, 16 bp, Homo sapiens
ctgagcaagagctggc

SEQ ID NO: 4108162 - DNA, 20 bp, Homo sapiens
ctgagcaagagctggcaaag

SEQ ID NO: 4108163 - DNA, 22 bp, Homo sapiens
ctgagcaagatcttgtctccac

SEQ ID NO: 4108164 - DNA, 16 bp, Homo sapiens
ctgagcaccctctgga

SEQ ID NO: 4108165 - DNA, 13 bp, Homo sapiens
ctgagcacctgct

SEQ ID NO: 4108166 - DNA, 16 bp, Homo sapiens
ctgagcacctgcttca

SEQ ID NO: 4108167 - DNA, 20 bp, Homo sapiens
ctgagcagccgccagctggg

SEQ ID NO: 4108168 - DNA, 17 bp, Homo sapiens
ctgagcagcctctggac

SEQ ID NO: 4108169 - DNA, 13 bp, Homo sapiens
ctgagcagtgcct

SEQ ID NO: 4108170 - DNA, 15 bp, Homo sapiens
ctgagcagttcccct

SEQ ID NO: 4108171 - DNA, 20 bp, Homo sapiens
ctgagcatactcaacaaaac

SEQ ID NO: 4108172 - DNA, 21 bp, Homo sapiens
ctgagcatgatgggaataggg

SEQ ID NO: 4108173 - DNA, 14 bp, Homo sapiens
ctgagccagcaggg

SEQ ID NO: 4108174 - DNA, 22 bp, Homo sapiens
ctgagccagtgctttaatggca

SEQ ID NO: 4108175 - DNA, 15 bp, Homo sapiens
ctgagcccagctgcc

SEQ ID NO: 4108176 - DNA, 19 bp, Homo sapiens
ctgagcccagctgcctgga

SEQ ID NO: 4108177 - DNA, 21 bp, Homo sapiens
ctgagcccagctgcctggaga

SEQ ID NO: 4108178 - DNA, 22 bp, Homo sapiens
ctgagcccagctgcctggagag

SEQ ID NO: 4108179 - DNA, 11 bp, Homo sapiens
ctgagcccata

SEQ ID NO: 4108180 - DNA, 19 bp, Homo sapiens
ctgagccccagggtgccca

SEQ ID NO: 4108181 - DNA, 22 bp, Homo sapiens
ctgagccccagggtgcccagaa

SEQ ID NO: 4108182 - DNA, 12 bp, Homo sapiens
ctgagccctggg

SEQ ID NO: 4108183 - DNA, 21 bp, Homo sapiens
ctgagccctggggactgttcc

SEQ ID NO: 4108184 - DNA, 18 bp, Homo sapiens
ctcttgtctgagggacat

SEQ ID NO: 4108185 - DNA, 22 bp, Homo sapiens
ctcttgtgatttctttaaaaga

SEQ ID NO: 4108186 - DNA, 21 bp, Homo sapiens
ctctttaagggcatgccttgt

SEQ ID NO: 4108187 - DNA, 15 bp, Homo sapiens
ctctttagtataatt

SEQ ID NO: 4108188 - DNA, 14 bp, Homo sapiens
ctctttatacagct

SEQ ID NO: 4108189 - DNA, 11 bp, Homo sapiens
ctctttcaaag

SEQ ID NO: 4108190 - DNA, 16 bp, Homo sapiens
ctctttcacattgttt

SEQ ID NO: 4108191 - DNA, 11 bp, Homo sapiens
ctctttcagtg

SEQ ID NO: 4108192 - DNA, 17 bp, Homo sapiens
ctctttcccacccagcc

SEQ ID NO: 4108193 - DNA, 18 bp, Homo sapiens
ctctttcccacccagcct

SEQ ID NO: 4108194 - DNA, 13 bp, Homo sapiens
ctctttccctgcg

SEQ ID NO: 4108195 - DNA, 15 bp, Homo sapiens
ctctttccctgcgag

SEQ ID NO: 4108196 - DNA, 19 bp, Homo sapiens
ctctttcctatttcagtgt

SEQ ID NO: 4108197 - DNA, 20 bp, Homo sapiens
ctctttctacatgactgggc

SEQ ID NO: 4108198 - DNA, 17 bp, Homo sapiens
ctctttctctgccagtg

SEQ ID NO: 4108199 - DNA, 18 bp, Homo sapiens
ctctttctctgccagtga

SEQ ID NO: 4108200 - DNA, 23 bp, Homo sapiens
ctctttgacaattcctagataaa

SEQ ID NO: 4108201 - DNA, 12 bp, Homo sapiens
ctctttgctgca

SEQ ID NO: 4108202 - DNA, 13 bp, Homo sapiens
ctctttgctgcag

SEQ ID NO: 4108203 - DNA, 17 bp, Homo sapiens
ctctttggcagttgcat

SEQ ID NO: 4108204 - DNA, 21 bp, Homo sapiens
ctctttggcgacctcctttca

SEQ ID NO: 4108205 - DNA, 19 bp, Homo sapiens
ctctttggggtcagccagg

SEQ ID NO: 4108206 - DNA, 20 bp, Homo sapiens
ctctttggggtcagccaggg

SEQ ID NO: 4108207 - DNA, 16 bp, Homo sapiens
ctcttttagatattgt

SEQ ID NO: 4108208 - DNA, 18 bp, Homo sapiens
ctcttttcccctttcctg

SEQ ID NO: 4108209 - DNA, 20 bp, Homo sapiens
ctcttttcctggtgctcttt

SEQ ID NO: 4108210 - DNA, 14 bp, Homo sapiens
ctcttttctgcatc

SEQ ID NO: 4108211 - DNA, 14 bp, Homo sapiens
ctcttttctttctg

SEQ ID NO: 4108212 - DNA, 21 bp, Homo sapiens
ctcttttgctttattccagaa

SEQ ID NO: 4108213 - DNA, 19 bp, Homo sapiens
ctcttttgttaaataatat

SEQ ID NO: 4108214 - DNA, 20 bp, Homo sapiens
ctctttttagggccaggcag

SEQ ID NO: 4108215 - DNA, 22 bp, Homo sapiens
ctgaaaaaacacctagctttat

SEQ ID NO: 4108216 - DNA, 23 bp, Homo sapiens
ctgaaaactggaataagaagcaa

SEQ ID NO: 4108217 - DNA, 13 bp, Homo sapiens
ctgaaaatataac

SEQ ID NO: 4108218 - DNA, 18 bp, Homo sapiens
ctgaaaatggtattttcc

SEQ ID NO: 4108219 - DNA, 14 bp, Homo sapiens
ctgaaaatgtttaa

SEQ ID NO: 4108220 - DNA, 22 bp, Homo sapiens
ctgaaaatgtttttctgccagg

SEQ ID NO: 4108221 - DNA, 22 bp, Homo sapiens
ctgaaaattccagaaaggatat

SEQ ID NO: 4108222 - DNA, 22 bp, Homo sapiens
ctgaaaccattttcccatcatc

SEQ ID NO: 4108223 - DNA, 22 bp, Homo sapiens
ctgaaacccacagatgtctctg

SEQ ID NO: 4108224 - DNA, 19 bp, Homo sapiens
ctgaaagaaacagttaact

SEQ ID NO: 4108225 - DNA, 13 bp, Homo sapiens
ctgaaagttttgt

SEQ ID NO: 4108226 - DNA, 17 bp, Homo sapiens
ctgaaagttttgtaaaa

SEQ ID NO: 4108227 - DNA, 18 bp, Homo sapiens
ctgaaagttttgtaaaag

SEQ ID NO: 4108228 - DNA, 15 bp, Homo sapiens
ctgaaatgttcttaa

SEQ ID NO: 4108229 - DNA, 19 bp, Homo sapiens
ctgaacaataggctgttcc

SEQ ID NO: 4108230 - DNA, 21 bp, Homo sapiens
ctgaacaataggctgttccca

SEQ ID NO: 4108231 - DNA, 14 bp, Homo sapiens
ctgaacacaggcag

SEQ ID NO: 4108232 - DNA, 16 bp, Homo sapiens
ctgaacacaggcagct

SEQ ID NO: 4108233 - DNA, 19 bp, Homo sapiens
ctgaacacaggcagctttc

SEQ ID NO: 4108234 - DNA, 20 bp, Homo sapiens
ctgaacacttttgttgtaaa

SEQ ID NO: 4108235 - DNA, 13 bp, Homo sapiens
ctgaacagctgta

SEQ ID NO: 4108236 - DNA, 19 bp, Homo sapiens
ctgaaccacctttgtctct

SEQ ID NO: 4108237 - DNA, 12 bp, Homo sapiens
ctgaaccatgtg

SEQ ID NO: 4108238 - DNA, 16 bp, Homo sapiens
ctgaacctgtcttttg

SEQ ID NO: 4108239 - DNA, 13 bp, Homo sapiens
ctgaactccaccg

SEQ ID NO: 4108240 - DNA, 22 bp, Homo sapiens
ctgaactccaccgaccaactgc

SEQ ID NO: 4108241 - DNA, 16 bp, Homo sapiens
ctgaactttggagagt

SEQ ID NO: 4108242 - DNA, 15 bp, Homo sapiens
ctgaagaaccagtcc

SEQ ID NO: 4108243 - DNA, 15 bp, Homo sapiens
ctgaagaattaagat

SEQ ID NO: 4108244 - DNA, 21 bp, Homo sapiens
ctgaagacaattatcaaccac

SEQ ID NO: 4108245 - DNA, 20 bp, Homo sapiens
ctgaagcaggttcccaagct

SEQ ID NO: 4108246 - DNA, 21 bp, Homo sapiens
ctgaagcaggttcccaagctc

SEQ ID NO: 4108247 - DNA, 14 bp, Homo sapiens
ctgaagcctctggg

SEQ ID NO: 4108248 - DNA, 13 bp, Homo sapiens
ctgaagcctgcag

SEQ ID NO: 4108249 - DNA, 15 bp, Homo sapiens
ctgaagcctgcagga

SEQ ID NO: 4108250 - DNA, 20 bp, Homo sapiens
ctgaagcttgactcccaagt

SEQ ID NO: 4108251 - DNA, 21 bp, Homo sapiens
ctgaagcttgactcccaagtt

SEQ ID NO: 4108252 - DNA, 12 bp, Homo sapiens
ctgaaggactgg

SEQ ID NO: 4108253 - DNA, 19 bp, Homo sapiens
ctgaagtcacatcacagga

SEQ ID NO: 4108254 - DNA, 22 bp, Homo sapiens
ctgaagtcacatcacaggacac

SEQ ID NO: 4108255 - DNA, 13 bp, Homo sapiens
ctgaagtcactgc

SEQ ID NO: 4108256 - DNA, 15 bp, Homo sapiens
ctgaagtcactgcac

SEQ ID NO: 4108257 - DNA, 19 bp, Homo sapiens
ctgaagtgagcacagccta

SEQ ID NO: 4108258 - DNA, 14 bp, Homo sapiens
ctgaagtgcatcca

SEQ ID NO: 4108259 - DNA, 17 bp, Homo sapiens
ctgaagtgcatccaaag

SEQ ID NO: 4108260 - DNA, 19 bp, Homo sapiens
ctgaagtgcatccaaaggt

SEQ ID NO: 4108261 - DNA, 22 bp, Homo sapiens
ctgaagtgcatccaaaggtgct

SEQ ID NO: 4108262 - DNA, 23 bp, Homo sapiens
ctgaagtttttttgctgctgcct

SEQ ID NO: 4108263 - DNA, 17 bp, Homo sapiens
ctgaatatacagcaggt

SEQ ID NO: 4108264 - DNA, 21 bp, Homo sapiens
ctgaatatttatatttcacta

SEQ ID NO: 4108265 - DNA, 17 bp, Homo sapiens
ctgaatattttggaaac

SEQ ID NO: 4108266 - DNA, 19 bp, Homo sapiens
ctgaatattttggaaactg

SEQ ID NO: 4108267 - DNA, 13 bp, Homo sapiens
ctgaatcatgagc

SEQ ID NO: 4108268 - DNA, 17 bp, Homo sapiens
ctgaatccaaaagaaaa

SEQ ID NO: 4108269 - DNA, 19 bp, Homo sapiens
ctgaatccaaaagaaaaac

SEQ ID NO: 4108270 - DNA, 13 bp, Homo sapiens
ctgaatccctgta

SEQ ID NO: 4108271 - DNA, 19 bp, Homo sapiens
ctgaatcgagtgagacaaa

SEQ ID NO: 4108272 - DNA, 16 bp, Homo sapiens
ctgaatctgtgcctgc

SEQ ID NO: 4108273 - DNA, 18 bp, Homo sapiens
ctgaatgcctcctgtggg

SEQ ID NO: 4108274 - DNA, 12 bp, Homo sapiens
ctgaatgctctg

SEQ ID NO: 4108275 - DNA, 17 bp, Homo sapiens
ctgaatgctctgtgcga

SEQ ID NO: 4108276 - DNA, 20 bp, Homo sapiens
ctgaatggttttcaaaataa

SEQ ID NO: 4108277 - DNA, 18 bp, Homo sapiens
ctgaatgtcaaacagtgc

SEQ ID NO: 4108278 - DNA, 22 bp, Homo sapiens
ctgaatgtcaaacagtgccaaa

SEQ ID NO: 4108279 - DNA, 12 bp, Homo sapiens
ctgaatgttctg

SEQ ID NO: 4108280 - DNA, 17 bp, Homo sapiens
ctgaatgttctgacatt

SEQ ID NO: 4108281 - DNA, 19 bp, Homo sapiens
ctgaatgttctgacattaa

SEQ ID NO: 4108282 - DNA, 22 bp, Homo sapiens
ctgaatgttctgacattaacag

SEQ ID NO: 4108283 - DNA, 19 bp, Homo sapiens
ctgaatgttttatttatca

SEQ ID NO: 4108284 - DNA, 14 bp, Homo sapiens
ctgaattaaataaa

SEQ ID NO: 4108285 - DNA, 21 bp, Homo sapiens
ctgaatttggcctgcactaat

SEQ ID NO: 4108286 - DNA, 20 bp, Homo sapiens
ctgaatttttttgtaataag

SEQ ID NO: 4108287 - DNA, 18 bp, Homo sapiens
ctctgagactctttagag

SEQ ID NO: 4108288 - DNA, 23 bp, Homo sapiens
ctctgagactctttagagcagct

SEQ ID NO: 4108289 - DNA, 16 bp, Homo sapiens
ctctgagactgctaag

SEQ ID NO: 4108290 - DNA, 21 bp, Homo sapiens
ctctgagatctaaggatgtca

SEQ ID NO: 4108291 - DNA, 22 bp, Homo sapiens
ctctgagatctaaggatgtcac

SEQ ID NO: 4108292 - DNA, 16 bp, Homo sapiens
ctctgagatgtggaga

SEQ ID NO: 4108293 - DNA, 17 bp, Homo sapiens
ctctgagatgtggagac

SEQ ID NO: 4108294 - DNA, 18 bp, Homo sapiens
ctctgagccacagtggga

SEQ ID NO: 4108295 - DNA, 14 bp, Homo sapiens
ctctgagcccagct

SEQ ID NO: 4108296 - DNA, 15 bp, Homo sapiens
ctctgagcgggaggc

SEQ ID NO: 4108297 - DNA, 16 bp, Homo sapiens
ctctgagcgggaggca

SEQ ID NO: 4108298 - DNA, 17 bp, Homo sapiens
ctctgagctgctcaccg

SEQ ID NO: 4108299 - DNA, 17 bp, Homo sapiens
ctctgagtttaccattt

SEQ ID NO: 4108300 - DNA, 20 bp, Homo sapiens
ctctgatattccatgaatgt

SEQ ID NO: 4108301 - DNA, 19 bp, Homo sapiens
ctctgcaagcttcttgctg

SEQ ID NO: 4108302 - DNA, 17 bp, Homo sapiens
ctctgcaatgggcactg

SEQ ID NO: 4108303 - DNA, 18 bp, Homo sapiens
ctctgcaatgggcactgg

SEQ ID NO: 4108304 - DNA, 15 bp, Homo sapiens
ctctgcaattcccct

SEQ ID NO: 4108305 - DNA, 19 bp, Homo sapiens
ctctgcaattcccctctgc

SEQ ID NO: 4108306 - DNA, 21 bp, Homo sapiens
ctctgcaattcccctctgctg

SEQ ID NO: 4108307 - DNA, 22 bp, Homo sapiens
ctctgcaattcccctctgctgc

SEQ ID NO: 4108308 - DNA, 13 bp, Homo sapiens
ctctgcacccacg

SEQ ID NO: 4108309 - DNA, 13 bp, Homo sapiens
ctctgcacccctc

SEQ ID NO: 4108310 - DNA, 15 bp, Homo sapiens
ctctgcactaagaga

SEQ ID NO: 4108311 - DNA, 19 bp, Homo sapiens
ctctgcagacttcccagct

SEQ ID NO: 4108312 - DNA, 22 bp, Homo sapiens
ctctgcagacttcccagctagg

SEQ ID NO: 4108313 - DNA, 11 bp, Homo sapiens
ctctgcagctg

SEQ ID NO: 4108314 - DNA, 14 bp, Homo sapiens
ctctgcagctgccg

SEQ ID NO: 4108315 - DNA, 19 bp, Homo sapiens
ctctgcagtctcatttctc

SEQ ID NO: 4108316 - DNA, 19 bp, Homo sapiens
ctctgcatcccagcacctg

SEQ ID NO: 4108317 - DNA, 20 bp, Homo sapiens
ctctgcatcccagcacctgc

SEQ ID NO: 4108318 - DNA, 23 bp, Homo sapiens
ctctgcatcccagcacctgcctc

SEQ ID NO: 4108319 - DNA, 15 bp, Homo sapiens
ctctgcattctagta

SEQ ID NO: 4108320 - DNA, 19 bp, Homo sapiens
ctctgccaaaggatgtgat

SEQ ID NO: 4108321 - DNA, 14 bp, Homo sapiens
ctctgccacccact

SEQ ID NO: 4108322 - DNA, 15 bp, Homo sapiens
ctctgccacccactc

SEQ ID NO: 4108323 - DNA, 23 bp, Homo sapiens
ctctgccagaagatcccctcagg

SEQ ID NO: 4108324 - DNA, 14 bp, Homo sapiens
ctctgccagtgaca

SEQ ID NO: 4108325 - DNA, 20 bp, Homo sapiens
ctctgccagtgacagacagg

SEQ ID NO: 4108326 - DNA, 13 bp, Homo sapiens
ctctgccagtgga

SEQ ID NO: 4108327 - DNA, 21 bp, Homo sapiens
ctctgccagtggatcccctgc

SEQ ID NO: 4108328 - DNA, 20 bp, Homo sapiens
ctctgcccaggaactcgcac

SEQ ID NO: 4108329 - DNA, 13 bp, Homo sapiens
ctctgccccaccc

SEQ ID NO: 4108330 - DNA, 19 bp, Homo sapiens
ctctgccccacgctgtggc

SEQ ID NO: 4108331 - DNA, 20 bp, Homo sapiens
ctctgccccacgctgtggcc

SEQ ID NO: 4108332 - DNA, 17 bp, Homo sapiens
ctctgccccctgctggc

SEQ ID NO: 4108333 - DNA, 23 bp, Homo sapiens
ctctgcccctcccaacccagccg

SEQ ID NO: 4108334 - DNA, 15 bp, Homo sapiens
ctctgcccctggacc

SEQ ID NO: 4108335 - DNA, 23 bp, Homo sapiens
ctctgccctcattactgggcctt

SEQ ID NO: 4108336 - DNA, 13 bp, Homo sapiens
ctctgccctggat

SEQ ID NO: 4108337 - DNA, 18 bp, Homo sapiens
ctctgccggtcgggcagc

SEQ ID NO: 4108338 - DNA, 20 bp, Homo sapiens
ctctgccggtcgggcagcca

SEQ ID NO: 4108339 - DNA, 22 bp, Homo sapiens
ctctgcctccaccctcctcctc

SEQ ID NO: 4108340 - DNA, 16 bp, Homo sapiens
ctctgcctcccaggtt

SEQ ID NO: 4108341 - DNA, 15 bp, Homo sapiens
ctctgcctgccccgc

SEQ ID NO: 4108342 - DNA, 20 bp, Homo sapiens
ctctgcctgccccgccccca

SEQ ID NO: 4108343 - DNA, 20 bp, Homo sapiens
ctctgcggggcagggccttc

SEQ ID NO: 4108344 - DNA, 24 bp, Homo sapiens
ctctgcggggcagggccttcctgg

SEQ ID NO: 4108345 - DNA, 23 bp, Homo sapiens
ctctgctatatataaaacggtgc

SEQ ID NO: 4108346 - DNA, 15 bp, Homo sapiens
ctctgctatgagtgt

SEQ ID NO: 4108347 - DNA, 22 bp, Homo sapiens
ctctgctcaccgcccatcaggg

SEQ ID NO: 4108348 - DNA, 16 bp, Homo sapiens
ctctgctcagccaagc

SEQ ID NO: 4108349 - DNA, 17 bp, Homo sapiens
ctctgctcctggagcct

SEQ ID NO: 4108350 - DNA, 17 bp, Homo sapiens
ctctgctcgccctcctt

SEQ ID NO: 4108351 - DNA, 14 bp, Homo sapiens
ctctgctgaatgca

SEQ ID NO: 4108352 - DNA, 13 bp, Homo sapiens
ctctgctgccgcc

SEQ ID NO: 4108353 - DNA, 15 bp, Homo sapiens
ctctgctgccgccct

SEQ ID NO: 4108354 - DNA, 14 bp, Homo sapiens
ctctgctggcccag

SEQ ID NO: 4108355 - DNA, 17 bp, Homo sapiens
ctctgcttctctcacct

SEQ ID NO: 4108356 - DNA, 19 bp, Homo sapiens
ctctggaaagaggctctgg

SEQ ID NO: 4108357 - DNA, 22 bp, Homo sapiens
ctctggaaatatgtaatgcttc

SEQ ID NO: 4108358 - DNA, 20 bp, Homo sapiens
ctctggaataaagttgcaga

SEQ ID NO: 4108359 - DNA, 21 bp, Homo sapiens
ctctggaataaagttgcagat

SEQ ID NO: 4108360 - DNA, 14 bp, Homo sapiens
ctctggacagcaga

SEQ ID NO: 4108361 - DNA, 17 bp, Homo sapiens
ctctggacagcagaagc

SEQ ID NO: 4108362 - DNA, 20 bp, Homo sapiens
ctctggacagcagaagcctc

SEQ ID NO: 4108363 - DNA, 13 bp, Homo sapiens
ctctggacagcca

SEQ ID NO: 4108364 - DNA, 14 bp, Homo sapiens
ctctggacagccag

SEQ ID NO: 4108365 - DNA, 18 bp, Homo sapiens
ctctggacagccccaccc

SEQ ID NO: 4108366 - DNA, 18 bp, Homo sapiens
ctctggacggcaggctca

SEQ ID NO: 4108367 - DNA, 16 bp, Homo sapiens
ctctggactggctaga

SEQ ID NO: 4108368 - DNA, 19 bp, Homo sapiens
ctctggactggctagagtc

SEQ ID NO: 4108369 - DNA, 15 bp, Homo sapiens
ctctggccaggatgg

SEQ ID NO: 4108370 - DNA, 19 bp, Homo sapiens
ctctggccaggatggaggg

SEQ ID NO: 4108371 - DNA, 14 bp, Homo sapiens
ctctggccctggcc

SEQ ID NO: 4108372 - DNA, 14 bp, Homo sapiens
ctctggctagaggc

SEQ ID NO: 4108373 - DNA, 21 bp, Homo sapiens
ctctggctagaggccagcccc

SEQ ID NO: 4108374 - DNA, 22 bp, Homo sapiens
ctctggctagaggccagcccca

SEQ ID NO: 4108375 - DNA, 16 bp, Homo sapiens
ctctggctctcatggg

SEQ ID NO: 4108376 - DNA, 17 bp, Homo sapiens
ctctggctttcccagga

SEQ ID NO: 4108377 - DNA, 22 bp, Homo sapiens
ctctggctttcccaggagatgg

SEQ ID NO: 4108378 - DNA, 19 bp, Homo sapiens
ctctgggaaataagagaga

SEQ ID NO: 4108379 - DNA, 22 bp, Homo sapiens
ctctgggcacgcctgctggccg

SEQ ID NO: 4108380 - DNA, 14 bp, Homo sapiens
ctctgggcccaggg

SEQ ID NO: 4108381 - DNA, 23 bp, Homo sapiens
ctctgggctgtaacgtggcactg

SEQ ID NO: 4108382 - DNA, 12 bp, Homo sapiens
ctctggggacag

SEQ ID NO: 4108383 - DNA, 20 bp, Homo sapiens
ctctggggaccccaacctca

SEQ ID NO: 4108384 - DNA, 16 bp, Homo sapiens
ctctggggcagatccc

SEQ ID NO: 4108385 - DNA, 15 bp, Homo sapiens
ctctggggcagcccc

SEQ ID NO: 4108386 - DNA, 14 bp, Homo sapiens
ctctggggccctgg

SEQ ID NO: 4108387 - DNA, 22 bp, Homo sapiens
ctctgggtctgattttctcact

SEQ ID NO: 4108388 - DNA, 17 bp, Homo sapiens
ctctggtaatattgact

SEQ ID NO: 4108389 - DNA, 17 bp, Homo sapiens
ctctggtggcacaggag

SEQ ID NO: 4108390 - DNA, 17 bp, Homo sapiens
ctctggttgtttctgtt

SEQ ID NO: 4108391 - DNA, 20 bp, Homo sapiens
ctctggttgtttctgttcca

SEQ ID NO: 4108392 - DNA, 19 bp, Homo sapiens
ctctgtaggcagcagagag

SEQ ID NO: 4108393 - DNA, 17 bp, Homo sapiens
ctctgtagtttatggca

SEQ ID NO: 4108394 - DNA, 15 bp, Homo sapiens
ctctgtatagaaatc

SEQ ID NO: 4108395 - DNA, 16 bp, Homo sapiens
ctctgtcacccttgtc

SEQ ID NO: 4108396 - DNA, 15 bp, Homo sapiens
ctctgtcagccagcc

SEQ ID NO: 4108397 - DNA, 16 bp, Homo sapiens
ctctgtcccaccccta

SEQ ID NO: 4108398 - DNA, 19 bp, Homo sapiens
ctctgtcggctttttgcca

SEQ ID NO: 4108399 - DNA, 10 bp, Homo sapiens
ctctgtctca

SEQ ID NO: 4108400 - DNA, 16 bp, Homo sapiens
ctctgtctcaataata

SEQ ID NO: 4108401 - DNA, 21 bp, Homo sapiens
ctctgtctcatcctcctggaa

SEQ ID NO: 4108402 - DNA, 17 bp, Homo sapiens
ctctgtctgcccttcac

SEQ ID NO: 4108403 - DNA, 22 bp, Homo sapiens
ctctgtctgcccttcaccccag

SEQ ID NO: 4108404 - DNA, 18 bp, Homo sapiens
ctctgtcttcaggctctg

SEQ ID NO: 4108405 - DNA, 23 bp, Homo sapiens
ctctgtcttcaggctctgcccag

SEQ ID NO: 4108406 - DNA, 22 bp, Homo sapiens
ctctgtgaatacaattaaaggt

SEQ ID NO: 4108407 - DNA, 13 bp, Homo sapiens
ctctgtgacccta

SEQ ID NO: 4108408 - DNA, 22 bp, Homo sapiens
ctctgtgccagggcagcatttt

SEQ ID NO: 4108409 - DNA, 16 bp, Homo sapiens
ctctgtgccttctttt

SEQ ID NO: 4108410 - DNA, 18 bp, Homo sapiens
ctctgtgctgtggaagca

SEQ ID NO: 4108411 - DNA, 19 bp, Homo sapiens
ctctgtggcattgaaatga

SEQ ID NO: 4108412 - DNA, 18 bp, Homo sapiens
ctctgtgttcccagaggc

SEQ ID NO: 4108413 - DNA, 14 bp, Homo sapiens
ctctgttaaggttg

SEQ ID NO: 4108414 - DNA, 16 bp, Homo sapiens
ctctgttaaggttgaa

SEQ ID NO: 4108415 - DNA, 20 bp, Homo sapiens
ctctgttaaggttgaacttt

SEQ ID NO: 4108416 - DNA, 23 bp, Homo sapiens
ctctgttccatgcaactggagtt

SEQ ID NO: 4108417 - DNA, 21 bp, Homo sapiens
ctctgttgtcgtaaagatttg

SEQ ID NO: 4108418 - DNA, 19 bp, Homo sapiens
ctctgttgtttggttcagg

SEQ ID NO: 4108419 - DNA, 18 bp, Homo sapiens
ctctgtttgatgctattt

SEQ ID NO: 4108420 - DNA, 23 bp, Homo sapiens
ctctgtttgatgctatttatgca

SEQ ID NO: 4108421 - DNA, 12 bp, Homo sapiens
ctcttaaagttg

SEQ ID NO: 4108422 - DNA, 22 bp, Homo sapiens
ctcttaaagttggaatttacca

SEQ ID NO: 4108423 - DNA, 17 bp, Homo sapiens
ctcttaacaatttctgt

SEQ ID NO: 4108424 - DNA, 17 bp, Homo sapiens
ctcttaagcagcatgga

SEQ ID NO: 4108425 - DNA, 15 bp, Homo sapiens
ctcttaatctgtgtg

SEQ ID NO: 4108426 - DNA, 18 bp, Homo sapiens
ctcttactacactgagga

SEQ ID NO: 4108427 - DNA, 18 bp, Homo sapiens
ctcttactctttcctatt

SEQ ID NO: 4108428 - DNA, 13 bp, Homo sapiens
ctcttagaaatac

SEQ ID NO: 4108429 - DNA, 18 bp, Homo sapiens
ctcttagattcttaattc

SEQ ID NO: 4108430 - DNA, 16 bp, Homo sapiens
ctcttagctactgtat

SEQ ID NO: 4108431 - DNA, 21 bp, Homo sapiens
ctcttagctactgtatgcaaa

SEQ ID NO: 4108432 - DNA, 22 bp, Homo sapiens
ctcttaggcatgtaggaccctg

SEQ ID NO: 4108433 - DNA, 22 bp, Homo sapiens
ctcttatctcagtcatgcataa

SEQ ID NO: 4108434 - DNA, 17 bp, Homo sapiens
ctcttattcctctaggc

SEQ ID NO: 4108435 - DNA, 17 bp, Homo sapiens
ctcttcaccccccactc

SEQ ID NO: 4108436 - DNA, 18 bp, Homo sapiens
ctcttcaccccccactca

SEQ ID NO: 4108437 - DNA, 20 bp, Homo sapiens
ctcttcaggcctccctctct

SEQ ID NO: 4108438 - DNA, 15 bp, Homo sapiens
ctcttcaggttctta

SEQ ID NO: 4108439 - DNA, 18 bp, Homo sapiens
ctcttcattattctctgc

SEQ ID NO: 4108440 - DNA, 12 bp, Homo sapiens
ctcttcccatga

SEQ ID NO: 4108441 - DNA, 20 bp, Homo sapiens
ctcttcccatgactgcaccc

SEQ ID NO: 4108442 - DNA, 12 bp, Homo sapiens
ctcttccccaga

SEQ ID NO: 4108443 - DNA, 15 bp, Homo sapiens
ctcttccccagagag

SEQ ID NO: 4108444 - DNA, 14 bp, Homo sapiens
ctcttccccttccc

SEQ ID NO: 4108445 - DNA, 16 bp, Homo sapiens
ctcttccccttcctgt

SEQ ID NO: 4108446 - DNA, 17 bp, Homo sapiens
ctcttccccttcctgtt

SEQ ID NO: 4108447 - DNA, 19 bp, Homo sapiens
ctcttccccttcctgtttc

SEQ ID NO: 4108448 - DNA, 20 bp, Homo sapiens
ctcttccccttcctgtttca

SEQ ID NO: 4108449 - DNA, 14 bp, Homo sapiens
ctcttccctttccc

SEQ ID NO: 4108450 - DNA, 12 bp, Homo sapiens
ctcttcctaccc

SEQ ID NO: 4108451 - DNA, 15 bp, Homo sapiens
ctcttcctacccaac

SEQ ID NO: 4108452 - DNA, 22 bp, Homo sapiens
ctcttcctacccaaccactcaa

SEQ ID NO: 4108453 - DNA, 11 bp, Homo sapiens
ctcttcctcca

SEQ ID NO: 4108454 - DNA, 19 bp, Homo sapiens
ctcttcctccaaggacaga

SEQ ID NO: 4108455 - DNA, 15 bp, Homo sapiens
ctcttcctggacagg

SEQ ID NO: 4108456 - DNA, 20 bp, Homo sapiens
ctcttcgcctttcccaccct

SEQ ID NO: 4108457 - DNA, 23 bp, Homo sapiens
ctcttcgcctttcccaccctcct

SEQ ID NO: 4108458 - DNA, 17 bp, Homo sapiens
ctcttctcggctcaggc

SEQ ID NO: 4108459 - DNA, 22 bp, Homo sapiens
ctcttctcggctcaggctctgc

SEQ ID NO: 4108460 - DNA, 15 bp, Homo sapiens
ctcttctctctgctc

SEQ ID NO: 4108461 - DNA, 11 bp, Homo sapiens
ctcttctgcta

SEQ ID NO: 4108462 - DNA, 15 bp, Homo sapiens
ctcttctgctccacc

SEQ ID NO: 4108463 - DNA, 19 bp, Homo sapiens
ctcttctgctccacccttg

SEQ ID NO: 4108464 - DNA, 20 bp, Homo sapiens
ctcttctgctccacccttgg

SEQ ID NO: 4108465 - DNA, 14 bp, Homo sapiens
ctcttctggaatgg

SEQ ID NO: 4108466 - DNA, 14 bp, Homo sapiens
ctcttctggctcaa

SEQ ID NO: 4108467 - DNA, 23 bp, Homo sapiens
ctcttctggggcaggctgggcca

SEQ ID NO: 4108468 - DNA, 12 bp, Homo sapiens
ctcttctggtgt

SEQ ID NO: 4108469 - DNA, 13 bp, Homo sapiens
ctcttctgtgttt

SEQ ID NO: 4108470 - DNA, 16 bp, Homo sapiens
ctcttctttgtgcctt

SEQ ID NO: 4108471 - DNA, 20 bp, Homo sapiens
ctcttctttgtgcctttggc

SEQ ID NO: 4108472 - DNA, 14 bp, Homo sapiens
ctcttgaaaagttc

SEQ ID NO: 4108473 - DNA, 21 bp, Homo sapiens
ctcttgaaaagttcagggacc

SEQ ID NO: 4108474 - DNA, 23 bp, Homo sapiens
ctcttgatacccccctctgtctt

SEQ ID NO: 4108475 - DNA, 15 bp, Homo sapiens
ctcttgatctctctt

SEQ ID NO: 4108476 - DNA, 13 bp, Homo sapiens
ctcttgatgtgaa

SEQ ID NO: 4108477 - DNA, 16 bp, Homo sapiens
ctcttgatgtgaagat

SEQ ID NO: 4108478 - DNA, 21 bp, Homo sapiens
ctcttgattatccatattgag

SEQ ID NO: 4108479 - DNA, 14 bp, Homo sapiens
ctcttgcccatcct

SEQ ID NO: 4108480 - DNA, 15 bp, Homo sapiens
ctcttgcccatcctg

SEQ ID NO: 4108481 - DNA, 19 bp, Homo sapiens
ctcttgcccatcctgactg

SEQ ID NO: 4108482 - DNA, 18 bp, Homo sapiens
ctcttgcgtgtcaatttc

SEQ ID NO: 4108483 - DNA, 14 bp, Homo sapiens
ctcttgcttgtcat

SEQ ID NO: 4108484 - DNA, 13 bp, Homo sapiens
ctcttggcccctg

SEQ ID NO: 4108485 - DNA, 16 bp, Homo sapiens
ctcttggcctgatcag

SEQ ID NO: 4108486 - DNA, 14 bp, Homo sapiens
ctcttggcctttgc

SEQ ID NO: 4108487 - DNA, 15 bp, Homo sapiens
ctcttggcctttgca

SEQ ID NO: 4108488 - DNA, 21 bp, Homo sapiens
ctcttggttcgatacctggag

SEQ ID NO: 4108489 - DNA, 21 bp, Homo sapiens
ctcttgtaagtcatctactta

SEQ ID NO: 4108490 - DNA, 20 bp, Homo sapiens
ctcttgtccctttccctacc

SEQ ID NO: 4108491 - DNA, 22 bp, Homo sapiens
ctcttgtcctcagtccatttat

SEQ ID NO: 4108492 - DNA, 15 bp, Homo sapiens
ctcttgtctgaggga

SEQ ID NO: 4108493 - DNA, 14 bp, Homo sapiens
ctgatcccttccac

SEQ ID NO: 4108494 - DNA, 21 bp, Homo sapiens
ctgatcgtgctaaattttcag

SEQ ID NO: 4108495 - DNA, 20 bp, Homo sapiens
ctgatgaaatctgctagaaa

SEQ ID NO: 4108496 - DNA, 22 bp, Homo sapiens
ctgatgaaatctgctagaaagt

SEQ ID NO: 4108497 - DNA, 19 bp, Homo sapiens
ctgatgagtgattgacaca

SEQ ID NO: 4108498 - DNA, 21 bp, Homo sapiens
ctgatgagtgattgacacaca

SEQ ID NO: 4108499 - DNA, 23 bp, Homo sapiens
ctgatgagtgattgacacacagc

SEQ ID NO: 4108500 - DNA, 20 bp, Homo sapiens
ctgatgccgtgatcctgagc

SEQ ID NO: 4108501 - DNA, 12 bp, Homo sapiens
ctgatgctccct

SEQ ID NO: 4108502 - DNA, 14 bp, Homo sapiens
ctgatgctccctcc

SEQ ID NO: 4108503 - DNA, 15 bp, Homo sapiens
ctgatgctccctccc

SEQ ID NO: 4108504 - DNA, 14 bp, Homo sapiens
ctgatgctgcccct

SEQ ID NO: 4108505 - DNA, 15 bp, Homo sapiens
ctgatgctgggcaat

SEQ ID NO: 4108506 - DNA, 17 bp, Homo sapiens
ctgatgctgttctcttc

SEQ ID NO: 4108507 - DNA, 19 bp, Homo sapiens
ctgatgcttttgtctaatt

SEQ ID NO: 4108508 - DNA, 15 bp, Homo sapiens
ctgatggaggaaaaa

SEQ ID NO: 4108509 - DNA, 22 bp, Homo sapiens
ctgatggcagaactcccacaac

SEQ ID NO: 4108510 - DNA, 14 bp, Homo sapiens
ctgatggccttaat

SEQ ID NO: 4108511 - DNA, 19 bp, Homo sapiens
ctgatggccttaatttcct

SEQ ID NO: 4108512 - DNA, 20 bp, Homo sapiens
ctgatggccttaatttcctt

SEQ ID NO: 4108513 - DNA, 21 bp, Homo sapiens
ctgatggccttaatttccttt

SEQ ID NO: 4108514 - DNA, 13 bp, Homo sapiens
ctgatggcttgac

SEQ ID NO: 4108515 - DNA, 15 bp, Homo sapiens
ctgatggcttgacat

SEQ ID NO: 4108516 - DNA, 23 bp, Homo sapiens
ctgatggcttgacatgtgcaatt

SEQ ID NO: 4108517 - DNA, 18 bp, Homo sapiens
ctgatggtcttaaatgct

SEQ ID NO: 4108518 - DNA, 23 bp, Homo sapiens
ctgatggtcttaaatgctcattt

SEQ ID NO: 4108519 - DNA, 12 bp, Homo sapiens
ctgatgtctcta

SEQ ID NO: 4108520 - DNA, 16 bp, Homo sapiens
ctgatgtgttgccact

SEQ ID NO: 4108521 - DNA, 14 bp, Homo sapiens
ctgattactgtcaa

SEQ ID NO: 4108522 - DNA, 16 bp, Homo sapiens
ctgattactgtcaata

SEQ ID NO: 4108523 - DNA, 19 bp, Homo sapiens
ctgattactgtcaataaac

SEQ ID NO: 4108524 - DNA, 20 bp, Homo sapiens
ctgattactgtcaataaaca

SEQ ID NO: 4108525 - DNA, 23 bp, Homo sapiens
ctgattactgtcaataaacagct

SEQ ID NO: 4108526 - DNA, 19 bp, Homo sapiens
ctgattagaaatgaccaat

SEQ ID NO: 4108527 - DNA, 19 bp, Homo sapiens
ctgattcttctaaattaaa

SEQ ID NO: 4108528 - DNA, 15 bp, Homo sapiens
ctgattgacctgctc

SEQ ID NO: 4108529 - DNA, 21 bp, Homo sapiens
ctgattgtggatcttttcatt

SEQ ID NO: 4108530 - DNA, 23 bp, Homo sapiens
ctgattgtggatcttttcattct

SEQ ID NO: 4108531 - DNA, 20 bp, Homo sapiens
ctgatttaggagaagccagg

SEQ ID NO: 4108532 - DNA, 14 bp, Homo sapiens
ctgatttcctttgg

SEQ ID NO: 4108533 - DNA, 16 bp, Homo sapiens
ctgatttgcaaaaaaa

SEQ ID NO: 4108534 - DNA, 14 bp, Homo sapiens
ctgatttgttttca

SEQ ID NO: 4108535 - DNA, 23 bp, Homo sapiens
ctgatttgttttcattatagaca

SEQ ID NO: 4108536 - DNA, 23 bp, Homo sapiens
ctgattttaaaggcagagaagtt

SEQ ID NO: 4108537 - DNA, 13 bp, Homo sapiens
ctgattttaacaa

SEQ ID NO: 4108538 - DNA, 15 bp, Homo sapiens
ctgattttctcactg

SEQ ID NO: 4108539 - DNA, 13 bp, Homo sapiens
ctgcaaaaatgga

SEQ ID NO: 4108540 - DNA, 15 bp, Homo sapiens
ctgcaaacagaaatc

SEQ ID NO: 4108541 - DNA, 20 bp, Homo sapiens
ctgcaaactcactgctcaag

SEQ ID NO: 4108542 - DNA, 17 bp, Homo sapiens
ctgcaaattttaactgt

SEQ ID NO: 4108543 - DNA, 17 bp, Homo sapiens
ctgcaacggcttagact

SEQ ID NO: 4108544 - DNA, 16 bp, Homo sapiens
ctgcaacttccgctga

SEQ ID NO: 4108545 - DNA, 17 bp, Homo sapiens
ctgcaacttccgctgag

SEQ ID NO: 4108546 - DNA, 23 bp, Homo sapiens
ctgcaacttccgctgaggggtct

SEQ ID NO: 4108547 - DNA, 21 bp, Homo sapiens
ctgcaagaaaatgatgtgtac

SEQ ID NO: 4108548 - DNA, 15 bp, Homo sapiens
ctgcaagccagggat

SEQ ID NO: 4108549 - DNA, 13 bp, Homo sapiens
ctgcaagcctgtc

SEQ ID NO: 4108550 - DNA, 14 bp, Homo sapiens
ctgcaagctgcttg

SEQ ID NO: 4108551 - DNA, 14 bp, Homo sapiens
ctgcaataacttct

SEQ ID NO: 4108552 - DNA, 17 bp, Homo sapiens
ctgcaataacttctgac

SEQ ID NO: 4108553 - DNA, 19 bp, Homo sapiens
ctgcaataacttctgacct

SEQ ID NO: 4108554 - DNA, 14 bp, Homo sapiens
ctgcaatagagact

SEQ ID NO: 4108555 - DNA, 16 bp, Homo sapiens
ctgcaatagagactgt

SEQ ID NO: 4108556 - DNA, 19 bp, Homo sapiens
ctgcaatagagactgtaga

SEQ ID NO: 4108557 - DNA, 20 bp, Homo sapiens
ctgcaatagagactgtagat

SEQ ID NO: 4108558 - DNA, 16 bp, Homo sapiens
ctgcaatatttgaatt

SEQ ID NO: 4108559 - DNA, 13 bp, Homo sapiens
ctgcaatgaaagg

SEQ ID NO: 4108560 - DNA, 16 bp, Homo sapiens
ctgcaattctacagtt

SEQ ID NO: 4108561 - DNA, 16 bp, Homo sapiens
ctgcaattgcttagga

SEQ ID NO: 4108562 - DNA, 11 bp, Homo sapiens
ctgcacactcc

SEQ ID NO: 4108563 - DNA, 17 bp, Homo sapiens
ctgcacactccaggcct

SEQ ID NO: 4108564 - DNA, 17 bp, Homo sapiens
ctgcacagatatttcca

SEQ ID NO: 4108565 - DNA, 23 bp, Homo sapiens
ctgcacagatggatttgcctgtg

SEQ ID NO: 4108566 - DNA, 19 bp, Homo sapiens
ctgcacagcggcccctgca

SEQ ID NO: 4108567 - DNA, 12 bp, Homo sapiens
ctgcaccagagc

SEQ ID NO: 4108568 - DNA, 12 bp, Homo sapiens
ctgcacccagct

SEQ ID NO: 4108569 - DNA, 15 bp, Homo sapiens
ctgcacccctgggcc

SEQ ID NO: 4108570 - DNA, 12 bp, Homo sapiens
ctgcaccctgcg

SEQ ID NO: 4108571 - DNA, 14 bp, Homo sapiens
ctgcaccctgcgcc

SEQ ID NO: 4108572 - DNA, 19 bp, Homo sapiens
ctgcaccctgcgcctccag

SEQ ID NO: 4108573 - DNA, 23 bp, Homo sapiens
ctgcaccctggggcctggacctg

SEQ ID NO: 4108574 - DNA, 13 bp, Homo sapiens
ctgcacctgtgca

SEQ ID NO: 4108575 - DNA, 13 bp, Homo sapiens
ctgcacctttcgg

SEQ ID NO: 4108576 - DNA, 20 bp, Homo sapiens
ctgcacctttcggcagagga

SEQ ID NO: 4108577 - DNA, 20 bp, Homo sapiens
ctgcactaaagccagcctga

SEQ ID NO: 4108578 - DNA, 21 bp, Homo sapiens
ctgcactaaagccagcctgac

SEQ ID NO: 4108579 - DNA, 14 bp, Homo sapiens
ctgcactccagcct

SEQ ID NO: 4108580 - DNA, 18 bp, Homo sapiens
ctgcactctaaactgcaa

SEQ ID NO: 4108581 - DNA, 19 bp, Homo sapiens
ctgcactctaaactgcaaa

SEQ ID NO: 4108582 - DNA, 15 bp, Homo sapiens
ctgcactgatgctgc

SEQ ID NO: 4108583 - DNA, 18 bp, Homo sapiens
ctgcactgatgctgcccc

SEQ ID NO: 4108584 - DNA, 19 bp, Homo sapiens
ctgcactgatgctgcccct

SEQ ID NO: 4108585 - DNA, 16 bp, Homo sapiens
ctgcactggggagccc

SEQ ID NO: 4108586 - DNA, 15 bp, Homo sapiens
ctgcagaagcaaggg

SEQ ID NO: 4108587 - DNA, 14 bp, Homo sapiens
ctgcagacacgcct

SEQ ID NO: 4108588 - DNA, 17 bp, Homo sapiens
ctgcagacttcccagct

SEQ ID NO: 4108589 - DNA, 20 bp, Homo sapiens
ctgcagatactactgaccag

SEQ ID NO: 4108590 - DNA, 21 bp, Homo sapiens
ctgcagatactactgaccaga

SEQ ID NO: 4108591 - DNA, 21 bp, Homo sapiens
ctgcagatgtgcggagcggga

SEQ ID NO: 4108592 - DNA, 22 bp, Homo sapiens
ctgcagattagttctttttgcc

SEQ ID NO: 4108593 - DNA, 18 bp, Homo sapiens
ctgcagcaaacactccac

SEQ ID NO: 4108594 - DNA, 15 bp, Homo sapiens
ctgcagcacctccag

SEQ ID NO: 4108595 - DNA, 20 bp, Homo sapiens
ctgcagcacctccaggcctg

SEQ ID NO: 4108596 - DNA, 20 bp, Homo sapiens
ctgcagcaggagtggtgcag

SEQ ID NO: 4108597 - DNA, 22 bp, Homo sapiens
ctgcagcatgacctgtgaccag

SEQ ID NO: 4108598 - DNA, 23 bp, Homo sapiens
ctgcagcatggtccctgccttag

SEQ ID NO: 4108599 - DNA, 14 bp, Homo sapiens
ctgcagccagctca

SEQ ID NO: 4108600 - DNA, 22 bp, Homo sapiens
ctgcagccagctcacgtccagg

SEQ ID NO: 4108601 - DNA, 22 bp, Homo sapiens
ctgcagcccaaaacccagggca

SEQ ID NO: 4108602 - DNA, 15 bp, Homo sapiens
ctgcagcccttgggc

SEQ ID NO: 4108603 - DNA, 16 bp, Homo sapiens
ctgcagcccttgggca

SEQ ID NO: 4108604 - DNA, 14 bp, Homo sapiens
ctgcagcctggctg

SEQ ID NO: 4108605 - DNA, 15 bp, Homo sapiens
ctgcagcctggctgg

SEQ ID NO: 4108606 - DNA, 21 bp, Homo sapiens
ctgcagctatgcgcaatgtgg

SEQ ID NO: 4108607 - DNA, 17 bp, Homo sapiens
ctgcagctctcatgctg

SEQ ID NO: 4108608 - DNA, 11 bp, Homo sapiens
ctgcagctgcc

SEQ ID NO: 4108609 - DNA, 18 bp, Homo sapiens
ctgcaggaaatagtcact

SEQ ID NO: 4108610 - DNA, 15 bp, Homo sapiens
ctgcaggaatcaaaa

SEQ ID NO: 4108611 - DNA, 20 bp, Homo sapiens
ctgcaggaatcaaaaattga

SEQ ID NO: 4108612 - DNA, 19 bp, Homo sapiens
ctgcaggacttgagaagac

SEQ ID NO: 4108613 - DNA, 23 bp, Homo sapiens
ctgcaggacttgagaagacctca

SEQ ID NO: 4108614 - DNA, 22 bp, Homo sapiens
ctgcaggagcagtttgccaccc

SEQ ID NO: 4108615 - DNA, 14 bp, Homo sapiens
ctgcaggcagagct

SEQ ID NO: 4108616 - DNA, 15 bp, Homo sapiens
ctgcaggctgagcca

SEQ ID NO: 4108617 - DNA, 20 bp, Homo sapiens
ctgcagggggtggacaaact

SEQ ID NO: 4108618 - DNA, 21 bp, Homo sapiens
ctgcaggtgccagggcccacc

SEQ ID NO: 4108619 - DNA, 14 bp, Homo sapiens
ctgcagtaaatctt

SEQ ID NO: 4108620 - DNA, 21 bp, Homo sapiens
ctgcagtcagtcatgatggca

SEQ ID NO: 4108621 - DNA, 13 bp, Homo sapiens
ctgcagtcctgga

SEQ ID NO: 4108622 - DNA, 18 bp, Homo sapiens
ctgcagtctcatttctca

SEQ ID NO: 4108623 - DNA, 14 bp, Homo sapiens
ctgcagtttcctgg

SEQ ID NO: 4108624 - DNA, 19 bp, Homo sapiens
ctgcagtttgagacaggag

SEQ ID NO: 4108625 - DNA, 20 bp, Homo sapiens
ctgcataagtgaaaatctta

SEQ ID NO: 4108626 - DNA, 20 bp, Homo sapiens
ctgcatagcgaaataaaaat

SEQ ID NO: 4108627 - DNA, 19 bp, Homo sapiens
ctgcatagctctattttaa

SEQ ID NO: 4108628 - DNA, 15 bp, Homo sapiens
ctgcatatgaaagga

SEQ ID NO: 4108629 - DNA, 14 bp, Homo sapiens
ctgcatatgttgaa

SEQ ID NO: 4108630 - DNA, 14 bp, Homo sapiens
ctgcatcatctgta

SEQ ID NO: 4108631 - DNA, 17 bp, Homo sapiens
ctgcatcatctgtagat

SEQ ID NO: 4108632 - DNA, 18 bp, Homo sapiens
ctgcatcccagcacctgc

SEQ ID NO: 4108633 - DNA, 23 bp, Homo sapiens
ctgcatcccagcacctgcctcct

SEQ ID NO: 4108634 - DNA, 19 bp, Homo sapiens
ctgcatggacctaacattc

SEQ ID NO: 4108635 - DNA, 22 bp, Homo sapiens
ctgcatggacctaacattcgat

SEQ ID NO: 4108636 - DNA, 22 bp, Homo sapiens
ctgcatgtggcttttttaaaaa

SEQ ID NO: 4108637 - DNA, 15 bp, Homo sapiens
ctgcatgttaccatc

SEQ ID NO: 4108638 - DNA, 15 bp, Homo sapiens
ctgcattatctatgc

SEQ ID NO: 4108639 - DNA, 15 bp, Homo sapiens
ctgcattattctctt

SEQ ID NO: 4108640 - DNA, 18 bp, Homo sapiens
ctgcattattctctttta

SEQ ID NO: 4108641 - DNA, 15 bp, Homo sapiens
ctgcattcattttta

SEQ ID NO: 4108642 - DNA, 16 bp, Homo sapiens
ctgcattcatttttat

SEQ ID NO: 4108643 - DNA, 23 bp, Homo sapiens
ctgcattgccgctgtataaagca

SEQ ID NO: 4108644 - DNA, 18 bp, Homo sapiens
ctgcattgctagataaaa

SEQ ID NO: 4108645 - DNA, 19 bp, Homo sapiens
ctgcattgctagataaaag

SEQ ID NO: 4108646 - DNA, 13 bp, Homo sapiens
ctgcatttctgag

SEQ ID NO: 4108647 - DNA, 17 bp, Homo sapiens
ctgcattttcaccccac

SEQ ID NO: 4108648 - DNA, 18 bp, Homo sapiens
ctgcattttcaccccacc

SEQ ID NO: 4108649 - DNA, 14 bp, Homo sapiens
ctgcattttgctat

SEQ ID NO: 4108650 - DNA, 23 bp, Homo sapiens
ctgcatttttcactttgctctca

SEQ ID NO: 4108651 - DNA, 14 bp, Homo sapiens
ctgccaaaggatgt

SEQ ID NO: 4108652 - DNA, 22 bp, Homo sapiens
ctgccaaaggatgtgatatata

SEQ ID NO: 4108653 - DNA, 15 bp, Homo sapiens
ctgccaaccctcccg

SEQ ID NO: 4108654 - DNA, 16 bp, Homo sapiens
ctgccaaccctcccgg

SEQ ID NO: 4108655 - DNA, 17 bp, Homo sapiens
ctgccaaccctcccggg

SEQ ID NO: 4108656 - DNA, 21 bp, Homo sapiens
ctgccaaggccagagtggcct

SEQ ID NO: 4108657 - DNA, 23 bp, Homo sapiens
ctgccaaggccagagtggcctgg

SEQ ID NO: 4108658 - DNA, 16 bp, Homo sapiens
ctgccaagggtgctgg

SEQ ID NO: 4108659 - DNA, 17 bp, Homo sapiens
ctgccaagtggggatgg

SEQ ID NO: 4108660 - DNA, 20 bp, Homo sapiens
ctgccacaaccagccaggca

SEQ ID NO: 4108661 - DNA, 13 bp, Homo sapiens
ctgccacacccag

SEQ ID NO: 4108662 - DNA, 17 bp, Homo sapiens
ctgccacacttcaggct

SEQ ID NO: 4108663 - DNA, 14 bp, Homo sapiens
ctgccacagccaga

SEQ ID NO: 4108664 - DNA, 16 bp, Homo sapiens
ctgccacagccagagg

SEQ ID NO: 4108665 - DNA, 17 bp, Homo sapiens
ctgccacatacaggtgc

SEQ ID NO: 4108666 - DNA, 20 bp, Homo sapiens
ctgccacatacaggtgctca

SEQ ID NO: 4108667 - DNA, 16 bp, Homo sapiens
ctgccacatggagccc

SEQ ID NO: 4108668 - DNA, 19 bp, Homo sapiens
ctgccaccatcctgctgct

SEQ ID NO: 4108669 - DNA, 16 bp, Homo sapiens
ctgccacctccctgac

SEQ ID NO: 4108670 - DNA, 12 bp, Homo sapiens
ctgccaccttca

SEQ ID NO: 4108671 - DNA, 22 bp, Homo sapiens
ctgccagaagatcccctcagga

SEQ ID NO: 4108672 - DNA, 22 bp, Homo sapiens
ctgccagaccttaataaaggcc

SEQ ID NO: 4108673 - DNA, 10 bp, Homo sapiens
ctgccagagg

SEQ ID NO: 4108674 - DNA, 12 bp, Homo sapiens
ctgccagcagcc

SEQ ID NO: 4108675 - DNA, 14 bp, Homo sapiens
ctgccagcagcccc

SEQ ID NO: 4108676 - DNA, 14 bp, Homo sapiens
ctgccagcccagaa

SEQ ID NO: 4108677 - DNA, 13 bp, Homo sapiens
ctgccagccccac

SEQ ID NO: 4108678 - DNA, 13 bp, Homo sapiens
ctgccagccttga

SEQ ID NO: 4108679 - DNA, 17 bp, Homo sapiens
ctgccagccttgagccc

SEQ ID NO: 4108680 - DNA, 20 bp, Homo sapiens
ctgccagccttgagccctgg

SEQ ID NO: 4108681 - DNA, 11 bp, Homo sapiens
ctgccagctgc

SEQ ID NO: 4108682 - DNA, 13 bp, Homo sapiens
ctgccaggccagc

SEQ ID NO: 4108683 - DNA, 15 bp, Homo sapiens
ctgccaggccagcct

SEQ ID NO: 4108684 - DNA, 20 bp, Homo sapiens
ctgccaggccagcctccgag

SEQ ID NO: 4108685 - DNA, 22 bp, Homo sapiens
ctgccaggccagcctccgagag

SEQ ID NO: 4108686 - DNA, 23 bp, Homo sapiens
ctgccaggccagcctccgagagg

SEQ ID NO: 4108687 - DNA, 12 bp, Homo sapiens
ctgccagtgaca

SEQ ID NO: 4108688 - DNA, 16 bp, Homo sapiens
ctgccagtgacagaca

SEQ ID NO: 4108689 - DNA, 19 bp, Homo sapiens
ctgccagtgacagacaggc

SEQ ID NO: 4108690 - DNA, 14 bp, Homo sapiens
ctgccagtgcagcc

SEQ ID NO: 4108691 - DNA, 17 bp, Homo sapiens
ctgccagtgcagccact

SEQ ID NO: 4108692 - DNA, 18 bp, Homo sapiens
ctgccagtgcagccactg

SEQ ID NO: 4108693 - DNA, 16 bp, Homo sapiens
ctgccagtgctggtca

SEQ ID NO: 4108694 - DNA, 17 bp, Homo sapiens
ctgccagtgctggtcac

SEQ ID NO: 4108695 - DNA, 15 bp, Homo sapiens
ctgccagtggatccc

SEQ ID NO: 4108696 - DNA, 22 bp, Homo sapiens
ctgccagtggggcctgaggctc

SEQ ID NO: 4108697 - DNA, 15 bp, Homo sapiens
ctgccagtgtggagt

SEQ ID NO: 4108698 - DNA, 17 bp, Homo sapiens
ctgccatgacagaggct

SEQ ID NO: 4108699 - DNA, 14 bp, Homo sapiens
ctgccatgccagga

SEQ ID NO: 4108700 - DNA, 18 bp, Homo sapiens
ctgccatgccaggaacct

SEQ ID NO: 4108701 - DNA, 22 bp, Homo sapiens
ctgccatgccaggaacctgtcc

SEQ ID NO: 4108702 - DNA, 23 bp, Homo sapiens
ctgccatgccaggaacctgtcct

SEQ ID NO: 4108703 - DNA, 13 bp, Homo sapiens
ctgccatttaaaa

SEQ ID NO: 4108704 - DNA, 15 bp, Homo sapiens
ctgccatttcccttc

SEQ ID NO: 4108705 - DNA, 17 bp, Homo sapiens
ctgcccaacccttccct

SEQ ID NO: 4108706 - DNA, 20 bp, Homo sapiens
ctgcccaacccttccctcac

SEQ ID NO: 4108707 - DNA, 18 bp, Homo sapiens
ctgcccaagcccaggcca

SEQ ID NO: 4108708 - DNA, 16 bp, Homo sapiens
ctgcccaattggagga

SEQ ID NO: 4108709 - DNA, 15 bp, Homo sapiens
ctgcccacttcccct

SEQ ID NO: 4108710 - DNA, 21 bp, Homo sapiens
ctgcccagatcagccagaagc

SEQ ID NO: 4108711 - DNA, 18 bp, Homo sapiens
ctgcccagatgccctttg

SEQ ID NO: 4108712 - DNA, 13 bp, Homo sapiens
ctgcccagcctgg

SEQ ID NO: 4108713 - DNA, 14 bp, Homo sapiens
ctgcccagcctggg

SEQ ID NO: 4108714 - DNA, 23 bp, Homo sapiens
ctgcccagcctggggcaaaccta

SEQ ID NO: 4108715 - DNA, 12 bp, Homo sapiens
ctgcccaggaga

SEQ ID NO: 4108716 - DNA, 19 bp, Homo sapiens
ctgcccaggagacagacca

SEQ ID NO: 4108717 - DNA, 21 bp, Homo sapiens
ctgcccaggagacagaccact

SEQ ID NO: 4108718 - DNA, 22 bp, Homo sapiens
ctgcccagtgttgtttgtaaat

SEQ ID NO: 4108719 - DNA, 15 bp, Homo sapiens
ctgcccatcacaggg

SEQ ID NO: 4108720 - DNA, 21 bp, Homo sapiens
ctgcccattcaccaaaattat

SEQ ID NO: 4108721 - DNA, 15 bp, Homo sapiens
ctgccccaaacaaat

SEQ ID NO: 4108722 - DNA, 21 bp, Homo sapiens
ctgccccaaacaaatatgcaa

SEQ ID NO: 4108723 - DNA, 17 bp, Homo sapiens
ctgccccacacggactc

SEQ ID NO: 4108724 - DNA, 20 bp, Homo sapiens
ctgccccacccaagcccaaa

SEQ ID NO: 4108725 - DNA, 12 bp, Homo sapiens
ctgcccccacga

SEQ ID NO: 4108726 - DNA, 16 bp, Homo sapiens
ctgcccccggccccct

SEQ ID NO: 4108727 - DNA, 14 bp, Homo sapiens
ctgccccctcctga

SEQ ID NO: 4108728 - DNA, 15 bp, Homo sapiens
ctgccccctcctgag

SEQ ID NO: 4108729 - DNA, 14 bp, Homo sapiens
ctgccccctgctgg

SEQ ID NO: 4108730 - DNA, 17 bp, Homo sapiens
ctgccccgcccccagtc

SEQ ID NO: 4108731 - DNA, 18 bp, Homo sapiens
ctgccccgcccccagtcc

SEQ ID NO: 4108732 - DNA, 23 bp, Homo sapiens
ctgccccgcccccagtccccacc

SEQ ID NO: 4108733 - DNA, 17 bp, Homo sapiens
ctgccccggcctcctcg

SEQ ID NO: 4108734 - DNA, 20 bp, Homo sapiens
ctgcccctaatctctgtagg

SEQ ID NO: 4108735 - DNA, 22 bp, Homo sapiens
ctgcccctcccccaacccccac

SEQ ID NO: 4108736 - DNA, 14 bp, Homo sapiens
ctgcccctcccttc

SEQ ID NO: 4108737 - DNA, 16 bp, Homo sapiens
ctgcccctgcagttgg

SEQ ID NO: 4108738 - DNA, 12 bp, Homo sapiens
ctgcccctgcct

SEQ ID NO: 4108739 - DNA, 14 bp, Homo sapiens
ctgcccctggacct

SEQ ID NO: 4108740 - DNA, 21 bp, Homo sapiens
ctgccccttaaacacaggctg

SEQ ID NO: 4108741 - DNA, 22 bp, Homo sapiens
ctgccccttcctttaaaaaact

SEQ ID NO: 4108742 - DNA, 21 bp, Homo sapiens
ctgcccctttcaggcctacag

SEQ ID NO: 4108743 - DNA, 13 bp, Homo sapiens
ctgcccgagctgg

SEQ ID NO: 4108744 - DNA, 16 bp, Homo sapiens
ctgcccgagctggtgc

SEQ ID NO: 4108745 - DNA, 18 bp, Homo sapiens
ctgcccgctgcaatgcct

SEQ ID NO: 4108746 - DNA, 21 bp, Homo sapiens
ctgcccgggaaggtcaccagc

SEQ ID NO: 4108747 - DNA, 23 bp, Homo sapiens
ctgcccggtgggggggcagagcc

SEQ ID NO: 4108748 - DNA, 17 bp, Homo sapiens
ctgccctaagcccccag

SEQ ID NO: 4108749 - DNA, 20 bp, Homo sapiens
ctgccctaagcccccagggc

SEQ ID NO: 4108750 - DNA, 22 bp, Homo sapiens
ctgccctaagcccccagggcct

SEQ ID NO: 4108751 - DNA, 15 bp, Homo sapiens
ctgccctagctgacc

SEQ ID NO: 4108752 - DNA, 16 bp, Homo sapiens
ctgccctagctgaccc

SEQ ID NO: 4108753 - DNA, 21 bp, Homo sapiens
ctgccctcattactgggcctt

SEQ ID NO: 4108754 - DNA, 22 bp, Homo sapiens
ctgccctcccctccggactggt

SEQ ID NO: 4108755 - DNA, 16 bp, Homo sapiens
ctgccctccctggagc

SEQ ID NO: 4108756 - DNA, 22 bp, Homo sapiens
ctgccctctcccaaaaaactac

SEQ ID NO: 4108757 - DNA, 12 bp, Homo sapiens
ctgccctgagaa

SEQ ID NO: 4108758 - DNA, 20 bp, Homo sapiens
ctgccctgcacgtcatggga

SEQ ID NO: 4108759 - DNA, 14 bp, Homo sapiens
ctgccctggtccag

SEQ ID NO: 4108760 - DNA, 23 bp, Homo sapiens
ctgccctggtccagggaagctgg

SEQ ID NO: 4108761 - DNA, 12 bp, Homo sapiens
ctgccctggtgc

SEQ ID NO: 4108762 - DNA, 13 bp, Homo sapiens
ctgccctggtgct

SEQ ID NO: 4108763 - DNA, 18 bp, Homo sapiens
ctgccctggtgctgccac

SEQ ID NO: 4108764 - DNA, 20 bp, Homo sapiens
ctgccctggtgctgccacac

SEQ ID NO: 4108765 - DNA, 23 bp, Homo sapiens
ctgccctggtgctgccacacttc

SEQ ID NO: 4108766 - DNA, 14 bp, Homo sapiens
ctgccctgtccctg

SEQ ID NO: 4108767 - DNA, 15 bp, Homo sapiens
ctgccctgtccctgt

SEQ ID NO: 4108768 - DNA, 12 bp, Homo sapiens
ctgccctgtgat

SEQ ID NO: 4108769 - DNA, 21 bp, Homo sapiens
ctgccctgtgatatgtctgct

SEQ ID NO: 4108770 - DNA, 22 bp, Homo sapiens
ctgccctgtgtacttcccgggc

SEQ ID NO: 4108771 - DNA, 18 bp, Homo sapiens
ctgccctgttcatgtgcc

SEQ ID NO: 4108772 - DNA, 20 bp, Homo sapiens
ctgccctgttcatgtgcctc

SEQ ID NO: 4108773 - DNA, 21 bp, Homo sapiens
ctgccctgttcatgtgcctct

SEQ ID NO: 4108774 - DNA, 23 bp, Homo sapiens
ctgccctgttcatgtgcctctgc

SEQ ID NO: 4108775 - DNA, 21 bp, Homo sapiens
ctgccctgttgtgtatagatg

SEQ ID NO: 4108776 - DNA, 15 bp, Homo sapiens
ctgccctgtttctgt

SEQ ID NO: 4108777 - DNA, 16 bp, Homo sapiens
ctgccctgtttctgtt

SEQ ID NO: 4108778 - DNA, 15 bp, Homo sapiens
ctgccctttcctagg

SEQ ID NO: 4108779 - DNA, 20 bp, Homo sapiens
ctgccctttgtcctcctgct

SEQ ID NO: 4108780 - DNA, 19 bp, Homo sapiens
ctgcccttttcaggaagct

SEQ ID NO: 4108781 - DNA, 16 bp, Homo sapiens
ctgccgcagacgggca

SEQ ID NO: 4108782 - DNA, 20 bp, Homo sapiens
ctgccgcagacgggcacaga

SEQ ID NO: 4108783 - DNA, 16 bp, Homo sapiens
ctgccgcccttcctgg

SEQ ID NO: 4108784 - DNA, 18 bp, Homo sapiens
ctgccgcccttcctggag

SEQ ID NO: 4108785 - DNA, 22 bp, Homo sapiens
ctgccgcccttcctggaggctg

SEQ ID NO: 4108786 - DNA, 18 bp, Homo sapiens
ctgccgctacctccctcc

SEQ ID NO: 4108787 - DNA, 16 bp, Homo sapiens
ctgccggcccccagga

SEQ ID NO: 4108788 - DNA, 22 bp, Homo sapiens
ctgccggtcgggcagccagcag

SEQ ID NO: 4108789 - DNA, 23 bp, Homo sapiens
ctgccggtcgggcagccagcaga

SEQ ID NO: 4108790 - DNA, 22 bp, Homo sapiens
ctgccgtgggcctgtcgtgcca

SEQ ID NO: 4108791 - DNA, 20 bp, Homo sapiens
ctgcctacagaacttcagaa

SEQ ID NO: 4108792 - DNA, 23 bp, Homo sapiens
ctgcctacagaacttcagaaaga

SEQ ID NO: 4108793 - DNA, 13 bp, Homo sapiens
ctgcctacagcca

SEQ ID NO: 4108794 - DNA, 15 bp, Homo sapiens
ctgcctacagccagg

SEQ ID NO: 4108795 - DNA, 17 bp, Homo sapiens
ctgcctagcaagctggc

SEQ ID NO: 4108796 - DNA, 19 bp, Homo sapiens
ctgcctagcaagctggcct

SEQ ID NO: 4108797 - DNA, 22 bp, Homo sapiens
ctgcctcagacgttgcctgaga

SEQ ID NO: 4108798 - DNA, 18 bp, Homo sapiens
ctgcctcagcctcccaag

SEQ ID NO: 4108799 - DNA, 17 bp, Homo sapiens
ctgcctcagccttccaa

SEQ ID NO: 4108800 - DNA, 15 bp, Homo sapiens
ctgcctcagctgacc

SEQ ID NO: 4108801 - DNA, 18 bp, Homo sapiens
ctgagcctacagatgaac

SEQ ID NO: 4108802 - DNA, 18 bp, Homo sapiens
ctgagcctctgctcccca

SEQ ID NO: 4108803 - DNA, 12 bp, Homo sapiens
ctgagcctgtgg

SEQ ID NO: 4108804 - DNA, 16 bp, Homo sapiens
ctgagcctgtgggtcc

SEQ ID NO: 4108805 - DNA, 17 bp, Homo sapiens
ctgagccttctgagctg

SEQ ID NO: 4108806 - DNA, 15 bp, Homo sapiens
ctgagccttgtaatt

SEQ ID NO: 4108807 - DNA, 19 bp, Homo sapiens
ctgagcggatgcatctggg

SEQ ID NO: 4108808 - DNA, 14 bp, Homo sapiens
ctgagcgggaggca

SEQ ID NO: 4108809 - DNA, 17 bp, Homo sapiens
ctgagctattttcctct

SEQ ID NO: 4108810 - DNA, 18 bp, Homo sapiens
ctgagctattttcctctg

SEQ ID NO: 4108811 - DNA, 22 bp, Homo sapiens
ctgagctattttcctctggccg

SEQ ID NO: 4108812 - DNA, 20 bp, Homo sapiens
ctgagctgagaccactgagt

SEQ ID NO: 4108813 - DNA, 13 bp, Homo sapiens
ctgagctgagtgg

SEQ ID NO: 4108814 - DNA, 16 bp, Homo sapiens
ctgagctgagtggcca

SEQ ID NO: 4108815 - DNA, 17 bp, Homo sapiens
ctgagctgagtggccag

SEQ ID NO: 4108816 - DNA, 17 bp, Homo sapiens
ctgagctgcagcctggc

SEQ ID NO: 4108817 - DNA, 18 bp, Homo sapiens
ctgagctgcagcctggct

SEQ ID NO: 4108818 - DNA, 13 bp, Homo sapiens
ctgagctggccag

SEQ ID NO: 4108819 - DNA, 12 bp, Homo sapiens
ctgagctgggga

SEQ ID NO: 4108820 - DNA, 22 bp, Homo sapiens
ctgagcttcggttctccagaat

SEQ ID NO: 4108821 - DNA, 14 bp, Homo sapiens
ctgaggacaaagtg

SEQ ID NO: 4108822 - DNA, 20 bp, Homo sapiens
ctgaggacaaagtggaggag

SEQ ID NO: 4108823 - DNA, 23 bp, Homo sapiens
ctgaggacaaagtggaggagggc

SEQ ID NO: 4108824 - DNA, 19 bp, Homo sapiens
ctgaggacatggcttctga

SEQ ID NO: 4108825 - DNA, 19 bp, Homo sapiens
ctgaggaccgctgataagc

SEQ ID NO: 4108826 - DNA, 14 bp, Homo sapiens
ctgaggaggcctcc

SEQ ID NO: 4108827 - DNA, 15 bp, Homo sapiens
ctgaggaggcctcca

SEQ ID NO: 4108828 - DNA, 20 bp, Homo sapiens
ctgaggatgggtcagagcta

SEQ ID NO: 4108829 - DNA, 22 bp, Homo sapiens
ctgaggatgtagagagaacagg

SEQ ID NO: 4108830 - DNA, 22 bp, Homo sapiens
ctgaggattcaggggctggggg

SEQ ID NO: 4108831 - DNA, 12 bp, Homo sapiens
ctgaggcaagag

SEQ ID NO: 4108832 - DNA, 20 bp, Homo sapiens
ctgaggccacactcagcaca

SEQ ID NO: 4108833 - DNA, 24 bp, Homo sapiens
ctgaggccacactcagcacaaggc

SEQ ID NO: 4108834 - DNA, 13 bp, Homo sapiens
ctgaggccagagt

SEQ ID NO: 4108835 - DNA, 19 bp, Homo sapiens
ctgaggcctaaaagtaaac

SEQ ID NO: 4108836 - DNA, 23 bp, Homo sapiens
ctgaggcctaaaagtaaacatta

SEQ ID NO: 4108837 - DNA, 22 bp, Homo sapiens
ctgaggcttagagagaggaggc

SEQ ID NO: 4108838 - DNA, 17 bp, Homo sapiens
ctgaggctttggatttg

SEQ ID NO: 4108839 - DNA, 18 bp, Homo sapiens
ctgagggaccaactgggc

SEQ ID NO: 4108840 - DNA, 14 bp, Homo sapiens
ctgagggactctga

SEQ ID NO: 4108841 - DNA, 23 bp, Homo sapiens
ctgagggactctgaagcctctgg

SEQ ID NO: 4108842 - DNA, 20 bp, Homo sapiens
ctgagggcagaaaggttctg

SEQ ID NO: 4108843 - DNA, 20 bp, Homo sapiens
ctgagggcagactggggcat

SEQ ID NO: 4108844 - DNA, 13 bp, Homo sapiens
ctgagggccacac

SEQ ID NO: 4108845 - DNA, 17 bp, Homo sapiens
ctgagggctgccagcag

SEQ ID NO: 4108846 - DNA, 17 bp, Homo sapiens
ctgaggggcagcctgcc

SEQ ID NO: 4108847 - DNA, 17 bp, Homo sapiens
ctgaggggcatctgccc

SEQ ID NO: 4108848 - DNA, 19 bp, Homo sapiens
ctgaggggcatctgcccct

SEQ ID NO: 4108849 - DNA, 16 bp, Homo sapiens
ctgaggggggccgtgc

SEQ ID NO: 4108850 - DNA, 19 bp, Homo sapiens
ctgagggtccccacctggg

SEQ ID NO: 4108851 - DNA, 19 bp, Homo sapiens
ctgagggtgtttcttcctg

SEQ ID NO: 4108852 - DNA, 20 bp, Homo sapiens
ctgagggtgtttcttcctgc

SEQ ID NO: 4108853 - DNA, 14 bp, Homo sapiens
ctgaggtcagggag

SEQ ID NO: 4108854 - DNA, 17 bp, Homo sapiens
ctgaggtcagggagtgc

SEQ ID NO: 4108855 - DNA, 16 bp, Homo sapiens
ctgaggtctcttgagg

SEQ ID NO: 4108856 - DNA, 19 bp, Homo sapiens
ctgaggtgaaagggagcta

SEQ ID NO: 4108857 - DNA, 19 bp, Homo sapiens
ctgaggtgcctgtcccacc

SEQ ID NO: 4108858 - DNA, 20 bp, Homo sapiens
ctgaggtgtctggcctgagg

SEQ ID NO: 4108859 - DNA, 22 bp, Homo sapiens
ctgaggtgtctggcctgaggtc

SEQ ID NO: 4108860 - DNA, 21 bp, Homo sapiens
ctgaggttaaacggtgcccat

SEQ ID NO: 4108861 - DNA, 19 bp, Homo sapiens
ctgaggttcctctgcctgc

SEQ ID NO: 4108862 - DNA, 14 bp, Homo sapiens
ctgagtaccagggg

SEQ ID NO: 4108863 - DNA, 19 bp, Homo sapiens
ctgagtaccaggggctggg

SEQ ID NO: 4108864 - DNA, 17 bp, Homo sapiens
ctgagtagctctcctga

SEQ ID NO: 4108865 - DNA, 20 bp, Homo sapiens
ctgagtagctggaattacag

SEQ ID NO: 4108866 - DNA, 13 bp, Homo sapiens
ctgagtcacgctg

SEQ ID NO: 4108867 - DNA, 16 bp, Homo sapiens
ctgagtcacgctgggg

SEQ ID NO: 4108868 - DNA, 17 bp, Homo sapiens
ctgagtccactgctcca

SEQ ID NO: 4108869 - DNA, 18 bp, Homo sapiens
ctgagtccactgctccat

SEQ ID NO: 4108870 - DNA, 14 bp, Homo sapiens
ctgagtccagagct

SEQ ID NO: 4108871 - DNA, 17 bp, Homo sapiens
ctgagtccagagcttgt

SEQ ID NO: 4108872 - DNA, 20 bp, Homo sapiens
ctgagtccagagcttgtgct

SEQ ID NO: 4108873 - DNA, 16 bp, Homo sapiens
ctgagtctcctgtgcc

SEQ ID NO: 4108874 - DNA, 16 bp, Homo sapiens
ctgagtctggactttg

SEQ ID NO: 4108875 - DNA, 15 bp, Homo sapiens
ctgagtgaacctgta

SEQ ID NO: 4108876 - DNA, 14 bp, Homo sapiens
ctgagtgacacaag

SEQ ID NO: 4108877 - DNA, 16 bp, Homo sapiens
ctgagtgagccacaga

SEQ ID NO: 4108878 - DNA, 23 bp, Homo sapiens
ctgagtgcgggctgaggccagag

SEQ ID NO: 4108879 - DNA, 13 bp, Homo sapiens
ctgagtggccagc

SEQ ID NO: 4108880 - DNA, 18 bp, Homo sapiens
ctgagtggccagccagtg

SEQ ID NO: 4108881 - DNA, 19 bp, Homo sapiens
ctgagtggccagccagtgc

SEQ ID NO: 4108882 - DNA, 20 bp, Homo sapiens
ctgagtggccagccagtgcc

SEQ ID NO: 4108883 - DNA, 15 bp, Homo sapiens
ctgagtgtttggaaa

SEQ ID NO: 4108884 - DNA, 18 bp, Homo sapiens
ctgagttggcctggccat

SEQ ID NO: 4108885 - DNA, 18 bp, Homo sapiens
ctgagtttaccatttgta

SEQ ID NO: 4108886 - DNA, 20 bp, Homo sapiens
ctgagtttcctatgggaaca

SEQ ID NO: 4108887 - DNA, 16 bp, Homo sapiens
ctgataaagcacagct

SEQ ID NO: 4108888 - DNA, 17 bp, Homo sapiens
ctgataacttggggagg

SEQ ID NO: 4108889 - DNA, 15 bp, Homo sapiens
ctgataagactgttt

SEQ ID NO: 4108890 - DNA, 15 bp, Homo sapiens
ctgataccactgcac

SEQ ID NO: 4108891 - DNA, 14 bp, Homo sapiens
ctgatacccagagc

SEQ ID NO: 4108892 - DNA, 15 bp, Homo sapiens
ctgatacccagagca

SEQ ID NO: 4108893 - DNA, 14 bp, Homo sapiens
ctgatatactgtgt

SEQ ID NO: 4108894 - DNA, 15 bp, Homo sapiens
ctgatattaatcaaa

SEQ ID NO: 4108895 - DNA, 17 bp, Homo sapiens
ctgatattaatcaaaat

SEQ ID NO: 4108896 - DNA, 22 bp, Homo sapiens
ctgatattgccgcactagggga

SEQ ID NO: 4108897 - DNA, 21 bp, Homo sapiens
ctgatcagaggtgtacactaa

SEQ ID NO: 4108898 - DNA, 18 bp, Homo sapiens
ctgatcatcgccagaggt

SEQ ID NO: 4108899 - DNA, 15 bp, Homo sapiens
ctgatcatgcattgt

SEQ ID NO: 4108900 - DNA, 17 bp, Homo sapiens
ctgatcatgcattgttg

SEQ ID NO: 4108901 - DNA, 17 bp, Homo sapiens
ctgatcccatggccagg

SEQ ID NO: 4108902 - DNA, 20 bp, Homo sapiens
ctgatcccattttcctctga

SEQ ID NO: 4108903 - DNA, 17 bp, Homo sapiens
ctgatccctgatccctt

SEQ ID NO: 4108904 - DNA, 15 bp, Homo sapiens
ctgctcccattcctc

SEQ ID NO: 4108905 - DNA, 18 bp, Homo sapiens
ctgctcccattcctccct

SEQ ID NO: 4108906 - DNA, 20 bp, Homo sapiens
ctgctccccagccctggctc

SEQ ID NO: 4108907 - DNA, 17 bp, Homo sapiens
ctgctcccccttttccc

SEQ ID NO: 4108908 - DNA, 22 bp, Homo sapiens
ctgctccctaccccagggccct

SEQ ID NO: 4108909 - DNA, 23 bp, Homo sapiens
ctgctccctaccccagggccctg

SEQ ID NO: 4108910 - DNA, 18 bp, Homo sapiens
ctgctccgctgctccttg

SEQ ID NO: 4108911 - DNA, 13 bp, Homo sapiens
ctgctcctcatgg

SEQ ID NO: 4108912 - DNA, 10 bp, Homo sapiens
ctgctcctgc

SEQ ID NO: 4108913 - DNA, 11 bp, Homo sapiens
ctgctcctgct

SEQ ID NO: 4108914 - DNA, 17 bp, Homo sapiens
ctgctcctgcttttctg

SEQ ID NO: 4108915 - DNA, 23 bp, Homo sapiens
ctgctcctgcttttctgtcctgg

SEQ ID NO: 4108916 - DNA, 13 bp, Homo sapiens
ctgctcctggagc

SEQ ID NO: 4108917 - DNA, 19 bp, Homo sapiens
ctgctcctggagcctttga

SEQ ID NO: 4108918 - DNA, 12 bp, Homo sapiens
ctgctccttccc

SEQ ID NO: 4108919 - DNA, 16 bp, Homo sapiens
ctgctccttcccttgc

SEQ ID NO: 4108920 - DNA, 13 bp, Homo sapiens
ctgctccttggct

SEQ ID NO: 4108921 - DNA, 19 bp, Homo sapiens
ctgctccttggcttacctg

SEQ ID NO: 4108922 - DNA, 14 bp, Homo sapiens
ctgctcgccctcct

SEQ ID NO: 4108923 - DNA, 17 bp, Homo sapiens
ctgctcgccctcctttc

SEQ ID NO: 4108924 - DNA, 23 bp, Homo sapiens
ctgctcgccctcctttctgtgcc

SEQ ID NO: 4108925 - DNA, 16 bp, Homo sapiens
ctgctctagtgggaca

SEQ ID NO: 4108926 - DNA, 23 bp, Homo sapiens
ctgctctagtgggacagcccaga

SEQ ID NO: 4108927 - DNA, 11 bp, Homo sapiens
ctgctctgacg

SEQ ID NO: 4108928 - DNA, 12 bp, Homo sapiens
ctgctctgctcg

SEQ ID NO: 4108929 - DNA, 11 bp, Homo sapiens
ctgctctgctg

SEQ ID NO: 4108930 - DNA, 13 bp, Homo sapiens
ctgctctggaaaa

SEQ ID NO: 4108931 - DNA, 22 bp, Homo sapiens
ctgctctggaataaagttgcag

SEQ ID NO: 4108932 - DNA, 23 bp, Homo sapiens
ctgctctggaataaagttgcaga

SEQ ID NO: 4108933 - DNA, 18 bp, Homo sapiens
ctgctctggttgtttctg

SEQ ID NO: 4108934 - DNA, 21 bp, Homo sapiens
ctgctctttctacatgactgg

SEQ ID NO: 4108935 - DNA, 13 bp, Homo sapiens
ctgctcttttcct

SEQ ID NO: 4108936 - DNA, 11 bp, Homo sapiens
ctgctgaccaa

SEQ ID NO: 4108937 - DNA, 20 bp, Homo sapiens
ctgctgaccaattgtgctgc

SEQ ID NO: 4108938 - DNA, 15 bp, Homo sapiens
ctgctgagttggcct

SEQ ID NO: 4108939 - DNA, 16 bp, Homo sapiens
ctgctgagttggcctg

SEQ ID NO: 4108940 - DNA, 17 bp, Homo sapiens
ctgctgagttggcctgg

SEQ ID NO: 4108941 - DNA, 21 bp, Homo sapiens
ctgctgagttggcctggccat

SEQ ID NO: 4108942 - DNA, 11 bp, Homo sapiens
ctgctgcaccc

SEQ ID NO: 4108943 - DNA, 18 bp, Homo sapiens
ctgctgcacccaactact

SEQ ID NO: 4108944 - DNA, 13 bp, Homo sapiens
ctgctgcaccctg

SEQ ID NO: 4108945 - DNA, 23 bp, Homo sapiens
ctgctgcaccctgcgcctccaga

SEQ ID NO: 4108946 - DNA, 13 bp, Homo sapiens
ctgctgccagtgc

SEQ ID NO: 4108947 - DNA, 14 bp, Homo sapiens
ctgctgccagtgca

SEQ ID NO: 4108948 - DNA, 19 bp, Homo sapiens
ctgctgccagtgcagccac

SEQ ID NO: 4108949 - DNA, 21 bp, Homo sapiens
ctgctgccatgaactgtcaag

SEQ ID NO: 4108950 - DNA, 19 bp, Homo sapiens
ctgctgcccaggctgtgca

SEQ ID NO: 4108951 - DNA, 17 bp, Homo sapiens
ctgctgcccatgtttca

SEQ ID NO: 4108952 - DNA, 22 bp, Homo sapiens
ctgctgccccagctgactgtgg

SEQ ID NO: 4108953 - DNA, 14 bp, Homo sapiens
ctgctgcccccacc

SEQ ID NO: 4108954 - DNA, 17 bp, Homo sapiens
ctgctgcccctgcagtt

SEQ ID NO: 4108955 - DNA, 19 bp, Homo sapiens
ctgctgccgcccttcctgg

SEQ ID NO: 4108956 - DNA, 17 bp, Homo sapiens
ctgctgcctctttccct

SEQ ID NO: 4108957 - DNA, 11 bp, Homo sapiens
ctgctgcctgc

SEQ ID NO: 4108958 - DNA, 20 bp, Homo sapiens
ctgctgcgcccttaccttcc

SEQ ID NO: 4108959 - DNA, 17 bp, Homo sapiens
ctgctgcggaggagctg

SEQ ID NO: 4108960 - DNA, 20 bp, Homo sapiens
ctgctgctgcgcccttacct

SEQ ID NO: 4108961 - DNA, 14 bp, Homo sapiens
ctgctgctgtccct

SEQ ID NO: 4108962 - DNA, 13 bp, Homo sapiens
ctgctgctgtgtt

SEQ ID NO: 4108963 - DNA, 15 bp, Homo sapiens
ctgctggaggcctca

SEQ ID NO: 4108964 - DNA, 17 bp, Homo sapiens
ctgctggaggcctcagg

SEQ ID NO: 4108965 - DNA, 21 bp, Homo sapiens
ctgctggagtttcatgtacaa

SEQ ID NO: 4108966 - DNA, 17 bp, Homo sapiens
ctgctggcacccaccgt

SEQ ID NO: 4108967 - DNA, 15 bp, Homo sapiens
ctgctggcatcaaga

SEQ ID NO: 4108968 - DNA, 14 bp, Homo sapiens
ctgctggcctggat

SEQ ID NO: 4108969 - DNA, 12 bp, Homo sapiens
ctgctggctctt

SEQ ID NO: 4108970 - DNA, 19 bp, Homo sapiens
ctgctggctcttctgccca

SEQ ID NO: 4108971 - DNA, 12 bp, Homo sapiens
ctgctggctgcc

SEQ ID NO: 4108972 - DNA, 15 bp, Homo sapiens
ctgctggctgcctta

SEQ ID NO: 4108973 - DNA, 14 bp, Homo sapiens
ctgctggcttgcag

SEQ ID NO: 4108974 - DNA, 21 bp, Homo sapiens
ctgctgggagttctagaacca

SEQ ID NO: 4108975 - DNA, 14 bp, Homo sapiens
ctgctgggctgagt

SEQ ID NO: 4108976 - DNA, 16 bp, Homo sapiens
ctgctggtaacagtgg

SEQ ID NO: 4108977 - DNA, 20 bp, Homo sapiens
ctgctggtcacagcctcctc

SEQ ID NO: 4108978 - DNA, 19 bp, Homo sapiens
ctgctggtcacttcttctg

SEQ ID NO: 4108979 - DNA, 20 bp, Homo sapiens
ctgctggtcacttcttctgt

SEQ ID NO: 4108980 - DNA, 13 bp, Homo sapiens
ctgctggtgccag

SEQ ID NO: 4108981 - DNA, 23 bp, Homo sapiens
ctgctggtgccagggtgggtgtc

SEQ ID NO: 4108982 - DNA, 16 bp, Homo sapiens
ctgctgtacccagatg

SEQ ID NO: 4108983 - DNA, 19 bp, Homo sapiens
ctgctgtcattgcttcttc

SEQ ID NO: 4108984 - DNA, 20 bp, Homo sapiens
ctgctgtcattgcttcttct

SEQ ID NO: 4108985 - DNA, 22 bp, Homo sapiens
ctgctgtcattgcttcttctga

SEQ ID NO: 4108986 - DNA, 21 bp, Homo sapiens
ctgctgtcttccccaccgcag

SEQ ID NO: 4108987 - DNA, 14 bp, Homo sapiens
ctgctgtcttctgg

SEQ ID NO: 4108988 - DNA, 12 bp, Homo sapiens
ctgctgtcttgt

SEQ ID NO: 4108989 - DNA, 22 bp, Homo sapiens
ctgctgtgaaccctggggcctg

SEQ ID NO: 4108990 - DNA, 16 bp, Homo sapiens
ctgctgtgattccact

SEQ ID NO: 4108991 - DNA, 21 bp, Homo sapiens
ctgctgtgccatgctgggcca

SEQ ID NO: 4108992 - DNA, 20 bp, Homo sapiens
ctgctgtgcgtggaaaaaga

SEQ ID NO: 4108993 - DNA, 13 bp, Homo sapiens
ctgcttaattcaa

SEQ ID NO: 4108994 - DNA, 20 bp, Homo sapiens
ctgcttagaatccaaacttg

SEQ ID NO: 4108995 - DNA, 17 bp, Homo sapiens
ctgcttagctgccttga

SEQ ID NO: 4108996 - DNA, 12 bp, Homo sapiens
ctgcttccagga

SEQ ID NO: 4108997 - DNA, 16 bp, Homo sapiens
ctgcttctaagatgcc

SEQ ID NO: 4108998 - DNA, 16 bp, Homo sapiens
ctgcttctcatcccaa

SEQ ID NO: 4108999 - DNA, 16 bp, Homo sapiens
ctgcttctccaaggaa

SEQ ID NO: 4109000 - DNA, 19 bp, Homo sapiens
ctgcttctctgcccagctt

SEQ ID NO: 4109001 - DNA, 15 bp, Homo sapiens
ctgcttctgaactca

SEQ ID NO: 4109002 - DNA, 20 bp, Homo sapiens
ctgcttgcccaagtcacaca

SEQ ID NO: 4109003 - DNA, 19 bp, Homo sapiens
ctgctttaaagggcctgcc

SEQ ID NO: 4109004 - DNA, 17 bp, Homo sapiens
ctgctttctgttccaaa

SEQ ID NO: 4109005 - DNA, 20 bp, Homo sapiens
ctgctttgcaaacatcaacc

SEQ ID NO: 4109006 - DNA, 18 bp, Homo sapiens
ctgctttgcctctaccag

SEQ ID NO: 4109007 - DNA, 16 bp, Homo sapiens
ctgctttggcagtgcc

SEQ ID NO: 4109008 - DNA, 23 bp, Homo sapiens
ctgcctcagctgacccggcctct

SEQ ID NO: 4109009 - DNA, 23 bp, Homo sapiens
ctgcctcccaaggtcctctcagt

SEQ ID NO: 4109010 - DNA, 15 bp, Homo sapiens
ctgcctcctcgttcc

SEQ ID NO: 4109011 - DNA, 19 bp, Homo sapiens
ctgcctcctcgttcctttc

SEQ ID NO: 4109012 - DNA, 15 bp, Homo sapiens
ctgcctcctgccctt

SEQ ID NO: 4109013 - DNA, 17 bp, Homo sapiens
ctgcctcctgcctgccc

SEQ ID NO: 4109014 - DNA, 19 bp, Homo sapiens
ctgcctcctgcctgcccct

SEQ ID NO: 4109015 - DNA, 12 bp, Homo sapiens
ctgcctcctgcg

SEQ ID NO: 4109016 - DNA, 12 bp, Homo sapiens
ctgcctcctggg

SEQ ID NO: 4109017 - DNA, 18 bp, Homo sapiens
ctgcctcgaaacacagaa

SEQ ID NO: 4109018 - DNA, 14 bp, Homo sapiens
ctgcctcgctcacc

SEQ ID NO: 4109019 - DNA, 14 bp, Homo sapiens
ctgcctctgggcca

SEQ ID NO: 4109020 - DNA, 18 bp, Homo sapiens
ctgcctgacactgagccc

SEQ ID NO: 4109021 - DNA, 15 bp, Homo sapiens
ctgcctgcacccctg

SEQ ID NO: 4109022 - DNA, 12 bp, Homo sapiens
ctgcctgcacct

SEQ ID NO: 4109023 - DNA, 16 bp, Homo sapiens
ctgcctgcagcaggca

SEQ ID NO: 4109024 - DNA, 15 bp, Homo sapiens
ctgcctgccagctgc

SEQ ID NO: 4109025 - DNA, 21 bp, Homo sapiens
ctgcctgccagctgcactgat

SEQ ID NO: 4109026 - DNA, 20 bp, Homo sapiens
ctgcctgccccacacggact

SEQ ID NO: 4109027 - DNA, 15 bp, Homo sapiens
ctgcctgccccgccc

SEQ ID NO: 4109028 - DNA, 19 bp, Homo sapiens
ctgcctgccccgcccccag

SEQ ID NO: 4109029 - DNA, 18 bp, Homo sapiens
ctgcctgcttggcccggc

SEQ ID NO: 4109030 - DNA, 11 bp, Homo sapiens
ctgcctggagc

SEQ ID NO: 4109031 - DNA, 19 bp, Homo sapiens
ctgcctggagtgctgtgct

SEQ ID NO: 4109032 - DNA, 20 bp, Homo sapiens
ctgcctggagtgctgtgctg

SEQ ID NO: 4109033 - DNA, 13 bp, Homo sapiens
ctgcctggccagg

SEQ ID NO: 4109034 - DNA, 15 bp, Homo sapiens
ctgcctggccaggca

SEQ ID NO: 4109035 - DNA, 13 bp, Homo sapiens
ctgcctggcccct

SEQ ID NO: 4109036 - DNA, 13 bp, Homo sapiens
ctgcctgggaagg

SEQ ID NO: 4109037 - DNA, 16 bp, Homo sapiens
ctgcctgttctgagga

SEQ ID NO: 4109038 - DNA, 16 bp, Homo sapiens
ctgccttaaaaccaaa

SEQ ID NO: 4109039 - DNA, 19 bp, Homo sapiens
ctgccttaaaaccaaagag

SEQ ID NO: 4109040 - DNA, 19 bp, Homo sapiens
ctgccttaggcctacctga

SEQ ID NO: 4109041 - DNA, 23 bp, Homo sapiens
ctgccttagtctcagtttgtgtg

SEQ ID NO: 4109042 - DNA, 17 bp, Homo sapiens
ctgccttatcttgcacc

SEQ ID NO: 4109043 - DNA, 17 bp, Homo sapiens
ctgccttccctagcttt

SEQ ID NO: 4109044 - DNA, 17 bp, Homo sapiens
ctgccttctcctctctg

SEQ ID NO: 4109045 - DNA, 23 bp, Homo sapiens
ctgccttctttccatcaactccc

SEQ ID NO: 4109046 - DNA, 13 bp, Homo sapiens
ctgccttgagcta

SEQ ID NO: 4109047 - DNA, 22 bp, Homo sapiens
ctgccttgcccactcctgctct

SEQ ID NO: 4109048 - DNA, 18 bp, Homo sapiens
ctgccttgctcctagcag

SEQ ID NO: 4109049 - DNA, 23 bp, Homo sapiens
ctgccttgcttctgtatttcctt

SEQ ID NO: 4109050 - DNA, 23 bp, Homo sapiens
ctgccttggactgtgtttttcct

SEQ ID NO: 4109051 - DNA, 20 bp, Homo sapiens
ctgccttgggccttgctgct

SEQ ID NO: 4109052 - DNA, 21 bp, Homo sapiens
ctgccttgggccttgctgctg

SEQ ID NO: 4109053 - DNA, 21 bp, Homo sapiens
ctgcctttgacatttaattta

SEQ ID NO: 4109054 - DNA, 13 bp, Homo sapiens
ctgcgaacactga

SEQ ID NO: 4109055 - DNA, 19 bp, Homo sapiens
ctgcgatcttcagagcagg

SEQ ID NO: 4109056 - DNA, 20 bp, Homo sapiens
ctgcgatcttcagagcaggg

SEQ ID NO: 4109057 - DNA, 21 bp, Homo sapiens
ctgcgcaccaatgcccagcag

SEQ ID NO: 4109058 - DNA, 20 bp, Homo sapiens
ctgcgccagtcctgctacct

SEQ ID NO: 4109059 - DNA, 17 bp, Homo sapiens
ctgcgcccttaccttcc

SEQ ID NO: 4109060 - DNA, 14 bp, Homo sapiens
ctgcgcctccagag

SEQ ID NO: 4109061 - DNA, 17 bp, Homo sapiens
ctgcgcctccagaggtc

SEQ ID NO: 4109062 - DNA, 16 bp, Homo sapiens
ctgcgcctgcaggcag

SEQ ID NO: 4109063 - DNA, 21 bp, Homo sapiens
ctgcgcctgcaggcagagctg

SEQ ID NO: 4109064 - DNA, 16 bp, Homo sapiens
ctgcgcctgctgcctg

SEQ ID NO: 4109065 - DNA, 23 bp, Homo sapiens
ctgcgccttgggatggggagtcc

SEQ ID NO: 4109066 - DNA, 17 bp, Homo sapiens
ctgcgcttgcttttctg

SEQ ID NO: 4109067 - DNA, 19 bp, Homo sapiens
ctgcggggagacagaagcc

SEQ ID NO: 4109068 - DNA, 23 bp, Homo sapiens
ctgcgggtgaacaaagcagccac

SEQ ID NO: 4109069 - DNA, 14 bp, Homo sapiens
ctgcgggttttaat

SEQ ID NO: 4109070 - DNA, 22 bp, Homo sapiens
ctgcggtagatgggagggaggc

SEQ ID NO: 4109071 - DNA, 14 bp, Homo sapiens
ctgcgtcctcctca

SEQ ID NO: 4109072 - DNA, 24 bp, Homo sapiens
ctgcgtcctcctcacctcatgccc

SEQ ID NO: 4109073 - DNA, 19 bp, Homo sapiens
ctgcgtgacaataaaacat

SEQ ID NO: 4109074 - DNA, 16 bp, Homo sapiens
ctgcgttggtccagag

SEQ ID NO: 4109075 - DNA, 17 bp, Homo sapiens
ctgcgttggtccagagc

SEQ ID NO: 4109076 - DNA, 20 bp, Homo sapiens
ctgcgttttggaagctctga

SEQ ID NO: 4109077 - DNA, 22 bp, Homo sapiens
ctgctaaattctatgttaaata

SEQ ID NO: 4109078 - DNA, 14 bp, Homo sapiens
ctgctaacctggaa

SEQ ID NO: 4109079 - DNA, 22 bp, Homo sapiens
ctgctaagtaggggcagtgatg

SEQ ID NO: 4109080 - DNA, 16 bp, Homo sapiens
ctgctaataaaaccca

SEQ ID NO: 4109081 - DNA, 12 bp, Homo sapiens
ctgctacagcaa

SEQ ID NO: 4109082 - DNA, 20 bp, Homo sapiens
ctgctacagcaatttctaat

SEQ ID NO: 4109083 - DNA, 14 bp, Homo sapiens
ctgctacaggaggg

SEQ ID NO: 4109084 - DNA, 17 bp, Homo sapiens
ctgctacccagaaatca

SEQ ID NO: 4109085 - DNA, 21 bp, Homo sapiens
ctgctaccgttgacttccagg

SEQ ID NO: 4109086 - DNA, 18 bp, Homo sapiens
ctgctactgtaattttat

SEQ ID NO: 4109087 - DNA, 15 bp, Homo sapiens
ctgctaggcgagtgc

SEQ ID NO: 4109088 - DNA, 23 bp, Homo sapiens
ctgctaggcgagtgccaggactc

SEQ ID NO: 4109089 - DNA, 21 bp, Homo sapiens
ctgctatccccatctccctgc

SEQ ID NO: 4109090 - DNA, 23 bp, Homo sapiens
ctgctatccccatctccctgcct

SEQ ID NO: 4109091 - DNA, 19 bp, Homo sapiens
ctgctcaccacctgcctct

SEQ ID NO: 4109092 - DNA, 16 bp, Homo sapiens
ctgctcacccacctct

SEQ ID NO: 4109093 - DNA, 18 bp, Homo sapiens
ctgctcacccacctcttg

SEQ ID NO: 4109094 - DNA, 19 bp, Homo sapiens
ctgctcacccacctcttgt

SEQ ID NO: 4109095 - DNA, 18 bp, Homo sapiens
ctgctcactttaaacctg

SEQ ID NO: 4109096 - DNA, 17 bp, Homo sapiens
ctgctcagaacttgctg

SEQ ID NO: 4109097 - DNA, 11 bp, Homo sapiens
ctgctcagcca

SEQ ID NO: 4109098 - DNA, 14 bp, Homo sapiens
ctgctcagctctgg

SEQ ID NO: 4109099 - DNA, 22 bp, Homo sapiens
ctgctcagctctgggccattct

SEQ ID NO: 4109100 - DNA, 11 bp, Homo sapiens
ctgctccacca

SEQ ID NO: 4109101 - DNA, 13 bp, Homo sapiens
ctgctccaccaca

SEQ ID NO: 4109102 - DNA, 14 bp, Homo sapiens
ctgctccaccagca

SEQ ID NO: 4109103 - DNA, 13 bp, Homo sapiens
ctgctccaccctt

SEQ ID NO: 4109104 - DNA, 17 bp, Homo sapiens
ctgctccacccttggcc

SEQ ID NO: 4109105 - DNA, 21 bp, Homo sapiens
ctgctccacccttggcctgtc

SEQ ID NO: 4109106 - DNA, 13 bp, Homo sapiens
ctgctccagaaga

SEQ ID NO: 4109107 - DNA, 22 bp, Homo sapiens
ctgctccagacctgatcctgga

SEQ ID NO: 4109108 - DNA, 22 bp, Homo sapiens
ctgctccatttataaccccagc

SEQ ID NO: 4109109 - DNA, 18 bp, Homo sapiens
ctgctcccagcctgctga

SEQ ID NO: 4109110 - DNA, 20 bp, Homo sapiens
ctgctcccagcctgctgaga

SEQ ID NO: 4109111 - DNA, 17 bp, Homo sapiens
ctgctttgggctgccct

SEQ ID NO: 4109112 - DNA, 16 bp, Homo sapiens
ctgcttttctgccctg

SEQ ID NO: 4109113 - DNA, 19 bp, Homo sapiens
ctgcttttctgccctggct

SEQ ID NO: 4109114 - DNA, 20 bp, Homo sapiens
ctgcttttctgccctggctg

SEQ ID NO: 4109115 - DNA, 24 bp, Homo sapiens
ctgcttttctgccctggctgctgc

SEQ ID NO: 4109116 - DNA, 18 bp, Homo sapiens
ctggaaaagaagaaactt

SEQ ID NO: 4109117 - DNA, 18 bp, Homo sapiens
ctggaaagaggctctgga

SEQ ID NO: 4109118 - DNA, 19 bp, Homo sapiens
ctggaaagaggctctggac

SEQ ID NO: 4109119 - DNA, 16 bp, Homo sapiens
ctggaaaggggagagc

SEQ ID NO: 4109120 - DNA, 19 bp, Homo sapiens
ctggaaaggggagagcctg

SEQ ID NO: 4109121 - DNA, 20 bp, Homo sapiens
ctggaaaggggagagcctgc

SEQ ID NO: 4109122 - DNA, 21 bp, Homo sapiens
ctggaaaggggagagcctgct

SEQ ID NO: 4109123 - DNA, 22 bp, Homo sapiens
ctggaaaggggagagcctgctg

SEQ ID NO: 4109124 - DNA, 23 bp, Homo sapiens
ctggaaaggggagagcctgctgg

SEQ ID NO: 4109125 - DNA, 14 bp, Homo sapiens
ctggaacccagact

SEQ ID NO: 4109126 - DNA, 16 bp, Homo sapiens
ctggaacccagactca

SEQ ID NO: 4109127 - DNA, 12 bp, Homo sapiens
ctggaacctcag

SEQ ID NO: 4109128 - DNA, 18 bp, Homo sapiens
ctggaacctcagcctggc

SEQ ID NO: 4109129 - DNA, 20 bp, Homo sapiens
ctggaacctcagcctggcca

SEQ ID NO: 4109130 - DNA, 15 bp, Homo sapiens
ctggaaccttgctgt

SEQ ID NO: 4109131 - DNA, 17 bp, Homo sapiens
ctggaaccttgctgtcc

SEQ ID NO: 4109132 - DNA, 19 bp, Homo sapiens
ctggaaccttgctgtcctg

SEQ ID NO: 4109133 - DNA, 16 bp, Homo sapiens
ctggaactcctggcct

SEQ ID NO: 4109134 - DNA, 12 bp, Homo sapiens
ctggaagagagg

SEQ ID NO: 4109135 - DNA, 19 bp, Homo sapiens
ctggaagagctaggcaggg

SEQ ID NO: 4109136 - DNA, 20 bp, Homo sapiens
ctggaagagttggtctctgc

SEQ ID NO: 4109137 - DNA, 12 bp, Homo sapiens
ctggaagcccag

SEQ ID NO: 4109138 - DNA, 21 bp, Homo sapiens
ctggaagcccagcccctactg

SEQ ID NO: 4109139 - DNA, 16 bp, Homo sapiens
ctggaagccctggaga

SEQ ID NO: 4109140 - DNA, 17 bp, Homo sapiens
ctggaagctaatttgca

SEQ ID NO: 4109141 - DNA, 16 bp, Homo sapiens
ctggaagtccaatgtg

SEQ ID NO: 4109142 - DNA, 17 bp, Homo sapiens
ctggaagttttgcattt

SEQ ID NO: 4109143 - DNA, 23 bp, Homo sapiens
ctggaataaagttgcagatgatt

SEQ ID NO: 4109144 - DNA, 15 bp, Homo sapiens
ctggaataatttgta

SEQ ID NO: 4109145 - DNA, 19 bp, Homo sapiens
ctggaataatttgtaaatg

SEQ ID NO: 4109146 - DNA, 17 bp, Homo sapiens
ctggaatattgtgattc

SEQ ID NO: 4109147 - DNA, 18 bp, Homo sapiens
ctggaatctacaagccaa

SEQ ID NO: 4109148 - DNA, 20 bp, Homo sapiens
ctggaatgtaatcaatgttt

SEQ ID NO: 4109149 - DNA, 14 bp, Homo sapiens
ctggaattcttctg

SEQ ID NO: 4109150 - DNA, 19 bp, Homo sapiens
ctggaatttggacaagtgc

SEQ ID NO: 4109151 - DNA, 23 bp, Homo sapiens
ctggacacattggaatgccttgg

SEQ ID NO: 4109152 - DNA, 17 bp, Homo sapiens
ctggacacccctgctct

SEQ ID NO: 4109153 - DNA, 16 bp, Homo sapiens
ctggacagcagaagcc

SEQ ID NO: 4109154 - DNA, 20 bp, Homo sapiens
ctggacagcagaagcctcca

SEQ ID NO: 4109155 - DNA, 15 bp, Homo sapiens
ctggacagccccacc

SEQ ID NO: 4109156 - DNA, 13 bp, Homo sapiens
ctggacaggctct

SEQ ID NO: 4109157 - DNA, 17 bp, Homo sapiens
ctggacataacattttc

SEQ ID NO: 4109158 - DNA, 19 bp, Homo sapiens
ctggacctcatgttgttga

SEQ ID NO: 4109159 - DNA, 17 bp, Homo sapiens
ctggacctgcctcctgc

SEQ ID NO: 4109160 - DNA, 18 bp, Homo sapiens
ctggactctgcatcccag

SEQ ID NO: 4109161 - DNA, 14 bp, Homo sapiens
ctggactctgcccc

SEQ ID NO: 4109162 - DNA, 15 bp, Homo sapiens
ctggactctgcccca

SEQ ID NO: 4109163 - DNA, 22 bp, Homo sapiens
ctggactgaagcctgcaggagt

SEQ ID NO: 4109164 - DNA, 23 bp, Homo sapiens
ctggactgaagcctgcaggagtt

SEQ ID NO: 4109165 - DNA, 17 bp, Homo sapiens
ctggactggaggtgggc

SEQ ID NO: 4109166 - DNA, 19 bp, Homo sapiens
ctggactggaggtgggcat

SEQ ID NO: 4109167 - DNA, 22 bp, Homo sapiens
ctggactggaggtgggcatgcc

SEQ ID NO: 4109168 - DNA, 16 bp, Homo sapiens
ctggactgggaggtag

SEQ ID NO: 4109169 - DNA, 17 bp, Homo sapiens
ctggactgggaggtaga

SEQ ID NO: 4109170 - DNA, 23 bp, Homo sapiens
ctggacttctacctgccctcaag

SEQ ID NO: 4109171 - DNA, 16 bp, Homo sapiens
ctggacttctgtgggc

SEQ ID NO: 4109172 - DNA, 19 bp, Homo sapiens
ctggacttctgtgggcccc

SEQ ID NO: 4109173 - DNA, 18 bp, Homo sapiens
ctggactttgcttcccct

SEQ ID NO: 4109174 - DNA, 14 bp, Homo sapiens
ctggagaactagag

SEQ ID NO: 4109175 - DNA, 18 bp, Homo sapiens
ctggagaagctcacccaa

SEQ ID NO: 4109176 - DNA, 15 bp, Homo sapiens
ctggagaagctgatg

SEQ ID NO: 4109177 - DNA, 19 bp, Homo sapiens
ctggagaagctgatgcttt

SEQ ID NO: 4109178 - DNA, 16 bp, Homo sapiens
ctggagagaagtggaa

SEQ ID NO: 4109179 - DNA, 21 bp, Homo sapiens
ctggagaggttataggtcact

SEQ ID NO: 4109180 - DNA, 15 bp, Homo sapiens
ctggagcagaccacc

SEQ ID NO: 4109181 - DNA, 22 bp, Homo sapiens
ctggagcagaccaccccgcctg

SEQ ID NO: 4109182 - DNA, 16 bp, Homo sapiens
ctggagcaggagcccc

SEQ ID NO: 4109183 - DNA, 16 bp, Homo sapiens
ctggagcatgcagagg

SEQ ID NO: 4109184 - DNA, 22 bp, Homo sapiens
ctggagcatgcagaggaggtga

SEQ ID NO: 4109185 - DNA, 12 bp, Homo sapiens
ctggagccccca

SEQ ID NO: 4109186 - DNA, 23 bp, Homo sapiens
ctggagcccccagcagaggcagg

SEQ ID NO: 4109187 - DNA, 18 bp, Homo sapiens
ctggaggaaagggaggag

SEQ ID NO: 4109188 - DNA, 17 bp, Homo sapiens
ctggaggagcagcagct

SEQ ID NO: 4109189 - DNA, 15 bp, Homo sapiens
ctggaggaggcctgt

SEQ ID NO: 4109190 - DNA, 13 bp, Homo sapiens
ctggaggcccagt

SEQ ID NO: 4109191 - DNA, 19 bp, Homo sapiens
ctggaggcccctggagcca

SEQ ID NO: 4109192 - DNA, 18 bp, Homo sapiens
ctggaggccttccagctg

SEQ ID NO: 4109193 - DNA, 17 bp, Homo sapiens
ctggaggctgcctatgt

SEQ ID NO: 4109194 - DNA, 17 bp, Homo sapiens
ctggaggggagagcttt

SEQ ID NO: 4109195 - DNA, 18 bp, Homo sapiens
ctggaggggagagctttg

SEQ ID NO: 4109196 - DNA, 16 bp, Homo sapiens
ctggaggggtgtggct

SEQ ID NO: 4109197 - DNA, 19 bp, Homo sapiens
ctggaggtcacattcagga

SEQ ID NO: 4109198 - DNA, 14 bp, Homo sapiens
ctggaggtgggcat

SEQ ID NO: 4109199 - DNA, 15 bp, Homo sapiens
ctggaggtgggcatg

SEQ ID NO: 4109200 - DNA, 24 bp, Homo sapiens
ctggaggtgggcatgccaccctca

SEQ ID NO: 4109201 - DNA, 23 bp, Homo sapiens
ctggaggtggggcgaggcaggcc

SEQ ID NO: 4109202 - DNA, 23 bp, Homo sapiens
ctggagtcagatgagcaaggaca

SEQ ID NO: 4109203 - DNA, 12 bp, Homo sapiens
ctggagtgcagg

SEQ ID NO: 4109204 - DNA, 15 bp, Homo sapiens
ctggagtgcagtggc

SEQ ID NO: 4109205 - DNA, 19 bp, Homo sapiens
ctggagtgtggctgaggag

SEQ ID NO: 4109206 - DNA, 22 bp, Homo sapiens
ctggagtgtggctgaggaggcc

SEQ ID NO: 4109207 - DNA, 16 bp, Homo sapiens
ctggagttacattaat

SEQ ID NO: 4109208 - DNA, 21 bp, Homo sapiens
ctggagttccttatccctctc

SEQ ID NO: 4109209 - DNA, 22 bp, Homo sapiens
ctggagtttcatgtacaagatg

SEQ ID NO: 4109210 - DNA, 23 bp, Homo sapiens
ctggagtttttgtttggagagca

SEQ ID NO: 4109211 - DNA, 14 bp, Homo sapiens
ctggataacttagg

SEQ ID NO: 4109212 - DNA, 19 bp, Homo sapiens
ctggataggagcctgctgg

SEQ ID NO: 4109213 - DNA, 15 bp, Homo sapiens
ctggatattttcaaa

SEQ ID NO: 4109214 - DNA, 21 bp, Homo sapiens
ctggatattttcaaattgtat

SEQ ID NO: 4109215 - DNA, 20 bp, Homo sapiens
ctggatcacgacgctgcaga

SEQ ID NO: 4109216 - DNA, 17 bp, Homo sapiens
ctggatcagggaatcca

SEQ ID NO: 4109217 - DNA, 21 bp, Homo sapiens
ctggatcagtcctttgatcag

SEQ ID NO: 4109218 - DNA, 18 bp, Homo sapiens
ctggatcccctctgtcta

SEQ ID NO: 4109219 - DNA, 23 bp, Homo sapiens
ctggatcccctctgtctacaaat

SEQ ID NO: 4109220 - DNA, 23 bp, Homo sapiens
ctggatctatccctgcggcctcc

SEQ ID NO: 4109221 - DNA, 15 bp, Homo sapiens
ctggatctccccact

SEQ ID NO: 4109222 - DNA, 13 bp, Homo sapiens
ctggatctgcttg

SEQ ID NO: 4109223 - DNA, 13 bp, Homo sapiens
ctggatgaagatt

SEQ ID NO: 4109224 - DNA, 16 bp, Homo sapiens
ctggatgccagctgtg

SEQ ID NO: 4109225 - DNA, 20 bp, Homo sapiens
ctggatgccagctgtgtcct

SEQ ID NO: 4109226 - DNA, 21 bp, Homo sapiens
ctggatggatttgaagcaaag

SEQ ID NO: 4109227 - DNA, 18 bp, Homo sapiens
ctggattctgggaggcaa

SEQ ID NO: 4109228 - DNA, 16 bp, Homo sapiens
ctggcaaacatgaaaa

SEQ ID NO: 4109229 - DNA, 20 bp, Homo sapiens
ctggcaatagtgtgttctga

SEQ ID NO: 4109230 - DNA, 23 bp, Homo sapiens
ctggcactataatgtaagctcta

SEQ ID NO: 4109231 - DNA, 14 bp, Homo sapiens
ctggcactgggagg

SEQ ID NO: 4109232 - DNA, 22 bp, Homo sapiens
ctggcactggtttgttccctgt

SEQ ID NO: 4109233 - DNA, 16 bp, Homo sapiens
ctggcacttactggtc

SEQ ID NO: 4109234 - DNA, 24 bp, Homo sapiens
ctggcacttactggtccttaccag

SEQ ID NO: 4109235 - DNA, 20 bp, Homo sapiens
ctggcagagagatcttccca

SEQ ID NO: 4109236 - DNA, 18 bp, Homo sapiens
ctggcagccgtgccttca

SEQ ID NO: 4109237 - DNA, 14 bp, Homo sapiens
ctggcagcctccca

SEQ ID NO: 4109238 - DNA, 12 bp, Homo sapiens
ctggcagctctg

SEQ ID NO: 4109239 - DNA, 18 bp, Homo sapiens
ctggcagctctggacagc

SEQ ID NO: 4109240 - DNA, 20 bp, Homo sapiens
ctggcagctctggacagccc

SEQ ID NO: 4109241 - DNA, 12 bp, Homo sapiens
ctggcaggcagg

SEQ ID NO: 4109242 - DNA, 13 bp, Homo sapiens
ctggcaggcaggg

SEQ ID NO: 4109243 - DNA, 14 bp, Homo sapiens
ctggcaggccagtg

SEQ ID NO: 4109244 - DNA, 19 bp, Homo sapiens
ctggcagtttaaaaaaatt

SEQ ID NO: 4109245 - DNA, 20 bp, Homo sapiens
ctggcatgttcaaagccaca

SEQ ID NO: 4109246 - DNA, 18 bp, Homo sapiens
ctggcattagaattattt

SEQ ID NO: 4109247 - DNA, 20 bp, Homo sapiens
ctggcattagaattatttaa

SEQ ID NO: 4109248 - DNA, 14 bp, Homo sapiens
ctggccaaggggtg

SEQ ID NO: 4109249 - DNA, 16 bp, Homo sapiens
ctggccaccagccatc

SEQ ID NO: 4109250 - DNA, 14 bp, Homo sapiens
ctggccactaaagc

SEQ ID NO: 4109251 - DNA, 15 bp, Homo sapiens
ctggccagacacagg

SEQ ID NO: 4109252 - DNA, 19 bp, Homo sapiens
ctggccagacacaggccct

SEQ ID NO: 4109253 - DNA, 11 bp, Homo sapiens
ctggccagatt

SEQ ID NO: 4109254 - DNA, 15 bp, Homo sapiens
ctggccagcaccctc

SEQ ID NO: 4109255 - DNA, 12 bp, Homo sapiens
ctggccaggatg

SEQ ID NO: 4109256 - DNA, 17 bp, Homo sapiens
ctggccaggcactgcct

SEQ ID NO: 4109257 - DNA, 13 bp, Homo sapiens
ctggccaggcaga

SEQ ID NO: 4109258 - DNA, 14 bp, Homo sapiens
ctggccaggcagat

SEQ ID NO: 4109259 - DNA, 22 bp, Homo sapiens
ctggccaggccctgagagtctg

SEQ ID NO: 4109260 - DNA, 23 bp, Homo sapiens
ctggccaggccctgagagtctgg

SEQ ID NO: 4109261 - DNA, 13 bp, Homo sapiens
ctggccagggcca

SEQ ID NO: 4109262 - DNA, 23 bp, Homo sapiens
ctggccagggccacgctccagct

SEQ ID NO: 4109263 - DNA, 13 bp, Homo sapiens
ctggcccagccaa

SEQ ID NO: 4109264 - DNA, 17 bp, Homo sapiens
ctggcccagccaaaccc

SEQ ID NO: 4109265 - DNA, 11 bp, Homo sapiens
ctggcccaggg

SEQ ID NO: 4109266 - DNA, 12 bp, Homo sapiens
ctggcccagggc

SEQ ID NO: 4109267 - DNA, 13 bp, Homo sapiens
ctggcccagggcc

SEQ ID NO: 4109268 - DNA, 14 bp, Homo sapiens
ctggcccagggccc

SEQ ID NO: 4109269 - DNA, 16 bp, Homo sapiens
ctggcccagggcccag

SEQ ID NO: 4109270 - DNA, 19 bp, Homo sapiens
ctggcccagggcccagagc

SEQ ID NO: 4109271 - DNA, 18 bp, Homo sapiens
ctggcccatctcagcctc

SEQ ID NO: 4109272 - DNA, 12 bp, Homo sapiens
ctggccccacac

SEQ ID NO: 4109273 - DNA, 17 bp, Homo sapiens
ctggccccagcctgggc

SEQ ID NO: 4109274 - DNA, 16 bp, Homo sapiens
ctggccccaggacctg

SEQ ID NO: 4109275 - DNA, 15 bp, Homo sapiens
ctggccccagggcac

SEQ ID NO: 4109276 - DNA, 21 bp, Homo sapiens
ctggccccagtgcggttcctc

SEQ ID NO: 4109277 - DNA, 14 bp, Homo sapiens
ctggcccctcgcct

SEQ ID NO: 4109278 - DNA, 15 bp, Homo sapiens
ctggcccctcgcctg

SEQ ID NO: 4109279 - DNA, 14 bp, Homo sapiens
ctggccctgcctcc

SEQ ID NO: 4109280 - DNA, 12 bp, Homo sapiens
ctggccctggct

SEQ ID NO: 4109281 - DNA, 21 bp, Homo sapiens
ctggcccttacacactcaggc

SEQ ID NO: 4109282 - DNA, 14 bp, Homo sapiens
ctggcccttagaga

SEQ ID NO: 4109283 - DNA, 18 bp, Homo sapiens
ctggcccttagagacccc

SEQ ID NO: 4109284 - DNA, 17 bp, Homo sapiens
ctggccgagggtcctgg

SEQ ID NO: 4109285 - DNA, 19 bp, Homo sapiens
ctggccgagggtcctggct

SEQ ID NO: 4109286 - DNA, 16 bp, Homo sapiens
ctggccgagtccaagc

SEQ ID NO: 4109287 - DNA, 20 bp, Homo sapiens
ctggccgagtccaagctggg

SEQ ID NO: 4109288 - DNA, 13 bp, Homo sapiens
ctggccgccccct

SEQ ID NO: 4109289 - DNA, 14 bp, Homo sapiens
ctggccgccccctg

SEQ ID NO: 4109290 - DNA, 22 bp, Homo sapiens
ctggccgccccctgccccccag

SEQ ID NO: 4109291 - DNA, 20 bp, Homo sapiens
ctggcctaaaatcttggaag

SEQ ID NO: 4109292 - DNA, 20 bp, Homo sapiens
ctggcctctaccacaagggc

SEQ ID NO: 4109293 - DNA, 13 bp, Homo sapiens
ctggcctctcact

SEQ ID NO: 4109294 - DNA, 16 bp, Homo sapiens
ctggcctctgcctcca

SEQ ID NO: 4109295 - DNA, 21 bp, Homo sapiens
ctggcctctgcctccaccctc

SEQ ID NO: 4109296 - DNA, 17 bp, Homo sapiens
ctggcctctggctctca

SEQ ID NO: 4109297 - DNA, 22 bp, Homo sapiens
ctggcctggactgttttctctc

SEQ ID NO: 4109298 - DNA, 14 bp, Homo sapiens
ctggcctggatctc

SEQ ID NO: 4109299 - DNA, 15 bp, Homo sapiens
ctggcctggatctcc

SEQ ID NO: 4109300 - DNA, 19 bp, Homo sapiens
ctggccttgaaaccacctt

SEQ ID NO: 4109301 - DNA, 19 bp, Homo sapiens
ctggctacatcccagcctg

SEQ ID NO: 4109302 - DNA, 17 bp, Homo sapiens
ctggctagagtcctcac

SEQ ID NO: 4109303 - DNA, 20 bp, Homo sapiens
ctggctagagtcctcactcc

SEQ ID NO: 4109304 - DNA, 22 bp, Homo sapiens
ctggctcacagtacagcatgtg

SEQ ID NO: 4109305 - DNA, 20 bp, Homo sapiens
ctggctccagatgcagggca

SEQ ID NO: 4109306 - DNA, 11 bp, Homo sapiens
ctggctccagc

SEQ ID NO: 4109307 - DNA, 16 bp, Homo sapiens
ctggctccagcctgga

SEQ ID NO: 4109308 - DNA, 15 bp, Homo sapiens
ctggctcccacaggc

SEQ ID NO: 4109309 - DNA, 18 bp, Homo sapiens
ctggctcccacaggccct

SEQ ID NO: 4109310 - DNA, 18 bp, Homo sapiens
ctggctccccctccccag

SEQ ID NO: 4109311 - DNA, 19 bp, Homo sapiens
ctggctccccctccccagg

SEQ ID NO: 4109312 - DNA, 22 bp, Homo sapiens
ctggctccctcctccaggcctg

SEQ ID NO: 4109313 - DNA, 16 bp, Homo sapiens
ctggctcctaggggaa

SEQ ID NO: 4109314 - DNA, 17 bp, Homo sapiens
ctggctcctgaggggca

SEQ ID NO: 4109315 - DNA, 22 bp, Homo sapiens
ctggctctaccttcctgtccct

SEQ ID NO: 4109316 - DNA, 15 bp, Homo sapiens
ctggctcttctgccc

SEQ ID NO: 4109317 - DNA, 19 bp, Homo sapiens
ctgggcccctccacgcctc

SEQ ID NO: 4109318 - DNA, 22 bp, Homo sapiens
ctgggcccctccacgcctcctg

SEQ ID NO: 4109319 - DNA, 24 bp, Homo sapiens
ctgggcccctcttattcctctagg

SEQ ID NO: 4109320 - DNA, 14 bp, Homo sapiens
ctgggcccctggga

SEQ ID NO: 4109321 - DNA, 17 bp, Homo sapiens
ctgggcccctgggatgg

SEQ ID NO: 4109322 - DNA, 18 bp, Homo sapiens
ctgggcccggaagggctt

SEQ ID NO: 4109323 - DNA, 16 bp, Homo sapiens
ctgggccctctttccc

SEQ ID NO: 4109324 - DNA, 19 bp, Homo sapiens
ctgggccctctttccctgc

SEQ ID NO: 4109325 - DNA, 14 bp, Homo sapiens
ctgggcctctgact

SEQ ID NO: 4109326 - DNA, 16 bp, Homo sapiens
ctgggcctctgcccct

SEQ ID NO: 4109327 - DNA, 13 bp, Homo sapiens
ctgggcctgcaga

SEQ ID NO: 4109328 - DNA, 17 bp, Homo sapiens
ctgggcctttgtttcct

SEQ ID NO: 4109329 - DNA, 19 bp, Homo sapiens
ctgggctcccgtgtatctg

SEQ ID NO: 4109330 - DNA, 17 bp, Homo sapiens
ctgggctcctccagggt

SEQ ID NO: 4109331 - DNA, 13 bp, Homo sapiens
ctgggctgagtga

SEQ ID NO: 4109332 - DNA, 17 bp, Homo sapiens
ctgggctgccatgtgaa

SEQ ID NO: 4109333 - DNA, 15 bp, Homo sapiens
ctgggctggactgga

SEQ ID NO: 4109334 - DNA, 16 bp, Homo sapiens
ctgggctggactggag

SEQ ID NO: 4109335 - DNA, 15 bp, Homo sapiens
ctgggctggggccac

SEQ ID NO: 4109336 - DNA, 23 bp, Homo sapiens
ctgggctggggccaccatccctg

SEQ ID NO: 4109337 - DNA, 22 bp, Homo sapiens
ctgggctgggtttgctgtcttg

SEQ ID NO: 4109338 - DNA, 18 bp, Homo sapiens
ctgggctgtctgtcacca

SEQ ID NO: 4109339 - DNA, 12 bp, Homo sapiens
ctgggctgttgt

SEQ ID NO: 4109340 - DNA, 19 bp, Homo sapiens
ctgggcttatatgtacttt

SEQ ID NO: 4109341 - DNA, 20 bp, Homo sapiens
ctgggcttggcctgctgtga

SEQ ID NO: 4109342 - DNA, 20 bp, Homo sapiens
ctgggcttggggcttcctaa

SEQ ID NO: 4109343 - DNA, 17 bp, Homo sapiens
ctggggaaggagccagt

SEQ ID NO: 4109344 - DNA, 14 bp, Homo sapiens
ctggggacagaggg

SEQ ID NO: 4109345 - DNA, 14 bp, Homo sapiens
ctggggacagcttc

SEQ ID NO: 4109346 - DNA, 20 bp, Homo sapiens
ctggggaccccaacctcaga

SEQ ID NO: 4109347 - DNA, 14 bp, Homo sapiens
ctggggacctggca

SEQ ID NO: 4109348 - DNA, 21 bp, Homo sapiens
ctggggactgttccaaagcca

SEQ ID NO: 4109349 - DNA, 21 bp, Homo sapiens
ctggggactttatttatttct

SEQ ID NO: 4109350 - DNA, 15 bp, Homo sapiens
ctggggagcccgtct

SEQ ID NO: 4109351 - DNA, 20 bp, Homo sapiens
ctggggagcccgtctcagtg

SEQ ID NO: 4109352 - DNA, 15 bp, Homo sapiens
ctggggatgtgggag

SEQ ID NO: 4109353 - DNA, 14 bp, Homo sapiens
ctggggcagatccc

SEQ ID NO: 4109354 - DNA, 19 bp, Homo sapiens
ctggggcagcctctgggcc

SEQ ID NO: 4109355 - DNA, 15 bp, Homo sapiens
ctggggcaggctggg

SEQ ID NO: 4109356 - DNA, 17 bp, Homo sapiens
ctggggcaggctgggcc

SEQ ID NO: 4109357 - DNA, 18 bp, Homo sapiens
ctggggcaggctgggcca

SEQ ID NO: 4109358 - DNA, 21 bp, Homo sapiens
ctggggcaggctgggccatgt

SEQ ID NO: 4109359 - DNA, 19 bp, Homo sapiens
ctggggccaccatccctga

SEQ ID NO: 4109360 - DNA, 12 bp, Homo sapiens
ctggggccagag

SEQ ID NO: 4109361 - DNA, 14 bp, Homo sapiens
ctggggccagaggc

SEQ ID NO: 4109362 - DNA, 14 bp, Homo sapiens
ctggggcccagccc

SEQ ID NO: 4109363 - DNA, 17 bp, Homo sapiens
ctggggccctgggcctc

SEQ ID NO: 4109364 - DNA, 18 bp, Homo sapiens
ctggggccctgggcctca

SEQ ID NO: 4109365 - DNA, 12 bp, Homo sapiens
ctggggcctgac

SEQ ID NO: 4109366 - DNA, 15 bp, Homo sapiens
ctggggcctgagaga

SEQ ID NO: 4109367 - DNA, 16 bp, Homo sapiens
ctggggcctgagagaa

SEQ ID NO: 4109368 - DNA, 18 bp, Homo sapiens
ctggggcctggacctgcc

SEQ ID NO: 4109369 - DNA, 21 bp, Homo sapiens
ctggggctcacggggcctcca

SEQ ID NO: 4109370 - DNA, 20 bp, Homo sapiens
ctggggctcctttctccagc

SEQ ID NO: 4109371 - DNA, 23 bp, Homo sapiens
ctggggctcctttctccagccag

SEQ ID NO: 4109372 - DNA, 14 bp, Homo sapiens
ctggggctggcctc

SEQ ID NO: 4109373 - DNA, 18 bp, Homo sapiens
ctggggctggggtgagag

SEQ ID NO: 4109374 - DNA, 18 bp, Homo sapiens
ctggggctttgccttgca

SEQ ID NO: 4109375 - DNA, 13 bp, Homo sapiens
ctgggggaaaaag

SEQ ID NO: 4109376 - DNA, 22 bp, Homo sapiens
ctgggggactgggagtcagagc

SEQ ID NO: 4109377 - DNA, 19 bp, Homo sapiens
ctgggggagagaggcagca

SEQ ID NO: 4109378 - DNA, 18 bp, Homo sapiens
ctgggggagttttcctct

SEQ ID NO: 4109379 - DNA, 20 bp, Homo sapiens
ctgggggatagaggggctgc

SEQ ID NO: 4109380 - DNA, 19 bp, Homo sapiens
ctgggggccttgggtgagt

SEQ ID NO: 4109381 - DNA, 15 bp, Homo sapiens
ctggggggttggcag

SEQ ID NO: 4109382 - DNA, 16 bp, Homo sapiens
ctggggggttggcagc

SEQ ID NO: 4109383 - DNA, 20 bp, Homo sapiens
ctggggggttggcagcccac

SEQ ID NO: 4109384 - DNA, 16 bp, Homo sapiens
ctgggggtggcaggca

SEQ ID NO: 4109385 - DNA, 20 bp, Homo sapiens
ctggggtataaaactttcct

SEQ ID NO: 4109386 - DNA, 22 bp, Homo sapiens
ctggggtctggagttgatctgg

SEQ ID NO: 4109387 - DNA, 16 bp, Homo sapiens
ctggggtgagagagga

SEQ ID NO: 4109388 - DNA, 14 bp, Homo sapiens
ctggggtgcatctc

SEQ ID NO: 4109389 - DNA, 10 bp, Homo sapiens
ctggggtgtc

SEQ ID NO: 4109390 - DNA, 11 bp, Homo sapiens
ctggggtgtca

SEQ ID NO: 4109391 - DNA, 19 bp, Homo sapiens
ctggggttggcaacaggac

SEQ ID NO: 4109392 - DNA, 19 bp, Homo sapiens
ctgggtataagcagagagg

SEQ ID NO: 4109393 - DNA, 16 bp, Homo sapiens
ctgggtccccagccct

SEQ ID NO: 4109394 - DNA, 18 bp, Homo sapiens
ctgggtccttgcacccct

SEQ ID NO: 4109395 - DNA, 23 bp, Homo sapiens
ctgggtccttgcacccctcactc

SEQ ID NO: 4109396 - DNA, 16 bp, Homo sapiens
ctgggtcggccctgcc

SEQ ID NO: 4109397 - DNA, 19 bp, Homo sapiens
ctgggtcggccctgcccaa

SEQ ID NO: 4109398 - DNA, 15 bp, Homo sapiens
ctgggtctgtgtctc

SEQ ID NO: 4109399 - DNA, 13 bp, Homo sapiens
ctgggtgacagag

SEQ ID NO: 4109400 - DNA, 14 bp, Homo sapiens
ctgggtgacatttg

SEQ ID NO: 4109401 - DNA, 14 bp, Homo sapiens
ctgggtgcctccca

SEQ ID NO: 4109402 - DNA, 13 bp, Homo sapiens
ctgggtgctggga

SEQ ID NO: 4109403 - DNA, 13 bp, Homo sapiens
ctgggtggcctcg

SEQ ID NO: 4109404 - DNA, 19 bp, Homo sapiens
ctgggtggcctcgggacac

SEQ ID NO: 4109405 - DNA, 14 bp, Homo sapiens
ctgggtgggcccag

SEQ ID NO: 4109406 - DNA, 15 bp, Homo sapiens
ctgggtgggcccaga

SEQ ID NO: 4109407 - DNA, 14 bp, Homo sapiens
ctgggtggggacag

SEQ ID NO: 4109408 - DNA, 16 bp, Homo sapiens
ctgggtggggtgagga

SEQ ID NO: 4109409 - DNA, 16 bp, Homo sapiens
ctgggtggtaccctct

SEQ ID NO: 4109410 - DNA, 21 bp, Homo sapiens
ctgggtgtcatttcattccat

SEQ ID NO: 4109411 - DNA, 21 bp, Homo sapiens
ctgggttccctttccttccat

SEQ ID NO: 4109412 - DNA, 17 bp, Homo sapiens
ctgggttcttgttttat

SEQ ID NO: 4109413 - DNA, 16 bp, Homo sapiens
ctgggtttgctgtctt

SEQ ID NO: 4109414 - DNA, 14 bp, Homo sapiens
ctggtaagaaaaag

SEQ ID NO: 4109415 - DNA, 23 bp, Homo sapiens
ctggtaagaaaaagcaaaaggca

SEQ ID NO: 4109416 - DNA, 14 bp, Homo sapiens
ctggtagatagaaa

SEQ ID NO: 4109417 - DNA, 15 bp, Homo sapiens
ctggtagatagaaat

SEQ ID NO: 4109418 - DNA, 23 bp, Homo sapiens
ctggtagatagaaataaatagct

SEQ ID NO: 4109419 - DNA, 21 bp, Homo sapiens
ctggtagcataaataaaactg

SEQ ID NO: 4109420 - DNA, 15 bp, Homo sapiens
ctggtatctcagaaa

SEQ ID NO: 4109421 - DNA, 20 bp, Homo sapiens
ctggctctttcgtcaccctt

SEQ ID NO: 4109422 - DNA, 23 bp, Homo sapiens
ctggctctttcgtcacccttgga

SEQ ID NO: 4109423 - DNA, 13 bp, Homo sapiens
ctggctgcccaga

SEQ ID NO: 4109424 - DNA, 19 bp, Homo sapiens
ctggctgccccaacctgct

SEQ ID NO: 4109425 - DNA, 15 bp, Homo sapiens
ctggctgcccctcac

SEQ ID NO: 4109426 - DNA, 17 bp, Homo sapiens
ctggctgcccctcacct

SEQ ID NO: 4109427 - DNA, 21 bp, Homo sapiens
ctggctgcccctcaccttggg

SEQ ID NO: 4109428 - DNA, 23 bp, Homo sapiens
ctggctgcccctcaccttgggct

SEQ ID NO: 4109429 - DNA, 15 bp, Homo sapiens
ctggctgctgccccc

SEQ ID NO: 4109430 - DNA, 16 bp, Homo sapiens
ctggctgctgccccca

SEQ ID NO: 4109431 - DNA, 19 bp, Homo sapiens
ctggctgctgcccccaccc

SEQ ID NO: 4109432 - DNA, 17 bp, Homo sapiens
ctggctggaggagcagc

SEQ ID NO: 4109433 - DNA, 14 bp, Homo sapiens
ctggctggcctgag

SEQ ID NO: 4109434 - DNA, 13 bp, Homo sapiens
ctggctggctcct

SEQ ID NO: 4109435 - DNA, 12 bp, Homo sapiens
ctggctgggacg

SEQ ID NO: 4109436 - DNA, 16 bp, Homo sapiens
ctggctgggacgtggc

SEQ ID NO: 4109437 - DNA, 16 bp, Homo sapiens
ctggctgggccatcct

SEQ ID NO: 4109438 - DNA, 17 bp, Homo sapiens
ctggctgggttcaggtc

SEQ ID NO: 4109439 - DNA, 19 bp, Homo sapiens
ctggctgggttcaggtccc

SEQ ID NO: 4109440 - DNA, 16 bp, Homo sapiens
ctggctgtctagaatg

SEQ ID NO: 4109441 - DNA, 17 bp, Homo sapiens
ctggctgtctagaatgt

SEQ ID NO: 4109442 - DNA, 19 bp, Homo sapiens
ctggctgtttagcagaact

SEQ ID NO: 4109443 - DNA, 20 bp, Homo sapiens
ctggctgtttagcagaactc

SEQ ID NO: 4109444 - DNA, 16 bp, Homo sapiens
ctggcttccagcttca

SEQ ID NO: 4109445 - DNA, 17 bp, Homo sapiens
ctggcttccagcttcag

SEQ ID NO: 4109446 - DNA, 20 bp, Homo sapiens
ctggcttggggtcaagaaac

SEQ ID NO: 4109447 - DNA, 19 bp, Homo sapiens
ctggctttcccaggagatg

SEQ ID NO: 4109448 - DNA, 20 bp, Homo sapiens
ctggctttgcctcttctttg

SEQ ID NO: 4109449 - DNA, 20 bp, Homo sapiens
ctggcttttcactgctggct

SEQ ID NO: 4109450 - DNA, 20 bp, Homo sapiens
ctggctttttcctctgagcc

SEQ ID NO: 4109451 - DNA, 22 bp, Homo sapiens
ctggctttttcctctgagccca

SEQ ID NO: 4109452 - DNA, 16 bp, Homo sapiens
ctgggaaataagagag

SEQ ID NO: 4109453 - DNA, 19 bp, Homo sapiens
ctgggaaatgagaaggcag

SEQ ID NO: 4109454 - DNA, 20 bp, Homo sapiens
ctgggaaatgagaaggcagc

SEQ ID NO: 4109455 - DNA, 23 bp, Homo sapiens
ctgggaaatgagaaggcagccac

SEQ ID NO: 4109456 - DNA, 17 bp, Homo sapiens
ctgggaagataggctct

SEQ ID NO: 4109457 - DNA, 20 bp, Homo sapiens
ctgggaagataggctctgca

SEQ ID NO: 4109458 - DNA, 14 bp, Homo sapiens
ctgggaagatgagg

SEQ ID NO: 4109459 - DNA, 22 bp, Homo sapiens
ctgggaatgtattattctgcag

SEQ ID NO: 4109460 - DNA, 23 bp, Homo sapiens
ctgggaatgtattattctgcagc

SEQ ID NO: 4109461 - DNA, 16 bp, Homo sapiens
ctgggacacagaccca

SEQ ID NO: 4109462 - DNA, 19 bp, Homo sapiens
ctgggacacagacccagga

SEQ ID NO: 4109463 - DNA, 17 bp, Homo sapiens
ctgggacagggagcagc

SEQ ID NO: 4109464 - DNA, 12 bp, Homo sapiens
ctgggaccagag

SEQ ID NO: 4109465 - DNA, 18 bp, Homo sapiens
ctgggaccagagccagat

SEQ ID NO: 4109466 - DNA, 14 bp, Homo sapiens
ctgggacctcctta

SEQ ID NO: 4109467 - DNA, 19 bp, Homo sapiens
ctgggacggaccagcatct

SEQ ID NO: 4109468 - DNA, 16 bp, Homo sapiens
ctgggacgtggctcag

SEQ ID NO: 4109469 - DNA, 17 bp, Homo sapiens
ctgggacgtggctcagc

SEQ ID NO: 4109470 - DNA, 17 bp, Homo sapiens
ctgggacttccatgcct

SEQ ID NO: 4109471 - DNA, 12 bp, Homo sapiens
ctgggagacaga

SEQ ID NO: 4109472 - DNA, 17 bp, Homo sapiens
ctgggagactgggacac

SEQ ID NO: 4109473 - DNA, 18 bp, Homo sapiens
ctgggagactgggacacc

SEQ ID NO: 4109474 - DNA, 15 bp, Homo sapiens
ctgggagattcaagg

SEQ ID NO: 4109475 - DNA, 12 bp, Homo sapiens
ctgggagcagaa

SEQ ID NO: 4109476 - DNA, 15 bp, Homo sapiens
ctgggagccagtcct

SEQ ID NO: 4109477 - DNA, 13 bp, Homo sapiens
ctgggagcccaga

SEQ ID NO: 4109478 - DNA, 14 bp, Homo sapiens
ctgggaggagggag

SEQ ID NO: 4109479 - DNA, 17 bp, Homo sapiens
ctgggaggagggagagg

SEQ ID NO: 4109480 - DNA, 17 bp, Homo sapiens
ctgggaggagggggagg

SEQ ID NO: 4109481 - DNA, 17 bp, Homo sapiens
ctgggaggcaagaaaag

SEQ ID NO: 4109482 - DNA, 19 bp, Homo sapiens
ctgggaggcagggctctcc

SEQ ID NO: 4109483 - DNA, 22 bp, Homo sapiens
ctgggaggcatggccctggggt

SEQ ID NO: 4109484 - DNA, 19 bp, Homo sapiens
ctgggaggtcaaagctgca

SEQ ID NO: 4109485 - DNA, 17 bp, Homo sapiens
ctgggagtcacacagtg

SEQ ID NO: 4109486 - DNA, 22 bp, Homo sapiens
ctgggagtcacacagtgttgga

SEQ ID NO: 4109487 - DNA, 15 bp, Homo sapiens
ctgggagtcagagcc

SEQ ID NO: 4109488 - DNA, 19 bp, Homo sapiens
ctgggagtcagagccctgg

SEQ ID NO: 4109489 - DNA, 21 bp, Homo sapiens
ctgggagtcagagccctggct

SEQ ID NO: 4109490 - DNA, 19 bp, Homo sapiens
ctgggatatggctgcccag

SEQ ID NO: 4109491 - DNA, 20 bp, Homo sapiens
ctgggatatggctgcccagg

SEQ ID NO: 4109492 - DNA, 21 bp, Homo sapiens
ctgggatgagccgctgtgagc

SEQ ID NO: 4109493 - DNA, 22 bp, Homo sapiens
ctgggatgagccgctgtgagcc

SEQ ID NO: 4109494 - DNA, 14 bp, Homo sapiens
ctgggattaagaaa

SEQ ID NO: 4109495 - DNA, 20 bp, Homo sapiens
ctgggattacaggcatgagc

SEQ ID NO: 4109496 - DNA, 15 bp, Homo sapiens
ctgggattcccacca

SEQ ID NO: 4109497 - DNA, 17 bp, Homo sapiens
ctgggattctactttaa

SEQ ID NO: 4109498 - DNA, 18 bp, Homo sapiens
ctgggattctactttaag

SEQ ID NO: 4109499 - DNA, 21 bp, Homo sapiens
ctgggcaaagccacaaggctg

SEQ ID NO: 4109500 - DNA, 18 bp, Homo sapiens
ctgggcaacagagcaaga

SEQ ID NO: 4109501 - DNA, 15 bp, Homo sapiens
ctgggcacagctctt

SEQ ID NO: 4109502 - DNA, 20 bp, Homo sapiens
ctgggcacagctcttcacac

SEQ ID NO: 4109503 - DNA, 21 bp, Homo sapiens
ctgggcacgcctgctggccga

SEQ ID NO: 4109504 - DNA, 17 bp, Homo sapiens
ctgggcagccaggctgc

SEQ ID NO: 4109505 - DNA, 18 bp, Homo sapiens
ctgggcagccaggctgcc

SEQ ID NO: 4109506 - DNA, 16 bp, Homo sapiens
ctgggcagccccagag

SEQ ID NO: 4109507 - DNA, 18 bp, Homo sapiens
ctgggcagccccagagag

SEQ ID NO: 4109508 - DNA, 20 bp, Homo sapiens
ctgggcaggcggtccccatc

SEQ ID NO: 4109509 - DNA, 17 bp, Homo sapiens
ctgggcatgggtccagg

SEQ ID NO: 4109510 - DNA, 16 bp, Homo sapiens
ctgggcattgctttcc

SEQ ID NO: 4109511 - DNA, 17 bp, Homo sapiens
ctgggcattgctttcca

SEQ ID NO: 4109512 - DNA, 16 bp, Homo sapiens
ctgggcattttcctcc

SEQ ID NO: 4109513 - DNA, 18 bp, Homo sapiens
ctgggcattttcctcctc

SEQ ID NO: 4109514 - DNA, 23 bp, Homo sapiens
ctgggcattttcctcctctgcct

SEQ ID NO: 4109515 - DNA, 12 bp, Homo sapiens
ctgggccactgg

SEQ ID NO: 4109516 - DNA, 17 bp, Homo sapiens
ctgggccactggggact

SEQ ID NO: 4109517 - DNA, 18 bp, Homo sapiens
ctgggccagccctgcagc

SEQ ID NO: 4109518 - DNA, 20 bp, Homo sapiens
ctgggccagggtctgtgtga

SEQ ID NO: 4109519 - DNA, 22 bp, Homo sapiens
ctgggccagggtctgtgtgaat

SEQ ID NO: 4109520 - DNA, 17 bp, Homo sapiens
ctgggccatccttccgc

SEQ ID NO: 4109521 - DNA, 18 bp, Homo sapiens
ctgggcccacccaagcag

SEQ ID NO: 4109522 - DNA, 15 bp, Homo sapiens
ctgggcccaggggct

SEQ ID NO: 4109523 - DNA, 14 bp, Homo sapiens
ctgggcccctccac

SEQ ID NO: 4109524 - DNA, 20 bp, Homo sapiens
cttcctgcccttccctctgg

SEQ ID NO: 4109525 - DNA, 16 bp, Homo sapiens
cttcctgctacaggag

SEQ ID NO: 4109526 - DNA, 10 bp, Homo sapiens
cttcctgctg

SEQ ID NO: 4109527 - DNA, 13 bp, Homo sapiens
cttcctgctgcac

SEQ ID NO: 4109528 - DNA, 16 bp, Homo sapiens
cttcctgctgcaccct

SEQ ID NO: 4109529 - DNA, 13 bp, Homo sapiens
cttcctggaggct

SEQ ID NO: 4109530 - DNA, 20 bp, Homo sapiens
cttcctggaggctgcctatg

SEQ ID NO: 4109531 - DNA, 21 bp, Homo sapiens
cttcctggttttgtacactgc

SEQ ID NO: 4109532 - DNA, 24 bp, Homo sapiens
cttcctggttttgtacactgctgt

SEQ ID NO: 4109533 - DNA, 18 bp, Homo sapiens
cttcctgtccagctccaa

SEQ ID NO: 4109534 - DNA, 15 bp, Homo sapiens
cttcctgtccctgag

SEQ ID NO: 4109535 - DNA, 22 bp, Homo sapiens
cttcctgtgaagtttaattgtc

SEQ ID NO: 4109536 - DNA, 15 bp, Homo sapiens
cttcctgtgtcctga

SEQ ID NO: 4109537 - DNA, 14 bp, Homo sapiens
cttccttcctgctt

SEQ ID NO: 4109538 - DNA, 18 bp, Homo sapiens
cttccttctttgcccttt

SEQ ID NO: 4109539 - DNA, 20 bp, Homo sapiens
cttccttgagacacggagcc

SEQ ID NO: 4109540 - DNA, 23 bp, Homo sapiens
cttccttgagacacggagcccag

SEQ ID NO: 4109541 - DNA, 17 bp, Homo sapiens
cttccttgccagtcttt

SEQ ID NO: 4109542 - DNA, 16 bp, Homo sapiens
cttcctttctccagga

SEQ ID NO: 4109543 - DNA, 16 bp, Homo sapiens
cttccttttccctgct

SEQ ID NO: 4109544 - DNA, 22 bp, Homo sapiens
cttccttttccctgcttccagg

SEQ ID NO: 4109545 - DNA, 14 bp, Homo sapiens
cttcgactcaggat

SEQ ID NO: 4109546 - DNA, 16 bp, Homo sapiens
cttcgactcaggatcc

SEQ ID NO: 4109547 - DNA, 19 bp, Homo sapiens
cttcgcctttcccaccctc

SEQ ID NO: 4109548 - DNA, 23 bp, Homo sapiens
cttcgcctttcccaccctcctgc

SEQ ID NO: 4109549 - DNA, 13 bp, Homo sapiens
cttcgctggacta

SEQ ID NO: 4109550 - DNA, 17 bp, Homo sapiens
cttcgctggactattgt

SEQ ID NO: 4109551 - DNA, 16 bp, Homo sapiens
cttcggaggaccaggg

SEQ ID NO: 4109552 - DNA, 22 bp, Homo sapiens
cttcggagggcccctgcgtggg

SEQ ID NO: 4109553 - DNA, 16 bp, Homo sapiens
cttcggccgagctggt

SEQ ID NO: 4109554 - DNA, 19 bp, Homo sapiens
cttcggggcgatgctccct

SEQ ID NO: 4109555 - DNA, 21 bp, Homo sapiens
cttcggggcgatgctccctca

SEQ ID NO: 4109556 - DNA, 17 bp, Homo sapiens
cttcgttaactgtgtat

SEQ ID NO: 4109557 - DNA, 12 bp, Homo sapiens
cttctaaaaact

SEQ ID NO: 4109558 - DNA, 21 bp, Homo sapiens
cttctaaaacttgtatgttta

SEQ ID NO: 4109559 - DNA, 22 bp, Homo sapiens
cttctaaacttccccatcttct

SEQ ID NO: 4109560 - DNA, 13 bp, Homo sapiens
cttctaaatgcat

SEQ ID NO: 4109561 - DNA, 17 bp, Homo sapiens
cttctaatcttaaatca

SEQ ID NO: 4109562 - DNA, 13 bp, Homo sapiens
cttctaattattt

SEQ ID NO: 4109563 - DNA, 14 bp, Homo sapiens
cttctacctgccct

SEQ ID NO: 4109564 - DNA, 14 bp, Homo sapiens
cttctactcctgcc

SEQ ID NO: 4109565 - DNA, 18 bp, Homo sapiens
cttctactgagccttcag

SEQ ID NO: 4109566 - DNA, 16 bp, Homo sapiens
cttctagtcttggcca

SEQ ID NO: 4109567 - DNA, 15 bp, Homo sapiens
cttctatattttaat

SEQ ID NO: 4109568 - DNA, 20 bp, Homo sapiens
cttctatattttaatagaaa

SEQ ID NO: 4109569 - DNA, 15 bp, Homo sapiens
cttctatcccaggag

SEQ ID NO: 4109570 - DNA, 12 bp, Homo sapiens
cttctattttta

SEQ ID NO: 4109571 - DNA, 20 bp, Homo sapiens
cttctatttttatcatgaat

SEQ ID NO: 4109572 - DNA, 20 bp, Homo sapiens
cttctcaagactttagcttt

SEQ ID NO: 4109573 - DNA, 22 bp, Homo sapiens
cttctcacacacaactgtccat

SEQ ID NO: 4109574 - DNA, 19 bp, Homo sapiens
cttctcacttcaattaatg

SEQ ID NO: 4109575 - DNA, 13 bp, Homo sapiens
cttctcagaagca

SEQ ID NO: 4109576 - DNA, 22 bp, Homo sapiens
cttctcagaagcacagaatatt

SEQ ID NO: 4109577 - DNA, 17 bp, Homo sapiens
cttctcatcttgacaga

SEQ ID NO: 4109578 - DNA, 23 bp, Homo sapiens
cttctcatcttgacagagcctgc

SEQ ID NO: 4109579 - DNA, 15 bp, Homo sapiens
cttctccactggatg

SEQ ID NO: 4109580 - DNA, 13 bp, Homo sapiens
cttctccagattt

SEQ ID NO: 4109581 - DNA, 20 bp, Homo sapiens
cttctccaggtctcacgggc

SEQ ID NO: 4109582 - DNA, 16 bp, Homo sapiens
cttctcccacatgagg

SEQ ID NO: 4109583 - DNA, 13 bp, Homo sapiens
cttctcccagcac

SEQ ID NO: 4109584 - DNA, 15 bp, Homo sapiens
cttctcccagcacac

SEQ ID NO: 4109585 - DNA, 14 bp, Homo sapiens
cttctccgccagcc

SEQ ID NO: 4109586 - DNA, 17 bp, Homo sapiens
cttctccgccagcctcc

SEQ ID NO: 4109587 - DNA, 24 bp, Homo sapiens
cttctccgccagcctcctctggac

SEQ ID NO: 4109588 - DNA, 14 bp, Homo sapiens
cttctcctctctgg

SEQ ID NO: 4109589 - DNA, 15 bp, Homo sapiens
cttctcctctctggg

SEQ ID NO: 4109590 - DNA, 17 bp, Homo sapiens
cttctcctctctgggcc

SEQ ID NO: 4109591 - DNA, 16 bp, Homo sapiens
cttctccttccccagg

SEQ ID NO: 4109592 - DNA, 15 bp, Homo sapiens
cttctcggctcaggc

SEQ ID NO: 4109593 - DNA, 15 bp, Homo sapiens
cttctctccctgcca

SEQ ID NO: 4109594 - DNA, 16 bp, Homo sapiens
cttctctctccagggt

SEQ ID NO: 4109595 - DNA, 15 bp, Homo sapiens
cttctctgaacacag

SEQ ID NO: 4109596 - DNA, 16 bp, Homo sapiens
cttctctgaacacagg

SEQ ID NO: 4109597 - DNA, 17 bp, Homo sapiens
cttctctgaacacaggc

SEQ ID NO: 4109598 - DNA, 18 bp, Homo sapiens
cttctctgaacacaggca

SEQ ID NO: 4109599 - DNA, 19 bp, Homo sapiens
cttctctgaacacaggcag

SEQ ID NO: 4109600 - DNA, 11 bp, Homo sapiens
cttctctgctc

SEQ ID NO: 4109601 - DNA, 12 bp, Homo sapiens
cttctctgctcc

SEQ ID NO: 4109602 - DNA, 22 bp, Homo sapiens
cttctctgtgaacgatttagaa

SEQ ID NO: 4109603 - DNA, 20 bp, Homo sapiens
cttctcttgaaaagttcagg

SEQ ID NO: 4109604 - DNA, 15 bp, Homo sapiens
cttctcttgctttct

SEQ ID NO: 4109605 - DNA, 16 bp, Homo sapiens
cttctcttgctttcta

SEQ ID NO: 4109606 - DNA, 16 bp, Homo sapiens
cttctcttgttaggta

SEQ ID NO: 4109607 - DNA, 16 bp, Homo sapiens
cttctgaaatgtgacc

SEQ ID NO: 4109608 - DNA, 14 bp, Homo sapiens
cttctgaatatttt

SEQ ID NO: 4109609 - DNA, 13 bp, Homo sapiens
cttctgactgctg

SEQ ID NO: 4109610 - DNA, 17 bp, Homo sapiens
cttctgagctggcctct

SEQ ID NO: 4109611 - DNA, 22 bp, Homo sapiens
cttctgaggaccgctgataagc

SEQ ID NO: 4109612 - DNA, 22 bp, Homo sapiens
cttctgcaaaaatggatattat

SEQ ID NO: 4109613 - DNA, 23 bp, Homo sapiens
cttctgcaagcctcatgccaacc

SEQ ID NO: 4109614 - DNA, 18 bp, Homo sapiens
cttctgccctccctggag

SEQ ID NO: 4109615 - DNA, 12 bp, Homo sapiens
cttctgcctgca

SEQ ID NO: 4109616 - DNA, 18 bp, Homo sapiens
cttctgccttagtctcag

SEQ ID NO: 4109617 - DNA, 19 bp, Homo sapiens
cttctgccttagtctcagt

SEQ ID NO: 4109618 - DNA, 20 bp, Homo sapiens
cttctgccttagtctcagtt

SEQ ID NO: 4109619 - DNA, 21 bp, Homo sapiens
cttctgccttagtctcagttt

SEQ ID NO: 4109620 - DNA, 15 bp, Homo sapiens
cttctgctcagctct

SEQ ID NO: 4109621 - DNA, 18 bp, Homo sapiens
cttctgctcagctctggg

SEQ ID NO: 4109622 - DNA, 13 bp, Homo sapiens
cttctgctccacc

SEQ ID NO: 4109623 - DNA, 15 bp, Homo sapiens
cttctgctccaccct

SEQ ID NO: 4109624 - DNA, 17 bp, Homo sapiens
cttctgctccacccttg

SEQ ID NO: 4109625 - DNA, 21 bp, Homo sapiens
cttctgctccacccttggcct

SEQ ID NO: 4109626 - DNA, 23 bp, Homo sapiens
cttctgctccacccttggcctgt

SEQ ID NO: 4109627 - DNA, 18 bp, Homo sapiens
ctgtcgccccaggccctc

SEQ ID NO: 4109628 - DNA, 15 bp, Homo sapiens
ctgtcgctctcagtt

SEQ ID NO: 4109629 - DNA, 15 bp, Homo sapiens
ctgtcggagaggctg

SEQ ID NO: 4109630 - DNA, 15 bp, Homo sapiens
ctgtcgtgccagtcc

SEQ ID NO: 4109631 - DNA, 19 bp, Homo sapiens
ctgtcgtgccagtcctggg

SEQ ID NO: 4109632 - DNA, 13 bp, Homo sapiens
ctgtctaaccccc

SEQ ID NO: 4109633 - DNA, 19 bp, Homo sapiens
ctgtctaacccccagctgg

SEQ ID NO: 4109634 - DNA, 20 bp, Homo sapiens
ctgtctaacccccagctggg

SEQ ID NO: 4109635 - DNA, 21 bp, Homo sapiens
ctgtctaacccccagctgggt

SEQ ID NO: 4109636 - DNA, 24 bp, Homo sapiens
ctgtctaacccccagctgggtcta

SEQ ID NO: 4109637 - DNA, 15 bp, Homo sapiens
ctgtctagaatgtgg

SEQ ID NO: 4109638 - DNA, 17 bp, Homo sapiens
ctgtctagcacttcctt

SEQ ID NO: 4109639 - DNA, 18 bp, Homo sapiens
ctgtctcaagagggcact

SEQ ID NO: 4109640 - DNA, 22 bp, Homo sapiens
ctgtctcaagagggcactggtg

SEQ ID NO: 4109641 - DNA, 14 bp, Homo sapiens
ctgtctcagcctcc

SEQ ID NO: 4109642 - DNA, 15 bp, Homo sapiens
ctgtctcagcctccc

SEQ ID NO: 4109643 - DNA, 16 bp, Homo sapiens
ctgtctcatccccagg

SEQ ID NO: 4109644 - DNA, 21 bp, Homo sapiens
ctgtctcatccccaggggtcc

SEQ ID NO: 4109645 - DNA, 18 bp, Homo sapiens
ctgtctccatgtttgatg

SEQ ID NO: 4109646 - DNA, 13 bp, Homo sapiens
ctgtctcctagga

SEQ ID NO: 4109647 - DNA, 12 bp, Homo sapiens
ctgtctctgctc

SEQ ID NO: 4109648 - DNA, 17 bp, Homo sapiens
ctgtctctgctcgccct

SEQ ID NO: 4109649 - DNA, 21 bp, Homo sapiens
ctgtctctgctcgccctcctt

SEQ ID NO: 4109650 - DNA, 23 bp, Homo sapiens
ctgtctctttaagggcatgcctt

SEQ ID NO: 4109651 - DNA, 11 bp, Homo sapiens
ctgtctgcccc

SEQ ID NO: 4109652 - DNA, 13 bp, Homo sapiens
ctgtctgccccag

SEQ ID NO: 4109653 - DNA, 15 bp, Homo sapiens
ctgtctgccccagcc

SEQ ID NO: 4109654 - DNA, 14 bp, Homo sapiens
ctgtctgctccagc

SEQ ID NO: 4109655 - DNA, 19 bp, Homo sapiens
ctgtctgctccagctctgg

SEQ ID NO: 4109656 - DNA, 19 bp, Homo sapiens
ctgtctgctggtcacttct

SEQ ID NO: 4109657 - DNA, 20 bp, Homo sapiens
ctgtcttcctcaaaataaag

SEQ ID NO: 4109658 - DNA, 22 bp, Homo sapiens
ctgtcttgttgcggatggatgg

SEQ ID NO: 4109659 - DNA, 16 bp, Homo sapiens
ctgtctttcagataca

SEQ ID NO: 4109660 - DNA, 23 bp, Homo sapiens
ctgtgaaactggcactgaattaa

SEQ ID NO: 4109661 - DNA, 21 bp, Homo sapiens
ctgtgaacaggctgggctgct

SEQ ID NO: 4109662 - DNA, 19 bp, Homo sapiens
ctgtgaaccctggggcctg

SEQ ID NO: 4109663 - DNA, 16 bp, Homo sapiens
ctgtgaacgatttaga

SEQ ID NO: 4109664 - DNA, 18 bp, Homo sapiens
ctgtgaacgatttagaaa

SEQ ID NO: 4109665 - DNA, 19 bp, Homo sapiens
ctgtgaagacccagcagga

SEQ ID NO: 4109666 - DNA, 18 bp, Homo sapiens
ctgtgaagttacatgcat

SEQ ID NO: 4109667 - DNA, 21 bp, Homo sapiens
ctgtgaagttacatgcataaa

SEQ ID NO: 4109668 - DNA, 15 bp, Homo sapiens
ctgtgaatacaatta

SEQ ID NO: 4109669 - DNA, 22 bp, Homo sapiens
ctgtgaatacaattaaaggtcc

SEQ ID NO: 4109670 - DNA, 14 bp, Homo sapiens
ctgtgaattcagat

SEQ ID NO: 4109671 - DNA, 20 bp, Homo sapiens
ctgtgacaataagtttgaac

SEQ ID NO: 4109672 - DNA, 20 bp, Homo sapiens
ctgtgacatggtgcctgaga

SEQ ID NO: 4109673 - DNA, 20 bp, Homo sapiens
ctgtgaccagcactgtctca

SEQ ID NO: 4109674 - DNA, 23 bp, Homo sapiens
ctgtgaccaggaaggaagtcagc

SEQ ID NO: 4109675 - DNA, 14 bp, Homo sapiens
ctgtgaccatttat

SEQ ID NO: 4109676 - DNA, 15 bp, Homo sapiens
ctgtgacccccagct

SEQ ID NO: 4109677 - DNA, 14 bp, Homo sapiens
ctgtgactgatgtt

SEQ ID NO: 4109678 - DNA, 18 bp, Homo sapiens
ctgtgagaatagtggagg

SEQ ID NO: 4109679 - DNA, 14 bp, Homo sapiens
ctgtgagaccccca

SEQ ID NO: 4109680 - DNA, 18 bp, Homo sapiens
ctgtgagacccccacacc

SEQ ID NO: 4109681 - DNA, 19 bp, Homo sapiens
ctgtgagacccccacacct

SEQ ID NO: 4109682 - DNA, 23 bp, Homo sapiens
ctgtgagacccccacacctcagt

SEQ ID NO: 4109683 - DNA, 16 bp, Homo sapiens
ctgtgagaggcagcta

SEQ ID NO: 4109684 - DNA, 21 bp, Homo sapiens
ctgtgaggaatgctctgtgcc

SEQ ID NO: 4109685 - DNA, 15 bp, Homo sapiens
ctgtgaggcccctgg

SEQ ID NO: 4109686 - DNA, 15 bp, Homo sapiens
ctgtgagggagggga

SEQ ID NO: 4109687 - DNA, 15 bp, Homo sapiens
ctgtgaggtgctgat

SEQ ID NO: 4109688 - DNA, 17 bp, Homo sapiens
ctgtgaggtgctgatga

SEQ ID NO: 4109689 - DNA, 15 bp, Homo sapiens
ctgtgagtaaatatt

SEQ ID NO: 4109690 - DNA, 18 bp, Homo sapiens
ctgtgagtaaatattgag

SEQ ID NO: 4109691 - DNA, 15 bp, Homo sapiens
ctgtgagttctccct

SEQ ID NO: 4109692 - DNA, 18 bp, Homo sapiens
ctgtgagttctccctgta

SEQ ID NO: 4109693 - DNA, 22 bp, Homo sapiens
ctgtgagttctccctgtacagt

SEQ ID NO: 4109694 - DNA, 17 bp, Homo sapiens
ctgtgagtttaaagcaa

SEQ ID NO: 4109695 - DNA, 20 bp, Homo sapiens
ctgtgatcaatatttttata

SEQ ID NO: 4109696 - DNA, 18 bp, Homo sapiens
ctgtgatcttttaaagtg

SEQ ID NO: 4109697 - DNA, 19 bp, Homo sapiens
ctgtgatgacattccctgc

SEQ ID NO: 4109698 - DNA, 16 bp, Homo sapiens
ctgtgatgccacacag

SEQ ID NO: 4109699 - DNA, 17 bp, Homo sapiens
ctgtgatgccacacaga

SEQ ID NO: 4109700 - DNA, 19 bp, Homo sapiens
ctgtgcacaaaacccagac

SEQ ID NO: 4109701 - DNA, 22 bp, Homo sapiens
ctgtgcacaaaacccagacctg

SEQ ID NO: 4109702 - DNA, 15 bp, Homo sapiens
ctgtgcactgccctg

SEQ ID NO: 4109703 - DNA, 19 bp, Homo sapiens
ctgtgcagaataatggaaa

SEQ ID NO: 4109704 - DNA, 21 bp, Homo sapiens
ctgtgcagaataatggaaaca

SEQ ID NO: 4109705 - DNA, 15 bp, Homo sapiens
ctgtgcagatgagca

SEQ ID NO: 4109706 - DNA, 23 bp, Homo sapiens
ctgtgcagatgagcagtcacact

SEQ ID NO: 4109707 - DNA, 16 bp, Homo sapiens
ctgtgcagcacgtctc

SEQ ID NO: 4109708 - DNA, 21 bp, Homo sapiens
ctgtgcagcacgtctcagaga

SEQ ID NO: 4109709 - DNA, 21 bp, Homo sapiens
ctgtgcagcgcagctggactc

SEQ ID NO: 4109710 - DNA, 15 bp, Homo sapiens
ctgtgcagggctggt

SEQ ID NO: 4109711 - DNA, 17 bp, Homo sapiens
ctgtgcagggctggttt

SEQ ID NO: 4109712 - DNA, 18 bp, Homo sapiens
ctgtgcagtcactggagg

SEQ ID NO: 4109713 - DNA, 18 bp, Homo sapiens
ctgtgcatagtgctggga

SEQ ID NO: 4109714 - DNA, 14 bp, Homo sapiens
ctgtgcatgggtga

SEQ ID NO: 4109715 - DNA, 17 bp, Homo sapiens
ctgtgcatttctggttg

SEQ ID NO: 4109716 - DNA, 13 bp, Homo sapiens
ctgtgccacccac

SEQ ID NO: 4109717 - DNA, 22 bp, Homo sapiens
ctgtgccagaaacagtgggagc

SEQ ID NO: 4109718 - DNA, 23 bp, Homo sapiens
ctgtgccagaaacagtgggagcc

SEQ ID NO: 4109719 - DNA, 17 bp, Homo sapiens
ctgtgccagaggccaga

SEQ ID NO: 4109720 - DNA, 14 bp, Homo sapiens
ctgtgccatgctgg

SEQ ID NO: 4109721 - DNA, 15 bp, Homo sapiens
ctgtgccatgctggg

SEQ ID NO: 4109722 - DNA, 15 bp, Homo sapiens
ctgtgccatggattt

SEQ ID NO: 4109723 - DNA, 18 bp, Homo sapiens
ctgtgcccacatcccagg

SEQ ID NO: 4109724 - DNA, 21 bp, Homo sapiens
ctgtgccccatgcctgtccag

SEQ ID NO: 4109725 - DNA, 14 bp, Homo sapiens
ctgtgcctcccagc

SEQ ID NO: 4109726 - DNA, 14 bp, Homo sapiens
ctgtgcctggcccc

SEQ ID NO: 4109727 - DNA, 14 bp, Homo sapiens
ctgtgccttcagct

SEQ ID NO: 4109728 - DNA, 15 bp, Homo sapiens
ctgtgccttcagctg

SEQ ID NO: 4109729 - DNA, 19 bp, Homo sapiens
ctgtgccttcttttgatta

SEQ ID NO: 4109730 - DNA, 14 bp, Homo sapiens
ctgtatatactttt

SEQ ID NO: 4109731 - DNA, 15 bp, Homo sapiens
ctgtatatacttttt

SEQ ID NO: 4109732 - DNA, 17 bp, Homo sapiens
ctgtatcaagtcatggc

SEQ ID NO: 4109733 - DNA, 14 bp, Homo sapiens
ctgtatgcaaagtc

SEQ ID NO: 4109734 - DNA, 15 bp, Homo sapiens
ctgtatgctgatcat

SEQ ID NO: 4109735 - DNA, 22 bp, Homo sapiens
ctgtatgctgatcatcgccaga

SEQ ID NO: 4109736 - DNA, 15 bp, Homo sapiens
ctgtatggaaacact

SEQ ID NO: 4109737 - DNA, 17 bp, Homo sapiens
ctgtatggaaacactga

SEQ ID NO: 4109738 - DNA, 21 bp, Homo sapiens
ctgtatggaaacactgatttt

SEQ ID NO: 4109739 - DNA, 14 bp, Homo sapiens
ctgtattgtaacta

SEQ ID NO: 4109740 - DNA, 20 bp, Homo sapiens
ctgtatttaatggtttttat

SEQ ID NO: 4109741 - DNA, 23 bp, Homo sapiens
ctgtatttatgtgtgaggagctg

SEQ ID NO: 4109742 - DNA, 20 bp, Homo sapiens
ctgtatttttgttagtttac

SEQ ID NO: 4109743 - DNA, 21 bp, Homo sapiens
ctgtatttttttttctaagag

SEQ ID NO: 4109744 - DNA, 20 bp, Homo sapiens
ctgtcaaggctgcttagaat

SEQ ID NO: 4109745 - DNA, 19 bp, Homo sapiens
ctgtcaagttaacaaggaa

SEQ ID NO: 4109746 - DNA, 12 bp, Homo sapiens
ctgtcaataaac

SEQ ID NO: 4109747 - DNA, 23 bp, Homo sapiens
ctgtcaatttcattatcatcaag

SEQ ID NO: 4109748 - DNA, 13 bp, Homo sapiens
ctgtcacattgca

SEQ ID NO: 4109749 - DNA, 18 bp, Homo sapiens
ctgtcacattgcattcta

SEQ ID NO: 4109750 - DNA, 12 bp, Homo sapiens
ctgtcaccccca

SEQ ID NO: 4109751 - DNA, 21 bp, Homo sapiens
ctgtcacggggttccctccta

SEQ ID NO: 4109752 - DNA, 22 bp, Homo sapiens
ctgtcactcattgctgagcctc

SEQ ID NO: 4109753 - DNA, 23 bp, Homo sapiens
ctgtcactcattgctgagcctct

SEQ ID NO: 4109754 - DNA, 18 bp, Homo sapiens
ctgtcactggctggctcc

SEQ ID NO: 4109755 - DNA, 22 bp, Homo sapiens
ctgtcactggctggctcctagg

SEQ ID NO: 4109756 - DNA, 16 bp, Homo sapiens
ctgtcagtatgacatt

SEQ ID NO: 4109757 - DNA, 13 bp, Homo sapiens
ctgtcagtcacag

SEQ ID NO: 4109758 - DNA, 14 bp, Homo sapiens
ctgtcagtcacagc

SEQ ID NO: 4109759 - DNA, 17 bp, Homo sapiens
ctgtcagtcacagccac

SEQ ID NO: 4109760 - DNA, 17 bp, Homo sapiens
ctgtcagtgttaaagat

SEQ ID NO: 4109761 - DNA, 21 bp, Homo sapiens
ctgtcatctgtgcactgccca

SEQ ID NO: 4109762 - DNA, 16 bp, Homo sapiens
ctgtcattgcttcttc

SEQ ID NO: 4109763 - DNA, 16 bp, Homo sapiens
ctgtcatttgttgtga

SEQ ID NO: 4109764 - DNA, 19 bp, Homo sapiens
ctgtccaaaagcgccctca

SEQ ID NO: 4109765 - DNA, 20 bp, Homo sapiens
ctgtccaaaagcgccctcac

SEQ ID NO: 4109766 - DNA, 21 bp, Homo sapiens
ctgtccaaaagcgccctcact

SEQ ID NO: 4109767 - DNA, 22 bp, Homo sapiens
ctgtccaaaagcgccctcacta

SEQ ID NO: 4109768 - DNA, 21 bp, Homo sapiens
ctgtccaaaggaggctggcag

SEQ ID NO: 4109769 - DNA, 23 bp, Homo sapiens
ctgtccagattattggctgcttt

SEQ ID NO: 4109770 - DNA, 13 bp, Homo sapiens
ctgtccagcctgg

SEQ ID NO: 4109771 - DNA, 18 bp, Homo sapiens
ctgtccagctccaacctg

SEQ ID NO: 4109772 - DNA, 20 bp, Homo sapiens
ctgtccagctggggccagag

SEQ ID NO: 4109773 - DNA, 23 bp, Homo sapiens
ctgtccagctggggccagaggct

SEQ ID NO: 4109774 - DNA, 15 bp, Homo sapiens
ctgtccatggccttt

SEQ ID NO: 4109775 - DNA, 20 bp, Homo sapiens
ctgtcccaattctgcccgct

SEQ ID NO: 4109776 - DNA, 14 bp, Homo sapiens
ctgtcccacccaca

SEQ ID NO: 4109777 - DNA, 16 bp, Homo sapiens
ctgtcccacccacaca

SEQ ID NO: 4109778 - DNA, 22 bp, Homo sapiens
ctgtcccacccacacagctgcc

SEQ ID NO: 4109779 - DNA, 14 bp, Homo sapiens
ctgtcccaccccca

SEQ ID NO: 4109780 - DNA, 13 bp, Homo sapiens
ctgtcccacccct

SEQ ID NO: 4109781 - DNA, 17 bp, Homo sapiens
ctgtcccacccctagcc

SEQ ID NO: 4109782 - DNA, 19 bp, Homo sapiens
ctgtcccacccctagccac

SEQ ID NO: 4109783 - DNA, 15 bp, Homo sapiens
ctgtcccaccgggag

SEQ ID NO: 4109784 - DNA, 19 bp, Homo sapiens
ctgtcccaccgggagcctc

SEQ ID NO: 4109785 - DNA, 20 bp, Homo sapiens
ctgtcccactacatctggga

SEQ ID NO: 4109786 - DNA, 22 bp, Homo sapiens
ctgtcccagccccggcaagcca

SEQ ID NO: 4109787 - DNA, 18 bp, Homo sapiens
ctgtcccaggccggccca

SEQ ID NO: 4109788 - DNA, 15 bp, Homo sapiens
ctgtcccatgcaggc

SEQ ID NO: 4109789 - DNA, 18 bp, Homo sapiens
ctgtcccatgcaggccct

SEQ ID NO: 4109790 - DNA, 23 bp, Homo sapiens
ctgtccccagccctgtcctggtt

SEQ ID NO: 4109791 - DNA, 13 bp, Homo sapiens
ctgtcccccaggc

SEQ ID NO: 4109792 - DNA, 14 bp, Homo sapiens
ctgtcccccaggct

SEQ ID NO: 4109793 - DNA, 13 bp, Homo sapiens
ctgtccccctacc

SEQ ID NO: 4109794 - DNA, 15 bp, Homo sapiens
ctgtccccctaccca

SEQ ID NO: 4109795 - DNA, 20 bp, Homo sapiens
ctgtccccctcccctcccag

SEQ ID NO: 4109796 - DNA, 18 bp, Homo sapiens
ctgtccccgtgttgcatg

SEQ ID NO: 4109797 - DNA, 13 bp, Homo sapiens
ctgtccctcactg

SEQ ID NO: 4109798 - DNA, 15 bp, Homo sapiens
ctgtccctccccctt

SEQ ID NO: 4109799 - DNA, 18 bp, Homo sapiens
ctgtccctcccttgctga

SEQ ID NO: 4109800 - DNA, 15 bp, Homo sapiens
ctgtccctgaaacct

SEQ ID NO: 4109801 - DNA, 13 bp, Homo sapiens
ctgtccctgaggt

SEQ ID NO: 4109802 - DNA, 14 bp, Homo sapiens
ctgtccctgtcccc

SEQ ID NO: 4109803 - DNA, 19 bp, Homo sapiens
ctgtcccttcccccataag

SEQ ID NO: 4109804 - DNA, 13 bp, Homo sapiens
ctgtcccttgcct

SEQ ID NO: 4109805 - DNA, 17 bp, Homo sapiens
ctgtcccttgcctctgc

SEQ ID NO: 4109806 - DNA, 17 bp, Homo sapiens
ctgtcccttttccctta

SEQ ID NO: 4109807 - DNA, 22 bp, Homo sapiens
ctgtcctaaaccgtcccctcct

SEQ ID NO: 4109808 - DNA, 17 bp, Homo sapiens
ctgtcctaaggaacctt

SEQ ID NO: 4109809 - DNA, 21 bp, Homo sapiens
ctgtcctcagccttgccagag

SEQ ID NO: 4109810 - DNA, 22 bp, Homo sapiens
ctgtcctcagccttgccagaga

SEQ ID NO: 4109811 - DNA, 18 bp, Homo sapiens
ctgtcctcccatcccctg

SEQ ID NO: 4109812 - DNA, 22 bp, Homo sapiens
ctgtcctcccctattgcgctct

SEQ ID NO: 4109813 - DNA, 14 bp, Homo sapiens
ctgtcctctcccct

SEQ ID NO: 4109814 - DNA, 19 bp, Homo sapiens
ctgtcctctcccctccagc

SEQ ID NO: 4109815 - DNA, 20 bp, Homo sapiens
ctgtcctctcccctccagcc

SEQ ID NO: 4109816 - DNA, 21 bp, Homo sapiens
ctgtcctctcccctccagcct

SEQ ID NO: 4109817 - DNA, 22 bp, Homo sapiens
ctgtcctctcccctccagcctt

SEQ ID NO: 4109818 - DNA, 13 bp, Homo sapiens
ctgtcctctcgag

SEQ ID NO: 4109819 - DNA, 17 bp, Homo sapiens
ctgtcctctcgagccca

SEQ ID NO: 4109820 - DNA, 23 bp, Homo sapiens
ctgtcctgcagcaaacactccac

SEQ ID NO: 4109821 - DNA, 22 bp, Homo sapiens
ctgtcctgctcattatgccact

SEQ ID NO: 4109822 - DNA, 12 bp, Homo sapiens
ctgtcctgggca

SEQ ID NO: 4109823 - DNA, 14 bp, Homo sapiens
ctgtcctgggcatg

SEQ ID NO: 4109824 - DNA, 20 bp, Homo sapiens
ctgtcctgggcatgggtcca

SEQ ID NO: 4109825 - DNA, 16 bp, Homo sapiens
ctgtcctgtcctgctc

SEQ ID NO: 4109826 - DNA, 12 bp, Homo sapiens
ctgtcctgtgac

SEQ ID NO: 4109827 - DNA, 11 bp, Homo sapiens
ctgtccttaac

SEQ ID NO: 4109828 - DNA, 16 bp, Homo sapiens
ctgtccttcagatgga

SEQ ID NO: 4109829 - DNA, 13 bp, Homo sapiens
ctgtcctttcctt

SEQ ID NO: 4109830 - DNA, 15 bp, Homo sapiens
ctgtcctttcttgca

SEQ ID NO: 4109831 - DNA, 14 bp, Homo sapiens
ctgtcgagacactt

SEQ ID NO: 4109832 - DNA, 16 bp, Homo sapiens
ctgtcgccccaggccc

SEQ ID NO: 4109833 - DNA, 17 bp, Homo sapiens
ctggtatctcagaaagt

SEQ ID NO: 4109834 - DNA, 19 bp, Homo sapiens
ctggtatctcagaaagtgc

SEQ ID NO: 4109835 - DNA, 20 bp, Homo sapiens
ctggtattctgttctggagg

SEQ ID NO: 4109836 - DNA, 13 bp, Homo sapiens
ctggtcaaagaaa

SEQ ID NO: 4109837 - DNA, 16 bp, Homo sapiens
ctggtcacttcttctg

SEQ ID NO: 4109838 - DNA, 20 bp, Homo sapiens
ctggtcatttcccccaaagg

SEQ ID NO: 4109839 - DNA, 13 bp, Homo sapiens
ctggtccagggct

SEQ ID NO: 4109840 - DNA, 14 bp, Homo sapiens
ctggtccagggcta

SEQ ID NO: 4109841 - DNA, 19 bp, Homo sapiens
ctggtcccctccctctgtc

SEQ ID NO: 4109842 - DNA, 19 bp, Homo sapiens
ctggtcccggggccagcac

SEQ ID NO: 4109843 - DNA, 21 bp, Homo sapiens
ctggtccggacactcctagag

SEQ ID NO: 4109844 - DNA, 22 bp, Homo sapiens
ctggtccggacactcctagaga

SEQ ID NO: 4109845 - DNA, 19 bp, Homo sapiens
ctggtcctgagggtcccca

SEQ ID NO: 4109846 - DNA, 22 bp, Homo sapiens
ctggtctcaaacttgtggcctc

SEQ ID NO: 4109847 - DNA, 18 bp, Homo sapiens
ctggtctgaggatgtaga

SEQ ID NO: 4109848 - DNA, 18 bp, Homo sapiens
ctggtgaactgagctggg

SEQ ID NO: 4109849 - DNA, 20 bp, Homo sapiens
ctggtgaatcacctggctga

SEQ ID NO: 4109850 - DNA, 23 bp, Homo sapiens
ctggtgaatcacctggctgagca

SEQ ID NO: 4109851 - DNA, 20 bp, Homo sapiens
ctggtgaatggccttccttc

SEQ ID NO: 4109852 - DNA, 21 bp, Homo sapiens
ctggtgactgcgatcttcaga

SEQ ID NO: 4109853 - DNA, 13 bp, Homo sapiens
ctggtgagcatta

SEQ ID NO: 4109854 - DNA, 17 bp, Homo sapiens
ctggtgcattacagaga

SEQ ID NO: 4109855 - DNA, 12 bp, Homo sapiens
ctggtgccaaaa

SEQ ID NO: 4109856 - DNA, 14 bp, Homo sapiens
ctggtgccagggtg

SEQ ID NO: 4109857 - DNA, 12 bp, Homo sapiens
ctggtgccccac

SEQ ID NO: 4109858 - DNA, 15 bp, Homo sapiens
ctggtgccccacagc

SEQ ID NO: 4109859 - DNA, 14 bp, Homo sapiens
ctggtgcccggaga

SEQ ID NO: 4109860 - DNA, 15 bp, Homo sapiens
ctggtgcctggctct

SEQ ID NO: 4109861 - DNA, 16 bp, Homo sapiens
ctggtgcggatggaca

SEQ ID NO: 4109862 - DNA, 13 bp, Homo sapiens
ctggtgctgccac

SEQ ID NO: 4109863 - DNA, 18 bp, Homo sapiens
ctggtgctgtggccaggg

SEQ ID NO: 4109864 - DNA, 15 bp, Homo sapiens
ctggtggcacaggag

SEQ ID NO: 4109865 - DNA, 12 bp, Homo sapiens
ctggtggcacca

SEQ ID NO: 4109866 - DNA, 13 bp, Homo sapiens
ctggtggcaccag

SEQ ID NO: 4109867 - DNA, 20 bp, Homo sapiens
ctggtggcccgacagcctgg

SEQ ID NO: 4109868 - DNA, 22 bp, Homo sapiens
ctggtggcccgacagcctggca

SEQ ID NO: 4109869 - DNA, 15 bp, Homo sapiens
ctggtggtcagatgc

SEQ ID NO: 4109870 - DNA, 16 bp, Homo sapiens
ctggtgtgacctgagg

SEQ ID NO: 4109871 - DNA, 20 bp, Homo sapiens
ctggtgtgtggtgaggggct

SEQ ID NO: 4109872 - DNA, 21 bp, Homo sapiens
ctggtgtgtggtgaggggctt

SEQ ID NO: 4109873 - DNA, 22 bp, Homo sapiens
ctggtgtgtggtgaggggcttt

SEQ ID NO: 4109874 - DNA, 14 bp, Homo sapiens
ctggtgtttcttga

SEQ ID NO: 4109875 - DNA, 18 bp, Homo sapiens
ctggttactcagggttca

SEQ ID NO: 4109876 - DNA, 18 bp, Homo sapiens
ctggttcccgtttctcca

SEQ ID NO: 4109877 - DNA, 23 bp, Homo sapiens
ctggttcttgcaaatgggagctg

SEQ ID NO: 4109878 - DNA, 18 bp, Homo sapiens
ctggtttaattcagcaga

SEQ ID NO: 4109879 - DNA, 19 bp, Homo sapiens
ctggtttaattcagcagag

SEQ ID NO: 4109880 - DNA, 17 bp, Homo sapiens
ctggtttcctgcccagc

SEQ ID NO: 4109881 - DNA, 21 bp, Homo sapiens
ctggtttcctgcccagcctgg

SEQ ID NO: 4109882 - DNA, 17 bp, Homo sapiens
ctggtttgttctgactt

SEQ ID NO: 4109883 - DNA, 18 bp, Homo sapiens
ctggttttcctaaatgca

SEQ ID NO: 4109884 - DNA, 22 bp, Homo sapiens
ctggttttgtacactgctgtac

SEQ ID NO: 4109885 - DNA, 22 bp, Homo sapiens
ctgtaaaatgcatgattttgta

SEQ ID NO: 4109886 - DNA, 18 bp, Homo sapiens
ctgtaacaggtattttgt

SEQ ID NO: 4109887 - DNA, 23 bp, Homo sapiens
ctgtaacaggtattttgtttctt

SEQ ID NO: 4109888 - DNA, 17 bp, Homo sapiens
ctgtaagaagagactgg

SEQ ID NO: 4109889 - DNA, 20 bp, Homo sapiens
ctgtaatacgtagctctctt

SEQ ID NO: 4109890 - DNA, 19 bp, Homo sapiens
ctgtaatcatataataaat

SEQ ID NO: 4109891 - DNA, 19 bp, Homo sapiens
ctgtaatcccagctactcg

SEQ ID NO: 4109892 - DNA, 18 bp, Homo sapiens
ctgtaatcccagctactt

SEQ ID NO: 4109893 - DNA, 14 bp, Homo sapiens
ctgtaatctatgaa

SEQ ID NO: 4109894 - DNA, 21 bp, Homo sapiens
ctgtacacattcctgcattca

SEQ ID NO: 4109895 - DNA, 15 bp, Homo sapiens
ctgtacattgtggga

SEQ ID NO: 4109896 - DNA, 13 bp, Homo sapiens
ctgtacatttaaa

SEQ ID NO: 4109897 - DNA, 16 bp, Homo sapiens
ctgtacatttaaaatt

SEQ ID NO: 4109898 - DNA, 19 bp, Homo sapiens
ctgtacatttaaaattgct

SEQ ID NO: 4109899 - DNA, 23 bp, Homo sapiens
ctgtaccacagacacaatatgta

SEQ ID NO: 4109900 - DNA, 20 bp, Homo sapiens
ctgtacccagatgcctacaa

SEQ ID NO: 4109901 - DNA, 20 bp, Homo sapiens
ctgtaccttttgaggagccc

SEQ ID NO: 4109902 - DNA, 19 bp, Homo sapiens
ctgtactcctcccaggcgc

SEQ ID NO: 4109903 - DNA, 18 bp, Homo sapiens
ctgtactctggggtgctg

SEQ ID NO: 4109904 - DNA, 23 bp, Homo sapiens
ctgtactctggggtgctgcctga

SEQ ID NO: 4109905 - DNA, 20 bp, Homo sapiens
ctgtactgttctgtgtcttt

SEQ ID NO: 4109906 - DNA, 13 bp, Homo sapiens
ctgtacttaataa

SEQ ID NO: 4109907 - DNA, 15 bp, Homo sapiens
ctgtacttcaagtta

SEQ ID NO: 4109908 - DNA, 15 bp, Homo sapiens
ctgtagagttgctga

SEQ ID NO: 4109909 - DNA, 23 bp, Homo sapiens
ctgtagagttgctgagagggctc

SEQ ID NO: 4109910 - DNA, 16 bp, Homo sapiens
ctgtagataaataatg

SEQ ID NO: 4109911 - DNA, 18 bp, Homo sapiens
ctgtagattgcttctgta

SEQ ID NO: 4109912 - DNA, 20 bp, Homo sapiens
ctgtagcagtgagaaaaagc

SEQ ID NO: 4109913 - DNA, 14 bp, Homo sapiens
ctgtagccacagct

SEQ ID NO: 4109914 - DNA, 23 bp, Homo sapiens
ctgtagccacagctgctgttctc

SEQ ID NO: 4109915 - DNA, 18 bp, Homo sapiens
ctgtaggaaggttaatgt

SEQ ID NO: 4109916 - DNA, 21 bp, Homo sapiens
ctgtaggaaggttaatgttca

SEQ ID NO: 4109917 - DNA, 12 bp, Homo sapiens
ctgtaggcagca

SEQ ID NO: 4109918 - DNA, 14 bp, Homo sapiens
ctgtagggctggac

SEQ ID NO: 4109919 - DNA, 16 bp, Homo sapiens
ctgtagggctggacct

SEQ ID NO: 4109920 - DNA, 20 bp, Homo sapiens
ctgtagtaaactatttatct

SEQ ID NO: 4109921 - DNA, 18 bp, Homo sapiens
ctgtagtactccttaaga

SEQ ID NO: 4109922 - DNA, 21 bp, Homo sapiens
ctgtagtactccttaagaaca

SEQ ID NO: 4109923 - DNA, 17 bp, Homo sapiens
ctgtagtcatttactaa

SEQ ID NO: 4109924 - DNA, 22 bp, Homo sapiens
ctgtagtcatttactaaacata

SEQ ID NO: 4109925 - DNA, 18 bp, Homo sapiens
ctgtagtcccagccactc

SEQ ID NO: 4109926 - DNA, 14 bp, Homo sapiens
ctgtagtcccagct

SEQ ID NO: 4109927 - DNA, 14 bp, Homo sapiens
ctgtagtgtagtca

SEQ ID NO: 4109928 - DNA, 19 bp, Homo sapiens
ctgtagtgtagtcaggtgc

SEQ ID NO: 4109929 - DNA, 13 bp, Homo sapiens
ctgtagtttatgg

SEQ ID NO: 4109930 - DNA, 19 bp, Homo sapiens
ctgtataaataggagagga

SEQ ID NO: 4109931 - DNA, 15 bp, Homo sapiens
ctgtataagcactga

SEQ ID NO: 4109932 - DNA, 21 bp, Homo sapiens
ctgtataagcactgaaaaaca

SEQ ID NO: 4109933 - DNA, 15 bp, Homo sapiens
ctgtataagttattt

SEQ ID NO: 4109934 - DNA, 22 bp, Homo sapiens
ctgtataagttatttttgtaca

SEQ ID NO: 4109935 - DNA, 13 bp, Homo sapiens
ctgtatatacttt

SEQ ID NO: 4109936 - DNA, 20 bp, Homo sapiens
cttgggaaaaaaacttggca

SEQ ID NO: 4109937 - DNA, 22 bp, Homo sapiens
cttgggaaaaaaacttggcact

SEQ ID NO: 4109938 - DNA, 19 bp, Homo sapiens
cttgggacagccagagctg

SEQ ID NO: 4109939 - DNA, 18 bp, Homo sapiens
cttgggagagtcaggcag

SEQ ID NO: 4109940 - DNA, 19 bp, Homo sapiens
cttgggagagtcaggcagg

SEQ ID NO: 4109941 - DNA, 23 bp, Homo sapiens
cttgggaggctgaggcaggagaa

SEQ ID NO: 4109942 - DNA, 19 bp, Homo sapiens
cttgggatagtgttctgct

SEQ ID NO: 4109943 - DNA, 22 bp, Homo sapiens
cttgggatagtgttctgctcct

SEQ ID NO: 4109944 - DNA, 23 bp, Homo sapiens
cttgggatggggagtcccaaagc

SEQ ID NO: 4109945 - DNA, 17 bp, Homo sapiens
cttgggatttgctgtgt

SEQ ID NO: 4109946 - DNA, 15 bp, Homo sapiens
cttgggccctgcaca

SEQ ID NO: 4109947 - DNA, 21 bp, Homo sapiens
cttgggcctgggcctctgccc

SEQ ID NO: 4109948 - DNA, 16 bp, Homo sapiens
cttgggccttgctgct

SEQ ID NO: 4109949 - DNA, 19 bp, Homo sapiens
cttgggctgggggactggg

SEQ ID NO: 4109950 - DNA, 21 bp, Homo sapiens
cttggggagttaagacctggc

SEQ ID NO: 4109951 - DNA, 22 bp, Homo sapiens
cttggggagttaagacctggca

SEQ ID NO: 4109952 - DNA, 14 bp, Homo sapiens
cttggggcaagact

SEQ ID NO: 4109953 - DNA, 14 bp, Homo sapiens
cttggggcttccta

SEQ ID NO: 4109954 - DNA, 13 bp, Homo sapiens
cttgggggtcagg

SEQ ID NO: 4109955 - DNA, 18 bp, Homo sapiens
cttgggggttcaggcccg

SEQ ID NO: 4109956 - DNA, 23 bp, Homo sapiens
cttgggggttcaggcccggcagg

SEQ ID NO: 4109957 - DNA, 22 bp, Homo sapiens
cttggggtactcttgatgtgaa

SEQ ID NO: 4109958 - DNA, 23 bp, Homo sapiens
cttggggtcaggaacagtggctg

SEQ ID NO: 4109959 - DNA, 18 bp, Homo sapiens
cttgggtcattgacctct

SEQ ID NO: 4109960 - DNA, 21 bp, Homo sapiens
cttgggtcattgacctctcag

SEQ ID NO: 4109961 - DNA, 23 bp, Homo sapiens
cttgggtcccccacgtgacagtg

SEQ ID NO: 4109962 - DNA, 13 bp, Homo sapiens
cttgggtgggtga

SEQ ID NO: 4109963 - DNA, 15 bp, Homo sapiens
cttgggtgggtgaag

SEQ ID NO: 4109964 - DNA, 23 bp, Homo sapiens
cttggtactactagatgtcttta

SEQ ID NO: 4109965 - DNA, 15 bp, Homo sapiens
cttggtgactgtccc

SEQ ID NO: 4109966 - DNA, 16 bp, Homo sapiens
cttggtgactgtccca

SEQ ID NO: 4109967 - DNA, 16 bp, Homo sapiens
cttggtgctctgtgtt

SEQ ID NO: 4109968 - DNA, 13 bp, Homo sapiens
cttggtgtaattt

SEQ ID NO: 4109969 - DNA, 19 bp, Homo sapiens
cttggtgtgaccctctgaa

SEQ ID NO: 4109970 - DNA, 21 bp, Homo sapiens
cttggttatttgtttaccact

SEQ ID NO: 4109971 - DNA, 14 bp, Homo sapiens
cttggttcataaat

SEQ ID NO: 4109972 - DNA, 23 bp, Homo sapiens
cttgtaaagactggttttctgcc

SEQ ID NO: 4109973 - DNA, 18 bp, Homo sapiens
cttgtaaagactgtagaa

SEQ ID NO: 4109974 - DNA, 15 bp, Homo sapiens
cttgtaaatacacca

SEQ ID NO: 4109975 - DNA, 16 bp, Homo sapiens
cttgtaataaatactg

SEQ ID NO: 4109976 - DNA, 17 bp, Homo sapiens
cttgtaataaatactgc

SEQ ID NO: 4109977 - DNA, 13 bp, Homo sapiens
cttgtaattctaa

SEQ ID NO: 4109978 - DNA, 22 bp, Homo sapiens
cttgtacttgtttcatctggtt

SEQ ID NO: 4109979 - DNA, 21 bp, Homo sapiens
cttgtagaactcactctgggc

SEQ ID NO: 4109980 - DNA, 23 bp, Homo sapiens
cttgtagaactcactctgggctg

SEQ ID NO: 4109981 - DNA, 16 bp, Homo sapiens
cttgtagccatggctg

SEQ ID NO: 4109982 - DNA, 11 bp, Homo sapiens
cttgtatattt

SEQ ID NO: 4109983 - DNA, 14 bp, Homo sapiens
cttgtatatttgta

SEQ ID NO: 4109984 - DNA, 19 bp, Homo sapiens
cttgtatatttgtacaaaa

SEQ ID NO: 4109985 - DNA, 20 bp, Homo sapiens
cttgtatcaacactgttact

SEQ ID NO: 4109986 - DNA, 18 bp, Homo sapiens
cttgtcaaaagaaataat

SEQ ID NO: 4109987 - DNA, 19 bp, Homo sapiens
cttgtcaatatttaaacat

SEQ ID NO: 4109988 - DNA, 13 bp, Homo sapiens
cttgtcattgact

SEQ ID NO: 4109989 - DNA, 15 bp, Homo sapiens
cttgtccacccacct

SEQ ID NO: 4109990 - DNA, 12 bp, Homo sapiens
cttgtccagctg

SEQ ID NO: 4109991 - DNA, 22 bp, Homo sapiens
cttgtcccacgtgtcttccact

SEQ ID NO: 4109992 - DNA, 18 bp, Homo sapiens
cttgtcctacgtccaagg

SEQ ID NO: 4109993 - DNA, 18 bp, Homo sapiens
cttgtcctagcttgggag

SEQ ID NO: 4109994 - DNA, 20 bp, Homo sapiens
cttgtcgctttctcagtgtg

SEQ ID NO: 4109995 - DNA, 21 bp, Homo sapiens
cttgtcgctttctcagtgtgt

SEQ ID NO: 4109996 - DNA, 14 bp, Homo sapiens
cttgtcggctccag

SEQ ID NO: 4109997 - DNA, 20 bp, Homo sapiens
cttgtctccactaaatgagc

SEQ ID NO: 4109998 - DNA, 23 bp, Homo sapiens
cttgtctgattggctcacccaag

SEQ ID NO: 4109999 - DNA, 14 bp, Homo sapiens
cttgtcttttcaga

SEQ ID NO: 4110000 - DNA, 17 bp, Homo sapiens
cttgtgaaacacagctg

SEQ ID NO: 4110001 - DNA, 19 bp, Homo sapiens
cttgtgaaacacagctgtt

SEQ ID NO: 4110002 - DNA, 16 bp, Homo sapiens
cttgtgattgctgcca

SEQ ID NO: 4110003 - DNA, 17 bp, Homo sapiens
cttgtgattgctgccat

SEQ ID NO: 4110004 - DNA, 18 bp, Homo sapiens
cttgtgattgctgccata

SEQ ID NO: 4110005 - DNA, 23 bp, Homo sapiens
cttgtgatttctttaaaagaatg

SEQ ID NO: 4110006 - DNA, 22 bp, Homo sapiens
cttgtgcacaggcagagcccag

SEQ ID NO: 4110007 - DNA, 23 bp, Homo sapiens
cttgtgctttgctcttgtcccac

SEQ ID NO: 4110008 - DNA, 20 bp, Homo sapiens
cttgtggccccttttacttt

SEQ ID NO: 4110009 - DNA, 24 bp, Homo sapiens
cttgtgggtccatgctaacaaaga

SEQ ID NO: 4110010 - DNA, 12 bp, Homo sapiens
cttgtggtgtaa

SEQ ID NO: 4110011 - DNA, 20 bp, Homo sapiens
cttgtggtgtaaagctggcc

SEQ ID NO: 4110012 - DNA, 20 bp, Homo sapiens
cttgtggttttcaaattgga

SEQ ID NO: 4110013 - DNA, 20 bp, Homo sapiens
cttgtgtgtgggctgtgagt

SEQ ID NO: 4110014 - DNA, 14 bp, Homo sapiens
cttgtgtttgctta

SEQ ID NO: 4110015 - DNA, 18 bp, Homo sapiens
cttgtgtttgcttaaaca

SEQ ID NO: 4110016 - DNA, 22 bp, Homo sapiens
cttgtgtttgcttaaacaaagt

SEQ ID NO: 4110017 - DNA, 16 bp, Homo sapiens
cttgttaagatagtta

SEQ ID NO: 4110018 - DNA, 23 bp, Homo sapiens
cttgttagaaaacaaaattttat

SEQ ID NO: 4110019 - DNA, 17 bp, Homo sapiens
cttgttagcccttcaga

SEQ ID NO: 4110020 - DNA, 13 bp, Homo sapiens
cttgttatttata

SEQ ID NO: 4110021 - DNA, 15 bp, Homo sapiens
cttgttatttataac

SEQ ID NO: 4110022 - DNA, 13 bp, Homo sapiens
cttgttccagctc

SEQ ID NO: 4110023 - DNA, 16 bp, Homo sapiens
cttgttccagctcttt

SEQ ID NO: 4110024 - DNA, 21 bp, Homo sapiens
cttgttccccactgacagcct

SEQ ID NO: 4110025 - DNA, 15 bp, Homo sapiens
cttgttctgggctca

SEQ ID NO: 4110026 - DNA, 16 bp, Homo sapiens
cttgttgtttgctttg

SEQ ID NO: 4110027 - DNA, 18 bp, Homo sapiens
cttgtttatcagatacat

SEQ ID NO: 4110028 - DNA, 21 bp, Homo sapiens
cttgtttatcagatacatcac

SEQ ID NO: 4110029 - DNA, 13 bp, Homo sapiens
cttgtttatgata

SEQ ID NO: 4110030 - DNA, 16 bp, Homo sapiens
cttgtttatgatattt

SEQ ID NO: 4110031 - DNA, 20 bp, Homo sapiens
cttgtttgagtttttcctcc

SEQ ID NO: 4110032 - DNA, 22 bp, Homo sapiens
cttgtttgagtttttcctccca

SEQ ID NO: 4110033 - DNA, 22 bp, Homo sapiens
cttgtttggtttggtttgcttt

SEQ ID NO: 4110034 - DNA, 13 bp, Homo sapiens
cttgttttaagca

SEQ ID NO: 4110035 - DNA, 23 bp, Homo sapiens
cttgttttaagcaaatgcattct

SEQ ID NO: 4110036 - DNA, 14 bp, Homo sapiens
cttgttttatatac

SEQ ID NO: 4110037 - DNA, 18 bp, Homo sapiens
cttgttttcttgccaatg

SEQ ID NO: 4110038 - DNA, 14 bp, Homo sapiens
cttgatgaagcaag

SEQ ID NO: 4110039 - DNA, 18 bp, Homo sapiens
cttgatgaccaaagtcct

SEQ ID NO: 4110040 - DNA, 19 bp, Homo sapiens
cttgatggtgacagctgca

SEQ ID NO: 4110041 - DNA, 15 bp, Homo sapiens
cttgatgtgaagata

SEQ ID NO: 4110042 - DNA, 23 bp, Homo sapiens
cttgatgtgaagataatttgcat

SEQ ID NO: 4110043 - DNA, 21 bp, Homo sapiens
cttgattaagattttacaaaa

SEQ ID NO: 4110044 - DNA, 13 bp, Homo sapiens
cttgattcctggt

SEQ ID NO: 4110045 - DNA, 21 bp, Homo sapiens
cttgattcctggtttgactca

SEQ ID NO: 4110046 - DNA, 21 bp, Homo sapiens
cttgattctgcagtaaatctt

SEQ ID NO: 4110047 - DNA, 22 bp, Homo sapiens
cttgattctgcagtaaatcttt

SEQ ID NO: 4110048 - DNA, 13 bp, Homo sapiens
cttgatttgatgt

SEQ ID NO: 4110049 - DNA, 13 bp, Homo sapiens
cttgatttgcatg

SEQ ID NO: 4110050 - DNA, 16 bp, Homo sapiens
cttgcaaatgggagct

SEQ ID NO: 4110051 - DNA, 17 bp, Homo sapiens
cttgcaatcttctactt

SEQ ID NO: 4110052 - DNA, 16 bp, Homo sapiens
cttgcacccctcactc

SEQ ID NO: 4110053 - DNA, 18 bp, Homo sapiens
cttgcacccctcactctg

SEQ ID NO: 4110054 - DNA, 20 bp, Homo sapiens
cttgcacccctcactctggc

SEQ ID NO: 4110055 - DNA, 13 bp, Homo sapiens
cttgcagccacat

SEQ ID NO: 4110056 - DNA, 18 bp, Homo sapiens
cttgcagccacatggccc

SEQ ID NO: 4110057 - DNA, 19 bp, Homo sapiens
cttgcaggggtcccccctc

SEQ ID NO: 4110058 - DNA, 15 bp, Homo sapiens
cttgcagtcatcaga

SEQ ID NO: 4110059 - DNA, 17 bp, Homo sapiens
cttgcagtcatcagaag

SEQ ID NO: 4110060 - DNA, 20 bp, Homo sapiens
cttgcataataagctaaaga

SEQ ID NO: 4110061 - DNA, 15 bp, Homo sapiens
cttgcattcattttc

SEQ ID NO: 4110062 - DNA, 16 bp, Homo sapiens
cttgcattcattttct

SEQ ID NO: 4110063 - DNA, 12 bp, Homo sapiens
cttgcattccca

SEQ ID NO: 4110064 - DNA, 16 bp, Homo sapiens
cttgcattcccagtgg

SEQ ID NO: 4110065 - DNA, 18 bp, Homo sapiens
cttgcattgaatatatta

SEQ ID NO: 4110066 - DNA, 18 bp, Homo sapiens
cttgccaagctttcttct

SEQ ID NO: 4110067 - DNA, 22 bp, Homo sapiens
cttgccaatgaggtctgaaatg

SEQ ID NO: 4110068 - DNA, 13 bp, Homo sapiens
cttgccaccccac

SEQ ID NO: 4110069 - DNA, 20 bp, Homo sapiens
cttgccaccccaccctccct

SEQ ID NO: 4110070 - DNA, 22 bp, Homo sapiens
cttgccaccccaccctccctgg

SEQ ID NO: 4110071 - DNA, 12 bp, Homo sapiens
cttgccagagat

SEQ ID NO: 4110072 - DNA, 21 bp, Homo sapiens
cttgcccaagtcacacagcta

SEQ ID NO: 4110073 - DNA, 23 bp, Homo sapiens
cttgcccactcctgctctgctcg

SEQ ID NO: 4110074 - DNA, 16 bp, Homo sapiens
cttgcccatcctgact

SEQ ID NO: 4110075 - DNA, 18 bp, Homo sapiens
cttgcccatcctgactga

SEQ ID NO: 4110076 - DNA, 17 bp, Homo sapiens
cttgcccatgctgggct

SEQ ID NO: 4110077 - DNA, 15 bp, Homo sapiens
cttgcctcaatgcca

SEQ ID NO: 4110078 - DNA, 12 bp, Homo sapiens
cttgcctcccca

SEQ ID NO: 4110079 - DNA, 20 bp, Homo sapiens
cttgcctccccatttcccat

SEQ ID NO: 4110080 - DNA, 17 bp, Homo sapiens
cttgcctctgccctgga

SEQ ID NO: 4110081 - DNA, 15 bp, Homo sapiens
cttgcctgctgggct

SEQ ID NO: 4110082 - DNA, 17 bp, Homo sapiens
cttgcctgctgggctcc

SEQ ID NO: 4110083 - DNA, 13 bp, Homo sapiens
cttgcctggggtc

SEQ ID NO: 4110084 - DNA, 17 bp, Homo sapiens
cttgcctgtctggctca

SEQ ID NO: 4110085 - DNA, 23 bp, Homo sapiens
cttgccttaaacactcaccttct

SEQ ID NO: 4110086 - DNA, 20 bp, Homo sapiens
cttgctccctgtgtccacct

SEQ ID NO: 4110087 - DNA, 23 bp, Homo sapiens
cttgctcccttcagcccccagcc

SEQ ID NO: 4110088 - DNA, 20 bp, Homo sapiens
cttgctcgctgtaaaatctt

SEQ ID NO: 4110089 - DNA, 14 bp, Homo sapiens
cttgctctcctcat

SEQ ID NO: 4110090 - DNA, 15 bp, Homo sapiens
cttgctctcctcatc

SEQ ID NO: 4110091 - DNA, 16 bp, Homo sapiens
cttgctctcctcatct

SEQ ID NO: 4110092 - DNA, 19 bp, Homo sapiens
cttgctctcctcatctcca

SEQ ID NO: 4110093 - DNA, 20 bp, Homo sapiens
cttgctctgtcccccaggct

SEQ ID NO: 4110094 - DNA, 22 bp, Homo sapiens
cttgctctgttacccaggctgg

SEQ ID NO: 4110095 - DNA, 17 bp, Homo sapiens
cttgctgaacacacaca

SEQ ID NO: 4110096 - DNA, 18 bp, Homo sapiens
cttgctgagctgtttata

SEQ ID NO: 4110097 - DNA, 21 bp, Homo sapiens
cttgctgagtggcgcaaggcc

SEQ ID NO: 4110098 - DNA, 14 bp, Homo sapiens
cttgctgcagcctg

SEQ ID NO: 4110099 - DNA, 17 bp, Homo sapiens
cttgctgctgctgcacc

SEQ ID NO: 4110100 - DNA, 22 bp, Homo sapiens
cttgctggctacgcctcttctg

SEQ ID NO: 4110101 - DNA, 19 bp, Homo sapiens
cttgctgtatgctgatcat

SEQ ID NO: 4110102 - DNA, 13 bp, Homo sapiens
cttgctgtcctga

SEQ ID NO: 4110103 - DNA, 13 bp, Homo sapiens
cttgctgtctctg

SEQ ID NO: 4110104 - DNA, 16 bp, Homo sapiens
cttgcttaaatttctt

SEQ ID NO: 4110105 - DNA, 19 bp, Homo sapiens
cttgcttctctagctctct

SEQ ID NO: 4110106 - DNA, 18 bp, Homo sapiens
cttgcttctgtatttcct

SEQ ID NO: 4110107 - DNA, 15 bp, Homo sapiens
cttgcttcttactga

SEQ ID NO: 4110108 - DNA, 15 bp, Homo sapiens
cttgctttcctgggc

SEQ ID NO: 4110109 - DNA, 11 bp, Homo sapiens
cttgctttcta

SEQ ID NO: 4110110 - DNA, 13 bp, Homo sapiens
cttgctttgattt

SEQ ID NO: 4110111 - DNA, 12 bp, Homo sapiens
cttgctttttgc

SEQ ID NO: 4110112 - DNA, 16 bp, Homo sapiens
cttggaagtacatgaa

SEQ ID NO: 4110113 - DNA, 22 bp, Homo sapiens
cttggacaagacaaaccaagtc

SEQ ID NO: 4110114 - DNA, 15 bp, Homo sapiens
cttggacaggagtca

SEQ ID NO: 4110115 - DNA, 19 bp, Homo sapiens
cttggaccatgccagattc

SEQ ID NO: 4110116 - DNA, 23 bp, Homo sapiens
cttggagaatgtgagaagccagc

SEQ ID NO: 4110117 - DNA, 22 bp, Homo sapiens
cttggagccaatggagactgtc

SEQ ID NO: 4110118 - DNA, 14 bp, Homo sapiens
cttggagggaccaa

SEQ ID NO: 4110119 - DNA, 23 bp, Homo sapiens
cttggagggatggagaggcggcc

SEQ ID NO: 4110120 - DNA, 13 bp, Homo sapiens
cttggaggtcaca

SEQ ID NO: 4110121 - DNA, 18 bp, Homo sapiens
cttggaggtcacagctgg

SEQ ID NO: 4110122 - DNA, 22 bp, Homo sapiens
cttggaggtcacagctggatct

SEQ ID NO: 4110123 - DNA, 22 bp, Homo sapiens
cttggagtttttcattgtcgct

SEQ ID NO: 4110124 - DNA, 15 bp, Homo sapiens
cttggattctctaac

SEQ ID NO: 4110125 - DNA, 16 bp, Homo sapiens
cttggcaaaagccttg

SEQ ID NO: 4110126 - DNA, 17 bp, Homo sapiens
cttggcaaaagccttgt

SEQ ID NO: 4110127 - DNA, 21 bp, Homo sapiens
cttggcaaaagccttgtgtat

SEQ ID NO: 4110128 - DNA, 14 bp, Homo sapiens
cttggccaagagaa

SEQ ID NO: 4110129 - DNA, 16 bp, Homo sapiens
cttggccaagagaagg

SEQ ID NO: 4110130 - DNA, 14 bp, Homo sapiens
cttggccctttcct

SEQ ID NO: 4110131 - DNA, 15 bp, Homo sapiens
cttggccctttcctt

SEQ ID NO: 4110132 - DNA, 20 bp, Homo sapiens
cttggccctttccttccaga

SEQ ID NO: 4110133 - DNA, 21 bp, Homo sapiens
cttggcgtggagccagggagc

SEQ ID NO: 4110134 - DNA, 12 bp, Homo sapiens
cttggctgaccc

SEQ ID NO: 4110135 - DNA, 14 bp, Homo sapiens
cttggctgacccct

SEQ ID NO: 4110136 - DNA, 17 bp, Homo sapiens
cttggctgactggggct

SEQ ID NO: 4110137 - DNA, 21 bp, Homo sapiens
cttggctgtgaggcccctgga

SEQ ID NO: 4110138 - DNA, 17 bp, Homo sapiens
cttggcttacctgacct

SEQ ID NO: 4110139 - DNA, 24 bp, Homo sapiens
cttggcttacctgacctcttgctg

SEQ ID NO: 4110140 - DNA, 16 bp, Homo sapiens
cttggcttttctagcc

SEQ ID NO: 4110141 - DNA, 17 bp, Homo sapiens
cttctgctcttttcctg

SEQ ID NO: 4110142 - DNA, 15 bp, Homo sapiens
cttctgctggataaa

SEQ ID NO: 4110143 - DNA, 15 bp, Homo sapiens
cttctgcttaggaga

SEQ ID NO: 4110144 - DNA, 18 bp, Homo sapiens
cttctgcttaggagagac

SEQ ID NO: 4110145 - DNA, 20 bp, Homo sapiens
cttctgcttttctgccctgg

SEQ ID NO: 4110146 - DNA, 16 bp, Homo sapiens
cttctggaatttgttc

SEQ ID NO: 4110147 - DNA, 16 bp, Homo sapiens
cttctggggcaggctg

SEQ ID NO: 4110148 - DNA, 22 bp, Homo sapiens
cttctggggcaggctgggccat

SEQ ID NO: 4110149 - DNA, 18 bp, Homo sapiens
cttctggtgttgactgga

SEQ ID NO: 4110150 - DNA, 14 bp, Homo sapiens
cttctgtccccagc

SEQ ID NO: 4110151 - DNA, 16 bp, Homo sapiens
cttctgtccccagccc

SEQ ID NO: 4110152 - DNA, 22 bp, Homo sapiens
cttctgtccccagccctgtcct

SEQ ID NO: 4110153 - DNA, 17 bp, Homo sapiens
cttctgtgaaatataat

SEQ ID NO: 4110154 - DNA, 22 bp, Homo sapiens
cttctgtgagacccccacacct

SEQ ID NO: 4110155 - DNA, 13 bp, Homo sapiens
cttctgtggctca

SEQ ID NO: 4110156 - DNA, 22 bp, Homo sapiens
cttctgtggctcacagaaccct

SEQ ID NO: 4110157 - DNA, 13 bp, Homo sapiens
cttctgtgggccc

SEQ ID NO: 4110158 - DNA, 13 bp, Homo sapiens
cttctgtgtcaca

SEQ ID NO: 4110159 - DNA, 13 bp, Homo sapiens
cttcttaaatatc

SEQ ID NO: 4110160 - DNA, 19 bp, Homo sapiens
cttcttaaatatcttttat

SEQ ID NO: 4110161 - DNA, 13 bp, Homo sapiens
cttcttacatgca

SEQ ID NO: 4110162 - DNA, 15 bp, Homo sapiens
cttcttacatgcatt

SEQ ID NO: 4110163 - DNA, 16 bp, Homo sapiens
cttcttatacatttga

SEQ ID NO: 4110164 - DNA, 22 bp, Homo sapiens
cttcttatggaattgatttgca

SEQ ID NO: 4110165 - DNA, 23 bp, Homo sapiens
cttcttatggaattgatttgcat

SEQ ID NO: 4110166 - DNA, 14 bp, Homo sapiens
cttcttcaaataca

SEQ ID NO: 4110167 - DNA, 19 bp, Homo sapiens
cttcttcaaatacaaagta

SEQ ID NO: 4110168 - DNA, 15 bp, Homo sapiens
cttcttcacccagct

SEQ ID NO: 4110169 - DNA, 16 bp, Homo sapiens
cttcttcattctatca

SEQ ID NO: 4110170 - DNA, 14 bp, Homo sapiens
cttcttctgaaaga

SEQ ID NO: 4110171 - DNA, 12 bp, Homo sapiens
cttcttgaaggt

SEQ ID NO: 4110172 - DNA, 23 bp, Homo sapiens
cttcttggtgcttacacatctca

SEQ ID NO: 4110173 - DNA, 17 bp, Homo sapiens
cttcttgtgattgctgc

SEQ ID NO: 4110174 - DNA, 13 bp, Homo sapiens
cttcttgttcccc

SEQ ID NO: 4110175 - DNA, 15 bp, Homo sapiens
cttcttgtttccttg

SEQ ID NO: 4110176 - DNA, 15 bp, Homo sapiens
cttctttaagccata

SEQ ID NO: 4110177 - DNA, 22 bp, Homo sapiens
cttctttataattctactttga

SEQ ID NO: 4110178 - DNA, 19 bp, Homo sapiens
cttctttcccttagtgact

SEQ ID NO: 4110179 - DNA, 13 bp, Homo sapiens
cttctttcccttc

SEQ ID NO: 4110180 - DNA, 18 bp, Homo sapiens
cttctttcccttcctcca

SEQ ID NO: 4110181 - DNA, 17 bp, Homo sapiens
cttctttgataatgtta

SEQ ID NO: 4110182 - DNA, 12 bp, Homo sapiens
cttctttgccct

SEQ ID NO: 4110183 - DNA, 22 bp, Homo sapiens
cttctttgtgcctttggcctgg

SEQ ID NO: 4110184 - DNA, 19 bp, Homo sapiens
cttcttttttcaaaagaaa

SEQ ID NO: 4110185 - DNA, 20 bp, Homo sapiens
cttcttttttcaaaagaaag

SEQ ID NO: 4110186 - DNA, 11 bp, Homo sapiens
cttgaaaagtt

SEQ ID NO: 4110187 - DNA, 17 bp, Homo sapiens
cttgaaaagttcaggga

SEQ ID NO: 4110188 - DNA, 20 bp, Homo sapiens
cttgaaaatatatgatggct

SEQ ID NO: 4110189 - DNA, 20 bp, Homo sapiens
cttgaaaattttattaaaaa

SEQ ID NO: 4110190 - DNA, 20 bp, Homo sapiens
cttgaaacagattcaggcca

SEQ ID NO: 4110191 - DNA, 22 bp, Homo sapiens
cttgaaacagattcaggccagc

SEQ ID NO: 4110192 - DNA, 16 bp, Homo sapiens
cttgaaagcatccatg

SEQ ID NO: 4110193 - DNA, 13 bp, Homo sapiens
cttgaaagctgtg

SEQ ID NO: 4110194 - DNA, 19 bp, Homo sapiens
cttgaaattactgtgtaaa

SEQ ID NO: 4110195 - DNA, 20 bp, Homo sapiens
cttgaaattactgtgtaaat

SEQ ID NO: 4110196 - DNA, 20 bp, Homo sapiens
cttgaaattatatctgtggt

SEQ ID NO: 4110197 - DNA, 21 bp, Homo sapiens
cttgaacctgtgagtaaatat

SEQ ID NO: 4110198 - DNA, 17 bp, Homo sapiens
cttgaagaaacagagtg

SEQ ID NO: 4110199 - DNA, 15 bp, Homo sapiens
cttgaagccaaagaa

SEQ ID NO: 4110200 - DNA, 16 bp, Homo sapiens
cttgaagccaaagaaa

SEQ ID NO: 4110201 - DNA, 19 bp, Homo sapiens
cttgaagccaaagaaaaat

SEQ ID NO: 4110202 - DNA, 13 bp, Homo sapiens
cttgaagggccag

SEQ ID NO: 4110203 - DNA, 17 bp, Homo sapiens
cttgaagggccagagcc

SEQ ID NO: 4110204 - DNA, 16 bp, Homo sapiens
cttgaagggtaaagaa

SEQ ID NO: 4110205 - DNA, 17 bp, Homo sapiens
cttgaagtacttaacat

SEQ ID NO: 4110206 - DNA, 20 bp, Homo sapiens
cttgaagtctaaaagcagaa

SEQ ID NO: 4110207 - DNA, 20 bp, Homo sapiens
cttgaatcagtttttaaaat

SEQ ID NO: 4110208 - DNA, 16 bp, Homo sapiens
cttgaatgctgccagt

SEQ ID NO: 4110209 - DNA, 21 bp, Homo sapiens
cttgaatggcaatgttttgct

SEQ ID NO: 4110210 - DNA, 20 bp, Homo sapiens
cttgaatgtagcagccccgg

SEQ ID NO: 4110211 - DNA, 21 bp, Homo sapiens
cttgaatgtagcagccccggg

SEQ ID NO: 4110212 - DNA, 21 bp, Homo sapiens
cttgaatgtggtctcaggata

SEQ ID NO: 4110213 - DNA, 15 bp, Homo sapiens
cttgaatgtgtcagg

SEQ ID NO: 4110214 - DNA, 20 bp, Homo sapiens
cttgaatttctaaaaaacag

SEQ ID NO: 4110215 - DNA, 22 bp, Homo sapiens
cttgacaagttgcgacggagag

SEQ ID NO: 4110216 - DNA, 22 bp, Homo sapiens
cttgacacctgctgagaaaaca

SEQ ID NO: 4110217 - DNA, 16 bp, Homo sapiens
cttgacagagcctgcc

SEQ ID NO: 4110218 - DNA, 17 bp, Homo sapiens
cttgaccgtactctcac

SEQ ID NO: 4110219 - DNA, 16 bp, Homo sapiens
cttgacctgctgaagt

SEQ ID NO: 4110220 - DNA, 20 bp, Homo sapiens
cttgactaaaaaaaaaagaa

SEQ ID NO: 4110221 - DNA, 14 bp, Homo sapiens
cttgactctaaatg

SEQ ID NO: 4110222 - DNA, 16 bp, Homo sapiens
cttgactctaaatgca

SEQ ID NO: 4110223 - DNA, 18 bp, Homo sapiens
cttgactgcattgccgct

SEQ ID NO: 4110224 - DNA, 19 bp, Homo sapiens
cttgactgcattgccgctg

SEQ ID NO: 4110225 - DNA, 17 bp, Homo sapiens
cttgacttgattagtgc

SEQ ID NO: 4110226 - DNA, 13 bp, Homo sapiens
cttgagaaacctt

SEQ ID NO: 4110227 - DNA, 21 bp, Homo sapiens
cttgagaatcctctcctttct

SEQ ID NO: 4110228 - DNA, 12 bp, Homo sapiens
cttgagacaatg

SEQ ID NO: 4110229 - DNA, 18 bp, Homo sapiens
cttgagacaatgttttct

SEQ ID NO: 4110230 - DNA, 20 bp, Homo sapiens
cttgagagtagatggtttga

SEQ ID NO: 4110231 - DNA, 13 bp, Homo sapiens
cttgagcagtggc

SEQ ID NO: 4110232 - DNA, 16 bp, Homo sapiens
cttgagcagtggctgg

SEQ ID NO: 4110233 - DNA, 13 bp, Homo sapiens
cttgagcccagga

SEQ ID NO: 4110234 - DNA, 20 bp, Homo sapiens
cttgagccctggctgttctg

SEQ ID NO: 4110235 - DNA, 19 bp, Homo sapiens
cttgagccgggcccctggg

SEQ ID NO: 4110236 - DNA, 15 bp, Homo sapiens
cttgagtaagtgaag

SEQ ID NO: 4110237 - DNA, 21 bp, Homo sapiens
cttgagtggggttatctctgt

SEQ ID NO: 4110238 - DNA, 18 bp, Homo sapiens
cttgagttggagtactat

SEQ ID NO: 4110239 - DNA, 21 bp, Homo sapiens
cttgagttggagtactatatt

SEQ ID NO: 4110240 - DNA, 18 bp, Homo sapiens
cttgatacccccctctgt

SEQ ID NO: 4110241 - DNA, 16 bp, Homo sapiens
cttgatccagaagagc

SEQ ID NO: 4110242 - DNA, 17 bp, Homo sapiens
cttgatccagaagagcc

SEQ ID NO: 4110243 - DNA, 16 bp, Homo sapiens
cttgatcttaaagatc

SEQ ID NO: 4110244 - DNA, 21 bp, Homo sapiens
ctgtgcgtcttggtgtaattt

SEQ ID NO: 4110245 - DNA, 22 bp, Homo sapiens
ctgtgcgtcttggtgtaatttg

SEQ ID NO: 4110246 - DNA, 19 bp, Homo sapiens
ctgtgctgctgttactgtt

SEQ ID NO: 4110247 - DNA, 23 bp, Homo sapiens
ctgtgctgggggaatgagcccag

SEQ ID NO: 4110248 - DNA, 21 bp, Homo sapiens
ctgtgctgtggaagcaacagg

SEQ ID NO: 4110249 - DNA, 13 bp, Homo sapiens
ctgtgctgtgttt

SEQ ID NO: 4110250 - DNA, 17 bp, Homo sapiens
ctgtgcttcaattaata

SEQ ID NO: 4110251 - DNA, 15 bp, Homo sapiens
ctgtgcttgaaggcc

SEQ ID NO: 4110252 - DNA, 12 bp, Homo sapiens
ctgtggaagcaa

SEQ ID NO: 4110253 - DNA, 19 bp, Homo sapiens
ctgtggaaggcctccctct

SEQ ID NO: 4110254 - DNA, 24 bp, Homo sapiens
ctgtggaccgtggacaggcccagc

SEQ ID NO: 4110255 - DNA, 19 bp, Homo sapiens
ctgtggagcaaaaggcagc

SEQ ID NO: 4110256 - DNA, 21 bp, Homo sapiens
ctgtggagcaaaaggcagctc

SEQ ID NO: 4110257 - DNA, 14 bp, Homo sapiens
ctgtggaggaagga

SEQ ID NO: 4110258 - DNA, 22 bp, Homo sapiens
ctgtggaggaaggattgtaaaa

SEQ ID NO: 4110259 - DNA, 21 bp, Homo sapiens
ctgtggccccaccgagctgga

SEQ ID NO: 4110260 - DNA, 20 bp, Homo sapiens
ctgtggccgtctcctccctc

SEQ ID NO: 4110261 - DNA, 23 bp, Homo sapiens
ctgtggcgttctgctgcccctgc

SEQ ID NO: 4110262 - DNA, 15 bp, Homo sapiens
ctgtggctagtgaca

SEQ ID NO: 4110263 - DNA, 14 bp, Homo sapiens
ctgtggctggctct

SEQ ID NO: 4110264 - DNA, 17 bp, Homo sapiens
ctgtgggcacaggtcag

SEQ ID NO: 4110265 - DNA, 12 bp, Homo sapiens
ctgtgggcagca

SEQ ID NO: 4110266 - DNA, 14 bp, Homo sapiens
ctgtgggcagcacc

SEQ ID NO: 4110267 - DNA, 21 bp, Homo sapiens
ctgtgggcagcaccctccccc

SEQ ID NO: 4110268 - DNA, 23 bp, Homo sapiens
ctgtgggctacatgctggggtca

SEQ ID NO: 4110269 - DNA, 18 bp, Homo sapiens
ctgtgggggactggctgg

SEQ ID NO: 4110270 - DNA, 16 bp, Homo sapiens
ctgtgggtctgggagt

SEQ ID NO: 4110271 - DNA, 23 bp, Homo sapiens
ctgtggtagtactcctgcaaaat

SEQ ID NO: 4110272 - DNA, 15 bp, Homo sapiens
ctgtggttcctctgc

SEQ ID NO: 4110273 - DNA, 16 bp, Homo sapiens
ctgtggttcctctgct

SEQ ID NO: 4110274 - DNA, 15 bp, Homo sapiens
ctgtgtatggaaaaa

SEQ ID NO: 4110275 - DNA, 14 bp, Homo sapiens
ctgtgtcatttctt

SEQ ID NO: 4110276 - DNA, 13 bp, Homo sapiens
ctgtgtgaaacat

SEQ ID NO: 4110277 - DNA, 19 bp, Homo sapiens
ctgtgtgaaataccagtgt

SEQ ID NO: 4110278 - DNA, 13 bp, Homo sapiens
ctgtgtgaatgtg

SEQ ID NO: 4110279 - DNA, 15 bp, Homo sapiens
ctgtgtgagttgagt

SEQ ID NO: 4110280 - DNA, 16 bp, Homo sapiens
ctgtgtgcctggggga

SEQ ID NO: 4110281 - DNA, 16 bp, Homo sapiens
ctgtgtggactgtgat

SEQ ID NO: 4110282 - DNA, 16 bp, Homo sapiens
ctgtgtgtaggctggg

SEQ ID NO: 4110283 - DNA, 14 bp, Homo sapiens
ctgtgtgtatattg

SEQ ID NO: 4110284 - DNA, 14 bp, Homo sapiens
ctgtgtgtgtgaat

SEQ ID NO: 4110285 - DNA, 18 bp, Homo sapiens
ctgtgtgtgtgaatgaac

SEQ ID NO: 4110286 - DNA, 21 bp, Homo sapiens
ctgtgtgtgtgaatgaacact

SEQ ID NO: 4110287 - DNA, 18 bp, Homo sapiens
ctgtgttcccagaggcag

SEQ ID NO: 4110288 - DNA, 23 bp, Homo sapiens
ctgtgttgccacagtagaactgt

SEQ ID NO: 4110289 - DNA, 22 bp, Homo sapiens
ctgtgttgtctctagagcaggg

SEQ ID NO: 4110290 - DNA, 13 bp, Homo sapiens
ctgtgtttaaaaa

SEQ ID NO: 4110291 - DNA, 20 bp, Homo sapiens
ctgtgtttgcagcctgctct

SEQ ID NO: 4110292 - DNA, 14 bp, Homo sapiens
ctgtgtttgctccc

SEQ ID NO: 4110293 - DNA, 19 bp, Homo sapiens
ctgtgtttgctccccttcc

SEQ ID NO: 4110294 - DNA, 22 bp, Homo sapiens
ctgtgtttgctccccttcccct

SEQ ID NO: 4110295 - DNA, 14 bp, Homo sapiens
ctgtgtttgttcct

SEQ ID NO: 4110296 - DNA, 15 bp, Homo sapiens
ctgtgtttgttccta

SEQ ID NO: 4110297 - DNA, 23 bp, Homo sapiens
ctgttaaacagtagttgtattct

SEQ ID NO: 4110298 - DNA, 17 bp, Homo sapiens
ctgttaaggttgaactt

SEQ ID NO: 4110299 - DNA, 19 bp, Homo sapiens
ctgttaaggttgaactttg

SEQ ID NO: 4110300 - DNA, 20 bp, Homo sapiens
ctgttaaggttgaactttgc

SEQ ID NO: 4110301 - DNA, 16 bp, Homo sapiens
ctgttaatttttctta

SEQ ID NO: 4110302 - DNA, 15 bp, Homo sapiens
ctgttaccatgtcac

SEQ ID NO: 4110303 - DNA, 16 bp, Homo sapiens
ctgttaccatgtcact

SEQ ID NO: 4110304 - DNA, 18 bp, Homo sapiens
ctgttaccatgtcactgt

SEQ ID NO: 4110305 - DNA, 20 bp, Homo sapiens
ctgttactcaatgtgtgccg

SEQ ID NO: 4110306 - DNA, 19 bp, Homo sapiens
ctgttagctttttaaaaca

SEQ ID NO: 4110307 - DNA, 21 bp, Homo sapiens
ctgttagctttttaaaacatt

SEQ ID NO: 4110308 - DNA, 12 bp, Homo sapiens
ctgttagtaaat

SEQ ID NO: 4110309 - DNA, 15 bp, Homo sapiens
ctgttagtcatttgc

SEQ ID NO: 4110310 - DNA, 18 bp, Homo sapiens
ctgttagtcatttgctga

SEQ ID NO: 4110311 - DNA, 17 bp, Homo sapiens
ctgttatatatctcttt

SEQ ID NO: 4110312 - DNA, 13 bp, Homo sapiens
ctgttatgtatga

SEQ ID NO: 4110313 - DNA, 13 bp, Homo sapiens
ctgttatttaatt

SEQ ID NO: 4110314 - DNA, 14 bp, Homo sapiens
ctgttatttcttcc

SEQ ID NO: 4110315 - DNA, 21 bp, Homo sapiens
ctgttatttcttccctgcttt

SEQ ID NO: 4110316 - DNA, 18 bp, Homo sapiens
ctgttcaagtgtccccag

SEQ ID NO: 4110317 - DNA, 19 bp, Homo sapiens
ctgttcaagtgtccccaga

SEQ ID NO: 4110318 - DNA, 20 bp, Homo sapiens
ctgttcacagaaaaagcatg

SEQ ID NO: 4110319 - DNA, 22 bp, Homo sapiens
ctgttcacgctcacccagtcac

SEQ ID NO: 4110320 - DNA, 15 bp, Homo sapiens
ctgttcactctactt

SEQ ID NO: 4110321 - DNA, 12 bp, Homo sapiens
ctgttcagtgag

SEQ ID NO: 4110322 - DNA, 19 bp, Homo sapiens
ctgttcagtgagatatcat

SEQ ID NO: 4110323 - DNA, 17 bp, Homo sapiens
ctgttcatacactaacc

SEQ ID NO: 4110324 - DNA, 19 bp, Homo sapiens
ctgttcatgtgcctctgcg

SEQ ID NO: 4110325 - DNA, 16 bp, Homo sapiens
ctgttccaaagccagt

SEQ ID NO: 4110326 - DNA, 18 bp, Homo sapiens
ctgttccaaagccagtga

SEQ ID NO: 4110327 - DNA, 19 bp, Homo sapiens
ctgttccaaagccagtgaa

SEQ ID NO: 4110328 - DNA, 18 bp, Homo sapiens
ctgttccaaattcagttt

SEQ ID NO: 4110329 - DNA, 21 bp, Homo sapiens
ctgttccaaattcagtttcat

SEQ ID NO: 4110330 - DNA, 13 bp, Homo sapiens
ctgttccccagag

SEQ ID NO: 4110331 - DNA, 15 bp, Homo sapiens
ctgttccccagagaa

SEQ ID NO: 4110332 - DNA, 14 bp, Homo sapiens
ctgttccctctgct

SEQ ID NO: 4110333 - DNA, 14 bp, Homo sapiens
ctgttccttttata

SEQ ID NO: 4110334 - DNA, 15 bp, Homo sapiens
ctgttctaacatgta

SEQ ID NO: 4110335 - DNA, 15 bp, Homo sapiens
ctgttctcttcttca

SEQ ID NO: 4110336 - DNA, 16 bp, Homo sapiens
ctgttctcttcttcat

SEQ ID NO: 4110337 - DNA, 21 bp, Homo sapiens
ctgttctcttgggaactgaac

SEQ ID NO: 4110338 - DNA, 22 bp, Homo sapiens
ctgttctgctgggagttctaga

SEQ ID NO: 4110339 - DNA, 13 bp, Homo sapiens
ctgttctggagga

SEQ ID NO: 4110340 - DNA, 14 bp, Homo sapiens
ctgttctggcctca

SEQ ID NO: 4110341 - DNA, 13 bp, Homo sapiens
ctgttctggggga

SEQ ID NO: 4110342 - DNA, 11 bp, Homo sapiens
ctgttctgtgt

SEQ ID NO: 4110343 - DNA, 12 bp, Homo sapiens
ctgttcttcctc

SEQ ID NO: 4110344 - DNA, 22 bp, Homo sapiens
ctgttcttcctccagctgcacc

SEQ ID NO: 4110345 - DNA, 13 bp, Homo sapiens
ctgttcttcctgg

SEQ ID NO: 4110346 - DNA, 15 bp, Homo sapiens
ctgttgaccaggcac

SEQ ID NO: 4110347 - DNA, 19 bp, Homo sapiens
ctttcgatacccaggacca

SEQ ID NO: 4110348 - DNA, 14 bp, Homo sapiens
ctttcgtcaccctt

SEQ ID NO: 4110349 - DNA, 19 bp, Homo sapiens
ctttctacatgactgggcc

SEQ ID NO: 4110350 - DNA, 14 bp, Homo sapiens
ctttctagctgttg

SEQ ID NO: 4110351 - DNA, 16 bp, Homo sapiens
ctttctagtggtcttt

SEQ ID NO: 4110352 - DNA, 23 bp, Homo sapiens
ctttctagtggtctttgtaagag

SEQ ID NO: 4110353 - DNA, 21 bp, Homo sapiens
ctttctcagccgcttctgact

SEQ ID NO: 4110354 - DNA, 21 bp, Homo sapiens
ctttctcaggagcttgggcag

SEQ ID NO: 4110355 - DNA, 14 bp, Homo sapiens
ctttctcagtgtgt

SEQ ID NO: 4110356 - DNA, 19 bp, Homo sapiens
ctttctccagccagcaatg

SEQ ID NO: 4110357 - DNA, 13 bp, Homo sapiens
ctttctccaggac

SEQ ID NO: 4110358 - DNA, 23 bp, Homo sapiens
ctttctccttagtcttctcatag

SEQ ID NO: 4110359 - DNA, 15 bp, Homo sapiens
ctttctccttgaata

SEQ ID NO: 4110360 - DNA, 12 bp, Homo sapiens
ctttctctgtgt

SEQ ID NO: 4110361 - DNA, 13 bp, Homo sapiens
ctttctctttctc

SEQ ID NO: 4110362 - DNA, 13 bp, Homo sapiens
ctttctcttttcc

SEQ ID NO: 4110363 - DNA, 20 bp, Homo sapiens
ctttctcttttcctctacca

SEQ ID NO: 4110364 - DNA, 13 bp, Homo sapiens
ctttctgaaattc

SEQ ID NO: 4110365 - DNA, 14 bp, Homo sapiens
ctttctgaaattca

SEQ ID NO: 4110366 - DNA, 16 bp, Homo sapiens
ctttctgaaattcaca

SEQ ID NO: 4110367 - DNA, 15 bp, Homo sapiens
ctttctgggagcaga

SEQ ID NO: 4110368 - DNA, 18 bp, Homo sapiens
ctttctggggtttttctg

SEQ ID NO: 4110369 - DNA, 20 bp, Homo sapiens
ctttctggggtttttctgtt

SEQ ID NO: 4110370 - DNA, 14 bp, Homo sapiens
ctttctgtgcccta

SEQ ID NO: 4110371 - DNA, 22 bp, Homo sapiens
ctttctgtgccctactcattgg

SEQ ID NO: 4110372 - DNA, 12 bp, Homo sapiens
ctttctgttcca

SEQ ID NO: 4110373 - DNA, 16 bp, Homo sapiens
ctttctgttccaaatt

SEQ ID NO: 4110374 - DNA, 22 bp, Homo sapiens
ctttctgttccaaattcagttt

SEQ ID NO: 4110375 - DNA, 22 bp, Homo sapiens
ctttctgttgtcattgctgttg

SEQ ID NO: 4110376 - DNA, 11 bp, Homo sapiens
ctttcttcctc

SEQ ID NO: 4110377 - DNA, 12 bp, Homo sapiens
ctttcttcctca

SEQ ID NO: 4110378 - DNA, 11 bp, Homo sapiens
ctttcttcctt

SEQ ID NO: 4110379 - DNA, 15 bp, Homo sapiens
ctttcttccttggcc

SEQ ID NO: 4110380 - DNA, 19 bp, Homo sapiens
ctttcttcctttcttcctt

SEQ ID NO: 4110381 - DNA, 13 bp, Homo sapiens
ctttcttctgccc

SEQ ID NO: 4110382 - DNA, 17 bp, Homo sapiens
ctttcttgctcccttca

SEQ ID NO: 4110383 - DNA, 11 bp, Homo sapiens
ctttcttggga

SEQ ID NO: 4110384 - DNA, 13 bp, Homo sapiens
ctttcttgggata

SEQ ID NO: 4110385 - DNA, 20 bp, Homo sapiens
ctttcttggttcataaatga

SEQ ID NO: 4110386 - DNA, 22 bp, Homo sapiens
ctttcttggttcataaatgaat

SEQ ID NO: 4110387 - DNA, 17 bp, Homo sapiens
ctttctttacctgagac

SEQ ID NO: 4110388 - DNA, 15 bp, Homo sapiens
ctttctttgagtttt

SEQ ID NO: 4110389 - DNA, 12 bp, Homo sapiens
ctttctttgcct

SEQ ID NO: 4110390 - DNA, 14 bp, Homo sapiens
ctttctttgcctct

SEQ ID NO: 4110391 - DNA, 15 bp, Homo sapiens
ctttctttgcctctg

SEQ ID NO: 4110392 - DNA, 14 bp, Homo sapiens
ctttcttttaatga

SEQ ID NO: 4110393 - DNA, 19 bp, Homo sapiens
ctttcttttaatgatgcca

SEQ ID NO: 4110394 - DNA, 14 bp, Homo sapiens
ctttgaaacctcag

SEQ ID NO: 4110395 - DNA, 20 bp, Homo sapiens
ctttgaaacctcagggctgt

SEQ ID NO: 4110396 - DNA, 16 bp, Homo sapiens
ctttgaagaaggtgga

SEQ ID NO: 4110397 - DNA, 16 bp, Homo sapiens
ctttgaagcctcagct

SEQ ID NO: 4110398 - DNA, 16 bp, Homo sapiens
ctttgaaggggcctca

SEQ ID NO: 4110399 - DNA, 18 bp, Homo sapiens
ctttgaaggggcctcacc

SEQ ID NO: 4110400 - DNA, 17 bp, Homo sapiens
ctttgacaaaagtaaat

SEQ ID NO: 4110401 - DNA, 15 bp, Homo sapiens
ctttgacaactaaaa

SEQ ID NO: 4110402 - DNA, 17 bp, Homo sapiens
ctttgacatttaattta

SEQ ID NO: 4110403 - DNA, 21 bp, Homo sapiens
ctttgactcttttgccattaa

SEQ ID NO: 4110404 - DNA, 23 bp, Homo sapiens
ctttgagaactgcttctaagatg

SEQ ID NO: 4110405 - DNA, 13 bp, Homo sapiens
ctttgagtgatcc

SEQ ID NO: 4110406 - DNA, 21 bp, Homo sapiens
ctttgagttttaaattatgta

SEQ ID NO: 4110407 - DNA, 13 bp, Homo sapiens
ctttgataatgtt

SEQ ID NO: 4110408 - DNA, 16 bp, Homo sapiens
ctttgataatgttaaa

SEQ ID NO: 4110409 - DNA, 18 bp, Homo sapiens
ctttgatctggacagaac

SEQ ID NO: 4110410 - DNA, 22 bp, Homo sapiens
ctttgatctggacagaacattt

SEQ ID NO: 4110411 - DNA, 21 bp, Homo sapiens
ctttgatgattaattcacctt

SEQ ID NO: 4110412 - DNA, 12 bp, Homo sapiens
ctttgattcata

SEQ ID NO: 4110413 - DNA, 21 bp, Homo sapiens
ctttgattcatagtaacttct

SEQ ID NO: 4110414 - DNA, 17 bp, Homo sapiens
ctttgcaagatgcttgg

SEQ ID NO: 4110415 - DNA, 16 bp, Homo sapiens
ctttgcacaggatgct

SEQ ID NO: 4110416 - DNA, 15 bp, Homo sapiens
ctttgcactgagggc

SEQ ID NO: 4110417 - DNA, 16 bp, Homo sapiens
ctttgcacttgacctc

SEQ ID NO: 4110418 - DNA, 17 bp, Homo sapiens
ctttgcagggcagcccc

SEQ ID NO: 4110419 - DNA, 22 bp, Homo sapiens
ctttgcagggctaaggccccca

SEQ ID NO: 4110420 - DNA, 21 bp, Homo sapiens
ctttgcatatgagccgtgaac

SEQ ID NO: 4110421 - DNA, 14 bp, Homo sapiens
ctttgcattttgga

SEQ ID NO: 4110422 - DNA, 18 bp, Homo sapiens
ctttgccaaaaaaaaaag

SEQ ID NO: 4110423 - DNA, 12 bp, Homo sapiens
ctttgcccaccc

SEQ ID NO: 4110424 - DNA, 16 bp, Homo sapiens
ctttgcccacccctca

SEQ ID NO: 4110425 - DNA, 22 bp, Homo sapiens
ctttgcccacccctcactcccc

SEQ ID NO: 4110426 - DNA, 15 bp, Homo sapiens
ctttgcctcaagact

SEQ ID NO: 4110427 - DNA, 18 bp, Homo sapiens
ctttgcctctgcagtctc

SEQ ID NO: 4110428 - DNA, 23 bp, Homo sapiens
ctttgcctctgcagtctcatttc

SEQ ID NO: 4110429 - DNA, 12 bp, Homo sapiens
ctttgcctcttc

SEQ ID NO: 4110430 - DNA, 13 bp, Homo sapiens
ctttgcctcttct

SEQ ID NO: 4110431 - DNA, 23 bp, Homo sapiens
ctttgcctcttctttgtgccttt

SEQ ID NO: 4110432 - DNA, 11 bp, Homo sapiens
ctttgccttgc

SEQ ID NO: 4110433 - DNA, 18 bp, Homo sapiens
ctttgccttgcagccaca

SEQ ID NO: 4110434 - DNA, 22 bp, Homo sapiens
ctttgccttgggctgctcctca

SEQ ID NO: 4110435 - DNA, 22 bp, Homo sapiens
ctttgcctttatctctgaggct

SEQ ID NO: 4110436 - DNA, 20 bp, Homo sapiens
ctttgcctttcttctgccct

SEQ ID NO: 4110437 - DNA, 16 bp, Homo sapiens
ctttgctcttgtccca

SEQ ID NO: 4110438 - DNA, 11 bp, Homo sapiens
ctttgctgcag

SEQ ID NO: 4110439 - DNA, 15 bp, Homo sapiens
ctttgctgcagagaa

SEQ ID NO: 4110440 - DNA, 21 bp, Homo sapiens
ctttgctgctaccgccctggg

SEQ ID NO: 4110441 - DNA, 17 bp, Homo sapiens
ctttgctgtgaggctgt

SEQ ID NO: 4110442 - DNA, 19 bp, Homo sapiens
ctttgcttatgaatattta

SEQ ID NO: 4110443 - DNA, 23 bp, Homo sapiens
ctttgcttatgaatatttataac

SEQ ID NO: 4110444 - DNA, 18 bp, Homo sapiens
ctttgcttcccctccagg

SEQ ID NO: 4110445 - DNA, 21 bp, Homo sapiens
ctttgcttcccctccaggagg

SEQ ID NO: 4110446 - DNA, 19 bp, Homo sapiens
ctttgcttgctttgaagta

SEQ ID NO: 4110447 - DNA, 22 bp, Homo sapiens
ctttggaaagtacactctgctg

SEQ ID NO: 4110448 - DNA, 13 bp, Homo sapiens
ctttggagctttt

SEQ ID NO: 4110449 - DNA, 14 bp, Homo sapiens
ctttggagtcccct

SEQ ID NO: 4110450 - DNA, 18 bp, Homo sapiens
ctttggagtcccctcacc

SEQ ID NO: 4110451 - DNA, 21 bp, Homo sapiens
cttgttttctttctttaaatg

SEQ ID NO: 4110452 - DNA, 14 bp, Homo sapiens
cttgttttgcttcc

SEQ ID NO: 4110453 - DNA, 17 bp, Homo sapiens
cttgttttgcttcccct

SEQ ID NO: 4110454 - DNA, 19 bp, Homo sapiens
cttgttttttttttccact

SEQ ID NO: 4110455 - DNA, 23 bp, Homo sapiens
ctttaaaaaagaaaagtgcatat

SEQ ID NO: 4110456 - DNA, 14 bp, Homo sapiens
ctttaaaaagaaaa

SEQ ID NO: 4110457 - DNA, 16 bp, Homo sapiens
ctttaaaaagcagtcc

SEQ ID NO: 4110458 - DNA, 15 bp, Homo sapiens
ctttaaaagaatgac

SEQ ID NO: 4110459 - DNA, 16 bp, Homo sapiens
ctttaaaagagagaga

SEQ ID NO: 4110460 - DNA, 21 bp, Homo sapiens
ctttaaaagagagagagagaa

SEQ ID NO: 4110461 - DNA, 19 bp, Homo sapiens
ctttaaaattacaactaag

SEQ ID NO: 4110462 - DNA, 23 bp, Homo sapiens
ctttaaacctgtttttttttcat

SEQ ID NO: 4110463 - DNA, 13 bp, Homo sapiens
ctttaaactcagg

SEQ ID NO: 4110464 - DNA, 16 bp, Homo sapiens
ctttaaactcagggac

SEQ ID NO: 4110465 - DNA, 21 bp, Homo sapiens
ctttaaaggaaaaaatgttgg

SEQ ID NO: 4110466 - DNA, 19 bp, Homo sapiens
ctttaaagggcctgcctgg

SEQ ID NO: 4110467 - DNA, 11 bp, Homo sapiens
ctttaaatgtt

SEQ ID NO: 4110468 - DNA, 22 bp, Homo sapiens
ctttaacttttttttctctctt

SEQ ID NO: 4110469 - DNA, 17 bp, Homo sapiens
ctttaagatatccatct

SEQ ID NO: 4110470 - DNA, 20 bp, Homo sapiens
ctttaagcactacataaact

SEQ ID NO: 4110471 - DNA, 22 bp, Homo sapiens
ctttaagccatagaccctgagg

SEQ ID NO: 4110472 - DNA, 14 bp, Homo sapiens
ctttaatcttcagt

SEQ ID NO: 4110473 - DNA, 13 bp, Homo sapiens
ctttaatgcatct

SEQ ID NO: 4110474 - DNA, 14 bp, Homo sapiens
ctttaatgcatcta

SEQ ID NO: 4110475 - DNA, 12 bp, Homo sapiens
ctttaatgcttt

SEQ ID NO: 4110476 - DNA, 19 bp, Homo sapiens
ctttaatggacttatttct

SEQ ID NO: 4110477 - DNA, 22 bp, Homo sapiens
ctttaatggacttatttcttca

SEQ ID NO: 4110478 - DNA, 18 bp, Homo sapiens
ctttaattctgtatctgt

SEQ ID NO: 4110479 - DNA, 19 bp, Homo sapiens
ctttaccctctttgctgca

SEQ ID NO: 4110480 - DNA, 13 bp, Homo sapiens
ctttacctgagac

SEQ ID NO: 4110481 - DNA, 14 bp, Homo sapiens
ctttactctgtgtt

SEQ ID NO: 4110482 - DNA, 20 bp, Homo sapiens
ctttacttgtctttctgggg

SEQ ID NO: 4110483 - DNA, 14 bp, Homo sapiens
ctttagaaaaggca

SEQ ID NO: 4110484 - DNA, 17 bp, Homo sapiens
ctttagaagtgcatttc

SEQ ID NO: 4110485 - DNA, 19 bp, Homo sapiens
ctttagaagtgcatttctg

SEQ ID NO: 4110486 - DNA, 20 bp, Homo sapiens
ctttagaagtgcatttctga

SEQ ID NO: 4110487 - DNA, 14 bp, Homo sapiens
ctttagcagggaag

SEQ ID NO: 4110488 - DNA, 23 bp, Homo sapiens
ctttagcagggaagtcacttcac

SEQ ID NO: 4110489 - DNA, 16 bp, Homo sapiens
ctttagccaaaccctt

SEQ ID NO: 4110490 - DNA, 14 bp, Homo sapiens
ctttagctgacaga

SEQ ID NO: 4110491 - DNA, 15 bp, Homo sapiens
ctttagcttttcctt

SEQ ID NO: 4110492 - DNA, 18 bp, Homo sapiens
ctttaggcagcagctttt

SEQ ID NO: 4110493 - DNA, 22 bp, Homo sapiens
ctttagtgccggctgtggagca

SEQ ID NO: 4110494 - DNA, 15 bp, Homo sapiens
ctttagtgtatttat

SEQ ID NO: 4110495 - DNA, 12 bp, Homo sapiens
ctttataaactt

SEQ ID NO: 4110496 - DNA, 13 bp, Homo sapiens
ctttataattcta

SEQ ID NO: 4110497 - DNA, 15 bp, Homo sapiens
ctttatacacagtgg

SEQ ID NO: 4110498 - DNA, 14 bp, Homo sapiens
ctttatacagctgt

SEQ ID NO: 4110499 - DNA, 23 bp, Homo sapiens
ctttatacagctgtattgtctga

SEQ ID NO: 4110500 - DNA, 22 bp, Homo sapiens
ctttatacattagtaaatgtct

SEQ ID NO: 4110501 - DNA, 18 bp, Homo sapiens
ctttatactgtgaagtta

SEQ ID NO: 4110502 - DNA, 13 bp, Homo sapiens
ctttatagatgta

SEQ ID NO: 4110503 - DNA, 19 bp, Homo sapiens
ctttatcacattatttgca

SEQ ID NO: 4110504 - DNA, 13 bp, Homo sapiens
ctttatcttttca

SEQ ID NO: 4110505 - DNA, 14 bp, Homo sapiens
ctttattaccccct

SEQ ID NO: 4110506 - DNA, 18 bp, Homo sapiens
ctttattgcccatgggat

SEQ ID NO: 4110507 - DNA, 14 bp, Homo sapiens
ctttattgcttttt

SEQ ID NO: 4110508 - DNA, 14 bp, Homo sapiens
ctttatttatttct

SEQ ID NO: 4110509 - DNA, 15 bp, Homo sapiens
ctttatttatttcta

SEQ ID NO: 4110510 - DNA, 22 bp, Homo sapiens
ctttattttaacctttgataga

SEQ ID NO: 4110511 - DNA, 18 bp, Homo sapiens
ctttattttctggtagat

SEQ ID NO: 4110512 - DNA, 19 bp, Homo sapiens
ctttcaaaattaaatctgt

SEQ ID NO: 4110513 - DNA, 19 bp, Homo sapiens
ctttcaattgtcacttttt

SEQ ID NO: 4110514 - DNA, 20 bp, Homo sapiens
ctttcacaacatttgcagat

SEQ ID NO: 4110515 - DNA, 16 bp, Homo sapiens
ctttcacaaccttctg

SEQ ID NO: 4110516 - DNA, 13 bp, Homo sapiens
ctttcacagctcc

SEQ ID NO: 4110517 - DNA, 14 bp, Homo sapiens
ctttcacagctcct

SEQ ID NO: 4110518 - DNA, 18 bp, Homo sapiens
ctttcacagctcctccca

SEQ ID NO: 4110519 - DNA, 16 bp, Homo sapiens
ctttcacatagatgtc

SEQ ID NO: 4110520 - DNA, 22 bp, Homo sapiens
ctttcacattgtttgctgctat

SEQ ID NO: 4110521 - DNA, 24 bp, Homo sapiens
ctttcacattgtttgctgctattg

SEQ ID NO: 4110522 - DNA, 18 bp, Homo sapiens
ctttcacttctttccctt

SEQ ID NO: 4110523 - DNA, 12 bp, Homo sapiens
ctttcactttga

SEQ ID NO: 4110524 - DNA, 14 bp, Homo sapiens
ctttcagcaggcag

SEQ ID NO: 4110525 - DNA, 15 bp, Homo sapiens
ctttcagcaggcagc

SEQ ID NO: 4110526 - DNA, 16 bp, Homo sapiens
ctttcagcaggcagcc

SEQ ID NO: 4110527 - DNA, 18 bp, Homo sapiens
ctttcagcaggcagcctt

SEQ ID NO: 4110528 - DNA, 16 bp, Homo sapiens
ctttcagggccatggt

SEQ ID NO: 4110529 - DNA, 14 bp, Homo sapiens
ctttcagttagcct

SEQ ID NO: 4110530 - DNA, 16 bp, Homo sapiens
ctttcatcacactggg

SEQ ID NO: 4110531 - DNA, 16 bp, Homo sapiens
ctttcatctacctttt

SEQ ID NO: 4110532 - DNA, 17 bp, Homo sapiens
ctttccaattctccttt

SEQ ID NO: 4110533 - DNA, 19 bp, Homo sapiens
ctttccaggcaccctcagg

SEQ ID NO: 4110534 - DNA, 18 bp, Homo sapiens
ctttccatgggagccagc

SEQ ID NO: 4110535 - DNA, 12 bp, Homo sapiens
ctttccattttg

SEQ ID NO: 4110536 - DNA, 15 bp, Homo sapiens
ctttcccaaaggcat

SEQ ID NO: 4110537 - DNA, 13 bp, Homo sapiens
ctttcccaggaga

SEQ ID NO: 4110538 - DNA, 16 bp, Homo sapiens
ctttcccatcttccaa

SEQ ID NO: 4110539 - DNA, 22 bp, Homo sapiens
ctttccccagcatcactcccca

SEQ ID NO: 4110540 - DNA, 14 bp, Homo sapiens
ctttcccttccagt

SEQ ID NO: 4110541 - DNA, 22 bp, Homo sapiens
ctttcctcaagtatcttctatt

SEQ ID NO: 4110542 - DNA, 15 bp, Homo sapiens
ctttcctccacccat

SEQ ID NO: 4110543 - DNA, 11 bp, Homo sapiens
ctttcctgccc

SEQ ID NO: 4110544 - DNA, 12 bp, Homo sapiens
ctttcctgcccc

SEQ ID NO: 4110545 - DNA, 14 bp, Homo sapiens
ctttcctgccccag

SEQ ID NO: 4110546 - DNA, 23 bp, Homo sapiens
ctttcctggacactcagacctga

SEQ ID NO: 4110547 - DNA, 17 bp, Homo sapiens
ctttcctgggcctttgc

SEQ ID NO: 4110548 - DNA, 9 bp, Homo sapiens
ctttcctgt

SEQ ID NO: 4110549 - DNA, 15 bp, Homo sapiens
ctttcctgtgccagg

SEQ ID NO: 4110550 - DNA, 11 bp, Homo sapiens
ctttccttccc

SEQ ID NO: 4110551 - DNA, 12 bp, Homo sapiens
ctttccttccct

SEQ ID NO: 4110552 - DNA, 13 bp, Homo sapiens
ctttccttccctc

SEQ ID NO: 4110553 - DNA, 17 bp, Homo sapiens
ctttccttggctttatg

SEQ ID NO: 4110554 - DNA, 15 bp, Homo sapiens
ctttccttttcttta

SEQ ID NO: 4110555 - DNA, 11 bp, Homo sapiens
ctttggcagtg

SEQ ID NO: 4110556 - DNA, 24 bp, Homo sapiens
ctttggcctggggtgcatctcctc

SEQ ID NO: 4110557 - DNA, 13 bp, Homo sapiens
ctttggctgaggg

SEQ ID NO: 4110558 - DNA, 14 bp, Homo sapiens
ctttggctgagggg

SEQ ID NO: 4110559 - DNA, 18 bp, Homo sapiens
ctttgggagcaaaataag

SEQ ID NO: 4110560 - DNA, 17 bp, Homo sapiens
ctttgggatcccaccct

SEQ ID NO: 4110561 - DNA, 20 bp, Homo sapiens
ctttgggatcccaccctggg

SEQ ID NO: 4110562 - DNA, 13 bp, Homo sapiens
ctttgggccagac

SEQ ID NO: 4110563 - DNA, 15 bp, Homo sapiens
ctttgggctgccctg

SEQ ID NO: 4110564 - DNA, 19 bp, Homo sapiens
ctttgggctgccctggtgc

SEQ ID NO: 4110565 - DNA, 22 bp, Homo sapiens
ctttgggcttagtatttctcag

SEQ ID NO: 4110566 - DNA, 19 bp, Homo sapiens
ctttgggtctacaagtata

SEQ ID NO: 4110567 - DNA, 23 bp, Homo sapiens
ctttggtgccaactggtgtttga

SEQ ID NO: 4110568 - DNA, 19 bp, Homo sapiens
ctttggttctctccaggaa

SEQ ID NO: 4110569 - DNA, 21 bp, Homo sapiens
ctttggttctggccagaatgc

SEQ ID NO: 4110570 - DNA, 20 bp, Homo sapiens
ctttgtaagagtgtagaagc

SEQ ID NO: 4110571 - DNA, 23 bp, Homo sapiens
ctttgtaagagtgtagaagcatt

SEQ ID NO: 4110572 - DNA, 16 bp, Homo sapiens
ctttgtaatactttct

SEQ ID NO: 4110573 - DNA, 15 bp, Homo sapiens
ctttgtaatttttgg

SEQ ID NO: 4110574 - DNA, 16 bp, Homo sapiens
ctttgtacttgtgttt

SEQ ID NO: 4110575 - DNA, 21 bp, Homo sapiens
ctttgtacttgtgtttgctta

SEQ ID NO: 4110576 - DNA, 13 bp, Homo sapiens
ctttgtattcaaa

SEQ ID NO: 4110577 - DNA, 16 bp, Homo sapiens
ctttgtcaaaaggaag

SEQ ID NO: 4110578 - DNA, 20 bp, Homo sapiens
ctttgtcatagttatgtgat

SEQ ID NO: 4110579 - DNA, 21 bp, Homo sapiens
ctttgtcatagttatgtgatt

SEQ ID NO: 4110580 - DNA, 13 bp, Homo sapiens
ctttgtcctcctg

SEQ ID NO: 4110581 - DNA, 16 bp, Homo sapiens
ctttgtcctcctgctg

SEQ ID NO: 4110582 - DNA, 18 bp, Homo sapiens
ctttgtcctcctgctgcc

SEQ ID NO: 4110583 - DNA, 20 bp, Homo sapiens
ctttgtctaactcagaatta

SEQ ID NO: 4110584 - DNA, 19 bp, Homo sapiens
ctttgtctcctctatcctg

SEQ ID NO: 4110585 - DNA, 14 bp, Homo sapiens
ctttgtctctcctg

SEQ ID NO: 4110586 - DNA, 15 bp, Homo sapiens
ctttgtctctcctgg

SEQ ID NO: 4110587 - DNA, 16 bp, Homo sapiens
ctttgtctctcctggc

SEQ ID NO: 4110588 - DNA, 18 bp, Homo sapiens
ctttgtctctcctggctg

SEQ ID NO: 4110589 - DNA, 12 bp, Homo sapiens
ctttgtgaatat

SEQ ID NO: 4110590 - DNA, 14 bp, Homo sapiens
ctttgtgaatattt

SEQ ID NO: 4110591 - DNA, 14 bp, Homo sapiens
ctttgtgacaggaa

SEQ ID NO: 4110592 - DNA, 23 bp, Homo sapiens
ctttgtgacaggaaagccctccc

SEQ ID NO: 4110593 - DNA, 13 bp, Homo sapiens
ctttgtgataatt

SEQ ID NO: 4110594 - DNA, 15 bp, Homo sapiens
ctttgtgataattta

SEQ ID NO: 4110595 - DNA, 18 bp, Homo sapiens
ctttgtgcacatttattt

SEQ ID NO: 4110596 - DNA, 14 bp, Homo sapiens
ctttgtgcctttgg

SEQ ID NO: 4110597 - DNA, 18 bp, Homo sapiens
ctttgtgcctttggcctg

SEQ ID NO: 4110598 - DNA, 16 bp, Homo sapiens
ctttgtgctgcgcctg

SEQ ID NO: 4110599 - DNA, 12 bp, Homo sapiens
ctttgtgtatct

SEQ ID NO: 4110600 - DNA, 15 bp, Homo sapiens
ctttgtgtgtgtgtc

SEQ ID NO: 4110601 - DNA, 20 bp, Homo sapiens
ctttgtgtgtgtgtcagctg

SEQ ID NO: 4110602 - DNA, 11 bp, Homo sapiens
ctttgtgttgg

SEQ ID NO: 4110603 - DNA, 17 bp, Homo sapiens
ctttgtgttgtaattct

SEQ ID NO: 4110604 - DNA, 17 bp, Homo sapiens
ctttgtgtttgcttggt

SEQ ID NO: 4110605 - DNA, 20 bp, Homo sapiens
ctttgttctttaggagattt

SEQ ID NO: 4110606 - DNA, 21 bp, Homo sapiens
ctttgttggcattgatcctag

SEQ ID NO: 4110607 - DNA, 17 bp, Homo sapiens
ctttgtttcaaccaagt

SEQ ID NO: 4110608 - DNA, 15 bp, Homo sapiens
ctttgtttccttgtt

SEQ ID NO: 4110609 - DNA, 17 bp, Homo sapiens
ctttgttttaataaaca

SEQ ID NO: 4110610 - DNA, 13 bp, Homo sapiens
ctttgttttctta

SEQ ID NO: 4110611 - DNA, 21 bp, Homo sapiens
ctttgttttcttagttacttt

SEQ ID NO: 4110612 - DNA, 23 bp, Homo sapiens
ctttgttttcttagttacttttt

SEQ ID NO: 4110613 - DNA, 20 bp, Homo sapiens
cttttaaacctcacctttgt

SEQ ID NO: 4110614 - DNA, 11 bp, Homo sapiens
cttttaaagtg

SEQ ID NO: 4110615 - DNA, 13 bp, Homo sapiens
cttttaaagtgtt

SEQ ID NO: 4110616 - DNA, 18 bp, Homo sapiens
cttttaaatggcagtatt

SEQ ID NO: 4110617 - DNA, 15 bp, Homo sapiens
cttttaatcagtgaa

SEQ ID NO: 4110618 - DNA, 23 bp, Homo sapiens
cttttaatgcttcattcaatatt

SEQ ID NO: 4110619 - DNA, 23 bp, Homo sapiens
cttttaccgttggggcccttaac

SEQ ID NO: 4110620 - DNA, 18 bp, Homo sapiens
cttttacttttttatagc

SEQ ID NO: 4110621 - DNA, 21 bp, Homo sapiens
cttttagaaatactgcaagaa

SEQ ID NO: 4110622 - DNA, 15 bp, Homo sapiens
cttttagagagggga

SEQ ID NO: 4110623 - DNA, 19 bp, Homo sapiens
cttttagttgactcacagg

SEQ ID NO: 4110624 - DNA, 21 bp, Homo sapiens
cttttagttttagttgcagaa

SEQ ID NO: 4110625 - DNA, 22 bp, Homo sapiens
cttttataggtgagaaaaaaac

SEQ ID NO: 4110626 - DNA, 15 bp, Homo sapiens
cttttatatggccca

SEQ ID NO: 4110627 - DNA, 16 bp, Homo sapiens
cttttatatttgtatc

SEQ ID NO: 4110628 - DNA, 16 bp, Homo sapiens
cttttatctgcagaac

SEQ ID NO: 4110629 - DNA, 23 bp, Homo sapiens
cttttatgtagtaattgacatgt

SEQ ID NO: 4110630 - DNA, 13 bp, Homo sapiens
cttttatgtttga

SEQ ID NO: 4110631 - DNA, 14 bp, Homo sapiens
cttttatgtttgaa

SEQ ID NO: 4110632 - DNA, 22 bp, Homo sapiens
cttttatgtttgaatatggaca

SEQ ID NO: 4110633 - DNA, 23 bp, Homo sapiens
cttttatgtttgaatatggacaa

SEQ ID NO: 4110634 - DNA, 18 bp, Homo sapiens
cttttattgacacagaaa

SEQ ID NO: 4110635 - DNA, 21 bp, Homo sapiens
cttttatttgcaacatttaca

SEQ ID NO: 4110636 - DNA, 13 bp, Homo sapiens
cttttattttttc

SEQ ID NO: 4110637 - DNA, 15 bp, Homo sapiens
cttttattttttctt

SEQ ID NO: 4110638 - DNA, 19 bp, Homo sapiens
cttttattttttcttttgt

SEQ ID NO: 4110639 - DNA, 23 bp, Homo sapiens
cttttcaacttggcttcctttct

SEQ ID NO: 4110640 - DNA, 16 bp, Homo sapiens
cttttcacccttctac

SEQ ID NO: 4110641 - DNA, 17 bp, Homo sapiens
cttttcacccttctact

SEQ ID NO: 4110642 - DNA, 17 bp, Homo sapiens
cttttcagctgagccct

SEQ ID NO: 4110643 - DNA, 20 bp, Homo sapiens
cttttcagctgagccctggg

SEQ ID NO: 4110644 - DNA, 22 bp, Homo sapiens
cttttcataaagggttgaaaat

SEQ ID NO: 4110645 - DNA, 19 bp, Homo sapiens
cttttccccaaccacagag

SEQ ID NO: 4110646 - DNA, 23 bp, Homo sapiens
cttttcccccttcccatttcttc

SEQ ID NO: 4110647 - DNA, 19 bp, Homo sapiens
cttttcccctacagaattt

SEQ ID NO: 4110648 - DNA, 18 bp, Homo sapiens
cttttcccctgttaaaca

SEQ ID NO: 4110649 - DNA, 21 bp, Homo sapiens
cttttcccctgttaaacagta

SEQ ID NO: 4110650 - DNA, 15 bp, Homo sapiens
cttttcccctttcct

SEQ ID NO: 4110651 - DNA, 16 bp, Homo sapiens
cttttcccctttcctg

SEQ ID NO: 4110652 - DNA, 20 bp, Homo sapiens
cttttcccctttcctgtccc

SEQ ID NO: 4110653 - DNA, 21 bp, Homo sapiens
cttttcccctttcctgtccca

SEQ ID NO: 4110654 - DNA, 22 bp, Homo sapiens
cttttccctcggagttcttctt

SEQ ID NO: 4110655 - DNA, 15 bp, Homo sapiens
cttttcccttgcttc

SEQ ID NO: 4110656 - DNA, 23 bp, Homo sapiens
cttttcctcccttgggttctgat

SEQ ID NO: 4110657 - DNA, 19 bp, Homo sapiens
cttttcctcgcttctttca

SEQ ID NO: 4110658 - DNA, 17 bp, Homo sapiens
cttttccttatttgcct

SEQ ID NO: 4110659 - DNA, 18 bp, Homo sapiens
cttttccttatttgcctt

SEQ ID NO: 4110660 - DNA, 16 bp, Homo sapiens
cttttccttccctttt

SEQ ID NO: 4110661 - DNA, 11 bp, Homo sapiens
cttttcgttaa

SEQ ID NO: 4110662 - DNA, 13 bp, Homo sapiens
cttttctgcattt

SEQ ID NO: 4110663 - DNA, 14 bp, Homo sapiens
cttttctgccctgg

SEQ ID NO: 4110664 - DNA, 14 bp, Homo sapiens
cttttctgtcacca

SEQ ID NO: 4110665 - DNA, 18 bp, Homo sapiens
cttttctgtcaccaaatt

SEQ ID NO: 4110666 - DNA, 14 bp, Homo sapiens
cttttctgtcctgg

SEQ ID NO: 4110667 - DNA, 17 bp, Homo sapiens
cttttctgtggctggct

SEQ ID NO: 4110668 - DNA, 17 bp, Homo sapiens
cttttctgttctagttt

SEQ ID NO: 4110669 - DNA, 17 bp, Homo sapiens
cttttcttatttaaaat

SEQ ID NO: 4110670 - DNA, 22 bp, Homo sapiens
cttttcttggcaaaagccttgt

SEQ ID NO: 4110671 - DNA, 12 bp, Homo sapiens
cttttctttcaa

SEQ ID NO: 4110672 - DNA, 15 bp, Homo sapiens
cttttctttgttata

SEQ ID NO: 4110673 - DNA, 16 bp, Homo sapiens
cttttctttttacata

SEQ ID NO: 4110674 - DNA, 23 bp, Homo sapiens
cttttctttttacataactgcct

SEQ ID NO: 4110675 - DNA, 12 bp, Homo sapiens
cttttgaggctt

SEQ ID NO: 4110676 - DNA, 23 bp, Homo sapiens
cttttgagtgtgtgtgtgcatgt

SEQ ID NO: 4110677 - DNA, 16 bp, Homo sapiens
cttttgctgcgcacca

SEQ ID NO: 4110678 - DNA, 14 bp, Homo sapiens
cttttgctttattc

SEQ ID NO: 4110679 - DNA, 12 bp, Homo sapiens
cttttggtttaa

SEQ ID NO: 4110680 - DNA, 15 bp, Homo sapiens
cttttgtaaattaaa

SEQ ID NO: 4110681 - DNA, 14 bp, Homo sapiens
cttttgtgaacttt

SEQ ID NO: 4110682 - DNA, 20 bp, Homo sapiens
cttttgtgctatcaatgagt

SEQ ID NO: 4110683 - DNA, 22 bp, Homo sapiens
cttttgttctgctttatctttt

SEQ ID NO: 4110684 - DNA, 14 bp, Homo sapiens
cttttgttttgctt

SEQ ID NO: 4110685 - DNA, 16 bp, Homo sapiens
ctttttaaatgtgaat

SEQ ID NO: 4110686 - DNA, 21 bp, Homo sapiens
ctttttaaccctaatctttca

SEQ ID NO: 4110687 - DNA, 22 bp, Homo sapiens
ctttttaatattgatatgctta

SEQ ID NO: 4110688 - DNA, 19 bp, Homo sapiens
ctttttacataactgcctt

SEQ ID NO: 4110689 - DNA, 22 bp, Homo sapiens
ctttttacataactgccttgaa

SEQ ID NO: 4110690 - DNA, 15 bp, Homo sapiens
ctttttacctttcat

SEQ ID NO: 4110691 - DNA, 21 bp, Homo sapiens
ctttttatttaattaaatgta

SEQ ID NO: 4110692 - DNA, 13 bp, Homo sapiens
ctttttatttctg

SEQ ID NO: 4110693 - DNA, 20 bp, Homo sapiens
ctttttcaatgaattttata

SEQ ID NO: 4110694 - DNA, 17 bp, Homo sapiens
ctttttcatatgttgct

SEQ ID NO: 4110695 - DNA, 14 bp, Homo sapiens
ctttttccatcatt

SEQ ID NO: 4110696 - DNA, 21 bp, Homo sapiens
ctttttccatcattttacagt

SEQ ID NO: 4110697 - DNA, 11 bp, Homo sapiens
ctttttcctcc

SEQ ID NO: 4110698 - DNA, 19 bp, Homo sapiens
ctttttcgtgtggatcttg

SEQ ID NO: 4110699 - DNA, 13 bp, Homo sapiens
ctttttctgatta

SEQ ID NO: 4110700 - DNA, 16 bp, Homo sapiens
ctttttctgattagct

SEQ ID NO: 4110701 - DNA, 13 bp, Homo sapiens
ctttttgacactg

SEQ ID NO: 4110702 - DNA, 22 bp, Homo sapiens
ctttttgccagttttccctgga

SEQ ID NO: 4110703 - DNA, 17 bp, Homo sapiens
ctttttggctgacttca

SEQ ID NO: 4110704 - DNA, 23 bp, Homo sapiens
ctttttggctgacttcatctggg

SEQ ID NO: 4110705 - DNA, 18 bp, Homo sapiens
ctttttgtataaaataga

SEQ ID NO: 4110706 - DNA, 21 bp, Homo sapiens
ctttttgttctggtccttttt

SEQ ID NO: 4110707 - DNA, 15 bp, Homo sapiens
cttttttatagctta

SEQ ID NO: 4110708 - DNA, 18 bp, Homo sapiens
cttttttatgtgccgtgt

SEQ ID NO: 4110709 - DNA, 22 bp, Homo sapiens
cttttttcatttcttcctcagc

SEQ ID NO: 4110710 - DNA, 15 bp, Homo sapiens
cttttttgtttgttt

SEQ ID NO: 4110711 - DNA, 17 bp, Homo sapiens
cttttttgtttgtttct

SEQ ID NO: 4110712 - DNA, 18 bp, Homo sapiens
cttttttgtttgtttctt

SEQ ID NO: 4110713 - DNA, 12 bp, Homo sapiens
ctttttttgtat

SEQ ID NO: 4110714 - DNA, 17 bp, Homo sapiens
cttttttttctctcttt

SEQ ID NO: 4110715 - DNA, 13 bp, Homo sapiens
ctttttttttaag

SEQ ID NO: 4110716 - DNA, 18 bp, Homo sapiens
ctttttttttaagttctt

SEQ ID NO: 4110717 - DNA, 17 bp, Homo sapiens
ctttttttttgaaacag

SEQ ID NO: 4110718 - DNA, 20 bp, Homo sapiens
cttttttttttttttacagt

SEQ ID NO: 4110719 - DNA, 20 bp, Homo sapiens
ctttttttttttttttgaaa

SEQ ID NO: 4110720 - DNA, 19 bp, Homo sapiens
gaaaaaaaaaaaagaaaag

SEQ ID NO: 4110721 - DNA, 16 bp, Homo sapiens
gaaaaaaaaagaatta

SEQ ID NO: 4110722 - DNA, 17 bp, Homo sapiens
gaaaaaaactataaata

SEQ ID NO: 4110723 - DNA, 22 bp, Homo sapiens
gaaaaaaatcttctccagattt

SEQ ID NO: 4110724 - DNA, 19 bp, Homo sapiens
gaaaaaacacctagcttta

SEQ ID NO: 4110725 - DNA, 21 bp, Homo sapiens
gaaaaaagaagtgtccgagaa

SEQ ID NO: 4110726 - DNA, 13 bp, Homo sapiens
gaaaaaagcacat

SEQ ID NO: 4110727 - DNA, 14 bp, Homo sapiens
gaaaaaagcacata

SEQ ID NO: 4110728 - DNA, 19 bp, Homo sapiens
gaaaaaagcacatacatta

SEQ ID NO: 4110729 - DNA, 14 bp, Homo sapiens
gaaaaaatcagaac

SEQ ID NO: 4110730 - DNA, 15 bp, Homo sapiens
gaaaaacacaagcaa

SEQ ID NO: 4110731 - DNA, 14 bp, Homo sapiens
gaaaaagaaacaca

SEQ ID NO: 4110732 - DNA, 20 bp, Homo sapiens
gaaaaagcatgatgggaaaa

SEQ ID NO: 4110733 - DNA, 19 bp, Homo sapiens
gaaaaagttaaacattgaa

SEQ ID NO: 4110734 - DNA, 18 bp, Homo sapiens
gaaaaataaatctgttct

SEQ ID NO: 4110735 - DNA, 20 bp, Homo sapiens
gaaaaatctaagtgatataa

SEQ ID NO: 4110736 - DNA, 19 bp, Homo sapiens
gaaaaatgtaatttagaaa

SEQ ID NO: 4110737 - DNA, 18 bp, Homo sapiens
gaaaaatttaagcattgt

SEQ ID NO: 4110738 - DNA, 14 bp, Homo sapiens
gaaaacaaaatcta

SEQ ID NO: 4110739 - DNA, 19 bp, Homo sapiens
gaaaacaaaatctaaaaca

SEQ ID NO: 4110740 - DNA, 19 bp, Homo sapiens
gaaaacaatgcaaaacctt

SEQ ID NO: 4110741 - DNA, 17 bp, Homo sapiens
gaaaacacccagggaac

SEQ ID NO: 4110742 - DNA, 14 bp, Homo sapiens
gaaaaccagagcct

SEQ ID NO: 4110743 - DNA, 16 bp, Homo sapiens
gaaaacgttttattgt

SEQ ID NO: 4110744 - DNA, 14 bp, Homo sapiens
gaaaactatacaac

SEQ ID NO: 4110745 - DNA, 22 bp, Homo sapiens
gaaaactatcctgcgggtttta

SEQ ID NO: 4110746 - DNA, 18 bp, Homo sapiens
gaaaactcccatttacgt

SEQ ID NO: 4110747 - DNA, 19 bp, Homo sapiens
gaaaactgtgttgccacag

SEQ ID NO: 4110748 - DNA, 14 bp, Homo sapiens
gaaaacttagccag

SEQ ID NO: 4110749 - DNA, 17 bp, Homo sapiens
gaaaacttagccagagt

SEQ ID NO: 4110750 - DNA, 12 bp, Homo sapiens
gaaaactttaaa

SEQ ID NO: 4110751 - DNA, 19 bp, Homo sapiens
gaaaactttaaaaaatatt

SEQ ID NO: 4110752 - DNA, 21 bp, Homo sapiens
gaaaagaaaatttttgtagta

SEQ ID NO: 4110753 - DNA, 18 bp, Homo sapiens
gaaaagaatacagaaaga

SEQ ID NO: 4110754 - DNA, 19 bp, Homo sapiens
gaaaagaatacagaaagat

SEQ ID NO: 4110755 - DNA, 16 bp, Homo sapiens
gaaaagatacgacttt

SEQ ID NO: 4110756 - DNA, 19 bp, Homo sapiens
gaaaagatacgactttatt

SEQ ID NO: 4110757 - DNA, 21 bp, Homo sapiens
gaaaagattttatttatggaa

SEQ ID NO: 4110758 - DNA, 18 bp, Homo sapiens
gaaaagcacttttgttat

SEQ ID NO: 4110759 - DNA, 24 bp, Homo sapiens
gaaaagctagtgtacctcctctca

SEQ ID NO: 4110760 - DNA, 19 bp, Homo sapiens
gaaaagctattagccagga

SEQ ID NO: 4110761 - DNA, 16 bp, Homo sapiens
gaaaggggagcccact

SEQ ID NO: 4110762 - DNA, 14 bp, Homo sapiens
gaaaggggtgcttt

SEQ ID NO: 4110763 - DNA, 15 bp, Homo sapiens
gaaaggggtgctttt

SEQ ID NO: 4110764 - DNA, 18 bp, Homo sapiens
gaaaggtactatatttgc

SEQ ID NO: 4110765 - DNA, 14 bp, Homo sapiens
gaaaggtttacatt

SEQ ID NO: 4110766 - DNA, 13 bp, Homo sapiens
gaaaggttttgga

SEQ ID NO: 4110767 - DNA, 13 bp, Homo sapiens
gaaaggttttttt

SEQ ID NO: 4110768 - DNA, 21 bp, Homo sapiens
gaaagtagggggctttctggg

SEQ ID NO: 4110769 - DNA, 19 bp, Homo sapiens
gaaagtgaagcaaatcaga

SEQ ID NO: 4110770 - DNA, 13 bp, Homo sapiens
gaaagtgaatttg

SEQ ID NO: 4110771 - DNA, 21 bp, Homo sapiens
gaaagtgatatcccccagcct

SEQ ID NO: 4110772 - DNA, 23 bp, Homo sapiens
gaaagtgttatttttcaaggaag

SEQ ID NO: 4110773 - DNA, 20 bp, Homo sapiens
gaaagtgttttattttcaaa

SEQ ID NO: 4110774 - DNA, 18 bp, Homo sapiens
gaaagttagggggttctt

SEQ ID NO: 4110775 - DNA, 20 bp, Homo sapiens
gaaagttagggggttcttat

SEQ ID NO: 4110776 - DNA, 21 bp, Homo sapiens
gaaagttagggggttcttatt

SEQ ID NO: 4110777 - DNA, 20 bp, Homo sapiens
gaaagtttacccatgaagat

SEQ ID NO: 4110778 - DNA, 17 bp, Homo sapiens
gaaagtttttagaatgt

SEQ ID NO: 4110779 - DNA, 16 bp, Homo sapiens
gaaataaaaggaagcc

SEQ ID NO: 4110780 - DNA, 19 bp, Homo sapiens
gaaataaaaggaagccaaa

SEQ ID NO: 4110781 - DNA, 19 bp, Homo sapiens
gaaataaaagtgaatgaaa

SEQ ID NO: 4110782 - DNA, 23 bp, Homo sapiens
gaaataaatagctatatccatgt

SEQ ID NO: 4110783 - DNA, 14 bp, Homo sapiens
gaaataaatcagag

SEQ ID NO: 4110784 - DNA, 18 bp, Homo sapiens
gaaataaatcagagagca

SEQ ID NO: 4110785 - DNA, 20 bp, Homo sapiens
gaaataacaatgttaaggaa

SEQ ID NO: 4110786 - DNA, 19 bp, Homo sapiens
gaaatacagttctgctctg

SEQ ID NO: 4110787 - DNA, 18 bp, Homo sapiens
gaaatactaaaagcaaat

SEQ ID NO: 4110788 - DNA, 15 bp, Homo sapiens
gaaatactatttaaa

SEQ ID NO: 4110789 - DNA, 18 bp, Homo sapiens
gaaatagaaagaagccat

SEQ ID NO: 4110790 - DNA, 19 bp, Homo sapiens
gaaatagaaagaagccata

SEQ ID NO: 4110791 - DNA, 20 bp, Homo sapiens
gaaatagatatcctctcccc

SEQ ID NO: 4110792 - DNA, 23 bp, Homo sapiens
gaaatatatatgtgtgtgtatgt

SEQ ID NO: 4110793 - DNA, 17 bp, Homo sapiens
gaaatatgaaattccag

SEQ ID NO: 4110794 - DNA, 22 bp, Homo sapiens
gaaatatgattttatttgacaa

SEQ ID NO: 4110795 - DNA, 13 bp, Homo sapiens
gaaatatgcatct

SEQ ID NO: 4110796 - DNA, 13 bp, Homo sapiens
gaaatatgtgaga

SEQ ID NO: 4110797 - DNA, 21 bp, Homo sapiens
gaaatatgtgagattttttat

SEQ ID NO: 4110798 - DNA, 13 bp, Homo sapiens
gaaatatttattt

SEQ ID NO: 4110799 - DNA, 20 bp, Homo sapiens
gaaatattttgataataaat

SEQ ID NO: 4110800 - DNA, 21 bp, Homo sapiens
gaaatattttgataataaatt

SEQ ID NO: 4110801 - DNA, 22 bp, Homo sapiens
gaaatattttgataataaattg

SEQ ID NO: 4110802 - DNA, 23 bp, Homo sapiens
gaaatattttgataataaattga

SEQ ID NO: 4110803 - DNA, 19 bp, Homo sapiens
gaaatcaaagagagaaaat

SEQ ID NO: 4110804 - DNA, 16 bp, Homo sapiens
gaaatcaatgcaagag

SEQ ID NO: 4110805 - DNA, 23 bp, Homo sapiens
gaaatcaggtgttttaagactga

SEQ ID NO: 4110806 - DNA, 18 bp, Homo sapiens
gaaatcagtaatatttat

SEQ ID NO: 4110807 - DNA, 18 bp, Homo sapiens
gaaatccattgtttaaag

SEQ ID NO: 4110808 - DNA, 19 bp, Homo sapiens
gaaatccattgtttaaaga

SEQ ID NO: 4110809 - DNA, 15 bp, Homo sapiens
gaaatctctttgccc

SEQ ID NO: 4110810 - DNA, 16 bp, Homo sapiens
gaaatgaacaaaagat

SEQ ID NO: 4110811 - DNA, 14 bp, Homo sapiens
gaaatgaccaatat

SEQ ID NO: 4110812 - DNA, 18 bp, Homo sapiens
gaaatgagaaggcagcca

SEQ ID NO: 4110813 - DNA, 22 bp, Homo sapiens
gaaatgaggtctgtttaaagtg

SEQ ID NO: 4110814 - DNA, 23 bp, Homo sapiens
gaaatgaggtctgtttaaagtgg

SEQ ID NO: 4110815 - DNA, 15 bp, Homo sapiens
gaaatgcaaggggga

SEQ ID NO: 4110816 - DNA, 15 bp, Homo sapiens
gaaatgctgctggcc

SEQ ID NO: 4110817 - DNA, 16 bp, Homo sapiens
gaaatgctgctggcca

SEQ ID NO: 4110818 - DNA, 16 bp, Homo sapiens
gaaatggatactacat

SEQ ID NO: 4110819 - DNA, 16 bp, Homo sapiens
gaaatggtatgagctg

SEQ ID NO: 4110820 - DNA, 17 bp, Homo sapiens
gaaatgtcatctaacca

SEQ ID NO: 4110821 - DNA, 15 bp, Homo sapiens
gaaatgtccctttct

SEQ ID NO: 4110822 - DNA, 12 bp, Homo sapiens
gaaatgtgaagg

SEQ ID NO: 4110823 - DNA, 15 bp, Homo sapiens
gaaatgtgaaggaaa

SEQ ID NO: 4110824 - DNA, 14 bp, Homo sapiens
gaaatgtggagaag

SEQ ID NO: 4110825 - DNA, 21 bp, Homo sapiens
gaaatgtggagaagagtgccc

SEQ ID NO: 4110826 - DNA, 12 bp, Homo sapiens
gaaatgttctta

SEQ ID NO: 4110827 - DNA, 19 bp, Homo sapiens
gaaattaacacaaaggaag

SEQ ID NO: 4110828 - DNA, 13 bp, Homo sapiens
gaaattatatctg

SEQ ID NO: 4110829 - DNA, 21 bp, Homo sapiens
gaaattccagcaataagaaat

SEQ ID NO: 4110830 - DNA, 17 bp, Homo sapiens
gaaattcgtgtgttttt

SEQ ID NO: 4110831 - DNA, 19 bp, Homo sapiens
gaaattcgtgtgttttttt

SEQ ID NO: 4110832 - DNA, 12 bp, Homo sapiens
gaaatttgcaaa

SEQ ID NO: 4110833 - DNA, 15 bp, Homo sapiens
gaaattttgcaaata

SEQ ID NO: 4110834 - DNA, 17 bp, Homo sapiens
gaaattttgcaaatata

SEQ ID NO: 4110835 - DNA, 12 bp, Homo sapiens
gaaattttgtaa

SEQ ID NO: 4110836 - DNA, 13 bp, Homo sapiens
gaaatttttatca

SEQ ID NO: 4110837 - DNA, 18 bp, Homo sapiens
gaaatttttattaaatta

SEQ ID NO: 4110838 - DNA, 20 bp, Homo sapiens
gaaatttttcagatgcttct

SEQ ID NO: 4110839 - DNA, 22 bp, Homo sapiens
gaaatttttcagatgcttctgg

SEQ ID NO: 4110840 - DNA, 23 bp, Homo sapiens
gaacaaaagattggagctgaaga

SEQ ID NO: 4110841 - DNA, 23 bp, Homo sapiens
gaacaaacactgcagtttcctgg

SEQ ID NO: 4110842 - DNA, 19 bp, Homo sapiens
gaacaaagcagccacgagg

SEQ ID NO: 4110843 - DNA, 18 bp, Homo sapiens
gaacaaatcttgggtggg

SEQ ID NO: 4110844 - DNA, 22 bp, Homo sapiens
gaacaaatcttgggtgggtgaa

SEQ ID NO: 4110845 - DNA, 17 bp, Homo sapiens
gaacaattgaagtaaac

SEQ ID NO: 4110846 - DNA, 15 bp, Homo sapiens
gaacacaatgtgtat

SEQ ID NO: 4110847 - DNA, 19 bp, Homo sapiens
gaacacaggcagctttcta

SEQ ID NO: 4110848 - DNA, 22 bp, Homo sapiens
gaacacataaggacgtgtgtaa

SEQ ID NO: 4110849 - DNA, 21 bp, Homo sapiens
gaacacccgactcctcaaaag

SEQ ID NO: 4110850 - DNA, 16 bp, Homo sapiens
gaacaccctatatttt

SEQ ID NO: 4110851 - DNA, 12 bp, Homo sapiens
gaacagaaggat

SEQ ID NO: 4110852 - DNA, 15 bp, Homo sapiens
gaacagaccagtgac

SEQ ID NO: 4110853 - DNA, 19 bp, Homo sapiens
gaacagagtgcaacccagt

SEQ ID NO: 4110854 - DNA, 18 bp, Homo sapiens
gaacagataatcagtgtg

SEQ ID NO: 4110855 - DNA, 22 bp, Homo sapiens
gaacagatcttttactttggcc

SEQ ID NO: 4110856 - DNA, 20 bp, Homo sapiens
gaacagatgacccctgccca

SEQ ID NO: 4110857 - DNA, 21 bp, Homo sapiens
gaacagcgggagacctgtgct

SEQ ID NO: 4110858 - DNA, 22 bp, Homo sapiens
gaacagcgggagacctgtgcta

SEQ ID NO: 4110859 - DNA, 22 bp, Homo sapiens
gaacagctatgggagccccagg

SEQ ID NO: 4110860 - DNA, 15 bp, Homo sapiens
gaacagctgtaatct

SEQ ID NO: 4110861 - DNA, 14 bp, Homo sapiens
gaacagcttcaggt

SEQ ID NO: 4110862 - DNA, 13 bp, Homo sapiens
gaacagtaaacat

SEQ ID NO: 4110863 - DNA, 14 bp, Homo sapiens
gaacagtggctggg

SEQ ID NO: 4110864 - DNA, 18 bp, Homo sapiens
gaacagtggctgggtggg

SEQ ID NO: 4110865 - DNA, 22 bp, Homo sapiens
gaacagtggctgggtgggccca

SEQ ID NO: 4110866 - DNA, 16 bp, Homo sapiens
gaacataaaaaggaca

SEQ ID NO: 4110867 - DNA, 18 bp, Homo sapiens
gaacataaaaaggacatc

SEQ ID NO: 4110868 - DNA, 15 bp, Homo sapiens
gaacatacttcaaaa

SEQ ID NO: 4110869 - DNA, 21 bp, Homo sapiens
gaacatacttcaaaaataatg

SEQ ID NO: 4110870 - DNA, 17 bp, Homo sapiens
gaacatccaaccttccc

SEQ ID NO: 4110871 - DNA, 17 bp, Homo sapiens
gaacatccctttttcaa

SEQ ID NO: 4110872 - DNA, 23 bp, Homo sapiens
gaacatcctttgcagggcagccc

SEQ ID NO: 4110873 - DNA, 19 bp, Homo sapiens
gaacatcgatatgtatatc

SEQ ID NO: 4110874 - DNA, 23 bp, Homo sapiens
gaacatggctagcctttcttgta

SEQ ID NO: 4110875 - DNA, 24 bp, Homo sapiens
gaacatgtcctaattcttctgtcc

SEQ ID NO: 4110876 - DNA, 19 bp, Homo sapiens
gaacatgtgagaggtttga

SEQ ID NO: 4110877 - DNA, 12 bp, Homo sapiens
gaacattggaat

SEQ ID NO: 4110878 - DNA, 22 bp, Homo sapiens
gaacattggaatgttctcagat

SEQ ID NO: 4110879 - DNA, 13 bp, Homo sapiens
gaacatttatatc

SEQ ID NO: 4110880 - DNA, 17 bp, Homo sapiens
gaaccaagcaggagacg

SEQ ID NO: 4110881 - DNA, 20 bp, Homo sapiens
gaaccaagcaggagacgaca

SEQ ID NO: 4110882 - DNA, 19 bp, Homo sapiens
gaaccaataaaataatttt

SEQ ID NO: 4110883 - DNA, 14 bp, Homo sapiens
gaaccacagggcca

SEQ ID NO: 4110884 - DNA, 15 bp, Homo sapiens
gaaccacctttgtct

SEQ ID NO: 4110885 - DNA, 16 bp, Homo sapiens
gaaccacttcctgcta

SEQ ID NO: 4110886 - DNA, 17 bp, Homo sapiens
gaaccagctcatctcca

SEQ ID NO: 4110887 - DNA, 19 bp, Homo sapiens
gaaccagtccccccaccct

SEQ ID NO: 4110888 - DNA, 20 bp, Homo sapiens
gaaccatccacttacatata

SEQ ID NO: 4110889 - DNA, 13 bp, Homo sapiens
gaacccagactca

SEQ ID NO: 4110890 - DNA, 16 bp, Homo sapiens
gaacccagactcagac

SEQ ID NO: 4110891 - DNA, 17 bp, Homo sapiens
gaacccagactcagaca

SEQ ID NO: 4110892 - DNA, 21 bp, Homo sapiens
gaacccccaccagacatcacc

SEQ ID NO: 4110893 - DNA, 23 bp, Homo sapiens
gaaccctctgtcccacccctagc

SEQ ID NO: 4110894 - DNA, 20 bp, Homo sapiens
gaaccctggggcctgactgc

SEQ ID NO: 4110895 - DNA, 23 bp, Homo sapiens
gaaccgagcaaagatcaaaataa

SEQ ID NO: 4110896 - DNA, 17 bp, Homo sapiens
gaaccgttttgaagcta

SEQ ID NO: 4110897 - DNA, 19 bp, Homo sapiens
gaacctacagactccatct

SEQ ID NO: 4110898 - DNA, 20 bp, Homo sapiens
gaacctacagactccatctc

SEQ ID NO: 4110899 - DNA, 22 bp, Homo sapiens
gaacctacctgccttggagagg

SEQ ID NO: 4110900 - DNA, 15 bp, Homo sapiens
gaacctaccttcatt

SEQ ID NO: 4110901 - DNA, 21 bp, Homo sapiens
gaacctcagcatttccttcca

SEQ ID NO: 4110902 - DNA, 14 bp, Homo sapiens
gaacctcagcctgg

SEQ ID NO: 4110903 - DNA, 18 bp, Homo sapiens
gaacctcagcctggccag

SEQ ID NO: 4110904 - DNA, 14 bp, Homo sapiens
gaacctcttcccca

SEQ ID NO: 4110905 - DNA, 22 bp, Homo sapiens
gaacctgagctattttcctctg

SEQ ID NO: 4110906 - DNA, 17 bp, Homo sapiens
gaacctgtgagtaaata

SEQ ID NO: 4110907 - DNA, 15 bp, Homo sapiens
gaaccttccctccaa

SEQ ID NO: 4110908 - DNA, 17 bp, Homo sapiens
gaaccttgctgtcctga

SEQ ID NO: 4110909 - DNA, 14 bp, Homo sapiens
gaacctttctgtgt

SEQ ID NO: 4110910 - DNA, 16 bp, Homo sapiens
gaacgatgtgtctgta

SEQ ID NO: 4110911 - DNA, 16 bp, Homo sapiens
gaacgcagccctagag

SEQ ID NO: 4110912 - DNA, 16 bp, Homo sapiens
gaacgccagtctccca

SEQ ID NO: 4110913 - DNA, 21 bp, Homo sapiens
gaacgccagtctcccaggccc

SEQ ID NO: 4110914 - DNA, 23 bp, Homo sapiens
gaacggagccccaggcctctgtg

SEQ ID NO: 4110915 - DNA, 13 bp, Homo sapiens
gaactaaatgttc

SEQ ID NO: 4110916 - DNA, 21 bp, Homo sapiens
gaactagcatatagccattga

SEQ ID NO: 4110917 - DNA, 16 bp, Homo sapiens
gaactagggaagctca

SEQ ID NO: 4110918 - DNA, 18 bp, Homo sapiens
gaactatctgcattatct

SEQ ID NO: 4110919 - DNA, 15 bp, Homo sapiens
gaactatgaactaca

SEQ ID NO: 4110920 - DNA, 19 bp, Homo sapiens
gaactcaaatggggccaga

SEQ ID NO: 4110921 - DNA, 17 bp, Homo sapiens
gaactcaccctgggagc

SEQ ID NO: 4110922 - DNA, 13 bp, Homo sapiens
gaactcactctgg

SEQ ID NO: 4110923 - DNA, 21 bp, Homo sapiens
gaactcagatccagggacaga

SEQ ID NO: 4110924 - DNA, 20 bp, Homo sapiens
gaactcagctgtctgtggct

SEQ ID NO: 4110925 - DNA, 22 bp, Homo sapiens
gaactccaccgaccaactgccc

SEQ ID NO: 4110926 - DNA, 17 bp, Homo sapiens
gaactcccagcaacaca

SEQ ID NO: 4110927 - DNA, 15 bp, Homo sapiens
gaactcctgacctca

SEQ ID NO: 4110928 - DNA, 17 bp, Homo sapiens
gaactctcaaaagtcta

SEQ ID NO: 4110929 - DNA, 22 bp, Homo sapiens
gaactctgaaccacctttgtct

SEQ ID NO: 4110930 - DNA, 20 bp, Homo sapiens
gaactctgaactttggagag

SEQ ID NO: 4110931 - DNA, 17 bp, Homo sapiens
gaactctggcttccagg

SEQ ID NO: 4110932 - DNA, 19 bp, Homo sapiens
gaactctggcttccaggta

SEQ ID NO: 4110933 - DNA, 14 bp, Homo sapiens
gaactctggtggca

SEQ ID NO: 4110934 - DNA, 13 bp, Homo sapiens
gaactctgttccc

SEQ ID NO: 4110935 - DNA, 13 bp, Homo sapiens
gaactcttaatca

SEQ ID NO: 4110936 - DNA, 12 bp, Homo sapiens
gaactgaactca

SEQ ID NO: 4110937 - DNA, 14 bp, Homo sapiens
gaactgcatggacc

SEQ ID NO: 4110938 - DNA, 23 bp, Homo sapiens
gaactgcatggacctaacattcg

SEQ ID NO: 4110939 - DNA, 13 bp, Homo sapiens
gaactgcccccac

SEQ ID NO: 4110940 - DNA, 16 bp, Homo sapiens
gaactggggctttgcc

SEQ ID NO: 4110941 - DNA, 21 bp, Homo sapiens
gaactggggctttgccttgca

SEQ ID NO: 4110942 - DNA, 13 bp, Homo sapiens
gaactgtccagag

SEQ ID NO: 4110943 - DNA, 14 bp, Homo sapiens
gaactgtccagaga

SEQ ID NO: 4110944 - DNA, 22 bp, Homo sapiens
gaactgtccagagagcaactct

SEQ ID NO: 4110945 - DNA, 17 bp, Homo sapiens
gaactgtctgtgaacag

SEQ ID NO: 4110946 - DNA, 18 bp, Homo sapiens
gaactgtgcatagtgctg

SEQ ID NO: 4110947 - DNA, 22 bp, Homo sapiens
gaactgtgcatagtgctgggat

SEQ ID NO: 4110948 - DNA, 17 bp, Homo sapiens
gaacttacattgttcaa

SEQ ID NO: 4110949 - DNA, 20 bp, Homo sapiens
gaacttatcctaaaacaaat

SEQ ID NO: 4110950 - DNA, 13 bp, Homo sapiens
gaacttcagaaag

SEQ ID NO: 4110951 - DNA, 18 bp, Homo sapiens
gaacttcagaaagacttg

SEQ ID NO: 4110952 - DNA, 15 bp, Homo sapiens
gaacttgactgggtg

SEQ ID NO: 4110953 - DNA, 15 bp, Homo sapiens
gaacttgatttgcat

SEQ ID NO: 4110954 - DNA, 16 bp, Homo sapiens
gaacttgatttgcatg

SEQ ID NO: 4110955 - DNA, 21 bp, Homo sapiens
gaacttgcagctgatgttgga

SEQ ID NO: 4110956 - DNA, 15 bp, Homo sapiens
gaacttgcattgtga

SEQ ID NO: 4110957 - DNA, 23 bp, Homo sapiens
gaacttgcattgtgattggcctg

SEQ ID NO: 4110958 - DNA, 16 bp, Homo sapiens
gaacttgcgagtccaa

SEQ ID NO: 4110959 - DNA, 15 bp, Homo sapiens
gaacttttctgtaat

SEQ ID NO: 4110960 - DNA, 16 bp, Homo sapiens
gaacttttgtactgaa

SEQ ID NO: 4110961 - DNA, 14 bp, Homo sapiens
gaactttttgtagg

SEQ ID NO: 4110962 - DNA, 10 bp, Homo sapiens
gaagaaaaaa

SEQ ID NO: 4110963 - DNA, 23 bp, Homo sapiens
gaagaaaaaaatcttctccagat

SEQ ID NO: 4110964 - DNA, 21 bp, Homo sapiens
gaagaaaactatcctgcgggt

SEQ ID NO: 4110965 - DNA, 22 bp, Homo sapiens
gaagaaaactcctttagcaggt

SEQ ID NO: 4110966 - DNA, 21 bp, Homo sapiens
gaagaaaatgttcttccagtt

SEQ ID NO: 4110967 - DNA, 22 bp, Homo sapiens
gaaaagctgccatttcccttct

SEQ ID NO: 4110968 - DNA, 17 bp, Homo sapiens
gaaaaggccttcttccc

SEQ ID NO: 4110969 - DNA, 14 bp, Homo sapiens
gaaaagtacattta

SEQ ID NO: 4110970 - DNA, 23 bp, Homo sapiens
gaaaagtatcactctaaaaaaca

SEQ ID NO: 4110971 - DNA, 14 bp, Homo sapiens
gaaaagtattttga

SEQ ID NO: 4110972 - DNA, 23 bp, Homo sapiens
gaaaagtattttgaagtttacat

SEQ ID NO: 4110973 - DNA, 14 bp, Homo sapiens
gaaaagtgcctgag

SEQ ID NO: 4110974 - DNA, 21 bp, Homo sapiens
gaaaagtgcctgagctgggga

SEQ ID NO: 4110975 - DNA, 12 bp, Homo sapiens
gaaaagttcata

SEQ ID NO: 4110976 - DNA, 14 bp, Homo sapiens
gaaaagttgtctta

SEQ ID NO: 4110977 - DNA, 15 bp, Homo sapiens
gaaaataaaactaag

SEQ ID NO: 4110978 - DNA, 20 bp, Homo sapiens
gaaaataaacatcagtttct

SEQ ID NO: 4110979 - DNA, 16 bp, Homo sapiens
gaaaatacaataaact

SEQ ID NO: 4110980 - DNA, 20 bp, Homo sapiens
gaaaatagaatgtggccact

SEQ ID NO: 4110981 - DNA, 19 bp, Homo sapiens
gaaaatagctctttcaggg

SEQ ID NO: 4110982 - DNA, 22 bp, Homo sapiens
gaaaatcaaaccgagcagggct

SEQ ID NO: 4110983 - DNA, 18 bp, Homo sapiens
gaaaatcactttgtctaa

SEQ ID NO: 4110984 - DNA, 19 bp, Homo sapiens
gaaaatcgagttggcaaaa

SEQ ID NO: 4110985 - DNA, 14 bp, Homo sapiens
gaaaatgacttatt

SEQ ID NO: 4110986 - DNA, 18 bp, Homo sapiens
gaaaatgacttatttctg

SEQ ID NO: 4110987 - DNA, 20 bp, Homo sapiens
gaaaatgatacgcaacataa

SEQ ID NO: 4110988 - DNA, 23 bp, Homo sapiens
gaaaatgatgtgtacccaaacgt

SEQ ID NO: 4110989 - DNA, 17 bp, Homo sapiens
gaaaatgtgtaattcaa

SEQ ID NO: 4110990 - DNA, 19 bp, Homo sapiens
gaaaatgtgtcctatctat

SEQ ID NO: 4110991 - DNA, 15 bp, Homo sapiens
gaaaatgttatttaa

SEQ ID NO: 4110992 - DNA, 15 bp, Homo sapiens
gaaaatgttctgttt

SEQ ID NO: 4110993 - DNA, 15 bp, Homo sapiens
gaaaatgttgagaat

SEQ ID NO: 4110994 - DNA, 14 bp, Homo sapiens
gaaaattagactgt

SEQ ID NO: 4110995 - DNA, 14 bp, Homo sapiens
gaaaattccagaaa

SEQ ID NO: 4110996 - DNA, 20 bp, Homo sapiens
gaaaattccagaaaggatat

SEQ ID NO: 4110997 - DNA, 14 bp, Homo sapiens
gaaaattgcactaa

SEQ ID NO: 4110998 - DNA, 22 bp, Homo sapiens
gaaaatttagccctttaaaacg

SEQ ID NO: 4110999 - DNA, 14 bp, Homo sapiens
gaaaattttacttc

SEQ ID NO: 4111000 - DNA, 18 bp, Homo sapiens
gaaaatttttacattcat

SEQ ID NO: 4111001 - DNA, 23 bp, Homo sapiens
gaaacaatgtggagtctccctct

SEQ ID NO: 4111002 - DNA, 14 bp, Homo sapiens
gaaacacaatattt

SEQ ID NO: 4111003 - DNA, 17 bp, Homo sapiens
gaaacacaccaggctgt

SEQ ID NO: 4111004 - DNA, 15 bp, Homo sapiens
gaaacacagagaagc

SEQ ID NO: 4111005 - DNA, 12 bp, Homo sapiens
gaaacacagctg

SEQ ID NO: 4111006 - DNA, 23 bp, Homo sapiens
gaaacaccaaaaaaatccagaaa

SEQ ID NO: 4111007 - DNA, 17 bp, Homo sapiens
gaaacacccacaggcat

SEQ ID NO: 4111008 - DNA, 19 bp, Homo sapiens
gaaacagattcaggccagc

SEQ ID NO: 4111009 - DNA, 21 bp, Homo sapiens
gaaacagattcaggccagccc

SEQ ID NO: 4111010 - DNA, 16 bp, Homo sapiens
gaaacagcagtcccag

SEQ ID NO: 4111011 - DNA, 12 bp, Homo sapiens
gaaacagccagc

SEQ ID NO: 4111012 - DNA, 18 bp, Homo sapiens
gaaacagccatgtccaag

SEQ ID NO: 4111013 - DNA, 17 bp, Homo sapiens
gaaacagtacttaggta

SEQ ID NO: 4111014 - DNA, 18 bp, Homo sapiens
gaaacagtgggagccctg

SEQ ID NO: 4111015 - DNA, 22 bp, Homo sapiens
gaaaccaaagatatatacacag

SEQ ID NO: 4111016 - DNA, 20 bp, Homo sapiens
gaaaccaccgtgaaccagag

SEQ ID NO: 4111017 - DNA, 22 bp, Homo sapiens
gaaaccaccgtgaaccagaggg

SEQ ID NO: 4111018 - DNA, 23 bp, Homo sapiens
gaaaccattttcccatcatcctt

SEQ ID NO: 4111019 - DNA, 13 bp, Homo sapiens
gaaacccagggag

SEQ ID NO: 4111020 - DNA, 21 bp, Homo sapiens
gaaaccgcctagtttactgtt

SEQ ID NO: 4111021 - DNA, 20 bp, Homo sapiens
gaaacctcagggctgtccca

SEQ ID NO: 4111022 - DNA, 13 bp, Homo sapiens
gaaacctgtctga

SEQ ID NO: 4111023 - DNA, 17 bp, Homo sapiens
gaaaccttgctctcctc

SEQ ID NO: 4111024 - DNA, 22 bp, Homo sapiens
gaaaccttttttaagatttttc

SEQ ID NO: 4111025 - DNA, 23 bp, Homo sapiens
gaaaccttttttaagatttttct

SEQ ID NO: 4111026 - DNA, 13 bp, Homo sapiens
gaaacgctacctc

SEQ ID NO: 4111027 - DNA, 16 bp, Homo sapiens
gaaacgtcttctaaac

SEQ ID NO: 4111028 - DNA, 21 bp, Homo sapiens
gaaactaagccaggcctggct

SEQ ID NO: 4111029 - DNA, 23 bp, Homo sapiens
gaaactaagccaggcctggctgg

SEQ ID NO: 4111030 - DNA, 16 bp, Homo sapiens
gaaactccacatctgc

SEQ ID NO: 4111031 - DNA, 20 bp, Homo sapiens
gaaactccacatctgcctta

SEQ ID NO: 4111032 - DNA, 18 bp, Homo sapiens
gaaactcccatgtatgga

SEQ ID NO: 4111033 - DNA, 17 bp, Homo sapiens
gaaactcctgtttctcc

SEQ ID NO: 4111034 - DNA, 13 bp, Homo sapiens
gaaactgatttct

SEQ ID NO: 4111035 - DNA, 19 bp, Homo sapiens
gaaactttatacattagta

SEQ ID NO: 4111036 - DNA, 20 bp, Homo sapiens
gaaactttatacattagtaa

SEQ ID NO: 4111037 - DNA, 11 bp, Homo sapiens
gaaagaagaga

SEQ ID NO: 4111038 - DNA, 11 bp, Homo sapiens
gaaagaaggaa

SEQ ID NO: 4111039 - DNA, 13 bp, Homo sapiens
gaaagaatatatt

SEQ ID NO: 4111040 - DNA, 18 bp, Homo sapiens
gaaagaatatatttattt

SEQ ID NO: 4111041 - DNA, 13 bp, Homo sapiens
gaaagaattattt

SEQ ID NO: 4111042 - DNA, 22 bp, Homo sapiens
gaaagagagagagagagagaaa

SEQ ID NO: 4111043 - DNA, 19 bp, Homo sapiens
gaaagagcagtcagagtcc

SEQ ID NO: 4111044 - DNA, 13 bp, Homo sapiens
gaaagaggaagca

SEQ ID NO: 4111045 - DNA, 20 bp, Homo sapiens
gaaagaggtaaaattctcta

SEQ ID NO: 4111046 - DNA, 14 bp, Homo sapiens
gaaagataactagg

SEQ ID NO: 4111047 - DNA, 16 bp, Homo sapiens
gaaagatcaaaaggtt

SEQ ID NO: 4111048 - DNA, 22 bp, Homo sapiens
gaaagatggataaactgagcct

SEQ ID NO: 4111049 - DNA, 17 bp, Homo sapiens
gaaagattttattgtat

SEQ ID NO: 4111050 - DNA, 17 bp, Homo sapiens
gaaagcaacaaagaaat

SEQ ID NO: 4111051 - DNA, 14 bp, Homo sapiens
gaaagcaataaatg

SEQ ID NO: 4111052 - DNA, 20 bp, Homo sapiens
gaaagcagatacctcaccct

SEQ ID NO: 4111053 - DNA, 22 bp, Homo sapiens
gaaagcagatacctcaccctgc

SEQ ID NO: 4111054 - DNA, 14 bp, Homo sapiens
gaaagccacctctc

SEQ ID NO: 4111055 - DNA, 18 bp, Homo sapiens
gaaagccacctctccctc

SEQ ID NO: 4111056 - DNA, 14 bp, Homo sapiens
gaaagcgattcact

SEQ ID NO: 4111057 - DNA, 16 bp, Homo sapiens
gaaagcgattcactgt

SEQ ID NO: 4111058 - DNA, 17 bp, Homo sapiens
gaaagctcactgtagct

SEQ ID NO: 4111059 - DNA, 19 bp, Homo sapiens
gaaagctgagaactcctga

SEQ ID NO: 4111060 - DNA, 22 bp, Homo sapiens
gaaagctgattactgtcaataa

SEQ ID NO: 4111061 - DNA, 17 bp, Homo sapiens
gaaagctgtgaacaggc

SEQ ID NO: 4111062 - DNA, 16 bp, Homo sapiens
gaaaggaacctgggat

SEQ ID NO: 4111063 - DNA, 13 bp, Homo sapiens
gaaaggagactag

SEQ ID NO: 4111064 - DNA, 17 bp, Homo sapiens
gaaaggatatttaagaa

SEQ ID NO: 4111065 - DNA, 22 bp, Homo sapiens
gaaaggatatttaagaaaatac

SEQ ID NO: 4111066 - DNA, 20 bp, Homo sapiens
gaaaggatgtggaagagcat

SEQ ID NO: 4111067 - DNA, 15 bp, Homo sapiens
gaaaggctgccgagg

SEQ ID NO: 4111068 - DNA, 15 bp, Homo sapiens
gaaagggctggctcc

SEQ ID NO: 4111069 - DNA, 20 bp, Homo sapiens
gaaaggggagagcctgctgg

SEQ ID NO: 4111070 - DNA, 13 bp, Homo sapiens
gaagaaccagtcc

SEQ ID NO: 4111071 - DNA, 22 bp, Homo sapiens
gaagaaccagtccccccaccct

SEQ ID NO: 4111072 - DNA, 22 bp, Homo sapiens
gaagaactagcatatagccatt

SEQ ID NO: 4111073 - DNA, 20 bp, Homo sapiens
gaagaagacctctaggagga

SEQ ID NO: 4111074 - DNA, 15 bp, Homo sapiens
gaagaagggagaaga

SEQ ID NO: 4111075 - DNA, 17 bp, Homo sapiens
gaagaagggagaagaaa

SEQ ID NO: 4111076 - DNA, 16 bp, Homo sapiens
gaagaagggcacccta

SEQ ID NO: 4111077 - DNA, 13 bp, Homo sapiens
gaagaagtggctg

SEQ ID NO: 4111078 - DNA, 12 bp, Homo sapiens
gaagaatattta

SEQ ID NO: 4111079 - DNA, 16 bp, Homo sapiens
gaagaattaagataca

SEQ ID NO: 4111080 - DNA, 19 bp, Homo sapiens
gaagaattgccaatcttgt

SEQ ID NO: 4111081 - DNA, 13 bp, Homo sapiens
gaagacaagcatt

SEQ ID NO: 4111082 - DNA, 20 bp, Homo sapiens
gaagacaatttgatacataa

SEQ ID NO: 4111083 - DNA, 16 bp, Homo sapiens
gaagacaccagagcag

SEQ ID NO: 4111084 - DNA, 22 bp, Homo sapiens
gaagacagcttaatagtagtta

SEQ ID NO: 4111085 - DNA, 14 bp, Homo sapiens
gaagacatttcttt

SEQ ID NO: 4111086 - DNA, 15 bp, Homo sapiens
gaagacatttctttt

SEQ ID NO: 4111087 - DNA, 17 bp, Homo sapiens
gaagacatttcttttct

SEQ ID NO: 4111088 - DNA, 23 bp, Homo sapiens
gaagacatttcttttctttttac

SEQ ID NO: 4111089 - DNA, 19 bp, Homo sapiens
gaagacattttttgctata

SEQ ID NO: 4111090 - DNA, 18 bp, Homo sapiens
gaagacccagcaggaagc

SEQ ID NO: 4111091 - DNA, 13 bp, Homo sapiens
gaagacctaacca

SEQ ID NO: 4111092 - DNA, 18 bp, Homo sapiens
gaagacctaaccagggcc

SEQ ID NO: 4111093 - DNA, 23 bp, Homo sapiens
gaagacctaaccagggccagaag

SEQ ID NO: 4111094 - DNA, 15 bp, Homo sapiens
gaagactggaagcta

SEQ ID NO: 4111095 - DNA, 16 bp, Homo sapiens
gaagactggaagctaa

SEQ ID NO: 4111096 - DNA, 17 bp, Homo sapiens
gaagactggaagctaat

SEQ ID NO: 4111097 - DNA, 20 bp, Homo sapiens
gaagagaagctgctgaccaa

SEQ ID NO: 4111098 - DNA, 23 bp, Homo sapiens
gaagagagatatatctgaaaact

SEQ ID NO: 4111099 - DNA, 22 bp, Homo sapiens
gaagagcaggactccaggccca

SEQ ID NO: 4111100 - DNA, 16 bp, Homo sapiens
gaagagcccagtctgt

SEQ ID NO: 4111101 - DNA, 17 bp, Homo sapiens
gaagagctattatataa

SEQ ID NO: 4111102 - DNA, 16 bp, Homo sapiens
gaagagcttgctttga

SEQ ID NO: 4111103 - DNA, 16 bp, Homo sapiens
gaagaggctggtgctg

SEQ ID NO: 4111104 - DNA, 20 bp, Homo sapiens
gaagagggagaagcatgaaa

SEQ ID NO: 4111105 - DNA, 17 bp, Homo sapiens
gaagagggcccagccca

SEQ ID NO: 4111106 - DNA, 19 bp, Homo sapiens
gaagagggcccagcccaga

SEQ ID NO: 4111107 - DNA, 14 bp, Homo sapiens
gaagagtattaatg

SEQ ID NO: 4111108 - DNA, 20 bp, Homo sapiens
gaagagtgccctgctttgca

SEQ ID NO: 4111109 - DNA, 14 bp, Homo sapiens
gaagagtgtgtgtg

SEQ ID NO: 4111110 - DNA, 16 bp, Homo sapiens
gaagataattgttgaa

SEQ ID NO: 4111111 - DNA, 19 bp, Homo sapiens
gaagataattgttgaaatt

SEQ ID NO: 4111112 - DNA, 16 bp, Homo sapiens
gaagataggctctgca

SEQ ID NO: 4111113 - DNA, 17 bp, Homo sapiens
gaagataggctctgcac

SEQ ID NO: 4111114 - DNA, 15 bp, Homo sapiens
gaagatcccctcagg

SEQ ID NO: 4111115 - DNA, 20 bp, Homo sapiens
gaagatcccctcaggactgc

SEQ ID NO: 4111116 - DNA, 17 bp, Homo sapiens
gaagatgaaagaggagg

SEQ ID NO: 4111117 - DNA, 17 bp, Homo sapiens
gaagatggtttcaattc

SEQ ID NO: 4111118 - DNA, 23 bp, Homo sapiens
gaagatgttgaagaatacagtta

SEQ ID NO: 4111119 - DNA, 16 bp, Homo sapiens
gaagattttcagtcta

SEQ ID NO: 4111120 - DNA, 23 bp, Homo sapiens
gaagattttgaaatttttattaa

SEQ ID NO: 4111121 - DNA, 14 bp, Homo sapiens
gaagcaacatttta

SEQ ID NO: 4111122 - DNA, 13 bp, Homo sapiens
gaagcaagccaga

SEQ ID NO: 4111123 - DNA, 13 bp, Homo sapiens
gaagcaaggaaga

SEQ ID NO: 4111124 - DNA, 16 bp, Homo sapiens
gaagcaccccatgcca

SEQ ID NO: 4111125 - DNA, 20 bp, Homo sapiens
gaagcacctactatgtgctg

SEQ ID NO: 4111126 - DNA, 20 bp, Homo sapiens
gaagcactacaccttgcctt

SEQ ID NO: 4111127 - DNA, 21 bp, Homo sapiens
gaagcactacaccttgccttg

SEQ ID NO: 4111128 - DNA, 21 bp, Homo sapiens
gaagcagcctccttatatttg

SEQ ID NO: 4111129 - DNA, 15 bp, Homo sapiens
gaagcaggggtgggg

SEQ ID NO: 4111130 - DNA, 19 bp, Homo sapiens
gaagcaggtgtgagggcag

SEQ ID NO: 4111131 - DNA, 15 bp, Homo sapiens
gaagcagtcttgctc

SEQ ID NO: 4111132 - DNA, 18 bp, Homo sapiens
gaagcagtgccttccata

SEQ ID NO: 4111133 - DNA, 19 bp, Homo sapiens
gaagcagtgccttccataa

SEQ ID NO: 4111134 - DNA, 17 bp, Homo sapiens
gaagcattcagagagca

SEQ ID NO: 4111135 - DNA, 17 bp, Homo sapiens
gaagcattctccccagt

SEQ ID NO: 4111136 - DNA, 12 bp, Homo sapiens
gaagccaaagaa

SEQ ID NO: 4111137 - DNA, 19 bp, Homo sapiens
gaagccaagggaaaggggt

SEQ ID NO: 4111138 - DNA, 21 bp, Homo sapiens
gaagccaagtggggtgctggg

SEQ ID NO: 4111139 - DNA, 17 bp, Homo sapiens
gaagccacccaaagcag

SEQ ID NO: 4111140 - DNA, 17 bp, Homo sapiens
gaagccacgctgtcctc

SEQ ID NO: 4111141 - DNA, 19 bp, Homo sapiens
gaagccacgctgtcctctc

SEQ ID NO: 4111142 - DNA, 13 bp, Homo sapiens
gaagccagagccc

SEQ ID NO: 4111143 - DNA, 21 bp, Homo sapiens
gaagccagagccccaagcagg

SEQ ID NO: 4111144 - DNA, 12 bp, Homo sapiens
gaagccagctgc

SEQ ID NO: 4111145 - DNA, 13 bp, Homo sapiens
gaagccaggctga

SEQ ID NO: 4111146 - DNA, 12 bp, Homo sapiens
gaagccaggtga

SEQ ID NO: 4111147 - DNA, 19 bp, Homo sapiens
gaagcccagcccctactgc

SEQ ID NO: 4111148 - DNA, 21 bp, Homo sapiens
gaagcccccagctaagaacct

SEQ ID NO: 4111149 - DNA, 13 bp, Homo sapiens
gaagccgactctg

SEQ ID NO: 4111150 - DNA, 14 bp, Homo sapiens
gaagccgactctgg

SEQ ID NO: 4111151 - DNA, 16 bp, Homo sapiens
gaagccggagggtgtt

SEQ ID NO: 4111152 - DNA, 16 bp, Homo sapiens
gaagccgggaacagac

SEQ ID NO: 4111153 - DNA, 23 bp, Homo sapiens
gaagccggggtgtaacttcctgc

SEQ ID NO: 4111154 - DNA, 21 bp, Homo sapiens
gaagcctccaagcacagagcc

SEQ ID NO: 4111155 - DNA, 21 bp, Homo sapiens
gaagcctccaagcctgcctcc

SEQ ID NO: 4111156 - DNA, 14 bp, Homo sapiens
gaagcctctggcta

SEQ ID NO: 4111157 - DNA, 13 bp, Homo sapiens
gaagcctctggga

SEQ ID NO: 4111158 - DNA, 15 bp, Homo sapiens
gaagcctgcaggagt

SEQ ID NO: 4111159 - DNA, 23 bp, Homo sapiens
gaagcctgcgttggtccagagcg

SEQ ID NO: 4111160 - DNA, 19 bp, Homo sapiens
gaagcctggactctgcccc

SEQ ID NO: 4111161 - DNA, 23 bp, Homo sapiens
gaagccttaagccataggcccag

SEQ ID NO: 4111162 - DNA, 14 bp, Homo sapiens
gaagcggatttcca

SEQ ID NO: 4111163 - DNA, 15 bp, Homo sapiens
gaagctaatttgcat

SEQ ID NO: 4111164 - DNA, 17 bp, Homo sapiens
gaagctaatttgcatta

SEQ ID NO: 4111165 - DNA, 17 bp, Homo sapiens
gaagctaccagagctct

SEQ ID NO: 4111166 - DNA, 13 bp, Homo sapiens
gaagctccactgt

SEQ ID NO: 4111167 - DNA, 19 bp, Homo sapiens
gaagctccactgtcaccct

SEQ ID NO: 4111168 - DNA, 17 bp, Homo sapiens
gaagctcctctccccag

SEQ ID NO: 4111169 - DNA, 19 bp, Homo sapiens
gaagctcctctccccagcc

SEQ ID NO: 4111170 - DNA, 20 bp, Homo sapiens
gaagctcctctccccagccc

SEQ ID NO: 4111171 - DNA, 22 bp, Homo sapiens
gaagctcctctccccagcccag

SEQ ID NO: 4111172 - DNA, 20 bp, Homo sapiens
gaagctcttggagctgtgag

SEQ ID NO: 4111173 - DNA, 11 bp, Homo sapiens
gataatgttaa

SEQ ID NO: 4111174 - DNA, 12 bp, Homo sapiens
gataatgttaaa

SEQ ID NO: 4111175 - DNA, 14 bp, Homo sapiens
gataatgttaaatt

SEQ ID NO: 4111176 - DNA, 22 bp, Homo sapiens
gataatttatttcaataaatct

SEQ ID NO: 4111177 - DNA, 21 bp, Homo sapiens
gataatttgcatattctattg

SEQ ID NO: 4111178 - DNA, 16 bp, Homo sapiens
gatacaaatgtctatc

SEQ ID NO: 4111179 - DNA, 17 bp, Homo sapiens
gatacaaatgtctatca

SEQ ID NO: 4111180 - DNA, 15 bp, Homo sapiens
gatacataataaaaa

SEQ ID NO: 4111181 - DNA, 20 bp, Homo sapiens
gatacatatgagtgtggaag

SEQ ID NO: 4111182 - DNA, 14 bp, Homo sapiens
gatacatcactgct

SEQ ID NO: 4111183 - DNA, 17 bp, Homo sapiens
gatacatcactgcttga

SEQ ID NO: 4111184 - DNA, 21 bp, Homo sapiens
gatacatccaaagcagacagc

SEQ ID NO: 4111185 - DNA, 17 bp, Homo sapiens
gataccaggttgaaaga

SEQ ID NO: 4111186 - DNA, 21 bp, Homo sapiens
gatacccccctctgtcttgtg

SEQ ID NO: 4111187 - DNA, 12 bp, Homo sapiens
gatacctggagc

SEQ ID NO: 4111188 - DNA, 13 bp, Homo sapiens
gatacgactttat

SEQ ID NO: 4111189 - DNA, 13 bp, Homo sapiens
gatactacatctt

SEQ ID NO: 4111190 - DNA, 13 bp, Homo sapiens
gatactctgtcag

SEQ ID NO: 4111191 - DNA, 13 bp, Homo sapiens
gatacttggattt

SEQ ID NO: 4111192 - DNA, 16 bp, Homo sapiens
gatagaaataaatagc

SEQ ID NO: 4111193 - DNA, 12 bp, Homo sapiens
gatagatgctgg

SEQ ID NO: 4111194 - DNA, 16 bp, Homo sapiens
gatagatgctggccca

SEQ ID NO: 4111195 - DNA, 18 bp, Homo sapiens
gatagatgctggcccagg

SEQ ID NO: 4111196 - DNA, 21 bp, Homo sapiens
gatagatgctggcccagggcc

SEQ ID NO: 4111197 - DNA, 13 bp, Homo sapiens
gataggaaactga

SEQ ID NO: 4111198 - DNA, 14 bp, Homo sapiens
gataggaaactgaa

SEQ ID NO: 4111199 - DNA, 18 bp, Homo sapiens
gataggaatgtgaaagca

SEQ ID NO: 4111200 - DNA, 14 bp, Homo sapiens
gataggcccctggg

SEQ ID NO: 4111201 - DNA, 15 bp, Homo sapiens
gataggcccctgggg

SEQ ID NO: 4111202 - DNA, 14 bp, Homo sapiens
gataggctctgcac

SEQ ID NO: 4111203 - DNA, 15 bp, Homo sapiens
gataggtaaattttt

SEQ ID NO: 4111204 - DNA, 15 bp, Homo sapiens
gatagtaacaatgaa

SEQ ID NO: 4111205 - DNA, 15 bp, Homo sapiens
gatagtgttctgctc

SEQ ID NO: 4111206 - DNA, 21 bp, Homo sapiens
gatagtgttctgctcctgctt

SEQ ID NO: 4111207 - DNA, 14 bp, Homo sapiens
gatataaaatgtgc

SEQ ID NO: 4111208 - DNA, 19 bp, Homo sapiens
gatataacattcagttccc

SEQ ID NO: 4111209 - DNA, 16 bp, Homo sapiens
gatatacaaagtgtac

SEQ ID NO: 4111210 - DNA, 18 bp, Homo sapiens
gatatacacggatgactt

SEQ ID NO: 4111211 - DNA, 16 bp, Homo sapiens
gatatacagatgaaaa

SEQ ID NO: 4111212 - DNA, 21 bp, Homo sapiens
gatatacagatgaaaatttga

SEQ ID NO: 4111213 - DNA, 14 bp, Homo sapiens
gatatacatgaaaa

SEQ ID NO: 4111214 - DNA, 15 bp, Homo sapiens
gatatactgtgtgct

SEQ ID NO: 4111215 - DNA, 18 bp, Homo sapiens
gatatatctgaaaactgg

SEQ ID NO: 4111216 - DNA, 19 bp, Homo sapiens
gatatatttaaaaatattt

SEQ ID NO: 4111217 - DNA, 21 bp, Homo sapiens
gatatatttcacttttgttct

SEQ ID NO: 4111218 - DNA, 17 bp, Homo sapiens
gatatatttttcacagt

SEQ ID NO: 4111219 - DNA, 13 bp, Homo sapiens
gatatcccagctt

SEQ ID NO: 4111220 - DNA, 16 bp, Homo sapiens
gatatcctctccccct

SEQ ID NO: 4111221 - DNA, 20 bp, Homo sapiens
gatatcctctccccctcctc

SEQ ID NO: 4111222 - DNA, 23 bp, Homo sapiens
gatatcctctccccctcctccag

SEQ ID NO: 4111223 - DNA, 21 bp, Homo sapiens
gatatctagctagtaatatat

SEQ ID NO: 4111224 - DNA, 15 bp, Homo sapiens
gatatggcagaagac

SEQ ID NO: 4111225 - DNA, 17 bp, Homo sapiens
gatatgtatgggtaggg

SEQ ID NO: 4111226 - DNA, 18 bp, Homo sapiens
gatatgtatgggtagggt

SEQ ID NO: 4111227 - DNA, 15 bp, Homo sapiens
gatatgtctgctgag

SEQ ID NO: 4111228 - DNA, 22 bp, Homo sapiens
gatatgtctgctgagttggcct

SEQ ID NO: 4111229 - DNA, 19 bp, Homo sapiens
gatatgtggtgtatatcct

SEQ ID NO: 4111230 - DNA, 12 bp, Homo sapiens
gatattatctac

SEQ ID NO: 4111231 - DNA, 16 bp, Homo sapiens
gatattccatgaatgt

SEQ ID NO: 4111232 - DNA, 14 bp, Homo sapiens
gatattgtacataa

SEQ ID NO: 4111233 - DNA, 17 bp, Homo sapiens
gatattgtacataaaag

SEQ ID NO: 4111234 - DNA, 13 bp, Homo sapiens
gatatttaagaaa

SEQ ID NO: 4111235 - DNA, 15 bp, Homo sapiens
gatatttaagaaaat

SEQ ID NO: 4111236 - DNA, 16 bp, Homo sapiens
gatatttatatatatt

SEQ ID NO: 4111237 - DNA, 23 bp, Homo sapiens
gatatttatatttttattttatt

SEQ ID NO: 4111238 - DNA, 14 bp, Homo sapiens
gatatttcttgctt

SEQ ID NO: 4111239 - DNA, 14 bp, Homo sapiens
gatatttgcattga

SEQ ID NO: 4111240 - DNA, 12 bp, Homo sapiens
gatattttcaaa

SEQ ID NO: 4111241 - DNA, 13 bp, Homo sapiens
gatatttttaaaa

SEQ ID NO: 4111242 - DNA, 14 bp, Homo sapiens
gatatttttgtact

SEQ ID NO: 4111243 - DNA, 15 bp, Homo sapiens
gatatttttgtactt

SEQ ID NO: 4111244 - DNA, 14 bp, Homo sapiens
gatcaaataactta

SEQ ID NO: 4111245 - DNA, 14 bp, Homo sapiens
gatcaaatacttta

SEQ ID NO: 4111246 - DNA, 16 bp, Homo sapiens
gatcaaatactttaaa

SEQ ID NO: 4111247 - DNA, 17 bp, Homo sapiens
gatcaaatactttaaag

SEQ ID NO: 4111248 - DNA, 19 bp, Homo sapiens
gatcaaatactttaaagga

SEQ ID NO: 4111249 - DNA, 23 bp, Homo sapiens
gatcaaattcatttttttcactg

SEQ ID NO: 4111250 - DNA, 18 bp, Homo sapiens
gatcaaccagctaagaaa

SEQ ID NO: 4111251 - DNA, 16 bp, Homo sapiens
gatcaacgcctcactg

SEQ ID NO: 4111252 - DNA, 17 bp, Homo sapiens
gatcaagtcctttgtga

SEQ ID NO: 4111253 - DNA, 22 bp, Homo sapiens
gatcaagtcctttgtgaatatt

SEQ ID NO: 4111254 - DNA, 21 bp, Homo sapiens
gatcaataaaatgtgattttt

SEQ ID NO: 4111255 - DNA, 19 bp, Homo sapiens
gatcaatatttttatatca

SEQ ID NO: 4111256 - DNA, 20 bp, Homo sapiens
gatcaattccctctctcagc

SEQ ID NO: 4111257 - DNA, 19 bp, Homo sapiens
gatcaattttcattaaact

SEQ ID NO: 4111258 - DNA, 13 bp, Homo sapiens
gatcacaagatgg

SEQ ID NO: 4111259 - DNA, 15 bp, Homo sapiens
gatcaccagcccggc

SEQ ID NO: 4111260 - DNA, 18 bp, Homo sapiens
gatcaccagcccggcctg

SEQ ID NO: 4111261 - DNA, 14 bp, Homo sapiens
gatcacgcctggct

SEQ ID NO: 4111262 - DNA, 15 bp, Homo sapiens
gatcacgcctggcta

SEQ ID NO: 4111263 - DNA, 15 bp, Homo sapiens
gatcagaacagcaga

SEQ ID NO: 4111264 - DNA, 16 bp, Homo sapiens
gatcagaccataatgt

SEQ ID NO: 4111265 - DNA, 22 bp, Homo sapiens
gatcagaggtgtacactaacat

SEQ ID NO: 4111266 - DNA, 16 bp, Homo sapiens
gatcagagttcctcct

SEQ ID NO: 4111267 - DNA, 19 bp, Homo sapiens
gatcagcaaaccggggcct

SEQ ID NO: 4111268 - DNA, 14 bp, Homo sapiens
gatcagccagaagc

SEQ ID NO: 4111269 - DNA, 14 bp, Homo sapiens
gatcaggaggaagt

SEQ ID NO: 4111270 - DNA, 20 bp, Homo sapiens
gatcagtataattttttaaa

SEQ ID NO: 4111271 - DNA, 23 bp, Homo sapiens
gatcagtcctttgatcagtataa

SEQ ID NO: 4111272 - DNA, 19 bp, Homo sapiens
gatcataagtgaatttata

SEQ ID NO: 4111273 - DNA, 20 bp, Homo sapiens
gatcatagctcactgcagcc

SEQ ID NO: 4111274 - DNA, 20 bp, Homo sapiens
gatcatggtgtaataagaca

SEQ ID NO: 4111275 - DNA, 21 bp, Homo sapiens
gatcatgtgtggaagttatta

SEQ ID NO: 4111276 - DNA, 18 bp, Homo sapiens
gatcattttccccccact

SEQ ID NO: 4111277 - DNA, 21 bp, Homo sapiens
gagtccagtgctctgcctcag

SEQ ID NO: 4111278 - DNA, 18 bp, Homo sapiens
gagtccattctcccaggt

SEQ ID NO: 4111279 - DNA, 20 bp, Homo sapiens
gagtccattctcccaggtac

SEQ ID NO: 4111280 - DNA, 11 bp, Homo sapiens
gagtcccctca

SEQ ID NO: 4111281 - DNA, 17 bp, Homo sapiens
gagtcccctcacctcct

SEQ ID NO: 4111282 - DNA, 18 bp, Homo sapiens
gagtcccctcacctcctc

SEQ ID NO: 4111283 - DNA, 16 bp, Homo sapiens
gagtcctcactcccag

SEQ ID NO: 4111284 - DNA, 21 bp, Homo sapiens
gagtcctccagaactcttcct

SEQ ID NO: 4111285 - DNA, 16 bp, Homo sapiens
gagtcctctagcaggc

SEQ ID NO: 4111286 - DNA, 20 bp, Homo sapiens
gagtcgtcactctctattgt

SEQ ID NO: 4111287 - DNA, 19 bp, Homo sapiens
gagtctagcgtagtgcagc

SEQ ID NO: 4111288 - DNA, 13 bp, Homo sapiens
gagtctccctctg

SEQ ID NO: 4111289 - DNA, 20 bp, Homo sapiens
gagtctcctctctgagactg

SEQ ID NO: 4111290 - DNA, 14 bp, Homo sapiens
gagtctctgccacc

SEQ ID NO: 4111291 - DNA, 13 bp, Homo sapiens
gagtctggacttt

SEQ ID NO: 4111292 - DNA, 15 bp, Homo sapiens
gagtctggggacctg

SEQ ID NO: 4111293 - DNA, 21 bp, Homo sapiens
gagtctggtctgcgccttggg

SEQ ID NO: 4111294 - DNA, 11 bp, Homo sapiens
gagtcttcatg

SEQ ID NO: 4111295 - DNA, 19 bp, Homo sapiens
gagtcttggtttctctcta

SEQ ID NO: 4111296 - DNA, 14 bp, Homo sapiens
gagtgaagaatctt

SEQ ID NO: 4111297 - DNA, 19 bp, Homo sapiens
gagtgacagtggattgcat

SEQ ID NO: 4111298 - DNA, 20 bp, Homo sapiens
gagtgagtcacctgctccag

SEQ ID NO: 4111299 - DNA, 19 bp, Homo sapiens
gagtgatgatttgggggag

SEQ ID NO: 4111300 - DNA, 12 bp, Homo sapiens
gagtgattgcag

SEQ ID NO: 4111301 - DNA, 15 bp, Homo sapiens
gagtgattgcagctt

SEQ ID NO: 4111302 - DNA, 16 bp, Homo sapiens
gagtgcacagctgtcc

SEQ ID NO: 4111303 - DNA, 16 bp, Homo sapiens
gagtgcagccttctcc

SEQ ID NO: 4111304 - DNA, 13 bp, Homo sapiens
gagtgccaggact

SEQ ID NO: 4111305 - DNA, 14 bp, Homo sapiens
gagtgccaggactc

SEQ ID NO: 4111306 - DNA, 22 bp, Homo sapiens
gagtgccaggactccccaggcc

SEQ ID NO: 4111307 - DNA, 19 bp, Homo sapiens
gagtgccctgctttgcaaa

SEQ ID NO: 4111308 - DNA, 16 bp, Homo sapiens
gagtgcgggctgaggc

SEQ ID NO: 4111309 - DNA, 18 bp, Homo sapiens
gagtgctggctcacagta

SEQ ID NO: 4111310 - DNA, 21 bp, Homo sapiens
gagtgctggctcacagtacag

SEQ ID NO: 4111311 - DNA, 22 bp, Homo sapiens
gagtgctggctcacagtacagc

SEQ ID NO: 4111312 - DNA, 20 bp, Homo sapiens
gagtggaggtgggctgggcc

SEQ ID NO: 4111313 - DNA, 19 bp, Homo sapiens
gagtggatctccaaggacc

SEQ ID NO: 4111314 - DNA, 17 bp, Homo sapiens
gagtggccagccagtgc

SEQ ID NO: 4111315 - DNA, 20 bp, Homo sapiens
gagtggccagccagtgccat

SEQ ID NO: 4111316 - DNA, 11 bp, Homo sapiens
gagtggcctcc

SEQ ID NO: 4111317 - DNA, 17 bp, Homo sapiens
gagtggcctccctgctg

SEQ ID NO: 4111318 - DNA, 13 bp, Homo sapiens
gagtggctcctcc

SEQ ID NO: 4111319 - DNA, 16 bp, Homo sapiens
gagtgggcacctcaga

SEQ ID NO: 4111320 - DNA, 21 bp, Homo sapiens
gagtggggttatctctgtgtt

SEQ ID NO: 4111321 - DNA, 16 bp, Homo sapiens
gagtggttaggcagca

SEQ ID NO: 4111322 - DNA, 19 bp, Homo sapiens
gagtggttaggcagcaagc

SEQ ID NO: 4111323 - DNA, 14 bp, Homo sapiens
gagtggttctcatt

SEQ ID NO: 4111324 - DNA, 21 bp, Homo sapiens
gagtggtttaggctatttgta

SEQ ID NO: 4111325 - DNA, 17 bp, Homo sapiens
gagtgtaagtgtgagta

SEQ ID NO: 4111326 - DNA, 13 bp, Homo sapiens
gagtgtagaagca

SEQ ID NO: 4111327 - DNA, 15 bp, Homo sapiens
gagtgtagaagcatt

SEQ ID NO: 4111328 - DNA, 15 bp, Homo sapiens
gagtgtagactgtgg

SEQ ID NO: 4111329 - DNA, 19 bp, Homo sapiens
gagtgtcctcttccctctc

SEQ ID NO: 4111330 - DNA, 11 bp, Homo sapiens
gagtgtgacag

SEQ ID NO: 4111331 - DNA, 12 bp, Homo sapiens
gagtgtgacagg

SEQ ID NO: 4111332 - DNA, 18 bp, Homo sapiens
gagtgtgggggaggcgca

SEQ ID NO: 4111333 - DNA, 22 bp, Homo sapiens
gagtgttgggcatgtgatcacg

SEQ ID NO: 4111334 - DNA, 18 bp, Homo sapiens
gagtgtttctaataaact

SEQ ID NO: 4111335 - DNA, 17 bp, Homo sapiens
gagttaaaaagggcagg

SEQ ID NO: 4111336 - DNA, 22 bp, Homo sapiens
gagttaaatagagtatatgcac

SEQ ID NO: 4111337 - DNA, 15 bp, Homo sapiens
gagttaggtcctcac

SEQ ID NO: 4111338 - DNA, 18 bp, Homo sapiens
gagttagtttctttggga

SEQ ID NO: 4111339 - DNA, 16 bp, Homo sapiens
gagttatctaaaagaa

SEQ ID NO: 4111340 - DNA, 22 bp, Homo sapiens
gagttatgatgtaatctctctg

SEQ ID NO: 4111341 - DNA, 13 bp, Homo sapiens
gagttcacaggag

SEQ ID NO: 4111342 - DNA, 22 bp, Homo sapiens
gagttcacaggaggccagtggg

SEQ ID NO: 4111343 - DNA, 23 bp, Homo sapiens
gagttcacaggaggccagtgggc

SEQ ID NO: 4111344 - DNA, 17 bp, Homo sapiens
gagttccatgaagacca

SEQ ID NO: 4111345 - DNA, 17 bp, Homo sapiens
gagttcctaccatggag

SEQ ID NO: 4111346 - DNA, 23 bp, Homo sapiens
gagttctgggtttctagaggtca

SEQ ID NO: 4111347 - DNA, 13 bp, Homo sapiens
gagttcttaaagt

SEQ ID NO: 4111348 - DNA, 20 bp, Homo sapiens
gagttgatctggaacccaga

SEQ ID NO: 4111349 - DNA, 20 bp, Homo sapiens
gagttggcaaaatggggttt

SEQ ID NO: 4111350 - DNA, 17 bp, Homo sapiens
gagtttaccatttgtaa

SEQ ID NO: 4111351 - DNA, 17 bp, Homo sapiens
gagtttcctatgggaac

SEQ ID NO: 4111352 - DNA, 12 bp, Homo sapiens
gagtttctgttt

SEQ ID NO: 4111353 - DNA, 15 bp, Homo sapiens
gagtttctgtttgat

SEQ ID NO: 4111354 - DNA, 22 bp, Homo sapiens
gagtttgaaggaggtgagggat

SEQ ID NO: 4111355 - DNA, 17 bp, Homo sapiens
gagtttgagaccagcct

SEQ ID NO: 4111356 - DNA, 17 bp, Homo sapiens
gagtttgcaatgtcaca

SEQ ID NO: 4111357 - DNA, 16 bp, Homo sapiens
gagtttgttctgttct

SEQ ID NO: 4111358 - DNA, 23 bp, Homo sapiens
gagttttaaattatgtataaaca

SEQ ID NO: 4111359 - DNA, 18 bp, Homo sapiens
gagttttgatttggtgga

SEQ ID NO: 4111360 - DNA, 19 bp, Homo sapiens
gataaaagggcaaatctgc

SEQ ID NO: 4111361 - DNA, 16 bp, Homo sapiens
gataaaataaataatt

SEQ ID NO: 4111362 - DNA, 13 bp, Homo sapiens
gataaaattacaa

SEQ ID NO: 4111363 - DNA, 11 bp, Homo sapiens
gataaagatga

SEQ ID NO: 4111364 - DNA, 15 bp, Homo sapiens
gataaagcacagctg

SEQ ID NO: 4111365 - DNA, 21 bp, Homo sapiens
gataaataatgtagttttgtt

SEQ ID NO: 4111366 - DNA, 14 bp, Homo sapiens
gataaatatttgac

SEQ ID NO: 4111367 - DNA, 16 bp, Homo sapiens
gataaatcatttcagt

SEQ ID NO: 4111368 - DNA, 18 bp, Homo sapiens
gataaatcatttcagtat

SEQ ID NO: 4111369 - DNA, 13 bp, Homo sapiens
gataaattataag

SEQ ID NO: 4111370 - DNA, 15 bp, Homo sapiens
gataacaagatcttt

SEQ ID NO: 4111371 - DNA, 15 bp, Homo sapiens
gataacaccagtggg

SEQ ID NO: 4111372 - DNA, 22 bp, Homo sapiens
gataacctgtacttcaagttaa

SEQ ID NO: 4111373 - DNA, 19 bp, Homo sapiens
gataactttacagaaatgg

SEQ ID NO: 4111374 - DNA, 22 bp, Homo sapiens
gataataaattgaaattgtgaa

SEQ ID NO: 4111375 - DNA, 12 bp, Homo sapiens
gataataatggg

SEQ ID NO: 4111376 - DNA, 21 bp, Homo sapiens
gataatcagtgtgtctaaatt

SEQ ID NO: 4111377 - DNA, 16 bp, Homo sapiens
gataatgaaataatca

SEQ ID NO: 4111378 - DNA, 16 bp, Homo sapiens
gataatgccccaagga

SEQ ID NO: 4111379 - DNA, 20 bp, Homo sapiens
gataatgccccaaggacaag

SEQ ID NO: 4111380 - DNA, 21 bp, Homo sapiens
gaggggatgtgtgtgtgcaga

SEQ ID NO: 4111381 - DNA, 23 bp, Homo sapiens
gaggggatgtgtgtgtgcagagc

SEQ ID NO: 4111382 - DNA, 13 bp, Homo sapiens
gaggggccctggc

SEQ ID NO: 4111383 - DNA, 16 bp, Homo sapiens
gaggggctctcagctc

SEQ ID NO: 4111384 - DNA, 16 bp, Homo sapiens
gaggggctgcagggcc

SEQ ID NO: 4111385 - DNA, 14 bp, Homo sapiens
gagggggagggggt

SEQ ID NO: 4111386 - DNA, 13 bp, Homo sapiens
gagggggagggtg

SEQ ID NO: 4111387 - DNA, 15 bp, Homo sapiens
gagggggctggccat

SEQ ID NO: 4111388 - DNA, 20 bp, Homo sapiens
gagggggttacaaactgcaa

SEQ ID NO: 4111389 - DNA, 14 bp, Homo sapiens
gaggggtaggcaga

SEQ ID NO: 4111390 - DNA, 14 bp, Homo sapiens
gaggggtctcggat

SEQ ID NO: 4111391 - DNA, 21 bp, Homo sapiens
gaggggtgtggctccttccca

SEQ ID NO: 4111392 - DNA, 20 bp, Homo sapiens
gaggggttggtgggagggtt

SEQ ID NO: 4111393 - DNA, 15 bp, Homo sapiens
gagggtaaataaacc

SEQ ID NO: 4111394 - DNA, 15 bp, Homo sapiens
gagggtacagctggg

SEQ ID NO: 4111395 - DNA, 17 bp, Homo sapiens
gagggtacagctgggct

SEQ ID NO: 4111396 - DNA, 19 bp, Homo sapiens
gagggtcaggactgtgact

SEQ ID NO: 4111397 - DNA, 15 bp, Homo sapiens
gagggtcctggctcc

SEQ ID NO: 4111398 - DNA, 17 bp, Homo sapiens
gagggtcctggctcctg

SEQ ID NO: 4111399 - DNA, 18 bp, Homo sapiens
gagggtctcgctgtcact

SEQ ID NO: 4111400 - DNA, 20 bp, Homo sapiens
gagggtggagactaagccct

SEQ ID NO: 4111401 - DNA, 14 bp, Homo sapiens
gagggtgggggagg

SEQ ID NO: 4111402 - DNA, 22 bp, Homo sapiens
gagggtgtggctttccaggcac

SEQ ID NO: 4111403 - DNA, 14 bp, Homo sapiens
gagggttggggagg

SEQ ID NO: 4111404 - DNA, 17 bp, Homo sapiens
gagggttggggaggggc

SEQ ID NO: 4111405 - DNA, 20 bp, Homo sapiens
gagggttgggttcatctgag

SEQ ID NO: 4111406 - DNA, 16 bp, Homo sapiens
gaggtagccgggctct

SEQ ID NO: 4111407 - DNA, 19 bp, Homo sapiens
gaggtcaaggctgcagtga

SEQ ID NO: 4111408 - DNA, 16 bp, Homo sapiens
gaggtcaagtaagaag

SEQ ID NO: 4111409 - DNA, 16 bp, Homo sapiens
gaggtcacattcagga

SEQ ID NO: 4111410 - DNA, 19 bp, Homo sapiens
gaggtcacattcaggaaga

SEQ ID NO: 4111411 - DNA, 15 bp, Homo sapiens
gaggtcactggaaag

SEQ ID NO: 4111412 - DNA, 18 bp, Homo sapiens
gaggtcaggacggctcct

SEQ ID NO: 4111413 - DNA, 12 bp, Homo sapiens
gaggtccaagca

SEQ ID NO: 4111414 - DNA, 20 bp, Homo sapiens
gaggtcccaaggttctgggt

SEQ ID NO: 4111415 - DNA, 13 bp, Homo sapiens
gaggtcccaggaa

SEQ ID NO: 4111416 - DNA, 14 bp, Homo sapiens
gaggtcccaggcag

SEQ ID NO: 4111417 - DNA, 23 bp, Homo sapiens
gaggtcctccgtagggtctttct

SEQ ID NO: 4111418 - DNA, 21 bp, Homo sapiens
gaggtctgtacgttacctctt

SEQ ID NO: 4111419 - DNA, 14 bp, Homo sapiens
gaggtctgttcctt

SEQ ID NO: 4111420 - DNA, 12 bp, Homo sapiens
gaggtcttgcta

SEQ ID NO: 4111421 - DNA, 22 bp, Homo sapiens
gaggtcttgctagaatgggaag

SEQ ID NO: 4111422 - DNA, 16 bp, Homo sapiens
gaggtgaaaaggccaa

SEQ ID NO: 4111423 - DNA, 17 bp, Homo sapiens
gaggtgaaaaggccaag

SEQ ID NO: 4111424 - DNA, 16 bp, Homo sapiens
gaggtgaaagggagct

SEQ ID NO: 4111425 - DNA, 16 bp, Homo sapiens
gaggtgaggagcagag

SEQ ID NO: 4111426 - DNA, 18 bp, Homo sapiens
gaggtgaggggggctggc

SEQ ID NO: 4111427 - DNA, 12 bp, Homo sapiens
gaggtgcctgga

SEQ ID NO: 4111428 - DNA, 15 bp, Homo sapiens
gaggtgcctgtccca

SEQ ID NO: 4111429 - DNA, 17 bp, Homo sapiens
gaggtggaagaagggag

SEQ ID NO: 4111430 - DNA, 19 bp, Homo sapiens
gaggtggagattgcagtga

SEQ ID NO: 4111431 - DNA, 13 bp, Homo sapiens
gaggtgggagggc

SEQ ID NO: 4111432 - DNA, 14 bp, Homo sapiens
gaggtgggagggcc

SEQ ID NO: 4111433 - DNA, 19 bp, Homo sapiens
gaggtgggcatgccaccct

SEQ ID NO: 4111434 - DNA, 20 bp, Homo sapiens
gaggtgggcatgccaccctc

SEQ ID NO: 4111435 - DNA, 17 bp, Homo sapiens
gaggtgggtgtgggtgg

SEQ ID NO: 4111436 - DNA, 18 bp, Homo sapiens
gaggtgggtgtgggtgga

SEQ ID NO: 4111437 - DNA, 13 bp, Homo sapiens
gaggtggtctgaa

SEQ ID NO: 4111438 - DNA, 19 bp, Homo sapiens
gaggtggtctgaatgttct

SEQ ID NO: 4111439 - DNA, 20 bp, Homo sapiens
gaggtggtggagtggagtga

SEQ ID NO: 4111440 - DNA, 17 bp, Homo sapiens
gaggtgtacactaacat

SEQ ID NO: 4111441 - DNA, 20 bp, Homo sapiens
gaggtgtacactaacatttc

SEQ ID NO: 4111442 - DNA, 13 bp, Homo sapiens
gaggtgtctggcc

SEQ ID NO: 4111443 - DNA, 16 bp, Homo sapiens
gaggtgtctggcctga

SEQ ID NO: 4111444 - DNA, 18 bp, Homo sapiens
gaggtgtctggcctgagg

SEQ ID NO: 4111445 - DNA, 20 bp, Homo sapiens
gaggtgtctggcctgaggtc

SEQ ID NO: 4111446 - DNA, 16 bp, Homo sapiens
gaggtgtgcctggcct

SEQ ID NO: 4111447 - DNA, 19 bp, Homo sapiens
gaggttataggtcactcct

SEQ ID NO: 4111448 - DNA, 19 bp, Homo sapiens
gaggttcctctgcctgccc

SEQ ID NO: 4111449 - DNA, 19 bp, Homo sapiens
gagtaaatattgaggcttt

SEQ ID NO: 4111450 - DNA, 17 bp, Homo sapiens
gagtaaattgctctgtt

SEQ ID NO: 4111451 - DNA, 20 bp, Homo sapiens
gagtaacaatacaaatggat

SEQ ID NO: 4111452 - DNA, 21 bp, Homo sapiens
gagtaacaatacaaatggatt

SEQ ID NO: 4111453 - DNA, 14 bp, Homo sapiens
gagtaatggtgtag

SEQ ID NO: 4111454 - DNA, 13 bp, Homo sapiens
gagtaccaggggc

SEQ ID NO: 4111455 - DNA, 17 bp, Homo sapiens
gagtacctgctgcccca

SEQ ID NO: 4111456 - DNA, 22 bp, Homo sapiens
gagtacctgctgccccagctga

SEQ ID NO: 4111457 - DNA, 15 bp, Homo sapiens
gagtacgtcctgcct

SEQ ID NO: 4111458 - DNA, 18 bp, Homo sapiens
gagtacgtcctgcctggc

SEQ ID NO: 4111459 - DNA, 13 bp, Homo sapiens
gagtactgggaga

SEQ ID NO: 4111460 - DNA, 17 bp, Homo sapiens
gagtagaaataaaagtg

SEQ ID NO: 4111461 - DNA, 17 bp, Homo sapiens
gagtagaattgcattga

SEQ ID NO: 4111462 - DNA, 15 bp, Homo sapiens
gagtagacaaaagga

SEQ ID NO: 4111463 - DNA, 22 bp, Homo sapiens
gagtagcaagttctagagaaga

SEQ ID NO: 4111464 - DNA, 13 bp, Homo sapiens
gagtagccaagct

SEQ ID NO: 4111465 - DNA, 12 bp, Homo sapiens
gagtatatgcac

SEQ ID NO: 4111466 - DNA, 17 bp, Homo sapiens
gagtatcaggtctccca

SEQ ID NO: 4111467 - DNA, 14 bp, Homo sapiens
gagtatccttcctt

SEQ ID NO: 4111468 - DNA, 16 bp, Homo sapiens
gagtatccttccttca

SEQ ID NO: 4111469 - DNA, 19 bp, Homo sapiens
gagtcaaatggtaggcatt

SEQ ID NO: 4111470 - DNA, 12 bp, Homo sapiens
gagtcacacagt

SEQ ID NO: 4111471 - DNA, 14 bp, Homo sapiens
gagtcaccttttct

SEQ ID NO: 4111472 - DNA, 13 bp, Homo sapiens
gagtcagagccct

SEQ ID NO: 4111473 - DNA, 22 bp, Homo sapiens
gagtcagagccctggctgggtt

SEQ ID NO: 4111474 - DNA, 12 bp, Homo sapiens
gagtcagatgag

SEQ ID NO: 4111475 - DNA, 20 bp, Homo sapiens
gagtcagcctcgcaggcctc

SEQ ID NO: 4111476 - DNA, 15 bp, Homo sapiens
gagtcagctctctgc

SEQ ID NO: 4111477 - DNA, 19 bp, Homo sapiens
gagtcagtcttcacttgca

SEQ ID NO: 4111478 - DNA, 16 bp, Homo sapiens
gagtcagtgtctggct

SEQ ID NO: 4111479 - DNA, 13 bp, Homo sapiens
gagtcatctccat

SEQ ID NO: 4111480 - DNA, 14 bp, Homo sapiens
gagtcatttaaatg

SEQ ID NO: 4111481 - DNA, 20 bp, Homo sapiens
gagtccagggtttctctgca

SEQ ID NO: 4111482 - DNA, 15 bp, Homo sapiens
gagtccagtgctctg

SEQ ID NO: 4111483 - DNA, 18 bp, Homo sapiens
gagtccagtgctctgcct

SEQ ID NO: 4111484 - DNA, 17 bp, Homo sapiens
gaggcccaggctgggaa

SEQ ID NO: 4111485 - DNA, 13 bp, Homo sapiens
gaggcccagttca

SEQ ID NO: 4111486 - DNA, 15 bp, Homo sapiens
gaggccccactgatg

SEQ ID NO: 4111487 - DNA, 18 bp, Homo sapiens
gaggccccactgatgctg

SEQ ID NO: 4111488 - DNA, 13 bp, Homo sapiens
gaggccccagcct

SEQ ID NO: 4111489 - DNA, 22 bp, Homo sapiens
gaggccccagcctccctgaagc

SEQ ID NO: 4111490 - DNA, 18 bp, Homo sapiens
gaggcccctggagccaga

SEQ ID NO: 4111491 - DNA, 17 bp, Homo sapiens
gaggccccttctctccc

SEQ ID NO: 4111492 - DNA, 22 bp, Homo sapiens
gaggccctcaatccaccttcag

SEQ ID NO: 4111493 - DNA, 21 bp, Homo sapiens
gaggccctcctgtgctggggg

SEQ ID NO: 4111494 - DNA, 14 bp, Homo sapiens
gaggccctgggctg

SEQ ID NO: 4111495 - DNA, 17 bp, Homo sapiens
gaggccgaaggtgcctc

SEQ ID NO: 4111496 - DNA, 15 bp, Homo sapiens
gaggcctcaggtgct

SEQ ID NO: 4111497 - DNA, 16 bp, Homo sapiens
gaggcctcaggtgctg

SEQ ID NO: 4111498 - DNA, 12 bp, Homo sapiens
gaggcctgcccg

SEQ ID NO: 4111499 - DNA, 21 bp, Homo sapiens
gaggcctgctgccagtgcagc

SEQ ID NO: 4111500 - DNA, 18 bp, Homo sapiens
gaggcctggactttcctg

SEQ ID NO: 4111501 - DNA, 17 bp, Homo sapiens
gaggcctggccaggcac

SEQ ID NO: 4111502 - DNA, 14 bp, Homo sapiens
gaggccttccagct

SEQ ID NO: 4111503 - DNA, 19 bp, Homo sapiens
gaggccttccagctgctgt

SEQ ID NO: 4111504 - DNA, 21 bp, Homo sapiens
gaggcggagagtgctgactgt

SEQ ID NO: 4111505 - DNA, 20 bp, Homo sapiens
gaggcggagcttgcagtgag

SEQ ID NO: 4111506 - DNA, 14 bp, Homo sapiens
gaggcggcccggcc

SEQ ID NO: 4111507 - DNA, 16 bp, Homo sapiens
gaggcggcccggccag

SEQ ID NO: 4111508 - DNA, 17 bp, Homo sapiens
gaggcggcccggccagc

SEQ ID NO: 4111509 - DNA, 23 bp, Homo sapiens
gaggcggcccggccagcgggcac

SEQ ID NO: 4111510 - DNA, 19 bp, Homo sapiens
gaggcgggtggatcacttg

SEQ ID NO: 4111511 - DNA, 19 bp, Homo sapiens
gaggcggtggtagagagag

SEQ ID NO: 4111512 - DNA, 22 bp, Homo sapiens
gaggctcagagactgcaagctg

SEQ ID NO: 4111513 - DNA, 14 bp, Homo sapiens
gaggctctggacag

SEQ ID NO: 4111514 - DNA, 21 bp, Homo sapiens
gaggctctggacagcagaagc

SEQ ID NO: 4111515 - DNA, 22 bp, Homo sapiens
gaggctgagcctacagatgaac

SEQ ID NO: 4111516 - DNA, 16 bp, Homo sapiens
gaggctgaggcaagag

SEQ ID NO: 4111517 - DNA, 17 bp, Homo sapiens
gaggctgaggcaggagg

SEQ ID NO: 4111518 - DNA, 16 bp, Homo sapiens
gaggctgaggcctgga

SEQ ID NO: 4111519 - DNA, 14 bp, Homo sapiens
gaggctgcagtcag

SEQ ID NO: 4111520 - DNA, 9 bp, Homo sapiens
gaggctgcc

SEQ ID NO: 4111521 - DNA, 12 bp, Homo sapiens
gaggctgccccc

SEQ ID NO: 4111522 - DNA, 21 bp, Homo sapiens
gaggctgcccccggccccctg

SEQ ID NO: 4111523 - DNA, 15 bp, Homo sapiens
gaggctgcccctctc

SEQ ID NO: 4111524 - DNA, 19 bp, Homo sapiens
gaggctgcccctctcacca

SEQ ID NO: 4111525 - DNA, 18 bp, Homo sapiens
gaggctgggcacagaggt

SEQ ID NO: 4111526 - DNA, 19 bp, Homo sapiens
gaggctgggcacagaggtc

SEQ ID NO: 4111527 - DNA, 12 bp, Homo sapiens
gaggctgtcctg

SEQ ID NO: 4111528 - DNA, 20 bp, Homo sapiens
gaggctgtgtgcctggggga

SEQ ID NO: 4111529 - DNA, 13 bp, Homo sapiens
gaggcttcctgcg

SEQ ID NO: 4111530 - DNA, 15 bp, Homo sapiens
gaggcttcctgcgtc

SEQ ID NO: 4111531 - DNA, 18 bp, Homo sapiens
gaggcttcggagtttctt

SEQ ID NO: 4111532 - DNA, 19 bp, Homo sapiens
gaggcttctccgccagcct

SEQ ID NO: 4111533 - DNA, 14 bp, Homo sapiens
gaggcttctccttc

SEQ ID NO: 4111534 - DNA, 20 bp, Homo sapiens
gaggctttggatttgacatt

SEQ ID NO: 4111535 - DNA, 14 bp, Homo sapiens
gaggctttgtgttg

SEQ ID NO: 4111536 - DNA, 16 bp, Homo sapiens
gaggctttgtgttgta

SEQ ID NO: 4111537 - DNA, 17 bp, Homo sapiens
gagggaaggttcttcat

SEQ ID NO: 4111538 - DNA, 23 bp, Homo sapiens
gagggaagtgtgagcgccttggt

SEQ ID NO: 4111539 - DNA, 17 bp, Homo sapiens
gagggaccaactgggcc

SEQ ID NO: 4111540 - DNA, 16 bp, Homo sapiens
gagggaccatgtgtca

SEQ ID NO: 4111541 - DNA, 18 bp, Homo sapiens
gagggactctgaagcctc

SEQ ID NO: 4111542 - DNA, 21 bp, Homo sapiens
gagggagacactggcccctca

SEQ ID NO: 4111543 - DNA, 16 bp, Homo sapiens
gagggagagagagaga

SEQ ID NO: 4111544 - DNA, 12 bp, Homo sapiens
gagggaggggaa

SEQ ID NO: 4111545 - DNA, 21 bp, Homo sapiens
gagggaggggaaaagcatttt

SEQ ID NO: 4111546 - DNA, 17 bp, Homo sapiens
gagggaggggaaatgta

SEQ ID NO: 4111547 - DNA, 18 bp, Homo sapiens
gagggaggtgtttaaaga

SEQ ID NO: 4111548 - DNA, 23 bp, Homo sapiens
gagggaggtgtttaaagagaggt

SEQ ID NO: 4111549 - DNA, 23 bp, Homo sapiens
gagggatgaagggcgagtgaatc

SEQ ID NO: 4111550 - DNA, 16 bp, Homo sapiens
gagggattgaggggcc

SEQ ID NO: 4111551 - DNA, 18 bp, Homo sapiens
gagggatttccctgcaga

SEQ ID NO: 4111552 - DNA, 18 bp, Homo sapiens
gagggcaagggccatgct

SEQ ID NO: 4111553 - DNA, 20 bp, Homo sapiens
gagggcaagtggatgggaat

SEQ ID NO: 4111554 - DNA, 12 bp, Homo sapiens
gagggcactggt

SEQ ID NO: 4111555 - DNA, 16 bp, Homo sapiens
gagggcactggtggcc

SEQ ID NO: 4111556 - DNA, 22 bp, Homo sapiens
gagggcagaaaggttctgcccg

SEQ ID NO: 4111557 - DNA, 23 bp, Homo sapiens
gagggcagaaaggttctgcccgg

SEQ ID NO: 4111558 - DNA, 18 bp, Homo sapiens
gagggcatccataccagc

SEQ ID NO: 4111559 - DNA, 14 bp, Homo sapiens
gagggcccagagca

SEQ ID NO: 4111560 - DNA, 18 bp, Homo sapiens
gagggcccagagcaggaa

SEQ ID NO: 4111561 - DNA, 20 bp, Homo sapiens
gagggcccagagcaggaagc

SEQ ID NO: 4111562 - DNA, 22 bp, Homo sapiens
gagggcccagagcaggaagcat

SEQ ID NO: 4111563 - DNA, 15 bp, Homo sapiens
gagggcccagccagg

SEQ ID NO: 4111564 - DNA, 19 bp, Homo sapiens
gagggcccagccaggagca

SEQ ID NO: 4111565 - DNA, 21 bp, Homo sapiens
gagggcccagccaggagcaga

SEQ ID NO: 4111566 - DNA, 14 bp, Homo sapiens
gagggcccagccca

SEQ ID NO: 4111567 - DNA, 18 bp, Homo sapiens
gagggcccagcccagagc

SEQ ID NO: 4111568 - DNA, 21 bp, Homo sapiens
gagggcctgctggaggcctca

SEQ ID NO: 4111569 - DNA, 17 bp, Homo sapiens
gagggcggtggacaata

SEQ ID NO: 4111570 - DNA, 19 bp, Homo sapiens
gagggctcgaggggtgggc

SEQ ID NO: 4111571 - DNA, 22 bp, Homo sapiens
gagggctgatggaggaaaaagg

SEQ ID NO: 4111572 - DNA, 19 bp, Homo sapiens
gagggctggaggcccaggc

SEQ ID NO: 4111573 - DNA, 10 bp, Homo sapiens
gagggctggc

SEQ ID NO: 4111574 - DNA, 16 bp, Homo sapiens
gagggctggctggcct

SEQ ID NO: 4111575 - DNA, 18 bp, Homo sapiens
gagggctggctggcctca

SEQ ID NO: 4111576 - DNA, 14 bp, Homo sapiens
gaggggaaaggctg

SEQ ID NO: 4111577 - DNA, 13 bp, Homo sapiens
gaggggaaatgta

SEQ ID NO: 4111578 - DNA, 15 bp, Homo sapiens
gaggggaaatgtaat

SEQ ID NO: 4111579 - DNA, 18 bp, Homo sapiens
gaggggaactgagtcacg

SEQ ID NO: 4111580 - DNA, 14 bp, Homo sapiens
gaggggaagtccct

SEQ ID NO: 4111581 - DNA, 16 bp, Homo sapiens
gaggggactgggggac

SEQ ID NO: 4111582 - DNA, 23 bp, Homo sapiens
gaggggagagacaggcagcccag

SEQ ID NO: 4111583 - DNA, 11 bp, Homo sapiens
gaggggagagg

SEQ ID NO: 4111584 - DNA, 11 bp, Homo sapiens
gaggggaggag

SEQ ID NO: 4111585 - DNA, 13 bp, Homo sapiens
gaggggaggcaga

SEQ ID NO: 4111586 - DNA, 12 bp, Homo sapiens
gaggggagggta

SEQ ID NO: 4111587 - DNA, 14 bp, Homo sapiens
gagctggagccccc

SEQ ID NO: 4111588 - DNA, 21 bp, Homo sapiens
gagctggccaggccctgagag

SEQ ID NO: 4111589 - DNA, 19 bp, Homo sapiens
gagctggctccagcctgga

SEQ ID NO: 4111590 - DNA, 12 bp, Homo sapiens
gagctgggaggc

SEQ ID NO: 4111591 - DNA, 18 bp, Homo sapiens
gagctgggaggcatggcc

SEQ ID NO: 4111592 - DNA, 19 bp, Homo sapiens
gagctggggacctggtacc

SEQ ID NO: 4111593 - DNA, 20 bp, Homo sapiens
gagctggggagaatggggct

SEQ ID NO: 4111594 - DNA, 20 bp, Homo sapiens
gagctggggggttggcagcc

SEQ ID NO: 4111595 - DNA, 23 bp, Homo sapiens
gagctggggggttggcagcccac

SEQ ID NO: 4111596 - DNA, 15 bp, Homo sapiens
gagctgggtggcctg

SEQ ID NO: 4111597 - DNA, 16 bp, Homo sapiens
gagctgggtggcctgt

SEQ ID NO: 4111598 - DNA, 24 bp, Homo sapiens
gagctgggtggcctgtttctgcag

SEQ ID NO: 4111599 - DNA, 16 bp, Homo sapiens
gagctggtgcattaca

SEQ ID NO: 4111600 - DNA, 18 bp, Homo sapiens
gagctggtgcattacaga

SEQ ID NO: 4111601 - DNA, 17 bp, Homo sapiens
gagctggtgcccggaga

SEQ ID NO: 4111602 - DNA, 17 bp, Homo sapiens
gagctgtcaccaaggaa

SEQ ID NO: 4111603 - DNA, 18 bp, Homo sapiens
gagctgtcaccaaggaaa

SEQ ID NO: 4111604 - DNA, 21 bp, Homo sapiens
gagctgtgagttctccctgta

SEQ ID NO: 4111605 - DNA, 20 bp, Homo sapiens
gagctgtttatggcctcagc

SEQ ID NO: 4111606 - DNA, 10 bp, Homo sapiens
gagcttctct

SEQ ID NO: 4111607 - DNA, 13 bp, Homo sapiens
gagcttggctctc

SEQ ID NO: 4111608 - DNA, 22 bp, Homo sapiens
gagcttggctctcctctggcta

SEQ ID NO: 4111609 - DNA, 23 bp, Homo sapiens
gagcttggctctcctctggctag

SEQ ID NO: 4111610 - DNA, 13 bp, Homo sapiens
gagcttgggcagt

SEQ ID NO: 4111611 - DNA, 24 bp, Homo sapiens
gagcttgtgctcctcttgattcct

SEQ ID NO: 4111612 - DNA, 14 bp, Homo sapiens
gagctttgtgcttg

SEQ ID NO: 4111613 - DNA, 16 bp, Homo sapiens
gaggaaatcctacctt

SEQ ID NO: 4111614 - DNA, 23 bp, Homo sapiens
gaggaacagtgtggtttgggaaa

SEQ ID NO: 4111615 - DNA, 16 bp, Homo sapiens
gaggaacccccaccag

SEQ ID NO: 4111616 - DNA, 15 bp, Homo sapiens
gaggaactgtccaga

SEQ ID NO: 4111617 - DNA, 18 bp, Homo sapiens
gaggaactgtccagagag

SEQ ID NO: 4111618 - DNA, 17 bp, Homo sapiens
gaggaagacaagcattt

SEQ ID NO: 4111619 - DNA, 13 bp, Homo sapiens
gaggaagagtctt

SEQ ID NO: 4111620 - DNA, 12 bp, Homo sapiens
gaggaagcttgg

SEQ ID NO: 4111621 - DNA, 13 bp, Homo sapiens
gaggaaggcaaga

SEQ ID NO: 4111622 - DNA, 13 bp, Homo sapiens
gaggaaggggggt

SEQ ID NO: 4111623 - DNA, 13 bp, Homo sapiens
gaggaatatcaat

SEQ ID NO: 4111624 - DNA, 21 bp, Homo sapiens
gaggaatcatgtcaggcctgt

SEQ ID NO: 4111625 - DNA, 13 bp, Homo sapiens
gaggaatcctgga

SEQ ID NO: 4111626 - DNA, 20 bp, Homo sapiens
gaggaatgctctgtgccaga

SEQ ID NO: 4111627 - DNA, 17 bp, Homo sapiens
gaggaatgctggactgg

SEQ ID NO: 4111628 - DNA, 18 bp, Homo sapiens
gaggaatgctggactgga

SEQ ID NO: 4111629 - DNA, 20 bp, Homo sapiens
gaggacaggcgggaggaggt

SEQ ID NO: 4111630 - DNA, 16 bp, Homo sapiens
gaggacctgaccctac

SEQ ID NO: 4111631 - DNA, 20 bp, Homo sapiens
gaggacctgaccctactccc

SEQ ID NO: 4111632 - DNA, 22 bp, Homo sapiens
gaggacctgaccctactccctt

SEQ ID NO: 4111633 - DNA, 16 bp, Homo sapiens
gaggacggtgcaaccc

SEQ ID NO: 4111634 - DNA, 13 bp, Homo sapiens
gaggagagacggt

SEQ ID NO: 4111635 - DNA, 18 bp, Homo sapiens
gaggagatgaccagggat

SEQ ID NO: 4111636 - DNA, 16 bp, Homo sapiens
gaggagctctaccctg

SEQ ID NO: 4111637 - DNA, 21 bp, Homo sapiens
gaggagctctaccctgctccc

SEQ ID NO: 4111638 - DNA, 22 bp, Homo sapiens
gaggagctctaccctgctccct

SEQ ID NO: 4111639 - DNA, 23 bp, Homo sapiens
gaggagctgcctgcttggcccgg

SEQ ID NO: 4111640 - DNA, 11 bp, Homo sapiens
gaggagctgct

SEQ ID NO: 4111641 - DNA, 12 bp, Homo sapiens
gaggagctgctg

SEQ ID NO: 4111642 - DNA, 16 bp, Homo sapiens
gaggaggaaggcaaga

SEQ ID NO: 4111643 - DNA, 13 bp, Homo sapiens
gaggaggagatgg

SEQ ID NO: 4111644 - DNA, 22 bp, Homo sapiens
gaggaggcctgtcccaattctg

SEQ ID NO: 4111645 - DNA, 21 bp, Homo sapiens
gaggaggccttgggctctgct

SEQ ID NO: 4111646 - DNA, 11 bp, Homo sapiens
gaggagggaga

SEQ ID NO: 4111647 - DNA, 13 bp, Homo sapiens
gaggagggcagag

SEQ ID NO: 4111648 - DNA, 15 bp, Homo sapiens
gaggaggtgcctgga

SEQ ID NO: 4111649 - DNA, 12 bp, Homo sapiens
gaggagtaacaa

SEQ ID NO: 4111650 - DNA, 20 bp, Homo sapiens
gaggagtaacaatacaaatg

SEQ ID NO: 4111651 - DNA, 14 bp, Homo sapiens
gaggagtggaggtg

SEQ ID NO: 4111652 - DNA, 15 bp, Homo sapiens
gaggatgagagccca

SEQ ID NO: 4111653 - DNA, 16 bp, Homo sapiens
gaggatgagagcccag

SEQ ID NO: 4111654 - DNA, 18 bp, Homo sapiens
gaggatgagagcccagag

SEQ ID NO: 4111655 - DNA, 23 bp, Homo sapiens
gaggatggaaactggactcacat

SEQ ID NO: 4111656 - DNA, 17 bp, Homo sapiens
gaggatgggtcagagct

SEQ ID NO: 4111657 - DNA, 20 bp, Homo sapiens
gaggatgtccctgggccagg

SEQ ID NO: 4111658 - DNA, 19 bp, Homo sapiens
gaggattataaatgaaatt

SEQ ID NO: 4111659 - DNA, 17 bp, Homo sapiens
gaggattcaggggctgg

SEQ ID NO: 4111660 - DNA, 19 bp, Homo sapiens
gaggattcaggggctgggg

SEQ ID NO: 4111661 - DNA, 17 bp, Homo sapiens
gaggattgttgaatcta

SEQ ID NO: 4111662 - DNA, 22 bp, Homo sapiens
gaggcaatgggagctgaggcca

SEQ ID NO: 4111663 - DNA, 19 bp, Homo sapiens
gaggcaatgtcaggaacag

SEQ ID NO: 4111664 - DNA, 20 bp, Homo sapiens
gaggcactcagtgagcctcc

SEQ ID NO: 4111665 - DNA, 18 bp, Homo sapiens
gaggcactgaagtgctta

SEQ ID NO: 4111666 - DNA, 19 bp, Homo sapiens
gaggcagagaaagaagaga

SEQ ID NO: 4111667 - DNA, 21 bp, Homo sapiens
gaggcagagaaagaagagaca

SEQ ID NO: 4111668 - DNA, 21 bp, Homo sapiens
gaggcagcttcaagtgccttt

SEQ ID NO: 4111669 - DNA, 14 bp, Homo sapiens
gaggcaggctggga

SEQ ID NO: 4111670 - DNA, 15 bp, Homo sapiens
gaggcagggctctcc

SEQ ID NO: 4111671 - DNA, 17 bp, Homo sapiens
gaggcagggctctcccg

SEQ ID NO: 4111672 - DNA, 21 bp, Homo sapiens
gaggcagttgcccagcctctt

SEQ ID NO: 4111673 - DNA, 14 bp, Homo sapiens
gaggcatggccctg

SEQ ID NO: 4111674 - DNA, 18 bp, Homo sapiens
gaggcatggccctggggt

SEQ ID NO: 4111675 - DNA, 23 bp, Homo sapiens
gaggcattgttagtttagtgtgt

SEQ ID NO: 4111676 - DNA, 19 bp, Homo sapiens
gaggccaaaggctggtggc

SEQ ID NO: 4111677 - DNA, 16 bp, Homo sapiens
gaggccaataaaaagt

SEQ ID NO: 4111678 - DNA, 17 bp, Homo sapiens
gaggccaataaaaagtt

SEQ ID NO: 4111679 - DNA, 20 bp, Homo sapiens
gaggccaataaaaagttcag

SEQ ID NO: 4111680 - DNA, 21 bp, Homo sapiens
gaggccacactcagcacaagg

SEQ ID NO: 4111681 - DNA, 13 bp, Homo sapiens
gaggccaccggga

SEQ ID NO: 4111682 - DNA, 21 bp, Homo sapiens
gaggccaccgggacagacctg

SEQ ID NO: 4111683 - DNA, 16 bp, Homo sapiens
gaggccacttagggaa

SEQ ID NO: 4111684 - DNA, 22 bp, Homo sapiens
gaggccagagtcaccttttctg

SEQ ID NO: 4111685 - DNA, 14 bp, Homo sapiens
gaggccagccccac

SEQ ID NO: 4111686 - DNA, 21 bp, Homo sapiens
gaggccagccccacccaggag

SEQ ID NO: 4111687 - DNA, 15 bp, Homo sapiens
gaggccatctcagga

SEQ ID NO: 4111688 - DNA, 17 bp, Homo sapiens
gaggccatctcaggaga

SEQ ID NO: 4111689 - DNA, 16 bp, Homo sapiens
gaggcccaggctggga

SEQ ID NO: 4111690 - DNA, 15 bp, Homo sapiens
gagccagatggcaag

SEQ ID NO: 4111691 - DNA, 11 bp, Homo sapiens
gagccagctgc

SEQ ID NO: 4111692 - DNA, 20 bp, Homo sapiens
gagccagctgctttttgtga

SEQ ID NO: 4111693 - DNA, 12 bp, Homo sapiens
gagccaggaggg

SEQ ID NO: 4111694 - DNA, 21 bp, Homo sapiens
gagccaggcctgggtctgtgt

SEQ ID NO: 4111695 - DNA, 22 bp, Homo sapiens
gagccaggcctgggtctgtgtc

SEQ ID NO: 4111696 - DNA, 22 bp, Homo sapiens
gagccaggtaatgagggactgg

SEQ ID NO: 4111697 - DNA, 23 bp, Homo sapiens
gagccagtggaacagcgggagac

SEQ ID NO: 4111698 - DNA, 18 bp, Homo sapiens
gagccagttgtcctatgg

SEQ ID NO: 4111699 - DNA, 19 bp, Homo sapiens
gagccagttgtcctatgga

SEQ ID NO: 4111700 - DNA, 21 bp, Homo sapiens
gagccatcactagaagaaaag

SEQ ID NO: 4111701 - DNA, 22 bp, Homo sapiens
gagccatcactagaagaaaagc

SEQ ID NO: 4111702 - DNA, 16 bp, Homo sapiens
gagccattttgtgaat

SEQ ID NO: 4111703 - DNA, 19 bp, Homo sapiens
gagcccactgtcctgggcc

SEQ ID NO: 4111704 - DNA, 19 bp, Homo sapiens
gagcccagagggtggcaag

SEQ ID NO: 4111705 - DNA, 21 bp, Homo sapiens
gagcccagaggtaacagaaca

SEQ ID NO: 4111706 - DNA, 23 bp, Homo sapiens
gagcccagaggtaacagaacagc

SEQ ID NO: 4111707 - DNA, 15 bp, Homo sapiens
gagcccagccctccc

SEQ ID NO: 4111708 - DNA, 13 bp, Homo sapiens
gagcccagcctgg

SEQ ID NO: 4111709 - DNA, 16 bp, Homo sapiens
gagcccagcctgggag

SEQ ID NO: 4111710 - DNA, 23 bp, Homo sapiens
gagcccagcctgggagcccagag

SEQ ID NO: 4111711 - DNA, 13 bp, Homo sapiens
gagcccagctgcc

SEQ ID NO: 4111712 - DNA, 14 bp, Homo sapiens
gagcccagctgcct

SEQ ID NO: 4111713 - DNA, 19 bp, Homo sapiens
gagcccagctgcctggaga

SEQ ID NO: 4111714 - DNA, 19 bp, Homo sapiens
gagcccagctgggtcaggc

SEQ ID NO: 4111715 - DNA, 21 bp, Homo sapiens
gagcccagctgggtcaggcag

SEQ ID NO: 4111716 - DNA, 11 bp, Homo sapiens
gagcccaggag

SEQ ID NO: 4111717 - DNA, 23 bp, Homo sapiens
gagcccaggagttcgaggctgca

SEQ ID NO: 4111718 - DNA, 16 bp, Homo sapiens
gagcccatactcagcc

SEQ ID NO: 4111719 - DNA, 17 bp, Homo sapiens
gagcccatactcagcct

SEQ ID NO: 4111720 - DNA, 18 bp, Homo sapiens
gagcccatactcagcctg

SEQ ID NO: 4111721 - DNA, 19 bp, Homo sapiens
gagcccatactcagcctgc

SEQ ID NO: 4111722 - DNA, 16 bp, Homo sapiens
gagccccaggcctctg

SEQ ID NO: 4111723 - DNA, 17 bp, Homo sapiens
gagccccaggcctctgt

SEQ ID NO: 4111724 - DNA, 13 bp, Homo sapiens
gagccccagggtc

SEQ ID NO: 4111725 - DNA, 24 bp, Homo sapiens
gagccccagggtcttccctacctc

SEQ ID NO: 4111726 - DNA, 19 bp, Homo sapiens
gagccccagggtgcccaga

SEQ ID NO: 4111727 - DNA, 17 bp, Homo sapiens
gagcccccagcagaggc

SEQ ID NO: 4111728 - DNA, 23 bp, Homo sapiens
gagcccccagcagaggcaggctg

SEQ ID NO: 4111729 - DNA, 13 bp, Homo sapiens
gagcccctggtcc

SEQ ID NO: 4111730 - DNA, 17 bp, Homo sapiens
gagccccttctgctcag

SEQ ID NO: 4111731 - DNA, 22 bp, Homo sapiens
gagccccttctgctcagctctg

SEQ ID NO: 4111732 - DNA, 22 bp, Homo sapiens
gagccctgaccttggctgactg

SEQ ID NO: 4111733 - DNA, 12 bp, Homo sapiens
gagccctgccct

SEQ ID NO: 4111734 - DNA, 19 bp, Homo sapiens
gagccctggctgggttcag

SEQ ID NO: 4111735 - DNA, 22 bp, Homo sapiens
gagcccttgcctccccatttcc

SEQ ID NO: 4111736 - DNA, 19 bp, Homo sapiens
gagccgctgtgagcccctg

SEQ ID NO: 4111737 - DNA, 13 bp, Homo sapiens
gagccgggcctgg

SEQ ID NO: 4111738 - DNA, 17 bp, Homo sapiens
gagccggtaactgtcct

SEQ ID NO: 4111739 - DNA, 22 bp, Homo sapiens
gagccggtaactgtcctgtcct

SEQ ID NO: 4111740 - DNA, 18 bp, Homo sapiens
gagccgtgaactgtgcat

SEQ ID NO: 4111741 - DNA, 20 bp, Homo sapiens
gagccgtggtccctgaggat

SEQ ID NO: 4111742 - DNA, 20 bp, Homo sapiens
gagcctccccatctgtccag

SEQ ID NO: 4111743 - DNA, 13 bp, Homo sapiens
gagcctccccctc

SEQ ID NO: 4111744 - DNA, 17 bp, Homo sapiens
gagcctccccctcagat

SEQ ID NO: 4111745 - DNA, 19 bp, Homo sapiens
gagcctgacagccagaact

SEQ ID NO: 4111746 - DNA, 11 bp, Homo sapiens
gagcctgctgg

SEQ ID NO: 4111747 - DNA, 20 bp, Homo sapiens
gagcctgctggaagcccagc

SEQ ID NO: 4111748 - DNA, 12 bp, Homo sapiens
gagcctggagaa

SEQ ID NO: 4111749 - DNA, 15 bp, Homo sapiens
gagcctggccccagg

SEQ ID NO: 4111750 - DNA, 16 bp, Homo sapiens
gagcctggctgcccat

SEQ ID NO: 4111751 - DNA, 16 bp, Homo sapiens
gagcctggtgctgctg

SEQ ID NO: 4111752 - DNA, 14 bp, Homo sapiens
gagcctgtgcagcc

SEQ ID NO: 4111753 - DNA, 20 bp, Homo sapiens
gagccttttatctgcagaac

SEQ ID NO: 4111754 - DNA, 12 bp, Homo sapiens
gagccttttgct

SEQ ID NO: 4111755 - DNA, 21 bp, Homo sapiens
gagcgagacttggtttcaaaa

SEQ ID NO: 4111756 - DNA, 16 bp, Homo sapiens
gagcgagcgctaccca

SEQ ID NO: 4111757 - DNA, 16 bp, Homo sapiens
gagcgcatcaggcctg

SEQ ID NO: 4111758 - DNA, 15 bp, Homo sapiens
gagcgggaggcagag

SEQ ID NO: 4111759 - DNA, 20 bp, Homo sapiens
gagcgttagactgacttgtt

SEQ ID NO: 4111760 - DNA, 17 bp, Homo sapiens
gagcgttcaccagtgac

SEQ ID NO: 4111761 - DNA, 18 bp, Homo sapiens
gagctaagggtgggtgct

SEQ ID NO: 4111762 - DNA, 13 bp, Homo sapiens
gagctaggcaggg

SEQ ID NO: 4111763 - DNA, 13 bp, Homo sapiens
gagctattgctgt

SEQ ID NO: 4111764 - DNA, 18 bp, Homo sapiens
gagctatttccattccag

SEQ ID NO: 4111765 - DNA, 20 bp, Homo sapiens
gagctatttccattccagaa

SEQ ID NO: 4111766 - DNA, 17 bp, Homo sapiens
gagctattttcctctgg

SEQ ID NO: 4111767 - DNA, 19 bp, Homo sapiens
gagctcacatgggactggg

SEQ ID NO: 4111768 - DNA, 17 bp, Homo sapiens
gagctcaggtggggagt

SEQ ID NO: 4111769 - DNA, 19 bp, Homo sapiens
gagctccccagatctccca

SEQ ID NO: 4111770 - DNA, 11 bp, Homo sapiens
gagctcctgcg

SEQ ID NO: 4111771 - DNA, 13 bp, Homo sapiens
gagctctggggac

SEQ ID NO: 4111772 - DNA, 22 bp, Homo sapiens
gagctctggggacagcttcctc

SEQ ID NO: 4111773 - DNA, 13 bp, Homo sapiens
gagctcttggcct

SEQ ID NO: 4111774 - DNA, 18 bp, Homo sapiens
gagctcttggcctttgca

SEQ ID NO: 4111775 - DNA, 19 bp, Homo sapiens
gagctgaacccattttgag

SEQ ID NO: 4111776 - DNA, 21 bp, Homo sapiens
gagctgagatcgtgctactgc

SEQ ID NO: 4111777 - DNA, 18 bp, Homo sapiens
gagctgagcagcctctgg

SEQ ID NO: 4111778 - DNA, 15 bp, Homo sapiens
gagctgagtggccag

SEQ ID NO: 4111779 - DNA, 17 bp, Homo sapiens
gagctgagtggccagcc

SEQ ID NO: 4111780 - DNA, 21 bp, Homo sapiens
gagctgatgaaactcacaaat

SEQ ID NO: 4111781 - DNA, 18 bp, Homo sapiens
gagctgcagcctggctgg

SEQ ID NO: 4111782 - DNA, 20 bp, Homo sapiens
gagctgcctgcttggcccgg

SEQ ID NO: 4111783 - DNA, 22 bp, Homo sapiens
gagctgcctgcttggcccggcc

SEQ ID NO: 4111784 - DNA, 13 bp, Homo sapiens
gagctgccttccc

SEQ ID NO: 4111785 - DNA, 14 bp, Homo sapiens
gagctgccttccct

SEQ ID NO: 4111786 - DNA, 15 bp, Homo sapiens
gagctgccttggctc

SEQ ID NO: 4111787 - DNA, 22 bp, Homo sapiens
gagctgccttggctcagacatg

SEQ ID NO: 4111788 - DNA, 18 bp, Homo sapiens
gagctgctcaccggagtc

SEQ ID NO: 4111789 - DNA, 16 bp, Homo sapiens
gagctgctctggaaaa

SEQ ID NO: 4111790 - DNA, 12 bp, Homo sapiens
gagctgctggct

SEQ ID NO: 4111791 - DNA, 16 bp, Homo sapiens
gagctgctggcttgca

SEQ ID NO: 4111792 - DNA, 13 bp, Homo sapiens
gagctgcttcccc

SEQ ID NO: 4111793 - DNA, 22 bp, Homo sapiens
gagatgagaaatgatgaaaagg

SEQ ID NO: 4111794 - DNA, 22 bp, Homo sapiens
gagatgatacatccaaagcaga

SEQ ID NO: 4111795 - DNA, 17 bp, Homo sapiens
gagatgctgtaacttaa

SEQ ID NO: 4111796 - DNA, 15 bp, Homo sapiens
gagatgcttctctcc

SEQ ID NO: 4111797 - DNA, 20 bp, Homo sapiens
gagatgcttctctccttgcc

SEQ ID NO: 4111798 - DNA, 17 bp, Homo sapiens
gagatggaaacaatgtg

SEQ ID NO: 4111799 - DNA, 18 bp, Homo sapiens
gagatggaaacaatgtgg

SEQ ID NO: 4111800 - DNA, 20 bp, Homo sapiens
gagatggaagttgcagtgag

SEQ ID NO: 4111801 - DNA, 12 bp, Homo sapiens
gagatggccata

SEQ ID NO: 4111802 - DNA, 15 bp, Homo sapiens
gagatgggagctcct

SEQ ID NO: 4111803 - DNA, 22 bp, Homo sapiens
gagatgggagctcctctcctgg

SEQ ID NO: 4111804 - DNA, 16 bp, Homo sapiens
gagatgtcttggaaca

SEQ ID NO: 4111805 - DNA, 15 bp, Homo sapiens
gagatgtggagactg

SEQ ID NO: 4111806 - DNA, 16 bp, Homo sapiens
gagattagagggaggt

SEQ ID NO: 4111807 - DNA, 17 bp, Homo sapiens
gagattcagttttcatt

SEQ ID NO: 4111808 - DNA, 23 bp, Homo sapiens
gagattcccgcgggttccgcagg

SEQ ID NO: 4111809 - DNA, 16 bp, Homo sapiens
gagattgaactccaag

SEQ ID NO: 4111810 - DNA, 22 bp, Homo sapiens
gagattgaatttcactgtcttt

SEQ ID NO: 4111811 - DNA, 16 bp, Homo sapiens
gagatttcctcctggc

SEQ ID NO: 4111812 - DNA, 17 bp, Homo sapiens
gagatttttaagaactt

SEQ ID NO: 4111813 - DNA, 19 bp, Homo sapiens
gagatttttttgtgtatgt

SEQ ID NO: 4111814 - DNA, 14 bp, Homo sapiens
gagcaaaaggcagc

SEQ ID NO: 4111815 - DNA, 16 bp, Homo sapiens
gagcaaaaggcagctc

SEQ ID NO: 4111816 - DNA, 14 bp, Homo sapiens
gagcaaaataagga

SEQ ID NO: 4111817 - DNA, 13 bp, Homo sapiens
gagcaaagatcaa

SEQ ID NO: 4111818 - DNA, 13 bp, Homo sapiens
gagcaaagctgat

SEQ ID NO: 4111819 - DNA, 15 bp, Homo sapiens
gagcaacctctcact

SEQ ID NO: 4111820 - DNA, 16 bp, Homo sapiens
gagcaacctctcactc

SEQ ID NO: 4111821 - DNA, 20 bp, Homo sapiens
gagcaacctctcactcccca

SEQ ID NO: 4111822 - DNA, 21 bp, Homo sapiens
gagcaacctctcactccccat

SEQ ID NO: 4111823 - DNA, 15 bp, Homo sapiens
gagcaagacagagac

SEQ ID NO: 4111824 - DNA, 12 bp, Homo sapiens
gagcaagactct

SEQ ID NO: 4111825 - DNA, 14 bp, Homo sapiens
gagcaagactctgt

SEQ ID NO: 4111826 - DNA, 20 bp, Homo sapiens
gagcaaggacattgccccaa

SEQ ID NO: 4111827 - DNA, 23 bp, Homo sapiens
gagcaatatttatggatgcaaca

SEQ ID NO: 4111828 - DNA, 16 bp, Homo sapiens
gagcaatgggactgga

SEQ ID NO: 4111829 - DNA, 17 bp, Homo sapiens
gagcaatgggactggag

SEQ ID NO: 4111830 - DNA, 18 bp, Homo sapiens
gagcaatgggactggagt

SEQ ID NO: 4111831 - DNA, 22 bp, Homo sapiens
gagcacaagaggagatccaggg

SEQ ID NO: 4111832 - DNA, 21 bp, Homo sapiens
gagcacatgttactgcttcat

SEQ ID NO: 4111833 - DNA, 14 bp, Homo sapiens
gagcaccccctgct

SEQ ID NO: 4111834 - DNA, 16 bp, Homo sapiens
gagcaccccctgctcc

SEQ ID NO: 4111835 - DNA, 17 bp, Homo sapiens
gagcaccccctgctcca

SEQ ID NO: 4111836 - DNA, 18 bp, Homo sapiens
gagcaccgtgtcaagctg

SEQ ID NO: 4111837 - DNA, 12 bp, Homo sapiens
gagcacctgctt

SEQ ID NO: 4111838 - DNA, 17 bp, Homo sapiens
gagcaccttcctcactt

SEQ ID NO: 4111839 - DNA, 20 bp, Homo sapiens
gagcaccttcctcacttcca

SEQ ID NO: 4111840 - DNA, 21 bp, Homo sapiens
gagcactctgagtttaccatt

SEQ ID NO: 4111841 - DNA, 20 bp, Homo sapiens
gagcactggagtgcagggag

SEQ ID NO: 4111842 - DNA, 23 bp, Homo sapiens
gagcactggtgtgaactcaccct

SEQ ID NO: 4111843 - DNA, 17 bp, Homo sapiens
gagcagaagtggagctg

SEQ ID NO: 4111844 - DNA, 21 bp, Homo sapiens
gagcagagacactaacgactt

SEQ ID NO: 4111845 - DNA, 19 bp, Homo sapiens
gagcagaggaggggaaagt

SEQ ID NO: 4111846 - DNA, 20 bp, Homo sapiens
gagcagagtctgggcctctg

SEQ ID NO: 4111847 - DNA, 14 bp, Homo sapiens
gagcagatgcagag

SEQ ID NO: 4111848 - DNA, 18 bp, Homo sapiens
gagcagatgcagagagcc

SEQ ID NO: 4111849 - DNA, 15 bp, Homo sapiens
gagcagccgccagct

SEQ ID NO: 4111850 - DNA, 21 bp, Homo sapiens
gagcagccgccagctgggagc

SEQ ID NO: 4111851 - DNA, 13 bp, Homo sapiens
gagcagcctgtgg

SEQ ID NO: 4111852 - DNA, 16 bp, Homo sapiens
gagcagcctgtggcat

SEQ ID NO: 4111853 - DNA, 13 bp, Homo sapiens
gagcagctcccca

SEQ ID NO: 4111854 - DNA, 14 bp, Homo sapiens
gagcagctccccag

SEQ ID NO: 4111855 - DNA, 17 bp, Homo sapiens
gagcagctccccaggag

SEQ ID NO: 4111856 - DNA, 16 bp, Homo sapiens
gagcaggaagcattca

SEQ ID NO: 4111857 - DNA, 16 bp, Homo sapiens
gagcaggaaggacagg

SEQ ID NO: 4111858 - DNA, 19 bp, Homo sapiens
gagcaggaaggacaggaag

SEQ ID NO: 4111859 - DNA, 16 bp, Homo sapiens
gagcaggactccaggc

SEQ ID NO: 4111860 - DNA, 19 bp, Homo sapiens
gagcaggactccaggccca

SEQ ID NO: 4111861 - DNA, 15 bp, Homo sapiens
gagcaggaggccaat

SEQ ID NO: 4111862 - DNA, 23 bp, Homo sapiens
gagcaggaggccaataaaaagtt

SEQ ID NO: 4111863 - DNA, 22 bp, Homo sapiens
gagcaggcaaaaaagggacagc

SEQ ID NO: 4111864 - DNA, 15 bp, Homo sapiens
gagcaggccggaacc

SEQ ID NO: 4111865 - DNA, 13 bp, Homo sapiens
gagcagggaaggc

SEQ ID NO: 4111866 - DNA, 17 bp, Homo sapiens
gagcagggaaggcctga

SEQ ID NO: 4111867 - DNA, 18 bp, Homo sapiens
gagcagggaaggcctgac

SEQ ID NO: 4111868 - DNA, 20 bp, Homo sapiens
gagcagggattaacctctgc

SEQ ID NO: 4111869 - DNA, 22 bp, Homo sapiens
gagcagggattaacctctgcac

SEQ ID NO: 4111870 - DNA, 19 bp, Homo sapiens
gagcagtcacactgttact

SEQ ID NO: 4111871 - DNA, 21 bp, Homo sapiens
gagcagtcagagtccagtgct

SEQ ID NO: 4111872 - DNA, 15 bp, Homo sapiens
gagcagtcgcctgcc

SEQ ID NO: 4111873 - DNA, 16 bp, Homo sapiens
gagcagtcgcctgcct

SEQ ID NO: 4111874 - DNA, 21 bp, Homo sapiens
gagcagtcgcctgcctgcagc

SEQ ID NO: 4111875 - DNA, 23 bp, Homo sapiens
gagcagtggctggtccagggcta

SEQ ID NO: 4111876 - DNA, 19 bp, Homo sapiens
gagcagtgtcttccataat

SEQ ID NO: 4111877 - DNA, 22 bp, Homo sapiens
gagcagttcccctggagcccct

SEQ ID NO: 4111878 - DNA, 18 bp, Homo sapiens
gagcatctcttgaggcca

SEQ ID NO: 4111879 - DNA, 19 bp, Homo sapiens
gagcatctcttgaggccag

SEQ ID NO: 4111880 - DNA, 22 bp, Homo sapiens
gagcatctcttgaggccaggag

SEQ ID NO: 4111881 - DNA, 17 bp, Homo sapiens
gagcatgacagcctgca

SEQ ID NO: 4111882 - DNA, 23 bp, Homo sapiens
gagcatgatgggaatagggagac

SEQ ID NO: 4111883 - DNA, 19 bp, Homo sapiens
gagcatgtaaaagcggaaa

SEQ ID NO: 4111884 - DNA, 14 bp, Homo sapiens
gagcattacaggca

SEQ ID NO: 4111885 - DNA, 15 bp, Homo sapiens
gagcattacaggcaa

SEQ ID NO: 4111886 - DNA, 16 bp, Homo sapiens
gagcattacaggcaag

SEQ ID NO: 4111887 - DNA, 18 bp, Homo sapiens
gagcattacgtgagccag

SEQ ID NO: 4111888 - DNA, 23 bp, Homo sapiens
gagccaacctcggcttgtgggct

SEQ ID NO: 4111889 - DNA, 16 bp, Homo sapiens
gagccaagtcctccct

SEQ ID NO: 4111890 - DNA, 20 bp, Homo sapiens
gagccaatgttttccaccca

SEQ ID NO: 4111891 - DNA, 23 bp, Homo sapiens
gagccacagaccacctgcttctg

SEQ ID NO: 4111892 - DNA, 21 bp, Homo sapiens
gagccaccgtgcctggccaga

SEQ ID NO: 4111893 - DNA, 13 bp, Homo sapiens
gagccacctggat

SEQ ID NO: 4111894 - DNA, 14 bp, Homo sapiens
gagccacctggatc

SEQ ID NO: 4111895 - DNA, 22 bp, Homo sapiens
gagccagatgcaggacaggagg

SEQ ID NO: 4111896 - DNA, 19 bp, Homo sapiens
gagacagaggaaagggctg

SEQ ID NO: 4111897 - DNA, 13 bp, Homo sapiens
gagacaggcagcc

SEQ ID NO: 4111898 - DNA, 16 bp, Homo sapiens
gagacaggcagcccag

SEQ ID NO: 4111899 - DNA, 16 bp, Homo sapiens
gagacagggtaggaaa

SEQ ID NO: 4111900 - DNA, 15 bp, Homo sapiens
gagacagttgcccga

SEQ ID NO: 4111901 - DNA, 15 bp, Homo sapiens
gagacatacttgaag

SEQ ID NO: 4111902 - DNA, 20 bp, Homo sapiens
gagacatacttgaagggcca

SEQ ID NO: 4111903 - DNA, 18 bp, Homo sapiens
gagaccaaggcgggagca

SEQ ID NO: 4111904 - DNA, 17 bp, Homo sapiens
gagaccaggctgtgtcc

SEQ ID NO: 4111905 - DNA, 23 bp, Homo sapiens
gagaccagtgtatcaggtcaggg

SEQ ID NO: 4111906 - DNA, 14 bp, Homo sapiens
gagaccatcctggc

SEQ ID NO: 4111907 - DNA, 23 bp, Homo sapiens
gagacccccccccaactccagga

SEQ ID NO: 4111908 - DNA, 15 bp, Homo sapiens
gagaccctgccacag

SEQ ID NO: 4111909 - DNA, 23 bp, Homo sapiens
gagaccctgccacagccagagga

SEQ ID NO: 4111910 - DNA, 15 bp, Homo sapiens
gagaccgagtgaacc

SEQ ID NO: 4111911 - DNA, 18 bp, Homo sapiens
gagacctcatcaggatga

SEQ ID NO: 4111912 - DNA, 19 bp, Homo sapiens
gagacctcatcaggatgaa

SEQ ID NO: 4111913 - DNA, 21 bp, Homo sapiens
gagacctcatcaggatgaacc

SEQ ID NO: 4111914 - DNA, 18 bp, Homo sapiens
gagacctgacaagcactg

SEQ ID NO: 4111915 - DNA, 19 bp, Homo sapiens
gagacgcacacagctgagc

SEQ ID NO: 4111916 - DNA, 16 bp, Homo sapiens
gagacgccactccctg

SEQ ID NO: 4111917 - DNA, 15 bp, Homo sapiens
gagacgcccagcccc

SEQ ID NO: 4111918 - DNA, 21 bp, Homo sapiens
gagacgtggaacctctgtctc

SEQ ID NO: 4111919 - DNA, 22 bp, Homo sapiens
gagactaagccctgtcgagaca

SEQ ID NO: 4111920 - DNA, 18 bp, Homo sapiens
gagactcaaaaaaacaaa

SEQ ID NO: 4111921 - DNA, 15 bp, Homo sapiens
gagactgagcagccg

SEQ ID NO: 4111922 - DNA, 17 bp, Homo sapiens
gagactgagcagccgcc

SEQ ID NO: 4111923 - DNA, 22 bp, Homo sapiens
gagactgaggcttagagagagg

SEQ ID NO: 4111924 - DNA, 23 bp, Homo sapiens
gagactgcaagctgcttgcccaa

SEQ ID NO: 4111925 - DNA, 14 bp, Homo sapiens
gagactgggaaggc

SEQ ID NO: 4111926 - DNA, 15 bp, Homo sapiens
gagactgggatggga

SEQ ID NO: 4111927 - DNA, 13 bp, Homo sapiens
gagactgtagatt

SEQ ID NO: 4111928 - DNA, 22 bp, Homo sapiens
gagactgtccctgaaacctagt

SEQ ID NO: 4111929 - DNA, 16 bp, Homo sapiens
gagactgtcggagagg

SEQ ID NO: 4111930 - DNA, 17 bp, Homo sapiens
gagactgtcggagaggc

SEQ ID NO: 4111931 - DNA, 20 bp, Homo sapiens
gagactgtcggagaggctgt

SEQ ID NO: 4111932 - DNA, 23 bp, Homo sapiens
gagactgtcggagaggctgtctg

SEQ ID NO: 4111933 - DNA, 23 bp, Homo sapiens
gagagaaattctgttaaaatcta

SEQ ID NO: 4111934 - DNA, 16 bp, Homo sapiens
gagagaagccacgctg

SEQ ID NO: 4111935 - DNA, 17 bp, Homo sapiens
gagagaattggctcaat

SEQ ID NO: 4111936 - DNA, 14 bp, Homo sapiens
gagagacaggcagc

SEQ ID NO: 4111937 - DNA, 15 bp, Homo sapiens
gagagacctcatcag

SEQ ID NO: 4111938 - DNA, 17 bp, Homo sapiens
gagagacctcatcagga

SEQ ID NO: 4111939 - DNA, 18 bp, Homo sapiens
gagagacctcatcaggat

SEQ ID NO: 4111940 - DNA, 11 bp, Homo sapiens
gagagagaaaa

SEQ ID NO: 4111941 - DNA, 20 bp, Homo sapiens
gagagagaaattctgttaaa

SEQ ID NO: 4111942 - DNA, 12 bp, Homo sapiens
gagagagagaga

SEQ ID NO: 4111943 - DNA, 15 bp, Homo sapiens
gagagagagagagaa

SEQ ID NO: 4111944 - DNA, 13 bp, Homo sapiens
gagagagagagga

SEQ ID NO: 4111945 - DNA, 12 bp, Homo sapiens
gagagagaggac

SEQ ID NO: 4111946 - DNA, 13 bp, Homo sapiens
gagagaggacagc

SEQ ID NO: 4111947 - DNA, 17 bp, Homo sapiens
gagagaggttgaaaaac

SEQ ID NO: 4111948 - DNA, 23 bp, Homo sapiens
gagagatcttcccataataaagc

SEQ ID NO: 4111949 - DNA, 18 bp, Homo sapiens
gagagatgggagctcctc

SEQ ID NO: 4111950 - DNA, 14 bp, Homo sapiens
gagagattctccat

SEQ ID NO: 4111951 - DNA, 15 bp, Homo sapiens
gagagattctgtgat

SEQ ID NO: 4111952 - DNA, 14 bp, Homo sapiens
gagagcagcagcac

SEQ ID NO: 4111953 - DNA, 13 bp, Homo sapiens
gagagcagctccc

SEQ ID NO: 4111954 - DNA, 20 bp, Homo sapiens
gagagcagctccctttctca

SEQ ID NO: 4111955 - DNA, 23 bp, Homo sapiens
gagagcagctttaaactcaggga

SEQ ID NO: 4111956 - DNA, 14 bp, Homo sapiens
gagagccattttgt

SEQ ID NO: 4111957 - DNA, 21 bp, Homo sapiens
gagagcccagaggtaacagaa

SEQ ID NO: 4111958 - DNA, 17 bp, Homo sapiens
gagagccgtggtccctg

SEQ ID NO: 4111959 - DNA, 13 bp, Homo sapiens
gagagcctgctgg

SEQ ID NO: 4111960 - DNA, 17 bp, Homo sapiens
gagagcctggtgctgct

SEQ ID NO: 4111961 - DNA, 17 bp, Homo sapiens
gagagctggtgcccgga

SEQ ID NO: 4111962 - DNA, 20 bp, Homo sapiens
gagaggaaaagtaaggtgca

SEQ ID NO: 4111963 - DNA, 10 bp, Homo sapiens
gagaggacag

SEQ ID NO: 4111964 - DNA, 14 bp, Homo sapiens
gagaggagaaacac

SEQ ID NO: 4111965 - DNA, 17 bp, Homo sapiens
gagaggagacggagggg

SEQ ID NO: 4111966 - DNA, 18 bp, Homo sapiens
gagaggagacggagggga

SEQ ID NO: 4111967 - DNA, 18 bp, Homo sapiens
gagaggagggttcctctt

SEQ ID NO: 4111968 - DNA, 16 bp, Homo sapiens
gagaggatgagagccc

SEQ ID NO: 4111969 - DNA, 20 bp, Homo sapiens
gagaggatgagagcccagag

SEQ ID NO: 4111970 - DNA, 12 bp, Homo sapiens
gagaggcaggca

SEQ ID NO: 4111971 - DNA, 21 bp, Homo sapiens
gagaggcaggcatagaggctt

SEQ ID NO: 4111972 - DNA, 14 bp, Homo sapiens
gagaggcatggctg

SEQ ID NO: 4111973 - DNA, 13 bp, Homo sapiens
gagaggccgggac

SEQ ID NO: 4111974 - DNA, 12 bp, Homo sapiens
gagaggcggcct

SEQ ID NO: 4111975 - DNA, 16 bp, Homo sapiens
gagaggcggcctcgtg

SEQ ID NO: 4111976 - DNA, 14 bp, Homo sapiens
gagaggctctgggg

SEQ ID NO: 4111977 - DNA, 10 bp, Homo sapiens
gagagggaga

SEQ ID NO: 4111978 - DNA, 19 bp, Homo sapiens
gagagggagagcagagaaa

SEQ ID NO: 4111979 - DNA, 14 bp, Homo sapiens
gagagggcagaggg

SEQ ID NO: 4111980 - DNA, 19 bp, Homo sapiens
gagagggcccaggtcccaa

SEQ ID NO: 4111981 - DNA, 18 bp, Homo sapiens
gagaggggaagggccagt

SEQ ID NO: 4111982 - DNA, 17 bp, Homo sapiens
gagaggtggagaactgg

SEQ ID NO: 4111983 - DNA, 20 bp, Homo sapiens
gagagtcagctctctgccct

SEQ ID NO: 4111984 - DNA, 21 bp, Homo sapiens
gagagtcagctctctgccctg

SEQ ID NO: 4111985 - DNA, 13 bp, Homo sapiens
gagagtctggtct

SEQ ID NO: 4111986 - DNA, 21 bp, Homo sapiens
gagagtggctcctcccggtgc

SEQ ID NO: 4111987 - DNA, 14 bp, Homo sapiens
gagagtttagctgt

SEQ ID NO: 4111988 - DNA, 14 bp, Homo sapiens
gagagtttcctgaa

SEQ ID NO: 4111989 - DNA, 20 bp, Homo sapiens
gagataaaccaataaatcca

SEQ ID NO: 4111990 - DNA, 18 bp, Homo sapiens
gagataatatctgtgagg

SEQ ID NO: 4111991 - DNA, 23 bp, Homo sapiens
gagatacttggtcacagccaggc

SEQ ID NO: 4111992 - DNA, 17 bp, Homo sapiens
gagatattttaaaatga

SEQ ID NO: 4111993 - DNA, 17 bp, Homo sapiens
gagatccccagggcagc

SEQ ID NO: 4111994 - DNA, 17 bp, Homo sapiens
gagatcccgcctcttct

SEQ ID NO: 4111995 - DNA, 21 bp, Homo sapiens
gagatcgagaccatcctggct

SEQ ID NO: 4111996 - DNA, 22 bp, Homo sapiens
gagatcgagaccatcctggcta

SEQ ID NO: 4111997 - DNA, 23 bp, Homo sapiens
gagatcttcccataataaagcaa

SEQ ID NO: 4111998 - DNA, 17 bp, Homo sapiens
gagatgaccagggatgc

SEQ ID NO: 4111999 - DNA, 15 bp, Homo sapiens
gactggggtgggagg

SEQ ID NO: 4112000 - DNA, 17 bp, Homo sapiens
gactgggtaggaaagag

SEQ ID NO: 4112001 - DNA, 14 bp, Homo sapiens
gactggttttctgc

SEQ ID NO: 4112002 - DNA, 20 bp, Homo sapiens
gactgtaccacagacacaat

SEQ ID NO: 4112003 - DNA, 16 bp, Homo sapiens
gactgtactcctccca

SEQ ID NO: 4112004 - DNA, 20 bp, Homo sapiens
gactgtagattgcttctgta

SEQ ID NO: 4112005 - DNA, 14 bp, Homo sapiens
gactgtagccacag

SEQ ID NO: 4112006 - DNA, 15 bp, Homo sapiens
gactgtagccacagc

SEQ ID NO: 4112007 - DNA, 17 bp, Homo sapiens
gactgtagccacagctg

SEQ ID NO: 4112008 - DNA, 19 bp, Homo sapiens
gactgtagccacagctgct

SEQ ID NO: 4112009 - DNA, 20 bp, Homo sapiens
gactgtagccacagctgctg

SEQ ID NO: 4112010 - DNA, 20 bp, Homo sapiens
gactgtcctctcccctccag

SEQ ID NO: 4112011 - DNA, 23 bp, Homo sapiens
gactgtcctctcccctccagcct

SEQ ID NO: 4112012 - DNA, 21 bp, Homo sapiens
gactgtctcaagagggcactg

SEQ ID NO: 4112013 - DNA, 22 bp, Homo sapiens
gactgtctcaagagggcactgg

SEQ ID NO: 4112014 - DNA, 23 bp, Homo sapiens
gactgtctcaagagggcactggt

SEQ ID NO: 4112015 - DNA, 15 bp, Homo sapiens
gactgtgattcagaa

SEQ ID NO: 4112016 - DNA, 17 bp, Homo sapiens
gactgtgccagaggcca

SEQ ID NO: 4112017 - DNA, 20 bp, Homo sapiens
gactgttccaaagccagtga

SEQ ID NO: 4112018 - DNA, 13 bp, Homo sapiens
gactgttgagtta

SEQ ID NO: 4112019 - DNA, 14 bp, Homo sapiens
gactgtttggctta

SEQ ID NO: 4112020 - DNA, 19 bp, Homo sapiens
gactgttttctctcggctc

SEQ ID NO: 4112021 - DNA, 13 bp, Homo sapiens
gactgttttgaaa

SEQ ID NO: 4112022 - DNA, 22 bp, Homo sapiens
gactgtttttaagtaacttaag

SEQ ID NO: 4112023 - DNA, 16 bp, Homo sapiens
gacttaacggctccag

SEQ ID NO: 4112024 - DNA, 19 bp, Homo sapiens
gacttaacggctccaggat

SEQ ID NO: 4112025 - DNA, 20 bp, Homo sapiens
gacttaactgcatttttaga

SEQ ID NO: 4112026 - DNA, 23 bp, Homo sapiens
gacttaatgtgattactgctcta

SEQ ID NO: 4112027 - DNA, 14 bp, Homo sapiens
gacttaccaggaag

SEQ ID NO: 4112028 - DNA, 18 bp, Homo sapiens
gacttatagtacatgata

SEQ ID NO: 4112029 - DNA, 18 bp, Homo sapiens
gacttattgccaaaaaca

SEQ ID NO: 4112030 - DNA, 12 bp, Homo sapiens
gacttatttctg

SEQ ID NO: 4112031 - DNA, 21 bp, Homo sapiens
gacttcagctgcctgaaacag

SEQ ID NO: 4112032 - DNA, 19 bp, Homo sapiens
gacttcccaacagccttag

SEQ ID NO: 4112033 - DNA, 18 bp, Homo sapiens
gacttcccagctaggaag

SEQ ID NO: 4112034 - DNA, 21 bp, Homo sapiens
gacttcctgattggtttctct

SEQ ID NO: 4112035 - DNA, 20 bp, Homo sapiens
gacttccttgagacacggag

SEQ ID NO: 4112036 - DNA, 19 bp, Homo sapiens
gacttctaatatcattcac

SEQ ID NO: 4112037 - DNA, 14 bp, Homo sapiens
gacttctccaggtc

SEQ ID NO: 4112038 - DNA, 21 bp, Homo sapiens
gacttctcttccagtttctgt

SEQ ID NO: 4112039 - DNA, 13 bp, Homo sapiens
gacttctgcagct

SEQ ID NO: 4112040 - DNA, 19 bp, Homo sapiens
gacttgaaagcatccatgt

SEQ ID NO: 4112041 - DNA, 18 bp, Homo sapiens
gacttgagacaatgtttt

SEQ ID NO: 4112042 - DNA, 18 bp, Homo sapiens
gacttggcaggtgcctgt

SEQ ID NO: 4112043 - DNA, 16 bp, Homo sapiens
gacttggggtcaggaa

SEQ ID NO: 4112044 - DNA, 16 bp, Homo sapiens
gacttgtatatttgta

SEQ ID NO: 4112045 - DNA, 19 bp, Homo sapiens
gacttgtatattttaagaa

SEQ ID NO: 4112046 - DNA, 19 bp, Homo sapiens
gacttgtgcacaggcagag

SEQ ID NO: 4112047 - DNA, 16 bp, Homo sapiens
gactttatctcctgct

SEQ ID NO: 4112048 - DNA, 18 bp, Homo sapiens
gactttatctcctgctct

SEQ ID NO: 4112049 - DNA, 15 bp, Homo sapiens
gactttatttatttc

SEQ ID NO: 4112050 - DNA, 21 bp, Homo sapiens
gactttgcagccggcacaggg

SEQ ID NO: 4112051 - DNA, 21 bp, Homo sapiens
gactttgctgatttcccctct

SEQ ID NO: 4112052 - DNA, 21 bp, Homo sapiens
gactttgcttcccctccagga

SEQ ID NO: 4112053 - DNA, 12 bp, Homo sapiens
gactttgcttgc

SEQ ID NO: 4112054 - DNA, 17 bp, Homo sapiens
gactttgcttgctttga

SEQ ID NO: 4112055 - DNA, 16 bp, Homo sapiens
gactttggctgattta

SEQ ID NO: 4112056 - DNA, 13 bp, Homo sapiens
gactttttttgta

SEQ ID NO: 4112057 - DNA, 17 bp, Homo sapiens
gactttttttgtatgtg

SEQ ID NO: 4112058 - DNA, 13 bp, Homo sapiens
gagaaaaaaacaa

SEQ ID NO: 4112059 - DNA, 11 bp, Homo sapiens
gagaaaaacaa

SEQ ID NO: 4112060 - DNA, 18 bp, Homo sapiens
gagaaaagcacacttgta

SEQ ID NO: 4112061 - DNA, 18 bp, Homo sapiens
gagaaactgctgcagatt

SEQ ID NO: 4112062 - DNA, 18 bp, Homo sapiens
gagaaagaagagacagga

SEQ ID NO: 4112063 - DNA, 20 bp, Homo sapiens
gagaaattctgttaaaatct

SEQ ID NO: 4112064 - DNA, 22 bp, Homo sapiens
gagaacgccagtctcccaggcc

SEQ ID NO: 4112065 - DNA, 13 bp, Homo sapiens
gagaactcctgac

SEQ ID NO: 4112066 - DNA, 15 bp, Homo sapiens
gagaactcctgactg

SEQ ID NO: 4112067 - DNA, 17 bp, Homo sapiens
gagaactttccattttg

SEQ ID NO: 4112068 - DNA, 18 bp, Homo sapiens
gagaagaaaatgttcttc

SEQ ID NO: 4112069 - DNA, 20 bp, Homo sapiens
gagaagaaaggtgagtttga

SEQ ID NO: 4112070 - DNA, 13 bp, Homo sapiens
gagaagaggctgg

SEQ ID NO: 4112071 - DNA, 20 bp, Homo sapiens
gagaagagggcccagcccag

SEQ ID NO: 4112072 - DNA, 14 bp, Homo sapiens
gagaagagggcctg

SEQ ID NO: 4112073 - DNA, 13 bp, Homo sapiens
gagaagcatgaaa

SEQ ID NO: 4112074 - DNA, 14 bp, Homo sapiens
gagaagccacgctg

SEQ ID NO: 4112075 - DNA, 12 bp, Homo sapiens
gagaagccagga

SEQ ID NO: 4112076 - DNA, 23 bp, Homo sapiens
gagaagccaggaatttcccagga

SEQ ID NO: 4112077 - DNA, 16 bp, Homo sapiens
gagaagcggtcatgag

SEQ ID NO: 4112078 - DNA, 22 bp, Homo sapiens
gagaagctcctctccccagccc

SEQ ID NO: 4112079 - DNA, 12 bp, Homo sapiens
gagaagctgctc

SEQ ID NO: 4112080 - DNA, 20 bp, Homo sapiens
gagaagctgctccaggcctg

SEQ ID NO: 4112081 - DNA, 20 bp, Homo sapiens
gagaaggacccggaggggcc

SEQ ID NO: 4112082 - DNA, 22 bp, Homo sapiens
gagaaggacccggaggggcctg

SEQ ID NO: 4112083 - DNA, 16 bp, Homo sapiens
gagaaggcagccacca

SEQ ID NO: 4112084 - DNA, 20 bp, Homo sapiens
gagaagggataaccctacac

SEQ ID NO: 4112085 - DNA, 14 bp, Homo sapiens
gagaagtcaaacat

SEQ ID NO: 4112086 - DNA, 18 bp, Homo sapiens
gagaagtcaaacatttca

SEQ ID NO: 4112087 - DNA, 16 bp, Homo sapiens
gagaagtgccttctcc

SEQ ID NO: 4112088 - DNA, 17 bp, Homo sapiens
gagaagttctcaaagtt

SEQ ID NO: 4112089 - DNA, 16 bp, Homo sapiens
gagaagtttctggccc

SEQ ID NO: 4112090 - DNA, 17 bp, Homo sapiens
gagaagtttctggccct

SEQ ID NO: 4112091 - DNA, 18 bp, Homo sapiens
gagaataagagaaagaaa

SEQ ID NO: 4112092 - DNA, 13 bp, Homo sapiens
gagaatataaaca

SEQ ID NO: 4112093 - DNA, 14 bp, Homo sapiens
gagaatatatacat

SEQ ID NO: 4112094 - DNA, 22 bp, Homo sapiens
gagaatcccttaaaattaccag

SEQ ID NO: 4112095 - DNA, 22 bp, Homo sapiens
gagaatgtgtgtgtgtggcagg

SEQ ID NO: 4112096 - DNA, 14 bp, Homo sapiens
gagaattgggggct

SEQ ID NO: 4112097 - DNA, 23 bp, Homo sapiens
gagaatttctaaaaagattagca

SEQ ID NO: 4112098 - DNA, 20 bp, Homo sapiens
gagacactaacgacttcagg

SEQ ID NO: 4112099 - DNA, 15 bp, Homo sapiens
gagacactggcccct

SEQ ID NO: 4112100 - DNA, 15 bp, Homo sapiens
gagacagaagcctgg

SEQ ID NO: 4112101 - DNA, 15 bp, Homo sapiens
gagacagaggaaagg

SEQ ID NO: 4112102 - DNA, 18 bp, Homo sapiens
gacgggcatcgcaggagt

SEQ ID NO: 4112103 - DNA, 16 bp, Homo sapiens
gacggggactggggat

SEQ ID NO: 4112104 - DNA, 20 bp, Homo sapiens
gacgtactccaacagaagaa

SEQ ID NO: 4112105 - DNA, 20 bp, Homo sapiens
gacgtcactttttggccatg

SEQ ID NO: 4112106 - DNA, 21 bp, Homo sapiens
gacgtcatcggaggctgggcc

SEQ ID NO: 4112107 - DNA, 17 bp, Homo sapiens
gacgtctggggtgtggg

SEQ ID NO: 4112108 - DNA, 19 bp, Homo sapiens
gacgtctggggtgtgggga

SEQ ID NO: 4112109 - DNA, 20 bp, Homo sapiens
gacgtctggggtgtggggat

SEQ ID NO: 4112110 - DNA, 12 bp, Homo sapiens
gacgtggctcag

SEQ ID NO: 4112111 - DNA, 21 bp, Homo sapiens
gacgtttttgtgctgtgggca

SEQ ID NO: 4112112 - DNA, 11 bp, Homo sapiens
gactaaaatgt

SEQ ID NO: 4112113 - DNA, 18 bp, Homo sapiens
gactaaagagagaatgta

SEQ ID NO: 4112114 - DNA, 13 bp, Homo sapiens
gactacagggctt

SEQ ID NO: 4112115 - DNA, 23 bp, Homo sapiens
gactaccctctcactagtgccaa

SEQ ID NO: 4112116 - DNA, 14 bp, Homo sapiens
gactactattttct

SEQ ID NO: 4112117 - DNA, 13 bp, Homo sapiens
gactacttagcat

SEQ ID NO: 4112118 - DNA, 19 bp, Homo sapiens
gactacttggaactaggct

SEQ ID NO: 4112119 - DNA, 20 bp, Homo sapiens
gactacttgggagcaccgcc

SEQ ID NO: 4112120 - DNA, 19 bp, Homo sapiens
gactagaagattagaaact

SEQ ID NO: 4112121 - DNA, 16 bp, Homo sapiens
gactagaggcttgcat

SEQ ID NO: 4112122 - DNA, 17 bp, Homo sapiens
gactagcaatctcttca

SEQ ID NO: 4112123 - DNA, 18 bp, Homo sapiens
gactagggattcaggctg

SEQ ID NO: 4112124 - DNA, 20 bp, Homo sapiens
gactagggattcaggctgct

SEQ ID NO: 4112125 - DNA, 14 bp, Homo sapiens
gactagtacaaatt

SEQ ID NO: 4112126 - DNA, 16 bp, Homo sapiens
gactatataatttatt

SEQ ID NO: 4112127 - DNA, 19 bp, Homo sapiens
gactattccttttctgtat

SEQ ID NO: 4112128 - DNA, 17 bp, Homo sapiens
gactattgtgccaactg

SEQ ID NO: 4112129 - DNA, 20 bp, Homo sapiens
gactatttaaacttataaat

SEQ ID NO: 4112130 - DNA, 21 bp, Homo sapiens
gactatttaaacttataaatc

SEQ ID NO: 4112131 - DNA, 18 bp, Homo sapiens
gactcaaaaaaacaaaaa

SEQ ID NO: 4112132 - DNA, 19 bp, Homo sapiens
gactcaagaagtgaagaat

SEQ ID NO: 4112133 - DNA, 20 bp, Homo sapiens
gactcaagaagtgaagaatg

SEQ ID NO: 4112134 - DNA, 18 bp, Homo sapiens
gactcaagtacccattct

SEQ ID NO: 4112135 - DNA, 21 bp, Homo sapiens
gactcaagtacccattctgtt

SEQ ID NO: 4112136 - DNA, 19 bp, Homo sapiens
gactcacaggccctggaga

SEQ ID NO: 4112137 - DNA, 10 bp, Homo sapiens
gactcagcca

SEQ ID NO: 4112138 - DNA, 11 bp, Homo sapiens
gactcagccct

SEQ ID NO: 4112139 - DNA, 15 bp, Homo sapiens
gactcagccctgagg

SEQ ID NO: 4112140 - DNA, 17 bp, Homo sapiens
gactcaggatccagtcc

SEQ ID NO: 4112141 - DNA, 18 bp, Homo sapiens
gactcagggaccggtgct

SEQ ID NO: 4112142 - DNA, 23 bp, Homo sapiens
gactcagggcagcgccaggctga

SEQ ID NO: 4112143 - DNA, 20 bp, Homo sapiens
gactcagggccatgcctgcc

SEQ ID NO: 4112144 - DNA, 22 bp, Homo sapiens
gactcagggccatgcctgcccc

SEQ ID NO: 4112145 - DNA, 13 bp, Homo sapiens
gactcatccccac

SEQ ID NO: 4112146 - DNA, 19 bp, Homo sapiens
gactccaggcccaaggctc

SEQ ID NO: 4112147 - DNA, 14 bp, Homo sapiens
gactccatctcttc

SEQ ID NO: 4112148 - DNA, 13 bp, Homo sapiens
gactcccattcct

SEQ ID NO: 4112149 - DNA, 15 bp, Homo sapiens
gactccccaggccag

SEQ ID NO: 4112150 - DNA, 19 bp, Homo sapiens
gactcccggagcctgtgca

SEQ ID NO: 4112151 - DNA, 13 bp, Homo sapiens
gactccctcctca

SEQ ID NO: 4112152 - DNA, 23 bp, Homo sapiens
gactccctcctcacctctggact

SEQ ID NO: 4112153 - DNA, 12 bp, Homo sapiens
gactccctgtgg

SEQ ID NO: 4112154 - DNA, 24 bp, Homo sapiens
gactccctgtgggggtggccatcc

SEQ ID NO: 4112155 - DNA, 18 bp, Homo sapiens
gactcctacctgccctgg

SEQ ID NO: 4112156 - DNA, 13 bp, Homo sapiens
gactcctcctttt

SEQ ID NO: 4112157 - DNA, 13 bp, Homo sapiens
gactcctctggct

SEQ ID NO: 4112158 - DNA, 12 bp, Homo sapiens
gactctaaatgc

SEQ ID NO: 4112159 - DNA, 15 bp, Homo sapiens
gactctaaatgcagt

SEQ ID NO: 4112160 - DNA, 19 bp, Homo sapiens
gactctacctcatatcagt

SEQ ID NO: 4112161 - DNA, 15 bp, Homo sapiens
gactctgagatgtgg

SEQ ID NO: 4112162 - DNA, 20 bp, Homo sapiens
gactctgagcgggaggcaga

SEQ ID NO: 4112163 - DNA, 22 bp, Homo sapiens
gactctgagcgggaggcagagt

SEQ ID NO: 4112164 - DNA, 20 bp, Homo sapiens
gactctgcatcccagcacct

SEQ ID NO: 4112165 - DNA, 21 bp, Homo sapiens
gactctgcatcccagcacctg

SEQ ID NO: 4112166 - DNA, 11 bp, Homo sapiens
gactctgcccc

SEQ ID NO: 4112167 - DNA, 13 bp, Homo sapiens
gactctgccccct

SEQ ID NO: 4112168 - DNA, 16 bp, Homo sapiens
gactctgccccctgct

SEQ ID NO: 4112169 - DNA, 19 bp, Homo sapiens
gactctgccccctgctggc

SEQ ID NO: 4112170 - DNA, 21 bp, Homo sapiens
gactctgccccctgctggctc

SEQ ID NO: 4112171 - DNA, 14 bp, Homo sapiens
gactctggccctgg

SEQ ID NO: 4112172 - DNA, 16 bp, Homo sapiens
gactctggccctggcc

SEQ ID NO: 4112173 - DNA, 18 bp, Homo sapiens
gactctggccctggccct

SEQ ID NO: 4112174 - DNA, 17 bp, Homo sapiens
gactcttctcggctcag

SEQ ID NO: 4112175 - DNA, 20 bp, Homo sapiens
gactctttttagggccaggc

SEQ ID NO: 4112176 - DNA, 15 bp, Homo sapiens
gactgaaagtagggg

SEQ ID NO: 4112177 - DNA, 16 bp, Homo sapiens
gactgaatgttttatt

SEQ ID NO: 4112178 - DNA, 14 bp, Homo sapiens
gactgagcacctgc

SEQ ID NO: 4112179 - DNA, 16 bp, Homo sapiens
gactgagcacctgctt

SEQ ID NO: 4112180 - DNA, 12 bp, Homo sapiens
gactgagcagcc

SEQ ID NO: 4112181 - DNA, 15 bp, Homo sapiens
gactgaggacaaagt

SEQ ID NO: 4112182 - DNA, 15 bp, Homo sapiens
gactgagggactctg

SEQ ID NO: 4112183 - DNA, 15 bp, Homo sapiens
gactgagtcagatgg

SEQ ID NO: 4112184 - DNA, 15 bp, Homo sapiens
gactgcaaacttttt

SEQ ID NO: 4112185 - DNA, 21 bp, Homo sapiens
gactgcaaacttttttatatc

SEQ ID NO: 4112186 - DNA, 17 bp, Homo sapiens
gactgcacccagctcca

SEQ ID NO: 4112187 - DNA, 20 bp, Homo sapiens
gactgcacccagctccaggg

SEQ ID NO: 4112188 - DNA, 23 bp, Homo sapiens
gactgcatgtaccatttgcatgg

SEQ ID NO: 4112189 - DNA, 19 bp, Homo sapiens
gactgctcagaacttgctg

SEQ ID NO: 4112190 - DNA, 15 bp, Homo sapiens
gactgctccccagcc

SEQ ID NO: 4112191 - DNA, 15 bp, Homo sapiens
gactggaaccaggga

SEQ ID NO: 4112192 - DNA, 21 bp, Homo sapiens
gactggaagctaatttgcatt

SEQ ID NO: 4112193 - DNA, 17 bp, Homo sapiens
gactggagtcagatgag

SEQ ID NO: 4112194 - DNA, 22 bp, Homo sapiens
gactggagtcagatgagcaagg

SEQ ID NO: 4112195 - DNA, 14 bp, Homo sapiens
gactggcccctggg

SEQ ID NO: 4112196 - DNA, 16 bp, Homo sapiens
gactggcccctgggtc

SEQ ID NO: 4112197 - DNA, 20 bp, Homo sapiens
gactgggaagataggctctg

SEQ ID NO: 4112198 - DNA, 22 bp, Homo sapiens
gactgggaagataggctctgca

SEQ ID NO: 4112199 - DNA, 23 bp, Homo sapiens
gactgggaagataggctctgcac

SEQ ID NO: 4112200 - DNA, 16 bp, Homo sapiens
gactgggaggaggggg

SEQ ID NO: 4112201 - DNA, 18 bp, Homo sapiens
gactgggagtcagagccc

SEQ ID NO: 4112202 - DNA, 13 bp, Homo sapiens
gactgggctgggt

SEQ ID NO: 4112203 - DNA, 20 bp, Homo sapiens
gactggggatgtgggaggga

SEQ ID NO: 4112204 - DNA, 17 bp, Homo sapiens
gactgggggactgggag

SEQ ID NO: 4112205 - DNA, 18 bp, Homo sapiens
gacccccatttgtcccag

SEQ ID NO: 4112206 - DNA, 18 bp, Homo sapiens
gaccccgagaagtgctct

SEQ ID NO: 4112207 - DNA, 20 bp, Homo sapiens
gaccccgtccacgtcctcca

SEQ ID NO: 4112208 - DNA, 18 bp, Homo sapiens
gacccctcgtccaccccc

SEQ ID NO: 4112209 - DNA, 22 bp, Homo sapiens
gacccctcgtccaccccccaca

SEQ ID NO: 4112210 - DNA, 22 bp, Homo sapiens
gacccctgctcccagcctgctg

SEQ ID NO: 4112211 - DNA, 12 bp, Homo sapiens
gacccggcctct

SEQ ID NO: 4112212 - DNA, 22 bp, Homo sapiens
gacccggctgggtcggccctgc

SEQ ID NO: 4112213 - DNA, 14 bp, Homo sapiens
gaccctacaggaga

SEQ ID NO: 4112214 - DNA, 22 bp, Homo sapiens
gaccctcatggcccccaggggc

SEQ ID NO: 4112215 - DNA, 23 bp, Homo sapiens
gaccctcatggcccccaggggca

SEQ ID NO: 4112216 - DNA, 16 bp, Homo sapiens
gaccctcgggccccat

SEQ ID NO: 4112217 - DNA, 20 bp, Homo sapiens
gaccctctgaatggtccagg

SEQ ID NO: 4112218 - DNA, 23 bp, Homo sapiens
gaccctctgaatggtccagggtt

SEQ ID NO: 4112219 - DNA, 18 bp, Homo sapiens
gaccctctggaaatatgt

SEQ ID NO: 4112220 - DNA, 13 bp, Homo sapiens
gaccctcttgccc

SEQ ID NO: 4112221 - DNA, 14 bp, Homo sapiens
gaccctcttgccca

SEQ ID NO: 4112222 - DNA, 17 bp, Homo sapiens
gaccctcttgcccatcc

SEQ ID NO: 4112223 - DNA, 20 bp, Homo sapiens
gaccctcttgcccatcctga

SEQ ID NO: 4112224 - DNA, 22 bp, Homo sapiens
gaccctcttgcccatcctgact

SEQ ID NO: 4112225 - DNA, 16 bp, Homo sapiens
gaccctgacctccgcc

SEQ ID NO: 4112226 - DNA, 17 bp, Homo sapiens
gaccctgacctccgccc

SEQ ID NO: 4112227 - DNA, 20 bp, Homo sapiens
gaccctgacctccgcccctg

SEQ ID NO: 4112228 - DNA, 22 bp, Homo sapiens
gaccctgacctccgcccctgcc

SEQ ID NO: 4112229 - DNA, 21 bp, Homo sapiens
gaccctgaggccctgggctgg

SEQ ID NO: 4112230 - DNA, 15 bp, Homo sapiens
gaccctgccacagcc

SEQ ID NO: 4112231 - DNA, 20 bp, Homo sapiens
gaccctgtcttctgggcaca

SEQ ID NO: 4112232 - DNA, 15 bp, Homo sapiens
gacccttgggcctgg

SEQ ID NO: 4112233 - DNA, 12 bp, Homo sapiens
gaccgccccctc

SEQ ID NO: 4112234 - DNA, 14 bp, Homo sapiens
gaccgccccctcct

SEQ ID NO: 4112235 - DNA, 13 bp, Homo sapiens
gaccgtccagggg

SEQ ID NO: 4112236 - DNA, 22 bp, Homo sapiens
gaccgtccaggggagatgggga

SEQ ID NO: 4112237 - DNA, 22 bp, Homo sapiens
gaccgttcagtgtcccaggcag

SEQ ID NO: 4112238 - DNA, 15 bp, Homo sapiens
gacctaaccagggcc

SEQ ID NO: 4112239 - DNA, 18 bp, Homo sapiens
gacctaaccagggccaga

SEQ ID NO: 4112240 - DNA, 19 bp, Homo sapiens
gacctaaccagggccagaa

SEQ ID NO: 4112241 - DNA, 14 bp, Homo sapiens
gacctacattccct

SEQ ID NO: 4112242 - DNA, 19 bp, Homo sapiens
gacctacattccctctcct

SEQ ID NO: 4112243 - DNA, 16 bp, Homo sapiens
gacctagcaggctgtt

SEQ ID NO: 4112244 - DNA, 21 bp, Homo sapiens
gacctatgtcctaaggacaca

SEQ ID NO: 4112245 - DNA, 13 bp, Homo sapiens
gacctcatcagga

SEQ ID NO: 4112246 - DNA, 19 bp, Homo sapiens
gacctcatcaggatgaacc

SEQ ID NO: 4112247 - DNA, 16 bp, Homo sapiens
gacctccgcccctgcc

SEQ ID NO: 4112248 - DNA, 18 bp, Homo sapiens
gacctccgcccctgcccc

SEQ ID NO: 4112249 - DNA, 17 bp, Homo sapiens
gacctcctaacaagtag

SEQ ID NO: 4112250 - DNA, 18 bp, Homo sapiens
gacctctagccctgcccg

SEQ ID NO: 4112251 - DNA, 13 bp, Homo sapiens
gacctctcagggc

SEQ ID NO: 4112252 - DNA, 15 bp, Homo sapiens
gacctctcagggcct

SEQ ID NO: 4112253 - DNA, 17 bp, Homo sapiens
gacctctcagggcctgg

SEQ ID NO: 4112254 - DNA, 14 bp, Homo sapiens
gacctcttgctgtc

SEQ ID NO: 4112255 - DNA, 20 bp, Homo sapiens
gacctgaccccattcctgat

SEQ ID NO: 4112256 - DNA, 21 bp, Homo sapiens
gacctgagctggccaggccct

SEQ ID NO: 4112257 - DNA, 16 bp, Homo sapiens
gacctgcactggggag

SEQ ID NO: 4112258 - DNA, 15 bp, Homo sapiens
gacctgccaggcagg

SEQ ID NO: 4112259 - DNA, 18 bp, Homo sapiens
gacctgccaggcaggggt

SEQ ID NO: 4112260 - DNA, 21 bp, Homo sapiens
gacctgctccgctgctccttg

SEQ ID NO: 4112261 - DNA, 20 bp, Homo sapiens
gacctgctgaagtccggaac

SEQ ID NO: 4112262 - DNA, 22 bp, Homo sapiens
gacctggcactggatgcagaaa

SEQ ID NO: 4112263 - DNA, 16 bp, Homo sapiens
gacctggcctgtctgt

SEQ ID NO: 4112264 - DNA, 21 bp, Homo sapiens
gacctggctgcccctcacctt

SEQ ID NO: 4112265 - DNA, 17 bp, Homo sapiens
gacctggtaccctcctg

SEQ ID NO: 4112266 - DNA, 19 bp, Homo sapiens
gacctggtaccctcctggc

SEQ ID NO: 4112267 - DNA, 21 bp, Homo sapiens
gacctggtaccctcctggctc

SEQ ID NO: 4112268 - DNA, 23 bp, Homo sapiens
gacctggtaccctcctggctctt

SEQ ID NO: 4112269 - DNA, 20 bp, Homo sapiens
gacctggttggccgtggtcc

SEQ ID NO: 4112270 - DNA, 17 bp, Homo sapiens
gacctgtaacttttgta

SEQ ID NO: 4112271 - DNA, 12 bp, Homo sapiens
gacctgtaatca

SEQ ID NO: 4112272 - DNA, 17 bp, Homo sapiens
gacctgtcttccaagga

SEQ ID NO: 4112273 - DNA, 12 bp, Homo sapiens
gacctgtgacca

SEQ ID NO: 4112274 - DNA, 15 bp, Homo sapiens
gacctgtgaccagca

SEQ ID NO: 4112275 - DNA, 15 bp, Homo sapiens
gacctgtgagcccag

SEQ ID NO: 4112276 - DNA, 17 bp, Homo sapiens
gacctgttagcagacag

SEQ ID NO: 4112277 - DNA, 19 bp, Homo sapiens
gacctgttagcagacaggc

SEQ ID NO: 4112278 - DNA, 22 bp, Homo sapiens
gaccttaataaaggcccccact

SEQ ID NO: 4112279 - DNA, 23 bp, Homo sapiens
gaccttaataaaggcccccactt

SEQ ID NO: 4112280 - DNA, 15 bp, Homo sapiens
gaccttaggccttcc

SEQ ID NO: 4112281 - DNA, 21 bp, Homo sapiens
gaccttatctgtgcgtgaaac

SEQ ID NO: 4112282 - DNA, 23 bp, Homo sapiens
gaccttccctccgccttctccca

SEQ ID NO: 4112283 - DNA, 14 bp, Homo sapiens
gaccttcctcatcc

SEQ ID NO: 4112284 - DNA, 19 bp, Homo sapiens
gaccttctagaattataag

SEQ ID NO: 4112285 - DNA, 18 bp, Homo sapiens
gacctttgggtctacaag

SEQ ID NO: 4112286 - DNA, 18 bp, Homo sapiens
gaccttttcttcattttg

SEQ ID NO: 4112287 - DNA, 15 bp, Homo sapiens
gacgacaggcgagag

SEQ ID NO: 4112288 - DNA, 18 bp, Homo sapiens
gacgattccttctctgaa

SEQ ID NO: 4112289 - DNA, 13 bp, Homo sapiens
gacgcaggaatgg

SEQ ID NO: 4112290 - DNA, 16 bp, Homo sapiens
gacgcaggaatggaaa

SEQ ID NO: 4112291 - DNA, 16 bp, Homo sapiens
gacgcagtccgcccag

SEQ ID NO: 4112292 - DNA, 18 bp, Homo sapiens
gacgccactccctgggac

SEQ ID NO: 4112293 - DNA, 14 bp, Homo sapiens
gacgcccagcccca

SEQ ID NO: 4112294 - DNA, 15 bp, Homo sapiens
gacgcccagccccat

SEQ ID NO: 4112295 - DNA, 21 bp, Homo sapiens
gacgcccagccccatccctgt

SEQ ID NO: 4112296 - DNA, 13 bp, Homo sapiens
gacgcctgagctc

SEQ ID NO: 4112297 - DNA, 17 bp, Homo sapiens
gacgcctgcaggagaga

SEQ ID NO: 4112298 - DNA, 15 bp, Homo sapiens
gacgcgtctcctgtt

SEQ ID NO: 4112299 - DNA, 11 bp, Homo sapiens
gacggcaggct

SEQ ID NO: 4112300 - DNA, 19 bp, Homo sapiens
gacggcaggctcactgcca

SEQ ID NO: 4112301 - DNA, 12 bp, Homo sapiens
gacggcggccag

SEQ ID NO: 4112302 - DNA, 13 bp, Homo sapiens
gacggcggccagg

SEQ ID NO: 4112303 - DNA, 14 bp, Homo sapiens
gacggcggccaggc

SEQ ID NO: 4112304 - DNA, 13 bp, Homo sapiens
gacggctcctcag

SEQ ID NO: 4112305 - DNA, 20 bp, Homo sapiens
gacgggaggggaaaggctgc

SEQ ID NO: 4112306 - DNA, 12 bp, Homo sapiens
gacgggcacaga

SEQ ID NO: 4112307 - DNA, 13 bp, Homo sapiens
gacgggcacagac

SEQ ID NO: 4112308 - DNA, 14 bp, Homo sapiens
gacatcctgtataa

SEQ ID NO: 4112309 - DNA, 15 bp, Homo sapiens
gacatctcaggggcc

SEQ ID NO: 4112310 - DNA, 16 bp, Homo sapiens
gacatctcaggggcca

SEQ ID NO: 4112311 - DNA, 13 bp, Homo sapiens
gacatctctgcac

SEQ ID NO: 4112312 - DNA, 15 bp, Homo sapiens
gacatctctgcaccc

SEQ ID NO: 4112313 - DNA, 17 bp, Homo sapiens
gacatctctgcaccctg

SEQ ID NO: 4112314 - DNA, 20 bp, Homo sapiens
gacatctggaatctggagac

SEQ ID NO: 4112315 - DNA, 22 bp, Homo sapiens
gacatctggaatctggagacca

SEQ ID NO: 4112316 - DNA, 21 bp, Homo sapiens
gacatctgtttctaaatgttt

SEQ ID NO: 4112317 - DNA, 20 bp, Homo sapiens
gacatcttcaaagcttgaag

SEQ ID NO: 4112318 - DNA, 16 bp, Homo sapiens
gacatgatttccttga

SEQ ID NO: 4112319 - DNA, 20 bp, Homo sapiens
gacatgatttccttgaatgt

SEQ ID NO: 4112320 - DNA, 24 bp, Homo sapiens
gacatgatttccttgaatgtggct

SEQ ID NO: 4112321 - DNA, 16 bp, Homo sapiens
gacatgcattgttggc

SEQ ID NO: 4112322 - DNA, 22 bp, Homo sapiens
gacatgcggtagccagcacaca

SEQ ID NO: 4112323 - DNA, 21 bp, Homo sapiens
gacatgctgactgtcctctcc

SEQ ID NO: 4112324 - DNA, 18 bp, Homo sapiens
gacatggcttctgaacct

SEQ ID NO: 4112325 - DNA, 14 bp, Homo sapiens
gacatggtgcctga

SEQ ID NO: 4112326 - DNA, 14 bp, Homo sapiens
gacatgtgaaacct

SEQ ID NO: 4112327 - DNA, 12 bp, Homo sapiens
gacatgtgacat

SEQ ID NO: 4112328 - DNA, 16 bp, Homo sapiens
gacatgtgaggaggaa

SEQ ID NO: 4112329 - DNA, 18 bp, Homo sapiens
gacatgtgaggaggaaaa

SEQ ID NO: 4112330 - DNA, 14 bp, Homo sapiens
gacattaacagttt

SEQ ID NO: 4112331 - DNA, 19 bp, Homo sapiens
gacattaacagttttccat

SEQ ID NO: 4112332 - DNA, 23 bp, Homo sapiens
gacattaacagttttccatgaaa

SEQ ID NO: 4112333 - DNA, 15 bp, Homo sapiens
gacattcacctgccc

SEQ ID NO: 4112334 - DNA, 21 bp, Homo sapiens
gacattcacctgccccaactc

SEQ ID NO: 4112335 - DNA, 12 bp, Homo sapiens
gacattccctgc

SEQ ID NO: 4112336 - DNA, 23 bp, Homo sapiens
gacattgacctatttccagaaat

SEQ ID NO: 4112337 - DNA, 12 bp, Homo sapiens
gacattgtcaat

SEQ ID NO: 4112338 - DNA, 13 bp, Homo sapiens
gacattgtcaata

SEQ ID NO: 4112339 - DNA, 14 bp, Homo sapiens
gacattgtcaataa

SEQ ID NO: 4112340 - DNA, 15 bp, Homo sapiens
gacattgtcaataaa

SEQ ID NO: 4112341 - DNA, 15 bp, Homo sapiens
gacatttaaatgtaa

SEQ ID NO: 4112342 - DNA, 15 bp, Homo sapiens
gacatttctgctctc

SEQ ID NO: 4112343 - DNA, 17 bp, Homo sapiens
gacatttcttttctttt

SEQ ID NO: 4112344 - DNA, 22 bp, Homo sapiens
gacatttcttttctttttacat

SEQ ID NO: 4112345 - DNA, 23 bp, Homo sapiens
gacatttgggagacatgtgacat

SEQ ID NO: 4112346 - DNA, 12 bp, Homo sapiens
gacattttctgg

SEQ ID NO: 4112347 - DNA, 20 bp, Homo sapiens
gacattttctttcatgggca

SEQ ID NO: 4112348 - DNA, 13 bp, Homo sapiens
gaccaacctgctc

SEQ ID NO: 4112349 - DNA, 14 bp, Homo sapiens
gaccaactgggccc

SEQ ID NO: 4112350 - DNA, 18 bp, Homo sapiens
gaccaaggggtgggccac

SEQ ID NO: 4112351 - DNA, 20 bp, Homo sapiens
gaccaataaaatttctaaga

SEQ ID NO: 4112352 - DNA, 13 bp, Homo sapiens
gaccaattgtgct

SEQ ID NO: 4112353 - DNA, 18 bp, Homo sapiens
gaccaattgtgctgccat

SEQ ID NO: 4112354 - DNA, 16 bp, Homo sapiens
gaccacaccctgtact

SEQ ID NO: 4112355 - DNA, 14 bp, Homo sapiens
gaccacagcacagc

SEQ ID NO: 4112356 - DNA, 23 bp, Homo sapiens
gaccacagcatcattttgcattc

SEQ ID NO: 4112357 - DNA, 17 bp, Homo sapiens
gaccacatgccactgcc

SEQ ID NO: 4112358 - DNA, 21 bp, Homo sapiens
gaccaccagccgccccagccc

SEQ ID NO: 4112359 - DNA, 20 bp, Homo sapiens
gaccaccccgcctgccctca

SEQ ID NO: 4112360 - DNA, 11 bp, Homo sapiens
gaccaccctcc

SEQ ID NO: 4112361 - DNA, 23 bp, Homo sapiens
gaccaccctccctgactggcctg

SEQ ID NO: 4112362 - DNA, 22 bp, Homo sapiens
gaccaccttctgtccccagccc

SEQ ID NO: 4112363 - DNA, 24 bp, Homo sapiens
gaccaccttctgtccccagccctg

SEQ ID NO: 4112364 - DNA, 21 bp, Homo sapiens
gaccactcttctttaagccat

SEQ ID NO: 4112365 - DNA, 22 bp, Homo sapiens
gaccactgagtaccaggggctg

SEQ ID NO: 4112366 - DNA, 22 bp, Homo sapiens
gaccacttccaggggaacctgc

SEQ ID NO: 4112367 - DNA, 15 bp, Homo sapiens
gaccagaagccttgg

SEQ ID NO: 4112368 - DNA, 15 bp, Homo sapiens
gaccagagcagtttc

SEQ ID NO: 4112369 - DNA, 22 bp, Homo sapiens
gaccagagccagatgcaggaca

SEQ ID NO: 4112370 - DNA, 14 bp, Homo sapiens
gaccagagctgtct

SEQ ID NO: 4112371 - DNA, 16 bp, Homo sapiens
gaccagataaatagaa

SEQ ID NO: 4112372 - DNA, 12 bp, Homo sapiens
gaccagccagca

SEQ ID NO: 4112373 - DNA, 16 bp, Homo sapiens
gaccagccagcagcag

SEQ ID NO: 4112374 - DNA, 18 bp, Homo sapiens
gaccagccagcagcagcc

SEQ ID NO: 4112375 - DNA, 17 bp, Homo sapiens
gaccagctcagaggccc

SEQ ID NO: 4112376 - DNA, 19 bp, Homo sapiens
gaccaggactccctcctca

SEQ ID NO: 4112377 - DNA, 21 bp, Homo sapiens
gaccaggactccctcctcacc

SEQ ID NO: 4112378 - DNA, 13 bp, Homo sapiens
gaccaggctgtgg

SEQ ID NO: 4112379 - DNA, 16 bp, Homo sapiens
gaccaggcttcttcct

SEQ ID NO: 4112380 - DNA, 14 bp, Homo sapiens
gaccagggagcctt

SEQ ID NO: 4112381 - DNA, 15 bp, Homo sapiens
gaccagggagccttt

SEQ ID NO: 4112382 - DNA, 18 bp, Homo sapiens
gaccagggatgctgggct

SEQ ID NO: 4112383 - DNA, 21 bp, Homo sapiens
gaccagggatgctgggctggg

SEQ ID NO: 4112384 - DNA, 15 bp, Homo sapiens
gaccagggccgagga

SEQ ID NO: 4112385 - DNA, 23 bp, Homo sapiens
gaccaggggtgatttcagagagg

SEQ ID NO: 4112386 - DNA, 21 bp, Homo sapiens
gaccagtgtatcaggtcaggg

SEQ ID NO: 4112387 - DNA, 20 bp, Homo sapiens
gaccagttgggagcactgga

SEQ ID NO: 4112388 - DNA, 18 bp, Homo sapiens
gaccatcaagaacctaca

SEQ ID NO: 4112389 - DNA, 19 bp, Homo sapiens
gaccatccactctaccctc

SEQ ID NO: 4112390 - DNA, 12 bp, Homo sapiens
gaccatcctggc

SEQ ID NO: 4112391 - DNA, 13 bp, Homo sapiens
gaccatcctggct

SEQ ID NO: 4112392 - DNA, 17 bp, Homo sapiens
gaccatctgcttttatt

SEQ ID NO: 4112393 - DNA, 15 bp, Homo sapiens
gaccatgtgtcactt

SEQ ID NO: 4112394 - DNA, 16 bp, Homo sapiens
gaccattaataaagac

SEQ ID NO: 4112395 - DNA, 13 bp, Homo sapiens
gaccatttataat

SEQ ID NO: 4112396 - DNA, 18 bp, Homo sapiens
gacccaatgtaggagctg

SEQ ID NO: 4112397 - DNA, 19 bp, Homo sapiens
gacccaatgtaggagctgc

SEQ ID NO: 4112398 - DNA, 17 bp, Homo sapiens
gacccagaatggagcct

SEQ ID NO: 4112399 - DNA, 16 bp, Homo sapiens
gacccagcaggaagcc

SEQ ID NO: 4112400 - DNA, 21 bp, Homo sapiens
gacccagcaggaagccaggct

SEQ ID NO: 4112401 - DNA, 22 bp, Homo sapiens
gacccagcaggaagccaggctg

SEQ ID NO: 4112402 - DNA, 21 bp, Homo sapiens
gacccaggtggagggcacagc

SEQ ID NO: 4112403 - DNA, 16 bp, Homo sapiens
gacccagtgcccccac

SEQ ID NO: 4112404 - DNA, 23 bp, Homo sapiens
gacccatgagttggggtctggca

SEQ ID NO: 4112405 - DNA, 23 bp, Homo sapiens
gaccccaaacaccttccagctcc

SEQ ID NO: 4112406 - DNA, 19 bp, Homo sapiens
gaccccaaagagcctggag

SEQ ID NO: 4112407 - DNA, 14 bp, Homo sapiens
gaccccaacctcag

SEQ ID NO: 4112408 - DNA, 22 bp, Homo sapiens
gaccccaacctcagaggcagct

SEQ ID NO: 4112409 - DNA, 20 bp, Homo sapiens
gaccccactgccaagtgggg

SEQ ID NO: 4112410 - DNA, 14 bp, Homo sapiens
gacccccaactcct

SEQ ID NO: 4112411 - DNA, 14 bp, Homo sapiens
gacactccagtgcc

SEQ ID NO: 4112412 - DNA, 19 bp, Homo sapiens
gacactccagtgccagcaa

SEQ ID NO: 4112413 - DNA, 15 bp, Homo sapiens
gacactcctagactt

SEQ ID NO: 4112414 - DNA, 22 bp, Homo sapiens
gacactcctagagaacgcagcc

SEQ ID NO: 4112415 - DNA, 15 bp, Homo sapiens
gacactctctggaag

SEQ ID NO: 4112416 - DNA, 17 bp, Homo sapiens
gacactctctggaagcc

SEQ ID NO: 4112417 - DNA, 17 bp, Homo sapiens
gacactgccactctccc

SEQ ID NO: 4112418 - DNA, 17 bp, Homo sapiens
gacactgtccctctttg

SEQ ID NO: 4112419 - DNA, 23 bp, Homo sapiens
gacacttatccacgagagcgcag

SEQ ID NO: 4112420 - DNA, 20 bp, Homo sapiens
gacacttcagagagctggta

SEQ ID NO: 4112421 - DNA, 20 bp, Homo sapiens
gacacttccgtcacatccca

SEQ ID NO: 4112422 - DNA, 15 bp, Homo sapiens
gacacttgccttctt

SEQ ID NO: 4112423 - DNA, 19 bp, Homo sapiens
gacagaaaagtgcctgagc

SEQ ID NO: 4112424 - DNA, 21 bp, Homo sapiens
gacagaaaagtgcctgagctg

SEQ ID NO: 4112425 - DNA, 21 bp, Homo sapiens
gacagaaactggattaaaaca

SEQ ID NO: 4112426 - DNA, 18 bp, Homo sapiens
gacagaacttgaatgtgt

SEQ ID NO: 4112427 - DNA, 14 bp, Homo sapiens
gacagaaggctcct

SEQ ID NO: 4112428 - DNA, 20 bp, Homo sapiens
gacagaaggctcctgccccc

SEQ ID NO: 4112429 - DNA, 16 bp, Homo sapiens
gacagaagtctcctca

SEQ ID NO: 4112430 - DNA, 18 bp, Homo sapiens
gacagaccacatctttat

SEQ ID NO: 4112431 - DNA, 15 bp, Homo sapiens
gacagacctggacac

SEQ ID NO: 4112432 - DNA, 19 bp, Homo sapiens
gacagagccatgctgggaa

SEQ ID NO: 4112433 - DNA, 13 bp, Homo sapiens
gacagagcctgcc

SEQ ID NO: 4112434 - DNA, 15 bp, Homo sapiens
gacagagcctgcccc

SEQ ID NO: 4112435 - DNA, 16 bp, Homo sapiens
gacagagcctgcccca

SEQ ID NO: 4112436 - DNA, 18 bp, Homo sapiens
gacagagcgacagagcag

SEQ ID NO: 4112437 - DNA, 13 bp, Homo sapiens
gacagaggaaagg

SEQ ID NO: 4112438 - DNA, 22 bp, Homo sapiens
gacagaggaaagggctggctcc

SEQ ID NO: 4112439 - DNA, 13 bp, Homo sapiens
gacagaggcccca

SEQ ID NO: 4112440 - DNA, 12 bp, Homo sapiens
gacagaggcctg

SEQ ID NO: 4112441 - DNA, 22 bp, Homo sapiens
gacagaggctgcacccctgggc

SEQ ID NO: 4112442 - DNA, 19 bp, Homo sapiens
gacagagttcacaggaggc

SEQ ID NO: 4112443 - DNA, 22 bp, Homo sapiens
gacagagttcacaggaggccag

SEQ ID NO: 4112444 - DNA, 21 bp, Homo sapiens
gacagagttcactataaatgg

SEQ ID NO: 4112445 - DNA, 14 bp, Homo sapiens
gacagatatattta

SEQ ID NO: 4112446 - DNA, 18 bp, Homo sapiens
gacagatatatttaagcc

SEQ ID NO: 4112447 - DNA, 23 bp, Homo sapiens
gacagatccccgttcctgacatc

SEQ ID NO: 4112448 - DNA, 14 bp, Homo sapiens
gacagatgccccag

SEQ ID NO: 4112449 - DNA, 20 bp, Homo sapiens
gacagatgccccagagctgt

SEQ ID NO: 4112450 - DNA, 13 bp, Homo sapiens
gacagcagaagcc

SEQ ID NO: 4112451 - DNA, 14 bp, Homo sapiens
gacagcagaagcct

SEQ ID NO: 4112452 - DNA, 20 bp, Homo sapiens
gacagcagaagcctccaagc

SEQ ID NO: 4112453 - DNA, 17 bp, Homo sapiens
gacagcaggcagcgcca

SEQ ID NO: 4112454 - DNA, 23 bp, Homo sapiens
gacagcagtcttatgcttccaga

SEQ ID NO: 4112455 - DNA, 13 bp, Homo sapiens
gacagccagaact

SEQ ID NO: 4112456 - DNA, 13 bp, Homo sapiens
gacagccagagct

SEQ ID NO: 4112457 - DNA, 13 bp, Homo sapiens
gacagcccagagc

SEQ ID NO: 4112458 - DNA, 15 bp, Homo sapiens
gacagcccagagcct

SEQ ID NO: 4112459 - DNA, 15 bp, Homo sapiens
gacagccccaccctg

SEQ ID NO: 4112460 - DNA, 18 bp, Homo sapiens
gacagcctccccctgtcc

SEQ ID NO: 4112461 - DNA, 12 bp, Homo sapiens
gacagcctggca

SEQ ID NO: 4112462 - DNA, 19 bp, Homo sapiens
gacagcctggcacagggca

SEQ ID NO: 4112463 - DNA, 18 bp, Homo sapiens
gacagcgcccctgctgtc

SEQ ID NO: 4112464 - DNA, 18 bp, Homo sapiens
gacagctccaccctggcc

SEQ ID NO: 4112465 - DNA, 14 bp, Homo sapiens
gacagctgcaagcc

SEQ ID NO: 4112466 - DNA, 17 bp, Homo sapiens
gacagcttcctcacacc

SEQ ID NO: 4112467 - DNA, 15 bp, Homo sapiens
gacagcttgagccgg

SEQ ID NO: 4112468 - DNA, 15 bp, Homo sapiens
gacaggaaagccctc

SEQ ID NO: 4112469 - DNA, 16 bp, Homo sapiens
gacaggaaagccctcc

SEQ ID NO: 4112470 - DNA, 20 bp, Homo sapiens
gacaggaaagccctccccct

SEQ ID NO: 4112471 - DNA, 23 bp, Homo sapiens
gacaggagcctagcggagcccag

SEQ ID NO: 4112472 - DNA, 15 bp, Homo sapiens
gacaggaggcggccc

SEQ ID NO: 4112473 - DNA, 20 bp, Homo sapiens
gacaggagggcaagggccat

SEQ ID NO: 4112474 - DNA, 19 bp, Homo sapiens
gacaggagtcagtgtctgg

SEQ ID NO: 4112475 - DNA, 20 bp, Homo sapiens
gacaggagtcagtgtctggc

SEQ ID NO: 4112476 - DNA, 16 bp, Homo sapiens
gacaggcaaataaaag

SEQ ID NO: 4112477 - DNA, 14 bp, Homo sapiens
gacaggcagcccag

SEQ ID NO: 4112478 - DNA, 15 bp, Homo sapiens
gacaggcgcctgcca

SEQ ID NO: 4112479 - DNA, 15 bp, Homo sapiens
gacagggaagagcag

SEQ ID NO: 4112480 - DNA, 16 bp, Homo sapiens
gacagggaagagcaga

SEQ ID NO: 4112481 - DNA, 13 bp, Homo sapiens
gacagggaggcca

SEQ ID NO: 4112482 - DNA, 12 bp, Homo sapiens
gacagggcagag

SEQ ID NO: 4112483 - DNA, 15 bp, Homo sapiens
gacagggcagagcag

SEQ ID NO: 4112484 - DNA, 22 bp, Homo sapiens
gacagggcatggccaggtggcc

SEQ ID NO: 4112485 - DNA, 13 bp, Homo sapiens
gacagggccagtg

SEQ ID NO: 4112486 - DNA, 14 bp, Homo sapiens
gacagggccagtgg

SEQ ID NO: 4112487 - DNA, 21 bp, Homo sapiens
gacagggccagtggggcctgt

SEQ ID NO: 4112488 - DNA, 22 bp, Homo sapiens
gacagggccagtggggcctgtg

SEQ ID NO: 4112489 - DNA, 15 bp, Homo sapiens
gacagggcctggagc

SEQ ID NO: 4112490 - DNA, 20 bp, Homo sapiens
gacaggggagggggcaaagg

SEQ ID NO: 4112491 - DNA, 14 bp, Homo sapiens
gacagggtgggctt

SEQ ID NO: 4112492 - DNA, 20 bp, Homo sapiens
gacagggtgggcttcctgcc

SEQ ID NO: 4112493 - DNA, 21 bp, Homo sapiens
gacagggtgggcttcctgccc

SEQ ID NO: 4112494 - DNA, 22 bp, Homo sapiens
gacagtatgagtcaatgtgcag

SEQ ID NO: 4112495 - DNA, 17 bp, Homo sapiens
gacagtcatcatcaggg

SEQ ID NO: 4112496 - DNA, 18 bp, Homo sapiens
gacagtcatcatcagggc

SEQ ID NO: 4112497 - DNA, 15 bp, Homo sapiens
gacagtccagtgtca

SEQ ID NO: 4112498 - DNA, 15 bp, Homo sapiens
gacagtgatctccat

SEQ ID NO: 4112499 - DNA, 17 bp, Homo sapiens
gacagtgcctgggaatg

SEQ ID NO: 4112500 - DNA, 23 bp, Homo sapiens
gacagttacacttgacagacaaa

SEQ ID NO: 4112501 - DNA, 21 bp, Homo sapiens
gacagttatactgtcggtttt

SEQ ID NO: 4112502 - DNA, 18 bp, Homo sapiens
gacagttcattcagggcc

SEQ ID NO: 4112503 - DNA, 19 bp, Homo sapiens
gacagtttaccagttgcct

SEQ ID NO: 4112504 - DNA, 14 bp, Homo sapiens
gacagtttttctgt

SEQ ID NO: 4112505 - DNA, 16 bp, Homo sapiens
gacataacgtttttcc

SEQ ID NO: 4112506 - DNA, 13 bp, Homo sapiens
gacataccccact

SEQ ID NO: 4112507 - DNA, 14 bp, Homo sapiens
gacataccccactg

SEQ ID NO: 4112508 - DNA, 15 bp, Homo sapiens
gacatacttgaaggg

SEQ ID NO: 4112509 - DNA, 19 bp, Homo sapiens
gacatacttgaagggccag

SEQ ID NO: 4112510 - DNA, 16 bp, Homo sapiens
gacatatcagtgacct

SEQ ID NO: 4112511 - DNA, 21 bp, Homo sapiens
gacatatgggatattcccaag

SEQ ID NO: 4112512 - DNA, 13 bp, Homo sapiens
gacatcacagcag

SEQ ID NO: 4112513 - DNA, 14 bp, Homo sapiens
gacatcagcaaaca

SEQ ID NO: 4112514 - DNA, 16 bp, Homo sapiens
gacatcctcttctgct

SEQ ID NO: 4112515 - DNA, 21 bp, Homo sapiens
gaatgtttttccctccccaga

SEQ ID NO: 4112516 - DNA, 12 bp, Homo sapiens
gaattaaaactt

SEQ ID NO: 4112517 - DNA, 19 bp, Homo sapiens
gaattaaaacttcttaaat

SEQ ID NO: 4112518 - DNA, 13 bp, Homo sapiens
gaattaaatttaa

SEQ ID NO: 4112519 - DNA, 21 bp, Homo sapiens
gaattaaccatttaataaaga

SEQ ID NO: 4112520 - DNA, 19 bp, Homo sapiens
gaattaacctggtgctgga

SEQ ID NO: 4112521 - DNA, 17 bp, Homo sapiens
gaattaagatacaaatt

SEQ ID NO: 4112522 - DNA, 20 bp, Homo sapiens
gaattaagttatctttaaaa

SEQ ID NO: 4112523 - DNA, 22 bp, Homo sapiens
gaattacatgtaaaacattatc

SEQ ID NO: 4112524 - DNA, 12 bp, Homo sapiens
gaattattgaca

SEQ ID NO: 4112525 - DNA, 22 bp, Homo sapiens
gaattatttttgtgtttctaaa

SEQ ID NO: 4112526 - DNA, 16 bp, Homo sapiens
gaattcaaactggggc

SEQ ID NO: 4112527 - DNA, 21 bp, Homo sapiens
gaattcaaactggggcctcca

SEQ ID NO: 4112528 - DNA, 23 bp, Homo sapiens
gaattcagctcagcttcttccta

SEQ ID NO: 4112529 - DNA, 12 bp, Homo sapiens
gaattccaagga

SEQ ID NO: 4112530 - DNA, 13 bp, Homo sapiens
gaattccaaggag

SEQ ID NO: 4112531 - DNA, 18 bp, Homo sapiens
gaattcctaacttttcaa

SEQ ID NO: 4112532 - DNA, 16 bp, Homo sapiens
gaattcctcttttgct

SEQ ID NO: 4112533 - DNA, 23 bp, Homo sapiens
gaattcctcttttgcttaaatca

SEQ ID NO: 4112534 - DNA, 16 bp, Homo sapiens
gaattctgcccttttc

SEQ ID NO: 4112535 - DNA, 12 bp, Homo sapiens
gaattcttctgc

SEQ ID NO: 4112536 - DNA, 23 bp, Homo sapiens
gaattcttgaaggaaaatgatac

SEQ ID NO: 4112537 - DNA, 18 bp, Homo sapiens
gaattgaggggattaata

SEQ ID NO: 4112538 - DNA, 14 bp, Homo sapiens
gaattgagtaatgg

SEQ ID NO: 4112539 - DNA, 20 bp, Homo sapiens
gaattgatcattttcccccc

SEQ ID NO: 4112540 - DNA, 12 bp, Homo sapiens
gaattgatttgc

SEQ ID NO: 4112541 - DNA, 13 bp, Homo sapiens
gaattgatttgca

SEQ ID NO: 4112542 - DNA, 22 bp, Homo sapiens
gaattggcaaacccactgcagc

SEQ ID NO: 4112543 - DNA, 13 bp, Homo sapiens
gaatttaaatata

SEQ ID NO: 4112544 - DNA, 14 bp, Homo sapiens
gaatttaaatataa

SEQ ID NO: 4112545 - DNA, 21 bp, Homo sapiens
gaatttagggagaaatgttgt

SEQ ID NO: 4112546 - DNA, 13 bp, Homo sapiens
gaatttatacctc

SEQ ID NO: 4112547 - DNA, 17 bp, Homo sapiens
gaatttattcaattcct

SEQ ID NO: 4112548 - DNA, 12 bp, Homo sapiens
gaatttcacaag

SEQ ID NO: 4112549 - DNA, 17 bp, Homo sapiens
gaatttcccacataccc

SEQ ID NO: 4112550 - DNA, 12 bp, Homo sapiens
gaatttctaaaa

SEQ ID NO: 4112551 - DNA, 14 bp, Homo sapiens
gaatttgcctgctg

SEQ ID NO: 4112552 - DNA, 13 bp, Homo sapiens
gaatttgctgggg

SEQ ID NO: 4112553 - DNA, 18 bp, Homo sapiens
gaatttgtaacctcagct

SEQ ID NO: 4112554 - DNA, 13 bp, Homo sapiens
gaattttaatgtg

SEQ ID NO: 4112555 - DNA, 15 bp, Homo sapiens
gaattttaatgtgaa

SEQ ID NO: 4112556 - DNA, 17 bp, Homo sapiens
gaattttaatgtgaaga

SEQ ID NO: 4112557 - DNA, 12 bp, Homo sapiens
gaattttatatt

SEQ ID NO: 4112558 - DNA, 20 bp, Homo sapiens
gaattttccacgcagttctt

SEQ ID NO: 4112559 - DNA, 23 bp, Homo sapiens
gaattttccacgcagttctttcc

SEQ ID NO: 4112560 - DNA, 18 bp, Homo sapiens
gacaaaaagtttccatat

SEQ ID NO: 4112561 - DNA, 17 bp, Homo sapiens
gacaaactggagtctgg

SEQ ID NO: 4112562 - DNA, 14 bp, Homo sapiens
gacaaatctgtctg

SEQ ID NO: 4112563 - DNA, 15 bp, Homo sapiens
gacaacagtgctttg

SEQ ID NO: 4112564 - DNA, 17 bp, Homo sapiens
gacaaccactggtctgt

SEQ ID NO: 4112565 - DNA, 21 bp, Homo sapiens
gacaacttatttaaaaatatt

SEQ ID NO: 4112566 - DNA, 22 bp, Homo sapiens
gacaacttatttaaaaatattt

SEQ ID NO: 4112567 - DNA, 21 bp, Homo sapiens
gacaagacaaaccaagtcgga

SEQ ID NO: 4112568 - DNA, 15 bp, Homo sapiens
gacaagacccccagc

SEQ ID NO: 4112569 - DNA, 14 bp, Homo sapiens
gacaagagatggga

SEQ ID NO: 4112570 - DNA, 21 bp, Homo sapiens
gacaagataccggtgcttctg

SEQ ID NO: 4112571 - DNA, 18 bp, Homo sapiens
gacaagatattgtacata

SEQ ID NO: 4112572 - DNA, 22 bp, Homo sapiens
gacaagccaacttgtaaataca

SEQ ID NO: 4112573 - DNA, 22 bp, Homo sapiens
gacaagctgttgaccaggcacc

SEQ ID NO: 4112574 - DNA, 11 bp, Homo sapiens
gacaaggggcg

SEQ ID NO: 4112575 - DNA, 22 bp, Homo sapiens
gacaaggggcgtgcctggcgcc

SEQ ID NO: 4112576 - DNA, 17 bp, Homo sapiens
gacaaggtgcaggcagg

SEQ ID NO: 4112577 - DNA, 20 bp, Homo sapiens
gacaagtgctgaacagtgga

SEQ ID NO: 4112578 - DNA, 14 bp, Homo sapiens
gacaataaaacatt

SEQ ID NO: 4112579 - DNA, 14 bp, Homo sapiens
gacaataagtttga

SEQ ID NO: 4112580 - DNA, 19 bp, Homo sapiens
gacaataagtttgaacctt

SEQ ID NO: 4112581 - DNA, 21 bp, Homo sapiens
gacaataatattgttgtataa

SEQ ID NO: 4112582 - DNA, 19 bp, Homo sapiens
gacaataattctggagata

SEQ ID NO: 4112583 - DNA, 19 bp, Homo sapiens
gacaatactgtatgtcgtc

SEQ ID NO: 4112584 - DNA, 21 bp, Homo sapiens
gacaatcatgaaatatgcatc

SEQ ID NO: 4112585 - DNA, 20 bp, Homo sapiens
gacaatgatattgacactgt

SEQ ID NO: 4112586 - DNA, 20 bp, Homo sapiens
gacaatggaccctttttgtt

SEQ ID NO: 4112587 - DNA, 21 bp, Homo sapiens
gacaattcctagataaaaaga

SEQ ID NO: 4112588 - DNA, 23 bp, Homo sapiens
gacaattcctagataaaaagatg

SEQ ID NO: 4112589 - DNA, 21 bp, Homo sapiens
gacaattgttttaatctgaaa

SEQ ID NO: 4112590 - DNA, 16 bp, Homo sapiens
gacaatttgatacata

SEQ ID NO: 4112591 - DNA, 18 bp, Homo sapiens
gacaatttgatacataat

SEQ ID NO: 4112592 - DNA, 22 bp, Homo sapiens
gacaatttgatacataataaaa

SEQ ID NO: 4112593 - DNA, 23 bp, Homo sapiens
gacacaatccctggggctgtgca

SEQ ID NO: 4112594 - DNA, 12 bp, Homo sapiens
gacacacacaca

SEQ ID NO: 4112595 - DNA, 18 bp, Homo sapiens
gacacacacacgcacgca

SEQ ID NO: 4112596 - DNA, 22 bp, Homo sapiens
gacacacacacgcacgcacaca

SEQ ID NO: 4112597 - DNA, 19 bp, Homo sapiens
gacacacagcactctctaa

SEQ ID NO: 4112598 - DNA, 19 bp, Homo sapiens
gacacacatgggcagccca

SEQ ID NO: 4112599 - DNA, 20 bp, Homo sapiens
gacacacatgggcagcccaa

SEQ ID NO: 4112600 - DNA, 20 bp, Homo sapiens
gacacaccccacaccccagc

SEQ ID NO: 4112601 - DNA, 18 bp, Homo sapiens
gacacactaaccaagctg

SEQ ID NO: 4112602 - DNA, 18 bp, Homo sapiens
gacacagacccaggaccc

SEQ ID NO: 4112603 - DNA, 19 bp, Homo sapiens
gacacagcagcttcaccag

SEQ ID NO: 4112604 - DNA, 17 bp, Homo sapiens
gacacccaccctgtgcc

SEQ ID NO: 4112605 - DNA, 13 bp, Homo sapiens
gacacccaggact

SEQ ID NO: 4112606 - DNA, 13 bp, Homo sapiens
gacacccctgctc

SEQ ID NO: 4112607 - DNA, 18 bp, Homo sapiens
gacacccctgctctaccc

SEQ ID NO: 4112608 - DNA, 12 bp, Homo sapiens
gacaccctggcc

SEQ ID NO: 4112609 - DNA, 20 bp, Homo sapiens
gacaccggggtggtgggaac

SEQ ID NO: 4112610 - DNA, 17 bp, Homo sapiens
gacacctgaaccctcca

SEQ ID NO: 4112611 - DNA, 21 bp, Homo sapiens
gacacgccttcccctcagcca

SEQ ID NO: 4112612 - DNA, 17 bp, Homo sapiens
gacacgctcgcgggcag

SEQ ID NO: 4112613 - DNA, 15 bp, Homo sapiens
gacacggggcagtgg

SEQ ID NO: 4112614 - DNA, 17 bp, Homo sapiens
gacactaagttatagta

SEQ ID NO: 4112615 - DNA, 16 bp, Homo sapiens
gacactagaagatttt

SEQ ID NO: 4112616 - DNA, 23 bp, Homo sapiens
gacactatagtttaaaacacatt

SEQ ID NO: 4112617 - DNA, 12 bp, Homo sapiens
gacactccagtg

SEQ ID NO: 4112618 - DNA, 22 bp, Homo sapiens
gaagctgaagtgcatccaaagg

SEQ ID NO: 4112619 - DNA, 18 bp, Homo sapiens
gaagctgaggcgggagaa

SEQ ID NO: 4112620 - DNA, 21 bp, Homo sapiens
gaagctgccagcccagaacac

SEQ ID NO: 4112621 - DNA, 13 bp, Homo sapiens
gaagctgctccag

SEQ ID NO: 4112622 - DNA, 22 bp, Homo sapiens
gaagctgctgaccaattgtgct

SEQ ID NO: 4112623 - DNA, 12 bp, Homo sapiens
gaagctggactt

SEQ ID NO: 4112624 - DNA, 19 bp, Homo sapiens
gaagctggcctgagagggg

SEQ ID NO: 4112625 - DNA, 20 bp, Homo sapiens
gaagctgttaatttttctta

SEQ ID NO: 4112626 - DNA, 13 bp, Homo sapiens
gaagctgttgtac

SEQ ID NO: 4112627 - DNA, 19 bp, Homo sapiens
gaagctgttgtacatttat

SEQ ID NO: 4112628 - DNA, 21 bp, Homo sapiens
gaagcttggaggtcacagctg

SEQ ID NO: 4112629 - DNA, 20 bp, Homo sapiens
gaaggaacatggagctgtca

SEQ ID NO: 4112630 - DNA, 16 bp, Homo sapiens
gaaggaagtgaagagg

SEQ ID NO: 4112631 - DNA, 17 bp, Homo sapiens
gaaggaatctgtgcaga

SEQ ID NO: 4112632 - DNA, 16 bp, Homo sapiens
gaaggacaggaagctg

SEQ ID NO: 4112633 - DNA, 20 bp, Homo sapiens
gaaggactggattggccaaa

SEQ ID NO: 4112634 - DNA, 13 bp, Homo sapiens
gaaggagagcctg

SEQ ID NO: 4112635 - DNA, 20 bp, Homo sapiens
gaaggaggctccaggcagca

SEQ ID NO: 4112636 - DNA, 19 bp, Homo sapiens
gaaggaggggagagacagg

SEQ ID NO: 4112637 - DNA, 22 bp, Homo sapiens
gaaggaggggagagacaggcag

SEQ ID NO: 4112638 - DNA, 15 bp, Homo sapiens
gaaggaggtgaggga

SEQ ID NO: 4112639 - DNA, 13 bp, Homo sapiens
gaaggattgtaaa

SEQ ID NO: 4112640 - DNA, 15 bp, Homo sapiens
gaaggcaaagcacga

SEQ ID NO: 4112641 - DNA, 16 bp, Homo sapiens
gaaggcagccaccagc

SEQ ID NO: 4112642 - DNA, 21 bp, Homo sapiens
gaaggcagggggaaggtgggg

SEQ ID NO: 4112643 - DNA, 22 bp, Homo sapiens
gaaggcagggggaaggtggggt

SEQ ID NO: 4112644 - DNA, 16 bp, Homo sapiens
gaaggccctgctgagt

SEQ ID NO: 4112645 - DNA, 20 bp, Homo sapiens
gaaggcctgacttctgctgg

SEQ ID NO: 4112646 - DNA, 14 bp, Homo sapiens
gaaggcctggctgg

SEQ ID NO: 4112647 - DNA, 16 bp, Homo sapiens
gaaggcctggctggaa

SEQ ID NO: 4112648 - DNA, 17 bp, Homo sapiens
gaaggctctcaccccca

SEQ ID NO: 4112649 - DNA, 16 bp, Homo sapiens
gaaggcttgggatttg

SEQ ID NO: 4112650 - DNA, 18 bp, Homo sapiens
gaagggaccttgaagggt

SEQ ID NO: 4112651 - DNA, 20 bp, Homo sapiens
gaagggaccttgaagggtaa

SEQ ID NO: 4112652 - DNA, 16 bp, Homo sapiens
gaagggagaagaaagg

SEQ ID NO: 4112653 - DNA, 21 bp, Homo sapiens
gaagggagaaggatctagaat

SEQ ID NO: 4112654 - DNA, 13 bp, Homo sapiens
gaagggccagagc

SEQ ID NO: 4112655 - DNA, 17 bp, Homo sapiens
gaagggccagagccagg

SEQ ID NO: 4112656 - DNA, 14 bp, Homo sapiens
gaagggccagtcct

SEQ ID NO: 4112657 - DNA, 16 bp, Homo sapiens
gaagggccagtcctgc

SEQ ID NO: 4112658 - DNA, 20 bp, Homo sapiens
gaagggccagtcctgcctgg

SEQ ID NO: 4112659 - DNA, 13 bp, Homo sapiens
gaagggtttctct

SEQ ID NO: 4112660 - DNA, 15 bp, Homo sapiens
gaagggtttgtggct

SEQ ID NO: 4112661 - DNA, 21 bp, Homo sapiens
gaagggtttgtggctgggggc

SEQ ID NO: 4112662 - DNA, 13 bp, Homo sapiens
gaaggtagcccag

SEQ ID NO: 4112663 - DNA, 16 bp, Homo sapiens
gaaggtagcccagcac

SEQ ID NO: 4112664 - DNA, 17 bp, Homo sapiens
gaaggtctattggccaa

SEQ ID NO: 4112665 - DNA, 19 bp, Homo sapiens
gaaggtgctgacggccagg

SEQ ID NO: 4112666 - DNA, 21 bp, Homo sapiens
gaaggtgctgacggccaggga

SEQ ID NO: 4112667 - DNA, 23 bp, Homo sapiens
gaaggtggaccttttaaagtgtt

SEQ ID NO: 4112668 - DNA, 22 bp, Homo sapiens
gaaggttggtgaatttcacaag

SEQ ID NO: 4112669 - DNA, 16 bp, Homo sapiens
gaaggtttgtatattg

SEQ ID NO: 4112670 - DNA, 13 bp, Homo sapiens
gaagtaaactttt

SEQ ID NO: 4112671 - DNA, 18 bp, Homo sapiens
gaagtaaattaggcagtg

SEQ ID NO: 4112672 - DNA, 16 bp, Homo sapiens
gaagtacatgaataca

SEQ ID NO: 4112673 - DNA, 21 bp, Homo sapiens
gaagtacgttattgttgactt

SEQ ID NO: 4112674 - DNA, 18 bp, Homo sapiens
gaagtagcttgctccctg

SEQ ID NO: 4112675 - DNA, 14 bp, Homo sapiens
gaagtagtccttgg

SEQ ID NO: 4112676 - DNA, 18 bp, Homo sapiens
gaagtatacttttcccct

SEQ ID NO: 4112677 - DNA, 15 bp, Homo sapiens
gaagtcatgaagccc

SEQ ID NO: 4112678 - DNA, 17 bp, Homo sapiens
gaagtccaatgtggcaa

SEQ ID NO: 4112679 - DNA, 15 bp, Homo sapiens
gaagtcttagatgta

SEQ ID NO: 4112680 - DNA, 14 bp, Homo sapiens
gaagtcttttgttc

SEQ ID NO: 4112681 - DNA, 23 bp, Homo sapiens
gaagtgagcagtcgcctgcctgc

SEQ ID NO: 4112682 - DNA, 22 bp, Homo sapiens
gaagtgatactatccagttact

SEQ ID NO: 4112683 - DNA, 19 bp, Homo sapiens
gaagtgcgtggtataatct

SEQ ID NO: 4112684 - DNA, 18 bp, Homo sapiens
gaagtgctcttggctgac

SEQ ID NO: 4112685 - DNA, 16 bp, Homo sapiens
gaagtggctgccacac

SEQ ID NO: 4112686 - DNA, 19 bp, Homo sapiens
gaagtggggtgttcttctt

SEQ ID NO: 4112687 - DNA, 14 bp, Homo sapiens
gaagtgtaacagct

SEQ ID NO: 4112688 - DNA, 16 bp, Homo sapiens
gaagtgtaacagctga

SEQ ID NO: 4112689 - DNA, 16 bp, Homo sapiens
gaagtgtgagcgcctt

SEQ ID NO: 4112690 - DNA, 18 bp, Homo sapiens
gaagtgtgagcgccttgg

SEQ ID NO: 4112691 - DNA, 18 bp, Homo sapiens
gaagtgttgaagggaggt

SEQ ID NO: 4112692 - DNA, 18 bp, Homo sapiens
gaagttacatgcataaaa

SEQ ID NO: 4112693 - DNA, 12 bp, Homo sapiens
gaagttactttg

SEQ ID NO: 4112694 - DNA, 16 bp, Homo sapiens
gaagttactttgtaat

SEQ ID NO: 4112695 - DNA, 20 bp, Homo sapiens
gaagttgcattcctttgtct

SEQ ID NO: 4112696 - DNA, 12 bp, Homo sapiens
gaagttttccta

SEQ ID NO: 4112697 - DNA, 17 bp, Homo sapiens
gaataaaagctgtggaa

SEQ ID NO: 4112698 - DNA, 17 bp, Homo sapiens
gaataaactagagaagg

SEQ ID NO: 4112699 - DNA, 16 bp, Homo sapiens
gaataaactgaatatt

SEQ ID NO: 4112700 - DNA, 22 bp, Homo sapiens
gaataaataaatgtatcttatt

SEQ ID NO: 4112701 - DNA, 19 bp, Homo sapiens
gaataacatgtaattaagt

SEQ ID NO: 4112702 - DNA, 17 bp, Homo sapiens
gaataactcagaatatt

SEQ ID NO: 4112703 - DNA, 19 bp, Homo sapiens
gaataatatgctgccaaat

SEQ ID NO: 4112704 - DNA, 14 bp, Homo sapiens
gaataatggaaaca

SEQ ID NO: 4112705 - DNA, 16 bp, Homo sapiens
gaataatggaaacatt

SEQ ID NO: 4112706 - DNA, 23 bp, Homo sapiens
gaataatttcccaattaggaagt

SEQ ID NO: 4112707 - DNA, 15 bp, Homo sapiens
gaataatttgtaaat

SEQ ID NO: 4112708 - DNA, 15 bp, Homo sapiens
gaatacaattaaagg

SEQ ID NO: 4112709 - DNA, 16 bp, Homo sapiens
gaatacaattaaaggt

SEQ ID NO: 4112710 - DNA, 17 bp, Homo sapiens
gaatacaattaaaggtc

SEQ ID NO: 4112711 - DNA, 13 bp, Homo sapiens
gaatactgctaca

SEQ ID NO: 4112712 - DNA, 14 bp, Homo sapiens
gaatacttgaagaa

SEQ ID NO: 4112713 - DNA, 15 bp, Homo sapiens
gaatagatgctgact

SEQ ID NO: 4112714 - DNA, 18 bp, Homo sapiens
gaatagccacatttggaa

SEQ ID NO: 4112715 - DNA, 22 bp, Homo sapiens
gaatagcctggccaccagccat

SEQ ID NO: 4112716 - DNA, 14 bp, Homo sapiens
gaatagctgatgtg

SEQ ID NO: 4112717 - DNA, 20 bp, Homo sapiens
gaataggcattaacacaaag

SEQ ID NO: 4112718 - DNA, 18 bp, Homo sapiens
gaatagggagacagggta

SEQ ID NO: 4112719 - DNA, 13 bp, Homo sapiens
gaatataaagctt

SEQ ID NO: 4112720 - DNA, 15 bp, Homo sapiens
gaatatatgtgtgcc

SEQ ID NO: 4112721 - DNA, 16 bp, Homo sapiens
gaatatatttaagcaa

SEQ ID NO: 4112722 - DNA, 13 bp, Homo sapiens
gaatatatttatt

SEQ ID NO: 4112723 - DNA, 17 bp, Homo sapiens
gaatatatttatttaaa

SEQ ID NO: 4112724 - DNA, 15 bp, Homo sapiens
gaatatctgtaatgg

SEQ ID NO: 4112725 - DNA, 14 bp, Homo sapiens
gaatatctttcgat

SEQ ID NO: 4112726 - DNA, 15 bp, Homo sapiens
gaatatgacggaaga

SEQ ID NO: 4112727 - DNA, 18 bp, Homo sapiens
gaatatgtagctcatcct

SEQ ID NO: 4112728 - DNA, 22 bp, Homo sapiens
gaatattgctttggtcatatga

SEQ ID NO: 4112729 - DNA, 17 bp, Homo sapiens
gaatatttaagaaaagc

SEQ ID NO: 4112730 - DNA, 15 bp, Homo sapiens
gaatatttataacag

SEQ ID NO: 4112731 - DNA, 20 bp, Homo sapiens
gaatatttatatttcactat

SEQ ID NO: 4112732 - DNA, 21 bp, Homo sapiens
gaatatttattacctctgata

SEQ ID NO: 4112733 - DNA, 19 bp, Homo sapiens
gaatatttccatatggatt

SEQ ID NO: 4112734 - DNA, 18 bp, Homo sapiens
gaatattttggaaactgc

SEQ ID NO: 4112735 - DNA, 22 bp, Homo sapiens
gaatatttttatatttccttta

SEQ ID NO: 4112736 - DNA, 21 bp, Homo sapiens
gaatcaaaaattgaagagaga

SEQ ID NO: 4112737 - DNA, 13 bp, Homo sapiens
gaatcaaaactct

SEQ ID NO: 4112738 - DNA, 14 bp, Homo sapiens
gaatcaaaactctc

SEQ ID NO: 4112739 - DNA, 15 bp, Homo sapiens
gaatcaaaactctcc

SEQ ID NO: 4112740 - DNA, 16 bp, Homo sapiens
gaatcaagagctgccc

SEQ ID NO: 4112741 - DNA, 17 bp, Homo sapiens
gaatcaagagctgccct

SEQ ID NO: 4112742 - DNA, 14 bp, Homo sapiens
gaatcaatcctggg

SEQ ID NO: 4112743 - DNA, 13 bp, Homo sapiens
gaatcacctggct

SEQ ID NO: 4112744 - DNA, 18 bp, Homo sapiens
gaatcacctggctgagca

SEQ ID NO: 4112745 - DNA, 16 bp, Homo sapiens
gaatcagagtagaaat

SEQ ID NO: 4112746 - DNA, 17 bp, Homo sapiens
gaatcagagtagaaata

SEQ ID NO: 4112747 - DNA, 21 bp, Homo sapiens
gaatcagtataaacaaagtta

SEQ ID NO: 4112748 - DNA, 20 bp, Homo sapiens
gaatcatgagcctgctggaa

SEQ ID NO: 4112749 - DNA, 13 bp, Homo sapiens
gaatcatggagaa

SEQ ID NO: 4112750 - DNA, 20 bp, Homo sapiens
gaatcatgtcaggcctgtgt

SEQ ID NO: 4112751 - DNA, 19 bp, Homo sapiens
gaatcatgtgaacccggga

SEQ ID NO: 4112752 - DNA, 19 bp, Homo sapiens
gaatcattgtccagagctg

SEQ ID NO: 4112753 - DNA, 24 bp, Homo sapiens
gaatcatttagcatgttgttgaaa

SEQ ID NO: 4112754 - DNA, 16 bp, Homo sapiens
gaatccaaaagaaaaa

SEQ ID NO: 4112755 - DNA, 12 bp, Homo sapiens
gaatccaaactt

SEQ ID NO: 4112756 - DNA, 22 bp, Homo sapiens
gaatccaagggttgagagccag

SEQ ID NO: 4112757 - DNA, 13 bp, Homo sapiens
gaatccagctccc

SEQ ID NO: 4112758 - DNA, 22 bp, Homo sapiens
gaatccagctccctagactgca

SEQ ID NO: 4112759 - DNA, 17 bp, Homo sapiens
gaatcccccttgccacc

SEQ ID NO: 4112760 - DNA, 23 bp, Homo sapiens
gaatcccccttgccaccccaccc

SEQ ID NO: 4112761 - DNA, 22 bp, Homo sapiens
gaatcctatatagaatgctgca

SEQ ID NO: 4112762 - DNA, 16 bp, Homo sapiens
gaatcctctcctttct

SEQ ID NO: 4112763 - DNA, 22 bp, Homo sapiens
gaatcggagcgaagcagagagg

SEQ ID NO: 4112764 - DNA, 16 bp, Homo sapiens
gaatctcaaataacta

SEQ ID NO: 4112765 - DNA, 17 bp, Homo sapiens
gaatctcgttcccaaag

SEQ ID NO: 4112766 - DNA, 19 bp, Homo sapiens
gaatctcgttcccaaagaa

SEQ ID NO: 4112767 - DNA, 23 bp, Homo sapiens
gaatctgtctcccagttatgaat

SEQ ID NO: 4112768 - DNA, 14 bp, Homo sapiens
gaatcttgtctaac

SEQ ID NO: 4112769 - DNA, 22 bp, Homo sapiens
gaatctttagagaagtatacat

SEQ ID NO: 4112770 - DNA, 15 bp, Homo sapiens
gaatgaaaaaacagt

SEQ ID NO: 4112771 - DNA, 19 bp, Homo sapiens
gaatgaaaaatttaagcat

SEQ ID NO: 4112772 - DNA, 16 bp, Homo sapiens
gaatgaaaacatttta

SEQ ID NO: 4112773 - DNA, 14 bp, Homo sapiens
gaatgaaatgtatg

SEQ ID NO: 4112774 - DNA, 20 bp, Homo sapiens
gaatgaaattaacacaaagg

SEQ ID NO: 4112775 - DNA, 16 bp, Homo sapiens
gaatgaaattgctgaa

SEQ ID NO: 4112776 - DNA, 20 bp, Homo sapiens
gaatgaacactcttttgctt

SEQ ID NO: 4112777 - DNA, 23 bp, Homo sapiens
gaatgaacccaagagcaagggct

SEQ ID NO: 4112778 - DNA, 13 bp, Homo sapiens
gaatgagcccaga

SEQ ID NO: 4112779 - DNA, 16 bp, Homo sapiens
gaatgagcccagagaa

SEQ ID NO: 4112780 - DNA, 18 bp, Homo sapiens
gaatgaggtcccaggcag

SEQ ID NO: 4112781 - DNA, 21 bp, Homo sapiens
gaatgaggtcccaggcagaga

SEQ ID NO: 4112782 - DNA, 22 bp, Homo sapiens
gaatgaggtcccaggcagagaa

SEQ ID NO: 4112783 - DNA, 20 bp, Homo sapiens
gaatgcacactagcctctcc

SEQ ID NO: 4112784 - DNA, 17 bp, Homo sapiens
gaatgcccacaggcaaa

SEQ ID NO: 4112785 - DNA, 22 bp, Homo sapiens
gaatgcccacaggcaaatgcat

SEQ ID NO: 4112786 - DNA, 22 bp, Homo sapiens
gaatgcctcaatgtgaccaggg

SEQ ID NO: 4112787 - DNA, 13 bp, Homo sapiens
gaatgcctcctcc

SEQ ID NO: 4112788 - DNA, 12 bp, Homo sapiens
gaatgcctgtgc

SEQ ID NO: 4112789 - DNA, 15 bp, Homo sapiens
gaatgcgctttattg

SEQ ID NO: 4112790 - DNA, 20 bp, Homo sapiens
gaatgcgctttattgcccat

SEQ ID NO: 4112791 - DNA, 19 bp, Homo sapiens
gaatgctgaactccttgtt

SEQ ID NO: 4112792 - DNA, 21 bp, Homo sapiens
gaatgctgcaggacttgagaa

SEQ ID NO: 4112793 - DNA, 17 bp, Homo sapiens
gaatgctgtacatctat

SEQ ID NO: 4112794 - DNA, 21 bp, Homo sapiens
gaatggaagggttctggctgc

SEQ ID NO: 4112795 - DNA, 19 bp, Homo sapiens
gaatggacatcctgtataa

SEQ ID NO: 4112796 - DNA, 21 bp, Homo sapiens
gaatggcaatagggtagaatg

SEQ ID NO: 4112797 - DNA, 15 bp, Homo sapiens
gaatggtccagggtt

SEQ ID NO: 4112798 - DNA, 16 bp, Homo sapiens
gaatggttccatgcct

SEQ ID NO: 4112799 - DNA, 22 bp, Homo sapiens
gaatgtaaaagaacttactgat

SEQ ID NO: 4112800 - DNA, 18 bp, Homo sapiens
gaatgtaactccagatag

SEQ ID NO: 4112801 - DNA, 14 bp, Homo sapiens
gaatgtaagaaaac

SEQ ID NO: 4112802 - DNA, 20 bp, Homo sapiens
gaatgtacatgaagcaatta

SEQ ID NO: 4112803 - DNA, 21 bp, Homo sapiens
gaatgtagcagccccgggagg

SEQ ID NO: 4112804 - DNA, 23 bp, Homo sapiens
gaatgtagcagccccgggagggc

SEQ ID NO: 4112805 - DNA, 20 bp, Homo sapiens
gaatgtagctggtttcctca

SEQ ID NO: 4112806 - DNA, 16 bp, Homo sapiens
gaatgtatcaggaaat

SEQ ID NO: 4112807 - DNA, 17 bp, Homo sapiens
gaatgtatgtaatgtgt

SEQ ID NO: 4112808 - DNA, 18 bp, Homo sapiens
gaatgtattattctgcag

SEQ ID NO: 4112809 - DNA, 19 bp, Homo sapiens
gaatgtattattctgcagc

SEQ ID NO: 4112810 - DNA, 16 bp, Homo sapiens
gaatgtatttatttgg

SEQ ID NO: 4112811 - DNA, 22 bp, Homo sapiens
gaatgtcaaacagtgccaaatg

SEQ ID NO: 4112812 - DNA, 18 bp, Homo sapiens
gaatgtggccacttattt

SEQ ID NO: 4112813 - DNA, 21 bp, Homo sapiens
gaatgtgggcactggcccagg

SEQ ID NO: 4112814 - DNA, 16 bp, Homo sapiens
gaatgtggtctcagga

SEQ ID NO: 4112815 - DNA, 17 bp, Homo sapiens
gaatgtgtgtgtgtggc

SEQ ID NO: 4112816 - DNA, 23 bp, Homo sapiens
gaatgtgtgtgtgtggcaggggg

SEQ ID NO: 4112817 - DNA, 19 bp, Homo sapiens
gaatgttctgacattaaca

SEQ ID NO: 4112818 - DNA, 20 bp, Homo sapiens
gaatgttctgacattaacag

SEQ ID NO: 4112819 - DNA, 20 bp, Homo sapiens
gaatgtttacactctttgta

SEQ ID NO: 4112820 - DNA, 16 bp, Homo sapiens
gaatgttttaaattct

SEQ ID NO: 4112821 - DNA, 19 bp, Homo sapiens
gaatgttttatttatcaaa

SEQ ID NO: 4112822 - DNA, 19 bp, Homo sapiens
gaatgtttttccctcccca

SEQ ID NO: 4112823 - DNA, 19 bp, Homo sapiens
gcagcaccgttctgtgcac

SEQ ID NO: 4112824 - DNA, 14 bp, Homo sapiens
gcagcacctccagg

SEQ ID NO: 4112825 - DNA, 16 bp, Homo sapiens
gcagcacgtctcagag

SEQ ID NO: 4112826 - DNA, 20 bp, Homo sapiens
gcagcagcccaagcttccct

SEQ ID NO: 4112827 - DNA, 17 bp, Homo sapiens
gcagcagcttggggaga

SEQ ID NO: 4112828 - DNA, 17 bp, Homo sapiens
gcagcagtgagtctctt

SEQ ID NO: 4112829 - DNA, 19 bp, Homo sapiens
gcagcatcttcacttctaa

SEQ ID NO: 4112830 - DNA, 17 bp, Homo sapiens
gcagcatgacctgtgac

SEQ ID NO: 4112831 - DNA, 15 bp, Homo sapiens
gcagcatgagacttt

SEQ ID NO: 4112832 - DNA, 23 bp, Homo sapiens
gcagcatggaaaaatggttgatg

SEQ ID NO: 4112833 - DNA, 14 bp, Homo sapiens
gcagcatggcatag

SEQ ID NO: 4112834 - DNA, 18 bp, Homo sapiens
gcagcatggggtttttat

SEQ ID NO: 4112835 - DNA, 20 bp, Homo sapiens
gcagcatggtccctgcctta

SEQ ID NO: 4112836 - DNA, 15 bp, Homo sapiens
gcagcattttcatat

SEQ ID NO: 4112837 - DNA, 21 bp, Homo sapiens
gcagcatttttaattttcaca

SEQ ID NO: 4112838 - DNA, 13 bp, Homo sapiens
gcagccaccagcg

SEQ ID NO: 4112839 - DNA, 15 bp, Homo sapiens
gcagccagcagaggg

SEQ ID NO: 4112840 - DNA, 19 bp, Homo sapiens
gcagccagctccccacacc

SEQ ID NO: 4112841 - DNA, 19 bp, Homo sapiens
gcagcccaaaacccagggc

SEQ ID NO: 4112842 - DNA, 17 bp, Homo sapiens
gcagcccaagcttccct

SEQ ID NO: 4112843 - DNA, 21 bp, Homo sapiens
gcagcccaagcttccctccat

SEQ ID NO: 4112844 - DNA, 17 bp, Homo sapiens
gcagcccatgcccacct

SEQ ID NO: 4112845 - DNA, 16 bp, Homo sapiens
gcagccccagaagaaa

SEQ ID NO: 4112846 - DNA, 14 bp, Homo sapiens
gcagccccctccac

SEQ ID NO: 4112847 - DNA, 21 bp, Homo sapiens
gcagccccttgctctcagctg

SEQ ID NO: 4112848 - DNA, 22 bp, Homo sapiens
gcagccctaaggatctctcagg

SEQ ID NO: 4112849 - DNA, 24 bp, Homo sapiens
gcagccctgctttgggctgccctg

SEQ ID NO: 4112850 - DNA, 15 bp, Homo sapiens
gcagcccttgggcag

SEQ ID NO: 4112851 - DNA, 13 bp, Homo sapiens
gcagccgccagct

SEQ ID NO: 4112852 - DNA, 20 bp, Homo sapiens
gcagccgccttaagctgatc

SEQ ID NO: 4112853 - DNA, 19 bp, Homo sapiens
gcagccggcacagggtctg

SEQ ID NO: 4112854 - DNA, 21 bp, Homo sapiens
gcagcctaaagtacagcctgg

SEQ ID NO: 4112855 - DNA, 18 bp, Homo sapiens
gcagcctcccatccaggg

SEQ ID NO: 4112856 - DNA, 20 bp, Homo sapiens
gcagcctcccatccagggcc

SEQ ID NO: 4112857 - DNA, 12 bp, Homo sapiens
gcagcctctgga

SEQ ID NO: 4112858 - DNA, 22 bp, Homo sapiens
gcagcctctggacagccagtga

SEQ ID NO: 4112859 - DNA, 13 bp, Homo sapiens
gcagcctggctgg

SEQ ID NO: 4112860 - DNA, 22 bp, Homo sapiens
gcagccttggggaaccccgagc

SEQ ID NO: 4112861 - DNA, 18 bp, Homo sapiens
gcagcgaccgccccctcc

SEQ ID NO: 4112862 - DNA, 21 bp, Homo sapiens
gcagcgagggcggagccggcc

SEQ ID NO: 4112863 - DNA, 12 bp, Homo sapiens
gcagcgggccag

SEQ ID NO: 4112864 - DNA, 17 bp, Homo sapiens
gcagctaacaatgtctg

SEQ ID NO: 4112865 - DNA, 22 bp, Homo sapiens
gcagctatgcgcaatgtggcat

SEQ ID NO: 4112866 - DNA, 13 bp, Homo sapiens
gcagctcacccct

SEQ ID NO: 4112867 - DNA, 14 bp, Homo sapiens
gcagctcacccctg

SEQ ID NO: 4112868 - DNA, 16 bp, Homo sapiens
gcagctcacccctggg

SEQ ID NO: 4112869 - DNA, 17 bp, Homo sapiens
gcagctcacccctgggc

SEQ ID NO: 4112870 - DNA, 20 bp, Homo sapiens
gcagctcacccctgggcagg

SEQ ID NO: 4112871 - DNA, 20 bp, Homo sapiens
gcagctccccaggagctcag

SEQ ID NO: 4112872 - DNA, 14 bp, Homo sapiens
gcagctcccgcagg

SEQ ID NO: 4112873 - DNA, 14 bp, Homo sapiens
gcagctcttcctgg

SEQ ID NO: 4112874 - DNA, 23 bp, Homo sapiens
gcagctcttcctggacaggccag

SEQ ID NO: 4112875 - DNA, 14 bp, Homo sapiens
gcagctgattttaa

SEQ ID NO: 4112876 - DNA, 15 bp, Homo sapiens
gcagctgattttaac

SEQ ID NO: 4112877 - DNA, 14 bp, Homo sapiens
gcagcttcaccaga

SEQ ID NO: 4112878 - DNA, 15 bp, Homo sapiens
gcagcttggggagag

SEQ ID NO: 4112879 - DNA, 21 bp, Homo sapiens
gcagctttaaactcagggaca

SEQ ID NO: 4112880 - DNA, 22 bp, Homo sapiens
gcagctttaaactcagggacag

SEQ ID NO: 4112881 - DNA, 15 bp, Homo sapiens
gcagctttgggatcc

SEQ ID NO: 4112882 - DNA, 17 bp, Homo sapiens
gcagctttgggatccca

SEQ ID NO: 4112883 - DNA, 23 bp, Homo sapiens
gcagctttgggatcccaccctgg

SEQ ID NO: 4112884 - DNA, 16 bp, Homo sapiens
gcaggaactcccagca

SEQ ID NO: 4112885 - DNA, 20 bp, Homo sapiens
gcaggaagcattcagagagc

SEQ ID NO: 4112886 - DNA, 20 bp, Homo sapiens
gcaggaagccaggctgagtg

SEQ ID NO: 4112887 - DNA, 17 bp, Homo sapiens
gcaggaaggagagcctg

SEQ ID NO: 4112888 - DNA, 23 bp, Homo sapiens
gcaggaaggagagcctgctgcat

SEQ ID NO: 4112889 - DNA, 19 bp, Homo sapiens
gcaggaatcaaaaattgaa

SEQ ID NO: 4112890 - DNA, 14 bp, Homo sapiens
gcaggaattatgtc

SEQ ID NO: 4112891 - DNA, 13 bp, Homo sapiens
gcaggacaggagg

SEQ ID NO: 4112892 - DNA, 19 bp, Homo sapiens
gcaggacaggaggcggccc

SEQ ID NO: 4112893 - DNA, 22 bp, Homo sapiens
gcaggacaggaggcggcccggc

SEQ ID NO: 4112894 - DNA, 15 bp, Homo sapiens
gcaggaccaggacta

SEQ ID NO: 4112895 - DNA, 13 bp, Homo sapiens
gcaggactccagg

SEQ ID NO: 4112896 - DNA, 14 bp, Homo sapiens
gcaggactccaggc

SEQ ID NO: 4112897 - DNA, 22 bp, Homo sapiens
gcaggactgagtcccctccagg

SEQ ID NO: 4112898 - DNA, 14 bp, Homo sapiens
gcaggaggattgct

SEQ ID NO: 4112899 - DNA, 16 bp, Homo sapiens
gcaggaggccaaactg

SEQ ID NO: 4112900 - DNA, 21 bp, Homo sapiens
gcaggaggccaataaaaagtt

SEQ ID NO: 4112901 - DNA, 16 bp, Homo sapiens
gcaggagtctctgcca

SEQ ID NO: 4112902 - DNA, 18 bp, Homo sapiens
gcaggagtctctgccacc

SEQ ID NO: 4112903 - DNA, 19 bp, Homo sapiens
gcaggagtggtgcagacag

SEQ ID NO: 4112904 - DNA, 22 bp, Homo sapiens
gcaggagtgtcctgcccatgcc

SEQ ID NO: 4112905 - DNA, 17 bp, Homo sapiens
gcaggatggcctttcct

SEQ ID NO: 4112906 - DNA, 21 bp, Homo sapiens
gcaggatggcctttccttccc

SEQ ID NO: 4112907 - DNA, 19 bp, Homo sapiens
gcaggcaaaaaagggacag

SEQ ID NO: 4112908 - DNA, 16 bp, Homo sapiens
gcaggcacacagcagc

SEQ ID NO: 4112909 - DNA, 17 bp, Homo sapiens
gcaggcacacagcagcc

SEQ ID NO: 4112910 - DNA, 22 bp, Homo sapiens
gcaggcaccgccacgtcccagc

SEQ ID NO: 4112911 - DNA, 20 bp, Homo sapiens
gcaggcagactacacaggat

SEQ ID NO: 4112912 - DNA, 22 bp, Homo sapiens
gcaggcagcttctactcctgcc

SEQ ID NO: 4112913 - DNA, 16 bp, Homo sapiens
gcaggcattgaggaag

SEQ ID NO: 4112914 - DNA, 18 bp, Homo sapiens
gcaggcattgaggaagag

SEQ ID NO: 4112915 - DNA, 17 bp, Homo sapiens
gcaggccggaaccacag

SEQ ID NO: 4112916 - DNA, 21 bp, Homo sapiens
gcaggccggaaccacagggcc

SEQ ID NO: 4112917 - DNA, 13 bp, Homo sapiens
gcaggcctccctg

SEQ ID NO: 4112918 - DNA, 18 bp, Homo sapiens
gcaggcctccctgccagt

SEQ ID NO: 4112919 - DNA, 20 bp, Homo sapiens
gcaggcggtccccatcccca

SEQ ID NO: 4112920 - DNA, 22 bp, Homo sapiens
gcaggcggtccccatccccacc

SEQ ID NO: 4112921 - DNA, 15 bp, Homo sapiens
gcaggctcactgcca

SEQ ID NO: 4112922 - DNA, 23 bp, Homo sapiens
gcaggctcactgccaggccagcc

SEQ ID NO: 4112923 - DNA, 16 bp, Homo sapiens
gcaggctgagccactc

SEQ ID NO: 4112924 - DNA, 16 bp, Homo sapiens
gcaggctgagtccaga

SEQ ID NO: 4112925 - DNA, 15 bp, Homo sapiens
gcaggctggctggcc

SEQ ID NO: 4112926 - DNA, 24 bp, Homo sapiens
gcactctctaaatcttccttgtga

SEQ ID NO: 4112927 - DNA, 23 bp, Homo sapiens
gcactctgagtttaccatttgta

SEQ ID NO: 4112928 - DNA, 19 bp, Homo sapiens
gcactgaaaacttagccag

SEQ ID NO: 4112929 - DNA, 16 bp, Homo sapiens
gcactgaataaagcac

SEQ ID NO: 4112930 - DNA, 14 bp, Homo sapiens
gcactgagagggca

SEQ ID NO: 4112931 - DNA, 16 bp, Homo sapiens
gcactgagctcacatg

SEQ ID NO: 4112932 - DNA, 22 bp, Homo sapiens
gcactgagctcacatgggactg

SEQ ID NO: 4112933 - DNA, 12 bp, Homo sapiens
gcactgagggcc

SEQ ID NO: 4112934 - DNA, 24 bp, Homo sapiens
gcactgagggccacactattacca

SEQ ID NO: 4112935 - DNA, 19 bp, Homo sapiens
gcactgagggtggcactca

SEQ ID NO: 4112936 - DNA, 19 bp, Homo sapiens
gcactgatttcacaacaga

SEQ ID NO: 4112937 - DNA, 13 bp, Homo sapiens
gcactgccctgtt

SEQ ID NO: 4112938 - DNA, 14 bp, Homo sapiens
gcactgccttctcc

SEQ ID NO: 4112939 - DNA, 22 bp, Homo sapiens
gcactgctaggcgagtgccagg

SEQ ID NO: 4112940 - DNA, 17 bp, Homo sapiens
gcactgctccctacccc

SEQ ID NO: 4112941 - DNA, 11 bp, Homo sapiens
gcactgggagg

SEQ ID NO: 4112942 - DNA, 12 bp, Homo sapiens
gcactgggccac

SEQ ID NO: 4112943 - DNA, 18 bp, Homo sapiens
gcactgggccacggagga

SEQ ID NO: 4112944 - DNA, 12 bp, Homo sapiens
gcactgggctgt

SEQ ID NO: 4112945 - DNA, 22 bp, Homo sapiens
gcactggggagcccgtctcagt

SEQ ID NO: 4112946 - DNA, 16 bp, Homo sapiens
gcactgggggaacaga

SEQ ID NO: 4112947 - DNA, 13 bp, Homo sapiens
gcactggtgccaa

SEQ ID NO: 4112948 - DNA, 14 bp, Homo sapiens
gcactggtggcccg

SEQ ID NO: 4112949 - DNA, 23 bp, Homo sapiens
gcactggtggcccgacagcctgg

SEQ ID NO: 4112950 - DNA, 17 bp, Homo sapiens
gcactggtttgttccct

SEQ ID NO: 4112951 - DNA, 19 bp, Homo sapiens
gcactggtttgttccctgt

SEQ ID NO: 4112952 - DNA, 18 bp, Homo sapiens
gcactgtcactttgctct

SEQ ID NO: 4112953 - DNA, 18 bp, Homo sapiens
gcactgtcccttgcctca

SEQ ID NO: 4112954 - DNA, 23 bp, Homo sapiens
gcactgtcccttgcctcaatgcc

SEQ ID NO: 4112955 - DNA, 15 bp, Homo sapiens
gcacttagcaggcac

SEQ ID NO: 4112956 - DNA, 12 bp, Homo sapiens
gcacttccaaaa

SEQ ID NO: 4112957 - DNA, 18 bp, Homo sapiens
gcacttccaaaattctta

SEQ ID NO: 4112958 - DNA, 14 bp, Homo sapiens
gcacttctgcctga

SEQ ID NO: 4112959 - DNA, 21 bp, Homo sapiens
gcacttctgcctgaggggcag

SEQ ID NO: 4112960 - DNA, 22 bp, Homo sapiens
gcacttgggggttcaggcccgg

SEQ ID NO: 4112961 - DNA, 21 bp, Homo sapiens
gcactttctacaatgtgaact

SEQ ID NO: 4112962 - DNA, 14 bp, Homo sapiens
gcacttttgttatt

SEQ ID NO: 4112963 - DNA, 16 bp, Homo sapiens
gcactttttggctgac

SEQ ID NO: 4112964 - DNA, 21 bp, Homo sapiens
gcagaaagctgtgaacaggct

SEQ ID NO: 4112965 - DNA, 15 bp, Homo sapiens
gcagaaatctagaag

SEQ ID NO: 4112966 - DNA, 18 bp, Homo sapiens
gcagaacatcgatatgta

SEQ ID NO: 4112967 - DNA, 13 bp, Homo sapiens
gcagaacggagcc

SEQ ID NO: 4112968 - DNA, 19 bp, Homo sapiens
gcagaacggaggaggctgc

SEQ ID NO: 4112969 - DNA, 16 bp, Homo sapiens
gcagaagacaaaaaga

SEQ ID NO: 4112970 - DNA, 21 bp, Homo sapiens
gcagaagacaccagagcagat

SEQ ID NO: 4112971 - DNA, 21 bp, Homo sapiens
gcagaagcaagggggtgatgt

SEQ ID NO: 4112972 - DNA, 15 bp, Homo sapiens
gcagaagccctgatg

SEQ ID NO: 4112973 - DNA, 13 bp, Homo sapiens
gcagaagggaatt

SEQ ID NO: 4112974 - DNA, 15 bp, Homo sapiens
gcagaataatggaaa

SEQ ID NO: 4112975 - DNA, 16 bp, Homo sapiens
gcagaataatggaaac

SEQ ID NO: 4112976 - DNA, 18 bp, Homo sapiens
gcagaattttaatgtgaa

SEQ ID NO: 4112977 - DNA, 15 bp, Homo sapiens
gcagacagcaggcag

SEQ ID NO: 4112978 - DNA, 18 bp, Homo sapiens
gcagacagcaggcagcgc

SEQ ID NO: 4112979 - DNA, 20 bp, Homo sapiens
gcagacaggccccgtgaggc

SEQ ID NO: 4112980 - DNA, 22 bp, Homo sapiens
gcagaccatgaagtaaattatg

SEQ ID NO: 4112981 - DNA, 19 bp, Homo sapiens
gcagacgggcacagacacg

SEQ ID NO: 4112982 - DNA, 15 bp, Homo sapiens
gcagactacacagga

SEQ ID NO: 4112983 - DNA, 17 bp, Homo sapiens
gcagactcagtttgtca

SEQ ID NO: 4112984 - DNA, 16 bp, Homo sapiens
gcagacttcccagcta

SEQ ID NO: 4112985 - DNA, 20 bp, Homo sapiens
gcagactttctctgtgtatg

SEQ ID NO: 4112986 - DNA, 15 bp, Homo sapiens
gcagagaaagaagag

SEQ ID NO: 4112987 - DNA, 22 bp, Homo sapiens
gcagagaaagaagagacaggag

SEQ ID NO: 4112988 - DNA, 13 bp, Homo sapiens
gcagagaagctgg

SEQ ID NO: 4112989 - DNA, 14 bp, Homo sapiens
gcagagaagctgga

SEQ ID NO: 4112990 - DNA, 15 bp, Homo sapiens
gcagagaagctggac

SEQ ID NO: 4112991 - DNA, 16 bp, Homo sapiens
gcagagaagctggact

SEQ ID NO: 4112992 - DNA, 15 bp, Homo sapiens
gcagagaagttctca

SEQ ID NO: 4112993 - DNA, 20 bp, Homo sapiens
gcagagaatcatacttagca

SEQ ID NO: 4112994 - DNA, 17 bp, Homo sapiens
gcagagagatcttccca

SEQ ID NO: 4112995 - DNA, 16 bp, Homo sapiens
gcagagaggtggagaa

SEQ ID NO: 4112996 - DNA, 15 bp, Homo sapiens
gcagagcccccagga

SEQ ID NO: 4112997 - DNA, 11 bp, Homo sapiens
gcagagccctg

SEQ ID NO: 4112998 - DNA, 15 bp, Homo sapiens
gcagagccctgctcc

SEQ ID NO: 4112999 - DNA, 16 bp, Homo sapiens
gcagagccctgctccc

SEQ ID NO: 4113000 - DNA, 19 bp, Homo sapiens
gcagagccttctcagaagc

SEQ ID NO: 4113001 - DNA, 15 bp, Homo sapiens
gcagaggcaggctgg

SEQ ID NO: 4113002 - DNA, 16 bp, Homo sapiens
gcagaggcaggctggg

SEQ ID NO: 4113003 - DNA, 21 bp, Homo sapiens
gcagaggcaggctgggacgga

SEQ ID NO: 4113004 - DNA, 13 bp, Homo sapiens
gcagagggctgga

SEQ ID NO: 4113005 - DNA, 17 bp, Homo sapiens
gcagagggctggaggcc

SEQ ID NO: 4113006 - DNA, 24 bp, Homo sapiens
gcagagggctggaggcccaggctg

SEQ ID NO: 4113007 - DNA, 21 bp, Homo sapiens
gcagaggtaaaagtgtgagca

SEQ ID NO: 4113008 - DNA, 18 bp, Homo sapiens
gcagagtaaattgctctg

SEQ ID NO: 4113009 - DNA, 16 bp, Homo sapiens
gcagagtctgggcctc

SEQ ID NO: 4113010 - DNA, 14 bp, Homo sapiens
gcagagtgctggca

SEQ ID NO: 4113011 - DNA, 21 bp, Homo sapiens
gcagataacaatgcagcaagg

SEQ ID NO: 4113012 - DNA, 17 bp, Homo sapiens
gcagatactactgacca

SEQ ID NO: 4113013 - DNA, 15 bp, Homo sapiens
gcagatccaggacta

SEQ ID NO: 4113014 - DNA, 20 bp, Homo sapiens
gcagatctgtgccccatgcc

SEQ ID NO: 4113015 - DNA, 23 bp, Homo sapiens
gcagatgaggtgaaaaggccaag

SEQ ID NO: 4113016 - DNA, 15 bp, Homo sapiens
gcagatgcagagagc

SEQ ID NO: 4113017 - DNA, 14 bp, Homo sapiens
gcagatgcagctct

SEQ ID NO: 4113018 - DNA, 18 bp, Homo sapiens
gcagatggaatgctgtgt

SEQ ID NO: 4113019 - DNA, 23 bp, Homo sapiens
gcagatggacagcgatgagggga

SEQ ID NO: 4113020 - DNA, 17 bp, Homo sapiens
gcagatgggcggacggc

SEQ ID NO: 4113021 - DNA, 22 bp, Homo sapiens
gcagatgtcttccctgggctgc

SEQ ID NO: 4113022 - DNA, 21 bp, Homo sapiens
gcagattctaggacctgtgtc

SEQ ID NO: 4113023 - DNA, 17 bp, Homo sapiens
gcagattgaaaaggaca

SEQ ID NO: 4113024 - DNA, 17 bp, Homo sapiens
gcagattttacaaaaga

SEQ ID NO: 4113025 - DNA, 12 bp, Homo sapiens
gcagcaatttaa

SEQ ID NO: 4113026 - DNA, 15 bp, Homo sapiens
gcagcaatttaaatg

SEQ ID NO: 4113027 - DNA, 13 bp, Homo sapiens
gcagcaccctccc

SEQ ID NO: 4113028 - DNA, 15 bp, Homo sapiens
gcagcaccctccccc

SEQ ID NO: 4113029 - DNA, 21 bp, Homo sapiens
gcaccacggcgtttttttaca

SEQ ID NO: 4113030 - DNA, 18 bp, Homo sapiens
gcaccactgtgtatttaa

SEQ ID NO: 4113031 - DNA, 14 bp, Homo sapiens
gcaccagacaccca

SEQ ID NO: 4113032 - DNA, 15 bp, Homo sapiens
gcaccagacacccag

SEQ ID NO: 4113033 - DNA, 16 bp, Homo sapiens
gcaccagacacccagg

SEQ ID NO: 4113034 - DNA, 18 bp, Homo sapiens
gcaccagacacccaggac

SEQ ID NO: 4113035 - DNA, 19 bp, Homo sapiens
gcaccagacacccaggact

SEQ ID NO: 4113036 - DNA, 18 bp, Homo sapiens
gcaccagagcaacctctc

SEQ ID NO: 4113037 - DNA, 19 bp, Homo sapiens
gcaccagagcaacctctca

SEQ ID NO: 4113038 - DNA, 13 bp, Homo sapiens
gcaccagaggccg

SEQ ID NO: 4113039 - DNA, 17 bp, Homo sapiens
gcaccagatgcaacctc

SEQ ID NO: 4113040 - DNA, 20 bp, Homo sapiens
gcaccagatgcaacctcact

SEQ ID NO: 4113041 - DNA, 15 bp, Homo sapiens
gcaccagcatccacc

SEQ ID NO: 4113042 - DNA, 12 bp, Homo sapiens
gcaccagccagc

SEQ ID NO: 4113043 - DNA, 17 bp, Homo sapiens
gcaccagcttctccagg

SEQ ID NO: 4113044 - DNA, 20 bp, Homo sapiens
gcaccagggcattcgggcca

SEQ ID NO: 4113045 - DNA, 20 bp, Homo sapiens
gcaccatactccttgcttcc

SEQ ID NO: 4113046 - DNA, 23 bp, Homo sapiens
gcaccatactccttgcttcctga

SEQ ID NO: 4113047 - DNA, 15 bp, Homo sapiens
gcaccattctcctgc

SEQ ID NO: 4113048 - DNA, 16 bp, Homo sapiens
gcaccattctcctgcc

SEQ ID NO: 4113049 - DNA, 20 bp, Homo sapiens
gcaccattctcctgcctcag

SEQ ID NO: 4113050 - DNA, 18 bp, Homo sapiens
gcacccaaatcacatctc

SEQ ID NO: 4113051 - DNA, 24 bp, Homo sapiens
gcacccaaatcacatctcacctcc

SEQ ID NO: 4113052 - DNA, 19 bp, Homo sapiens
gcacccaccgtggaggagg

SEQ ID NO: 4113053 - DNA, 13 bp, Homo sapiens
gcacccacgtgca

SEQ ID NO: 4113054 - DNA, 15 bp, Homo sapiens
gcacccagagcaccc

SEQ ID NO: 4113055 - DNA, 13 bp, Homo sapiens
gcaccccaaggct

SEQ ID NO: 4113056 - DNA, 18 bp, Homo sapiens
gcacccccacccacctcc

SEQ ID NO: 4113057 - DNA, 20 bp, Homo sapiens
gcacccccctgttctaaggg

SEQ ID NO: 4113058 - DNA, 21 bp, Homo sapiens
gcaccccctgctccaccagca

SEQ ID NO: 4113059 - DNA, 14 bp, Homo sapiens
gcaccccctggaga

SEQ ID NO: 4113060 - DNA, 14 bp, Homo sapiens
gcaccccgctgcgg

SEQ ID NO: 4113061 - DNA, 15 bp, Homo sapiens
gcaccccggcctcag

SEQ ID NO: 4113062 - DNA, 17 bp, Homo sapiens
gcaccccggcctcaggg

SEQ ID NO: 4113063 - DNA, 19 bp, Homo sapiens
gcacccctgagccagcagg

SEQ ID NO: 4113064 - DNA, 19 bp, Homo sapiens
gcaccccttctctcctccc

SEQ ID NO: 4113065 - DNA, 20 bp, Homo sapiens
gcaccccttctctcctcccc

SEQ ID NO: 4113066 - DNA, 21 bp, Homo sapiens
gcaccccttctctcctcccca

SEQ ID NO: 4113067 - DNA, 22 bp, Homo sapiens
gcaccccttctctcctccccaa

SEQ ID NO: 4113068 - DNA, 21 bp, Homo sapiens
gcaccctagttctacctcagg

SEQ ID NO: 4113069 - DNA, 17 bp, Homo sapiens
gcaccctcatacacaga

SEQ ID NO: 4113070 - DNA, 20 bp, Homo sapiens
gcaccctgcgcctccagagg

SEQ ID NO: 4113071 - DNA, 17 bp, Homo sapiens
gcaccctggggcctgga

SEQ ID NO: 4113072 - DNA, 19 bp, Homo sapiens
gcaccctgtggccctggct

SEQ ID NO: 4113073 - DNA, 19 bp, Homo sapiens
gcaccgactagacacacaa

SEQ ID NO: 4113074 - DNA, 12 bp, Homo sapiens
gcaccgccacgt

SEQ ID NO: 4113075 - DNA, 20 bp, Homo sapiens
gcaccgccacgtcccagcat

SEQ ID NO: 4113076 - DNA, 17 bp, Homo sapiens
gcaccggcctggctgca

SEQ ID NO: 4113077 - DNA, 20 bp, Homo sapiens
gcaccgtgtcaagctgctct

SEQ ID NO: 4113078 - DNA, 21 bp, Homo sapiens
gcaccgtgtcaagctgctctg

SEQ ID NO: 4113079 - DNA, 14 bp, Homo sapiens
gcaccgttctgtgc

SEQ ID NO: 4113080 - DNA, 15 bp, Homo sapiens
gcacctaatccaggc

SEQ ID NO: 4113081 - DNA, 16 bp, Homo sapiens
gcacctaatccaggca

SEQ ID NO: 4113082 - DNA, 18 bp, Homo sapiens
gcacctaatccaggcaga

SEQ ID NO: 4113083 - DNA, 19 bp, Homo sapiens
gcacctaccatcagggaca

SEQ ID NO: 4113084 - DNA, 15 bp, Homo sapiens
gcacctccccgctgg

SEQ ID NO: 4113085 - DNA, 14 bp, Homo sapiens
gcacctcttccttg

SEQ ID NO: 4113086 - DNA, 20 bp, Homo sapiens
gcacctcttccttgatgttt

SEQ ID NO: 4113087 - DNA, 16 bp, Homo sapiens
gcacctgcacactcca

SEQ ID NO: 4113088 - DNA, 13 bp, Homo sapiens
gcacctgcctcag

SEQ ID NO: 4113089 - DNA, 20 bp, Homo sapiens
gcacctgcttcatgctcagc

SEQ ID NO: 4113090 - DNA, 21 bp, Homo sapiens
gcacctgtaatcccagctact

SEQ ID NO: 4113091 - DNA, 11 bp, Homo sapiens
gcacctgtccc

SEQ ID NO: 4113092 - DNA, 20 bp, Homo sapiens
gcacctgtccccaccctcca

SEQ ID NO: 4113093 - DNA, 21 bp, Homo sapiens
gcacctgtccccaccctccac

SEQ ID NO: 4113094 - DNA, 12 bp, Homo sapiens
gcacctgtctgc

SEQ ID NO: 4113095 - DNA, 15 bp, Homo sapiens
gcacctgtctgctcc

SEQ ID NO: 4113096 - DNA, 16 bp, Homo sapiens
gcacctgtctgctcca

SEQ ID NO: 4113097 - DNA, 18 bp, Homo sapiens
gcacctgtctgctccagc

SEQ ID NO: 4113098 - DNA, 20 bp, Homo sapiens
gcaccttcagggctgagttc

SEQ ID NO: 4113099 - DNA, 15 bp, Homo sapiens
gcaccttcctcactt

SEQ ID NO: 4113100 - DNA, 16 bp, Homo sapiens
gcaccttcctcacttc

SEQ ID NO: 4113101 - DNA, 16 bp, Homo sapiens
gcacctttgcacagga

SEQ ID NO: 4113102 - DNA, 14 bp, Homo sapiens
gcacgcacacacac

SEQ ID NO: 4113103 - DNA, 15 bp, Homo sapiens
gcacgcacacacaca

SEQ ID NO: 4113104 - DNA, 16 bp, Homo sapiens
gcacgcacacacacaa

SEQ ID NO: 4113105 - DNA, 14 bp, Homo sapiens
gcacgcaggaccag

SEQ ID NO: 4113106 - DNA, 13 bp, Homo sapiens
gcacgcctgctgg

SEQ ID NO: 4113107 - DNA, 14 bp, Homo sapiens
gcacgcctgctggc

SEQ ID NO: 4113108 - DNA, 15 bp, Homo sapiens
gcacgcctgctggcc

SEQ ID NO: 4113109 - DNA, 21 bp, Homo sapiens
gcacgcttgcgtatgtctgtt

SEQ ID NO: 4113110 - DNA, 18 bp, Homo sapiens
gcacgtggagagctggtg

SEQ ID NO: 4113111 - DNA, 20 bp, Homo sapiens
gcacgtggagagctggtgcc

SEQ ID NO: 4113112 - DNA, 15 bp, Homo sapiens
gcacgtggcctcttg

SEQ ID NO: 4113113 - DNA, 16 bp, Homo sapiens
gcacgttcataaccaa

SEQ ID NO: 4113114 - DNA, 21 bp, Homo sapiens
gcactaaagccagcctgacct

SEQ ID NO: 4113115 - DNA, 20 bp, Homo sapiens
gcactaacgttgagcccctg

SEQ ID NO: 4113116 - DNA, 20 bp, Homo sapiens
gcactaaggccgtgtctctg

SEQ ID NO: 4113117 - DNA, 14 bp, Homo sapiens
gcactacataaact

SEQ ID NO: 4113118 - DNA, 16 bp, Homo sapiens
gcactacattcattta

SEQ ID NO: 4113119 - DNA, 18 bp, Homo sapiens
gcactactgacatgtggg

SEQ ID NO: 4113120 - DNA, 17 bp, Homo sapiens
gcactactgggtgtcat

SEQ ID NO: 4113121 - DNA, 14 bp, Homo sapiens
gcactataatgtaa

SEQ ID NO: 4113122 - DNA, 22 bp, Homo sapiens
gcactataatgtaagctctact

SEQ ID NO: 4113123 - DNA, 21 bp, Homo sapiens
gcactcaactctgagcccata

SEQ ID NO: 4113124 - DNA, 16 bp, Homo sapiens
gcactcagtgagcctc

SEQ ID NO: 4113125 - DNA, 18 bp, Homo sapiens
gcactcagtgagcctcct

SEQ ID NO: 4113126 - DNA, 20 bp, Homo sapiens
gcactcattttctataacag

SEQ ID NO: 4113127 - DNA, 19 bp, Homo sapiens
gcactccagcctgggggac

SEQ ID NO: 4113128 - DNA, 17 bp, Homo sapiens
gcactccggcctgatga

SEQ ID NO: 4113129 - DNA, 14 bp, Homo sapiens
gcactctaaactgc

SEQ ID NO: 4113130 - DNA, 16 bp, Homo sapiens
gcactctaaactgcaa

SEQ ID NO: 4113131 - DNA, 20 bp, Homo sapiens
gcactctctaaatcttcctt

SEQ ID NO: 4113132 - DNA, 15 bp, Homo sapiens
gcaagccacaggaag

SEQ ID NO: 4113133 - DNA, 19 bp, Homo sapiens
gcaagccacaggaaggagg

SEQ ID NO: 4113134 - DNA, 23 bp, Homo sapiens
gcaagccagacctagcaggctgt

SEQ ID NO: 4113135 - DNA, 15 bp, Homo sapiens
gcaagccctacagag

SEQ ID NO: 4113136 - DNA, 13 bp, Homo sapiens
gcaagcgggagcc

SEQ ID NO: 4113137 - DNA, 14 bp, Homo sapiens
gcaagctggcctct

SEQ ID NO: 4113138 - DNA, 14 bp, Homo sapiens
gcaagcttcttgct

SEQ ID NO: 4113139 - DNA, 16 bp, Homo sapiens
gcaagcttcttgctga

SEQ ID NO: 4113140 - DNA, 10 bp, Homo sapiens
gcaaggaaag

SEQ ID NO: 4113141 - DNA, 13 bp, Homo sapiens
gcaaggaaggaaa

SEQ ID NO: 4113142 - DNA, 22 bp, Homo sapiens
gcaaggactacgttaagggaag

SEQ ID NO: 4113143 - DNA, 16 bp, Homo sapiens
gcaaggactcccggag

SEQ ID NO: 4113144 - DNA, 20 bp, Homo sapiens
gcaaggactcccggagcctg

SEQ ID NO: 4113145 - DNA, 14 bp, Homo sapiens
gcaaggccctgctg

SEQ ID NO: 4113146 - DNA, 15 bp, Homo sapiens
gcaaggccctgctgc

SEQ ID NO: 4113147 - DNA, 19 bp, Homo sapiens
gcaaggccctgctgcccaa

SEQ ID NO: 4113148 - DNA, 22 bp, Homo sapiens
gcaaggccgagcgttcccagca

SEQ ID NO: 4113149 - DNA, 14 bp, Homo sapiens
gcaagggagaaaag

SEQ ID NO: 4113150 - DNA, 19 bp, Homo sapiens
gcaagggagaaaagagaaa

SEQ ID NO: 4113151 - DNA, 15 bp, Homo sapiens
gcaagggccatgctg

SEQ ID NO: 4113152 - DNA, 19 bp, Homo sapiens
gcaagtagataaatatttg

SEQ ID NO: 4113153 - DNA, 18 bp, Homo sapiens
gcaagtagctttccacat

SEQ ID NO: 4113154 - DNA, 15 bp, Homo sapiens
gcaagtggatgggaa

SEQ ID NO: 4113155 - DNA, 16 bp, Homo sapiens
gcaagtgtgcactcca

SEQ ID NO: 4113156 - DNA, 19 bp, Homo sapiens
gcaagttaagagaaacttt

SEQ ID NO: 4113157 - DNA, 20 bp, Homo sapiens
gcaagttctagagaagaggc

SEQ ID NO: 4113158 - DNA, 18 bp, Homo sapiens
gcaagtttccatcatcta

SEQ ID NO: 4113159 - DNA, 21 bp, Homo sapiens
gcaataaatctgacccagtgc

SEQ ID NO: 4113160 - DNA, 12 bp, Homo sapiens
gcaataaatgaa

SEQ ID NO: 4113161 - DNA, 20 bp, Homo sapiens
gcaataacctcaaagtgact

SEQ ID NO: 4113162 - DNA, 16 bp, Homo sapiens
gcaataagaaatgaac

SEQ ID NO: 4113163 - DNA, 20 bp, Homo sapiens
gcaataagaaatgaacaaaa

SEQ ID NO: 4113164 - DNA, 14 bp, Homo sapiens
gcaatagagactgt

SEQ ID NO: 4113165 - DNA, 17 bp, Homo sapiens
gcaatagagactgtaga

SEQ ID NO: 4113166 - DNA, 17 bp, Homo sapiens
gcaatagtgtgttctga

SEQ ID NO: 4113167 - DNA, 21 bp, Homo sapiens
gcaatatttatggatgcaaca

SEQ ID NO: 4113168 - DNA, 14 bp, Homo sapiens
gcaatatttgaatt

SEQ ID NO: 4113169 - DNA, 18 bp, Homo sapiens
gcaatccacctgccttgg

SEQ ID NO: 4113170 - DNA, 20 bp, Homo sapiens
gcaatccacctgccttggcc

SEQ ID NO: 4113171 - DNA, 20 bp, Homo sapiens
gcaatccatgttagttttta

SEQ ID NO: 4113172 - DNA, 14 bp, Homo sapiens
gcaatcctcctgcc

SEQ ID NO: 4113173 - DNA, 15 bp, Homo sapiens
gcaatcctcctgcct

SEQ ID NO: 4113174 - DNA, 17 bp, Homo sapiens
gcaatctcttcattatt

SEQ ID NO: 4113175 - DNA, 23 bp, Homo sapiens
gcaatgaaaggtactatatttgc

SEQ ID NO: 4113176 - DNA, 16 bp, Homo sapiens
gcaatgatgaatgaga

SEQ ID NO: 4113177 - DNA, 17 bp, Homo sapiens
gcaatgatgaatgagaa

SEQ ID NO: 4113178 - DNA, 23 bp, Homo sapiens
gcaatggtgtcagtatccaggct

SEQ ID NO: 4113179 - DNA, 20 bp, Homo sapiens
gcaatgtcaggaacagaagg

SEQ ID NO: 4113180 - DNA, 19 bp, Homo sapiens
gcaatgtctgagtgaacct

SEQ ID NO: 4113181 - DNA, 14 bp, Homo sapiens
gcaatgttttgctt

SEQ ID NO: 4113182 - DNA, 15 bp, Homo sapiens
gcaattccgcattta

SEQ ID NO: 4113183 - DNA, 14 bp, Homo sapiens
gcaattctacagtt

SEQ ID NO: 4113184 - DNA, 15 bp, Homo sapiens
gcaattgcttaggat

SEQ ID NO: 4113185 - DNA, 13 bp, Homo sapiens
gcaattgtctatt

SEQ ID NO: 4113186 - DNA, 18 bp, Homo sapiens
gcaatttaaatgttatga

SEQ ID NO: 4113187 - DNA, 14 bp, Homo sapiens
gcaatttcatatgc

SEQ ID NO: 4113188 - DNA, 20 bp, Homo sapiens
gcaatttgtttaaagaataa

SEQ ID NO: 4113189 - DNA, 15 bp, Homo sapiens
gcacaaacacacaca

SEQ ID NO: 4113190 - DNA, 22 bp, Homo sapiens
gcacaaactttagggtaaaaat

SEQ ID NO: 4113191 - DNA, 14 bp, Homo sapiens
gcacaagaatggat

SEQ ID NO: 4113192 - DNA, 15 bp, Homo sapiens
gcacaagaatggatc

SEQ ID NO: 4113193 - DNA, 21 bp, Homo sapiens
gcacaagcagagtgcacagct

SEQ ID NO: 4113194 - DNA, 23 bp, Homo sapiens
gcacaagcagagtgcacagctgt

SEQ ID NO: 4113195 - DNA, 19 bp, Homo sapiens
gcacaaggttggttgctaa

SEQ ID NO: 4113196 - DNA, 10 bp, Homo sapiens
gcacacacac

SEQ ID NO: 4113197 - DNA, 12 bp, Homo sapiens
gcacacacacaa

SEQ ID NO: 4113198 - DNA, 13 bp, Homo sapiens
gcacacagcagcc

SEQ ID NO: 4113199 - DNA, 14 bp, Homo sapiens
gcacacagcagccc

SEQ ID NO: 4113200 - DNA, 15 bp, Homo sapiens
gcacacagcagcccc

SEQ ID NO: 4113201 - DNA, 21 bp, Homo sapiens
gcacacagcagccccccagca

SEQ ID NO: 4113202 - DNA, 16 bp, Homo sapiens
gcacacagctgagcac

SEQ ID NO: 4113203 - DNA, 15 bp, Homo sapiens
gcacaccacaattct

SEQ ID NO: 4113204 - DNA, 17 bp, Homo sapiens
gcacacgcacaaacaca

SEQ ID NO: 4113205 - DNA, 22 bp, Homo sapiens
gcacactacagagcagctcccc

SEQ ID NO: 4113206 - DNA, 23 bp, Homo sapiens
gcacactacagagcagctcccca

SEQ ID NO: 4113207 - DNA, 11 bp, Homo sapiens
gcacactattt

SEQ ID NO: 4113208 - DNA, 22 bp, Homo sapiens
gcacagacacgctcgcgggcag

SEQ ID NO: 4113209 - DNA, 13 bp, Homo sapiens
gcacagatggatt

SEQ ID NO: 4113210 - DNA, 18 bp, Homo sapiens
gcacagatggatttgcct

SEQ ID NO: 4113211 - DNA, 19 bp, Homo sapiens
gcacagatggatttgcctg

SEQ ID NO: 4113212 - DNA, 15 bp, Homo sapiens
gcacagcagcctggg

SEQ ID NO: 4113213 - DNA, 22 bp, Homo sapiens
gcacagcagcctggggctggcc

SEQ ID NO: 4113214 - DNA, 19 bp, Homo sapiens
gcacagctcttcacaccat

SEQ ID NO: 4113215 - DNA, 23 bp, Homo sapiens
gcacagctgtagtggggttctag

SEQ ID NO: 4113216 - DNA, 15 bp, Homo sapiens
gcacagcttagattt

SEQ ID NO: 4113217 - DNA, 17 bp, Homo sapiens
gcacagcttagatttca

SEQ ID NO: 4113218 - DNA, 16 bp, Homo sapiens
gcacaggatgctggcc

SEQ ID NO: 4113219 - DNA, 14 bp, Homo sapiens
gcacaggcagctgg

SEQ ID NO: 4113220 - DNA, 16 bp, Homo sapiens
gcacagggaagggctt

SEQ ID NO: 4113221 - DNA, 14 bp, Homo sapiens
gcacagggcaccag

SEQ ID NO: 4113222 - DNA, 19 bp, Homo sapiens
gcacagggcaccagaggcc

SEQ ID NO: 4113223 - DNA, 20 bp, Homo sapiens
gcacagggcaccagaggccg

SEQ ID NO: 4113224 - DNA, 12 bp, Homo sapiens
gcacagtccaga

SEQ ID NO: 4113225 - DNA, 15 bp, Homo sapiens
gcacagtccagaccc

SEQ ID NO: 4113226 - DNA, 15 bp, Homo sapiens
gcacagtgcatctca

SEQ ID NO: 4113227 - DNA, 19 bp, Homo sapiens
gcacagtgcatctcagccc

SEQ ID NO: 4113228 - DNA, 18 bp, Homo sapiens
gcacagtgtaatccaggg

SEQ ID NO: 4113229 - DNA, 14 bp, Homo sapiens
gcacagtgtgagcc

SEQ ID NO: 4113230 - DNA, 14 bp, Homo sapiens
gcacatgaaagttt

SEQ ID NO: 4113231 - DNA, 16 bp, Homo sapiens
gcacatgattgtataa

SEQ ID NO: 4113232 - DNA, 15 bp, Homo sapiens
gcacatggtgtgggg

SEQ ID NO: 4113233 - DNA, 17 bp, Homo sapiens
gcacatgtgtatttata

SEQ ID NO: 4113234 - DNA, 22 bp, Homo sapiens
gcaccaccctagtcccttcccc

SEQ ID NO: 4113235 - DNA, 15 bp, Homo sapiens
gcaccaccctccttc

SEQ ID NO: 4113236 - DNA, 23 bp, Homo sapiens
gatttcatacctcagaatgtaaa

SEQ ID NO: 4113237 - DNA, 18 bp, Homo sapiens
gatttcatagttcagaat

SEQ ID NO: 4113238 - DNA, 11 bp, Homo sapiens
gatttccctgc

SEQ ID NO: 4113239 - DNA, 23 bp, Homo sapiens
gatttccctgcagacctcaagcc

SEQ ID NO: 4113240 - DNA, 18 bp, Homo sapiens
gatttcctttatactgtg

SEQ ID NO: 4113241 - DNA, 22 bp, Homo sapiens
gatttcctttatactgtgaagt

SEQ ID NO: 4113242 - DNA, 16 bp, Homo sapiens
gatttctaatcaaaag

SEQ ID NO: 4113243 - DNA, 13 bp, Homo sapiens
gatttcttaaata

SEQ ID NO: 4113244 - DNA, 20 bp, Homo sapiens
gatttctttaaaagaatgac

SEQ ID NO: 4113245 - DNA, 16 bp, Homo sapiens
gatttgatatttgcat

SEQ ID NO: 4113246 - DNA, 17 bp, Homo sapiens
gatttgatatttgcatt

SEQ ID NO: 4113247 - DNA, 15 bp, Homo sapiens
gatttgatgctggag

SEQ ID NO: 4113248 - DNA, 15 bp, Homo sapiens
gatttgatgtgactt

SEQ ID NO: 4113249 - DNA, 17 bp, Homo sapiens
gatttgatgtgactttt

SEQ ID NO: 4113250 - DNA, 19 bp, Homo sapiens
gatttgattcattttcctg

SEQ ID NO: 4113251 - DNA, 21 bp, Homo sapiens
gatttgcattgaacacaaact

SEQ ID NO: 4113252 - DNA, 15 bp, Homo sapiens
gatttgcctgtgcca

SEQ ID NO: 4113253 - DNA, 16 bp, Homo sapiens
gatttgggggaggctt

SEQ ID NO: 4113254 - DNA, 19 bp, Homo sapiens
gatttgtagcactgagggt

SEQ ID NO: 4113255 - DNA, 21 bp, Homo sapiens
gatttgtaggaaggtctcatt

SEQ ID NO: 4113256 - DNA, 18 bp, Homo sapiens
gatttgtgtttttctttt

SEQ ID NO: 4113257 - DNA, 14 bp, Homo sapiens
gatttgttttgaat

SEQ ID NO: 4113258 - DNA, 16 bp, Homo sapiens
gatttgttttgaattt

SEQ ID NO: 4113259 - DNA, 18 bp, Homo sapiens
gatttgttttgaattttg

SEQ ID NO: 4113260 - DNA, 15 bp, Homo sapiens
gattttaattttgaa

SEQ ID NO: 4113261 - DNA, 17 bp, Homo sapiens
gattttacaaaagatgt

SEQ ID NO: 4113262 - DNA, 15 bp, Homo sapiens
gattttatttgacaa

SEQ ID NO: 4113263 - DNA, 21 bp, Homo sapiens
gattttcaaccagataacata

SEQ ID NO: 4113264 - DNA, 15 bp, Homo sapiens
gattttcctttgtag

SEQ ID NO: 4113265 - DNA, 20 bp, Homo sapiens
gattttcctttgtagctact

SEQ ID NO: 4113266 - DNA, 17 bp, Homo sapiens
gattttctattgttact

SEQ ID NO: 4113267 - DNA, 11 bp, Homo sapiens
gattttgcaaa

SEQ ID NO: 4113268 - DNA, 18 bp, Homo sapiens
gattttggataaatcatt

SEQ ID NO: 4113269 - DNA, 21 bp, Homo sapiens
gattttgtaaagttgccttta

SEQ ID NO: 4113270 - DNA, 13 bp, Homo sapiens
gattttgtaaccc

SEQ ID NO: 4113271 - DNA, 23 bp, Homo sapiens
gatttttcggaggccccactgat

SEQ ID NO: 4113272 - DNA, 13 bp, Homo sapiens
gatttttctcaaa

SEQ ID NO: 4113273 - DNA, 18 bp, Homo sapiens
gatttttctcaaagtttt

SEQ ID NO: 4113274 - DNA, 12 bp, Homo sapiens
gatttttcttct

SEQ ID NO: 4113275 - DNA, 16 bp, Homo sapiens
gatttttcttctttta

SEQ ID NO: 4113276 - DNA, 21 bp, Homo sapiens
gatttttcttttgaggcatgc

SEQ ID NO: 4113277 - DNA, 18 bp, Homo sapiens
gattttttattattattc

SEQ ID NO: 4113278 - DNA, 18 bp, Homo sapiens
gattttttattgctagta

SEQ ID NO: 4113279 - DNA, 19 bp, Homo sapiens
gattttttgcattcctgac

SEQ ID NO: 4113280 - DNA, 14 bp, Homo sapiens
gatttttttattat

SEQ ID NO: 4113281 - DNA, 13 bp, Homo sapiens
gatttttttcctc

SEQ ID NO: 4113282 - DNA, 17 bp, Homo sapiens
gatttttttgtgtatgt

SEQ ID NO: 4113283 - DNA, 20 bp, Homo sapiens
gatttttttttttttttcct

SEQ ID NO: 4113284 - DNA, 15 bp, Homo sapiens
gcaaaaacaaaaaga

SEQ ID NO: 4113285 - DNA, 20 bp, Homo sapiens
gcaaaaacaaaaagaaaaga

SEQ ID NO: 4113286 - DNA, 15 bp, Homo sapiens
gcaaaaacatgtatg

SEQ ID NO: 4113287 - DNA, 22 bp, Homo sapiens
gcaaaaacatgtatgtgcattt

SEQ ID NO: 4113288 - DNA, 20 bp, Homo sapiens
gcaaaaagcaagggagaaaa

SEQ ID NO: 4113289 - DNA, 14 bp, Homo sapiens
gcaaaaatatttat

SEQ ID NO: 4113290 - DNA, 18 bp, Homo sapiens
gcaaaacactatgtatag

SEQ ID NO: 4113291 - DNA, 14 bp, Homo sapiens
gcaaaagccttgtg

SEQ ID NO: 4113292 - DNA, 15 bp, Homo sapiens
gcaaaaggcagctca

SEQ ID NO: 4113293 - DNA, 23 bp, Homo sapiens
gcaaaaggcagctcacccctggg

SEQ ID NO: 4113294 - DNA, 21 bp, Homo sapiens
gcaaaaggttcactaaagcag

SEQ ID NO: 4113295 - DNA, 10 bp, Homo sapiens
gcaaaatatg

SEQ ID NO: 4113296 - DNA, 16 bp, Homo sapiens
gcaaaatcacttagca

SEQ ID NO: 4113297 - DNA, 20 bp, Homo sapiens
gcaaaatcacttagcagcaa

SEQ ID NO: 4113298 - DNA, 12 bp, Homo sapiens
gcaaaatgagtt

SEQ ID NO: 4113299 - DNA, 13 bp, Homo sapiens
gcaaaattgcaaa

SEQ ID NO: 4113300 - DNA, 17 bp, Homo sapiens
gcaaacacacaaaggta

SEQ ID NO: 4113301 - DNA, 17 bp, Homo sapiens
gcaaacactccaccctc

SEQ ID NO: 4113302 - DNA, 13 bp, Homo sapiens
gcaaacagaacag

SEQ ID NO: 4113303 - DNA, 14 bp, Homo sapiens
gcaaacagaacagg

SEQ ID NO: 4113304 - DNA, 16 bp, Homo sapiens
gcaaaccaatggtgat

SEQ ID NO: 4113305 - DNA, 22 bp, Homo sapiens
gcaaaccagcttgttctgggct

SEQ ID NO: 4113306 - DNA, 16 bp, Homo sapiens
gcaaaccatttttaaa

SEQ ID NO: 4113307 - DNA, 19 bp, Homo sapiens
gcaaactcactgctcaaga

SEQ ID NO: 4113308 - DNA, 22 bp, Homo sapiens
gcaaagataatttatttcaata

SEQ ID NO: 4113309 - DNA, 16 bp, Homo sapiens
gcaaagatcaaaataa

SEQ ID NO: 4113310 - DNA, 20 bp, Homo sapiens
gcaaagatctgtcctcagcc

SEQ ID NO: 4113311 - DNA, 19 bp, Homo sapiens
gcaaagccacaaggctggc

SEQ ID NO: 4113312 - DNA, 19 bp, Homo sapiens
gcaaagctgttcttcctgg

SEQ ID NO: 4113313 - DNA, 13 bp, Homo sapiens
gcaaaggggacag

SEQ ID NO: 4113314 - DNA, 15 bp, Homo sapiens
gcaaatctacagatc

SEQ ID NO: 4113315 - DNA, 21 bp, Homo sapiens
gcaaatgcattctatcgttat

SEQ ID NO: 4113316 - DNA, 14 bp, Homo sapiens
gcaaattttaactg

SEQ ID NO: 4113317 - DNA, 15 bp, Homo sapiens
gcaacaacaattggt

SEQ ID NO: 4113318 - DNA, 21 bp, Homo sapiens
gcaacaacaattggtaaaact

SEQ ID NO: 4113319 - DNA, 21 bp, Homo sapiens
gcaacaagcccgttagcccca

SEQ ID NO: 4113320 - DNA, 22 bp, Homo sapiens
gcaacactggaacatggctagc

SEQ ID NO: 4113321 - DNA, 12 bp, Homo sapiens
gcaacagatctg

SEQ ID NO: 4113322 - DNA, 14 bp, Homo sapiens
gcaacagatctgga

SEQ ID NO: 4113323 - DNA, 13 bp, Homo sapiens
gcaacaggacaga

SEQ ID NO: 4113324 - DNA, 14 bp, Homo sapiens
gcaaccactaagaa

SEQ ID NO: 4113325 - DNA, 22 bp, Homo sapiens
gcaacgaccagggccgaggagg

SEQ ID NO: 4113326 - DNA, 15 bp, Homo sapiens
gcaacgcccctccaa

SEQ ID NO: 4113327 - DNA, 19 bp, Homo sapiens
gcaacgcccctccaaacct

SEQ ID NO: 4113328 - DNA, 22 bp, Homo sapiens
gcaacttgtctttttctggact

SEQ ID NO: 4113329 - DNA, 16 bp, Homo sapiens
gcaagacagaaaagtg

SEQ ID NO: 4113330 - DNA, 19 bp, Homo sapiens
gcaagacagaaaagtgcct

SEQ ID NO: 4113331 - DNA, 15 bp, Homo sapiens
gcaagactgcaaact

SEQ ID NO: 4113332 - DNA, 18 bp, Homo sapiens
gcaagactgttgctcaaa

SEQ ID NO: 4113333 - DNA, 19 bp, Homo sapiens
gcaagagactgggagccac

SEQ ID NO: 4113334 - DNA, 23 bp, Homo sapiens
gcaagagggggtggaggggtgtg

SEQ ID NO: 4113335 - DNA, 19 bp, Homo sapiens
gcaagagtgattgcagctt

SEQ ID NO: 4113336 - DNA, 14 bp, Homo sapiens
gcaagcacatctgc

SEQ ID NO: 4113337 - DNA, 21 bp, Homo sapiens
gcaagcacctgttaataaagg

SEQ ID NO: 4113338 - DNA, 16 bp, Homo sapiens
gcaagcaggacctggc

SEQ ID NO: 4113339 - DNA, 19 bp, Homo sapiens
gatgtccctgggccagggt

SEQ ID NO: 4113340 - DNA, 20 bp, Homo sapiens
gatgtccctttcttggccag

SEQ ID NO: 4113341 - DNA, 15 bp, Homo sapiens
gatgtcttccctggg

SEQ ID NO: 4113342 - DNA, 21 bp, Homo sapiens
gatgtgaagataatttgcata

SEQ ID NO: 4113343 - DNA, 14 bp, Homo sapiens
gatgtgactgtata

SEQ ID NO: 4113344 - DNA, 12 bp, Homo sapiens
gatgtgactttt

SEQ ID NO: 4113345 - DNA, 14 bp, Homo sapiens
gatgtgagaaaacc

SEQ ID NO: 4113346 - DNA, 22 bp, Homo sapiens
gatgtgagaaaaccccttccca

SEQ ID NO: 4113347 - DNA, 23 bp, Homo sapiens
gatgtgagccaccgtgcctggcc

SEQ ID NO: 4113348 - DNA, 16 bp, Homo sapiens
gatgtgattgtggaat

SEQ ID NO: 4113349 - DNA, 21 bp, Homo sapiens
gatgtgcatttttgtgaaatg

SEQ ID NO: 4113350 - DNA, 17 bp, Homo sapiens
gatgtggaaagcacttt

SEQ ID NO: 4113351 - DNA, 20 bp, Homo sapiens
gatgtggtgcctgaggtctg

SEQ ID NO: 4113352 - DNA, 21 bp, Homo sapiens
gatgtgtcccccccaggcctt

SEQ ID NO: 4113353 - DNA, 23 bp, Homo sapiens
gatgttacatcacagtgtttgca

SEQ ID NO: 4113354 - DNA, 23 bp, Homo sapiens
gatgttgaatgcccacaggcaaa

SEQ ID NO: 4113355 - DNA, 19 bp, Homo sapiens
gatgtttccagacttcctt

SEQ ID NO: 4113356 - DNA, 16 bp, Homo sapiens
gatgtttgtggcctca

SEQ ID NO: 4113357 - DNA, 18 bp, Homo sapiens
gatgtttgtggcctcaga

SEQ ID NO: 4113358 - DNA, 17 bp, Homo sapiens
gatgttttcaggtgtca

SEQ ID NO: 4113359 - DNA, 16 bp, Homo sapiens
gattaaacacctgaca

SEQ ID NO: 4113360 - DNA, 14 bp, Homo sapiens
gattaatatgaaaa

SEQ ID NO: 4113361 - DNA, 18 bp, Homo sapiens
gattaatatgaaaactta

SEQ ID NO: 4113362 - DNA, 10 bp, Homo sapiens
gattaatcaa

SEQ ID NO: 4113363 - DNA, 14 bp, Homo sapiens
gattagaaggcaag

SEQ ID NO: 4113364 - DNA, 13 bp, Homo sapiens
gattagagggagg

SEQ ID NO: 4113365 - DNA, 17 bp, Homo sapiens
gattagagggaggtgtt

SEQ ID NO: 4113366 - DNA, 10 bp, Homo sapiens
gattagcttt

SEQ ID NO: 4113367 - DNA, 20 bp, Homo sapiens
gattaggagaaacacattct

SEQ ID NO: 4113368 - DNA, 22 bp, Homo sapiens
gattataaatgaaatttgcaaa

SEQ ID NO: 4113369 - DNA, 13 bp, Homo sapiens
gattatgggtcct

SEQ ID NO: 4113370 - DNA, 15 bp, Homo sapiens
gattatggttttgtg

SEQ ID NO: 4113371 - DNA, 17 bp, Homo sapiens
gattatggttttgtgat

SEQ ID NO: 4113372 - DNA, 16 bp, Homo sapiens
gattcaaagtagtttt

SEQ ID NO: 4113373 - DNA, 17 bp, Homo sapiens
gattcaaagtagtttta

SEQ ID NO: 4113374 - DNA, 23 bp, Homo sapiens
gattcaaagtgttgtgttcctgg

SEQ ID NO: 4113375 - DNA, 23 bp, Homo sapiens
gattcagaaaatgttctgtttgc

SEQ ID NO: 4113376 - DNA, 13 bp, Homo sapiens
gattcaggccagc

SEQ ID NO: 4113377 - DNA, 17 bp, Homo sapiens
gattcaggccagcccag

SEQ ID NO: 4113378 - DNA, 20 bp, Homo sapiens
gattcaggccagcccagcca

SEQ ID NO: 4113379 - DNA, 21 bp, Homo sapiens
gattcaggccagcccagccag

SEQ ID NO: 4113380 - DNA, 22 bp, Homo sapiens
gattcaggccagcccagccagg

SEQ ID NO: 4113381 - DNA, 12 bp, Homo sapiens
gattcaggctgc

SEQ ID NO: 4113382 - DNA, 16 bp, Homo sapiens
gattcaggctgcttgg

SEQ ID NO: 4113383 - DNA, 22 bp, Homo sapiens
gattcagttttcatttggttca

SEQ ID NO: 4113384 - DNA, 16 bp, Homo sapiens
gattcatagtaacttc

SEQ ID NO: 4113385 - DNA, 18 bp, Homo sapiens
gattcatatttacttctt

SEQ ID NO: 4113386 - DNA, 15 bp, Homo sapiens
gattcattctcataa

SEQ ID NO: 4113387 - DNA, 13 bp, Homo sapiens
gattcattttcct

SEQ ID NO: 4113388 - DNA, 14 bp, Homo sapiens
gattcattttcctg

SEQ ID NO: 4113389 - DNA, 15 bp, Homo sapiens
gattcattttcctgt

SEQ ID NO: 4113390 - DNA, 23 bp, Homo sapiens
gattccaaagagtagaattgcat

SEQ ID NO: 4113391 - DNA, 20 bp, Homo sapiens
gattccactacacctggctg

SEQ ID NO: 4113392 - DNA, 19 bp, Homo sapiens
gattccagagagtggctcc

SEQ ID NO: 4113393 - DNA, 15 bp, Homo sapiens
gattccagcccacat

SEQ ID NO: 4113394 - DNA, 18 bp, Homo sapiens
gattccagcccacattgg

SEQ ID NO: 4113395 - DNA, 16 bp, Homo sapiens
gattcccaccaaggtc

SEQ ID NO: 4113396 - DNA, 22 bp, Homo sapiens
gattcctaagccacttgaaatg

SEQ ID NO: 4113397 - DNA, 22 bp, Homo sapiens
gattcctaatcactcagagcag

SEQ ID NO: 4113398 - DNA, 23 bp, Homo sapiens
gattcctctgtattgtgctgatt

SEQ ID NO: 4113399 - DNA, 10 bp, Homo sapiens
gattcctggt

SEQ ID NO: 4113400 - DNA, 16 bp, Homo sapiens
gattcctgtttcaagt

SEQ ID NO: 4113401 - DNA, 22 bp, Homo sapiens
gattccttctctgaacacaggc

SEQ ID NO: 4113402 - DNA, 18 bp, Homo sapiens
gattcgtggtcttttcct

SEQ ID NO: 4113403 - DNA, 11 bp, Homo sapiens
gattctcagat

SEQ ID NO: 4113404 - DNA, 16 bp, Homo sapiens
gattctgcagtaaatc

SEQ ID NO: 4113405 - DNA, 15 bp, Homo sapiens
gattctgtgtatctt

SEQ ID NO: 4113406 - DNA, 19 bp, Homo sapiens
gattctgtgtgttttcata

SEQ ID NO: 4113407 - DNA, 16 bp, Homo sapiens
gattcttcaaaagcat

SEQ ID NO: 4113408 - DNA, 21 bp, Homo sapiens
gattcttgtatttattacaac

SEQ ID NO: 4113409 - DNA, 15 bp, Homo sapiens
gattcttgttttgct

SEQ ID NO: 4113410 - DNA, 16 bp, Homo sapiens
gattcttgttttgctt

SEQ ID NO: 4113411 - DNA, 15 bp, Homo sapiens
gattctttagagaag

SEQ ID NO: 4113412 - DNA, 16 bp, Homo sapiens
gattgaatgtgtgatg

SEQ ID NO: 4113413 - DNA, 15 bp, Homo sapiens
gattgacacacagca

SEQ ID NO: 4113414 - DNA, 14 bp, Homo sapiens
gattgacctgctcc

SEQ ID NO: 4113415 - DNA, 18 bp, Homo sapiens
gattgacctgctccgctg

SEQ ID NO: 4113416 - DNA, 13 bp, Homo sapiens
gattgaggcctgc

SEQ ID NO: 4113417 - DNA, 22 bp, Homo sapiens
gattgaggcctgccctcaggga

SEQ ID NO: 4113418 - DNA, 22 bp, Homo sapiens
gattgatcggagcctcctctct

SEQ ID NO: 4113419 - DNA, 12 bp, Homo sapiens
gattgcagcttt

SEQ ID NO: 4113420 - DNA, 22 bp, Homo sapiens
gattgcattagaaatagacagt

SEQ ID NO: 4113421 - DNA, 21 bp, Homo sapiens
gattgcccctggctttgcctc

SEQ ID NO: 4113422 - DNA, 15 bp, Homo sapiens
gattgctatgaatga

SEQ ID NO: 4113423 - DNA, 16 bp, Homo sapiens
gattgcttctgtagta

SEQ ID NO: 4113424 - DNA, 19 bp, Homo sapiens
gattgcttgagcccaggag

SEQ ID NO: 4113425 - DNA, 19 bp, Homo sapiens
gattggagaatactttgct

SEQ ID NO: 4113426 - DNA, 15 bp, Homo sapiens
gattggagctgaaga

SEQ ID NO: 4113427 - DNA, 17 bp, Homo sapiens
gattggattattcattt

SEQ ID NO: 4113428 - DNA, 21 bp, Homo sapiens
gattggattatttaataacat

SEQ ID NO: 4113429 - DNA, 22 bp, Homo sapiens
gattggattatttaataacatt

SEQ ID NO: 4113430 - DNA, 16 bp, Homo sapiens
gattggcctgtagagt

SEQ ID NO: 4113431 - DNA, 20 bp, Homo sapiens
gattggcctgtagagttgct

SEQ ID NO: 4113432 - DNA, 16 bp, Homo sapiens
gattggtttctcttct

SEQ ID NO: 4113433 - DNA, 17 bp, Homo sapiens
gattggtttctcttctc

SEQ ID NO: 4113434 - DNA, 20 bp, Homo sapiens
gattgtataagcatgctttc

SEQ ID NO: 4113435 - DNA, 16 bp, Homo sapiens
gatttaaacacacaga

SEQ ID NO: 4113436 - DNA, 17 bp, Homo sapiens
gatttaaacacacagat

SEQ ID NO: 4113437 - DNA, 20 bp, Homo sapiens
gatttaaagggacaccccta

SEQ ID NO: 4113438 - DNA, 16 bp, Homo sapiens
gatttaagcacaaact

SEQ ID NO: 4113439 - DNA, 14 bp, Homo sapiens
gatttaatttccag

SEQ ID NO: 4113440 - DNA, 18 bp, Homo sapiens
gatttataaatgctattt

SEQ ID NO: 4113441 - DNA, 15 bp, Homo sapiens
gatttcaagatcctc

SEQ ID NO: 4113442 - DNA, 19 bp, Homo sapiens
gatgataaagagacagtga

SEQ ID NO: 4113443 - DNA, 18 bp, Homo sapiens
gatgatacatccaaagca

SEQ ID NO: 4113444 - DNA, 19 bp, Homo sapiens
gatgatcagctgtttgtca

SEQ ID NO: 4113445 - DNA, 20 bp, Homo sapiens
gatgatcagctgtttgtcat

SEQ ID NO: 4113446 - DNA, 13 bp, Homo sapiens
gatgatccagaac

SEQ ID NO: 4113447 - DNA, 16 bp, Homo sapiens
gatgatccagaacagt

SEQ ID NO: 4113448 - DNA, 21 bp, Homo sapiens
gatgatctactcagaaatttt

SEQ ID NO: 4113449 - DNA, 22 bp, Homo sapiens
gatgatctctccacggtagcac

SEQ ID NO: 4113450 - DNA, 19 bp, Homo sapiens
gatgatgagaatttctaaa

SEQ ID NO: 4113451 - DNA, 15 bp, Homo sapiens
gatgattcagaaatt

SEQ ID NO: 4113452 - DNA, 18 bp, Homo sapiens
gatgatttgggggaggct

SEQ ID NO: 4113453 - DNA, 23 bp, Homo sapiens
gatgattttcatttcatgaaaat

SEQ ID NO: 4113454 - DNA, 18 bp, Homo sapiens
gatgcaacctcactatgg

SEQ ID NO: 4113455 - DNA, 17 bp, Homo sapiens
gatgcaaggaccaggac

SEQ ID NO: 4113456 - DNA, 18 bp, Homo sapiens
gatgcaaggaccaggact

SEQ ID NO: 4113457 - DNA, 18 bp, Homo sapiens
gatgcaatgtgctactga

SEQ ID NO: 4113458 - DNA, 16 bp, Homo sapiens
gatgcacatccctgga

SEQ ID NO: 4113459 - DNA, 16 bp, Homo sapiens
gatgcaggacaggagg

SEQ ID NO: 4113460 - DNA, 17 bp, Homo sapiens
gatgcaggacaggaggc

SEQ ID NO: 4113461 - DNA, 23 bp, Homo sapiens
gatgcaggacaggaggcggcccg

SEQ ID NO: 4113462 - DNA, 14 bp, Homo sapiens
gatgcagtgcttcc

SEQ ID NO: 4113463 - DNA, 17 bp, Homo sapiens
gatgccacacagagtgg

SEQ ID NO: 4113464 - DNA, 17 bp, Homo sapiens
gatgccactcctccctc

SEQ ID NO: 4113465 - DNA, 16 bp, Homo sapiens
gatgccagcttctctc

SEQ ID NO: 4113466 - DNA, 11 bp, Homo sapiens
gatgccaggac

SEQ ID NO: 4113467 - DNA, 12 bp, Homo sapiens
gatgccccagag

SEQ ID NO: 4113468 - DNA, 18 bp, Homo sapiens
gatgccgaggtaaaagtt

SEQ ID NO: 4113469 - DNA, 20 bp, Homo sapiens
gatgcctacaaccatccctg

SEQ ID NO: 4113470 - DNA, 23 bp, Homo sapiens
gatgctatttatgcaagttaggg

SEQ ID NO: 4113471 - DNA, 14 bp, Homo sapiens
gatgctcaggcttg

SEQ ID NO: 4113472 - DNA, 18 bp, Homo sapiens
gatgctccctcagcctca

SEQ ID NO: 4113473 - DNA, 23 bp, Homo sapiens
gatgctccctcagcctcagagga

SEQ ID NO: 4113474 - DNA, 13 bp, Homo sapiens
gatgctccctccc

SEQ ID NO: 4113475 - DNA, 12 bp, Homo sapiens
gatgctctttcc

SEQ ID NO: 4113476 - DNA, 21 bp, Homo sapiens
gatgctgacattcacctgccc

SEQ ID NO: 4113477 - DNA, 14 bp, Homo sapiens
gatgctggcccagg

SEQ ID NO: 4113478 - DNA, 21 bp, Homo sapiens
gatgctggcccagggcccaga

SEQ ID NO: 4113479 - DNA, 17 bp, Homo sapiens
gatgctgggcaatgagg

SEQ ID NO: 4113480 - DNA, 21 bp, Homo sapiens
gatgctgggcacttcatctga

SEQ ID NO: 4113481 - DNA, 15 bp, Homo sapiens
gatgctgggctgggc

SEQ ID NO: 4113482 - DNA, 14 bp, Homo sapiens
gatgcttataataa

SEQ ID NO: 4113483 - DNA, 15 bp, Homo sapiens
gatgcttctgggaga

SEQ ID NO: 4113484 - DNA, 15 bp, Homo sapiens
gatggaaaaggaaga

SEQ ID NO: 4113485 - DNA, 17 bp, Homo sapiens
gatggaacacggccaca

SEQ ID NO: 4113486 - DNA, 15 bp, Homo sapiens
gatggaattcttcct

SEQ ID NO: 4113487 - DNA, 17 bp, Homo sapiens
gatggacactaatgcag

SEQ ID NO: 4113488 - DNA, 12 bp, Homo sapiens
gatggagcccat

SEQ ID NO: 4113489 - DNA, 12 bp, Homo sapiens
gatggaggaaaa

SEQ ID NO: 4113490 - DNA, 23 bp, Homo sapiens
gatggaggaaaaccaagccgtgg

SEQ ID NO: 4113491 - DNA, 21 bp, Homo sapiens
gatggaggggtggtcctgact

SEQ ID NO: 4113492 - DNA, 23 bp, Homo sapiens
gatggaggttctcagagccaagt

SEQ ID NO: 4113493 - DNA, 18 bp, Homo sapiens
gatggataaactgagcct

SEQ ID NO: 4113494 - DNA, 14 bp, Homo sapiens
gatggattctcaga

SEQ ID NO: 4113495 - DNA, 19 bp, Homo sapiens
gatggattctcagatattt

SEQ ID NO: 4113496 - DNA, 14 bp, Homo sapiens
gatggatttgcctg

SEQ ID NO: 4113497 - DNA, 19 bp, Homo sapiens
gatggatttgcctgtgcca

SEQ ID NO: 4113498 - DNA, 22 bp, Homo sapiens
gatggcaacagatctggaacct

SEQ ID NO: 4113499 - DNA, 12 bp, Homo sapiens
gatggcagctgg

SEQ ID NO: 4113500 - DNA, 14 bp, Homo sapiens
gatggccagcccct

SEQ ID NO: 4113501 - DNA, 22 bp, Homo sapiens
gatggccagcccctggggccca

SEQ ID NO: 4113502 - DNA, 14 bp, Homo sapiens
gatggccaggcaag

SEQ ID NO: 4113503 - DNA, 22 bp, Homo sapiens
gatggccagtttgaagcctgtg

SEQ ID NO: 4113504 - DNA, 14 bp, Homo sapiens
gatggccataggag

SEQ ID NO: 4113505 - DNA, 15 bp, Homo sapiens
gatggcccttcccac

SEQ ID NO: 4113506 - DNA, 14 bp, Homo sapiens
gatggccttaattt

SEQ ID NO: 4113507 - DNA, 18 bp, Homo sapiens
gatggccttaatttcctt

SEQ ID NO: 4113508 - DNA, 14 bp, Homo sapiens
gatggcctttcctt

SEQ ID NO: 4113509 - DNA, 16 bp, Homo sapiens
gatggcctttccttcc

SEQ ID NO: 4113510 - DNA, 17 bp, Homo sapiens
gatggcctttccttccc

SEQ ID NO: 4113511 - DNA, 21 bp, Homo sapiens
gatggcctttccttccctctc

SEQ ID NO: 4113512 - DNA, 19 bp, Homo sapiens
gatggctgaggcaggagaa

SEQ ID NO: 4113513 - DNA, 19 bp, Homo sapiens
gatggctggaaggggtcca

SEQ ID NO: 4113514 - DNA, 23 bp, Homo sapiens
gatggcttattttttaaaatatt

SEQ ID NO: 4113515 - DNA, 17 bp, Homo sapiens
gatggcttgacatgtgc

SEQ ID NO: 4113516 - DNA, 18 bp, Homo sapiens
gatggcttgacatgtgca

SEQ ID NO: 4113517 - DNA, 15 bp, Homo sapiens
gatgggacagggagg

SEQ ID NO: 4113518 - DNA, 18 bp, Homo sapiens
gatgggactcattgtaga

SEQ ID NO: 4113519 - DNA, 20 bp, Homo sapiens
gatgggagctcctctcctgg

SEQ ID NO: 4113520 - DNA, 15 bp, Homo sapiens
gatgggagtgagaca

SEQ ID NO: 4113521 - DNA, 14 bp, Homo sapiens
gatgggagtgggca

SEQ ID NO: 4113522 - DNA, 19 bp, Homo sapiens
gatgggagtgggcacctca

SEQ ID NO: 4113523 - DNA, 20 bp, Homo sapiens
gatgggccacggctgagcct

SEQ ID NO: 4113524 - DNA, 12 bp, Homo sapiens
gatgggccaggg

SEQ ID NO: 4113525 - DNA, 18 bp, Homo sapiens
gatgggcttgttttcttg

SEQ ID NO: 4113526 - DNA, 18 bp, Homo sapiens
gatggggagtcccaaagc

SEQ ID NO: 4113527 - DNA, 22 bp, Homo sapiens
gatggggctcagatggactggg

SEQ ID NO: 4113528 - DNA, 15 bp, Homo sapiens
gatgggtcagagcta

SEQ ID NO: 4113529 - DNA, 21 bp, Homo sapiens
gatgggtctggctgagctgaa

SEQ ID NO: 4113530 - DNA, 22 bp, Homo sapiens
gatgggtgggtggggtattttt

SEQ ID NO: 4113531 - DNA, 14 bp, Homo sapiens
gatgggttccagag

SEQ ID NO: 4113532 - DNA, 23 bp, Homo sapiens
gatgggttctaattttggatgga

SEQ ID NO: 4113533 - DNA, 21 bp, Homo sapiens
gatggtggactacaaaataca

SEQ ID NO: 4113534 - DNA, 17 bp, Homo sapiens
gatggtgtgggtgtcct

SEQ ID NO: 4113535 - DNA, 23 bp, Homo sapiens
gatgtaacaagggttttaatgta

SEQ ID NO: 4113536 - DNA, 22 bp, Homo sapiens
gatgtaatttagggtactaaat

SEQ ID NO: 4113537 - DNA, 22 bp, Homo sapiens
gatgtacatagttatttttctc

SEQ ID NO: 4113538 - DNA, 19 bp, Homo sapiens
gatgtagagagaacaggtg

SEQ ID NO: 4113539 - DNA, 20 bp, Homo sapiens
gatgtagttctgccaggcaa

SEQ ID NO: 4113540 - DNA, 15 bp, Homo sapiens
gatgtatatgtttat

SEQ ID NO: 4113541 - DNA, 19 bp, Homo sapiens
gatgtcagcagacacacat

SEQ ID NO: 4113542 - DNA, 20 bp, Homo sapiens
gatgtcatgtctgcttgtca

SEQ ID NO: 4113543 - DNA, 18 bp, Homo sapiens
gatgtcccagtgctcacc

SEQ ID NO: 4113544 - DNA, 16 bp, Homo sapiens
gatgtccctgggccag

SEQ ID NO: 4113545 - DNA, 23 bp, Homo sapiens
gatccaaaagaagcccccagcta

SEQ ID NO: 4113546 - DNA, 13 bp, Homo sapiens
gatccaagacaaa

SEQ ID NO: 4113547 - DNA, 23 bp, Homo sapiens
gatccacactttgggcttagtat

SEQ ID NO: 4113548 - DNA, 19 bp, Homo sapiens
gatccacctgtctcagcct

SEQ ID NO: 4113549 - DNA, 14 bp, Homo sapiens
gatccagagagcag

SEQ ID NO: 4113550 - DNA, 16 bp, Homo sapiens
gatccagagagcagct

SEQ ID NO: 4113551 - DNA, 14 bp, Homo sapiens
gatccagcactggt

SEQ ID NO: 4113552 - DNA, 13 bp, Homo sapiens
gatccagcctggg

SEQ ID NO: 4113553 - DNA, 14 bp, Homo sapiens
gatccagggacaga

SEQ ID NO: 4113554 - DNA, 18 bp, Homo sapiens
gatccagggacagaggcc

SEQ ID NO: 4113555 - DNA, 22 bp, Homo sapiens
gatccagggacagaggccccag

SEQ ID NO: 4113556 - DNA, 16 bp, Homo sapiens
gatccatccatctcca

SEQ ID NO: 4113557 - DNA, 17 bp, Homo sapiens
gatccatccatctccag

SEQ ID NO: 4113558 - DNA, 15 bp, Homo sapiens
gatccccactgtcct

SEQ ID NO: 4113559 - DNA, 17 bp, Homo sapiens
gatccccgttcctgaca

SEQ ID NO: 4113560 - DNA, 13 bp, Homo sapiens
gatcccctcagga

SEQ ID NO: 4113561 - DNA, 17 bp, Homo sapiens
gatcccctcaggactgc

SEQ ID NO: 4113562 - DNA, 21 bp, Homo sapiens
gatcccctctgtctacaaata

SEQ ID NO: 4113563 - DNA, 19 bp, Homo sapiens
gatcccctgcggtcaggct

SEQ ID NO: 4113564 - DNA, 21 bp, Homo sapiens
gatcccgcctcttcttcttca

SEQ ID NO: 4113565 - DNA, 23 bp, Homo sapiens
gatccctcccccccatgcactgt

SEQ ID NO: 4113566 - DNA, 20 bp, Homo sapiens
gatccctgcccttctcaaga

SEQ ID NO: 4113567 - DNA, 24 bp, Homo sapiens
gatccctgtgttgtctctagagca

SEQ ID NO: 4113568 - DNA, 22 bp, Homo sapiens
gatcccttccacctgctctgct

SEQ ID NO: 4113569 - DNA, 20 bp, Homo sapiens
gatcctattctcaccaggaa

SEQ ID NO: 4113570 - DNA, 15 bp, Homo sapiens
gatcctggaggccca

SEQ ID NO: 4113571 - DNA, 19 bp, Homo sapiens
gatcctgtctttaaggaaa

SEQ ID NO: 4113572 - DNA, 20 bp, Homo sapiens
gatcctgtctttaaggaaaa

SEQ ID NO: 4113573 - DNA, 21 bp, Homo sapiens
gatcctttttccatcatttta

SEQ ID NO: 4113574 - DNA, 17 bp, Homo sapiens
gatcgaaccgttttgaa

SEQ ID NO: 4113575 - DNA, 18 bp, Homo sapiens
gatcgagaccatcctggc

SEQ ID NO: 4113576 - DNA, 13 bp, Homo sapiens
gatcgcagtttgc

SEQ ID NO: 4113577 - DNA, 15 bp, Homo sapiens
gatcgcatcattgca

SEQ ID NO: 4113578 - DNA, 15 bp, Homo sapiens
gatcgtgctaaattt

SEQ ID NO: 4113579 - DNA, 17 bp, Homo sapiens
gatctaagcctttccat

SEQ ID NO: 4113580 - DNA, 18 bp, Homo sapiens
gatctaccagcataaata

SEQ ID NO: 4113581 - DNA, 16 bp, Homo sapiens
gatctagaatgtgttt

SEQ ID NO: 4113582 - DNA, 20 bp, Homo sapiens
gatctagaatgtgttttctg

SEQ ID NO: 4113583 - DNA, 14 bp, Homo sapiens
gatctatgggaaga

SEQ ID NO: 4113584 - DNA, 16 bp, Homo sapiens
gatctatttcatgttt

SEQ ID NO: 4113585 - DNA, 13 bp, Homo sapiens
gatctcagggcag

SEQ ID NO: 4113586 - DNA, 17 bp, Homo sapiens
gatctcattcagtatta

SEQ ID NO: 4113587 - DNA, 20 bp, Homo sapiens
gatctccaaggaccaggtta

SEQ ID NO: 4113588 - DNA, 12 bp, Homo sapiens
gatctctcagga

SEQ ID NO: 4113589 - DNA, 16 bp, Homo sapiens
gatctctcaggagcac

SEQ ID NO: 4113590 - DNA, 17 bp, Homo sapiens
gatctctcaggagcaca

SEQ ID NO: 4113591 - DNA, 18 bp, Homo sapiens
gatctctcaggagcacag

SEQ ID NO: 4113592 - DNA, 22 bp, Homo sapiens
gatctctcaggagcacaggcag

SEQ ID NO: 4113593 - DNA, 14 bp, Homo sapiens
gatctctcctggcc

SEQ ID NO: 4113594 - DNA, 17 bp, Homo sapiens
gatctctctagctttgt

SEQ ID NO: 4113595 - DNA, 18 bp, Homo sapiens
gatctctctagctttgtc

SEQ ID NO: 4113596 - DNA, 16 bp, Homo sapiens
gatctctcttgtcctc

SEQ ID NO: 4113597 - DNA, 23 bp, Homo sapiens
gatctctcttgtcctcttctgct

SEQ ID NO: 4113598 - DNA, 14 bp, Homo sapiens
gatctggaacccag

SEQ ID NO: 4113599 - DNA, 15 bp, Homo sapiens
gatctggaacccaga

SEQ ID NO: 4113600 - DNA, 17 bp, Homo sapiens
gatctggaacccagact

SEQ ID NO: 4113601 - DNA, 18 bp, Homo sapiens
gatctggaacccagactc

SEQ ID NO: 4113602 - DNA, 18 bp, Homo sapiens
gatctggaacctcagcct

SEQ ID NO: 4113603 - DNA, 23 bp, Homo sapiens
gatctggaacctcagcctggcca

SEQ ID NO: 4113604 - DNA, 17 bp, Homo sapiens
gatctggggctctggga

SEQ ID NO: 4113605 - DNA, 20 bp, Homo sapiens
gatctgtatttaatggtttt

SEQ ID NO: 4113606 - DNA, 15 bp, Homo sapiens
gatctgtccaaggaa

SEQ ID NO: 4113607 - DNA, 17 bp, Homo sapiens
gatctgtcctcagcctt

SEQ ID NO: 4113608 - DNA, 21 bp, Homo sapiens
gatctgtgatagttcaccccc

SEQ ID NO: 4113609 - DNA, 17 bp, Homo sapiens
gatctgttttgaaggca

SEQ ID NO: 4113610 - DNA, 20 bp, Homo sapiens
gatctgttttgaaggcaaaa

SEQ ID NO: 4113611 - DNA, 13 bp, Homo sapiens
gatcttaaagatc

SEQ ID NO: 4113612 - DNA, 14 bp, Homo sapiens
gatcttcaatggct

SEQ ID NO: 4113613 - DNA, 14 bp, Homo sapiens
gatcttcagagcag

SEQ ID NO: 4113614 - DNA, 20 bp, Homo sapiens
gatcttcccataataaagca

SEQ ID NO: 4113615 - DNA, 13 bp, Homo sapiens
gatcttgaatgtg

SEQ ID NO: 4113616 - DNA, 23 bp, Homo sapiens
gatcttgaatgtggtctcaggat

SEQ ID NO: 4113617 - DNA, 19 bp, Homo sapiens
gatcttgccacatttctga

SEQ ID NO: 4113618 - DNA, 20 bp, Homo sapiens
gatcttgccacatttctgat

SEQ ID NO: 4113619 - DNA, 13 bp, Homo sapiens
gatcttgtgctca

SEQ ID NO: 4113620 - DNA, 17 bp, Homo sapiens
gatcttgtgctcagcat

SEQ ID NO: 4113621 - DNA, 18 bp, Homo sapiens
gatgaaaaatatttctga

SEQ ID NO: 4113622 - DNA, 16 bp, Homo sapiens
gatgaaactcacaaat

SEQ ID NO: 4113623 - DNA, 14 bp, Homo sapiens
gatgaaataatttt

SEQ ID NO: 4113624 - DNA, 18 bp, Homo sapiens
gatgaaatctgctagaaa

SEQ ID NO: 4113625 - DNA, 20 bp, Homo sapiens
gatgaaccagccggggcctt

SEQ ID NO: 4113626 - DNA, 22 bp, Homo sapiens
gatgaagcttggaggtcacagc

SEQ ID NO: 4113627 - DNA, 16 bp, Homo sapiens
gatgaagttttacatt

SEQ ID NO: 4113628 - DNA, 22 bp, Homo sapiens
gatgaagttttacattgttgag

SEQ ID NO: 4113629 - DNA, 23 bp, Homo sapiens
gatgaagttttacattgttgagc

SEQ ID NO: 4113630 - DNA, 16 bp, Homo sapiens
gatgaatgccgtggat

SEQ ID NO: 4113631 - DNA, 13 bp, Homo sapiens
gatgaatgtatgt

SEQ ID NO: 4113632 - DNA, 16 bp, Homo sapiens
gatgaattaaatttaa

SEQ ID NO: 4113633 - DNA, 17 bp, Homo sapiens
gatgacaacttcccagt

SEQ ID NO: 4113634 - DNA, 17 bp, Homo sapiens
gatgacaccctggcctg

SEQ ID NO: 4113635 - DNA, 13 bp, Homo sapiens
gatgacagggcag

SEQ ID NO: 4113636 - DNA, 17 bp, Homo sapiens
gatgacattccctgcta

SEQ ID NO: 4113637 - DNA, 18 bp, Homo sapiens
gatgaccagaacaaggtt

SEQ ID NO: 4113638 - DNA, 14 bp, Homo sapiens
gatgacccctgccc

SEQ ID NO: 4113639 - DNA, 15 bp, Homo sapiens
gatgacctggataac

SEQ ID NO: 4113640 - DNA, 20 bp, Homo sapiens
gatgactttctgttttctgt

SEQ ID NO: 4113641 - DNA, 21 bp, Homo sapiens
gatgagaatttctaaaaagat

SEQ ID NO: 4113642 - DNA, 23 bp, Homo sapiens
gatgagacttccaaacctgacag

SEQ ID NO: 4113643 - DNA, 15 bp, Homo sapiens
gatgagagcccagag

SEQ ID NO: 4113644 - DNA, 18 bp, Homo sapiens
gatgagagcccagaggta

SEQ ID NO: 4113645 - DNA, 15 bp, Homo sapiens
gatgagcaaggacat

SEQ ID NO: 4113646 - DNA, 13 bp, Homo sapiens
gatgagccgctgt

SEQ ID NO: 4113647 - DNA, 20 bp, Homo sapiens
gatgagtgattgacacacag

SEQ ID NO: 4113648 - DNA, 15 bp, Homo sapiens
gcaggctgggccatg

SEQ ID NO: 4113649 - DNA, 21 bp, Homo sapiens
gcagggaaggggaggcagccg

SEQ ID NO: 4113650 - DNA, 15 bp, Homo sapiens
gcagggaatttctat

SEQ ID NO: 4113651 - DNA, 18 bp, Homo sapiens
gcagggagggcagttttc

SEQ ID NO: 4113652 - DNA, 19 bp, Homo sapiens
gcagggattaacctctgca

SEQ ID NO: 4113653 - DNA, 12 bp, Homo sapiens
gcagggcagccc

SEQ ID NO: 4113654 - DNA, 13 bp, Homo sapiens
gcagggcagtcat

SEQ ID NO: 4113655 - DNA, 21 bp, Homo sapiens
gcagggcatctcctgtgcatg

SEQ ID NO: 4113656 - DNA, 22 bp, Homo sapiens
gcagggcatctcctgtgcatgg

SEQ ID NO: 4113657 - DNA, 20 bp, Homo sapiens
gcagggcccttggggctggg

SEQ ID NO: 4113658 - DNA, 20 bp, Homo sapiens
gcagggcgggcagagggctg

SEQ ID NO: 4113659 - DNA, 21 bp, Homo sapiens
gcagggcgggcagagggctgg

SEQ ID NO: 4113660 - DNA, 22 bp, Homo sapiens
gcagggcgggcagagggctgga

SEQ ID NO: 4113661 - DNA, 16 bp, Homo sapiens
gcagggctctcccgtg

SEQ ID NO: 4113662 - DNA, 18 bp, Homo sapiens
gcagggctgaagtctggc

SEQ ID NO: 4113663 - DNA, 23 bp, Homo sapiens
gcagggctgtgcttgaaggccct

SEQ ID NO: 4113664 - DNA, 19 bp, Homo sapiens
gcaggggagacaggagcct

SEQ ID NO: 4113665 - DNA, 23 bp, Homo sapiens
gcagggggccccgccagggctgg

SEQ ID NO: 4113666 - DNA, 15 bp, Homo sapiens
gcaggggttgcagtg

SEQ ID NO: 4113667 - DNA, 13 bp, Homo sapiens
gcagggtaccctt

SEQ ID NO: 4113668 - DNA, 17 bp, Homo sapiens
gcagggtgggcagccta

SEQ ID NO: 4113669 - DNA, 20 bp, Homo sapiens
gcaggtggatctatttcatg

SEQ ID NO: 4113670 - DNA, 12 bp, Homo sapiens
gcaggtgggcac

SEQ ID NO: 4113671 - DNA, 15 bp, Homo sapiens
gcaggtgggcactgg

SEQ ID NO: 4113672 - DNA, 17 bp, Homo sapiens
gcaggtgggctggactt

SEQ ID NO: 4113673 - DNA, 22 bp, Homo sapiens
gcaggtgggtgctgccctgtgt

SEQ ID NO: 4113674 - DNA, 15 bp, Homo sapiens
gcaggtggtcctgag

SEQ ID NO: 4113675 - DNA, 21 bp, Homo sapiens
gcaggtggtcctgagacctga

SEQ ID NO: 4113676 - DNA, 15 bp, Homo sapiens
gcaggtgtcctgagc

SEQ ID NO: 4113677 - DNA, 16 bp, Homo sapiens
gcaggtgtcctgagca

SEQ ID NO: 4113678 - DNA, 18 bp, Homo sapiens
gcaggtgtgagggcagtg

SEQ ID NO: 4113679 - DNA, 20 bp, Homo sapiens
gcaggtgtttggcacccaaa

SEQ ID NO: 4113680 - DNA, 13 bp, Homo sapiens
gcaggttcccaag

SEQ ID NO: 4113681 - DNA, 22 bp, Homo sapiens
gcaggttggaaggggccttgct

SEQ ID NO: 4113682 - DNA, 13 bp, Homo sapiens
gcaggttggatgg

SEQ ID NO: 4113683 - DNA, 22 bp, Homo sapiens
gcaggttggcaaacgggcttga

SEQ ID NO: 4113684 - DNA, 22 bp, Homo sapiens
gcagtaccctccattgggcaca

SEQ ID NO: 4113685 - DNA, 23 bp, Homo sapiens
gcagtaccctccattgggcacag

SEQ ID NO: 4113686 - DNA, 17 bp, Homo sapiens
gcagtagaactccaggc

SEQ ID NO: 4113687 - DNA, 18 bp, Homo sapiens
gcagtagagtcatctcca

SEQ ID NO: 4113688 - DNA, 15 bp, Homo sapiens
gcagtagatgtgctt

SEQ ID NO: 4113689 - DNA, 21 bp, Homo sapiens
gcagtatcatgccctgtgcaa

SEQ ID NO: 4113690 - DNA, 16 bp, Homo sapiens
gcagtattttgtgtcc

SEQ ID NO: 4113691 - DNA, 13 bp, Homo sapiens
gcagtcagagtcc

SEQ ID NO: 4113692 - DNA, 15 bp, Homo sapiens
gcagtcagagtccag

SEQ ID NO: 4113693 - DNA, 17 bp, Homo sapiens
gcagtcatctacttttt

SEQ ID NO: 4113694 - DNA, 18 bp, Homo sapiens
gcagtcctgcctcagcct

SEQ ID NO: 4113695 - DNA, 12 bp, Homo sapiens
gcagtcgcctgc

SEQ ID NO: 4113696 - DNA, 17 bp, Homo sapiens
gcagtcgcctgcctgca

SEQ ID NO: 4113697 - DNA, 17 bp, Homo sapiens
gcagtctgataaactga

SEQ ID NO: 4113698 - DNA, 17 bp, Homo sapiens
gcagtcttatgcttcca

SEQ ID NO: 4113699 - DNA, 12 bp, Homo sapiens
gcagtcttgctc

SEQ ID NO: 4113700 - DNA, 21 bp, Homo sapiens
gcagtgaattgtgaccaagtt

SEQ ID NO: 4113701 - DNA, 12 bp, Homo sapiens
gcagtgactttg

SEQ ID NO: 4113702 - DNA, 14 bp, Homo sapiens
gcagtgactttgta

SEQ ID NO: 4113703 - DNA, 14 bp, Homo sapiens
gcagtgagcggaga

SEQ ID NO: 4113704 - DNA, 18 bp, Homo sapiens
gcagtgagtctcttcaga

SEQ ID NO: 4113705 - DNA, 22 bp, Homo sapiens
gcagtgatatggcagaagacac

SEQ ID NO: 4113706 - DNA, 14 bp, Homo sapiens
gcagtgccccaggg

SEQ ID NO: 4113707 - DNA, 21 bp, Homo sapiens
gcagtgccccagggagtccag

SEQ ID NO: 4113708 - DNA, 14 bp, Homo sapiens
gcagtgcctcttgt

SEQ ID NO: 4113709 - DNA, 13 bp, Homo sapiens
gcagtgccttgca

SEQ ID NO: 4113710 - DNA, 20 bp, Homo sapiens
gcagtgctgggaccagagcc

SEQ ID NO: 4113711 - DNA, 22 bp, Homo sapiens
gcagtgctgggaccagagccag

SEQ ID NO: 4113712 - DNA, 16 bp, Homo sapiens
gcagtgcttctctaca

SEQ ID NO: 4113713 - DNA, 17 bp, Homo sapiens
gcagtggagcccaggag

SEQ ID NO: 4113714 - DNA, 18 bp, Homo sapiens
gcagtggctggtccaggg

SEQ ID NO: 4113715 - DNA, 14 bp, Homo sapiens
gcagtgtcttccat

SEQ ID NO: 4113716 - DNA, 16 bp, Homo sapiens
gcagtgtcttccataa

SEQ ID NO: 4113717 - DNA, 20 bp, Homo sapiens
gcagtgtgaatagcctggcc

SEQ ID NO: 4113718 - DNA, 22 bp, Homo sapiens
gcagtgtgaatagcctggccac

SEQ ID NO: 4113719 - DNA, 14 bp, Homo sapiens
gcagtgtgcccccc

SEQ ID NO: 4113720 - DNA, 22 bp, Homo sapiens
gcagtgtgccccccagccccgg

SEQ ID NO: 4113721 - DNA, 22 bp, Homo sapiens
gcagtgtggagaccctgccaca

SEQ ID NO: 4113722 - DNA, 21 bp, Homo sapiens
gcagtgttcctatttggggct

SEQ ID NO: 4113723 - DNA, 20 bp, Homo sapiens
gcagtgttctcacagtgtgg

SEQ ID NO: 4113724 - DNA, 15 bp, Homo sapiens
gcagttctcactcct

SEQ ID NO: 4113725 - DNA, 15 bp, Homo sapiens
gcagttgacagcagg

SEQ ID NO: 4113726 - DNA, 21 bp, Homo sapiens
gcagttgagaggacactcccg

SEQ ID NO: 4113727 - DNA, 23 bp, Homo sapiens
gcagttgcccagcctctttccct

SEQ ID NO: 4113728 - DNA, 17 bp, Homo sapiens
gcagttggactctcagg

SEQ ID NO: 4113729 - DNA, 13 bp, Homo sapiens
gcagtttcctgga

SEQ ID NO: 4113730 - DNA, 17 bp, Homo sapiens
gcagtttcttcatctca

SEQ ID NO: 4113731 - DNA, 21 bp, Homo sapiens
gcagtttgcctggtgcagtgg

SEQ ID NO: 4113732 - DNA, 16 bp, Homo sapiens
gcataaaaacatttta

SEQ ID NO: 4113733 - DNA, 20 bp, Homo sapiens
gcataaagaattaatgactt

SEQ ID NO: 4113734 - DNA, 14 bp, Homo sapiens
gcataaatcacttc

SEQ ID NO: 4113735 - DNA, 23 bp, Homo sapiens
gcataagtggttttcttcaggaa

SEQ ID NO: 4113736 - DNA, 14 bp, Homo sapiens
gcataataagctaa

SEQ ID NO: 4113737 - DNA, 15 bp, Homo sapiens
gcataatgataaaat

SEQ ID NO: 4113738 - DNA, 20 bp, Homo sapiens
gcataatgataaaataaata

SEQ ID NO: 4113739 - DNA, 16 bp, Homo sapiens
gcatacacacagcagt

SEQ ID NO: 4113740 - DNA, 18 bp, Homo sapiens
gcatacaggttaacctgc

SEQ ID NO: 4113741 - DNA, 23 bp, Homo sapiens
gcatacaggttaacctgcagaaa

SEQ ID NO: 4113742 - DNA, 17 bp, Homo sapiens
gcatacatttataatgt

SEQ ID NO: 4113743 - DNA, 20 bp, Homo sapiens
gcatacgagagcagaggtct

SEQ ID NO: 4113744 - DNA, 22 bp, Homo sapiens
gcatagaggcttctccgccagc

SEQ ID NO: 4113745 - DNA, 23 bp, Homo sapiens
gcatagatgttttggtagattaa

SEQ ID NO: 4113746 - DNA, 16 bp, Homo sapiens
gcatagcaagacacat

SEQ ID NO: 4113747 - DNA, 16 bp, Homo sapiens
gcatagcgaaataaaa

SEQ ID NO: 4113748 - DNA, 12 bp, Homo sapiens
gcataggcctgg

SEQ ID NO: 4113749 - DNA, 17 bp, Homo sapiens
gcataggcctgggtgct

SEQ ID NO: 4113750 - DNA, 23 bp, Homo sapiens
gcataggcctgggtgctggctgc

SEQ ID NO: 4113751 - DNA, 24 bp, Homo sapiens
gcataggctcttaagcagcatgga

SEQ ID NO: 4113752 - DNA, 17 bp, Homo sapiens
gcataggtaagctgtgc

SEQ ID NO: 4113753 - DNA, 20 bp, Homo sapiens
gcatagtaccaatcatttta

SEQ ID NO: 4113754 - DNA, 22 bp, Homo sapiens
gcatagtctacttgttataaat

SEQ ID NO: 4113755 - DNA, 18 bp, Homo sapiens
gcatatgttgaatacttt

SEQ ID NO: 4113756 - DNA, 22 bp, Homo sapiens
gcatattctattgtattatttg

SEQ ID NO: 4113757 - DNA, 23 bp, Homo sapiens
gcatatttatagcaatccatgtt

SEQ ID NO: 4113758 - DNA, 21 bp, Homo sapiens
gcatatttatccaaaatgtgt

SEQ ID NO: 4113759 - DNA, 23 bp, Homo sapiens
gcatatttatccaaaatgtgtat

SEQ ID NO: 4113760 - DNA, 18 bp, Homo sapiens
gcatattttgagaaactg

SEQ ID NO: 4113761 - DNA, 16 bp, Homo sapiens
gcatcacctcaccaag

SEQ ID NO: 4113762 - DNA, 15 bp, Homo sapiens
gcatcactaaaccga

SEQ ID NO: 4113763 - DNA, 18 bp, Homo sapiens
gcatcactgggtgttgat

SEQ ID NO: 4113764 - DNA, 15 bp, Homo sapiens
gcatcagtccccctg

SEQ ID NO: 4113765 - DNA, 14 bp, Homo sapiens
gcatcatggtggat

SEQ ID NO: 4113766 - DNA, 20 bp, Homo sapiens
gcatcattttgcattcaaat

SEQ ID NO: 4113767 - DNA, 21 bp, Homo sapiens
gcatccaccttggctctgcca

SEQ ID NO: 4113768 - DNA, 22 bp, Homo sapiens
gcatcccagcacctgcctcctc

SEQ ID NO: 4113769 - DNA, 15 bp, Homo sapiens
gcatcccagcctggg

SEQ ID NO: 4113770 - DNA, 16 bp, Homo sapiens
gcatccctggagcagg

SEQ ID NO: 4113771 - DNA, 21 bp, Homo sapiens
gcatccctggagcaggagccc

SEQ ID NO: 4113772 - DNA, 21 bp, Homo sapiens
gcatcctaagaaatatgtgag

SEQ ID NO: 4113773 - DNA, 16 bp, Homo sapiens
gcatcctgtgccacta

SEQ ID NO: 4113774 - DNA, 12 bp, Homo sapiens
gcatcgcaggag

SEQ ID NO: 4113775 - DNA, 14 bp, Homo sapiens
gcatctacacagcc

SEQ ID NO: 4113776 - DNA, 14 bp, Homo sapiens
gcatctatctcatc

SEQ ID NO: 4113777 - DNA, 13 bp, Homo sapiens
gcatctcagccca

SEQ ID NO: 4113778 - DNA, 14 bp, Homo sapiens
gcatctcagcccac

SEQ ID NO: 4113779 - DNA, 17 bp, Homo sapiens
gcatctcttccccagag

SEQ ID NO: 4113780 - DNA, 23 bp, Homo sapiens
gcatctcttccccagagaggcac

SEQ ID NO: 4113781 - DNA, 17 bp, Homo sapiens
gcatctcttgaggccag

SEQ ID NO: 4113782 - DNA, 20 bp, Homo sapiens
gcatctcttgaggccaggag

SEQ ID NO: 4113783 - DNA, 12 bp, Homo sapiens
gcatctgcccct

SEQ ID NO: 4113784 - DNA, 23 bp, Homo sapiens
gcatctggaagagctaggcaggg

SEQ ID NO: 4113785 - DNA, 16 bp, Homo sapiens
gcatctgggattccca

SEQ ID NO: 4113786 - DNA, 12 bp, Homo sapiens
gcatctggggcc

SEQ ID NO: 4113787 - DNA, 15 bp, Homo sapiens
gcatctttgccttgg

SEQ ID NO: 4113788 - DNA, 16 bp, Homo sapiens
gcatgacagcctgcag

SEQ ID NO: 4113789 - DNA, 13 bp, Homo sapiens
gcatgagactttc

SEQ ID NO: 4113790 - DNA, 21 bp, Homo sapiens
gcatgaggtgttgtgcatttg

SEQ ID NO: 4113791 - DNA, 16 bp, Homo sapiens
gcatgatgggaaaata

SEQ ID NO: 4113792 - DNA, 19 bp, Homo sapiens
gcatgatgggaaaatattt

SEQ ID NO: 4113793 - DNA, 14 bp, Homo sapiens
gcatgcattttgca

SEQ ID NO: 4113794 - DNA, 11 bp, Homo sapiens
gcatgccaccc

SEQ ID NO: 4113795 - DNA, 13 bp, Homo sapiens
gcatgccccttgg

SEQ ID NO: 4113796 - DNA, 15 bp, Homo sapiens
gcatgccccttggct

SEQ ID NO: 4113797 - DNA, 13 bp, Homo sapiens
gcatgccttgtgc

SEQ ID NO: 4113798 - DNA, 21 bp, Homo sapiens
gcatgcttcccagagggagca

SEQ ID NO: 4113799 - DNA, 16 bp, Homo sapiens
gcatggaggccctcct

SEQ ID NO: 4113800 - DNA, 24 bp, Homo sapiens
gcatggagtgtgtattgttcccag

SEQ ID NO: 4113801 - DNA, 18 bp, Homo sapiens
gcatggattttggataaa

SEQ ID NO: 4113802 - DNA, 13 bp, Homo sapiens
gcatggccctggg

SEQ ID NO: 4113803 - DNA, 16 bp, Homo sapiens
gcatggccctggggtc

SEQ ID NO: 4113804 - DNA, 15 bp, Homo sapiens
gcatggctcagagct

SEQ ID NO: 4113805 - DNA, 18 bp, Homo sapiens
gcatggctccagaaatgt

SEQ ID NO: 4113806 - DNA, 13 bp, Homo sapiens
gcatggctggggt

SEQ ID NO: 4113807 - DNA, 20 bp, Homo sapiens
gcatgggaaagccacctctc

SEQ ID NO: 4113808 - DNA, 16 bp, Homo sapiens
gcatgggtccagggcc

SEQ ID NO: 4113809 - DNA, 17 bp, Homo sapiens
gcatgggtccagggcct

SEQ ID NO: 4113810 - DNA, 15 bp, Homo sapiens
gcatggtccattctc

SEQ ID NO: 4113811 - DNA, 18 bp, Homo sapiens
gcatggtggctcatgcct

SEQ ID NO: 4113812 - DNA, 21 bp, Homo sapiens
gcatgtacggattttcagtta

SEQ ID NO: 4113813 - DNA, 22 bp, Homo sapiens
gcatgtagactgtgccagaggc

SEQ ID NO: 4113814 - DNA, 16 bp, Homo sapiens
gcatgtctgttcttct

SEQ ID NO: 4113815 - DNA, 17 bp, Homo sapiens
gcatgtggcttttttaa

SEQ ID NO: 4113816 - DNA, 21 bp, Homo sapiens
gcatgtgtatttccagtgcaa

SEQ ID NO: 4113817 - DNA, 13 bp, Homo sapiens
gcatgtgtcagag

SEQ ID NO: 4113818 - DNA, 15 bp, Homo sapiens
gcatgtgtcagagtg

SEQ ID NO: 4113819 - DNA, 18 bp, Homo sapiens
gcatgtgtcagagtgttg

SEQ ID NO: 4113820 - DNA, 14 bp, Homo sapiens
gcatgtgtgtgtgt

SEQ ID NO: 4113821 - DNA, 14 bp, Homo sapiens
gcatgtttgaaatg

SEQ ID NO: 4113822 - DNA, 15 bp, Homo sapiens
gcatgtttgaaatga

SEQ ID NO: 4113823 - DNA, 14 bp, Homo sapiens
gcattaactaatct

SEQ ID NO: 4113824 - DNA, 13 bp, Homo sapiens
gcattacatgtgt

SEQ ID NO: 4113825 - DNA, 16 bp, Homo sapiens
gcattagaaatagaca

SEQ ID NO: 4113826 - DNA, 21 bp, Homo sapiens
gcattagaaatagacagtata

SEQ ID NO: 4113827 - DNA, 15 bp, Homo sapiens
gcattataaaaagaa

SEQ ID NO: 4113828 - DNA, 16 bp, Homo sapiens
gcattattcatttagt

SEQ ID NO: 4113829 - DNA, 22 bp, Homo sapiens
gcattattctcttttatctgtt

SEQ ID NO: 4113830 - DNA, 14 bp, Homo sapiens
gcattattgcatta

SEQ ID NO: 4113831 - DNA, 16 bp, Homo sapiens
gcattcagagagcagc

SEQ ID NO: 4113832 - DNA, 18 bp, Homo sapiens
gcattcatttttatagca

SEQ ID NO: 4113833 - DNA, 12 bp, Homo sapiens
gcattccagaat

SEQ ID NO: 4113834 - DNA, 17 bp, Homo sapiens
gcattccagtcaggctc

SEQ ID NO: 4113835 - DNA, 22 bp, Homo sapiens
gcattccttctttgataatgtt

SEQ ID NO: 4113836 - DNA, 23 bp, Homo sapiens
gcattcgctgtaccctttaagat

SEQ ID NO: 4113837 - DNA, 14 bp, Homo sapiens
gcattcggagggag

SEQ ID NO: 4113838 - DNA, 16 bp, Homo sapiens
gcattcgggccacagg

SEQ ID NO: 4113839 - DNA, 13 bp, Homo sapiens
gcattctagtact

SEQ ID NO: 4113840 - DNA, 18 bp, Homo sapiens
gcattctatcgttattat

SEQ ID NO: 4113841 - DNA, 22 bp, Homo sapiens
gcattctatcgttattataaat

SEQ ID NO: 4113842 - DNA, 18 bp, Homo sapiens
gcattctattgccttctt

SEQ ID NO: 4113843 - DNA, 13 bp, Homo sapiens
gcattctcactcc

SEQ ID NO: 4113844 - DNA, 22 bp, Homo sapiens
gcattctggaggggagagcttt

SEQ ID NO: 4113845 - DNA, 22 bp, Homo sapiens
gcattcttgtcacaataaatgt

SEQ ID NO: 4113846 - DNA, 18 bp, Homo sapiens
gcattgaacacaaactgt

SEQ ID NO: 4113847 - DNA, 19 bp, Homo sapiens
gcattgaacacaaactgta

SEQ ID NO: 4113848 - DNA, 22 bp, Homo sapiens
gcattgaccgcgactaatttca

SEQ ID NO: 4113849 - DNA, 22 bp, Homo sapiens
gcattgactggtttacaggccc

SEQ ID NO: 4113850 - DNA, 15 bp, Homo sapiens
gcattgctagataaa

SEQ ID NO: 4113851 - DNA, 12 bp, Homo sapiens
gcattgctgtta

SEQ ID NO: 4113852 - DNA, 22 bp, Homo sapiens
gcattgtgattggcctgtagag

SEQ ID NO: 4113853 - DNA, 23 bp, Homo sapiens
gcattgtttgcttattgttccaa

SEQ ID NO: 4113854 - DNA, 13 bp, Homo sapiens
gccacctcagggc

SEQ ID NO: 4113855 - DNA, 20 bp, Homo sapiens
gccacctggcattccttctg

SEQ ID NO: 4113856 - DNA, 17 bp, Homo sapiens
gccacctgtagccatct

SEQ ID NO: 4113857 - DNA, 15 bp, Homo sapiens
gccacgattggagaa

SEQ ID NO: 4113858 - DNA, 20 bp, Homo sapiens
gccacgcactgggccacgga

SEQ ID NO: 4113859 - DNA, 15 bp, Homo sapiens
gccacgccccagccc

SEQ ID NO: 4113860 - DNA, 16 bp, Homo sapiens
gccacgccccagcccg

SEQ ID NO: 4113861 - DNA, 18 bp, Homo sapiens
gccacgccccagcccgac

SEQ ID NO: 4113862 - DNA, 14 bp, Homo sapiens
gccacgctccagct

SEQ ID NO: 4113863 - DNA, 15 bp, Homo sapiens
gccacgctccagctg

SEQ ID NO: 4113864 - DNA, 22 bp, Homo sapiens
gccacgctgtcctctcgagccc

SEQ ID NO: 4113865 - DNA, 14 bp, Homo sapiens
gccacgctttgctg

SEQ ID NO: 4113866 - DNA, 18 bp, Homo sapiens
gccacgtcccagcatccc

SEQ ID NO: 4113867 - DNA, 21 bp, Homo sapiens
gccacgtcccagcatccctgg

SEQ ID NO: 4113868 - DNA, 17 bp, Homo sapiens
gccacgtggtcactgtg

SEQ ID NO: 4113869 - DNA, 18 bp, Homo sapiens
gccacgtggtcactgtgc

SEQ ID NO: 4113870 - DNA, 21 bp, Homo sapiens
gccactcaggaggctgaggca

SEQ ID NO: 4113871 - DNA, 17 bp, Homo sapiens
gccactccacaaatgat

SEQ ID NO: 4113872 - DNA, 16 bp, Homo sapiens
gccactccagacccct

SEQ ID NO: 4113873 - DNA, 19 bp, Homo sapiens
gccactccagacccctggc

SEQ ID NO: 4113874 - DNA, 22 bp, Homo sapiens
gccactccagacccctggcttt

SEQ ID NO: 4113875 - DNA, 14 bp, Homo sapiens
gccactctccccat

SEQ ID NO: 4113876 - DNA, 15 bp, Homo sapiens
gccactgcactccgg

SEQ ID NO: 4113877 - DNA, 19 bp, Homo sapiens
gccactgcccgagctggtg

SEQ ID NO: 4113878 - DNA, 13 bp, Homo sapiens
gccactgcctgca

SEQ ID NO: 4113879 - DNA, 18 bp, Homo sapiens
gccactggggactttatt

SEQ ID NO: 4113880 - DNA, 23 bp, Homo sapiens
gccactggggactttatttattt

SEQ ID NO: 4113881 - DNA, 19 bp, Homo sapiens
gccactgtactccagcctg

SEQ ID NO: 4113882 - DNA, 18 bp, Homo sapiens
gccacttccttttaactg

SEQ ID NO: 4113883 - DNA, 13 bp, Homo sapiens
gccactttccaag

SEQ ID NO: 4113884 - DNA, 18 bp, Homo sapiens
gccactttccaagtcact

SEQ ID NO: 4113885 - DNA, 23 bp, Homo sapiens
gccacttttgactagggattcag

SEQ ID NO: 4113886 - DNA, 22 bp, Homo sapiens
gccagaaacagtgggagccctg

SEQ ID NO: 4113887 - DNA, 16 bp, Homo sapiens
gccagaactctgtgtc

SEQ ID NO: 4113888 - DNA, 17 bp, Homo sapiens
gccagaagatcccctca

SEQ ID NO: 4113889 - DNA, 22 bp, Homo sapiens
gccagacccacgggctcatgca

SEQ ID NO: 4113890 - DNA, 12 bp, Homo sapiens
gccagagctggg

SEQ ID NO: 4113891 - DNA, 14 bp, Homo sapiens
gccagagctgggtg

SEQ ID NO: 4113892 - DNA, 16 bp, Homo sapiens
gccagagctgggtggg

SEQ ID NO: 4113893 - DNA, 22 bp, Homo sapiens
gccagagctgggtggggacagt

SEQ ID NO: 4113894 - DNA, 18 bp, Homo sapiens
gccagaggaactgtccag

SEQ ID NO: 4113895 - DNA, 20 bp, Homo sapiens
gccagaggaactgtccagag

SEQ ID NO: 4113896 - DNA, 22 bp, Homo sapiens
gccagaggaactgtccagagag

SEQ ID NO: 4113897 - DNA, 23 bp, Homo sapiens
gccagaggaactgtccagagagc

SEQ ID NO: 4113898 - DNA, 20 bp, Homo sapiens
gccagaggctgggagtccct

SEQ ID NO: 4113899 - DNA, 13 bp, Homo sapiens
gccagagggagct

SEQ ID NO: 4113900 - DNA, 13 bp, Homo sapiens
gccagaggtgctt

SEQ ID NO: 4113901 - DNA, 19 bp, Homo sapiens
gccagagtcaccttttctg

SEQ ID NO: 4113902 - DNA, 13 bp, Homo sapiens
gccagagtggcct

SEQ ID NO: 4113903 - DNA, 11 bp, Homo sapiens
gccagatccag

SEQ ID NO: 4113904 - DNA, 17 bp, Homo sapiens
gccagatccagcctggg

SEQ ID NO: 4113905 - DNA, 17 bp, Homo sapiens
gccagatgcaggacagg

SEQ ID NO: 4113906 - DNA, 21 bp, Homo sapiens
gccagatgcaggacaggaggc

SEQ ID NO: 4113907 - DNA, 17 bp, Homo sapiens
gccagattctgcctctc

SEQ ID NO: 4113908 - DNA, 19 bp, Homo sapiens
gccagattctgcctctctg

SEQ ID NO: 4113909 - DNA, 15 bp, Homo sapiens
gccagcaacattggc

SEQ ID NO: 4113910 - DNA, 19 bp, Homo sapiens
gccagcaacattggcacat

SEQ ID NO: 4113911 - DNA, 22 bp, Homo sapiens
gccagcaacgcttgtagaactc

SEQ ID NO: 4113912 - DNA, 19 bp, Homo sapiens
gccagcaagagttaggggc

SEQ ID NO: 4113913 - DNA, 20 bp, Homo sapiens
gccagcaatgacatctcagg

SEQ ID NO: 4113914 - DNA, 23 bp, Homo sapiens
gccagcaatgacatctcaggggc

SEQ ID NO: 4113915 - DNA, 21 bp, Homo sapiens
gccagcaatgatgtccagaag

SEQ ID NO: 4113916 - DNA, 22 bp, Homo sapiens
gccagcaatgatgtccagaaga

SEQ ID NO: 4113917 - DNA, 16 bp, Homo sapiens
gccagcacacagggca

SEQ ID NO: 4113918 - DNA, 17 bp, Homo sapiens
gccagcacacagggcag

SEQ ID NO: 4113919 - DNA, 14 bp, Homo sapiens
gccagcaccctctc

SEQ ID NO: 4113920 - DNA, 18 bp, Homo sapiens
gccagcaccctctcctgg

SEQ ID NO: 4113921 - DNA, 21 bp, Homo sapiens
gccagccagtgccattccact

SEQ ID NO: 4113922 - DNA, 13 bp, Homo sapiens
gccagcccagcca

SEQ ID NO: 4113923 - DNA, 17 bp, Homo sapiens
gccagccccacacagct

SEQ ID NO: 4113924 - DNA, 18 bp, Homo sapiens
gccagccccacacagcta

SEQ ID NO: 4113925 - DNA, 22 bp, Homo sapiens
gccagccccacacagctacagc

SEQ ID NO: 4113926 - DNA, 15 bp, Homo sapiens
gccagccccacccag

SEQ ID NO: 4113927 - DNA, 17 bp, Homo sapiens
gccagccccacccagga

SEQ ID NO: 4113928 - DNA, 18 bp, Homo sapiens
gccagccccggccctggg

SEQ ID NO: 4113929 - DNA, 19 bp, Homo sapiens
gccagcccctggccccagg

SEQ ID NO: 4113930 - DNA, 16 bp, Homo sapiens
gccagcccctggggcc

SEQ ID NO: 4113931 - DNA, 17 bp, Homo sapiens
gccagcccctggggccc

SEQ ID NO: 4113932 - DNA, 15 bp, Homo sapiens
gccagccgccctggg

SEQ ID NO: 4113933 - DNA, 18 bp, Homo sapiens
gccagcctccgagaggga

SEQ ID NO: 4113934 - DNA, 20 bp, Homo sapiens
gccagcctccgagagggaga

SEQ ID NO: 4113935 - DNA, 14 bp, Homo sapiens
gccagcctcctctg

SEQ ID NO: 4113936 - DNA, 18 bp, Homo sapiens
gccagccttgagccctgg

SEQ ID NO: 4113937 - DNA, 19 bp, Homo sapiens
gccagccttgagccctggc

SEQ ID NO: 4113938 - DNA, 23 bp, Homo sapiens
gccagcgggcacagggcaccaga

SEQ ID NO: 4113939 - DNA, 17 bp, Homo sapiens
gccagcggggctgctca

SEQ ID NO: 4113940 - DNA, 19 bp, Homo sapiens
gccagctcacagtgctgtg

SEQ ID NO: 4113941 - DNA, 22 bp, Homo sapiens
gccagctgccctatgggcctgc

SEQ ID NO: 4113942 - DNA, 14 bp, Homo sapiens
gccagctgtgcact

SEQ ID NO: 4113943 - DNA, 20 bp, Homo sapiens
gccagcttctctctccaggg

SEQ ID NO: 4113944 - DNA, 18 bp, Homo sapiens
gccagcttgttatttata

SEQ ID NO: 4113945 - DNA, 17 bp, Homo sapiens
gccagcttttcctccct

SEQ ID NO: 4113946 - DNA, 15 bp, Homo sapiens
gccaggaacctgtcc

SEQ ID NO: 4113947 - DNA, 22 bp, Homo sapiens
gccaggaacctgtcctaaggaa

SEQ ID NO: 4113948 - DNA, 13 bp, Homo sapiens
gccaggaagccag

SEQ ID NO: 4113949 - DNA, 15 bp, Homo sapiens
gccaggaagccagag

SEQ ID NO: 4113950 - DNA, 16 bp, Homo sapiens
gccaggaagccagagc

SEQ ID NO: 4113951 - DNA, 17 bp, Homo sapiens
gccaggaagccagagcc

SEQ ID NO: 4113952 - DNA, 18 bp, Homo sapiens
gccaggaatttcccagga

SEQ ID NO: 4113953 - DNA, 19 bp, Homo sapiens
gccaggaatttcccaggac

SEQ ID NO: 4113954 - DNA, 20 bp, Homo sapiens
gccaggaatttcccaggacc

SEQ ID NO: 4113955 - DNA, 21 bp, Homo sapiens
gccaggactccccaggccagg

SEQ ID NO: 4113956 - DNA, 23 bp, Homo sapiens
gccaggagcaatgggactggagt

SEQ ID NO: 4113957 - DNA, 18 bp, Homo sapiens
gcatttaatggcagctag

SEQ ID NO: 4113958 - DNA, 22 bp, Homo sapiens
gcatttagaactttctgctttg

SEQ ID NO: 4113959 - DNA, 21 bp, Homo sapiens
gcatttatttatacagtgcct

SEQ ID NO: 4113960 - DNA, 22 bp, Homo sapiens
gcatttatttatacagtgcctt

SEQ ID NO: 4113961 - DNA, 22 bp, Homo sapiens
gcatttcaagcagctgaagaaa

SEQ ID NO: 4113962 - DNA, 17 bp, Homo sapiens
gcatttccttccagccc

SEQ ID NO: 4113963 - DNA, 19 bp, Homo sapiens
gcatttccttccagcccat

SEQ ID NO: 4113964 - DNA, 18 bp, Homo sapiens
gcattttcaccccaccct

SEQ ID NO: 4113965 - DNA, 17 bp, Homo sapiens
gcattttcctcctctgc

SEQ ID NO: 4113966 - DNA, 17 bp, Homo sapiens
gcattttgctattgtaa

SEQ ID NO: 4113967 - DNA, 22 bp, Homo sapiens
gcattttggagagtttcctgaa

SEQ ID NO: 4113968 - DNA, 21 bp, Homo sapiens
gcatttttaattttcacaaaa

SEQ ID NO: 4113969 - DNA, 20 bp, Homo sapiens
gcatttttcaatatattgaa

SEQ ID NO: 4113970 - DNA, 21 bp, Homo sapiens
gcatttttcaatatattgaac

SEQ ID NO: 4113971 - DNA, 21 bp, Homo sapiens
gccaaaagctagacagatccc

SEQ ID NO: 4113972 - DNA, 20 bp, Homo sapiens
gccaaaagcttccctccctg

SEQ ID NO: 4113973 - DNA, 22 bp, Homo sapiens
gccaaaagcttccctccctgct

SEQ ID NO: 4113974 - DNA, 15 bp, Homo sapiens
gccaaaagtccctcc

SEQ ID NO: 4113975 - DNA, 19 bp, Homo sapiens
gccaaaagtccctccctgc

SEQ ID NO: 4113976 - DNA, 23 bp, Homo sapiens
gccaaaagtccctccctgcctga

SEQ ID NO: 4113977 - DNA, 20 bp, Homo sapiens
gccaaacccttgctttcctg

SEQ ID NO: 4113978 - DNA, 15 bp, Homo sapiens
gccaaactgtccctc

SEQ ID NO: 4113979 - DNA, 19 bp, Homo sapiens
gccaaactgtccctccctt

SEQ ID NO: 4113980 - DNA, 16 bp, Homo sapiens
gccaaaggatgtgata

SEQ ID NO: 4113981 - DNA, 14 bp, Homo sapiens
gccaaatagcaaag

SEQ ID NO: 4113982 - DNA, 15 bp, Homo sapiens
gccaaatatgtcctg

SEQ ID NO: 4113983 - DNA, 17 bp, Homo sapiens
gccaaatatgtcctggg

SEQ ID NO: 4113984 - DNA, 17 bp, Homo sapiens
gccaaatgctggggcag

SEQ ID NO: 4113985 - DNA, 16 bp, Homo sapiens
gccaaatgtaattgaa

SEQ ID NO: 4113986 - DNA, 19 bp, Homo sapiens
gccaacagaagcttccatt

SEQ ID NO: 4113987 - DNA, 23 bp, Homo sapiens
gccaacaggtggcaggaccagga

SEQ ID NO: 4113988 - DNA, 18 bp, Homo sapiens
gccaacggccccagcttc

SEQ ID NO: 4113989 - DNA, 21 bp, Homo sapiens
gccaacttgagggcccagagc

SEQ ID NO: 4113990 - DNA, 15 bp, Homo sapiens
gccaacttgtaaata

SEQ ID NO: 4113991 - DNA, 18 bp, Homo sapiens
gccaagaaaatgaaggga

SEQ ID NO: 4113992 - DNA, 13 bp, Homo sapiens
gccaagaatactt

SEQ ID NO: 4113993 - DNA, 12 bp, Homo sapiens
gccaagagaagg

SEQ ID NO: 4113994 - DNA, 14 bp, Homo sapiens
gccaagagaagggc

SEQ ID NO: 4113995 - DNA, 22 bp, Homo sapiens
gccaagaggtttggctcctgcc

SEQ ID NO: 4113996 - DNA, 21 bp, Homo sapiens
gccaagccctccccatcccat

SEQ ID NO: 4113997 - DNA, 14 bp, Homo sapiens
gccaaggccttctc

SEQ ID NO: 4113998 - DNA, 15 bp, Homo sapiens
gccaaggccttctcc

SEQ ID NO: 4113999 - DNA, 22 bp, Homo sapiens
gccaagggaaaggggtgctttt

SEQ ID NO: 4114000 - DNA, 13 bp, Homo sapiens
gccaagtggggtg

SEQ ID NO: 4114001 - DNA, 23 bp, Homo sapiens
gccaagtggggtgctgggaggag

SEQ ID NO: 4114002 - DNA, 19 bp, Homo sapiens
gccaagtgtgaccccactg

SEQ ID NO: 4114003 - DNA, 22 bp, Homo sapiens
gccaagtgtgaccccactgcca

SEQ ID NO: 4114004 - DNA, 11 bp, Homo sapiens
gccaataaaaa

SEQ ID NO: 4114005 - DNA, 18 bp, Homo sapiens
gccaatattaaatctgct

SEQ ID NO: 4114006 - DNA, 21 bp, Homo sapiens
gccaatctggcccttacacac

SEQ ID NO: 4114007 - DNA, 23 bp, Homo sapiens
gccaatcttgttttaagcaaatg

SEQ ID NO: 4114008 - DNA, 19 bp, Homo sapiens
gccaatgaggtctgaaatg

SEQ ID NO: 4114009 - DNA, 19 bp, Homo sapiens
gccaattattgttacacat

SEQ ID NO: 4114010 - DNA, 15 bp, Homo sapiens
gccaattcagacagg

SEQ ID NO: 4114011 - DNA, 17 bp, Homo sapiens
gccaattcagacaggca

SEQ ID NO: 4114012 - DNA, 17 bp, Homo sapiens
gccacaaggacttcctg

SEQ ID NO: 4114013 - DNA, 21 bp, Homo sapiens
gccacaaggacttcctgtcca

SEQ ID NO: 4114014 - DNA, 17 bp, Homo sapiens
gccacaaggctggccag

SEQ ID NO: 4114015 - DNA, 21 bp, Homo sapiens
gccacaatgcagttctgagca

SEQ ID NO: 4114016 - DNA, 13 bp, Homo sapiens
gccacaccctccc

SEQ ID NO: 4114017 - DNA, 21 bp, Homo sapiens
gccacactattaccatgagaa

SEQ ID NO: 4114018 - DNA, 17 bp, Homo sapiens
gccacactcagcacaag

SEQ ID NO: 4114019 - DNA, 22 bp, Homo sapiens
gccacacttcaggctcttctcc

SEQ ID NO: 4114020 - DNA, 17 bp, Homo sapiens
gccacagaccacctgct

SEQ ID NO: 4114021 - DNA, 14 bp, Homo sapiens
gccacagccagagg

SEQ ID NO: 4114022 - DNA, 16 bp, Homo sapiens
gccacagccagaggag

SEQ ID NO: 4114023 - DNA, 17 bp, Homo sapiens
gccacagctgctgttct

SEQ ID NO: 4114024 - DNA, 18 bp, Homo sapiens
gccacagctgctgttctc

SEQ ID NO: 4114025 - DNA, 20 bp, Homo sapiens
gccacagctgctgttctcag

SEQ ID NO: 4114026 - DNA, 12 bp, Homo sapiens
gccacagctttt

SEQ ID NO: 4114027 - DNA, 15 bp, Homo sapiens
gccacagcttttgca

SEQ ID NO: 4114028 - DNA, 15 bp, Homo sapiens
gccacagtagaactg

SEQ ID NO: 4114029 - DNA, 18 bp, Homo sapiens
gccacagtagtcttgatg

SEQ ID NO: 4114030 - DNA, 15 bp, Homo sapiens
gccacatcaaagagg

SEQ ID NO: 4114031 - DNA, 14 bp, Homo sapiens
gccacatccccaag

SEQ ID NO: 4114032 - DNA, 17 bp, Homo sapiens
gccacatccccaagccc

SEQ ID NO: 4114033 - DNA, 20 bp, Homo sapiens
gccacatggccccatcccag

SEQ ID NO: 4114034 - DNA, 16 bp, Homo sapiens
gccacatttagtcctg

SEQ ID NO: 4114035 - DNA, 19 bp, Homo sapiens
gccacatttggaatacttt

SEQ ID NO: 4114036 - DNA, 20 bp, Homo sapiens
gccaccaaaagtgctcccca

SEQ ID NO: 4114037 - DNA, 18 bp, Homo sapiens
gccaccacctctgtggca

SEQ ID NO: 4114038 - DNA, 16 bp, Homo sapiens
gccaccacgtccagct

SEQ ID NO: 4114039 - DNA, 12 bp, Homo sapiens
gccaccaggatg

SEQ ID NO: 4114040 - DNA, 14 bp, Homo sapiens
gccaccagtgtcct

SEQ ID NO: 4114041 - DNA, 17 bp, Homo sapiens
gccaccagtgtcctcca

SEQ ID NO: 4114042 - DNA, 17 bp, Homo sapiens
gccaccatggccagcca

SEQ ID NO: 4114043 - DNA, 12 bp, Homo sapiens
gccacccactca

SEQ ID NO: 4114044 - DNA, 15 bp, Homo sapiens
gccaccccaccctcc

SEQ ID NO: 4114045 - DNA, 18 bp, Homo sapiens
gccaccccaccctccctg

SEQ ID NO: 4114046 - DNA, 20 bp, Homo sapiens
gccaccccaccctccctgga

SEQ ID NO: 4114047 - DNA, 22 bp, Homo sapiens
gccaccccaccctccctggagt

SEQ ID NO: 4114048 - DNA, 22 bp, Homo sapiens
gccacccgccccgcgcacccca

SEQ ID NO: 4114049 - DNA, 18 bp, Homo sapiens
gccacccgttctgctggc

SEQ ID NO: 4114050 - DNA, 23 bp, Homo sapiens
gccacccgttctgctggcctgga

SEQ ID NO: 4114051 - DNA, 15 bp, Homo sapiens
gccaccctcacacac

SEQ ID NO: 4114052 - DNA, 17 bp, Homo sapiens
gccaccgcgcctggccg

SEQ ID NO: 4114053 - DNA, 17 bp, Homo sapiens
gccaccgggacagacct

SEQ ID NO: 4114054 - DNA, 19 bp, Homo sapiens
gccaccgggacagacctgg

SEQ ID NO: 4114055 - DNA, 17 bp, Homo sapiens
gccaccgtgcctggcca

SEQ ID NO: 4114056 - DNA, 19 bp, Homo sapiens
gccaccgtgcctggccaga

SEQ ID NO: 4114057 - DNA, 16 bp, Homo sapiens
gccaccgtgcctggct

SEQ ID NO: 4114058 - DNA, 22 bp, Homo sapiens
gccacctatctcgtgggagagc

SEQ ID NO: 4114059 - DNA, 15 bp, Homo sapiens
gccatgctgaaggga

SEQ ID NO: 4114060 - DNA, 16 bp, Homo sapiens
gccatgctgggaagac

SEQ ID NO: 4114061 - DNA, 12 bp, Homo sapiens
gccatggctggg

SEQ ID NO: 4114062 - DNA, 22 bp, Homo sapiens
gccatgtaaatccccactggga

SEQ ID NO: 4114063 - DNA, 15 bp, Homo sapiens
gccatgtactagttt

SEQ ID NO: 4114064 - DNA, 19 bp, Homo sapiens
gccatgtccaaagaggctg

SEQ ID NO: 4114065 - DNA, 15 bp, Homo sapiens
gccatgtgaagaggg

SEQ ID NO: 4114066 - DNA, 14 bp, Homo sapiens
gccatgtgagccac

SEQ ID NO: 4114067 - DNA, 14 bp, Homo sapiens
gccattccactcca

SEQ ID NO: 4114068 - DNA, 17 bp, Homo sapiens
gccattctccacagcaa

SEQ ID NO: 4114069 - DNA, 20 bp, Homo sapiens
gccattctcctgcctcagcc

SEQ ID NO: 4114070 - DNA, 17 bp, Homo sapiens
gccattgccaccaggag

SEQ ID NO: 4114071 - DNA, 20 bp, Homo sapiens
gccatttccaagaggctgta

SEQ ID NO: 4114072 - DNA, 13 bp, Homo sapiens
gccattttgtgaa

SEQ ID NO: 4114073 - DNA, 14 bp, Homo sapiens
gccattttgtgaat

SEQ ID NO: 4114074 - DNA, 17 bp, Homo sapiens
gcccaaaacccagggca

SEQ ID NO: 4114075 - DNA, 22 bp, Homo sapiens
gcccaaagctgcaggtgccagg

SEQ ID NO: 4114076 - DNA, 13 bp, Homo sapiens
gcccaacctcctg

SEQ ID NO: 4114077 - DNA, 19 bp, Homo sapiens
gcccaagacagatgcccca

SEQ ID NO: 4114078 - DNA, 20 bp, Homo sapiens
gcccaagagcagagtctggg

SEQ ID NO: 4114079 - DNA, 15 bp, Homo sapiens
gcccaaggtcccctc

SEQ ID NO: 4114080 - DNA, 20 bp, Homo sapiens
gcccaattggaggaaagcaa

SEQ ID NO: 4114081 - DNA, 14 bp, Homo sapiens
gcccacatcccagg

SEQ ID NO: 4114082 - DNA, 15 bp, Homo sapiens
gcccacatcccaggc

SEQ ID NO: 4114083 - DNA, 18 bp, Homo sapiens
gcccaccaccccctcaag

SEQ ID NO: 4114084 - DNA, 17 bp, Homo sapiens
gcccaccattcccggcc

SEQ ID NO: 4114085 - DNA, 15 bp, Homo sapiens
gcccaccccagcctc

SEQ ID NO: 4114086 - DNA, 16 bp, Homo sapiens
gcccaccccagcctcg

SEQ ID NO: 4114087 - DNA, 21 bp, Homo sapiens
gcccaccccagcctcgcctgt

SEQ ID NO: 4114088 - DNA, 15 bp, Homo sapiens
gcccaccccctgccc

SEQ ID NO: 4114089 - DNA, 18 bp, Homo sapiens
gcccaccccctgccctgc

SEQ ID NO: 4114090 - DNA, 21 bp, Homo sapiens
gcccacccctcactccccagg

SEQ ID NO: 4114091 - DNA, 10 bp, Homo sapiens
gcccaccctg

SEQ ID NO: 4114092 - DNA, 23 bp, Homo sapiens
gcccaccctgctcctcctgccct

SEQ ID NO: 4114093 - DNA, 16 bp, Homo sapiens
gcccactcctgctctg

SEQ ID NO: 4114094 - DNA, 18 bp, Homo sapiens
gcccactcctgctctgct

SEQ ID NO: 4114095 - DNA, 13 bp, Homo sapiens
gcccactgctggt

SEQ ID NO: 4114096 - DNA, 17 bp, Homo sapiens
gcccagaactgccccca

SEQ ID NO: 4114097 - DNA, 15 bp, Homo sapiens
gcccagaacttccct

SEQ ID NO: 4114098 - DNA, 19 bp, Homo sapiens
gcccagacccctctggcca

SEQ ID NO: 4114099 - DNA, 20 bp, Homo sapiens
gcccagacccctctggccag

SEQ ID NO: 4114100 - DNA, 21 bp, Homo sapiens
gcccagacccctctggccagg

SEQ ID NO: 4114101 - DNA, 17 bp, Homo sapiens
gcccagaccctggagga

SEQ ID NO: 4114102 - DNA, 11 bp, Homo sapiens
gcccagactct

SEQ ID NO: 4114103 - DNA, 13 bp, Homo sapiens
gcccagactctga

SEQ ID NO: 4114104 - DNA, 15 bp, Homo sapiens
gcccagactctgagc

SEQ ID NO: 4114105 - DNA, 13 bp, Homo sapiens
gcccagagaacag

SEQ ID NO: 4114106 - DNA, 23 bp, Homo sapiens
gcccagagacatacttgaagggc

SEQ ID NO: 4114107 - DNA, 17 bp, Homo sapiens
gcccagagccacctgga

SEQ ID NO: 4114108 - DNA, 13 bp, Homo sapiens
gcccagagcccag

SEQ ID NO: 4114109 - DNA, 18 bp, Homo sapiens
gcccagaggtaacagaac

SEQ ID NO: 4114110 - DNA, 18 bp, Homo sapiens
gcccagatcagccagaag

SEQ ID NO: 4114111 - DNA, 19 bp, Homo sapiens
gcccagattcccctgtgtc

SEQ ID NO: 4114112 - DNA, 13 bp, Homo sapiens
gcccagcactgtg

SEQ ID NO: 4114113 - DNA, 23 bp, Homo sapiens
gcccagcaggagagactgagcag

SEQ ID NO: 4114114 - DNA, 20 bp, Homo sapiens
gcccagccaaaccctgtctg

SEQ ID NO: 4114115 - DNA, 12 bp, Homo sapiens
gcccagcccaga

SEQ ID NO: 4114116 - DNA, 16 bp, Homo sapiens
gcccagccccatccct

SEQ ID NO: 4114117 - DNA, 19 bp, Homo sapiens
gcccagcccctactgctgt

SEQ ID NO: 4114118 - DNA, 18 bp, Homo sapiens
gcccagcccggaccttgg

SEQ ID NO: 4114119 - DNA, 14 bp, Homo sapiens
gcccagcctgggag

SEQ ID NO: 4114120 - DNA, 20 bp, Homo sapiens
gcccagcctgggagcccaga

SEQ ID NO: 4114121 - DNA, 14 bp, Homo sapiens
gcccagcgccaagt

SEQ ID NO: 4114122 - DNA, 14 bp, Homo sapiens
gcccagcgcggcca

SEQ ID NO: 4114123 - DNA, 15 bp, Homo sapiens
gcccagcgcggccag

SEQ ID NO: 4114124 - DNA, 16 bp, Homo sapiens
gcccagcgcggccagc

SEQ ID NO: 4114125 - DNA, 15 bp, Homo sapiens
gcccagctccaaggg

SEQ ID NO: 4114126 - DNA, 13 bp, Homo sapiens
gcccagctgcctg

SEQ ID NO: 4114127 - DNA, 15 bp, Homo sapiens
gcccagctgcctgga

SEQ ID NO: 4114128 - DNA, 18 bp, Homo sapiens
gcccagctgggtcaggca

SEQ ID NO: 4114129 - DNA, 21 bp, Homo sapiens
gcccaggagaccacggggagc

SEQ ID NO: 4114130 - DNA, 13 bp, Homo sapiens
gcccaggagggag

SEQ ID NO: 4114131 - DNA, 20 bp, Homo sapiens
gcccaggagggcatccatac

SEQ ID NO: 4114132 - DNA, 22 bp, Homo sapiens
gcccaggagggcatccatacca

SEQ ID NO: 4114133 - DNA, 21 bp, Homo sapiens
gcccaggccggggtggagcat

SEQ ID NO: 4114134 - DNA, 18 bp, Homo sapiens
gcccaggcctcaccacct

SEQ ID NO: 4114135 - DNA, 19 bp, Homo sapiens
gcccaggctggagtgcagt

SEQ ID NO: 4114136 - DNA, 15 bp, Homo sapiens
gcccagggagggaag

SEQ ID NO: 4114137 - DNA, 17 bp, Homo sapiens
gcccagggagggaagtg

SEQ ID NO: 4114138 - DNA, 23 bp, Homo sapiens
gcccagggcatcttgctggctac

SEQ ID NO: 4114139 - DNA, 19 bp, Homo sapiens
gcccagggcccagagccca

SEQ ID NO: 4114140 - DNA, 21 bp, Homo sapiens
gcccagggtgaggtggcatgg

SEQ ID NO: 4114141 - DNA, 21 bp, Homo sapiens
gcccaggtaccacccttcaga

SEQ ID NO: 4114142 - DNA, 15 bp, Homo sapiens
gcccaggtcctctga

SEQ ID NO: 4114143 - DNA, 14 bp, Homo sapiens
gcccagtctgttga

SEQ ID NO: 4114144 - DNA, 15 bp, Homo sapiens
gcccagtctgttgag

SEQ ID NO: 4114145 - DNA, 14 bp, Homo sapiens
gcccagtgaagcct

SEQ ID NO: 4114146 - DNA, 18 bp, Homo sapiens
gcccagtgttgtttgtaa

SEQ ID NO: 4114147 - DNA, 19 bp, Homo sapiens
gcccagtgttgtttgtaaa

SEQ ID NO: 4114148 - DNA, 14 bp, Homo sapiens
gcccatactcagcc

SEQ ID NO: 4114149 - DNA, 15 bp, Homo sapiens
gcccatactcagcct

SEQ ID NO: 4114150 - DNA, 17 bp, Homo sapiens
gcccatactcagcctgc

SEQ ID NO: 4114151 - DNA, 19 bp, Homo sapiens
gcccatactcagcctgctg

SEQ ID NO: 4114152 - DNA, 20 bp, Homo sapiens
gcccatactcagcctgctgc

SEQ ID NO: 4114153 - DNA, 19 bp, Homo sapiens
gcccatacttttggctcct

SEQ ID NO: 4114154 - DNA, 23 bp, Homo sapiens
gcccatacttttggctcctctag

SEQ ID NO: 4114155 - DNA, 13 bp, Homo sapiens
gcccatcacaggg

SEQ ID NO: 4114156 - DNA, 22 bp, Homo sapiens
gcccatcacagggttgggccca

SEQ ID NO: 4114157 - DNA, 20 bp, Homo sapiens
gcccatccattaggccagca

SEQ ID NO: 4114158 - DNA, 17 bp, Homo sapiens
gcccatctcagcctcct

SEQ ID NO: 4114159 - DNA, 13 bp, Homo sapiens
gcccatgaatttg

SEQ ID NO: 4114160 - DNA, 20 bp, Homo sapiens
gcccatgctcaaccactgtg

SEQ ID NO: 4114161 - DNA, 22 bp, Homo sapiens
gcccatgctcaaccactgtggc

SEQ ID NO: 4114162 - DNA, 20 bp, Homo sapiens
gcccatggacaggctggctc

SEQ ID NO: 4114163 - DNA, 23 bp, Homo sapiens
gcccatggacaggctggctccag

SEQ ID NO: 4114164 - DNA, 19 bp, Homo sapiens
gcccatgtggagtcagcct

SEQ ID NO: 4114165 - DNA, 18 bp, Homo sapiens
gcccatgtgtcccctcac

SEQ ID NO: 4114166 - DNA, 15 bp, Homo sapiens
gcccattaggtccct

SEQ ID NO: 4114167 - DNA, 13 bp, Homo sapiens
gccccaacctgct

SEQ ID NO: 4114168 - DNA, 15 bp, Homo sapiens
gccccacaccagccc

SEQ ID NO: 4114169 - DNA, 21 bp, Homo sapiens
gccccacacggactcccgggc

SEQ ID NO: 4114170 - DNA, 23 bp, Homo sapiens
gccccacacggactcccgggcca

SEQ ID NO: 4114171 - DNA, 14 bp, Homo sapiens
gccccacagctacc

SEQ ID NO: 4114172 - DNA, 13 bp, Homo sapiens
gccccacccaagc

SEQ ID NO: 4114173 - DNA, 12 bp, Homo sapiens
gccccacccagg

SEQ ID NO: 4114174 - DNA, 18 bp, Homo sapiens
gccccaccccacctccac

SEQ ID NO: 4114175 - DNA, 13 bp, Homo sapiens
gccccactgatgc

SEQ ID NO: 4114176 - DNA, 21 bp, Homo sapiens
gccccagacagggtgggcttc

SEQ ID NO: 4114177 - DNA, 18 bp, Homo sapiens
gccccagaccccagggca

SEQ ID NO: 4114178 - DNA, 19 bp, Homo sapiens
gccccagaccccagggcag

SEQ ID NO: 4114179 - DNA, 13 bp, Homo sapiens
gccccagagagag

SEQ ID NO: 4114180 - DNA, 13 bp, Homo sapiens
gccccagagctgt

SEQ ID NO: 4114181 - DNA, 16 bp, Homo sapiens
gccccagagtggccca

SEQ ID NO: 4114182 - DNA, 17 bp, Homo sapiens
gccccagagtggcccac

SEQ ID NO: 4114183 - DNA, 14 bp, Homo sapiens
gccccagcagccct

SEQ ID NO: 4114184 - DNA, 20 bp, Homo sapiens
gccccagcagccctcaacag

SEQ ID NO: 4114185 - DNA, 21 bp, Homo sapiens
gccccagcctccctgaagcct

SEQ ID NO: 4114186 - DNA, 18 bp, Homo sapiens
gccccagcctgggccatc

SEQ ID NO: 4114187 - DNA, 16 bp, Homo sapiens
gccccaggaccagctc

SEQ ID NO: 4114188 - DNA, 18 bp, Homo sapiens
gccccaggaccagctcag

SEQ ID NO: 4114189 - DNA, 19 bp, Homo sapiens
gccccaggaccagctcagg

SEQ ID NO: 4114190 - DNA, 21 bp, Homo sapiens
gccccaggacctggctgccat

SEQ ID NO: 4114191 - DNA, 17 bp, Homo sapiens
gccccaggccccagaca

SEQ ID NO: 4114192 - DNA, 17 bp, Homo sapiens
gccccaggccctccctg

SEQ ID NO: 4114193 - DNA, 13 bp, Homo sapiens
gccccagggcacc

SEQ ID NO: 4114194 - DNA, 16 bp, Homo sapiens
gccccagggtcttccc

SEQ ID NO: 4114195 - DNA, 17 bp, Homo sapiens
gccccagggtcttccct

SEQ ID NO: 4114196 - DNA, 20 bp, Homo sapiens
gccccagggtcttccctacc

SEQ ID NO: 4114197 - DNA, 21 bp, Homo sapiens
gccccagggtcttccctacct

SEQ ID NO: 4114198 - DNA, 23 bp, Homo sapiens
gccccagggtcttccctacctca

SEQ ID NO: 4114199 - DNA, 20 bp, Homo sapiens
gccccagtcggccccatctc

SEQ ID NO: 4114200 - DNA, 20 bp, Homo sapiens
gccccatcagaacctgagct

SEQ ID NO: 4114201 - DNA, 19 bp, Homo sapiens
gccccatccagacctggct

SEQ ID NO: 4114202 - DNA, 11 bp, Homo sapiens
gccccatccct

SEQ ID NO: 4114203 - DNA, 13 bp, Homo sapiens
gccccatccctgt

SEQ ID NO: 4114204 - DNA, 19 bp, Homo sapiens
gccccattccttgcgcctc

SEQ ID NO: 4114205 - DNA, 17 bp, Homo sapiens
gcccccaacctcagggc

SEQ ID NO: 4114206 - DNA, 19 bp, Homo sapiens
gcccccaacctcagggctc

SEQ ID NO: 4114207 - DNA, 20 bp, Homo sapiens
gcccccaccgtgggcaggga

SEQ ID NO: 4114208 - DNA, 17 bp, Homo sapiens
gcccccactgaccagaa

SEQ ID NO: 4114209 - DNA, 20 bp, Homo sapiens
gcccccagccccggggtgag

SEQ ID NO: 4114210 - DNA, 21 bp, Homo sapiens
gcccccagccccggggtgagt

SEQ ID NO: 4114211 - DNA, 15 bp, Homo sapiens
gcccccagggcctcc

SEQ ID NO: 4114212 - DNA, 16 bp, Homo sapiens
gcccccagggcctcca

SEQ ID NO: 4114213 - DNA, 17 bp, Homo sapiens
gcccccagggcctccag

SEQ ID NO: 4114214 - DNA, 13 bp, Homo sapiens
gcccccaggggca

SEQ ID NO: 4114215 - DNA, 16 bp, Homo sapiens
gcccccaggggcagga

SEQ ID NO: 4114216 - DNA, 17 bp, Homo sapiens
gcccccagtccccaccc

SEQ ID NO: 4114217 - DNA, 22 bp, Homo sapiens
gcccccagtgggaccacatgcc

SEQ ID NO: 4114218 - DNA, 13 bp, Homo sapiens
gcccccatctcat

SEQ ID NO: 4114219 - DNA, 18 bp, Homo sapiens
gcccccatctcatgcccc

SEQ ID NO: 4114220 - DNA, 19 bp, Homo sapiens
gcccccatgggctcctgcc

SEQ ID NO: 4114221 - DNA, 20 bp, Homo sapiens
gccccccaaatcccagggaa

SEQ ID NO: 4114222 - DNA, 19 bp, Homo sapiens
gccccccgcgctcgcccag

SEQ ID NO: 4114223 - DNA, 21 bp, Homo sapiens
gcccccgccccagagtggccc

SEQ ID NO: 4114224 - DNA, 22 bp, Homo sapiens
gcccccgccccagagtggccca

SEQ ID NO: 4114225 - DNA, 14 bp, Homo sapiens
gcccccggccccct

SEQ ID NO: 4114226 - DNA, 13 bp, Homo sapiens
gccccctgccccc

SEQ ID NO: 4114227 - DNA, 15 bp, Homo sapiens
gccccctggcctctg

SEQ ID NO: 4114228 - DNA, 16 bp, Homo sapiens
gccccctggcctctgt

SEQ ID NO: 4114229 - DNA, 13 bp, Homo sapiens
gccccctggtctc

SEQ ID NO: 4114230 - DNA, 13 bp, Homo sapiens
gccccgccagggc

SEQ ID NO: 4114231 - DNA, 15 bp, Homo sapiens
gccccgccagggctg

SEQ ID NO: 4114232 - DNA, 19 bp, Homo sapiens
gccccgccagggctgggga

SEQ ID NO: 4114233 - DNA, 16 bp, Homo sapiens
gccccgcgcaccccac

SEQ ID NO: 4114234 - DNA, 17 bp, Homo sapiens
gccccggcaagccacag

SEQ ID NO: 4114235 - DNA, 15 bp, Homo sapiens
gccccggccctgggc

SEQ ID NO: 4114236 - DNA, 17 bp, Homo sapiens
gccccgggttcagcctg

SEQ ID NO: 4114237 - DNA, 19 bp, Homo sapiens
gccccgggttcagcctggc

SEQ ID NO: 4114238 - DNA, 21 bp, Homo sapiens
gccccgggttcagcctggcct

SEQ ID NO: 4114239 - DNA, 17 bp, Homo sapiens
gccccggtggctgggca

SEQ ID NO: 4114240 - DNA, 19 bp, Homo sapiens
gccccggtggctgggcaga

SEQ ID NO: 4114241 - DNA, 21 bp, Homo sapiens
gccccgtctacagctccccca

SEQ ID NO: 4114242 - DNA, 15 bp, Homo sapiens
gccccgtctgcccac

SEQ ID NO: 4114243 - DNA, 16 bp, Homo sapiens
gccccgtctgcccacc

SEQ ID NO: 4114244 - DNA, 19 bp, Homo sapiens
gcccctaatctctgtagga

SEQ ID NO: 4114245 - DNA, 19 bp, Homo sapiens
gcccctactgctgtgaacc

SEQ ID NO: 4114246 - DNA, 18 bp, Homo sapiens
gcccctatagcactgagc

SEQ ID NO: 4114247 - DNA, 21 bp, Homo sapiens
gcccctatagcactgagctca

SEQ ID NO: 4114248 - DNA, 18 bp, Homo sapiens
gcccctcaacagccaagt

SEQ ID NO: 4114249 - DNA, 12 bp, Homo sapiens
gcccctcacctt

SEQ ID NO: 4114250 - DNA, 18 bp, Homo sapiens
gcccctcaccttgggctg

SEQ ID NO: 4114251 - DNA, 20 bp, Homo sapiens
gcccctcagagccctgccct

SEQ ID NO: 4114252 - DNA, 21 bp, Homo sapiens
gcccctcatctctctgcccaa

SEQ ID NO: 4114253 - DNA, 18 bp, Homo sapiens
gcccctccaaacctccag

SEQ ID NO: 4114254 - DNA, 21 bp, Homo sapiens
gcccctccacgcctcctggcc

SEQ ID NO: 4114255 - DNA, 16 bp, Homo sapiens
gcccctccatccaccc

SEQ ID NO: 4114256 - DNA, 22 bp, Homo sapiens
gcccctcccccaacccccaccc

SEQ ID NO: 4114257 - DNA, 14 bp, Homo sapiens
gcccctcccttcaa

SEQ ID NO: 4114258 - DNA, 17 bp, Homo sapiens
gcccctcctagacccag

SEQ ID NO: 4114259 - DNA, 15 bp, Homo sapiens
gcccctcctccagcc

SEQ ID NO: 4114260 - DNA, 23 bp, Homo sapiens
gcccctcgcctgtggagctcagc

SEQ ID NO: 4114261 - DNA, 21 bp, Homo sapiens
gcccctctcccgccagactgt

SEQ ID NO: 4114262 - DNA, 20 bp, Homo sapiens
gcccctcttattcctctagg

SEQ ID NO: 4114263 - DNA, 21 bp, Homo sapiens
gcccctcttattcctctaggc

SEQ ID NO: 4114264 - DNA, 17 bp, Homo sapiens
gcccctgcagttggcag

SEQ ID NO: 4114265 - DNA, 20 bp, Homo sapiens
gcccctgcatccccttggct

SEQ ID NO: 4114266 - DNA, 18 bp, Homo sapiens
gcccctgccacctccctg

SEQ ID NO: 4114267 - DNA, 18 bp, Homo sapiens
gcccctgccccggaggaa

SEQ ID NO: 4114268 - DNA, 21 bp, Homo sapiens
gcccctgccttggggtcaggt

SEQ ID NO: 4114269 - DNA, 19 bp, Homo sapiens
gcccctggacaagcagagg

SEQ ID NO: 4114270 - DNA, 17 bp, Homo sapiens
gcccctggacctgggaa

SEQ ID NO: 4114271 - DNA, 13 bp, Homo sapiens
gcccctggagcca

SEQ ID NO: 4114272 - DNA, 16 bp, Homo sapiens
gcccctggcccatctc

SEQ ID NO: 4114273 - DNA, 20 bp, Homo sapiens
gcccctggcccatctcagcc

SEQ ID NO: 4114274 - DNA, 21 bp, Homo sapiens
gcccctggcccatctcagcct

SEQ ID NO: 4114275 - DNA, 17 bp, Homo sapiens
gcccctggctttgcctc

SEQ ID NO: 4114276 - DNA, 22 bp, Homo sapiens
gcccctggctttgcctcttctt

SEQ ID NO: 4114277 - DNA, 19 bp, Homo sapiens
gcccctgggcttggcctgc

SEQ ID NO: 4114278 - DNA, 11 bp, Homo sapiens
gcccctgggtt

SEQ ID NO: 4114279 - DNA, 14 bp, Homo sapiens
gcccctgtggccct

SEQ ID NO: 4114280 - DNA, 21 bp, Homo sapiens
gcccctgtgtattcaccacca

SEQ ID NO: 4114281 - DNA, 12 bp, Homo sapiens
gcccctgtgtga

SEQ ID NO: 4114282 - DNA, 19 bp, Homo sapiens
gccccttaaacacaggctg

SEQ ID NO: 4114283 - DNA, 19 bp, Homo sapiens
gccccttcccactcacccc

SEQ ID NO: 4114284 - DNA, 12 bp, Homo sapiens
gccccttccccc

SEQ ID NO: 4114285 - DNA, 14 bp, Homo sapiens
gccccttcctttaa

SEQ ID NO: 4114286 - DNA, 21 bp, Homo sapiens
gccccttcgggagcagggctg

SEQ ID NO: 4114287 - DNA, 17 bp, Homo sapiens
gccccttctctccctgc

SEQ ID NO: 4114288 - DNA, 14 bp, Homo sapiens
gccccttctgctca

SEQ ID NO: 4114289 - DNA, 17 bp, Homo sapiens
gcccgaaactaagccag

SEQ ID NO: 4114290 - DNA, 14 bp, Homo sapiens
gcccgacagcctgg

SEQ ID NO: 4114291 - DNA, 13 bp, Homo sapiens
gcccgcacacctg

SEQ ID NO: 4114292 - DNA, 21 bp, Homo sapiens
gcccgcaccccggcctcaggg

SEQ ID NO: 4114293 - DNA, 22 bp, Homo sapiens
gcccgctcctgccgcagacggg

SEQ ID NO: 4114294 - DNA, 21 bp, Homo sapiens
gcccgctgagctgagtggcca

SEQ ID NO: 4114295 - DNA, 14 bp, Homo sapiens
gcccgctgcaatgc

SEQ ID NO: 4114296 - DNA, 14 bp, Homo sapiens
gcccggaccttggc

SEQ ID NO: 4114297 - DNA, 17 bp, Homo sapiens
gcccggcagggcgggca

SEQ ID NO: 4114298 - DNA, 11 bp, Homo sapiens
gcccggccagc

SEQ ID NO: 4114299 - DNA, 14 bp, Homo sapiens
gcccggccggcctg

SEQ ID NO: 4114300 - DNA, 15 bp, Homo sapiens
gcccggcctgctccc

SEQ ID NO: 4114301 - DNA, 18 bp, Homo sapiens
gcccgggcgcggccagcc

SEQ ID NO: 4114302 - DNA, 23 bp, Homo sapiens
gcccgtgccctggtgaatcacct

SEQ ID NO: 4114303 - DNA, 22 bp, Homo sapiens
gcccgtggtggcggtggctgcc

SEQ ID NO: 4114304 - DNA, 23 bp, Homo sapiens
gcccgtggtggcggtggctgccc

SEQ ID NO: 4114305 - DNA, 16 bp, Homo sapiens
gccctaagcccccagg

SEQ ID NO: 4114306 - DNA, 17 bp, Homo sapiens
gccctaagcccccaggg

SEQ ID NO: 4114307 - DNA, 20 bp, Homo sapiens
gccctaagcccccagggcct

SEQ ID NO: 4114308 - DNA, 23 bp, Homo sapiens
gccctaagcccccagggcctcca

SEQ ID NO: 4114309 - DNA, 17 bp, Homo sapiens
gccctacagagctgtgg

SEQ ID NO: 4114310 - DNA, 17 bp, Homo sapiens
gccctactgggagactg

SEQ ID NO: 4114311 - DNA, 13 bp, Homo sapiens
gccctagagcctg

SEQ ID NO: 4114312 - DNA, 14 bp, Homo sapiens
gccctagagcctgc

SEQ ID NO: 4114313 - DNA, 15 bp, Homo sapiens
gccctagagcctgcc

SEQ ID NO: 4114314 - DNA, 19 bp, Homo sapiens
gccctagagcctgcctgga

SEQ ID NO: 4114315 - DNA, 20 bp, Homo sapiens
gccctagagcctgcctggag

SEQ ID NO: 4114316 - DNA, 21 bp, Homo sapiens
gccctagagcctgcctggagc

SEQ ID NO: 4114317 - DNA, 23 bp, Homo sapiens
gccctagagcctgcctggagcgt

SEQ ID NO: 4114318 - DNA, 21 bp, Homo sapiens
gccctagcccagactctgagc

SEQ ID NO: 4114319 - DNA, 22 bp, Homo sapiens
gccctagcccagactctgagct

SEQ ID NO: 4114320 - DNA, 20 bp, Homo sapiens
gccctcaacaggcccaggga

SEQ ID NO: 4114321 - DNA, 12 bp, Homo sapiens
gccctcagaaca

SEQ ID NO: 4114322 - DNA, 18 bp, Homo sapiens
gccctcatggcccctctg

SEQ ID NO: 4114323 - DNA, 15 bp, Homo sapiens
gccctcccagaacct

SEQ ID NO: 4114324 - DNA, 18 bp, Homo sapiens
gccctccccatggagcca

SEQ ID NO: 4114325 - DNA, 19 bp, Homo sapiens
gccctccccatggagccag

SEQ ID NO: 4114326 - DNA, 22 bp, Homo sapiens
gccctccccctcaacctcacca

SEQ ID NO: 4114327 - DNA, 20 bp, Homo sapiens
gccctcccccttccccttct

SEQ ID NO: 4114328 - DNA, 22 bp, Homo sapiens
gccctcccctccggactggtgc

SEQ ID NO: 4114329 - DNA, 23 bp, Homo sapiens
gccctccctgactccctgtgggg

SEQ ID NO: 4114330 - DNA, 20 bp, Homo sapiens
gccctccctgttccccagag

SEQ ID NO: 4114331 - DNA, 22 bp, Homo sapiens
gccctccgaccacttccagggg

SEQ ID NO: 4114332 - DNA, 18 bp, Homo sapiens
gccctccgaccctcatgg

SEQ ID NO: 4114333 - DNA, 14 bp, Homo sapiens
gccctcctcgggcc

SEQ ID NO: 4114334 - DNA, 20 bp, Homo sapiens
gccctcctttctgtgcccta

SEQ ID NO: 4114335 - DNA, 16 bp, Homo sapiens
gccctcgctgcttctg

SEQ ID NO: 4114336 - DNA, 13 bp, Homo sapiens
gccctctctctgg

SEQ ID NO: 4114337 - DNA, 20 bp, Homo sapiens
gccctctctgagtctggact

SEQ ID NO: 4114338 - DNA, 20 bp, Homo sapiens
gccctcttgggggcactgct

SEQ ID NO: 4114339 - DNA, 21 bp, Homo sapiens
gccctcttgggggcactgctc

SEQ ID NO: 4114340 - DNA, 19 bp, Homo sapiens
gccctctttccctgcgaga

SEQ ID NO: 4114341 - DNA, 20 bp, Homo sapiens
gccctctttccctgcgagac

SEQ ID NO: 4114342 - DNA, 15 bp, Homo sapiens
gccctgaccttggct

SEQ ID NO: 4114343 - DNA, 15 bp, Homo sapiens
gccctgactcctctg

SEQ ID NO: 4114344 - DNA, 21 bp, Homo sapiens
gccctgaggtgaaagggagct

SEQ ID NO: 4114345 - DNA, 12 bp, Homo sapiens
gccctgcacaga

SEQ ID NO: 4114346 - DNA, 17 bp, Homo sapiens
gccctgcacctgtgcag

SEQ ID NO: 4114347 - DNA, 10 bp, Homo sapiens
gccctgccct

SEQ ID NO: 4114348 - DNA, 13 bp, Homo sapiens
gccctgccctgca

SEQ ID NO: 4114349 - DNA, 14 bp, Homo sapiens
gccctgcctcctgg

SEQ ID NO: 4114350 - DNA, 17 bp, Homo sapiens
gccctgcctcctgggaa

SEQ ID NO: 4114351 - DNA, 20 bp, Homo sapiens
gccctgcctcctgggaagat

SEQ ID NO: 4114352 - DNA, 22 bp, Homo sapiens
gccctgcctcctgggaagatga

SEQ ID NO: 4114353 - DNA, 14 bp, Homo sapiens
gccctgctcctgca

SEQ ID NO: 4114354 - DNA, 16 bp, Homo sapiens
gccctgctcctgcagc

SEQ ID NO: 4114355 - DNA, 17 bp, Homo sapiens
gccctgctcctgcagca

SEQ ID NO: 4114356 - DNA, 12 bp, Homo sapiens
gccctgctgccc

SEQ ID NO: 4114357 - DNA, 15 bp, Homo sapiens
gccctgctttgcaaa

SEQ ID NO: 4114358 - DNA, 22 bp, Homo sapiens
gccctgctttgggctgccctgg

SEQ ID NO: 4114359 - DNA, 18 bp, Homo sapiens
gccctggacacccctgct

SEQ ID NO: 4114360 - DNA, 16 bp, Homo sapiens
gccctggcaggcaggg

SEQ ID NO: 4114361 - DNA, 19 bp, Homo sapiens
gccctggccagccgggagc

SEQ ID NO: 4114362 - DNA, 19 bp, Homo sapiens
gccctggctcccacaggcc

SEQ ID NO: 4114363 - DNA, 10 bp, Homo sapiens
gccctggctg

SEQ ID NO: 4114364 - DNA, 11 bp, Homo sapiens
gccctggctgc

SEQ ID NO: 4114365 - DNA, 17 bp, Homo sapiens
gccctggctgctgcccc

SEQ ID NO: 4114366 - DNA, 15 bp, Homo sapiens
gccctggctgttctg

SEQ ID NO: 4114367 - DNA, 14 bp, Homo sapiens
gccctgggctggac

SEQ ID NO: 4114368 - DNA, 17 bp, Homo sapiens
gccctgggctggactgg

SEQ ID NO: 4114369 - DNA, 20 bp, Homo sapiens
gccaggcacacacagcccct

SEQ ID NO: 4114370 - DNA, 16 bp, Homo sapiens
gccaggcacagggccc

SEQ ID NO: 4114371 - DNA, 18 bp, Homo sapiens
gccaggcacagggcccgc

SEQ ID NO: 4114372 - DNA, 21 bp, Homo sapiens
gccaggcaccccctggagaga

SEQ ID NO: 4114373 - DNA, 16 bp, Homo sapiens
gccaggcactgccctt

SEQ ID NO: 4114374 - DNA, 19 bp, Homo sapiens
gccaggcactgccttctcc

SEQ ID NO: 4114375 - DNA, 21 bp, Homo sapiens
gccaggcagatctgtgcccca

SEQ ID NO: 4114376 - DNA, 23 bp, Homo sapiens
gccaggcagatctgtgccccatg

SEQ ID NO: 4114377 - DNA, 19 bp, Homo sapiens
gccaggcaggcgggcgcca

SEQ ID NO: 4114378 - DNA, 14 bp, Homo sapiens
gccaggcaggggtg

SEQ ID NO: 4114379 - DNA, 17 bp, Homo sapiens
gccaggcaggtccacag

SEQ ID NO: 4114380 - DNA, 19 bp, Homo sapiens
gccaggccagcctccgaga

SEQ ID NO: 4114381 - DNA, 22 bp, Homo sapiens
gccaggcccgcaccccggcctc

SEQ ID NO: 4114382 - DNA, 14 bp, Homo sapiens
gccaggcctgggtc

SEQ ID NO: 4114383 - DNA, 22 bp, Homo sapiens
gccaggcgctagcacagctccc

SEQ ID NO: 4114384 - DNA, 16 bp, Homo sapiens
gccaggctgaccacag

SEQ ID NO: 4114385 - DNA, 22 bp, Homo sapiens
gccaggctgaccacagcacagc

SEQ ID NO: 4114386 - DNA, 20 bp, Homo sapiens
gccaggctgcctcctgccct

SEQ ID NO: 4114387 - DNA, 22 bp, Homo sapiens
gccagggaccccagaatcatgt

SEQ ID NO: 4114388 - DNA, 16 bp, Homo sapiens
gccagggagaagctcc

SEQ ID NO: 4114389 - DNA, 19 bp, Homo sapiens
gccagggccacgctccagc

SEQ ID NO: 4114390 - DNA, 22 bp, Homo sapiens
gccagggccacgctccagctgc

SEQ ID NO: 4114391 - DNA, 17 bp, Homo sapiens
gccagggcccaccccag

SEQ ID NO: 4114392 - DNA, 22 bp, Homo sapiens
gccagggcccaccccagcctcg

SEQ ID NO: 4114393 - DNA, 22 bp, Homo sapiens
gccagggcccctcaccctgcct

SEQ ID NO: 4114394 - DNA, 10 bp, Homo sapiens
gccagggctg

SEQ ID NO: 4114395 - DNA, 14 bp, Homo sapiens
gccagggctgcccc

SEQ ID NO: 4114396 - DNA, 17 bp, Homo sapiens
gccagggctgccctgag

SEQ ID NO: 4114397 - DNA, 19 bp, Homo sapiens
gccagggctgccctgagaa

SEQ ID NO: 4114398 - DNA, 11 bp, Homo sapiens
gccagggctgg

SEQ ID NO: 4114399 - DNA, 14 bp, Homo sapiens
gccagggctgggga

SEQ ID NO: 4114400 - DNA, 15 bp, Homo sapiens
gccagggggatgcca

SEQ ID NO: 4114401 - DNA, 20 bp, Homo sapiens
gccagggtctctccctcagg

SEQ ID NO: 4114402 - DNA, 22 bp, Homo sapiens
gccagggtctctccctcaggtg

SEQ ID NO: 4114403 - DNA, 19 bp, Homo sapiens
gccagggtctgtgtgaatg

SEQ ID NO: 4114404 - DNA, 22 bp, Homo sapiens
gccagggtctgtgtgaatgtgg

SEQ ID NO: 4114405 - DNA, 15 bp, Homo sapiens
gccagggtgagagct

SEQ ID NO: 4114406 - DNA, 16 bp, Homo sapiens
gccagggtgagagctg

SEQ ID NO: 4114407 - DNA, 20 bp, Homo sapiens
gccagggtggtcttgatctc

SEQ ID NO: 4114408 - DNA, 19 bp, Homo sapiens
gccagggtttacccagtgg

SEQ ID NO: 4114409 - DNA, 21 bp, Homo sapiens
gccaggtaatgtgaataaatt

SEQ ID NO: 4114410 - DNA, 16 bp, Homo sapiens
gccaggtatggctctg

SEQ ID NO: 4114411 - DNA, 21 bp, Homo sapiens
gccaggtcaccctttgctgtg

SEQ ID NO: 4114412 - DNA, 15 bp, Homo sapiens
gccaggtgagaaact

SEQ ID NO: 4114413 - DNA, 17 bp, Homo sapiens
gccaggtgagctctgac

SEQ ID NO: 4114414 - DNA, 22 bp, Homo sapiens
gccaggtggttgtcttattgca

SEQ ID NO: 4114415 - DNA, 22 bp, Homo sapiens
gccagtaacacaggccaccctg

SEQ ID NO: 4114416 - DNA, 20 bp, Homo sapiens
gccagtaacgcgtcttcctg

SEQ ID NO: 4114417 - DNA, 22 bp, Homo sapiens
gccagtaacgcgtcttcctgag

SEQ ID NO: 4114418 - DNA, 18 bp, Homo sapiens
gccagtcaagaagaaaaa

SEQ ID NO: 4114419 - DNA, 20 bp, Homo sapiens
gccagtccccatttctgcct

SEQ ID NO: 4114420 - DNA, 17 bp, Homo sapiens
gccagtcctcctgggag

SEQ ID NO: 4114421 - DNA, 19 bp, Homo sapiens
gccagtcctcctgggagcc

SEQ ID NO: 4114422 - DNA, 16 bp, Homo sapiens
gccagtcctgcctggc

SEQ ID NO: 4114423 - DNA, 18 bp, Homo sapiens
gccagtcctgcctggcca

SEQ ID NO: 4114424 - DNA, 20 bp, Homo sapiens
gccagtcctgcctggccagg

SEQ ID NO: 4114425 - DNA, 22 bp, Homo sapiens
gccagtcctgctacctcccttg

SEQ ID NO: 4114426 - DNA, 13 bp, Homo sapiens
gccagtctcccag

SEQ ID NO: 4114427 - DNA, 15 bp, Homo sapiens
gccagtctgggctgc

SEQ ID NO: 4114428 - DNA, 16 bp, Homo sapiens
gccagtctgggctgcc

SEQ ID NO: 4114429 - DNA, 14 bp, Homo sapiens
gccagtgacagaca

SEQ ID NO: 4114430 - DNA, 23 bp, Homo sapiens
gccagtgacctttgacctcggtg

SEQ ID NO: 4114431 - DNA, 16 bp, Homo sapiens
gccagtgctccaggca

SEQ ID NO: 4114432 - DNA, 15 bp, Homo sapiens
gccagtgctggtcac

SEQ ID NO: 4114433 - DNA, 15 bp, Homo sapiens
gccagtggggcctgt

SEQ ID NO: 4114434 - DNA, 16 bp, Homo sapiens
gccagtggggcctgtg

SEQ ID NO: 4114435 - DNA, 17 bp, Homo sapiens
gccagtggggcctgtgg

SEQ ID NO: 4114436 - DNA, 18 bp, Homo sapiens
gccagtggggcctgtgga

SEQ ID NO: 4114437 - DNA, 12 bp, Homo sapiens
gccagtgtctgg

SEQ ID NO: 4114438 - DNA, 17 bp, Homo sapiens
gccagttagactagtcc

SEQ ID NO: 4114439 - DNA, 19 bp, Homo sapiens
gccagtttgaagcctgtgc

SEQ ID NO: 4114440 - DNA, 19 bp, Homo sapiens
gccagttttccctggaact

SEQ ID NO: 4114441 - DNA, 22 bp, Homo sapiens
gccataattctaagttatttac

SEQ ID NO: 4114442 - DNA, 20 bp, Homo sapiens
gccatacttatctctctgtg

SEQ ID NO: 4114443 - DNA, 22 bp, Homo sapiens
gccatacttatctctctgtgct

SEQ ID NO: 4114444 - DNA, 17 bp, Homo sapiens
gccatagaccctgaggc

SEQ ID NO: 4114445 - DNA, 19 bp, Homo sapiens
gccatagaccctgaggccc

SEQ ID NO: 4114446 - DNA, 15 bp, Homo sapiens
gccataggccctttc

SEQ ID NO: 4114447 - DNA, 19 bp, Homo sapiens
gccatatatgaccagaagc

SEQ ID NO: 4114448 - DNA, 14 bp, Homo sapiens
gccatatttactac

SEQ ID NO: 4114449 - DNA, 19 bp, Homo sapiens
gccatcaccataacctctg

SEQ ID NO: 4114450 - DNA, 20 bp, Homo sapiens
gccatccaaataagaaacct

SEQ ID NO: 4114451 - DNA, 21 bp, Homo sapiens
gccatccaaataagaaaccta

SEQ ID NO: 4114452 - DNA, 16 bp, Homo sapiens
gccatccctgggcccc

SEQ ID NO: 4114453 - DNA, 18 bp, Homo sapiens
gccatccctgggcccctc

SEQ ID NO: 4114454 - DNA, 21 bp, Homo sapiens
gccatcctcaaacgacagagg

SEQ ID NO: 4114455 - DNA, 23 bp, Homo sapiens
gccatcctcaaacgacagaggag

SEQ ID NO: 4114456 - DNA, 24 bp, Homo sapiens
gccatcctcaaacgacagaggagc

SEQ ID NO: 4114457 - DNA, 12 bp, Homo sapiens
gccatcctccct

SEQ ID NO: 4114458 - DNA, 13 bp, Homo sapiens
gccatcctccctc

SEQ ID NO: 4114459 - DNA, 22 bp, Homo sapiens
gccatccttcaccagagcccat

SEQ ID NO: 4114460 - DNA, 23 bp, Homo sapiens
gccatccttcaccagagcccatg

SEQ ID NO: 4114461 - DNA, 19 bp, Homo sapiens
gccatccttccgccaatct

SEQ ID NO: 4114462 - DNA, 23 bp, Homo sapiens
gccatccttccgccaatctggcc

SEQ ID NO: 4114463 - DNA, 18 bp, Homo sapiens
gccatctcatgaggggag

SEQ ID NO: 4114464 - DNA, 17 bp, Homo sapiens
gccatctgatccccatg

SEQ ID NO: 4114465 - DNA, 21 bp, Homo sapiens
gccatctgggctcctccaggg

SEQ ID NO: 4114466 - DNA, 15 bp, Homo sapiens
gccatgagggacagg

SEQ ID NO: 4114467 - DNA, 19 bp, Homo sapiens
gccatgagggacagggtct

SEQ ID NO: 4114468 - DNA, 22 bp, Homo sapiens
gccatgatctgtatttaatggt

SEQ ID NO: 4114469 - DNA, 19 bp, Homo sapiens
gccatgatggcaacagatc

SEQ ID NO: 4114470 - DNA, 14 bp, Homo sapiens
gccatgctgaaggg

SEQ ID NO: 4114471 - DNA, 15 bp, Homo sapiens
gcctggccccaggcc

SEQ ID NO: 4114472 - DNA, 22 bp, Homo sapiens
gcctggccccaggccccagaca

SEQ ID NO: 4114473 - DNA, 13 bp, Homo sapiens
gcctggcccccaa

SEQ ID NO: 4114474 - DNA, 20 bp, Homo sapiens
gcctggcccccaacctcagg

SEQ ID NO: 4114475 - DNA, 22 bp, Homo sapiens
gcctggcccccaacctcagggc

SEQ ID NO: 4114476 - DNA, 23 bp, Homo sapiens
gcctggctctttcgtcacccttg

SEQ ID NO: 4114477 - DNA, 19 bp, Homo sapiens
gcctggctggtcctcccat

SEQ ID NO: 4114478 - DNA, 17 bp, Homo sapiens
gcctgggacttccatgc

SEQ ID NO: 4114479 - DNA, 16 bp, Homo sapiens
gcctgggagcccagag

SEQ ID NO: 4114480 - DNA, 17 bp, Homo sapiens
gcctgggataggggcag

SEQ ID NO: 4114481 - DNA, 16 bp, Homo sapiens
gcctgggcaacagagc

SEQ ID NO: 4114482 - DNA, 23 bp, Homo sapiens
gcctgggcagccaggctgccaag

SEQ ID NO: 4114483 - DNA, 20 bp, Homo sapiens
gcctgggccacagggcgaga

SEQ ID NO: 4114484 - DNA, 20 bp, Homo sapiens
gcctgggcccggaagggctt

SEQ ID NO: 4114485 - DNA, 14 bp, Homo sapiens
gcctgggcctctgc

SEQ ID NO: 4114486 - DNA, 17 bp, Homo sapiens
gcctgggcctctgcccc

SEQ ID NO: 4114487 - DNA, 13 bp, Homo sapiens
gcctgggggccag

SEQ ID NO: 4114488 - DNA, 17 bp, Homo sapiens
gcctgggggccagtggg

SEQ ID NO: 4114489 - DNA, 18 bp, Homo sapiens
gcctgggggccagtgggg

SEQ ID NO: 4114490 - DNA, 16 bp, Homo sapiens
gcctggggtgcatctc

SEQ ID NO: 4114491 - DNA, 17 bp, Homo sapiens
gcctggggtgcatctcc

SEQ ID NO: 4114492 - DNA, 14 bp, Homo sapiens
gcctgggtctgtgt

SEQ ID NO: 4114493 - DNA, 19 bp, Homo sapiens
gcctgggtctgtgtctctt

SEQ ID NO: 4114494 - DNA, 15 bp, Homo sapiens
gcctgggtgctggct

SEQ ID NO: 4114495 - DNA, 17 bp, Homo sapiens
gcctgggtgctggctgc

SEQ ID NO: 4114496 - DNA, 20 bp, Homo sapiens
gcctgggtgctggctgccca

SEQ ID NO: 4114497 - DNA, 14 bp, Homo sapiens
gcctggtccctggg

SEQ ID NO: 4114498 - DNA, 15 bp, Homo sapiens
gcctggtccctggga

SEQ ID NO: 4114499 - DNA, 16 bp, Homo sapiens
gcctggtccctgggag

SEQ ID NO: 4114500 - DNA, 13 bp, Homo sapiens
gcctggtgcagtg

SEQ ID NO: 4114501 - DNA, 20 bp, Homo sapiens
gcctgtaatcccagcacttt

SEQ ID NO: 4114502 - DNA, 22 bp, Homo sapiens
gcctgtaatcccagctactcag

SEQ ID NO: 4114503 - DNA, 13 bp, Homo sapiens
gcctgtagagttg

SEQ ID NO: 4114504 - DNA, 14 bp, Homo sapiens
gcctgtagcagtga

SEQ ID NO: 4114505 - DNA, 19 bp, Homo sapiens
gcctgtcacccccactccc

SEQ ID NO: 4114506 - DNA, 11 bp, Homo sapiens
gcctgtcccaa

SEQ ID NO: 4114507 - DNA, 22 bp, Homo sapiens
gcctgtcccaattctgcccgct

SEQ ID NO: 4114508 - DNA, 21 bp, Homo sapiens
gcctgtcccatggacactcca

SEQ ID NO: 4114509 - DNA, 20 bp, Homo sapiens
gcctgtcccttgcctctgcc

SEQ ID NO: 4114510 - DNA, 16 bp, Homo sapiens
gcctgtcgtgccagtc

SEQ ID NO: 4114511 - DNA, 21 bp, Homo sapiens
gcctgtcgtgccagtcctggg

SEQ ID NO: 4114512 - DNA, 19 bp, Homo sapiens
gcctgtctcatccccaggg

SEQ ID NO: 4114513 - DNA, 15 bp, Homo sapiens
gcctgtctgagactc

SEQ ID NO: 4114514 - DNA, 13 bp, Homo sapiens
gcctgtctgcccc

SEQ ID NO: 4114515 - DNA, 19 bp, Homo sapiens
gcctgtctgtgaagagcaa

SEQ ID NO: 4114516 - DNA, 15 bp, Homo sapiens
gcctgtgcccactcc

SEQ ID NO: 4114517 - DNA, 18 bp, Homo sapiens
gcctgtgcctcccagctt

SEQ ID NO: 4114518 - DNA, 16 bp, Homo sapiens
gcctgtgcctctggga

SEQ ID NO: 4114519 - DNA, 17 bp, Homo sapiens
gcctgtgcctctgggac

SEQ ID NO: 4114520 - DNA, 17 bp, Homo sapiens
gcctgtggagctcagcc

SEQ ID NO: 4114521 - DNA, 16 bp, Homo sapiens
gcctgtggccccaccg

SEQ ID NO: 4114522 - DNA, 23 bp, Homo sapiens
gcctgtggccccaccgagctgga

SEQ ID NO: 4114523 - DNA, 22 bp, Homo sapiens
gcctgttcccctcactggatga

SEQ ID NO: 4114524 - DNA, 18 bp, Homo sapiens
gcctgttctgaggattca

SEQ ID NO: 4114525 - DNA, 19 bp, Homo sapiens
gcctgttctgaggattcag

SEQ ID NO: 4114526 - DNA, 20 bp, Homo sapiens
gcctgttgctatagagccta

SEQ ID NO: 4114527 - DNA, 16 bp, Homo sapiens
gcctgtttctgcagcc

SEQ ID NO: 4114528 - DNA, 19 bp, Homo sapiens
gcctgtttctgcagccctt

SEQ ID NO: 4114529 - DNA, 14 bp, Homo sapiens
gccttaaaaccaaa

SEQ ID NO: 4114530 - DNA, 13 bp, Homo sapiens
gccttaaaatgga

SEQ ID NO: 4114531 - DNA, 19 bp, Homo sapiens
gccttaaaatggaattgaa

SEQ ID NO: 4114532 - DNA, 20 bp, Homo sapiens
gccttaaacctacctcccac

SEQ ID NO: 4114533 - DNA, 22 bp, Homo sapiens
gccttaagccataggcccagga

SEQ ID NO: 4114534 - DNA, 19 bp, Homo sapiens
gccttaatttcctttttga

SEQ ID NO: 4114535 - DNA, 21 bp, Homo sapiens
gccttaatttcctttttgaca

SEQ ID NO: 4114536 - DNA, 19 bp, Homo sapiens
gccttacacagggcgaggg

SEQ ID NO: 4114537 - DNA, 15 bp, Homo sapiens
gccttagggaagctg

SEQ ID NO: 4114538 - DNA, 22 bp, Homo sapiens
gccttagggaagctggcctgag

SEQ ID NO: 4114539 - DNA, 16 bp, Homo sapiens
gccttagtgggccagg

SEQ ID NO: 4114540 - DNA, 17 bp, Homo sapiens
gccttagtgggccaggg

SEQ ID NO: 4114541 - DNA, 19 bp, Homo sapiens
gccttagtgggccagggct

SEQ ID NO: 4114542 - DNA, 16 bp, Homo sapiens
gccttataaaccaatc

SEQ ID NO: 4114543 - DNA, 17 bp, Homo sapiens
gccttataaaccaatct

SEQ ID NO: 4114544 - DNA, 18 bp, Homo sapiens
gccttataaaccaatctt

SEQ ID NO: 4114545 - DNA, 13 bp, Homo sapiens
gccttcaaatcaa

SEQ ID NO: 4114546 - DNA, 20 bp, Homo sapiens
gccttcagagtacgtcctgc

SEQ ID NO: 4114547 - DNA, 15 bp, Homo sapiens
gccttccagctgctg

SEQ ID NO: 4114548 - DNA, 15 bp, Homo sapiens
gccttcctcagctgc

SEQ ID NO: 4114549 - DNA, 23 bp, Homo sapiens
gccttctccatatctccatggcc

SEQ ID NO: 4114550 - DNA, 14 bp, Homo sapiens
gccttctcctctct

SEQ ID NO: 4114551 - DNA, 21 bp, Homo sapiens
gccttctctattgggcacagc

SEQ ID NO: 4114552 - DNA, 14 bp, Homo sapiens
gccttctgaaatgt

SEQ ID NO: 4114553 - DNA, 22 bp, Homo sapiens
gccttcttttgattatgttttt

SEQ ID NO: 4114554 - DNA, 14 bp, Homo sapiens
gccttgaacctgtg

SEQ ID NO: 4114555 - DNA, 15 bp, Homo sapiens
gccttgagccctggc

SEQ ID NO: 4114556 - DNA, 12 bp, Homo sapiens
gccttgccagag

SEQ ID NO: 4114557 - DNA, 13 bp, Homo sapiens
gccttgccagaga

SEQ ID NO: 4114558 - DNA, 18 bp, Homo sapiens
gccttgcccactcctgct

SEQ ID NO: 4114559 - DNA, 23 bp, Homo sapiens
gccttgcccactcctgctctgct

SEQ ID NO: 4114560 - DNA, 13 bp, Homo sapiens
gccttgctcattc

SEQ ID NO: 4114561 - DNA, 14 bp, Homo sapiens
gccttgctgagtgg

SEQ ID NO: 4114562 - DNA, 17 bp, Homo sapiens
gccttgctgtttgtcct

SEQ ID NO: 4114563 - DNA, 11 bp, Homo sapiens
gccttgcttgt

SEQ ID NO: 4114564 - DNA, 18 bp, Homo sapiens
gccttgggctgctcctca

SEQ ID NO: 4114565 - DNA, 22 bp, Homo sapiens
gccttgggctgctcctcatggt

SEQ ID NO: 4114566 - DNA, 17 bp, Homo sapiens
gccttgtaattctaaat

SEQ ID NO: 4114567 - DNA, 19 bp, Homo sapiens
gccttgtctcctactcctg

SEQ ID NO: 4114568 - DNA, 23 bp, Homo sapiens
gccttgtctcctactcctgactc

SEQ ID NO: 4114569 - DNA, 18 bp, Homo sapiens
gcctttaaaggtttttaa

SEQ ID NO: 4114570 - DNA, 21 bp, Homo sapiens
gcctttaatggacttatttct

SEQ ID NO: 4114571 - DNA, 20 bp, Homo sapiens
gcctttagttctccactggg

SEQ ID NO: 4114572 - DNA, 13 bp, Homo sapiens
gcctttatttgct

SEQ ID NO: 4114573 - DNA, 17 bp, Homo sapiens
gcctttcagcaggcagc

SEQ ID NO: 4114574 - DNA, 22 bp, Homo sapiens
gcctctggctagaggccagccc

SEQ ID NO: 4114575 - DNA, 15 bp, Homo sapiens
gcctctgtgtccttc

SEQ ID NO: 4114576 - DNA, 19 bp, Homo sapiens
gcctcttactaatgtaaaa

SEQ ID NO: 4114577 - DNA, 20 bp, Homo sapiens
gcctcttcgcctttcccacc

SEQ ID NO: 4114578 - DNA, 15 bp, Homo sapiens
gcctcttcttcttca

SEQ ID NO: 4114579 - DNA, 16 bp, Homo sapiens
gcctcttcttcttcag

SEQ ID NO: 4114580 - DNA, 21 bp, Homo sapiens
gcctcttcttcttcagaagac

SEQ ID NO: 4114581 - DNA, 13 bp, Homo sapiens
gcctcttctttgt

SEQ ID NO: 4114582 - DNA, 14 bp, Homo sapiens
gcctcttctttgtg

SEQ ID NO: 4114583 - DNA, 15 bp, Homo sapiens
gcctcttctttgtgc

SEQ ID NO: 4114584 - DNA, 18 bp, Homo sapiens
gcctcttgcgtattggct

SEQ ID NO: 4114585 - DNA, 16 bp, Homo sapiens
gcctcttgtaaagact

SEQ ID NO: 4114586 - DNA, 17 bp, Homo sapiens
gcctcttgtaaagactg

SEQ ID NO: 4114587 - DNA, 12 bp, Homo sapiens
gcctcttttctc

SEQ ID NO: 4114588 - DNA, 18 bp, Homo sapiens
gcctcttttctctgtgct

SEQ ID NO: 4114589 - DNA, 16 bp, Homo sapiens
gcctgaaagaggctga

SEQ ID NO: 4114590 - DNA, 18 bp, Homo sapiens
gcctgaaatttcaccatt

SEQ ID NO: 4114591 - DNA, 15 bp, Homo sapiens
gcctgaacagaagct

SEQ ID NO: 4114592 - DNA, 14 bp, Homo sapiens
gcctgaactgagga

SEQ ID NO: 4114593 - DNA, 15 bp, Homo sapiens
gcctgaactgaggag

SEQ ID NO: 4114594 - DNA, 15 bp, Homo sapiens
gcctgaagccagctg

SEQ ID NO: 4114595 - DNA, 21 bp, Homo sapiens
gcctgacaaccactggtctgt

SEQ ID NO: 4114596 - DNA, 22 bp, Homo sapiens
gcctgacacactaaccaagctg

SEQ ID NO: 4114597 - DNA, 16 bp, Homo sapiens
gcctgacaccccctcc

SEQ ID NO: 4114598 - DNA, 21 bp, Homo sapiens
gcctgacaccccctccccgcc

SEQ ID NO: 4114599 - DNA, 15 bp, Homo sapiens
gcctgaccccttgct

SEQ ID NO: 4114600 - DNA, 20 bp, Homo sapiens
gcctgaccccttgctccctt

SEQ ID NO: 4114601 - DNA, 17 bp, Homo sapiens
gcctgacctgagactgt

SEQ ID NO: 4114602 - DNA, 21 bp, Homo sapiens
gcctgactaatttttgtattt

SEQ ID NO: 4114603 - DNA, 15 bp, Homo sapiens
gcctgactcccccag

SEQ ID NO: 4114604 - DNA, 16 bp, Homo sapiens
gcctgacttctgctgg

SEQ ID NO: 4114605 - DNA, 18 bp, Homo sapiens
gcctgagaagaagtggct

SEQ ID NO: 4114606 - DNA, 13 bp, Homo sapiens
gcctgagaggcag

SEQ ID NO: 4114607 - DNA, 20 bp, Homo sapiens
gcctgagaggcaggcataga

SEQ ID NO: 4114608 - DNA, 16 bp, Homo sapiens
gcctgagaggggaagc

SEQ ID NO: 4114609 - DNA, 13 bp, Homo sapiens
gcctgagagtatt

SEQ ID NO: 4114610 - DNA, 20 bp, Homo sapiens
gcctgagagtcagctctctg

SEQ ID NO: 4114611 - DNA, 15 bp, Homo sapiens
gcctgagctcctgct

SEQ ID NO: 4114612 - DNA, 17 bp, Homo sapiens
gcctgagggtggagact

SEQ ID NO: 4114613 - DNA, 16 bp, Homo sapiens
gcctgaggtcaatggt

SEQ ID NO: 4114614 - DNA, 13 bp, Homo sapiens
gcctgaggtctgt

SEQ ID NO: 4114615 - DNA, 13 bp, Homo sapiens
gcctgagtttcca

SEQ ID NO: 4114616 - DNA, 16 bp, Homo sapiens
gcctgatcagaccacg

SEQ ID NO: 4114617 - DNA, 16 bp, Homo sapiens
gcctgatgctccctcc

SEQ ID NO: 4114618 - DNA, 17 bp, Homo sapiens
gcctgatgctccctccc

SEQ ID NO: 4114619 - DNA, 15 bp, Homo sapiens
gcctgcaatttcata

SEQ ID NO: 4114620 - DNA, 15 bp, Homo sapiens
gcctgcacctttcgg

SEQ ID NO: 4114621 - DNA, 18 bp, Homo sapiens
gcctgcagagagaagcct

SEQ ID NO: 4114622 - DNA, 14 bp, Homo sapiens
gcctgcaggagaga

SEQ ID NO: 4114623 - DNA, 16 bp, Homo sapiens
gcctgcaggcagagct

SEQ ID NO: 4114624 - DNA, 17 bp, Homo sapiens
gcctgcagtcctggaag

SEQ ID NO: 4114625 - DNA, 15 bp, Homo sapiens
gcctgccagctgcac

SEQ ID NO: 4114626 - DNA, 18 bp, Homo sapiens
gcctgccagctgcactga

SEQ ID NO: 4114627 - DNA, 16 bp, Homo sapiens
gcctgcccccctcatc

SEQ ID NO: 4114628 - DNA, 14 bp, Homo sapiens
gcctgcccctctcc

SEQ ID NO: 4114629 - DNA, 16 bp, Homo sapiens
gcctgcccgtgccctg

SEQ ID NO: 4114630 - DNA, 21 bp, Homo sapiens
gcctgccctcatggcccctct

SEQ ID NO: 4114631 - DNA, 19 bp, Homo sapiens
gcctgccctgtcaggaggc

SEQ ID NO: 4114632 - DNA, 20 bp, Homo sapiens
gcctgccctttgtcctcctg

SEQ ID NO: 4114633 - DNA, 17 bp, Homo sapiens
gcctgcctgcagcaggc

SEQ ID NO: 4114634 - DNA, 18 bp, Homo sapiens
gcctgcctgcagcaggca

SEQ ID NO: 4114635 - DNA, 13 bp, Homo sapiens
gcctgcctggagc

SEQ ID NO: 4114636 - DNA, 19 bp, Homo sapiens
gcctgctaaggctcctcct

SEQ ID NO: 4114637 - DNA, 12 bp, Homo sapiens
gcctgctccaga

SEQ ID NO: 4114638 - DNA, 13 bp, Homo sapiens
gcctgctccagac

SEQ ID NO: 4114639 - DNA, 14 bp, Homo sapiens
gcctgctccagacc

SEQ ID NO: 4114640 - DNA, 17 bp, Homo sapiens
gcctgctccagacctga

SEQ ID NO: 4114641 - DNA, 21 bp, Homo sapiens
gcctgctccagacctgatcct

SEQ ID NO: 4114642 - DNA, 13 bp, Homo sapiens
gcctgctcccagc

SEQ ID NO: 4114643 - DNA, 16 bp, Homo sapiens
gcctgctcccagcagc

SEQ ID NO: 4114644 - DNA, 15 bp, Homo sapiens
gcctgctccctccag

SEQ ID NO: 4114645 - DNA, 17 bp, Homo sapiens
gcctgctccctccagaa

SEQ ID NO: 4114646 - DNA, 20 bp, Homo sapiens
gcctgctccttcccttgcta

SEQ ID NO: 4114647 - DNA, 13 bp, Homo sapiens
gcctgctgagagc

SEQ ID NO: 4114648 - DNA, 18 bp, Homo sapiens
gcctgctgagatgaggag

SEQ ID NO: 4114649 - DNA, 18 bp, Homo sapiens
gcctgctgccagtgcagc

SEQ ID NO: 4114650 - DNA, 23 bp, Homo sapiens
gcctgctgccagtgcagccactg

SEQ ID NO: 4114651 - DNA, 13 bp, Homo sapiens
gcctgctgcccag

SEQ ID NO: 4114652 - DNA, 18 bp, Homo sapiens
gcctgctgcccaggctgt

SEQ ID NO: 4114653 - DNA, 13 bp, Homo sapiens
gcctgctgcggca

SEQ ID NO: 4114654 - DNA, 18 bp, Homo sapiens
gcctgctggaagcccagc

SEQ ID NO: 4114655 - DNA, 17 bp, Homo sapiens
gcctgctggaggcctca

SEQ ID NO: 4114656 - DNA, 16 bp, Homo sapiens
gcctgctggcacccac

SEQ ID NO: 4114657 - DNA, 19 bp, Homo sapiens
gcctgctggcacccaccgt

SEQ ID NO: 4114658 - DNA, 17 bp, Homo sapiens
gcctgctggtcacagcc

SEQ ID NO: 4114659 - DNA, 17 bp, Homo sapiens
gcctgctttgtctcctc

SEQ ID NO: 4114660 - DNA, 17 bp, Homo sapiens
gcctggaaacctgtctg

SEQ ID NO: 4114661 - DNA, 20 bp, Homo sapiens
gcctggacatttgccttgct

SEQ ID NO: 4114662 - DNA, 16 bp, Homo sapiens
gcctggaccacccctg

SEQ ID NO: 4114663 - DNA, 14 bp, Homo sapiens
gcctggacctgcct

SEQ ID NO: 4114664 - DNA, 16 bp, Homo sapiens
gcctggacctgcctcc

SEQ ID NO: 4114665 - DNA, 15 bp, Homo sapiens
gcctggactctgccc

SEQ ID NO: 4114666 - DNA, 16 bp, Homo sapiens
gcctggactctgcccc

SEQ ID NO: 4114667 - DNA, 20 bp, Homo sapiens
gcctggactctgccccacgc

SEQ ID NO: 4114668 - DNA, 15 bp, Homo sapiens
gcctggagaagctga

SEQ ID NO: 4114669 - DNA, 12 bp, Homo sapiens
gcctggatctcc

SEQ ID NO: 4114670 - DNA, 20 bp, Homo sapiens
gcctggatgcggatggccgg

SEQ ID NO: 4114671 - DNA, 12 bp, Homo sapiens
gcctggcagccg

SEQ ID NO: 4114672 - DNA, 20 bp, Homo sapiens
gcctggcaggccagtgtctg

SEQ ID NO: 4114673 - DNA, 16 bp, Homo sapiens
gcctggccagacacag

SEQ ID NO: 4114674 - DNA, 17 bp, Homo sapiens
gcctggccagacacagg

SEQ ID NO: 4114675 - DNA, 21 bp, Homo sapiens
gcctggccagatttttctttt

SEQ ID NO: 4114676 - DNA, 19 bp, Homo sapiens
gcctggccccagcctgggc

SEQ ID NO: 4114677 - DNA, 20 bp, Homo sapiens
gcctggccccagcctgggcc

SEQ ID NO: 4114678 - DNA, 17 bp, Homo sapiens
gcctacaaccatccctg

SEQ ID NO: 4114679 - DNA, 22 bp, Homo sapiens
gcctacaaccatccctgccaca

SEQ ID NO: 4114680 - DNA, 14 bp, Homo sapiens
gcctacagccaggt

SEQ ID NO: 4114681 - DNA, 15 bp, Homo sapiens
gcctactcttcaggg

SEQ ID NO: 4114682 - DNA, 12 bp, Homo sapiens
gcctagcaagct

SEQ ID NO: 4114683 - DNA, 22 bp, Homo sapiens
gcctagcgatctctcctggcct

SEQ ID NO: 4114684 - DNA, 18 bp, Homo sapiens
gcctagcggagcccagcc

SEQ ID NO: 4114685 - DNA, 13 bp, Homo sapiens
gcctatccgctgc

SEQ ID NO: 4114686 - DNA, 18 bp, Homo sapiens
gcctatccgctgccagcc

SEQ ID NO: 4114687 - DNA, 19 bp, Homo sapiens
gcctatgttgggggggacc

SEQ ID NO: 4114688 - DNA, 20 bp, Homo sapiens
gcctattatattaaaatatg

SEQ ID NO: 4114689 - DNA, 13 bp, Homo sapiens
gcctatttgtgtg

SEQ ID NO: 4114690 - DNA, 13 bp, Homo sapiens
gcctcaaaatgtg

SEQ ID NO: 4114691 - DNA, 14 bp, Homo sapiens
gcctcaaaatgtgt

SEQ ID NO: 4114692 - DNA, 21 bp, Homo sapiens
gcctcaagcaatccacctgcc

SEQ ID NO: 4114693 - DNA, 14 bp, Homo sapiens
gcctcaatgccagt

SEQ ID NO: 4114694 - DNA, 14 bp, Homo sapiens
gcctcaccacctga

SEQ ID NO: 4114695 - DNA, 18 bp, Homo sapiens
gcctcacccacccctgca

SEQ ID NO: 4114696 - DNA, 19 bp, Homo sapiens
gcctcacccacccctgcac

SEQ ID NO: 4114697 - DNA, 18 bp, Homo sapiens
gcctcacttgaatgtgtc

SEQ ID NO: 4114698 - DNA, 17 bp, Homo sapiens
gcctcagccctcagttc

SEQ ID NO: 4114699 - DNA, 23 bp, Homo sapiens
gcctcagctacccactatccttc

SEQ ID NO: 4114700 - DNA, 19 bp, Homo sapiens
gcctcagctgaatgcctcc

SEQ ID NO: 4114701 - DNA, 14 bp, Homo sapiens
gcctcagctgcctc

SEQ ID NO: 4114702 - DNA, 15 bp, Homo sapiens
gcctcagctgcctca

SEQ ID NO: 4114703 - DNA, 20 bp, Homo sapiens
gcctcagctgcctcacttcc

SEQ ID NO: 4114704 - DNA, 14 bp, Homo sapiens
gcctcagggccagg

SEQ ID NO: 4114705 - DNA, 15 bp, Homo sapiens
gcctcagggcgctca

SEQ ID NO: 4114706 - DNA, 16 bp, Homo sapiens
gcctcagggcgctcag

SEQ ID NO: 4114707 - DNA, 20 bp, Homo sapiens
gcctcaggtgctgtccatgg

SEQ ID NO: 4114708 - DNA, 16 bp, Homo sapiens
gcctcagttcaacctg

SEQ ID NO: 4114709 - DNA, 22 bp, Homo sapiens
gcctcagttcaacctggtggca

SEQ ID NO: 4114710 - DNA, 15 bp, Homo sapiens
gcctcatactcctgg

SEQ ID NO: 4114711 - DNA, 20 bp, Homo sapiens
gcctcatactcctgggctca

SEQ ID NO: 4114712 - DNA, 16 bp, Homo sapiens
gcctccaagcacagag

SEQ ID NO: 4114713 - DNA, 19 bp, Homo sapiens
gcctccaagcacagagcct

SEQ ID NO: 4114714 - DNA, 20 bp, Homo sapiens
gcctccaagcacagagcctg

SEQ ID NO: 4114715 - DNA, 15 bp, Homo sapiens
gcctccaccctcctc

SEQ ID NO: 4114716 - DNA, 18 bp, Homo sapiens
gcctccagcctgcccaag

SEQ ID NO: 4114717 - DNA, 13 bp, Homo sapiens
gcctcccaaagtg

SEQ ID NO: 4114718 - DNA, 19 bp, Homo sapiens
gcctcccaaggtcctctca

SEQ ID NO: 4114719 - DNA, 20 bp, Homo sapiens
gcctcccacacttgctgggg

SEQ ID NO: 4114720 - DNA, 13 bp, Homo sapiens
gcctcccaccaga

SEQ ID NO: 4114721 - DNA, 17 bp, Homo sapiens
gcctcccacccccatct

SEQ ID NO: 4114722 - DNA, 19 bp, Homo sapiens
gcctcccatccttccctca

SEQ ID NO: 4114723 - DNA, 13 bp, Homo sapiens
gcctccccatctg

SEQ ID NO: 4114724 - DNA, 20 bp, Homo sapiens
gcctccccatctgtccagct

SEQ ID NO: 4114725 - DNA, 19 bp, Homo sapiens
gcctccccatttcccatct

SEQ ID NO: 4114726 - DNA, 21 bp, Homo sapiens
gcctccccatttcccatctgc

SEQ ID NO: 4114727 - DNA, 13 bp, Homo sapiens
gcctccccctcag

SEQ ID NO: 4114728 - DNA, 22 bp, Homo sapiens
gcctccccctcagatgatctct

SEQ ID NO: 4114729 - DNA, 16 bp, Homo sapiens
gcctccctccttgggt

SEQ ID NO: 4114730 - DNA, 22 bp, Homo sapiens
gcctccctctcagaggcctgct

SEQ ID NO: 4114731 - DNA, 13 bp, Homo sapiens
gcctccctgaagc

SEQ ID NO: 4114732 - DNA, 18 bp, Homo sapiens
gcctccctgaagcctttg

SEQ ID NO: 4114733 - DNA, 17 bp, Homo sapiens
gcctccctgctgtgcca

SEQ ID NO: 4114734 - DNA, 23 bp, Homo sapiens
gcctccctgctgtgccatgctgg

SEQ ID NO: 4114735 - DNA, 22 bp, Homo sapiens
gcctccctgtctccagctgcct

SEQ ID NO: 4114736 - DNA, 23 bp, Homo sapiens
gcctccctgtctccagctgcctg

SEQ ID NO: 4114737 - DNA, 14 bp, Homo sapiens
gcctccggaagctg

SEQ ID NO: 4114738 - DNA, 12 bp, Homo sapiens
gcctcctcatcc

SEQ ID NO: 4114739 - DNA, 17 bp, Homo sapiens
gcctcctcggagagcag

SEQ ID NO: 4114740 - DNA, 15 bp, Homo sapiens
gcctcctcgttcctt

SEQ ID NO: 4114741 - DNA, 19 bp, Homo sapiens
gcctcctcgttcctttctc

SEQ ID NO: 4114742 - DNA, 21 bp, Homo sapiens
gcctcctctcataaaagagac

SEQ ID NO: 4114743 - DNA, 20 bp, Homo sapiens
gcctcctctggacggcaggc

SEQ ID NO: 4114744 - DNA, 16 bp, Homo sapiens
gcctcctgagcctgtg

SEQ ID NO: 4114745 - DNA, 17 bp, Homo sapiens
gcctcctgcctgcccct

SEQ ID NO: 4114746 - DNA, 11 bp, Homo sapiens
gcctcctggcc

SEQ ID NO: 4114747 - DNA, 14 bp, Homo sapiens
gcctcctggccaga

SEQ ID NO: 4114748 - DNA, 16 bp, Homo sapiens
gcctcctggccagacg

SEQ ID NO: 4114749 - DNA, 13 bp, Homo sapiens
gcctcctgtgcct

SEQ ID NO: 4114750 - DNA, 15 bp, Homo sapiens
gcctcctgtgcctgg

SEQ ID NO: 4114751 - DNA, 16 bp, Homo sapiens
gcctcctgtgcctggc

SEQ ID NO: 4114752 - DNA, 20 bp, Homo sapiens
gcctcctgtgcctggcccca

SEQ ID NO: 4114753 - DNA, 18 bp, Homo sapiens
gcctcctgtggcctgcca

SEQ ID NO: 4114754 - DNA, 20 bp, Homo sapiens
gcctcctgtggcctgccagt

SEQ ID NO: 4114755 - DNA, 18 bp, Homo sapiens
gcctcctgtggggaaagg

SEQ ID NO: 4114756 - DNA, 18 bp, Homo sapiens
gcctccttccacctccct

SEQ ID NO: 4114757 - DNA, 18 bp, Homo sapiens
gcctcgcaggcctccctg

SEQ ID NO: 4114758 - DNA, 15 bp, Homo sapiens
gcctcgctcaccgct

SEQ ID NO: 4114759 - DNA, 22 bp, Homo sapiens
gcctcgctcaccgctggccctt

SEQ ID NO: 4114760 - DNA, 21 bp, Homo sapiens
gcctcgggacacctgccctgc

SEQ ID NO: 4114761 - DNA, 13 bp, Homo sapiens
gcctcgggacctc

SEQ ID NO: 4114762 - DNA, 15 bp, Homo sapiens
gcctcgtccctccct

SEQ ID NO: 4114763 - DNA, 19 bp, Homo sapiens
gcctcgtgccatgatctgt

SEQ ID NO: 4114764 - DNA, 22 bp, Homo sapiens
gcctcgtggttattagcaaggc

SEQ ID NO: 4114765 - DNA, 23 bp, Homo sapiens
gcctcgtggttattagcaaggct

SEQ ID NO: 4114766 - DNA, 13 bp, Homo sapiens
gcctctcccgcac

SEQ ID NO: 4114767 - DNA, 24 bp, Homo sapiens
gcctctgactctgagtccactgct

SEQ ID NO: 4114768 - DNA, 18 bp, Homo sapiens
gcctctgcagtctcattt

SEQ ID NO: 4114769 - DNA, 23 bp, Homo sapiens
gcctctgccaaaggatgtgatat

SEQ ID NO: 4114770 - DNA, 18 bp, Homo sapiens
gcctctgcccctcccaac

SEQ ID NO: 4114771 - DNA, 13 bp, Homo sapiens
gcctctgccctgg

SEQ ID NO: 4114772 - DNA, 14 bp, Homo sapiens
gcctctgccctgga

SEQ ID NO: 4114773 - DNA, 17 bp, Homo sapiens
gcctctgccctggattg

SEQ ID NO: 4114774 - DNA, 21 bp, Homo sapiens
gcctctgcggggcagggcctt

SEQ ID NO: 4114775 - DNA, 12 bp, Homo sapiens
gcctctgctgaa

SEQ ID NO: 4114776 - DNA, 17 bp, Homo sapiens
gcctctgctgccgccct

SEQ ID NO: 4114777 - DNA, 17 bp, Homo sapiens
gcctctggacagccagt

SEQ ID NO: 4114778 - DNA, 20 bp, Homo sapiens
gcctctggacagccagtgac

SEQ ID NO: 4114779 - DNA, 12 bp, Homo sapiens
gcctctggctag

SEQ ID NO: 4114780 - DNA, 18 bp, Homo sapiens
gcctctggctagaggcca

SEQ ID NO: 4114781 - DNA, 22 bp, Homo sapiens
gccctggggactgttccaaagc

SEQ ID NO: 4114782 - DNA, 16 bp, Homo sapiens
gccctggtccagggaa

SEQ ID NO: 4114783 - DNA, 18 bp, Homo sapiens
gccctggtccagggaagc

SEQ ID NO: 4114784 - DNA, 20 bp, Homo sapiens
gccctggtccagggaagctg

SEQ ID NO: 4114785 - DNA, 19 bp, Homo sapiens
gccctggtgaatcacctgg

SEQ ID NO: 4114786 - DNA, 21 bp, Homo sapiens
gccctggtgctgccacacttc

SEQ ID NO: 4114787 - DNA, 17 bp, Homo sapiens
gccctgtccctgtcccc

SEQ ID NO: 4114788 - DNA, 16 bp, Homo sapiens
gccctgtcgagacact

SEQ ID NO: 4114789 - DNA, 21 bp, Homo sapiens
gccctgtgcaacctcttggcc

SEQ ID NO: 4114790 - DNA, 13 bp, Homo sapiens
gccctgtgtactt

SEQ ID NO: 4114791 - DNA, 20 bp, Homo sapiens
gccctgttcacgctcaccca

SEQ ID NO: 4114792 - DNA, 21 bp, Homo sapiens
gccctgttcacgctcacccag

SEQ ID NO: 4114793 - DNA, 17 bp, Homo sapiens
gccctgttcatgtgcct

SEQ ID NO: 4114794 - DNA, 19 bp, Homo sapiens
gccctgttcatgtgcctct

SEQ ID NO: 4114795 - DNA, 21 bp, Homo sapiens
gccctgttcatgtgcctctgc

SEQ ID NO: 4114796 - DNA, 17 bp, Homo sapiens
gccctgttgtgtataga

SEQ ID NO: 4114797 - DNA, 23 bp, Homo sapiens
gcccttacagccctaagtggctg

SEQ ID NO: 4114798 - DNA, 21 bp, Homo sapiens
gcccttcaccccagtggccac

SEQ ID NO: 4114799 - DNA, 14 bp, Homo sapiens
gcccttcagattgt

SEQ ID NO: 4114800 - DNA, 15 bp, Homo sapiens
gcccttcagattgtt

SEQ ID NO: 4114801 - DNA, 17 bp, Homo sapiens
gcccttccatgtgcctt

SEQ ID NO: 4114802 - DNA, 20 bp, Homo sapiens
gcccttccatgtgcctttct

SEQ ID NO: 4114803 - DNA, 22 bp, Homo sapiens
gcccttccctctgggcacgcct

SEQ ID NO: 4114804 - DNA, 13 bp, Homo sapiens
gcccttccctgag

SEQ ID NO: 4114805 - DNA, 14 bp, Homo sapiens
gcccttcctctcca

SEQ ID NO: 4114806 - DNA, 18 bp, Homo sapiens
gcccttcctctccactgc

SEQ ID NO: 4114807 - DNA, 22 bp, Homo sapiens
gcccttcctctccactgccttc

SEQ ID NO: 4114808 - DNA, 14 bp, Homo sapiens
gcccttcctctgct

SEQ ID NO: 4114809 - DNA, 15 bp, Homo sapiens
gcccttgcccatgct

SEQ ID NO: 4114810 - DNA, 14 bp, Homo sapiens
gcccttgcctcccc

SEQ ID NO: 4114811 - DNA, 16 bp, Homo sapiens
gcccttggccatgggt

SEQ ID NO: 4114812 - DNA, 14 bp, Homo sapiens
gcccttggggctgg

SEQ ID NO: 4114813 - DNA, 21 bp, Homo sapiens
gccctttacttgtctttctgg

SEQ ID NO: 4114814 - DNA, 15 bp, Homo sapiens
gccctttcctaggcc

SEQ ID NO: 4114815 - DNA, 18 bp, Homo sapiens
gccctttcctaggcccag

SEQ ID NO: 4114816 - DNA, 21 bp, Homo sapiens
gcccttttctctcacccatcc

SEQ ID NO: 4114817 - DNA, 16 bp, Homo sapiens
gccgaaggtgcctcag

SEQ ID NO: 4114818 - DNA, 18 bp, Homo sapiens
gccgaaggtgcctcagac

SEQ ID NO: 4114819 - DNA, 15 bp, Homo sapiens
gccgaatagctgatg

SEQ ID NO: 4114820 - DNA, 15 bp, Homo sapiens
gccgaatgccctcag

SEQ ID NO: 4114821 - DNA, 22 bp, Homo sapiens
gccgacccctagttccctctgc

SEQ ID NO: 4114822 - DNA, 13 bp, Homo sapiens
gccgaccttccct

SEQ ID NO: 4114823 - DNA, 12 bp, Homo sapiens
gccgactctggc

SEQ ID NO: 4114824 - DNA, 17 bp, Homo sapiens
gccgactctggccctgg

SEQ ID NO: 4114825 - DNA, 15 bp, Homo sapiens
gccgagccgggcctg

SEQ ID NO: 4114826 - DNA, 20 bp, Homo sapiens
gccgagccgggcctggggct

SEQ ID NO: 4114827 - DNA, 17 bp, Homo sapiens
gccgagcgttcccagca

SEQ ID NO: 4114828 - DNA, 13 bp, Homo sapiens
gccgagctggttt

SEQ ID NO: 4114829 - DNA, 12 bp, Homo sapiens
gccgaggaccct

SEQ ID NO: 4114830 - DNA, 18 bp, Homo sapiens
gccgaggaggtgcctgga

SEQ ID NO: 4114831 - DNA, 19 bp, Homo sapiens
gccgcagacgggcacagac

SEQ ID NO: 4114832 - DNA, 21 bp, Homo sapiens
gccgcagacgggcacagacac

SEQ ID NO: 4114833 - DNA, 14 bp, Homo sapiens
gccgcaggtgggtg

SEQ ID NO: 4114834 - DNA, 17 bp, Homo sapiens
gccgccattgccaccag

SEQ ID NO: 4114835 - DNA, 12 bp, Homo sapiens
gccgccccagcc

SEQ ID NO: 4114836 - DNA, 17 bp, Homo sapiens
gccgccccctgcccccc

SEQ ID NO: 4114837 - DNA, 15 bp, Homo sapiens
gccgccttaagctga

SEQ ID NO: 4114838 - DNA, 19 bp, Homo sapiens
gccgcggggaagctggctt

SEQ ID NO: 4114839 - DNA, 11 bp, Homo sapiens
gccgctacctc

SEQ ID NO: 4114840 - DNA, 12 bp, Homo sapiens
gccgctccagag

SEQ ID NO: 4114841 - DNA, 13 bp, Homo sapiens
gccgctccagagt

SEQ ID NO: 4114842 - DNA, 14 bp, Homo sapiens
gccgctgcaccacg

SEQ ID NO: 4114843 - DNA, 15 bp, Homo sapiens
gccgctgccgctgca

SEQ ID NO: 4114844 - DNA, 16 bp, Homo sapiens
gccgctgccgctgcac

SEQ ID NO: 4114845 - DNA, 17 bp, Homo sapiens
gccgctgccgctgcacc

SEQ ID NO: 4114846 - DNA, 17 bp, Homo sapiens
gccgctgctttgcgctg

SEQ ID NO: 4114847 - DNA, 19 bp, Homo sapiens
gccgctgtataaagcatgt

SEQ ID NO: 4114848 - DNA, 16 bp, Homo sapiens
gccggaaccacagggc

SEQ ID NO: 4114849 - DNA, 19 bp, Homo sapiens
gccggaaccacagggccag

SEQ ID NO: 4114850 - DNA, 22 bp, Homo sapiens
gccggcacccacaagtgccact

SEQ ID NO: 4114851 - DNA, 19 bp, Homo sapiens
gccggcccagatgtgtccc

SEQ ID NO: 4114852 - DNA, 17 bp, Homo sapiens
gccggcggctactctgg

SEQ ID NO: 4114853 - DNA, 15 bp, Homo sapiens
gccggctgtggagca

SEQ ID NO: 4114854 - DNA, 17 bp, Homo sapiens
gccgggcaggtcctgcc

SEQ ID NO: 4114855 - DNA, 17 bp, Homo sapiens
gccgggcccctgggctt

SEQ ID NO: 4114856 - DNA, 12 bp, Homo sapiens
gccgggcctggg

SEQ ID NO: 4114857 - DNA, 21 bp, Homo sapiens
gccgggctacccgtgagccct

SEQ ID NO: 4114858 - DNA, 12 bp, Homo sapiens
gccgggctctgc

SEQ ID NO: 4114859 - DNA, 21 bp, Homo sapiens
gccgggctctgcacccacgtg

SEQ ID NO: 4114860 - DNA, 18 bp, Homo sapiens
gccgggctgagggcctgc

SEQ ID NO: 4114861 - DNA, 22 bp, Homo sapiens
gccgggcttgggccctgcacag

SEQ ID NO: 4114862 - DNA, 21 bp, Homo sapiens
gccggggaagctgccagccca

SEQ ID NO: 4114863 - DNA, 19 bp, Homo sapiens
gccggggtgtaacttcctg

SEQ ID NO: 4114864 - DNA, 21 bp, Homo sapiens
gccggggtgtaacttcctgct

SEQ ID NO: 4114865 - DNA, 18 bp, Homo sapiens
gccggtcgggcagccagc

SEQ ID NO: 4114866 - DNA, 22 bp, Homo sapiens
gccggtcgggcagccagcagag

SEQ ID NO: 4114867 - DNA, 20 bp, Homo sapiens
gccgtagggagtacctgctg

SEQ ID NO: 4114868 - DNA, 20 bp, Homo sapiens
gccgtcccaccagcttcact

SEQ ID NO: 4114869 - DNA, 22 bp, Homo sapiens
gccgtccttctaatgaagacaa

SEQ ID NO: 4114870 - DNA, 13 bp, Homo sapiens
gccgtctcctccc

SEQ ID NO: 4114871 - DNA, 12 bp, Homo sapiens
gccgtgcccagg

SEQ ID NO: 4114872 - DNA, 17 bp, Homo sapiens
gccgtgccttcagctct

SEQ ID NO: 4114873 - DNA, 13 bp, Homo sapiens
gccgtggatggcc

SEQ ID NO: 4114874 - DNA, 23 bp, Homo sapiens
gccgtgggcctgtcgtgccagtc

SEQ ID NO: 4114875 - DNA, 21 bp, Homo sapiens
gccgtggtccaaccaggagct

SEQ ID NO: 4114876 - DNA, 15 bp, Homo sapiens
gccgtggtccagctc

SEQ ID NO: 4114877 - DNA, 16 bp, Homo sapiens
gccgtggtccagctct

SEQ ID NO: 4114878 - DNA, 19 bp, Homo sapiens
gccgtgtgagtgtgacagg

SEQ ID NO: 4114879 - DNA, 18 bp, Homo sapiens
gccgttgccgctgatgtt

SEQ ID NO: 4114880 - DNA, 22 bp, Homo sapiens
gcctaaaagtgggcttgattct

SEQ ID NO: 4114881 - DNA, 13 bp, Homo sapiens
gcctaaaatcttg

SEQ ID NO: 4114882 - DNA, 20 bp, Homo sapiens
gcctaaaggatagatcaaag

SEQ ID NO: 4114883 - DNA, 14 bp, Homo sapiens
gcctaatccctggg

SEQ ID NO: 4114884 - DNA, 12 bp, Homo sapiens
gctcccctctgc

SEQ ID NO: 4114885 - DNA, 15 bp, Homo sapiens
gctcccgcagggctg

SEQ ID NO: 4114886 - DNA, 14 bp, Homo sapiens
gctcccgctcccag

SEQ ID NO: 4114887 - DNA, 23 bp, Homo sapiens
gctcccggccttgtgtgatttta

SEQ ID NO: 4114888 - DNA, 19 bp, Homo sapiens
gctccctaccccagggccc

SEQ ID NO: 4114889 - DNA, 23 bp, Homo sapiens
gctccctaccccagggccctggc

SEQ ID NO: 4114890 - DNA, 16 bp, Homo sapiens
gctccctcaaagaggc

SEQ ID NO: 4114891 - DNA, 19 bp, Homo sapiens
gctccctcaaagaggcagt

SEQ ID NO: 4114892 - DNA, 15 bp, Homo sapiens
gctccctcagcctca

SEQ ID NO: 4114893 - DNA, 17 bp, Homo sapiens
gctccctcccctgccct

SEQ ID NO: 4114894 - DNA, 19 bp, Homo sapiens
gctccctcccctgccctgg

SEQ ID NO: 4114895 - DNA, 20 bp, Homo sapiens
gctccctccgggtcttccta

SEQ ID NO: 4114896 - DNA, 16 bp, Homo sapiens
gctccctcctccaggc

SEQ ID NO: 4114897 - DNA, 16 bp, Homo sapiens
gctccctgatgacacc

SEQ ID NO: 4114898 - DNA, 16 bp, Homo sapiens
gctccctgtggcactc

SEQ ID NO: 4114899 - DNA, 12 bp, Homo sapiens
gctcccttcagc

SEQ ID NO: 4114900 - DNA, 19 bp, Homo sapiens
gctcccttcagcccccagc

SEQ ID NO: 4114901 - DNA, 23 bp, Homo sapiens
gctcccttcagcccccagcccct

SEQ ID NO: 4114902 - DNA, 18 bp, Homo sapiens
gctcccttgacctgctga

SEQ ID NO: 4114903 - DNA, 12 bp, Homo sapiens
gctccgctgctc

SEQ ID NO: 4114904 - DNA, 14 bp, Homo sapiens
gctccgctgctcct

SEQ ID NO: 4114905 - DNA, 19 bp, Homo sapiens
gctccgctgctccttggct

SEQ ID NO: 4114906 - DNA, 22 bp, Homo sapiens
gctccggcgtgtgttcagtgtt

SEQ ID NO: 4114907 - DNA, 23 bp, Homo sapiens
gctccggcgtgtgttcagtgtta

SEQ ID NO: 4114908 - DNA, 15 bp, Homo sapiens
gctcctacctctgtg

SEQ ID NO: 4114909 - DNA, 17 bp, Homo sapiens
gctcctaggggaacaga

SEQ ID NO: 4114910 - DNA, 18 bp, Homo sapiens
gctcctcaactcacctaa

SEQ ID NO: 4114911 - DNA, 19 bp, Homo sapiens
gctcctcatggtgggttca

SEQ ID NO: 4114912 - DNA, 20 bp, Homo sapiens
gctcctccagggtgtgtgct

SEQ ID NO: 4114913 - DNA, 16 bp, Homo sapiens
gctcctcccggtgccc

SEQ ID NO: 4114914 - DNA, 16 bp, Homo sapiens
gctcctcctgccctgt

SEQ ID NO: 4114915 - DNA, 18 bp, Homo sapiens
gctcctcctgccctgtcc

SEQ ID NO: 4114916 - DNA, 20 bp, Homo sapiens
gctcctcctgccctgtccct

SEQ ID NO: 4114917 - DNA, 15 bp, Homo sapiens
gctcctctcctggag

SEQ ID NO: 4114918 - DNA, 18 bp, Homo sapiens
gctcctctcctggaggat

SEQ ID NO: 4114919 - DNA, 21 bp, Homo sapiens
gctcctgaggggcatctgccc

SEQ ID NO: 4114920 - DNA, 15 bp, Homo sapiens
gctcctgcagcatgg

SEQ ID NO: 4114921 - DNA, 21 bp, Homo sapiens
gctcctgcagcatggtccctg

SEQ ID NO: 4114922 - DNA, 11 bp, Homo sapiens
gctcctgcccc

SEQ ID NO: 4114923 - DNA, 24 bp, Homo sapiens
gctcctgcccctttcaggcctaca

SEQ ID NO: 4114924 - DNA, 13 bp, Homo sapiens
gctcctgctgcgg

SEQ ID NO: 4114925 - DNA, 15 bp, Homo sapiens
gctcctgcttttctg

SEQ ID NO: 4114926 - DNA, 18 bp, Homo sapiens
gctcctgcttttctgtcc

SEQ ID NO: 4114927 - DNA, 19 bp, Homo sapiens
gctcctgcttttctgtcct

SEQ ID NO: 4114928 - DNA, 18 bp, Homo sapiens
gctcctggagcctttgaa

SEQ ID NO: 4114929 - DNA, 19 bp, Homo sapiens
gctcctggagcctttgaat

SEQ ID NO: 4114930 - DNA, 21 bp, Homo sapiens
gctccttagggttttctctct

SEQ ID NO: 4114931 - DNA, 13 bp, Homo sapiens
gctccttcccatc

SEQ ID NO: 4114932 - DNA, 17 bp, Homo sapiens
gctcctttctccagcca

SEQ ID NO: 4114933 - DNA, 20 bp, Homo sapiens
gctcctttctccagccagca

SEQ ID NO: 4114934 - DNA, 21 bp, Homo sapiens
gctcgcacccccctgttctaa

SEQ ID NO: 4114935 - DNA, 20 bp, Homo sapiens
gctcgccctcctttctgtgc

SEQ ID NO: 4114936 - DNA, 12 bp, Homo sapiens
gctcgcgggcag

SEQ ID NO: 4114937 - DNA, 13 bp, Homo sapiens
gctcgcgggcagc

SEQ ID NO: 4114938 - DNA, 19 bp, Homo sapiens
gctcgcgggcagcgggcca

SEQ ID NO: 4114939 - DNA, 21 bp, Homo sapiens
gctcgcgggcagcgggccagg

SEQ ID NO: 4114940 - DNA, 15 bp, Homo sapiens
gctcggaggaagccc

SEQ ID NO: 4114941 - DNA, 14 bp, Homo sapiens
gctcggaggctgcc

SEQ ID NO: 4114942 - DNA, 16 bp, Homo sapiens
gctcggaggctgcccc

SEQ ID NO: 4114943 - DNA, 13 bp, Homo sapiens
gctcggcgcccac

SEQ ID NO: 4114944 - DNA, 16 bp, Homo sapiens
gctctacatcttctgc

SEQ ID NO: 4114945 - DNA, 13 bp, Homo sapiens
gctctacccatga

SEQ ID NO: 4114946 - DNA, 15 bp, Homo sapiens
gctctacccatgagc

SEQ ID NO: 4114947 - DNA, 15 bp, Homo sapiens
gctctaccttcctgt

SEQ ID NO: 4114948 - DNA, 19 bp, Homo sapiens
gctctactgaggtgctatg

SEQ ID NO: 4114949 - DNA, 14 bp, Homo sapiens
gctctcaattaaag

SEQ ID NO: 4114950 - DNA, 15 bp, Homo sapiens
gctctcaattaaagt

SEQ ID NO: 4114951 - DNA, 14 bp, Homo sapiens
gctctcacccccat

SEQ ID NO: 4114952 - DNA, 16 bp, Homo sapiens
gctctcacccccatcc

SEQ ID NO: 4114953 - DNA, 17 bp, Homo sapiens
gctctcacccccatccc

SEQ ID NO: 4114954 - DNA, 12 bp, Homo sapiens
gctctcagaagg

SEQ ID NO: 4114955 - DNA, 17 bp, Homo sapiens
gctctcatgctgcccct

SEQ ID NO: 4114956 - DNA, 18 bp, Homo sapiens
gctctccaagtctcagtg

SEQ ID NO: 4114957 - DNA, 22 bp, Homo sapiens
gctctccaagtctcagtggctt

SEQ ID NO: 4114958 - DNA, 14 bp, Homo sapiens
gctctcccagtgaa

SEQ ID NO: 4114959 - DNA, 23 bp, Homo sapiens
gctctcccgtgcatcccccctgc

SEQ ID NO: 4114960 - DNA, 19 bp, Homo sapiens
gctctcctcagaagaaaga

SEQ ID NO: 4114961 - DNA, 14 bp, Homo sapiens
gctctcctctggct

SEQ ID NO: 4114962 - DNA, 18 bp, Homo sapiens
gctctctaggcctctcca

SEQ ID NO: 4114963 - DNA, 12 bp, Homo sapiens
gctctctgccct

SEQ ID NO: 4114964 - DNA, 14 bp, Homo sapiens
gctctctgccctgt

SEQ ID NO: 4114965 - DNA, 15 bp, Homo sapiens
gctctctgccctgtg

SEQ ID NO: 4114966 - DNA, 11 bp, Homo sapiens
gctctctggga

SEQ ID NO: 4114967 - DNA, 23 bp, Homo sapiens
gctctgcaattcccctctgctgc

SEQ ID NO: 4114968 - DNA, 12 bp, Homo sapiens
gctctgcacaga

SEQ ID NO: 4114969 - DNA, 14 bp, Homo sapiens
gctctgcacagatg

SEQ ID NO: 4114970 - DNA, 23 bp, Homo sapiens
gctctgcccaggaactcgcacct

SEQ ID NO: 4114971 - DNA, 14 bp, Homo sapiens
gctctgcctcagac

SEQ ID NO: 4114972 - DNA, 22 bp, Homo sapiens
gctctgctgatgacccccccag

SEQ ID NO: 4114973 - DNA, 23 bp, Homo sapiens
gctctgctgtgggcacaggtcag

SEQ ID NO: 4114974 - DNA, 21 bp, Homo sapiens
gctctggaaaatgtgacccag

SEQ ID NO: 4114975 - DNA, 22 bp, Homo sapiens
gctctggaaaatgtgacccaga

SEQ ID NO: 4114976 - DNA, 23 bp, Homo sapiens
gctctggacagcagaagcctcca

SEQ ID NO: 4114977 - DNA, 14 bp, Homo sapiens
gctctggcacagtg

SEQ ID NO: 4114978 - DNA, 21 bp, Homo sapiens
gctctgggatagctgacccag

SEQ ID NO: 4114979 - DNA, 20 bp, Homo sapiens
gctctgggccattctccaca

SEQ ID NO: 4114980 - DNA, 23 bp, Homo sapiens
gctctgggccattctccacagca

SEQ ID NO: 4114981 - DNA, 14 bp, Homo sapiens
gctctgtccccaaa

SEQ ID NO: 4114982 - DNA, 16 bp, Homo sapiens
gctctgtcccccaggc

SEQ ID NO: 4114983 - DNA, 15 bp, Homo sapiens
gctctgtgccagaaa

SEQ ID NO: 4114984 - DNA, 22 bp, Homo sapiens
gctctgtgttcccagaggcagg

SEQ ID NO: 4114985 - DNA, 20 bp, Homo sapiens
gctctgttacccaggctgga

SEQ ID NO: 4114986 - DNA, 13 bp, Homo sapiens
gctcttaaatgta

SEQ ID NO: 4114987 - DNA, 19 bp, Homo sapiens
gctataggctggagaagct

SEQ ID NO: 4114988 - DNA, 14 bp, Homo sapiens
gctatatccatgta

SEQ ID NO: 4114989 - DNA, 19 bp, Homo sapiens
gctatatccatgtactgta

SEQ ID NO: 4114990 - DNA, 23 bp, Homo sapiens
gctatatccatgtactgtagttt

SEQ ID NO: 4114991 - DNA, 22 bp, Homo sapiens
gctatccccatctccctgcctg

SEQ ID NO: 4114992 - DNA, 14 bp, Homo sapiens
gctatctaaagttt

SEQ ID NO: 4114993 - DNA, 22 bp, Homo sapiens
gctatctgcactctaaactgca

SEQ ID NO: 4114994 - DNA, 21 bp, Homo sapiens
gctatctggaggccttccagc

SEQ ID NO: 4114995 - DNA, 23 bp, Homo sapiens
gctatggcccagaaacaacaggg

SEQ ID NO: 4114996 - DNA, 22 bp, Homo sapiens
gctatgtatggaatacagtgtt

SEQ ID NO: 4114997 - DNA, 16 bp, Homo sapiens
gctatgttactatttt

SEQ ID NO: 4114998 - DNA, 18 bp, Homo sapiens
gctattcagtaataactc

SEQ ID NO: 4114999 - DNA, 19 bp, Homo sapiens
gctattcagtaataactct

SEQ ID NO: 4115000 - DNA, 20 bp, Homo sapiens
gctattcagtaataactcta

SEQ ID NO: 4115001 - DNA, 12 bp, Homo sapiens
gctattgctgct

SEQ ID NO: 4115002 - DNA, 16 bp, Homo sapiens
gctattgtaaatatgt

SEQ ID NO: 4115003 - DNA, 18 bp, Homo sapiens
gctatttccattccagaa

SEQ ID NO: 4115004 - DNA, 12 bp, Homo sapiens
gctatttgaaat

SEQ ID NO: 4115005 - DNA, 21 bp, Homo sapiens
gctatttgaaatactaaaagc

SEQ ID NO: 4115006 - DNA, 14 bp, Homo sapiens
gctcaaaaggaaac

SEQ ID NO: 4115007 - DNA, 14 bp, Homo sapiens
gctcaaataaaaat

SEQ ID NO: 4115008 - DNA, 14 bp, Homo sapiens
gctcaaatctattc

SEQ ID NO: 4115009 - DNA, 22 bp, Homo sapiens
gctcaaatctattcagacaagc

SEQ ID NO: 4115010 - DNA, 17 bp, Homo sapiens
gctcaaccactgtggcg

SEQ ID NO: 4115011 - DNA, 17 bp, Homo sapiens
gctcaagcaatcctcct

SEQ ID NO: 4115012 - DNA, 19 bp, Homo sapiens
gctcaagcaatcctcctgc

SEQ ID NO: 4115013 - DNA, 16 bp, Homo sapiens
gctcaataaacacttg

SEQ ID NO: 4115014 - DNA, 21 bp, Homo sapiens
gctcaatattcctgaatgaaa

SEQ ID NO: 4115015 - DNA, 16 bp, Homo sapiens
gctcaatcctctaagc

SEQ ID NO: 4115016 - DNA, 14 bp, Homo sapiens
gctcacactccagt

SEQ ID NO: 4115017 - DNA, 19 bp, Homo sapiens
gctcacactccagtggcag

SEQ ID NO: 4115018 - DNA, 20 bp, Homo sapiens
gctcacagtacagcatgtgc

SEQ ID NO: 4115019 - DNA, 22 bp, Homo sapiens
gctcacagtacagcatgtgcct

SEQ ID NO: 4115020 - DNA, 14 bp, Homo sapiens
gctcaccacctgcc

SEQ ID NO: 4115021 - DNA, 20 bp, Homo sapiens
gctcaccagccctgcagccc

SEQ ID NO: 4115022 - DNA, 13 bp, Homo sapiens
gctcacccctggg

SEQ ID NO: 4115023 - DNA, 14 bp, Homo sapiens
gctcacccctgggc

SEQ ID NO: 4115024 - DNA, 19 bp, Homo sapiens
gctcacccctgggcaggcg

SEQ ID NO: 4115025 - DNA, 15 bp, Homo sapiens
gctcaccgctggccc

SEQ ID NO: 4115026 - DNA, 16 bp, Homo sapiens
gctcaccgctggccct

SEQ ID NO: 4115027 - DNA, 19 bp, Homo sapiens
gctcactgcaacctctgcc

SEQ ID NO: 4115028 - DNA, 17 bp, Homo sapiens
gctcactgcagcctcat

SEQ ID NO: 4115029 - DNA, 18 bp, Homo sapiens
gctcactgcagcctcata

SEQ ID NO: 4115030 - DNA, 17 bp, Homo sapiens
gctcactgccaggccag

SEQ ID NO: 4115031 - DNA, 16 bp, Homo sapiens
gctcagaacttgctgc

SEQ ID NO: 4115032 - DNA, 19 bp, Homo sapiens
gctcagaacttgctgctgt

SEQ ID NO: 4115033 - DNA, 19 bp, Homo sapiens
gctcagacggcggccaggc

SEQ ID NO: 4115034 - DNA, 21 bp, Homo sapiens
gctcagacggcggccaggcac

SEQ ID NO: 4115035 - DNA, 22 bp, Homo sapiens
gctcagagactgcaagctgctt

SEQ ID NO: 4115036 - DNA, 18 bp, Homo sapiens
gctcagagatgtgcaccc

SEQ ID NO: 4115037 - DNA, 18 bp, Homo sapiens
gctcagaggcgcactgtg

SEQ ID NO: 4115038 - DNA, 17 bp, Homo sapiens
gctcagatggactggga

SEQ ID NO: 4115039 - DNA, 15 bp, Homo sapiens
gctcagccagcactt

SEQ ID NO: 4115040 - DNA, 18 bp, Homo sapiens
gctcagccccgagctgtc

SEQ ID NO: 4115041 - DNA, 17 bp, Homo sapiens
gctcagccctccctgcc

SEQ ID NO: 4115042 - DNA, 19 bp, Homo sapiens
gctcagccctgactggtgc

SEQ ID NO: 4115043 - DNA, 20 bp, Homo sapiens
gctcagccctgactggtgct

SEQ ID NO: 4115044 - DNA, 15 bp, Homo sapiens
gctcagctcctacct

SEQ ID NO: 4115045 - DNA, 16 bp, Homo sapiens
gctcagctctgggcca

SEQ ID NO: 4115046 - DNA, 14 bp, Homo sapiens
gctcagcttcttcc

SEQ ID NO: 4115047 - DNA, 19 bp, Homo sapiens
gctcagcttcttcctaggt

SEQ ID NO: 4115048 - DNA, 23 bp, Homo sapiens
gctcagggtcaaagacagaatgg

SEQ ID NO: 4115049 - DNA, 14 bp, Homo sapiens
gctcagtctccctt

SEQ ID NO: 4115050 - DNA, 12 bp, Homo sapiens
gctcagtgctct

SEQ ID NO: 4115051 - DNA, 20 bp, Homo sapiens
gctcatacaaaataaatggt

SEQ ID NO: 4115052 - DNA, 19 bp, Homo sapiens
gctcatatggggctgggag

SEQ ID NO: 4115053 - DNA, 14 bp, Homo sapiens
gctcattaaacttt

SEQ ID NO: 4115054 - DNA, 16 bp, Homo sapiens
gctcattatgccactt

SEQ ID NO: 4115055 - DNA, 12 bp, Homo sapiens
gctcatttaagt

SEQ ID NO: 4115056 - DNA, 14 bp, Homo sapiens
gctcatttttgctg

SEQ ID NO: 4115057 - DNA, 14 bp, Homo sapiens
gctccaagacctag

SEQ ID NO: 4115058 - DNA, 17 bp, Homo sapiens
gctccacacacacaaaa

SEQ ID NO: 4115059 - DNA, 19 bp, Homo sapiens
gctccaccctggccgagtc

SEQ ID NO: 4115060 - DNA, 21 bp, Homo sapiens
gctccactcttgatctctctt

SEQ ID NO: 4115061 - DNA, 12 bp, Homo sapiens
gctccactgtca

SEQ ID NO: 4115062 - DNA, 18 bp, Homo sapiens
gctccactgtcaccctcc

SEQ ID NO: 4115063 - DNA, 17 bp, Homo sapiens
gctccagaagatgccag

SEQ ID NO: 4115064 - DNA, 20 bp, Homo sapiens
gctccagaagatgccagctt

SEQ ID NO: 4115065 - DNA, 21 bp, Homo sapiens
gctccagaagatgccagcttc

SEQ ID NO: 4115066 - DNA, 24 bp, Homo sapiens
gctccagaagatgccagcttctct

SEQ ID NO: 4115067 - DNA, 13 bp, Homo sapiens
gctccagacctga

SEQ ID NO: 4115068 - DNA, 14 bp, Homo sapiens
gctccagccatctc

SEQ ID NO: 4115069 - DNA, 16 bp, Homo sapiens
gctccagctgccccgg

SEQ ID NO: 4115070 - DNA, 21 bp, Homo sapiens
gctccagctgccccggcccct

SEQ ID NO: 4115071 - DNA, 17 bp, Homo sapiens
gctccagctttctgcca

SEQ ID NO: 4115072 - DNA, 12 bp, Homo sapiens
gctccaggcagc

SEQ ID NO: 4115073 - DNA, 15 bp, Homo sapiens
gctccaggcagcacc

SEQ ID NO: 4115074 - DNA, 19 bp, Homo sapiens
gctccaggcctgcagcagg

SEQ ID NO: 4115075 - DNA, 16 bp, Homo sapiens
gctccaggtggctctg

SEQ ID NO: 4115076 - DNA, 21 bp, Homo sapiens
gctccaggtggctctgaggtg

SEQ ID NO: 4115077 - DNA, 13 bp, Homo sapiens
gctcccacagaac

SEQ ID NO: 4115078 - DNA, 15 bp, Homo sapiens
gctcccacaggccct

SEQ ID NO: 4115079 - DNA, 12 bp, Homo sapiens
gctcccagcagc

SEQ ID NO: 4115080 - DNA, 23 bp, Homo sapiens
gctcccagcagccctaaggatct

SEQ ID NO: 4115081 - DNA, 12 bp, Homo sapiens
gctcccagcctg

SEQ ID NO: 4115082 - DNA, 14 bp, Homo sapiens
gctcccagcctgct

SEQ ID NO: 4115083 - DNA, 18 bp, Homo sapiens
gctcccaggggtctccct

SEQ ID NO: 4115084 - DNA, 22 bp, Homo sapiens
gctcccaggggtctccctggct

SEQ ID NO: 4115085 - DNA, 22 bp, Homo sapiens
gctcccatcattccttctggcc

SEQ ID NO: 4115086 - DNA, 19 bp, Homo sapiens
gctccccagccctggctct

SEQ ID NO: 4115087 - DNA, 22 bp, Homo sapiens
gctccccagccctggctctgca

SEQ ID NO: 4115088 - DNA, 15 bp, Homo sapiens
gctcccccaggctgt

SEQ ID NO: 4115089 - DNA, 11 bp, Homo sapiens
gctccccccag

SEQ ID NO: 4115090 - DNA, 18 bp, Homo sapiens
gcggtggactgcgctgga

SEQ ID NO: 4115091 - DNA, 18 bp, Homo sapiens
gcggtggctcacgcctgt

SEQ ID NO: 4115092 - DNA, 16 bp, Homo sapiens
gcggtggctgccccgg

SEQ ID NO: 4115093 - DNA, 21 bp, Homo sapiens
gcggtggctgccccggcctcc

SEQ ID NO: 4115094 - DNA, 20 bp, Homo sapiens
gcgtagcgtgcccgtgtgca

SEQ ID NO: 4115095 - DNA, 14 bp, Homo sapiens
gcgtcagctgctcc

SEQ ID NO: 4115096 - DNA, 21 bp, Homo sapiens
gcgtcagggttggtgtgctga

SEQ ID NO: 4115097 - DNA, 15 bp, Homo sapiens
gcgtcatctggtcct

SEQ ID NO: 4115098 - DNA, 19 bp, Homo sapiens
gcgtcccagtctctggcag

SEQ ID NO: 4115099 - DNA, 11 bp, Homo sapiens
gcgtccctggc

SEQ ID NO: 4115100 - DNA, 21 bp, Homo sapiens
gcgtctcctgtttttctgggt

SEQ ID NO: 4115101 - DNA, 20 bp, Homo sapiens
gcgtgaaacacaccaggctg

SEQ ID NO: 4115102 - DNA, 13 bp, Homo sapiens
gcgtgacaataaa

SEQ ID NO: 4115103 - DNA, 21 bp, Homo sapiens
gcgtgccgtgtgagtgtgaca

SEQ ID NO: 4115104 - DNA, 24 bp, Homo sapiens
gcgtgccgtgtgagtgtgacaggg

SEQ ID NO: 4115105 - DNA, 23 bp, Homo sapiens
gcgtgctagaggttgcagcatga

SEQ ID NO: 4115106 - DNA, 12 bp, Homo sapiens
gcgtggaaaaag

SEQ ID NO: 4115107 - DNA, 22 bp, Homo sapiens
gcgtggcccaccaggcccccct

SEQ ID NO: 4115108 - DNA, 15 bp, Homo sapiens
gcgtggttcctttct

SEQ ID NO: 4115109 - DNA, 15 bp, Homo sapiens
gcgtgtgtagagtta

SEQ ID NO: 4115110 - DNA, 20 bp, Homo sapiens
gcgtgtgtagagttaagaag

SEQ ID NO: 4115111 - DNA, 13 bp, Homo sapiens
gcgttcctttctt

SEQ ID NO: 4115112 - DNA, 19 bp, Homo sapiens
gcgttgttgcatgtttgaa

SEQ ID NO: 4115113 - DNA, 23 bp, Homo sapiens
gcgttgttgcatgtttgaaatga

SEQ ID NO: 4115114 - DNA, 20 bp, Homo sapiens
gcgtttcaccatgttggcca

SEQ ID NO: 4115115 - DNA, 22 bp, Homo sapiens
gcgtttgaccttttatgtagta

SEQ ID NO: 4115116 - DNA, 14 bp, Homo sapiens
gcgtttttacagtt

SEQ ID NO: 4115117 - DNA, 22 bp, Homo sapiens
gctaaagagcccttgcctcccc

SEQ ID NO: 4115118 - DNA, 19 bp, Homo sapiens
gctaaattctatgttaaat

SEQ ID NO: 4115119 - DNA, 13 bp, Homo sapiens
gctaaattttctg

SEQ ID NO: 4115120 - DNA, 20 bp, Homo sapiens
gctaacatggtgaaaccccg

SEQ ID NO: 4115121 - DNA, 14 bp, Homo sapiens
gctaacctggaaag

SEQ ID NO: 4115122 - DNA, 16 bp, Homo sapiens
gctaagaacctggaac

SEQ ID NO: 4115123 - DNA, 17 bp, Homo sapiens
gctaagaacctggaact

SEQ ID NO: 4115124 - DNA, 23 bp, Homo sapiens
gctaagaacctggaacttgggga

SEQ ID NO: 4115125 - DNA, 22 bp, Homo sapiens
gctaagggaagacatttctttt

SEQ ID NO: 4115126 - DNA, 23 bp, Homo sapiens
gctaagggaagacatttcttttc

SEQ ID NO: 4115127 - DNA, 20 bp, Homo sapiens
gctaagggtgggtgctcaga

SEQ ID NO: 4115128 - DNA, 21 bp, Homo sapiens
gctaagggtgggtgctcagaa

SEQ ID NO: 4115129 - DNA, 18 bp, Homo sapiens
gctaagtaaatctcttct

SEQ ID NO: 4115130 - DNA, 21 bp, Homo sapiens
gctaagtacacaataagcaaa

SEQ ID NO: 4115131 - DNA, 22 bp, Homo sapiens
gctaagtacacaataagcaaaa

SEQ ID NO: 4115132 - DNA, 18 bp, Homo sapiens
gctaagtgaaaaggtcat

SEQ ID NO: 4115133 - DNA, 22 bp, Homo sapiens
gctaataaaattcgctttctaa

SEQ ID NO: 4115134 - DNA, 23 bp, Homo sapiens
gctaataaaattcgctttctaaa

SEQ ID NO: 4115135 - DNA, 11 bp, Homo sapiens
gctaataaact

SEQ ID NO: 4115136 - DNA, 11 bp, Homo sapiens
gctaataaatc

SEQ ID NO: 4115137 - DNA, 21 bp, Homo sapiens
gctaatacctcttactttgct

SEQ ID NO: 4115138 - DNA, 21 bp, Homo sapiens
gctaatcaaagccagggtctc

SEQ ID NO: 4115139 - DNA, 14 bp, Homo sapiens
gctaatcagcattc

SEQ ID NO: 4115140 - DNA, 17 bp, Homo sapiens
gctaatcagcattctca

SEQ ID NO: 4115141 - DNA, 22 bp, Homo sapiens
gctaatcagcattctcactcct

SEQ ID NO: 4115142 - DNA, 22 bp, Homo sapiens
gctaatttagagataggaaact

SEQ ID NO: 4115143 - DNA, 12 bp, Homo sapiens
gctaatttgcat

SEQ ID NO: 4115144 - DNA, 17 bp, Homo sapiens
gctaattttctcaaaag

SEQ ID NO: 4115145 - DNA, 19 bp, Homo sapiens
gctaattttctcaaaagca

SEQ ID NO: 4115146 - DNA, 12 bp, Homo sapiens
gctacagagccg

SEQ ID NO: 4115147 - DNA, 19 bp, Homo sapiens
gctacagcaatttctaatt

SEQ ID NO: 4115148 - DNA, 20 bp, Homo sapiens
gctacaggaagcaccccatg

SEQ ID NO: 4115149 - DNA, 11 bp, Homo sapiens
gctacaggagg

SEQ ID NO: 4115150 - DNA, 15 bp, Homo sapiens
gctacaggaggggtc

SEQ ID NO: 4115151 - DNA, 14 bp, Homo sapiens
gctacatcccagcc

SEQ ID NO: 4115152 - DNA, 13 bp, Homo sapiens
gctaccactggta

SEQ ID NO: 4115153 - DNA, 16 bp, Homo sapiens
gctaccctttttctcc

SEQ ID NO: 4115154 - DNA, 22 bp, Homo sapiens
gctaccctttttctccagctgg

SEQ ID NO: 4115155 - DNA, 16 bp, Homo sapiens
gctaccgccctgggct

SEQ ID NO: 4115156 - DNA, 17 bp, Homo sapiens
gctacgcctcttctgtc

SEQ ID NO: 4115157 - DNA, 22 bp, Homo sapiens
gctactaagttcacattagaat

SEQ ID NO: 4115158 - DNA, 16 bp, Homo sapiens
gctactaatgatgttt

SEQ ID NO: 4115159 - DNA, 18 bp, Homo sapiens
gctactaatgatgttttc

SEQ ID NO: 4115160 - DNA, 19 bp, Homo sapiens
gctactcgtgagcgccagt

SEQ ID NO: 4115161 - DNA, 22 bp, Homo sapiens
gctactctccccacgagggctg

SEQ ID NO: 4115162 - DNA, 21 bp, Homo sapiens
gctactgcactccagcctggg

SEQ ID NO: 4115163 - DNA, 15 bp, Homo sapiens
gctactgtgtgtgtg

SEQ ID NO: 4115164 - DNA, 19 bp, Homo sapiens
gctactgtgtgtgtgaatg

SEQ ID NO: 4115165 - DNA, 16 bp, Homo sapiens
gctacttgggaggctg

SEQ ID NO: 4115166 - DNA, 19 bp, Homo sapiens
gctagaggccagccccacc

SEQ ID NO: 4115167 - DNA, 19 bp, Homo sapiens
gctagaggttgcagcatga

SEQ ID NO: 4115168 - DNA, 19 bp, Homo sapiens
gctagcaaatggcagaacc

SEQ ID NO: 4115169 - DNA, 15 bp, Homo sapiens
gctagcacagctccc

SEQ ID NO: 4115170 - DNA, 12 bp, Homo sapiens
gctagcttctgc

SEQ ID NO: 4115171 - DNA, 18 bp, Homo sapiens
gctagcttctgcttttct

SEQ ID NO: 4115172 - DNA, 22 bp, Homo sapiens
gctagcttctgcttttctgccc

SEQ ID NO: 4115173 - DNA, 19 bp, Homo sapiens
gctagcttgacacagtcag

SEQ ID NO: 4115174 - DNA, 21 bp, Homo sapiens
gctagcttgacacagtcagca

SEQ ID NO: 4115175 - DNA, 19 bp, Homo sapiens
gctaggcagggtgtctgcc

SEQ ID NO: 4115176 - DNA, 20 bp, Homo sapiens
gctaggcagggtgtctgccc

SEQ ID NO: 4115177 - DNA, 18 bp, Homo sapiens
gctaggcgagtgccagga

SEQ ID NO: 4115178 - DNA, 21 bp, Homo sapiens
gctaggcgagtgccaggactc

SEQ ID NO: 4115179 - DNA, 11 bp, Homo sapiens
gctagtatttg

SEQ ID NO: 4115180 - DNA, 14 bp, Homo sapiens
gctagtatttgaat

SEQ ID NO: 4115181 - DNA, 15 bp, Homo sapiens
gctagtatttgaatt

SEQ ID NO: 4115182 - DNA, 18 bp, Homo sapiens
gctagtatttgaattaaa

SEQ ID NO: 4115183 - DNA, 14 bp, Homo sapiens
gctagtgacttgtg

SEQ ID NO: 4115184 - DNA, 21 bp, Homo sapiens
gctagtgacttgtgtcccatg

SEQ ID NO: 4115185 - DNA, 13 bp, Homo sapiens
gctagtgccttta

SEQ ID NO: 4115186 - DNA, 22 bp, Homo sapiens
gctagtgggccctctctctggg

SEQ ID NO: 4115187 - DNA, 23 bp, Homo sapiens
gctagtgggccctctctctgggc

SEQ ID NO: 4115188 - DNA, 13 bp, Homo sapiens
gctagtgtttcta

SEQ ID NO: 4115189 - DNA, 22 bp, Homo sapiens
gctagtgtttctagctaaataa

SEQ ID NO: 4115190 - DNA, 21 bp, Homo sapiens
gctagttttacagattgcctc

SEQ ID NO: 4115191 - DNA, 20 bp, Homo sapiens
gctataatcattagttttag

SEQ ID NO: 4115192 - DNA, 12 bp, Homo sapiens
gcctttcatagt

SEQ ID NO: 4115193 - DNA, 21 bp, Homo sapiens
gcctttccataaggaatgtag

SEQ ID NO: 4115194 - DNA, 21 bp, Homo sapiens
gcctttcccaccctcctgccc

SEQ ID NO: 4115195 - DNA, 14 bp, Homo sapiens
gcctttccttccct

SEQ ID NO: 4115196 - DNA, 20 bp, Homo sapiens
gcctttccttccctctctga

SEQ ID NO: 4115197 - DNA, 14 bp, Homo sapiens
gcctttctaagact

SEQ ID NO: 4115198 - DNA, 12 bp, Homo sapiens
gcctttctggga

SEQ ID NO: 4115199 - DNA, 22 bp, Homo sapiens
gcctttcttgtagccatggctg

SEQ ID NO: 4115200 - DNA, 13 bp, Homo sapiens
gcctttctttgcc

SEQ ID NO: 4115201 - DNA, 15 bp, Homo sapiens
gcctttgacatttaa

SEQ ID NO: 4115202 - DNA, 22 bp, Homo sapiens
gcctttgcagttggactctcag

SEQ ID NO: 4115203 - DNA, 14 bp, Homo sapiens
gcctttgcatttat

SEQ ID NO: 4115204 - DNA, 12 bp, Homo sapiens
gcctttggcctg

SEQ ID NO: 4115205 - DNA, 11 bp, Homo sapiens
gcctttgtaag

SEQ ID NO: 4115206 - DNA, 15 bp, Homo sapiens
gcctttgtaagttat

SEQ ID NO: 4115207 - DNA, 22 bp, Homo sapiens
gcctttgtgctgcgcctgcagg

SEQ ID NO: 4115208 - DNA, 22 bp, Homo sapiens
gccttttatcccaaagttgttg

SEQ ID NO: 4115209 - DNA, 16 bp, Homo sapiens
gccttttgcagaagag

SEQ ID NO: 4115210 - DNA, 14 bp, Homo sapiens
gccttttgctctct

SEQ ID NO: 4115211 - DNA, 18 bp, Homo sapiens
gccttttgctctctgtga

SEQ ID NO: 4115212 - DNA, 20 bp, Homo sapiens
gccttttgctctctgtgacc

SEQ ID NO: 4115213 - DNA, 15 bp, Homo sapiens
gccttttgctgcgca

SEQ ID NO: 4115214 - DNA, 17 bp, Homo sapiens
gccttttgctgcgcacc

SEQ ID NO: 4115215 - DNA, 17 bp, Homo sapiens
gcgaaataaaaatggca

SEQ ID NO: 4115216 - DNA, 22 bp, Homo sapiens
gcgaagaccctcttgcccatcc

SEQ ID NO: 4115217 - DNA, 10 bp, Homo sapiens
gcgacctcct

SEQ ID NO: 4115218 - DNA, 23 bp, Homo sapiens
gcgaccttcctcatccaccccat

SEQ ID NO: 4115219 - DNA, 13 bp, Homo sapiens
gcgactaatttca

SEQ ID NO: 4115220 - DNA, 21 bp, Homo sapiens
gcgactaatttcaaaatgctt

SEQ ID NO: 4115221 - DNA, 22 bp, Homo sapiens
gcgagacgcacacagctgagca

SEQ ID NO: 4115222 - DNA, 15 bp, Homo sapiens
gcgagaggcagagaa

SEQ ID NO: 4115223 - DNA, 16 bp, Homo sapiens
gcgagcatcctggcca

SEQ ID NO: 4115224 - DNA, 17 bp, Homo sapiens
gcgagtctggggacctg

SEQ ID NO: 4115225 - DNA, 15 bp, Homo sapiens
gcgagtgccaggact

SEQ ID NO: 4115226 - DNA, 21 bp, Homo sapiens
gcgatccacctgtctcagcct

SEQ ID NO: 4115227 - DNA, 23 bp, Homo sapiens
gcgatgctccctcagcctcagag

SEQ ID NO: 4115228 - DNA, 18 bp, Homo sapiens
gcgatggggcaagacaga

SEQ ID NO: 4115229 - DNA, 21 bp, Homo sapiens
gcgatgtttcaggaggctgga

SEQ ID NO: 4115230 - DNA, 16 bp, Homo sapiens
gcgcaccaatgcccag

SEQ ID NO: 4115231 - DNA, 17 bp, Homo sapiens
gcgcaccccacgccctg

SEQ ID NO: 4115232 - DNA, 20 bp, Homo sapiens
gcgcatcaatgtattttatc

SEQ ID NO: 4115233 - DNA, 17 bp, Homo sapiens
gcgccaccgtgcctggc

SEQ ID NO: 4115234 - DNA, 14 bp, Homo sapiens
gcgccaggaagcca

SEQ ID NO: 4115235 - DNA, 15 bp, Homo sapiens
gcgccaggaagccag

SEQ ID NO: 4115236 - DNA, 19 bp, Homo sapiens
gcgccaggaagccagagcc

SEQ ID NO: 4115237 - DNA, 21 bp, Homo sapiens
gcgccaggaagccagagcccc

SEQ ID NO: 4115238 - DNA, 19 bp, Homo sapiens
gcgcctactcttcagggtc

SEQ ID NO: 4115239 - DNA, 15 bp, Homo sapiens
gcgcctcagccctca

SEQ ID NO: 4115240 - DNA, 17 bp, Homo sapiens
gcgcctcagccctcagt

SEQ ID NO: 4115241 - DNA, 12 bp, Homo sapiens
gcgcctccagag

SEQ ID NO: 4115242 - DNA, 15 bp, Homo sapiens
gcgcctgcaggcaga

SEQ ID NO: 4115243 - DNA, 19 bp, Homo sapiens
gcgcctgcaggcagagctg

SEQ ID NO: 4115244 - DNA, 21 bp, Homo sapiens
gcgcctgcaggcagagctgga

SEQ ID NO: 4115245 - DNA, 19 bp, Homo sapiens
gcgcctgctccctccagaa

SEQ ID NO: 4115246 - DNA, 12 bp, Homo sapiens
gcgcctgctgcc

SEQ ID NO: 4115247 - DNA, 21 bp, Homo sapiens
gcgcgatcccacacaggctgg

SEQ ID NO: 4115248 - DNA, 18 bp, Homo sapiens
gcgcgccaccgtgcctgg

SEQ ID NO: 4115249 - DNA, 13 bp, Homo sapiens
gcgcggccagccc

SEQ ID NO: 4115250 - DNA, 15 bp, Homo sapiens
gcgcggccagccccg

SEQ ID NO: 4115251 - DNA, 13 bp, Homo sapiens
gcgcggtggctca

SEQ ID NO: 4115252 - DNA, 14 bp, Homo sapiens
gcgctcagacggcg

SEQ ID NO: 4115253 - DNA, 20 bp, Homo sapiens
gcgctcagacggcggccagg

SEQ ID NO: 4115254 - DNA, 22 bp, Homo sapiens
gcgctcagacggcggccaggca

SEQ ID NO: 4115255 - DNA, 22 bp, Homo sapiens
gcgctggacgatagcttggagg

SEQ ID NO: 4115256 - DNA, 21 bp, Homo sapiens
gcgctggtcccctccctctgt

SEQ ID NO: 4115257 - DNA, 13 bp, Homo sapiens
gcgcttcccaact

SEQ ID NO: 4115258 - DNA, 14 bp, Homo sapiens
gcggagaggaagcc

SEQ ID NO: 4115259 - DNA, 19 bp, Homo sapiens
gcggagaggaagccagctg

SEQ ID NO: 4115260 - DNA, 20 bp, Homo sapiens
gcggagaggaagccagctgg

SEQ ID NO: 4115261 - DNA, 16 bp, Homo sapiens
gcggagagtacagtga

SEQ ID NO: 4115262 - DNA, 15 bp, Homo sapiens
gcggaggctgtgctc

SEQ ID NO: 4115263 - DNA, 16 bp, Homo sapiens
gcggaggctgtgtgcc

SEQ ID NO: 4115264 - DNA, 18 bp, Homo sapiens
gcggaggctgtgtgcctg

SEQ ID NO: 4115265 - DNA, 17 bp, Homo sapiens
gcggcaaacctttcccc

SEQ ID NO: 4115266 - DNA, 23 bp, Homo sapiens
gcggcaaacctttcccccttagc

SEQ ID NO: 4115267 - DNA, 21 bp, Homo sapiens
gcggcagacgggaggggaaag

SEQ ID NO: 4115268 - DNA, 19 bp, Homo sapiens
gcggccacgcactgggcca

SEQ ID NO: 4115269 - DNA, 20 bp, Homo sapiens
gcggccagccccggccctgg

SEQ ID NO: 4115270 - DNA, 21 bp, Homo sapiens
gcggccagccccggccctggg

SEQ ID NO: 4115271 - DNA, 14 bp, Homo sapiens
gcggccccaggagg

SEQ ID NO: 4115272 - DNA, 13 bp, Homo sapiens
gcggcccctcccg

SEQ ID NO: 4115273 - DNA, 15 bp, Homo sapiens
gcggcccggccagcg

SEQ ID NO: 4115274 - DNA, 16 bp, Homo sapiens
gcggcccggccagcgg

SEQ ID NO: 4115275 - DNA, 21 bp, Homo sapiens
gcggcccggccagcgggcaca

SEQ ID NO: 4115276 - DNA, 12 bp, Homo sapiens
gcggcctccaca

SEQ ID NO: 4115277 - DNA, 17 bp, Homo sapiens
gcggcgatttttgtatg

SEQ ID NO: 4115278 - DNA, 14 bp, Homo sapiens
gcggctactctgga

SEQ ID NO: 4115279 - DNA, 20 bp, Homo sapiens
gcggctcccctctgcttctc

SEQ ID NO: 4115280 - DNA, 22 bp, Homo sapiens
gcggctcccctctgcttctcat

SEQ ID NO: 4115281 - DNA, 23 bp, Homo sapiens
gcgggacgagaccctacaggaga

SEQ ID NO: 4115282 - DNA, 16 bp, Homo sapiens
gcgggagacctgtgct

SEQ ID NO: 4115283 - DNA, 17 bp, Homo sapiens
gcgggagacctgtgcta

SEQ ID NO: 4115284 - DNA, 13 bp, Homo sapiens
gcgggcacagggc

SEQ ID NO: 4115285 - DNA, 15 bp, Homo sapiens
gcgggcacagggcac

SEQ ID NO: 4115286 - DNA, 16 bp, Homo sapiens
gcgggcagagggctgg

SEQ ID NO: 4115287 - DNA, 13 bp, Homo sapiens
gcgggcagcgggc

SEQ ID NO: 4115288 - DNA, 16 bp, Homo sapiens
gcgggcagcgggccag

SEQ ID NO: 4115289 - DNA, 11 bp, Homo sapiens
gcgggccaggc

SEQ ID NO: 4115290 - DNA, 13 bp, Homo sapiens
gcgggccaggccc

SEQ ID NO: 4115291 - DNA, 18 bp, Homo sapiens
gcgggctgaggccagagt

SEQ ID NO: 4115292 - DNA, 23 bp, Homo sapiens
gcggtagccagcacacagggcag

SEQ ID NO: 4115293 - DNA, 17 bp, Homo sapiens
gcggtcaggctgggcag

SEQ ID NO: 4115294 - DNA, 16 bp, Homo sapiens
gcggtccccatcccca

SEQ ID NO: 4115295 - DNA, 14 bp, Homo sapiens
gctcttactctttc

SEQ ID NO: 4115296 - DNA, 18 bp, Homo sapiens
gctcttcaggcctccctc

SEQ ID NO: 4115297 - DNA, 17 bp, Homo sapiens
gctcttgatacccccct

SEQ ID NO: 4115298 - DNA, 13 bp, Homo sapiens
gctcttggccttt

SEQ ID NO: 4115299 - DNA, 13 bp, Homo sapiens
gctcttggctgac

SEQ ID NO: 4115300 - DNA, 17 bp, Homo sapiens
gctcttggctgacccct

SEQ ID NO: 4115301 - DNA, 23 bp, Homo sapiens
gctcttgtcctcagtccatttat

SEQ ID NO: 4115302 - DNA, 21 bp, Homo sapiens
gctctttatgaatgaaaaaac

SEQ ID NO: 4115303 - DNA, 22 bp, Homo sapiens
gctctttcccacccagcctggg

SEQ ID NO: 4115304 - DNA, 19 bp, Homo sapiens
gctctttctacatgactgg

SEQ ID NO: 4115305 - DNA, 22 bp, Homo sapiens
gctctttctacatgactgggcc

SEQ ID NO: 4115306 - DNA, 15 bp, Homo sapiens
gctctttctctgcca

SEQ ID NO: 4115307 - DNA, 21 bp, Homo sapiens
gctctttctctgccagtgaca

SEQ ID NO: 4115308 - DNA, 23 bp, Homo sapiens
gctctttgaaatagtctgtgtga

SEQ ID NO: 4115309 - DNA, 15 bp, Homo sapiens
gctcttttaagcagt

SEQ ID NO: 4115310 - DNA, 21 bp, Homo sapiens
gctcttttttgtttgtttctt

SEQ ID NO: 4115311 - DNA, 13 bp, Homo sapiens
gctgaacacacac

SEQ ID NO: 4115312 - DNA, 14 bp, Homo sapiens
gctgaacacacaca

SEQ ID NO: 4115313 - DNA, 13 bp, Homo sapiens
gctgaatgcctcc

SEQ ID NO: 4115314 - DNA, 19 bp, Homo sapiens
gctgaatgcctcctgtggg

SEQ ID NO: 4115315 - DNA, 16 bp, Homo sapiens
gctgaccaattgtgct

SEQ ID NO: 4115316 - DNA, 22 bp, Homo sapiens
gctgacccagccccttgagaaa

SEQ ID NO: 4115317 - DNA, 18 bp, Homo sapiens
gctgaccccaaagagcct

SEQ ID NO: 4115318 - DNA, 21 bp, Homo sapiens
gctgacccggcctctctgccc

SEQ ID NO: 4115319 - DNA, 15 bp, Homo sapiens
gctgactagaagggc

SEQ ID NO: 4115320 - DNA, 13 bp, Homo sapiens
gctgactggggct

SEQ ID NO: 4115321 - DNA, 15 bp, Homo sapiens
gctgactggggctgg

SEQ ID NO: 4115322 - DNA, 17 bp, Homo sapiens
gctgactggggctgggg

SEQ ID NO: 4115323 - DNA, 21 bp, Homo sapiens
gctgactgtactcctcccagg

SEQ ID NO: 4115324 - DNA, 16 bp, Homo sapiens
gctgactgtcctctcc

SEQ ID NO: 4115325 - DNA, 18 bp, Homo sapiens
gctgactgtcctctcccc

SEQ ID NO: 4115326 - DNA, 13 bp, Homo sapiens
gctgactgtggcc

SEQ ID NO: 4115327 - DNA, 24 bp, Homo sapiens
gctgacttcatctcccacctagca

SEQ ID NO: 4115328 - DNA, 15 bp, Homo sapiens
gctgacttcatctgg

SEQ ID NO: 4115329 - DNA, 15 bp, Homo sapiens
gctgagaactcctga

SEQ ID NO: 4115330 - DNA, 20 bp, Homo sapiens
gctgagcacttagcaggcac

SEQ ID NO: 4115331 - DNA, 20 bp, Homo sapiens
gctgagcagcctctggacag

SEQ ID NO: 4115332 - DNA, 15 bp, Homo sapiens
gctgagccctgggga

SEQ ID NO: 4115333 - DNA, 16 bp, Homo sapiens
gctgagccctggggac

SEQ ID NO: 4115334 - DNA, 17 bp, Homo sapiens
gctgagccttcagagta

SEQ ID NO: 4115335 - DNA, 16 bp, Homo sapiens
gctgagccttctgagc

SEQ ID NO: 4115336 - DNA, 15 bp, Homo sapiens
gctgaggcaggagga

SEQ ID NO: 4115337 - DNA, 15 bp, Homo sapiens
gctgaggctggcaca

SEQ ID NO: 4115338 - DNA, 16 bp, Homo sapiens
gctgagggcagactgg

SEQ ID NO: 4115339 - DNA, 15 bp, Homo sapiens
gctgagggctgccag

SEQ ID NO: 4115340 - DNA, 21 bp, Homo sapiens
gctgaggggggccgtgcccag

SEQ ID NO: 4115341 - DNA, 19 bp, Homo sapiens
gctgagggtgtttcttcct

SEQ ID NO: 4115342 - DNA, 14 bp, Homo sapiens
gctgaggtgtctgg

SEQ ID NO: 4115343 - DNA, 15 bp, Homo sapiens
gctgaggtgtctggc

SEQ ID NO: 4115344 - DNA, 13 bp, Homo sapiens
gctgaggttcctc

SEQ ID NO: 4115345 - DNA, 17 bp, Homo sapiens
gctgaggttcctctgcc

SEQ ID NO: 4115346 - DNA, 21 bp, Homo sapiens
gctgaggttcctctgcctgcc

SEQ ID NO: 4115347 - DNA, 22 bp, Homo sapiens
gctgaggttcctctgcctgccc

SEQ ID NO: 4115348 - DNA, 23 bp, Homo sapiens
gctgagtcatctgttagggcctt

SEQ ID NO: 4115349 - DNA, 15 bp, Homo sapiens
gctgagtccgacctg

SEQ ID NO: 4115350 - DNA, 16 bp, Homo sapiens
gctgagtgagccacag

SEQ ID NO: 4115351 - DNA, 15 bp, Homo sapiens
gctgagtggccagcc

SEQ ID NO: 4115352 - DNA, 23 bp, Homo sapiens
gctgagtggccagccagtgccat

SEQ ID NO: 4115353 - DNA, 11 bp, Homo sapiens
gctgagtttcc

SEQ ID NO: 4115354 - DNA, 16 bp, Homo sapiens
gctgataaatttaatc

SEQ ID NO: 4115355 - DNA, 17 bp, Homo sapiens
gctgataagcattgact

SEQ ID NO: 4115356 - DNA, 14 bp, Homo sapiens
gctgatacttcatt

SEQ ID NO: 4115357 - DNA, 15 bp, Homo sapiens
gctgatataaattct

SEQ ID NO: 4115358 - DNA, 20 bp, Homo sapiens
gctgatcatcgccagaggtg

SEQ ID NO: 4115359 - DNA, 15 bp, Homo sapiens
gctgatgattttgca

SEQ ID NO: 4115360 - DNA, 14 bp, Homo sapiens
gctgatggcagctg

SEQ ID NO: 4115361 - DNA, 20 bp, Homo sapiens
gctgattttaacaataacta

SEQ ID NO: 4115362 - DNA, 16 bp, Homo sapiens
gctgcaagccagggat

SEQ ID NO: 4115363 - DNA, 17 bp, Homo sapiens
gctgcaatgcctagact

SEQ ID NO: 4115364 - DNA, 14 bp, Homo sapiens
gctgcaccagagca

SEQ ID NO: 4115365 - DNA, 13 bp, Homo sapiens
gctgcacccaact

SEQ ID NO: 4115366 - DNA, 20 bp, Homo sapiens
gctgcaccctgcgcctccag

SEQ ID NO: 4115367 - DNA, 21 bp, Homo sapiens
gctgcaccctgcgcctccaga

SEQ ID NO: 4115368 - DNA, 20 bp, Homo sapiens
gctgcagccccttgctctca

SEQ ID NO: 4115369 - DNA, 12 bp, Homo sapiens
gctgcagcctgg

SEQ ID NO: 4115370 - DNA, 13 bp, Homo sapiens
gctgcagcctggc

SEQ ID NO: 4115371 - DNA, 14 bp, Homo sapiens
gctgcagcctggct

SEQ ID NO: 4115372 - DNA, 17 bp, Homo sapiens
gctgcagcctggctggt

SEQ ID NO: 4115373 - DNA, 17 bp, Homo sapiens
gctgcaggacttgagaa

SEQ ID NO: 4115374 - DNA, 17 bp, Homo sapiens
gctgcagggccactgga

SEQ ID NO: 4115375 - DNA, 16 bp, Homo sapiens
gctgcaggtgccaggg

SEQ ID NO: 4115376 - DNA, 22 bp, Homo sapiens
gctgcatctgggattcccacca

SEQ ID NO: 4115377 - DNA, 22 bp, Homo sapiens
gctgcatggggtggggtagggc

SEQ ID NO: 4115378 - DNA, 14 bp, Homo sapiens
gctgccaaccctcc

SEQ ID NO: 4115379 - DNA, 14 bp, Homo sapiens
gctgccaccagccc

SEQ ID NO: 4115380 - DNA, 16 bp, Homo sapiens
gctgccaccagccccc

SEQ ID NO: 4115381 - DNA, 14 bp, Homo sapiens
gctgccagcacaga

SEQ ID NO: 4115382 - DNA, 16 bp, Homo sapiens
gctgccagcagccccg

SEQ ID NO: 4115383 - DNA, 16 bp, Homo sapiens
gctgccagcccagaac

SEQ ID NO: 4115384 - DNA, 22 bp, Homo sapiens
gctgccagccttgagccctggc

SEQ ID NO: 4115385 - DNA, 15 bp, Homo sapiens
gctgccagtaccagc

SEQ ID NO: 4115386 - DNA, 20 bp, Homo sapiens
gctgccagtgcagccactgg

SEQ ID NO: 4115387 - DNA, 16 bp, Homo sapiens
gctgccagtgctggtc

SEQ ID NO: 4115388 - DNA, 17 bp, Homo sapiens
gctgccatgtgaagagg

SEQ ID NO: 4115389 - DNA, 16 bp, Homo sapiens
gctgcccaatctccat

SEQ ID NO: 4115390 - DNA, 12 bp, Homo sapiens
gctgcccaggag

SEQ ID NO: 4115391 - DNA, 17 bp, Homo sapiens
gctgcccatcatgtggc

SEQ ID NO: 4115392 - DNA, 14 bp, Homo sapiens
gctgccccagctga

SEQ ID NO: 4115393 - DNA, 15 bp, Homo sapiens
gctgccccagctgac

SEQ ID NO: 4115394 - DNA, 21 bp, Homo sapiens
gctgccccagctgactgtggc

SEQ ID NO: 4115395 - DNA, 23 bp, Homo sapiens
gctgcccccggccccctggtctc

SEQ ID NO: 4115396 - DNA, 13 bp, Homo sapiens
gctgccccggccc

SEQ ID NO: 4115397 - DNA, 13 bp, Homo sapiens
gctgcccctctca

SEQ ID NO: 4115398 - DNA, 13 bp, Homo sapiens
gctgcccctgcct

SEQ ID NO: 4115399 - DNA, 16 bp, Homo sapiens
gctgccctatgggcct

SEQ ID NO: 4115400 - DNA, 18 bp, Homo sapiens
gctgccctggtgctgcca

SEQ ID NO: 4115401 - DNA, 15 bp, Homo sapiens
gctgccgaggaccct

SEQ ID NO: 4115402 - DNA, 13 bp, Homo sapiens
gctgccgctgcac

SEQ ID NO: 4115403 - DNA, 19 bp, Homo sapiens
gctgccgggcctgatttgg

SEQ ID NO: 4115404 - DNA, 15 bp, Homo sapiens
gctgcctcctgcgcc

SEQ ID NO: 4115405 - DNA, 11 bp, Homo sapiens
gctgcctctgg

SEQ ID NO: 4115406 - DNA, 13 bp, Homo sapiens
gctgcctgaatcc

SEQ ID NO: 4115407 - DNA, 21 bp, Homo sapiens
gctgcctgacactgagcccca

SEQ ID NO: 4115408 - DNA, 22 bp, Homo sapiens
gctgcctgacactgagccccac

SEQ ID NO: 4115409 - DNA, 14 bp, Homo sapiens
gctgcctgcttggc

SEQ ID NO: 4115410 - DNA, 18 bp, Homo sapiens
gctgcctgcttggcccgg

SEQ ID NO: 4115411 - DNA, 19 bp, Homo sapiens
gctgcctgcttggcccggc

SEQ ID NO: 4115412 - DNA, 12 bp, Homo sapiens
gctgcctgggcc

SEQ ID NO: 4115413 - DNA, 13 bp, Homo sapiens
gctgccttcccta

SEQ ID NO: 4115414 - DNA, 16 bp, Homo sapiens
gctgccttccctagct

SEQ ID NO: 4115415 - DNA, 16 bp, Homo sapiens
gctgccttctttccat

SEQ ID NO: 4115416 - DNA, 12 bp, Homo sapiens
gctgccttgagc

SEQ ID NO: 4115417 - DNA, 14 bp, Homo sapiens
gctgccttggctca

SEQ ID NO: 4115418 - DNA, 23 bp, Homo sapiens
gctgcgcaccaatgcccagcagg

SEQ ID NO: 4115419 - DNA, 19 bp, Homo sapiens
gctgcgcccttaccttccc

SEQ ID NO: 4115420 - DNA, 16 bp, Homo sapiens
gctgcgcttgcttttc

SEQ ID NO: 4115421 - DNA, 12 bp, Homo sapiens
gctgctacccag

SEQ ID NO: 4115422 - DNA, 14 bp, Homo sapiens
gctgctacccagaa

SEQ ID NO: 4115423 - DNA, 17 bp, Homo sapiens
gctgctaccgccctggg

SEQ ID NO: 4115424 - DNA, 20 bp, Homo sapiens
gctgctaccgccctgggctg

SEQ ID NO: 4115425 - DNA, 22 bp, Homo sapiens
gctgctaccgccctgggctgga

SEQ ID NO: 4115426 - DNA, 23 bp, Homo sapiens
gctgctaccgccctgggctggac

SEQ ID NO: 4115427 - DNA, 21 bp, Homo sapiens
gctgctatccccatctccctg

SEQ ID NO: 4115428 - DNA, 17 bp, Homo sapiens
gctgctcacccacctct

SEQ ID NO: 4115429 - DNA, 23 bp, Homo sapiens
gctgctcacccacctcttgtgca

SEQ ID NO: 4115430 - DNA, 15 bp, Homo sapiens
gctgctccaggcctg

SEQ ID NO: 4115431 - DNA, 16 bp, Homo sapiens
gctgctccaggcctgc

SEQ ID NO: 4115432 - DNA, 22 bp, Homo sapiens
gctgctccaggcctgcagcagg

SEQ ID NO: 4115433 - DNA, 23 bp, Homo sapiens
gctgctccaggcctgcagcagga

SEQ ID NO: 4115434 - DNA, 13 bp, Homo sapiens
gctgctccctggc

SEQ ID NO: 4115435 - DNA, 14 bp, Homo sapiens
gctgctccttggct

SEQ ID NO: 4115436 - DNA, 14 bp, Homo sapiens
gctgctctgagcca

SEQ ID NO: 4115437 - DNA, 11 bp, Homo sapiens
gctgctgacca

SEQ ID NO: 4115438 - DNA, 21 bp, Homo sapiens
gctgctgcacccaactactga

SEQ ID NO: 4115439 - DNA, 12 bp, Homo sapiens
gctgctgcaggc

SEQ ID NO: 4115440 - DNA, 18 bp, Homo sapiens
gctgctgcccatgtttca

SEQ ID NO: 4115441 - DNA, 13 bp, Homo sapiens
gctgctgcctctt

SEQ ID NO: 4115442 - DNA, 12 bp, Homo sapiens
gctgctgcgccc

SEQ ID NO: 4115443 - DNA, 13 bp, Homo sapiens
gctgctgctgcac

SEQ ID NO: 4115444 - DNA, 13 bp, Homo sapiens
gctgctgctgctg

SEQ ID NO: 4115445 - DNA, 18 bp, Homo sapiens
gctgctggatcacagctg

SEQ ID NO: 4115446 - DNA, 11 bp, Homo sapiens
gctgctggcca

SEQ ID NO: 4115447 - DNA, 21 bp, Homo sapiens
gctgctggccaaatagcaaag

SEQ ID NO: 4115448 - DNA, 22 bp, Homo sapiens
gctgctgggctgagtgacacaa

SEQ ID NO: 4115449 - DNA, 16 bp, Homo sapiens
gctgctgtccctcccc

SEQ ID NO: 4115450 - DNA, 22 bp, Homo sapiens
gctgctgtccctcccccttgtc

SEQ ID NO: 4115451 - DNA, 23 bp, Homo sapiens
gctgctgtccctcccccttgtcc

SEQ ID NO: 4115452 - DNA, 17 bp, Homo sapiens
gctgctgttctcaggac

SEQ ID NO: 4115453 - DNA, 20 bp, Homo sapiens
gctgctgttctcaggacagc

SEQ ID NO: 4115454 - DNA, 21 bp, Homo sapiens
gctgctgttctcaggacagca

SEQ ID NO: 4115455 - DNA, 19 bp, Homo sapiens
gctgcttgcccaagtcaca

SEQ ID NO: 4115456 - DNA, 20 bp, Homo sapiens
gctgctttgcgctggtggac

SEQ ID NO: 4115457 - DNA, 14 bp, Homo sapiens
gctggaagagggtg

SEQ ID NO: 4115458 - DNA, 20 bp, Homo sapiens
gctggaagtctccatgaaga

SEQ ID NO: 4115459 - DNA, 17 bp, Homo sapiens
gctggactattgtgcca

SEQ ID NO: 4115460 - DNA, 16 bp, Homo sapiens
gctggactctgcatcc

SEQ ID NO: 4115461 - DNA, 22 bp, Homo sapiens
gctggactggaggtgggcatgc

SEQ ID NO: 4115462 - DNA, 16 bp, Homo sapiens
gctggagaagctcacc

SEQ ID NO: 4115463 - DNA, 12 bp, Homo sapiens
gctggagaggtt

SEQ ID NO: 4115464 - DNA, 13 bp, Homo sapiens
gctggagaggtta

SEQ ID NO: 4115465 - DNA, 22 bp, Homo sapiens
gctggagatacttggtcacagc

SEQ ID NO: 4115466 - DNA, 22 bp, Homo sapiens
gctggagccctgttcctccctc

SEQ ID NO: 4115467 - DNA, 22 bp, Homo sapiens
gctggaggagcagcagcttggg

SEQ ID NO: 4115468 - DNA, 16 bp, Homo sapiens
gctggaggcccaggct

SEQ ID NO: 4115469 - DNA, 12 bp, Homo sapiens
gctggaggcctc

SEQ ID NO: 4115470 - DNA, 19 bp, Homo sapiens
gctggaggcctcaggtgct

SEQ ID NO: 4115471 - DNA, 22 bp, Homo sapiens
gctggaggtggggcgaggcagg

SEQ ID NO: 4115472 - DNA, 23 bp, Homo sapiens
gctggatcacagctgctttctgt

SEQ ID NO: 4115473 - DNA, 14 bp, Homo sapiens
gctggatctgcttg

SEQ ID NO: 4115474 - DNA, 20 bp, Homo sapiens
gctggatgagacttccaaac

SEQ ID NO: 4115475 - DNA, 19 bp, Homo sapiens
gctggcaacacagaggcag

SEQ ID NO: 4115476 - DNA, 21 bp, Homo sapiens
gctggcaacacagaggcagcc

SEQ ID NO: 4115477 - DNA, 21 bp, Homo sapiens
gctggcacccaccgtggagga

SEQ ID NO: 4115478 - DNA, 14 bp, Homo sapiens
gctggcatgcagtg

SEQ ID NO: 4115479 - DNA, 19 bp, Homo sapiens
gctggccaaatagcaaaga

SEQ ID NO: 4115480 - DNA, 17 bp, Homo sapiens
gctggccagcaaggcag

SEQ ID NO: 4115481 - DNA, 15 bp, Homo sapiens
gctggccagcaccct

SEQ ID NO: 4115482 - DNA, 16 bp, Homo sapiens
gctggccatggggccc

SEQ ID NO: 4115483 - DNA, 15 bp, Homo sapiens
gctggcccagggccc

SEQ ID NO: 4115484 - DNA, 17 bp, Homo sapiens
gctggcccagggcccag

SEQ ID NO: 4115485 - DNA, 19 bp, Homo sapiens
gctggcccagggcccagag

SEQ ID NO: 4115486 - DNA, 21 bp, Homo sapiens
gctggcccagggcccagagcc

SEQ ID NO: 4115487 - DNA, 18 bp, Homo sapiens
gctggccccagggcaccc

SEQ ID NO: 4115488 - DNA, 16 bp, Homo sapiens
gctggccctgcctcct

SEQ ID NO: 4115489 - DNA, 17 bp, Homo sapiens
gctggccctgcctcctg

SEQ ID NO: 4115490 - DNA, 20 bp, Homo sapiens
gctggccgagggtcctggct

SEQ ID NO: 4115491 - DNA, 19 bp, Homo sapiens
gctggccgggggaggtggg

SEQ ID NO: 4115492 - DNA, 20 bp, Homo sapiens
gctggccgggggaggtgggt

SEQ ID NO: 4115493 - DNA, 21 bp, Homo sapiens
gctggcctcacccacccctgc

SEQ ID NO: 4115494 - DNA, 21 bp, Homo sapiens
gctggcctcccaaatgagcca

SEQ ID NO: 4115495 - DNA, 14 bp, Homo sapiens
gctggcctctacca

SEQ ID NO: 4115496 - DNA, 16 bp, Homo sapiens
gctggcctctaccaca

SEQ ID NO: 4115497 - DNA, 23 bp, Homo sapiens
gctggcctctggctctcatgggg

SEQ ID NO: 4115498 - DNA, 12 bp, Homo sapiens
gctggcctggat

SEQ ID NO: 4115499 - DNA, 15 bp, Homo sapiens
gctggcctggatctc

SEQ ID NO: 4115500 - DNA, 20 bp, Homo sapiens
gctggcctggggtcaggccg

SEQ ID NO: 4115501 - DNA, 20 bp, Homo sapiens
gctggctccccctccccagg

SEQ ID NO: 4115502 - DNA, 23 bp, Homo sapiens
ggctgaggcaggagaatggtgtg

SEQ ID NO: 4115503 - DNA, 18 bp, Homo sapiens
ggctgaggctggcacagg

SEQ ID NO: 4115504 - DNA, 12 bp, Homo sapiens
ggctgagggcct

SEQ ID NO: 4115505 - DNA, 14 bp, Homo sapiens
ggctgagggcctgc

SEQ ID NO: 4115506 - DNA, 16 bp, Homo sapiens
ggctgagggcctgctg

SEQ ID NO: 4115507 - DNA, 18 bp, Homo sapiens
ggctgagggcctgctgga

SEQ ID NO: 4115508 - DNA, 19 bp, Homo sapiens
ggctgaggggcaacgaaga

SEQ ID NO: 4115509 - DNA, 15 bp, Homo sapiens
ggctgaggggcttgg

SEQ ID NO: 4115510 - DNA, 16 bp, Homo sapiens
ggctgaggggcttggg

SEQ ID NO: 4115511 - DNA, 20 bp, Homo sapiens
ggctgaggttcctctgcctg

SEQ ID NO: 4115512 - DNA, 23 bp, Homo sapiens
ggctgaggttcctctgcctgccc

SEQ ID NO: 4115513 - DNA, 17 bp, Homo sapiens
ggctgagtgagccacag

SEQ ID NO: 4115514 - DNA, 16 bp, Homo sapiens
ggctgccagcagcccc

SEQ ID NO: 4115515 - DNA, 19 bp, Homo sapiens
ggctgcccccggccccctg

SEQ ID NO: 4115516 - DNA, 21 bp, Homo sapiens
ggctgcccccggccccctggt

SEQ ID NO: 4115517 - DNA, 17 bp, Homo sapiens
ggctgccccggcctcct

SEQ ID NO: 4115518 - DNA, 12 bp, Homo sapiens
ggctgcccctca

SEQ ID NO: 4115519 - DNA, 14 bp, Homo sapiens
ggctgcccctcacc

SEQ ID NO: 4115520 - DNA, 15 bp, Homo sapiens
ggctgcccctcacct

SEQ ID NO: 4115521 - DNA, 17 bp, Homo sapiens
ggctgcccctcaccttg

SEQ ID NO: 4115522 - DNA, 14 bp, Homo sapiens
ggctgccctgagaa

SEQ ID NO: 4115523 - DNA, 21 bp, Homo sapiens
ggctgccctgagaagctgctc

SEQ ID NO: 4115524 - DNA, 15 bp, Homo sapiens
ggctgccctggtgct

SEQ ID NO: 4115525 - DNA, 16 bp, Homo sapiens
ggctgccctggtgctg

SEQ ID NO: 4115526 - DNA, 22 bp, Homo sapiens
ggctgccctggtgctgccacac

SEQ ID NO: 4115527 - DNA, 16 bp, Homo sapiens
ggctgccttagaacct

SEQ ID NO: 4115528 - DNA, 15 bp, Homo sapiens
ggctgctacccagaa

SEQ ID NO: 4115529 - DNA, 16 bp, Homo sapiens
ggctgctacccagaaa

SEQ ID NO: 4115530 - DNA, 15 bp, Homo sapiens
ggctgctgcaggccg

SEQ ID NO: 4115531 - DNA, 10 bp, Homo sapiens
ggctgctgcc

SEQ ID NO: 4115532 - DNA, 13 bp, Homo sapiens
ggctgctgccccc

SEQ ID NO: 4115533 - DNA, 15 bp, Homo sapiens
ggctgctgctacaat

SEQ ID NO: 4115534 - DNA, 15 bp, Homo sapiens
ggctggacgtggtgg

SEQ ID NO: 4115535 - DNA, 20 bp, Homo sapiens
ggctggacttctacctgccc

SEQ ID NO: 4115536 - DNA, 21 bp, Homo sapiens
ggctggacttctacctgccct

SEQ ID NO: 4115537 - DNA, 13 bp, Homo sapiens
ggctggaggccca

SEQ ID NO: 4115538 - DNA, 15 bp, Homo sapiens
ggctggaggcccagg

SEQ ID NO: 4115539 - DNA, 17 bp, Homo sapiens
ggctggagtgcagtggc

SEQ ID NO: 4115540 - DNA, 19 bp, Homo sapiens
ggctggatgtggtggcata

SEQ ID NO: 4115541 - DNA, 13 bp, Homo sapiens
ggctggcacagga

SEQ ID NO: 4115542 - DNA, 14 bp, Homo sapiens
ggctggccagcaag

SEQ ID NO: 4115543 - DNA, 19 bp, Homo sapiens
ggctggccagcaaggcagg

SEQ ID NO: 4115544 - DNA, 22 bp, Homo sapiens
ggctggccagcaaggcaggttg

SEQ ID NO: 4115545 - DNA, 23 bp, Homo sapiens
ggctggccatggggccctcccag

SEQ ID NO: 4115546 - DNA, 23 bp, Homo sapiens
ggctggcctcacccacccctgca

SEQ ID NO: 4115547 - DNA, 20 bp, Homo sapiens
ggctggcctcccaaatgagc

SEQ ID NO: 4115548 - DNA, 17 bp, Homo sapiens
ggctggctcctagggga

SEQ ID NO: 4115549 - DNA, 22 bp, Homo sapiens
ggctggctctaccttcctgtcc

SEQ ID NO: 4115550 - DNA, 13 bp, Homo sapiens
ggctggctctgca

SEQ ID NO: 4115551 - DNA, 20 bp, Homo sapiens
ggctggctctgcactaagag

SEQ ID NO: 4115552 - DNA, 15 bp, Homo sapiens
ggctgggagtcccta

SEQ ID NO: 4115553 - DNA, 14 bp, Homo sapiens
ggctgggcagagct

SEQ ID NO: 4115554 - DNA, 18 bp, Homo sapiens
ggctgggcagccccagag

SEQ ID NO: 4115555 - DNA, 11 bp, Homo sapiens
ggctgggccat

SEQ ID NO: 4115556 - DNA, 14 bp, Homo sapiens
ggctgggccatcct

SEQ ID NO: 4115557 - DNA, 22 bp, Homo sapiens
ggctgggccatccttccgccaa

SEQ ID NO: 4115558 - DNA, 17 bp, Homo sapiens
ggctgggccatgtccaa

SEQ ID NO: 4115559 - DNA, 18 bp, Homo sapiens
ggctgggccctctttccc

SEQ ID NO: 4115560 - DNA, 15 bp, Homo sapiens
ggctggggaggacct

SEQ ID NO: 4115561 - DNA, 19 bp, Homo sapiens
ggctggggcggggcccagg

SEQ ID NO: 4115562 - DNA, 18 bp, Homo sapiens
ggctgggggagagccgtg

SEQ ID NO: 4115563 - DNA, 19 bp, Homo sapiens
ggctgggggagagccgtgg

SEQ ID NO: 4115564 - DNA, 17 bp, Homo sapiens
ggctgggggcaggaggg

SEQ ID NO: 4115565 - DNA, 16 bp, Homo sapiens
ggctgggggtgctgga

SEQ ID NO: 4115566 - DNA, 13 bp, Homo sapiens
ggctgggtgctgg

SEQ ID NO: 4115567 - DNA, 18 bp, Homo sapiens
ggctgggtgggcccagaa

SEQ ID NO: 4115568 - DNA, 19 bp, Homo sapiens
ggctgggtgggcccagaac

SEQ ID NO: 4115569 - DNA, 20 bp, Homo sapiens
ggctgggtgtttcagtttga

SEQ ID NO: 4115570 - DNA, 16 bp, Homo sapiens
ggctggtatctcagaa

SEQ ID NO: 4115571 - DNA, 13 bp, Homo sapiens
ggctggtgcccca

SEQ ID NO: 4115572 - DNA, 15 bp, Homo sapiens
ggctggtgccccaca

SEQ ID NO: 4115573 - DNA, 17 bp, Homo sapiens
ggctggtgccccacagc

SEQ ID NO: 4115574 - DNA, 16 bp, Homo sapiens
ggctgtaaaatgcatg

SEQ ID NO: 4115575 - DNA, 21 bp, Homo sapiens
ggctgtccttaacccacctct

SEQ ID NO: 4115576 - DNA, 12 bp, Homo sapiens
ggctgtctagaa

SEQ ID NO: 4115577 - DNA, 15 bp, Homo sapiens
ggctgtctggggcct

SEQ ID NO: 4115578 - DNA, 13 bp, Homo sapiens
ggctgtgaggccc

SEQ ID NO: 4115579 - DNA, 11 bp, Homo sapiens
ggctgtgagtg

SEQ ID NO: 4115580 - DNA, 17 bp, Homo sapiens
ggctgtgcttgaaggcc

SEQ ID NO: 4115581 - DNA, 19 bp, Homo sapiens
ggctgtgcttgaaggccct

SEQ ID NO: 4115582 - DNA, 20 bp, Homo sapiens
ggctgtgcttgaaggccctg

SEQ ID NO: 4115583 - DNA, 21 bp, Homo sapiens
ggctgtggaccgtggacaggc

SEQ ID NO: 4115584 - DNA, 23 bp, Homo sapiens
ggctgtggaccgtggacaggccc

SEQ ID NO: 4115585 - DNA, 22 bp, Homo sapiens
ggctgtggccgtctcctccctc

SEQ ID NO: 4115586 - DNA, 21 bp, Homo sapiens
ggctgtgggcctcaaggactt

SEQ ID NO: 4115587 - DNA, 22 bp, Homo sapiens
ggctgtgggcctcaaggacttg

SEQ ID NO: 4115588 - DNA, 18 bp, Homo sapiens
ggctgtgtttccatctca

SEQ ID NO: 4115589 - DNA, 20 bp, Homo sapiens
ggctgtgtttgcagcctgct

SEQ ID NO: 4115590 - DNA, 13 bp, Homo sapiens
ggctgttccatgt

SEQ ID NO: 4115591 - DNA, 16 bp, Homo sapiens
ggctgtttagcagaac

SEQ ID NO: 4115592 - DNA, 16 bp, Homo sapiens
ggcttacaggcatgga

SEQ ID NO: 4115593 - DNA, 22 bp, Homo sapiens
ggcttacctgacctcttgctgt

SEQ ID NO: 4115594 - DNA, 23 bp, Homo sapiens
ggcttacctgacctcttgctgtc

SEQ ID NO: 4115595 - DNA, 21 bp, Homo sapiens
ggcttagacttcgactcagga

SEQ ID NO: 4115596 - DNA, 15 bp, Homo sapiens
ggcttagtatttctc

SEQ ID NO: 4115597 - DNA, 17 bp, Homo sapiens
ggcttagtatttctcag

SEQ ID NO: 4115598 - DNA, 19 bp, Homo sapiens
ggcttagtatttctcagga

SEQ ID NO: 4115599 - DNA, 21 bp, Homo sapiens
ggcttcaagttgtaaaaatga

SEQ ID NO: 4115600 - DNA, 14 bp, Homo sapiens
ggcttcacagtctg

SEQ ID NO: 4115601 - DNA, 21 bp, Homo sapiens
ggcttcactgtataaatagga

SEQ ID NO: 4115602 - DNA, 17 bp, Homo sapiens
ggcttcagcatatttat

SEQ ID NO: 4115603 - DNA, 15 bp, Homo sapiens
ggcttcatgccagct

SEQ ID NO: 4115604 - DNA, 16 bp, Homo sapiens
ggcttccagcttcagg

SEQ ID NO: 4115605 - DNA, 16 bp, Homo sapiens
ggcgagagaggagcca

SEQ ID NO: 4115606 - DNA, 16 bp, Homo sapiens
ggcgcaggtgggctgg

SEQ ID NO: 4115607 - DNA, 22 bp, Homo sapiens
ggcgcccaccaccccctcaagc

SEQ ID NO: 4115608 - DNA, 13 bp, Homo sapiens
ggcgcccctgcca

SEQ ID NO: 4115609 - DNA, 18 bp, Homo sapiens
ggcgcctgtagtcccagc

SEQ ID NO: 4115610 - DNA, 16 bp, Homo sapiens
ggcgctattacaaata

SEQ ID NO: 4115611 - DNA, 14 bp, Homo sapiens
ggcgctcagacggc

SEQ ID NO: 4115612 - DNA, 19 bp, Homo sapiens
ggcgctcagacggcggcca

SEQ ID NO: 4115613 - DNA, 23 bp, Homo sapiens
ggcgctcagacggcggccaggca

SEQ ID NO: 4115614 - DNA, 21 bp, Homo sapiens
ggcggagagtacagtgagcca

SEQ ID NO: 4115615 - DNA, 20 bp, Homo sapiens
ggcggaggttgtggtgagcg

SEQ ID NO: 4115616 - DNA, 24 bp, Homo sapiens
ggcggccacgcactgggccacgga

SEQ ID NO: 4115617 - DNA, 14 bp, Homo sapiens
ggcggccaggcaca

SEQ ID NO: 4115618 - DNA, 16 bp, Homo sapiens
ggcggccaggcacagg

SEQ ID NO: 4115619 - DNA, 21 bp, Homo sapiens
ggcggccaggcacagggcccg

SEQ ID NO: 4115620 - DNA, 17 bp, Homo sapiens
ggcggcccctcccgccc

SEQ ID NO: 4115621 - DNA, 14 bp, Homo sapiens
ggcggcccggccag

SEQ ID NO: 4115622 - DNA, 15 bp, Homo sapiens
ggcggcccggccagc

SEQ ID NO: 4115623 - DNA, 18 bp, Homo sapiens
ggcggcccggccagcggg

SEQ ID NO: 4115624 - DNA, 19 bp, Homo sapiens
ggcggcccggccagcgggc

SEQ ID NO: 4115625 - DNA, 16 bp, Homo sapiens
ggcggcgggcggctgg

SEQ ID NO: 4115626 - DNA, 14 bp, Homo sapiens
ggcggctactctgg

SEQ ID NO: 4115627 - DNA, 15 bp, Homo sapiens
ggcggctactctgga

SEQ ID NO: 4115628 - DNA, 17 bp, Homo sapiens
ggcgggcagagggctgg

SEQ ID NO: 4115629 - DNA, 23 bp, Homo sapiens
ggcgggccatgagggacagggtc

SEQ ID NO: 4115630 - DNA, 14 bp, Homo sapiens
ggcgggcggtcagg

SEQ ID NO: 4115631 - DNA, 20 bp, Homo sapiens
ggcgggtggatcacgaggtc

SEQ ID NO: 4115632 - DNA, 12 bp, Homo sapiens
ggcgtgatctcg

SEQ ID NO: 4115633 - DNA, 20 bp, Homo sapiens
ggcgtggagagcccggcgcc

SEQ ID NO: 4115634 - DNA, 16 bp, Homo sapiens
ggcgtggagccaggga

SEQ ID NO: 4115635 - DNA, 19 bp, Homo sapiens
ggcgtggagccagggagcg

SEQ ID NO: 4115636 - DNA, 23 bp, Homo sapiens
ggcgttctgctgcccctgcagtt

SEQ ID NO: 4115637 - DNA, 18 bp, Homo sapiens
ggcgttgggagcctagct

SEQ ID NO: 4115638 - DNA, 18 bp, Homo sapiens
ggctaacgggaggctggg

SEQ ID NO: 4115639 - DNA, 19 bp, Homo sapiens
ggctaacgggaggctgggc

SEQ ID NO: 4115640 - DNA, 18 bp, Homo sapiens
ggctagaggccagcccca

SEQ ID NO: 4115641 - DNA, 13 bp, Homo sapiens
ggctagagtcctc

SEQ ID NO: 4115642 - DNA, 19 bp, Homo sapiens
ggctagagtcctcactccc

SEQ ID NO: 4115643 - DNA, 20 bp, Homo sapiens
ggctagagtcctcactccca

SEQ ID NO: 4115644 - DNA, 22 bp, Homo sapiens
ggctagcttctgcttttctgcc

SEQ ID NO: 4115645 - DNA, 23 bp, Homo sapiens
ggctaggtatcattcaactctcc

SEQ ID NO: 4115646 - DNA, 19 bp, Homo sapiens
ggctatagctacaggaagc

SEQ ID NO: 4115647 - DNA, 17 bp, Homo sapiens
ggctatttttgaagcaa

SEQ ID NO: 4115648 - DNA, 20 bp, Homo sapiens
ggctcaagcaatcctcctgc

SEQ ID NO: 4115649 - DNA, 18 bp, Homo sapiens
ggctcaagcccaggaggg

SEQ ID NO: 4115650 - DNA, 19 bp, Homo sapiens
ggctcaagcgattctcctg

SEQ ID NO: 4115651 - DNA, 20 bp, Homo sapiens
ggctcacggggcctccaacc

SEQ ID NO: 4115652 - DNA, 17 bp, Homo sapiens
ggctcagagcttgaaga

SEQ ID NO: 4115653 - DNA, 18 bp, Homo sapiens
ggctccaagacctaggct

SEQ ID NO: 4115654 - DNA, 22 bp, Homo sapiens
ggctccacacacacaaaaaaag

SEQ ID NO: 4115655 - DNA, 23 bp, Homo sapiens
ggctccacacacacaaaaaaaga

SEQ ID NO: 4115656 - DNA, 21 bp, Homo sapiens
ggctcccaagtcacacccact

SEQ ID NO: 4115657 - DNA, 20 bp, Homo sapiens
ggctcccacaggcccttcct

SEQ ID NO: 4115658 - DNA, 23 bp, Homo sapiens
ggctcccaggggtctccctggct

SEQ ID NO: 4115659 - DNA, 21 bp, Homo sapiens
ggctccccatgtgtcctggtt

SEQ ID NO: 4115660 - DNA, 15 bp, Homo sapiens
ggctccccctcccca

SEQ ID NO: 4115661 - DNA, 20 bp, Homo sapiens
ggctccccctccccaggctg

SEQ ID NO: 4115662 - DNA, 22 bp, Homo sapiens
ggctccccctccccaggctgga

SEQ ID NO: 4115663 - DNA, 13 bp, Homo sapiens
ggctcccctctgc

SEQ ID NO: 4115664 - DNA, 16 bp, Homo sapiens
ggctcccctctgcttc

SEQ ID NO: 4115665 - DNA, 20 bp, Homo sapiens
ggctcccctctgcttctcat

SEQ ID NO: 4115666 - DNA, 15 bp, Homo sapiens
ggctcccggaattcc

SEQ ID NO: 4115667 - DNA, 15 bp, Homo sapiens
ggctccctcctccag

SEQ ID NO: 4115668 - DNA, 16 bp, Homo sapiens
ggctccctcctccagg

SEQ ID NO: 4115669 - DNA, 13 bp, Homo sapiens
ggctcctcagagc

SEQ ID NO: 4115670 - DNA, 14 bp, Homo sapiens
ggctcctcagagcg

SEQ ID NO: 4115671 - DNA, 16 bp, Homo sapiens
ggctcctccttgccca

SEQ ID NO: 4115672 - DNA, 15 bp, Homo sapiens
ggctcctgcccccat

SEQ ID NO: 4115673 - DNA, 14 bp, Homo sapiens
ggctcctgcccctt

SEQ ID NO: 4115674 - DNA, 22 bp, Homo sapiens
ggctcctgcccctttcaggcct

SEQ ID NO: 4115675 - DNA, 20 bp, Homo sapiens
ggctccttcccatcgctgtc

SEQ ID NO: 4115676 - DNA, 12 bp, Homo sapiens
ggctcctttctc

SEQ ID NO: 4115677 - DNA, 19 bp, Homo sapiens
ggctcctttctccagccag

SEQ ID NO: 4115678 - DNA, 17 bp, Homo sapiens
ggctctaccttcctgtc

SEQ ID NO: 4115679 - DNA, 19 bp, Homo sapiens
ggctctcagctcagcgcca

SEQ ID NO: 4115680 - DNA, 13 bp, Homo sapiens
ggctctccagtta

SEQ ID NO: 4115681 - DNA, 14 bp, Homo sapiens
ggctctcggaaatg

SEQ ID NO: 4115682 - DNA, 23 bp, Homo sapiens
ggctctctgagactctttagagc

SEQ ID NO: 4115683 - DNA, 16 bp, Homo sapiens
ggctctctgggctgac

SEQ ID NO: 4115684 - DNA, 19 bp, Homo sapiens
ggctctgaggtgcctgtcc

SEQ ID NO: 4115685 - DNA, 13 bp, Homo sapiens
ggctctgcaccca

SEQ ID NO: 4115686 - DNA, 15 bp, Homo sapiens
ggctctgcactaaga

SEQ ID NO: 4115687 - DNA, 17 bp, Homo sapiens
ggctctgcactaagaga

SEQ ID NO: 4115688 - DNA, 12 bp, Homo sapiens
ggctctgccagt

SEQ ID NO: 4115689 - DNA, 19 bp, Homo sapiens
ggctctgccagtggatccc

SEQ ID NO: 4115690 - DNA, 16 bp, Homo sapiens
ggctctggggcagccc

SEQ ID NO: 4115691 - DNA, 20 bp, Homo sapiens
ggctcttagcagcttccaga

SEQ ID NO: 4115692 - DNA, 15 bp, Homo sapiens
ggctcttgactactt

SEQ ID NO: 4115693 - DNA, 19 bp, Homo sapiens
ggctcttgatacccccctc

SEQ ID NO: 4115694 - DNA, 20 bp, Homo sapiens
ggctgaaagaggccaatgcc

SEQ ID NO: 4115695 - DNA, 11 bp, Homo sapiens
ggctgaaagcc

SEQ ID NO: 4115696 - DNA, 18 bp, Homo sapiens
ggctgaactttgtggtcg

SEQ ID NO: 4115697 - DNA, 22 bp, Homo sapiens
ggctgaccacagcacagccaac

SEQ ID NO: 4115698 - DNA, 15 bp, Homo sapiens
ggctgaccaggcttc

SEQ ID NO: 4115699 - DNA, 18 bp, Homo sapiens
ggctgaccccaaagagcc

SEQ ID NO: 4115700 - DNA, 13 bp, Homo sapiens
ggctgactggggc

SEQ ID NO: 4115701 - DNA, 15 bp, Homo sapiens
ggctgactggggctg

SEQ ID NO: 4115702 - DNA, 18 bp, Homo sapiens
ggctgactggggctgggg

SEQ ID NO: 4115703 - DNA, 15 bp, Homo sapiens
ggctgagacaggaga

SEQ ID NO: 4115704 - DNA, 19 bp, Homo sapiens
ggctgagcggatgcatctg

SEQ ID NO: 4115705 - DNA, 16 bp, Homo sapiens
ggctgaggaggcctcc

SEQ ID NO: 4115706 - DNA, 14 bp, Homo sapiens
ggctgaggcagaag

SEQ ID NO: 4115707 - DNA, 15 bp, Homo sapiens
ggctgaggcaggaga

SEQ ID NO: 4115708 - DNA, 12 bp, Homo sapiens
ggccgaggcggg

SEQ ID NO: 4115709 - DNA, 16 bp, Homo sapiens
ggccgagggtcctggc

SEQ ID NO: 4115710 - DNA, 17 bp, Homo sapiens
ggccgaggtcccattgt

SEQ ID NO: 4115711 - DNA, 13 bp, Homo sapiens
ggccgagtccaag

SEQ ID NO: 4115712 - DNA, 16 bp, Homo sapiens
ggccgatggggcagtc

SEQ ID NO: 4115713 - DNA, 17 bp, Homo sapiens
ggccgcctgcgggctgc

SEQ ID NO: 4115714 - DNA, 18 bp, Homo sapiens
ggccgctgctttgcgctg

SEQ ID NO: 4115715 - DNA, 20 bp, Homo sapiens
ggccgctgctttgcgctggt

SEQ ID NO: 4115716 - DNA, 17 bp, Homo sapiens
ggccggaaccacagggc

SEQ ID NO: 4115717 - DNA, 21 bp, Homo sapiens
ggccgggcacggtcacacggc

SEQ ID NO: 4115718 - DNA, 20 bp, Homo sapiens
ggccgggcaggtcctgccca

SEQ ID NO: 4115719 - DNA, 18 bp, Homo sapiens
ggccggggaagctgccag

SEQ ID NO: 4115720 - DNA, 16 bp, Homo sapiens
ggccgggggaggtggg

SEQ ID NO: 4115721 - DNA, 13 bp, Homo sapiens
ggccgtctcctcc

SEQ ID NO: 4115722 - DNA, 18 bp, Homo sapiens
ggcctaaaactggcctga

SEQ ID NO: 4115723 - DNA, 17 bp, Homo sapiens
ggcctacagccacatcc

SEQ ID NO: 4115724 - DNA, 24 bp, Homo sapiens
ggcctactagagtctgaacagctg

SEQ ID NO: 4115725 - DNA, 19 bp, Homo sapiens
ggcctattatattaaaata

SEQ ID NO: 4115726 - DNA, 19 bp, Homo sapiens
ggcctcaaaggcccgctct

SEQ ID NO: 4115727 - DNA, 22 bp, Homo sapiens
ggcctcaaagttggggcaggct

SEQ ID NO: 4115728 - DNA, 20 bp, Homo sapiens
ggcctcaagcaatccacctg

SEQ ID NO: 4115729 - DNA, 12 bp, Homo sapiens
ggcctcacccac

SEQ ID NO: 4115730 - DNA, 12 bp, Homo sapiens
ggcctcagacca

SEQ ID NO: 4115731 - DNA, 14 bp, Homo sapiens
ggcctcagccctca

SEQ ID NO: 4115732 - DNA, 17 bp, Homo sapiens
ggcctcagctgaatgcc

SEQ ID NO: 4115733 - DNA, 13 bp, Homo sapiens
ggcctcagctgcc

SEQ ID NO: 4115734 - DNA, 10 bp, Homo sapiens
ggcctcaggg

SEQ ID NO: 4115735 - DNA, 18 bp, Homo sapiens
ggcctcagggcgctcaga

SEQ ID NO: 4115736 - DNA, 24 bp, Homo sapiens
ggcctcagggcgctcagacggcgg

SEQ ID NO: 4115737 - DNA, 16 bp, Homo sapiens
ggcctcccaaagtgct

SEQ ID NO: 4115738 - DNA, 23 bp, Homo sapiens
ggcctcccaaagtgctgagattg

SEQ ID NO: 4115739 - DNA, 15 bp, Homo sapiens
ggcctccctgccagt

SEQ ID NO: 4115740 - DNA, 17 bp, Homo sapiens
ggcctccctgctgtgcc

SEQ ID NO: 4115741 - DNA, 17 bp, Homo sapiens
ggcctcctcggagagca

SEQ ID NO: 4115742 - DNA, 18 bp, Homo sapiens
ggcctcctcggagagcag

SEQ ID NO: 4115743 - DNA, 20 bp, Homo sapiens
ggcctcctcggagagcagca

SEQ ID NO: 4115744 - DNA, 21 bp, Homo sapiens
ggcctcctcggagagcagcag

SEQ ID NO: 4115745 - DNA, 22 bp, Homo sapiens
ggcctcctcggagagcagcagc

SEQ ID NO: 4115746 - DNA, 16 bp, Homo sapiens
ggcctctagttccaga

SEQ ID NO: 4115747 - DNA, 13 bp, Homo sapiens
ggcctctctgccc

SEQ ID NO: 4115748 - DNA, 22 bp, Homo sapiens
ggcctctctgccccacccaagc

SEQ ID NO: 4115749 - DNA, 19 bp, Homo sapiens
ggcctctgcctccaccctc

SEQ ID NO: 4115750 - DNA, 20 bp, Homo sapiens
ggcctctgcctccaccctcc

SEQ ID NO: 4115751 - DNA, 23 bp, Homo sapiens
ggcctcttcgcctttcccaccct

SEQ ID NO: 4115752 - DNA, 21 bp, Homo sapiens
ggcctctttcagtgaatttgt

SEQ ID NO: 4115753 - DNA, 17 bp, Homo sapiens
ggcctgaaagaggctga

SEQ ID NO: 4115754 - DNA, 12 bp, Homo sapiens
ggcctgaaccac

SEQ ID NO: 4115755 - DNA, 15 bp, Homo sapiens
ggcctgaactgagga

SEQ ID NO: 4115756 - DNA, 16 bp, Homo sapiens
ggcctgaatccaaaag

SEQ ID NO: 4115757 - DNA, 17 bp, Homo sapiens
ggcctgacaccccctcc

SEQ ID NO: 4115758 - DNA, 18 bp, Homo sapiens
ggcctgatcagaccacgg

SEQ ID NO: 4115759 - DNA, 20 bp, Homo sapiens
ggcctgatcagaccacggct

SEQ ID NO: 4115760 - DNA, 16 bp, Homo sapiens
ggcctgatcttgcctg

SEQ ID NO: 4115761 - DNA, 14 bp, Homo sapiens
ggcctgatgctccc

SEQ ID NO: 4115762 - DNA, 20 bp, Homo sapiens
ggcctgatgctccctcccct

SEQ ID NO: 4115763 - DNA, 17 bp, Homo sapiens
ggcctgcccgtgccctg

SEQ ID NO: 4115764 - DNA, 21 bp, Homo sapiens
ggcctgccgggctgagggcct

SEQ ID NO: 4115765 - DNA, 18 bp, Homo sapiens
ggcctgctaaggctcctc

SEQ ID NO: 4115766 - DNA, 21 bp, Homo sapiens
ggcctgctaaggctcctcctt

SEQ ID NO: 4115767 - DNA, 13 bp, Homo sapiens
ggcctgctccaga

SEQ ID NO: 4115768 - DNA, 18 bp, Homo sapiens
ggcctgctccagacctga

SEQ ID NO: 4115769 - DNA, 13 bp, Homo sapiens
ggcctgctgccag

SEQ ID NO: 4115770 - DNA, 23 bp, Homo sapiens
ggcctgctgccagtgcagccact

SEQ ID NO: 4115771 - DNA, 15 bp, Homo sapiens
ggcctgctggaggcc

SEQ ID NO: 4115772 - DNA, 18 bp, Homo sapiens
ggcctgctggaggcctca

SEQ ID NO: 4115773 - DNA, 21 bp, Homo sapiens
ggcctgctggaggcctcaggt

SEQ ID NO: 4115774 - DNA, 15 bp, Homo sapiens
ggcctggacctgcct

SEQ ID NO: 4115775 - DNA, 22 bp, Homo sapiens
ggcctggacctgcctcctgcct

SEQ ID NO: 4115776 - DNA, 18 bp, Homo sapiens
ggcctggactttcctgca

SEQ ID NO: 4115777 - DNA, 21 bp, Homo sapiens
ggcctggactttcctgcaact

SEQ ID NO: 4115778 - DNA, 15 bp, Homo sapiens
ggcctggagccccat

SEQ ID NO: 4115779 - DNA, 21 bp, Homo sapiens
ggcctggatctccccactcta

SEQ ID NO: 4115780 - DNA, 21 bp, Homo sapiens
ggcctggatgccagctgtgtc

SEQ ID NO: 4115781 - DNA, 14 bp, Homo sapiens
ggcctggcaggcca

SEQ ID NO: 4115782 - DNA, 16 bp, Homo sapiens
ggcctggcaggccagt

SEQ ID NO: 4115783 - DNA, 17 bp, Homo sapiens
ggcctggccacctctct

SEQ ID NO: 4115784 - DNA, 18 bp, Homo sapiens
ggcctggccaggagctct

SEQ ID NO: 4115785 - DNA, 13 bp, Homo sapiens
ggcctggctgcag

SEQ ID NO: 4115786 - DNA, 14 bp, Homo sapiens
ggcctgggcctctg

SEQ ID NO: 4115787 - DNA, 15 bp, Homo sapiens
ggcctggggcctgag

SEQ ID NO: 4115788 - DNA, 18 bp, Homo sapiens
ggcctggggcctgagaga

SEQ ID NO: 4115789 - DNA, 14 bp, Homo sapiens
ggcctggggctcct

SEQ ID NO: 4115790 - DNA, 23 bp, Homo sapiens
ggcctggggctcctttctccagc

SEQ ID NO: 4115791 - DNA, 20 bp, Homo sapiens
ggcctggggtgcatctcctc

SEQ ID NO: 4115792 - DNA, 15 bp, Homo sapiens
ggcctgtcgtgccag

SEQ ID NO: 4115793 - DNA, 19 bp, Homo sapiens
ggcctgtctcggaacctgt

SEQ ID NO: 4115794 - DNA, 22 bp, Homo sapiens
ggcctgtctgtgaagagcaaga

SEQ ID NO: 4115795 - DNA, 12 bp, Homo sapiens
ggcctgtgccca

SEQ ID NO: 4115796 - DNA, 17 bp, Homo sapiens
ggcctgtgcccactccc

SEQ ID NO: 4115797 - DNA, 22 bp, Homo sapiens
ggcctgtggaatgagtgtgcat

SEQ ID NO: 4115798 - DNA, 22 bp, Homo sapiens
ggcctgtgtgtgaaaggaagct

SEQ ID NO: 4115799 - DNA, 24 bp, Homo sapiens
ggcctgttgctatagagcctacct

SEQ ID NO: 4115800 - DNA, 20 bp, Homo sapiens
ggcctgtttctgcagccctt

SEQ ID NO: 4115801 - DNA, 13 bp, Homo sapiens
ggccttaatttcc

SEQ ID NO: 4115802 - DNA, 16 bp, Homo sapiens
ggccttagtgggccag

SEQ ID NO: 4115803 - DNA, 22 bp, Homo sapiens
ggccttatcgggctccagccat

SEQ ID NO: 4115804 - DNA, 16 bp, Homo sapiens
ggccttgctgctgctg

SEQ ID NO: 4115805 - DNA, 18 bp, Homo sapiens
ggccttgctgctgctgca

SEQ ID NO: 4115806 - DNA, 11 bp, Homo sapiens
ggcctttcctt

SEQ ID NO: 4115807 - DNA, 17 bp, Homo sapiens
ggcctttctaataaact

SEQ ID NO: 4115808 - DNA, 19 bp, Homo sapiens
ggcctttgcaagatgcttg

SEQ ID NO: 4115809 - DNA, 23 bp, Homo sapiens
ggcctttgtgctgcgcctgcagg

SEQ ID NO: 4115810 - DNA, 11 bp, Homo sapiens
ggcgacctcct

SEQ ID NO: 4115811 - DNA, 15 bp, Homo sapiens
ggccatgagggacag

SEQ ID NO: 4115812 - DNA, 15 bp, Homo sapiens
ggccatgatggcaac

SEQ ID NO: 4115813 - DNA, 14 bp, Homo sapiens
ggccatgcctgccc

SEQ ID NO: 4115814 - DNA, 15 bp, Homo sapiens
ggccatggaggcagt

SEQ ID NO: 4115815 - DNA, 13 bp, Homo sapiens
ggccatgtccaaa

SEQ ID NO: 4115816 - DNA, 15 bp, Homo sapiens
ggccatgtccaaaga

SEQ ID NO: 4115817 - DNA, 23 bp, Homo sapiens
ggccatgtccaaagaggctgccc

SEQ ID NO: 4115818 - DNA, 14 bp, Homo sapiens
ggccatgtgagcca

SEQ ID NO: 4115819 - DNA, 21 bp, Homo sapiens
ggccatttccttttctctgcc

SEQ ID NO: 4115820 - DNA, 23 bp, Homo sapiens
ggccatttccttttctctgccct

SEQ ID NO: 4115821 - DNA, 20 bp, Homo sapiens
ggcccaagagcagagtctgg

SEQ ID NO: 4115822 - DNA, 21 bp, Homo sapiens
ggcccaaggtcccctccacat

SEQ ID NO: 4115823 - DNA, 14 bp, Homo sapiens
ggcccaccccagcc

SEQ ID NO: 4115824 - DNA, 17 bp, Homo sapiens
ggcccaccccagcctcg

SEQ ID NO: 4115825 - DNA, 21 bp, Homo sapiens
ggcccacccggttcagtgttt

SEQ ID NO: 4115826 - DNA, 17 bp, Homo sapiens
ggcccagaactgccccc

SEQ ID NO: 4115827 - DNA, 19 bp, Homo sapiens
ggcccagaactgcccccac

SEQ ID NO: 4115828 - DNA, 12 bp, Homo sapiens
ggcccagagccc

SEQ ID NO: 4115829 - DNA, 14 bp, Homo sapiens
ggcccagagcccag

SEQ ID NO: 4115830 - DNA, 17 bp, Homo sapiens
ggcccagagcccagctc

SEQ ID NO: 4115831 - DNA, 14 bp, Homo sapiens
ggcccagccaggag

SEQ ID NO: 4115832 - DNA, 22 bp, Homo sapiens
ggcccagcccagagccacctgg

SEQ ID NO: 4115833 - DNA, 12 bp, Homo sapiens
ggcccagcgcgg

SEQ ID NO: 4115834 - DNA, 14 bp, Homo sapiens
ggcccagcgggcag

SEQ ID NO: 4115835 - DNA, 16 bp, Homo sapiens
ggcccagcgggcagat

SEQ ID NO: 4115836 - DNA, 12 bp, Homo sapiens
ggcccaggcctc

SEQ ID NO: 4115837 - DNA, 16 bp, Homo sapiens
ggcccaggcctgggtt

SEQ ID NO: 4115838 - DNA, 14 bp, Homo sapiens
ggcccagggcccag

SEQ ID NO: 4115839 - DNA, 15 bp, Homo sapiens
ggcccagggcccaga

SEQ ID NO: 4115840 - DNA, 17 bp, Homo sapiens
ggcccagggcccagagc

SEQ ID NO: 4115841 - DNA, 18 bp, Homo sapiens
ggcccatctcagcctcct

SEQ ID NO: 4115842 - DNA, 20 bp, Homo sapiens
ggccccaccgagctggagcg

SEQ ID NO: 4115843 - DNA, 17 bp, Homo sapiens
ggccccagacagggtgg

SEQ ID NO: 4115844 - DNA, 11 bp, Homo sapiens
ggccccagcct

SEQ ID NO: 4115845 - DNA, 19 bp, Homo sapiens
ggccccagcttctcagctc

SEQ ID NO: 4115846 - DNA, 12 bp, Homo sapiens
ggccccaggagg

SEQ ID NO: 4115847 - DNA, 13 bp, Homo sapiens
ggccccagggcac

SEQ ID NO: 4115848 - DNA, 16 bp, Homo sapiens
ggccccagggcaccct

SEQ ID NO: 4115849 - DNA, 13 bp, Homo sapiens
ggccccatcccag

SEQ ID NO: 4115850 - DNA, 20 bp, Homo sapiens
ggcccccaaacatagcccct

SEQ ID NO: 4115851 - DNA, 17 bp, Homo sapiens
ggcccccaggggcagga

SEQ ID NO: 4115852 - DNA, 15 bp, Homo sapiens
ggcccccatctcatg

SEQ ID NO: 4115853 - DNA, 21 bp, Homo sapiens
ggcccccatctcatgcccctg

SEQ ID NO: 4115854 - DNA, 19 bp, Homo sapiens
ggccccccaaatcccaggg

SEQ ID NO: 4115855 - DNA, 17 bp, Homo sapiens
ggccccctgcctgccct

SEQ ID NO: 4115856 - DNA, 15 bp, Homo sapiens
ggccccgccagggct

SEQ ID NO: 4115857 - DNA, 13 bp, Homo sapiens
ggccccgccccat

SEQ ID NO: 4115858 - DNA, 14 bp, Homo sapiens
ggccccgggttcag

SEQ ID NO: 4115859 - DNA, 20 bp, Homo sapiens
ggccccgggttcagcctggc

SEQ ID NO: 4115860 - DNA, 21 bp, Homo sapiens
ggccccgggttcagcctggcc

SEQ ID NO: 4115861 - DNA, 22 bp, Homo sapiens
ggccccgggttcagcctggcct

SEQ ID NO: 4115862 - DNA, 22 bp, Homo sapiens
ggcccctcaccctgccttatct

SEQ ID NO: 4115863 - DNA, 14 bp, Homo sapiens
ggcccctcagagcc

SEQ ID NO: 4115864 - DNA, 18 bp, Homo sapiens
ggcccctccacgcctcct

SEQ ID NO: 4115865 - DNA, 16 bp, Homo sapiens
ggcccctccccctgag

SEQ ID NO: 4115866 - DNA, 17 bp, Homo sapiens
ggcccctcctagaccca

SEQ ID NO: 4115867 - DNA, 23 bp, Homo sapiens
ggcccctcctagacccaggtgga

SEQ ID NO: 4115868 - DNA, 23 bp, Homo sapiens
ggcccctcttattcctctaggca

SEQ ID NO: 4115869 - DNA, 17 bp, Homo sapiens
ggcccctgcatcccctt

SEQ ID NO: 4115870 - DNA, 12 bp, Homo sapiens
ggcccctgggat

SEQ ID NO: 4115871 - DNA, 21 bp, Homo sapiens
ggcccctgggcttggcctgct

SEQ ID NO: 4115872 - DNA, 23 bp, Homo sapiens
ggcccctgggtcagtctggtggg

SEQ ID NO: 4115873 - DNA, 13 bp, Homo sapiens
ggcccctgtgtga

SEQ ID NO: 4115874 - DNA, 15 bp, Homo sapiens
ggcccgacagcctgg

SEQ ID NO: 4115875 - DNA, 21 bp, Homo sapiens
ggcccgcaccccggcctcagg

SEQ ID NO: 4115876 - DNA, 23 bp, Homo sapiens
ggcccgcaccccggcctcagggc

SEQ ID NO: 4115877 - DNA, 15 bp, Homo sapiens
ggcccgcagtgctgg

SEQ ID NO: 4115878 - DNA, 21 bp, Homo sapiens
ggcccgcagtgctgggaccag

SEQ ID NO: 4115879 - DNA, 17 bp, Homo sapiens
ggcccggatgctgcttc

SEQ ID NO: 4115880 - DNA, 16 bp, Homo sapiens
ggcccggccagcgggc

SEQ ID NO: 4115881 - DNA, 17 bp, Homo sapiens
ggccctaggcccctcct

SEQ ID NO: 4115882 - DNA, 21 bp, Homo sapiens
ggccctaggggtcactgtact

SEQ ID NO: 4115883 - DNA, 20 bp, Homo sapiens
ggccctcaatccaccttcag

SEQ ID NO: 4115884 - DNA, 13 bp, Homo sapiens
ggccctccctgac

SEQ ID NO: 4115885 - DNA, 23 bp, Homo sapiens
ggccctccctgactccctgtggg

SEQ ID NO: 4115886 - DNA, 20 bp, Homo sapiens
ggccctccctgttccccaga

SEQ ID NO: 4115887 - DNA, 22 bp, Homo sapiens
ggccctccctgttccccagaga

SEQ ID NO: 4115888 - DNA, 14 bp, Homo sapiens
ggccctctctctgg

SEQ ID NO: 4115889 - DNA, 15 bp, Homo sapiens
ggccctgactcctct

SEQ ID NO: 4115890 - DNA, 19 bp, Homo sapiens
ggccctgactcctctggct

SEQ ID NO: 4115891 - DNA, 16 bp, Homo sapiens
ggccctgcagccagct

SEQ ID NO: 4115892 - DNA, 11 bp, Homo sapiens
ggccctgccca

SEQ ID NO: 4115893 - DNA, 17 bp, Homo sapiens
ggccctgccctggcagg

SEQ ID NO: 4115894 - DNA, 12 bp, Homo sapiens
ggccctgcctcc

SEQ ID NO: 4115895 - DNA, 18 bp, Homo sapiens
ggccctgctcctgcagca

SEQ ID NO: 4115896 - DNA, 22 bp, Homo sapiens
ggccctggaggaattcagctca

SEQ ID NO: 4115897 - DNA, 13 bp, Homo sapiens
ggccctggccagc

SEQ ID NO: 4115898 - DNA, 12 bp, Homo sapiens
ggccctggccct

SEQ ID NO: 4115899 - DNA, 15 bp, Homo sapiens
ggccctggctctgct

SEQ ID NO: 4115900 - DNA, 15 bp, Homo sapiens
ggccctgggcctcag

SEQ ID NO: 4115901 - DNA, 16 bp, Homo sapiens
ggccctgggctcggag

SEQ ID NO: 4115902 - DNA, 15 bp, Homo sapiens
ggccctgggctgggt

SEQ ID NO: 4115903 - DNA, 15 bp, Homo sapiens
ggccctgtcccaggc

SEQ ID NO: 4115904 - DNA, 16 bp, Homo sapiens
ggcccttacacactca

SEQ ID NO: 4115905 - DNA, 21 bp, Homo sapiens
ggcccttacacactcaggcct

SEQ ID NO: 4115906 - DNA, 13 bp, Homo sapiens
ggcccttcctctc

SEQ ID NO: 4115907 - DNA, 23 bp, Homo sapiens
ggcccttcctctccactgccttc

SEQ ID NO: 4115908 - DNA, 19 bp, Homo sapiens
ggccctttccttccagatc

SEQ ID NO: 4115909 - DNA, 18 bp, Homo sapiens
ggccctttgaagcctcag

SEQ ID NO: 4115910 - DNA, 21 bp, Homo sapiens
ggccgaatcccctccctgtca

SEQ ID NO: 4115911 - DNA, 18 bp, Homo sapiens
ggccgagcgttcccagca

SEQ ID NO: 4115912 - DNA, 19 bp, Homo sapiens
ggccgagcgttcccagcag

SEQ ID NO: 4115913 - DNA, 20 bp, Homo sapiens
ggccgagcgttcccagcagg

SEQ ID NO: 4115914 - DNA, 16 bp, Homo sapiens
ggccgaggcccagcgg

SEQ ID NO: 4115915 - DNA, 14 bp, Homo sapiens
ggcatctcctgtgc

SEQ ID NO: 4115916 - DNA, 21 bp, Homo sapiens
ggcatctcctgtgcatgggtg

SEQ ID NO: 4115917 - DNA, 14 bp, Homo sapiens
ggcatctcttcccc

SEQ ID NO: 4115918 - DNA, 19 bp, Homo sapiens
ggcatctcttccccagaga

SEQ ID NO: 4115919 - DNA, 21 bp, Homo sapiens
ggcatctttgccttgggctgc

SEQ ID NO: 4115920 - DNA, 16 bp, Homo sapiens
ggcatgccaccctcac

SEQ ID NO: 4115921 - DNA, 17 bp, Homo sapiens
ggcatgccaccctcaca

SEQ ID NO: 4115922 - DNA, 14 bp, Homo sapiens
ggcatgccttgtgc

SEQ ID NO: 4115923 - DNA, 12 bp, Homo sapiens
ggcatggccctg

SEQ ID NO: 4115924 - DNA, 18 bp, Homo sapiens
ggcatgggtccagggcct

SEQ ID NO: 4115925 - DNA, 16 bp, Homo sapiens
ggcatgtaggaccctg

SEQ ID NO: 4115926 - DNA, 13 bp, Homo sapiens
ggcatgtctgcct

SEQ ID NO: 4115927 - DNA, 14 bp, Homo sapiens
ggcatgtgtatgtg

SEQ ID NO: 4115928 - DNA, 20 bp, Homo sapiens
ggcattagaattatttaaac

SEQ ID NO: 4115929 - DNA, 19 bp, Homo sapiens
ggcattcgggccacagggc

SEQ ID NO: 4115930 - DNA, 15 bp, Homo sapiens
ggcattgttagttta

SEQ ID NO: 4115931 - DNA, 16 bp, Homo sapiens
ggcatttcccaccctg

SEQ ID NO: 4115932 - DNA, 22 bp, Homo sapiens
ggcatttgctgccccagctact

SEQ ID NO: 4115933 - DNA, 16 bp, Homo sapiens
ggcattttcctcctct

SEQ ID NO: 4115934 - DNA, 18 bp, Homo sapiens
ggcattttcctcctctgc

SEQ ID NO: 4115935 - DNA, 17 bp, Homo sapiens
ggccaaaagctagacag

SEQ ID NO: 4115936 - DNA, 17 bp, Homo sapiens
ggccaaacatcagacct

SEQ ID NO: 4115937 - DNA, 19 bp, Homo sapiens
ggccaaacatcagacctgt

SEQ ID NO: 4115938 - DNA, 23 bp, Homo sapiens
ggccaaacatcagacctgtcttc

SEQ ID NO: 4115939 - DNA, 19 bp, Homo sapiens
ggccaaactgtccctccct

SEQ ID NO: 4115940 - DNA, 23 bp, Homo sapiens
ggccaacaatcctttctgcccac

SEQ ID NO: 4115941 - DNA, 18 bp, Homo sapiens
ggccaaggccttctcctc

SEQ ID NO: 4115942 - DNA, 16 bp, Homo sapiens
ggccaagtccgcagaa

SEQ ID NO: 4115943 - DNA, 14 bp, Homo sapiens
ggccaataaaaagt

SEQ ID NO: 4115944 - DNA, 16 bp, Homo sapiens
ggccaataaaaagttc

SEQ ID NO: 4115945 - DNA, 22 bp, Homo sapiens
ggccacacgcactggtgccaaa

SEQ ID NO: 4115946 - DNA, 21 bp, Homo sapiens
ggccacactcagcacaaggcc

SEQ ID NO: 4115947 - DNA, 14 bp, Homo sapiens
ggccacatttaata

SEQ ID NO: 4115948 - DNA, 15 bp, Homo sapiens
ggccaccagccatcc

SEQ ID NO: 4115949 - DNA, 23 bp, Homo sapiens
ggccaccagccatcctccctcca

SEQ ID NO: 4115950 - DNA, 14 bp, Homo sapiens
ggccaccaggatgg

SEQ ID NO: 4115951 - DNA, 12 bp, Homo sapiens
ggccaccatccc

SEQ ID NO: 4115952 - DNA, 14 bp, Homo sapiens
ggccaccatccctg

SEQ ID NO: 4115953 - DNA, 18 bp, Homo sapiens
ggccaccgggacagacct

SEQ ID NO: 4115954 - DNA, 19 bp, Homo sapiens
ggccaccgggacagacctg

SEQ ID NO: 4115955 - DNA, 17 bp, Homo sapiens
ggccacgcactgggcca

SEQ ID NO: 4115956 - DNA, 15 bp, Homo sapiens
ggccacggaggaggg

SEQ ID NO: 4115957 - DNA, 15 bp, Homo sapiens
ggccacggctgagcc

SEQ ID NO: 4115958 - DNA, 16 bp, Homo sapiens
ggccacggctgagcct

SEQ ID NO: 4115959 - DNA, 17 bp, Homo sapiens
ggccacggctgagcctt

SEQ ID NO: 4115960 - DNA, 23 bp, Homo sapiens
ggccacgtgggcaaacaggcagt

SEQ ID NO: 4115961 - DNA, 15 bp, Homo sapiens
ggccactaaagcttc

SEQ ID NO: 4115962 - DNA, 15 bp, Homo sapiens
ggccagaagtagctt

SEQ ID NO: 4115963 - DNA, 17 bp, Homo sapiens
ggccagaagtagctttg

SEQ ID NO: 4115964 - DNA, 18 bp, Homo sapiens
ggccagacatgccacaag

SEQ ID NO: 4115965 - DNA, 23 bp, Homo sapiens
ggccagacccacgggctcatgca

SEQ ID NO: 4115966 - DNA, 14 bp, Homo sapiens
ggccagacgctgcc

SEQ ID NO: 4115967 - DNA, 18 bp, Homo sapiens
ggccagagagcctggtgc

SEQ ID NO: 4115968 - DNA, 22 bp, Homo sapiens
ggccagagagcctggtgctgct

SEQ ID NO: 4115969 - DNA, 23 bp, Homo sapiens
ggccagagagcctggtgctgctg

SEQ ID NO: 4115970 - DNA, 14 bp, Homo sapiens
ggccagagccaggg

SEQ ID NO: 4115971 - DNA, 14 bp, Homo sapiens
ggccagagctggga

SEQ ID NO: 4115972 - DNA, 16 bp, Homo sapiens
ggccagagtggcctgg

SEQ ID NO: 4115973 - DNA, 19 bp, Homo sapiens
ggccagagtggcctggcca

SEQ ID NO: 4115974 - DNA, 12 bp, Homo sapiens
ggccagatccag

SEQ ID NO: 4115975 - DNA, 16 bp, Homo sapiens
ggccagatccagcctg

SEQ ID NO: 4115976 - DNA, 17 bp, Homo sapiens
ggccagatccagcctgg

SEQ ID NO: 4115977 - DNA, 17 bp, Homo sapiens
ggccagcaacgcttgta

SEQ ID NO: 4115978 - DNA, 14 bp, Homo sapiens
ggccagcaaggcag

SEQ ID NO: 4115979 - DNA, 17 bp, Homo sapiens
ggccagcaaggcaggtt

SEQ ID NO: 4115980 - DNA, 12 bp, Homo sapiens
ggccagcaccct

SEQ ID NO: 4115981 - DNA, 20 bp, Homo sapiens
ggccagcaccctctcctggg

SEQ ID NO: 4115982 - DNA, 16 bp, Homo sapiens
ggccagccagtgccat

SEQ ID NO: 4115983 - DNA, 17 bp, Homo sapiens
ggccagccagtgccatt

SEQ ID NO: 4115984 - DNA, 13 bp, Homo sapiens
ggccagcccagcc

SEQ ID NO: 4115985 - DNA, 17 bp, Homo sapiens
ggccagcccagccaggc

SEQ ID NO: 4115986 - DNA, 15 bp, Homo sapiens
ggccagccccaccca

SEQ ID NO: 4115987 - DNA, 19 bp, Homo sapiens
ggccagccccggccctggg

SEQ ID NO: 4115988 - DNA, 20 bp, Homo sapiens
ggccagccccggccctgggc

SEQ ID NO: 4115989 - DNA, 18 bp, Homo sapiens
ggccagccctgcagccca

SEQ ID NO: 4115990 - DNA, 19 bp, Homo sapiens
ggccagcctccgagaggga

SEQ ID NO: 4115991 - DNA, 20 bp, Homo sapiens
ggccagcctccgagagggag

SEQ ID NO: 4115992 - DNA, 19 bp, Homo sapiens
ggccagcgggcacagggca

SEQ ID NO: 4115993 - DNA, 16 bp, Homo sapiens
ggccagcggggctgct

SEQ ID NO: 4115994 - DNA, 16 bp, Homo sapiens
ggccagcgtcccaggg

SEQ ID NO: 4115995 - DNA, 12 bp, Homo sapiens
ggccaggacacc

SEQ ID NO: 4115996 - DNA, 19 bp, Homo sapiens
ggccaggagtttgagacca

SEQ ID NO: 4115997 - DNA, 20 bp, Homo sapiens
ggccaggagtttgagaccag

SEQ ID NO: 4115998 - DNA, 19 bp, Homo sapiens
ggccaggcacaatggctca

SEQ ID NO: 4115999 - DNA, 19 bp, Homo sapiens
ggccaggcacagggcccgc

SEQ ID NO: 4116000 - DNA, 15 bp, Homo sapiens
ggccaggccaccagg

SEQ ID NO: 4116001 - DNA, 17 bp, Homo sapiens
ggccaggccaccaggat

SEQ ID NO: 4116002 - DNA, 20 bp, Homo sapiens
ggccaggcccaggcctcacc

SEQ ID NO: 4116003 - DNA, 17 bp, Homo sapiens
ggccagggagaagctcc

SEQ ID NO: 4116004 - DNA, 20 bp, Homo sapiens
ggccagggccacgctccagc

SEQ ID NO: 4116005 - DNA, 11 bp, Homo sapiens
ggccagggctg

SEQ ID NO: 4116006 - DNA, 20 bp, Homo sapiens
ggccagggctgccctgagaa

SEQ ID NO: 4116007 - DNA, 17 bp, Homo sapiens
ggccagggtctgtgtga

SEQ ID NO: 4116008 - DNA, 11 bp, Homo sapiens
ggccaggtcac

SEQ ID NO: 4116009 - DNA, 12 bp, Homo sapiens
ggccagtcccca

SEQ ID NO: 4116010 - DNA, 21 bp, Homo sapiens
ggccagtccccatttctgcct

SEQ ID NO: 4116011 - DNA, 20 bp, Homo sapiens
ggccagtggggaactgaggg

SEQ ID NO: 4116012 - DNA, 21 bp, Homo sapiens
ggccagtggggaactgagggc

SEQ ID NO: 4116013 - DNA, 15 bp, Homo sapiens
ggccagtggggcctg

SEQ ID NO: 4116014 - DNA, 18 bp, Homo sapiens
ggccagtggggcctgtgg

SEQ ID NO: 4116015 - DNA, 20 bp, Homo sapiens
ggccagtttgaagcctgtgc

SEQ ID NO: 4116016 - DNA, 16 bp, Homo sapiens
ggccataggagaggag

SEQ ID NO: 4116017 - DNA, 21 bp, Homo sapiens
ggccatccttccgccaatctg

SEQ ID NO: 4116018 - DNA, 13 bp, Homo sapiens
ggcacagccctcc

SEQ ID NO: 4116019 - DNA, 22 bp, Homo sapiens
ggcacagcggagtctgtcctgt

SEQ ID NO: 4116020 - DNA, 20 bp, Homo sapiens
ggcacagggcaccagaggcc

SEQ ID NO: 4116021 - DNA, 16 bp, Homo sapiens
ggcacagggcagtggg

SEQ ID NO: 4116022 - DNA, 13 bp, Homo sapiens
ggcacagggcccg

SEQ ID NO: 4116023 - DNA, 14 bp, Homo sapiens
ggcacagggcccgc

SEQ ID NO: 4116024 - DNA, 17 bp, Homo sapiens
ggcacagtccagaccca

SEQ ID NO: 4116025 - DNA, 18 bp, Homo sapiens
ggcacatgccacctggca

SEQ ID NO: 4116026 - DNA, 20 bp, Homo sapiens
ggcaccagacacccaggact

SEQ ID NO: 4116027 - DNA, 17 bp, Homo sapiens
ggcaccagatgcaacct

SEQ ID NO: 4116028 - DNA, 18 bp, Homo sapiens
ggcaccagatgcaacctc

SEQ ID NO: 4116029 - DNA, 20 bp, Homo sapiens
ggcaccccctggagagaagt

SEQ ID NO: 4116030 - DNA, 13 bp, Homo sapiens
ggcaccctcaggg

SEQ ID NO: 4116031 - DNA, 20 bp, Homo sapiens
ggcaccctcagggagcctcc

SEQ ID NO: 4116032 - DNA, 19 bp, Homo sapiens
ggcaccctgtggccctggc

SEQ ID NO: 4116033 - DNA, 14 bp, Homo sapiens
ggcaccgagaatgt

SEQ ID NO: 4116034 - DNA, 17 bp, Homo sapiens
ggcacctaatccaggca

SEQ ID NO: 4116035 - DNA, 19 bp, Homo sapiens
ggcacctaatccaggcaga

SEQ ID NO: 4116036 - DNA, 22 bp, Homo sapiens
ggcacctaatccaggcagatcc

SEQ ID NO: 4116037 - DNA, 12 bp, Homo sapiens
ggcacctcttcc

SEQ ID NO: 4116038 - DNA, 17 bp, Homo sapiens
ggcacctgcacactcca

SEQ ID NO: 4116039 - DNA, 20 bp, Homo sapiens
ggcacctgcacactccatct

SEQ ID NO: 4116040 - DNA, 22 bp, Homo sapiens
ggcacctgcacactccatctcc

SEQ ID NO: 4116041 - DNA, 14 bp, Homo sapiens
ggcacgcctgctgg

SEQ ID NO: 4116042 - DNA, 19 bp, Homo sapiens
ggcactcaactctgagccc

SEQ ID NO: 4116043 - DNA, 16 bp, Homo sapiens
ggcactgcccttttca

SEQ ID NO: 4116044 - DNA, 20 bp, Homo sapiens
ggcactgccttctcctctct

SEQ ID NO: 4116045 - DNA, 14 bp, Homo sapiens
ggcactggcccagg

SEQ ID NO: 4116046 - DNA, 19 bp, Homo sapiens
ggcactgggatgagccgct

SEQ ID NO: 4116047 - DNA, 21 bp, Homo sapiens
ggcactgggatgagccgctgt

SEQ ID NO: 4116048 - DNA, 21 bp, Homo sapiens
ggcactggtaggttgggacac

SEQ ID NO: 4116049 - DNA, 20 bp, Homo sapiens
ggcactggtttgttccctgt

SEQ ID NO: 4116050 - DNA, 22 bp, Homo sapiens
ggcactttgaaggggcctcacc

SEQ ID NO: 4116051 - DNA, 18 bp, Homo sapiens
ggcagaactcccacaacc

SEQ ID NO: 4116052 - DNA, 14 bp, Homo sapiens
ggcagactgtgaac

SEQ ID NO: 4116053 - DNA, 14 bp, Homo sapiens
ggcagagagagaga

SEQ ID NO: 4116054 - DNA, 22 bp, Homo sapiens
ggcagagcctttggatgaccag

SEQ ID NO: 4116055 - DNA, 12 bp, Homo sapiens
ggcagagggctg

SEQ ID NO: 4116056 - DNA, 21 bp, Homo sapiens
ggcagagggctggaggcccag

SEQ ID NO: 4116057 - DNA, 16 bp, Homo sapiens
ggcagatctgtgcccc

SEQ ID NO: 4116058 - DNA, 17 bp, Homo sapiens
ggcagatctgtgcccca

SEQ ID NO: 4116059 - DNA, 18 bp, Homo sapiens
ggcagatctgtgccccat

SEQ ID NO: 4116060 - DNA, 21 bp, Homo sapiens
ggcagatgtcttccctgggct

SEQ ID NO: 4116061 - DNA, 17 bp, Homo sapiens
ggcagatgtttgcctca

SEQ ID NO: 4116062 - DNA, 12 bp, Homo sapiens
ggcagcaccctc

SEQ ID NO: 4116063 - DNA, 15 bp, Homo sapiens
ggcagcaccctcccc

SEQ ID NO: 4116064 - DNA, 22 bp, Homo sapiens
ggcagcagagagagaggacaga

SEQ ID NO: 4116065 - DNA, 19 bp, Homo sapiens
ggcagcatagcaagacaca

SEQ ID NO: 4116066 - DNA, 21 bp, Homo sapiens
ggcagcattttcatatccaag

SEQ ID NO: 4116067 - DNA, 23 bp, Homo sapiens
ggcagccacttcggccaggtcac

SEQ ID NO: 4116068 - DNA, 15 bp, Homo sapiens
ggcagccagatggcc

SEQ ID NO: 4116069 - DNA, 18 bp, Homo sapiens
ggcagcccaaagctgcag

SEQ ID NO: 4116070 - DNA, 22 bp, Homo sapiens
ggcagcccactgcaccgcctca

SEQ ID NO: 4116071 - DNA, 13 bp, Homo sapiens
ggcagcccagcag

SEQ ID NO: 4116072 - DNA, 14 bp, Homo sapiens
ggcagcccagcagt

SEQ ID NO: 4116073 - DNA, 15 bp, Homo sapiens
ggcagccccagagag

SEQ ID NO: 4116074 - DNA, 22 bp, Homo sapiens
ggcagcccccatgggctcctgc

SEQ ID NO: 4116075 - DNA, 16 bp, Homo sapiens
ggcagccccctccaca

SEQ ID NO: 4116076 - DNA, 18 bp, Homo sapiens
ggcagccgtgccttcagc

SEQ ID NO: 4116077 - DNA, 23 bp, Homo sapiens
ggcagcctgccttgcccactcct

SEQ ID NO: 4116078 - DNA, 14 bp, Homo sapiens
ggcagccttgggga

SEQ ID NO: 4116079 - DNA, 14 bp, Homo sapiens
ggcagcgccaggct

SEQ ID NO: 4116080 - DNA, 15 bp, Homo sapiens
ggcagcgggccaggc

SEQ ID NO: 4116081 - DNA, 16 bp, Homo sapiens
ggcagcgggccaggcc

SEQ ID NO: 4116082 - DNA, 13 bp, Homo sapiens
ggcagctagtgcc

SEQ ID NO: 4116083 - DNA, 18 bp, Homo sapiens
ggcagctatctgcactct

SEQ ID NO: 4116084 - DNA, 15 bp, Homo sapiens
ggcagctcacccctg

SEQ ID NO: 4116085 - DNA, 20 bp, Homo sapiens
ggcagctgtttctcatgaag

SEQ ID NO: 4116086 - DNA, 17 bp, Homo sapiens
ggcagcttcaagtgcct

SEQ ID NO: 4116087 - DNA, 19 bp, Homo sapiens
ggcagcttctactcctgcc

SEQ ID NO: 4116088 - DNA, 15 bp, Homo sapiens
ggcaggaaggagagc

SEQ ID NO: 4116089 - DNA, 23 bp, Homo sapiens
ggcaggaaggagagcctgctgca

SEQ ID NO: 4116090 - DNA, 11 bp, Homo sapiens
ggcaggactga

SEQ ID NO: 4116091 - DNA, 24 bp, Homo sapiens
ggcaggaggattgcttgagcccag

SEQ ID NO: 4116092 - DNA, 14 bp, Homo sapiens
ggcaggagggccct

SEQ ID NO: 4116093 - DNA, 16 bp, Homo sapiens
ggcaggatggcctttc

SEQ ID NO: 4116094 - DNA, 21 bp, Homo sapiens
ggcaggatggcctttccttcc

SEQ ID NO: 4116095 - DNA, 17 bp, Homo sapiens
ggcaggcacacagcagc

SEQ ID NO: 4116096 - DNA, 22 bp, Homo sapiens
ggcaggcacacagcagcccccc

SEQ ID NO: 4116097 - DNA, 17 bp, Homo sapiens
ggcaggccagtgtctgg

SEQ ID NO: 4116098 - DNA, 13 bp, Homo sapiens
ggcaggctcactg

SEQ ID NO: 4116099 - DNA, 14 bp, Homo sapiens
ggcagggaccacac

SEQ ID NO: 4116100 - DNA, 22 bp, Homo sapiens
ggcagggcccttggggctgggg

SEQ ID NO: 4116101 - DNA, 23 bp, Homo sapiens
ggcaggggagacaggagcctagc

SEQ ID NO: 4116102 - DNA, 22 bp, Homo sapiens
ggcagggggccccgccagggct

SEQ ID NO: 4116103 - DNA, 16 bp, Homo sapiens
ggcaggggtgggggtg

SEQ ID NO: 4116104 - DNA, 15 bp, Homo sapiens
ggcaggtcctggcca

SEQ ID NO: 4116105 - DNA, 19 bp, Homo sapiens
ggcagtattttgtgtcctc

SEQ ID NO: 4116106 - DNA, 21 bp, Homo sapiens
ggcagtgagggagggctgtca

SEQ ID NO: 4116107 - DNA, 14 bp, Homo sapiens
ggcagtgccccagg

SEQ ID NO: 4116108 - DNA, 12 bp, Homo sapiens
ggcagtggaggt

SEQ ID NO: 4116109 - DNA, 21 bp, Homo sapiens
ggcagttctcactcctaggag

SEQ ID NO: 4116110 - DNA, 23 bp, Homo sapiens
ggcagttctcactcctaggagag

SEQ ID NO: 4116111 - DNA, 11 bp, Homo sapiens
ggcagttgcat

SEQ ID NO: 4116112 - DNA, 16 bp, Homo sapiens
ggcagttgcccagcct

SEQ ID NO: 4116113 - DNA, 17 bp, Homo sapiens
ggcatacacacagcagt

SEQ ID NO: 4116114 - DNA, 14 bp, Homo sapiens
ggcataggcctggg

SEQ ID NO: 4116115 - DNA, 16 bp, Homo sapiens
ggcataggcctgggtg

SEQ ID NO: 4116116 - DNA, 18 bp, Homo sapiens
ggcataggtaagctgtgc

SEQ ID NO: 4116117 - DNA, 14 bp, Homo sapiens
ggcatcaaccacca

SEQ ID NO: 4116118 - DNA, 22 bp, Homo sapiens
ggcatcccagcctgggggccag

SEQ ID NO: 4116119 - DNA, 16 bp, Homo sapiens
ggcatctacacagcct

SEQ ID NO: 4116120 - DNA, 17 bp, Homo sapiens
ggcatctacacagcctg

SEQ ID NO: 4116121 - DNA, 19 bp, Homo sapiens
ggatagtgttctgctcctg

SEQ ID NO: 4116122 - DNA, 22 bp, Homo sapiens
ggatatccttatcagagctaag

SEQ ID NO: 4116123 - DNA, 13 bp, Homo sapiens
ggatcaattttca

SEQ ID NO: 4116124 - DNA, 12 bp, Homo sapiens
ggatcagaatag

SEQ ID NO: 4116125 - DNA, 21 bp, Homo sapiens
ggatcagggaatccagctccc

SEQ ID NO: 4116126 - DNA, 12 bp, Homo sapiens
ggatcagttttt

SEQ ID NO: 4116127 - DNA, 19 bp, Homo sapiens
ggatcatggtgtaataaga

SEQ ID NO: 4116128 - DNA, 21 bp, Homo sapiens
ggatcccaagcctcctgctgc

SEQ ID NO: 4116129 - DNA, 17 bp, Homo sapiens
ggatccctcccccccat

SEQ ID NO: 4116130 - DNA, 14 bp, Homo sapiens
ggatcctattctca

SEQ ID NO: 4116131 - DNA, 20 bp, Homo sapiens
ggatcctattctcaccagga

SEQ ID NO: 4116132 - DNA, 17 bp, Homo sapiens
ggatcctccctcatggc

SEQ ID NO: 4116133 - DNA, 15 bp, Homo sapiens
ggatcggactctgcc

SEQ ID NO: 4116134 - DNA, 14 bp, Homo sapiens
ggatctatttcatg

SEQ ID NO: 4116135 - DNA, 13 bp, Homo sapiens
ggatctccaagga

SEQ ID NO: 4116136 - DNA, 13 bp, Homo sapiens
ggatctctcagga

SEQ ID NO: 4116137 - DNA, 19 bp, Homo sapiens
ggatctgtcacaccagcca

SEQ ID NO: 4116138 - DNA, 15 bp, Homo sapiens
ggatcttcaatggct

SEQ ID NO: 4116139 - DNA, 20 bp, Homo sapiens
ggatcttgaatgtggtctca

SEQ ID NO: 4116140 - DNA, 21 bp, Homo sapiens
ggatcttgaatgtggtctcag

SEQ ID NO: 4116141 - DNA, 14 bp, Homo sapiens
ggatcttgccacat

SEQ ID NO: 4116142 - DNA, 23 bp, Homo sapiens
ggatgaatgtatgtgcactgtca

SEQ ID NO: 4116143 - DNA, 22 bp, Homo sapiens
ggatgacacaatccctggggct

SEQ ID NO: 4116144 - DNA, 16 bp, Homo sapiens
ggatgacaccctggcc

SEQ ID NO: 4116145 - DNA, 19 bp, Homo sapiens
ggatgacaggcgcctgcca

SEQ ID NO: 4116146 - DNA, 18 bp, Homo sapiens
ggatgagagcccagaggt

SEQ ID NO: 4116147 - DNA, 19 bp, Homo sapiens
ggatgagagcccagaggta

SEQ ID NO: 4116148 - DNA, 20 bp, Homo sapiens
ggatgagagcccagaggtaa

SEQ ID NO: 4116149 - DNA, 21 bp, Homo sapiens
ggatgattcagaaattggaac

SEQ ID NO: 4116150 - DNA, 18 bp, Homo sapiens
ggatgccactcctccctc

SEQ ID NO: 4116151 - DNA, 20 bp, Homo sapiens
ggatgccactcctccctccg

SEQ ID NO: 4116152 - DNA, 14 bp, Homo sapiens
ggatgcgcagtgcc

SEQ ID NO: 4116153 - DNA, 16 bp, Homo sapiens
ggatgctgctccgccc

SEQ ID NO: 4116154 - DNA, 17 bp, Homo sapiens
ggatggagaggcggcct

SEQ ID NO: 4116155 - DNA, 19 bp, Homo sapiens
ggatggaggggtggtcctg

SEQ ID NO: 4116156 - DNA, 15 bp, Homo sapiens
ggatggcccagggtg

SEQ ID NO: 4116157 - DNA, 19 bp, Homo sapiens
ggatggcctttccttccct

SEQ ID NO: 4116158 - DNA, 18 bp, Homo sapiens
ggatgggaacactggtgg

SEQ ID NO: 4116159 - DNA, 22 bp, Homo sapiens
ggatgggagtgggcacctcaga

SEQ ID NO: 4116160 - DNA, 19 bp, Homo sapiens
ggatggggagtcccaaagc

SEQ ID NO: 4116161 - DNA, 21 bp, Homo sapiens
ggatgggggaactcagatcca

SEQ ID NO: 4116162 - DNA, 16 bp, Homo sapiens
ggatgggtggatggcc

SEQ ID NO: 4116163 - DNA, 14 bp, Homo sapiens
ggatggtccaggat

SEQ ID NO: 4116164 - DNA, 16 bp, Homo sapiens
ggatgtcacagggcca

SEQ ID NO: 4116165 - DNA, 22 bp, Homo sapiens
ggatgtcagcagacacacatgg

SEQ ID NO: 4116166 - DNA, 14 bp, Homo sapiens
ggatgtccctgggc

SEQ ID NO: 4116167 - DNA, 19 bp, Homo sapiens
ggatgtccctgggccaggg

SEQ ID NO: 4116168 - DNA, 14 bp, Homo sapiens
ggatgtcgtctttg

SEQ ID NO: 4116169 - DNA, 23 bp, Homo sapiens
ggatgttattatccttgggggct

SEQ ID NO: 4116170 - DNA, 23 bp, Homo sapiens
ggatgttcagcactgtcccttgc

SEQ ID NO: 4116171 - DNA, 21 bp, Homo sapiens
ggatgttttgtcccatttcct

SEQ ID NO: 4116172 - DNA, 18 bp, Homo sapiens
ggatgtttttcatgaaaa

SEQ ID NO: 4116173 - DNA, 17 bp, Homo sapiens
ggattaaaacaattttt

SEQ ID NO: 4116174 - DNA, 16 bp, Homo sapiens
ggattaacctctgcac

SEQ ID NO: 4116175 - DNA, 14 bp, Homo sapiens
ggattaatatgaaa

SEQ ID NO: 4116176 - DNA, 22 bp, Homo sapiens
ggattattcatttaaaatgatt

SEQ ID NO: 4116177 - DNA, 17 bp, Homo sapiens
ggattatttaataacat

SEQ ID NO: 4116178 - DNA, 22 bp, Homo sapiens
ggattatttaataacattacct

SEQ ID NO: 4116179 - DNA, 22 bp, Homo sapiens
ggattcccaccaaggtcttcag

SEQ ID NO: 4116180 - DNA, 23 bp, Homo sapiens
ggattcctaatcactcagagcag

SEQ ID NO: 4116181 - DNA, 20 bp, Homo sapiens
ggattctactttaagcacta

SEQ ID NO: 4116182 - DNA, 23 bp, Homo sapiens
ggattgcccctggctttgcctct

SEQ ID NO: 4116183 - DNA, 22 bp, Homo sapiens
ggattggccaaacatcagacct

SEQ ID NO: 4116184 - DNA, 20 bp, Homo sapiens
ggattgtatcaagtggcatg

SEQ ID NO: 4116185 - DNA, 14 bp, Homo sapiens
ggatttaatttcca

SEQ ID NO: 4116186 - DNA, 13 bp, Homo sapiens
ggatttccctgca

SEQ ID NO: 4116187 - DNA, 15 bp, Homo sapiens
ggatttcgtttttct

SEQ ID NO: 4116188 - DNA, 22 bp, Homo sapiens
ggatttgccccttcccatctct

SEQ ID NO: 4116189 - DNA, 15 bp, Homo sapiens
ggatttgttgccatg

SEQ ID NO: 4116190 - DNA, 22 bp, Homo sapiens
ggattttaacaaaagcaagact

SEQ ID NO: 4116191 - DNA, 13 bp, Homo sapiens
ggcaaaaatgcaa

SEQ ID NO: 4116192 - DNA, 21 bp, Homo sapiens
ggcaaaaatgcaacaaatgaa

SEQ ID NO: 4116193 - DNA, 16 bp, Homo sapiens
ggcaaaagccttgtgt

SEQ ID NO: 4116194 - DNA, 23 bp, Homo sapiens
ggcaaacaggcagttggccagag

SEQ ID NO: 4116195 - DNA, 15 bp, Homo sapiens
ggcaaacgggcttga

SEQ ID NO: 4116196 - DNA, 22 bp, Homo sapiens
ggcaaagcacgaaatgttattt

SEQ ID NO: 4116197 - DNA, 19 bp, Homo sapiens
ggcaaagtttaaatgtatt

SEQ ID NO: 4116198 - DNA, 12 bp, Homo sapiens
ggcaaataaaag

SEQ ID NO: 4116199 - DNA, 11 bp, Homo sapiens
ggcaaatctgc

SEQ ID NO: 4116200 - DNA, 15 bp, Homo sapiens
ggcaacagatctgga

SEQ ID NO: 4116201 - DNA, 17 bp, Homo sapiens
ggcaacaggacagagtt

SEQ ID NO: 4116202 - DNA, 15 bp, Homo sapiens
ggcaacgaagaaaaa

SEQ ID NO: 4116203 - DNA, 16 bp, Homo sapiens
ggcaacgaagaaaaaa

SEQ ID NO: 4116204 - DNA, 16 bp, Homo sapiens
ggcaacgcacaaaaca

SEQ ID NO: 4116205 - DNA, 12 bp, Homo sapiens
ggcaagaaaagg

SEQ ID NO: 4116206 - DNA, 16 bp, Homo sapiens
ggcaagaacagtgggc

SEQ ID NO: 4116207 - DNA, 21 bp, Homo sapiens
ggcaagacagaaaagtgcctg

SEQ ID NO: 4116208 - DNA, 16 bp, Homo sapiens
ggcaagagggggtgga

SEQ ID NO: 4116209 - DNA, 17 bp, Homo sapiens
ggcaagagggtgacagc

SEQ ID NO: 4116210 - DNA, 13 bp, Homo sapiens
ggcaagcagcggg

SEQ ID NO: 4116211 - DNA, 14 bp, Homo sapiens
ggcaagcagcgggc

SEQ ID NO: 4116212 - DNA, 12 bp, Homo sapiens
ggcaagcaggac

SEQ ID NO: 4116213 - DNA, 22 bp, Homo sapiens
ggcaagctgtgacttctccagg

SEQ ID NO: 4116214 - DNA, 16 bp, Homo sapiens
ggcaatagggtagaat

SEQ ID NO: 4116215 - DNA, 18 bp, Homo sapiens
ggcaatagtgtgttctga

SEQ ID NO: 4116216 - DNA, 18 bp, Homo sapiens
ggcaatgtcaggaacaga

SEQ ID NO: 4116217 - DNA, 13 bp, Homo sapiens
ggcaattgtctat

SEQ ID NO: 4116218 - DNA, 15 bp, Homo sapiens
ggcacaactgcaata

SEQ ID NO: 4116219 - DNA, 22 bp, Homo sapiens
ggcacaactgcaataacttctg

SEQ ID NO: 4116220 - DNA, 18 bp, Homo sapiens
ggcacaagtcctggatgt

SEQ ID NO: 4116221 - DNA, 22 bp, Homo sapiens
ggcacaatggctaattcccaga

SEQ ID NO: 4116222 - DNA, 15 bp, Homo sapiens
ggcacacacagcccc

SEQ ID NO: 4116223 - DNA, 21 bp, Homo sapiens
ggcacagaaacacaatatttt

SEQ ID NO: 4116224 - DNA, 14 bp, Homo sapiens
ggagctgcactgat

SEQ ID NO: 4116225 - DNA, 16 bp, Homo sapiens
ggagctgcctgcttgg

SEQ ID NO: 4116226 - DNA, 18 bp, Homo sapiens
ggagctgccttggctcag

SEQ ID NO: 4116227 - DNA, 13 bp, Homo sapiens
ggagctgctggct

SEQ ID NO: 4116228 - DNA, 15 bp, Homo sapiens
ggagctgctggcttg

SEQ ID NO: 4116229 - DNA, 18 bp, Homo sapiens
ggagctgtcaccaaggaa

SEQ ID NO: 4116230 - DNA, 20 bp, Homo sapiens
ggagctgtgagttctccctg

SEQ ID NO: 4116231 - DNA, 21 bp, Homo sapiens
ggagcttagccaatgtgggag

SEQ ID NO: 4116232 - DNA, 22 bp, Homo sapiens
ggaggaaaaccaagccgtggct

SEQ ID NO: 4116233 - DNA, 13 bp, Homo sapiens
ggaggaaaaggaa

SEQ ID NO: 4116234 - DNA, 12 bp, Homo sapiens
ggaggaaagcaa

SEQ ID NO: 4116235 - DNA, 14 bp, Homo sapiens
ggaggaattcagct

SEQ ID NO: 4116236 - DNA, 22 bp, Homo sapiens
ggaggaccagggctggggcagc

SEQ ID NO: 4116237 - DNA, 17 bp, Homo sapiens
ggaggagaccagctcag

SEQ ID NO: 4116238 - DNA, 15 bp, Homo sapiens
ggaggagcagcagct

SEQ ID NO: 4116239 - DNA, 13 bp, Homo sapiens
ggaggagctgcct

SEQ ID NO: 4116240 - DNA, 15 bp, Homo sapiens
ggaggaggaaggcaa

SEQ ID NO: 4116241 - DNA, 12 bp, Homo sapiens
ggaggagggaga

SEQ ID NO: 4116242 - DNA, 16 bp, Homo sapiens
ggaggagggatgctgc

SEQ ID NO: 4116243 - DNA, 18 bp, Homo sapiens
ggaggatcagttttttgt

SEQ ID NO: 4116244 - DNA, 19 bp, Homo sapiens
ggaggcaagaaaaggacaa

SEQ ID NO: 4116245 - DNA, 23 bp, Homo sapiens
ggaggcaagagactgggagccac

SEQ ID NO: 4116246 - DNA, 13 bp, Homo sapiens
ggaggcagccccc

SEQ ID NO: 4116247 - DNA, 15 bp, Homo sapiens
ggaggcatggccctg

SEQ ID NO: 4116248 - DNA, 18 bp, Homo sapiens
ggaggccaaactgtccct

SEQ ID NO: 4116249 - DNA, 20 bp, Homo sapiens
ggaggccaaactgtccctcc

SEQ ID NO: 4116250 - DNA, 21 bp, Homo sapiens
ggaggccacacgcactggtgc

SEQ ID NO: 4116251 - DNA, 16 bp, Homo sapiens
ggaggcccaggctggg

SEQ ID NO: 4116252 - DNA, 18 bp, Homo sapiens
ggaggcccctggagccag

SEQ ID NO: 4116253 - DNA, 23 bp, Homo sapiens
ggaggccctcctgtgctggggga

SEQ ID NO: 4116254 - DNA, 17 bp, Homo sapiens
ggaggcctcaggtgctg

SEQ ID NO: 4116255 - DNA, 17 bp, Homo sapiens
ggaggccttccagctgc

SEQ ID NO: 4116256 - DNA, 19 bp, Homo sapiens
ggaggccttccagctgctg

SEQ ID NO: 4116257 - DNA, 20 bp, Homo sapiens
ggaggccttccagctgctgt

SEQ ID NO: 4116258 - DNA, 21 bp, Homo sapiens
ggaggccttccagctgctgtc

SEQ ID NO: 4116259 - DNA, 14 bp, Homo sapiens
ggaggcggcccggc

SEQ ID NO: 4116260 - DNA, 18 bp, Homo sapiens
ggaggcggcccggccagc

SEQ ID NO: 4116261 - DNA, 10 bp, Homo sapiens
ggaggctgcc

SEQ ID NO: 4116262 - DNA, 21 bp, Homo sapiens
ggaggctgcccccggccccct

SEQ ID NO: 4116263 - DNA, 21 bp, Homo sapiens
ggagggaagtgtgagcgcctt

SEQ ID NO: 4116264 - DNA, 22 bp, Homo sapiens
ggagggacaagtggactcaggg

SEQ ID NO: 4116265 - DNA, 23 bp, Homo sapiens
ggagggcaagggccatgctgaag

SEQ ID NO: 4116266 - DNA, 21 bp, Homo sapiens
ggagggcccctgcgtgggggc

SEQ ID NO: 4116267 - DNA, 14 bp, Homo sapiens
ggagggcggtggac

SEQ ID NO: 4116268 - DNA, 22 bp, Homo sapiens
ggagggctgtcatctgtgcact

SEQ ID NO: 4116269 - DNA, 13 bp, Homo sapiens
ggaggggaggcag

SEQ ID NO: 4116270 - DNA, 18 bp, Homo sapiens
ggaggggaggcagatgga

SEQ ID NO: 4116271 - DNA, 14 bp, Homo sapiens
ggaggggcctggca

SEQ ID NO: 4116272 - DNA, 18 bp, Homo sapiens
ggaggggcctggcagccg

SEQ ID NO: 4116273 - DNA, 17 bp, Homo sapiens
ggaggggcggcaggagg

SEQ ID NO: 4116274 - DNA, 15 bp, Homo sapiens
ggagggggagggggt

SEQ ID NO: 4116275 - DNA, 16 bp, Homo sapiens
ggagggggcttgaagc

SEQ ID NO: 4116276 - DNA, 23 bp, Homo sapiens
ggagggtaaatgatgtggtgcct

SEQ ID NO: 4116277 - DNA, 20 bp, Homo sapiens
ggaggtcacattcaggaaga

SEQ ID NO: 4116278 - DNA, 23 bp, Homo sapiens
ggaggtcacattcaggaagatga

SEQ ID NO: 4116279 - DNA, 22 bp, Homo sapiens
ggaggtgagatcacagcctcca

SEQ ID NO: 4116280 - DNA, 15 bp, Homo sapiens
ggaggtgaggggggc

SEQ ID NO: 4116281 - DNA, 17 bp, Homo sapiens
ggaggtggaagaaggga

SEQ ID NO: 4116282 - DNA, 20 bp, Homo sapiens
ggaggtggaggctgcagtga

SEQ ID NO: 4116283 - DNA, 16 bp, Homo sapiens
ggaggtgggcatgcca

SEQ ID NO: 4116284 - DNA, 19 bp, Homo sapiens
ggaggtggggcgaggcagg

SEQ ID NO: 4116285 - DNA, 21 bp, Homo sapiens
ggaggtgggtgtgggtggaag

SEQ ID NO: 4116286 - DNA, 22 bp, Homo sapiens
ggaggtgggtgtgggtggaagg

SEQ ID NO: 4116287 - DNA, 21 bp, Homo sapiens
ggaggtgtttaaagagaggtt

SEQ ID NO: 4116288 - DNA, 15 bp, Homo sapiens
ggaggttctcagagc

SEQ ID NO: 4116289 - DNA, 20 bp, Homo sapiens
ggaggttctcagagccaagt

SEQ ID NO: 4116290 - DNA, 22 bp, Homo sapiens
ggagtcagatgagcaaggacat

SEQ ID NO: 4116291 - DNA, 15 bp, Homo sapiens
ggagtcagccaggag

SEQ ID NO: 4116292 - DNA, 19 bp, Homo sapiens
ggagtcagccaggagctgt

SEQ ID NO: 4116293 - DNA, 15 bp, Homo sapiens
ggagtcagtgtctgg

SEQ ID NO: 4116294 - DNA, 18 bp, Homo sapiens
ggagtcagtgtctggctt

SEQ ID NO: 4116295 - DNA, 13 bp, Homo sapiens
ggagtcccaaagc

SEQ ID NO: 4116296 - DNA, 16 bp, Homo sapiens
ggagtcccaaggaaag

SEQ ID NO: 4116297 - DNA, 20 bp, Homo sapiens
ggagtcccactccaagccag

SEQ ID NO: 4116298 - DNA, 15 bp, Homo sapiens
ggagtcccctcacct

SEQ ID NO: 4116299 - DNA, 18 bp, Homo sapiens
ggagtctggagtgggcag

SEQ ID NO: 4116300 - DNA, 18 bp, Homo sapiens
ggagtgcagggaggagag

SEQ ID NO: 4116301 - DNA, 17 bp, Homo sapiens
ggagtgcagtggcatga

SEQ ID NO: 4116302 - DNA, 16 bp, Homo sapiens
ggagtgctggctcaca

SEQ ID NO: 4116303 - DNA, 17 bp, Homo sapiens
ggagtgggcacctcaga

SEQ ID NO: 4116304 - DNA, 18 bp, Homo sapiens
ggagtgggcacctcagaa

SEQ ID NO: 4116305 - DNA, 17 bp, Homo sapiens
ggagtggttaggcagca

SEQ ID NO: 4116306 - DNA, 24 bp, Homo sapiens
ggagtgtcctcttccctctctgca

SEQ ID NO: 4116307 - DNA, 15 bp, Homo sapiens
ggagttaagacctgg

SEQ ID NO: 4116308 - DNA, 23 bp, Homo sapiens
ggagttaagacctggcagctctg

SEQ ID NO: 4116309 - DNA, 20 bp, Homo sapiens
ggagttccttatccctctct

SEQ ID NO: 4116310 - DNA, 24 bp, Homo sapiens
ggagttccttatccctctcttccc

SEQ ID NO: 4116311 - DNA, 20 bp, Homo sapiens
ggagttcgaggctgcagtca

SEQ ID NO: 4116312 - DNA, 21 bp, Homo sapiens
ggagttcgaggctgcagtcag

SEQ ID NO: 4116313 - DNA, 18 bp, Homo sapiens
ggagttctagaaccactt

SEQ ID NO: 4116314 - DNA, 19 bp, Homo sapiens
ggagttctagaaccacttc

SEQ ID NO: 4116315 - DNA, 12 bp, Homo sapiens
ggagttcttctt

SEQ ID NO: 4116316 - DNA, 22 bp, Homo sapiens
ggagttgtcaagtctctgctgg

SEQ ID NO: 4116317 - DNA, 19 bp, Homo sapiens
ggataaaataatgctgcaa

SEQ ID NO: 4116318 - DNA, 15 bp, Homo sapiens
ggataaactgagcct

SEQ ID NO: 4116319 - DNA, 16 bp, Homo sapiens
ggataaactgagcctc

SEQ ID NO: 4116320 - DNA, 20 bp, Homo sapiens
ggataactttacagaaatgg

SEQ ID NO: 4116321 - DNA, 14 bp, Homo sapiens
ggatagaggggctg

SEQ ID NO: 4116322 - DNA, 18 bp, Homo sapiens
ggatagatgctggcccag

SEQ ID NO: 4116323 - DNA, 17 bp, Homo sapiens
ggataggagcctgctgg

SEQ ID NO: 4116324 - DNA, 16 bp, Homo sapiens
ggatagtatgagccct

SEQ ID NO: 4116325 - DNA, 17 bp, Homo sapiens
ggatagtgttctgctcc

SEQ ID NO: 4116326 - DNA, 20 bp, Homo sapiens
ggactgttccaaagccagtg

SEQ ID NO: 4116327 - DNA, 17 bp, Homo sapiens
ggacttaacggctccag

SEQ ID NO: 4116328 - DNA, 19 bp, Homo sapiens
ggacttaacggctccagga

SEQ ID NO: 4116329 - DNA, 18 bp, Homo sapiens
ggacttcctgtccagctc

SEQ ID NO: 4116330 - DNA, 19 bp, Homo sapiens
ggacttcctgtccagctcc

SEQ ID NO: 4116331 - DNA, 19 bp, Homo sapiens
ggacttgtatatttgtaca

SEQ ID NO: 4116332 - DNA, 16 bp, Homo sapiens
ggactttgcagccggc

SEQ ID NO: 4116333 - DNA, 22 bp, Homo sapiens
ggactttgcagccggcacaggg

SEQ ID NO: 4116334 - DNA, 21 bp, Homo sapiens
ggactttggttctctccagga

SEQ ID NO: 4116335 - DNA, 19 bp, Homo sapiens
ggacttttaatcagtgaag

SEQ ID NO: 4116336 - DNA, 14 bp, Homo sapiens
ggagaagagccctg

SEQ ID NO: 4116337 - DNA, 20 bp, Homo sapiens
ggagaagagtgccctgcttt

SEQ ID NO: 4116338 - DNA, 13 bp, Homo sapiens
ggagaagcatgaa

SEQ ID NO: 4116339 - DNA, 13 bp, Homo sapiens
ggagaagctgatg

SEQ ID NO: 4116340 - DNA, 16 bp, Homo sapiens
ggagaagctgatgctt

SEQ ID NO: 4116341 - DNA, 22 bp, Homo sapiens
ggagaatggtgtgaacccggga

SEQ ID NO: 4116342 - DNA, 22 bp, Homo sapiens
ggagaatttaggtttttattag

SEQ ID NO: 4116343 - DNA, 15 bp, Homo sapiens
ggagacaagaaatcc

SEQ ID NO: 4116344 - DNA, 20 bp, Homo sapiens
ggagacactggcccctcaaa

SEQ ID NO: 4116345 - DNA, 17 bp, Homo sapiens
ggagacagaatagagtg

SEQ ID NO: 4116346 - DNA, 13 bp, Homo sapiens
ggagacagaccac

SEQ ID NO: 4116347 - DNA, 20 bp, Homo sapiens
ggagacagaggaaagggctg

SEQ ID NO: 4116348 - DNA, 21 bp, Homo sapiens
ggagacagaggaaagggctgg

SEQ ID NO: 4116349 - DNA, 19 bp, Homo sapiens
ggagacatgtgacatttat

SEQ ID NO: 4116350 - DNA, 15 bp, Homo sapiens
ggagacattgtttgg

SEQ ID NO: 4116351 - DNA, 17 bp, Homo sapiens
ggagaccaaggcgggag

SEQ ID NO: 4116352 - DNA, 19 bp, Homo sapiens
ggagaccaagtcctggcta

SEQ ID NO: 4116353 - DNA, 14 bp, Homo sapiens
ggagaccagctcag

SEQ ID NO: 4116354 - DNA, 22 bp, Homo sapiens
ggagaccctgcaaacagaacag

SEQ ID NO: 4116355 - DNA, 12 bp, Homo sapiens
ggagaccctgcc

SEQ ID NO: 4116356 - DNA, 17 bp, Homo sapiens
ggagaccctgccacagc

SEQ ID NO: 4116357 - DNA, 16 bp, Homo sapiens
ggagactaagccctgt

SEQ ID NO: 4116358 - DNA, 12 bp, Homo sapiens
ggagactgagat

SEQ ID NO: 4116359 - DNA, 12 bp, Homo sapiens
ggagagaaaaaa

SEQ ID NO: 4116360 - DNA, 14 bp, Homo sapiens
ggagagaagctctt

SEQ ID NO: 4116361 - DNA, 15 bp, Homo sapiens
ggagagacaggcagc

SEQ ID NO: 4116362 - DNA, 20 bp, Homo sapiens
ggagagacaggcagcccagc

SEQ ID NO: 4116363 - DNA, 15 bp, Homo sapiens
ggagagacctcatca

SEQ ID NO: 4116364 - DNA, 14 bp, Homo sapiens
ggagagcagcagca

SEQ ID NO: 4116365 - DNA, 12 bp, Homo sapiens
ggagagcctgct

SEQ ID NO: 4116366 - DNA, 14 bp, Homo sapiens
ggagagcctgctgg

SEQ ID NO: 4116367 - DNA, 18 bp, Homo sapiens
ggagagctggtgcccgga

SEQ ID NO: 4116368 - DNA, 17 bp, Homo sapiens
ggagaggaaaagtaagg

SEQ ID NO: 4116369 - DNA, 11 bp, Homo sapiens
ggagaggagac

SEQ ID NO: 4116370 - DNA, 22 bp, Homo sapiens
ggagaggatgagagcccagagg

SEQ ID NO: 4116371 - DNA, 16 bp, Homo sapiens
ggagaggcggcctcgt

SEQ ID NO: 4116372 - DNA, 13 bp, Homo sapiens
ggagaggctgtct

SEQ ID NO: 4116373 - DNA, 16 bp, Homo sapiens
ggagaggctgtctggg

SEQ ID NO: 4116374 - DNA, 13 bp, Homo sapiens
ggagagggaggtc

SEQ ID NO: 4116375 - DNA, 18 bp, Homo sapiens
ggagagggatttccctgc

SEQ ID NO: 4116376 - DNA, 12 bp, Homo sapiens
ggagaggggggc

SEQ ID NO: 4116377 - DNA, 21 bp, Homo sapiens
ggagaggttataggtcactcc

SEQ ID NO: 4116378 - DNA, 23 bp, Homo sapiens
ggagatacttggtcacagccagg

SEQ ID NO: 4116379 - DNA, 14 bp, Homo sapiens
ggagatgaccaggg

SEQ ID NO: 4116380 - DNA, 19 bp, Homo sapiens
ggagatggaaacaatgtgg

SEQ ID NO: 4116381 - DNA, 12 bp, Homo sapiens
ggagatggaggg

SEQ ID NO: 4116382 - DNA, 16 bp, Homo sapiens
ggagcaaaaggcagct

SEQ ID NO: 4116383 - DNA, 19 bp, Homo sapiens
ggagcaaaaggcagctcac

SEQ ID NO: 4116384 - DNA, 20 bp, Homo sapiens
ggagcaaaatcgatgcagtg

SEQ ID NO: 4116385 - DNA, 19 bp, Homo sapiens
ggagcacccagagcacccc

SEQ ID NO: 4116386 - DNA, 10 bp, Homo sapiens
ggagcagaaa

SEQ ID NO: 4116387 - DNA, 18 bp, Homo sapiens
ggagcagaaacagccatt

SEQ ID NO: 4116388 - DNA, 13 bp, Homo sapiens
ggagcaggaacaa

SEQ ID NO: 4116389 - DNA, 12 bp, Homo sapiens
ggagcaggagcc

SEQ ID NO: 4116390 - DNA, 16 bp, Homo sapiens
ggagcagggaaggcct

SEQ ID NO: 4116391 - DNA, 13 bp, Homo sapiens
ggagcagtgtctt

SEQ ID NO: 4116392 - DNA, 16 bp, Homo sapiens
ggagcatctcttgagg

SEQ ID NO: 4116393 - DNA, 17 bp, Homo sapiens
ggagcatgcagaggagg

SEQ ID NO: 4116394 - DNA, 16 bp, Homo sapiens
ggagcatgggcctggc

SEQ ID NO: 4116395 - DNA, 20 bp, Homo sapiens
ggagccaacagaagcttcca

SEQ ID NO: 4116396 - DNA, 16 bp, Homo sapiens
ggagccaatggagact

SEQ ID NO: 4116397 - DNA, 21 bp, Homo sapiens
ggagccagctccctctattta

SEQ ID NO: 4116398 - DNA, 12 bp, Homo sapiens
ggagccagctct

SEQ ID NO: 4116399 - DNA, 17 bp, Homo sapiens
ggagcccactgtcctgg

SEQ ID NO: 4116400 - DNA, 13 bp, Homo sapiens
ggagcccagaggg

SEQ ID NO: 4116401 - DNA, 19 bp, Homo sapiens
ggagcccagccctccccat

SEQ ID NO: 4116402 - DNA, 19 bp, Homo sapiens
ggagcccatactcagcctg

SEQ ID NO: 4116403 - DNA, 21 bp, Homo sapiens
ggagcccatactcagcctgct

SEQ ID NO: 4116404 - DNA, 18 bp, Homo sapiens
ggagccccagctaccctt

SEQ ID NO: 4116405 - DNA, 12 bp, Homo sapiens
ggagccccaggg

SEQ ID NO: 4116406 - DNA, 13 bp, Homo sapiens
ggagccccagggt

SEQ ID NO: 4116407 - DNA, 20 bp, Homo sapiens
ggagccccagggtcttccct

SEQ ID NO: 4116408 - DNA, 15 bp, Homo sapiens
ggagcccccagatag

SEQ ID NO: 4116409 - DNA, 16 bp, Homo sapiens
ggagccccgccacagc

SEQ ID NO: 4116410 - DNA, 18 bp, Homo sapiens
ggagccccttctgctcag

SEQ ID NO: 4116411 - DNA, 18 bp, Homo sapiens
ggagccggtaactgtcct

SEQ ID NO: 4116412 - DNA, 23 bp, Homo sapiens
ggagccggtaactgtcctgtcct

SEQ ID NO: 4116413 - DNA, 17 bp, Homo sapiens
ggagcctagcggagccc

SEQ ID NO: 4116414 - DNA, 21 bp, Homo sapiens
ggagcctagcggagcccagcc

SEQ ID NO: 4116415 - DNA, 23 bp, Homo sapiens
ggagcctagcggagcccagcctg

SEQ ID NO: 4116416 - DNA, 14 bp, Homo sapiens
ggagcctagctcct

SEQ ID NO: 4116417 - DNA, 12 bp, Homo sapiens
ggagcctcccca

SEQ ID NO: 4116418 - DNA, 16 bp, Homo sapiens
ggagcctccccctcag

SEQ ID NO: 4116419 - DNA, 14 bp, Homo sapiens
ggagcctgctctcc

SEQ ID NO: 4116420 - DNA, 13 bp, Homo sapiens
ggagcctgctggt

SEQ ID NO: 4116421 - DNA, 19 bp, Homo sapiens
ggagcggaggttgcagtga

SEQ ID NO: 4116422 - DNA, 19 bp, Homo sapiens
ggagcggccgcctgcgggc

SEQ ID NO: 4116423 - DNA, 22 bp, Homo sapiens
ggagctatcaggaacagctatg

SEQ ID NO: 4116424 - DNA, 17 bp, Homo sapiens
ggagctcatctgcaaaa

SEQ ID NO: 4116425 - DNA, 17 bp, Homo sapiens
ggagctcctctcctgga

SEQ ID NO: 4116426 - DNA, 20 bp, Homo sapiens
ggagctctggggacagcttc

SEQ ID NO: 4116427 - DNA, 17 bp, Homo sapiens
ggagctcttcaggcctc

SEQ ID NO: 4116428 - DNA, 20 bp, Homo sapiens
ggagctcttcaggcctccct

SEQ ID NO: 4116429 - DNA, 17 bp, Homo sapiens
ggagctgatggcagctg

SEQ ID NO: 4116430 - DNA, 14 bp, Homo sapiens
ggacacctgccctg

SEQ ID NO: 4116431 - DNA, 14 bp, Homo sapiens
ggacactcagacct

SEQ ID NO: 4116432 - DNA, 14 bp, Homo sapiens
ggacactccagtgc

SEQ ID NO: 4116433 - DNA, 15 bp, Homo sapiens
ggacactcctagaga

SEQ ID NO: 4116434 - DNA, 15 bp, Homo sapiens
ggacagacctggaca

SEQ ID NO: 4116435 - DNA, 14 bp, Homo sapiens
ggacagagccatgc

SEQ ID NO: 4116436 - DNA, 16 bp, Homo sapiens
ggacagaggcctgccc

SEQ ID NO: 4116437 - DNA, 19 bp, Homo sapiens
ggacagagttcacaggagg

SEQ ID NO: 4116438 - DNA, 14 bp, Homo sapiens
ggacagcagaagcc

SEQ ID NO: 4116439 - DNA, 17 bp, Homo sapiens
ggacagcagaagcctcc

SEQ ID NO: 4116440 - DNA, 16 bp, Homo sapiens
ggacagcatcccttcc

SEQ ID NO: 4116441 - DNA, 24 bp, Homo sapiens
ggacagcatcccttcccacatgcc

SEQ ID NO: 4116442 - DNA, 21 bp, Homo sapiens
ggacagcatgccccttggctg

SEQ ID NO: 4116443 - DNA, 22 bp, Homo sapiens
ggacagcatgccccttggctgg

SEQ ID NO: 4116444 - DNA, 14 bp, Homo sapiens
ggacagcccactga

SEQ ID NO: 4116445 - DNA, 18 bp, Homo sapiens
ggacagcccagagcctgg

SEQ ID NO: 4116446 - DNA, 19 bp, Homo sapiens
ggacagcgatgaggggaca

SEQ ID NO: 4116447 - DNA, 13 bp, Homo sapiens
ggacagcttcctc

SEQ ID NO: 4116448 - DNA, 15 bp, Homo sapiens
ggacagcttcctcac

SEQ ID NO: 4116449 - DNA, 19 bp, Homo sapiens
ggacagcttgagccgggcc

SEQ ID NO: 4116450 - DNA, 20 bp, Homo sapiens
ggacaggcccagcgcggcca

SEQ ID NO: 4116451 - DNA, 21 bp, Homo sapiens
ggacaggcccagcgcggccag

SEQ ID NO: 4116452 - DNA, 22 bp, Homo sapiens
ggacaggcccagcgcggccagc

SEQ ID NO: 4116453 - DNA, 16 bp, Homo sapiens
ggacaggccgcagctc

SEQ ID NO: 4116454 - DNA, 15 bp, Homo sapiens
ggacagggcatggcc

SEQ ID NO: 4116455 - DNA, 22 bp, Homo sapiens
ggacagggcatggccaggtggc

SEQ ID NO: 4116456 - DNA, 22 bp, Homo sapiens
ggacagggtcttttttcatttc

SEQ ID NO: 4116457 - DNA, 17 bp, Homo sapiens
ggacagtgataggccca

SEQ ID NO: 4116458 - DNA, 11 bp, Homo sapiens
ggacagtggtg

SEQ ID NO: 4116459 - DNA, 18 bp, Homo sapiens
ggacatcctgtataagca

SEQ ID NO: 4116460 - DNA, 16 bp, Homo sapiens
ggacatgcggtagcca

SEQ ID NO: 4116461 - DNA, 21 bp, Homo sapiens
ggacatgcggtagccagcaca

SEQ ID NO: 4116462 - DNA, 21 bp, Homo sapiens
ggacatgctcacctctagcct

SEQ ID NO: 4116463 - DNA, 21 bp, Homo sapiens
ggaccaacctgctctgtcccc

SEQ ID NO: 4116464 - DNA, 12 bp, Homo sapiens
ggaccacatgcc

SEQ ID NO: 4116465 - DNA, 13 bp, Homo sapiens
ggaccacatgcca

SEQ ID NO: 4116466 - DNA, 18 bp, Homo sapiens
ggaccacatgccactgcc

SEQ ID NO: 4116467 - DNA, 21 bp, Homo sapiens
ggaccacatgccactgcctgc

SEQ ID NO: 4116468 - DNA, 14 bp, Homo sapiens
ggaccacattttat

SEQ ID NO: 4116469 - DNA, 12 bp, Homo sapiens
ggaccagagcca

SEQ ID NO: 4116470 - DNA, 13 bp, Homo sapiens
ggaccagagccag

SEQ ID NO: 4116471 - DNA, 16 bp, Homo sapiens
ggaccagagccagatg

SEQ ID NO: 4116472 - DNA, 15 bp, Homo sapiens
ggaccagccagcagc

SEQ ID NO: 4116473 - DNA, 21 bp, Homo sapiens
ggaccaggactatagcccagg

SEQ ID NO: 4116474 - DNA, 15 bp, Homo sapiens
ggaccaggctgtagg

SEQ ID NO: 4116475 - DNA, 16 bp, Homo sapiens
ggaccagggatggggg

SEQ ID NO: 4116476 - DNA, 19 bp, Homo sapiens
ggacccaatgtaggagctg

SEQ ID NO: 4116477 - DNA, 18 bp, Homo sapiens
ggacccagcgggcaggtt

SEQ ID NO: 4116478 - DNA, 16 bp, Homo sapiens
ggacccccactaagac

SEQ ID NO: 4116479 - DNA, 13 bp, Homo sapiens
ggaccctgaaggg

SEQ ID NO: 4116480 - DNA, 16 bp, Homo sapiens
ggaccctgcctcagct

SEQ ID NO: 4116481 - DNA, 23 bp, Homo sapiens
ggacccttgagagtatcaggtct

SEQ ID NO: 4116482 - DNA, 14 bp, Homo sapiens
ggaccggtgctgca

SEQ ID NO: 4116483 - DNA, 17 bp, Homo sapiens
ggaccggtgctgcagga

SEQ ID NO: 4116484 - DNA, 15 bp, Homo sapiens
ggaccgtggacaggc

SEQ ID NO: 4116485 - DNA, 17 bp, Homo sapiens
ggaccgtggacaggccc

SEQ ID NO: 4116486 - DNA, 21 bp, Homo sapiens
ggaccgtggacaggcccagcg

SEQ ID NO: 4116487 - DNA, 17 bp, Homo sapiens
ggacctatgtcctaagg

SEQ ID NO: 4116488 - DNA, 11 bp, Homo sapiens
ggacctcctta

SEQ ID NO: 4116489 - DNA, 17 bp, Homo sapiens
ggacctctgtaggcagc

SEQ ID NO: 4116490 - DNA, 21 bp, Homo sapiens
ggacctgagcctggtcctggc

SEQ ID NO: 4116491 - DNA, 16 bp, Homo sapiens
ggacctgagctggcca

SEQ ID NO: 4116492 - DNA, 18 bp, Homo sapiens
ggacctgagctggccagg

SEQ ID NO: 4116493 - DNA, 14 bp, Homo sapiens
ggacctgccaggca

SEQ ID NO: 4116494 - DNA, 15 bp, Homo sapiens
ggaccttatctgtgc

SEQ ID NO: 4116495 - DNA, 22 bp, Homo sapiens
ggaccttatctgtgcgtgaaac

SEQ ID NO: 4116496 - DNA, 15 bp, Homo sapiens
ggaccttttaaagtg

SEQ ID NO: 4116497 - DNA, 22 bp, Homo sapiens
ggaccttttaaagtgtttcagc

SEQ ID NO: 4116498 - DNA, 21 bp, Homo sapiens
ggacgagatgggaaggcacag

SEQ ID NO: 4116499 - DNA, 23 bp, Homo sapiens
ggacgatcaggaggaagtgagca

SEQ ID NO: 4116500 - DNA, 13 bp, Homo sapiens
ggacgcctgcagg

SEQ ID NO: 4116501 - DNA, 13 bp, Homo sapiens
ggacgctctgctg

SEQ ID NO: 4116502 - DNA, 17 bp, Homo sapiens
ggacggggaagccgagc

SEQ ID NO: 4116503 - DNA, 22 bp, Homo sapiens
ggacgtcatcggaggctgggcc

SEQ ID NO: 4116504 - DNA, 20 bp, Homo sapiens
ggactaggacctgagcctgg

SEQ ID NO: 4116505 - DNA, 23 bp, Homo sapiens
ggactatatttgggcctgctcca

SEQ ID NO: 4116506 - DNA, 16 bp, Homo sapiens
ggactcagcagtgacc

SEQ ID NO: 4116507 - DNA, 13 bp, Homo sapiens
ggactcagccctg

SEQ ID NO: 4116508 - DNA, 14 bp, Homo sapiens
ggactcagccctga

SEQ ID NO: 4116509 - DNA, 22 bp, Homo sapiens
ggactcagggcagcgccaggct

SEQ ID NO: 4116510 - DNA, 23 bp, Homo sapiens
ggactccaggcccaaggctcccg

SEQ ID NO: 4116511 - DNA, 21 bp, Homo sapiens
ggactcccaaccctggcttgg

SEQ ID NO: 4116512 - DNA, 19 bp, Homo sapiens
ggactcccgggccacgccc

SEQ ID NO: 4116513 - DNA, 13 bp, Homo sapiens
ggactctcaggga

SEQ ID NO: 4116514 - DNA, 19 bp, Homo sapiens
ggactctgagcgggaggca

SEQ ID NO: 4116515 - DNA, 13 bp, Homo sapiens
ggactctgcccca

SEQ ID NO: 4116516 - DNA, 18 bp, Homo sapiens
ggactctgcccctggacc

SEQ ID NO: 4116517 - DNA, 14 bp, Homo sapiens
ggactcttctcggc

SEQ ID NO: 4116518 - DNA, 20 bp, Homo sapiens
ggactcttctcggctcaggc

SEQ ID NO: 4116519 - DNA, 14 bp, Homo sapiens
ggactgaagcctgc

SEQ ID NO: 4116520 - DNA, 16 bp, Homo sapiens
ggactgaagcctgcag

SEQ ID NO: 4116521 - DNA, 19 bp, Homo sapiens
ggactgaagcctgcaggag

SEQ ID NO: 4116522 - DNA, 22 bp, Homo sapiens
ggactgactttccgagcctcca

SEQ ID NO: 4116523 - DNA, 17 bp, Homo sapiens
ggactgagggactctga

SEQ ID NO: 4116524 - DNA, 17 bp, Homo sapiens
ggactggaaccagggag

SEQ ID NO: 4116525 - DNA, 23 bp, Homo sapiens
ggactggaggtgggcatgccacc

SEQ ID NO: 4116526 - DNA, 22 bp, Homo sapiens
ggactggcgagtccagagagga

SEQ ID NO: 4116527 - DNA, 19 bp, Homo sapiens
ggactggctagagtcctca

SEQ ID NO: 4116528 - DNA, 22 bp, Homo sapiens
ggactggctagagtcctcactc

SEQ ID NO: 4116529 - DNA, 18 bp, Homo sapiens
ggactgggaggaggggga

SEQ ID NO: 4116530 - DNA, 19 bp, Homo sapiens
ggactgggggactgggagt

SEQ ID NO: 4116531 - DNA, 9 bp, Homo sapiens
ggactggtg

SEQ ID NO: 4116532 - DNA, 21 bp, Homo sapiens
ggactgtcacggggttccctc

SEQ ID NO: 4116533 - DNA, 15 bp, Homo sapiens
ggaagagggacagat

SEQ ID NO: 4116534 - DNA, 22 bp, Homo sapiens
ggaagagggctgagctgagctt

SEQ ID NO: 4116535 - DNA, 19 bp, Homo sapiens
ggaagagggggctggccat

SEQ ID NO: 4116536 - DNA, 14 bp, Homo sapiens
ggaagagtgtgtgt

SEQ ID NO: 4116537 - DNA, 17 bp, Homo sapiens
ggaagagttggtctctg

SEQ ID NO: 4116538 - DNA, 18 bp, Homo sapiens
ggaagataggctctgcac

SEQ ID NO: 4116539 - DNA, 21 bp, Homo sapiens
ggaagataggctctgcacaga

SEQ ID NO: 4116540 - DNA, 17 bp, Homo sapiens
ggaagatgaggttctga

SEQ ID NO: 4116541 - DNA, 23 bp, Homo sapiens
ggaagcacatgtttatttattct

SEQ ID NO: 4116542 - DNA, 12 bp, Homo sapiens
ggaagcagccag

SEQ ID NO: 4116543 - DNA, 13 bp, Homo sapiens
ggaagcagccagc

SEQ ID NO: 4116544 - DNA, 11 bp, Homo sapiens
ggaagcagtgc

SEQ ID NO: 4116545 - DNA, 12 bp, Homo sapiens
ggaagcagtgcc

SEQ ID NO: 4116546 - DNA, 19 bp, Homo sapiens
ggaagcagtgccttccata

SEQ ID NO: 4116547 - DNA, 22 bp, Homo sapiens
ggaagcatgtggatgacacaat

SEQ ID NO: 4116548 - DNA, 16 bp, Homo sapiens
ggaagcattcagagag

SEQ ID NO: 4116549 - DNA, 20 bp, Homo sapiens
ggaagcattcagagagcagc

SEQ ID NO: 4116550 - DNA, 12 bp, Homo sapiens
ggaagccagagc

SEQ ID NO: 4116551 - DNA, 14 bp, Homo sapiens
ggaagccagagccc

SEQ ID NO: 4116552 - DNA, 18 bp, Homo sapiens
ggaagccagagccccaag

SEQ ID NO: 4116553 - DNA, 14 bp, Homo sapiens
ggaagccaggctga

SEQ ID NO: 4116554 - DNA, 23 bp, Homo sapiens
ggaagccggggtgtaacttcctg

SEQ ID NO: 4116555 - DNA, 13 bp, Homo sapiens
ggaagccttgctc

SEQ ID NO: 4116556 - DNA, 20 bp, Homo sapiens
ggaagctcttggagctgtga

SEQ ID NO: 4116557 - DNA, 16 bp, Homo sapiens
ggaagctgccagccca

SEQ ID NO: 4116558 - DNA, 17 bp, Homo sapiens
ggaagctgccagcccag

SEQ ID NO: 4116559 - DNA, 18 bp, Homo sapiens
ggaagctggcagaacgga

SEQ ID NO: 4116560 - DNA, 18 bp, Homo sapiens
ggaagctggccgagggtc

SEQ ID NO: 4116561 - DNA, 18 bp, Homo sapiens
ggaaggaacatggagctg

SEQ ID NO: 4116562 - DNA, 17 bp, Homo sapiens
ggaaggaactctggctt

SEQ ID NO: 4116563 - DNA, 23 bp, Homo sapiens
ggaaggaactctggcttccaggt

SEQ ID NO: 4116564 - DNA, 13 bp, Homo sapiens
ggaaggagagcct

SEQ ID NO: 4116565 - DNA, 15 bp, Homo sapiens
ggaaggagagcctgc

SEQ ID NO: 4116566 - DNA, 13 bp, Homo sapiens
ggaaggagccagt

SEQ ID NO: 4116567 - DNA, 21 bp, Homo sapiens
ggaaggagccagtttgccgga

SEQ ID NO: 4116568 - DNA, 20 bp, Homo sapiens
ggaaggagggtacagctggg

SEQ ID NO: 4116569 - DNA, 18 bp, Homo sapiens
ggaaggcagacagcaggc

SEQ ID NO: 4116570 - DNA, 12 bp, Homo sapiens
ggaaggcctgac

SEQ ID NO: 4116571 - DNA, 14 bp, Homo sapiens
ggaagggcaaaacc

SEQ ID NO: 4116572 - DNA, 12 bp, Homo sapiens
ggaagggcagga

SEQ ID NO: 4116573 - DNA, 15 bp, Homo sapiens
ggaagggcaggaagg

SEQ ID NO: 4116574 - DNA, 21 bp, Homo sapiens
ggaagggcaggaaggagagcc

SEQ ID NO: 4116575 - DNA, 13 bp, Homo sapiens
ggaagggctgggt

SEQ ID NO: 4116576 - DNA, 16 bp, Homo sapiens
ggaaggggccttgctg

SEQ ID NO: 4116577 - DNA, 15 bp, Homo sapiens
ggaagggtttctcta

SEQ ID NO: 4116578 - DNA, 17 bp, Homo sapiens
ggaaggtagcccagcac

SEQ ID NO: 4116579 - DNA, 16 bp, Homo sapiens
ggaaggtggccacagc

SEQ ID NO: 4116580 - DNA, 14 bp, Homo sapiens
ggaagtagtccttg

SEQ ID NO: 4116581 - DNA, 14 bp, Homo sapiens
ggaagtcacttcac

SEQ ID NO: 4116582 - DNA, 14 bp, Homo sapiens
ggaagtctccatga

SEQ ID NO: 4116583 - DNA, 19 bp, Homo sapiens
ggaagtgtaacagctgagg

SEQ ID NO: 4116584 - DNA, 17 bp, Homo sapiens
ggaagttacatgctgta

SEQ ID NO: 4116585 - DNA, 14 bp, Homo sapiens
ggaagttttctgta

SEQ ID NO: 4116586 - DNA, 18 bp, Homo sapiens
ggaataaactagagaagg

SEQ ID NO: 4116587 - DNA, 21 bp, Homo sapiens
ggaataaagttgcagatgatt

SEQ ID NO: 4116588 - DNA, 22 bp, Homo sapiens
ggaataaccttccatacatttt

SEQ ID NO: 4116589 - DNA, 21 bp, Homo sapiens
ggaataacttttacacgacca

SEQ ID NO: 4116590 - DNA, 17 bp, Homo sapiens
ggaataagaagcaaata

SEQ ID NO: 4116591 - DNA, 21 bp, Homo sapiens
ggaataagaagcaaataaata

SEQ ID NO: 4116592 - DNA, 13 bp, Homo sapiens
ggaataatttgta

SEQ ID NO: 4116593 - DNA, 16 bp, Homo sapiens
ggaataatttgtaaat

SEQ ID NO: 4116594 - DNA, 20 bp, Homo sapiens
ggaataatttgtaaatgatt

SEQ ID NO: 4116595 - DNA, 12 bp, Homo sapiens
ggaatagggaga

SEQ ID NO: 4116596 - DNA, 19 bp, Homo sapiens
ggaatatttataggccagg

SEQ ID NO: 4116597 - DNA, 23 bp, Homo sapiens
ggaatcaagagctgccctccttg

SEQ ID NO: 4116598 - DNA, 19 bp, Homo sapiens
ggaatcatgtcaggcctgt

SEQ ID NO: 4116599 - DNA, 17 bp, Homo sapiens
ggaatcattccagtgct

SEQ ID NO: 4116600 - DNA, 20 bp, Homo sapiens
ggaatcattgtccagagctg

SEQ ID NO: 4116601 - DNA, 14 bp, Homo sapiens
ggaatcctcctcca

SEQ ID NO: 4116602 - DNA, 22 bp, Homo sapiens
ggaatcctggaccaagcacaaa

SEQ ID NO: 4116603 - DNA, 20 bp, Homo sapiens
ggaatgaaattaacacaaag

SEQ ID NO: 4116604 - DNA, 16 bp, Homo sapiens
ggaatgaagcttttta

SEQ ID NO: 4116605 - DNA, 15 bp, Homo sapiens
ggaatgagtgtgcat

SEQ ID NO: 4116606 - DNA, 21 bp, Homo sapiens
ggaatgcactgaataaagcac

SEQ ID NO: 4116607 - DNA, 18 bp, Homo sapiens
ggaatgctctgtgccaga

SEQ ID NO: 4116608 - DNA, 14 bp, Homo sapiens
ggaatgctgtgtta

SEQ ID NO: 4116609 - DNA, 21 bp, Homo sapiens
ggaatggaaaaagcagaaggc

SEQ ID NO: 4116610 - DNA, 17 bp, Homo sapiens
ggaatgggataagaagg

SEQ ID NO: 4116611 - DNA, 14 bp, Homo sapiens
ggaatgtgcccctg

SEQ ID NO: 4116612 - DNA, 21 bp, Homo sapiens
ggaatgtttgggcagaaggga

SEQ ID NO: 4116613 - DNA, 14 bp, Homo sapiens
ggaattaacctggt

SEQ ID NO: 4116614 - DNA, 16 bp, Homo sapiens
ggaattaacctggtgc

SEQ ID NO: 4116615 - DNA, 22 bp, Homo sapiens
ggaattaagttatctttaaaat

SEQ ID NO: 4116616 - DNA, 22 bp, Homo sapiens
ggaattattgtaccattttcta

SEQ ID NO: 4116617 - DNA, 21 bp, Homo sapiens
ggaattcattttcatcactgg

SEQ ID NO: 4116618 - DNA, 18 bp, Homo sapiens
ggaattcctcttttgctt

SEQ ID NO: 4116619 - DNA, 10 bp, Homo sapiens
ggaattgaaa

SEQ ID NO: 4116620 - DNA, 23 bp, Homo sapiens
ggaattggtggcagattttacaa

SEQ ID NO: 4116621 - DNA, 23 bp, Homo sapiens
ggaattgtctttagtgccggctg

SEQ ID NO: 4116622 - DNA, 11 bp, Homo sapiens
ggaatttaaaa

SEQ ID NO: 4116623 - DNA, 14 bp, Homo sapiens
ggaatttaaaatta

SEQ ID NO: 4116624 - DNA, 15 bp, Homo sapiens
ggaatttaaaattaa

SEQ ID NO: 4116625 - DNA, 19 bp, Homo sapiens
ggaatttggaaatctcttt

SEQ ID NO: 4116626 - DNA, 16 bp, Homo sapiens
ggaatttgtaacctca

SEQ ID NO: 4116627 - DNA, 17 bp, Homo sapiens
ggaatttgtaacctcag

SEQ ID NO: 4116628 - DNA, 13 bp, Homo sapiens
ggacaaaatgtta

SEQ ID NO: 4116629 - DNA, 13 bp, Homo sapiens
ggacaaacctaga

SEQ ID NO: 4116630 - DNA, 19 bp, Homo sapiens
ggacaacagtgctttgtaa

SEQ ID NO: 4116631 - DNA, 15 bp, Homo sapiens
ggacaagaggtacag

SEQ ID NO: 4116632 - DNA, 17 bp, Homo sapiens
ggacaaggtgcaggcag

SEQ ID NO: 4116633 - DNA, 23 bp, Homo sapiens
ggacacaccccacaccccagccc

SEQ ID NO: 4116634 - DNA, 13 bp, Homo sapiens
ggacacagaccca

SEQ ID NO: 4116635 - DNA, 17 bp, Homo sapiens
ggacacccctgctctac

SEQ ID NO: 4116636 - DNA, 21 bp, Homo sapiens
ggacaccccttatccaggact

SEQ ID NO: 4116637 - DNA, 15 bp, Homo sapiens
gcttttaattctcat

SEQ ID NO: 4116638 - DNA, 19 bp, Homo sapiens
gcttttaattctcatttgt

SEQ ID NO: 4116639 - DNA, 22 bp, Homo sapiens
gcttttaattctcatttgttct

SEQ ID NO: 4116640 - DNA, 13 bp, Homo sapiens
gcttttactttat

SEQ ID NO: 4116641 - DNA, 20 bp, Homo sapiens
gcttttattttttcttttgt

SEQ ID NO: 4116642 - DNA, 21 bp, Homo sapiens
gcttttattttttcttttgta

SEQ ID NO: 4116643 - DNA, 14 bp, Homo sapiens
gcttttcactgctg

SEQ ID NO: 4116644 - DNA, 14 bp, Homo sapiens
gcttttctgccctg

SEQ ID NO: 4116645 - DNA, 19 bp, Homo sapiens
gcttttctgccctggctgc

SEQ ID NO: 4116646 - DNA, 18 bp, Homo sapiens
gcttttctgtattttatt

SEQ ID NO: 4116647 - DNA, 15 bp, Homo sapiens
gcttttctgtcctgg

SEQ ID NO: 4116648 - DNA, 18 bp, Homo sapiens
gcttttgttccaatgtca

SEQ ID NO: 4116649 - DNA, 13 bp, Homo sapiens
gctttttaattgt

SEQ ID NO: 4116650 - DNA, 21 bp, Homo sapiens
gctttttaattgttgtttctt

SEQ ID NO: 4116651 - DNA, 15 bp, Homo sapiens
gctttttatttctgc

SEQ ID NO: 4116652 - DNA, 13 bp, Homo sapiens
gctttttcagagt

SEQ ID NO: 4116653 - DNA, 15 bp, Homo sapiens
gctttttcctctgag

SEQ ID NO: 4116654 - DNA, 18 bp, Homo sapiens
gctttttcctctgagccc

SEQ ID NO: 4116655 - DNA, 15 bp, Homo sapiens
gcttttttttccttc

SEQ ID NO: 4116656 - DNA, 20 bp, Homo sapiens
ggaaaaaaacataaaaagca

SEQ ID NO: 4116657 - DNA, 14 bp, Homo sapiens
ggaaaaaagcacat

SEQ ID NO: 4116658 - DNA, 19 bp, Homo sapiens
ggaaaaaatgttggattta

SEQ ID NO: 4116659 - DNA, 13 bp, Homo sapiens
ggaaaaagccata

SEQ ID NO: 4116660 - DNA, 14 bp, Homo sapiens
ggaaaaataatcaa

SEQ ID NO: 4116661 - DNA, 20 bp, Homo sapiens
ggaaaaataatcaagatttt

SEQ ID NO: 4116662 - DNA, 17 bp, Homo sapiens
ggaaaaatggttgatgg

SEQ ID NO: 4116663 - DNA, 22 bp, Homo sapiens
ggaaaaccaagccgtggcttcc

SEQ ID NO: 4116664 - DNA, 15 bp, Homo sapiens
ggaaaaccagagcct

SEQ ID NO: 4116665 - DNA, 13 bp, Homo sapiens
ggaaaactgtgtt

SEQ ID NO: 4116666 - DNA, 23 bp, Homo sapiens
ggaaaagaagaaactttgcctca

SEQ ID NO: 4116667 - DNA, 18 bp, Homo sapiens
ggaaaagaatacagaaag

SEQ ID NO: 4116668 - DNA, 21 bp, Homo sapiens
ggaaaagaggagtttcgaggt

SEQ ID NO: 4116669 - DNA, 11 bp, Homo sapiens
ggaaaagctga

SEQ ID NO: 4116670 - DNA, 19 bp, Homo sapiens
ggaaaataaaaaaagaaaa

SEQ ID NO: 4116671 - DNA, 14 bp, Homo sapiens
ggaaaattgcccca

SEQ ID NO: 4116672 - DNA, 17 bp, Homo sapiens
ggaaaccaagtggtcag

SEQ ID NO: 4116673 - DNA, 17 bp, Homo sapiens
ggaaactcttatctcag

SEQ ID NO: 4116674 - DNA, 17 bp, Homo sapiens
ggaaactgctaaattct

SEQ ID NO: 4116675 - DNA, 16 bp, Homo sapiens
ggaaagaaagaaggaa

SEQ ID NO: 4116676 - DNA, 21 bp, Homo sapiens
ggaaagcacagaggcctcctg

SEQ ID NO: 4116677 - DNA, 12 bp, Homo sapiens
ggaaagccctcc

SEQ ID NO: 4116678 - DNA, 16 bp, Homo sapiens
ggaaagccctccccct

SEQ ID NO: 4116679 - DNA, 14 bp, Homo sapiens
ggaaaggggagagc

SEQ ID NO: 4116680 - DNA, 21 bp, Homo sapiens
ggaaaggggttggggtgacag

SEQ ID NO: 4116681 - DNA, 22 bp, Homo sapiens
ggaaaggggttggggtgacagt

SEQ ID NO: 4116682 - DNA, 17 bp, Homo sapiens
ggaaagtcaagaagaat

SEQ ID NO: 4116683 - DNA, 13 bp, Homo sapiens
ggaaagtgaattt

SEQ ID NO: 4116684 - DNA, 22 bp, Homo sapiens
ggaaagtgaatttgaatgaaaa

SEQ ID NO: 4116685 - DNA, 19 bp, Homo sapiens
ggaaatacagttctgctct

SEQ ID NO: 4116686 - DNA, 20 bp, Homo sapiens
ggaaatagaaagaagccata

SEQ ID NO: 4116687 - DNA, 23 bp, Homo sapiens
ggaaatatatacaaaaagaaaat

SEQ ID NO: 4116688 - DNA, 23 bp, Homo sapiens
ggaaatatgtaatgcttccaatc

SEQ ID NO: 4116689 - DNA, 15 bp, Homo sapiens
ggaaatatttatttt

SEQ ID NO: 4116690 - DNA, 20 bp, Homo sapiens
ggaaatattttgataataaa

SEQ ID NO: 4116691 - DNA, 18 bp, Homo sapiens
ggaaatctcaccccatcc

SEQ ID NO: 4116692 - DNA, 18 bp, Homo sapiens
ggaaatctgtaacaggta

SEQ ID NO: 4116693 - DNA, 21 bp, Homo sapiens
ggaaatgtaatactggaataa

SEQ ID NO: 4116694 - DNA, 18 bp, Homo sapiens
ggaaatgtcacagaagca

SEQ ID NO: 4116695 - DNA, 13 bp, Homo sapiens
ggaaatgtggaga

SEQ ID NO: 4116696 - DNA, 15 bp, Homo sapiens
ggaaatgtggagaag

SEQ ID NO: 4116697 - DNA, 16 bp, Homo sapiens
ggaacagaatgtttta

SEQ ID NO: 4116698 - DNA, 20 bp, Homo sapiens
ggaacagacaacagaagtca

SEQ ID NO: 4116699 - DNA, 21 bp, Homo sapiens
ggaacagacaacagaagtcat

SEQ ID NO: 4116700 - DNA, 23 bp, Homo sapiens
ggaacagctatgggagccccagg

SEQ ID NO: 4116701 - DNA, 16 bp, Homo sapiens
ggaacagtggctgggt

SEQ ID NO: 4116702 - DNA, 17 bp, Homo sapiens
ggaacagtggctgggtg

SEQ ID NO: 4116703 - DNA, 23 bp, Homo sapiens
ggaacagtgtttcccataatttt

SEQ ID NO: 4116704 - DNA, 21 bp, Homo sapiens
ggaacatcctttgcagggcag

SEQ ID NO: 4116705 - DNA, 22 bp, Homo sapiens
ggaacatcctttgcagggcagc

SEQ ID NO: 4116706 - DNA, 15 bp, Homo sapiens
ggaaccacagggcca

SEQ ID NO: 4116707 - DNA, 16 bp, Homo sapiens
ggaaccacagggccag

SEQ ID NO: 4116708 - DNA, 18 bp, Homo sapiens
ggaaccacagggccagag

SEQ ID NO: 4116709 - DNA, 14 bp, Homo sapiens
ggaacccagactca

SEQ ID NO: 4116710 - DNA, 15 bp, Homo sapiens
ggaacccagactcag

SEQ ID NO: 4116711 - DNA, 21 bp, Homo sapiens
ggaaccccggggtgcccacag

SEQ ID NO: 4116712 - DNA, 21 bp, Homo sapiens
ggaaccgtggtatgtctgcca

SEQ ID NO: 4116713 - DNA, 15 bp, Homo sapiens
ggaacctcagcctgg

SEQ ID NO: 4116714 - DNA, 19 bp, Homo sapiens
ggaacctcagcctggccag

SEQ ID NO: 4116715 - DNA, 21 bp, Homo sapiens
ggaacctcagcctggccagac

SEQ ID NO: 4116716 - DNA, 14 bp, Homo sapiens
ggaacctctgtctc

SEQ ID NO: 4116717 - DNA, 15 bp, Homo sapiens
ggaacctctgtctca

SEQ ID NO: 4116718 - DNA, 11 bp, Homo sapiens
ggaacctgcca

SEQ ID NO: 4116719 - DNA, 22 bp, Homo sapiens
ggaacctgtcctaaggaacctt

SEQ ID NO: 4116720 - DNA, 15 bp, Homo sapiens
ggaaccttccctcca

SEQ ID NO: 4116721 - DNA, 20 bp, Homo sapiens
ggaaccttccttcctgcttg

SEQ ID NO: 4116722 - DNA, 17 bp, Homo sapiens
ggaaccttgctgtcctg

SEQ ID NO: 4116723 - DNA, 15 bp, Homo sapiens
ggaactcagatccag

SEQ ID NO: 4116724 - DNA, 19 bp, Homo sapiens
ggaactctggcttccaggt

SEQ ID NO: 4116725 - DNA, 17 bp, Homo sapiens
ggaactgagggcaaggg

SEQ ID NO: 4116726 - DNA, 16 bp, Homo sapiens
ggaactgtcctttcct

SEQ ID NO: 4116727 - DNA, 14 bp, Homo sapiens
ggaacttcagagat

SEQ ID NO: 4116728 - DNA, 23 bp, Homo sapiens
ggaacttggggagttaagacctg

SEQ ID NO: 4116729 - DNA, 17 bp, Homo sapiens
ggaagaaaaaaatcttc

SEQ ID NO: 4116730 - DNA, 23 bp, Homo sapiens
ggaagaaaaaaatcttctccaga

SEQ ID NO: 4116731 - DNA, 16 bp, Homo sapiens
ggaagaacatagaact

SEQ ID NO: 4116732 - DNA, 14 bp, Homo sapiens
ggaagaaggaggaa

SEQ ID NO: 4116733 - DNA, 14 bp, Homo sapiens
ggaagaagggagaa

SEQ ID NO: 4116734 - DNA, 18 bp, Homo sapiens
ggaagaagggagaagaaa

SEQ ID NO: 4116735 - DNA, 17 bp, Homo sapiens
ggaagaagtgagcagtg

SEQ ID NO: 4116736 - DNA, 16 bp, Homo sapiens
ggaagaattggggatt

SEQ ID NO: 4116737 - DNA, 15 bp, Homo sapiens
ggaagacatttttcc

SEQ ID NO: 4116738 - DNA, 21 bp, Homo sapiens
ggaagacttttggtagagaag

SEQ ID NO: 4116739 - DNA, 19 bp, Homo sapiens
ggaagagcagaacggagcc

SEQ ID NO: 4116740 - DNA, 23 bp, Homo sapiens
gcttctggaatttgttcaagttt

SEQ ID NO: 4116741 - DNA, 20 bp, Homo sapiens
gcttctgtagtactccttaa

SEQ ID NO: 4116742 - DNA, 13 bp, Homo sapiens
gcttcttaattaa

SEQ ID NO: 4116743 - DNA, 18 bp, Homo sapiens
gcttcttactgataattt

SEQ ID NO: 4116744 - DNA, 17 bp, Homo sapiens
gcttcttctgaggcctg

SEQ ID NO: 4116745 - DNA, 21 bp, Homo sapiens
gcttctttcccttagtgactc

SEQ ID NO: 4116746 - DNA, 19 bp, Homo sapiens
gcttgaaaagctagtgtac

SEQ ID NO: 4116747 - DNA, 21 bp, Homo sapiens
gcttgaaattactgtgtaaat

SEQ ID NO: 4116748 - DNA, 21 bp, Homo sapiens
gcttgaagatcgttagtatct

SEQ ID NO: 4116749 - DNA, 22 bp, Homo sapiens
gcttgaagatcgttagtatcta

SEQ ID NO: 4116750 - DNA, 11 bp, Homo sapiens
gcttgaagcca

SEQ ID NO: 4116751 - DNA, 14 bp, Homo sapiens
gcttgaagccaaag

SEQ ID NO: 4116752 - DNA, 15 bp, Homo sapiens
gcttgaagccaaaga

SEQ ID NO: 4116753 - DNA, 20 bp, Homo sapiens
gcttgaagccaaagaaaaat

SEQ ID NO: 4116754 - DNA, 15 bp, Homo sapiens
gcttgacacagtcag

SEQ ID NO: 4116755 - DNA, 17 bp, Homo sapiens
gcttgacacagtcagca

SEQ ID NO: 4116756 - DNA, 18 bp, Homo sapiens
gcttgaccgtactctcac

SEQ ID NO: 4116757 - DNA, 15 bp, Homo sapiens
gcttgactttggctg

SEQ ID NO: 4116758 - DNA, 20 bp, Homo sapiens
gcttgagaaatatggacact

SEQ ID NO: 4116759 - DNA, 13 bp, Homo sapiens
gcttgatccagaa

SEQ ID NO: 4116760 - DNA, 20 bp, Homo sapiens
gcttgatggtgacagctgca

SEQ ID NO: 4116761 - DNA, 14 bp, Homo sapiens
gcttgattctgcag

SEQ ID NO: 4116762 - DNA, 14 bp, Homo sapiens
gcttgcactctctt

SEQ ID NO: 4116763 - DNA, 19 bp, Homo sapiens
gcttgcactttgtaacatg

SEQ ID NO: 4116764 - DNA, 22 bp, Homo sapiens
gcttgcactttgtaacatgttt

SEQ ID NO: 4116765 - DNA, 22 bp, Homo sapiens
gcttgcaggaggccaaactgtc

SEQ ID NO: 4116766 - DNA, 23 bp, Homo sapiens
gcttgcataataagctaaagagg

SEQ ID NO: 4116767 - DNA, 14 bp, Homo sapiens
gcttgcctggagac

SEQ ID NO: 4116768 - DNA, 20 bp, Homo sapiens
gcttggaggtcacagctgga

SEQ ID NO: 4116769 - DNA, 12 bp, Homo sapiens
gcttggcccagc

SEQ ID NO: 4116770 - DNA, 17 bp, Homo sapiens
gcttggcccggccggcc

SEQ ID NO: 4116771 - DNA, 15 bp, Homo sapiens
gcttggcctgctgtg

SEQ ID NO: 4116772 - DNA, 16 bp, Homo sapiens
gcttggcctgctgtga

SEQ ID NO: 4116773 - DNA, 12 bp, Homo sapiens
gcttgggaaaaa

SEQ ID NO: 4116774 - DNA, 20 bp, Homo sapiens
gcttgggagagtcaggcagg

SEQ ID NO: 4116775 - DNA, 15 bp, Homo sapiens
gcttgggcagtgccc

SEQ ID NO: 4116776 - DNA, 20 bp, Homo sapiens
gcttgggccctgcacagata

SEQ ID NO: 4116777 - DNA, 16 bp, Homo sapiens
gcttggtgctggttta

SEQ ID NO: 4116778 - DNA, 14 bp, Homo sapiens
gcttggtttgcaac

SEQ ID NO: 4116779 - DNA, 22 bp, Homo sapiens
gcttgtatatagagattgtaca

SEQ ID NO: 4116780 - DNA, 17 bp, Homo sapiens
gcttgtatcaacactgt

SEQ ID NO: 4116781 - DNA, 18 bp, Homo sapiens
gcttgtatgcaatggatt

SEQ ID NO: 4116782 - DNA, 15 bp, Homo sapiens
gcttgtcattccaga

SEQ ID NO: 4116783 - DNA, 16 bp, Homo sapiens
gcttgtcattccagag

SEQ ID NO: 4116784 - DNA, 12 bp, Homo sapiens
gcttgtgaacag

SEQ ID NO: 4116785 - DNA, 13 bp, Homo sapiens
gcttgtgaacaga

SEQ ID NO: 4116786 - DNA, 13 bp, Homo sapiens
gcttgtggctcca

SEQ ID NO: 4116787 - DNA, 15 bp, Homo sapiens
gcttgtgggctggtg

SEQ ID NO: 4116788 - DNA, 17 bp, Homo sapiens
gcttgtgggctggtgcc

SEQ ID NO: 4116789 - DNA, 16 bp, Homo sapiens
gcttgtgtcctgtcct

SEQ ID NO: 4116790 - DNA, 12 bp, Homo sapiens
gcttgtgttaag

SEQ ID NO: 4116791 - DNA, 12 bp, Homo sapiens
gcttgtgttctg

SEQ ID NO: 4116792 - DNA, 15 bp, Homo sapiens
gcttgttctgggctc

SEQ ID NO: 4116793 - DNA, 17 bp, Homo sapiens
gcttgttctgggctcag

SEQ ID NO: 4116794 - DNA, 20 bp, Homo sapiens
gcttgttttataaaattttg

SEQ ID NO: 4116795 - DNA, 15 bp, Homo sapiens
gctttaaaaagaaaa

SEQ ID NO: 4116796 - DNA, 16 bp, Homo sapiens
gctttaaaaagaaaaa

SEQ ID NO: 4116797 - DNA, 22 bp, Homo sapiens
gctttaaaaagggaagaaactg

SEQ ID NO: 4116798 - DNA, 13 bp, Homo sapiens
gctttaaacaaat

SEQ ID NO: 4116799 - DNA, 17 bp, Homo sapiens
gctttaaacaaattcat

SEQ ID NO: 4116800 - DNA, 18 bp, Homo sapiens
gctttaaactcagggaca

SEQ ID NO: 4116801 - DNA, 12 bp, Homo sapiens
gctttatgttca

SEQ ID NO: 4116802 - DNA, 23 bp, Homo sapiens
gctttatgttcatttgtttgttt

SEQ ID NO: 4116803 - DNA, 21 bp, Homo sapiens
gctttattttttaagtattta

SEQ ID NO: 4116804 - DNA, 23 bp, Homo sapiens
gctttattttttaagtatttata

SEQ ID NO: 4116805 - DNA, 23 bp, Homo sapiens
gctttcaaaggagctcgaaggat

SEQ ID NO: 4116806 - DNA, 21 bp, Homo sapiens
gctttcagggccatggttcac

SEQ ID NO: 4116807 - DNA, 20 bp, Homo sapiens
gctttcccagtcccattcct

SEQ ID NO: 4116808 - DNA, 11 bp, Homo sapiens
gctttcctgcc

SEQ ID NO: 4116809 - DNA, 19 bp, Homo sapiens
gctttcctgggcctttgca

SEQ ID NO: 4116810 - DNA, 13 bp, Homo sapiens
gctttcctgtgcc

SEQ ID NO: 4116811 - DNA, 14 bp, Homo sapiens
gctttcctgtgcca

SEQ ID NO: 4116812 - DNA, 18 bp, Homo sapiens
gctttctcagtgtgtgtg

SEQ ID NO: 4116813 - DNA, 20 bp, Homo sapiens
gctttctctggacactgcca

SEQ ID NO: 4116814 - DNA, 21 bp, Homo sapiens
gctttctcttccccttcctgt

SEQ ID NO: 4116815 - DNA, 15 bp, Homo sapiens
gctttctgccatcta

SEQ ID NO: 4116816 - DNA, 13 bp, Homo sapiens
gctttctgttcca

SEQ ID NO: 4116817 - DNA, 15 bp, Homo sapiens
gctttctgttccaaa

SEQ ID NO: 4116818 - DNA, 16 bp, Homo sapiens
gctttctgttccaaat

SEQ ID NO: 4116819 - DNA, 22 bp, Homo sapiens
gctttctgttgtcattgctgtt

SEQ ID NO: 4116820 - DNA, 19 bp, Homo sapiens
gctttcttattttgtttga

SEQ ID NO: 4116821 - DNA, 20 bp, Homo sapiens
gctttcttctacaaccagag

SEQ ID NO: 4116822 - DNA, 21 bp, Homo sapiens
gctttcttctacaaccagagc

SEQ ID NO: 4116823 - DNA, 17 bp, Homo sapiens
gctttcttgctggttgt

SEQ ID NO: 4116824 - DNA, 21 bp, Homo sapiens
gctttcttgtcttttcagaag

SEQ ID NO: 4116825 - DNA, 12 bp, Homo sapiens
gctttgattcat

SEQ ID NO: 4116826 - DNA, 15 bp, Homo sapiens
gctttgattcatagt

SEQ ID NO: 4116827 - DNA, 15 bp, Homo sapiens
gctttgccagctgct

SEQ ID NO: 4116828 - DNA, 17 bp, Homo sapiens
gctttgcccacccctca

SEQ ID NO: 4116829 - DNA, 13 bp, Homo sapiens
gctttgcctctac

SEQ ID NO: 4116830 - DNA, 13 bp, Homo sapiens
gctttgccttgca

SEQ ID NO: 4116831 - DNA, 14 bp, Homo sapiens
gctttgctgctacc

SEQ ID NO: 4116832 - DNA, 19 bp, Homo sapiens
gctttgctgctaccgccct

SEQ ID NO: 4116833 - DNA, 18 bp, Homo sapiens
gctttggctgaggggctt

SEQ ID NO: 4116834 - DNA, 20 bp, Homo sapiens
gctttgggatcccaccctgg

SEQ ID NO: 4116835 - DNA, 15 bp, Homo sapiens
gctttgggctgccct

SEQ ID NO: 4116836 - DNA, 18 bp, Homo sapiens
gctttgggctgccctggt

SEQ ID NO: 4116837 - DNA, 20 bp, Homo sapiens
gctttggttaagggctccct

SEQ ID NO: 4116838 - DNA, 15 bp, Homo sapiens
gctttggttccttct

SEQ ID NO: 4116839 - DNA, 17 bp, Homo sapiens
gctttggttccttctct

SEQ ID NO: 4116840 - DNA, 13 bp, Homo sapiens
gctttgtgtttgg

SEQ ID NO: 4116841 - DNA, 21 bp, Homo sapiens
gctttgtgtttggtttacatt

SEQ ID NO: 4116842 - DNA, 23 bp, Homo sapiens
gctttgtgtttggtttacattta

SEQ ID NO: 4116843 - DNA, 15 bp, Homo sapiens
gcttttaattaaata

SEQ ID NO: 4116844 - DNA, 16 bp, Homo sapiens
gctgtggccctggagg

SEQ ID NO: 4116845 - DNA, 15 bp, Homo sapiens
gctgtgggcagcacc

SEQ ID NO: 4116846 - DNA, 18 bp, Homo sapiens
gctgtgttaaataaacct

SEQ ID NO: 4116847 - DNA, 18 bp, Homo sapiens
gctgtgtttgcagcctgc

SEQ ID NO: 4116848 - DNA, 14 bp, Homo sapiens
gctgttagagaaat

SEQ ID NO: 4116849 - DNA, 19 bp, Homo sapiens
gctgttatgtctgtttaag

SEQ ID NO: 4116850 - DNA, 23 bp, Homo sapiens
gctgttctcaggacagcatccct

SEQ ID NO: 4116851 - DNA, 12 bp, Homo sapiens
gctgttctccag

SEQ ID NO: 4116852 - DNA, 20 bp, Homo sapiens
gctgttctccaggcttcaca

SEQ ID NO: 4116853 - DNA, 21 bp, Homo sapiens
gctgttctccaggcttcacag

SEQ ID NO: 4116854 - DNA, 12 bp, Homo sapiens
gctgttcttctg

SEQ ID NO: 4116855 - DNA, 18 bp, Homo sapiens
gctgttgaccaggcacct

SEQ ID NO: 4116856 - DNA, 12 bp, Homo sapiens
gctgttgagctg

SEQ ID NO: 4116857 - DNA, 20 bp, Homo sapiens
gctgttgaggggtcccctct

SEQ ID NO: 4116858 - DNA, 14 bp, Homo sapiens
gctgttgtacattt

SEQ ID NO: 4116859 - DNA, 17 bp, Homo sapiens
gctgttgtccctctgct

SEQ ID NO: 4116860 - DNA, 18 bp, Homo sapiens
gctgttgtccctctgcta

SEQ ID NO: 4116861 - DNA, 17 bp, Homo sapiens
gctgttgtctcttctcc

SEQ ID NO: 4116862 - DNA, 18 bp, Homo sapiens
gctgttgttccattgaag

SEQ ID NO: 4116863 - DNA, 15 bp, Homo sapiens
gctgtttatggcctc

SEQ ID NO: 4116864 - DNA, 22 bp, Homo sapiens
gctgtttatggcctcagctgcc

SEQ ID NO: 4116865 - DNA, 16 bp, Homo sapiens
gctgtttctcatgaag

SEQ ID NO: 4116866 - DNA, 18 bp, Homo sapiens
gctgtttgtagtgaaata

SEQ ID NO: 4116867 - DNA, 19 bp, Homo sapiens
gcttaaaataaacagttgt

SEQ ID NO: 4116868 - DNA, 21 bp, Homo sapiens
gcttaaaataagcaggtggat

SEQ ID NO: 4116869 - DNA, 12 bp, Homo sapiens
gcttaaactaaa

SEQ ID NO: 4116870 - DNA, 17 bp, Homo sapiens
gcttaaactaaataatg

SEQ ID NO: 4116871 - DNA, 13 bp, Homo sapiens
gcttaaatttctt

SEQ ID NO: 4116872 - DNA, 21 bp, Homo sapiens
gcttaaatttcttatgtgaca

SEQ ID NO: 4116873 - DNA, 22 bp, Homo sapiens
gcttaacctttccgctgtcgcc

SEQ ID NO: 4116874 - DNA, 12 bp, Homo sapiens
gcttaagaaaaa

SEQ ID NO: 4116875 - DNA, 15 bp, Homo sapiens
gcttaatagccctcc

SEQ ID NO: 4116876 - DNA, 19 bp, Homo sapiens
gcttaatagccctccccct

SEQ ID NO: 4116877 - DNA, 12 bp, Homo sapiens
gcttaatgttta

SEQ ID NO: 4116878 - DNA, 17 bp, Homo sapiens
gcttaatgtttattcct

SEQ ID NO: 4116879 - DNA, 18 bp, Homo sapiens
gcttaatttctaaagata

SEQ ID NO: 4116880 - DNA, 22 bp, Homo sapiens
gcttacctgacctcttgctgtc

SEQ ID NO: 4116881 - DNA, 13 bp, Homo sapiens
gcttagagagagg

SEQ ID NO: 4116882 - DNA, 21 bp, Homo sapiens
gcttagaggcatgggcttgct

SEQ ID NO: 4116883 - DNA, 13 bp, Homo sapiens
gcttagatttcat

SEQ ID NO: 4116884 - DNA, 20 bp, Homo sapiens
gcttagctgccttgagctaa

SEQ ID NO: 4116885 - DNA, 13 bp, Homo sapiens
gcttaggagagac

SEQ ID NO: 4116886 - DNA, 14 bp, Homo sapiens
gcttagtatctcat

SEQ ID NO: 4116887 - DNA, 22 bp, Homo sapiens
gcttagtatctcatcaacaaag

SEQ ID NO: 4116888 - DNA, 15 bp, Homo sapiens
gcttagtatttctca

SEQ ID NO: 4116889 - DNA, 16 bp, Homo sapiens
gcttagtatttctcag

SEQ ID NO: 4116890 - DNA, 17 bp, Homo sapiens
gcttataaacacattga

SEQ ID NO: 4116891 - DNA, 19 bp, Homo sapiens
gcttataaacacattgaat

SEQ ID NO: 4116892 - DNA, 15 bp, Homo sapiens
gcttatatgtacttt

SEQ ID NO: 4116893 - DNA, 15 bp, Homo sapiens
gcttatctcttttat

SEQ ID NO: 4116894 - DNA, 16 bp, Homo sapiens
gcttatgaatatttat

SEQ ID NO: 4116895 - DNA, 21 bp, Homo sapiens
gcttatgaatatttataacag

SEQ ID NO: 4116896 - DNA, 18 bp, Homo sapiens
gcttatgcttaaattcaa

SEQ ID NO: 4116897 - DNA, 20 bp, Homo sapiens
gcttattcatctgtttttct

SEQ ID NO: 4116898 - DNA, 20 bp, Homo sapiens
gcttattgttccaagacatt

SEQ ID NO: 4116899 - DNA, 19 bp, Homo sapiens
gcttatttattaacaggat

SEQ ID NO: 4116900 - DNA, 20 bp, Homo sapiens
gcttcaagtgccttttgctg

SEQ ID NO: 4116901 - DNA, 15 bp, Homo sapiens
gcttcaattaataaa

SEQ ID NO: 4116902 - DNA, 15 bp, Homo sapiens
gcttcaccagagcat

SEQ ID NO: 4116903 - DNA, 15 bp, Homo sapiens
gcttcaccctgtcaa

SEQ ID NO: 4116904 - DNA, 18 bp, Homo sapiens
gcttcactctctccgtct

SEQ ID NO: 4116905 - DNA, 15 bp, Homo sapiens
gcttcactgtataaa

SEQ ID NO: 4116906 - DNA, 17 bp, Homo sapiens
gcttcagcatatttata

SEQ ID NO: 4116907 - DNA, 18 bp, Homo sapiens
gcttcaggcaccagcatc

SEQ ID NO: 4116908 - DNA, 23 bp, Homo sapiens
gcttcaggttatcgaaataacaa

SEQ ID NO: 4116909 - DNA, 14 bp, Homo sapiens
gcttcatgccagct

SEQ ID NO: 4116910 - DNA, 15 bp, Homo sapiens
gcttcatgcctttgt

SEQ ID NO: 4116911 - DNA, 16 bp, Homo sapiens
gcttcatgcctttgta

SEQ ID NO: 4116912 - DNA, 14 bp, Homo sapiens
gcttcatgctcagc

SEQ ID NO: 4116913 - DNA, 18 bp, Homo sapiens
gcttcattcaatattgac

SEQ ID NO: 4116914 - DNA, 14 bp, Homo sapiens
gcttcattttggag

SEQ ID NO: 4116915 - DNA, 15 bp, Homo sapiens
gcttcattttggagc

SEQ ID NO: 4116916 - DNA, 18 bp, Homo sapiens
gcttcattttggagcttg

SEQ ID NO: 4116917 - DNA, 17 bp, Homo sapiens
gcttccagcttcaggca

SEQ ID NO: 4116918 - DNA, 19 bp, Homo sapiens
gcttccaggaaactccaca

SEQ ID NO: 4116919 - DNA, 19 bp, Homo sapiens
gcttccaggataaggagac

SEQ ID NO: 4116920 - DNA, 19 bp, Homo sapiens
gcttccaggtatctccagg

SEQ ID NO: 4116921 - DNA, 14 bp, Homo sapiens
gcttccatgattct

SEQ ID NO: 4116922 - DNA, 13 bp, Homo sapiens
gcttcccagaggg

SEQ ID NO: 4116923 - DNA, 17 bp, Homo sapiens
gcttcccctccaggagg

SEQ ID NO: 4116924 - DNA, 17 bp, Homo sapiens
gcttcccgctcagccct

SEQ ID NO: 4116925 - DNA, 18 bp, Homo sapiens
gcttcccgctcagccctc

SEQ ID NO: 4116926 - DNA, 18 bp, Homo sapiens
gcttccctgacttgcttt

SEQ ID NO: 4116927 - DNA, 21 bp, Homo sapiens
gcttccggtagggaggcagcc

SEQ ID NO: 4116928 - DNA, 23 bp, Homo sapiens
gcttcctacccacacctctgcca

SEQ ID NO: 4116929 - DNA, 20 bp, Homo sapiens
gcttcctcacacccctgtcc

SEQ ID NO: 4116930 - DNA, 20 bp, Homo sapiens
gcttcctctagaagccaagg

SEQ ID NO: 4116931 - DNA, 18 bp, Homo sapiens
gcttcctgcccttccctc

SEQ ID NO: 4116932 - DNA, 19 bp, Homo sapiens
gcttcctgcccttccctct

SEQ ID NO: 4116933 - DNA, 23 bp, Homo sapiens
gcttcctttcctgtgtgtactct

SEQ ID NO: 4116934 - DNA, 12 bp, Homo sapiens
gcttcctttctt

SEQ ID NO: 4116935 - DNA, 12 bp, Homo sapiens
gcttctatccca

SEQ ID NO: 4116936 - DNA, 14 bp, Homo sapiens
gcttctatcccagg

SEQ ID NO: 4116937 - DNA, 18 bp, Homo sapiens
gcttctatcccaggaggt

SEQ ID NO: 4116938 - DNA, 14 bp, Homo sapiens
gcttctccgccagc

SEQ ID NO: 4116939 - DNA, 18 bp, Homo sapiens
gcttctctagctctctag

SEQ ID NO: 4116940 - DNA, 19 bp, Homo sapiens
gcttctctagctctctagg

SEQ ID NO: 4116941 - DNA, 22 bp, Homo sapiens
gcttctctgtgaacgatttaga

SEQ ID NO: 4116942 - DNA, 23 bp, Homo sapiens
gcttctgaactcaagctgcgttt

SEQ ID NO: 4116943 - DNA, 20 bp, Homo sapiens
gcttctgcttttctgccctg

SEQ ID NO: 4116944 - DNA, 17 bp, Homo sapiens
gcttctggaaactacca

SEQ ID NO: 4116945 - DNA, 17 bp, Homo sapiens
gcttctggaatttgttc

SEQ ID NO: 4116946 - DNA, 20 bp, Homo sapiens
gcttctggaatttgttcaag

SEQ ID NO: 4116947 - DNA, 15 bp, Homo sapiens
gctggctctgcacta

SEQ ID NO: 4116948 - DNA, 14 bp, Homo sapiens
gctggctcttctgc

SEQ ID NO: 4116949 - DNA, 12 bp, Homo sapiens
gctggctggcct

SEQ ID NO: 4116950 - DNA, 21 bp, Homo sapiens
gctggctttgaaacctcaggg

SEQ ID NO: 4116951 - DNA, 15 bp, Homo sapiens
gctgggaccagagcc

SEQ ID NO: 4116952 - DNA, 17 bp, Homo sapiens
gctgggacgctctgctg

SEQ ID NO: 4116953 - DNA, 17 bp, Homo sapiens
gctgggacgtggctcag

SEQ ID NO: 4116954 - DNA, 14 bp, Homo sapiens
gctgggagcactgg

SEQ ID NO: 4116955 - DNA, 18 bp, Homo sapiens
gctgggagtagttgtctt

SEQ ID NO: 4116956 - DNA, 12 bp, Homo sapiens
gctgggcccctg

SEQ ID NO: 4116957 - DNA, 23 bp, Homo sapiens
gctgggcccctgggatgggacca

SEQ ID NO: 4116958 - DNA, 15 bp, Homo sapiens
gctgggccctctctt

SEQ ID NO: 4116959 - DNA, 18 bp, Homo sapiens
gctgggccctctcttctc

SEQ ID NO: 4116960 - DNA, 21 bp, Homo sapiens
gctgggccctctttccctgcg

SEQ ID NO: 4116961 - DNA, 15 bp, Homo sapiens
gctgggctcccccca

SEQ ID NO: 4116962 - DNA, 16 bp, Homo sapiens
gctgggctccccccag

SEQ ID NO: 4116963 - DNA, 20 bp, Homo sapiens
gctgggctccctgatgacac

SEQ ID NO: 4116964 - DNA, 12 bp, Homo sapiens
gctgggctgagt

SEQ ID NO: 4116965 - DNA, 23 bp, Homo sapiens
gctggggacctggtaccctcctg

SEQ ID NO: 4116966 - DNA, 14 bp, Homo sapiens
gctggggactcagg

SEQ ID NO: 4116967 - DNA, 16 bp, Homo sapiens
gctggggactcaggga

SEQ ID NO: 4116968 - DNA, 14 bp, Homo sapiens
gctggggcaggggg

SEQ ID NO: 4116969 - DNA, 16 bp, Homo sapiens
gctggggcagggggtg

SEQ ID NO: 4116970 - DNA, 16 bp, Homo sapiens
gctggggccagaggct

SEQ ID NO: 4116971 - DNA, 19 bp, Homo sapiens
gctggggccagaggctggg

SEQ ID NO: 4116972 - DNA, 18 bp, Homo sapiens
gctggggcggggcccagg

SEQ ID NO: 4116973 - DNA, 23 bp, Homo sapiens
gctggggctaggggaagggcttt

SEQ ID NO: 4116974 - DNA, 22 bp, Homo sapiens
gctgggggaatgagcccagaga

SEQ ID NO: 4116975 - DNA, 19 bp, Homo sapiens
gctgggggactggggggcc

SEQ ID NO: 4116976 - DNA, 20 bp, Homo sapiens
gctgggggcaggagggccct

SEQ ID NO: 4116977 - DNA, 15 bp, Homo sapiens
gctgggggtgctgga

SEQ ID NO: 4116978 - DNA, 16 bp, Homo sapiens
gctgggggtgctggat

SEQ ID NO: 4116979 - DNA, 18 bp, Homo sapiens
gctggggtgagagaggaa

SEQ ID NO: 4116980 - DNA, 13 bp, Homo sapiens
gctggggtgtcaa

SEQ ID NO: 4116981 - DNA, 20 bp, Homo sapiens
gctgggtataagcagagagg

SEQ ID NO: 4116982 - DNA, 15 bp, Homo sapiens
gctgggtcaggcagg

SEQ ID NO: 4116983 - DNA, 19 bp, Homo sapiens
gctgggtcggccctgccca

SEQ ID NO: 4116984 - DNA, 21 bp, Homo sapiens
gctgggtctaatccttctcat

SEQ ID NO: 4116985 - DNA, 17 bp, Homo sapiens
gctgggtggtaccctct

SEQ ID NO: 4116986 - DNA, 22 bp, Homo sapiens
gctggtaacagttcatgtttgc

SEQ ID NO: 4116987 - DNA, 15 bp, Homo sapiens
gctggtaagagaagt

SEQ ID NO: 4116988 - DNA, 13 bp, Homo sapiens
gctggtagttagt

SEQ ID NO: 4116989 - DNA, 15 bp, Homo sapiens
gctggtatctcagaa

SEQ ID NO: 4116990 - DNA, 15 bp, Homo sapiens
gctggtcacagcctc

SEQ ID NO: 4116991 - DNA, 20 bp, Homo sapiens
gctggtcacagcctcctctg

SEQ ID NO: 4116992 - DNA, 22 bp, Homo sapiens
gctggtcacagcctcctctgtc

SEQ ID NO: 4116993 - DNA, 14 bp, Homo sapiens
gctggtcacttctt

SEQ ID NO: 4116994 - DNA, 13 bp, Homo sapiens
gctggtcctccca

SEQ ID NO: 4116995 - DNA, 17 bp, Homo sapiens
gctggtgccagggtggg

SEQ ID NO: 4116996 - DNA, 18 bp, Homo sapiens
gctggtgccagggtgggt

SEQ ID NO: 4116997 - DNA, 23 bp, Homo sapiens
gctggtggaaagcgattcactgt

SEQ ID NO: 4116998 - DNA, 19 bp, Homo sapiens
gctggtggaccacaggcat

SEQ ID NO: 4116999 - DNA, 16 bp, Homo sapiens
gctggttactcagggt

SEQ ID NO: 4117000 - DNA, 23 bp, Homo sapiens
gctggttactcagggttcatctg

SEQ ID NO: 4117001 - DNA, 15 bp, Homo sapiens
gctggtttcctcatt

SEQ ID NO: 4117002 - DNA, 14 bp, Homo sapiens
gctggtttgttctg

SEQ ID NO: 4117003 - DNA, 12 bp, Homo sapiens
gctggttttcct

SEQ ID NO: 4117004 - DNA, 23 bp, Homo sapiens
gctggttttcctaaatgcagtga

SEQ ID NO: 4117005 - DNA, 16 bp, Homo sapiens
gctgtaaaatgcatga

SEQ ID NO: 4117006 - DNA, 18 bp, Homo sapiens
gctgtaacgtggcactgg

SEQ ID NO: 4117007 - DNA, 16 bp, Homo sapiens
gctgtaacttaaaata

SEQ ID NO: 4117008 - DNA, 22 bp, Homo sapiens
gctgtacatctattttggattg

SEQ ID NO: 4117009 - DNA, 15 bp, Homo sapiens
gctgtacccagatgc

SEQ ID NO: 4117010 - DNA, 16 bp, Homo sapiens
gctgtacccagatgcc

SEQ ID NO: 4117011 - DNA, 16 bp, Homo sapiens
gctgtataaagcatgt

SEQ ID NO: 4117012 - DNA, 15 bp, Homo sapiens
gctgtataagttatt

SEQ ID NO: 4117013 - DNA, 16 bp, Homo sapiens
gctgtatgatttgttt

SEQ ID NO: 4117014 - DNA, 21 bp, Homo sapiens
gctgtatgatttgttttgaat

SEQ ID NO: 4117015 - DNA, 16 bp, Homo sapiens
gctgtcaccaaggaaa

SEQ ID NO: 4117016 - DNA, 15 bp, Homo sapiens
gctgtcactggctgg

SEQ ID NO: 4117017 - DNA, 18 bp, Homo sapiens
gctgtcataagaatgaat

SEQ ID NO: 4117018 - DNA, 15 bp, Homo sapiens
gctgtcattgcttct

SEQ ID NO: 4117019 - DNA, 20 bp, Homo sapiens
gctgtcattgcttcttctga

SEQ ID NO: 4117020 - DNA, 16 bp, Homo sapiens
gctgtccagagaaaag

SEQ ID NO: 4117021 - DNA, 16 bp, Homo sapiens
gctgtcccagccccgg

SEQ ID NO: 4117022 - DNA, 17 bp, Homo sapiens
gctgtcctctcgagccc

SEQ ID NO: 4117023 - DNA, 18 bp, Homo sapiens
gctgtcgccccaggccct

SEQ ID NO: 4117024 - DNA, 23 bp, Homo sapiens
gctgtcgccccaggccctccctg

SEQ ID NO: 4117025 - DNA, 20 bp, Homo sapiens
gctgtctaacccccagctgg

SEQ ID NO: 4117026 - DNA, 19 bp, Homo sapiens
gctgtctagaatgtggatt

SEQ ID NO: 4117027 - DNA, 13 bp, Homo sapiens
gctgtctctgctc

SEQ ID NO: 4117028 - DNA, 12 bp, Homo sapiens
gctgtctggggc

SEQ ID NO: 4117029 - DNA, 14 bp, Homo sapiens
gctgtctggggcct

SEQ ID NO: 4117030 - DNA, 13 bp, Homo sapiens
gctgtctgtcacc

SEQ ID NO: 4117031 - DNA, 14 bp, Homo sapiens
gctgtctgtggctt

SEQ ID NO: 4117032 - DNA, 13 bp, Homo sapiens
gctgtcttctgga

SEQ ID NO: 4117033 - DNA, 18 bp, Homo sapiens
gctgtcttggggtcccac

SEQ ID NO: 4117034 - DNA, 23 bp, Homo sapiens
gctgtcttgttgcggatggatgg

SEQ ID NO: 4117035 - DNA, 20 bp, Homo sapiens
gctgtgaaccctggggcctg

SEQ ID NO: 4117036 - DNA, 16 bp, Homo sapiens
gctgtgacttctccag

SEQ ID NO: 4117037 - DNA, 18 bp, Homo sapiens
gctgtgaggaatgctctg

SEQ ID NO: 4117038 - DNA, 23 bp, Homo sapiens
gctgtgaggaatgctctgtgcca

SEQ ID NO: 4117039 - DNA, 22 bp, Homo sapiens
gctgtgaggcccctggacaagc

SEQ ID NO: 4117040 - DNA, 17 bp, Homo sapiens
gctgtgaggctgtcctg

SEQ ID NO: 4117041 - DNA, 19 bp, Homo sapiens
gctgtgagttctccctgta

SEQ ID NO: 4117042 - DNA, 15 bp, Homo sapiens
gctgtgccatgctgg

SEQ ID NO: 4117043 - DNA, 14 bp, Homo sapiens
gctgtgctatgaat

SEQ ID NO: 4117044 - DNA, 16 bp, Homo sapiens
gctgtgctatgaattt

SEQ ID NO: 4117045 - DNA, 15 bp, Homo sapiens
gctgtggaagcaaca

SEQ ID NO: 4117046 - DNA, 20 bp, Homo sapiens
gctgtggagcaaaaggcagc

SEQ ID NO: 4117047 - DNA, 19 bp, Homo sapiens
gctgtggccagggtgagag

SEQ ID NO: 4117048 - DNA, 21 bp, Homo sapiens
gctgtggccagggtgagagct

SEQ ID NO: 4117049 - DNA, 22 bp, Homo sapiens
gctgtggccagggtgagagctg

SEQ ID NO: 4117050 - DNA, 13 bp, Homo sapiens
aaaaaaaaaaaga

SEQ ID NO: 4117051 - DNA, 13 bp, Homo sapiens
aaaaaaacataaa

SEQ ID NO: 4117052 - DNA, 13 bp, Homo sapiens
aaaaaaagacaag

SEQ ID NO: 4117053 - DNA, 10 bp, Homo sapiens
aaaaaaagag

SEQ ID NO: 4117054 - DNA, 11 bp, Homo sapiens
aaaaaaatagt

SEQ ID NO: 4117055 - DNA, 13 bp, Homo sapiens
aaaaaaatgacta

SEQ ID NO: 4117056 - DNA, 11 bp, Homo sapiens
aaaaaaatgcc

SEQ ID NO: 4117057 - DNA, 11 bp, Homo sapiens
aaaaaaattta

SEQ ID NO: 4117058 - DNA, 10 bp, Homo sapiens
aaaaaagcac

SEQ ID NO: 4117059 - DNA, 13 bp, Homo sapiens
aaaaaaggaaaaa

SEQ ID NO: 4117060 - DNA, 19 bp, Homo sapiens
aaaaaaggttaatttttcc

SEQ ID NO: 4117061 - DNA, 12 bp, Homo sapiens
aaaaaagtttta

SEQ ID NO: 4117062 - DNA, 11 bp, Homo sapiens
aaaaaatactt

SEQ ID NO: 4117063 - DNA, 18 bp, Homo sapiens
aaaaaatgagacttactg

SEQ ID NO: 4117064 - DNA, 12 bp, Homo sapiens
aaaaaatggaaa

SEQ ID NO: 4117065 - DNA, 11 bp, Homo sapiens
aaaaaatgtcc

SEQ ID NO: 4117066 - DNA, 12 bp, Homo sapiens
aaaaaatttaag

SEQ ID NO: 4117067 - DNA, 11 bp, Homo sapiens
aaaaacaaaag

SEQ ID NO: 4117068 - DNA, 18 bp, Homo sapiens
aaaaacacctagctttat

SEQ ID NO: 4117069 - DNA, 15 bp, Homo sapiens
aaaaacagcattgct

SEQ ID NO: 4117070 - DNA, 16 bp, Homo sapiens
aaaaacataaaaagca

SEQ ID NO: 4117071 - DNA, 16 bp, Homo sapiens
aaaaacatagaaaaat

SEQ ID NO: 4117072 - DNA, 12 bp, Homo sapiens
aaaaactgaatg

SEQ ID NO: 4117073 - DNA, 21 bp, Homo sapiens
aaaaacttagtgacaaaatag

SEQ ID NO: 4117074 - DNA, 15 bp, Homo sapiens
aaaaacttgaaaata

SEQ ID NO: 4117075 - DNA, 12 bp, Homo sapiens
aaaaacttgtaa

SEQ ID NO: 4117076 - DNA, 13 bp, Homo sapiens
aaaaagaagttac

SEQ ID NO: 4117077 - DNA, 16 bp, Homo sapiens
aaaaagaagttacttt

SEQ ID NO: 4117078 - DNA, 22 bp, Homo sapiens
aaaaagaagttactttgtaatt

SEQ ID NO: 4117079 - DNA, 17 bp, Homo sapiens
aaaaagacgatgtttat

SEQ ID NO: 4117080 - DNA, 19 bp, Homo sapiens
aaaaagacgatgtttatgt

SEQ ID NO: 4117081 - DNA, 23 bp, Homo sapiens
aaaaagacgatgtttatgttctt

SEQ ID NO: 4117082 - DNA, 19 bp, Homo sapiens
aaaaagagaattagattat

SEQ ID NO: 4117083 - DNA, 15 bp, Homo sapiens
aaaaagcaagggaga

SEQ ID NO: 4117084 - DNA, 20 bp, Homo sapiens
aaaaagcacatacattaaaa

SEQ ID NO: 4117085 - DNA, 22 bp, Homo sapiens
aaaaagcagaattttaatgtga

SEQ ID NO: 4117086 - DNA, 17 bp, Homo sapiens
aaaaagcataaaaacat

SEQ ID NO: 4117087 - DNA, 18 bp, Homo sapiens
aaaaagcatgatgggaaa

SEQ ID NO: 4117088 - DNA, 23 bp, Homo sapiens
aaaaagccagtttgggtaaaata

SEQ ID NO: 4117089 - DNA, 15 bp, Homo sapiens
aaaaagcctggtttt

SEQ ID NO: 4117090 - DNA, 20 bp, Homo sapiens
aaaaagcctggtttttctca

SEQ ID NO: 4117091 - DNA, 16 bp, Homo sapiens
aaaaaggacatcagca

SEQ ID NO: 4117092 - DNA, 22 bp, Homo sapiens
aaaaagggcagggcatctcctg

SEQ ID NO: 4117093 - DNA, 13 bp, Homo sapiens
aaaaagtgacaca

SEQ ID NO: 4117094 - DNA, 14 bp, Homo sapiens
aaaaagtgacacag

SEQ ID NO: 4117095 - DNA, 23 bp, Homo sapiens
aaaaagtgacacagcagcttcac

SEQ ID NO: 4117096 - DNA, 13 bp, Homo sapiens
aaaaagttcagag

SEQ ID NO: 4117097 - DNA, 17 bp, Homo sapiens
aaaaagttttatttttc

SEQ ID NO: 4117098 - DNA, 20 bp, Homo sapiens
aaaaataaaataattataaa

SEQ ID NO: 4117099 - DNA, 17 bp, Homo sapiens
aaaaataatcaagattt

SEQ ID NO: 4117100 - DNA, 13 bp, Homo sapiens
aaaaatatattta

SEQ ID NO: 4117101 - DNA, 16 bp, Homo sapiens
aaaaatattataactt

SEQ ID NO: 4117102 - DNA, 12 bp, Homo sapiens
aaaaatattgtt

SEQ ID NO: 4117103 - DNA, 15 bp, Homo sapiens
aaaaatgaatgtcta

SEQ ID NO: 4117104 - DNA, 21 bp, Homo sapiens
aaaaatgcacgtagctgaggc

SEQ ID NO: 4117105 - DNA, 13 bp, Homo sapiens
aaaaatgcctttg

SEQ ID NO: 4117106 - DNA, 18 bp, Homo sapiens
aaaaatgcctttgagaca

SEQ ID NO: 4117107 - DNA, 19 bp, Homo sapiens
aaaaatgcctttgagacag

SEQ ID NO: 4117108 - DNA, 17 bp, Homo sapiens
aaaaatggaaaaaaaca

SEQ ID NO: 4117109 - DNA, 20 bp, Homo sapiens
aaaaatgggagacagcctct

SEQ ID NO: 4117110 - DNA, 13 bp, Homo sapiens
aaaaatgtaaata

SEQ ID NO: 4117111 - DNA, 22 bp, Homo sapiens
aaaaatgttggatttataaatg

SEQ ID NO: 4117112 - DNA, 23 bp, Homo sapiens
aaaaattacagcttcaccctgtc

SEQ ID NO: 4117113 - DNA, 18 bp, Homo sapiens
aaaaattcctaagaatca

SEQ ID NO: 4117114 - DNA, 13 bp, Homo sapiens
aaaaattgaagag

SEQ ID NO: 4117115 - DNA, 19 bp, Homo sapiens
aaaaattgaagagagatat

SEQ ID NO: 4117116 - DNA, 21 bp, Homo sapiens
aaaaatttaaagggtgtactt

SEQ ID NO: 4117117 - DNA, 15 bp, Homo sapiens
aaaaatttaagcatt

SEQ ID NO: 4117118 - DNA, 21 bp, Homo sapiens
aaaaatttaagcattgtttgc

SEQ ID NO: 4117119 - DNA, 17 bp, Homo sapiens
aaaaatttgaacactgg

SEQ ID NO: 4117120 - DNA, 15 bp, Homo sapiens
aaaacaaaatctaaa

SEQ ID NO: 4117121 - DNA, 22 bp, Homo sapiens
aaaacaactatggatcagaata

SEQ ID NO: 4117122 - DNA, 15 bp, Homo sapiens
aaaacaagaatgaaa

SEQ ID NO: 4117123 - DNA, 12 bp, Homo sapiens
aaaacaagtgaa

SEQ ID NO: 4117124 - DNA, 16 bp, Homo sapiens
aaaacacattatgtat

SEQ ID NO: 4117125 - DNA, 21 bp, Homo sapiens
aaaacacattatgtatcttag

SEQ ID NO: 4117126 - DNA, 20 bp, Homo sapiens
aaaacactgaaaaattatac

SEQ ID NO: 4117127 - DNA, 15 bp, Homo sapiens
aaaacactgccctct

SEQ ID NO: 4117128 - DNA, 13 bp, Homo sapiens
aaaacagaagcct

SEQ ID NO: 4117129 - DNA, 22 bp, Homo sapiens
aaaacagccataggccctttca

SEQ ID NO: 4117130 - DNA, 13 bp, Homo sapiens
aaaacagtattta

SEQ ID NO: 4117131 - DNA, 23 bp, Homo sapiens
aaaacagtatttattttgtaatt

SEQ ID NO: 4117132 - DNA, 14 bp, Homo sapiens
aaaacatggtagaa

SEQ ID NO: 4117133 - DNA, 16 bp, Homo sapiens
aaaacatggtagaatt

SEQ ID NO: 4117134 - DNA, 13 bp, Homo sapiens
aaaacatttttaa

SEQ ID NO: 4117135 - DNA, 12 bp, Homo sapiens
aaaaccacacaa

SEQ ID NO: 4117136 - DNA, 15 bp, Homo sapiens
aaaaccacacaaaga

SEQ ID NO: 4117137 - DNA, 13 bp, Homo sapiens
aaaaccagagcct

SEQ ID NO: 4117138 - DNA, 13 bp, Homo sapiens
aaaaccatttgaa

SEQ ID NO: 4117139 - DNA, 14 bp, Homo sapiens
aaaacccagggcaa

SEQ ID NO: 4117140 - DNA, 13 bp, Homo sapiens
aaaacctgacaaa

SEQ ID NO: 4117141 - DNA, 19 bp, Homo sapiens
aaaacctgtatttttgtta

SEQ ID NO: 4117142 - DNA, 14 bp, Homo sapiens
aaaacgaaaataaa

SEQ ID NO: 4117143 - DNA, 20 bp, Homo sapiens
aaaacgaaaataaagtagct

SEQ ID NO: 4117144 - DNA, 15 bp, Homo sapiens
aaaactaagcacaaa

SEQ ID NO: 4117145 - DNA, 17 bp, Homo sapiens
aaaactacttctttttt

SEQ ID NO: 4117146 - DNA, 20 bp, Homo sapiens
aaaactaggtaatgttttgt

SEQ ID NO: 4117147 - DNA, 12 bp, Homo sapiens
aaaactatggtt

SEQ ID NO: 4117148 - DNA, 21 bp, Homo sapiens
aaaactatttagtgttagtta

SEQ ID NO: 4117149 - DNA, 17 bp, Homo sapiens
aaaactgtacatttaaa

SEQ ID NO: 4117150 - DNA, 12 bp, Homo sapiens
aaaactgtgttg

SEQ ID NO: 4117151 - DNA, 17 bp, Homo sapiens
aaaactgtgttgccaca

SEQ ID NO: 4117152 - DNA, 18 bp, Homo sapiens
aaaacttcttaaatatct

SEQ ID NO: 4117153 - DNA, 15 bp, Homo sapiens
aaaacttttctgctg

SEQ ID NO: 4117154 - DNA, 9 bp, Homo sapiens
aaaagaaaa

SEQ ID NO: 4117155 - DNA, 14 bp, Homo sapiens
aaaagaaacacaag

SEQ ID NO: 4117156 - DNA, 14 bp, Homo sapiens
aaaagaaatgaaca

SEQ ID NO: 4117157 - DNA, 14 bp, Homo sapiens
aaaagaaatgacta

SEQ ID NO: 4117158 - DNA, 15 bp, Homo sapiens
aaaagaaatgactaa

SEQ ID NO: 4117159 - DNA, 14 bp, Homo sapiens
aaaagaagttactt

SEQ ID NO: 4117160 - DNA, 17 bp, Homo sapiens
aaaagaagttactttgt

SEQ ID NO: 4117161 - DNA, 18 bp, Homo sapiens
aaaagaagttactttgta

SEQ ID NO: 4117162 - DNA, 11 bp, Homo sapiens
aaaagaatgac

SEQ ID NO: 4117163 - DNA, 11 bp, Homo sapiens
aaaagagaaac

SEQ ID NO: 4117164 - DNA, 18 bp, Homo sapiens
aaaagagaattagattat

SEQ ID NO: 4117165 - DNA, 14 bp, Homo sapiens
aaaagagatatttt

SEQ ID NO: 4117166 - DNA, 21 bp, Homo sapiens
aaaagagcagcatttttaatt

SEQ ID NO: 4117167 - DNA, 14 bp, Homo sapiens
aaaagataaagatg

SEQ ID NO: 4117168 - DNA, 20 bp, Homo sapiens
aaaagataaagatgatctac

SEQ ID NO: 4117169 - DNA, 13 bp, Homo sapiens
aaaagatcgcagt

SEQ ID NO: 4117170 - DNA, 23 bp, Homo sapiens
aaaagatctgttttgaaggcaaa

SEQ ID NO: 4117171 - DNA, 18 bp, Homo sapiens
aaaagatggcctttgctt

SEQ ID NO: 4117172 - DNA, 14 bp, Homo sapiens
aaaagatgtatcct

SEQ ID NO: 4117173 - DNA, 14 bp, Homo sapiens
aaaagattttaatc

SEQ ID NO: 4117174 - DNA, 15 bp, Homo sapiens
aaaagattttaatca

SEQ ID NO: 4117175 - DNA, 21 bp, Homo sapiens
aaaagcaaatctacagatcct

SEQ ID NO: 4117176 - DNA, 12 bp, Homo sapiens
aaaagcaagact

SEQ ID NO: 4117177 - DNA, 16 bp, Homo sapiens
aaaagcacatacatta

SEQ ID NO: 4117178 - DNA, 13 bp, Homo sapiens
aaaagcacttttg

SEQ ID NO: 4117179 - DNA, 14 bp, Homo sapiens
aaaagcacttttgt

SEQ ID NO: 4117180 - DNA, 15 bp, Homo sapiens
aaaagcacttttgtt

SEQ ID NO: 4117181 - DNA, 22 bp, Homo sapiens
aaaagcagaattttaatgtgaa

SEQ ID NO: 4117182 - DNA, 18 bp, Homo sapiens
aaaagcagcgtcactcta

SEQ ID NO: 4117183 - DNA, 14 bp, Homo sapiens
aaaagcagctacca

SEQ ID NO: 4117184 - DNA, 19 bp, Homo sapiens
aaaagcagtaaatttgcta

SEQ ID NO: 4117185 - DNA, 22 bp, Homo sapiens
aaaagcagtcctcttattccta

SEQ ID NO: 4117186 - DNA, 13 bp, Homo sapiens
aaaagcctggttt

SEQ ID NO: 4117187 - DNA, 18 bp, Homo sapiens
aaaagccttgtgtatatt

SEQ ID NO: 4117188 - DNA, 20 bp, Homo sapiens
aaaagccttgtgtatatttg

SEQ ID NO: 4117189 - DNA, 21 bp, Homo sapiens
aaaagctagtgtacctcctct

SEQ ID NO: 4117190 - DNA, 14 bp, Homo sapiens
aaaagcttccatga

SEQ ID NO: 4117191 - DNA, 13 bp, Homo sapiens
aaaagcttcttaa

SEQ ID NO: 4117192 - DNA, 22 bp, Homo sapiens
aaaagcttcttaattaatttga

SEQ ID NO: 4117193 - DNA, 11 bp, Homo sapiens
aaaaggaaaaa

SEQ ID NO: 4117194 - DNA, 13 bp, Homo sapiens
aaaaggaaagaaa

SEQ ID NO: 4117195 - DNA, 16 bp, Homo sapiens
aaaaggaacaaataaa

SEQ ID NO: 4117196 - DNA, 15 bp, Homo sapiens
aaaaggcctcttgta

SEQ ID NO: 4117197 - DNA, 23 bp, Homo sapiens
aaaaggcctcttgtaaagactgg

SEQ ID NO: 4117198 - DNA, 20 bp, Homo sapiens
aaaaggcgcatctaacgcgt

SEQ ID NO: 4117199 - DNA, 18 bp, Homo sapiens
aaaagggaagtagtcctt

SEQ ID NO: 4117200 - DNA, 23 bp, Homo sapiens
aaaagggcagggcatctcctgtg

SEQ ID NO: 4117201 - DNA, 15 bp, Homo sapiens
aaaagggtcaaacct

SEQ ID NO: 4117202 - DNA, 21 bp, Homo sapiens
aaaaggtgataggtaaatttt

SEQ ID NO: 4117203 - DNA, 16 bp, Homo sapiens
aaaaggttaataaagt

SEQ ID NO: 4117204 - DNA, 21 bp, Homo sapiens
aaaagtacatatttattttct

SEQ ID NO: 4117205 - DNA, 13 bp, Homo sapiens
aaaagtacattta

SEQ ID NO: 4117206 - DNA, 17 bp, Homo sapiens
aaaagtacatttaatac

SEQ ID NO: 4117207 - DNA, 20 bp, Homo sapiens
aaaagtaggtttacattcat

SEQ ID NO: 4117208 - DNA, 15 bp, Homo sapiens
aaaagtatatgttag

SEQ ID NO: 4117209 - DNA, 11 bp, Homo sapiens
aaaagtatttt

SEQ ID NO: 4117210 - DNA, 14 bp, Homo sapiens
aaaagtattttgaa

SEQ ID NO: 4117211 - DNA, 20 bp, Homo sapiens
aaaagtattttgaagtttac

SEQ ID NO: 4117212 - DNA, 23 bp, Homo sapiens
aaaagtattttgaagtttacatt

SEQ ID NO: 4117213 - DNA, 17 bp, Homo sapiens
aaaagtgacacagcagc

SEQ ID NO: 4117214 - DNA, 14 bp, Homo sapiens
aaaagtgactctca

SEQ ID NO: 4117215 - DNA, 21 bp, Homo sapiens
aaaagtgatcaataaaatgtg

SEQ ID NO: 4117216 - DNA, 23 bp, Homo sapiens
aaaagtgatcaataaaatgtgat

SEQ ID NO: 4117217 - DNA, 13 bp, Homo sapiens
aaaagttcagagt

SEQ ID NO: 4117218 - DNA, 19 bp, Homo sapiens
aaaagtttacaacttgatt

SEQ ID NO: 4117219 - DNA, 17 bp, Homo sapiens
aaaagttttatttttct

SEQ ID NO: 4117220 - DNA, 21 bp, Homo sapiens
aaaagttttttttttgtttgt

SEQ ID NO: 4117221 - DNA, 20 bp, Homo sapiens
aaaataaaacttcacattta

SEQ ID NO: 4117222 - DNA, 13 bp, Homo sapiens
aaaataaaatgaa

SEQ ID NO: 4117223 - DNA, 21 bp, Homo sapiens
aaaataaaatgaaaattgtat

SEQ ID NO: 4117224 - DNA, 12 bp, Homo sapiens
aaaataaacatc

SEQ ID NO: 4117225 - DNA, 16 bp, Homo sapiens
aaaataataaaaaaag

SEQ ID NO: 4117226 - DNA, 14 bp, Homo sapiens
aaaataattagtta

SEQ ID NO: 4117227 - DNA, 15 bp, Homo sapiens
aaaatacaatcctgt

SEQ ID NO: 4117228 - DNA, 18 bp, Homo sapiens
aaaatacatttaaaactt

SEQ ID NO: 4117229 - DNA, 21 bp, Homo sapiens
aaaatagaaattttgtaagaa

SEQ ID NO: 4117230 - DNA, 13 bp, Homo sapiens
aaaatagacactc

SEQ ID NO: 4117231 - DNA, 23 bp, Homo sapiens
aaaatagttaagacatgatttcc

SEQ ID NO: 4117232 - DNA, 17 bp, Homo sapiens
aaaatatatactaaaca

SEQ ID NO: 4117233 - DNA, 14 bp, Homo sapiens
aaaatatatttaat

SEQ ID NO: 4117234 - DNA, 15 bp, Homo sapiens
aaaatatggtttggt

SEQ ID NO: 4117235 - DNA, 22 bp, Homo sapiens
aaaatattactcagtttatgtt

SEQ ID NO: 4117236 - DNA, 14 bp, Homo sapiens
aaaatattatgtgt

SEQ ID NO: 4117237 - DNA, 21 bp, Homo sapiens
aaaatattcctccaaatctct

SEQ ID NO: 4117238 - DNA, 16 bp, Homo sapiens
aaaatattgtttctgc

SEQ ID NO: 4117239 - DNA, 13 bp, Homo sapiens
aaaatatttataa

SEQ ID NO: 4117240 - DNA, 11 bp, Homo sapiens
aaaatatttca

SEQ ID NO: 4117241 - DNA, 13 bp, Homo sapiens
aaaatatttcaga

SEQ ID NO: 4117242 - DNA, 13 bp, Homo sapiens
aaaatattttata

SEQ ID NO: 4117243 - DNA, 17 bp, Homo sapiens
aaaatatttttttttct

SEQ ID NO: 4117244 - DNA, 16 bp, Homo sapiens
aaaatcaaaacaagtg

SEQ ID NO: 4117245 - DNA, 13 bp, Homo sapiens
aaaatcacaaaaa

SEQ ID NO: 4117246 - DNA, 21 bp, Homo sapiens
aaaatcactatctttctgata

SEQ ID NO: 4117247 - DNA, 22 bp, Homo sapiens
aaaatcattgattgtcagctac

SEQ ID NO: 4117248 - DNA, 16 bp, Homo sapiens
aaaatccaaaacttct

SEQ ID NO: 4117249 - DNA, 12 bp, Homo sapiens
aaaatccagaaa

SEQ ID NO: 4117250 - DNA, 16 bp, Homo sapiens
aaaatctaaaacaaaa

SEQ ID NO: 4117251 - DNA, 14 bp, Homo sapiens
aaaatctattctgt

SEQ ID NO: 4117252 - DNA, 21 bp, Homo sapiens
aaaatctcccattttggaatt

SEQ ID NO: 4117253 - DNA, 16 bp, Homo sapiens
aaaatctgaactctca

SEQ ID NO: 4117254 - DNA, 17 bp, Homo sapiens
aaaatctgaactctcaa

SEQ ID NO: 4117255 - DNA, 12 bp, Homo sapiens
aaaatctgtcca

SEQ ID NO: 4117256 - DNA, 14 bp, Homo sapiens
aaaatcttggaagt

SEQ ID NO: 4117257 - DNA, 15 bp, Homo sapiens
aaaatgaaatatttt

SEQ ID NO: 4117258 - DNA, 20 bp, Homo sapiens
aaaatgaaggttaggattta

SEQ ID NO: 4117259 - DNA, 19 bp, Homo sapiens
aaaatgactacttagcatc

SEQ ID NO: 4117260 - DNA, 18 bp, Homo sapiens
aaaatgaggttcaactgt

SEQ ID NO: 4117261 - DNA, 16 bp, Homo sapiens
aaaatgagttgtgatg

SEQ ID NO: 4117262 - DNA, 22 bp, Homo sapiens
aaaatgatttgtagtggaaaca

SEQ ID NO: 4117263 - DNA, 12 bp, Homo sapiens
aaaatgcctttg

SEQ ID NO: 4117264 - DNA, 15 bp, Homo sapiens
aaaatgcctttgaga

SEQ ID NO: 4117265 - DNA, 22 bp, Homo sapiens
aaaatgcggttataaaaaatgg

SEQ ID NO: 4117266 - DNA, 18 bp, Homo sapiens
aaaatgctttttatttct

SEQ ID NO: 4117267 - DNA, 19 bp, Homo sapiens
aaaatgctttttatttctg

SEQ ID NO: 4117268 - DNA, 18 bp, Homo sapiens
aaaatggaaaaaaacata

SEQ ID NO: 4117269 - DNA, 12 bp, Homo sapiens
aaaatggaaaga

SEQ ID NO: 4117270 - DNA, 13 bp, Homo sapiens
aaaatggaaagaa

SEQ ID NO: 4117271 - DNA, 14 bp, Homo sapiens
aaaatggaaagaat

SEQ ID NO: 4117272 - DNA, 22 bp, Homo sapiens
aaaatggtccaattagtttcct

SEQ ID NO: 4117273 - DNA, 19 bp, Homo sapiens
aaaatggttgatggaaaat

SEQ ID NO: 4117274 - DNA, 20 bp, Homo sapiens
aaaatggttgatggaaaata

SEQ ID NO: 4117275 - DNA, 18 bp, Homo sapiens
aaaatgtatgtgtaagta

SEQ ID NO: 4117276 - DNA, 16 bp, Homo sapiens
aaaatgtcctgccttt

SEQ ID NO: 4117277 - DNA, 13 bp, Homo sapiens
aaaatgtctcagt

SEQ ID NO: 4117278 - DNA, 18 bp, Homo sapiens
aaaatgtctgttaactta

SEQ ID NO: 4117279 - DNA, 15 bp, Homo sapiens
aaaatgtgaggaaga

SEQ ID NO: 4117280 - DNA, 16 bp, Homo sapiens
aaaatgttatttaaca

SEQ ID NO: 4117281 - DNA, 12 bp, Homo sapiens
aaaatgttcttt

SEQ ID NO: 4117282 - DNA, 14 bp, Homo sapiens
aaaatgttgagaat

SEQ ID NO: 4117283 - DNA, 22 bp, Homo sapiens
aaaatgttggatttataaatgc

SEQ ID NO: 4117284 - DNA, 16 bp, Homo sapiens
aaaatgtttaagtatt

SEQ ID NO: 4117285 - DNA, 16 bp, Homo sapiens
aaaatgtttcatttac

SEQ ID NO: 4117286 - DNA, 14 bp, Homo sapiens
aaaattaagtagaa

SEQ ID NO: 4117287 - DNA, 21 bp, Homo sapiens
aaaattatactaacttattta

SEQ ID NO: 4117288 - DNA, 17 bp, Homo sapiens
aaaattcaattgtaaat

SEQ ID NO: 4117289 - DNA, 13 bp, Homo sapiens
aaaattcagtttt

SEQ ID NO: 4117290 - DNA, 16 bp, Homo sapiens
aaaattccattatctt

SEQ ID NO: 4117291 - DNA, 21 bp, Homo sapiens
aaaattccattatcttatgaa

SEQ ID NO: 4117292 - DNA, 23 bp, Homo sapiens
aaaattctgtgccttgttttttg

SEQ ID NO: 4117293 - DNA, 20 bp, Homo sapiens
aaaattgaatgtggctgaag

SEQ ID NO: 4117294 - DNA, 23 bp, Homo sapiens
aaaattgatatacttttttctta

SEQ ID NO: 4117295 - DNA, 15 bp, Homo sapiens
aaaattgcaaatctt

SEQ ID NO: 4117296 - DNA, 22 bp, Homo sapiens
aaaattgctatgttactatttt

SEQ ID NO: 4117297 - DNA, 21 bp, Homo sapiens
aaaattgtcacctctgttaag

SEQ ID NO: 4117298 - DNA, 20 bp, Homo sapiens
aaaattgtctaaaatgtcag

SEQ ID NO: 4117299 - DNA, 13 bp, Homo sapiens
aaaattgtgatca

SEQ ID NO: 4117300 - DNA, 22 bp, Homo sapiens
aaaatttaaagggtgtacttat

SEQ ID NO: 4117301 - DNA, 15 bp, Homo sapiens
aaaatttaagcattg

SEQ ID NO: 4117302 - DNA, 15 bp, Homo sapiens
aaaatttaagtgcgt

SEQ ID NO: 4117303 - DNA, 23 bp, Homo sapiens
aaaatttaagtgcgtgtgtagag

SEQ ID NO: 4117304 - DNA, 18 bp, Homo sapiens
aaaatttagccctttaaa

SEQ ID NO: 4117305 - DNA, 24 bp, Homo sapiens
aaaatttatcttaagttctatgaa

SEQ ID NO: 4117306 - DNA, 13 bp, Homo sapiens
aaaatttctaaga

SEQ ID NO: 4117307 - DNA, 18 bp, Homo sapiens
aaaatttgaaatttagct

SEQ ID NO: 4117308 - DNA, 16 bp, Homo sapiens
aaaattttacttccat

SEQ ID NO: 4117309 - DNA, 17 bp, Homo sapiens
aaaatttttacattcat

SEQ ID NO: 4117310 - DNA, 15 bp, Homo sapiens
aaacaaaatctaaaa

SEQ ID NO: 4117311 - DNA, 15 bp, Homo sapiens
aaacaaaatctgaac

SEQ ID NO: 4117312 - DNA, 16 bp, Homo sapiens
aaacaaaatctgaact

SEQ ID NO: 4117313 - DNA, 17 bp, Homo sapiens
aaacaaaatctgaactc

SEQ ID NO: 4117314 - DNA, 12 bp, Homo sapiens
aaacaaatatgc

SEQ ID NO: 4117315 - DNA, 14 bp, Homo sapiens
aaacaaatatgcaa

SEQ ID NO: 4117316 - DNA, 16 bp, Homo sapiens
aaacaataaatgtgca

SEQ ID NO: 4117317 - DNA, 17 bp, Homo sapiens
aaacaatgcaaaacctt

SEQ ID NO: 4117318 - DNA, 20 bp, Homo sapiens
aaacacaaaagttagctgag

SEQ ID NO: 4117319 - DNA, 16 bp, Homo sapiens
aaacacaccaggctgt

SEQ ID NO: 4117320 - DNA, 11 bp, Homo sapiens
aaacacagctg

SEQ ID NO: 4117321 - DNA, 11 bp, Homo sapiens
aaacacagctt

SEQ ID NO: 4117322 - DNA, 19 bp, Homo sapiens
aaacacattatgtatctta

SEQ ID NO: 4117323 - DNA, 14 bp, Homo sapiens
aaacacctagcttt

SEQ ID NO: 4117324 - DNA, 18 bp, Homo sapiens
aaacacctcctcatgtac

SEQ ID NO: 4117325 - DNA, 22 bp, Homo sapiens
aaacaccttccagctcctgtaa

SEQ ID NO: 4117326 - DNA, 19 bp, Homo sapiens
aaacactcaataaattgca

SEQ ID NO: 4117327 - DNA, 20 bp, Homo sapiens
aaacactccaccctccacct

SEQ ID NO: 4117328 - DNA, 23 bp, Homo sapiens
aaacactgaggcagccttgggga

SEQ ID NO: 4117329 - DNA, 18 bp, Homo sapiens
aaacagaaaaacagacaa

SEQ ID NO: 4117330 - DNA, 16 bp, Homo sapiens
aaacagacaatatgtg

SEQ ID NO: 4117331 - DNA, 22 bp, Homo sapiens
aaacagacaatatgtgagtgcc

SEQ ID NO: 4117332 - DNA, 21 bp, Homo sapiens
aaacagagtggcctccctgct

SEQ ID NO: 4117333 - DNA, 21 bp, Homo sapiens
aaacagatgatgagaatttct

SEQ ID NO: 4117334 - DNA, 21 bp, Homo sapiens
aaacagattcaggccagccca

SEQ ID NO: 4117335 - DNA, 22 bp, Homo sapiens
aaacagattcaggccagcccag

SEQ ID NO: 4117336 - DNA, 15 bp, Homo sapiens
aaacagatttttaca

SEQ ID NO: 4117337 - DNA, 17 bp, Homo sapiens
aaacagcattgctttct

SEQ ID NO: 4117338 - DNA, 18 bp, Homo sapiens
aaacagcattgctttctg

SEQ ID NO: 4117339 - DNA, 15 bp, Homo sapiens
aaacagccatgtcca

SEQ ID NO: 4117340 - DNA, 20 bp, Homo sapiens
aaacagctgcattagaaaaa

SEQ ID NO: 4117341 - DNA, 21 bp, Homo sapiens
aaacaggtatatactttgaaa

SEQ ID NO: 4117342 - DNA, 20 bp, Homo sapiens
aaacagtagttgtattcttc

SEQ ID NO: 4117343 - DNA, 17 bp, Homo sapiens
aaacagtatttattttg

SEQ ID NO: 4117344 - DNA, 15 bp, Homo sapiens
aaacagtatttcatt

SEQ ID NO: 4117345 - DNA, 17 bp, Homo sapiens
aaacagtatttcattgc

SEQ ID NO: 4117346 - DNA, 20 bp, Homo sapiens
aaacagtgccaaatgctggg

SEQ ID NO: 4117347 - DNA, 18 bp, Homo sapiens
aaacagtgggagccctga

SEQ ID NO: 4117348 - DNA, 14 bp, Homo sapiens
aaacagttaacttt

SEQ ID NO: 4117349 - DNA, 14 bp, Homo sapiens
aaacataaaaagca

SEQ ID NO: 4117350 - DNA, 21 bp, Homo sapiens
aaacataaaaagcagaatttt

SEQ ID NO: 4117351 - DNA, 15 bp, Homo sapiens
aaacataatgaaaat

SEQ ID NO: 4117352 - DNA, 15 bp, Homo sapiens
aaacatatgatttca

SEQ ID NO: 4117353 - DNA, 20 bp, Homo sapiens
aaacatcaacctggcaaaaa

SEQ ID NO: 4117354 - DNA, 14 bp, Homo sapiens
aaacatcagtttct

SEQ ID NO: 4117355 - DNA, 15 bp, Homo sapiens
aaacatggttacaat

SEQ ID NO: 4117356 - DNA, 17 bp, Homo sapiens
aaacatggttacaatca

SEQ ID NO: 4117357 - DNA, 17 bp, Homo sapiens
aaacatgttagaagcaa

SEQ ID NO: 4117358 - DNA, 21 bp, Homo sapiens
aaacatgtttatttttcttgt

SEQ ID NO: 4117359 - DNA, 20 bp, Homo sapiens
aaacattatagattttcatg

SEQ ID NO: 4117360 - DNA, 17 bp, Homo sapiens
aaacattcgtgagctgg

SEQ ID NO: 4117361 - DNA, 16 bp, Homo sapiens
aaacattgaagtaatg

SEQ ID NO: 4117362 - DNA, 19 bp, Homo sapiens
aaacattgacgattccttc

SEQ ID NO: 4117363 - DNA, 11 bp, Homo sapiens
aaacatttata

SEQ ID NO: 4117364 - DNA, 15 bp, Homo sapiens
aaacatttcatttcc

SEQ ID NO: 4117365 - DNA, 16 bp, Homo sapiens
aaacatttgttcctgg

SEQ ID NO: 4117366 - DNA, 17 bp, Homo sapiens
aaacatttgttcctgga

SEQ ID NO: 4117367 - DNA, 15 bp, Homo sapiens
aaacattttgaagtg

SEQ ID NO: 4117368 - DNA, 17 bp, Homo sapiens
aaacattttgaagtgtg

SEQ ID NO: 4117369 - DNA, 19 bp, Homo sapiens
aaacattttgtcatataag

SEQ ID NO: 4117370 - DNA, 23 bp, Homo sapiens
aaacatttttaatttaacaaact

SEQ ID NO: 4117371 - DNA, 15 bp, Homo sapiens
aaacattttttcttc

SEQ ID NO: 4117372 - DNA, 22 bp, Homo sapiens
aaacattttttcttctgaagat

SEQ ID NO: 4117373 - DNA, 19 bp, Homo sapiens
aaaccaaagagggcttcct

SEQ ID NO: 4117374 - DNA, 21 bp, Homo sapiens
aaaccaaagagggcttcctct

SEQ ID NO: 4117375 - DNA, 22 bp, Homo sapiens
aaaccaacctaatatattgtat

SEQ ID NO: 4117376 - DNA, 14 bp, Homo sapiens
aaaccaaggactga

SEQ ID NO: 4117377 - DNA, 19 bp, Homo sapiens
aaaccaatggtgatcctct

SEQ ID NO: 4117378 - DNA, 16 bp, Homo sapiens
aaaccactagaactct

SEQ ID NO: 4117379 - DNA, 23 bp, Homo sapiens
aaaccatccagtgacaaaccatc

SEQ ID NO: 4117380 - DNA, 13 bp, Homo sapiens
aaaccatgactgt

SEQ ID NO: 4117381 - DNA, 17 bp, Homo sapiens
aaaccctagccttgctt

SEQ ID NO: 4117382 - DNA, 16 bp, Homo sapiens
aaacccttgctttcct

SEQ ID NO: 4117383 - DNA, 16 bp, Homo sapiens
aaaccgcctagtttac

SEQ ID NO: 4117384 - DNA, 19 bp, Homo sapiens
aaaccgtcccctccttccc

SEQ ID NO: 4117385 - DNA, 21 bp, Homo sapiens
aaaccgtgtttgtctcttctg

SEQ ID NO: 4117386 - DNA, 16 bp, Homo sapiens
aaacctagtactgccc

SEQ ID NO: 4117387 - DNA, 17 bp, Homo sapiens
aaacctcaaaatgtcta

SEQ ID NO: 4117388 - DNA, 11 bp, Homo sapiens
aaacctcaggg

SEQ ID NO: 4117389 - DNA, 23 bp, Homo sapiens
aaacctcagggctgtcccagccc

SEQ ID NO: 4117390 - DNA, 12 bp, Homo sapiens
aaacctgaagac

SEQ ID NO: 4117391 - DNA, 15 bp, Homo sapiens
aaacctgaagactga

SEQ ID NO: 4117392 - DNA, 21 bp, Homo sapiens
aaacctggaatctacaagcca

SEQ ID NO: 4117393 - DNA, 15 bp, Homo sapiens
aaacctggatgtcac

SEQ ID NO: 4117394 - DNA, 19 bp, Homo sapiens
aaacctgtagatgcagaaa

SEQ ID NO: 4117395 - DNA, 20 bp, Homo sapiens
aaacctgtatttttgttagt

SEQ ID NO: 4117396 - DNA, 20 bp, Homo sapiens
aaacctgtttttttttcatt

SEQ ID NO: 4117397 - DNA, 16 bp, Homo sapiens
aaaccttattgtacct

SEQ ID NO: 4117398 - DNA, 14 bp, Homo sapiens
aaaccttctgcctt

SEQ ID NO: 4117399 - DNA, 16 bp, Homo sapiens
aaaccttgctctcctc

SEQ ID NO: 4117400 - DNA, 19 bp, Homo sapiens
aaacgacaaatctgtctgc

SEQ ID NO: 4117401 - DNA, 13 bp, Homo sapiens
aaacgctacctct

SEQ ID NO: 4117402 - DNA, 16 bp, Homo sapiens
aaacgctacctctctg

SEQ ID NO: 4117403 - DNA, 16 bp, Homo sapiens
aaacgctcctttgtgt

SEQ ID NO: 4117404 - DNA, 18 bp, Homo sapiens
aaacgtcttattgtggta

SEQ ID NO: 4117405 - DNA, 21 bp, Homo sapiens
aaacgttttattgtgttttta

SEQ ID NO: 4117406 - DNA, 15 bp, Homo sapiens
aaactaaaaatattc

SEQ ID NO: 4117407 - DNA, 20 bp, Homo sapiens
aaactaaataatgaataaac

SEQ ID NO: 4117408 - DNA, 15 bp, Homo sapiens
aaactaacagataag

SEQ ID NO: 4117409 - DNA, 20 bp, Homo sapiens
aaactaaccttgaataaggc

SEQ ID NO: 4117410 - DNA, 14 bp, Homo sapiens
aaactactctttga

SEQ ID NO: 4117411 - DNA, 17 bp, Homo sapiens
aaactaggtaatgtttt

SEQ ID NO: 4117412 - DNA, 22 bp, Homo sapiens
aaactaggtaatgttttgtata

SEQ ID NO: 4117413 - DNA, 15 bp, Homo sapiens
aaactataaatacaa

SEQ ID NO: 4117414 - DNA, 16 bp, Homo sapiens
aaactatggttcccaa

SEQ ID NO: 4117415 - DNA, 20 bp, Homo sapiens
aaactattggaaagtactcc

SEQ ID NO: 4117416 - DNA, 11 bp, Homo sapiens
aaactatttat

SEQ ID NO: 4117417 - DNA, 16 bp, Homo sapiens
aaactcaccatgtaaa

SEQ ID NO: 4117418 - DNA, 20 bp, Homo sapiens
aaactcactgctcaagaaga

SEQ ID NO: 4117419 - DNA, 18 bp, Homo sapiens
aaactcagggacagagcc

SEQ ID NO: 4117420 - DNA, 17 bp, Homo sapiens
aaactcatattacaaaa

SEQ ID NO: 4117421 - DNA, 15 bp, Homo sapiens
aaactcattttgctt

SEQ ID NO: 4117422 - DNA, 12 bp, Homo sapiens
aaactcattttt

SEQ ID NO: 4117423 - DNA, 14 bp, Homo sapiens
aaactctttaactt

SEQ ID NO: 4117424 - DNA, 15 bp, Homo sapiens
aaactgaatattttg

SEQ ID NO: 4117425 - DNA, 17 bp, Homo sapiens
aaactgaatattttgga

SEQ ID NO: 4117426 - DNA, 13 bp, Homo sapiens
aaactgactatca

SEQ ID NO: 4117427 - DNA, 11 bp, Homo sapiens
aaactgatttc

SEQ ID NO: 4117428 - DNA, 17 bp, Homo sapiens
aaactgatttcttcaga

SEQ ID NO: 4117429 - DNA, 17 bp, Homo sapiens
aaactgcaatagagact

SEQ ID NO: 4117430 - DNA, 15 bp, Homo sapiens
aaactggaataagaa

SEQ ID NO: 4117431 - DNA, 11 bp, Homo sapiens
aaactggagtc

SEQ ID NO: 4117432 - DNA, 15 bp, Homo sapiens
aaactggagtctgga

SEQ ID NO: 4117433 - DNA, 19 bp, Homo sapiens
aaactggattaaaacaatt

SEQ ID NO: 4117434 - DNA, 14 bp, Homo sapiens
aaactggcttcccc

SEQ ID NO: 4117435 - DNA, 19 bp, Homo sapiens
aaactgggattaagaaacc

SEQ ID NO: 4117436 - DNA, 13 bp, Homo sapiens
aaactgtatgctc

SEQ ID NO: 4117437 - DNA, 15 bp, Homo sapiens
aaactgtatgctcac

SEQ ID NO: 4117438 - DNA, 18 bp, Homo sapiens
aaactgtctttaaaagag

SEQ ID NO: 4117439 - DNA, 14 bp, Homo sapiens
aaacttactatttt

SEQ ID NO: 4117440 - DNA, 16 bp, Homo sapiens
aaacttagaggaaaat

SEQ ID NO: 4117441 - DNA, 21 bp, Homo sapiens
aaacttagtgcggacaagttt

SEQ ID NO: 4117442 - DNA, 20 bp, Homo sapiens
aaacttataaatcatattga

SEQ ID NO: 4117443 - DNA, 20 bp, Homo sapiens
aaacttatgctgatttattt

SEQ ID NO: 4117444 - DNA, 17 bp, Homo sapiens
aaacttcacatttatgt

SEQ ID NO: 4117445 - DNA, 20 bp, Homo sapiens
aaacttcagttgatcttctt

SEQ ID NO: 4117446 - DNA, 21 bp, Homo sapiens
aaacttccctttctgcttgtg

SEQ ID NO: 4117447 - DNA, 13 bp, Homo sapiens
aaacttcttaaat

SEQ ID NO: 4117448 - DNA, 20 bp, Homo sapiens
aaacttcttaaatatctttt

SEQ ID NO: 4117449 - DNA, 13 bp, Homo sapiens
aaacttgaagcag

SEQ ID NO: 4117450 - DNA, 22 bp, Homo sapiens
aaacttgatgtgttatctctta

SEQ ID NO: 4117451 - DNA, 16 bp, Homo sapiens
aaacttgctgagctgt

SEQ ID NO: 4117452 - DNA, 24 bp, Homo sapiens
aaacttgtggcctcaagcaatcca

SEQ ID NO: 4117453 - DNA, 12 bp, Homo sapiens
aaactttaaaaa

SEQ ID NO: 4117454 - DNA, 20 bp, Homo sapiens
aaactttaaaaaatatttat

SEQ ID NO: 4117455 - DNA, 21 bp, Homo sapiens
aaactttaaaaaatatttatt

SEQ ID NO: 4117456 - DNA, 18 bp, Homo sapiens
aaactttagggtaaaaat

SEQ ID NO: 4117457 - DNA, 16 bp, Homo sapiens
aaactttatacattag

SEQ ID NO: 4117458 - DNA, 16 bp, Homo sapiens
aaactttggcctttgt

SEQ ID NO: 4117459 - DNA, 16 bp, Homo sapiens
aaacttttttatatct

SEQ ID NO: 4117460 - DNA, 17 bp, Homo sapiens
aaacttttttatatctt

SEQ ID NO: 4117461 - DNA, 16 bp, Homo sapiens
aaagaaaagaaaattt

SEQ ID NO: 4117462 - DNA, 23 bp, Homo sapiens
aaagaaaagataaagatgatcta

SEQ ID NO: 4117463 - DNA, 12 bp, Homo sapiens
aaagaaaatttt

SEQ ID NO: 4117464 - DNA, 12 bp, Homo sapiens
aaagaaatattt

SEQ ID NO: 4117465 - DNA, 18 bp, Homo sapiens
aaagaaatcatgtccata

SEQ ID NO: 4117466 - DNA, 15 bp, Homo sapiens
aaagaacagtaaaca

SEQ ID NO: 4117467 - DNA, 14 bp, Homo sapiens
aaagaactgtactg

SEQ ID NO: 4117468 - DNA, 12 bp, Homo sapiens
aaagaacttact

SEQ ID NO: 4117469 - DNA, 17 bp, Homo sapiens
aaagaacttactgatta

SEQ ID NO: 4117470 - DNA, 18 bp, Homo sapiens
aaagaacttgatttgcat

SEQ ID NO: 4117471 - DNA, 12 bp, Homo sapiens
aaagaagagaca

SEQ ID NO: 4117472 - DNA, 15 bp, Homo sapiens
aaagaagatgttgaa

SEQ ID NO: 4117473 - DNA, 12 bp, Homo sapiens
aaagaagccata

SEQ ID NO: 4117474 - DNA, 12 bp, Homo sapiens
aaagaaggaagt

SEQ ID NO: 4117475 - DNA, 19 bp, Homo sapiens
aaagaagtgtccgagaact

SEQ ID NO: 4117476 - DNA, 21 bp, Homo sapiens
aaagaagtgtccgagaactaa

SEQ ID NO: 4117477 - DNA, 24 bp, Homo sapiens
aaagaagtgtggggattttcactg

SEQ ID NO: 4117478 - DNA, 13 bp, Homo sapiens
aaagaagttactt

SEQ ID NO: 4117479 - DNA, 16 bp, Homo sapiens
aaagaagttactttgt

SEQ ID NO: 4117480 - DNA, 19 bp, Homo sapiens
aaagaagttactttgtaat

SEQ ID NO: 4117481 - DNA, 15 bp, Homo sapiens
aaagaatacagaaag

SEQ ID NO: 4117482 - DNA, 18 bp, Homo sapiens
aaagaatactatttccaa

SEQ ID NO: 4117483 - DNA, 23 bp, Homo sapiens
aaagaattatttttgtgtttcta

SEQ ID NO: 4117484 - DNA, 20 bp, Homo sapiens
aaagacattgattcagcctg

SEQ ID NO: 4117485 - DNA, 17 bp, Homo sapiens
aaagactatctaaatgt

SEQ ID NO: 4117486 - DNA, 15 bp, Homo sapiens
aaagactggttttct

SEQ ID NO: 4117487 - DNA, 15 bp, Homo sapiens
aaagactgtacaaag

SEQ ID NO: 4117488 - DNA, 18 bp, Homo sapiens
aaagacttagtatatttt

SEQ ID NO: 4117489 - DNA, 20 bp, Homo sapiens
aaagacttagtatattttct

SEQ ID NO: 4117490 - DNA, 17 bp, Homo sapiens
aaagacttgagacaatg

SEQ ID NO: 4117491 - DNA, 19 bp, Homo sapiens
aaagacttgtaatattttt

SEQ ID NO: 4117492 - DNA, 16 bp, Homo sapiens
aaagagaaaccgggag

SEQ ID NO: 4117493 - DNA, 19 bp, Homo sapiens
aaagagaattagattatat

SEQ ID NO: 4117494 - DNA, 21 bp, Homo sapiens
aaagagacagtgatattggaa

SEQ ID NO: 4117495 - DNA, 11 bp, Homo sapiens
aaagagagaga

SEQ ID NO: 4117496 - DNA, 20 bp, Homo sapiens
aaagagagagagagaaaaaa

SEQ ID NO: 4117497 - DNA, 18 bp, Homo sapiens
aaagagataataagatta

SEQ ID NO: 4117498 - DNA, 14 bp, Homo sapiens
aaagagatacagag

SEQ ID NO: 4117499 - DNA, 20 bp, Homo sapiens
aaagagatattttaaaatga

SEQ ID NO: 4117500 - DNA, 18 bp, Homo sapiens
aaagagcacttactgtaa

SEQ ID NO: 4117501 - DNA, 20 bp, Homo sapiens
aaagaggcagttgcccagcc

SEQ ID NO: 4117502 - DNA, 21 bp, Homo sapiens
aaagaggctctggacagcaga

SEQ ID NO: 4117503 - DNA, 16 bp, Homo sapiens
aaagaggctgaaagag

SEQ ID NO: 4117504 - DNA, 14 bp, Homo sapiens
aaagaggctgcccc

SEQ ID NO: 4117505 - DNA, 18 bp, Homo sapiens
aaagagtagaattgcatt

SEQ ID NO: 4117506 - DNA, 22 bp, Homo sapiens
aaagagtgggctgcatctggga

SEQ ID NO: 4117507 - DNA, 23 bp, Homo sapiens
aaagagttctggaaaagaactgt

SEQ ID NO: 4117508 - DNA, 24 bp, Homo sapiens
aaagagttctggaaaagaactgtt

SEQ ID NO: 4117509 - DNA, 15 bp, Homo sapiens
aaagataaagatgat

SEQ ID NO: 4117510 - DNA, 20 bp, Homo sapiens
aaagataacaagatctttca

SEQ ID NO: 4117511 - DNA, 20 bp, Homo sapiens
aaagataatttatttcaata

SEQ ID NO: 4117512 - DNA, 16 bp, Homo sapiens
aaagatacgactttat

SEQ ID NO: 4117513 - DNA, 22 bp, Homo sapiens
aaagatagagattgtttttaga

SEQ ID NO: 4117514 - DNA, 16 bp, Homo sapiens
aaagatcaaaataaaa

SEQ ID NO: 4117515 - DNA, 17 bp, Homo sapiens
aaagatcaaaataaaaa

SEQ ID NO: 4117516 - DNA, 18 bp, Homo sapiens
aaagatctgtcctcagcc

SEQ ID NO: 4117517 - DNA, 19 bp, Homo sapiens
aaagatctgtcctcagcct

SEQ ID NO: 4117518 - DNA, 12 bp, Homo sapiens
aaagatgaagtt

SEQ ID NO: 4117519 - DNA, 21 bp, Homo sapiens
aaagatggataaactgagcct

SEQ ID NO: 4117520 - DNA, 16 bp, Homo sapiens
aaagatggatgtgctt

SEQ ID NO: 4117521 - DNA, 22 bp, Homo sapiens
aaagattagcaaggtcatttct

SEQ ID NO: 4117522 - DNA, 15 bp, Homo sapiens
aaagattttaatcaa

SEQ ID NO: 4117523 - DNA, 19 bp, Homo sapiens
aaagattttatttatggaa

SEQ ID NO: 4117524 - DNA, 14 bp, Homo sapiens
aaagattttgtttt

SEQ ID NO: 4117525 - DNA, 13 bp, Homo sapiens
aaagcaaatgaga

SEQ ID NO: 4117526 - DNA, 18 bp, Homo sapiens
aaagcaagggagaaaaga

SEQ ID NO: 4117527 - DNA, 15 bp, Homo sapiens
aaagcaataaatgaa

SEQ ID NO: 4117528 - DNA, 18 bp, Homo sapiens
aaagcaatattttggagt

SEQ ID NO: 4117529 - DNA, 20 bp, Homo sapiens
aaagcaatctgattcagcat

SEQ ID NO: 4117530 - DNA, 13 bp, Homo sapiens
aaagcacatacat

SEQ ID NO: 4117531 - DNA, 15 bp, Homo sapiens
aaagcacatacatta

SEQ ID NO: 4117532 - DNA, 20 bp, Homo sapiens
aaagcacatacattaaaact

SEQ ID NO: 4117533 - DNA, 13 bp, Homo sapiens
aaagcacttttgt

SEQ ID NO: 4117534 - DNA, 16 bp, Homo sapiens
aaagcagaattttaat

SEQ ID NO: 4117535 - DNA, 21 bp, Homo sapiens
aaagcagaattttaatgtgaa

SEQ ID NO: 4117536 - DNA, 22 bp, Homo sapiens
aaagcagatacctcaccctgct

SEQ ID NO: 4117537 - DNA, 21 bp, Homo sapiens
aaagcagcattctggagggga

SEQ ID NO: 4117538 - DNA, 18 bp, Homo sapiens
aaagcagggaatttctat

SEQ ID NO: 4117539 - DNA, 14 bp, Homo sapiens
aaagcataaaaaca

SEQ ID NO: 4117540 - DNA, 16 bp, Homo sapiens
aaagcataaaaacatt

SEQ ID NO: 4117541 - DNA, 15 bp, Homo sapiens
aaagcataaatgcaa

SEQ ID NO: 4117542 - DNA, 20 bp, Homo sapiens
aaagcatagatgttttggta

SEQ ID NO: 4117543 - DNA, 13 bp, Homo sapiens
aaagcatccatgt

SEQ ID NO: 4117544 - DNA, 16 bp, Homo sapiens
aaagcatgatgggaaa

SEQ ID NO: 4117545 - DNA, 20 bp, Homo sapiens
aaagcatgatgggaaaatat

SEQ ID NO: 4117546 - DNA, 22 bp, Homo sapiens
aaagcatgatgggaaaatattt

SEQ ID NO: 4117547 - DNA, 14 bp, Homo sapiens
aaagcattgctgtt

SEQ ID NO: 4117548 - DNA, 15 bp, Homo sapiens
aaagcatttataaat

SEQ ID NO: 4117549 - DNA, 14 bp, Homo sapiens
aaagcatttatcat

SEQ ID NO: 4117550 - DNA, 16 bp, Homo sapiens
aaagcatttttcaata

SEQ ID NO: 4117551 - DNA, 17 bp, Homo sapiens
aaagccacattatttct

SEQ ID NO: 4117552 - DNA, 12 bp, Homo sapiens
aaagccacctct

SEQ ID NO: 4117553 - DNA, 23 bp, Homo sapiens
aaagccatatcatgctaaaattc

SEQ ID NO: 4117554 - DNA, 18 bp, Homo sapiens
aaagcctgcaatttcata

SEQ ID NO: 4117555 - DNA, 17 bp, Homo sapiens
aaagcctgggtgacatt

SEQ ID NO: 4117556 - DNA, 12 bp, Homo sapiens
aaagccttgtgt

SEQ ID NO: 4117557 - DNA, 14 bp, Homo sapiens
aaagccttgtgtat

SEQ ID NO: 4117558 - DNA, 22 bp, Homo sapiens
aaagccttgtgtatatttgtat

SEQ ID NO: 4117559 - DNA, 17 bp, Homo sapiens
aaagcctttagtatcag

SEQ ID NO: 4117560 - DNA, 14 bp, Homo sapiens
aaagcggtccctgt

SEQ ID NO: 4117561 - DNA, 18 bp, Homo sapiens
aaagcgttggatgtagca

SEQ ID NO: 4117562 - DNA, 19 bp, Homo sapiens
aaagcgtttctttacttct

SEQ ID NO: 4117563 - DNA, 22 bp, Homo sapiens
aaagctagtgtacctcctctca

SEQ ID NO: 4117564 - DNA, 23 bp, Homo sapiens
aaagctagtgtacctcctctcag

SEQ ID NO: 4117565 - DNA, 17 bp, Homo sapiens
aaagctatataagacaa

SEQ ID NO: 4117566 - DNA, 18 bp, Homo sapiens
aaagctattagccaggat

SEQ ID NO: 4117567 - DNA, 16 bp, Homo sapiens
aaagctcctgtcctcc

SEQ ID NO: 4117568 - DNA, 21 bp, Homo sapiens
aaagctctgttccatgcaact

SEQ ID NO: 4117569 - DNA, 17 bp, Homo sapiens
aaagctgagaactcctg

SEQ ID NO: 4117570 - DNA, 18 bp, Homo sapiens
aaagctgagaactcctga

SEQ ID NO: 4117571 - DNA, 17 bp, Homo sapiens
aaagctgccatttccct

SEQ ID NO: 4117572 - DNA, 23 bp, Homo sapiens
aaagctgtggccagcttgttatt

SEQ ID NO: 4117573 - DNA, 14 bp, Homo sapiens
aaagctgttcttcc

SEQ ID NO: 4117574 - DNA, 11 bp, Homo sapiens
aaagcttcccc

SEQ ID NO: 4117575 - DNA, 13 bp, Homo sapiens
aaagcttccctcc

SEQ ID NO: 4117576 - DNA, 16 bp, Homo sapiens
aaagcttccctccctg

SEQ ID NO: 4117577 - DNA, 12 bp, Homo sapiens
aaagcttcttaa

SEQ ID NO: 4117578 - DNA, 23 bp, Homo sapiens
aaagcttcttaattaatttgatt

SEQ ID NO: 4117579 - DNA, 15 bp, Homo sapiens
aaagcttgttaagat

SEQ ID NO: 4117580 - DNA, 23 bp, Homo sapiens
aaagctttcctgccccaggcctg

SEQ ID NO: 4117581 - DNA, 15 bp, Homo sapiens
aaagctttgttttgt

SEQ ID NO: 4117582 - DNA, 11 bp, Homo sapiens
aaaggaaaaat

SEQ ID NO: 4117583 - DNA, 15 bp, Homo sapiens
aaaggaaaacctgaa

SEQ ID NO: 4117584 - DNA, 20 bp, Homo sapiens
aaaggaaagtcaagaagaat

SEQ ID NO: 4117585 - DNA, 19 bp, Homo sapiens
aaaggaagagctaataaat

SEQ ID NO: 4117586 - DNA, 12 bp, Homo sapiens
aaaggaagccaa

SEQ ID NO: 4117587 - DNA, 14 bp, Homo sapiens
aaaggacaggagga

SEQ ID NO: 4117588 - DNA, 14 bp, Homo sapiens
aaaggacatcagca

SEQ ID NO: 4117589 - DNA, 15 bp, Homo sapiens
aaaggacatcagcaa

SEQ ID NO: 4117590 - DNA, 16 bp, Homo sapiens
aaaggacatcagcaaa

SEQ ID NO: 4117591 - DNA, 21 bp, Homo sapiens
aaaggacccttgagtaagtga

SEQ ID NO: 4117592 - DNA, 22 bp, Homo sapiens
aaaggacccttgagtaagtgaa

SEQ ID NO: 4117593 - DNA, 13 bp, Homo sapiens
aaaggaggctggc

SEQ ID NO: 4117594 - DNA, 23 bp, Homo sapiens
aaaggcaagttaagagaaacttt

SEQ ID NO: 4117595 - DNA, 18 bp, Homo sapiens
aaaggcagagaagttctc

SEQ ID NO: 4117596 - DNA, 14 bp, Homo sapiens
aaaggcagctgttg

SEQ ID NO: 4117597 - DNA, 22 bp, Homo sapiens
aaaggcagctgttgtctcttct

SEQ ID NO: 4117598 - DNA, 18 bp, Homo sapiens
aaaggcatcccagcctgg

SEQ ID NO: 4117599 - DNA, 22 bp, Homo sapiens
aaagggacacccctacacacac

SEQ ID NO: 4117600 - DNA, 23 bp, Homo sapiens
aaagggacacccctacacacacc

SEQ ID NO: 4117601 - DNA, 22 bp, Homo sapiens
aaagggacagcatgccccttgg

SEQ ID NO: 4117602 - DNA, 18 bp, Homo sapiens
aaagggagctatcaggaa

SEQ ID NO: 4117603 - DNA, 20 bp, Homo sapiens
aaagggcagggcatctcctg

SEQ ID NO: 4117604 - DNA, 16 bp, Homo sapiens
aaaggggagagcctgc

SEQ ID NO: 4117605 - DNA, 14 bp, Homo sapiens
aaaggggggagggg

SEQ ID NO: 4117606 - DNA, 18 bp, Homo sapiens
aaaggggggagggggagg

SEQ ID NO: 4117607 - DNA, 20 bp, Homo sapiens
aaaggggttggggtgacagt

SEQ ID NO: 4117608 - DNA, 15 bp, Homo sapiens
aaagggtcaaacctg

SEQ ID NO: 4117609 - DNA, 14 bp, Homo sapiens
aaaggtcctgccct

SEQ ID NO: 4117610 - DNA, 16 bp, Homo sapiens
aaaggtcttaaataat

SEQ ID NO: 4117611 - DNA, 21 bp, Homo sapiens
aaaggtgagtttgagctgcct

SEQ ID NO: 4117612 - DNA, 18 bp, Homo sapiens
aaaggtggcaatgcttaa

SEQ ID NO: 4117613 - DNA, 18 bp, Homo sapiens
aaaggtggtgaggcaata

SEQ ID NO: 4117614 - DNA, 15 bp, Homo sapiens
aaaggtgtatttaaa

SEQ ID NO: 4117615 - DNA, 19 bp, Homo sapiens
aaaggtgtgagactgggaa

SEQ ID NO: 4117616 - DNA, 23 bp, Homo sapiens
aaaggttttggatcttgaatgtg

SEQ ID NO: 4117617 - DNA, 13 bp, Homo sapiens
aaaggttttgtat

SEQ ID NO: 4117618 - DNA, 17 bp, Homo sapiens
aaaggttttgtattttt

SEQ ID NO: 4117619 - DNA, 19 bp, Homo sapiens
aaaggtttttaaattgttt

SEQ ID NO: 4117620 - DNA, 12 bp, Homo sapiens
aaagtaaagcta

SEQ ID NO: 4117621 - DNA, 22 bp, Homo sapiens
aaagtaaatacaagactgttgt

SEQ ID NO: 4117622 - DNA, 20 bp, Homo sapiens
aaagtaactcatttgttaaa

SEQ ID NO: 4117623 - DNA, 14 bp, Homo sapiens
aaagtaaggtgcag

SEQ ID NO: 4117624 - DNA, 12 bp, Homo sapiens
aaagtaagttaa

SEQ ID NO: 4117625 - DNA, 15 bp, Homo sapiens
aaagtaagttaataa

SEQ ID NO: 4117626 - DNA, 21 bp, Homo sapiens
aaagtaagttaataatgtatt

SEQ ID NO: 4117627 - DNA, 17 bp, Homo sapiens
aaagtacactctgctgt

SEQ ID NO: 4117628 - DNA, 18 bp, Homo sapiens
aaagtacttgagtgtaat

SEQ ID NO: 4117629 - DNA, 18 bp, Homo sapiens
aaagtagaagcatgtttg

SEQ ID NO: 4117630 - DNA, 12 bp, Homo sapiens
aaagtagggggc

SEQ ID NO: 4117631 - DNA, 13 bp, Homo sapiens
aaagtatatatag

SEQ ID NO: 4117632 - DNA, 23 bp, Homo sapiens
aaagtatcactctaaaaaacatt

SEQ ID NO: 4117633 - DNA, 10 bp, Homo sapiens
aaagtatttt

SEQ ID NO: 4117634 - DNA, 13 bp, Homo sapiens
aaagtattttgaa

SEQ ID NO: 4117635 - DNA, 14 bp, Homo sapiens
aaagtattttgaag

SEQ ID NO: 4117636 - DNA, 16 bp, Homo sapiens
aaagtattttgaagtt

SEQ ID NO: 4117637 - DNA, 17 bp, Homo sapiens
aaagtattttgaagttt

SEQ ID NO: 4117638 - DNA, 18 bp, Homo sapiens
aaagtattttgaagttta

SEQ ID NO: 4117639 - DNA, 22 bp, Homo sapiens
aaagtcacttactattgttgct

SEQ ID NO: 4117640 - DNA, 19 bp, Homo sapiens
aaagtccctccctgcctga

SEQ ID NO: 4117641 - DNA, 23 bp, Homo sapiens
aaagtccctccctgcctgagggc

SEQ ID NO: 4117642 - DNA, 20 bp, Homo sapiens
aaagtctaaacaaaattgca

SEQ ID NO: 4117643 - DNA, 18 bp, Homo sapiens
aaagtcttttttttcctg

SEQ ID NO: 4117644 - DNA, 15 bp, Homo sapiens
aaagtgaatgaaaga

SEQ ID NO: 4117645 - DNA, 15 bp, Homo sapiens
aaagtgaatttgaat

SEQ ID NO: 4117646 - DNA, 11 bp, Homo sapiens
aaagtgacttt

SEQ ID NO: 4117647 - DNA, 21 bp, Homo sapiens
aaagtgactttaaaagaaaat

SEQ ID NO: 4117648 - DNA, 12 bp, Homo sapiens
aaagtgatttct

SEQ ID NO: 4117649 - DNA, 12 bp, Homo sapiens
aaagtgcccagc

SEQ ID NO: 4117650 - DNA, 12 bp, Homo sapiens
aaagtgctggga

SEQ ID NO: 4117651 - DNA, 17 bp, Homo sapiens
aaagtgggcttgattct

SEQ ID NO: 4117652 - DNA, 18 bp, Homo sapiens
aaagtgtcaactctttgt

SEQ ID NO: 4117653 - DNA, 14 bp, Homo sapiens
aaagtgtgagcagt

SEQ ID NO: 4117654 - DNA, 20 bp, Homo sapiens
aaagtgtgagctcttccctt

SEQ ID NO: 4117655 - DNA, 14 bp, Homo sapiens
aaagtgtgttgttg

SEQ ID NO: 4117656 - DNA, 11 bp, Homo sapiens
aaagtgttact

SEQ ID NO: 4117657 - DNA, 17 bp, Homo sapiens
aaagtgttttattttca

SEQ ID NO: 4117658 - DNA, 18 bp, Homo sapiens
aaagtgttttattttcaa

SEQ ID NO: 4117659 - DNA, 13 bp, Homo sapiens
aaagtgttttttc

SEQ ID NO: 4117660 - DNA, 16 bp, Homo sapiens
aaagttaaacattgaa

SEQ ID NO: 4117661 - DNA, 17 bp, Homo sapiens
aaagttacagaaatact

SEQ ID NO: 4117662 - DNA, 20 bp, Homo sapiens
aaagttactaggtaacttca

SEQ ID NO: 4117663 - DNA, 21 bp, Homo sapiens
aaagttactaggtaacttcat

SEQ ID NO: 4117664 - DNA, 12 bp, Homo sapiens
aaagttcaggga

SEQ ID NO: 4117665 - DNA, 12 bp, Homo sapiens
aaagttgcacat

SEQ ID NO: 4117666 - DNA, 19 bp, Homo sapiens
aaagttgcagatgtattga

SEQ ID NO: 4117667 - DNA, 22 bp, Homo sapiens
aaagttgcagatgtattgactg

SEQ ID NO: 4117668 - DNA, 13 bp, Homo sapiens
aaagttgttgtaa

SEQ ID NO: 4117669 - DNA, 23 bp, Homo sapiens
aaagtttaaatgtattttacata

SEQ ID NO: 4117670 - DNA, 18 bp, Homo sapiens
aaagtttcctaggatgtc

SEQ ID NO: 4117671 - DNA, 13 bp, Homo sapiens
aaagttttgaaaa

SEQ ID NO: 4117672 - DNA, 19 bp, Homo sapiens
aaagttttgaaaagctatt

SEQ ID NO: 4117673 - DNA, 13 bp, Homo sapiens
aaagttttgtaaa

SEQ ID NO: 4117674 - DNA, 18 bp, Homo sapiens
aaagttttgtaaaagaaa

SEQ ID NO: 4117675 - DNA, 14 bp, Homo sapiens
aaataaaaataaat

SEQ ID NO: 4117676 - DNA, 14 bp, Homo sapiens
aaataaaaatattg

SEQ ID NO: 4117677 - DNA, 17 bp, Homo sapiens
aaataaaaatggcaaat

SEQ ID NO: 4117678 - DNA, 14 bp, Homo sapiens
aaataaaactgaat

SEQ ID NO: 4117679 - DNA, 18 bp, Homo sapiens
aaataaaaggaagccaaa

SEQ ID NO: 4117680 - DNA, 14 bp, Homo sapiens
aaataaaccactgt

SEQ ID NO: 4117681 - DNA, 13 bp, Homo sapiens
aaataaagaagta

SEQ ID NO: 4117682 - DNA, 14 bp, Homo sapiens
aaataaagaagtat

SEQ ID NO: 4117683 - DNA, 20 bp, Homo sapiens
aaataaagcttgcaacaaaa

SEQ ID NO: 4117684 - DNA, 13 bp, Homo sapiens
aaataaagtatat

SEQ ID NO: 4117685 - DNA, 20 bp, Homo sapiens
aaataaagtttgcttagaaa

SEQ ID NO: 4117686 - DNA, 20 bp, Homo sapiens
aaataaatagctatatccat

SEQ ID NO: 4117687 - DNA, 22 bp, Homo sapiens
aaataaattcctacaacttaat

SEQ ID NO: 4117688 - DNA, 15 bp, Homo sapiens
aaataacaaaatgga

SEQ ID NO: 4117689 - DNA, 19 bp, Homo sapiens
aaataacaatgttaaggaa

SEQ ID NO: 4117690 - DNA, 13 bp, Homo sapiens
aaataacacacat

SEQ ID NO: 4117691 - DNA, 21 bp, Homo sapiens
aaataacacacatataaacat

SEQ ID NO: 4117692 - DNA, 14 bp, Homo sapiens
aaataagagatttg

SEQ ID NO: 4117693 - DNA, 22 bp, Homo sapiens
aaataagcaggtggatctattt

SEQ ID NO: 4117694 - DNA, 22 bp, Homo sapiens
aaataaggaagagggctgagct

SEQ ID NO: 4117695 - DNA, 15 bp, Homo sapiens
aaataagtatttata

SEQ ID NO: 4117696 - DNA, 18 bp, Homo sapiens
aaataatcaagattttag

SEQ ID NO: 4117697 - DNA, 13 bp, Homo sapiens
aaataatgctgca

SEQ ID NO: 4117698 - DNA, 17 bp, Homo sapiens
aaataatgcttcagata

SEQ ID NO: 4117699 - DNA, 17 bp, Homo sapiens
aaataatgtagttttgt

SEQ ID NO: 4117700 - DNA, 22 bp, Homo sapiens
aaataatgtagttttgtttatg

SEQ ID NO: 4117701 - DNA, 13 bp, Homo sapiens
aaataattctaaa

SEQ ID NO: 4117702 - DNA, 13 bp, Homo sapiens
aaataattttaat

SEQ ID NO: 4117703 - DNA, 18 bp, Homo sapiens
aaatacaaagtaaataca

SEQ ID NO: 4117704 - DNA, 19 bp, Homo sapiens
aaatacaaagtaaatacaa

SEQ ID NO: 4117705 - DNA, 20 bp, Homo sapiens
aaatacaaagtaaatacaag

SEQ ID NO: 4117706 - DNA, 19 bp, Homo sapiens
aaatacaaatctgtataaa

SEQ ID NO: 4117707 - DNA, 21 bp, Homo sapiens
aaatacaagactgttgtgatc

SEQ ID NO: 4117708 - DNA, 14 bp, Homo sapiens
aaatacaataaact

SEQ ID NO: 4117709 - DNA, 16 bp, Homo sapiens
aaatacaatcctgttt

SEQ ID NO: 4117710 - DNA, 22 bp, Homo sapiens
aaatacaccacctcactcctgt

SEQ ID NO: 4117711 - DNA, 23 bp, Homo sapiens
aaatacaccacctcactcctgtt

SEQ ID NO: 4117712 - DNA, 16 bp, Homo sapiens
aaatacagacactaag

SEQ ID NO: 4117713 - DNA, 12 bp, Homo sapiens
aaatactaaaag

SEQ ID NO: 4117714 - DNA, 16 bp, Homo sapiens
aaatactattgcctca

SEQ ID NO: 4117715 - DNA, 14 bp, Homo sapiens
aaatacttcatgag

SEQ ID NO: 4117716 - DNA, 17 bp, Homo sapiens
aaatactttaaaggaaa

SEQ ID NO: 4117717 - DNA, 15 bp, Homo sapiens
aaatagaaaatggtc

SEQ ID NO: 4117718 - DNA, 12 bp, Homo sapiens
aaatagaaattt

SEQ ID NO: 4117719 - DNA, 19 bp, Homo sapiens
aaatagaaattttgtaaga

SEQ ID NO: 4117720 - DNA, 16 bp, Homo sapiens
aaatagaaccactatg

SEQ ID NO: 4117721 - DNA, 12 bp, Homo sapiens
aaatagaactat

SEQ ID NO: 4117722 - DNA, 24 bp, Homo sapiens
aaatagaactatctgcattatcta

SEQ ID NO: 4117723 - DNA, 16 bp, Homo sapiens
aaatagaagagagagg

SEQ ID NO: 4117724 - DNA, 19 bp, Homo sapiens
aaatagagtatatgcactt

SEQ ID NO: 4117725 - DNA, 14 bp, Homo sapiens
aaatagatacaaat

SEQ ID NO: 4117726 - DNA, 12 bp, Homo sapiens
aaatagcaaaga

SEQ ID NO: 4117727 - DNA, 18 bp, Homo sapiens
aaatagccttcaaaaaga

SEQ ID NO: 4117728 - DNA, 18 bp, Homo sapiens
aaatagcgctgtttttgt

SEQ ID NO: 4117729 - DNA, 16 bp, Homo sapiens
aaatagctatatccat

SEQ ID NO: 4117730 - DNA, 24 bp, Homo sapiens
aaataggagaggatgagagcccag

SEQ ID NO: 4117731 - DNA, 23 bp, Homo sapiens
aaatagtctctttaaaaggaaag

SEQ ID NO: 4117732 - DNA, 22 bp, Homo sapiens
aaatagtgacataatatattct

SEQ ID NO: 4117733 - DNA, 12 bp, Homo sapiens
aaatagtgttcc

SEQ ID NO: 4117734 - DNA, 11 bp, Homo sapiens
aaatataattc

SEQ ID NO: 4117735 - DNA, 12 bp, Homo sapiens
aaatataattct

SEQ ID NO: 4117736 - DNA, 13 bp, Homo sapiens
aaatataattctg

SEQ ID NO: 4117737 - DNA, 13 bp, Homo sapiens
aaatataattgta

SEQ ID NO: 4117738 - DNA, 17 bp, Homo sapiens
aaatatagattagaaaa

SEQ ID NO: 4117739 - DNA, 12 bp, Homo sapiens
aaatatatacta

SEQ ID NO: 4117740 - DNA, 23 bp, Homo sapiens
aaatatatatgtgtgtgtatgtt

SEQ ID NO: 4117741 - DNA, 16 bp, Homo sapiens
aaatatattcaggagt

SEQ ID NO: 4117742 - DNA, 20 bp, Homo sapiens
aaatatatttaagataatta

SEQ ID NO: 4117743 - DNA, 22 bp, Homo sapiens
aaatatatttaagataattata

SEQ ID NO: 4117744 - DNA, 13 bp, Homo sapiens
aaatatcattgta

SEQ ID NO: 4117745 - DNA, 18 bp, Homo sapiens
aaatatcatttatttttt

SEQ ID NO: 4117746 - DNA, 16 bp, Homo sapiens
aaatatcgtgtgtgtg

SEQ ID NO: 4117747 - DNA, 12 bp, Homo sapiens
aaatatctgaaa

SEQ ID NO: 4117748 - DNA, 18 bp, Homo sapiens
aaatatctgaaaatgtat

SEQ ID NO: 4117749 - DNA, 19 bp, Homo sapiens
aaatatcttttatgtttga

SEQ ID NO: 4117750 - DNA, 18 bp, Homo sapiens
aaatatgcagtgatatgg

SEQ ID NO: 4117751 - DNA, 15 bp, Homo sapiens
aaatatgctaatttg

SEQ ID NO: 4117752 - DNA, 18 bp, Homo sapiens
aaatatggaacttacatt

SEQ ID NO: 4117753 - DNA, 21 bp, Homo sapiens
aaatatggaacttacattgtt

SEQ ID NO: 4117754 - DNA, 21 bp, Homo sapiens
aaatatgtgagattttttatt

SEQ ID NO: 4117755 - DNA, 23 bp, Homo sapiens
aaatatgtgagattttttattgc

SEQ ID NO: 4117756 - DNA, 19 bp, Homo sapiens
aaatatgttttttagatca

SEQ ID NO: 4117757 - DNA, 21 bp, Homo sapiens
aaatatgttttttagatcaaa

SEQ ID NO: 4117758 - DNA, 19 bp, Homo sapiens
aaatattagttaatggatt

SEQ ID NO: 4117759 - DNA, 14 bp, Homo sapiens
aaatattatgtgtt

SEQ ID NO: 4117760 - DNA, 23 bp, Homo sapiens
aaatattattgtggaaatgaata

SEQ ID NO: 4117761 - DNA, 18 bp, Homo sapiens
aaatattctatatgaatt

SEQ ID NO: 4117762 - DNA, 17 bp, Homo sapiens
aaatattgaggctttgt

SEQ ID NO: 4117763 - DNA, 22 bp, Homo sapiens
aaatattgtttctgcattcatt

SEQ ID NO: 4117764 - DNA, 14 bp, Homo sapiens
aaatatttaaacct

SEQ ID NO: 4117765 - DNA, 14 bp, Homo sapiens
aaatatttagtcta

SEQ ID NO: 4117766 - DNA, 12 bp, Homo sapiens
aaatatttatct

SEQ ID NO: 4117767 - DNA, 16 bp, Homo sapiens
aaatatttattaaata

SEQ ID NO: 4117768 - DNA, 23 bp, Homo sapiens
aaatatttattaaataaaatcaa

SEQ ID NO: 4117769 - DNA, 15 bp, Homo sapiens
aaatatttcagatat

SEQ ID NO: 4117770 - DNA, 14 bp, Homo sapiens
aaatatttccttaa

SEQ ID NO: 4117771 - DNA, 23 bp, Homo sapiens
aaatatttgaatgaaaacatttt

SEQ ID NO: 4117772 - DNA, 19 bp, Homo sapiens
aaatattttgataataaat

SEQ ID NO: 4117773 - DNA, 15 bp, Homo sapiens
aaatattttttgcaa

SEQ ID NO: 4117774 - DNA, 18 bp, Homo sapiens
aaatattttttgcaagtt

SEQ ID NO: 4117775 - DNA, 16 bp, Homo sapiens
aaatcaaaacaagtga

SEQ ID NO: 4117776 - DNA, 12 bp, Homo sapiens
aaatcaagtatt

SEQ ID NO: 4117777 - DNA, 18 bp, Homo sapiens
aaatcaagtatttgggaa

SEQ ID NO: 4117778 - DNA, 17 bp, Homo sapiens
aaatcaatacactagtt

SEQ ID NO: 4117779 - DNA, 14 bp, Homo sapiens
aaatcacacattca

SEQ ID NO: 4117780 - DNA, 17 bp, Homo sapiens
aaatcacatctcacctc

SEQ ID NO: 4117781 - DNA, 18 bp, Homo sapiens
aaatcactatctttctga

SEQ ID NO: 4117782 - DNA, 23 bp, Homo sapiens
aaatcagaataaattaatattgt

SEQ ID NO: 4117783 - DNA, 18 bp, Homo sapiens
aaatcagagagcaaggca

SEQ ID NO: 4117784 - DNA, 16 bp, Homo sapiens
aaatcaggtgttttaa

SEQ ID NO: 4117785 - DNA, 15 bp, Homo sapiens
aaatcagtaagaggt

SEQ ID NO: 4117786 - DNA, 18 bp, Homo sapiens
aaatcatgtatgttatga

SEQ ID NO: 4117787 - DNA, 14 bp, Homo sapiens
aaatcatttcagta

SEQ ID NO: 4117788 - DNA, 13 bp, Homo sapiens
aaatccattgttt

SEQ ID NO: 4117789 - DNA, 14 bp, Homo sapiens
aaatccctggatca

SEQ ID NO: 4117790 - DNA, 17 bp, Homo sapiens
aaatccctgtttaatat

SEQ ID NO: 4117791 - DNA, 13 bp, Homo sapiens
aaatccttccaaa

SEQ ID NO: 4117792 - DNA, 16 bp, Homo sapiens
aaatcctttactgtta

SEQ ID NO: 4117793 - DNA, 19 bp, Homo sapiens
aaatcctttttctttataa

SEQ ID NO: 4117794 - DNA, 13 bp, Homo sapiens
aaatcgatgcagt

SEQ ID NO: 4117795 - DNA, 23 bp, Homo sapiens
aaatcggatctggggctctggga

SEQ ID NO: 4117796 - DNA, 15 bp, Homo sapiens
aaatctaaatctatt

SEQ ID NO: 4117797 - DNA, 22 bp, Homo sapiens
aaatctacagatcctttttcca

SEQ ID NO: 4117798 - DNA, 13 bp, Homo sapiens
aaatctattcaga

SEQ ID NO: 4117799 - DNA, 19 bp, Homo sapiens
aaatctattcagacaagca

SEQ ID NO: 4117800 - DNA, 15 bp, Homo sapiens
aaatctattctgtgt

SEQ ID NO: 4117801 - DNA, 12 bp, Homo sapiens
aaatctatttat

SEQ ID NO: 4117802 - DNA, 19 bp, Homo sapiens
aaatctatttattaatatt

SEQ ID NO: 4117803 - DNA, 17 bp, Homo sapiens
aaatctcaccccatccc

SEQ ID NO: 4117804 - DNA, 20 bp, Homo sapiens
aaatctcccattttggaatt

SEQ ID NO: 4117805 - DNA, 13 bp, Homo sapiens
aaatctcttctgt

SEQ ID NO: 4117806 - DNA, 17 bp, Homo sapiens
aaatctcttctttgctg

SEQ ID NO: 4117807 - DNA, 16 bp, Homo sapiens
aaatctcttgcttgtc

SEQ ID NO: 4117808 - DNA, 18 bp, Homo sapiens
aaatctcttgcttgtcat

SEQ ID NO: 4117809 - DNA, 19 bp, Homo sapiens
aaatctcttgcttgtcatt

SEQ ID NO: 4117810 - DNA, 17 bp, Homo sapiens
aaatctgaccaaaacaa

SEQ ID NO: 4117811 - DNA, 14 bp, Homo sapiens
aaatctgacccagt

SEQ ID NO: 4117812 - DNA, 20 bp, Homo sapiens
aaatctgacccagtgccccc

SEQ ID NO: 4117813 - DNA, 22 bp, Homo sapiens
aaatctgctggagtttcatgta

SEQ ID NO: 4117814 - DNA, 22 bp, Homo sapiens
aaatctggtcttgttagaaaac

SEQ ID NO: 4117815 - DNA, 19 bp, Homo sapiens
aaatctgtaacaggtattt

SEQ ID NO: 4117816 - DNA, 23 bp, Homo sapiens
aaatctgtaacaggtattttgtt

SEQ ID NO: 4117817 - DNA, 13 bp, Homo sapiens
aaatctgtataaa

SEQ ID NO: 4117818 - DNA, 14 bp, Homo sapiens
aaatctgtctgctg

SEQ ID NO: 4117819 - DNA, 20 bp, Homo sapiens
aaatctgttctgggctcttt

SEQ ID NO: 4117820 - DNA, 18 bp, Homo sapiens
aaatctgtttgatccctg

SEQ ID NO: 4117821 - DNA, 13 bp, Homo sapiens
aaatcttacaaca

SEQ ID NO: 4117822 - DNA, 14 bp, Homo sapiens
aaatcttctccaga

SEQ ID NO: 4117823 - DNA, 13 bp, Homo sapiens
aaatcttgaaatt

SEQ ID NO: 4117824 - DNA, 13 bp, Homo sapiens
aaatctttcaaaa

SEQ ID NO: 4117825 - DNA, 11 bp, Homo sapiens
aaatcttttac

SEQ ID NO: 4117826 - DNA, 18 bp, Homo sapiens
aaatgaaaacatgtaata

SEQ ID NO: 4117827 - DNA, 12 bp, Homo sapiens
aaatgaaaattg

SEQ ID NO: 4117828 - DNA, 18 bp, Homo sapiens
aaatgaaagcatgtctca

SEQ ID NO: 4117829 - DNA, 15 bp, Homo sapiens
aaatgaaagtgactt

SEQ ID NO: 4117830 - DNA, 23 bp, Homo sapiens
aaatgaaagtgactttaaaagaa

SEQ ID NO: 4117831 - DNA, 12 bp, Homo sapiens
aaatgaacaaaa

SEQ ID NO: 4117832 - DNA, 14 bp, Homo sapiens
aaatgaactgaagt

SEQ ID NO: 4117833 - DNA, 19 bp, Homo sapiens
aaatgaaggttaggattta

SEQ ID NO: 4117834 - DNA, 17 bp, Homo sapiens
aaatgaataatttccca

SEQ ID NO: 4117835 - DNA, 18 bp, Homo sapiens
aaatgaataatttcccaa

SEQ ID NO: 4117836 - DNA, 23 bp, Homo sapiens
aaatgaatctcgttcccaaagaa

SEQ ID NO: 4117837 - DNA, 16 bp, Homo sapiens
aaatgaattttccacg

SEQ ID NO: 4117838 - DNA, 18 bp, Homo sapiens
aaatgaattttccacgca

SEQ ID NO: 4117839 - DNA, 15 bp, Homo sapiens
aaatgaccaatatta

SEQ ID NO: 4117840 - DNA, 13 bp, Homo sapiens
aaatgacttattt

SEQ ID NO: 4117841 - DNA, 20 bp, Homo sapiens
aaatgacttatttctgctct

SEQ ID NO: 4117842 - DNA, 21 bp, Homo sapiens
aaatgagaattttatattcta

SEQ ID NO: 4117843 - DNA, 13 bp, Homo sapiens
aaatgagccatga

SEQ ID NO: 4117844 - DNA, 18 bp, Homo sapiens
aaatgagtaacatttgct

SEQ ID NO: 4117845 - DNA, 18 bp, Homo sapiens
aaatgatgtgtacccaaa

SEQ ID NO: 4117846 - DNA, 16 bp, Homo sapiens
aaatgatgttttcagg

SEQ ID NO: 4117847 - DNA, 15 bp, Homo sapiens
aaatgattcttagtg

SEQ ID NO: 4117848 - DNA, 23 bp, Homo sapiens
aaatgattggaatattacaatac

SEQ ID NO: 4117849 - DNA, 23 bp, Homo sapiens
aaatgatttttacaagttttaaa

SEQ ID NO: 4117850 - DNA, 17 bp, Homo sapiens
aaatgcaaacacacaaa

SEQ ID NO: 4117851 - DNA, 11 bp, Homo sapiens
aaatgcaaggg

SEQ ID NO: 4117852 - DNA, 14 bp, Homo sapiens
aaatgcaataattt

SEQ ID NO: 4117853 - DNA, 15 bp, Homo sapiens
aaatgcaataatttt

SEQ ID NO: 4117854 - DNA, 19 bp, Homo sapiens
aaatgcaggtgtcctgagc

SEQ ID NO: 4117855 - DNA, 14 bp, Homo sapiens
aaatgcatgatttt

SEQ ID NO: 4117856 - DNA, 17 bp, Homo sapiens
aaatgccttaaaatgga

SEQ ID NO: 4117857 - DNA, 18 bp, Homo sapiens
aaatgccttaaaatggaa

SEQ ID NO: 4117858 - DNA, 16 bp, Homo sapiens
aaatgcctttgagaca

SEQ ID NO: 4117859 - DNA, 20 bp, Homo sapiens
aaatgctaggttaattccaa

SEQ ID NO: 4117860 - DNA, 18 bp, Homo sapiens
aaatgctcaaagaaatct

SEQ ID NO: 4117861 - DNA, 16 bp, Homo sapiens
aaatgctctctcaaat

SEQ ID NO: 4117862 - DNA, 15 bp, Homo sapiens
aaatggatactacat

SEQ ID NO: 4117863 - DNA, 13 bp, Homo sapiens
aaatggatactgg

SEQ ID NO: 4117864 - DNA, 14 bp, Homo sapiens
aaatggcaaatgca

SEQ ID NO: 4117865 - DNA, 17 bp, Homo sapiens
aaatgggagacagcctc

SEQ ID NO: 4117866 - DNA, 16 bp, Homo sapiens
aaatggggccagatcc

SEQ ID NO: 4117867 - DNA, 21 bp, Homo sapiens
aaatggggccagatccagcct

SEQ ID NO: 4117868 - DNA, 16 bp, Homo sapiens
aaatggtcgcccagga

SEQ ID NO: 4117869 - DNA, 20 bp, Homo sapiens
aaatggtctctaacatttcc

SEQ ID NO: 4117870 - DNA, 16 bp, Homo sapiens
aaatggtgtacataat

SEQ ID NO: 4117871 - DNA, 15 bp, Homo sapiens
aaatggttcagaatt

SEQ ID NO: 4117872 - DNA, 17 bp, Homo sapiens
aaatggttgatggaaaa

SEQ ID NO: 4117873 - DNA, 15 bp, Homo sapiens
aaatggtttttgcct

SEQ ID NO: 4117874 - DNA, 19 bp, Homo sapiens
aaatgtaaaaataataatt

SEQ ID NO: 4117875 - DNA, 15 bp, Homo sapiens
aaatgtaaatattct

SEQ ID NO: 4117876 - DNA, 17 bp, Homo sapiens
aaatgtaaatattctat

SEQ ID NO: 4117877 - DNA, 18 bp, Homo sapiens
aaatgtaaatttataaat

SEQ ID NO: 4117878 - DNA, 18 bp, Homo sapiens
aaatgtaatttagaaact

SEQ ID NO: 4117879 - DNA, 16 bp, Homo sapiens
aaatgtaggtatgaat

SEQ ID NO: 4117880 - DNA, 14 bp, Homo sapiens
aaatgtatcttatt

SEQ ID NO: 4117881 - DNA, 15 bp, Homo sapiens
aaatgtattcaaata

SEQ ID NO: 4117882 - DNA, 14 bp, Homo sapiens
aaatgtattttgaa

SEQ ID NO: 4117883 - DNA, 19 bp, Homo sapiens
aaatgtcagtgtttgggaa

SEQ ID NO: 4117884 - DNA, 22 bp, Homo sapiens
aaatgtcctccagaagcctctg

SEQ ID NO: 4117885 - DNA, 16 bp, Homo sapiens
aaatgtctattaaggt

SEQ ID NO: 4117886 - DNA, 17 bp, Homo sapiens
aaatgtctcagttttca

SEQ ID NO: 4117887 - DNA, 15 bp, Homo sapiens
aaatgtcttaatttt

SEQ ID NO: 4117888 - DNA, 15 bp, Homo sapiens
aaatgtctttgtaag

SEQ ID NO: 4117889 - DNA, 16 bp, Homo sapiens
aaatgtctttgtaagt

SEQ ID NO: 4117890 - DNA, 17 bp, Homo sapiens
aaatgtctttgtaagtc

SEQ ID NO: 4117891 - DNA, 10 bp, Homo sapiens
aaatgtgaat

SEQ ID NO: 4117892 - DNA, 12 bp, Homo sapiens
aaatgtgaattt

SEQ ID NO: 4117893 - DNA, 13 bp, Homo sapiens
aaatgtgaatttt

SEQ ID NO: 4117894 - DNA, 22 bp, Homo sapiens
aaatgtgatgcttataataaag

SEQ ID NO: 4117895 - DNA, 23 bp, Homo sapiens
aaatgtgatgcttataataaaga

SEQ ID NO: 4117896 - DNA, 21 bp, Homo sapiens
aaatgtggagaagagtgccct

SEQ ID NO: 4117897 - DNA, 23 bp, Homo sapiens
aaatgttagtattttaatcctgt

SEQ ID NO: 4117898 - DNA, 20 bp, Homo sapiens
aaatgttattttttaattat

SEQ ID NO: 4117899 - DNA, 15 bp, Homo sapiens
aaatgttctgtttgc

SEQ ID NO: 4117900 - DNA, 11 bp, Homo sapiens
aaatgttcttt

SEQ ID NO: 4117901 - DNA, 19 bp, Homo sapiens
aaatgttgagaatcccaaa

SEQ ID NO: 4117902 - DNA, 19 bp, Homo sapiens
aaatgttggatttataaat

SEQ ID NO: 4117903 - DNA, 21 bp, Homo sapiens
aaatgttggatttataaatgc

SEQ ID NO: 4117904 - DNA, 23 bp, Homo sapiens
aaatgttgttcattattggaggg

SEQ ID NO: 4117905 - DNA, 20 bp, Homo sapiens
aaatgtttatgttttcaact

SEQ ID NO: 4117906 - DNA, 22 bp, Homo sapiens
aaatgttttataagttcacaaa

SEQ ID NO: 4117907 - DNA, 21 bp, Homo sapiens
aaatgtttttctgccagggag

SEQ ID NO: 4117908 - DNA, 16 bp, Homo sapiens
aaattaaacacaaagt

SEQ ID NO: 4117909 - DNA, 18 bp, Homo sapiens
aaattaaacataaaacaa

SEQ ID NO: 4117910 - DNA, 23 bp, Homo sapiens
aaattaaatctgtccctgagagt

SEQ ID NO: 4117911 - DNA, 14 bp, Homo sapiens
aaattaagtagaac

SEQ ID NO: 4117912 - DNA, 15 bp, Homo sapiens
aaattaagtagaaca

SEQ ID NO: 4117913 - DNA, 14 bp, Homo sapiens
aaattaattttact

SEQ ID NO: 4117914 - DNA, 19 bp, Homo sapiens
aaattacaaaagagcagca

SEQ ID NO: 4117915 - DNA, 13 bp, Homo sapiens
aaattacaactaa

SEQ ID NO: 4117916 - DNA, 20 bp, Homo sapiens
aaattagaaaatgttattta

SEQ ID NO: 4117917 - DNA, 16 bp, Homo sapiens
aaattagccaggcttg

SEQ ID NO: 4117918 - DNA, 15 bp, Homo sapiens
aaattagccgggcgt

SEQ ID NO: 4117919 - DNA, 18 bp, Homo sapiens
aaattagctgtgtgaaat

SEQ ID NO: 4117920 - DNA, 19 bp, Homo sapiens
aaattagctgtgtgaaata

SEQ ID NO: 4117921 - DNA, 14 bp, Homo sapiens
aaattaggaataaa

SEQ ID NO: 4117922 - DNA, 16 bp, Homo sapiens
aaattaggaataaata

SEQ ID NO: 4117923 - DNA, 16 bp, Homo sapiens
aaattaggactgtata

SEQ ID NO: 4117924 - DNA, 12 bp, Homo sapiens
aaattaggcagt

SEQ ID NO: 4117925 - DNA, 23 bp, Homo sapiens
aaattatgtataaacataagttg

SEQ ID NO: 4117926 - DNA, 17 bp, Homo sapiens
aaattatgtatgtttac

SEQ ID NO: 4117927 - DNA, 20 bp, Homo sapiens
aaattatgtgacattttaca

SEQ ID NO: 4117928 - DNA, 21 bp, Homo sapiens
aaattatgttttaaacacatg

SEQ ID NO: 4117929 - DNA, 16 bp, Homo sapiens
aaattattataagcat

SEQ ID NO: 4117930 - DNA, 17 bp, Homo sapiens
aaattcaagaaaataaa

SEQ ID NO: 4117931 - DNA, 20 bp, Homo sapiens
aaattcaagaaaataaaact

SEQ ID NO: 4117932 - DNA, 18 bp, Homo sapiens
aaattcacaaacttttat

SEQ ID NO: 4117933 - DNA, 15 bp, Homo sapiens
aaattcagagtcctt

SEQ ID NO: 4117934 - DNA, 21 bp, Homo sapiens
aaattcagcaaaccattttta

SEQ ID NO: 4117935 - DNA, 18 bp, Homo sapiens
aaattcagtttttgtatc

SEQ ID NO: 4117936 - DNA, 19 bp, Homo sapiens
aaattccagcaataagaaa

SEQ ID NO: 4117937 - DNA, 15 bp, Homo sapiens
aaattccattatctt

SEQ ID NO: 4117938 - DNA, 18 bp, Homo sapiens
aaattccattatcttatg

SEQ ID NO: 4117939 - DNA, 24 bp, Homo sapiens
aaattcctaagaatcagagtagaa

SEQ ID NO: 4117940 - DNA, 14 bp, Homo sapiens
aaattcgctttcta

SEQ ID NO: 4117941 - DNA, 16 bp, Homo sapiens
aaattctatgttaaat

SEQ ID NO: 4117942 - DNA, 22 bp, Homo sapiens
aaattctatgttaaatactgtg

SEQ ID NO: 4117943 - DNA, 12 bp, Homo sapiens
aaattctgattc

SEQ ID NO: 4117944 - DNA, 14 bp, Homo sapiens
aaattcttcacatg

SEQ ID NO: 4117945 - DNA, 17 bp, Homo sapiens
aaattgaagagagatat

SEQ ID NO: 4117946 - DNA, 23 bp, Homo sapiens
aaattgaatcagtataaacaaag

SEQ ID NO: 4117947 - DNA, 20 bp, Homo sapiens
aaattgacacaagtggacct

SEQ ID NO: 4117948 - DNA, 15 bp, Homo sapiens
aaattgcaacatatt

SEQ ID NO: 4117949 - DNA, 17 bp, Homo sapiens
aaattgcataaagcata

SEQ ID NO: 4117950 - DNA, 17 bp, Homo sapiens
aaattgctatgttacta

SEQ ID NO: 4117951 - DNA, 21 bp, Homo sapiens
aaattgctatgttactatttt

SEQ ID NO: 4117952 - DNA, 13 bp, Homo sapiens
aaattgctctgtt

SEQ ID NO: 4117953 - DNA, 14 bp, Homo sapiens
aaattgctgtgctt

SEQ ID NO: 4117954 - DNA, 22 bp, Homo sapiens
aaattggttggagaatttaggt

SEQ ID NO: 4117955 - DNA, 19 bp, Homo sapiens
aaattgtcacctgcttctc

SEQ ID NO: 4117956 - DNA, 18 bp, Homo sapiens
aaattgtctaaaatgtca

SEQ ID NO: 4117957 - DNA, 19 bp, Homo sapiens
aaattgtgaactcattgct

SEQ ID NO: 4117958 - DNA, 12 bp, Homo sapiens
aaatttaaaatt

SEQ ID NO: 4117959 - DNA, 16 bp, Homo sapiens
aaatttaaaattacgt

SEQ ID NO: 4117960 - DNA, 19 bp, Homo sapiens
aaatttaactctggtttct

SEQ ID NO: 4117961 - DNA, 12 bp, Homo sapiens
aaatttaagcat

SEQ ID NO: 4117962 - DNA, 16 bp, Homo sapiens
aaatttaagtgcgtgt

SEQ ID NO: 4117963 - DNA, 13 bp, Homo sapiens
aaatttatcaaag

SEQ ID NO: 4117964 - DNA, 22 bp, Homo sapiens
aaatttatttcaatattagcaa

SEQ ID NO: 4117965 - DNA, 14 bp, Homo sapiens
aaatttattttaat

SEQ ID NO: 4117966 - DNA, 22 bp, Homo sapiens
aaatttattttaatgtaaagaa

SEQ ID NO: 4117967 - DNA, 23 bp, Homo sapiens
aaatttccagtacctttgtcaca

SEQ ID NO: 4117968 - DNA, 11 bp, Homo sapiens
aaatttcttat

SEQ ID NO: 4117969 - DNA, 20 bp, Homo sapiens
aaatttgaatgggtccattt

SEQ ID NO: 4117970 - DNA, 13 bp, Homo sapiens
aaatttgtaagtt

SEQ ID NO: 4117971 - DNA, 14 bp, Homo sapiens
aaatttgtaagttt

SEQ ID NO: 4117972 - DNA, 16 bp, Homo sapiens
aaatttgtaagtttca

SEQ ID NO: 4117973 - DNA, 20 bp, Homo sapiens
aaatttgtaagtttcaggtg

SEQ ID NO: 4117974 - DNA, 18 bp, Homo sapiens
aaatttgttataatgaat

SEQ ID NO: 4117975 - DNA, 12 bp, Homo sapiens
aaatttgtttaa

SEQ ID NO: 4117976 - DNA, 12 bp, Homo sapiens
aaattttgcaaa

SEQ ID NO: 4117977 - DNA, 18 bp, Homo sapiens
aaattttggccaaagtgt

SEQ ID NO: 4117978 - DNA, 17 bp, Homo sapiens
aaatttttaggcaaaga

SEQ ID NO: 4117979 - DNA, 15 bp, Homo sapiens
aaatttttatttttc

SEQ ID NO: 4117980 - DNA, 18 bp, Homo sapiens
aaatttttcagatgcttc

SEQ ID NO: 4117981 - DNA, 20 bp, Homo sapiens
aaatttttgtagtagcgttt

SEQ ID NO: 4117982 - DNA, 16 bp, Homo sapiens
aacaaaaagcttcccc

SEQ ID NO: 4117983 - DNA, 11 bp, Homo sapiens
aacaaaaataa

SEQ ID NO: 4117984 - DNA, 13 bp, Homo sapiens
aacaaaaattagg

SEQ ID NO: 4117985 - DNA, 13 bp, Homo sapiens
aacaaaagatgaa

SEQ ID NO: 4117986 - DNA, 15 bp, Homo sapiens
aacaaaagcaagact

SEQ ID NO: 4117987 - DNA, 21 bp, Homo sapiens
aacaaaagcgacccattcaga

SEQ ID NO: 4117988 - DNA, 17 bp, Homo sapiens
aacaaaatctaaaacaa

SEQ ID NO: 4117989 - DNA, 12 bp, Homo sapiens
aacaaaattgca

SEQ ID NO: 4117990 - DNA, 16 bp, Homo sapiens
aacaaaattgcaattt

SEQ ID NO: 4117991 - DNA, 19 bp, Homo sapiens
aacaaaatttgtttgaaat

SEQ ID NO: 4117992 - DNA, 14 bp, Homo sapiens
aacaaacagatgct

SEQ ID NO: 4117993 - DNA, 13 bp, Homo sapiens
aacaaactaaaaa

SEQ ID NO: 4117994 - DNA, 13 bp, Homo sapiens
aacaaagaaatat

SEQ ID NO: 4117995 - DNA, 19 bp, Homo sapiens
aacaaaggcaagttaagag

SEQ ID NO: 4117996 - DNA, 20 bp, Homo sapiens
aacaaaggcaagttaagaga

SEQ ID NO: 4117997 - DNA, 21 bp, Homo sapiens
aacaaaggcaagttaagagaa

SEQ ID NO: 4117998 - DNA, 12 bp, Homo sapiens
aacaaatatgca

SEQ ID NO: 4117999 - DNA, 20 bp, Homo sapiens
aacaaattatgttacatctg

SEQ ID NO: 4118000 - DNA, 13 bp, Homo sapiens
aacaacaattggt

SEQ ID NO: 4118001 - DNA, 16 bp, Homo sapiens
aacaactaggcttcag

SEQ ID NO: 4118002 - DNA, 12 bp, Homo sapiens
aacaagaagaaa

SEQ ID NO: 4118003 - DNA, 23 bp, Homo sapiens
aacaagaataaaggcagctgttg

SEQ ID NO: 4118004 - DNA, 12 bp, Homo sapiens
aacaagaatgca

SEQ ID NO: 4118005 - DNA, 19 bp, Homo sapiens
aacaagaccccgtctcaaa

SEQ ID NO: 4118006 - DNA, 17 bp, Homo sapiens
aacaagatctttcagga

SEQ ID NO: 4118007 - DNA, 19 bp, Homo sapiens
aacaagatctttcaggaaa

SEQ ID NO: 4118008 - DNA, 17 bp, Homo sapiens
aacaataactactgtgt

SEQ ID NO: 4118009 - DNA, 16 bp, Homo sapiens
aacaatacaaatggat

SEQ ID NO: 4118010 - DNA, 17 bp, Homo sapiens
aacaatctggaagaaaa

SEQ ID NO: 4118011 - DNA, 11 bp, Homo sapiens
aacaatgttaa

SEQ ID NO: 4118012 - DNA, 18 bp, Homo sapiens
aacaatgttaaggaaact

SEQ ID NO: 4118013 - DNA, 12 bp, Homo sapiens
aacaattcatgc

SEQ ID NO: 4118014 - DNA, 17 bp, Homo sapiens
aacaattcatgcctttc

SEQ ID NO: 4118015 - DNA, 17 bp, Homo sapiens
aacaattggtaaaactc

SEQ ID NO: 4118016 - DNA, 24 bp, Homo sapiens
aacaattggtaaaactcactgtga

SEQ ID NO: 4118017 - DNA, 20 bp, Homo sapiens
aacaattgtgtagccttttt

SEQ ID NO: 4118018 - DNA, 13 bp, Homo sapiens
aacaattttaatg

SEQ ID NO: 4118019 - DNA, 17 bp, Homo sapiens
aacaattttttttttcc

SEQ ID NO: 4118020 - DNA, 12 bp, Homo sapiens
aacacaagcaaa

SEQ ID NO: 4118021 - DNA, 13 bp, Homo sapiens
aacacaagcaaaa

SEQ ID NO: 4118022 - DNA, 18 bp, Homo sapiens
aacacaagctggaagcac

SEQ ID NO: 4118023 - DNA, 13 bp, Homo sapiens
aacacacacacac

SEQ ID NO: 4118024 - DNA, 13 bp, Homo sapiens
aacacacacacta

SEQ ID NO: 4118025 - DNA, 12 bp, Homo sapiens
aacacactgaaa

SEQ ID NO: 4118026 - DNA, 19 bp, Homo sapiens
aacacagaaacctttttaa

SEQ ID NO: 4118027 - DNA, 22 bp, Homo sapiens
aacacagaggaatttatacctc

SEQ ID NO: 4118028 - DNA, 18 bp, Homo sapiens
aacacagcaattcctcag

SEQ ID NO: 4118029 - DNA, 24 bp, Homo sapiens
aacacagctgttcttctgttctgc

SEQ ID NO: 4118030 - DNA, 13 bp, Homo sapiens
aacacaggcagct

SEQ ID NO: 4118031 - DNA, 17 bp, Homo sapiens
aacacaggcagctttct

SEQ ID NO: 4118032 - DNA, 16 bp, Homo sapiens
aacacaggccaccctg

SEQ ID NO: 4118033 - DNA, 20 bp, Homo sapiens
aacacatttgattctgtgtg

SEQ ID NO: 4118034 - DNA, 18 bp, Homo sapiens
aacaccaagcacagcagc

SEQ ID NO: 4118035 - DNA, 22 bp, Homo sapiens
aacaccaatcccagggctggct

SEQ ID NO: 4118036 - DNA, 14 bp, Homo sapiens
aacaccacagaaat

SEQ ID NO: 4118037 - DNA, 13 bp, Homo sapiens
aacacccttagaa

SEQ ID NO: 4118038 - DNA, 14 bp, Homo sapiens
aacacccttagaaa

SEQ ID NO: 4118039 - DNA, 20 bp, Homo sapiens
aacaccgcttctgccttttc

SEQ ID NO: 4118040 - DNA, 13 bp, Homo sapiens
aacacctgacaca

SEQ ID NO: 4118041 - DNA, 14 bp, Homo sapiens
aacacctgacacat

SEQ ID NO: 4118042 - DNA, 15 bp, Homo sapiens
aacacctgacagccc

SEQ ID NO: 4118043 - DNA, 15 bp, Homo sapiens
aacacgcacctgcct

SEQ ID NO: 4118044 - DNA, 13 bp, Homo sapiens
aacactaaacatt

SEQ ID NO: 4118045 - DNA, 14 bp, Homo sapiens
aacactaattcata

SEQ ID NO: 4118046 - DNA, 23 bp, Homo sapiens
aacactactgctaaatcctcatg

SEQ ID NO: 4118047 - DNA, 15 bp, Homo sapiens
aacactataaaggtt

SEQ ID NO: 4118048 - DNA, 13 bp, Homo sapiens
aacactatgtata

SEQ ID NO: 4118049 - DNA, 12 bp, Homo sapiens
aacactcttttg

SEQ ID NO: 4118050 - DNA, 19 bp, Homo sapiens
aacactgaggcagccttgg

SEQ ID NO: 4118051 - DNA, 19 bp, Homo sapiens
aacactgcagtttcctgga

SEQ ID NO: 4118052 - DNA, 23 bp, Homo sapiens
aacactggtggaggatggaaagg

SEQ ID NO: 4118053 - DNA, 22 bp, Homo sapiens
aacacttaggactagaagatta

SEQ ID NO: 4118054 - DNA, 22 bp, Homo sapiens
aacagaaagcctgggtgacatt

SEQ ID NO: 4118055 - DNA, 14 bp, Homo sapiens
aacagaacagcttc

SEQ ID NO: 4118056 - DNA, 16 bp, Homo sapiens
aacagaacagcttcag

SEQ ID NO: 4118057 - DNA, 13 bp, Homo sapiens
aacagaacagggt

SEQ ID NO: 4118058 - DNA, 17 bp, Homo sapiens
aacagaactaaatgttc

SEQ ID NO: 4118059 - DNA, 14 bp, Homo sapiens
aacagaagcttcca

SEQ ID NO: 4118060 - DNA, 13 bp, Homo sapiens
aacagaccagtga

SEQ ID NO: 4118061 - DNA, 20 bp, Homo sapiens
aacagatagttgtgttttta

SEQ ID NO: 4118062 - DNA, 14 bp, Homo sapiens
aacagatcttttac

SEQ ID NO: 4118063 - DNA, 21 bp, Homo sapiens
aacagatgcaatgtgctactg

SEQ ID NO: 4118064 - DNA, 13 bp, Homo sapiens
aacagcaagaaat

SEQ ID NO: 4118065 - DNA, 16 bp, Homo sapiens
aacagcagaggttctt

SEQ ID NO: 4118066 - DNA, 17 bp, Homo sapiens
aacagcagaggttcttt

SEQ ID NO: 4118067 - DNA, 12 bp, Homo sapiens
aacagcagtgat

SEQ ID NO: 4118068 - DNA, 13 bp, Homo sapiens
aacagcagtgttc

SEQ ID NO: 4118069 - DNA, 15 bp, Homo sapiens
aacagcagtgttccc

SEQ ID NO: 4118070 - DNA, 19 bp, Homo sapiens
aacagcagtgttctcacag

SEQ ID NO: 4118071 - DNA, 20 bp, Homo sapiens
aacagcattgctttctgaaa

SEQ ID NO: 4118072 - DNA, 23 bp, Homo sapiens
aacagccaagtgtgaccccactg

SEQ ID NO: 4118073 - DNA, 17 bp, Homo sapiens
aacagccatgtccaagt

SEQ ID NO: 4118074 - DNA, 15 bp, Homo sapiens
aacagccgctccaga

SEQ ID NO: 4118075 - DNA, 11 bp, Homo sapiens
aacagccttag

SEQ ID NO: 4118076 - DNA, 16 bp, Homo sapiens
aacagccttagctgcc

SEQ ID NO: 4118077 - DNA, 20 bp, Homo sapiens
aacagcgaagtagcttgctc

SEQ ID NO: 4118078 - DNA, 21 bp, Homo sapiens
aacagcgggagacctgtgcta

SEQ ID NO: 4118079 - DNA, 18 bp, Homo sapiens
aacagctatgggagcccc

SEQ ID NO: 4118080 - DNA, 21 bp, Homo sapiens
aacagctgaggtctcttgagg

SEQ ID NO: 4118081 - DNA, 16 bp, Homo sapiens
aacagctgcattagaa

SEQ ID NO: 4118082 - DNA, 21 bp, Homo sapiens
aacagcttcatgcctttgtaa

SEQ ID NO: 4118083 - DNA, 19 bp, Homo sapiens
aacaggacagagttcacag

SEQ ID NO: 4118084 - DNA, 14 bp, Homo sapiens
aacaggataaccct

SEQ ID NO: 4118085 - DNA, 20 bp, Homo sapiens
aacaggatcagttaactatt

SEQ ID NO: 4118086 - DNA, 12 bp, Homo sapiens
aacaggcccagg

SEQ ID NO: 4118087 - DNA, 21 bp, Homo sapiens
aacaggctcaatattcctgaa

SEQ ID NO: 4118088 - DNA, 18 bp, Homo sapiens
aacaggtaatataaaaag

SEQ ID NO: 4118089 - DNA, 17 bp, Homo sapiens
aacaggtatatactttg

SEQ ID NO: 4118090 - DNA, 18 bp, Homo sapiens
aacaggtatatactttga

SEQ ID NO: 4118091 - DNA, 22 bp, Homo sapiens
aacaggtattttgtttctttta

SEQ ID NO: 4118092 - DNA, 16 bp, Homo sapiens
aacaggtggcaggacc

SEQ ID NO: 4118093 - DNA, 12 bp, Homo sapiens
aacaggtgggct

SEQ ID NO: 4118094 - DNA, 22 bp, Homo sapiens
aacaggtgtggggacacagcag

SEQ ID NO: 4118095 - DNA, 16 bp, Homo sapiens
aacagtagttgtattc

SEQ ID NO: 4118096 - DNA, 12 bp, Homo sapiens
aacagtatttat

SEQ ID NO: 4118097 - DNA, 13 bp, Homo sapiens
aacagtcatttaa

SEQ ID NO: 4118098 - DNA, 14 bp, Homo sapiens
aacagtgccaaatg

SEQ ID NO: 4118099 - DNA, 15 bp, Homo sapiens
aacagtgccaaatgc

SEQ ID NO: 4118100 - DNA, 13 bp, Homo sapiens
aacagtggctggg

SEQ ID NO: 4118101 - DNA, 14 bp, Homo sapiens
aacagtggctgggt

SEQ ID NO: 4118102 - DNA, 16 bp, Homo sapiens
aacagtggctgggtgg

SEQ ID NO: 4118103 - DNA, 13 bp, Homo sapiens
aacagtgtttccc

SEQ ID NO: 4118104 - DNA, 15 bp, Homo sapiens
aacagtgtttcccat

SEQ ID NO: 4118105 - DNA, 17 bp, Homo sapiens
aacagttgcatttagct

SEQ ID NO: 4118106 - DNA, 11 bp, Homo sapiens
aacagttttcc

SEQ ID NO: 4118107 - DNA, 14 bp, Homo sapiens
aacagttttccatg

SEQ ID NO: 4118108 - DNA, 16 bp, Homo sapiens
aacagttttccatgaa

SEQ ID NO: 4118109 - DNA, 17 bp, Homo sapiens
aacagttttccatgaaa

SEQ ID NO: 4118110 - DNA, 23 bp, Homo sapiens
aacataaaaagcagaattttaat

SEQ ID NO: 4118111 - DNA, 16 bp, Homo sapiens
aacataagctaaatca

SEQ ID NO: 4118112 - DNA, 19 bp, Homo sapiens
aacataagctaaatcatat

SEQ ID NO: 4118113 - DNA, 14 bp, Homo sapiens
aacataagttgcat

SEQ ID NO: 4118114 - DNA, 12 bp, Homo sapiens
aacataattaaa

SEQ ID NO: 4118115 - DNA, 13 bp, Homo sapiens
aacatagaaaaat

SEQ ID NO: 4118116 - DNA, 19 bp, Homo sapiens
aacatatatttattgagta

SEQ ID NO: 4118117 - DNA, 14 bp, Homo sapiens
aacatatgatttca

SEQ ID NO: 4118118 - DNA, 19 bp, Homo sapiens
aacatatgtacataaattg

SEQ ID NO: 4118119 - DNA, 13 bp, Homo sapiens
aacatatgttgca

SEQ ID NO: 4118120 - DNA, 19 bp, Homo sapiens
aacatattctgtatgaact

SEQ ID NO: 4118121 - DNA, 23 bp, Homo sapiens
aacatattctgtatgaactttat

SEQ ID NO: 4118122 - DNA, 17 bp, Homo sapiens
aacatcaacctggcaaa

SEQ ID NO: 4118123 - DNA, 19 bp, Homo sapiens
aacatcaatgttcattgta

SEQ ID NO: 4118124 - DNA, 19 bp, Homo sapiens
aacatctttgcgaaaagat

SEQ ID NO: 4118125 - DNA, 20 bp, Homo sapiens
aacatgaacacccttagaaa

SEQ ID NO: 4118126 - DNA, 17 bp, Homo sapiens
aacatgaggttctctct

SEQ ID NO: 4118127 - DNA, 16 bp, Homo sapiens
aacatgcagttcatta

SEQ ID NO: 4118128 - DNA, 22 bp, Homo sapiens
aacatgcagttcattattttgt

SEQ ID NO: 4118129 - DNA, 14 bp, Homo sapiens
aacatggacttgta

SEQ ID NO: 4118130 - DNA, 16 bp, Homo sapiens
aacatggacttgtata

SEQ ID NO: 4118131 - DNA, 23 bp, Homo sapiens
aacatggacttgtatatttgtac

SEQ ID NO: 4118132 - DNA, 16 bp, Homo sapiens
aacatggagctgtcat

SEQ ID NO: 4118133 - DNA, 14 bp, Homo sapiens
aacattaaggaatt

SEQ ID NO: 4118134 - DNA, 18 bp, Homo sapiens
aacattacagttcataat

SEQ ID NO: 4118135 - DNA, 21 bp, Homo sapiens
aacattatagattttcatgtt

SEQ ID NO: 4118136 - DNA, 21 bp, Homo sapiens
aacattcgatctcattcagta

SEQ ID NO: 4118137 - DNA, 18 bp, Homo sapiens
aacattgaagtaatgaat

SEQ ID NO: 4118138 - DNA, 12 bp, Homo sapiens
aacattgtatta

SEQ ID NO: 4118139 - DNA, 21 bp, Homo sapiens
aacatttcccccgagctcttg

SEQ ID NO: 4118140 - DNA, 14 bp, Homo sapiens
aacatttgctgttt

SEQ ID NO: 4118141 - DNA, 11 bp, Homo sapiens
aacatttgttc

SEQ ID NO: 4118142 - DNA, 14 bp, Homo sapiens
aacatttgttcctg

SEQ ID NO: 4118143 - DNA, 23 bp, Homo sapiens
aacattttagctctattgatact

SEQ ID NO: 4118144 - DNA, 19 bp, Homo sapiens
aacattttttttttaaatc

SEQ ID NO: 4118145 - DNA, 13 bp, Homo sapiens
aaccaacaatata

SEQ ID NO: 4118146 - DNA, 13 bp, Homo sapiens
aaccaacatcttt

SEQ ID NO: 4118147 - DNA, 15 bp, Homo sapiens
aaccaacctttaaaa

SEQ ID NO: 4118148 - DNA, 22 bp, Homo sapiens
aaccaacctttaaaattgtcac

SEQ ID NO: 4118149 - DNA, 21 bp, Homo sapiens
aaccaagatctataaagcgat

SEQ ID NO: 4118150 - DNA, 18 bp, Homo sapiens
aaccaagctgagtttcct

SEQ ID NO: 4118151 - DNA, 16 bp, Homo sapiens
aaccaagtcatgtgca

SEQ ID NO: 4118152 - DNA, 20 bp, Homo sapiens
aaccaagtcatgtgcatttc

SEQ ID NO: 4118153 - DNA, 13 bp, Homo sapiens
aaccaagtttatt

SEQ ID NO: 4118154 - DNA, 21 bp, Homo sapiens
aaccaatcttaaacataataa

SEQ ID NO: 4118155 - DNA, 19 bp, Homo sapiens
aaccaatggtgatcctcta

SEQ ID NO: 4118156 - DNA, 22 bp, Homo sapiens
aaccaatggtgatcctctattt

SEQ ID NO: 4118157 - DNA, 23 bp, Homo sapiens
aaccacaaggtccactccctgct

SEQ ID NO: 4118158 - DNA, 13 bp, Homo sapiens
aaccacagctcct

SEQ ID NO: 4118159 - DNA, 14 bp, Homo sapiens
aaccacggaaaaga

SEQ ID NO: 4118160 - DNA, 22 bp, Homo sapiens
aaccacgtggagaaaatcaaac

SEQ ID NO: 4118161 - DNA, 20 bp, Homo sapiens
aaccactgtaaaatgaaatt

SEQ ID NO: 4118162 - DNA, 18 bp, Homo sapiens
aaccagaataaagttctg

SEQ ID NO: 4118163 - DNA, 13 bp, Homo sapiens
aaccagagccccc

SEQ ID NO: 4118164 - DNA, 18 bp, Homo sapiens
aaccagagccccccacaa

SEQ ID NO: 4118165 - DNA, 13 bp, Homo sapiens
aaccagagcctat

SEQ ID NO: 4118166 - DNA, 23 bp, Homo sapiens
aaccagagggtgtggctttccag

SEQ ID NO: 4118167 - DNA, 15 bp, Homo sapiens
aaccaggcctctgct

SEQ ID NO: 4118168 - DNA, 14 bp, Homo sapiens
aaccatatgatact

SEQ ID NO: 4118169 - DNA, 15 bp, Homo sapiens
aaccatgaagacagg

SEQ ID NO: 4118170 - DNA, 15 bp, Homo sapiens
aaccatgactgtgac

SEQ ID NO: 4118171 - DNA, 21 bp, Homo sapiens
aaccattttcccatcatcctt

SEQ ID NO: 4118172 - DNA, 15 bp, Homo sapiens
aacccaagcttagaa

SEQ ID NO: 4118173 - DNA, 18 bp, Homo sapiens
aacccaaggactgaggga

SEQ ID NO: 4118174 - DNA, 19 bp, Homo sapiens
aacccaatgacttccctgc

SEQ ID NO: 4118175 - DNA, 21 bp, Homo sapiens
aacccacagatgtctctgggg

SEQ ID NO: 4118176 - DNA, 16 bp, Homo sapiens
aacccacctctcctgc

SEQ ID NO: 4118177 - DNA, 22 bp, Homo sapiens
aacccagacctgttagcagaca

SEQ ID NO: 4118178 - DNA, 16 bp, Homo sapiens
aacccaggacgcttct

SEQ ID NO: 4118179 - DNA, 19 bp, Homo sapiens
aaccccaccttgccaagct

SEQ ID NO: 4118180 - DNA, 13 bp, Homo sapiens
aaccccagcctga

SEQ ID NO: 4118181 - DNA, 15 bp, Homo sapiens
aaccccagcctgacc

SEQ ID NO: 4118182 - DNA, 18 bp, Homo sapiens
aaccccagcctgacctga

SEQ ID NO: 4118183 - DNA, 12 bp, Homo sapiens
aaccccagctcc

SEQ ID NO: 4118184 - DNA, 18 bp, Homo sapiens
aaccccatgtcctcagca

SEQ ID NO: 4118185 - DNA, 11 bp, Homo sapiens
aacccccacca

SEQ ID NO: 4118186 - DNA, 11 bp, Homo sapiens
aacccccaccc

SEQ ID NO: 4118187 - DNA, 22 bp, Homo sapiens
aaccccgtcgaggggctctcag

SEQ ID NO: 4118188 - DNA, 23 bp, Homo sapiens
aacccgagtcattcgttctgtgg

SEQ ID NO: 4118189 - DNA, 17 bp, Homo sapiens
aaccctacacccagacc

SEQ ID NO: 4118190 - DNA, 13 bp, Homo sapiens
aaccctagccttg

SEQ ID NO: 4118191 - DNA, 16 bp, Homo sapiens
aaccctagccttgctt

SEQ ID NO: 4118192 - DNA, 18 bp, Homo sapiens
aaccctagccttgcttgt

SEQ ID NO: 4118193 - DNA, 17 bp, Homo sapiens
aaccctcaggggaaaac

SEQ ID NO: 4118194 - DNA, 20 bp, Homo sapiens
aaccctggggaaggagccag

SEQ ID NO: 4118195 - DNA, 21 bp, Homo sapiens
aaccctggggaaggagccagt

SEQ ID NO: 4118196 - DNA, 21 bp, Homo sapiens
aacccttaccccttagcctcc

SEQ ID NO: 4118197 - DNA, 23 bp, Homo sapiens
aacccttaccccttagcctccct

SEQ ID NO: 4118198 - DNA, 16 bp, Homo sapiens
aacccttcatcttcct

SEQ ID NO: 4118199 - DNA, 13 bp, Homo sapiens
aacccttgtcagt

SEQ ID NO: 4118200 - DNA, 22 bp, Homo sapiens
aaccgagcaaagatcaaaataa

SEQ ID NO: 4118201 - DNA, 20 bp, Homo sapiens
aaccgataatgcatgaagca

SEQ ID NO: 4118202 - DNA, 19 bp, Homo sapiens
aaccgtgtttgtctcttct

SEQ ID NO: 4118203 - DNA, 21 bp, Homo sapiens
aaccgtgtttgtctcttctgg

SEQ ID NO: 4118204 - DNA, 21 bp, Homo sapiens
aacctaaaataattggttctt

SEQ ID NO: 4118205 - DNA, 15 bp, Homo sapiens
aacctagagaagata

SEQ ID NO: 4118206 - DNA, 17 bp, Homo sapiens
aacctcaaaatgtctaa

SEQ ID NO: 4118207 - DNA, 15 bp, Homo sapiens
aacctcaaagtgact

SEQ ID NO: 4118208 - DNA, 22 bp, Homo sapiens
aacctcagacttaccaggaagc

SEQ ID NO: 4118209 - DNA, 23 bp, Homo sapiens
aacctcagcatttccttccagcc

SEQ ID NO: 4118210 - DNA, 11 bp, Homo sapiens
aacctcagcct

SEQ ID NO: 4118211 - DNA, 13 bp, Homo sapiens
aacctcagcctgg

SEQ ID NO: 4118212 - DNA, 16 bp, Homo sapiens
aacctcagcctggcca

SEQ ID NO: 4118213 - DNA, 14 bp, Homo sapiens
aacctcagctctgg

SEQ ID NO: 4118214 - DNA, 16 bp, Homo sapiens
aacctcagctctggga

SEQ ID NO: 4118215 - DNA, 21 bp, Homo sapiens
aacctcagctctgggagagga

SEQ ID NO: 4118216 - DNA, 19 bp, Homo sapiens
aacctcagggctcccaggg

SEQ ID NO: 4118217 - DNA, 23 bp, Homo sapiens
aacctcagggctgtcccagcccc

SEQ ID NO: 4118218 - DNA, 13 bp, Homo sapiens
aacctcagtgtca

SEQ ID NO: 4118219 - DNA, 19 bp, Homo sapiens
aacctcagtgtcatttatg

SEQ ID NO: 4118220 - DNA, 14 bp, Homo sapiens
aacctccagcctcc

SEQ ID NO: 4118221 - DNA, 19 bp, Homo sapiens
aacctcggcttgtgggctg

SEQ ID NO: 4118222 - DNA, 21 bp, Homo sapiens
aacctcggcttgtgggctggt

SEQ ID NO: 4118223 - DNA, 13 bp, Homo sapiens
aacctctcactcc

SEQ ID NO: 4118224 - DNA, 13 bp, Homo sapiens
aacctctgcctcc

SEQ ID NO: 4118225 - DNA, 14 bp, Homo sapiens
aacctctgtctcat

SEQ ID NO: 4118226 - DNA, 17 bp, Homo sapiens
aacctcttctggctcaa

SEQ ID NO: 4118227 - DNA, 16 bp, Homo sapiens
aacctctttttcctcc

SEQ ID NO: 4118228 - DNA, 18 bp, Homo sapiens
aacctctttttcctcctg

SEQ ID NO: 4118229 - DNA, 20 bp, Homo sapiens
aacctgaaatttattcacat

SEQ ID NO: 4118230 - DNA, 16 bp, Homo sapiens
aacctgcaaaatctgt

SEQ ID NO: 4118231 - DNA, 14 bp, Homo sapiens
aacctgcagaaaca

SEQ ID NO: 4118232 - DNA, 17 bp, Homo sapiens
aacctggatccagcact

SEQ ID NO: 4118233 - DNA, 11 bp, Homo sapiens
aacctggtgct

SEQ ID NO: 4118234 - DNA, 23 bp, Homo sapiens
aacctgtacttcaagttaaagtg

SEQ ID NO: 4118235 - DNA, 19 bp, Homo sapiens
aacctgtagatgcagaaaa

SEQ ID NO: 4118236 - DNA, 23 bp, Homo sapiens
aacctgtagatgcagaaaaagaa

SEQ ID NO: 4118237 - DNA, 15 bp, Homo sapiens
aacctgtcctaagga

SEQ ID NO: 4118238 - DNA, 14 bp, Homo sapiens
aacctgtcttttgg

SEQ ID NO: 4118239 - DNA, 21 bp, Homo sapiens
aacctgttgctgtgtttaatt

SEQ ID NO: 4118240 - DNA, 19 bp, Homo sapiens
aaccttcacatctgtcacg

SEQ ID NO: 4118241 - DNA, 15 bp, Homo sapiens
aaccttcgtcctttt

SEQ ID NO: 4118242 - DNA, 15 bp, Homo sapiens
aaccttgaatgctgc

SEQ ID NO: 4118243 - DNA, 15 bp, Homo sapiens
aaccttgctctcctc

SEQ ID NO: 4118244 - DNA, 11 bp, Homo sapiens
aaccttgctgt

SEQ ID NO: 4118245 - DNA, 23 bp, Homo sapiens
aaccttgttttggacagtttacc

SEQ ID NO: 4118246 - DNA, 11 bp, Homo sapiens
aacctttcccc

SEQ ID NO: 4118247 - DNA, 13 bp, Homo sapiens
aacctttccccca

SEQ ID NO: 4118248 - DNA, 18 bp, Homo sapiens
aacctttccgctgtcgcc

SEQ ID NO: 4118249 - DNA, 12 bp, Homo sapiens
aacctttctgtg

SEQ ID NO: 4118250 - DNA, 11 bp, Homo sapiens
aacctttttct

SEQ ID NO: 4118251 - DNA, 17 bp, Homo sapiens
aaccttttttaagattt

SEQ ID NO: 4118252 - DNA, 20 bp, Homo sapiens
aacctttttttttgaaacag

SEQ ID NO: 4118253 - DNA, 13 bp, Homo sapiens
aacgaagaaaaaa

SEQ ID NO: 4118254 - DNA, 21 bp, Homo sapiens
aacgagccttttcacccttct

SEQ ID NO: 4118255 - DNA, 22 bp, Homo sapiens
aacgagggctgatggaggaaaa

SEQ ID NO: 4118256 - DNA, 16 bp, Homo sapiens
aacgataaaattacaa

SEQ ID NO: 4118257 - DNA, 13 bp, Homo sapiens
aacgatttagaaa

SEQ ID NO: 4118258 - DNA, 20 bp, Homo sapiens
aacgcaaagggctgaaagcc

SEQ ID NO: 4118259 - DNA, 21 bp, Homo sapiens
aacgcatggagtgtgtattgt

SEQ ID NO: 4118260 - DNA, 13 bp, Homo sapiens
aacgccagtctcc

SEQ ID NO: 4118261 - DNA, 13 bp, Homo sapiens
aacgcccctccaa

SEQ ID NO: 4118262 - DNA, 16 bp, Homo sapiens
aacgcccctccaaacc

SEQ ID NO: 4118263 - DNA, 20 bp, Homo sapiens
aacgcccctccaaacctcca

SEQ ID NO: 4118264 - DNA, 22 bp, Homo sapiens
aacgcccctccaaacctccagc

SEQ ID NO: 4118265 - DNA, 13 bp, Homo sapiens
aacgcctccccct

SEQ ID NO: 4118266 - DNA, 18 bp, Homo sapiens
aacgcctcccctgcccca

SEQ ID NO: 4118267 - DNA, 21 bp, Homo sapiens
aacgctaaagagcccttgcct

SEQ ID NO: 4118268 - DNA, 22 bp, Homo sapiens
aacgctaaagagcccttgcctc

SEQ ID NO: 4118269 - DNA, 22 bp, Homo sapiens
aacgcttgtagaactcactctg

SEQ ID NO: 4118270 - DNA, 23 bp, Homo sapiens
aacgcttgtagaactcactctgg

SEQ ID NO: 4118271 - DNA, 20 bp, Homo sapiens
aacggagccccaggcctctg

SEQ ID NO: 4118272 - DNA, 15 bp, Homo sapiens
aacggccccagcttc

SEQ ID NO: 4118273 - DNA, 19 bp, Homo sapiens
aacggccctgcagccagct

SEQ ID NO: 4118274 - DNA, 14 bp, Homo sapiens
aacggctccaggat

SEQ ID NO: 4118275 - DNA, 16 bp, Homo sapiens
aacgggaggctgggca

SEQ ID NO: 4118276 - DNA, 20 bp, Homo sapiens
aacgtgatgatcagctgttt

SEQ ID NO: 4118277 - DNA, 20 bp, Homo sapiens
aacgttttgaactaataaaa

SEQ ID NO: 4118278 - DNA, 23 bp, Homo sapiens
aacgtttttcctttaaaaaaatt

SEQ ID NO: 4118279 - DNA, 18 bp, Homo sapiens
aactaaactcttaccata

SEQ ID NO: 4118280 - DNA, 22 bp, Homo sapiens
aactaaaggacttgatgtacat

SEQ ID NO: 4118281 - DNA, 14 bp, Homo sapiens
aactaaataatgaa

SEQ ID NO: 4118282 - DNA, 16 bp, Homo sapiens
aactaaataatgaata

SEQ ID NO: 4118283 - DNA, 19 bp, Homo sapiens
aactaaatgagattatatg

SEQ ID NO: 4118284 - DNA, 15 bp, Homo sapiens
aactaagaaacttaa

SEQ ID NO: 4118285 - DNA, 12 bp, Homo sapiens
aactaagccagg

SEQ ID NO: 4118286 - DNA, 20 bp, Homo sapiens
aactaagccaggcctggctg

SEQ ID NO: 4118287 - DNA, 22 bp, Homo sapiens
aactaatctattgggttcatta

SEQ ID NO: 4118288 - DNA, 23 bp, Homo sapiens
aactaatttgaatgtggttactt

SEQ ID NO: 4118289 - DNA, 13 bp, Homo sapiens
aactacaaatcaa

SEQ ID NO: 4118290 - DNA, 22 bp, Homo sapiens
aactacatgagaacaaacagat

SEQ ID NO: 4118291 - DNA, 13 bp, Homo sapiens
aactactctttga

SEQ ID NO: 4118292 - DNA, 14 bp, Homo sapiens
aactactctttgat

SEQ ID NO: 4118293 - DNA, 13 bp, Homo sapiens
aactactgtgttc

SEQ ID NO: 4118294 - DNA, 17 bp, Homo sapiens
aactactgtgttcctgg

SEQ ID NO: 4118295 - DNA, 17 bp, Homo sapiens
aactagaatttattcaa

SEQ ID NO: 4118296 - DNA, 12 bp, Homo sapiens
aactagagaagg

SEQ ID NO: 4118297 - DNA, 22 bp, Homo sapiens
aactagcataagtggttttctt

SEQ ID NO: 4118298 - DNA, 23 bp, Homo sapiens
aactaggaaggcacttctgcctg

SEQ ID NO: 4118299 - DNA, 16 bp, Homo sapiens
aactaggtaatgtttt

SEQ ID NO: 4118300 - DNA, 20 bp, Homo sapiens
aactaggtaatgttttgtat

SEQ ID NO: 4118301 - DNA, 21 bp, Homo sapiens
aactaggtaatgttttgtata

SEQ ID NO: 4118302 - DNA, 15 bp, Homo sapiens
aactataaatacaaa

SEQ ID NO: 4118303 - DNA, 16 bp, Homo sapiens
aactataaatacaaat

SEQ ID NO: 4118304 - DNA, 18 bp, Homo sapiens
aactataaatacaaatct

SEQ ID NO: 4118305 - DNA, 13 bp, Homo sapiens
aactatctgcatt

SEQ ID NO: 4118306 - DNA, 16 bp, Homo sapiens
aactatctgcattatc

SEQ ID NO: 4118307 - DNA, 19 bp, Homo sapiens
aactatctggccatattta

SEQ ID NO: 4118308 - DNA, 23 bp, Homo sapiens
aactatgagcttgctcattaatt

SEQ ID NO: 4118309 - DNA, 23 bp, Homo sapiens
aactattcaggagagtagaacag

SEQ ID NO: 4118310 - DNA, 16 bp, Homo sapiens
aactattgcatttata

SEQ ID NO: 4118311 - DNA, 15 bp, Homo sapiens
aactattggaaagta

SEQ ID NO: 4118312 - DNA, 18 bp, Homo sapiens
aactcaaatggggccaga

SEQ ID NO: 4118313 - DNA, 14 bp, Homo sapiens
aactcacaaatgat

SEQ ID NO: 4118314 - DNA, 22 bp, Homo sapiens
aactcacacattcccccaccag

SEQ ID NO: 4118315 - DNA, 21 bp, Homo sapiens
aactcaccatgtaaaagagtc

SEQ ID NO: 4118316 - DNA, 12 bp, Homo sapiens
aactcactctgg

SEQ ID NO: 4118317 - DNA, 13 bp, Homo sapiens
aactcactctggg

SEQ ID NO: 4118318 - DNA, 16 bp, Homo sapiens
aactcactctgggctg

SEQ ID NO: 4118319 - DNA, 22 bp, Homo sapiens
aactcactgctcaagaagacat

SEQ ID NO: 4118320 - DNA, 21 bp, Homo sapiens
aactcagaattatttttaaaa

SEQ ID NO: 4118321 - DNA, 14 bp, Homo sapiens
aactcagatccagg

SEQ ID NO: 4118322 - DNA, 13 bp, Homo sapiens
aactcagatctgt

SEQ ID NO: 4118323 - DNA, 18 bp, Homo sapiens
aactcagttttaactaga

SEQ ID NO: 4118324 - DNA, 18 bp, Homo sapiens
aactcatacctttaaagg

SEQ ID NO: 4118325 - DNA, 19 bp, Homo sapiens
aactcatttttgccataca

SEQ ID NO: 4118326 - DNA, 20 bp, Homo sapiens
aactcatttttgccatacat

SEQ ID NO: 4118327 - DNA, 15 bp, Homo sapiens
aactccacatctgcc

SEQ ID NO: 4118328 - DNA, 17 bp, Homo sapiens
aactccacatctgcctt

SEQ ID NO: 4118329 - DNA, 19 bp, Homo sapiens
aactccaccgaccaactgc

SEQ ID NO: 4118330 - DNA, 16 bp, Homo sapiens
aactccaggccctcct

SEQ ID NO: 4118331 - DNA, 22 bp, Homo sapiens
aactcccagcaacacaagctgg

SEQ ID NO: 4118332 - DNA, 23 bp, Homo sapiens
aactcctaattttaaataatttc

SEQ ID NO: 4118333 - DNA, 22 bp, Homo sapiens
aactcctcacacaccctgaggt

SEQ ID NO: 4118334 - DNA, 18 bp, Homo sapiens
aactcctgagaaatgtta

SEQ ID NO: 4118335 - DNA, 13 bp, Homo sapiens
aactcctgccagg

SEQ ID NO: 4118336 - DNA, 12 bp, Homo sapiens
aactcctgtccc

SEQ ID NO: 4118337 - DNA, 20 bp, Homo sapiens
aactcctgtcccttttccct

SEQ ID NO: 4118338 - DNA, 20 bp, Homo sapiens
aactccttcctggcctgaga

SEQ ID NO: 4118339 - DNA, 17 bp, Homo sapiens
aactctaagtgtttgct

SEQ ID NO: 4118340 - DNA, 16 bp, Homo sapiens
aactctacccctgctc

SEQ ID NO: 4118341 - DNA, 18 bp, Homo sapiens
aactctgaactttggaga

SEQ ID NO: 4118342 - DNA, 16 bp, Homo sapiens
aactctgcattctagt

SEQ ID NO: 4118343 - DNA, 22 bp, Homo sapiens
aactctgttgcaagtgcaataa

SEQ ID NO: 4118344 - DNA, 19 bp, Homo sapiens
aactctttgttatttgaaa

SEQ ID NO: 4118345 - DNA, 21 bp, Homo sapiens
aactgaaaactcccatttacg

SEQ ID NO: 4118346 - DNA, 13 bp, Homo sapiens
aactgaaaatgta

SEQ ID NO: 4118347 - DNA, 17 bp, Homo sapiens
aactgaaaatgtaaatt

SEQ ID NO: 4118348 - DNA, 23 bp, Homo sapiens
aactgaagacaattatcaaccac

SEQ ID NO: 4118349 - DNA, 18 bp, Homo sapiens
aactgaagttctatttat

SEQ ID NO: 4118350 - DNA, 12 bp, Homo sapiens
aactgaatataa

SEQ ID NO: 4118351 - DNA, 23 bp, Homo sapiens
aactgaatattttggaaactgct

SEQ ID NO: 4118352 - DNA, 22 bp, Homo sapiens
aactgaatggaaggtttgtata

SEQ ID NO: 4118353 - DNA, 22 bp, Homo sapiens
aactgacgattcttaatcaaga

SEQ ID NO: 4118354 - DNA, 18 bp, Homo sapiens
aactgactatcataaaat

SEQ ID NO: 4118355 - DNA, 18 bp, Homo sapiens
aactgactttatcctcag

SEQ ID NO: 4118356 - DNA, 10 bp, Homo sapiens
aactgagcct

SEQ ID NO: 4118357 - DNA, 22 bp, Homo sapiens
aactgaggagatgaccagggat

SEQ ID NO: 4118358 - DNA, 13 bp, Homo sapiens
aactgattcataa

SEQ ID NO: 4118359 - DNA, 18 bp, Homo sapiens
aactgcaataacttctga

SEQ ID NO: 4118360 - DNA, 21 bp, Homo sapiens
aactgcaataacttctgacct

SEQ ID NO: 4118361 - DNA, 16 bp, Homo sapiens
aactgcaatagagact

SEQ ID NO: 4118362 - DNA, 22 bp, Homo sapiens
aactgcaatagagactgtagat

SEQ ID NO: 4118363 - DNA, 23 bp, Homo sapiens
aactgcaatagagactgtagatt

SEQ ID NO: 4118364 - DNA, 15 bp, Homo sapiens
aactgcagctctcca

SEQ ID NO: 4118365 - DNA, 14 bp, Homo sapiens
aactgcaggagcag

SEQ ID NO: 4118366 - DNA, 15 bp, Homo sapiens
aactgccaagaaatt

SEQ ID NO: 4118367 - DNA, 14 bp, Homo sapiens
aactgccaagggtg

SEQ ID NO: 4118368 - DNA, 16 bp, Homo sapiens
aactgccaggctgcct

SEQ ID NO: 4118369 - DNA, 24 bp, Homo sapiens
aactgccaggctgcctcctgccct

SEQ ID NO: 4118370 - DNA, 15 bp, Homo sapiens
aactgccctaagccc

SEQ ID NO: 4118371 - DNA, 18 bp, Homo sapiens
aactgccctaagccccca

SEQ ID NO: 4118372 - DNA, 19 bp, Homo sapiens
aactgccctaagcccccag

SEQ ID NO: 4118373 - DNA, 19 bp, Homo sapiens
aactgctaaattctatgtt

SEQ ID NO: 4118374 - DNA, 21 bp, Homo sapiens
aactgctaaattctatgttaa

SEQ ID NO: 4118375 - DNA, 22 bp, Homo sapiens
aactgctaaattctatgttaaa

SEQ ID NO: 4118376 - DNA, 13 bp, Homo sapiens
aactgctgcagat

SEQ ID NO: 4118377 - DNA, 13 bp, Homo sapiens
aactgctttcaag

SEQ ID NO: 4118378 - DNA, 17 bp, Homo sapiens
aactgctttcaagtctg

SEQ ID NO: 4118379 - DNA, 18 bp, Homo sapiens
aactgctttcaagtctga

SEQ ID NO: 4118380 - DNA, 17 bp, Homo sapiens
aactgctttctgttcca

SEQ ID NO: 4118381 - DNA, 21 bp, Homo sapiens
aactggaataagaagcaaata

SEQ ID NO: 4118382 - DNA, 13 bp, Homo sapiens
aactggactcaca

SEQ ID NO: 4118383 - DNA, 16 bp, Homo sapiens
aactggagtctggagt

SEQ ID NO: 4118384 - DNA, 23 bp, Homo sapiens
aactggagttccttatccctctc

SEQ ID NO: 4118385 - DNA, 16 bp, Homo sapiens
aactggattaaaacaa

SEQ ID NO: 4118386 - DNA, 22 bp, Homo sapiens
aactggcaggggagacaggagc

SEQ ID NO: 4118387 - DNA, 23 bp, Homo sapiens
aactggcaggggagacaggagcc

SEQ ID NO: 4118388 - DNA, 13 bp, Homo sapiens
aactggcttcccc

SEQ ID NO: 4118389 - DNA, 13 bp, Homo sapiens
aactgtaaataaa

SEQ ID NO: 4118390 - DNA, 18 bp, Homo sapiens
aactgtacttttaaggca

SEQ ID NO: 4118391 - DNA, 19 bp, Homo sapiens
aactgtaggtatgatctct

SEQ ID NO: 4118392 - DNA, 16 bp, Homo sapiens
aactgtccctcccttg

SEQ ID NO: 4118393 - DNA, 17 bp, Homo sapiens
aactgtccctcccttgc

SEQ ID NO: 4118394 - DNA, 17 bp, Homo sapiens
aactgtcctgtcctgct

SEQ ID NO: 4118395 - DNA, 18 bp, Homo sapiens
aactgtcctgtcctgctc

SEQ ID NO: 4118396 - DNA, 21 bp, Homo sapiens
aactgtgaatacttgaactct

SEQ ID NO: 4118397 - DNA, 15 bp, Homo sapiens
aactgttacctaaag

SEQ ID NO: 4118398 - DNA, 14 bp, Homo sapiens
aactgttcaagtgt

SEQ ID NO: 4118399 - DNA, 19 bp, Homo sapiens
aactgttcaagtgtcccca

SEQ ID NO: 4118400 - DNA, 18 bp, Homo sapiens
aactgttgtagaagacaa

SEQ ID NO: 4118401 - DNA, 22 bp, Homo sapiens
aactgttgtgggcgctgcttcc

SEQ ID NO: 4118402 - DNA, 22 bp, Homo sapiens
aactgtttgaaaacttcagaag

SEQ ID NO: 4118403 - DNA, 19 bp, Homo sapiens
aacttaaattttagttctt

SEQ ID NO: 4118404 - DNA, 20 bp, Homo sapiens
aacttacattgttcaattag

SEQ ID NO: 4118405 - DNA, 20 bp, Homo sapiens
aacttagcttgcacatgaat

SEQ ID NO: 4118406 - DNA, 23 bp, Homo sapiens
aacttagcttgcacatgaatgca

SEQ ID NO: 4118407 - DNA, 20 bp, Homo sapiens
aacttagtgacaaaatagac

SEQ ID NO: 4118408 - DNA, 14 bp, Homo sapiens
aacttataaatcat

SEQ ID NO: 4118409 - DNA, 19 bp, Homo sapiens
aacttataaatcatattga

SEQ ID NO: 4118410 - DNA, 12 bp, Homo sapiens
aacttatattga

SEQ ID NO: 4118411 - DNA, 19 bp, Homo sapiens
aacttatcctaaaacaaat

SEQ ID NO: 4118412 - DNA, 15 bp, Homo sapiens
aacttattagaaacc

SEQ ID NO: 4118413 - DNA, 17 bp, Homo sapiens
aacttattctttgagta

SEQ ID NO: 4118414 - DNA, 21 bp, Homo sapiens
aacttatttaaaaatatttca

SEQ ID NO: 4118415 - DNA, 13 bp, Homo sapiens
aacttatttagag

SEQ ID NO: 4118416 - DNA, 16 bp, Homo sapiens
aacttcacaactaggc

SEQ ID NO: 4118417 - DNA, 17 bp, Homo sapiens
aacttcacattaaaaaa

SEQ ID NO: 4118418 - DNA, 23 bp, Homo sapiens
aacttcagttttatttttgccaa

SEQ ID NO: 4118419 - DNA, 13 bp, Homo sapiens
aacttcattttta

SEQ ID NO: 4118420 - DNA, 10 bp, Homo sapiens
aacttccaag

SEQ ID NO: 4118421 - DNA, 19 bp, Homo sapiens
aacttccaggtgttactgt

SEQ ID NO: 4118422 - DNA, 22 bp, Homo sapiens
aacttccaggtgttactgtaat

SEQ ID NO: 4118423 - DNA, 18 bp, Homo sapiens
aacttccccatcttctaa

SEQ ID NO: 4118424 - DNA, 19 bp, Homo sapiens
aacttctcttgctttctat

SEQ ID NO: 4118425 - DNA, 20 bp, Homo sapiens
aacttcttaaatatctttta

SEQ ID NO: 4118426 - DNA, 12 bp, Homo sapiens
aacttcttcctg

SEQ ID NO: 4118427 - DNA, 14 bp, Homo sapiens
aacttgaaaatata

SEQ ID NO: 4118428 - DNA, 18 bp, Homo sapiens
aacttgaagcctgctcct

SEQ ID NO: 4118429 - DNA, 23 bp, Homo sapiens
aacttgacatgtagcttcttctg

SEQ ID NO: 4118430 - DNA, 20 bp, Homo sapiens
aacttgagggcccagagcag

SEQ ID NO: 4118431 - DNA, 14 bp, Homo sapiens
aacttgatttgcat

SEQ ID NO: 4118432 - DNA, 14 bp, Homo sapiens
aacttgctgctgtc

SEQ ID NO: 4118433 - DNA, 16 bp, Homo sapiens
aacttgctgctgtctt

SEQ ID NO: 4118434 - DNA, 17 bp, Homo sapiens
aacttggatacttggat

SEQ ID NO: 4118435 - DNA, 13 bp, Homo sapiens
aacttggcacttt

SEQ ID NO: 4118436 - DNA, 16 bp, Homo sapiens
aacttggcactttttc

SEQ ID NO: 4118437 - DNA, 13 bp, Homo sapiens
aacttggggaggc

SEQ ID NO: 4118438 - DNA, 15 bp, Homo sapiens
aacttggggaggcaa

SEQ ID NO: 4118439 - DNA, 22 bp, Homo sapiens
aacttggggagttaagacctgg

SEQ ID NO: 4118440 - DNA, 23 bp, Homo sapiens
aacttggggagttaagacctggc

SEQ ID NO: 4118441 - DNA, 18 bp, Homo sapiens
aacttgtacttgtttcat

SEQ ID NO: 4118442 - DNA, 14 bp, Homo sapiens
aacttgtcttttca

SEQ ID NO: 4118443 - DNA, 20 bp, Homo sapiens
aacttgtctttttctggact

SEQ ID NO: 4118444 - DNA, 12 bp, Homo sapiens
aacttgtggcct

SEQ ID NO: 4118445 - DNA, 19 bp, Homo sapiens
aacttgttcttccaaagca

SEQ ID NO: 4118446 - DNA, 20 bp, Homo sapiens
aacttgttcttccaaagcag

SEQ ID NO: 4118447 - DNA, 15 bp, Homo sapiens
aactttaaaaaatat

SEQ ID NO: 4118448 - DNA, 16 bp, Homo sapiens
aactttactctgtgtt

SEQ ID NO: 4118449 - DNA, 21 bp, Homo sapiens
aactttactctgtgtttaaaa

SEQ ID NO: 4118450 - DNA, 22 bp, Homo sapiens
aactttagaagtgcatttctga

SEQ ID NO: 4118451 - DNA, 22 bp, Homo sapiens
aactttagagtagcatgagaga

SEQ ID NO: 4118452 - DNA, 21 bp, Homo sapiens
aactttatacattagtaaatg

SEQ ID NO: 4118453 - DNA, 21 bp, Homo sapiens
aactttatcacattatttgca

SEQ ID NO: 4118454 - DNA, 17 bp, Homo sapiens
aactttattaaatacaa

SEQ ID NO: 4118455 - DNA, 21 bp, Homo sapiens
aactttattaaatacaaaact

SEQ ID NO: 4118456 - DNA, 15 bp, Homo sapiens
aactttcaattgtca

SEQ ID NO: 4118457 - DNA, 14 bp, Homo sapiens
aactttcctcgcct

SEQ ID NO: 4118458 - DNA, 21 bp, Homo sapiens
aactttgccaaaaaaaaaaga

SEQ ID NO: 4118459 - DNA, 11 bp, Homo sapiens
aacttttaatt

SEQ ID NO: 4118460 - DNA, 16 bp, Homo sapiens
aacttttctaacagaa

SEQ ID NO: 4118461 - DNA, 18 bp, Homo sapiens
aacttttcttaaggtttt

SEQ ID NO: 4118462 - DNA, 15 bp, Homo sapiens
aactttttgttctgg

SEQ ID NO: 4118463 - DNA, 23 bp, Homo sapiens
aactttttgttctggtccttttt

SEQ ID NO: 4118464 - DNA, 19 bp, Homo sapiens
aacttttttttctctcttt

SEQ ID NO: 4118465 - DNA, 15 bp, Homo sapiens
aagaaaaaaaaaaga

SEQ ID NO: 4118466 - DNA, 16 bp, Homo sapiens
aagaaaaaaaataaca

SEQ ID NO: 4118467 - DNA, 13 bp, Homo sapiens
aagaaaaaatcag

SEQ ID NO: 4118468 - DNA, 13 bp, Homo sapiens
aagaaaacatctt

SEQ ID NO: 4118469 - DNA, 14 bp, Homo sapiens
aagaaaacctgtat

SEQ ID NO: 4118470 - DNA, 21 bp, Homo sapiens
aagaaaacctgtatttttgtt

SEQ ID NO: 4118471 - DNA, 18 bp, Homo sapiens
aagaaaagacttgtaata

SEQ ID NO: 4118472 - DNA, 15 bp, Homo sapiens
aagaaaagataaaga

SEQ ID NO: 4118473 - DNA, 14 bp, Homo sapiens
aagaaaagcacttt

SEQ ID NO: 4118474 - DNA, 15 bp, Homo sapiens
aagaaaagcactttt

SEQ ID NO: 4118475 - DNA, 17 bp, Homo sapiens
aagaaaagcacttttgt

SEQ ID NO: 4118476 - DNA, 19 bp, Homo sapiens
aagaaaagcacttttgtta

SEQ ID NO: 4118477 - DNA, 22 bp, Homo sapiens
aagaaaagtaggtttacattca

SEQ ID NO: 4118478 - DNA, 13 bp, Homo sapiens
aagaaaagtattt

SEQ ID NO: 4118479 - DNA, 15 bp, Homo sapiens
aagaaaagtattttg

SEQ ID NO: 4118480 - DNA, 17 bp, Homo sapiens
aagaaaagtattttgaa

SEQ ID NO: 4118481 - DNA, 15 bp, Homo sapiens
aagaaaagtgcatat

SEQ ID NO: 4118482 - DNA, 22 bp, Homo sapiens
aagaaaagtgcatatttatcca

SEQ ID NO: 4118483 - DNA, 19 bp, Homo sapiens
aagaaaccttgctctcctc

SEQ ID NO: 4118484 - DNA, 17 bp, Homo sapiens
aagaaactatacatcat

SEQ ID NO: 4118485 - DNA, 16 bp, Homo sapiens
aagaaagactctattc

SEQ ID NO: 4118486 - DNA, 22 bp, Homo sapiens
aagaaagactctattctcaaag

SEQ ID NO: 4118487 - DNA, 19 bp, Homo sapiens
aagaaagggaaaagggaga

SEQ ID NO: 4118488 - DNA, 22 bp, Homo sapiens
aagaaagtgttttattttcaaa

SEQ ID NO: 4118489 - DNA, 23 bp, Homo sapiens
aagaaataaaaggaagccaaaga

SEQ ID NO: 4118490 - DNA, 14 bp, Homo sapiens
aagaaataaatcag

SEQ ID NO: 4118491 - DNA, 21 bp, Homo sapiens
aagaaatatgaaattccagca

SEQ ID NO: 4118492 - DNA, 16 bp, Homo sapiens
aagaaatatgtgagat

SEQ ID NO: 4118493 - DNA, 20 bp, Homo sapiens
aagaaatattccaaatgtct

SEQ ID NO: 4118494 - DNA, 13 bp, Homo sapiens
aagaaatccctgt

SEQ ID NO: 4118495 - DNA, 14 bp, Homo sapiens
aagaaatccctgtt

SEQ ID NO: 4118496 - DNA, 20 bp, Homo sapiens
aagaaatgcatatgtcacta

SEQ ID NO: 4118497 - DNA, 16 bp, Homo sapiens
aagaacatagaactct

SEQ ID NO: 4118498 - DNA, 19 bp, Homo sapiens
aagaacatggacttgtata

SEQ ID NO: 4118499 - DNA, 22 bp, Homo sapiens
aagaacatggacttgtatattt

SEQ ID NO: 4118500 - DNA, 17 bp, Homo sapiens
aagaaccctctgtccca

SEQ ID NO: 4118501 - DNA, 20 bp, Homo sapiens
aagaaccctctgtcccaccc

SEQ ID NO: 4118502 - DNA, 22 bp, Homo sapiens
aagaacctacagactccatctc

SEQ ID NO: 4118503 - DNA, 17 bp, Homo sapiens
aagaacttcatttttaa

SEQ ID NO: 4118504 - DNA, 19 bp, Homo sapiens
aagaagaaatatgaaattc

SEQ ID NO: 4118505 - DNA, 15 bp, Homo sapiens
aagaagaacttgcat

SEQ ID NO: 4118506 - DNA, 12 bp, Homo sapiens
aagaagacatga

SEQ ID NO: 4118507 - DNA, 17 bp, Homo sapiens
aagaagagaagctgctg

SEQ ID NO: 4118508 - DNA, 10 bp, Homo sapiens
aagaagagac

SEQ ID NO: 4118509 - DNA, 14 bp, Homo sapiens
aagaagagacagga

SEQ ID NO: 4118510 - DNA, 17 bp, Homo sapiens
aagaagccgggaacaga

SEQ ID NO: 4118511 - DNA, 14 bp, Homo sapiens
aagaagctgttgta

SEQ ID NO: 4118512 - DNA, 19 bp, Homo sapiens
aagaagctgttgtacattt

SEQ ID NO: 4118513 - DNA, 21 bp, Homo sapiens
aagaagctgttgtacatttat

SEQ ID NO: 4118514 - DNA, 22 bp, Homo sapiens
aagaagctgttgtacatttatg

SEQ ID NO: 4118515 - DNA, 11 bp, Homo sapiens
aagaaggaagt

SEQ ID NO: 4118516 - DNA, 14 bp, Homo sapiens
aagaaggcaaaaat

SEQ ID NO: 4118517 - DNA, 15 bp, Homo sapiens
aagaagggagaagaa

SEQ ID NO: 4118518 - DNA, 16 bp, Homo sapiens
aagaaggtggaccttt

SEQ ID NO: 4118519 - DNA, 13 bp, Homo sapiens
aagaagttttaaa

SEQ ID NO: 4118520 - DNA, 18 bp, Homo sapiens
aagaagttttaaaaagcc

SEQ ID NO: 4118521 - DNA, 23 bp, Homo sapiens
aagaagttttaaaaagccagttt

SEQ ID NO: 4118522 - DNA, 16 bp, Homo sapiens
aagaataaaggcagct

SEQ ID NO: 4118523 - DNA, 22 bp, Homo sapiens
aagaataattcaattttaaaga

SEQ ID NO: 4118524 - DNA, 13 bp, Homo sapiens
aagaatacagaaa

SEQ ID NO: 4118525 - DNA, 23 bp, Homo sapiens
aagaatacagttaggcaccagaa

SEQ ID NO: 4118526 - DNA, 21 bp, Homo sapiens
aagaatatgtttccttgttta

SEQ ID NO: 4118527 - DNA, 14 bp, Homo sapiens
aagaatcagagtag

SEQ ID NO: 4118528 - DNA, 15 bp, Homo sapiens
aagaatctttagaga

SEQ ID NO: 4118529 - DNA, 18 bp, Homo sapiens
aagaatgcacaagaatgg

SEQ ID NO: 4118530 - DNA, 20 bp, Homo sapiens
aagaatgcacaagaatggat

SEQ ID NO: 4118531 - DNA, 17 bp, Homo sapiens
aagaatgccatttctca

SEQ ID NO: 4118532 - DNA, 22 bp, Homo sapiens
aagaatgccatttctcacgccc

SEQ ID NO: 4118533 - DNA, 15 bp, Homo sapiens
aagaatgctggtttt

SEQ ID NO: 4118534 - DNA, 18 bp, Homo sapiens
aagaatgctggttttcct

SEQ ID NO: 4118535 - DNA, 17 bp, Homo sapiens
aagaatgtcgattaaaa

SEQ ID NO: 4118536 - DNA, 20 bp, Homo sapiens
aagaattaccaagagaaggg

SEQ ID NO: 4118537 - DNA, 22 bp, Homo sapiens
aagaattaccaagagaagggga

SEQ ID NO: 4118538 - DNA, 19 bp, Homo sapiens
aagaattcaaactggggcc

SEQ ID NO: 4118539 - DNA, 22 bp, Homo sapiens
aagaattgaccatctgctttta

SEQ ID NO: 4118540 - DNA, 20 bp, Homo sapiens
aagaattgaccttgaccatt

SEQ ID NO: 4118541 - DNA, 16 bp, Homo sapiens
aagaattgagtaatgg

SEQ ID NO: 4118542 - DNA, 17 bp, Homo sapiens
aagaattgccaatcttg

SEQ ID NO: 4118543 - DNA, 15 bp, Homo sapiens
aagaattggaagtta

SEQ ID NO: 4118544 - DNA, 15 bp, Homo sapiens
aagaatttagggaga

SEQ ID NO: 4118545 - DNA, 20 bp, Homo sapiens
aagaatttcttggtaagaag

SEQ ID NO: 4118546 - DNA, 23 bp, Homo sapiens
aagaatttcttggtaagaagccg

SEQ ID NO: 4118547 - DNA, 13 bp, Homo sapiens
aagaatttttttg

SEQ ID NO: 4118548 - DNA, 23 bp, Homo sapiens
aagacacaggggacacccagaaa

SEQ ID NO: 4118549 - DNA, 13 bp, Homo sapiens
aagacaccagagc

SEQ ID NO: 4118550 - DNA, 15 bp, Homo sapiens
aagacaccagagcag

SEQ ID NO: 4118551 - DNA, 16 bp, Homo sapiens
aagacaccagagcaga

SEQ ID NO: 4118552 - DNA, 20 bp, Homo sapiens
aagacaccagagcagatgca

SEQ ID NO: 4118553 - DNA, 22 bp, Homo sapiens
aagacaccagagcagatgcaga

SEQ ID NO: 4118554 - DNA, 16 bp, Homo sapiens
aagacagatgccccag

SEQ ID NO: 4118555 - DNA, 17 bp, Homo sapiens
aagacagatgccccaga

SEQ ID NO: 4118556 - DNA, 22 bp, Homo sapiens
aagacaggatgggggctggcct

SEQ ID NO: 4118557 - DNA, 18 bp, Homo sapiens
aagacataacgtttttcc

SEQ ID NO: 4118558 - DNA, 23 bp, Homo sapiens
aagacatactccttccatcaaat

SEQ ID NO: 4118559 - DNA, 17 bp, Homo sapiens
aagacatgtgaggagga

SEQ ID NO: 4118560 - DNA, 13 bp, Homo sapiens
aagacattgtcaa

SEQ ID NO: 4118561 - DNA, 14 bp, Homo sapiens
aagacattgtcaat

SEQ ID NO: 4118562 - DNA, 22 bp, Homo sapiens
aagacatttctgctctcagctc

SEQ ID NO: 4118563 - DNA, 14 bp, Homo sapiens
aagacatttctttt

SEQ ID NO: 4118564 - DNA, 21 bp, Homo sapiens
aagacatttcttttcttttta

SEQ ID NO: 4118565 - DNA, 18 bp, Homo sapiens
aagaccaccacttcgaaa

SEQ ID NO: 4118566 - DNA, 15 bp, Homo sapiens
aagacccctgactca

SEQ ID NO: 4118567 - DNA, 15 bp, Homo sapiens
aagaccctcccatgg

SEQ ID NO: 4118568 - DNA, 19 bp, Homo sapiens
aagacctacattccctctc

SEQ ID NO: 4118569 - DNA, 16 bp, Homo sapiens
aagacctcacctagaa

SEQ ID NO: 4118570 - DNA, 21 bp, Homo sapiens
aagacctttggagcaaagctg

SEQ ID NO: 4118571 - DNA, 17 bp, Homo sapiens
aagactctattctcaaa

SEQ ID NO: 4118572 - DNA, 15 bp, Homo sapiens
aagactgaatgtttt

SEQ ID NO: 4118573 - DNA, 20 bp, Homo sapiens
aagactgaatgttttattta

SEQ ID NO: 4118574 - DNA, 20 bp, Homo sapiens
aagactggttttctgccaat

SEQ ID NO: 4118575 - DNA, 21 bp, Homo sapiens
aagactgttgtgatcttgcat

SEQ ID NO: 4118576 - DNA, 22 bp, Homo sapiens
aagactgttgtgatcttgcatt

SEQ ID NO: 4118577 - DNA, 16 bp, Homo sapiens
aagactgtttttaagt

SEQ ID NO: 4118578 - DNA, 21 bp, Homo sapiens
aagacttcattgtccctcttc

SEQ ID NO: 4118579 - DNA, 21 bp, Homo sapiens
aagacttgagacaatgttttc

SEQ ID NO: 4118580 - DNA, 12 bp, Homo sapiens
aagacttgtttt

SEQ ID NO: 4118581 - DNA, 21 bp, Homo sapiens
aagacttttggtagagaagga

SEQ ID NO: 4118582 - DNA, 14 bp, Homo sapiens
aagagaaaatgtgt

SEQ ID NO: 4118583 - DNA, 21 bp, Homo sapiens
aagagaaaccgggagaaggca

SEQ ID NO: 4118584 - DNA, 19 bp, Homo sapiens
aagagaaactttatacatt

SEQ ID NO: 4118585 - DNA, 18 bp, Homo sapiens
aagagaaagtgatttcta

SEQ ID NO: 4118586 - DNA, 20 bp, Homo sapiens
aagagaagagggcccagccc

SEQ ID NO: 4118587 - DNA, 14 bp, Homo sapiens
aagagaagcaattt

SEQ ID NO: 4118588 - DNA, 14 bp, Homo sapiens
aagagaagctgctg

SEQ ID NO: 4118589 - DNA, 12 bp, Homo sapiens
aagagagaatgt

SEQ ID NO: 4118590 - DNA, 15 bp, Homo sapiens
aagagagatgttttg

SEQ ID NO: 4118591 - DNA, 15 bp, Homo sapiens
aagagaggacacaaa

SEQ ID NO: 4118592 - DNA, 11 bp, Homo sapiens
aagagaggtta

SEQ ID NO: 4118593 - DNA, 20 bp, Homo sapiens
aagagataataagattagtt

SEQ ID NO: 4118594 - DNA, 12 bp, Homo sapiens
aagagatatttt

SEQ ID NO: 4118595 - DNA, 17 bp, Homo sapiens
aagagatgagaaatgat

SEQ ID NO: 4118596 - DNA, 14 bp, Homo sapiens
aagagcaagggctt

SEQ ID NO: 4118597 - DNA, 21 bp, Homo sapiens
aagagcacactgcacagggaa

SEQ ID NO: 4118598 - DNA, 14 bp, Homo sapiens
aagagcagaacaga

SEQ ID NO: 4118599 - DNA, 17 bp, Homo sapiens
aagagcagagtctgggc

SEQ ID NO: 4118600 - DNA, 18 bp, Homo sapiens
aagagcagagtctgggcc

SEQ ID NO: 4118601 - DNA, 22 bp, Homo sapiens
aagagcagagtctgggcctctg

SEQ ID NO: 4118602 - DNA, 19 bp, Homo sapiens
aagagcagcctgtggcatc

SEQ ID NO: 4118603 - DNA, 17 bp, Homo sapiens
aagagcaggactccagg

SEQ ID NO: 4118604 - DNA, 22 bp, Homo sapiens
aagagcaggactccaggcccaa

SEQ ID NO: 4118605 - DNA, 18 bp, Homo sapiens
aagagcatgaaattttta

SEQ ID NO: 4118606 - DNA, 20 bp, Homo sapiens
aagagccctggacacccctg

SEQ ID NO: 4118607 - DNA, 22 bp, Homo sapiens
aagagccctggacacccctgct

SEQ ID NO: 4118608 - DNA, 16 bp, Homo sapiens
aagagcctggagaagc

SEQ ID NO: 4118609 - DNA, 15 bp, Homo sapiens
aagagctaataaatc

SEQ ID NO: 4118610 - DNA, 20 bp, Homo sapiens
aagagctattgccaaccagt

SEQ ID NO: 4118611 - DNA, 13 bp, Homo sapiens
aagagcttgcttt

SEQ ID NO: 4118612 - DNA, 16 bp, Homo sapiens
aagagcttgctttgat

SEQ ID NO: 4118613 - DNA, 13 bp, Homo sapiens
aagaggaacagtg

SEQ ID NO: 4118614 - DNA, 14 bp, Homo sapiens
aagaggaagcaaat

SEQ ID NO: 4118615 - DNA, 18 bp, Homo sapiens
aagaggaatttcttttcc

SEQ ID NO: 4118616 - DNA, 22 bp, Homo sapiens
aagaggcagagttctgtgaaga

SEQ ID NO: 4118617 - DNA, 16 bp, Homo sapiens
aagaggctgaaagagg

SEQ ID NO: 4118618 - DNA, 15 bp, Homo sapiens
aagaggctgaggcct

SEQ ID NO: 4118619 - DNA, 22 bp, Homo sapiens
aagaggctgaggctggcacagg

SEQ ID NO: 4118620 - DNA, 21 bp, Homo sapiens
aagaggctgcccctctcacca

SEQ ID NO: 4118621 - DNA, 13 bp, Homo sapiens
aagagggcaagtg

SEQ ID NO: 4118622 - DNA, 14 bp, Homo sapiens
aagagggcctgtgg

SEQ ID NO: 4118623 - DNA, 16 bp, Homo sapiens
aagagggctgagctga

SEQ ID NO: 4118624 - DNA, 17 bp, Homo sapiens
aagagggggctggccat

SEQ ID NO: 4118625 - DNA, 16 bp, Homo sapiens
aagagggggtggaggg

SEQ ID NO: 4118626 - DNA, 15 bp, Homo sapiens
aagaggtacagggtt

SEQ ID NO: 4118627 - DNA, 20 bp, Homo sapiens
aagaggtacagggtttttac

SEQ ID NO: 4118628 - DNA, 16 bp, Homo sapiens
aagaggtgggagggcc

SEQ ID NO: 4118629 - DNA, 17 bp, Homo sapiens
aagaggtgggagggccc

SEQ ID NO: 4118630 - DNA, 17 bp, Homo sapiens
aagaggtgttatttgga

SEQ ID NO: 4118631 - DNA, 13 bp, Homo sapiens
aagagtaacttta

SEQ ID NO: 4118632 - DNA, 17 bp, Homo sapiens
aagagtatccttccttc

SEQ ID NO: 4118633 - DNA, 18 bp, Homo sapiens
aagagtgactagtacaaa

SEQ ID NO: 4118634 - DNA, 20 bp, Homo sapiens
aagagtgactagtacaaatt

SEQ ID NO: 4118635 - DNA, 13 bp, Homo sapiens
aagagtgattgca

SEQ ID NO: 4118636 - DNA, 20 bp, Homo sapiens
aagagtgattgcagctttat

SEQ ID NO: 4118637 - DNA, 15 bp, Homo sapiens
aagagtgtagaagca

SEQ ID NO: 4118638 - DNA, 16 bp, Homo sapiens
aagagtgtagaagcat

SEQ ID NO: 4118639 - DNA, 17 bp, Homo sapiens
aagataaagatgatcta

SEQ ID NO: 4118640 - DNA, 13 bp, Homo sapiens
aagataaatgtgc

SEQ ID NO: 4118641 - DNA, 21 bp, Homo sapiens
aagataacaagatctttcagg

SEQ ID NO: 4118642 - DNA, 22 bp, Homo sapiens
aagataacaagatctttcagga

SEQ ID NO: 4118643 - DNA, 15 bp, Homo sapiens
aagataacttgagca

SEQ ID NO: 4118644 - DNA, 19 bp, Homo sapiens
aagataatttatttcaata

SEQ ID NO: 4118645 - DNA, 15 bp, Homo sapiens
aagataatttgcata

SEQ ID NO: 4118646 - DNA, 19 bp, Homo sapiens
aagataatttgcatattct

SEQ ID NO: 4118647 - DNA, 15 bp, Homo sapiens
aagatacaagtttca

SEQ ID NO: 4118648 - DNA, 20 bp, Homo sapiens
aagatacaagtttcagacag

SEQ ID NO: 4118649 - DNA, 16 bp, Homo sapiens
aagatagatcctttta

SEQ ID NO: 4118650 - DNA, 13 bp, Homo sapiens
aagataggctctg

SEQ ID NO: 4118651 - DNA, 14 bp, Homo sapiens
aagataggctctgc

SEQ ID NO: 4118652 - DNA, 14 bp, Homo sapiens
aagatagtgtaact

SEQ ID NO: 4118653 - DNA, 15 bp, Homo sapiens
aagatagtgtaactt

SEQ ID NO: 4118654 - DNA, 14 bp, Homo sapiens
aagatatacatgaa

SEQ ID NO: 4118655 - DNA, 15 bp, Homo sapiens
aagatattgtacata

SEQ ID NO: 4118656 - DNA, 17 bp, Homo sapiens
aagatattgtacataaa

SEQ ID NO: 4118657 - DNA, 14 bp, Homo sapiens
aagatattgttcaa

SEQ ID NO: 4118658 - DNA, 18 bp, Homo sapiens
aagatatttatatatatt

SEQ ID NO: 4118659 - DNA, 20 bp, Homo sapiens
aagatcaaaaggttaataaa

SEQ ID NO: 4118660 - DNA, 14 bp, Homo sapiens
aagatccaagaagg

SEQ ID NO: 4118661 - DNA, 16 bp, Homo sapiens
aagatccatttgcctt

SEQ ID NO: 4118662 - DNA, 21 bp, Homo sapiens
aagatcctgtctttaaggaaa

SEQ ID NO: 4118663 - DNA, 22 bp, Homo sapiens
aagatccttcgggtgctggaag

SEQ ID NO: 4118664 - DNA, 16 bp, Homo sapiens
aagatctataaagcga

SEQ ID NO: 4118665 - DNA, 17 bp, Homo sapiens
aagatctgtcctcagcc

SEQ ID NO: 4118666 - DNA, 18 bp, Homo sapiens
aagatctgtcctcagcct

SEQ ID NO: 4118667 - DNA, 19 bp, Homo sapiens
aagatctgtcctcagcctt

SEQ ID NO: 4118668 - DNA, 22 bp, Homo sapiens
aagatctgttttgaaggcaaaa

SEQ ID NO: 4118669 - DNA, 15 bp, Homo sapiens
aagatcttgtctcca

SEQ ID NO: 4118670 - DNA, 13 bp, Homo sapiens
aagatgacacaag

SEQ ID NO: 4118671 - DNA, 12 bp, Homo sapiens
aagatgcactga

SEQ ID NO: 4118672 - DNA, 18 bp, Homo sapiens
aagatgccaattattgtt

SEQ ID NO: 4118673 - DNA, 21 bp, Homo sapiens
aagatgccagcttctctctcc

SEQ ID NO: 4118674 - DNA, 15 bp, Homo sapiens
aagatggatgtgctt

SEQ ID NO: 4118675 - DNA, 17 bp, Homo sapiens
aagatggattctcagat

SEQ ID NO: 4118676 - DNA, 21 bp, Homo sapiens
aagatggattctcagatattt

SEQ ID NO: 4118677 - DNA, 21 bp, Homo sapiens
aagatgggggcagggctgtgc

SEQ ID NO: 4118678 - DNA, 16 bp, Homo sapiens
aagatggtatatttgg

SEQ ID NO: 4118679 - DNA, 21 bp, Homo sapiens
aagatggtccatttgttcctg

SEQ ID NO: 4118680 - DNA, 17 bp, Homo sapiens
aagatggtcgtgtgtgt

SEQ ID NO: 4118681 - DNA, 14 bp, Homo sapiens
aagatggtttcaat

SEQ ID NO: 4118682 - DNA, 15 bp, Homo sapiens
aagatgttgaagaat

SEQ ID NO: 4118683 - DNA, 22 bp, Homo sapiens
aagattagcaaggtcatttctt

SEQ ID NO: 4118684 - DNA, 19 bp, Homo sapiens
aagattaggagaaacacat

SEQ ID NO: 4118685 - DNA, 19 bp, Homo sapiens
aagattagttggacagttt

SEQ ID NO: 4118686 - DNA, 20 bp, Homo sapiens
aagattcatatttacttctt

SEQ ID NO: 4118687 - DNA, 17 bp, Homo sapiens
aagattctcctgtgcta

SEQ ID NO: 4118688 - DNA, 17 bp, Homo sapiens
aagatttggaataaagt

SEQ ID NO: 4118689 - DNA, 21 bp, Homo sapiens
aagatttgttttgtcaagtgt

SEQ ID NO: 4118690 - DNA, 17 bp, Homo sapiens
aagattttaatcaagtt

SEQ ID NO: 4118691 - DNA, 14 bp, Homo sapiens
aagattttagggct

SEQ ID NO: 4118692 - DNA, 19 bp, Homo sapiens
aagattttagggcttttat

SEQ ID NO: 4118693 - DNA, 22 bp, Homo sapiens
aagattttagggcttttatttt

SEQ ID NO: 4118694 - DNA, 20 bp, Homo sapiens
aagattttattgtataaaaa

SEQ ID NO: 4118695 - DNA, 20 bp, Homo sapiens
aagattttcctcttgtgatt

SEQ ID NO: 4118696 - DNA, 17 bp, Homo sapiens
aagattttgaatgcttc

SEQ ID NO: 4118697 - DNA, 14 bp, Homo sapiens
aagatttttctcaa

SEQ ID NO: 4118698 - DNA, 21 bp, Homo sapiens
aagatttttctcaaagttttg

SEQ ID NO: 4118699 - DNA, 13 bp, Homo sapiens
aagatttttttcc

SEQ ID NO: 4118700 - DNA, 15 bp, Homo sapiens
aagatttttttcctg

SEQ ID NO: 4118701 - DNA, 12 bp, Homo sapiens
aagcaaagggga

SEQ ID NO: 4118702 - DNA, 17 bp, Homo sapiens
aagcaaaggtgaagaga

SEQ ID NO: 4118703 - DNA, 14 bp, Homo sapiens
aagcaaatctacag

SEQ ID NO: 4118704 - DNA, 15 bp, Homo sapiens
aagcaaatgcattct

SEQ ID NO: 4118705 - DNA, 21 bp, Homo sapiens
aagcaacgataaaattacaaa

SEQ ID NO: 4118706 - DNA, 15 bp, Homo sapiens
aagcaagagagatgt

SEQ ID NO: 4118707 - DNA, 16 bp, Homo sapiens
aagcaagcaacacaga

SEQ ID NO: 4118708 - DNA, 13 bp, Homo sapiens
aagcaagccagac

SEQ ID NO: 4118709 - DNA, 13 bp, Homo sapiens
aagcaagggagaa

SEQ ID NO: 4118710 - DNA, 15 bp, Homo sapiens
aagcaagggggtgat

SEQ ID NO: 4118711 - DNA, 16 bp, Homo sapiens
aagcaagtagctttcc

SEQ ID NO: 4118712 - DNA, 17 bp, Homo sapiens
aagcaatattttggagt

SEQ ID NO: 4118713 - DNA, 14 bp, Homo sapiens
aagcaatcctcctg

SEQ ID NO: 4118714 - DNA, 16 bp, Homo sapiens
aagcaatcctcctgcc

SEQ ID NO: 4118715 - DNA, 13 bp, Homo sapiens
aagcacagtcagg

SEQ ID NO: 4118716 - DNA, 13 bp, Homo sapiens
aagcacatacatt

SEQ ID NO: 4118717 - DNA, 20 bp, Homo sapiens
aagcacatacattaaaacta

SEQ ID NO: 4118718 - DNA, 21 bp, Homo sapiens
aagcaccagcttctccaggct

SEQ ID NO: 4118719 - DNA, 14 bp, Homo sapiens
aagcaccccatgcc

SEQ ID NO: 4118720 - DNA, 12 bp, Homo sapiens
aagcacccttga

SEQ ID NO: 4118721 - DNA, 16 bp, Homo sapiens
aagcacctactatgtg

SEQ ID NO: 4118722 - DNA, 15 bp, Homo sapiens
aagcacgaaatgtta

SEQ ID NO: 4118723 - DNA, 17 bp, Homo sapiens
aagcactacataaactg

SEQ ID NO: 4118724 - DNA, 13 bp, Homo sapiens
aagcactgaaaaa

SEQ ID NO: 4118725 - DNA, 14 bp, Homo sapiens
aagcacttttgtta

SEQ ID NO: 4118726 - DNA, 19 bp, Homo sapiens
aagcacttttgttattcca

SEQ ID NO: 4118727 - DNA, 21 bp, Homo sapiens
aagcacttttgttattccatc

SEQ ID NO: 4118728 - DNA, 23 bp, Homo sapiens
aagcacttttgttattccatcaa

SEQ ID NO: 4118729 - DNA, 20 bp, Homo sapiens
aagcagaaaataaaggaagc

SEQ ID NO: 4118730 - DNA, 15 bp, Homo sapiens
aagcagaattttaat

SEQ ID NO: 4118731 - DNA, 20 bp, Homo sapiens
aagcagaattttaatgtgaa

SEQ ID NO: 4118732 - DNA, 18 bp, Homo sapiens
aagcagagaggtggagaa

SEQ ID NO: 4118733 - DNA, 20 bp, Homo sapiens
aagcagatggaatgctgtgt

SEQ ID NO: 4118734 - DNA, 16 bp, Homo sapiens
aagcagcattctggag

SEQ ID NO: 4118735 - DNA, 11 bp, Homo sapiens
aagcagccagc

SEQ ID NO: 4118736 - DNA, 17 bp, Homo sapiens
aagcagcctcagagtgg

SEQ ID NO: 4118737 - DNA, 19 bp, Homo sapiens
aagcagctgaagaaaaaat

SEQ ID NO: 4118738 - DNA, 21 bp, Homo sapiens
aagcagctttaaacaaattca

SEQ ID NO: 4118739 - DNA, 11 bp, Homo sapiens
aagcaggaggc

SEQ ID NO: 4118740 - DNA, 14 bp, Homo sapiens
aagcaggcactgta

SEQ ID NO: 4118741 - DNA, 17 bp, Homo sapiens
aagcagggaatttctat

SEQ ID NO: 4118742 - DNA, 14 bp, Homo sapiens
aagcagggtaccct

SEQ ID NO: 4118743 - DNA, 23 bp, Homo sapiens
aagcagggtaccctttggggagc

SEQ ID NO: 4118744 - DNA, 19 bp, Homo sapiens
aagcaggtggatctatttc

SEQ ID NO: 4118745 - DNA, 14 bp, Homo sapiens
aagcagtcttgctc

SEQ ID NO: 4118746 - DNA, 22 bp, Homo sapiens
aagcataaatgcaaacacacaa

SEQ ID NO: 4118747 - DNA, 14 bp, Homo sapiens
aagcatagatgttt

SEQ ID NO: 4118748 - DNA, 16 bp, Homo sapiens
aagcatatagagatga

SEQ ID NO: 4118749 - DNA, 14 bp, Homo sapiens
aagcatccatgtgt

SEQ ID NO: 4118750 - DNA, 15 bp, Homo sapiens
aagcatgatgggaaa

SEQ ID NO: 4118751 - DNA, 18 bp, Homo sapiens
aagcatgatgggaaaata

SEQ ID NO: 4118752 - DNA, 20 bp, Homo sapiens
aagcatgatgggaaaatatt

SEQ ID NO: 4118753 - DNA, 23 bp, Homo sapiens
aagcatgatgggaaaatatttcc

SEQ ID NO: 4118754 - DNA, 20 bp, Homo sapiens
aagcatgtagactgtgccag

SEQ ID NO: 4118755 - DNA, 17 bp, Homo sapiens
aagcattcagagagcag

SEQ ID NO: 4118756 - DNA, 18 bp, Homo sapiens
aagcattccttctttgat

SEQ ID NO: 4118757 - DNA, 22 bp, Homo sapiens
aagcattccttctttgataatg

SEQ ID NO: 4118758 - DNA, 20 bp, Homo sapiens
aagcattgcttttattttga

SEQ ID NO: 4118759 - DNA, 22 bp, Homo sapiens
aagcattgcttttattttgaaa

SEQ ID NO: 4118760 - DNA, 11 bp, Homo sapiens
aagcattgttt

SEQ ID NO: 4118761 - DNA, 20 bp, Homo sapiens
aagcattgtttgcttattgt

SEQ ID NO: 4118762 - DNA, 21 bp, Homo sapiens
aagcattgtttgcttattgtt

SEQ ID NO: 4118763 - DNA, 12 bp, Homo sapiens
aagcatttccta

SEQ ID NO: 4118764 - DNA, 21 bp, Homo sapiens
aagccaaaagtccctccctgc

SEQ ID NO: 4118765 - DNA, 11 bp, Homo sapiens
aagccaaagaa

SEQ ID NO: 4118766 - DNA, 12 bp, Homo sapiens
aagccaaagaaa

SEQ ID NO: 4118767 - DNA, 15 bp, Homo sapiens
aagccaaagaaaaat

SEQ ID NO: 4118768 - DNA, 22 bp, Homo sapiens
aagccaaagtggcatgttttgt

SEQ ID NO: 4118769 - DNA, 19 bp, Homo sapiens
aagccaacttgtaaataca

SEQ ID NO: 4118770 - DNA, 9 bp, Homo sapiens
aagccaagc

SEQ ID NO: 4118771 - DNA, 13 bp, Homo sapiens
aagccaagggaaa

SEQ ID NO: 4118772 - DNA, 18 bp, Homo sapiens
aagccacaagtcttccag

SEQ ID NO: 4118773 - DNA, 13 bp, Homo sapiens
aagccacaggaag

SEQ ID NO: 4118774 - DNA, 18 bp, Homo sapiens
aagccacattatttctag

SEQ ID NO: 4118775 - DNA, 19 bp, Homo sapiens
aagccacattatttctagt

SEQ ID NO: 4118776 - DNA, 11 bp, Homo sapiens
aagccacctct

SEQ ID NO: 4118777 - DNA, 20 bp, Homo sapiens
aagccacctctccctcaaca

SEQ ID NO: 4118778 - DNA, 19 bp, Homo sapiens
aagccactctgtcccttcc

SEQ ID NO: 4118779 - DNA, 13 bp, Homo sapiens
aagccacttgaaa

SEQ ID NO: 4118780 - DNA, 15 bp, Homo sapiens
aagccagctgcccta

SEQ ID NO: 4118781 - DNA, 18 bp, Homo sapiens
aagccaggctgagtgagc

SEQ ID NO: 4118782 - DNA, 23 bp, Homo sapiens
aagccaggctgagtgagccacag

SEQ ID NO: 4118783 - DNA, 17 bp, Homo sapiens
aagccatagaccctgag

SEQ ID NO: 4118784 - DNA, 16 bp, Homo sapiens
aagccataggcccagg

SEQ ID NO: 4118785 - DNA, 22 bp, Homo sapiens
aagccatatatgaccagaagcc

SEQ ID NO: 4118786 - DNA, 16 bp, Homo sapiens
aagccatgtataaatg

SEQ ID NO: 4118787 - DNA, 20 bp, Homo sapiens
aagccattctaaggaaatta

SEQ ID NO: 4118788 - DNA, 22 bp, Homo sapiens
aagccattctcctgcctcagcc

SEQ ID NO: 4118789 - DNA, 18 bp, Homo sapiens
aagcccaatattataatt

SEQ ID NO: 4118790 - DNA, 12 bp, Homo sapiens
aagcccaccagg

SEQ ID NO: 4118791 - DNA, 16 bp, Homo sapiens
aagccccagcagccct

SEQ ID NO: 4118792 - DNA, 15 bp, Homo sapiens
aagccccatttcctc

SEQ ID NO: 4118793 - DNA, 23 bp, Homo sapiens
aagcccccagctaagaacctgga

SEQ ID NO: 4118794 - DNA, 14 bp, Homo sapiens
aagcccccagggcc

SEQ ID NO: 4118795 - DNA, 21 bp, Homo sapiens
aagcccccagggcctccaggg

SEQ ID NO: 4118796 - DNA, 18 bp, Homo sapiens
aagccctgtcgagacact

SEQ ID NO: 4118797 - DNA, 19 bp, Homo sapiens
aagccctgtcgagacactt

SEQ ID NO: 4118798 - DNA, 14 bp, Homo sapiens
aagccgactctggc

SEQ ID NO: 4118799 - DNA, 17 bp, Homo sapiens
aagccgactctggccct

SEQ ID NO: 4118800 - DNA, 14 bp, Homo sapiens
aagccgggaacaga

SEQ ID NO: 4118801 - DNA, 23 bp, Homo sapiens
aagccggggtgtaacttcctgct

SEQ ID NO: 4118802 - DNA, 14 bp, Homo sapiens
aagccgtggcttcc

SEQ ID NO: 4118803 - DNA, 23 bp, Homo sapiens
aagcctaaaagtgggcttgattc

SEQ ID NO: 4118804 - DNA, 14 bp, Homo sapiens
aagcctacctgctc

SEQ ID NO: 4118805 - DNA, 22 bp, Homo sapiens
aagcctcaactagtcatttttt

SEQ ID NO: 4118806 - DNA, 18 bp, Homo sapiens
aagcctccaagcacagag

SEQ ID NO: 4118807 - DNA, 20 bp, Homo sapiens
aagcctccatttagttcttt

SEQ ID NO: 4118808 - DNA, 22 bp, Homo sapiens
aagcctccatttagttctttgt

SEQ ID NO: 4118809 - DNA, 19 bp, Homo sapiens
aagcctccttagaaaaaaa

SEQ ID NO: 4118810 - DNA, 15 bp, Homo sapiens
aagcctgatgctgac

SEQ ID NO: 4118811 - DNA, 17 bp, Homo sapiens
aagcctgcaatttcata

SEQ ID NO: 4118812 - DNA, 14 bp, Homo sapiens
aagcctgcaggagt

SEQ ID NO: 4118813 - DNA, 12 bp, Homo sapiens
aagcctgctcct

SEQ ID NO: 4118814 - DNA, 17 bp, Homo sapiens
aagcctgctccttccct

SEQ ID NO: 4118815 - DNA, 18 bp, Homo sapiens
aagcctgttcccctcact

SEQ ID NO: 4118816 - DNA, 21 bp, Homo sapiens
aagccttaaactgtacagaat

SEQ ID NO: 4118817 - DNA, 21 bp, Homo sapiens
aagccttaagccataggccca

SEQ ID NO: 4118818 - DNA, 21 bp, Homo sapiens
aagccttacacagggcgaggg

SEQ ID NO: 4118819 - DNA, 19 bp, Homo sapiens
aagccttataaaccaatct

SEQ ID NO: 4118820 - DNA, 20 bp, Homo sapiens
aagccttataaaccaatctt

SEQ ID NO: 4118821 - DNA, 18 bp, Homo sapiens
aagccttggaaccagccc

SEQ ID NO: 4118822 - DNA, 19 bp, Homo sapiens
aagccttggaaccagcccc

SEQ ID NO: 4118823 - DNA, 23 bp, Homo sapiens
aagccttgggttccaaccaggca

SEQ ID NO: 4118824 - DNA, 13 bp, Homo sapiens
aagccttgtgtat

SEQ ID NO: 4118825 - DNA, 21 bp, Homo sapiens
aagccttgtgtatatttgtat

SEQ ID NO: 4118826 - DNA, 19 bp, Homo sapiens
aagcctttagtatcagtgt

SEQ ID NO: 4118827 - DNA, 21 bp, Homo sapiens
aagcctttagtatcagtgttt

SEQ ID NO: 4118828 - DNA, 17 bp, Homo sapiens
aagcctttatggctgct

SEQ ID NO: 4118829 - DNA, 15 bp, Homo sapiens
aagcctttccataag

SEQ ID NO: 4118830 - DNA, 22 bp, Homo sapiens
aagcgaagtctttgccttctct

SEQ ID NO: 4118831 - DNA, 21 bp, Homo sapiens
aagcgatatacagatgaaaat

SEQ ID NO: 4118832 - DNA, 22 bp, Homo sapiens
aagcgatatacagatgaaaatt

SEQ ID NO: 4118833 - DNA, 14 bp, Homo sapiens
aagcgattctcctg

SEQ ID NO: 4118834 - DNA, 22 bp, Homo sapiens
aagcggaataaactagagaagg

SEQ ID NO: 4118835 - DNA, 14 bp, Homo sapiens
aagcgtatttaatg

SEQ ID NO: 4118836 - DNA, 11 bp, Homo sapiens
aagctaaagag

SEQ ID NO: 4118837 - DNA, 15 bp, Homo sapiens
aagctagacagatcc

SEQ ID NO: 4118838 - DNA, 19 bp, Homo sapiens
aagctagggtggcccttgc

SEQ ID NO: 4118839 - DNA, 14 bp, Homo sapiens
aagctagtgtttct

SEQ ID NO: 4118840 - DNA, 16 bp, Homo sapiens
aagctattagccagga

SEQ ID NO: 4118841 - DNA, 21 bp, Homo sapiens
aagctattagccaggatcatg

SEQ ID NO: 4118842 - DNA, 21 bp, Homo sapiens
aagctattccctcaaatctga

SEQ ID NO: 4118843 - DNA, 16 bp, Homo sapiens
aagctcagtgctctct

SEQ ID NO: 4118844 - DNA, 22 bp, Homo sapiens
aagctcatgcatttcaagcagc

SEQ ID NO: 4118845 - DNA, 19 bp, Homo sapiens
aagctcctctccccagccc

SEQ ID NO: 4118846 - DNA, 19 bp, Homo sapiens
aagctcctggtcttgagat

SEQ ID NO: 4118847 - DNA, 13 bp, Homo sapiens
aagctcctgtcct

SEQ ID NO: 4118848 - DNA, 22 bp, Homo sapiens
aagctcctgtcctcccatcccc

SEQ ID NO: 4118849 - DNA, 21 bp, Homo sapiens
aagctctactgaggtgctatg

SEQ ID NO: 4118850 - DNA, 16 bp, Homo sapiens
aagctctgaagtcaca

SEQ ID NO: 4118851 - DNA, 23 bp, Homo sapiens
aagctctgttccatgcaactgga

SEQ ID NO: 4118852 - DNA, 16 bp, Homo sapiens
aagctcttactctttc

SEQ ID NO: 4118853 - DNA, 19 bp, Homo sapiens
aagctcttggagctgtgag

SEQ ID NO: 4118854 - DNA, 16 bp, Homo sapiens
aagctctttgagaact

SEQ ID NO: 4118855 - DNA, 22 bp, Homo sapiens
aagctgaatgtcaaacagtgcc

SEQ ID NO: 4118856 - DNA, 23 bp, Homo sapiens
aagctgaatgtcaaacagtgcca

SEQ ID NO: 4118857 - DNA, 19 bp, Homo sapiens
aagctgagaactcctgact

SEQ ID NO: 4118858 - DNA, 14 bp, Homo sapiens
aagctgaggcggga

SEQ ID NO: 4118859 - DNA, 13 bp, Homo sapiens
aagctgagtttcc

SEQ ID NO: 4118860 - DNA, 22 bp, Homo sapiens
aagctgagtttcctatgggaac

SEQ ID NO: 4118861 - DNA, 15 bp, Homo sapiens
aagctgcaaatctga

SEQ ID NO: 4118862 - DNA, 20 bp, Homo sapiens
aagctgccgaaccaaaagaa

SEQ ID NO: 4118863 - DNA, 16 bp, Homo sapiens
aagctgctccaggcct

SEQ ID NO: 4118864 - DNA, 21 bp, Homo sapiens
aagctgctttaaaaaaataca

SEQ ID NO: 4118865 - DNA, 13 bp, Homo sapiens
aagctggccctgc

SEQ ID NO: 4118866 - DNA, 22 bp, Homo sapiens
aagctggcctctaccacaaggg

SEQ ID NO: 4118867 - DNA, 12 bp, Homo sapiens
aagctggctctg

SEQ ID NO: 4118868 - DNA, 16 bp, Homo sapiens
aagctggctctgtttg

SEQ ID NO: 4118869 - DNA, 17 bp, Homo sapiens
aagctggctctgtttga

SEQ ID NO: 4118870 - DNA, 22 bp, Homo sapiens
aagctggctttgaaacctcagg

SEQ ID NO: 4118871 - DNA, 19 bp, Homo sapiens
aagctgtgccttcagctgt

SEQ ID NO: 4118872 - DNA, 23 bp, Homo sapiens
aagctgtgccttcagctgttgca

SEQ ID NO: 4118873 - DNA, 20 bp, Homo sapiens
aagctgtggaatgaagcttt

SEQ ID NO: 4118874 - DNA, 18 bp, Homo sapiens
aagctgttgaccaggcac

SEQ ID NO: 4118875 - DNA, 17 bp, Homo sapiens
aagctgttgtacattta

SEQ ID NO: 4118876 - DNA, 20 bp, Homo sapiens
aagctgttgtacatttatga

SEQ ID NO: 4118877 - DNA, 15 bp, Homo sapiens
aagctgtttccatag

SEQ ID NO: 4118878 - DNA, 23 bp, Homo sapiens
aagctgtttccatagggtgacac

SEQ ID NO: 4118879 - DNA, 18 bp, Homo sapiens
aagcttaatagccctccc

SEQ ID NO: 4118880 - DNA, 14 bp, Homo sapiens
aagcttcaaattaa

SEQ ID NO: 4118881 - DNA, 12 bp, Homo sapiens
aagcttcagact

SEQ ID NO: 4118882 - DNA, 21 bp, Homo sapiens
aagcttcattctccttgttgt

SEQ ID NO: 4118883 - DNA, 15 bp, Homo sapiens
aagcttccatgattc

SEQ ID NO: 4118884 - DNA, 19 bp, Homo sapiens
aagcttcttaattaatttg

SEQ ID NO: 4118885 - DNA, 21 bp, Homo sapiens
aagctttcctgccccaggcct

SEQ ID NO: 4118886 - DNA, 20 bp, Homo sapiens
aagctttggtttatggtttt

SEQ ID NO: 4118887 - DNA, 13 bp, Homo sapiens
aagcttttattcg

SEQ ID NO: 4118888 - DNA, 17 bp, Homo sapiens
aaggaaaaaatgttgga

SEQ ID NO: 4118889 - DNA, 19 bp, Homo sapiens
aaggaaaaacacaagcaaa

SEQ ID NO: 4118890 - DNA, 14 bp, Homo sapiens
aaggaaaaataatc

SEQ ID NO: 4118891 - DNA, 15 bp, Homo sapiens
aaggaaaaataatca

SEQ ID NO: 4118892 - DNA, 16 bp, Homo sapiens
aaggaaaaataatcaa

SEQ ID NO: 4118893 - DNA, 13 bp, Homo sapiens
aaggaaactctta

SEQ ID NO: 4118894 - DNA, 20 bp, Homo sapiens
aaggaaacttcagttgatct

SEQ ID NO: 4118895 - DNA, 19 bp, Homo sapiens
aaggaaagtcaagaagaat

SEQ ID NO: 4118896 - DNA, 18 bp, Homo sapiens
aaggaacagttgcattta

SEQ ID NO: 4118897 - DNA, 21 bp, Homo sapiens
aaggaacagttgcatttagct

SEQ ID NO: 4118898 - DNA, 12 bp, Homo sapiens
aaggaaccttcc

SEQ ID NO: 4118899 - DNA, 13 bp, Homo sapiens
aaggaagactaga

SEQ ID NO: 4118900 - DNA, 21 bp, Homo sapiens
aaggaagagccaatgttttcc

SEQ ID NO: 4118901 - DNA, 22 bp, Homo sapiens
aaggaagccttgctcattcttg

SEQ ID NO: 4118902 - DNA, 13 bp, Homo sapiens
aaggaaggaaaga

SEQ ID NO: 4118903 - DNA, 15 bp, Homo sapiens
aaggaaggttcatgt

SEQ ID NO: 4118904 - DNA, 13 bp, Homo sapiens
aaggaataaatga

SEQ ID NO: 4118905 - DNA, 21 bp, Homo sapiens
aaggaatctccagttttcagt

SEQ ID NO: 4118906 - DNA, 15 bp, Homo sapiens
aaggaatctgtgcag

SEQ ID NO: 4118907 - DNA, 21 bp, Homo sapiens
aaggaatctgtgcagatgagc

SEQ ID NO: 4118908 - DNA, 17 bp, Homo sapiens
aaggacaaaaatgaact

SEQ ID NO: 4118909 - DNA, 23 bp, Homo sapiens
aaggacaaaaatgaactgaagtt

SEQ ID NO: 4118910 - DNA, 21 bp, Homo sapiens
aaggacattgccccaagatag

SEQ ID NO: 4118911 - DNA, 16 bp, Homo sapiens
aaggaccacattttat

SEQ ID NO: 4118912 - DNA, 18 bp, Homo sapiens
aaggacctgagctggcca

SEQ ID NO: 4118913 - DNA, 15 bp, Homo sapiens
aaggacgcctgcagg

SEQ ID NO: 4118914 - DNA, 22 bp, Homo sapiens
aaggactcctcctttttccatg

SEQ ID NO: 4118915 - DNA, 18 bp, Homo sapiens
aaggactggattggccaa

SEQ ID NO: 4118916 - DNA, 20 bp, Homo sapiens
aaggacttcctgtccagctc

SEQ ID NO: 4118917 - DNA, 22 bp, Homo sapiens
aaggacttcctgtccagctcca

SEQ ID NO: 4118918 - DNA, 12 bp, Homo sapiens
aaggacttgaaa

SEQ ID NO: 4118919 - DNA, 19 bp, Homo sapiens
aaggacttgaaagcatcca

SEQ ID NO: 4118920 - DNA, 15 bp, Homo sapiens
aaggagccagtttgc

SEQ ID NO: 4118921 - DNA, 19 bp, Homo sapiens
aaggaggctccaggcagca

SEQ ID NO: 4118922 - DNA, 18 bp, Homo sapiens
aaggagggtacagctggg

SEQ ID NO: 4118923 - DNA, 17 bp, Homo sapiens
aaggatatttaagaaaa

SEQ ID NO: 4118924 - DNA, 23 bp, Homo sapiens
aaggatatttaagaaaatacaat

SEQ ID NO: 4118925 - DNA, 13 bp, Homo sapiens
aaggatccagaga

SEQ ID NO: 4118926 - DNA, 16 bp, Homo sapiens
aaggatcctctccact

SEQ ID NO: 4118927 - DNA, 21 bp, Homo sapiens
aaggatcggactctgcccctg

SEQ ID NO: 4118928 - DNA, 20 bp, Homo sapiens
aaggatctctcaggagcaca

SEQ ID NO: 4118929 - DNA, 17 bp, Homo sapiens
aaggatgtcacagggcc

SEQ ID NO: 4118930 - DNA, 12 bp, Homo sapiens
aaggattgtaaa

SEQ ID NO: 4118931 - DNA, 23 bp, Homo sapiens
aaggattgtaaaaaaaaatgcct

SEQ ID NO: 4118932 - DNA, 15 bp, Homo sapiens
aaggcaaaattgcaa

SEQ ID NO: 4118933 - DNA, 19 bp, Homo sapiens
aaggcaagagggggtggag

SEQ ID NO: 4118934 - DNA, 21 bp, Homo sapiens
aaggcaagttaagagaaactt

SEQ ID NO: 4118935 - DNA, 20 bp, Homo sapiens
aaggcaagtttctagctaga

SEQ ID NO: 4118936 - DNA, 15 bp, Homo sapiens
aaggcagctcacccc

SEQ ID NO: 4118937 - DNA, 21 bp, Homo sapiens
aaggcagctcacccctgggca

SEQ ID NO: 4118938 - DNA, 22 bp, Homo sapiens
aaggcagctgttgtctcttctc

SEQ ID NO: 4118939 - DNA, 17 bp, Homo sapiens
aaggcatacgagagcag

SEQ ID NO: 4118940 - DNA, 16 bp, Homo sapiens
aaggcatcccagcctg

SEQ ID NO: 4118941 - DNA, 17 bp, Homo sapiens
aaggcatcccagcctgg

SEQ ID NO: 4118942 - DNA, 12 bp, Homo sapiens
aaggcatgagaa

SEQ ID NO: 4118943 - DNA, 17 bp, Homo sapiens
aaggccagagtggcctg

SEQ ID NO: 4118944 - DNA, 19 bp, Homo sapiens
aaggccagagtggcctggc

SEQ ID NO: 4118945 - DNA, 24 bp, Homo sapiens
aaggccataaaacaggtaatataa

SEQ ID NO: 4118946 - DNA, 13 bp, Homo sapiens
aaggcccaagagc

SEQ ID NO: 4118947 - DNA, 15 bp, Homo sapiens
aaggcccactgtaat

SEQ ID NO: 4118948 - DNA, 14 bp, Homo sapiens
aaggccccctgcct

SEQ ID NO: 4118949 - DNA, 19 bp, Homo sapiens
aaggccccctgcctgccct

SEQ ID NO: 4118950 - DNA, 16 bp, Homo sapiens
aaggccgtgtctctga

SEQ ID NO: 4118951 - DNA, 19 bp, Homo sapiens
aaggcctccctcaggctct

SEQ ID NO: 4118952 - DNA, 13 bp, Homo sapiens
aaggcctgaatca

SEQ ID NO: 4118953 - DNA, 12 bp, Homo sapiens
aaggcctggctg

SEQ ID NO: 4118954 - DNA, 13 bp, Homo sapiens
aaggcctggctgg

SEQ ID NO: 4118955 - DNA, 15 bp, Homo sapiens
aaggcctggctggaa

SEQ ID NO: 4118956 - DNA, 20 bp, Homo sapiens
aaggccttcatggccccagc

SEQ ID NO: 4118957 - DNA, 13 bp, Homo sapiens
aaggcggcccctc

SEQ ID NO: 4118958 - DNA, 15 bp, Homo sapiens
aaggctatgtgatta

SEQ ID NO: 4118959 - DNA, 15 bp, Homo sapiens
aaggctcctgccccc

SEQ ID NO: 4118960 - DNA, 21 bp, Homo sapiens
aaggctgggtaatgtgaaggc

SEQ ID NO: 4118961 - DNA, 15 bp, Homo sapiens
aaggcttgctgcaga

SEQ ID NO: 4118962 - DNA, 14 bp, Homo sapiens
aaggcttgggattt

SEQ ID NO: 4118963 - DNA, 15 bp, Homo sapiens
aagggaaaagggaga

SEQ ID NO: 4118964 - DNA, 15 bp, Homo sapiens
aagggaaagaaaatg

SEQ ID NO: 4118965 - DNA, 14 bp, Homo sapiens
aagggaaatatcat

SEQ ID NO: 4118966 - DNA, 15 bp, Homo sapiens
aagggaagacatttc

SEQ ID NO: 4118967 - DNA, 18 bp, Homo sapiens
aagggaagacatttcttt

SEQ ID NO: 4118968 - DNA, 12 bp, Homo sapiens
aagggaatcctc

SEQ ID NO: 4118969 - DNA, 21 bp, Homo sapiens
aagggacacccctacacacac

SEQ ID NO: 4118970 - DNA, 15 bp, Homo sapiens
aagggacagcatgcc

SEQ ID NO: 4118971 - DNA, 13 bp, Homo sapiens
aagggagaaaaga

SEQ ID NO: 4118972 - DNA, 12 bp, Homo sapiens
aagggagaagaa

SEQ ID NO: 4118973 - DNA, 15 bp, Homo sapiens
aagggagaagaaagg

SEQ ID NO: 4118974 - DNA, 13 bp, Homo sapiens
aagggagaatata

SEQ ID NO: 4118975 - DNA, 14 bp, Homo sapiens
aagggagagctgag

SEQ ID NO: 4118976 - DNA, 18 bp, Homo sapiens
aagggagctatcaggaac

SEQ ID NO: 4118977 - DNA, 15 bp, Homo sapiens
aagggatggaaaagg

SEQ ID NO: 4118978 - DNA, 21 bp, Homo sapiens
aagggatggaaaaggaagact

SEQ ID NO: 4118979 - DNA, 14 bp, Homo sapiens
aagggcaaatctgc

SEQ ID NO: 4118980 - DNA, 14 bp, Homo sapiens
aagggcatgccttg

SEQ ID NO: 4118981 - DNA, 16 bp, Homo sapiens
aagggcatgccttgtg

SEQ ID NO: 4118982 - DNA, 15 bp, Homo sapiens
aagggccagagccag

SEQ ID NO: 4118983 - DNA, 14 bp, Homo sapiens
aagggccagtcctg

SEQ ID NO: 4118984 - DNA, 16 bp, Homo sapiens
aagggccagtcctgcc

SEQ ID NO: 4118985 - DNA, 14 bp, Homo sapiens
aagggccagtctgg

SEQ ID NO: 4118986 - DNA, 23 bp, Homo sapiens
aagggcgcctactcttcagggtc

SEQ ID NO: 4118987 - DNA, 13 bp, Homo sapiens
aagggctggctcc

SEQ ID NO: 4118988 - DNA, 13 bp, Homo sapiens
aagggctgggtgt

SEQ ID NO: 4118989 - DNA, 23 bp, Homo sapiens
aagggctttggttccttctctgg

SEQ ID NO: 4118990 - DNA, 21 bp, Homo sapiens
aaggggaatctggaggtagcc

SEQ ID NO: 4118991 - DNA, 16 bp, Homo sapiens
aaggggacagctgtgt

SEQ ID NO: 4118992 - DNA, 18 bp, Homo sapiens
aaggggagagcctgctgg

SEQ ID NO: 4118993 - DNA, 13 bp, Homo sapiens
aaggggagcccac

SEQ ID NO: 4118994 - DNA, 16 bp, Homo sapiens
aaggggctgaaagaac

SEQ ID NO: 4118995 - DNA, 18 bp, Homo sapiens
aagggggaggggaagtcc

SEQ ID NO: 4118996 - DNA, 16 bp, Homo sapiens
aaggggggagggggag

SEQ ID NO: 4118997 - DNA, 20 bp, Homo sapiens
aagggggggctacattataa

SEQ ID NO: 4118998 - DNA, 20 bp, Homo sapiens
aagggtggatgacagggcag

SEQ ID NO: 4118999 - DNA, 18 bp, Homo sapiens
aagggttgagagccagtg

SEQ ID NO: 4119000 - DNA, 13 bp, Homo sapiens
aagggtttctcta

SEQ ID NO: 4119001 - DNA, 14 bp, Homo sapiens
aagggtttctctat

SEQ ID NO: 4119002 - DNA, 12 bp, Homo sapiens
aaggtaatccta

SEQ ID NO: 4119003 - DNA, 17 bp, Homo sapiens
aaggtagcccagcactg

SEQ ID NO: 4119004 - DNA, 18 bp, Homo sapiens
aaggtagcccagcactgt

SEQ ID NO: 4119005 - DNA, 12 bp, Homo sapiens
aaggtagttttt

SEQ ID NO: 4119006 - DNA, 17 bp, Homo sapiens
aaggtatttcgaaactg

SEQ ID NO: 4119007 - DNA, 23 bp, Homo sapiens
aaggtatttctccagttgggact

SEQ ID NO: 4119008 - DNA, 19 bp, Homo sapiens
aaggtattttgtagatgtg

SEQ ID NO: 4119009 - DNA, 20 bp, Homo sapiens
aaggtattttgtagatgtga

SEQ ID NO: 4119010 - DNA, 19 bp, Homo sapiens
aaggtcaccagcaccaaca

SEQ ID NO: 4119011 - DNA, 14 bp, Homo sapiens
aaggtcatttcttc

SEQ ID NO: 4119012 - DNA, 14 bp, Homo sapiens
aaggtcctctcagt

SEQ ID NO: 4119013 - DNA, 20 bp, Homo sapiens
aaggtcctctgtcagtcaca

SEQ ID NO: 4119014 - DNA, 12 bp, Homo sapiens
aaggtctattgg

SEQ ID NO: 4119015 - DNA, 19 bp, Homo sapiens
aaggtctcctaaaactggg

SEQ ID NO: 4119016 - DNA, 21 bp, Homo sapiens
aaggtctcctaaaactgggat

SEQ ID NO: 4119017 - DNA, 12 bp, Homo sapiens
aaggtgcatctg

SEQ ID NO: 4119018 - DNA, 16 bp, Homo sapiens
aaggtggaccttttaa

SEQ ID NO: 4119019 - DNA, 18 bp, Homo sapiens
aaggtggagtttctctgt

SEQ ID NO: 4119020 - DNA, 21 bp, Homo sapiens
aaggtggcagatgtcttccct

SEQ ID NO: 4119021 - DNA, 15 bp, Homo sapiens
aaggtggccacagca

SEQ ID NO: 4119022 - DNA, 17 bp, Homo sapiens
aaggtgggccttgctac

SEQ ID NO: 4119023 - DNA, 22 bp, Homo sapiens
aaggtgggccttgctacctcaa

SEQ ID NO: 4119024 - DNA, 23 bp, Homo sapiens
aaggtggggtatttaccacagca

SEQ ID NO: 4119025 - DNA, 16 bp, Homo sapiens
aaggtggtgtgatctt

SEQ ID NO: 4119026 - DNA, 12 bp, Homo sapiens
aaggtgtattta

SEQ ID NO: 4119027 - DNA, 21 bp, Homo sapiens
aaggtgtatttaaactatctt

SEQ ID NO: 4119028 - DNA, 15 bp, Homo sapiens
aaggttataattttt

SEQ ID NO: 4119029 - DNA, 16 bp, Homo sapiens
aaggttccctctgaga

SEQ ID NO: 4119030 - DNA, 21 bp, Homo sapiens
aaggttctcaggtgttgccaa

SEQ ID NO: 4119031 - DNA, 17 bp, Homo sapiens
aaggttggagcccaggg

SEQ ID NO: 4119032 - DNA, 16 bp, Homo sapiens
aaggttggttgctaag

SEQ ID NO: 4119033 - DNA, 15 bp, Homo sapiens
aaggttttgtatttt

SEQ ID NO: 4119034 - DNA, 23 bp, Homo sapiens
aaggttttgtattttttaaaaca

SEQ ID NO: 4119035 - DNA, 20 bp, Homo sapiens
aaggtttttaaattgtttca

SEQ ID NO: 4119036 - DNA, 13 bp, Homo sapiens
aagtaaaattgct

SEQ ID NO: 4119037 - DNA, 12 bp, Homo sapiens
aagtaaagctaa

SEQ ID NO: 4119038 - DNA, 21 bp, Homo sapiens
aagtaaagctaaaatgatttt

SEQ ID NO: 4119039 - DNA, 16 bp, Homo sapiens
aagtaaatacaagact

SEQ ID NO: 4119040 - DNA, 16 bp, Homo sapiens
aagtaaatgggagggc

SEQ ID NO: 4119041 - DNA, 14 bp, Homo sapiens
aagtaactcatttg

SEQ ID NO: 4119042 - DNA, 14 bp, Homo sapiens
aagtaacttaagga

SEQ ID NO: 4119043 - DNA, 14 bp, Homo sapiens
aagtaagaagacat

SEQ ID NO: 4119044 - DNA, 20 bp, Homo sapiens
aagtaagaagacatgaacca

SEQ ID NO: 4119045 - DNA, 20 bp, Homo sapiens
aagtaagttaataatgtatt

SEQ ID NO: 4119046 - DNA, 13 bp, Homo sapiens
aagtaattatcgg

SEQ ID NO: 4119047 - DNA, 23 bp, Homo sapiens
aagtaattatcgggaacagtgtt

SEQ ID NO: 4119048 - DNA, 15 bp, Homo sapiens
aagtaattgttccag

SEQ ID NO: 4119049 - DNA, 19 bp, Homo sapiens
aagtacacaataagcaaaa

SEQ ID NO: 4119050 - DNA, 15 bp, Homo sapiens
aagtacactctgctg

SEQ ID NO: 4119051 - DNA, 22 bp, Homo sapiens
aagtacagcggctcccctctgc

SEQ ID NO: 4119052 - DNA, 17 bp, Homo sapiens
aagtacatgaatacaaa

SEQ ID NO: 4119053 - DNA, 16 bp, Homo sapiens
aagtacgttattgttg

SEQ ID NO: 4119054 - DNA, 15 bp, Homo sapiens
aagtactatgtatca

SEQ ID NO: 4119055 - DNA, 16 bp, Homo sapiens
aagtactatgtatcaa

SEQ ID NO: 4119056 - DNA, 14 bp, Homo sapiens
aagtacttaacata

SEQ ID NO: 4119057 - DNA, 17 bp, Homo sapiens
aagtacttatctttatt

SEQ ID NO: 4119058 - DNA, 21 bp, Homo sapiens
aagtacttgagtgtaatgttt

SEQ ID NO: 4119059 - DNA, 19 bp, Homo sapiens
aagtagaagtcttagatgt

SEQ ID NO: 4119060 - DNA, 20 bp, Homo sapiens
aagtagaagtcttagatgta

SEQ ID NO: 4119061 - DNA, 21 bp, Homo sapiens
aagtagaagtcttagatgtat

SEQ ID NO: 4119062 - DNA, 20 bp, Homo sapiens
aagtagaggttgtatacacc

SEQ ID NO: 4119063 - DNA, 15 bp, Homo sapiens
aagtaggaaaaataa

SEQ ID NO: 4119064 - DNA, 17 bp, Homo sapiens
aagtagtgtatcacagt

SEQ ID NO: 4119065 - DNA, 15 bp, Homo sapiens
aagtagttttatttt

SEQ ID NO: 4119066 - DNA, 19 bp, Homo sapiens
aagtagttttattttaata

SEQ ID NO: 4119067 - DNA, 19 bp, Homo sapiens
aagtatcactctaaaaaac

SEQ ID NO: 4119068 - DNA, 21 bp, Homo sapiens
aagtatcactctaaaaaacat

SEQ ID NO: 4119069 - DNA, 23 bp, Homo sapiens
aagtatcactctaaaaaacattt

SEQ ID NO: 4119070 - DNA, 16 bp, Homo sapiens
aagtatcctgcgacct

SEQ ID NO: 4119071 - DNA, 23 bp, Homo sapiens
aagtatcttctatttttatcatg

SEQ ID NO: 4119072 - DNA, 17 bp, Homo sapiens
aagtatgagggaaaatg

SEQ ID NO: 4119073 - DNA, 19 bp, Homo sapiens
aagtatgtgtaaaatgtga

SEQ ID NO: 4119074 - DNA, 23 bp, Homo sapiens
aagtattcttatttaatgaaaga

SEQ ID NO: 4119075 - DNA, 13 bp, Homo sapiens
aagtatttataat

SEQ ID NO: 4119076 - DNA, 12 bp, Homo sapiens
aagtatttatat

SEQ ID NO: 4119077 - DNA, 13 bp, Homo sapiens
aagtatttatata

SEQ ID NO: 4119078 - DNA, 15 bp, Homo sapiens
aagtatttatatatt

SEQ ID NO: 4119079 - DNA, 16 bp, Homo sapiens
aagtatttatatattt

SEQ ID NO: 4119080 - DNA, 23 bp, Homo sapiens
aagtatttatatatttataactc

SEQ ID NO: 4119081 - DNA, 12 bp, Homo sapiens
aagtatttctga

SEQ ID NO: 4119082 - DNA, 15 bp, Homo sapiens
aagtattttgaagtt

SEQ ID NO: 4119083 - DNA, 16 bp, Homo sapiens
aagtattttgaagttt

SEQ ID NO: 4119084 - DNA, 14 bp, Homo sapiens
aagtatttttgtct

SEQ ID NO: 4119085 - DNA, 15 bp, Homo sapiens
aagtcaaattaataa

SEQ ID NO: 4119086 - DNA, 22 bp, Homo sapiens
aagtcaatcatttctcactgtg

SEQ ID NO: 4119087 - DNA, 12 bp, Homo sapiens
aagtcacacagc

SEQ ID NO: 4119088 - DNA, 16 bp, Homo sapiens
aagtcacatcacagga

SEQ ID NO: 4119089 - DNA, 17 bp, Homo sapiens
aagtcacatcacaggac

SEQ ID NO: 4119090 - DNA, 16 bp, Homo sapiens
aagtcacccctttctg

SEQ ID NO: 4119091 - DNA, 17 bp, Homo sapiens
aagtcacccctttctgt

SEQ ID NO: 4119092 - DNA, 23 bp, Homo sapiens
aagtcacccctttctgtcccact

SEQ ID NO: 4119093 - DNA, 14 bp, Homo sapiens
aagtcactgcacag

SEQ ID NO: 4119094 - DNA, 20 bp, Homo sapiens
aagtcacttactattgttgc

SEQ ID NO: 4119095 - DNA, 22 bp, Homo sapiens
aagtcagctccagctttctgcc

SEQ ID NO: 4119096 - DNA, 19 bp, Homo sapiens
aagtcatgctcccctgtgc

SEQ ID NO: 4119097 - DNA, 17 bp, Homo sapiens
aagtcatggagaatctg

SEQ ID NO: 4119098 - DNA, 20 bp, Homo sapiens
aagtcatggcaggtacagta

SEQ ID NO: 4119099 - DNA, 18 bp, Homo sapiens
aagtcattttaactttat

SEQ ID NO: 4119100 - DNA, 20 bp, Homo sapiens
aagtcattttaactttatca

SEQ ID NO: 4119101 - DNA, 18 bp, Homo sapiens
aagtccgcagaagccctg

SEQ ID NO: 4119102 - DNA, 19 bp, Homo sapiens
aagtcctgactgggctggg

SEQ ID NO: 4119103 - DNA, 23 bp, Homo sapiens
aagtcctggctacatcccagcct

SEQ ID NO: 4119104 - DNA, 15 bp, Homo sapiens
aagtccttggactgt

SEQ ID NO: 4119105 - DNA, 16 bp, Homo sapiens
aagtcctttgtgaata

SEQ ID NO: 4119106 - DNA, 17 bp, Homo sapiens
aagtcctttgtgaatat

SEQ ID NO: 4119107 - DNA, 21 bp, Homo sapiens
aagtctaaacaaaattgcaat

SEQ ID NO: 4119108 - DNA, 13 bp, Homo sapiens
aagtctagagtct

SEQ ID NO: 4119109 - DNA, 20 bp, Homo sapiens
aagtctcacccattatctgg

SEQ ID NO: 4119110 - DNA, 21 bp, Homo sapiens
aagtctcactggctgtcagta

SEQ ID NO: 4119111 - DNA, 16 bp, Homo sapiens
aagtctccatgaagag

SEQ ID NO: 4119112 - DNA, 13 bp, Homo sapiens
aagtctcctgtct

SEQ ID NO: 4119113 - DNA, 23 bp, Homo sapiens
aagtctcctgtcttatggtccag

SEQ ID NO: 4119114 - DNA, 18 bp, Homo sapiens
aagtctctctgtgaatac

SEQ ID NO: 4119115 - DNA, 15 bp, Homo sapiens
aagtctctgctggcc

SEQ ID NO: 4119116 - DNA, 20 bp, Homo sapiens
aagtctgactctccactcct

SEQ ID NO: 4119117 - DNA, 20 bp, Homo sapiens
aagtcttaacaaaccaacat

SEQ ID NO: 4119118 - DNA, 12 bp, Homo sapiens
aagtcttcaggg

SEQ ID NO: 4119119 - DNA, 17 bp, Homo sapiens
aagtctttgccttctct

SEQ ID NO: 4119120 - DNA, 14 bp, Homo sapiens
aagtcttttgttcg

SEQ ID NO: 4119121 - DNA, 18 bp, Homo sapiens
aagtcttttgttcgcatg

SEQ ID NO: 4119122 - DNA, 15 bp, Homo sapiens
aagtcttttttttcc

SEQ ID NO: 4119123 - DNA, 13 bp, Homo sapiens
aagtgaaaatctt

SEQ ID NO: 4119124 - DNA, 16 bp, Homo sapiens
aagtgaaatcaaaggt

SEQ ID NO: 4119125 - DNA, 13 bp, Homo sapiens
aagtgaagactgg

SEQ ID NO: 4119126 - DNA, 16 bp, Homo sapiens
aagtgaagactggaag

SEQ ID NO: 4119127 - DNA, 14 bp, Homo sapiens
aagtgaagtgatac

SEQ ID NO: 4119128 - DNA, 20 bp, Homo sapiens
aagtgaatttgaatgaaaaa

SEQ ID NO: 4119129 - DNA, 20 bp, Homo sapiens
aagtgagaaagaaagtaaaa

SEQ ID NO: 4119130 - DNA, 15 bp, Homo sapiens
aagtgagcagtgttg

SEQ ID NO: 4119131 - DNA, 23 bp, Homo sapiens
aagtgatcaataaaatgtgattt

SEQ ID NO: 4119132 - DNA, 16 bp, Homo sapiens
aagtgcatccaaaggt

SEQ ID NO: 4119133 - DNA, 17 bp, Homo sapiens
aagtgccaaatgctctc

SEQ ID NO: 4119134 - DNA, 23 bp, Homo sapiens
aagtgccactgcccgagctggtg

SEQ ID NO: 4119135 - DNA, 15 bp, Homo sapiens
aagtgccccctcacc

SEQ ID NO: 4119136 - DNA, 16 bp, Homo sapiens
aagtgccccctcacct

SEQ ID NO: 4119137 - DNA, 14 bp, Homo sapiens
aagtgcctgagctg

SEQ ID NO: 4119138 - DNA, 20 bp, Homo sapiens
aagtgccttctccttcccca

SEQ ID NO: 4119139 - DNA, 17 bp, Homo sapiens
aagtgcggtgctttagc

SEQ ID NO: 4119140 - DNA, 18 bp, Homo sapiens
aagtgcgtgtgtagagtt

SEQ ID NO: 4119141 - DNA, 22 bp, Homo sapiens
aagtgctcttggctgacccctc

SEQ ID NO: 4119142 - DNA, 23 bp, Homo sapiens
aagtgctcttggctgacccctct

SEQ ID NO: 4119143 - DNA, 11 bp, Homo sapiens
aagtgctggga

SEQ ID NO: 4119144 - DNA, 17 bp, Homo sapiens
aagtgctgttgggatat

SEQ ID NO: 4119145 - DNA, 22 bp, Homo sapiens
aagtggacagagcgcccctccc

SEQ ID NO: 4119146 - DNA, 22 bp, Homo sapiens
aagtggaccttaggccttcctc

SEQ ID NO: 4119147 - DNA, 20 bp, Homo sapiens
aagtggaccttgagaccaca

SEQ ID NO: 4119148 - DNA, 13 bp, Homo sapiens
aagtggcacctgt

SEQ ID NO: 4119149 - DNA, 13 bp, Homo sapiens
aagtggctgcctt

SEQ ID NO: 4119150 - DNA, 16 bp, Homo sapiens
aagtgggcttgattct

SEQ ID NO: 4119151 - DNA, 22 bp, Homo sapiens
aagtgggcttgattctgcagta

SEQ ID NO: 4119152 - DNA, 17 bp, Homo sapiens
aagtggggatggggcct

SEQ ID NO: 4119153 - DNA, 18 bp, Homo sapiens
aagtggggtgctgggagg

SEQ ID NO: 4119154 - DNA, 16 bp, Homo sapiens
aagtggggtgttcttc

SEQ ID NO: 4119155 - DNA, 14 bp, Homo sapiens
aagtgtaacagctg

SEQ ID NO: 4119156 - DNA, 15 bp, Homo sapiens
aagtgtaacagctga

SEQ ID NO: 4119157 - DNA, 15 bp, Homo sapiens
aagtgtgagcagtga

SEQ ID NO: 4119158 - DNA, 18 bp, Homo sapiens
aagtgtgagtaagagctg

SEQ ID NO: 4119159 - DNA, 19 bp, Homo sapiens
aagtgtgagtaagagctgg

SEQ ID NO: 4119160 - DNA, 20 bp, Homo sapiens
aagtgtggggattttcactg

SEQ ID NO: 4119161 - DNA, 18 bp, Homo sapiens
aagtgttgaagggaggtg

SEQ ID NO: 4119162 - DNA, 18 bp, Homo sapiens
aagtgttgtaaatattta

SEQ ID NO: 4119163 - DNA, 22 bp, Homo sapiens
aagtgttgtaaatatttatgta

SEQ ID NO: 4119164 - DNA, 12 bp, Homo sapiens
aagtgttgtatc

SEQ ID NO: 4119165 - DNA, 16 bp, Homo sapiens
aagtgttgtgttcctg

SEQ ID NO: 4119166 - DNA, 23 bp, Homo sapiens
aagtgttttattttcaaatctgg

SEQ ID NO: 4119167 - DNA, 12 bp, Homo sapiens
aagttaaataaa

SEQ ID NO: 4119168 - DNA, 14 bp, Homo sapiens
aagttaaataaatc

SEQ ID NO: 4119169 - DNA, 15 bp, Homo sapiens
aagttaacaaggaat

SEQ ID NO: 4119170 - DNA, 17 bp, Homo sapiens
aagttaacaaggaatgc

SEQ ID NO: 4119171 - DNA, 13 bp, Homo sapiens
aagttaacagaga

SEQ ID NO: 4119172 - DNA, 18 bp, Homo sapiens
aagttaagagaaacttta

SEQ ID NO: 4119173 - DNA, 20 bp, Homo sapiens
aagttaagagaaactttata

SEQ ID NO: 4119174 - DNA, 13 bp, Homo sapiens
aagttaataatgt

SEQ ID NO: 4119175 - DNA, 16 bp, Homo sapiens
aagttaataatgtatt

SEQ ID NO: 4119176 - DNA, 13 bp, Homo sapiens
aagttaattcacc

SEQ ID NO: 4119177 - DNA, 21 bp, Homo sapiens
aagttacacagaaatgctgct

SEQ ID NO: 4119178 - DNA, 15 bp, Homo sapiens
aagttacatgcataa

SEQ ID NO: 4119179 - DNA, 16 bp, Homo sapiens
aagttacatgcataaa

SEQ ID NO: 4119180 - DNA, 14 bp, Homo sapiens
aagttactttgtaa

SEQ ID NO: 4119181 - DNA, 17 bp, Homo sapiens
aagttactttgtaattt

SEQ ID NO: 4119182 - DNA, 18 bp, Homo sapiens
aagttataaatcaatgtc

SEQ ID NO: 4119183 - DNA, 20 bp, Homo sapiens
aagttataaatcaatgtcac

SEQ ID NO: 4119184 - DNA, 17 bp, Homo sapiens
aagttatagtatatctg

SEQ ID NO: 4119185 - DNA, 17 bp, Homo sapiens
aagttatagtgaatact

SEQ ID NO: 4119186 - DNA, 14 bp, Homo sapiens
aagttatttacttt

SEQ ID NO: 4119187 - DNA, 15 bp, Homo sapiens
aagttatttcttgtt

SEQ ID NO: 4119188 - DNA, 14 bp, Homo sapiens
aagttattttctac

SEQ ID NO: 4119189 - DNA, 18 bp, Homo sapiens
aagttattttctacagtg

SEQ ID NO: 4119190 - DNA, 15 bp, Homo sapiens
aagttatttttgtac

SEQ ID NO: 4119191 - DNA, 21 bp, Homo sapiens
aagttcacgtaagatacaagt

SEQ ID NO: 4119192 - DNA, 13 bp, Homo sapiens
aagttcagggacc

SEQ ID NO: 4119193 - DNA, 21 bp, Homo sapiens
aagttcatattccatatttat

SEQ ID NO: 4119194 - DNA, 18 bp, Homo sapiens
aagttctagagaagaggc

SEQ ID NO: 4119195 - DNA, 16 bp, Homo sapiens
aagttctatgaagagt

SEQ ID NO: 4119196 - DNA, 9 bp, Homo sapiens
aagttctta

SEQ ID NO: 4119197 - DNA, 20 bp, Homo sapiens
aagttcttatgaggagggga

SEQ ID NO: 4119198 - DNA, 16 bp, Homo sapiens
aagttgacttatagta

SEQ ID NO: 4119199 - DNA, 21 bp, Homo sapiens
aagttgacttatagtacatga

SEQ ID NO: 4119200 - DNA, 15 bp, Homo sapiens
aagttgagattttta

SEQ ID NO: 4119201 - DNA, 23 bp, Homo sapiens
aagttgagatttttaagaacttc

SEQ ID NO: 4119202 - DNA, 17 bp, Homo sapiens
aagttgaggattgttga

SEQ ID NO: 4119203 - DNA, 16 bp, Homo sapiens
aagttgcagatgtatt

SEQ ID NO: 4119204 - DNA, 22 bp, Homo sapiens
aagttgcagatgtattgactgt

SEQ ID NO: 4119205 - DNA, 18 bp, Homo sapiens
aagttgcatttagaaatc

SEQ ID NO: 4119206 - DNA, 19 bp, Homo sapiens
aagttgcatttagaaatca

SEQ ID NO: 4119207 - DNA, 23 bp, Homo sapiens
aagttgcatttagaaatcaagca

SEQ ID NO: 4119208 - DNA, 20 bp, Homo sapiens
aagttgcgacggagagaaaa

SEQ ID NO: 4119209 - DNA, 22 bp, Homo sapiens
aagttggaaccgtgtccagcac

SEQ ID NO: 4119210 - DNA, 23 bp, Homo sapiens
aagttggaaccgtgtccagcaca

SEQ ID NO: 4119211 - DNA, 21 bp, Homo sapiens
aagttgggttaataccagctt

SEQ ID NO: 4119212 - DNA, 11 bp, Homo sapiens
aagttgtacaa

SEQ ID NO: 4119213 - DNA, 16 bp, Homo sapiens
aagttgtacaaatgta

SEQ ID NO: 4119214 - DNA, 12 bp, Homo sapiens
aagtttaaaaca

SEQ ID NO: 4119215 - DNA, 18 bp, Homo sapiens
aagtttaaaacagtattt

SEQ ID NO: 4119216 - DNA, 17 bp, Homo sapiens
aagtttaaatgtatttt

SEQ ID NO: 4119217 - DNA, 20 bp, Homo sapiens
aagtttaaatgtattttaca

SEQ ID NO: 4119218 - DNA, 16 bp, Homo sapiens
aagtttaattgtctca

SEQ ID NO: 4119219 - DNA, 18 bp, Homo sapiens
aagtttacattgtaaata

SEQ ID NO: 4119220 - DNA, 12 bp, Homo sapiens
aagtttacattt

SEQ ID NO: 4119221 - DNA, 13 bp, Homo sapiens
aagtttacatttt

SEQ ID NO: 4119222 - DNA, 22 bp, Homo sapiens
aagtttacatttttatttatga

SEQ ID NO: 4119223 - DNA, 22 bp, Homo sapiens
aagtttcaaacttactattttg

SEQ ID NO: 4119224 - DNA, 14 bp, Homo sapiens
aagtttcaggtgac

SEQ ID NO: 4119225 - DNA, 19 bp, Homo sapiens
aagtttcaggtgacatgtg

SEQ ID NO: 4119226 - DNA, 19 bp, Homo sapiens
aagtttcagtattagatgc

SEQ ID NO: 4119227 - DNA, 20 bp, Homo sapiens
aagtttccatagcaacagga

SEQ ID NO: 4119228 - DNA, 16 bp, Homo sapiens
aagtttccatcatcta

SEQ ID NO: 4119229 - DNA, 21 bp, Homo sapiens
aagtttctagctagaaatatg

SEQ ID NO: 4119230 - DNA, 23 bp, Homo sapiens
aagtttctagctagaaatatgat

SEQ ID NO: 4119231 - DNA, 12 bp, Homo sapiens
aagtttctattc

SEQ ID NO: 4119232 - DNA, 14 bp, Homo sapiens
aagtttctattctg

SEQ ID NO: 4119233 - DNA, 16 bp, Homo sapiens
aagtttgcttagaaaa

SEQ ID NO: 4119234 - DNA, 23 bp, Homo sapiens
aagtttgttagatagctgcatgt

SEQ ID NO: 4119235 - DNA, 13 bp, Homo sapiens
aagttttctgtag

SEQ ID NO: 4119236 - DNA, 16 bp, Homo sapiens
aagttttgaaaagcta

SEQ ID NO: 4119237 - DNA, 19 bp, Homo sapiens
aagttttgtaaaagaaatc

SEQ ID NO: 4119238 - DNA, 15 bp, Homo sapiens
aagtttttagaatgt

SEQ ID NO: 4119239 - DNA, 12 bp, Homo sapiens
aagtttttttgc

SEQ ID NO: 4119240 - DNA, 23 bp, Homo sapiens
aataaaaaagaacttttgtatct

SEQ ID NO: 4119241 - DNA, 20 bp, Homo sapiens
aataaaaacattttgaagtg

SEQ ID NO: 4119242 - DNA, 16 bp, Homo sapiens
aataaaaataaatttg

SEQ ID NO: 4119243 - DNA, 22 bp, Homo sapiens
aataaaaatattgtgttgtgaa

SEQ ID NO: 4119244 - DNA, 13 bp, Homo sapiens
aataaaaatggat

SEQ ID NO: 4119245 - DNA, 12 bp, Homo sapiens
aataaaactgaa

SEQ ID NO: 4119246 - DNA, 13 bp, Homo sapiens
aataaaactgaat

SEQ ID NO: 4119247 - DNA, 13 bp, Homo sapiens
aataaaacttcac

SEQ ID NO: 4119248 - DNA, 18 bp, Homo sapiens
aataaaagcagcatctgc

SEQ ID NO: 4119249 - DNA, 21 bp, Homo sapiens
aataaaaggaagccaaagagt

SEQ ID NO: 4119250 - DNA, 15 bp, Homo sapiens
aataaaataattcta

SEQ ID NO: 4119251 - DNA, 16 bp, Homo sapiens
aataaaattcatttct

SEQ ID NO: 4119252 - DNA, 20 bp, Homo sapiens
aataaacctcaaaatgtcta

SEQ ID NO: 4119253 - DNA, 17 bp, Homo sapiens
aataaactactctttga

SEQ ID NO: 4119254 - DNA, 12 bp, Homo sapiens
aataaactgaat

SEQ ID NO: 4119255 - DNA, 12 bp, Homo sapiens
aataaagaaata

SEQ ID NO: 4119256 - DNA, 18 bp, Homo sapiens
aataaagacactggcaga

SEQ ID NO: 4119257 - DNA, 18 bp, Homo sapiens
aataaagcttgtggcccc

SEQ ID NO: 4119258 - DNA, 11 bp, Homo sapiens
aataaaggact

SEQ ID NO: 4119259 - DNA, 16 bp, Homo sapiens
aataaaggatgtgatt

SEQ ID NO: 4119260 - DNA, 23 bp, Homo sapiens
aataaaggcagctgttgtctctt

SEQ ID NO: 4119261 - DNA, 15 bp, Homo sapiens
aataaagtatatata

SEQ ID NO: 4119262 - DNA, 18 bp, Homo sapiens
aataaagtgtaacaattg

SEQ ID NO: 4119263 - DNA, 19 bp, Homo sapiens
aataaagttctgagtgttt

SEQ ID NO: 4119264 - DNA, 23 bp, Homo sapiens
aataaataaaattcatttctaca

SEQ ID NO: 4119265 - DNA, 14 bp, Homo sapiens
aataaataatttta

SEQ ID NO: 4119266 - DNA, 23 bp, Homo sapiens
aataaatactgcagcttgagttt

SEQ ID NO: 4119267 - DNA, 21 bp, Homo sapiens
aataaatagctatatccatgt

SEQ ID NO: 4119268 - DNA, 19 bp, Homo sapiens
aataaatctcttctttgct

SEQ ID NO: 4119269 - DNA, 16 bp, Homo sapiens
aataaatctgacccag

SEQ ID NO: 4119270 - DNA, 20 bp, Homo sapiens
aataaatctgacccagtgcc

SEQ ID NO: 4119271 - DNA, 15 bp, Homo sapiens
aataaatctttcaaa

SEQ ID NO: 4119272 - DNA, 16 bp, Homo sapiens
aataaatgccctcttc

SEQ ID NO: 4119273 - DNA, 16 bp, Homo sapiens
aataaattaatattgt

SEQ ID NO: 4119274 - DNA, 21 bp, Homo sapiens
aataaattaatattgtattgc

SEQ ID NO: 4119275 - DNA, 14 bp, Homo sapiens
aataaattagttgt

SEQ ID NO: 4119276 - DNA, 21 bp, Homo sapiens
aataaattcccaacttctctt

SEQ ID NO: 4119277 - DNA, 15 bp, Homo sapiens
aataaattctgattc

SEQ ID NO: 4119278 - DNA, 20 bp, Homo sapiens
aataaattctgattcttcta

SEQ ID NO: 4119279 - DNA, 14 bp, Homo sapiens
aataaattgaaatt

SEQ ID NO: 4119280 - DNA, 16 bp, Homo sapiens
aataacacagagagac

SEQ ID NO: 4119281 - DNA, 13 bp, Homo sapiens
aataacagccgct

SEQ ID NO: 4119282 - DNA, 12 bp, Homo sapiens
aataacatgtaa

SEQ ID NO: 4119283 - DNA, 13 bp, Homo sapiens
aataacatttgtg

SEQ ID NO: 4119284 - DNA, 15 bp, Homo sapiens
aataactaaaaggta

SEQ ID NO: 4119285 - DNA, 14 bp, Homo sapiens
aataactactgtgt

SEQ ID NO: 4119286 - DNA, 15 bp, Homo sapiens
aataactactgtgtt

SEQ ID NO: 4119287 - DNA, 16 bp, Homo sapiens
aataactgtgaagttt

SEQ ID NO: 4119288 - DNA, 15 bp, Homo sapiens
aataacttctgacct

SEQ ID NO: 4119289 - DNA, 12 bp, Homo sapiens
aataagaaatga

SEQ ID NO: 4119290 - DNA, 17 bp, Homo sapiens
aataagacataacgttt

SEQ ID NO: 4119291 - DNA, 15 bp, Homo sapiens
aataagagaaagaaa

SEQ ID NO: 4119292 - DNA, 16 bp, Homo sapiens
aataaggaagagggct

SEQ ID NO: 4119293 - DNA, 21 bp, Homo sapiens
aataagtatttctgattttgt

SEQ ID NO: 4119294 - DNA, 14 bp, Homo sapiens
aataataaatattt

SEQ ID NO: 4119295 - DNA, 11 bp, Homo sapiens
aataatataat

SEQ ID NO: 4119296 - DNA, 12 bp, Homo sapiens
aataatatgcat

SEQ ID NO: 4119297 - DNA, 17 bp, Homo sapiens
aataatatgcattgtca

SEQ ID NO: 4119298 - DNA, 12 bp, Homo sapiens
aataatattgtt

SEQ ID NO: 4119299 - DNA, 15 bp, Homo sapiens
aataatcatgtgaaa

SEQ ID NO: 4119300 - DNA, 19 bp, Homo sapiens
aataatccagtattgctga

SEQ ID NO: 4119301 - DNA, 16 bp, Homo sapiens
aataatccctgtaata

SEQ ID NO: 4119302 - DNA, 23 bp, Homo sapiens
aataatccctgtaatatttagct

SEQ ID NO: 4119303 - DNA, 13 bp, Homo sapiens
aataatcttatta

SEQ ID NO: 4119304 - DNA, 14 bp, Homo sapiens
aataatctttgggt

SEQ ID NO: 4119305 - DNA, 18 bp, Homo sapiens
aataatgaataaactgaa

SEQ ID NO: 4119306 - DNA, 11 bp, Homo sapiens
aataatgctgc

SEQ ID NO: 4119307 - DNA, 12 bp, Homo sapiens
aataatgctgca

SEQ ID NO: 4119308 - DNA, 14 bp, Homo sapiens
aataatgcttcaga

SEQ ID NO: 4119309 - DNA, 13 bp, Homo sapiens
aataatggaaaca

SEQ ID NO: 4119310 - DNA, 20 bp, Homo sapiens
aataatggaaacattacagt

SEQ ID NO: 4119311 - DNA, 17 bp, Homo sapiens
aataatgtagttttgtt

SEQ ID NO: 4119312 - DNA, 19 bp, Homo sapiens
aataatgtattgtaatctt

SEQ ID NO: 4119313 - DNA, 15 bp, Homo sapiens
aataatttgtaaatg

SEQ ID NO: 4119314 - DNA, 11 bp, Homo sapiens
aataattttat

SEQ ID NO: 4119315 - DNA, 11 bp, Homo sapiens
aatacaaagta

SEQ ID NO: 4119316 - DNA, 15 bp, Homo sapiens
aatacaaagtaaata

SEQ ID NO: 4119317 - DNA, 13 bp, Homo sapiens
aatacaaatctgt

SEQ ID NO: 4119318 - DNA, 18 bp, Homo sapiens
aatacaaatctgtataaa

SEQ ID NO: 4119319 - DNA, 13 bp, Homo sapiens
aatacaattaaag

SEQ ID NO: 4119320 - DNA, 15 bp, Homo sapiens
aatacaattaaaggt

SEQ ID NO: 4119321 - DNA, 21 bp, Homo sapiens
aatacaccacctcactcctgt

SEQ ID NO: 4119322 - DNA, 13 bp, Homo sapiens
aatacagacacta

SEQ ID NO: 4119323 - DNA, 21 bp, Homo sapiens
aatacagacactaagttatag

SEQ ID NO: 4119324 - DNA, 17 bp, Homo sapiens
aatacagataacattag

SEQ ID NO: 4119325 - DNA, 13 bp, Homo sapiens
aatacaggacttt

SEQ ID NO: 4119326 - DNA, 16 bp, Homo sapiens
aatacagggcattttg

SEQ ID NO: 4119327 - DNA, 12 bp, Homo sapiens
aatacagtgtta

SEQ ID NO: 4119328 - DNA, 17 bp, Homo sapiens
aatacagttctgtcata

SEQ ID NO: 4119329 - DNA, 16 bp, Homo sapiens
aatacatttaaaactt

SEQ ID NO: 4119330 - DNA, 19 bp, Homo sapiens
aatacctcttactttgctt

SEQ ID NO: 4119331 - DNA, 11 bp, Homo sapiens
aatactaaaag

SEQ ID NO: 4119332 - DNA, 13 bp, Homo sapiens
aatactaaaagca

SEQ ID NO: 4119333 - DNA, 15 bp, Homo sapiens
aatactaaaagcaaa

SEQ ID NO: 4119334 - DNA, 23 bp, Homo sapiens
aatactaaaagcaaatctacaga

SEQ ID NO: 4119335 - DNA, 14 bp, Homo sapiens
aatactaccttgaa

SEQ ID NO: 4119336 - DNA, 21 bp, Homo sapiens
aatactaccttgaaaataaga

SEQ ID NO: 4119337 - DNA, 13 bp, Homo sapiens
aatactcaaatga

SEQ ID NO: 4119338 - DNA, 23 bp, Homo sapiens
aatactcttaggaagagaaacca

SEQ ID NO: 4119339 - DNA, 15 bp, Homo sapiens
aatactggaataatt

SEQ ID NO: 4119340 - DNA, 17 bp, Homo sapiens
aatactgtgcagaataa

SEQ ID NO: 4119341 - DNA, 19 bp, Homo sapiens
aatactgtgcagaataatg

SEQ ID NO: 4119342 - DNA, 17 bp, Homo sapiens
aatactttaaaggaaaa

SEQ ID NO: 4119343 - DNA, 14 bp, Homo sapiens
aatactttatttct

SEQ ID NO: 4119344 - DNA, 18 bp, Homo sapiens
aatacttttactctgcct

SEQ ID NO: 4119345 - DNA, 10 bp, Homo sapiens
aatacttttt

SEQ ID NO: 4119346 - DNA, 15 bp, Homo sapiens
aatagaaaatggtcc

SEQ ID NO: 4119347 - DNA, 12 bp, Homo sapiens
aatagaaacaag

SEQ ID NO: 4119348 - DNA, 15 bp, Homo sapiens
aatagaaagaagcca

SEQ ID NO: 4119349 - DNA, 22 bp, Homo sapiens
aatagaaataaaggatgtgatt

SEQ ID NO: 4119350 - DNA, 13 bp, Homo sapiens
aatagaaatagct

SEQ ID NO: 4119351 - DNA, 15 bp, Homo sapiens
aatagaaattttgta

SEQ ID NO: 4119352 - DNA, 17 bp, Homo sapiens
aatagaactatctgcat

SEQ ID NO: 4119353 - DNA, 22 bp, Homo sapiens
aatagaactatctgcattatct

SEQ ID NO: 4119354 - DNA, 20 bp, Homo sapiens
aatagaatataattatcgga

SEQ ID NO: 4119355 - DNA, 21 bp, Homo sapiens
aatagaatgtggccacttatt

SEQ ID NO: 4119356 - DNA, 14 bp, Homo sapiens
aatagacaaataga

SEQ ID NO: 4119357 - DNA, 22 bp, Homo sapiens
aatagacactccccgaagtctt

SEQ ID NO: 4119358 - DNA, 14 bp, Homo sapiens
aatagagactgtag

SEQ ID NO: 4119359 - DNA, 15 bp, Homo sapiens
aatagagtatatgca

SEQ ID NO: 4119360 - DNA, 13 bp, Homo sapiens
aatagcaactttt

SEQ ID NO: 4119361 - DNA, 17 bp, Homo sapiens
aatagcaacttttgtgt

SEQ ID NO: 4119362 - DNA, 19 bp, Homo sapiens
aatagcaacttttgtgtaa

SEQ ID NO: 4119363 - DNA, 21 bp, Homo sapiens
aatagcaaggctgtgcatcta

SEQ ID NO: 4119364 - DNA, 23 bp, Homo sapiens
aatagccacatttggaatacttt

SEQ ID NO: 4119365 - DNA, 12 bp, Homo sapiens
aatagcctggcc

SEQ ID NO: 4119366 - DNA, 14 bp, Homo sapiens
aatagcctggccac

SEQ ID NO: 4119367 - DNA, 15 bp, Homo sapiens
aatagctatatccat

SEQ ID NO: 4119368 - DNA, 22 bp, Homo sapiens
aatagctatatccatgtactgt

SEQ ID NO: 4119369 - DNA, 23 bp, Homo sapiens
aatagctatatccatgtactgta

SEQ ID NO: 4119370 - DNA, 21 bp, Homo sapiens
aataggaatcttcactagaag

SEQ ID NO: 4119371 - DNA, 15 bp, Homo sapiens
aataggagaggatga

SEQ ID NO: 4119372 - DNA, 14 bp, Homo sapiens
aataggcctattta

SEQ ID NO: 4119373 - DNA, 23 bp, Homo sapiens
aatagggagacagggtaggaaag

SEQ ID NO: 4119374 - DNA, 15 bp, Homo sapiens
aataggggatattta

SEQ ID NO: 4119375 - DNA, 16 bp, Homo sapiens
aataggggatatttaa

SEQ ID NO: 4119376 - DNA, 18 bp, Homo sapiens
aataggtagtttggatat

SEQ ID NO: 4119377 - DNA, 21 bp, Homo sapiens
aataggtagtttggatatttt

SEQ ID NO: 4119378 - DNA, 20 bp, Homo sapiens
aatagtatttgagagttcta

SEQ ID NO: 4119379 - DNA, 14 bp, Homo sapiens
aatagtctgtgtga

SEQ ID NO: 4119380 - DNA, 13 bp, Homo sapiens
aatagtgcttttt

SEQ ID NO: 4119381 - DNA, 14 bp, Homo sapiens
aatagtgtgttctg

SEQ ID NO: 4119382 - DNA, 22 bp, Homo sapiens
aatagtgtgttctgattagaaa

SEQ ID NO: 4119383 - DNA, 21 bp, Homo sapiens
aatagttaagacatgatttcc

SEQ ID NO: 4119384 - DNA, 13 bp, Homo sapiens
aatagttattatt

SEQ ID NO: 4119385 - DNA, 19 bp, Homo sapiens
aatagttattatttaattg

SEQ ID NO: 4119386 - DNA, 16 bp, Homo sapiens
aatagtttaggagaaa

SEQ ID NO: 4119387 - DNA, 14 bp, Homo sapiens
aatagtttgtctat

SEQ ID NO: 4119388 - DNA, 17 bp, Homo sapiens
aatagtttgtctatttt

SEQ ID NO: 4119389 - DNA, 15 bp, Homo sapiens
aatataaaaacattt

SEQ ID NO: 4119390 - DNA, 14 bp, Homo sapiens
aatataaaatatga

SEQ ID NO: 4119391 - DNA, 12 bp, Homo sapiens
aatataaacatc

SEQ ID NO: 4119392 - DNA, 20 bp, Homo sapiens
aatataaaccgtggtctcat

SEQ ID NO: 4119393 - DNA, 13 bp, Homo sapiens
aatataaagctta

SEQ ID NO: 4119394 - DNA, 17 bp, Homo sapiens
aatataagacatttgtt

SEQ ID NO: 4119395 - DNA, 21 bp, Homo sapiens
aatataataatagttattatt

SEQ ID NO: 4119396 - DNA, 11 bp, Homo sapiens
aatataattat

SEQ ID NO: 4119397 - DNA, 17 bp, Homo sapiens
aatatagattagaaaaa

SEQ ID NO: 4119398 - DNA, 14 bp, Homo sapiens
aatatataatttat

SEQ ID NO: 4119399 - DNA, 13 bp, Homo sapiens
aatatatatgaat

SEQ ID NO: 4119400 - DNA, 14 bp, Homo sapiens
aatatatattttgt

SEQ ID NO: 4119401 - DNA, 13 bp, Homo sapiens
aatatattataat

SEQ ID NO: 4119402 - DNA, 16 bp, Homo sapiens
aatatattataatctt

SEQ ID NO: 4119403 - DNA, 19 bp, Homo sapiens
aatatattgaacttttgta

SEQ ID NO: 4119404 - DNA, 15 bp, Homo sapiens
aatatatttcagata

SEQ ID NO: 4119405 - DNA, 18 bp, Homo sapiens
aatatatttttagactca

SEQ ID NO: 4119406 - DNA, 14 bp, Homo sapiens
aatatcaatcaagc

SEQ ID NO: 4119407 - DNA, 15 bp, Homo sapiens
aatatcacagtatta

SEQ ID NO: 4119408 - DNA, 17 bp, Homo sapiens
aatatccctacatgtat

SEQ ID NO: 4119409 - DNA, 19 bp, Homo sapiens
aatatccctacatgtattg

SEQ ID NO: 4119410 - DNA, 14 bp, Homo sapiens
aatatcgtgtgtgt

SEQ ID NO: 4119411 - DNA, 16 bp, Homo sapiens
aatatctattaatata

SEQ ID NO: 4119412 - DNA, 16 bp, Homo sapiens
aatatctgaaaatgta

SEQ ID NO: 4119413 - DNA, 17 bp, Homo sapiens
aatatctgaaaatgtat

SEQ ID NO: 4119414 - DNA, 18 bp, Homo sapiens
aatatctgaaaatgtatg

SEQ ID NO: 4119415 - DNA, 20 bp, Homo sapiens
aatatctgaaaatgtatgtg

SEQ ID NO: 4119416 - DNA, 22 bp, Homo sapiens
aatatctgtgaggtgctgatga

SEQ ID NO: 4119417 - DNA, 15 bp, Homo sapiens
aatatcttttatgtt

SEQ ID NO: 4119418 - DNA, 14 bp, Homo sapiens
aatatgaaaactta

SEQ ID NO: 4119419 - DNA, 20 bp, Homo sapiens
aatatgaatctgctcacttt

SEQ ID NO: 4119420 - DNA, 22 bp, Homo sapiens
aatatgaattcaagaaaggaaa

SEQ ID NO: 4119421 - DNA, 17 bp, Homo sapiens
aatatgcaacattgtcc

SEQ ID NO: 4119422 - DNA, 14 bp, Homo sapiens
aatatgccccttct

SEQ ID NO: 4119423 - DNA, 18 bp, Homo sapiens
aatatggaaccttccctc

SEQ ID NO: 4119424 - DNA, 14 bp, Homo sapiens
aatatggaacttac

SEQ ID NO: 4119425 - DNA, 21 bp, Homo sapiens
aatatggacacttaatactac

SEQ ID NO: 4119426 - DNA, 17 bp, Homo sapiens
aatatgtatatgacatt

SEQ ID NO: 4119427 - DNA, 12 bp, Homo sapiens
aatatgtcctgg

SEQ ID NO: 4119428 - DNA, 14 bp, Homo sapiens
aatatgtgagattt

SEQ ID NO: 4119429 - DNA, 21 bp, Homo sapiens
aatatgtgagtgccttttgca

SEQ ID NO: 4119430 - DNA, 13 bp, Homo sapiens
aatatgtttcctt

SEQ ID NO: 4119431 - DNA, 14 bp, Homo sapiens
aatatgtttccttg

SEQ ID NO: 4119432 - DNA, 18 bp, Homo sapiens
aatatgtttccttgttta

SEQ ID NO: 4119433 - DNA, 19 bp, Homo sapiens
aatatgtttccttgtttat

SEQ ID NO: 4119434 - DNA, 21 bp, Homo sapiens
aatatgttttttagatcaaat

SEQ ID NO: 4119435 - DNA, 22 bp, Homo sapiens
aatatgttttttagatcaaata

SEQ ID NO: 4119436 - DNA, 14 bp, Homo sapiens
aatattaaatacag

SEQ ID NO: 4119437 - DNA, 16 bp, Homo sapiens
aatattaaatacagac

SEQ ID NO: 4119438 - DNA, 20 bp, Homo sapiens
aatattaaatacagacacta

SEQ ID NO: 4119439 - DNA, 21 bp, Homo sapiens
aatattaaatctgctggagtt

SEQ ID NO: 4119440 - DNA, 18 bp, Homo sapiens
aatattagttaatggatt

SEQ ID NO: 4119441 - DNA, 19 bp, Homo sapiens
aatattcctccaaatctct

SEQ ID NO: 4119442 - DNA, 20 bp, Homo sapiens
aatattctatatgaatttaa

SEQ ID NO: 4119443 - DNA, 21 bp, Homo sapiens
aatattcttttgtttccatgg

SEQ ID NO: 4119444 - DNA, 15 bp, Homo sapiens
aatattgacatttgt

SEQ ID NO: 4119445 - DNA, 16 bp, Homo sapiens
aatattgacatttgta

SEQ ID NO: 4119446 - DNA, 14 bp, Homo sapiens
aatattgaggcttt

SEQ ID NO: 4119447 - DNA, 17 bp, Homo sapiens
aatattgatatgcttat

SEQ ID NO: 4119448 - DNA, 21 bp, Homo sapiens
aatattgtattgctgctgtgc

SEQ ID NO: 4119449 - DNA, 23 bp, Homo sapiens
aatattgtgaagaaaaataaagt

SEQ ID NO: 4119450 - DNA, 17 bp, Homo sapiens
aatattgtgttgtgaat

SEQ ID NO: 4119451 - DNA, 18 bp, Homo sapiens
aatattgtgttgtgaatg

SEQ ID NO: 4119452 - DNA, 14 bp, Homo sapiens
aatattgtttctgc

SEQ ID NO: 4119453 - DNA, 23 bp, Homo sapiens
aatattgtttctgcattcatttt

SEQ ID NO: 4119454 - DNA, 14 bp, Homo sapiens
aatatttaaacagc

SEQ ID NO: 4119455 - DNA, 17 bp, Homo sapiens
aatatttaaacagcagt

SEQ ID NO: 4119456 - DNA, 22 bp, Homo sapiens
aatatttaaacatggttacaat

SEQ ID NO: 4119457 - DNA, 12 bp, Homo sapiens
aatatttaagac

SEQ ID NO: 4119458 - DNA, 13 bp, Homo sapiens
aatatttataaaa

SEQ ID NO: 4119459 - DNA, 16 bp, Homo sapiens
aatatttataaaactt

SEQ ID NO: 4119460 - DNA, 17 bp, Homo sapiens
aatatttataaaacttc

SEQ ID NO: 4119461 - DNA, 19 bp, Homo sapiens
aatatttataaaacttctc

SEQ ID NO: 4119462 - DNA, 12 bp, Homo sapiens
aatatttataac

SEQ ID NO: 4119463 - DNA, 17 bp, Homo sapiens
aatatttatatatttat

SEQ ID NO: 4119464 - DNA, 18 bp, Homo sapiens
aatatttatatttcacta

SEQ ID NO: 4119465 - DNA, 12 bp, Homo sapiens
aatatttatgga

SEQ ID NO: 4119466 - DNA, 19 bp, Homo sapiens
aatatttatgtctatttaa

SEQ ID NO: 4119467 - DNA, 21 bp, Homo sapiens
aatatttatgtctatttaagc

SEQ ID NO: 4119468 - DNA, 23 bp, Homo sapiens
aatatttatgtctatttaagcct

SEQ ID NO: 4119469 - DNA, 12 bp, Homo sapiens
aatatttattaa

SEQ ID NO: 4119470 - DNA, 18 bp, Homo sapiens
aatatttattaaataaaa

SEQ ID NO: 4119471 - DNA, 21 bp, Homo sapiens
aatatttattaaataaaatca

SEQ ID NO: 4119472 - DNA, 15 bp, Homo sapiens
aatatttattacctc

SEQ ID NO: 4119473 - DNA, 16 bp, Homo sapiens
aatatttccatatgga

SEQ ID NO: 4119474 - DNA, 23 bp, Homo sapiens
aatatttccatatggattttcta

SEQ ID NO: 4119475 - DNA, 12 bp, Homo sapiens
aatatttcctga

SEQ ID NO: 4119476 - DNA, 16 bp, Homo sapiens
aatatttgacttgcat

SEQ ID NO: 4119477 - DNA, 21 bp, Homo sapiens
aatatttgacttgcatgaaga

SEQ ID NO: 4119478 - DNA, 22 bp, Homo sapiens
aatatttgacttgcatgaagag

SEQ ID NO: 4119479 - DNA, 23 bp, Homo sapiens
aatatttgacttgcatgaagaga

SEQ ID NO: 4119480 - DNA, 14 bp, Homo sapiens
aatattttcaacta

SEQ ID NO: 4119481 - DNA, 18 bp, Homo sapiens
aatattttctttaatgct

SEQ ID NO: 4119482 - DNA, 16 bp, Homo sapiens
aatatttttatataca

SEQ ID NO: 4119483 - DNA, 21 bp, Homo sapiens
aatatttttatatttccttta

SEQ ID NO: 4119484 - DNA, 22 bp, Homo sapiens
aatatttttatatttcctttat

SEQ ID NO: 4119485 - DNA, 15 bp, Homo sapiens
aatattttttgcaag

SEQ ID NO: 4119486 - DNA, 14 bp, Homo sapiens
aatcaaaaattgaa

SEQ ID NO: 4119487 - DNA, 17 bp, Homo sapiens
aatcaaaaattgaagag

SEQ ID NO: 4119488 - DNA, 14 bp, Homo sapiens
aatcaaaacaagtg

SEQ ID NO: 4119489 - DNA, 10 bp, Homo sapiens
aatcaaaact

SEQ ID NO: 4119490 - DNA, 14 bp, Homo sapiens
aatcaaaattgtct

SEQ ID NO: 4119491 - DNA, 17 bp, Homo sapiens
aatcaaagccagggtct

SEQ ID NO: 4119492 - DNA, 15 bp, Homo sapiens
aatcaaataagtatt

SEQ ID NO: 4119493 - DNA, 18 bp, Homo sapiens
aatcaaataagtatttat

SEQ ID NO: 4119494 - DNA, 14 bp, Homo sapiens
aatcaagagctgcc

SEQ ID NO: 4119495 - DNA, 13 bp, Homo sapiens
aatcaagatttta

SEQ ID NO: 4119496 - DNA, 20 bp, Homo sapiens
aatcaagatttttttcctga

SEQ ID NO: 4119497 - DNA, 17 bp, Homo sapiens
aatcaaggttataattt

SEQ ID NO: 4119498 - DNA, 22 bp, Homo sapiens
aatcaagttgtaacttatattg

SEQ ID NO: 4119499 - DNA, 17 bp, Homo sapiens
aatcaatgtcacttaaa

SEQ ID NO: 4119500 - DNA, 19 bp, Homo sapiens
aatcacactgtcttctgat

SEQ ID NO: 4119501 - DNA, 20 bp, Homo sapiens
aatcaccagggccaaaagct

SEQ ID NO: 4119502 - DNA, 16 bp, Homo sapiens
aatcaccatgtaagca

SEQ ID NO: 4119503 - DNA, 14 bp, Homo sapiens
aatcacctggctga

SEQ ID NO: 4119504 - DNA, 19 bp, Homo sapiens
aatcactaggtaacttatt

SEQ ID NO: 4119505 - DNA, 17 bp, Homo sapiens
aatcactatctttctga

SEQ ID NO: 4119506 - DNA, 18 bp, Homo sapiens
aatcactatctttctgat

SEQ ID NO: 4119507 - DNA, 12 bp, Homo sapiens
aatcactcagag

SEQ ID NO: 4119508 - DNA, 15 bp, Homo sapiens
aatcactcagagcag

SEQ ID NO: 4119509 - DNA, 16 bp, Homo sapiens
aatcactcagagcagt

SEQ ID NO: 4119510 - DNA, 21 bp, Homo sapiens
aatcactctaattaattgtaa

SEQ ID NO: 4119511 - DNA, 18 bp, Homo sapiens
aatcagagagcaaggcat

SEQ ID NO: 4119512 - DNA, 19 bp, Homo sapiens
aatcagaggagagacggtg

SEQ ID NO: 4119513 - DNA, 15 bp, Homo sapiens
aatcagagtagaaat

SEQ ID NO: 4119514 - DNA, 17 bp, Homo sapiens
aatcagagtagaaataa

SEQ ID NO: 4119515 - DNA, 19 bp, Homo sapiens
aatcagcattctcactcct

SEQ ID NO: 4119516 - DNA, 11 bp, Homo sapiens
aatcagctcct

SEQ ID NO: 4119517 - DNA, 21 bp, Homo sapiens
aatcagctccttttccgttct

SEQ ID NO: 4119518 - DNA, 21 bp, Homo sapiens
aatcagtaatatttatatatt

SEQ ID NO: 4119519 - DNA, 22 bp, Homo sapiens
aatcagtcatgtgtaatatgca

SEQ ID NO: 4119520 - DNA, 11 bp, Homo sapiens
aatcagtgaag

SEQ ID NO: 4119521 - DNA, 18 bp, Homo sapiens
aatcagtgggcaggataa

SEQ ID NO: 4119522 - DNA, 24 bp, Homo sapiens
aatcagtgggcaggataaactgaa

SEQ ID NO: 4119523 - DNA, 15 bp, Homo sapiens
aatcagttagttttt

SEQ ID NO: 4119524 - DNA, 22 bp, Homo sapiens
aatcatagtactctttgtagca

SEQ ID NO: 4119525 - DNA, 22 bp, Homo sapiens
aatcatatgtgtctttatagat

SEQ ID NO: 4119526 - DNA, 19 bp, Homo sapiens
aatcatattgatgaaaaga

SEQ ID NO: 4119527 - DNA, 15 bp, Homo sapiens
aatcatctataaaga

SEQ ID NO: 4119528 - DNA, 16 bp, Homo sapiens
aatcatgaaatatgca

SEQ ID NO: 4119529 - DNA, 12 bp, Homo sapiens
aatcatgtatgt

SEQ ID NO: 4119530 - DNA, 16 bp, Homo sapiens
aatcatgtcaggcctg

SEQ ID NO: 4119531 - DNA, 19 bp, Homo sapiens
aatcatgtccatacacttt

SEQ ID NO: 4119532 - DNA, 16 bp, Homo sapiens
aatcatgtgaacccgg

SEQ ID NO: 4119533 - DNA, 15 bp, Homo sapiens
aatcattctcgattt

SEQ ID NO: 4119534 - DNA, 17 bp, Homo sapiens
aatcattctcgatttaa

SEQ ID NO: 4119535 - DNA, 12 bp, Homo sapiens
aatcatttcagt

SEQ ID NO: 4119536 - DNA, 21 bp, Homo sapiens
aatcatttcagtatcatctcc

SEQ ID NO: 4119537 - DNA, 15 bp, Homo sapiens
aatcattttaattat

SEQ ID NO: 4119538 - DNA, 22 bp, Homo sapiens
aatcattttaattattattctt

SEQ ID NO: 4119539 - DNA, 13 bp, Homo sapiens
aatccaaatggcg

SEQ ID NO: 4119540 - DNA, 20 bp, Homo sapiens
aatccaaatggcgtctggaa

SEQ ID NO: 4119541 - DNA, 22 bp, Homo sapiens
aatccaagggttgagagccagt

SEQ ID NO: 4119542 - DNA, 23 bp, Homo sapiens
aatccaagggttgagagccagtg

SEQ ID NO: 4119543 - DNA, 18 bp, Homo sapiens
aatccaccttcaggcccc

SEQ ID NO: 4119544 - DNA, 22 bp, Homo sapiens
aatccagaattgaccttttgac

SEQ ID NO: 4119545 - DNA, 16 bp, Homo sapiens
aatccagagagcttaa

SEQ ID NO: 4119546 - DNA, 21 bp, Homo sapiens
aatccagtattgctgatttta

SEQ ID NO: 4119547 - DNA, 19 bp, Homo sapiens
aatccatgttagtttttac

SEQ ID NO: 4119548 - DNA, 17 bp, Homo sapiens
aatccattgtttaaaga

SEQ ID NO: 4119549 - DNA, 18 bp, Homo sapiens
aatcccccttgccacccc

SEQ ID NO: 4119550 - DNA, 15 bp, Homo sapiens
aatccccttatgact

SEQ ID NO: 4119551 - DNA, 14 bp, Homo sapiens
aatccctgtttaat

SEQ ID NO: 4119552 - DNA, 19 bp, Homo sapiens
aatcctaatttctcctccc

SEQ ID NO: 4119553 - DNA, 24 bp, Homo sapiens
aatcctaatttctcctcccttcct

SEQ ID NO: 4119554 - DNA, 21 bp, Homo sapiens
aatcctattaaaacacagctt

SEQ ID NO: 4119555 - DNA, 16 bp, Homo sapiens
aatcctcactgggtgg

SEQ ID NO: 4119556 - DNA, 20 bp, Homo sapiens
aatcctcctgcctcagcctt

SEQ ID NO: 4119557 - DNA, 15 bp, Homo sapiens
aatcctctcctttct

SEQ ID NO: 4119558 - DNA, 21 bp, Homo sapiens
aatcctggagagggtattttt

SEQ ID NO: 4119559 - DNA, 14 bp, Homo sapiens
aatcctgtttataa

SEQ ID NO: 4119560 - DNA, 19 bp, Homo sapiens
aatcctgtttataatctga

SEQ ID NO: 4119561 - DNA, 22 bp, Homo sapiens
aatccttctcattacccacccg

SEQ ID NO: 4119562 - DNA, 20 bp, Homo sapiens
aatctaaaacaaaatctgaa

SEQ ID NO: 4119563 - DNA, 19 bp, Homo sapiens
aatctaaaagctctgttcc

SEQ ID NO: 4119564 - DNA, 20 bp, Homo sapiens
aatctaaaccttacatgtgt

SEQ ID NO: 4119565 - DNA, 19 bp, Homo sapiens
aatctaaatctatttatta

SEQ ID NO: 4119566 - DNA, 17 bp, Homo sapiens
aatctaagtgatataaa

SEQ ID NO: 4119567 - DNA, 18 bp, Homo sapiens
aatctacagatccttttt

SEQ ID NO: 4119568 - DNA, 13 bp, Homo sapiens
aatctagacaata

SEQ ID NO: 4119569 - DNA, 19 bp, Homo sapiens
aatctattcagacaagcaa

SEQ ID NO: 4119570 - DNA, 16 bp, Homo sapiens
aatctattctgtgttg

SEQ ID NO: 4119571 - DNA, 17 bp, Homo sapiens
aatctattgggttcatt

SEQ ID NO: 4119572 - DNA, 19 bp, Homo sapiens
aatctattgggttcattat

SEQ ID NO: 4119573 - DNA, 18 bp, Homo sapiens
aatctatttattaatatt

SEQ ID NO: 4119574 - DNA, 20 bp, Homo sapiens
aatctatttattaatattta

SEQ ID NO: 4119575 - DNA, 23 bp, Homo sapiens
aatctatttcacttattttggct

SEQ ID NO: 4119576 - DNA, 15 bp, Homo sapiens
aatctcaaataacta

SEQ ID NO: 4119577 - DNA, 17 bp, Homo sapiens
aatctcattgcttacaa

SEQ ID NO: 4119578 - DNA, 16 bp, Homo sapiens
aatctcccattttgga

SEQ ID NO: 4119579 - DNA, 18 bp, Homo sapiens
aatctcccattttggaat

SEQ ID NO: 4119580 - DNA, 15 bp, Homo sapiens
aatctcctcttttat

SEQ ID NO: 4119581 - DNA, 19 bp, Homo sapiens
aatctctcaaatctgttat

SEQ ID NO: 4119582 - DNA, 11 bp, Homo sapiens
aatctcttctg

SEQ ID NO: 4119583 - DNA, 14 bp, Homo sapiens
aatctgaaattcta

SEQ ID NO: 4119584 - DNA, 14 bp, Homo sapiens
aatctgaactctca

SEQ ID NO: 4119585 - DNA, 22 bp, Homo sapiens
aatctgagctgcagcctggctg

SEQ ID NO: 4119586 - DNA, 14 bp, Homo sapiens
aatctgatggcctt

SEQ ID NO: 4119587 - DNA, 15 bp, Homo sapiens
aatctgatggcctta

SEQ ID NO: 4119588 - DNA, 16 bp, Homo sapiens
aatctgatggccttaa

SEQ ID NO: 4119589 - DNA, 18 bp, Homo sapiens
aatctgatggccttaatt

SEQ ID NO: 4119590 - DNA, 20 bp, Homo sapiens
aatctgatggccttaatttc

SEQ ID NO: 4119591 - DNA, 22 bp, Homo sapiens
aatctgattcagcatcactaaa

SEQ ID NO: 4119592 - DNA, 20 bp, Homo sapiens
aatctgctcactttaaacct

SEQ ID NO: 4119593 - DNA, 21 bp, Homo sapiens
aatctggcccttacacactca

SEQ ID NO: 4119594 - DNA, 19 bp, Homo sapiens
aatctggtcttgttagaaa

SEQ ID NO: 4119595 - DNA, 14 bp, Homo sapiens
aatctgtataaatg

SEQ ID NO: 4119596 - DNA, 17 bp, Homo sapiens
aatctgtataaatgtct

SEQ ID NO: 4119597 - DNA, 19 bp, Homo sapiens
aatctgtataaatgtctat

SEQ ID NO: 4119598 - DNA, 21 bp, Homo sapiens
aatctgtataaatgtctatta

SEQ ID NO: 4119599 - DNA, 11 bp, Homo sapiens
aatctgtctgc

SEQ ID NO: 4119600 - DNA, 22 bp, Homo sapiens
aatctgtctgctggtcacttct

SEQ ID NO: 4119601 - DNA, 23 bp, Homo sapiens
aatctgtctgctggtcacttctt

SEQ ID NO: 4119602 - DNA, 17 bp, Homo sapiens
aatctgtgggtctggga

SEQ ID NO: 4119603 - DNA, 15 bp, Homo sapiens
aatctgtgtgtatat

SEQ ID NO: 4119604 - DNA, 16 bp, Homo sapiens
aatctgtgtgtatatt

SEQ ID NO: 4119605 - DNA, 16 bp, Homo sapiens
aatcttaaatcagaat

SEQ ID NO: 4119606 - DNA, 18 bp, Homo sapiens
aatcttaaatcagaataa

SEQ ID NO: 4119607 - DNA, 19 bp, Homo sapiens
aatcttaggggagagcttt

SEQ ID NO: 4119608 - DNA, 20 bp, Homo sapiens
aatcttcagttttatcttta

SEQ ID NO: 4119609 - DNA, 22 bp, Homo sapiens
aatcttcagttttatctttaat

SEQ ID NO: 4119610 - DNA, 14 bp, Homo sapiens
aatcttgaaattaa

SEQ ID NO: 4119611 - DNA, 12 bp, Homo sapiens
aatcttggaagt

SEQ ID NO: 4119612 - DNA, 18 bp, Homo sapiens
aatcttgttttaagcaaa

SEQ ID NO: 4119613 - DNA, 22 bp, Homo sapiens
aatcttgttttaagcaaatgca

SEQ ID NO: 4119614 - DNA, 15 bp, Homo sapiens
aatctttacctgtat

SEQ ID NO: 4119615 - DNA, 18 bp, Homo sapiens
aatctttacctgtataca

SEQ ID NO: 4119616 - DNA, 21 bp, Homo sapiens
aatctttagagaagtatacat

SEQ ID NO: 4119617 - DNA, 16 bp, Homo sapiens
aatctttcacttgaaa

SEQ ID NO: 4119618 - DNA, 18 bp, Homo sapiens
aatctttcacttgaaaga

SEQ ID NO: 4119619 - DNA, 20 bp, Homo sapiens
aatctttcacttgaaagatt

SEQ ID NO: 4119620 - DNA, 17 bp, Homo sapiens
aatctttctttacctga

SEQ ID NO: 4119621 - DNA, 16 bp, Homo sapiens
aatctttgtgacagga

SEQ ID NO: 4119622 - DNA, 21 bp, Homo sapiens
aatcttttacaactgcctcga

SEQ ID NO: 4119623 - DNA, 14 bp, Homo sapiens
aatgaaaaattctc

SEQ ID NO: 4119624 - DNA, 18 bp, Homo sapiens
aatgaaaaatttaagcat

SEQ ID NO: 4119625 - DNA, 13 bp, Homo sapiens
aatgaaaatgaat

SEQ ID NO: 4119626 - DNA, 17 bp, Homo sapiens
aatgaaaatgcagtcct

SEQ ID NO: 4119627 - DNA, 12 bp, Homo sapiens
aatgaaaatgtc

SEQ ID NO: 4119628 - DNA, 20 bp, Homo sapiens
aatgaaaatgtcagaaacca

SEQ ID NO: 4119629 - DNA, 14 bp, Homo sapiens
aatgaaaattgtat

SEQ ID NO: 4119630 - DNA, 17 bp, Homo sapiens
aatgaaagactgtacaa

SEQ ID NO: 4119631 - DNA, 12 bp, Homo sapiens
aatgaaagatta

SEQ ID NO: 4119632 - DNA, 17 bp, Homo sapiens
aatgaaagcatgtctca

SEQ ID NO: 4119633 - DNA, 23 bp, Homo sapiens
aatgaaaggtactatatttgcta

SEQ ID NO: 4119634 - DNA, 15 bp, Homo sapiens
aatgaaataatcagt

SEQ ID NO: 4119635 - DNA, 16 bp, Homo sapiens
aatgaaataatcagtg

SEQ ID NO: 4119636 - DNA, 17 bp, Homo sapiens
aatgaaatccttttcct

SEQ ID NO: 4119637 - DNA, 14 bp, Homo sapiens
aatgaaatttgcaa

SEQ ID NO: 4119638 - DNA, 19 bp, Homo sapiens
aatgaaatttgcaaaatca

SEQ ID NO: 4119639 - DNA, 14 bp, Homo sapiens
aatgaacaaaagat

SEQ ID NO: 4119640 - DNA, 18 bp, Homo sapiens
aatgaacactcttttgct

SEQ ID NO: 4119641 - DNA, 11 bp, Homo sapiens
aatgaactgaa

SEQ ID NO: 4119642 - DNA, 15 bp, Homo sapiens
aatgaactgaagttt

SEQ ID NO: 4119643 - DNA, 14 bp, Homo sapiens
aatgaagaagtttc

SEQ ID NO: 4119644 - DNA, 20 bp, Homo sapiens
aatgaagacatttctgctct

SEQ ID NO: 4119645 - DNA, 22 bp, Homo sapiens
aatgaaggttaggatttaacag

SEQ ID NO: 4119646 - DNA, 16 bp, Homo sapiens
aatgaataaactgaat

SEQ ID NO: 4119647 - DNA, 15 bp, Homo sapiens
aatgaataataatta

SEQ ID NO: 4119648 - DNA, 20 bp, Homo sapiens
aatgaatatctattaatata

SEQ ID NO: 4119649 - DNA, 17 bp, Homo sapiens
aatgaatctcgttccca

SEQ ID NO: 4119650 - DNA, 12 bp, Homo sapiens
aatgaatgtcta

SEQ ID NO: 4119651 - DNA, 23 bp, Homo sapiens
aatgaatttgttctttctgattt

SEQ ID NO: 4119652 - DNA, 14 bp, Homo sapiens
aatgacgtttacat

SEQ ID NO: 4119653 - DNA, 17 bp, Homo sapiens
aatgactaaaaatatta

SEQ ID NO: 4119654 - DNA, 24 bp, Homo sapiens
aatgactaaaaatattataactta

SEQ ID NO: 4119655 - DNA, 23 bp, Homo sapiens
aatgactaattagggtacattta

SEQ ID NO: 4119656 - DNA, 23 bp, Homo sapiens
aatgactatataatttatttcca

SEQ ID NO: 4119657 - DNA, 16 bp, Homo sapiens
aatgactccactgttt

SEQ ID NO: 4119658 - DNA, 17 bp, Homo sapiens
aatgactccactgtttt

SEQ ID NO: 4119659 - DNA, 21 bp, Homo sapiens
aatgactgccctgtttctgtt

SEQ ID NO: 4119660 - DNA, 14 bp, Homo sapiens
aatgacttatttct

SEQ ID NO: 4119661 - DNA, 23 bp, Homo sapiens
aatgacttatttctgctctggaa

SEQ ID NO: 4119662 - DNA, 19 bp, Homo sapiens
aatgacttctaatttatat

SEQ ID NO: 4119663 - DNA, 19 bp, Homo sapiens
aatgagactctagggtcca

SEQ ID NO: 4119664 - DNA, 16 bp, Homo sapiens
aatgagatagtagcat

SEQ ID NO: 4119665 - DNA, 23 bp, Homo sapiens
aatgagcacccattccaaagctt

SEQ ID NO: 4119666 - DNA, 13 bp, Homo sapiens
aatgagcccagag

SEQ ID NO: 4119667 - DNA, 14 bp, Homo sapiens
aatgagcccagaga

SEQ ID NO: 4119668 - DNA, 19 bp, Homo sapiens
aatgagcccagagaacagc

SEQ ID NO: 4119669 - DNA, 13 bp, Homo sapiens
aatgagctcctgc

SEQ ID NO: 4119670 - DNA, 22 bp, Homo sapiens
aatgagctcgcatttgtcaatg

SEQ ID NO: 4119671 - DNA, 17 bp, Homo sapiens
aatgaggattattgata

SEQ ID NO: 4119672 - DNA, 14 bp, Homo sapiens
aatgagggactgga

SEQ ID NO: 4119673 - DNA, 15 bp, Homo sapiens
aatgaggtcccaggc

SEQ ID NO: 4119674 - DNA, 16 bp, Homo sapiens
aatgaggtctgaaatg

SEQ ID NO: 4119675 - DNA, 14 bp, Homo sapiens
aatgaggtctgttt

SEQ ID NO: 4119676 - DNA, 23 bp, Homo sapiens
aatgaggtgggaggtggaagaag

SEQ ID NO: 4119677 - DNA, 19 bp, Homo sapiens
aatgagtaacatttgctgt

SEQ ID NO: 4119678 - DNA, 15 bp, Homo sapiens
aatgagtatttggtc

SEQ ID NO: 4119679 - DNA, 13 bp, Homo sapiens
aatgagtgtgcat

SEQ ID NO: 4119680 - DNA, 14 bp, Homo sapiens
aatgataaaataaa

SEQ ID NO: 4119681 - DNA, 21 bp, Homo sapiens
aatgataaaataaataatttt

SEQ ID NO: 4119682 - DNA, 23 bp, Homo sapiens
aatgataaaataaataattttaa

SEQ ID NO: 4119683 - DNA, 21 bp, Homo sapiens
aatgataagtaaatgctaggt

SEQ ID NO: 4119684 - DNA, 16 bp, Homo sapiens
aatgatcagcatctgt

SEQ ID NO: 4119685 - DNA, 17 bp, Homo sapiens
aatgatcagcatctgtg

SEQ ID NO: 4119686 - DNA, 22 bp, Homo sapiens
aatgatcatatcaattggcagt

SEQ ID NO: 4119687 - DNA, 20 bp, Homo sapiens
aatgatgattaaacacctga

SEQ ID NO: 4119688 - DNA, 15 bp, Homo sapiens
aatgatgtccagaag

SEQ ID NO: 4119689 - DNA, 21 bp, Homo sapiens
aatgatgtgtacccaaacgtg

SEQ ID NO: 4119690 - DNA, 17 bp, Homo sapiens
aatgattaatcaaaggc

SEQ ID NO: 4119691 - DNA, 19 bp, Homo sapiens
aatgattttatctgtgaat

SEQ ID NO: 4119692 - DNA, 17 bp, Homo sapiens
aatgcaataattttact

SEQ ID NO: 4119693 - DNA, 20 bp, Homo sapiens
aatgcagccacgattggaga

SEQ ID NO: 4119694 - DNA, 22 bp, Homo sapiens
aatgcagccacgattggagaat

SEQ ID NO: 4119695 - DNA, 23 bp, Homo sapiens
aatgcagccacgattggagaata

SEQ ID NO: 4119696 - DNA, 17 bp, Homo sapiens
aatgcagtcctgaggag

SEQ ID NO: 4119697 - DNA, 14 bp, Homo sapiens
aatgcatgaagcaa

SEQ ID NO: 4119698 - DNA, 19 bp, Homo sapiens
aatgcatgaagcaacgata

SEQ ID NO: 4119699 - DNA, 13 bp, Homo sapiens
aatgcatgagtaa

SEQ ID NO: 4119700 - DNA, 18 bp, Homo sapiens
aatgcatgagtaaaaaaa

SEQ ID NO: 4119701 - DNA, 18 bp, Homo sapiens
aatgcattccctgaatct

SEQ ID NO: 4119702 - DNA, 19 bp, Homo sapiens
aatgcattcttctctgttg

SEQ ID NO: 4119703 - DNA, 21 bp, Homo sapiens
aatgccacgtggtcactgtgc

SEQ ID NO: 4119704 - DNA, 23 bp, Homo sapiens
aatgccagtaacgcgtcttcctg

SEQ ID NO: 4119705 - DNA, 21 bp, Homo sapiens
aatgccatttcagtggcttcc

SEQ ID NO: 4119706 - DNA, 14 bp, Homo sapiens
aatgccccaaggac

SEQ ID NO: 4119707 - DNA, 15 bp, Homo sapiens
aatgcctaataaaca

SEQ ID NO: 4119708 - DNA, 14 bp, Homo sapiens
aatgcctcctccct

SEQ ID NO: 4119709 - DNA, 13 bp, Homo sapiens
aatgcctcctgtg

SEQ ID NO: 4119710 - DNA, 12 bp, Homo sapiens
aatgcctgtgcc

SEQ ID NO: 4119711 - DNA, 19 bp, Homo sapiens
aatgcctgtgccaataaaa

SEQ ID NO: 4119712 - DNA, 17 bp, Homo sapiens
aatgccttaaaatggaa

SEQ ID NO: 4119713 - DNA, 17 bp, Homo sapiens
aatgcctttgagacagt

SEQ ID NO: 4119714 - DNA, 18 bp, Homo sapiens
aatgcctttgagacagtt

SEQ ID NO: 4119715 - DNA, 19 bp, Homo sapiens
aatgctaatttaaagagac

SEQ ID NO: 4119716 - DNA, 20 bp, Homo sapiens
aatgctctggggtcttttta

SEQ ID NO: 4119717 - DNA, 15 bp, Homo sapiens
aatgctgaggttatg

SEQ ID NO: 4119718 - DNA, 17 bp, Homo sapiens
aatgctgcaaacttaat

SEQ ID NO: 4119719 - DNA, 11 bp, Homo sapiens
aatgctgccag

SEQ ID NO: 4119720 - DNA, 14 bp, Homo sapiens
aatgctggactgga

SEQ ID NO: 4119721 - DNA, 13 bp, Homo sapiens
aatgctgtacatc

SEQ ID NO: 4119722 - DNA, 23 bp, Homo sapiens
aatgctgtacatctattttggat

SEQ ID NO: 4119723 - DNA, 20 bp, Homo sapiens
aatgctgttagtaaatttct

SEQ ID NO: 4119724 - DNA, 15 bp, Homo sapiens
aatgcttaaactaaa

SEQ ID NO: 4119725 - DNA, 17 bp, Homo sapiens
aatgcttcattcaatat

SEQ ID NO: 4119726 - DNA, 22 bp, Homo sapiens
aatgcttcattcaatattgaca

SEQ ID NO: 4119727 - DNA, 21 bp, Homo sapiens
aatgcttccaatcttgctttg

SEQ ID NO: 4119728 - DNA, 19 bp, Homo sapiens
aatgcttttatatggccca

SEQ ID NO: 4119729 - DNA, 20 bp, Homo sapiens
aatgctttttatttctgcat

SEQ ID NO: 4119730 - DNA, 11 bp, Homo sapiens
aatggaaaaaa

SEQ ID NO: 4119731 - DNA, 22 bp, Homo sapiens
aatggaccctttttgttatgat

SEQ ID NO: 4119732 - DNA, 17 bp, Homo sapiens
aatggactggaagggga

SEQ ID NO: 4119733 - DNA, 19 bp, Homo sapiens
aatggatactacatcttta

SEQ ID NO: 4119734 - DNA, 18 bp, Homo sapiens
aatggattggattattta

SEQ ID NO: 4119735 - DNA, 20 bp, Homo sapiens
aatggattggattatttaat

SEQ ID NO: 4119736 - DNA, 19 bp, Homo sapiens
aatggcactgttgcaaact

SEQ ID NO: 4119737 - DNA, 16 bp, Homo sapiens
aatggcagctagtgcc

SEQ ID NO: 4119738 - DNA, 13 bp, Homo sapiens
aatggcagtattt

SEQ ID NO: 4119739 - DNA, 22 bp, Homo sapiens
aatgggaactgcctctttcctg

SEQ ID NO: 4119740 - DNA, 23 bp, Homo sapiens
aatgggactggagtcagatgagc

SEQ ID NO: 4119741 - DNA, 12 bp, Homo sapiens
aatgggagctga

SEQ ID NO: 4119742 - DNA, 21 bp, Homo sapiens
aatgggagctgaggccacact

SEQ ID NO: 4119743 - DNA, 19 bp, Homo sapiens
aatgggatttttcttttga

SEQ ID NO: 4119744 - DNA, 23 bp, Homo sapiens
aatgggcactgggatgagccgct

SEQ ID NO: 4119745 - DNA, 13 bp, Homo sapiens
aatggggccagat

SEQ ID NO: 4119746 - DNA, 17 bp, Homo sapiens
aatggggccagatccag

SEQ ID NO: 4119747 - DNA, 18 bp, Homo sapiens
aatgggtgtatataattt

SEQ ID NO: 4119748 - DNA, 20 bp, Homo sapiens
aatgggtgtatataatttta

SEQ ID NO: 4119749 - DNA, 18 bp, Homo sapiens
aatggtaggcatttccta

SEQ ID NO: 4119750 - DNA, 13 bp, Homo sapiens
aatggtccagggt

SEQ ID NO: 4119751 - DNA, 14 bp, Homo sapiens
aatggtccagggtt

SEQ ID NO: 4119752 - DNA, 19 bp, Homo sapiens
aatggtgatcctctatttt

SEQ ID NO: 4119753 - DNA, 20 bp, Homo sapiens
aatggtgatcctctattttg

SEQ ID NO: 4119754 - DNA, 23 bp, Homo sapiens
aatggtgatcctctattttgtga

SEQ ID NO: 4119755 - DNA, 22 bp, Homo sapiens
aatggtgcaaaggagccgccac

SEQ ID NO: 4119756 - DNA, 16 bp, Homo sapiens
aatggtgtacataatg

SEQ ID NO: 4119757 - DNA, 20 bp, Homo sapiens
aatggtgtcagtatccaggc

SEQ ID NO: 4119758 - DNA, 23 bp, Homo sapiens
aatggttgatggaaaataaacat

SEQ ID NO: 4119759 - DNA, 21 bp, Homo sapiens
aatggtttctgaaaatgttta

SEQ ID NO: 4119760 - DNA, 12 bp, Homo sapiens
aatgtaaaaaag

SEQ ID NO: 4119761 - DNA, 19 bp, Homo sapiens
aatgtaaaaaagaaaaaca

SEQ ID NO: 4119762 - DNA, 22 bp, Homo sapiens
aatgtaaactttgtcatggttt

SEQ ID NO: 4119763 - DNA, 14 bp, Homo sapiens
aatgtaaagaactt

SEQ ID NO: 4119764 - DNA, 16 bp, Homo sapiens
aatgtaaatgatttta

SEQ ID NO: 4119765 - DNA, 23 bp, Homo sapiens
aatgtaactccagatagagaaat

SEQ ID NO: 4119766 - DNA, 19 bp, Homo sapiens
aatgtaagaaaacaaaatc

SEQ ID NO: 4119767 - DNA, 15 bp, Homo sapiens
aatgtaagctctact

SEQ ID NO: 4119768 - DNA, 15 bp, Homo sapiens
aatgtaatactggaa

SEQ ID NO: 4119769 - DNA, 14 bp, Homo sapiens
aatgtaattgaata

SEQ ID NO: 4119770 - DNA, 16 bp, Homo sapiens
aatgtaattgaataaa

SEQ ID NO: 4119771 - DNA, 16 bp, Homo sapiens
aatgtaatttagaaac

SEQ ID NO: 4119772 - DNA, 22 bp, Homo sapiens
aatgtaatttagaaactgattt

SEQ ID NO: 4119773 - DNA, 12 bp, Homo sapiens
aatgtactgcat

SEQ ID NO: 4119774 - DNA, 14 bp, Homo sapiens
aatgtactgcatat

SEQ ID NO: 4119775 - DNA, 14 bp, Homo sapiens
aatgtatcaggaaa

SEQ ID NO: 4119776 - DNA, 18 bp, Homo sapiens
aatgtatcaggaaatata

SEQ ID NO: 4119777 - DNA, 13 bp, Homo sapiens
aatgtatcttatt

SEQ ID NO: 4119778 - DNA, 16 bp, Homo sapiens
aatgtatcttattcac

SEQ ID NO: 4119779 - DNA, 18 bp, Homo sapiens
aatgtatcttattcacat

SEQ ID NO: 4119780 - DNA, 18 bp, Homo sapiens
aatgtatgtgcactgtca

SEQ ID NO: 4119781 - DNA, 19 bp, Homo sapiens
aatgtatgtgtaagtattc

SEQ ID NO: 4119782 - DNA, 22 bp, Homo sapiens
aatgtattattctgcagcatga

SEQ ID NO: 4119783 - DNA, 13 bp, Homo sapiens
aatgtattcaaat

SEQ ID NO: 4119784 - DNA, 13 bp, Homo sapiens
aatgtattttgaa

SEQ ID NO: 4119785 - DNA, 19 bp, Homo sapiens
aatgtattttgaagaatat

SEQ ID NO: 4119786 - DNA, 22 bp, Homo sapiens
aatgtattttgaagaatattta

SEQ ID NO: 4119787 - DNA, 17 bp, Homo sapiens
aatgtcacattctattt

SEQ ID NO: 4119788 - DNA, 16 bp, Homo sapiens
aatgtcagatttctgg

SEQ ID NO: 4119789 - DNA, 18 bp, Homo sapiens
aatgtcagtgtttgggaa

SEQ ID NO: 4119790 - DNA, 18 bp, Homo sapiens
aatgtccatgatggaata

SEQ ID NO: 4119791 - DNA, 17 bp, Homo sapiens
aatgtcctccagaagcc

SEQ ID NO: 4119792 - DNA, 21 bp, Homo sapiens
aatgtcctccagaagcctctg

SEQ ID NO: 4119793 - DNA, 15 bp, Homo sapiens
aatgtctaaatgctg

SEQ ID NO: 4119794 - DNA, 18 bp, Homo sapiens
aatgtctaaatgctgaaa

SEQ ID NO: 4119795 - DNA, 19 bp, Homo sapiens
aatgtctcactgttctgca

SEQ ID NO: 4119796 - DNA, 16 bp, Homo sapiens
aatgtctgctgaggag

SEQ ID NO: 4119797 - DNA, 23 bp, Homo sapiens
aatgtctgtagctcctcaactca

SEQ ID NO: 4119798 - DNA, 17 bp, Homo sapiens
aatgtctgttaacttaa

SEQ ID NO: 4119799 - DNA, 12 bp, Homo sapiens
aatgtcttcata

SEQ ID NO: 4119800 - DNA, 16 bp, Homo sapiens
aatgtctttgtaagtc

SEQ ID NO: 4119801 - DNA, 19 bp, Homo sapiens
aatgtctttgtaagtcagt

SEQ ID NO: 4119802 - DNA, 22 bp, Homo sapiens
aatgtctttgttggaaaagaat

SEQ ID NO: 4119803 - DNA, 15 bp, Homo sapiens
aatgtgaactttatt

SEQ ID NO: 4119804 - DNA, 20 bp, Homo sapiens
aatgtgaactttattaaata

SEQ ID NO: 4119805 - DNA, 12 bp, Homo sapiens
aatgtgaatttt

SEQ ID NO: 4119806 - DNA, 23 bp, Homo sapiens
aatgtgatgcttataataaagaa

SEQ ID NO: 4119807 - DNA, 22 bp, Homo sapiens
aatgtggcaaggaaaaacaggt

SEQ ID NO: 4119808 - DNA, 16 bp, Homo sapiens
aatgtggctgaagttg

SEQ ID NO: 4119809 - DNA, 16 bp, Homo sapiens
aatgtggcttgagaaa

SEQ ID NO: 4119810 - DNA, 13 bp, Homo sapiens
aatgtgggcactg

SEQ ID NO: 4119811 - DNA, 19 bp, Homo sapiens
aatgtgtacaatgtacaca

SEQ ID NO: 4119812 - DNA, 19 bp, Homo sapiens
aatgtgtcctatctatctt

SEQ ID NO: 4119813 - DNA, 13 bp, Homo sapiens
aatgtgtgaaaaa

SEQ ID NO: 4119814 - DNA, 15 bp, Homo sapiens
aatgtgtttgctgcc

SEQ ID NO: 4119815 - DNA, 12 bp, Homo sapiens
aatgttaaattt

SEQ ID NO: 4119816 - DNA, 13 bp, Homo sapiens
aatgttaaatttg

SEQ ID NO: 4119817 - DNA, 16 bp, Homo sapiens
aatgttaaatttgtaa

SEQ ID NO: 4119818 - DNA, 12 bp, Homo sapiens
aatgttaagaat

SEQ ID NO: 4119819 - DNA, 18 bp, Homo sapiens
aatgttaaggaaactctt

SEQ ID NO: 4119820 - DNA, 22 bp, Homo sapiens
aatgttaaggaaactcttatct

SEQ ID NO: 4119821 - DNA, 22 bp, Homo sapiens
aatgttaaggacttctgcagct

SEQ ID NO: 4119822 - DNA, 16 bp, Homo sapiens
aatgttacattattat

SEQ ID NO: 4119823 - DNA, 22 bp, Homo sapiens
aatgttactgatcatgcattgt

SEQ ID NO: 4119824 - DNA, 14 bp, Homo sapiens
aatgttatttaaca

SEQ ID NO: 4119825 - DNA, 18 bp, Homo sapiens
aatgttcacaatatattt

SEQ ID NO: 4119826 - DNA, 12 bp, Homo sapiens
aatgttctgaca

SEQ ID NO: 4119827 - DNA, 17 bp, Homo sapiens
aatgttctgacattaac

SEQ ID NO: 4119828 - DNA, 22 bp, Homo sapiens
aatgttctgttcaccctgcatt

SEQ ID NO: 4119829 - DNA, 23 bp, Homo sapiens
aatgttctgttcaccctgcatta

SEQ ID NO: 4119830 - DNA, 10 bp, Homo sapiens
aatgttcttt

SEQ ID NO: 4119831 - DNA, 17 bp, Homo sapiens
aatgttctttggaaagt

SEQ ID NO: 4119832 - DNA, 21 bp, Homo sapiens
aatgttctttggaaagtacac

SEQ ID NO: 4119833 - DNA, 20 bp, Homo sapiens
aatgttggcagatgcagctc

SEQ ID NO: 4119834 - DNA, 20 bp, Homo sapiens
aatgtttaaatcatgtatgt

SEQ ID NO: 4119835 - DNA, 21 bp, Homo sapiens
aatgtttaaatcatgtatgtt

SEQ ID NO: 4119836 - DNA, 14 bp, Homo sapiens
aatgtttaagtatt

SEQ ID NO: 4119837 - DNA, 14 bp, Homo sapiens
aatgtttaatgctg

SEQ ID NO: 4119838 - DNA, 15 bp, Homo sapiens
aatgtttatgagcca

SEQ ID NO: 4119839 - DNA, 21 bp, Homo sapiens
aatgtttggattctcttagct

SEQ ID NO: 4119840 - DNA, 20 bp, Homo sapiens
aatgttttactgtgaaactg

SEQ ID NO: 4119841 - DNA, 23 bp, Homo sapiens
aatgttttcttcaacatgctcca

SEQ ID NO: 4119842 - DNA, 22 bp, Homo sapiens
aatgttttgtatatacagttat

SEQ ID NO: 4119843 - DNA, 18 bp, Homo sapiens
aatgtttttccctcccca

SEQ ID NO: 4119844 - DNA, 17 bp, Homo sapiens
aattaaaatttatctta

SEQ ID NO: 4119845 - DNA, 23 bp, Homo sapiens
aattaaaatttatcttaagttct

SEQ ID NO: 4119846 - DNA, 14 bp, Homo sapiens
aattaaacttttaa

SEQ ID NO: 4119847 - DNA, 18 bp, Homo sapiens
aattaaaggtcctgccct

SEQ ID NO: 4119848 - DNA, 18 bp, Homo sapiens
aattaaagtctattcaaa

SEQ ID NO: 4119849 - DNA, 12 bp, Homo sapiens
aattaaatctgt

SEQ ID NO: 4119850 - DNA, 17 bp, Homo sapiens
aattaaatgtatttaat

SEQ ID NO: 4119851 - DNA, 14 bp, Homo sapiens
aattaaattaggaa

SEQ ID NO: 4119852 - DNA, 15 bp, Homo sapiens
aattaacacaaagga

SEQ ID NO: 4119853 - DNA, 14 bp, Homo sapiens
aattaaccatttaa

SEQ ID NO: 4119854 - DNA, 15 bp, Homo sapiens
aattaaccatttaat

SEQ ID NO: 4119855 - DNA, 19 bp, Homo sapiens
aattaaccatttaataaag

SEQ ID NO: 4119856 - DNA, 17 bp, Homo sapiens
aattaacttgagtttta

SEQ ID NO: 4119857 - DNA, 13 bp, Homo sapiens
aattaagaaggca

SEQ ID NO: 4119858 - DNA, 13 bp, Homo sapiens
aattaagtactat

SEQ ID NO: 4119859 - DNA, 15 bp, Homo sapiens
aattaataatcttat

SEQ ID NO: 4119860 - DNA, 19 bp, Homo sapiens
aattaatatccctacatgt

SEQ ID NO: 4119861 - DNA, 13 bp, Homo sapiens
aattaatattgta

SEQ ID NO: 4119862 - DNA, 15 bp, Homo sapiens
aattaattgtaatct

SEQ ID NO: 4119863 - DNA, 21 bp, Homo sapiens
aattaatttgattaacaaata

SEQ ID NO: 4119864 - DNA, 13 bp, Homo sapiens
aattaattttact

SEQ ID NO: 4119865 - DNA, 14 bp, Homo sapiens
aattacataatttt

SEQ ID NO: 4119866 - DNA, 16 bp, Homo sapiens
aattacgtttgttatt

SEQ ID NO: 4119867 - DNA, 17 bp, Homo sapiens
aattactacaaaatttg

SEQ ID NO: 4119868 - DNA, 19 bp, Homo sapiens
aattactcagcagaatggt

SEQ ID NO: 4119869 - DNA, 21 bp, Homo sapiens
aattactggaattcttctgca

SEQ ID NO: 4119870 - DNA, 19 bp, Homo sapiens
aattagactgtgattcaga

SEQ ID NO: 4119871 - DNA, 23 bp, Homo sapiens
aattagactgtgattcagaaaat

SEQ ID NO: 4119872 - DNA, 21 bp, Homo sapiens
aattaggcagtgctaaagcct

SEQ ID NO: 4119873 - DNA, 20 bp, Homo sapiens
aattagggtacatttataat

SEQ ID NO: 4119874 - DNA, 21 bp, Homo sapiens
aattaggtttttccttatttg

SEQ ID NO: 4119875 - DNA, 18 bp, Homo sapiens
aattagtatttatttaat

SEQ ID NO: 4119876 - DNA, 19 bp, Homo sapiens
aattagtggatttttttgt

SEQ ID NO: 4119877 - DNA, 23 bp, Homo sapiens
aattataacttaaaatattttat

SEQ ID NO: 4119878 - DNA, 17 bp, Homo sapiens
aattatatatttctaac

SEQ ID NO: 4119879 - DNA, 12 bp, Homo sapiens
aattatatctgt

SEQ ID NO: 4119880 - DNA, 21 bp, Homo sapiens
aattatcctgaactcttctgc

SEQ ID NO: 4119881 - DNA, 17 bp, Homo sapiens
aattatcggaagcagtg

SEQ ID NO: 4119882 - DNA, 17 bp, Homo sapiens
aattatcgggaacagtg

SEQ ID NO: 4119883 - DNA, 19 bp, Homo sapiens
aattatcgggaacagtgtt

SEQ ID NO: 4119884 - DNA, 16 bp, Homo sapiens
aattatctatacatat

SEQ ID NO: 4119885 - DNA, 15 bp, Homo sapiens
aattatctatagcta

SEQ ID NO: 4119886 - DNA, 12 bp, Homo sapiens
aattatgacaat

SEQ ID NO: 4119887 - DNA, 19 bp, Homo sapiens
aattatgagttatttttat

SEQ ID NO: 4119888 - DNA, 15 bp, Homo sapiens
aattatgatttgggt

SEQ ID NO: 4119889 - DNA, 12 bp, Homo sapiens
aattatgtataa

SEQ ID NO: 4119890 - DNA, 13 bp, Homo sapiens
aattatgtataaa

SEQ ID NO: 4119891 - DNA, 15 bp, Homo sapiens
aattatgtgacattt

SEQ ID NO: 4119892 - DNA, 18 bp, Homo sapiens
aattatgttttaaacaca

SEQ ID NO: 4119893 - DNA, 16 bp, Homo sapiens
aattattaactacatt

SEQ ID NO: 4119894 - DNA, 23 bp, Homo sapiens
aattattaactacatttatgagt

SEQ ID NO: 4119895 - DNA, 13 bp, Homo sapiens
aattattatttat

SEQ ID NO: 4119896 - DNA, 16 bp, Homo sapiens
aattattatttatata

SEQ ID NO: 4119897 - DNA, 15 bp, Homo sapiens
aattattggcaaagt

SEQ ID NO: 4119898 - DNA, 17 bp, Homo sapiens
aattatttaaataaaat

SEQ ID NO: 4119899 - DNA, 21 bp, Homo sapiens
aattatttaaataaaatcacc

SEQ ID NO: 4119900 - DNA, 12 bp, Homo sapiens
aattattttaaa

SEQ ID NO: 4119901 - DNA, 19 bp, Homo sapiens
aattattttggtactttta

SEQ ID NO: 4119902 - DNA, 12 bp, Homo sapiens
aattatttttgt

SEQ ID NO: 4119903 - DNA, 19 bp, Homo sapiens
aattatttttgtgtttcta

SEQ ID NO: 4119904 - DNA, 12 bp, Homo sapiens
aattcaagaaaa

SEQ ID NO: 4119905 - DNA, 14 bp, Homo sapiens
aattcaattgtaaa

SEQ ID NO: 4119906 - DNA, 17 bp, Homo sapiens
aattcaattgtaaattg

SEQ ID NO: 4119907 - DNA, 23 bp, Homo sapiens
aattcaattgtaaattgaatcag

SEQ ID NO: 4119908 - DNA, 15 bp, Homo sapiens
aattcaattttaaag

SEQ ID NO: 4119909 - DNA, 14 bp, Homo sapiens
aattcacaaacttt

SEQ ID NO: 4119910 - DNA, 21 bp, Homo sapiens
aattcaccccctttcctggac

SEQ ID NO: 4119911 - DNA, 16 bp, Homo sapiens
aattcagattgtcttg

SEQ ID NO: 4119912 - DNA, 16 bp, Homo sapiens
aattcagcaaaccatt

SEQ ID NO: 4119913 - DNA, 16 bp, Homo sapiens
aattcagtttttgtat

SEQ ID NO: 4119914 - DNA, 19 bp, Homo sapiens
aattcagtttttgtatctt

SEQ ID NO: 4119915 - DNA, 17 bp, Homo sapiens
aattcataatcactcta

SEQ ID NO: 4119916 - DNA, 23 bp, Homo sapiens
aattccaaggagttccatgaaga

SEQ ID NO: 4119917 - DNA, 20 bp, Homo sapiens
aattccagaaaggatattta

SEQ ID NO: 4119918 - DNA, 13 bp, Homo sapiens
aattccagcaata

SEQ ID NO: 4119919 - DNA, 18 bp, Homo sapiens
aattccagcaataagaaa

SEQ ID NO: 4119920 - DNA, 19 bp, Homo sapiens
aattccagcaataagaaat

SEQ ID NO: 4119921 - DNA, 20 bp, Homo sapiens
aattccagcaataagaaatg

SEQ ID NO: 4119922 - DNA, 16 bp, Homo sapiens
aattcccattttgcaa

SEQ ID NO: 4119923 - DNA, 17 bp, Homo sapiens
aattcccattttgcaaa

SEQ ID NO: 4119924 - DNA, 10 bp, Homo sapiens
aattccctat

SEQ ID NO: 4119925 - DNA, 13 bp, Homo sapiens
aattccgtcacca

SEQ ID NO: 4119926 - DNA, 14 bp, Homo sapiens
aattcctacaactt

SEQ ID NO: 4119927 - DNA, 13 bp, Homo sapiens
aattcctacagca

SEQ ID NO: 4119928 - DNA, 18 bp, Homo sapiens
aattcctacagcactact

SEQ ID NO: 4119929 - DNA, 14 bp, Homo sapiens
aattcctctgggaa

SEQ ID NO: 4119930 - DNA, 19 bp, Homo sapiens
aattcgctttctaaagtta

SEQ ID NO: 4119931 - DNA, 19 bp, Homo sapiens
aattctaagttatttactt

SEQ ID NO: 4119932 - DNA, 22 bp, Homo sapiens
aattctataaggccataaaaca

SEQ ID NO: 4119933 - DNA, 22 bp, Homo sapiens
aattctatgttaaatactgtgc

SEQ ID NO: 4119934 - DNA, 14 bp, Homo sapiens
aattctcatttgtt

SEQ ID NO: 4119935 - DNA, 16 bp, Homo sapiens
aattctcccctccctc

SEQ ID NO: 4119936 - DNA, 20 bp, Homo sapiens
aattctccctatcttgtgaa

SEQ ID NO: 4119937 - DNA, 20 bp, Homo sapiens
aattctcctgcctcagcctc

SEQ ID NO: 4119938 - DNA, 12 bp, Homo sapiens
aattctgtaaat

SEQ ID NO: 4119939 - DNA, 16 bp, Homo sapiens
aattctgtgccttgtt

SEQ ID NO: 4119940 - DNA, 23 bp, Homo sapiens
aattctgtgggtccgataatatc

SEQ ID NO: 4119941 - DNA, 16 bp, Homo sapiens
aattcttaagtatgtt

SEQ ID NO: 4119942 - DNA, 18 bp, Homo sapiens
aattcttaccctgtacat

SEQ ID NO: 4119943 - DNA, 20 bp, Homo sapiens
aattcttcagcgtaaaatgg

SEQ ID NO: 4119944 - DNA, 15 bp, Homo sapiens
aattcttctgtcctg

SEQ ID NO: 4119945 - DNA, 18 bp, Homo sapiens
aattcttgtaatttttat

SEQ ID NO: 4119946 - DNA, 16 bp, Homo sapiens
aattcttgtatattat

SEQ ID NO: 4119947 - DNA, 17 bp, Homo sapiens
aattgaaaaactcttta

SEQ ID NO: 4119948 - DNA, 18 bp, Homo sapiens
aattgaaactagttattt

SEQ ID NO: 4119949 - DNA, 17 bp, Homo sapiens
aattgaagagagatata

SEQ ID NO: 4119950 - DNA, 23 bp, Homo sapiens
aattgaagagagatatatctgaa

SEQ ID NO: 4119951 - DNA, 11 bp, Homo sapiens
aattgactacc

SEQ ID NO: 4119952 - DNA, 21 bp, Homo sapiens
aattgactgatgattttcctt

SEQ ID NO: 4119953 - DNA, 23 bp, Homo sapiens
aattgagaaaaatatatactaaa

SEQ ID NO: 4119954 - DNA, 21 bp, Homo sapiens
aattgagtaatggtgtagaac

SEQ ID NO: 4119955 - DNA, 13 bp, Homo sapiens
aattgatttgcat

SEQ ID NO: 4119956 - DNA, 17 bp, Homo sapiens
aattgatttttcttctt

SEQ ID NO: 4119957 - DNA, 21 bp, Homo sapiens
aattgatttttcttcttttac

SEQ ID NO: 4119958 - DNA, 11 bp, Homo sapiens
aattgcattga

SEQ ID NO: 4119959 - DNA, 13 bp, Homo sapiens
aattgccaatctt

SEQ ID NO: 4119960 - DNA, 14 bp, Homo sapiens
aattgcctgatttg

SEQ ID NO: 4119961 - DNA, 20 bp, Homo sapiens
aattgctatgttactatttt

SEQ ID NO: 4119962 - DNA, 14 bp, Homo sapiens
aattgctcaagttc

SEQ ID NO: 4119963 - DNA, 12 bp, Homo sapiens
aattgctctgtt

SEQ ID NO: 4119964 - DNA, 20 bp, Homo sapiens
aattgcttacatttttacaa

SEQ ID NO: 4119965 - DNA, 16 bp, Homo sapiens
aattggcagtgacttt

SEQ ID NO: 4119966 - DNA, 17 bp, Homo sapiens
aattggcagtgactttg

SEQ ID NO: 4119967 - DNA, 20 bp, Homo sapiens
aattggcagtgactttgtat

SEQ ID NO: 4119968 - DNA, 16 bp, Homo sapiens
aattggggaggagggg

SEQ ID NO: 4119969 - DNA, 21 bp, Homo sapiens
aattggtaaaactcactgtga

SEQ ID NO: 4119970 - DNA, 13 bp, Homo sapiens
aattgtaacctgc

SEQ ID NO: 4119971 - DNA, 18 bp, Homo sapiens
aattgtaccatcatttta

SEQ ID NO: 4119972 - DNA, 19 bp, Homo sapiens
aattgtaccatcattttat

SEQ ID NO: 4119973 - DNA, 20 bp, Homo sapiens
aattgtaccatcattttatt

SEQ ID NO: 4119974 - DNA, 24 bp, Homo sapiens
aattgtatcatttgaacaactagg

SEQ ID NO: 4119975 - DNA, 18 bp, Homo sapiens
aattgtcagcaatttaac

SEQ ID NO: 4119976 - DNA, 13 bp, Homo sapiens
aattgtctattta

SEQ ID NO: 4119977 - DNA, 18 bp, Homo sapiens
aattgtctatttatcttt

SEQ ID NO: 4119978 - DNA, 20 bp, Homo sapiens
aattgtcttttgtcatgtgg

SEQ ID NO: 4119979 - DNA, 20 bp, Homo sapiens
aattgtgccgagaaaagcat

SEQ ID NO: 4119980 - DNA, 15 bp, Homo sapiens
aattgtgctgccatt

SEQ ID NO: 4119981 - DNA, 21 bp, Homo sapiens
aattgtgtaaaaaatggaaaa

SEQ ID NO: 4119982 - DNA, 16 bp, Homo sapiens
aattgtgtagcctttt

SEQ ID NO: 4119983 - DNA, 16 bp, Homo sapiens
aattgttgaaattttg

SEQ ID NO: 4119984 - DNA, 23 bp, Homo sapiens
aattgttgaaattttgcaaatat

SEQ ID NO: 4119985 - DNA, 21 bp, Homo sapiens
aattgttgtttctttctagtg

SEQ ID NO: 4119986 - DNA, 16 bp, Homo sapiens
aattgtttcatatctg

SEQ ID NO: 4119987 - DNA, 13 bp, Homo sapiens
aattgttttacct

SEQ ID NO: 4119988 - DNA, 22 bp, Homo sapiens
aattgttttacctgttctgaaa

SEQ ID NO: 4119989 - DNA, 21 bp, Homo sapiens
aattgtttttgaatttaaata

SEQ ID NO: 4119990 - DNA, 13 bp, Homo sapiens
aatttaaaattaa

SEQ ID NO: 4119991 - DNA, 18 bp, Homo sapiens
aatttaaaattaagtaga

SEQ ID NO: 4119992 - DNA, 12 bp, Homo sapiens
aatttaaagata

SEQ ID NO: 4119993 - DNA, 17 bp, Homo sapiens
aatttaaagatattgtt

SEQ ID NO: 4119994 - DNA, 22 bp, Homo sapiens
aatttaaagggtgtacttatat

SEQ ID NO: 4119995 - DNA, 12 bp, Homo sapiens
aatttaaataaa

SEQ ID NO: 4119996 - DNA, 20 bp, Homo sapiens
aatttaaatataattctgta

SEQ ID NO: 4119997 - DNA, 11 bp, Homo sapiens
aatttaaatgt

SEQ ID NO: 4119998 - DNA, 17 bp, Homo sapiens
aatttaaatttaaagat

SEQ ID NO: 4119999 - DNA, 13 bp, Homo sapiens
aatttaagcattg

SEQ ID NO: 4120000 - DNA, 21 bp, Homo sapiens
aatttaagcattgtttgctta

SEQ ID NO: 4120001 - DNA, 14 bp, Homo sapiens
aatttaagtatctt

SEQ ID NO: 4120002 - DNA, 16 bp, Homo sapiens
aatttacaaaaatata

SEQ ID NO: 4120003 - DNA, 15 bp, Homo sapiens
aatttacatactctg

SEQ ID NO: 4120004 - DNA, 18 bp, Homo sapiens
aatttagccctttaaaac

SEQ ID NO: 4120005 - DNA, 22 bp, Homo sapiens
aatttagggtactaaatttaaa

SEQ ID NO: 4120006 - DNA, 17 bp, Homo sapiens
aatttagtgtatccata

SEQ ID NO: 4120007 - DNA, 17 bp, Homo sapiens
aatttatacaatatcat

SEQ ID NO: 4120008 - DNA, 14 bp, Homo sapiens
aatttatcaaagca

SEQ ID NO: 4120009 - DNA, 15 bp, Homo sapiens
aatttatcaaagcat

SEQ ID NO: 4120010 - DNA, 17 bp, Homo sapiens
aatttatcacacttctg

SEQ ID NO: 4120011 - DNA, 21 bp, Homo sapiens
aatttatctaaattaaagcct

SEQ ID NO: 4120012 - DNA, 21 bp, Homo sapiens
aatttatcttaagttctatga

SEQ ID NO: 4120013 - DNA, 20 bp, Homo sapiens
aatttatcttgtctctgggc

SEQ ID NO: 4120014 - DNA, 16 bp, Homo sapiens
aatttattcacatata

SEQ ID NO: 4120015 - DNA, 16 bp, Homo sapiens
aatttatttattaaga

SEQ ID NO: 4120016 - DNA, 19 bp, Homo sapiens
aatttatttcaataaatct

SEQ ID NO: 4120017 - DNA, 23 bp, Homo sapiens
aatttatttcaataaatctttca

SEQ ID NO: 4120018 - DNA, 16 bp, Homo sapiens
aatttatttcatccag

SEQ ID NO: 4120019 - DNA, 15 bp, Homo sapiens
aatttcaaaaatata

SEQ ID NO: 4120020 - DNA, 16 bp, Homo sapiens
aatttcaaaaatataa

SEQ ID NO: 4120021 - DNA, 19 bp, Homo sapiens
aatttcaaaaatataactt

SEQ ID NO: 4120022 - DNA, 16 bp, Homo sapiens
aatttcaaaatgcttt

SEQ ID NO: 4120023 - DNA, 17 bp, Homo sapiens
aatttccagtacctttg

SEQ ID NO: 4120024 - DNA, 13 bp, Homo sapiens
aatttccatatcc

SEQ ID NO: 4120025 - DNA, 17 bp, Homo sapiens
aatttccatatccttct

SEQ ID NO: 4120026 - DNA, 12 bp, Homo sapiens
aatttcccagga

SEQ ID NO: 4120027 - DNA, 16 bp, Homo sapiens
aatttcccaggaccct

SEQ ID NO: 4120028 - DNA, 22 bp, Homo sapiens
aatttcccaggaccctgaaggg

SEQ ID NO: 4120029 - DNA, 17 bp, Homo sapiens
aatttccctcaggttct

SEQ ID NO: 4120030 - DNA, 15 bp, Homo sapiens
aatttcctttttgac

SEQ ID NO: 4120031 - DNA, 17 bp, Homo sapiens
aatttcctttttgacac

SEQ ID NO: 4120032 - DNA, 18 bp, Homo sapiens
aatttcctttttgacact

SEQ ID NO: 4120033 - DNA, 14 bp, Homo sapiens
aatttcgagatttg

SEQ ID NO: 4120034 - DNA, 17 bp, Homo sapiens
aatttcggattttttcc

SEQ ID NO: 4120035 - DNA, 21 bp, Homo sapiens
aatttcggattttttccaaaa

SEQ ID NO: 4120036 - DNA, 22 bp, Homo sapiens
aatttctaaaaaacagaggcca

SEQ ID NO: 4120037 - DNA, 15 bp, Homo sapiens
aatttctaaagataa

SEQ ID NO: 4120038 - DNA, 16 bp, Homo sapiens
aatttctaaagataat

SEQ ID NO: 4120039 - DNA, 23 bp, Homo sapiens
aatttctaaagataatattactg

SEQ ID NO: 4120040 - DNA, 12 bp, Homo sapiens
aatttctcctcc

SEQ ID NO: 4120041 - DNA, 15 bp, Homo sapiens
aatttcttatgtgac

SEQ ID NO: 4120042 - DNA, 18 bp, Homo sapiens
aatttcttatgtgacatt

SEQ ID NO: 4120043 - DNA, 12 bp, Homo sapiens
aatttgaatgaa

SEQ ID NO: 4120044 - DNA, 14 bp, Homo sapiens
aatttgaatgaaaa

SEQ ID NO: 4120045 - DNA, 16 bp, Homo sapiens
aatttgaatgaaaaat

SEQ ID NO: 4120046 - DNA, 13 bp, Homo sapiens
aatttgattaaca

SEQ ID NO: 4120047 - DNA, 20 bp, Homo sapiens
aatttgattgactgcccatt

SEQ ID NO: 4120048 - DNA, 15 bp, Homo sapiens
aatttgattgatttg

SEQ ID NO: 4120049 - DNA, 17 bp, Homo sapiens
aatttgattgatttgaa

SEQ ID NO: 4120050 - DNA, 20 bp, Homo sapiens
aatttgattgatttgaagaa

SEQ ID NO: 4120051 - DNA, 17 bp, Homo sapiens
aatttgcatattctatt

SEQ ID NO: 4120052 - DNA, 21 bp, Homo sapiens
aatttgcattaaattcacaaa

SEQ ID NO: 4120053 - DNA, 23 bp, Homo sapiens
aatttgcattaaattcacaaact

SEQ ID NO: 4120054 - DNA, 18 bp, Homo sapiens
aatttggcctgcactaat

SEQ ID NO: 4120055 - DNA, 22 bp, Homo sapiens
aatttgggaaggtttgtgtttt

SEQ ID NO: 4120056 - DNA, 22 bp, Homo sapiens
aatttggttctaatagaactca

SEQ ID NO: 4120057 - DNA, 24 bp, Homo sapiens
aatttgtaaaaacagcattgcttt

SEQ ID NO: 4120058 - DNA, 15 bp, Homo sapiens
aatttgtaaatgatt

SEQ ID NO: 4120059 - DNA, 23 bp, Homo sapiens
aatttgtaagtttcaggtgacat

SEQ ID NO: 4120060 - DNA, 17 bp, Homo sapiens
aatttgtaccatttcag

SEQ ID NO: 4120061 - DNA, 16 bp, Homo sapiens
aatttgttataatgaa

SEQ ID NO: 4120062 - DNA, 14 bp, Homo sapiens
aatttgtttaaaga

SEQ ID NO: 4120063 - DNA, 17 bp, Homo sapiens
aatttgtttaattaaat

SEQ ID NO: 4120064 - DNA, 21 bp, Homo sapiens
aatttgtttaattaaatttaa

SEQ ID NO: 4120065 - DNA, 13 bp, Homo sapiens
aattttaatgtga

SEQ ID NO: 4120066 - DNA, 22 bp, Homo sapiens
aattttaatgtgaagacatttt

SEQ ID NO: 4120067 - DNA, 13 bp, Homo sapiens
aattttacacatt

SEQ ID NO: 4120068 - DNA, 14 bp, Homo sapiens
aattttacttccat

SEQ ID NO: 4120069 - DNA, 15 bp, Homo sapiens
aattttagaacttta

SEQ ID NO: 4120070 - DNA, 12 bp, Homo sapiens
aattttaggaac

SEQ ID NO: 4120071 - DNA, 14 bp, Homo sapiens
aattttagtattca

SEQ ID NO: 4120072 - DNA, 15 bp, Homo sapiens
aattttataatctgc

SEQ ID NO: 4120073 - DNA, 14 bp, Homo sapiens
aattttatccctca

SEQ ID NO: 4120074 - DNA, 12 bp, Homo sapiens
aattttcacaaa

SEQ ID NO: 4120075 - DNA, 22 bp, Homo sapiens
aattttcacaaaatgtctcagt

SEQ ID NO: 4120076 - DNA, 18 bp, Homo sapiens
aattttcattaaacttga

SEQ ID NO: 4120077 - DNA, 20 bp, Homo sapiens
aattttcattaaacttgaag

SEQ ID NO: 4120078 - DNA, 23 bp, Homo sapiens
aattttccacgcagttctttcca

SEQ ID NO: 4120079 - DNA, 14 bp, Homo sapiens
aattttcttcatgc

SEQ ID NO: 4120080 - DNA, 17 bp, Homo sapiens
aattttgacttaatgtg

SEQ ID NO: 4120081 - DNA, 17 bp, Homo sapiens
aattttgagttgccaca

SEQ ID NO: 4120082 - DNA, 11 bp, Homo sapiens
aattttgcaaa

SEQ ID NO: 4120083 - DNA, 16 bp, Homo sapiens
aattttgcaaatataa

SEQ ID NO: 4120084 - DNA, 18 bp, Homo sapiens
aattttgcaaatataaac

SEQ ID NO: 4120085 - DNA, 14 bp, Homo sapiens
aattttgcaaatta

SEQ ID NO: 4120086 - DNA, 22 bp, Homo sapiens
aattttgctggaattcctaact

SEQ ID NO: 4120087 - DNA, 16 bp, Homo sapiens
aattttgcttttaatt

SEQ ID NO: 4120088 - DNA, 17 bp, Homo sapiens
aattttgcttttaatta

SEQ ID NO: 4120089 - DNA, 18 bp, Homo sapiens
aattttggaagattttca

SEQ ID NO: 4120090 - DNA, 22 bp, Homo sapiens
aattttggccaaagtgttaatc

SEQ ID NO: 4120091 - DNA, 13 bp, Homo sapiens
aattttgtacaaa

SEQ ID NO: 4120092 - DNA, 14 bp, Homo sapiens
aattttgtacaaat

SEQ ID NO: 4120093 - DNA, 14 bp, Homo sapiens
aattttgtttttat

SEQ ID NO: 4120094 - DNA, 19 bp, Homo sapiens
aatttttaaagtatatatt

SEQ ID NO: 4120095 - DNA, 22 bp, Homo sapiens
aatttttaaagtatatatttat

SEQ ID NO: 4120096 - DNA, 20 bp, Homo sapiens
aatttttacattcatcaata

SEQ ID NO: 4120097 - DNA, 22 bp, Homo sapiens
aatttttaggaagttttctgta

SEQ ID NO: 4120098 - DNA, 22 bp, Homo sapiens
aatttttatatttaattattaa

SEQ ID NO: 4120099 - DNA, 15 bp, Homo sapiens
aatttttatttcttc

SEQ ID NO: 4120100 - DNA, 16 bp, Homo sapiens
aatttttatttttcta

SEQ ID NO: 4120101 - DNA, 15 bp, Homo sapiens
aatttttcagatgct

SEQ ID NO: 4120102 - DNA, 19 bp, Homo sapiens
aatttttcagatgcttctg

SEQ ID NO: 4120103 - DNA, 21 bp, Homo sapiens
aatttttcttttcttgatttt

SEQ ID NO: 4120104 - DNA, 22 bp, Homo sapiens
aatttttcttttcttgattttt

SEQ ID NO: 4120105 - DNA, 20 bp, Homo sapiens
aatttttggggaaaaaagca

SEQ ID NO: 4120106 - DNA, 21 bp, Homo sapiens
aatttttggggaaaaaagcac

SEQ ID NO: 4120107 - DNA, 22 bp, Homo sapiens
aatttttggggaaaaaagcaca

SEQ ID NO: 4120108 - DNA, 23 bp, Homo sapiens
aatttttggggaaaaaagcacat

SEQ ID NO: 4120109 - DNA, 15 bp, Homo sapiens
aatttttgtctcaga

SEQ ID NO: 4120110 - DNA, 18 bp, Homo sapiens
aatttttttatgttttgt

SEQ ID NO: 4120111 - DNA, 13 bp, Homo sapiens
aatttttttcacc

SEQ ID NO: 4120112 - DNA, 20 bp, Homo sapiens
aatttttttcacctagattt

SEQ ID NO: 4120113 - DNA, 15 bp, Homo sapiens
aatttttttgtaata

SEQ ID NO: 4120114 - DNA, 12 bp, Homo sapiens
aattttttttac

SEQ ID NO: 4120115 - DNA, 12 bp, Homo sapiens
acaaaaaatact

SEQ ID NO: 4120116 - DNA, 18 bp, Homo sapiens
acaaaaagtttccatatg

SEQ ID NO: 4120117 - DNA, 12 bp, Homo sapiens
acaaaaataaca

SEQ ID NO: 4120118 - DNA, 13 bp, Homo sapiens
acaaaaatataaa

SEQ ID NO: 4120119 - DNA, 22 bp, Homo sapiens
acaaaaatgaaagcatgtctca

SEQ ID NO: 4120120 - DNA, 19 bp, Homo sapiens
acaaaaatgaactgaagtt

SEQ ID NO: 4120121 - DNA, 13 bp, Homo sapiens
acaaaaatttgaa

SEQ ID NO: 4120122 - DNA, 19 bp, Homo sapiens
acaaaacaatccccatcag

SEQ ID NO: 4120123 - DNA, 23 bp, Homo sapiens
acaaaactacatgagaacaaaca

SEQ ID NO: 4120124 - DNA, 13 bp, Homo sapiens
acaaaagatgaaa

SEQ ID NO: 4120125 - DNA, 11 bp, Homo sapiens
acaaaagatgt

SEQ ID NO: 4120126 - DNA, 21 bp, Homo sapiens
acaaaagatgtatccttccaa

SEQ ID NO: 4120127 - DNA, 14 bp, Homo sapiens
acaaaagtaaatgg

SEQ ID NO: 4120128 - DNA, 21 bp, Homo sapiens
acaaaagtctgtctttcctga

SEQ ID NO: 4120129 - DNA, 16 bp, Homo sapiens
acaaaatctaaaacaa

SEQ ID NO: 4120130 - DNA, 10 bp, Homo sapiens
acaaaatgga

SEQ ID NO: 4120131 - DNA, 11 bp, Homo sapiens
acaaaatggac

SEQ ID NO: 4120132 - DNA, 22 bp, Homo sapiens
acaaaatgtctcagttttcagc

SEQ ID NO: 4120133 - DNA, 16 bp, Homo sapiens
acaaaattgcaatttc

SEQ ID NO: 4120134 - DNA, 22 bp, Homo sapiens
acaaaattttattttgtgctca

SEQ ID NO: 4120135 - DNA, 15 bp, Homo sapiens
acaaacaagggagaa

SEQ ID NO: 4120136 - DNA, 13 bp, Homo sapiens
acaaacaatgaaa

SEQ ID NO: 4120137 - DNA, 13 bp, Homo sapiens
acaaacacacaca

SEQ ID NO: 4120138 - DNA, 22 bp, Homo sapiens
acaaacactgcagtttcctgga

SEQ ID NO: 4120139 - DNA, 17 bp, Homo sapiens
acaaaccaacatctttg

SEQ ID NO: 4120140 - DNA, 18 bp, Homo sapiens
acaaacgtgttttttaaa

SEQ ID NO: 4120141 - DNA, 14 bp, Homo sapiens
acaaactgcaatag

SEQ ID NO: 4120142 - DNA, 13 bp, Homo sapiens
acaaactgtaaat

SEQ ID NO: 4120143 - DNA, 21 bp, Homo sapiens
acaaagaaatccggagaagct

SEQ ID NO: 4120144 - DNA, 21 bp, Homo sapiens
acaaagatgtttgtcagatat

SEQ ID NO: 4120145 - DNA, 23 bp, Homo sapiens
acaaagatgtttgtcagatatga

SEQ ID NO: 4120146 - DNA, 24 bp, Homo sapiens
acaaagatgtttgtcagatatgat

SEQ ID NO: 4120147 - DNA, 12 bp, Homo sapiens
acaaagcagcca

SEQ ID NO: 4120148 - DNA, 17 bp, Homo sapiens
acaaagccaacagtcaa

SEQ ID NO: 4120149 - DNA, 12 bp, Homo sapiens
acaaagccttac

SEQ ID NO: 4120150 - DNA, 22 bp, Homo sapiens
acaaagcttctatcccaggagg

SEQ ID NO: 4120151 - DNA, 14 bp, Homo sapiens
acaaagtaaataca

SEQ ID NO: 4120152 - DNA, 15 bp, Homo sapiens
acaaagtaatttctt

SEQ ID NO: 4120153 - DNA, 21 bp, Homo sapiens
acaaagttactaggtaacttc

SEQ ID NO: 4120154 - DNA, 12 bp, Homo sapiens
acaaatatgcaa

SEQ ID NO: 4120155 - DNA, 19 bp, Homo sapiens
acaaatatgcaaaaggttc

SEQ ID NO: 4120156 - DNA, 16 bp, Homo sapiens
acaaatatgctaattt

SEQ ID NO: 4120157 - DNA, 19 bp, Homo sapiens
acaaatctgtataaatgtc

SEQ ID NO: 4120158 - DNA, 23 bp, Homo sapiens
acaaatctgtataaatgtctatt

SEQ ID NO: 4120159 - DNA, 19 bp, Homo sapiens
acaaatcttgggtgggtga

SEQ ID NO: 4120160 - DNA, 21 bp, Homo sapiens
acaaatgatgttttcaggtgt

SEQ ID NO: 4120161 - DNA, 21 bp, Homo sapiens
acaaatgcaggtgtcctgagc

SEQ ID NO: 4120162 - DNA, 20 bp, Homo sapiens
acaaatgccttaaaatggaa

SEQ ID NO: 4120163 - DNA, 17 bp, Homo sapiens
acaaatgctcaaagaaa

SEQ ID NO: 4120164 - DNA, 21 bp, Homo sapiens
acaaatgtattttgaagaata

SEQ ID NO: 4120165 - DNA, 23 bp, Homo sapiens
acaaatgtattttgaagaatatt

SEQ ID NO: 4120166 - DNA, 13 bp, Homo sapiens
acaaattaatttt

SEQ ID NO: 4120167 - DNA, 17 bp, Homo sapiens
acaaattcatattctgt

SEQ ID NO: 4120168 - DNA, 17 bp, Homo sapiens
acaacaaaaagcttccc

SEQ ID NO: 4120169 - DNA, 18 bp, Homo sapiens
acaacaaaggcaagttaa

SEQ ID NO: 4120170 - DNA, 18 bp, Homo sapiens
acaacaattggtaaaact

SEQ ID NO: 4120171 - DNA, 20 bp, Homo sapiens
acaacagtgctttgtaaatt

SEQ ID NO: 4120172 - DNA, 21 bp, Homo sapiens
acaaccaatttacactgccat

SEQ ID NO: 4120173 - DNA, 15 bp, Homo sapiens
acaaccactggtctg

SEQ ID NO: 4120174 - DNA, 13 bp, Homo sapiens
acaacccccagct

SEQ ID NO: 4120175 - DNA, 17 bp, Homo sapiens
acaaccctgttttatac

SEQ ID NO: 4120176 - DNA, 22 bp, Homo sapiens
acaacctccattctattttaga

SEQ ID NO: 4120177 - DNA, 20 bp, Homo sapiens
acaacctctctgatcttgtg

SEQ ID NO: 4120178 - DNA, 19 bp, Homo sapiens
acaactaggcttcagcata

SEQ ID NO: 4120179 - DNA, 18 bp, Homo sapiens
acaactatcctgacttct

SEQ ID NO: 4120180 - DNA, 21 bp, Homo sapiens
acaactgcaataacttctgac

SEQ ID NO: 4120181 - DNA, 21 bp, Homo sapiens
acaactgcctcgaaacacaga

SEQ ID NO: 4120182 - DNA, 17 bp, Homo sapiens
acaactgtctaacttta

SEQ ID NO: 4120183 - DNA, 19 bp, Homo sapiens
acaactgtctaactttaga

SEQ ID NO: 4120184 - DNA, 13 bp, Homo sapiens
acaactgtgactg

SEQ ID NO: 4120185 - DNA, 14 bp, Homo sapiens
acaactgtgactgt

SEQ ID NO: 4120186 - DNA, 15 bp, Homo sapiens
acaacttaatggaaa

SEQ ID NO: 4120187 - DNA, 23 bp, Homo sapiens
acaacttatttaaaaatatttca

SEQ ID NO: 4120188 - DNA, 17 bp, Homo sapiens
acaacttcaatatccaa

SEQ ID NO: 4120189 - DNA, 14 bp, Homo sapiens
acaacttcagcagt

SEQ ID NO: 4120190 - DNA, 13 bp, Homo sapiens
acaactttgccag

SEQ ID NO: 4120191 - DNA, 16 bp, Homo sapiens
acaagaaatccctgtt

SEQ ID NO: 4120192 - DNA, 15 bp, Homo sapiens
acaagaactgaaacc

SEQ ID NO: 4120193 - DNA, 13 bp, Homo sapiens
acaagaagaaata

SEQ ID NO: 4120194 - DNA, 15 bp, Homo sapiens
acaagaaggaacaat

SEQ ID NO: 4120195 - DNA, 23 bp, Homo sapiens
acaagaatgcattccctgaatct

SEQ ID NO: 4120196 - DNA, 13 bp, Homo sapiens
acaagaatggatc

SEQ ID NO: 4120197 - DNA, 23 bp, Homo sapiens
acaagaatggatcacaagatgga

SEQ ID NO: 4120198 - DNA, 15 bp, Homo sapiens
acaagacagaagctg

SEQ ID NO: 4120199 - DNA, 19 bp, Homo sapiens
acaagaccaccacttcgaa

SEQ ID NO: 4120200 - DNA, 19 bp, Homo sapiens
acaagaccccgtctcaaaa

SEQ ID NO: 4120201 - DNA, 16 bp, Homo sapiens
acaagactgttgtgat

SEQ ID NO: 4120202 - DNA, 21 bp, Homo sapiens
acaagagacttaaaggacagg

SEQ ID NO: 4120203 - DNA, 15 bp, Homo sapiens
acaagagcactacat

SEQ ID NO: 4120204 - DNA, 18 bp, Homo sapiens
acaagagcagcctgtggc

SEQ ID NO: 4120205 - DNA, 19 bp, Homo sapiens
acaagagcagcctgtggca

SEQ ID NO: 4120206 - DNA, 17 bp, Homo sapiens
acaagatattgtacata

SEQ ID NO: 4120207 - DNA, 18 bp, Homo sapiens
acaagatattgtacataa

SEQ ID NO: 4120208 - DNA, 13 bp, Homo sapiens
acaagatccattt

SEQ ID NO: 4120209 - DNA, 21 bp, Homo sapiens
acaagcagagtgcacagctgt

SEQ ID NO: 4120210 - DNA, 21 bp, Homo sapiens
acaagccaaaagtccctccct

SEQ ID NO: 4120211 - DNA, 14 bp, Homo sapiens
acaagccaacttgt

SEQ ID NO: 4120212 - DNA, 21 bp, Homo sapiens
acaagccaacttgtaaataca

SEQ ID NO: 4120213 - DNA, 23 bp, Homo sapiens
acaagctattccctcaaatctga

SEQ ID NO: 4120214 - DNA, 14 bp, Homo sapiens
acaaggaataaatg

SEQ ID NO: 4120215 - DNA, 23 bp, Homo sapiens
acaaggaataaatgagagggaat

SEQ ID NO: 4120216 - DNA, 16 bp, Homo sapiens
acaaggaatgcctgtg

SEQ ID NO: 4120217 - DNA, 18 bp, Homo sapiens
acaaggaatgcctgtgcc

SEQ ID NO: 4120218 - DNA, 20 bp, Homo sapiens
acaaggaatgcctgtgccaa

SEQ ID NO: 4120219 - DNA, 15 bp, Homo sapiens
acaaggaggtagaga

SEQ ID NO: 4120220 - DNA, 18 bp, Homo sapiens
acaaggatagatgctggc

SEQ ID NO: 4120221 - DNA, 18 bp, Homo sapiens
acaaggccatctgggctc

SEQ ID NO: 4120222 - DNA, 14 bp, Homo sapiens
acaaggctggccag

SEQ ID NO: 4120223 - DNA, 15 bp, Homo sapiens
acaaggctggccagc

SEQ ID NO: 4120224 - DNA, 22 bp, Homo sapiens
acaaggcttgctgcagatacta

SEQ ID NO: 4120225 - DNA, 21 bp, Homo sapiens
acaaggggcgtgcctggcgcc

SEQ ID NO: 4120226 - DNA, 21 bp, Homo sapiens
acaaggtccactccctgctcc

SEQ ID NO: 4120227 - DNA, 20 bp, Homo sapiens
acaaggttccctctgagaat

SEQ ID NO: 4120228 - DNA, 22 bp, Homo sapiens
acaagtcagctccagctttctg

SEQ ID NO: 4120229 - DNA, 21 bp, Homo sapiens
acaagtcattttaactttatc

SEQ ID NO: 4120230 - DNA, 23 bp, Homo sapiens
acaagtcattttaactttatcac

SEQ ID NO: 4120231 - DNA, 21 bp, Homo sapiens
acaagtcctggatgttgtgtg

SEQ ID NO: 4120232 - DNA, 17 bp, Homo sapiens
acaagtggtgtttattg

SEQ ID NO: 4120233 - DNA, 18 bp, Homo sapiens
acaagttgcttttacctg

SEQ ID NO: 4120234 - DNA, 19 bp, Homo sapiens
acaagttgttattgttgaa

SEQ ID NO: 4120235 - DNA, 13 bp, Homo sapiens
acaataaatgtat

SEQ ID NO: 4120236 - DNA, 15 bp, Homo sapiens
acaataaatgtgctt

SEQ ID NO: 4120237 - DNA, 21 bp, Homo sapiens
acaataacactaaaattttag

SEQ ID NO: 4120238 - DNA, 17 bp, Homo sapiens
acaataactactgtgtt

SEQ ID NO: 4120239 - DNA, 21 bp, Homo sapiens
acaataactactgtgttcctg

SEQ ID NO: 4120240 - DNA, 13 bp, Homo sapiens
acaatacaaatgg

SEQ ID NO: 4120241 - DNA, 16 bp, Homo sapiens
acaatacaaatggatt

SEQ ID NO: 4120242 - DNA, 19 bp, Homo sapiens
acaatagctttaccctcag

SEQ ID NO: 4120243 - DNA, 12 bp, Homo sapiens
acaatatcatat

SEQ ID NO: 4120244 - DNA, 17 bp, Homo sapiens
acaatatcatatcatca

SEQ ID NO: 4120245 - DNA, 13 bp, Homo sapiens
acaatatgtatgc

SEQ ID NO: 4120246 - DNA, 17 bp, Homo sapiens
acaatattttgtggctt

SEQ ID NO: 4120247 - DNA, 19 bp, Homo sapiens
acaatcatgaaatatgcat

SEQ ID NO: 4120248 - DNA, 18 bp, Homo sapiens
acaatcattgctgaaaat

SEQ ID NO: 4120249 - DNA, 18 bp, Homo sapiens
acaatctggaagaaaaaa

SEQ ID NO: 4120250 - DNA, 12 bp, Homo sapiens
acaatcttctgt

SEQ ID NO: 4120251 - DNA, 18 bp, Homo sapiens
acaatgaaaactctttgc

SEQ ID NO: 4120252 - DNA, 21 bp, Homo sapiens
acaatgaaaactctttgctgc

SEQ ID NO: 4120253 - DNA, 18 bp, Homo sapiens
acaatgaagataaaaaga

SEQ ID NO: 4120254 - DNA, 23 bp, Homo sapiens
acaatgtagatggcctcttacta

SEQ ID NO: 4120255 - DNA, 22 bp, Homo sapiens
acaatgtcagtatttcagtgta

SEQ ID NO: 4120256 - DNA, 22 bp, Homo sapiens
acaatgtcatatactgccatgt

SEQ ID NO: 4120257 - DNA, 19 bp, Homo sapiens
acaatgttaaggaaactct

SEQ ID NO: 4120258 - DNA, 17 bp, Homo sapiens
acaattaatagtttgtc

SEQ ID NO: 4120259 - DNA, 12 bp, Homo sapiens
acaattataaac

SEQ ID NO: 4120260 - DNA, 19 bp, Homo sapiens
acaattattggcaaagttt

SEQ ID NO: 4120261 - DNA, 23 bp, Homo sapiens
acaattcctagataaaaagatgg

SEQ ID NO: 4120262 - DNA, 15 bp, Homo sapiens
acaattctacattgt

SEQ ID NO: 4120263 - DNA, 19 bp, Homo sapiens
acaattctccctatcttgt

SEQ ID NO: 4120264 - DNA, 20 bp, Homo sapiens
acaattctccctatcttgtg

SEQ ID NO: 4120265 - DNA, 16 bp, Homo sapiens
acaattgaagtaaact

SEQ ID NO: 4120266 - DNA, 19 bp, Homo sapiens
acaattgaagtaaactttt

SEQ ID NO: 4120267 - DNA, 15 bp, Homo sapiens
acaattggtaaaact

SEQ ID NO: 4120268 - DNA, 17 bp, Homo sapiens
acaattgtgtagccttt

SEQ ID NO: 4120269 - DNA, 23 bp, Homo sapiens
acaattgtgtagcctttttgtat

SEQ ID NO: 4120270 - DNA, 13 bp, Homo sapiens
acaatttgataca

SEQ ID NO: 4120271 - DNA, 15 bp, Homo sapiens
acaatttgatacata

SEQ ID NO: 4120272 - DNA, 16 bp, Homo sapiens
acaatttgatacataa

SEQ ID NO: 4120273 - DNA, 21 bp, Homo sapiens
acaatttgatacataataaaa

SEQ ID NO: 4120274 - DNA, 16 bp, Homo sapiens
acaattttttttttcc

SEQ ID NO: 4120275 - DNA, 22 bp, Homo sapiens
acacaagaagaagggcacccta

SEQ ID NO: 4120276 - DNA, 14 bp, Homo sapiens
acacaagctggaag

SEQ ID NO: 4120277 - DNA, 15 bp, Homo sapiens
acacaatatgtatgc

SEQ ID NO: 4120278 - DNA, 16 bp, Homo sapiens
acacaatatgtatgct

SEQ ID NO: 4120279 - DNA, 22 bp, Homo sapiens
acacaatatgtatgctttttac

SEQ ID NO: 4120280 - DNA, 15 bp, Homo sapiens
acacaatccctgggg

SEQ ID NO: 4120281 - DNA, 23 bp, Homo sapiens
acacaatttaattcctcttttta

SEQ ID NO: 4120282 - DNA, 10 bp, Homo sapiens
acacacacac

SEQ ID NO: 4120283 - DNA, 15 bp, Homo sapiens
acacacacacaaacc

SEQ ID NO: 4120284 - DNA, 14 bp, Homo sapiens
acacacacacacac

SEQ ID NO: 4120285 - DNA, 14 bp, Homo sapiens
acacacacacacag

SEQ ID NO: 4120286 - DNA, 12 bp, Homo sapiens
acacacacacag

SEQ ID NO: 4120287 - DNA, 13 bp, Homo sapiens
acacacacacgca

SEQ ID NO: 4120288 - DNA, 14 bp, Homo sapiens
acacacacacgcac

SEQ ID NO: 4120289 - DNA, 13 bp, Homo sapiens
acacacacactcc

SEQ ID NO: 4120290 - DNA, 12 bp, Homo sapiens
acacacacaggt

SEQ ID NO: 4120291 - DNA, 15 bp, Homo sapiens
acacacacaggtggg

SEQ ID NO: 4120292 - DNA, 13 bp, Homo sapiens
acacacacataca

SEQ ID NO: 4120293 - DNA, 12 bp, Homo sapiens
acacacacgcac

SEQ ID NO: 4120294 - DNA, 19 bp, Homo sapiens
acacacacgcacgcacaca

SEQ ID NO: 4120295 - DNA, 13 bp, Homo sapiens
acacacagcactc

SEQ ID NO: 4120296 - DNA, 13 bp, Homo sapiens
acacacagcagtg

SEQ ID NO: 4120297 - DNA, 24 bp, Homo sapiens
acacacaggtggggactgggcaca

SEQ ID NO: 4120298 - DNA, 21 bp, Homo sapiens
acacacatataaacatcacac

SEQ ID NO: 4120299 - DNA, 19 bp, Homo sapiens
acacacatgggcagcccaa

SEQ ID NO: 4120300 - DNA, 19 bp, Homo sapiens
acacaccccacaccccagc

SEQ ID NO: 4120301 - DNA, 20 bp, Homo sapiens
acacaccccacaccccagcc

SEQ ID NO: 4120302 - DNA, 21 bp, Homo sapiens
acacaccccacaccccagccc

SEQ ID NO: 4120303 - DNA, 13 bp, Homo sapiens
acacaccctgagg

SEQ ID NO: 4120304 - DNA, 14 bp, Homo sapiens
acacaccctgaggt

SEQ ID NO: 4120305 - DNA, 13 bp, Homo sapiens
acacacgcacgca

SEQ ID NO: 4120306 - DNA, 18 bp, Homo sapiens
acacacgcacgcacacac

SEQ ID NO: 4120307 - DNA, 13 bp, Homo sapiens
acacactaatcga

SEQ ID NO: 4120308 - DNA, 14 bp, Homo sapiens
acacactcaggcct

SEQ ID NO: 4120309 - DNA, 24 bp, Homo sapiens
acacactcaggcctgtgcccactc

SEQ ID NO: 4120310 - DNA, 14 bp, Homo sapiens
acacactccctgct

SEQ ID NO: 4120311 - DNA, 19 bp, Homo sapiens
acacactttttaagaaata

SEQ ID NO: 4120312 - DNA, 19 bp, Homo sapiens
acacagaaaatgttgagaa

SEQ ID NO: 4120313 - DNA, 21 bp, Homo sapiens
acacagaaacctttttaaaaa

SEQ ID NO: 4120314 - DNA, 22 bp, Homo sapiens
acacagagaagcggatttccag

SEQ ID NO: 4120315 - DNA, 20 bp, Homo sapiens
acacagaggaatttatacct

SEQ ID NO: 4120316 - DNA, 19 bp, Homo sapiens
acacagaggctgcctctcc

SEQ ID NO: 4120317 - DNA, 14 bp, Homo sapiens
acacagcagtgtga

SEQ ID NO: 4120318 - DNA, 14 bp, Homo sapiens
acacagcatgtgta

SEQ ID NO: 4120319 - DNA, 15 bp, Homo sapiens
acacagcctggactt

SEQ ID NO: 4120320 - DNA, 22 bp, Homo sapiens
acacagctagtgaagaccagag

SEQ ID NO: 4120321 - DNA, 11 bp, Homo sapiens
acacagctgcc

SEQ ID NO: 4120322 - DNA, 16 bp, Homo sapiens
acacagctgccctagc

SEQ ID NO: 4120323 - DNA, 19 bp, Homo sapiens
acacagctgggcaaagcca

SEQ ID NO: 4120324 - DNA, 20 bp, Homo sapiens
acacaggcacgggtccctgc

SEQ ID NO: 4120325 - DNA, 15 bp, Homo sapiens
acacaggcagctttc

SEQ ID NO: 4120326 - DNA, 16 bp, Homo sapiens
acacaggccaccctgt

SEQ ID NO: 4120327 - DNA, 19 bp, Homo sapiens
acacaggccaccctgtgca

SEQ ID NO: 4120328 - DNA, 23 bp, Homo sapiens
acacagtcaaaataattctaaat

SEQ ID NO: 4120329 - DNA, 16 bp, Homo sapiens
acacagtcagcatgct

SEQ ID NO: 4120330 - DNA, 22 bp, Homo sapiens
acacagttgctgtcataagaat

SEQ ID NO: 4120331 - DNA, 15 bp, Homo sapiens
acacataccctcttc

SEQ ID NO: 4120332 - DNA, 14 bp, Homo sapiens
acacatataaacat

SEQ ID NO: 4120333 - DNA, 21 bp, Homo sapiens
acacatgcctatattatcata

SEQ ID NO: 4120334 - DNA, 16 bp, Homo sapiens
acacatgctaggatgc

SEQ ID NO: 4120335 - DNA, 20 bp, Homo sapiens
acacattatcgggagcagtg

SEQ ID NO: 4120336 - DNA, 14 bp, Homo sapiens
acacattatgtatc

SEQ ID NO: 4120337 - DNA, 21 bp, Homo sapiens
acacattgaatgcgctttatt

SEQ ID NO: 4120338 - DNA, 22 bp, Homo sapiens
acacattgaatgcgctttattg

SEQ ID NO: 4120339 - DNA, 19 bp, Homo sapiens
acacattggaatgccttgg

SEQ ID NO: 4120340 - DNA, 15 bp, Homo sapiens
acacatttgtacaga

SEQ ID NO: 4120341 - DNA, 18 bp, Homo sapiens
acacatttgtacagaatt

SEQ ID NO: 4120342 - DNA, 23 bp, Homo sapiens
acaccaatcccagggctggctct

SEQ ID NO: 4120343 - DNA, 18 bp, Homo sapiens
acaccacaattctcccta

SEQ ID NO: 4120344 - DNA, 12 bp, Homo sapiens
acaccacagaca

SEQ ID NO: 4120345 - DNA, 21 bp, Homo sapiens
acaccacagacacacacacgc

SEQ ID NO: 4120346 - DNA, 22 bp, Homo sapiens
acaccacagacacacacacgca

SEQ ID NO: 4120347 - DNA, 20 bp, Homo sapiens
acaccagagcagatgcagag

SEQ ID NO: 4120348 - DNA, 18 bp, Homo sapiens
acaccccacaccccagcc

SEQ ID NO: 4120349 - DNA, 19 bp, Homo sapiens
acaccccacaccccagccc

SEQ ID NO: 4120350 - DNA, 11 bp, Homo sapiens
acaccccagcc

SEQ ID NO: 4120351 - DNA, 15 bp, Homo sapiens
acacccctacacaca

SEQ ID NO: 4120352 - DNA, 16 bp, Homo sapiens
acacccctacacacac

SEQ ID NO: 4120353 - DNA, 18 bp, Homo sapiens
acaccccttatccaggac

SEQ ID NO: 4120354 - DNA, 19 bp, Homo sapiens
acaccccttatccaggact

SEQ ID NO: 4120355 - DNA, 18 bp, Homo sapiens
acaccctcaacctcttct

SEQ ID NO: 4120356 - DNA, 17 bp, Homo sapiens
acaccgtgtaaaccaaa

SEQ ID NO: 4120357 - DNA, 21 bp, Homo sapiens
acacctagctttattcttcag

SEQ ID NO: 4120358 - DNA, 18 bp, Homo sapiens
acacctcagttcccttgg

SEQ ID NO: 4120359 - DNA, 13 bp, Homo sapiens
acacctctgccag

SEQ ID NO: 4120360 - DNA, 14 bp, Homo sapiens
acacctctgccaga

SEQ ID NO: 4120361 - DNA, 16 bp, Homo sapiens
acacctgacagcccct

SEQ ID NO: 4120362 - DNA, 14 bp, Homo sapiens
acaccttccagggc

SEQ ID NO: 4120363 - DNA, 15 bp, Homo sapiens
acaccttccagggcc

SEQ ID NO: 4120364 - DNA, 17 bp, Homo sapiens
acaccttccagggccct

SEQ ID NO: 4120365 - DNA, 19 bp, Homo sapiens
acaccttggggtccctcca

SEQ ID NO: 4120366 - DNA, 23 bp, Homo sapiens
acaccttggggtccctccacccc

SEQ ID NO: 4120367 - DNA, 13 bp, Homo sapiens
acacgcacaaaca

SEQ ID NO: 4120368 - DNA, 15 bp, Homo sapiens
acacgcacaaacaca

SEQ ID NO: 4120369 - DNA, 18 bp, Homo sapiens
acacgcacaaacacacac

SEQ ID NO: 4120370 - DNA, 16 bp, Homo sapiens
acacgccttcccctca

SEQ ID NO: 4120371 - DNA, 21 bp, Homo sapiens
acacgcgggcgcgatcccaca

SEQ ID NO: 4120372 - DNA, 16 bp, Homo sapiens
acacgctcgcgggcag

SEQ ID NO: 4120373 - DNA, 23 bp, Homo sapiens
acacgttcacccatcttatcaag

SEQ ID NO: 4120374 - DNA, 12 bp, Homo sapiens
acactaaaattt

SEQ ID NO: 4120375 - DNA, 15 bp, Homo sapiens
acactaaaattttag

SEQ ID NO: 4120376 - DNA, 18 bp, Homo sapiens
acactaaaattttaggca

SEQ ID NO: 4120377 - DNA, 17 bp, Homo sapiens
acactaaagatccaaga

SEQ ID NO: 4120378 - DNA, 16 bp, Homo sapiens
acactaaccaagctga

SEQ ID NO: 4120379 - DNA, 13 bp, Homo sapiens
acactaattcata

SEQ ID NO: 4120380 - DNA, 21 bp, Homo sapiens
acactacagagcagctcccca

SEQ ID NO: 4120381 - DNA, 17 bp, Homo sapiens
acactaccccatataca

SEQ ID NO: 4120382 - DNA, 17 bp, Homo sapiens
acactactgctaaatcc

SEQ ID NO: 4120383 - DNA, 18 bp, Homo sapiens
acactactgctaaatcct

SEQ ID NO: 4120384 - DNA, 16 bp, Homo sapiens
acactataaggctgag

SEQ ID NO: 4120385 - DNA, 14 bp, Homo sapiens
acactcagacctga

SEQ ID NO: 4120386 - DNA, 19 bp, Homo sapiens
acactcagacctgaattct

SEQ ID NO: 4120387 - DNA, 16 bp, Homo sapiens
acactcagcacaaggc

SEQ ID NO: 4120388 - DNA, 12 bp, Homo sapiens
acactcaggcct

SEQ ID NO: 4120389 - DNA, 17 bp, Homo sapiens
acactcaggcctgtgcc

SEQ ID NO: 4120390 - DNA, 18 bp, Homo sapiens
acactcaggcctgtgccc

SEQ ID NO: 4120391 - DNA, 16 bp, Homo sapiens
acactcagttgttcaa

SEQ ID NO: 4120392 - DNA, 14 bp, Homo sapiens
acactccaggcctc

SEQ ID NO: 4120393 - DNA, 14 bp, Homo sapiens
acactccagtgcca

SEQ ID NO: 4120394 - DNA, 13 bp, Homo sapiens
acactccatctcc

SEQ ID NO: 4120395 - DNA, 23 bp, Homo sapiens
acactccatctcctgctcaccac

SEQ ID NO: 4120396 - DNA, 20 bp, Homo sapiens
acactcccaaggttggagcc

SEQ ID NO: 4120397 - DNA, 20 bp, Homo sapiens
acactccccgccttagagcc

SEQ ID NO: 4120398 - DNA, 20 bp, Homo sapiens
acactcctagagaacgcagc

SEQ ID NO: 4120399 - DNA, 14 bp, Homo sapiens
acactctctggaag

SEQ ID NO: 4120400 - DNA, 23 bp, Homo sapiens
acactctctggaagccctggaga

SEQ ID NO: 4120401 - DNA, 17 bp, Homo sapiens
acactgaaagttttgta

SEQ ID NO: 4120402 - DNA, 18 bp, Homo sapiens
acactgaaagttttgtaa

SEQ ID NO: 4120403 - DNA, 22 bp, Homo sapiens
acactgatgcttagatgttcca

SEQ ID NO: 4120404 - DNA, 18 bp, Homo sapiens
acactgctcttaagaaac

SEQ ID NO: 4120405 - DNA, 19 bp, Homo sapiens
acactgctcttaagaaact

SEQ ID NO: 4120406 - DNA, 21 bp, Homo sapiens
acactgctgctccagtgcagg

SEQ ID NO: 4120407 - DNA, 14 bp, Homo sapiens
acactgctgtaccc

SEQ ID NO: 4120408 - DNA, 19 bp, Homo sapiens
acactggaacatggctagc

SEQ ID NO: 4120409 - DNA, 20 bp, Homo sapiens
acactgggtggtggcctggt

SEQ ID NO: 4120410 - DNA, 16 bp, Homo sapiens
acactggtctgctgtc

SEQ ID NO: 4120411 - DNA, 21 bp, Homo sapiens
acactgtcatgcttcatcatt

SEQ ID NO: 4120412 - DNA, 21 bp, Homo sapiens
acactgtccctctttggcagt

SEQ ID NO: 4120413 - DNA, 18 bp, Homo sapiens
acactgttactccacagc

SEQ ID NO: 4120414 - DNA, 23 bp, Homo sapiens
acacttaaaattgtaacctgcat

SEQ ID NO: 4120415 - DNA, 11 bp, Homo sapiens
acacttaacag

SEQ ID NO: 4120416 - DNA, 14 bp, Homo sapiens
acacttaacagatg

SEQ ID NO: 4120417 - DNA, 18 bp, Homo sapiens
acacttacactttatgca

SEQ ID NO: 4120418 - DNA, 15 bp, Homo sapiens
acacttagctggaga

SEQ ID NO: 4120419 - DNA, 16 bp, Homo sapiens
acacttcagagagctg

SEQ ID NO: 4120420 - DNA, 17 bp, Homo sapiens
acacttcagagagctgg

SEQ ID NO: 4120421 - DNA, 19 bp, Homo sapiens
acacttcaggctcttctcc

SEQ ID NO: 4120422 - DNA, 20 bp, Homo sapiens
acacttctgtgagaccccca

SEQ ID NO: 4120423 - DNA, 18 bp, Homo sapiens
acacttgccttcttcacc

SEQ ID NO: 4120424 - DNA, 14 bp, Homo sapiens
acacttgctcccaa

SEQ ID NO: 4120425 - DNA, 15 bp, Homo sapiens
acacttgtagagcag

SEQ ID NO: 4120426 - DNA, 22 bp, Homo sapiens
acacttgtgattataaaattaa

SEQ ID NO: 4120427 - DNA, 19 bp, Homo sapiens
acacttgttccagctcttt

SEQ ID NO: 4120428 - DNA, 19 bp, Homo sapiens
acactttgcactgatatat

SEQ ID NO: 4120429 - DNA, 22 bp, Homo sapiens
acactttgcactgatatatcat

SEQ ID NO: 4120430 - DNA, 21 bp, Homo sapiens
acactttttctttacaaacaa

SEQ ID NO: 4120431 - DNA, 13 bp, Homo sapiens
acagaaaaatata

SEQ ID NO: 4120432 - DNA, 20 bp, Homo sapiens
acagaaacctttttaaaaat

SEQ ID NO: 4120433 - DNA, 18 bp, Homo sapiens
acagaaacgcatccagca

SEQ ID NO: 4120434 - DNA, 23 bp, Homo sapiens
acagaaactaaactcttaccata

SEQ ID NO: 4120435 - DNA, 20 bp, Homo sapiens
acagaaagagactccgtctc

SEQ ID NO: 4120436 - DNA, 13 bp, Homo sapiens
acagaaatactat

SEQ ID NO: 4120437 - DNA, 19 bp, Homo sapiens
acagaaatgctgctggcca

SEQ ID NO: 4120438 - DNA, 14 bp, Homo sapiens
acagaacagcttca

SEQ ID NO: 4120439 - DNA, 17 bp, Homo sapiens
acagaacagcttcaggt

SEQ ID NO: 4120440 - DNA, 13 bp, Homo sapiens
acagaacagggtc

SEQ ID NO: 4120441 - DNA, 15 bp, Homo sapiens
acagaactaaatgtt

SEQ ID NO: 4120442 - DNA, 17 bp, Homo sapiens
acagaactaaatgttct

SEQ ID NO: 4120443 - DNA, 20 bp, Homo sapiens
acagaacttcagaaagactt

SEQ ID NO: 4120444 - DNA, 13 bp, Homo sapiens
acagaagcttcca

SEQ ID NO: 4120445 - DNA, 15 bp, Homo sapiens
acagaatatttttat

SEQ ID NO: 4120446 - DNA, 16 bp, Homo sapiens
acagaatatttttata

SEQ ID NO: 4120447 - DNA, 14 bp, Homo sapiens
acagacaacagaag

SEQ ID NO: 4120448 - DNA, 17 bp, Homo sapiens
acagacacaatatgtat

SEQ ID NO: 4120449 - DNA, 12 bp, Homo sapiens
acagacacacac

SEQ ID NO: 4120450 - DNA, 13 bp, Homo sapiens
acagacacacaca

SEQ ID NO: 4120451 - DNA, 22 bp, Homo sapiens
acagacacacacacgcacgcac

SEQ ID NO: 4120452 - DNA, 13 bp, Homo sapiens
acagacaggctct

SEQ ID NO: 4120453 - DNA, 15 bp, Homo sapiens
acagacaggctctta

SEQ ID NO: 4120454 - DNA, 21 bp, Homo sapiens
acagaccacatctttatctgt

SEQ ID NO: 4120455 - DNA, 14 bp, Homo sapiens
acagaccacttgcc

SEQ ID NO: 4120456 - DNA, 20 bp, Homo sapiens
acagaccagtgaccccagaa

SEQ ID NO: 4120457 - DNA, 12 bp, Homo sapiens
acagacccagga

SEQ ID NO: 4120458 - DNA, 15 bp, Homo sapiens
acagacccctaggga

SEQ ID NO: 4120459 - DNA, 16 bp, Homo sapiens
acagactgttgagtta

SEQ ID NO: 4120460 - DNA, 15 bp, Homo sapiens
acagacttctccaga

SEQ ID NO: 4120461 - DNA, 15 bp, Homo sapiens
acagacttgagaact

SEQ ID NO: 4120462 - DNA, 18 bp, Homo sapiens
acagagacgcaggaatgg

SEQ ID NO: 4120463 - DNA, 14 bp, Homo sapiens
acagagaggagaaa

SEQ ID NO: 4120464 - DNA, 16 bp, Homo sapiens
acagagaggagaaaca

SEQ ID NO: 4120465 - DNA, 24 bp, Homo sapiens
acagagagggagagcagagaaaga

SEQ ID NO: 4120466 - DNA, 21 bp, Homo sapiens
acagagagggcaccatcacaa

SEQ ID NO: 4120467 - DNA, 15 bp, Homo sapiens
acagagatgtctctt

SEQ ID NO: 4120468 - DNA, 20 bp, Homo sapiens
acagagattgaactccaaga

SEQ ID NO: 4120469 - DNA, 19 bp, Homo sapiens
acagagcctgccccagcgc

SEQ ID NO: 4120470 - DNA, 22 bp, Homo sapiens
acagagctgtcacttttgctcc

SEQ ID NO: 4120471 - DNA, 12 bp, Homo sapiens
acagagctgtgg

SEQ ID NO: 4120472 - DNA, 12 bp, Homo sapiens
acagaggaaagg

SEQ ID NO: 4120473 - DNA, 20 bp, Homo sapiens
acagaggaaagggctggctc

SEQ ID NO: 4120474 - DNA, 13 bp, Homo sapiens
acagaggcagccc

SEQ ID NO: 4120475 - DNA, 15 bp, Homo sapiens
acagaggccccagcc

SEQ ID NO: 4120476 - DNA, 22 bp, Homo sapiens
acagaggccccagcctccctga

SEQ ID NO: 4120477 - DNA, 12 bp, Homo sapiens
acagaggcctgc

SEQ ID NO: 4120478 - DNA, 22 bp, Homo sapiens
acagaggctgcacccctgggcc

SEQ ID NO: 4120479 - DNA, 24 bp, Homo sapiens
acagaggctgcacccctgggccag

SEQ ID NO: 4120480 - DNA, 15 bp, Homo sapiens
acagataagcaagag

SEQ ID NO: 4120481 - DNA, 21 bp, Homo sapiens
acagataataatgggtttctt

SEQ ID NO: 4120482 - DNA, 14 bp, Homo sapiens
acagataatcagtg

SEQ ID NO: 4120483 - DNA, 20 bp, Homo sapiens
acagatagatatatgctctg

SEQ ID NO: 4120484 - DNA, 23 bp, Homo sapiens
acagatatttccatttcttcctc

SEQ ID NO: 4120485 - DNA, 20 bp, Homo sapiens
acagatctggaacctcagcc

SEQ ID NO: 4120486 - DNA, 21 bp, Homo sapiens
acagatctggaacctcagcct

SEQ ID NO: 4120487 - DNA, 22 bp, Homo sapiens
acagatctggaacctcagcctg

SEQ ID NO: 4120488 - DNA, 13 bp, Homo sapiens
acagatgaaaatt

SEQ ID NO: 4120489 - DNA, 20 bp, Homo sapiens
acagatgcaatgtgctactg

SEQ ID NO: 4120490 - DNA, 18 bp, Homo sapiens
acagatgccacacaagga

SEQ ID NO: 4120491 - DNA, 15 bp, Homo sapiens
acagatgtctctggg

SEQ ID NO: 4120492 - DNA, 17 bp, Homo sapiens
acagatgtctctggggc

SEQ ID NO: 4120493 - DNA, 15 bp, Homo sapiens
acagattcaggccag

SEQ ID NO: 4120494 - DNA, 17 bp, Homo sapiens
acagattcaggccagcc

SEQ ID NO: 4120495 - DNA, 17 bp, Homo sapiens
acagatttcatacctca

SEQ ID NO: 4120496 - DNA, 14 bp, Homo sapiens
acagcaagaaataa

SEQ ID NO: 4120497 - DNA, 15 bp, Homo sapiens
acagcaagtagataa

SEQ ID NO: 4120498 - DNA, 21 bp, Homo sapiens
acagcaagtagataaatattt

SEQ ID NO: 4120499 - DNA, 17 bp, Homo sapiens
acagcaattcctcaggc

SEQ ID NO: 4120500 - DNA, 12 bp, Homo sapiens
acagcacagcca

SEQ ID NO: 4120501 - DNA, 17 bp, Homo sapiens
acagcactactgggtgt

SEQ ID NO: 4120502 - DNA, 20 bp, Homo sapiens
acagcactactgggtgtcat

SEQ ID NO: 4120503 - DNA, 21 bp, Homo sapiens
acagcactactgggtgtcatt

SEQ ID NO: 4120504 - DNA, 23 bp, Homo sapiens
acagcactctctaaatcttcctt

SEQ ID NO: 4120505 - DNA, 13 bp, Homo sapiens
acagcagaagcct

SEQ ID NO: 4120506 - DNA, 21 bp, Homo sapiens
acagcagataacaatgcagca

SEQ ID NO: 4120507 - DNA, 19 bp, Homo sapiens
acagcagccccccagcact

SEQ ID NO: 4120508 - DNA, 12 bp, Homo sapiens
acagcagcttca

SEQ ID NO: 4120509 - DNA, 16 bp, Homo sapiens
acagcagcttcaccag

SEQ ID NO: 4120510 - DNA, 18 bp, Homo sapiens
acagcagcttcaccagag

SEQ ID NO: 4120511 - DNA, 22 bp, Homo sapiens
acagcagtgtgaatagcctggc

SEQ ID NO: 4120512 - DNA, 13 bp, Homo sapiens
acagcagtgttcc

SEQ ID NO: 4120513 - DNA, 17 bp, Homo sapiens
acagcatcattttgcat

SEQ ID NO: 4120514 - DNA, 13 bp, Homo sapiens
acagcatgcccct

SEQ ID NO: 4120515 - DNA, 15 bp, Homo sapiens
acagcatgccccttg

SEQ ID NO: 4120516 - DNA, 19 bp, Homo sapiens
acagcattcttgtcacaat

SEQ ID NO: 4120517 - DNA, 11 bp, Homo sapiens
acagcattgct

SEQ ID NO: 4120518 - DNA, 12 bp, Homo sapiens
acagcattgctt

SEQ ID NO: 4120519 - DNA, 13 bp, Homo sapiens
acagcattgcttt

SEQ ID NO: 4120520 - DNA, 13 bp, Homo sapiens
acagccaacaggt

SEQ ID NO: 4120521 - DNA, 23 bp, Homo sapiens
acagccaacaggtggcaggacca

SEQ ID NO: 4120522 - DNA, 16 bp, Homo sapiens
acagccaactagcccc

SEQ ID NO: 4120523 - DNA, 14 bp, Homo sapiens
acagccaagtgtga

SEQ ID NO: 4120524 - DNA, 16 bp, Homo sapiens
acagccaagtgtgacc

SEQ ID NO: 4120525 - DNA, 19 bp, Homo sapiens
acagccagagctgggtggg

SEQ ID NO: 4120526 - DNA, 12 bp, Homo sapiens
acagccagagga

SEQ ID NO: 4120527 - DNA, 18 bp, Homo sapiens
acagccagaggagggcag

SEQ ID NO: 4120528 - DNA, 19 bp, Homo sapiens
acagccagaggagggcaga

SEQ ID NO: 4120529 - DNA, 14 bp, Homo sapiens
acagccagggggat

SEQ ID NO: 4120530 - DNA, 22 bp, Homo sapiens
acagccatgtccaagttcttca

SEQ ID NO: 4120531 - DNA, 16 bp, Homo sapiens
acagccattgcggccc

SEQ ID NO: 4120532 - DNA, 20 bp, Homo sapiens
acagccattgcggccccagg

SEQ ID NO: 4120533 - DNA, 22 bp, Homo sapiens
acagccattgcggccccaggag

SEQ ID NO: 4120534 - DNA, 19 bp, Homo sapiens
acagcccatggtgaatgta

SEQ ID NO: 4120535 - DNA, 14 bp, Homo sapiens
acagccccaccctg

SEQ ID NO: 4120536 - DNA, 19 bp, Homo sapiens
acagcccctccctcctctg

SEQ ID NO: 4120537 - DNA, 15 bp, Homo sapiens
acagccgctccagag

SEQ ID NO: 4120538 - DNA, 20 bp, Homo sapiens
acagccgtcagccaaatgta

SEQ ID NO: 4120539 - DNA, 14 bp, Homo sapiens
acagcctccagggc

SEQ ID NO: 4120540 - DNA, 15 bp, Homo sapiens
acagcctccccaccc

SEQ ID NO: 4120541 - DNA, 13 bp, Homo sapiens
acagcctcctctg

SEQ ID NO: 4120542 - DNA, 22 bp, Homo sapiens
acagcctcctctgtctgccctt

SEQ ID NO: 4120543 - DNA, 11 bp, Homo sapiens
acagcctggca

SEQ ID NO: 4120544 - DNA, 15 bp, Homo sapiens
acagcctggcacagg

SEQ ID NO: 4120545 - DNA, 17 bp, Homo sapiens
acagcctggggaggggg

SEQ ID NO: 4120546 - DNA, 21 bp, Homo sapiens
acagccttagctgccagtgct

SEQ ID NO: 4120547 - DNA, 22 bp, Homo sapiens
acagccttagctgccagtgctg

SEQ ID NO: 4120548 - DNA, 15 bp, Homo sapiens
acagcgagaggcaga

SEQ ID NO: 4120549 - DNA, 19 bp, Homo sapiens
acagcgagaggcagagaaa

SEQ ID NO: 4120550 - DNA, 14 bp, Homo sapiens
acagcgcccctgct

SEQ ID NO: 4120551 - DNA, 15 bp, Homo sapiens
acagcggaggagacc

SEQ ID NO: 4120552 - DNA, 21 bp, Homo sapiens
acagcggaggagaccagctca

SEQ ID NO: 4120553 - DNA, 22 bp, Homo sapiens
acagcggaggagaccagctcag

SEQ ID NO: 4120554 - DNA, 15 bp, Homo sapiens
acagcggcccctgca

SEQ ID NO: 4120555 - DNA, 19 bp, Homo sapiens
acagcggcccctgcatccc

SEQ ID NO: 4120556 - DNA, 20 bp, Homo sapiens
acagcgggagacctgtgcta

SEQ ID NO: 4120557 - DNA, 14 bp, Homo sapiens
acagcgtccctggc

SEQ ID NO: 4120558 - DNA, 17 bp, Homo sapiens
acagcgtccctggcgca

SEQ ID NO: 4120559 - DNA, 20 bp, Homo sapiens
acagctaatcagcattctca

SEQ ID NO: 4120560 - DNA, 22 bp, Homo sapiens
acagctactctccccacgaggg

SEQ ID NO: 4120561 - DNA, 22 bp, Homo sapiens
acagctatcgaacttcacaact

SEQ ID NO: 4120562 - DNA, 16 bp, Homo sapiens
acagctatgggagccc

SEQ ID NO: 4120563 - DNA, 21 bp, Homo sapiens
acagctatgggagccccaggg

SEQ ID NO: 4120564 - DNA, 19 bp, Homo sapiens
acagctcattaaacttttt

SEQ ID NO: 4120565 - DNA, 16 bp, Homo sapiens
acagctcccccagctc

SEQ ID NO: 4120566 - DNA, 14 bp, Homo sapiens
acagctcctcccac

SEQ ID NO: 4120567 - DNA, 21 bp, Homo sapiens
acagctccttttccagagcat

SEQ ID NO: 4120568 - DNA, 17 bp, Homo sapiens
acagctcttcacaccat

SEQ ID NO: 4120569 - DNA, 22 bp, Homo sapiens
acagctgaggtctcttgaggga

SEQ ID NO: 4120570 - DNA, 16 bp, Homo sapiens
acagctgatacttcat

SEQ ID NO: 4120571 - DNA, 10 bp, Homo sapiens
acagctgcaa

SEQ ID NO: 4120572 - DNA, 21 bp, Homo sapiens
acagctgctttctgttgtcat

SEQ ID NO: 4120573 - DNA, 12 bp, Homo sapiens
acagctgggcaa

SEQ ID NO: 4120574 - DNA, 19 bp, Homo sapiens
acagctgtattgtctgaac

SEQ ID NO: 4120575 - DNA, 10 bp, Homo sapiens
acagctgtgt

SEQ ID NO: 4120576 - DNA, 22 bp, Homo sapiens
acagctgtgttattctttgcgt

SEQ ID NO: 4120577 - DNA, 16 bp, Homo sapiens
acagctgttcttctgt

SEQ ID NO: 4120578 - DNA, 15 bp, Homo sapiens
acagcttcaggttat

SEQ ID NO: 4120579 - DNA, 20 bp, Homo sapiens
acagcttcaggttatcgaaa

SEQ ID NO: 4120580 - DNA, 20 bp, Homo sapiens
acagcttcatgcctttgtaa

SEQ ID NO: 4120581 - DNA, 18 bp, Homo sapiens
acagcttcctttcctgtg

SEQ ID NO: 4120582 - DNA, 22 bp, Homo sapiens
acagcttgagccgggcccctgg

SEQ ID NO: 4120583 - DNA, 21 bp, Homo sapiens
acagctttcttgctcccttca

SEQ ID NO: 4120584 - DNA, 17 bp, Homo sapiens
acaggaaagagtcacac

SEQ ID NO: 4120585 - DNA, 15 bp, Homo sapiens
acaggaaagccctcc

SEQ ID NO: 4120586 - DNA, 16 bp, Homo sapiens
acaggaaagtgttatt

SEQ ID NO: 4120587 - DNA, 21 bp, Homo sapiens
acaggaagctggcagaacgga

SEQ ID NO: 4120588 - DNA, 19 bp, Homo sapiens
acaggaatcaagagctgcc

SEQ ID NO: 4120589 - DNA, 22 bp, Homo sapiens
acaggacagagttcacaggagg

SEQ ID NO: 4120590 - DNA, 23 bp, Homo sapiens
acaggacagagttcacaggaggc

SEQ ID NO: 4120591 - DNA, 19 bp, Homo sapiens
acaggaggaggagatggcc

SEQ ID NO: 4120592 - DNA, 16 bp, Homo sapiens
acaggaggccagtggg

SEQ ID NO: 4120593 - DNA, 17 bp, Homo sapiens
acaggaggccagtgggc

SEQ ID NO: 4120594 - DNA, 15 bp, Homo sapiens
acaggaggggtctca

SEQ ID NO: 4120595 - DNA, 21 bp, Homo sapiens
acaggatcctattctcaccag

SEQ ID NO: 4120596 - DNA, 17 bp, Homo sapiens
acaggatgaaagttccc

SEQ ID NO: 4120597 - DNA, 14 bp, Homo sapiens
acaggattattgga

SEQ ID NO: 4120598 - DNA, 22 bp, Homo sapiens
acaggcatgggtgcaaggaaaa

SEQ ID NO: 4120599 - DNA, 17 bp, Homo sapiens
acaggccatgtgagcca

SEQ ID NO: 4120600 - DNA, 21 bp, Homo sapiens
acaggccctccctgttcccca

SEQ ID NO: 4120601 - DNA, 22 bp, Homo sapiens
acaggccctccctgttccccag

SEQ ID NO: 4120602 - DNA, 15 bp, Homo sapiens
acaggccctgctcct

SEQ ID NO: 4120603 - DNA, 20 bp, Homo sapiens
acaggccctgctcctgcagc

SEQ ID NO: 4120604 - DNA, 21 bp, Homo sapiens
acaggccctgctcctgcagca

SEQ ID NO: 4120605 - DNA, 15 bp, Homo sapiens
acaggcccttcctct

SEQ ID NO: 4120606 - DNA, 16 bp, Homo sapiens
acaggccgccctgcgg

SEQ ID NO: 4120607 - DNA, 19 bp, Homo sapiens
acaggcgagagaggagcca

SEQ ID NO: 4120608 - DNA, 21 bp, Homo sapiens
acaggcgagagaggagccaga

SEQ ID NO: 4120609 - DNA, 14 bp, Homo sapiens
acaggctgtcctta

SEQ ID NO: 4120610 - DNA, 23 bp, Homo sapiens
acagggaaccctgcttgcacttt

SEQ ID NO: 4120611 - DNA, 15 bp, Homo sapiens
acagggaagggcttg

SEQ ID NO: 4120612 - DNA, 16 bp, Homo sapiens
acagggagctgggaca

SEQ ID NO: 4120613 - DNA, 16 bp, Homo sapiens
acagggaggccacacg

SEQ ID NO: 4120614 - DNA, 20 bp, Homo sapiens
acagggatttagacttacta

SEQ ID NO: 4120615 - DNA, 17 bp, Homo sapiens
acagggcaccagaggcc

SEQ ID NO: 4120616 - DNA, 15 bp, Homo sapiens
acagggccagaggga

SEQ ID NO: 4120617 - DNA, 16 bp, Homo sapiens
acagggccagagggag

SEQ ID NO: 4120618 - DNA, 17 bp, Homo sapiens
acagggccagagggagc

SEQ ID NO: 4120619 - DNA, 23 bp, Homo sapiens
acagggccagtggggcctgtgga

SEQ ID NO: 4120620 - DNA, 19 bp, Homo sapiens
acagggcccgcagtgctgg

SEQ ID NO: 4120621 - DNA, 16 bp, Homo sapiens
acagggggccagaaca

SEQ ID NO: 4120622 - DNA, 18 bp, Homo sapiens
acagggtaactgtgctga

SEQ ID NO: 4120623 - DNA, 23 bp, Homo sapiens
acagggtaactgtgctgaatgct

SEQ ID NO: 4120624 - DNA, 15 bp, Homo sapiens
acagggtctgctctt

SEQ ID NO: 4120625 - DNA, 20 bp, Homo sapiens
acagggtcttttttcatttc

SEQ ID NO: 4120626 - DNA, 16 bp, Homo sapiens
acagggttcaaaatgt

SEQ ID NO: 4120627 - DNA, 14 bp, Homo sapiens
acagggttgggccc

SEQ ID NO: 4120628 - DNA, 18 bp, Homo sapiens
acagggtttttacctgtc

SEQ ID NO: 4120629 - DNA, 15 bp, Homo sapiens
acaggtaccagttct

SEQ ID NO: 4120630 - DNA, 12 bp, Homo sapiens
acaggtattttg

SEQ ID NO: 4120631 - DNA, 20 bp, Homo sapiens
acaggtggcaggaccaggac

SEQ ID NO: 4120632 - DNA, 21 bp, Homo sapiens
acaggtggcaggaccaggact

SEQ ID NO: 4120633 - DNA, 14 bp, Homo sapiens
acaggttttataat

SEQ ID NO: 4120634 - DNA, 22 bp, Homo sapiens
acagtaacaaataaagtgcagt

SEQ ID NO: 4120635 - DNA, 18 bp, Homo sapiens
acagtaatctaggtgtgg

SEQ ID NO: 4120636 - DNA, 22 bp, Homo sapiens
acagtaatctaggtgtggctgt

SEQ ID NO: 4120637 - DNA, 18 bp, Homo sapiens
acagtaggtgacactata

SEQ ID NO: 4120638 - DNA, 18 bp, Homo sapiens
acagtatattctttggtt

SEQ ID NO: 4120639 - DNA, 21 bp, Homo sapiens
acagtatgagtcaatgtgcag

SEQ ID NO: 4120640 - DNA, 23 bp, Homo sapiens
acagtatgagtcaatgtgcagtg

SEQ ID NO: 4120641 - DNA, 17 bp, Homo sapiens
acagtattttggttctt

SEQ ID NO: 4120642 - DNA, 16 bp, Homo sapiens
acagtcaaaataattc

SEQ ID NO: 4120643 - DNA, 19 bp, Homo sapiens
acagtcaaaataattctaa

SEQ ID NO: 4120644 - DNA, 15 bp, Homo sapiens
acagtcactaatata

SEQ ID NO: 4120645 - DNA, 16 bp, Homo sapiens
acagtcagcatgcttc

SEQ ID NO: 4120646 - DNA, 17 bp, Homo sapiens
acagtcagcatgcttcc

SEQ ID NO: 4120647 - DNA, 19 bp, Homo sapiens
acagtcagcatgcttccca

SEQ ID NO: 4120648 - DNA, 20 bp, Homo sapiens
acagtcagcatgcttcccag

SEQ ID NO: 4120649 - DNA, 22 bp, Homo sapiens
acagtcagcatgcttcccagag

SEQ ID NO: 4120650 - DNA, 16 bp, Homo sapiens
acagtcaggttgaaga

SEQ ID NO: 4120651 - DNA, 19 bp, Homo sapiens
acagtcatcatcagggcct

SEQ ID NO: 4120652 - DNA, 21 bp, Homo sapiens
acagtcatcatcagggcctgg

SEQ ID NO: 4120653 - DNA, 18 bp, Homo sapiens
acagtcattctaggatgt

SEQ ID NO: 4120654 - DNA, 21 bp, Homo sapiens
acagtcattctaggatgtgga

SEQ ID NO: 4120655 - DNA, 13 bp, Homo sapiens
acagtctccccca

SEQ ID NO: 4120656 - DNA, 18 bp, Homo sapiens
acagtgaccttttcttca

SEQ ID NO: 4120657 - DNA, 15 bp, Homo sapiens
acagtgataggccca

SEQ ID NO: 4120658 - DNA, 18 bp, Homo sapiens
acagtgatattggaactt

SEQ ID NO: 4120659 - DNA, 14 bp, Homo sapiens
acagtgatctccat

SEQ ID NO: 4120660 - DNA, 15 bp, Homo sapiens
acagtgatctccata

SEQ ID NO: 4120661 - DNA, 15 bp, Homo sapiens
acagtgcagacaggc

SEQ ID NO: 4120662 - DNA, 19 bp, Homo sapiens
acagtgcagagccttctca

SEQ ID NO: 4120663 - DNA, 17 bp, Homo sapiens
acagtgcatctcagccc

SEQ ID NO: 4120664 - DNA, 21 bp, Homo sapiens
acagtgcctgggaatgtatta

SEQ ID NO: 4120665 - DNA, 13 bp, Homo sapiens
acagtgctgtgtg

SEQ ID NO: 4120666 - DNA, 16 bp, Homo sapiens
acagtggactcagcag

SEQ ID NO: 4120667 - DNA, 19 bp, Homo sapiens
acagtggattgtttatact

SEQ ID NO: 4120668 - DNA, 12 bp, Homo sapiens
acagtggctggg

SEQ ID NO: 4120669 - DNA, 13 bp, Homo sapiens
acagtggctgggt

SEQ ID NO: 4120670 - DNA, 18 bp, Homo sapiens
acagtggctgggtgggcc

SEQ ID NO: 4120671 - DNA, 19 bp, Homo sapiens
acagtggctgggtgggccc

SEQ ID NO: 4120672 - DNA, 22 bp, Homo sapiens
acagtggctgggtgggcccaga

SEQ ID NO: 4120673 - DNA, 19 bp, Homo sapiens
acagtgggagccctgacct

SEQ ID NO: 4120674 - DNA, 23 bp, Homo sapiens
acagtgggcgttgggagcctagc

SEQ ID NO: 4120675 - DNA, 15 bp, Homo sapiens
acagtgggtggtgga

SEQ ID NO: 4120676 - DNA, 18 bp, Homo sapiens
acagtggttttatactga

SEQ ID NO: 4120677 - DNA, 21 bp, Homo sapiens
acagtgtaatccaggggtgta

SEQ ID NO: 4120678 - DNA, 23 bp, Homo sapiens
acagtgtctgtatcggagacagt

SEQ ID NO: 4120679 - DNA, 16 bp, Homo sapiens
acagtgtctgtgccat

SEQ ID NO: 4120680 - DNA, 19 bp, Homo sapiens
acagtgtggggcagccgtc

SEQ ID NO: 4120681 - DNA, 20 bp, Homo sapiens
acagtgtggggcagccgtcc

SEQ ID NO: 4120682 - DNA, 22 bp, Homo sapiens
acagtgtggtttgggaaagatg

SEQ ID NO: 4120683 - DNA, 9 bp, Homo sapiens
acagtgttt

SEQ ID NO: 4120684 - DNA, 16 bp, Homo sapiens
acagttaactttcaga

SEQ ID NO: 4120685 - DNA, 19 bp, Homo sapiens
acagttagggttttgcaat

SEQ ID NO: 4120686 - DNA, 12 bp, Homo sapiens
acagttcataat

SEQ ID NO: 4120687 - DNA, 19 bp, Homo sapiens
acagttcattcagggccga

SEQ ID NO: 4120688 - DNA, 19 bp, Homo sapiens
acagttccaatcagtagct

SEQ ID NO: 4120689 - DNA, 17 bp, Homo sapiens
acagttcttggtgactg

SEQ ID NO: 4120690 - DNA, 22 bp, Homo sapiens
acagttcttggtgactgtccca

SEQ ID NO: 4120691 - DNA, 19 bp, Homo sapiens
acagttctttgggccagac

SEQ ID NO: 4120692 - DNA, 22 bp, Homo sapiens
acagttctttgggccagacatg

SEQ ID NO: 4120693 - DNA, 22 bp, Homo sapiens
acagttgaagggaggggctgtg

SEQ ID NO: 4120694 - DNA, 21 bp, Homo sapiens
acagttgcatttagcttcttt

SEQ ID NO: 4120695 - DNA, 21 bp, Homo sapiens
acagttgccacatttagtcct

SEQ ID NO: 4120696 - DNA, 19 bp, Homo sapiens
acagttgtgttagcctctt

SEQ ID NO: 4120697 - DNA, 16 bp, Homo sapiens
acagtttcttagcttt

SEQ ID NO: 4120698 - DNA, 18 bp, Homo sapiens
acagtttcttagcttttt

SEQ ID NO: 4120699 - DNA, 19 bp, Homo sapiens
acagttttccatgaaaacg

SEQ ID NO: 4120700 - DNA, 20 bp, Homo sapiens
acataaaaaggacatcagca

SEQ ID NO: 4120701 - DNA, 22 bp, Homo sapiens
acataaaaaggacatcagcaaa

SEQ ID NO: 4120702 - DNA, 13 bp, Homo sapiens
acataaactgact

SEQ ID NO: 4120703 - DNA, 15 bp, Homo sapiens
acataaactgacttt

SEQ ID NO: 4120704 - DNA, 13 bp, Homo sapiens
acataaattagag

SEQ ID NO: 4120705 - DNA, 19 bp, Homo sapiens
acataacggaaagttttta

SEQ ID NO: 4120706 - DNA, 14 bp, Homo sapiens
acataacgtttttc

SEQ ID NO: 4120707 - DNA, 20 bp, Homo sapiens
acataacgtttttcctttaa

SEQ ID NO: 4120708 - DNA, 22 bp, Homo sapiens
acataacgtttttcctttaaaa

SEQ ID NO: 4120709 - DNA, 20 bp, Homo sapiens
acataagtaattcaagaaaa

SEQ ID NO: 4120710 - DNA, 21 bp, Homo sapiens
acataagtaattcaagaaaac

SEQ ID NO: 4120711 - DNA, 16 bp, Homo sapiens
acataagttgcattta

SEQ ID NO: 4120712 - DNA, 22 bp, Homo sapiens
acataagttgcatttagaaatc

SEQ ID NO: 4120713 - DNA, 17 bp, Homo sapiens
acataataaaaaattat

SEQ ID NO: 4120714 - DNA, 23 bp, Homo sapiens
acataataaaaaattatgacaat

SEQ ID NO: 4120715 - DNA, 14 bp, Homo sapiens
acataataaatcac

SEQ ID NO: 4120716 - DNA, 13 bp, Homo sapiens
acataatgaaaat

SEQ ID NO: 4120717 - DNA, 18 bp, Homo sapiens
acataatgcttaatttct

SEQ ID NO: 4120718 - DNA, 20 bp, Homo sapiens
acataatgtattgttggtaa

SEQ ID NO: 4120719 - DNA, 21 bp, Homo sapiens
acataccctggccgccccctg

SEQ ID NO: 4120720 - DNA, 19 bp, Homo sapiens
acatactgcatgtaagcca

SEQ ID NO: 4120721 - DNA, 19 bp, Homo sapiens
acatacttgaagggccaga

SEQ ID NO: 4120722 - DNA, 20 bp, Homo sapiens
acatacttgaagggccagag

SEQ ID NO: 4120723 - DNA, 21 bp, Homo sapiens
acatacttgaagggccagagc

SEQ ID NO: 4120724 - DNA, 23 bp, Homo sapiens
acatacttgaagggccagagcca

SEQ ID NO: 4120725 - DNA, 23 bp, Homo sapiens
acatactttcatcctgactctgc

SEQ ID NO: 4120726 - DNA, 15 bp, Homo sapiens
acatagatattttca

SEQ ID NO: 4120727 - DNA, 12 bp, Homo sapiens
acatagcccctg

SEQ ID NO: 4120728 - DNA, 16 bp, Homo sapiens
acatagcccctgcccc

SEQ ID NO: 4120729 - DNA, 13 bp, Homo sapiens
acatagtgaaata

SEQ ID NO: 4120730 - DNA, 19 bp, Homo sapiens
acatagtgaaataaattct

SEQ ID NO: 4120731 - DNA, 20 bp, Homo sapiens
acatagttttaaactcattt

SEQ ID NO: 4120732 - DNA, 20 bp, Homo sapiens
acatataaacatcacacaca

SEQ ID NO: 4120733 - DNA, 20 bp, Homo sapiens
acatatactgattctgtgta

SEQ ID NO: 4120734 - DNA, 16 bp, Homo sapiens
acatatagaatgcaga

SEQ ID NO: 4120735 - DNA, 15 bp, Homo sapiens
acatatatttattga

SEQ ID NO: 4120736 - DNA, 22 bp, Homo sapiens
acatatatttttaaaaaatgaa

SEQ ID NO: 4120737 - DNA, 15 bp, Homo sapiens
acatatcttagatgg

SEQ ID NO: 4120738 - DNA, 23 bp, Homo sapiens
acatatgtagatattgttttctg

SEQ ID NO: 4120739 - DNA, 18 bp, Homo sapiens
acatattaggaaaatatg

SEQ ID NO: 4120740 - DNA, 13 bp, Homo sapiens
acatcaatgttca

SEQ ID NO: 4120741 - DNA, 13 bp, Homo sapiens
acatcacacacac

SEQ ID NO: 4120742 - DNA, 13 bp, Homo sapiens
acatcacagcagc

SEQ ID NO: 4120743 - DNA, 14 bp, Homo sapiens
acatcacagcagcc

SEQ ID NO: 4120744 - DNA, 13 bp, Homo sapiens
acatcacaggaca

SEQ ID NO: 4120745 - DNA, 14 bp, Homo sapiens
acatcactgcttga

SEQ ID NO: 4120746 - DNA, 21 bp, Homo sapiens
acatcactgcttgatgaagca

SEQ ID NO: 4120747 - DNA, 19 bp, Homo sapiens
acatcagacctgtcttcca

SEQ ID NO: 4120748 - DNA, 21 bp, Homo sapiens
acatcagacctgtcttccaag

SEQ ID NO: 4120749 - DNA, 11 bp, Homo sapiens
acatcagttcc

SEQ ID NO: 4120750 - DNA, 15 bp, Homo sapiens
acatcatgaatttta

SEQ ID NO: 4120751 - DNA, 18 bp, Homo sapiens
acatccaaagcagacagc

SEQ ID NO: 4120752 - DNA, 15 bp, Homo sapiens
acatccatccctcca

SEQ ID NO: 4120753 - DNA, 13 bp, Homo sapiens
acatcccagcctg

SEQ ID NO: 4120754 - DNA, 14 bp, Homo sapiens
acatcccagcctgt

SEQ ID NO: 4120755 - DNA, 23 bp, Homo sapiens
acatccctacaaaaaattagaaa

SEQ ID NO: 4120756 - DNA, 17 bp, Homo sapiens
acatcctccgtccagcc

SEQ ID NO: 4120757 - DNA, 17 bp, Homo sapiens
acatcctgtataagcac

SEQ ID NO: 4120758 - DNA, 20 bp, Homo sapiens
acatcctttcttttaatgat

SEQ ID NO: 4120759 - DNA, 21 bp, Homo sapiens
acatcctttgcagggcagccc

SEQ ID NO: 4120760 - DNA, 16 bp, Homo sapiens
acatcgatatgtatat

SEQ ID NO: 4120761 - DNA, 18 bp, Homo sapiens
acatcgatatgtatatca

SEQ ID NO: 4120762 - DNA, 18 bp, Homo sapiens
acatctattttggattgt

SEQ ID NO: 4120763 - DNA, 19 bp, Homo sapiens
acatctattttggattgta

SEQ ID NO: 4120764 - DNA, 13 bp, Homo sapiens
acatctcacctcc

SEQ ID NO: 4120765 - DNA, 19 bp, Homo sapiens
acatctcaggggccagagg

SEQ ID NO: 4120766 - DNA, 15 bp, Homo sapiens
acatctccttagaaa

SEQ ID NO: 4120767 - DNA, 21 bp, Homo sapiens
acatctctccccaaccctagg

SEQ ID NO: 4120768 - DNA, 22 bp, Homo sapiens
acatctctgcaccctggggcct

SEQ ID NO: 4120769 - DNA, 20 bp, Homo sapiens
acatctgcaatatgaattca

SEQ ID NO: 4120770 - DNA, 11 bp, Homo sapiens
acatctgcctt

SEQ ID NO: 4120771 - DNA, 23 bp, Homo sapiens
acatctgccttaaaaccaaagag

SEQ ID NO: 4120772 - DNA, 16 bp, Homo sapiens
acatctgttatcaaac

SEQ ID NO: 4120773 - DNA, 22 bp, Homo sapiens
acatctgttatcaaactgctgt

SEQ ID NO: 4120774 - DNA, 16 bp, Homo sapiens
acatcttcagcaaata

SEQ ID NO: 4120775 - DNA, 17 bp, Homo sapiens
acatctttatctgttct

SEQ ID NO: 4120776 - DNA, 18 bp, Homo sapiens
acatctttcctcaagtat

SEQ ID NO: 4120777 - DNA, 15 bp, Homo sapiens
acatgaaaattttaa

SEQ ID NO: 4120778 - DNA, 13 bp, Homo sapiens
acatgaagaagct

SEQ ID NO: 4120779 - DNA, 16 bp, Homo sapiens
acatgaagaagctaaa

SEQ ID NO: 4120780 - DNA, 21 bp, Homo sapiens
acatgaatgcagtcatgcaaa

SEQ ID NO: 4120781 - DNA, 14 bp, Homo sapiens
acatgaattaaagt

SEQ ID NO: 4120782 - DNA, 18 bp, Homo sapiens
acatgactgggcctccct

SEQ ID NO: 4120783 - DNA, 22 bp, Homo sapiens
acatgagctatttccattccag

SEQ ID NO: 4120784 - DNA, 19 bp, Homo sapiens
acatgaggccatctcagga

SEQ ID NO: 4120785 - DNA, 21 bp, Homo sapiens
acatgaggccatctcaggaga

SEQ ID NO: 4120786 - DNA, 22 bp, Homo sapiens
acatgaggccatctcaggagat

SEQ ID NO: 4120787 - DNA, 14 bp, Homo sapiens
acatgatgttatgt

SEQ ID NO: 4120788 - DNA, 14 bp, Homo sapiens
acatgattgtataa

SEQ ID NO: 4120789 - DNA, 21 bp, Homo sapiens
acatgattgtataagcatgct

SEQ ID NO: 4120790 - DNA, 13 bp, Homo sapiens
acatgatttcctt

SEQ ID NO: 4120791 - DNA, 16 bp, Homo sapiens
acatgatttccttgaa

SEQ ID NO: 4120792 - DNA, 17 bp, Homo sapiens
acatgatttccttgaat

SEQ ID NO: 4120793 - DNA, 15 bp, Homo sapiens
acatgcagcccatgc

SEQ ID NO: 4120794 - DNA, 20 bp, Homo sapiens
acatgcagcccatgcccacc

SEQ ID NO: 4120795 - DNA, 22 bp, Homo sapiens
acatgcagcccatgcccacctg

SEQ ID NO: 4120796 - DNA, 22 bp, Homo sapiens
acatgcagttcattattttgtg

SEQ ID NO: 4120797 - DNA, 23 bp, Homo sapiens
acatgcagttcattattttgtgg

SEQ ID NO: 4120798 - DNA, 19 bp, Homo sapiens
acatgcataaaagggtcaa

SEQ ID NO: 4120799 - DNA, 12 bp, Homo sapiens
acatgcattgtt

SEQ ID NO: 4120800 - DNA, 18 bp, Homo sapiens
acatgcattgttggctat

SEQ ID NO: 4120801 - DNA, 23 bp, Homo sapiens
acatgcattgttggctatttgaa

SEQ ID NO: 4120802 - DNA, 14 bp, Homo sapiens
acatgccacaagga

SEQ ID NO: 4120803 - DNA, 18 bp, Homo sapiens
acatgccactgcctgcac

SEQ ID NO: 4120804 - DNA, 22 bp, Homo sapiens
acatgcctgccccaaacaaata

SEQ ID NO: 4120805 - DNA, 22 bp, Homo sapiens
acatgcctgcgcctgctgcctg

SEQ ID NO: 4120806 - DNA, 18 bp, Homo sapiens
acatgctaggatgcggaa

SEQ ID NO: 4120807 - DNA, 19 bp, Homo sapiens
acatgctcacctctagcct

SEQ ID NO: 4120808 - DNA, 14 bp, Homo sapiens
acatggacttgtat

SEQ ID NO: 4120809 - DNA, 15 bp, Homo sapiens
acatggacttgtata

SEQ ID NO: 4120810 - DNA, 17 bp, Homo sapiens
acatggacttgtatatt

SEQ ID NO: 4120811 - DNA, 17 bp, Homo sapiens
acatggagactcctgcc

SEQ ID NO: 4120812 - DNA, 21 bp, Homo sapiens
acatggagactcctgccctgt

SEQ ID NO: 4120813 - DNA, 19 bp, Homo sapiens
acatggagccccctctgcc

SEQ ID NO: 4120814 - DNA, 15 bp, Homo sapiens
acatggctagccttt

SEQ ID NO: 4120815 - DNA, 21 bp, Homo sapiens
acatgggagcttattgctaat

SEQ ID NO: 4120816 - DNA, 14 bp, Homo sapiens
acatggtactcttg

SEQ ID NO: 4120817 - DNA, 13 bp, Homo sapiens
acatggtgcctga

SEQ ID NO: 4120818 - DNA, 16 bp, Homo sapiens
acatggtgcctgagag

SEQ ID NO: 4120819 - DNA, 18 bp, Homo sapiens
acatggttgtgacctgag

SEQ ID NO: 4120820 - DNA, 20 bp, Homo sapiens
acatgtaataaaaagtatat

SEQ ID NO: 4120821 - DNA, 23 bp, Homo sapiens
acatgtaattaagtactatgtat

SEQ ID NO: 4120822 - DNA, 15 bp, Homo sapiens
acatgtagcttcttc

SEQ ID NO: 4120823 - DNA, 20 bp, Homo sapiens
acatgtagcttcttctgaaa

SEQ ID NO: 4120824 - DNA, 11 bp, Homo sapiens
acatgtatgtg

SEQ ID NO: 4120825 - DNA, 21 bp, Homo sapiens
acatgtattgcacattgtaaa

SEQ ID NO: 4120826 - DNA, 19 bp, Homo sapiens
acatgtcctaattcttctg

SEQ ID NO: 4120827 - DNA, 13 bp, Homo sapiens
acatgtgaaacct

SEQ ID NO: 4120828 - DNA, 20 bp, Homo sapiens
acatgtgaaaccttttttaa

SEQ ID NO: 4120829 - DNA, 18 bp, Homo sapiens
acatgtgaggaggaaaag

SEQ ID NO: 4120830 - DNA, 19 bp, Homo sapiens
acatgtgaggaggaaaagg

SEQ ID NO: 4120831 - DNA, 22 bp, Homo sapiens
acatgtgccagggcaatgatga

SEQ ID NO: 4120832 - DNA, 19 bp, Homo sapiens
acatgtggaaagtgaattt

SEQ ID NO: 4120833 - DNA, 18 bp, Homo sapiens
acatgtggggccaggtca

SEQ ID NO: 4120834 - DNA, 21 bp, Homo sapiens
acatgtgtagcctatgttgtg

SEQ ID NO: 4120835 - DNA, 22 bp, Homo sapiens
acatgtgtatttatacccccag

SEQ ID NO: 4120836 - DNA, 16 bp, Homo sapiens
acatgttactgaccag

SEQ ID NO: 4120837 - DNA, 17 bp, Homo sapiens
acatgttactgcttcat

SEQ ID NO: 4120838 - DNA, 12 bp, Homo sapiens
acatgttctcca

SEQ ID NO: 4120839 - DNA, 21 bp, Homo sapiens
acatgtttatttattctgcat

SEQ ID NO: 4120840 - DNA, 13 bp, Homo sapiens
acattaaaactag

SEQ ID NO: 4120841 - DNA, 19 bp, Homo sapiens
acattaaatgcaataattt

SEQ ID NO: 4120842 - DNA, 23 bp, Homo sapiens
acattaaatgcaataattttact

SEQ ID NO: 4120843 - DNA, 20 bp, Homo sapiens
acattaagattgaggcctgc

SEQ ID NO: 4120844 - DNA, 19 bp, Homo sapiens
acattaatagcagcctttc

SEQ ID NO: 4120845 - DNA, 20 bp, Homo sapiens
acattagaataaaaggtagt

SEQ ID NO: 4120846 - DNA, 17 bp, Homo sapiens
acattagtaaatgtctt

SEQ ID NO: 4120847 - DNA, 18 bp, Homo sapiens
acattagtaaatgtcttt

SEQ ID NO: 4120848 - DNA, 19 bp, Homo sapiens
acattagtaaatgtctttg

SEQ ID NO: 4120849 - DNA, 23 bp, Homo sapiens
acattagtaaatgtctttgtaag

SEQ ID NO: 4120850 - DNA, 14 bp, Homo sapiens
acattatttatatg

SEQ ID NO: 4120851 - DNA, 14 bp, Homo sapiens
acattcacctgccc

SEQ ID NO: 4120852 - DNA, 16 bp, Homo sapiens
acattcaggaagatga

SEQ ID NO: 4120853 - DNA, 13 bp, Homo sapiens
acattcccctccc

SEQ ID NO: 4120854 - DNA, 14 bp, Homo sapiens
acattccctctcct

SEQ ID NO: 4120855 - DNA, 11 bp, Homo sapiens
acattccctgc

SEQ ID NO: 4120856 - DNA, 15 bp, Homo sapiens
acattcgacataccc

SEQ ID NO: 4120857 - DNA, 17 bp, Homo sapiens
acattcttattaattct

SEQ ID NO: 4120858 - DNA, 19 bp, Homo sapiens
acattcttccaaaaagatt

SEQ ID NO: 4120859 - DNA, 12 bp, Homo sapiens
acattgaaagag

SEQ ID NO: 4120860 - DNA, 17 bp, Homo sapiens
acattgaccaagaactg

SEQ ID NO: 4120861 - DNA, 16 bp, Homo sapiens
acattgagctgatata

SEQ ID NO: 4120862 - DNA, 20 bp, Homo sapiens
acattgagctgatataaatt

SEQ ID NO: 4120863 - DNA, 17 bp, Homo sapiens
acattgcattctattgc

SEQ ID NO: 4120864 - DNA, 12 bp, Homo sapiens
acattgccccaa

SEQ ID NO: 4120865 - DNA, 23 bp, Homo sapiens
acattgcgtttgaccttttatgt

SEQ ID NO: 4120866 - DNA, 17 bp, Homo sapiens
acattggaatgttctca

SEQ ID NO: 4120867 - DNA, 22 bp, Homo sapiens
acattggcacctaatccaggca

SEQ ID NO: 4120868 - DNA, 16 bp, Homo sapiens
acattggtaagaatga

SEQ ID NO: 4120869 - DNA, 21 bp, Homo sapiens
acattgtaaatagtatttgag

SEQ ID NO: 4120870 - DNA, 17 bp, Homo sapiens
acattgttaagaaaaat

SEQ ID NO: 4120871 - DNA, 16 bp, Homo sapiens
acattgttcaattaga

SEQ ID NO: 4120872 - DNA, 17 bp, Homo sapiens
acattgttcttattctg

SEQ ID NO: 4120873 - DNA, 14 bp, Homo sapiens
acattgttgagcta

SEQ ID NO: 4120874 - DNA, 19 bp, Homo sapiens
acattgtttggatttcctt

SEQ ID NO: 4120875 - DNA, 10 bp, Homo sapiens
acatttaaaa

SEQ ID NO: 4120876 - DNA, 17 bp, Homo sapiens
acatttaaaattgctat

SEQ ID NO: 4120877 - DNA, 12 bp, Homo sapiens
acatttaaatgt

SEQ ID NO: 4120878 - DNA, 16 bp, Homo sapiens
acatttaatatcttca

SEQ ID NO: 4120879 - DNA, 15 bp, Homo sapiens
acatttaatttagtg

SEQ ID NO: 4120880 - DNA, 12 bp, Homo sapiens
acatttacagtc

SEQ ID NO: 4120881 - DNA, 21 bp, Homo sapiens
acatttacagtccttcaaaat

SEQ ID NO: 4120882 - DNA, 15 bp, Homo sapiens
acatttagtcctgta

SEQ ID NO: 4120883 - DNA, 15 bp, Homo sapiens
acatttataatgttt

SEQ ID NO: 4120884 - DNA, 22 bp, Homo sapiens
acatttatgatttaataaaata

SEQ ID NO: 4120885 - DNA, 16 bp, Homo sapiens
acatttcactgtctgt

SEQ ID NO: 4120886 - DNA, 20 bp, Homo sapiens
acatttcccccgagctcttg

SEQ ID NO: 4120887 - DNA, 18 bp, Homo sapiens
acatttctatcagtactt

SEQ ID NO: 4120888 - DNA, 19 bp, Homo sapiens
acatttctatcagtacttt

SEQ ID NO: 4120889 - DNA, 20 bp, Homo sapiens
acatttctcttccccttaga

SEQ ID NO: 4120890 - DNA, 18 bp, Homo sapiens
acatttctgatcagaggt

SEQ ID NO: 4120891 - DNA, 14 bp, Homo sapiens
acatttcttttctt

SEQ ID NO: 4120892 - DNA, 22 bp, Homo sapiens
acatttcttttctttttacata

SEQ ID NO: 4120893 - DNA, 15 bp, Homo sapiens
acatttgccttgctg

SEQ ID NO: 4120894 - DNA, 22 bp, Homo sapiens
acatttgctgttttaaacatta

SEQ ID NO: 4120895 - DNA, 23 bp, Homo sapiens
acatttgctgttttaaacattaa

SEQ ID NO: 4120896 - DNA, 12 bp, Homo sapiens
acatttggaata

SEQ ID NO: 4120897 - DNA, 17 bp, Homo sapiens
acatttggaatactttt

SEQ ID NO: 4120898 - DNA, 17 bp, Homo sapiens
acatttgtagttggagt

SEQ ID NO: 4120899 - DNA, 13 bp, Homo sapiens
acatttgttcctg

SEQ ID NO: 4120900 - DNA, 16 bp, Homo sapiens
acatttgtttgctgta

SEQ ID NO: 4120901 - DNA, 23 bp, Homo sapiens
acattttaaaaacatagaaaaat

SEQ ID NO: 4120902 - DNA, 14 bp, Homo sapiens
acattttacattaa

SEQ ID NO: 4120903 - DNA, 18 bp, Homo sapiens
acattttacattaaattt

SEQ ID NO: 4120904 - DNA, 17 bp, Homo sapiens
acattttggtgagaaat

SEQ ID NO: 4120905 - DNA, 14 bp, Homo sapiens
acatttttaaattg

SEQ ID NO: 4120906 - DNA, 20 bp, Homo sapiens
acatttttaaattgttagct

SEQ ID NO: 4120907 - DNA, 17 bp, Homo sapiens
acatttttaatttaaca

SEQ ID NO: 4120908 - DNA, 12 bp, Homo sapiens
acatttttattt

SEQ ID NO: 4120909 - DNA, 16 bp, Homo sapiens
acatttttatttatga

SEQ ID NO: 4120910 - DNA, 18 bp, Homo sapiens
acatttttatttatgaag

SEQ ID NO: 4120911 - DNA, 21 bp, Homo sapiens
acattttttcttctgaagatt

SEQ ID NO: 4120912 - DNA, 19 bp, Homo sapiens
accaaagcaaagaaaataa

SEQ ID NO: 4120913 - DNA, 12 bp, Homo sapiens
accaaagccacc

SEQ ID NO: 4120914 - DNA, 16 bp, Homo sapiens
accaaataaaaatatt

SEQ ID NO: 4120915 - DNA, 16 bp, Homo sapiens
accaaatcagctgcta

SEQ ID NO: 4120916 - DNA, 18 bp, Homo sapiens
accaaatctgacatatta

SEQ ID NO: 4120917 - DNA, 13 bp, Homo sapiens
accaaatttgtac

SEQ ID NO: 4120918 - DNA, 12 bp, Homo sapiens
accaagaactgc

SEQ ID NO: 4120919 - DNA, 16 bp, Homo sapiens
accaagactctgaaat

SEQ ID NO: 4120920 - DNA, 15 bp, Homo sapiens
accaagagtaacttt

SEQ ID NO: 4120921 - DNA, 20 bp, Homo sapiens
accaagatctataaagcgat

SEQ ID NO: 4120922 - DNA, 14 bp, Homo sapiens
accaagcacagcag

SEQ ID NO: 4120923 - DNA, 16 bp, Homo sapiens
accaagcacagcagcc

SEQ ID NO: 4120924 - DNA, 15 bp, Homo sapiens
accaagcaggagacg

SEQ ID NO: 4120925 - DNA, 18 bp, Homo sapiens
accaagccgtggcttccc

SEQ ID NO: 4120926 - DNA, 18 bp, Homo sapiens
accaagctgagtttccta

SEQ ID NO: 4120927 - DNA, 21 bp, Homo sapiens
accaaggaaacgctacctctc

SEQ ID NO: 4120928 - DNA, 15 bp, Homo sapiens
accaaggtcttcagc

SEQ ID NO: 4120929 - DNA, 13 bp, Homo sapiens
accaagtcctggc

SEQ ID NO: 4120930 - DNA, 20 bp, Homo sapiens
accaagtcctggctacatcc

SEQ ID NO: 4120931 - DNA, 23 bp, Homo sapiens
accaagttataaatcaatgtcac

SEQ ID NO: 4120932 - DNA, 16 bp, Homo sapiens
accaatagcccacagc

SEQ ID NO: 4120933 - DNA, 20 bp, Homo sapiens
accaatattatactaagaaa

SEQ ID NO: 4120934 - DNA, 17 bp, Homo sapiens
accaatcccagggctgg

SEQ ID NO: 4120935 - DNA, 18 bp, Homo sapiens
accaatcccagggctggc

SEQ ID NO: 4120936 - DNA, 20 bp, Homo sapiens
accaatcttaaacataataa

SEQ ID NO: 4120937 - DNA, 22 bp, Homo sapiens
accaatgcccagcaggggaggt

SEQ ID NO: 4120938 - DNA, 22 bp, Homo sapiens
accaatggtgatcctctatttt

SEQ ID NO: 4120939 - DNA, 13 bp, Homo sapiens
accaattgtgctg

SEQ ID NO: 4120940 - DNA, 18 bp, Homo sapiens
accaatttacactgccat

SEQ ID NO: 4120941 - DNA, 23 bp, Homo sapiens
accacaaggtccactccctgctc

SEQ ID NO: 4120942 - DNA, 21 bp, Homo sapiens
accacaattctccctatcttg

SEQ ID NO: 4120943 - DNA, 11 bp, Homo sapiens
accacacaaag

SEQ ID NO: 4120944 - DNA, 14 bp, Homo sapiens
accacacaaagaca

SEQ ID NO: 4120945 - DNA, 15 bp, Homo sapiens
accacacatctatga

SEQ ID NO: 4120946 - DNA, 16 bp, Homo sapiens
accacaccgcagaagc

SEQ ID NO: 4120947 - DNA, 20 bp, Homo sapiens
accacacttgtcggctccag

SEQ ID NO: 4120948 - DNA, 23 bp, Homo sapiens
accacagacacaatatgtatgct

SEQ ID NO: 4120949 - DNA, 20 bp, Homo sapiens
accacagacacacacacgca

SEQ ID NO: 4120950 - DNA, 15 bp, Homo sapiens
accacagagctgtca

SEQ ID NO: 4120951 - DNA, 15 bp, Homo sapiens
accacagcacagcca

SEQ ID NO: 4120952 - DNA, 23 bp, Homo sapiens
accacagcatcgggagcacccag

SEQ ID NO: 4120953 - DNA, 12 bp, Homo sapiens
accacagctcct

SEQ ID NO: 4120954 - DNA, 15 bp, Homo sapiens
accacagctcctttt

SEQ ID NO: 4120955 - DNA, 17 bp, Homo sapiens
accacagctccttttcc

SEQ ID NO: 4120956 - DNA, 22 bp, Homo sapiens
accacaggcatctacacagcct

SEQ ID NO: 4120957 - DNA, 19 bp, Homo sapiens
accacagggccagagggag

SEQ ID NO: 4120958 - DNA, 14 bp, Homo sapiens
accacatcctccgt

SEQ ID NO: 4120959 - DNA, 21 bp, Homo sapiens
accacatcctccgtccagccg

SEQ ID NO: 4120960 - DNA, 18 bp, Homo sapiens
accacatctgccagacct

SEQ ID NO: 4120961 - DNA, 17 bp, Homo sapiens
accacatctttatctgt

SEQ ID NO: 4120962 - DNA, 13 bp, Homo sapiens
accacatgccact

SEQ ID NO: 4120963 - DNA, 17 bp, Homo sapiens
accacccgaaatgccac

SEQ ID NO: 4120964 - DNA, 18 bp, Homo sapiens
accacctaatcaggctga

SEQ ID NO: 4120965 - DNA, 16 bp, Homo sapiens
accacctcactcctgt

SEQ ID NO: 4120966 - DNA, 13 bp, Homo sapiens
accacctgcttct

SEQ ID NO: 4120967 - DNA, 19 bp, Homo sapiens
accaccttctgtccccagc

SEQ ID NO: 4120968 - DNA, 20 bp, Homo sapiens
accaccttctgtccccagcc

SEQ ID NO: 4120969 - DNA, 17 bp, Homo sapiens
accaccttttattacat

SEQ ID NO: 4120970 - DNA, 19 bp, Homo sapiens
accacgactggccagggcc

SEQ ID NO: 4120971 - DNA, 24 bp, Homo sapiens
accacgactggccagggccacgct

SEQ ID NO: 4120972 - DNA, 14 bp, Homo sapiens
accacggaaaagag

SEQ ID NO: 4120973 - DNA, 20 bp, Homo sapiens
accacggccggctaattttt

SEQ ID NO: 4120974 - DNA, 19 bp, Homo sapiens
accacggcgtttttttaca

SEQ ID NO: 4120975 - DNA, 23 bp, Homo sapiens
accactaaaagatcgcagtttgc

SEQ ID NO: 4120976 - DNA, 17 bp, Homo sapiens
accactaactcctgaga

SEQ ID NO: 4120977 - DNA, 20 bp, Homo sapiens
accactcaaattaatctttc

SEQ ID NO: 4120978 - DNA, 21 bp, Homo sapiens
accactcgtgcatccctgaga

SEQ ID NO: 4120979 - DNA, 22 bp, Homo sapiens
accactcttctttaagccatag

SEQ ID NO: 4120980 - DNA, 23 bp, Homo sapiens
accactcttctttaagccataga

SEQ ID NO: 4120981 - DNA, 21 bp, Homo sapiens
accactgagtaccaggggctg

SEQ ID NO: 4120982 - DNA, 18 bp, Homo sapiens
accactgcactccagcct

SEQ ID NO: 4120983 - DNA, 17 bp, Homo sapiens
accactggtacttcctt

SEQ ID NO: 4120984 - DNA, 22 bp, Homo sapiens
accactggtacttcctttctcc

SEQ ID NO: 4120985 - DNA, 20 bp, Homo sapiens
accactgtggcgttctgctg

SEQ ID NO: 4120986 - DNA, 21 bp, Homo sapiens
accactgtggcgttctgctgc

SEQ ID NO: 4120987 - DNA, 16 bp, Homo sapiens
accactgtgtatttaa

SEQ ID NO: 4120988 - DNA, 14 bp, Homo sapiens
accacttcattctg

SEQ ID NO: 4120989 - DNA, 18 bp, Homo sapiens
accacttcctgctacagg

SEQ ID NO: 4120990 - DNA, 19 bp, Homo sapiens
accacttcctgctacagga

SEQ ID NO: 4120991 - DNA, 20 bp, Homo sapiens
accacttcctgctacaggag

SEQ ID NO: 4120992 - DNA, 20 bp, Homo sapiens
accactttcttattctgtat

SEQ ID NO: 4120993 - DNA, 14 bp, Homo sapiens
accagaagccaaag

SEQ ID NO: 4120994 - DNA, 16 bp, Homo sapiens
accagacaagctgttg

SEQ ID NO: 4120995 - DNA, 14 bp, Homo sapiens
accagacacccagg

SEQ ID NO: 4120996 - DNA, 15 bp, Homo sapiens
accagacacccagga

SEQ ID NO: 4120997 - DNA, 16 bp, Homo sapiens
accagacacccaggac

SEQ ID NO: 4120998 - DNA, 17 bp, Homo sapiens
accagacacccaggact

SEQ ID NO: 4120999 - DNA, 23 bp, Homo sapiens
accagagacccaacagcagtgat

SEQ ID NO: 4121000 - DNA, 15 bp, Homo sapiens
accagagacgcccag

SEQ ID NO: 4121001 - DNA, 17 bp, Homo sapiens
accagagacgcccagcc

SEQ ID NO: 4121002 - DNA, 18 bp, Homo sapiens
accagagacgcccagccc

SEQ ID NO: 4121003 - DNA, 16 bp, Homo sapiens
accagagcagatgcag

SEQ ID NO: 4121004 - DNA, 20 bp, Homo sapiens
accagagcatttccaacacc

SEQ ID NO: 4121005 - DNA, 22 bp, Homo sapiens
accagagccagatgcaggacag

SEQ ID NO: 4121006 - DNA, 10 bp, Homo sapiens
accagagccc

SEQ ID NO: 4121007 - DNA, 12 bp, Homo sapiens
accagagcccat

SEQ ID NO: 4121008 - DNA, 16 bp, Homo sapiens
accagagccccccaca

SEQ ID NO: 4121009 - DNA, 22 bp, Homo sapiens
accagaggccgaaggtgcctca

SEQ ID NO: 4121010 - DNA, 15 bp, Homo sapiens
accagagggtgtggc

SEQ ID NO: 4121011 - DNA, 19 bp, Homo sapiens
accagataaatagaactat

SEQ ID NO: 4121012 - DNA, 16 bp, Homo sapiens
accagccatcctccct

SEQ ID NO: 4121013 - DNA, 19 bp, Homo sapiens
accagccccaatccaaaac

SEQ ID NO: 4121014 - DNA, 21 bp, Homo sapiens
accagcccccgccccagagtg

SEQ ID NO: 4121015 - DNA, 23 bp, Homo sapiens
accagcccccgccccagagtggc

SEQ ID NO: 4121016 - DNA, 14 bp, Homo sapiens
accagcccggcctg

SEQ ID NO: 4121017 - DNA, 20 bp, Homo sapiens
accagcctcgccaacatggt

SEQ ID NO: 4121018 - DNA, 14 bp, Homo sapiens
accagcctgggcag

SEQ ID NO: 4121019 - DNA, 22 bp, Homo sapiens
accagccttcctgtgggcccct

SEQ ID NO: 4121020 - DNA, 22 bp, Homo sapiens
accagctaagaaaagattttaa

SEQ ID NO: 4121021 - DNA, 17 bp, Homo sapiens
accagctatctgtcatc

SEQ ID NO: 4121022 - DNA, 21 bp, Homo sapiens
accagctatctgtcatctctc

SEQ ID NO: 4121023 - DNA, 23 bp, Homo sapiens
accagctatctgtcatctctctg

SEQ ID NO: 4121024 - DNA, 21 bp, Homo sapiens
accagctcagaggcccaggaa

SEQ ID NO: 4121025 - DNA, 12 bp, Homo sapiens
accagctgcagc

SEQ ID NO: 4121026 - DNA, 16 bp, Homo sapiens
accagctgcgcttgct

SEQ ID NO: 4121027 - DNA, 20 bp, Homo sapiens
accagcttagccaacatagt

SEQ ID NO: 4121028 - DNA, 22 bp, Homo sapiens
accagcttgtatgcaatggatt

SEQ ID NO: 4121029 - DNA, 23 bp, Homo sapiens
accagcttgttctgggctcaggg

SEQ ID NO: 4121030 - DNA, 19 bp, Homo sapiens
accaggactatagcccagg

SEQ ID NO: 4121031 - DNA, 21 bp, Homo sapiens
accaggactatagcccaggtc

SEQ ID NO: 4121032 - DNA, 14 bp, Homo sapiens
accaggactccctc

SEQ ID NO: 4121033 - DNA, 16 bp, Homo sapiens
accaggactccctcct

SEQ ID NO: 4121034 - DNA, 21 bp, Homo sapiens
accaggactccctcctcacct

SEQ ID NO: 4121035 - DNA, 19 bp, Homo sapiens
accaggcacctcccctccc

SEQ ID NO: 4121036 - DNA, 21 bp, Homo sapiens
accaggccgggcttgggccct

SEQ ID NO: 4121037 - DNA, 13 bp, Homo sapiens
accaggcctctgc

SEQ ID NO: 4121038 - DNA, 13 bp, Homo sapiens
accaggctgtgtc

SEQ ID NO: 4121039 - DNA, 18 bp, Homo sapiens
accaggcttcttcctaca

SEQ ID NO: 4121040 - DNA, 20 bp, Homo sapiens
accagggagcccctttgatg

SEQ ID NO: 4121041 - DNA, 18 bp, Homo sapiens
accagggatgctgggctg

SEQ ID NO: 4121042 - DNA, 20 bp, Homo sapiens
accagggatgctgggctggg

SEQ ID NO: 4121043 - DNA, 22 bp, Homo sapiens
accagggatgctgggctgggcc

SEQ ID NO: 4121044 - DNA, 18 bp, Homo sapiens
accagggcattcgggcca

SEQ ID NO: 4121045 - DNA, 22 bp, Homo sapiens
accagggccagaagtagctttg

SEQ ID NO: 4121046 - DNA, 17 bp, Homo sapiens
accaggtgcatgcatgc

SEQ ID NO: 4121047 - DNA, 19 bp, Homo sapiens
accaggttttgttccgccc

SEQ ID NO: 4121048 - DNA, 21 bp, Homo sapiens
accagtggcgttgttgcatgt

SEQ ID NO: 4121049 - DNA, 13 bp, Homo sapiens
accagtgtcccct

SEQ ID NO: 4121050 - DNA, 17 bp, Homo sapiens
accagttatgtgaatga

SEQ ID NO: 4121051 - DNA, 20 bp, Homo sapiens
accagttgccctagcccaga

SEQ ID NO: 4121052 - DNA, 17 bp, Homo sapiens
accagttggcagacagc

SEQ ID NO: 4121053 - DNA, 21 bp, Homo sapiens
accagttggcagacagccgtt

SEQ ID NO: 4121054 - DNA, 18 bp, Homo sapiens
accagttgggagcactgg

SEQ ID NO: 4121055 - DNA, 19 bp, Homo sapiens
accagttgggagcactgga

SEQ ID NO: 4121056 - DNA, 20 bp, Homo sapiens
accagttgggagcactggag

SEQ ID NO: 4121057 - DNA, 21 bp, Homo sapiens
accagttgggagcactggagt

SEQ ID NO: 4121058 - DNA, 24 bp, Homo sapiens
accagtttttggataaagaatact

SEQ ID NO: 4121059 - DNA, 13 bp, Homo sapiens
accataatgttac

SEQ ID NO: 4121060 - DNA, 15 bp, Homo sapiens
accataatgttacat

SEQ ID NO: 4121061 - DNA, 18 bp, Homo sapiens
accataatgttacattat

SEQ ID NO: 4121062 - DNA, 15 bp, Homo sapiens
accatactgagggac

SEQ ID NO: 4121063 - DNA, 20 bp, Homo sapiens
accatagtaccatttataca

SEQ ID NO: 4121064 - DNA, 12 bp, Homo sapiens
accatatgaatt

SEQ ID NO: 4121065 - DNA, 18 bp, Homo sapiens
accatcacaatacagata

SEQ ID NO: 4121066 - DNA, 15 bp, Homo sapiens
accatcagggacagg

SEQ ID NO: 4121067 - DNA, 21 bp, Homo sapiens
accatccctgccacatacagg

SEQ ID NO: 4121068 - DNA, 22 bp, Homo sapiens
accatcctggctaacatggtga

SEQ ID NO: 4121069 - DNA, 14 bp, Homo sapiens
accatcctggctgc

SEQ ID NO: 4121070 - DNA, 18 bp, Homo sapiens
accatcctgtattcttca

SEQ ID NO: 4121071 - DNA, 14 bp, Homo sapiens
accatctgctttta

SEQ ID NO: 4121072 - DNA, 18 bp, Homo sapiens
accatcttcataatttgc

SEQ ID NO: 4121073 - DNA, 15 bp, Homo sapiens
accatgaagacagga

SEQ ID NO: 4121074 - DNA, 20 bp, Homo sapiens
accatgaagtaaattatgta

SEQ ID NO: 4121075 - DNA, 16 bp, Homo sapiens
accatgactgtgacca

SEQ ID NO: 4121076 - DNA, 20 bp, Homo sapiens
accatgagaagagggcctgt

SEQ ID NO: 4121077 - DNA, 21 bp, Homo sapiens
accatgagaagagggcctgtg

SEQ ID NO: 4121078 - DNA, 23 bp, Homo sapiens
accatgagaataagagaaagaaa

SEQ ID NO: 4121079 - DNA, 21 bp, Homo sapiens
accatgccagattctgcctct

SEQ ID NO: 4121080 - DNA, 17 bp, Homo sapiens
accatgctggtatatgg

SEQ ID NO: 4121081 - DNA, 18 bp, Homo sapiens
accatggatttttacaag

SEQ ID NO: 4121082 - DNA, 13 bp, Homo sapiens
accatgtcactgt

SEQ ID NO: 4121083 - DNA, 13 bp, Homo sapiens
accattctcctgc

SEQ ID NO: 4121084 - DNA, 21 bp, Homo sapiens
accattgctcttagtcccaag

SEQ ID NO: 4121085 - DNA, 18 bp, Homo sapiens
accattgtgaagcaccta

SEQ ID NO: 4121086 - DNA, 13 bp, Homo sapiens
accatttatacaa

SEQ ID NO: 4121087 - DNA, 16 bp, Homo sapiens
accatttatacaaatt

SEQ ID NO: 4121088 - DNA, 19 bp, Homo sapiens
accattttcccatcatcct

SEQ ID NO: 4121089 - DNA, 18 bp, Homo sapiens
acccaaaaactgtcttta

SEQ ID NO: 4121090 - DNA, 13 bp, Homo sapiens
acccaaaccccca

SEQ ID NO: 4121091 - DNA, 11 bp, Homo sapiens
acccaaagcag

SEQ ID NO: 4121092 - DNA, 15 bp, Homo sapiens
acccaacggccctgc

SEQ ID NO: 4121093 - DNA, 18 bp, Homo sapiens
acccaagagcaagggctt

SEQ ID NO: 4121094 - DNA, 15 bp, Homo sapiens
acccaagcccaaact

SEQ ID NO: 4121095 - DNA, 13 bp, Homo sapiens
acccaatccaaat

SEQ ID NO: 4121096 - DNA, 14 bp, Homo sapiens
acccaatccaaatg

SEQ ID NO: 4121097 - DNA, 19 bp, Homo sapiens
acccaatctgcacactcca

SEQ ID NO: 4121098 - DNA, 21 bp, Homo sapiens
acccaatctgcacactccagg

SEQ ID NO: 4121099 - DNA, 13 bp, Homo sapiens
acccacacagctg

SEQ ID NO: 4121100 - DNA, 16 bp, Homo sapiens
acccacacagctgccc

SEQ ID NO: 4121101 - DNA, 19 bp, Homo sapiens
acccacacagctgccctag

SEQ ID NO: 4121102 - DNA, 22 bp, Homo sapiens
acccacccgacctggctgcccc

SEQ ID NO: 4121103 - DNA, 20 bp, Homo sapiens
acccaccgatggagccccca

SEQ ID NO: 4121104 - DNA, 21 bp, Homo sapiens
acccaccgatggagcccccag

SEQ ID NO: 4121105 - DNA, 15 bp, Homo sapiens
acccaccgtggagga

SEQ ID NO: 4121106 - DNA, 22 bp, Homo sapiens
acccaccgtggaggaggaaggc

SEQ ID NO: 4121107 - DNA, 18 bp, Homo sapiens
acccacctccacccagcc

SEQ ID NO: 4121108 - DNA, 18 bp, Homo sapiens
acccacctctcctgccct

SEQ ID NO: 4121109 - DNA, 13 bp, Homo sapiens
acccactcaggat

SEQ ID NO: 4121110 - DNA, 20 bp, Homo sapiens
acccactgcagcccctgaga

SEQ ID NO: 4121111 - DNA, 20 bp, Homo sapiens
acccagaaacgccacatccc

SEQ ID NO: 4121112 - DNA, 14 bp, Homo sapiens
acccagaatggagc

SEQ ID NO: 4121113 - DNA, 17 bp, Homo sapiens
acccagaccccaggctg

SEQ ID NO: 4121114 - DNA, 22 bp, Homo sapiens
acccagacctgttagcagacag

SEQ ID NO: 4121115 - DNA, 23 bp, Homo sapiens
acccagagcattacgtgagccag

SEQ ID NO: 4121116 - DNA, 10 bp, Homo sapiens
acccagcccc

SEQ ID NO: 4121117 - DNA, 19 bp, Homo sapiens
acccaggagggagggggct

SEQ ID NO: 4121118 - DNA, 20 bp, Homo sapiens
acccaggcccatgccaaggc

SEQ ID NO: 4121119 - DNA, 20 bp, Homo sapiens
acccaggttttgcactcttg

SEQ ID NO: 4121120 - DNA, 19 bp, Homo sapiens
acccagtcacctccccaca

SEQ ID NO: 4121121 - DNA, 22 bp, Homo sapiens
acccagtgcccccactgaccag

SEQ ID NO: 4121122 - DNA, 18 bp, Homo sapiens
acccagttgccatctgcg

SEQ ID NO: 4121123 - DNA, 16 bp, Homo sapiens
acccataaacagtaat

SEQ ID NO: 4121124 - DNA, 17 bp, Homo sapiens
acccataaacagtaatg

SEQ ID NO: 4121125 - DNA, 17 bp, Homo sapiens
acccataatcctttctg

SEQ ID NO: 4121126 - DNA, 15 bp, Homo sapiens
acccatagcttccat

SEQ ID NO: 4121127 - DNA, 18 bp, Homo sapiens
acccatgagcctgcccgc

SEQ ID NO: 4121128 - DNA, 20 bp, Homo sapiens
acccatgagttggggtctgg

SEQ ID NO: 4121129 - DNA, 21 bp, Homo sapiens
acccatgagttggggtctggc

SEQ ID NO: 4121130 - DNA, 14 bp, Homo sapiens
acccatgggctctg

SEQ ID NO: 4121131 - DNA, 17 bp, Homo sapiens
acccatgtgccaaggtg

SEQ ID NO: 4121132 - DNA, 22 bp, Homo sapiens
acccattcgtggtgatcaatta

SEQ ID NO: 4121133 - DNA, 22 bp, Homo sapiens
acccattgccccagacctggaa

SEQ ID NO: 4121134 - DNA, 18 bp, Homo sapiens
acccatttaatcaccatg

SEQ ID NO: 4121135 - DNA, 20 bp, Homo sapiens
accccaaacaccttccagct

SEQ ID NO: 4121136 - DNA, 15 bp, Homo sapiens
accccaaagagcctg

SEQ ID NO: 4121137 - DNA, 22 bp, Homo sapiens
accccaaagagcctggagaagc

SEQ ID NO: 4121138 - DNA, 17 bp, Homo sapiens
accccaaagctttcctg

SEQ ID NO: 4121139 - DNA, 16 bp, Homo sapiens
accccacaccagcctt

SEQ ID NO: 4121140 - DNA, 15 bp, Homo sapiens
accccacaccccagc

SEQ ID NO: 4121141 - DNA, 17 bp, Homo sapiens
accccacaccccagccc

SEQ ID NO: 4121142 - DNA, 19 bp, Homo sapiens
accccacaccccagcccac

SEQ ID NO: 4121143 - DNA, 21 bp, Homo sapiens
accccaccctagtttccctga

SEQ ID NO: 4121144 - DNA, 13 bp, Homo sapiens
accccaccctccc

SEQ ID NO: 4121145 - DNA, 15 bp, Homo sapiens
accccaccctccctg

SEQ ID NO: 4121146 - DNA, 19 bp, Homo sapiens
accccaccctccctggagt

SEQ ID NO: 4121147 - DNA, 20 bp, Homo sapiens
accccaccctccctggagtg

SEQ ID NO: 4121148 - DNA, 19 bp, Homo sapiens
accccacccttcccctcct

SEQ ID NO: 4121149 - DNA, 15 bp, Homo sapiens
accccactgggcaca

SEQ ID NO: 4121150 - DNA, 20 bp, Homo sapiens
accccactgggccagccctg

SEQ ID NO: 4121151 - DNA, 11 bp, Homo sapiens
accccagccca

SEQ ID NO: 4121152 - DNA, 21 bp, Homo sapiens
accccagcccaccctgctcct

SEQ ID NO: 4121153 - DNA, 19 bp, Homo sapiens
accccagcctcgcctgtca

SEQ ID NO: 4121154 - DNA, 20 bp, Homo sapiens
accccagcctcgcctgtcac

SEQ ID NO: 4121155 - DNA, 22 bp, Homo sapiens
accccagcctcgcctgtcaccc

SEQ ID NO: 4121156 - DNA, 17 bp, Homo sapiens
accccagctccctagga

SEQ ID NO: 4121157 - DNA, 23 bp, Homo sapiens
accccagctccctaggagaccaa

SEQ ID NO: 4121158 - DNA, 15 bp, Homo sapiens
accccaggcccttca

SEQ ID NO: 4121159 - DNA, 15 bp, Homo sapiens
accccagggccctgg

SEQ ID NO: 4121160 - DNA, 16 bp, Homo sapiens
accccagggccctggc

SEQ ID NO: 4121161 - DNA, 21 bp, Homo sapiens
accccagggccctggccagcc

SEQ ID NO: 4121162 - DNA, 16 bp, Homo sapiens
accccagtggccactc

SEQ ID NO: 4121163 - DNA, 19 bp, Homo sapiens
accccagtggccactcagc

SEQ ID NO: 4121164 - DNA, 18 bp, Homo sapiens
accccatatacacctgga

SEQ ID NO: 4121165 - DNA, 15 bp, Homo sapiens
accccatcccacacc

SEQ ID NO: 4121166 - DNA, 16 bp, Homo sapiens
accccatgccaaagct

SEQ ID NO: 4121167 - DNA, 12 bp, Homo sapiens
accccattcctg

SEQ ID NO: 4121168 - DNA, 20 bp, Homo sapiens
acccccaaaatccaaaactt

SEQ ID NO: 4121169 - DNA, 13 bp, Homo sapiens
acccccacccacc

SEQ ID NO: 4121170 - DNA, 14 bp, Homo sapiens
acccccacccacct

SEQ ID NO: 4121171 - DNA, 16 bp, Homo sapiens
acccccaccccacact

SEQ ID NO: 4121172 - DNA, 17 bp, Homo sapiens
acccccaccccacactt

SEQ ID NO: 4121173 - DNA, 13 bp, Homo sapiens
acccccaccctgc

SEQ ID NO: 4121174 - DNA, 12 bp, Homo sapiens
acccccagctcc

SEQ ID NO: 4121175 - DNA, 12 bp, Homo sapiens
acccccctgttc

SEQ ID NO: 4121176 - DNA, 17 bp, Homo sapiens
acccccctgttctaagg

SEQ ID NO: 4121177 - DNA, 17 bp, Homo sapiens
acccccgaggggagggc

SEQ ID NO: 4121178 - DNA, 21 bp, Homo sapiens
acccccgccacctcagggcac

SEQ ID NO: 4121179 - DNA, 17 bp, Homo sapiens
accccctcaagccccag

SEQ ID NO: 4121180 - DNA, 16 bp, Homo sapiens
accccctccctacaca

SEQ ID NO: 4121181 - DNA, 19 bp, Homo sapiens
accccctccctacacacac

SEQ ID NO: 4121182 - DNA, 16 bp, Homo sapiens
accccctctgctctgt

SEQ ID NO: 4121183 - DNA, 20 bp, Homo sapiens
accccctgagatcccctgag

SEQ ID NO: 4121184 - DNA, 23 bp, Homo sapiens
accccctgagatcccctgagccc

SEQ ID NO: 4121185 - DNA, 15 bp, Homo sapiens
accccctgccctgca

SEQ ID NO: 4121186 - DNA, 19 bp, Homo sapiens
accccctgctccaccagca

SEQ ID NO: 4121187 - DNA, 12 bp, Homo sapiens
accccctggaga

SEQ ID NO: 4121188 - DNA, 12 bp, Homo sapiens
acccccttcccc

SEQ ID NO: 4121189 - DNA, 15 bp, Homo sapiens
acccccttcctgtcc

SEQ ID NO: 4121190 - DNA, 18 bp, Homo sapiens
acccccttctactgagcc

SEQ ID NO: 4121191 - DNA, 13 bp, Homo sapiens
acccccttctctg

SEQ ID NO: 4121192 - DNA, 13 bp, Homo sapiens
accccctttgctg

SEQ ID NO: 4121193 - DNA, 15 bp, Homo sapiens
accccggcctcaggg

SEQ ID NO: 4121194 - DNA, 17 bp, Homo sapiens
accccggcctcagggcg

SEQ ID NO: 4121195 - DNA, 23 bp, Homo sapiens
accccggggtgcccacaggccgc

SEQ ID NO: 4121196 - DNA, 16 bp, Homo sapiens
accccgtctctactaa

SEQ ID NO: 4121197 - DNA, 22 bp, Homo sapiens
acccctaaagagatactttgat

SEQ ID NO: 4121198 - DNA, 14 bp, Homo sapiens
acccctacacacac

SEQ ID NO: 4121199 - DNA, 17 bp, Homo sapiens
acccctacacacacact

SEQ ID NO: 4121200 - DNA, 19 bp, Homo sapiens
acccctacacacacactcc

SEQ ID NO: 4121201 - DNA, 15 bp, Homo sapiens
acccctacacacacc

SEQ ID NO: 4121202 - DNA, 20 bp, Homo sapiens
acccctacacacacccaggc

SEQ ID NO: 4121203 - DNA, 17 bp, Homo sapiens
acccctagccaccagtg

SEQ ID NO: 4121204 - DNA, 20 bp, Homo sapiens
acccctagttccctctgctc

SEQ ID NO: 4121205 - DNA, 14 bp, Homo sapiens
acccctcactcccc

SEQ ID NO: 4121206 - DNA, 10 bp, Homo sapiens
acccctccat

SEQ ID NO: 4121207 - DNA, 21 bp, Homo sapiens
acccctcccggccctgcctgc

SEQ ID NO: 4121208 - DNA, 17 bp, Homo sapiens
acccctcgtccaccccc

SEQ ID NO: 4121209 - DNA, 11 bp, Homo sapiens
acccctctggt

SEQ ID NO: 4121210 - DNA, 22 bp, Homo sapiens
acccctctggtgtgtggtgagg

SEQ ID NO: 4121211 - DNA, 10 bp, Homo sapiens
acccctgccc

SEQ ID NO: 4121212 - DNA, 11 bp, Homo sapiens
acccctgctcc

SEQ ID NO: 4121213 - DNA, 15 bp, Homo sapiens
acccctgctcccagc

SEQ ID NO: 4121214 - DNA, 19 bp, Homo sapiens
acccctgctcccagcctgc

SEQ ID NO: 4121215 - DNA, 20 bp, Homo sapiens
acccctgctcccagcctgct

SEQ ID NO: 4121216 - DNA, 23 bp, Homo sapiens
acccctgctcccattcctccctc

SEQ ID NO: 4121217 - DNA, 12 bp, Homo sapiens
acccctggaaga

SEQ ID NO: 4121218 - DNA, 18 bp, Homo sapiens
acccctggaagagcccag

SEQ ID NO: 4121219 - DNA, 12 bp, Homo sapiens
acccctggcttt

SEQ ID NO: 4121220 - DNA, 15 bp, Homo sapiens
acccctggcttttca

SEQ ID NO: 4121221 - DNA, 11 bp, Homo sapiens
acccctgggca

SEQ ID NO: 4121222 - DNA, 13 bp, Homo sapiens
acccctgggcagg

SEQ ID NO: 4121223 - DNA, 22 bp, Homo sapiens
acccctgtcccatgcaggccct

SEQ ID NO: 4121224 - DNA, 17 bp, Homo sapiens
accccttatccaggact

SEQ ID NO: 4121225 - DNA, 17 bp, Homo sapiens
accccttctctcctccc

SEQ ID NO: 4121226 - DNA, 16 bp, Homo sapiens
accccttgctcccttc

SEQ ID NO: 4121227 - DNA, 12 bp, Homo sapiens
acccgacctggc

SEQ ID NO: 4121228 - DNA, 14 bp, Homo sapiens
acccgacctggctg

SEQ ID NO: 4121229 - DNA, 18 bp, Homo sapiens
acccgacctggctgcccc

SEQ ID NO: 4121230 - DNA, 18 bp, Homo sapiens
acccggaggggcctggca

SEQ ID NO: 4121231 - DNA, 13 bp, Homo sapiens
acccggcctctct

SEQ ID NO: 4121232 - DNA, 18 bp, Homo sapiens
acccggcctctctgcccc

SEQ ID NO: 4121233 - DNA, 19 bp, Homo sapiens
acccggcctctctgcccca

SEQ ID NO: 4121234 - DNA, 20 bp, Homo sapiens
acccggcctctctgccccac

SEQ ID NO: 4121235 - DNA, 23 bp, Homo sapiens
acccggcctggatgccagctgtg

SEQ ID NO: 4121236 - DNA, 22 bp, Homo sapiens
acccggctgggtcggccctgcc

SEQ ID NO: 4121237 - DNA, 21 bp, Homo sapiens
acccgggaggcggagcttgca

SEQ ID NO: 4121238 - DNA, 18 bp, Homo sapiens
acccgggggagcccagtg

SEQ ID NO: 4121239 - DNA, 22 bp, Homo sapiens
acccggttcagtgtttctgggg

SEQ ID NO: 4121240 - DNA, 21 bp, Homo sapiens
accctaatctttcacttgaaa

SEQ ID NO: 4121241 - DNA, 17 bp, Homo sapiens
accctagccttgcttgt

SEQ ID NO: 4121242 - DNA, 22 bp, Homo sapiens
accctaggttccctgttcttcc

SEQ ID NO: 4121243 - DNA, 23 bp, Homo sapiens
accctaggttccctgttcttcct

SEQ ID NO: 4121244 - DNA, 16 bp, Homo sapiens
accctagtttccctga

SEQ ID NO: 4121245 - DNA, 23 bp, Homo sapiens
accctatattttgcatagtacca

SEQ ID NO: 4121246 - DNA, 13 bp, Homo sapiens
accctcacacaca

SEQ ID NO: 4121247 - DNA, 22 bp, Homo sapiens
accctcacacacacagctgggc

SEQ ID NO: 4121248 - DNA, 20 bp, Homo sapiens
accctcaggcataggcctgg

SEQ ID NO: 4121249 - DNA, 22 bp, Homo sapiens
accctcaggcataggcctgggt

SEQ ID NO: 4121250 - DNA, 23 bp, Homo sapiens
accctcaggcataggcctgggtg

SEQ ID NO: 4121251 - DNA, 13 bp, Homo sapiens
accctcagggagc

SEQ ID NO: 4121252 - DNA, 21 bp, Homo sapiens
accctcaggggaaaactgtta

SEQ ID NO: 4121253 - DNA, 21 bp, Homo sapiens
accctcatggcccccaggggc

SEQ ID NO: 4121254 - DNA, 23 bp, Homo sapiens
accctcatggcccccaggggcag

SEQ ID NO: 4121255 - DNA, 17 bp, Homo sapiens
accctcattctactgaa

SEQ ID NO: 4121256 - DNA, 12 bp, Homo sapiens
accctccacctt

SEQ ID NO: 4121257 - DNA, 21 bp, Homo sapiens
accctccactcagctgtcctg

SEQ ID NO: 4121258 - DNA, 20 bp, Homo sapiens
accctccatgctcctcacct

SEQ ID NO: 4121259 - DNA, 20 bp, Homo sapiens
accctcccacccccttctct

SEQ ID NO: 4121260 - DNA, 15 bp, Homo sapiens
accctcccccgcagc

SEQ ID NO: 4121261 - DNA, 20 bp, Homo sapiens
accctccccttcccagggca

SEQ ID NO: 4121262 - DNA, 13 bp, Homo sapiens
accctccctggag

SEQ ID NO: 4121263 - DNA, 21 bp, Homo sapiens
accctccttcccactcttctc

SEQ ID NO: 4121264 - DNA, 20 bp, Homo sapiens
accctctcactagtgccaat

SEQ ID NO: 4121265 - DNA, 14 bp, Homo sapiens
accctctcctgggg

SEQ ID NO: 4121266 - DNA, 20 bp, Homo sapiens
accctctcctgggggtggca

SEQ ID NO: 4121267 - DNA, 18 bp, Homo sapiens
accctctgtcccacccct

SEQ ID NO: 4121268 - DNA, 22 bp, Homo sapiens
accctcttgcccatcctgactg

SEQ ID NO: 4121269 - DNA, 23 bp, Homo sapiens
accctcttgcccatcctgactga

SEQ ID NO: 4121270 - DNA, 12 bp, Homo sapiens
accctgaagggg

SEQ ID NO: 4121271 - DNA, 21 bp, Homo sapiens
accctgaatttggcctgcact

SEQ ID NO: 4121272 - DNA, 17 bp, Homo sapiens
accctgacccccttcct

SEQ ID NO: 4121273 - DNA, 21 bp, Homo sapiens
accctgacctccgcccctgcc

SEQ ID NO: 4121274 - DNA, 20 bp, Homo sapiens
accctgaggccctgggctgg

SEQ ID NO: 4121275 - DNA, 17 bp, Homo sapiens
accctgagttttgtttt

SEQ ID NO: 4121276 - DNA, 22 bp, Homo sapiens
accctgattatatccagtaaca

SEQ ID NO: 4121277 - DNA, 22 bp, Homo sapiens
accctgatttaggagaagccag

SEQ ID NO: 4121278 - DNA, 15 bp, Homo sapiens
accctgccacagcca

SEQ ID NO: 4121279 - DNA, 16 bp, Homo sapiens
accctgccacagccag

SEQ ID NO: 4121280 - DNA, 20 bp, Homo sapiens
accctgccacagccagagga

SEQ ID NO: 4121281 - DNA, 19 bp, Homo sapiens
accctgcgcctccagaggt

SEQ ID NO: 4121282 - DNA, 14 bp, Homo sapiens
accctgctcctcct

SEQ ID NO: 4121283 - DNA, 18 bp, Homo sapiens
accctggccgagtccaag

SEQ ID NO: 4121284 - DNA, 11 bp, Homo sapiens
accctggcctg

SEQ ID NO: 4121285 - DNA, 14 bp, Homo sapiens
accctgggagacag

SEQ ID NO: 4121286 - DNA, 17 bp, Homo sapiens
accctgggagacagacc

SEQ ID NO: 4121287 - DNA, 19 bp, Homo sapiens
accctggggaaggagccag

SEQ ID NO: 4121288 - DNA, 14 bp, Homo sapiens
accctggggcctga

SEQ ID NO: 4121289 - DNA, 15 bp, Homo sapiens
accctggtgggccaa

SEQ ID NO: 4121290 - DNA, 16 bp, Homo sapiens
accctgtacctcatcc

SEQ ID NO: 4121291 - DNA, 20 bp, Homo sapiens
accctgtactgttctgtgtc

SEQ ID NO: 4121292 - DNA, 20 bp, Homo sapiens
accctgtcaagttaacaagg

SEQ ID NO: 4121293 - DNA, 16 bp, Homo sapiens
accctgtggccctggc

SEQ ID NO: 4121294 - DNA, 16 bp, Homo sapiens
accctgttttatactg

SEQ ID NO: 4121295 - DNA, 17 bp, Homo sapiens
accctgttttgagccct

SEQ ID NO: 4121296 - DNA, 15 bp, Homo sapiens
acccttcagacccca

SEQ ID NO: 4121297 - DNA, 18 bp, Homo sapiens
acccttcatcttcctgtg

SEQ ID NO: 4121298 - DNA, 20 bp, Homo sapiens
acccttcatcttcctgtgtc

SEQ ID NO: 4121299 - DNA, 19 bp, Homo sapiens
acccttcttgcctgctggg

SEQ ID NO: 4121300 - DNA, 14 bp, Homo sapiens
acccttgctttcct

SEQ ID NO: 4121301 - DNA, 19 bp, Homo sapiens
acccttgctttcctgggcc

SEQ ID NO: 4121302 - DNA, 11 bp, Homo sapiens
acccttggcct

SEQ ID NO: 4121303 - DNA, 13 bp, Homo sapiens
acccttggcctgt

SEQ ID NO: 4121304 - DNA, 23 bp, Homo sapiens
accctttgcctttcttctgccct

SEQ ID NO: 4121305 - DNA, 21 bp, Homo sapiens
accctttggtttttttcttct

SEQ ID NO: 4121306 - DNA, 14 bp, Homo sapiens
acccttttccccct

SEQ ID NO: 4121307 - DNA, 18 bp, Homo sapiens
acccttttcccccttccc

SEQ ID NO: 4121308 - DNA, 19 bp, Homo sapiens
acccttttcccccttccca

SEQ ID NO: 4121309 - DNA, 13 bp, Homo sapiens
acccttttctcag

SEQ ID NO: 4121310 - DNA, 17 bp, Homo sapiens
accgaccaactgcccta

SEQ ID NO: 4121311 - DNA, 16 bp, Homo sapiens
accgacgcgtctcctg

SEQ ID NO: 4121312 - DNA, 12 bp, Homo sapiens
accgaggccctc

SEQ ID NO: 4121313 - DNA, 24 bp, Homo sapiens
accgagtctcttctccactggatg

SEQ ID NO: 4121314 - DNA, 19 bp, Homo sapiens
accgataatgcatgaagca

SEQ ID NO: 4121315 - DNA, 20 bp, Homo sapiens
accgataatgcatgaagcaa

SEQ ID NO: 4121316 - DNA, 13 bp, Homo sapiens
accgatggagccc

SEQ ID NO: 4121317 - DNA, 16 bp, Homo sapiens
accgattctttggagt

SEQ ID NO: 4121318 - DNA, 17 bp, Homo sapiens
accgcaactcacacatt

SEQ ID NO: 4121319 - DNA, 17 bp, Homo sapiens
accgcacatgcacacac

SEQ ID NO: 4121320 - DNA, 13 bp, Homo sapiens
accgccctgggct

SEQ ID NO: 4121321 - DNA, 20 bp, Homo sapiens
accgccctgggctggactgg

SEQ ID NO: 4121322 - DNA, 15 bp, Homo sapiens
accgcctagtttact

SEQ ID NO: 4121323 - DNA, 20 bp, Homo sapiens
accgcgactaatttcaaaat

SEQ ID NO: 4121324 - DNA, 19 bp, Homo sapiens
accgctgccagcacagagc

SEQ ID NO: 4121325 - DNA, 15 bp, Homo sapiens
accgctggcccttag

SEQ ID NO: 4121326 - DNA, 16 bp, Homo sapiens
accggcctggctgcag

SEQ ID NO: 4121327 - DNA, 17 bp, Homo sapiens
accggcctggctgcagc

SEQ ID NO: 4121328 - DNA, 19 bp, Homo sapiens
accgggagcctccccctca

SEQ ID NO: 4121329 - DNA, 21 bp, Homo sapiens
accgggcatgtctgcctggag

SEQ ID NO: 4121330 - DNA, 16 bp, Homo sapiens
accggtcagtgccttt

SEQ ID NO: 4121331 - DNA, 22 bp, Homo sapiens
accggtcagtgccttttggaac

SEQ ID NO: 4121332 - DNA, 18 bp, Homo sapiens
accggtgcttctggaaac

SEQ ID NO: 4121333 - DNA, 14 bp, Homo sapiens
accgtactctcaca

SEQ ID NO: 4121334 - DNA, 18 bp, Homo sapiens
accgtactctcacatgtg

SEQ ID NO: 4121335 - DNA, 12 bp, Homo sapiens
accgtccagggg

SEQ ID NO: 4121336 - DNA, 22 bp, Homo sapiens
accgtccaggggagatggggag

SEQ ID NO: 4121337 - DNA, 11 bp, Homo sapiens
accgtgcctgg

SEQ ID NO: 4121338 - DNA, 16 bp, Homo sapiens
accgtgcctggccaga

SEQ ID NO: 4121339 - DNA, 15 bp, Homo sapiens
accgtggacaggccc

SEQ ID NO: 4121340 - DNA, 16 bp, Homo sapiens
accgtggtatgtctgc

SEQ ID NO: 4121341 - DNA, 17 bp, Homo sapiens
accgtggtatgtctgcc

SEQ ID NO: 4121342 - DNA, 17 bp, Homo sapiens
accgtgtcaagctgctc

SEQ ID NO: 4121343 - DNA, 14 bp, Homo sapiens
accgtgtccagcac

SEQ ID NO: 4121344 - DNA, 15 bp, Homo sapiens
accgtgtccagcaca

SEQ ID NO: 4121345 - DNA, 17 bp, Homo sapiens
accgtgtctgtctggca

SEQ ID NO: 4121346 - DNA, 15 bp, Homo sapiens
accgtgtttgtctct

SEQ ID NO: 4121347 - DNA, 19 bp, Homo sapiens
accgtgtttgtctcttctg

SEQ ID NO: 4121348 - DNA, 14 bp, Homo sapiens
accgttctgtgcac

SEQ ID NO: 4121349 - DNA, 16 bp, Homo sapiens
accgttggggccctta

SEQ ID NO: 4121350 - DNA, 22 bp, Homo sapiens
acctaaaaggaaatctcacccc

SEQ ID NO: 4121351 - DNA, 22 bp, Homo sapiens
acctaaagtgcttgctttttgc

SEQ ID NO: 4121352 - DNA, 11 bp, Homo sapiens
acctaacattc

SEQ ID NO: 4121353 - DNA, 14 bp, Homo sapiens
acctaaccagggcc

SEQ ID NO: 4121354 - DNA, 18 bp, Homo sapiens
acctaagtgacatttgta

SEQ ID NO: 4121355 - DNA, 20 bp, Homo sapiens
acctaatcaccatgtaagca

SEQ ID NO: 4121356 - DNA, 21 bp, Homo sapiens
acctaatccaggcagatccag

SEQ ID NO: 4121357 - DNA, 18 bp, Homo sapiens
acctaatgtctcactgtt

SEQ ID NO: 4121358 - DNA, 21 bp, Homo sapiens
acctaatgtctcactgttctg

SEQ ID NO: 4121359 - DNA, 22 bp, Homo sapiens
acctaattcgatgaaggctgcc

SEQ ID NO: 4121360 - DNA, 22 bp, Homo sapiens
acctacaccattatcttggaaa

SEQ ID NO: 4121361 - DNA, 16 bp, Homo sapiens
acctacagactccatc

SEQ ID NO: 4121362 - DNA, 17 bp, Homo sapiens
acctaccacagtgtctg

SEQ ID NO: 4121363 - DNA, 16 bp, Homo sapiens
acctacctgccttgga

SEQ ID NO: 4121364 - DNA, 21 bp, Homo sapiens
acctagaatgtcagatttctg

SEQ ID NO: 4121365 - DNA, 17 bp, Homo sapiens
acctagagaagataatt

SEQ ID NO: 4121366 - DNA, 14 bp, Homo sapiens
acctagcagcaccg

SEQ ID NO: 4121367 - DNA, 12 bp, Homo sapiens
acctagccggaa

SEQ ID NO: 4121368 - DNA, 14 bp, Homo sapiens
acctagtactgccc

SEQ ID NO: 4121369 - DNA, 17 bp, Homo sapiens
acctatctcgtgggaga

SEQ ID NO: 4121370 - DNA, 16 bp, Homo sapiens
acctatttccagaaat

SEQ ID NO: 4121371 - DNA, 17 bp, Homo sapiens
acctatttccagaaata

SEQ ID NO: 4121372 - DNA, 14 bp, Homo sapiens
acctatttgacata

SEQ ID NO: 4121373 - DNA, 19 bp, Homo sapiens
acctcaacccccatttcta

SEQ ID NO: 4121374 - DNA, 14 bp, Homo sapiens
acctcaagaccccc

SEQ ID NO: 4121375 - DNA, 15 bp, Homo sapiens
acctcaagggggact

SEQ ID NO: 4121376 - DNA, 11 bp, Homo sapiens
acctcaccatt

SEQ ID NO: 4121377 - DNA, 22 bp, Homo sapiens
acctcaccattgtgaagcacct

SEQ ID NO: 4121378 - DNA, 15 bp, Homo sapiens
acctcacctagaaat

SEQ ID NO: 4121379 - DNA, 15 bp, Homo sapiens
acctcaccttcctgt

SEQ ID NO: 4121380 - DNA, 19 bp, Homo sapiens
acctcaccttcctgtgggt

SEQ ID NO: 4121381 - DNA, 22 bp, Homo sapiens
acctcacgcaggctgagtccag

SEQ ID NO: 4121382 - DNA, 21 bp, Homo sapiens
acctcactcagaagtccagag

SEQ ID NO: 4121383 - DNA, 22 bp, Homo sapiens
acctcagacttaccaggaagca

SEQ ID NO: 4121384 - DNA, 18 bp, Homo sapiens
acctcagaggcagcttca

SEQ ID NO: 4121385 - DNA, 22 bp, Homo sapiens
acctcagaggcagcttcaagtg

SEQ ID NO: 4121386 - DNA, 19 bp, Homo sapiens
acctcagattcttcattga

SEQ ID NO: 4121387 - DNA, 11 bp, Homo sapiens
acctcagcctg

SEQ ID NO: 4121388 - DNA, 13 bp, Homo sapiens
acctcagcctggc

SEQ ID NO: 4121389 - DNA, 17 bp, Homo sapiens
acctcagcctggccaga

SEQ ID NO: 4121390 - DNA, 18 bp, Homo sapiens
acctcagctctgggagag

SEQ ID NO: 4121391 - DNA, 12 bp, Homo sapiens
acctcaggcagg

SEQ ID NO: 4121392 - DNA, 17 bp, Homo sapiens
acctcagggctcccagg

SEQ ID NO: 4121393 - DNA, 12 bp, Homo sapiens
acctcagggctg

SEQ ID NO: 4121394 - DNA, 20 bp, Homo sapiens
acctcagggctgtcccagcc

SEQ ID NO: 4121395 - DNA, 15 bp, Homo sapiens
acctcaggtgatcca

SEQ ID NO: 4121396 - DNA, 16 bp, Homo sapiens
acctcagtgtcattta

SEQ ID NO: 4121397 - DNA, 17 bp, Homo sapiens
acctcagttttatcatt

SEQ ID NO: 4121398 - DNA, 14 bp, Homo sapiens
acctcatcaggatg

SEQ ID NO: 4121399 - DNA, 14 bp, Homo sapiens
acctcatctcccga

SEQ ID NO: 4121400 - DNA, 20 bp, Homo sapiens
acctcatgcccaccccctgc

SEQ ID NO: 4121401 - DNA, 21 bp, Homo sapiens
acctcatgcccaccccctgcc

SEQ ID NO: 4121402 - DNA, 17 bp, Homo sapiens
acctcattgacaagaac

SEQ ID NO: 4121403 - DNA, 19 bp, Homo sapiens
acctccaacagaactaaat

SEQ ID NO: 4121404 - DNA, 22 bp, Homo sapiens
acctccaccacatctgccagac

SEQ ID NO: 4121405 - DNA, 11 bp, Homo sapiens
acctccaccca

SEQ ID NO: 4121406 - DNA, 16 bp, Homo sapiens
acctccacccagcccc

SEQ ID NO: 4121407 - DNA, 20 bp, Homo sapiens
acctccagcctccctgtctc

SEQ ID NO: 4121408 - DNA, 13 bp, Homo sapiens
acctccagcctga

SEQ ID NO: 4121409 - DNA, 14 bp, Homo sapiens
acctccaggcctgt

SEQ ID NO: 4121410 - DNA, 20 bp, Homo sapiens
acctccattaaagtctgaat

SEQ ID NO: 4121411 - DNA, 13 bp, Homo sapiens
acctccccacatc

SEQ ID NO: 4121412 - DNA, 14 bp, Homo sapiens
acctccccacatcg

SEQ ID NO: 4121413 - DNA, 16 bp, Homo sapiens
acctcccccactccca

SEQ ID NO: 4121414 - DNA, 10 bp, Homo sapiens
acctccctcc

SEQ ID NO: 4121415 - DNA, 18 bp, Homo sapiens
acctccgagacagtccag

SEQ ID NO: 4121416 - DNA, 15 bp, Homo sapiens
acctccgcccctgcc

SEQ ID NO: 4121417 - DNA, 12 bp, Homo sapiens
acctcctctcag

SEQ ID NO: 4121418 - DNA, 16 bp, Homo sapiens
acctcctctcagtgtt

SEQ ID NO: 4121419 - DNA, 18 bp, Homo sapiens
acctccttagccctgtct

SEQ ID NO: 4121420 - DNA, 18 bp, Homo sapiens
acctccttgtcactttat

SEQ ID NO: 4121421 - DNA, 15 bp, Homo sapiens
acctcggtgaccact

SEQ ID NO: 4121422 - DNA, 18 bp, Homo sapiens
acctcggtgaccactctt

SEQ ID NO: 4121423 - DNA, 20 bp, Homo sapiens
acctctaaatttccatatcc

SEQ ID NO: 4121424 - DNA, 14 bp, Homo sapiens
acctctaggaggag

SEQ ID NO: 4121425 - DNA, 16 bp, Homo sapiens
acctctcaagctagtg

SEQ ID NO: 4121426 - DNA, 13 bp, Homo sapiens
acctctcactccc

SEQ ID NO: 4121427 - DNA, 16 bp, Homo sapiens
acctctcactccccat

SEQ ID NO: 4121428 - DNA, 12 bp, Homo sapiens
acctctcagggc

SEQ ID NO: 4121429 - DNA, 15 bp, Homo sapiens
acctctcagggcctg

SEQ ID NO: 4121430 - DNA, 17 bp, Homo sapiens
acctctccaggtgctca

SEQ ID NO: 4121431 - DNA, 18 bp, Homo sapiens
acctctccaggtgctcat

SEQ ID NO: 4121432 - DNA, 13 bp, Homo sapiens
acctctcctgccc

SEQ ID NO: 4121433 - DNA, 14 bp, Homo sapiens
acctctcctgccct

SEQ ID NO: 4121434 - DNA, 19 bp, Homo sapiens
actgttgtagaagacaaaa

SEQ ID NO: 4121435 - DNA, 19 bp, Homo sapiens
actgttgtgatcttgcatt

SEQ ID NO: 4121436 - DNA, 22 bp, Homo sapiens
actgttgtgatcttgcattcat

SEQ ID NO: 4121437 - DNA, 15 bp, Homo sapiens
actgttgtgggcgct

SEQ ID NO: 4121438 - DNA, 16 bp, Homo sapiens
actgttgttaagcaac

SEQ ID NO: 4121439 - DNA, 15 bp, Homo sapiens
actgtttatttctgt

SEQ ID NO: 4121440 - DNA, 21 bp, Homo sapiens
actgtttgaaaacttcagaag

SEQ ID NO: 4121441 - DNA, 19 bp, Homo sapiens
actgtttggcttataaaca

SEQ ID NO: 4121442 - DNA, 17 bp, Homo sapiens
actgtttttaagtaact

SEQ ID NO: 4121443 - DNA, 13 bp, Homo sapiens
acttaaaaaaatg

SEQ ID NO: 4121444 - DNA, 17 bp, Homo sapiens
acttaaaaaaatgacag

SEQ ID NO: 4121445 - DNA, 23 bp, Homo sapiens
acttaaaaaacttgtaaatgctg

SEQ ID NO: 4121446 - DNA, 15 bp, Homo sapiens
acttaaaaaatgtcc

SEQ ID NO: 4121447 - DNA, 16 bp, Homo sapiens
acttaaaaatgtaaat

SEQ ID NO: 4121448 - DNA, 22 bp, Homo sapiens
acttaaaataggggatatttaa

SEQ ID NO: 4121449 - DNA, 13 bp, Homo sapiens
acttaaatgaaag

SEQ ID NO: 4121450 - DNA, 14 bp, Homo sapiens
acttaaattatgtt

SEQ ID NO: 4121451 - DNA, 14 bp, Homo sapiens
acttaagcaaaaga

SEQ ID NO: 4121452 - DNA, 20 bp, Homo sapiens
acttaagcaaaagaaaaaga

SEQ ID NO: 4121453 - DNA, 18 bp, Homo sapiens
acttaataactgtgtact

SEQ ID NO: 4121454 - DNA, 18 bp, Homo sapiens
acttaatactaccttgaa

SEQ ID NO: 4121455 - DNA, 19 bp, Homo sapiens
acttaatactcaaatgagt

SEQ ID NO: 4121456 - DNA, 12 bp, Homo sapiens
acttaatggaaa

SEQ ID NO: 4121457 - DNA, 17 bp, Homo sapiens
acttacagctctggcca

SEQ ID NO: 4121458 - DNA, 15 bp, Homo sapiens
acttacatcttctgt

SEQ ID NO: 4121459 - DNA, 23 bp, Homo sapiens
acttacattgttcaattagaata

SEQ ID NO: 4121460 - DNA, 17 bp, Homo sapiens
acttacctagatttaca

SEQ ID NO: 4121461 - DNA, 20 bp, Homo sapiens
acttagaggtggggagcaga

SEQ ID NO: 4121462 - DNA, 21 bp, Homo sapiens
acttagagtttctgtttgatt

SEQ ID NO: 4121463 - DNA, 19 bp, Homo sapiens
acttagcagcaactgaaga

SEQ ID NO: 4121464 - DNA, 18 bp, Homo sapiens
acttagcatcctaagaaa

SEQ ID NO: 4121465 - DNA, 19 bp, Homo sapiens
acttagcatcctaagaaat

SEQ ID NO: 4121466 - DNA, 18 bp, Homo sapiens
acttaggactagaagatt

SEQ ID NO: 4121467 - DNA, 17 bp, Homo sapiens
acttagggtttggagct

SEQ ID NO: 4121468 - DNA, 18 bp, Homo sapiens
acttagtgacaaaataga

SEQ ID NO: 4121469 - DNA, 18 bp, Homo sapiens
acttataaagaaggttgg

SEQ ID NO: 4121470 - DNA, 20 bp, Homo sapiens
acttataaatcatattgatg

SEQ ID NO: 4121471 - DNA, 17 bp, Homo sapiens
acttatagtacatgata

SEQ ID NO: 4121472 - DNA, 18 bp, Homo sapiens
acttatagtacatgataa

SEQ ID NO: 4121473 - DNA, 18 bp, Homo sapiens
acttatattgaagacaat

SEQ ID NO: 4121474 - DNA, 15 bp, Homo sapiens
acttatatttcccta

SEQ ID NO: 4121475 - DNA, 19 bp, Homo sapiens
acttatcctaaaacaaata

SEQ ID NO: 4121476 - DNA, 23 bp, Homo sapiens
acttatgacctcttcctttagga

SEQ ID NO: 4121477 - DNA, 14 bp, Homo sapiens
acttatgctgattt

SEQ ID NO: 4121478 - DNA, 20 bp, Homo sapiens
acttattacaatttgttcat

SEQ ID NO: 4121479 - DNA, 13 bp, Homo sapiens
acttattagaaac

SEQ ID NO: 4121480 - DNA, 12 bp, Homo sapiens
acttatttaaaa

SEQ ID NO: 4121481 - DNA, 15 bp, Homo sapiens
acttatttaaaaata

SEQ ID NO: 4121482 - DNA, 22 bp, Homo sapiens
acttatttaaaaatatttcaga

SEQ ID NO: 4121483 - DNA, 20 bp, Homo sapiens
acttatttcactatcttctt

SEQ ID NO: 4121484 - DNA, 15 bp, Homo sapiens
acttattttctctgt

SEQ ID NO: 4121485 - DNA, 13 bp, Homo sapiens
acttcaaggccca

SEQ ID NO: 4121486 - DNA, 22 bp, Homo sapiens
acttcaatgggctcttccaaca

SEQ ID NO: 4121487 - DNA, 18 bp, Homo sapiens
acttcacattaaaaaatg

SEQ ID NO: 4121488 - DNA, 16 bp, Homo sapiens
acttcacgcccttggc

SEQ ID NO: 4121489 - DNA, 18 bp, Homo sapiens
acttcagaagcaaacaat

SEQ ID NO: 4121490 - DNA, 18 bp, Homo sapiens
acttcaggagaaactgct

SEQ ID NO: 4121491 - DNA, 16 bp, Homo sapiens
acttcaggctcttctc

SEQ ID NO: 4121492 - DNA, 19 bp, Homo sapiens
acttcagggcagggctctg

SEQ ID NO: 4121493 - DNA, 16 bp, Homo sapiens
acttcagttgatcttc

SEQ ID NO: 4121494 - DNA, 21 bp, Homo sapiens
acttcattattttaaaaatat

SEQ ID NO: 4121495 - DNA, 17 bp, Homo sapiens
acttcattctgcagggt

SEQ ID NO: 4121496 - DNA, 19 bp, Homo sapiens
acttcattcttgaaagctg

SEQ ID NO: 4121497 - DNA, 15 bp, Homo sapiens
acttccaaaattctt

SEQ ID NO: 4121498 - DNA, 18 bp, Homo sapiens
acttccaatttacatact

SEQ ID NO: 4121499 - DNA, 23 bp, Homo sapiens
acttccacctccaccacatctgc

SEQ ID NO: 4121500 - DNA, 20 bp, Homo sapiens
acttccaggggaacctgcca

SEQ ID NO: 4121501 - DNA, 21 bp, Homo sapiens
acttccaggggaacctgccat

SEQ ID NO: 4121502 - DNA, 21 bp, Homo sapiens
acttccaggtgttactgtaat

SEQ ID NO: 4121503 - DNA, 16 bp, Homo sapiens
acttccatacagctct

SEQ ID NO: 4121504 - DNA, 19 bp, Homo sapiens
acttccataggacatactg

SEQ ID NO: 4121505 - DNA, 22 bp, Homo sapiens
acttccataggacatactgcat

SEQ ID NO: 4121506 - DNA, 14 bp, Homo sapiens
acttccatgcctta

SEQ ID NO: 4121507 - DNA, 20 bp, Homo sapiens
acttccatgccttaaaccta

SEQ ID NO: 4121508 - DNA, 24 bp, Homo sapiens
acttcccagttcaggagtcccaag

SEQ ID NO: 4121509 - DNA, 18 bp, Homo sapiens
acttcccgggccagggct

SEQ ID NO: 4121510 - DNA, 20 bp, Homo sapiens
acttcccgggccagggctgc

SEQ ID NO: 4121511 - DNA, 14 bp, Homo sapiens
acttccgctgaggg

SEQ ID NO: 4121512 - DNA, 16 bp, Homo sapiens
acttccgtcacatccc

SEQ ID NO: 4121513 - DNA, 22 bp, Homo sapiens
acttcctgattggtttctcttc

SEQ ID NO: 4121514 - DNA, 17 bp, Homo sapiens
acttcctgctacaggag

SEQ ID NO: 4121515 - DNA, 11 bp, Homo sapiens
acttcctgctg

SEQ ID NO: 4121516 - DNA, 13 bp, Homo sapiens
acttcctgctgca

SEQ ID NO: 4121517 - DNA, 14 bp, Homo sapiens
acttccttttaact

SEQ ID NO: 4121518 - DNA, 19 bp, Homo sapiens
acttcgactcaggatccag

SEQ ID NO: 4121519 - DNA, 17 bp, Homo sapiens
acttcgggctgtgtaaa

SEQ ID NO: 4121520 - DNA, 19 bp, Homo sapiens
acttcgtcttctaatttca

SEQ ID NO: 4121521 - DNA, 15 bp, Homo sapiens
acttctaatatcatt

SEQ ID NO: 4121522 - DNA, 16 bp, Homo sapiens
acttctaatatcattc

SEQ ID NO: 4121523 - DNA, 16 bp, Homo sapiens
acttctaatcttaaat

SEQ ID NO: 4121524 - DNA, 19 bp, Homo sapiens
acttctaatcttaaatcag

SEQ ID NO: 4121525 - DNA, 12 bp, Homo sapiens
acttctatattt

SEQ ID NO: 4121526 - DNA, 23 bp, Homo sapiens
acttctatattttaatagaaata

SEQ ID NO: 4121527 - DNA, 16 bp, Homo sapiens
acttctccaggtctca

SEQ ID NO: 4121528 - DNA, 23 bp, Homo sapiens
acttctctgcctttgacatttaa

SEQ ID NO: 4121529 - DNA, 14 bp, Homo sapiens
acttctcttgcttt

SEQ ID NO: 4121530 - DNA, 16 bp, Homo sapiens
acttctcttgctttct

SEQ ID NO: 4121531 - DNA, 13 bp, Homo sapiens
acttctggctcct

SEQ ID NO: 4121532 - DNA, 15 bp, Homo sapiens
acttctggctcctca

SEQ ID NO: 4121533 - DNA, 13 bp, Homo sapiens
acttctgtgggcc

SEQ ID NO: 4121534 - DNA, 14 bp, Homo sapiens
acttcttaaatatc

SEQ ID NO: 4121535 - DNA, 16 bp, Homo sapiens
acttcttaaatatctt

SEQ ID NO: 4121536 - DNA, 17 bp, Homo sapiens
acttcttaaatatcttt

SEQ ID NO: 4121537 - DNA, 18 bp, Homo sapiens
acttcttaaatatctttt

SEQ ID NO: 4121538 - DNA, 18 bp, Homo sapiens
acttcttatacatttgat

SEQ ID NO: 4121539 - DNA, 13 bp, Homo sapiens
acttcttgaaggt

SEQ ID NO: 4121540 - DNA, 16 bp, Homo sapiens
acttcttgaaggtgct

SEQ ID NO: 4121541 - DNA, 12 bp, Homo sapiens
acttctttccct

SEQ ID NO: 4121542 - DNA, 18 bp, Homo sapiens
acttgaaaagaaagtgtt

SEQ ID NO: 4121543 - DNA, 23 bp, Homo sapiens
acttgaaatgttagtcattgtta

SEQ ID NO: 4121544 - DNA, 16 bp, Homo sapiens
acttgaaattatatct

SEQ ID NO: 4121545 - DNA, 17 bp, Homo sapiens
acttgaaattatatctg

SEQ ID NO: 4121546 - DNA, 15 bp, Homo sapiens
acttgaagggccaga

SEQ ID NO: 4121547 - DNA, 17 bp, Homo sapiens
acttgaagggccagagc

SEQ ID NO: 4121548 - DNA, 19 bp, Homo sapiens
acttgaagggccagagcca

SEQ ID NO: 4121549 - DNA, 20 bp, Homo sapiens
acttgaagggccagagccag

SEQ ID NO: 4121550 - DNA, 21 bp, Homo sapiens
acttgaagggccagagccagg

SEQ ID NO: 4121551 - DNA, 13 bp, Homo sapiens
acttgaatatgta

SEQ ID NO: 4121552 - DNA, 14 bp, Homo sapiens
acttgaatttcaaa

SEQ ID NO: 4121553 - DNA, 21 bp, Homo sapiens
acttgagaactttccattttg

SEQ ID NO: 4121554 - DNA, 20 bp, Homo sapiens
acttgagcaccgtcatggct

SEQ ID NO: 4121555 - DNA, 19 bp, Homo sapiens
acttgatagcaaacactgg

SEQ ID NO: 4121556 - DNA, 22 bp, Homo sapiens
acttgatgtacataactcctgt

SEQ ID NO: 4121557 - DNA, 18 bp, Homo sapiens
acttgatgtgccatttta

SEQ ID NO: 4121558 - DNA, 19 bp, Homo sapiens
acttgatgtgccattttaa

SEQ ID NO: 4121559 - DNA, 19 bp, Homo sapiens
acttgattaagattttaca

SEQ ID NO: 4121560 - DNA, 21 bp, Homo sapiens
acttgattaagattttacaaa

SEQ ID NO: 4121561 - DNA, 18 bp, Homo sapiens
acttgatttgatgtgact

SEQ ID NO: 4121562 - DNA, 13 bp, Homo sapiens
acttgatttgcat

SEQ ID NO: 4121563 - DNA, 14 bp, Homo sapiens
acttgatttgcatg

SEQ ID NO: 4121564 - DNA, 15 bp, Homo sapiens
acttgatttgcatgg

SEQ ID NO: 4121565 - DNA, 23 bp, Homo sapiens
acttgcagctgatgttggaagag

SEQ ID NO: 4121566 - DNA, 19 bp, Homo sapiens
acttgcattgaatatatta

SEQ ID NO: 4121567 - DNA, 15 bp, Homo sapiens
acttgcccaggtcac

SEQ ID NO: 4121568 - DNA, 14 bp, Homo sapiens
acttgcgagtccaa

SEQ ID NO: 4121569 - DNA, 15 bp, Homo sapiens
acttgctggggctca

SEQ ID NO: 4121570 - DNA, 23 bp, Homo sapiens
acttgctggggctcacggggcct

SEQ ID NO: 4121571 - DNA, 18 bp, Homo sapiens
acttgcttaaatttctta

SEQ ID NO: 4121572 - DNA, 15 bp, Homo sapiens
acttgcttctctagc

SEQ ID NO: 4121573 - DNA, 22 bp, Homo sapiens
acttgctttatgccttcttatt

SEQ ID NO: 4121574 - DNA, 22 bp, Homo sapiens
acttggaatttgtaacctcagc

SEQ ID NO: 4121575 - DNA, 16 bp, Homo sapiens
acttggcaggtgcctg

SEQ ID NO: 4121576 - DNA, 20 bp, Homo sapiens
acttgggagacctgtaatca

SEQ ID NO: 4121577 - DNA, 14 bp, Homo sapiens
acttggggaggcaa

SEQ ID NO: 4121578 - DNA, 18 bp, Homo sapiens
acttggggcacagggaga

SEQ ID NO: 4121579 - DNA, 15 bp, Homo sapiens
acttgggtcttccct

SEQ ID NO: 4121580 - DNA, 13 bp, Homo sapiens
acttgtaaataca

SEQ ID NO: 4121581 - DNA, 22 bp, Homo sapiens
acttgtaatatttttatataca

SEQ ID NO: 4121582 - DNA, 23 bp, Homo sapiens
acttgtacttgtttcatctggtt

SEQ ID NO: 4121583 - DNA, 16 bp, Homo sapiens
acttgtcaggcatggc

SEQ ID NO: 4121584 - DNA, 13 bp, Homo sapiens
acttgtctttctg

SEQ ID NO: 4121585 - DNA, 17 bp, Homo sapiens
acttgtctttttctgga

SEQ ID NO: 4121586 - DNA, 17 bp, Homo sapiens
acttgtgaaacacagct

SEQ ID NO: 4121587 - DNA, 18 bp, Homo sapiens
acttgtgaaacacagctg

SEQ ID NO: 4121588 - DNA, 13 bp, Homo sapiens
acttgtggcctca

SEQ ID NO: 4121589 - DNA, 15 bp, Homo sapiens
acttgtggcctcaag

SEQ ID NO: 4121590 - DNA, 17 bp, Homo sapiens
acttgtggttttcaaat

SEQ ID NO: 4121591 - DNA, 20 bp, Homo sapiens
acttgtgtgtgggctgtgag

SEQ ID NO: 4121592 - DNA, 22 bp, Homo sapiens
acttgtgtgtgggctgtgagtg

SEQ ID NO: 4121593 - DNA, 23 bp, Homo sapiens
acttgtgtgtgggctgtgagtgt

SEQ ID NO: 4121594 - DNA, 13 bp, Homo sapiens
acttgtgtttgct

SEQ ID NO: 4121595 - DNA, 22 bp, Homo sapiens
acttgtgtttgcttaaacaaag

SEQ ID NO: 4121596 - DNA, 17 bp, Homo sapiens
acttgttccagctcttt

SEQ ID NO: 4121597 - DNA, 16 bp, Homo sapiens
acttgtttgtcttcca

SEQ ID NO: 4121598 - DNA, 12 bp, Homo sapiens
actttaaaggaa

SEQ ID NO: 4121599 - DNA, 15 bp, Homo sapiens
actttaatggcctgg

SEQ ID NO: 4121600 - DNA, 14 bp, Homo sapiens
actttacagaaatg

SEQ ID NO: 4121601 - DNA, 12 bp, Homo sapiens
actttagaaata

SEQ ID NO: 4121602 - DNA, 15 bp, Homo sapiens
actttagagtagcat

SEQ ID NO: 4121603 - DNA, 19 bp, Homo sapiens
actttagagtagcatgaga

SEQ ID NO: 4121604 - DNA, 22 bp, Homo sapiens
actttagggtaaaaattgccat

SEQ ID NO: 4121605 - DNA, 16 bp, Homo sapiens
actttatacattagta

SEQ ID NO: 4121606 - DNA, 19 bp, Homo sapiens
actttatagttgttttata

SEQ ID NO: 4121607 - DNA, 13 bp, Homo sapiens
actttatcacatt

SEQ ID NO: 4121608 - DNA, 13 bp, Homo sapiens
actttatctaaag

SEQ ID NO: 4121609 - DNA, 18 bp, Homo sapiens
actttatgtttgtctttt

SEQ ID NO: 4121610 - DNA, 20 bp, Homo sapiens
actttattaaatacaaaact

SEQ ID NO: 4121611 - DNA, 20 bp, Homo sapiens
actttcaattgtcacttttt

SEQ ID NO: 4121612 - DNA, 15 bp, Homo sapiens
actttcacatagatg

SEQ ID NO: 4121613 - DNA, 17 bp, Homo sapiens
actttcacatagatgtc

SEQ ID NO: 4121614 - DNA, 21 bp, Homo sapiens
actttcacatagatgtccctt

SEQ ID NO: 4121615 - DNA, 19 bp, Homo sapiens
actttcatcctgactctgc

SEQ ID NO: 4121616 - DNA, 15 bp, Homo sapiens
actttcatctacctt

SEQ ID NO: 4121617 - DNA, 15 bp, Homo sapiens
actttcattccttca

SEQ ID NO: 4121618 - DNA, 17 bp, Homo sapiens
actttccaattctcctt

SEQ ID NO: 4121619 - DNA, 19 bp, Homo sapiens
actttccaattctccttta

SEQ ID NO: 4121620 - DNA, 17 bp, Homo sapiens
actttccacttcttcct

SEQ ID NO: 4121621 - DNA, 22 bp, Homo sapiens
actttccacttcttcctttctc

SEQ ID NO: 4121622 - DNA, 17 bp, Homo sapiens
actttccgagcctccag

SEQ ID NO: 4121623 - DNA, 19 bp, Homo sapiens
actttctacaatgtgaact

SEQ ID NO: 4121624 - DNA, 18 bp, Homo sapiens
actttcttctgaatattt

SEQ ID NO: 4121625 - DNA, 23 bp, Homo sapiens
actttgcagccggcacagggtct

SEQ ID NO: 4121626 - DNA, 20 bp, Homo sapiens
actttgccaaaaaaaaaaga

SEQ ID NO: 4121627 - DNA, 19 bp, Homo sapiens
actttgccagcttttcctc

SEQ ID NO: 4121628 - DNA, 23 bp, Homo sapiens
actttgccagcttttcctccctt

SEQ ID NO: 4121629 - DNA, 18 bp, Homo sapiens
actttgctctcaattaaa

SEQ ID NO: 4121630 - DNA, 19 bp, Homo sapiens
actttgctctcaattaaag

SEQ ID NO: 4121631 - DNA, 15 bp, Homo sapiens
actttgctgatttcc

SEQ ID NO: 4121632 - DNA, 20 bp, Homo sapiens
actttgctgatttcccctct

SEQ ID NO: 4121633 - DNA, 13 bp, Homo sapiens
actttgcttcata

SEQ ID NO: 4121634 - DNA, 17 bp, Homo sapiens
actttgcttcccctcca

SEQ ID NO: 4121635 - DNA, 17 bp, Homo sapiens
actttgcttgagaatcc

SEQ ID NO: 4121636 - DNA, 13 bp, Homo sapiens
actttgcttgctt

SEQ ID NO: 4121637 - DNA, 20 bp, Homo sapiens
actttgcttgctttgaagta

SEQ ID NO: 4121638 - DNA, 18 bp, Homo sapiens
actttggagtcccctcac

SEQ ID NO: 4121639 - DNA, 12 bp, Homo sapiens
actttgggaggc

SEQ ID NO: 4121640 - DNA, 19 bp, Homo sapiens
actttgggaggccaaggtg

SEQ ID NO: 4121641 - DNA, 22 bp, Homo sapiens
actttgtacttgtgtttgctta

SEQ ID NO: 4121642 - DNA, 20 bp, Homo sapiens
actttgtcgcccaggctgga

SEQ ID NO: 4121643 - DNA, 16 bp, Homo sapiens
actttgtctctcctgg

SEQ ID NO: 4121644 - DNA, 20 bp, Homo sapiens
actttgtctctcctggctgg

SEQ ID NO: 4121645 - DNA, 20 bp, Homo sapiens
actttgttctttaggagatt

SEQ ID NO: 4121646 - DNA, 21 bp, Homo sapiens
actttgttgcaagatgtgaat

SEQ ID NO: 4121647 - DNA, 20 bp, Homo sapiens
acttttaaatggcagtattt

SEQ ID NO: 4121648 - DNA, 22 bp, Homo sapiens
acttttaaatggcagtatttca

SEQ ID NO: 4121649 - DNA, 23 bp, Homo sapiens
acttttatactctttctgtatat

SEQ ID NO: 4121650 - DNA, 15 bp, Homo sapiens
acttttattttcttt

SEQ ID NO: 4121651 - DNA, 12 bp, Homo sapiens
acttttgagtgt

SEQ ID NO: 4121652 - DNA, 16 bp, Homo sapiens
acttttgagtgtgtgt

SEQ ID NO: 4121653 - DNA, 21 bp, Homo sapiens
acttttgagtgtgtgtgtgca

SEQ ID NO: 4121654 - DNA, 16 bp, Homo sapiens
acttttgtactgaatt

SEQ ID NO: 4121655 - DNA, 22 bp, Homo sapiens
acttttgtgctatcaatgagtt

SEQ ID NO: 4121656 - DNA, 15 bp, Homo sapiens
acttttgttattcca

SEQ ID NO: 4121657 - DNA, 16 bp, Homo sapiens
acttttgttattccat

SEQ ID NO: 4121658 - DNA, 19 bp, Homo sapiens
acttttgttattccatcaa

SEQ ID NO: 4121659 - DNA, 13 bp, Homo sapiens
actttttggctga

SEQ ID NO: 4121660 - DNA, 17 bp, Homo sapiens
acttttttttctctctt

SEQ ID NO: 4121661 - DNA, 22 bp, Homo sapiens
agaaaaaaaaaagaaatgcaaa

SEQ ID NO: 4121662 - DNA, 17 bp, Homo sapiens
agaaaaaaaataacaca

SEQ ID NO: 4121663 - DNA, 20 bp, Homo sapiens
agaaaaaaaataacacagag

SEQ ID NO: 4121664 - DNA, 18 bp, Homo sapiens
agaaaaaaaccacacaaa

SEQ ID NO: 4121665 - DNA, 17 bp, Homo sapiens
agaaaaaaagatttatt

SEQ ID NO: 4121666 - DNA, 21 bp, Homo sapiens
agaaaaaaatcttctccagat

SEQ ID NO: 4121667 - DNA, 19 bp, Homo sapiens
agaaaaaaattactaattt

SEQ ID NO: 4121668 - DNA, 22 bp, Homo sapiens
agaaaaaaggttctttgtgtat

SEQ ID NO: 4121669 - DNA, 13 bp, Homo sapiens
agaaaaagaaaca

SEQ ID NO: 4121670 - DNA, 17 bp, Homo sapiens
agaaaaagcaaaaggca

SEQ ID NO: 4121671 - DNA, 20 bp, Homo sapiens
agaaaaagctcctgtcctcc

SEQ ID NO: 4121672 - DNA, 13 bp, Homo sapiens
agaaaaatgttct

SEQ ID NO: 4121673 - DNA, 20 bp, Homo sapiens
agaaaaattcagcaaaccat

SEQ ID NO: 4121674 - DNA, 13 bp, Homo sapiens
agaaaacaaaatt

SEQ ID NO: 4121675 - DNA, 23 bp, Homo sapiens
agaaaacattttttttttaaatc

SEQ ID NO: 4121676 - DNA, 20 bp, Homo sapiens
agaaaacctgtatttttgtt

SEQ ID NO: 4121677 - DNA, 22 bp, Homo sapiens
agaaaacctgtatttttgttag

SEQ ID NO: 4121678 - DNA, 21 bp, Homo sapiens
agaaaactcctttagcaggtg

SEQ ID NO: 4121679 - DNA, 20 bp, Homo sapiens
agaaaactttaaaaaatatt

SEQ ID NO: 4121680 - DNA, 23 bp, Homo sapiens
agaaaagagatattttaaaatga

SEQ ID NO: 4121681 - DNA, 18 bp, Homo sapiens
agaaaagattttaatcaa

SEQ ID NO: 4121682 - DNA, 20 bp, Homo sapiens
agaaaagattttaatcaagt

SEQ ID NO: 4121683 - DNA, 11 bp, Homo sapiens
agaaaagcact

SEQ ID NO: 4121684 - DNA, 12 bp, Homo sapiens
agaaaagcactt

SEQ ID NO: 4121685 - DNA, 13 bp, Homo sapiens
agaaaagccaagc

SEQ ID NO: 4121686 - DNA, 13 bp, Homo sapiens
agaaaagcccatt

SEQ ID NO: 4121687 - DNA, 16 bp, Homo sapiens
agaaaatacaataaac

SEQ ID NO: 4121688 - DNA, 23 bp, Homo sapiens
agaaaatgacttatttctgctct

SEQ ID NO: 4121689 - DNA, 22 bp, Homo sapiens
agaaaatgcggttataaaaaat

SEQ ID NO: 4121690 - DNA, 17 bp, Homo sapiens
agaaaatgtgtaattca

SEQ ID NO: 4121691 - DNA, 17 bp, Homo sapiens
agaaaatgttgagaatc

SEQ ID NO: 4121692 - DNA, 16 bp, Homo sapiens
agaaaattctgtgcct

SEQ ID NO: 4121693 - DNA, 16 bp, Homo sapiens
agaaaattgcactaaa

SEQ ID NO: 4121694 - DNA, 21 bp, Homo sapiens
agaaaatttagccctttaaaa

SEQ ID NO: 4121695 - DNA, 23 bp, Homo sapiens
agaaaatttagccctttaaaacg

SEQ ID NO: 4121696 - DNA, 16 bp, Homo sapiens
agaaaatttttgtagt

SEQ ID NO: 4121697 - DNA, 16 bp, Homo sapiens
agaaacacattcttat

SEQ ID NO: 4121698 - DNA, 18 bp, Homo sapiens
agaaacagagtggcctcc

SEQ ID NO: 4121699 - DNA, 23 bp, Homo sapiens
agaaacagagtggcctccctgct

SEQ ID NO: 4121700 - DNA, 13 bp, Homo sapiens
agaaacagccagc

SEQ ID NO: 4121701 - DNA, 14 bp, Homo sapiens
agaaacagccattg

SEQ ID NO: 4121702 - DNA, 18 bp, Homo sapiens
agaaacagtgggagccct

SEQ ID NO: 4121703 - DNA, 15 bp, Homo sapiens
agaaaccttgctctc

SEQ ID NO: 4121704 - DNA, 19 bp, Homo sapiens
agaaaccttgctctcctca

SEQ ID NO: 4121705 - DNA, 18 bp, Homo sapiens
agaaacgcatccagcaag

SEQ ID NO: 4121706 - DNA, 16 bp, Homo sapiens
agaaacgtcttctaaa

SEQ ID NO: 4121707 - DNA, 21 bp, Homo sapiens
agaaacgtcttctaaacttcc

SEQ ID NO: 4121708 - DNA, 18 bp, Homo sapiens
agaaactggattaaaaca

SEQ ID NO: 4121709 - DNA, 21 bp, Homo sapiens
agaaacttaaattttagttct

SEQ ID NO: 4121710 - DNA, 16 bp, Homo sapiens
agaaacttaagcaaag

SEQ ID NO: 4121711 - DNA, 15 bp, Homo sapiens
agaaactttatacat

SEQ ID NO: 4121712 - DNA, 10 bp, Homo sapiens
agaaagaaag

SEQ ID NO: 4121713 - DNA, 12 bp, Homo sapiens
agaaagaagaga

SEQ ID NO: 4121714 - DNA, 12 bp, Homo sapiens
agaaagaaggaa

SEQ ID NO: 4121715 - DNA, 13 bp, Homo sapiens
agaaagaaggaag

SEQ ID NO: 4121716 - DNA, 18 bp, Homo sapiens
agaaagaaggaagtgaag

SEQ ID NO: 4121717 - DNA, 22 bp, Homo sapiens
agaaagactatctaaatgttga

SEQ ID NO: 4121718 - DNA, 12 bp, Homo sapiens
agaaagacttgg

SEQ ID NO: 4121719 - DNA, 19 bp, Homo sapiens
agaaagagtattgttatgt

SEQ ID NO: 4121720 - DNA, 14 bp, Homo sapiens
agaaagcataaaat

SEQ ID NO: 4121721 - DNA, 16 bp, Homo sapiens
agaaagctgtgaacag

SEQ ID NO: 4121722 - DNA, 16 bp, Homo sapiens
agaaaggaacctggga

SEQ ID NO: 4121723 - DNA, 21 bp, Homo sapiens
agaaaggatatttaagaaaat

SEQ ID NO: 4121724 - DNA, 14 bp, Homo sapiens
agaaaggggagccc

SEQ ID NO: 4121725 - DNA, 15 bp, Homo sapiens
agaaaggggagccca

SEQ ID NO: 4121726 - DNA, 16 bp, Homo sapiens
agaaaggttctgcccg

SEQ ID NO: 4121727 - DNA, 23 bp, Homo sapiens
agaaagtgaagcaaatcagaaac

SEQ ID NO: 4121728 - DNA, 22 bp, Homo sapiens
agaaagtgcctgacacactaac

SEQ ID NO: 4121729 - DNA, 22 bp, Homo sapiens
agaaagttagggggttcttatt

SEQ ID NO: 4121730 - DNA, 17 bp, Homo sapiens
agaaataaaaggaagcc

SEQ ID NO: 4121731 - DNA, 22 bp, Homo sapiens
agaaataaatcagagagcaagg

SEQ ID NO: 4121732 - DNA, 19 bp, Homo sapiens
agaaataatccctgtaata

SEQ ID NO: 4121733 - DNA, 23 bp, Homo sapiens
agaaataatccctgtaatattta

SEQ ID NO: 4121734 - DNA, 15 bp, Homo sapiens
agaaataatggtctt

SEQ ID NO: 4121735 - DNA, 18 bp, Homo sapiens
agaaatagacagtatatt

SEQ ID NO: 4121736 - DNA, 14 bp, Homo sapiens
agaaatataattga

SEQ ID NO: 4121737 - DNA, 21 bp, Homo sapiens
agaaatatgcacaatagcagt

SEQ ID NO: 4121738 - DNA, 14 bp, Homo sapiens
agaaatatgtggtt

SEQ ID NO: 4121739 - DNA, 21 bp, Homo sapiens
agaaatcaagcataaatcact

SEQ ID NO: 4121740 - DNA, 14 bp, Homo sapiens
agaaatcagaggag

SEQ ID NO: 4121741 - DNA, 18 bp, Homo sapiens
agaaatcaggtgttttaa

SEQ ID NO: 4121742 - DNA, 22 bp, Homo sapiens
agaaatcaggtgttttaagact

SEQ ID NO: 4121743 - DNA, 18 bp, Homo sapiens
agaaatcagtaatattta

SEQ ID NO: 4121744 - DNA, 17 bp, Homo sapiens
agaaatgactaattagg

SEQ ID NO: 4121745 - DNA, 15 bp, Homo sapiens
agaaatgctgctggc

SEQ ID NO: 4121746 - DNA, 20 bp, Homo sapiens
agaaatgggacttaactcct

SEQ ID NO: 4121747 - DNA, 20 bp, Homo sapiens
agaaatgtctaaatgctgaa

SEQ ID NO: 4121748 - DNA, 16 bp, Homo sapiens
agaaatgtcttaattt

SEQ ID NO: 4121749 - DNA, 20 bp, Homo sapiens
agaaattcgtgtgttttttt

SEQ ID NO: 4121750 - DNA, 23 bp, Homo sapiens
agaaattcgtgtgtttttttatg

SEQ ID NO: 4121751 - DNA, 13 bp, Homo sapiens
agaaattctgtta

SEQ ID NO: 4121752 - DNA, 15 bp, Homo sapiens
agaaattctgttaaa

SEQ ID NO: 4121753 - DNA, 17 bp, Homo sapiens
agaaattgcatttcctg

SEQ ID NO: 4121754 - DNA, 15 bp, Homo sapiens
agaaattggctggat

SEQ ID NO: 4121755 - DNA, 22 bp, Homo sapiens
agaaattttacaataggtgctt

SEQ ID NO: 4121756 - DNA, 16 bp, Homo sapiens
agaaattttgtaagaa

SEQ ID NO: 4121757 - DNA, 17 bp, Homo sapiens
agaaatttttatcagtt

SEQ ID NO: 4121758 - DNA, 13 bp, Homo sapiens
agaaatttttatt

SEQ ID NO: 4121759 - DNA, 17 bp, Homo sapiens
agaaatttttcagatgc

SEQ ID NO: 4121760 - DNA, 18 bp, Homo sapiens
agaaatttttcagatgct

SEQ ID NO: 4121761 - DNA, 20 bp, Homo sapiens
agaacaagagtttgttctgt

SEQ ID NO: 4121762 - DNA, 18 bp, Homo sapiens
agaacacggctcacgctt

SEQ ID NO: 4121763 - DNA, 19 bp, Homo sapiens
agaacagataatcagtgtg

SEQ ID NO: 4121764 - DNA, 18 bp, Homo sapiens
agaacagcagaggttctt

SEQ ID NO: 4121765 - DNA, 22 bp, Homo sapiens
agaacagcatcatgtcataaac

SEQ ID NO: 4121766 - DNA, 12 bp, Homo sapiens
agaacagtgggc

SEQ ID NO: 4121767 - DNA, 22 bp, Homo sapiens
agaacagtgggcgttgggagcc

SEQ ID NO: 4121768 - DNA, 17 bp, Homo sapiens
agaacattccatttgaa

SEQ ID NO: 4121769 - DNA, 19 bp, Homo sapiens
agaaccaaaaatcccacct

SEQ ID NO: 4121770 - DNA, 20 bp, Homo sapiens
agaaccacttcctgctacag

SEQ ID NO: 4121771 - DNA, 16 bp, Homo sapiens
agaaccagtcccccca

SEQ ID NO: 4121772 - DNA, 20 bp, Homo sapiens
agaaccctctgtcccacccc

SEQ ID NO: 4121773 - DNA, 22 bp, Homo sapiens
agaaccgagcaaagatcaaaat

SEQ ID NO: 4121774 - DNA, 22 bp, Homo sapiens
agaacctacagactccatctct

SEQ ID NO: 4121775 - DNA, 21 bp, Homo sapiens
agaacctcagattcttcattg

SEQ ID NO: 4121776 - DNA, 13 bp, Homo sapiens
agaacctcttccc

SEQ ID NO: 4121777 - DNA, 20 bp, Homo sapiens
agaacctgagctattttcct

SEQ ID NO: 4121778 - DNA, 23 bp, Homo sapiens
agaacctgagctattttcctctg

SEQ ID NO: 4121779 - DNA, 22 bp, Homo sapiens
agaacgcagccctagagcctgc

SEQ ID NO: 4121780 - DNA, 18 bp, Homo sapiens
agaacgccagtctcccag

SEQ ID NO: 4121781 - DNA, 21 bp, Homo sapiens
agaacggagccccaggcctct

SEQ ID NO: 4121782 - DNA, 14 bp, Homo sapiens
agaactaccccctt

SEQ ID NO: 4121783 - DNA, 20 bp, Homo sapiens
agaactacctggatttgtat

SEQ ID NO: 4121784 - DNA, 15 bp, Homo sapiens
agaactagcatatag

SEQ ID NO: 4121785 - DNA, 14 bp, Homo sapiens
agaactcactgggg

SEQ ID NO: 4121786 - DNA, 17 bp, Homo sapiens
agaactcagttttaact

SEQ ID NO: 4121787 - DNA, 15 bp, Homo sapiens
agaactccaggccct

SEQ ID NO: 4121788 - DNA, 11 bp, Homo sapiens
agaactcctga

SEQ ID NO: 4121789 - DNA, 13 bp, Homo sapiens
agaactcctgact

SEQ ID NO: 4121790 - DNA, 13 bp, Homo sapiens
agaactctgcctg

SEQ ID NO: 4121791 - DNA, 23 bp, Homo sapiens
agaactctgcctgccctttgtcc

SEQ ID NO: 4121792 - DNA, 14 bp, Homo sapiens
agaactctgggctg

SEQ ID NO: 4121793 - DNA, 22 bp, Homo sapiens
agaactcttcctccaaggacag

SEQ ID NO: 4121794 - DNA, 23 bp, Homo sapiens
agaactgcatggacctaacattc

SEQ ID NO: 4121795 - DNA, 15 bp, Homo sapiens
agaactgcccccact

SEQ ID NO: 4121796 - DNA, 21 bp, Homo sapiens
agaactgcttctaagatgcca

SEQ ID NO: 4121797 - DNA, 14 bp, Homo sapiens
agaactgggatttg

SEQ ID NO: 4121798 - DNA, 15 bp, Homo sapiens
agaacttcagaaaga

SEQ ID NO: 4121799 - DNA, 18 bp, Homo sapiens
agaacttcagaaagactt

SEQ ID NO: 4121800 - DNA, 17 bp, Homo sapiens
agaacttcatttttaat

SEQ ID NO: 4121801 - DNA, 21 bp, Homo sapiens
agaacttccctgattgacctg

SEQ ID NO: 4121802 - DNA, 17 bp, Homo sapiens
agaacttgaagcctgct

SEQ ID NO: 4121803 - DNA, 21 bp, Homo sapiens
agaagaaactttgcctcaaga

SEQ ID NO: 4121804 - DNA, 23 bp, Homo sapiens
agaagaaactttgcctcaagact

SEQ ID NO: 4121805 - DNA, 13 bp, Homo sapiens
agaagaatgaaaa

SEQ ID NO: 4121806 - DNA, 15 bp, Homo sapiens
agaagacaaaaagac

SEQ ID NO: 4121807 - DNA, 16 bp, Homo sapiens
agaagacaccagagca

SEQ ID NO: 4121808 - DNA, 18 bp, Homo sapiens
agaagacaccagagcaga

SEQ ID NO: 4121809 - DNA, 22 bp, Homo sapiens
agaagacatggagactcctgcc

SEQ ID NO: 4121810 - DNA, 13 bp, Homo sapiens
agaagagaagctg

SEQ ID NO: 4121811 - DNA, 16 bp, Homo sapiens
agaagagaagctgctg

SEQ ID NO: 4121812 - DNA, 13 bp, Homo sapiens
agaagagaagtga

SEQ ID NO: 4121813 - DNA, 12 bp, Homo sapiens
agaagagccctg

SEQ ID NO: 4121814 - DNA, 17 bp, Homo sapiens
agaagagccctggacac

SEQ ID NO: 4121815 - DNA, 17 bp, Homo sapiens
agaagagggcccagccc

SEQ ID NO: 4121816 - DNA, 19 bp, Homo sapiens
agaagagggcccagcccag

SEQ ID NO: 4121817 - DNA, 20 bp, Homo sapiens
agaagagggcccagcccaga

SEQ ID NO: 4121818 - DNA, 16 bp, Homo sapiens
agaagagggcctgtgg

SEQ ID NO: 4121819 - DNA, 24 bp, Homo sapiens
agaagagggcctgtgggagcctgc

SEQ ID NO: 4121820 - DNA, 14 bp, Homo sapiens
agaagataattgtt

SEQ ID NO: 4121821 - DNA, 22 bp, Homo sapiens
agaagataattgttgaaatttt

SEQ ID NO: 4121822 - DNA, 14 bp, Homo sapiens
agaagatcccctca

SEQ ID NO: 4121823 - DNA, 22 bp, Homo sapiens
agaagatgccagcttctctctc

SEQ ID NO: 4121824 - DNA, 23 bp, Homo sapiens
agaagatgttgaagaatacagtt

SEQ ID NO: 4121825 - DNA, 16 bp, Homo sapiens
agaagattagaaacta

SEQ ID NO: 4121826 - DNA, 19 bp, Homo sapiens
agaagatttgatgctggag

SEQ ID NO: 4121827 - DNA, 22 bp, Homo sapiens
agaagatttgatgctggagagg

SEQ ID NO: 4121828 - DNA, 18 bp, Homo sapiens
agaagattttgaaatttt

SEQ ID NO: 4121829 - DNA, 21 bp, Homo sapiens
agaagcacagaatatttttat

SEQ ID NO: 4121830 - DNA, 14 bp, Homo sapiens
agaagcacatgtgt

SEQ ID NO: 4121831 - DNA, 15 bp, Homo sapiens
agaagcatgaaaaag

SEQ ID NO: 4121832 - DNA, 15 bp, Homo sapiens
agaagcattccttct

SEQ ID NO: 4121833 - DNA, 19 bp, Homo sapiens
agaagcattccttctttga

SEQ ID NO: 4121834 - DNA, 22 bp, Homo sapiens
agaagcattccttctttgataa

SEQ ID NO: 4121835 - DNA, 19 bp, Homo sapiens
agaagccaagggaaagggg

SEQ ID NO: 4121836 - DNA, 18 bp, Homo sapiens
agaagccacccaaagcag

SEQ ID NO: 4121837 - DNA, 22 bp, Homo sapiens
agaagccaggaatttcccagga

SEQ ID NO: 4121838 - DNA, 14 bp, Homo sapiens
agaagcccccagct

SEQ ID NO: 4121839 - DNA, 23 bp, Homo sapiens
agaagcccccagctaagaacctg

SEQ ID NO: 4121840 - DNA, 24 bp, Homo sapiens
agaagcccccagctaagaacctgg

SEQ ID NO: 4121841 - DNA, 13 bp, Homo sapiens
agaagccctgatg

SEQ ID NO: 4121842 - DNA, 21 bp, Homo sapiens
agaagccgagagccttttgtg

SEQ ID NO: 4121843 - DNA, 14 bp, Homo sapiens
agaagccgggaaca

SEQ ID NO: 4121844 - DNA, 20 bp, Homo sapiens
agaagcctccaagcacagag

SEQ ID NO: 4121845 - DNA, 23 bp, Homo sapiens
agaagcctccaagcacagagcct

SEQ ID NO: 4121846 - DNA, 14 bp, Homo sapiens
agaagcctctggct

SEQ ID NO: 4121847 - DNA, 17 bp, Homo sapiens
agaagcctgatgctgac

SEQ ID NO: 4121848 - DNA, 20 bp, Homo sapiens
agaagcctggactctgcccc

SEQ ID NO: 4121849 - DNA, 22 bp, Homo sapiens
agaagccttggaaccagcccca

SEQ ID NO: 4121850 - DNA, 24 bp, Homo sapiens
agaagccttggaaccagccccatc

SEQ ID NO: 4121851 - DNA, 16 bp, Homo sapiens
agaagcggatttccag

SEQ ID NO: 4121852 - DNA, 17 bp, Homo sapiens
agaagctcctctcccca

SEQ ID NO: 4121853 - DNA, 23 bp, Homo sapiens
agaagctcctctccccagcccag

SEQ ID NO: 4121854 - DNA, 20 bp, Homo sapiens
agaagctcttactctttcct

SEQ ID NO: 4121855 - DNA, 21 bp, Homo sapiens
agaagctgaagtgcatccaaa

SEQ ID NO: 4121856 - DNA, 23 bp, Homo sapiens
agaagctgccaggtgagaaactg

SEQ ID NO: 4121857 - DNA, 13 bp, Homo sapiens
agaagctgctcca

SEQ ID NO: 4121858 - DNA, 19 bp, Homo sapiens
agaagctgctccaggcctg

SEQ ID NO: 4121859 - DNA, 22 bp, Homo sapiens
agaagctgctccaggcctgcag

SEQ ID NO: 4121860 - DNA, 16 bp, Homo sapiens
agaagctgctgaccaa

SEQ ID NO: 4121861 - DNA, 15 bp, Homo sapiens
agaagctggacttct

SEQ ID NO: 4121862 - DNA, 19 bp, Homo sapiens
agaagctgttgtacattta

SEQ ID NO: 4121863 - DNA, 23 bp, Homo sapiens
agaagctttagcttcattttact

SEQ ID NO: 4121864 - DNA, 22 bp, Homo sapiens
agaaggcaagtttctagctaga

SEQ ID NO: 4121865 - DNA, 14 bp, Homo sapiens
agaaggcaatatta

SEQ ID NO: 4121866 - DNA, 13 bp, Homo sapiens
agaaggcagccac

SEQ ID NO: 4121867 - DNA, 18 bp, Homo sapiens
agaaggcgcttcccaact

SEQ ID NO: 4121868 - DNA, 16 bp, Homo sapiens
agaagggaatcctcct

SEQ ID NO: 4121869 - DNA, 15 bp, Homo sapiens
agaagggagaagaaa

SEQ ID NO: 4121870 - DNA, 22 bp, Homo sapiens
agaagggcttacaggcatggac

SEQ ID NO: 4121871 - DNA, 19 bp, Homo sapiens
agaaggggacttctcttcc

SEQ ID NO: 4121872 - DNA, 14 bp, Homo sapiens
agaagggtggatga

SEQ ID NO: 4121873 - DNA, 20 bp, Homo sapiens
agaaggtaaggtgtgaacct

SEQ ID NO: 4121874 - DNA, 21 bp, Homo sapiens
agaaggtattccttttgtgta

SEQ ID NO: 4121875 - DNA, 18 bp, Homo sapiens
agaaggtggaccttttaa

SEQ ID NO: 4121876 - DNA, 17 bp, Homo sapiens
agaaggttgacacagtt

SEQ ID NO: 4121877 - DNA, 20 bp, Homo sapiens
agaagtcatgaagcccaagt

SEQ ID NO: 4121878 - DNA, 16 bp, Homo sapiens
agaagtgcatttctga

SEQ ID NO: 4121879 - DNA, 13 bp, Homo sapiens
agaagtgccttct

SEQ ID NO: 4121880 - DNA, 22 bp, Homo sapiens
agaagtgccttctccttcccca

SEQ ID NO: 4121881 - DNA, 14 bp, Homo sapiens
agaagtggctgcca

SEQ ID NO: 4121882 - DNA, 22 bp, Homo sapiens
agaagtgtggggattttcactg

SEQ ID NO: 4121883 - DNA, 23 bp, Homo sapiens
agaagttattttctacagtggtt

SEQ ID NO: 4121884 - DNA, 23 bp, Homo sapiens
agaagtttctggccctggctgac

SEQ ID NO: 4121885 - DNA, 15 bp, Homo sapiens
agaataaaagctgtg

SEQ ID NO: 4121886 - DNA, 21 bp, Homo sapiens
agaataaagttctgagtgttt

SEQ ID NO: 4121887 - DNA, 20 bp, Homo sapiens
agaataaattaatattgtat

SEQ ID NO: 4121888 - DNA, 13 bp, Homo sapiens
agaataatctttg

SEQ ID NO: 4121889 - DNA, 17 bp, Homo sapiens
agaataatggaaacatt

SEQ ID NO: 4121890 - DNA, 23 bp, Homo sapiens
agaataatggaaacattacagtt

SEQ ID NO: 4121891 - DNA, 16 bp, Homo sapiens
agaataatgttctatt

SEQ ID NO: 4121892 - DNA, 19 bp, Homo sapiens
agaataatgttctattgtg

SEQ ID NO: 4121893 - DNA, 12 bp, Homo sapiens
agaatacagaaa

SEQ ID NO: 4121894 - DNA, 22 bp, Homo sapiens
agaatagaaataaaggatgtga

SEQ ID NO: 4121895 - DNA, 21 bp, Homo sapiens
agaatagccacatttggaata

SEQ ID NO: 4121896 - DNA, 17 bp, Homo sapiens
agaatataattatcgga

SEQ ID NO: 4121897 - DNA, 23 bp, Homo sapiens
agaatataattatcggaagcagt

SEQ ID NO: 4121898 - DNA, 13 bp, Homo sapiens
agaatatatacat

SEQ ID NO: 4121899 - DNA, 12 bp, Homo sapiens
agaatatattta

SEQ ID NO: 4121900 - DNA, 20 bp, Homo sapiens
agaatatatttatttaaagc

SEQ ID NO: 4121901 - DNA, 13 bp, Homo sapiens
agaatatgataaa

SEQ ID NO: 4121902 - DNA, 15 bp, Homo sapiens
agaatatgtttcctt

SEQ ID NO: 4121903 - DNA, 18 bp, Homo sapiens
agaatatgtttccttgtt

SEQ ID NO: 4121904 - DNA, 15 bp, Homo sapiens
agaatattcaggact

SEQ ID NO: 4121905 - DNA, 16 bp, Homo sapiens
agaatatttaagaaaa

SEQ ID NO: 4121906 - DNA, 22 bp, Homo sapiens
agaatatttaagaaaagcactt

SEQ ID NO: 4121907 - DNA, 17 bp, Homo sapiens
agaatatttctattgaa

SEQ ID NO: 4121908 - DNA, 19 bp, Homo sapiens
agaatatttctattgaatt

SEQ ID NO: 4121909 - DNA, 22 bp, Homo sapiens
agaatatttttatatttccttt

SEQ ID NO: 4121910 - DNA, 14 bp, Homo sapiens
agaatcaaaactct

SEQ ID NO: 4121911 - DNA, 18 bp, Homo sapiens
agaatcactaggtaactt

SEQ ID NO: 4121912 - DNA, 20 bp, Homo sapiens
agaatcagaatcatggagaa

SEQ ID NO: 4121913 - DNA, 17 bp, Homo sapiens
agaatcagagtagaaat

SEQ ID NO: 4121914 - DNA, 15 bp, Homo sapiens
agaatcatttagcat

SEQ ID NO: 4121915 - DNA, 15 bp, Homo sapiens
agaatccagtattat

SEQ ID NO: 4121916 - DNA, 15 bp, Homo sapiens
agaatcccttaaaat

SEQ ID NO: 4121917 - DNA, 12 bp, Homo sapiens
agaatcctctcc

SEQ ID NO: 4121918 - DNA, 21 bp, Homo sapiens
agaatcctctcctttcttatt

SEQ ID NO: 4121919 - DNA, 17 bp, Homo sapiens
agaatcttgactttctg

SEQ ID NO: 4121920 - DNA, 18 bp, Homo sapiens
agaatcttgactttctga

SEQ ID NO: 4121921 - DNA, 17 bp, Homo sapiens
agaatgaaatgtatgtg

SEQ ID NO: 4121922 - DNA, 16 bp, Homo sapiens
agaatgagcacccatt

SEQ ID NO: 4121923 - DNA, 19 bp, Homo sapiens
agaatgatcaaggatctgg

SEQ ID NO: 4121924 - DNA, 18 bp, Homo sapiens
agaatgattaatcaaagg

SEQ ID NO: 4121925 - DNA, 14 bp, Homo sapiens
agaatgccatttct

SEQ ID NO: 4121926 - DNA, 20 bp, Homo sapiens
agaatgctgaactccttgtt

SEQ ID NO: 4121927 - DNA, 18 bp, Homo sapiens
agaatgctggttttccta

SEQ ID NO: 4121928 - DNA, 15 bp, Homo sapiens
agaatgctgtacatc

SEQ ID NO: 4121929 - DNA, 20 bp, Homo sapiens
agaatgctgtacatctattt

SEQ ID NO: 4121930 - DNA, 20 bp, Homo sapiens
agaatggtgtgaacccggga

SEQ ID NO: 4121931 - DNA, 19 bp, Homo sapiens
agaatgtaagaaaacaaaa

SEQ ID NO: 4121932 - DNA, 16 bp, Homo sapiens
agaatgtcagatttct

SEQ ID NO: 4121933 - DNA, 18 bp, Homo sapiens
agaatgtcagatttctgg

SEQ ID NO: 4121934 - DNA, 21 bp, Homo sapiens
agaatgtggatttgattcatt

SEQ ID NO: 4121935 - DNA, 21 bp, Homo sapiens
agaatgtggccacttatttca

SEQ ID NO: 4121936 - DNA, 17 bp, Homo sapiens
agaatgtgttttctgaa

SEQ ID NO: 4121937 - DNA, 20 bp, Homo sapiens
agaatgttgaaaagtaattg

SEQ ID NO: 4121938 - DNA, 22 bp, Homo sapiens
agaattaaacttttaattcatt

SEQ ID NO: 4121939 - DNA, 17 bp, Homo sapiens
agaattaacagagattg

SEQ ID NO: 4121940 - DNA, 18 bp, Homo sapiens
agaattaccaagagaagg

SEQ ID NO: 4121941 - DNA, 21 bp, Homo sapiens
agaattagtgccagaatttta

SEQ ID NO: 4121942 - DNA, 18 bp, Homo sapiens
agaattatttgccttctg

SEQ ID NO: 4121943 - DNA, 16 bp, Homo sapiens
agaattatttttgtgt

SEQ ID NO: 4121944 - DNA, 17 bp, Homo sapiens
agaattatttttgtgtt

SEQ ID NO: 4121945 - DNA, 21 bp, Homo sapiens
agaattatttttgtgtttcta

SEQ ID NO: 4121946 - DNA, 13 bp, Homo sapiens
agaattccaagga

SEQ ID NO: 4121947 - DNA, 20 bp, Homo sapiens
agaattctcagaatctcaaa

SEQ ID NO: 4121948 - DNA, 18 bp, Homo sapiens
agaattgagtaatggtgt

SEQ ID NO: 4121949 - DNA, 20 bp, Homo sapiens
agaattgatatacacggatg

SEQ ID NO: 4121950 - DNA, 21 bp, Homo sapiens
agaattgatcattttcccccc

SEQ ID NO: 4121951 - DNA, 15 bp, Homo sapiens
agaattgccaatctt

SEQ ID NO: 4121952 - DNA, 21 bp, Homo sapiens
agaattgccaatcttgtttta

SEQ ID NO: 4121953 - DNA, 18 bp, Homo sapiens
agaattggggattctcta

SEQ ID NO: 4121954 - DNA, 15 bp, Homo sapiens
agaattgtatcattt

SEQ ID NO: 4121955 - DNA, 20 bp, Homo sapiens
agaatttaagtagaaaagtt

SEQ ID NO: 4121956 - DNA, 14 bp, Homo sapiens
agaatttagtgtat

SEQ ID NO: 4121957 - DNA, 21 bp, Homo sapiens
agaatttattcaattcctctg

SEQ ID NO: 4121958 - DNA, 22 bp, Homo sapiens
agaatttctaaaaagattagca

SEQ ID NO: 4121959 - DNA, 23 bp, Homo sapiens
agaatttctaaaaagattagcaa

SEQ ID NO: 4121960 - DNA, 13 bp, Homo sapiens
agaatttcttggt

SEQ ID NO: 4121961 - DNA, 15 bp, Homo sapiens
agaattttaaattat

SEQ ID NO: 4121962 - DNA, 18 bp, Homo sapiens
agaattttaaattataac

SEQ ID NO: 4121963 - DNA, 21 bp, Homo sapiens
agaattttaagtgctttgtaa

SEQ ID NO: 4121964 - DNA, 22 bp, Homo sapiens
agaattttaagtgctttgtaat

SEQ ID NO: 4121965 - DNA, 16 bp, Homo sapiens
agaattttaatgtgaa

SEQ ID NO: 4121966 - DNA, 17 bp, Homo sapiens
agaattttaatgtgaag

SEQ ID NO: 4121967 - DNA, 23 bp, Homo sapiens
agaattttaatgtgaagacattt

SEQ ID NO: 4121968 - DNA, 17 bp, Homo sapiens
agaattttacttccatt

SEQ ID NO: 4121969 - DNA, 15 bp, Homo sapiens
agaatttttttgtct

SEQ ID NO: 4121970 - DNA, 16 bp, Homo sapiens
agaatttttttgtctt

SEQ ID NO: 4121971 - DNA, 20 bp, Homo sapiens
agacaaaaaaatttaaaatt

SEQ ID NO: 4121972 - DNA, 15 bp, Homo sapiens
agacaaaaagacaaa

SEQ ID NO: 4121973 - DNA, 13 bp, Homo sapiens
agacaacagaagt

SEQ ID NO: 4121974 - DNA, 13 bp, Homo sapiens
agacaagaaatcc

SEQ ID NO: 4121975 - DNA, 18 bp, Homo sapiens
agacaagaaatccctgtt

SEQ ID NO: 4121976 - DNA, 16 bp, Homo sapiens
agacaagatattgtac

SEQ ID NO: 4121977 - DNA, 14 bp, Homo sapiens
agacaagcaacagg

SEQ ID NO: 4121978 - DNA, 19 bp, Homo sapiens
agacaagttggaaaaacaa

SEQ ID NO: 4121979 - DNA, 20 bp, Homo sapiens
agacaagttggaaaaacaac

SEQ ID NO: 4121980 - DNA, 13 bp, Homo sapiens
agacaatatacaa

SEQ ID NO: 4121981 - DNA, 13 bp, Homo sapiens
agacaatcttctg

SEQ ID NO: 4121982 - DNA, 14 bp, Homo sapiens
agacaatgttttct

SEQ ID NO: 4121983 - DNA, 16 bp, Homo sapiens
agacaatttgatacat

SEQ ID NO: 4121984 - DNA, 20 bp, Homo sapiens
agacacaactatttttccaa

SEQ ID NO: 4121985 - DNA, 23 bp, Homo sapiens
agacacacacacgcacgcacaca

SEQ ID NO: 4121986 - DNA, 15 bp, Homo sapiens
agacacagataataa

SEQ ID NO: 4121987 - DNA, 13 bp, Homo sapiens
agacaccagagca

SEQ ID NO: 4121988 - DNA, 14 bp, Homo sapiens
agacacccaggact

SEQ ID NO: 4121989 - DNA, 21 bp, Homo sapiens
agacaccctcaacctcttctg

SEQ ID NO: 4121990 - DNA, 17 bp, Homo sapiens
agacaccgttcattcag

SEQ ID NO: 4121991 - DNA, 21 bp, Homo sapiens
agacacctgttcacagaaaaa

SEQ ID NO: 4121992 - DNA, 23 bp, Homo sapiens
agacacgctcgcgggcagcgggc

SEQ ID NO: 4121993 - DNA, 21 bp, Homo sapiens
agacacggagcccagccctcc

SEQ ID NO: 4121994 - DNA, 22 bp, Homo sapiens
agacactaacgacttcagggca

SEQ ID NO: 4121995 - DNA, 16 bp, Homo sapiens
agacactcaaatatga

SEQ ID NO: 4121996 - DNA, 22 bp, Homo sapiens
agacactccccgaagtcttttg

SEQ ID NO: 4121997 - DNA, 23 bp, Homo sapiens
agacactccccgaagtcttttgt

SEQ ID NO: 4121998 - DNA, 19 bp, Homo sapiens
agacactgaccatccactc

SEQ ID NO: 4121999 - DNA, 18 bp, Homo sapiens
agacactggcagagagat

SEQ ID NO: 4122000 - DNA, 13 bp, Homo sapiens
agacacttccgtc

SEQ ID NO: 4122001 - DNA, 15 bp, Homo sapiens
agacagaaaagtgcc

SEQ ID NO: 4122002 - DNA, 14 bp, Homo sapiens
agacagaaactgga

SEQ ID NO: 4122003 - DNA, 15 bp, Homo sapiens
agacagaaactggat

SEQ ID NO: 4122004 - DNA, 17 bp, Homo sapiens
agacagaacttgaatgt

SEQ ID NO: 4122005 - DNA, 17 bp, Homo sapiens
agacagaccacttgcca

SEQ ID NO: 4122006 - DNA, 16 bp, Homo sapiens
agacagagacgcagga

SEQ ID NO: 4122007 - DNA, 23 bp, Homo sapiens
agacagagtccctggctcctcta

SEQ ID NO: 4122008 - DNA, 16 bp, Homo sapiens
agacagatcccatcca

SEQ ID NO: 4122009 - DNA, 19 bp, Homo sapiens
agacagatgccccagagct

SEQ ID NO: 4122010 - DNA, 18 bp, Homo sapiens
agacagcaggcagcgcca

SEQ ID NO: 4122011 - DNA, 17 bp, Homo sapiens
agacagctccaccctgg

SEQ ID NO: 4122012 - DNA, 19 bp, Homo sapiens
agacagctgatacttcatt

SEQ ID NO: 4122013 - DNA, 19 bp, Homo sapiens
agacaggagggcaagggcc

SEQ ID NO: 4122014 - DNA, 20 bp, Homo sapiens
agacaggccatgtgagccac

SEQ ID NO: 4122015 - DNA, 19 bp, Homo sapiens
agacagggtaggaaagggc

SEQ ID NO: 4122016 - DNA, 19 bp, Homo sapiens
agacagggtctgaaggact

SEQ ID NO: 4122017 - DNA, 23 bp, Homo sapiens
agacagggtcttgctctgtcccc

SEQ ID NO: 4122018 - DNA, 21 bp, Homo sapiens
agacagggtgggcttcctgcc

SEQ ID NO: 4122019 - DNA, 18 bp, Homo sapiens
agacagtttcttagcttt

SEQ ID NO: 4122020 - DNA, 22 bp, Homo sapiens
agacagtttcttagctttttaa

SEQ ID NO: 4122021 - DNA, 22 bp, Homo sapiens
agacatactgcttgattttaat

SEQ ID NO: 4122022 - DNA, 16 bp, Homo sapiens
agacatacttgaaggg

SEQ ID NO: 4122023 - DNA, 19 bp, Homo sapiens
agacatacttgaagggcca

SEQ ID NO: 4122024 - DNA, 20 bp, Homo sapiens
agacatccaaactaaaagga

SEQ ID NO: 4122025 - DNA, 16 bp, Homo sapiens
agacatctctgcaccc

SEQ ID NO: 4122026 - DNA, 22 bp, Homo sapiens
agacatgatttccttgaatgtg

SEQ ID NO: 4122027 - DNA, 17 bp, Homo sapiens
agacatgtgacatttat

SEQ ID NO: 4122028 - DNA, 20 bp, Homo sapiens
agacatgtgaggaggaaaag

SEQ ID NO: 4122029 - DNA, 22 bp, Homo sapiens
agacattgtttggatttccttt

SEQ ID NO: 4122030 - DNA, 21 bp, Homo sapiens
agacatttgtttgctgtacag

SEQ ID NO: 4122031 - DNA, 15 bp, Homo sapiens
agacattttttgcta

SEQ ID NO: 4122032 - DNA, 23 bp, Homo sapiens
agacattttttgctataatcatt

SEQ ID NO: 4122033 - DNA, 15 bp, Homo sapiens
agaccaaagcaaaga

SEQ ID NO: 4122034 - DNA, 14 bp, Homo sapiens
agaccaaggcggga

SEQ ID NO: 4122035 - DNA, 15 bp, Homo sapiens
agaccacctgcttct

SEQ ID NO: 4122036 - DNA, 16 bp, Homo sapiens
agaccactgagtacca

SEQ ID NO: 4122037 - DNA, 16 bp, Homo sapiens
agaccacttgccacgc

SEQ ID NO: 4122038 - DNA, 16 bp, Homo sapiens
agaccagagcagtttc

SEQ ID NO: 4122039 - DNA, 15 bp, Homo sapiens
agaccagagctgtct

SEQ ID NO: 4122040 - DNA, 11 bp, Homo sapiens
agaccagctca

SEQ ID NO: 4122041 - DNA, 18 bp, Homo sapiens
agaccagttgggagcact

SEQ ID NO: 4122042 - DNA, 19 bp, Homo sapiens
agaccagttgggagcactg

SEQ ID NO: 4122043 - DNA, 15 bp, Homo sapiens
agacccaaaccccca

SEQ ID NO: 4122044 - DNA, 13 bp, Homo sapiens
agacccagcagga

SEQ ID NO: 4122045 - DNA, 14 bp, Homo sapiens
agacccaggcctgt

SEQ ID NO: 4122046 - DNA, 13 bp, Homo sapiens
agaccccaggctg

SEQ ID NO: 4122047 - DNA, 17 bp, Homo sapiens
agaccccagttctaggg

SEQ ID NO: 4122048 - DNA, 14 bp, Homo sapiens
agacccccagcact

SEQ ID NO: 4122049 - DNA, 20 bp, Homo sapiens
agacccccatttgtcccaga

SEQ ID NO: 4122050 - DNA, 20 bp, Homo sapiens
agacccccccatttcccgca

SEQ ID NO: 4122051 - DNA, 18 bp, Homo sapiens
agacccccccccaactcc

SEQ ID NO: 4122052 - DNA, 23 bp, Homo sapiens
agaccccgaggtaggggtgggga

SEQ ID NO: 4122053 - DNA, 14 bp, Homo sapiens
agacccctctggcc

SEQ ID NO: 4122054 - DNA, 21 bp, Homo sapiens
agacccctctggccaggatgg

SEQ ID NO: 4122055 - DNA, 14 bp, Homo sapiens
agacccctggcttt

SEQ ID NO: 4122056 - DNA, 19 bp, Homo sapiens
agaccctcgcccaactcca

SEQ ID NO: 4122057 - DNA, 20 bp, Homo sapiens
agaccctgaggccctgggct

SEQ ID NO: 4122058 - DNA, 22 bp, Homo sapiens
agaccctgcaaacagaacaggg

SEQ ID NO: 4122059 - DNA, 22 bp, Homo sapiens
agaccctgccacagccagagga

SEQ ID NO: 4122060 - DNA, 24 bp, Homo sapiens
agaccctgccacagccagaggagg

SEQ ID NO: 4122061 - DNA, 13 bp, Homo sapiens
agaccctggagga

SEQ ID NO: 4122062 - DNA, 20 bp, Homo sapiens
agaccctgggtgggctctgt

SEQ ID NO: 4122063 - DNA, 21 bp, Homo sapiens
agacccttcttgcctgctggg

SEQ ID NO: 4122064 - DNA, 18 bp, Homo sapiens
agacccttgacacctgct

SEQ ID NO: 4122065 - DNA, 15 bp, Homo sapiens
agacccttttctcag

SEQ ID NO: 4122066 - DNA, 14 bp, Homo sapiens
agacctaaagtgct

SEQ ID NO: 4122067 - DNA, 17 bp, Homo sapiens
agacctaaccagggcca

SEQ ID NO: 4122068 - DNA, 18 bp, Homo sapiens
agacctacattccctctc

SEQ ID NO: 4122069 - DNA, 15 bp, Homo sapiens
agacctagggaggac

SEQ ID NO: 4122070 - DNA, 19 bp, Homo sapiens
agacctagggaggacctta

SEQ ID NO: 4122071 - DNA, 16 bp, Homo sapiens
agacctcatcaggatg

SEQ ID NO: 4122072 - DNA, 18 bp, Homo sapiens
agacctgatcctggaggc

SEQ ID NO: 4122073 - DNA, 21 bp, Homo sapiens
agacctgatcctggaggccca

SEQ ID NO: 4122074 - DNA, 22 bp, Homo sapiens
agacctgatcctggaggcccag

SEQ ID NO: 4122075 - DNA, 14 bp, Homo sapiens
agacctggcagctc

SEQ ID NO: 4122076 - DNA, 23 bp, Homo sapiens
agacctggcagctctggacagcc

SEQ ID NO: 4122077 - DNA, 14 bp, Homo sapiens
agacctgtcttcca

SEQ ID NO: 4122078 - DNA, 19 bp, Homo sapiens
agacctgtgctagttttac

SEQ ID NO: 4122079 - DNA, 16 bp, Homo sapiens
agaccttctccaaatg

SEQ ID NO: 4122080 - DNA, 18 bp, Homo sapiens
agaccttctccaaatgag

SEQ ID NO: 4122081 - DNA, 13 bp, Homo sapiens
agacgacaggcga

SEQ ID NO: 4122082 - DNA, 19 bp, Homo sapiens
agacgatgtttatgttctt

SEQ ID NO: 4122083 - DNA, 18 bp, Homo sapiens
agacgccactccctggga

SEQ ID NO: 4122084 - DNA, 23 bp, Homo sapiens
agacgccactccctgggacacag

SEQ ID NO: 4122085 - DNA, 12 bp, Homo sapiens
agacgcccagcc

SEQ ID NO: 4122086 - DNA, 14 bp, Homo sapiens
agacgcccagcccc

SEQ ID NO: 4122087 - DNA, 19 bp, Homo sapiens
agacgcccagccccatccc

SEQ ID NO: 4122088 - DNA, 21 bp, Homo sapiens
agacgcccagccccatccctg

SEQ ID NO: 4122089 - DNA, 22 bp, Homo sapiens
agacgcccagccccatccctgt

SEQ ID NO: 4122090 - DNA, 22 bp, Homo sapiens
agacgccggggacagaggcctg

SEQ ID NO: 4122091 - DNA, 13 bp, Homo sapiens
agacgggcacaga

SEQ ID NO: 4122092 - DNA, 17 bp, Homo sapiens
agacgggcacagacacg

SEQ ID NO: 4122093 - DNA, 15 bp, Homo sapiens
agacggtgttgggag

SEQ ID NO: 4122094 - DNA, 20 bp, Homo sapiens
agacgtggaacctctgtctc

SEQ ID NO: 4122095 - DNA, 15 bp, Homo sapiens
agactaaaggatcca

SEQ ID NO: 4122096 - DNA, 20 bp, Homo sapiens
agactaaaggatccagagag

SEQ ID NO: 4122097 - DNA, 14 bp, Homo sapiens
agactaagccctgt

SEQ ID NO: 4122098 - DNA, 23 bp, Homo sapiens
agactaagccctgtcgagacact

SEQ ID NO: 4122099 - DNA, 15 bp, Homo sapiens
agactacacaggatg

SEQ ID NO: 4122100 - DNA, 16 bp, Homo sapiens
agactactattttctt

SEQ ID NO: 4122101 - DNA, 19 bp, Homo sapiens
agactactattttcttttt

SEQ ID NO: 4122102 - DNA, 16 bp, Homo sapiens
agactagattgccttt

SEQ ID NO: 4122103 - DNA, 18 bp, Homo sapiens
agactatctaaatgttga

SEQ ID NO: 4122104 - DNA, 20 bp, Homo sapiens
agactattccttttctgtat

SEQ ID NO: 4122105 - DNA, 19 bp, Homo sapiens
agactatttaaacttataa

SEQ ID NO: 4122106 - DNA, 23 bp, Homo sapiens
agactcaagtacccattctgttt

SEQ ID NO: 4122107 - DNA, 14 bp, Homo sapiens
agactcacaggaag

SEQ ID NO: 4122108 - DNA, 22 bp, Homo sapiens
agactccagaaatgtccctttc

SEQ ID NO: 4122109 - DNA, 13 bp, Homo sapiens
agactccatctct

SEQ ID NO: 4122110 - DNA, 18 bp, Homo sapiens
agactccatctcttctgc

SEQ ID NO: 4122111 - DNA, 17 bp, Homo sapiens
agactcccattcctgaa

SEQ ID NO: 4122112 - DNA, 19 bp, Homo sapiens
agactcccattcctgaaga

SEQ ID NO: 4122113 - DNA, 23 bp, Homo sapiens
agactcccattcctgaagaacca

SEQ ID NO: 4122114 - DNA, 14 bp, Homo sapiens
agactcctcctcca

SEQ ID NO: 4122115 - DNA, 15 bp, Homo sapiens
agactcctgccctgt

SEQ ID NO: 4122116 - DNA, 19 bp, Homo sapiens
agactctacccatattaca

SEQ ID NO: 4122117 - DNA, 18 bp, Homo sapiens
agactctagacaagatat

SEQ ID NO: 4122118 - DNA, 15 bp, Homo sapiens
agactctagggtcca

SEQ ID NO: 4122119 - DNA, 15 bp, Homo sapiens
agactctattctcaa

SEQ ID NO: 4122120 - DNA, 16 bp, Homo sapiens
agactctgaaatctca

SEQ ID NO: 4122121 - DNA, 17 bp, Homo sapiens
agactctgagatgtgga

SEQ ID NO: 4122122 - DNA, 17 bp, Homo sapiens
agactctgagctgctca

SEQ ID NO: 4122123 - DNA, 18 bp, Homo sapiens
agactcttttccttccct

SEQ ID NO: 4122124 - DNA, 17 bp, Homo sapiens
agactgagcacctgctt

SEQ ID NO: 4122125 - DNA, 18 bp, Homo sapiens
agactgagtcagatgggt

SEQ ID NO: 4122126 - DNA, 21 bp, Homo sapiens
agactgataacttggggaggc

SEQ ID NO: 4122127 - DNA, 15 bp, Homo sapiens
agactgatggccagg

SEQ ID NO: 4122128 - DNA, 20 bp, Homo sapiens
agactgatggccaggcaagt

SEQ ID NO: 4122129 - DNA, 15 bp, Homo sapiens
agactgcaaactttt

SEQ ID NO: 4122130 - DNA, 22 bp, Homo sapiens
agactgccccacggagacagag

SEQ ID NO: 4122131 - DNA, 19 bp, Homo sapiens
agactggaagctaatttgc

SEQ ID NO: 4122132 - DNA, 21 bp, Homo sapiens
agactgggaaggcttgggatt

SEQ ID NO: 4122133 - DNA, 18 bp, Homo sapiens
agactgggagccacttct

SEQ ID NO: 4122134 - DNA, 18 bp, Homo sapiens
agactgggtaggaaagag

SEQ ID NO: 4122135 - DNA, 22 bp, Homo sapiens
agactgggtaggaaagaggaag

SEQ ID NO: 4122136 - DNA, 15 bp, Homo sapiens
agactggttttctgc

SEQ ID NO: 4122137 - DNA, 18 bp, Homo sapiens
agactggttttctgccaa

SEQ ID NO: 4122138 - DNA, 16 bp, Homo sapiens
agactgtacaaagtag

SEQ ID NO: 4122139 - DNA, 21 bp, Homo sapiens
agactgtcagcttccaaacat

SEQ ID NO: 4122140 - DNA, 20 bp, Homo sapiens
agactgtcggagaggctgtc

SEQ ID NO: 4122141 - DNA, 21 bp, Homo sapiens
agactgtcggagaggctgtct

SEQ ID NO: 4122142 - DNA, 15 bp, Homo sapiens
agactgtgaacttga

SEQ ID NO: 4122143 - DNA, 18 bp, Homo sapiens
agactgtgacaactgtct

SEQ ID NO: 4122144 - DNA, 19 bp, Homo sapiens
agactgtgccagaggccag

SEQ ID NO: 4122145 - DNA, 23 bp, Homo sapiens
agactgttgctcaaatctattca

SEQ ID NO: 4122146 - DNA, 20 bp, Homo sapiens
agactgttgtgatcttgcat

SEQ ID NO: 4122147 - DNA, 19 bp, Homo sapiens
agactgtttttaagtaact

SEQ ID NO: 4122148 - DNA, 15 bp, Homo sapiens
agacttaccaggaag

SEQ ID NO: 4122149 - DNA, 22 bp, Homo sapiens
agacttagtatattttcttttc

SEQ ID NO: 4122150 - DNA, 22 bp, Homo sapiens
agacttcagggagtcagctgtt

SEQ ID NO: 4122151 - DNA, 19 bp, Homo sapiens
agacttccaaacctgacag

SEQ ID NO: 4122152 - DNA, 18 bp, Homo sapiens
agacttcccaacagcctt

SEQ ID NO: 4122153 - DNA, 14 bp, Homo sapiens
agacttcccagcta

SEQ ID NO: 4122154 - DNA, 15 bp, Homo sapiens
agacttgagacaatg

SEQ ID NO: 4122155 - DNA, 21 bp, Homo sapiens
agacttggttggtagggtggg

SEQ ID NO: 4122156 - DNA, 18 bp, Homo sapiens
agactttctctgtgtatg

SEQ ID NO: 4122157 - DNA, 19 bp, Homo sapiens
agactttgtttttaaaatg

SEQ ID NO: 4122158 - DNA, 17 bp, Homo sapiens
agacttttggtagagaa

SEQ ID NO: 4122159 - DNA, 20 bp, Homo sapiens
agagaaaatgcggttataaa

SEQ ID NO: 4122160 - DNA, 15 bp, Homo sapiens
agagaaaattgcact

SEQ ID NO: 4122161 - DNA, 22 bp, Homo sapiens
agagaaaattgcactaaatgaa

SEQ ID NO: 4122162 - DNA, 16 bp, Homo sapiens
agagaaagaaaatgaa

SEQ ID NO: 4122163 - DNA, 16 bp, Homo sapiens
agagaaagaagagaca

SEQ ID NO: 4122164 - DNA, 17 bp, Homo sapiens
agagaaagaagagacag

SEQ ID NO: 4122165 - DNA, 18 bp, Homo sapiens
agagaaaggggagcccac

SEQ ID NO: 4122166 - DNA, 21 bp, Homo sapiens
agagaaaggggagcccactgt

SEQ ID NO: 4122167 - DNA, 12 bp, Homo sapiens
agagaaatcctt

SEQ ID NO: 4122168 - DNA, 18 bp, Homo sapiens
agagaaattctgttaaaa

SEQ ID NO: 4122169 - DNA, 20 bp, Homo sapiens
agagaaccgagcaaagatca

SEQ ID NO: 4122170 - DNA, 12 bp, Homo sapiens
agagaagaggct

SEQ ID NO: 4122171 - DNA, 17 bp, Homo sapiens
agagaagagggcccagc

SEQ ID NO: 4122172 - DNA, 21 bp, Homo sapiens
agagaagataattgttgaaat

SEQ ID NO: 4122173 - DNA, 21 bp, Homo sapiens
agagaagatggatatgaccag

SEQ ID NO: 4122174 - DNA, 15 bp, Homo sapiens
agagaagccacgctg

SEQ ID NO: 4122175 - DNA, 18 bp, Homo sapiens
agagaagcggatttccag

SEQ ID NO: 4122176 - DNA, 13 bp, Homo sapiens
agagaagctgctg

SEQ ID NO: 4122177 - DNA, 12 bp, Homo sapiens
agagaagctgga

SEQ ID NO: 4122178 - DNA, 23 bp, Homo sapiens
agagaagctggacttctgtgggc

SEQ ID NO: 4122179 - DNA, 16 bp, Homo sapiens
agagaaggaaaagact

SEQ ID NO: 4122180 - DNA, 18 bp, Homo sapiens
agagaaggagcagaaaga

SEQ ID NO: 4122181 - DNA, 16 bp, Homo sapiens
agagaattatatattt

SEQ ID NO: 4122182 - DNA, 18 bp, Homo sapiens
agagacagacttgagaac

SEQ ID NO: 4122183 - DNA, 15 bp, Homo sapiens
agagacaggcagccc

SEQ ID NO: 4122184 - DNA, 20 bp, Homo sapiens
agagacaggcagcccagcag

SEQ ID NO: 4122185 - DNA, 23 bp, Homo sapiens
agagacatacttgaagggccaga

SEQ ID NO: 4122186 - DNA, 16 bp, Homo sapiens
agagacccaacagcag

SEQ ID NO: 4122187 - DNA, 20 bp, Homo sapiens
agagaccgtcgggggctgag

SEQ ID NO: 4122188 - DNA, 13 bp, Homo sapiens
agagacctcatca

SEQ ID NO: 4122189 - DNA, 14 bp, Homo sapiens
agagacgccactcc

SEQ ID NO: 4122190 - DNA, 21 bp, Homo sapiens
agagacgccactccctgggac

SEQ ID NO: 4122191 - DNA, 14 bp, Homo sapiens
agagacgcccagcc

SEQ ID NO: 4122192 - DNA, 20 bp, Homo sapiens
agagactgagcagccgccag

SEQ ID NO: 4122193 - DNA, 23 bp, Homo sapiens
agagactgggaagataggctctg

SEQ ID NO: 4122194 - DNA, 15 bp, Homo sapiens
agagactgtagattg

SEQ ID NO: 4122195 - DNA, 14 bp, Homo sapiens
agagagaaattctg

SEQ ID NO: 4122196 - DNA, 10 bp, Homo sapiens
agagagagag

SEQ ID NO: 4122197 - DNA, 12 bp, Homo sapiens
agagagagagag

SEQ ID NO: 4122198 - DNA, 15 bp, Homo sapiens
agagagagaggacag

SEQ ID NO: 4122199 - DNA, 13 bp, Homo sapiens
agagagaggaggc

SEQ ID NO: 4122200 - DNA, 18 bp, Homo sapiens
agagagataaaaggtgga

SEQ ID NO: 4122201 - DNA, 21 bp, Homo sapiens
agagagatcttcccataataa

SEQ ID NO: 4122202 - DNA, 19 bp, Homo sapiens
agagagatgggagctcctc

SEQ ID NO: 4122203 - DNA, 13 bp, Homo sapiens
agagagcaaggca

SEQ ID NO: 4122204 - DNA, 15 bp, Homo sapiens
agagaggcagcaagt

SEQ ID NO: 4122205 - DNA, 16 bp, Homo sapiens
agagagggatgggttc

SEQ ID NO: 4122206 - DNA, 19 bp, Homo sapiens
agagaggggaaagtgtgag

SEQ ID NO: 4122207 - DNA, 20 bp, Homo sapiens
agagaggtggagaactggga

SEQ ID NO: 4122208 - DNA, 14 bp, Homo sapiens
agagataataagat

SEQ ID NO: 4122209 - DNA, 15 bp, Homo sapiens
agagataattcttaa

SEQ ID NO: 4122210 - DNA, 17 bp, Homo sapiens
agagataattcttaaaa

SEQ ID NO: 4122211 - DNA, 13 bp, Homo sapiens
agagatacagagg

SEQ ID NO: 4122212 - DNA, 21 bp, Homo sapiens
agagataggaaactgaagcat

SEQ ID NO: 4122213 - DNA, 13 bp, Homo sapiens
agagatatatata

SEQ ID NO: 4122214 - DNA, 14 bp, Homo sapiens
agagatatatctga

SEQ ID NO: 4122215 - DNA, 19 bp, Homo sapiens
agagatatatctgaaaact

SEQ ID NO: 4122216 - DNA, 23 bp, Homo sapiens
agagatcttcccataataaagca

SEQ ID NO: 4122217 - DNA, 19 bp, Homo sapiens
agagatgggaatgaggtgg

SEQ ID NO: 4122218 - DNA, 14 bp, Homo sapiens
agagatgtgcaccc

SEQ ID NO: 4122219 - DNA, 17 bp, Homo sapiens
agagatttgtctaattg

SEQ ID NO: 4122220 - DNA, 16 bp, Homo sapiens
agagcaagagagcagc

SEQ ID NO: 4122221 - DNA, 20 bp, Homo sapiens
agagcaccctcgagaagggt

SEQ ID NO: 4122222 - DNA, 23 bp, Homo sapiens
agagcaccctcgagaagggtgga

SEQ ID NO: 4122223 - DNA, 21 bp, Homo sapiens
agagcaccttcctcacttcca

SEQ ID NO: 4122224 - DNA, 12 bp, Homo sapiens
agagcagaggtc

SEQ ID NO: 4122225 - DNA, 14 bp, Homo sapiens
agagcagagtctgg

SEQ ID NO: 4122226 - DNA, 12 bp, Homo sapiens
agagcagcagca

SEQ ID NO: 4122227 - DNA, 15 bp, Homo sapiens
agagcagcagcacca

SEQ ID NO: 4122228 - DNA, 16 bp, Homo sapiens
agagcagcctgtggca

SEQ ID NO: 4122229 - DNA, 17 bp, Homo sapiens
agagcagcctgtggcat

SEQ ID NO: 4122230 - DNA, 17 bp, Homo sapiens
agagcagctccccagga

SEQ ID NO: 4122231 - DNA, 18 bp, Homo sapiens
agagcagctccccaggag

SEQ ID NO: 4122232 - DNA, 19 bp, Homo sapiens
agagcagctccctttctca

SEQ ID NO: 4122233 - DNA, 21 bp, Homo sapiens
agagcagctccctttctcagg

SEQ ID NO: 4122234 - DNA, 23 bp, Homo sapiens
agagcaggaagcattcagagagc

SEQ ID NO: 4122235 - DNA, 14 bp, Homo sapiens
agagcaggaaggac

SEQ ID NO: 4122236 - DNA, 13 bp, Homo sapiens
agagcaggactcc

SEQ ID NO: 4122237 - DNA, 15 bp, Homo sapiens
agagcaggactccag

SEQ ID NO: 4122238 - DNA, 21 bp, Homo sapiens
agagcaggactccaggcccaa

SEQ ID NO: 4122239 - DNA, 22 bp, Homo sapiens
agagcagggattaacctctgca

SEQ ID NO: 4122240 - DNA, 17 bp, Homo sapiens
agagcagtcagagtcca

SEQ ID NO: 4122241 - DNA, 19 bp, Homo sapiens
agagcagttgagaggacac

SEQ ID NO: 4122242 - DNA, 12 bp, Homo sapiens
agagcatgaaat

SEQ ID NO: 4122243 - DNA, 19 bp, Homo sapiens
agagcattacgtgagccag

SEQ ID NO: 4122244 - DNA, 17 bp, Homo sapiens
agagcattccagtcagg

SEQ ID NO: 4122245 - DNA, 21 bp, Homo sapiens
agagccaacctcggcttgtgg

SEQ ID NO: 4122246 - DNA, 21 bp, Homo sapiens
agagccacaaaagaaaagact

SEQ ID NO: 4122247 - DNA, 20 bp, Homo sapiens
agagccagatgcaggacagg

SEQ ID NO: 4122248 - DNA, 13 bp, Homo sapiens
agagccagctccc

SEQ ID NO: 4122249 - DNA, 22 bp, Homo sapiens
agagccaggggggtgaggagct

SEQ ID NO: 4122250 - DNA, 23 bp, Homo sapiens
agagccagtggcgggtgatggcc

SEQ ID NO: 4122251 - DNA, 16 bp, Homo sapiens
agagccatgctgggaa

SEQ ID NO: 4122252 - DNA, 16 bp, Homo sapiens
agagccattttgtgaa

SEQ ID NO: 4122253 - DNA, 20 bp, Homo sapiens
agagcccagaggtaacagaa

SEQ ID NO: 4122254 - DNA, 15 bp, Homo sapiens
agagcccagctccaa

SEQ ID NO: 4122255 - DNA, 21 bp, Homo sapiens
agagcccatgctcaaccactg

SEQ ID NO: 4122256 - DNA, 16 bp, Homo sapiens
agagccccccacaatg

SEQ ID NO: 4122257 - DNA, 23 bp, Homo sapiens
agagcccctcctccagcccctgt

SEQ ID NO: 4122258 - DNA, 14 bp, Homo sapiens
agagccctgctccc

SEQ ID NO: 4122259 - DNA, 16 bp, Homo sapiens
agagccctgctccctc

SEQ ID NO: 4122260 - DNA, 18 bp, Homo sapiens
agagccctgctccctccg

SEQ ID NO: 4122261 - DNA, 23 bp, Homo sapiens
agagccctggacacccctgctct

SEQ ID NO: 4122262 - DNA, 21 bp, Homo sapiens
agagccgtggtccctgaggat

SEQ ID NO: 4122263 - DNA, 18 bp, Homo sapiens
agagcctcgtccctccct

SEQ ID NO: 4122264 - DNA, 20 bp, Homo sapiens
agagcctcgtccctccctca

SEQ ID NO: 4122265 - DNA, 17 bp, Homo sapiens
agagcctgcctggagcg

SEQ ID NO: 4122266 - DNA, 17 bp, Homo sapiens
agagcctgctgcatggg

SEQ ID NO: 4122267 - DNA, 14 bp, Homo sapiens
agagcctggagaag

SEQ ID NO: 4122268 - DNA, 17 bp, Homo sapiens
agagcctggagaagctg

SEQ ID NO: 4122269 - DNA, 15 bp, Homo sapiens
agagccttctcagaa

SEQ ID NO: 4122270 - DNA, 18 bp, Homo sapiens
agagccttctcagaagca

SEQ ID NO: 4122271 - DNA, 21 bp, Homo sapiens
agagcctttggatgaccagaa

SEQ ID NO: 4122272 - DNA, 23 bp, Homo sapiens
agagcgaggctgagcctacagat

SEQ ID NO: 4122273 - DNA, 13 bp, Homo sapiens
agagcgccaggaa

SEQ ID NO: 4122274 - DNA, 19 bp, Homo sapiens
agagcgccaggaagccaga

SEQ ID NO: 4122275 - DNA, 17 bp, Homo sapiens
agagcgtccttccccct

SEQ ID NO: 4122276 - DNA, 18 bp, Homo sapiens
agagcgtccttccccctg

SEQ ID NO: 4122277 - DNA, 23 bp, Homo sapiens
agagctaagggtgggtgctcaga

SEQ ID NO: 4122278 - DNA, 21 bp, Homo sapiens
agagctaataaatctcttctt

SEQ ID NO: 4122279 - DNA, 14 bp, Homo sapiens
agagctaggcaggg

SEQ ID NO: 4122280 - DNA, 19 bp, Homo sapiens
agagctatggacagcattg

SEQ ID NO: 4122281 - DNA, 14 bp, Homo sapiens
agagctgagccagt

SEQ ID NO: 4122282 - DNA, 13 bp, Homo sapiens
agagctgccctcc

SEQ ID NO: 4122283 - DNA, 15 bp, Homo sapiens
agagctgctctggaa

SEQ ID NO: 4122284 - DNA, 23 bp, Homo sapiens
agagctgctctggaaaatgtgac

SEQ ID NO: 4122285 - DNA, 15 bp, Homo sapiens
agagctggagccccc

SEQ ID NO: 4122286 - DNA, 18 bp, Homo sapiens
agagctggcaaaggtggc

SEQ ID NO: 4122287 - DNA, 22 bp, Homo sapiens
agagctgggaggcatggccctg

SEQ ID NO: 4122288 - DNA, 17 bp, Homo sapiens
agagctgtctgaactca

SEQ ID NO: 4122289 - DNA, 19 bp, Homo sapiens
agagctgtttatggcctca

SEQ ID NO: 4122290 - DNA, 19 bp, Homo sapiens
agagcttgtaataaatact

SEQ ID NO: 4122291 - DNA, 15 bp, Homo sapiens
agagctttgtgcttg

SEQ ID NO: 4122292 - DNA, 17 bp, Homo sapiens
agaggaaaaaaatgact

SEQ ID NO: 4122293 - DNA, 18 bp, Homo sapiens
agaggaaaagtaaggtgc

SEQ ID NO: 4122294 - DNA, 13 bp, Homo sapiens
agaggaaaatgag

SEQ ID NO: 4122295 - DNA, 21 bp, Homo sapiens
agaggaaatctgtaacaggta

SEQ ID NO: 4122296 - DNA, 15 bp, Homo sapiens
agaggaactgtccag

SEQ ID NO: 4122297 - DNA, 20 bp, Homo sapiens
agaggaactgtccagagagc

SEQ ID NO: 4122298 - DNA, 19 bp, Homo sapiens
agaggacagtggattgttt

SEQ ID NO: 4122299 - DNA, 15 bp, Homo sapiens
agaggagaaacacat

SEQ ID NO: 4122300 - DNA, 12 bp, Homo sapiens
agaggagctcta

SEQ ID NO: 4122301 - DNA, 13 bp, Homo sapiens
agaggagggcaga

SEQ ID NO: 4122302 - DNA, 14 bp, Homo sapiens
agaggagggcagag

SEQ ID NO: 4122303 - DNA, 20 bp, Homo sapiens
agaggatgaatgtatgtgca

SEQ ID NO: 4122304 - DNA, 17 bp, Homo sapiens
agaggatgagagcccag

SEQ ID NO: 4122305 - DNA, 17 bp, Homo sapiens
agaggatgtggaaagca

SEQ ID NO: 4122306 - DNA, 19 bp, Homo sapiens
agaggatttttttctgagc

SEQ ID NO: 4122307 - DNA, 21 bp, Homo sapiens
agaggcaacactggaacatgg

SEQ ID NO: 4122308 - DNA, 19 bp, Homo sapiens
agaggcactcagtgagcct

SEQ ID NO: 4122309 - DNA, 23 bp, Homo sapiens
agaggcactcagtgagcctcctg

SEQ ID NO: 4122310 - DNA, 14 bp, Homo sapiens
agaggcagagaaag

SEQ ID NO: 4122311 - DNA, 16 bp, Homo sapiens
agaggcagcccgcaca

SEQ ID NO: 4122312 - DNA, 10 bp, Homo sapiens
agaggcaggc

SEQ ID NO: 4122313 - DNA, 13 bp, Homo sapiens
agaggcaggctgg

SEQ ID NO: 4122314 - DNA, 14 bp, Homo sapiens
agaggccatggagg

SEQ ID NO: 4122315 - DNA, 23 bp, Homo sapiens
agaggccatggcagaataatctt

SEQ ID NO: 4122316 - DNA, 14 bp, Homo sapiens
agaggccccagcct

SEQ ID NO: 4122317 - DNA, 18 bp, Homo sapiens
agaggccgagagctatgg

SEQ ID NO: 4122318 - DNA, 16 bp, Homo sapiens
agaggcctgctgccag

SEQ ID NO: 4122319 - DNA, 17 bp, Homo sapiens
agaggctagcttctgct

SEQ ID NO: 4122320 - DNA, 13 bp, Homo sapiens
agaggctcagaga

SEQ ID NO: 4122321 - DNA, 16 bp, Homo sapiens
agaggctctggacagc

SEQ ID NO: 4122322 - DNA, 15 bp, Homo sapiens
agaggctctggggca

SEQ ID NO: 4122323 - DNA, 16 bp, Homo sapiens
agaggctctggggcag

SEQ ID NO: 4122324 - DNA, 16 bp, Homo sapiens
agaggctcttgatggt

SEQ ID NO: 4122325 - DNA, 14 bp, Homo sapiens
agaggctgaggcct

SEQ ID NO: 4122326 - DNA, 17 bp, Homo sapiens
agaggctgaggcctgga

SEQ ID NO: 4122327 - DNA, 18 bp, Homo sapiens
agaggctgaggcctggac

SEQ ID NO: 4122328 - DNA, 21 bp, Homo sapiens
agaggctgaggctggcacagg

SEQ ID NO: 4122329 - DNA, 22 bp, Homo sapiens
agaggctgcacccctgggccag

SEQ ID NO: 4122330 - DNA, 13 bp, Homo sapiens
agaggctgcattg

SEQ ID NO: 4122331 - DNA, 19 bp, Homo sapiens
agaggctgcccctctcacc

SEQ ID NO: 4122332 - DNA, 20 bp, Homo sapiens
agaggctgcccctctcacca

SEQ ID NO: 4122333 - DNA, 16 bp, Homo sapiens
agaggctggtgctgtg

SEQ ID NO: 4122334 - DNA, 21 bp, Homo sapiens
agaggctggtgctgtggccag

SEQ ID NO: 4122335 - DNA, 21 bp, Homo sapiens
agaggcttctccgccagcctc

SEQ ID NO: 4122336 - DNA, 22 bp, Homo sapiens
agaggcttctccgccagcctcc

SEQ ID NO: 4122337 - DNA, 23 bp, Homo sapiens
agaggcttctccgccagcctcct

SEQ ID NO: 4122338 - DNA, 21 bp, Homo sapiens
agagggacagcccactgagaa

SEQ ID NO: 4122339 - DNA, 20 bp, Homo sapiens
agagggaggtcactggaaag

SEQ ID NO: 4122340 - DNA, 16 bp, Homo sapiens
agagggatttccctgc

SEQ ID NO: 4122341 - DNA, 18 bp, Homo sapiens
agagggatttccctgcag

SEQ ID NO: 4122342 - DNA, 19 bp, Homo sapiens
agagggatttccctgcaga

SEQ ID NO: 4122343 - DNA, 15 bp, Homo sapiens
agagggcccagccca

SEQ ID NO: 4122344 - DNA, 21 bp, Homo sapiens
agagggcccagcccagagcca

SEQ ID NO: 4122345 - DNA, 16 bp, Homo sapiens
agagggcctgtgggag

SEQ ID NO: 4122346 - DNA, 12 bp, Homo sapiens
agagggctggag

SEQ ID NO: 4122347 - DNA, 17 bp, Homo sapiens
agagggctggaggccca

SEQ ID NO: 4122348 - DNA, 19 bp, Homo sapiens
agagggctggaggcccagg

SEQ ID NO: 4122349 - DNA, 12 bp, Homo sapiens
agaggggaagga

SEQ ID NO: 4122350 - DNA, 12 bp, Homo sapiens
agagggggcctg

SEQ ID NO: 4122351 - DNA, 16 bp, Homo sapiens
agagggggctggccat

SEQ ID NO: 4122352 - DNA, 12 bp, Homo sapiens
agagggggtgga

SEQ ID NO: 4122353 - DNA, 23 bp, Homo sapiens
agagggtctcgctgtcactggct

SEQ ID NO: 4122354 - DNA, 19 bp, Homo sapiens
agagggtgagtcctccaga

SEQ ID NO: 4122355 - DNA, 13 bp, Homo sapiens
agagggttcctgt

SEQ ID NO: 4122356 - DNA, 22 bp, Homo sapiens
agaggtaaaagtgtgagcagtg

SEQ ID NO: 4122357 - DNA, 17 bp, Homo sapiens
agaggtacagggttttt

SEQ ID NO: 4122358 - DNA, 14 bp, Homo sapiens
agaggtcagactaa

SEQ ID NO: 4122359 - DNA, 19 bp, Homo sapiens
agaggtcaggacggctcct

SEQ ID NO: 4122360 - DNA, 16 bp, Homo sapiens
agaggtgcacttgggg

SEQ ID NO: 4122361 - DNA, 19 bp, Homo sapiens
agaggtgggatcctccctc

SEQ ID NO: 4122362 - DNA, 16 bp, Homo sapiens
agagtaaattgctctg

SEQ ID NO: 4122363 - DNA, 16 bp, Homo sapiens
agagtaactttactct

SEQ ID NO: 4122364 - DNA, 20 bp, Homo sapiens
agagtacgtcctgcctggca

SEQ ID NO: 4122365 - DNA, 13 bp, Homo sapiens
agagtagaaataa

SEQ ID NO: 4122366 - DNA, 14 bp, Homo sapiens
agagtagaaataaa

SEQ ID NO: 4122367 - DNA, 18 bp, Homo sapiens
agagtagaattgcattga

SEQ ID NO: 4122368 - DNA, 12 bp, Homo sapiens
agagtagcaagt

SEQ ID NO: 4122369 - DNA, 22 bp, Homo sapiens
agagtagcaagttctagagaag

SEQ ID NO: 4122370 - DNA, 17 bp, Homo sapiens
agagtatccttccttca

SEQ ID NO: 4122371 - DNA, 16 bp, Homo sapiens
agagtcaccttttctg

SEQ ID NO: 4122372 - DNA, 17 bp, Homo sapiens
agagtcagctctctgcc

SEQ ID NO: 4122373 - DNA, 20 bp, Homo sapiens
agagtcagctctctgccctg

SEQ ID NO: 4122374 - DNA, 21 bp, Homo sapiens
agagtcagctctctgccctgt

SEQ ID NO: 4122375 - DNA, 19 bp, Homo sapiens
agagtcatctccatcagct

SEQ ID NO: 4122376 - DNA, 17 bp, Homo sapiens
agagtctagcactcatt

SEQ ID NO: 4122377 - DNA, 21 bp, Homo sapiens
agagtctcagaaactcccctg

SEQ ID NO: 4122378 - DNA, 12 bp, Homo sapiens
agagtctgaaca

SEQ ID NO: 4122379 - DNA, 16 bp, Homo sapiens
agagtctgggcctctg

SEQ ID NO: 4122380 - DNA, 17 bp, Homo sapiens
agagtctgggcctctga

SEQ ID NO: 4122381 - DNA, 21 bp, Homo sapiens
agagtcttccacttcaatgca

SEQ ID NO: 4122382 - DNA, 17 bp, Homo sapiens
agagtgaaaccatgact

SEQ ID NO: 4122383 - DNA, 21 bp, Homo sapiens
agagtgaaaccatgactgtga

SEQ ID NO: 4122384 - DNA, 15 bp, Homo sapiens
agagtgaagaatctt

SEQ ID NO: 4122385 - DNA, 22 bp, Homo sapiens
agagtgagctacagagccgagc

SEQ ID NO: 4122386 - DNA, 16 bp, Homo sapiens
agagtgattgcagctt

SEQ ID NO: 4122387 - DNA, 19 bp, Homo sapiens
agagtgcaacccagtcaca

SEQ ID NO: 4122388 - DNA, 16 bp, Homo sapiens
agagtgcacagctgtc

SEQ ID NO: 4122389 - DNA, 14 bp, Homo sapiens
agagtggcctccct

SEQ ID NO: 4122390 - DNA, 17 bp, Homo sapiens
agagtggcctccctgct

SEQ ID NO: 4122391 - DNA, 20 bp, Homo sapiens
agagtggcctccctgctgtg

SEQ ID NO: 4122392 - DNA, 21 bp, Homo sapiens
agagtggcctccctgctgtgc

SEQ ID NO: 4122393 - DNA, 22 bp, Homo sapiens
agagtggcctccctgctgtgcc

SEQ ID NO: 4122394 - DNA, 15 bp, Homo sapiens
agagtggcctggcca

SEQ ID NO: 4122395 - DNA, 22 bp, Homo sapiens
agagtggcctggccaggagctc

SEQ ID NO: 4122396 - DNA, 12 bp, Homo sapiens
agagtggctcct

SEQ ID NO: 4122397 - DNA, 23 bp, Homo sapiens
agagtggctcctcccggtgccca

SEQ ID NO: 4122398 - DNA, 18 bp, Homo sapiens
agagtggtctttctggag

SEQ ID NO: 4122399 - DNA, 13 bp, Homo sapiens
agagtgtagaagc

SEQ ID NO: 4122400 - DNA, 17 bp, Homo sapiens
agagtgtagaagcattc

SEQ ID NO: 4122401 - DNA, 18 bp, Homo sapiens
agagtgtagaagcattcc

SEQ ID NO: 4122402 - DNA, 15 bp, Homo sapiens
agagtgtggaggctg

SEQ ID NO: 4122403 - DNA, 23 bp, Homo sapiens
agagttaaatagagtatatgcac

SEQ ID NO: 4122404 - DNA, 14 bp, Homo sapiens
agagttaagaagct

SEQ ID NO: 4122405 - DNA, 19 bp, Homo sapiens
agagttagtttctttggga

SEQ ID NO: 4122406 - DNA, 13 bp, Homo sapiens
agagttcacagga

SEQ ID NO: 4122407 - DNA, 15 bp, Homo sapiens
agagttctgtgaaga

SEQ ID NO: 4122408 - DNA, 23 bp, Homo sapiens
agagtttagctgtaacagttctt

SEQ ID NO: 4122409 - DNA, 13 bp, Homo sapiens
agagtttcctgaa

SEQ ID NO: 4122410 - DNA, 15 bp, Homo sapiens
agagtttctgtttga

SEQ ID NO: 4122411 - DNA, 22 bp, Homo sapiens
agagtttctgtttgattctttt

SEQ ID NO: 4122412 - DNA, 20 bp, Homo sapiens
agagtttgttctgttctggg

SEQ ID NO: 4122413 - DNA, 23 bp, Homo sapiens
agagtttgttctgttctggggga

SEQ ID NO: 4122414 - DNA, 15 bp, Homo sapiens
agataaaaggtggag

SEQ ID NO: 4122415 - DNA, 23 bp, Homo sapiens
agataaaaggtggagtttctctg

SEQ ID NO: 4122416 - DNA, 13 bp, Homo sapiens
agataaagatgat

SEQ ID NO: 4122417 - DNA, 14 bp, Homo sapiens
agataaatagaact

SEQ ID NO: 4122418 - DNA, 15 bp, Homo sapiens
agataaatagaacta

SEQ ID NO: 4122419 - DNA, 17 bp, Homo sapiens
agataaatagaactatc

SEQ ID NO: 4122420 - DNA, 20 bp, Homo sapiens
agataaatatttgacttgca

SEQ ID NO: 4122421 - DNA, 19 bp, Homo sapiens
agataactttgactttctt

SEQ ID NO: 4122422 - DNA, 16 bp, Homo sapiens
agataagcaagagaga

SEQ ID NO: 4122423 - DNA, 16 bp, Homo sapiens
agataagtgtattttt

SEQ ID NO: 4122424 - DNA, 14 bp, Homo sapiens
agataataagatta

SEQ ID NO: 4122425 - DNA, 15 bp, Homo sapiens
agataataagattag

SEQ ID NO: 4122426 - DNA, 15 bp, Homo sapiens
agataatatctgtga

SEQ ID NO: 4122427 - DNA, 17 bp, Homo sapiens
agataatatctgtgagg

SEQ ID NO: 4122428 - DNA, 18 bp, Homo sapiens
agataatatctgtgaggt

SEQ ID NO: 4122429 - DNA, 19 bp, Homo sapiens
agataatcagtgtgtctaa

SEQ ID NO: 4122430 - DNA, 13 bp, Homo sapiens
agataatccctgt

SEQ ID NO: 4122431 - DNA, 14 bp, Homo sapiens
agataattgctatt

SEQ ID NO: 4122432 - DNA, 20 bp, Homo sapiens
agataatttgcatattctat

SEQ ID NO: 4122433 - DNA, 23 bp, Homo sapiens
agataatttgcatattctattgt

SEQ ID NO: 4122434 - DNA, 15 bp, Homo sapiens
agatacaagtttcag

SEQ ID NO: 4122435 - DNA, 17 bp, Homo sapiens
agatacaagtttcagac

SEQ ID NO: 4122436 - DNA, 22 bp, Homo sapiens
agatacatatgagtgtggaagc

SEQ ID NO: 4122437 - DNA, 16 bp, Homo sapiens
agatacatcactgctt

SEQ ID NO: 4122438 - DNA, 21 bp, Homo sapiens
agatacatggttgtgacctga

SEQ ID NO: 4122439 - DNA, 18 bp, Homo sapiens
agataccaggttgaaaga

SEQ ID NO: 4122440 - DNA, 22 bp, Homo sapiens
agataccctacgctgtccagaa

SEQ ID NO: 4122441 - DNA, 17 bp, Homo sapiens
agatacctcaccctgct

SEQ ID NO: 4122442 - DNA, 21 bp, Homo sapiens
agatactactgaccagacaag

SEQ ID NO: 4122443 - DNA, 23 bp, Homo sapiens
agatactactgaccagacaagct

SEQ ID NO: 4122444 - DNA, 14 bp, Homo sapiens
agatactggtggaa

SEQ ID NO: 4122445 - DNA, 18 bp, Homo sapiens
agatacttatttttctga

SEQ ID NO: 4122446 - DNA, 23 bp, Homo sapiens
agatacttctgaaataaatgttc

SEQ ID NO: 4122447 - DNA, 15 bp, Homo sapiens
agatagagctgggtg

SEQ ID NO: 4122448 - DNA, 20 bp, Homo sapiens
agatagagctgggtggcctg

SEQ ID NO: 4122449 - DNA, 14 bp, Homo sapiens
agataggaaactga

SEQ ID NO: 4122450 - DNA, 15 bp, Homo sapiens
agataggaaactgaa

SEQ ID NO: 4122451 - DNA, 13 bp, Homo sapiens
agataggctctgc

SEQ ID NO: 4122452 - DNA, 14 bp, Homo sapiens
agataggctctgca

SEQ ID NO: 4122453 - DNA, 13 bp, Homo sapiens
agataggggcaca

SEQ ID NO: 4122454 - DNA, 17 bp, Homo sapiens
agatagtagcatacatt

SEQ ID NO: 4122455 - DNA, 22 bp, Homo sapiens
agatagtatctagcaatcacaa

SEQ ID NO: 4122456 - DNA, 15 bp, Homo sapiens
agatataaatggctg

SEQ ID NO: 4122457 - DNA, 18 bp, Homo sapiens
agatatatttaagcctta

SEQ ID NO: 4122458 - DNA, 15 bp, Homo sapiens
agatatatttttcac

SEQ ID NO: 4122459 - DNA, 16 bp, Homo sapiens
agatatatttttcaca

SEQ ID NO: 4122460 - DNA, 17 bp, Homo sapiens
agatatcctctccccct

SEQ ID NO: 4122461 - DNA, 18 bp, Homo sapiens
agatatcctctccccctc

SEQ ID NO: 4122462 - DNA, 19 bp, Homo sapiens
agatattataagggagagc

SEQ ID NO: 4122463 - DNA, 19 bp, Homo sapiens
agatattgtacataaaaga

SEQ ID NO: 4122464 - DNA, 18 bp, Homo sapiens
agatattgtgaagtacat

SEQ ID NO: 4122465 - DNA, 13 bp, Homo sapiens
agatattgttcaa

SEQ ID NO: 4122466 - DNA, 23 bp, Homo sapiens
agatattgttcaaacaatatcat

SEQ ID NO: 4122467 - DNA, 20 bp, Homo sapiens
agatattgttttctgtaaat

SEQ ID NO: 4122468 - DNA, 23 bp, Homo sapiens
agatatttacatgaattgcattt

SEQ ID NO: 4122469 - DNA, 17 bp, Homo sapiens
agatatttatattttta

SEQ ID NO: 4122470 - DNA, 15 bp, Homo sapiens
agatattttaaaatg

SEQ ID NO: 4122471 - DNA, 18 bp, Homo sapiens
agatattttaaaatgaga

SEQ ID NO: 4122472 - DNA, 18 bp, Homo sapiens
agatattttttcagaaat

SEQ ID NO: 4122473 - DNA, 18 bp, Homo sapiens
agatcaaaaggttaataa

SEQ ID NO: 4122474 - DNA, 14 bp, Homo sapiens
agatcaaatacttt

SEQ ID NO: 4122475 - DNA, 15 bp, Homo sapiens
agatcaaatacttta

SEQ ID NO: 4122476 - DNA, 16 bp, Homo sapiens
agatcaacgcctcact

SEQ ID NO: 4122477 - DNA, 17 bp, Homo sapiens
agatcaacgcctcactg

SEQ ID NO: 4122478 - DNA, 22 bp, Homo sapiens
agatcaattccctctctcagca

SEQ ID NO: 4122479 - DNA, 12 bp, Homo sapiens
agatcacagcct

SEQ ID NO: 4122480 - DNA, 20 bp, Homo sapiens
agatcacagcctccagggcc

SEQ ID NO: 4122481 - DNA, 20 bp, Homo sapiens
agatcagcaaaccggggcct

SEQ ID NO: 4122482 - DNA, 23 bp, Homo sapiens
agatccaaaagaagcccccagct

SEQ ID NO: 4122483 - DNA, 12 bp, Homo sapiens
agatccaggact

SEQ ID NO: 4122484 - DNA, 13 bp, Homo sapiens
agatccaggacta

SEQ ID NO: 4122485 - DNA, 13 bp, Homo sapiens
agatccatttgcc

SEQ ID NO: 4122486 - DNA, 19 bp, Homo sapiens
agatcccatccatcagctc

SEQ ID NO: 4122487 - DNA, 11 bp, Homo sapiens
agatcccctca

SEQ ID NO: 4122488 - DNA, 15 bp, Homo sapiens
agatcccgcctcttc

SEQ ID NO: 4122489 - DNA, 17 bp, Homo sapiens
agatcctttttccatca

SEQ ID NO: 4122490 - DNA, 18 bp, Homo sapiens
agatcctttttccatcat

SEQ ID NO: 4122491 - DNA, 17 bp, Homo sapiens
agatcgagaccatcctg

SEQ ID NO: 4122492 - DNA, 16 bp, Homo sapiens
agatcgcatcattgca

SEQ ID NO: 4122493 - DNA, 15 bp, Homo sapiens
agatcgcgccactgc

SEQ ID NO: 4122494 - DNA, 17 bp, Homo sapiens
agatcgttagtatctaa

SEQ ID NO: 4122495 - DNA, 20 bp, Homo sapiens
agatctaagcctttccataa

SEQ ID NO: 4122496 - DNA, 16 bp, Homo sapiens
agatctatgggaagat

SEQ ID NO: 4122497 - DNA, 12 bp, Homo sapiens
agatctcccact

SEQ ID NO: 4122498 - DNA, 17 bp, Homo sapiens
agatctggaacctcagc

SEQ ID NO: 4122499 - DNA, 23 bp, Homo sapiens
agatcttcccataataaagcaat

SEQ ID NO: 4122500 - DNA, 22 bp, Homo sapiens
agatcttgtctccactaaatga

SEQ ID NO: 4122501 - DNA, 21 bp, Homo sapiens
agatctttcaggaaagacgga

SEQ ID NO: 4122502 - DNA, 13 bp, Homo sapiens
agatgaaagagga

SEQ ID NO: 4122503 - DNA, 23 bp, Homo sapiens
agatgaaagaggaggtttggggt

SEQ ID NO: 4122504 - DNA, 22 bp, Homo sapiens
agatgaaagcagggaatttcta

SEQ ID NO: 4122505 - DNA, 23 bp, Homo sapiens
agatgaaagcagggaatttctat

SEQ ID NO: 4122506 - DNA, 15 bp, Homo sapiens
agatgaagttttaca

SEQ ID NO: 4122507 - DNA, 16 bp, Homo sapiens
agatgaatgccgtgga

SEQ ID NO: 4122508 - DNA, 23 bp, Homo sapiens
agatgacccctgcccagatcagc

SEQ ID NO: 4122509 - DNA, 17 bp, Homo sapiens
agatgagcaaggacatt

SEQ ID NO: 4122510 - DNA, 18 bp, Homo sapiens
agatgagcaaggacattg

SEQ ID NO: 4122511 - DNA, 15 bp, Homo sapiens
agatgagcagtcaca

SEQ ID NO: 4122512 - DNA, 19 bp, Homo sapiens
agatgagcagtcacactgt

SEQ ID NO: 4122513 - DNA, 18 bp, Homo sapiens
agatgaggggttgaggga

SEQ ID NO: 4122514 - DNA, 18 bp, Homo sapiens
agatgataaagagacagt

SEQ ID NO: 4122515 - DNA, 16 bp, Homo sapiens
agatgatacatccaaa

SEQ ID NO: 4122516 - DNA, 16 bp, Homo sapiens
agatgatggatgccaa

SEQ ID NO: 4122517 - DNA, 23 bp, Homo sapiens
agatgatgtttgcttttctaaga

SEQ ID NO: 4122518 - DNA, 14 bp, Homo sapiens
agatgattcaaagt

SEQ ID NO: 4122519 - DNA, 13 bp, Homo sapiens
agatgcaagatat

SEQ ID NO: 4122520 - DNA, 20 bp, Homo sapiens
agatgcaaggaccaggactc

SEQ ID NO: 4122521 - DNA, 19 bp, Homo sapiens
agatgcaatgtgctactga

SEQ ID NO: 4122522 - DNA, 23 bp, Homo sapiens
agatgcacttaagttagcctcca

SEQ ID NO: 4122523 - DNA, 14 bp, Homo sapiens
agatgcagaaaaag

SEQ ID NO: 4122524 - DNA, 13 bp, Homo sapiens
agatgcagagagc

SEQ ID NO: 4122525 - DNA, 14 bp, Homo sapiens
agatgcagagagcc

SEQ ID NO: 4122526 - DNA, 15 bp, Homo sapiens
agatgcagagagcca

SEQ ID NO: 4122527 - DNA, 17 bp, Homo sapiens
agatgcagagagccatt

SEQ ID NO: 4122528 - DNA, 19 bp, Homo sapiens
agatgcagagagccatttt

SEQ ID NO: 4122529 - DNA, 16 bp, Homo sapiens
agatgcagctcttcct

SEQ ID NO: 4122530 - DNA, 17 bp, Homo sapiens
agatgcagctcttcctg

SEQ ID NO: 4122531 - DNA, 21 bp, Homo sapiens
agatgcaggttggaaggggcc

SEQ ID NO: 4122532 - DNA, 12 bp, Homo sapiens
agatgccccaga

SEQ ID NO: 4122533 - DNA, 20 bp, Homo sapiens
agatgctgactgtactcctc

SEQ ID NO: 4122534 - DNA, 14 bp, Homo sapiens
agatgctggcccag

SEQ ID NO: 4122535 - DNA, 18 bp, Homo sapiens
agatgctggcccagggcc

SEQ ID NO: 4122536 - DNA, 19 bp, Homo sapiens
agatgctggcccagggccc

SEQ ID NO: 4122537 - DNA, 15 bp, Homo sapiens
agatgctggttttct

SEQ ID NO: 4122538 - DNA, 13 bp, Homo sapiens
agatgcttctctc

SEQ ID NO: 4122539 - DNA, 16 bp, Homo sapiens
agatgcttctgggaga

SEQ ID NO: 4122540 - DNA, 18 bp, Homo sapiens
agatggaatgctgtgtta

SEQ ID NO: 4122541 - DNA, 15 bp, Homo sapiens
agatggataaactga

SEQ ID NO: 4122542 - DNA, 17 bp, Homo sapiens
agatggatatgaccagt

SEQ ID NO: 4122543 - DNA, 16 bp, Homo sapiens
agatggattctcagat

SEQ ID NO: 4122544 - DNA, 17 bp, Homo sapiens
agatggattctcagata

SEQ ID NO: 4122545 - DNA, 22 bp, Homo sapiens
agatggcaagagggtgacagct

SEQ ID NO: 4122546 - DNA, 20 bp, Homo sapiens
agatggcatcaaaaaagata

SEQ ID NO: 4122547 - DNA, 18 bp, Homo sapiens
agatgggaatgaggtggg

SEQ ID NO: 4122548 - DNA, 23 bp, Homo sapiens
agatgggagctcctctcctggag

SEQ ID NO: 4122549 - DNA, 17 bp, Homo sapiens
agatgggcttgttttct

SEQ ID NO: 4122550 - DNA, 16 bp, Homo sapiens
agatgggggcagggct

SEQ ID NO: 4122551 - DNA, 20 bp, Homo sapiens
agatgggtctgatattaatc

SEQ ID NO: 4122552 - DNA, 17 bp, Homo sapiens
agatgggtctggctgag

SEQ ID NO: 4122553 - DNA, 16 bp, Homo sapiens
agatggtccatttgtt

SEQ ID NO: 4122554 - DNA, 20 bp, Homo sapiens
agatggtccatttgttcctg

SEQ ID NO: 4122555 - DNA, 21 bp, Homo sapiens
agatggtccatttgttcctgc

SEQ ID NO: 4122556 - DNA, 20 bp, Homo sapiens
agatggtgaagcattctccc

SEQ ID NO: 4122557 - DNA, 17 bp, Homo sapiens
agatggtggagattggc

SEQ ID NO: 4122558 - DNA, 21 bp, Homo sapiens
agatgtagcaaaacgcatgga

SEQ ID NO: 4122559 - DNA, 18 bp, Homo sapiens
agatgtcagccgagccgg

SEQ ID NO: 4122560 - DNA, 23 bp, Homo sapiens
agatgtcatttagttcagcatcc

SEQ ID NO: 4122561 - DNA, 13 bp, Homo sapiens
agatgtctctggg

SEQ ID NO: 4122562 - DNA, 15 bp, Homo sapiens
agatgtctctggggc

SEQ ID NO: 4122563 - DNA, 15 bp, Homo sapiens
agatgtcttccctgg

SEQ ID NO: 4122564 - DNA, 19 bp, Homo sapiens
agatgtcttccctgggctg

SEQ ID NO: 4122565 - DNA, 13 bp, Homo sapiens
agatgtcttggaa

SEQ ID NO: 4122566 - DNA, 14 bp, Homo sapiens
agatgtgaattatt

SEQ ID NO: 4122567 - DNA, 22 bp, Homo sapiens
agatgtgagccaccgtgcctgg

SEQ ID NO: 4122568 - DNA, 17 bp, Homo sapiens
agatgtgataaggatca

SEQ ID NO: 4122569 - DNA, 16 bp, Homo sapiens
agatgtgcaaatgcaa

SEQ ID NO: 4122570 - DNA, 12 bp, Homo sapiens
agatgtgcaata

SEQ ID NO: 4122571 - DNA, 13 bp, Homo sapiens
agatgtgcaccca

SEQ ID NO: 4122572 - DNA, 21 bp, Homo sapiens
agatgtgcacccatgggctct

SEQ ID NO: 4122573 - DNA, 18 bp, Homo sapiens
agatgtgccaataaccaa

SEQ ID NO: 4122574 - DNA, 13 bp, Homo sapiens
agatgtgcttctg

SEQ ID NO: 4122575 - DNA, 21 bp, Homo sapiens
agatgtgtcccccccaggcct

SEQ ID NO: 4122576 - DNA, 16 bp, Homo sapiens
agatgtgtctatggct

SEQ ID NO: 4122577 - DNA, 23 bp, Homo sapiens
agatgtttcacaccggaaggttt

SEQ ID NO: 4122578 - DNA, 17 bp, Homo sapiens
agatgtttgtcagatat

SEQ ID NO: 4122579 - DNA, 24 bp, Homo sapiens
agatgtttgtcagatatgatatgt

SEQ ID NO: 4122580 - DNA, 21 bp, Homo sapiens
agatgttttggtagattaaat

SEQ ID NO: 4122581 - DNA, 12 bp, Homo sapiens
agattaaatata

SEQ ID NO: 4122582 - DNA, 22 bp, Homo sapiens
agattacccaaaaactgtcttt

SEQ ID NO: 4122583 - DNA, 21 bp, Homo sapiens
agattaccccctcattgttta

SEQ ID NO: 4122584 - DNA, 14 bp, Homo sapiens
agattagagggagg

SEQ ID NO: 4122585 - DNA, 20 bp, Homo sapiens
agattaggtagactttgctt

SEQ ID NO: 4122586 - DNA, 19 bp, Homo sapiens
agattagttctttttgcca

SEQ ID NO: 4122587 - DNA, 21 bp, Homo sapiens
agattcaggccagcccagcca

SEQ ID NO: 4122588 - DNA, 23 bp, Homo sapiens
agattcaggccagcccagccagg

SEQ ID NO: 4122589 - DNA, 16 bp, Homo sapiens
agattcatatttactt

SEQ ID NO: 4122590 - DNA, 22 bp, Homo sapiens
agattccagagagtggctcctc

SEQ ID NO: 4122591 - DNA, 15 bp, Homo sapiens
agattcccctgtgtc

SEQ ID NO: 4122592 - DNA, 16 bp, Homo sapiens
agattcccctgtgtca

SEQ ID NO: 4122593 - DNA, 13 bp, Homo sapiens
agattctccatta

SEQ ID NO: 4122594 - DNA, 15 bp, Homo sapiens
agattctcctgtgct

SEQ ID NO: 4122595 - DNA, 19 bp, Homo sapiens
agattctgtgatcttttaa

SEQ ID NO: 4122596 - DNA, 22 bp, Homo sapiens
agattctgtgatcttttaaagt

SEQ ID NO: 4122597 - DNA, 18 bp, Homo sapiens
agattgaaaatcttgtgt

SEQ ID NO: 4122598 - DNA, 13 bp, Homo sapiens
agattgaggcctg

SEQ ID NO: 4122599 - DNA, 22 bp, Homo sapiens
agattgaggcctgccctcaggg

SEQ ID NO: 4122600 - DNA, 23 bp, Homo sapiens
agattgagtataaaaacttgaaa

SEQ ID NO: 4122601 - DNA, 19 bp, Homo sapiens
agattgcagaaaattctgt

SEQ ID NO: 4122602 - DNA, 19 bp, Homo sapiens
agattgctgaaaaagtaga

SEQ ID NO: 4122603 - DNA, 14 bp, Homo sapiens
agattgcttctgta

SEQ ID NO: 4122604 - DNA, 15 bp, Homo sapiens
agattgtgtaacaat

SEQ ID NO: 4122605 - DNA, 12 bp, Homo sapiens
agatttagtgta

SEQ ID NO: 4122606 - DNA, 15 bp, Homo sapiens
agatttctggttgat

SEQ ID NO: 4122607 - DNA, 20 bp, Homo sapiens
agatttcttctctttagtat

SEQ ID NO: 4122608 - DNA, 17 bp, Homo sapiens
agatttggcttgacaaa

SEQ ID NO: 4122609 - DNA, 17 bp, Homo sapiens
agattttaaaaagtctt

SEQ ID NO: 4122610 - DNA, 19 bp, Homo sapiens
agattttaaattcacaata

SEQ ID NO: 4122611 - DNA, 17 bp, Homo sapiens
agattttaattttgaat

SEQ ID NO: 4122612 - DNA, 20 bp, Homo sapiens
agattttacaaaagatgtat

SEQ ID NO: 4122613 - DNA, 14 bp, Homo sapiens
agattttaggtgtt

SEQ ID NO: 4122614 - DNA, 14 bp, Homo sapiens
agattttattttac

SEQ ID NO: 4122615 - DNA, 17 bp, Homo sapiens
agattttcagaaaatat

SEQ ID NO: 4122616 - DNA, 13 bp, Homo sapiens
agattttgcattt

SEQ ID NO: 4122617 - DNA, 16 bp, Homo sapiens
agatttttaacgaatg

SEQ ID NO: 4122618 - DNA, 14 bp, Homo sapiens
agatttttaagaac

SEQ ID NO: 4122619 - DNA, 15 bp, Homo sapiens
agatttttaagaact

SEQ ID NO: 4122620 - DNA, 18 bp, Homo sapiens
agatttttaagaacttca

SEQ ID NO: 4122621 - DNA, 21 bp, Homo sapiens
agatttttaagaacttcattt

SEQ ID NO: 4122622 - DNA, 18 bp, Homo sapiens
agattttttattgctagt

SEQ ID NO: 4122623 - DNA, 19 bp, Homo sapiens
agatttttttgtgtatgtt

SEQ ID NO: 4122624 - DNA, 12 bp, Homo sapiens
agcaaaagaaaa

SEQ ID NO: 4122625 - DNA, 14 bp, Homo sapiens
agcaaaaggcagct

SEQ ID NO: 4122626 - DNA, 16 bp, Homo sapiens
agcaaaaggcagctca

SEQ ID NO: 4122627 - DNA, 16 bp, Homo sapiens
agcaaaataaggaaga

SEQ ID NO: 4122628 - DNA, 16 bp, Homo sapiens
agcaaaatatgcccct

SEQ ID NO: 4122629 - DNA, 17 bp, Homo sapiens
agcaaaatatgcccctt

SEQ ID NO: 4122630 - DNA, 20 bp, Homo sapiens
agcaaaccaatggtgatcct

SEQ ID NO: 4122631 - DNA, 23 bp, Homo sapiens
agcaaaccagcttgttctgggct

SEQ ID NO: 4122632 - DNA, 16 bp, Homo sapiens
agcaaagagtgggctg

SEQ ID NO: 4122633 - DNA, 19 bp, Homo sapiens
agcaaataaactaggaaat

SEQ ID NO: 4122634 - DNA, 14 bp, Homo sapiens
agcaacacaagctg

SEQ ID NO: 4122635 - DNA, 11 bp, Homo sapiens
agcaacacaga

SEQ ID NO: 4122636 - DNA, 14 bp, Homo sapiens
agcaacaggaaaaa

SEQ ID NO: 4122637 - DNA, 23 bp, Homo sapiens
agcaacaggaatcaagagctgcc

SEQ ID NO: 4122638 - DNA, 16 bp, Homo sapiens
agcaaccccaggctga

SEQ ID NO: 4122639 - DNA, 19 bp, Homo sapiens
agcaaccgcctcaaaatgt

SEQ ID NO: 4122640 - DNA, 14 bp, Homo sapiens
agcaacgcccctcc

SEQ ID NO: 4122641 - DNA, 19 bp, Homo sapiens
agcaacgcccctccaaacc

SEQ ID NO: 4122642 - DNA, 15 bp, Homo sapiens
agcaacttgtctttt

SEQ ID NO: 4122643 - DNA, 21 bp, Homo sapiens
agcaacttgtctttttctgga

SEQ ID NO: 4122644 - DNA, 23 bp, Homo sapiens
agcaacttgtctttttctggact

SEQ ID NO: 4122645 - DNA, 18 bp, Homo sapiens
agcaagaaataaatcaga

SEQ ID NO: 4122646 - DNA, 15 bp, Homo sapiens
agcaagagagatgtt

SEQ ID NO: 4122647 - DNA, 23 bp, Homo sapiens
agcaagagctggcaaaggtggct

SEQ ID NO: 4122648 - DNA, 17 bp, Homo sapiens
agcaagatcttgtctcc

SEQ ID NO: 4122649 - DNA, 20 bp, Homo sapiens
agcaagcatttatgtttatt

SEQ ID NO: 4122650 - DNA, 13 bp, Homo sapiens
agcaagcgggagc

SEQ ID NO: 4122651 - DNA, 14 bp, Homo sapiens
agcaagctttggtt

SEQ ID NO: 4122652 - DNA, 21 bp, Homo sapiens
agcaaggaagatatacatgaa

SEQ ID NO: 4122653 - DNA, 23 bp, Homo sapiens
agcaaggacattgccccaagata

SEQ ID NO: 4122654 - DNA, 12 bp, Homo sapiens
agcaaggccctg

SEQ ID NO: 4122655 - DNA, 14 bp, Homo sapiens
agcaagggagaaaa

SEQ ID NO: 4122656 - DNA, 15 bp, Homo sapiens
agcaagggagaaaag

SEQ ID NO: 4122657 - DNA, 20 bp, Homo sapiens
agcaagggagaaaagagaaa

SEQ ID NO: 4122658 - DNA, 19 bp, Homo sapiens
agcaaggtcttgctctcct

SEQ ID NO: 4122659 - DNA, 13 bp, Homo sapiens
agcaagtaaaaag

SEQ ID NO: 4122660 - DNA, 24 bp, Homo sapiens
agcaagtgagagagatgggagctc

SEQ ID NO: 4122661 - DNA, 16 bp, Homo sapiens
agcaagttacagtgat

SEQ ID NO: 4122662 - DNA, 18 bp, Homo sapiens
agcaagttcgtctgttgt

SEQ ID NO: 4122663 - DNA, 15 bp, Homo sapiens
agcaagttttcttcc

SEQ ID NO: 4122664 - DNA, 14 bp, Homo sapiens
agcaataaatgaat

SEQ ID NO: 4122665 - DNA, 16 bp, Homo sapiens
agcaataagaaatgaa

SEQ ID NO: 4122666 - DNA, 17 bp, Homo sapiens
agcaataagaaatgaac

SEQ ID NO: 4122667 - DNA, 20 bp, Homo sapiens
agcaataagaaatgaacaaa

SEQ ID NO: 4122668 - DNA, 15 bp, Homo sapiens
agcaatatttatgga

SEQ ID NO: 4122669 - DNA, 22 bp, Homo sapiens
agcaatcaaggttataattttt

SEQ ID NO: 4122670 - DNA, 18 bp, Homo sapiens
agcaatccacctgccttg

SEQ ID NO: 4122671 - DNA, 17 bp, Homo sapiens
agcaatccatgttagtt

SEQ ID NO: 4122672 - DNA, 20 bp, Homo sapiens
agcaatccatgttagttttt

SEQ ID NO: 4122673 - DNA, 15 bp, Homo sapiens
agcaatcctcctgcc

SEQ ID NO: 4122674 - DNA, 23 bp, Homo sapiens
agcaatcctcctgcctcagcctt

SEQ ID NO: 4122675 - DNA, 21 bp, Homo sapiens
agcaatgacatctcaggggcc

SEQ ID NO: 4122676 - DNA, 20 bp, Homo sapiens
agcaatgatgtccagaagaa

SEQ ID NO: 4122677 - DNA, 20 bp, Homo sapiens
agcaatgccatttcagtggc

SEQ ID NO: 4122678 - DNA, 11 bp, Homo sapiens
agcaatgggac

SEQ ID NO: 4122679 - DNA, 12 bp, Homo sapiens
agcaatgggact

SEQ ID NO: 4122680 - DNA, 16 bp, Homo sapiens
agcaattcagacccct

SEQ ID NO: 4122681 - DNA, 18 bp, Homo sapiens
agcaattctcctgcctca

SEQ ID NO: 4122682 - DNA, 23 bp, Homo sapiens
agcaattctcctgcctcagcctc

SEQ ID NO: 4122683 - DNA, 17 bp, Homo sapiens
agcaatttaaatgttat

SEQ ID NO: 4122684 - DNA, 17 bp, Homo sapiens
agcaatttaactagaca

SEQ ID NO: 4122685 - DNA, 16 bp, Homo sapiens
agcaatttcccccctc

SEQ ID NO: 4122686 - DNA, 23 bp, Homo sapiens
agcacaagcagagtgcacagctg

SEQ ID NO: 4122687 - DNA, 16 bp, Homo sapiens
agcacaccacaattct

SEQ ID NO: 4122688 - DNA, 14 bp, Homo sapiens
agcacagaatattt

SEQ ID NO: 4122689 - DNA, 17 bp, Homo sapiens
agcacagagcctggccc

SEQ ID NO: 4122690 - DNA, 12 bp, Homo sapiens
agcacagcagcc

SEQ ID NO: 4122691 - DNA, 23 bp, Homo sapiens
agcacagcagcctggggctggcc

SEQ ID NO: 4122692 - DNA, 13 bp, Homo sapiens
agcacagccaaca

SEQ ID NO: 4122693 - DNA, 12 bp, Homo sapiens
agcacagcctgg

SEQ ID NO: 4122694 - DNA, 13 bp, Homo sapiens
agcacagcctggg

SEQ ID NO: 4122695 - DNA, 16 bp, Homo sapiens
agcacagctcccttct

SEQ ID NO: 4122696 - DNA, 13 bp, Homo sapiens
agcacaggcagct

SEQ ID NO: 4122697 - DNA, 15 bp, Homo sapiens
agcacaggcagctgg

SEQ ID NO: 4122698 - DNA, 21 bp, Homo sapiens
agcacagggggattctgagca

SEQ ID NO: 4122699 - DNA, 18 bp, Homo sapiens
agcacagtcaggttgaag

SEQ ID NO: 4122700 - DNA, 15 bp, Homo sapiens
agcacatacattaaa

SEQ ID NO: 4122701 - DNA, 21 bp, Homo sapiens
agcacatacattaaaactagg

SEQ ID NO: 4122702 - DNA, 19 bp, Homo sapiens
agcacatactgtgttccaa

SEQ ID NO: 4122703 - DNA, 16 bp, Homo sapiens
agcacatctgcatttt

SEQ ID NO: 4122704 - DNA, 20 bp, Homo sapiens
agcaccagcttctccaggct

SEQ ID NO: 4122705 - DNA, 13 bp, Homo sapiens
agcacccccaccc

SEQ ID NO: 4122706 - DNA, 18 bp, Homo sapiens
agcacccccacccacctc

SEQ ID NO: 4122707 - DNA, 22 bp, Homo sapiens
agcaccccctgctccaccagca

SEQ ID NO: 4122708 - DNA, 17 bp, Homo sapiens
agcaccctcgagaaggg

SEQ ID NO: 4122709 - DNA, 12 bp, Homo sapiens
agcaccctctcc

SEQ ID NO: 4122710 - DNA, 19 bp, Homo sapiens
agcaccctctcctgggggt

SEQ ID NO: 4122711 - DNA, 16 bp, Homo sapiens
agcaccgttctgtgca

SEQ ID NO: 4122712 - DNA, 16 bp, Homo sapiens
agcacctccaggcctg

SEQ ID NO: 4122713 - DNA, 14 bp, Homo sapiens
agcacctccccgct

SEQ ID NO: 4122714 - DNA, 19 bp, Homo sapiens
agcacctccttgtcacttt

SEQ ID NO: 4122715 - DNA, 14 bp, Homo sapiens
agcacctgcctcct

SEQ ID NO: 4122716 - DNA, 16 bp, Homo sapiens
agcaccttcagggctg

SEQ ID NO: 4122717 - DNA, 19 bp, Homo sapiens
agcacctttgcacaggatg

SEQ ID NO: 4122718 - DNA, 18 bp, Homo sapiens
agcacgggacggaagtgc

SEQ ID NO: 4122719 - DNA, 16 bp, Homo sapiens
agcacgtctcagagat

SEQ ID NO: 4122720 - DNA, 16 bp, Homo sapiens
agcactaacgtaaata

SEQ ID NO: 4122721 - DNA, 18 bp, Homo sapiens
agcactacaccttgcctt

SEQ ID NO: 4122722 - DNA, 16 bp, Homo sapiens
agcactacataaactg

SEQ ID NO: 4122723 - DNA, 17 bp, Homo sapiens
agcactacataaactga

SEQ ID NO: 4122724 - DNA, 21 bp, Homo sapiens
agcactacataaactgacttt

SEQ ID NO: 4122725 - DNA, 17 bp, Homo sapiens
agcactactgggtgtca

SEQ ID NO: 4122726 - DNA, 18 bp, Homo sapiens
agcactactgggtgtcat

SEQ ID NO: 4122727 - DNA, 19 bp, Homo sapiens
agcactactgggtgtcatt

SEQ ID NO: 4122728 - DNA, 18 bp, Homo sapiens
agcactcacgccctaagc

SEQ ID NO: 4122729 - DNA, 22 bp, Homo sapiens
agcactctctaaatcttccttg

SEQ ID NO: 4122730 - DNA, 23 bp, Homo sapiens
agcactctgagtttaccatttgt

SEQ ID NO: 4122731 - DNA, 12 bp, Homo sapiens
agcactgagcaa

SEQ ID NO: 4122732 - DNA, 17 bp, Homo sapiens
agcactgagcaagttga

SEQ ID NO: 4122733 - DNA, 12 bp, Homo sapiens
agcactgagctc

SEQ ID NO: 4122734 - DNA, 20 bp, Homo sapiens
agcactgagctcacatggga

SEQ ID NO: 4122735 - DNA, 21 bp, Homo sapiens
agcactgagctcacatgggac

SEQ ID NO: 4122736 - DNA, 22 bp, Homo sapiens
agcactgagggtggcactcaac

SEQ ID NO: 4122737 - DNA, 22 bp, Homo sapiens
agcactgctaggcgagtgccag

SEQ ID NO: 4122738 - DNA, 23 bp, Homo sapiens
agcactgctaggcgagtgccagg

SEQ ID NO: 4122739 - DNA, 16 bp, Homo sapiens
agcactggagtgcagg

SEQ ID NO: 4122740 - DNA, 22 bp, Homo sapiens
agcactggagtgcagggaggag

SEQ ID NO: 4122741 - DNA, 13 bp, Homo sapiens
agcactgtccctt

SEQ ID NO: 4122742 - DNA, 16 bp, Homo sapiens
agcactgtcccttgcc

SEQ ID NO: 4122743 - DNA, 22 bp, Homo sapiens
agcactgtcccttgcctcaatg

SEQ ID NO: 4122744 - DNA, 20 bp, Homo sapiens
agcactgtgaagacccagca

SEQ ID NO: 4122745 - DNA, 15 bp, Homo sapiens
agcacttatttaatg

SEQ ID NO: 4122746 - DNA, 19 bp, Homo sapiens
agcacttccaaaattctta

SEQ ID NO: 4122747 - DNA, 22 bp, Homo sapiens
agcacttgggggttcaggcccg

SEQ ID NO: 4122748 - DNA, 20 bp, Homo sapiens
agcactttgggaggccgagg

SEQ ID NO: 4122749 - DNA, 16 bp, Homo sapiens
agcactttgggaggct

SEQ ID NO: 4122750 - DNA, 14 bp, Homo sapiens
agcacttttgttat

SEQ ID NO: 4122751 - DNA, 22 bp, Homo sapiens
agcacttttgttattccatcaa

SEQ ID NO: 4122752 - DNA, 15 bp, Homo sapiens
agcagaaacagccat

SEQ ID NO: 4122753 - DNA, 23 bp, Homo sapiens
agcagaactcattctatccccaa

SEQ ID NO: 4122754 - DNA, 13 bp, Homo sapiens
agcagaagcctcc

SEQ ID NO: 4122755 - DNA, 23 bp, Homo sapiens
agcagaagcctccaagcacagag

SEQ ID NO: 4122756 - DNA, 16 bp, Homo sapiens
agcagaagtggagctg

SEQ ID NO: 4122757 - DNA, 20 bp, Homo sapiens
agcagaattttaatgtgaag

SEQ ID NO: 4122758 - DNA, 15 bp, Homo sapiens
agcagacacacatgg

SEQ ID NO: 4122759 - DNA, 14 bp, Homo sapiens
agcagacagaaact

SEQ ID NO: 4122760 - DNA, 15 bp, Homo sapiens
agcagacagaaactg

SEQ ID NO: 4122761 - DNA, 17 bp, Homo sapiens
agcagacagaaactgga

SEQ ID NO: 4122762 - DNA, 14 bp, Homo sapiens
agcagagaattctc

SEQ ID NO: 4122763 - DNA, 21 bp, Homo sapiens
agcagagaattctcttatcca

SEQ ID NO: 4122764 - DNA, 15 bp, Homo sapiens
agcagaggcaggctg

SEQ ID NO: 4122765 - DNA, 17 bp, Homo sapiens
agcagaggcaggctggg

SEQ ID NO: 4122766 - DNA, 16 bp, Homo sapiens
agcagagtctgggcct

SEQ ID NO: 4122767 - DNA, 17 bp, Homo sapiens
agcagagtgcacagctg

SEQ ID NO: 4122768 - DNA, 18 bp, Homo sapiens
agcagagtgcacagctgt

SEQ ID NO: 4122769 - DNA, 13 bp, Homo sapiens
agcagagtgctgg

SEQ ID NO: 4122770 - DNA, 14 bp, Homo sapiens
agcagagtgctggc

SEQ ID NO: 4122771 - DNA, 17 bp, Homo sapiens
agcagagtgctggcact

SEQ ID NO: 4122772 - DNA, 20 bp, Homo sapiens
agcagatacatatgagtgtg

SEQ ID NO: 4122773 - DNA, 18 bp, Homo sapiens
agcagatacctcaccctg

SEQ ID NO: 4122774 - DNA, 21 bp, Homo sapiens
agcagatgcagagagccattt

SEQ ID NO: 4122775 - DNA, 14 bp, Homo sapiens
agcagatggacagc

SEQ ID NO: 4122776 - DNA, 13 bp, Homo sapiens
agcagattttaat

SEQ ID NO: 4122777 - DNA, 16 bp, Homo sapiens
agcagcaactgaagac

SEQ ID NO: 4122778 - DNA, 18 bp, Homo sapiens
agcagcaaggtcttgctc

SEQ ID NO: 4122779 - DNA, 23 bp, Homo sapiens
agcagcaaggtcttgctctccta

SEQ ID NO: 4122780 - DNA, 19 bp, Homo sapiens
agcagcagcctttaatgca

SEQ ID NO: 4122781 - DNA, 14 bp, Homo sapiens
agcagcatggaaaa

SEQ ID NO: 4122782 - DNA, 19 bp, Homo sapiens
agcagcatggaaaaatggt

SEQ ID NO: 4122783 - DNA, 20 bp, Homo sapiens
agcagcatggaaaaatggtt

SEQ ID NO: 4122784 - DNA, 18 bp, Homo sapiens
agcagcattctggagggg

SEQ ID NO: 4122785 - DNA, 22 bp, Homo sapiens
agcagcattctggaggggagag

SEQ ID NO: 4122786 - DNA, 23 bp, Homo sapiens
agcagcatttttaattttcacaa

SEQ ID NO: 4122787 - DNA, 13 bp, Homo sapiens
agcagcccaagct

SEQ ID NO: 4122788 - DNA, 13 bp, Homo sapiens
agcagccccccag

SEQ ID NO: 4122789 - DNA, 17 bp, Homo sapiens
agcagccccccagcact

SEQ ID NO: 4122790 - DNA, 15 bp, Homo sapiens
agcagccccgggagg

SEQ ID NO: 4122791 - DNA, 19 bp, Homo sapiens
agcagccccgtctgcccac

SEQ ID NO: 4122792 - DNA, 18 bp, Homo sapiens
agcagccctaaggatctc

SEQ ID NO: 4122793 - DNA, 19 bp, Homo sapiens
agcagcctccttatatttg

SEQ ID NO: 4122794 - DNA, 13 bp, Homo sapiens
agcagcctgagca

SEQ ID NO: 4122795 - DNA, 19 bp, Homo sapiens
agcagcctgagcaactctt

SEQ ID NO: 4122796 - DNA, 23 bp, Homo sapiens
agcagcgaccgccccctcctcta

SEQ ID NO: 4122797 - DNA, 23 bp, Homo sapiens
agcagcggtttggggagcagaga

SEQ ID NO: 4122798 - DNA, 18 bp, Homo sapiens
agcagctccccaggagct

SEQ ID NO: 4122799 - DNA, 15 bp, Homo sapiens
agcagctccctttct

SEQ ID NO: 4122800 - DNA, 19 bp, Homo sapiens
agcagctccctttctcagg

SEQ ID NO: 4122801 - DNA, 23 bp, Homo sapiens
agcagctctgctatgagtgtgtg

SEQ ID NO: 4122802 - DNA, 18 bp, Homo sapiens
agcagctgaagaaaaaat

SEQ ID NO: 4122803 - DNA, 15 bp, Homo sapiens
agcagcttcaccaga

SEQ ID NO: 4122804 - DNA, 19 bp, Homo sapiens
agcagctttaaactcaggg

SEQ ID NO: 4122805 - DNA, 18 bp, Homo sapiens
agcagctttgggatccca

SEQ ID NO: 4122806 - DNA, 23 bp, Homo sapiens
agcagctttgggatcccaccctg

SEQ ID NO: 4122807 - DNA, 20 bp, Homo sapiens
agcaggaatatatgtgtgcc

SEQ ID NO: 4122808 - DNA, 20 bp, Homo sapiens
agcaggacctggcatcatgg

SEQ ID NO: 4122809 - DNA, 15 bp, Homo sapiens
agcaggactccaggc

SEQ ID NO: 4122810 - DNA, 22 bp, Homo sapiens
agcaggactccaggcccaaggc

SEQ ID NO: 4122811 - DNA, 22 bp, Homo sapiens
agcaggagacgacaggcgagag

SEQ ID NO: 4122812 - DNA, 18 bp, Homo sapiens
agcaggagagactgagca

SEQ ID NO: 4122813 - DNA, 23 bp, Homo sapiens
agcaggagagaggctctggggca

SEQ ID NO: 4122814 - DNA, 19 bp, Homo sapiens
agcaggagccccgccacag

SEQ ID NO: 4122815 - DNA, 23 bp, Homo sapiens
agcaggaggccaataaaaagttc

SEQ ID NO: 4122816 - DNA, 13 bp, Homo sapiens
agcaggcagcctt

SEQ ID NO: 4122817 - DNA, 14 bp, Homo sapiens
agcaggccggaacc

SEQ ID NO: 4122818 - DNA, 20 bp, Homo sapiens
agcaggcctaagacatgtga

SEQ ID NO: 4122819 - DNA, 14 bp, Homo sapiens
agcagggaaggcct

SEQ ID NO: 4122820 - DNA, 22 bp, Homo sapiens
agcagggattaacctctgcact

SEQ ID NO: 4122821 - DNA, 21 bp, Homo sapiens
agcaggggtggggggtgcagg

SEQ ID NO: 4122822 - DNA, 21 bp, Homo sapiens
agcagggtaccctttggggag

SEQ ID NO: 4122823 - DNA, 18 bp, Homo sapiens
agcagggtcgggaaaggc

SEQ ID NO: 4122824 - DNA, 13 bp, Homo sapiens
agcaggtgctgac

SEQ ID NO: 4122825 - DNA, 18 bp, Homo sapiens
agcaggtggtcctgagac

SEQ ID NO: 4122826 - DNA, 18 bp, Homo sapiens
agcaggtgtgagggcagt

SEQ ID NO: 4122827 - DNA, 23 bp, Homo sapiens
agcaggttcccaagctcagaggc

SEQ ID NO: 4122828 - DNA, 17 bp, Homo sapiens
agcagtaaatttgctag

SEQ ID NO: 4122829 - DNA, 21 bp, Homo sapiens
agcagtagaaataatatgcat

SEQ ID NO: 4122830 - DNA, 22 bp, Homo sapiens
agcagtagaaataatatgcatt

SEQ ID NO: 4122831 - DNA, 13 bp, Homo sapiens
agcagtcacactg

SEQ ID NO: 4122832 - DNA, 16 bp, Homo sapiens
agcagtcagagtccag

SEQ ID NO: 4122833 - DNA, 15 bp, Homo sapiens
agcagtcttgctctg

SEQ ID NO: 4122834 - DNA, 23 bp, Homo sapiens
agcagtgagttacagcgagaggc

SEQ ID NO: 4122835 - DNA, 16 bp, Homo sapiens
agcagtgatctcaggg

SEQ ID NO: 4122836 - DNA, 19 bp, Homo sapiens
agcagtgatctcagggcag

SEQ ID NO: 4122837 - DNA, 17 bp, Homo sapiens
agcagtgccttccataa

SEQ ID NO: 4122838 - DNA, 19 bp, Homo sapiens
agcagtgccttccataatt

SEQ ID NO: 4122839 - DNA, 16 bp, Homo sapiens
agcagtggagcccagg

SEQ ID NO: 4122840 - DNA, 18 bp, Homo sapiens
agcagtggagcccaggag

SEQ ID NO: 4122841 - DNA, 13 bp, Homo sapiens
agcagtggctggt

SEQ ID NO: 4122842 - DNA, 20 bp, Homo sapiens
agcagtgtggagaccctgcc

SEQ ID NO: 4122843 - DNA, 21 bp, Homo sapiens
agcagtgttccccatctgggt

SEQ ID NO: 4122844 - DNA, 14 bp, Homo sapiens
agcagtgttctcac

SEQ ID NO: 4122845 - DNA, 22 bp, Homo sapiens
agcagttaactttaagactgag

SEQ ID NO: 4122846 - DNA, 13 bp, Homo sapiens
agcagttttcaag

SEQ ID NO: 4122847 - DNA, 22 bp, Homo sapiens
agcagttttcaagtcaaattaa

SEQ ID NO: 4122848 - DNA, 17 bp, Homo sapiens
agcataaataaaactga

SEQ ID NO: 4122849 - DNA, 23 bp, Homo sapiens
agcataagtttctgggacctcag

SEQ ID NO: 4122850 - DNA, 23 bp, Homo sapiens
agcatacaggttaacctgcagaa

SEQ ID NO: 4122851 - DNA, 14 bp, Homo sapiens
agcatacatttata

SEQ ID NO: 4122852 - DNA, 16 bp, Homo sapiens
agcatagcttattatt

SEQ ID NO: 4122853 - DNA, 23 bp, Homo sapiens
agcatatgggtgggattttgcaa

SEQ ID NO: 4122854 - DNA, 19 bp, Homo sapiens
agcatattaatgcgatttc

SEQ ID NO: 4122855 - DNA, 23 bp, Homo sapiens
agcatcactaaaccgataatgca

SEQ ID NO: 4122856 - DNA, 13 bp, Homo sapiens
agcatcagtcccc

SEQ ID NO: 4122857 - DNA, 14 bp, Homo sapiens
agcatcatcctgca

SEQ ID NO: 4122858 - DNA, 16 bp, Homo sapiens
agcatcattttgcatt

SEQ ID NO: 4122859 - DNA, 20 bp, Homo sapiens
agcatcattttgcattcaaa

SEQ ID NO: 4122860 - DNA, 20 bp, Homo sapiens
agcatccctgaggagccagg

SEQ ID NO: 4122861 - DNA, 14 bp, Homo sapiens
agcatccctggagc

SEQ ID NO: 4122862 - DNA, 14 bp, Homo sapiens
agcatcccttccca

SEQ ID NO: 4122863 - DNA, 21 bp, Homo sapiens
agcatccgcaggtgctggtcc

SEQ ID NO: 4122864 - DNA, 17 bp, Homo sapiens
agcatcctaagaaatat

SEQ ID NO: 4122865 - DNA, 23 bp, Homo sapiens
agcatcctaagaaatatgtgaga

SEQ ID NO: 4122866 - DNA, 22 bp, Homo sapiens
agcatcggacaagacccccagc

SEQ ID NO: 4122867 - DNA, 23 bp, Homo sapiens
agcatcggacaagacccccagca

SEQ ID NO: 4122868 - DNA, 18 bp, Homo sapiens
agcatcgggagcacccag

SEQ ID NO: 4122869 - DNA, 22 bp, Homo sapiens
agcatctcttgaggccaggagt

SEQ ID NO: 4122870 - DNA, 17 bp, Homo sapiens
agcatctggaagagcta

SEQ ID NO: 4122871 - DNA, 12 bp, Homo sapiens
agcatctggctg

SEQ ID NO: 4122872 - DNA, 13 bp, Homo sapiens
agcatctggctgt

SEQ ID NO: 4122873 - DNA, 23 bp, Homo sapiens
agcatcttcacttctaaatgcat

SEQ ID NO: 4122874 - DNA, 14 bp, Homo sapiens
agcatgaaaaagca

SEQ ID NO: 4122875 - DNA, 16 bp, Homo sapiens
agcatgaacagtgcac

SEQ ID NO: 4122876 - DNA, 22 bp, Homo sapiens
agcatgaatggtatggaactct

SEQ ID NO: 4122877 - DNA, 15 bp, Homo sapiens
agcatgacagcctgc

SEQ ID NO: 4122878 - DNA, 13 bp, Homo sapiens
agcatgagacttt

SEQ ID NO: 4122879 - DNA, 12 bp, Homo sapiens
agcatgcccctt

SEQ ID NO: 4122880 - DNA, 16 bp, Homo sapiens
agcatgccccttggct

SEQ ID NO: 4122881 - DNA, 15 bp, Homo sapiens
agcatgccttcaaat

SEQ ID NO: 4122882 - DNA, 14 bp, Homo sapiens
agcatgcttcccag

SEQ ID NO: 4122883 - DNA, 16 bp, Homo sapiens
agcatgcttcccagag

SEQ ID NO: 4122884 - DNA, 20 bp, Homo sapiens
agcatggaaaaatggttgat

SEQ ID NO: 4122885 - DNA, 20 bp, Homo sapiens
agcatggcatagccccggcc

SEQ ID NO: 4122886 - DNA, 15 bp, Homo sapiens
agcatggggttttta

SEQ ID NO: 4122887 - DNA, 21 bp, Homo sapiens
agcatgtaatgttaatgttat

SEQ ID NO: 4122888 - DNA, 16 bp, Homo sapiens
agcatgtgtcagagtg

SEQ ID NO: 4122889 - DNA, 16 bp, Homo sapiens
agcatgtgtcccagga

SEQ ID NO: 4122890 - DNA, 21 bp, Homo sapiens
agcatgttgagccaggcctgg

SEQ ID NO: 4122891 - DNA, 16 bp, Homo sapiens
agcattatgcaattag

SEQ ID NO: 4122892 - DNA, 15 bp, Homo sapiens
agcattccttctttg

SEQ ID NO: 4122893 - DNA, 23 bp, Homo sapiens
agcattccttctttgataatgtt

SEQ ID NO: 4122894 - DNA, 14 bp, Homo sapiens
agcattcggaggga

SEQ ID NO: 4122895 - DNA, 13 bp, Homo sapiens
agcattctcccca

SEQ ID NO: 4122896 - DNA, 16 bp, Homo sapiens
agcattcttgtcacaa

SEQ ID NO: 4122897 - DNA, 20 bp, Homo sapiens
agcattcttgtcacaataaa

SEQ ID NO: 4122898 - DNA, 21 bp, Homo sapiens
agcattcttgtcacaataaat

SEQ ID NO: 4122899 - DNA, 22 bp, Homo sapiens
agcattcttgtcacaataaatg

SEQ ID NO: 4122900 - DNA, 15 bp, Homo sapiens
agcattgaaattata

SEQ ID NO: 4122901 - DNA, 13 bp, Homo sapiens
agcattgcatgga

SEQ ID NO: 4122902 - DNA, 16 bp, Homo sapiens
agcattgctgttatgt

SEQ ID NO: 4122903 - DNA, 14 bp, Homo sapiens
agcattgctttctg

SEQ ID NO: 4122904 - DNA, 17 bp, Homo sapiens
agcattgctttctgaaa

SEQ ID NO: 4122905 - DNA, 18 bp, Homo sapiens
agcattgtcttaattttt

SEQ ID NO: 4122906 - DNA, 21 bp, Homo sapiens
agcattgtttgcttattgttc

SEQ ID NO: 4122907 - DNA, 23 bp, Homo sapiens
agcattgtttgcttattgttcca

SEQ ID NO: 4122908 - DNA, 20 bp, Homo sapiens
agcatttaatggcagctagt

SEQ ID NO: 4122909 - DNA, 22 bp, Homo sapiens
agcatttaatggcagctagtgc

SEQ ID NO: 4122910 - DNA, 15 bp, Homo sapiens
agcatttatcattct

SEQ ID NO: 4122911 - DNA, 23 bp, Homo sapiens
agcatttccaacaccacagacac

SEQ ID NO: 4122912 - DNA, 20 bp, Homo sapiens
agcatttcttttctggccaa

SEQ ID NO: 4122913 - DNA, 17 bp, Homo sapiens
agcatttttaattttca

SEQ ID NO: 4122914 - DNA, 13 bp, Homo sapiens
agcatttttcaat

SEQ ID NO: 4122915 - DNA, 22 bp, Homo sapiens
agcatttttttattcagcagac

SEQ ID NO: 4122916 - DNA, 17 bp, Homo sapiens
agccaaaagtccctccc

SEQ ID NO: 4122917 - DNA, 20 bp, Homo sapiens
agccaaaagtccctccctgc

SEQ ID NO: 4122918 - DNA, 22 bp, Homo sapiens
agccaaaagtccctccctgcct

SEQ ID NO: 4122919 - DNA, 23 bp, Homo sapiens
agccaaaagtccctccctgcctg

SEQ ID NO: 4122920 - DNA, 16 bp, Homo sapiens
agccaaaccctgtctg

SEQ ID NO: 4122921 - DNA, 12 bp, Homo sapiens
agccaaagaaaa

SEQ ID NO: 4122922 - DNA, 22 bp, Homo sapiens
agccaaatgcagggaggggagg

SEQ ID NO: 4122923 - DNA, 17 bp, Homo sapiens
agccaacaggtggcagg

SEQ ID NO: 4122924 - DNA, 13 bp, Homo sapiens
agccaactctggg

SEQ ID NO: 4122925 - DNA, 18 bp, Homo sapiens
agccaacttgtaaataca

SEQ ID NO: 4122926 - DNA, 20 bp, Homo sapiens
agccaacttgtaaatacacc

SEQ ID NO: 4122927 - DNA, 15 bp, Homo sapiens
agccaacttttgcat

SEQ ID NO: 4122928 - DNA, 19 bp, Homo sapiens
agccaagacaaggaggtag

SEQ ID NO: 4122929 - DNA, 20 bp, Homo sapiens
agccaagattttcctcttgt

SEQ ID NO: 4122930 - DNA, 20 bp, Homo sapiens
agccaagcaaaccaatggtg

SEQ ID NO: 4122931 - DNA, 23 bp, Homo sapiens
agccaagggaaaggggtgctttt

SEQ ID NO: 4122932 - DNA, 17 bp, Homo sapiens
agccaagggtatccaag

SEQ ID NO: 4122933 - DNA, 16 bp, Homo sapiens
agccaagtggggtgct

SEQ ID NO: 4122934 - DNA, 16 bp, Homo sapiens
agccaattcagacagg

SEQ ID NO: 4122935 - DNA, 18 bp, Homo sapiens
agccaattcagacaggca

SEQ ID NO: 4122936 - DNA, 15 bp, Homo sapiens
agccacaaggctggc

SEQ ID NO: 4122937 - DNA, 18 bp, Homo sapiens
agccacaaggctggccag

SEQ ID NO: 4122938 - DNA, 20 bp, Homo sapiens
agccacaaggctggccagca

SEQ ID NO: 4122939 - DNA, 16 bp, Homo sapiens
agccacaagtcttcca

SEQ ID NO: 4122940 - DNA, 18 bp, Homo sapiens
agccacaagtcttccaga

SEQ ID NO: 4122941 - DNA, 18 bp, Homo sapiens
agccacagaccacctgct

SEQ ID NO: 4122942 - DNA, 13 bp, Homo sapiens
agccacagctgct

SEQ ID NO: 4122943 - DNA, 18 bp, Homo sapiens
agccacagctgctgttct

SEQ ID NO: 4122944 - DNA, 13 bp, Homo sapiens
agccacaggaagg

SEQ ID NO: 4122945 - DNA, 18 bp, Homo sapiens
agccacatccccaagccc

SEQ ID NO: 4122946 - DNA, 23 bp, Homo sapiens
agccacatccctttgaaacaaga

SEQ ID NO: 4122947 - DNA, 23 bp, Homo sapiens
agccacatttggaatactttttg

SEQ ID NO: 4122948 - DNA, 14 bp, Homo sapiens
agccaccagtgtcc

SEQ ID NO: 4122949 - DNA, 20 bp, Homo sapiens
agccaccccgggctctctgc

SEQ ID NO: 4122950 - DNA, 18 bp, Homo sapiens
agccaccgtgcctggcca

SEQ ID NO: 4122951 - DNA, 14 bp, Homo sapiens
agccacctctccct

SEQ ID NO: 4122952 - DNA, 23 bp, Homo sapiens
agccaccttttgggaatgtttta

SEQ ID NO: 4122953 - DNA, 15 bp, Homo sapiens
agccacgattggaga

SEQ ID NO: 4122954 - DNA, 17 bp, Homo sapiens
agccacgattggagaat

SEQ ID NO: 4122955 - DNA, 14 bp, Homo sapiens
agccacgctgtcct

SEQ ID NO: 4122956 - DNA, 20 bp, Homo sapiens
agccacgctgtcctctcgag

SEQ ID NO: 4122957 - DNA, 15 bp, Homo sapiens
agccactcgggaggc

SEQ ID NO: 4122958 - DNA, 20 bp, Homo sapiens
agccactctcttccctttcc

SEQ ID NO: 4122959 - DNA, 22 bp, Homo sapiens
agccagaagccacccaaagcag

SEQ ID NO: 4122960 - DNA, 13 bp, Homo sapiens
agccagagcccca

SEQ ID NO: 4122961 - DNA, 16 bp, Homo sapiens
agccagagccccaagc

SEQ ID NO: 4122962 - DNA, 21 bp, Homo sapiens
agccagaggagggcagaggga

SEQ ID NO: 4122963 - DNA, 15 bp, Homo sapiens
agccagatcctcttg

SEQ ID NO: 4122964 - DNA, 19 bp, Homo sapiens
agccagatgcaggacagga

SEQ ID NO: 4122965 - DNA, 22 bp, Homo sapiens
agccagatgcaggacaggaggc

SEQ ID NO: 4122966 - DNA, 13 bp, Homo sapiens
agccagcacacag

SEQ ID NO: 4122967 - DNA, 15 bp, Homo sapiens
agccagcacacaggg

SEQ ID NO: 4122968 - DNA, 17 bp, Homo sapiens
agccagcacacagggca

SEQ ID NO: 4122969 - DNA, 19 bp, Homo sapiens
agccagcacacagggcagt

SEQ ID NO: 4122970 - DNA, 22 bp, Homo sapiens
agccagcacttgtccagctgag

SEQ ID NO: 4122971 - DNA, 16 bp, Homo sapiens
agccagcagcagccca

SEQ ID NO: 4122972 - DNA, 21 bp, Homo sapiens
agccagcagcagcccaagctt

SEQ ID NO: 4122973 - DNA, 16 bp, Homo sapiens
agccagcccctcttcc

SEQ ID NO: 4122974 - DNA, 16 bp, Homo sapiens
agccagccgccctggg

SEQ ID NO: 4122975 - DNA, 21 bp, Homo sapiens
agccagctcacagtgctgtgt

SEQ ID NO: 4122976 - DNA, 15 bp, Homo sapiens
agccagctccctcta

SEQ ID NO: 4122977 - DNA, 22 bp, Homo sapiens
agccagctccctctatttatgt

SEQ ID NO: 4122978 - DNA, 20 bp, Homo sapiens
agccaggaagtacttccacc

SEQ ID NO: 4122979 - DNA, 21 bp, Homo sapiens
agccaggaatttcccaggacc

SEQ ID NO: 4122980 - DNA, 15 bp, Homo sapiens
agccaggagctgtca

SEQ ID NO: 4122981 - DNA, 11 bp, Homo sapiens
agccaggaggg

SEQ ID NO: 4122982 - DNA, 20 bp, Homo sapiens
agccaggatcatggtgtaat

SEQ ID NO: 4122983 - DNA, 14 bp, Homo sapiens
agccaggcctggct

SEQ ID NO: 4122984 - DNA, 22 bp, Homo sapiens
agccaggcctgggtctgtgtct

SEQ ID NO: 4122985 - DNA, 23 bp, Homo sapiens
agccaggcgctagcacagctccc

SEQ ID NO: 4122986 - DNA, 17 bp, Homo sapiens
agccaggctgagtgagc

SEQ ID NO: 4122987 - DNA, 12 bp, Homo sapiens
agccagggccag

SEQ ID NO: 4122988 - DNA, 17 bp, Homo sapiens
agccagggccaggggtc

SEQ ID NO: 4122989 - DNA, 16 bp, Homo sapiens
agccagtgacctttga

SEQ ID NO: 4122990 - DNA, 21 bp, Homo sapiens
agccagtgacctttgacctcg

SEQ ID NO: 4122991 - DNA, 16 bp, Homo sapiens
agccagtgagggcagt

SEQ ID NO: 4122992 - DNA, 14 bp, Homo sapiens
agccagtgccattc

SEQ ID NO: 4122993 - DNA, 18 bp, Homo sapiens
agccagtggcgggtgatg

SEQ ID NO: 4122994 - DNA, 23 bp, Homo sapiens
agccagtggcgggtgatggccag

SEQ ID NO: 4122995 - DNA, 13 bp, Homo sapiens
agccataaatgat

SEQ ID NO: 4122996 - DNA, 20 bp, Homo sapiens
agccatatatgaccagaagc

SEQ ID NO: 4122997 - DNA, 21 bp, Homo sapiens
agccatatatgaccagaagcc

SEQ ID NO: 4122998 - DNA, 22 bp, Homo sapiens
agccatatcatgctaaaattct

SEQ ID NO: 4122999 - DNA, 18 bp, Homo sapiens
agccatcaaaatgctttt

SEQ ID NO: 4123000 - DNA, 23 bp, Homo sapiens
agccatcactagaagaaaagccc

SEQ ID NO: 4123001 - DNA, 19 bp, Homo sapiens
agccatcctccctccacct

SEQ ID NO: 4123002 - DNA, 22 bp, Homo sapiens
agccatcctccctccacctcaa

SEQ ID NO: 4123003 - DNA, 22 bp, Homo sapiens
agccatcggtgaaactaacaga

SEQ ID NO: 4123004 - DNA, 17 bp, Homo sapiens
agccatgtataaatgtg

SEQ ID NO: 4123005 - DNA, 18 bp, Homo sapiens
agccatgtataaatgtga

SEQ ID NO: 4123006 - DNA, 18 bp, Homo sapiens
agccattgcggccccagg

SEQ ID NO: 4123007 - DNA, 22 bp, Homo sapiens
agccatttgttggggcagtggt

SEQ ID NO: 4123008 - DNA, 19 bp, Homo sapiens
agccattttgtgaatggat

SEQ ID NO: 4123009 - DNA, 21 bp, Homo sapiens
agcccaagcttaatagccctc

SEQ ID NO: 4123010 - DNA, 16 bp, Homo sapiens
agcccaagcttccctc

SEQ ID NO: 4123011 - DNA, 16 bp, Homo sapiens
agcccaatattataat

SEQ ID NO: 4123012 - DNA, 17 bp, Homo sapiens
agcccacacttgagagg

SEQ ID NO: 4123013 - DNA, 23 bp, Homo sapiens
agcccaccagacgtcaggccctg

SEQ ID NO: 4123014 - DNA, 11 bp, Homo sapiens
agcccaccagg

SEQ ID NO: 4123015 - DNA, 15 bp, Homo sapiens
agcccactgtcctgg

SEQ ID NO: 4123016 - DNA, 19 bp, Homo sapiens
agcccactgtcctgggcct

SEQ ID NO: 4123017 - DNA, 12 bp, Homo sapiens
agcccagacaaa

SEQ ID NO: 4123018 - DNA, 14 bp, Homo sapiens
agcccagagaacag

SEQ ID NO: 4123019 - DNA, 21 bp, Homo sapiens
agcccagagacatacttgaag

SEQ ID NO: 4123020 - DNA, 14 bp, Homo sapiens
agcccagagccacc

SEQ ID NO: 4123021 - DNA, 18 bp, Homo sapiens
agcccagagccacctgga

SEQ ID NO: 4123022 - DNA, 21 bp, Homo sapiens
agcccagagcctggctgccca

SEQ ID NO: 4123023 - DNA, 21 bp, Homo sapiens
agcccagaggtaacagaacag

SEQ ID NO: 4123024 - DNA, 13 bp, Homo sapiens
agcccagcactgt

SEQ ID NO: 4123025 - DNA, 20 bp, Homo sapiens
agcccagcactgtgaagacc

SEQ ID NO: 4123026 - DNA, 24 bp, Homo sapiens
agcccagcactgtgaagacccagc

SEQ ID NO: 4123027 - DNA, 20 bp, Homo sapiens
agcccagccaggccaacagc

SEQ ID NO: 4123028 - DNA, 12 bp, Homo sapiens
agcccagcccct

SEQ ID NO: 4123029 - DNA, 16 bp, Homo sapiens
agcccagcctgggagc

SEQ ID NO: 4123030 - DNA, 17 bp, Homo sapiens
agcccagcctgggagcc

SEQ ID NO: 4123031 - DNA, 16 bp, Homo sapiens
agcccagctgcctgga

SEQ ID NO: 4123032 - DNA, 17 bp, Homo sapiens
agcccagctgcctggag

SEQ ID NO: 4123033 - DNA, 19 bp, Homo sapiens
agcccaggagggagcagag

SEQ ID NO: 4123034 - DNA, 22 bp, Homo sapiens
agcccaggagggcatccatacc

SEQ ID NO: 4123035 - DNA, 12 bp, Homo sapiens
agcccaggccac

SEQ ID NO: 4123036 - DNA, 22 bp, Homo sapiens
agcccaggccggggtggagcat

SEQ ID NO: 4123037 - DNA, 16 bp, Homo sapiens
agcccagtgaagcctc

SEQ ID NO: 4123038 - DNA, 19 bp, Homo sapiens
agcccatactcagcctgct

SEQ ID NO: 4123039 - DNA, 17 bp, Homo sapiens
agcccatccaaacactg

SEQ ID NO: 4123040 - DNA, 18 bp, Homo sapiens
agcccatctgcctgttct

SEQ ID NO: 4123041 - DNA, 16 bp, Homo sapiens
agcccatgcccacctg

SEQ ID NO: 4123042 - DNA, 22 bp, Homo sapiens
agcccatgcccacctgcccatc

SEQ ID NO: 4123043 - DNA, 14 bp, Homo sapiens
agccccacacagct

SEQ ID NO: 4123044 - DNA, 13 bp, Homo sapiens
agccccacccagg

SEQ ID NO: 4123045 - DNA, 16 bp, Homo sapiens
agccccacccaggagg

SEQ ID NO: 4123046 - DNA, 22 bp, Homo sapiens
agccccacctctccaagtctct

SEQ ID NO: 4123047 - DNA, 17 bp, Homo sapiens
agccccagcagccctca

SEQ ID NO: 4123048 - DNA, 12 bp, Homo sapiens
agccccaggcct

SEQ ID NO: 4123049 - DNA, 18 bp, Homo sapiens
agccccaggcctctgtgt

SEQ ID NO: 4123050 - DNA, 10 bp, Homo sapiens
agccccaggg

SEQ ID NO: 4123051 - DNA, 16 bp, Homo sapiens
agccccaggggacaag

SEQ ID NO: 4123052 - DNA, 22 bp, Homo sapiens
agccccagggtcttccctacct

SEQ ID NO: 4123053 - DNA, 23 bp, Homo sapiens
agccccagggtcttccctacctc

SEQ ID NO: 4123054 - DNA, 18 bp, Homo sapiens
agccccagggtgcccaga

SEQ ID NO: 4123055 - DNA, 17 bp, Homo sapiens
agccccatccctgtcct

SEQ ID NO: 4123056 - DNA, 19 bp, Homo sapiens
agcccccaccttgatccca

SEQ ID NO: 4123057 - DNA, 22 bp, Homo sapiens
agcccccaccttgatcccaatc

SEQ ID NO: 4123058 - DNA, 21 bp, Homo sapiens
agcccccagatagagctgggt

SEQ ID NO: 4123059 - DNA, 13 bp, Homo sapiens
agcccccaggaag

SEQ ID NO: 4123060 - DNA, 17 bp, Homo sapiens
agcccccagggcctcca

SEQ ID NO: 4123061 - DNA, 21 bp, Homo sapiens
agcccccagggcctccagggc

SEQ ID NO: 4123062 - DNA, 20 bp, Homo sapiens
agcccccatgggctcctgcc

SEQ ID NO: 4123063 - DNA, 15 bp, Homo sapiens
agcccccgccccaga

SEQ ID NO: 4123064 - DNA, 16 bp, Homo sapiens
agcccccgccccagag

SEQ ID NO: 4123065 - DNA, 13 bp, Homo sapiens
agccccctccaca

SEQ ID NO: 4123066 - DNA, 17 bp, Homo sapiens
agccccctggcctctgt

SEQ ID NO: 4123067 - DNA, 16 bp, Homo sapiens
agccccgagctgtccc

SEQ ID NO: 4123068 - DNA, 15 bp, Homo sapiens
agccccggcaagcca

SEQ ID NO: 4123069 - DNA, 21 bp, Homo sapiens
agccccggccctgggctcgga

SEQ ID NO: 4123070 - DNA, 24 bp, Homo sapiens
agccccggggtgagtccattctcc

SEQ ID NO: 4123071 - DNA, 17 bp, Homo sapiens
agccccggtggctgggc

SEQ ID NO: 4123072 - DNA, 18 bp, Homo sapiens
agcccctatagcactgag

SEQ ID NO: 4123073 - DNA, 21 bp, Homo sapiens
agcccctatagcactgagctc

SEQ ID NO: 4123074 - DNA, 10 bp, Homo sapiens
agcccctccc

SEQ ID NO: 4123075 - DNA, 13 bp, Homo sapiens
agcccctccccca

SEQ ID NO: 4123076 - DNA, 12 bp, Homo sapiens
agcccctgcccc

SEQ ID NO: 4123077 - DNA, 17 bp, Homo sapiens
agcccctggggcccagc

SEQ ID NO: 4123078 - DNA, 19 bp, Homo sapiens
agcccctggggcccagccc

SEQ ID NO: 4123079 - DNA, 20 bp, Homo sapiens
agcccctggggcccagcccc

SEQ ID NO: 4123080 - DNA, 23 bp, Homo sapiens
agccccttctcccagcacacggc

SEQ ID NO: 4123081 - DNA, 19 bp, Homo sapiens
agccccttctgctcagctc

SEQ ID NO: 4123082 - DNA, 18 bp, Homo sapiens
agccccttgctctcagct

SEQ ID NO: 4123083 - DNA, 14 bp, Homo sapiens
agcccggatgcttc

SEQ ID NO: 4123084 - DNA, 21 bp, Homo sapiens
agcccggcctgctcccagcag

SEQ ID NO: 4123085 - DNA, 16 bp, Homo sapiens
agcccggcgcccctgc

SEQ ID NO: 4123086 - DNA, 19 bp, Homo sapiens
agcccgttagccccaggga

SEQ ID NO: 4123087 - DNA, 16 bp, Homo sapiens
agccctaaggatctct

SEQ ID NO: 4123088 - DNA, 21 bp, Homo sapiens
agccctaaggatctctcagga

SEQ ID NO: 4123089 - DNA, 18 bp, Homo sapiens
agccctaagtggctgcct

SEQ ID NO: 4123090 - DNA, 17 bp, Homo sapiens
agccctacagagctgtg

SEQ ID NO: 4123091 - DNA, 15 bp, Homo sapiens
agccctagagcctgc

SEQ ID NO: 4123092 - DNA, 22 bp, Homo sapiens
agccctagagcctgcctggagc

SEQ ID NO: 4123093 - DNA, 16 bp, Homo sapiens
agccctcaacaggccc

SEQ ID NO: 4123094 - DNA, 18 bp, Homo sapiens
agccctcaacaggcccag

SEQ ID NO: 4123095 - DNA, 13 bp, Homo sapiens
agccctcagaaca

SEQ ID NO: 4123096 - DNA, 17 bp, Homo sapiens
agccctcagttccttca

SEQ ID NO: 4123097 - DNA, 12 bp, Homo sapiens
agccctccccct

SEQ ID NO: 4123098 - DNA, 16 bp, Homo sapiens
agccctcccccttccc

SEQ ID NO: 4123099 - DNA, 20 bp, Homo sapiens
agccctcccccttccccttc

SEQ ID NO: 4123100 - DNA, 21 bp, Homo sapiens
agccctcccccttccccttct

SEQ ID NO: 4123101 - DNA, 13 bp, Homo sapiens
agccctccctgcc

SEQ ID NO: 4123102 - DNA, 15 bp, Homo sapiens
agccctccctgcccc

SEQ ID NO: 4123103 - DNA, 16 bp, Homo sapiens
agccctccctgcccct

SEQ ID NO: 4123104 - DNA, 22 bp, Homo sapiens
agccctccctgcccctcccttc

SEQ ID NO: 4123105 - DNA, 12 bp, Homo sapiens
agccctgacctt

SEQ ID NO: 4123106 - DNA, 16 bp, Homo sapiens
agccctgaccttggct

SEQ ID NO: 4123107 - DNA, 17 bp, Homo sapiens
agccctgactggtgcta

SEQ ID NO: 4123108 - DNA, 21 bp, Homo sapiens
agccctgaggtgaaagggagc

SEQ ID NO: 4123109 - DNA, 22 bp, Homo sapiens
agccctgaggtgaaagggagct

SEQ ID NO: 4123110 - DNA, 23 bp, Homo sapiens
agccctgatgtgtcctcagggag

SEQ ID NO: 4123111 - DNA, 13 bp, Homo sapiens
agccctgccctgc

SEQ ID NO: 4123112 - DNA, 12 bp, Homo sapiens
agccctgctccc

SEQ ID NO: 4123113 - DNA, 13 bp, Homo sapiens
agccctgctccct

SEQ ID NO: 4123114 - DNA, 17 bp, Homo sapiens
agccctgctttgggctg

SEQ ID NO: 4123115 - DNA, 14 bp, Homo sapiens
agccctggctctgc

SEQ ID NO: 4123116 - DNA, 15 bp, Homo sapiens
agccctggctctgca

SEQ ID NO: 4123117 - DNA, 14 bp, Homo sapiens
agccctggctgggt

SEQ ID NO: 4123118 - DNA, 12 bp, Homo sapiens
agccctggctgt

SEQ ID NO: 4123119 - DNA, 13 bp, Homo sapiens
agccctggggact

SEQ ID NO: 4123120 - DNA, 18 bp, Homo sapiens
agccctggggactgttcc

SEQ ID NO: 4123121 - DNA, 15 bp, Homo sapiens
agccctgtcctggtt

SEQ ID NO: 4123122 - DNA, 18 bp, Homo sapiens
agccctgtcgagacactt

SEQ ID NO: 4123123 - DNA, 21 bp, Homo sapiens
agccctgtcgagacacttgcc

SEQ ID NO: 4123124 - DNA, 23 bp, Homo sapiens
agccctgtcgagacacttgcctt

SEQ ID NO: 4123125 - DNA, 22 bp, Homo sapiens
agccctgtctgctaggcgctgg

SEQ ID NO: 4123126 - DNA, 16 bp, Homo sapiens
agcccttcctctgctc

SEQ ID NO: 4123127 - DNA, 20 bp, Homo sapiens
agcccttcctctgctccccc

SEQ ID NO: 4123128 - DNA, 14 bp, Homo sapiens
agcccttgcctccc

SEQ ID NO: 4123129 - DNA, 23 bp, Homo sapiens
agcccttgcctccccatttccca

SEQ ID NO: 4123130 - DNA, 13 bp, Homo sapiens
agcccttgggcag

SEQ ID NO: 4123131 - DNA, 16 bp, Homo sapiens
agccgaatagctgatg

SEQ ID NO: 4123132 - DNA, 15 bp, Homo sapiens
agccgaccttccctc

SEQ ID NO: 4123133 - DNA, 12 bp, Homo sapiens
agccgactctgg

SEQ ID NO: 4123134 - DNA, 19 bp, Homo sapiens
agccgactctggccctggc

SEQ ID NO: 4123135 - DNA, 23 bp, Homo sapiens
agccgactgcacagcggcccctg

SEQ ID NO: 4123136 - DNA, 18 bp, Homo sapiens
agccgagccgggcctggg

SEQ ID NO: 4123137 - DNA, 18 bp, Homo sapiens
agccgccattgccaccag

SEQ ID NO: 4123138 - DNA, 19 bp, Homo sapiens
agccgccattgccaccagg

SEQ ID NO: 4123139 - DNA, 14 bp, Homo sapiens
agccgccccagccc

SEQ ID NO: 4123140 - DNA, 15 bp, Homo sapiens
agccgccccagcccc

SEQ ID NO: 4123141 - DNA, 12 bp, Homo sapiens
agccgccctggg

SEQ ID NO: 4123142 - DNA, 13 bp, Homo sapiens
agccgccctgggc

SEQ ID NO: 4123143 - DNA, 17 bp, Homo sapiens
agccgccttaagctgat

SEQ ID NO: 4123144 - DNA, 19 bp, Homo sapiens
agccgctgtgagcccctgg

SEQ ID NO: 4123145 - DNA, 15 bp, Homo sapiens
agccggaaggccgag

SEQ ID NO: 4123146 - DNA, 19 bp, Homo sapiens
agccgggcctggggctcct

SEQ ID NO: 4123147 - DNA, 13 bp, Homo sapiens
agccggggcctta

SEQ ID NO: 4123148 - DNA, 16 bp, Homo sapiens
agccggtaactgtcct

SEQ ID NO: 4123149 - DNA, 18 bp, Homo sapiens
agccggtaactgtcctgt

SEQ ID NO: 4123150 - DNA, 21 bp, Homo sapiens
agccggtaactgtcctgtcct

SEQ ID NO: 4123151 - DNA, 19 bp, Homo sapiens
agccgtcagccaaatgtaa

SEQ ID NO: 4123152 - DNA, 17 bp, Homo sapiens
agccgtgaactgtgcat

SEQ ID NO: 4123153 - DNA, 17 bp, Homo sapiens
agccgtgatgctcaggc

SEQ ID NO: 4123154 - DNA, 15 bp, Homo sapiens
agccgtgccttcagc

SEQ ID NO: 4123155 - DNA, 22 bp, Homo sapiens
agccgtggcttcccgctcagcc

SEQ ID NO: 4123156 - DNA, 23 bp, Homo sapiens
agcctaatccctgggcattgctt

SEQ ID NO: 4123157 - DNA, 14 bp, Homo sapiens
agcctacctgtatg

SEQ ID NO: 4123158 - DNA, 17 bp, Homo sapiens
agcctagaagagcttct

SEQ ID NO: 4123159 - DNA, 13 bp, Homo sapiens
agcctagcggagc

SEQ ID NO: 4123160 - DNA, 19 bp, Homo sapiens
agcctagcggagcccagcc

SEQ ID NO: 4123161 - DNA, 17 bp, Homo sapiens
agcctaggaggactggg

SEQ ID NO: 4123162 - DNA, 14 bp, Homo sapiens
agcctagttcatcc

SEQ ID NO: 4123163 - DNA, 15 bp, Homo sapiens
agcctagttcatcca

SEQ ID NO: 4123164 - DNA, 20 bp, Homo sapiens
agcctatgggggctctcgga

SEQ ID NO: 4123165 - DNA, 16 bp, Homo sapiens
agcctatgttgtggtc

SEQ ID NO: 4123166 - DNA, 16 bp, Homo sapiens
agcctatttacctgca

SEQ ID NO: 4123167 - DNA, 16 bp, Homo sapiens
agcctcacttgccctc

SEQ ID NO: 4123168 - DNA, 12 bp, Homo sapiens
agcctcagagga

SEQ ID NO: 4123169 - DNA, 16 bp, Homo sapiens
agcctcagctacccac

SEQ ID NO: 4123170 - DNA, 14 bp, Homo sapiens
agcctcatatttaa

SEQ ID NO: 4123171 - DNA, 17 bp, Homo sapiens
agcctcatatttaaaga

SEQ ID NO: 4123172 - DNA, 20 bp, Homo sapiens
agcctcatatttaaagacag

SEQ ID NO: 4123173 - DNA, 20 bp, Homo sapiens
agcctccaagcacagagcct

SEQ ID NO: 4123174 - DNA, 23 bp, Homo sapiens
agcctccaagcacagagcctggc

SEQ ID NO: 4123175 - DNA, 13 bp, Homo sapiens
agcctccaagcct

SEQ ID NO: 4123176 - DNA, 19 bp, Homo sapiens
agcctccaagcctgcctcc

SEQ ID NO: 4123177 - DNA, 17 bp, Homo sapiens
agcctccatttagttct

SEQ ID NO: 4123178 - DNA, 13 bp, Homo sapiens
agcctcccacccc

SEQ ID NO: 4123179 - DNA, 16 bp, Homo sapiens
agcctccccacccagg

SEQ ID NO: 4123180 - DNA, 20 bp, Homo sapiens
agcctcccctccctgtatca

SEQ ID NO: 4123181 - DNA, 12 bp, Homo sapiens
agcctccctgaa

SEQ ID NO: 4123182 - DNA, 15 bp, Homo sapiens
agcctccctgaagcc

SEQ ID NO: 4123183 - DNA, 15 bp, Homo sapiens
agcctccctgtctcc

SEQ ID NO: 4123184 - DNA, 24 bp, Homo sapiens
agcctccctgtctccagctgcctg

SEQ ID NO: 4123185 - DNA, 14 bp, Homo sapiens
agcctccgagaggg

SEQ ID NO: 4123186 - DNA, 16 bp, Homo sapiens
agcctccgagagggag

SEQ ID NO: 4123187 - DNA, 20 bp, Homo sapiens
agcctcctcatcccgtgttc

SEQ ID NO: 4123188 - DNA, 12 bp, Homo sapiens
agcctcctctgg

SEQ ID NO: 4123189 - DNA, 16 bp, Homo sapiens
agcctcctctgtctgc

SEQ ID NO: 4123190 - DNA, 12 bp, Homo sapiens
agcctcctgagc

SEQ ID NO: 4123191 - DNA, 16 bp, Homo sapiens
agcctcctgagcctgt

SEQ ID NO: 4123192 - DNA, 17 bp, Homo sapiens
agcctcctgctgccaca

SEQ ID NO: 4123193 - DNA, 14 bp, Homo sapiens
agcctcctgtgcct

SEQ ID NO: 4123194 - DNA, 15 bp, Homo sapiens
agcctcctgtgcctg

SEQ ID NO: 4123195 - DNA, 16 bp, Homo sapiens
agcctcctgtgcctgg

SEQ ID NO: 4123196 - DNA, 21 bp, Homo sapiens
agcctcctgtgcctggcccca

SEQ ID NO: 4123197 - DNA, 18 bp, Homo sapiens
agcctcgcctgtcacccc

SEQ ID NO: 4123198 - DNA, 22 bp, Homo sapiens
agcctcgcctgtcacccccact

SEQ ID NO: 4123199 - DNA, 23 bp, Homo sapiens
agcctcgcctgtcacccccactc

SEQ ID NO: 4123200 - DNA, 16 bp, Homo sapiens
agcctctgctccccag

SEQ ID NO: 4123201 - DNA, 19 bp, Homo sapiens
agcctctggacagccagtg

SEQ ID NO: 4123202 - DNA, 23 bp, Homo sapiens
agcctctggacagccagtgacct

SEQ ID NO: 4123203 - DNA, 14 bp, Homo sapiens
agcctctggctaga

SEQ ID NO: 4123204 - DNA, 20 bp, Homo sapiens
agcctctttcccttccagtt

SEQ ID NO: 4123205 - DNA, 16 bp, Homo sapiens
agcctgaacagaagct

SEQ ID NO: 4123206 - DNA, 14 bp, Homo sapiens
agcctgacagccag

SEQ ID NO: 4123207 - DNA, 15 bp, Homo sapiens
agcctgacagccaga

SEQ ID NO: 4123208 - DNA, 16 bp, Homo sapiens
agcctgaggcagccac

SEQ ID NO: 4123209 - DNA, 22 bp, Homo sapiens
agcctgagtaaagttaaaagaa

SEQ ID NO: 4123210 - DNA, 21 bp, Homo sapiens
agcctgcaatttcatatgctg

SEQ ID NO: 4123211 - DNA, 19 bp, Homo sapiens
agcctgccccagcgctgac

SEQ ID NO: 4123212 - DNA, 23 bp, Homo sapiens
agcctgccttgcccactcctgct

SEQ ID NO: 4123213 - DNA, 15 bp, Homo sapiens
agcctgctccttccc

SEQ ID NO: 4123214 - DNA, 18 bp, Homo sapiens
agcctgctgagagccccc

SEQ ID NO: 4123215 - DNA, 12 bp, Homo sapiens
agcctgctgcat

SEQ ID NO: 4123216 - DNA, 14 bp, Homo sapiens
agcctgctggaagc

SEQ ID NO: 4123217 - DNA, 20 bp, Homo sapiens
agcctgctggtcacagcctc

SEQ ID NO: 4123218 - DNA, 11 bp, Homo sapiens
agcctggagaa

SEQ ID NO: 4123219 - DNA, 13 bp, Homo sapiens
agcctggagaagc

SEQ ID NO: 4123220 - DNA, 14 bp, Homo sapiens
agcctggagaagct

SEQ ID NO: 4123221 - DNA, 17 bp, Homo sapiens
agcctggcacagggcag

SEQ ID NO: 4123222 - DNA, 16 bp, Homo sapiens
agcctggccaccagcc

SEQ ID NO: 4123223 - DNA, 13 bp, Homo sapiens
agcctggccagac

SEQ ID NO: 4123224 - DNA, 22 bp, Homo sapiens
agcctggccagacacaggccct

SEQ ID NO: 4123225 - DNA, 14 bp, Homo sapiens
agcctggccccagg

SEQ ID NO: 4123226 - DNA, 12 bp, Homo sapiens
agcctggcctgc

SEQ ID NO: 4123227 - DNA, 14 bp, Homo sapiens
agcctggcctgccc

SEQ ID NO: 4123228 - DNA, 17 bp, Homo sapiens
agcctggcctgcccgtg

SEQ ID NO: 4123229 - DNA, 19 bp, Homo sapiens
agcctggcctgcccgtgcc

SEQ ID NO: 4123230 - DNA, 15 bp, Homo sapiens
agcctggctggtcct

SEQ ID NO: 4123231 - DNA, 16 bp, Homo sapiens
agcctggctggtcctc

SEQ ID NO: 4123232 - DNA, 20 bp, Homo sapiens
agcctggctggtcctcccat

SEQ ID NO: 4123233 - DNA, 16 bp, Homo sapiens
agcctgggagcccaga

SEQ ID NO: 4123234 - DNA, 17 bp, Homo sapiens
agcctgggagcccagag

SEQ ID NO: 4123235 - DNA, 17 bp, Homo sapiens
agcctgggcagcatagc

SEQ ID NO: 4123236 - DNA, 20 bp, Homo sapiens
agcctgggcagcatagcaag

SEQ ID NO: 4123237 - DNA, 15 bp, Homo sapiens
agcctgggcagccag

SEQ ID NO: 4123238 - DNA, 19 bp, Homo sapiens
agcctgggcagccaggctg

SEQ ID NO: 4123239 - DNA, 21 bp, Homo sapiens
agcctgggcagccaggctgcc

SEQ ID NO: 4123240 - DNA, 17 bp, Homo sapiens
agcctgggccatctctt

SEQ ID NO: 4123241 - DNA, 14 bp, Homo sapiens
agcctggggctggc

SEQ ID NO: 4123242 - DNA, 18 bp, Homo sapiens
agcctgggggccagtggg

SEQ ID NO: 4123243 - DNA, 16 bp, Homo sapiens
agcctgtaagcctgca

SEQ ID NO: 4123244 - DNA, 18 bp, Homo sapiens
agcctgtaagcctgcaag

SEQ ID NO: 4123245 - DNA, 14 bp, Homo sapiens
agcctgtgcagcct

SEQ ID NO: 4123246 - DNA, 16 bp, Homo sapiens
agcctgtgcctcccag

SEQ ID NO: 4123247 - DNA, 19 bp, Homo sapiens
agcctgtgcctcccagctt

SEQ ID NO: 4123248 - DNA, 18 bp, Homo sapiens
agcctgtgcctctgggac

SEQ ID NO: 4123249 - DNA, 21 bp, Homo sapiens
agcctgtggcatctttgcctt

SEQ ID NO: 4123250 - DNA, 20 bp, Homo sapiens
agcctgttcccctcactgga

SEQ ID NO: 4123251 - DNA, 12 bp, Homo sapiens
agccttaatttt

SEQ ID NO: 4123252 - DNA, 20 bp, Homo sapiens
agccttaatttttttttcat

SEQ ID NO: 4123253 - DNA, 15 bp, Homo sapiens
agccttaccttgaaa

SEQ ID NO: 4123254 - DNA, 19 bp, Homo sapiens
agccttatttctagaagca

SEQ ID NO: 4123255 - DNA, 18 bp, Homo sapiens
agccttcagagtacgtcc

SEQ ID NO: 4123256 - DNA, 16 bp, Homo sapiens
agccttgagccctggc

SEQ ID NO: 4123257 - DNA, 14 bp, Homo sapiens
agccttgccagaga

SEQ ID NO: 4123258 - DNA, 15 bp, Homo sapiens
agccttggaaccagc

SEQ ID NO: 4123259 - DNA, 22 bp, Homo sapiens
agccttgggttccaaccaggca

SEQ ID NO: 4123260 - DNA, 23 bp, Homo sapiens
agccttgggttccaaccaggcag

SEQ ID NO: 4123261 - DNA, 16 bp, Homo sapiens
agccttggtgccacca

SEQ ID NO: 4123262 - DNA, 22 bp, Homo sapiens
agccttgtgtatatttgtatat

SEQ ID NO: 4123263 - DNA, 23 bp, Homo sapiens
agcctttaatggacttatttctt

SEQ ID NO: 4123264 - DNA, 23 bp, Homo sapiens
agcctttccataaggaatgtagc

SEQ ID NO: 4123265 - DNA, 23 bp, Homo sapiens
agcctttcttgtagccatggctg

SEQ ID NO: 4123266 - DNA, 11 bp, Homo sapiens
agcctttgaat

SEQ ID NO: 4123267 - DNA, 18 bp, Homo sapiens
agcctttggatgaccaga

SEQ ID NO: 4123268 - DNA, 17 bp, Homo sapiens
agcctttggccttggct

SEQ ID NO: 4123269 - DNA, 17 bp, Homo sapiens
agccttttatactgatt

SEQ ID NO: 4123270 - DNA, 19 bp, Homo sapiens
agccttttatctgcagaac

SEQ ID NO: 4123271 - DNA, 22 bp, Homo sapiens
agccttttgtttcccttgcttt

SEQ ID NO: 4123272 - DNA, 21 bp, Homo sapiens
agcctttttgtataaaataga

SEQ ID NO: 4123273 - DNA, 18 bp, Homo sapiens
agcgaaataaaaatggca

SEQ ID NO: 4123274 - DNA, 17 bp, Homo sapiens
agcgaagtagcttgctc

SEQ ID NO: 4123275 - DNA, 17 bp, Homo sapiens
agcgaccgccccctcct

SEQ ID NO: 4123276 - DNA, 22 bp, Homo sapiens
agcgaccttcctcatccacccc

SEQ ID NO: 4123277 - DNA, 15 bp, Homo sapiens
agcgatatacagatg

SEQ ID NO: 4123278 - DNA, 20 bp, Homo sapiens
agcgatatacagatgaaaat

SEQ ID NO: 4123279 - DNA, 19 bp, Homo sapiens
agcgatctctcctggccta

SEQ ID NO: 4123280 - DNA, 18 bp, Homo sapiens
agcgccagcctgtcccat

SEQ ID NO: 4123281 - DNA, 17 bp, Homo sapiens
agcgccaggaagccaga

SEQ ID NO: 4123282 - DNA, 20 bp, Homo sapiens
agcgccaggaagccagagcc

SEQ ID NO: 4123283 - DNA, 21 bp, Homo sapiens
agcgccaggaagccagagccc

SEQ ID NO: 4123284 - DNA, 22 bp, Homo sapiens
agcgccaggaagccagagcccc

SEQ ID NO: 4123285 - DNA, 12 bp, Homo sapiens
agcgccaggctg

SEQ ID NO: 4123286 - DNA, 16 bp, Homo sapiens
agcgcccctgctgtct

SEQ ID NO: 4123287 - DNA, 16 bp, Homo sapiens
agcgcggccagcgtcc

SEQ ID NO: 4123288 - DNA, 22 bp, Homo sapiens
agcgctgacgtgtcaggaaaac

SEQ ID NO: 4123289 - DNA, 16 bp, Homo sapiens
agcggaaaagttgtct

SEQ ID NO: 4123290 - DNA, 17 bp, Homo sapiens
agcggaacaaggagtca

SEQ ID NO: 4123291 - DNA, 14 bp, Homo sapiens
agcggaataaacta

SEQ ID NO: 4123292 - DNA, 22 bp, Homo sapiens
agcggaataaactagagaaggg

SEQ ID NO: 4123293 - DNA, 15 bp, Homo sapiens
agcggaggagaccag

SEQ ID NO: 4123294 - DNA, 21 bp, Homo sapiens
agcggaggttgcagtgagctg

SEQ ID NO: 4123295 - DNA, 16 bp, Homo sapiens
agcggattgcaaagca

SEQ ID NO: 4123296 - DNA, 20 bp, Homo sapiens
agcggcaaacctttccccct

SEQ ID NO: 4123297 - DNA, 17 bp, Homo sapiens
agcggccctaagggagt

SEQ ID NO: 4123298 - DNA, 11 bp, Homo sapiens
agcggccggcc

SEQ ID NO: 4123299 - DNA, 18 bp, Homo sapiens
agcggccggccagcccct

SEQ ID NO: 4123300 - DNA, 18 bp, Homo sapiens
agcggctcaagcccagga

SEQ ID NO: 4123301 - DNA, 13 bp, Homo sapiens
agcggctcccctc

SEQ ID NO: 4123302 - DNA, 21 bp, Homo sapiens
agcggctcccctctgcttctc

SEQ ID NO: 4123303 - DNA, 16 bp, Homo sapiens
agcggctgttccccct

SEQ ID NO: 4123304 - DNA, 20 bp, Homo sapiens
agcggctgttccccctgccg

SEQ ID NO: 4123305 - DNA, 14 bp, Homo sapiens
agcgggagcccgtg

SEQ ID NO: 4123306 - DNA, 22 bp, Homo sapiens
agcgggatctcgtatctttaaa

SEQ ID NO: 4123307 - DNA, 10 bp, Homo sapiens
agcgggcaca

SEQ ID NO: 4123308 - DNA, 13 bp, Homo sapiens
agcgggcacaggg

SEQ ID NO: 4123309 - DNA, 14 bp, Homo sapiens
agcgggcacagggc

SEQ ID NO: 4123310 - DNA, 23 bp, Homo sapiens
agcgggcacagggcaccagaggc

SEQ ID NO: 4123311 - DNA, 19 bp, Homo sapiens
agcgggcaggttctgcctg

SEQ ID NO: 4123312 - DNA, 16 bp, Homo sapiens
agcgggccaggcccgc

SEQ ID NO: 4123313 - DNA, 13 bp, Homo sapiens
agcggggggaggg

SEQ ID NO: 4123314 - DNA, 16 bp, Homo sapiens
agcggggtatgaagag

SEQ ID NO: 4123315 - DNA, 19 bp, Homo sapiens
agcggtttggggagcagag

SEQ ID NO: 4123316 - DNA, 22 bp, Homo sapiens
agcggtttggggagcagagaca

SEQ ID NO: 4123317 - DNA, 15 bp, Homo sapiens
agcgtagtgcagcag

SEQ ID NO: 4123318 - DNA, 17 bp, Homo sapiens
agcgtagtgcagcaggg

SEQ ID NO: 4123319 - DNA, 16 bp, Homo sapiens
agcgtcccagtctctg

SEQ ID NO: 4123320 - DNA, 12 bp, Homo sapiens
agcgtctgggaa

SEQ ID NO: 4123321 - DNA, 20 bp, Homo sapiens
agcgtctgggaacttgcgag

SEQ ID NO: 4123322 - DNA, 14 bp, Homo sapiens
agcgttttttaaat

SEQ ID NO: 4123323 - DNA, 15 bp, Homo sapiens
agctaaaatgatttt

SEQ ID NO: 4123324 - DNA, 18 bp, Homo sapiens
agctaaaccaaggactga

SEQ ID NO: 4123325 - DNA, 13 bp, Homo sapiens
agctaaagaggct

SEQ ID NO: 4123326 - DNA, 14 bp, Homo sapiens
agctaagaacctgg

SEQ ID NO: 4123327 - DNA, 17 bp, Homo sapiens
agctaagggaagacatt

SEQ ID NO: 4123328 - DNA, 19 bp, Homo sapiens
agctaagggaagacatttc

SEQ ID NO: 4123329 - DNA, 20 bp, Homo sapiens
agctaataaatctcttcttt

SEQ ID NO: 4123330 - DNA, 17 bp, Homo sapiens
agctaatctgtagggct

SEQ ID NO: 4123331 - DNA, 20 bp, Homo sapiens
agctaatctgtagggctgga

SEQ ID NO: 4123332 - DNA, 13 bp, Homo sapiens
agctaatttgcat

SEQ ID NO: 4123333 - DNA, 14 bp, Homo sapiens
agctaatttgcatt

SEQ ID NO: 4123334 - DNA, 20 bp, Homo sapiens
agctacagctttcttgctcc

SEQ ID NO: 4123335 - DNA, 16 bp, Homo sapiens
agctaccccttctttg

SEQ ID NO: 4123336 - DNA, 20 bp, Homo sapiens
agctaccctttttctccagc

SEQ ID NO: 4123337 - DNA, 23 bp, Homo sapiens
agctactgatttcctttggagct

SEQ ID NO: 4123338 - DNA, 15 bp, Homo sapiens
agctactgtgtgtgt

SEQ ID NO: 4123339 - DNA, 21 bp, Homo sapiens
agctacttcctcctccccact

SEQ ID NO: 4123340 - DNA, 17 bp, Homo sapiens
agctacttgggaggctg

SEQ ID NO: 4123341 - DNA, 18 bp, Homo sapiens
agctacttgggaggctga

SEQ ID NO: 4123342 - DNA, 18 bp, Homo sapiens
agctaggaagagcaggac

SEQ ID NO: 4123343 - DNA, 16 bp, Homo sapiens
agctagtatcttcaaa

SEQ ID NO: 4123344 - DNA, 19 bp, Homo sapiens
agctagtgtacctcctctc

SEQ ID NO: 4123345 - DNA, 22 bp, Homo sapiens
agctagtgtacctcctctcagt

SEQ ID NO: 4123346 - DNA, 14 bp, Homo sapiens
agctatacctgcac

SEQ ID NO: 4123347 - DNA, 14 bp, Homo sapiens
agctatatccatgt

SEQ ID NO: 4123348 - DNA, 20 bp, Homo sapiens
agctatatccatgtactgta

SEQ ID NO: 4123349 - DNA, 15 bp, Homo sapiens
agctatctaaagttt

SEQ ID NO: 4123350 - DNA, 15 bp, Homo sapiens
agctatctaggtgga

SEQ ID NO: 4123351 - DNA, 22 bp, Homo sapiens
agctatctgcactctaaactgc

SEQ ID NO: 4123352 - DNA, 20 bp, Homo sapiens
agctattagccaggatcatg

SEQ ID NO: 4123353 - DNA, 19 bp, Homo sapiens
agctattcagtaataactc

SEQ ID NO: 4123354 - DNA, 18 bp, Homo sapiens
agctatttccattccaga

SEQ ID NO: 4123355 - DNA, 17 bp, Homo sapiens
agctattttcctctggc

SEQ ID NO: 4123356 - DNA, 17 bp, Homo sapiens
agctcacatgggactgg

SEQ ID NO: 4123357 - DNA, 17 bp, Homo sapiens
agctcacccaataaaca

SEQ ID NO: 4123358 - DNA, 15 bp, Homo sapiens
agctcacccctgggc

SEQ ID NO: 4123359 - DNA, 16 bp, Homo sapiens
agctcacccctgggca

SEQ ID NO: 4123360 - DNA, 19 bp, Homo sapiens
agctcacccctgggcaggc

SEQ ID NO: 4123361 - DNA, 20 bp, Homo sapiens
agctcacccctgggcaggcg

SEQ ID NO: 4123362 - DNA, 19 bp, Homo sapiens
agctcagaggcgcactgtg

SEQ ID NO: 4123363 - DNA, 22 bp, Homo sapiens
agctcagccccgagctgtcccc

SEQ ID NO: 4123364 - DNA, 16 bp, Homo sapiens
agctcagcttcttcct

SEQ ID NO: 4123365 - DNA, 17 bp, Homo sapiens
agctcagcttcttccta

SEQ ID NO: 4123366 - DNA, 17 bp, Homo sapiens
agctcagtgctctctcc

SEQ ID NO: 4123367 - DNA, 20 bp, Homo sapiens
agctcagtgctctctccact

SEQ ID NO: 4123368 - DNA, 16 bp, Homo sapiens
agctcattaaactttt

SEQ ID NO: 4123369 - DNA, 13 bp, Homo sapiens
agctccaacctgc

SEQ ID NO: 4123370 - DNA, 14 bp, Homo sapiens
agctccaacctgca

SEQ ID NO: 4123371 - DNA, 18 bp, Homo sapiens
agctccactgtcaccctc

SEQ ID NO: 4123372 - DNA, 23 bp, Homo sapiens
agctccactgtcaccctccacct

SEQ ID NO: 4123373 - DNA, 13 bp, Homo sapiens
agctccagagcaa

SEQ ID NO: 4123374 - DNA, 14 bp, Homo sapiens
agctccagctttct

SEQ ID NO: 4123375 - DNA, 15 bp, Homo sapiens
agctccaggggccct

SEQ ID NO: 4123376 - DNA, 18 bp, Homo sapiens
agctccccagatctccca

SEQ ID NO: 4123377 - DNA, 15 bp, Homo sapiens
agctccccaggagct

SEQ ID NO: 4123378 - DNA, 18 bp, Homo sapiens
agctccccaggagctcag

SEQ ID NO: 4123379 - DNA, 23 bp, Homo sapiens
agctcccccaggctgttctccag

SEQ ID NO: 4123380 - DNA, 14 bp, Homo sapiens
agctccccccacct

SEQ ID NO: 4123381 - DNA, 15 bp, Homo sapiens
agctccccccacctc

SEQ ID NO: 4123382 - DNA, 16 bp, Homo sapiens
agctccctagactgca

SEQ ID NO: 4123383 - DNA, 17 bp, Homo sapiens
agctccctaggagacca

SEQ ID NO: 4123384 - DNA, 17 bp, Homo sapiens
agctccctttctcagga

SEQ ID NO: 4123385 - DNA, 19 bp, Homo sapiens
agctccggcgtgtgttcag

SEQ ID NO: 4123386 - DNA, 17 bp, Homo sapiens
agctcctacctctgtgc

SEQ ID NO: 4123387 - DNA, 20 bp, Homo sapiens
agctcctacctctgtgccag

SEQ ID NO: 4123388 - DNA, 16 bp, Homo sapiens
agctcctcaactcacc

SEQ ID NO: 4123389 - DNA, 20 bp, Homo sapiens
agctcctctccccagcccag

SEQ ID NO: 4123390 - DNA, 21 bp, Homo sapiens
agctcctctccccagcccaga

SEQ ID NO: 4123391 - DNA, 24 bp, Homo sapiens
agctcctctccccagcccagagac

SEQ ID NO: 4123392 - DNA, 16 bp, Homo sapiens
agctcctctcctggag

SEQ ID NO: 4123393 - DNA, 22 bp, Homo sapiens
agctcctggtcttgagatgtct

SEQ ID NO: 4123394 - DNA, 17 bp, Homo sapiens
agctcctgtcctcccat

SEQ ID NO: 4123395 - DNA, 18 bp, Homo sapiens
agctccttttccagagca

SEQ ID NO: 4123396 - DNA, 19 bp, Homo sapiens
agctcgaattaagaatatg

SEQ ID NO: 4123397 - DNA, 20 bp, Homo sapiens
agctcgcacccccctgttct

SEQ ID NO: 4123398 - DNA, 23 bp, Homo sapiens
agctcgtttttcagcacccccac

SEQ ID NO: 4123399 - DNA, 15 bp, Homo sapiens
agctctaccctgctc

SEQ ID NO: 4123400 - DNA, 18 bp, Homo sapiens
agctctaccctgctccct

SEQ ID NO: 4123401 - DNA, 18 bp, Homo sapiens
agctctattgatactctt

SEQ ID NO: 4123402 - DNA, 17 bp, Homo sapiens
agctctattttaaagta

SEQ ID NO: 4123403 - DNA, 12 bp, Homo sapiens
agctctcccagt

SEQ ID NO: 4123404 - DNA, 15 bp, Homo sapiens
agctctcccagtgaa

SEQ ID NO: 4123405 - DNA, 17 bp, Homo sapiens
agctctcctgactttta

SEQ ID NO: 4123406 - DNA, 17 bp, Homo sapiens
agctctctaggcctctc

SEQ ID NO: 4123407 - DNA, 19 bp, Homo sapiens
agctctctaggcctctcca

SEQ ID NO: 4123408 - DNA, 22 bp, Homo sapiens
agctctctaggcctctccagtt

SEQ ID NO: 4123409 - DNA, 23 bp, Homo sapiens
agctctgaagtcacatcacagga

SEQ ID NO: 4123410 - DNA, 16 bp, Homo sapiens
agctctgacccttggg

SEQ ID NO: 4123411 - DNA, 19 bp, Homo sapiens
agctctgacccttgggcct

SEQ ID NO: 4123412 - DNA, 20 bp, Homo sapiens
agctctgagacccttttctc

SEQ ID NO: 4123413 - DNA, 22 bp, Homo sapiens
agctctggccacaacagggcat

SEQ ID NO: 4123414 - DNA, 18 bp, Homo sapiens
agctctggggacagcttc

SEQ ID NO: 4123415 - DNA, 19 bp, Homo sapiens
agctctggggacagcttcc

SEQ ID NO: 4123416 - DNA, 22 bp, Homo sapiens
agctctggggacagcttcctca

SEQ ID NO: 4123417 - DNA, 17 bp, Homo sapiens
agctcttactctttcct

SEQ ID NO: 4123418 - DNA, 15 bp, Homo sapiens
agctcttcaggcctc

SEQ ID NO: 4123419 - DNA, 16 bp, Homo sapiens
agctcttcaggcctcc

SEQ ID NO: 4123420 - DNA, 13 bp, Homo sapiens
agctcttccctta

SEQ ID NO: 4123421 - DNA, 12 bp, Homo sapiens
agctcttcctgg

SEQ ID NO: 4123422 - DNA, 17 bp, Homo sapiens
agctcttggcctttgca

SEQ ID NO: 4123423 - DNA, 19 bp, Homo sapiens
agctgaagaaaaaatcaga

SEQ ID NO: 4123424 - DNA, 15 bp, Homo sapiens
agctgaagagctggg

SEQ ID NO: 4123425 - DNA, 17 bp, Homo sapiens
agctgaagtgcatccaa

SEQ ID NO: 4123426 - DNA, 13 bp, Homo sapiens
agctgaagttact

SEQ ID NO: 4123427 - DNA, 13 bp, Homo sapiens
agctgaatgtcaa

SEQ ID NO: 4123428 - DNA, 16 bp, Homo sapiens
agctgacccagcccct

SEQ ID NO: 4123429 - DNA, 22 bp, Homo sapiens
agctgaccccgagaagtgctct

SEQ ID NO: 4123430 - DNA, 19 bp, Homo sapiens
agctgacccggcctctctg

SEQ ID NO: 4123431 - DNA, 11 bp, Homo sapiens
agctgactgtg

SEQ ID NO: 4123432 - DNA, 19 bp, Homo sapiens
agctgagaactcctgactg

SEQ ID NO: 4123433 - DNA, 15 bp, Homo sapiens
agctgagcagcctct

SEQ ID NO: 4123434 - DNA, 16 bp, Homo sapiens
agctgagcagcctctg

SEQ ID NO: 4123435 - DNA, 17 bp, Homo sapiens
agctgagcagcctctgg

SEQ ID NO: 4123436 - DNA, 15 bp, Homo sapiens
agctgagccagttgt

SEQ ID NO: 4123437 - DNA, 11 bp, Homo sapiens
agctgagccct

SEQ ID NO: 4123438 - DNA, 13 bp, Homo sapiens
agctgagccctgg

SEQ ID NO: 4123439 - DNA, 15 bp, Homo sapiens
agctgagccttctga

SEQ ID NO: 4123440 - DNA, 20 bp, Homo sapiens
agctgaggacacaccccaca

SEQ ID NO: 4123441 - DNA, 16 bp, Homo sapiens
agctgagttatgatgt

SEQ ID NO: 4123442 - DNA, 20 bp, Homo sapiens
agctgatacttcatttaaaa

SEQ ID NO: 4123443 - DNA, 21 bp, Homo sapiens
agctgatacttcatttaaaaa

SEQ ID NO: 4123444 - DNA, 19 bp, Homo sapiens
agctgatataaattctgtg

SEQ ID NO: 4123445 - DNA, 12 bp, Homo sapiens
agctgatgaaac

SEQ ID NO: 4123446 - DNA, 22 bp, Homo sapiens
agctgatgaaactcacaaatga

SEQ ID NO: 4123447 - DNA, 23 bp, Homo sapiens
agctgatgaaactcacaaatgat

SEQ ID NO: 4123448 - DNA, 14 bp, Homo sapiens
agctgatggcagct

SEQ ID NO: 4123449 - DNA, 14 bp, Homo sapiens
agctgattttaaca

SEQ ID NO: 4123450 - DNA, 15 bp, Homo sapiens
agctgattttaacaa

SEQ ID NO: 4123451 - DNA, 20 bp, Homo sapiens
agctgattttaacaataact

SEQ ID NO: 4123452 - DNA, 16 bp, Homo sapiens
agctgcaaatctgatg

SEQ ID NO: 4123453 - DNA, 17 bp, Homo sapiens
agctgcaagccagggat

SEQ ID NO: 4123454 - DNA, 14 bp, Homo sapiens
agctgcaccagagc

SEQ ID NO: 4123455 - DNA, 19 bp, Homo sapiens
agctgcactgatcacccaa

SEQ ID NO: 4123456 - DNA, 22 bp, Homo sapiens
agctgcactgatgctgcccctc

SEQ ID NO: 4123457 - DNA, 21 bp, Homo sapiens
agctgcagccccttgctctca

SEQ ID NO: 4123458 - DNA, 14 bp, Homo sapiens
agctgcagcctggc

SEQ ID NO: 4123459 - DNA, 17 bp, Homo sapiens
agctgcagcctggctgg

SEQ ID NO: 4123460 - DNA, 21 bp, Homo sapiens
agctgcagcctggctggtcct

SEQ ID NO: 4123461 - DNA, 18 bp, Homo sapiens
agctgcagctgagcctga

SEQ ID NO: 4123462 - DNA, 23 bp, Homo sapiens
agctgcaggaatcaaaaattgaa

SEQ ID NO: 4123463 - DNA, 20 bp, Homo sapiens
agctgcatcatccttgcagg

SEQ ID NO: 4123464 - DNA, 23 bp, Homo sapiens
agctgcatgtggcttttttaaaa

SEQ ID NO: 4123465 - DNA, 13 bp, Homo sapiens
agctgccagccca

SEQ ID NO: 4123466 - DNA, 19 bp, Homo sapiens
agctgccccggcccctccc

SEQ ID NO: 4123467 - DNA, 14 bp, Homo sapiens
agctgccctagctg

SEQ ID NO: 4123468 - DNA, 15 bp, Homo sapiens
agctgccctagctga

SEQ ID NO: 4123469 - DNA, 16 bp, Homo sapiens
agctgccctagctgac

SEQ ID NO: 4123470 - DNA, 18 bp, Homo sapiens
agctgcctcctgcgccct

SEQ ID NO: 4123471 - DNA, 15 bp, Homo sapiens
agctgcctgaaacag

SEQ ID NO: 4123472 - DNA, 18 bp, Homo sapiens
agctgcctgcttggcccg

SEQ ID NO: 4123473 - DNA, 12 bp, Homo sapiens
agctgcctggag

SEQ ID NO: 4123474 - DNA, 13 bp, Homo sapiens
agctgcctggaga

SEQ ID NO: 4123475 - DNA, 17 bp, Homo sapiens
agctgcctgggcccgga

SEQ ID NO: 4123476 - DNA, 10 bp, Homo sapiens
agctgccttc

SEQ ID NO: 4123477 - DNA, 12 bp, Homo sapiens
agctgccttccc

SEQ ID NO: 4123478 - DNA, 16 bp, Homo sapiens
agctgccttccctagc

SEQ ID NO: 4123479 - DNA, 17 bp, Homo sapiens
agctgccttccctagct

SEQ ID NO: 4123480 - DNA, 18 bp, Homo sapiens
agctgccttccctagctt

SEQ ID NO: 4123481 - DNA, 19 bp, Homo sapiens
agctgccttccctagcttt

SEQ ID NO: 4123482 - DNA, 16 bp, Homo sapiens
agctgccttggctcag

SEQ ID NO: 4123483 - DNA, 17 bp, Homo sapiens
agctgccttggctcaga

SEQ ID NO: 4123484 - DNA, 22 bp, Homo sapiens
agctgcgtttattaatgcctct

SEQ ID NO: 4123485 - DNA, 19 bp, Homo sapiens
agctgctatccccatctcc

SEQ ID NO: 4123486 - DNA, 23 bp, Homo sapiens
agctgctatccccatctccctgc

SEQ ID NO: 4123487 - DNA, 21 bp, Homo sapiens
agctgctctgaaatctccttt

SEQ ID NO: 4123488 - DNA, 20 bp, Homo sapiens
agctgctgaccaattgtgct

SEQ ID NO: 4123489 - DNA, 21 bp, Homo sapiens
agctgctgaccaattgtgctg

SEQ ID NO: 4123490 - DNA, 12 bp, Homo sapiens
agctgctgccat

SEQ ID NO: 4123491 - DNA, 18 bp, Homo sapiens
agctgctgttctcaggac

SEQ ID NO: 4123492 - DNA, 21 bp, Homo sapiens
agctgcttgtcctgggcctgc

SEQ ID NO: 4123493 - DNA, 11 bp, Homo sapiens
agctggacttc

SEQ ID NO: 4123494 - DNA, 16 bp, Homo sapiens
agctggacttctgtgg

SEQ ID NO: 4123495 - DNA, 18 bp, Homo sapiens
agctggacttctgtgggc

SEQ ID NO: 4123496 - DNA, 20 bp, Homo sapiens
agctggagcccccagcagag

SEQ ID NO: 4123497 - DNA, 15 bp, Homo sapiens
agctggccaggccct

SEQ ID NO: 4123498 - DNA, 20 bp, Homo sapiens
agctggccaggccctgagag

SEQ ID NO: 4123499 - DNA, 21 bp, Homo sapiens
agctggccaggccctgagagt

SEQ ID NO: 4123500 - DNA, 11 bp, Homo sapiens
agctggccctg

SEQ ID NO: 4123501 - DNA, 13 bp, Homo sapiens
agctggccctgcc

SEQ ID NO: 4123502 - DNA, 16 bp, Homo sapiens
agctggccctgcctcc

SEQ ID NO: 4123503 - DNA, 19 bp, Homo sapiens
agctggccctgcctcctgg

SEQ ID NO: 4123504 - DNA, 21 bp, Homo sapiens
agctggccctgcctcctggga

SEQ ID NO: 4123505 - DNA, 23 bp, Homo sapiens
agctggccgagggtcctggctcc

SEQ ID NO: 4123506 - DNA, 16 bp, Homo sapiens
agctggcctctcactg

SEQ ID NO: 4123507 - DNA, 22 bp, Homo sapiens
agctggcctctcactgcctccc

SEQ ID NO: 4123508 - DNA, 12 bp, Homo sapiens
agctggctccag

SEQ ID NO: 4123509 - DNA, 21 bp, Homo sapiens
agctggctttgaaacctcagg

SEQ ID NO: 4123510 - DNA, 23 bp, Homo sapiens
agctggctttgaaacctcagggc

SEQ ID NO: 4123511 - DNA, 14 bp, Homo sapiens
agctgggaggcatg

SEQ ID NO: 4123512 - DNA, 19 bp, Homo sapiens
agctgggaggcatggccct

SEQ ID NO: 4123513 - DNA, 20 bp, Homo sapiens
agctgggaggcatggccctg

SEQ ID NO: 4123514 - DNA, 17 bp, Homo sapiens
agctggggactcaggga

SEQ ID NO: 4123515 - DNA, 22 bp, Homo sapiens
agctggggatccctccccccca

SEQ ID NO: 4123516 - DNA, 15 bp, Homo sapiens
agctggggccagagg

SEQ ID NO: 4123517 - DNA, 15 bp, Homo sapiens
agctgggtcaggcag

SEQ ID NO: 4123518 - DNA, 16 bp, Homo sapiens
agctgggtcaggcagg

SEQ ID NO: 4123519 - DNA, 20 bp, Homo sapiens
agctgggtggggacagtgat

SEQ ID NO: 4123520 - DNA, 19 bp, Homo sapiens
agctggtgcattacagaga

SEQ ID NO: 4123521 - DNA, 14 bp, Homo sapiens
agctggtgcccgga

SEQ ID NO: 4123522 - DNA, 22 bp, Homo sapiens
agctggtttcctcattcctgaa

SEQ ID NO: 4123523 - DNA, 16 bp, Homo sapiens
agctggtttcctgccc

SEQ ID NO: 4123524 - DNA, 22 bp, Homo sapiens
agctggtttcctgcccagcctg

SEQ ID NO: 4123525 - DNA, 19 bp, Homo sapiens
agctgtaaactgaatataa

SEQ ID NO: 4123526 - DNA, 15 bp, Homo sapiens
agctgtaacagttct

SEQ ID NO: 4123527 - DNA, 21 bp, Homo sapiens
agctgtacttcgtcttctaat

SEQ ID NO: 4123528 - DNA, 20 bp, Homo sapiens
agctgtatgatttgttttga

SEQ ID NO: 4123529 - DNA, 17 bp, Homo sapiens
agctgtcatcactcaac

SEQ ID NO: 4123530 - DNA, 14 bp, Homo sapiens
agctgtcctgcagc

SEQ ID NO: 4123531 - DNA, 17 bp, Homo sapiens
agctgtctaacccccag

SEQ ID NO: 4123532 - DNA, 18 bp, Homo sapiens
agctgtctaacccccagc

SEQ ID NO: 4123533 - DNA, 15 bp, Homo sapiens
agctgtctctaactt

SEQ ID NO: 4123534 - DNA, 15 bp, Homo sapiens
agctgtgaacaggct

SEQ ID NO: 4123535 - DNA, 19 bp, Homo sapiens
agctgtgagttctccctgt

SEQ ID NO: 4123536 - DNA, 17 bp, Homo sapiens
agctgtgccttcagctg

SEQ ID NO: 4123537 - DNA, 20 bp, Homo sapiens
agctgtgtccggcccagttt

SEQ ID NO: 4123538 - DNA, 16 bp, Homo sapiens
agctgtgtccttcggg

SEQ ID NO: 4123539 - DNA, 13 bp, Homo sapiens
agctgtgtgaaat

SEQ ID NO: 4123540 - DNA, 14 bp, Homo sapiens
agctgttcttcctg

SEQ ID NO: 4123541 - DNA, 13 bp, Homo sapiens
agctgttgaccag

SEQ ID NO: 4123542 - DNA, 16 bp, Homo sapiens
agctgttgaccaggca

SEQ ID NO: 4123543 - DNA, 17 bp, Homo sapiens
agctgttgagctgtttt

SEQ ID NO: 4123544 - DNA, 21 bp, Homo sapiens
agctgttgcagatgaaatgtt

SEQ ID NO: 4123545 - DNA, 15 bp, Homo sapiens
agctgttgtacattt

SEQ ID NO: 4123546 - DNA, 22 bp, Homo sapiens
agctgttgtacatttatgattt

SEQ ID NO: 4123547 - DNA, 23 bp, Homo sapiens
agctgttgtacatttatgattta

SEQ ID NO: 4123548 - DNA, 17 bp, Homo sapiens
agctgttgtctcttctc

SEQ ID NO: 4123549 - DNA, 21 bp, Homo sapiens
agctgttgtctcttctcctta

SEQ ID NO: 4123550 - DNA, 18 bp, Homo sapiens
agctgtttatggcctcag

SEQ ID NO: 4123551 - DNA, 20 bp, Homo sapiens
agctgtttatggcctcagct

SEQ ID NO: 4123552 - DNA, 14 bp, Homo sapiens
agctgtttctcatg

SEQ ID NO: 4123553 - DNA, 15 bp, Homo sapiens
agctgtttctcatga

SEQ ID NO: 4123554 - DNA, 17 bp, Homo sapiens
agctgtttctcatgaag

SEQ ID NO: 4123555 - DNA, 23 bp, Homo sapiens
agcttaaaataaacagttgtgaa

SEQ ID NO: 4123556 - DNA, 15 bp, Homo sapiens
agcttaactaatttg

SEQ ID NO: 4123557 - DNA, 16 bp, Homo sapiens
agcttaatagccctcc

SEQ ID NO: 4123558 - DNA, 17 bp, Homo sapiens
agcttaatagccctccc

SEQ ID NO: 4123559 - DNA, 22 bp, Homo sapiens
agcttacatagttttaaactca

SEQ ID NO: 4123560 - DNA, 21 bp, Homo sapiens
agcttactctgtccatttatc

SEQ ID NO: 4123561 - DNA, 16 bp, Homo sapiens
agcttagatttcatag

SEQ ID NO: 4123562 - DNA, 17 bp, Homo sapiens
agcttagccaatgtggg

SEQ ID NO: 4123563 - DNA, 11 bp, Homo sapiens
agcttatctct

SEQ ID NO: 4123564 - DNA, 22 bp, Homo sapiens
agcttatctcttttatatttgt

SEQ ID NO: 4123565 - DNA, 17 bp, Homo sapiens
agcttatttttctgtga

SEQ ID NO: 4123566 - DNA, 13 bp, Homo sapiens
agcttcacttctg

SEQ ID NO: 4123567 - DNA, 23 bp, Homo sapiens
agcttcacttctgactcttcccc

SEQ ID NO: 4123568 - DNA, 21 bp, Homo sapiens
agcttcagactcaagtaccca

SEQ ID NO: 4123569 - DNA, 13 bp, Homo sapiens
agcttcaggcacc

SEQ ID NO: 4123570 - DNA, 14 bp, Homo sapiens
agcttcaggcacca

SEQ ID NO: 4123571 - DNA, 17 bp, Homo sapiens
agcttcaggcaccagca

SEQ ID NO: 4123572 - DNA, 20 bp, Homo sapiens
agcttcaggcaccagcatcc

SEQ ID NO: 4123573 - DNA, 11 bp, Homo sapiens
agcttcaggtt

SEQ ID NO: 4123574 - DNA, 13 bp, Homo sapiens
agcttcaggttat

SEQ ID NO: 4123575 - DNA, 23 bp, Homo sapiens
agcttcaggttatcgaaataaca

SEQ ID NO: 4123576 - DNA, 20 bp, Homo sapiens
agcttcatgcctttgtaagt

SEQ ID NO: 4123577 - DNA, 21 bp, Homo sapiens
agcttcattctccttgttgtt

SEQ ID NO: 4123578 - DNA, 18 bp, Homo sapiens
agcttccctccctgctgt

SEQ ID NO: 4123579 - DNA, 19 bp, Homo sapiens
agcttcctcacacccctgt

SEQ ID NO: 4123580 - DNA, 23 bp, Homo sapiens
agcttcctcacacccctgtccca

SEQ ID NO: 4123581 - DNA, 24 bp, Homo sapiens
agcttcctcacacccctgtcccac

SEQ ID NO: 4123582 - DNA, 16 bp, Homo sapiens
agcttcctcggtagca

SEQ ID NO: 4123583 - DNA, 20 bp, Homo sapiens
agcttcggagggcccctgcg

SEQ ID NO: 4123584 - DNA, 17 bp, Homo sapiens
agcttctaaatggtgct

SEQ ID NO: 4123585 - DNA, 15 bp, Homo sapiens
agcttctccaggctc

SEQ ID NO: 4123586 - DNA, 13 bp, Homo sapiens
agcttctctgtga

SEQ ID NO: 4123587 - DNA, 17 bp, Homo sapiens
agcttctgcttttctgc

SEQ ID NO: 4123588 - DNA, 19 bp, Homo sapiens
agcttctgcttttctgccc

SEQ ID NO: 4123589 - DNA, 14 bp, Homo sapiens
agcttcttcctagg

SEQ ID NO: 4123590 - DNA, 22 bp, Homo sapiens
agcttcttcctaggtccaagcc

SEQ ID NO: 4123591 - DNA, 22 bp, Homo sapiens
agcttctttcccttagtgactc

SEQ ID NO: 4123592 - DNA, 17 bp, Homo sapiens
agcttgaaagttttcag

SEQ ID NO: 4123593 - DNA, 22 bp, Homo sapiens
agcttgaagatcgttagtatct

SEQ ID NO: 4123594 - DNA, 12 bp, Homo sapiens
agcttgaagatt

SEQ ID NO: 4123595 - DNA, 23 bp, Homo sapiens
agcttgaagattaggagaaacac

SEQ ID NO: 4123596 - DNA, 17 bp, Homo sapiens
agcttgacacagtcagc

SEQ ID NO: 4123597 - DNA, 15 bp, Homo sapiens
agcttgactcccaag

SEQ ID NO: 4123598 - DNA, 14 bp, Homo sapiens
agcttgcacatgaa

SEQ ID NO: 4123599 - DNA, 16 bp, Homo sapiens
agcttgctccctgtgt

SEQ ID NO: 4123600 - DNA, 17 bp, Homo sapiens
agcttgctccctgtgtc

SEQ ID NO: 4123601 - DNA, 12 bp, Homo sapiens
agcttgctttga

SEQ ID NO: 4123602 - DNA, 22 bp, Homo sapiens
agcttggaggtcacagctggat

SEQ ID NO: 4123603 - DNA, 23 bp, Homo sapiens
agcttgtgctcctcttgattcct

SEQ ID NO: 4123604 - DNA, 14 bp, Homo sapiens
agcttgtggcccct

SEQ ID NO: 4123605 - DNA, 17 bp, Homo sapiens
agcttgtgtcctgtcct

SEQ ID NO: 4123606 - DNA, 18 bp, Homo sapiens
agcttgtgtcctgtcctt

SEQ ID NO: 4123607 - DNA, 14 bp, Homo sapiens
agctttaaaaagaa

SEQ ID NO: 4123608 - DNA, 15 bp, Homo sapiens
agctttaaacaaatt

SEQ ID NO: 4123609 - DNA, 19 bp, Homo sapiens
agctttaaactcagggaca

SEQ ID NO: 4123610 - DNA, 20 bp, Homo sapiens
agctttaaactcagggacag

SEQ ID NO: 4123611 - DNA, 13 bp, Homo sapiens
agctttaccctca

SEQ ID NO: 4123612 - DNA, 12 bp, Homo sapiens
agctttcctgcc

SEQ ID NO: 4123613 - DNA, 13 bp, Homo sapiens
agctttcctgccc

SEQ ID NO: 4123614 - DNA, 21 bp, Homo sapiens
agctttcctgccccaggcctg

SEQ ID NO: 4123615 - DNA, 23 bp, Homo sapiens
agctttctagaagtttcccttcc

SEQ ID NO: 4123616 - DNA, 23 bp, Homo sapiens
agctttcttctacaaccagagcc

SEQ ID NO: 4123617 - DNA, 16 bp, Homo sapiens
agctttgccagctgct

SEQ ID NO: 4123618 - DNA, 19 bp, Homo sapiens
agctttgccagctgctgct

SEQ ID NO: 4123619 - DNA, 15 bp, Homo sapiens
agctttgggatccca

SEQ ID NO: 4123620 - DNA, 22 bp, Homo sapiens
agctttgtcatagttatgtgat

SEQ ID NO: 4123621 - DNA, 17 bp, Homo sapiens
agctttgtgtttggttt

SEQ ID NO: 4123622 - DNA, 21 bp, Homo sapiens
agctttgtgtttggtttacat

SEQ ID NO: 4123623 - DNA, 22 bp, Homo sapiens
agctttgtgtttggtttacatt

SEQ ID NO: 4123624 - DNA, 19 bp, Homo sapiens
agctttgtttcaaccaagt

SEQ ID NO: 4123625 - DNA, 14 bp, Homo sapiens
agcttttcctccct

SEQ ID NO: 4123626 - DNA, 13 bp, Homo sapiens
agcttttgttgtt

SEQ ID NO: 4123627 - DNA, 15 bp, Homo sapiens
agctttttaaaacat

SEQ ID NO: 4123628 - DNA, 17 bp, Homo sapiens
agctttttcctcctgga

SEQ ID NO: 4123629 - DNA, 14 bp, Homo sapiens
aggaaaaaaatgac

SEQ ID NO: 4123630 - DNA, 19 bp, Homo sapiens
aggaaaaacacaagcaaaa

SEQ ID NO: 4123631 - DNA, 13 bp, Homo sapiens
aggaaaaacaggt

SEQ ID NO: 4123632 - DNA, 12 bp, Homo sapiens
aggaaaaaggtc

SEQ ID NO: 4123633 - DNA, 13 bp, Homo sapiens
aggaaaaataatc

SEQ ID NO: 4123634 - DNA, 15 bp, Homo sapiens
aggaaaaataatcaa

SEQ ID NO: 4123635 - DNA, 12 bp, Homo sapiens
aggaaaaggaaa

SEQ ID NO: 4123636 - DNA, 11 bp, Homo sapiens
aggaaaccaag

SEQ ID NO: 4123637 - DNA, 20 bp, Homo sapiens
aggaaactccacatctgcct

SEQ ID NO: 4123638 - DNA, 21 bp, Homo sapiens
aggaaactctgcattctagta

SEQ ID NO: 4123639 - DNA, 13 bp, Homo sapiens
aggaaactcttat

SEQ ID NO: 4123640 - DNA, 12 bp, Homo sapiens
aggaaagaaaac

SEQ ID NO: 4123641 - DNA, 22 bp, Homo sapiens
aggaaagcaataaatgaatggg

SEQ ID NO: 4123642 - DNA, 13 bp, Homo sapiens
aggaaagcacaga

SEQ ID NO: 4123643 - DNA, 18 bp, Homo sapiens
aggaaaggggagaaggga

SEQ ID NO: 4123644 - DNA, 22 bp, Homo sapiens
aggaaagtggcacctgtctgct

SEQ ID NO: 4123645 - DNA, 21 bp, Homo sapiens
aggaaatagtaccttcaatac

SEQ ID NO: 4123646 - DNA, 12 bp, Homo sapiens
aggaaatattaa

SEQ ID NO: 4123647 - DNA, 14 bp, Homo sapiens
aggaaatattaatt

SEQ ID NO: 4123648 - DNA, 19 bp, Homo sapiens
aggaaatccattgtttaaa

SEQ ID NO: 4123649 - DNA, 16 bp, Homo sapiens
aggaaatctcacccca

SEQ ID NO: 4123650 - DNA, 21 bp, Homo sapiens
aggaacagcagtgttctcaca

SEQ ID NO: 4123651 - DNA, 16 bp, Homo sapiens
aggaacagtggctggg

SEQ ID NO: 4123652 - DNA, 18 bp, Homo sapiens
aggaacagtggctgggtg

SEQ ID NO: 4123653 - DNA, 19 bp, Homo sapiens
aggaacatatgaaaataca

SEQ ID NO: 4123654 - DNA, 20 bp, Homo sapiens
aggaacatggagctgtcatc

SEQ ID NO: 4123655 - DNA, 14 bp, Homo sapiens
aggaacccccacca

SEQ ID NO: 4123656 - DNA, 15 bp, Homo sapiens
aggaacccccaccag

SEQ ID NO: 4123657 - DNA, 20 bp, Homo sapiens
aggaaccgtggtatgtctgc

SEQ ID NO: 4123658 - DNA, 23 bp, Homo sapiens
aggaaccgtggtatgtctgccat

SEQ ID NO: 4123659 - DNA, 13 bp, Homo sapiens
aggaactcccagc

SEQ ID NO: 4123660 - DNA, 18 bp, Homo sapiens
aggaactctggcttccag

SEQ ID NO: 4123661 - DNA, 19 bp, Homo sapiens
aggaactctggcttccagg

SEQ ID NO: 4123662 - DNA, 18 bp, Homo sapiens
aggaactgtccagagagc

SEQ ID NO: 4123663 - DNA, 19 bp, Homo sapiens
aggaactgtccagagagca

SEQ ID NO: 4123664 - DNA, 20 bp, Homo sapiens
aggaactgtccagagagcaa

SEQ ID NO: 4123665 - DNA, 15 bp, Homo sapiens
aggaagaaggcagtg

SEQ ID NO: 4123666 - DNA, 19 bp, Homo sapiens
aggaagagggctgagctga

SEQ ID NO: 4123667 - DNA, 15 bp, Homo sapiens
aggaagagtcttggt

SEQ ID NO: 4123668 - DNA, 18 bp, Homo sapiens
aggaagcaccccatgcca

SEQ ID NO: 4123669 - DNA, 23 bp, Homo sapiens
aggaagcactgaaaatagtgttc

SEQ ID NO: 4123670 - DNA, 20 bp, Homo sapiens
aggaagcagcctcagagtgg

SEQ ID NO: 4123671 - DNA, 15 bp, Homo sapiens
aggaagccaaattta

SEQ ID NO: 4123672 - DNA, 11 bp, Homo sapiens
aggaagccaga

SEQ ID NO: 4123673 - DNA, 14 bp, Homo sapiens
aggaagccaggctg

SEQ ID NO: 4123674 - DNA, 19 bp, Homo sapiens
aggaagccaggctgagtga

SEQ ID NO: 4123675 - DNA, 20 bp, Homo sapiens
aggaagccaggctgagtgag

SEQ ID NO: 4123676 - DNA, 22 bp, Homo sapiens
aggaagcccccaccgtgggcag

SEQ ID NO: 4123677 - DNA, 15 bp, Homo sapiens
aggaaggagagcctg

SEQ ID NO: 4123678 - DNA, 18 bp, Homo sapiens
aggaaggagagcctgctg

SEQ ID NO: 4123679 - DNA, 16 bp, Homo sapiens
aggaaggattgtaaaa

SEQ ID NO: 4123680 - DNA, 17 bp, Homo sapiens
aggaaggattgtaaaaa

SEQ ID NO: 4123681 - DNA, 14 bp, Homo sapiens
aggaaggcaagagg

SEQ ID NO: 4123682 - DNA, 15 bp, Homo sapiens
aggaaggcacttctg

SEQ ID NO: 4123683 - DNA, 12 bp, Homo sapiens
aggaagggcaaa

SEQ ID NO: 4123684 - DNA, 21 bp, Homo sapiens
aggaagggggtctaaggtcta

SEQ ID NO: 4123685 - DNA, 17 bp, Homo sapiens
aggaaggtctcattctt

SEQ ID NO: 4123686 - DNA, 19 bp, Homo sapiens
aggaataaataaaaatgga

SEQ ID NO: 4123687 - DNA, 14 bp, Homo sapiens
aggaataaatgaga

SEQ ID NO: 4123688 - DNA, 20 bp, Homo sapiens
aggaatatgacggaagaaca

SEQ ID NO: 4123689 - DNA, 17 bp, Homo sapiens
aggaatcaagagctgcc

SEQ ID NO: 4123690 - DNA, 21 bp, Homo sapiens
aggaatcatgtcaggcctgtg

SEQ ID NO: 4123691 - DNA, 18 bp, Homo sapiens
aggaatcattccagtgct

SEQ ID NO: 4123692 - DNA, 17 bp, Homo sapiens
aggaatgcctgtgccaa

SEQ ID NO: 4123693 - DNA, 21 bp, Homo sapiens
aggaatgcctgtgccaataaa

SEQ ID NO: 4123694 - DNA, 14 bp, Homo sapiens
aggaatgctctgtg

SEQ ID NO: 4123695 - DNA, 16 bp, Homo sapiens
aggaatgtgtggcctg

SEQ ID NO: 4123696 - DNA, 17 bp, Homo sapiens
aggaattaagttatctt

SEQ ID NO: 4123697 - DNA, 14 bp, Homo sapiens
aggaatttaaaatt

SEQ ID NO: 4123698 - DNA, 19 bp, Homo sapiens
aggacaaaaatgaactgaa

SEQ ID NO: 4123699 - DNA, 16 bp, Homo sapiens
aggacaatactggggt

SEQ ID NO: 4123700 - DNA, 23 bp, Homo sapiens
aggacacactaatcgaactatga

SEQ ID NO: 4123701 - DNA, 14 bp, Homo sapiens
aggacaccagtcca

SEQ ID NO: 4123702 - DNA, 17 bp, Homo sapiens
aggacagaaggctcctg

SEQ ID NO: 4123703 - DNA, 22 bp, Homo sapiens
aggacagaggggtaagatgagg

SEQ ID NO: 4123704 - DNA, 20 bp, Homo sapiens
aggacagagttcacaggagg

SEQ ID NO: 4123705 - DNA, 20 bp, Homo sapiens
aggacaggaaagtggcacct

SEQ ID NO: 4123706 - DNA, 16 bp, Homo sapiens
aggacaggaggcggcc

SEQ ID NO: 4123707 - DNA, 20 bp, Homo sapiens
aggacataaattagaggtct

SEQ ID NO: 4123708 - DNA, 12 bp, Homo sapiens
aggacatcagca

SEQ ID NO: 4123709 - DNA, 22 bp, Homo sapiens
aggacatcagcaaacaggatca

SEQ ID NO: 4123710 - DNA, 14 bp, Homo sapiens
aggacatggcttct

SEQ ID NO: 4123711 - DNA, 21 bp, Homo sapiens
aggacatggcttctgaacctg

SEQ ID NO: 4123712 - DNA, 12 bp, Homo sapiens
aggacattgccc

SEQ ID NO: 4123713 - DNA, 18 bp, Homo sapiens
aggacattgccccaagat

SEQ ID NO: 4123714 - DNA, 12 bp, Homo sapiens
aggaccactcct

SEQ ID NO: 4123715 - DNA, 21 bp, Homo sapiens
aggacccggaggggcctggca

SEQ ID NO: 4123716 - DNA, 19 bp, Homo sapiens
aggaccctgaaggggccat

SEQ ID NO: 4123717 - DNA, 13 bp, Homo sapiens
aggaccctgacct

SEQ ID NO: 4123718 - DNA, 22 bp, Homo sapiens
aggaccctgacctccgcccctg

SEQ ID NO: 4123719 - DNA, 17 bp, Homo sapiens
aggaccgctgataagca

SEQ ID NO: 4123720 - DNA, 18 bp, Homo sapiens
aggacctctgtaggcagc

SEQ ID NO: 4123721 - DNA, 19 bp, Homo sapiens
aggacctctgtaggcagca

SEQ ID NO: 4123722 - DNA, 15 bp, Homo sapiens
aggacctgagctggc

SEQ ID NO: 4123723 - DNA, 17 bp, Homo sapiens
aggacctgagctggcca

SEQ ID NO: 4123724 - DNA, 21 bp, Homo sapiens
aggacctgagctggccaggcc

SEQ ID NO: 4123725 - DNA, 22 bp, Homo sapiens
aggacctgagctggccaggccc

SEQ ID NO: 4123726 - DNA, 12 bp, Homo sapiens
aggacctgcccg

SEQ ID NO: 4123727 - DNA, 18 bp, Homo sapiens
aggacctggcatcatggt

SEQ ID NO: 4123728 - DNA, 22 bp, Homo sapiens
aggacctggcatcatggtggat

SEQ ID NO: 4123729 - DNA, 16 bp, Homo sapiens
aggacctggctgccat

SEQ ID NO: 4123730 - DNA, 16 bp, Homo sapiens
aggaccttatctgtgc

SEQ ID NO: 4123731 - DNA, 20 bp, Homo sapiens
aggacgaacatccaaccttc

SEQ ID NO: 4123732 - DNA, 20 bp, Homo sapiens
aggacgcttcacaggacagg

SEQ ID NO: 4123733 - DNA, 13 bp, Homo sapiens
aggacgcttctga

SEQ ID NO: 4123734 - DNA, 14 bp, Homo sapiens
aggacgcttctgaa

SEQ ID NO: 4123735 - DNA, 15 bp, Homo sapiens
aggacggctcctcag

SEQ ID NO: 4123736 - DNA, 16 bp, Homo sapiens
aggacggtgcaaccca

SEQ ID NO: 4123737 - DNA, 19 bp, Homo sapiens
aggacgtgtgtaaatatgt

SEQ ID NO: 4123738 - DNA, 19 bp, Homo sapiens
aggactacgttaagggaag

SEQ ID NO: 4123739 - DNA, 21 bp, Homo sapiens
aggactagaagattagaaact

SEQ ID NO: 4123740 - DNA, 20 bp, Homo sapiens
aggactatagcccaggtcct

SEQ ID NO: 4123741 - DNA, 20 bp, Homo sapiens
aggactccaggcccaaggct

SEQ ID NO: 4123742 - DNA, 23 bp, Homo sapiens
aggactccaggcccaaggctccc

SEQ ID NO: 4123743 - DNA, 17 bp, Homo sapiens
aggactcccaaccctgg

SEQ ID NO: 4123744 - DNA, 19 bp, Homo sapiens
aggactcccaaccctggct

SEQ ID NO: 4123745 - DNA, 17 bp, Homo sapiens
aggactccccaggccag

SEQ ID NO: 4123746 - DNA, 19 bp, Homo sapiens
aggactccccaggccaggc

SEQ ID NO: 4123747 - DNA, 20 bp, Homo sapiens
aggactccccaggccaggcc

SEQ ID NO: 4123748 - DNA, 17 bp, Homo sapiens
aggactcccggagcctg

SEQ ID NO: 4123749 - DNA, 18 bp, Homo sapiens
aggactccctcctcacct

SEQ ID NO: 4123750 - DNA, 19 bp, Homo sapiens
aggactccctcctcacctc

SEQ ID NO: 4123751 - DNA, 12 bp, Homo sapiens
aggactgaggga

SEQ ID NO: 4123752 - DNA, 18 bp, Homo sapiens
aggactgagggactctga

SEQ ID NO: 4123753 - DNA, 17 bp, Homo sapiens
aggactggattggccaa

SEQ ID NO: 4123754 - DNA, 15 bp, Homo sapiens
aggactgtataagta

SEQ ID NO: 4123755 - DNA, 22 bp, Homo sapiens
aggactgttactcaatgtgtgc

SEQ ID NO: 4123756 - DNA, 18 bp, Homo sapiens
aggacttaacggctccag

SEQ ID NO: 4123757 - DNA, 20 bp, Homo sapiens
aggacttaacggctccagga

SEQ ID NO: 4123758 - DNA, 21 bp, Homo sapiens
aggacttaacggctccaggat

SEQ ID NO: 4123759 - DNA, 23 bp, Homo sapiens
aggacttggagagaatcatgctg

SEQ ID NO: 4123760 - DNA, 23 bp, Homo sapiens
aggactttgaggcaagtgtgggc

SEQ ID NO: 4123761 - DNA, 13 bp, Homo sapiens
aggagaaacacat

SEQ ID NO: 4123762 - DNA, 14 bp, Homo sapiens
aggagaaatctcag

SEQ ID NO: 4123763 - DNA, 20 bp, Homo sapiens
aggagaactacttgaacctg

SEQ ID NO: 4123764 - DNA, 12 bp, Homo sapiens
aggagaagccag

SEQ ID NO: 4123765 - DNA, 20 bp, Homo sapiens
aggagaatggcgtgaacccg

SEQ ID NO: 4123766 - DNA, 20 bp, Homo sapiens
aggagaatggtgtgaacccg

SEQ ID NO: 4123767 - DNA, 12 bp, Homo sapiens
aggagaccacgg

SEQ ID NO: 4123768 - DNA, 11 bp, Homo sapiens
aggagagaccg

SEQ ID NO: 4123769 - DNA, 21 bp, Homo sapiens
aggagagaggctctggggcag

SEQ ID NO: 4123770 - DNA, 13 bp, Homo sapiens
aggagagcctgct

SEQ ID NO: 4123771 - DNA, 15 bp, Homo sapiens
aggagagcctgctgc

SEQ ID NO: 4123772 - DNA, 15 bp, Homo sapiens
aggagaggaaaagta

SEQ ID NO: 4123773 - DNA, 20 bp, Homo sapiens
aggagaggaaaagtaaggtg

SEQ ID NO: 4123774 - DNA, 15 bp, Homo sapiens
aggagaggatgagag

SEQ ID NO: 4123775 - DNA, 17 bp, Homo sapiens
aggagaggatgagagcc

SEQ ID NO: 4123776 - DNA, 17 bp, Homo sapiens
aggagagtagaacagat

SEQ ID NO: 4123777 - DNA, 16 bp, Homo sapiens
aggagatgaccaggga

SEQ ID NO: 4123778 - DNA, 18 bp, Homo sapiens
aggagatgaccagggatg

SEQ ID NO: 4123779 - DNA, 23 bp, Homo sapiens
aggagatggaaacaatgtggagt

SEQ ID NO: 4123780 - DNA, 15 bp, Homo sapiens
aggagatggagggct

SEQ ID NO: 4123781 - DNA, 12 bp, Homo sapiens
aggagcagcagc

SEQ ID NO: 4123782 - DNA, 13 bp, Homo sapiens
aggagcagcagct

SEQ ID NO: 4123783 - DNA, 23 bp, Homo sapiens
aggagcatttttttattcagcag

SEQ ID NO: 4123784 - DNA, 15 bp, Homo sapiens
aggagccagacagac

SEQ ID NO: 4123785 - DNA, 22 bp, Homo sapiens
aggagcctagcggagcccagcc

SEQ ID NO: 4123786 - DNA, 22 bp, Homo sapiens
aggagcctgctggtcacagcct

SEQ ID NO: 4123787 - DNA, 22 bp, Homo sapiens
aggagcgctcccttgacctgct

SEQ ID NO: 4123788 - DNA, 22 bp, Homo sapiens
aggagctcaggtggggagtcca

SEQ ID NO: 4123789 - DNA, 23 bp, Homo sapiens
aggagctctaccctgctccctgc

SEQ ID NO: 4123790 - DNA, 15 bp, Homo sapiens
aggagctgatggcag

SEQ ID NO: 4123791 - DNA, 12 bp, Homo sapiens
aggagctgcctg

SEQ ID NO: 4123792 - DNA, 21 bp, Homo sapiens
aggagctgccttggctcagac

SEQ ID NO: 4123793 - DNA, 14 bp, Homo sapiens
aggagctgctggct

SEQ ID NO: 4123794 - DNA, 17 bp, Homo sapiens
aggagctgctggcttgc

SEQ ID NO: 4123795 - DNA, 21 bp, Homo sapiens
aggagctgtcaccaaggaaac

SEQ ID NO: 4123796 - DNA, 22 bp, Homo sapiens
aggagcttgggcagtgccccag

SEQ ID NO: 4123797 - DNA, 13 bp, Homo sapiens
aggaggaaaagga

SEQ ID NO: 4123798 - DNA, 17 bp, Homo sapiens
aggaggaaggcaagagg

SEQ ID NO: 4123799 - DNA, 17 bp, Homo sapiens
aggaggaatgctggact

SEQ ID NO: 4123800 - DNA, 17 bp, Homo sapiens
aggaggatgtccctggg

SEQ ID NO: 4123801 - DNA, 20 bp, Homo sapiens
aggaggattgcttgagccca

SEQ ID NO: 4123802 - DNA, 23 bp, Homo sapiens
aggaggattgcttgagcccagga

SEQ ID NO: 4123803 - DNA, 14 bp, Homo sapiens
aggaggcagccccc

SEQ ID NO: 4123804 - DNA, 18 bp, Homo sapiens
aggaggcagccccctcca

SEQ ID NO: 4123805 - DNA, 19 bp, Homo sapiens
aggaggcagccccctccac

SEQ ID NO: 4123806 - DNA, 15 bp, Homo sapiens
aggaggccaataaaa

SEQ ID NO: 4123807 - DNA, 18 bp, Homo sapiens
aggaggccaataaaaagt

SEQ ID NO: 4123808 - DNA, 20 bp, Homo sapiens
aggaggccaataaaaagttc

SEQ ID NO: 4123809 - DNA, 14 bp, Homo sapiens
aggaggcctgtccc

SEQ ID NO: 4123810 - DNA, 20 bp, Homo sapiens
aggaggccttgggctctgct

SEQ ID NO: 4123811 - DNA, 23 bp, Homo sapiens
aggagggagacactggcccctca

SEQ ID NO: 4123812 - DNA, 16 bp, Homo sapiens
aggagggcaagggcca

SEQ ID NO: 4123813 - DNA, 19 bp, Homo sapiens
aggaggggagcgtctggga

SEQ ID NO: 4123814 - DNA, 17 bp, Homo sapiens
aggagggggccgggcgc

SEQ ID NO: 4123815 - DNA, 19 bp, Homo sapiens
aggagggggccgggcgcgg

SEQ ID NO: 4123816 - DNA, 17 bp, Homo sapiens
aggagggtacagctggg

SEQ ID NO: 4123817 - DNA, 13 bp, Homo sapiens
aggagggtggggg

SEQ ID NO: 4123818 - DNA, 15 bp, Homo sapiens
aggaggtagagaggg

SEQ ID NO: 4123819 - DNA, 15 bp, Homo sapiens
aggaggtgagagtgg

SEQ ID NO: 4123820 - DNA, 13 bp, Homo sapiens
aggaggtgaggga

SEQ ID NO: 4123821 - DNA, 20 bp, Homo sapiens
aggaggtgtgaggaggaggc

SEQ ID NO: 4123822 - DNA, 14 bp, Homo sapiens
aggaggtttggatg

SEQ ID NO: 4123823 - DNA, 23 bp, Homo sapiens
aggaggtttggggtctgccacca

SEQ ID NO: 4123824 - DNA, 14 bp, Homo sapiens
aggagtcagtgtct

SEQ ID NO: 4123825 - DNA, 14 bp, Homo sapiens
aggagtcccaagga

SEQ ID NO: 4123826 - DNA, 22 bp, Homo sapiens
aggagtcccactccaagccagc

SEQ ID NO: 4123827 - DNA, 15 bp, Homo sapiens
aggagtctctgccac

SEQ ID NO: 4123828 - DNA, 21 bp, Homo sapiens
aggagtctctgccacccactc

SEQ ID NO: 4123829 - DNA, 18 bp, Homo sapiens
aggagtggtgcagacaga

SEQ ID NO: 4123830 - DNA, 14 bp, Homo sapiens
aggagtgtcctctt

SEQ ID NO: 4123831 - DNA, 15 bp, Homo sapiens
aggagtgtcctgccc

SEQ ID NO: 4123832 - DNA, 16 bp, Homo sapiens
aggagtgtggccacgt

SEQ ID NO: 4123833 - DNA, 17 bp, Homo sapiens
aggagttaagagtagca

SEQ ID NO: 4123834 - DNA, 22 bp, Homo sapiens
aggagtttctttagctgacaga

SEQ ID NO: 4123835 - DNA, 19 bp, Homo sapiens
aggagtttgagaccagcct

SEQ ID NO: 4123836 - DNA, 21 bp, Homo sapiens
aggataataattttatagaaa

SEQ ID NO: 4123837 - DNA, 18 bp, Homo sapiens
aggataatgaaataatca

SEQ ID NO: 4123838 - DNA, 19 bp, Homo sapiens
aggatagatgctggcccag

SEQ ID NO: 4123839 - DNA, 20 bp, Homo sapiens
aggatatccttatcagagct

SEQ ID NO: 4123840 - DNA, 23 bp, Homo sapiens
aggatatccttatcagagctaag

SEQ ID NO: 4123841 - DNA, 16 bp, Homo sapiens
aggatatttaagaaaa

SEQ ID NO: 4123842 - DNA, 19 bp, Homo sapiens
aggatatttaagaaaatac

SEQ ID NO: 4123843 - DNA, 15 bp, Homo sapiens
aggatcaagaaagtg

SEQ ID NO: 4123844 - DNA, 22 bp, Homo sapiens
aggatcagttttttgttttaca

SEQ ID NO: 4123845 - DNA, 17 bp, Homo sapiens
aggatcatggtgtaata

SEQ ID NO: 4123846 - DNA, 16 bp, Homo sapiens
aggatccagagagcag

SEQ ID NO: 4123847 - DNA, 21 bp, Homo sapiens
aggatcctattctcaccagga

SEQ ID NO: 4123848 - DNA, 18 bp, Homo sapiens
aggatcctctccactcca

SEQ ID NO: 4123849 - DNA, 19 bp, Homo sapiens
aggatcggactctgcccct

SEQ ID NO: 4123850 - DNA, 20 bp, Homo sapiens
aggatcggactctgcccctg

SEQ ID NO: 4123851 - DNA, 14 bp, Homo sapiens
aggatctctcagga

SEQ ID NO: 4123852 - DNA, 19 bp, Homo sapiens
aggatctctcaggagcaca

SEQ ID NO: 4123853 - DNA, 20 bp, Homo sapiens
aggatctctcaggagcacag

SEQ ID NO: 4123854 - DNA, 20 bp, Homo sapiens
aggatgaatgaggtcccagg

SEQ ID NO: 4123855 - DNA, 23 bp, Homo sapiens
aggatgagagcccagaggtaaca

SEQ ID NO: 4123856 - DNA, 16 bp, Homo sapiens
aggatgctaacatcta

SEQ ID NO: 4123857 - DNA, 22 bp, Homo sapiens
aggatgctaacatctaaaaata

SEQ ID NO: 4123858 - DNA, 17 bp, Homo sapiens
aggatgggatgggttcc

SEQ ID NO: 4123859 - DNA, 19 bp, Homo sapiens
aggatgggggctggcctct

SEQ ID NO: 4123860 - DNA, 17 bp, Homo sapiens
aggatgggtcagagcta

SEQ ID NO: 4123861 - DNA, 21 bp, Homo sapiens
aggatggtctcgatctcctga

SEQ ID NO: 4123862 - DNA, 17 bp, Homo sapiens
aggatgtcacagggcca

SEQ ID NO: 4123863 - DNA, 17 bp, Homo sapiens
aggatgtccctgggcca

SEQ ID NO: 4123864 - DNA, 23 bp, Homo sapiens
aggatgtccctgggccagggtct

SEQ ID NO: 4123865 - DNA, 20 bp, Homo sapiens
aggatgtgattgtggaatgg

SEQ ID NO: 4123866 - DNA, 18 bp, Homo sapiens
aggattataaatgaaatt

SEQ ID NO: 4123867 - DNA, 18 bp, Homo sapiens
aggattattgatagtact

SEQ ID NO: 4123868 - DNA, 17 bp, Homo sapiens
aggattgcttgagccca

SEQ ID NO: 4123869 - DNA, 21 bp, Homo sapiens
aggattgcttgagcccaggag

SEQ ID NO: 4123870 - DNA, 13 bp, Homo sapiens
aggattgtaaaaa

SEQ ID NO: 4123871 - DNA, 23 bp, Homo sapiens
aggattgtaaaaaaaaatgcctt

SEQ ID NO: 4123872 - DNA, 21 bp, Homo sapiens
aggatttaacagtcatttaaa

SEQ ID NO: 4123873 - DNA, 18 bp, Homo sapiens
aggatttctaatcaaaag

SEQ ID NO: 4123874 - DNA, 19 bp, Homo sapiens
aggatttttttcctcccca

SEQ ID NO: 4123875 - DNA, 15 bp, Homo sapiens
aggcaaaaaactctt

SEQ ID NO: 4123876 - DNA, 16 bp, Homo sapiens
aggcaaaaaactctta

SEQ ID NO: 4123877 - DNA, 19 bp, Homo sapiens
aggcaaaattgcaaatctt

SEQ ID NO: 4123878 - DNA, 21 bp, Homo sapiens
aggcaaagataatttatttca

SEQ ID NO: 4123879 - DNA, 22 bp, Homo sapiens
aggcaacactggaacatggcta

SEQ ID NO: 4123880 - DNA, 18 bp, Homo sapiens
aggcaagaaaaggacaaa

SEQ ID NO: 4123881 - DNA, 17 bp, Homo sapiens
aggcaagagggggtgga

SEQ ID NO: 4123882 - DNA, 21 bp, Homo sapiens
aggcaagagggggtggagggg

SEQ ID NO: 4123883 - DNA, 14 bp, Homo sapiens
aggcaagcaggacc

SEQ ID NO: 4123884 - DNA, 15 bp, Homo sapiens
aggcaagcaggacct

SEQ ID NO: 4123885 - DNA, 16 bp, Homo sapiens
aggcaagcaggacctg

SEQ ID NO: 4123886 - DNA, 18 bp, Homo sapiens
aggcaagtttctagctag

SEQ ID NO: 4123887 - DNA, 22 bp, Homo sapiens
aggcaatgattgttaatttaca

SEQ ID NO: 4123888 - DNA, 18 bp, Homo sapiens
aggcacacacagccccta

SEQ ID NO: 4123889 - DNA, 14 bp, Homo sapiens
aggcacacagcagc

SEQ ID NO: 4123890 - DNA, 16 bp, Homo sapiens
aggcacacagcagccc

SEQ ID NO: 4123891 - DNA, 17 bp, Homo sapiens
aggcacacagcagcccc

SEQ ID NO: 4123892 - DNA, 14 bp, Homo sapiens
aggcacagctgagt

SEQ ID NO: 4123893 - DNA, 15 bp, Homo sapiens
aggcacagggagaag

SEQ ID NO: 4123894 - DNA, 18 bp, Homo sapiens
aggcaccgagaatgttgt

SEQ ID NO: 4123895 - DNA, 22 bp, Homo sapiens
aggcaccgccacgtcccagcat

SEQ ID NO: 4123896 - DNA, 14 bp, Homo sapiens
aggcactcttaaat

SEQ ID NO: 4123897 - DNA, 13 bp, Homo sapiens
aggcactgccctt

SEQ ID NO: 4123898 - DNA, 22 bp, Homo sapiens
aggcactgcccttttcaggaag

SEQ ID NO: 4123899 - DNA, 23 bp, Homo sapiens
aggcactgccttctcctctctgg

SEQ ID NO: 4123900 - DNA, 15 bp, Homo sapiens
aggcacttctgcctg

SEQ ID NO: 4123901 - DNA, 13 bp, Homo sapiens
aggcagacagcag

SEQ ID NO: 4123902 - DNA, 19 bp, Homo sapiens
aggcagacagcaggcagcg

SEQ ID NO: 4123903 - DNA, 17 bp, Homo sapiens
aggcagagaaagaagag

SEQ ID NO: 4123904 - DNA, 18 bp, Homo sapiens
aggcagagaaagaagaga

SEQ ID NO: 4123905 - DNA, 16 bp, Homo sapiens
aggcagatagcactgg

SEQ ID NO: 4123906 - DNA, 15 bp, Homo sapiens
aggcagatctgtgcc

SEQ ID NO: 4123907 - DNA, 17 bp, Homo sapiens
aggcagatggagcccat

SEQ ID NO: 4123908 - DNA, 16 bp, Homo sapiens
aggcagattgaaaagg

SEQ ID NO: 4123909 - DNA, 16 bp, Homo sapiens
aggcagatttgaggtt

SEQ ID NO: 4123910 - DNA, 23 bp, Homo sapiens
aggcagcagagagagaggacaga

SEQ ID NO: 4123911 - DNA, 16 bp, Homo sapiens
aggcagctcacccctg

SEQ ID NO: 4123912 - DNA, 18 bp, Homo sapiens
aggcagctggatgagact

SEQ ID NO: 4123913 - DNA, 22 bp, Homo sapiens
aggcagctggatgagacttcca

SEQ ID NO: 4123914 - DNA, 13 bp, Homo sapiens
aggcagctgttgt

SEQ ID NO: 4123915 - DNA, 20 bp, Homo sapiens
aggcagctgttgtctcttct

SEQ ID NO: 4123916 - DNA, 18 bp, Homo sapiens
aggcagcttcaagtgcct

SEQ ID NO: 4123917 - DNA, 19 bp, Homo sapiens
aggcagcttcaagtgcctt

SEQ ID NO: 4123918 - DNA, 20 bp, Homo sapiens
aggcagcttctactcctgcc

SEQ ID NO: 4123919 - DNA, 21 bp, Homo sapiens
aggcagcttctactcctgcct

SEQ ID NO: 4123920 - DNA, 20 bp, Homo sapiens
aggcaggaagggcaggaagg

SEQ ID NO: 4123921 - DNA, 22 bp, Homo sapiens
aggcaggcatagaggcttctcc

SEQ ID NO: 4123922 - DNA, 13 bp, Homo sapiens
aggcaggcattga

SEQ ID NO: 4123923 - DNA, 21 bp, Homo sapiens
aggcagggcccttggggctgg

SEQ ID NO: 4123924 - DNA, 20 bp, Homo sapiens
aggcaggggtgggggtggag

SEQ ID NO: 4123925 - DNA, 22 bp, Homo sapiens
aggcaggggtgggggtggaggc

SEQ ID NO: 4123926 - DNA, 23 bp, Homo sapiens
aggcaggggtgggggtggaggct

SEQ ID NO: 4123927 - DNA, 15 bp, Homo sapiens
aggcagggtgtctgc

SEQ ID NO: 4123928 - DNA, 13 bp, Homo sapiens
aggcaggtgcctg

SEQ ID NO: 4123929 - DNA, 17 bp, Homo sapiens
aggcagttgcccagcct

SEQ ID NO: 4123930 - DNA, 17 bp, Homo sapiens
aggcataggcctgggtg

SEQ ID NO: 4123931 - DNA, 20 bp, Homo sapiens
aggcataggcctgggtgctg

SEQ ID NO: 4123932 - DNA, 22 bp, Homo sapiens
aggcatattgctttttctaatg

SEQ ID NO: 4123933 - DNA, 23 bp, Homo sapiens
aggcatcagtccccctgtgcata

SEQ ID NO: 4123934 - DNA, 13 bp, Homo sapiens
aggcatcccagcc

SEQ ID NO: 4123935 - DNA, 22 bp, Homo sapiens
aggcatcccagcctgggggcca

SEQ ID NO: 4123936 - DNA, 21 bp, Homo sapiens
aggcatcgggggtgaatcttg

SEQ ID NO: 4123937 - DNA, 18 bp, Homo sapiens
aggcatctacacagcctg

SEQ ID NO: 4123938 - DNA, 20 bp, Homo sapiens
aggcatgaaattcttcctaa

SEQ ID NO: 4123939 - DNA, 14 bp, Homo sapiens
aggcatgagaaaga

SEQ ID NO: 4123940 - DNA, 14 bp, Homo sapiens
aggcatggccctgg

SEQ ID NO: 4123941 - DNA, 16 bp, Homo sapiens
aggcatggccctgggg

SEQ ID NO: 4123942 - DNA, 17 bp, Homo sapiens
aggcatggctcagagct

SEQ ID NO: 4123943 - DNA, 13 bp, Homo sapiens
aggcatggctggg

SEQ ID NO: 4123944 - DNA, 13 bp, Homo sapiens
aggcattaacaca

SEQ ID NO: 4123945 - DNA, 19 bp, Homo sapiens
aggcattaacacaaaggag

SEQ ID NO: 4123946 - DNA, 20 bp, Homo sapiens
aggcattaatgtttctatct

SEQ ID NO: 4123947 - DNA, 14 bp, Homo sapiens
aggcattgaggaag

SEQ ID NO: 4123948 - DNA, 19 bp, Homo sapiens
aggcattgaggaagagtct

SEQ ID NO: 4123949 - DNA, 23 bp, Homo sapiens
aggccaaaattaccaaaaatctt

SEQ ID NO: 4123950 - DNA, 22 bp, Homo sapiens
aggccaaactgtccctcccttg

SEQ ID NO: 4123951 - DNA, 16 bp, Homo sapiens
aggccaaaggctggtg

SEQ ID NO: 4123952 - DNA, 14 bp, Homo sapiens
aggccaacagcacc

SEQ ID NO: 4123953 - DNA, 18 bp, Homo sapiens
aggccaacagcacctccc

SEQ ID NO: 4123954 - DNA, 21 bp, Homo sapiens
aggccaagaaacgtcttctaa

SEQ ID NO: 4123955 - DNA, 21 bp, Homo sapiens
aggccaagaggtttggctcct

SEQ ID NO: 4123956 - DNA, 14 bp, Homo sapiens
aggccaataaaaag

SEQ ID NO: 4123957 - DNA, 16 bp, Homo sapiens
aggccaataaaaagtt

SEQ ID NO: 4123958 - DNA, 17 bp, Homo sapiens
aggccacactcagcaca

SEQ ID NO: 4123959 - DNA, 14 bp, Homo sapiens
aggccaccgggaca

SEQ ID NO: 4123960 - DNA, 15 bp, Homo sapiens
aggccagagggcagt

SEQ ID NO: 4123961 - DNA, 18 bp, Homo sapiens
aggccagagggcagtggc

SEQ ID NO: 4123962 - DNA, 16 bp, Homo sapiens
aggccagagtggcctg

SEQ ID NO: 4123963 - DNA, 19 bp, Homo sapiens
aggccagagtggcctggcc

SEQ ID NO: 4123964 - DNA, 11 bp, Homo sapiens
aggccagccca

SEQ ID NO: 4123965 - DNA, 17 bp, Homo sapiens
aggccagcccagccagg

SEQ ID NO: 4123966 - DNA, 18 bp, Homo sapiens
aggccagcccagccaggc

SEQ ID NO: 4123967 - DNA, 14 bp, Homo sapiens
aggccagccccacc

SEQ ID NO: 4123968 - DNA, 21 bp, Homo sapiens
aggccagccccacccaggagg

SEQ ID NO: 4123969 - DNA, 19 bp, Homo sapiens
aggccaggccaccaggatg

SEQ ID NO: 4123970 - DNA, 15 bp, Homo sapiens
aggccagggcatgtg

SEQ ID NO: 4123971 - DNA, 14 bp, Homo sapiens
aggccagtccccat

SEQ ID NO: 4123972 - DNA, 18 bp, Homo sapiens
aggccagtgggcgggcca

SEQ ID NO: 4123973 - DNA, 16 bp, Homo sapiens
aggccataaaacaggt

SEQ ID NO: 4123974 - DNA, 14 bp, Homo sapiens
aggccatctcagga

SEQ ID NO: 4123975 - DNA, 14 bp, Homo sapiens
aggcccaactgtga

SEQ ID NO: 4123976 - DNA, 21 bp, Homo sapiens
aggcccaagagcagagtctgg

SEQ ID NO: 4123977 - DNA, 22 bp, Homo sapiens
aggcccaagagcagagtctggg

SEQ ID NO: 4123978 - DNA, 17 bp, Homo sapiens
aggcccaaggctcccgg

SEQ ID NO: 4123979 - DNA, 18 bp, Homo sapiens
aggcccaaggtcccctcc

SEQ ID NO: 4123980 - DNA, 19 bp, Homo sapiens
aggcccagcgcggccagcg

SEQ ID NO: 4123981 - DNA, 16 bp, Homo sapiens
aggcccagcgggcaga

SEQ ID NO: 4123982 - DNA, 18 bp, Homo sapiens
aggcccagcgggcagatg

SEQ ID NO: 4123983 - DNA, 19 bp, Homo sapiens
aggcccaggcctcaccacc

SEQ ID NO: 4123984 - DNA, 22 bp, Homo sapiens
aggcccaggcctcaccacctga

SEQ ID NO: 4123985 - DNA, 17 bp, Homo sapiens
aggcccaggcctgggtt

SEQ ID NO: 4123986 - DNA, 13 bp, Homo sapiens
aggcccaggctgg

SEQ ID NO: 4123987 - DNA, 17 bp, Homo sapiens
aggcccaggctgggaac

SEQ ID NO: 4123988 - DNA, 23 bp, Homo sapiens
aggcccagggagggaagtgtgag

SEQ ID NO: 4123989 - DNA, 23 bp, Homo sapiens
aggcccatgtatataagtactga

SEQ ID NO: 4123990 - DNA, 14 bp, Homo sapiens
aggccccactgatg

SEQ ID NO: 4123991 - DNA, 15 bp, Homo sapiens
aggccccactgatgc

SEQ ID NO: 4123992 - DNA, 21 bp, Homo sapiens
aggccccactgatgctgttct

SEQ ID NO: 4123993 - DNA, 13 bp, Homo sapiens
aggccccagacag

SEQ ID NO: 4123994 - DNA, 12 bp, Homo sapiens
aggccccagcct

SEQ ID NO: 4123995 - DNA, 19 bp, Homo sapiens
aggcccccaaacatagccc

SEQ ID NO: 4123996 - DNA, 22 bp, Homo sapiens
aggcccccaaacatagcccctg

SEQ ID NO: 4123997 - DNA, 14 bp, Homo sapiens
aggcccccagtggg

SEQ ID NO: 4123998 - DNA, 23 bp, Homo sapiens
aggcccccagtgggaccacatgc

SEQ ID NO: 4123999 - DNA, 15 bp, Homo sapiens
aggcccctcctagac

SEQ ID NO: 4124000 - DNA, 19 bp, Homo sapiens
aggcccctcctagacccag

SEQ ID NO: 4124001 - DNA, 23 bp, Homo sapiens
aggcccctcctagacccaggtgg

SEQ ID NO: 4124002 - DNA, 14 bp, Homo sapiens
aggcccctggagcc

SEQ ID NO: 4124003 - DNA, 21 bp, Homo sapiens
aggcccgcaccccggcctcag

SEQ ID NO: 4124004 - DNA, 23 bp, Homo sapiens
aggcccgcaccccggcctcaggg

SEQ ID NO: 4124005 - DNA, 20 bp, Homo sapiens
aggcccgctctacatcttct

SEQ ID NO: 4124006 - DNA, 14 bp, Homo sapiens
aggccctccctgac

SEQ ID NO: 4124007 - DNA, 22 bp, Homo sapiens
aggccctccctgactccctgtg

SEQ ID NO: 4124008 - DNA, 23 bp, Homo sapiens
aggccctccctgactccctgtgg

SEQ ID NO: 4124009 - DNA, 22 bp, Homo sapiens
aggccctccctgttccccagag

SEQ ID NO: 4124010 - DNA, 21 bp, Homo sapiens
aggccctcctctcccatcctt

SEQ ID NO: 4124011 - DNA, 16 bp, Homo sapiens
aggccctgactcctct

SEQ ID NO: 4124012 - DNA, 17 bp, Homo sapiens
aggccctgactcctctg

SEQ ID NO: 4124013 - DNA, 19 bp, Homo sapiens
aggccctgactcctctggc

SEQ ID NO: 4124014 - DNA, 21 bp, Homo sapiens
aggccctgactcctctggctt

SEQ ID NO: 4124015 - DNA, 12 bp, Homo sapiens
aggccctgctcc

SEQ ID NO: 4124016 - DNA, 16 bp, Homo sapiens
aggccctgctcctgca

SEQ ID NO: 4124017 - DNA, 17 bp, Homo sapiens
aggccctgctcctgcag

SEQ ID NO: 4124018 - DNA, 21 bp, Homo sapiens
aggccctgctcctgcagcatg

SEQ ID NO: 4124019 - DNA, 13 bp, Homo sapiens
aggccctgggctg

SEQ ID NO: 4124020 - DNA, 20 bp, Homo sapiens
aggccctgggctgggtgctg

SEQ ID NO: 4124021 - DNA, 22 bp, Homo sapiens
aggccctgggctgggtgctggg

SEQ ID NO: 4124022 - DNA, 17 bp, Homo sapiens
aggcccttcctctccac

SEQ ID NO: 4124023 - DNA, 22 bp, Homo sapiens
aggcccttcctctccactgcct

SEQ ID NO: 4124024 - DNA, 21 bp, Homo sapiens
aggccgaaggtgcctcagact

SEQ ID NO: 4124025 - DNA, 21 bp, Homo sapiens
aggccgagcgttcccagcagg

SEQ ID NO: 4124026 - DNA, 23 bp, Homo sapiens
aggccgagcgttcccagcagggg

SEQ ID NO: 4124027 - DNA, 21 bp, Homo sapiens
aggccggaaccacagggccag

SEQ ID NO: 4124028 - DNA, 23 bp, Homo sapiens
aggccgggcttgggccctgcaca

SEQ ID NO: 4124029 - DNA, 17 bp, Homo sapiens
aggcctaaaagtaaaca

SEQ ID NO: 4124030 - DNA, 13 bp, Homo sapiens
aggcctaagacat

SEQ ID NO: 4124031 - DNA, 21 bp, Homo sapiens
aggcctacagccacatcccca

SEQ ID NO: 4124032 - DNA, 15 bp, Homo sapiens
aggcctcaccacctg

SEQ ID NO: 4124033 - DNA, 19 bp, Homo sapiens
aggcctcaccacctgacgc

SEQ ID NO: 4124034 - DNA, 15 bp, Homo sapiens
aggcctcaggtgctg

SEQ ID NO: 4124035 - DNA, 15 bp, Homo sapiens
aggcctccctctctc

SEQ ID NO: 4124036 - DNA, 22 bp, Homo sapiens
aggcctccctctctcttctgct

SEQ ID NO: 4124037 - DNA, 22 bp, Homo sapiens
aggcctcctgtggcctgccagt

SEQ ID NO: 4124038 - DNA, 23 bp, Homo sapiens
aggcctcctgtggcctgccagtc

SEQ ID NO: 4124039 - DNA, 23 bp, Homo sapiens
aggcctctccagtttgcacctgt

SEQ ID NO: 4124040 - DNA, 20 bp, Homo sapiens
aggcctctgtgtccttccct

SEQ ID NO: 4124041 - DNA, 19 bp, Homo sapiens
aggcctgacttctgctggc

SEQ ID NO: 4124042 - DNA, 20 bp, Homo sapiens
aggcctgctgccagtgcagc

SEQ ID NO: 4124043 - DNA, 17 bp, Homo sapiens
aggcctggactttcctg

SEQ ID NO: 4124044 - DNA, 19 bp, Homo sapiens
aggcctggactttcctgca

SEQ ID NO: 4124045 - DNA, 22 bp, Homo sapiens
aggcctggactttcctgcaact

SEQ ID NO: 4124046 - DNA, 15 bp, Homo sapiens
aggcctggccaggca

SEQ ID NO: 4124047 - DNA, 14 bp, Homo sapiens
aggcctggctggaa

SEQ ID NO: 4124048 - DNA, 17 bp, Homo sapiens
aggcctgggtctgtgtc

SEQ ID NO: 4124049 - DNA, 17 bp, Homo sapiens
aggcctggtgtttcttg

SEQ ID NO: 4124050 - DNA, 12 bp, Homo sapiens
aggcctgtccca

SEQ ID NO: 4124051 - DNA, 13 bp, Homo sapiens
aggcctgtcccaa

SEQ ID NO: 4124052 - DNA, 19 bp, Homo sapiens
aggcctgtcccttgcctct

SEQ ID NO: 4124053 - DNA, 15 bp, Homo sapiens
aggcctgtgcccact

SEQ ID NO: 4124054 - DNA, 17 bp, Homo sapiens
aggcctgtgcccactcc

SEQ ID NO: 4124055 - DNA, 21 bp, Homo sapiens
aggcctgtgcccactccctat

SEQ ID NO: 4124056 - DNA, 20 bp, Homo sapiens
aggcctgttgctatagagcc

SEQ ID NO: 4124057 - DNA, 20 bp, Homo sapiens
aggccttccagctgctgtct

SEQ ID NO: 4124058 - DNA, 16 bp, Homo sapiens
aggccttcctctctcc

SEQ ID NO: 4124059 - DNA, 18 bp, Homo sapiens
aggccttgggctctgctg

SEQ ID NO: 4124060 - DNA, 16 bp, Homo sapiens
aggcgagtctggggac

SEQ ID NO: 4124061 - DNA, 23 bp, Homo sapiens
aggcgagtctggggacctggcac

SEQ ID NO: 4124062 - DNA, 23 bp, Homo sapiens
aggcgatccacctgtctcagcct

SEQ ID NO: 4124063 - DNA, 19 bp, Homo sapiens
aggcgcacagtgtgagccc

SEQ ID NO: 4124064 - DNA, 21 bp, Homo sapiens
aggcgcactgtgacccccagc

SEQ ID NO: 4124065 - DNA, 22 bp, Homo sapiens
aggcgcactgtgacccccagct

SEQ ID NO: 4124066 - DNA, 15 bp, Homo sapiens
aggcgcttcccaact

SEQ ID NO: 4124067 - DNA, 15 bp, Homo sapiens
aggcggagagtacag

SEQ ID NO: 4124068 - DNA, 20 bp, Homo sapiens
aggcggagagtacagtgagc

SEQ ID NO: 4124069 - DNA, 17 bp, Homo sapiens
aggcggaggctgtgctc

SEQ ID NO: 4124070 - DNA, 21 bp, Homo sapiens
aggcggcccggccagcgggca

SEQ ID NO: 4124071 - DNA, 20 bp, Homo sapiens
aggcgggaggaggtgtgagg

SEQ ID NO: 4124072 - DNA, 16 bp, Homo sapiens
aggcggggtgctgtgg

SEQ ID NO: 4124073 - DNA, 20 bp, Homo sapiens
aggcggtccccatccccacc

SEQ ID NO: 4124074 - DNA, 21 bp, Homo sapiens
aggcggtccccatccccacca

SEQ ID NO: 4124075 - DNA, 18 bp, Homo sapiens
aggcgtgggctgaccagg

SEQ ID NO: 4124076 - DNA, 20 bp, Homo sapiens
aggcgtgggctgaccaggct

SEQ ID NO: 4124077 - DNA, 21 bp, Homo sapiens
aggctaaacatccaatatttt

SEQ ID NO: 4124078 - DNA, 15 bp, Homo sapiens
aggctagcttctgct

SEQ ID NO: 4124079 - DNA, 22 bp, Homo sapiens
aggctatggacagggcatgcca

SEQ ID NO: 4124080 - DNA, 21 bp, Homo sapiens
aggctatggagggtcctcctc

SEQ ID NO: 4124081 - DNA, 16 bp, Homo sapiens
aggctatttgtaaatc

SEQ ID NO: 4124082 - DNA, 21 bp, Homo sapiens
aggctatttgtaaatctgcca

SEQ ID NO: 4124083 - DNA, 22 bp, Homo sapiens
aggctatttgtaaatctgccac

SEQ ID NO: 4124084 - DNA, 11 bp, Homo sapiens
aggctcagaga

SEQ ID NO: 4124085 - DNA, 13 bp, Homo sapiens
aggctcagagatg

SEQ ID NO: 4124086 - DNA, 14 bp, Homo sapiens
aggctcagagatgt

SEQ ID NO: 4124087 - DNA, 10 bp, Homo sapiens
aggctcaggt

SEQ ID NO: 4124088 - DNA, 21 bp, Homo sapiens
aggctcctccttgcccagact

SEQ ID NO: 4124089 - DNA, 13 bp, Homo sapiens
aggctcctgcccc

SEQ ID NO: 4124090 - DNA, 22 bp, Homo sapiens
aggctccttagggttttctctc

SEQ ID NO: 4124091 - DNA, 20 bp, Homo sapiens
aggctccttcaacaaggctt

SEQ ID NO: 4124092 - DNA, 15 bp, Homo sapiens
aggctctctgggctg

SEQ ID NO: 4124093 - DNA, 13 bp, Homo sapiens
aggctctgcacag

SEQ ID NO: 4124094 - DNA, 17 bp, Homo sapiens
aggctctgcacagatgg

SEQ ID NO: 4124095 - DNA, 22 bp, Homo sapiens
aggctctgcttctccaaggaaa

SEQ ID NO: 4124096 - DNA, 23 bp, Homo sapiens
aggctctggacagcagaagcctc

SEQ ID NO: 4124097 - DNA, 13 bp, Homo sapiens
aggctctggggca

SEQ ID NO: 4124098 - DNA, 22 bp, Homo sapiens
aggctctttggggtcagccagg

SEQ ID NO: 4124099 - DNA, 17 bp, Homo sapiens
aggctgaaagaggccaa

SEQ ID NO: 4124100 - DNA, 13 bp, Homo sapiens
aggctgaccacag

SEQ ID NO: 4124101 - DNA, 18 bp, Homo sapiens
aggctgaccacagcacag

SEQ ID NO: 4124102 - DNA, 20 bp, Homo sapiens
aggctgacgtgtgagggagg

SEQ ID NO: 4124103 - DNA, 18 bp, Homo sapiens
aggctgaggcaagagaat

SEQ ID NO: 4124104 - DNA, 14 bp, Homo sapiens
aggctgaggcagga

SEQ ID NO: 4124105 - DNA, 15 bp, Homo sapiens
aggctgaggcaggag

SEQ ID NO: 4124106 - DNA, 17 bp, Homo sapiens
aggctgaggcaggagga

SEQ ID NO: 4124107 - DNA, 13 bp, Homo sapiens
aggctgaggcctg

SEQ ID NO: 4124108 - DNA, 14 bp, Homo sapiens
aggctgaggcctgg

SEQ ID NO: 4124109 - DNA, 15 bp, Homo sapiens
aggctgaggctggca

SEQ ID NO: 4124110 - DNA, 17 bp, Homo sapiens
aggctgaggctggcaca

SEQ ID NO: 4124111 - DNA, 16 bp, Homo sapiens
aggctgagggctgcca

SEQ ID NO: 4124112 - DNA, 17 bp, Homo sapiens
aggctgagggctgccag

SEQ ID NO: 4124113 - DNA, 14 bp, Homo sapiens
aggctgaggtgtct

SEQ ID NO: 4124114 - DNA, 14 bp, Homo sapiens
aggctgagtccaga

SEQ ID NO: 4124115 - DNA, 18 bp, Homo sapiens
aggctgagtgagccacag

SEQ ID NO: 4124116 - DNA, 19 bp, Homo sapiens
aggctgcacccctgggcca

SEQ ID NO: 4124117 - DNA, 19 bp, Homo sapiens
aggctgcagaggcacctca

SEQ ID NO: 4124118 - DNA, 12 bp, Homo sapiens
aggctgcccccg

SEQ ID NO: 4124119 - DNA, 14 bp, Homo sapiens
aggctgcttagaat

SEQ ID NO: 4124120 - DNA, 23 bp, Homo sapiens
aggctggatcttggagaatgtga

SEQ ID NO: 4124121 - DNA, 13 bp, Homo sapiens
aggctggctggcc

SEQ ID NO: 4124122 - DNA, 18 bp, Homo sapiens
aggctgggaactcatctg

SEQ ID NO: 4124123 - DNA, 18 bp, Homo sapiens
aggctgggacgctctgct

SEQ ID NO: 4124124 - DNA, 19 bp, Homo sapiens
aggctgggacggaccagca

SEQ ID NO: 4124125 - DNA, 17 bp, Homo sapiens
aggctgggcagccccag

SEQ ID NO: 4124126 - DNA, 23 bp, Homo sapiens
aggctgggcagccccagagagag

SEQ ID NO: 4124127 - DNA, 18 bp, Homo sapiens
aggctgggccatgtccaa

SEQ ID NO: 4124128 - DNA, 14 bp, Homo sapiens
aggctgggcccctg

SEQ ID NO: 4124129 - DNA, 20 bp, Homo sapiens
aggctggggcggggcccagg

SEQ ID NO: 4124130 - DNA, 22 bp, Homo sapiens
aggctggggcggggcccaggag

SEQ ID NO: 4124131 - DNA, 19 bp, Homo sapiens
aggctgggggagagccgtg

SEQ ID NO: 4124132 - DNA, 17 bp, Homo sapiens
aggctggtaagagaagt

SEQ ID NO: 4124133 - DNA, 18 bp, Homo sapiens
aggctggtaagagaagtg

SEQ ID NO: 4124134 - DNA, 22 bp, Homo sapiens
aggctggtgctgtggccagggt

SEQ ID NO: 4124135 - DNA, 18 bp, Homo sapiens
aggctgtagaaaggggag

SEQ ID NO: 4124136 - DNA, 21 bp, Homo sapiens
aggctgtcctgtacattgtgg

SEQ ID NO: 4124137 - DNA, 14 bp, Homo sapiens
aggctgtctggggc

SEQ ID NO: 4124138 - DNA, 15 bp, Homo sapiens
aggctgtgggcctca

SEQ ID NO: 4124139 - DNA, 22 bp, Homo sapiens
aggctgtgtccctcttctcttc

SEQ ID NO: 4124140 - DNA, 21 bp, Homo sapiens
aggctgttccatgttctattt

SEQ ID NO: 4124141 - DNA, 12 bp, Homo sapiens
aggctgttctcc

SEQ ID NO: 4124142 - DNA, 17 bp, Homo sapiens
aggcttctccgccagcc

SEQ ID NO: 4124143 - DNA, 16 bp, Homo sapiens
aggcttctccttctcc

SEQ ID NO: 4124144 - DNA, 15 bp, Homo sapiens
aggcttgctgcagat

SEQ ID NO: 4124145 - DNA, 21 bp, Homo sapiens
aggcttgggatttgctgtgta

SEQ ID NO: 4124146 - DNA, 13 bp, Homo sapiens
aggctttgtgttg

SEQ ID NO: 4124147 - DNA, 18 bp, Homo sapiens
aggctttgtgttgtaatt

SEQ ID NO: 4124148 - DNA, 10 bp, Homo sapiens
agggaaaagg

SEQ ID NO: 4124149 - DNA, 16 bp, Homo sapiens
agggaaaattgcccca

SEQ ID NO: 4124150 - DNA, 18 bp, Homo sapiens
agggaaaggggtgctttt

SEQ ID NO: 4124151 - DNA, 19 bp, Homo sapiens
agggaaaggggtgctttta

SEQ ID NO: 4124152 - DNA, 13 bp, Homo sapiens
agggaactgggga

SEQ ID NO: 4124153 - DNA, 12 bp, Homo sapiens
agggaagaaact

SEQ ID NO: 4124154 - DNA, 18 bp, Homo sapiens
agggaagaaggaggaatg

SEQ ID NO: 4124155 - DNA, 18 bp, Homo sapiens
agggaaggaactctggct

SEQ ID NO: 4124156 - DNA, 12 bp, Homo sapiens
agggaaggcctg

SEQ ID NO: 4124157 - DNA, 13 bp, Homo sapiens
agggaaggcctga

SEQ ID NO: 4124158 - DNA, 16 bp, Homo sapiens
agggaaggcctgactt

SEQ ID NO: 4124159 - DNA, 20 bp, Homo sapiens
agggaaggggaggcagccgg

SEQ ID NO: 4124160 - DNA, 15 bp, Homo sapiens
agggaatccagctcc

SEQ ID NO: 4124161 - DNA, 15 bp, Homo sapiens
agggaatcctcctcc

SEQ ID NO: 4124162 - DNA, 16 bp, Homo sapiens
agggaatcctcctcca

SEQ ID NO: 4124163 - DNA, 18 bp, Homo sapiens
agggaatcctcctccagg

SEQ ID NO: 4124164 - DNA, 13 bp, Homo sapiens
agggaattgctca

SEQ ID NO: 4124165 - DNA, 20 bp, Homo sapiens
agggacacccctacacacac

SEQ ID NO: 4124166 - DNA, 20 bp, Homo sapiens
agggacagaggccccagcct

SEQ ID NO: 4124167 - DNA, 18 bp, Homo sapiens
agggacatgctcacctct

SEQ ID NO: 4124168 - DNA, 19 bp, Homo sapiens
agggaccaactgggcccaa

SEQ ID NO: 4124169 - DNA, 18 bp, Homo sapiens
agggaccggtgctgcagg

SEQ ID NO: 4124170 - DNA, 21 bp, Homo sapiens
agggaccggtgctgcaggagt

SEQ ID NO: 4124171 - DNA, 17 bp, Homo sapiens
agggaccgtccagggga

SEQ ID NO: 4124172 - DNA, 14 bp, Homo sapiens
agggaccttgaagg

SEQ ID NO: 4124173 - DNA, 15 bp, Homo sapiens
agggaccttgaaggg

SEQ ID NO: 4124174 - DNA, 20 bp, Homo sapiens
agggactctgaagcctctgg

SEQ ID NO: 4124175 - DNA, 15 bp, Homo sapiens
agggactggaaccag

SEQ ID NO: 4124176 - DNA, 12 bp, Homo sapiens
agggacttaaaa

SEQ ID NO: 4124177 - DNA, 13 bp, Homo sapiens
agggagaaaagag

SEQ ID NO: 4124178 - DNA, 15 bp, Homo sapiens
agggagaaaagagaa

SEQ ID NO: 4124179 - DNA, 16 bp, Homo sapiens
agggagaaggatctag

SEQ ID NO: 4124180 - DNA, 22 bp, Homo sapiens
agggagaaggatctagaatgtg

SEQ ID NO: 4124181 - DNA, 12 bp, Homo sapiens
agggagaatata

SEQ ID NO: 4124182 - DNA, 15 bp, Homo sapiens
agggagagccagctc

SEQ ID NO: 4124183 - DNA, 18 bp, Homo sapiens
agggagcaagacagagac

SEQ ID NO: 4124184 - DNA, 22 bp, Homo sapiens
agggagcacaacccccagctcc

SEQ ID NO: 4124185 - DNA, 23 bp, Homo sapiens
agggagcacaacccccagctccc

SEQ ID NO: 4124186 - DNA, 17 bp, Homo sapiens
agggagcagacaggagg

SEQ ID NO: 4124187 - DNA, 22 bp, Homo sapiens
agggagcaggccggaaccacag

SEQ ID NO: 4124188 - DNA, 19 bp, Homo sapiens
agggagcagggaaggcctg

SEQ ID NO: 4124189 - DNA, 17 bp, Homo sapiens
agggagcccctttgatg

SEQ ID NO: 4124190 - DNA, 10 bp, Homo sapiens
agggagcctc

SEQ ID NO: 4124191 - DNA, 22 bp, Homo sapiens
agggagcctccccatctgtcca

SEQ ID NO: 4124192 - DNA, 18 bp, Homo sapiens
agggagcctttggttctg

SEQ ID NO: 4124193 - DNA, 16 bp, Homo sapiens
agggagctggaacccg

SEQ ID NO: 4124194 - DNA, 13 bp, Homo sapiens
agggagctgggac

SEQ ID NO: 4124195 - DNA, 13 bp, Homo sapiens
agggaggcagcct

SEQ ID NO: 4124196 - DNA, 16 bp, Homo sapiens
agggaggcagcctcca

SEQ ID NO: 4124197 - DNA, 22 bp, Homo sapiens
agggaggccacacgcactggtg

SEQ ID NO: 4124198 - DNA, 20 bp, Homo sapiens
agggagggcggtggacaata

SEQ ID NO: 4124199 - DNA, 13 bp, Homo sapiens
agggaggggctgt

SEQ ID NO: 4124200 - DNA, 19 bp, Homo sapiens
agggaggtgtgaggcagga

SEQ ID NO: 4124201 - DNA, 22 bp, Homo sapiens
agggaggtgtttaaagagaggt

SEQ ID NO: 4124202 - DNA, 23 bp, Homo sapiens
agggaggtgtttaaagagaggtt

SEQ ID NO: 4124203 - DNA, 13 bp, Homo sapiens
agggaggtttgtg

SEQ ID NO: 4124204 - DNA, 19 bp, Homo sapiens
agggatcttgcattcccag

SEQ ID NO: 4124205 - DNA, 18 bp, Homo sapiens
agggatgaagggcgagtg

SEQ ID NO: 4124206 - DNA, 14 bp, Homo sapiens
agggatgctgggct

SEQ ID NO: 4124207 - DNA, 21 bp, Homo sapiens
agggatgttattatccttggg

SEQ ID NO: 4124208 - DNA, 19 bp, Homo sapiens
agggattaacctctgcact

SEQ ID NO: 4124209 - DNA, 18 bp, Homo sapiens
agggattcaggctgcttg

SEQ ID NO: 4124210 - DNA, 14 bp, Homo sapiens
agggcaagggccat

SEQ ID NO: 4124211 - DNA, 13 bp, Homo sapiens
agggcacagccct

SEQ ID NO: 4124212 - DNA, 16 bp, Homo sapiens
agggcacagccctccg

SEQ ID NO: 4124213 - DNA, 13 bp, Homo sapiens
agggcaccagagg

SEQ ID NO: 4124214 - DNA, 14 bp, Homo sapiens
agggcactgggctg

SEQ ID NO: 4124215 - DNA, 14 bp, Homo sapiens
agggcactggtggc

SEQ ID NO: 4124216 - DNA, 20 bp, Homo sapiens
agggcagaccacattgcttt

SEQ ID NO: 4124217 - DNA, 20 bp, Homo sapiens
agggcagactggggcatcct

SEQ ID NO: 4124218 - DNA, 14 bp, Homo sapiens
agggcagagggaga

SEQ ID NO: 4124219 - DNA, 18 bp, Homo sapiens
agggcagagggagaatcc

SEQ ID NO: 4124220 - DNA, 13 bp, Homo sapiens
agggcagccccac

SEQ ID NO: 4124221 - DNA, 17 bp, Homo sapiens
agggcagggcatctcct

SEQ ID NO: 4124222 - DNA, 18 bp, Homo sapiens
agggcagggtgggcagcc

SEQ ID NO: 4124223 - DNA, 23 bp, Homo sapiens
agggcagggtgggcagcctatgg

SEQ ID NO: 4124224 - DNA, 16 bp, Homo sapiens
agggcagtgcaaggag

SEQ ID NO: 4124225 - DNA, 14 bp, Homo sapiens
agggcatccatacc

SEQ ID NO: 4124226 - DNA, 21 bp, Homo sapiens
agggcatccataccagctcgc

SEQ ID NO: 4124227 - DNA, 12 bp, Homo sapiens
agggcatctcct

SEQ ID NO: 4124228 - DNA, 17 bp, Homo sapiens
agggcatggccaggtgg

SEQ ID NO: 4124229 - DNA, 16 bp, Homo sapiens
agggcatgtgtatgtg

SEQ ID NO: 4124230 - DNA, 21 bp, Homo sapiens
agggcattccatcccttcctg

SEQ ID NO: 4124231 - DNA, 20 bp, Homo sapiens
agggcatttgctgccccagc

SEQ ID NO: 4124232 - DNA, 14 bp, Homo sapiens
agggccaaaagctt

SEQ ID NO: 4124233 - DNA, 20 bp, Homo sapiens
agggccacgctccagctgcc

SEQ ID NO: 4124234 - DNA, 20 bp, Homo sapiens
agggccactggaaggaacat

SEQ ID NO: 4124235 - DNA, 17 bp, Homo sapiens
agggccagaagtagctt

SEQ ID NO: 4124236 - DNA, 12 bp, Homo sapiens
agggccagagcc

SEQ ID NO: 4124237 - DNA, 13 bp, Homo sapiens
agggccagagcca

SEQ ID NO: 4124238 - DNA, 14 bp, Homo sapiens
agggccagagccag

SEQ ID NO: 4124239 - DNA, 15 bp, Homo sapiens
agggccagagccagg

SEQ ID NO: 4124240 - DNA, 14 bp, Homo sapiens
agggccagagggag

SEQ ID NO: 4124241 - DNA, 12 bp, Homo sapiens
agggccaggccc

SEQ ID NO: 4124242 - DNA, 19 bp, Homo sapiens
agggccaggcccaggcctc

SEQ ID NO: 4124243 - DNA, 22 bp, Homo sapiens
agggccagtcctcctgggagcc

SEQ ID NO: 4124244 - DNA, 23 bp, Homo sapiens
agggccagtcctcctgggagccc

SEQ ID NO: 4124245 - DNA, 21 bp, Homo sapiens
agggccagtcctgcctggcca

SEQ ID NO: 4124246 - DNA, 22 bp, Homo sapiens
agggccagtcctgcctggccag

SEQ ID NO: 4124247 - DNA, 15 bp, Homo sapiens
agggccagtggggcc

SEQ ID NO: 4124248 - DNA, 19 bp, Homo sapiens
agggccagtggggcctgtg

SEQ ID NO: 4124249 - DNA, 20 bp, Homo sapiens
agggccagtggggcctgtgg

SEQ ID NO: 4124250 - DNA, 21 bp, Homo sapiens
agggccagtggggcctgtgga

SEQ ID NO: 4124251 - DNA, 19 bp, Homo sapiens
agggccatgctgaagggac

SEQ ID NO: 4124252 - DNA, 19 bp, Homo sapiens
agggcccaccccagcctcg

SEQ ID NO: 4124253 - DNA, 11 bp, Homo sapiens
agggcccagag

SEQ ID NO: 4124254 - DNA, 12 bp, Homo sapiens
agggcccagagc

SEQ ID NO: 4124255 - DNA, 13 bp, Homo sapiens
agggcccagagca

SEQ ID NO: 4124256 - DNA, 14 bp, Homo sapiens
agggcccagagcag

SEQ ID NO: 4124257 - DNA, 15 bp, Homo sapiens
agggcccagagcagg

SEQ ID NO: 4124258 - DNA, 16 bp, Homo sapiens
agggcccagagcccag

SEQ ID NO: 4124259 - DNA, 19 bp, Homo sapiens
agggcccagagcccagctc

SEQ ID NO: 4124260 - DNA, 20 bp, Homo sapiens
agggcccagagcccagctcc

SEQ ID NO: 4124261 - DNA, 21 bp, Homo sapiens
agggcccagagcccagctcca

SEQ ID NO: 4124262 - DNA, 13 bp, Homo sapiens
agggcccagccca

SEQ ID NO: 4124263 - DNA, 14 bp, Homo sapiens
agggcccagcccag

SEQ ID NO: 4124264 - DNA, 12 bp, Homo sapiens
agggcccctgcg

SEQ ID NO: 4124265 - DNA, 19 bp, Homo sapiens
agggcccctgcgtgggggc

SEQ ID NO: 4124266 - DNA, 15 bp, Homo sapiens
agggccctaggcccc

SEQ ID NO: 4124267 - DNA, 13 bp, Homo sapiens
agggccctggcca

SEQ ID NO: 4124268 - DNA, 20 bp, Homo sapiens
agggcctcaaaggcccgctc

SEQ ID NO: 4124269 - DNA, 12 bp, Homo sapiens
agggcctccagg

SEQ ID NO: 4124270 - DNA, 15 bp, Homo sapiens
agggcctccagggcc

SEQ ID NO: 4124271 - DNA, 19 bp, Homo sapiens
agggcctgctggaggcctc

SEQ ID NO: 4124272 - DNA, 13 bp, Homo sapiens
agggcctggagcc

SEQ ID NO: 4124273 - DNA, 16 bp, Homo sapiens
agggcctggcaggcca

SEQ ID NO: 4124274 - DNA, 17 bp, Homo sapiens
agggcctggcaggccag

SEQ ID NO: 4124275 - DNA, 16 bp, Homo sapiens
agggcctggggcctga

SEQ ID NO: 4124276 - DNA, 17 bp, Homo sapiens
agggcctggggcctgag

SEQ ID NO: 4124277 - DNA, 18 bp, Homo sapiens
agggcctggggcctgaga

SEQ ID NO: 4124278 - DNA, 21 bp, Homo sapiens
agggcctggtccctgggagga

SEQ ID NO: 4124279 - DNA, 14 bp, Homo sapiens
agggcgcctactct

SEQ ID NO: 4124280 - DNA, 16 bp, Homo sapiens
agggcgctcagacggc

SEQ ID NO: 4124281 - DNA, 17 bp, Homo sapiens
agggctcgggagccatg

SEQ ID NO: 4124282 - DNA, 16 bp, Homo sapiens
agggctctcttaggca

SEQ ID NO: 4124283 - DNA, 17 bp, Homo sapiens
agggctctgatattcca

SEQ ID NO: 4124284 - DNA, 14 bp, Homo sapiens
agggctgaaagcca

SEQ ID NO: 4124285 - DNA, 16 bp, Homo sapiens
agggctgagctgagct

SEQ ID NO: 4124286 - DNA, 16 bp, Homo sapiens
agggctgagctgggga

SEQ ID NO: 4124287 - DNA, 18 bp, Homo sapiens
agggctgatggaggaaaa

SEQ ID NO: 4124288 - DNA, 13 bp, Homo sapiens
agggctgccagca

SEQ ID NO: 4124289 - DNA, 16 bp, Homo sapiens
agggctgccagcagcc

SEQ ID NO: 4124290 - DNA, 18 bp, Homo sapiens
agggctgccagcagcccc

SEQ ID NO: 4124291 - DNA, 21 bp, Homo sapiens
agggctgcccctaatctctgt

SEQ ID NO: 4124292 - DNA, 13 bp, Homo sapiens
agggctgccctga

SEQ ID NO: 4124293 - DNA, 15 bp, Homo sapiens
agggctgccctgaga

SEQ ID NO: 4124294 - DNA, 12 bp, Homo sapiens
agggctggacct

SEQ ID NO: 4124295 - DNA, 13 bp, Homo sapiens
agggctggaccta

SEQ ID NO: 4124296 - DNA, 11 bp, Homo sapiens
agggctggctc

SEQ ID NO: 4124297 - DNA, 16 bp, Homo sapiens
agggctggctccccct

SEQ ID NO: 4124298 - DNA, 13 bp, Homo sapiens
agggctggctctg

SEQ ID NO: 4124299 - DNA, 14 bp, Homo sapiens
agggctggctctgc

SEQ ID NO: 4124300 - DNA, 18 bp, Homo sapiens
agggctggctctgcacta

SEQ ID NO: 4124301 - DNA, 20 bp, Homo sapiens
agggctggctggcctcaccc

SEQ ID NO: 4124302 - DNA, 10 bp, Homo sapiens
agggctgggg

SEQ ID NO: 4124303 - DNA, 15 bp, Homo sapiens
agggctggggacaga

SEQ ID NO: 4124304 - DNA, 16 bp, Homo sapiens
agggctggtctctgct

SEQ ID NO: 4124305 - DNA, 20 bp, Homo sapiens
agggctgtcatctgtgcact

SEQ ID NO: 4124306 - DNA, 22 bp, Homo sapiens
agggctgtgcttgaaggccctg

SEQ ID NO: 4124307 - DNA, 18 bp, Homo sapiens
agggctgtgtcccagatg

SEQ ID NO: 4124308 - DNA, 12 bp, Homo sapiens
agggcttcctct

SEQ ID NO: 4124309 - DNA, 15 bp, Homo sapiens
agggcttgatggtga

SEQ ID NO: 4124310 - DNA, 21 bp, Homo sapiens
agggcttgatggtgacagctg

SEQ ID NO: 4124311 - DNA, 17 bp, Homo sapiens
agggcttggcccagcgc

SEQ ID NO: 4124312 - DNA, 18 bp, Homo sapiens
agggcttggcccagcgcc

SEQ ID NO: 4124313 - DNA, 18 bp, Homo sapiens
agggctttcctgtgccag

SEQ ID NO: 4124314 - DNA, 22 bp, Homo sapiens
agggcttttattttttcttttg

SEQ ID NO: 4124315 - DNA, 16 bp, Homo sapiens
aggggaacagaccagt

SEQ ID NO: 4124316 - DNA, 23 bp, Homo sapiens
aggggaagggccagtctgggctg

SEQ ID NO: 4124317 - DNA, 20 bp, Homo sapiens
aggggaagggctttgagggt

SEQ ID NO: 4124318 - DNA, 14 bp, Homo sapiens
aggggaagtccctg

SEQ ID NO: 4124319 - DNA, 21 bp, Homo sapiens
aggggacattttctggattct

SEQ ID NO: 4124320 - DNA, 21 bp, Homo sapiens
aggggactgggggactgggag

SEQ ID NO: 4124321 - DNA, 17 bp, Homo sapiens
aggggagagacaggcag

SEQ ID NO: 4124322 - DNA, 15 bp, Homo sapiens
aggggagagcctgct

SEQ ID NO: 4124323 - DNA, 16 bp, Homo sapiens
aggggagagcctgctg

SEQ ID NO: 4124324 - DNA, 17 bp, Homo sapiens
aggggagagcctgctgg

SEQ ID NO: 4124325 - DNA, 17 bp, Homo sapiens
aggggagcccactgtcc

SEQ ID NO: 4124326 - DNA, 21 bp, Homo sapiens
aggggagcccactgtcctggg

SEQ ID NO: 4124327 - DNA, 14 bp, Homo sapiens
aggggaggcagatg

SEQ ID NO: 4124328 - DNA, 13 bp, Homo sapiens
aggggaggcagcc

SEQ ID NO: 4124329 - DNA, 21 bp, Homo sapiens
aggggatatttaaggtagctt

SEQ ID NO: 4124330 - DNA, 18 bp, Homo sapiens
aggggattaatatgaaaa

SEQ ID NO: 4124331 - DNA, 19 bp, Homo sapiens
aggggcaacgaagaaaaaa

SEQ ID NO: 4124332 - DNA, 14 bp, Homo sapiens
aggggcaggactga

SEQ ID NO: 4124333 - DNA, 17 bp, Homo sapiens
aggggcatctgcccctc

SEQ ID NO: 4124334 - DNA, 22 bp, Homo sapiens
aggggcccaaattctttcagtg

SEQ ID NO: 4124335 - DNA, 16 bp, Homo sapiens
aggggccctggccagg

SEQ ID NO: 4124336 - DNA, 19 bp, Homo sapiens
aggggcccttgggacagcc

SEQ ID NO: 4124337 - DNA, 21 bp, Homo sapiens
aggggccggggaagctgccag

SEQ ID NO: 4124338 - DNA, 12 bp, Homo sapiens
aggggcctggca

SEQ ID NO: 4124339 - DNA, 13 bp, Homo sapiens
aggggcctggcag

SEQ ID NO: 4124340 - DNA, 23 bp, Homo sapiens
aggggcctggcagccgtgccttc

SEQ ID NO: 4124341 - DNA, 14 bp, Homo sapiens
aggggccttgctga

SEQ ID NO: 4124342 - DNA, 18 bp, Homo sapiens
aggggctccatgccagcc

SEQ ID NO: 4124343 - DNA, 17 bp, Homo sapiens
aggggctctcagctcag

SEQ ID NO: 4124344 - DNA, 20 bp, Homo sapiens
aggggctgaaagaacatgga

SEQ ID NO: 4124345 - DNA, 16 bp, Homo sapiens
aggggctgggctccct

SEQ ID NO: 4124346 - DNA, 18 bp, Homo sapiens
aggggctgggctccctga

SEQ ID NO: 4124347 - DNA, 19 bp, Homo sapiens
aggggctgggctccctgat

SEQ ID NO: 4124348 - DNA, 20 bp, Homo sapiens
aggggctgggggtgctggat

SEQ ID NO: 4124349 - DNA, 16 bp, Homo sapiens
aggggcttacaaagcc

SEQ ID NO: 4124350 - DNA, 19 bp, Homo sapiens
aggggctttctcttcccct

SEQ ID NO: 4124351 - DNA, 22 bp, Homo sapiens
aggggctttctcttccccttcc

SEQ ID NO: 4124352 - DNA, 19 bp, Homo sapiens
agggggaaaaagtgtcaac

SEQ ID NO: 4124353 - DNA, 22 bp, Homo sapiens
agggggaaggtggggtcctgga

SEQ ID NO: 4124354 - DNA, 12 bp, Homo sapiens
agggggagggtg

SEQ ID NO: 4124355 - DNA, 18 bp, Homo sapiens
agggggagtagccaagct

SEQ ID NO: 4124356 - DNA, 17 bp, Homo sapiens
agggggattctgagcag

SEQ ID NO: 4124357 - DNA, 20 bp, Homo sapiens
agggggattctgagcagtgc

SEQ ID NO: 4124358 - DNA, 22 bp, Homo sapiens
agggggattctgagcagtgcct

SEQ ID NO: 4124359 - DNA, 19 bp, Homo sapiens
agggggccccgccagggct

SEQ ID NO: 4124360 - DNA, 20 bp, Homo sapiens
agggggccccgccagggctg

SEQ ID NO: 4124361 - DNA, 18 bp, Homo sapiens
agggggggctacattata

SEQ ID NO: 4124362 - DNA, 18 bp, Homo sapiens
agggggtcattgttctcc

SEQ ID NO: 4124363 - DNA, 16 bp, Homo sapiens
agggggtccacccagc

SEQ ID NO: 4124364 - DNA, 20 bp, Homo sapiens
agggggttacaaactgcaat

SEQ ID NO: 4124365 - DNA, 22 bp, Homo sapiens
aggggtatgttccctcttgtcc

SEQ ID NO: 4124366 - DNA, 15 bp, Homo sapiens
aggggtcccagccac

SEQ ID NO: 4124367 - DNA, 18 bp, Homo sapiens
aggggtcccagccacccc

SEQ ID NO: 4124368 - DNA, 20 bp, Homo sapiens
aggggtcccctccaggagta

SEQ ID NO: 4124369 - DNA, 13 bp, Homo sapiens
aggggtctccctg

SEQ ID NO: 4124370 - DNA, 15 bp, Homo sapiens
aggggtctccctgga

SEQ ID NO: 4124371 - DNA, 16 bp, Homo sapiens
aggggtctccctggag

SEQ ID NO: 4124372 - DNA, 23 bp, Homo sapiens
aggggtgactttgtctctcctgg

SEQ ID NO: 4124373 - DNA, 22 bp, Homo sapiens
aggggtgatttcagagagggca

SEQ ID NO: 4124374 - DNA, 14 bp, Homo sapiens
aggggtgggctggt

SEQ ID NO: 4124375 - DNA, 21 bp, Homo sapiens
aggggtggggagatgcttctc

SEQ ID NO: 4124376 - DNA, 19 bp, Homo sapiens
aggggtgggggtggaggct

SEQ ID NO: 4124377 - DNA, 18 bp, Homo sapiens
aggggtggtcctgactca

SEQ ID NO: 4124378 - DNA, 18 bp, Homo sapiens
aggggtgtggcagtggtt

SEQ ID NO: 4124379 - DNA, 14 bp, Homo sapiens
aggggttggtggga

SEQ ID NO: 4124380 - DNA, 14 bp, Homo sapiens
agggtacagtttgg

SEQ ID NO: 4124381 - DNA, 22 bp, Homo sapiens
agggtacccgcctgagctcctg

SEQ ID NO: 4124382 - DNA, 22 bp, Homo sapiens
agggtagaatgattaatcaaag

SEQ ID NO: 4124383 - DNA, 17 bp, Homo sapiens
agggtagtctggtttct

SEQ ID NO: 4124384 - DNA, 20 bp, Homo sapiens
agggtatccaagttggactg

SEQ ID NO: 4124385 - DNA, 21 bp, Homo sapiens
agggtatccaagttggactgg

SEQ ID NO: 4124386 - DNA, 20 bp, Homo sapiens
agggtcccatttctcactga

SEQ ID NO: 4124387 - DNA, 15 bp, Homo sapiens
agggtccccacctgg

SEQ ID NO: 4124388 - DNA, 16 bp, Homo sapiens
agggtctctccctcag

SEQ ID NO: 4124389 - DNA, 20 bp, Homo sapiens
agggtctgctctttctctgc

SEQ ID NO: 4124390 - DNA, 22 bp, Homo sapiens
agggtcttgctctgtcccccag

SEQ ID NO: 4124391 - DNA, 23 bp, Homo sapiens
agggtcttgctctgtcccccagg

SEQ ID NO: 4124392 - DNA, 20 bp, Homo sapiens
agggtcttgggggtcagggg

SEQ ID NO: 4124393 - DNA, 18 bp, Homo sapiens
agggtgaaaggcagggcc

SEQ ID NO: 4124394 - DNA, 17 bp, Homo sapiens
agggtgacagcttcctt

SEQ ID NO: 4124395 - DNA, 21 bp, Homo sapiens
agggtgccctttggggtcccg

SEQ ID NO: 4124396 - DNA, 19 bp, Homo sapiens
agggtggatgacagggcag

SEQ ID NO: 4124397 - DNA, 18 bp, Homo sapiens
agggtggcccttgcagtt

SEQ ID NO: 4124398 - DNA, 14 bp, Homo sapiens
agggtgggcagcct

SEQ ID NO: 4124399 - DNA, 19 bp, Homo sapiens
agggtgggcttcctgccct

SEQ ID NO: 4124400 - DNA, 18 bp, Homo sapiens
agggtgggggagggaggt

SEQ ID NO: 4124401 - DNA, 16 bp, Homo sapiens
agggtgggtgctcaga

SEQ ID NO: 4124402 - DNA, 21 bp, Homo sapiens
agggttgaaaatgtgtttgct

SEQ ID NO: 4124403 - DNA, 12 bp, Homo sapiens
agggttggcacc

SEQ ID NO: 4124404 - DNA, 15 bp, Homo sapiens
agggttgggcccaga

SEQ ID NO: 4124405 - DNA, 17 bp, Homo sapiens
agggttggggaggggcg

SEQ ID NO: 4124406 - DNA, 21 bp, Homo sapiens
agggttgttaatggtgcaaat

SEQ ID NO: 4124407 - DNA, 16 bp, Homo sapiens
agggtttaatagactg

SEQ ID NO: 4124408 - DNA, 14 bp, Homo sapiens
agggtttctctatt

SEQ ID NO: 4124409 - DNA, 23 bp, Homo sapiens
agggttttggggtcctgggctgg

SEQ ID NO: 4124410 - DNA, 15 bp, Homo sapiens
aggtaacagaacagc

SEQ ID NO: 4124411 - DNA, 19 bp, Homo sapiens
aggtaacagaacagcttca

SEQ ID NO: 4124412 - DNA, 21 bp, Homo sapiens
aggtaacagaacagcttcagg

SEQ ID NO: 4124413 - DNA, 22 bp, Homo sapiens
aggtaacagaacagcttcaggt

SEQ ID NO: 4124414 - DNA, 23 bp, Homo sapiens
aggtaacagaacagcttcaggtt

SEQ ID NO: 4124415 - DNA, 20 bp, Homo sapiens
aggtaaccttatatttacaa

SEQ ID NO: 4124416 - DNA, 22 bp, Homo sapiens
aggtaagaagttttaaaaagcc

SEQ ID NO: 4124417 - DNA, 15 bp, Homo sapiens
aggtaagctgtgcct

SEQ ID NO: 4124418 - DNA, 13 bp, Homo sapiens
aggtaagtttttt

SEQ ID NO: 4124419 - DNA, 21 bp, Homo sapiens
aggtaatgttttgtatataca

SEQ ID NO: 4124420 - DNA, 14 bp, Homo sapiens
aggtaatttttacc

SEQ ID NO: 4124421 - DNA, 18 bp, Homo sapiens
aggtacagggtttttacc

SEQ ID NO: 4124422 - DNA, 12 bp, Homo sapiens
aggtacctcatg

SEQ ID NO: 4124423 - DNA, 14 bp, Homo sapiens
aggtactagaatgc

SEQ ID NO: 4124424 - DNA, 16 bp, Homo sapiens
aggtactagaatgctt

SEQ ID NO: 4124425 - DNA, 23 bp, Homo sapiens
aggtagaaatatctgaaaatgta

SEQ ID NO: 4124426 - DNA, 20 bp, Homo sapiens
aggtagaccaggatttctaa

SEQ ID NO: 4124427 - DNA, 15 bp, Homo sapiens
aggtagactttgctt

SEQ ID NO: 4124428 - DNA, 17 bp, Homo sapiens
aggtagcccagcactgt

SEQ ID NO: 4124429 - DNA, 19 bp, Homo sapiens
aggtagcccagcactgtga

SEQ ID NO: 4124430 - DNA, 22 bp, Homo sapiens
aggtagcccagcactgtgaaga

SEQ ID NO: 4124431 - DNA, 19 bp, Homo sapiens
aggtagccgggctctgcac

SEQ ID NO: 4124432 - DNA, 19 bp, Homo sapiens
aggtagtttggatattttt

SEQ ID NO: 4124433 - DNA, 21 bp, Homo sapiens
aggtagtttggatatttttgt

SEQ ID NO: 4124434 - DNA, 14 bp, Homo sapiens
aggtatctccagga

SEQ ID NO: 4124435 - DNA, 15 bp, Homo sapiens
aggtattattatctt

SEQ ID NO: 4124436 - DNA, 16 bp, Homo sapiens
aggtattattatcttt

SEQ ID NO: 4124437 - DNA, 20 bp, Homo sapiens
aggtatttcgaaactgccaa

SEQ ID NO: 4124438 - DNA, 13 bp, Homo sapiens
aggtatttgaaaa

SEQ ID NO: 4124439 - DNA, 19 bp, Homo sapiens
aggtattttgtagatgtga

SEQ ID NO: 4124440 - DNA, 17 bp, Homo sapiens
aggtattttgtttcttt

SEQ ID NO: 4124441 - DNA, 17 bp, Homo sapiens
aggtcaataaggtcaag

SEQ ID NO: 4124442 - DNA, 12 bp, Homo sapiens
aggtcacagctg

SEQ ID NO: 4124443 - DNA, 17 bp, Homo sapiens
aggtcacagctggatct

SEQ ID NO: 4124444 - DNA, 18 bp, Homo sapiens
aggtcacagctggatctg

SEQ ID NO: 4124445 - DNA, 15 bp, Homo sapiens
aggtcacattcagga

SEQ ID NO: 4124446 - DNA, 19 bp, Homo sapiens
aggtcactagatggcgagc

SEQ ID NO: 4124447 - DNA, 14 bp, Homo sapiens
aggtcactcctggg

SEQ ID NO: 4124448 - DNA, 13 bp, Homo sapiens
aggtcagatggag

SEQ ID NO: 4124449 - DNA, 21 bp, Homo sapiens
aggtcaggaagcaggggtggg

SEQ ID NO: 4124450 - DNA, 22 bp, Homo sapiens
aggtcaggacggctcctcagag

SEQ ID NO: 4124451 - DNA, 23 bp, Homo sapiens
aggtcaggacggctcctcagagc

SEQ ID NO: 4124452 - DNA, 16 bp, Homo sapiens
aggtcaggagttccta

SEQ ID NO: 4124453 - DNA, 14 bp, Homo sapiens
aggtcagggacttg

SEQ ID NO: 4124454 - DNA, 18 bp, Homo sapiens
aggtcagggacttggaca

SEQ ID NO: 4124455 - DNA, 16 bp, Homo sapiens
aggtcagggagtgctg

SEQ ID NO: 4124456 - DNA, 17 bp, Homo sapiens
aggtcatagctgagatt

SEQ ID NO: 4124457 - DNA, 16 bp, Homo sapiens
aggtccaagcagagtg

SEQ ID NO: 4124458 - DNA, 21 bp, Homo sapiens
aggtccaagccccccacacct

SEQ ID NO: 4124459 - DNA, 16 bp, Homo sapiens
aggtccactccctgct

SEQ ID NO: 4124460 - DNA, 19 bp, Homo sapiens
aggtcccacgtctggccag

SEQ ID NO: 4124461 - DNA, 11 bp, Homo sapiens
aggtcccaggc

SEQ ID NO: 4124462 - DNA, 12 bp, Homo sapiens
aggtcccaggca

SEQ ID NO: 4124463 - DNA, 13 bp, Homo sapiens
aggtcccaggcag

SEQ ID NO: 4124464 - DNA, 21 bp, Homo sapiens
aggtcccattgttggcgctga

SEQ ID NO: 4124465 - DNA, 13 bp, Homo sapiens
aggtcccctccac

SEQ ID NO: 4124466 - DNA, 20 bp, Homo sapiens
aggtccgtccggtgtgtcag

SEQ ID NO: 4124467 - DNA, 16 bp, Homo sapiens
aggtcctacagggcca

SEQ ID NO: 4124468 - DNA, 13 bp, Homo sapiens
aggtcctctcagt

SEQ ID NO: 4124469 - DNA, 13 bp, Homo sapiens
aggtcctctgtca

SEQ ID NO: 4124470 - DNA, 19 bp, Homo sapiens
aggtcctctgtcagtcaca

SEQ ID NO: 4124471 - DNA, 23 bp, Homo sapiens
aggtcctctgtcagtcacagcca

SEQ ID NO: 4124472 - DNA, 13 bp, Homo sapiens
aggtcctgcccat

SEQ ID NO: 4124473 - DNA, 19 bp, Homo sapiens
aggtcctgctcagcagtga

SEQ ID NO: 4124474 - DNA, 16 bp, Homo sapiens
aggtcttcagccatca

SEQ ID NO: 4124475 - DNA, 19 bp, Homo sapiens
aggtcttcttaatatgttc

SEQ ID NO: 4124476 - DNA, 19 bp, Homo sapiens
aggtcttgactcatggcag

SEQ ID NO: 4124477 - DNA, 22 bp, Homo sapiens
aggtcttgactcatggcagctg

SEQ ID NO: 4124478 - DNA, 23 bp, Homo sapiens
aggtcttgactcatggcagctgt

SEQ ID NO: 4124479 - DNA, 15 bp, Homo sapiens
aggtcttgctctcct

SEQ ID NO: 4124480 - DNA, 23 bp, Homo sapiens
aggtcttgctctcctaggtagcc

SEQ ID NO: 4124481 - DNA, 19 bp, Homo sapiens
aggtgacactatagtttaa

SEQ ID NO: 4124482 - DNA, 13 bp, Homo sapiens
aggtgagaaaaaa

SEQ ID NO: 4124483 - DNA, 22 bp, Homo sapiens
aggtgagatcacagcctccagg

SEQ ID NO: 4124484 - DNA, 14 bp, Homo sapiens
aggtgagatggcca

SEQ ID NO: 4124485 - DNA, 18 bp, Homo sapiens
aggtgaggagcagagcag

SEQ ID NO: 4124486 - DNA, 19 bp, Homo sapiens
aggtgagtttgagctgcct

SEQ ID NO: 4124487 - DNA, 22 bp, Homo sapiens
aggtgagtttgagctgccttcc

SEQ ID NO: 4124488 - DNA, 18 bp, Homo sapiens
aggtgatatatttaaaaa

SEQ ID NO: 4124489 - DNA, 19 bp, Homo sapiens
aggtgatggaggtatttga

SEQ ID NO: 4124490 - DNA, 23 bp, Homo sapiens
aggtgatttttttattattttta

SEQ ID NO: 4124491 - DNA, 20 bp, Homo sapiens
aggtgcacttggggcacagg

SEQ ID NO: 4124492 - DNA, 22 bp, Homo sapiens
aggtgcacttggggcacaggga

SEQ ID NO: 4124493 - DNA, 13 bp, Homo sapiens
aggtgcaggcagg

SEQ ID NO: 4124494 - DNA, 16 bp, Homo sapiens
aggtgcagttccccca

SEQ ID NO: 4124495 - DNA, 15 bp, Homo sapiens
aggtgcatttttact

SEQ ID NO: 4124496 - DNA, 21 bp, Homo sapiens
aggtgccagcctgaggcagcc

SEQ ID NO: 4124497 - DNA, 20 bp, Homo sapiens
aggtgccagggcccacccca

SEQ ID NO: 4124498 - DNA, 15 bp, Homo sapiens
aggtgcctcagactc

SEQ ID NO: 4124499 - DNA, 20 bp, Homo sapiens
aggtgcctcagactccgccc

SEQ ID NO: 4124500 - DNA, 14 bp, Homo sapiens
aggtgctaggaatt

SEQ ID NO: 4124501 - DNA, 16 bp, Homo sapiens
aggtgctgacggccag

SEQ ID NO: 4124502 - DNA, 20 bp, Homo sapiens
aggtgctgacggccagggag

SEQ ID NO: 4124503 - DNA, 23 bp, Homo sapiens
aggtgcttattctcaaagcagga

SEQ ID NO: 4124504 - DNA, 18 bp, Homo sapiens
aggtggaagaagggagaa

SEQ ID NO: 4124505 - DNA, 18 bp, Homo sapiens
aggtggaccttttaaagt

SEQ ID NO: 4124506 - DNA, 22 bp, Homo sapiens
aggtggaccttttaaagtgttt

SEQ ID NO: 4124507 - DNA, 13 bp, Homo sapiens
aggtggagggcac

SEQ ID NO: 4124508 - DNA, 16 bp, Homo sapiens
aggtggagggcacagc

SEQ ID NO: 4124509 - DNA, 20 bp, Homo sapiens
aggtggagggcacagccctc

SEQ ID NO: 4124510 - DNA, 20 bp, Homo sapiens
aggtggcaatgcttaaacta

SEQ ID NO: 4124511 - DNA, 23 bp, Homo sapiens
aggtggcagatgtcttccctggg

SEQ ID NO: 4124512 - DNA, 17 bp, Homo sapiens
aggtggccactccagac

SEQ ID NO: 4124513 - DNA, 17 bp, Homo sapiens
aggtggctatggccacc

SEQ ID NO: 4124514 - DNA, 17 bp, Homo sapiens
aggtgggatcctccctc

SEQ ID NO: 4124515 - DNA, 12 bp, Homo sapiens
aggtgggcatgc

SEQ ID NO: 4124516 - DNA, 19 bp, Homo sapiens
aggtgggcatgccaccctc

SEQ ID NO: 4124517 - DNA, 15 bp, Homo sapiens
aggtgggctggactt

SEQ ID NO: 4124518 - DNA, 21 bp, Homo sapiens
aggtgggctgggccctctctt

SEQ ID NO: 4124519 - DNA, 16 bp, Homo sapiens
aggtgggctgtattca

SEQ ID NO: 4124520 - DNA, 13 bp, Homo sapiens
aggtggggactgg

SEQ ID NO: 4124521 - DNA, 22 bp, Homo sapiens
aggtggggattgcccctggctt

SEQ ID NO: 4124522 - DNA, 18 bp, Homo sapiens
aggtggggcgaggcaggc

SEQ ID NO: 4124523 - DNA, 23 bp, Homo sapiens
aggtggggtatttaccacagcag

SEQ ID NO: 4124524 - DNA, 23 bp, Homo sapiens
aggtggtctgaatgttctgacat

SEQ ID NO: 4124525 - DNA, 19 bp, Homo sapiens
aggtggtgggcattctctc

SEQ ID NO: 4124526 - DNA, 21 bp, Homo sapiens
aggtggtggtagagaagcaag

SEQ ID NO: 4124527 - DNA, 15 bp, Homo sapiens
aggtgtacactaaca

SEQ ID NO: 4124528 - DNA, 13 bp, Homo sapiens
aggtgtatttaaa

SEQ ID NO: 4124529 - DNA, 17 bp, Homo sapiens
aggtgtctgcacccagg

SEQ ID NO: 4124530 - DNA, 22 bp, Homo sapiens
aggtgtgaacctacctgccttg

SEQ ID NO: 4124531 - DNA, 17 bp, Homo sapiens
aggtgtgaggcaggaga

SEQ ID NO: 4124532 - DNA, 15 bp, Homo sapiens
aggtgtgcctggaag

SEQ ID NO: 4124533 - DNA, 19 bp, Homo sapiens
aggtgtgcctggcctctgc

SEQ ID NO: 4124534 - DNA, 22 bp, Homo sapiens
aggtgtggggacacagcagtga

SEQ ID NO: 4124535 - DNA, 23 bp, Homo sapiens
aggtgtggggacacagcagtgag

SEQ ID NO: 4124536 - DNA, 14 bp, Homo sapiens
aggtgtgtgcttta

SEQ ID NO: 4124537 - DNA, 21 bp, Homo sapiens
aggtgtgtgctttaggcgtgg

SEQ ID NO: 4124538 - DNA, 16 bp, Homo sapiens
aggtgttactgtaatt

SEQ ID NO: 4124539 - DNA, 12 bp, Homo sapiens
aggtgttatttg

SEQ ID NO: 4124540 - DNA, 23 bp, Homo sapiens
aggtgttatttggaaccttgttt

SEQ ID NO: 4124541 - DNA, 17 bp, Homo sapiens
aggtgttctacactcat

SEQ ID NO: 4124542 - DNA, 21 bp, Homo sapiens
aggtgttgattttctgttgta

SEQ ID NO: 4124543 - DNA, 12 bp, Homo sapiens
aggtgttgccaa

SEQ ID NO: 4124544 - DNA, 21 bp, Homo sapiens
aggtgttgccaaatatgtcct

SEQ ID NO: 4124545 - DNA, 13 bp, Homo sapiens
aggtgtttaaaga

SEQ ID NO: 4124546 - DNA, 19 bp, Homo sapiens
aggttaaacggtgcccatc

SEQ ID NO: 4124547 - DNA, 19 bp, Homo sapiens
aggttatttaaaataaatt

SEQ ID NO: 4124548 - DNA, 16 bp, Homo sapiens
aggttcactaaagcag

SEQ ID NO: 4124549 - DNA, 16 bp, Homo sapiens
aggttccatcctttac

SEQ ID NO: 4124550 - DNA, 16 bp, Homo sapiens
aggttcccaagctcag

SEQ ID NO: 4124551 - DNA, 17 bp, Homo sapiens
aggttcccccagcaagc

SEQ ID NO: 4124552 - DNA, 16 bp, Homo sapiens
aggttccctctgagaa

SEQ ID NO: 4124553 - DNA, 11 bp, Homo sapiens
aggttccctgt

SEQ ID NO: 4124554 - DNA, 12 bp, Homo sapiens
aggttcctctgc

SEQ ID NO: 4124555 - DNA, 14 bp, Homo sapiens
aggttcctctgcct

SEQ ID NO: 4124556 - DNA, 18 bp, Homo sapiens
aggttctattttcttaaa

SEQ ID NO: 4124557 - DNA, 13 bp, Homo sapiens
aggttctcagagc

SEQ ID NO: 4124558 - DNA, 18 bp, Homo sapiens
aggttctcagagccaagt

SEQ ID NO: 4124559 - DNA, 17 bp, Homo sapiens
aggttctgcctgctttg

SEQ ID NO: 4124560 - DNA, 13 bp, Homo sapiens
aggttgaaaaaca

SEQ ID NO: 4124561 - DNA, 23 bp, Homo sapiens
aggttgaagacctaaccagggcc

SEQ ID NO: 4124562 - DNA, 13 bp, Homo sapiens
aggttgaagccaa

SEQ ID NO: 4124563 - DNA, 15 bp, Homo sapiens
aggttgaagccaagt

SEQ ID NO: 4124564 - DNA, 14 bp, Homo sapiens
aggttgcagtgagc

SEQ ID NO: 4124565 - DNA, 12 bp, Homo sapiens
aggttgcctgaa

SEQ ID NO: 4124566 - DNA, 17 bp, Homo sapiens
aggttgcctgaaaaatg

SEQ ID NO: 4124567 - DNA, 16 bp, Homo sapiens
aggttggagcccaggg

SEQ ID NO: 4124568 - DNA, 14 bp, Homo sapiens
aggttggtgaattt

SEQ ID NO: 4124569 - DNA, 14 bp, Homo sapiens
aggtttctctccct

SEQ ID NO: 4124570 - DNA, 15 bp, Homo sapiens
aggtttctctccctc

SEQ ID NO: 4124571 - DNA, 22 bp, Homo sapiens
aggtttgtgagagcgaggctga

SEQ ID NO: 4124572 - DNA, 14 bp, Homo sapiens
aggttttgttgcta

SEQ ID NO: 4124573 - DNA, 13 bp, Homo sapiens
aggtttttattag

SEQ ID NO: 4124574 - DNA, 15 bp, Homo sapiens
aggtttttattagta

SEQ ID NO: 4124575 - DNA, 19 bp, Homo sapiens
aggtttttctcatgtatct

SEQ ID NO: 4124576 - DNA, 17 bp, Homo sapiens
aggttttttttcagttg

SEQ ID NO: 4124577 - DNA, 20 bp, Homo sapiens
agtaaaatactattgcctca

SEQ ID NO: 4124578 - DNA, 15 bp, Homo sapiens
agtaaacaacttgta

SEQ ID NO: 4124579 - DNA, 17 bp, Homo sapiens
agtaaagctaaaatgat

SEQ ID NO: 4124580 - DNA, 16 bp, Homo sapiens
agtaaatacaagactg

SEQ ID NO: 4124581 - DNA, 18 bp, Homo sapiens
agtaaatacaagactgtt

SEQ ID NO: 4124582 - DNA, 19 bp, Homo sapiens
agtaaatacaagactgttg

SEQ ID NO: 4124583 - DNA, 13 bp, Homo sapiens
agtaaatattgag

SEQ ID NO: 4124584 - DNA, 14 bp, Homo sapiens
agtaaatatttcag

SEQ ID NO: 4124585 - DNA, 16 bp, Homo sapiens
agtaaatgtctttgta

SEQ ID NO: 4124586 - DNA, 18 bp, Homo sapiens
agtaaatgtctttgtaag

SEQ ID NO: 4124587 - DNA, 19 bp, Homo sapiens
agtaacaatgaagataaaa

SEQ ID NO: 4124588 - DNA, 15 bp, Homo sapiens
agtaacatttgctgt

SEQ ID NO: 4124589 - DNA, 17 bp, Homo sapiens
agtaacgcgtcttcctg

SEQ ID NO: 4124590 - DNA, 22 bp, Homo sapiens
agtaacgcgtcttcctgagtgg

SEQ ID NO: 4124591 - DNA, 19 bp, Homo sapiens
agtaacttcttatggaatt

SEQ ID NO: 4124592 - DNA, 20 bp, Homo sapiens
agtaactttactctgtgttt

SEQ ID NO: 4124593 - DNA, 23 bp, Homo sapiens
agtaactttactctgtgtttaaa

SEQ ID NO: 4124594 - DNA, 16 bp, Homo sapiens
agtaagaagacatgaa

SEQ ID NO: 4124595 - DNA, 14 bp, Homo sapiens
agtaagagctggtg

SEQ ID NO: 4124596 - DNA, 14 bp, Homo sapiens
agtaaggtgcagtt

SEQ ID NO: 4124597 - DNA, 22 bp, Homo sapiens
agtaagttaataatgtattgta

SEQ ID NO: 4124598 - DNA, 17 bp, Homo sapiens
agtaagtttcccctctg

SEQ ID NO: 4124599 - DNA, 17 bp, Homo sapiens
agtaataaactgtgttt

SEQ ID NO: 4124600 - DNA, 19 bp, Homo sapiens
agtaatcccgccacctatc

SEQ ID NO: 4124601 - DNA, 22 bp, Homo sapiens
agtaatcccgccacctatctcg

SEQ ID NO: 4124602 - DNA, 22 bp, Homo sapiens
agtaatgaatttttatgatatt

SEQ ID NO: 4124603 - DNA, 14 bp, Homo sapiens
agtaatggtgtaga

SEQ ID NO: 4124604 - DNA, 15 bp, Homo sapiens
agtaatggtgtagaa

SEQ ID NO: 4124605 - DNA, 18 bp, Homo sapiens
agtaatggtgtagaacac

SEQ ID NO: 4124606 - DNA, 22 bp, Homo sapiens
agtaatggtgtagaacactaat

SEQ ID NO: 4124607 - DNA, 23 bp, Homo sapiens
agtaatggtgtagaacactaatt

SEQ ID NO: 4124608 - DNA, 20 bp, Homo sapiens
agtaattatcgggaacagtg

SEQ ID NO: 4124609 - DNA, 22 bp, Homo sapiens
agtaattatcgggaacagtgtt

SEQ ID NO: 4124610 - DNA, 22 bp, Homo sapiens
agtaattgcatttgcttttgta

SEQ ID NO: 4124611 - DNA, 16 bp, Homo sapiens
agtaattgttccagag

SEQ ID NO: 4124612 - DNA, 13 bp, Homo sapiens
agtacaaatgcct

SEQ ID NO: 4124613 - DNA, 17 bp, Homo sapiens
agtacacaataagcaaa

SEQ ID NO: 4124614 - DNA, 22 bp, Homo sapiens
agtacacaataagcaaaaacaa

SEQ ID NO: 4124615 - DNA, 16 bp, Homo sapiens
agtacagcatgtgcct

SEQ ID NO: 4124616 - DNA, 13 bp, Homo sapiens
agtacagcctgga

SEQ ID NO: 4124617 - DNA, 15 bp, Homo sapiens
agtacagcctggacc

SEQ ID NO: 4124618 - DNA, 13 bp, Homo sapiens
agtacagcggctc

SEQ ID NO: 4124619 - DNA, 18 bp, Homo sapiens
agtacagcggctcccctc

SEQ ID NO: 4124620 - DNA, 19 bp, Homo sapiens
agtacatatttattttctt

SEQ ID NO: 4124621 - DNA, 22 bp, Homo sapiens
agtacatatttattttcttttg

SEQ ID NO: 4124622 - DNA, 21 bp, Homo sapiens
agtacatttaatacagcagtg

SEQ ID NO: 4124623 - DNA, 16 bp, Homo sapiens
agtacatttggagaca

SEQ ID NO: 4124624 - DNA, 19 bp, Homo sapiens
agtaccaaagttttatcaa

SEQ ID NO: 4124625 - DNA, 15 bp, Homo sapiens
agtaccaatcatttt

SEQ ID NO: 4124626 - DNA, 16 bp, Homo sapiens
agtaccaatcatttta

SEQ ID NO: 4124627 - DNA, 14 bp, Homo sapiens
agtaccagcgctct

SEQ ID NO: 4124628 - DNA, 22 bp, Homo sapiens
agtaccaggggctgggctccct

SEQ ID NO: 4124629 - DNA, 18 bp, Homo sapiens
agtacccatctagtactt

SEQ ID NO: 4124630 - DNA, 19 bp, Homo sapiens
agtaccctctcagctccag

SEQ ID NO: 4124631 - DNA, 21 bp, Homo sapiens
agtacctataaagtaaagcta

SEQ ID NO: 4124632 - DNA, 19 bp, Homo sapiens
agtacctgggtccccagcc

SEQ ID NO: 4124633 - DNA, 21 bp, Homo sapiens
agtacctgggtccccagccct

SEQ ID NO: 4124634 - DNA, 20 bp, Homo sapiens
agtaccttatcaaagtagca

SEQ ID NO: 4124635 - DNA, 13 bp, Homo sapiens
agtacctttgtca

SEQ ID NO: 4124636 - DNA, 18 bp, Homo sapiens
agtacgtcctgcctggca

SEQ ID NO: 4124637 - DNA, 17 bp, Homo sapiens
agtactccttaagaaca

SEQ ID NO: 4124638 - DNA, 18 bp, Homo sapiens
agtacttgagtgtaatgt

SEQ ID NO: 4124639 - DNA, 23 bp, Homo sapiens
agtacttgggagacctgtaatca

SEQ ID NO: 4124640 - DNA, 20 bp, Homo sapiens
agtacttgtgaaacacagct

SEQ ID NO: 4124641 - DNA, 24 bp, Homo sapiens
agtacttgtgaaacacagctgttc

SEQ ID NO: 4124642 - DNA, 15 bp, Homo sapiens
agtacttttattaat

SEQ ID NO: 4124643 - DNA, 17 bp, Homo sapiens
agtagaagtcttagatg

SEQ ID NO: 4124644 - DNA, 22 bp, Homo sapiens
agtagagcttgtaataaatact

SEQ ID NO: 4124645 - DNA, 18 bp, Homo sapiens
agtagaggtactagaatg

SEQ ID NO: 4124646 - DNA, 20 bp, Homo sapiens
agtagattgcagaaaattct

SEQ ID NO: 4124647 - DNA, 19 bp, Homo sapiens
agtagattttaaagacaaa

SEQ ID NO: 4124648 - DNA, 20 bp, Homo sapiens
agtagcaagttctagagaag

SEQ ID NO: 4124649 - DNA, 13 bp, Homo sapiens
agtagctgggatg

SEQ ID NO: 4124650 - DNA, 18 bp, Homo sapiens
agtagcttgctccctgtg

SEQ ID NO: 4124651 - DNA, 23 bp, Homo sapiens
agtaggacaaggtgcaggcaggc

SEQ ID NO: 4124652 - DNA, 17 bp, Homo sapiens
agtaggtcctcaataaa

SEQ ID NO: 4124653 - DNA, 13 bp, Homo sapiens
agtataaacaaag

SEQ ID NO: 4124654 - DNA, 18 bp, Homo sapiens
agtataaatggttgtctg

SEQ ID NO: 4124655 - DNA, 17 bp, Homo sapiens
agtataaccatatgata

SEQ ID NO: 4124656 - DNA, 21 bp, Homo sapiens
agtataaccatatgatactat

SEQ ID NO: 4124657 - DNA, 14 bp, Homo sapiens
agtataagaaatgc

SEQ ID NO: 4124658 - DNA, 22 bp, Homo sapiens
agtatacttttcccctgttaaa

SEQ ID NO: 4124659 - DNA, 13 bp, Homo sapiens
agtatatctggac

SEQ ID NO: 4124660 - DNA, 16 bp, Homo sapiens
agtatatctggacaag

SEQ ID NO: 4124661 - DNA, 22 bp, Homo sapiens
agtatatctggacaagccaact

SEQ ID NO: 4124662 - DNA, 12 bp, Homo sapiens
agtatatgtgag

SEQ ID NO: 4124663 - DNA, 15 bp, Homo sapiens
agtatatgttccctc

SEQ ID NO: 4124664 - DNA, 11 bp, Homo sapiens
agtatattctt

SEQ ID NO: 4124665 - DNA, 13 bp, Homo sapiens
agtatattttctt

SEQ ID NO: 4124666 - DNA, 18 bp, Homo sapiens
agtatcactctaaaaaac

SEQ ID NO: 4124667 - DNA, 13 bp, Homo sapiens
agtatcagtgttt

SEQ ID NO: 4124668 - DNA, 17 bp, Homo sapiens
agtatcagtgttttaaa

SEQ ID NO: 4124669 - DNA, 22 bp, Homo sapiens
agtatcagtgttttaaattctg

SEQ ID NO: 4124670 - DNA, 11 bp, Homo sapiens
agtatccaggc

SEQ ID NO: 4124671 - DNA, 14 bp, Homo sapiens
agtatccttccttc

SEQ ID NO: 4124672 - DNA, 24 bp, Homo sapiens
agtatcttcaaactttcactttga

SEQ ID NO: 4124673 - DNA, 17 bp, Homo sapiens
agtatcttttttcaaaa

SEQ ID NO: 4124674 - DNA, 23 bp, Homo sapiens
agtatggtaatctttacctgtat

SEQ ID NO: 4124675 - DNA, 23 bp, Homo sapiens
agtatgtattacttttgtaatca

SEQ ID NO: 4124676 - DNA, 15 bp, Homo sapiens
agtattaacttacaa

SEQ ID NO: 4124677 - DNA, 19 bp, Homo sapiens
agtattcttatttaatgaa

SEQ ID NO: 4124678 - DNA, 18 bp, Homo sapiens
agtattggggtctgaccc

SEQ ID NO: 4124679 - DNA, 15 bp, Homo sapiens
agtatttatatattt

SEQ ID NO: 4124680 - DNA, 19 bp, Homo sapiens
agtatttatatatttataa

SEQ ID NO: 4124681 - DNA, 14 bp, Homo sapiens
agtatttattttgt

SEQ ID NO: 4124682 - DNA, 13 bp, Homo sapiens
agtatttcagtgt

SEQ ID NO: 4124683 - DNA, 23 bp, Homo sapiens
agtatttcagtgtagttaattta

SEQ ID NO: 4124684 - DNA, 15 bp, Homo sapiens
agtatttcattgcct

SEQ ID NO: 4124685 - DNA, 19 bp, Homo sapiens
agtatttcattgcctgtgt

SEQ ID NO: 4124686 - DNA, 14 bp, Homo sapiens
agtatttcatttct

SEQ ID NO: 4124687 - DNA, 13 bp, Homo sapiens
agtatttctcagg

SEQ ID NO: 4124688 - DNA, 14 bp, Homo sapiens
agtatttctcagga

SEQ ID NO: 4124689 - DNA, 11 bp, Homo sapiens
agtatttctga

SEQ ID NO: 4124690 - DNA, 16 bp, Homo sapiens
agtatttctgattttg

SEQ ID NO: 4124691 - DNA, 13 bp, Homo sapiens
agtatttgaatta

SEQ ID NO: 4124692 - DNA, 15 bp, Homo sapiens
agtatttgaattaaa

SEQ ID NO: 4124693 - DNA, 16 bp, Homo sapiens
agtatttgaattaaaa

SEQ ID NO: 4124694 - DNA, 16 bp, Homo sapiens
agtatttgagagttct

SEQ ID NO: 4124695 - DNA, 18 bp, Homo sapiens
agtatttggtccaaaaaa

SEQ ID NO: 4124696 - DNA, 22 bp, Homo sapiens
agtatttggtccaaaaaaagga

SEQ ID NO: 4124697 - DNA, 12 bp, Homo sapiens
agtattttaatc

SEQ ID NO: 4124698 - DNA, 16 bp, Homo sapiens
agtattttaatcctgt

SEQ ID NO: 4124699 - DNA, 18 bp, Homo sapiens
agtattttgaagtttaca

SEQ ID NO: 4124700 - DNA, 21 bp, Homo sapiens
agtattttgaagtttacattt

SEQ ID NO: 4124701 - DNA, 17 bp, Homo sapiens
agtattttggttcttag

SEQ ID NO: 4124702 - DNA, 15 bp, Homo sapiens
agtattttgtgtcct

SEQ ID NO: 4124703 - DNA, 22 bp, Homo sapiens
agtatttttataaatataagcc

SEQ ID NO: 4124704 - DNA, 14 bp, Homo sapiens
agtcaaaacagaga

SEQ ID NO: 4124705 - DNA, 21 bp, Homo sapiens
agtcaaaacagagatgtgata

SEQ ID NO: 4124706 - DNA, 22 bp, Homo sapiens
agtcaaatggtaggcatttcct

SEQ ID NO: 4124707 - DNA, 23 bp, Homo sapiens
agtcaaatgtaatgtggcttctg

SEQ ID NO: 4124708 - DNA, 22 bp, Homo sapiens
agtcaaattaataatcttatta

SEQ ID NO: 4124709 - DNA, 12 bp, Homo sapiens
agtcaacaaact

SEQ ID NO: 4124710 - DNA, 21 bp, Homo sapiens
agtcaacttattctttgagta

SEQ ID NO: 4124711 - DNA, 14 bp, Homo sapiens
agtcaatcatttct

SEQ ID NO: 4124712 - DNA, 15 bp, Homo sapiens
agtcaatcatttctc

SEQ ID NO: 4124713 - DNA, 17 bp, Homo sapiens
agtcaatcatttctcac

SEQ ID NO: 4124714 - DNA, 15 bp, Homo sapiens
agtcaatgtgcagtg

SEQ ID NO: 4124715 - DNA, 16 bp, Homo sapiens
agtcacaagagcccag

SEQ ID NO: 4124716 - DNA, 16 bp, Homo sapiens
agtcacacagctagtg

SEQ ID NO: 4124717 - DNA, 17 bp, Homo sapiens
agtcacacagtgttgga

SEQ ID NO: 4124718 - DNA, 12 bp, Homo sapiens
agtcacacccac

SEQ ID NO: 4124719 - DNA, 15 bp, Homo sapiens
agtcacactgtggcc

SEQ ID NO: 4124720 - DNA, 14 bp, Homo sapiens
agtcacatcacagg

SEQ ID NO: 4124721 - DNA, 17 bp, Homo sapiens
agtcaccaggacttggg

SEQ ID NO: 4124722 - DNA, 15 bp, Homo sapiens
agtcacctccccaca

SEQ ID NO: 4124723 - DNA, 18 bp, Homo sapiens
agtcactccctctgcctt

SEQ ID NO: 4124724 - DNA, 19 bp, Homo sapiens
agtcactccctctgccttc

SEQ ID NO: 4124725 - DNA, 19 bp, Homo sapiens
agtcacttactattgttgc

SEQ ID NO: 4124726 - DNA, 21 bp, Homo sapiens
agtcacttgatgtgccatttt

SEQ ID NO: 4124727 - DNA, 22 bp, Homo sapiens
agtcagagcccctacagcattg

SEQ ID NO: 4124728 - DNA, 12 bp, Homo sapiens
agtcagagccct

SEQ ID NO: 4124729 - DNA, 14 bp, Homo sapiens
agtcagagccctgg

SEQ ID NO: 4124730 - DNA, 16 bp, Homo sapiens
agtcagagccctggct

SEQ ID NO: 4124731 - DNA, 14 bp, Homo sapiens
agtcagagtccagt

SEQ ID NO: 4124732 - DNA, 19 bp, Homo sapiens
agtcagcatgcttcccaga

SEQ ID NO: 4124733 - DNA, 21 bp, Homo sapiens
agtcagcatgcttcccagagg

SEQ ID NO: 4124734 - DNA, 18 bp, Homo sapiens
agtcagccaggagctgtc

SEQ ID NO: 4124735 - DNA, 23 bp, Homo sapiens
agtcagcctcgcaggcctccctg

SEQ ID NO: 4124736 - DNA, 13 bp, Homo sapiens
agtcagctctctg

SEQ ID NO: 4124737 - DNA, 22 bp, Homo sapiens
agtcaggccttaattttcagta

SEQ ID NO: 4124738 - DNA, 17 bp, Homo sapiens
agtcaggctctctgggc

SEQ ID NO: 4124739 - DNA, 11 bp, Homo sapiens
agtcaggtgct

SEQ ID NO: 4124740 - DNA, 22 bp, Homo sapiens
agtcagtcgcctttcagcaggc

SEQ ID NO: 4124741 - DNA, 23 bp, Homo sapiens
agtcagtcgcctttcagcaggca

SEQ ID NO: 4124742 - DNA, 17 bp, Homo sapiens
agtcagtcttcacttgc

SEQ ID NO: 4124743 - DNA, 17 bp, Homo sapiens
agtcagtgtctggcttt

SEQ ID NO: 4124744 - DNA, 15 bp, Homo sapiens
agtcagtgttgagat

SEQ ID NO: 4124745 - DNA, 16 bp, Homo sapiens
agtcagttgaaattct

SEQ ID NO: 4124746 - DNA, 13 bp, Homo sapiens
agtcatcatcagg

SEQ ID NO: 4124747 - DNA, 16 bp, Homo sapiens
agtcatccaacaagaa

SEQ ID NO: 4124748 - DNA, 21 bp, Homo sapiens
agtcatccaacaagaagaaat

SEQ ID NO: 4124749 - DNA, 22 bp, Homo sapiens
agtcatccaacaagaagaaata

SEQ ID NO: 4124750 - DNA, 23 bp, Homo sapiens
agtcatccaacaagaagaaatat

SEQ ID NO: 4124751 - DNA, 16 bp, Homo sapiens
agtcatctactttttt

SEQ ID NO: 4124752 - DNA, 22 bp, Homo sapiens
agtcatgcaaaccgttaggaaa

SEQ ID NO: 4124753 - DNA, 16 bp, Homo sapiens
agtcatgcataaatat

SEQ ID NO: 4124754 - DNA, 15 bp, Homo sapiens
agtcatggtgttgcg

SEQ ID NO: 4124755 - DNA, 13 bp, Homo sapiens
agtcatgtgcatt

SEQ ID NO: 4124756 - DNA, 17 bp, Homo sapiens
agtcattcgttctgtgg

SEQ ID NO: 4124757 - DNA, 14 bp, Homo sapiens
agtcattcttccct

SEQ ID NO: 4124758 - DNA, 15 bp, Homo sapiens
agtcatttactaaac

SEQ ID NO: 4124759 - DNA, 22 bp, Homo sapiens
agtcatttgctgagcatgtact

SEQ ID NO: 4124760 - DNA, 11 bp, Homo sapiens
agtccaaagtc

SEQ ID NO: 4124761 - DNA, 11 bp, Homo sapiens
agtccaagctg

SEQ ID NO: 4124762 - DNA, 16 bp, Homo sapiens
agtccaagctgggaga

SEQ ID NO: 4124763 - DNA, 16 bp, Homo sapiens
agtccaaggccagtcc

SEQ ID NO: 4124764 - DNA, 13 bp, Homo sapiens
agtccaataagac

SEQ ID NO: 4124765 - DNA, 11 bp, Homo sapiens
agtccagacac

SEQ ID NO: 4124766 - DNA, 19 bp, Homo sapiens
agtccagggtttctctgca

SEQ ID NO: 4124767 - DNA, 18 bp, Homo sapiens
agtccagtgctctgcctc

SEQ ID NO: 4124768 - DNA, 20 bp, Homo sapiens
agtccagtgctctgcctcag

SEQ ID NO: 4124769 - DNA, 19 bp, Homo sapiens
agtccattctcccaggtac

SEQ ID NO: 4124770 - DNA, 12 bp, Homo sapiens
agtccatttata

SEQ ID NO: 4124771 - DNA, 19 bp, Homo sapiens
agtccatttatatatgaaa

SEQ ID NO: 4124772 - DNA, 21 bp, Homo sapiens
agtccatttcccacatctttc

SEQ ID NO: 4124773 - DNA, 21 bp, Homo sapiens
agtcccaaggaaagccccagc

SEQ ID NO: 4124774 - DNA, 19 bp, Homo sapiens
agtcccactccaagccagc

SEQ ID NO: 4124775 - DNA, 20 bp, Homo sapiens
agtcccagtattctcagagc

SEQ ID NO: 4124776 - DNA, 12 bp, Homo sapiens
agtccccacccc

SEQ ID NO: 4124777 - DNA, 17 bp, Homo sapiens
agtccccacccctgccc

SEQ ID NO: 4124778 - DNA, 13 bp, Homo sapiens
agtcccctccagg

SEQ ID NO: 4124779 - DNA, 18 bp, Homo sapiens
agtccctccctgcctgag

SEQ ID NO: 4124780 - DNA, 23 bp, Homo sapiens
agtccctgtcatttgaacctgga

SEQ ID NO: 4124781 - DNA, 15 bp, Homo sapiens
agtcccttcccctcc

SEQ ID NO: 4124782 - DNA, 17 bp, Homo sapiens
agtcccttcccctccct

SEQ ID NO: 4124783 - DNA, 15 bp, Homo sapiens
agtccgcagaagccc

SEQ ID NO: 4124784 - DNA, 21 bp, Homo sapiens
agtcctaattcaatcctactt

SEQ ID NO: 4124785 - DNA, 20 bp, Homo sapiens
agtcctacaagctaaaatta

SEQ ID NO: 4124786 - DNA, 17 bp, Homo sapiens
agtcctagccactcagg

SEQ ID NO: 4124787 - DNA, 15 bp, Homo sapiens
agtcctcactcccag

SEQ ID NO: 4124788 - DNA, 16 bp, Homo sapiens
agtcctcactcccagt

SEQ ID NO: 4124789 - DNA, 19 bp, Homo sapiens
agtcctccagaactcttcc

SEQ ID NO: 4124790 - DNA, 20 bp, Homo sapiens
agtcctccagaactcttcct

SEQ ID NO: 4124791 - DNA, 15 bp, Homo sapiens
agtcctcctgggagc

SEQ ID NO: 4124792 - DNA, 17 bp, Homo sapiens
agtcctgactgggctgg

SEQ ID NO: 4124793 - DNA, 19 bp, Homo sapiens
agtcctgactgggctgggt

SEQ ID NO: 4124794 - DNA, 19 bp, Homo sapiens
agtcctgagtgtggacttg

SEQ ID NO: 4124795 - DNA, 22 bp, Homo sapiens
agtcctgctacctcccttgcct

SEQ ID NO: 4124796 - DNA, 17 bp, Homo sapiens
agtcctggatgttgtgt

SEQ ID NO: 4124797 - DNA, 19 bp, Homo sapiens
agtcctggctacatcccag

SEQ ID NO: 4124798 - DNA, 21 bp, Homo sapiens
agtcgcctgcctgcagcaggc

SEQ ID NO: 4124799 - DNA, 21 bp, Homo sapiens
agtcgcctttcagcaggcagc

SEQ ID NO: 4124800 - DNA, 22 bp, Homo sapiens
agtcgcctttcagcaggcagcc

SEQ ID NO: 4124801 - DNA, 16 bp, Homo sapiens
agtcggcacagcctgg

SEQ ID NO: 4124802 - DNA, 14 bp, Homo sapiens
agtcggtcctcttt

SEQ ID NO: 4124803 - DNA, 16 bp, Homo sapiens
agtcgtaaaagagata

SEQ ID NO: 4124804 - DNA, 16 bp, Homo sapiens
agtctagcactcattt

SEQ ID NO: 4124805 - DNA, 20 bp, Homo sapiens
agtctagcactcattttcta

SEQ ID NO: 4124806 - DNA, 23 bp, Homo sapiens
agtctatttttttaactgaaaat

SEQ ID NO: 4124807 - DNA, 17 bp, Homo sapiens
agtctcaaaaatacaaa

SEQ ID NO: 4124808 - DNA, 18 bp, Homo sapiens
agtctcagtttgtgtgtc

SEQ ID NO: 4124809 - DNA, 21 bp, Homo sapiens
agtctcagtttgtgtgtctta

SEQ ID NO: 4124810 - DNA, 17 bp, Homo sapiens
agtctcattacttttga

SEQ ID NO: 4124811 - DNA, 19 bp, Homo sapiens
agtctccatgaagagcttg

SEQ ID NO: 4124812 - DNA, 19 bp, Homo sapiens
agtctcccaggccccctgc

SEQ ID NO: 4124813 - DNA, 23 bp, Homo sapiens
agtctcccccacccttgttccag

SEQ ID NO: 4124814 - DNA, 14 bp, Homo sapiens
agtctccctctgat

SEQ ID NO: 4124815 - DNA, 16 bp, Homo sapiens
agtctccctctgattg

SEQ ID NO: 4124816 - DNA, 23 bp, Homo sapiens
agtctcctcaatttttgtctcag

SEQ ID NO: 4124817 - DNA, 23 bp, Homo sapiens
agtctcctgtcttatggtccaga

SEQ ID NO: 4124818 - DNA, 17 bp, Homo sapiens
agtctcctttgcactga

SEQ ID NO: 4124819 - DNA, 14 bp, Homo sapiens
agtctctctgtgaa

SEQ ID NO: 4124820 - DNA, 15 bp, Homo sapiens
agtctctctgtgaat

SEQ ID NO: 4124821 - DNA, 21 bp, Homo sapiens
agtctctctgtgaatacaatt

SEQ ID NO: 4124822 - DNA, 22 bp, Homo sapiens
agtctctctgtgaatacaatta

SEQ ID NO: 4124823 - DNA, 17 bp, Homo sapiens
agtctctcttaaagttg

SEQ ID NO: 4124824 - DNA, 17 bp, Homo sapiens
agtctcttctccactgg

SEQ ID NO: 4124825 - DNA, 18 bp, Homo sapiens
agtctcttctccactgga

SEQ ID NO: 4124826 - DNA, 22 bp, Homo sapiens
agtctctttaatcttcagtttt

SEQ ID NO: 4124827 - DNA, 15 bp, Homo sapiens
agtctgaacagctgt

SEQ ID NO: 4124828 - DNA, 19 bp, Homo sapiens
agtctggagtgggcagagc

SEQ ID NO: 4124829 - DNA, 13 bp, Homo sapiens
agtctgggcctct

SEQ ID NO: 4124830 - DNA, 19 bp, Homo sapiens
agtctggggacctggcact

SEQ ID NO: 4124831 - DNA, 16 bp, Homo sapiens
agtctggtctgcgcct

SEQ ID NO: 4124832 - DNA, 21 bp, Homo sapiens
agtctgtctttcctgaaccat

SEQ ID NO: 4124833 - DNA, 12 bp, Homo sapiens
agtcttaacaaa

SEQ ID NO: 4124834 - DNA, 13 bp, Homo sapiens
agtcttagatgta

SEQ ID NO: 4124835 - DNA, 16 bp, Homo sapiens
agtcttagatgtatat

SEQ ID NO: 4124836 - DNA, 17 bp, Homo sapiens
agtcttatgcttccaga

SEQ ID NO: 4124837 - DNA, 19 bp, Homo sapiens
agtcttcactctctgaaga

SEQ ID NO: 4124838 - DNA, 18 bp, Homo sapiens
agtcttcatgttcccact

SEQ ID NO: 4124839 - DNA, 21 bp, Homo sapiens
agtcttctcatagcattaact

SEQ ID NO: 4124840 - DNA, 17 bp, Homo sapiens
agtcttggtttctctct

SEQ ID NO: 4124841 - DNA, 14 bp, Homo sapiens
agtcttttctgtca

SEQ ID NO: 4124842 - DNA, 16 bp, Homo sapiens
agtcttttttttcctg

SEQ ID NO: 4124843 - DNA, 13 bp, Homo sapiens
agtgaaccatcat

SEQ ID NO: 4124844 - DNA, 16 bp, Homo sapiens
agtgaactcctgccag

SEQ ID NO: 4124845 - DNA, 14 bp, Homo sapiens
agtgaagaccagag

SEQ ID NO: 4124846 - DNA, 21 bp, Homo sapiens
agtgaagactagaaaattaga

SEQ ID NO: 4124847 - DNA, 17 bp, Homo sapiens
agtgaagactccagaaa

SEQ ID NO: 4124848 - DNA, 23 bp, Homo sapiens
agtgaagatggtttcaattcaga

SEQ ID NO: 4124849 - DNA, 17 bp, Homo sapiens
agtgaataaatgtcttg

SEQ ID NO: 4124850 - DNA, 16 bp, Homo sapiens
agtgaatactgctaca

SEQ ID NO: 4124851 - DNA, 21 bp, Homo sapiens
agtgaatctaaggataatgaa

SEQ ID NO: 4124852 - DNA, 13 bp, Homo sapiens
agtgaatgaaaga

SEQ ID NO: 4124853 - DNA, 20 bp, Homo sapiens
agtgaattcttgaaggaaaa

SEQ ID NO: 4124854 - DNA, 21 bp, Homo sapiens
agtgaattgtgaccaagttat

SEQ ID NO: 4124855 - DNA, 23 bp, Homo sapiens
agtgacacagcagcttcaccaga

SEQ ID NO: 4124856 - DNA, 20 bp, Homo sapiens
agtgacacttcagagagctg

SEQ ID NO: 4124857 - DNA, 22 bp, Homo sapiens
agtgacacttcagagagctggt

SEQ ID NO: 4124858 - DNA, 15 bp, Homo sapiens
agtgacagtattttg

SEQ ID NO: 4124859 - DNA, 19 bp, Homo sapiens
agtgacagtggattgcatt

SEQ ID NO: 4124860 - DNA, 18 bp, Homo sapiens
agtgaccattgcatgccg

SEQ ID NO: 4124861 - DNA, 13 bp, Homo sapiens
agtgaccccagaa

SEQ ID NO: 4124862 - DNA, 20 bp, Homo sapiens
agtgaccttttcttcatttt

SEQ ID NO: 4124863 - DNA, 18 bp, Homo sapiens
agtgactagtacaaatta

SEQ ID NO: 4124864 - DNA, 18 bp, Homo sapiens
agtgactgaaaccatttt

SEQ ID NO: 4124865 - DNA, 22 bp, Homo sapiens
agtgactgaaaccattttccca

SEQ ID NO: 4124866 - DNA, 18 bp, Homo sapiens
agtgacttgtgtcccatg

SEQ ID NO: 4124867 - DNA, 17 bp, Homo sapiens
agtgactttaaaagaaa

SEQ ID NO: 4124868 - DNA, 14 bp, Homo sapiens
agtgactttgtata

SEQ ID NO: 4124869 - DNA, 22 bp, Homo sapiens
agtgagcaaaatatgccccttc

SEQ ID NO: 4124870 - DNA, 15 bp, Homo sapiens
agtgagccacagacc

SEQ ID NO: 4124871 - DNA, 16 bp, Homo sapiens
agtgagccacagacca

SEQ ID NO: 4124872 - DNA, 18 bp, Homo sapiens
agtgagcctcctgtgcct

SEQ ID NO: 4124873 - DNA, 14 bp, Homo sapiens
agtgagctacagag

SEQ ID NO: 4124874 - DNA, 17 bp, Homo sapiens
agtgagtcacctgctcc

SEQ ID NO: 4124875 - DNA, 20 bp, Homo sapiens
agtgagtcacctgctccaga

SEQ ID NO: 4124876 - DNA, 19 bp, Homo sapiens
agtgataccagttcagaca

SEQ ID NO: 4124877 - DNA, 21 bp, Homo sapiens
agtgatatggcagaagacacc

SEQ ID NO: 4124878 - DNA, 22 bp, Homo sapiens
agtgatatggcagaagacacca

SEQ ID NO: 4124879 - DNA, 13 bp, Homo sapiens
agtgatctccata

SEQ ID NO: 4124880 - DNA, 12 bp, Homo sapiens
agtgatgatttg

SEQ ID NO: 4124881 - DNA, 16 bp, Homo sapiens
agtgatgtaccatgaa

SEQ ID NO: 4124882 - DNA, 17 bp, Homo sapiens
agtgattgacacacagc

SEQ ID NO: 4124883 - DNA, 23 bp, Homo sapiens
agtgattgagactcaaaaaaaca

SEQ ID NO: 4124884 - DNA, 13 bp, Homo sapiens
agtgatttctaga

SEQ ID NO: 4124885 - DNA, 20 bp, Homo sapiens
agtgcaataaatctgaccca

SEQ ID NO: 4124886 - DNA, 22 bp, Homo sapiens
agtgcaatggtataaatttcaa

SEQ ID NO: 4124887 - DNA, 15 bp, Homo sapiens
agtgcacagctgtcc

SEQ ID NO: 4124888 - DNA, 20 bp, Homo sapiens
agtgcacctgggacagggag

SEQ ID NO: 4124889 - DNA, 16 bp, Homo sapiens
agtgcagacaggccat

SEQ ID NO: 4124890 - DNA, 21 bp, Homo sapiens
agtgcagagccttctcagaag

SEQ ID NO: 4124891 - DNA, 16 bp, Homo sapiens
agtgcatatttatcca

SEQ ID NO: 4124892 - DNA, 14 bp, Homo sapiens
agtgcatccaaagg

SEQ ID NO: 4124893 - DNA, 16 bp, Homo sapiens
agtgcatctcagccca

SEQ ID NO: 4124894 - DNA, 21 bp, Homo sapiens
agtgcatttctgaatagaaat

SEQ ID NO: 4124895 - DNA, 17 bp, Homo sapiens
agtgcattttcccagat

SEQ ID NO: 4124896 - DNA, 16 bp, Homo sapiens
agtgccaactcctcac

SEQ ID NO: 4124897 - DNA, 17 bp, Homo sapiens
agtgccaatgatgtgac

SEQ ID NO: 4124898 - DNA, 18 bp, Homo sapiens
agtgccaatgatgtgacc

SEQ ID NO: 4124899 - DNA, 20 bp, Homo sapiens
agtgccagaattttaggaac

SEQ ID NO: 4124900 - DNA, 18 bp, Homo sapiens
agtgccagcacctgccca

SEQ ID NO: 4124901 - DNA, 19 bp, Homo sapiens
agtgccaggactccccagg

SEQ ID NO: 4124902 - DNA, 15 bp, Homo sapiens
agtgccatgtaaatc

SEQ ID NO: 4124903 - DNA, 20 bp, Homo sapiens
agtgcccaccctgggagaca

SEQ ID NO: 4124904 - DNA, 22 bp, Homo sapiens
agtgcccaccctgggagacaga

SEQ ID NO: 4124905 - DNA, 16 bp, Homo sapiens
agtgcccccactgacc

SEQ ID NO: 4124906 - DNA, 22 bp, Homo sapiens
agtgccccctcacctctccagg

SEQ ID NO: 4124907 - DNA, 18 bp, Homo sapiens
agtgccctgctttgcaaa

SEQ ID NO: 4124908 - DNA, 14 bp, Homo sapiens
agtgccggctgtgg

SEQ ID NO: 4124909 - DNA, 12 bp, Homo sapiens
agtgcctgagct

SEQ ID NO: 4124910 - DNA, 17 bp, Homo sapiens
agtgcctgggaatgtat

SEQ ID NO: 4124911 - DNA, 13 bp, Homo sapiens
agtgccttccata

SEQ ID NO: 4124912 - DNA, 13 bp, Homo sapiens
agtgccttctcct

SEQ ID NO: 4124913 - DNA, 15 bp, Homo sapiens
agtgccttctccttc

SEQ ID NO: 4124914 - DNA, 16 bp, Homo sapiens
agtgccttctccttcc

SEQ ID NO: 4124915 - DNA, 19 bp, Homo sapiens
agtgccttttgcagaagag

SEQ ID NO: 4124916 - DNA, 17 bp, Homo sapiens
agtgccttttgctgcgc

SEQ ID NO: 4124917 - DNA, 18 bp, Homo sapiens
agtgccttttgctgcgca

SEQ ID NO: 4124918 - DNA, 19 bp, Homo sapiens
agtgccttttgctgcgcac

SEQ ID NO: 4124919 - DNA, 20 bp, Homo sapiens
agtgccttttgctgcgcacc

SEQ ID NO: 4124920 - DNA, 14 bp, Homo sapiens
agtgccttttggaa

SEQ ID NO: 4124921 - DNA, 18 bp, Homo sapiens
agtgcgatgtttcaggag

SEQ ID NO: 4124922 - DNA, 19 bp, Homo sapiens
agtgcgggctgaggccaga

SEQ ID NO: 4124923 - DNA, 23 bp, Homo sapiens
agtgcgggctgaggccagagtca

SEQ ID NO: 4124924 - DNA, 16 bp, Homo sapiens
agtgcggttcctcatc

SEQ ID NO: 4124925 - DNA, 21 bp, Homo sapiens
agtgcgtggtataatctccat

SEQ ID NO: 4124926 - DNA, 16 bp, Homo sapiens
agtgcgtgtgtagagt

SEQ ID NO: 4124927 - DNA, 24 bp, Homo sapiens
agtgctagaaaatttagcccttta

SEQ ID NO: 4124928 - DNA, 14 bp, Homo sapiens
agtgctattgcaga

SEQ ID NO: 4124929 - DNA, 22 bp, Homo sapiens
agtgctccccaaaaggaaggag

SEQ ID NO: 4124930 - DNA, 12 bp, Homo sapiens
agtgctctgcct

SEQ ID NO: 4124931 - DNA, 14 bp, Homo sapiens
agtgctgaacagtg

SEQ ID NO: 4124932 - DNA, 16 bp, Homo sapiens
agtgctgaacagtgga

SEQ ID NO: 4124933 - DNA, 21 bp, Homo sapiens
agtgctgaggccagggctgat

SEQ ID NO: 4124934 - DNA, 16 bp, Homo sapiens
agtgctggctcacagt

SEQ ID NO: 4124935 - DNA, 21 bp, Homo sapiens
agtgctggctcacagtacagc

SEQ ID NO: 4124936 - DNA, 18 bp, Homo sapiens
agtgctgggaccagagcc

SEQ ID NO: 4124937 - DNA, 20 bp, Homo sapiens
agtgctgggattacaggtgt

SEQ ID NO: 4124938 - DNA, 19 bp, Homo sapiens
agtgctgtgctgtgtttaa

SEQ ID NO: 4124939 - DNA, 16 bp, Homo sapiens
agtgcttccaaggatg

SEQ ID NO: 4124940 - DNA, 14 bp, Homo sapiens
agtgcttctctaca

SEQ ID NO: 4124941 - DNA, 21 bp, Homo sapiens
agtgcttcttaaagagttctt

SEQ ID NO: 4124942 - DNA, 16 bp, Homo sapiens
agtgcttttctgttta

SEQ ID NO: 4124943 - DNA, 20 bp, Homo sapiens
agtgcttttttttttttgac

SEQ ID NO: 4124944 - DNA, 16 bp, Homo sapiens
agtggaaacatttata

SEQ ID NO: 4124945 - DNA, 16 bp, Homo sapiens
agtggaacagcgggag

SEQ ID NO: 4124946 - DNA, 21 bp, Homo sapiens
agtggaaggtctattggccaa

SEQ ID NO: 4124947 - DNA, 22 bp, Homo sapiens
agtggaatagtgaatacttact

SEQ ID NO: 4124948 - DNA, 19 bp, Homo sapiens
agtggacaaattttgagtt

SEQ ID NO: 4124949 - DNA, 17 bp, Homo sapiens
agtggaccttaggcctt

SEQ ID NO: 4124950 - DNA, 14 bp, Homo sapiens
agtggactcagcag

SEQ ID NO: 4124951 - DNA, 13 bp, Homo sapiens
agtggactcaggg

SEQ ID NO: 4124952 - DNA, 14 bp, Homo sapiens
agtggatctccaag

SEQ ID NO: 4124953 - DNA, 16 bp, Homo sapiens
agtggatgactgttga

SEQ ID NO: 4124954 - DNA, 12 bp, Homo sapiens
agtggatgggaa

SEQ ID NO: 4124955 - DNA, 16 bp, Homo sapiens
agtggatgggaatttg

SEQ ID NO: 4124956 - DNA, 14 bp, Homo sapiens
agtggattgcattt

SEQ ID NO: 4124957 - DNA, 21 bp, Homo sapiens
agtggatttttttgtcattaa

SEQ ID NO: 4124958 - DNA, 21 bp, Homo sapiens
agtggcacctgtctgctccag

SEQ ID NO: 4124959 - DNA, 16 bp, Homo sapiens
agtggcagacaaacag

SEQ ID NO: 4124960 - DNA, 17 bp, Homo sapiens
agtggcagacaaacaga

SEQ ID NO: 4124961 - DNA, 18 bp, Homo sapiens
agtggccagccagtgcca

SEQ ID NO: 4124962 - DNA, 19 bp, Homo sapiens
agtggccagccagtgccat

SEQ ID NO: 4124963 - DNA, 15 bp, Homo sapiens
agtggcccaacaggg

SEQ ID NO: 4124964 - DNA, 15 bp, Homo sapiens
agtggcctccctgct

SEQ ID NO: 4124965 - DNA, 23 bp, Homo sapiens
agtggcctgctaaggctcctcct

SEQ ID NO: 4124966 - DNA, 15 bp, Homo sapiens
agtggcctggccagg

SEQ ID NO: 4124967 - DNA, 18 bp, Homo sapiens
agtggcctggccaggagc

SEQ ID NO: 4124968 - DNA, 20 bp, Homo sapiens
agtggcctggccaggagctc

SEQ ID NO: 4124969 - DNA, 15 bp, Homo sapiens
agtggcgcaaggccg

SEQ ID NO: 4124970 - DNA, 20 bp, Homo sapiens
agtggcgggtgatggccagc

SEQ ID NO: 4124971 - DNA, 13 bp, Homo sapiens
agtggctcctccc

SEQ ID NO: 4124972 - DNA, 15 bp, Homo sapiens
agtggctgccttctt

SEQ ID NO: 4124973 - DNA, 21 bp, Homo sapiens
agtggctgggtgggcccagaa

SEQ ID NO: 4124974 - DNA, 18 bp, Homo sapiens
agtggctggtccagggct

SEQ ID NO: 4124975 - DNA, 22 bp, Homo sapiens
agtgggaagagggggctggcca

SEQ ID NO: 4124976 - DNA, 21 bp, Homo sapiens
agtgggacagggcatggccag

SEQ ID NO: 4124977 - DNA, 15 bp, Homo sapiens
agtgggaccacatgc

SEQ ID NO: 4124978 - DNA, 19 bp, Homo sapiens
agtgggagaaggcagtgat

SEQ ID NO: 4124979 - DNA, 15 bp, Homo sapiens
agtgggcacctcaga

SEQ ID NO: 4124980 - DNA, 18 bp, Homo sapiens
agtgggccctctctctgg

SEQ ID NO: 4124981 - DNA, 18 bp, Homo sapiens
agtgggcgggccatgagg

SEQ ID NO: 4124982 - DNA, 15 bp, Homo sapiens
agtgggcgttgggag

SEQ ID NO: 4124983 - DNA, 16 bp, Homo sapiens
agtgggcttgattctg

SEQ ID NO: 4124984 - DNA, 22 bp, Homo sapiens
agtgggcttgattctgcagtaa

SEQ ID NO: 4124985 - DNA, 22 bp, Homo sapiens
agtggggatggggcctccctcc

SEQ ID NO: 4124986 - DNA, 12 bp, Homo sapiens
agtggggcctgt

SEQ ID NO: 4124987 - DNA, 13 bp, Homo sapiens
agtggggcctgtg

SEQ ID NO: 4124988 - DNA, 15 bp, Homo sapiens
agtggggcctgtgga

SEQ ID NO: 4124989 - DNA, 21 bp, Homo sapiens
agtggggtgctgggaggaggg

SEQ ID NO: 4124990 - DNA, 18 bp, Homo sapiens
agtggggttatctctgtg

SEQ ID NO: 4124991 - DNA, 19 bp, Homo sapiens
agtggggttatctctgtgt

SEQ ID NO: 4124992 - DNA, 14 bp, Homo sapiens
agtgggtctgggat

SEQ ID NO: 4124993 - DNA, 18 bp, Homo sapiens
agtgggtggtggatctgt

SEQ ID NO: 4124994 - DNA, 16 bp, Homo sapiens
agtggtaagctctggc

SEQ ID NO: 4124995 - DNA, 20 bp, Homo sapiens
agtggtaatcatatgtgtct

SEQ ID NO: 4124996 - DNA, 22 bp, Homo sapiens
agtggtcgcttactttgagtga

SEQ ID NO: 4124997 - DNA, 16 bp, Homo sapiens
agtggtctttctggag

SEQ ID NO: 4124998 - DNA, 17 bp, Homo sapiens
agtggtctttgtaagag

SEQ ID NO: 4124999 - DNA, 19 bp, Homo sapiens
agtggtctttgtaagagtg

SEQ ID NO: 4125000 - DNA, 16 bp, Homo sapiens
agtggtgtttattgca

SEQ ID NO: 4125001 - DNA, 17 bp, Homo sapiens
agtggttaggcagcaag

SEQ ID NO: 4125002 - DNA, 13 bp, Homo sapiens
agtggttctcatt

SEQ ID NO: 4125003 - DNA, 17 bp, Homo sapiens
agtggttttatactgaa

SEQ ID NO: 4125004 - DNA, 23 bp, Homo sapiens
agtggttttatactgaaggaaaa

SEQ ID NO: 4125005 - DNA, 21 bp, Homo sapiens
agtgtaaatcctttttcttta

SEQ ID NO: 4125006 - DNA, 22 bp, Homo sapiens
agtgtaacaattgtgtagcctt

SEQ ID NO: 4125007 - DNA, 23 bp, Homo sapiens
agtgtaacaattgtgtagccttt

SEQ ID NO: 4125008 - DNA, 16 bp, Homo sapiens
agtgtaacagctgagg

SEQ ID NO: 4125009 - DNA, 18 bp, Homo sapiens
agtgtaacttgcttaaat

SEQ ID NO: 4125010 - DNA, 20 bp, Homo sapiens
agtgtaacttgcttaaattt

SEQ ID NO: 4125011 - DNA, 19 bp, Homo sapiens
agtgtaatgtagcgtgttt

SEQ ID NO: 4125012 - DNA, 21 bp, Homo sapiens
agtgtacctcctctcagtgtt

SEQ ID NO: 4125013 - DNA, 16 bp, Homo sapiens
agtgtacgattcttaa

SEQ ID NO: 4125014 - DNA, 12 bp, Homo sapiens
agtgtagaagca

SEQ ID NO: 4125015 - DNA, 16 bp, Homo sapiens
agtgtagaagcattcc

SEQ ID NO: 4125016 - DNA, 18 bp, Homo sapiens
agtgtagaagcattcctt

SEQ ID NO: 4125017 - DNA, 19 bp, Homo sapiens
agtgtagaagcattccttc

SEQ ID NO: 4125018 - DNA, 15 bp, Homo sapiens
agtgtagtcaggtgc

SEQ ID NO: 4125019 - DNA, 16 bp, Homo sapiens
agtgtagtcaggtgct

SEQ ID NO: 4125020 - DNA, 17 bp, Homo sapiens
agtgtagtcaggtgctc

SEQ ID NO: 4125021 - DNA, 17 bp, Homo sapiens
agtgtagttaatttatc

SEQ ID NO: 4125022 - DNA, 16 bp, Homo sapiens
agtgtatgtcttgtat

SEQ ID NO: 4125023 - DNA, 19 bp, Homo sapiens
agtgtcacctctctcagag

SEQ ID NO: 4125024 - DNA, 19 bp, Homo sapiens
agtgtcacttacctagatt

SEQ ID NO: 4125025 - DNA, 21 bp, Homo sapiens
agtgtcacttacctagattta

SEQ ID NO: 4125026 - DNA, 20 bp, Homo sapiens
agtgtcagaatcagaatcat

SEQ ID NO: 4125027 - DNA, 16 bp, Homo sapiens
agtgtcatcagaagat

SEQ ID NO: 4125028 - DNA, 20 bp, Homo sapiens
agtgtcatcagaagataact

SEQ ID NO: 4125029 - DNA, 14 bp, Homo sapiens
agtgtcccaggcag

SEQ ID NO: 4125030 - DNA, 13 bp, Homo sapiens
agtgtcccctcca

SEQ ID NO: 4125031 - DNA, 14 bp, Homo sapiens
agtgtcccctccac

SEQ ID NO: 4125032 - DNA, 16 bp, Homo sapiens
agtgtccgagaactaa

SEQ ID NO: 4125033 - DNA, 23 bp, Homo sapiens
agtgtcctccaagtgccccctca

SEQ ID NO: 4125034 - DNA, 12 bp, Homo sapiens
agtgtcctgccc

SEQ ID NO: 4125035 - DNA, 18 bp, Homo sapiens
agtgtccttagtgtataa

SEQ ID NO: 4125036 - DNA, 17 bp, Homo sapiens
agtgtctataaaagaaa

SEQ ID NO: 4125037 - DNA, 22 bp, Homo sapiens
agtgtctcggagggattcccct

SEQ ID NO: 4125038 - DNA, 22 bp, Homo sapiens
agtgtctggctttttcctctga

SEQ ID NO: 4125039 - DNA, 17 bp, Homo sapiens
agtgtctgggtttttct

SEQ ID NO: 4125040 - DNA, 12 bp, Homo sapiens
agtgtctgtgag

SEQ ID NO: 4125041 - DNA, 15 bp, Homo sapiens
agtgtctgtgccatg

SEQ ID NO: 4125042 - DNA, 16 bp, Homo sapiens
agtgtctgtgccatgg

SEQ ID NO: 4125043 - DNA, 14 bp, Homo sapiens
agtgtcttccataa

SEQ ID NO: 4125044 - DNA, 23 bp, Homo sapiens
agtgtctttaaatacttcatgag

SEQ ID NO: 4125045 - DNA, 18 bp, Homo sapiens
agtgtgaatagcctggcc

SEQ ID NO: 4125046 - DNA, 11 bp, Homo sapiens
agtgtgacagg

SEQ ID NO: 4125047 - DNA, 14 bp, Homo sapiens
agtgtgacagggcc

SEQ ID NO: 4125048 - DNA, 18 bp, Homo sapiens
agtgtgaccccactgcca

SEQ ID NO: 4125049 - DNA, 16 bp, Homo sapiens
agtgtgagcagtgagt

SEQ ID NO: 4125050 - DNA, 21 bp, Homo sapiens
agtgtgagcagtgagttacag

SEQ ID NO: 4125051 - DNA, 16 bp, Homo sapiens
agtgtgagctcttccc

SEQ ID NO: 4125052 - DNA, 18 bp, Homo sapiens
agtgtgagctcttccctt

SEQ ID NO: 4125053 - DNA, 19 bp, Homo sapiens
agtgtgagctcttccctta

SEQ ID NO: 4125054 - DNA, 17 bp, Homo sapiens
agtgtgagtaagagctg

SEQ ID NO: 4125055 - DNA, 22 bp, Homo sapiens
agtgtgcacgagtgggaaggac

SEQ ID NO: 4125056 - DNA, 20 bp, Homo sapiens
agtgtggaagccggagggtg

SEQ ID NO: 4125057 - DNA, 21 bp, Homo sapiens
agtgtggagaccctgccacag

SEQ ID NO: 4125058 - DNA, 12 bp, Homo sapiens
agtgtggagtgg

SEQ ID NO: 4125059 - DNA, 21 bp, Homo sapiens
agtgtgtattgttcccagtga

SEQ ID NO: 4125060 - DNA, 14 bp, Homo sapiens
agtgtgtctaaatt

SEQ ID NO: 4125061 - DNA, 20 bp, Homo sapiens
agtgtgtcttcctagaattc

SEQ ID NO: 4125062 - DNA, 14 bp, Homo sapiens
agtgtgtgtgtgca

SEQ ID NO: 4125063 - DNA, 17 bp, Homo sapiens
agtgttacctgtgtgct

SEQ ID NO: 4125064 - DNA, 17 bp, Homo sapiens
agtgttactttttgtaa

SEQ ID NO: 4125065 - DNA, 15 bp, Homo sapiens
agtgttagttataaa

SEQ ID NO: 4125066 - DNA, 20 bp, Homo sapiens
agtgttagttataaatagcc

SEQ ID NO: 4125067 - DNA, 15 bp, Homo sapiens
agtgttcagaaaaaa

SEQ ID NO: 4125068 - DNA, 21 bp, Homo sapiens
agtgttcctttttaaatgtga

SEQ ID NO: 4125069 - DNA, 18 bp, Homo sapiens
agtgttctgccagatctt

SEQ ID NO: 4125070 - DNA, 15 bp, Homo sapiens
agtgttctgctcctg

SEQ ID NO: 4125071 - DNA, 17 bp, Homo sapiens
agtgttgctcagctcct

SEQ ID NO: 4125072 - DNA, 13 bp, Homo sapiens
agtgttgtttgta

SEQ ID NO: 4125073 - DNA, 18 bp, Homo sapiens
agtgttgtttgtaaataa

SEQ ID NO: 4125074 - DNA, 20 bp, Homo sapiens
agtgttgtttgtaaataaga

SEQ ID NO: 4125075 - DNA, 18 bp, Homo sapiens
agtgtttcagctaaggga

SEQ ID NO: 4125076 - DNA, 21 bp, Homo sapiens
agtgtttctaataaacttgga

SEQ ID NO: 4125077 - DNA, 14 bp, Homo sapiens
agtgtttctagcta

SEQ ID NO: 4125078 - DNA, 11 bp, Homo sapiens
agtgtttcttt

SEQ ID NO: 4125079 - DNA, 14 bp, Homo sapiens
agtgttttaaattc

SEQ ID NO: 4125080 - DNA, 15 bp, Homo sapiens
agtgttttaaattct

SEQ ID NO: 4125081 - DNA, 18 bp, Homo sapiens
agtgttttaaattctgag

SEQ ID NO: 4125082 - DNA, 23 bp, Homo sapiens
agtgttttggactccatctctca

SEQ ID NO: 4125083 - DNA, 16 bp, Homo sapiens
agttaaagtgaataac

SEQ ID NO: 4125084 - DNA, 12 bp, Homo sapiens
agttaaataaat

SEQ ID NO: 4125085 - DNA, 15 bp, Homo sapiens
agttaactattgcat

SEQ ID NO: 4125086 - DNA, 19 bp, Homo sapiens
agttaactattgcatttat

SEQ ID NO: 4125087 - DNA, 14 bp, Homo sapiens
agttaactttcaga

SEQ ID NO: 4125088 - DNA, 20 bp, Homo sapiens
agttaagaagctgttgtaca

SEQ ID NO: 4125089 - DNA, 16 bp, Homo sapiens
agttaagacctggcag

SEQ ID NO: 4125090 - DNA, 21 bp, Homo sapiens
agttaagagaaactttataca

SEQ ID NO: 4125091 - DNA, 22 bp, Homo sapiens
agttaagagaaactttatacat

SEQ ID NO: 4125092 - DNA, 13 bp, Homo sapiens
agttaataatgta

SEQ ID NO: 4125093 - DNA, 20 bp, Homo sapiens
agttaatgatggttgatggg

SEQ ID NO: 4125094 - DNA, 13 bp, Homo sapiens
agttaatttatct

SEQ ID NO: 4125095 - DNA, 19 bp, Homo sapiens
agttacaaagtaatttctt

SEQ ID NO: 4125096 - DNA, 17 bp, Homo sapiens
agttactaggtaacttc

SEQ ID NO: 4125097 - DNA, 19 bp, Homo sapiens
agttactaggtaacttcat

SEQ ID NO: 4125098 - DNA, 21 bp, Homo sapiens
agttactgccggtttgaaaat

SEQ ID NO: 4125099 - DNA, 15 bp, Homo sapiens
agttacttcctatca

SEQ ID NO: 4125100 - DNA, 16 bp, Homo sapiens
agttacttgaatttca

SEQ ID NO: 4125101 - DNA, 14 bp, Homo sapiens
agttactttatgtt

SEQ ID NO: 4125102 - DNA, 11 bp, Homo sapiens
agttactttgt

SEQ ID NO: 4125103 - DNA, 16 bp, Homo sapiens
agttactttgtaattt

SEQ ID NO: 4125104 - DNA, 13 bp, Homo sapiens
agttactttttcc

SEQ ID NO: 4125105 - DNA, 23 bp, Homo sapiens
agttagccatctaatgcttgttt

SEQ ID NO: 4125106 - DNA, 15 bp, Homo sapiens
agttagcctccacca

SEQ ID NO: 4125107 - DNA, 18 bp, Homo sapiens
agttagggttttgcaata

SEQ ID NO: 4125108 - DNA, 21 bp, Homo sapiens
agttaggttgtctccaggcca

SEQ ID NO: 4125109 - DNA, 15 bp, Homo sapiens
agttagtagcatgtt

SEQ ID NO: 4125110 - DNA, 16 bp, Homo sapiens
agttagtagcatgttg

SEQ ID NO: 4125111 - DNA, 16 bp, Homo sapiens
agttagttaagttggg

SEQ ID NO: 4125112 - DNA, 17 bp, Homo sapiens
agttagtttttaggtca

SEQ ID NO: 4125113 - DNA, 14 bp, Homo sapiens
agttatagtgaata

SEQ ID NO: 4125114 - DNA, 20 bp, Homo sapiens
agttatagtgaatactgcta

SEQ ID NO: 4125115 - DNA, 21 bp, Homo sapiens
agttatccagagggttgtgat

SEQ ID NO: 4125116 - DNA, 13 bp, Homo sapiens
agttatgtgaatg

SEQ ID NO: 4125117 - DNA, 15 bp, Homo sapiens
agttattatttaatt

SEQ ID NO: 4125118 - DNA, 15 bp, Homo sapiens
agttatttaatcaaa

SEQ ID NO: 4125119 - DNA, 21 bp, Homo sapiens
agttatttttatttatttaaa

SEQ ID NO: 4125120 - DNA, 16 bp, Homo sapiens
agttatttttctcttt

SEQ ID NO: 4125121 - DNA, 21 bp, Homo sapiens
agttcaacctggtggcaccag

SEQ ID NO: 4125122 - DNA, 22 bp, Homo sapiens
agttcaacctggtggcaccaga

SEQ ID NO: 4125123 - DNA, 13 bp, Homo sapiens
agttcacaggagg

SEQ ID NO: 4125124 - DNA, 19 bp, Homo sapiens
agttcacaggaggccagtg

SEQ ID NO: 4125125 - DNA, 18 bp, Homo sapiens
agttcacattagaattag

SEQ ID NO: 4125126 - DNA, 15 bp, Homo sapiens
agttcagaatttagt

SEQ ID NO: 4125127 - DNA, 21 bp, Homo sapiens
agttcagagccaagccttaaa

SEQ ID NO: 4125128 - DNA, 20 bp, Homo sapiens
agttcaggagtcccaaggaa

SEQ ID NO: 4125129 - DNA, 20 bp, Homo sapiens
agttcatagggtctcttcag

SEQ ID NO: 4125130 - DNA, 15 bp, Homo sapiens
agttcatcccttctc

SEQ ID NO: 4125131 - DNA, 18 bp, Homo sapiens
agttcatcgattttctat

SEQ ID NO: 4125132 - DNA, 23 bp, Homo sapiens
agttcatgtttgcttcataaatg

SEQ ID NO: 4125133 - DNA, 15 bp, Homo sapiens
agttcccccaacctc

SEQ ID NO: 4125134 - DNA, 18 bp, Homo sapiens
agttccctctgctcagcc

SEQ ID NO: 4125135 - DNA, 20 bp, Homo sapiens
agttccctctgctcagccaa

SEQ ID NO: 4125136 - DNA, 22 bp, Homo sapiens
agttccctctgctcagccaagc

SEQ ID NO: 4125137 - DNA, 15 bp, Homo sapiens
agttcccttggcctc

SEQ ID NO: 4125138 - DNA, 16 bp, Homo sapiens
agttcccttggcctca

SEQ ID NO: 4125139 - DNA, 18 bp, Homo sapiens
agttcctcctacttacaa

SEQ ID NO: 4125140 - DNA, 18 bp, Homo sapiens
agttcctgtaacaggtgt

SEQ ID NO: 4125141 - DNA, 21 bp, Homo sapiens
agttcctgtcccttctcttaa

SEQ ID NO: 4125142 - DNA, 23 bp, Homo sapiens
agttcctgtcccttctcttaatt

SEQ ID NO: 4125143 - DNA, 19 bp, Homo sapiens
agttccttatccctctctt

SEQ ID NO: 4125144 - DNA, 23 bp, Homo sapiens
agttccttatccctctcttcccc

SEQ ID NO: 4125145 - DNA, 13 bp, Homo sapiens
agttcgtctgttg

SEQ ID NO: 4125146 - DNA, 22 bp, Homo sapiens
agttctacctcaggcagctcaa

SEQ ID NO: 4125147 - DNA, 17 bp, Homo sapiens
agttctagaaccacttc

SEQ ID NO: 4125148 - DNA, 19 bp, Homo sapiens
agttctagaaccacttcct

SEQ ID NO: 4125149 - DNA, 21 bp, Homo sapiens
agttctagaaccacttcctgc

SEQ ID NO: 4125150 - DNA, 16 bp, Homo sapiens
agttctagagaagagg

SEQ ID NO: 4125151 - DNA, 17 bp, Homo sapiens
agttctagagaagaggc

SEQ ID NO: 4125152 - DNA, 19 bp, Homo sapiens
agttctagctctatttact

SEQ ID NO: 4125153 - DNA, 23 bp, Homo sapiens
agttctatgaagagtattaatgt

SEQ ID NO: 4125154 - DNA, 13 bp, Homo sapiens
agttctcactcct

SEQ ID NO: 4125155 - DNA, 18 bp, Homo sapiens
agttctcactgttccctc

SEQ ID NO: 4125156 - DNA, 14 bp, Homo sapiens
agttctgagtgttt

SEQ ID NO: 4125157 - DNA, 14 bp, Homo sapiens
agttctgccaggca

SEQ ID NO: 4125158 - DNA, 23 bp, Homo sapiens
agttctgccaggcaacttttaaa

SEQ ID NO: 4125159 - DNA, 19 bp, Homo sapiens
agttctggaaaagaactgt

SEQ ID NO: 4125160 - DNA, 21 bp, Homo sapiens
agttctgtagagccttctgat

SEQ ID NO: 4125161 - DNA, 13 bp, Homo sapiens
agttctgtgaaga

SEQ ID NO: 4125162 - DNA, 19 bp, Homo sapiens
agttcttactgcttaattc

SEQ ID NO: 4125163 - DNA, 23 bp, Homo sapiens
agttcttactgcttaattcaaat

SEQ ID NO: 4125164 - DNA, 20 bp, Homo sapiens
agttcttatgaggaggggag

SEQ ID NO: 4125165 - DNA, 12 bp, Homo sapiens
agttcttcacct

SEQ ID NO: 4125166 - DNA, 15 bp, Homo sapiens
agttcttcacctcta

SEQ ID NO: 4125167 - DNA, 19 bp, Homo sapiens
agttcttggtgactgtccc

SEQ ID NO: 4125168 - DNA, 21 bp, Homo sapiens
agttcttggtgactgtcccac

SEQ ID NO: 4125169 - DNA, 12 bp, Homo sapiens
agttctttcctc

SEQ ID NO: 4125170 - DNA, 18 bp, Homo sapiens
agttctttgggccagaca

SEQ ID NO: 4125171 - DNA, 16 bp, Homo sapiens
agttgacaacctagaa

SEQ ID NO: 4125172 - DNA, 19 bp, Homo sapiens
agttgacaacctagaatgt

SEQ ID NO: 4125173 - DNA, 20 bp, Homo sapiens
agttgacaacctagaatgtc

SEQ ID NO: 4125174 - DNA, 13 bp, Homo sapiens
agttgacagcagg

SEQ ID NO: 4125175 - DNA, 15 bp, Homo sapiens
agttgacttatagta

SEQ ID NO: 4125176 - DNA, 18 bp, Homo sapiens
agttgacttatagtacat

SEQ ID NO: 4125177 - DNA, 21 bp, Homo sapiens
agttgagatttttaagaactt

SEQ ID NO: 4125178 - DNA, 22 bp, Homo sapiens
agttgagtctcctctctgagac

SEQ ID NO: 4125179 - DNA, 17 bp, Homo sapiens
agttgatctggaaccca

SEQ ID NO: 4125180 - DNA, 18 bp, Homo sapiens
agttgatgggggccagga

SEQ ID NO: 4125181 - DNA, 15 bp, Homo sapiens
agttgatgttgcatt

SEQ ID NO: 4125182 - DNA, 19 bp, Homo sapiens
agttgcacatgattgtata

SEQ ID NO: 4125183 - DNA, 17 bp, Homo sapiens
agttgcagatgtattga

SEQ ID NO: 4125184 - DNA, 22 bp, Homo sapiens
agttgcagatgtattgactgta

SEQ ID NO: 4125185 - DNA, 11 bp, Homo sapiens
agttgcattta

SEQ ID NO: 4125186 - DNA, 16 bp, Homo sapiens
agttgcatttagaaat

SEQ ID NO: 4125187 - DNA, 14 bp, Homo sapiens
agttgccaccacct

SEQ ID NO: 4125188 - DNA, 20 bp, Homo sapiens
agttgccaccacctctgtgg

SEQ ID NO: 4125189 - DNA, 19 bp, Homo sapiens
agttgccctagcccagact

SEQ ID NO: 4125190 - DNA, 14 bp, Homo sapiens
agttgctgtcataa

SEQ ID NO: 4125191 - DNA, 18 bp, Homo sapiens
agttggaaccgtgtccag

SEQ ID NO: 4125192 - DNA, 21 bp, Homo sapiens
agttggaaccgtgtccagcac

SEQ ID NO: 4125193 - DNA, 23 bp, Homo sapiens
agttggaaccgtgtccagcacag

SEQ ID NO: 4125194 - DNA, 18 bp, Homo sapiens
agttggagtttgtgtctg

SEQ ID NO: 4125195 - DNA, 17 bp, Homo sapiens
agttggcagacagccgt

SEQ ID NO: 4125196 - DNA, 16 bp, Homo sapiens
agttggctttgcccac

SEQ ID NO: 4125197 - DNA, 24 bp, Homo sapiens
agttggctttgcccacccctcact

SEQ ID NO: 4125198 - DNA, 15 bp, Homo sapiens
agttgggactcagga

SEQ ID NO: 4125199 - DNA, 19 bp, Homo sapiens
agttgggactcaggatatt

SEQ ID NO: 4125200 - DNA, 19 bp, Homo sapiens
agttggggaagccaggtga

SEQ ID NO: 4125201 - DNA, 17 bp, Homo sapiens
agttggggtctggcagc

SEQ ID NO: 4125202 - DNA, 18 bp, Homo sapiens
agttgtaaaaatgaaagt

SEQ ID NO: 4125203 - DNA, 16 bp, Homo sapiens
agttgtaacttatatt

SEQ ID NO: 4125204 - DNA, 16 bp, Homo sapiens
agttgtacaaatgtat

SEQ ID NO: 4125205 - DNA, 17 bp, Homo sapiens
agttgtacaaatgtatt

SEQ ID NO: 4125206 - DNA, 16 bp, Homo sapiens
agttgtagcagattgt

SEQ ID NO: 4125207 - DNA, 16 bp, Homo sapiens
agttgtcctatggaca

SEQ ID NO: 4125208 - DNA, 18 bp, Homo sapiens
agttgtcctatggacaac

SEQ ID NO: 4125209 - DNA, 21 bp, Homo sapiens
agttgtcctatggacaactta

SEQ ID NO: 4125210 - DNA, 13 bp, Homo sapiens
agttgtctaaaca

SEQ ID NO: 4125211 - DNA, 22 bp, Homo sapiens
agttgtgagtttaccttgtata

SEQ ID NO: 4125212 - DNA, 18 bp, Homo sapiens
agttgtgttagcctcttg

SEQ ID NO: 4125213 - DNA, 18 bp, Homo sapiens
agttgttattgttgaaca

SEQ ID NO: 4125214 - DNA, 18 bp, Homo sapiens
agttgttctttttagaaa

SEQ ID NO: 4125215 - DNA, 18 bp, Homo sapiens
agttgtttgtttttgctt

SEQ ID NO: 4125216 - DNA, 12 bp, Homo sapiens
agtttaaaaaaa

SEQ ID NO: 4125217 - DNA, 18 bp, Homo sapiens
agtttaaaacagaagcct

SEQ ID NO: 4125218 - DNA, 16 bp, Homo sapiens
agtttaaaacagtatt

SEQ ID NO: 4125219 - DNA, 18 bp, Homo sapiens
agtttaaaacagtattta

SEQ ID NO: 4125220 - DNA, 12 bp, Homo sapiens
agtttaaagcaa

SEQ ID NO: 4125221 - DNA, 13 bp, Homo sapiens
agtttaaagttgc

SEQ ID NO: 4125222 - DNA, 18 bp, Homo sapiens
agtttaaagttgcacatg

SEQ ID NO: 4125223 - DNA, 19 bp, Homo sapiens
agtttaaatgtattttaca

SEQ ID NO: 4125224 - DNA, 15 bp, Homo sapiens
agtttacaacttgat

SEQ ID NO: 4125225 - DNA, 20 bp, Homo sapiens
agtttacaatattatgaaat

SEQ ID NO: 4125226 - DNA, 14 bp, Homo sapiens
agtttacattttta

SEQ ID NO: 4125227 - DNA, 19 bp, Homo sapiens
agtttacatttttatttat

SEQ ID NO: 4125228 - DNA, 13 bp, Homo sapiens
agtttaccatttg

SEQ ID NO: 4125229 - DNA, 21 bp, Homo sapiens
agtttaccatttgtaataaag

SEQ ID NO: 4125230 - DNA, 22 bp, Homo sapiens
agtttaccatttgtaataaagt

SEQ ID NO: 4125231 - DNA, 21 bp, Homo sapiens
agtttacccatgaagattggt

SEQ ID NO: 4125232 - DNA, 14 bp, Homo sapiens
agtttagaggaaaa

SEQ ID NO: 4125233 - DNA, 17 bp, Homo sapiens
agtttattcagtaaaca

SEQ ID NO: 4125234 - DNA, 21 bp, Homo sapiens
agtttattccagagctgccag

SEQ ID NO: 4125235 - DNA, 16 bp, Homo sapiens
agtttattctcatttg

SEQ ID NO: 4125236 - DNA, 17 bp, Homo sapiens
agtttcacaggtcaata

SEQ ID NO: 4125237 - DNA, 15 bp, Homo sapiens
agtttcagcttaaaa

SEQ ID NO: 4125238 - DNA, 20 bp, Homo sapiens
agtttcaggtgacatgtgaa

SEQ ID NO: 4125239 - DNA, 21 bp, Homo sapiens
agtttcaggtgacatgtgaaa

SEQ ID NO: 4125240 - DNA, 20 bp, Homo sapiens
agtttcagtagattgcagaa

SEQ ID NO: 4125241 - DNA, 16 bp, Homo sapiens
agtttcatgtgagttt

SEQ ID NO: 4125242 - DNA, 14 bp, Homo sapiens
agtttcccctctgg

SEQ ID NO: 4125243 - DNA, 16 bp, Homo sapiens
agtttcccctctggct

SEQ ID NO: 4125244 - DNA, 12 bp, Homo sapiens
agtttcctggaa

SEQ ID NO: 4125245 - DNA, 12 bp, Homo sapiens
agtttccttttt

SEQ ID NO: 4125246 - DNA, 18 bp, Homo sapiens
agtttcctttttaatatg

SEQ ID NO: 4125247 - DNA, 20 bp, Homo sapiens
agtttcgtttctgtttttta

SEQ ID NO: 4125248 - DNA, 13 bp, Homo sapiens
agtttctattctg

SEQ ID NO: 4125249 - DNA, 21 bp, Homo sapiens
agtttgaaggaggtgagggat

SEQ ID NO: 4125250 - DNA, 14 bp, Homo sapiens
agtttgagctgcct

SEQ ID NO: 4125251 - DNA, 21 bp, Homo sapiens
agtttgcaaataggcagaatg

SEQ ID NO: 4125252 - DNA, 23 bp, Homo sapiens
agtttgcaaataggcagaatgga

SEQ ID NO: 4125253 - DNA, 20 bp, Homo sapiens
agtttgccccgttctgtttg

SEQ ID NO: 4125254 - DNA, 22 bp, Homo sapiens
agtttgccggatacaaactggt

SEQ ID NO: 4125255 - DNA, 22 bp, Homo sapiens
agtttggccgggtgcggtggct

SEQ ID NO: 4125256 - DNA, 13 bp, Homo sapiens
agtttgggtaaaa

SEQ ID NO: 4125257 - DNA, 20 bp, Homo sapiens
agtttggttcacttacagat

SEQ ID NO: 4125258 - DNA, 14 bp, Homo sapiens
agtttgtcagactt

SEQ ID NO: 4125259 - DNA, 19 bp, Homo sapiens
agtttgtctattttaaaat

SEQ ID NO: 4125260 - DNA, 16 bp, Homo sapiens
agtttgtgtgtcttaa

SEQ ID NO: 4125261 - DNA, 16 bp, Homo sapiens
agtttgttctgttctg

SEQ ID NO: 4125262 - DNA, 20 bp, Homo sapiens
agtttgttctgttctggggg

SEQ ID NO: 4125263 - DNA, 13 bp, Homo sapiens
agttttaaattat

SEQ ID NO: 4125264 - DNA, 22 bp, Homo sapiens
agttttaaattatgtataaaca

SEQ ID NO: 4125265 - DNA, 18 bp, Homo sapiens
agttttaactagaattta

SEQ ID NO: 4125266 - DNA, 13 bp, Homo sapiens
agttttacagatt

SEQ ID NO: 4125267 - DNA, 14 bp, Homo sapiens
agttttagttttct

SEQ ID NO: 4125268 - DNA, 14 bp, Homo sapiens
agttttatcatttt

SEQ ID NO: 4125269 - DNA, 15 bp, Homo sapiens
agttttatcattttc

SEQ ID NO: 4125270 - DNA, 20 bp, Homo sapiens
agttttatcattttcaaaat

SEQ ID NO: 4125271 - DNA, 16 bp, Homo sapiens
agttttattgagaatt

SEQ ID NO: 4125272 - DNA, 21 bp, Homo sapiens
agttttattgagaattttaaa

SEQ ID NO: 4125273 - DNA, 22 bp, Homo sapiens
agttttcaagtcaaattaataa

SEQ ID NO: 4125274 - DNA, 20 bp, Homo sapiens
agttttcagaacctcttccc

SEQ ID NO: 4125275 - DNA, 22 bp, Homo sapiens
agttttcagaacctcttcccca

SEQ ID NO: 4125276 - DNA, 17 bp, Homo sapiens
agttttctccttttact

SEQ ID NO: 4125277 - DNA, 12 bp, Homo sapiens
agttttctctta

SEQ ID NO: 4125278 - DNA, 15 bp, Homo sapiens
agttttcttccatga

SEQ ID NO: 4125279 - DNA, 17 bp, Homo sapiens
agttttgaaaagctatt

SEQ ID NO: 4125280 - DNA, 13 bp, Homo sapiens
agttttgaatgtt

SEQ ID NO: 4125281 - DNA, 12 bp, Homo sapiens
agttttgtttat

SEQ ID NO: 4125282 - DNA, 17 bp, Homo sapiens
agtttttacctaccaca

SEQ ID NO: 4125283 - DNA, 22 bp, Homo sapiens
agtttttacctaccacagtgtc

SEQ ID NO: 4125284 - DNA, 22 bp, Homo sapiens
agtttttctgttttgtttggca

SEQ ID NO: 4125285 - DNA, 21 bp, Homo sapiens
agttttttacttttgtttatt

SEQ ID NO: 4125286 - DNA, 23 bp, Homo sapiens
agttttttgaaattatgtgacat

SEQ ID NO: 4125287 - DNA, 20 bp, Homo sapiens
ataaaaacttgaaaatatat

SEQ ID NO: 4125288 - DNA, 22 bp, Homo sapiens
ataaaaagcctgcaatttcata

SEQ ID NO: 4125289 - DNA, 21 bp, Homo sapiens
ataaaaagcttccatgattct

SEQ ID NO: 4125290 - DNA, 14 bp, Homo sapiens
ataaaaaggacatc

SEQ ID NO: 4125291 - DNA, 18 bp, Homo sapiens
ataaaaatggcaaatgca

SEQ ID NO: 4125292 - DNA, 13 bp, Homo sapiens
ataaaacattaat

SEQ ID NO: 4125293 - DNA, 18 bp, Homo sapiens
ataaaagcataaatgcaa

SEQ ID NO: 4125294 - DNA, 12 bp, Homo sapiens
ataaaagccttg

SEQ ID NO: 4125295 - DNA, 15 bp, Homo sapiens
ataaaaggaagccaa

SEQ ID NO: 4125296 - DNA, 20 bp, Homo sapiens
ataaaaggaagccaaagagt

SEQ ID NO: 4125297 - DNA, 18 bp, Homo sapiens
ataaaagggcaaatctgc

SEQ ID NO: 4125298 - DNA, 16 bp, Homo sapiens
ataaaagttttctcca

SEQ ID NO: 4125299 - DNA, 15 bp, Homo sapiens
ataaaataattctaa

SEQ ID NO: 4125300 - DNA, 15 bp, Homo sapiens
ataaaatgactactt

SEQ ID NO: 4125301 - DNA, 11 bp, Homo sapiens
ataaaatgtgc

SEQ ID NO: 4125302 - DNA, 16 bp, Homo sapiens
ataaaattttgctttt

SEQ ID NO: 4125303 - DNA, 16 bp, Homo sapiens
ataaacacattgaatg

SEQ ID NO: 4125304 - DNA, 22 bp, Homo sapiens
ataaacacattgaatgcgcttt

SEQ ID NO: 4125305 - DNA, 14 bp, Homo sapiens
ataaacagacaata

SEQ ID NO: 4125306 - DNA, 16 bp, Homo sapiens
ataaacatcagtttct

SEQ ID NO: 4125307 - DNA, 21 bp, Homo sapiens
ataaacatccttcaagaactc

SEQ ID NO: 4125308 - DNA, 23 bp, Homo sapiens
ataaacattaagattgaggcctg

SEQ ID NO: 4125309 - DNA, 21 bp, Homo sapiens
ataaacccagttgccatctgc

SEQ ID NO: 4125310 - DNA, 20 bp, Homo sapiens
ataaaccgtggtctcatgta

SEQ ID NO: 4125311 - DNA, 16 bp, Homo sapiens
ataaacctggagatat

SEQ ID NO: 4125312 - DNA, 16 bp, Homo sapiens
ataaactagagaaggg

SEQ ID NO: 4125313 - DNA, 17 bp, Homo sapiens
ataaactcattttgctt

SEQ ID NO: 4125314 - DNA, 12 bp, Homo sapiens
ataaactgaaaa

SEQ ID NO: 4125315 - DNA, 20 bp, Homo sapiens
ataaactgactttatcctca

SEQ ID NO: 4125316 - DNA, 13 bp, Homo sapiens
ataaactgagcct

SEQ ID NO: 4125317 - DNA, 20 bp, Homo sapiens
ataaacttagaggaaaatga

SEQ ID NO: 4125318 - DNA, 23 bp, Homo sapiens
ataaacttagtgcggacaagttt

SEQ ID NO: 4125319 - DNA, 16 bp, Homo sapiens
ataaagaaatatttac

SEQ ID NO: 4125320 - DNA, 12 bp, Homo sapiens
ataaagacacct

SEQ ID NO: 4125321 - DNA, 13 bp, Homo sapiens
ataaagcaatctg

SEQ ID NO: 4125322 - DNA, 21 bp, Homo sapiens
ataaagcataagtatacagtt

SEQ ID NO: 4125323 - DNA, 18 bp, Homo sapiens
ataaagcatttataaatt

SEQ ID NO: 4125324 - DNA, 21 bp, Homo sapiens
ataaagcgatatacagatgaa

SEQ ID NO: 4125325 - DNA, 22 bp, Homo sapiens
ataaagcgatatacagatgaaa

SEQ ID NO: 4125326 - DNA, 21 bp, Homo sapiens
ataaaggatgtgattgtggaa

SEQ ID NO: 4125327 - DNA, 17 bp, Homo sapiens
ataaagggttgaaaatg

SEQ ID NO: 4125328 - DNA, 16 bp, Homo sapiens
ataaaggttgacaata

SEQ ID NO: 4125329 - DNA, 17 bp, Homo sapiens
ataaagtaaagctaaaa

SEQ ID NO: 4125330 - DNA, 13 bp, Homo sapiens
ataaagtacttga

SEQ ID NO: 4125331 - DNA, 13 bp, Homo sapiens
ataaataaaactg

SEQ ID NO: 4125332 - DNA, 15 bp, Homo sapiens
ataaataaaactgaa

SEQ ID NO: 4125333 - DNA, 19 bp, Homo sapiens
ataaataaaattcatttct

SEQ ID NO: 4125334 - DNA, 15 bp, Homo sapiens
ataaataatctgtac

SEQ ID NO: 4125335 - DNA, 12 bp, Homo sapiens
ataaataatttt

SEQ ID NO: 4125336 - DNA, 13 bp, Homo sapiens
ataaataatttta

SEQ ID NO: 4125337 - DNA, 15 bp, Homo sapiens
ataaataattttaat

SEQ ID NO: 4125338 - DNA, 16 bp, Homo sapiens
ataaatacaaatctgt

SEQ ID NO: 4125339 - DNA, 17 bp, Homo sapiens
ataaatacaaatctgta

SEQ ID NO: 4125340 - DNA, 20 bp, Homo sapiens
ataaatagccttcaaaaaga

SEQ ID NO: 4125341 - DNA, 16 bp, Homo sapiens
ataaatataagccttt

SEQ ID NO: 4125342 - DNA, 14 bp, Homo sapiens
ataaatatttatgt

SEQ ID NO: 4125343 - DNA, 18 bp, Homo sapiens
ataaatatttttgccata

SEQ ID NO: 4125344 - DNA, 14 bp, Homo sapiens
ataaatcacacatt

SEQ ID NO: 4125345 - DNA, 20 bp, Homo sapiens
ataaatcatattgatgaaaa

SEQ ID NO: 4125346 - DNA, 14 bp, Homo sapiens
ataaatcatttcag

SEQ ID NO: 4125347 - DNA, 16 bp, Homo sapiens
ataaatcatttcagta

SEQ ID NO: 4125348 - DNA, 18 bp, Homo sapiens
ataaatccagttctacta

SEQ ID NO: 4125349 - DNA, 14 bp, Homo sapiens
ataaatctcttctt

SEQ ID NO: 4125350 - DNA, 11 bp, Homo sapiens
ataaatgaagc

SEQ ID NO: 4125351 - DNA, 18 bp, Homo sapiens
ataaatgaagcagcttta

SEQ ID NO: 4125352 - DNA, 18 bp, Homo sapiens
ataaatgattcttagtga

SEQ ID NO: 4125353 - DNA, 19 bp, Homo sapiens
ataaatgctattttttatt

SEQ ID NO: 4125354 - DNA, 16 bp, Homo sapiens
ataaatggctggtttt

SEQ ID NO: 4125355 - DNA, 21 bp, Homo sapiens
ataaatgggtgtatataattt

SEQ ID NO: 4125356 - DNA, 13 bp, Homo sapiens
ataaatggtttct

SEQ ID NO: 4125357 - DNA, 15 bp, Homo sapiens
ataaatgtacattaa

SEQ ID NO: 4125358 - DNA, 23 bp, Homo sapiens
ataaatgttagttctagctctat

SEQ ID NO: 4125359 - DNA, 13 bp, Homo sapiens
ataaattcagata

SEQ ID NO: 4125360 - DNA, 16 bp, Homo sapiens
ataaattcagatatat

SEQ ID NO: 4125361 - DNA, 18 bp, Homo sapiens
ataaattcctaaactccc

SEQ ID NO: 4125362 - DNA, 13 bp, Homo sapiens
ataaattctgatt

SEQ ID NO: 4125363 - DNA, 18 bp, Homo sapiens
ataaattgtagggcttta

SEQ ID NO: 4125364 - DNA, 12 bp, Homo sapiens
ataaatttaatc

SEQ ID NO: 4125365 - DNA, 20 bp, Homo sapiens
ataaatttggttctaataga

SEQ ID NO: 4125366 - DNA, 13 bp, Homo sapiens
ataacaaaatgga

SEQ ID NO: 4125367 - DNA, 14 bp, Homo sapiens
ataacaaaatggac

SEQ ID NO: 4125368 - DNA, 14 bp, Homo sapiens
ataacaatgttaag

SEQ ID NO: 4125369 - DNA, 16 bp, Homo sapiens
ataacaatgttaagga

SEQ ID NO: 4125370 - DNA, 18 bp, Homo sapiens
ataacaatgttaaggaaa

SEQ ID NO: 4125371 - DNA, 13 bp, Homo sapiens
ataacacagagag

SEQ ID NO: 4125372 - DNA, 22 bp, Homo sapiens
ataacacagagagacagacttg

SEQ ID NO: 4125373 - DNA, 22 bp, Homo sapiens
ataacacttaaaattgtaacct

SEQ ID NO: 4125374 - DNA, 23 bp, Homo sapiens
ataacagaaagcctgggtgacat

SEQ ID NO: 4125375 - DNA, 18 bp, Homo sapiens
ataacaggcatttgttca

SEQ ID NO: 4125376 - DNA, 12 bp, Homo sapiens
ataacatgtaat

SEQ ID NO: 4125377 - DNA, 14 bp, Homo sapiens
ataacattacctta

SEQ ID NO: 4125378 - DNA, 15 bp, Homo sapiens
ataacattcagttcc

SEQ ID NO: 4125379 - DNA, 14 bp, Homo sapiens
ataaccaacaatat

SEQ ID NO: 4125380 - DNA, 14 bp, Homo sapiens
ataaccagacacaa

SEQ ID NO: 4125381 - DNA, 16 bp, Homo sapiens
ataaccagacacaaac

SEQ ID NO: 4125382 - DNA, 13 bp, Homo sapiens
ataaccccacctt

SEQ ID NO: 4125383 - DNA, 13 bp, Homo sapiens
ataacgtttttcc

SEQ ID NO: 4125384 - DNA, 15 bp, Homo sapiens
ataacgtttttcctt

SEQ ID NO: 4125385 - DNA, 18 bp, Homo sapiens
ataactcatcataaaata

SEQ ID NO: 4125386 - DNA, 19 bp, Homo sapiens
ataactcctgtcccttttc

SEQ ID NO: 4125387 - DNA, 19 bp, Homo sapiens
ataactctgtaaaaacact

SEQ ID NO: 4125388 - DNA, 21 bp, Homo sapiens
ataactctgtaaaaacactga

SEQ ID NO: 4125389 - DNA, 13 bp, Homo sapiens
ataactgtgaagt

SEQ ID NO: 4125390 - DNA, 16 bp, Homo sapiens
ataactgtgtactgtt

SEQ ID NO: 4125391 - DNA, 12 bp, Homo sapiens
ataacttaaaaa

SEQ ID NO: 4125392 - DNA, 12 bp, Homo sapiens
ataacttcctgt

SEQ ID NO: 4125393 - DNA, 13 bp, Homo sapiens
ataacttctatat

SEQ ID NO: 4125394 - DNA, 18 bp, Homo sapiens
ataacttggggaggcaag

SEQ ID NO: 4125395 - DNA, 18 bp, Homo sapiens
ataagaaatgaacaaaag

SEQ ID NO: 4125396 - DNA, 19 bp, Homo sapiens
ataagaatgctggttttcc

SEQ ID NO: 4125397 - DNA, 14 bp, Homo sapiens
ataagacataacgt

SEQ ID NO: 4125398 - DNA, 17 bp, Homo sapiens
ataagacataacgtttt

SEQ ID NO: 4125399 - DNA, 23 bp, Homo sapiens
ataagacataacgtttttccttt

SEQ ID NO: 4125400 - DNA, 14 bp, Homo sapiens
ataagacatttgtt

SEQ ID NO: 4125401 - DNA, 19 bp, Homo sapiens
ataagactgtttttaagta

SEQ ID NO: 4125402 - DNA, 23 bp, Homo sapiens
ataagactgtttttaagtaactt

SEQ ID NO: 4125403 - DNA, 12 bp, Homo sapiens
ataagagatttg

SEQ ID NO: 4125404 - DNA, 17 bp, Homo sapiens
ataagataaatgtgctg

SEQ ID NO: 4125405 - DNA, 21 bp, Homo sapiens
ataagattcatatttacttct

SEQ ID NO: 4125406 - DNA, 12 bp, Homo sapiens
ataagcatgctt

SEQ ID NO: 4125407 - DNA, 14 bp, Homo sapiens
ataagcatgctttc

SEQ ID NO: 4125408 - DNA, 14 bp, Homo sapiens
ataaggaagagggc

SEQ ID NO: 4125409 - DNA, 17 bp, Homo sapiens
ataaggaagagggctga

SEQ ID NO: 4125410 - DNA, 15 bp, Homo sapiens
ataaggacttcctga

SEQ ID NO: 4125411 - DNA, 22 bp, Homo sapiens
ataaggatcagaacagcagagg

SEQ ID NO: 4125412 - DNA, 16 bp, Homo sapiens
ataaggccttaatatg

SEQ ID NO: 4125413 - DNA, 19 bp, Homo sapiens
ataagggagagctgagcca

SEQ ID NO: 4125414 - DNA, 15 bp, Homo sapiens
ataagtatacagttc

SEQ ID NO: 4125415 - DNA, 16 bp, Homo sapiens
ataagtcattgtatgt

SEQ ID NO: 4125416 - DNA, 19 bp, Homo sapiens
ataagtggaggcactttag

SEQ ID NO: 4125417 - DNA, 20 bp, Homo sapiens
ataagtggaggcactttagg

SEQ ID NO: 4125418 - DNA, 16 bp, Homo sapiens
ataagtggttttcttc

SEQ ID NO: 4125419 - DNA, 18 bp, Homo sapiens
ataagtggttttcttcag

SEQ ID NO: 4125420 - DNA, 19 bp, Homo sapiens
ataagtgtacatatgtgct

SEQ ID NO: 4125421 - DNA, 20 bp, Homo sapiens
ataagtgtacatatgtgctg

SEQ ID NO: 4125422 - DNA, 14 bp, Homo sapiens
ataagtgtattttt

SEQ ID NO: 4125423 - DNA, 16 bp, Homo sapiens
ataagtgtatttttca

SEQ ID NO: 4125424 - DNA, 17 bp, Homo sapiens
ataagttaacttccaat

SEQ ID NO: 4125425 - DNA, 12 bp, Homo sapiens
ataagttatttt

SEQ ID NO: 4125426 - DNA, 20 bp, Homo sapiens
ataagttatttttgtacatg

SEQ ID NO: 4125427 - DNA, 16 bp, Homo sapiens
ataagttcacaaaatg

SEQ ID NO: 4125428 - DNA, 16 bp, Homo sapiens
ataagtttctattctg

SEQ ID NO: 4125429 - DNA, 21 bp, Homo sapiens
ataagtttctattctgtcagt

SEQ ID NO: 4125430 - DNA, 21 bp, Homo sapiens
ataagtttctgggacctcagt

SEQ ID NO: 4125431 - DNA, 19 bp, Homo sapiens
ataataaaaaattatgaca

SEQ ID NO: 4125432 - DNA, 17 bp, Homo sapiens
ataataaagaaaacctt

SEQ ID NO: 4125433 - DNA, 16 bp, Homo sapiens
ataataaagctactga

SEQ ID NO: 4125434 - DNA, 18 bp, Homo sapiens
ataataaaggactgtaat

SEQ ID NO: 4125435 - DNA, 14 bp, Homo sapiens
ataataattagtaa

SEQ ID NO: 4125436 - DNA, 21 bp, Homo sapiens
ataataggtagtttggatatt

SEQ ID NO: 4125437 - DNA, 16 bp, Homo sapiens
ataatagtcaatttct

SEQ ID NO: 4125438 - DNA, 24 bp, Homo sapiens
ataatatctgtgaggtgctgatga

SEQ ID NO: 4125439 - DNA, 18 bp, Homo sapiens
ataatatctttgtgataa

SEQ ID NO: 4125440 - DNA, 21 bp, Homo sapiens
ataatatgctgccaaattttg

SEQ ID NO: 4125441 - DNA, 23 bp, Homo sapiens
ataatatggaaccttccctccaa

SEQ ID NO: 4125442 - DNA, 13 bp, Homo sapiens
ataatattactgt

SEQ ID NO: 4125443 - DNA, 14 bp, Homo sapiens
ataatattactgtt

SEQ ID NO: 4125444 - DNA, 14 bp, Homo sapiens
ataatattgttgta

SEQ ID NO: 4125445 - DNA, 22 bp, Homo sapiens
ataatattgttgtataatttcg

SEQ ID NO: 4125446 - DNA, 13 bp, Homo sapiens
ataatcaagattt

SEQ ID NO: 4125447 - DNA, 14 bp, Homo sapiens
ataatcaagatttt

SEQ ID NO: 4125448 - DNA, 22 bp, Homo sapiens
ataatcactctaattaattgta

SEQ ID NO: 4125449 - DNA, 21 bp, Homo sapiens
ataatcagcaagaatttgatc

SEQ ID NO: 4125450 - DNA, 23 bp, Homo sapiens
ataatcagtgactgaaaccattt

SEQ ID NO: 4125451 - DNA, 19 bp, Homo sapiens
ataatcatgtgaaatgttt

SEQ ID NO: 4125452 - DNA, 19 bp, Homo sapiens
ataatcattagttttagag

SEQ ID NO: 4125453 - DNA, 17 bp, Homo sapiens
ataatccagtaaaataa

SEQ ID NO: 4125454 - DNA, 17 bp, Homo sapiens
ataatctccatttcaaa

SEQ ID NO: 4125455 - DNA, 13 bp, Homo sapiens
ataatctttgggt

SEQ ID NO: 4125456 - DNA, 15 bp, Homo sapiens
ataatgaatgaaaca

SEQ ID NO: 4125457 - DNA, 23 bp, Homo sapiens
ataatgactgccctgtttctgtt

SEQ ID NO: 4125458 - DNA, 16 bp, Homo sapiens
ataatgatttgctctt

SEQ ID NO: 4125459 - DNA, 15 bp, Homo sapiens
ataatgcttaatttc

SEQ ID NO: 4125460 - DNA, 17 bp, Homo sapiens
ataatgcttaatttcta

SEQ ID NO: 4125461 - DNA, 15 bp, Homo sapiens
ataatgcttcagata

SEQ ID NO: 4125462 - DNA, 15 bp, Homo sapiens
ataatgtaagctcta

SEQ ID NO: 4125463 - DNA, 22 bp, Homo sapiens
ataatgtataaagaacaaggta

SEQ ID NO: 4125464 - DNA, 10 bp, Homo sapiens
ataatgttaa

SEQ ID NO: 4125465 - DNA, 19 bp, Homo sapiens
ataatgttaaatttgtaag

SEQ ID NO: 4125466 - DNA, 13 bp, Homo sapiens
ataatgtttgcta

SEQ ID NO: 4125467 - DNA, 13 bp, Homo sapiens
ataattaaagact

SEQ ID NO: 4125468 - DNA, 18 bp, Homo sapiens
ataattcaattttaaaga

SEQ ID NO: 4125469 - DNA, 22 bp, Homo sapiens
ataattcactcaagcactgata

SEQ ID NO: 4125470 - DNA, 19 bp, Homo sapiens
ataattccctatcttttag

SEQ ID NO: 4125471 - DNA, 13 bp, Homo sapiens
ataattcctacag

SEQ ID NO: 4125472 - DNA, 19 bp, Homo sapiens
ataattcctacagcactac

SEQ ID NO: 4125473 - DNA, 22 bp, Homo sapiens
ataattcctatatcctgtgact

SEQ ID NO: 4125474 - DNA, 14 bp, Homo sapiens
ataattcttaaaag

SEQ ID NO: 4125475 - DNA, 15 bp, Homo sapiens
ataattgatcaaatt

SEQ ID NO: 4125476 - DNA, 19 bp, Homo sapiens
ataattgcatctaggtaat

SEQ ID NO: 4125477 - DNA, 16 bp, Homo sapiens
ataattgctatttatt

SEQ ID NO: 4125478 - DNA, 21 bp, Homo sapiens
ataattgttgaaattttgcaa

SEQ ID NO: 4125479 - DNA, 12 bp, Homo sapiens
ataatttaagag

SEQ ID NO: 4125480 - DNA, 13 bp, Homo sapiens
ataatttatttca

SEQ ID NO: 4125481 - DNA, 14 bp, Homo sapiens
ataatttatttcaa

SEQ ID NO: 4125482 - DNA, 18 bp, Homo sapiens
ataatttcccaattagga

SEQ ID NO: 4125483 - DNA, 22 bp, Homo sapiens
ataatttcccaattaggaagtg

SEQ ID NO: 4125484 - DNA, 17 bp, Homo sapiens
ataattttcttcatgca

SEQ ID NO: 4125485 - DNA, 22 bp, Homo sapiens
ataattttcttcatgcaatgac

SEQ ID NO: 4125486 - DNA, 12 bp, Homo sapiens
ataattttgcaa

SEQ ID NO: 4125487 - DNA, 15 bp, Homo sapiens
ataatttttaaagta

SEQ ID NO: 4125488 - DNA, 19 bp, Homo sapiens
ataatttttaaagtatata

SEQ ID NO: 4125489 - DNA, 19 bp, Homo sapiens
ataatttttatatttaatt

SEQ ID NO: 4125490 - DNA, 13 bp, Homo sapiens
ataattttttgta

SEQ ID NO: 4125491 - DNA, 22 bp, Homo sapiens
ataattttttgtaatgtgtgaa

SEQ ID NO: 4125492 - DNA, 20 bp, Homo sapiens
ataatttttttcaatattta

SEQ ID NO: 4125493 - DNA, 21 bp, Homo sapiens
ataatttttttcaatatttat

SEQ ID NO: 4125494 - DNA, 12 bp, Homo sapiens
atacaaagtaaa

SEQ ID NO: 4125495 - DNA, 15 bp, Homo sapiens
atacaaagtaaatac

SEQ ID NO: 4125496 - DNA, 13 bp, Homo sapiens
atacaaatggatt

SEQ ID NO: 4125497 - DNA, 14 bp, Homo sapiens
atacaaatggattt

SEQ ID NO: 4125498 - DNA, 20 bp, Homo sapiens
atacaaatggattttgggag

SEQ ID NO: 4125499 - DNA, 14 bp, Homo sapiens
atacaaattagaaa

SEQ ID NO: 4125500 - DNA, 18 bp, Homo sapiens
atacaaattagaaaatgt

SEQ ID NO: 4125501 - DNA, 12 bp, Homo sapiens
atacaagccaaa

SEQ ID NO: 4125502 - DNA, 20 bp, Homo sapiens
atacaaggtgagtgtgactt

SEQ ID NO: 4125503 - DNA, 18 bp, Homo sapiens
atacaagtttcagacagg

SEQ ID NO: 4125504 - DNA, 23 bp, Homo sapiens
atacaatcctgtttataatctga

SEQ ID NO: 4125505 - DNA, 13 bp, Homo sapiens
atacaattaaagg

SEQ ID NO: 4125506 - DNA, 15 bp, Homo sapiens
atacaattaaaggtc

SEQ ID NO: 4125507 - DNA, 16 bp, Homo sapiens
atacaattaaaggtcc

SEQ ID NO: 4125508 - DNA, 15 bp, Homo sapiens
atacacaagtaaaca

SEQ ID NO: 4125509 - DNA, 19 bp, Homo sapiens
atacacgttaactgcagag

SEQ ID NO: 4125510 - DNA, 22 bp, Homo sapiens
atacactatttgtgagcaaagg

SEQ ID NO: 4125511 - DNA, 13 bp, Homo sapiens
atacacttacact

SEQ ID NO: 4125512 - DNA, 17 bp, Homo sapiens
atacactttgttgcaag

SEQ ID NO: 4125513 - DNA, 12 bp, Homo sapiens
atacagacacta

SEQ ID NO: 4125514 - DNA, 14 bp, Homo sapiens
atacagacactaag

SEQ ID NO: 4125515 - DNA, 15 bp, Homo sapiens
atacagacactaagt

SEQ ID NO: 4125516 - DNA, 15 bp, Homo sapiens
atacagatgaaaatt

SEQ ID NO: 4125517 - DNA, 20 bp, Homo sapiens
atacagatgaaaatttgaga

SEQ ID NO: 4125518 - DNA, 11 bp, Homo sapiens
atacagctcta

SEQ ID NO: 4125519 - DNA, 12 bp, Homo sapiens
atacagctgtat

SEQ ID NO: 4125520 - DNA, 18 bp, Homo sapiens
atacaggacttttaaatg

SEQ ID NO: 4125521 - DNA, 19 bp, Homo sapiens
atacaggacttttaaatgg

SEQ ID NO: 4125522 - DNA, 21 bp, Homo sapiens
atacaggatttgaactcagat

SEQ ID NO: 4125523 - DNA, 12 bp, Homo sapiens
atacaggtgctc

SEQ ID NO: 4125524 - DNA, 12 bp, Homo sapiens
atacagtacaca

SEQ ID NO: 4125525 - DNA, 13 bp, Homo sapiens
atacagtgcagag

SEQ ID NO: 4125526 - DNA, 12 bp, Homo sapiens
atacagtgcctt

SEQ ID NO: 4125527 - DNA, 15 bp, Homo sapiens
atacagtgttatttt

SEQ ID NO: 4125528 - DNA, 22 bp, Homo sapiens
atacagttaggcaccagaagaa

SEQ ID NO: 4125529 - DNA, 16 bp, Homo sapiens
atacagttttcagaaa

SEQ ID NO: 4125530 - DNA, 16 bp, Homo sapiens
atacatatctttatta

SEQ ID NO: 4125531 - DNA, 13 bp, Homo sapiens
atacatcactgct

SEQ ID NO: 4125532 - DNA, 15 bp, Homo sapiens
atacatcactgcttg

SEQ ID NO: 4125533 - DNA, 13 bp, Homo sapiens
atacattaaaact

SEQ ID NO: 4125534 - DNA, 14 bp, Homo sapiens
atacattaaaacta

SEQ ID NO: 4125535 - DNA, 18 bp, Homo sapiens
atacattagtaaatgtct

SEQ ID NO: 4125536 - DNA, 22 bp, Homo sapiens
atacattagtaaatgtctttgt

SEQ ID NO: 4125537 - DNA, 20 bp, Homo sapiens
atacatttataatgtttgct

SEQ ID NO: 4125538 - DNA, 16 bp, Homo sapiens
atacatttgataaagt

SEQ ID NO: 4125539 - DNA, 17 bp, Homo sapiens
ataccaagtatttatta

SEQ ID NO: 4125540 - DNA, 18 bp, Homo sapiens
ataccagcttagatttta

SEQ ID NO: 4125541 - DNA, 17 bp, Homo sapiens
ataccagttcagacact

SEQ ID NO: 4125542 - DNA, 22 bp, Homo sapiens
ataccattcagatcactgaatt

SEQ ID NO: 4125543 - DNA, 12 bp, Homo sapiens
ataccccactgg

SEQ ID NO: 4125544 - DNA, 16 bp, Homo sapiens
atacctgcacgttcat

SEQ ID NO: 4125545 - DNA, 22 bp, Homo sapiens
atacctgcacgttcataaccaa

SEQ ID NO: 4125546 - DNA, 19 bp, Homo sapiens
atacctggcttttacttta

SEQ ID NO: 4125547 - DNA, 22 bp, Homo sapiens
atacctggcttttactttatta

SEQ ID NO: 4125548 - DNA, 23 bp, Homo sapiens
atacgcaacataattaaattttg

SEQ ID NO: 4125549 - DNA, 21 bp, Homo sapiens
atacgctggcaacacagaggc

SEQ ID NO: 4125550 - DNA, 21 bp, Homo sapiens
atacgtagttgtgcttttgtt

SEQ ID NO: 4125551 - DNA, 22 bp, Homo sapiens
atactaaaagcaaatctacaga

SEQ ID NO: 4125552 - DNA, 15 bp, Homo sapiens
atactaacttattta

SEQ ID NO: 4125553 - DNA, 15 bp, Homo sapiens
atactacatctttaa

SEQ ID NO: 4125554 - DNA, 16 bp, Homo sapiens
atactacatctttaaa

SEQ ID NO: 4125555 - DNA, 21 bp, Homo sapiens
atactactgaaacagatttca

SEQ ID NO: 4125556 - DNA, 21 bp, Homo sapiens
atactatttaaagcctcctca

SEQ ID NO: 4125557 - DNA, 20 bp, Homo sapiens
atactcaaatgagtaacatt

SEQ ID NO: 4125558 - DNA, 18 bp, Homo sapiens
atactccttgcttcctga

SEQ ID NO: 4125559 - DNA, 17 bp, Homo sapiens
atactctagatgaagtt

SEQ ID NO: 4125560 - DNA, 23 bp, Homo sapiens
atactctagatgaagttttacat

SEQ ID NO: 4125561 - DNA, 12 bp, Homo sapiens
atactctgtcag

SEQ ID NO: 4125562 - DNA, 19 bp, Homo sapiens
atactcttaggaagagaaa

SEQ ID NO: 4125563 - DNA, 22 bp, Homo sapiens
atactcttaggaagagaaacca

SEQ ID NO: 4125564 - DNA, 22 bp, Homo sapiens
atactcttcctatttttgtagt

SEQ ID NO: 4125565 - DNA, 15 bp, Homo sapiens
atactctttctgtat

SEQ ID NO: 4125566 - DNA, 12 bp, Homo sapiens
atactgaaggaa

SEQ ID NO: 4125567 - DNA, 13 bp, Homo sapiens
atactgaaggaaa

SEQ ID NO: 4125568 - DNA, 14 bp, Homo sapiens
atactgagggacca

SEQ ID NO: 4125569 - DNA, 16 bp, Homo sapiens
atactgattctgtgta

SEQ ID NO: 4125570 - DNA, 19 bp, Homo sapiens
atactgctacagcaatttc

SEQ ID NO: 4125571 - DNA, 18 bp, Homo sapiens
atactggaagttttgcat

SEQ ID NO: 4125572 - DNA, 19 bp, Homo sapiens
atactggaagttttgcatt

SEQ ID NO: 4125573 - DNA, 23 bp, Homo sapiens
atactggaataatttgtaaatga

SEQ ID NO: 4125574 - DNA, 20 bp, Homo sapiens
atactgtgaagttacatgca

SEQ ID NO: 4125575 - DNA, 13 bp, Homo sapiens
atactgtgcagaa

SEQ ID NO: 4125576 - DNA, 19 bp, Homo sapiens
atactgtgcagaataatgg

SEQ ID NO: 4125577 - DNA, 22 bp, Homo sapiens
atactgtgcagaataatggaaa

SEQ ID NO: 4125578 - DNA, 16 bp, Homo sapiens
atacttactataattt

SEQ ID NO: 4125579 - DNA, 15 bp, Homo sapiens
atacttatatttccc

SEQ ID NO: 4125580 - DNA, 17 bp, Homo sapiens
atacttatctctctgtg

SEQ ID NO: 4125581 - DNA, 18 bp, Homo sapiens
atacttatctctctgtgc

SEQ ID NO: 4125582 - DNA, 20 bp, Homo sapiens
atacttatctctctgtgctg

SEQ ID NO: 4125583 - DNA, 19 bp, Homo sapiens
atacttcaaaaataatgtg

SEQ ID NO: 4125584 - DNA, 17 bp, Homo sapiens
atacttgaagaaacaga

SEQ ID NO: 4125585 - DNA, 19 bp, Homo sapiens
atacttgaagggccagagc

SEQ ID NO: 4125586 - DNA, 17 bp, Homo sapiens
atacttgccttctgata

SEQ ID NO: 4125587 - DNA, 13 bp, Homo sapiens
atacttggattta

SEQ ID NO: 4125588 - DNA, 16 bp, Homo sapiens
atactttctatgtgac

SEQ ID NO: 4125589 - DNA, 22 bp, Homo sapiens
atactttgaaaggagatgtctt

SEQ ID NO: 4125590 - DNA, 16 bp, Homo sapiens
atacttttactctgcc

SEQ ID NO: 4125591 - DNA, 18 bp, Homo sapiens
atacttttcccctgttaa

SEQ ID NO: 4125592 - DNA, 20 bp, Homo sapiens
atactttttacaattaaaaa

SEQ ID NO: 4125593 - DNA, 21 bp, Homo sapiens
atacttttttttctttaaaaa

SEQ ID NO: 4125594 - DNA, 13 bp, Homo sapiens
atagaaaaggaac

SEQ ID NO: 4125595 - DNA, 14 bp, Homo sapiens
atagaaagaagcca

SEQ ID NO: 4125596 - DNA, 12 bp, Homo sapiens
atagaaagctat

SEQ ID NO: 4125597 - DNA, 22 bp, Homo sapiens
atagaaataaaggatgtgattg

SEQ ID NO: 4125598 - DNA, 13 bp, Homo sapiens
atagaaataaatt

SEQ ID NO: 4125599 - DNA, 18 bp, Homo sapiens
atagaaattttgtaagaa

SEQ ID NO: 4125600 - DNA, 23 bp, Homo sapiens
atagaaattttgtaagaaggcaa

SEQ ID NO: 4125601 - DNA, 13 bp, Homo sapiens
atagaagttttat

SEQ ID NO: 4125602 - DNA, 16 bp, Homo sapiens
atagaataaaagctgt

SEQ ID NO: 4125603 - DNA, 22 bp, Homo sapiens
atagaatatttattacctctga

SEQ ID NO: 4125604 - DNA, 13 bp, Homo sapiens
atagaatgctgca

SEQ ID NO: 4125605 - DNA, 20 bp, Homo sapiens
atagaatgtggccacttatt

SEQ ID NO: 4125606 - DNA, 17 bp, Homo sapiens
atagacaaatagaaaat

SEQ ID NO: 4125607 - DNA, 19 bp, Homo sapiens
atagacaaatagaaaatgg

SEQ ID NO: 4125608 - DNA, 17 bp, Homo sapiens
atagacaacgatgaatt

SEQ ID NO: 4125609 - DNA, 21 bp, Homo sapiens
atagacaattgaggtaagttt

SEQ ID NO: 4125610 - DNA, 20 bp, Homo sapiens
atagacaatttgcacatctt

SEQ ID NO: 4125611 - DNA, 22 bp, Homo sapiens
atagacactccccgaagtcttt

SEQ ID NO: 4125612 - DNA, 20 bp, Homo sapiens
atagacagtatatttatagt

SEQ ID NO: 4125613 - DNA, 14 bp, Homo sapiens
atagagaatttaag

SEQ ID NO: 4125614 - DNA, 14 bp, Homo sapiens
atagagattgtaca

SEQ ID NO: 4125615 - DNA, 16 bp, Homo sapiens
atagagattgtacatt

SEQ ID NO: 4125616 - DNA, 17 bp, Homo sapiens
atagagattgtacattt

SEQ ID NO: 4125617 - DNA, 22 bp, Homo sapiens
atagagcaaaattgatgtgttt

SEQ ID NO: 4125618 - DNA, 12 bp, Homo sapiens
atagagctttta

SEQ ID NO: 4125619 - DNA, 18 bp, Homo sapiens
atagagcttttaaaaatg

SEQ ID NO: 4125620 - DNA, 12 bp, Homo sapiens
atagaggctagc

SEQ ID NO: 4125621 - DNA, 23 bp, Homo sapiens
atagaggcttctccgccagcctc

SEQ ID NO: 4125622 - DNA, 15 bp, Homo sapiens
atagagtatatgcac

SEQ ID NO: 4125623 - DNA, 19 bp, Homo sapiens
atagagtgtacttaactat

SEQ ID NO: 4125624 - DNA, 16 bp, Homo sapiens
atagagttgattgtct

SEQ ID NO: 4125625 - DNA, 19 bp, Homo sapiens
atagagtttggtgtcaact

SEQ ID NO: 4125626 - DNA, 13 bp, Homo sapiens
atagatacaaatg

SEQ ID NO: 4125627 - DNA, 16 bp, Homo sapiens
atagatatcctctccc

SEQ ID NO: 4125628 - DNA, 17 bp, Homo sapiens
atagatattttcacaat

SEQ ID NO: 4125629 - DNA, 19 bp, Homo sapiens
atagatctccagcgtcagc

SEQ ID NO: 4125630 - DNA, 21 bp, Homo sapiens
atagatgcaagatatttatat

SEQ ID NO: 4125631 - DNA, 16 bp, Homo sapiens
atagatgctggcccag

SEQ ID NO: 4125632 - DNA, 22 bp, Homo sapiens
atagatgggtctggctgagctg

SEQ ID NO: 4125633 - DNA, 22 bp, Homo sapiens
atagatgttttggtagattaaa

SEQ ID NO: 4125634 - DNA, 19 bp, Homo sapiens
atagcaagacacatcccta

SEQ ID NO: 4125635 - DNA, 11 bp, Homo sapiens
atagcactttc

SEQ ID NO: 4125636 - DNA, 12 bp, Homo sapiens
atagcagaaaga

SEQ ID NO: 4125637 - DNA, 15 bp, Homo sapiens
atagcccctctcccc

SEQ ID NO: 4125638 - DNA, 19 bp, Homo sapiens
atagccctccccctcaacc

SEQ ID NO: 4125639 - DNA, 18 bp, Homo sapiens
atagcctggccaccagcc

SEQ ID NO: 4125640 - DNA, 22 bp, Homo sapiens
atagcctggccaccagccatcc

SEQ ID NO: 4125641 - DNA, 14 bp, Homo sapiens
atagctaagtacac

SEQ ID NO: 4125642 - DNA, 21 bp, Homo sapiens
atagctaatttatttccccag

SEQ ID NO: 4125643 - DNA, 15 bp, Homo sapiens
atagctacaggaagc

SEQ ID NO: 4125644 - DNA, 16 bp, Homo sapiens
atagctatatccatgt

SEQ ID NO: 4125645 - DNA, 19 bp, Homo sapiens
atagctatatccatgtact

SEQ ID NO: 4125646 - DNA, 20 bp, Homo sapiens
atagctatatccatgtactg

SEQ ID NO: 4125647 - DNA, 19 bp, Homo sapiens
atagctcactgcagcctca

SEQ ID NO: 4125648 - DNA, 20 bp, Homo sapiens
atagctccccgcttctgcct

SEQ ID NO: 4125649 - DNA, 23 bp, Homo sapiens
atagctccccgcttctgcctgca

SEQ ID NO: 4125650 - DNA, 18 bp, Homo sapiens
atagctgcatgtggcttt

SEQ ID NO: 4125651 - DNA, 16 bp, Homo sapiens
atagcttaactaattt

SEQ ID NO: 4125652 - DNA, 19 bp, Homo sapiens
atagctttattttttaagt

SEQ ID NO: 4125653 - DNA, 21 bp, Homo sapiens
atagctttattttttaagtat

SEQ ID NO: 4125654 - DNA, 19 bp, Homo sapiens
ataggaaaagtacatttaa

SEQ ID NO: 4125655 - DNA, 16 bp, Homo sapiens
ataggaagcgtctggc

SEQ ID NO: 4125656 - DNA, 24 bp, Homo sapiens
ataggagaggatgagagcccagag

SEQ ID NO: 4125657 - DNA, 13 bp, Homo sapiens
ataggagcctgct

SEQ ID NO: 4125658 - DNA, 15 bp, Homo sapiens
ataggagcctgctgg

SEQ ID NO: 4125659 - DNA, 20 bp, Homo sapiens
ataggcccaaggtcccctcc

SEQ ID NO: 4125660 - DNA, 14 bp, Homo sapiens
ataggcccctgggg

SEQ ID NO: 4125661 - DNA, 16 bp, Homo sapiens
ataggcccctggggct

SEQ ID NO: 4125662 - DNA, 23 bp, Homo sapiens
ataggcctgtcccttgcctctgc

SEQ ID NO: 4125663 - DNA, 13 bp, Homo sapiens
ataggctctgcac

SEQ ID NO: 4125664 - DNA, 14 bp, Homo sapiens
ataggctctgcaca

SEQ ID NO: 4125665 - DNA, 22 bp, Homo sapiens
ataggctctgcacagatggatt

SEQ ID NO: 4125666 - DNA, 14 bp, Homo sapiens
ataggctggagaag

SEQ ID NO: 4125667 - DNA, 16 bp, Homo sapiens
ataggctggagaagct

SEQ ID NO: 4125668 - DNA, 19 bp, Homo sapiens
atagggaaaggttttgtat

SEQ ID NO: 4125669 - DNA, 18 bp, Homo sapiens
ataggggatatttaaggt

SEQ ID NO: 4125670 - DNA, 21 bp, Homo sapiens
atagggtagaatgattaatca

SEQ ID NO: 4125671 - DNA, 21 bp, Homo sapiens
atagggtctcttcaggttctt

SEQ ID NO: 4125672 - DNA, 15 bp, Homo sapiens
ataggtaaattttta

SEQ ID NO: 4125673 - DNA, 23 bp, Homo sapiens
ataggtaaatttttaggcaaaga

SEQ ID NO: 4125674 - DNA, 17 bp, Homo sapiens
ataggtagtttggatat

SEQ ID NO: 4125675 - DNA, 20 bp, Homo sapiens
ataggtagtttggatatttt

SEQ ID NO: 4125676 - DNA, 14 bp, Homo sapiens
ataggtttctctcc

SEQ ID NO: 4125677 - DNA, 18 bp, Homo sapiens
atagtaaaagataacaag

SEQ ID NO: 4125678 - DNA, 14 bp, Homo sapiens
atagtaccatttat

SEQ ID NO: 4125679 - DNA, 20 bp, Homo sapiens
atagtagttagcttaagtag

SEQ ID NO: 4125680 - DNA, 16 bp, Homo sapiens
atagtatatctggaca

SEQ ID NO: 4125681 - DNA, 13 bp, Homo sapiens
atagtattggagc

SEQ ID NO: 4125682 - DNA, 23 bp, Homo sapiens
atagtatttgagagttctaaatt

SEQ ID NO: 4125683 - DNA, 15 bp, Homo sapiens
atagtcgtaagtgga

SEQ ID NO: 4125684 - DNA, 13 bp, Homo sapiens
atagtctgtgtga

SEQ ID NO: 4125685 - DNA, 14 bp, Homo sapiens
atagtcttccacaa

SEQ ID NO: 4125686 - DNA, 17 bp, Homo sapiens
atagtgaaataaattct

SEQ ID NO: 4125687 - DNA, 23 bp, Homo sapiens
atagtgaaataaattctgattct

SEQ ID NO: 4125688 - DNA, 12 bp, Homo sapiens
atagtgcttttt

SEQ ID NO: 4125689 - DNA, 14 bp, Homo sapiens
atagtgtaacttgc

SEQ ID NO: 4125690 - DNA, 13 bp, Homo sapiens
atagtgtgttctg

SEQ ID NO: 4125691 - DNA, 15 bp, Homo sapiens
atagtgtgttctgat

SEQ ID NO: 4125692 - DNA, 17 bp, Homo sapiens
atagtgtgttctgatta

SEQ ID NO: 4125693 - DNA, 23 bp, Homo sapiens
atagtgtgttctgattagaaatg

SEQ ID NO: 4125694 - DNA, 20 bp, Homo sapiens
atagtgttctgctcctgctt

SEQ ID NO: 4125695 - DNA, 23 bp, Homo sapiens
atagtgttctgctcctgcttttc

SEQ ID NO: 4125696 - DNA, 15 bp, Homo sapiens
atagttagaacctgg

SEQ ID NO: 4125697 - DNA, 21 bp, Homo sapiens
atagttcagaatttagtgtat

SEQ ID NO: 4125698 - DNA, 13 bp, Homo sapiens
atagtttaaaaca

SEQ ID NO: 4125699 - DNA, 17 bp, Homo sapiens
atagtttgtctatttta

SEQ ID NO: 4125700 - DNA, 17 bp, Homo sapiens
atataaaaagaaaagat

SEQ ID NO: 4125701 - DNA, 20 bp, Homo sapiens
atataaaaagaaaagataaa

SEQ ID NO: 4125702 - DNA, 21 bp, Homo sapiens
atataaaccgtggtctcatgt

SEQ ID NO: 4125703 - DNA, 14 bp, Homo sapiens
atataaatgtggag

SEQ ID NO: 4125704 - DNA, 21 bp, Homo sapiens
atataatgttgttatttaaag

SEQ ID NO: 4125705 - DNA, 21 bp, Homo sapiens
atataattatcggaagcagtg

SEQ ID NO: 4125706 - DNA, 12 bp, Homo sapiens
atataattctgt

SEQ ID NO: 4125707 - DNA, 16 bp, Homo sapiens
atataattctgtaaat

SEQ ID NO: 4125708 - DNA, 22 bp, Homo sapiens
atataattgtaccaacctcata

SEQ ID NO: 4125709 - DNA, 13 bp, Homo sapiens
atataattttatg

SEQ ID NO: 4125710 - DNA, 23 bp, Homo sapiens
atataatttttttatgttttgtt

SEQ ID NO: 4125711 - DNA, 19 bp, Homo sapiens
atatacacaggatcctatt

SEQ ID NO: 4125712 - DNA, 13 bp, Homo sapiens
atatacagaggaa

SEQ ID NO: 4125713 - DNA, 14 bp, Homo sapiens
atatacagttattt

SEQ ID NO: 4125714 - DNA, 19 bp, Homo sapiens
atatacagttattttggat

SEQ ID NO: 4125715 - DNA, 16 bp, Homo sapiens
atatacatgaagaata

SEQ ID NO: 4125716 - DNA, 19 bp, Homo sapiens
atatacatgaagaatagaa

SEQ ID NO: 4125717 - DNA, 18 bp, Homo sapiens
atatacattcaaacttaa

SEQ ID NO: 4125718 - DNA, 19 bp, Homo sapiens
atatacctggcttttactt

SEQ ID NO: 4125719 - DNA, 22 bp, Homo sapiens
atatacctggcttttactttat

SEQ ID NO: 4125720 - DNA, 21 bp, Homo sapiens
atatactgggttcttgtttta

SEQ ID NO: 4125721 - DNA, 11 bp, Homo sapiens
atatacttttt

SEQ ID NO: 4125722 - DNA, 22 bp, Homo sapiens
atatacttttttcttatttaac

SEQ ID NO: 4125723 - DNA, 20 bp, Homo sapiens
atatacttttttttctttaa

SEQ ID NO: 4125724 - DNA, 15 bp, Homo sapiens
atatagaatgctgca

SEQ ID NO: 4125725 - DNA, 17 bp, Homo sapiens
atatagattagaaaaat

SEQ ID NO: 4125726 - DNA, 23 bp, Homo sapiens
atatagccattgatcataaactg

SEQ ID NO: 4125727 - DNA, 18 bp, Homo sapiens
atataggtgatgtttgct

SEQ ID NO: 4125728 - DNA, 18 bp, Homo sapiens
atatagtcaacttattct

SEQ ID NO: 4125729 - DNA, 16 bp, Homo sapiens
atatagtccagacact

SEQ ID NO: 4125730 - DNA, 17 bp, Homo sapiens
atatagtttttaccttt

SEQ ID NO: 4125731 - DNA, 17 bp, Homo sapiens
atatataaaacggtgct

SEQ ID NO: 4125732 - DNA, 13 bp, Homo sapiens
atatatagaatct

SEQ ID NO: 4125733 - DNA, 20 bp, Homo sapiens
atatatagtccagacactta

SEQ ID NO: 4125734 - DNA, 14 bp, Homo sapiens
atatatataaatat

SEQ ID NO: 4125735 - DNA, 14 bp, Homo sapiens
atatatatgaataa

SEQ ID NO: 4125736 - DNA, 16 bp, Homo sapiens
atatatcaaagtgaga

SEQ ID NO: 4125737 - DNA, 13 bp, Homo sapiens
atatatgaaaact

SEQ ID NO: 4125738 - DNA, 15 bp, Homo sapiens
atatatgaaaactat

SEQ ID NO: 4125739 - DNA, 16 bp, Homo sapiens
atatatgtgtgtgtat

SEQ ID NO: 4125740 - DNA, 19 bp, Homo sapiens
atatatgtgtgtgtatgtt

SEQ ID NO: 4125741 - DNA, 16 bp, Homo sapiens
atatattattgtaagt

SEQ ID NO: 4125742 - DNA, 17 bp, Homo sapiens
atatattattgtaagtt

SEQ ID NO: 4125743 - DNA, 17 bp, Homo sapiens
atatattcttataaaaa

SEQ ID NO: 4125744 - DNA, 13 bp, Homo sapiens
atatattgaactt

SEQ ID NO: 4125745 - DNA, 15 bp, Homo sapiens
atatattgaactttt

SEQ ID NO: 4125746 - DNA, 17 bp, Homo sapiens
atatattgaacttttgt

SEQ ID NO: 4125747 - DNA, 13 bp, Homo sapiens
atatattgaatta

SEQ ID NO: 4125748 - DNA, 13 bp, Homo sapiens
atatattgtatta

SEQ ID NO: 4125749 - DNA, 13 bp, Homo sapiens
atatatttaagca

SEQ ID NO: 4125750 - DNA, 20 bp, Homo sapiens
atatatttaagcaacatctt

SEQ ID NO: 4125751 - DNA, 14 bp, Homo sapiens
atatatttaagcct

SEQ ID NO: 4125752 - DNA, 16 bp, Homo sapiens
atatatttaatgataa

SEQ ID NO: 4125753 - DNA, 10 bp, Homo sapiens
atatatttat

SEQ ID NO: 4125754 - DNA, 12 bp, Homo sapiens
atatatttataa

SEQ ID NO: 4125755 - DNA, 14 bp, Homo sapiens
atatatttataact

SEQ ID NO: 4125756 - DNA, 19 bp, Homo sapiens
atatatttatttaaagcat

SEQ ID NO: 4125757 - DNA, 14 bp, Homo sapiens
atatatttctttgt

SEQ ID NO: 4125758 - DNA, 17 bp, Homo sapiens
atatcaaaagacacagg

SEQ ID NO: 4125759 - DNA, 11 bp, Homo sapiens
atatcacttcc

SEQ ID NO: 4125760 - DNA, 12 bp, Homo sapiens
atatcagcctga

SEQ ID NO: 4125761 - DNA, 13 bp, Homo sapiens
atatcatacaaat

SEQ ID NO: 4125762 - DNA, 21 bp, Homo sapiens
atatcatgagtgaataaatgt

SEQ ID NO: 4125763 - DNA, 14 bp, Homo sapiens
atatcatgctaaaa

SEQ ID NO: 4125764 - DNA, 17 bp, Homo sapiens
atatccatgtactgtag

SEQ ID NO: 4125765 - DNA, 15 bp, Homo sapiens
atatccctcttgtaa

SEQ ID NO: 4125766 - DNA, 16 bp, Homo sapiens
atatccctcttgtaag

SEQ ID NO: 4125767 - DNA, 16 bp, Homo sapiens
atatcccttaatgaaa

SEQ ID NO: 4125768 - DNA, 14 bp, Homo sapiens
atatcctgagccat

SEQ ID NO: 4125769 - DNA, 13 bp, Homo sapiens
atatcctgtgact

SEQ ID NO: 4125770 - DNA, 20 bp, Homo sapiens
atatcctgtgactgtctcac

SEQ ID NO: 4125771 - DNA, 16 bp, Homo sapiens
atatcctttctaacaa

SEQ ID NO: 4125772 - DNA, 18 bp, Homo sapiens
atatctaaatctgtccaa

SEQ ID NO: 4125773 - DNA, 17 bp, Homo sapiens
atatctaatatatatga

SEQ ID NO: 4125774 - DNA, 12 bp, Homo sapiens
atatctattaat

SEQ ID NO: 4125775 - DNA, 22 bp, Homo sapiens
atatctattaatatatgtatta

SEQ ID NO: 4125776 - DNA, 20 bp, Homo sapiens
atatctgaaaatgtatgtgt

SEQ ID NO: 4125777 - DNA, 22 bp, Homo sapiens
atatctgaaaatgtatgtgtaa

SEQ ID NO: 4125778 - DNA, 17 bp, Homo sapiens
atatctgggattctact

SEQ ID NO: 4125779 - DNA, 13 bp, Homo sapiens
atatctttattaa

SEQ ID NO: 4125780 - DNA, 16 bp, Homo sapiens
atatctttgtgataat

SEQ ID NO: 4125781 - DNA, 19 bp, Homo sapiens
atatcttttatgtttgaat

SEQ ID NO: 4125782 - DNA, 14 bp, Homo sapiens
atatcttttggtta

SEQ ID NO: 4125783 - DNA, 17 bp, Homo sapiens
atatgaaaactatacaa

SEQ ID NO: 4125784 - DNA, 21 bp, Homo sapiens
atatgaaattccagcaataag

SEQ ID NO: 4125785 - DNA, 14 bp, Homo sapiens
atatgaagacataa

SEQ ID NO: 4125786 - DNA, 14 bp, Homo sapiens
atatgaattgtaca

SEQ ID NO: 4125787 - DNA, 15 bp, Homo sapiens
atatgaattgtacag

SEQ ID NO: 4125788 - DNA, 17 bp, Homo sapiens
atatgaatttaaatata

SEQ ID NO: 4125789 - DNA, 12 bp, Homo sapiens
atatgaccagaa

SEQ ID NO: 4125790 - DNA, 20 bp, Homo sapiens
atatgaccagaagccttgga

SEQ ID NO: 4125791 - DNA, 18 bp, Homo sapiens
atatgacggaagaacata

SEQ ID NO: 4125792 - DNA, 20 bp, Homo sapiens
atatgacggaagaacataga

SEQ ID NO: 4125793 - DNA, 13 bp, Homo sapiens
atatgactcacat

SEQ ID NO: 4125794 - DNA, 21 bp, Homo sapiens
atatgagcttccttctgtgaa

SEQ ID NO: 4125795 - DNA, 17 bp, Homo sapiens
atatgagttactgaagg

SEQ ID NO: 4125796 - DNA, 13 bp, Homo sapiens
atatgattgtttc

SEQ ID NO: 4125797 - DNA, 23 bp, Homo sapiens
atatgatttcactagaaaagctg

SEQ ID NO: 4125798 - DNA, 21 bp, Homo sapiens
atatgccccttcttgggcccc

SEQ ID NO: 4125799 - DNA, 23 bp, Homo sapiens
atatgccccttcttgggccccag

SEQ ID NO: 4125800 - DNA, 16 bp, Homo sapiens
atatgctctgcatgtt

SEQ ID NO: 4125801 - DNA, 20 bp, Homo sapiens
atatgctctgcatgttacat

SEQ ID NO: 4125802 - DNA, 22 bp, Homo sapiens
atatgctgccaaattttggcca

SEQ ID NO: 4125803 - DNA, 16 bp, Homo sapiens
atatgcttatacactt

SEQ ID NO: 4125804 - DNA, 15 bp, Homo sapiens
atatggacacttaat

SEQ ID NO: 4125805 - DNA, 20 bp, Homo sapiens
atatggacacttaatactac

SEQ ID NO: 4125806 - DNA, 22 bp, Homo sapiens
atatggattttctattgttact

SEQ ID NO: 4125807 - DNA, 15 bp, Homo sapiens
atatggcagaagaca

SEQ ID NO: 4125808 - DNA, 23 bp, Homo sapiens
atatggccacagtagtcttgatg

SEQ ID NO: 4125809 - DNA, 12 bp, Homo sapiens
atatggctgccc

SEQ ID NO: 4125810 - DNA, 14 bp, Homo sapiens
atatggctgcccag

SEQ ID NO: 4125811 - DNA, 15 bp, Homo sapiens
atatggctgcccagg

SEQ ID NO: 4125812 - DNA, 17 bp, Homo sapiens
atatggctgcccaggag

SEQ ID NO: 4125813 - DNA, 15 bp, Homo sapiens
atatggcttcaagtt

SEQ ID NO: 4125814 - DNA, 17 bp, Homo sapiens
atatgggcattgtagtt

SEQ ID NO: 4125815 - DNA, 17 bp, Homo sapiens
atatgggggcatctctt

SEQ ID NO: 4125816 - DNA, 22 bp, Homo sapiens
atatggtctaccagtttgctga

SEQ ID NO: 4125817 - DNA, 22 bp, Homo sapiens
atatggtgcagagaagctggac

SEQ ID NO: 4125818 - DNA, 14 bp, Homo sapiens
atatgtacatgaga

SEQ ID NO: 4125819 - DNA, 13 bp, Homo sapiens
atatgtacatttg

SEQ ID NO: 4125820 - DNA, 19 bp, Homo sapiens
atatgtaccatgtacatga

SEQ ID NO: 4125821 - DNA, 17 bp, Homo sapiens
atatgtatgggtagggt

SEQ ID NO: 4125822 - DNA, 23 bp, Homo sapiens
atatgtatgggtagggtaaatca

SEQ ID NO: 4125823 - DNA, 17 bp, Homo sapiens
atatgtattatttataa

SEQ ID NO: 4125824 - DNA, 22 bp, Homo sapiens
atatgtattatttataattcct

SEQ ID NO: 4125825 - DNA, 23 bp, Homo sapiens
atatgtattatttataattccta

SEQ ID NO: 4125826 - DNA, 11 bp, Homo sapiens
atatgtcctgg

SEQ ID NO: 4125827 - DNA, 15 bp, Homo sapiens
atatgtctgataatg

SEQ ID NO: 4125828 - DNA, 14 bp, Homo sapiens
atatgtgaaaaaaa

SEQ ID NO: 4125829 - DNA, 22 bp, Homo sapiens
atatgtgagattttttattgct

SEQ ID NO: 4125830 - DNA, 19 bp, Homo sapiens
atatgtgctggaattctaa

SEQ ID NO: 4125831 - DNA, 22 bp, Homo sapiens
atatgtgtatgcacagtaaaaa

SEQ ID NO: 4125832 - DNA, 20 bp, Homo sapiens
atatgtgtgtgtatgtttgc

SEQ ID NO: 4125833 - DNA, 20 bp, Homo sapiens
atatgtttccttgtttatca

SEQ ID NO: 4125834 - DNA, 13 bp, Homo sapiens
atattaaatacag

SEQ ID NO: 4125835 - DNA, 20 bp, Homo sapiens
atattaaatacagacactaa

SEQ ID NO: 4125836 - DNA, 22 bp, Homo sapiens
atattaagaaagactatctaaa

SEQ ID NO: 4125837 - DNA, 14 bp, Homo sapiens
atattaatcaaaat

SEQ ID NO: 4125838 - DNA, 20 bp, Homo sapiens
atattaatgcgatttcttcc

SEQ ID NO: 4125839 - DNA, 14 bp, Homo sapiens
atattacaaaaaca

SEQ ID NO: 4125840 - DNA, 16 bp, Homo sapiens
atattacaaaaacaaa

SEQ ID NO: 4125841 - DNA, 21 bp, Homo sapiens
atattacaataccgttaagat

SEQ ID NO: 4125842 - DNA, 15 bp, Homo sapiens
atattacctggatta

SEQ ID NO: 4125843 - DNA, 21 bp, Homo sapiens
atattactgttgcatttactt

SEQ ID NO: 4125844 - DNA, 15 bp, Homo sapiens
atattagtgaagatg

SEQ ID NO: 4125845 - DNA, 20 bp, Homo sapiens
atattatacaggaaagcaat

SEQ ID NO: 4125846 - DNA, 19 bp, Homo sapiens
atattatgcctgaatgact

SEQ ID NO: 4125847 - DNA, 16 bp, Homo sapiens
atattatggaagattt

SEQ ID NO: 4125848 - DNA, 13 bp, Homo sapiens
atattatgtgttt

SEQ ID NO: 4125849 - DNA, 13 bp, Homo sapiens
atattattatgaa

SEQ ID NO: 4125850 - DNA, 16 bp, Homo sapiens
atattccatgaatgta

SEQ ID NO: 4125851 - DNA, 18 bp, Homo sapiens
atattcccctatctctag

SEQ ID NO: 4125852 - DNA, 22 bp, Homo sapiens
atattcctgaatgaaatatcag

SEQ ID NO: 4125853 - DNA, 15 bp, Homo sapiens
atattctattgtatt

SEQ ID NO: 4125854 - DNA, 13 bp, Homo sapiens
atattcttataaa

SEQ ID NO: 4125855 - DNA, 13 bp, Homo sapiens
atattcttttgtt

SEQ ID NO: 4125856 - DNA, 20 bp, Homo sapiens
atattgaacttttgtactga

SEQ ID NO: 4125857 - DNA, 15 bp, Homo sapiens
atattgaagacaatt

SEQ ID NO: 4125858 - DNA, 17 bp, Homo sapiens
atattgaagacaatttg

SEQ ID NO: 4125859 - DNA, 17 bp, Homo sapiens
atattgacactgtccct

SEQ ID NO: 4125860 - DNA, 15 bp, Homo sapiens
atattgacttgtata

SEQ ID NO: 4125861 - DNA, 16 bp, Homo sapiens
atattgaggctttgtg

SEQ ID NO: 4125862 - DNA, 17 bp, Homo sapiens
atattgaggctttgtgt

SEQ ID NO: 4125863 - DNA, 19 bp, Homo sapiens
atattgaggctttgtgttg

SEQ ID NO: 4125864 - DNA, 16 bp, Homo sapiens
atattgccgcactagg

SEQ ID NO: 4125865 - DNA, 13 bp, Homo sapiens
atattgctttttc

SEQ ID NO: 4125866 - DNA, 16 bp, Homo sapiens
atattgctttttctaa

SEQ ID NO: 4125867 - DNA, 21 bp, Homo sapiens
atattgctttttctaatgtgg

SEQ ID NO: 4125868 - DNA, 19 bp, Homo sapiens
atattggtgcgtttttaca

SEQ ID NO: 4125869 - DNA, 13 bp, Homo sapiens
atattgtacataa

SEQ ID NO: 4125870 - DNA, 17 bp, Homo sapiens
atattgtcagatatttt

SEQ ID NO: 4125871 - DNA, 17 bp, Homo sapiens
atattgtgttgtgaatg

SEQ ID NO: 4125872 - DNA, 18 bp, Homo sapiens
atattgtgttgtgaatgt

SEQ ID NO: 4125873 - DNA, 15 bp, Homo sapiens
atattgttcaaacaa

SEQ ID NO: 4125874 - DNA, 18 bp, Homo sapiens
atattgttcaaacaatat

SEQ ID NO: 4125875 - DNA, 20 bp, Homo sapiens
atattgttgcattgcttttt

SEQ ID NO: 4125876 - DNA, 16 bp, Homo sapiens
atattgttgtataatt

SEQ ID NO: 4125877 - DNA, 18 bp, Homo sapiens
atattgttgtataatttc

SEQ ID NO: 4125878 - DNA, 14 bp, Homo sapiens
atattgtttctgca

SEQ ID NO: 4125879 - DNA, 19 bp, Homo sapiens
atattgttttctgtaaata

SEQ ID NO: 4125880 - DNA, 16 bp, Homo sapiens
atattgtttttgtatt

SEQ ID NO: 4125881 - DNA, 19 bp, Homo sapiens
atattgtttttgtatttat

SEQ ID NO: 4125882 - DNA, 19 bp, Homo sapiens
atatttaaaaacaaaaggc

SEQ ID NO: 4125883 - DNA, 12 bp, Homo sapiens
atatttaaacag

SEQ ID NO: 4125884 - DNA, 21 bp, Homo sapiens
atatttaaacctttttcttga

SEQ ID NO: 4125885 - DNA, 14 bp, Homo sapiens
atatttaaagacag

SEQ ID NO: 4125886 - DNA, 19 bp, Homo sapiens
atatttaacattatttata

SEQ ID NO: 4125887 - DNA, 15 bp, Homo sapiens
atatttaagaaaagc

SEQ ID NO: 4125888 - DNA, 16 bp, Homo sapiens
atatttaagaaaagca

SEQ ID NO: 4125889 - DNA, 18 bp, Homo sapiens
atatttaagaaaagcact

SEQ ID NO: 4125890 - DNA, 14 bp, Homo sapiens
atatttaagaaaat

SEQ ID NO: 4125891 - DNA, 18 bp, Homo sapiens
atatttaagaaaatacaa

SEQ ID NO: 4125892 - DNA, 19 bp, Homo sapiens
atatttaagaaaatacaat

SEQ ID NO: 4125893 - DNA, 18 bp, Homo sapiens
atatttaagcaacatctt

SEQ ID NO: 4125894 - DNA, 14 bp, Homo sapiens
atatttaagcctta

SEQ ID NO: 4125895 - DNA, 23 bp, Homo sapiens
atatttaatgataagtaaatgct

SEQ ID NO: 4125896 - DNA, 17 bp, Homo sapiens
atatttaattattaact

SEQ ID NO: 4125897 - DNA, 13 bp, Homo sapiens
atatttacaataa

SEQ ID NO: 4125898 - DNA, 19 bp, Homo sapiens
atatttacttcttatacat

SEQ ID NO: 4125899 - DNA, 16 bp, Homo sapiens
atatttataacagcat

SEQ ID NO: 4125900 - DNA, 20 bp, Homo sapiens
atatttataactcatcataa

SEQ ID NO: 4125901 - DNA, 21 bp, Homo sapiens
atatttataactcatcataaa

SEQ ID NO: 4125902 - DNA, 15 bp, Homo sapiens
atatttatatatatt

SEQ ID NO: 4125903 - DNA, 14 bp, Homo sapiens
atatttatgtagat

SEQ ID NO: 4125904 - DNA, 19 bp, Homo sapiens
atatttatgtctatttaag

SEQ ID NO: 4125905 - DNA, 22 bp, Homo sapiens
atatttattaaataaaatcaat

SEQ ID NO: 4125906 - DNA, 16 bp, Homo sapiens
atatttattgttagaa

SEQ ID NO: 4125907 - DNA, 22 bp, Homo sapiens
atatttattgtttatttatcag

SEQ ID NO: 4125908 - DNA, 23 bp, Homo sapiens
atatttattgtttatttatcagt

SEQ ID NO: 4125909 - DNA, 17 bp, Homo sapiens
atatttatttaaagcat

SEQ ID NO: 4125910 - DNA, 17 bp, Homo sapiens
atatttatttatttatt

SEQ ID NO: 4125911 - DNA, 17 bp, Homo sapiens
atatttcagatatcaaa

SEQ ID NO: 4125912 - DNA, 20 bp, Homo sapiens
atatttccctaaaatacatt

SEQ ID NO: 4125913 - DNA, 22 bp, Homo sapiens
atatttccctaaaatacattta

SEQ ID NO: 4125914 - DNA, 17 bp, Homo sapiens
atatttcctgacttgag

SEQ ID NO: 4125915 - DNA, 12 bp, Homo sapiens
atatttccttta

SEQ ID NO: 4125916 - DNA, 14 bp, Homo sapiens
atatttcctttatg

SEQ ID NO: 4125917 - DNA, 21 bp, Homo sapiens
atatttcctttatgtgaattt

SEQ ID NO: 4125918 - DNA, 14 bp, Homo sapiens
atatttctaactat

SEQ ID NO: 4125919 - DNA, 16 bp, Homo sapiens
atatttctaactatat

SEQ ID NO: 4125920 - DNA, 20 bp, Homo sapiens
atatttcttgctttcaatta

SEQ ID NO: 4125921 - DNA, 14 bp, Homo sapiens
atatttgaatgaaa

SEQ ID NO: 4125922 - DNA, 20 bp, Homo sapiens
atatttgaattttaaatcta

SEQ ID NO: 4125923 - DNA, 16 bp, Homo sapiens
atatttgacttgcatg

SEQ ID NO: 4125924 - DNA, 21 bp, Homo sapiens
atatttgctagactctagaca

SEQ ID NO: 4125925 - DNA, 21 bp, Homo sapiens
atatttggcccaaactcatct

SEQ ID NO: 4125926 - DNA, 14 bp, Homo sapiens
atatttgtacaaaa

SEQ ID NO: 4125927 - DNA, 20 bp, Homo sapiens
atatttgtgatagcactttc

SEQ ID NO: 4125928 - DNA, 21 bp, Homo sapiens
atatttgtgatagcactttct

SEQ ID NO: 4125929 - DNA, 13 bp, Homo sapiens
atattttaataga

SEQ ID NO: 4125930 - DNA, 17 bp, Homo sapiens
atattttaatagaaata

SEQ ID NO: 4125931 - DNA, 19 bp, Homo sapiens
atattttcaacgcagccct

SEQ ID NO: 4125932 - DNA, 18 bp, Homo sapiens
atattttcaactatgtag

SEQ ID NO: 4125933 - DNA, 19 bp, Homo sapiens
atattttcttccaagcaaa

SEQ ID NO: 4125934 - DNA, 18 bp, Homo sapiens
atattttctttaatgctt

SEQ ID NO: 4125935 - DNA, 15 bp, Homo sapiens
atattttgagaaact

SEQ ID NO: 4125936 - DNA, 20 bp, Homo sapiens
atatttttaaaatatttatt

SEQ ID NO: 4125937 - DNA, 20 bp, Homo sapiens
atatttttataataaacata

SEQ ID NO: 4125938 - DNA, 16 bp, Homo sapiens
atatttttattttatt

SEQ ID NO: 4125939 - DNA, 21 bp, Homo sapiens
atatttttggttgtcaatatt

SEQ ID NO: 4125940 - DNA, 19 bp, Homo sapiens
atcaaaaattgaagagaga

SEQ ID NO: 4125941 - DNA, 14 bp, Homo sapiens
atcaaaataaaaag

SEQ ID NO: 4125942 - DNA, 12 bp, Homo sapiens
atcaaaatgctt

SEQ ID NO: 4125943 - DNA, 22 bp, Homo sapiens
atcaaaatgctttttatttctg

SEQ ID NO: 4125944 - DNA, 19 bp, Homo sapiens
atcaaacagtaatctaggt

SEQ ID NO: 4125945 - DNA, 18 bp, Homo sapiens
atcaaaccctagccttgc

SEQ ID NO: 4125946 - DNA, 22 bp, Homo sapiens
atcaaaccctagccttgcttgt

SEQ ID NO: 4125947 - DNA, 18 bp, Homo sapiens
atcaaagagagaaaataa

SEQ ID NO: 4125948 - DNA, 21 bp, Homo sapiens
atcaaaggaaaatagtaatgt

SEQ ID NO: 4125949 - DNA, 18 bp, Homo sapiens
atcaaataagtatttata

SEQ ID NO: 4125950 - DNA, 13 bp, Homo sapiens
atcaaatacttta

SEQ ID NO: 4125951 - DNA, 14 bp, Homo sapiens
atcaaatactttaa

SEQ ID NO: 4125952 - DNA, 20 bp, Homo sapiens
atcaaatactttaaaggaaa

SEQ ID NO: 4125953 - DNA, 21 bp, Homo sapiens
atcaaatagaaccactatgaa

SEQ ID NO: 4125954 - DNA, 15 bp, Homo sapiens
atcaacaaagaaata

SEQ ID NO: 4125955 - DNA, 14 bp, Homo sapiens
atcaactcccaact

SEQ ID NO: 4125956 - DNA, 15 bp, Homo sapiens
atcaagagctgccct

SEQ ID NO: 4125957 - DNA, 17 bp, Homo sapiens
atcaagatttttttcct

SEQ ID NO: 4125958 - DNA, 17 bp, Homo sapiens
atcaagcataaatcact

SEQ ID NO: 4125959 - DNA, 13 bp, Homo sapiens
atcaagcccttta

SEQ ID NO: 4125960 - DNA, 21 bp, Homo sapiens
atcaaggactctggtttctca

SEQ ID NO: 4125961 - DNA, 19 bp, Homo sapiens
atcaaggttataatttttt

SEQ ID NO: 4125962 - DNA, 15 bp, Homo sapiens
atcaagtcaatcatt

SEQ ID NO: 4125963 - DNA, 16 bp, Homo sapiens
atcaagtcctttgtga

SEQ ID NO: 4125964 - DNA, 16 bp, Homo sapiens
atcaagttcttaaaat

SEQ ID NO: 4125965 - DNA, 15 bp, Homo sapiens
atcaagttgaattga

SEQ ID NO: 4125966 - DNA, 15 bp, Homo sapiens
atcaataaaatgtga

SEQ ID NO: 4125967 - DNA, 17 bp, Homo sapiens
atcaataaaatgtgatt

SEQ ID NO: 4125968 - DNA, 18 bp, Homo sapiens
atcaatatctaatatata

SEQ ID NO: 4125969 - DNA, 21 bp, Homo sapiens
atcaatctgtaaaactaagaa

SEQ ID NO: 4125970 - DNA, 21 bp, Homo sapiens
atcaatgaatttgttctttct

SEQ ID NO: 4125971 - DNA, 16 bp, Homo sapiens
atcaatgagttcttct

SEQ ID NO: 4125972 - DNA, 13 bp, Homo sapiens
atcaatgttcatt

SEQ ID NO: 4125973 - DNA, 14 bp, Homo sapiens
atcaatgttcattg

SEQ ID NO: 4125974 - DNA, 17 bp, Homo sapiens
atcaattccctctctca

SEQ ID NO: 4125975 - DNA, 18 bp, Homo sapiens
atcaattccctctctcag

SEQ ID NO: 4125976 - DNA, 20 bp, Homo sapiens
atcaattttcattaaacttg

SEQ ID NO: 4125977 - DNA, 22 bp, Homo sapiens
atcaattttgacttaatgtgat

SEQ ID NO: 4125978 - DNA, 16 bp, Homo sapiens
atcacaatacagataa

SEQ ID NO: 4125979 - DNA, 18 bp, Homo sapiens
atcacacttctgtgagac

SEQ ID NO: 4125980 - DNA, 13 bp, Homo sapiens
atcacagcctcca

SEQ ID NO: 4125981 - DNA, 14 bp, Homo sapiens
atcacagcctccag

SEQ ID NO: 4125982 - DNA, 17 bp, Homo sapiens
atcacagcctccagggc

SEQ ID NO: 4125983 - DNA, 18 bp, Homo sapiens
atcacagggttgggccca

SEQ ID NO: 4125984 - DNA, 19 bp, Homo sapiens
atcacagggttgggcccag

SEQ ID NO: 4125985 - DNA, 23 bp, Homo sapiens
atcacagggttgggcccagatct

SEQ ID NO: 4125986 - DNA, 16 bp, Homo sapiens
atcacagtattatctg

SEQ ID NO: 4125987 - DNA, 22 bp, Homo sapiens
atcacattatttgcatgttacc

SEQ ID NO: 4125988 - DNA, 22 bp, Homo sapiens
atcacattgagctgatataaat

SEQ ID NO: 4125989 - DNA, 14 bp, Homo sapiens
atcacatttctatg

SEQ ID NO: 4125990 - DNA, 21 bp, Homo sapiens
atcaccagcccggcctgctcc

SEQ ID NO: 4125991 - DNA, 17 bp, Homo sapiens
atcaccataacctctgg

SEQ ID NO: 4125992 - DNA, 19 bp, Homo sapiens
atcaccctttgccttagca

SEQ ID NO: 4125993 - DNA, 17 bp, Homo sapiens
atcacgacgctgcagag

SEQ ID NO: 4125994 - DNA, 14 bp, Homo sapiens
atcacgcctggcta

SEQ ID NO: 4125995 - DNA, 18 bp, Homo sapiens
atcactaggtaacttatt

SEQ ID NO: 4125996 - DNA, 18 bp, Homo sapiens
atcactctaaaaaacatt

SEQ ID NO: 4125997 - DNA, 17 bp, Homo sapiens
atcactgaacaaactaa

SEQ ID NO: 4125998 - DNA, 13 bp, Homo sapiens
atcactgactctg

SEQ ID NO: 4125999 - DNA, 16 bp, Homo sapiens
atcactgactctgact

SEQ ID NO: 4126000 - DNA, 22 bp, Homo sapiens
atcactgcattattctctttta

SEQ ID NO: 4126001 - DNA, 19 bp, Homo sapiens
atcactgcttgatgaagca

SEQ ID NO: 4126002 - DNA, 16 bp, Homo sapiens
atcactggctggcctg

SEQ ID NO: 4126003 - DNA, 13 bp, Homo sapiens
atcagaacagcag

SEQ ID NO: 4126004 - DNA, 14 bp, Homo sapiens
atcagaacagcaga

SEQ ID NO: 4126005 - DNA, 16 bp, Homo sapiens
atcagaacctgagcta

SEQ ID NO: 4126006 - DNA, 17 bp, Homo sapiens
atcagaagataacttga

SEQ ID NO: 4126007 - DNA, 12 bp, Homo sapiens
atcagaataaat

SEQ ID NO: 4126008 - DNA, 22 bp, Homo sapiens
atcagaatagccacatttggaa

SEQ ID NO: 4126009 - DNA, 14 bp, Homo sapiens
atcagacaagtgtt

SEQ ID NO: 4126010 - DNA, 14 bp, Homo sapiens
atcagacctgtctt

SEQ ID NO: 4126011 - DNA, 21 bp, Homo sapiens
atcagacctgtcttccaagga

SEQ ID NO: 4126012 - DNA, 16 bp, Homo sapiens
atcagagagcaaggca

SEQ ID NO: 4126013 - DNA, 15 bp, Homo sapiens
atcagatacatcact

SEQ ID NO: 4126014 - DNA, 22 bp, Homo sapiens
atcagatggaaatattttgata

SEQ ID NO: 4126015 - DNA, 23 bp, Homo sapiens
atcagatggaaatattttgataa

SEQ ID NO: 4126016 - DNA, 15 bp, Homo sapiens
atcagccacattcta

SEQ ID NO: 4126017 - DNA, 15 bp, Homo sapiens
atcagctccttttcc

SEQ ID NO: 4126018 - DNA, 13 bp, Homo sapiens
atcagctgctact

SEQ ID NO: 4126019 - DNA, 13 bp, Homo sapiens
atcaggatgaacc

SEQ ID NO: 4126020 - DNA, 13 bp, Homo sapiens
atcagggcctggg

SEQ ID NO: 4126021 - DNA, 15 bp, Homo sapiens
atcaggggagaaaaa

SEQ ID NO: 4126022 - DNA, 13 bp, Homo sapiens
atcaggtcaggga

SEQ ID NO: 4126023 - DNA, 21 bp, Homo sapiens
atcaggtcagggacttggaca

SEQ ID NO: 4126024 - DNA, 23 bp, Homo sapiens
atcagtaagaggtgttatttgga

SEQ ID NO: 4126025 - DNA, 20 bp, Homo sapiens
atcagtacttttattaatat

SEQ ID NO: 4126026 - DNA, 21 bp, Homo sapiens
atcagtacttttattaatatt

SEQ ID NO: 4126027 - DNA, 18 bp, Homo sapiens
atcagtataaacaaagtt

SEQ ID NO: 4126028 - DNA, 14 bp, Homo sapiens
atcagtgactgaaa

SEQ ID NO: 4126029 - DNA, 19 bp, Homo sapiens
atcagtgactgaaaccatt

SEQ ID NO: 4126030 - DNA, 22 bp, Homo sapiens
atcagtgggcaggataaactga

SEQ ID NO: 4126031 - DNA, 20 bp, Homo sapiens
atcagtgtgtctaaatttga

SEQ ID NO: 4126032 - DNA, 14 bp, Homo sapiens
atcagttattcatt

SEQ ID NO: 4126033 - DNA, 19 bp, Homo sapiens
atcagttcccccagtacct

SEQ ID NO: 4126034 - DNA, 16 bp, Homo sapiens
atcagttgactttaag

SEQ ID NO: 4126035 - DNA, 21 bp, Homo sapiens
atcagttgactttaagtgaaa

SEQ ID NO: 4126036 - DNA, 12 bp, Homo sapiens
atcataaaataa

SEQ ID NO: 4126037 - DNA, 13 bp, Homo sapiens
atcataaaataaa

SEQ ID NO: 4126038 - DNA, 15 bp, Homo sapiens
atcataagtgaattt

SEQ ID NO: 4126039 - DNA, 14 bp, Homo sapiens
atcatattgatgaa

SEQ ID NO: 4126040 - DNA, 15 bp, Homo sapiens
atcatcctaagctat

SEQ ID NO: 4126041 - DNA, 17 bp, Homo sapiens
atcatcctgcagacaga

SEQ ID NO: 4126042 - DNA, 16 bp, Homo sapiens
atcatcctttgttctg

SEQ ID NO: 4126043 - DNA, 21 bp, Homo sapiens
atcatcctttgttctgagcat

SEQ ID NO: 4126044 - DNA, 13 bp, Homo sapiens
atcatcgccagag

SEQ ID NO: 4126045 - DNA, 15 bp, Homo sapiens
atcatcgccagaggt

SEQ ID NO: 4126046 - DNA, 16 bp, Homo sapiens
atcatctataaagaag

SEQ ID NO: 4126047 - DNA, 14 bp, Homo sapiens
atcatgaaatatgc

SEQ ID NO: 4126048 - DNA, 18 bp, Homo sapiens
atcatgaaatatgcatct

SEQ ID NO: 4126049 - DNA, 19 bp, Homo sapiens
atcatgaattcccttttaa

SEQ ID NO: 4126050 - DNA, 20 bp, Homo sapiens
atcatgaattcccttttaat

SEQ ID NO: 4126051 - DNA, 23 bp, Homo sapiens
atcatgaattcccttttaatcaa

SEQ ID NO: 4126052 - DNA, 12 bp, Homo sapiens
atcatgcaaaat

SEQ ID NO: 4126053 - DNA, 21 bp, Homo sapiens
atcatgcattgttgaggtggt

SEQ ID NO: 4126054 - DNA, 12 bp, Homo sapiens
atcatgccctgt

SEQ ID NO: 4126055 - DNA, 15 bp, Homo sapiens
atcatgctaaaattc

SEQ ID NO: 4126056 - DNA, 21 bp, Homo sapiens
atcatgctaaaattctataga

SEQ ID NO: 4126057 - DNA, 17 bp, Homo sapiens
atcatggtgtaataaga

SEQ ID NO: 4126058 - DNA, 18 bp, Homo sapiens
atcatggtgtaataagac

SEQ ID NO: 4126059 - DNA, 20 bp, Homo sapiens
atcatggtgtaataagacat

SEQ ID NO: 4126060 - DNA, 18 bp, Homo sapiens
atcatgtcaggcctgtgt

SEQ ID NO: 4126061 - DNA, 16 bp, Homo sapiens
atcatgtccatacact

SEQ ID NO: 4126062 - DNA, 16 bp, Homo sapiens
atcattaatttttaat

SEQ ID NO: 4126063 - DNA, 11 bp, Homo sapiens
atcattccagt

SEQ ID NO: 4126064 - DNA, 15 bp, Homo sapiens
atcattccagtgcta

SEQ ID NO: 4126065 - DNA, 15 bp, Homo sapiens
atcattccctctcat

SEQ ID NO: 4126066 - DNA, 15 bp, Homo sapiens
atcattctacagaat

SEQ ID NO: 4126067 - DNA, 20 bp, Homo sapiens
atcattggaacaactgatac

SEQ ID NO: 4126068 - DNA, 22 bp, Homo sapiens
atcattgtacatagcatgttta

SEQ ID NO: 4126069 - DNA, 23 bp, Homo sapiens
atcatttcagtatcatctccatc

SEQ ID NO: 4126070 - DNA, 15 bp, Homo sapiens
atcatttctcactgt

SEQ ID NO: 4126071 - DNA, 17 bp, Homo sapiens
atcatttgaacaactag

SEQ ID NO: 4126072 - DNA, 22 bp, Homo sapiens
atcattttacagtgaccttttc

SEQ ID NO: 4126073 - DNA, 14 bp, Homo sapiens
atcattttattata

SEQ ID NO: 4126074 - DNA, 15 bp, Homo sapiens
atcattttgcattca

SEQ ID NO: 4126075 - DNA, 12 bp, Homo sapiens
atccaaaagaaa

SEQ ID NO: 4126076 - DNA, 14 bp, Homo sapiens
atccaaaagaaaaa

SEQ ID NO: 4126077 - DNA, 13 bp, Homo sapiens
atccaaaagaagc

SEQ ID NO: 4126078 - DNA, 18 bp, Homo sapiens
atccaaaagaagccccca

SEQ ID NO: 4126079 - DNA, 14 bp, Homo sapiens
atccaaaatatttt

SEQ ID NO: 4126080 - DNA, 20 bp, Homo sapiens
atccaaaatattttttgcaa

SEQ ID NO: 4126081 - DNA, 20 bp, Homo sapiens
atccaaacttggatttttga

SEQ ID NO: 4126082 - DNA, 14 bp, Homo sapiens
atccaacaagaaga

SEQ ID NO: 4126083 - DNA, 22 bp, Homo sapiens
atccaagatcaattccctctct

SEQ ID NO: 4126084 - DNA, 14 bp, Homo sapiens
atccaatcctcact

SEQ ID NO: 4126085 - DNA, 18 bp, Homo sapiens
atccaatcctcactgggt

SEQ ID NO: 4126086 - DNA, 13 bp, Homo sapiens
atccacaattatt

SEQ ID NO: 4126087 - DNA, 21 bp, Homo sapiens
atccacaattattggcaaagt

SEQ ID NO: 4126088 - DNA, 14 bp, Homo sapiens
atccacctgccttg

SEQ ID NO: 4126089 - DNA, 22 bp, Homo sapiens
atccaccttggctctgccagtg

SEQ ID NO: 4126090 - DNA, 20 bp, Homo sapiens
atccactctaccctcccacc

SEQ ID NO: 4126091 - DNA, 21 bp, Homo sapiens
atccactctaccctcccaccc

SEQ ID NO: 4126092 - DNA, 16 bp, Homo sapiens
atccagaacagtggct

SEQ ID NO: 4126093 - DNA, 18 bp, Homo sapiens
atccagaacagtggctcg

SEQ ID NO: 4126094 - DNA, 20 bp, Homo sapiens
atccagaattgaccttttga

SEQ ID NO: 4126095 - DNA, 15 bp, Homo sapiens
atccagagagcagct

SEQ ID NO: 4126096 - DNA, 20 bp, Homo sapiens
atccagagggttgtgatttt

SEQ ID NO: 4126097 - DNA, 16 bp, Homo sapiens
atccagcagtgttgct

SEQ ID NO: 4126098 - DNA, 21 bp, Homo sapiens
atccagcagtgttgctcagct

SEQ ID NO: 4126099 - DNA, 11 bp, Homo sapiens
atccagctccc

SEQ ID NO: 4126100 - DNA, 17 bp, Homo sapiens
atccagctccctagact

SEQ ID NO: 4126101 - DNA, 21 bp, Homo sapiens
atccagctccctagactgcat

SEQ ID NO: 4126102 - DNA, 13 bp, Homo sapiens
atccaggactctg

SEQ ID NO: 4126103 - DNA, 16 bp, Homo sapiens
atccaggcacagctga

SEQ ID NO: 4126104 - DNA, 14 bp, Homo sapiens
atccaggcagatcc

SEQ ID NO: 4126105 - DNA, 15 bp, Homo sapiens
atccaggcagatcca

SEQ ID NO: 4126106 - DNA, 12 bp, Homo sapiens
atccagggacag

SEQ ID NO: 4126107 - DNA, 19 bp, Homo sapiens
atccagggacagaggcccc

SEQ ID NO: 4126108 - DNA, 16 bp, Homo sapiens
atccagtattgctgat

SEQ ID NO: 4126109 - DNA, 15 bp, Homo sapiens
atccagtttgttctc

SEQ ID NO: 4126110 - DNA, 18 bp, Homo sapiens
atccatattgagtcaaat

SEQ ID NO: 4126111 - DNA, 14 bp, Homo sapiens
atccatcagtgcca

SEQ ID NO: 4126112 - DNA, 15 bp, Homo sapiens
atccatccatctcca

SEQ ID NO: 4126113 - DNA, 12 bp, Homo sapiens
atccatgtactg

SEQ ID NO: 4126114 - DNA, 22 bp, Homo sapiens
atccatgtactgtagtttttct

SEQ ID NO: 4126115 - DNA, 19 bp, Homo sapiens
atccatgttagtttttact

SEQ ID NO: 4126116 - DNA, 15 bp, Homo sapiens
atccattacctccat

SEQ ID NO: 4126117 - DNA, 16 bp, Homo sapiens
atccattaggccagca

SEQ ID NO: 4126118 - DNA, 12 bp, Homo sapiens
atccatttgcct

SEQ ID NO: 4126119 - DNA, 22 bp, Homo sapiens
atcccaaagttgttgtaacctg

SEQ ID NO: 4126120 - DNA, 17 bp, Homo sapiens
atcccaagctagtgagc

SEQ ID NO: 4126121 - DNA, 12 bp, Homo sapiens
atcccacccctc

SEQ ID NO: 4126122 - DNA, 14 bp, Homo sapiens
atcccaccttccca

SEQ ID NO: 4126123 - DNA, 16 bp, Homo sapiens
atcccacgcactccat

SEQ ID NO: 4126124 - DNA, 14 bp, Homo sapiens
atcccagcacctgc

SEQ ID NO: 4126125 - DNA, 16 bp, Homo sapiens
atcccagcacctgcct

SEQ ID NO: 4126126 - DNA, 21 bp, Homo sapiens
atcccagcacctgcctcctcg

SEQ ID NO: 4126127 - DNA, 17 bp, Homo sapiens
atcccagcactttggga

SEQ ID NO: 4126128 - DNA, 20 bp, Homo sapiens
atcccagcactttgggaggc

SEQ ID NO: 4126129 - DNA, 22 bp, Homo sapiens
atcccagcactttgggaggctg

SEQ ID NO: 4126130 - DNA, 14 bp, Homo sapiens
atcccagcagccca

SEQ ID NO: 4126131 - DNA, 17 bp, Homo sapiens
atcccagcagcccaagc

SEQ ID NO: 4126132 - DNA, 12 bp, Homo sapiens
atcccagcctgg

SEQ ID NO: 4126133 - DNA, 16 bp, Homo sapiens
atcccagcctgtggtt

SEQ ID NO: 4126134 - DNA, 19 bp, Homo sapiens
atcccagctttaaaaagaa

SEQ ID NO: 4126135 - DNA, 22 bp, Homo sapiens
atcccagctttaaaaagaaaaa

SEQ ID NO: 4126136 - DNA, 17 bp, Homo sapiens
atcccagggaaggactt

SEQ ID NO: 4126137 - DNA, 12 bp, Homo sapiens
atcccagggctg

SEQ ID NO: 4126138 - DNA, 15 bp, Homo sapiens
atcccagggctggct

SEQ ID NO: 4126139 - DNA, 19 bp, Homo sapiens
atcccaggggcccaaggcg

SEQ ID NO: 4126140 - DNA, 16 bp, Homo sapiens
atcccatccatcagct

SEQ ID NO: 4126141 - DNA, 16 bp, Homo sapiens
atccccaccagctcgt

SEQ ID NO: 4126142 - DNA, 14 bp, Homo sapiens
atccccagggcagc

SEQ ID NO: 4126143 - DNA, 19 bp, Homo sapiens
atccccaggggtcccagcc

SEQ ID NO: 4126144 - DNA, 15 bp, Homo sapiens
atccccatcctccag

SEQ ID NO: 4126145 - DNA, 15 bp, Homo sapiens
atccccatctccctg

SEQ ID NO: 4126146 - DNA, 18 bp, Homo sapiens
atccccatctccctgcct

SEQ ID NO: 4126147 - DNA, 20 bp, Homo sapiens
atccccatctccctgcctgg

SEQ ID NO: 4126148 - DNA, 14 bp, Homo sapiens
atccccatgcctag

SEQ ID NO: 4126149 - DNA, 15 bp, Homo sapiens
atcccccctgctcag

SEQ ID NO: 4126150 - DNA, 14 bp, Homo sapiens
atcccccttgccac

SEQ ID NO: 4126151 - DNA, 22 bp, Homo sapiens
atccccgttcctgacatcacag

SEQ ID NO: 4126152 - DNA, 15 bp, Homo sapiens
atcccctccctgtca

SEQ ID NO: 4126153 - DNA, 19 bp, Homo sapiens
atcccctccctgtcaaagc

SEQ ID NO: 4126154 - DNA, 12 bp, Homo sapiens
atcccctgagcc

SEQ ID NO: 4126155 - DNA, 14 bp, Homo sapiens
atcccgtgctttta

SEQ ID NO: 4126156 - DNA, 18 bp, Homo sapiens
atccctacatgtattgca

SEQ ID NO: 4126157 - DNA, 22 bp, Homo sapiens
atccctaccccctaagagccat

SEQ ID NO: 4126158 - DNA, 21 bp, Homo sapiens
atccctagtccccctgttttc

SEQ ID NO: 4126159 - DNA, 14 bp, Homo sapiens
atccctcacctgta

SEQ ID NO: 4126160 - DNA, 19 bp, Homo sapiens
atccctccattcatccttc

SEQ ID NO: 4126161 - DNA, 22 bp, Homo sapiens
atccctcccccccatgcactgt

SEQ ID NO: 4126162 - DNA, 24 bp, Homo sapiens
atccctcgatatttttaaagatct

SEQ ID NO: 4126163 - DNA, 12 bp, Homo sapiens
atccctctcttc

SEQ ID NO: 4126164 - DNA, 18 bp, Homo sapiens
atccctctcttccccttc

SEQ ID NO: 4126165 - DNA, 20 bp, Homo sapiens
atccctctcttccccttccc

SEQ ID NO: 4126166 - DNA, 14 bp, Homo sapiens
atccctcttgtaag

SEQ ID NO: 4126167 - DNA, 15 bp, Homo sapiens
atccctcttgtaagt

SEQ ID NO: 4126168 - DNA, 22 bp, Homo sapiens
atccctgaatcccccttgccac

SEQ ID NO: 4126169 - DNA, 22 bp, Homo sapiens
atccctgatggcagaactccca

SEQ ID NO: 4126170 - DNA, 22 bp, Homo sapiens
atccctggagcaggagccccgc

SEQ ID NO: 4126171 - DNA, 16 bp, Homo sapiens
atccctgggcattgct

SEQ ID NO: 4126172 - DNA, 18 bp, Homo sapiens
atccctgggcattgcttt

SEQ ID NO: 4126173 - DNA, 11 bp, Homo sapiens
atccctgggcc

SEQ ID NO: 4126174 - DNA, 15 bp, Homo sapiens
atccctgggcccctc

SEQ ID NO: 4126175 - DNA, 17 bp, Homo sapiens
atccctgggcccctcca

SEQ ID NO: 4126176 - DNA, 16 bp, Homo sapiens
atccctggggctgtgc

SEQ ID NO: 4126177 - DNA, 18 bp, Homo sapiens
atccctggggctgtgcat

SEQ ID NO: 4126178 - DNA, 12 bp, Homo sapiens
atccctgtcctc

SEQ ID NO: 4126179 - DNA, 13 bp, Homo sapiens
atccctgtttaat

SEQ ID NO: 4126180 - DNA, 15 bp, Homo sapiens
atccctgtttaatat

SEQ ID NO: 4126181 - DNA, 18 bp, Homo sapiens
atccctgtttaatattta

SEQ ID NO: 4126182 - DNA, 20 bp, Homo sapiens
atcccttcccacatgcctgc

SEQ ID NO: 4126183 - DNA, 19 bp, Homo sapiens
atcccttccttttagccta

SEQ ID NO: 4126184 - DNA, 21 bp, Homo sapiens
atcccttccttttagcctagt

SEQ ID NO: 4126185 - DNA, 13 bp, Homo sapiens
atcccttctcttc

SEQ ID NO: 4126186 - DNA, 16 bp, Homo sapiens
atccctttcccttggt

SEQ ID NO: 4126187 - DNA, 22 bp, Homo sapiens
atccggcaacatcaacccgagt

SEQ ID NO: 4126188 - DNA, 16 bp, Homo sapiens
atccggggccagctcc

SEQ ID NO: 4126189 - DNA, 21 bp, Homo sapiens
atccggtggcctattccagga

SEQ ID NO: 4126190 - DNA, 23 bp, Homo sapiens
atccggtttagtcatccaacaag

SEQ ID NO: 4126191 - DNA, 12 bp, Homo sapiens
atcctaagaaat

SEQ ID NO: 4126192 - DNA, 15 bp, Homo sapiens
atcctaagaaatatg

SEQ ID NO: 4126193 - DNA, 16 bp, Homo sapiens
atcctaagaaatatgt

SEQ ID NO: 4126194 - DNA, 20 bp, Homo sapiens
atcctaagaaatatgtgaga

SEQ ID NO: 4126195 - DNA, 18 bp, Homo sapiens
atcctaatttctcctccc

SEQ ID NO: 4126196 - DNA, 24 bp, Homo sapiens
atcctacgagtaattgcatttgct

SEQ ID NO: 4126197 - DNA, 18 bp, Homo sapiens
atcctattctcaccagga

SEQ ID NO: 4126198 - DNA, 20 bp, Homo sapiens
atcctattctcaccaggaag

SEQ ID NO: 4126199 - DNA, 20 bp, Homo sapiens
atcctcaaacgacagaggag

SEQ ID NO: 4126200 - DNA, 15 bp, Homo sapiens
atcctcactgggtgg

SEQ ID NO: 4126201 - DNA, 21 bp, Homo sapiens
atcctccagagaaacccaggg

SEQ ID NO: 4126202 - DNA, 21 bp, Homo sapiens
atcctccagtaccttgcttct

SEQ ID NO: 4126203 - DNA, 17 bp, Homo sapiens
atcctccctccacctca

SEQ ID NO: 4126204 - DNA, 16 bp, Homo sapiens
atcctccgtccagccg

SEQ ID NO: 4126205 - DNA, 12 bp, Homo sapiens
atcctcctgcct

SEQ ID NO: 4126206 - DNA, 13 bp, Homo sapiens
atcctcctgcctc

SEQ ID NO: 4126207 - DNA, 20 bp, Homo sapiens
atcctcctgcctcagccttc

SEQ ID NO: 4126208 - DNA, 14 bp, Homo sapiens
atcctcctggaacc

SEQ ID NO: 4126209 - DNA, 21 bp, Homo sapiens
atcctcctggaaccttgctgt

SEQ ID NO: 4126210 - DNA, 16 bp, Homo sapiens
atcctctaaagcagag

SEQ ID NO: 4126211 - DNA, 12 bp, Homo sapiens
atcctctatttt

SEQ ID NO: 4126212 - DNA, 17 bp, Homo sapiens
atcctctccccctcctc

SEQ ID NO: 4126213 - DNA, 20 bp, Homo sapiens
atcctctccccctcctccag

SEQ ID NO: 4126214 - DNA, 21 bp, Homo sapiens
atcctctccccctcctccagg

SEQ ID NO: 4126215 - DNA, 15 bp, Homo sapiens
atcctctcctttctt

SEQ ID NO: 4126216 - DNA, 17 bp, Homo sapiens
atcctgccagccccaca

SEQ ID NO: 4126217 - DNA, 21 bp, Homo sapiens
atcctgccagccccacacagc

SEQ ID NO: 4126218 - DNA, 22 bp, Homo sapiens
atcctgcccagtgttgtttgta

SEQ ID NO: 4126219 - DNA, 17 bp, Homo sapiens
atcctgccttcatggaa

SEQ ID NO: 4126220 - DNA, 21 bp, Homo sapiens
atcctgccttcatggaactca

SEQ ID NO: 4126221 - DNA, 13 bp, Homo sapiens
atcctgctaagtt

SEQ ID NO: 4126222 - DNA, 14 bp, Homo sapiens
atcctgctgctgtg

SEQ ID NO: 4126223 - DNA, 14 bp, Homo sapiens
atcctggtttcata

SEQ ID NO: 4126224 - DNA, 16 bp, Homo sapiens
atcctgtaccaaatct

SEQ ID NO: 4126225 - DNA, 23 bp, Homo sapiens
atcctgtaccaaatctgacatat

SEQ ID NO: 4126226 - DNA, 23 bp, Homo sapiens
atcctgtataagcactgaaaaac

SEQ ID NO: 4126227 - DNA, 16 bp, Homo sapiens
atcctgtgacatgtaa

SEQ ID NO: 4126228 - DNA, 14 bp, Homo sapiens
atcctgtttataat

SEQ ID NO: 4126229 - DNA, 16 bp, Homo sapiens
atccttatcagagcta

SEQ ID NO: 4126230 - DNA, 21 bp, Homo sapiens
atccttcaccagagcccatgc

SEQ ID NO: 4126231 - DNA, 18 bp, Homo sapiens
atccttccaaaaattatt

SEQ ID NO: 4126232 - DNA, 23 bp, Homo sapiens
atccttccaaaaattattataag

SEQ ID NO: 4126233 - DNA, 18 bp, Homo sapiens
atccttccaaagaattct

SEQ ID NO: 4126234 - DNA, 20 bp, Homo sapiens
atccttccaaagaattctta

SEQ ID NO: 4126235 - DNA, 22 bp, Homo sapiens
atccttccaaagaattcttata

SEQ ID NO: 4126236 - DNA, 16 bp, Homo sapiens
atccttccctttggag

SEQ ID NO: 4126237 - DNA, 17 bp, Homo sapiens
atccttccctttggaga

SEQ ID NO: 4126238 - DNA, 21 bp, Homo sapiens
atccttccctttggagatgct

SEQ ID NO: 4126239 - DNA, 16 bp, Homo sapiens
atccttccgccaatct

SEQ ID NO: 4126240 - DNA, 19 bp, Homo sapiens
atccttcgggtgctggaag

SEQ ID NO: 4126241 - DNA, 19 bp, Homo sapiens
atccttcgtgaacatcccc

SEQ ID NO: 4126242 - DNA, 14 bp, Homo sapiens
atccttctttgtaa

SEQ ID NO: 4126243 - DNA, 16 bp, Homo sapiens
atccttgactggacct

SEQ ID NO: 4126244 - DNA, 17 bp, Homo sapiens
atccttgggggctccca

SEQ ID NO: 4126245 - DNA, 15 bp, Homo sapiens
atccttggtctttgt

SEQ ID NO: 4126246 - DNA, 18 bp, Homo sapiens
atccttggtctttgtatc

SEQ ID NO: 4126247 - DNA, 19 bp, Homo sapiens
atccttggtctttgtatct

SEQ ID NO: 4126248 - DNA, 16 bp, Homo sapiens
atcctttctgccgacc

SEQ ID NO: 4126249 - DNA, 16 bp, Homo sapiens
atcctttgcagggcag

SEQ ID NO: 4126250 - DNA, 21 bp, Homo sapiens
atcctttgttttctgactaat

SEQ ID NO: 4126251 - DNA, 20 bp, Homo sapiens
atccttttccttatttgcct

SEQ ID NO: 4126252 - DNA, 15 bp, Homo sapiens
atcctttttctttat

SEQ ID NO: 4126253 - DNA, 13 bp, Homo sapiens
atcgaaataacaa

SEQ ID NO: 4126254 - DNA, 22 bp, Homo sapiens
atcgaaataacaatgttaagga

SEQ ID NO: 4126255 - DNA, 23 bp, Homo sapiens
atcgaaataacaatgttaaggaa

SEQ ID NO: 4126256 - DNA, 18 bp, Homo sapiens
atcgaatctactaattcc

SEQ ID NO: 4126257 - DNA, 17 bp, Homo sapiens
atcgagttggcaaaatg

SEQ ID NO: 4126258 - DNA, 15 bp, Homo sapiens
atcgctgacttcatg

SEQ ID NO: 4126259 - DNA, 21 bp, Homo sapiens
atcgctttatgtttttggtta

SEQ ID NO: 4126260 - DNA, 18 bp, Homo sapiens
atcggaagcagtgccttc

SEQ ID NO: 4126261 - DNA, 22 bp, Homo sapiens
atcggaagcagtgccttccata

SEQ ID NO: 4126262 - DNA, 17 bp, Homo sapiens
atcggactctgcccctg

SEQ ID NO: 4126263 - DNA, 13 bp, Homo sapiens
atcggagacagtg

SEQ ID NO: 4126264 - DNA, 15 bp, Homo sapiens
atcggagcctcctct

SEQ ID NO: 4126265 - DNA, 16 bp, Homo sapiens
atcgggaacagtgttt

SEQ ID NO: 4126266 - DNA, 15 bp, Homo sapiens
atcgggagcacccag

SEQ ID NO: 4126267 - DNA, 18 bp, Homo sapiens
atcgggagcacccagagc

SEQ ID NO: 4126268 - DNA, 16 bp, Homo sapiens
atcgggagcagtgtct

SEQ ID NO: 4126269 - DNA, 22 bp, Homo sapiens
atcgttagtatctaacatgtat

SEQ ID NO: 4126270 - DNA, 23 bp, Homo sapiens
atctaaaaatagacttaaatctc

SEQ ID NO: 4126271 - DNA, 17 bp, Homo sapiens
atctaaagtgtgttgtt

SEQ ID NO: 4126272 - DNA, 23 bp, Homo sapiens
atctaaagtgtgttgttgcttta

SEQ ID NO: 4126273 - DNA, 22 bp, Homo sapiens
atctaaatctatttattaatat

SEQ ID NO: 4126274 - DNA, 16 bp, Homo sapiens
atctaaatctgtccaa

SEQ ID NO: 4126275 - DNA, 16 bp, Homo sapiens
atctaagcctttccat

SEQ ID NO: 4126276 - DNA, 18 bp, Homo sapiens
atctaagcctttccataa

SEQ ID NO: 4126277 - DNA, 14 bp, Homo sapiens
atctaagtgatata

SEQ ID NO: 4126278 - DNA, 17 bp, Homo sapiens
atctaatatatatgaat

SEQ ID NO: 4126279 - DNA, 18 bp, Homo sapiens
atctaatatatatgaata

SEQ ID NO: 4126280 - DNA, 22 bp, Homo sapiens
atctaatatatatgaataaagt

SEQ ID NO: 4126281 - DNA, 23 bp, Homo sapiens
atctaatgcttgtttatgatatt

SEQ ID NO: 4126282 - DNA, 16 bp, Homo sapiens
atctaattattttgca

SEQ ID NO: 4126283 - DNA, 12 bp, Homo sapiens
atctacaagcca

SEQ ID NO: 4126284 - DNA, 18 bp, Homo sapiens
atctacaatcagttgact

SEQ ID NO: 4126285 - DNA, 13 bp, Homo sapiens
atctacacagcct

SEQ ID NO: 4126286 - DNA, 22 bp, Homo sapiens
atctacacagcctggactttgg

SEQ ID NO: 4126287 - DNA, 17 bp, Homo sapiens
atctacagatccttttt

SEQ ID NO: 4126288 - DNA, 21 bp, Homo sapiens
atctacagatcctttttccat

SEQ ID NO: 4126289 - DNA, 22 bp, Homo sapiens
atctacagatcctttttccatc

SEQ ID NO: 4126290 - DNA, 23 bp, Homo sapiens
atctacagatcctttttccatca

SEQ ID NO: 4126291 - DNA, 14 bp, Homo sapiens
atctaccttttctg

SEQ ID NO: 4126292 - DNA, 19 bp, Homo sapiens
atctagattatggagcttt

SEQ ID NO: 4126293 - DNA, 22 bp, Homo sapiens
atctagcaatcacaacactggc

SEQ ID NO: 4126294 - DNA, 12 bp, Homo sapiens
atctagccagcc

SEQ ID NO: 4126295 - DNA, 15 bp, Homo sapiens
atctagctagtaata

SEQ ID NO: 4126296 - DNA, 15 bp, Homo sapiens
atctaggtgtggctg

SEQ ID NO: 4126297 - DNA, 19 bp, Homo sapiens
atctaggtgtggctgtgaa

SEQ ID NO: 4126298 - DNA, 14 bp, Homo sapiens
atctagtgcagctg

SEQ ID NO: 4126299 - DNA, 17 bp, Homo sapiens
atctagtgcagctgatt

SEQ ID NO: 4126300 - DNA, 18 bp, Homo sapiens
atctagtgcagctgattt

SEQ ID NO: 4126301 - DNA, 21 bp, Homo sapiens
atctataaagcgatatacaga

SEQ ID NO: 4126302 - DNA, 16 bp, Homo sapiens
atctatacatatcttt

SEQ ID NO: 4126303 - DNA, 13 bp, Homo sapiens
atctatgaggaaa

SEQ ID NO: 4126304 - DNA, 14 bp, Homo sapiens
atctattaaagtga

SEQ ID NO: 4126305 - DNA, 16 bp, Homo sapiens
atctattaaagtgact

SEQ ID NO: 4126306 - DNA, 17 bp, Homo sapiens
atctattaaagtgactt

SEQ ID NO: 4126307 - DNA, 12 bp, Homo sapiens
atctattaatat

SEQ ID NO: 4126308 - DNA, 15 bp, Homo sapiens
atctattcagacaag

SEQ ID NO: 4126309 - DNA, 22 bp, Homo sapiens
atctattcagacaagcaacagg

SEQ ID NO: 4126310 - DNA, 22 bp, Homo sapiens
atctattgggttcattattgga

SEQ ID NO: 4126311 - DNA, 17 bp, Homo sapiens
atctatttcacttattt

SEQ ID NO: 4126312 - DNA, 23 bp, Homo sapiens
atctcaagatgggggcagggctg

SEQ ID NO: 4126313 - DNA, 13 bp, Homo sapiens
atctcaccccatc

SEQ ID NO: 4126314 - DNA, 16 bp, Homo sapiens
atctcacttagtcctt

SEQ ID NO: 4126315 - DNA, 12 bp, Homo sapiens
atctcagaaagt

SEQ ID NO: 4126316 - DNA, 18 bp, Homo sapiens
atctcagaaagtgcctga

SEQ ID NO: 4126317 - DNA, 20 bp, Homo sapiens
atctcagaaagtgcctgaca

SEQ ID NO: 4126318 - DNA, 16 bp, Homo sapiens
atctcagcctcctgag

SEQ ID NO: 4126319 - DNA, 14 bp, Homo sapiens
atctcaggagatgg

SEQ ID NO: 4126320 - DNA, 15 bp, Homo sapiens
atctcaggggccaga

SEQ ID NO: 4126321 - DNA, 16 bp, Homo sapiens
atctcatcaacaaaga

SEQ ID NO: 4126322 - DNA, 21 bp, Homo sapiens
atctcatctgccggcccccag

SEQ ID NO: 4126323 - DNA, 23 bp, Homo sapiens
atctcatctgccggcccccagga

SEQ ID NO: 4126324 - DNA, 21 bp, Homo sapiens
atctcatgcccctggctggga

SEQ ID NO: 4126325 - DNA, 17 bp, Homo sapiens
atctcattgcttacaag

SEQ ID NO: 4126326 - DNA, 16 bp, Homo sapiens
atctccaaggaccagg

SEQ ID NO: 4126327 - DNA, 18 bp, Homo sapiens
atctccaaggcagggacc

SEQ ID NO: 4126328 - DNA, 16 bp, Homo sapiens
atctccagggagcaag

SEQ ID NO: 4126329 - DNA, 15 bp, Homo sapiens
atctccatctgtcaa

SEQ ID NO: 4126330 - DNA, 14 bp, Homo sapiens
atctccatggccct

SEQ ID NO: 4126331 - DNA, 22 bp, Homo sapiens
atctccattgtgcctaagtcca

SEQ ID NO: 4126332 - DNA, 20 bp, Homo sapiens
atctcccacctagcagcacc

SEQ ID NO: 4126333 - DNA, 18 bp, Homo sapiens
atctccctgcctggcccc

SEQ ID NO: 4126334 - DNA, 16 bp, Homo sapiens
atctcctgctcaccac

SEQ ID NO: 4126335 - DNA, 19 bp, Homo sapiens
atctcctgctcaccacctg

SEQ ID NO: 4126336 - DNA, 19 bp, Homo sapiens
atctcctgtcttttcaggt

SEQ ID NO: 4126337 - DNA, 14 bp, Homo sapiens
atctcctgtgcatg

SEQ ID NO: 4126338 - DNA, 17 bp, Homo sapiens
atctccttcccacccct

SEQ ID NO: 4126339 - DNA, 18 bp, Homo sapiens
atctcgggagtcctctag

SEQ ID NO: 4126340 - DNA, 15 bp, Homo sapiens
atctcgtgggagagc

SEQ ID NO: 4126341 - DNA, 13 bp, Homo sapiens
atctcgttcccaa

SEQ ID NO: 4126342 - DNA, 23 bp, Homo sapiens
atctcgtttttcttcttaagact

SEQ ID NO: 4126343 - DNA, 18 bp, Homo sapiens
atctctagaattttaagt

SEQ ID NO: 4126344 - DNA, 21 bp, Homo sapiens
atctctaggatgtcgtctttg

SEQ ID NO: 4126345 - DNA, 17 bp, Homo sapiens
atctctcaggagcacag

SEQ ID NO: 4126346 - DNA, 16 bp, Homo sapiens
atctctcatcctccag

SEQ ID NO: 4126347 - DNA, 17 bp, Homo sapiens
atctctcatcctccagt

SEQ ID NO: 4126348 - DNA, 15 bp, Homo sapiens
atctctccctcccct

SEQ ID NO: 4126349 - DNA, 14 bp, Homo sapiens
atctctcctggcct

SEQ ID NO: 4126350 - DNA, 22 bp, Homo sapiens
atctctcctggcctatccgctg

SEQ ID NO: 4126351 - DNA, 17 bp, Homo sapiens
atctctctagctttgtc

SEQ ID NO: 4126352 - DNA, 22 bp, Homo sapiens
atctctctgaatcctaagggct

SEQ ID NO: 4126353 - DNA, 14 bp, Homo sapiens
atctctctgcagct

SEQ ID NO: 4126354 - DNA, 15 bp, Homo sapiens
atctctctgcagctg

SEQ ID NO: 4126355 - DNA, 16 bp, Homo sapiens
atctctctgcagctgc

SEQ ID NO: 4126356 - DNA, 14 bp, Homo sapiens
atctctctgcccaa

SEQ ID NO: 4126357 - DNA, 22 bp, Homo sapiens
atctctctggggccctgggcct

SEQ ID NO: 4126358 - DNA, 20 bp, Homo sapiens
atctctgcaccctggggcct

SEQ ID NO: 4126359 - DNA, 23 bp, Homo sapiens
atctctgcaccctggggcctgga

SEQ ID NO: 4126360 - DNA, 18 bp, Homo sapiens
atctctgtactttgcttg

SEQ ID NO: 4126361 - DNA, 19 bp, Homo sapiens
atctcttattttacaataa

SEQ ID NO: 4126362 - DNA, 15 bp, Homo sapiens
atctcttccccagag

SEQ ID NO: 4126363 - DNA, 16 bp, Homo sapiens
atctcttccccagaga

SEQ ID NO: 4126364 - DNA, 13 bp, Homo sapiens
atctctttcacat

SEQ ID NO: 4126365 - DNA, 13 bp, Homo sapiens
atctgaaaactgg

SEQ ID NO: 4126366 - DNA, 12 bp, Homo sapiens
atctgaaaatgt

SEQ ID NO: 4126367 - DNA, 16 bp, Homo sapiens
atctgaaaatgtatgt

SEQ ID NO: 4126368 - DNA, 23 bp, Homo sapiens
atctgaaaatgtatgtgtaagta

SEQ ID NO: 4126369 - DNA, 13 bp, Homo sapiens
atctgaaattcta

SEQ ID NO: 4126370 - DNA, 23 bp, Homo sapiens
atctgaagagtatccttccttca

SEQ ID NO: 4126371 - DNA, 17 bp, Homo sapiens
atctgaagatatatttc

SEQ ID NO: 4126372 - DNA, 19 bp, Homo sapiens
atctgaagatatatttcac

SEQ ID NO: 4126373 - DNA, 21 bp, Homo sapiens
atctgaataaagtgtaacaat

SEQ ID NO: 4126374 - DNA, 17 bp, Homo sapiens
atctgaattaaataaat

SEQ ID NO: 4126375 - DNA, 18 bp, Homo sapiens
atctgaattaaataaata

SEQ ID NO: 4126376 - DNA, 17 bp, Homo sapiens
atctgacatattatgcc

SEQ ID NO: 4126377 - DNA, 18 bp, Homo sapiens
atctgacatattatgcct

SEQ ID NO: 4126378 - DNA, 12 bp, Homo sapiens
atctgacccagt

SEQ ID NO: 4126379 - DNA, 13 bp, Homo sapiens
atctgacccagtg

SEQ ID NO: 4126380 - DNA, 14 bp, Homo sapiens
atctgacccagtgc

SEQ ID NO: 4126381 - DNA, 15 bp, Homo sapiens
atctgagccagtgct

SEQ ID NO: 4126382 - DNA, 18 bp, Homo sapiens
atctgagctgcagcctgg

SEQ ID NO: 4126383 - DNA, 21 bp, Homo sapiens
atctgatggccttaatttcct

SEQ ID NO: 4126384 - DNA, 23 bp, Homo sapiens
atctgatggccttaatttccttt

SEQ ID NO: 4126385 - DNA, 21 bp, Homo sapiens
atctgcaaaaggcctcttgta

SEQ ID NO: 4126386 - DNA, 13 bp, Homo sapiens
atctgcacactcc

SEQ ID NO: 4126387 - DNA, 14 bp, Homo sapiens
atctgcacactcca

SEQ ID NO: 4126388 - DNA, 19 bp, Homo sapiens
atctgcacactccaggcct

SEQ ID NO: 4126389 - DNA, 22 bp, Homo sapiens
atctgcaccccttctctcctcc

SEQ ID NO: 4126390 - DNA, 23 bp, Homo sapiens
atctgcaccccttctctcctccc

SEQ ID NO: 4126391 - DNA, 19 bp, Homo sapiens
atctgcactctaaactgca

SEQ ID NO: 4126392 - DNA, 22 bp, Homo sapiens
atctgcagaacatcgatatgta

SEQ ID NO: 4126393 - DNA, 17 bp, Homo sapiens
atctgcagtacagtctt

SEQ ID NO: 4126394 - DNA, 15 bp, Homo sapiens
atctgcattatctat

SEQ ID NO: 4126395 - DNA, 23 bp, Homo sapiens
atctgcattttcaccccaccctt

SEQ ID NO: 4126396 - DNA, 13 bp, Homo sapiens
atctgccagacct

SEQ ID NO: 4126397 - DNA, 16 bp, Homo sapiens
atctgccagaccttaa

SEQ ID NO: 4126398 - DNA, 11 bp, Homo sapiens
atctgcccctc

SEQ ID NO: 4126399 - DNA, 12 bp, Homo sapiens
atctgcccctcc

SEQ ID NO: 4126400 - DNA, 15 bp, Homo sapiens
atctgcccctccccc

SEQ ID NO: 4126401 - DNA, 16 bp, Homo sapiens
atctgccggcccccag

SEQ ID NO: 4126402 - DNA, 17 bp, Homo sapiens
atctgccggcccccagg

SEQ ID NO: 4126403 - DNA, 19 bp, Homo sapiens
atctgccggcccccaggac

SEQ ID NO: 4126404 - DNA, 18 bp, Homo sapiens
atctgccttaaaaccaaa

SEQ ID NO: 4126405 - DNA, 17 bp, Homo sapiens
atctgcgtgacaataaa

SEQ ID NO: 4126406 - DNA, 13 bp, Homo sapiens
atctgctcacttt

SEQ ID NO: 4126407 - DNA, 21 bp, Homo sapiens
atctgctgcatagctctattt

SEQ ID NO: 4126408 - DNA, 14 bp, Homo sapiens
atctgctggagttt

SEQ ID NO: 4126409 - DNA, 14 bp, Homo sapiens
atctggaacccaga

SEQ ID NO: 4126410 - DNA, 14 bp, Homo sapiens
atctggaagaaaaa

SEQ ID NO: 4126411 - DNA, 13 bp, Homo sapiens
atctggaagagct

SEQ ID NO: 4126412 - DNA, 21 bp, Homo sapiens
atctggaatctggagaccagg

SEQ ID NO: 4126413 - DNA, 20 bp, Homo sapiens
atctggaccccaaagaatag

SEQ ID NO: 4126414 - DNA, 17 bp, Homo sapiens
atctggaggccttccag

SEQ ID NO: 4126415 - DNA, 23 bp, Homo sapiens
atctggaggccttccagctgctg

SEQ ID NO: 4126416 - DNA, 21 bp, Homo sapiens
atctggataggagcctgctgg

SEQ ID NO: 4126417 - DNA, 14 bp, Homo sapiens
atctggcccttaca

SEQ ID NO: 4126418 - DNA, 18 bp, Homo sapiens
atctggcctaaaatcttg

SEQ ID NO: 4126419 - DNA, 19 bp, Homo sapiens
atctggcctaaaatcttgg

SEQ ID NO: 4126420 - DNA, 22 bp, Homo sapiens
atctgggcattttcctcctctg

SEQ ID NO: 4126421 - DNA, 24 bp, Homo sapiens
atctgggcattttcctcctctgcc

SEQ ID NO: 4126422 - DNA, 21 bp, Homo sapiens
atctgggcttatatgtacttt

SEQ ID NO: 4126423 - DNA, 19 bp, Homo sapiens
atctggggttggcaacagg

SEQ ID NO: 4126424 - DNA, 22 bp, Homo sapiens
atctggtcaagttgagattttt

SEQ ID NO: 4126425 - DNA, 17 bp, Homo sapiens
atctggtcccttgcagc

SEQ ID NO: 4126426 - DNA, 18 bp, Homo sapiens
atctggtcttgttagaaa

SEQ ID NO: 4126427 - DNA, 14 bp, Homo sapiens
atctggtgatctcc

SEQ ID NO: 4126428 - DNA, 15 bp, Homo sapiens
atctggtgttgggga

SEQ ID NO: 4126429 - DNA, 18 bp, Homo sapiens
atctgtaatggtactgac

SEQ ID NO: 4126430 - DNA, 12 bp, Homo sapiens
atctgtagatac

SEQ ID NO: 4126431 - DNA, 22 bp, Homo sapiens
atctgtagatactagctatcta

SEQ ID NO: 4126432 - DNA, 17 bp, Homo sapiens
atctgtagggctggacc

SEQ ID NO: 4126433 - DNA, 21 bp, Homo sapiens
atctgtataaatgtctattat

SEQ ID NO: 4126434 - DNA, 21 bp, Homo sapiens
atctgtcatatagtaaacact

SEQ ID NO: 4126435 - DNA, 19 bp, Homo sapiens
atctgtcatctctctgggg

SEQ ID NO: 4126436 - DNA, 18 bp, Homo sapiens
atctgtccaaaggaggct

SEQ ID NO: 4126437 - DNA, 23 bp, Homo sapiens
atctgtccaaaggaggctggcag

SEQ ID NO: 4126438 - DNA, 21 bp, Homo sapiens
atctgtccatggcctttctaa

SEQ ID NO: 4126439 - DNA, 16 bp, Homo sapiens
atctgtccgtggaaaa

SEQ ID NO: 4126440 - DNA, 21 bp, Homo sapiens
atctgtccgtggaaaatttca

SEQ ID NO: 4126441 - DNA, 11 bp, Homo sapiens
atctgtctgct

SEQ ID NO: 4126442 - DNA, 20 bp, Homo sapiens
atctgtgaagaaagaggtta

SEQ ID NO: 4126443 - DNA, 18 bp, Homo sapiens
atctgtgaggtgctgatg

SEQ ID NO: 4126444 - DNA, 15 bp, Homo sapiens
atctgtgcagggctg

SEQ ID NO: 4126445 - DNA, 17 bp, Homo sapiens
atctgtgcagggctggt

SEQ ID NO: 4126446 - DNA, 12 bp, Homo sapiens
atctgtgcccca

SEQ ID NO: 4126447 - DNA, 23 bp, Homo sapiens
atctgtgccccatgcctgtccag

SEQ ID NO: 4126448 - DNA, 16 bp, Homo sapiens
atctgtgcgtgaaaca

SEQ ID NO: 4126449 - DNA, 17 bp, Homo sapiens
atctgtgcgtgaaacac

SEQ ID NO: 4126450 - DNA, 16 bp, Homo sapiens
atctgtgtttttgaaa

SEQ ID NO: 4126451 - DNA, 18 bp, Homo sapiens
atctgtgtttttgaaata

SEQ ID NO: 4126452 - DNA, 21 bp, Homo sapiens
atctgtgtttttgaaatatta

SEQ ID NO: 4126453 - DNA, 17 bp, Homo sapiens
atctgttagggccttgg

SEQ ID NO: 4126454 - DNA, 16 bp, Homo sapiens
atctgttctaacatgt

SEQ ID NO: 4126455 - DNA, 20 bp, Homo sapiens
atctgttctgggctctttcc

SEQ ID NO: 4126456 - DNA, 22 bp, Homo sapiens
atctgtttaaagcatatagaga

SEQ ID NO: 4126457 - DNA, 17 bp, Homo sapiens
atcttaaagatcgtgta

SEQ ID NO: 4126458 - DNA, 19 bp, Homo sapiens
atcttaaagtgtgtttcta

SEQ ID NO: 4126459 - DNA, 15 bp, Homo sapiens
atcttaaatcagaat

SEQ ID NO: 4126460 - DNA, 19 bp, Homo sapiens
atcttaaatcagaataaat

SEQ ID NO: 4126461 - DNA, 20 bp, Homo sapiens
atcttaaatcagaataaatt

SEQ ID NO: 4126462 - DNA, 14 bp, Homo sapiens
atcttaagttctat

SEQ ID NO: 4126463 - DNA, 15 bp, Homo sapiens
atcttaatttattat

SEQ ID NO: 4126464 - DNA, 21 bp, Homo sapiens
atcttacaagatattgatgat

SEQ ID NO: 4126465 - DNA, 18 bp, Homo sapiens
atcttagatgtttcacac

SEQ ID NO: 4126466 - DNA, 19 bp, Homo sapiens
atcttagcatagcttatta

SEQ ID NO: 4126467 - DNA, 20 bp, Homo sapiens
atcttaggggagagctttct

SEQ ID NO: 4126468 - DNA, 18 bp, Homo sapiens
atcttagttacatttcta

SEQ ID NO: 4126469 - DNA, 22 bp, Homo sapiens
atcttattagggagaaaattca

SEQ ID NO: 4126470 - DNA, 13 bp, Homo sapiens
atcttattcacat

SEQ ID NO: 4126471 - DNA, 13 bp, Homo sapiens
atcttatttagga

SEQ ID NO: 4126472 - DNA, 23 bp, Homo sapiens
atcttattttcatgtatatgtgt

SEQ ID NO: 4126473 - DNA, 17 bp, Homo sapiens
atcttcactagaagccg

SEQ ID NO: 4126474 - DNA, 22 bp, Homo sapiens
atcttcactgcaattttgtgta

SEQ ID NO: 4126475 - DNA, 23 bp, Homo sapiens
atcttcacttctaaatgcatatc

SEQ ID NO: 4126476 - DNA, 20 bp, Homo sapiens
atcttcagttttatctttaa

SEQ ID NO: 4126477 - DNA, 17 bp, Homo sapiens
atcttccatatttggaa

SEQ ID NO: 4126478 - DNA, 14 bp, Homo sapiens
atcttcctgtgtcc

SEQ ID NO: 4126479 - DNA, 15 bp, Homo sapiens
atcttcctgtgtcct

SEQ ID NO: 4126480 - DNA, 17 bp, Homo sapiens
atcttccttgtgaggat

SEQ ID NO: 4126481 - DNA, 17 bp, Homo sapiens
atcttctctttgacaat

SEQ ID NO: 4126482 - DNA, 17 bp, Homo sapiens
atcttctgcaattgctt

SEQ ID NO: 4126483 - DNA, 21 bp, Homo sapiens
atcttctgccttagtctcagt

SEQ ID NO: 4126484 - DNA, 16 bp, Homo sapiens
atcttctgtgaaatat

SEQ ID NO: 4126485 - DNA, 16 bp, Homo sapiens
atcttcttcaaataca

SEQ ID NO: 4126486 - DNA, 22 bp, Homo sapiens
atcttcttcaaatacaaagtaa

SEQ ID NO: 4126487 - DNA, 23 bp, Homo sapiens
atcttcttcatccaacttccaag

SEQ ID NO: 4126488 - DNA, 12 bp, Homo sapiens
atcttgaaatta

SEQ ID NO: 4126489 - DNA, 22 bp, Homo sapiens
atcttgaaattaagaaggcaaa

SEQ ID NO: 4126490 - DNA, 23 bp, Homo sapiens
atcttgaaattaagaaggcaaaa

SEQ ID NO: 4126491 - DNA, 12 bp, Homo sapiens
atcttgaatgtg

SEQ ID NO: 4126492 - DNA, 19 bp, Homo sapiens
atcttgaatgtggtctcag

SEQ ID NO: 4126493 - DNA, 24 bp, Homo sapiens
atcttgcaccccaaagctttcctg

SEQ ID NO: 4126494 - DNA, 18 bp, Homo sapiens
atcttgcattcattttct

SEQ ID NO: 4126495 - DNA, 16 bp, Homo sapiens
atcttgccacatttct

SEQ ID NO: 4126496 - DNA, 16 bp, Homo sapiens
atcttgcctgtctggc

SEQ ID NO: 4126497 - DNA, 12 bp, Homo sapiens
atcttgctggct

SEQ ID NO: 4126498 - DNA, 22 bp, Homo sapiens
atcttgctttgtgtatctcatt

SEQ ID NO: 4126499 - DNA, 16 bp, Homo sapiens
atcttgtatacacata

SEQ ID NO: 4126500 - DNA, 23 bp, Homo sapiens
atcttgtgtgattaacttattta

SEQ ID NO: 4126501 - DNA, 22 bp, Homo sapiens
atcttgttttaagcaaatgcat

SEQ ID NO: 4126502 - DNA, 18 bp, Homo sapiens
atctttaaaaagcagtcc

SEQ ID NO: 4126503 - DNA, 17 bp, Homo sapiens
atctttacaaaactaca

SEQ ID NO: 4126504 - DNA, 21 bp, Homo sapiens
atctttacaaaactacatgag

SEQ ID NO: 4126505 - DNA, 13 bp, Homo sapiens
atctttattaatc

SEQ ID NO: 4126506 - DNA, 17 bp, Homo sapiens
atctttcacttgaaaga

SEQ ID NO: 4126507 - DNA, 12 bp, Homo sapiens
atctttcaggaa

SEQ ID NO: 4126508 - DNA, 17 bp, Homo sapiens
atctttcgataaacaac

SEQ ID NO: 4126509 - DNA, 22 bp, Homo sapiens
atctttctccttgaatatcttt

SEQ ID NO: 4126510 - DNA, 14 bp, Homo sapiens
atctttctttacct

SEQ ID NO: 4126511 - DNA, 18 bp, Homo sapiens
atctttctttacctgaga

SEQ ID NO: 4126512 - DNA, 20 bp, Homo sapiens
atctttctttacctgagacc

SEQ ID NO: 4126513 - DNA, 22 bp, Homo sapiens
atctttctttacctgagaccag

SEQ ID NO: 4126514 - DNA, 22 bp, Homo sapiens
atctttgaatttcttgattttt

SEQ ID NO: 4126515 - DNA, 14 bp, Homo sapiens
atctttgcgaaaag

SEQ ID NO: 4126516 - DNA, 18 bp, Homo sapiens
atctttgcgaaaagataa

SEQ ID NO: 4126517 - DNA, 14 bp, Homo sapiens
atctttgtgataat

SEQ ID NO: 4126518 - DNA, 17 bp, Homo sapiens
atcttttaaagtgttac

SEQ ID NO: 4126519 - DNA, 22 bp, Homo sapiens
atcttttacaactgcctcgaaa

SEQ ID NO: 4126520 - DNA, 17 bp, Homo sapiens
atcttttatgtttgaat

SEQ ID NO: 4126521 - DNA, 20 bp, Homo sapiens
atcttttatgtttgaatatg

SEQ ID NO: 4126522 - DNA, 21 bp, Homo sapiens
atcttttatgtttgaatatgg

SEQ ID NO: 4126523 - DNA, 19 bp, Homo sapiens
atctttttaacctctgttc

SEQ ID NO: 4126524 - DNA, 21 bp, Homo sapiens
atcttttttggaactaaagca

SEQ ID NO: 4126525 - DNA, 17 bp, Homo sapiens
atgaaaaatatttctga

SEQ ID NO: 4126526 - DNA, 13 bp, Homo sapiens
atgaaaaattctc

SEQ ID NO: 4126527 - DNA, 18 bp, Homo sapiens
atgaaaaatttaagcatt

SEQ ID NO: 4126528 - DNA, 21 bp, Homo sapiens
atgaaaaatttaagcattgtt

SEQ ID NO: 4126529 - DNA, 22 bp, Homo sapiens
atgaaaacattttatttttaaa

SEQ ID NO: 4126530 - DNA, 19 bp, Homo sapiens
atgaaaacgttttattgtg

SEQ ID NO: 4126531 - DNA, 16 bp, Homo sapiens
atgaaaactctttgct

SEQ ID NO: 4126532 - DNA, 13 bp, Homo sapiens
atgaaaagattta

SEQ ID NO: 4126533 - DNA, 13 bp, Homo sapiens
atgaaaatacaac

SEQ ID NO: 4126534 - DNA, 17 bp, Homo sapiens
atgaaaatacaacttaa

SEQ ID NO: 4126535 - DNA, 13 bp, Homo sapiens
atgaaaatttgag

SEQ ID NO: 4126536 - DNA, 14 bp, Homo sapiens
atgaaagaatatat

SEQ ID NO: 4126537 - DNA, 18 bp, Homo sapiens
atgaaagaatatatttat

SEQ ID NO: 4126538 - DNA, 13 bp, Homo sapiens
atgaaagactgta

SEQ ID NO: 4126539 - DNA, 12 bp, Homo sapiens
atgaaagcatgt

SEQ ID NO: 4126540 - DNA, 14 bp, Homo sapiens
atgaaaggtactat

SEQ ID NO: 4126541 - DNA, 16 bp, Homo sapiens
atgaaaggtttacatt

SEQ ID NO: 4126542 - DNA, 21 bp, Homo sapiens
atgaaaggtttacattgtcaa

SEQ ID NO: 4126543 - DNA, 15 bp, Homo sapiens
atgaaagtgacttta

SEQ ID NO: 4126544 - DNA, 20 bp, Homo sapiens
atgaaataactccttcttgt

SEQ ID NO: 4126545 - DNA, 19 bp, Homo sapiens
atgaaatacacaagtaaac

SEQ ID NO: 4126546 - DNA, 17 bp, Homo sapiens
atgaaatactatttaaa

SEQ ID NO: 4126547 - DNA, 13 bp, Homo sapiens
atgaaatatcaga

SEQ ID NO: 4126548 - DNA, 13 bp, Homo sapiens
atgaaatatgcat

SEQ ID NO: 4126549 - DNA, 15 bp, Homo sapiens
atgaaatatgcatct

SEQ ID NO: 4126550 - DNA, 19 bp, Homo sapiens
atgaaatccttgactggac

SEQ ID NO: 4126551 - DNA, 13 bp, Homo sapiens
atgaaatttgcaa

SEQ ID NO: 4126552 - DNA, 17 bp, Homo sapiens
atgaaatttgcaaaatc

SEQ ID NO: 4126553 - DNA, 17 bp, Homo sapiens
atgaacacccttagaaa

SEQ ID NO: 4126554 - DNA, 16 bp, Homo sapiens
atgaactcttaatcaa

SEQ ID NO: 4126555 - DNA, 14 bp, Homo sapiens
atgaactgaagttt

SEQ ID NO: 4126556 - DNA, 16 bp, Homo sapiens
atgaactgaagtttca

SEQ ID NO: 4126557 - DNA, 19 bp, Homo sapiens
atgaactgaagtttcacat

SEQ ID NO: 4126558 - DNA, 18 bp, Homo sapiens
atgaagagaagcaatttt

SEQ ID NO: 4126559 - DNA, 21 bp, Homo sapiens
atgaagatgtctaatagttat

SEQ ID NO: 4126560 - DNA, 14 bp, Homo sapiens
atgaagcaaggaag

SEQ ID NO: 4126561 - DNA, 23 bp, Homo sapiens
atgaagcaattagtctgaaactg

SEQ ID NO: 4126562 - DNA, 12 bp, Homo sapiens
atgaagccagct

SEQ ID NO: 4126563 - DNA, 12 bp, Homo sapiens
atgaagcccaag

SEQ ID NO: 4126564 - DNA, 15 bp, Homo sapiens
atgaagcccaagtga

SEQ ID NO: 4126565 - DNA, 20 bp, Homo sapiens
atgaagcctccttagaaaaa

SEQ ID NO: 4126566 - DNA, 17 bp, Homo sapiens
atgaagggaaaggatat

SEQ ID NO: 4126567 - DNA, 20 bp, Homo sapiens
atgaaggttaggatttaaca

SEQ ID NO: 4126568 - DNA, 14 bp, Homo sapiens
atgaagtatacttt

SEQ ID NO: 4126569 - DNA, 15 bp, Homo sapiens
atgaagtatactttt

SEQ ID NO: 4126570 - DNA, 16 bp, Homo sapiens
atgaagtatacttttc

SEQ ID NO: 4126571 - DNA, 20 bp, Homo sapiens
atgaagtgcgtgaatgtatg

SEQ ID NO: 4126572 - DNA, 16 bp, Homo sapiens
atgaagttttacattg

SEQ ID NO: 4126573 - DNA, 14 bp, Homo sapiens
atgaataaactgaa

SEQ ID NO: 4126574 - DNA, 17 bp, Homo sapiens
atgaataaagacaccta

SEQ ID NO: 4126575 - DNA, 15 bp, Homo sapiens
atgaataagcacttg

SEQ ID NO: 4126576 - DNA, 15 bp, Homo sapiens
atgaataatttccca

SEQ ID NO: 4126577 - DNA, 14 bp, Homo sapiens
atgaatacaaattt

SEQ ID NO: 4126578 - DNA, 17 bp, Homo sapiens
atgaatacgagcaagct

SEQ ID NO: 4126579 - DNA, 16 bp, Homo sapiens
atgaatcaatgaaaaa

SEQ ID NO: 4126580 - DNA, 17 bp, Homo sapiens
atgaatcaatgaaaaat

SEQ ID NO: 4126581 - DNA, 20 bp, Homo sapiens
atgaatctggtgttggggaa

SEQ ID NO: 4126582 - DNA, 23 bp, Homo sapiens
atgaatctgtctcccagttatga

SEQ ID NO: 4126583 - DNA, 20 bp, Homo sapiens
atgaatgaggtcccaggcag

SEQ ID NO: 4126584 - DNA, 13 bp, Homo sapiens
atgaatgcccagt

SEQ ID NO: 4126585 - DNA, 13 bp, Homo sapiens
atgaatgtatcag

SEQ ID NO: 4126586 - DNA, 17 bp, Homo sapiens
atgaatgtatgtgcact

SEQ ID NO: 4126587 - DNA, 19 bp, Homo sapiens
atgaatgtatgtgcactgt

SEQ ID NO: 4126588 - DNA, 22 bp, Homo sapiens
atgaatgtttacactctttgta

SEQ ID NO: 4126589 - DNA, 13 bp, Homo sapiens
atgaattaaattt

SEQ ID NO: 4126590 - DNA, 20 bp, Homo sapiens
atgaattcaagaaaggaaat

SEQ ID NO: 4126591 - DNA, 22 bp, Homo sapiens
atgaattcccttttaatcaact

SEQ ID NO: 4126592 - DNA, 13 bp, Homo sapiens
atgaattgcattt

SEQ ID NO: 4126593 - DNA, 14 bp, Homo sapiens
atgaattgtacaga

SEQ ID NO: 4126594 - DNA, 18 bp, Homo sapiens
atgaattttcaagtaatt

SEQ ID NO: 4126595 - DNA, 18 bp, Homo sapiens
atgaattttccacgcagt

SEQ ID NO: 4126596 - DNA, 21 bp, Homo sapiens
atgaattttccacgcagttct

SEQ ID NO: 4126597 - DNA, 16 bp, Homo sapiens
atgacaccctggcctg

SEQ ID NO: 4126598 - DNA, 21 bp, Homo sapiens
atgacactagaaaacttgact

SEQ ID NO: 4126599 - DNA, 22 bp, Homo sapiens
atgacagatatatttaagcctt

SEQ ID NO: 4126600 - DNA, 23 bp, Homo sapiens
atgacagatatatttaagcctta

SEQ ID NO: 4126601 - DNA, 21 bp, Homo sapiens
atgacattaaatgcaataatt

SEQ ID NO: 4126602 - DNA, 22 bp, Homo sapiens
atgacatttaaatgtaacttat

SEQ ID NO: 4126603 - DNA, 15 bp, Homo sapiens
atgaccaaagtcctt

SEQ ID NO: 4126604 - DNA, 12 bp, Homo sapiens
atgaccagaagc

SEQ ID NO: 4126605 - DNA, 14 bp, Homo sapiens
atgaccagggatgc

SEQ ID NO: 4126606 - DNA, 18 bp, Homo sapiens
atgaccagggatgctggg

SEQ ID NO: 4126607 - DNA, 22 bp, Homo sapiens
atgaccagggatgctgggctgg

SEQ ID NO: 4126608 - DNA, 18 bp, Homo sapiens
atgaccagtgataatgcc

SEQ ID NO: 4126609 - DNA, 20 bp, Homo sapiens
atgacccctcgtccaccccc

SEQ ID NO: 4126610 - DNA, 23 bp, Homo sapiens
atgacccctcgtccaccccccac

SEQ ID NO: 4126611 - DNA, 15 bp, Homo sapiens
atgacggaagaacat

SEQ ID NO: 4126612 - DNA, 13 bp, Homo sapiens
atgactaattagg

SEQ ID NO: 4126613 - DNA, 21 bp, Homo sapiens
atgactaattagggtacattt

SEQ ID NO: 4126614 - DNA, 17 bp, Homo sapiens
atgactatataatttat

SEQ ID NO: 4126615 - DNA, 22 bp, Homo sapiens
atgactatataatttatttcca

SEQ ID NO: 4126616 - DNA, 16 bp, Homo sapiens
atgactatgtaaacta

SEQ ID NO: 4126617 - DNA, 18 bp, Homo sapiens
atgactgcacccagctcc

SEQ ID NO: 4126618 - DNA, 22 bp, Homo sapiens
atgactgcacccagctccaggg

SEQ ID NO: 4126619 - DNA, 23 bp, Homo sapiens
atgactgctccccagccctggct

SEQ ID NO: 4126620 - DNA, 17 bp, Homo sapiens
atgactgtgaccacctt

SEQ ID NO: 4126621 - DNA, 11 bp, Homo sapiens
atgactgttga

SEQ ID NO: 4126622 - DNA, 18 bp, Homo sapiens
atgacttatttctgctct

SEQ ID NO: 4126623 - DNA, 21 bp, Homo sapiens
atgacttatttctgctctgga

SEQ ID NO: 4126624 - DNA, 13 bp, Homo sapiens
atgagaacaaaca

SEQ ID NO: 4126625 - DNA, 18 bp, Homo sapiens
atgagaagagggcctgtg

SEQ ID NO: 4126626 - DNA, 14 bp, Homo sapiens
atgagaagtacttg

SEQ ID NO: 4126627 - DNA, 22 bp, Homo sapiens
atgagaatttctaaaaagatta

SEQ ID NO: 4126628 - DNA, 19 bp, Homo sapiens
atgagaattttacttccat

SEQ ID NO: 4126629 - DNA, 21 bp, Homo sapiens
atgagaattttacttccatta

SEQ ID NO: 4126630 - DNA, 13 bp, Homo sapiens
atgagaattttat

SEQ ID NO: 4126631 - DNA, 15 bp, Homo sapiens
atgagactctagggt

SEQ ID NO: 4126632 - DNA, 17 bp, Homo sapiens
atgagactttctgctgg

SEQ ID NO: 4126633 - DNA, 14 bp, Homo sapiens
atgagagcccagag

SEQ ID NO: 4126634 - DNA, 20 bp, Homo sapiens
atgagaggggagagctgaac

SEQ ID NO: 4126635 - DNA, 22 bp, Homo sapiens
atgagatctaagcctttccata

SEQ ID NO: 4126636 - DNA, 23 bp, Homo sapiens
atgagatgatacatccaaagcag

SEQ ID NO: 4126637 - DNA, 22 bp, Homo sapiens
atgagcaaggacattgccccaa

SEQ ID NO: 4126638 - DNA, 19 bp, Homo sapiens
atgagccatcactagaaga

SEQ ID NO: 4126639 - DNA, 14 bp, Homo sapiens
atgagcccagagaa

SEQ ID NO: 4126640 - DNA, 14 bp, Homo sapiens
atgagccctaaaaa

SEQ ID NO: 4126641 - DNA, 11 bp, Homo sapiens
atgagcctgcc

SEQ ID NO: 4126642 - DNA, 13 bp, Homo sapiens
atgagcctgcccg

SEQ ID NO: 4126643 - DNA, 16 bp, Homo sapiens
atgagcctgcccgctg

SEQ ID NO: 4126644 - DNA, 22 bp, Homo sapiens
atgagctatttccattccagaa

SEQ ID NO: 4126645 - DNA, 23 bp, Homo sapiens
atgagctatttccattccagaat

SEQ ID NO: 4126646 - DNA, 11 bp, Homo sapiens
atgagctcctg

SEQ ID NO: 4126647 - DNA, 21 bp, Homo sapiens
atgagctcgcatttgtcaatg

SEQ ID NO: 4126648 - DNA, 12 bp, Homo sapiens
atgaggagacag

SEQ ID NO: 4126649 - DNA, 21 bp, Homo sapiens
atgaggaggatgtccctgggc

SEQ ID NO: 4126650 - DNA, 24 bp, Homo sapiens
atgaggaggatgtccctgggccag

SEQ ID NO: 4126651 - DNA, 12 bp, Homo sapiens
atgaggagggga

SEQ ID NO: 4126652 - DNA, 13 bp, Homo sapiens
atgaggaggggag

SEQ ID NO: 4126653 - DNA, 14 bp, Homo sapiens
atgaggaggggagg

SEQ ID NO: 4126654 - DNA, 18 bp, Homo sapiens
atgaggcaatgtcaggaa

SEQ ID NO: 4126655 - DNA, 21 bp, Homo sapiens
atgaggcaatgtcaggaacag

SEQ ID NO: 4126656 - DNA, 17 bp, Homo sapiens
atgaggccatctcagga

SEQ ID NO: 4126657 - DNA, 22 bp, Homo sapiens
atgaggccatctcaggagatgg

SEQ ID NO: 4126658 - DNA, 18 bp, Homo sapiens
atgagggacagggtcttt

SEQ ID NO: 4126659 - DNA, 20 bp, Homo sapiens
atgagggactggaaccaggg

SEQ ID NO: 4126660 - DNA, 12 bp, Homo sapiens
atgaggggagag

SEQ ID NO: 4126661 - DNA, 15 bp, Homo sapiens
atgaggtcccaggca

SEQ ID NO: 4126662 - DNA, 20 bp, Homo sapiens
atgaggtcccaggcagagaa

SEQ ID NO: 4126663 - DNA, 15 bp, Homo sapiens
atgaggtctgaaatg

SEQ ID NO: 4126664 - DNA, 13 bp, Homo sapiens
atgaggtctgttt

SEQ ID NO: 4126665 - DNA, 20 bp, Homo sapiens
atgaggtgttgtgcatttgt

SEQ ID NO: 4126666 - DNA, 22 bp, Homo sapiens
atgaggttcaactgttgattgc

SEQ ID NO: 4126667 - DNA, 14 bp, Homo sapiens
atgaggttctctct

SEQ ID NO: 4126668 - DNA, 22 bp, Homo sapiens
atgaggttctgagaccagtgta

SEQ ID NO: 4126669 - DNA, 16 bp, Homo sapiens
atgagtacaaatgcct

SEQ ID NO: 4126670 - DNA, 17 bp, Homo sapiens
atgagtcaatgtgcagt

SEQ ID NO: 4126671 - DNA, 16 bp, Homo sapiens
atgagtgaataaatgt

SEQ ID NO: 4126672 - DNA, 22 bp, Homo sapiens
atgagtgattgacacacagcac

SEQ ID NO: 4126673 - DNA, 22 bp, Homo sapiens
atgagtgtctgtgagaggcagc

SEQ ID NO: 4126674 - DNA, 15 bp, Homo sapiens
atgagttcttctcaa

SEQ ID NO: 4126675 - DNA, 20 bp, Homo sapiens
atgagttgtcagctttgact

SEQ ID NO: 4126676 - DNA, 20 bp, Homo sapiens
atgagttgtgatgaatcaat

SEQ ID NO: 4126677 - DNA, 19 bp, Homo sapiens
atgagtttttgatagcttt

SEQ ID NO: 4126678 - DNA, 21 bp, Homo sapiens
atgagtttttgatagctttat

SEQ ID NO: 4126679 - DNA, 19 bp, Homo sapiens
atgataaaataaataattt

SEQ ID NO: 4126680 - DNA, 20 bp, Homo sapiens
atgataacaccagtgggaat

SEQ ID NO: 4126681 - DNA, 20 bp, Homo sapiens
atgataagttcctttccttt

SEQ ID NO: 4126682 - DNA, 21 bp, Homo sapiens
atgatatgtaaacataattct

SEQ ID NO: 4126683 - DNA, 16 bp, Homo sapiens
atgatattgacactgt

SEQ ID NO: 4126684 - DNA, 17 bp, Homo sapiens
atgatattgacactgtc

SEQ ID NO: 4126685 - DNA, 14 bp, Homo sapiens
atgatattgtttaa

SEQ ID NO: 4126686 - DNA, 20 bp, Homo sapiens
atgatattgtttaaaattca

SEQ ID NO: 4126687 - DNA, 22 bp, Homo sapiens
atgatattgtttaaaattcagt

SEQ ID NO: 4126688 - DNA, 18 bp, Homo sapiens
atgatcagctgtttgtca

SEQ ID NO: 4126689 - DNA, 13 bp, Homo sapiens
atgatcagtgttg

SEQ ID NO: 4126690 - DNA, 12 bp, Homo sapiens
atgatccagaac

SEQ ID NO: 4126691 - DNA, 15 bp, Homo sapiens
atgatctactcagaa

SEQ ID NO: 4126692 - DNA, 19 bp, Homo sapiens
atgatctgcctctaaaagc

SEQ ID NO: 4126693 - DNA, 22 bp, Homo sapiens
atgatctgtatttaatggtttt

SEQ ID NO: 4126694 - DNA, 14 bp, Homo sapiens
atgatcttctttat

SEQ ID NO: 4126695 - DNA, 21 bp, Homo sapiens
atgatcttgagtataagaaat

SEQ ID NO: 4126696 - DNA, 15 bp, Homo sapiens
atgatgaatgagaat

SEQ ID NO: 4126697 - DNA, 19 bp, Homo sapiens
atgatgagaatttctaaaa

SEQ ID NO: 4126698 - DNA, 16 bp, Homo sapiens
atgatgattaaacacc

SEQ ID NO: 4126699 - DNA, 17 bp, Homo sapiens
atgatgattaaacacct

SEQ ID NO: 4126700 - DNA, 21 bp, Homo sapiens
atgatgtaatctctctgcagc

SEQ ID NO: 4126701 - DNA, 23 bp, Homo sapiens
atgatgtggtgcctgaggtctgt

SEQ ID NO: 4126702 - DNA, 19 bp, Homo sapiens
atgattaaacacctgacac

SEQ ID NO: 4126703 - DNA, 22 bp, Homo sapiens
atgattaaacacctgacacatc

SEQ ID NO: 4126704 - DNA, 23 bp, Homo sapiens
atgattctaatttttaagcaaaa

SEQ ID NO: 4126705 - DNA, 22 bp, Homo sapiens
atgattctatttatatgtacat

SEQ ID NO: 4126706 - DNA, 23 bp, Homo sapiens
atgattctatttatatgtacatg

SEQ ID NO: 4126707 - DNA, 19 bp, Homo sapiens
atgattgaattatatgttc

SEQ ID NO: 4126708 - DNA, 19 bp, Homo sapiens
atgattggaatattacaat

SEQ ID NO: 4126709 - DNA, 13 bp, Homo sapiens
atgattggattat

SEQ ID NO: 4126710 - DNA, 16 bp, Homo sapiens
atgattggattattca

SEQ ID NO: 4126711 - DNA, 22 bp, Homo sapiens
atgattggattattcatttaaa

SEQ ID NO: 4126712 - DNA, 15 bp, Homo sapiens
atgattgtataagca

SEQ ID NO: 4126713 - DNA, 16 bp, Homo sapiens
atgatttaataaaata

SEQ ID NO: 4126714 - DNA, 19 bp, Homo sapiens
atgatttaataaaataatt

SEQ ID NO: 4126715 - DNA, 18 bp, Homo sapiens
atgatttcactagaaaag

SEQ ID NO: 4126716 - DNA, 21 bp, Homo sapiens
atgatttcactagaaaagctg

SEQ ID NO: 4126717 - DNA, 17 bp, Homo sapiens
atgatttccttgaatgt

SEQ ID NO: 4126718 - DNA, 18 bp, Homo sapiens
atgatttccttgaatgtg

SEQ ID NO: 4126719 - DNA, 21 bp, Homo sapiens
atgatttccttgaatgtggct

SEQ ID NO: 4126720 - DNA, 17 bp, Homo sapiens
atgatttgttttgaatt

SEQ ID NO: 4126721 - DNA, 19 bp, Homo sapiens
atgatttgttttgaatttt

SEQ ID NO: 4126722 - DNA, 21 bp, Homo sapiens
atgatttgttttgaattttgt

SEQ ID NO: 4126723 - DNA, 23 bp, Homo sapiens
atgattttatttgacaaaatttg

SEQ ID NO: 4126724 - DNA, 23 bp, Homo sapiens
atgcaaaaagaaatgactaatta

SEQ ID NO: 4126725 - DNA, 23 bp, Homo sapiens
atgcaaaaggttcactaaagcag

SEQ ID NO: 4126726 - DNA, 15 bp, Homo sapiens
atgcaaagaaaatca

SEQ ID NO: 4126727 - DNA, 20 bp, Homo sapiens
atgcaacacgcatggtcaac

SEQ ID NO: 4126728 - DNA, 20 bp, Homo sapiens
atgcaagagtgattgcagct

SEQ ID NO: 4126729 - DNA, 16 bp, Homo sapiens
atgcaaggaaggaaag

SEQ ID NO: 4126730 - DNA, 14 bp, Homo sapiens
atgcaaggaccagg

SEQ ID NO: 4126731 - DNA, 22 bp, Homo sapiens
atgcaaggaccaggactccctc

SEQ ID NO: 4126732 - DNA, 22 bp, Homo sapiens
atgcaatcagacaagtgttttg

SEQ ID NO: 4126733 - DNA, 17 bp, Homo sapiens
atgcaatccttccctgc

SEQ ID NO: 4126734 - DNA, 18 bp, Homo sapiens
atgcaatgtgctactgat

SEQ ID NO: 4126735 - DNA, 22 bp, Homo sapiens
atgcacactagcctctccagga

SEQ ID NO: 4126736 - DNA, 17 bp, Homo sapiens
atgcactgaataaagca

SEQ ID NO: 4126737 - DNA, 18 bp, Homo sapiens
atgcactgtgaaggaccc

SEQ ID NO: 4126738 - DNA, 16 bp, Homo sapiens
atgcagagagccattt

SEQ ID NO: 4126739 - DNA, 22 bp, Homo sapiens
atgcagagagccattttgtgaa

SEQ ID NO: 4126740 - DNA, 22 bp, Homo sapiens
atgcagaggaggtgagagtggg

SEQ ID NO: 4126741 - DNA, 19 bp, Homo sapiens
atgcagcaaggccctgctg

SEQ ID NO: 4126742 - DNA, 21 bp, Homo sapiens
atgcagcaaggccctgctgcc

SEQ ID NO: 4126743 - DNA, 19 bp, Homo sapiens
atgcagccacgattggaga

SEQ ID NO: 4126744 - DNA, 21 bp, Homo sapiens
atgcagccacgattggagaat

SEQ ID NO: 4126745 - DNA, 15 bp, Homo sapiens
atgcagcccatgccc

SEQ ID NO: 4126746 - DNA, 22 bp, Homo sapiens
atgcagcccatgcccacctgcc

SEQ ID NO: 4126747 - DNA, 22 bp, Homo sapiens
atgcaggccctttgaagcctca

SEQ ID NO: 4126748 - DNA, 13 bp, Homo sapiens
atgcagggcagtc

SEQ ID NO: 4126749 - DNA, 16 bp, Homo sapiens
atgcagtaaattatct

SEQ ID NO: 4126750 - DNA, 19 bp, Homo sapiens
atgcagtcctgaggagagg

SEQ ID NO: 4126751 - DNA, 22 bp, Homo sapiens
atgcagtgatatggcagaagac

SEQ ID NO: 4126752 - DNA, 13 bp, Homo sapiens
atgcagtgcttcc

SEQ ID NO: 4126753 - DNA, 18 bp, Homo sapiens
atgcagttcattattttg

SEQ ID NO: 4126754 - DNA, 15 bp, Homo sapiens
atgcagttctgagca

SEQ ID NO: 4126755 - DNA, 14 bp, Homo sapiens
atgcagttttaaga

SEQ ID NO: 4126756 - DNA, 15 bp, Homo sapiens
atgcagttttaagaa

SEQ ID NO: 4126757 - DNA, 20 bp, Homo sapiens
atgcataaaagggtcaaacc

SEQ ID NO: 4126758 - DNA, 16 bp, Homo sapiens
atgcataaatatgcag

SEQ ID NO: 4126759 - DNA, 22 bp, Homo sapiens
atgcatctcactggatgcaaag

SEQ ID NO: 4126760 - DNA, 17 bp, Homo sapiens
atgcatgccctctctga

SEQ ID NO: 4126761 - DNA, 19 bp, Homo sapiens
atgcatggtgcagttgaca

SEQ ID NO: 4126762 - DNA, 17 bp, Homo sapiens
atgcatggtgccccagg

SEQ ID NO: 4126763 - DNA, 19 bp, Homo sapiens
atgcatggtgccccaggac

SEQ ID NO: 4126764 - DNA, 13 bp, Homo sapiens
atgcattccctga

SEQ ID NO: 4126765 - DNA, 19 bp, Homo sapiens
atgcattccctgaatctgt

SEQ ID NO: 4126766 - DNA, 21 bp, Homo sapiens
atgcattctatcgttattata

SEQ ID NO: 4126767 - DNA, 23 bp, Homo sapiens
atgcattctatcgttattataaa

SEQ ID NO: 4126768 - DNA, 14 bp, Homo sapiens
atgcattcttctct

SEQ ID NO: 4126769 - DNA, 16 bp, Homo sapiens
atgcattgttgaggtg

SEQ ID NO: 4126770 - DNA, 20 bp, Homo sapiens
atgcattgttggctatttga

SEQ ID NO: 4126771 - DNA, 13 bp, Homo sapiens
atgcatttgaggt

SEQ ID NO: 4126772 - DNA, 17 bp, Homo sapiens
atgcatttgaggtcaag

SEQ ID NO: 4126773 - DNA, 23 bp, Homo sapiens
atgcatttgaggtcaagtaagaa

SEQ ID NO: 4126774 - DNA, 14 bp, Homo sapiens
atgcatttgcattt

SEQ ID NO: 4126775 - DNA, 23 bp, Homo sapiens
atgcattttattttagacacaaa

SEQ ID NO: 4126776 - DNA, 13 bp, Homo sapiens
atgcattttgcag

SEQ ID NO: 4126777 - DNA, 18 bp, Homo sapiens
atgcattttgcagcagtg

SEQ ID NO: 4126778 - DNA, 20 bp, Homo sapiens
atgccaaattgtagttcttg

SEQ ID NO: 4126779 - DNA, 19 bp, Homo sapiens
atgccaaggcctccctcag

SEQ ID NO: 4126780 - DNA, 19 bp, Homo sapiens
atgccacaaggacttcctg

SEQ ID NO: 4126781 - DNA, 15 bp, Homo sapiens
atgccaccctcacac

SEQ ID NO: 4126782 - DNA, 19 bp, Homo sapiens
atgccaccctgttttcagc

SEQ ID NO: 4126783 - DNA, 23 bp, Homo sapiens
atgccacgtggtcactgtgcact

SEQ ID NO: 4126784 - DNA, 14 bp, Homo sapiens
atgccactcctccc

SEQ ID NO: 4126785 - DNA, 16 bp, Homo sapiens
atgccactcctccctc

SEQ ID NO: 4126786 - DNA, 13 bp, Homo sapiens
atgccactgcctg

SEQ ID NO: 4126787 - DNA, 17 bp, Homo sapiens
atgccactgcctgcacc

SEQ ID NO: 4126788 - DNA, 20 bp, Homo sapiens
atgccacttccttttaactg

SEQ ID NO: 4126789 - DNA, 21 bp, Homo sapiens
atgccagattctgcctctctg

SEQ ID NO: 4126790 - DNA, 16 bp, Homo sapiens
atgccagctacttcct

SEQ ID NO: 4126791 - DNA, 18 bp, Homo sapiens
atgccagctcagtcccat

SEQ ID NO: 4126792 - DNA, 19 bp, Homo sapiens
atgccagctcagtcccatc

SEQ ID NO: 4126793 - DNA, 14 bp, Homo sapiens
atgccagcttctct

SEQ ID NO: 4126794 - DNA, 23 bp, Homo sapiens
atgccagcttctctctccagggt

SEQ ID NO: 4126795 - DNA, 22 bp, Homo sapiens
atgccaggccagagggcagtgg

SEQ ID NO: 4126796 - DNA, 22 bp, Homo sapiens
atgccagtaacgcgtcttcctg

SEQ ID NO: 4126797 - DNA, 17 bp, Homo sapiens
atgcccaccccctgccc

SEQ ID NO: 4126798 - DNA, 19 bp, Homo sapiens
atgcccaccccctgccctg

SEQ ID NO: 4126799 - DNA, 15 bp, Homo sapiens
atgcccacctgccca

SEQ ID NO: 4126800 - DNA, 21 bp, Homo sapiens
atgcccacctgcccatcacag

SEQ ID NO: 4126801 - DNA, 12 bp, Homo sapiens
atgcccactgct

SEQ ID NO: 4126802 - DNA, 20 bp, Homo sapiens
atgcccactgctggtgccag

SEQ ID NO: 4126803 - DNA, 18 bp, Homo sapiens
atgcccaggtaccaccct

SEQ ID NO: 4126804 - DNA, 21 bp, Homo sapiens
atgcccatttgcctttaaaaa

SEQ ID NO: 4126805 - DNA, 15 bp, Homo sapiens
atgccccagagctgt

SEQ ID NO: 4126806 - DNA, 12 bp, Homo sapiens
atgccccagtcg

SEQ ID NO: 4126807 - DNA, 16 bp, Homo sapiens
atgccccattccttgc

SEQ ID NO: 4126808 - DNA, 20 bp, Homo sapiens
atgccccattccttgcgcct

SEQ ID NO: 4126809 - DNA, 13 bp, Homo sapiens
atgccctgtgcaa

SEQ ID NO: 4126810 - DNA, 15 bp, Homo sapiens
atgcccttaaatcat

SEQ ID NO: 4126811 - DNA, 19 bp, Homo sapiens
atgccctttggaaagccat

SEQ ID NO: 4126812 - DNA, 19 bp, Homo sapiens
atgccgatatactctagat

SEQ ID NO: 4126813 - DNA, 13 bp, Homo sapiens
atgcctaataaac

SEQ ID NO: 4126814 - DNA, 20 bp, Homo sapiens
atgcctacaaccatccctgc

SEQ ID NO: 4126815 - DNA, 23 bp, Homo sapiens
atgcctacaaccatccctgccac

SEQ ID NO: 4126816 - DNA, 14 bp, Homo sapiens
atgcctctcccgca

SEQ ID NO: 4126817 - DNA, 20 bp, Homo sapiens
atgcctctcccgcaccaggc

SEQ ID NO: 4126818 - DNA, 19 bp, Homo sapiens
atgcctgactaatttttgt

SEQ ID NO: 4126819 - DNA, 20 bp, Homo sapiens
atgcctgactaatttttgta

SEQ ID NO: 4126820 - DNA, 12 bp, Homo sapiens
atgcctgagggt

SEQ ID NO: 4126821 - DNA, 17 bp, Homo sapiens
atgcctggtgagcatta

SEQ ID NO: 4126822 - DNA, 16 bp, Homo sapiens
atgcctgtccagcctg

SEQ ID NO: 4126823 - DNA, 22 bp, Homo sapiens
atgcctgtggaagagtgtgtgt

SEQ ID NO: 4126824 - DNA, 19 bp, Homo sapiens
atgccttaaaatggaattg

SEQ ID NO: 4126825 - DNA, 14 bp, Homo sapiens
atgccttcttattg

SEQ ID NO: 4126826 - DNA, 12 bp, Homo sapiens
atgcctttgaga

SEQ ID NO: 4126827 - DNA, 13 bp, Homo sapiens
atgcctttgagac

SEQ ID NO: 4126828 - DNA, 14 bp, Homo sapiens
atgcgcagtgcctt

SEQ ID NO: 4126829 - DNA, 21 bp, Homo sapiens
atgcgtacgtttcctgagaag

SEQ ID NO: 4126830 - DNA, 16 bp, Homo sapiens
atgctaacatctaaaa

SEQ ID NO: 4126831 - DNA, 17 bp, Homo sapiens
atgctaacatctaaaaa

SEQ ID NO: 4126832 - DNA, 15 bp, Homo sapiens
atgctaataaactgt

SEQ ID NO: 4126833 - DNA, 21 bp, Homo sapiens
atgctaggatgcggaaatccc

SEQ ID NO: 4126834 - DNA, 12 bp, Homo sapiens
atgctatttctg

SEQ ID NO: 4126835 - DNA, 13 bp, Homo sapiens
atgctcaaagaaa

SEQ ID NO: 4126836 - DNA, 15 bp, Homo sapiens
atgctcaaagaaatc

SEQ ID NO: 4126837 - DNA, 17 bp, Homo sapiens
atgctcaaccactgtgg

SEQ ID NO: 4126838 - DNA, 18 bp, Homo sapiens
atgctcacctctagcctt

SEQ ID NO: 4126839 - DNA, 18 bp, Homo sapiens
atgctcagccctgactgg

SEQ ID NO: 4126840 - DNA, 15 bp, Homo sapiens
atgctcattttctgg

SEQ ID NO: 4126841 - DNA, 16 bp, Homo sapiens
atgctcattttctggt

SEQ ID NO: 4126842 - DNA, 21 bp, Homo sapiens
atgctccccacagcgtccctg

SEQ ID NO: 4126843 - DNA, 22 bp, Homo sapiens
atgctccccacagcgtccctgg

SEQ ID NO: 4126844 - DNA, 17 bp, Homo sapiens
atgctcccctgtgccag

SEQ ID NO: 4126845 - DNA, 14 bp, Homo sapiens
atgctccctcccct

SEQ ID NO: 4126846 - DNA, 20 bp, Homo sapiens
atgctccctcccctgccctg

SEQ ID NO: 4126847 - DNA, 18 bp, Homo sapiens
atgctctgcatgttacat

SEQ ID NO: 4126848 - DNA, 19 bp, Homo sapiens
atgctctgcatgttacata

SEQ ID NO: 4126849 - DNA, 23 bp, Homo sapiens
atgctctgtgcgagggttactat

SEQ ID NO: 4126850 - DNA, 12 bp, Homo sapiens
atgctctttccc

SEQ ID NO: 4126851 - DNA, 15 bp, Homo sapiens
atgctctttcccacc

SEQ ID NO: 4126852 - DNA, 14 bp, Homo sapiens
atgctgaactcctt

SEQ ID NO: 4126853 - DNA, 12 bp, Homo sapiens
atgctgaaggga

SEQ ID NO: 4126854 - DNA, 19 bp, Homo sapiens
atgctgacattcacctgcc

SEQ ID NO: 4126855 - DNA, 20 bp, Homo sapiens
atgctgacattcacctgccc

SEQ ID NO: 4126856 - DNA, 22 bp, Homo sapiens
atgctgacattcacctgcccca

SEQ ID NO: 4126857 - DNA, 20 bp, Homo sapiens
atgctgactgtactcctccc

SEQ ID NO: 4126858 - DNA, 14 bp, Homo sapiens
atgctgagattctt

SEQ ID NO: 4126859 - DNA, 12 bp, Homo sapiens
atgctgatcatc

SEQ ID NO: 4126860 - DNA, 14 bp, Homo sapiens
atgctgatcatcgc

SEQ ID NO: 4126861 - DNA, 19 bp, Homo sapiens
atgctgcaggacttgagaa

SEQ ID NO: 4126862 - DNA, 12 bp, Homo sapiens
atgctgccagtg

SEQ ID NO: 4126863 - DNA, 11 bp, Homo sapiens
atgctgcccct

SEQ ID NO: 4126864 - DNA, 15 bp, Homo sapiens
atgctgcccctgcct

SEQ ID NO: 4126865 - DNA, 16 bp, Homo sapiens
atgctgcccctgcctt

SEQ ID NO: 4126866 - DNA, 16 bp, Homo sapiens
atgctggactggaggc

SEQ ID NO: 4126867 - DNA, 22 bp, Homo sapiens
atgctggactggaggcccctgg

SEQ ID NO: 4126868 - DNA, 23 bp, Homo sapiens
atgctggcatttgcacctacctc

SEQ ID NO: 4126869 - DNA, 14 bp, Homo sapiens
atgctggccagcac

SEQ ID NO: 4126870 - DNA, 16 bp, Homo sapiens
atgctggccagcaccc

SEQ ID NO: 4126871 - DNA, 17 bp, Homo sapiens
atgctggccagcaccct

SEQ ID NO: 4126872 - DNA, 21 bp, Homo sapiens
atgctggccagcaccctctcc

SEQ ID NO: 4126873 - DNA, 22 bp, Homo sapiens
atgctggccagcaccctctcct

SEQ ID NO: 4126874 - DNA, 12 bp, Homo sapiens
atgctggcccag

SEQ ID NO: 4126875 - DNA, 18 bp, Homo sapiens
atgctggcccagggccca

SEQ ID NO: 4126876 - DNA, 19 bp, Homo sapiens
atgctggcccagggcccag

SEQ ID NO: 4126877 - DNA, 23 bp, Homo sapiens
atgctggcccagggcccagagcc

SEQ ID NO: 4126878 - DNA, 17 bp, Homo sapiens
atgctggcctttgctct

SEQ ID NO: 4126879 - DNA, 19 bp, Homo sapiens
atgctgggccactggggac

SEQ ID NO: 4126880 - DNA, 17 bp, Homo sapiens
atgctgggctgggccct

SEQ ID NO: 4126881 - DNA, 21 bp, Homo sapiens
atgctggtatatggcttcaag

SEQ ID NO: 4126882 - DNA, 22 bp, Homo sapiens
atgctgtcaactatgatatggt

SEQ ID NO: 4126883 - DNA, 21 bp, Homo sapiens
atgctgtgacaataagtttga

SEQ ID NO: 4126884 - DNA, 18 bp, Homo sapiens
atgctgtgctaaatatca

SEQ ID NO: 4126885 - DNA, 19 bp, Homo sapiens
atgctgttctcttcttcat

SEQ ID NO: 4126886 - DNA, 16 bp, Homo sapiens
atgcttaaaataagca

SEQ ID NO: 4126887 - DNA, 15 bp, Homo sapiens
atgcttaaactaaat

SEQ ID NO: 4126888 - DNA, 19 bp, Homo sapiens
atgcttaaactaaataatg

SEQ ID NO: 4126889 - DNA, 14 bp, Homo sapiens
atgcttaatttcta

SEQ ID NO: 4126890 - DNA, 19 bp, Homo sapiens
atgcttacggccatctctt

SEQ ID NO: 4126891 - DNA, 17 bp, Homo sapiens
atgcttagatgttccag

SEQ ID NO: 4126892 - DNA, 19 bp, Homo sapiens
atgcttatcatctaaagat

SEQ ID NO: 4126893 - DNA, 22 bp, Homo sapiens
atgcttcatcattccctctcat

SEQ ID NO: 4126894 - DNA, 22 bp, Homo sapiens
atgcttccagaaacacccacag

SEQ ID NO: 4126895 - DNA, 12 bp, Homo sapiens
atgcttcccaga

SEQ ID NO: 4126896 - DNA, 13 bp, Homo sapiens
atgcttcccagag

SEQ ID NO: 4126897 - DNA, 18 bp, Homo sapiens
atgcttcccagagggagc

SEQ ID NO: 4126898 - DNA, 20 bp, Homo sapiens
atgcttcctgacaatcaact

SEQ ID NO: 4126899 - DNA, 11 bp, Homo sapiens
atgcttctctc

SEQ ID NO: 4126900 - DNA, 13 bp, Homo sapiens
atgcttctctcct

SEQ ID NO: 4126901 - DNA, 14 bp, Homo sapiens
atgcttctctcctt

SEQ ID NO: 4126902 - DNA, 12 bp, Homo sapiens
atgcttgattta

SEQ ID NO: 4126903 - DNA, 13 bp, Homo sapiens
atgcttttgtcta

SEQ ID NO: 4126904 - DNA, 21 bp, Homo sapiens
atggaaaaaccatttgaagtg

SEQ ID NO: 4126905 - DNA, 14 bp, Homo sapiens
atggaaaaggaaga

SEQ ID NO: 4126906 - DNA, 16 bp, Homo sapiens
atggaaaataaacatc

SEQ ID NO: 4126907 - DNA, 16 bp, Homo sapiens
atggaaacaatgtgga

SEQ ID NO: 4126908 - DNA, 17 bp, Homo sapiens
atggaaacaatgtggag

SEQ ID NO: 4126909 - DNA, 18 bp, Homo sapiens
atggaaacaatgtggagt

SEQ ID NO: 4126910 - DNA, 13 bp, Homo sapiens
atggaaacactga

SEQ ID NO: 4126911 - DNA, 16 bp, Homo sapiens
atggaaacattacagt

SEQ ID NO: 4126912 - DNA, 15 bp, Homo sapiens
atggaaagacaaact

SEQ ID NO: 4126913 - DNA, 22 bp, Homo sapiens
atggaactcagctgtctgtggc

SEQ ID NO: 4126914 - DNA, 23 bp, Homo sapiens
atggaactcagctgtctgtggct

SEQ ID NO: 4126915 - DNA, 17 bp, Homo sapiens
atggaagattttaaatt

SEQ ID NO: 4126916 - DNA, 15 bp, Homo sapiens
atggaaggaagaaaa

SEQ ID NO: 4126917 - DNA, 16 bp, Homo sapiens
atggaagggtttgtgg

SEQ ID NO: 4126918 - DNA, 22 bp, Homo sapiens
atggaaggtttgtatattgtca

SEQ ID NO: 4126919 - DNA, 18 bp, Homo sapiens
atggaatcgatttcctcc

SEQ ID NO: 4126920 - DNA, 19 bp, Homo sapiens
atggaatgtgcccctggcc

SEQ ID NO: 4126921 - DNA, 23 bp, Homo sapiens
atggaattaaccatttaataaag

SEQ ID NO: 4126922 - DNA, 14 bp, Homo sapiens
atggaattgatttg

SEQ ID NO: 4126923 - DNA, 17 bp, Homo sapiens
atggaattgatttgcat

SEQ ID NO: 4126924 - DNA, 17 bp, Homo sapiens
atggaattgcttaccaa

SEQ ID NO: 4126925 - DNA, 20 bp, Homo sapiens
atggacaacttatttaaaaa

SEQ ID NO: 4126926 - DNA, 21 bp, Homo sapiens
atggacaccccttatccagga

SEQ ID NO: 4126927 - DNA, 14 bp, Homo sapiens
atggacaggctggc

SEQ ID NO: 4126928 - DNA, 21 bp, Homo sapiens
atggacagtgggcatcagcag

SEQ ID NO: 4126929 - DNA, 20 bp, Homo sapiens
atggacatcctgtataagca

SEQ ID NO: 4126930 - DNA, 14 bp, Homo sapiens
atggacatgatctt

SEQ ID NO: 4126931 - DNA, 19 bp, Homo sapiens
atggacatgatcttcttta

SEQ ID NO: 4126932 - DNA, 17 bp, Homo sapiens
atggaccaacctgctct

SEQ ID NO: 4126933 - DNA, 20 bp, Homo sapiens
atggaccaacctgctctgtc

SEQ ID NO: 4126934 - DNA, 13 bp, Homo sapiens
atggactcttctc

SEQ ID NO: 4126935 - DNA, 18 bp, Homo sapiens
atggactcttctcggctc

SEQ ID NO: 4126936 - DNA, 21 bp, Homo sapiens
atggactcttctcggctcagg

SEQ ID NO: 4126937 - DNA, 21 bp, Homo sapiens
atggactgggaggagggggag

SEQ ID NO: 4126938 - DNA, 16 bp, Homo sapiens
atggacttgtatattt

SEQ ID NO: 4126939 - DNA, 17 bp, Homo sapiens
atggacttgtatatttg

SEQ ID NO: 4126940 - DNA, 20 bp, Homo sapiens
atggagactcctgccctgtt

SEQ ID NO: 4126941 - DNA, 11 bp, Homo sapiens
atggagagaat

SEQ ID NO: 4126942 - DNA, 20 bp, Homo sapiens
atggagaggcggcctcgtgc

SEQ ID NO: 4126943 - DNA, 20 bp, Homo sapiens
atggagattcagttttcatt

SEQ ID NO: 4126944 - DNA, 21 bp, Homo sapiens
atggagcccataggccacccc

SEQ ID NO: 4126945 - DNA, 24 bp, Homo sapiens
atggagcccccagatagagctggg

SEQ ID NO: 4126946 - DNA, 13 bp, Homo sapiens
atggaggaaaaag

SEQ ID NO: 4126947 - DNA, 22 bp, Homo sapiens
atggaggaaaaccaagccgtgg

SEQ ID NO: 4126948 - DNA, 16 bp, Homo sapiens
atggagggaataatac

SEQ ID NO: 4126949 - DNA, 14 bp, Homo sapiens
atggagggcttggc

SEQ ID NO: 4126950 - DNA, 18 bp, Homo sapiens
atggaggggtggtcctga

SEQ ID NO: 4126951 - DNA, 20 bp, Homo sapiens
atggaggggtggtcctgact

SEQ ID NO: 4126952 - DNA, 18 bp, Homo sapiens
atggaggttctcagagcc

SEQ ID NO: 4126953 - DNA, 20 bp, Homo sapiens
atggagtccagggaagagaa

SEQ ID NO: 4126954 - DNA, 13 bp, Homo sapiens
atggataaactga

SEQ ID NO: 4126955 - DNA, 17 bp, Homo sapiens
atggataaactgagcct

SEQ ID NO: 4126956 - DNA, 18 bp, Homo sapiens
atggatattattagaaat

SEQ ID NO: 4126957 - DNA, 19 bp, Homo sapiens
atggatgcccagaggactc

SEQ ID NO: 4126958 - DNA, 19 bp, Homo sapiens
atggatgggggaactcaga

SEQ ID NO: 4126959 - DNA, 17 bp, Homo sapiens
atggatttgttacagcc

SEQ ID NO: 4126960 - DNA, 21 bp, Homo sapiens
atggattttgggagtgactca

SEQ ID NO: 4126961 - DNA, 18 bp, Homo sapiens
atggcaagtctagagtct

SEQ ID NO: 4126962 - DNA, 22 bp, Homo sapiens
atggcaagtctagagtctcaga

SEQ ID NO: 4126963 - DNA, 16 bp, Homo sapiens
atggcagaagacacca

SEQ ID NO: 4126964 - DNA, 17 bp, Homo sapiens
atggcagaagacaccag

SEQ ID NO: 4126965 - DNA, 21 bp, Homo sapiens
atggcagaagacaccagagca

SEQ ID NO: 4126966 - DNA, 22 bp, Homo sapiens
atggcagaagacaccagagcag

SEQ ID NO: 4126967 - DNA, 24 bp, Homo sapiens
atggcagaagacaccagagcagat

SEQ ID NO: 4126968 - DNA, 14 bp, Homo sapiens
atggcagaagggaa

SEQ ID NO: 4126969 - DNA, 16 bp, Homo sapiens
atggcagaagggaatt

SEQ ID NO: 4126970 - DNA, 21 bp, Homo sapiens
atggcatagccccggcccccc

SEQ ID NO: 4126971 - DNA, 18 bp, Homo sapiens
atggcatcaaccaccatg

SEQ ID NO: 4126972 - DNA, 22 bp, Homo sapiens
atggccacagtagtcttgatga

SEQ ID NO: 4126973 - DNA, 13 bp, Homo sapiens
atggccagcccct

SEQ ID NO: 4126974 - DNA, 20 bp, Homo sapiens
atggccaggtggttgtctta

SEQ ID NO: 4126975 - DNA, 21 bp, Homo sapiens
atggccagtttgaagcctgtg

SEQ ID NO: 4126976 - DNA, 22 bp, Homo sapiens
atggccagtttgaagcctgtgc

SEQ ID NO: 4126977 - DNA, 23 bp, Homo sapiens
atggccagtttgaagcctgtgcc

SEQ ID NO: 4126978 - DNA, 16 bp, Homo sapiens
atggccccatcccagt

SEQ ID NO: 4126979 - DNA, 13 bp, Homo sapiens
atggcccccaggg

SEQ ID NO: 4126980 - DNA, 21 bp, Homo sapiens
atggcccggatgctgcttccg

SEQ ID NO: 4126981 - DNA, 21 bp, Homo sapiens
atggccctgtagccagcacct

SEQ ID NO: 4126982 - DNA, 18 bp, Homo sapiens
atggccctgtcccaggcc

SEQ ID NO: 4126983 - DNA, 18 bp, Homo sapiens
atggcccttcccactgga

SEQ ID NO: 4126984 - DNA, 16 bp, Homo sapiens
atggcctcagctgcct

SEQ ID NO: 4126985 - DNA, 18 bp, Homo sapiens
atggcctcagctgcctca

SEQ ID NO: 4126986 - DNA, 15 bp, Homo sapiens
atggcctttccttcc

SEQ ID NO: 4126987 - DNA, 12 bp, Homo sapiens
atggcctttcta

SEQ ID NO: 4126988 - DNA, 19 bp, Homo sapiens
atggcgcctgctccctcca

SEQ ID NO: 4126989 - DNA, 20 bp, Homo sapiens
atggcgcctgctccctccag

SEQ ID NO: 4126990 - DNA, 22 bp, Homo sapiens
atggctactttggtttctgtct

SEQ ID NO: 4126991 - DNA, 15 bp, Homo sapiens
atggctataaatata

SEQ ID NO: 4126992 - DNA, 15 bp, Homo sapiens
atggctccagaaatg

SEQ ID NO: 4126993 - DNA, 16 bp, Homo sapiens
atggctccagaaatgt

SEQ ID NO: 4126994 - DNA, 17 bp, Homo sapiens
atggctccagaaatgtc

SEQ ID NO: 4126995 - DNA, 17 bp, Homo sapiens
atggctctgcacccctc

SEQ ID NO: 4126996 - DNA, 22 bp, Homo sapiens
atggctctgcacccctctgccc

SEQ ID NO: 4126997 - DNA, 17 bp, Homo sapiens
atggctgcccaggagac

SEQ ID NO: 4126998 - DNA, 21 bp, Homo sapiens
atggctgtgtttgcagcctgc

SEQ ID NO: 4126999 - DNA, 14 bp, Homo sapiens
atggcttaatgttt

SEQ ID NO: 4127000 - DNA, 22 bp, Homo sapiens
atggcttattttttaaaatatt

SEQ ID NO: 4127001 - DNA, 13 bp, Homo sapiens
atgggaaaatatt

SEQ ID NO: 4127002 - DNA, 17 bp, Homo sapiens
atgggaaaatatttcct

SEQ ID NO: 4127003 - DNA, 18 bp, Homo sapiens
atgggaaaatatttcctg

SEQ ID NO: 4127004 - DNA, 18 bp, Homo sapiens
atgggaaagccacctctc

SEQ ID NO: 4127005 - DNA, 17 bp, Homo sapiens
atgggaacaattgaagt

SEQ ID NO: 4127006 - DNA, 18 bp, Homo sapiens
atgggaatgaggtgggag

SEQ ID NO: 4127007 - DNA, 11 bp, Homo sapiens
atgggaccagg

SEQ ID NO: 4127008 - DNA, 13 bp, Homo sapiens
atgggaccaggga

SEQ ID NO: 4127009 - DNA, 18 bp, Homo sapiens
atgggactcattgtagaa

SEQ ID NO: 4127010 - DNA, 19 bp, Homo sapiens
atgggactggagtcagatg

SEQ ID NO: 4127011 - DNA, 15 bp, Homo sapiens
atgggagctcctctc

SEQ ID NO: 4127012 - DNA, 20 bp, Homo sapiens
atgggagctcctctcctgga

SEQ ID NO: 4127013 - DNA, 23 bp, Homo sapiens
atgggagctcctctcctggagga

SEQ ID NO: 4127014 - DNA, 18 bp, Homo sapiens
atgggagggaggctcagg

SEQ ID NO: 4127015 - DNA, 11 bp, Homo sapiens
atgggccaggg

SEQ ID NO: 4127016 - DNA, 21 bp, Homo sapiens
atgggctctgacagaaagcag

SEQ ID NO: 4127017 - DNA, 23 bp, Homo sapiens
atgggcttgttttcttgccaatg

SEQ ID NO: 4127018 - DNA, 14 bp, Homo sapiens
atggggccagatcc

SEQ ID NO: 4127019 - DNA, 21 bp, Homo sapiens
atggggccagatccagcctgg

SEQ ID NO: 4127020 - DNA, 19 bp, Homo sapiens
atggggcctccctccttgg

SEQ ID NO: 4127021 - DNA, 22 bp, Homo sapiens
atggggcctccctccttgggtc

SEQ ID NO: 4127022 - DNA, 19 bp, Homo sapiens
atggggctcagatggactg

SEQ ID NO: 4127023 - DNA, 21 bp, Homo sapiens
atgggggaactcagatccagg

SEQ ID NO: 4127024 - DNA, 18 bp, Homo sapiens
atgggggatgggccaggg

SEQ ID NO: 4127025 - DNA, 16 bp, Homo sapiens
atgggggcacttgagt

SEQ ID NO: 4127026 - DNA, 14 bp, Homo sapiens
atgggggcagggct

SEQ ID NO: 4127027 - DNA, 18 bp, Homo sapiens
atgggggcatctcttccc

SEQ ID NO: 4127028 - DNA, 12 bp, Homo sapiens
atggggtggggt

SEQ ID NO: 4127029 - DNA, 23 bp, Homo sapiens
atgggtagggctctgacaaagct

SEQ ID NO: 4127030 - DNA, 14 bp, Homo sapiens
atgggtccagggcc

SEQ ID NO: 4127031 - DNA, 22 bp, Homo sapiens
atgggtcctagcccttccctga

SEQ ID NO: 4127032 - DNA, 16 bp, Homo sapiens
atgggtctgatattaa

SEQ ID NO: 4127033 - DNA, 19 bp, Homo sapiens
atgggtctggctgagctga

SEQ ID NO: 4127034 - DNA, 16 bp, Homo sapiens
atgggtgcaaggaaaa

SEQ ID NO: 4127035 - DNA, 14 bp, Homo sapiens
atgggttccagagg

SEQ ID NO: 4127036 - DNA, 14 bp, Homo sapiens
atgggttgcatttg

SEQ ID NO: 4127037 - DNA, 23 bp, Homo sapiens
atggtaaaagttacttattctag

SEQ ID NO: 4127038 - DNA, 18 bp, Homo sapiens
atggtacatgtcttccat

SEQ ID NO: 4127039 - DNA, 19 bp, Homo sapiens
atggtagccagatgataaa

SEQ ID NO: 4127040 - DNA, 17 bp, Homo sapiens
atggtaggcatttccta

SEQ ID NO: 4127041 - DNA, 21 bp, Homo sapiens
atggtatatttggtactgtat

SEQ ID NO: 4127042 - DNA, 16 bp, Homo sapiens
atggtatgctggccag

SEQ ID NO: 4127043 - DNA, 15 bp, Homo sapiens
atggtcacacactga

SEQ ID NO: 4127044 - DNA, 17 bp, Homo sapiens
atggtccaggatctcca

SEQ ID NO: 4127045 - DNA, 19 bp, Homo sapiens
atggtgaaaccccgtctct

SEQ ID NO: 4127046 - DNA, 24 bp, Homo sapiens
atggtgaaaccccgtctctactaa

SEQ ID NO: 4127047 - DNA, 21 bp, Homo sapiens
atggtgatcctctattttgtg

SEQ ID NO: 4127048 - DNA, 19 bp, Homo sapiens
atggtgcagagaagctgga

SEQ ID NO: 4127049 - DNA, 20 bp, Homo sapiens
atggtgcagttgacagcagg

SEQ ID NO: 4127050 - DNA, 16 bp, Homo sapiens
atggtgccccaggacc

SEQ ID NO: 4127051 - DNA, 19 bp, Homo sapiens
atggtgccccaggaccagc

SEQ ID NO: 4127052 - DNA, 20 bp, Homo sapiens
atggtgccccaggaccagct

SEQ ID NO: 4127053 - DNA, 21 bp, Homo sapiens
atggtgccccaggaccagctc

SEQ ID NO: 4127054 - DNA, 22 bp, Homo sapiens
atggtgccccaggaccagctca

SEQ ID NO: 4127055 - DNA, 20 bp, Homo sapiens
atggtgcctgagaggcaggc

SEQ ID NO: 4127056 - DNA, 21 bp, Homo sapiens
atggtgcctgagaggcaggca

SEQ ID NO: 4127057 - DNA, 17 bp, Homo sapiens
atggtggctcatgcctg

SEQ ID NO: 4127058 - DNA, 16 bp, Homo sapiens
atggtgtaataagaca

SEQ ID NO: 4127059 - DNA, 22 bp, Homo sapiens
atggtgtaataagacataacgt

SEQ ID NO: 4127060 - DNA, 16 bp, Homo sapiens
atggtgtagaacacta

SEQ ID NO: 4127061 - DNA, 19 bp, Homo sapiens
atggtgtagaacactaatt

SEQ ID NO: 4127062 - DNA, 18 bp, Homo sapiens
atggtgtgaacccgggag

SEQ ID NO: 4127063 - DNA, 20 bp, Homo sapiens
atggtgtggggggctggggg

SEQ ID NO: 4127064 - DNA, 18 bp, Homo sapiens
atggtgtgggtgtcctgc

SEQ ID NO: 4127065 - DNA, 20 bp, Homo sapiens
atggttacaatcattgctga

SEQ ID NO: 4127066 - DNA, 21 bp, Homo sapiens
atggttcagaattaaactttt

SEQ ID NO: 4127067 - DNA, 19 bp, Homo sapiens
atggttgagaaatgaataa

SEQ ID NO: 4127068 - DNA, 22 bp, Homo sapiens
atggttgatggaaaataaacat

SEQ ID NO: 4127069 - DNA, 17 bp, Homo sapiens
atggttgccaggacgaa

SEQ ID NO: 4127070 - DNA, 23 bp, Homo sapiens
atggttgccaggacgaattgaga

SEQ ID NO: 4127071 - DNA, 21 bp, Homo sapiens
atggttggttttatttgtcag

SEQ ID NO: 4127072 - DNA, 22 bp, Homo sapiens
atggtttcctccatttgagaaa

SEQ ID NO: 4127073 - DNA, 20 bp, Homo sapiens
atggtttctgaaaatgttta

SEQ ID NO: 4127074 - DNA, 22 bp, Homo sapiens
atggtttgactcccgaacatca

SEQ ID NO: 4127075 - DNA, 19 bp, Homo sapiens
atgtaaaaaagaaaaacac

SEQ ID NO: 4127076 - DNA, 17 bp, Homo sapiens
atgtaaaacagaaaaaa

SEQ ID NO: 4127077 - DNA, 17 bp, Homo sapiens
atgtaaaagaaaatcca

SEQ ID NO: 4127078 - DNA, 19 bp, Homo sapiens
atgtaaaagaacttactga

SEQ ID NO: 4127079 - DNA, 22 bp, Homo sapiens
atgtaaaagaacttactgatta

SEQ ID NO: 4127080 - DNA, 21 bp, Homo sapiens
atgtaaaagagtcatctggta

SEQ ID NO: 4127081 - DNA, 20 bp, Homo sapiens
atgtaaaggagtcaaaacta

SEQ ID NO: 4127082 - DNA, 12 bp, Homo sapiens
atgtaaatattc

SEQ ID NO: 4127083 - DNA, 15 bp, Homo sapiens
atgtaaatattctat

SEQ ID NO: 4127084 - DNA, 21 bp, Homo sapiens
atgtaaatgattttatgtttt

SEQ ID NO: 4127085 - DNA, 21 bp, Homo sapiens
atgtaaatttataaatatatt

SEQ ID NO: 4127086 - DNA, 16 bp, Homo sapiens
atgtaacacataaaca

SEQ ID NO: 4127087 - DNA, 15 bp, Homo sapiens
atgtaacttattatt

SEQ ID NO: 4127088 - DNA, 16 bp, Homo sapiens
atgtaagaaaacaaaa

SEQ ID NO: 4127089 - DNA, 21 bp, Homo sapiens
atgtaagaaaacaaaatctaa

SEQ ID NO: 4127090 - DNA, 17 bp, Homo sapiens
atgtaagccaagtcatg

SEQ ID NO: 4127091 - DNA, 19 bp, Homo sapiens
atgtaataaaaagtatatg

SEQ ID NO: 4127092 - DNA, 15 bp, Homo sapiens
atgtaatactggaat

SEQ ID NO: 4127093 - DNA, 22 bp, Homo sapiens
atgtaatctctctgcagctgcc

SEQ ID NO: 4127094 - DNA, 19 bp, Homo sapiens
atgtaatgcttccaatctt

SEQ ID NO: 4127095 - DNA, 14 bp, Homo sapiens
atgtaatgtccctt

SEQ ID NO: 4127096 - DNA, 23 bp, Homo sapiens
atgtaatgtgtggtggcctcagc

SEQ ID NO: 4127097 - DNA, 21 bp, Homo sapiens
atgtaatttagggtactaaat

SEQ ID NO: 4127098 - DNA, 22 bp, Homo sapiens
atgtaatttagggtactaaatt

SEQ ID NO: 4127099 - DNA, 13 bp, Homo sapiens
atgtaatttatgc

SEQ ID NO: 4127100 - DNA, 14 bp, Homo sapiens
atgtacaagatgaa

SEQ ID NO: 4127101 - DNA, 22 bp, Homo sapiens
atgtacatagttatttttctct

SEQ ID NO: 4127102 - DNA, 15 bp, Homo sapiens
atgtacatgaagcaa

SEQ ID NO: 4127103 - DNA, 22 bp, Homo sapiens
atgtaccatttgcatggctcca

SEQ ID NO: 4127104 - DNA, 20 bp, Homo sapiens
atgtactagtgttctgtttg

SEQ ID NO: 4127105 - DNA, 19 bp, Homo sapiens
atgtacttgtttctctgtt

SEQ ID NO: 4127106 - DNA, 22 bp, Homo sapiens
atgtagactgtgccagaggcca

SEQ ID NO: 4127107 - DNA, 19 bp, Homo sapiens
atgtagagagaacaggtgg

SEQ ID NO: 4127108 - DNA, 23 bp, Homo sapiens
atgtagatattgtgaagtacata

SEQ ID NO: 4127109 - DNA, 21 bp, Homo sapiens
atgtagatattgttttctgta

SEQ ID NO: 4127110 - DNA, 13 bp, Homo sapiens
atgtagcccatcc

SEQ ID NO: 4127111 - DNA, 18 bp, Homo sapiens
atgtagccccctggcctc

SEQ ID NO: 4127112 - DNA, 19 bp, Homo sapiens
atgtagccccctggcctct

SEQ ID NO: 4127113 - DNA, 16 bp, Homo sapiens
atgtagcttttgggga

SEQ ID NO: 4127114 - DNA, 17 bp, Homo sapiens
atgtaggtatgaataag

SEQ ID NO: 4127115 - DNA, 17 bp, Homo sapiens
atgtagtaattgacatg

SEQ ID NO: 4127116 - DNA, 16 bp, Homo sapiens
atgtagtataaagaaa

SEQ ID NO: 4127117 - DNA, 17 bp, Homo sapiens
atgtagttttgtttatg

SEQ ID NO: 4127118 - DNA, 17 bp, Homo sapiens
atgtataaagaacaagg

SEQ ID NO: 4127119 - DNA, 14 bp, Homo sapiens
atgtataaatgtga

SEQ ID NO: 4127120 - DNA, 19 bp, Homo sapiens
atgtatatatatatatgca

SEQ ID NO: 4127121 - DNA, 19 bp, Homo sapiens
atgtatatcattctacaga

SEQ ID NO: 4127122 - DNA, 12 bp, Homo sapiens
atgtatcaatga

SEQ ID NO: 4127123 - DNA, 21 bp, Homo sapiens
atgtatgaaggaatcattcca

SEQ ID NO: 4127124 - DNA, 16 bp, Homo sapiens
atgtatgatctctcta

SEQ ID NO: 4127125 - DNA, 15 bp, Homo sapiens
atgtatgctttttac

SEQ ID NO: 4127126 - DNA, 21 bp, Homo sapiens
atgtatggaatacagtgttat

SEQ ID NO: 4127127 - DNA, 22 bp, Homo sapiens
atgtatggaatcccactgtatg

SEQ ID NO: 4127128 - DNA, 19 bp, Homo sapiens
atgtatgggtagggtaaat

SEQ ID NO: 4127129 - DNA, 13 bp, Homo sapiens
atgtatgtaaagt

SEQ ID NO: 4127130 - DNA, 14 bp, Homo sapiens
atgtatgtgcattt

SEQ ID NO: 4127131 - DNA, 17 bp, Homo sapiens
atgtatgttatgatatt

SEQ ID NO: 4127132 - DNA, 18 bp, Homo sapiens
atgtatgtttacatatca

SEQ ID NO: 4127133 - DNA, 21 bp, Homo sapiens
atgtattcatccagagttctt

SEQ ID NO: 4127134 - DNA, 14 bp, Homo sapiens
atgtattgactgta

SEQ ID NO: 4127135 - DNA, 16 bp, Homo sapiens
atgtattgcacattgt

SEQ ID NO: 4127136 - DNA, 19 bp, Homo sapiens
atgtattgtaatctttcat

SEQ ID NO: 4127137 - DNA, 19 bp, Homo sapiens
atgtattttgaagaatatt

SEQ ID NO: 4127138 - DNA, 16 bp, Homo sapiens
atgtcaaacagtgcca

SEQ ID NO: 4127139 - DNA, 18 bp, Homo sapiens
atgtcaaacagtgccaaa

SEQ ID NO: 4127140 - DNA, 19 bp, Homo sapiens
atgtcaaacagtgccaaat

SEQ ID NO: 4127141 - DNA, 19 bp, Homo sapiens
atgtcaaagatatgttaag

SEQ ID NO: 4127142 - DNA, 19 bp, Homo sapiens
atgtcaataaacaacagct

SEQ ID NO: 4127143 - DNA, 13 bp, Homo sapiens
atgtcacagggcc

SEQ ID NO: 4127144 - DNA, 14 bp, Homo sapiens
atgtcacagggcca

SEQ ID NO: 4127145 - DNA, 19 bp, Homo sapiens
atgtcaccggtcagtgcct

SEQ ID NO: 4127146 - DNA, 21 bp, Homo sapiens
atgtcaccggtcagtgccttt

SEQ ID NO: 4127147 - DNA, 14 bp, Homo sapiens
atgtcactagaatg

SEQ ID NO: 4127148 - DNA, 22 bp, Homo sapiens
atgtcactagaatggataaaat

SEQ ID NO: 4127149 - DNA, 16 bp, Homo sapiens
atgtcagaacagagtg

SEQ ID NO: 4127150 - DNA, 15 bp, Homo sapiens
atgtcagatttctgg

SEQ ID NO: 4127151 - DNA, 16 bp, Homo sapiens
atgtcaggcctgtgtg

SEQ ID NO: 4127152 - DNA, 14 bp, Homo sapiens
atgtcataaacgat

SEQ ID NO: 4127153 - DNA, 22 bp, Homo sapiens
atgtcatatactgccatgtact

SEQ ID NO: 4127154 - DNA, 12 bp, Homo sapiens
atgtccaaagag

SEQ ID NO: 4127155 - DNA, 19 bp, Homo sapiens
atgtccaaagaggctgccc

SEQ ID NO: 4127156 - DNA, 14 bp, Homo sapiens
atgtccaagttctt

SEQ ID NO: 4127157 - DNA, 20 bp, Homo sapiens
atgtccaagttcttcacctc

SEQ ID NO: 4127158 - DNA, 13 bp, Homo sapiens
atgtccatacact

SEQ ID NO: 4127159 - DNA, 19 bp, Homo sapiens
atgtccctagaaaacaatg

SEQ ID NO: 4127160 - DNA, 16 bp, Homo sapiens
atgtccctgggccagg

SEQ ID NO: 4127161 - DNA, 17 bp, Homo sapiens
atgtccctgggccaggg

SEQ ID NO: 4127162 - DNA, 20 bp, Homo sapiens
atgtccctgggccagggtct

SEQ ID NO: 4127163 - DNA, 17 bp, Homo sapiens
atgtccctttcttctcc

SEQ ID NO: 4127164 - DNA, 18 bp, Homo sapiens
atgtccctttcttctccc

SEQ ID NO: 4127165 - DNA, 20 bp, Homo sapiens
atgtcctaaggacacactaa

SEQ ID NO: 4127166 - DNA, 15 bp, Homo sapiens
atgtcctgcctttta

SEQ ID NO: 4127167 - DNA, 17 bp, Homo sapiens
atgtcctgctggcttcc

SEQ ID NO: 4127168 - DNA, 18 bp, Homo sapiens
atgtcgtcgagctccccc

SEQ ID NO: 4127169 - DNA, 17 bp, Homo sapiens
atgtctattaaggtgat

SEQ ID NO: 4127170 - DNA, 13 bp, Homo sapiens
atgtctattatta

SEQ ID NO: 4127171 - DNA, 15 bp, Homo sapiens
atgtctatttaagcc

SEQ ID NO: 4127172 - DNA, 20 bp, Homo sapiens
atgtctcaatagtaaaagat

SEQ ID NO: 4127173 - DNA, 17 bp, Homo sapiens
atgtctcactgttctgc

SEQ ID NO: 4127174 - DNA, 19 bp, Homo sapiens
atgtctcactgttctgcaa

SEQ ID NO: 4127175 - DNA, 11 bp, Homo sapiens
atgtctctggg

SEQ ID NO: 4127176 - DNA, 19 bp, Homo sapiens
atgtctctggggcagatcc

SEQ ID NO: 4127177 - DNA, 14 bp, Homo sapiens
atgtctgataatga

SEQ ID NO: 4127178 - DNA, 13 bp, Homo sapiens
atgtctgcctgga

SEQ ID NO: 4127179 - DNA, 13 bp, Homo sapiens
atgtctgctgagt

SEQ ID NO: 4127180 - DNA, 16 bp, Homo sapiens
atgtctgtagctcctc

SEQ ID NO: 4127181 - DNA, 18 bp, Homo sapiens
atgtctgtagctcctcaa

SEQ ID NO: 4127182 - DNA, 14 bp, Homo sapiens
atgtctgtttaaga

SEQ ID NO: 4127183 - DNA, 17 bp, Homo sapiens
atgtctgtttaagaaaa

SEQ ID NO: 4127184 - DNA, 15 bp, Homo sapiens
atgtcttcataaagt

SEQ ID NO: 4127185 - DNA, 19 bp, Homo sapiens
atgtcttcataaagtactt

SEQ ID NO: 4127186 - DNA, 12 bp, Homo sapiens
atgtcttccctg

SEQ ID NO: 4127187 - DNA, 22 bp, Homo sapiens
atgtctttctccaaagttatcc

SEQ ID NO: 4127188 - DNA, 13 bp, Homo sapiens
atgtctttgtaag

SEQ ID NO: 4127189 - DNA, 21 bp, Homo sapiens
atgtctttgtaagtcagtgtt

SEQ ID NO: 4127190 - DNA, 23 bp, Homo sapiens
atgtctttgttggaaaagaatac

SEQ ID NO: 4127191 - DNA, 18 bp, Homo sapiens
atgtcttttagaagatag

SEQ ID NO: 4127192 - DNA, 16 bp, Homo sapiens
atgtcttttatatttg

SEQ ID NO: 4127193 - DNA, 15 bp, Homo sapiens
atgtcttttcttggc

SEQ ID NO: 4127194 - DNA, 12 bp, Homo sapiens
atgtgaaacatt

SEQ ID NO: 4127195 - DNA, 23 bp, Homo sapiens
atgtgaaaccttttttaagattt

SEQ ID NO: 4127196 - DNA, 12 bp, Homo sapiens
atgtgaaagcac

SEQ ID NO: 4127197 - DNA, 15 bp, Homo sapiens
atgtgaactttatta

SEQ ID NO: 4127198 - DNA, 15 bp, Homo sapiens
atgtgaagacatttt

SEQ ID NO: 4127199 - DNA, 21 bp, Homo sapiens
atgtgaagccaattcagacag

SEQ ID NO: 4127200 - DNA, 14 bp, Homo sapiens
atgtgaaggcccaa

SEQ ID NO: 4127201 - DNA, 20 bp, Homo sapiens
atgtgaattattgacactga

SEQ ID NO: 4127202 - DNA, 13 bp, Homo sapiens
atgtgaattttta

SEQ ID NO: 4127203 - DNA, 15 bp, Homo sapiens
atgtgaatttttaag

SEQ ID NO: 4127204 - DNA, 16 bp, Homo sapiens
atgtgaatttttaagc

SEQ ID NO: 4127205 - DNA, 17 bp, Homo sapiens
atgtgaatttttaagct

SEQ ID NO: 4127206 - DNA, 18 bp, Homo sapiens
atgtgaatttttaagctg

SEQ ID NO: 4127207 - DNA, 21 bp, Homo sapiens
atgtgaatttttaagctgcaa

SEQ ID NO: 4127208 - DNA, 18 bp, Homo sapiens
atgtgaatttttatttct

SEQ ID NO: 4127209 - DNA, 15 bp, Homo sapiens
atgtgacaataatat

SEQ ID NO: 4127210 - DNA, 21 bp, Homo sapiens
atgtgacaattttgtacaaat

SEQ ID NO: 4127211 - DNA, 15 bp, Homo sapiens
atgtgacaccaaagc

SEQ ID NO: 4127212 - DNA, 21 bp, Homo sapiens
atgtgacattaacaaataaaa

SEQ ID NO: 4127213 - DNA, 14 bp, Homo sapiens
atgtgactaaagga

SEQ ID NO: 4127214 - DNA, 22 bp, Homo sapiens
atgtgactaaaggaaaaaactt

SEQ ID NO: 4127215 - DNA, 19 bp, Homo sapiens
atgtgactttttttggtat

SEQ ID NO: 4127216 - DNA, 14 bp, Homo sapiens
atgtgagaagccag

SEQ ID NO: 4127217 - DNA, 14 bp, Homo sapiens
atgtgagagaaagt

SEQ ID NO: 4127218 - DNA, 21 bp, Homo sapiens
atgtgagattttttattgcta

SEQ ID NO: 4127219 - DNA, 19 bp, Homo sapiens
atgtgagctgctgccatga

SEQ ID NO: 4127220 - DNA, 14 bp, Homo sapiens
atgtgaggaggaaa

SEQ ID NO: 4127221 - DNA, 20 bp, Homo sapiens
atgtgagtgccttttgcaga

SEQ ID NO: 4127222 - DNA, 22 bp, Homo sapiens
atgtgagtgccttttgcagaag

SEQ ID NO: 4127223 - DNA, 20 bp, Homo sapiens
atgtgataaggatcagaaca

SEQ ID NO: 4127224 - DNA, 17 bp, Homo sapiens
atgtgatatataagtgt

SEQ ID NO: 4127225 - DNA, 20 bp, Homo sapiens
atgtgatcatgtgtggaagt

SEQ ID NO: 4127226 - DNA, 19 bp, Homo sapiens
atgtgatgcttataataaa

SEQ ID NO: 4127227 - DNA, 20 bp, Homo sapiens
atgtgcacccggcctggatg

SEQ ID NO: 4127228 - DNA, 18 bp, Homo sapiens
atgtgcactgtcactttg

SEQ ID NO: 4127229 - DNA, 20 bp, Homo sapiens
atgtgcatttttgtgaaatg

SEQ ID NO: 4127230 - DNA, 15 bp, Homo sapiens
atgtgccaaggtggg

SEQ ID NO: 4127231 - DNA, 23 bp, Homo sapiens
atgtgccaataaccaagtttatt

SEQ ID NO: 4127232 - DNA, 16 bp, Homo sapiens
atgtgccagttcctgt

SEQ ID NO: 4127233 - DNA, 14 bp, Homo sapiens
atgtgccatctgta

SEQ ID NO: 4127234 - DNA, 19 bp, Homo sapiens
atgtgccatctgtacatat

SEQ ID NO: 4127235 - DNA, 14 bp, Homo sapiens
atgtgcccctggcc

SEQ ID NO: 4127236 - DNA, 17 bp, Homo sapiens
atgtgccgaatgtgcag

SEQ ID NO: 4127237 - DNA, 18 bp, Homo sapiens
atgtgccgaatgtgcagg

SEQ ID NO: 4127238 - DNA, 14 bp, Homo sapiens
atgtgcctttcttt

SEQ ID NO: 4127239 - DNA, 20 bp, Homo sapiens
atgtgcctttctttgcctct

SEQ ID NO: 4127240 - DNA, 14 bp, Homo sapiens
atgtgctactgatt

SEQ ID NO: 4127241 - DNA, 15 bp, Homo sapiens
atgtgctgggtgcct

SEQ ID NO: 4127242 - DNA, 18 bp, Homo sapiens
atgtgctgtgaccattta

SEQ ID NO: 4127243 - DNA, 19 bp, Homo sapiens
atgtggaaagtgaatttga

SEQ ID NO: 4127244 - DNA, 16 bp, Homo sapiens
atgtggactaaatatc

SEQ ID NO: 4127245 - DNA, 15 bp, Homo sapiens
atgtggagaagagtg

SEQ ID NO: 4127246 - DNA, 20 bp, Homo sapiens
atgtggagactgatggccag

SEQ ID NO: 4127247 - DNA, 18 bp, Homo sapiens
atgtggcaaggaaaaaca

SEQ ID NO: 4127248 - DNA, 17 bp, Homo sapiens
atgtggcattggggggc

SEQ ID NO: 4127249 - DNA, 17 bp, Homo sapiens
atgtggccacttatttc

SEQ ID NO: 4127250 - DNA, 16 bp, Homo sapiens
atgtggcttgagaaat

SEQ ID NO: 4127251 - DNA, 22 bp, Homo sapiens
atgtggcttttttaaaaaagca

SEQ ID NO: 4127252 - DNA, 13 bp, Homo sapiens
atgtggggccagg

SEQ ID NO: 4127253 - DNA, 15 bp, Homo sapiens
atgtgggtgagccag

SEQ ID NO: 4127254 - DNA, 19 bp, Homo sapiens
atgtggtcgttagagacag

SEQ ID NO: 4127255 - DNA, 14 bp, Homo sapiens
atgtggtctcagga

SEQ ID NO: 4127256 - DNA, 20 bp, Homo sapiens
atgtggttacttcctactgt

SEQ ID NO: 4127257 - DNA, 17 bp, Homo sapiens
atgtggttatttctctg

SEQ ID NO: 4127258 - DNA, 15 bp, Homo sapiens
atgtgtaaaatgtga

SEQ ID NO: 4127259 - DNA, 13 bp, Homo sapiens
atgtgtaagtatt

SEQ ID NO: 4127260 - DNA, 20 bp, Homo sapiens
atgtgtacaatgtacacact

SEQ ID NO: 4127261 - DNA, 15 bp, Homo sapiens
atgtgtagcctatgt

SEQ ID NO: 4127262 - DNA, 18 bp, Homo sapiens
atgtgtcccccccaggcc

SEQ ID NO: 4127263 - DNA, 14 bp, Homo sapiens
atgtgtcccctcac

SEQ ID NO: 4127264 - DNA, 24 bp, Homo sapiens
atgtgtcccctcactctgtcagcc

SEQ ID NO: 4127265 - DNA, 17 bp, Homo sapiens
atgtgtcctcagggagc

SEQ ID NO: 4127266 - DNA, 13 bp, Homo sapiens
atgtgtcctggtt

SEQ ID NO: 4127267 - DNA, 16 bp, Homo sapiens
atgtgtctgtatttca

SEQ ID NO: 4127268 - DNA, 19 bp, Homo sapiens
atgtgtggtggcctcagct

SEQ ID NO: 4127269 - DNA, 18 bp, Homo sapiens
atgtgtttattcatccag

SEQ ID NO: 4127270 - DNA, 19 bp, Homo sapiens
atgtgtttattcatccagc

SEQ ID NO: 4127271 - DNA, 12 bp, Homo sapiens
atgtgtttccat

SEQ ID NO: 4127272 - DNA, 15 bp, Homo sapiens
atgtgttttctgaat

SEQ ID NO: 4127273 - DNA, 22 bp, Homo sapiens
atgttaaatactgtgcagaata

SEQ ID NO: 4127274 - DNA, 12 bp, Homo sapiens
atgttaaatttg

SEQ ID NO: 4127275 - DNA, 17 bp, Homo sapiens
atgttaaatttgtaagt

SEQ ID NO: 4127276 - DNA, 18 bp, Homo sapiens
atgttaaatttgtaagtt

SEQ ID NO: 4127277 - DNA, 18 bp, Homo sapiens
atgttaacctcagtgtca

SEQ ID NO: 4127278 - DNA, 23 bp, Homo sapiens
atgttaagcagctaaattttctg

SEQ ID NO: 4127279 - DNA, 17 bp, Homo sapiens
atgttaaggaaactctt

SEQ ID NO: 4127280 - DNA, 23 bp, Homo sapiens
atgttaaggaaactcttatctca

SEQ ID NO: 4127281 - DNA, 17 bp, Homo sapiens
atgttacactaagggtg

SEQ ID NO: 4127282 - DNA, 14 bp, Homo sapiens
atgttacattgttt

SEQ ID NO: 4127283 - DNA, 22 bp, Homo sapiens
atgttactcagtgttagagaaa

SEQ ID NO: 4127284 - DNA, 14 bp, Homo sapiens
atgttactgaccag

SEQ ID NO: 4127285 - DNA, 20 bp, Homo sapiens
atgttactgatcatgcattg

SEQ ID NO: 4127286 - DNA, 22 bp, Homo sapiens
atgttactgatcatgcattgtt

SEQ ID NO: 4127287 - DNA, 14 bp, Homo sapiens
atgttactgcttca

SEQ ID NO: 4127288 - DNA, 15 bp, Homo sapiens
atgttactgcttcat

SEQ ID NO: 4127289 - DNA, 17 bp, Homo sapiens
atgttagtattttaatc

SEQ ID NO: 4127290 - DNA, 18 bp, Homo sapiens
atgttagtattttaatcc

SEQ ID NO: 4127291 - DNA, 22 bp, Homo sapiens
atgttagtcattgttatttata

SEQ ID NO: 4127292 - DNA, 12 bp, Homo sapiens
atgttagttcta

SEQ ID NO: 4127293 - DNA, 21 bp, Homo sapiens
atgttagttctagctctattt

SEQ ID NO: 4127294 - DNA, 20 bp, Homo sapiens
atgttatgatattgtttaaa

SEQ ID NO: 4127295 - DNA, 13 bp, Homo sapiens
atgttatttaaca

SEQ ID NO: 4127296 - DNA, 17 bp, Homo sapiens
atgttattttttaatta

SEQ ID NO: 4127297 - DNA, 18 bp, Homo sapiens
atgttcaaagccacatta

SEQ ID NO: 4127298 - DNA, 17 bp, Homo sapiens
atgttcacgcaacttga

SEQ ID NO: 4127299 - DNA, 16 bp, Homo sapiens
atgttcagattattgg

SEQ ID NO: 4127300 - DNA, 23 bp, Homo sapiens
atgttcattgtaatgttactgat

SEQ ID NO: 4127301 - DNA, 16 bp, Homo sapiens
atgttctgacattaac

SEQ ID NO: 4127302 - DNA, 17 bp, Homo sapiens
atgttctgacattaaca

SEQ ID NO: 4127303 - DNA, 18 bp, Homo sapiens
atgttctgacattaacag

SEQ ID NO: 4127304 - DNA, 16 bp, Homo sapiens
atgttcttatagaata

SEQ ID NO: 4127305 - DNA, 17 bp, Homo sapiens
atgttcttatagaataa

SEQ ID NO: 4127306 - DNA, 21 bp, Homo sapiens
atgttcttatgcaaaatggaa

SEQ ID NO: 4127307 - DNA, 16 bp, Homo sapiens
atgttctttggaaagt

SEQ ID NO: 4127308 - DNA, 20 bp, Homo sapiens
atgttcttttaaatgattga

SEQ ID NO: 4127309 - DNA, 16 bp, Homo sapiens
atgttgagaatcccaa

SEQ ID NO: 4127310 - DNA, 22 bp, Homo sapiens
atgttgagaatcccaaatttga

SEQ ID NO: 4127311 - DNA, 17 bp, Homo sapiens
atgttggaagagaaagc

SEQ ID NO: 4127312 - DNA, 16 bp, Homo sapiens
atgttggatttataaa

SEQ ID NO: 4127313 - DNA, 21 bp, Homo sapiens
atgttggatttataaatgcta

SEQ ID NO: 4127314 - DNA, 15 bp, Homo sapiens
atgttgggaaagtat

SEQ ID NO: 4127315 - DNA, 22 bp, Homo sapiens
atgttgggggggaccctgcctc

SEQ ID NO: 4127316 - DNA, 15 bp, Homo sapiens
atgttgtacaatgta

SEQ ID NO: 4127317 - DNA, 14 bp, Homo sapiens
atgttgttatttaa

SEQ ID NO: 4127318 - DNA, 15 bp, Homo sapiens
atgttgttcaaatgc

SEQ ID NO: 4127319 - DNA, 14 bp, Homo sapiens
atgttgttgaaagg

SEQ ID NO: 4127320 - DNA, 19 bp, Homo sapiens
atgtttaaaataaaatgaa

SEQ ID NO: 4127321 - DNA, 18 bp, Homo sapiens
atgtttaaagtaattgtt

SEQ ID NO: 4127322 - DNA, 14 bp, Homo sapiens
atgtttaaatcatg

SEQ ID NO: 4127323 - DNA, 17 bp, Homo sapiens
atgtttaaatcatgtat

SEQ ID NO: 4127324 - DNA, 22 bp, Homo sapiens
atgtttaaatcatgtatgttat

SEQ ID NO: 4127325 - DNA, 20 bp, Homo sapiens
atgtttaagtattaacttac

SEQ ID NO: 4127326 - DNA, 18 bp, Homo sapiens
atgtttacactctttgta

SEQ ID NO: 4127327 - DNA, 21 bp, Homo sapiens
atgtttacactctttgtaaga

SEQ ID NO: 4127328 - DNA, 22 bp, Homo sapiens
atgtttacaggtggacacacaa

SEQ ID NO: 4127329 - DNA, 14 bp, Homo sapiens
atgtttatatactg

SEQ ID NO: 4127330 - DNA, 16 bp, Homo sapiens
atgtttatgagccaga

SEQ ID NO: 4127331 - DNA, 18 bp, Homo sapiens
atgtttatgcaaggaagg

SEQ ID NO: 4127332 - DNA, 20 bp, Homo sapiens
atgtttatgcaaggaaggaa

SEQ ID NO: 4127333 - DNA, 14 bp, Homo sapiens
atgtttatgttctt

SEQ ID NO: 4127334 - DNA, 14 bp, Homo sapiens
atgtttattcctga

SEQ ID NO: 4127335 - DNA, 18 bp, Homo sapiens
atgtttcaggaggctgga

SEQ ID NO: 4127336 - DNA, 13 bp, Homo sapiens
atgtttgaatatg

SEQ ID NO: 4127337 - DNA, 23 bp, Homo sapiens
atgtttgctcttgtttttattaa

SEQ ID NO: 4127338 - DNA, 17 bp, Homo sapiens
atgtttggattctctta

SEQ ID NO: 4127339 - DNA, 18 bp, Homo sapiens
atgtttgggcagaaggga

SEQ ID NO: 4127340 - DNA, 23 bp, Homo sapiens
atgtttgggcagaagggagaagg

SEQ ID NO: 4127341 - DNA, 13 bp, Homo sapiens
atgtttggtaaga

SEQ ID NO: 4127342 - DNA, 14 bp, Homo sapiens
atgtttgtggcctc

SEQ ID NO: 4127343 - DNA, 18 bp, Homo sapiens
atgtttgtggcctcagaa

SEQ ID NO: 4127344 - DNA, 14 bp, Homo sapiens
atgttttaaacaca

SEQ ID NO: 4127345 - DNA, 20 bp, Homo sapiens
atgttttaccgtaataatta

SEQ ID NO: 4127346 - DNA, 20 bp, Homo sapiens
atgttttattatttctatta

SEQ ID NO: 4127347 - DNA, 14 bp, Homo sapiens
atgttttatttatc

SEQ ID NO: 4127348 - DNA, 21 bp, Homo sapiens
atgttttctgaaaatataacc

SEQ ID NO: 4127349 - DNA, 20 bp, Homo sapiens
atgttttgtatatacagtta

SEQ ID NO: 4127350 - DNA, 16 bp, Homo sapiens
atgttttgtttctgaa

SEQ ID NO: 4127351 - DNA, 21 bp, Homo sapiens
atgttttgtttctgaaaattc

SEQ ID NO: 4127352 - DNA, 15 bp, Homo sapiens
atgtttttcatgaaa

SEQ ID NO: 4127353 - DNA, 21 bp, Homo sapiens
atgtttttctgccagggagct

SEQ ID NO: 4127354 - DNA, 18 bp, Homo sapiens
atgtttttggttattggt

SEQ ID NO: 4127355 - DNA, 19 bp, Homo sapiens
atgttttttagatcaaata

SEQ ID NO: 4127356 - DNA, 21 bp, Homo sapiens
atgttttttgccacagctttt

SEQ ID NO: 4127357 - DNA, 22 bp, Homo sapiens
atgttttttgccacagcttttg

SEQ ID NO: 4127358 - DNA, 12 bp, Homo sapiens
attaaaaaacaa

SEQ ID NO: 4127359 - DNA, 13 bp, Homo sapiens
attaaaaagttaa

SEQ ID NO: 4127360 - DNA, 17 bp, Homo sapiens
attaaaaagttaatctt

SEQ ID NO: 4127361 - DNA, 21 bp, Homo sapiens
attaaaacacattatgtatct

SEQ ID NO: 4127362 - DNA, 22 bp, Homo sapiens
attaaaacagctgcattagaaa

SEQ ID NO: 4127363 - DNA, 15 bp, Homo sapiens
attaaaactaggtaa

SEQ ID NO: 4127364 - DNA, 13 bp, Homo sapiens
attaaaacttctt

SEQ ID NO: 4127365 - DNA, 20 bp, Homo sapiens
attaaaacttcttaaatatc

SEQ ID NO: 4127366 - DNA, 19 bp, Homo sapiens
attaaacagatgatgagaa

SEQ ID NO: 4127367 - DNA, 18 bp, Homo sapiens
attaaacagatttttaca

SEQ ID NO: 4127368 - DNA, 16 bp, Homo sapiens
attaaacataaaacaa

SEQ ID NO: 4127369 - DNA, 13 bp, Homo sapiens
attaaagacagag

SEQ ID NO: 4127370 - DNA, 22 bp, Homo sapiens
attaaagcttatttttctgtga

SEQ ID NO: 4127371 - DNA, 17 bp, Homo sapiens
attaaaggtcctgccct

SEQ ID NO: 4127372 - DNA, 13 bp, Homo sapiens
attaaataaaatc

SEQ ID NO: 4127373 - DNA, 21 bp, Homo sapiens
attaaataaaatcaattttta

SEQ ID NO: 4127374 - DNA, 19 bp, Homo sapiens
attaaatacaaaacttcca

SEQ ID NO: 4127375 - DNA, 12 bp, Homo sapiens
attaaatacaga

SEQ ID NO: 4127376 - DNA, 17 bp, Homo sapiens
attaaatagttatataa

SEQ ID NO: 4127377 - DNA, 14 bp, Homo sapiens
attaaatatagatt

SEQ ID NO: 4127378 - DNA, 15 bp, Homo sapiens
attaaatccaataaa

SEQ ID NO: 4127379 - DNA, 11 bp, Homo sapiens
attaaatctgt

SEQ ID NO: 4127380 - DNA, 13 bp, Homo sapiens
attaaattcacaa

SEQ ID NO: 4127381 - DNA, 17 bp, Homo sapiens
attaaattttttttaca

SEQ ID NO: 4127382 - DNA, 19 bp, Homo sapiens
attaaattttttttacatt

SEQ ID NO: 4127383 - DNA, 20 bp, Homo sapiens
attaaattttttttacattt

SEQ ID NO: 4127384 - DNA, 21 bp, Homo sapiens
attaacaaatatgctaatttg

SEQ ID NO: 4127385 - DNA, 14 bp, Homo sapiens
attaacaaattatg

SEQ ID NO: 4127386 - DNA, 12 bp, Homo sapiens
attaacagtttt

SEQ ID NO: 4127387 - DNA, 19 bp, Homo sapiens
attaacagttttccatgaa

SEQ ID NO: 4127388 - DNA, 22 bp, Homo sapiens
attaacagttttccatgaaaac

SEQ ID NO: 4127389 - DNA, 16 bp, Homo sapiens
attaaccatttaataa

SEQ ID NO: 4127390 - DNA, 16 bp, Homo sapiens
attaacctggtgctgg

SEQ ID NO: 4127391 - DNA, 21 bp, Homo sapiens
attaagaaaccttgctctcct

SEQ ID NO: 4127392 - DNA, 19 bp, Homo sapiens
attaagaaggcaaaaatgt

SEQ ID NO: 4127393 - DNA, 22 bp, Homo sapiens
attaagaaggcaaaaatgtaaa

SEQ ID NO: 4127394 - DNA, 14 bp, Homo sapiens
attaagatacaaat

SEQ ID NO: 4127395 - DNA, 24 bp, Homo sapiens
attaagatggattctcagatattt

SEQ ID NO: 4127396 - DNA, 17 bp, Homo sapiens
attaagattgaggcctg

SEQ ID NO: 4127397 - DNA, 21 bp, Homo sapiens
attaagcactttaagctcctt

SEQ ID NO: 4127398 - DNA, 15 bp, Homo sapiens
attaagcagtaaaaa

SEQ ID NO: 4127399 - DNA, 19 bp, Homo sapiens
attaagcagtaaaaactgt

SEQ ID NO: 4127400 - DNA, 14 bp, Homo sapiens
attaaggtatttcg

SEQ ID NO: 4127401 - DNA, 23 bp, Homo sapiens
attaaggtatttcgaaactgcca

SEQ ID NO: 4127402 - DNA, 18 bp, Homo sapiens
attaagtaatcaataaag

SEQ ID NO: 4127403 - DNA, 14 bp, Homo sapiens
attaagtactatgt

SEQ ID NO: 4127404 - DNA, 16 bp, Homo sapiens
attaagtactatgtat

SEQ ID NO: 4127405 - DNA, 18 bp, Homo sapiens
attaagtactatgtatca

SEQ ID NO: 4127406 - DNA, 19 bp, Homo sapiens
attaagtactatgtatcaa

SEQ ID NO: 4127407 - DNA, 21 bp, Homo sapiens
attaagtagaacaaaaaaccc

SEQ ID NO: 4127408 - DNA, 13 bp, Homo sapiens
attaagtcatgtg

SEQ ID NO: 4127409 - DNA, 18 bp, Homo sapiens
attaagtcatgtgtgaac

SEQ ID NO: 4127410 - DNA, 16 bp, Homo sapiens
attaataaaaaatgga

SEQ ID NO: 4127411 - DNA, 22 bp, Homo sapiens
attaataaaaaatggaaagaat

SEQ ID NO: 4127412 - DNA, 18 bp, Homo sapiens
attaatagcagcctttct

SEQ ID NO: 4127413 - DNA, 22 bp, Homo sapiens
attaatatatagtccagacact

SEQ ID NO: 4127414 - DNA, 22 bp, Homo sapiens
attaatatatgtattatttata

SEQ ID NO: 4127415 - DNA, 15 bp, Homo sapiens
attaatattattatg

SEQ ID NO: 4127416 - DNA, 15 bp, Homo sapiens
attaatattgtattg

SEQ ID NO: 4127417 - DNA, 16 bp, Homo sapiens
attaatcaaaattgtc

SEQ ID NO: 4127418 - DNA, 11 bp, Homo sapiens
attaatcaaag

SEQ ID NO: 4127419 - DNA, 16 bp, Homo sapiens
attaatcactattgtt

SEQ ID NO: 4127420 - DNA, 14 bp, Homo sapiens
attaatcatctata

SEQ ID NO: 4127421 - DNA, 13 bp, Homo sapiens
attaatgcctctc

SEQ ID NO: 4127422 - DNA, 19 bp, Homo sapiens
attaatgcctctcccgcac

SEQ ID NO: 4127423 - DNA, 16 bp, Homo sapiens
attaatgtacttgttt

SEQ ID NO: 4127424 - DNA, 22 bp, Homo sapiens
attaatgtttctatctgatttt

SEQ ID NO: 4127425 - DNA, 13 bp, Homo sapiens
attaattaaacat

SEQ ID NO: 4127426 - DNA, 13 bp, Homo sapiens
attaattctataa

SEQ ID NO: 4127427 - DNA, 19 bp, Homo sapiens
attaattgttttgcacttt

SEQ ID NO: 4127428 - DNA, 16 bp, Homo sapiens
attaatttgattaaca

SEQ ID NO: 4127429 - DNA, 17 bp, Homo sapiens
attaatttgattaacaa

SEQ ID NO: 4127430 - DNA, 18 bp, Homo sapiens
attaatttgattaacaaa

SEQ ID NO: 4127431 - DNA, 14 bp, Homo sapiens
attacaatatttct

SEQ ID NO: 4127432 - DNA, 15 bp, Homo sapiens
attacagttcataat

SEQ ID NO: 4127433 - DNA, 16 bp, Homo sapiens
attacatgtaaaacat

SEQ ID NO: 4127434 - DNA, 19 bp, Homo sapiens
attacatgtaaaacattat

SEQ ID NO: 4127435 - DNA, 15 bp, Homo sapiens
attaccaagagaagg

SEQ ID NO: 4127436 - DNA, 22 bp, Homo sapiens
attaccagggactatctttgct

SEQ ID NO: 4127437 - DNA, 22 bp, Homo sapiens
attacctccatccatccttcca

SEQ ID NO: 4127438 - DNA, 13 bp, Homo sapiens
attacctctgata

SEQ ID NO: 4127439 - DNA, 16 bp, Homo sapiens
attacgtgagccaggt

SEQ ID NO: 4127440 - DNA, 20 bp, Homo sapiens
attacgtgagccaggtaatg

SEQ ID NO: 4127441 - DNA, 15 bp, Homo sapiens
attacgtttgttatt

SEQ ID NO: 4127442 - DNA, 19 bp, Homo sapiens
attactaattttacacatt

SEQ ID NO: 4127443 - DNA, 20 bp, Homo sapiens
attactacaaaatttgaaat

SEQ ID NO: 4127444 - DNA, 21 bp, Homo sapiens
attactacaaaatttgaaatt

SEQ ID NO: 4127445 - DNA, 17 bp, Homo sapiens
attactgtcaataaaca

SEQ ID NO: 4127446 - DNA, 17 bp, Homo sapiens
attactgtgtaaatata

SEQ ID NO: 4127447 - DNA, 19 bp, Homo sapiens
attactgttgcatttactt

SEQ ID NO: 4127448 - DNA, 17 bp, Homo sapiens
attactgtttatttctg

SEQ ID NO: 4127449 - DNA, 19 bp, Homo sapiens
attacttgattaagatttt

SEQ ID NO: 4127450 - DNA, 13 bp, Homo sapiens
attagaaaatgtt

SEQ ID NO: 4127451 - DNA, 18 bp, Homo sapiens
attagaaaatgttattta

SEQ ID NO: 4127452 - DNA, 20 bp, Homo sapiens
attagaaacccaaattggga

SEQ ID NO: 4127453 - DNA, 13 bp, Homo sapiens
attagaatagtgt

SEQ ID NO: 4127454 - DNA, 18 bp, Homo sapiens
attagactgtgattcaga

SEQ ID NO: 4127455 - DNA, 20 bp, Homo sapiens
attagactttagaaataaat

SEQ ID NO: 4127456 - DNA, 13 bp, Homo sapiens
attagagggaggt

SEQ ID NO: 4127457 - DNA, 22 bp, Homo sapiens
attagagggaggtgtttaaaga

SEQ ID NO: 4127458 - DNA, 16 bp, Homo sapiens
attagaggggaaaagc

SEQ ID NO: 4127459 - DNA, 22 bp, Homo sapiens
attagatggcttattttttaaa

SEQ ID NO: 4127460 - DNA, 17 bp, Homo sapiens
attagatgtgccaataa

SEQ ID NO: 4127461 - DNA, 21 bp, Homo sapiens
attagcaaggtcatttcttca

SEQ ID NO: 4127462 - DNA, 17 bp, Homo sapiens
attagcagtttgctttg

SEQ ID NO: 4127463 - DNA, 14 bp, Homo sapiens
attagccaggatca

SEQ ID NO: 4127464 - DNA, 21 bp, Homo sapiens
attagccaggatcatggtgta

SEQ ID NO: 4127465 - DNA, 22 bp, Homo sapiens
attagctgtgatttttgttgat

SEQ ID NO: 4127466 - DNA, 20 bp, Homo sapiens
attaggaagtgtaacagctg

SEQ ID NO: 4127467 - DNA, 13 bp, Homo sapiens
attaggaataaat

SEQ ID NO: 4127468 - DNA, 16 bp, Homo sapiens
attaggaataaataaa

SEQ ID NO: 4127469 - DNA, 14 bp, Homo sapiens
attaggactgtata

SEQ ID NO: 4127470 - DNA, 15 bp, Homo sapiens
attaggactgtataa

SEQ ID NO: 4127471 - DNA, 22 bp, Homo sapiens
attaggagaaacacattcttat

SEQ ID NO: 4127472 - DNA, 14 bp, Homo sapiens
attaggattttgat

SEQ ID NO: 4127473 - DNA, 21 bp, Homo sapiens
attaggcaaggctatgtgatt

SEQ ID NO: 4127474 - DNA, 18 bp, Homo sapiens
attaggccagcaacgctt

SEQ ID NO: 4127475 - DNA, 16 bp, Homo sapiens
attagggagaaaattc

SEQ ID NO: 4127476 - DNA, 14 bp, Homo sapiens
attagtaaatgtct

SEQ ID NO: 4127477 - DNA, 17 bp, Homo sapiens
attagtaaatgtctttg

SEQ ID NO: 4127478 - DNA, 21 bp, Homo sapiens
attagtaaatgtctttgtaag

SEQ ID NO: 4127479 - DNA, 15 bp, Homo sapiens
attagtaactttgaa

SEQ ID NO: 4127480 - DNA, 18 bp, Homo sapiens
attagtaagctagcaaat

SEQ ID NO: 4127481 - DNA, 13 bp, Homo sapiens
attagtgaagatg

SEQ ID NO: 4127482 - DNA, 19 bp, Homo sapiens
attagtgccagaattttag

SEQ ID NO: 4127483 - DNA, 21 bp, Homo sapiens
attagttgaaaggcctcaaga

SEQ ID NO: 4127484 - DNA, 21 bp, Homo sapiens
attagtttcacatgatatacc

SEQ ID NO: 4127485 - DNA, 18 bp, Homo sapiens
attagtttcctttttaat

SEQ ID NO: 4127486 - DNA, 14 bp, Homo sapiens
attataaacgctta

SEQ ID NO: 4127487 - DNA, 17 bp, Homo sapiens
attataaatatcattgt

SEQ ID NO: 4127488 - DNA, 15 bp, Homo sapiens
attataacttaaaat

SEQ ID NO: 4127489 - DNA, 20 bp, Homo sapiens
attataacttaaaatatttt

SEQ ID NO: 4127490 - DNA, 18 bp, Homo sapiens
attataagcattgaaatt

SEQ ID NO: 4127491 - DNA, 15 bp, Homo sapiens
attataagggagagc

SEQ ID NO: 4127492 - DNA, 13 bp, Homo sapiens
attataatgaatt

SEQ ID NO: 4127493 - DNA, 22 bp, Homo sapiens
attataatttttttcaatattt

SEQ ID NO: 4127494 - DNA, 20 bp, Homo sapiens
attatacatcaattggaaat

SEQ ID NO: 4127495 - DNA, 15 bp, Homo sapiens
attatacctgttgct

SEQ ID NO: 4127496 - DNA, 17 bp, Homo sapiens
attatactaagaaaaga

SEQ ID NO: 4127497 - DNA, 23 bp, Homo sapiens
attatagacaacgatgaatttct

SEQ ID NO: 4127498 - DNA, 19 bp, Homo sapiens
attataggagccttaattt

SEQ ID NO: 4127499 - DNA, 13 bp, Homo sapiens
attatattaaaat

SEQ ID NO: 4127500 - DNA, 17 bp, Homo sapiens
attatcaatatctaata

SEQ ID NO: 4127501 - DNA, 14 bp, Homo sapiens
attatccatattga

SEQ ID NO: 4127502 - DNA, 12 bp, Homo sapiens
attatccctgaa

SEQ ID NO: 4127503 - DNA, 21 bp, Homo sapiens
attatcctgaactcttctgca

SEQ ID NO: 4127504 - DNA, 23 bp, Homo sapiens
attatcgctttatgtttttggtt

SEQ ID NO: 4127505 - DNA, 17 bp, Homo sapiens
attatcggaagcagtgc

SEQ ID NO: 4127506 - DNA, 19 bp, Homo sapiens
attatcggaagcagtgcct

SEQ ID NO: 4127507 - DNA, 16 bp, Homo sapiens
attatcgggaacagtg

SEQ ID NO: 4127508 - DNA, 22 bp, Homo sapiens
attatcgggaacagtgtttccc

SEQ ID NO: 4127509 - DNA, 16 bp, Homo sapiens
attatcgggagcagtg

SEQ ID NO: 4127510 - DNA, 14 bp, Homo sapiens
attatctatacata

SEQ ID NO: 4127511 - DNA, 15 bp, Homo sapiens
attatctatgcagca

SEQ ID NO: 4127512 - DNA, 17 bp, Homo sapiens
attatctatgcagcatg

SEQ ID NO: 4127513 - DNA, 14 bp, Homo sapiens
attatcttatgaat

SEQ ID NO: 4127514 - DNA, 20 bp, Homo sapiens
attatgaaagcaacaaagaa

SEQ ID NO: 4127515 - DNA, 21 bp, Homo sapiens
attatgaaagcaacaaagaaa

SEQ ID NO: 4127516 - DNA, 23 bp, Homo sapiens
attatgaaagcaacaaagaaatc

SEQ ID NO: 4127517 - DNA, 16 bp, Homo sapiens
attatgacagttatac

SEQ ID NO: 4127518 - DNA, 17 bp, Homo sapiens
attatgacagttatact

SEQ ID NO: 4127519 - DNA, 21 bp, Homo sapiens
attatgatttgggttggggaa

SEQ ID NO: 4127520 - DNA, 17 bp, Homo sapiens
attatgcctgaatgact

SEQ ID NO: 4127521 - DNA, 15 bp, Homo sapiens
attatggaaaactgt

SEQ ID NO: 4127522 - DNA, 16 bp, Homo sapiens
attatggaagatttta

SEQ ID NO: 4127523 - DNA, 22 bp, Homo sapiens
attatgtatcttagttacattt

SEQ ID NO: 4127524 - DNA, 23 bp, Homo sapiens
attatgtatcttagttacatttc

SEQ ID NO: 4127525 - DNA, 16 bp, Homo sapiens
attatgtatgtttaca

SEQ ID NO: 4127526 - DNA, 17 bp, Homo sapiens
attatgtatgtttacat

SEQ ID NO: 4127527 - DNA, 13 bp, Homo sapiens
attatgtgacatt

SEQ ID NO: 4127528 - DNA, 17 bp, Homo sapiens
attatgttggtactttc

SEQ ID NO: 4127529 - DNA, 18 bp, Homo sapiens
attattaactacatttat

SEQ ID NO: 4127530 - DNA, 19 bp, Homo sapiens
attattataaaagggggtc

SEQ ID NO: 4127531 - DNA, 15 bp, Homo sapiens
attattataggtaat

SEQ ID NO: 4127532 - DNA, 22 bp, Homo sapiens
attattatcaggggagaaaaat

SEQ ID NO: 4127533 - DNA, 16 bp, Homo sapiens
attattattcttcata

SEQ ID NO: 4127534 - DNA, 16 bp, Homo sapiens
attattcatttaaaat

SEQ ID NO: 4127535 - DNA, 19 bp, Homo sapiens
attattcatttaaaatgat

SEQ ID NO: 4127536 - DNA, 12 bp, Homo sapiens
attattccctct

SEQ ID NO: 4127537 - DNA, 13 bp, Homo sapiens
attattctgcagc

SEQ ID NO: 4127538 - DNA, 13 bp, Homo sapiens
attattctgtttt

SEQ ID NO: 4127539 - DNA, 17 bp, Homo sapiens
attattgatagtactct

SEQ ID NO: 4127540 - DNA, 18 bp, Homo sapiens
attattggaattaacctg

SEQ ID NO: 4127541 - DNA, 14 bp, Homo sapiens
attattggcaaagt

SEQ ID NO: 4127542 - DNA, 20 bp, Homo sapiens
attattggctgctttgcctc

SEQ ID NO: 4127543 - DNA, 12 bp, Homo sapiens
attattgtaagt

SEQ ID NO: 4127544 - DNA, 18 bp, Homo sapiens
attatttaaataaaatca

SEQ ID NO: 4127545 - DNA, 13 bp, Homo sapiens
attatttattatt

SEQ ID NO: 4127546 - DNA, 19 bp, Homo sapiens
attatttgccttctgaaat

SEQ ID NO: 4127547 - DNA, 21 bp, Homo sapiens
attatttgccttctgaaatgt

SEQ ID NO: 4127548 - DNA, 12 bp, Homo sapiens
attatttgctaa

SEQ ID NO: 4127549 - DNA, 15 bp, Homo sapiens
attatttgtgtttta

SEQ ID NO: 4127550 - DNA, 21 bp, Homo sapiens
attattttcttcatccaactt

SEQ ID NO: 4127551 - DNA, 17 bp, Homo sapiens
attattttggggtctct

SEQ ID NO: 4127552 - DNA, 14 bp, Homo sapiens
attattttgtggtt

SEQ ID NO: 4127553 - DNA, 17 bp, Homo sapiens
attattttgtggttcta

SEQ ID NO: 4127554 - DNA, 21 bp, Homo sapiens
attattttgtggttctatttt

SEQ ID NO: 4127555 - DNA, 22 bp, Homo sapiens
attattttgtggttctatttta

SEQ ID NO: 4127556 - DNA, 12 bp, Homo sapiens
attatttttacc

SEQ ID NO: 4127557 - DNA, 19 bp, Homo sapiens
attatttttacctaaagac

SEQ ID NO: 4127558 - DNA, 23 bp, Homo sapiens
attatttttatactgaatataaa

SEQ ID NO: 4127559 - DNA, 11 bp, Homo sapiens
attatttttgt

SEQ ID NO: 4127560 - DNA, 14 bp, Homo sapiens
attatttttgtgtt

SEQ ID NO: 4127561 - DNA, 16 bp, Homo sapiens
attcaaaaattatcta

SEQ ID NO: 4127562 - DNA, 19 bp, Homo sapiens
attcaaaagattaatgtgt

SEQ ID NO: 4127563 - DNA, 17 bp, Homo sapiens
attcaaactggggcctc

SEQ ID NO: 4127564 - DNA, 19 bp, Homo sapiens
attcaaactggggcctcca

SEQ ID NO: 4127565 - DNA, 21 bp, Homo sapiens
attcaaagtagttttatttta

SEQ ID NO: 4127566 - DNA, 22 bp, Homo sapiens
attcaaagtgttgtgttcctgg

SEQ ID NO: 4127567 - DNA, 23 bp, Homo sapiens
attcaaagtgttgtgttcctggc

SEQ ID NO: 4127568 - DNA, 14 bp, Homo sapiens
attcaaataccaat

SEQ ID NO: 4127569 - DNA, 16 bp, Homo sapiens
attcaaccactgtaaa

SEQ ID NO: 4127570 - DNA, 12 bp, Homo sapiens
attcaagaacat

SEQ ID NO: 4127571 - DNA, 22 bp, Homo sapiens
attcaataaaatactattcttt

SEQ ID NO: 4127572 - DNA, 13 bp, Homo sapiens
attcaatattgac

SEQ ID NO: 4127573 - DNA, 16 bp, Homo sapiens
attcaatattgacatt

SEQ ID NO: 4127574 - DNA, 14 bp, Homo sapiens
attcaattcctctg

SEQ ID NO: 4127575 - DNA, 17 bp, Homo sapiens
attcaattcctctggga

SEQ ID NO: 4127576 - DNA, 18 bp, Homo sapiens
attcaattcctctgggaa

SEQ ID NO: 4127577 - DNA, 21 bp, Homo sapiens
attcaattgtaaattgaatca

SEQ ID NO: 4127578 - DNA, 16 bp, Homo sapiens
attcacactgttccag

SEQ ID NO: 4127579 - DNA, 22 bp, Homo sapiens
attcacagttctttgggccaga

SEQ ID NO: 4127580 - DNA, 23 bp, Homo sapiens
attcacagttctttgggccagac

SEQ ID NO: 4127581 - DNA, 17 bp, Homo sapiens
attcacattgaccgcaa

SEQ ID NO: 4127582 - DNA, 20 bp, Homo sapiens
attcacctatgttattttgt

SEQ ID NO: 4127583 - DNA, 23 bp, Homo sapiens
attcaccttccagtgtctcggag

SEQ ID NO: 4127584 - DNA, 13 bp, Homo sapiens
attcactggcccc

SEQ ID NO: 4127585 - DNA, 13 bp, Homo sapiens
attcagaaattgg

SEQ ID NO: 4127586 - DNA, 14 bp, Homo sapiens
attcagaaattgga

SEQ ID NO: 4127587 - DNA, 14 bp, Homo sapiens
attcagacaggcaa

SEQ ID NO: 4127588 - DNA, 14 bp, Homo sapiens
attcagagagcagc

SEQ ID NO: 4127589 - DNA, 16 bp, Homo sapiens
attcagatcactgaat

SEQ ID NO: 4127590 - DNA, 18 bp, Homo sapiens
attcagattgtcttgcaa

SEQ ID NO: 4127591 - DNA, 19 bp, Homo sapiens
attcagattttaaaaagtc

SEQ ID NO: 4127592 - DNA, 14 bp, Homo sapiens
attcagcaaaccat

SEQ ID NO: 4127593 - DNA, 16 bp, Homo sapiens
attcagcatcactaaa

SEQ ID NO: 4127594 - DNA, 16 bp, Homo sapiens
attcaggaagatgaaa

SEQ ID NO: 4127595 - DNA, 14 bp, Homo sapiens
attcaggccagccc

SEQ ID NO: 4127596 - DNA, 18 bp, Homo sapiens
attcaggccagcccagcc

SEQ ID NO: 4127597 - DNA, 19 bp, Homo sapiens
attcaggccagcccagcca

SEQ ID NO: 4127598 - DNA, 16 bp, Homo sapiens
attcaggctactcatt

SEQ ID NO: 4127599 - DNA, 16 bp, Homo sapiens
attcagtgagggtctt

SEQ ID NO: 4127600 - DNA, 21 bp, Homo sapiens
attcagtgagggtcttcttac

SEQ ID NO: 4127601 - DNA, 17 bp, Homo sapiens
attcagtgcttcttaaa

SEQ ID NO: 4127602 - DNA, 17 bp, Homo sapiens
attcagtttcataaaag

SEQ ID NO: 4127603 - DNA, 19 bp, Homo sapiens
attcagtttttgtatcttg

SEQ ID NO: 4127604 - DNA, 11 bp, Homo sapiens
attcataataa

SEQ ID NO: 4127605 - DNA, 20 bp, Homo sapiens
attcataattaaaatttatc

SEQ ID NO: 4127606 - DNA, 19 bp, Homo sapiens
attcatagtaacttcttat

SEQ ID NO: 4127607 - DNA, 15 bp, Homo sapiens
attcatccagcagtg

SEQ ID NO: 4127608 - DNA, 16 bp, Homo sapiens
attcatccagcagtgt

SEQ ID NO: 4127609 - DNA, 17 bp, Homo sapiens
attcatcccaactgtct

SEQ ID NO: 4127610 - DNA, 23 bp, Homo sapiens
attcatgcctttcatagtttatt

SEQ ID NO: 4127611 - DNA, 14 bp, Homo sapiens
attcatttaaaatg

SEQ ID NO: 4127612 - DNA, 10 bp, Homo sapiens
attcattttc

SEQ ID NO: 4127613 - DNA, 22 bp, Homo sapiens
attcattttcctgttcagtgag

SEQ ID NO: 4127614 - DNA, 18 bp, Homo sapiens
attcattttctgacatgc

SEQ ID NO: 4127615 - DNA, 20 bp, Homo sapiens
attcattttctgacatgcat

SEQ ID NO: 4127616 - DNA, 21 bp, Homo sapiens
attcattttctgacatgcatt

SEQ ID NO: 4127617 - DNA, 22 bp, Homo sapiens
attcattttctgacatgcattg

SEQ ID NO: 4127618 - DNA, 21 bp, Homo sapiens
attccaaagctttattaccag

SEQ ID NO: 4127619 - DNA, 19 bp, Homo sapiens
attccactacacctggctg

SEQ ID NO: 4127620 - DNA, 16 bp, Homo sapiens
attccactccactcag

SEQ ID NO: 4127621 - DNA, 16 bp, Homo sapiens
attccagaaaggatat

SEQ ID NO: 4127622 - DNA, 19 bp, Homo sapiens
attccagaagaagagaagc

SEQ ID NO: 4127623 - DNA, 23 bp, Homo sapiens
attccagaagaagagaagctgct

SEQ ID NO: 4127624 - DNA, 13 bp, Homo sapiens
attccagaatctt

SEQ ID NO: 4127625 - DNA, 21 bp, Homo sapiens
attccagaatcttgactttct

SEQ ID NO: 4127626 - DNA, 23 bp, Homo sapiens
attccagaatgctgtacatctat

SEQ ID NO: 4127627 - DNA, 18 bp, Homo sapiens
attccagagagtggctcc

SEQ ID NO: 4127628 - DNA, 21 bp, Homo sapiens
attccagagagtggctcctcc

SEQ ID NO: 4127629 - DNA, 15 bp, Homo sapiens
attccagagtgctga

SEQ ID NO: 4127630 - DNA, 22 bp, Homo sapiens
attccagcaataagaaatgaac

SEQ ID NO: 4127631 - DNA, 13 bp, Homo sapiens
attccatatttat

SEQ ID NO: 4127632 - DNA, 15 bp, Homo sapiens
attccatgaatgtat

SEQ ID NO: 4127633 - DNA, 17 bp, Homo sapiens
attccatgaatgtatca

SEQ ID NO: 4127634 - DNA, 23 bp, Homo sapiens
attccatgaatgtatcaggaaat

SEQ ID NO: 4127635 - DNA, 22 bp, Homo sapiens
attcccaactgagtgttatttg

SEQ ID NO: 4127636 - DNA, 15 bp, Homo sapiens
attcccaccaaggtc

SEQ ID NO: 4127637 - DNA, 15 bp, Homo sapiens
attcccattttgcaa

SEQ ID NO: 4127638 - DNA, 18 bp, Homo sapiens
attcccattttgcaaaat

SEQ ID NO: 4127639 - DNA, 20 bp, Homo sapiens
attcccattttgcaaaattt

SEQ ID NO: 4127640 - DNA, 15 bp, Homo sapiens
attcccctcccacct

SEQ ID NO: 4127641 - DNA, 21 bp, Homo sapiens
attcccctcccacctctcctt

SEQ ID NO: 4127642 - DNA, 22 bp, Homo sapiens
attcccctcccacctctccttt

SEQ ID NO: 4127643 - DNA, 15 bp, Homo sapiens
attcccctctgctgc

SEQ ID NO: 4127644 - DNA, 22 bp, Homo sapiens
attcccctctgctgctgtccct

SEQ ID NO: 4127645 - DNA, 12 bp, Homo sapiens
attccctccagt

SEQ ID NO: 4127646 - DNA, 17 bp, Homo sapiens
attccctcgtctttccc

SEQ ID NO: 4127647 - DNA, 18 bp, Homo sapiens
attccctcgtctttccca

SEQ ID NO: 4127648 - DNA, 20 bp, Homo sapiens
attccctctctcagcacagc

SEQ ID NO: 4127649 - DNA, 23 bp, Homo sapiens
attccctctctcagcacagcctg

SEQ ID NO: 4127650 - DNA, 14 bp, Homo sapiens
attcctaagaatca

SEQ ID NO: 4127651 - DNA, 15 bp, Homo sapiens
attcctaagccactt

SEQ ID NO: 4127652 - DNA, 18 bp, Homo sapiens
attcctacaaagatgttt

SEQ ID NO: 4127653 - DNA, 14 bp, Homo sapiens
attcctacaactta

SEQ ID NO: 4127654 - DNA, 19 bp, Homo sapiens
attcctagtggatgactgt

SEQ ID NO: 4127655 - DNA, 20 bp, Homo sapiens
attcctatatcctgtgactg

SEQ ID NO: 4127656 - DNA, 17 bp, Homo sapiens
attcctcaacgtattgt

SEQ ID NO: 4127657 - DNA, 13 bp, Homo sapiens
attcctctcttaa

SEQ ID NO: 4127658 - DNA, 19 bp, Homo sapiens
attcctgaagaaccagtcc

SEQ ID NO: 4127659 - DNA, 22 bp, Homo sapiens
attcctgagatttcctcctggc

SEQ ID NO: 4127660 - DNA, 20 bp, Homo sapiens
attcctgccccagatggctt

SEQ ID NO: 4127661 - DNA, 22 bp, Homo sapiens
attcctggtttaattcagcaga

SEQ ID NO: 4127662 - DNA, 15 bp, Homo sapiens
attccttctttgata

SEQ ID NO: 4127663 - DNA, 20 bp, Homo sapiens
attccttctttgataatgtt

SEQ ID NO: 4127664 - DNA, 23 bp, Homo sapiens
attccttctttgataatgttaaa

SEQ ID NO: 4127665 - DNA, 16 bp, Homo sapiens
attccttgcgcctcag

SEQ ID NO: 4127666 - DNA, 23 bp, Homo sapiens
attcctttgtcttcaaactgtga

SEQ ID NO: 4127667 - DNA, 17 bp, Homo sapiens
attcgggccccacctgc

SEQ ID NO: 4127668 - DNA, 23 bp, Homo sapiens
attcggtgtggtgcagtgtgaaa

SEQ ID NO: 4127669 - DNA, 18 bp, Homo sapiens
attcgtggcatgttttga

SEQ ID NO: 4127670 - DNA, 23 bp, Homo sapiens
attcgtggtgatcaattaaatgt

SEQ ID NO: 4127671 - DNA, 13 bp, Homo sapiens
attcgttctgtgg

SEQ ID NO: 4127672 - DNA, 20 bp, Homo sapiens
attcgttgtgttttttaaga

SEQ ID NO: 4127673 - DNA, 19 bp, Homo sapiens
attctaaagagcacttact

SEQ ID NO: 4127674 - DNA, 17 bp, Homo sapiens
attctaaatgaatgttt

SEQ ID NO: 4127675 - DNA, 18 bp, Homo sapiens
attctaaatgaatgttta

SEQ ID NO: 4127676 - DNA, 21 bp, Homo sapiens
attctaagccagttttcattt

SEQ ID NO: 4127677 - DNA, 15 bp, Homo sapiens
attctaagtgaaatt

SEQ ID NO: 4127678 - DNA, 18 bp, Homo sapiens
attctaagttatttactt

SEQ ID NO: 4127679 - DNA, 19 bp, Homo sapiens
attctaagttatttacttt

SEQ ID NO: 4127680 - DNA, 20 bp, Homo sapiens
attctaagttatttactttt

SEQ ID NO: 4127681 - DNA, 12 bp, Homo sapiens
attctacagaat

SEQ ID NO: 4127682 - DNA, 15 bp, Homo sapiens
attctacagtttctt

SEQ ID NO: 4127683 - DNA, 15 bp, Homo sapiens
attctagctaatgta

SEQ ID NO: 4127684 - DNA, 19 bp, Homo sapiens
attctagctgtatgatttg

SEQ ID NO: 4127685 - DNA, 16 bp, Homo sapiens
attctaggacctgtgt

SEQ ID NO: 4127686 - DNA, 16 bp, Homo sapiens
attctaggatgtggag

SEQ ID NO: 4127687 - DNA, 14 bp, Homo sapiens
attctatccccaat

SEQ ID NO: 4127688 - DNA, 21 bp, Homo sapiens
attctatcgttattataaatg

SEQ ID NO: 4127689 - DNA, 22 bp, Homo sapiens
attctatcgttattataaatgt

SEQ ID NO: 4127690 - DNA, 19 bp, Homo sapiens
attctatgttaaatactgt

SEQ ID NO: 4127691 - DNA, 24 bp, Homo sapiens
attctatgttaaatactgtgcaga

SEQ ID NO: 4127692 - DNA, 22 bp, Homo sapiens
attctattgccttctttgaaga

SEQ ID NO: 4127693 - DNA, 23 bp, Homo sapiens
attctattgccttctttgaagaa

SEQ ID NO: 4127694 - DNA, 23 bp, Homo sapiens
attctatttcccctcttctgcta

SEQ ID NO: 4127695 - DNA, 21 bp, Homo sapiens
attctcaagggacgtcctcca

SEQ ID NO: 4127696 - DNA, 14 bp, Homo sapiens
attctcaccaggaa

SEQ ID NO: 4127697 - DNA, 17 bp, Homo sapiens
attctcataattcctac

SEQ ID NO: 4127698 - DNA, 18 bp, Homo sapiens
attctcataattcctaca

SEQ ID NO: 4127699 - DNA, 19 bp, Homo sapiens
attctcataattcctacag

SEQ ID NO: 4127700 - DNA, 16 bp, Homo sapiens
attctcattgcagaat

SEQ ID NO: 4127701 - DNA, 17 bp, Homo sapiens
attctcatttgttctca

SEQ ID NO: 4127702 - DNA, 24 bp, Homo sapiens
attctcccaggtaccagctgcgct

SEQ ID NO: 4127703 - DNA, 13 bp, Homo sapiens
attctcctgcctc

SEQ ID NO: 4127704 - DNA, 20 bp, Homo sapiens
attctcctgcctcagcctcc

SEQ ID NO: 4127705 - DNA, 18 bp, Homo sapiens
attctccttgttgttggt

SEQ ID NO: 4127706 - DNA, 12 bp, Homo sapiens
attctctattgg

SEQ ID NO: 4127707 - DNA, 14 bp, Homo sapiens
attctctttcaaag

SEQ ID NO: 4127708 - DNA, 15 bp, Homo sapiens
attctgaagcaacat

SEQ ID NO: 4127709 - DNA, 10 bp, Homo sapiens
attctgaatg

SEQ ID NO: 4127710 - DNA, 19 bp, Homo sapiens
attctgagacatgtgtcaa

SEQ ID NO: 4127711 - DNA, 15 bp, Homo sapiens
attctgagcagtgcc

SEQ ID NO: 4127712 - DNA, 17 bp, Homo sapiens
attctgaggccctgccc

SEQ ID NO: 4127713 - DNA, 12 bp, Homo sapiens
attctgattctt

SEQ ID NO: 4127714 - DNA, 21 bp, Homo sapiens
attctgcagtaaatcttttac

SEQ ID NO: 4127715 - DNA, 19 bp, Homo sapiens
attctgccctccttaattt

SEQ ID NO: 4127716 - DNA, 15 bp, Homo sapiens
attctgcctctctgg

SEQ ID NO: 4127717 - DNA, 21 bp, Homo sapiens
attctgcctctctggaaagag

SEQ ID NO: 4127718 - DNA, 19 bp, Homo sapiens
attctgggctcctggaacc

SEQ ID NO: 4127719 - DNA, 20 bp, Homo sapiens
attctgtaaaatgtctgtta

SEQ ID NO: 4127720 - DNA, 20 bp, Homo sapiens
attctgtgatcttttaaagt

SEQ ID NO: 4127721 - DNA, 12 bp, Homo sapiens
attctgttaaaa

SEQ ID NO: 4127722 - DNA, 15 bp, Homo sapiens
attctgttaaaatct

SEQ ID NO: 4127723 - DNA, 20 bp, Homo sapiens
attctgttaaaatctattct

SEQ ID NO: 4127724 - DNA, 17 bp, Homo sapiens
attctgttttcccccag

SEQ ID NO: 4127725 - DNA, 19 bp, Homo sapiens
attctgttttcccccagca

SEQ ID NO: 4127726 - DNA, 14 bp, Homo sapiens
attcttaaaaattg

SEQ ID NO: 4127727 - DNA, 20 bp, Homo sapiens
attcttaaaatatatttcag

SEQ ID NO: 4127728 - DNA, 22 bp, Homo sapiens
attcttaaaattcaagaaaata

SEQ ID NO: 4127729 - DNA, 18 bp, Homo sapiens
attcttaatgttcacata

SEQ ID NO: 4127730 - DNA, 14 bp, Homo sapiens
attcttcaaccagt

SEQ ID NO: 4127731 - DNA, 22 bp, Homo sapiens
attcttcaggcttcctgcaatt

SEQ ID NO: 4127732 - DNA, 12 bp, Homo sapiens
attcttccagaa

SEQ ID NO: 4127733 - DNA, 21 bp, Homo sapiens
attcttgttttctttctttaa

SEQ ID NO: 4127734 - DNA, 23 bp, Homo sapiens
attcttgttttctttctttaaat

SEQ ID NO: 4127735 - DNA, 15 bp, Homo sapiens
attcttgttttgctt

SEQ ID NO: 4127736 - DNA, 15 bp, Homo sapiens
attctttaatagaag

SEQ ID NO: 4127737 - DNA, 16 bp, Homo sapiens
attctttccattatga

SEQ ID NO: 4127738 - DNA, 18 bp, Homo sapiens
attcttttgtttccatgg

SEQ ID NO: 4127739 - DNA, 13 bp, Homo sapiens
attgaaactagtt

SEQ ID NO: 4127740 - DNA, 12 bp, Homo sapiens
attgaaattata

SEQ ID NO: 4127741 - DNA, 17 bp, Homo sapiens
attgaaattctgagaaa

SEQ ID NO: 4127742 - DNA, 19 bp, Homo sapiens
attgaaattgtgaactcat

SEQ ID NO: 4127743 - DNA, 20 bp, Homo sapiens
attgaacacaaactgtaaat

SEQ ID NO: 4127744 - DNA, 20 bp, Homo sapiens
attgaacttttgtactgaat

SEQ ID NO: 4127745 - DNA, 19 bp, Homo sapiens
attgaagacaatttgatac

SEQ ID NO: 4127746 - DNA, 22 bp, Homo sapiens
attgaagacaatttgatacata

SEQ ID NO: 4127747 - DNA, 22 bp, Homo sapiens
attgaagccgactctggccctg

SEQ ID NO: 4127748 - DNA, 19 bp, Homo sapiens
attgaaggaagccaaattt

SEQ ID NO: 4127749 - DNA, 15 bp, Homo sapiens
attgaagtaaacttt

SEQ ID NO: 4127750 - DNA, 16 bp, Homo sapiens
attgaagtaaactttt

SEQ ID NO: 4127751 - DNA, 15 bp, Homo sapiens
attgaagtaatgaat

SEQ ID NO: 4127752 - DNA, 15 bp, Homo sapiens
attgacactgaactt

SEQ ID NO: 4127753 - DNA, 13 bp, Homo sapiens
attgacatttgta

SEQ ID NO: 4127754 - DNA, 17 bp, Homo sapiens
attgaccaagaactgca

SEQ ID NO: 4127755 - DNA, 17 bp, Homo sapiens
attgaccgcgactaatt

SEQ ID NO: 4127756 - DNA, 20 bp, Homo sapiens
attgaccgcgactaatttca

SEQ ID NO: 4127757 - DNA, 18 bp, Homo sapiens
attgacctctcagggcct

SEQ ID NO: 4127758 - DNA, 21 bp, Homo sapiens
attgacgacaagtgctgaaca

SEQ ID NO: 4127759 - DNA, 16 bp, Homo sapiens
attgacgattccttct

SEQ ID NO: 4127760 - DNA, 20 bp, Homo sapiens
attgacgattccttctctga

SEQ ID NO: 4127761 - DNA, 15 bp, Homo sapiens
attgactgatgattt

SEQ ID NO: 4127762 - DNA, 20 bp, Homo sapiens
attgactgatgattttcctt

SEQ ID NO: 4127763 - DNA, 21 bp, Homo sapiens
attgactggtttacaggccct

SEQ ID NO: 4127764 - DNA, 22 bp, Homo sapiens
attgactggtttacaggccctg

SEQ ID NO: 4127765 - DNA, 19 bp, Homo sapiens
attgactttcagtaaacat

SEQ ID NO: 4127766 - DNA, 20 bp, Homo sapiens
attgagaaaaatatatacta

SEQ ID NO: 4127767 - DNA, 16 bp, Homo sapiens
attgagaaagaaacta

SEQ ID NO: 4127768 - DNA, 13 bp, Homo sapiens
attgagaatttta

SEQ ID NO: 4127769 - DNA, 17 bp, Homo sapiens
attgagaattttaaatt

SEQ ID NO: 4127770 - DNA, 20 bp, Homo sapiens
attgagataatatctgtgag

SEQ ID NO: 4127771 - DNA, 21 bp, Homo sapiens
attgagataatatctgtgagg

SEQ ID NO: 4127772 - DNA, 20 bp, Homo sapiens
attgagctgatataaattct

SEQ ID NO: 4127773 - DNA, 21 bp, Homo sapiens
attgaggcctgccctcaggga

SEQ ID NO: 4127774 - DNA, 14 bp, Homo sapiens
attgaggctttgtg

SEQ ID NO: 4127775 - DNA, 22 bp, Homo sapiens
attgaggctttgtgttgtaatt

SEQ ID NO: 4127776 - DNA, 19 bp, Homo sapiens
attgaggggccctggccag

SEQ ID NO: 4127777 - DNA, 20 bp, Homo sapiens
attgagtaatggtgtagaac

SEQ ID NO: 4127778 - DNA, 15 bp, Homo sapiens
attgatactctttct

SEQ ID NO: 4127779 - DNA, 17 bp, Homo sapiens
attgatatgcttataca

SEQ ID NO: 4127780 - DNA, 17 bp, Homo sapiens
attgatgaaaagattta

SEQ ID NO: 4127781 - DNA, 23 bp, Homo sapiens
attgatgataacacttaaaattg

SEQ ID NO: 4127782 - DNA, 12 bp, Homo sapiens
attgatgtatat

SEQ ID NO: 4127783 - DNA, 14 bp, Homo sapiens
attgattgcttttt

SEQ ID NO: 4127784 - DNA, 16 bp, Homo sapiens
attgatttgaagaaca

SEQ ID NO: 4127785 - DNA, 13 bp, Homo sapiens
attgatttgcatt

SEQ ID NO: 4127786 - DNA, 16 bp, Homo sapiens
attgatttgcattgaa

SEQ ID NO: 4127787 - DNA, 16 bp, Homo sapiens
attgatttttcttctt

SEQ ID NO: 4127788 - DNA, 22 bp, Homo sapiens
attgatttttcttcttttactt

SEQ ID NO: 4127789 - DNA, 14 bp, Homo sapiens
attgcaacagactg

SEQ ID NO: 4127790 - DNA, 15 bp, Homo sapiens
attgcacagaatttg

SEQ ID NO: 4127791 - DNA, 15 bp, Homo sapiens
attgcacattgtaaa

SEQ ID NO: 4127792 - DNA, 23 bp, Homo sapiens
attgcaccatactccttgcttcc

SEQ ID NO: 4127793 - DNA, 12 bp, Homo sapiens
attgcactaaat

SEQ ID NO: 4127794 - DNA, 17 bp, Homo sapiens
attgcagaaaattctgt

SEQ ID NO: 4127795 - DNA, 18 bp, Homo sapiens
attgcagaaaattctgtg

SEQ ID NO: 4127796 - DNA, 19 bp, Homo sapiens
attgcatctcaaaattatt

SEQ ID NO: 4127797 - DNA, 14 bp, Homo sapiens
attgcattctattg

SEQ ID NO: 4127798 - DNA, 22 bp, Homo sapiens
attgcattctattgccttcttt

SEQ ID NO: 4127799 - DNA, 23 bp, Homo sapiens
attgcattctattgccttctttg

SEQ ID NO: 4127800 - DNA, 21 bp, Homo sapiens
attgcccatgggatatgtggt

SEQ ID NO: 4127801 - DNA, 18 bp, Homo sapiens
attgccccatctagacta

SEQ ID NO: 4127802 - DNA, 16 bp, Homo sapiens
attgccccctctcact

SEQ ID NO: 4127803 - DNA, 17 bp, Homo sapiens
attgcccctggctttgc

SEQ ID NO: 4127804 - DNA, 20 bp, Homo sapiens
attgcccctggctttgcctc

SEQ ID NO: 4127805 - DNA, 21 bp, Homo sapiens
attgcccctggctttgcctct

SEQ ID NO: 4127806 - DNA, 18 bp, Homo sapiens
attgcctgactaaaatgt

SEQ ID NO: 4127807 - DNA, 20 bp, Homo sapiens
attgcctgactaaaatgttt

SEQ ID NO: 4127808 - DNA, 14 bp, Homo sapiens
attgcctgcagaga

SEQ ID NO: 4127809 - DNA, 16 bp, Homo sapiens
attgcctgcagagaga

SEQ ID NO: 4127810 - DNA, 15 bp, Homo sapiens
attgccttctttgaa

SEQ ID NO: 4127811 - DNA, 16 bp, Homo sapiens
attgcgctctcaagac

SEQ ID NO: 4127812 - DNA, 14 bp, Homo sapiens
attgcggccccagg

SEQ ID NO: 4127813 - DNA, 17 bp, Homo sapiens
attgcggccccaggagg

SEQ ID NO: 4127814 - DNA, 21 bp, Homo sapiens
attgcgtttgaccttttatgt

SEQ ID NO: 4127815 - DNA, 21 bp, Homo sapiens
attgctaatcaccaaaggctc

SEQ ID NO: 4127816 - DNA, 14 bp, Homo sapiens
attgctagataaaa

SEQ ID NO: 4127817 - DNA, 22 bp, Homo sapiens
attgctatctggaggccttcca

SEQ ID NO: 4127818 - DNA, 20 bp, Homo sapiens
attgctatgttactattttc

SEQ ID NO: 4127819 - DNA, 16 bp, Homo sapiens
attgctgattttaaag

SEQ ID NO: 4127820 - DNA, 22 bp, Homo sapiens
attgctggaggaaccagaggca

SEQ ID NO: 4127821 - DNA, 18 bp, Homo sapiens
attgctgtgctttatgga

SEQ ID NO: 4127822 - DNA, 21 bp, Homo sapiens
attgctgttgtccctctgcta

SEQ ID NO: 4127823 - DNA, 13 bp, Homo sapiens
attgcttctgtag

SEQ ID NO: 4127824 - DNA, 15 bp, Homo sapiens
attgctttctgaaat

SEQ ID NO: 4127825 - DNA, 19 bp, Homo sapiens
attgcttttattttgaaaa

SEQ ID NO: 4127826 - DNA, 14 bp, Homo sapiens
attgcttttttaaa

SEQ ID NO: 4127827 - DNA, 16 bp, Homo sapiens
attgcttttttaaata

SEQ ID NO: 4127828 - DNA, 15 bp, Homo sapiens
attgcttttttgtat

SEQ ID NO: 4127829 - DNA, 18 bp, Homo sapiens
attggaatctgatatact

SEQ ID NO: 4127830 - DNA, 13 bp, Homo sapiens
attggacagttgt

SEQ ID NO: 4127831 - DNA, 14 bp, Homo sapiens
attggagaatactt

SEQ ID NO: 4127832 - DNA, 15 bp, Homo sapiens
attggagaatacttt

SEQ ID NO: 4127833 - DNA, 14 bp, Homo sapiens
attggagctgaaga

SEQ ID NO: 4127834 - DNA, 15 bp, Homo sapiens
attggaggaaagcaa

SEQ ID NO: 4127835 - DNA, 23 bp, Homo sapiens
attggaggaaagcaaccggtgga

SEQ ID NO: 4127836 - DNA, 22 bp, Homo sapiens
attggagggtaaatgatgtggt

SEQ ID NO: 4127837 - DNA, 16 bp, Homo sapiens
attggattatttaata

SEQ ID NO: 4127838 - DNA, 18 bp, Homo sapiens
attggattatttaataac

SEQ ID NO: 4127839 - DNA, 22 bp, Homo sapiens
attggattatttaataacatta

SEQ ID NO: 4127840 - DNA, 12 bp, Homo sapiens
attggcaaagtt

SEQ ID NO: 4127841 - DNA, 22 bp, Homo sapiens
attggcaaagtttaaatgtatt

SEQ ID NO: 4127842 - DNA, 17 bp, Homo sapiens
attggcagtgactttgt

SEQ ID NO: 4127843 - DNA, 22 bp, Homo sapiens
attggccacctgtagccatctg

SEQ ID NO: 4127844 - DNA, 20 bp, Homo sapiens
attggcctgtagagttgctg

SEQ ID NO: 4127845 - DNA, 21 bp, Homo sapiens
attggcctgtagagttgctga

SEQ ID NO: 4127846 - DNA, 22 bp, Homo sapiens
attggcctgtagagttgctgag

SEQ ID NO: 4127847 - DNA, 23 bp, Homo sapiens
attggcctgtagagttgctgaga

SEQ ID NO: 4127848 - DNA, 17 bp, Homo sapiens
attggctatttaaaact

SEQ ID NO: 4127849 - DNA, 12 bp, Homo sapiens
attggctcccaa

SEQ ID NO: 4127850 - DNA, 15 bp, Homo sapiens
attggctgctttgcc

SEQ ID NO: 4127851 - DNA, 19 bp, Homo sapiens
attggctttttcagagtca

SEQ ID NO: 4127852 - DNA, 14 bp, Homo sapiens
attggggaggaggg

SEQ ID NO: 4127853 - DNA, 18 bp, Homo sapiens
attggtatcaagaaagtc

SEQ ID NO: 4127854 - DNA, 18 bp, Homo sapiens
attggtgggattttttgt

SEQ ID NO: 4127855 - DNA, 16 bp, Homo sapiens
attggttggcaaacta

SEQ ID NO: 4127856 - DNA, 17 bp, Homo sapiens
attggtttctcttctcc

SEQ ID NO: 4127857 - DNA, 19 bp, Homo sapiens
attggtttctcttctcccc

SEQ ID NO: 4127858 - DNA, 15 bp, Homo sapiens
attggtttttttgta

SEQ ID NO: 4127859 - DNA, 21 bp, Homo sapiens
attgtaaaaaaaaatgccttt

SEQ ID NO: 4127860 - DNA, 22 bp, Homo sapiens
attgtaaaaaaggttttctata

SEQ ID NO: 4127861 - DNA, 10 bp, Homo sapiens
attgtaaata

SEQ ID NO: 4127862 - DNA, 16 bp, Homo sapiens
attgtaaatatgtttt

SEQ ID NO: 4127863 - DNA, 23 bp, Homo sapiens
attgtaaattgaatcagtataaa

SEQ ID NO: 4127864 - DNA, 12 bp, Homo sapiens
attgtaacctgc

SEQ ID NO: 4127865 - DNA, 15 bp, Homo sapiens
attgtaagttgtaca

SEQ ID NO: 4127866 - DNA, 16 bp, Homo sapiens
attgtaagttgtacaa

SEQ ID NO: 4127867 - DNA, 15 bp, Homo sapiens
attgtaatgttactg

SEQ ID NO: 4127868 - DNA, 17 bp, Homo sapiens
attgtaatgttactgat

SEQ ID NO: 4127869 - DNA, 19 bp, Homo sapiens
attgtacatagcatgttta

SEQ ID NO: 4127870 - DNA, 16 bp, Homo sapiens
attgtaccatcatttt

SEQ ID NO: 4127871 - DNA, 19 bp, Homo sapiens
attgtacctctcttataga

SEQ ID NO: 4127872 - DNA, 23 bp, Homo sapiens
attgtattaggtgtcatttccat

SEQ ID NO: 4127873 - DNA, 21 bp, Homo sapiens
attgtattagtattgtgaata

SEQ ID NO: 4127874 - DNA, 15 bp, Homo sapiens
attgtatttatgtgt

SEQ ID NO: 4127875 - DNA, 19 bp, Homo sapiens
attgtcacctctgttaagg

SEQ ID NO: 4127876 - DNA, 21 bp, Homo sapiens
attgtcacctctgttaaggtt

SEQ ID NO: 4127877 - DNA, 21 bp, Homo sapiens
attgtcacctgcttctctgcc

SEQ ID NO: 4127878 - DNA, 13 bp, Homo sapiens
attgtcacttttt

SEQ ID NO: 4127879 - DNA, 13 bp, Homo sapiens
attgtcattaaag

SEQ ID NO: 4127880 - DNA, 19 bp, Homo sapiens
attgtccagagctgcttcc

SEQ ID NO: 4127881 - DNA, 18 bp, Homo sapiens
attgtctgaacttgcatt

SEQ ID NO: 4127882 - DNA, 20 bp, Homo sapiens
attgtcttgcaacttcagtt

SEQ ID NO: 4127883 - DNA, 16 bp, Homo sapiens
attgtgaccaagttat

SEQ ID NO: 4127884 - DNA, 11 bp, Homo sapiens
attgtgctgcc

SEQ ID NO: 4127885 - DNA, 13 bp, Homo sapiens
attgtgctgccat

SEQ ID NO: 4127886 - DNA, 21 bp, Homo sapiens
attgtgggacttattacaatt

SEQ ID NO: 4127887 - DNA, 19 bp, Homo sapiens
attgtgtaaaaaatggaaa

SEQ ID NO: 4127888 - DNA, 18 bp, Homo sapiens
attgtgtagcaattgaca

SEQ ID NO: 4127889 - DNA, 14 bp, Homo sapiens
attgtgtagccttt

SEQ ID NO: 4127890 - DNA, 18 bp, Homo sapiens
attgtgtagcctttttgt

SEQ ID NO: 4127891 - DNA, 15 bp, Homo sapiens
attgtgtatattcat

SEQ ID NO: 4127892 - DNA, 21 bp, Homo sapiens
attgtgtgaattaatttctaa

SEQ ID NO: 4127893 - DNA, 21 bp, Homo sapiens
attgtgttgtcttcagcagtc

SEQ ID NO: 4127894 - DNA, 23 bp, Homo sapiens
attgttaagtctaaatatttcct

SEQ ID NO: 4127895 - DNA, 23 bp, Homo sapiens
attgttaggagtggttctcattt

SEQ ID NO: 4127896 - DNA, 13 bp, Homo sapiens
attgttatttata

SEQ ID NO: 4127897 - DNA, 15 bp, Homo sapiens
attgttcaaacaata

SEQ ID NO: 4127898 - DNA, 16 bp, Homo sapiens
attgttcaaacaatat

SEQ ID NO: 4127899 - DNA, 15 bp, Homo sapiens
attgttccaagacat

SEQ ID NO: 4127900 - DNA, 18 bp, Homo sapiens
attgttccaagacattgt

SEQ ID NO: 4127901 - DNA, 19 bp, Homo sapiens
attgttcccagtgacactt

SEQ ID NO: 4127902 - DNA, 19 bp, Homo sapiens
attgttcttagtttgcagt

SEQ ID NO: 4127903 - DNA, 16 bp, Homo sapiens
attgttgagctattgc

SEQ ID NO: 4127904 - DNA, 16 bp, Homo sapiens
attgttgcattgcttt

SEQ ID NO: 4127905 - DNA, 16 bp, Homo sapiens
attgttgctgaaactt

SEQ ID NO: 4127906 - DNA, 17 bp, Homo sapiens
attgttggctatttgaa

SEQ ID NO: 4127907 - DNA, 12 bp, Homo sapiens
attgtttaaaga

SEQ ID NO: 4127908 - DNA, 17 bp, Homo sapiens
attgtttcctcttccaa

SEQ ID NO: 4127909 - DNA, 13 bp, Homo sapiens
attgtttgcttat

SEQ ID NO: 4127910 - DNA, 14 bp, Homo sapiens
attgtttgcttatt

SEQ ID NO: 4127911 - DNA, 19 bp, Homo sapiens
attgtttgcttattgttcc

SEQ ID NO: 4127912 - DNA, 20 bp, Homo sapiens
attgtttgtctgtcttcata

SEQ ID NO: 4127913 - DNA, 13 bp, Homo sapiens
attgttttaatct

SEQ ID NO: 4127914 - DNA, 20 bp, Homo sapiens
attgttttaatctgaaattc

SEQ ID NO: 4127915 - DNA, 19 bp, Homo sapiens
attgttttacctgttctga

SEQ ID NO: 4127916 - DNA, 18 bp, Homo sapiens
attgttttcagtgtacat

SEQ ID NO: 4127917 - DNA, 19 bp, Homo sapiens
attgttttcagtgtacatg

SEQ ID NO: 4127918 - DNA, 15 bp, Homo sapiens
attgttttctattta

SEQ ID NO: 4127919 - DNA, 17 bp, Homo sapiens
atttaaaaagtgagaaa

SEQ ID NO: 4127920 - DNA, 21 bp, Homo sapiens
atttaaaattaagtagaacaa

SEQ ID NO: 4127921 - DNA, 16 bp, Homo sapiens
atttaaaattacgttt

SEQ ID NO: 4127922 - DNA, 20 bp, Homo sapiens
atttaaaattccattatctt

SEQ ID NO: 4127923 - DNA, 21 bp, Homo sapiens
atttaaaattgctatgttact

SEQ ID NO: 4127924 - DNA, 15 bp, Homo sapiens
atttaaacacacaga

SEQ ID NO: 4127925 - DNA, 20 bp, Homo sapiens
atttaaacatttgttcctgg

SEQ ID NO: 4127926 - DNA, 15 bp, Homo sapiens
atttaaacctttttc

SEQ ID NO: 4127927 - DNA, 22 bp, Homo sapiens
atttaaacctttttcttgatct

SEQ ID NO: 4127928 - DNA, 17 bp, Homo sapiens
atttaaactatcttgtg

SEQ ID NO: 4127929 - DNA, 19 bp, Homo sapiens
atttaaagaacaccctata

SEQ ID NO: 4127930 - DNA, 21 bp, Homo sapiens
atttaaagacagggaagagca

SEQ ID NO: 4127931 - DNA, 19 bp, Homo sapiens
atttaaagatattgttcaa

SEQ ID NO: 4127932 - DNA, 18 bp, Homo sapiens
atttaaagcattgctgtt

SEQ ID NO: 4127933 - DNA, 15 bp, Homo sapiens
atttaaataaaatca

SEQ ID NO: 4127934 - DNA, 13 bp, Homo sapiens
atttaaataaagt

SEQ ID NO: 4127935 - DNA, 18 bp, Homo sapiens
atttaaatgtaacttatt

SEQ ID NO: 4127936 - DNA, 24 bp, Homo sapiens
atttaaatgtgtacaatgtacaca

SEQ ID NO: 4127937 - DNA, 16 bp, Homo sapiens
atttaaatttaaagat

SEQ ID NO: 4127938 - DNA, 17 bp, Homo sapiens
atttaaatttaaagata

SEQ ID NO: 4127939 - DNA, 13 bp, Homo sapiens
atttaacaaacta

SEQ ID NO: 4127940 - DNA, 21 bp, Homo sapiens
atttaacagctgaattatcta

SEQ ID NO: 4127941 - DNA, 18 bp, Homo sapiens
atttaacagtcatttaaa

SEQ ID NO: 4127942 - DNA, 14 bp, Homo sapiens
atttaagaaaagca

SEQ ID NO: 4127943 - DNA, 16 bp, Homo sapiens
atttaagaaaagcact

SEQ ID NO: 4127944 - DNA, 20 bp, Homo sapiens
atttaagaaaagcacttttg

SEQ ID NO: 4127945 - DNA, 21 bp, Homo sapiens
atttaagaaaagcacttttgt

SEQ ID NO: 4127946 - DNA, 16 bp, Homo sapiens
atttaagacactgaaa

SEQ ID NO: 4127947 - DNA, 14 bp, Homo sapiens
atttaagtgcgtgt

SEQ ID NO: 4127948 - DNA, 21 bp, Homo sapiens
atttaagtgcgtgtgtagagt

SEQ ID NO: 4127949 - DNA, 21 bp, Homo sapiens
atttaataaaataattctaaa

SEQ ID NO: 4127950 - DNA, 14 bp, Homo sapiens
atttaataaagaaa

SEQ ID NO: 4127951 - DNA, 16 bp, Homo sapiens
atttaataaagaaata

SEQ ID NO: 4127952 - DNA, 19 bp, Homo sapiens
atttaataaagaaatattt

SEQ ID NO: 4127953 - DNA, 20 bp, Homo sapiens
atttaataaagaaatattta

SEQ ID NO: 4127954 - DNA, 23 bp, Homo sapiens
atttaataaagaaatatttacct

SEQ ID NO: 4127955 - DNA, 13 bp, Homo sapiens
atttaataacatt

SEQ ID NO: 4127956 - DNA, 14 bp, Homo sapiens
atttaataacatta

SEQ ID NO: 4127957 - DNA, 18 bp, Homo sapiens
atttaataacattacctt

SEQ ID NO: 4127958 - DNA, 19 bp, Homo sapiens
atttaataacattacctta

SEQ ID NO: 4127959 - DNA, 15 bp, Homo sapiens
atttaatacagcagt

SEQ ID NO: 4127960 - DNA, 21 bp, Homo sapiens
atttaatgaaagactgtacaa

SEQ ID NO: 4127961 - DNA, 12 bp, Homo sapiens
atttaattatta

SEQ ID NO: 4127962 - DNA, 21 bp, Homo sapiens
atttaattgcaacatgaagtt

SEQ ID NO: 4127963 - DNA, 18 bp, Homo sapiens
atttacaataaatgaaga

SEQ ID NO: 4127964 - DNA, 14 bp, Homo sapiens
atttacactgccat

SEQ ID NO: 4127965 - DNA, 16 bp, Homo sapiens
atttacaggaacttca

SEQ ID NO: 4127966 - DNA, 18 bp, Homo sapiens
atttacatgaattgcatt

SEQ ID NO: 4127967 - DNA, 17 bp, Homo sapiens
atttaccacagcagctg

SEQ ID NO: 4127968 - DNA, 18 bp, Homo sapiens
atttaccacagcagctga

SEQ ID NO: 4127969 - DNA, 21 bp, Homo sapiens
atttaccacagcagctgaaca

SEQ ID NO: 4127970 - DNA, 13 bp, Homo sapiens
atttacctgcagg

SEQ ID NO: 4127971 - DNA, 14 bp, Homo sapiens
atttactaaacata

SEQ ID NO: 4127972 - DNA, 18 bp, Homo sapiens
atttactaccttatcact

SEQ ID NO: 4127973 - DNA, 21 bp, Homo sapiens
atttactgagcttctctgtga

SEQ ID NO: 4127974 - DNA, 16 bp, Homo sapiens
atttacttcttataca

SEQ ID NO: 4127975 - DNA, 17 bp, Homo sapiens
atttacttcttatacat

SEQ ID NO: 4127976 - DNA, 20 bp, Homo sapiens
atttacttcttatacatttg

SEQ ID NO: 4127977 - DNA, 21 bp, Homo sapiens
atttacttttaccactattta

SEQ ID NO: 4127978 - DNA, 21 bp, Homo sapiens
atttagaaaatagagctttta

SEQ ID NO: 4127979 - DNA, 22 bp, Homo sapiens
atttagaaagaagcccaatatt

SEQ ID NO: 4127980 - DNA, 15 bp, Homo sapiens
atttagaaatataat

SEQ ID NO: 4127981 - DNA, 17 bp, Homo sapiens
atttagaaatcaagcat

SEQ ID NO: 4127982 - DNA, 18 bp, Homo sapiens
atttagaaatcaagcata

SEQ ID NO: 4127983 - DNA, 18 bp, Homo sapiens
atttagacaacctgaaat

SEQ ID NO: 4127984 - DNA, 14 bp, Homo sapiens
atttagacaagaga

SEQ ID NO: 4127985 - DNA, 16 bp, Homo sapiens
atttagacaagagatg

SEQ ID NO: 4127986 - DNA, 19 bp, Homo sapiens
atttagagataggaaactg

SEQ ID NO: 4127987 - DNA, 17 bp, Homo sapiens
atttagatgataaagag

SEQ ID NO: 4127988 - DNA, 15 bp, Homo sapiens
atttagcatgttgtt

SEQ ID NO: 4127989 - DNA, 16 bp, Homo sapiens
atttagccgggcgcgg

SEQ ID NO: 4127990 - DNA, 23 bp, Homo sapiens
atttagctaaacggattccaaag

SEQ ID NO: 4127991 - DNA, 13 bp, Homo sapiens
atttagcttcttt

SEQ ID NO: 4127992 - DNA, 17 bp, Homo sapiens
atttagcttctttccct

SEQ ID NO: 4127993 - DNA, 20 bp, Homo sapiens
atttagggagaaatgttgtt

SEQ ID NO: 4127994 - DNA, 19 bp, Homo sapiens
atttaggtttttattagta

SEQ ID NO: 4127995 - DNA, 14 bp, Homo sapiens
atttagtcctgtac

SEQ ID NO: 4127996 - DNA, 21 bp, Homo sapiens
atttagtgagttattccttga

SEQ ID NO: 4127997 - DNA, 18 bp, Homo sapiens
atttagtgatcttagcat

SEQ ID NO: 4127998 - DNA, 16 bp, Homo sapiens
atttagttctttgtta

SEQ ID NO: 4127999 - DNA, 17 bp, Homo sapiens
atttagttctttgttat

SEQ ID NO: 4128000 - DNA, 14 bp, Homo sapiens
atttagtttcagta

SEQ ID NO: 4128001 - DNA, 21 bp, Homo sapiens
atttataaaacttctcaagat

SEQ ID NO: 4128002 - DNA, 15 bp, Homo sapiens
atttataaacagaca

SEQ ID NO: 4128003 - DNA, 23 bp, Homo sapiens
atttataaatatattcaggagtt

SEQ ID NO: 4128004 - DNA, 16 bp, Homo sapiens
atttataaatgctatt

SEQ ID NO: 4128005 - DNA, 19 bp, Homo sapiens
atttataaccccagcctga

SEQ ID NO: 4128006 - DNA, 14 bp, Homo sapiens
atttataactcatc

SEQ ID NO: 4128007 - DNA, 16 bp, Homo sapiens
atttataactcatcat

SEQ ID NO: 4128008 - DNA, 17 bp, Homo sapiens
atttataactcatcata

SEQ ID NO: 4128009 - DNA, 21 bp, Homo sapiens
atttataactcatcataaaat

SEQ ID NO: 4128010 - DNA, 20 bp, Homo sapiens
atttataatgttagtagaaa

SEQ ID NO: 4128011 - DNA, 17 bp, Homo sapiens
atttataattgcatcta

SEQ ID NO: 4128012 - DNA, 14 bp, Homo sapiens
atttatacaaatta

SEQ ID NO: 4128013 - DNA, 13 bp, Homo sapiens
atttatacaagat

SEQ ID NO: 4128014 - DNA, 22 bp, Homo sapiens
atttatacaagattgaaaatct

SEQ ID NO: 4128015 - DNA, 19 bp, Homo sapiens
atttatacagtgccttgct

SEQ ID NO: 4128016 - DNA, 19 bp, Homo sapiens
atttatacccccaggaaac

SEQ ID NO: 4128017 - DNA, 17 bp, Homo sapiens
atttatatatgaaaact

SEQ ID NO: 4128018 - DNA, 19 bp, Homo sapiens
atttatatatgaaaactat

SEQ ID NO: 4128019 - DNA, 22 bp, Homo sapiens
atttatatatgaaaactataca

SEQ ID NO: 4128020 - DNA, 14 bp, Homo sapiens
atttatatatgtat

SEQ ID NO: 4128021 - DNA, 16 bp, Homo sapiens
atttatatatttataa

SEQ ID NO: 4128022 - DNA, 20 bp, Homo sapiens
atttatatatttataactca

SEQ ID NO: 4128023 - DNA, 19 bp, Homo sapiens
atttatatggggaatatat

SEQ ID NO: 4128024 - DNA, 16 bp, Homo sapiens
atttatatgtacatga

SEQ ID NO: 4128025 - DNA, 13 bp, Homo sapiens
atttatatttttg

SEQ ID NO: 4128026 - DNA, 13 bp, Homo sapiens
atttatcaaaatg

SEQ ID NO: 4128027 - DNA, 15 bp, Homo sapiens
atttatcaaaatgta

SEQ ID NO: 4128028 - DNA, 16 bp, Homo sapiens
atttatcaaaatgtag

SEQ ID NO: 4128029 - DNA, 21 bp, Homo sapiens
atttatcaaaccctagccttg

SEQ ID NO: 4128030 - DNA, 16 bp, Homo sapiens
atttatcacacttctg

SEQ ID NO: 4128031 - DNA, 15 bp, Homo sapiens
atttatcagtgacag

SEQ ID NO: 4128032 - DNA, 13 bp, Homo sapiens
atttatcattctt

SEQ ID NO: 4128033 - DNA, 18 bp, Homo sapiens
atttatccaaaatgtgta

SEQ ID NO: 4128034 - DNA, 20 bp, Homo sapiens
atttatctaaattaaagcct

SEQ ID NO: 4128035 - DNA, 16 bp, Homo sapiens
atttatctctatttaa

SEQ ID NO: 4128036 - DNA, 18 bp, Homo sapiens
atttatcttaagttctat

SEQ ID NO: 4128037 - DNA, 15 bp, Homo sapiens
atttatgatttaata

SEQ ID NO: 4128038 - DNA, 19 bp, Homo sapiens
atttatggaattaaccatt

SEQ ID NO: 4128039 - DNA, 12 bp, Homo sapiens
atttatgtaaac

SEQ ID NO: 4128040 - DNA, 23 bp, Homo sapiens
atttatgtaaactgcattagaaa

SEQ ID NO: 4128041 - DNA, 18 bp, Homo sapiens
atttatgtagatgtgcat

SEQ ID NO: 4128042 - DNA, 22 bp, Homo sapiens
atttatgtctatttaagcctca

SEQ ID NO: 4128043 - DNA, 16 bp, Homo sapiens
atttatgttaaaagat

SEQ ID NO: 4128044 - DNA, 13 bp, Homo sapiens
atttattaaataa

SEQ ID NO: 4128045 - DNA, 14 bp, Homo sapiens
atttattaaataaa

SEQ ID NO: 4128046 - DNA, 16 bp, Homo sapiens
atttattaaataaaat

SEQ ID NO: 4128047 - DNA, 23 bp, Homo sapiens
atttattaagatggattctcaga

SEQ ID NO: 4128048 - DNA, 12 bp, Homo sapiens
atttattaatat

SEQ ID NO: 4128049 - DNA, 11 bp, Homo sapiens
atttattaatt

SEQ ID NO: 4128050 - DNA, 14 bp, Homo sapiens
atttattaatttga

SEQ ID NO: 4128051 - DNA, 17 bp, Homo sapiens
atttattaatttgaaac

SEQ ID NO: 4128052 - DNA, 19 bp, Homo sapiens
atttattaatttgaaacca

SEQ ID NO: 4128053 - DNA, 15 bp, Homo sapiens
atttattacctctga

SEQ ID NO: 4128054 - DNA, 13 bp, Homo sapiens
atttattatttat

SEQ ID NO: 4128055 - DNA, 19 bp, Homo sapiens
atttattatttatttatta

SEQ ID NO: 4128056 - DNA, 21 bp, Homo sapiens
atttattattttttttatatt

SEQ ID NO: 4128057 - DNA, 21 bp, Homo sapiens
atttattcacatatatcaaag

SEQ ID NO: 4128058 - DNA, 18 bp, Homo sapiens
atttattgttagaaaatg

SEQ ID NO: 4128059 - DNA, 19 bp, Homo sapiens
atttattgtttatttatca

SEQ ID NO: 4128060 - DNA, 14 bp, Homo sapiens
atttatttaaagca

SEQ ID NO: 4128061 - DNA, 18 bp, Homo sapiens
atttatttaatatttaat

SEQ ID NO: 4128062 - DNA, 17 bp, Homo sapiens
atttatttaatgttatg

SEQ ID NO: 4128063 - DNA, 23 bp, Homo sapiens
atttatttacagatgaatgtatt

SEQ ID NO: 4128064 - DNA, 14 bp, Homo sapiens
atttatttattaag

SEQ ID NO: 4128065 - DNA, 14 bp, Homo sapiens
atttatttattact

SEQ ID NO: 4128066 - DNA, 14 bp, Homo sapiens
atttatttattatt

SEQ ID NO: 4128067 - DNA, 16 bp, Homo sapiens
atttatttcatccagt

SEQ ID NO: 4128068 - DNA, 13 bp, Homo sapiens
atttattttgtaa

SEQ ID NO: 4128069 - DNA, 14 bp, Homo sapiens
atttatttttacaa

SEQ ID NO: 4128070 - DNA, 14 bp, Homo sapiens
atttcaaaatgctt

SEQ ID NO: 4128071 - DNA, 16 bp, Homo sapiens
atttcaaaatgctttt

SEQ ID NO: 4128072 - DNA, 21 bp, Homo sapiens
atttcaaaccattgctcttag

SEQ ID NO: 4128073 - DNA, 22 bp, Homo sapiens
atttcaatcccacgtacttata

SEQ ID NO: 4128074 - DNA, 22 bp, Homo sapiens
atttcactatttttatttatat

SEQ ID NO: 4128075 - DNA, 14 bp, Homo sapiens
atttcactgtctgt

SEQ ID NO: 4128076 - DNA, 23 bp, Homo sapiens
atttcagactcccattcctgaag

SEQ ID NO: 4128077 - DNA, 13 bp, Homo sapiens
atttcaggaattt

SEQ ID NO: 4128078 - DNA, 14 bp, Homo sapiens
atttcaggaattta

SEQ ID NO: 4128079 - DNA, 22 bp, Homo sapiens
atttcaggatactctgtcagat

SEQ ID NO: 4128080 - DNA, 20 bp, Homo sapiens
atttcagtcttggtggttct

SEQ ID NO: 4128081 - DNA, 22 bp, Homo sapiens
atttcagttattgtccctggct

SEQ ID NO: 4128082 - DNA, 13 bp, Homo sapiens
atttcatagttca

SEQ ID NO: 4128083 - DNA, 15 bp, Homo sapiens
atttcatagttcaga

SEQ ID NO: 4128084 - DNA, 19 bp, Homo sapiens
atttcatcctttcacttct

SEQ ID NO: 4128085 - DNA, 14 bp, Homo sapiens
atttcatgtggctg

SEQ ID NO: 4128086 - DNA, 16 bp, Homo sapiens
atttcatgtggctgta

SEQ ID NO: 4128087 - DNA, 16 bp, Homo sapiens
atttcatgtttttgat

SEQ ID NO: 4128088 - DNA, 17 bp, Homo sapiens
atttcattccattgcct

SEQ ID NO: 4128089 - DNA, 15 bp, Homo sapiens
atttcatttcttgtc

SEQ ID NO: 4128090 - DNA, 23 bp, Homo sapiens
atttcatttcttgtcaattatgt

SEQ ID NO: 4128091 - DNA, 19 bp, Homo sapiens
atttccaacaccacagaca

SEQ ID NO: 4128092 - DNA, 21 bp, Homo sapiens
atttccactaaaaatattgtt

SEQ ID NO: 4128093 - DNA, 15 bp, Homo sapiens
atttccatatggatt

SEQ ID NO: 4128094 - DNA, 23 bp, Homo sapiens
atttcccacaccgtgtaaaccaa

SEQ ID NO: 4128095 - DNA, 15 bp, Homo sapiens
atttcccacatcttt

SEQ ID NO: 4128096 - DNA, 13 bp, Homo sapiens
atttcccaggacc

SEQ ID NO: 4128097 - DNA, 14 bp, Homo sapiens
atttcccaggaccc

SEQ ID NO: 4128098 - DNA, 14 bp, Homo sapiens
atttcccccaaagg

SEQ ID NO: 4128099 - DNA, 14 bp, Homo sapiens
atttccccctttct

SEQ ID NO: 4128100 - DNA, 16 bp, Homo sapiens
atttcccctccttccc

SEQ ID NO: 4128101 - DNA, 20 bp, Homo sapiens
atttccgtgaactctggtgc

SEQ ID NO: 4128102 - DNA, 21 bp, Homo sapiens
atttccgtgaactctggtgct

SEQ ID NO: 4128103 - DNA, 13 bp, Homo sapiens
atttcctcctggc

SEQ ID NO: 4128104 - DNA, 19 bp, Homo sapiens
atttcctgtgtgtgttgcc

SEQ ID NO: 4128105 - DNA, 14 bp, Homo sapiens
atttccttgaatgt

SEQ ID NO: 4128106 - DNA, 11 bp, Homo sapiens
atttccttgga

SEQ ID NO: 4128107 - DNA, 16 bp, Homo sapiens
atttccttggaggcca

SEQ ID NO: 4128108 - DNA, 22 bp, Homo sapiens
atttcctttatactgtgaagtt

SEQ ID NO: 4128109 - DNA, 13 bp, Homo sapiens
atttcctttatgt

SEQ ID NO: 4128110 - DNA, 21 bp, Homo sapiens
atttcctttatgtgaattttt

SEQ ID NO: 4128111 - DNA, 19 bp, Homo sapiens
atttccttttctctgccct

SEQ ID NO: 4128112 - DNA, 15 bp, Homo sapiens
atttcctttttgaca

SEQ ID NO: 4128113 - DNA, 15 bp, Homo sapiens
atttcgaaactgcca

SEQ ID NO: 4128114 - DNA, 17 bp, Homo sapiens
atttcgaaactgccaag

SEQ ID NO: 4128115 - DNA, 20 bp, Homo sapiens
atttctaaaaagattagcaa

SEQ ID NO: 4128116 - DNA, 21 bp, Homo sapiens
atttctaaagataatattact

SEQ ID NO: 4128117 - DNA, 19 bp, Homo sapiens
atttctaatccttttcctt

SEQ ID NO: 4128118 - DNA, 18 bp, Homo sapiens
atttctaggcacaaggtt

SEQ ID NO: 4128119 - DNA, 21 bp, Homo sapiens
atttctagttctttcctcccc

SEQ ID NO: 4128120 - DNA, 15 bp, Homo sapiens
atttctcactagtgt

SEQ ID NO: 4128121 - DNA, 17 bp, Homo sapiens
atttctcactagtgtca

SEQ ID NO: 4128122 - DNA, 14 bp, Homo sapiens
atttctcactgaga

SEQ ID NO: 4128123 - DNA, 18 bp, Homo sapiens
atttctccagttgggact

SEQ ID NO: 4128124 - DNA, 11 bp, Homo sapiens
atttctccttt

SEQ ID NO: 4128125 - DNA, 20 bp, Homo sapiens
atttctccttttgtgttcca

SEQ ID NO: 4128126 - DNA, 16 bp, Homo sapiens
atttctgatcagaggt

SEQ ID NO: 4128127 - DNA, 19 bp, Homo sapiens
atttctgatcagaggtgta

SEQ ID NO: 4128128 - DNA, 24 bp, Homo sapiens
atttctgatcagaggtgtacacta

SEQ ID NO: 4128129 - DNA, 13 bp, Homo sapiens
atttctgcatatg

SEQ ID NO: 4128130 - DNA, 18 bp, Homo sapiens
atttctgcatatgttgaa

SEQ ID NO: 4128131 - DNA, 15 bp, Homo sapiens
atttctgcctcgctc

SEQ ID NO: 4128132 - DNA, 15 bp, Homo sapiens
atttctgctctggaa

SEQ ID NO: 4128133 - DNA, 21 bp, Homo sapiens
atttctgctctggaataaagt

SEQ ID NO: 4128134 - DNA, 16 bp, Homo sapiens
atttctgggtcttttg

SEQ ID NO: 4128135 - DNA, 13 bp, Homo sapiens
atttctgtatata

SEQ ID NO: 4128136 - DNA, 22 bp, Homo sapiens
atttcttatacgcttttctttg

SEQ ID NO: 4128137 - DNA, 19 bp, Homo sapiens
atttcttatgtgacattaa

SEQ ID NO: 4128138 - DNA, 21 bp, Homo sapiens
atttcttcaaatccttccaaa

SEQ ID NO: 4128139 - DNA, 23 bp, Homo sapiens
atttcttcagtcagaaaacttta

SEQ ID NO: 4128140 - DNA, 12 bp, Homo sapiens
atttcttccctg

SEQ ID NO: 4128141 - DNA, 13 bp, Homo sapiens
atttcttccctgc

SEQ ID NO: 4128142 - DNA, 20 bp, Homo sapiens
atttcttccctgctttgcat

SEQ ID NO: 4128143 - DNA, 20 bp, Homo sapiens
atttcttcctaccaagtcaa

SEQ ID NO: 4128144 - DNA, 23 bp, Homo sapiens
atttcttcctaccaagtcaaact

SEQ ID NO: 4128145 - DNA, 18 bp, Homo sapiens
atttcttcctcactatga

SEQ ID NO: 4128146 - DNA, 17 bp, Homo sapiens
atttcttccttgttgtt

SEQ ID NO: 4128147 - DNA, 14 bp, Homo sapiens
atttcttgcgagcc

SEQ ID NO: 4128148 - DNA, 21 bp, Homo sapiens
atttcttgctctatctctcaa

SEQ ID NO: 4128149 - DNA, 11 bp, Homo sapiens
atttcttgctt

SEQ ID NO: 4128150 - DNA, 12 bp, Homo sapiens
atttcttgcttt

SEQ ID NO: 4128151 - DNA, 13 bp, Homo sapiens
atttcttgctttc

SEQ ID NO: 4128152 - DNA, 21 bp, Homo sapiens
atttctttaaaagaatgacta

SEQ ID NO: 4128153 - DNA, 16 bp, Homo sapiens
atttctttgcattcca

SEQ ID NO: 4128154 - DNA, 22 bp, Homo sapiens
atttcttttccttcattcatag

SEQ ID NO: 4128155 - DNA, 24 bp, Homo sapiens
atttcttttccttcattcataggg

SEQ ID NO: 4128156 - DNA, 16 bp, Homo sapiens
atttgaaaaaaacttc

SEQ ID NO: 4128157 - DNA, 13 bp, Homo sapiens
atttgaaatacta

SEQ ID NO: 4128158 - DNA, 14 bp, Homo sapiens
atttgaaatactaa

SEQ ID NO: 4128159 - DNA, 16 bp, Homo sapiens
atttgaaatactaaaa

SEQ ID NO: 4128160 - DNA, 19 bp, Homo sapiens
atttgaaatactaaaagca

SEQ ID NO: 4128161 - DNA, 21 bp, Homo sapiens
atttgaacccccgccatcctt

SEQ ID NO: 4128162 - DNA, 11 bp, Homo sapiens
atttgaatgaa

SEQ ID NO: 4128163 - DNA, 17 bp, Homo sapiens
atttgaatgggtccatt

SEQ ID NO: 4128164 - DNA, 13 bp, Homo sapiens
atttgaatgttaa

SEQ ID NO: 4128165 - DNA, 18 bp, Homo sapiens
atttgaattttaaatcta

SEQ ID NO: 4128166 - DNA, 20 bp, Homo sapiens
atttgaattttaaatctaaa

SEQ ID NO: 4128167 - DNA, 16 bp, Homo sapiens
atttgacttgaatatg

SEQ ID NO: 4128168 - DNA, 18 bp, Homo sapiens
atttgacttgcatgaaga

SEQ ID NO: 4128169 - DNA, 14 bp, Homo sapiens
atttgaggctcaga

SEQ ID NO: 4128170 - DNA, 17 bp, Homo sapiens
atttgagggcccagcca

SEQ ID NO: 4128171 - DNA, 18 bp, Homo sapiens
atttgagggcccagccag

SEQ ID NO: 4128172 - DNA, 19 bp, Homo sapiens
atttgagggcccagccagg

SEQ ID NO: 4128173 - DNA, 12 bp, Homo sapiens
atttgagtgttt

SEQ ID NO: 4128174 - DNA, 19 bp, Homo sapiens
atttgatatttgcattgag

SEQ ID NO: 4128175 - DNA, 15 bp, Homo sapiens
atttgatgaaagctg

SEQ ID NO: 4128176 - DNA, 21 bp, Homo sapiens
atttgatgaaagctgattact

SEQ ID NO: 4128177 - DNA, 16 bp, Homo sapiens
atttgatgattttcat

SEQ ID NO: 4128178 - DNA, 16 bp, Homo sapiens
atttgatgctggagag

SEQ ID NO: 4128179 - DNA, 17 bp, Homo sapiens
atttgatgctggagagg

SEQ ID NO: 4128180 - DNA, 20 bp, Homo sapiens
atttgatgtttacaggtgga

SEQ ID NO: 4128181 - DNA, 14 bp, Homo sapiens
atttgattaacaaa

SEQ ID NO: 4128182 - DNA, 17 bp, Homo sapiens
atttgattaacaaatat

SEQ ID NO: 4128183 - DNA, 19 bp, Homo sapiens
atttgattcattttcctgt

SEQ ID NO: 4128184 - DNA, 13 bp, Homo sapiens
atttgattgattt

SEQ ID NO: 4128185 - DNA, 21 bp, Homo sapiens
atttgcaatattcctttgggc

SEQ ID NO: 4128186 - DNA, 14 bp, Homo sapiens
atttgcagggtcct

SEQ ID NO: 4128187 - DNA, 18 bp, Homo sapiens
atttgcatattctattgt

SEQ ID NO: 4128188 - DNA, 13 bp, Homo sapiens
atttgcatggatt

SEQ ID NO: 4128189 - DNA, 23 bp, Homo sapiens
atttgcattaaattcacaaactt

SEQ ID NO: 4128190 - DNA, 22 bp, Homo sapiens
atttgcattgaacacaaactgt

SEQ ID NO: 4128191 - DNA, 15 bp, Homo sapiens
atttgccatgggctt

SEQ ID NO: 4128192 - DNA, 24 bp, Homo sapiens
atttgccatgggcttcactgtata

SEQ ID NO: 4128193 - DNA, 21 bp, Homo sapiens
atttgcctgtttctgcttgct

SEQ ID NO: 4128194 - DNA, 23 bp, Homo sapiens
atttgcctttaaaaaaaaaagtt

SEQ ID NO: 4128195 - DNA, 14 bp, Homo sapiens
atttgctaagcata

SEQ ID NO: 4128196 - DNA, 21 bp, Homo sapiens
atttggaagaaaaaaatcttc

SEQ ID NO: 4128197 - DNA, 14 bp, Homo sapiens
atttggaatacttt

SEQ ID NO: 4128198 - DNA, 16 bp, Homo sapiens
atttggagttaggtcc

SEQ ID NO: 4128199 - DNA, 17 bp, Homo sapiens
atttgggagacatgtga

SEQ ID NO: 4128200 - DNA, 21 bp, Homo sapiens
atttgggcctgctccagacct

SEQ ID NO: 4128201 - DNA, 12 bp, Homo sapiens
atttggtacttt

SEQ ID NO: 4128202 - DNA, 16 bp, Homo sapiens
atttggttcattaatt

SEQ ID NO: 4128203 - DNA, 23 bp, Homo sapiens
atttgtaaaagaacagtaaacat

SEQ ID NO: 4128204 - DNA, 16 bp, Homo sapiens
atttgtaaatctgcca

SEQ ID NO: 4128205 - DNA, 13 bp, Homo sapiens
atttgtaaatgct

SEQ ID NO: 4128206 - DNA, 16 bp, Homo sapiens
atttgtaacctcagct

SEQ ID NO: 4128207 - DNA, 19 bp, Homo sapiens
atttgtaacctcagctctg

SEQ ID NO: 4128208 - DNA, 14 bp, Homo sapiens
atttgtaagtttca

SEQ ID NO: 4128209 - DNA, 17 bp, Homo sapiens
atttgtaagtttcaggt

SEQ ID NO: 4128210 - DNA, 21 bp, Homo sapiens
atttgtaagtttcaggtgaca

SEQ ID NO: 4128211 - DNA, 13 bp, Homo sapiens
atttgtacaaaaa

SEQ ID NO: 4128212 - DNA, 14 bp, Homo sapiens
atttgtaggagaaa

SEQ ID NO: 4128213 - DNA, 19 bp, Homo sapiens
atttgtagtggaaacattt

SEQ ID NO: 4128214 - DNA, 22 bp, Homo sapiens
atttgtagtggaaacatttata

SEQ ID NO: 4128215 - DNA, 21 bp, Homo sapiens
atttgtatgtattttcagtta

SEQ ID NO: 4128216 - DNA, 16 bp, Homo sapiens
atttgtcactgcttca

SEQ ID NO: 4128217 - DNA, 19 bp, Homo sapiens
atttgtcatgctgggattt

SEQ ID NO: 4128218 - DNA, 18 bp, Homo sapiens
atttgtgatagcactttc

SEQ ID NO: 4128219 - DNA, 22 bp, Homo sapiens
atttgtggcaattttatgtttt

SEQ ID NO: 4128220 - DNA, 13 bp, Homo sapiens
atttgtgttttaa

SEQ ID NO: 4128221 - DNA, 20 bp, Homo sapiens
atttgtgttttaatttaaac

SEQ ID NO: 4128222 - DNA, 18 bp, Homo sapiens
atttgttcactgaaggtg

SEQ ID NO: 4128223 - DNA, 15 bp, Homo sapiens
atttgttcagctccc

SEQ ID NO: 4128224 - DNA, 19 bp, Homo sapiens
atttgttcagctcccccag

SEQ ID NO: 4128225 - DNA, 11 bp, Homo sapiens
atttgttcctg

SEQ ID NO: 4128226 - DNA, 18 bp, Homo sapiens
atttgttgaaattatgta

SEQ ID NO: 4128227 - DNA, 20 bp, Homo sapiens
atttgttgaaattatgtatg

SEQ ID NO: 4128228 - DNA, 18 bp, Homo sapiens
atttgttgattctctcca

SEQ ID NO: 4128229 - DNA, 15 bp, Homo sapiens
atttgttgttttctg

SEQ ID NO: 4128230 - DNA, 18 bp, Homo sapiens
attttaaaaagtcttcac

SEQ ID NO: 4128231 - DNA, 21 bp, Homo sapiens
attttaaaaagtcttcactct

SEQ ID NO: 4128232 - DNA, 19 bp, Homo sapiens
attttaaaataaattagtt

SEQ ID NO: 4128233 - DNA, 20 bp, Homo sapiens
attttaaataaaagtgatca

SEQ ID NO: 4128234 - DNA, 17 bp, Homo sapiens
attttaaataatttcta

SEQ ID NO: 4128235 - DNA, 19 bp, Homo sapiens
attttaaatctaaatctat

SEQ ID NO: 4128236 - DNA, 21 bp, Homo sapiens
attttaaatctaaatctattt

SEQ ID NO: 4128237 - DNA, 22 bp, Homo sapiens
attttaaattataacttaaaat

SEQ ID NO: 4128238 - DNA, 16 bp, Homo sapiens
attttaaattcacaat

SEQ ID NO: 4128239 - DNA, 15 bp, Homo sapiens
attttaacaataact

SEQ ID NO: 4128240 - DNA, 16 bp, Homo sapiens
attttaacaataacta

SEQ ID NO: 4128241 - DNA, 21 bp, Homo sapiens
attttaagcactcttaaagca

SEQ ID NO: 4128242 - DNA, 22 bp, Homo sapiens
attttaagcactcttaaagcaa

SEQ ID NO: 4128243 - DNA, 14 bp, Homo sapiens
attttaagtgcttt

SEQ ID NO: 4128244 - DNA, 17 bp, Homo sapiens
attttaagtgctttgta

SEQ ID NO: 4128245 - DNA, 18 bp, Homo sapiens
attttaagtgctttgtaa

SEQ ID NO: 4128246 - DNA, 20 bp, Homo sapiens
attttaagtgctttgtaatg

SEQ ID NO: 4128247 - DNA, 12 bp, Homo sapiens
attttaatacat

SEQ ID NO: 4128248 - DNA, 13 bp, Homo sapiens
attttaatgtgaa

SEQ ID NO: 4128249 - DNA, 14 bp, Homo sapiens
attttaatgtgaag

SEQ ID NO: 4128250 - DNA, 12 bp, Homo sapiens
attttaattcat

SEQ ID NO: 4128251 - DNA, 11 bp, Homo sapiens
attttacaaaa

SEQ ID NO: 4128252 - DNA, 17 bp, Homo sapiens
attttacaaaagatgta

SEQ ID NO: 4128253 - DNA, 15 bp, Homo sapiens
attttacataacgga

SEQ ID NO: 4128254 - DNA, 15 bp, Homo sapiens
attttacttccatta

SEQ ID NO: 4128255 - DNA, 15 bp, Homo sapiens
attttagcatattaa

SEQ ID NO: 4128256 - DNA, 17 bp, Homo sapiens
attttaggaacttcaga

SEQ ID NO: 4128257 - DNA, 18 bp, Homo sapiens
attttaggaacttcagag

SEQ ID NO: 4128258 - DNA, 20 bp, Homo sapiens
attttaggcactcttaaatg

SEQ ID NO: 4128259 - DNA, 15 bp, Homo sapiens
attttaggtgttgat

SEQ ID NO: 4128260 - DNA, 16 bp, Homo sapiens
attttaggtgttgatt

SEQ ID NO: 4128261 - DNA, 19 bp, Homo sapiens
attttagtattcattctgc

SEQ ID NO: 4128262 - DNA, 22 bp, Homo sapiens
attttagtggataaaatttgta

SEQ ID NO: 4128263 - DNA, 20 bp, Homo sapiens
attttatccctcacctgtag

SEQ ID NO: 4128264 - DNA, 13 bp, Homo sapiens
attttatctgtga

SEQ ID NO: 4128265 - DNA, 14 bp, Homo sapiens
attttatctgtgaa

SEQ ID NO: 4128266 - DNA, 21 bp, Homo sapiens
attttatgaaaggtttacatt

SEQ ID NO: 4128267 - DNA, 16 bp, Homo sapiens
attttatgaatgtctt

SEQ ID NO: 4128268 - DNA, 17 bp, Homo sapiens
attttatgatcagtgtt

SEQ ID NO: 4128269 - DNA, 15 bp, Homo sapiens
attttatggtggaaa

SEQ ID NO: 4128270 - DNA, 13 bp, Homo sapiens
attttattgtata

SEQ ID NO: 4128271 - DNA, 20 bp, Homo sapiens
attttattgtataaaaagtt

SEQ ID NO: 4128272 - DNA, 17 bp, Homo sapiens
attttatttgtttttca

SEQ ID NO: 4128273 - DNA, 21 bp, Homo sapiens
attttattttgtgctcattta

SEQ ID NO: 4128274 - DNA, 23 bp, Homo sapiens
attttattttgtgctcatttaag

SEQ ID NO: 4128275 - DNA, 16 bp, Homo sapiens
attttcaaatctggtc

SEQ ID NO: 4128276 - DNA, 17 bp, Homo sapiens
attttcaaatctggtcc

SEQ ID NO: 4128277 - DNA, 20 bp, Homo sapiens
attttcaacgcagccctgct

SEQ ID NO: 4128278 - DNA, 19 bp, Homo sapiens
attttcaagtaattgtgaa

SEQ ID NO: 4128279 - DNA, 22 bp, Homo sapiens
attttcacaaaatgtctcagtt

SEQ ID NO: 4128280 - DNA, 15 bp, Homo sapiens
attttcacaatgtca

SEQ ID NO: 4128281 - DNA, 20 bp, Homo sapiens
attttcacaatgtcagtatt

SEQ ID NO: 4128282 - DNA, 14 bp, Homo sapiens
attttcagaaaata

SEQ ID NO: 4128283 - DNA, 19 bp, Homo sapiens
attttcagtataatttaac

SEQ ID NO: 4128284 - DNA, 18 bp, Homo sapiens
attttcattaaacttgaa

SEQ ID NO: 4128285 - DNA, 14 bp, Homo sapiens
attttcatttcatg

SEQ ID NO: 4128286 - DNA, 21 bp, Homo sapiens
attttccccccactctcccca

SEQ ID NO: 4128287 - DNA, 14 bp, Homo sapiens
attttcctcttgtg

SEQ ID NO: 4128288 - DNA, 17 bp, Homo sapiens
attttcctgttcagtga

SEQ ID NO: 4128289 - DNA, 16 bp, Homo sapiens
attttcgttcattact

SEQ ID NO: 4128290 - DNA, 20 bp, Homo sapiens
attttctcaaaagcatttat

SEQ ID NO: 4128291 - DNA, 21 bp, Homo sapiens
attttctcactgaactccacc

SEQ ID NO: 4128292 - DNA, 16 bp, Homo sapiens
attttctgacatgcat

SEQ ID NO: 4128293 - DNA, 20 bp, Homo sapiens
attttctggtagatagaaat

SEQ ID NO: 4128294 - DNA, 21 bp, Homo sapiens
attttctggtagatagaaata

SEQ ID NO: 4128295 - DNA, 21 bp, Homo sapiens
attttcttattgcgctgctac

SEQ ID NO: 4128296 - DNA, 21 bp, Homo sapiens
attttcttcatgcaatgacat

SEQ ID NO: 4128297 - DNA, 18 bp, Homo sapiens
attttctttatcattgct

SEQ ID NO: 4128298 - DNA, 18 bp, Homo sapiens
attttcttttgaattgtt

SEQ ID NO: 4128299 - DNA, 22 bp, Homo sapiens
attttgaagaatatttaagaaa

SEQ ID NO: 4128300 - DNA, 14 bp, Homo sapiens
attttgaagtttac

SEQ ID NO: 4128301 - DNA, 15 bp, Homo sapiens
attttgaagtttaca

SEQ ID NO: 4128302 - DNA, 18 bp, Homo sapiens
attttgaagtttacattt

SEQ ID NO: 4128303 - DNA, 24 bp, Homo sapiens
attttgacagttattttgataaca

SEQ ID NO: 4128304 - DNA, 17 bp, Homo sapiens
attttgacctactctca

SEQ ID NO: 4128305 - DNA, 13 bp, Homo sapiens
attttgagaaact

SEQ ID NO: 4128306 - DNA, 23 bp, Homo sapiens
attttgagaaactgctgcagatt

SEQ ID NO: 4128307 - DNA, 22 bp, Homo sapiens
attttgagaatgctgacacttt

SEQ ID NO: 4128308 - DNA, 13 bp, Homo sapiens
attttgataataa

SEQ ID NO: 4128309 - DNA, 18 bp, Homo sapiens
attttgataataaattga

SEQ ID NO: 4128310 - DNA, 21 bp, Homo sapiens
attttgatgtgacaataatat

SEQ ID NO: 4128311 - DNA, 14 bp, Homo sapiens
attttgcaaaatga

SEQ ID NO: 4128312 - DNA, 18 bp, Homo sapiens
attttgcaaggtgcattt

SEQ ID NO: 4128313 - DNA, 16 bp, Homo sapiens
attttgcagcagtgag

SEQ ID NO: 4128314 - DNA, 17 bp, Homo sapiens
attttgcattccagaat

SEQ ID NO: 4128315 - DNA, 19 bp, Homo sapiens
attttgcattccagaatct

SEQ ID NO: 4128316 - DNA, 22 bp, Homo sapiens
attttgcccttccatagcctaa

SEQ ID NO: 4128317 - DNA, 21 bp, Homo sapiens
attttgctattgtaaatatgt

SEQ ID NO: 4128318 - DNA, 22 bp, Homo sapiens
attttggaaactgctaaattct

SEQ ID NO: 4128319 - DNA, 20 bp, Homo sapiens
attttggaagttttcaggac

SEQ ID NO: 4128320 - DNA, 11 bp, Homo sapiens
attttggaatt

SEQ ID NO: 4128321 - DNA, 12 bp, Homo sapiens
attttggaattt

SEQ ID NO: 4128322 - DNA, 21 bp, Homo sapiens
attttggagagtttcctgaaa

SEQ ID NO: 4128323 - DNA, 18 bp, Homo sapiens
attttggatatattattg

SEQ ID NO: 4128324 - DNA, 21 bp, Homo sapiens
attttggatatattattgtaa

SEQ ID NO: 4128325 - DNA, 19 bp, Homo sapiens
attttggcgctattacaaa

SEQ ID NO: 4128326 - DNA, 14 bp, Homo sapiens
attttggggtctct

SEQ ID NO: 4128327 - DNA, 21 bp, Homo sapiens
attttgggtattaatatatag

SEQ ID NO: 4128328 - DNA, 19 bp, Homo sapiens
attttgggttttgggtctt

SEQ ID NO: 4128329 - DNA, 18 bp, Homo sapiens
attttggtccaagttgtg

SEQ ID NO: 4128330 - DNA, 14 bp, Homo sapiens
attttggtgagaaa

SEQ ID NO: 4128331 - DNA, 15 bp, Homo sapiens
attttggtgagaaat

SEQ ID NO: 4128332 - DNA, 16 bp, Homo sapiens
attttgtaagaaggca

SEQ ID NO: 4128333 - DNA, 21 bp, Homo sapiens
attttgtaagaaggcaatatt

SEQ ID NO: 4128334 - DNA, 23 bp, Homo sapiens
attttgtcatataagattcatat

SEQ ID NO: 4128335 - DNA, 20 bp, Homo sapiens
attttgtgctcatttaagtt

SEQ ID NO: 4128336 - DNA, 18 bp, Homo sapiens
attttgtggttctatttt

SEQ ID NO: 4128337 - DNA, 23 bp, Homo sapiens
attttgtgtacaagttgttattg

SEQ ID NO: 4128338 - DNA, 21 bp, Homo sapiens
attttgtgtcctccaggagct

SEQ ID NO: 4128339 - DNA, 19 bp, Homo sapiens
attttgttgcttttgtgaa

SEQ ID NO: 4128340 - DNA, 20 bp, Homo sapiens
attttgttgcttttgtgaac

SEQ ID NO: 4128341 - DNA, 22 bp, Homo sapiens
atttttaaaaaatgaaatcctt

SEQ ID NO: 4128342 - DNA, 18 bp, Homo sapiens
atttttaaaatatgtttt

SEQ ID NO: 4128343 - DNA, 13 bp, Homo sapiens
atttttaaattgt

SEQ ID NO: 4128344 - DNA, 22 bp, Homo sapiens
atttttacaagaagtttattct

SEQ ID NO: 4128345 - DNA, 16 bp, Homo sapiens
atttttacaagatcca

SEQ ID NO: 4128346 - DNA, 23 bp, Homo sapiens
atttttacaagatccatttgcct

SEQ ID NO: 4128347 - DNA, 21 bp, Homo sapiens
atttttaccctaatgtcttca

SEQ ID NO: 4128348 - DNA, 22 bp, Homo sapiens
atttttaggaagttttctgtag

SEQ ID NO: 4128349 - DNA, 18 bp, Homo sapiens
atttttatatcagcctga

SEQ ID NO: 4128350 - DNA, 14 bp, Homo sapiens
atttttatatttcc

SEQ ID NO: 4128351 - DNA, 11 bp, Homo sapiens
atttttatcag

SEQ ID NO: 4128352 - DNA, 14 bp, Homo sapiens
atttttatcatgaa

SEQ ID NO: 4128353 - DNA, 21 bp, Homo sapiens
atttttattaaagcatttcct

SEQ ID NO: 4128354 - DNA, 14 bp, Homo sapiens
atttttatttcaaa

SEQ ID NO: 4128355 - DNA, 13 bp, Homo sapiens
atttttatttctt

SEQ ID NO: 4128356 - DNA, 16 bp, Homo sapiens
atttttatttcttttt

SEQ ID NO: 4128357 - DNA, 17 bp, Homo sapiens
atttttcaataaagcat

SEQ ID NO: 4128358 - DNA, 17 bp, Homo sapiens
atttttcaatatattga

SEQ ID NO: 4128359 - DNA, 18 bp, Homo sapiens
atttttcagatgcttctg

SEQ ID NO: 4128360 - DNA, 22 bp, Homo sapiens
atttttcggaggccccactgat

SEQ ID NO: 4128361 - DNA, 17 bp, Homo sapiens
atttttctaaccttgaa

SEQ ID NO: 4128362 - DNA, 16 bp, Homo sapiens
atttttctcccaagaa

SEQ ID NO: 4128363 - DNA, 12 bp, Homo sapiens
atttttctcttc

SEQ ID NO: 4128364 - DNA, 19 bp, Homo sapiens
atttttctgaggtccttat

SEQ ID NO: 4128365 - DNA, 19 bp, Homo sapiens
atttttcttagtgttgtgg

SEQ ID NO: 4128366 - DNA, 20 bp, Homo sapiens
atttttcttttgaggcatgc

SEQ ID NO: 4128367 - DNA, 17 bp, Homo sapiens
atttttgaaaaaagtac

SEQ ID NO: 4128368 - DNA, 23 bp, Homo sapiens
atttttgatacagttttcagaaa

SEQ ID NO: 4128369 - DNA, 15 bp, Homo sapiens
atttttgccatacat

SEQ ID NO: 4128370 - DNA, 18 bp, Homo sapiens
atttttgccatacatcag

SEQ ID NO: 4128371 - DNA, 18 bp, Homo sapiens
atttttggagtttaccac

SEQ ID NO: 4128372 - DNA, 14 bp, Homo sapiens
atttttggggaaaa

SEQ ID NO: 4128373 - DNA, 20 bp, Homo sapiens
atttttggggaaaaaagcac

SEQ ID NO: 4128374 - DNA, 21 bp, Homo sapiens
atttttggggaaaaaagcaca

SEQ ID NO: 4128375 - DNA, 19 bp, Homo sapiens
atttttgtaatgtgaaaag

SEQ ID NO: 4128376 - DNA, 14 bp, Homo sapiens
atttttgtacttga

SEQ ID NO: 4128377 - DNA, 18 bp, Homo sapiens
atttttgtacttgatttg

SEQ ID NO: 4128378 - DNA, 17 bp, Homo sapiens
atttttgtgtttctaaa

SEQ ID NO: 4128379 - DNA, 22 bp, Homo sapiens
atttttgtttcttccaaagcac

SEQ ID NO: 4128380 - DNA, 18 bp, Homo sapiens
attttttaaaacactaaa

SEQ ID NO: 4128381 - DNA, 19 bp, Homo sapiens
attttttaagtatttatat

SEQ ID NO: 4128382 - DNA, 13 bp, Homo sapiens
attttttattgct

SEQ ID NO: 4128383 - DNA, 15 bp, Homo sapiens
attttttattttact

SEQ ID NO: 4128384 - DNA, 22 bp, Homo sapiens
attttttcagaaatatgtggtt

SEQ ID NO: 4128385 - DNA, 12 bp, Homo sapiens
attttttccaaa

SEQ ID NO: 4128386 - DNA, 14 bp, Homo sapiens
attttttccaaaat

SEQ ID NO: 4128387 - DNA, 20 bp, Homo sapiens
attttttcgtgcactctgct

SEQ ID NO: 4128388 - DNA, 21 bp, Homo sapiens
attttttcgtgcactctgcta

SEQ ID NO: 4128389 - DNA, 14 bp, Homo sapiens
attttttcttttgt

SEQ ID NO: 4128390 - DNA, 20 bp, Homo sapiens
attttttcttttgtaattgt

SEQ ID NO: 4128391 - DNA, 22 bp, Homo sapiens
attttttgctataatcattagt

SEQ ID NO: 4128392 - DNA, 19 bp, Homo sapiens
attttttggtggtgaaatt

SEQ ID NO: 4128393 - DNA, 20 bp, Homo sapiens
attttttggtggtgaaattg

SEQ ID NO: 4128394 - DNA, 23 bp, Homo sapiens
attttttgtaatgtgtgaaaaag

SEQ ID NO: 4128395 - DNA, 12 bp, Homo sapiens
atttttttaagc

SEQ ID NO: 4128396 - DNA, 18 bp, Homo sapiens
atttttttaatagtgctt

SEQ ID NO: 4128397 - DNA, 21 bp, Homo sapiens
atttttttcactggagttaca

SEQ ID NO: 4128398 - DNA, 12 bp, Homo sapiens
atttttttcctg

SEQ ID NO: 4128399 - DNA, 13 bp, Homo sapiens
atttttttctacc

SEQ ID NO: 4128400 - DNA, 20 bp, Homo sapiens
atttttttctaccttgaggt

SEQ ID NO: 4128401 - DNA, 15 bp, Homo sapiens
atttttttgtaattg

SEQ ID NO: 4128402 - DNA, 22 bp, Homo sapiens
attttttttaaaatagaaattt

SEQ ID NO: 4128403 - DNA, 17 bp, Homo sapiens
attttttttatatttat

SEQ ID NO: 4128404 - DNA, 14 bp, Homo sapiens
atttttttttctaa

SEQ ID NO: 4128405 - DNA, 15 bp, Homo sapiens
atttttttttctaag

SEQ ID NO: 4128406 - DNA, 14 bp, Homo sapiens
caaaaaaaaaagaa

SEQ ID NO: 4128407 - DNA, 20 bp, Homo sapiens
caaaaaaaaaagaagttact

SEQ ID NO: 4128408 - DNA, 15 bp, Homo sapiens
caaaaaaacaaaaaa

SEQ ID NO: 4128409 - DNA, 12 bp, Homo sapiens
caaaaaaaggaa

SEQ ID NO: 4128410 - DNA, 14 bp, Homo sapiens
caaaaaaaggaaaa

SEQ ID NO: 4128411 - DNA, 15 bp, Homo sapiens
caaaaaaatttaaaa

SEQ ID NO: 4128412 - DNA, 16 bp, Homo sapiens
caaaaaaatttaaaat

SEQ ID NO: 4128413 - DNA, 23 bp, Homo sapiens
caaaaaagacttgagacaatgtt

SEQ ID NO: 4128414 - DNA, 17 bp, Homo sapiens
caaaaaagggacagcat

SEQ ID NO: 4128415 - DNA, 19 bp, Homo sapiens
caaaaaagtcaacaaactg

SEQ ID NO: 4128416 - DNA, 13 bp, Homo sapiens
caaaaaataatta

SEQ ID NO: 4128417 - DNA, 18 bp, Homo sapiens
caaaaaattagccgggcg

SEQ ID NO: 4128418 - DNA, 22 bp, Homo sapiens
caaaaacaggtatatactttga

SEQ ID NO: 4128419 - DNA, 15 bp, Homo sapiens
caaaaacatgtatgt

SEQ ID NO: 4128420 - DNA, 23 bp, Homo sapiens
caaaaacatgtatgtgcatttca

SEQ ID NO: 4128421 - DNA, 14 bp, Homo sapiens
caaaaactatttgg

SEQ ID NO: 4128422 - DNA, 16 bp, Homo sapiens
caaaaactatttggga

SEQ ID NO: 4128423 - DNA, 14 bp, Homo sapiens
caaaaagaaatgac

SEQ ID NO: 4128424 - DNA, 14 bp, Homo sapiens
caaaaagacaaaca

SEQ ID NO: 4128425 - DNA, 21 bp, Homo sapiens
caaaaagcaagggagaaaaga

SEQ ID NO: 4128426 - DNA, 14 bp, Homo sapiens
caaaaagcttcccc

SEQ ID NO: 4128427 - DNA, 12 bp, Homo sapiens
caaaaataatgt

SEQ ID NO: 4128428 - DNA, 13 bp, Homo sapiens
caaaaatacaaaa

SEQ ID NO: 4128429 - DNA, 15 bp, Homo sapiens
caaaaatagccctgc

SEQ ID NO: 4128430 - DNA, 19 bp, Homo sapiens
caaaaatgaaagcatgtct

SEQ ID NO: 4128431 - DNA, 15 bp, Homo sapiens
caaaaattagccggg

SEQ ID NO: 4128432 - DNA, 16 bp, Homo sapiens
caaaaattaggtattt

SEQ ID NO: 4128433 - DNA, 19 bp, Homo sapiens
caaaaattatctatagcta

SEQ ID NO: 4128434 - DNA, 22 bp, Homo sapiens
caaaacaaaaattaggtatttt

SEQ ID NO: 4128435 - DNA, 13 bp, Homo sapiens
caaaaccaggcct

SEQ ID NO: 4128436 - DNA, 18 bp, Homo sapiens
caaaaccaggcctctgct

SEQ ID NO: 4128437 - DNA, 23 bp, Homo sapiens
caaaaccttgctaattttctcaa

SEQ ID NO: 4128438 - DNA, 23 bp, Homo sapiens
caaaacgcatggagtgtgtattg

SEQ ID NO: 4128439 - DNA, 13 bp, Homo sapiens
caaaacgtcttat

SEQ ID NO: 4128440 - DNA, 21 bp, Homo sapiens
caaaacttctcttgaaaagtt

SEQ ID NO: 4128441 - DNA, 13 bp, Homo sapiens
caaaagaagcccc

SEQ ID NO: 4128442 - DNA, 20 bp, Homo sapiens
caaaagatttggaaagatat

SEQ ID NO: 4128443 - DNA, 14 bp, Homo sapiens
caaaagcaagactg

SEQ ID NO: 4128444 - DNA, 21 bp, Homo sapiens
caaaagcatttatcattcttg

SEQ ID NO: 4128445 - DNA, 12 bp, Homo sapiens
caaaaggcagct

SEQ ID NO: 4128446 - DNA, 13 bp, Homo sapiens
caaaaggcagctc

SEQ ID NO: 4128447 - DNA, 14 bp, Homo sapiens
caaaaggcagctca

SEQ ID NO: 4128448 - DNA, 23 bp, Homo sapiens
caaaaggcagctcacccctgggc

SEQ ID NO: 4128449 - DNA, 21 bp, Homo sapiens
caaaaggcatttcccaccctg

SEQ ID NO: 4128450 - DNA, 16 bp, Homo sapiens
caaaaggcctcttgta

SEQ ID NO: 4128451 - DNA, 22 bp, Homo sapiens
caaaagggtcttgactctaaat

SEQ ID NO: 4128452 - DNA, 20 bp, Homo sapiens
caaaagggtttaaactgatt

SEQ ID NO: 4128453 - DNA, 22 bp, Homo sapiens
caaaagggtttaaactgattca

SEQ ID NO: 4128454 - DNA, 20 bp, Homo sapiens
caaaaggttaataaagtaat

SEQ ID NO: 4128455 - DNA, 20 bp, Homo sapiens
caaaaggttcactaaagcag

SEQ ID NO: 4128456 - DNA, 16 bp, Homo sapiens
caaaagtctgtctttc

SEQ ID NO: 4128457 - DNA, 21 bp, Homo sapiens
caaaataaaaagtgacacagc

SEQ ID NO: 4128458 - DNA, 22 bp, Homo sapiens
caaaataattttaagaaatcaa

SEQ ID NO: 4128459 - DNA, 16 bp, Homo sapiens
caaaatacaatcctgt

SEQ ID NO: 4128460 - DNA, 22 bp, Homo sapiens
caaaatacaatcctgtttataa

SEQ ID NO: 4128461 - DNA, 21 bp, Homo sapiens
caaaatatgccccttcttggg

SEQ ID NO: 4128462 - DNA, 22 bp, Homo sapiens
caaaatatgccccttcttgggc

SEQ ID NO: 4128463 - DNA, 16 bp, Homo sapiens
caaaatatgtttaaaa

SEQ ID NO: 4128464 - DNA, 16 bp, Homo sapiens
caaaatattttttgca

SEQ ID NO: 4128465 - DNA, 20 bp, Homo sapiens
caaaatattttttgcaagtt

SEQ ID NO: 4128466 - DNA, 16 bp, Homo sapiens
caaaatcaattaaaat

SEQ ID NO: 4128467 - DNA, 19 bp, Homo sapiens
caaaatctcccattttgga

SEQ ID NO: 4128468 - DNA, 18 bp, Homo sapiens
caaaatgctttttatttc

SEQ ID NO: 4128469 - DNA, 22 bp, Homo sapiens
caaaatgtctgtagctcctcaa

SEQ ID NO: 4128470 - DNA, 19 bp, Homo sapiens
caaaattctagctgtatga

SEQ ID NO: 4128471 - DNA, 16 bp, Homo sapiens
caaaattgatgtgttt

SEQ ID NO: 4128472 - DNA, 17 bp, Homo sapiens
caaaattgcaaatcttg

SEQ ID NO: 4128473 - DNA, 20 bp, Homo sapiens
caaaattgtctaaaatgtca

SEQ ID NO: 4128474 - DNA, 15 bp, Homo sapiens
caaaatttccagtac

SEQ ID NO: 4128475 - DNA, 16 bp, Homo sapiens
caaaattttattttgt

SEQ ID NO: 4128476 - DNA, 20 bp, Homo sapiens
caaaattttctcattttctt

SEQ ID NO: 4128477 - DNA, 16 bp, Homo sapiens
caaacaagggagaaga

SEQ ID NO: 4128478 - DNA, 12 bp, Homo sapiens
caaacacacaca

SEQ ID NO: 4128479 - DNA, 14 bp, Homo sapiens
caaacacacacact

SEQ ID NO: 4128480 - DNA, 15 bp, Homo sapiens
caaacacatacagga

SEQ ID NO: 4128481 - DNA, 12 bp, Homo sapiens
caaacaccttcc

SEQ ID NO: 4128482 - DNA, 18 bp, Homo sapiens
caaacactccaccctcca

SEQ ID NO: 4128483 - DNA, 16 bp, Homo sapiens
caaacactgaggcagc

SEQ ID NO: 4128484 - DNA, 21 bp, Homo sapiens
caaacactgaggcagccttgg

SEQ ID NO: 4128485 - DNA, 17 bp, Homo sapiens
caaacactgcagtttcc

SEQ ID NO: 4128486 - DNA, 22 bp, Homo sapiens
caaacagaaatcaggtgtttta

SEQ ID NO: 4128487 - DNA, 21 bp, Homo sapiens
caaacagtaatctaggtgtgg

SEQ ID NO: 4128488 - DNA, 18 bp, Homo sapiens
caaacatcagacctgtct

SEQ ID NO: 4128489 - DNA, 14 bp, Homo sapiens
caaacatttcaaag

SEQ ID NO: 4128490 - DNA, 15 bp, Homo sapiens
caaaccaacatcttt

SEQ ID NO: 4128491 - DNA, 22 bp, Homo sapiens
caaaccagcttgttctgggctc

SEQ ID NO: 4128492 - DNA, 17 bp, Homo sapiens
caaaccagtatcgctca

SEQ ID NO: 4128493 - DNA, 13 bp, Homo sapiens
caaacccatgagg

SEQ ID NO: 4128494 - DNA, 14 bp, Homo sapiens
caaacccccattct

SEQ ID NO: 4128495 - DNA, 16 bp, Homo sapiens
caaacctgtagatgca

SEQ ID NO: 4128496 - DNA, 20 bp, Homo sapiens
caaacgccctttcctcctca

SEQ ID NO: 4128497 - DNA, 23 bp, Homo sapiens
caaacgccctttcctcctcaggc

SEQ ID NO: 4128498 - DNA, 23 bp, Homo sapiens
caaacgctaaagagcccttgcct

SEQ ID NO: 4128499 - DNA, 15 bp, Homo sapiens
caaacgtgtttttta

SEQ ID NO: 4128500 - DNA, 11 bp, Homo sapiens
caaactaaaaa

SEQ ID NO: 4128501 - DNA, 20 bp, Homo sapiens
caaactgcaatagagactgt

SEQ ID NO: 4128502 - DNA, 16 bp, Homo sapiens
caaactggagtctgga

SEQ ID NO: 4128503 - DNA, 16 bp, Homo sapiens
caaactggggcctcca

SEQ ID NO: 4128504 - DNA, 19 bp, Homo sapiens
caaactggggcctccagaa

SEQ ID NO: 4128505 - DNA, 14 bp, Homo sapiens
caaactgtaaataa

SEQ ID NO: 4128506 - DNA, 13 bp, Homo sapiens
caaactgtccctc

SEQ ID NO: 4128507 - DNA, 15 bp, Homo sapiens
caaactgtccctccc

SEQ ID NO: 4128508 - DNA, 16 bp, Homo sapiens
caaactgttaaatgtg

SEQ ID NO: 4128509 - DNA, 18 bp, Homo sapiens
caaacttactattttgac

SEQ ID NO: 4128510 - DNA, 18 bp, Homo sapiens
caaacttggatacttgga

SEQ ID NO: 4128511 - DNA, 17 bp, Homo sapiens
caaacttggatttttga

SEQ ID NO: 4128512 - DNA, 23 bp, Homo sapiens
caaacttgtggcctcaagcaatc

SEQ ID NO: 4128513 - DNA, 18 bp, Homo sapiens
caaacttttatactcttt

SEQ ID NO: 4128514 - DNA, 13 bp, Homo sapiens
caaacttttttat

SEQ ID NO: 4128515 - DNA, 20 bp, Homo sapiens
caaagaaatccggagaagct

SEQ ID NO: 4128516 - DNA, 20 bp, Homo sapiens
caaagaacttgatttgcatg

SEQ ID NO: 4128517 - DNA, 22 bp, Homo sapiens
caaagaaggcatttgcagggtc

SEQ ID NO: 4128518 - DNA, 13 bp, Homo sapiens
caaagaatagact

SEQ ID NO: 4128519 - DNA, 19 bp, Homo sapiens
caaagacaaaagtctgtct

SEQ ID NO: 4128520 - DNA, 16 bp, Homo sapiens
caaagacttagtatat

SEQ ID NO: 4128521 - DNA, 16 bp, Homo sapiens
caaagagagaaaataa

SEQ ID NO: 4128522 - DNA, 13 bp, Homo sapiens
caaagagcctgga

SEQ ID NO: 4128523 - DNA, 15 bp, Homo sapiens
caaagagcctggaga

SEQ ID NO: 4128524 - DNA, 16 bp, Homo sapiens
caaagagcctggagaa

SEQ ID NO: 4128525 - DNA, 17 bp, Homo sapiens
caaagagcctggagaag

SEQ ID NO: 4128526 - DNA, 20 bp, Homo sapiens
caaagaggctgaggctggca

SEQ ID NO: 4128527 - DNA, 23 bp, Homo sapiens
caaagaggctgcccctctcacca

SEQ ID NO: 4128528 - DNA, 18 bp, Homo sapiens
caaagagggcttcctcta

SEQ ID NO: 4128529 - DNA, 24 bp, Homo sapiens
caaagagttctggaaaagaactgt

SEQ ID NO: 4128530 - DNA, 18 bp, Homo sapiens
caaagatcaaaataaaaa

SEQ ID NO: 4128531 - DNA, 18 bp, Homo sapiens
caaagatgtttgtcagat

SEQ ID NO: 4128532 - DNA, 21 bp, Homo sapiens
caaagcaccagcttctccagg

SEQ ID NO: 4128533 - DNA, 15 bp, Homo sapiens
caaagcagacagctc

SEQ ID NO: 4128534 - DNA, 16 bp, Homo sapiens
caaagcagacagctcc

SEQ ID NO: 4128535 - DNA, 15 bp, Homo sapiens
caaagcagagagcat

SEQ ID NO: 4128536 - DNA, 21 bp, Homo sapiens
caaagcagtggagcccaggag

SEQ ID NO: 4128537 - DNA, 19 bp, Homo sapiens
caaagccacaaggctggcc

SEQ ID NO: 4128538 - DNA, 20 bp, Homo sapiens
caaagccacctctgtcattt

SEQ ID NO: 4128539 - DNA, 14 bp, Homo sapiens
caaagccagggtct

SEQ ID NO: 4128540 - DNA, 14 bp, Homo sapiens
caaagccagtgaaa

SEQ ID NO: 4128541 - DNA, 17 bp, Homo sapiens
caaagccagtgaaatgt

SEQ ID NO: 4128542 - DNA, 13 bp, Homo sapiens
caaagccttacac

SEQ ID NO: 4128543 - DNA, 14 bp, Homo sapiens
caaagccttacaca

SEQ ID NO: 4128544 - DNA, 21 bp, Homo sapiens
caaagcgggacgccgcaggtg

SEQ ID NO: 4128545 - DNA, 17 bp, Homo sapiens
caaagctgttcttcctg

SEQ ID NO: 4128546 - DNA, 18 bp, Homo sapiens
caaagcttctatcccagg

SEQ ID NO: 4128547 - DNA, 20 bp, Homo sapiens
caaagcttctatcccaggag

SEQ ID NO: 4128548 - DNA, 14 bp, Homo sapiens
caaagcttgaagat

SEQ ID NO: 4128549 - DNA, 16 bp, Homo sapiens
caaagcttgttaagat

SEQ ID NO: 4128550 - DNA, 18 bp, Homo sapiens
caaagctttcctgcccca

SEQ ID NO: 4128551 - DNA, 23 bp, Homo sapiens
caaagctttcctgccccaggcct

SEQ ID NO: 4128552 - DNA, 19 bp, Homo sapiens
caaaggaatctccagtttt

SEQ ID NO: 4128553 - DNA, 22 bp, Homo sapiens
caaaggaatctccagttttcag

SEQ ID NO: 4128554 - DNA, 13 bp, Homo sapiens
caaaggatgtgat

SEQ ID NO: 4128555 - DNA, 18 bp, Homo sapiens
caaaggcatcccagcctg

SEQ ID NO: 4128556 - DNA, 20 bp, Homo sapiens
caaaggcatcccagcctggg

SEQ ID NO: 4128557 - DNA, 22 bp, Homo sapiens
caaaggcatcccagcctggggg

SEQ ID NO: 4128558 - DNA, 15 bp, Homo sapiens
caaagggaaatatca

SEQ ID NO: 4128559 - DNA, 17 bp, Homo sapiens
caaagggaaatatcatt

SEQ ID NO: 4128560 - DNA, 18 bp, Homo sapiens
caaagggctgaaagccat

SEQ ID NO: 4128561 - DNA, 22 bp, Homo sapiens
caaagggggaggagaagaaaat

SEQ ID NO: 4128562 - DNA, 21 bp, Homo sapiens
caaagggtgaagctatttatc

SEQ ID NO: 4128563 - DNA, 13 bp, Homo sapiens
caaaggtggctct

SEQ ID NO: 4128564 - DNA, 14 bp, Homo sapiens
caaaggtggctctc

SEQ ID NO: 4128565 - DNA, 14 bp, Homo sapiens
caaagtagaagtct

SEQ ID NO: 4128566 - DNA, 22 bp, Homo sapiens
caaagtagaagtcttagatgta

SEQ ID NO: 4128567 - DNA, 21 bp, Homo sapiens
caaagtagttttattttaata

SEQ ID NO: 4128568 - DNA, 19 bp, Homo sapiens
caaagtcctttttttccat

SEQ ID NO: 4128569 - DNA, 18 bp, Homo sapiens
caaagtgactgtttggct

SEQ ID NO: 4128570 - DNA, 20 bp, Homo sapiens
caaagtgatagaaaagtgtg

SEQ ID NO: 4128571 - DNA, 22 bp, Homo sapiens
caaagtgctgagattgcagatg

SEQ ID NO: 4128572 - DNA, 21 bp, Homo sapiens
caaagttactaggtaacttca

SEQ ID NO: 4128573 - DNA, 14 bp, Homo sapiens
caaagttttatcaa

SEQ ID NO: 4128574 - DNA, 14 bp, Homo sapiens
caaagttttgaaaa

SEQ ID NO: 4128575 - DNA, 17 bp, Homo sapiens
caaagttttgaaaagct

SEQ ID NO: 4128576 - DNA, 19 bp, Homo sapiens
caaagttttgaaaagctat

SEQ ID NO: 4128577 - DNA, 18 bp, Homo sapiens
caaataaaaatattgtgt

SEQ ID NO: 4128578 - DNA, 16 bp, Homo sapiens
caaataagtatttata

SEQ ID NO: 4128579 - DNA, 14 bp, Homo sapiens
caaatacaaagtaa

SEQ ID NO: 4128580 - DNA, 24 bp, Homo sapiens
caaatacaaagtaaatacaagact

SEQ ID NO: 4128581 - DNA, 16 bp, Homo sapiens
caaatagaaaatggtc

SEQ ID NO: 4128582 - DNA, 17 bp, Homo sapiens
caaatatgctaatttgg

SEQ ID NO: 4128583 - DNA, 15 bp, Homo sapiens
caaatatgtcctggg

SEQ ID NO: 4128584 - DNA, 22 bp, Homo sapiens
caaatattgttgacaactgtga

SEQ ID NO: 4128585 - DNA, 15 bp, Homo sapiens
caaatcaatacacta

SEQ ID NO: 4128586 - DNA, 14 bp, Homo sapiens
caaatcacatctca

SEQ ID NO: 4128587 - DNA, 18 bp, Homo sapiens
caaatcacatctcacctc

SEQ ID NO: 4128588 - DNA, 20 bp, Homo sapiens
caaatccttccaaaaattat

SEQ ID NO: 4128589 - DNA, 21 bp, Homo sapiens
caaatcgtccagcgaccttcc

SEQ ID NO: 4128590 - DNA, 14 bp, Homo sapiens
caaatctacagatc

SEQ ID NO: 4128591 - DNA, 21 bp, Homo sapiens
caaatctacagatcctttttc

SEQ ID NO: 4128592 - DNA, 14 bp, Homo sapiens
caaatctataaaga

SEQ ID NO: 4128593 - DNA, 13 bp, Homo sapiens
caaatctattcag

SEQ ID NO: 4128594 - DNA, 22 bp, Homo sapiens
caaatctattcagacaagcaac

SEQ ID NO: 4128595 - DNA, 14 bp, Homo sapiens
caaatctgacatat

SEQ ID NO: 4128596 - DNA, 15 bp, Homo sapiens
caaatctgacatatt

SEQ ID NO: 4128597 - DNA, 21 bp, Homo sapiens
caaatctggctcctttacaaa

SEQ ID NO: 4128598 - DNA, 17 bp, Homo sapiens
caaatctgtataaatgt

SEQ ID NO: 4128599 - DNA, 22 bp, Homo sapiens
caaatcttggcaatattcctta

SEQ ID NO: 4128600 - DNA, 21 bp, Homo sapiens
caaatgaattttccacgcagt

SEQ ID NO: 4128601 - DNA, 14 bp, Homo sapiens
caaatgagtaacat

SEQ ID NO: 4128602 - DNA, 15 bp, Homo sapiens
caaatgcaatttgat

SEQ ID NO: 4128603 - DNA, 15 bp, Homo sapiens
caaatgcagggaggg

SEQ ID NO: 4128604 - DNA, 20 bp, Homo sapiens
caaatgcagggaggggaggc

SEQ ID NO: 4128605 - DNA, 22 bp, Homo sapiens
caaatgctctctcaaattgtca

SEQ ID NO: 4128606 - DNA, 15 bp, Homo sapiens
caaatgctggggcag

SEQ ID NO: 4128607 - DNA, 17 bp, Homo sapiens
caaatgctggggcaggg

SEQ ID NO: 4128608 - DNA, 19 bp, Homo sapiens
caaatggagctttctgtat

SEQ ID NO: 4128609 - DNA, 20 bp, Homo sapiens
caaatggagctttctgtata

SEQ ID NO: 4128610 - DNA, 14 bp, Homo sapiens
caaatggaggaata

SEQ ID NO: 4128611 - DNA, 19 bp, Homo sapiens
caaatggcgtctggaagtc

SEQ ID NO: 4128612 - DNA, 22 bp, Homo sapiens
caaatggcgtctggaagtccaa

SEQ ID NO: 4128613 - DNA, 20 bp, Homo sapiens
caaatgggagctgagcagcc

SEQ ID NO: 4128614 - DNA, 23 bp, Homo sapiens
caaatggggccagatccagcctg

SEQ ID NO: 4128615 - DNA, 15 bp, Homo sapiens
caaatggtaggcatt

SEQ ID NO: 4128616 - DNA, 18 bp, Homo sapiens
caaatgtaattgaataaa

SEQ ID NO: 4128617 - DNA, 24 bp, Homo sapiens
caaatgtcttttagaagatagatg

SEQ ID NO: 4128618 - DNA, 22 bp, Homo sapiens
caaattaagggttaagaaaaga

SEQ ID NO: 4128619 - DNA, 17 bp, Homo sapiens
caaattaataatcttat

SEQ ID NO: 4128620 - DNA, 13 bp, Homo sapiens
caaattataaaaa

SEQ ID NO: 4128621 - DNA, 19 bp, Homo sapiens
caaattataaaaagccact

SEQ ID NO: 4128622 - DNA, 12 bp, Homo sapiens
caaattcagttt

SEQ ID NO: 4128623 - DNA, 14 bp, Homo sapiens
caaattcagtttca

SEQ ID NO: 4128624 - DNA, 16 bp, Homo sapiens
caaattcagtttcata

SEQ ID NO: 4128625 - DNA, 17 bp, Homo sapiens
caaattcagtttcataa

SEQ ID NO: 4128626 - DNA, 18 bp, Homo sapiens
caaattcagtttcataaa

SEQ ID NO: 4128627 - DNA, 22 bp, Homo sapiens
caaattgggacaacagtgcttt

SEQ ID NO: 4128628 - DNA, 21 bp, Homo sapiens
caaattgtcacctgcttctct

SEQ ID NO: 4128629 - DNA, 14 bp, Homo sapiens
caaattgtcagcaa

SEQ ID NO: 4128630 - DNA, 19 bp, Homo sapiens
caaatttatcaaagcatag

SEQ ID NO: 4128631 - DNA, 11 bp, Homo sapiens
caaatttattt

SEQ ID NO: 4128632 - DNA, 16 bp, Homo sapiens
caaattttcagaaggt

SEQ ID NO: 4128633 - DNA, 13 bp, Homo sapiens
caaattttggcca

SEQ ID NO: 4128634 - DNA, 15 bp, Homo sapiens
caaattttggccaaa

SEQ ID NO: 4128635 - DNA, 18 bp, Homo sapiens
caacaagaagaaatatga

SEQ ID NO: 4128636 - DNA, 21 bp, Homo sapiens
caacaagcccgttagccccag

SEQ ID NO: 4128637 - DNA, 15 bp, Homo sapiens
caacaagggagagac

SEQ ID NO: 4128638 - DNA, 18 bp, Homo sapiens
caacaagggagagacctc

SEQ ID NO: 4128639 - DNA, 21 bp, Homo sapiens
caacaagggagagacctcatc

SEQ ID NO: 4128640 - DNA, 12 bp, Homo sapiens
caacaatccttt

SEQ ID NO: 4128641 - DNA, 16 bp, Homo sapiens
caacacagaggaattt

SEQ ID NO: 4128642 - DNA, 22 bp, Homo sapiens
caacaccaagcacagcagcctg

SEQ ID NO: 4128643 - DNA, 13 bp, Homo sapiens
caacaccacagac

SEQ ID NO: 4128644 - DNA, 14 bp, Homo sapiens
caacaccacagaca

SEQ ID NO: 4128645 - DNA, 15 bp, Homo sapiens
caacacgcacctgcc

SEQ ID NO: 4128646 - DNA, 17 bp, Homo sapiens
caacacgcacctgcctc

SEQ ID NO: 4128647 - DNA, 13 bp, Homo sapiens
caacagaacatat

SEQ ID NO: 4128648 - DNA, 22 bp, Homo sapiens
caacagaacatatgttgcaaga

SEQ ID NO: 4128649 - DNA, 15 bp, Homo sapiens
caacagaagcttcca

SEQ ID NO: 4128650 - DNA, 18 bp, Homo sapiens
caacagactgttgagtta

SEQ ID NO: 4128651 - DNA, 14 bp, Homo sapiens
caacagatactgga

SEQ ID NO: 4128652 - DNA, 17 bp, Homo sapiens
caacagatctggaacct

SEQ ID NO: 4128653 - DNA, 15 bp, Homo sapiens
caacagcaagaaata

SEQ ID NO: 4128654 - DNA, 14 bp, Homo sapiens
caacagctgaagca

SEQ ID NO: 4128655 - DNA, 23 bp, Homo sapiens
caacaggaatcaagagctgccct

SEQ ID NO: 4128656 - DNA, 21 bp, Homo sapiens
caacaggacagagttcacagg

SEQ ID NO: 4128657 - DNA, 13 bp, Homo sapiens
caacaggcccagg

SEQ ID NO: 4128658 - DNA, 15 bp, Homo sapiens
caacaggcccaggga

SEQ ID NO: 4128659 - DNA, 19 bp, Homo sapiens
caacaggcccagggaggga

SEQ ID NO: 4128660 - DNA, 22 bp, Homo sapiens
caacaggtggcaggaccaggac

SEQ ID NO: 4128661 - DNA, 13 bp, Homo sapiens
caacaggttttat

SEQ ID NO: 4128662 - DNA, 17 bp, Homo sapiens
caacataactcaagtct

SEQ ID NO: 4128663 - DNA, 18 bp, Homo sapiens
caacatcaatgttcattg

SEQ ID NO: 4128664 - DNA, 15 bp, Homo sapiens
caacatcctgccagc

SEQ ID NO: 4128665 - DNA, 16 bp, Homo sapiens
caacatcctgccagcc

SEQ ID NO: 4128666 - DNA, 23 bp, Homo sapiens
caacatgcctgccccaaacaaat

SEQ ID NO: 4128667 - DNA, 19 bp, Homo sapiens
caacatgctccaaatataa

SEQ ID NO: 4128668 - DNA, 18 bp, Homo sapiens
caacatggtgaaaccccg

SEQ ID NO: 4128669 - DNA, 17 bp, Homo sapiens
caacatgttactgacca

SEQ ID NO: 4128670 - DNA, 18 bp, Homo sapiens
caacatgttactgaccag

SEQ ID NO: 4128671 - DNA, 20 bp, Homo sapiens
caacatgttactgaccagca

SEQ ID NO: 4128672 - DNA, 22 bp, Homo sapiens
caacattttagctctattgata

SEQ ID NO: 4128673 - DNA, 18 bp, Homo sapiens
caaccaagtcatgtgcat

SEQ ID NO: 4128674 - DNA, 13 bp, Homo sapiens
caaccacagagaa

SEQ ID NO: 4128675 - DNA, 14 bp, Homo sapiens
caaccaccatggat

SEQ ID NO: 4128676 - DNA, 15 bp, Homo sapiens
caaccacgtggagaa

SEQ ID NO: 4128677 - DNA, 14 bp, Homo sapiens
caaccactgtaaaa

SEQ ID NO: 4128678 - DNA, 17 bp, Homo sapiens
caaccactgtaaaatga

SEQ ID NO: 4128679 - DNA, 19 bp, Homo sapiens
caaccactgtaaaatgaaa

SEQ ID NO: 4128680 - DNA, 21 bp, Homo sapiens
caaccactgtaaaatgaaatt

SEQ ID NO: 4128681 - DNA, 22 bp, Homo sapiens
caaccactgtggcgttctgctg

SEQ ID NO: 4128682 - DNA, 13 bp, Homo sapiens
caaccagagcccc

SEQ ID NO: 4128683 - DNA, 18 bp, Homo sapiens
caaccatgagaccactgt

SEQ ID NO: 4128684 - DNA, 14 bp, Homo sapiens
caaccattccccat

SEQ ID NO: 4128685 - DNA, 22 bp, Homo sapiens
caacccaaggactgagggactc

SEQ ID NO: 4128686 - DNA, 21 bp, Homo sapiens
caacccagccgtcgtctccct

SEQ ID NO: 4128687 - DNA, 20 bp, Homo sapiens
caacccagtcacactgtggc

SEQ ID NO: 4128688 - DNA, 18 bp, Homo sapiens
caaccccaaacccaagtg

SEQ ID NO: 4128689 - DNA, 13 bp, Homo sapiens
caacccccacccc

SEQ ID NO: 4128690 - DNA, 15 bp, Homo sapiens
caacccccagctccc

SEQ ID NO: 4128691 - DNA, 16 bp, Homo sapiens
caacccccagctcccg

SEQ ID NO: 4128692 - DNA, 20 bp, Homo sapiens
caacccccgccacctcaggg

SEQ ID NO: 4128693 - DNA, 23 bp, Homo sapiens
caacccccgccacctcagggcac

SEQ ID NO: 4128694 - DNA, 18 bp, Homo sapiens
caaccctaggttccctgt

SEQ ID NO: 4128695 - DNA, 13 bp, Homo sapiens
caaccctcagagc

SEQ ID NO: 4128696 - DNA, 18 bp, Homo sapiens
caaccctcaggggaaaac

SEQ ID NO: 4128697 - DNA, 23 bp, Homo sapiens
caaccctggggaaggagccagtt

SEQ ID NO: 4128698 - DNA, 17 bp, Homo sapiens
caacccttccctcacct

SEQ ID NO: 4128699 - DNA, 18 bp, Homo sapiens
caaccgacaggccctggc

SEQ ID NO: 4128700 - DNA, 18 bp, Homo sapiens
caaccgttggaaacataa

SEQ ID NO: 4128701 - DNA, 14 bp, Homo sapiens
caacctagaatgtc

SEQ ID NO: 4128702 - DNA, 15 bp, Homo sapiens
caacctcagggctcc

SEQ ID NO: 4128703 - DNA, 21 bp, Homo sapiens
caacctcggcttgtgggctgg

SEQ ID NO: 4128704 - DNA, 22 bp, Homo sapiens
caacctcggcttgtgggctggt

SEQ ID NO: 4128705 - DNA, 24 bp, Homo sapiens
caacctcggcttgtgggctggtgc

SEQ ID NO: 4128706 - DNA, 13 bp, Homo sapiens
caacctctcactc

SEQ ID NO: 4128707 - DNA, 23 bp, Homo sapiens
caacctctctgatcttgtgctca

SEQ ID NO: 4128708 - DNA, 20 bp, Homo sapiens
caacctctttttcctcctgg

SEQ ID NO: 4128709 - DNA, 15 bp, Homo sapiens
caacctgaaatttat

SEQ ID NO: 4128710 - DNA, 12 bp, Homo sapiens
caacctgctctg

SEQ ID NO: 4128711 - DNA, 14 bp, Homo sapiens
caacctgctctgtc

SEQ ID NO: 4128712 - DNA, 15 bp, Homo sapiens
caacctggtggcacc

SEQ ID NO: 4128713 - DNA, 17 bp, Homo sapiens
caacctggtggcaccag

SEQ ID NO: 4128714 - DNA, 13 bp, Homo sapiens
caacctttaaaat

SEQ ID NO: 4128715 - DNA, 19 bp, Homo sapiens
caacctttaaaattgtcac

SEQ ID NO: 4128716 - DNA, 13 bp, Homo sapiens
caacgaagaaaaa

SEQ ID NO: 4128717 - DNA, 19 bp, Homo sapiens
caacgaccagggccgagga

SEQ ID NO: 4128718 - DNA, 14 bp, Homo sapiens
caacgcccctccaa

SEQ ID NO: 4128719 - DNA, 21 bp, Homo sapiens
caacgcccctccaaacctcca

SEQ ID NO: 4128720 - DNA, 18 bp, Homo sapiens
caacggccctgcagccag

SEQ ID NO: 4128721 - DNA, 23 bp, Homo sapiens
caacgtggctttttttttttccc

SEQ ID NO: 4128722 - DNA, 23 bp, Homo sapiens
caacgtttacaccgactagccag

SEQ ID NO: 4128723 - DNA, 13 bp, Homo sapiens
caactaaaattag

SEQ ID NO: 4128724 - DNA, 17 bp, Homo sapiens
caactaggcttcagcat

SEQ ID NO: 4128725 - DNA, 17 bp, Homo sapiens
caactatggatcagaat

SEQ ID NO: 4128726 - DNA, 20 bp, Homo sapiens
caactatttttccaaaataa

SEQ ID NO: 4128727 - DNA, 22 bp, Homo sapiens
caactcacacattcccccacca

SEQ ID NO: 4128728 - DNA, 15 bp, Homo sapiens
caactccaggaaaga

SEQ ID NO: 4128729 - DNA, 18 bp, Homo sapiens
caactctcccctgacctg

SEQ ID NO: 4128730 - DNA, 22 bp, Homo sapiens
caactgaaaagactcagtgttc

SEQ ID NO: 4128731 - DNA, 15 bp, Homo sapiens
caactgcacatgaaa

SEQ ID NO: 4128732 - DNA, 23 bp, Homo sapiens
caactgcctcgaaacacagaaac

SEQ ID NO: 4128733 - DNA, 23 bp, Homo sapiens
caactggagttccttatccctct

SEQ ID NO: 4128734 - DNA, 13 bp, Homo sapiens
caactgggcccaa

SEQ ID NO: 4128735 - DNA, 21 bp, Homo sapiens
caactggttgtatatttttat

SEQ ID NO: 4128736 - DNA, 18 bp, Homo sapiens
caactgtcttatttaatg

SEQ ID NO: 4128737 - DNA, 19 bp, Homo sapiens
caactgttgattgcaggaa

SEQ ID NO: 4128738 - DNA, 17 bp, Homo sapiens
caacttagagattgcat

SEQ ID NO: 4128739 - DNA, 15 bp, Homo sapiens
caacttatttaaaaa

SEQ ID NO: 4128740 - DNA, 14 bp, Homo sapiens
caacttcagtccaa

SEQ ID NO: 4128741 - DNA, 15 bp, Homo sapiens
caacttcagttttat

SEQ ID NO: 4128742 - DNA, 20 bp, Homo sapiens
caacttcagttttatttttg

SEQ ID NO: 4128743 - DNA, 15 bp, Homo sapiens
caacttccgctgagg

SEQ ID NO: 4128744 - DNA, 22 bp, Homo sapiens
caacttcctcccttacagagca

SEQ ID NO: 4128745 - DNA, 19 bp, Homo sapiens
caacttctcttgctttcta

SEQ ID NO: 4128746 - DNA, 14 bp, Homo sapiens
caacttctggctcc

SEQ ID NO: 4128747 - DNA, 23 bp, Homo sapiens
caacttgaaattatatctgtggt

SEQ ID NO: 4128748 - DNA, 16 bp, Homo sapiens
caacttgagggcccag

SEQ ID NO: 4128749 - DNA, 20 bp, Homo sapiens
caacttgagggcccagagca

SEQ ID NO: 4128750 - DNA, 21 bp, Homo sapiens
caacttgagggcccagagcag

SEQ ID NO: 4128751 - DNA, 23 bp, Homo sapiens
caacttgtattaaagacagaggc

SEQ ID NO: 4128752 - DNA, 22 bp, Homo sapiens
caacttgtctttttctggactg

SEQ ID NO: 4128753 - DNA, 13 bp, Homo sapiens
caacttttaaagc

SEQ ID NO: 4128754 - DNA, 18 bp, Homo sapiens
caagaaaacaacttcaat

SEQ ID NO: 4128755 - DNA, 15 bp, Homo sapiens
caagaaaaggacaaa

SEQ ID NO: 4128756 - DNA, 13 bp, Homo sapiens
caagaaacagcca

SEQ ID NO: 4128757 - DNA, 14 bp, Homo sapiens
caagaaacagccag

SEQ ID NO: 4128758 - DNA, 12 bp, Homo sapiens
caagaaagtcca

SEQ ID NO: 4128759 - DNA, 19 bp, Homo sapiens
caagaaataaaaggaagcc

SEQ ID NO: 4128760 - DNA, 21 bp, Homo sapiens
caagaaataaaaggaagccaa

SEQ ID NO: 4128761 - DNA, 20 bp, Homo sapiens
caagaacacagccctgcttc

SEQ ID NO: 4128762 - DNA, 15 bp, Homo sapiens
caagaacctggaaaa

SEQ ID NO: 4128763 - DNA, 14 bp, Homo sapiens
caagaagtttattc

SEQ ID NO: 4128764 - DNA, 17 bp, Homo sapiens
caagaagtttattctca

SEQ ID NO: 4128765 - DNA, 18 bp, Homo sapiens
caagaataaaggcagctg

SEQ ID NO: 4128766 - DNA, 22 bp, Homo sapiens
caagaataaaggcagctgttgt

SEQ ID NO: 4128767 - DNA, 14 bp, Homo sapiens
caagaatggatcac

SEQ ID NO: 4128768 - DNA, 22 bp, Homo sapiens
caagaatttcttggtaagaagc

SEQ ID NO: 4128769 - DNA, 15 bp, Homo sapiens
caagacacatcccta

SEQ ID NO: 4128770 - DNA, 17 bp, Homo sapiens
caagacagaaaagtgcc

SEQ ID NO: 4128771 - DNA, 22 bp, Homo sapiens
caagacagaaaagtgcctgagc

SEQ ID NO: 4128772 - DNA, 12 bp, Homo sapiens
caagacagagac

SEQ ID NO: 4128773 - DNA, 13 bp, Homo sapiens
caagacagatgcc

SEQ ID NO: 4128774 - DNA, 13 bp, Homo sapiens
caagacattgtca

SEQ ID NO: 4128775 - DNA, 15 bp, Homo sapiens
caagacccccagcac

SEQ ID NO: 4128776 - DNA, 21 bp, Homo sapiens
caagacccccatttgtcccag

SEQ ID NO: 4128777 - DNA, 16 bp, Homo sapiens
caagaccctcccatgg

SEQ ID NO: 4128778 - DNA, 14 bp, Homo sapiens
caagactgttgctc

SEQ ID NO: 4128779 - DNA, 18 bp, Homo sapiens
caagactgttgctcaaat

SEQ ID NO: 4128780 - DNA, 22 bp, Homo sapiens
caagactgttgtgatcttgcat

SEQ ID NO: 4128781 - DNA, 21 bp, Homo sapiens
caagagagcagcaaggtcttg

SEQ ID NO: 4128782 - DNA, 13 bp, Homo sapiens
caagagaggatga

SEQ ID NO: 4128783 - DNA, 16 bp, Homo sapiens
caagagatgggaatga

SEQ ID NO: 4128784 - DNA, 20 bp, Homo sapiens
caagagcagagtctgggcct

SEQ ID NO: 4128785 - DNA, 22 bp, Homo sapiens
caagagcagagtctgggcctct

SEQ ID NO: 4128786 - DNA, 16 bp, Homo sapiens
caagagcagcctgtgg

SEQ ID NO: 4128787 - DNA, 14 bp, Homo sapiens
caagagggggtgga

SEQ ID NO: 4128788 - DNA, 18 bp, Homo sapiens
caagagggggtggagggg

SEQ ID NO: 4128789 - DNA, 21 bp, Homo sapiens
caagagggggtggaggggtgt

SEQ ID NO: 4128790 - DNA, 21 bp, Homo sapiens
caagaggtacagggtttttac

SEQ ID NO: 4128791 - DNA, 22 bp, Homo sapiens
caagagtttgttctgttctggg

SEQ ID NO: 4128792 - DNA, 16 bp, Homo sapiens
caagataactgagaat

SEQ ID NO: 4128793 - DNA, 16 bp, Homo sapiens
caagatattgtacata

SEQ ID NO: 4128794 - DNA, 19 bp, Homo sapiens
caagatattgtacataaaa

SEQ ID NO: 4128795 - DNA, 21 bp, Homo sapiens
caagatattgtacataaaaga

SEQ ID NO: 4128796 - DNA, 15 bp, Homo sapiens
caagatccatttgcc

SEQ ID NO: 4128797 - DNA, 19 bp, Homo sapiens
caagatcctgtctttaagg

SEQ ID NO: 4128798 - DNA, 14 bp, Homo sapiens
caagatgaaataat

SEQ ID NO: 4128799 - DNA, 17 bp, Homo sapiens
caagatggacttacctg

SEQ ID NO: 4128800 - DNA, 19 bp, Homo sapiens
caagatgggggcagggctg

SEQ ID NO: 4128801 - DNA, 20 bp, Homo sapiens
caagatggtccatttgttcc

SEQ ID NO: 4128802 - DNA, 22 bp, Homo sapiens
caagatggtccatttgttcctg

SEQ ID NO: 4128803 - DNA, 13 bp, Homo sapiens
caagatgtgaatt

SEQ ID NO: 4128804 - DNA, 14 bp, Homo sapiens
caagatgtgaatta

SEQ ID NO: 4128805 - DNA, 18 bp, Homo sapiens
caagatgtgaattattga

SEQ ID NO: 4128806 - DNA, 14 bp, Homo sapiens
caagattaaatgta

SEQ ID NO: 4128807 - DNA, 12 bp, Homo sapiens
caagattgaaaa

SEQ ID NO: 4128808 - DNA, 12 bp, Homo sapiens
caagattttagg

SEQ ID NO: 4128809 - DNA, 14 bp, Homo sapiens
caagattttagggc

SEQ ID NO: 4128810 - DNA, 19 bp, Homo sapiens
caagattttcctcttgtga

SEQ ID NO: 4128811 - DNA, 22 bp, Homo sapiens
caagattttgaatgcttcctga

SEQ ID NO: 4128812 - DNA, 16 bp, Homo sapiens
caagatttttttcctg

SEQ ID NO: 4128813 - DNA, 19 bp, Homo sapiens
caagcaatccacctgcctt

SEQ ID NO: 4128814 - DNA, 15 bp, Homo sapiens
caagcaatcctcctg

SEQ ID NO: 4128815 - DNA, 22 bp, Homo sapiens
caagcaatcctcctgcctcagc

SEQ ID NO: 4128816 - DNA, 14 bp, Homo sapiens
caagcacagcagcc

SEQ ID NO: 4128817 - DNA, 20 bp, Homo sapiens
caagcacatctgcattttca

SEQ ID NO: 4128818 - DNA, 12 bp, Homo sapiens
caagcactgata

SEQ ID NO: 4128819 - DNA, 15 bp, Homo sapiens
caagcactgatatct

SEQ ID NO: 4128820 - DNA, 17 bp, Homo sapiens
caagcagaggtggccag

SEQ ID NO: 4128821 - DNA, 18 bp, Homo sapiens
caagcagaggtggccaga

SEQ ID NO: 4128822 - DNA, 20 bp, Homo sapiens
caagcagaggtggccagagc

SEQ ID NO: 4128823 - DNA, 20 bp, Homo sapiens
caagcagagtgcacagctgt

SEQ ID NO: 4128824 - DNA, 23 bp, Homo sapiens
caagcagctgaagaaaaaatcag

SEQ ID NO: 4128825 - DNA, 17 bp, Homo sapiens
caagcaggacctggcat

SEQ ID NO: 4128826 - DNA, 18 bp, Homo sapiens
caagcaggacctggcatc

SEQ ID NO: 4128827 - DNA, 13 bp, Homo sapiens
caagcaggagacg

SEQ ID NO: 4128828 - DNA, 14 bp, Homo sapiens
caagcaggagacga

SEQ ID NO: 4128829 - DNA, 19 bp, Homo sapiens
caagcaggagacgacaggc

SEQ ID NO: 4128830 - DNA, 20 bp, Homo sapiens
caagccaaaagtccctccct

SEQ ID NO: 4128831 - DNA, 18 bp, Homo sapiens
caagccaacttgtaaata

SEQ ID NO: 4128832 - DNA, 13 bp, Homo sapiens
caagccagaccta

SEQ ID NO: 4128833 - DNA, 19 bp, Homo sapiens
caagccatgtataaatgtg

SEQ ID NO: 4128834 - DNA, 14 bp, Homo sapiens
caagcccaggaggg

SEQ ID NO: 4128835 - DNA, 21 bp, Homo sapiens
caagcccaggtgccagcctga

SEQ ID NO: 4128836 - DNA, 17 bp, Homo sapiens
caagccccatttcctca

SEQ ID NO: 4128837 - DNA, 16 bp, Homo sapiens
caagccttaaactgta

SEQ ID NO: 4128838 - DNA, 15 bp, Homo sapiens
caagctagtgtttct

SEQ ID NO: 4128839 - DNA, 20 bp, Homo sapiens
caagctctgcctcccgggtt

SEQ ID NO: 4128840 - DNA, 22 bp, Homo sapiens
caagctgagtttcctatgggaa

SEQ ID NO: 4128841 - DNA, 15 bp, Homo sapiens
caagctgctctgagc

SEQ ID NO: 4128842 - DNA, 16 bp, Homo sapiens
caagctgctctgagcc

SEQ ID NO: 4128843 - DNA, 23 bp, Homo sapiens
caagctggaagaagtgagcagtg

SEQ ID NO: 4128844 - DNA, 12 bp, Homo sapiens
caagctggaagc

SEQ ID NO: 4128845 - DNA, 22 bp, Homo sapiens
caagctgttatttcttccctgc

SEQ ID NO: 4128846 - DNA, 22 bp, Homo sapiens
caagcttaatagccctccccct

SEQ ID NO: 4128847 - DNA, 12 bp, Homo sapiens
caagcttccctc

SEQ ID NO: 4128848 - DNA, 19 bp, Homo sapiens
caagcttccctccatcccc

SEQ ID NO: 4128849 - DNA, 13 bp, Homo sapiens
caagcttcttgct

SEQ ID NO: 4128850 - DNA, 14 bp, Homo sapiens
caagcttcttgctg

SEQ ID NO: 4128851 - DNA, 20 bp, Homo sapiens
caagcttgttatcagctttc

SEQ ID NO: 4128852 - DNA, 12 bp, Homo sapiens
caagctttcttc

SEQ ID NO: 4128853 - DNA, 19 bp, Homo sapiens
caagctttcttctacaacc

SEQ ID NO: 4128854 - DNA, 22 bp, Homo sapiens
caagctttcttctacaaccaga

SEQ ID NO: 4128855 - DNA, 14 bp, Homo sapiens
caagcttttgctca

SEQ ID NO: 4128856 - DNA, 15 bp, Homo sapiens
caagcttttgcttga

SEQ ID NO: 4128857 - DNA, 20 bp, Homo sapiens
caaggaaagccccagcacta

SEQ ID NO: 4128858 - DNA, 18 bp, Homo sapiens
caaggaagcagcctcaga

SEQ ID NO: 4128859 - DNA, 19 bp, Homo sapiens
caaggaagcagcctcagag

SEQ ID NO: 4128860 - DNA, 12 bp, Homo sapiens
caaggaaggaaa

SEQ ID NO: 4128861 - DNA, 20 bp, Homo sapiens
caaggaataaatgagaggga

SEQ ID NO: 4128862 - DNA, 17 bp, Homo sapiens
caaggaatgcctgtgcc

SEQ ID NO: 4128863 - DNA, 18 bp, Homo sapiens
caaggacagaaggctcct

SEQ ID NO: 4128864 - DNA, 19 bp, Homo sapiens
caaggacattgccccaaga

SEQ ID NO: 4128865 - DNA, 16 bp, Homo sapiens
caaggaccaggactcc

SEQ ID NO: 4128866 - DNA, 21 bp, Homo sapiens
caaggaccaggactccctcct

SEQ ID NO: 4128867 - DNA, 15 bp, Homo sapiens
caaggacgcttcaca

SEQ ID NO: 4128868 - DNA, 21 bp, Homo sapiens
caaggacgcttcacaggacag

SEQ ID NO: 4128869 - DNA, 14 bp, Homo sapiens
caaggactcccgga

SEQ ID NO: 4128870 - DNA, 19 bp, Homo sapiens
caaggactcccggagcctg

SEQ ID NO: 4128871 - DNA, 14 bp, Homo sapiens
caaggacttcctgt

SEQ ID NO: 4128872 - DNA, 15 bp, Homo sapiens
caaggactttgcagc

SEQ ID NO: 4128873 - DNA, 16 bp, Homo sapiens
caaggactttgcagcc

SEQ ID NO: 4128874 - DNA, 16 bp, Homo sapiens
caaggagcacaagcca

SEQ ID NO: 4128875 - DNA, 17 bp, Homo sapiens
caaggaggtagagaggg

SEQ ID NO: 4128876 - DNA, 19 bp, Homo sapiens
caaggagttccatgaagac

SEQ ID NO: 4128877 - DNA, 15 bp, Homo sapiens
caaggatagatgctg

SEQ ID NO: 4128878 - DNA, 17 bp, Homo sapiens
caaggatagatgctggc

SEQ ID NO: 4128879 - DNA, 14 bp, Homo sapiens
caaggatcctctcc

SEQ ID NO: 4128880 - DNA, 16 bp, Homo sapiens
caaggatcctctccac

SEQ ID NO: 4128881 - DNA, 14 bp, Homo sapiens
caaggccctgctgc

SEQ ID NO: 4128882 - DNA, 20 bp, Homo sapiens
caaggccgagcgttcccagc

SEQ ID NO: 4128883 - DNA, 22 bp, Homo sapiens
caaggcctccctcaggctctgt

SEQ ID NO: 4128884 - DNA, 14 bp, Homo sapiens
caaggccttctcct

SEQ ID NO: 4128885 - DNA, 15 bp, Homo sapiens
caaggcggcccctcc

SEQ ID NO: 4128886 - DNA, 19 bp, Homo sapiens
caaggcgggagcatctctt

SEQ ID NO: 4128887 - DNA, 14 bp, Homo sapiens
caaggctatgtgat

SEQ ID NO: 4128888 - DNA, 18 bp, Homo sapiens
caaggctgcggtttgttg

SEQ ID NO: 4128889 - DNA, 14 bp, Homo sapiens
caaggctggccagc

SEQ ID NO: 4128890 - DNA, 21 bp, Homo sapiens
caaggctggccagcaaggcag

SEQ ID NO: 4128891 - DNA, 22 bp, Homo sapiens
caaggctggccagcaaggcagg

SEQ ID NO: 4128892 - DNA, 15 bp, Homo sapiens
caaggctgtgcatct

SEQ ID NO: 4128893 - DNA, 16 bp, Homo sapiens
caaggcttgctgcaga

SEQ ID NO: 4128894 - DNA, 21 bp, Homo sapiens
caagggaaaataaaaaaagaa

SEQ ID NO: 4128895 - DNA, 16 bp, Homo sapiens
caagggaaaggggtgc

SEQ ID NO: 4128896 - DNA, 20 bp, Homo sapiens
caagggaaaggggtgctttt

SEQ ID NO: 4128897 - DNA, 19 bp, Homo sapiens
caagggagaaaagagaaac

SEQ ID NO: 4128898 - DNA, 15 bp, Homo sapiens
caagggagagacctc

SEQ ID NO: 4128899 - DNA, 17 bp, Homo sapiens
caagggagagacctcat

SEQ ID NO: 4128900 - DNA, 19 bp, Homo sapiens
caagggcaaaaagtctaca

SEQ ID NO: 4128901 - DNA, 14 bp, Homo sapiens
caagggccatgctg

SEQ ID NO: 4128902 - DNA, 23 bp, Homo sapiens
caagggcttgatggtgacagctg

SEQ ID NO: 4128903 - DNA, 13 bp, Homo sapiens
caagggctttcct

SEQ ID NO: 4128904 - DNA, 22 bp, Homo sapiens
caaggggaatctggaggtagcc

SEQ ID NO: 4128905 - DNA, 17 bp, Homo sapiens
caaggggcccaaattct

SEQ ID NO: 4128906 - DNA, 20 bp, Homo sapiens
caaggggcgtgcctggcgcc

SEQ ID NO: 4128907 - DNA, 20 bp, Homo sapiens
caaggtccactccctgctcc

SEQ ID NO: 4128908 - DNA, 22 bp, Homo sapiens
caaggtccactccctgctccac

SEQ ID NO: 4128909 - DNA, 14 bp, Homo sapiens
caaggtcccctcca

SEQ ID NO: 4128910 - DNA, 15 bp, Homo sapiens
caaggtcctctcagt

SEQ ID NO: 4128911 - DNA, 21 bp, Homo sapiens
caaggtcctctgtcagtcaca

SEQ ID NO: 4128912 - DNA, 15 bp, Homo sapiens
caaggtcttgctctc

SEQ ID NO: 4128913 - DNA, 15 bp, Homo sapiens
caaggtgcaaatcaa

SEQ ID NO: 4128914 - DNA, 14 bp, Homo sapiens
caaggtgcaggcag

SEQ ID NO: 4128915 - DNA, 14 bp, Homo sapiens
caaggtggcagatg

SEQ ID NO: 4128916 - DNA, 15 bp, Homo sapiens
caaggtggcagatgt

SEQ ID NO: 4128917 - DNA, 23 bp, Homo sapiens
caaggtggcagatgtcttccctg

SEQ ID NO: 4128918 - DNA, 19 bp, Homo sapiens
caaggtggggattgcccct

SEQ ID NO: 4128919 - DNA, 21 bp, Homo sapiens
caaggttataattttttttaa

SEQ ID NO: 4128920 - DNA, 22 bp, Homo sapiens
caaggttataattttttttaaa

SEQ ID NO: 4128921 - DNA, 16 bp, Homo sapiens
caaggttggttgctaa

SEQ ID NO: 4128922 - DNA, 13 bp, Homo sapiens
caagtaagaagac

SEQ ID NO: 4128923 - DNA, 21 bp, Homo sapiens
caagtaagagtactgggagaa

SEQ ID NO: 4128924 - DNA, 17 bp, Homo sapiens
caagtagctttccacat

SEQ ID NO: 4128925 - DNA, 20 bp, Homo sapiens
caagtataattttttgtaat

SEQ ID NO: 4128926 - DNA, 19 bp, Homo sapiens
caagtatatgtgaaaaaaa

SEQ ID NO: 4128927 - DNA, 22 bp, Homo sapiens
caagtatatgtgaaaaaaatga

SEQ ID NO: 4128928 - DNA, 15 bp, Homo sapiens
caagtatcttctatt

SEQ ID NO: 4128929 - DNA, 19 bp, Homo sapiens
caagtatgaataaagacac

SEQ ID NO: 4128930 - DNA, 16 bp, Homo sapiens
caagtcagctccagct

SEQ ID NO: 4128931 - DNA, 18 bp, Homo sapiens
caagtcatagccataaat

SEQ ID NO: 4128932 - DNA, 12 bp, Homo sapiens
caagtcatttta

SEQ ID NO: 4128933 - DNA, 17 bp, Homo sapiens
caagtcattttaacttt

SEQ ID NO: 4128934 - DNA, 15 bp, Homo sapiens
caagtcctccctctc

SEQ ID NO: 4128935 - DNA, 24 bp, Homo sapiens
caagtcctccctctctactggagt

SEQ ID NO: 4128936 - DNA, 19 bp, Homo sapiens
caagtcctggatgttgtgt

SEQ ID NO: 4128937 - DNA, 15 bp, Homo sapiens
caagtcctggctaca

SEQ ID NO: 4128938 - DNA, 22 bp, Homo sapiens
caagtcctggctacatcccagc

SEQ ID NO: 4128939 - DNA, 23 bp, Homo sapiens
caagtccttacctcttccggaga

SEQ ID NO: 4128940 - DNA, 16 bp, Homo sapiens
caagtctcagtggctt

SEQ ID NO: 4128941 - DNA, 22 bp, Homo sapiens
caagtctctctgtgaatacaat

SEQ ID NO: 4128942 - DNA, 20 bp, Homo sapiens
caagtgaaataacaaaatgg

SEQ ID NO: 4128943 - DNA, 14 bp, Homo sapiens
caagtgcacggggc

SEQ ID NO: 4128944 - DNA, 16 bp, Homo sapiens
caagtgcctgctttta

SEQ ID NO: 4128945 - DNA, 18 bp, Homo sapiens
caagtgctgaacagtgga

SEQ ID NO: 4128946 - DNA, 19 bp, Homo sapiens
caagtggaccttgagacca

SEQ ID NO: 4128947 - DNA, 15 bp, Homo sapiens
caagtggatgggaat

SEQ ID NO: 4128948 - DNA, 20 bp, Homo sapiens
caagtggcaaagctgttctt

SEQ ID NO: 4128949 - DNA, 23 bp, Homo sapiens
caagtggcaaagctgttcttcct

SEQ ID NO: 4128950 - DNA, 17 bp, Homo sapiens
caagtggcatgtgctgt

SEQ ID NO: 4128951 - DNA, 19 bp, Homo sapiens
caagtggcatgtgctgtga

SEQ ID NO: 4128952 - DNA, 17 bp, Homo sapiens
caagtgggatctgtcac

SEQ ID NO: 4128953 - DNA, 15 bp, Homo sapiens
caagtggggtgctgg

SEQ ID NO: 4128954 - DNA, 17 bp, Homo sapiens
caagtggggtgctggga

SEQ ID NO: 4128955 - DNA, 14 bp, Homo sapiens
caagtggtcaggag

SEQ ID NO: 4128956 - DNA, 18 bp, Homo sapiens
caagtgtccccagaccct

SEQ ID NO: 4128957 - DNA, 18 bp, Homo sapiens
caagtgtgaccccactgc

SEQ ID NO: 4128958 - DNA, 21 bp, Homo sapiens
caagtgtgggccactgtggtg

SEQ ID NO: 4128959 - DNA, 18 bp, Homo sapiens
caagtgtggggggtcctt

SEQ ID NO: 4128960 - DNA, 16 bp, Homo sapiens
caagttaacaaggaat

SEQ ID NO: 4128961 - DNA, 13 bp, Homo sapiens
caagttaagagaa

SEQ ID NO: 4128962 - DNA, 20 bp, Homo sapiens
caagttatattagtgaagat

SEQ ID NO: 4128963 - DNA, 23 bp, Homo sapiens
caagttcacacctgcagattcta

SEQ ID NO: 4128964 - DNA, 18 bp, Homo sapiens
caagttcttcacctctat

SEQ ID NO: 4128965 - DNA, 19 bp, Homo sapiens
caagttcttcacctctatc

SEQ ID NO: 4128966 - DNA, 19 bp, Homo sapiens
caagttgaagactttgttt

SEQ ID NO: 4128967 - DNA, 13 bp, Homo sapiens
caagttgagattt

SEQ ID NO: 4128968 - DNA, 15 bp, Homo sapiens
caagttgagattttt

SEQ ID NO: 4128969 - DNA, 20 bp, Homo sapiens
caagttgcgacggagagaaa

SEQ ID NO: 4128970 - DNA, 23 bp, Homo sapiens
caagttgcgacggagagaaaaaa

SEQ ID NO: 4128971 - DNA, 14 bp, Homo sapiens
caagttggactggg

SEQ ID NO: 4128972 - DNA, 20 bp, Homo sapiens
caagttgtaaaaatgaaagt

SEQ ID NO: 4128973 - DNA, 15 bp, Homo sapiens
caagttgtaaataat

SEQ ID NO: 4128974 - DNA, 17 bp, Homo sapiens
caagttgttattgttga

SEQ ID NO: 4128975 - DNA, 17 bp, Homo sapiens
caagtttattcagtaaa

SEQ ID NO: 4128976 - DNA, 15 bp, Homo sapiens
caagtttcagacagg

SEQ ID NO: 4128977 - DNA, 21 bp, Homo sapiens
caagttttcttccatgatttt

SEQ ID NO: 4128978 - DNA, 20 bp, Homo sapiens
caataaaaacattttgaagt

SEQ ID NO: 4128979 - DNA, 14 bp, Homo sapiens
caataaaaatcata

SEQ ID NO: 4128980 - DNA, 15 bp, Homo sapiens
caataaaacattaat

SEQ ID NO: 4128981 - DNA, 13 bp, Homo sapiens
caataaaagtgac

SEQ ID NO: 4128982 - DNA, 20 bp, Homo sapiens
caataaaagttttctccaac

SEQ ID NO: 4128983 - DNA, 19 bp, Homo sapiens
caataaacatttcatttcc

SEQ ID NO: 4128984 - DNA, 13 bp, Homo sapiens
caataaaccaggt

SEQ ID NO: 4128985 - DNA, 23 bp, Homo sapiens
caataaaccaggtttagacagta

SEQ ID NO: 4128986 - DNA, 18 bp, Homo sapiens
caataaacgcattatcag

SEQ ID NO: 4128987 - DNA, 15 bp, Homo sapiens
caataaagcatttat

SEQ ID NO: 4128988 - DNA, 19 bp, Homo sapiens
caataaagcatttataaat

SEQ ID NO: 4128989 - DNA, 20 bp, Homo sapiens
caataaatctgacccagtgc

SEQ ID NO: 4128990 - DNA, 16 bp, Homo sapiens
caataactactgtgtt

SEQ ID NO: 4128991 - DNA, 17 bp, Homo sapiens
caataactactgtgttc

SEQ ID NO: 4128992 - DNA, 18 bp, Homo sapiens
caataacttctatatttt

SEQ ID NO: 4128993 - DNA, 16 bp, Homo sapiens
caataacttctgacct

SEQ ID NO: 4128994 - DNA, 13 bp, Homo sapiens
caataagaaatga

SEQ ID NO: 4128995 - DNA, 15 bp, Homo sapiens
caataagaaatgaac

SEQ ID NO: 4128996 - DNA, 21 bp, Homo sapiens
caataagaaatgaacaaaaga

SEQ ID NO: 4128997 - DNA, 20 bp, Homo sapiens
caataagaatttagggagaa

SEQ ID NO: 4128998 - DNA, 19 bp, Homo sapiens
caataataaatatttttgc

SEQ ID NO: 4128999 - DNA, 14 bp, Homo sapiens
caatacaaatggat

SEQ ID NO: 4129000 - DNA, 23 bp, Homo sapiens
caatagaaactcaccatgtaaaa

SEQ ID NO: 4129001 - DNA, 12 bp, Homo sapiens
caatagagactg

SEQ ID NO: 4129002 - DNA, 22 bp, Homo sapiens
caatagagactgtagattgctt

SEQ ID NO: 4129003 - DNA, 15 bp, Homo sapiens
caatagatctccagc

SEQ ID NO: 4129004 - DNA, 19 bp, Homo sapiens
caatagctaagcatctcct

SEQ ID NO: 4129005 - DNA, 15 bp, Homo sapiens
caatagtgtgttctg

SEQ ID NO: 4129006 - DNA, 17 bp, Homo sapiens
caatagtgtgttctgat

SEQ ID NO: 4129007 - DNA, 21 bp, Homo sapiens
caatataatctttgaatttct

SEQ ID NO: 4129008 - DNA, 15 bp, Homo sapiens
caatatattgaactt

SEQ ID NO: 4129009 - DNA, 23 bp, Homo sapiens
caatatcatatcatcacattgag

SEQ ID NO: 4129010 - DNA, 18 bp, Homo sapiens
caatatccctcttgtaag

SEQ ID NO: 4129011 - DNA, 21 bp, Homo sapiens
caatatgaattcaagaaagga

SEQ ID NO: 4129012 - DNA, 17 bp, Homo sapiens
caatatgtatgcttttt

SEQ ID NO: 4129013 - DNA, 22 bp, Homo sapiens
caatatgtatgctttttaccta

SEQ ID NO: 4129014 - DNA, 17 bp, Homo sapiens
caatatgtgtttacttt

SEQ ID NO: 4129015 - DNA, 12 bp, Homo sapiens
caatattaaata

SEQ ID NO: 4129016 - DNA, 20 bp, Homo sapiens
caatattaaatacagacact

SEQ ID NO: 4129017 - DNA, 23 bp, Homo sapiens
caatattaaatacagacactaag

SEQ ID NO: 4129018 - DNA, 15 bp, Homo sapiens
caatattaaatctgc

SEQ ID NO: 4129019 - DNA, 14 bp, Homo sapiens
caatattataattt

SEQ ID NO: 4129020 - DNA, 14 bp, Homo sapiens
caatattatgaaat

SEQ ID NO: 4129021 - DNA, 21 bp, Homo sapiens
caatattatgaaatttcactt

SEQ ID NO: 4129022 - DNA, 21 bp, Homo sapiens
caatattcctgaatgaaatat

SEQ ID NO: 4129023 - DNA, 16 bp, Homo sapiens
caatattgacatttgt

SEQ ID NO: 4129024 - DNA, 14 bp, Homo sapiens
caatatttaaacat

SEQ ID NO: 4129025 - DNA, 12 bp, Homo sapiens
caatatttatta

SEQ ID NO: 4129026 - DNA, 16 bp, Homo sapiens
caatatttgttactgt

SEQ ID NO: 4129027 - DNA, 16 bp, Homo sapiens
caatattttctttaat

SEQ ID NO: 4129028 - DNA, 19 bp, Homo sapiens
caatattttctttaatgct

SEQ ID NO: 4129029 - DNA, 16 bp, Homo sapiens
caatatttttatatca

SEQ ID NO: 4129030 - DNA, 20 bp, Homo sapiens
caatatttttatatcatgca

SEQ ID NO: 4129031 - DNA, 18 bp, Homo sapiens
caatcattgctgaaaatg

SEQ ID NO: 4129032 - DNA, 21 bp, Homo sapiens
caatcattgctgaaaatggta

SEQ ID NO: 4129033 - DNA, 17 bp, Homo sapiens
caatcattttaattatt

SEQ ID NO: 4129034 - DNA, 18 bp, Homo sapiens
caatccacctgccttggc

SEQ ID NO: 4129035 - DNA, 12 bp, Homo sapiens
caatccaccttc

SEQ ID NO: 4129036 - DNA, 16 bp, Homo sapiens
caatcccaccaaccct

SEQ ID NO: 4129037 - DNA, 19 bp, Homo sapiens
caatcccagggctggctct

SEQ ID NO: 4129038 - DNA, 18 bp, Homo sapiens
caatcccgtgaaagaatt

SEQ ID NO: 4129039 - DNA, 16 bp, Homo sapiens
caatccctgatccctg

SEQ ID NO: 4129040 - DNA, 21 bp, Homo sapiens
caatcctgttaagagataatt

SEQ ID NO: 4129041 - DNA, 22 bp, Homo sapiens
caatcctgtttataatctgaag

SEQ ID NO: 4129042 - DNA, 22 bp, Homo sapiens
caatccttccctgctcttgcag

SEQ ID NO: 4129043 - DNA, 12 bp, Homo sapiens
caatctaatttt

SEQ ID NO: 4129044 - DNA, 23 bp, Homo sapiens
caatctcctctctctttcctcca

SEQ ID NO: 4129045 - DNA, 15 bp, Homo sapiens
caatctcttcattat

SEQ ID NO: 4129046 - DNA, 20 bp, Homo sapiens
caatctgattcagcatcact

SEQ ID NO: 4129047 - DNA, 22 bp, Homo sapiens
caatctgattcagcatcactaa

SEQ ID NO: 4129048 - DNA, 19 bp, Homo sapiens
caatctggcccttacacac

SEQ ID NO: 4129049 - DNA, 23 bp, Homo sapiens
caatctggcccttacacactcag

SEQ ID NO: 4129050 - DNA, 12 bp, Homo sapiens
caatctgtgggc

SEQ ID NO: 4129051 - DNA, 12 bp, Homo sapiens
caatcttgtttt

SEQ ID NO: 4129052 - DNA, 20 bp, Homo sapiens
caatgaaaactctttgctgc

SEQ ID NO: 4129053 - DNA, 22 bp, Homo sapiens
caatgaaatacacaagtaaaca

SEQ ID NO: 4129054 - DNA, 17 bp, Homo sapiens
caatgacatctcagggg

SEQ ID NO: 4129055 - DNA, 19 bp, Homo sapiens
caatgacatctcaggggcc

SEQ ID NO: 4129056 - DNA, 22 bp, Homo sapiens
caatgacatctcaggggccaga

SEQ ID NO: 4129057 - DNA, 19 bp, Homo sapiens
caatgacttctaatttata

SEQ ID NO: 4129058 - DNA, 14 bp, Homo sapiens
caatgatgaatgag

SEQ ID NO: 4129059 - DNA, 21 bp, Homo sapiens
caatgatgattaaacacctga

SEQ ID NO: 4129060 - DNA, 14 bp, Homo sapiens
caatgatgtccaga

SEQ ID NO: 4129061 - DNA, 13 bp, Homo sapiens
caatgatgtgacc

SEQ ID NO: 4129062 - DNA, 21 bp, Homo sapiens
caatgcaagagtgattgcagc

SEQ ID NO: 4129063 - DNA, 23 bp, Homo sapiens
caatgcaagagtgattgcagctt

SEQ ID NO: 4129064 - DNA, 18 bp, Homo sapiens
caatgccatttcagtggc

SEQ ID NO: 4129065 - DNA, 16 bp, Homo sapiens
caatgcccagcagggg

SEQ ID NO: 4129066 - DNA, 16 bp, Homo sapiens
caatgctgatttggtg

SEQ ID NO: 4129067 - DNA, 20 bp, Homo sapiens
caatgcttaaactaaataat

SEQ ID NO: 4129068 - DNA, 17 bp, Homo sapiens
caatggcgcctgctccc

SEQ ID NO: 4129069 - DNA, 17 bp, Homo sapiens
caatggctaattcccag

SEQ ID NO: 4129070 - DNA, 23 bp, Homo sapiens
caatggctaattcccagagtgtg

SEQ ID NO: 4129071 - DNA, 15 bp, Homo sapiens
caatggctttttaaa

SEQ ID NO: 4129072 - DNA, 13 bp, Homo sapiens
caatgggactgga

SEQ ID NO: 4129073 - DNA, 17 bp, Homo sapiens
caatgggactggagtca

SEQ ID NO: 4129074 - DNA, 15 bp, Homo sapiens
caatgggcactggga

SEQ ID NO: 4129075 - DNA, 22 bp, Homo sapiens
caatggtgatcctctattttgt

SEQ ID NO: 4129076 - DNA, 17 bp, Homo sapiens
caatggtgttgccctga

SEQ ID NO: 4129077 - DNA, 19 bp, Homo sapiens
caatgtcacaacctctctg

SEQ ID NO: 4129078 - DNA, 22 bp, Homo sapiens
caatgtcacaacctctctgatc

SEQ ID NO: 4129079 - DNA, 15 bp, Homo sapiens
caatgtctgagtgaa

SEQ ID NO: 4129080 - DNA, 21 bp, Homo sapiens
caatgtgaactttattaaata

SEQ ID NO: 4129081 - DNA, 17 bp, Homo sapiens
caatgtgaccaggggtg

SEQ ID NO: 4129082 - DNA, 23 bp, Homo sapiens
caatgtgctactgattgtttcat

SEQ ID NO: 4129083 - DNA, 20 bp, Homo sapiens
caatgtggagtctccctctg

SEQ ID NO: 4129084 - DNA, 13 bp, Homo sapiens
caatgttcattgt

SEQ ID NO: 4129085 - DNA, 22 bp, Homo sapiens
caatgttcattgtaatgttact

SEQ ID NO: 4129086 - DNA, 22 bp, Homo sapiens
caattaaatgtaggtatgaata

SEQ ID NO: 4129087 - DNA, 11 bp, Homo sapiens
caattaatgct

SEQ ID NO: 4129088 - DNA, 20 bp, Homo sapiens
caattaggaagtgtaacagc

SEQ ID NO: 4129089 - DNA, 15 bp, Homo sapiens
caattagtctgaaac

SEQ ID NO: 4129090 - DNA, 17 bp, Homo sapiens
caattagtttccttttt

SEQ ID NO: 4129091 - DNA, 21 bp, Homo sapiens
caattagtttcctttttaata

SEQ ID NO: 4129092 - DNA, 22 bp, Homo sapiens
caattataaactcattttgctt

SEQ ID NO: 4129093 - DNA, 16 bp, Homo sapiens
caattattggcaaagt

SEQ ID NO: 4129094 - DNA, 16 bp, Homo sapiens
caattatttgcatatt

SEQ ID NO: 4129095 - DNA, 15 bp, Homo sapiens
caattcagacaggca

SEQ ID NO: 4129096 - DNA, 14 bp, Homo sapiens
caattcagacccct

SEQ ID NO: 4129097 - DNA, 19 bp, Homo sapiens
caattcagattgtcttgca

SEQ ID NO: 4129098 - DNA, 20 bp, Homo sapiens
caattcatgcctttcatagt

SEQ ID NO: 4129099 - DNA, 15 bp, Homo sapiens
caattccaaaggaat

SEQ ID NO: 4129100 - DNA, 16 bp, Homo sapiens
caattccctctctcag

SEQ ID NO: 4129101 - DNA, 19 bp, Homo sapiens
caattccctctctcagcac

SEQ ID NO: 4129102 - DNA, 15 bp, Homo sapiens
caattcctagataaa

SEQ ID NO: 4129103 - DNA, 18 bp, Homo sapiens
caattcctagataaaaag

SEQ ID NO: 4129104 - DNA, 22 bp, Homo sapiens
caattcctagataaaaagatgg

SEQ ID NO: 4129105 - DNA, 14 bp, Homo sapiens
caattcctctggga

SEQ ID NO: 4129106 - DNA, 19 bp, Homo sapiens
caattctacagtttcttac

SEQ ID NO: 4129107 - DNA, 13 bp, Homo sapiens
caattctccttta

SEQ ID NO: 4129108 - DNA, 22 bp, Homo sapiens
caattctgcccgctccatggaa

SEQ ID NO: 4129109 - DNA, 17 bp, Homo sapiens
caattgaagtaaacttt

SEQ ID NO: 4129110 - DNA, 21 bp, Homo sapiens
caattgaagtaaactttttgt

SEQ ID NO: 4129111 - DNA, 14 bp, Homo sapiens
caattgagaaaaat

SEQ ID NO: 4129112 - DNA, 23 bp, Homo sapiens
caattgagaaaaatatatactaa

SEQ ID NO: 4129113 - DNA, 18 bp, Homo sapiens
caattggcagtgactttg

SEQ ID NO: 4129114 - DNA, 15 bp, Homo sapiens
caattgtcacttttt

SEQ ID NO: 4129115 - DNA, 15 bp, Homo sapiens
caattgtgctgccat

SEQ ID NO: 4129116 - DNA, 16 bp, Homo sapiens
caattgtgctgccatt

SEQ ID NO: 4129117 - DNA, 15 bp, Homo sapiens
caattgtgtagcctt

SEQ ID NO: 4129118 - DNA, 18 bp, Homo sapiens
caattgtgtagccttttt

SEQ ID NO: 4129119 - DNA, 13 bp, Homo sapiens
caattgtgtgaat

SEQ ID NO: 4129120 - DNA, 22 bp, Homo sapiens
caattgtttgggtgattcctaa

SEQ ID NO: 4129121 - DNA, 13 bp, Homo sapiens
caatttaattcct

SEQ ID NO: 4129122 - DNA, 17 bp, Homo sapiens
caatttcccccctcgtg

SEQ ID NO: 4129123 - DNA, 13 bp, Homo sapiens
caatttcggattt

SEQ ID NO: 4129124 - DNA, 22 bp, Homo sapiens
caatttctgtccttcagatgga

SEQ ID NO: 4129125 - DNA, 19 bp, Homo sapiens
caatttgatacataataaa

SEQ ID NO: 4129126 - DNA, 22 bp, Homo sapiens
caatttgatacataataaaaaa

SEQ ID NO: 4129127 - DNA, 12 bp, Homo sapiens
caattttaaaga

SEQ ID NO: 4129128 - DNA, 18 bp, Homo sapiens
caattttcattaaacttg

SEQ ID NO: 4129129 - DNA, 20 bp, Homo sapiens
caattttcattaaacttgaa

SEQ ID NO: 4129130 - DNA, 22 bp, Homo sapiens
caattttctaagcaatttcttg

SEQ ID NO: 4129131 - DNA, 14 bp, Homo sapiens
caatttttaggaag

SEQ ID NO: 4129132 - DNA, 16 bp, Homo sapiens
caatttttgtctcaga

SEQ ID NO: 4129133 - DNA, 15 bp, Homo sapiens
cacaaaatgtctcag

SEQ ID NO: 4129134 - DNA, 17 bp, Homo sapiens
cacaaacacacacacta

SEQ ID NO: 4129135 - DNA, 12 bp, Homo sapiens
cacaaactgtaa

SEQ ID NO: 4129136 - DNA, 15 bp, Homo sapiens
cacaaactgtaaata

SEQ ID NO: 4129137 - DNA, 23 bp, Homo sapiens
cacaaactgtaaataaaaagaaa

SEQ ID NO: 4129138 - DNA, 15 bp, Homo sapiens
cacaaagagttctgg

SEQ ID NO: 4129139 - DNA, 18 bp, Homo sapiens
cacaaagcggggggaggg

SEQ ID NO: 4129140 - DNA, 11 bp, Homo sapiens
cacaaaggaag

SEQ ID NO: 4129141 - DNA, 15 bp, Homo sapiens
cacaaatgctcaaag

SEQ ID NO: 4129142 - DNA, 19 bp, Homo sapiens
cacaacaaacctattgtag

SEQ ID NO: 4129143 - DNA, 16 bp, Homo sapiens
cacaacacacacactc

SEQ ID NO: 4129144 - DNA, 18 bp, Homo sapiens
cacaacccccagctcccg

SEQ ID NO: 4129145 - DNA, 23 bp, Homo sapiens
cacaacctctctgatcttgtgct

SEQ ID NO: 4129146 - DNA, 19 bp, Homo sapiens
cacaaccttctgtggctca

SEQ ID NO: 4129147 - DNA, 23 bp, Homo sapiens
cacaaccttctgtggctcacaga

SEQ ID NO: 4129148 - DNA, 19 bp, Homo sapiens
cacaactgcaataacttct

SEQ ID NO: 4129149 - DNA, 23 bp, Homo sapiens
cacaactgcaataacttctgacc

SEQ ID NO: 4129150 - DNA, 17 bp, Homo sapiens
cacaacttagtgtaata

SEQ ID NO: 4129151 - DNA, 15 bp, Homo sapiens
cacaacttgggttct

SEQ ID NO: 4129152 - DNA, 14 bp, Homo sapiens
cacaagaatggatc

SEQ ID NO: 4129153 - DNA, 23 bp, Homo sapiens
cacaagaatggatcacaagatgg

SEQ ID NO: 4129154 - DNA, 22 bp, Homo sapiens
cacaagcagagtgcacagctgt

SEQ ID NO: 4129155 - DNA, 21 bp, Homo sapiens
cacaagccacaagtcttccag

SEQ ID NO: 4129156 - DNA, 14 bp, Homo sapiens
cacaagctggaagc

SEQ ID NO: 4129157 - DNA, 20 bp, Homo sapiens
cacaaggaaaatagtttagg

SEQ ID NO: 4129158 - DNA, 18 bp, Homo sapiens
cacaaggaataaatgaga

SEQ ID NO: 4129159 - DNA, 22 bp, Homo sapiens
cacaaggacttcctgtccagct

SEQ ID NO: 4129160 - DNA, 16 bp, Homo sapiens
cacaaggctggccagc

SEQ ID NO: 4129161 - DNA, 20 bp, Homo sapiens
cacaaggctggccagcaagg

SEQ ID NO: 4129162 - DNA, 15 bp, Homo sapiens
cacaaggtccactcc

SEQ ID NO: 4129163 - DNA, 20 bp, Homo sapiens
cacaaggtccactccctgct

SEQ ID NO: 4129164 - DNA, 22 bp, Homo sapiens
cacaaggtccactccctgctcc

SEQ ID NO: 4129165 - DNA, 17 bp, Homo sapiens
cacaaggtgcaaatcaa

SEQ ID NO: 4129166 - DNA, 19 bp, Homo sapiens
cacaataaatgtattcaaa

SEQ ID NO: 4129167 - DNA, 11 bp, Homo sapiens
cacaatatttt

SEQ ID NO: 4129168 - DNA, 16 bp, Homo sapiens
cacaatccctggggct

SEQ ID NO: 4129169 - DNA, 20 bp, Homo sapiens
cacaatgatgattaaacacc

SEQ ID NO: 4129170 - DNA, 17 bp, Homo sapiens
cacaattgttttacctg

SEQ ID NO: 4129171 - DNA, 19 bp, Homo sapiens
cacacaaaaaaagacctgt

SEQ ID NO: 4129172 - DNA, 12 bp, Homo sapiens
cacacaaagcag

SEQ ID NO: 4129173 - DNA, 13 bp, Homo sapiens
cacacaaaggtat

SEQ ID NO: 4129174 - DNA, 16 bp, Homo sapiens
cacacaagaagaaggg

SEQ ID NO: 4129175 - DNA, 14 bp, Homo sapiens
cacacacaaaaaaa

SEQ ID NO: 4129176 - DNA, 9 bp, Homo sapiens
cacacacac

SEQ ID NO: 4129177 - DNA, 12 bp, Homo sapiens
cacacacacaca

SEQ ID NO: 4129178 - DNA, 14 bp, Homo sapiens
cacacacacacaca

SEQ ID NO: 4129179 - DNA, 15 bp, Homo sapiens
cacacacacacacaa

SEQ ID NO: 4129180 - DNA, 15 bp, Homo sapiens
cacacacacacacac

SEQ ID NO: 4129181 - DNA, 16 bp, Homo sapiens
cacacacacacacact

SEQ ID NO: 4129182 - DNA, 14 bp, Homo sapiens
cacacacacacagg

SEQ ID NO: 4129183 - DNA, 14 bp, Homo sapiens
cacacacacagctg

SEQ ID NO: 4129184 - DNA, 14 bp, Homo sapiens
cacacacacatgct

SEQ ID NO: 4129185 - DNA, 13 bp, Homo sapiens
cacacacactccc

SEQ ID NO: 4129186 - DNA, 14 bp, Homo sapiens
cacacacactccct

SEQ ID NO: 4129187 - DNA, 13 bp, Homo sapiens
cacacacactcta

SEQ ID NO: 4129188 - DNA, 22 bp, Homo sapiens
cacacacagctgggcaaagcca

SEQ ID NO: 4129189 - DNA, 10 bp, Homo sapiens
cacacacagg

SEQ ID NO: 4129190 - DNA, 18 bp, Homo sapiens
cacacacatgctaggatg

SEQ ID NO: 4129191 - DNA, 16 bp, Homo sapiens
cacacacccaggccca

SEQ ID NO: 4129192 - DNA, 23 bp, Homo sapiens
cacacacgcacgcacacacacaa

SEQ ID NO: 4129193 - DNA, 13 bp, Homo sapiens
cacacactccctg

SEQ ID NO: 4129194 - DNA, 14 bp, Homo sapiens
cacacactccctgc

SEQ ID NO: 4129195 - DNA, 16 bp, Homo sapiens
cacacactccctgctt

SEQ ID NO: 4129196 - DNA, 19 bp, Homo sapiens
cacacagaggctgcctctc

SEQ ID NO: 4129197 - DNA, 20 bp, Homo sapiens
cacacagagtggtctttctg

SEQ ID NO: 4129198 - DNA, 18 bp, Homo sapiens
cacacagcactctctaaa

SEQ ID NO: 4129199 - DNA, 14 bp, Homo sapiens
cacacagcagcccc

SEQ ID NO: 4129200 - DNA, 13 bp, Homo sapiens
cacacagccccta

SEQ ID NO: 4129201 - DNA, 15 bp, Homo sapiens
cacacagctgagcac

SEQ ID NO: 4129202 - DNA, 13 bp, Homo sapiens
cacacagctgccc

SEQ ID NO: 4129203 - DNA, 14 bp, Homo sapiens
cacacagctgccct

SEQ ID NO: 4129204 - DNA, 21 bp, Homo sapiens
cacacaggtggggactgggca

SEQ ID NO: 4129205 - DNA, 21 bp, Homo sapiens
cacacatataaacatcacaca

SEQ ID NO: 4129206 - DNA, 17 bp, Homo sapiens
cacacatgggcagccca

SEQ ID NO: 4129207 - DNA, 18 bp, Homo sapiens
cacacatgggcagcccaa

SEQ ID NO: 4129208 - DNA, 22 bp, Homo sapiens
cacacatttcactgtctgtctg

SEQ ID NO: 4129209 - DNA, 16 bp, Homo sapiens
cacaccacaattctcc

SEQ ID NO: 4129210 - DNA, 12 bp, Homo sapiens
cacaccagccat

SEQ ID NO: 4129211 - DNA, 14 bp, Homo sapiens
cacaccaggctgtg

SEQ ID NO: 4129212 - DNA, 13 bp, Homo sapiens
cacaccccacacc

SEQ ID NO: 4129213 - DNA, 13 bp, Homo sapiens
cacaccccagccc

SEQ ID NO: 4129214 - DNA, 13 bp, Homo sapiens
cacacccctgtcc

SEQ ID NO: 4129215 - DNA, 22 bp, Homo sapiens
cacaccctgaggtcagggagtg

SEQ ID NO: 4129216 - DNA, 21 bp, Homo sapiens
cacaccctgtactgttctgtg

SEQ ID NO: 4129217 - DNA, 21 bp, Homo sapiens
cacacctcagttcccttggcc

SEQ ID NO: 4129218 - DNA, 22 bp, Homo sapiens
cacacctcagttcccttggcct

SEQ ID NO: 4129219 - DNA, 21 bp, Homo sapiens
cacacctggctaattttttgt

SEQ ID NO: 4129220 - DNA, 16 bp, Homo sapiens
cacaccttccagggcc

SEQ ID NO: 4129221 - DNA, 20 bp, Homo sapiens
cacaccttccagggccctag

SEQ ID NO: 4129222 - DNA, 21 bp, Homo sapiens
cacaccttccagggccctagg

SEQ ID NO: 4129223 - DNA, 22 bp, Homo sapiens
cacaccttttattgacacagaa

SEQ ID NO: 4129224 - DNA, 20 bp, Homo sapiens
cacacgaccggggccagcac

SEQ ID NO: 4129225 - DNA, 19 bp, Homo sapiens
cacacgcacgcacacacac

SEQ ID NO: 4129226 - DNA, 17 bp, Homo sapiens
cacacgcactggtgcca

SEQ ID NO: 4129227 - DNA, 19 bp, Homo sapiens
cacacgcaggaactcccag

SEQ ID NO: 4129228 - DNA, 20 bp, Homo sapiens
cacacgcaggaactcccagc

SEQ ID NO: 4129229 - DNA, 13 bp, Homo sapiens
cacacggccaccc

SEQ ID NO: 4129230 - DNA, 14 bp, Homo sapiens
cacacggccacccg

SEQ ID NO: 4129231 - DNA, 19 bp, Homo sapiens
cacacggccacccgccccg

SEQ ID NO: 4129232 - DNA, 17 bp, Homo sapiens
cacactattaccatgag

SEQ ID NO: 4129233 - DNA, 14 bp, Homo sapiens
cacactcaggcctg

SEQ ID NO: 4129234 - DNA, 17 bp, Homo sapiens
cacactcaggcctgtgc

SEQ ID NO: 4129235 - DNA, 23 bp, Homo sapiens
cacactcaggcctgtgcccactc

SEQ ID NO: 4129236 - DNA, 11 bp, Homo sapiens
cacactccagt

SEQ ID NO: 4129237 - DNA, 14 bp, Homo sapiens
cacactcccaaggt

SEQ ID NO: 4129238 - DNA, 21 bp, Homo sapiens
cacactcccaaggttggagcc

SEQ ID NO: 4129239 - DNA, 20 bp, Homo sapiens
cacactccccgccttagagc

SEQ ID NO: 4129240 - DNA, 14 bp, Homo sapiens
cacactgatgctta

SEQ ID NO: 4129241 - DNA, 18 bp, Homo sapiens
cacactgatgcttagatg

SEQ ID NO: 4129242 - DNA, 14 bp, Homo sapiens
cacactgcctccca

SEQ ID NO: 4129243 - DNA, 19 bp, Homo sapiens
cacactgctcttaagaaac

SEQ ID NO: 4129244 - DNA, 15 bp, Homo sapiens
cacactggggccccg

SEQ ID NO: 4129245 - DNA, 19 bp, Homo sapiens
cacactggtacttagagtt

SEQ ID NO: 4129246 - DNA, 15 bp, Homo sapiens
cacactggtgactgc

SEQ ID NO: 4129247 - DNA, 15 bp, Homo sapiens
cacactgtaaatatg

SEQ ID NO: 4129248 - DNA, 18 bp, Homo sapiens
cacactgtcatgcttcat

SEQ ID NO: 4129249 - DNA, 22 bp, Homo sapiens
cacactgtcatgcttcatcatt

SEQ ID NO: 4129250 - DNA, 16 bp, Homo sapiens
cacactgttactccac

SEQ ID NO: 4129251 - DNA, 19 bp, Homo sapiens
cacactgttactccacagc

SEQ ID NO: 4129252 - DNA, 16 bp, Homo sapiens
cacacttagctggaga

SEQ ID NO: 4129253 - DNA, 17 bp, Homo sapiens
cacacttcaggctcttc

SEQ ID NO: 4129254 - DNA, 18 bp, Homo sapiens
cacacttcaggctcttct

SEQ ID NO: 4129255 - DNA, 22 bp, Homo sapiens
cacacttctgtgagacccccac

SEQ ID NO: 4129256 - DNA, 17 bp, Homo sapiens
cacacttgtcggctcca

SEQ ID NO: 4129257 - DNA, 21 bp, Homo sapiens
cacacttgtgtgtgggctgtg

SEQ ID NO: 4129258 - DNA, 17 bp, Homo sapiens
cacactttttaagaaat

SEQ ID NO: 4129259 - DNA, 13 bp, Homo sapiens
cacagaaaaagca

SEQ ID NO: 4129260 - DNA, 12 bp, Homo sapiens
cacagaaacctt

SEQ ID NO: 4129261 - DNA, 20 bp, Homo sapiens
cacagaaatcagaggagaga

SEQ ID NO: 4129262 - DNA, 13 bp, Homo sapiens
cacagaaatgctg

SEQ ID NO: 4129263 - DNA, 20 bp, Homo sapiens
cacagaaggaatctgtgcag

SEQ ID NO: 4129264 - DNA, 16 bp, Homo sapiens
cacagaatatttttat

SEQ ID NO: 4129265 - DNA, 18 bp, Homo sapiens
cacagaatatttttatat

SEQ ID NO: 4129266 - DNA, 20 bp, Homo sapiens
cacagacacaatatgtatgc

SEQ ID NO: 4129267 - DNA, 17 bp, Homo sapiens
cacagacacacacacgc

SEQ ID NO: 4129268 - DNA, 15 bp, Homo sapiens
cacagacacgctcgc

SEQ ID NO: 4129269 - DNA, 22 bp, Homo sapiens
cacagacacgctcgcgggcagc

SEQ ID NO: 4129270 - DNA, 17 bp, Homo sapiens
cacagacagatcccatc

SEQ ID NO: 4129271 - DNA, 20 bp, Homo sapiens
cacagacagatcccatccat

SEQ ID NO: 4129272 - DNA, 16 bp, Homo sapiens
cacagacccaggaccc

SEQ ID NO: 4129273 - DNA, 16 bp, Homo sapiens
cacagacccctaggga

SEQ ID NO: 4129274 - DNA, 10 bp, Homo sapiens
cacagagaga

SEQ ID NO: 4129275 - DNA, 18 bp, Homo sapiens
cacagagagacagacttg

SEQ ID NO: 4129276 - DNA, 19 bp, Homo sapiens
cacagagagggagagcaga

SEQ ID NO: 4129277 - DNA, 23 bp, Homo sapiens
cacagagagggagagcagagaaa

SEQ ID NO: 4129278 - DNA, 13 bp, Homo sapiens
cacagagcctggc

SEQ ID NO: 4129279 - DNA, 18 bp, Homo sapiens
cacagagcctggccccag

SEQ ID NO: 4129280 - DNA, 20 bp, Homo sapiens
cacagatatttccatttctt

SEQ ID NO: 4129281 - DNA, 12 bp, Homo sapiens
cacagatggatt

SEQ ID NO: 4129282 - DNA, 23 bp, Homo sapiens
cacagatggatttgcctgtgcca

SEQ ID NO: 4129283 - DNA, 16 bp, Homo sapiens
cacagatgtctctggg

SEQ ID NO: 4129284 - DNA, 17 bp, Homo sapiens
cacagcaaccccaggct

SEQ ID NO: 4129285 - DNA, 20 bp, Homo sapiens
cacagcaagtacagcggctc

SEQ ID NO: 4129286 - DNA, 18 bp, Homo sapiens
cacagcaattcctcaggc

SEQ ID NO: 4129287 - DNA, 15 bp, Homo sapiens
cacagcagcccccca

SEQ ID NO: 4129288 - DNA, 18 bp, Homo sapiens
cacagcagccccccagca

SEQ ID NO: 4129289 - DNA, 12 bp, Homo sapiens
cacagcagcctg

SEQ ID NO: 4129290 - DNA, 13 bp, Homo sapiens
cacagcagcttca

SEQ ID NO: 4129291 - DNA, 14 bp, Homo sapiens
cacagcatcgggag

SEQ ID NO: 4129292 - DNA, 15 bp, Homo sapiens
cacagcatcgggagc

SEQ ID NO: 4129293 - DNA, 22 bp, Homo sapiens
cacagcatcgggagcacccaga

SEQ ID NO: 4129294 - DNA, 22 bp, Homo sapiens
cacagccagggggatgccactc

SEQ ID NO: 4129295 - DNA, 19 bp, Homo sapiens
cacagcctcctctgtctgc

SEQ ID NO: 4129296 - DNA, 16 bp, Homo sapiens
cacagcctggggaggg

SEQ ID NO: 4129297 - DNA, 23 bp, Homo sapiens
cacagccttcggacagacatatg

SEQ ID NO: 4129298 - DNA, 16 bp, Homo sapiens
cacagcggaggagacc

SEQ ID NO: 4129299 - DNA, 14 bp, Homo sapiens
cacagcgtccctgg

SEQ ID NO: 4129300 - DNA, 18 bp, Homo sapiens
cacagcgtccctggcgca

SEQ ID NO: 4129301 - DNA, 19 bp, Homo sapiens
cacagcgtccctggcgcag

SEQ ID NO: 4129302 - DNA, 16 bp, Homo sapiens
cacagctactctcccc

SEQ ID NO: 4129303 - DNA, 21 bp, Homo sapiens
cacagctagtgaagaccagag

SEQ ID NO: 4129304 - DNA, 10 bp, Homo sapiens
cacagctcct

SEQ ID NO: 4129305 - DNA, 22 bp, Homo sapiens
cacagctgccctagctgacccc

SEQ ID NO: 4129306 - DNA, 16 bp, Homo sapiens
cacagctgctgttctc

SEQ ID NO: 4129307 - DNA, 21 bp, Homo sapiens
cacagctggagctctcaaact

SEQ ID NO: 4129308 - DNA, 12 bp, Homo sapiens
cacagctgggca

SEQ ID NO: 4129309 - DNA, 13 bp, Homo sapiens
cacagctgggcaa

SEQ ID NO: 4129310 - DNA, 17 bp, Homo sapiens
cacagcttagatttcat

SEQ ID NO: 4129311 - DNA, 13 bp, Homo sapiens
cacaggaggccag

SEQ ID NO: 4129312 - DNA, 18 bp, Homo sapiens
cacaggaggccagtgggc

SEQ ID NO: 4129313 - DNA, 23 bp, Homo sapiens
cacaggatcctattctcaccagg

SEQ ID NO: 4129314 - DNA, 16 bp, Homo sapiens
cacaggcagctggatg

SEQ ID NO: 4129315 - DNA, 15 bp, Homo sapiens
cacaggcagctttct

SEQ ID NO: 4129316 - DNA, 22 bp, Homo sapiens
cacaggcatctacacagcctgg

SEQ ID NO: 4129317 - DNA, 18 bp, Homo sapiens
cacaggccaccctgtgca

SEQ ID NO: 4129318 - DNA, 23 bp, Homo sapiens
cacaggccaccctgtgcagaagg

SEQ ID NO: 4129319 - DNA, 12 bp, Homo sapiens
cacaggccccct

SEQ ID NO: 4129320 - DNA, 13 bp, Homo sapiens
cacaggccctccc

SEQ ID NO: 4129321 - DNA, 16 bp, Homo sapiens
cacaggcccttcctct

SEQ ID NO: 4129322 - DNA, 17 bp, Homo sapiens
cacaggcccttcctctc

SEQ ID NO: 4129323 - DNA, 21 bp, Homo sapiens
cacaggcccttcctctccact

SEQ ID NO: 4129324 - DNA, 22 bp, Homo sapiens
cacaggcccttcctctccactg

SEQ ID NO: 4129325 - DNA, 16 bp, Homo sapiens
cacagggaagggcttg

SEQ ID NO: 4129326 - DNA, 18 bp, Homo sapiens
cacagggaagggcttggc

SEQ ID NO: 4129327 - DNA, 18 bp, Homo sapiens
cacagggcaccagaggcc

SEQ ID NO: 4129328 - DNA, 16 bp, Homo sapiens
cacagggccagaggga

SEQ ID NO: 4129329 - DNA, 18 bp, Homo sapiens
cacagggccagagggagc

SEQ ID NO: 4129330 - DNA, 19 bp, Homo sapiens
cacagggggattctgagca

SEQ ID NO: 4129331 - DNA, 23 bp, Homo sapiens
cacagggggattctgagcagtgc

SEQ ID NO: 4129332 - DNA, 16 bp, Homo sapiens
cacagggtctgctctt

SEQ ID NO: 4129333 - DNA, 18 bp, Homo sapiens
cacaggtcaataaactta

SEQ ID NO: 4129334 - DNA, 19 bp, Homo sapiens
cacaggttcatgccaccat

SEQ ID NO: 4129335 - DNA, 19 bp, Homo sapiens
cacagtacagcatgtgcct

SEQ ID NO: 4129336 - DNA, 20 bp, Homo sapiens
cacagtagaactgtctgtga

SEQ ID NO: 4129337 - DNA, 16 bp, Homo sapiens
cacagtagtcttgatg

SEQ ID NO: 4129338 - DNA, 13 bp, Homo sapiens
cacagtattatct

SEQ ID NO: 4129339 - DNA, 13 bp, Homo sapiens
cacagtcagcatg

SEQ ID NO: 4129340 - DNA, 21 bp, Homo sapiens
cacagtcagcatgcttcccag

SEQ ID NO: 4129341 - DNA, 14 bp, Homo sapiens
cacagtcaggttga

SEQ ID NO: 4129342 - DNA, 22 bp, Homo sapiens
cacagtctggtgcttgggagag

SEQ ID NO: 4129343 - DNA, 16 bp, Homo sapiens
cacagtgataccagtt

SEQ ID NO: 4129344 - DNA, 18 bp, Homo sapiens
cacagtggactcagcagt

SEQ ID NO: 4129345 - DNA, 20 bp, Homo sapiens
cacagtggactcagcagtga

SEQ ID NO: 4129346 - DNA, 21 bp, Homo sapiens
cacagtggactcagcagtgac

SEQ ID NO: 4129347 - DNA, 19 bp, Homo sapiens
cacagtgggatgaaccagc

SEQ ID NO: 4129348 - DNA, 18 bp, Homo sapiens
cacagtgtctgtatcgga

SEQ ID NO: 4129349 - DNA, 14 bp, Homo sapiens
cacagtgtgagccc

SEQ ID NO: 4129350 - DNA, 19 bp, Homo sapiens
cacagtgttgcccaggctg

SEQ ID NO: 4129351 - DNA, 18 bp, Homo sapiens
cacagttcttggtgactg

SEQ ID NO: 4129352 - DNA, 14 bp, Homo sapiens
cacatacaggtgct

SEQ ID NO: 4129353 - DNA, 17 bp, Homo sapiens
cacatacaggtgctcaa

SEQ ID NO: 4129354 - DNA, 14 bp, Homo sapiens
cacatacattaaaa

SEQ ID NO: 4129355 - DNA, 22 bp, Homo sapiens
cacataccctcttcatggatgg

SEQ ID NO: 4129356 - DNA, 17 bp, Homo sapiens
cacatactgtgttccaa

SEQ ID NO: 4129357 - DNA, 13 bp, Homo sapiens
cacatcccacccc

SEQ ID NO: 4129358 - DNA, 14 bp, Homo sapiens
cacatcccagcagc

SEQ ID NO: 4129359 - DNA, 15 bp, Homo sapiens
cacatcccagcagcc

SEQ ID NO: 4129360 - DNA, 16 bp, Homo sapiens
cacatcccagcagccc

SEQ ID NO: 4129361 - DNA, 18 bp, Homo sapiens
cacatcccagcagcccaa

SEQ ID NO: 4129362 - DNA, 22 bp, Homo sapiens
cacatcccagcagcccaagctt

SEQ ID NO: 4129363 - DNA, 12 bp, Homo sapiens
cacatcccaggc

SEQ ID NO: 4129364 - DNA, 12 bp, Homo sapiens
cacatccctcta

SEQ ID NO: 4129365 - DNA, 19 bp, Homo sapiens
cacatccggggccagctcc

SEQ ID NO: 4129366 - DNA, 14 bp, Homo sapiens
cacatcctccgtcc

SEQ ID NO: 4129367 - DNA, 13 bp, Homo sapiens
cacatctcacctc

SEQ ID NO: 4129368 - DNA, 21 bp, Homo sapiens
cacatctgcattttcacccca

SEQ ID NO: 4129369 - DNA, 12 bp, Homo sapiens
cacatcttccct

SEQ ID NO: 4129370 - DNA, 22 bp, Homo sapiens
cacatcttccctagagggttcc

SEQ ID NO: 4129371 - DNA, 21 bp, Homo sapiens
cacatgaaaggcatcagtccc

SEQ ID NO: 4129372 - DNA, 21 bp, Homo sapiens
cacatgacaactttgccagct

SEQ ID NO: 4129373 - DNA, 15 bp, Homo sapiens
cacatgaggccatct

SEQ ID NO: 4129374 - DNA, 21 bp, Homo sapiens
cacatgaggccatctcaggag

SEQ ID NO: 4129375 - DNA, 13 bp, Homo sapiens
cacatgccactgc

SEQ ID NO: 4129376 - DNA, 19 bp, Homo sapiens
cacatgcctatattatcat

SEQ ID NO: 4129377 - DNA, 21 bp, Homo sapiens
cacatgcctgcgcctgctgcc

SEQ ID NO: 4129378 - DNA, 9 bp, Homo sapiens
cacatgcta

SEQ ID NO: 4129379 - DNA, 15 bp, Homo sapiens
cacatgggactggga

SEQ ID NO: 4129380 - DNA, 15 bp, Homo sapiens
cacatgggcagccca

SEQ ID NO: 4129381 - DNA, 19 bp, Homo sapiens
cacatgtggcaaaatatgg

SEQ ID NO: 4129382 - DNA, 19 bp, Homo sapiens
cacatgttactgcttcatt

SEQ ID NO: 4129383 - DNA, 20 bp, Homo sapiens
cacattaaaaaatgaaatat

SEQ ID NO: 4129384 - DNA, 23 bp, Homo sapiens
cacattagattttattttactat

SEQ ID NO: 4129385 - DNA, 20 bp, Homo sapiens
cacattatcgggagcagtgt

SEQ ID NO: 4129386 - DNA, 23 bp, Homo sapiens
cacattcagggctattttttccc

SEQ ID NO: 4129387 - DNA, 16 bp, Homo sapiens
cacattgcattctatt

SEQ ID NO: 4129388 - DNA, 18 bp, Homo sapiens
cacattgtttgctgctat

SEQ ID NO: 4129389 - DNA, 15 bp, Homo sapiens
cacatttctttgcat

SEQ ID NO: 4129390 - DNA, 23 bp, Homo sapiens
cacatttctttgcattccagctg

SEQ ID NO: 4129391 - DNA, 17 bp, Homo sapiens
cacatttgattctgtgt

SEQ ID NO: 4129392 - DNA, 19 bp, Homo sapiens
cacatttggaatacttttt

SEQ ID NO: 4129393 - DNA, 22 bp, Homo sapiens
caccaaccacagcatcgggagc

SEQ ID NO: 4129394 - DNA, 13 bp, Homo sapiens
caccaaccctcag

SEQ ID NO: 4129395 - DNA, 15 bp, Homo sapiens
caccaaccgacaggc

SEQ ID NO: 4129396 - DNA, 18 bp, Homo sapiens
caccaactcctaatttta

SEQ ID NO: 4129397 - DNA, 22 bp, Homo sapiens
caccaagacttgttttatgctc

SEQ ID NO: 4129398 - DNA, 15 bp, Homo sapiens
caccaagcacagcag

SEQ ID NO: 4129399 - DNA, 11 bp, Homo sapiens
caccaaggaaa

SEQ ID NO: 4129400 - DNA, 12 bp, Homo sapiens
caccaaggaaac

SEQ ID NO: 4129401 - DNA, 20 bp, Homo sapiens
caccaaggtcttcagccatc

SEQ ID NO: 4129402 - DNA, 21 bp, Homo sapiens
caccaaggtcttcagccatca

SEQ ID NO: 4129403 - DNA, 17 bp, Homo sapiens
caccaatcccagggctg

SEQ ID NO: 4129404 - DNA, 17 bp, Homo sapiens
caccaatgcccagcagg

SEQ ID NO: 4129405 - DNA, 13 bp, Homo sapiens
caccacagacaca

SEQ ID NO: 4129406 - DNA, 14 bp, Homo sapiens
caccacagacacac

SEQ ID NO: 4129407 - DNA, 19 bp, Homo sapiens
caccacagacacacacacg

SEQ ID NO: 4129408 - DNA, 20 bp, Homo sapiens
caccacagacacacacacgc

SEQ ID NO: 4129409 - DNA, 21 bp, Homo sapiens
caccacagacacacacacgca

SEQ ID NO: 4129410 - DNA, 18 bp, Homo sapiens
caccacatcctccgtcca

SEQ ID NO: 4129411 - DNA, 21 bp, Homo sapiens
caccacatcctccgtccagcc

SEQ ID NO: 4129412 - DNA, 16 bp, Homo sapiens
caccaccccaacaaac

SEQ ID NO: 4129413 - DNA, 22 bp, Homo sapiens
caccaccccctcaagccccagc

SEQ ID NO: 4129414 - DNA, 23 bp, Homo sapiens
caccaccccctcaagccccagca

SEQ ID NO: 4129415 - DNA, 16 bp, Homo sapiens
caccacccgaaatgcc

SEQ ID NO: 4129416 - DNA, 18 bp, Homo sapiens
caccacctcactcctgtt

SEQ ID NO: 4129417 - DNA, 16 bp, Homo sapiens
caccagacacccagga

SEQ ID NO: 4129418 - DNA, 20 bp, Homo sapiens
caccagacacccaggactta

SEQ ID NO: 4129419 - DNA, 19 bp, Homo sapiens
caccagagcagatgcagag

SEQ ID NO: 4129420 - DNA, 21 bp, Homo sapiens
caccagagcatttccaacacc

SEQ ID NO: 4129421 - DNA, 13 bp, Homo sapiens
caccagagcccat

SEQ ID NO: 4129422 - DNA, 16 bp, Homo sapiens
caccagatagcagagg

SEQ ID NO: 4129423 - DNA, 10 bp, Homo sapiens
caccagcagc

SEQ ID NO: 4129424 - DNA, 16 bp, Homo sapiens
caccagccatcctccc

SEQ ID NO: 4129425 - DNA, 18 bp, Homo sapiens
caccagcccggcctgctc

SEQ ID NO: 4129426 - DNA, 16 bp, Homo sapiens
caccagccctgcagcc

SEQ ID NO: 4129427 - DNA, 20 bp, Homo sapiens
caccagccctgcagcccacc

SEQ ID NO: 4129428 - DNA, 17 bp, Homo sapiens
caccagccgccccagcc

SEQ ID NO: 4129429 - DNA, 18 bp, Homo sapiens
caccagccgccccagccc

SEQ ID NO: 4129430 - DNA, 16 bp, Homo sapiens
caccagccttggtgcc

SEQ ID NO: 4129431 - DNA, 20 bp, Homo sapiens
caccagccttggtgccacca

SEQ ID NO: 4129432 - DNA, 13 bp, Homo sapiens
caccagcttcact

SEQ ID NO: 4129433 - DNA, 19 bp, Homo sapiens
caccaggacttggggtcag

SEQ ID NO: 4129434 - DNA, 20 bp, Homo sapiens
caccaggacttggggtcagg

SEQ ID NO: 4129435 - DNA, 19 bp, Homo sapiens
caccaggagaaccactaca

SEQ ID NO: 4129436 - DNA, 13 bp, Homo sapiens
caccaggatggcc

SEQ ID NO: 4129437 - DNA, 23 bp, Homo sapiens
caccaggccgggcttgggccctg

SEQ ID NO: 4129438 - DNA, 17 bp, Homo sapiens
caccaggccgtgccttg

SEQ ID NO: 4129439 - DNA, 16 bp, Homo sapiens
caccagggccaaaagc

SEQ ID NO: 4129440 - DNA, 20 bp, Homo sapiens
caccaggtagaacgccaggg

SEQ ID NO: 4129441 - DNA, 15 bp, Homo sapiens
caccaggtgtcagga

SEQ ID NO: 4129442 - DNA, 23 bp, Homo sapiens
caccagtcacatgacctgatcac

SEQ ID NO: 4129443 - DNA, 15 bp, Homo sapiens
caccagtgacctgga

SEQ ID NO: 4129444 - DNA, 15 bp, Homo sapiens
caccagtggcctcgt

SEQ ID NO: 4129445 - DNA, 13 bp, Homo sapiens
caccagtgtcccc

SEQ ID NO: 4129446 - DNA, 17 bp, Homo sapiens
caccatactccttgctt

SEQ ID NO: 4129447 - DNA, 18 bp, Homo sapiens
caccatactccttgcttc

SEQ ID NO: 4129448 - DNA, 14 bp, Homo sapiens
caccatatgaattg

SEQ ID NO: 4129449 - DNA, 15 bp, Homo sapiens
caccatatgaattgt

SEQ ID NO: 4129450 - DNA, 19 bp, Homo sapiens
caccatatgaattgtacag

SEQ ID NO: 4129451 - DNA, 20 bp, Homo sapiens
caccatatgaattgtacaga

SEQ ID NO: 4129452 - DNA, 13 bp, Homo sapiens
caccatgtattca

SEQ ID NO: 4129453 - DNA, 14 bp, Homo sapiens
caccatgtgggcac

SEQ ID NO: 4129454 - DNA, 19 bp, Homo sapiens
caccatgtgggcacggagg

SEQ ID NO: 4129455 - DNA, 19 bp, Homo sapiens
cacccaaatcacatctcac

SEQ ID NO: 4129456 - DNA, 22 bp, Homo sapiens
cacccaaatcacatctcacctc

SEQ ID NO: 4129457 - DNA, 18 bp, Homo sapiens
cacccacacagctgccct

SEQ ID NO: 4129458 - DNA, 15 bp, Homo sapiens
cacccacaggcatgt

SEQ ID NO: 4129459 - DNA, 16 bp, Homo sapiens
cacccaccgtggagga

SEQ ID NO: 4129460 - DNA, 12 bp, Homo sapiens
cacccacctcca

SEQ ID NO: 4129461 - DNA, 13 bp, Homo sapiens
cacccactcagga

SEQ ID NO: 4129462 - DNA, 17 bp, Homo sapiens
cacccactcccttcccc

SEQ ID NO: 4129463 - DNA, 15 bp, Homo sapiens
cacccagagcacccc

SEQ ID NO: 4129464 - DNA, 17 bp, Homo sapiens
cacccagagcaccccct

SEQ ID NO: 4129465 - DNA, 12 bp, Homo sapiens
cacccagcctgg

SEQ ID NO: 4129466 - DNA, 14 bp, Homo sapiens
cacccagctccagg

SEQ ID NO: 4129467 - DNA, 18 bp, Homo sapiens
cacccaggaactcctgac

SEQ ID NO: 4129468 - DNA, 15 bp, Homo sapiens
cacccagtcacctcc

SEQ ID NO: 4129469 - DNA, 14 bp, Homo sapiens
cacccagtgggaag

SEQ ID NO: 4129470 - DNA, 15 bp, Homo sapiens
cacccataaacagta

SEQ ID NO: 4129471 - DNA, 16 bp, Homo sapiens
cacccataaacagtaa

SEQ ID NO: 4129472 - DNA, 18 bp, Homo sapiens
caccccaaagctttcctg

SEQ ID NO: 4129473 - DNA, 19 bp, Homo sapiens
caccccaaagctttcctgc

SEQ ID NO: 4129474 - DNA, 15 bp, Homo sapiens
caccccacaccccag

SEQ ID NO: 4129475 - DNA, 16 bp, Homo sapiens
caccccacaccccagc

SEQ ID NO: 4129476 - DNA, 18 bp, Homo sapiens
caccccacaccccagccc

SEQ ID NO: 4129477 - DNA, 12 bp, Homo sapiens
caccccacactt

SEQ ID NO: 4129478 - DNA, 15 bp, Homo sapiens
caccccacagaacct

SEQ ID NO: 4129479 - DNA, 16 bp, Homo sapiens
caccccacagaacctt

SEQ ID NO: 4129480 - DNA, 13 bp, Homo sapiens
caccccaccctcc

SEQ ID NO: 4129481 - DNA, 14 bp, Homo sapiens
caccccagcccacc

SEQ ID NO: 4129482 - DNA, 11 bp, Homo sapiens
caccccagcct

SEQ ID NO: 4129483 - DNA, 16 bp, Homo sapiens
caccccagcctcgcct

SEQ ID NO: 4129484 - DNA, 17 bp, Homo sapiens
caccccagcctcgcctg

SEQ ID NO: 4129485 - DNA, 15 bp, Homo sapiens
caccccatcccacac

SEQ ID NO: 4129486 - DNA, 12 bp, Homo sapiens
caccccatgcca

SEQ ID NO: 4129487 - DNA, 17 bp, Homo sapiens
cacccccacccacctcc

SEQ ID NO: 4129488 - DNA, 13 bp, Homo sapiens
caccccccacaca

SEQ ID NO: 4129489 - DNA, 16 bp, Homo sapiens
caccccccacacacac

SEQ ID NO: 4129490 - DNA, 18 bp, Homo sapiens
caccccctcaagccccag

SEQ ID NO: 4129491 - DNA, 16 bp, Homo sapiens
caccccctgccctgca

SEQ ID NO: 4129492 - DNA, 19 bp, Homo sapiens
caccccctgctccaccagc

SEQ ID NO: 4129493 - DNA, 13 bp, Homo sapiens
cacccccttcccc

SEQ ID NO: 4129494 - DNA, 19 bp, Homo sapiens
caccccggcctcagggcgc

SEQ ID NO: 4129495 - DNA, 18 bp, Homo sapiens
caccccgggctctctgct

SEQ ID NO: 4129496 - DNA, 15 bp, Homo sapiens
cacccctaaagagat

SEQ ID NO: 4129497 - DNA, 16 bp, Homo sapiens
cacccctacacacacc

SEQ ID NO: 4129498 - DNA, 16 bp, Homo sapiens
cacccctagccaccag

SEQ ID NO: 4129499 - DNA, 21 bp, Homo sapiens
cacccctagccaccagtgtcc

SEQ ID NO: 4129500 - DNA, 13 bp, Homo sapiens
cacccctcactcc

SEQ ID NO: 4129501 - DNA, 19 bp, Homo sapiens
cacccctcactccccaggg

SEQ ID NO: 4129502 - DNA, 17 bp, Homo sapiens
cacccctcactctggcc

SEQ ID NO: 4129503 - DNA, 22 bp, Homo sapiens
cacccctccagaacacggctca

SEQ ID NO: 4129504 - DNA, 15 bp, Homo sapiens
cacccctgagccagc

SEQ ID NO: 4129505 - DNA, 13 bp, Homo sapiens
cacccctgcacag

SEQ ID NO: 4129506 - DNA, 16 bp, Homo sapiens
cacccctgggcaggcg

SEQ ID NO: 4129507 - DNA, 22 bp, Homo sapiens
cacccctgggccagcggggctg

SEQ ID NO: 4129508 - DNA, 18 bp, Homo sapiens
caccccttatccaggact

SEQ ID NO: 4129509 - DNA, 20 bp, Homo sapiens
caccccttatccaggactct

SEQ ID NO: 4129510 - DNA, 21 bp, Homo sapiens
caccccttctctcctccccaa

SEQ ID NO: 4129511 - DNA, 13 bp, Homo sapiens
cacccgacctggc

SEQ ID NO: 4129512 - DNA, 23 bp, Homo sapiens
cacccggcctggatgccagctgt

SEQ ID NO: 4129513 - DNA, 17 bp, Homo sapiens
cacccgtggtggctcaa

SEQ ID NO: 4129514 - DNA, 18 bp, Homo sapiens
cacccgttctgctggcct

SEQ ID NO: 4129515 - DNA, 20 bp, Homo sapiens
cacccgttctgctggcctgg

SEQ ID NO: 4129516 - DNA, 21 bp, Homo sapiens
cacccgttctgctggcctgga

SEQ ID NO: 4129517 - DNA, 16 bp, Homo sapiens
caccctagtcccttcc

SEQ ID NO: 4129518 - DNA, 13 bp, Homo sapiens
caccctcagggag

SEQ ID NO: 4129519 - DNA, 18 bp, Homo sapiens
caccctcagggagcctcc

SEQ ID NO: 4129520 - DNA, 17 bp, Homo sapiens
caccctcattctactga

SEQ ID NO: 4129521 - DNA, 14 bp, Homo sapiens
caccctccatgctc

SEQ ID NO: 4129522 - DNA, 21 bp, Homo sapiens
caccctccatgctcctcacct

SEQ ID NO: 4129523 - DNA, 22 bp, Homo sapiens
caccctccatgctcctcacctg

SEQ ID NO: 4129524 - DNA, 20 bp, Homo sapiens
caccctcccccgccactcct

SEQ ID NO: 4129525 - DNA, 14 bp, Homo sapiens
caccctccctggag

SEQ ID NO: 4129526 - DNA, 20 bp, Homo sapiens
caccctcctcctcttcacca

SEQ ID NO: 4129527 - DNA, 13 bp, Homo sapiens
caccctcctgccc

SEQ ID NO: 4129528 - DNA, 18 bp, Homo sapiens
caccctcctgccccacac

SEQ ID NO: 4129529 - DNA, 19 bp, Homo sapiens
caccctcctgccccacact

SEQ ID NO: 4129530 - DNA, 12 bp, Homo sapiens
caccctccttcc

SEQ ID NO: 4129531 - DNA, 22 bp, Homo sapiens
caccctccttcccactcttctc

SEQ ID NO: 4129532 - DNA, 18 bp, Homo sapiens
caccctgaatggttccat

SEQ ID NO: 4129533 - DNA, 17 bp, Homo sapiens
caccctgaggtcaggga

SEQ ID NO: 4129534 - DNA, 20 bp, Homo sapiens
caccctgaggtcagggagtg

SEQ ID NO: 4129535 - DNA, 18 bp, Homo sapiens
caccctgccttatcttgc

SEQ ID NO: 4129536 - DNA, 19 bp, Homo sapiens
caccctgccttatcttgca

SEQ ID NO: 4129537 - DNA, 14 bp, Homo sapiens
caccctgcgcctcc

SEQ ID NO: 4129538 - DNA, 15 bp, Homo sapiens
caccctgcgcctcca

SEQ ID NO: 4129539 - DNA, 18 bp, Homo sapiens
caccctgcgcctccagag

SEQ ID NO: 4129540 - DNA, 19 bp, Homo sapiens
caccctgcgcctccagagg

SEQ ID NO: 4129541 - DNA, 22 bp, Homo sapiens
caccctggccgagtccaagctg

SEQ ID NO: 4129542 - DNA, 13 bp, Homo sapiens
caccctggcctga

SEQ ID NO: 4129543 - DNA, 15 bp, Homo sapiens
caccctgggagccag

SEQ ID NO: 4129544 - DNA, 16 bp, Homo sapiens
caccctgggagccagt

SEQ ID NO: 4129545 - DNA, 16 bp, Homo sapiens
caccctggggaccccc

SEQ ID NO: 4129546 - DNA, 13 bp, Homo sapiens
caccctggggcct

SEQ ID NO: 4129547 - DNA, 16 bp, Homo sapiens
caccctggtgggccaa

SEQ ID NO: 4129548 - DNA, 16 bp, Homo sapiens
caccctgtactgttct

SEQ ID NO: 4129549 - DNA, 22 bp, Homo sapiens
caccctgtcaagttaacaagga

SEQ ID NO: 4129550 - DNA, 14 bp, Homo sapiens
cacccttcagaccc

SEQ ID NO: 4129551 - DNA, 16 bp, Homo sapiens
cacccttcagacccca

SEQ ID NO: 4129552 - DNA, 13 bp, Homo sapiens
cacccttcccctc

SEQ ID NO: 4129553 - DNA, 14 bp, Homo sapiens
cacccttcccctcc

SEQ ID NO: 4129554 - DNA, 23 bp, Homo sapiens
cacccttcccctccttctccctt

SEQ ID NO: 4129555 - DNA, 16 bp, Homo sapiens
caccctttgccttagc

SEQ ID NO: 4129556 - DNA, 22 bp, Homo sapiens
caccctttgctgtgaggctgtc

SEQ ID NO: 4129557 - DNA, 21 bp, Homo sapiens
caccgaagtggactggcccct

SEQ ID NO: 4129558 - DNA, 14 bp, Homo sapiens
caccgaccaactgc

SEQ ID NO: 4129559 - DNA, 17 bp, Homo sapiens
caccgaccaactgccct

SEQ ID NO: 4129560 - DNA, 23 bp, Homo sapiens
caccgaccaactgccctaagccc

SEQ ID NO: 4129561 - DNA, 14 bp, Homo sapiens
caccgagctggagc

SEQ ID NO: 4129562 - DNA, 12 bp, Homo sapiens
caccgagtgggg

SEQ ID NO: 4129563 - DNA, 16 bp, Homo sapiens
caccgcagtcaccacc

SEQ ID NO: 4129564 - DNA, 14 bp, Homo sapiens
caccgcccatcagg

SEQ ID NO: 4129565 - DNA, 21 bp, Homo sapiens
caccgcggcgcttcccagcac

SEQ ID NO: 4129566 - DNA, 17 bp, Homo sapiens
caccgctgccagcacag

SEQ ID NO: 4129567 - DNA, 19 bp, Homo sapiens
caccgggacagacctggac

SEQ ID NO: 4129568 - DNA, 13 bp, Homo sapiens
caccgggagcctc

SEQ ID NO: 4129569 - DNA, 21 bp, Homo sapiens
caccgggagcctccccctcag

SEQ ID NO: 4129570 - DNA, 13 bp, Homo sapiens
caccgggcctgga

SEQ ID NO: 4129571 - DNA, 14 bp, Homo sapiens
caccggtcagtgcc

SEQ ID NO: 4129572 - DNA, 15 bp, Homo sapiens
caccggtcagtgcct

SEQ ID NO: 4129573 - DNA, 22 bp, Homo sapiens
caccgtacatctgcaatatgaa

SEQ ID NO: 4129574 - DNA, 17 bp, Homo sapiens
caccgtgaaccagaggg

SEQ ID NO: 4129575 - DNA, 15 bp, Homo sapiens
caccgtgcctggcca

SEQ ID NO: 4129576 - DNA, 14 bp, Homo sapiens
caccgtgcctggct

SEQ ID NO: 4129577 - DNA, 15 bp, Homo sapiens
caccgtgtaaaccaa

SEQ ID NO: 4129578 - DNA, 16 bp, Homo sapiens
caccgtgtaaaccaaa

SEQ ID NO: 4129579 - DNA, 14 bp, Homo sapiens
caccgttctgtgca

SEQ ID NO: 4129580 - DNA, 15 bp, Homo sapiens
caccgttctgtgcac

SEQ ID NO: 4129581 - DNA, 21 bp, Homo sapiens
cacctaaaggtgtatttaaac

SEQ ID NO: 4129582 - DNA, 22 bp, Homo sapiens
cacctaatccaggcagatccag

SEQ ID NO: 4129583 - DNA, 14 bp, Homo sapiens
cacctaatgtttat

SEQ ID NO: 4129584 - DNA, 21 bp, Homo sapiens
cacctactatgtgctgggtgc

SEQ ID NO: 4129585 - DNA, 23 bp, Homo sapiens
cacctagacaaacaagggagaag

SEQ ID NO: 4129586 - DNA, 14 bp, Homo sapiens
cacctagcagcacc

SEQ ID NO: 4129587 - DNA, 16 bp, Homo sapiens
cacctagctttattct

SEQ ID NO: 4129588 - DNA, 20 bp, Homo sapiens
cacctatctcgtgggagagc

SEQ ID NO: 4129589 - DNA, 15 bp, Homo sapiens
cacctcaccaaggat

SEQ ID NO: 4129590 - DNA, 17 bp, Homo sapiens
cacctcacccggcctct

SEQ ID NO: 4129591 - DNA, 14 bp, Homo sapiens
cacctcactcctgt

SEQ ID NO: 4129592 - DNA, 11 bp, Homo sapiens
cacctcagaaa

SEQ ID NO: 4129593 - DNA, 11 bp, Homo sapiens
cacctcagggc

SEQ ID NO: 4129594 - DNA, 11 bp, Homo sapiens
cacctcagttc

SEQ ID NO: 4129595 - DNA, 22 bp, Homo sapiens
cacctcagttcccttggcctca

SEQ ID NO: 4129596 - DNA, 16 bp, Homo sapiens
cacctcatgcccaccc

SEQ ID NO: 4129597 - DNA, 17 bp, Homo sapiens
cacctcatgcccacccc

SEQ ID NO: 4129598 - DNA, 18 bp, Homo sapiens
cacctcatgcccaccccc

SEQ ID NO: 4129599 - DNA, 20 bp, Homo sapiens
cacctcatgcccaccccctg

SEQ ID NO: 4129600 - DNA, 18 bp, Homo sapiens
cacctccaccacatctgc

SEQ ID NO: 4129601 - DNA, 20 bp, Homo sapiens
cacctccacccagcccctgg

SEQ ID NO: 4129602 - DNA, 14 bp, Homo sapiens
cacctccactccca

SEQ ID NO: 4129603 - DNA, 15 bp, Homo sapiens
cacctccactcccac

SEQ ID NO: 4129604 - DNA, 12 bp, Homo sapiens
cacctcccaccc

SEQ ID NO: 4129605 - DNA, 22 bp, Homo sapiens
cacctccccacatcgcacactg

SEQ ID NO: 4129606 - DNA, 11 bp, Homo sapiens
cacctccccca

SEQ ID NO: 4129607 - DNA, 12 bp, Homo sapiens
cacctccctccc

SEQ ID NO: 4129608 - DNA, 14 bp, Homo sapiens
cacctcctcatgta

SEQ ID NO: 4129609 - DNA, 14 bp, Homo sapiens
cacctctagcctta

SEQ ID NO: 4129610 - DNA, 14 bp, Homo sapiens
cacctctccaggtg

SEQ ID NO: 4129611 - DNA, 16 bp, Homo sapiens
cacctctccaggtgct

SEQ ID NO: 4129612 - DNA, 19 bp, Homo sapiens
cacctctccctcaacaagg

SEQ ID NO: 4129613 - DNA, 17 bp, Homo sapiens
cacctctcctgccctgt

SEQ ID NO: 4129614 - DNA, 13 bp, Homo sapiens
cacctctgtggca

SEQ ID NO: 4129615 - DNA, 13 bp, Homo sapiens
cacctgacacatc

SEQ ID NO: 4129616 - DNA, 21 bp, Homo sapiens
cacctgacgctgcatgagaca

SEQ ID NO: 4129617 - DNA, 21 bp, Homo sapiens
cacctgagcccggatgcttct

SEQ ID NO: 4129618 - DNA, 23 bp, Homo sapiens
cacctgagcccggatgcttctcc

SEQ ID NO: 4129619 - DNA, 12 bp, Homo sapiens
cacctgcacact

SEQ ID NO: 4129620 - DNA, 15 bp, Homo sapiens
cacctgcacactcca

SEQ ID NO: 4129621 - DNA, 19 bp, Homo sapiens
cacctgcacactccatctc

SEQ ID NO: 4129622 - DNA, 20 bp, Homo sapiens
cacctgcacactccatctcc

SEQ ID NO: 4129623 - DNA, 23 bp, Homo sapiens
cacctgcacactccatctcctgc

SEQ ID NO: 4129624 - DNA, 23 bp, Homo sapiens
cacctgcagattctaggacctgt

SEQ ID NO: 4129625 - DNA, 12 bp, Homo sapiens
cacctgcagctc

SEQ ID NO: 4129626 - DNA, 18 bp, Homo sapiens
cacctgcccatcacaggg

SEQ ID NO: 4129627 - DNA, 22 bp, Homo sapiens
cacctgcccatcacagggttgg

SEQ ID NO: 4129628 - DNA, 15 bp, Homo sapiens
cacctgccccaactc

SEQ ID NO: 4129629 - DNA, 12 bp, Homo sapiens
cacctgccctgc

SEQ ID NO: 4129630 - DNA, 14 bp, Homo sapiens
cacctgccctgccc

SEQ ID NO: 4129631 - DNA, 14 bp, Homo sapiens
cacctgcctcctcg

SEQ ID NO: 4129632 - DNA, 20 bp, Homo sapiens
cacctgcctctaatctgagc

SEQ ID NO: 4129633 - DNA, 17 bp, Homo sapiens
cacctgccttggcctcc

SEQ ID NO: 4129634 - DNA, 18 bp, Homo sapiens
cacctgccttggcctccc

SEQ ID NO: 4129635 - DNA, 15 bp, Homo sapiens
cacctgctccagaag

SEQ ID NO: 4129636 - DNA, 14 bp, Homo sapiens
cacctgctctgctg

SEQ ID NO: 4129637 - DNA, 19 bp, Homo sapiens
cacctgcttctctgcccag

SEQ ID NO: 4129638 - DNA, 15 bp, Homo sapiens
cacctggctgagcag

SEQ ID NO: 4129639 - DNA, 22 bp, Homo sapiens
cacctggctgagcagttcccct

SEQ ID NO: 4129640 - DNA, 23 bp, Homo sapiens
cacctggctgaggttcctctgcc

SEQ ID NO: 4129641 - DNA, 21 bp, Homo sapiens
cacctgggacagggagcagcc

SEQ ID NO: 4129642 - DNA, 15 bp, Homo sapiens
cacctgggccctgga

SEQ ID NO: 4129643 - DNA, 18 bp, Homo sapiens
cacctgggcgtcatctgg

SEQ ID NO: 4129644 - DNA, 18 bp, Homo sapiens
cacctgtaaagtgcctta

SEQ ID NO: 4129645 - DNA, 16 bp, Homo sapiens
cacctgtagtcccagc

SEQ ID NO: 4129646 - DNA, 17 bp, Homo sapiens
cacctgtagtcccagct

SEQ ID NO: 4129647 - DNA, 15 bp, Homo sapiens
cacctgtctcagcct

SEQ ID NO: 4129648 - DNA, 19 bp, Homo sapiens
cacctgtctcagcctccca

SEQ ID NO: 4129649 - DNA, 20 bp, Homo sapiens
cacctgtctgctccagctct

SEQ ID NO: 4129650 - DNA, 22 bp, Homo sapiens
cacctgtggaacataaaaagga

SEQ ID NO: 4129651 - DNA, 10 bp, Homo sapiens
cacctgtggg

SEQ ID NO: 4129652 - DNA, 20 bp, Homo sapiens
cacctgtgggtgtagccagg

SEQ ID NO: 4129653 - DNA, 20 bp, Homo sapiens
cacctgtttttaagctgttt

SEQ ID NO: 4129654 - DNA, 15 bp, Homo sapiens
caccttccagctcct

SEQ ID NO: 4129655 - DNA, 15 bp, Homo sapiens
caccttccagggccc

SEQ ID NO: 4129656 - DNA, 18 bp, Homo sapiens
caccttccagggccctag

SEQ ID NO: 4129657 - DNA, 14 bp, Homo sapiens
caccttcctcactt

SEQ ID NO: 4129658 - DNA, 16 bp, Homo sapiens
caccttcctgtgggtg

SEQ ID NO: 4129659 - DNA, 21 bp, Homo sapiens
caccttctagtcttggccagc

SEQ ID NO: 4129660 - DNA, 19 bp, Homo sapiens
caccttctgtccccagccc

SEQ ID NO: 4129661 - DNA, 20 bp, Homo sapiens
caccttctgtccccagccct

SEQ ID NO: 4129662 - DNA, 22 bp, Homo sapiens
caccttgaagaacctctcactt

SEQ ID NO: 4129663 - DNA, 23 bp, Homo sapiens
caccttgatcccaatccttatcc

SEQ ID NO: 4129664 - DNA, 17 bp, Homo sapiens
caccttggcaccagaca

SEQ ID NO: 4129665 - DNA, 16 bp, Homo sapiens
caccttggctctgcca

SEQ ID NO: 4129666 - DNA, 19 bp, Homo sapiens
caccttggctctgccagtg

SEQ ID NO: 4129667 - DNA, 14 bp, Homo sapiens
caccttttctgtgg

SEQ ID NO: 4129668 - DNA, 17 bp, Homo sapiens
caccttttctgtggctg

SEQ ID NO: 4129669 - DNA, 14 bp, Homo sapiens
caccttttttccta

SEQ ID NO: 4129670 - DNA, 16 bp, Homo sapiens
cacgaaatgttatttt

SEQ ID NO: 4129671 - DNA, 18 bp, Homo sapiens
cacgaagccttaagccat

SEQ ID NO: 4129672 - DNA, 22 bp, Homo sapiens
cacgaatttgctggggaatctc

SEQ ID NO: 4129673 - DNA, 17 bp, Homo sapiens
cacgactggccagggcc

SEQ ID NO: 4129674 - DNA, 11 bp, Homo sapiens
cacgagggctg

SEQ ID NO: 4129675 - DNA, 12 bp, Homo sapiens
cacgagggctgg

SEQ ID NO: 4129676 - DNA, 16 bp, Homo sapiens
cacgattggccacctg

SEQ ID NO: 4129677 - DNA, 13 bp, Homo sapiens
cacgcaacttgaa

SEQ ID NO: 4129678 - DNA, 13 bp, Homo sapiens
cacgcacaaacac

SEQ ID NO: 4129679 - DNA, 16 bp, Homo sapiens
cacgcacaaacacaca

SEQ ID NO: 4129680 - DNA, 15 bp, Homo sapiens
cacgcacacacacaa

SEQ ID NO: 4129681 - DNA, 12 bp, Homo sapiens
cacgcacgcaca

SEQ ID NO: 4129682 - DNA, 18 bp, Homo sapiens
cacgcactgggccacgga

SEQ ID NO: 4129683 - DNA, 21 bp, Homo sapiens
cacgcactgggccacggagga

SEQ ID NO: 4129684 - DNA, 23 bp, Homo sapiens
cacgcactgggccacggaggagg

SEQ ID NO: 4129685 - DNA, 14 bp, Homo sapiens
cacgcactggtgcc

SEQ ID NO: 4129686 - DNA, 15 bp, Homo sapiens
cacgcactggtgcca

SEQ ID NO: 4129687 - DNA, 13 bp, Homo sapiens
cacgcaggaactc

SEQ ID NO: 4129688 - DNA, 19 bp, Homo sapiens
cacgcaggaactcccagca

SEQ ID NO: 4129689 - DNA, 13 bp, Homo sapiens
cacgccccagccc

SEQ ID NO: 4129690 - DNA, 18 bp, Homo sapiens
cacgcctcctggccagac

SEQ ID NO: 4129691 - DNA, 16 bp, Homo sapiens
cacgcctgtaatccca

SEQ ID NO: 4129692 - DNA, 15 bp, Homo sapiens
cacgcgggggccttg

SEQ ID NO: 4129693 - DNA, 12 bp, Homo sapiens
cacgctcaccca

SEQ ID NO: 4129694 - DNA, 13 bp, Homo sapiens
cacgctcacccag

SEQ ID NO: 4129695 - DNA, 13 bp, Homo sapiens
cacgctccagctg

SEQ ID NO: 4129696 - DNA, 18 bp, Homo sapiens
cacgctccagctgccccg

SEQ ID NO: 4129697 - DNA, 22 bp, Homo sapiens
cacgctcgcgggcagcgggcca

SEQ ID NO: 4129698 - DNA, 22 bp, Homo sapiens
cacgctggggctctctgagact

SEQ ID NO: 4129699 - DNA, 18 bp, Homo sapiens
cacgctgtcctctcgagc

SEQ ID NO: 4129700 - DNA, 13 bp, Homo sapiens
cacggagacagag

SEQ ID NO: 4129701 - DNA, 19 bp, Homo sapiens
cacggagcccagccctccc

SEQ ID NO: 4129702 - DNA, 20 bp, Homo sapiens
cacggaggagggatgctgct

SEQ ID NO: 4129703 - DNA, 22 bp, Homo sapiens
cacggagggggacggggctcag

SEQ ID NO: 4129704 - DNA, 13 bp, Homo sapiens
cacggccacatca

SEQ ID NO: 4129705 - DNA, 15 bp, Homo sapiens
cacggccacccgccc

SEQ ID NO: 4129706 - DNA, 23 bp, Homo sapiens
cacggctgagccttcagagtacg

SEQ ID NO: 4129707 - DNA, 18 bp, Homo sapiens
cacgggacggaagtgctt

SEQ ID NO: 4129708 - DNA, 15 bp, Homo sapiens
cacgggagatttctt

SEQ ID NO: 4129709 - DNA, 21 bp, Homo sapiens
cacggggttccctcctagctc

SEQ ID NO: 4129710 - DNA, 22 bp, Homo sapiens
cacggggttccctcctagctct

SEQ ID NO: 4129711 - DNA, 22 bp, Homo sapiens
cacggtatttatagagagagac

SEQ ID NO: 4129712 - DNA, 20 bp, Homo sapiens
cacggtcacacggccacccg

SEQ ID NO: 4129713 - DNA, 22 bp, Homo sapiens
cacgtaagatacaagtttcaga

SEQ ID NO: 4129714 - DNA, 15 bp, Homo sapiens
cacgtacaaaatcca

SEQ ID NO: 4129715 - DNA, 22 bp, Homo sapiens
cacgtcccagcatccctggagc

SEQ ID NO: 4129716 - DNA, 12 bp, Homo sapiens
cacgtctggcca

SEQ ID NO: 4129717 - DNA, 22 bp, Homo sapiens
cacgtctggccaggcactgcct

SEQ ID NO: 4129718 - DNA, 16 bp, Homo sapiens
cacgtcttggtgcctt

SEQ ID NO: 4129719 - DNA, 18 bp, Homo sapiens
cacgtcttggtgcctttt

SEQ ID NO: 4129720 - DNA, 13 bp, Homo sapiens
cacgtggagagct

SEQ ID NO: 4129721 - DNA, 12 bp, Homo sapiens
cacgtggcctct

SEQ ID NO: 4129722 - DNA, 13 bp, Homo sapiens
cacgtggcctctt

SEQ ID NO: 4129723 - DNA, 17 bp, Homo sapiens
cacgtggcctcttgagc

SEQ ID NO: 4129724 - DNA, 16 bp, Homo sapiens
cacgtgggctcatatg

SEQ ID NO: 4129725 - DNA, 16 bp, Homo sapiens
cacgtggtcactgtgc

SEQ ID NO: 4129726 - DNA, 17 bp, Homo sapiens
cacgtggtcactgtgca

SEQ ID NO: 4129727 - DNA, 22 bp, Homo sapiens
cacgtggtcactgtgcactgcc

SEQ ID NO: 4129728 - DNA, 18 bp, Homo sapiens
cacgttccacagttgcca

SEQ ID NO: 4129729 - DNA, 22 bp, Homo sapiens
cactaaaaatattgtttctgca

SEQ ID NO: 4129730 - DNA, 15 bp, Homo sapiens
cactaaaattttagg

SEQ ID NO: 4129731 - DNA, 12 bp, Homo sapiens
cactaaagcagt

SEQ ID NO: 4129732 - DNA, 15 bp, Homo sapiens
cactaaagccagcct

SEQ ID NO: 4129733 - DNA, 21 bp, Homo sapiens
cactaaagccagcctgacctt

SEQ ID NO: 4129734 - DNA, 15 bp, Homo sapiens
cactaaagcttcaga

SEQ ID NO: 4129735 - DNA, 15 bp, Homo sapiens
cactaaatgagctcc

SEQ ID NO: 4129736 - DNA, 16 bp, Homo sapiens
cactaaatgagctcct

SEQ ID NO: 4129737 - DNA, 20 bp, Homo sapiens
cactaacgttgagcccctgg

SEQ ID NO: 4129738 - DNA, 19 bp, Homo sapiens
cactaagagaaaattgcac

SEQ ID NO: 4129739 - DNA, 15 bp, Homo sapiens
cactaagagggcaga

SEQ ID NO: 4129740 - DNA, 14 bp, Homo sapiens
cactaagttatagt

SEQ ID NO: 4129741 - DNA, 22 bp, Homo sapiens
cactaagttatagtatatctgg

SEQ ID NO: 4129742 - DNA, 16 bp, Homo sapiens
cactaatctgaaagga

SEQ ID NO: 4129743 - DNA, 17 bp, Homo sapiens
cactaatttgatgttta

SEQ ID NO: 4129744 - DNA, 23 bp, Homo sapiens
cactacacctggctgaggttcct

SEQ ID NO: 4129745 - DNA, 19 bp, Homo sapiens
cactacagagcagctcccc

SEQ ID NO: 4129746 - DNA, 22 bp, Homo sapiens
cactacagagcagctccccagg

SEQ ID NO: 4129747 - DNA, 15 bp, Homo sapiens
cactacatgcagccc

SEQ ID NO: 4129748 - DNA, 17 bp, Homo sapiens
cactaccaaaggacact

SEQ ID NO: 4129749 - DNA, 16 bp, Homo sapiens
cactaccccacaccag

SEQ ID NO: 4129750 - DNA, 17 bp, Homo sapiens
cactaccccacaccagc

SEQ ID NO: 4129751 - DNA, 17 bp, Homo sapiens
cactaccccatatacac

SEQ ID NO: 4129752 - DNA, 21 bp, Homo sapiens
cactaccccatatacacctgg

SEQ ID NO: 4129753 - DNA, 17 bp, Homo sapiens
cactactcacagtctct

SEQ ID NO: 4129754 - DNA, 12 bp, Homo sapiens
cactactgcagc

SEQ ID NO: 4129755 - DNA, 17 bp, Homo sapiens
cactactgctaaatcct

SEQ ID NO: 4129756 - DNA, 16 bp, Homo sapiens
cactactgggtgtcat

SEQ ID NO: 4129757 - DNA, 20 bp, Homo sapiens
cactagaaaagctgatcata

SEQ ID NO: 4129758 - DNA, 16 bp, Homo sapiens
cactagcctctccagg

SEQ ID NO: 4129759 - DNA, 21 bp, Homo sapiens
cactaggggatataggagagg

SEQ ID NO: 4129760 - DNA, 16 bp, Homo sapiens
cactaggtaacttatt

SEQ ID NO: 4129761 - DNA, 17 bp, Homo sapiens
cactagtgtcaggcccc

SEQ ID NO: 4129762 - DNA, 18 bp, Homo sapiens
cactagtgtcaggccccc

SEQ ID NO: 4129763 - DNA, 21 bp, Homo sapiens
cactagtgtcaggcccccagt

SEQ ID NO: 4129764 - DNA, 22 bp, Homo sapiens
cactagtgtcaggcccccagtg

SEQ ID NO: 4129765 - DNA, 17 bp, Homo sapiens
cactagttttgtgccag

SEQ ID NO: 4129766 - DNA, 17 bp, Homo sapiens
cactataaggctgaggg

SEQ ID NO: 4129767 - DNA, 18 bp, Homo sapiens
cactataaggctgagggc

SEQ ID NO: 4129768 - DNA, 14 bp, Homo sapiens
cactataatgtaag

SEQ ID NO: 4129769 - DNA, 19 bp, Homo sapiens
cactatctccgttccatct

SEQ ID NO: 4129770 - DNA, 12 bp, Homo sapiens
cactatcttctt

SEQ ID NO: 4129771 - DNA, 14 bp, Homo sapiens
cactatcttcttca

SEQ ID NO: 4129772 - DNA, 15 bp, Homo sapiens
cactatgacactgag

SEQ ID NO: 4129773 - DNA, 17 bp, Homo sapiens
cactatggtatttgagt

SEQ ID NO: 4129774 - DNA, 22 bp, Homo sapiens
cactatttttatttatattttt

SEQ ID NO: 4129775 - DNA, 23 bp, Homo sapiens
cactatttttatttatatttttg

SEQ ID NO: 4129776 - DNA, 16 bp, Homo sapiens
cactcaaattaatctt

SEQ ID NO: 4129777 - DNA, 19 bp, Homo sapiens
cactcaactctgagcccat

SEQ ID NO: 4129778 - DNA, 20 bp, Homo sapiens
cactcaactctgagcccata

SEQ ID NO: 4129779 - DNA, 13 bp, Homo sapiens
cactcaagcactg

SEQ ID NO: 4129780 - DNA, 13 bp, Homo sapiens
cactcaataaatt

SEQ ID NO: 4129781 - DNA, 14 bp, Homo sapiens
cactcaccatgaag

SEQ ID NO: 4129782 - DNA, 21 bp, Homo sapiens
cactcaccccctttgctgtga

SEQ ID NO: 4129783 - DNA, 12 bp, Homo sapiens
cactcagacctg

SEQ ID NO: 4129784 - DNA, 21 bp, Homo sapiens
cactcagagcagtctgtgact

SEQ ID NO: 4129785 - DNA, 12 bp, Homo sapiens
cactcagcacaa

SEQ ID NO: 4129786 - DNA, 19 bp, Homo sapiens
cactcaggaggctgaggca

SEQ ID NO: 4129787 - DNA, 14 bp, Homo sapiens
cactcaggcctgtg

SEQ ID NO: 4129788 - DNA, 17 bp, Homo sapiens
cactcaggcctgtgccc

SEQ ID NO: 4129789 - DNA, 18 bp, Homo sapiens
cactcagtgagcctcctg

SEQ ID NO: 4129790 - DNA, 19 bp, Homo sapiens
cactcagtgagcctcctgt

SEQ ID NO: 4129791 - DNA, 16 bp, Homo sapiens
cactcattgctgagcc

SEQ ID NO: 4129792 - DNA, 23 bp, Homo sapiens
cactcattgctgagcctctgctc

SEQ ID NO: 4129793 - DNA, 15 bp, Homo sapiens
cactccaccctccac

SEQ ID NO: 4129794 - DNA, 21 bp, Homo sapiens
cactccaccctccaccttcca

SEQ ID NO: 4129795 - DNA, 14 bp, Homo sapiens
cactccaggcctct

SEQ ID NO: 4129796 - DNA, 16 bp, Homo sapiens
cactccatctcctgct

SEQ ID NO: 4129797 - DNA, 20 bp, Homo sapiens
cactcccacctcacccggcc

SEQ ID NO: 4129798 - DNA, 18 bp, Homo sapiens
cactcccacctgcatctg

SEQ ID NO: 4129799 - DNA, 13 bp, Homo sapiens
cactccccaggga

SEQ ID NO: 4129800 - DNA, 14 bp, Homo sapiens
cactccccagggag

SEQ ID NO: 4129801 - DNA, 19 bp, Homo sapiens
cactccccatgccacgttc

SEQ ID NO: 4129802 - DNA, 22 bp, Homo sapiens
cactccccctaaacccctgtcc

SEQ ID NO: 4129803 - DNA, 12 bp, Homo sapiens
cactcccgcctc

SEQ ID NO: 4129804 - DNA, 14 bp, Homo sapiens
cactcccgcctcag

SEQ ID NO: 4129805 - DNA, 16 bp, Homo sapiens
cactccctatctcctt

SEQ ID NO: 4129806 - DNA, 12 bp, Homo sapiens
cactccctgctc

SEQ ID NO: 4129807 - DNA, 14 bp, Homo sapiens
cactccctgggaca

SEQ ID NO: 4129808 - DNA, 16 bp, Homo sapiens
cactcctaggagagcc

SEQ ID NO: 4129809 - DNA, 19 bp, Homo sapiens
cactcctaggagagccaac

SEQ ID NO: 4129810 - DNA, 14 bp, Homo sapiens
cactcctccctccg

SEQ ID NO: 4129811 - DNA, 19 bp, Homo sapiens
cactcctcctcactaaaaa

SEQ ID NO: 4129812 - DNA, 15 bp, Homo sapiens
cactcctgctctgct

SEQ ID NO: 4129813 - DNA, 12 bp, Homo sapiens
cactcctggggc

SEQ ID NO: 4129814 - DNA, 22 bp, Homo sapiens
cactcgacccagaatggagcct

SEQ ID NO: 4129815 - DNA, 22 bp, Homo sapiens
cactcgccatctcctgggccgt

SEQ ID NO: 4129816 - DNA, 22 bp, Homo sapiens
cactcggatggaccaacctgct

SEQ ID NO: 4129817 - DNA, 20 bp, Homo sapiens
cactcggtcccagttttgtt

SEQ ID NO: 4129818 - DNA, 18 bp, Homo sapiens
cactctaaaaaacatttt

SEQ ID NO: 4129819 - DNA, 17 bp, Homo sapiens
cactctaccctcccacc

SEQ ID NO: 4129820 - DNA, 18 bp, Homo sapiens
cactctaccctcccaccc

SEQ ID NO: 4129821 - DNA, 12 bp, Homo sapiens
cactctccccac

SEQ ID NO: 4129822 - DNA, 14 bp, Homo sapiens
cactctctgaagat

SEQ ID NO: 4129823 - DNA, 18 bp, Homo sapiens
cactctggatgatggatt

SEQ ID NO: 4129824 - DNA, 22 bp, Homo sapiens
cactctgtcagccagccgccct

SEQ ID NO: 4129825 - DNA, 23 bp, Homo sapiens
cactctgtcagccagccgccctg

SEQ ID NO: 4129826 - DNA, 14 bp, Homo sapiens
cactcttaaagcaa

SEQ ID NO: 4129827 - DNA, 22 bp, Homo sapiens
cactcttaaagcaaaaaatgaa

SEQ ID NO: 4129828 - DNA, 18 bp, Homo sapiens
cactcttgatctctcttg

SEQ ID NO: 4129829 - DNA, 20 bp, Homo sapiens
cactcttgatctctcttgtc

SEQ ID NO: 4129830 - DNA, 15 bp, Homo sapiens
cactctttgtaagag

SEQ ID NO: 4129831 - DNA, 15 bp, Homo sapiens
cactcttttgcttta

SEQ ID NO: 4129832 - DNA, 20 bp, Homo sapiens
cactgaaaaatctaagtgat

SEQ ID NO: 4129833 - DNA, 20 bp, Homo sapiens
cactgaaagctctgttgcaa

SEQ ID NO: 4129834 - DNA, 14 bp, Homo sapiens
cactgaagcctgcg

SEQ ID NO: 4129835 - DNA, 17 bp, Homo sapiens
cactgaaggacctgagc

SEQ ID NO: 4129836 - DNA, 23 bp, Homo sapiens
cactgaaggacctgagctggcca

SEQ ID NO: 4129837 - DNA, 15 bp, Homo sapiens
cactgaatccctgta

SEQ ID NO: 4129838 - DNA, 21 bp, Homo sapiens
cactgaatgcctcaatgtgac

SEQ ID NO: 4129839 - DNA, 13 bp, Homo sapiens
cactgaatttata

SEQ ID NO: 4129840 - DNA, 19 bp, Homo sapiens
cactgaatttataaagtac

SEQ ID NO: 4129841 - DNA, 14 bp, Homo sapiens
cactgacagcctcc

SEQ ID NO: 4129842 - DNA, 15 bp, Homo sapiens
cactgacagcctccc

SEQ ID NO: 4129843 - DNA, 16 bp, Homo sapiens
cactgacagcctccca

SEQ ID NO: 4129844 - DNA, 20 bp, Homo sapiens
cactgacagcctcccacccc

SEQ ID NO: 4129845 - DNA, 15 bp, Homo sapiens
cactgaccagaacta

SEQ ID NO: 4129846 - DNA, 16 bp, Homo sapiens
cactgaccatccactc

SEQ ID NO: 4129847 - DNA, 19 bp, Homo sapiens
cactgaccctaactgcaga

SEQ ID NO: 4129848 - DNA, 17 bp, Homo sapiens
cactgagaagattgtga

SEQ ID NO: 4129849 - DNA, 14 bp, Homo sapiens
cactgagccccacc

SEQ ID NO: 4129850 - DNA, 14 bp, Homo sapiens
cactgagctcccca

SEQ ID NO: 4129851 - DNA, 15 bp, Homo sapiens
cactgaggcagcctt

SEQ ID NO: 4129852 - DNA, 17 bp, Homo sapiens
cactgaggcagccttgg

SEQ ID NO: 4129853 - DNA, 14 bp, Homo sapiens
cactgataagactg

SEQ ID NO: 4129854 - DNA, 20 bp, Homo sapiens
cactgatatatcatgagtga

SEQ ID NO: 4129855 - DNA, 18 bp, Homo sapiens
cactgatatattttccag

SEQ ID NO: 4129856 - DNA, 17 bp, Homo sapiens
cactgatgctgcccctc

SEQ ID NO: 4129857 - DNA, 19 bp, Homo sapiens
cactgatgctgcccctcat

SEQ ID NO: 4129858 - DNA, 23 bp, Homo sapiens
cactgatgctgttctcttcttca

SEQ ID NO: 4129859 - DNA, 21 bp, Homo sapiens
cactgatttcacaacagatca

SEQ ID NO: 4129860 - DNA, 16 bp, Homo sapiens
cactgattttgtaaag

SEQ ID NO: 4129861 - DNA, 13 bp, Homo sapiens
cactgcaacctcc

SEQ ID NO: 4129862 - DNA, 14 bp, Homo sapiens
cactgcaacctccg

SEQ ID NO: 4129863 - DNA, 14 bp, Homo sapiens
cactgcaacctctg

SEQ ID NO: 4129864 - DNA, 13 bp, Homo sapiens
cactgcaccgcct

SEQ ID NO: 4129865 - DNA, 18 bp, Homo sapiens
cactgcaccgcctcaggg

SEQ ID NO: 4129866 - DNA, 13 bp, Homo sapiens
cactgcactccgg

SEQ ID NO: 4129867 - DNA, 13 bp, Homo sapiens
cactgcagacttg

SEQ ID NO: 4129868 - DNA, 13 bp, Homo sapiens
cactgcagcctca

SEQ ID NO: 4129869 - DNA, 21 bp, Homo sapiens
cactgcagcctcatactcctg

SEQ ID NO: 4129870 - DNA, 16 bp, Homo sapiens
cactgcagtcttattt

SEQ ID NO: 4129871 - DNA, 19 bp, Homo sapiens
cactgcattattctctttt

SEQ ID NO: 4129872 - DNA, 16 bp, Homo sapiens
cactgccaggccagcc

SEQ ID NO: 4129873 - DNA, 17 bp, Homo sapiens
cactgccaggccagcct

SEQ ID NO: 4129874 - DNA, 20 bp, Homo sapiens
cactgccaggccagcctccg

SEQ ID NO: 4129875 - DNA, 15 bp, Homo sapiens
cactgcccgagctgg

SEQ ID NO: 4129876 - DNA, 17 bp, Homo sapiens
cactgcccgagctggtg

SEQ ID NO: 4129877 - DNA, 18 bp, Homo sapiens
cactgcccgagctggtgc

SEQ ID NO: 4129878 - DNA, 19 bp, Homo sapiens
cactgcccgagctggtgca

SEQ ID NO: 4129879 - DNA, 17 bp, Homo sapiens
cactgcctgcacctttc

SEQ ID NO: 4129880 - DNA, 20 bp, Homo sapiens
cactgccttcgatacaccgg

SEQ ID NO: 4129881 - DNA, 17 bp, Homo sapiens
cactgccttctcctctc

SEQ ID NO: 4129882 - DNA, 23 bp, Homo sapiens
cactgccttctcctctctgggcc

SEQ ID NO: 4129883 - DNA, 20 bp, Homo sapiens
cactgctaggcgagtgccag

SEQ ID NO: 4129884 - DNA, 19 bp, Homo sapiens
cactgctcaagaagacatg

SEQ ID NO: 4129885 - DNA, 22 bp, Homo sapiens
cactgctcaagaagacatggag

SEQ ID NO: 4129886 - DNA, 13 bp, Homo sapiens
cactgctggctgc

SEQ ID NO: 4129887 - DNA, 13 bp, Homo sapiens
cactgctggtgcc

SEQ ID NO: 4129888 - DNA, 18 bp, Homo sapiens
cactgctgtacccagatg

SEQ ID NO: 4129889 - DNA, 19 bp, Homo sapiens
cactgctgtacccagatgc

SEQ ID NO: 4129890 - DNA, 22 bp, Homo sapiens
cactggaaaggggagagcctgc

SEQ ID NO: 4129891 - DNA, 17 bp, Homo sapiens
cactggaacatggctag

SEQ ID NO: 4129892 - DNA, 23 bp, Homo sapiens
cactggaaggaacatggagctgt

SEQ ID NO: 4129893 - DNA, 22 bp, Homo sapiens
cactggagttacattaatgtta

SEQ ID NO: 4129894 - DNA, 23 bp, Homo sapiens
cactggatgcaaagaaaatcaga

SEQ ID NO: 4129895 - DNA, 16 bp, Homo sapiens
cactggcaatgaaaaa

SEQ ID NO: 4129896 - DNA, 23 bp, Homo sapiens
cactggcagagagatcttcccat

SEQ ID NO: 4129897 - DNA, 21 bp, Homo sapiens
cactggctgagcggatgcatc

SEQ ID NO: 4129898 - DNA, 14 bp, Homo sapiens
cactggctggcctg

SEQ ID NO: 4129899 - DNA, 21 bp, Homo sapiens
cactgggaggcagggctctcc

SEQ ID NO: 4129900 - DNA, 22 bp, Homo sapiens
cactgggatgagccgctgtgag

SEQ ID NO: 4129901 - DNA, 15 bp, Homo sapiens
cactgggcacaactg

SEQ ID NO: 4129902 - DNA, 16 bp, Homo sapiens
cactgggccacggagg

SEQ ID NO: 4129903 - DNA, 19 bp, Homo sapiens
cactgggccacggaggagg

SEQ ID NO: 4129904 - DNA, 23 bp, Homo sapiens
cactgggccagccctgcagccca

SEQ ID NO: 4129905 - DNA, 22 bp, Homo sapiens
cactgggccataatgttgcttc

SEQ ID NO: 4129906 - DNA, 13 bp, Homo sapiens
cactggggccccg

SEQ ID NO: 4129907 - DNA, 15 bp, Homo sapiens
cactggggccccggg

SEQ ID NO: 4129908 - DNA, 16 bp, Homo sapiens
cactggggccccgggt

SEQ ID NO: 4129909 - DNA, 23 bp, Homo sapiens
cactggggccccgggttcagcct

SEQ ID NO: 4129910 - DNA, 19 bp, Homo sapiens
cactgggggaacagatgct

SEQ ID NO: 4129911 - DNA, 23 bp, Homo sapiens
cactgggtggggtgaggaccact

SEQ ID NO: 4129912 - DNA, 15 bp, Homo sapiens
cactgggtggtggcc

SEQ ID NO: 4129913 - DNA, 18 bp, Homo sapiens
cactgggtggtggcctgg

SEQ ID NO: 4129914 - DNA, 16 bp, Homo sapiens
cactgggtgttgatct

SEQ ID NO: 4129915 - DNA, 15 bp, Homo sapiens
cactggtctgctgtc

SEQ ID NO: 4129916 - DNA, 12 bp, Homo sapiens
cactggtgccaa

SEQ ID NO: 4129917 - DNA, 21 bp, Homo sapiens
cactggtgccaaaaccaggcc

SEQ ID NO: 4129918 - DNA, 23 bp, Homo sapiens
cactggtgccaaaaccaggcctc

SEQ ID NO: 4129919 - DNA, 13 bp, Homo sapiens
cactggtggcccg

SEQ ID NO: 4129920 - DNA, 22 bp, Homo sapiens
cactggtggcccgacagcctgg

SEQ ID NO: 4129921 - DNA, 15 bp, Homo sapiens
cactggtgggcagct

SEQ ID NO: 4129922 - DNA, 19 bp, Homo sapiens
cactggtgggcagctgagg

SEQ ID NO: 4129923 - DNA, 19 bp, Homo sapiens
cactggtggtttttgctct

SEQ ID NO: 4129924 - DNA, 20 bp, Homo sapiens
cactggtgtgaactcaccct

SEQ ID NO: 4129925 - DNA, 20 bp, Homo sapiens
cactggtgtgacctgagggc

SEQ ID NO: 4129926 - DNA, 18 bp, Homo sapiens
cactggtgtttaggtgaa

SEQ ID NO: 4129927 - DNA, 22 bp, Homo sapiens
cactgtaatacgtagctctctt

SEQ ID NO: 4129928 - DNA, 16 bp, Homo sapiens
cactgtaattaaaact

SEQ ID NO: 4129929 - DNA, 16 bp, Homo sapiens
cactgtataaatagga

SEQ ID NO: 4129930 - DNA, 21 bp, Homo sapiens
cactgtataaataggagagga

SEQ ID NO: 4129931 - DNA, 20 bp, Homo sapiens
cactgtcaccctccacctct

SEQ ID NO: 4129932 - DNA, 20 bp, Homo sapiens
cactgtccccctacccaccg

SEQ ID NO: 4129933 - DNA, 22 bp, Homo sapiens
cactgtccctctttggcagttg

SEQ ID NO: 4129934 - DNA, 12 bp, Homo sapiens
cactgtcccttg

SEQ ID NO: 4129935 - DNA, 22 bp, Homo sapiens
cactgtcctaccagttgcccta

SEQ ID NO: 4129936 - DNA, 18 bp, Homo sapiens
cactgtcctgggcctgca

SEQ ID NO: 4129937 - DNA, 10 bp, Homo sapiens
cactgtctgt

SEQ ID NO: 4129938 - DNA, 18 bp, Homo sapiens
cactgtctttaattctgt

SEQ ID NO: 4129939 - DNA, 13 bp, Homo sapiens
cactgtgaaggac

SEQ ID NO: 4129940 - DNA, 22 bp, Homo sapiens
cactgtgacccccagctccggc

SEQ ID NO: 4129941 - DNA, 23 bp, Homo sapiens
cactgtgacccccagctccggcc

SEQ ID NO: 4129942 - DNA, 19 bp, Homo sapiens
cactgtgcgtcttggtgta

SEQ ID NO: 4129943 - DNA, 17 bp, Homo sapiens
cactgttactccacagc

SEQ ID NO: 4129944 - DNA, 23 bp, Homo sapiens
cactgttagctttttaaaacatt

SEQ ID NO: 4129945 - DNA, 21 bp, Homo sapiens
cactgttccagtgtctataaa

SEQ ID NO: 4129946 - DNA, 16 bp, Homo sapiens
cactgttccctctgct

SEQ ID NO: 4129947 - DNA, 19 bp, Homo sapiens
cactgttctgaaagtgact

SEQ ID NO: 4129948 - DNA, 14 bp, Homo sapiens
cactgtttctctgc

SEQ ID NO: 4129949 - DNA, 16 bp, Homo sapiens
cacttaaaaaatgtcc

SEQ ID NO: 4129950 - DNA, 15 bp, Homo sapiens
cacttaaaattgtaa

SEQ ID NO: 4129951 - DNA, 17 bp, Homo sapiens
cacttaagttagcctcc

SEQ ID NO: 4129952 - DNA, 13 bp, Homo sapiens
cacttacatatat

SEQ ID NO: 4129953 - DNA, 19 bp, Homo sapiens
cacttacatatatttttaa

SEQ ID NO: 4129954 - DNA, 17 bp, Homo sapiens
cacttagaaattgcatt

SEQ ID NO: 4129955 - DNA, 19 bp, Homo sapiens
cacttagaaattgcatttc

SEQ ID NO: 4129956 - DNA, 23 bp, Homo sapiens
cacttagcaggcaccgccacgtc

SEQ ID NO: 4129957 - DNA, 18 bp, Homo sapiens
cacttagtaggtcctcaa

SEQ ID NO: 4129958 - DNA, 21 bp, Homo sapiens
cacttagtaggtcctcaataa

SEQ ID NO: 4129959 - DNA, 20 bp, Homo sapiens
cacttatttatgaacctgcc

SEQ ID NO: 4129960 - DNA, 13 bp, Homo sapiens
cacttatttcact

SEQ ID NO: 4129961 - DNA, 18 bp, Homo sapiens
cacttcactccagcctgg

SEQ ID NO: 4129962 - DNA, 17 bp, Homo sapiens
cacttcagagagctggt

SEQ ID NO: 4129963 - DNA, 20 bp, Homo sapiens
cacttcaggagaaactgctg

SEQ ID NO: 4129964 - DNA, 15 bp, Homo sapiens
cacttcaggctcttc

SEQ ID NO: 4129965 - DNA, 20 bp, Homo sapiens
cacttcaggctcttctcctt

SEQ ID NO: 4129966 - DNA, 19 bp, Homo sapiens
cacttccaaaattcttatt

SEQ ID NO: 4129967 - DNA, 14 bp, Homo sapiens
cacttccaggggaa

SEQ ID NO: 4129968 - DNA, 17 bp, Homo sapiens
cacttccaggggaacct

SEQ ID NO: 4129969 - DNA, 18 bp, Homo sapiens
cacttccatacagctcta

SEQ ID NO: 4129970 - DNA, 20 bp, Homo sapiens
cacttcctgctacaggaggg

SEQ ID NO: 4129971 - DNA, 23 bp, Homo sapiens
cacttcggccaggtcacacgacc

SEQ ID NO: 4129972 - DNA, 23 bp, Homo sapiens
cacttcgggctgtgtaaacacag

SEQ ID NO: 4129973 - DNA, 17 bp, Homo sapiens
cacttctaaatagcaat

SEQ ID NO: 4129974 - DNA, 15 bp, Homo sapiens
cacttcttcctttct

SEQ ID NO: 4129975 - DNA, 17 bp, Homo sapiens
cacttcttcctttctct

SEQ ID NO: 4129976 - DNA, 16 bp, Homo sapiens
cacttcttctgtccaa

SEQ ID NO: 4129977 - DNA, 13 bp, Homo sapiens
cacttctttccct

SEQ ID NO: 4129978 - DNA, 15 bp, Homo sapiens
cacttctttcccttc

SEQ ID NO: 4129979 - DNA, 23 bp, Homo sapiens
cacttgaaagattttattgtata

SEQ ID NO: 4129980 - DNA, 18 bp, Homo sapiens
cacttgaggtcaggagtt

SEQ ID NO: 4129981 - DNA, 12 bp, Homo sapiens
cacttgcatttc

SEQ ID NO: 4129982 - DNA, 17 bp, Homo sapiens
cacttgctcccaaccca

SEQ ID NO: 4129983 - DNA, 20 bp, Homo sapiens
cacttgctggggctcacggg

SEQ ID NO: 4129984 - DNA, 16 bp, Homo sapiens
cacttgggtcttccct

SEQ ID NO: 4129985 - DNA, 23 bp, Homo sapiens
cacttgtccagctgagcgccagg

SEQ ID NO: 4129986 - DNA, 19 bp, Homo sapiens
cacttgtgctttgctcttg

SEQ ID NO: 4129987 - DNA, 19 bp, Homo sapiens
cacttgtgtgtgggctgtg

SEQ ID NO: 4129988 - DNA, 21 bp, Homo sapiens
cacttgtgtgtgggctgtgag

SEQ ID NO: 4129989 - DNA, 13 bp, Homo sapiens
cactttaaacctg

SEQ ID NO: 4129990 - DNA, 15 bp, Homo sapiens
cactttaagctcctt

SEQ ID NO: 4129991 - DNA, 19 bp, Homo sapiens
cactttaatggcctggagg

SEQ ID NO: 4129992 - DNA, 18 bp, Homo sapiens
cactttagggctgtaaaa

SEQ ID NO: 4129993 - DNA, 17 bp, Homo sapiens
cactttcacatagatgt

SEQ ID NO: 4129994 - DNA, 17 bp, Homo sapiens
cactttccacttcttcc

SEQ ID NO: 4129995 - DNA, 19 bp, Homo sapiens
cactttctacaatgtgaac

SEQ ID NO: 4129996 - DNA, 23 bp, Homo sapiens
cactttctacaatgtgaacttta

SEQ ID NO: 4129997 - DNA, 16 bp, Homo sapiens
cactttctatagcaga

SEQ ID NO: 4129998 - DNA, 19 bp, Homo sapiens
cactttgctctgggtggaa

SEQ ID NO: 4129999 - DNA, 13 bp, Homo sapiens
cactttgggaggc

SEQ ID NO: 4130000 - DNA, 12 bp, Homo sapiens
cactttgttctt

SEQ ID NO: 4130001 - DNA, 14 bp, Homo sapiens
cactttgttgcaag

SEQ ID NO: 4130002 - DNA, 15 bp, Homo sapiens
cactttgttgcaaga

SEQ ID NO: 4130003 - DNA, 12 bp, Homo sapiens
cacttttgttat

SEQ ID NO: 4130004 - DNA, 14 bp, Homo sapiens
cacttttgttattc

SEQ ID NO: 4130005 - DNA, 19 bp, Homo sapiens
cacttttgttattccatca

SEQ ID NO: 4130006 - DNA, 22 bp, Homo sapiens
cacttttgttattccatcaata

SEQ ID NO: 4130007 - DNA, 18 bp, Homo sapiens
cacttttgttctgcttta

SEQ ID NO: 4130008 - DNA, 15 bp, Homo sapiens
cactttttcgtgtgg

SEQ ID NO: 4130009 - DNA, 20 bp, Homo sapiens
cactttttctttacaaacaa

SEQ ID NO: 4130010 - DNA, 19 bp, Homo sapiens
cagaaaaactctgggaaat

SEQ ID NO: 4130011 - DNA, 21 bp, Homo sapiens
cagaaaaagaaatgaacataa

SEQ ID NO: 4130012 - DNA, 16 bp, Homo sapiens
cagaaaaatatatatt

SEQ ID NO: 4130013 - DNA, 20 bp, Homo sapiens
cagaaaactttaaaaaatat

SEQ ID NO: 4130014 - DNA, 19 bp, Homo sapiens
cagaaaatattatgtgttt

SEQ ID NO: 4130015 - DNA, 23 bp, Homo sapiens
cagaaaattctgtgccttgtttt

SEQ ID NO: 4130016 - DNA, 15 bp, Homo sapiens
cagaaacacccacag

SEQ ID NO: 4130017 - DNA, 19 bp, Homo sapiens
cagaaacacccacaggcat

SEQ ID NO: 4130018 - DNA, 14 bp, Homo sapiens
cagaaacagccatt

SEQ ID NO: 4130019 - DNA, 18 bp, Homo sapiens
cagaaacaggtgcatctg

SEQ ID NO: 4130020 - DNA, 21 bp, Homo sapiens
cagaaacagtacttaggtaat

SEQ ID NO: 4130021 - DNA, 15 bp, Homo sapiens
cagaaacagtgggag

SEQ ID NO: 4130022 - DNA, 13 bp, Homo sapiens
cagaaaccagtta

SEQ ID NO: 4130023 - DNA, 17 bp, Homo sapiens
cagaaacgcatccagca

SEQ ID NO: 4130024 - DNA, 17 bp, Homo sapiens
cagaaactcccctgggg

SEQ ID NO: 4130025 - DNA, 17 bp, Homo sapiens
cagaaactcctgtttct

SEQ ID NO: 4130026 - DNA, 19 bp, Homo sapiens
cagaaactcctgtttctcc

SEQ ID NO: 4130027 - DNA, 22 bp, Homo sapiens
cagaaactggattaaaacaatt

SEQ ID NO: 4130028 - DNA, 18 bp, Homo sapiens
cagaaacttgttcttcca

SEQ ID NO: 4130029 - DNA, 18 bp, Homo sapiens
cagaaagcataaaattct

SEQ ID NO: 4130030 - DNA, 19 bp, Homo sapiens
cagaaagccctcttggggg

SEQ ID NO: 4130031 - DNA, 22 bp, Homo sapiens
cagaaaggatatttaagaaaat

SEQ ID NO: 4130032 - DNA, 21 bp, Homo sapiens
cagaaaggatgttttgtccca

SEQ ID NO: 4130033 - DNA, 15 bp, Homo sapiens
cagaaaggttctgcc

SEQ ID NO: 4130034 - DNA, 16 bp, Homo sapiens
cagaaagtcaccagga

SEQ ID NO: 4130035 - DNA, 19 bp, Homo sapiens
cagaaagtcaccaggactt

SEQ ID NO: 4130036 - DNA, 14 bp, Homo sapiens
cagaaagtgcctga

SEQ ID NO: 4130037 - DNA, 19 bp, Homo sapiens
cagaaagtgcctgacacac

SEQ ID NO: 4130038 - DNA, 22 bp, Homo sapiens
cagaaagtggccatgccaccct

SEQ ID NO: 4130039 - DNA, 22 bp, Homo sapiens
cagaaatactataacatatgta

SEQ ID NO: 4130040 - DNA, 20 bp, Homo sapiens
cagaaatcagtaatatttat

SEQ ID NO: 4130041 - DNA, 15 bp, Homo sapiens
cagaaatgctgctgg

SEQ ID NO: 4130042 - DNA, 16 bp, Homo sapiens
cagaaatgctgctggc

SEQ ID NO: 4130043 - DNA, 18 bp, Homo sapiens
cagaaatgctgctggcca

SEQ ID NO: 4130044 - DNA, 19 bp, Homo sapiens
cagaaatgctgctggccaa

SEQ ID NO: 4130045 - DNA, 21 bp, Homo sapiens
cagaaatggggaattctctaa

SEQ ID NO: 4130046 - DNA, 17 bp, Homo sapiens
cagaaatgtccctttct

SEQ ID NO: 4130047 - DNA, 11 bp, Homo sapiens
cagaaatgtct

SEQ ID NO: 4130048 - DNA, 14 bp, Homo sapiens
cagaaatgtctaaa

SEQ ID NO: 4130049 - DNA, 20 bp, Homo sapiens
cagaaattggaacagaatgt

SEQ ID NO: 4130050 - DNA, 14 bp, Homo sapiens
cagaaatttttatt

SEQ ID NO: 4130051 - DNA, 18 bp, Homo sapiens
cagaaatttttatttttc

SEQ ID NO: 4130052 - DNA, 19 bp, Homo sapiens
cagaaatttttatttttct

SEQ ID NO: 4130053 - DNA, 16 bp, Homo sapiens
cagaacagcttcaggt

SEQ ID NO: 4130054 - DNA, 24 bp, Homo sapiens
cagaacagcttcaggttatcgaaa

SEQ ID NO: 4130055 - DNA, 13 bp, Homo sapiens
cagaacagggtca

SEQ ID NO: 4130056 - DNA, 22 bp, Homo sapiens
cagaacccttggagccaatgga

SEQ ID NO: 4130057 - DNA, 12 bp, Homo sapiens
cagaacctcttc

SEQ ID NO: 4130058 - DNA, 21 bp, Homo sapiens
cagaacctcttccccagaaag

SEQ ID NO: 4130059 - DNA, 20 bp, Homo sapiens
cagaaccttcaacccagtgg

SEQ ID NO: 4130060 - DNA, 21 bp, Homo sapiens
cagaacggagccccaggcctc

SEQ ID NO: 4130061 - DNA, 12 bp, Homo sapiens
cagaactaaatg

SEQ ID NO: 4130062 - DNA, 17 bp, Homo sapiens
cagaactaaatgttcta

SEQ ID NO: 4130063 - DNA, 13 bp, Homo sapiens
cagaactacttct

SEQ ID NO: 4130064 - DNA, 20 bp, Homo sapiens
cagaactcaaatggggccag

SEQ ID NO: 4130065 - DNA, 21 bp, Homo sapiens
cagaactcaaatggggccaga

SEQ ID NO: 4130066 - DNA, 13 bp, Homo sapiens
cagaactgccccc

SEQ ID NO: 4130067 - DNA, 14 bp, Homo sapiens
cagaactgccccca

SEQ ID NO: 4130068 - DNA, 16 bp, Homo sapiens
cagaactgtgccacaa

SEQ ID NO: 4130069 - DNA, 17 bp, Homo sapiens
cagaactgtgccacaat

SEQ ID NO: 4130070 - DNA, 16 bp, Homo sapiens
cagaacttcagaaaga

SEQ ID NO: 4130071 - DNA, 9 bp, Homo sapiens
cagaacttg

SEQ ID NO: 4130072 - DNA, 20 bp, Homo sapiens
cagaacttgaagcctgctcc

SEQ ID NO: 4130073 - DNA, 21 bp, Homo sapiens
cagaacttgaagcctgctcct

SEQ ID NO: 4130074 - DNA, 18 bp, Homo sapiens
cagaacttgctgctgtct

SEQ ID NO: 4130075 - DNA, 20 bp, Homo sapiens
cagaacttgctgctgtcttg

SEQ ID NO: 4130076 - DNA, 14 bp, Homo sapiens
cagaagaagagaag

SEQ ID NO: 4130077 - DNA, 17 bp, Homo sapiens
cagaagaagagaagctg

SEQ ID NO: 4130078 - DNA, 20 bp, Homo sapiens
cagaagaagagaagctgctg

SEQ ID NO: 4130079 - DNA, 14 bp, Homo sapiens
cagaagaatattca

SEQ ID NO: 4130080 - DNA, 15 bp, Homo sapiens
cagaagaatattcag

SEQ ID NO: 4130081 - DNA, 17 bp, Homo sapiens
cagaagaatattcagga

SEQ ID NO: 4130082 - DNA, 19 bp, Homo sapiens
cagaagaatattcaggact

SEQ ID NO: 4130083 - DNA, 20 bp, Homo sapiens
cagaagacaccagagcagat

SEQ ID NO: 4130084 - DNA, 20 bp, Homo sapiens
cagaagagatgggcttgttt

SEQ ID NO: 4130085 - DNA, 19 bp, Homo sapiens
cagaagatcccctcaggac

SEQ ID NO: 4130086 - DNA, 15 bp, Homo sapiens
cagaagcaagccaga

SEQ ID NO: 4130087 - DNA, 22 bp, Homo sapiens
cagaagcaagggggtgatgtag

SEQ ID NO: 4130088 - DNA, 20 bp, Homo sapiens
cagaagcagggtaccctttg

SEQ ID NO: 4130089 - DNA, 21 bp, Homo sapiens
cagaagcagggtaccctttgg

SEQ ID NO: 4130090 - DNA, 23 bp, Homo sapiens
cagaagccctgatgtgtcctcag

SEQ ID NO: 4130091 - DNA, 21 bp, Homo sapiens
cagaagcctaggaggactggg

SEQ ID NO: 4130092 - DNA, 15 bp, Homo sapiens
cagaagcctccaagc

SEQ ID NO: 4130093 - DNA, 21 bp, Homo sapiens
cagaagcctccaagcacagag

SEQ ID NO: 4130094 - DNA, 14 bp, Homo sapiens
cagaagcctctggc

SEQ ID NO: 4130095 - DNA, 21 bp, Homo sapiens
cagaagcctggactctgcccc

SEQ ID NO: 4130096 - DNA, 12 bp, Homo sapiens
cagaagcttcca

SEQ ID NO: 4130097 - DNA, 19 bp, Homo sapiens
cagaaggaatctgtgcaga

SEQ ID NO: 4130098 - DNA, 14 bp, Homo sapiens
cagaaggctcctgc

SEQ ID NO: 4130099 - DNA, 17 bp, Homo sapiens
cagaaggctcctgcccc

SEQ ID NO: 4130100 - DNA, 19 bp, Homo sapiens
cagaaggctcctgccccca

SEQ ID NO: 4130101 - DNA, 17 bp, Homo sapiens
cagaagggaattgctca

SEQ ID NO: 4130102 - DNA, 15 bp, Homo sapiens
cagaaggtattcctt

SEQ ID NO: 4130103 - DNA, 16 bp, Homo sapiens
cagaagtagctttgca

SEQ ID NO: 4130104 - DNA, 16 bp, Homo sapiens
cagaagtcatgaagcc

SEQ ID NO: 4130105 - DNA, 19 bp, Homo sapiens
cagaagtcatgaagcccaa

SEQ ID NO: 4130106 - DNA, 14 bp, Homo sapiens
cagaagtctcctca

SEQ ID NO: 4130107 - DNA, 15 bp, Homo sapiens
cagaagtctcctcaa

SEQ ID NO: 4130108 - DNA, 18 bp, Homo sapiens
cagaataaggcaggcatt

SEQ ID NO: 4130109 - DNA, 20 bp, Homo sapiens
cagaataaggcaggcattga

SEQ ID NO: 4130110 - DNA, 14 bp, Homo sapiens
cagaataatccagt

SEQ ID NO: 4130111 - DNA, 22 bp, Homo sapiens
cagaataatccagtattgctga

SEQ ID NO: 4130112 - DNA, 11 bp, Homo sapiens
cagaataatgg

SEQ ID NO: 4130113 - DNA, 15 bp, Homo sapiens
cagaataatggaaac

SEQ ID NO: 4130114 - DNA, 19 bp, Homo sapiens
cagaataatggaaacatta

SEQ ID NO: 4130115 - DNA, 23 bp, Homo sapiens
cagaataatggaaacattacagt

SEQ ID NO: 4130116 - DNA, 18 bp, Homo sapiens
cagaataatgttctattg

SEQ ID NO: 4130117 - DNA, 21 bp, Homo sapiens
cagaatagccacatttggaat

SEQ ID NO: 4130118 - DNA, 12 bp, Homo sapiens
cagaatatctgg

SEQ ID NO: 4130119 - DNA, 13 bp, Homo sapiens
cagaatattgctt

SEQ ID NO: 4130120 - DNA, 17 bp, Homo sapiens
cagaatatttctattga

SEQ ID NO: 4130121 - DNA, 22 bp, Homo sapiens
cagaatatttttatatttcctt

SEQ ID NO: 4130122 - DNA, 15 bp, Homo sapiens
cagaatcatggagaa

SEQ ID NO: 4130123 - DNA, 16 bp, Homo sapiens
cagaatctctgaattt

SEQ ID NO: 4130124 - DNA, 19 bp, Homo sapiens
cagaatcttgactttctga

SEQ ID NO: 4130125 - DNA, 16 bp, Homo sapiens
cagaatgctgaactcc

SEQ ID NO: 4130126 - DNA, 16 bp, Homo sapiens
cagaatgctgtacatc

SEQ ID NO: 4130127 - DNA, 21 bp, Homo sapiens
cagaatgctgtacatctattt

SEQ ID NO: 4130128 - DNA, 22 bp, Homo sapiens
cagaatgtaagaaaacaaaatc

SEQ ID NO: 4130129 - DNA, 15 bp, Homo sapiens
cagaattaaactttt

SEQ ID NO: 4130130 - DNA, 16 bp, Homo sapiens
cagaattaaactttta

SEQ ID NO: 4130131 - DNA, 17 bp, Homo sapiens
cagaattaaacttttaa

SEQ ID NO: 4130132 - DNA, 20 bp, Homo sapiens
cagaattagatggcttattt

SEQ ID NO: 4130133 - DNA, 13 bp, Homo sapiens
cagaattattttt

SEQ ID NO: 4130134 - DNA, 11 bp, Homo sapiens
cagaattctca

SEQ ID NO: 4130135 - DNA, 19 bp, Homo sapiens
cagaatttaccatcatctc

SEQ ID NO: 4130136 - DNA, 13 bp, Homo sapiens
cagaatttccact

SEQ ID NO: 4130137 - DNA, 15 bp, Homo sapiens
cagaatttccactgt

SEQ ID NO: 4130138 - DNA, 19 bp, Homo sapiens
cagaatttgggttctgcct

SEQ ID NO: 4130139 - DNA, 21 bp, Homo sapiens
cagaatttgtatgtattttca

SEQ ID NO: 4130140 - DNA, 24 bp, Homo sapiens
cagaattttaatgtgaagacattt

SEQ ID NO: 4130141 - DNA, 15 bp, Homo sapiens
cagaattttaggaac

SEQ ID NO: 4130142 - DNA, 20 bp, Homo sapiens
cagacaaaacaatccccatc

SEQ ID NO: 4130143 - DNA, 17 bp, Homo sapiens
cagacaacagaagtcat

SEQ ID NO: 4130144 - DNA, 19 bp, Homo sapiens
cagacaagcaacaggtttt

SEQ ID NO: 4130145 - DNA, 17 bp, Homo sapiens
cagacaatatgtgagtg

SEQ ID NO: 4130146 - DNA, 18 bp, Homo sapiens
cagacacaatatgtatgc

SEQ ID NO: 4130147 - DNA, 11 bp, Homo sapiens
cagacacacac

SEQ ID NO: 4130148 - DNA, 14 bp, Homo sapiens
cagacacacacacg

SEQ ID NO: 4130149 - DNA, 17 bp, Homo sapiens
cagacacacacacgcac

SEQ ID NO: 4130150 - DNA, 14 bp, Homo sapiens
cagacacaggccct

SEQ ID NO: 4130151 - DNA, 18 bp, Homo sapiens
cagacacaggccctccct

SEQ ID NO: 4130152 - DNA, 15 bp, Homo sapiens
cagacaccctcaacc

SEQ ID NO: 4130153 - DNA, 22 bp, Homo sapiens
cagacacctgttcacagaaaaa

SEQ ID NO: 4130154 - DNA, 15 bp, Homo sapiens
cagacactaccccat

SEQ ID NO: 4130155 - DNA, 21 bp, Homo sapiens
cagacactgaccatccactct

SEQ ID NO: 4130156 - DNA, 15 bp, Homo sapiens
cagacagaacttgaa

SEQ ID NO: 4130157 - DNA, 23 bp, Homo sapiens
cagacagaacttgaatgtgtcag

SEQ ID NO: 4130158 - DNA, 14 bp, Homo sapiens
cagacagcaggcag

SEQ ID NO: 4130159 - DNA, 16 bp, Homo sapiens
cagacagcaggcagcg

SEQ ID NO: 4130160 - DNA, 21 bp, Homo sapiens
cagacagccctccactccagc

SEQ ID NO: 4130161 - DNA, 18 bp, Homo sapiens
cagacagccgtttgttct

SEQ ID NO: 4130162 - DNA, 21 bp, Homo sapiens
cagacagctccaccctggccg

SEQ ID NO: 4130163 - DNA, 20 bp, Homo sapiens
cagacaggccccgtgaggca

SEQ ID NO: 4130164 - DNA, 14 bp, Homo sapiens
cagacaggctctta

SEQ ID NO: 4130165 - DNA, 22 bp, Homo sapiens
cagacaggctcttagcagcttc

SEQ ID NO: 4130166 - DNA, 18 bp, Homo sapiens
cagacagggggccagaac

SEQ ID NO: 4130167 - DNA, 17 bp, Homo sapiens
cagacatcaccctttgc

SEQ ID NO: 4130168 - DNA, 23 bp, Homo sapiens
cagacatcaccctttgccttagc

SEQ ID NO: 4130169 - DNA, 15 bp, Homo sapiens
cagacatcatgaatt

SEQ ID NO: 4130170 - DNA, 15 bp, Homo sapiens
cagaccaactctctc

SEQ ID NO: 4130171 - DNA, 20 bp, Homo sapiens
cagaccacatctttatctgt

SEQ ID NO: 4130172 - DNA, 16 bp, Homo sapiens
cagaccaccagccgcc

SEQ ID NO: 4130173 - DNA, 19 bp, Homo sapiens
cagaccaccagccgcccca

SEQ ID NO: 4130174 - DNA, 13 bp, Homo sapiens
cagaccaccccgc

SEQ ID NO: 4130175 - DNA, 15 bp, Homo sapiens
cagaccaccccgcct

SEQ ID NO: 4130176 - DNA, 13 bp, Homo sapiens
cagaccacttgcc

SEQ ID NO: 4130177 - DNA, 16 bp, Homo sapiens
cagaccacttgccacg

SEQ ID NO: 4130178 - DNA, 18 bp, Homo sapiens
cagaccacttgccacgct

SEQ ID NO: 4130179 - DNA, 16 bp, Homo sapiens
cagaccagagctgtct

SEQ ID NO: 4130180 - DNA, 22 bp, Homo sapiens
cagaccagagctgtctgaactc

SEQ ID NO: 4130181 - DNA, 16 bp, Homo sapiens
cagaccataatgttac

SEQ ID NO: 4130182 - DNA, 14 bp, Homo sapiens
cagaccatgaagta

SEQ ID NO: 4130183 - DNA, 19 bp, Homo sapiens
cagacccacgggctcatgc

SEQ ID NO: 4130184 - DNA, 20 bp, Homo sapiens
cagacccacgggctcatgca

SEQ ID NO: 4130185 - DNA, 20 bp, Homo sapiens
cagacccctctggccaggat

SEQ ID NO: 4130186 - DNA, 22 bp, Homo sapiens
cagacccctctggccaggatgg

SEQ ID NO: 4130187 - DNA, 21 bp, Homo sapiens
cagacccctggcttttcactg

SEQ ID NO: 4130188 - DNA, 17 bp, Homo sapiens
cagacccttcttgcctg

SEQ ID NO: 4130189 - DNA, 20 bp, Homo sapiens
cagacccttcttgcctgctg

SEQ ID NO: 4130190 - DNA, 21 bp, Homo sapiens
cagacccttcttgcctgctgg

SEQ ID NO: 4130191 - DNA, 17 bp, Homo sapiens
cagacctgatcctggag

SEQ ID NO: 4130192 - DNA, 20 bp, Homo sapiens
cagacctgatcctggaggcc

SEQ ID NO: 4130193 - DNA, 13 bp, Homo sapiens
cagacctgtcttc

SEQ ID NO: 4130194 - DNA, 17 bp, Homo sapiens
cagacgctgccgctgcc

SEQ ID NO: 4130195 - DNA, 12 bp, Homo sapiens
cagacggcggcc

SEQ ID NO: 4130196 - DNA, 19 bp, Homo sapiens
cagacggcggccaggcaca

SEQ ID NO: 4130197 - DNA, 20 bp, Homo sapiens
cagacggcggccaggcacag

SEQ ID NO: 4130198 - DNA, 23 bp, Homo sapiens
cagacggcggccaggcacagggc

SEQ ID NO: 4130199 - DNA, 14 bp, Homo sapiens
cagacgggcacaga

SEQ ID NO: 4130200 - DNA, 15 bp, Homo sapiens
cagacgggcacagac

SEQ ID NO: 4130201 - DNA, 16 bp, Homo sapiens
cagactactattttct

SEQ ID NO: 4130202 - DNA, 13 bp, Homo sapiens
cagactccatctc

SEQ ID NO: 4130203 - DNA, 15 bp, Homo sapiens
cagactccatctctt

SEQ ID NO: 4130204 - DNA, 20 bp, Homo sapiens
cagactccatctcttctgca

SEQ ID NO: 4130205 - DNA, 19 bp, Homo sapiens
cagactcccattcctgaag

SEQ ID NO: 4130206 - DNA, 14 bp, Homo sapiens
cagactccgccctc

SEQ ID NO: 4130207 - DNA, 14 bp, Homo sapiens
cagactctgagctg

SEQ ID NO: 4130208 - DNA, 16 bp, Homo sapiens
cagactggggcatcct

SEQ ID NO: 4130209 - DNA, 23 bp, Homo sapiens
cagactgttagaaaatggacact

SEQ ID NO: 4130210 - DNA, 24 bp, Homo sapiens
cagacttccttgagacacggagcc

SEQ ID NO: 4130211 - DNA, 20 bp, Homo sapiens
cagacttctccagacccacc

SEQ ID NO: 4130212 - DNA, 18 bp, Homo sapiens
cagagaaaaatgctcccc

SEQ ID NO: 4130213 - DNA, 15 bp, Homo sapiens
cagagaaagaagaga

SEQ ID NO: 4130214 - DNA, 18 bp, Homo sapiens
cagagaaagaagagacag

SEQ ID NO: 4130215 - DNA, 19 bp, Homo sapiens
cagagaaagaagagacagg

SEQ ID NO: 4130216 - DNA, 24 bp, Homo sapiens
cagagaacagcgaagtagcttgct

SEQ ID NO: 4130217 - DNA, 13 bp, Homo sapiens
cagagaagctgga

SEQ ID NO: 4130218 - DNA, 15 bp, Homo sapiens
cagagaagctggact

SEQ ID NO: 4130219 - DNA, 16 bp, Homo sapiens
cagagacatacttgaa

SEQ ID NO: 4130220 - DNA, 20 bp, Homo sapiens
cagagacatacttgaagggc

SEQ ID NO: 4130221 - DNA, 15 bp, Homo sapiens
cagagaccaggctgt

SEQ ID NO: 4130222 - DNA, 18 bp, Homo sapiens
cagagaccaggctgtgtc

SEQ ID NO: 4130223 - DNA, 14 bp, Homo sapiens
cagagacgcaggaa

SEQ ID NO: 4130224 - DNA, 18 bp, Homo sapiens
cagagacgcaggaatgga

SEQ ID NO: 4130225 - DNA, 12 bp, Homo sapiens
cagagacgccca

SEQ ID NO: 4130226 - DNA, 23 bp, Homo sapiens
cagagacgcccagccccatccct

SEQ ID NO: 4130227 - DNA, 14 bp, Homo sapiens
cagagactgcaagc

SEQ ID NO: 4130228 - DNA, 16 bp, Homo sapiens
cagagactgcaagctg

SEQ ID NO: 4130229 - DNA, 19 bp, Homo sapiens
cagagactgcaagctgctt

SEQ ID NO: 4130230 - DNA, 21 bp, Homo sapiens
cagagactgcaagctgcttgc

SEQ ID NO: 4130231 - DNA, 11 bp, Homo sapiens
cagagagacag

SEQ ID NO: 4130232 - DNA, 22 bp, Homo sapiens
cagagagacagacttgagaact

SEQ ID NO: 4130233 - DNA, 16 bp, Homo sapiens
cagagagacccttgtg

SEQ ID NO: 4130234 - DNA, 15 bp, Homo sapiens
cagagagagagaaag

SEQ ID NO: 4130235 - DNA, 17 bp, Homo sapiens
cagagagagagaaagag

SEQ ID NO: 4130236 - DNA, 21 bp, Homo sapiens
cagagagagaggacagagggg

SEQ ID NO: 4130237 - DNA, 22 bp, Homo sapiens
cagagagatcttcccataataa

SEQ ID NO: 4130238 - DNA, 15 bp, Homo sapiens
cagagagccattttg

SEQ ID NO: 4130239 - DNA, 18 bp, Homo sapiens
cagagagccattttgtga

SEQ ID NO: 4130240 - DNA, 19 bp, Homo sapiens
cagagagcctggtgctgct

SEQ ID NO: 4130241 - DNA, 20 bp, Homo sapiens
cagagagcctggtgctgctg

SEQ ID NO: 4130242 - DNA, 12 bp, Homo sapiens
cagagagctggt

SEQ ID NO: 4130243 - DNA, 17 bp, Homo sapiens
cagagagcttaaattgt

SEQ ID NO: 4130244 - DNA, 22 bp, Homo sapiens
cagagaggagaaacacatcttc

SEQ ID NO: 4130245 - DNA, 21 bp, Homo sapiens
cagagagggagagcagagaaa

SEQ ID NO: 4130246 - DNA, 18 bp, Homo sapiens
cagagaggtggagaactg

SEQ ID NO: 4130247 - DNA, 21 bp, Homo sapiens
cagagaggtggagaactggga

SEQ ID NO: 4130248 - DNA, 14 bp, Homo sapiens
cagagagtggctcc

SEQ ID NO: 4130249 - DNA, 15 bp, Homo sapiens
cagagagtggctcct

SEQ ID NO: 4130250 - DNA, 18 bp, Homo sapiens
cagagagtggctcctccc

SEQ ID NO: 4130251 - DNA, 21 bp, Homo sapiens
cagagatccaaaagaagcccc

SEQ ID NO: 4130252 - DNA, 13 bp, Homo sapiens
cagagcaccccct

SEQ ID NO: 4130253 - DNA, 15 bp, Homo sapiens
cagagcagatgcaga

SEQ ID NO: 4130254 - DNA, 16 bp, Homo sapiens
cagagcagatgcagag

SEQ ID NO: 4130255 - DNA, 20 bp, Homo sapiens
cagagcagatgcagagagcc

SEQ ID NO: 4130256 - DNA, 12 bp, Homo sapiens
cagagcagctcc

SEQ ID NO: 4130257 - DNA, 15 bp, Homo sapiens
cagagcagctcccca

SEQ ID NO: 4130258 - DNA, 16 bp, Homo sapiens
cagagcagctccccag

SEQ ID NO: 4130259 - DNA, 17 bp, Homo sapiens
cagagcagctccccagg

SEQ ID NO: 4130260 - DNA, 17 bp, Homo sapiens
cagagcaggaaggacag

SEQ ID NO: 4130261 - DNA, 13 bp, Homo sapiens
cagagcaggcaat

SEQ ID NO: 4130262 - DNA, 16 bp, Homo sapiens
cagagcatctggctgt

SEQ ID NO: 4130263 - DNA, 15 bp, Homo sapiens
cagagcatgtgtcag

SEQ ID NO: 4130264 - DNA, 19 bp, Homo sapiens
cagagcattacgtgagcca

SEQ ID NO: 4130265 - DNA, 23 bp, Homo sapiens
cagagcattacgtgagccaggta

SEQ ID NO: 4130266 - DNA, 18 bp, Homo sapiens
cagagcattccagtcagg

SEQ ID NO: 4130267 - DNA, 20 bp, Homo sapiens
cagagcattccagtcaggct

SEQ ID NO: 4130268 - DNA, 22 bp, Homo sapiens
cagagcattccagtcaggctct

SEQ ID NO: 4130269 - DNA, 21 bp, Homo sapiens
cagagcatttccaacaccaca

SEQ ID NO: 4130270 - DNA, 11 bp, Homo sapiens
cagagccaagt

SEQ ID NO: 4130271 - DNA, 13 bp, Homo sapiens
cagagccaagtcc

SEQ ID NO: 4130272 - DNA, 19 bp, Homo sapiens
cagagccagatgcaggaca

SEQ ID NO: 4130273 - DNA, 21 bp, Homo sapiens
cagagccagatgcaggacagg

SEQ ID NO: 4130274 - DNA, 20 bp, Homo sapiens
cagagcccagaccctggagg

SEQ ID NO: 4130275 - DNA, 13 bp, Homo sapiens
cagagcccagctc

SEQ ID NO: 4130276 - DNA, 22 bp, Homo sapiens
cagagcccatgctcaaccactg

SEQ ID NO: 4130277 - DNA, 19 bp, Homo sapiens
cagagccccaagcaggacg

SEQ ID NO: 4130278 - DNA, 14 bp, Homo sapiens
cagagcccccagga

SEQ ID NO: 4130279 - DNA, 14 bp, Homo sapiens
cagagccctgccct

SEQ ID NO: 4130280 - DNA, 22 bp, Homo sapiens
cagagccctgccctgcaccctt

SEQ ID NO: 4130281 - DNA, 14 bp, Homo sapiens
cagagccctgctcc

SEQ ID NO: 4130282 - DNA, 15 bp, Homo sapiens
cagagccctgctccc

SEQ ID NO: 4130283 - DNA, 19 bp, Homo sapiens
cagagcctggccccaggcc

SEQ ID NO: 4130284 - DNA, 17 bp, Homo sapiens
cagagcctggctgccca

SEQ ID NO: 4130285 - DNA, 13 bp, Homo sapiens
cagagccttctca

SEQ ID NO: 4130286 - DNA, 16 bp, Homo sapiens
cagagccttctcagaa

SEQ ID NO: 4130287 - DNA, 20 bp, Homo sapiens
cagagccttctcagaagcac

SEQ ID NO: 4130288 - DNA, 21 bp, Homo sapiens
cagagccttctcagaagcaca

SEQ ID NO: 4130289 - DNA, 20 bp, Homo sapiens
cagagcctttggatgaccag

SEQ ID NO: 4130290 - DNA, 15 bp, Homo sapiens
cagagcgccaggaag

SEQ ID NO: 4130291 - DNA, 18 bp, Homo sapiens
cagagcgccaggaagcca

SEQ ID NO: 4130292 - DNA, 15 bp, Homo sapiens
cagagcgcccctccc

SEQ ID NO: 4130293 - DNA, 14 bp, Homo sapiens
cagagcgtccttcc

SEQ ID NO: 4130294 - DNA, 22 bp, Homo sapiens
cagagcgtccttccccctgtag

SEQ ID NO: 4130295 - DNA, 18 bp, Homo sapiens
cagagctaaactccttcc

SEQ ID NO: 4130296 - DNA, 20 bp, Homo sapiens
cagagctaaactccttcctg

SEQ ID NO: 4130297 - DNA, 21 bp, Homo sapiens
cagagctaaactccttcctgg

SEQ ID NO: 4130298 - DNA, 22 bp, Homo sapiens
cagagctaaactccttcctggc

SEQ ID NO: 4130299 - DNA, 21 bp, Homo sapiens
cagagctaagggtgggtgctc

SEQ ID NO: 4130300 - DNA, 12 bp, Homo sapiens
cagagctgccag

SEQ ID NO: 4130301 - DNA, 15 bp, Homo sapiens
cagagctggagcccc

SEQ ID NO: 4130302 - DNA, 21 bp, Homo sapiens
cagagctggagcccccagcag

SEQ ID NO: 4130303 - DNA, 19 bp, Homo sapiens
cagagctgtttatggcctc

SEQ ID NO: 4130304 - DNA, 21 bp, Homo sapiens
cagagctgtttatggcctcag

SEQ ID NO: 4130305 - DNA, 22 bp, Homo sapiens
cagagctgtttatggcctcagc

SEQ ID NO: 4130306 - DNA, 19 bp, Homo sapiens
cagaggaaagggctggctc

SEQ ID NO: 4130307 - DNA, 21 bp, Homo sapiens
cagaggaaagggctggctccc

SEQ ID NO: 4130308 - DNA, 21 bp, Homo sapiens
cagaggaactgtccagagagc

SEQ ID NO: 4130309 - DNA, 21 bp, Homo sapiens
cagaggactcccaaccctggc

SEQ ID NO: 4130310 - DNA, 13 bp, Homo sapiens
cagaggagctcta

SEQ ID NO: 4130311 - DNA, 14 bp, Homo sapiens
cagaggagctctac

SEQ ID NO: 4130312 - DNA, 22 bp, Homo sapiens
cagaggagctctaccctgctcc

SEQ ID NO: 4130313 - DNA, 11 bp, Homo sapiens
cagaggagctt

SEQ ID NO: 4130314 - DNA, 14 bp, Homo sapiens
cagaggagggcaga

SEQ ID NO: 4130315 - DNA, 16 bp, Homo sapiens
cagaggaggggaaagt

SEQ ID NO: 4130316 - DNA, 20 bp, Homo sapiens
cagaggagtgcagccttctc

SEQ ID NO: 4130317 - DNA, 22 bp, Homo sapiens
cagaggagtgcagccttctcca

SEQ ID NO: 4130318 - DNA, 13 bp, Homo sapiens
cagaggcacctca

SEQ ID NO: 4130319 - DNA, 21 bp, Homo sapiens
cagaggcagcccgcacacctg

SEQ ID NO: 4130320 - DNA, 15 bp, Homo sapiens
cagaggcaggctggg

SEQ ID NO: 4130321 - DNA, 14 bp, Homo sapiens
cagaggccagaccc

SEQ ID NO: 4130322 - DNA, 15 bp, Homo sapiens
cagaggccagaccca

SEQ ID NO: 4130323 - DNA, 17 bp, Homo sapiens
cagaggccccagcctcc

SEQ ID NO: 4130324 - DNA, 20 bp, Homo sapiens
cagaggccgaaggtgcctca

SEQ ID NO: 4130325 - DNA, 16 bp, Homo sapiens
cagaggcctcctgtgg

SEQ ID NO: 4130326 - DNA, 21 bp, Homo sapiens
cagaggcctcctgtggcctgc

SEQ ID NO: 4130327 - DNA, 16 bp, Homo sapiens
cagaggcctgctgcca

SEQ ID NO: 4130328 - DNA, 22 bp, Homo sapiens
cagaggcctgctgccagtgcag

SEQ ID NO: 4130329 - DNA, 19 bp, Homo sapiens
cagagggagaatccaaggg

SEQ ID NO: 4130330 - DNA, 22 bp, Homo sapiens
cagagggagctggaacccgagg

SEQ ID NO: 4130331 - DNA, 10 bp, Homo sapiens
cagagggctg

SEQ ID NO: 4130332 - DNA, 12 bp, Homo sapiens
cagaggggaagg

SEQ ID NO: 4130333 - DNA, 20 bp, Homo sapiens
cagagggggagtagccaagc

SEQ ID NO: 4130334 - DNA, 15 bp, Homo sapiens
cagagggtgtggctt

SEQ ID NO: 4130335 - DNA, 17 bp, Homo sapiens
cagagggttgtgatttt

SEQ ID NO: 4130336 - DNA, 20 bp, Homo sapiens
cagaggtaaaagtgtgagca

SEQ ID NO: 4130337 - DNA, 13 bp, Homo sapiens
cagaggtaacaga

SEQ ID NO: 4130338 - DNA, 17 bp, Homo sapiens
cagaggtaacagaacag

SEQ ID NO: 4130339 - DNA, 20 bp, Homo sapiens
cagaggtaacagaacagctt

SEQ ID NO: 4130340 - DNA, 21 bp, Homo sapiens
cagaggtgcttcaccctgagt

SEQ ID NO: 4130341 - DNA, 19 bp, Homo sapiens
cagaggtggccagagctgg

SEQ ID NO: 4130342 - DNA, 17 bp, Homo sapiens
cagaggtgtacactaac

SEQ ID NO: 4130343 - DNA, 22 bp, Homo sapiens
cagaggtgtacactaacatttc

SEQ ID NO: 4130344 - DNA, 18 bp, Homo sapiens
cagagtaaattgctctgt

SEQ ID NO: 4130345 - DNA, 23 bp, Homo sapiens
cagagtaaattgctctgttccca

SEQ ID NO: 4130346 - DNA, 19 bp, Homo sapiens
cagagtacgtcctgcctgg

SEQ ID NO: 4130347 - DNA, 20 bp, Homo sapiens
cagagtcatttatgagcaga

SEQ ID NO: 4130348 - DNA, 14 bp, Homo sapiens
cagagtccagtgct

SEQ ID NO: 4130349 - DNA, 15 bp, Homo sapiens
cagagtccagtgctc

SEQ ID NO: 4130350 - DNA, 17 bp, Homo sapiens
cagagtccagtgctctg

SEQ ID NO: 4130351 - DNA, 18 bp, Homo sapiens
cagagtccagtgctctgc

SEQ ID NO: 4130352 - DNA, 22 bp, Homo sapiens
cagagtccagtgctctgcctca

SEQ ID NO: 4130353 - DNA, 16 bp, Homo sapiens
cagagtgaagaatctt

SEQ ID NO: 4130354 - DNA, 15 bp, Homo sapiens
cagagtgcacagctg

SEQ ID NO: 4130355 - DNA, 16 bp, Homo sapiens
cagagtgcacagctgt

SEQ ID NO: 4130356 - DNA, 17 bp, Homo sapiens
cagagtgctgaggccag

SEQ ID NO: 4130357 - DNA, 15 bp, Homo sapiens
cagagtgcttttctg

SEQ ID NO: 4130358 - DNA, 12 bp, Homo sapiens
cagagtggccca

SEQ ID NO: 4130359 - DNA, 17 bp, Homo sapiens
cagagtggcctccctgc

SEQ ID NO: 4130360 - DNA, 15 bp, Homo sapiens
cagagtggcctggcc

SEQ ID NO: 4130361 - DNA, 18 bp, Homo sapiens
cagagtggtcgagtgaca

SEQ ID NO: 4130362 - DNA, 20 bp, Homo sapiens
cagagtggtcgagtgacaca

SEQ ID NO: 4130363 - DNA, 22 bp, Homo sapiens
cagagtggtctttctggagagg

SEQ ID NO: 4130364 - DNA, 19 bp, Homo sapiens
cagagttcacaggaggcca

SEQ ID NO: 4130365 - DNA, 16 bp, Homo sapiens
cagataaatagaacta

SEQ ID NO: 4130366 - DNA, 22 bp, Homo sapiens
cagataacaatgcagcaaggcc

SEQ ID NO: 4130367 - DNA, 16 bp, Homo sapiens
cagataacataccttt

SEQ ID NO: 4130368 - DNA, 19 bp, Homo sapiens
cagataagaatgctggttt

SEQ ID NO: 4130369 - DNA, 14 bp, Homo sapiens
cagataatcagtgt

SEQ ID NO: 4130370 - DNA, 13 bp, Homo sapiens
cagatacatcact

SEQ ID NO: 4130371 - DNA, 15 bp, Homo sapiens
cagatacatcactgc

SEQ ID NO: 4130372 - DNA, 16 bp, Homo sapiens
cagatacatcactgct

SEQ ID NO: 4130373 - DNA, 18 bp, Homo sapiens
cagataccttgaaaggaa

SEQ ID NO: 4130374 - DNA, 19 bp, Homo sapiens
cagataccttgaaaggaag

SEQ ID NO: 4130375 - DNA, 18 bp, Homo sapiens
cagatactactgaccaga

SEQ ID NO: 4130376 - DNA, 13 bp, Homo sapiens
cagatagagaaat

SEQ ID NO: 4130377 - DNA, 14 bp, Homo sapiens
cagatagagctggg

SEQ ID NO: 4130378 - DNA, 16 bp, Homo sapiens
cagatagagctgggtg

SEQ ID NO: 4130379 - DNA, 18 bp, Homo sapiens
cagatataaatggctggt

SEQ ID NO: 4130380 - DNA, 20 bp, Homo sapiens
cagatataaatggctggttt

SEQ ID NO: 4130381 - DNA, 23 bp, Homo sapiens
cagatataaatggctggttttta

SEQ ID NO: 4130382 - DNA, 17 bp, Homo sapiens
cagatatatttaagcct

SEQ ID NO: 4130383 - DNA, 15 bp, Homo sapiens
cagatatatttttca

SEQ ID NO: 4130384 - DNA, 16 bp, Homo sapiens
cagatatatttttcac

SEQ ID NO: 4130385 - DNA, 19 bp, Homo sapiens
cagatatatttttcacagt

SEQ ID NO: 4130386 - DNA, 17 bp, Homo sapiens
cagatatcaaaattcta

SEQ ID NO: 4130387 - DNA, 11 bp, Homo sapiens
cagatatttat

SEQ ID NO: 4130388 - DNA, 14 bp, Homo sapiens
cagatatttatatt

SEQ ID NO: 4130389 - DNA, 20 bp, Homo sapiens
cagatatttatatttttatt

SEQ ID NO: 4130390 - DNA, 17 bp, Homo sapiens
cagatatttccatttct

SEQ ID NO: 4130391 - DNA, 21 bp, Homo sapiens
cagatatttccatttcttcct

SEQ ID NO: 4130392 - DNA, 23 bp, Homo sapiens
cagatatttccatttcttcctca

SEQ ID NO: 4130393 - DNA, 20 bp, Homo sapiens
cagatattttttcagaaata

SEQ ID NO: 4130394 - DNA, 18 bp, Homo sapiens
cagatcactgaatttata

SEQ ID NO: 4130395 - DNA, 19 bp, Homo sapiens
cagatcactgaatttataa

SEQ ID NO: 4130396 - DNA, 15 bp, Homo sapiens
cagatcagccagaag

SEQ ID NO: 4130397 - DNA, 14 bp, Homo sapiens
cagatccagcctgg

SEQ ID NO: 4130398 - DNA, 12 bp, Homo sapiens
cagatccaggac

SEQ ID NO: 4130399 - DNA, 13 bp, Homo sapiens
cagatccagggac

SEQ ID NO: 4130400 - DNA, 15 bp, Homo sapiens
cagatccagggacag

SEQ ID NO: 4130401 - DNA, 17 bp, Homo sapiens
cagatcccatccatcag

SEQ ID NO: 4130402 - DNA, 16 bp, Homo sapiens
cagatcctcacaacca

SEQ ID NO: 4130403 - DNA, 18 bp, Homo sapiens
cagatcctttttccatca

SEQ ID NO: 4130404 - DNA, 13 bp, Homo sapiens
cagatctcccact

SEQ ID NO: 4130405 - DNA, 15 bp, Homo sapiens
cagatctggaacctc

SEQ ID NO: 4130406 - DNA, 18 bp, Homo sapiens
cagatctggtcccttgca

SEQ ID NO: 4130407 - DNA, 13 bp, Homo sapiens
cagatctgtctga

SEQ ID NO: 4130408 - DNA, 15 bp, Homo sapiens
cagatctgtgcccca

SEQ ID NO: 4130409 - DNA, 18 bp, Homo sapiens
cagatctttctccttgaa

SEQ ID NO: 4130410 - DNA, 14 bp, Homo sapiens
cagatgaaaatttg

SEQ ID NO: 4130411 - DNA, 17 bp, Homo sapiens
cagatgaaaatttgaga

SEQ ID NO: 4130412 - DNA, 20 bp, Homo sapiens
cagatgagcaaggacattgc

SEQ ID NO: 4130413 - DNA, 21 bp, Homo sapiens
cagatgagcaaggacattgcc

SEQ ID NO: 4130414 - DNA, 18 bp, Homo sapiens
cagatgagcagtcacact

SEQ ID NO: 4130415 - DNA, 18 bp, Homo sapiens
cagatgatctctccacgg

SEQ ID NO: 4130416 - DNA, 13 bp, Homo sapiens
cagatgcaacctc

SEQ ID NO: 4130417 - DNA, 16 bp, Homo sapiens
cagatgcagagagcca

SEQ ID NO: 4130418 - DNA, 13 bp, Homo sapiens
cagatgcagctct

SEQ ID NO: 4130419 - DNA, 14 bp, Homo sapiens
cagatgcagctctt

SEQ ID NO: 4130420 - DNA, 19 bp, Homo sapiens
cagatgcagctcttcctgg

SEQ ID NO: 4130421 - DNA, 13 bp, Homo sapiens
cagatgcaggaca

SEQ ID NO: 4130422 - DNA, 19 bp, Homo sapiens
cagatgcaggacaggaggc

SEQ ID NO: 4130423 - DNA, 22 bp, Homo sapiens
cagatgcaggacaggaggcggc

SEQ ID NO: 4130424 - DNA, 23 bp, Homo sapiens
cagatgcaggacaggaggcggcc

SEQ ID NO: 4130425 - DNA, 13 bp, Homo sapiens
cagatgcagggca

SEQ ID NO: 4130426 - DNA, 13 bp, Homo sapiens
cagatgccccaga

SEQ ID NO: 4130427 - DNA, 15 bp, Homo sapiens
cagatgccccagagc

SEQ ID NO: 4130428 - DNA, 22 bp, Homo sapiens
cagatgccctttggaaagccat

SEQ ID NO: 4130429 - DNA, 12 bp, Homo sapiens
cagatgctctga

SEQ ID NO: 4130430 - DNA, 13 bp, Homo sapiens
cagatgcttctgg

SEQ ID NO: 4130431 - DNA, 17 bp, Homo sapiens
cagatggaaatattttg

SEQ ID NO: 4130432 - DNA, 13 bp, Homo sapiens
cagatggactggg

SEQ ID NO: 4130433 - DNA, 15 bp, Homo sapiens
cagatggactgggag

SEQ ID NO: 4130434 - DNA, 18 bp, Homo sapiens
cagatggactgggaggag

SEQ ID NO: 4130435 - DNA, 22 bp, Homo sapiens
cagatggaggttctcagagcca

SEQ ID NO: 4130436 - DNA, 23 bp, Homo sapiens
cagatggaggttctcagagccaa

SEQ ID NO: 4130437 - DNA, 22 bp, Homo sapiens
cagatggcccggatgctgcttc

SEQ ID NO: 4130438 - DNA, 15 bp, Homo sapiens
cagatgggccacggc

SEQ ID NO: 4130439 - DNA, 22 bp, Homo sapiens
cagatgggtctgatattaatca

SEQ ID NO: 4130440 - DNA, 23 bp, Homo sapiens
cagatgggtctgatattaatcaa

SEQ ID NO: 4130441 - DNA, 19 bp, Homo sapiens
cagatggtttccacattta

SEQ ID NO: 4130442 - DNA, 17 bp, Homo sapiens
cagatgtattgactgta

SEQ ID NO: 4130443 - DNA, 16 bp, Homo sapiens
cagatgtctctggggc

SEQ ID NO: 4130444 - DNA, 22 bp, Homo sapiens
cagatgtctctggggcagatcc

SEQ ID NO: 4130445 - DNA, 16 bp, Homo sapiens
cagatgtgactgtata

SEQ ID NO: 4130446 - DNA, 15 bp, Homo sapiens
cagatgtgagccacc

SEQ ID NO: 4130447 - DNA, 22 bp, Homo sapiens
cagatgtgtcccccccaggcct

SEQ ID NO: 4130448 - DNA, 23 bp, Homo sapiens
cagatgttgaatgcccacaggca

SEQ ID NO: 4130449 - DNA, 18 bp, Homo sapiens
cagatgtttccagacttc

SEQ ID NO: 4130450 - DNA, 23 bp, Homo sapiens
cagatgtttccagacttccttga

SEQ ID NO: 4130451 - DNA, 20 bp, Homo sapiens
cagattagatgtgccaataa

SEQ ID NO: 4130452 - DNA, 20 bp, Homo sapiens
cagattcaggccagcccagc

SEQ ID NO: 4130453 - DNA, 16 bp, Homo sapiens
cagattcccctgtgtc

SEQ ID NO: 4130454 - DNA, 14 bp, Homo sapiens
cagattgaaaagga

SEQ ID NO: 4130455 - DNA, 14 bp, Homo sapiens
cagattgcctcctt

SEQ ID NO: 4130456 - DNA, 23 bp, Homo sapiens
cagattgttaggagtggttctca

SEQ ID NO: 4130457 - DNA, 17 bp, Homo sapiens
cagatttactaaatcaa

SEQ ID NO: 4130458 - DNA, 16 bp, Homo sapiens
cagatttctggttgat

SEQ ID NO: 4130459 - DNA, 17 bp, Homo sapiens
cagatttctggttgatt

SEQ ID NO: 4130460 - DNA, 23 bp, Homo sapiens
cagattttaattttgaataaata

SEQ ID NO: 4130461 - DNA, 17 bp, Homo sapiens
cagattttacaaaagat

SEQ ID NO: 4130462 - DNA, 14 bp, Homo sapiens
cagatttttacaaa

SEQ ID NO: 4130463 - DNA, 15 bp, Homo sapiens
cagatttttacaaat

SEQ ID NO: 4130464 - DNA, 17 bp, Homo sapiens
cagatttttcggaggcc

SEQ ID NO: 4130465 - DNA, 23 bp, Homo sapiens
cagattttttgaaccatccactt

SEQ ID NO: 4130466 - DNA, 19 bp, Homo sapiens
cagcaaagagtgggctgca

SEQ ID NO: 4130467 - DNA, 23 bp, Homo sapiens
cagcaaagcaaatgttgggaaag

SEQ ID NO: 4130468 - DNA, 23 bp, Homo sapiens
cagcaacgcccctccaaacctcc

SEQ ID NO: 4130469 - DNA, 15 bp, Homo sapiens
cagcaagaatattgt

SEQ ID NO: 4130470 - DNA, 20 bp, Homo sapiens
cagcaagccgaatagctgat

SEQ ID NO: 4130471 - DNA, 20 bp, Homo sapiens
cagcaaggcaggttggatgg

SEQ ID NO: 4130472 - DNA, 18 bp, Homo sapiens
cagcaaggccctgctgcc

SEQ ID NO: 4130473 - DNA, 19 bp, Homo sapiens
cagcaaggccctgctgccc

SEQ ID NO: 4130474 - DNA, 16 bp, Homo sapiens
cagcaaggtcttgctc

SEQ ID NO: 4130475 - DNA, 16 bp, Homo sapiens
cagcaataagaaatga

SEQ ID NO: 4130476 - DNA, 21 bp, Homo sapiens
cagcaataagaaatgaacaaa

SEQ ID NO: 4130477 - DNA, 19 bp, Homo sapiens
cagcaatgacatctcaggg

SEQ ID NO: 4130478 - DNA, 20 bp, Homo sapiens
cagcaatgacatctcagggg

SEQ ID NO: 4130479 - DNA, 18 bp, Homo sapiens
cagcaatgatgtccagaa

SEQ ID NO: 4130480 - DNA, 22 bp, Homo sapiens
cagcaatgatgtccagaagaat

SEQ ID NO: 4130481 - DNA, 15 bp, Homo sapiens
cagcaatttaaatgt

SEQ ID NO: 4130482 - DNA, 16 bp, Homo sapiens
cagcacaaggccatct

SEQ ID NO: 4130483 - DNA, 18 bp, Homo sapiens
cagcacacagggcagtga

SEQ ID NO: 4130484 - DNA, 21 bp, Homo sapiens
cagcacagaaggaatctgtgc

SEQ ID NO: 4130485 - DNA, 11 bp, Homo sapiens
cagcacagcct

SEQ ID NO: 4130486 - DNA, 23 bp, Homo sapiens
cagcacagggggattctgagcag

SEQ ID NO: 4130487 - DNA, 14 bp, Homo sapiens
cagcacccccaccc

SEQ ID NO: 4130488 - DNA, 17 bp, Homo sapiens
cagcacccccacccacc

SEQ ID NO: 4130489 - DNA, 18 bp, Homo sapiens
cagcacccccacccacct

SEQ ID NO: 4130490 - DNA, 13 bp, Homo sapiens
cagcaccctaaga

SEQ ID NO: 4130491 - DNA, 14 bp, Homo sapiens
cagcaccctccccc

SEQ ID NO: 4130492 - DNA, 17 bp, Homo sapiens
cagcaccctctcctggg

SEQ ID NO: 4130493 - DNA, 23 bp, Homo sapiens
cagcaccctctcctgggggtggc

SEQ ID NO: 4130494 - DNA, 18 bp, Homo sapiens
cagcacctccaggcctgt

SEQ ID NO: 4130495 - DNA, 15 bp, Homo sapiens
cagcacctgcctcct

SEQ ID NO: 4130496 - DNA, 18 bp, Homo sapiens
cagcactaaggccgtgtc

SEQ ID NO: 4130497 - DNA, 21 bp, Homo sapiens
cagcactaaggccgtgtctct

SEQ ID NO: 4130498 - DNA, 14 bp, Homo sapiens
cagcactgatttca

SEQ ID NO: 4130499 - DNA, 12 bp, Homo sapiens
cagcactgtccc

SEQ ID NO: 4130500 - DNA, 18 bp, Homo sapiens
cagcactgtcccttgcct

SEQ ID NO: 4130501 - DNA, 15 bp, Homo sapiens
cagcactgtctcagt

SEQ ID NO: 4130502 - DNA, 22 bp, Homo sapiens
cagcactgtgaagacccagcag

SEQ ID NO: 4130503 - DNA, 20 bp, Homo sapiens
cagcagaagcctccaagcac

SEQ ID NO: 4130504 - DNA, 21 bp, Homo sapiens
cagcagaatggtgatcactcc

SEQ ID NO: 4130505 - DNA, 16 bp, Homo sapiens
cagcagacacacatgg

SEQ ID NO: 4130506 - DNA, 21 bp, Homo sapiens
cagcagacacacatgggcagc

SEQ ID NO: 4130507 - DNA, 13 bp, Homo sapiens
cagcagaggcagg

SEQ ID NO: 4130508 - DNA, 17 bp, Homo sapiens
cagcagaggcaggctgg

SEQ ID NO: 4130509 - DNA, 18 bp, Homo sapiens
cagcagaggcaggctggg

SEQ ID NO: 4130510 - DNA, 22 bp, Homo sapiens
cagcagaggcggtcttcaacat

SEQ ID NO: 4130511 - DNA, 14 bp, Homo sapiens
cagcagcaccaacc

SEQ ID NO: 4130512 - DNA, 16 bp, Homo sapiens
cagcagcccaagctta

SEQ ID NO: 4130513 - DNA, 19 bp, Homo sapiens
cagcagccccgtctgccca

SEQ ID NO: 4130514 - DNA, 21 bp, Homo sapiens
cagcagccccgtctgcccacc

SEQ ID NO: 4130515 - DNA, 17 bp, Homo sapiens
cagcagccctcaacagg

SEQ ID NO: 4130516 - DNA, 21 bp, Homo sapiens
cagcagcctggggctggcctc

SEQ ID NO: 4130517 - DNA, 18 bp, Homo sapiens
cagcagctgaacagccaa

SEQ ID NO: 4130518 - DNA, 20 bp, Homo sapiens
cagcagctgaacagccaaat

SEQ ID NO: 4130519 - DNA, 16 bp, Homo sapiens
cagcagcttcaccaga

SEQ ID NO: 4130520 - DNA, 20 bp, Homo sapiens
cagcagcttggggagaggga

SEQ ID NO: 4130521 - DNA, 18 bp, Homo sapiens
cagcaggaagccaggctg

SEQ ID NO: 4130522 - DNA, 15 bp, Homo sapiens
cagcagggcagtagc

SEQ ID NO: 4130523 - DNA, 15 bp, Homo sapiens
cagcagggcctcaaa

SEQ ID NO: 4130524 - DNA, 21 bp, Homo sapiens
cagcagggttttgggttgacc

SEQ ID NO: 4130525 - DNA, 14 bp, Homo sapiens
cagcagtgaccaca

SEQ ID NO: 4130526 - DNA, 19 bp, Homo sapiens
cagcagtgaccacaccaac

SEQ ID NO: 4130527 - DNA, 15 bp, Homo sapiens
cagcagtgatctcag

SEQ ID NO: 4130528 - DNA, 21 bp, Homo sapiens
cagcagtgatctcagggcaga

SEQ ID NO: 4130529 - DNA, 14 bp, Homo sapiens
cagcagtgttcccc

SEQ ID NO: 4130530 - DNA, 18 bp, Homo sapiens
cagcagtgttgctcagct

SEQ ID NO: 4130531 - DNA, 14 bp, Homo sapiens
cagcatcactcccc

SEQ ID NO: 4130532 - DNA, 15 bp, Homo sapiens
cagcatcactcccca

SEQ ID NO: 4130533 - DNA, 22 bp, Homo sapiens
cagcatcactccccaaggaaga

SEQ ID NO: 4130534 - DNA, 19 bp, Homo sapiens
cagcatcattttgcattca

SEQ ID NO: 4130535 - DNA, 20 bp, Homo sapiens
cagcatcattttgcattcaa

SEQ ID NO: 4130536 - DNA, 22 bp, Homo sapiens
cagcatcattttgcattcaaat

SEQ ID NO: 4130537 - DNA, 18 bp, Homo sapiens
cagcatccaccttggctc

SEQ ID NO: 4130538 - DNA, 19 bp, Homo sapiens
cagcatccaccttggctct

SEQ ID NO: 4130539 - DNA, 20 bp, Homo sapiens
cagcatccctggagcaggag

SEQ ID NO: 4130540 - DNA, 12 bp, Homo sapiens
cagcatccgcag

SEQ ID NO: 4130541 - DNA, 20 bp, Homo sapiens
cagcatccgcaggtgctggt

SEQ ID NO: 4130542 - DNA, 22 bp, Homo sapiens
cagcatcggacaagacccccag

SEQ ID NO: 4130543 - DNA, 23 bp, Homo sapiens
cagcatcgggagcacccagagca

SEQ ID NO: 4130544 - DNA, 20 bp, Homo sapiens
cagcatctggctgtctagaa

SEQ ID NO: 4130545 - DNA, 23 bp, Homo sapiens
cagcatgaggtgttgtgcatttg

SEQ ID NO: 4130546 - DNA, 16 bp, Homo sapiens
cagcatgccccttggc

SEQ ID NO: 4130547 - DNA, 20 bp, Homo sapiens
cagcatgcttcccagaggga

SEQ ID NO: 4130548 - DNA, 22 bp, Homo sapiens
cagcatgcttcccagagggagc

SEQ ID NO: 4130549 - DNA, 17 bp, Homo sapiens
cagcatggaaaaatggt

SEQ ID NO: 4130550 - DNA, 18 bp, Homo sapiens
cagcatggaaaaatggtt

SEQ ID NO: 4130551 - DNA, 19 bp, Homo sapiens
cagcatggcatagccccgg

SEQ ID NO: 4130552 - DNA, 16 bp, Homo sapiens
cagcatggggttttta

SEQ ID NO: 4130553 - DNA, 23 bp, Homo sapiens
cagcatggggtttttattatttt

SEQ ID NO: 4130554 - DNA, 13 bp, Homo sapiens
cagcatgtgcctt

SEQ ID NO: 4130555 - DNA, 15 bp, Homo sapiens
cagcattctcactcc

SEQ ID NO: 4130556 - DNA, 13 bp, Homo sapiens
cagcattctggag

SEQ ID NO: 4130557 - DNA, 14 bp, Homo sapiens
cagcattctggagg

SEQ ID NO: 4130558 - DNA, 19 bp, Homo sapiens
cagcattcttgtcacaata

SEQ ID NO: 4130559 - DNA, 20 bp, Homo sapiens
cagcattcttgtcacaataa

SEQ ID NO: 4130560 - DNA, 12 bp, Homo sapiens
cagcatttcaag

SEQ ID NO: 4130561 - DNA, 19 bp, Homo sapiens
cagcatttccttccagccc

SEQ ID NO: 4130562 - DNA, 19 bp, Homo sapiens
cagcatttttaattttcac

SEQ ID NO: 4130563 - DNA, 17 bp, Homo sapiens
cagccaaacccatgagg

SEQ ID NO: 4130564 - DNA, 17 bp, Homo sapiens
cagccaaatgcagggag

SEQ ID NO: 4130565 - DNA, 18 bp, Homo sapiens
cagccaaatgcagggagg

SEQ ID NO: 4130566 - DNA, 19 bp, Homo sapiens
cagccaacacgcacctgcc

SEQ ID NO: 4130567 - DNA, 22 bp, Homo sapiens
cagccaacacgcacctgcctca

SEQ ID NO: 4130568 - DNA, 23 bp, Homo sapiens
cagccaacacgcacctgcctcag

SEQ ID NO: 4130569 - DNA, 17 bp, Homo sapiens
cagccaactagcccctg

SEQ ID NO: 4130570 - DNA, 19 bp, Homo sapiens
cagccaactagcccctggg

SEQ ID NO: 4130571 - DNA, 20 bp, Homo sapiens
cagccaactagcccctgggg

SEQ ID NO: 4130572 - DNA, 15 bp, Homo sapiens
cagccacacccaggc

SEQ ID NO: 4130573 - DNA, 19 bp, Homo sapiens
cagccacacccaggcactt

SEQ ID NO: 4130574 - DNA, 23 bp, Homo sapiens
cagccacagcctccccacccagg

SEQ ID NO: 4130575 - DNA, 12 bp, Homo sapiens
cagccacatccc

SEQ ID NO: 4130576 - DNA, 15 bp, Homo sapiens
cagccacatccccaa

SEQ ID NO: 4130577 - DNA, 11 bp, Homo sapiens
cagccaccccg

SEQ ID NO: 4130578 - DNA, 17 bp, Homo sapiens
cagccaccccgggctct

SEQ ID NO: 4130579 - DNA, 20 bp, Homo sapiens
cagccaccccgggctctctg

SEQ ID NO: 4130580 - DNA, 16 bp, Homo sapiens
cagccacgattggaga

SEQ ID NO: 4130581 - DNA, 23 bp, Homo sapiens
cagccactcgggaggctgagaca

SEQ ID NO: 4130582 - DNA, 12 bp, Homo sapiens
cagccactggct

SEQ ID NO: 4130583 - DNA, 21 bp, Homo sapiens
cagccacttcggccaggtcac

SEQ ID NO: 4130584 - DNA, 12 bp, Homo sapiens
cagccagaactc

SEQ ID NO: 4130585 - DNA, 12 bp, Homo sapiens
cagccagagctg

SEQ ID NO: 4130586 - DNA, 19 bp, Homo sapiens
cagccagaggagggcagag

SEQ ID NO: 4130587 - DNA, 21 bp, Homo sapiens
cagccagaggagggcagaggg

SEQ ID NO: 4130588 - DNA, 22 bp, Homo sapiens
cagccagaggagggcagaggga

SEQ ID NO: 4130589 - DNA, 19 bp, Homo sapiens
cagccagaggcatctgagg

SEQ ID NO: 4130590 - DNA, 20 bp, Homo sapiens
cagccagcaatgatgtccag

SEQ ID NO: 4130591 - DNA, 22 bp, Homo sapiens
cagccagcaatgatgtccagaa

SEQ ID NO: 4130592 - DNA, 12 bp, Homo sapiens
cagccagcagag

SEQ ID NO: 4130593 - DNA, 14 bp, Homo sapiens
cagccagcagaggg

SEQ ID NO: 4130594 - DNA, 12 bp, Homo sapiens
cagccagggcca

SEQ ID NO: 4130595 - DNA, 18 bp, Homo sapiens
cagccaggtttagcggca

SEQ ID NO: 4130596 - DNA, 22 bp, Homo sapiens
cagccagtgacctttgacctcg

SEQ ID NO: 4130597 - DNA, 21 bp, Homo sapiens
cagccatacttatctctctgt

SEQ ID NO: 4130598 - DNA, 13 bp, Homo sapiens
cagccatcaaaat

SEQ ID NO: 4130599 - DNA, 16 bp, Homo sapiens
cagccatcaaaatgct

SEQ ID NO: 4130600 - DNA, 17 bp, Homo sapiens
cagccatcctccctcca

SEQ ID NO: 4130601 - DNA, 15 bp, Homo sapiens
cagccatgtccaagt

SEQ ID NO: 4130602 - DNA, 21 bp, Homo sapiens
cagcccaaagctgcaggtgcc

SEQ ID NO: 4130603 - DNA, 17 bp, Homo sapiens
cagcccaatccctgatc

SEQ ID NO: 4130604 - DNA, 11 bp, Homo sapiens
cagcccaccct

SEQ ID NO: 4130605 - DNA, 21 bp, Homo sapiens
cagcccactgcaccgcctcag

SEQ ID NO: 4130606 - DNA, 22 bp, Homo sapiens
cagcccagagacatacttgaag

SEQ ID NO: 4130607 - DNA, 14 bp, Homo sapiens
cagcccagagcctg

SEQ ID NO: 4130608 - DNA, 22 bp, Homo sapiens
cagcccagaggccgagagctat

SEQ ID NO: 4130609 - DNA, 17 bp, Homo sapiens
cagcccagcagtgtgga

SEQ ID NO: 4130610 - DNA, 23 bp, Homo sapiens
cagcccaggccggggtggagcat

SEQ ID NO: 4130611 - DNA, 19 bp, Homo sapiens
cagcccatgcccacctgcc

SEQ ID NO: 4130612 - DNA, 22 bp, Homo sapiens
cagccccaaattgtcacctgct

SEQ ID NO: 4130613 - DNA, 21 bp, Homo sapiens
cagccccacccaggagggagg

SEQ ID NO: 4130614 - DNA, 14 bp, Homo sapiens
cagccccaccctgt

SEQ ID NO: 4130615 - DNA, 15 bp, Homo sapiens
cagccccagaagaaa

SEQ ID NO: 4130616 - DNA, 17 bp, Homo sapiens
cagccccagagagagga

SEQ ID NO: 4130617 - DNA, 22 bp, Homo sapiens
cagccccatcagaacctgagct

SEQ ID NO: 4130618 - DNA, 14 bp, Homo sapiens
cagccccatccctg

SEQ ID NO: 4130619 - DNA, 17 bp, Homo sapiens
cagccccatccctgtcc

SEQ ID NO: 4130620 - DNA, 19 bp, Homo sapiens
cagccccatccctgtcctc

SEQ ID NO: 4130621 - DNA, 14 bp, Homo sapiens
cagcccccagcccc

SEQ ID NO: 4130622 - DNA, 16 bp, Homo sapiens
cagcccccgccccaga

SEQ ID NO: 4130623 - DNA, 18 bp, Homo sapiens
cagcccccgccccagagt

SEQ ID NO: 4130624 - DNA, 23 bp, Homo sapiens
cagcccccgccccagagtggccc

SEQ ID NO: 4130625 - DNA, 16 bp, Homo sapiens
cagccccctccacacc

SEQ ID NO: 4130626 - DNA, 17 bp, Homo sapiens
cagccccggcaagccac

SEQ ID NO: 4130627 - DNA, 15 bp, Homo sapiens
cagccccggccctgg

SEQ ID NO: 4130628 - DNA, 17 bp, Homo sapiens
cagccccggccctgggc

SEQ ID NO: 4130629 - DNA, 18 bp, Homo sapiens
cagccccgtctgcccacc

SEQ ID NO: 4130630 - DNA, 17 bp, Homo sapiens
cagcccctactgctgtg

SEQ ID NO: 4130631 - DNA, 20 bp, Homo sapiens
cagcccctactgctgtgaac

SEQ ID NO: 4130632 - DNA, 13 bp, Homo sapiens
cagcccctggccc

SEQ ID NO: 4130633 - DNA, 14 bp, Homo sapiens
cagcccctggggcc

SEQ ID NO: 4130634 - DNA, 19 bp, Homo sapiens
cagcccctggggcccagcc

SEQ ID NO: 4130635 - DNA, 20 bp, Homo sapiens
cagcccctgtttactggttc

SEQ ID NO: 4130636 - DNA, 21 bp, Homo sapiens
cagcccctgtttactggttct

SEQ ID NO: 4130637 - DNA, 16 bp, Homo sapiens
cagccccttgctctca

SEQ ID NO: 4130638 - DNA, 18 bp, Homo sapiens
cagccctaaggatctctc

SEQ ID NO: 4130639 - DNA, 20 bp, Homo sapiens
cagccctaaggatctctcag

SEQ ID NO: 4130640 - DNA, 16 bp, Homo sapiens
cagccctagagcctgc

SEQ ID NO: 4130641 - DNA, 22 bp, Homo sapiens
cagccctagagcctgcctggag

SEQ ID NO: 4130642 - DNA, 23 bp, Homo sapiens
cagccctagagcctgcctggagc

SEQ ID NO: 4130643 - DNA, 22 bp, Homo sapiens
cagccctcaacaggcccaggga

SEQ ID NO: 4130644 - DNA, 16 bp, Homo sapiens
cagccctccactccag

SEQ ID NO: 4130645 - DNA, 21 bp, Homo sapiens
cagccctccccatggagccag

SEQ ID NO: 4130646 - DNA, 16 bp, Homo sapiens
cagccctccctgcccc

SEQ ID NO: 4130647 - DNA, 22 bp, Homo sapiens
cagccctccctgcccctccctt

SEQ ID NO: 4130648 - DNA, 21 bp, Homo sapiens
cagccctccgaccctcatggc

SEQ ID NO: 4130649 - DNA, 12 bp, Homo sapiens
cagccctgaggt

SEQ ID NO: 4130650 - DNA, 22 bp, Homo sapiens
cagccctgaggtgaaagggagc

SEQ ID NO: 4130651 - DNA, 11 bp, Homo sapiens
cagccctgctt

SEQ ID NO: 4130652 - DNA, 22 bp, Homo sapiens
cagccctgctttgggctgccct

SEQ ID NO: 4130653 - DNA, 16 bp, Homo sapiens
cagccctggctctgca

SEQ ID NO: 4130654 - DNA, 15 bp, Homo sapiens
cagccctgtcctggt

SEQ ID NO: 4130655 - DNA, 16 bp, Homo sapiens
cagccctgtcctggtt

SEQ ID NO: 4130656 - DNA, 17 bp, Homo sapiens
cagccctgtcctggttc

SEQ ID NO: 4130657 - DNA, 17 bp, Homo sapiens
cagccgagccgggcctg

SEQ ID NO: 4130658 - DNA, 13 bp, Homo sapiens
cagccgccagctg

SEQ ID NO: 4130659 - DNA, 16 bp, Homo sapiens
cagccgccccagcccc

SEQ ID NO: 4130660 - DNA, 13 bp, Homo sapiens
cagccgccctggg

SEQ ID NO: 4130661 - DNA, 13 bp, Homo sapiens
cagccgctccaga

SEQ ID NO: 4130662 - DNA, 15 bp, Homo sapiens
cagccggcacagggt

SEQ ID NO: 4130663 - DNA, 17 bp, Homo sapiens
cagccgggagcttggct

SEQ ID NO: 4130664 - DNA, 19 bp, Homo sapiens
cagccgtgatgctcaggct

SEQ ID NO: 4130665 - DNA, 16 bp, Homo sapiens
cagccgtgccttcagc

SEQ ID NO: 4130666 - DNA, 18 bp, Homo sapiens
cagccgtgccttcagctc

SEQ ID NO: 4130667 - DNA, 23 bp, Homo sapiens
cagccgtttgttctacatggctt

SEQ ID NO: 4130668 - DNA, 12 bp, Homo sapiens
cagcctacagtt

SEQ ID NO: 4130669 - DNA, 14 bp, Homo sapiens
cagcctatgggggc

SEQ ID NO: 4130670 - DNA, 12 bp, Homo sapiens
cagcctcagagg

SEQ ID NO: 4130671 - DNA, 22 bp, Homo sapiens
cagcctccaacacaaggctcca

SEQ ID NO: 4130672 - DNA, 14 bp, Homo sapiens
cagcctccagcctg

SEQ ID NO: 4130673 - DNA, 15 bp, Homo sapiens
cagcctccagcctgc

SEQ ID NO: 4130674 - DNA, 12 bp, Homo sapiens
cagcctccaggg

SEQ ID NO: 4130675 - DNA, 18 bp, Homo sapiens
cagcctcccacccccatc

SEQ ID NO: 4130676 - DNA, 16 bp, Homo sapiens
cagcctcccatccagg

SEQ ID NO: 4130677 - DNA, 18 bp, Homo sapiens
cagcctcccatccagggc

SEQ ID NO: 4130678 - DNA, 20 bp, Homo sapiens
cagcctcccatccagggccc

SEQ ID NO: 4130679 - DNA, 12 bp, Homo sapiens
cagcctccccac

SEQ ID NO: 4130680 - DNA, 16 bp, Homo sapiens
cagcctccctgtctcc

SEQ ID NO: 4130681 - DNA, 17 bp, Homo sapiens
cagcctccctgtctcca

SEQ ID NO: 4130682 - DNA, 20 bp, Homo sapiens
cagcctccctgtctccagct

SEQ ID NO: 4130683 - DNA, 22 bp, Homo sapiens
cagcctccctgtctccagctgc

SEQ ID NO: 4130684 - DNA, 12 bp, Homo sapiens
cagcctcctctg

SEQ ID NO: 4130685 - DNA, 14 bp, Homo sapiens
cagcctcctctgga

SEQ ID NO: 4130686 - DNA, 22 bp, Homo sapiens
cagcctcctctggacggcaggc

SEQ ID NO: 4130687 - DNA, 15 bp, Homo sapiens
cagcctcgcctgtca

SEQ ID NO: 4130688 - DNA, 18 bp, Homo sapiens
cagcctcgttggaagagg

SEQ ID NO: 4130689 - DNA, 15 bp, Homo sapiens
cagcctctttccctt

SEQ ID NO: 4130690 - DNA, 19 bp, Homo sapiens
cagcctctttcccttccag

SEQ ID NO: 4130691 - DNA, 13 bp, Homo sapiens
cagcctgacctga

SEQ ID NO: 4130692 - DNA, 19 bp, Homo sapiens
cagcctgacctgagactgt

SEQ ID NO: 4130693 - DNA, 15 bp, Homo sapiens
cagcctgaccttcct

SEQ ID NO: 4130694 - DNA, 22 bp, Homo sapiens
cagcctgaccttccttcctgtt

SEQ ID NO: 4130695 - DNA, 20 bp, Homo sapiens
cagcctgagcaactcttgat

SEQ ID NO: 4130696 - DNA, 21 bp, Homo sapiens
cagcctgagcaactcttgatt

SEQ ID NO: 4130697 - DNA, 23 bp, Homo sapiens
cagcctgaggcagccacttcggc

SEQ ID NO: 4130698 - DNA, 10 bp, Homo sapiens
cagcctgagt

SEQ ID NO: 4130699 - DNA, 20 bp, Homo sapiens
cagcctgagtctcctgtgcc

SEQ ID NO: 4130700 - DNA, 21 bp, Homo sapiens
cagcctgcccaagcccaggcc

SEQ ID NO: 4130701 - DNA, 14 bp, Homo sapiens
cagcctgcccctag

SEQ ID NO: 4130702 - DNA, 18 bp, Homo sapiens
cagcctgccttgcccact

SEQ ID NO: 4130703 - DNA, 16 bp, Homo sapiens
cagcctgctgagagcc

SEQ ID NO: 4130704 - DNA, 19 bp, Homo sapiens
cagcctggaaacctgtctg

SEQ ID NO: 4130705 - DNA, 22 bp, Homo sapiens
cagcctggactttggttctctc

SEQ ID NO: 4130706 - DNA, 19 bp, Homo sapiens
cagcctggatccctgccct

SEQ ID NO: 4130707 - DNA, 13 bp, Homo sapiens
cagcctggcacag

SEQ ID NO: 4130708 - DNA, 14 bp, Homo sapiens
cagcctggccagac

SEQ ID NO: 4130709 - DNA, 20 bp, Homo sapiens
cagcctggccagacacaggc

SEQ ID NO: 4130710 - DNA, 11 bp, Homo sapiens
cagcctggcct

SEQ ID NO: 4130711 - DNA, 13 bp, Homo sapiens
cagcctggcctgc

SEQ ID NO: 4130712 - DNA, 12 bp, Homo sapiens
cagcctggctgg

SEQ ID NO: 4130713 - DNA, 16 bp, Homo sapiens
cagcctggctggtcct

SEQ ID NO: 4130714 - DNA, 19 bp, Homo sapiens
cagcctggctggtcctccc

SEQ ID NO: 4130715 - DNA, 19 bp, Homo sapiens
cagcctgggcaacagagca

SEQ ID NO: 4130716 - DNA, 23 bp, Homo sapiens
cagcctggggcaaacctagccgg

SEQ ID NO: 4130717 - DNA, 19 bp, Homo sapiens
cagcctggggtctggagtt

SEQ ID NO: 4130718 - DNA, 19 bp, Homo sapiens
cagcctgtggcatctttgc

SEQ ID NO: 4130719 - DNA, 12 bp, Homo sapiens
cagcctgtggtt

SEQ ID NO: 4130720 - DNA, 20 bp, Homo sapiens
cagcctgtggttacagtgca

SEQ ID NO: 4130721 - DNA, 17 bp, Homo sapiens
cagccttagctgccagt

SEQ ID NO: 4130722 - DNA, 22 bp, Homo sapiens
cagccttctccatatctccatg

SEQ ID NO: 4130723 - DNA, 23 bp, Homo sapiens
cagccttctccatatctccatgg

SEQ ID NO: 4130724 - DNA, 15 bp, Homo sapiens
cagccttgagccctg

SEQ ID NO: 4130725 - DNA, 18 bp, Homo sapiens
cagccttgagccctggct

SEQ ID NO: 4130726 - DNA, 13 bp, Homo sapiens
cagccttgccaga

SEQ ID NO: 4130727 - DNA, 12 bp, Homo sapiens
cagccttgggga

SEQ ID NO: 4130728 - DNA, 17 bp, Homo sapiens
cagcctttgcctccccg

SEQ ID NO: 4130729 - DNA, 18 bp, Homo sapiens
cagcctttggccttggct

SEQ ID NO: 4130730 - DNA, 22 bp, Homo sapiens
cagcgaagtagcttgctccctg

SEQ ID NO: 4130731 - DNA, 20 bp, Homo sapiens
cagcgagaggcagagaaaga

SEQ ID NO: 4130732 - DNA, 23 bp, Homo sapiens
cagcgccaagtgcgtgccgtgtg

SEQ ID NO: 4130733 - DNA, 18 bp, Homo sapiens
cagcgccaggctgaccac

SEQ ID NO: 4130734 - DNA, 12 bp, Homo sapiens
cagcgcggccag

SEQ ID NO: 4130735 - DNA, 19 bp, Homo sapiens
cagcgctgttgaggggtcc

SEQ ID NO: 4130736 - DNA, 19 bp, Homo sapiens
cagcggaggagaccagctc

SEQ ID NO: 4130737 - DNA, 20 bp, Homo sapiens
cagcggcccctgcatcccct

SEQ ID NO: 4130738 - DNA, 18 bp, Homo sapiens
cagcgggagacctgtgct

SEQ ID NO: 4130739 - DNA, 13 bp, Homo sapiens
cagcgggcacagg

SEQ ID NO: 4130740 - DNA, 19 bp, Homo sapiens
cagcgggccaggcccgcac

SEQ ID NO: 4130741 - DNA, 16 bp, Homo sapiens
cagcgtaaaatggtga

SEQ ID NO: 4130742 - DNA, 19 bp, Homo sapiens
cagcgtcactctacctaat

SEQ ID NO: 4130743 - DNA, 15 bp, Homo sapiens
cagcgtcccagggta

SEQ ID NO: 4130744 - DNA, 14 bp, Homo sapiens
cagcgtcccagtct

SEQ ID NO: 4130745 - DNA, 15 bp, Homo sapiens
cagcgtccctggcgc

SEQ ID NO: 4130746 - DNA, 22 bp, Homo sapiens
cagctaaaccaaggactgagca

SEQ ID NO: 4130747 - DNA, 13 bp, Homo sapiens
cagctaagaacct

SEQ ID NO: 4130748 - DNA, 14 bp, Homo sapiens
cagctaagaacctg

SEQ ID NO: 4130749 - DNA, 16 bp, Homo sapiens
cagctaagaacctgga

SEQ ID NO: 4130750 - DNA, 19 bp, Homo sapiens
cagctaagaacctggaact

SEQ ID NO: 4130751 - DNA, 19 bp, Homo sapiens
cagctaagggaagacattt

SEQ ID NO: 4130752 - DNA, 13 bp, Homo sapiens
cagctaccccttc

SEQ ID NO: 4130753 - DNA, 19 bp, Homo sapiens
cagctactaaggtgctagg

SEQ ID NO: 4130754 - DNA, 19 bp, Homo sapiens
cagctactaatgatgtttt

SEQ ID NO: 4130755 - DNA, 13 bp, Homo sapiens
cagctactctccc

SEQ ID NO: 4130756 - DNA, 21 bp, Homo sapiens
cagctacttcctcctccccac

SEQ ID NO: 4130757 - DNA, 15 bp, Homo sapiens
cagctacttgggagg

SEQ ID NO: 4130758 - DNA, 21 bp, Homo sapiens
cagctaggaagagcaggactc

SEQ ID NO: 4130759 - DNA, 12 bp, Homo sapiens
cagctagtgcct

SEQ ID NO: 4130760 - DNA, 15 bp, Homo sapiens
cagctatacctgcac

SEQ ID NO: 4130761 - DNA, 18 bp, Homo sapiens
cagctatacctgcacgtt

SEQ ID NO: 4130762 - DNA, 23 bp, Homo sapiens
cagctatacctgcacgttcataa

SEQ ID NO: 4130763 - DNA, 18 bp, Homo sapiens
cagctatgggagccccag

SEQ ID NO: 4130764 - DNA, 20 bp, Homo sapiens
cagctatgggagccccaggg

SEQ ID NO: 4130765 - DNA, 13 bp, Homo sapiens
cagctcacccctg

SEQ ID NO: 4130766 - DNA, 15 bp, Homo sapiens
cagctcacccctggg

SEQ ID NO: 4130767 - DNA, 16 bp, Homo sapiens
cagctcacccctgggc

SEQ ID NO: 4130768 - DNA, 18 bp, Homo sapiens
cagctcaggacagatgcc

SEQ ID NO: 4130769 - DNA, 22 bp, Homo sapiens
cagctcaggacagatgccacac

SEQ ID NO: 4130770 - DNA, 12 bp, Homo sapiens
cagctcagtgag

SEQ ID NO: 4130771 - DNA, 17 bp, Homo sapiens
cagctcatctccaagga

SEQ ID NO: 4130772 - DNA, 13 bp, Homo sapiens
cagctccaccctg

SEQ ID NO: 4130773 - DNA, 16 bp, Homo sapiens
cagctccaggggccct

SEQ ID NO: 4130774 - DNA, 19 bp, Homo sapiens
cagctccaggggcccttgg

SEQ ID NO: 4130775 - DNA, 20 bp, Homo sapiens
cagctccaggggcccttggg

SEQ ID NO: 4130776 - DNA, 17 bp, Homo sapiens
cagctccaggtggctct

SEQ ID NO: 4130777 - DNA, 15 bp, Homo sapiens
cagctcccccaggct

SEQ ID NO: 4130778 - DNA, 21 bp, Homo sapiens
cagctcccccaggctgttctc

SEQ ID NO: 4130779 - DNA, 24 bp, Homo sapiens
cagctcccccaggctgttctccag

SEQ ID NO: 4130780 - DNA, 22 bp, Homo sapiens
cagctcccccgacggtgggcat

SEQ ID NO: 4130781 - DNA, 19 bp, Homo sapiens
cagctccctaggagaccaa

SEQ ID NO: 4130782 - DNA, 20 bp, Homo sapiens
cagctccctaggagaccaag

SEQ ID NO: 4130783 - DNA, 12 bp, Homo sapiens
cagctcccttct

SEQ ID NO: 4130784 - DNA, 13 bp, Homo sapiens
cagctcccttctg

SEQ ID NO: 4130785 - DNA, 15 bp, Homo sapiens
cagctcccttctgtt

SEQ ID NO: 4130786 - DNA, 14 bp, Homo sapiens
cagctccctttctc

SEQ ID NO: 4130787 - DNA, 17 bp, Homo sapiens
cagctccctttctcagg

SEQ ID NO: 4130788 - DNA, 16 bp, Homo sapiens
cagctccggcctgtcc

SEQ ID NO: 4130789 - DNA, 22 bp, Homo sapiens
cagctccggcgtgtgttcagtg

SEQ ID NO: 4130790 - DNA, 16 bp, Homo sapiens
cagctcctacctctgt

SEQ ID NO: 4130791 - DNA, 18 bp, Homo sapiens
cagctcctacctctgtgc

SEQ ID NO: 4130792 - DNA, 17 bp, Homo sapiens
cagctccttttccgttc

SEQ ID NO: 4130793 - DNA, 23 bp, Homo sapiens
cagctccttttccgttctgttct

SEQ ID NO: 4130794 - DNA, 19 bp, Homo sapiens
cagctcgcacccccctgtt

SEQ ID NO: 4130795 - DNA, 22 bp, Homo sapiens
cagctcgcacccccctgttcta

SEQ ID NO: 4130796 - DNA, 23 bp, Homo sapiens
cagctcgcacccccctgttctaa

SEQ ID NO: 4130797 - DNA, 23 bp, Homo sapiens
cagctcgtttttcagcaccccca

SEQ ID NO: 4130798 - DNA, 15 bp, Homo sapiens
cagctctaataaaac

SEQ ID NO: 4130799 - DNA, 19 bp, Homo sapiens
cagctctctgccctgtgta

SEQ ID NO: 4130800 - DNA, 21 bp, Homo sapiens
cagctctggacagccccaccc

SEQ ID NO: 4130801 - DNA, 12 bp, Homo sapiens
cagctctgggcc

SEQ ID NO: 4130802 - DNA, 19 bp, Homo sapiens
cagctctgggccattctcc

SEQ ID NO: 4130803 - DNA, 23 bp, Homo sapiens
cagctctgggccattctccacag

SEQ ID NO: 4130804 - DNA, 23 bp, Homo sapiens
cagctcttcctggacaggccagg

SEQ ID NO: 4130805 - DNA, 17 bp, Homo sapiens
cagctcttggcccctgt

SEQ ID NO: 4130806 - DNA, 15 bp, Homo sapiens
cagctgaacagccaa

SEQ ID NO: 4130807 - DNA, 21 bp, Homo sapiens
cagctgaatgcctcctgtggg

SEQ ID NO: 4130808 - DNA, 22 bp, Homo sapiens
cagctgacccggcctctctgcc

SEQ ID NO: 4130809 - DNA, 23 bp, Homo sapiens
cagctgacccggcctctctgccc

SEQ ID NO: 4130810 - DNA, 20 bp, Homo sapiens
cagctgactgtggccccctc

SEQ ID NO: 4130811 - DNA, 19 bp, Homo sapiens
cagctgagccctggggact

SEQ ID NO: 4130812 - DNA, 16 bp, Homo sapiens
cagctgagccttctga

SEQ ID NO: 4130813 - DNA, 14 bp, Homo sapiens
cagctgagcgccag

SEQ ID NO: 4130814 - DNA, 20 bp, Homo sapiens
cagctgaggacacaccccac

SEQ ID NO: 4130815 - DNA, 19 bp, Homo sapiens
cagctgaggtctcttgagg

SEQ ID NO: 4130816 - DNA, 21 bp, Homo sapiens
cagctgatacttcatttaaaa

SEQ ID NO: 4130817 - DNA, 18 bp, Homo sapiens
cagctgatgttggaagag

SEQ ID NO: 4130818 - DNA, 20 bp, Homo sapiens
cagctgattttaacaataac

SEQ ID NO: 4130819 - DNA, 21 bp, Homo sapiens
cagctgattttaacaataact

SEQ ID NO: 4130820 - DNA, 17 bp, Homo sapiens
cagctgcaagccaggga

SEQ ID NO: 4130821 - DNA, 16 bp, Homo sapiens
cagctgcaccagagca

SEQ ID NO: 4130822 - DNA, 18 bp, Homo sapiens
cagctgcactgatgctgc

SEQ ID NO: 4130823 - DNA, 17 bp, Homo sapiens
cagctgccccggcccct

SEQ ID NO: 4130824 - DNA, 19 bp, Homo sapiens
cagctgccccggcccctcc

SEQ ID NO: 4130825 - DNA, 22 bp, Homo sapiens
cagctgccccggcccctccccc

SEQ ID NO: 4130826 - DNA, 11 bp, Homo sapiens
cagctgcccta

SEQ ID NO: 4130827 - DNA, 15 bp, Homo sapiens
cagctgcctcctgcg

SEQ ID NO: 4130828 - DNA, 17 bp, Homo sapiens
cagctgcctggagaggg

SEQ ID NO: 4130829 - DNA, 21 bp, Homo sapiens
cagctgcctggagagggtctc

SEQ ID NO: 4130830 - DNA, 13 bp, Homo sapiens
cagctgcctgggc

SEQ ID NO: 4130831 - DNA, 15 bp, Homo sapiens
cagctgcctgggccc

SEQ ID NO: 4130832 - DNA, 17 bp, Homo sapiens
cagctgcgcttgctttt

SEQ ID NO: 4130833 - DNA, 12 bp, Homo sapiens
cagctgctgtct

SEQ ID NO: 4130834 - DNA, 14 bp, Homo sapiens
cagctgctgtcttc

SEQ ID NO: 4130835 - DNA, 11 bp, Homo sapiens
cagctgctttt

SEQ ID NO: 4130836 - DNA, 19 bp, Homo sapiens
cagctggactctgcatccc

SEQ ID NO: 4130837 - DNA, 13 bp, Homo sapiens
cagctggatctgc

SEQ ID NO: 4130838 - DNA, 20 bp, Homo sapiens
cagctggctctgacaagatg

SEQ ID NO: 4130839 - DNA, 11 bp, Homo sapiens
cagctgggcaa

SEQ ID NO: 4130840 - DNA, 15 bp, Homo sapiens
cagctgggcaaagcc

SEQ ID NO: 4130841 - DNA, 17 bp, Homo sapiens
cagctgggctctgcaat

SEQ ID NO: 4130842 - DNA, 16 bp, Homo sapiens
cagctggggccagagg

SEQ ID NO: 4130843 - DNA, 16 bp, Homo sapiens
cagctgggtcaggcag

SEQ ID NO: 4130844 - DNA, 18 bp, Homo sapiens
cagctggttactcagggt

SEQ ID NO: 4130845 - DNA, 20 bp, Homo sapiens
cagctggttactcagggttc

SEQ ID NO: 4130846 - DNA, 21 bp, Homo sapiens
cagctggttactcagggttca

SEQ ID NO: 4130847 - DNA, 16 bp, Homo sapiens
cagctgtaatctatga

SEQ ID NO: 4130848 - DNA, 22 bp, Homo sapiens
cagctgtcctgcagcaaacact

SEQ ID NO: 4130849 - DNA, 14 bp, Homo sapiens
cagctgtctgtggc

SEQ ID NO: 4130850 - DNA, 16 bp, Homo sapiens
cagctgtgcagcacgt

SEQ ID NO: 4130851 - DNA, 19 bp, Homo sapiens
cagctgttgtctcttctcc

SEQ ID NO: 4130852 - DNA, 22 bp, Homo sapiens
cagctgttgtctcttctcctta

SEQ ID NO: 4130853 - DNA, 11 bp, Homo sapiens
cagctgtttct

SEQ ID NO: 4130854 - DNA, 16 bp, Homo sapiens
cagctgtttctcatga

SEQ ID NO: 4130855 - DNA, 14 bp, Homo sapiens
cagctgtttgtcat

SEQ ID NO: 4130856 - DNA, 16 bp, Homo sapiens
cagcttaaatcctagc

SEQ ID NO: 4130857 - DNA, 14 bp, Homo sapiens
cagcttagatttca

SEQ ID NO: 4130858 - DNA, 15 bp, Homo sapiens
cagcttatctctttt

SEQ ID NO: 4130859 - DNA, 16 bp, Homo sapiens
cagcttatctctttta

SEQ ID NO: 4130860 - DNA, 23 bp, Homo sapiens
cagcttatctcttttatatttgt

SEQ ID NO: 4130861 - DNA, 14 bp, Homo sapiens
cagcttcaagtgcc

SEQ ID NO: 4130862 - DNA, 13 bp, Homo sapiens
cagcttcaccaga

SEQ ID NO: 4130863 - DNA, 22 bp, Homo sapiens
cagcttcactctctccgtctgt

SEQ ID NO: 4130864 - DNA, 18 bp, Homo sapiens
cagcttcaggcaccagca

SEQ ID NO: 4130865 - DNA, 18 bp, Homo sapiens
cagcttcatgcctttgta

SEQ ID NO: 4130866 - DNA, 20 bp, Homo sapiens
cagcttcatgcctttgtaag

SEQ ID NO: 4130867 - DNA, 19 bp, Homo sapiens
cagcttcattttatttttg

SEQ ID NO: 4130868 - DNA, 19 bp, Homo sapiens
cagcttcctacccacacct

SEQ ID NO: 4130869 - DNA, 22 bp, Homo sapiens
cagcttcctacccacacctctg

SEQ ID NO: 4130870 - DNA, 21 bp, Homo sapiens
cagcttcggagggcccctgcg

SEQ ID NO: 4130871 - DNA, 18 bp, Homo sapiens
cagcttctactcctgcct

SEQ ID NO: 4130872 - DNA, 21 bp, Homo sapiens
cagcttctactcctgcctcat

SEQ ID NO: 4130873 - DNA, 14 bp, Homo sapiens
cagcttctctctcc

SEQ ID NO: 4130874 - DNA, 19 bp, Homo sapiens
cagcttcttcacaggcact

SEQ ID NO: 4130875 - DNA, 17 bp, Homo sapiens
cagcttcttcctaggtc

SEQ ID NO: 4130876 - DNA, 14 bp, Homo sapiens
cagcttgagccggg

SEQ ID NO: 4130877 - DNA, 17 bp, Homo sapiens
cagcttgttctgggctc

SEQ ID NO: 4130878 - DNA, 13 bp, Homo sapiens
cagctttaaacaa

SEQ ID NO: 4130879 - DNA, 21 bp, Homo sapiens
cagctttaaactcagggacag

SEQ ID NO: 4130880 - DNA, 22 bp, Homo sapiens
cagctttcttgctcccttcagc

SEQ ID NO: 4130881 - DNA, 23 bp, Homo sapiens
cagctttcttgctcccttcagcc

SEQ ID NO: 4130882 - DNA, 22 bp, Homo sapiens
cagctttgactttatctcctgc

SEQ ID NO: 4130883 - DNA, 14 bp, Homo sapiens
cagcttttactgtt

SEQ ID NO: 4130884 - DNA, 15 bp, Homo sapiens
cagcttttcattgct

SEQ ID NO: 4130885 - DNA, 16 bp, Homo sapiens
cagcttttcctccctt

SEQ ID NO: 4130886 - DNA, 19 bp, Homo sapiens
caggaaaacacccagggaa

SEQ ID NO: 4130887 - DNA, 11 bp, Homo sapiens
caggaaaataa

SEQ ID NO: 4130888 - DNA, 21 bp, Homo sapiens
caggaaactccacatctgcct

SEQ ID NO: 4130889 - DNA, 18 bp, Homo sapiens
caggaaagagcagtcaga

SEQ ID NO: 4130890 - DNA, 23 bp, Homo sapiens
caggaaagagcagtcagagtcca

SEQ ID NO: 4130891 - DNA, 15 bp, Homo sapiens
caggaaagccctccc

SEQ ID NO: 4130892 - DNA, 12 bp, Homo sapiens
caggaacagaag

SEQ ID NO: 4130893 - DNA, 20 bp, Homo sapiens
caggaacagctatgggagcc

SEQ ID NO: 4130894 - DNA, 23 bp, Homo sapiens
caggaacagctatgggagcccca

SEQ ID NO: 4130895 - DNA, 18 bp, Homo sapiens
caggaacagtggctgggt

SEQ ID NO: 4130896 - DNA, 23 bp, Homo sapiens
caggaactcgcacctgtgctgga

SEQ ID NO: 4130897 - DNA, 14 bp, Homo sapiens
caggaagcacccca

SEQ ID NO: 4130898 - DNA, 19 bp, Homo sapiens
caggaagcattcagagagc

SEQ ID NO: 4130899 - DNA, 14 bp, Homo sapiens
caggaagccagagc

SEQ ID NO: 4130900 - DNA, 15 bp, Homo sapiens
caggaagctggcaga

SEQ ID NO: 4130901 - DNA, 14 bp, Homo sapiens
caggaaggaagtca

SEQ ID NO: 4130902 - DNA, 18 bp, Homo sapiens
caggaaggagagcctgct

SEQ ID NO: 4130903 - DNA, 23 bp, Homo sapiens
caggaaggaggagccgaccggga

SEQ ID NO: 4130904 - DNA, 22 bp, Homo sapiens
caggaaggaggggagagacagg

SEQ ID NO: 4130905 - DNA, 18 bp, Homo sapiens
caggaagggggtccaccc

SEQ ID NO: 4130906 - DNA, 23 bp, Homo sapiens
caggaagggggtccacccagcaa

SEQ ID NO: 4130907 - DNA, 17 bp, Homo sapiens
caggaaggtagcccagc

SEQ ID NO: 4130908 - DNA, 21 bp, Homo sapiens
caggaaggtagcccagcactg

SEQ ID NO: 4130909 - DNA, 18 bp, Homo sapiens
caggaatcaagagctgcc

SEQ ID NO: 4130910 - DNA, 23 bp, Homo sapiens
caggaatcaagagctgccctcct

SEQ ID NO: 4130911 - DNA, 17 bp, Homo sapiens
caggaatggaaagcgga

SEQ ID NO: 4130912 - DNA, 18 bp, Homo sapiens
caggaatttcccaggacc

SEQ ID NO: 4130913 - DNA, 20 bp, Homo sapiens
caggaatttcccaggaccct

SEQ ID NO: 4130914 - DNA, 20 bp, Homo sapiens
caggacaccagtccaggtag

SEQ ID NO: 4130915 - DNA, 15 bp, Homo sapiens
caggacacggggcag

SEQ ID NO: 4130916 - DNA, 14 bp, Homo sapiens
caggacagagttca

SEQ ID NO: 4130917 - DNA, 21 bp, Homo sapiens
caggacagagttcacaggagg

SEQ ID NO: 4130918 - DNA, 14 bp, Homo sapiens
caggacagatgcca

SEQ ID NO: 4130919 - DNA, 24 bp, Homo sapiens
caggacagcatcccttcccacatg

SEQ ID NO: 4130920 - DNA, 18 bp, Homo sapiens
caggacatgcggtagcca

SEQ ID NO: 4130921 - DNA, 15 bp, Homo sapiens
caggaccaagccaca

SEQ ID NO: 4130922 - DNA, 16 bp, Homo sapiens
caggaccacaaaaatg

SEQ ID NO: 4130923 - DNA, 10 bp, Homo sapiens
caggaccagc

SEQ ID NO: 4130924 - DNA, 14 bp, Homo sapiens
caggaccagctcag

SEQ ID NO: 4130925 - DNA, 13 bp, Homo sapiens
caggaccaggact

SEQ ID NO: 4130926 - DNA, 14 bp, Homo sapiens
caggacccccgagg

SEQ ID NO: 4130927 - DNA, 19 bp, Homo sapiens
caggacgaaaaagaggcat

SEQ ID NO: 4130928 - DNA, 21 bp, Homo sapiens
caggacgcttctgaatgctgc

SEQ ID NO: 4130929 - DNA, 22 bp, Homo sapiens
caggacgcttctgaatgctgct

SEQ ID NO: 4130930 - DNA, 16 bp, Homo sapiens
caggacggctcctcag

SEQ ID NO: 4130931 - DNA, 18 bp, Homo sapiens
caggacggctcctcagag

SEQ ID NO: 4130932 - DNA, 16 bp, Homo sapiens
caggactatagcccag

SEQ ID NO: 4130933 - DNA, 17 bp, Homo sapiens
caggactatagcccagg

SEQ ID NO: 4130934 - DNA, 21 bp, Homo sapiens
caggactatagcccaggtcct

SEQ ID NO: 4130935 - DNA, 17 bp, Homo sapiens
caggactccaggcccaa

SEQ ID NO: 4130936 - DNA, 18 bp, Homo sapiens
caggactccccaggccag

SEQ ID NO: 4130937 - DNA, 21 bp, Homo sapiens
caggactccctcctcacctct

SEQ ID NO: 4130938 - DNA, 19 bp, Homo sapiens
caggactgcaacaggcttg

SEQ ID NO: 4130939 - DNA, 21 bp, Homo sapiens
caggacttaacggctccagga

SEQ ID NO: 4130940 - DNA, 23 bp, Homo sapiens
caggacttaacggctccaggatt

SEQ ID NO: 4130941 - DNA, 19 bp, Homo sapiens
caggactttgaggcaagtg

SEQ ID NO: 4130942 - DNA, 17 bp, Homo sapiens
caggagaaccactacat

SEQ ID NO: 4130943 - DNA, 22 bp, Homo sapiens
caggagacagaccacttgccac

SEQ ID NO: 4130944 - DNA, 18 bp, Homo sapiens
caggagagactgagcagc

SEQ ID NO: 4130945 - DNA, 21 bp, Homo sapiens
caggagagactgagcagccgc

SEQ ID NO: 4130946 - DNA, 17 bp, Homo sapiens
caggagagagcagcact

SEQ ID NO: 4130947 - DNA, 21 bp, Homo sapiens
caggagagaggctctggggca

SEQ ID NO: 4130948 - DNA, 12 bp, Homo sapiens
caggagagggaa

SEQ ID NO: 4130949 - DNA, 12 bp, Homo sapiens
caggagagtaga

SEQ ID NO: 4130950 - DNA, 20 bp, Homo sapiens
caggagatggaagttgcagt

SEQ ID NO: 4130951 - DNA, 16 bp, Homo sapiens
caggagatggagggct

SEQ ID NO: 4130952 - DNA, 18 bp, Homo sapiens
caggagatggagggcttg

SEQ ID NO: 4130953 - DNA, 21 bp, Homo sapiens
caggagatggagggcttggcc

SEQ ID NO: 4130954 - DNA, 15 bp, Homo sapiens
caggagatgggtcca

SEQ ID NO: 4130955 - DNA, 18 bp, Homo sapiens
caggagatgggtccaggg

SEQ ID NO: 4130956 - DNA, 15 bp, Homo sapiens
caggagcacaggcag

SEQ ID NO: 4130957 - DNA, 15 bp, Homo sapiens
caggagcaggaccta

SEQ ID NO: 4130958 - DNA, 15 bp, Homo sapiens
caggagccccgccac

SEQ ID NO: 4130959 - DNA, 12 bp, Homo sapiens
caggagcctagc

SEQ ID NO: 4130960 - DNA, 21 bp, Homo sapiens
caggagcctagcggagcccag

SEQ ID NO: 4130961 - DNA, 22 bp, Homo sapiens
caggagcctagcggagcccagc

SEQ ID NO: 4130962 - DNA, 22 bp, Homo sapiens
caggagctcttcaggcctccct

SEQ ID NO: 4130963 - DNA, 23 bp, Homo sapiens
caggagctcttcaggcctccctc

SEQ ID NO: 4130964 - DNA, 15 bp, Homo sapiens
caggaggccaaactg

SEQ ID NO: 4130965 - DNA, 20 bp, Homo sapiens
caggaggccaaactgtccct

SEQ ID NO: 4130966 - DNA, 21 bp, Homo sapiens
caggaggccaataaaaagttc

SEQ ID NO: 4130967 - DNA, 13 bp, Homo sapiens
caggaggccagtg

SEQ ID NO: 4130968 - DNA, 20 bp, Homo sapiens
caggaggccagtgggcgggc

SEQ ID NO: 4130969 - DNA, 15 bp, Homo sapiens
caggaggcggcccgg

SEQ ID NO: 4130970 - DNA, 19 bp, Homo sapiens
caggaggcggcccggccag

SEQ ID NO: 4130971 - DNA, 15 bp, Homo sapiens
caggaggctgaggca

SEQ ID NO: 4130972 - DNA, 19 bp, Homo sapiens
caggaggctgaggcaggag

SEQ ID NO: 4130973 - DNA, 15 bp, Homo sapiens
caggaggctggagga

SEQ ID NO: 4130974 - DNA, 22 bp, Homo sapiens
caggaggctgggacgctctgct

SEQ ID NO: 4130975 - DNA, 23 bp, Homo sapiens
caggaggctgggacgctctgctg

SEQ ID NO: 4130976 - DNA, 17 bp, Homo sapiens
caggagggaccaccctc

SEQ ID NO: 4130977 - DNA, 12 bp, Homo sapiens
caggagggaggg

SEQ ID NO: 4130978 - DNA, 16 bp, Homo sapiens
caggagggccctacct

SEQ ID NO: 4130979 - DNA, 17 bp, Homo sapiens
caggagggtgaggaggt

SEQ ID NO: 4130980 - DNA, 15 bp, Homo sapiens
caggagtagtgaaga

SEQ ID NO: 4130981 - DNA, 19 bp, Homo sapiens
caggagtcagtgtctggct

SEQ ID NO: 4130982 - DNA, 16 bp, Homo sapiens
caggagtcccaaggaa

SEQ ID NO: 4130983 - DNA, 17 bp, Homo sapiens
caggagtcccaaggaaa

SEQ ID NO: 4130984 - DNA, 16 bp, Homo sapiens
caggagtctctgccac

SEQ ID NO: 4130985 - DNA, 18 bp, Homo sapiens
caggagtctctgccaccc

SEQ ID NO: 4130986 - DNA, 19 bp, Homo sapiens
caggagtctctgccaccca

SEQ ID NO: 4130987 - DNA, 20 bp, Homo sapiens
caggagtggtgcagacagaa

SEQ ID NO: 4130988 - DNA, 16 bp, Homo sapiens
caggagtgtcctgccc

SEQ ID NO: 4130989 - DNA, 18 bp, Homo sapiens
caggataaactgaaaact

SEQ ID NO: 4130990 - DNA, 16 bp, Homo sapiens
caggataaggagactg

SEQ ID NO: 4130991 - DNA, 18 bp, Homo sapiens
caggataataaagtgttt

SEQ ID NO: 4130992 - DNA, 23 bp, Homo sapiens
caggatactctgtcagatgggaa

SEQ ID NO: 4130993 - DNA, 16 bp, Homo sapiens
caggatactggacgct

SEQ ID NO: 4130994 - DNA, 21 bp, Homo sapiens
caggatatccttatcagagct

SEQ ID NO: 4130995 - DNA, 15 bp, Homo sapiens
caggatcatggtgta

SEQ ID NO: 4130996 - DNA, 21 bp, Homo sapiens
caggatcatggtgtaataaga

SEQ ID NO: 4130997 - DNA, 22 bp, Homo sapiens
caggatcatggtgtaataagac

SEQ ID NO: 4130998 - DNA, 23 bp, Homo sapiens
caggatcatggtgtaataagaca

SEQ ID NO: 4130999 - DNA, 22 bp, Homo sapiens
caggatcccaggggcccaaggc

SEQ ID NO: 4131000 - DNA, 19 bp, Homo sapiens
caggatcctattctcacca

SEQ ID NO: 4131001 - DNA, 22 bp, Homo sapiens
caggatcctattctcaccagga

SEQ ID NO: 4131002 - DNA, 15 bp, Homo sapiens
caggatgaacccagg

SEQ ID NO: 4131003 - DNA, 17 bp, Homo sapiens
caggatgaacccaggac

SEQ ID NO: 4131004 - DNA, 16 bp, Homo sapiens
caggatgacctggata

SEQ ID NO: 4131005 - DNA, 20 bp, Homo sapiens
caggatggactcttctcggc

SEQ ID NO: 4131006 - DNA, 21 bp, Homo sapiens
caggatggactcttctcggct

SEQ ID NO: 4131007 - DNA, 23 bp, Homo sapiens
caggatggactcttctcggctca

SEQ ID NO: 4131008 - DNA, 13 bp, Homo sapiens
caggatggccttt

SEQ ID NO: 4131009 - DNA, 18 bp, Homo sapiens
caggatggcctttccttc

SEQ ID NO: 4131010 - DNA, 20 bp, Homo sapiens
caggatggcctttccttccc

SEQ ID NO: 4131011 - DNA, 18 bp, Homo sapiens
caggatgggggctggcct

SEQ ID NO: 4131012 - DNA, 17 bp, Homo sapiens
caggattcagccggagg

SEQ ID NO: 4131013 - DNA, 21 bp, Homo sapiens
caggatttgaactcagatctg

SEQ ID NO: 4131014 - DNA, 21 bp, Homo sapiens
caggcaaaaaagggacagcat

SEQ ID NO: 4131015 - DNA, 12 bp, Homo sapiens
caggcaaattca

SEQ ID NO: 4131016 - DNA, 13 bp, Homo sapiens
caggcacacagct

SEQ ID NO: 4131017 - DNA, 15 bp, Homo sapiens
caggcacagctgagt

SEQ ID NO: 4131018 - DNA, 16 bp, Homo sapiens
caggcacagctgagtt

SEQ ID NO: 4131019 - DNA, 14 bp, Homo sapiens
caggcacagggccc

SEQ ID NO: 4131020 - DNA, 14 bp, Homo sapiens
caggcaccagcatc

SEQ ID NO: 4131021 - DNA, 17 bp, Homo sapiens
caggcaccccctggaga

SEQ ID NO: 4131022 - DNA, 15 bp, Homo sapiens
caggcaccctcaggg

SEQ ID NO: 4131023 - DNA, 20 bp, Homo sapiens
caggcaccgccacgtcccag

SEQ ID NO: 4131024 - DNA, 19 bp, Homo sapiens
caggcactgcccttttcag

SEQ ID NO: 4131025 - DNA, 17 bp, Homo sapiens
caggcactgccttctcc

SEQ ID NO: 4131026 - DNA, 21 bp, Homo sapiens
caggcacttaagcacaagcag

SEQ ID NO: 4131027 - DNA, 14 bp, Homo sapiens
caggcagagaatca

SEQ ID NO: 4131028 - DNA, 23 bp, Homo sapiens
caggcagagaatcatacttagca

SEQ ID NO: 4131029 - DNA, 20 bp, Homo sapiens
caggcagagctggagccccc

SEQ ID NO: 4131030 - DNA, 16 bp, Homo sapiens
caggcagatctgtgcc

SEQ ID NO: 4131031 - DNA, 18 bp, Homo sapiens
caggcagatctgtgcccc

SEQ ID NO: 4131032 - DNA, 19 bp, Homo sapiens
caggcagatctgtgcccca

SEQ ID NO: 4131033 - DNA, 16 bp, Homo sapiens
caggcagcacagtgtg

SEQ ID NO: 4131034 - DNA, 12 bp, Homo sapiens
caggcagcccag

SEQ ID NO: 4131035 - DNA, 15 bp, Homo sapiens
caggcagcccagcag

SEQ ID NO: 4131036 - DNA, 20 bp, Homo sapiens
caggcagcttctactcctgc

SEQ ID NO: 4131037 - DNA, 17 bp, Homo sapiens
caggcagctttctagaa

SEQ ID NO: 4131038 - DNA, 19 bp, Homo sapiens
caggcaggaagggcaggaa

SEQ ID NO: 4131039 - DNA, 17 bp, Homo sapiens
caggcaggggccctgca

SEQ ID NO: 4131040 - DNA, 23 bp, Homo sapiens
caggcaggggccctgcagctctc

SEQ ID NO: 4131041 - DNA, 15 bp, Homo sapiens
caggcagggtgcagt

SEQ ID NO: 4131042 - DNA, 19 bp, Homo sapiens
caggcatagaggcttctcc

SEQ ID NO: 4131043 - DNA, 23 bp, Homo sapiens
caggcatagaggcttctccgcca

SEQ ID NO: 4131044 - DNA, 14 bp, Homo sapiens
caggcatccggccc

SEQ ID NO: 4131045 - DNA, 19 bp, Homo sapiens
caggcatctacacagcctg

SEQ ID NO: 4131046 - DNA, 23 bp, Homo sapiens
caggcatctacacagcctggact

SEQ ID NO: 4131047 - DNA, 16 bp, Homo sapiens
caggcatggctcagag

SEQ ID NO: 4131048 - DNA, 23 bp, Homo sapiens
caggcatgggtgcaaggaaaatt

SEQ ID NO: 4131049 - DNA, 18 bp, Homo sapiens
caggcatttgactgaaga

SEQ ID NO: 4131050 - DNA, 17 bp, Homo sapiens
caggccaagaaacgtct

SEQ ID NO: 4131051 - DNA, 15 bp, Homo sapiens
caggccaccctgtgc

SEQ ID NO: 4131052 - DNA, 16 bp, Homo sapiens
caggccagagggcagt

SEQ ID NO: 4131053 - DNA, 15 bp, Homo sapiens
caggccagcccagcc

SEQ ID NO: 4131054 - DNA, 20 bp, Homo sapiens
caggccagcccagccaggcc

SEQ ID NO: 4131055 - DNA, 12 bp, Homo sapiens
caggccagcctc

SEQ ID NO: 4131056 - DNA, 15 bp, Homo sapiens
caggccagcctccga

SEQ ID NO: 4131057 - DNA, 14 bp, Homo sapiens
caggccaggccacc

SEQ ID NO: 4131058 - DNA, 15 bp, Homo sapiens
caggccagtgtctgg

SEQ ID NO: 4131059 - DNA, 22 bp, Homo sapiens
caggcccagcgcggccagcgtc

SEQ ID NO: 4131060 - DNA, 14 bp, Homo sapiens
caggcccaggcctc

SEQ ID NO: 4131061 - DNA, 14 bp, Homo sapiens
caggcccagggagg

SEQ ID NO: 4131062 - DNA, 15 bp, Homo sapiens
caggcccagggaggg

SEQ ID NO: 4131063 - DNA, 13 bp, Homo sapiens
caggccccagaca

SEQ ID NO: 4131064 - DNA, 15 bp, Homo sapiens
caggcccctgggttt

SEQ ID NO: 4131065 - DNA, 17 bp, Homo sapiens
caggcccgcaccccggc

SEQ ID NO: 4131066 - DNA, 22 bp, Homo sapiens
caggcccgcaccccggcctcag

SEQ ID NO: 4131067 - DNA, 23 bp, Homo sapiens
caggcccgcaccccggcctcagg

SEQ ID NO: 4131068 - DNA, 24 bp, Homo sapiens
caggcccgcaccccggcctcaggg

SEQ ID NO: 4131069 - DNA, 19 bp, Homo sapiens
caggccctccctgactccc

SEQ ID NO: 4131070 - DNA, 20 bp, Homo sapiens
caggccctccctgactccct

SEQ ID NO: 4131071 - DNA, 22 bp, Homo sapiens
caggccctccctgactccctgt

SEQ ID NO: 4131072 - DNA, 14 bp, Homo sapiens
caggccctgactcc

SEQ ID NO: 4131073 - DNA, 15 bp, Homo sapiens
caggccctgactcct

SEQ ID NO: 4131074 - DNA, 18 bp, Homo sapiens
caggccctgagagtctgg

SEQ ID NO: 4131075 - DNA, 22 bp, Homo sapiens
caggccctgctcctgcagcatg

SEQ ID NO: 4131076 - DNA, 23 bp, Homo sapiens
caggcccttcctctccactgcct

SEQ ID NO: 4131077 - DNA, 14 bp, Homo sapiens
caggccgccctgcg

SEQ ID NO: 4131078 - DNA, 18 bp, Homo sapiens
caggccgggcttgggccc

SEQ ID NO: 4131079 - DNA, 23 bp, Homo sapiens
caggccgggcttgggccctgcac

SEQ ID NO: 4131080 - DNA, 19 bp, Homo sapiens
caggccggggtggagcatg

SEQ ID NO: 4131081 - DNA, 15 bp, Homo sapiens
caggcctaagacatg

SEQ ID NO: 4131082 - DNA, 13 bp, Homo sapiens
caggcctccctct

SEQ ID NO: 4131083 - DNA, 16 bp, Homo sapiens
caggcctccctctctc

SEQ ID NO: 4131084 - DNA, 17 bp, Homo sapiens
caggcctccctgccagt

SEQ ID NO: 4131085 - DNA, 18 bp, Homo sapiens
caggcctccctgccagta

SEQ ID NO: 4131086 - DNA, 20 bp, Homo sapiens
caggcctctagttccagaag

SEQ ID NO: 4131087 - DNA, 14 bp, Homo sapiens
caggcctctgtgtc

SEQ ID NO: 4131088 - DNA, 17 bp, Homo sapiens
caggcctctgtgtcctt

SEQ ID NO: 4131089 - DNA, 12 bp, Homo sapiens
caggcctgcagc

SEQ ID NO: 4131090 - DNA, 22 bp, Homo sapiens
caggcctgcagcaggagtggtg

SEQ ID NO: 4131091 - DNA, 14 bp, Homo sapiens
caggcctgcctccc

SEQ ID NO: 4131092 - DNA, 15 bp, Homo sapiens
caggcctgcctccca

SEQ ID NO: 4131093 - DNA, 16 bp, Homo sapiens
caggcctgcctcccac

SEQ ID NO: 4131094 - DNA, 20 bp, Homo sapiens
caggcctggcaagtgggtga

SEQ ID NO: 4131095 - DNA, 13 bp, Homo sapiens
caggcctgtgccc

SEQ ID NO: 4131096 - DNA, 16 bp, Homo sapiens
caggcctgtgcccact

SEQ ID NO: 4131097 - DNA, 21 bp, Homo sapiens
caggcctgtgcccactcccta

SEQ ID NO: 4131098 - DNA, 11 bp, Homo sapiens
caggccttgtc

SEQ ID NO: 4131099 - DNA, 16 bp, Homo sapiens
caggcgatccacctgt

SEQ ID NO: 4131100 - DNA, 19 bp, Homo sapiens
caggcgatccacctgtctc

SEQ ID NO: 4131101 - DNA, 15 bp, Homo sapiens
caggcgcctgccatc

SEQ ID NO: 4131102 - DNA, 18 bp, Homo sapiens
caggcggtccccatcccc

SEQ ID NO: 4131103 - DNA, 14 bp, Homo sapiens
caggctactagaat

SEQ ID NO: 4131104 - DNA, 19 bp, Homo sapiens
caggctatatgcagtcctt

SEQ ID NO: 4131105 - DNA, 13 bp, Homo sapiens
caggctcactgcc

SEQ ID NO: 4131106 - DNA, 16 bp, Homo sapiens
caggctctctgggctg

SEQ ID NO: 4131107 - DNA, 12 bp, Homo sapiens
caggctctgccc

SEQ ID NO: 4131108 - DNA, 15 bp, Homo sapiens
caggctctgcccagg

SEQ ID NO: 4131109 - DNA, 19 bp, Homo sapiens
caggctctgctggtggaaa

SEQ ID NO: 4131110 - DNA, 23 bp, Homo sapiens
caggctctgctggtggaaagcga

SEQ ID NO: 4131111 - DNA, 18 bp, Homo sapiens
caggctcttagcagcttc

SEQ ID NO: 4131112 - DNA, 12 bp, Homo sapiens
caggctcttctc

SEQ ID NO: 4131113 - DNA, 18 bp, Homo sapiens
caggctcttctcctttca

SEQ ID NO: 4131114 - DNA, 22 bp, Homo sapiens
caggctcttctcctttcacaac

SEQ ID NO: 4131115 - DNA, 22 bp, Homo sapiens
caggctctttggggtcagccag

SEQ ID NO: 4131116 - DNA, 15 bp, Homo sapiens
caggctgaccacagc

SEQ ID NO: 4131117 - DNA, 15 bp, Homo sapiens
caggctgagtgagcc

SEQ ID NO: 4131118 - DNA, 20 bp, Homo sapiens
caggctgagtgagccacaga

SEQ ID NO: 4131119 - DNA, 19 bp, Homo sapiens
caggctgcctcctgccctt

SEQ ID NO: 4131120 - DNA, 22 bp, Homo sapiens
caggctggacatgctgactgtc

SEQ ID NO: 4131121 - DNA, 21 bp, Homo sapiens
caggctggcctggggtcaggc

SEQ ID NO: 4131122 - DNA, 16 bp, Homo sapiens
caggctggctccagat

SEQ ID NO: 4131123 - DNA, 23 bp, Homo sapiens
caggctgggacggaccagcatct

SEQ ID NO: 4131124 - DNA, 13 bp, Homo sapiens
caggctgggcagc

SEQ ID NO: 4131125 - DNA, 13 bp, Homo sapiens
caggctggtctca

SEQ ID NO: 4131126 - DNA, 21 bp, Homo sapiens
caggctgtaggaaatctagtt

SEQ ID NO: 4131127 - DNA, 16 bp, Homo sapiens
caggctgtgggcctca

SEQ ID NO: 4131128 - DNA, 20 bp, Homo sapiens
caggctgtgggtagatgtgc

SEQ ID NO: 4131129 - DNA, 13 bp, Homo sapiens
caggctgttctcc

SEQ ID NO: 4131130 - DNA, 15 bp, Homo sapiens
caggctgttctccag

SEQ ID NO: 4131131 - DNA, 17 bp, Homo sapiens
caggctgttctccaggc

SEQ ID NO: 4131132 - DNA, 19 bp, Homo sapiens
caggctgttctccaggctt

SEQ ID NO: 4131133 - DNA, 19 bp, Homo sapiens
caggcttcacagtctggtg

SEQ ID NO: 4131134 - DNA, 22 bp, Homo sapiens
caggcttcacagtctggtgctt

SEQ ID NO: 4131135 - DNA, 15 bp, Homo sapiens
caggcttcaccctga

SEQ ID NO: 4131136 - DNA, 20 bp, Homo sapiens
caggcttccctgacttgctt

SEQ ID NO: 4131137 - DNA, 21 bp, Homo sapiens
caggcttcctgcaattttcta

SEQ ID NO: 4131138 - DNA, 19 bp, Homo sapiens
caggcttctgtcaatttca

SEQ ID NO: 4131139 - DNA, 17 bp, Homo sapiens
cagggaagagcagaacg

SEQ ID NO: 4131140 - DNA, 19 bp, Homo sapiens
cagggaaggacttggagag

SEQ ID NO: 4131141 - DNA, 23 bp, Homo sapiens
cagggaaggacttggagagaatc

SEQ ID NO: 4131142 - DNA, 16 bp, Homo sapiens
cagggaaggcctgact

SEQ ID NO: 4131143 - DNA, 23 bp, Homo sapiens
cagggaaggcctgacttctgctg

SEQ ID NO: 4131144 - DNA, 18 bp, Homo sapiens
cagggaaggtggccacag

SEQ ID NO: 4131145 - DNA, 12 bp, Homo sapiens
cagggaatccag

SEQ ID NO: 4131146 - DNA, 22 bp, Homo sapiens
cagggaatccagctccctagac

SEQ ID NO: 4131147 - DNA, 14 bp, Homo sapiens
cagggaatttctat

SEQ ID NO: 4131148 - DNA, 21 bp, Homo sapiens
cagggacagaggccccagcct

SEQ ID NO: 4131149 - DNA, 16 bp, Homo sapiens
cagggaccacaccctg

SEQ ID NO: 4131150 - DNA, 18 bp, Homo sapiens
cagggaccatcaagaacc

SEQ ID NO: 4131151 - DNA, 14 bp, Homo sapiens
cagggaccccagaa

SEQ ID NO: 4131152 - DNA, 15 bp, Homo sapiens
cagggaccggtgctg

SEQ ID NO: 4131153 - DNA, 18 bp, Homo sapiens
cagggaccggtgctgcag

SEQ ID NO: 4131154 - DNA, 20 bp, Homo sapiens
cagggacttggacaggagtc

SEQ ID NO: 4131155 - DNA, 22 bp, Homo sapiens
cagggagaccgagcgctttctg

SEQ ID NO: 4131156 - DNA, 22 bp, Homo sapiens
cagggagcatttaatggcagct

SEQ ID NO: 4131157 - DNA, 23 bp, Homo sapiens
cagggagcctccccatctgtcca

SEQ ID NO: 4131158 - DNA, 15 bp, Homo sapiens
cagggagctctgggg

SEQ ID NO: 4131159 - DNA, 15 bp, Homo sapiens
cagggagctgggaca

SEQ ID NO: 4131160 - DNA, 12 bp, Homo sapiens
cagggaggagag

SEQ ID NO: 4131161 - DNA, 22 bp, Homo sapiens
cagggaggagaggggaagggcc

SEQ ID NO: 4131162 - DNA, 23 bp, Homo sapiens
cagggaggagaggggaagggcca

SEQ ID NO: 4131163 - DNA, 11 bp, Homo sapiens
cagggaggcca

SEQ ID NO: 4131164 - DNA, 22 bp, Homo sapiens
cagggagggaagtgtgagcgcc

SEQ ID NO: 4131165 - DNA, 17 bp, Homo sapiens
cagggaggggaggcaga

SEQ ID NO: 4131166 - DNA, 14 bp, Homo sapiens
cagggagtccaggg

SEQ ID NO: 4131167 - DNA, 15 bp, Homo sapiens
cagggagtgatgatt

SEQ ID NO: 4131168 - DNA, 22 bp, Homo sapiens
cagggatctcagaggctcagag

SEQ ID NO: 4131169 - DNA, 17 bp, Homo sapiens
cagggatcttgcattcc

SEQ ID NO: 4131170 - DNA, 14 bp, Homo sapiens
cagggatgctgggc

SEQ ID NO: 4131171 - DNA, 18 bp, Homo sapiens
cagggatgctgggctggg

SEQ ID NO: 4131172 - DNA, 22 bp, Homo sapiens
cagggatgctgggctgggccct

SEQ ID NO: 4131173 - DNA, 23 bp, Homo sapiens
cagggatgggggatgggccaggg

SEQ ID NO: 4131174 - DNA, 17 bp, Homo sapiens
cagggattaacctctgc

SEQ ID NO: 4131175 - DNA, 23 bp, Homo sapiens
cagggattctgggcttggggtgt

SEQ ID NO: 4131176 - DNA, 23 bp, Homo sapiens
cagggcaacaagcccgttagccc

SEQ ID NO: 4131177 - DNA, 15 bp, Homo sapiens
cagggcaaggccatt

SEQ ID NO: 4131178 - DNA, 22 bp, Homo sapiens
cagggcaagggttaaggcctga

SEQ ID NO: 4131179 - DNA, 22 bp, Homo sapiens
cagggcaataaaatgaccatgg

SEQ ID NO: 4131180 - DNA, 15 bp, Homo sapiens
cagggcaccagaggc

SEQ ID NO: 4131181 - DNA, 21 bp, Homo sapiens
cagggcaccctgtggccctgg

SEQ ID NO: 4131182 - DNA, 19 bp, Homo sapiens
cagggcacgcaggaccagt

SEQ ID NO: 4131183 - DNA, 13 bp, Homo sapiens
cagggcagcgcca

SEQ ID NO: 4131184 - DNA, 14 bp, Homo sapiens
cagggcagcgccag

SEQ ID NO: 4131185 - DNA, 18 bp, Homo sapiens
cagggcagcgccaggctg

SEQ ID NO: 4131186 - DNA, 22 bp, Homo sapiens
cagggcagcgccaggctgacca

SEQ ID NO: 4131187 - DNA, 15 bp, Homo sapiens
cagggcagggctctg

SEQ ID NO: 4131188 - DNA, 17 bp, Homo sapiens
cagggcagggctctgat

SEQ ID NO: 4131189 - DNA, 19 bp, Homo sapiens
cagggcagggctctgatat

SEQ ID NO: 4131190 - DNA, 22 bp, Homo sapiens
cagggcagggtgggcagcctat

SEQ ID NO: 4131191 - DNA, 23 bp, Homo sapiens
cagggcagggtgggcagcctatg

SEQ ID NO: 4131192 - DNA, 14 bp, Homo sapiens
cagggcatctcctg

SEQ ID NO: 4131193 - DNA, 15 bp, Homo sapiens
cagggcatcttgctg

SEQ ID NO: 4131194 - DNA, 19 bp, Homo sapiens
cagggcatcttgctggcta

SEQ ID NO: 4131195 - DNA, 20 bp, Homo sapiens
cagggcatcttgctggctac

SEQ ID NO: 4131196 - DNA, 20 bp, Homo sapiens
cagggcatggccaggtggcc

SEQ ID NO: 4131197 - DNA, 14 bp, Homo sapiens
cagggcattcgggc

SEQ ID NO: 4131198 - DNA, 19 bp, Homo sapiens
cagggcattcgggccacag

SEQ ID NO: 4131199 - DNA, 17 bp, Homo sapiens
cagggccaacttgaggg

SEQ ID NO: 4131200 - DNA, 22 bp, Homo sapiens
cagggccaacttgagggcccag

SEQ ID NO: 4131201 - DNA, 18 bp, Homo sapiens
cagggccacgctccagct

SEQ ID NO: 4131202 - DNA, 22 bp, Homo sapiens
cagggccacgctccagctgccc

SEQ ID NO: 4131203 - DNA, 16 bp, Homo sapiens
cagggccaggcccagg

SEQ ID NO: 4131204 - DNA, 16 bp, Homo sapiens
cagggccagtggggcc

SEQ ID NO: 4131205 - DNA, 21 bp, Homo sapiens
cagggccagtggggcctgtgg

SEQ ID NO: 4131206 - DNA, 19 bp, Homo sapiens
cagggcccagagcccagct

SEQ ID NO: 4131207 - DNA, 21 bp, Homo sapiens
cagggcccagagcccagctcc

SEQ ID NO: 4131208 - DNA, 22 bp, Homo sapiens
cagggcccagagcccagctcca

SEQ ID NO: 4131209 - DNA, 14 bp, Homo sapiens
cagggcccaggttc

SEQ ID NO: 4131210 - DNA, 20 bp, Homo sapiens
cagggcccaggttcgagacc

SEQ ID NO: 4131211 - DNA, 16 bp, Homo sapiens
cagggcccccatctca

SEQ ID NO: 4131212 - DNA, 21 bp, Homo sapiens
cagggcccctcaccctgcctt

SEQ ID NO: 4131213 - DNA, 20 bp, Homo sapiens
cagggcccgcagtgctggga

SEQ ID NO: 4131214 - DNA, 19 bp, Homo sapiens
cagggcccttggggctggg

SEQ ID NO: 4131215 - DNA, 21 bp, Homo sapiens
cagggcccttggggctggggg

SEQ ID NO: 4131216 - DNA, 15 bp, Homo sapiens
cagggcctccagggc

SEQ ID NO: 4131217 - DNA, 14 bp, Homo sapiens
cagggcctgacacc

SEQ ID NO: 4131218 - DNA, 20 bp, Homo sapiens
cagggcctgacaccccctcc

SEQ ID NO: 4131219 - DNA, 15 bp, Homo sapiens
cagggcctggagccc

SEQ ID NO: 4131220 - DNA, 14 bp, Homo sapiens
cagggcctggcagg

SEQ ID NO: 4131221 - DNA, 15 bp, Homo sapiens
cagggcctggcaggc

SEQ ID NO: 4131222 - DNA, 20 bp, Homo sapiens
cagggcctggcaggccagtg

SEQ ID NO: 4131223 - DNA, 22 bp, Homo sapiens
cagggcctggggagatggagga

SEQ ID NO: 4131224 - DNA, 20 bp, Homo sapiens
cagggcctggggcctgagag

SEQ ID NO: 4131225 - DNA, 19 bp, Homo sapiens
cagggcgctcagacggcgg

SEQ ID NO: 4131226 - DNA, 20 bp, Homo sapiens
cagggcgctcagacggcggc

SEQ ID NO: 4131227 - DNA, 22 bp, Homo sapiens
cagggcgctcagacggcggcca

SEQ ID NO: 4131228 - DNA, 17 bp, Homo sapiens
cagggctaaggccccca

SEQ ID NO: 4131229 - DNA, 12 bp, Homo sapiens
cagggctcccag

SEQ ID NO: 4131230 - DNA, 12 bp, Homo sapiens
cagggctcccgg

SEQ ID NO: 4131231 - DNA, 15 bp, Homo sapiens
cagggctgccctgag

SEQ ID NO: 4131232 - DNA, 16 bp, Homo sapiens
cagggctgccctgaga

SEQ ID NO: 4131233 - DNA, 19 bp, Homo sapiens
cagggctggccccagggca

SEQ ID NO: 4131234 - DNA, 20 bp, Homo sapiens
cagggctggccccagggcac

SEQ ID NO: 4131235 - DNA, 23 bp, Homo sapiens
cagggctggccccagggcaccct

SEQ ID NO: 4131236 - DNA, 14 bp, Homo sapiens
cagggctggctctg

SEQ ID NO: 4131237 - DNA, 15 bp, Homo sapiens
cagggctggggacag

SEQ ID NO: 4131238 - DNA, 19 bp, Homo sapiens
cagggctggggcagcctct

SEQ ID NO: 4131239 - DNA, 12 bp, Homo sapiens
cagggctggttt

SEQ ID NO: 4131240 - DNA, 14 bp, Homo sapiens
cagggctgtcccag

SEQ ID NO: 4131241 - DNA, 15 bp, Homo sapiens
cagggctgtcccagc

SEQ ID NO: 4131242 - DNA, 17 bp, Homo sapiens
cagggctgtcccagccc

SEQ ID NO: 4131243 - DNA, 13 bp, Homo sapiens
cagggctgtgctt

SEQ ID NO: 4131244 - DNA, 17 bp, Homo sapiens
cagggctgtgtcccaga

SEQ ID NO: 4131245 - DNA, 19 bp, Homo sapiens
caggggaaggccctgaggc

SEQ ID NO: 4131246 - DNA, 18 bp, Homo sapiens
caggggactcagccctga

SEQ ID NO: 4131247 - DNA, 17 bp, Homo sapiens
caggggagacaggagcc

SEQ ID NO: 4131248 - DNA, 14 bp, Homo sapiens
caggggcaggactg

SEQ ID NO: 4131249 - DNA, 15 bp, Homo sapiens
caggggcaggactga

SEQ ID NO: 4131250 - DNA, 15 bp, Homo sapiens
caggggccctgcagc

SEQ ID NO: 4131251 - DNA, 17 bp, Homo sapiens
caggggccctgcagctc

SEQ ID NO: 4131252 - DNA, 18 bp, Homo sapiens
caggggccctgcagctct

SEQ ID NO: 4131253 - DNA, 17 bp, Homo sapiens
caggggcccttgggaca

SEQ ID NO: 4131254 - DNA, 19 bp, Homo sapiens
caggggcccttgggacagc

SEQ ID NO: 4131255 - DNA, 17 bp, Homo sapiens
caggggctccatgccag

SEQ ID NO: 4131256 - DNA, 18 bp, Homo sapiens
caggggctccatgccagc

SEQ ID NO: 4131257 - DNA, 20 bp, Homo sapiens
caggggctgtggccgtctcc

SEQ ID NO: 4131258 - DNA, 18 bp, Homo sapiens
cagggggattctgagcag

SEQ ID NO: 4131259 - DNA, 21 bp, Homo sapiens
cagggggccccgccagggctg

SEQ ID NO: 4131260 - DNA, 23 bp, Homo sapiens
cagggggccccgccagggctggg

SEQ ID NO: 4131261 - DNA, 13 bp, Homo sapiens
caggggggagaag

SEQ ID NO: 4131262 - DNA, 19 bp, Homo sapiens
caggggggtgaggagctgg

SEQ ID NO: 4131263 - DNA, 21 bp, Homo sapiens
cagggggtgaagaaccctctg

SEQ ID NO: 4131264 - DNA, 18 bp, Homo sapiens
caggggtcccagccaccc

SEQ ID NO: 4131265 - DNA, 20 bp, Homo sapiens
caggggtcccagccaccccg

SEQ ID NO: 4131266 - DNA, 16 bp, Homo sapiens
caggggtctccctgga

SEQ ID NO: 4131267 - DNA, 18 bp, Homo sapiens
caggggtctccctggctc

SEQ ID NO: 4131268 - DNA, 19 bp, Homo sapiens
caggggtctccctggctcc

SEQ ID NO: 4131269 - DNA, 20 bp, Homo sapiens
caggggtctccctggctccc

SEQ ID NO: 4131270 - DNA, 23 bp, Homo sapiens
caggggtgactttgtctctcctg

SEQ ID NO: 4131271 - DNA, 12 bp, Homo sapiens
caggggtggggg

SEQ ID NO: 4131272 - DNA, 19 bp, Homo sapiens
caggggtggggggtgcagg

SEQ ID NO: 4131273 - DNA, 13 bp, Homo sapiens
caggggttcgaga

SEQ ID NO: 4131274 - DNA, 13 bp, Homo sapiens
caggggttgcagt

SEQ ID NO: 4131275 - DNA, 21 bp, Homo sapiens
cagggtaactgtgctgaatgc

SEQ ID NO: 4131276 - DNA, 19 bp, Homo sapiens
cagggtaccctttggggag

SEQ ID NO: 4131277 - DNA, 22 bp, Homo sapiens
cagggtaccctttggggagcag

SEQ ID NO: 4131278 - DNA, 17 bp, Homo sapiens
cagggtacctcaagccc

SEQ ID NO: 4131279 - DNA, 14 bp, Homo sapiens
cagggtaggaaagg

SEQ ID NO: 4131280 - DNA, 16 bp, Homo sapiens
cagggtcaaagacaga

SEQ ID NO: 4131281 - DNA, 20 bp, Homo sapiens
cagggtcaaagacagaatgg

SEQ ID NO: 4131282 - DNA, 17 bp, Homo sapiens
cagggtcccatttctca

SEQ ID NO: 4131283 - DNA, 15 bp, Homo sapiens
cagggtctctccctc

SEQ ID NO: 4131284 - DNA, 20 bp, Homo sapiens
cagggtctgctctttctctg

SEQ ID NO: 4131285 - DNA, 21 bp, Homo sapiens
cagggtctgctctttctctgc

SEQ ID NO: 4131286 - DNA, 23 bp, Homo sapiens
cagggtctgctctttctctgcca

SEQ ID NO: 4131287 - DNA, 23 bp, Homo sapiens
cagggtctgtgtgaatgtgggca

SEQ ID NO: 4131288 - DNA, 13 bp, Homo sapiens
cagggtcttccct

SEQ ID NO: 4131289 - DNA, 23 bp, Homo sapiens
cagggtgcttagttggctttgcc

SEQ ID NO: 4131290 - DNA, 15 bp, Homo sapiens
cagggtggggggtga

SEQ ID NO: 4131291 - DNA, 17 bp, Homo sapiens
cagggtgggtgtccatg

SEQ ID NO: 4131292 - DNA, 24 bp, Homo sapiens
cagggtgtctgccccctcctgagt

SEQ ID NO: 4131293 - DNA, 21 bp, Homo sapiens
cagggttaaactgcaggagca

SEQ ID NO: 4131294 - DNA, 13 bp, Homo sapiens
cagggttcatctg

SEQ ID NO: 4131295 - DNA, 17 bp, Homo sapiens
cagggttcatctgtcca

SEQ ID NO: 4131296 - DNA, 15 bp, Homo sapiens
cagggttggtgtgct

SEQ ID NO: 4131297 - DNA, 22 bp, Homo sapiens
cagggttttggggtcctgggct

SEQ ID NO: 4131298 - DNA, 17 bp, Homo sapiens
caggtaatgagggactg

SEQ ID NO: 4131299 - DNA, 20 bp, Homo sapiens
caggtaatgagggactggaa

SEQ ID NO: 4131300 - DNA, 22 bp, Homo sapiens
caggtaatgagggactggaacc

SEQ ID NO: 4131301 - DNA, 13 bp, Homo sapiens
caggtaatgtgaa

SEQ ID NO: 4131302 - DNA, 19 bp, Homo sapiens
caggtaccacccttcagac

SEQ ID NO: 4131303 - DNA, 14 bp, Homo sapiens
caggtaccagctgc

SEQ ID NO: 4131304 - DNA, 18 bp, Homo sapiens
caggtaccagctgcgctt

SEQ ID NO: 4131305 - DNA, 19 bp, Homo sapiens
caggtaccagctgcgcttg

SEQ ID NO: 4131306 - DNA, 15 bp, Homo sapiens
caggtaccagttctt

SEQ ID NO: 4131307 - DNA, 17 bp, Homo sapiens
caggtagaacgccaggg

SEQ ID NO: 4131308 - DNA, 22 bp, Homo sapiens
caggtagtgttgagacccaggc

SEQ ID NO: 4131309 - DNA, 15 bp, Homo sapiens
caggtatatactttg

SEQ ID NO: 4131310 - DNA, 18 bp, Homo sapiens
caggtatatactttgaaa

SEQ ID NO: 4131311 - DNA, 22 bp, Homo sapiens
caggtatatactttgaaaggag

SEQ ID NO: 4131312 - DNA, 14 bp, Homo sapiens
caggtatctccagg

SEQ ID NO: 4131313 - DNA, 11 bp, Homo sapiens
caggtattttg

SEQ ID NO: 4131314 - DNA, 22 bp, Homo sapiens
caggtcagggacttggacagga

SEQ ID NO: 4131315 - DNA, 19 bp, Homo sapiens
caggtcccacgtctggcca

SEQ ID NO: 4131316 - DNA, 21 bp, Homo sapiens
caggtcctctgatacccagag

SEQ ID NO: 4131317 - DNA, 22 bp, Homo sapiens
caggtcctctgatacccagagc

SEQ ID NO: 4131318 - DNA, 18 bp, Homo sapiens
caggtcctgcccatgtgt

SEQ ID NO: 4131319 - DNA, 14 bp, Homo sapiens
caggtctcacgggc

SEQ ID NO: 4131320 - DNA, 20 bp, Homo sapiens
caggtctcccacgtgggaga

SEQ ID NO: 4131321 - DNA, 19 bp, Homo sapiens
caggtcttgactcatggca

SEQ ID NO: 4131322 - DNA, 14 bp, Homo sapiens
caggtgaaggaggc

SEQ ID NO: 4131323 - DNA, 18 bp, Homo sapiens
caggtgacatgtgaaacc

SEQ ID NO: 4131324 - DNA, 22 bp, Homo sapiens
caggtgagctctgacccttggg

SEQ ID NO: 4131325 - DNA, 16 bp, Homo sapiens
caggtgaggtctgttc

SEQ ID NO: 4131326 - DNA, 14 bp, Homo sapiens
caggtgcatgcatg

SEQ ID NO: 4131327 - DNA, 21 bp, Homo sapiens
caggtgccagggcccacccca

SEQ ID NO: 4131328 - DNA, 20 bp, Homo sapiens
caggtgcgcgccaccgtgcc

SEQ ID NO: 4131329 - DNA, 19 bp, Homo sapiens
caggtgctcaataaatgat

SEQ ID NO: 4131330 - DNA, 11 bp, Homo sapiens
caggtgctcat

SEQ ID NO: 4131331 - DNA, 15 bp, Homo sapiens
caggtgctcattgta

SEQ ID NO: 4131332 - DNA, 20 bp, Homo sapiens
caggtgctgacttcatctcc

SEQ ID NO: 4131333 - DNA, 23 bp, Homo sapiens
caggtgctgacttcatctcccac

SEQ ID NO: 4131334 - DNA, 15 bp, Homo sapiens
caggtgctggtcccg

SEQ ID NO: 4131335 - DNA, 18 bp, Homo sapiens
caggtggatgaggagaca

SEQ ID NO: 4131336 - DNA, 16 bp, Homo sapiens
caggtggcaggaccag

SEQ ID NO: 4131337 - DNA, 18 bp, Homo sapiens
caggtgggcactggagca

SEQ ID NO: 4131338 - DNA, 23 bp, Homo sapiens
caggtgggctggacttctacctg

SEQ ID NO: 4131339 - DNA, 14 bp, Homo sapiens
caggtggggactgg

SEQ ID NO: 4131340 - DNA, 17 bp, Homo sapiens
caggtggggactgggca

SEQ ID NO: 4131341 - DNA, 19 bp, Homo sapiens
caggtggggactgggcaca

SEQ ID NO: 4131342 - DNA, 23 bp, Homo sapiens
caggtggggactgggcacagctc

SEQ ID NO: 4131343 - DNA, 20 bp, Homo sapiens
caggtggggagtccagggct

SEQ ID NO: 4131344 - DNA, 17 bp, Homo sapiens
caggtgggggttgctgt

SEQ ID NO: 4131345 - DNA, 20 bp, Homo sapiens
caggtggtcctgagacctga

SEQ ID NO: 4131346 - DNA, 13 bp, Homo sapiens
caggtggttttta

SEQ ID NO: 4131347 - DNA, 22 bp, Homo sapiens
caggtgttactgtaattcctca

SEQ ID NO: 4131348 - DNA, 16 bp, Homo sapiens
caggtgtttagttgca

SEQ ID NO: 4131349 - DNA, 23 bp, Homo sapiens
caggtgtttggcacccaaatcac

SEQ ID NO: 4131350 - DNA, 17 bp, Homo sapiens
caggtgttttaagactg

SEQ ID NO: 4131351 - DNA, 23 bp, Homo sapiens
caggttatcgaaataacaatgtt

SEQ ID NO: 4131352 - DNA, 16 bp, Homo sapiens
caggttcaacccacag

SEQ ID NO: 4131353 - DNA, 17 bp, Homo sapiens
caggttcaacccacagc

SEQ ID NO: 4131354 - DNA, 15 bp, Homo sapiens
caggttcccaagctc

SEQ ID NO: 4131355 - DNA, 15 bp, Homo sapiens
caggttcccccagca

SEQ ID NO: 4131356 - DNA, 18 bp, Homo sapiens
caggttcccccagcaagc

SEQ ID NO: 4131357 - DNA, 20 bp, Homo sapiens
caggttggcaaacgggcttg

SEQ ID NO: 4131358 - DNA, 23 bp, Homo sapiens
caggttgtctgaagtcactgcac

SEQ ID NO: 4131359 - DNA, 13 bp, Homo sapiens
caggtttgttaca

SEQ ID NO: 4131360 - DNA, 14 bp, Homo sapiens
caggtttgttacat

SEQ ID NO: 4131361 - DNA, 14 bp, Homo sapiens
caggttttgcactc

SEQ ID NO: 4131362 - DNA, 21 bp, Homo sapiens
cagtaaaatactattgcctca

SEQ ID NO: 4131363 - DNA, 17 bp, Homo sapiens
cagtaaacttagagttt

SEQ ID NO: 4131364 - DNA, 14 bp, Homo sapiens
cagtaaataacagg

SEQ ID NO: 4131365 - DNA, 14 bp, Homo sapiens
cagtaaatttgcta

SEQ ID NO: 4131366 - DNA, 22 bp, Homo sapiens
cagtaacacatagactgtgcgc

SEQ ID NO: 4131367 - DNA, 18 bp, Homo sapiens
cagtaacgcgtcttcctg

SEQ ID NO: 4131368 - DNA, 13 bp, Homo sapiens
cagtaaggcaggg

SEQ ID NO: 4131369 - DNA, 20 bp, Homo sapiens
cagtaagtttcccctctggc

SEQ ID NO: 4131370 - DNA, 21 bp, Homo sapiens
cagtaagtttcccctctggct

SEQ ID NO: 4131371 - DNA, 16 bp, Homo sapiens
cagtaccctctcagct

SEQ ID NO: 4131372 - DNA, 24 bp, Homo sapiens
cagtaccctctcagctccaggtgg

SEQ ID NO: 4131373 - DNA, 20 bp, Homo sapiens
cagtacctataaagtaaagc

SEQ ID NO: 4131374 - DNA, 13 bp, Homo sapiens
cagtacctctcaa

SEQ ID NO: 4131375 - DNA, 15 bp, Homo sapiens
cagtacctttgtcac

SEQ ID NO: 4131376 - DNA, 21 bp, Homo sapiens
cagtacttgtgaaacacagct

SEQ ID NO: 4131377 - DNA, 17 bp, Homo sapiens
cagtacttttattaata

SEQ ID NO: 4131378 - DNA, 22 bp, Homo sapiens
cagtacttttattaatatttgt

SEQ ID NO: 4131379 - DNA, 22 bp, Homo sapiens
cagtagaactccaggccctcct

SEQ ID NO: 4131380 - DNA, 17 bp, Homo sapiens
cagtagagtcatctcca

SEQ ID NO: 4131381 - DNA, 18 bp, Homo sapiens
cagtagatgtgcttctga

SEQ ID NO: 4131382 - DNA, 19 bp, Homo sapiens
cagtagatgtgcttctgaa

SEQ ID NO: 4131383 - DNA, 24 bp, Homo sapiens
cagtaggacaaggtgcaggcaggc

SEQ ID NO: 4131384 - DNA, 17 bp, Homo sapiens
cagtaggataagccact

SEQ ID NO: 4131385 - DNA, 16 bp, Homo sapiens
cagtagttgtattctt

SEQ ID NO: 4131386 - DNA, 14 bp, Homo sapiens
cagtataaacaaag

SEQ ID NO: 4131387 - DNA, 19 bp, Homo sapiens
cagtataaacaaagttact

SEQ ID NO: 4131388 - DNA, 13 bp, Homo sapiens
cagtatatttata

SEQ ID NO: 4131389 - DNA, 14 bp, Homo sapiens
cagtatatttatag

SEQ ID NO: 4131390 - DNA, 13 bp, Homo sapiens
cagtatcatgccc

SEQ ID NO: 4131391 - DNA, 16 bp, Homo sapiens
cagtatcatgccctgt

SEQ ID NO: 4131392 - DNA, 23 bp, Homo sapiens
cagtatgagtcaatgtgcagtgt

SEQ ID NO: 4131393 - DNA, 21 bp, Homo sapiens
cagtatggtctaacactggca

SEQ ID NO: 4131394 - DNA, 21 bp, Homo sapiens
cagtattaaaggggggagggg

SEQ ID NO: 4131395 - DNA, 17 bp, Homo sapiens
cagtattgccccctctc

SEQ ID NO: 4131396 - DNA, 16 bp, Homo sapiens
cagtattgctgatttt

SEQ ID NO: 4131397 - DNA, 16 bp, Homo sapiens
cagtatttattttgta

SEQ ID NO: 4131398 - DNA, 15 bp, Homo sapiens
cagtatttcattgcc

SEQ ID NO: 4131399 - DNA, 19 bp, Homo sapiens
cagtattttggttcttagt

SEQ ID NO: 4131400 - DNA, 14 bp, Homo sapiens
cagtattttgtgtc

SEQ ID NO: 4131401 - DNA, 16 bp, Homo sapiens
cagtattttgtgtcct

SEQ ID NO: 4131402 - DNA, 17 bp, Homo sapiens
cagtcacatgacctgat

SEQ ID NO: 4131403 - DNA, 21 bp, Homo sapiens
cagtcagagtccagtgctctg

SEQ ID NO: 4131404 - DNA, 22 bp, Homo sapiens
cagtcagagtccagtgctctgc

SEQ ID NO: 4131405 - DNA, 15 bp, Homo sapiens
cagtcatcatcaggg

SEQ ID NO: 4131406 - DNA, 20 bp, Homo sapiens
cagtcatcatcagggcctgg

SEQ ID NO: 4131407 - DNA, 22 bp, Homo sapiens
cagtcatcatcagggcctgggg

SEQ ID NO: 4131408 - DNA, 19 bp, Homo sapiens
cagtcatgcataaatatgc

SEQ ID NO: 4131409 - DNA, 23 bp, Homo sapiens
cagtcatgcataaatatgcagtg

SEQ ID NO: 4131410 - DNA, 22 bp, Homo sapiens
cagtcattagactcctcctcca

SEQ ID NO: 4131411 - DNA, 18 bp, Homo sapiens
cagtcattctaggatgtg

SEQ ID NO: 4131412 - DNA, 21 bp, Homo sapiens
cagtcattggctgtctcctag

SEQ ID NO: 4131413 - DNA, 21 bp, Homo sapiens
cagtccaaatgtcctccagaa

SEQ ID NO: 4131414 - DNA, 23 bp, Homo sapiens
cagtccaaatgtcctccagaagc

SEQ ID NO: 4131415 - DNA, 16 bp, Homo sapiens
cagtccagacccaagt

SEQ ID NO: 4131416 - DNA, 17 bp, Homo sapiens
cagtccagacccaagtc

SEQ ID NO: 4131417 - DNA, 23 bp, Homo sapiens
cagtccaggatgctaacatctaa

SEQ ID NO: 4131418 - DNA, 17 bp, Homo sapiens
cagtccatttatatatg

SEQ ID NO: 4131419 - DNA, 19 bp, Homo sapiens
cagtcccatcagagagcga

SEQ ID NO: 4131420 - DNA, 17 bp, Homo sapiens
cagtccccacccctgcc

SEQ ID NO: 4131421 - DNA, 18 bp, Homo sapiens
cagtccccacccctgccc

SEQ ID NO: 4131422 - DNA, 21 bp, Homo sapiens
cagtccccagaactctgcctg

SEQ ID NO: 4131423 - DNA, 20 bp, Homo sapiens
cagtccccatttctgcctcg

SEQ ID NO: 4131424 - DNA, 14 bp, Homo sapiens
cagtccccttcccg

SEQ ID NO: 4131425 - DNA, 16 bp, Homo sapiens
cagtcctcctgggagc

SEQ ID NO: 4131426 - DNA, 17 bp, Homo sapiens
cagtcctcttattccta

SEQ ID NO: 4131427 - DNA, 15 bp, Homo sapiens
cagtcctgaggagag

SEQ ID NO: 4131428 - DNA, 17 bp, Homo sapiens
cagtcctgcctcagcct

SEQ ID NO: 4131429 - DNA, 13 bp, Homo sapiens
cagtcctgcctgg

SEQ ID NO: 4131430 - DNA, 15 bp, Homo sapiens
cagtcctgcctggcc

SEQ ID NO: 4131431 - DNA, 17 bp, Homo sapiens
cagtcctgcctggccag

SEQ ID NO: 4131432 - DNA, 14 bp, Homo sapiens
cagtcctttgtaaa

SEQ ID NO: 4131433 - DNA, 13 bp, Homo sapiens
cagtcgcctgcct

SEQ ID NO: 4131434 - DNA, 22 bp, Homo sapiens
cagtcgcctgcctgcagcaggc

SEQ ID NO: 4131435 - DNA, 19 bp, Homo sapiens
cagtcgcctttcagcaggc

SEQ ID NO: 4131436 - DNA, 21 bp, Homo sapiens
cagtcgtggctttggcagtgt

SEQ ID NO: 4131437 - DNA, 13 bp, Homo sapiens
cagtctcatttct

SEQ ID NO: 4131438 - DNA, 14 bp, Homo sapiens
cagtctcccaggcc

SEQ ID NO: 4131439 - DNA, 18 bp, Homo sapiens
cagtctcccaggccccct

SEQ ID NO: 4131440 - DNA, 18 bp, Homo sapiens
cagtctctcttaaagttg

SEQ ID NO: 4131441 - DNA, 15 bp, Homo sapiens
cagtctctttaatct

SEQ ID NO: 4131442 - DNA, 18 bp, Homo sapiens
cagtctgaatgctgccac

SEQ ID NO: 4131443 - DNA, 11 bp, Homo sapiens
cagtcttggtg

SEQ ID NO: 4131444 - DNA, 15 bp, Homo sapiens
cagtgaaatgtgaag

SEQ ID NO: 4131445 - DNA, 15 bp, Homo sapiens
cagtgaactcctgcc

SEQ ID NO: 4131446 - DNA, 16 bp, Homo sapiens
cagtgacagacaggct

SEQ ID NO: 4131447 - DNA, 18 bp, Homo sapiens
cagtgacagagttcacta

SEQ ID NO: 4131448 - DNA, 14 bp, Homo sapiens
cagtgaccccagaa

SEQ ID NO: 4131449 - DNA, 21 bp, Homo sapiens
cagtgaccttttcttcatttt

SEQ ID NO: 4131450 - DNA, 11 bp, Homo sapiens
cagtgactttg

SEQ ID NO: 4131451 - DNA, 16 bp, Homo sapiens
cagtgactttgtatag

SEQ ID NO: 4131452 - DNA, 14 bp, Homo sapiens
cagtgagaaaaagc

SEQ ID NO: 4131453 - DNA, 19 bp, Homo sapiens
cagtgagaaaaagctcctg

SEQ ID NO: 4131454 - DNA, 20 bp, Homo sapiens
cagtgagaaaaagctcctgt

SEQ ID NO: 4131455 - DNA, 17 bp, Homo sapiens
cagtgagactgccccac

SEQ ID NO: 4131456 - DNA, 15 bp, Homo sapiens
cagtgagcctcctgt

SEQ ID NO: 4131457 - DNA, 18 bp, Homo sapiens
cagtgagcctcctgtgcc

SEQ ID NO: 4131458 - DNA, 20 bp, Homo sapiens
cagtgagcctcctgtgcctg

SEQ ID NO: 4131459 - DNA, 22 bp, Homo sapiens
cagtgagcctcctgtgcctggc

SEQ ID NO: 4131460 - DNA, 23 bp, Homo sapiens
cagtgagcctcctgtgcctggcc

SEQ ID NO: 4131461 - DNA, 17 bp, Homo sapiens
cagtgagcggagatcgc

SEQ ID NO: 4131462 - DNA, 23 bp, Homo sapiens
cagtgagctggagatacttggtc

SEQ ID NO: 4131463 - DNA, 23 bp, Homo sapiens
cagtgagggtcttcttacatgca

SEQ ID NO: 4131464 - DNA, 18 bp, Homo sapiens
cagtgagtctcttcagaa

SEQ ID NO: 4131465 - DNA, 23 bp, Homo sapiens
cagtgagttacagcgagaggcag

SEQ ID NO: 4131466 - DNA, 21 bp, Homo sapiens
cagtgataatgccccaaggac

SEQ ID NO: 4131467 - DNA, 15 bp, Homo sapiens
cagtgatatggcaga

SEQ ID NO: 4131468 - DNA, 18 bp, Homo sapiens
cagtgatatggcagaaga

SEQ ID NO: 4131469 - DNA, 18 bp, Homo sapiens
cagtgatctcagggcaga

SEQ ID NO: 4131470 - DNA, 13 bp, Homo sapiens
cagtgatctccat

SEQ ID NO: 4131471 - DNA, 15 bp, Homo sapiens
cagtgcacctgggac

SEQ ID NO: 4131472 - DNA, 14 bp, Homo sapiens
cagtgcagacaggc

SEQ ID NO: 4131473 - DNA, 15 bp, Homo sapiens
cagtgcagacaggcc

SEQ ID NO: 4131474 - DNA, 16 bp, Homo sapiens
cagtgcagagccttct

SEQ ID NO: 4131475 - DNA, 19 bp, Homo sapiens
cagtgcagagccttctcag

SEQ ID NO: 4131476 - DNA, 20 bp, Homo sapiens
cagtgcagagccttctcaga

SEQ ID NO: 4131477 - DNA, 12 bp, Homo sapiens
cagtgcagccac

SEQ ID NO: 4131478 - DNA, 15 bp, Homo sapiens
cagtgcatctcagcc

SEQ ID NO: 4131479 - DNA, 13 bp, Homo sapiens
cagtgccaaatgc

SEQ ID NO: 4131480 - DNA, 22 bp, Homo sapiens
cagtgccaaatgctggggcagg

SEQ ID NO: 4131481 - DNA, 14 bp, Homo sapiens
cagtgccagcaatg

SEQ ID NO: 4131482 - DNA, 20 bp, Homo sapiens
cagtgccattccactccact

SEQ ID NO: 4131483 - DNA, 21 bp, Homo sapiens
cagtgccattccactccactc

SEQ ID NO: 4131484 - DNA, 22 bp, Homo sapiens
cagtgccattccactccactca

SEQ ID NO: 4131485 - DNA, 22 bp, Homo sapiens
cagtgccccagggagtccaggg

SEQ ID NO: 4131486 - DNA, 15 bp, Homo sapiens
cagtgcccccactga

SEQ ID NO: 4131487 - DNA, 22 bp, Homo sapiens
cagtgcccccactgaccagaac

SEQ ID NO: 4131488 - DNA, 23 bp, Homo sapiens
cagtgcccccactgaccagaact

SEQ ID NO: 4131489 - DNA, 18 bp, Homo sapiens
cagtgcctcttgtctgag

SEQ ID NO: 4131490 - DNA, 20 bp, Homo sapiens
cagtgcctcttgtctgaggg

SEQ ID NO: 4131491 - DNA, 14 bp, Homo sapiens
cagtgcctgggaat

SEQ ID NO: 4131492 - DNA, 18 bp, Homo sapiens
cagtgcctgggaatgtat

SEQ ID NO: 4131493 - DNA, 20 bp, Homo sapiens
cagtgcctgggaatgtatta

SEQ ID NO: 4131494 - DNA, 14 bp, Homo sapiens
cagtgccttccata

SEQ ID NO: 4131495 - DNA, 15 bp, Homo sapiens
cagtgccttccataa

SEQ ID NO: 4131496 - DNA, 12 bp, Homo sapiens
cagtgccttctc

SEQ ID NO: 4131497 - DNA, 24 bp, Homo sapiens
cagtgcgcgtgcacgtggagagct

SEQ ID NO: 4131498 - DNA, 19 bp, Homo sapiens
cagtgctaaagcctgtggg

SEQ ID NO: 4131499 - DNA, 17 bp, Homo sapiens
cagtgctctgcctcaga

SEQ ID NO: 4131500 - DNA, 16 bp, Homo sapiens
cagtgctgggaccaga

SEQ ID NO: 4131501 - DNA, 20 bp, Homo sapiens
cagtgctgggaccagagcca

SEQ ID NO: 4131502 - DNA, 21 bp, Homo sapiens
cagtgctgggaccagagccag

SEQ ID NO: 4131503 - DNA, 23 bp, Homo sapiens
cagtgctgggaccagagccagat

SEQ ID NO: 4131504 - DNA, 17 bp, Homo sapiens
cagtgcttctctacaga

SEQ ID NO: 4131505 - DNA, 20 bp, Homo sapiens
cagtggactcagcagtgacc

SEQ ID NO: 4131506 - DNA, 16 bp, Homo sapiens
cagtggagcccaggag

SEQ ID NO: 4131507 - DNA, 20 bp, Homo sapiens
cagtggaggaagagggacag

SEQ ID NO: 4131508 - DNA, 13 bp, Homo sapiens
cagtggccactca

SEQ ID NO: 4131509 - DNA, 20 bp, Homo sapiens
cagtggcctttttctgagat

SEQ ID NO: 4131510 - DNA, 21 bp, Homo sapiens
cagtggcgggtgatggccagc

SEQ ID NO: 4131511 - DNA, 13 bp, Homo sapiens
cagtggctgggtg

SEQ ID NO: 4131512 - DNA, 15 bp, Homo sapiens
cagtggcttcccagc

SEQ ID NO: 4131513 - DNA, 21 bp, Homo sapiens
cagtggcttcccagctctgac

SEQ ID NO: 4131514 - DNA, 15 bp, Homo sapiens
cagtgggagccctga

SEQ ID NO: 4131515 - DNA, 16 bp, Homo sapiens
cagtgggagccctgac

SEQ ID NO: 4131516 - DNA, 22 bp, Homo sapiens
cagtgggagccctgaccttggc

SEQ ID NO: 4131517 - DNA, 21 bp, Homo sapiens
cagtgggatgaaccagccggg

SEQ ID NO: 4131518 - DNA, 15 bp, Homo sapiens
cagtgggatgggaca

SEQ ID NO: 4131519 - DNA, 18 bp, Homo sapiens
cagtgggatgggacaggg

SEQ ID NO: 4131520 - DNA, 22 bp, Homo sapiens
cagtgggatgggacagggaggc

SEQ ID NO: 4131521 - DNA, 18 bp, Homo sapiens
cagtgggcatcagcagca

SEQ ID NO: 4131522 - DNA, 21 bp, Homo sapiens
cagtggggaactgagggcaag

SEQ ID NO: 4131523 - DNA, 13 bp, Homo sapiens
cagtggggcctgt

SEQ ID NO: 4131524 - DNA, 14 bp, Homo sapiens
cagtggggcctgtg

SEQ ID NO: 4131525 - DNA, 16 bp, Homo sapiens
cagtggggcctgtgga

SEQ ID NO: 4131526 - DNA, 18 bp, Homo sapiens
cagtggtcaaaccgcact

SEQ ID NO: 4131527 - DNA, 23 bp, Homo sapiens
cagtggtgaagaaaactccttta

SEQ ID NO: 4131528 - DNA, 15 bp, Homo sapiens
cagtggttttatact

SEQ ID NO: 4131529 - DNA, 20 bp, Homo sapiens
cagtggttttatactgaagg

SEQ ID NO: 4131530 - DNA, 21 bp, Homo sapiens
cagtggttttatactgaagga

SEQ ID NO: 4131531 - DNA, 16 bp, Homo sapiens
cagtgtacatggaata

SEQ ID NO: 4131532 - DNA, 20 bp, Homo sapiens
cagtgtacatggaataacat

SEQ ID NO: 4131533 - DNA, 15 bp, Homo sapiens
cagtgtagttaattt

SEQ ID NO: 4131534 - DNA, 21 bp, Homo sapiens
cagtgtagttaatttatctaa

SEQ ID NO: 4131535 - DNA, 17 bp, Homo sapiens
cagtgtatcaggtcagg

SEQ ID NO: 4131536 - DNA, 14 bp, Homo sapiens
cagtgtcacctctc

SEQ ID NO: 4131537 - DNA, 18 bp, Homo sapiens
cagtgtcacctctctcag

SEQ ID NO: 4131538 - DNA, 20 bp, Homo sapiens
cagtgtcatttatgaaaaga

SEQ ID NO: 4131539 - DNA, 14 bp, Homo sapiens
cagtgtcccaggca

SEQ ID NO: 4131540 - DNA, 17 bp, Homo sapiens
cagtgtcccctccactg

SEQ ID NO: 4131541 - DNA, 17 bp, Homo sapiens
cagtgtcctccaagtgc

SEQ ID NO: 4131542 - DNA, 21 bp, Homo sapiens
cagtgtcctccaagtgccccc

SEQ ID NO: 4131543 - DNA, 14 bp, Homo sapiens
cagtgtcctttcca

SEQ ID NO: 4131544 - DNA, 23 bp, Homo sapiens
cagtgtctgtatcggagacagtg

SEQ ID NO: 4131545 - DNA, 16 bp, Homo sapiens
cagtgtctgtgccatg

SEQ ID NO: 4131546 - DNA, 13 bp, Homo sapiens
cagtgtcttccat

SEQ ID NO: 4131547 - DNA, 18 bp, Homo sapiens
cagtgtcttccataatgt

SEQ ID NO: 4131548 - DNA, 22 bp, Homo sapiens
cagtgtcttccataatgtataa

SEQ ID NO: 4131549 - DNA, 23 bp, Homo sapiens
cagtgtcttccataatgtataaa

SEQ ID NO: 4131550 - DNA, 15 bp, Homo sapiens
cagtgtggagaccct

SEQ ID NO: 4131551 - DNA, 17 bp, Homo sapiens
cagtgtgggcttgacca

SEQ ID NO: 4131552 - DNA, 20 bp, Homo sapiens
cagtgtgtgtgtgtggtcca

SEQ ID NO: 4131553 - DNA, 23 bp, Homo sapiens
cagtgtgtgtgtgtggtccatgc

SEQ ID NO: 4131554 - DNA, 12 bp, Homo sapiens
cagtgttgagat

SEQ ID NO: 4131555 - DNA, 18 bp, Homo sapiens
cagtgttgagccttttcc

SEQ ID NO: 4131556 - DNA, 13 bp, Homo sapiens
cagtgttgctcag

SEQ ID NO: 4131557 - DNA, 18 bp, Homo sapiens
cagtgttgctcagctcct

SEQ ID NO: 4131558 - DNA, 15 bp, Homo sapiens
cagtgttgtttgtaa

SEQ ID NO: 4131559 - DNA, 22 bp, Homo sapiens
cagtgttgtttgtaaataagag

SEQ ID NO: 4131560 - DNA, 14 bp, Homo sapiens
cagtgtttcccata

SEQ ID NO: 4131561 - DNA, 17 bp, Homo sapiens
cagtgtttcccataatt

SEQ ID NO: 4131562 - DNA, 14 bp, Homo sapiens
cagtgttttaaatt

SEQ ID NO: 4131563 - DNA, 16 bp, Homo sapiens
cagtgttttaaattct

SEQ ID NO: 4131564 - DNA, 11 bp, Homo sapiens
cagtgttttgg

SEQ ID NO: 4131565 - DNA, 22 bp, Homo sapiens
cagtgttttggactccatctct

SEQ ID NO: 4131566 - DNA, 23 bp, Homo sapiens
cagttactttccaattctccttt

SEQ ID NO: 4131567 - DNA, 23 bp, Homo sapiens
cagttagggttttgcaataactt

SEQ ID NO: 4131568 - DNA, 16 bp, Homo sapiens
cagttagttgtgaaag

SEQ ID NO: 4131569 - DNA, 13 bp, Homo sapiens
cagttatgaatca

SEQ ID NO: 4131570 - DNA, 16 bp, Homo sapiens
cagttatgttcagtca

SEQ ID NO: 4131571 - DNA, 17 bp, Homo sapiens
cagttattcattctgtg

SEQ ID NO: 4131572 - DNA, 20 bp, Homo sapiens
cagttattgtccctggcttc

SEQ ID NO: 4131573 - DNA, 17 bp, Homo sapiens
cagttattttgataaca

SEQ ID NO: 4131574 - DNA, 22 bp, Homo sapiens
cagttcaataaacttaacttta

SEQ ID NO: 4131575 - DNA, 17 bp, Homo sapiens
cagttcagacactaccc

SEQ ID NO: 4131576 - DNA, 17 bp, Homo sapiens
cagttcagcaccaccct

SEQ ID NO: 4131577 - DNA, 23 bp, Homo sapiens
cagttcagtaataaactgtgttt

SEQ ID NO: 4131578 - DNA, 23 bp, Homo sapiens
cagttcatatgtaccatgtacat

SEQ ID NO: 4131579 - DNA, 16 bp, Homo sapiens
cagttcatcgattttc

SEQ ID NO: 4131580 - DNA, 15 bp, Homo sapiens
cagttcattattttg

SEQ ID NO: 4131581 - DNA, 19 bp, Homo sapiens
cagttcccccaacctcaga

SEQ ID NO: 4131582 - DNA, 20 bp, Homo sapiens
cagttcccccagtacctcca

SEQ ID NO: 4131583 - DNA, 19 bp, Homo sapiens
cagttcccctggagcccct

SEQ ID NO: 4131584 - DNA, 11 bp, Homo sapiens
cagttcctgta

SEQ ID NO: 4131585 - DNA, 17 bp, Homo sapiens
cagttctcactcctagg

SEQ ID NO: 4131586 - DNA, 20 bp, Homo sapiens
cagttctcactcctaggaga

SEQ ID NO: 4131587 - DNA, 17 bp, Homo sapiens
cagttctctcccttcct

SEQ ID NO: 4131588 - DNA, 17 bp, Homo sapiens
cagttcttggtgctctg

SEQ ID NO: 4131589 - DNA, 18 bp, Homo sapiens
cagttcttggtgctctgt

SEQ ID NO: 4131590 - DNA, 17 bp, Homo sapiens
cagttctttccatgggc

SEQ ID NO: 4131591 - DNA, 12 bp, Homo sapiens
cagttgccacca

SEQ ID NO: 4131592 - DNA, 15 bp, Homo sapiens
cagttgccaccacct

SEQ ID NO: 4131593 - DNA, 16 bp, Homo sapiens
cagttgccaccacctc

SEQ ID NO: 4131594 - DNA, 21 bp, Homo sapiens
cagttgccaccacctctgtgg

SEQ ID NO: 4131595 - DNA, 16 bp, Homo sapiens
cagttgcccagcctct

SEQ ID NO: 4131596 - DNA, 19 bp, Homo sapiens
cagttgcccagcctctttc

SEQ ID NO: 4131597 - DNA, 21 bp, Homo sapiens
cagttgcccagcctctttccc

SEQ ID NO: 4131598 - DNA, 22 bp, Homo sapiens
cagttgccctagcccagactct

SEQ ID NO: 4131599 - DNA, 13 bp, Homo sapiens
cagttgcctttta

SEQ ID NO: 4131600 - DNA, 17 bp, Homo sapiens
cagttggactctcaggg

SEQ ID NO: 4131601 - DNA, 16 bp, Homo sapiens
cagttggcagacagcc

SEQ ID NO: 4131602 - DNA, 17 bp, Homo sapiens
cagttggccagagagcc

SEQ ID NO: 4131603 - DNA, 15 bp, Homo sapiens
cagttgggactcagg

SEQ ID NO: 4131604 - DNA, 22 bp, Homo sapiens
cagttggggaagccaggtgagc

SEQ ID NO: 4131605 - DNA, 21 bp, Homo sapiens
cagttgtagggttacagagac

SEQ ID NO: 4131606 - DNA, 18 bp, Homo sapiens
cagttgtgttagcctctt

SEQ ID NO: 4131607 - DNA, 21 bp, Homo sapiens
cagttgttagttactacctcc

SEQ ID NO: 4131608 - DNA, 23 bp, Homo sapiens
cagttgttcaataataaatattt

SEQ ID NO: 4131609 - DNA, 15 bp, Homo sapiens
cagttgttcttttta

SEQ ID NO: 4131610 - DNA, 18 bp, Homo sapiens
cagttgtttgtttttgct

SEQ ID NO: 4131611 - DNA, 21 bp, Homo sapiens
cagttgtttgtttttgcttgt

SEQ ID NO: 4131612 - DNA, 18 bp, Homo sapiens
cagtttaccagttgcctt

SEQ ID NO: 4131613 - DNA, 14 bp, Homo sapiens
cagtttattccaga

SEQ ID NO: 4131614 - DNA, 18 bp, Homo sapiens
cagtttatttgaaccaat

SEQ ID NO: 4131615 - DNA, 23 bp, Homo sapiens
cagtttcactttcacatagatgt

SEQ ID NO: 4131616 - DNA, 15 bp, Homo sapiens
cagtttcaggtgttt

SEQ ID NO: 4131617 - DNA, 15 bp, Homo sapiens
cagtttcttagcttt

SEQ ID NO: 4131618 - DNA, 17 bp, Homo sapiens
cagtttgaagcctgtgc

SEQ ID NO: 4131619 - DNA, 19 bp, Homo sapiens
cagtttgaagcctgtgcct

SEQ ID NO: 4131620 - DNA, 18 bp, Homo sapiens
cagtttgcacctgtcccc

SEQ ID NO: 4131621 - DNA, 20 bp, Homo sapiens
cagtttgccacccctgtcca

SEQ ID NO: 4131622 - DNA, 13 bp, Homo sapiens
cagtttggttggg

SEQ ID NO: 4131623 - DNA, 21 bp, Homo sapiens
cagtttgtgtgtcttaattat

SEQ ID NO: 4131624 - DNA, 16 bp, Homo sapiens
cagtttgttctccggg

SEQ ID NO: 4131625 - DNA, 13 bp, Homo sapiens
cagttttaagaat

SEQ ID NO: 4131626 - DNA, 22 bp, Homo sapiens
cagttttcaagtcaaattaata

SEQ ID NO: 4131627 - DNA, 14 bp, Homo sapiens
cagttttcagaaaa

SEQ ID NO: 4131628 - DNA, 12 bp, Homo sapiens
cagttttccatg

SEQ ID NO: 4131629 - DNA, 14 bp, Homo sapiens
cagttttccatgaa

SEQ ID NO: 4131630 - DNA, 16 bp, Homo sapiens
cagttttccatgaaaa

SEQ ID NO: 4131631 - DNA, 14 bp, Homo sapiens
cataaaaagcagaa

SEQ ID NO: 4131632 - DNA, 19 bp, Homo sapiens
cataaaaagcagaatttta

SEQ ID NO: 4131633 - DNA, 23 bp, Homo sapiens
cataaaaagcctgcaatttcata

SEQ ID NO: 4131634 - DNA, 20 bp, Homo sapiens
cataaaaaggacatcagcaa

SEQ ID NO: 4131635 - DNA, 22 bp, Homo sapiens
cataaaattttctactcttttt

SEQ ID NO: 4131636 - DNA, 21 bp, Homo sapiens
cataaacaattcatgcctttc

SEQ ID NO: 4131637 - DNA, 14 bp, Homo sapiens
cataaacagtaatg

SEQ ID NO: 4131638 - DNA, 20 bp, Homo sapiens
cataaagaattaatgactta

SEQ ID NO: 4131639 - DNA, 18 bp, Homo sapiens
cataaagcataagtatac

SEQ ID NO: 4131640 - DNA, 16 bp, Homo sapiens
cataaagggttgaaaa

SEQ ID NO: 4131641 - DNA, 14 bp, Homo sapiens
cataaataaaactg

SEQ ID NO: 4131642 - DNA, 16 bp, Homo sapiens
cataaataaaactgaa

SEQ ID NO: 4131643 - DNA, 17 bp, Homo sapiens
cataaataaaactgaat

SEQ ID NO: 4131644 - DNA, 12 bp, Homo sapiens
cataaatatgca

SEQ ID NO: 4131645 - DNA, 15 bp, Homo sapiens
cataaatatgcagtg

SEQ ID NO: 4131646 - DNA, 14 bp, Homo sapiens
cataaatgaagcag

SEQ ID NO: 4131647 - DNA, 13 bp, Homo sapiens
cataaatgaattt

SEQ ID NO: 4131648 - DNA, 21 bp, Homo sapiens
cataacaccaatcccagggct

SEQ ID NO: 4131649 - DNA, 13 bp, Homo sapiens
cataaccaacaat

SEQ ID NO: 4131650 - DNA, 16 bp, Homo sapiens
cataacgtttttcctt

SEQ ID NO: 4131651 - DNA, 18 bp, Homo sapiens
cataacgtttttccttta

SEQ ID NO: 4131652 - DNA, 16 bp, Homo sapiens
cataactcctgtccct

SEQ ID NO: 4131653 - DNA, 23 bp, Homo sapiens
cataactgccttgaacctgtgag

SEQ ID NO: 4131654 - DNA, 19 bp, Homo sapiens
cataagaaaactaagaaat

SEQ ID NO: 4131655 - DNA, 21 bp, Homo sapiens
cataagaatgaataataatta

SEQ ID NO: 4131656 - DNA, 20 bp, Homo sapiens
cataagaccataacagccaa

SEQ ID NO: 4131657 - DNA, 23 bp, Homo sapiens
cataagaccataacagccaacag

SEQ ID NO: 4131658 - DNA, 16 bp, Homo sapiens
cataagaccctaagcc

SEQ ID NO: 4131659 - DNA, 21 bp, Homo sapiens
cataagcctccatttagttct

SEQ ID NO: 4131660 - DNA, 23 bp, Homo sapiens
cataagcctccatttagttcttt

SEQ ID NO: 4131661 - DNA, 20 bp, Homo sapiens
cataaggacgtgtgtaaata

SEQ ID NO: 4131662 - DNA, 21 bp, Homo sapiens
cataaggccagtatgatttat

SEQ ID NO: 4131663 - DNA, 18 bp, Homo sapiens
cataagtaattcaagaaa

SEQ ID NO: 4131664 - DNA, 22 bp, Homo sapiens
cataagtgctattgcagagccg

SEQ ID NO: 4131665 - DNA, 11 bp, Homo sapiens
cataagttgca

SEQ ID NO: 4131666 - DNA, 12 bp, Homo sapiens
cataagtttctg

SEQ ID NO: 4131667 - DNA, 18 bp, Homo sapiens
cataataaaaggctttga

SEQ ID NO: 4131668 - DNA, 15 bp, Homo sapiens
cataataaagcaatc

SEQ ID NO: 4131669 - DNA, 16 bp, Homo sapiens
cataataaatcacaca

SEQ ID NO: 4131670 - DNA, 20 bp, Homo sapiens
cataataaatcacacattca

SEQ ID NO: 4131671 - DNA, 21 bp, Homo sapiens
cataataagagaatgttccta

SEQ ID NO: 4131672 - DNA, 22 bp, Homo sapiens
cataataggtagtttggatatt

SEQ ID NO: 4131673 - DNA, 16 bp, Homo sapiens
cataatcactctaatt

SEQ ID NO: 4131674 - DNA, 17 bp, Homo sapiens
cataatccagtaaaata

SEQ ID NO: 4131675 - DNA, 18 bp, Homo sapiens
cataatccagtaaaataa

SEQ ID NO: 4131676 - DNA, 23 bp, Homo sapiens
cataatgataaaataaataattt

SEQ ID NO: 4131677 - DNA, 15 bp, Homo sapiens
cataatgtataaaga

SEQ ID NO: 4131678 - DNA, 17 bp, Homo sapiens
cataatgttacattatt

SEQ ID NO: 4131679 - DNA, 19 bp, Homo sapiens
cataattatgacagttata

SEQ ID NO: 4131680 - DNA, 21 bp, Homo sapiens
cataattctaagttatttact

SEQ ID NO: 4131681 - DNA, 13 bp, Homo sapiens
cataattttgcaa

SEQ ID NO: 4131682 - DNA, 19 bp, Homo sapiens
catacactaaccaaatctc

SEQ ID NO: 4131683 - DNA, 23 bp, Homo sapiens
catacaggaaggtagaaatatct

SEQ ID NO: 4131684 - DNA, 21 bp, Homo sapiens
catacaggatttgaactcaga

SEQ ID NO: 4131685 - DNA, 14 bp, Homo sapiens
catacattaaaact

SEQ ID NO: 4131686 - DNA, 19 bp, Homo sapiens
catacattaaaactaggta

SEQ ID NO: 4131687 - DNA, 21 bp, Homo sapiens
catacattccctctaatttga

SEQ ID NO: 4131688 - DNA, 21 bp, Homo sapiens
catacatttataatgtttgct

SEQ ID NO: 4131689 - DNA, 23 bp, Homo sapiens
catacatttataatgtttgctat

SEQ ID NO: 4131690 - DNA, 24 bp, Homo sapiens
catacatttataatgtttgctatt

SEQ ID NO: 4131691 - DNA, 22 bp, Homo sapiens
catacctcagaatgtaaaagaa

SEQ ID NO: 4131692 - DNA, 22 bp, Homo sapiens
catactactgaaacagatttca

SEQ ID NO: 4131693 - DNA, 14 bp, Homo sapiens
catactcagcctgc

SEQ ID NO: 4131694 - DNA, 18 bp, Homo sapiens
catactcagcctgctgcc

SEQ ID NO: 4131695 - DNA, 19 bp, Homo sapiens
catactcagcctgctgccc

SEQ ID NO: 4131696 - DNA, 21 bp, Homo sapiens
catactcagcctgctgcccag

SEQ ID NO: 4131697 - DNA, 16 bp, Homo sapiens
catactccttgcttcc

SEQ ID NO: 4131698 - DNA, 13 bp, Homo sapiens
catactctctgcc

SEQ ID NO: 4131699 - DNA, 22 bp, Homo sapiens
catactgagccaagtataattt

SEQ ID NO: 4131700 - DNA, 16 bp, Homo sapiens
catactgcatgtaagc

SEQ ID NO: 4131701 - DNA, 15 bp, Homo sapiens
catactggcctggac

SEQ ID NO: 4131702 - DNA, 22 bp, Homo sapiens
catactggcctggactgttttc

SEQ ID NO: 4131703 - DNA, 13 bp, Homo sapiens
catacttgaaggg

SEQ ID NO: 4131704 - DNA, 17 bp, Homo sapiens
catactttcatcctgac

SEQ ID NO: 4131705 - DNA, 21 bp, Homo sapiens
catactttcatcctgactctg

SEQ ID NO: 4131706 - DNA, 21 bp, Homo sapiens
catagaccctgaggccctggg

SEQ ID NO: 4131707 - DNA, 19 bp, Homo sapiens
catagataggcccctgggg

SEQ ID NO: 4131708 - DNA, 14 bp, Homo sapiens
catagatattttca

SEQ ID NO: 4131709 - DNA, 21 bp, Homo sapiens
catagatttcttctctttagt

SEQ ID NO: 4131710 - DNA, 17 bp, Homo sapiens
catagcaagcttttgct

SEQ ID NO: 4131711 - DNA, 19 bp, Homo sapiens
catagcaagcttttgctca

SEQ ID NO: 4131712 - DNA, 16 bp, Homo sapiens
catagcagattttaat

SEQ ID NO: 4131713 - DNA, 17 bp, Homo sapiens
catagcagattttaatt

SEQ ID NO: 4131714 - DNA, 13 bp, Homo sapiens
catagccataaat

SEQ ID NO: 4131715 - DNA, 17 bp, Homo sapiens
catagccataaatgatg

SEQ ID NO: 4131716 - DNA, 19 bp, Homo sapiens
catagccccggccccccgc

SEQ ID NO: 4131717 - DNA, 17 bp, Homo sapiens
catagcgaaataaaaat

SEQ ID NO: 4131718 - DNA, 12 bp, Homo sapiens
catagctcactg

SEQ ID NO: 4131719 - DNA, 15 bp, Homo sapiens
catagctcactgcag

SEQ ID NO: 4131720 - DNA, 20 bp, Homo sapiens
catagcttattattgaagga

SEQ ID NO: 4131721 - DNA, 19 bp, Homo sapiens
cataggaaaagtacattta

SEQ ID NO: 4131722 - DNA, 16 bp, Homo sapiens
cataggcctgctttgt

SEQ ID NO: 4131723 - DNA, 15 bp, Homo sapiens
cataggcctgggtgc

SEQ ID NO: 4131724 - DNA, 17 bp, Homo sapiens
cataggtaagctgtgcc

SEQ ID NO: 4131725 - DNA, 19 bp, Homo sapiens
cataggtttctctccctcc

SEQ ID NO: 4131726 - DNA, 21 bp, Homo sapiens
catagtaacttcttatggaat

SEQ ID NO: 4131727 - DNA, 24 bp, Homo sapiens
catagtaacttcttatggaattga

SEQ ID NO: 4131728 - DNA, 19 bp, Homo sapiens
catagtaccatttatacaa

SEQ ID NO: 4131729 - DNA, 13 bp, Homo sapiens
catagtagttttt

SEQ ID NO: 4131730 - DNA, 21 bp, Homo sapiens
catagtcgggatgtcagcaga

SEQ ID NO: 4131731 - DNA, 17 bp, Homo sapiens
catagtgctgggatgga

SEQ ID NO: 4131732 - DNA, 13 bp, Homo sapiens
catagtgtaatgt

SEQ ID NO: 4131733 - DNA, 10 bp, Homo sapiens
catagtttat

SEQ ID NO: 4131734 - DNA, 14 bp, Homo sapiens
catagttttaaact

SEQ ID NO: 4131735 - DNA, 14 bp, Homo sapiens
catataaccaaaat

SEQ ID NO: 4131736 - DNA, 23 bp, Homo sapiens
catataagattcatatttacttc

SEQ ID NO: 4131737 - DNA, 17 bp, Homo sapiens
catatacacctggaaca

SEQ ID NO: 4131738 - DNA, 20 bp, Homo sapiens
catatactgattctgtgtat

SEQ ID NO: 4131739 - DNA, 19 bp, Homo sapiens
catatattaattagcaggt

SEQ ID NO: 4131740 - DNA, 12 bp, Homo sapiens
catatatttatt

SEQ ID NO: 4131741 - DNA, 22 bp, Homo sapiens
catatatttttaaaaaatgaaa

SEQ ID NO: 4131742 - DNA, 22 bp, Homo sapiens
catatccaagatcaattccctc

SEQ ID NO: 4131743 - DNA, 16 bp, Homo sapiens
catatccaccacctcc

SEQ ID NO: 4131744 - DNA, 14 bp, Homo sapiens
catatcctgagcca

SEQ ID NO: 4131745 - DNA, 22 bp, Homo sapiens
catatcgctgacttcatggaat

SEQ ID NO: 4131746 - DNA, 22 bp, Homo sapiens
catatctccatggccctgtccc

SEQ ID NO: 4131747 - DNA, 23 bp, Homo sapiens
catatctccatggccctgtccca

SEQ ID NO: 4131748 - DNA, 13 bp, Homo sapiens
catatctctaatt

SEQ ID NO: 4131749 - DNA, 24 bp, Homo sapiens
catatcttctatatctgaagagta

SEQ ID NO: 4131750 - DNA, 14 bp, Homo sapiens
catatctttattaa

SEQ ID NO: 4131751 - DNA, 17 bp, Homo sapiens
catatctttattaatca

SEQ ID NO: 4131752 - DNA, 16 bp, Homo sapiens
catatgaattgtacag

SEQ ID NO: 4131753 - DNA, 20 bp, Homo sapiens
catatgactcacatgatgca

SEQ ID NO: 4131754 - DNA, 19 bp, Homo sapiens
catatgagtgtggaagccg

SEQ ID NO: 4131755 - DNA, 21 bp, Homo sapiens
catatgatttcactagaaaag

SEQ ID NO: 4131756 - DNA, 21 bp, Homo sapiens
catatgcctgaccccttgctc

SEQ ID NO: 4131757 - DNA, 20 bp, Homo sapiens
catatggattttctattgtt

SEQ ID NO: 4131758 - DNA, 21 bp, Homo sapiens
catatgggtgggattttgcaa

SEQ ID NO: 4131759 - DNA, 14 bp, Homo sapiens
catatgtaaacata

SEQ ID NO: 4131760 - DNA, 15 bp, Homo sapiens
catatgtaaacataa

SEQ ID NO: 4131761 - DNA, 15 bp, Homo sapiens
catatgtacataaat

SEQ ID NO: 4131762 - DNA, 19 bp, Homo sapiens
catatgtacataaattgca

SEQ ID NO: 4131763 - DNA, 19 bp, Homo sapiens
catatgttgaatacttttt

SEQ ID NO: 4131764 - DNA, 12 bp, Homo sapiens
catatgttgcaa

SEQ ID NO: 4131765 - DNA, 15 bp, Homo sapiens
catatgttgctcagt

SEQ ID NO: 4131766 - DNA, 20 bp, Homo sapiens
catattaggaaaatatgggt

SEQ ID NO: 4131767 - DNA, 15 bp, Homo sapiens
catattatgcctgaa

SEQ ID NO: 4131768 - DNA, 15 bp, Homo sapiens
catattctaaaacca

SEQ ID NO: 4131769 - DNA, 21 bp, Homo sapiens
catattctattgtattatttg

SEQ ID NO: 4131770 - DNA, 13 bp, Homo sapiens
catattctgtctg

SEQ ID NO: 4131771 - DNA, 14 bp, Homo sapiens
catattgatgaaaa

SEQ ID NO: 4131772 - DNA, 17 bp, Homo sapiens
catattgctgagagaaa

SEQ ID NO: 4131773 - DNA, 20 bp, Homo sapiens
catatttacattctagttca

SEQ ID NO: 4131774 - DNA, 13 bp, Homo sapiens
catatttactacc

SEQ ID NO: 4131775 - DNA, 17 bp, Homo sapiens
catatttactaccttat

SEQ ID NO: 4131776 - DNA, 15 bp, Homo sapiens
catatttgagactag

SEQ ID NO: 4131777 - DNA, 15 bp, Homo sapiens
catatttggaagaaa

SEQ ID NO: 4131778 - DNA, 16 bp, Homo sapiens
catattttgagaaact

SEQ ID NO: 4131779 - DNA, 13 bp, Homo sapiens
catcaaaatgctt

SEQ ID NO: 4131780 - DNA, 15 bp, Homo sapiens
catcaaaatgctttt

SEQ ID NO: 4131781 - DNA, 16 bp, Homo sapiens
catcaacaaagaaata

SEQ ID NO: 4131782 - DNA, 18 bp, Homo sapiens
catcaagcaggaattatg

SEQ ID NO: 4131783 - DNA, 19 bp, Homo sapiens
catcaataaatgctctatt

SEQ ID NO: 4131784 - DNA, 20 bp, Homo sapiens
catcaatatccctcttgtaa

SEQ ID NO: 4131785 - DNA, 11 bp, Homo sapiens
catcacacaca

SEQ ID NO: 4131786 - DNA, 12 bp, Homo sapiens
catcacacacac

SEQ ID NO: 4131787 - DNA, 19 bp, Homo sapiens
catcacactgggtggtggc

SEQ ID NO: 4131788 - DNA, 14 bp, Homo sapiens
catcacagcagcct

SEQ ID NO: 4131789 - DNA, 19 bp, Homo sapiens
catcaccgacgcgtctcct

SEQ ID NO: 4131790 - DNA, 11 bp, Homo sapiens
catcacctcac

SEQ ID NO: 4131791 - DNA, 24 bp, Homo sapiens
catcacgtaccccactgggccagc

SEQ ID NO: 4131792 - DNA, 16 bp, Homo sapiens
catcactaaaccgata

SEQ ID NO: 4131793 - DNA, 16 bp, Homo sapiens
catcagaacctgagct

SEQ ID NO: 4131794 - DNA, 13 bp, Homo sapiens
catcagaagataa

SEQ ID NO: 4131795 - DNA, 14 bp, Homo sapiens
catcagaagtggta

SEQ ID NO: 4131796 - DNA, 22 bp, Homo sapiens
catcagacctgtcttccaagga

SEQ ID NO: 4131797 - DNA, 12 bp, Homo sapiens
catcagcagcag

SEQ ID NO: 4131798 - DNA, 18 bp, Homo sapiens
catcagcccaatccctga

SEQ ID NO: 4131799 - DNA, 12 bp, Homo sapiens
catcagctccct

SEQ ID NO: 4131800 - DNA, 23 bp, Homo sapiens
catcagctgtaagaagagactgg

SEQ ID NO: 4131801 - DNA, 12 bp, Homo sapiens
catcagggacag

SEQ ID NO: 4131802 - DNA, 14 bp, Homo sapiens
catcagggacagga

SEQ ID NO: 4131803 - DNA, 11 bp, Homo sapiens
catcagggcct

SEQ ID NO: 4131804 - DNA, 18 bp, Homo sapiens
catcagggcctggggcct

SEQ ID NO: 4131805 - DNA, 22 bp, Homo sapiens
catcagggcctggggcctgaga

SEQ ID NO: 4131806 - DNA, 23 bp, Homo sapiens
catcagggcctggggcctgagag

SEQ ID NO: 4131807 - DNA, 13 bp, Homo sapiens
catcataaaataa

SEQ ID NO: 4131808 - DNA, 14 bp, Homo sapiens
catcataaaataaa

SEQ ID NO: 4131809 - DNA, 13 bp, Homo sapiens
catcatagaaact

SEQ ID NO: 4131810 - DNA, 13 bp, Homo sapiens
catcatatgcctg

SEQ ID NO: 4131811 - DNA, 16 bp, Homo sapiens
catcatcctaagctat

SEQ ID NO: 4131812 - DNA, 13 bp, Homo sapiens
catcatctgtaga

SEQ ID NO: 4131813 - DNA, 18 bp, Homo sapiens
catcatctgtagatacta

SEQ ID NO: 4131814 - DNA, 13 bp, Homo sapiens
catcatgcctgac

SEQ ID NO: 4131815 - DNA, 14 bp, Homo sapiens
catcatggtggata

SEQ ID NO: 4131816 - DNA, 17 bp, Homo sapiens
catcattataaacgtga

SEQ ID NO: 4131817 - DNA, 16 bp, Homo sapiens
catcattccctctcat

SEQ ID NO: 4131818 - DNA, 20 bp, Homo sapiens
catcattccctctcatctca

SEQ ID NO: 4131819 - DNA, 16 bp, Homo sapiens
catcattccttctggc

SEQ ID NO: 4131820 - DNA, 12 bp, Homo sapiens
catcattttaca

SEQ ID NO: 4131821 - DNA, 16 bp, Homo sapiens
catcattttgcattca

SEQ ID NO: 4131822 - DNA, 18 bp, Homo sapiens
catcattttgcattcaaa

SEQ ID NO: 4131823 - DNA, 23 bp, Homo sapiens
catccaaaatagttaagacatga

SEQ ID NO: 4131824 - DNA, 17 bp, Homo sapiens
catccaaaatatttttt

SEQ ID NO: 4131825 - DNA, 21 bp, Homo sapiens
catccaaaatattttttgcaa

SEQ ID NO: 4131826 - DNA, 21 bp, Homo sapiens
catccaaacactgaggcagcc

SEQ ID NO: 4131827 - DNA, 22 bp, Homo sapiens
catccaaacactgaggcagcct

SEQ ID NO: 4131828 - DNA, 17 bp, Homo sapiens
catccaaagcagacagc

SEQ ID NO: 4131829 - DNA, 15 bp, Homo sapiens
catccaacaagaaga

SEQ ID NO: 4131830 - DNA, 14 bp, Homo sapiens
catccaacttatgt

SEQ ID NO: 4131831 - DNA, 13 bp, Homo sapiens
catccaatcctca

SEQ ID NO: 4131832 - DNA, 14 bp, Homo sapiens
catccaatcctcac

SEQ ID NO: 4131833 - DNA, 15 bp, Homo sapiens
catccaatcctcact

SEQ ID NO: 4131834 - DNA, 19 bp, Homo sapiens
catccaatcctcactgggt

SEQ ID NO: 4131835 - DNA, 18 bp, Homo sapiens
catccacacacgcaggaa

SEQ ID NO: 4131836 - DNA, 12 bp, Homo sapiens
catccaccccat

SEQ ID NO: 4131837 - DNA, 19 bp, Homo sapiens
catccacccgggggagccc

SEQ ID NO: 4131838 - DNA, 17 bp, Homo sapiens
catccactctaccctcc

SEQ ID NO: 4131839 - DNA, 18 bp, Homo sapiens
catccactctaccctccc

SEQ ID NO: 4131840 - DNA, 21 bp, Homo sapiens
catccacttacatatattttt

SEQ ID NO: 4131841 - DNA, 16 bp, Homo sapiens
catccagacatcatga

SEQ ID NO: 4131842 - DNA, 12 bp, Homo sapiens
catccagcaaga

SEQ ID NO: 4131843 - DNA, 21 bp, Homo sapiens
catccagcagtgttgctcagc

SEQ ID NO: 4131844 - DNA, 16 bp, Homo sapiens
catccagtttgttctc

SEQ ID NO: 4131845 - DNA, 17 bp, Homo sapiens
catccataaatccagtt

SEQ ID NO: 4131846 - DNA, 19 bp, Homo sapiens
catccatgttccgagaaga

SEQ ID NO: 4131847 - DNA, 15 bp, Homo sapiens
catccattacctcca

SEQ ID NO: 4131848 - DNA, 18 bp, Homo sapiens
catccattacctccatcc

SEQ ID NO: 4131849 - DNA, 20 bp, Homo sapiens
catccattaggccagcaacg

SEQ ID NO: 4131850 - DNA, 14 bp, Homo sapiens
catcccacaccctg

SEQ ID NO: 4131851 - DNA, 18 bp, Homo sapiens
catcccagcagcccaagc

SEQ ID NO: 4131852 - DNA, 13 bp, Homo sapiens
catcccagcctgg

SEQ ID NO: 4131853 - DNA, 22 bp, Homo sapiens
catcccagcctgggggccagtg

SEQ ID NO: 4131854 - DNA, 12 bp, Homo sapiens
catcccatcatc

SEQ ID NO: 4131855 - DNA, 12 bp, Homo sapiens
catccccaagcc

SEQ ID NO: 4131856 - DNA, 16 bp, Homo sapiens
catccccaagcccacc

SEQ ID NO: 4131857 - DNA, 18 bp, Homo sapiens
catccccaggggtcccag

SEQ ID NO: 4131858 - DNA, 16 bp, Homo sapiens
catcccccctgctcag

SEQ ID NO: 4131859 - DNA, 17 bp, Homo sapiens
catcccccctgctcagc

SEQ ID NO: 4131860 - DNA, 14 bp, Homo sapiens
catcccctggactg

SEQ ID NO: 4131861 - DNA, 19 bp, Homo sapiens
catcccctggactgggagg

SEQ ID NO: 4131862 - DNA, 16 bp, Homo sapiens
catcccgtgttctcct

SEQ ID NO: 4131863 - DNA, 17 bp, Homo sapiens
catcccgtgttctcctt

SEQ ID NO: 4131864 - DNA, 21 bp, Homo sapiens
catcccgtgttctccttttcc

SEQ ID NO: 4131865 - DNA, 19 bp, Homo sapiens
catccctcgggaagcagcc

SEQ ID NO: 4131866 - DNA, 16 bp, Homo sapiens
catccctgactggcca

SEQ ID NO: 4131867 - DNA, 24 bp, Homo sapiens
catccctgagcaggaaagtttacc

SEQ ID NO: 4131868 - DNA, 18 bp, Homo sapiens
catccctgaggagccagg

SEQ ID NO: 4131869 - DNA, 20 bp, Homo sapiens
catccctgatggcagaactc

SEQ ID NO: 4131870 - DNA, 23 bp, Homo sapiens
catccctgccacatacaggtgct

SEQ ID NO: 4131871 - DNA, 17 bp, Homo sapiens
catcccttcccacatgc

SEQ ID NO: 4131872 - DNA, 14 bp, Homo sapiens
catccctttccctt

SEQ ID NO: 4131873 - DNA, 19 bp, Homo sapiens
catccctttgaaacaagat

SEQ ID NO: 4131874 - DNA, 15 bp, Homo sapiens
catccctttttcaat

SEQ ID NO: 4131875 - DNA, 14 bp, Homo sapiens
catccgcaggtgct

SEQ ID NO: 4131876 - DNA, 20 bp, Homo sapiens
catccgcaggtgctggtccc

SEQ ID NO: 4131877 - DNA, 14 bp, Homo sapiens
catcctaagaaata

SEQ ID NO: 4131878 - DNA, 15 bp, Homo sapiens
catcctaagaaatat

SEQ ID NO: 4131879 - DNA, 15 bp, Homo sapiens
catcctcatccctga

SEQ ID NO: 4131880 - DNA, 20 bp, Homo sapiens
catcctcatccctgactggc

SEQ ID NO: 4131881 - DNA, 12 bp, Homo sapiens
catcctccagag

SEQ ID NO: 4131882 - DNA, 21 bp, Homo sapiens
catcctccagagaaacccagg

SEQ ID NO: 4131883 - DNA, 23 bp, Homo sapiens
catcctccagagaaacccaggga

SEQ ID NO: 4131884 - DNA, 13 bp, Homo sapiens
catcctccagggc

SEQ ID NO: 4131885 - DNA, 14 bp, Homo sapiens
catcctcctggaac

SEQ ID NO: 4131886 - DNA, 21 bp, Homo sapiens
catcctcctggaaccttgctg

SEQ ID NO: 4131887 - DNA, 16 bp, Homo sapiens
catcctgactctgccc

SEQ ID NO: 4131888 - DNA, 20 bp, Homo sapiens
catcctgactctgccccctg

SEQ ID NO: 4131889 - DNA, 17 bp, Homo sapiens
catcctgccatcctcaa

SEQ ID NO: 4131890 - DNA, 15 bp, Homo sapiens
catcctggctgcggc

SEQ ID NO: 4131891 - DNA, 13 bp, Homo sapiens
catccttcaccag

SEQ ID NO: 4131892 - DNA, 16 bp, Homo sapiens
catccttcaccagagc

SEQ ID NO: 4131893 - DNA, 23 bp, Homo sapiens
catccttccctcatgcccgccag

SEQ ID NO: 4131894 - DNA, 15 bp, Homo sapiens
catcctttacgtgtt

SEQ ID NO: 4131895 - DNA, 19 bp, Homo sapiens
catcctttgcagggcagcc

SEQ ID NO: 4131896 - DNA, 13 bp, Homo sapiens
catcgcacactgg

SEQ ID NO: 4131897 - DNA, 17 bp, Homo sapiens
catcgcacactggggcc

SEQ ID NO: 4131898 - DNA, 20 bp, Homo sapiens
catcgcaggagtctctgcca

SEQ ID NO: 4131899 - DNA, 22 bp, Homo sapiens
catcgcaggagtctctgccacc

SEQ ID NO: 4131900 - DNA, 20 bp, Homo sapiens
catcgccagaggtgcttcac

SEQ ID NO: 4131901 - DNA, 20 bp, Homo sapiens
catcggacaagacccccagc

SEQ ID NO: 4131902 - DNA, 17 bp, Homo sapiens
catcggaggctgggccc

SEQ ID NO: 4131903 - DNA, 19 bp, Homo sapiens
catcggaggctgggcccct

SEQ ID NO: 4131904 - DNA, 17 bp, Homo sapiens
catctaatgcttgttta

SEQ ID NO: 4131905 - DNA, 18 bp, Homo sapiens
catctacacagcctggac

SEQ ID NO: 4131906 - DNA, 22 bp, Homo sapiens
catctagccagcccctcttccc

SEQ ID NO: 4131907 - DNA, 14 bp, Homo sapiens
catctataaagaag

SEQ ID NO: 4131908 - DNA, 17 bp, Homo sapiens
catctatagaaagctat

SEQ ID NO: 4131909 - DNA, 14 bp, Homo sapiens
catctcaaaattat

SEQ ID NO: 4131910 - DNA, 13 bp, Homo sapiens
catctcacctccg

SEQ ID NO: 4131911 - DNA, 13 bp, Homo sapiens
catctcagcccac

SEQ ID NO: 4131912 - DNA, 16 bp, Homo sapiens
catctcagcctcctga

SEQ ID NO: 4131913 - DNA, 20 bp, Homo sapiens
catctcagcctcctgagcct

SEQ ID NO: 4131914 - DNA, 22 bp, Homo sapiens
catctcaggagatggagggctt

SEQ ID NO: 4131915 - DNA, 18 bp, Homo sapiens
catctcaggagatttcat

SEQ ID NO: 4131916 - DNA, 12 bp, Homo sapiens
catctcaggggc

SEQ ID NO: 4131917 - DNA, 18 bp, Homo sapiens
catctcatgaggggagag

SEQ ID NO: 4131918 - DNA, 17 bp, Homo sapiens
catctcattccaacttc

SEQ ID NO: 4131919 - DNA, 15 bp, Homo sapiens
catctccatcagctg

SEQ ID NO: 4131920 - DNA, 20 bp, Homo sapiens
catctcccaaagtgctggga

SEQ ID NO: 4131921 - DNA, 14 bp, Homo sapiens
catctcccaccctg

SEQ ID NO: 4131922 - DNA, 15 bp, Homo sapiens
catctcccaccctgt

SEQ ID NO: 4131923 - DNA, 16 bp, Homo sapiens
catctcccaccctgta

SEQ ID NO: 4131924 - DNA, 21 bp, Homo sapiens
catctcccacctagcagcacc

SEQ ID NO: 4131925 - DNA, 14 bp, Homo sapiens
catctccctgcctg

SEQ ID NO: 4131926 - DNA, 17 bp, Homo sapiens
catctccctgcctggcc

SEQ ID NO: 4131927 - DNA, 19 bp, Homo sapiens
catctccctgcctggcccc

SEQ ID NO: 4131928 - DNA, 20 bp, Homo sapiens
catctcctccatactcagga

SEQ ID NO: 4131929 - DNA, 19 bp, Homo sapiens
catctcctcccgcccttcc

SEQ ID NO: 4131930 - DNA, 12 bp, Homo sapiens
catctcctgctc

SEQ ID NO: 4131931 - DNA, 14 bp, Homo sapiens
catctcctgctcac

SEQ ID NO: 4131932 - DNA, 15 bp, Homo sapiens
catctcctgctcacc

SEQ ID NO: 4131933 - DNA, 19 bp, Homo sapiens
catctcctgtgcatgggtg

SEQ ID NO: 4131934 - DNA, 23 bp, Homo sapiens
catctccttacagtcactaatat

SEQ ID NO: 4131935 - DNA, 16 bp, Homo sapiens
catctctcatcctcca

SEQ ID NO: 4131936 - DNA, 15 bp, Homo sapiens
catctctccctcccc

SEQ ID NO: 4131937 - DNA, 16 bp, Homo sapiens
catctctccctcccct

SEQ ID NO: 4131938 - DNA, 23 bp, Homo sapiens
catctctccctcccctgccattt

SEQ ID NO: 4131939 - DNA, 13 bp, Homo sapiens
catctctctgccc

SEQ ID NO: 4131940 - DNA, 13 bp, Homo sapiens
catctctctgggg

SEQ ID NO: 4131941 - DNA, 16 bp, Homo sapiens
catctcttccccagag

SEQ ID NO: 4131942 - DNA, 18 bp, Homo sapiens
catctcttccccagagag

SEQ ID NO: 4131943 - DNA, 23 bp, Homo sapiens
catctcttcctacccaaccactc

SEQ ID NO: 4131944 - DNA, 15 bp, Homo sapiens
catctcttgaggcca

SEQ ID NO: 4131945 - DNA, 16 bp, Homo sapiens
catctgaaacccacag

SEQ ID NO: 4131946 - DNA, 18 bp, Homo sapiens
catctgagcaagagctgg

SEQ ID NO: 4131947 - DNA, 19 bp, Homo sapiens
catctgatccccatgccta

SEQ ID NO: 4131948 - DNA, 23 bp, Homo sapiens
catctgcacacacctccgagaca

SEQ ID NO: 4131949 - DNA, 13 bp, Homo sapiens
catctgccagacc

SEQ ID NO: 4131950 - DNA, 13 bp, Homo sapiens
catctgcccctcc

SEQ ID NO: 4131951 - DNA, 16 bp, Homo sapiens
catctgcccctccccc

SEQ ID NO: 4131952 - DNA, 17 bp, Homo sapiens
catctgcccctccccca

SEQ ID NO: 4131953 - DNA, 18 bp, Homo sapiens
catctgcccctcccccaa

SEQ ID NO: 4131954 - DNA, 19 bp, Homo sapiens
catctgccggcccccagga

SEQ ID NO: 4131955 - DNA, 16 bp, Homo sapiens
catctgcttttattaa

SEQ ID NO: 4131956 - DNA, 16 bp, Homo sapiens
catctggataggagcc

SEQ ID NO: 4131957 - DNA, 20 bp, Homo sapiens
catctggataggagcctgct

SEQ ID NO: 4131958 - DNA, 22 bp, Homo sapiens
catctggctgtctagaatgtgg

SEQ ID NO: 4131959 - DNA, 14 bp, Homo sapiens
catctggctgttta

SEQ ID NO: 4131960 - DNA, 17 bp, Homo sapiens
catctggctgtttagca

SEQ ID NO: 4131961 - DNA, 16 bp, Homo sapiens
catctgggattcccac

SEQ ID NO: 4131962 - DNA, 16 bp, Homo sapiens
catctggggttggcaa

SEQ ID NO: 4131963 - DNA, 24 bp, Homo sapiens
catctggggttggcaacaggacag

SEQ ID NO: 4131964 - DNA, 12 bp, Homo sapiens
catctgtagata

SEQ ID NO: 4131965 - DNA, 21 bp, Homo sapiens
catctgtataccctctgtttc

SEQ ID NO: 4131966 - DNA, 20 bp, Homo sapiens
catctgtccagctggggcca

SEQ ID NO: 4131967 - DNA, 22 bp, Homo sapiens
catctgtccatggcctttctaa

SEQ ID NO: 4131968 - DNA, 18 bp, Homo sapiens
catctgtgcactgcccat

SEQ ID NO: 4131969 - DNA, 21 bp, Homo sapiens
catctgtgcactgcccatgga

SEQ ID NO: 4131970 - DNA, 16 bp, Homo sapiens
catctgtgcagggctg

SEQ ID NO: 4131971 - DNA, 17 bp, Homo sapiens
catctgtgcagggctgg

SEQ ID NO: 4131972 - DNA, 18 bp, Homo sapiens
catcttatcaaggactct

SEQ ID NO: 4131973 - DNA, 14 bp, Homo sapiens
catcttcaaagctt

SEQ ID NO: 4131974 - DNA, 14 bp, Homo sapiens
catcttcacttcta

SEQ ID NO: 4131975 - DNA, 21 bp, Homo sapiens
catcttcacttctaaatgcat

SEQ ID NO: 4131976 - DNA, 12 bp, Homo sapiens
catcttcctgtg

SEQ ID NO: 4131977 - DNA, 16 bp, Homo sapiens
catcttcctgtgtcct

SEQ ID NO: 4131978 - DNA, 13 bp, Homo sapiens
catcttctgcctt

SEQ ID NO: 4131979 - DNA, 16 bp, Homo sapiens
catcttctgtgaaata

SEQ ID NO: 4131980 - DNA, 21 bp, Homo sapiens
catcttcttcccagtaagttt

SEQ ID NO: 4131981 - DNA, 15 bp, Homo sapiens
catcttgacagagcc

SEQ ID NO: 4131982 - DNA, 22 bp, Homo sapiens
catctttacaaaactacatgag

SEQ ID NO: 4131983 - DNA, 14 bp, Homo sapiens
catctttccatcca

SEQ ID NO: 4131984 - DNA, 23 bp, Homo sapiens
catctttcctcaagtatcttcta

SEQ ID NO: 4131985 - DNA, 14 bp, Homo sapiens
catctttttctttt

SEQ ID NO: 4131986 - DNA, 22 bp, Homo sapiens
catctttttctttttaacccta

SEQ ID NO: 4131987 - DNA, 18 bp, Homo sapiens
catgaaaaagcagctacc

SEQ ID NO: 4131988 - DNA, 13 bp, Homo sapiens
catgaaaacgttt

SEQ ID NO: 4131989 - DNA, 21 bp, Homo sapiens
catgaaaacgttttattgtgt

SEQ ID NO: 4131990 - DNA, 20 bp, Homo sapiens
catgaaagttttgcaaaggg

SEQ ID NO: 4131991 - DNA, 17 bp, Homo sapiens
catgaagaccacatcca

SEQ ID NO: 4131992 - DNA, 15 bp, Homo sapiens
catgaagagaagcaa

SEQ ID NO: 4131993 - DNA, 16 bp, Homo sapiens
catgaagagaagcaat

SEQ ID NO: 4131994 - DNA, 21 bp, Homo sapiens
catgaagagaagcaattttgg

SEQ ID NO: 4131995 - DNA, 14 bp, Homo sapiens
catgaagagcttgt

SEQ ID NO: 4131996 - DNA, 14 bp, Homo sapiens
catgaagcaacgat

SEQ ID NO: 4131997 - DNA, 15 bp, Homo sapiens
catgaagcaacgata

SEQ ID NO: 4131998 - DNA, 22 bp, Homo sapiens
catgaagcccaagtgaaatcaa

SEQ ID NO: 4131999 - DNA, 18 bp, Homo sapiens
catgaagtaaattatgta

SEQ ID NO: 4132000 - DNA, 16 bp, Homo sapiens
catgaatccagtccag

SEQ ID NO: 4132001 - DNA, 14 bp, Homo sapiens
catgaatctgtctc

SEQ ID NO: 4132002 - DNA, 20 bp, Homo sapiens
catgaatgcagtcatgcaaa

SEQ ID NO: 4132003 - DNA, 21 bp, Homo sapiens
catgaatgcagtcatgcaaac

SEQ ID NO: 4132004 - DNA, 15 bp, Homo sapiens
catgacagaggctgc

SEQ ID NO: 4132005 - DNA, 20 bp, Homo sapiens
catgacccctcgtccacccc

SEQ ID NO: 4132006 - DNA, 22 bp, Homo sapiens
catgacctgatcactagcctgt

SEQ ID NO: 4132007 - DNA, 11 bp, Homo sapiens
catgactgcac

SEQ ID NO: 4132008 - DNA, 21 bp, Homo sapiens
catgactgcacccagctccag

SEQ ID NO: 4132009 - DNA, 22 bp, Homo sapiens
catgactgggcctcccttgggc

SEQ ID NO: 4132010 - DNA, 13 bp, Homo sapiens
catgactgtgacc

SEQ ID NO: 4132011 - DNA, 14 bp, Homo sapiens
catgagaagagggc

SEQ ID NO: 4132012 - DNA, 15 bp, Homo sapiens
catgagaagagggcc

SEQ ID NO: 4132013 - DNA, 18 bp, Homo sapiens
catgagaattttacttcc

SEQ ID NO: 4132014 - DNA, 14 bp, Homo sapiens
catgagacacatct

SEQ ID NO: 4132015 - DNA, 19 bp, Homo sapiens
catgagaccactgttatca

SEQ ID NO: 4132016 - DNA, 23 bp, Homo sapiens
catgagagaattgtatcatttga

SEQ ID NO: 4132017 - DNA, 22 bp, Homo sapiens
catgagatgatacatccaaagc

SEQ ID NO: 4132018 - DNA, 21 bp, Homo sapiens
catgagcaccccaaggctgcg

SEQ ID NO: 4132019 - DNA, 16 bp, Homo sapiens
catgagcctgcccgct

SEQ ID NO: 4132020 - DNA, 19 bp, Homo sapiens
catgagcctgcccgctgca

SEQ ID NO: 4132021 - DNA, 22 bp, Homo sapiens
catgagcctgctggaagcccag

SEQ ID NO: 4132022 - DNA, 20 bp, Homo sapiens
catgaggagggtgggggagg

SEQ ID NO: 4132023 - DNA, 17 bp, Homo sapiens
catgaggccatctcagg

SEQ ID NO: 4132024 - DNA, 15 bp, Homo sapiens
catgaggggagagga

SEQ ID NO: 4132025 - DNA, 17 bp, Homo sapiens
catgagttgtcagcttt

SEQ ID NO: 4132026 - DNA, 24 bp, Homo sapiens
catgatcatagctcactgcagcct

SEQ ID NO: 4132027 - DNA, 16 bp, Homo sapiens
catgatgctctttccc

SEQ ID NO: 4132028 - DNA, 19 bp, Homo sapiens
catgatgggaaaatatttc

SEQ ID NO: 4132029 - DNA, 16 bp, Homo sapiens
catgattgtataagca

SEQ ID NO: 4132030 - DNA, 22 bp, Homo sapiens
catgattgtataagcatgcttt

SEQ ID NO: 4132031 - DNA, 17 bp, Homo sapiens
catgcaaaaagaaatga

SEQ ID NO: 4132032 - DNA, 16 bp, Homo sapiens
catgcaatgacatctt

SEQ ID NO: 4132033 - DNA, 14 bp, Homo sapiens
catgcactgtgaag

SEQ ID NO: 4132034 - DNA, 16 bp, Homo sapiens
catgcagcccatgccc

SEQ ID NO: 4132035 - DNA, 17 bp, Homo sapiens
catgcagttcattattt

SEQ ID NO: 4132036 - DNA, 20 bp, Homo sapiens
catgcagttcattattttgt

SEQ ID NO: 4132037 - DNA, 23 bp, Homo sapiens
catgcagttcattattttgtggt

SEQ ID NO: 4132038 - DNA, 13 bp, Homo sapiens
catgcataaatat

SEQ ID NO: 4132039 - DNA, 16 bp, Homo sapiens
catgcataaatatgca

SEQ ID NO: 4132040 - DNA, 15 bp, Homo sapiens
catgcatgccctctc

SEQ ID NO: 4132041 - DNA, 19 bp, Homo sapiens
catgcatgccctctctgag

SEQ ID NO: 4132042 - DNA, 12 bp, Homo sapiens
catgcattgttg

SEQ ID NO: 4132043 - DNA, 14 bp, Homo sapiens
catgcattttgcag

SEQ ID NO: 4132044 - DNA, 14 bp, Homo sapiens
catgccaaggcctc

SEQ ID NO: 4132045 - DNA, 21 bp, Homo sapiens
catgccacaaggacttcctgt

SEQ ID NO: 4132046 - DNA, 11 bp, Homo sapiens
catgccaccct

SEQ ID NO: 4132047 - DNA, 16 bp, Homo sapiens
catgccacctggcaaa

SEQ ID NO: 4132048 - DNA, 12 bp, Homo sapiens
catgccactgcc

SEQ ID NO: 4132049 - DNA, 15 bp, Homo sapiens
catgccactgcctgc

SEQ ID NO: 4132050 - DNA, 22 bp, Homo sapiens
catgccagattctgcctctctg

SEQ ID NO: 4132051 - DNA, 21 bp, Homo sapiens
catgccagctacttcctcctc

SEQ ID NO: 4132052 - DNA, 18 bp, Homo sapiens
catgcccaccccctgccc

SEQ ID NO: 4132053 - DNA, 16 bp, Homo sapiens
catgcccacctgccca

SEQ ID NO: 4132054 - DNA, 12 bp, Homo sapiens
catgcccactgc

SEQ ID NO: 4132055 - DNA, 14 bp, Homo sapiens
catgcccactgctg

SEQ ID NO: 4132056 - DNA, 17 bp, Homo sapiens
catgcccactgctggtg

SEQ ID NO: 4132057 - DNA, 18 bp, Homo sapiens
catgcccactgctggtgc

SEQ ID NO: 4132058 - DNA, 20 bp, Homo sapiens
catgcccactgctggtgcca

SEQ ID NO: 4132059 - DNA, 21 bp, Homo sapiens
catgcccactgctggtgccag

SEQ ID NO: 4132060 - DNA, 23 bp, Homo sapiens
catgcccactgctggtgccaggg

SEQ ID NO: 4132061 - DNA, 12 bp, Homo sapiens
catgccccagtc

SEQ ID NO: 4132062 - DNA, 22 bp, Homo sapiens
catgccccagtcggccccatct

SEQ ID NO: 4132063 - DNA, 13 bp, Homo sapiens
catgccccttggc

SEQ ID NO: 4132064 - DNA, 16 bp, Homo sapiens
catgccccttggctgg

SEQ ID NO: 4132065 - DNA, 16 bp, Homo sapiens
catgccctctctgagt

SEQ ID NO: 4132066 - DNA, 19 bp, Homo sapiens
catgccctgtgcaacctct

SEQ ID NO: 4132067 - DNA, 15 bp, Homo sapiens
catgccgggtgcagc

SEQ ID NO: 4132068 - DNA, 20 bp, Homo sapiens
catgcctgagggtggagact

SEQ ID NO: 4132069 - DNA, 20 bp, Homo sapiens
catgcctgcccccctcatct

SEQ ID NO: 4132070 - DNA, 23 bp, Homo sapiens
catgcctgcgcctgctgcctgct

SEQ ID NO: 4132071 - DNA, 21 bp, Homo sapiens
catgcctgtccagcctgggca

SEQ ID NO: 4132072 - DNA, 14 bp, Homo sapiens
catgccttaaattt

SEQ ID NO: 4132073 - DNA, 15 bp, Homo sapiens
catgccttaaatttg

SEQ ID NO: 4132074 - DNA, 23 bp, Homo sapiens
catgccttaaatttgtttaatta

SEQ ID NO: 4132075 - DNA, 18 bp, Homo sapiens
catgcctttcatagttta

SEQ ID NO: 4132076 - DNA, 20 bp, Homo sapiens
catgcctttcatagtttatt

SEQ ID NO: 4132077 - DNA, 14 bp, Homo sapiens
catgcggtagccag

SEQ ID NO: 4132078 - DNA, 19 bp, Homo sapiens
catgcggtagccagcacac

SEQ ID NO: 4132079 - DNA, 21 bp, Homo sapiens
catgcggtagccagcacacag

SEQ ID NO: 4132080 - DNA, 14 bp, Homo sapiens
catgctaaaattct

SEQ ID NO: 4132081 - DNA, 18 bp, Homo sapiens
catgctcaaccactgtgg

SEQ ID NO: 4132082 - DNA, 14 bp, Homo sapiens
catgctcacctcta

SEQ ID NO: 4132083 - DNA, 15 bp, Homo sapiens
catgctcagccctga

SEQ ID NO: 4132084 - DNA, 23 bp, Homo sapiens
catgctcagccctgactggtgct

SEQ ID NO: 4132085 - DNA, 18 bp, Homo sapiens
catgctcctcacctgtct

SEQ ID NO: 4132086 - DNA, 13 bp, Homo sapiens
catgctgaaggga

SEQ ID NO: 4132087 - DNA, 19 bp, Homo sapiens
catgctgactgtcctctcc

SEQ ID NO: 4132088 - DNA, 20 bp, Homo sapiens
catgctgggaagacgcctga

SEQ ID NO: 4132089 - DNA, 23 bp, Homo sapiens
catgctgggaagacgcctgagct

SEQ ID NO: 4132090 - DNA, 14 bp, Homo sapiens
catgctgggatttc

SEQ ID NO: 4132091 - DNA, 23 bp, Homo sapiens
catgcttcatcattccctctcat

SEQ ID NO: 4132092 - DNA, 13 bp, Homo sapiens
catgcttcccaga

SEQ ID NO: 4132093 - DNA, 15 bp, Homo sapiens
catgcttcccagagg

SEQ ID NO: 4132094 - DNA, 17 bp, Homo sapiens
catgcttcccagaggga

SEQ ID NO: 4132095 - DNA, 20 bp, Homo sapiens
catgcttcccagagggagca

SEQ ID NO: 4132096 - DNA, 18 bp, Homo sapiens
catgctttctttgagttt

SEQ ID NO: 4132097 - DNA, 23 bp, Homo sapiens
catggaaaaatggttgatggaaa

SEQ ID NO: 4132098 - DNA, 23 bp, Homo sapiens
catggaatatttataggccaggg

SEQ ID NO: 4132099 - DNA, 19 bp, Homo sapiens
catggaatggacatcctgt

SEQ ID NO: 4132100 - DNA, 14 bp, Homo sapiens
catggacacccctt

SEQ ID NO: 4132101 - DNA, 22 bp, Homo sapiens
catggacaccccttatccagga

SEQ ID NO: 4132102 - DNA, 15 bp, Homo sapiens
catggacaggctggc

SEQ ID NO: 4132103 - DNA, 18 bp, Homo sapiens
catggacaggctggctcc

SEQ ID NO: 4132104 - DNA, 18 bp, Homo sapiens
catggacatgatcttctt

SEQ ID NO: 4132105 - DNA, 19 bp, Homo sapiens
catggacgcaccggcctgg

SEQ ID NO: 4132106 - DNA, 15 bp, Homo sapiens
catggacttccactg

SEQ ID NO: 4132107 - DNA, 13 bp, Homo sapiens
catggacttgtat

SEQ ID NO: 4132108 - DNA, 16 bp, Homo sapiens
catggacttgtatatt

SEQ ID NO: 4132109 - DNA, 20 bp, Homo sapiens
catggagaatctgctgcata

SEQ ID NO: 4132110 - DNA, 18 bp, Homo sapiens
catggagccccctctgcc

SEQ ID NO: 4132111 - DNA, 19 bp, Homo sapiens
catggagccccctctgccg

SEQ ID NO: 4132112 - DNA, 14 bp, Homo sapiens
catggagctgtcat

SEQ ID NO: 4132113 - DNA, 17 bp, Homo sapiens
catggaggccctcctgt

SEQ ID NO: 4132114 - DNA, 18 bp, Homo sapiens
catggaggccctcctgtg

SEQ ID NO: 4132115 - DNA, 20 bp, Homo sapiens
catggaggccctcctgtgct

SEQ ID NO: 4132116 - DNA, 18 bp, Homo sapiens
catggagtgtgtattgtt

SEQ ID NO: 4132117 - DNA, 20 bp, Homo sapiens
catggagtgtgtattgttcc

SEQ ID NO: 4132118 - DNA, 14 bp, Homo sapiens
catggattttggat

SEQ ID NO: 4132119 - DNA, 22 bp, Homo sapiens
catggatttttacaagatccat

SEQ ID NO: 4132120 - DNA, 23 bp, Homo sapiens
catggatttttacaagatccatt

SEQ ID NO: 4132121 - DNA, 14 bp, Homo sapiens
catggcagctgttt

SEQ ID NO: 4132122 - DNA, 22 bp, Homo sapiens
catggccacttgggtcttccct

SEQ ID NO: 4132123 - DNA, 14 bp, Homo sapiens
catggcccccaggg

SEQ ID NO: 4132124 - DNA, 19 bp, Homo sapiens
catggcccccaggggcagg

SEQ ID NO: 4132125 - DNA, 18 bp, Homo sapiens
catggcccctctgacctg

SEQ ID NO: 4132126 - DNA, 12 bp, Homo sapiens
catggcctttct

SEQ ID NO: 4132127 - DNA, 13 bp, Homo sapiens
catggcctttcta

SEQ ID NO: 4132128 - DNA, 20 bp, Homo sapiens
catggctcagagcttgaaga

SEQ ID NO: 4132129 - DNA, 12 bp, Homo sapiens
catggctggggt

SEQ ID NO: 4132130 - DNA, 20 bp, Homo sapiens
catggctgtgtttgcagcct

SEQ ID NO: 4132131 - DNA, 17 bp, Homo sapiens
catggcttaatgtttat

SEQ ID NO: 4132132 - DNA, 19 bp, Homo sapiens
catggcttctgaacctgtc

SEQ ID NO: 4132133 - DNA, 20 bp, Homo sapiens
catgggaaatgtcaacaagt

SEQ ID NO: 4132134 - DNA, 12 bp, Homo sapiens
catgggagccag

SEQ ID NO: 4132135 - DNA, 17 bp, Homo sapiens
catgggagccagctgct

SEQ ID NO: 4132136 - DNA, 22 bp, Homo sapiens
catgggagccagctgctttttg

SEQ ID NO: 4132137 - DNA, 14 bp, Homo sapiens
catgggagggggct

SEQ ID NO: 4132138 - DNA, 22 bp, Homo sapiens
catgggagggggcttgaagcca

SEQ ID NO: 4132139 - DNA, 14 bp, Homo sapiens
catgggcagcccaa

SEQ ID NO: 4132140 - DNA, 20 bp, Homo sapiens
catgggcataggtaagctgt

SEQ ID NO: 4132141 - DNA, 14 bp, Homo sapiens
catgggctcctgcc

SEQ ID NO: 4132142 - DNA, 17 bp, Homo sapiens
catgggctcctgcccct

SEQ ID NO: 4132143 - DNA, 18 bp, Homo sapiens
catgggctcctgcccctt

SEQ ID NO: 4132144 - DNA, 12 bp, Homo sapiens
catgggcttcac

SEQ ID NO: 4132145 - DNA, 14 bp, Homo sapiens
catgggcttcactg

SEQ ID NO: 4132146 - DNA, 20 bp, Homo sapiens
catgggcttcactgtataaa

SEQ ID NO: 4132147 - DNA, 21 bp, Homo sapiens
catggggatcaattttcatta

SEQ ID NO: 4132148 - DNA, 15 bp, Homo sapiens
catggggccctccca

SEQ ID NO: 4132149 - DNA, 22 bp, Homo sapiens
catggggtttttattattttta

SEQ ID NO: 4132150 - DNA, 23 bp, Homo sapiens
catgggtgaagggagagccagct

SEQ ID NO: 4132151 - DNA, 20 bp, Homo sapiens
catggtagagaatctctccc

SEQ ID NO: 4132152 - DNA, 16 bp, Homo sapiens
catggtcacacactga

SEQ ID NO: 4132153 - DNA, 17 bp, Homo sapiens
catggtcacacactgat

SEQ ID NO: 4132154 - DNA, 21 bp, Homo sapiens
catggtcacacactgatgctt

SEQ ID NO: 4132155 - DNA, 21 bp, Homo sapiens
catggtgcagttgacagcagg

SEQ ID NO: 4132156 - DNA, 15 bp, Homo sapiens
catggtgccccagga

SEQ ID NO: 4132157 - DNA, 18 bp, Homo sapiens
catggtgccccaggacca

SEQ ID NO: 4132158 - DNA, 22 bp, Homo sapiens
catggtgccccaggaccagctc

SEQ ID NO: 4132159 - DNA, 19 bp, Homo sapiens
catggtgcctgagaggcag

SEQ ID NO: 4132160 - DNA, 21 bp, Homo sapiens
catggtgcctgagaggcaggc

SEQ ID NO: 4132161 - DNA, 13 bp, Homo sapiens
catggtgtggggg

SEQ ID NO: 4132162 - DNA, 22 bp, Homo sapiens
catggtgtggggggctggggga

SEQ ID NO: 4132163 - DNA, 23 bp, Homo sapiens
catggtgtggggggctgggggag

SEQ ID NO: 4132164 - DNA, 21 bp, Homo sapiens
catggttacaatcattgctga

SEQ ID NO: 4132165 - DNA, 14 bp, Homo sapiens
catggttgagaaat

SEQ ID NO: 4132166 - DNA, 17 bp, Homo sapiens
catggtttccatttact

SEQ ID NO: 4132167 - DNA, 16 bp, Homo sapiens
catgtaaaagagtcat

SEQ ID NO: 4132168 - DNA, 17 bp, Homo sapiens
catgtaaagaaatgtct

SEQ ID NO: 4132169 - DNA, 21 bp, Homo sapiens
catgtaaagaaatgtcttaat

SEQ ID NO: 4132170 - DNA, 19 bp, Homo sapiens
catgtaacacataaacaat

SEQ ID NO: 4132171 - DNA, 21 bp, Homo sapiens
catgtaacacataaacaattc

SEQ ID NO: 4132172 - DNA, 12 bp, Homo sapiens
catgtaataaaa

SEQ ID NO: 4132173 - DNA, 21 bp, Homo sapiens
catgtaataaaaagtatatgt

SEQ ID NO: 4132174 - DNA, 21 bp, Homo sapiens
catgtaatggtatcttaaagt

SEQ ID NO: 4132175 - DNA, 19 bp, Homo sapiens
catgtaatgttaatgttat

SEQ ID NO: 4132176 - DNA, 19 bp, Homo sapiens
catgtaccatttgcatggc

SEQ ID NO: 4132177 - DNA, 13 bp, Homo sapiens
catgtactgtagt

SEQ ID NO: 4132178 - DNA, 12 bp, Homo sapiens
catgtagagaaa

SEQ ID NO: 4132179 - DNA, 13 bp, Homo sapiens
catgtagccccct

SEQ ID NO: 4132180 - DNA, 18 bp, Homo sapiens
catgtagccccctggcct

SEQ ID NO: 4132181 - DNA, 17 bp, Homo sapiens
catgtataaatgtgata

SEQ ID NO: 4132182 - DNA, 17 bp, Homo sapiens
catgtatattttctcta

SEQ ID NO: 4132183 - DNA, 15 bp, Homo sapiens
catgtatcatctgga

SEQ ID NO: 4132184 - DNA, 23 bp, Homo sapiens
catgtatgttatgatattgttta

SEQ ID NO: 4132185 - DNA, 15 bp, Homo sapiens
catgtattcatccag

SEQ ID NO: 4132186 - DNA, 13 bp, Homo sapiens
catgtcactgtgg

SEQ ID NO: 4132187 - DNA, 15 bp, Homo sapiens
catgtcactgtggtc

SEQ ID NO: 4132188 - DNA, 21 bp, Homo sapiens
catgtcaggcctgtgtgtgaa

SEQ ID NO: 4132189 - DNA, 13 bp, Homo sapiens
catgtccaaagag

SEQ ID NO: 4132190 - DNA, 18 bp, Homo sapiens
catgtccaaagaggctgc

SEQ ID NO: 4132191 - DNA, 21 bp, Homo sapiens
catgtccaaagaggctgcccc

SEQ ID NO: 4132192 - DNA, 17 bp, Homo sapiens
catgtccaagttcttca

SEQ ID NO: 4132193 - DNA, 20 bp, Homo sapiens
catgtccaagttcttcacct

SEQ ID NO: 4132194 - DNA, 22 bp, Homo sapiens
catgtccaagttcttcacctct

SEQ ID NO: 4132195 - DNA, 23 bp, Homo sapiens
catgtccaagttcttcacctcta

SEQ ID NO: 4132196 - DNA, 23 bp, Homo sapiens
catgtccatacactttgttgcaa

SEQ ID NO: 4132197 - DNA, 22 bp, Homo sapiens
catgtccctaccgagtctcttc

SEQ ID NO: 4132198 - DNA, 12 bp, Homo sapiens
catgtcctgctg

SEQ ID NO: 4132199 - DNA, 17 bp, Homo sapiens
catgtcctgctggcttc

SEQ ID NO: 4132200 - DNA, 19 bp, Homo sapiens
catgtcctgctggcttcca

SEQ ID NO: 4132201 - DNA, 22 bp, Homo sapiens
catgtcctgctggcttccagct

SEQ ID NO: 4132202 - DNA, 20 bp, Homo sapiens
catgtctgcctggagtgctg

SEQ ID NO: 4132203 - DNA, 24 bp, Homo sapiens
catgtgaaaccttttttaagattt

SEQ ID NO: 4132204 - DNA, 13 bp, Homo sapiens
catgtgacattta

SEQ ID NO: 4132205 - DNA, 16 bp, Homo sapiens
catgtgaccactctgt

SEQ ID NO: 4132206 - DNA, 12 bp, Homo sapiens
catgtgagccac

SEQ ID NO: 4132207 - DNA, 22 bp, Homo sapiens
catgtgagccaccgctgccagc

SEQ ID NO: 4132208 - DNA, 23 bp, Homo sapiens
catgtgagccaccgctgccagca

SEQ ID NO: 4132209 - DNA, 17 bp, Homo sapiens
catgtgaggaggaaaag

SEQ ID NO: 4132210 - DNA, 19 bp, Homo sapiens
catgtgaggaggaaaagga

SEQ ID NO: 4132211 - DNA, 21 bp, Homo sapiens
catgtgcacccggcctggatg

SEQ ID NO: 4132212 - DNA, 18 bp, Homo sapiens
catgtgccatctgtacat

SEQ ID NO: 4132213 - DNA, 22 bp, Homo sapiens
catgtgcctctgcggggcaggg

SEQ ID NO: 4132214 - DNA, 19 bp, Homo sapiens
catgtgcctttctttgcct

SEQ ID NO: 4132215 - DNA, 19 bp, Homo sapiens
catgtgctgtgaccattta

SEQ ID NO: 4132216 - DNA, 17 bp, Homo sapiens
catgtggaaagtgaatt

SEQ ID NO: 4132217 - DNA, 22 bp, Homo sapiens
catgtggaaagtgaatttgaat

SEQ ID NO: 4132218 - DNA, 23 bp, Homo sapiens
catgtggaaagtgaatttgaatg

SEQ ID NO: 4132219 - DNA, 15 bp, Homo sapiens
catgtggccccaccc

SEQ ID NO: 4132220 - DNA, 20 bp, Homo sapiens
catgtggcttttttaaaaaa

SEQ ID NO: 4132221 - DNA, 17 bp, Homo sapiens
catgtggggccaggtca

SEQ ID NO: 4132222 - DNA, 16 bp, Homo sapiens
catgtgggtgagccag

SEQ ID NO: 4132223 - DNA, 16 bp, Homo sapiens
catgtgtagcctatgt

SEQ ID NO: 4132224 - DNA, 11 bp, Homo sapiens
catgtgtatgt

SEQ ID NO: 4132225 - DNA, 23 bp, Homo sapiens
catgtgtcaacacccctgtgtgg

SEQ ID NO: 4132226 - DNA, 18 bp, Homo sapiens
catgtgtcacttgtgctt

SEQ ID NO: 4132227 - DNA, 14 bp, Homo sapiens
catgtgtcagagtg

SEQ ID NO: 4132228 - DNA, 17 bp, Homo sapiens
catgtgtcccctcactc

SEQ ID NO: 4132229 - DNA, 21 bp, Homo sapiens
catgtgtcctggttcccgttt

SEQ ID NO: 4132230 - DNA, 14 bp, Homo sapiens
catgtgtggactca

SEQ ID NO: 4132231 - DNA, 13 bp, Homo sapiens
catgtgtgtgtgt

SEQ ID NO: 4132232 - DNA, 16 bp, Homo sapiens
catgttacataagata

SEQ ID NO: 4132233 - DNA, 12 bp, Homo sapiens
catgttaccatc

SEQ ID NO: 4132234 - DNA, 17 bp, Homo sapiens
catgttactgcttcatt

SEQ ID NO: 4132235 - DNA, 22 bp, Homo sapiens
catgttcaaagccacattattt

SEQ ID NO: 4132236 - DNA, 20 bp, Homo sapiens
catgttcaaattttatcatg

SEQ ID NO: 4132237 - DNA, 19 bp, Homo sapiens
catgttgagccaggcctgg

SEQ ID NO: 4132238 - DNA, 19 bp, Homo sapiens
catgttgcttgtcgctttc

SEQ ID NO: 4132239 - DNA, 20 bp, Homo sapiens
catgtttaatgggtatgctc

SEQ ID NO: 4132240 - DNA, 14 bp, Homo sapiens
catgtttccagcag

SEQ ID NO: 4132241 - DNA, 14 bp, Homo sapiens
catgtttgcttcat

SEQ ID NO: 4132242 - DNA, 14 bp, Homo sapiens
catgttttccgtga

SEQ ID NO: 4132243 - DNA, 13 bp, Homo sapiens
cattaaaaaatga

SEQ ID NO: 4132244 - DNA, 22 bp, Homo sapiens
cattaaaaaatgaaatattttt

SEQ ID NO: 4132245 - DNA, 19 bp, Homo sapiens
cattaaaaatgttagtatt

SEQ ID NO: 4132246 - DNA, 20 bp, Homo sapiens
cattaaaactaggtaatgtt

SEQ ID NO: 4132247 - DNA, 21 bp, Homo sapiens
cattaaaatttcttatttacc

SEQ ID NO: 4132248 - DNA, 11 bp, Homo sapiens
cattaaacttt

SEQ ID NO: 4132249 - DNA, 14 bp, Homo sapiens
cattaaactttttt

SEQ ID NO: 4132250 - DNA, 13 bp, Homo sapiens
cattaaagtctga

SEQ ID NO: 4132251 - DNA, 14 bp, Homo sapiens
cattaaattcacaa

SEQ ID NO: 4132252 - DNA, 18 bp, Homo sapiens
cattaaattcacaaactt

SEQ ID NO: 4132253 - DNA, 13 bp, Homo sapiens
cattaacaaataa

SEQ ID NO: 4132254 - DNA, 16 bp, Homo sapiens
cattaacagttttcca

SEQ ID NO: 4132255 - DNA, 14 bp, Homo sapiens
cattaagtaatcaa

SEQ ID NO: 4132256 - DNA, 15 bp, Homo sapiens
cattaagtcatgtgt

SEQ ID NO: 4132257 - DNA, 23 bp, Homo sapiens
cattaagtcatgtgtgaacacat

SEQ ID NO: 4132258 - DNA, 16 bp, Homo sapiens
cattaatcatttcccc

SEQ ID NO: 4132259 - DNA, 17 bp, Homo sapiens
cattaatcatttcccca

SEQ ID NO: 4132260 - DNA, 13 bp, Homo sapiens
cattaatgttaat

SEQ ID NO: 4132261 - DNA, 12 bp, Homo sapiens
cattaatgtttc

SEQ ID NO: 4132262 - DNA, 15 bp, Homo sapiens
cattaatgtttctat

SEQ ID NO: 4132263 - DNA, 12 bp, Homo sapiens
cattaattctat

SEQ ID NO: 4132264 - DNA, 17 bp, Homo sapiens
cattaatttttaattga

SEQ ID NO: 4132265 - DNA, 23 bp, Homo sapiens
cattaatttttaattgaaactag

SEQ ID NO: 4132266 - DNA, 13 bp, Homo sapiens
cattacagagagg

SEQ ID NO: 4132267 - DNA, 18 bp, Homo sapiens
cattacagagaggagaaa

SEQ ID NO: 4132268 - DNA, 14 bp, Homo sapiens
cattacatgtgttt

SEQ ID NO: 4132269 - DNA, 23 bp, Homo sapiens
cattacatgtgtttattcatcca

SEQ ID NO: 4132270 - DNA, 13 bp, Homo sapiens
cattaccactcag

SEQ ID NO: 4132271 - DNA, 19 bp, Homo sapiens
cattacccacccgacctgg

SEQ ID NO: 4132272 - DNA, 20 bp, Homo sapiens
cattacccacccgacctggc

SEQ ID NO: 4132273 - DNA, 22 bp, Homo sapiens
cattacccacccgacctggctg

SEQ ID NO: 4132274 - DNA, 13 bp, Homo sapiens
cattacccttccc

SEQ ID NO: 4132275 - DNA, 16 bp, Homo sapiens
cattacccttccctgc

SEQ ID NO: 4132276 - DNA, 19 bp, Homo sapiens
cattacccttccctgcact

SEQ ID NO: 4132277 - DNA, 16 bp, Homo sapiens
cattacctccatccat

SEQ ID NO: 4132278 - DNA, 24 bp, Homo sapiens
cattacctccatccatccttccaa

SEQ ID NO: 4132279 - DNA, 13 bp, Homo sapiens
cattaccttactg

SEQ ID NO: 4132280 - DNA, 13 bp, Homo sapiens
cattacgtgagcc

SEQ ID NO: 4132281 - DNA, 16 bp, Homo sapiens
cattacgtgagccagg

SEQ ID NO: 4132282 - DNA, 18 bp, Homo sapiens
cattagaaattagctgtg

SEQ ID NO: 4132283 - DNA, 14 bp, Homo sapiens
cattagaattattt

SEQ ID NO: 4132284 - DNA, 17 bp, Homo sapiens
cattagactcctcctcc

SEQ ID NO: 4132285 - DNA, 16 bp, Homo sapiens
cattaggccagcaacg

SEQ ID NO: 4132286 - DNA, 20 bp, Homo sapiens
cattaggccagcaacgcttg

SEQ ID NO: 4132287 - DNA, 22 bp, Homo sapiens
cattaggtccctcactccacag

SEQ ID NO: 4132288 - DNA, 19 bp, Homo sapiens
cattagtaaatgtctttgt

SEQ ID NO: 4132289 - DNA, 23 bp, Homo sapiens
cattagtaaatgtctttgtaagt

SEQ ID NO: 4132290 - DNA, 20 bp, Homo sapiens
cattatacatcaattggaaa

SEQ ID NO: 4132291 - DNA, 13 bp, Homo sapiens
cattatccctgaa

SEQ ID NO: 4132292 - DNA, 13 bp, Homo sapiens
cattatctatgca

SEQ ID NO: 4132293 - DNA, 16 bp, Homo sapiens
cattatctatgcagca

SEQ ID NO: 4132294 - DNA, 19 bp, Homo sapiens
cattatctcacttagtcct

SEQ ID NO: 4132295 - DNA, 14 bp, Homo sapiens
cattatcttatgaa

SEQ ID NO: 4132296 - DNA, 14 bp, Homo sapiens
cattatgattcttt

SEQ ID NO: 4132297 - DNA, 15 bp, Homo sapiens
cattatgtatcttag

SEQ ID NO: 4132298 - DNA, 13 bp, Homo sapiens
cattattatcaac

SEQ ID NO: 4132299 - DNA, 14 bp, Homo sapiens
cattattcatttag

SEQ ID NO: 4132300 - DNA, 16 bp, Homo sapiens
cattattcatttagtg

SEQ ID NO: 4132301 - DNA, 17 bp, Homo sapiens
cattattggaattaacc

SEQ ID NO: 4132302 - DNA, 20 bp, Homo sapiens
cattattttgggaagaaaac

SEQ ID NO: 4132303 - DNA, 20 bp, Homo sapiens
cattatttttccactttgtt

SEQ ID NO: 4132304 - DNA, 12 bp, Homo sapiens
cattcaacaaga

SEQ ID NO: 4132305 - DNA, 23 bp, Homo sapiens
cattcaactttagtatttttact

SEQ ID NO: 4132306 - DNA, 13 bp, Homo sapiens
cattcacctgccc

SEQ ID NO: 4132307 - DNA, 19 bp, Homo sapiens
cattcacctgccccaactc

SEQ ID NO: 4132308 - DNA, 15 bp, Homo sapiens
cattcactagctttg

SEQ ID NO: 4132309 - DNA, 15 bp, Homo sapiens
cattcagagagcagc

SEQ ID NO: 4132310 - DNA, 18 bp, Homo sapiens
cattcagagctatggtgc

SEQ ID NO: 4132311 - DNA, 18 bp, Homo sapiens
cattcatagggaaaggtt

SEQ ID NO: 4132312 - DNA, 14 bp, Homo sapiens
cattcatccttcca

SEQ ID NO: 4132313 - DNA, 21 bp, Homo sapiens
cattcattttctgacatgcat

SEQ ID NO: 4132314 - DNA, 13 bp, Homo sapiens
cattcatttttat

SEQ ID NO: 4132315 - DNA, 17 bp, Homo sapiens
cattccaggcccgaagc

SEQ ID NO: 4132316 - DNA, 21 bp, Homo sapiens
cattccagtgctagaaaattt

SEQ ID NO: 4132317 - DNA, 16 bp, Homo sapiens
cattcccctcccacct

SEQ ID NO: 4132318 - DNA, 18 bp, Homo sapiens
cattccctcgtctttccc

SEQ ID NO: 4132319 - DNA, 14 bp, Homo sapiens
cattccctctcctg

SEQ ID NO: 4132320 - DNA, 15 bp, Homo sapiens
cattccctctcctgc

SEQ ID NO: 4132321 - DNA, 16 bp, Homo sapiens
cattccctgaatctgt

SEQ ID NO: 4132322 - DNA, 16 bp, Homo sapiens
cattccgttgtctgtg

SEQ ID NO: 4132323 - DNA, 20 bp, Homo sapiens
cattcctaacacagcatgtg

SEQ ID NO: 4132324 - DNA, 19 bp, Homo sapiens
cattcctgaaagaaacagt

SEQ ID NO: 4132325 - DNA, 17 bp, Homo sapiens
cattcctgaagaaccag

SEQ ID NO: 4132326 - DNA, 17 bp, Homo sapiens
cattccttctggcctct

SEQ ID NO: 4132327 - DNA, 16 bp, Homo sapiens
cattccttctttgata

SEQ ID NO: 4132328 - DNA, 15 bp, Homo sapiens
cattccttgcgcctc

SEQ ID NO: 4132329 - DNA, 21 bp, Homo sapiens
cattcgctgtaccctttaaga

SEQ ID NO: 4132330 - DNA, 14 bp, Homo sapiens
cattcgggccacag

SEQ ID NO: 4132331 - DNA, 23 bp, Homo sapiens
cattcgggccccacctgcagctc

SEQ ID NO: 4132332 - DNA, 15 bp, Homo sapiens
cattcgtgagctggg

SEQ ID NO: 4132333 - DNA, 15 bp, Homo sapiens
cattctacagaataa

SEQ ID NO: 4132334 - DNA, 15 bp, Homo sapiens
cattctatcaagccc

SEQ ID NO: 4132335 - DNA, 23 bp, Homo sapiens
cattctatcaagcccaggtgcca

SEQ ID NO: 4132336 - DNA, 19 bp, Homo sapiens
cattctatcgttattataa

SEQ ID NO: 4132337 - DNA, 13 bp, Homo sapiens
cattctattgcct

SEQ ID NO: 4132338 - DNA, 19 bp, Homo sapiens
cattctattgccttctttg

SEQ ID NO: 4132339 - DNA, 22 bp, Homo sapiens
cattctattgccttctttgaag

SEQ ID NO: 4132340 - DNA, 17 bp, Homo sapiens
cattctattttagaata

SEQ ID NO: 4132341 - DNA, 16 bp, Homo sapiens
cattctcaagggacgt

SEQ ID NO: 4132342 - DNA, 21 bp, Homo sapiens
cattctcataattcctacagc

SEQ ID NO: 4132343 - DNA, 14 bp, Homo sapiens
cattctccacagca

SEQ ID NO: 4132344 - DNA, 17 bp, Homo sapiens
cattctccacagcaacc

SEQ ID NO: 4132345 - DNA, 22 bp, Homo sapiens
cattctccccagtgtatgtctt

SEQ ID NO: 4132346 - DNA, 11 bp, Homo sapiens
cattctcctgc

SEQ ID NO: 4132347 - DNA, 13 bp, Homo sapiens
cattctcctgcct

SEQ ID NO: 4132348 - DNA, 23 bp, Homo sapiens
cattctcctgcctgtagcagtga

SEQ ID NO: 4132349 - DNA, 19 bp, Homo sapiens
cattctcgtgagtcattta

SEQ ID NO: 4132350 - DNA, 23 bp, Homo sapiens
cattctcgtgagtcatttaaatg

SEQ ID NO: 4132351 - DNA, 12 bp, Homo sapiens
cattctctctcc

SEQ ID NO: 4132352 - DNA, 18 bp, Homo sapiens
cattctgcattgctagat

SEQ ID NO: 4132353 - DNA, 21 bp, Homo sapiens
cattctgcattgctagataaa

SEQ ID NO: 4132354 - DNA, 13 bp, Homo sapiens
cattctgttttcc

SEQ ID NO: 4132355 - DNA, 16 bp, Homo sapiens
cattctgttttccccc

SEQ ID NO: 4132356 - DNA, 21 bp, Homo sapiens
cattcttaaaattcaagaaaa

SEQ ID NO: 4132357 - DNA, 13 bp, Homo sapiens
cattcttggccca

SEQ ID NO: 4132358 - DNA, 18 bp, Homo sapiens
cattcttgtcacaataaa

SEQ ID NO: 4132359 - DNA, 12 bp, Homo sapiens
cattgaaagaag

SEQ ID NO: 4132360 - DNA, 19 bp, Homo sapiens
cattgaaagagaaccagtt

SEQ ID NO: 4132361 - DNA, 21 bp, Homo sapiens
cattgaaatgagcacctccat

SEQ ID NO: 4132362 - DNA, 14 bp, Homo sapiens
cattgaacacaaac

SEQ ID NO: 4132363 - DNA, 17 bp, Homo sapiens
cattgaacacaaactgt

SEQ ID NO: 4132364 - DNA, 18 bp, Homo sapiens
cattgaacacaaactgta

SEQ ID NO: 4132365 - DNA, 20 bp, Homo sapiens
cattgaagccgactctggcc

SEQ ID NO: 4132366 - DNA, 16 bp, Homo sapiens
cattgacaagaactga

SEQ ID NO: 4132367 - DNA, 22 bp, Homo sapiens
cattgacaccagaaagccctct

SEQ ID NO: 4132368 - DNA, 19 bp, Homo sapiens
cattgaccaagaactgcat

SEQ ID NO: 4132369 - DNA, 21 bp, Homo sapiens
cattgaccaagaactgcatgg

SEQ ID NO: 4132370 - DNA, 21 bp, Homo sapiens
cattgaccgcgactaatttca

SEQ ID NO: 4132371 - DNA, 19 bp, Homo sapiens
cattgacgattccttctct

SEQ ID NO: 4132372 - DNA, 21 bp, Homo sapiens
cattgaggaaatattaatttt

SEQ ID NO: 4132373 - DNA, 18 bp, Homo sapiens
cattgagttggttacttc

SEQ ID NO: 4132374 - DNA, 20 bp, Homo sapiens
cattgcactctagcctgggc

SEQ ID NO: 4132375 - DNA, 12 bp, Homo sapiens
cattgcattcta

SEQ ID NO: 4132376 - DNA, 18 bp, Homo sapiens
cattgcattctattgcct

SEQ ID NO: 4132377 - DNA, 13 bp, Homo sapiens
cattgccaccagg

SEQ ID NO: 4132378 - DNA, 11 bp, Homo sapiens
cattgccccaa

SEQ ID NO: 4132379 - DNA, 16 bp, Homo sapiens
cattgcctagctcttt

SEQ ID NO: 4132380 - DNA, 16 bp, Homo sapiens
cattgcctgactaaaa

SEQ ID NO: 4132381 - DNA, 17 bp, Homo sapiens
cattgctagataaaagc

SEQ ID NO: 4132382 - DNA, 20 bp, Homo sapiens
cattgctcttagtcccaagc

SEQ ID NO: 4132383 - DNA, 15 bp, Homo sapiens
cattgctgagcctct

SEQ ID NO: 4132384 - DNA, 18 bp, Homo sapiens
cattgctgttagagaaat

SEQ ID NO: 4132385 - DNA, 22 bp, Homo sapiens
cattgctgttatgtctgtttaa

SEQ ID NO: 4132386 - DNA, 13 bp, Homo sapiens
cattgcttcttct

SEQ ID NO: 4132387 - DNA, 15 bp, Homo sapiens
cattgcttcttctga

SEQ ID NO: 4132388 - DNA, 16 bp, Homo sapiens
cattgcttcttctgag

SEQ ID NO: 4132389 - DNA, 14 bp, Homo sapiens
cattgctttctgaa

SEQ ID NO: 4132390 - DNA, 15 bp, Homo sapiens
cattgctttctgaaa

SEQ ID NO: 4132391 - DNA, 21 bp, Homo sapiens
cattgcttttattttgaaaag

SEQ ID NO: 4132392 - DNA, 17 bp, Homo sapiens
cattggaatgccttgga

SEQ ID NO: 4132393 - DNA, 19 bp, Homo sapiens
cattggaatgttctcagat

SEQ ID NO: 4132394 - DNA, 21 bp, Homo sapiens
cattggcaagatgaaataatt

SEQ ID NO: 4132395 - DNA, 21 bp, Homo sapiens
cattggggttccgcactttcc

SEQ ID NO: 4132396 - DNA, 22 bp, Homo sapiens
cattggtgaagtaaattaggca

SEQ ID NO: 4132397 - DNA, 17 bp, Homo sapiens
cattgtaatgttactga

SEQ ID NO: 4132398 - DNA, 15 bp, Homo sapiens
cattgtccagagctg

SEQ ID NO: 4132399 - DNA, 17 bp, Homo sapiens
cattgtccctcttcact

SEQ ID NO: 4132400 - DNA, 18 bp, Homo sapiens
cattgtccctcttcactc

SEQ ID NO: 4132401 - DNA, 16 bp, Homo sapiens
cattgtgattggcctg

SEQ ID NO: 4132402 - DNA, 13 bp, Homo sapiens
cattgttctcctc

SEQ ID NO: 4132403 - DNA, 22 bp, Homo sapiens
cattgttctcctcgtccatcag

SEQ ID NO: 4132404 - DNA, 16 bp, Homo sapiens
cattgttgaggtggtc

SEQ ID NO: 4132405 - DNA, 17 bp, Homo sapiens
cattgttggcgctgagg

SEQ ID NO: 4132406 - DNA, 17 bp, Homo sapiens
cattgttggctatttga

SEQ ID NO: 4132407 - DNA, 17 bp, Homo sapiens
cattgtttattaacaaa

SEQ ID NO: 4132408 - DNA, 22 bp, Homo sapiens
cattgtttgtctgtcttcatag

SEQ ID NO: 4132409 - DNA, 14 bp, Homo sapiens
cattgttttgaaac

SEQ ID NO: 4132410 - DNA, 15 bp, Homo sapiens
catttaaaaaaatca

SEQ ID NO: 4132411 - DNA, 12 bp, Homo sapiens
catttaaaatga

SEQ ID NO: 4132412 - DNA, 17 bp, Homo sapiens
catttaaaatgattaga

SEQ ID NO: 4132413 - DNA, 18 bp, Homo sapiens
catttaaaatgattagaa

SEQ ID NO: 4132414 - DNA, 19 bp, Homo sapiens
catttaaaattgctatgtt

SEQ ID NO: 4132415 - DNA, 12 bp, Homo sapiens
catttaaagcat

SEQ ID NO: 4132416 - DNA, 16 bp, Homo sapiens
catttaaagcattgct

SEQ ID NO: 4132417 - DNA, 17 bp, Homo sapiens
catttaaagcattgctg

SEQ ID NO: 4132418 - DNA, 22 bp, Homo sapiens
catttaaatgtaacttattatt

SEQ ID NO: 4132419 - DNA, 19 bp, Homo sapiens
catttaataaagaaatatt

SEQ ID NO: 4132420 - DNA, 18 bp, Homo sapiens
catttaatttgttataag

SEQ ID NO: 4132421 - DNA, 20 bp, Homo sapiens
catttacagtccttcaaaat

SEQ ID NO: 4132422 - DNA, 12 bp, Homo sapiens
catttagaaaat

SEQ ID NO: 4132423 - DNA, 22 bp, Homo sapiens
catttagaaaatagagctttta

SEQ ID NO: 4132424 - DNA, 15 bp, Homo sapiens
catttagaaatcaag

SEQ ID NO: 4132425 - DNA, 19 bp, Homo sapiens
catttagaactttctgctt

SEQ ID NO: 4132426 - DNA, 21 bp, Homo sapiens
catttagaactttctgctttg

SEQ ID NO: 4132427 - DNA, 22 bp, Homo sapiens
catttagatcctggtttcataa

SEQ ID NO: 4132428 - DNA, 19 bp, Homo sapiens
catttagtgagttattcct

SEQ ID NO: 4132429 - DNA, 14 bp, Homo sapiens
catttagttctttg

SEQ ID NO: 4132430 - DNA, 23 bp, Homo sapiens
catttataaccccagcctgacct

SEQ ID NO: 4132431 - DNA, 17 bp, Homo sapiens
catttataatgtttgct

SEQ ID NO: 4132432 - DNA, 15 bp, Homo sapiens
catttataattgcat

SEQ ID NO: 4132433 - DNA, 19 bp, Homo sapiens
catttatacaaattagaaa

SEQ ID NO: 4132434 - DNA, 14 bp, Homo sapiens
catttatatatgaa

SEQ ID NO: 4132435 - DNA, 12 bp, Homo sapiens
catttatatatt

SEQ ID NO: 4132436 - DNA, 22 bp, Homo sapiens
catttatccacaggaaagtgtt

SEQ ID NO: 4132437 - DNA, 19 bp, Homo sapiens
catttatgagtaactatta

SEQ ID NO: 4132438 - DNA, 16 bp, Homo sapiens
catttatgatttaata

SEQ ID NO: 4132439 - DNA, 23 bp, Homo sapiens
catttatgatttaataaaataat

SEQ ID NO: 4132440 - DNA, 21 bp, Homo sapiens
catttatggtcaacacttaag

SEQ ID NO: 4132441 - DNA, 13 bp, Homo sapiens
catttattgttta

SEQ ID NO: 4132442 - DNA, 20 bp, Homo sapiens
catttatttatacagtgcct

SEQ ID NO: 4132443 - DNA, 18 bp, Homo sapiens
catttatttattactgtc

SEQ ID NO: 4132444 - DNA, 22 bp, Homo sapiens
catttatttattactgtcccta

SEQ ID NO: 4132445 - DNA, 21 bp, Homo sapiens
catttattttaagcactctta

SEQ ID NO: 4132446 - DNA, 17 bp, Homo sapiens
catttattttttacatt

SEQ ID NO: 4132447 - DNA, 15 bp, Homo sapiens
catttcaactgtttg

SEQ ID NO: 4132448 - DNA, 14 bp, Homo sapiens
catttcaggaattt

SEQ ID NO: 4132449 - DNA, 16 bp, Homo sapiens
catttcatcattgttt

SEQ ID NO: 4132450 - DNA, 14 bp, Homo sapiens
catttcatcctttc

SEQ ID NO: 4132451 - DNA, 17 bp, Homo sapiens
catttcatgaaaatgac

SEQ ID NO: 4132452 - DNA, 18 bp, Homo sapiens
catttcattcctaacaca

SEQ ID NO: 4132453 - DNA, 14 bp, Homo sapiens
catttcccacatct

SEQ ID NO: 4132454 - DNA, 16 bp, Homo sapiens
catttcccacatcttt

SEQ ID NO: 4132455 - DNA, 17 bp, Homo sapiens
catttcccacatctttc

SEQ ID NO: 4132456 - DNA, 18 bp, Homo sapiens
catttcccacatctttcc

SEQ ID NO: 4132457 - DNA, 14 bp, Homo sapiens
catttcccatctgc

SEQ ID NO: 4132458 - DNA, 22 bp, Homo sapiens
catttcccccaaaggcatccca

SEQ ID NO: 4132459 - DNA, 23 bp, Homo sapiens
catttcccccgagctcttggcct

SEQ ID NO: 4132460 - DNA, 20 bp, Homo sapiens
catttcctcagcttatctct

SEQ ID NO: 4132461 - DNA, 20 bp, Homo sapiens
catttcctgacagaaggact

SEQ ID NO: 4132462 - DNA, 12 bp, Homo sapiens
catttccttcca

SEQ ID NO: 4132463 - DNA, 17 bp, Homo sapiens
catttccttccagccca

SEQ ID NO: 4132464 - DNA, 11 bp, Homo sapiens
catttccttgg

SEQ ID NO: 4132465 - DNA, 18 bp, Homo sapiens
catttctactgtgactga

SEQ ID NO: 4132466 - DNA, 13 bp, Homo sapiens
catttctcactga

SEQ ID NO: 4132467 - DNA, 21 bp, Homo sapiens
catttctcttccccttagaaa

SEQ ID NO: 4132468 - DNA, 22 bp, Homo sapiens
catttctgagtttcattctcct

SEQ ID NO: 4132469 - DNA, 22 bp, Homo sapiens
catttctgatcagaggtgtaca

SEQ ID NO: 4132470 - DNA, 15 bp, Homo sapiens
catttctgctctcag

SEQ ID NO: 4132471 - DNA, 15 bp, Homo sapiens
catttcttcacttca

SEQ ID NO: 4132472 - DNA, 23 bp, Homo sapiens
catttcttcagtcagaaaacttt

SEQ ID NO: 4132473 - DNA, 14 bp, Homo sapiens
catttcttcctcac

SEQ ID NO: 4132474 - DNA, 16 bp, Homo sapiens
catttcttcctcagct

SEQ ID NO: 4132475 - DNA, 17 bp, Homo sapiens
catttcttcctcagctg

SEQ ID NO: 4132476 - DNA, 20 bp, Homo sapiens
catttcttttctttttacat

SEQ ID NO: 4132477 - DNA, 23 bp, Homo sapiens
catttgaacctggatccagcact

SEQ ID NO: 4132478 - DNA, 16 bp, Homo sapiens
catttgatgctaaata

SEQ ID NO: 4132479 - DNA, 19 bp, Homo sapiens
catttgcagggtcctcttc

SEQ ID NO: 4132480 - DNA, 15 bp, Homo sapiens
catttgcctttctgg

SEQ ID NO: 4132481 - DNA, 16 bp, Homo sapiens
catttgctgttttaaa

SEQ ID NO: 4132482 - DNA, 16 bp, Homo sapiens
catttggtctgccaga

SEQ ID NO: 4132483 - DNA, 17 bp, Homo sapiens
catttggtctgccagaa

SEQ ID NO: 4132484 - DNA, 22 bp, Homo sapiens
catttggtctgccagaatactg

SEQ ID NO: 4132485 - DNA, 23 bp, Homo sapiens
catttggtgtggattttctactg

SEQ ID NO: 4132486 - DNA, 21 bp, Homo sapiens
catttggttcattaattctat

SEQ ID NO: 4132487 - DNA, 14 bp, Homo sapiens
catttgtaaatgct

SEQ ID NO: 4132488 - DNA, 13 bp, Homo sapiens
catttgtaataaa

SEQ ID NO: 4132489 - DNA, 12 bp, Homo sapiens
catttgtcccag

SEQ ID NO: 4132490 - DNA, 16 bp, Homo sapiens
catttgtctgtgtttg

SEQ ID NO: 4132491 - DNA, 14 bp, Homo sapiens
catttgttcactga

SEQ ID NO: 4132492 - DNA, 14 bp, Homo sapiens
catttgttcctgct

SEQ ID NO: 4132493 - DNA, 14 bp, Homo sapiens
catttgttcctgga

SEQ ID NO: 4132494 - DNA, 18 bp, Homo sapiens
catttgttgtgatgtctt

SEQ ID NO: 4132495 - DNA, 13 bp, Homo sapiens
cattttaaaaaca

SEQ ID NO: 4132496 - DNA, 17 bp, Homo sapiens
cattttaattattattc

SEQ ID NO: 4132497 - DNA, 12 bp, Homo sapiens
cattttacagtg

SEQ ID NO: 4132498 - DNA, 18 bp, Homo sapiens
cattttacattaaatttt

SEQ ID NO: 4132499 - DNA, 15 bp, Homo sapiens
cattttatcattaat

SEQ ID NO: 4132500 - DNA, 17 bp, Homo sapiens
cattttcaccccaccct

SEQ ID NO: 4132501 - DNA, 21 bp, Homo sapiens
cattttccatatcctggtgcc

SEQ ID NO: 4132502 - DNA, 20 bp, Homo sapiens
cattttcccatcatcctttg

SEQ ID NO: 4132503 - DNA, 21 bp, Homo sapiens
cattttcccccactactgcag

SEQ ID NO: 4132504 - DNA, 17 bp, Homo sapiens
cattttccccccactct

SEQ ID NO: 4132505 - DNA, 17 bp, Homo sapiens
cattttcctcctctgcc

SEQ ID NO: 4132506 - DNA, 10 bp, Homo sapiens
cattttcctg

SEQ ID NO: 4132507 - DNA, 18 bp, Homo sapiens
cattttctataacagata

SEQ ID NO: 4132508 - DNA, 19 bp, Homo sapiens
cattttctgacatgcattg

SEQ ID NO: 4132509 - DNA, 18 bp, Homo sapiens
cattttcttttcacttcg

SEQ ID NO: 4132510 - DNA, 12 bp, Homo sapiens
cattttgaagtg

SEQ ID NO: 4132511 - DNA, 15 bp, Homo sapiens
cattttgcagcagtg

SEQ ID NO: 4132512 - DNA, 17 bp, Homo sapiens
cattttgctattgtaaa

SEQ ID NO: 4132513 - DNA, 14 bp, Homo sapiens
cattttggtttatt

SEQ ID NO: 4132514 - DNA, 14 bp, Homo sapiens
cattttgtgaatgg

SEQ ID NO: 4132515 - DNA, 21 bp, Homo sapiens
cattttgtgaatggattggat

SEQ ID NO: 4132516 - DNA, 23 bp, Homo sapiens
catttttaaagtagaagagggtt

SEQ ID NO: 4132517 - DNA, 23 bp, Homo sapiens
catttttaatttaacaaactaaa

SEQ ID NO: 4132518 - DNA, 16 bp, Homo sapiens
catttttagcctgtgt

SEQ ID NO: 4132519 - DNA, 12 bp, Homo sapiens
catttttatagc

SEQ ID NO: 4132520 - DNA, 15 bp, Homo sapiens
catttttatttatga

SEQ ID NO: 4132521 - DNA, 10 bp, Homo sapiens
catttttcaa

SEQ ID NO: 4132522 - DNA, 22 bp, Homo sapiens
catttttctcccaagaaacctg

SEQ ID NO: 4132523 - DNA, 19 bp, Homo sapiens
cattttttgctataatcat

SEQ ID NO: 4132524 - DNA, 18 bp, Homo sapiens
cattttttgggcagcaat

SEQ ID NO: 4132525 - DNA, 19 bp, Homo sapiens
cattttttgggcagcaatt

SEQ ID NO: 4132526 - DNA, 22 bp, Homo sapiens
cattttttgggcagcaatttaa

SEQ ID NO: 4132527 - DNA, 17 bp, Homo sapiens
catttttttattcagca

SEQ ID NO: 4132528 - DNA, 17 bp, Homo sapiens
cattttttttttaaatc

SEQ ID NO: 4132529 - DNA, 23 bp, Homo sapiens
ccaaaaaaaggaaaaataatcaa

SEQ ID NO: 4132530 - DNA, 17 bp, Homo sapiens
ccaaaaaaatccagaaa

SEQ ID NO: 4132531 - DNA, 12 bp, Homo sapiens
ccaaaaaactac

SEQ ID NO: 4132532 - DNA, 20 bp, Homo sapiens
ccaaaaaattctacaacaca

SEQ ID NO: 4132533 - DNA, 22 bp, Homo sapiens
ccaaaaaggttgctgtttcaca

SEQ ID NO: 4132534 - DNA, 23 bp, Homo sapiens
ccaaaaaggttgctgtttcacaa

SEQ ID NO: 4132535 - DNA, 14 bp, Homo sapiens
ccaaaaattattat

SEQ ID NO: 4132536 - DNA, 12 bp, Homo sapiens
ccaaaacaaaca

SEQ ID NO: 4132537 - DNA, 13 bp, Homo sapiens
ccaaaacacagga

SEQ ID NO: 4132538 - DNA, 16 bp, Homo sapiens
ccaaaaccaggcctct

SEQ ID NO: 4132539 - DNA, 22 bp, Homo sapiens
ccaaaacttctcttgaaaagtt

SEQ ID NO: 4132540 - DNA, 19 bp, Homo sapiens
ccaaaagtccctccctgcc

SEQ ID NO: 4132541 - DNA, 18 bp, Homo sapiens
ccaaaatattttttgcaa

SEQ ID NO: 4132542 - DNA, 20 bp, Homo sapiens
ccaaacaccttccagctcct

SEQ ID NO: 4132543 - DNA, 16 bp, Homo sapiens
ccaaacccatgaggca

SEQ ID NO: 4132544 - DNA, 16 bp, Homo sapiens
ccaaacccccattctg

SEQ ID NO: 4132545 - DNA, 17 bp, Homo sapiens
ccaaacccttgctttcc

SEQ ID NO: 4132546 - DNA, 21 bp, Homo sapiens
ccaaacctccagcctccctgt

SEQ ID NO: 4132547 - DNA, 15 bp, Homo sapiens
ccaaacctgacagat

SEQ ID NO: 4132548 - DNA, 22 bp, Homo sapiens
ccaaactgtccctcccttgctg

SEQ ID NO: 4132549 - DNA, 23 bp, Homo sapiens
ccaaactgtccctcccttgctga

SEQ ID NO: 4132550 - DNA, 16 bp, Homo sapiens
ccaaacttggattttt

SEQ ID NO: 4132551 - DNA, 16 bp, Homo sapiens
ccaaagaacttgattt

SEQ ID NO: 4132552 - DNA, 20 bp, Homo sapiens
ccaaagaacttgatttgcat

SEQ ID NO: 4132553 - DNA, 21 bp, Homo sapiens
ccaaagaacttgatttgcatg

SEQ ID NO: 4132554 - DNA, 14 bp, Homo sapiens
ccaaagaattctta

SEQ ID NO: 4132555 - DNA, 14 bp, Homo sapiens
ccaaagagcctgga

SEQ ID NO: 4132556 - DNA, 16 bp, Homo sapiens
ccaaagagcctggaga

SEQ ID NO: 4132557 - DNA, 12 bp, Homo sapiens
ccaaagaggctg

SEQ ID NO: 4132558 - DNA, 23 bp, Homo sapiens
ccaaagcagtggagcccaggagt

SEQ ID NO: 4132559 - DNA, 22 bp, Homo sapiens
ccaaagccagtgaaatgtgaag

SEQ ID NO: 4132560 - DNA, 19 bp, Homo sapiens
ccaaagctagggtggccct

SEQ ID NO: 4132561 - DNA, 23 bp, Homo sapiens
ccaaagctagggtggcccttgca

SEQ ID NO: 4132562 - DNA, 13 bp, Homo sapiens
ccaaagctggtct

SEQ ID NO: 4132563 - DNA, 16 bp, Homo sapiens
ccaaagctttcctgcc

SEQ ID NO: 4132564 - DNA, 17 bp, Homo sapiens
ccaaagctttcctgccc

SEQ ID NO: 4132565 - DNA, 20 bp, Homo sapiens
ccaaagctttcctgccccag

SEQ ID NO: 4132566 - DNA, 16 bp, Homo sapiens
ccaaaggaggctggca

SEQ ID NO: 4132567 - DNA, 17 bp, Homo sapiens
ccaaaggaggctggcag

SEQ ID NO: 4132568 - DNA, 18 bp, Homo sapiens
ccaaaggaggctggcagg

SEQ ID NO: 4132569 - DNA, 18 bp, Homo sapiens
ccaaaggcatcccagcct

SEQ ID NO: 4132570 - DNA, 12 bp, Homo sapiens
ccaaaggccccc

SEQ ID NO: 4132571 - DNA, 16 bp, Homo sapiens
ccaaaggctctctcct

SEQ ID NO: 4132572 - DNA, 13 bp, Homo sapiens
ccaaaggctggtg

SEQ ID NO: 4132573 - DNA, 16 bp, Homo sapiens
ccaaataagaaaccta

SEQ ID NO: 4132574 - DNA, 16 bp, Homo sapiens
ccaaatataagacatt

SEQ ID NO: 4132575 - DNA, 20 bp, Homo sapiens
ccaaatataagacatttgtt

SEQ ID NO: 4132576 - DNA, 18 bp, Homo sapiens
ccaaatatgtattttcct

SEQ ID NO: 4132577 - DNA, 13 bp, Homo sapiens
ccaaatatgtcct

SEQ ID NO: 4132578 - DNA, 15 bp, Homo sapiens
ccaaatatgtcctgg

SEQ ID NO: 4132579 - DNA, 17 bp, Homo sapiens
ccaaatcacatctcacc

SEQ ID NO: 4132580 - DNA, 16 bp, Homo sapiens
ccaaatgcaatttgat

SEQ ID NO: 4132581 - DNA, 22 bp, Homo sapiens
ccaaatgcatggtgcagttgac

SEQ ID NO: 4132582 - DNA, 17 bp, Homo sapiens
ccaaatgctggggcagg

SEQ ID NO: 4132583 - DNA, 18 bp, Homo sapiens
ccaaattcagtttcataa

SEQ ID NO: 4132584 - DNA, 15 bp, Homo sapiens
ccaaatttgattgat

SEQ ID NO: 4132585 - DNA, 16 bp, Homo sapiens
ccaacaaaccatccag

SEQ ID NO: 4132586 - DNA, 20 bp, Homo sapiens
ccaacaagaagaaatatgaa

SEQ ID NO: 4132587 - DNA, 19 bp, Homo sapiens
ccaacaagaataaaggcag

SEQ ID NO: 4132588 - DNA, 12 bp, Homo sapiens
ccaacaagaatg

SEQ ID NO: 4132589 - DNA, 21 bp, Homo sapiens
ccaacaagattgcttaataaa

SEQ ID NO: 4132590 - DNA, 23 bp, Homo sapiens
ccaacaaggttggcaccccagct

SEQ ID NO: 4132591 - DNA, 22 bp, Homo sapiens
ccaacaccaagcacagcagcct

SEQ ID NO: 4132592 - DNA, 18 bp, Homo sapiens
ccaacaccacagacacac

SEQ ID NO: 4132593 - DNA, 16 bp, Homo sapiens
ccaacacgcacctgcc

SEQ ID NO: 4132594 - DNA, 19 bp, Homo sapiens
ccaacaggtggcaggacca

SEQ ID NO: 4132595 - DNA, 13 bp, Homo sapiens
ccaacatcaacat

SEQ ID NO: 4132596 - DNA, 17 bp, Homo sapiens
ccaacatcgtgaaaccc

SEQ ID NO: 4132597 - DNA, 20 bp, Homo sapiens
ccaacatctttgcgaaaaga

SEQ ID NO: 4132598 - DNA, 16 bp, Homo sapiens
ccaaccacagagaaca

SEQ ID NO: 4132599 - DNA, 19 bp, Homo sapiens
ccaaccacagcatcgggag

SEQ ID NO: 4132600 - DNA, 21 bp, Homo sapiens
ccaaccacagcatcgggagca

SEQ ID NO: 4132601 - DNA, 23 bp, Homo sapiens
ccaaccaggagctgatggcagct

SEQ ID NO: 4132602 - DNA, 16 bp, Homo sapiens
ccaaccccaacaattg

SEQ ID NO: 4132603 - DNA, 14 bp, Homo sapiens
ccaaccctcccggg

SEQ ID NO: 4132604 - DNA, 17 bp, Homo sapiens
ccaaccctggcttgggg

SEQ ID NO: 4132605 - DNA, 17 bp, Homo sapiens
ccaaccctggggaagga

SEQ ID NO: 4132606 - DNA, 22 bp, Homo sapiens
ccaacctcggcttgtgggctgg

SEQ ID NO: 4132607 - DNA, 17 bp, Homo sapiens
ccaacctctttttcctc

SEQ ID NO: 4132608 - DNA, 21 bp, Homo sapiens
ccaacctctttttcctcctgg

SEQ ID NO: 4132609 - DNA, 17 bp, Homo sapiens
ccaacctgcaaagatct

SEQ ID NO: 4132610 - DNA, 12 bp, Homo sapiens
ccaaccttccca

SEQ ID NO: 4132611 - DNA, 15 bp, Homo sapiens
ccaacggccccagct

SEQ ID NO: 4132612 - DNA, 18 bp, Homo sapiens
ccaactactgagctgaga

SEQ ID NO: 4132613 - DNA, 15 bp, Homo sapiens
ccaactagcccctgg

SEQ ID NO: 4132614 - DNA, 15 bp, Homo sapiens
ccaactagctgggac

SEQ ID NO: 4132615 - DNA, 20 bp, Homo sapiens
ccaactccaggaaagagcag

SEQ ID NO: 4132616 - DNA, 19 bp, Homo sapiens
ccaacttctcttgctttct

SEQ ID NO: 4132617 - DNA, 19 bp, Homo sapiens
ccaacttgagggcccagag

SEQ ID NO: 4132618 - DNA, 20 bp, Homo sapiens
ccaacttgagggcccagagc

SEQ ID NO: 4132619 - DNA, 14 bp, Homo sapiens
ccaagaactgcatg

SEQ ID NO: 4132620 - DNA, 15 bp, Homo sapiens
ccaagaactgcatgg

SEQ ID NO: 4132621 - DNA, 15 bp, Homo sapiens
ccaagaatacttgaa

SEQ ID NO: 4132622 - DNA, 20 bp, Homo sapiens
ccaagaatagatgctgactg

SEQ ID NO: 4132623 - DNA, 23 bp, Homo sapiens
ccaagacagatgccccagagctg

SEQ ID NO: 4132624 - DNA, 12 bp, Homo sapiens
ccaagagaaggg

SEQ ID NO: 4132625 - DNA, 19 bp, Homo sapiens
ccaagagcagagtctgggc

SEQ ID NO: 4132626 - DNA, 16 bp, Homo sapiens
ccaagataggggcaca

SEQ ID NO: 4132627 - DNA, 16 bp, Homo sapiens
ccaagatcgcgccact

SEQ ID NO: 4132628 - DNA, 22 bp, Homo sapiens
ccaagattttcctcttgtgatt

SEQ ID NO: 4132629 - DNA, 10 bp, Homo sapiens
ccaagcaaac

SEQ ID NO: 4132630 - DNA, 14 bp, Homo sapiens
ccaagcaaaccaat

SEQ ID NO: 4132631 - DNA, 20 bp, Homo sapiens
ccaagcaaaggtgaagagac

SEQ ID NO: 4132632 - DNA, 17 bp, Homo sapiens
ccaagcaacatttgtat

SEQ ID NO: 4132633 - DNA, 22 bp, Homo sapiens
ccaagcaagtagctttccacat

SEQ ID NO: 4132634 - DNA, 14 bp, Homo sapiens
ccaagcacagagcc

SEQ ID NO: 4132635 - DNA, 19 bp, Homo sapiens
ccaagcactttcagtccaa

SEQ ID NO: 4132636 - DNA, 22 bp, Homo sapiens
ccaagcaggagacgacaggcga

SEQ ID NO: 4132637 - DNA, 15 bp, Homo sapiens
ccaagcagtggcctt

SEQ ID NO: 4132638 - DNA, 20 bp, Homo sapiens
ccaagcagtggcctttttct

SEQ ID NO: 4132639 - DNA, 23 bp, Homo sapiens
ccaagccgaccttccctccgcct

SEQ ID NO: 4132640 - DNA, 15 bp, Homo sapiens
ccaagccgtggcttc

SEQ ID NO: 4132641 - DNA, 21 bp, Homo sapiens
ccaagccgtggcttcccgctc

SEQ ID NO: 4132642 - DNA, 23 bp, Homo sapiens
ccaagccgtggcttcccgctcag

SEQ ID NO: 4132643 - DNA, 13 bp, Homo sapiens
ccaagcctgcctc

SEQ ID NO: 4132644 - DNA, 15 bp, Homo sapiens
ccaagctgagtttcc

SEQ ID NO: 4132645 - DNA, 16 bp, Homo sapiens
ccaagctgcctctggg

SEQ ID NO: 4132646 - DNA, 18 bp, Homo sapiens
ccaagcttaatagccctc

SEQ ID NO: 4132647 - DNA, 15 bp, Homo sapiens
ccaagctttcttcta

SEQ ID NO: 4132648 - DNA, 17 bp, Homo sapiens
ccaaggaaacgctacct

SEQ ID NO: 4132649 - DNA, 22 bp, Homo sapiens
ccaaggaaacgctacctctctg

SEQ ID NO: 4132650 - DNA, 13 bp, Homo sapiens
ccaaggaagcagc

SEQ ID NO: 4132651 - DNA, 21 bp, Homo sapiens
ccaaggaagcagcctcagagt

SEQ ID NO: 4132652 - DNA, 13 bp, Homo sapiens
ccaaggaccaggt

SEQ ID NO: 4132653 - DNA, 12 bp, Homo sapiens
ccaaggagacca

SEQ ID NO: 4132654 - DNA, 13 bp, Homo sapiens
ccaaggagaccaa

SEQ ID NO: 4132655 - DNA, 21 bp, Homo sapiens
ccaaggatcctctccactcca

SEQ ID NO: 4132656 - DNA, 20 bp, Homo sapiens
ccaaggatcggactctgccc

SEQ ID NO: 4132657 - DNA, 17 bp, Homo sapiens
ccaaggcctccctcagg

SEQ ID NO: 4132658 - DNA, 14 bp, Homo sapiens
ccaaggccttctcc

SEQ ID NO: 4132659 - DNA, 16 bp, Homo sapiens
ccaaggcggcccctcc

SEQ ID NO: 4132660 - DNA, 21 bp, Homo sapiens
ccaagggaaaggggtgctttt

SEQ ID NO: 4132661 - DNA, 17 bp, Homo sapiens
ccaagggcctcccacca

SEQ ID NO: 4132662 - DNA, 19 bp, Homo sapiens
ccaagggcctcccaccaga

SEQ ID NO: 4132663 - DNA, 20 bp, Homo sapiens
ccaagggcctcccaccagag

SEQ ID NO: 4132664 - DNA, 22 bp, Homo sapiens
ccaagggcctcccaccagagac

SEQ ID NO: 4132665 - DNA, 19 bp, Homo sapiens
ccaaggggtcccctccagg

SEQ ID NO: 4132666 - DNA, 17 bp, Homo sapiens
ccaagggttgagagcca

SEQ ID NO: 4132667 - DNA, 20 bp, Homo sapiens
ccaagggttgagagccagtg

SEQ ID NO: 4132668 - DNA, 15 bp, Homo sapiens
ccaaggtcctgctca

SEQ ID NO: 4132669 - DNA, 20 bp, Homo sapiens
ccaaggtgggtagatcacga

SEQ ID NO: 4132670 - DNA, 14 bp, Homo sapiens
ccaaggttctgggt

SEQ ID NO: 4132671 - DNA, 20 bp, Homo sapiens
ccaagtcacacccactccct

SEQ ID NO: 4132672 - DNA, 21 bp, Homo sapiens
ccaagtccgcagaagccctga

SEQ ID NO: 4132673 - DNA, 18 bp, Homo sapiens
ccaagtcggaacagcaga

SEQ ID NO: 4132674 - DNA, 19 bp, Homo sapiens
ccaagtcggaacagcagat

SEQ ID NO: 4132675 - DNA, 12 bp, Homo sapiens
ccaagtctctct

SEQ ID NO: 4132676 - DNA, 15 bp, Homo sapiens
ccaagtctctctgtg

SEQ ID NO: 4132677 - DNA, 17 bp, Homo sapiens
ccaagtctctctgtgaa

SEQ ID NO: 4132678 - DNA, 18 bp, Homo sapiens
ccaagtctctctgtgaat

SEQ ID NO: 4132679 - DNA, 14 bp, Homo sapiens
ccaagtgccccctc

SEQ ID NO: 4132680 - DNA, 20 bp, Homo sapiens
ccaagtgccccctcacctct

SEQ ID NO: 4132681 - DNA, 22 bp, Homo sapiens
ccaagtgccccctcacctctcc

SEQ ID NO: 4132682 - DNA, 13 bp, Homo sapiens
ccaagtgcgtgcc

SEQ ID NO: 4132683 - DNA, 22 bp, Homo sapiens
ccaagtggagcctgacagccag

SEQ ID NO: 4132684 - DNA, 23 bp, Homo sapiens
ccaagtggggatggggcctccct

SEQ ID NO: 4132685 - DNA, 15 bp, Homo sapiens
ccaagtggggtgctg

SEQ ID NO: 4132686 - DNA, 15 bp, Homo sapiens
ccaagttataaatca

SEQ ID NO: 4132687 - DNA, 19 bp, Homo sapiens
ccaagtttattcagtaaac

SEQ ID NO: 4132688 - DNA, 16 bp, Homo sapiens
ccaagtttccatagca

SEQ ID NO: 4132689 - DNA, 20 bp, Homo sapiens
ccaagtttccatagcaacag

SEQ ID NO: 4132690 - DNA, 13 bp, Homo sapiens
ccaataaaaacat

SEQ ID NO: 4132691 - DNA, 13 bp, Homo sapiens
ccaataaaaagtt

SEQ ID NO: 4132692 - DNA, 17 bp, Homo sapiens
ccaataaaaagttcaga

SEQ ID NO: 4132693 - DNA, 14 bp, Homo sapiens
ccaataaaagtgac

SEQ ID NO: 4132694 - DNA, 21 bp, Homo sapiens
ccaataaaagtgactctcagc

SEQ ID NO: 4132695 - DNA, 22 bp, Homo sapiens
ccaataaaagttttctccaact

SEQ ID NO: 4132696 - DNA, 23 bp, Homo sapiens
ccaataataaatgccctcttctc

SEQ ID NO: 4132697 - DNA, 15 bp, Homo sapiens
ccaatattaaatctg

SEQ ID NO: 4132698 - DNA, 12 bp, Homo sapiens
ccaatattataa

SEQ ID NO: 4132699 - DNA, 22 bp, Homo sapiens
ccaatcagtagcttaagaaaaa

SEQ ID NO: 4132700 - DNA, 17 bp, Homo sapiens
ccaatcccagggctggc

SEQ ID NO: 4132701 - DNA, 19 bp, Homo sapiens
ccaatcccagggctggctc

SEQ ID NO: 4132702 - DNA, 14 bp, Homo sapiens
ccaatcccgtgaaa

SEQ ID NO: 4132703 - DNA, 21 bp, Homo sapiens
ccaatctggcccttacacact

SEQ ID NO: 4132704 - DNA, 22 bp, Homo sapiens
ccaatctggcccttacacactc

SEQ ID NO: 4132705 - DNA, 24 bp, Homo sapiens
ccaatctggcccttacacactcag

SEQ ID NO: 4132706 - DNA, 21 bp, Homo sapiens
ccaatcttgttttaagcaaat

SEQ ID NO: 4132707 - DNA, 21 bp, Homo sapiens
ccaatgagactctagggtcca

SEQ ID NO: 4132708 - DNA, 14 bp, Homo sapiens
ccaatgcagaactc

SEQ ID NO: 4132709 - DNA, 15 bp, Homo sapiens
ccaatgtaggagctg

SEQ ID NO: 4132710 - DNA, 17 bp, Homo sapiens
ccaatgtaggagctgcc

SEQ ID NO: 4132711 - DNA, 20 bp, Homo sapiens
ccaatgtaggagctgccttg

SEQ ID NO: 4132712 - DNA, 15 bp, Homo sapiens
ccaattagtttcctt

SEQ ID NO: 4132713 - DNA, 20 bp, Homo sapiens
ccaattagtttcctttttaa

SEQ ID NO: 4132714 - DNA, 16 bp, Homo sapiens
ccaattcagacaggca

SEQ ID NO: 4132715 - DNA, 15 bp, Homo sapiens
ccaattgatgtatat

SEQ ID NO: 4132716 - DNA, 13 bp, Homo sapiens
ccaattgtgctgc

SEQ ID NO: 4132717 - DNA, 15 bp, Homo sapiens
ccaattgtgctgcca

SEQ ID NO: 4132718 - DNA, 16 bp, Homo sapiens
ccaattgtgctgccat

SEQ ID NO: 4132719 - DNA, 22 bp, Homo sapiens
ccaatttcccacccccacccac

SEQ ID NO: 4132720 - DNA, 15 bp, Homo sapiens
ccacaaaaaatactt

SEQ ID NO: 4132721 - DNA, 18 bp, Homo sapiens
ccacaaccctgttttata

SEQ ID NO: 4132722 - DNA, 19 bp, Homo sapiens
ccacaactcctacatgatg

SEQ ID NO: 4132723 - DNA, 16 bp, Homo sapiens
ccacaaggctggccag

SEQ ID NO: 4132724 - DNA, 23 bp, Homo sapiens
ccacaaggtccactccctgctcc

SEQ ID NO: 4132725 - DNA, 20 bp, Homo sapiens
ccacacaaggatagatgctg

SEQ ID NO: 4132726 - DNA, 12 bp, Homo sapiens
ccacacacacaa

SEQ ID NO: 4132727 - DNA, 15 bp, Homo sapiens
ccacacacgcaggaa

SEQ ID NO: 4132728 - DNA, 23 bp, Homo sapiens
ccacacacgcaggaactcccagc

SEQ ID NO: 4132729 - DNA, 17 bp, Homo sapiens
ccacacagctgccctag

SEQ ID NO: 4132730 - DNA, 19 bp, Homo sapiens
ccacacagctgccctagct

SEQ ID NO: 4132731 - DNA, 13 bp, Homo sapiens
ccacaccagcccc

SEQ ID NO: 4132732 - DNA, 14 bp, Homo sapiens
ccacaccagcccca

SEQ ID NO: 4132733 - DNA, 14 bp, Homo sapiens
ccacaccagccttg

SEQ ID NO: 4132734 - DNA, 14 bp, Homo sapiens
ccacaccccagccc

SEQ ID NO: 4132735 - DNA, 17 bp, Homo sapiens
ccacaccccagcccacc

SEQ ID NO: 4132736 - DNA, 21 bp, Homo sapiens
ccacaccctcccccgccactc

SEQ ID NO: 4132737 - DNA, 20 bp, Homo sapiens
ccacaccgtgtaaaccaaag

SEQ ID NO: 4132738 - DNA, 18 bp, Homo sapiens
ccacacctcagttccctt

SEQ ID NO: 4132739 - DNA, 19 bp, Homo sapiens
ccacacctgaacttgccta

SEQ ID NO: 4132740 - DNA, 21 bp, Homo sapiens
ccacaccttccagggccctag

SEQ ID NO: 4132741 - DNA, 22 bp, Homo sapiens
ccacaccttccagggccctagg

SEQ ID NO: 4132742 - DNA, 17 bp, Homo sapiens
ccacacgcactggtgcc

SEQ ID NO: 4132743 - DNA, 18 bp, Homo sapiens
ccacactattaccatgag

SEQ ID NO: 4132744 - DNA, 20 bp, Homo sapiens
ccacactattaccatgagaa

SEQ ID NO: 4132745 - DNA, 22 bp, Homo sapiens
ccacacttcaggctcttctcct

SEQ ID NO: 4132746 - DNA, 19 bp, Homo sapiens
ccacacttgagaggatgaa

SEQ ID NO: 4132747 - DNA, 13 bp, Homo sapiens
ccacacttgctgg

SEQ ID NO: 4132748 - DNA, 18 bp, Homo sapiens
ccacacttgctggggctc

SEQ ID NO: 4132749 - DNA, 23 bp, Homo sapiens
ccacagaaccttcaacccagtgg

SEQ ID NO: 4132750 - DNA, 12 bp, Homo sapiens
ccacagacacac

SEQ ID NO: 4132751 - DNA, 13 bp, Homo sapiens
ccacagacacaca

SEQ ID NO: 4132752 - DNA, 15 bp, Homo sapiens
ccacagacacacaca

SEQ ID NO: 4132753 - DNA, 20 bp, Homo sapiens
ccacagacacacacacgcac

SEQ ID NO: 4132754 - DNA, 14 bp, Homo sapiens
ccacagaccacctg

SEQ ID NO: 4132755 - DNA, 16 bp, Homo sapiens
ccacagagtgagccag

SEQ ID NO: 4132756 - DNA, 15 bp, Homo sapiens
ccacagatgtctctg

SEQ ID NO: 4132757 - DNA, 20 bp, Homo sapiens
ccacagcaaccccaggctga

SEQ ID NO: 4132758 - DNA, 21 bp, Homo sapiens
ccacagcaagtacagcggctc

SEQ ID NO: 4132759 - DNA, 12 bp, Homo sapiens
ccacagccagag

SEQ ID NO: 4132760 - DNA, 15 bp, Homo sapiens
ccacagccagaggag

SEQ ID NO: 4132761 - DNA, 17 bp, Homo sapiens
ccacagccagaggaggg

SEQ ID NO: 4132762 - DNA, 18 bp, Homo sapiens
ccacagcggaggagacca

SEQ ID NO: 4132763 - DNA, 20 bp, Homo sapiens
ccacagcggaggagaccagc

SEQ ID NO: 4132764 - DNA, 13 bp, Homo sapiens
ccacagctgctgt

SEQ ID NO: 4132765 - DNA, 23 bp, Homo sapiens
ccacagctgctgttctcaggaca

SEQ ID NO: 4132766 - DNA, 14 bp, Homo sapiens
ccacaggaaagtgt

SEQ ID NO: 4132767 - DNA, 19 bp, Homo sapiens
ccacaggcatctacacagc

SEQ ID NO: 4132768 - DNA, 18 bp, Homo sapiens
ccacaggcatgtcccatg

SEQ ID NO: 4132769 - DNA, 17 bp, Homo sapiens
ccacaggccgccctgcg

SEQ ID NO: 4132770 - DNA, 24 bp, Homo sapiens
ccacagggccagagggagctggaa

SEQ ID NO: 4132771 - DNA, 22 bp, Homo sapiens
ccacaggttcatgccaccatgg

SEQ ID NO: 4132772 - DNA, 20 bp, Homo sapiens
ccacagtagaactgtctgtg

SEQ ID NO: 4132773 - DNA, 12 bp, Homo sapiens
ccacagtgtctg

SEQ ID NO: 4132774 - DNA, 18 bp, Homo sapiens
ccacatacgcagggggaa

SEQ ID NO: 4132775 - DNA, 19 bp, Homo sapiens
ccacatagtgatggttccc

SEQ ID NO: 4132776 - DNA, 20 bp, Homo sapiens
ccacatccacacacgcagga

SEQ ID NO: 4132777 - DNA, 16 bp, Homo sapiens
ccacatccacagtctc

SEQ ID NO: 4132778 - DNA, 16 bp, Homo sapiens
ccacatcccagcagcc

SEQ ID NO: 4132779 - DNA, 13 bp, Homo sapiens
ccacatcccaggc

SEQ ID NO: 4132780 - DNA, 18 bp, Homo sapiens
ccacatcccaggcttcac

SEQ ID NO: 4132781 - DNA, 12 bp, Homo sapiens
ccacatctgcct

SEQ ID NO: 4132782 - DNA, 20 bp, Homo sapiens
ccacatgaggccatctcagg

SEQ ID NO: 4132783 - DNA, 22 bp, Homo sapiens
ccacatgaggccatctcaggag

SEQ ID NO: 4132784 - DNA, 17 bp, Homo sapiens
ccacatgccactgcctg

SEQ ID NO: 4132785 - DNA, 20 bp, Homo sapiens
ccacatttctgatcagaggt

SEQ ID NO: 4132786 - DNA, 21 bp, Homo sapiens
ccacatttctgatcagaggtg

SEQ ID NO: 4132787 - DNA, 19 bp, Homo sapiens
ccacatttggaatactttt

SEQ ID NO: 4132788 - DNA, 21 bp, Homo sapiens
ccaccaataaatcagaccatg

SEQ ID NO: 4132789 - DNA, 15 bp, Homo sapiens
ccaccacatctgcca

SEQ ID NO: 4132790 - DNA, 20 bp, Homo sapiens
ccaccacatctgccagacct

SEQ ID NO: 4132791 - DNA, 18 bp, Homo sapiens
ccaccacccgaaatgcca

SEQ ID NO: 4132792 - DNA, 15 bp, Homo sapiens
ccaccacctctgtgg

SEQ ID NO: 4132793 - DNA, 15 bp, Homo sapiens
ccaccagagactggg

SEQ ID NO: 4132794 - DNA, 13 bp, Homo sapiens
ccaccagcagcat

SEQ ID NO: 4132795 - DNA, 18 bp, Homo sapiens
ccaccagccacagcctcc

SEQ ID NO: 4132796 - DNA, 23 bp, Homo sapiens
ccaccagccacagcctccccacc

SEQ ID NO: 4132797 - DNA, 20 bp, Homo sapiens
ccaccagccatcctccctcc

SEQ ID NO: 4132798 - DNA, 17 bp, Homo sapiens
ccaccagccgccccagc

SEQ ID NO: 4132799 - DNA, 20 bp, Homo sapiens
ccaccagccgccccagcccc

SEQ ID NO: 4132800 - DNA, 13 bp, Homo sapiens
ccaccaggagaac

SEQ ID NO: 4132801 - DNA, 19 bp, Homo sapiens
ccaccaggagaaccactac

SEQ ID NO: 4132802 - DNA, 22 bp, Homo sapiens
ccaccaggcatccggcccttac

SEQ ID NO: 4132803 - DNA, 13 bp, Homo sapiens
ccaccaggtgtca

SEQ ID NO: 4132804 - DNA, 12 bp, Homo sapiens
ccaccagtgtcc

SEQ ID NO: 4132805 - DNA, 12 bp, Homo sapiens
ccaccatccctg

SEQ ID NO: 4132806 - DNA, 17 bp, Homo sapiens
ccaccatggccagccaa

SEQ ID NO: 4132807 - DNA, 17 bp, Homo sapiens
ccacccacacagctgcc

SEQ ID NO: 4132808 - DNA, 11 bp, Homo sapiens
ccacccacctc

SEQ ID NO: 4132809 - DNA, 13 bp, Homo sapiens
ccacccacctcca

SEQ ID NO: 4132810 - DNA, 12 bp, Homo sapiens
ccacccaggagg

SEQ ID NO: 4132811 - DNA, 23 bp, Homo sapiens
ccacccaggagggagggggctat

SEQ ID NO: 4132812 - DNA, 20 bp, Homo sapiens
ccacccaggatgacccctgg

SEQ ID NO: 4132813 - DNA, 23 bp, Homo sapiens
ccacccataatcctttctgccga

SEQ ID NO: 4132814 - DNA, 12 bp, Homo sapiens
ccaccccacact

SEQ ID NO: 4132815 - DNA, 14 bp, Homo sapiens
ccaccccagcctcg

SEQ ID NO: 4132816 - DNA, 13 bp, Homo sapiens
ccacccccagctc

SEQ ID NO: 4132817 - DNA, 15 bp, Homo sapiens
ccaccccctcaagcc

SEQ ID NO: 4132818 - DNA, 18 bp, Homo sapiens
ccaccccctgccctgcac

SEQ ID NO: 4132819 - DNA, 19 bp, Homo sapiens
ccacccccttctctgctcc

SEQ ID NO: 4132820 - DNA, 23 bp, Homo sapiens
ccacccccttctctgctccacca

SEQ ID NO: 4132821 - DNA, 18 bp, Homo sapiens
ccaccccgggctctctgc

SEQ ID NO: 4132822 - DNA, 19 bp, Homo sapiens
ccaccccggggaccctgtg

SEQ ID NO: 4132823 - DNA, 19 bp, Homo sapiens
ccacccctacacacacact

SEQ ID NO: 4132824 - DNA, 18 bp, Homo sapiens
ccacccctagccaccagt

SEQ ID NO: 4132825 - DNA, 20 bp, Homo sapiens
ccacccctagccaccagtgt

SEQ ID NO: 4132826 - DNA, 11 bp, Homo sapiens
ccacccctcac

SEQ ID NO: 4132827 - DNA, 13 bp, Homo sapiens
ccacccctcactc

SEQ ID NO: 4132828 - DNA, 12 bp, Homo sapiens
ccacccctccat

SEQ ID NO: 4132829 - DNA, 13 bp, Homo sapiens
ccacccctgcccc

SEQ ID NO: 4132830 - DNA, 21 bp, Homo sapiens
ccacccctggaagagcccagt

SEQ ID NO: 4132831 - DNA, 17 bp, Homo sapiens
ccacccgacctggctgc

SEQ ID NO: 4132832 - DNA, 19 bp, Homo sapiens
ccacccgtggtggctcaag

SEQ ID NO: 4132833 - DNA, 21 bp, Homo sapiens
ccacccgttctgctggcctgg

SEQ ID NO: 4132834 - DNA, 23 bp, Homo sapiens
ccaccctcacacacacagctggg

SEQ ID NO: 4132835 - DNA, 19 bp, Homo sapiens
ccaccctccaccttccatt

SEQ ID NO: 4132836 - DNA, 20 bp, Homo sapiens
ccaccctccctgactggcct

SEQ ID NO: 4132837 - DNA, 13 bp, Homo sapiens
ccaccctccctgg

SEQ ID NO: 4132838 - DNA, 17 bp, Homo sapiens
ccaccctccctggagtg

SEQ ID NO: 4132839 - DNA, 17 bp, Homo sapiens
ccaccctgctcctcctg

SEQ ID NO: 4132840 - DNA, 20 bp, Homo sapiens
ccaccctgctcctcctgccc

SEQ ID NO: 4132841 - DNA, 22 bp, Homo sapiens
ccaccctgctcctcctgccctg

SEQ ID NO: 4132842 - DNA, 21 bp, Homo sapiens
ccaccctggccgagtccaagc

SEQ ID NO: 4132843 - DNA, 17 bp, Homo sapiens
ccaccctgggagacaga

SEQ ID NO: 4132844 - DNA, 12 bp, Homo sapiens
ccaccctgtgcc

SEQ ID NO: 4132845 - DNA, 12 bp, Homo sapiens
ccacccttggcc

SEQ ID NO: 4132846 - DNA, 14 bp, Homo sapiens
ccacccttggcctg

SEQ ID NO: 4132847 - DNA, 15 bp, Homo sapiens
ccacccttggcctgt

SEQ ID NO: 4132848 - DNA, 16 bp, Homo sapiens
ccacccttggcctgtc

SEQ ID NO: 4132849 - DNA, 17 bp, Homo sapiens
ccacccttggcctgtct

SEQ ID NO: 4132850 - DNA, 19 bp, Homo sapiens
ccacccttggcctgtctca

SEQ ID NO: 4132851 - DNA, 15 bp, Homo sapiens
ccacccttgttccag

SEQ ID NO: 4132852 - DNA, 23 bp, Homo sapiens
ccaccgaagtggactggcccctg

SEQ ID NO: 4132853 - DNA, 18 bp, Homo sapiens
ccaccgaccaactgccct

SEQ ID NO: 4132854 - DNA, 15 bp, Homo sapiens
ccaccgatggagccc

SEQ ID NO: 4132855 - DNA, 14 bp, Homo sapiens
ccaccgctgccagc

SEQ ID NO: 4132856 - DNA, 15 bp, Homo sapiens
ccaccgctgccagca

SEQ ID NO: 4132857 - DNA, 16 bp, Homo sapiens
ccaccgctgccagcac

SEQ ID NO: 4132858 - DNA, 20 bp, Homo sapiens
ccaccgggagcctccccctc

SEQ ID NO: 4132859 - DNA, 18 bp, Homo sapiens
ccaccgtgaaccagaggg

SEQ ID NO: 4132860 - DNA, 17 bp, Homo sapiens
ccacctaatcaggctga

SEQ ID NO: 4132861 - DNA, 23 bp, Homo sapiens
ccacctaattcgatgaaggctgc

SEQ ID NO: 4132862 - DNA, 21 bp, Homo sapiens
ccacctagactgtaaacctct

SEQ ID NO: 4132863 - DNA, 14 bp, Homo sapiens
ccacctagcagcac

SEQ ID NO: 4132864 - DNA, 23 bp, Homo sapiens
ccacctagcagcaccgttctgtg

SEQ ID NO: 4132865 - DNA, 20 bp, Homo sapiens
ccacctatctcgtgggagag

SEQ ID NO: 4132866 - DNA, 21 bp, Homo sapiens
ccacctatctcgtgggagagc

SEQ ID NO: 4132867 - DNA, 16 bp, Homo sapiens
ccacctcaagaccccc

SEQ ID NO: 4132868 - DNA, 15 bp, Homo sapiens
ccacctcacccggcc

SEQ ID NO: 4132869 - DNA, 14 bp, Homo sapiens
ccacctcagggcac

SEQ ID NO: 4132870 - DNA, 20 bp, Homo sapiens
ccacctcagggcacgcagga

SEQ ID NO: 4132871 - DNA, 14 bp, Homo sapiens
ccacctccacccag

SEQ ID NO: 4132872 - DNA, 13 bp, Homo sapiens
ccacctccctcac

SEQ ID NO: 4132873 - DNA, 14 bp, Homo sapiens
ccacctcggtcact

SEQ ID NO: 4132874 - DNA, 13 bp, Homo sapiens
ccacctctccctc

SEQ ID NO: 4132875 - DNA, 14 bp, Homo sapiens
ccacctctctcctt

SEQ ID NO: 4132876 - DNA, 23 bp, Homo sapiens
ccacctgccttggcctcccaaag

SEQ ID NO: 4132877 - DNA, 11 bp, Homo sapiens
ccacctggcaa

SEQ ID NO: 4132878 - DNA, 23 bp, Homo sapiens
ccacctggcaaaggacccttgag

SEQ ID NO: 4132879 - DNA, 22 bp, Homo sapiens
ccacctgggcatatccaccacc

SEQ ID NO: 4132880 - DNA, 19 bp, Homo sapiens
ccacctgtagccatctgca

SEQ ID NO: 4132881 - DNA, 12 bp, Homo sapiens
ccacctgtctca

SEQ ID NO: 4132882 - DNA, 16 bp, Homo sapiens
ccacctgtctcagcct

SEQ ID NO: 4132883 - DNA, 23 bp, Homo sapiens
ccacctgtctcagcctcccagag

SEQ ID NO: 4132884 - DNA, 14 bp, Homo sapiens
ccaccttcaggccc

SEQ ID NO: 4132885 - DNA, 15 bp, Homo sapiens
ccaccttcaggcccc

SEQ ID NO: 4132886 - DNA, 18 bp, Homo sapiens
ccaccttctgtccccagc

SEQ ID NO: 4132887 - DNA, 21 bp, Homo sapiens
ccaccttctgtccccagccct

SEQ ID NO: 4132888 - DNA, 14 bp, Homo sapiens
ccaccttgatccca

SEQ ID NO: 4132889 - DNA, 15 bp, Homo sapiens
ccaccttggctctgc

SEQ ID NO: 4132890 - DNA, 18 bp, Homo sapiens
ccacgactggccagggcc

SEQ ID NO: 4132891 - DNA, 15 bp, Homo sapiens
ccacgagagcgcagc

SEQ ID NO: 4132892 - DNA, 19 bp, Homo sapiens
ccacgagggctggctggcc

SEQ ID NO: 4132893 - DNA, 13 bp, Homo sapiens
ccacgattggcca

SEQ ID NO: 4132894 - DNA, 13 bp, Homo sapiens
ccacgcactccat

SEQ ID NO: 4132895 - DNA, 13 bp, Homo sapiens
ccacgccccagcc

SEQ ID NO: 4132896 - DNA, 14 bp, Homo sapiens
ccacgccccagccc

SEQ ID NO: 4132897 - DNA, 15 bp, Homo sapiens
ccacgccccagcccg

SEQ ID NO: 4132898 - DNA, 17 bp, Homo sapiens
ccacgcctcctggccag

SEQ ID NO: 4132899 - DNA, 18 bp, Homo sapiens
ccacgcctcctggccaga

SEQ ID NO: 4132900 - DNA, 18 bp, Homo sapiens
ccacgcgggggccttgag

SEQ ID NO: 4132901 - DNA, 12 bp, Homo sapiens
ccacgctccagc

SEQ ID NO: 4132902 - DNA, 18 bp, Homo sapiens
ccacgctgtggccctgga

SEQ ID NO: 4132903 - DNA, 19 bp, Homo sapiens
ccacggaggagggatgctg

SEQ ID NO: 4132904 - DNA, 14 bp, Homo sapiens
ccacggctgagcct

SEQ ID NO: 4132905 - DNA, 14 bp, Homo sapiens
ccacgtcccagcat

SEQ ID NO: 4132906 - DNA, 15 bp, Homo sapiens
ccacgtcccagcatc

SEQ ID NO: 4132907 - DNA, 18 bp, Homo sapiens
ccacgtcccagcatccct

SEQ ID NO: 4132908 - DNA, 21 bp, Homo sapiens
ccacgtcccagcatccctgga

SEQ ID NO: 4132909 - DNA, 22 bp, Homo sapiens
ccacgtcccagcatccctggag

SEQ ID NO: 4132910 - DNA, 22 bp, Homo sapiens
ccacgtcctccaagctcacgac

SEQ ID NO: 4132911 - DNA, 15 bp, Homo sapiens
ccacgtctggccagg

SEQ ID NO: 4132912 - DNA, 17 bp, Homo sapiens
ccacgtctggccaggca

SEQ ID NO: 4132913 - DNA, 18 bp, Homo sapiens
ccacgtctggccaggcac

SEQ ID NO: 4132914 - DNA, 13 bp, Homo sapiens
ccacgtggtcact

SEQ ID NO: 4132915 - DNA, 20 bp, Homo sapiens
ccacgtggtcactgtgcact

SEQ ID NO: 4132916 - DNA, 22 bp, Homo sapiens
ccacgtggtcactgtgcactgc

SEQ ID NO: 4132917 - DNA, 16 bp, Homo sapiens
ccacgttccacagttg

SEQ ID NO: 4132918 - DNA, 20 bp, Homo sapiens
ccacgttccacagttgccac

SEQ ID NO: 4132919 - DNA, 13 bp, Homo sapiens
ccactaaagcttc

SEQ ID NO: 4132920 - DNA, 16 bp, Homo sapiens
ccactaaagcttcaga

SEQ ID NO: 4132921 - DNA, 18 bp, Homo sapiens
ccactaaagcttcagact

SEQ ID NO: 4132922 - DNA, 18 bp, Homo sapiens
ccactaaatgagctcctg

SEQ ID NO: 4132923 - DNA, 19 bp, Homo sapiens
ccactaaatgagctcctgc

SEQ ID NO: 4132924 - DNA, 21 bp, Homo sapiens
ccactaagaattcaaactggg

SEQ ID NO: 4132925 - DNA, 11 bp, Homo sapiens
ccactcacccc

SEQ ID NO: 4132926 - DNA, 15 bp, Homo sapiens
ccactcacccccttt

SEQ ID NO: 4132927 - DNA, 22 bp, Homo sapiens
ccactcaccccctttgctgtga

SEQ ID NO: 4132928 - DNA, 12 bp, Homo sapiens
ccactcaccccg

SEQ ID NO: 4132929 - DNA, 15 bp, Homo sapiens
ccactcagctgtcct

SEQ ID NO: 4132930 - DNA, 13 bp, Homo sapiens
ccactcaggaggc

SEQ ID NO: 4132931 - DNA, 19 bp, Homo sapiens
ccactcccccgtttctcct

SEQ ID NO: 4132932 - DNA, 22 bp, Homo sapiens
ccactcccccgtttctcctttt

SEQ ID NO: 4132933 - DNA, 14 bp, Homo sapiens
ccactccctgctcc

SEQ ID NO: 4132934 - DNA, 11 bp, Homo sapiens
ccactcctccc

SEQ ID NO: 4132935 - DNA, 13 bp, Homo sapiens
ccactcctccctc

SEQ ID NO: 4132936 - DNA, 16 bp, Homo sapiens
ccactcctgctctgct

SEQ ID NO: 4132937 - DNA, 14 bp, Homo sapiens
ccactcctgtacac

SEQ ID NO: 4132938 - DNA, 18 bp, Homo sapiens
ccactcgtgcatccctga

SEQ ID NO: 4132939 - DNA, 20 bp, Homo sapiens
ccactctaccctcccacccc

SEQ ID NO: 4132940 - DNA, 13 bp, Homo sapiens
ccactctccccac

SEQ ID NO: 4132941 - DNA, 15 bp, Homo sapiens
ccactctccccacac

SEQ ID NO: 4132942 - DNA, 14 bp, Homo sapiens
ccactctcttccct

SEQ ID NO: 4132943 - DNA, 15 bp, Homo sapiens
ccactctcttccctt

SEQ ID NO: 4132944 - DNA, 15 bp, Homo sapiens
ccactcttgatctct

SEQ ID NO: 4132945 - DNA, 17 bp, Homo sapiens
ccactcttgatctctct

SEQ ID NO: 4132946 - DNA, 18 bp, Homo sapiens
ccactcttgatctctctt

SEQ ID NO: 4132947 - DNA, 15 bp, Homo sapiens
ccactgacagcctcc

SEQ ID NO: 4132948 - DNA, 16 bp, Homo sapiens
ccactgacagcctccc

SEQ ID NO: 4132949 - DNA, 19 bp, Homo sapiens
ccactgacagcctcccacc

SEQ ID NO: 4132950 - DNA, 16 bp, Homo sapiens
ccactgagtaccaggg

SEQ ID NO: 4132951 - DNA, 19 bp, Homo sapiens
ccactgatgctgttctctt

SEQ ID NO: 4132952 - DNA, 18 bp, Homo sapiens
ccactgcaccgcctcagg

SEQ ID NO: 4132953 - DNA, 16 bp, Homo sapiens
ccactgcccgagctgg

SEQ ID NO: 4132954 - DNA, 18 bp, Homo sapiens
ccactgcccgagctggtg

SEQ ID NO: 4132955 - DNA, 18 bp, Homo sapiens
ccactgcctgcacctttc

SEQ ID NO: 4132956 - DNA, 21 bp, Homo sapiens
ccactgccttcgatacaccgg

SEQ ID NO: 4132957 - DNA, 23 bp, Homo sapiens
ccactgctcgaaatggcccctgt

SEQ ID NO: 4132958 - DNA, 15 bp, Homo sapiens
ccactgctggtgcca

SEQ ID NO: 4132959 - DNA, 19 bp, Homo sapiens
ccactgctggtgccagggt

SEQ ID NO: 4132960 - DNA, 21 bp, Homo sapiens
ccactgctggtgccagggtgg

SEQ ID NO: 4132961 - DNA, 24 bp, Homo sapiens
ccactggaaggaacatggagctgt

SEQ ID NO: 4132962 - DNA, 16 bp, Homo sapiens
ccactgggaccaaccc

SEQ ID NO: 4132963 - DNA, 23 bp, Homo sapiens
ccactgggaccaaccctggggaa

SEQ ID NO: 4132964 - DNA, 11 bp, Homo sapiens
ccactgggagg

SEQ ID NO: 4132965 - DNA, 17 bp, Homo sapiens
ccactgggcacacgcac

SEQ ID NO: 4132966 - DNA, 13 bp, Homo sapiens
ccactgggccagc

SEQ ID NO: 4132967 - DNA, 22 bp, Homo sapiens
ccactgggccagccctgcagcc

SEQ ID NO: 4132968 - DNA, 24 bp, Homo sapiens
ccactgggccagccctgcagccca

SEQ ID NO: 4132969 - DNA, 23 bp, Homo sapiens
ccactggggaggaatcctggacc

SEQ ID NO: 4132970 - DNA, 18 bp, Homo sapiens
ccactggtacttcctttc

SEQ ID NO: 4132971 - DNA, 20 bp, Homo sapiens
ccactgtaattaaaactatt

SEQ ID NO: 4132972 - DNA, 17 bp, Homo sapiens
ccactgtcaccctccac

SEQ ID NO: 4132973 - DNA, 19 bp, Homo sapiens
ccactgtcactgtttctct

SEQ ID NO: 4132974 - DNA, 21 bp, Homo sapiens
ccactgtccccctacccaccg

SEQ ID NO: 4132975 - DNA, 23 bp, Homo sapiens
ccacttcattcttgaaagctgtg

SEQ ID NO: 4132976 - DNA, 18 bp, Homo sapiens
ccacttccaggggaacct

SEQ ID NO: 4132977 - DNA, 16 bp, Homo sapiens
ccacttcctgctacag

SEQ ID NO: 4132978 - DNA, 17 bp, Homo sapiens
ccacttcctgctacagg

SEQ ID NO: 4132979 - DNA, 19 bp, Homo sapiens
ccacttcctgctacaggag

SEQ ID NO: 4132980 - DNA, 13 bp, Homo sapiens
ccacttctcccca

SEQ ID NO: 4132981 - DNA, 18 bp, Homo sapiens
ccacttcttcctttctct

SEQ ID NO: 4132982 - DNA, 19 bp, Homo sapiens
ccacttcttgttccccact

SEQ ID NO: 4132983 - DNA, 18 bp, Homo sapiens
ccacttgagtgtcaagct

SEQ ID NO: 4132984 - DNA, 21 bp, Homo sapiens
ccacttggaggcctttcatcc

SEQ ID NO: 4132985 - DNA, 15 bp, Homo sapiens
ccacttgtccgctgg

SEQ ID NO: 4132986 - DNA, 13 bp, Homo sapiens
ccactttgtccat

SEQ ID NO: 4132987 - DNA, 15 bp, Homo sapiens
ccagaaacagtggga

SEQ ID NO: 4132988 - DNA, 18 bp, Homo sapiens
ccagaaacgccacatccc

SEQ ID NO: 4132989 - DNA, 15 bp, Homo sapiens
ccagaaactcctgtt

SEQ ID NO: 4132990 - DNA, 20 bp, Homo sapiens
ccagaaaggatatttaagaa

SEQ ID NO: 4132991 - DNA, 22 bp, Homo sapiens
ccagaacaaggttccctctgag

SEQ ID NO: 4132992 - DNA, 19 bp, Homo sapiens
ccagaactcactggggcct

SEQ ID NO: 4132993 - DNA, 19 bp, Homo sapiens
ccagaactgcccccactgt

SEQ ID NO: 4132994 - DNA, 16 bp, Homo sapiens
ccagaagaatattcag

SEQ ID NO: 4132995 - DNA, 17 bp, Homo sapiens
ccagaagaatattcagg

SEQ ID NO: 4132996 - DNA, 19 bp, Homo sapiens
ccagaagaatattcaggac

SEQ ID NO: 4132997 - DNA, 18 bp, Homo sapiens
ccagaagatgccagcttc

SEQ ID NO: 4132998 - DNA, 19 bp, Homo sapiens
ccagaagatgccagcttct

SEQ ID NO: 4132999 - DNA, 19 bp, Homo sapiens
ccagaagcctctggctaga

SEQ ID NO: 4133000 - DNA, 20 bp, Homo sapiens
ccagaagcctctggctagag

SEQ ID NO: 4133001 - DNA, 14 bp, Homo sapiens
ccagaagccttgga

SEQ ID NO: 4133002 - DNA, 23 bp, Homo sapiens
ccagaagccttggaaccagcccc

SEQ ID NO: 4133003 - DNA, 18 bp, Homo sapiens
ccagaaggatccaagaca

SEQ ID NO: 4133004 - DNA, 17 bp, Homo sapiens
ccagaatactgggttct

SEQ ID NO: 4133005 - DNA, 17 bp, Homo sapiens
ccagaatcttgactttc

SEQ ID NO: 4133006 - DNA, 22 bp, Homo sapiens
ccagaatgctgaactccttgtt

SEQ ID NO: 4133007 - DNA, 16 bp, Homo sapiens
ccagaatgctgtacat

SEQ ID NO: 4133008 - DNA, 19 bp, Homo sapiens
ccagaatttaccatcatct

SEQ ID NO: 4133009 - DNA, 18 bp, Homo sapiens
ccagacacaaactgccaa

SEQ ID NO: 4133010 - DNA, 20 bp, Homo sapiens
ccagacagggtgggcttcct

SEQ ID NO: 4133011 - DNA, 20 bp, Homo sapiens
ccagacatgccacaaggact

SEQ ID NO: 4133012 - DNA, 14 bp, Homo sapiens
ccagaccccagggc

SEQ ID NO: 4133013 - DNA, 15 bp, Homo sapiens
ccagaccccagggca

SEQ ID NO: 4133014 - DNA, 18 bp, Homo sapiens
ccagacccctctggccag

SEQ ID NO: 4133015 - DNA, 19 bp, Homo sapiens
ccagacccctctggccagg

SEQ ID NO: 4133016 - DNA, 17 bp, Homo sapiens
ccagacccttcttgcct

SEQ ID NO: 4133017 - DNA, 21 bp, Homo sapiens
ccagacccttcttgcctgctg

SEQ ID NO: 4133018 - DNA, 22 bp, Homo sapiens
ccagacccttcttgcctgctgg

SEQ ID NO: 4133019 - DNA, 23 bp, Homo sapiens
ccagacccttcttgcctgctggg

SEQ ID NO: 4133020 - DNA, 18 bp, Homo sapiens
ccagacctagcaggctgt

SEQ ID NO: 4133021 - DNA, 22 bp, Homo sapiens
ccagacctagcaggctgttcca

SEQ ID NO: 4133022 - DNA, 16 bp, Homo sapiens
ccagacctgatcctgg

SEQ ID NO: 4133023 - DNA, 20 bp, Homo sapiens
ccagacctgatcctggaggc

SEQ ID NO: 4133024 - DNA, 21 bp, Homo sapiens
ccagacctgatcctggaggcc

SEQ ID NO: 4133025 - DNA, 20 bp, Homo sapiens
ccagacctggctccactctt

SEQ ID NO: 4133026 - DNA, 15 bp, Homo sapiens
ccagacgtcaggccc

SEQ ID NO: 4133027 - DNA, 21 bp, Homo sapiens
ccagactaaaggatccagaga

SEQ ID NO: 4133028 - DNA, 23 bp, Homo sapiens
ccagagaaaggggagcccactgt

SEQ ID NO: 4133029 - DNA, 22 bp, Homo sapiens
ccagagacatacttgaagggcc

SEQ ID NO: 4133030 - DNA, 23 bp, Homo sapiens
ccagagacatacttgaagggcca

SEQ ID NO: 4133031 - DNA, 18 bp, Homo sapiens
ccagagacgcccagcccc

SEQ ID NO: 4133032 - DNA, 19 bp, Homo sapiens
ccagagacgcccagcccca

SEQ ID NO: 4133033 - DNA, 19 bp, Homo sapiens
ccagagagaggatgtggaa

SEQ ID NO: 4133034 - DNA, 20 bp, Homo sapiens
ccagagagcaactctgagat

SEQ ID NO: 4133035 - DNA, 21 bp, Homo sapiens
ccagagagcaactctgagatc

SEQ ID NO: 4133036 - DNA, 16 bp, Homo sapiens
ccagagagcagctccc

SEQ ID NO: 4133037 - DNA, 18 bp, Homo sapiens
ccagagagcttaaattgt

SEQ ID NO: 4133038 - DNA, 13 bp, Homo sapiens
ccagagaggcact

SEQ ID NO: 4133039 - DNA, 19 bp, Homo sapiens
ccagagaggcactcagtga

SEQ ID NO: 4133040 - DNA, 16 bp, Homo sapiens
ccagagagtggctcct

SEQ ID NO: 4133041 - DNA, 18 bp, Homo sapiens
ccagagagtggctcctcc

SEQ ID NO: 4133042 - DNA, 16 bp, Homo sapiens
ccagagcagatgcaga

SEQ ID NO: 4133043 - DNA, 18 bp, Homo sapiens
ccagagcagatgcagaga

SEQ ID NO: 4133044 - DNA, 22 bp, Homo sapiens
ccagagcattacgtgagccagg

SEQ ID NO: 4133045 - DNA, 23 bp, Homo sapiens
ccagagcattccagtcaggctct

SEQ ID NO: 4133046 - DNA, 12 bp, Homo sapiens
ccagagccacct

SEQ ID NO: 4133047 - DNA, 17 bp, Homo sapiens
ccagagccagatgcagg

SEQ ID NO: 4133048 - DNA, 19 bp, Homo sapiens
ccagagccagatgcaggac

SEQ ID NO: 4133049 - DNA, 23 bp, Homo sapiens
ccagagccagatgcaggacagga

SEQ ID NO: 4133050 - DNA, 13 bp, Homo sapiens
ccagagcccagct

SEQ ID NO: 4133051 - DNA, 14 bp, Homo sapiens
ccagagcccagctc

SEQ ID NO: 4133052 - DNA, 15 bp, Homo sapiens
ccagagcccagctcc

SEQ ID NO: 4133053 - DNA, 17 bp, Homo sapiens
ccagagcccatgctcaa

SEQ ID NO: 4133054 - DNA, 15 bp, Homo sapiens
ccagagccccaagca

SEQ ID NO: 4133055 - DNA, 16 bp, Homo sapiens
ccagagccccaagcag

SEQ ID NO: 4133056 - DNA, 19 bp, Homo sapiens
ccagagcggaggctgtgtg

SEQ ID NO: 4133057 - DNA, 14 bp, Homo sapiens
ccagagctgggagg

SEQ ID NO: 4133058 - DNA, 14 bp, Homo sapiens
ccagaggaactgtc

SEQ ID NO: 4133059 - DNA, 20 bp, Homo sapiens
ccagaggaactgtccagaga

SEQ ID NO: 4133060 - DNA, 15 bp, Homo sapiens
ccagaggactcccaa

SEQ ID NO: 4133061 - DNA, 20 bp, Homo sapiens
ccagaggactcccaaccctg

SEQ ID NO: 4133062 - DNA, 21 bp, Homo sapiens
ccagaggccgaaggtgcctca

SEQ ID NO: 4133063 - DNA, 22 bp, Homo sapiens
ccagaggccgaaggtgcctcag

SEQ ID NO: 4133064 - DNA, 23 bp, Homo sapiens
ccagaggccgaaggtgcctcaga

SEQ ID NO: 4133065 - DNA, 15 bp, Homo sapiens
ccagaggctgggagt

SEQ ID NO: 4133066 - DNA, 18 bp, Homo sapiens
ccagagggagctggaacc

SEQ ID NO: 4133067 - DNA, 13 bp, Homo sapiens
ccagaggggaagg

SEQ ID NO: 4133068 - DNA, 23 bp, Homo sapiens
ccagaggggaaggagggtacagc

SEQ ID NO: 4133069 - DNA, 18 bp, Homo sapiens
ccagaggtaacagaacag

SEQ ID NO: 4133070 - DNA, 21 bp, Homo sapiens
ccagaggtattcctctcttaa

SEQ ID NO: 4133071 - DNA, 15 bp, Homo sapiens
ccagaggtcctccgt

SEQ ID NO: 4133072 - DNA, 23 bp, Homo sapiens
ccagaggtcctccgtagggtctt

SEQ ID NO: 4133073 - DNA, 18 bp, Homo sapiens
ccagagtgctgaaggaat

SEQ ID NO: 4133074 - DNA, 13 bp, Homo sapiens
ccagagtggccca

SEQ ID NO: 4133075 - DNA, 16 bp, Homo sapiens
ccagagtggcctggcc

SEQ ID NO: 4133076 - DNA, 19 bp, Homo sapiens
ccagagtggcctggccagg

SEQ ID NO: 4133077 - DNA, 21 bp, Homo sapiens
ccagagtggcctggccaggag

SEQ ID NO: 4133078 - DNA, 23 bp, Homo sapiens
ccagagtggcctggccaggagct

SEQ ID NO: 4133079 - DNA, 12 bp, Homo sapiens
ccagagtgtgaa

SEQ ID NO: 4133080 - DNA, 15 bp, Homo sapiens
ccagagttcttaaag

SEQ ID NO: 4133081 - DNA, 14 bp, Homo sapiens
ccagataagaatgc

SEQ ID NO: 4133082 - DNA, 13 bp, Homo sapiens
ccagatagagaaa

SEQ ID NO: 4133083 - DNA, 13 bp, Homo sapiens
ccagatcagccag

SEQ ID NO: 4133084 - DNA, 14 bp, Homo sapiens
ccagatcctcttgg

SEQ ID NO: 4133085 - DNA, 18 bp, Homo sapiens
ccagatgcacatccctgg

SEQ ID NO: 4133086 - DNA, 13 bp, Homo sapiens
ccagatgcaggac

SEQ ID NO: 4133087 - DNA, 15 bp, Homo sapiens
ccagatgcaggacag

SEQ ID NO: 4133088 - DNA, 16 bp, Homo sapiens
ccagatgcaggacagg

SEQ ID NO: 4133089 - DNA, 17 bp, Homo sapiens
ccagatgcaggacagga

SEQ ID NO: 4133090 - DNA, 15 bp, Homo sapiens
ccagatgcagggcag

SEQ ID NO: 4133091 - DNA, 16 bp, Homo sapiens
ccagatgggccacggc

SEQ ID NO: 4133092 - DNA, 17 bp, Homo sapiens
ccagatgtttccagact

SEQ ID NO: 4133093 - DNA, 23 bp, Homo sapiens
ccagatgtttccagacttccttg

SEQ ID NO: 4133094 - DNA, 19 bp, Homo sapiens
ccagattattggctgcttt

SEQ ID NO: 4133095 - DNA, 19 bp, Homo sapiens
ccagattgacgacaagtgc

SEQ ID NO: 4133096 - DNA, 18 bp, Homo sapiens
ccagcaacgcccctccaa

SEQ ID NO: 4133097 - DNA, 22 bp, Homo sapiens
ccagcaacgcccctccaaacct

SEQ ID NO: 4133098 - DNA, 21 bp, Homo sapiens
ccagcaacttgtctttttctg

SEQ ID NO: 4133099 - DNA, 17 bp, Homo sapiens
ccagcaagcgggagccc

SEQ ID NO: 4133100 - DNA, 14 bp, Homo sapiens
ccagcaataagaaa

SEQ ID NO: 4133101 - DNA, 21 bp, Homo sapiens
ccagcaatgacatctcagggg

SEQ ID NO: 4133102 - DNA, 19 bp, Homo sapiens
ccagcacagcttagatttc

SEQ ID NO: 4133103 - DNA, 22 bp, Homo sapiens
ccagcacagcttagatttcata

SEQ ID NO: 4133104 - DNA, 20 bp, Homo sapiens
ccagcaccaccctccttccc

SEQ ID NO: 4133105 - DNA, 23 bp, Homo sapiens
ccagcaccctctcctgggggtgg

SEQ ID NO: 4133106 - DNA, 16 bp, Homo sapiens
ccagcacctgcctcct

SEQ ID NO: 4133107 - DNA, 17 bp, Homo sapiens
ccagcacctgcctcctc

SEQ ID NO: 4133108 - DNA, 15 bp, Homo sapiens
ccagcactgtctcag

SEQ ID NO: 4133109 - DNA, 12 bp, Homo sapiens
ccagcactgtga

SEQ ID NO: 4133110 - DNA, 18 bp, Homo sapiens
ccagcactgtgaagaccc

SEQ ID NO: 4133111 - DNA, 20 bp, Homo sapiens
ccagcactgtgaagacccag

SEQ ID NO: 4133112 - DNA, 19 bp, Homo sapiens
ccagcacttgtccagctga

SEQ ID NO: 4133113 - DNA, 11 bp, Homo sapiens
ccagcactttg

SEQ ID NO: 4133114 - DNA, 17 bp, Homo sapiens
ccagcactttgggaggc

SEQ ID NO: 4133115 - DNA, 12 bp, Homo sapiens
ccagcagcatgg

SEQ ID NO: 4133116 - DNA, 22 bp, Homo sapiens
ccagcagccccgtctgcccacc

SEQ ID NO: 4133117 - DNA, 23 bp, Homo sapiens
ccagcagccccgtctgcccacca

SEQ ID NO: 4133118 - DNA, 13 bp, Homo sapiens
ccagcagccctca

SEQ ID NO: 4133119 - DNA, 23 bp, Homo sapiens
ccagcaggagagactgagcagcc

SEQ ID NO: 4133120 - DNA, 21 bp, Homo sapiens
ccagcagggggagaaaccctt

SEQ ID NO: 4133121 - DNA, 18 bp, Homo sapiens
ccagcaggtgctgacttc

SEQ ID NO: 4133122 - DNA, 21 bp, Homo sapiens
ccagcagtgtggagaccctgc

SEQ ID NO: 4133123 - DNA, 14 bp, Homo sapiens
ccagcatcactccc

SEQ ID NO: 4133124 - DNA, 16 bp, Homo sapiens
ccagcatcactcccca

SEQ ID NO: 4133125 - DNA, 23 bp, Homo sapiens
ccagcatccaccttggctctgcc

SEQ ID NO: 4133126 - DNA, 15 bp, Homo sapiens
ccagcatccctggag

SEQ ID NO: 4133127 - DNA, 14 bp, Homo sapiens
ccagcatctggaag

SEQ ID NO: 4133128 - DNA, 20 bp, Homo sapiens
ccagccacagcctccccacc

SEQ ID NO: 4133129 - DNA, 22 bp, Homo sapiens
ccagccaccccgggctctctgc

SEQ ID NO: 4133130 - DNA, 21 bp, Homo sapiens
ccagccactcgggaggctgag

SEQ ID NO: 4133131 - DNA, 16 bp, Homo sapiens
ccagccagcagcagcc

SEQ ID NO: 4133132 - DNA, 17 bp, Homo sapiens
ccagccaggccaacagc

SEQ ID NO: 4133133 - DNA, 18 bp, Homo sapiens
ccagccatcaaaatgctt

SEQ ID NO: 4133134 - DNA, 12 bp, Homo sapiens
ccagcccacatt

SEQ ID NO: 4133135 - DNA, 22 bp, Homo sapiens
ccagcccaccctgctcctcctg

SEQ ID NO: 4133136 - DNA, 13 bp, Homo sapiens
ccagcccagagac

SEQ ID NO: 4133137 - DNA, 16 bp, Homo sapiens
ccagcccagagccacc

SEQ ID NO: 4133138 - DNA, 17 bp, Homo sapiens
ccagcccagagccacct

SEQ ID NO: 4133139 - DNA, 20 bp, Homo sapiens
ccagcccagagccacctgga

SEQ ID NO: 4133140 - DNA, 13 bp, Homo sapiens
ccagcccagaggc

SEQ ID NO: 4133141 - DNA, 21 bp, Homo sapiens
ccagcccagattcccctgtgt

SEQ ID NO: 4133142 - DNA, 21 bp, Homo sapiens
ccagccccacacagctacagc

SEQ ID NO: 4133143 - DNA, 15 bp, Homo sapiens
ccagccccacccagg

SEQ ID NO: 4133144 - DNA, 16 bp, Homo sapiens
ccagccccacccagga

SEQ ID NO: 4133145 - DNA, 23 bp, Homo sapiens
ccagccccatcagaacctgagct

SEQ ID NO: 4133146 - DNA, 14 bp, Homo sapiens
ccagccccatccct

SEQ ID NO: 4133147 - DNA, 15 bp, Homo sapiens
ccagccccatccctg

SEQ ID NO: 4133148 - DNA, 21 bp, Homo sapiens
ccagccccggcaagccacagg

SEQ ID NO: 4133149 - DNA, 18 bp, Homo sapiens
ccagccccggtggctggg

SEQ ID NO: 4133150 - DNA, 17 bp, Homo sapiens
ccagcccctcccccatc

SEQ ID NO: 4133151 - DNA, 18 bp, Homo sapiens
ccagcccctcccccatct

SEQ ID NO: 4133152 - DNA, 21 bp, Homo sapiens
ccagcccctcccccatctccc

SEQ ID NO: 4133153 - DNA, 17 bp, Homo sapiens
ccagcccctcttcccca

SEQ ID NO: 4133154 - DNA, 15 bp, Homo sapiens
ccagcccctggggcc

SEQ ID NO: 4133155 - DNA, 22 bp, Homo sapiens
ccagcccctgtttactggttct

SEQ ID NO: 4133156 - DNA, 17 bp, Homo sapiens
ccagcccggcctgctcc

SEQ ID NO: 4133157 - DNA, 19 bp, Homo sapiens
ccagcccggcctgctccca

SEQ ID NO: 4133158 - DNA, 14 bp, Homo sapiens
ccagccctccccat

SEQ ID NO: 4133159 - DNA, 20 bp, Homo sapiens
ccagccctccccatggagcc

SEQ ID NO: 4133160 - DNA, 12 bp, Homo sapiens
ccagccctgtcc

SEQ ID NO: 4133161 - DNA, 13 bp, Homo sapiens
ccagcccttcctc

SEQ ID NO: 4133162 - DNA, 17 bp, Homo sapiens
ccagcccttcctctgct

SEQ ID NO: 4133163 - DNA, 14 bp, Homo sapiens
ccagccgccctggg

SEQ ID NO: 4133164 - DNA, 16 bp, Homo sapiens
ccagccgccctgggct

SEQ ID NO: 4133165 - DNA, 16 bp, Homo sapiens
ccagccgggagcttgg

SEQ ID NO: 4133166 - DNA, 11 bp, Homo sapiens
ccagcctccct

SEQ ID NO: 4133167 - DNA, 18 bp, Homo sapiens
ccagcctccctgtctcca

SEQ ID NO: 4133168 - DNA, 21 bp, Homo sapiens
ccagcctccctgtctccagct

SEQ ID NO: 4133169 - DNA, 21 bp, Homo sapiens
ccagcctccgagagggagaga

SEQ ID NO: 4133170 - DNA, 13 bp, Homo sapiens
ccagcctcctctg

SEQ ID NO: 4133171 - DNA, 16 bp, Homo sapiens
ccagcctcgcctgtca

SEQ ID NO: 4133172 - DNA, 20 bp, Homo sapiens
ccagcctgcccaagcccagg

SEQ ID NO: 4133173 - DNA, 22 bp, Homo sapiens
ccagcctgcccaagcccaggcc

SEQ ID NO: 4133174 - DNA, 21 bp, Homo sapiens
ccagcctggaaacctgtctga

SEQ ID NO: 4133175 - DNA, 19 bp, Homo sapiens
ccagcctgggagcccagag

SEQ ID NO: 4133176 - DNA, 16 bp, Homo sapiens
ccagcctgggcagcca

SEQ ID NO: 4133177 - DNA, 18 bp, Homo sapiens
ccagcctgggcagccagg

SEQ ID NO: 4133178 - DNA, 13 bp, Homo sapiens
ccagcctggggtc

SEQ ID NO: 4133179 - DNA, 19 bp, Homo sapiens
ccagcctgtggttacagtg

SEQ ID NO: 4133180 - DNA, 21 bp, Homo sapiens
ccagcctgtggttacagtgca

SEQ ID NO: 4133181 - DNA, 10 bp, Homo sapiens
ccagccttgt

SEQ ID NO: 4133182 - DNA, 13 bp, Homo sapiens
ccagcgcggccag

SEQ ID NO: 4133183 - DNA, 15 bp, Homo sapiens
ccagcgcggccagcg

SEQ ID NO: 4133184 - DNA, 21 bp, Homo sapiens
ccagcgcggccagcgtcccag

SEQ ID NO: 4133185 - DNA, 15 bp, Homo sapiens
ccagcgctgacgtgt

SEQ ID NO: 4133186 - DNA, 17 bp, Homo sapiens
ccagcgggcacagggca

SEQ ID NO: 4133187 - DNA, 18 bp, Homo sapiens
ccagcgggcacagggcac

SEQ ID NO: 4133188 - DNA, 20 bp, Homo sapiens
ccagcgggcacagggcacca

SEQ ID NO: 4133189 - DNA, 21 bp, Homo sapiens
ccagcgggcacagggcaccag

SEQ ID NO: 4133190 - DNA, 14 bp, Homo sapiens
ccagcgtcccaggg

SEQ ID NO: 4133191 - DNA, 17 bp, Homo sapiens
ccagcgtcccagggtac

SEQ ID NO: 4133192 - DNA, 22 bp, Homo sapiens
ccagcgtcccagtctctggcag

SEQ ID NO: 4133193 - DNA, 15 bp, Homo sapiens
ccagctaagaacctg

SEQ ID NO: 4133194 - DNA, 23 bp, Homo sapiens
ccagctaaggacatttcccaggg

SEQ ID NO: 4133195 - DNA, 16 bp, Homo sapiens
ccagctaccctttttc

SEQ ID NO: 4133196 - DNA, 22 bp, Homo sapiens
ccagctaccctttttctccagc

SEQ ID NO: 4133197 - DNA, 15 bp, Homo sapiens
ccagctacttcctcc

SEQ ID NO: 4133198 - DNA, 16 bp, Homo sapiens
ccagctacttgggagg

SEQ ID NO: 4133199 - DNA, 21 bp, Homo sapiens
ccagctatctgtcatctctct

SEQ ID NO: 4133200 - DNA, 17 bp, Homo sapiens
ccagctcaatggactgg

SEQ ID NO: 4133201 - DNA, 17 bp, Homo sapiens
ccagctcagaggcccag

SEQ ID NO: 4133202 - DNA, 13 bp, Homo sapiens
ccagctcaggaca

SEQ ID NO: 4133203 - DNA, 15 bp, Homo sapiens
ccagctcagtcccat

SEQ ID NO: 4133204 - DNA, 17 bp, Homo sapiens
ccagctcatctccaagg

SEQ ID NO: 4133205 - DNA, 21 bp, Homo sapiens
ccagctcatctccaaggatcc

SEQ ID NO: 4133206 - DNA, 22 bp, Homo sapiens
ccagctccaaggggaatcagaa

SEQ ID NO: 4133207 - DNA, 14 bp, Homo sapiens
ccagctccaggggc

SEQ ID NO: 4133208 - DNA, 21 bp, Homo sapiens
ccagctccaggggcccttggg

SEQ ID NO: 4133209 - DNA, 15 bp, Homo sapiens
ccagctccctagact

SEQ ID NO: 4133210 - DNA, 17 bp, Homo sapiens
ccagctccctagactgc

SEQ ID NO: 4133211 - DNA, 16 bp, Homo sapiens
ccagctccctctattt

SEQ ID NO: 4133212 - DNA, 18 bp, Homo sapiens
ccagctccggcctgtcct

SEQ ID NO: 4133213 - DNA, 17 bp, Homo sapiens
ccagctcgcacccccct

SEQ ID NO: 4133214 - DNA, 20 bp, Homo sapiens
ccagctcgtttttcagcacc

SEQ ID NO: 4133215 - DNA, 22 bp, Homo sapiens
ccagctctgagacccttttctc

SEQ ID NO: 4133216 - DNA, 20 bp, Homo sapiens
ccagctgactgtggccccct

SEQ ID NO: 4133217 - DNA, 20 bp, Homo sapiens
ccagctgagcgccaggatgg

SEQ ID NO: 4133218 - DNA, 13 bp, Homo sapiens
ccagctgcaccag

SEQ ID NO: 4133219 - DNA, 16 bp, Homo sapiens
ccagctgcaccagagc

SEQ ID NO: 4133220 - DNA, 13 bp, Homo sapiens
ccagctgcactga

SEQ ID NO: 4133221 - DNA, 14 bp, Homo sapiens
ccagctgcactgat

SEQ ID NO: 4133222 - DNA, 18 bp, Homo sapiens
ccagctgcagccccttgc

SEQ ID NO: 4133223 - DNA, 23 bp, Homo sapiens
ccagctgcaggaatcaaaaattg

SEQ ID NO: 4133224 - DNA, 20 bp, Homo sapiens
ccagctgccctatgggcctg

SEQ ID NO: 4133225 - DNA, 18 bp, Homo sapiens
ccagctgcctggagaggg

SEQ ID NO: 4133226 - DNA, 22 bp, Homo sapiens
ccagctgcctggagagggtctc

SEQ ID NO: 4133227 - DNA, 16 bp, Homo sapiens
ccagctgcctgggccc

SEQ ID NO: 4133228 - DNA, 19 bp, Homo sapiens
ccagctgctgtcttctgga

SEQ ID NO: 4133229 - DNA, 20 bp, Homo sapiens
ccagctggggccagaggctg

SEQ ID NO: 4133230 - DNA, 21 bp, Homo sapiens
ccagctggggccagaggctgg

SEQ ID NO: 4133231 - DNA, 14 bp, Homo sapiens
ccagctgtgtcctt

SEQ ID NO: 4133232 - DNA, 19 bp, Homo sapiens
ccagctgtgtccttcgggg

SEQ ID NO: 4133233 - DNA, 22 bp, Homo sapiens
ccagctgtgtccttcgggggcg

SEQ ID NO: 4133234 - DNA, 19 bp, Homo sapiens
ccagcttaaatcctagcag

SEQ ID NO: 4133235 - DNA, 19 bp, Homo sapiens
ccagcttcacttctgactc

SEQ ID NO: 4133236 - DNA, 15 bp, Homo sapiens
ccagcttcaggcacc

SEQ ID NO: 4133237 - DNA, 17 bp, Homo sapiens
ccagcttgttatttata

SEQ ID NO: 4133238 - DNA, 16 bp, Homo sapiens
ccagcttttcattgct

SEQ ID NO: 4133239 - DNA, 18 bp, Homo sapiens
ccagcttttcctcccttg

SEQ ID NO: 4133240 - DNA, 16 bp, Homo sapiens
ccaggaaagagcagtc

SEQ ID NO: 4133241 - DNA, 20 bp, Homo sapiens
ccaggaactcgcacctgtgc

SEQ ID NO: 4133242 - DNA, 21 bp, Homo sapiens
ccaggaactcgcacctgtgct

SEQ ID NO: 4133243 - DNA, 14 bp, Homo sapiens
ccaggaagaagcag

SEQ ID NO: 4133244 - DNA, 17 bp, Homo sapiens
ccaggaagaagcagggg

SEQ ID NO: 4133245 - DNA, 21 bp, Homo sapiens
ccaggaagggggtccacccag

SEQ ID NO: 4133246 - DNA, 22 bp, Homo sapiens
ccaggaagggggtccacccagc

SEQ ID NO: 4133247 - DNA, 17 bp, Homo sapiens
ccaggaaggtagcccag

SEQ ID NO: 4133248 - DNA, 18 bp, Homo sapiens
ccaggaaggtagcccagc

SEQ ID NO: 4133249 - DNA, 23 bp, Homo sapiens
ccaggaaggtagcccagcactgt

SEQ ID NO: 4133250 - DNA, 17 bp, Homo sapiens
ccaggaatttcccagga

SEQ ID NO: 4133251 - DNA, 18 bp, Homo sapiens
ccaggaatttcccaggac

SEQ ID NO: 4133252 - DNA, 20 bp, Homo sapiens
ccaggaatttcccaggaccc

SEQ ID NO: 4133253 - DNA, 23 bp, Homo sapiens
ccaggaatttcccaggaccctga

SEQ ID NO: 4133254 - DNA, 21 bp, Homo sapiens
ccaggacaccagtccaggtag

SEQ ID NO: 4133255 - DNA, 13 bp, Homo sapiens
ccaggaccagctc

SEQ ID NO: 4133256 - DNA, 15 bp, Homo sapiens
ccaggaccagctcag

SEQ ID NO: 4133257 - DNA, 17 bp, Homo sapiens
ccaggacctggctgcca

SEQ ID NO: 4133258 - DNA, 18 bp, Homo sapiens
ccaggacctggctgccat

SEQ ID NO: 4133259 - DNA, 20 bp, Homo sapiens
ccaggacgcttctgaatgct

SEQ ID NO: 4133260 - DNA, 20 bp, Homo sapiens
ccaggactatatttgggcct

SEQ ID NO: 4133261 - DNA, 17 bp, Homo sapiens
ccaggactccccaggcc

SEQ ID NO: 4133262 - DNA, 22 bp, Homo sapiens
ccaggactccccaggccaggcc

SEQ ID NO: 4133263 - DNA, 14 bp, Homo sapiens
ccaggactccctcc

SEQ ID NO: 4133264 - DNA, 23 bp, Homo sapiens
ccaggactccctcctcacctctg

SEQ ID NO: 4133265 - DNA, 17 bp, Homo sapiens
ccaggacttggggtcag

SEQ ID NO: 4133266 - DNA, 15 bp, Homo sapiens
ccaggagacagacca

SEQ ID NO: 4133267 - DNA, 17 bp, Homo sapiens
ccaggagatgggtccag

SEQ ID NO: 4133268 - DNA, 18 bp, Homo sapiens
ccaggagatgggtccagg

SEQ ID NO: 4133269 - DNA, 15 bp, Homo sapiens
ccaggagcaatggga

SEQ ID NO: 4133270 - DNA, 20 bp, Homo sapiens
ccaggagcaatgggactgga

SEQ ID NO: 4133271 - DNA, 22 bp, Homo sapiens
ccaggagcaggacctactagga

SEQ ID NO: 4133272 - DNA, 21 bp, Homo sapiens
ccaggagctcttcaggcctcc

SEQ ID NO: 4133273 - DNA, 19 bp, Homo sapiens
ccaggagctgatggcagct

SEQ ID NO: 4133274 - DNA, 23 bp, Homo sapiens
ccaggagctgtcaccaaggaaac

SEQ ID NO: 4133275 - DNA, 22 bp, Homo sapiens
ccaggaggtgggagtgaggagc

SEQ ID NO: 4133276 - DNA, 21 bp, Homo sapiens
ccaggagtgtggccacgtggg

SEQ ID NO: 4133277 - DNA, 20 bp, Homo sapiens
ccaggagttcgaggctgcag

SEQ ID NO: 4133278 - DNA, 14 bp, Homo sapiens
ccaggataaggaga

SEQ ID NO: 4133279 - DNA, 14 bp, Homo sapiens
ccaggatggagggg

SEQ ID NO: 4133280 - DNA, 20 bp, Homo sapiens
ccaggatggcccttcccact

SEQ ID NO: 4133281 - DNA, 22 bp, Homo sapiens
ccaggatggtctcgatctcctg

SEQ ID NO: 4133282 - DNA, 23 bp, Homo sapiens
ccaggatggtctcgatctcctga

SEQ ID NO: 4133283 - DNA, 16 bp, Homo sapiens
ccaggatttattttga

SEQ ID NO: 4133284 - DNA, 23 bp, Homo sapiens
ccaggattttaacaaaagcaaga

SEQ ID NO: 4133285 - DNA, 16 bp, Homo sapiens
ccaggcacagctgagt

SEQ ID NO: 4133286 - DNA, 23 bp, Homo sapiens
ccaggcacagctgagttatgatg

SEQ ID NO: 4133287 - DNA, 13 bp, Homo sapiens
ccaggcacagggc

SEQ ID NO: 4133288 - DNA, 14 bp, Homo sapiens
ccaggcacagggcc

SEQ ID NO: 4133289 - DNA, 15 bp, Homo sapiens
ccaggcacagggccc

SEQ ID NO: 4133290 - DNA, 18 bp, Homo sapiens
ccaggcacagggcccgca

SEQ ID NO: 4133291 - DNA, 21 bp, Homo sapiens
ccaggcaccccctggagagaa

SEQ ID NO: 4133292 - DNA, 16 bp, Homo sapiens
ccaggcaccctcaggg

SEQ ID NO: 4133293 - DNA, 17 bp, Homo sapiens
ccaggcaccctcaggga

SEQ ID NO: 4133294 - DNA, 15 bp, Homo sapiens
ccaggcagatccagg

SEQ ID NO: 4133295 - DNA, 18 bp, Homo sapiens
ccaggcagatccaggact

SEQ ID NO: 4133296 - DNA, 18 bp, Homo sapiens
ccaggcagatctgtgccc

SEQ ID NO: 4133297 - DNA, 21 bp, Homo sapiens
ccaggcagatctgtgccccat

SEQ ID NO: 4133298 - DNA, 21 bp, Homo sapiens
ccaggcatgaaattcttccta

SEQ ID NO: 4133299 - DNA, 16 bp, Homo sapiens
ccaggccaacagcacc

SEQ ID NO: 4133300 - DNA, 17 bp, Homo sapiens
ccaggccaacagcacct

SEQ ID NO: 4133301 - DNA, 18 bp, Homo sapiens
ccaggccaacagcacctc

SEQ ID NO: 4133302 - DNA, 14 bp, Homo sapiens
ccaggccaccagga

SEQ ID NO: 4133303 - DNA, 16 bp, Homo sapiens
ccaggccagcctccga

SEQ ID NO: 4133304 - DNA, 14 bp, Homo sapiens
ccaggcccaaggct

SEQ ID NO: 4133305 - DNA, 19 bp, Homo sapiens
ccaggcccaggcctcacca

SEQ ID NO: 4133306 - DNA, 13 bp, Homo sapiens
ccaggccccagac

SEQ ID NO: 4133307 - DNA, 16 bp, Homo sapiens
ccaggcccccctgtca

SEQ ID NO: 4133308 - DNA, 17 bp, Homo sapiens
ccaggccccctgcatct

SEQ ID NO: 4133309 - DNA, 24 bp, Homo sapiens
ccaggcccgcaccccggcctcagg

SEQ ID NO: 4133310 - DNA, 17 bp, Homo sapiens
ccaggccctccctgact

SEQ ID NO: 4133311 - DNA, 18 bp, Homo sapiens
ccaggccctcctctccca

SEQ ID NO: 4133312 - DNA, 14 bp, Homo sapiens
ccaggccctgagag

SEQ ID NO: 4133313 - DNA, 15 bp, Homo sapiens
ccaggccctgagagt

SEQ ID NO: 4133314 - DNA, 14 bp, Homo sapiens
ccaggccggcccag

SEQ ID NO: 4133315 - DNA, 21 bp, Homo sapiens
ccaggcctctagttccagaag

SEQ ID NO: 4133316 - DNA, 13 bp, Homo sapiens
ccaggcctctgct

SEQ ID NO: 4133317 - DNA, 15 bp, Homo sapiens
ccaggcctctgctgc

SEQ ID NO: 4133318 - DNA, 18 bp, Homo sapiens
ccaggcctgcagcaggag

SEQ ID NO: 4133319 - DNA, 16 bp, Homo sapiens
ccaggcctgcctccca

SEQ ID NO: 4133320 - DNA, 12 bp, Homo sapiens
ccaggcctgggt

SEQ ID NO: 4133321 - DNA, 13 bp, Homo sapiens
ccaggcctgttgc

SEQ ID NO: 4133322 - DNA, 13 bp, Homo sapiens
ccaggccttgtcc

SEQ ID NO: 4133323 - DNA, 16 bp, Homo sapiens
ccaggcgctagcacag

SEQ ID NO: 4133324 - DNA, 22 bp, Homo sapiens
ccaggctctttggggtcagcca

SEQ ID NO: 4133325 - DNA, 20 bp, Homo sapiens
ccaggctgaagcaggttccc

SEQ ID NO: 4133326 - DNA, 16 bp, Homo sapiens
ccaggctgaccacagc

SEQ ID NO: 4133327 - DNA, 17 bp, Homo sapiens
ccaggctgaccacagca

SEQ ID NO: 4133328 - DNA, 21 bp, Homo sapiens
ccaggctgagtgagccacaga

SEQ ID NO: 4133329 - DNA, 18 bp, Homo sapiens
ccaggctggacatgctga

SEQ ID NO: 4133330 - DNA, 15 bp, Homo sapiens
ccaggctggagaccc

SEQ ID NO: 4133331 - DNA, 14 bp, Homo sapiens
ccaggctggtctca

SEQ ID NO: 4133332 - DNA, 15 bp, Homo sapiens
ccaggctggtctcaa

SEQ ID NO: 4133333 - DNA, 23 bp, Homo sapiens
ccaggctgtgggtagatgtgcaa

SEQ ID NO: 4133334 - DNA, 16 bp, Homo sapiens
ccaggctgttctccag

SEQ ID NO: 4133335 - DNA, 16 bp, Homo sapiens
ccaggcttcaccctga

SEQ ID NO: 4133336 - DNA, 17 bp, Homo sapiens
ccagggaagagaaagtg

SEQ ID NO: 4133337 - DNA, 17 bp, Homo sapiens
ccagggaagctggccga

SEQ ID NO: 4133338 - DNA, 18 bp, Homo sapiens
ccagggacagaggcccca

SEQ ID NO: 4133339 - DNA, 20 bp, Homo sapiens
ccagggacagaggccccagc

SEQ ID NO: 4133340 - DNA, 21 bp, Homo sapiens
ccagggacagaggccccagcc

SEQ ID NO: 4133341 - DNA, 17 bp, Homo sapiens
ccagggactatctttgc

SEQ ID NO: 4133342 - DNA, 13 bp, Homo sapiens
ccagggagaagct

SEQ ID NO: 4133343 - DNA, 14 bp, Homo sapiens
ccagggagaagctc

SEQ ID NO: 4133344 - DNA, 13 bp, Homo sapiens
ccagggagaccga

SEQ ID NO: 4133345 - DNA, 13 bp, Homo sapiens
ccagggagccttt

SEQ ID NO: 4133346 - DNA, 14 bp, Homo sapiens
ccagggagcctttg

SEQ ID NO: 4133347 - DNA, 16 bp, Homo sapiens
ccagggagctctgggg

SEQ ID NO: 4133348 - DNA, 18 bp, Homo sapiens
ccagggagctctggggac

SEQ ID NO: 4133349 - DNA, 19 bp, Homo sapiens
ccagggagggaagtgtgag

SEQ ID NO: 4133350 - DNA, 20 bp, Homo sapiens
ccagggagggaagtgtgagc

SEQ ID NO: 4133351 - DNA, 12 bp, Homo sapiens
ccagggatgctg

SEQ ID NO: 4133352 - DNA, 17 bp, Homo sapiens
ccagggatgggggatgg

SEQ ID NO: 4133353 - DNA, 21 bp, Homo sapiens
ccagggcaagggttaaggcct

SEQ ID NO: 4133354 - DNA, 23 bp, Homo sapiens
ccagggcaagggttaaggcctga

SEQ ID NO: 4133355 - DNA, 23 bp, Homo sapiens
ccagggcaccctgtggccctggc

SEQ ID NO: 4133356 - DNA, 21 bp, Homo sapiens
ccagggcagggtgggcagcct

SEQ ID NO: 4133357 - DNA, 21 bp, Homo sapiens
ccagggcatcttgctggctac

SEQ ID NO: 4133358 - DNA, 22 bp, Homo sapiens
ccagggcattcgggccacaggg

SEQ ID NO: 4133359 - DNA, 13 bp, Homo sapiens
ccagggccaaaag

SEQ ID NO: 4133360 - DNA, 12 bp, Homo sapiens
ccagggccaggg

SEQ ID NO: 4133361 - DNA, 12 bp, Homo sapiens
ccagggcccacc

SEQ ID NO: 4133362 - DNA, 21 bp, Homo sapiens
ccagggcccctcaccctgcct

SEQ ID NO: 4133363 - DNA, 18 bp, Homo sapiens
ccagggccctaggcccct

SEQ ID NO: 4133364 - DNA, 14 bp, Homo sapiens
ccagggccctggcc

SEQ ID NO: 4133365 - DNA, 14 bp, Homo sapiens
ccagggcctccagg

SEQ ID NO: 4133366 - DNA, 16 bp, Homo sapiens
ccagggcctccagggc

SEQ ID NO: 4133367 - DNA, 12 bp, Homo sapiens
ccagggcctgac

SEQ ID NO: 4133368 - DNA, 15 bp, Homo sapiens
ccagggctgccctga

SEQ ID NO: 4133369 - DNA, 16 bp, Homo sapiens
ccagggctgccctgag

SEQ ID NO: 4133370 - DNA, 21 bp, Homo sapiens
ccagggctgccctgagaagct

SEQ ID NO: 4133371 - DNA, 23 bp, Homo sapiens
ccagggctgccctgagaagctgc

SEQ ID NO: 4133372 - DNA, 12 bp, Homo sapiens
ccagggctggct

SEQ ID NO: 4133373 - DNA, 15 bp, Homo sapiens
ccagggctggctctg

SEQ ID NO: 4133374 - DNA, 12 bp, Homo sapiens
ccagggctgggg

SEQ ID NO: 4133375 - DNA, 13 bp, Homo sapiens
ccagggctgggga

SEQ ID NO: 4133376 - DNA, 18 bp, Homo sapiens
ccagggctggggacagag

SEQ ID NO: 4133377 - DNA, 22 bp, Homo sapiens
ccagggctggggcagcctctgg

SEQ ID NO: 4133378 - DNA, 12 bp, Homo sapiens
ccaggggaacct

SEQ ID NO: 4133379 - DNA, 13 bp, Homo sapiens
ccaggggaacctg

SEQ ID NO: 4133380 - DNA, 17 bp, Homo sapiens
ccaggggaacctgccat

SEQ ID NO: 4133381 - DNA, 14 bp, Homo sapiens
ccaggggaaggccc

SEQ ID NO: 4133382 - DNA, 12 bp, Homo sapiens
ccaggggcagga

SEQ ID NO: 4133383 - DNA, 13 bp, Homo sapiens
ccaggggcaggac

SEQ ID NO: 4133384 - DNA, 14 bp, Homo sapiens
ccaggggcaggact

SEQ ID NO: 4133385 - DNA, 16 bp, Homo sapiens
ccaggggcaggactga

SEQ ID NO: 4133386 - DNA, 19 bp, Homo sapiens
ccaggggcccaaggcggcc

SEQ ID NO: 4133387 - DNA, 22 bp, Homo sapiens
ccaggggcccaaggcggcccct

SEQ ID NO: 4133388 - DNA, 22 bp, Homo sapiens
ccaggggcccttgggacagcca

SEQ ID NO: 4133389 - DNA, 23 bp, Homo sapiens
ccaggggctgggctccctgatga

SEQ ID NO: 4133390 - DNA, 17 bp, Homo sapiens
ccaggggggtgaggagc

SEQ ID NO: 4133391 - DNA, 19 bp, Homo sapiens
ccaggggggtgaggagctg

SEQ ID NO: 4133392 - DNA, 23 bp, Homo sapiens
ccagggtacccgcctgagctcct

SEQ ID NO: 4133393 - DNA, 22 bp, Homo sapiens
ccagggtctgtgtgaatgtggg

SEQ ID NO: 4133394 - DNA, 23 bp, Homo sapiens
ccagggtcttccctacctcaggc

SEQ ID NO: 4133395 - DNA, 15 bp, Homo sapiens
ccagggtgagagctg

SEQ ID NO: 4133396 - DNA, 22 bp, Homo sapiens
ccagggtgagagctgctctgga

SEQ ID NO: 4133397 - DNA, 23 bp, Homo sapiens
ccagggtgagagctgctctggaa

SEQ ID NO: 4133398 - DNA, 22 bp, Homo sapiens
ccagggtgcccagaacttccct

SEQ ID NO: 4133399 - DNA, 22 bp, Homo sapiens
ccagggttgatcacactctggg

SEQ ID NO: 4133400 - DNA, 14 bp, Homo sapiens
ccagggtttctctg

SEQ ID NO: 4133401 - DNA, 15 bp, Homo sapiens
ccagggtttctctgc

SEQ ID NO: 4133402 - DNA, 18 bp, Homo sapiens
ccaggtaatgagggactg

SEQ ID NO: 4133403 - DNA, 19 bp, Homo sapiens
ccaggtaccacccttcaga

SEQ ID NO: 4133404 - DNA, 22 bp, Homo sapiens
ccaggtaccacccttcagaccc

SEQ ID NO: 4133405 - DNA, 18 bp, Homo sapiens
ccaggtaccagctgcgct

SEQ ID NO: 4133406 - DNA, 17 bp, Homo sapiens
ccaggtagaacgccagg

SEQ ID NO: 4133407 - DNA, 15 bp, Homo sapiens
ccaggtatctccagg

SEQ ID NO: 4133408 - DNA, 18 bp, Homo sapiens
ccaggtatctccaggatt

SEQ ID NO: 4133409 - DNA, 13 bp, Homo sapiens
ccaggtcctctga

SEQ ID NO: 4133410 - DNA, 23 bp, Homo sapiens
ccaggtctacccctcccggccct

SEQ ID NO: 4133411 - DNA, 15 bp, Homo sapiens
ccaggtctcacgggc

SEQ ID NO: 4133412 - DNA, 22 bp, Homo sapiens
ccaggtgcatgcatgccctctc

SEQ ID NO: 4133413 - DNA, 19 bp, Homo sapiens
ccaggtggaaggcagacag

SEQ ID NO: 4133414 - DNA, 20 bp, Homo sapiens
ccaggtggaaggcagacagc

SEQ ID NO: 4133415 - DNA, 17 bp, Homo sapiens
ccaggtggagggcacag

SEQ ID NO: 4133416 - DNA, 14 bp, Homo sapiens
ccaggtgtgcctgg

SEQ ID NO: 4133417 - DNA, 17 bp, Homo sapiens
ccaggtgttactgtaat

SEQ ID NO: 4133418 - DNA, 16 bp, Homo sapiens
ccaggttcccccagca

SEQ ID NO: 4133419 - DNA, 13 bp, Homo sapiens
ccaggttgaaaga

SEQ ID NO: 4133420 - DNA, 23 bp, Homo sapiens
ccaggttttgcactcttgtttct

SEQ ID NO: 4133421 - DNA, 20 bp, Homo sapiens
ccaggttttgttccgcccag

SEQ ID NO: 4133422 - DNA, 20 bp, Homo sapiens
ccagtaacacaggccaccct

SEQ ID NO: 4133423 - DNA, 20 bp, Homo sapiens
ccagtaacgcgtcttcctga

SEQ ID NO: 4133424 - DNA, 21 bp, Homo sapiens
ccagtaagtttcccctctggc

SEQ ID NO: 4133425 - DNA, 22 bp, Homo sapiens
ccagtaagtttcccctctggct

SEQ ID NO: 4133426 - DNA, 23 bp, Homo sapiens
ccagtacctgggtccccagccct

SEQ ID NO: 4133427 - DNA, 17 bp, Homo sapiens
ccagtagttataaagtc

SEQ ID NO: 4133428 - DNA, 13 bp, Homo sapiens
ccagtatcgctca

SEQ ID NO: 4133429 - DNA, 16 bp, Homo sapiens
ccagtattgccccctc

SEQ ID NO: 4133430 - DNA, 13 bp, Homo sapiens
ccagtcacatgac

SEQ ID NO: 4133431 - DNA, 17 bp, Homo sapiens
ccagtcaggctgcagag

SEQ ID NO: 4133432 - DNA, 17 bp, Homo sapiens
ccagtccccacccctgc

SEQ ID NO: 4133433 - DNA, 19 bp, Homo sapiens
ccagtccccatttctgcct

SEQ ID NO: 4133434 - DNA, 20 bp, Homo sapiens
ccagtccccatttctgcctc

SEQ ID NO: 4133435 - DNA, 21 bp, Homo sapiens
ccagtccccatttctgcctcg

SEQ ID NO: 4133436 - DNA, 18 bp, Homo sapiens
ccagtcctccagaccacc

SEQ ID NO: 4133437 - DNA, 19 bp, Homo sapiens
ccagtcctccagaccacca

SEQ ID NO: 4133438 - DNA, 16 bp, Homo sapiens
ccagtcctgcctggcc

SEQ ID NO: 4133439 - DNA, 11 bp, Homo sapiens
ccagtcctgct

SEQ ID NO: 4133440 - DNA, 21 bp, Homo sapiens
ccagtcctgctacctcccttg

SEQ ID NO: 4133441 - DNA, 13 bp, Homo sapiens
ccagtctcccagg

SEQ ID NO: 4133442 - DNA, 22 bp, Homo sapiens
ccagtctcccaggccccctgca

SEQ ID NO: 4133443 - DNA, 16 bp, Homo sapiens
ccagtctgggctgccg

SEQ ID NO: 4133444 - DNA, 16 bp, Homo sapiens
ccagtgaaatgtgaag

SEQ ID NO: 4133445 - DNA, 17 bp, Homo sapiens
ccagtgaactcctgcca

SEQ ID NO: 4133446 - DNA, 12 bp, Homo sapiens
ccagtgaagcct

SEQ ID NO: 4133447 - DNA, 20 bp, Homo sapiens
ccagtgaattcttgaaggaa

SEQ ID NO: 4133448 - DNA, 20 bp, Homo sapiens
ccagtgacacttcagagagc

SEQ ID NO: 4133449 - DNA, 23 bp, Homo sapiens
ccagtgacacttcagagagctgg

SEQ ID NO: 4133450 - DNA, 19 bp, Homo sapiens
ccagtgacagacaggctct

SEQ ID NO: 4133451 - DNA, 13 bp, Homo sapiens
ccagtgagactgt

SEQ ID NO: 4133452 - DNA, 17 bp, Homo sapiens
ccagtgcagccactggc

SEQ ID NO: 4133453 - DNA, 21 bp, Homo sapiens
ccagtgccattccactccact

SEQ ID NO: 4133454 - DNA, 19 bp, Homo sapiens
ccagtgcggttcctcatct

SEQ ID NO: 4133455 - DNA, 22 bp, Homo sapiens
ccagtgctcaccagccctgcag

SEQ ID NO: 4133456 - DNA, 18 bp, Homo sapiens
ccagtggatcccctgcgg

SEQ ID NO: 4133457 - DNA, 21 bp, Homo sapiens
ccagtggccactcagcttcct

SEQ ID NO: 4133458 - DNA, 22 bp, Homo sapiens
ccagtggcgggtgatggccagc

SEQ ID NO: 4133459 - DNA, 12 bp, Homo sapiens
ccagtgggacag

SEQ ID NO: 4133460 - DNA, 23 bp, Homo sapiens
ccagtgggaccacatgccactgc

SEQ ID NO: 4133461 - DNA, 21 bp, Homo sapiens
ccagtgggatgggacagggag

SEQ ID NO: 4133462 - DNA, 18 bp, Homo sapiens
ccagtggggaactgaggg

SEQ ID NO: 4133463 - DNA, 23 bp, Homo sapiens
ccagtggggaactgagggcaagg

SEQ ID NO: 4133464 - DNA, 12 bp, Homo sapiens
ccagtgtacata

SEQ ID NO: 4133465 - DNA, 18 bp, Homo sapiens
ccagtgtatcaggtcagg

SEQ ID NO: 4133466 - DNA, 22 bp, Homo sapiens
ccagtgtcacctctctcagagc

SEQ ID NO: 4133467 - DNA, 14 bp, Homo sapiens
ccagtgtcccctcc

SEQ ID NO: 4133468 - DNA, 12 bp, Homo sapiens
ccagtgtcctcc

SEQ ID NO: 4133469 - DNA, 14 bp, Homo sapiens
ccagtgtctgggtt

SEQ ID NO: 4133470 - DNA, 20 bp, Homo sapiens
ccagtgttgtttgtaaataa

SEQ ID NO: 4133471 - DNA, 22 bp, Homo sapiens
ccagtgttgtttgtaaataaga

SEQ ID NO: 4133472 - DNA, 17 bp, Homo sapiens
ccagttatgtgaatgat

SEQ ID NO: 4133473 - DNA, 13 bp, Homo sapiens
ccagttcaccctg

SEQ ID NO: 4133474 - DNA, 21 bp, Homo sapiens
ccagttcagacactaccccat

SEQ ID NO: 4133475 - DNA, 18 bp, Homo sapiens
ccagttcaggagtcccaa

SEQ ID NO: 4133476 - DNA, 21 bp, Homo sapiens
ccagttcctgtaacaggtgtg

SEQ ID NO: 4133477 - DNA, 14 bp, Homo sapiens
ccagttgcctttta

SEQ ID NO: 4133478 - DNA, 20 bp, Homo sapiens
ccagttgggagcactggagt

SEQ ID NO: 4133479 - DNA, 21 bp, Homo sapiens
ccagttggggaagccaggtga

SEQ ID NO: 4133480 - DNA, 21 bp, Homo sapiens
ccagtttcaggtgtttagttg

SEQ ID NO: 4133481 - DNA, 14 bp, Homo sapiens
ccagttttcatttt

SEQ ID NO: 4133482 - DNA, 23 bp, Homo sapiens
ccataatgctaatttaaagagac

SEQ ID NO: 4133483 - DNA, 17 bp, Homo sapiens
ccataattttcttcatg

SEQ ID NO: 4133484 - DNA, 23 bp, Homo sapiens
ccataattttcttcatgcaatga

SEQ ID NO: 4133485 - DNA, 15 bp, Homo sapiens
ccatacacagaggag

SEQ ID NO: 4133486 - DNA, 17 bp, Homo sapiens
ccatacactttgttgca

SEQ ID NO: 4133487 - DNA, 20 bp, Homo sapiens
ccatacactttgttgcaaga

SEQ ID NO: 4133488 - DNA, 19 bp, Homo sapiens
ccatactccttgcttcctg

SEQ ID NO: 4133489 - DNA, 17 bp, Homo sapiens
ccatacttatctctctg

SEQ ID NO: 4133490 - DNA, 19 bp, Homo sapiens
ccatagaccctgaggccct

SEQ ID NO: 4133491 - DNA, 15 bp, Homo sapiens
ccatagctgtggtgt

SEQ ID NO: 4133492 - DNA, 12 bp, Homo sapiens
ccataggccctt

SEQ ID NO: 4133493 - DNA, 14 bp, Homo sapiens
ccataggccctttc

SEQ ID NO: 4133494 - DNA, 14 bp, Homo sapiens
ccatatgaattgta

SEQ ID NO: 4133495 - DNA, 14 bp, Homo sapiens
ccatatttggaaga

SEQ ID NO: 4133496 - DNA, 16 bp, Homo sapiens
ccatcaaaatgctttt

SEQ ID NO: 4133497 - DNA, 20 bp, Homo sapiens
ccatcaagaacctacagact

SEQ ID NO: 4133498 - DNA, 17 bp, Homo sapiens
ccatcaccataacctct

SEQ ID NO: 4133499 - DNA, 24 bp, Homo sapiens
ccatcagctgtaagaagagactgg

SEQ ID NO: 4133500 - DNA, 21 bp, Homo sapiens
ccatcagggatctcagaggct

SEQ ID NO: 4133501 - DNA, 23 bp, Homo sapiens
ccatcatcctttgttctgagcat

SEQ ID NO: 4133502 - DNA, 12 bp, Homo sapiens
ccatcatctctg

SEQ ID NO: 4133503 - DNA, 19 bp, Homo sapiens
ccatcattacccttccctg

SEQ ID NO: 4133504 - DNA, 18 bp, Homo sapiens
ccatcattccttctggcc

SEQ ID NO: 4133505 - DNA, 14 bp, Homo sapiens
ccatcattttacag

SEQ ID NO: 4133506 - DNA, 22 bp, Homo sapiens
ccatccaaacactgaggcagcc

SEQ ID NO: 4133507 - DNA, 18 bp, Homo sapiens
ccatccagtgacaaacca

SEQ ID NO: 4133508 - DNA, 17 bp, Homo sapiens
ccatccattaggccagc

SEQ ID NO: 4133509 - DNA, 12 bp, Homo sapiens
ccatcccacacc

SEQ ID NO: 4133510 - DNA, 14 bp, Homo sapiens
ccatccccaccagc

SEQ ID NO: 4133511 - DNA, 13 bp, Homo sapiens
ccatcccctggac

SEQ ID NO: 4133512 - DNA, 12 bp, Homo sapiens
ccatccctcggg

SEQ ID NO: 4133513 - DNA, 19 bp, Homo sapiens
ccatccctgccacatacag

SEQ ID NO: 4133514 - DNA, 12 bp, Homo sapiens
ccatccctgggc

SEQ ID NO: 4133515 - DNA, 18 bp, Homo sapiens
ccatccctgggcccctcc

SEQ ID NO: 4133516 - DNA, 13 bp, Homo sapiens
ccatccctgtcct

SEQ ID NO: 4133517 - DNA, 14 bp, Homo sapiens
ccatccctgtcctc

SEQ ID NO: 4133518 - DNA, 13 bp, Homo sapiens
ccatcccttcctg

SEQ ID NO: 4133519 - DNA, 23 bp, Homo sapiens
ccatccggtggcctattccagga

SEQ ID NO: 4133520 - DNA, 18 bp, Homo sapiens
ccatcctcaaacgacaga

SEQ ID NO: 4133521 - DNA, 16 bp, Homo sapiens
ccatcctcatccctga

SEQ ID NO: 4133522 - DNA, 13 bp, Homo sapiens
ccatcctccagag

SEQ ID NO: 4133523 - DNA, 16 bp, Homo sapiens
ccatcctccagagaaa

SEQ ID NO: 4133524 - DNA, 14 bp, Homo sapiens
ccatcctccctcca

SEQ ID NO: 4133525 - DNA, 20 bp, Homo sapiens
ccatcctccctccacctcaa

SEQ ID NO: 4133526 - DNA, 17 bp, Homo sapiens
ccatcctgtattcttca

SEQ ID NO: 4133527 - DNA, 20 bp, Homo sapiens
ccatccttcaccagagccca

SEQ ID NO: 4133528 - DNA, 21 bp, Homo sapiens
ccatccttcaccagagcccat

SEQ ID NO: 4133529 - DNA, 15 bp, Homo sapiens
ccatccttccctttg

SEQ ID NO: 4133530 - DNA, 12 bp, Homo sapiens
ccatctcagcct

SEQ ID NO: 4133531 - DNA, 15 bp, Homo sapiens
ccatctcagcctcct

SEQ ID NO: 4133532 - DNA, 19 bp, Homo sapiens
ccatctcagcctcctgagc

SEQ ID NO: 4133533 - DNA, 21 bp, Homo sapiens
ccatctcagcctcctgagcct

SEQ ID NO: 4133534 - DNA, 14 bp, Homo sapiens
ccatctcaggagat

SEQ ID NO: 4133535 - DNA, 16 bp, Homo sapiens
ccatctcctgctcacc

SEQ ID NO: 4133536 - DNA, 17 bp, Homo sapiens
ccatctcctgctcacca

SEQ ID NO: 4133537 - DNA, 24 bp, Homo sapiens
ccatctcctgctcaccacctgcct

SEQ ID NO: 4133538 - DNA, 14 bp, Homo sapiens
ccatctctccctcc

SEQ ID NO: 4133539 - DNA, 14 bp, Homo sapiens
ccatctcttctgca

SEQ ID NO: 4133540 - DNA, 18 bp, Homo sapiens
ccatctgcacacacctcc

SEQ ID NO: 4133541 - DNA, 12 bp, Homo sapiens
ccatctgcaccc

SEQ ID NO: 4133542 - DNA, 22 bp, Homo sapiens
ccatctgcaccccttctctcct

SEQ ID NO: 4133543 - DNA, 23 bp, Homo sapiens
ccatctgcaccccttctctcctc

SEQ ID NO: 4133544 - DNA, 18 bp, Homo sapiens
ccatctgcctgttctgag

SEQ ID NO: 4133545 - DNA, 23 bp, Homo sapiens
ccatctgggtccttgcacccctc

SEQ ID NO: 4133546 - DNA, 20 bp, Homo sapiens
ccatctgtccagctggggcc

SEQ ID NO: 4133547 - DNA, 19 bp, Homo sapiens
ccatctgtgatatgccata

SEQ ID NO: 4133548 - DNA, 15 bp, Homo sapiens
ccatctttactccca

SEQ ID NO: 4133549 - DNA, 20 bp, Homo sapiens
ccatctttactcccaagact

SEQ ID NO: 4133550 - DNA, 15 bp, Homo sapiens
ccatctttccatcca

SEQ ID NO: 4133551 - DNA, 23 bp, Homo sapiens
ccatctttttaacctctgttcag

SEQ ID NO: 4133552 - DNA, 12 bp, Homo sapiens
ccatctttttct

SEQ ID NO: 4133553 - DNA, 14 bp, Homo sapiens
ccatgaagacagga

SEQ ID NO: 4133554 - DNA, 19 bp, Homo sapiens
ccatgaatgtatcaggaaa

SEQ ID NO: 4133555 - DNA, 16 bp, Homo sapiens
ccatgacagaggctgc

SEQ ID NO: 4133556 - DNA, 14 bp, Homo sapiens
ccatgactgcaccc

SEQ ID NO: 4133557 - DNA, 16 bp, Homo sapiens
ccatgactgcacccag

SEQ ID NO: 4133558 - DNA, 17 bp, Homo sapiens
ccatgagaagagggcct

SEQ ID NO: 4133559 - DNA, 21 bp, Homo sapiens
ccatgagaagagggcctgtgg

SEQ ID NO: 4133560 - DNA, 15 bp, Homo sapiens
ccatgagggacaggg

SEQ ID NO: 4133561 - DNA, 17 bp, Homo sapiens
ccatgagggacagggtc

SEQ ID NO: 4133562 - DNA, 19 bp, Homo sapiens
ccatgagggacagggtctt

SEQ ID NO: 4133563 - DNA, 19 bp, Homo sapiens
ccatgatggcaacagatct

SEQ ID NO: 4133564 - DNA, 20 bp, Homo sapiens
ccatgcactgtgaaggaccc

SEQ ID NO: 4133565 - DNA, 17 bp, Homo sapiens
ccatgcaggccctttga

SEQ ID NO: 4133566 - DNA, 11 bp, Homo sapiens
ccatgcatttc

SEQ ID NO: 4133567 - DNA, 13 bp, Homo sapiens
ccatgccacgttc

SEQ ID NO: 4133568 - DNA, 21 bp, Homo sapiens
ccatgccacgttccacagttg

SEQ ID NO: 4133569 - DNA, 19 bp, Homo sapiens
ccatgccagattctgcctc

SEQ ID NO: 4133570 - DNA, 15 bp, Homo sapiens
ccatgccaggaacct

SEQ ID NO: 4133571 - DNA, 18 bp, Homo sapiens
ccatgcccacctgcccat

SEQ ID NO: 4133572 - DNA, 21 bp, Homo sapiens
ccatgcccactgctggtgcca

SEQ ID NO: 4133573 - DNA, 13 bp, Homo sapiens
ccatgccccagtc

SEQ ID NO: 4133574 - DNA, 13 bp, Homo sapiens
ccatgcctgaggg

SEQ ID NO: 4133575 - DNA, 14 bp, Homo sapiens
ccatgcctgagggt

SEQ ID NO: 4133576 - DNA, 18 bp, Homo sapiens
ccatgcctgagggtggag

SEQ ID NO: 4133577 - DNA, 13 bp, Homo sapiens
ccatgcctgtcca

SEQ ID NO: 4133578 - DNA, 21 bp, Homo sapiens
ccatgctcaaccactgtggcg

SEQ ID NO: 4133579 - DNA, 13 bp, Homo sapiens
ccatgctgaaggg

SEQ ID NO: 4133580 - DNA, 16 bp, Homo sapiens
ccatgctgggaagacg

SEQ ID NO: 4133581 - DNA, 21 bp, Homo sapiens
ccatgctgggaagacgcctga

SEQ ID NO: 4133582 - DNA, 20 bp, Homo sapiens
ccatgctggtggaaagatag

SEQ ID NO: 4133583 - DNA, 21 bp, Homo sapiens
ccatggacactccagtgccag

SEQ ID NO: 4133584 - DNA, 16 bp, Homo sapiens
ccatggacaggctggc

SEQ ID NO: 4133585 - DNA, 17 bp, Homo sapiens
ccatggagccagctccc

SEQ ID NO: 4133586 - DNA, 18 bp, Homo sapiens
ccatggagccagctccct

SEQ ID NO: 4133587 - DNA, 22 bp, Homo sapiens
ccatggagtgggtctggaggac

SEQ ID NO: 4133588 - DNA, 21 bp, Homo sapiens
ccatggatttcgtttttcttg

SEQ ID NO: 4133589 - DNA, 16 bp, Homo sapiens
ccatggccctgtccca

SEQ ID NO: 4133590 - DNA, 11 bp, Homo sapiens
ccatggctggg

SEQ ID NO: 4133591 - DNA, 21 bp, Homo sapiens
ccatgggcataggtaagctgt

SEQ ID NO: 4133592 - DNA, 18 bp, Homo sapiens
ccatgggctcctgcccct

SEQ ID NO: 4133593 - DNA, 16 bp, Homo sapiens
ccatggggccctccca

SEQ ID NO: 4133594 - DNA, 20 bp, Homo sapiens
ccatgggggcacttgagttt

SEQ ID NO: 4133595 - DNA, 15 bp, Homo sapiens
ccatggtgtcccggt

SEQ ID NO: 4133596 - DNA, 23 bp, Homo sapiens
ccatgtaaatccccactgggacc

SEQ ID NO: 4133597 - DNA, 17 bp, Homo sapiens
ccatgtactagttttag

SEQ ID NO: 4133598 - DNA, 14 bp, Homo sapiens
ccatgtagccccct

SEQ ID NO: 4133599 - DNA, 19 bp, Homo sapiens
ccatgtattcatccagagt

SEQ ID NO: 4133600 - DNA, 22 bp, Homo sapiens
ccatgtatttatctctatttaa

SEQ ID NO: 4133601 - DNA, 23 bp, Homo sapiens
ccatgtatttatctctatttaat

SEQ ID NO: 4133602 - DNA, 13 bp, Homo sapiens
ccatgtcactgtg

SEQ ID NO: 4133603 - DNA, 21 bp, Homo sapiens
ccatgtccaagttcttcacct

SEQ ID NO: 4133604 - DNA, 15 bp, Homo sapiens
ccatgtcctcagcat

SEQ ID NO: 4133605 - DNA, 13 bp, Homo sapiens
ccatgtgcacccg

SEQ ID NO: 4133606 - DNA, 20 bp, Homo sapiens
ccatgtgccatctgtacata

SEQ ID NO: 4133607 - DNA, 15 bp, Homo sapiens
ccatgtgcctttctt

SEQ ID NO: 4133608 - DNA, 19 bp, Homo sapiens
ccatgtgcctttctttgcc

SEQ ID NO: 4133609 - DNA, 22 bp, Homo sapiens
ccatgtgcctttctttgcctct

SEQ ID NO: 4133610 - DNA, 18 bp, Homo sapiens
ccatgtgtcccctcactc

SEQ ID NO: 4133611 - DNA, 22 bp, Homo sapiens
ccatgtgtcccctcactctgtc

SEQ ID NO: 4133612 - DNA, 14 bp, Homo sapiens
ccatgtgtcctggt

SEQ ID NO: 4133613 - DNA, 13 bp, Homo sapiens
ccatgttgcccct

SEQ ID NO: 4133614 - DNA, 16 bp, Homo sapiens
ccattaagtcatgtgt

SEQ ID NO: 4133615 - DNA, 12 bp, Homo sapiens
ccattaataaag

SEQ ID NO: 4133616 - DNA, 16 bp, Homo sapiens
ccattaatcatttccc

SEQ ID NO: 4133617 - DNA, 13 bp, Homo sapiens
ccattacctccat

SEQ ID NO: 4133618 - DNA, 22 bp, Homo sapiens
ccattacctccatccatccttc

SEQ ID NO: 4133619 - DNA, 14 bp, Homo sapiens
ccattaggccagca

SEQ ID NO: 4133620 - DNA, 16 bp, Homo sapiens
ccattaggccagcaac

SEQ ID NO: 4133621 - DNA, 14 bp, Homo sapiens
ccattatccctgaa

SEQ ID NO: 4133622 - DNA, 20 bp, Homo sapiens
ccattcagtgattactgtca

SEQ ID NO: 4133623 - DNA, 13 bp, Homo sapiens
ccattcatccttc

SEQ ID NO: 4133624 - DNA, 22 bp, Homo sapiens
ccattcattctggtcatttccc

SEQ ID NO: 4133625 - DNA, 15 bp, Homo sapiens
ccattccactccact

SEQ ID NO: 4133626 - DNA, 18 bp, Homo sapiens
ccattccctccatttttc

SEQ ID NO: 4133627 - DNA, 13 bp, Homo sapiens
ccattcctccctc

SEQ ID NO: 4133628 - DNA, 15 bp, Homo sapiens
ccattctcccaggta

SEQ ID NO: 4133629 - DNA, 18 bp, Homo sapiens
ccattgatcataaactga

SEQ ID NO: 4133630 - DNA, 15 bp, Homo sapiens
ccattgccaccagga

SEQ ID NO: 4133631 - DNA, 15 bp, Homo sapiens
ccattgcggccccag

SEQ ID NO: 4133632 - DNA, 18 bp, Homo sapiens
ccattgcggccccaggag

SEQ ID NO: 4133633 - DNA, 19 bp, Homo sapiens
ccattgcggccccaggagg

SEQ ID NO: 4133634 - DNA, 22 bp, Homo sapiens
ccattgctcttagtcccaagct

SEQ ID NO: 4133635 - DNA, 19 bp, Homo sapiens
ccattgggcacagtccaga

SEQ ID NO: 4133636 - DNA, 19 bp, Homo sapiens
ccatttagttctttgttat

SEQ ID NO: 4133637 - DNA, 20 bp, Homo sapiens
ccatttataaccccagcctg

SEQ ID NO: 4133638 - DNA, 17 bp, Homo sapiens
ccatttcagtggcttcc

SEQ ID NO: 4133639 - DNA, 11 bp, Homo sapiens
ccatttccctt

SEQ ID NO: 4133640 - DNA, 19 bp, Homo sapiens
ccatttcctcagcttatct

SEQ ID NO: 4133641 - DNA, 18 bp, Homo sapiens
ccatttccttggaggcca

SEQ ID NO: 4133642 - DNA, 17 bp, Homo sapiens
ccatttctatttattta

SEQ ID NO: 4133643 - DNA, 15 bp, Homo sapiens
ccatttctcactagt

SEQ ID NO: 4133644 - DNA, 13 bp, Homo sapiens
ccatttctcactg

SEQ ID NO: 4133645 - DNA, 14 bp, Homo sapiens
ccatttctgccttt

SEQ ID NO: 4133646 - DNA, 15 bp, Homo sapiens
ccatttgcctttctg

SEQ ID NO: 4133647 - DNA, 21 bp, Homo sapiens
ccatttggtgtggattttcta

SEQ ID NO: 4133648 - DNA, 18 bp, Homo sapiens
ccatttgtaataaagtat

SEQ ID NO: 4133649 - DNA, 20 bp, Homo sapiens
ccatttgtaataaagtatat

SEQ ID NO: 4133650 - DNA, 19 bp, Homo sapiens
ccattttcaactgctttga

SEQ ID NO: 4133651 - DNA, 21 bp, Homo sapiens
ccattttcccatcatcctttg

SEQ ID NO: 4133652 - DNA, 16 bp, Homo sapiens
ccattttgcccttcca

SEQ ID NO: 4133653 - DNA, 20 bp, Homo sapiens
ccattttggtgtctttctct

SEQ ID NO: 4133654 - DNA, 22 bp, Homo sapiens
ccatttttctcccaagaaacct

SEQ ID NO: 4133655 - DNA, 14 bp, Homo sapiens
cccaaaacccaggg

SEQ ID NO: 4133656 - DNA, 15 bp, Homo sapiens
cccaaaaggaaggag

SEQ ID NO: 4133657 - DNA, 22 bp, Homo sapiens
cccaaacaccttccagctcctg

SEQ ID NO: 4133658 - DNA, 22 bp, Homo sapiens
cccaaacgccctttcctcctca

SEQ ID NO: 4133659 - DNA, 23 bp, Homo sapiens
cccaaactgttgattattagcca

SEQ ID NO: 4133660 - DNA, 21 bp, Homo sapiens
cccaaagaatgtttatagcaa

SEQ ID NO: 4133661 - DNA, 14 bp, Homo sapiens
cccaaagctttcct

SEQ ID NO: 4133662 - DNA, 16 bp, Homo sapiens
cccaaagctttcctgc

SEQ ID NO: 4133663 - DNA, 20 bp, Homo sapiens
cccaaatatgtattttccta

SEQ ID NO: 4133664 - DNA, 16 bp, Homo sapiens
cccaaatttgattgat

SEQ ID NO: 4133665 - DNA, 21 bp, Homo sapiens
cccaacagccttagctgccag

SEQ ID NO: 4133666 - DNA, 13 bp, Homo sapiens
cccaacccccacc

SEQ ID NO: 4133667 - DNA, 12 bp, Homo sapiens
cccaacctcaga

SEQ ID NO: 4133668 - DNA, 15 bp, Homo sapiens
cccaacctcagggct

SEQ ID NO: 4133669 - DNA, 20 bp, Homo sapiens
cccaactccaccagatagca

SEQ ID NO: 4133670 - DNA, 20 bp, Homo sapiens
cccaactctcccctgacctg

SEQ ID NO: 4133671 - DNA, 15 bp, Homo sapiens
cccaactgtcttttt

SEQ ID NO: 4133672 - DNA, 21 bp, Homo sapiens
cccaagacagatgccccagag

SEQ ID NO: 4133673 - DNA, 20 bp, Homo sapiens
cccaagacttcattgtccct

SEQ ID NO: 4133674 - DNA, 22 bp, Homo sapiens
cccaagagcagagtctgggcct

SEQ ID NO: 4133675 - DNA, 16 bp, Homo sapiens
cccaagcccaccaggt

SEQ ID NO: 4133676 - DNA, 17 bp, Homo sapiens
cccaagcccaccaggtg

SEQ ID NO: 4133677 - DNA, 19 bp, Homo sapiens
cccaagggcctcccaccag

SEQ ID NO: 4133678 - DNA, 19 bp, Homo sapiens
cccaagggtgccctttggg

SEQ ID NO: 4133679 - DNA, 17 bp, Homo sapiens
cccaaggtcccctccac

SEQ ID NO: 4133680 - DNA, 17 bp, Homo sapiens
cccaagtcacacagcta

SEQ ID NO: 4133681 - DNA, 16 bp, Homo sapiens
cccaagtcacacccac

SEQ ID NO: 4133682 - DNA, 21 bp, Homo sapiens
cccaagtcacacccactccct

SEQ ID NO: 4133683 - DNA, 23 bp, Homo sapiens
cccaagtttccatagcaacagga

SEQ ID NO: 4133684 - DNA, 15 bp, Homo sapiens
cccaatattataatt

SEQ ID NO: 4133685 - DNA, 14 bp, Homo sapiens
cccaatcagctcct

SEQ ID NO: 4133686 - DNA, 14 bp, Homo sapiens
cccaatctccatct

SEQ ID NO: 4133687 - DNA, 19 bp, Homo sapiens
cccaatctgcacactccag

SEQ ID NO: 4133688 - DNA, 20 bp, Homo sapiens
cccaatctgcacactccagg

SEQ ID NO: 4133689 - DNA, 16 bp, Homo sapiens
cccaatgtaggagctg

SEQ ID NO: 4133690 - DNA, 14 bp, Homo sapiens
cccaattctgcccg

SEQ ID NO: 4133691 - DNA, 14 bp, Homo sapiens
cccaattggaggaa

SEQ ID NO: 4133692 - DNA, 13 bp, Homo sapiens
cccacacagctgc

SEQ ID NO: 4133693 - DNA, 14 bp, Homo sapiens
cccacacagctgcc

SEQ ID NO: 4133694 - DNA, 22 bp, Homo sapiens
cccacacagctgccctagctga

SEQ ID NO: 4133695 - DNA, 15 bp, Homo sapiens
cccacaccagccttg

SEQ ID NO: 4133696 - DNA, 16 bp, Homo sapiens
cccacaccagccttgg

SEQ ID NO: 4133697 - DNA, 17 bp, Homo sapiens
cccacaccccagcccac

SEQ ID NO: 4133698 - DNA, 22 bp, Homo sapiens
cccacaccccagcccaccctgc

SEQ ID NO: 4133699 - DNA, 12 bp, Homo sapiens
cccacaccctgg

SEQ ID NO: 4133700 - DNA, 22 bp, Homo sapiens
cccacacctcagttcccttggc

SEQ ID NO: 4133701 - DNA, 20 bp, Homo sapiens
cccacaccttccagggccct

SEQ ID NO: 4133702 - DNA, 19 bp, Homo sapiens
cccacacttgttccagctc

SEQ ID NO: 4133703 - DNA, 18 bp, Homo sapiens
cccacagacagatcccat

SEQ ID NO: 4133704 - DNA, 20 bp, Homo sapiens
cccacaggaagcctgcagtc

SEQ ID NO: 4133705 - DNA, 23 bp, Homo sapiens
cccacaggaagcctgcagtcctg

SEQ ID NO: 4133706 - DNA, 19 bp, Homo sapiens
cccacatagtgatggttcc

SEQ ID NO: 4133707 - DNA, 22 bp, Homo sapiens
cccacatccggggccagctccg

SEQ ID NO: 4133708 - DNA, 16 bp, Homo sapiens
cccacatcgcacactg

SEQ ID NO: 4133709 - DNA, 20 bp, Homo sapiens
cccacatcgcacactggggc

SEQ ID NO: 4133710 - DNA, 13 bp, Homo sapiens
cccacatgcctgc

SEQ ID NO: 4133711 - DNA, 24 bp, Homo sapiens
cccaccagccacagcctccccacc

SEQ ID NO: 4133712 - DNA, 18 bp, Homo sapiens
cccacccacacagctgcc

SEQ ID NO: 4133713 - DNA, 11 bp, Homo sapiens
cccacccacct

SEQ ID NO: 4133714 - DNA, 13 bp, Homo sapiens
cccacccacctcc

SEQ ID NO: 4133715 - DNA, 15 bp, Homo sapiens
cccacccacctccac

SEQ ID NO: 4133716 - DNA, 14 bp, Homo sapiens
cccaccccagcctc

SEQ ID NO: 4133717 - DNA, 12 bp, Homo sapiens
cccacccccatc

SEQ ID NO: 4133718 - DNA, 14 bp, Homo sapiens
cccaccccctgccc

SEQ ID NO: 4133719 - DNA, 16 bp, Homo sapiens
cccacccccttctctg

SEQ ID NO: 4133720 - DNA, 18 bp, Homo sapiens
cccaccccggggaccctg

SEQ ID NO: 4133721 - DNA, 13 bp, Homo sapiens
cccacccctacac

SEQ ID NO: 4133722 - DNA, 16 bp, Homo sapiens
cccacccctagccacc

SEQ ID NO: 4133723 - DNA, 16 bp, Homo sapiens
cccacccctcactccc

SEQ ID NO: 4133724 - DNA, 17 bp, Homo sapiens
cccacccctcactcccc

SEQ ID NO: 4133725 - DNA, 12 bp, Homo sapiens
cccacccctgcc

SEQ ID NO: 4133726 - DNA, 21 bp, Homo sapiens
cccaccctgctcctcctgccc

SEQ ID NO: 4133727 - DNA, 15 bp, Homo sapiens
cccaccgagctggag

SEQ ID NO: 4133728 - DNA, 17 bp, Homo sapiens
cccaccgagctggagcg

SEQ ID NO: 4133729 - DNA, 15 bp, Homo sapiens
cccaccgatggagcc

SEQ ID NO: 4133730 - DNA, 15 bp, Homo sapiens
cccaccgcagtcacc

SEQ ID NO: 4133731 - DNA, 21 bp, Homo sapiens
cccaccgggagcctccccctc

SEQ ID NO: 4133732 - DNA, 23 bp, Homo sapiens
cccaccgggagcctccccctcag

SEQ ID NO: 4133733 - DNA, 20 bp, Homo sapiens
cccaccgtggaggaggaagg

SEQ ID NO: 4133734 - DNA, 17 bp, Homo sapiens
cccaccgtgggcaggga

SEQ ID NO: 4133735 - DNA, 12 bp, Homo sapiens
cccacctccacc

SEQ ID NO: 4133736 - DNA, 18 bp, Homo sapiens
cccacctccacccagccc

SEQ ID NO: 4133737 - DNA, 21 bp, Homo sapiens
cccacctccacccagcccctg

SEQ ID NO: 4133738 - DNA, 15 bp, Homo sapiens
cccacctccactccc

SEQ ID NO: 4133739 - DNA, 16 bp, Homo sapiens
cccacctctcctgccc

SEQ ID NO: 4133740 - DNA, 19 bp, Homo sapiens
cccacctgcatctggggcc

SEQ ID NO: 4133741 - DNA, 15 bp, Homo sapiens
cccacgagggctggc

SEQ ID NO: 4133742 - DNA, 16 bp, Homo sapiens
cccacgccgggaacca

SEQ ID NO: 4133743 - DNA, 17 bp, Homo sapiens
cccacggagacagagga

SEQ ID NO: 4133744 - DNA, 14 bp, Homo sapiens
cccacgtctggcca

SEQ ID NO: 4133745 - DNA, 18 bp, Homo sapiens
cccactatccttcgtgaa

SEQ ID NO: 4133746 - DNA, 15 bp, Homo sapiens
cccactccctatctc

SEQ ID NO: 4133747 - DNA, 19 bp, Homo sapiens
cccactccctatctccttc

SEQ ID NO: 4133748 - DNA, 20 bp, Homo sapiens
cccactccctggctctcaga

SEQ ID NO: 4133749 - DNA, 17 bp, Homo sapiens
cccactctccccacact

SEQ ID NO: 4133750 - DNA, 16 bp, Homo sapiens
cccactgacagcctcc

SEQ ID NO: 4133751 - DNA, 14 bp, Homo sapiens
cccactgaccagaa

SEQ ID NO: 4133752 - DNA, 18 bp, Homo sapiens
cccactgcaccgcctcag

SEQ ID NO: 4133753 - DNA, 16 bp, Homo sapiens
cccactgctggtgcca

SEQ ID NO: 4133754 - DNA, 15 bp, Homo sapiens
cccactggcagcatc

SEQ ID NO: 4133755 - DNA, 19 bp, Homo sapiens
cccactgggaccaaccctg

SEQ ID NO: 4133756 - DNA, 13 bp, Homo sapiens
cccactgggcaca

SEQ ID NO: 4133757 - DNA, 12 bp, Homo sapiens
cccactgtatga

SEQ ID NO: 4133758 - DNA, 17 bp, Homo sapiens
cccactgtatgatttat

SEQ ID NO: 4133759 - DNA, 22 bp, Homo sapiens
cccactgtcctgggcctgcaga

SEQ ID NO: 4133760 - DNA, 17 bp, Homo sapiens
cccactttcatctacct

SEQ ID NO: 4133761 - DNA, 21 bp, Homo sapiens
cccactttcatctaccttttc

SEQ ID NO: 4133762 - DNA, 14 bp, Homo sapiens
cccagaaacaacag

SEQ ID NO: 4133763 - DNA, 14 bp, Homo sapiens
cccagaaaggagac

SEQ ID NO: 4133764 - DNA, 17 bp, Homo sapiens
cccagaactgcccccac

SEQ ID NO: 4133765 - DNA, 18 bp, Homo sapiens
cccagaactgcccccact

SEQ ID NO: 4133766 - DNA, 15 bp, Homo sapiens
cccagaacttccctg

SEQ ID NO: 4133767 - DNA, 19 bp, Homo sapiens
cccagaagtggctactgac

SEQ ID NO: 4133768 - DNA, 20 bp, Homo sapiens
cccagaagtggctactgact

SEQ ID NO: 4133769 - DNA, 14 bp, Homo sapiens
cccagaatggagcc

SEQ ID NO: 4133770 - DNA, 18 bp, Homo sapiens
cccagaatggagcctgct

SEQ ID NO: 4133771 - DNA, 21 bp, Homo sapiens
cccagaatggagcctgctctc

SEQ ID NO: 4133772 - DNA, 21 bp, Homo sapiens
cccagaatttaccatcatctc

SEQ ID NO: 4133773 - DNA, 22 bp, Homo sapiens
cccagaatttaccatcatctct

SEQ ID NO: 4133774 - DNA, 19 bp, Homo sapiens
cccagacagacatctctgc

SEQ ID NO: 4133775 - DNA, 20 bp, Homo sapiens
cccagacagggtgggcttcc

SEQ ID NO: 4133776 - DNA, 16 bp, Homo sapiens
cccagaccccagggca

SEQ ID NO: 4133777 - DNA, 17 bp, Homo sapiens
cccagaccccagggcag

SEQ ID NO: 4133778 - DNA, 22 bp, Homo sapiens
cccagactaaaggatccagaga

SEQ ID NO: 4133779 - DNA, 23 bp, Homo sapiens
cccagactaaaggatccagagag

SEQ ID NO: 4133780 - DNA, 15 bp, Homo sapiens
cccagactacagggc

SEQ ID NO: 4133781 - DNA, 16 bp, Homo sapiens
cccagactcagacatt

SEQ ID NO: 4133782 - DNA, 20 bp, Homo sapiens
cccagactcagacattggca

SEQ ID NO: 4133783 - DNA, 18 bp, Homo sapiens
cccagagcaccccctgct

SEQ ID NO: 4133784 - DNA, 13 bp, Homo sapiens
cccagagccacct

SEQ ID NO: 4133785 - DNA, 16 bp, Homo sapiens
cccagagcccagctcc

SEQ ID NO: 4133786 - DNA, 16 bp, Homo sapiens
cccagagcccctcctc

SEQ ID NO: 4133787 - DNA, 20 bp, Homo sapiens
cccagagcctggctgcccat

SEQ ID NO: 4133788 - DNA, 17 bp, Homo sapiens
cccagagtgtgaaactt

SEQ ID NO: 4133789 - DNA, 15 bp, Homo sapiens
cccagatagagctgg

SEQ ID NO: 4133790 - DNA, 16 bp, Homo sapiens
cccagatagagctggg

SEQ ID NO: 4133791 - DNA, 19 bp, Homo sapiens
cccagatcagccagaagcc

SEQ ID NO: 4133792 - DNA, 12 bp, Homo sapiens
cccagatcctca

SEQ ID NO: 4133793 - DNA, 18 bp, Homo sapiens
cccagatctggtcccttg

SEQ ID NO: 4133794 - DNA, 20 bp, Homo sapiens
cccagatctggtcccttgca

SEQ ID NO: 4133795 - DNA, 23 bp, Homo sapiens
cccagatgccctttggaaagcca

SEQ ID NO: 4133796 - DNA, 15 bp, Homo sapiens
cccagcaacgcccct

SEQ ID NO: 4133797 - DNA, 18 bp, Homo sapiens
cccagcaacgcccctcca

SEQ ID NO: 4133798 - DNA, 17 bp, Homo sapiens
cccagcaagcgggagcc

SEQ ID NO: 4133799 - DNA, 12 bp, Homo sapiens
cccagcactgtg

SEQ ID NO: 4133800 - DNA, 17 bp, Homo sapiens
cccagcactttgggagg

SEQ ID NO: 4133801 - DNA, 18 bp, Homo sapiens
cccagcactttgggaggc

SEQ ID NO: 4133802 - DNA, 23 bp, Homo sapiens
cccagcactttgggaggccgagg

SEQ ID NO: 4133803 - DNA, 20 bp, Homo sapiens
cccagcactttgggaggcct

SEQ ID NO: 4133804 - DNA, 21 bp, Homo sapiens
cccagcactttgggaggccta

SEQ ID NO: 4133805 - DNA, 15 bp, Homo sapiens
cccagcagaggcagg

SEQ ID NO: 4133806 - DNA, 17 bp, Homo sapiens
cccagcagccctaagga

SEQ ID NO: 4133807 - DNA, 17 bp, Homo sapiens
cccagcagccctcaaca

SEQ ID NO: 4133808 - DNA, 15 bp, Homo sapiens
cccagcaggaagcca

SEQ ID NO: 4133809 - DNA, 21 bp, Homo sapiens
cccagcaggagagactgagca

SEQ ID NO: 4133810 - DNA, 21 bp, Homo sapiens
cccagcagtgtggagaccctg

SEQ ID NO: 4133811 - DNA, 14 bp, Homo sapiens
cccagcatccctgg

SEQ ID NO: 4133812 - DNA, 12 bp, Homo sapiens
cccagccacccc

SEQ ID NO: 4133813 - DNA, 22 bp, Homo sapiens
cccagccaccccgggctctctg

SEQ ID NO: 4133814 - DNA, 15 bp, Homo sapiens
cccagccaggagcag

SEQ ID NO: 4133815 - DNA, 9 bp, Homo sapiens
cccagccca

SEQ ID NO: 4133816 - DNA, 11 bp, Homo sapiens
cccagcccacc

SEQ ID NO: 4133817 - DNA, 15 bp, Homo sapiens
cccagcccaccctgc

SEQ ID NO: 4133818 - DNA, 19 bp, Homo sapiens
cccagcccaccctgctcct

SEQ ID NO: 4133819 - DNA, 20 bp, Homo sapiens
cccagcccaccctgctcctc

SEQ ID NO: 4133820 - DNA, 12 bp, Homo sapiens
cccagcccagag

SEQ ID NO: 4133821 - DNA, 15 bp, Homo sapiens
cccagcccagagaca

SEQ ID NO: 4133822 - DNA, 16 bp, Homo sapiens
cccagcccagagacat

SEQ ID NO: 4133823 - DNA, 13 bp, Homo sapiens
cccagcccagagc

SEQ ID NO: 4133824 - DNA, 19 bp, Homo sapiens
cccagcccagagccacctg

SEQ ID NO: 4133825 - DNA, 16 bp, Homo sapiens
cccagccccatccctg

SEQ ID NO: 4133826 - DNA, 19 bp, Homo sapiens
cccagccccatccctgtcc

SEQ ID NO: 4133827 - DNA, 20 bp, Homo sapiens
cccagccccatccctgtcct

SEQ ID NO: 4133828 - DNA, 19 bp, Homo sapiens
cccagcccctactgctgtg

SEQ ID NO: 4133829 - DNA, 18 bp, Homo sapiens
cccagccccttctcccag

SEQ ID NO: 4133830 - DNA, 22 bp, Homo sapiens
cccagccccttctcccagcaca

SEQ ID NO: 4133831 - DNA, 12 bp, Homo sapiens
cccagccctggc

SEQ ID NO: 4133832 - DNA, 16 bp, Homo sapiens
cccagccctggctctg

SEQ ID NO: 4133833 - DNA, 19 bp, Homo sapiens
cccagcccttcctctgctc

SEQ ID NO: 4133834 - DNA, 19 bp, Homo sapiens
cccagccgtcgtctccctc

SEQ ID NO: 4133835 - DNA, 22 bp, Homo sapiens
cccagccgtcgtctccctcgac

SEQ ID NO: 4133836 - DNA, 13 bp, Homo sapiens
cccagcctcgcct

SEQ ID NO: 4133837 - DNA, 19 bp, Homo sapiens
cccagcctcgcctgtcacc

SEQ ID NO: 4133838 - DNA, 15 bp, Homo sapiens
cccagcctctttccc

SEQ ID NO: 4133839 - DNA, 16 bp, Homo sapiens
cccagcctgacctgag

SEQ ID NO: 4133840 - DNA, 18 bp, Homo sapiens
cccagcctgacctgagac

SEQ ID NO: 4133841 - DNA, 22 bp, Homo sapiens
cccagcctgctgagagccccca

SEQ ID NO: 4133842 - DNA, 18 bp, Homo sapiens
cccagcctgggccatctc

SEQ ID NO: 4133843 - DNA, 12 bp, Homo sapiens
cccagcctgggg

SEQ ID NO: 4133844 - DNA, 17 bp, Homo sapiens
cccagcctgggggccag

SEQ ID NO: 4133845 - DNA, 14 bp, Homo sapiens
cccagcgcggccag

SEQ ID NO: 4133846 - DNA, 15 bp, Homo sapiens
cccagcgcggccagc

SEQ ID NO: 4133847 - DNA, 12 bp, Homo sapiens
cccagcgggcag

SEQ ID NO: 4133848 - DNA, 16 bp, Homo sapiens
cccagctaagaacctg

SEQ ID NO: 4133849 - DNA, 20 bp, Homo sapiens
cccagctaagaacctggaac

SEQ ID NO: 4133850 - DNA, 18 bp, Homo sapiens
cccagctaatctgtaggg

SEQ ID NO: 4133851 - DNA, 18 bp, Homo sapiens
cccagctacttgggaggc

SEQ ID NO: 4133852 - DNA, 18 bp, Homo sapiens
cccagctaggaagagcag

SEQ ID NO: 4133853 - DNA, 23 bp, Homo sapiens
cccagctaggaagagcaggactc

SEQ ID NO: 4133854 - DNA, 14 bp, Homo sapiens
cccagctccagggg

SEQ ID NO: 4133855 - DNA, 17 bp, Homo sapiens
cccagctccggcctgtc

SEQ ID NO: 4133856 - DNA, 14 bp, Homo sapiens
cccagctgactgtg

SEQ ID NO: 4133857 - DNA, 12 bp, Homo sapiens
cccagctgggtc

SEQ ID NO: 4133858 - DNA, 17 bp, Homo sapiens
cccagctgggtcaggca

SEQ ID NO: 4133859 - DNA, 18 bp, Homo sapiens
cccagctttaaaaagaaa

SEQ ID NO: 4133860 - DNA, 19 bp, Homo sapiens
cccagctttaaaaagaaaa

SEQ ID NO: 4133861 - DNA, 22 bp, Homo sapiens
cccaggaactcgcacctgtgct

SEQ ID NO: 4133862 - DNA, 14 bp, Homo sapiens
cccaggaccagctc

SEQ ID NO: 4133863 - DNA, 16 bp, Homo sapiens
cccaggaccagctcag

SEQ ID NO: 4133864 - DNA, 20 bp, Homo sapiens
cccaggaccagctcaggaca

SEQ ID NO: 4133865 - DNA, 16 bp, Homo sapiens
cccaggagacagacca

SEQ ID NO: 4133866 - DNA, 20 bp, Homo sapiens
cccaggagaccacggggagc

SEQ ID NO: 4133867 - DNA, 18 bp, Homo sapiens
cccaggagatgggtccag

SEQ ID NO: 4133868 - DNA, 10 bp, Homo sapiens
cccaggaggg

SEQ ID NO: 4133869 - DNA, 18 bp, Homo sapiens
cccaggagggagggggct

SEQ ID NO: 4133870 - DNA, 21 bp, Homo sapiens
cccaggcatgaaattcttcct

SEQ ID NO: 4133871 - DNA, 13 bp, Homo sapiens
cccaggccaggcc

SEQ ID NO: 4133872 - DNA, 12 bp, Homo sapiens
cccaggccccct

SEQ ID NO: 4133873 - DNA, 14 bp, Homo sapiens
cccaggccggccca

SEQ ID NO: 4133874 - DNA, 21 bp, Homo sapiens
cccaggccggggtggagcatg

SEQ ID NO: 4133875 - DNA, 18 bp, Homo sapiens
cccaggcctgtggcccca

SEQ ID NO: 4133876 - DNA, 20 bp, Homo sapiens
cccaggcctgtggccccacc

SEQ ID NO: 4133877 - DNA, 16 bp, Homo sapiens
cccaggctggagaccc

SEQ ID NO: 4133878 - DNA, 18 bp, Homo sapiens
cccaggctggagtgcagt

SEQ ID NO: 4133879 - DNA, 16 bp, Homo sapiens
cccaggctggtctcaa

SEQ ID NO: 4133880 - DNA, 21 bp, Homo sapiens
cccaggctgtgcagcgcagct

SEQ ID NO: 4133881 - DNA, 22 bp, Homo sapiens
cccaggctgttctccaggcttc

SEQ ID NO: 4133882 - DNA, 13 bp, Homo sapiens
cccagggagctct

SEQ ID NO: 4133883 - DNA, 15 bp, Homo sapiens
cccagggagctctgg

SEQ ID NO: 4133884 - DNA, 16 bp, Homo sapiens
cccagggagggaagtg

SEQ ID NO: 4133885 - DNA, 13 bp, Homo sapiens
cccagggagtcca

SEQ ID NO: 4133886 - DNA, 16 bp, Homo sapiens
cccagggagtccaggg

SEQ ID NO: 4133887 - DNA, 14 bp, Homo sapiens
cccagggcagcctg

SEQ ID NO: 4133888 - DNA, 23 bp, Homo sapiens
cccagggcagggtgggcagccta

SEQ ID NO: 4133889 - DNA, 17 bp, Homo sapiens
cccagggcccagagccc

SEQ ID NO: 4133890 - DNA, 19 bp, Homo sapiens
cccagggcccagagcccag

SEQ ID NO: 4133891 - DNA, 20 bp, Homo sapiens
cccagggcccagagcccagc

SEQ ID NO: 4133892 - DNA, 22 bp, Homo sapiens
cccagggcccagagcccagctc

SEQ ID NO: 4133893 - DNA, 14 bp, Homo sapiens
cccagggccctggc

SEQ ID NO: 4133894 - DNA, 18 bp, Homo sapiens
cccagggccctggccagc

SEQ ID NO: 4133895 - DNA, 11 bp, Homo sapiens
cccagggctgg

SEQ ID NO: 4133896 - DNA, 19 bp, Homo sapiens
cccaggggaaggccctgag

SEQ ID NO: 4133897 - DNA, 16 bp, Homo sapiens
cccaggggacaaggga

SEQ ID NO: 4133898 - DNA, 13 bp, Homo sapiens
cccaggggcagga

SEQ ID NO: 4133899 - DNA, 17 bp, Homo sapiens
cccaggggcccacaggg

SEQ ID NO: 4133900 - DNA, 22 bp, Homo sapiens
cccaggggtctccctggctccc

SEQ ID NO: 4133901 - DNA, 23 bp, Homo sapiens
cccaggggtctccctggctccct

SEQ ID NO: 4133902 - DNA, 18 bp, Homo sapiens
cccagggtcttccctacc

SEQ ID NO: 4133903 - DNA, 17 bp, Homo sapiens
cccaggtaccagctgcg

SEQ ID NO: 4133904 - DNA, 20 bp, Homo sapiens
cccaggtcctctgataccca

SEQ ID NO: 4133905 - DNA, 16 bp, Homo sapiens
cccaggtgccagcctg

SEQ ID NO: 4133906 - DNA, 20 bp, Homo sapiens
cccaggttcccccagcaagc

SEQ ID NO: 4133907 - DNA, 18 bp, Homo sapiens
cccaggttcgagacccaa

SEQ ID NO: 4133908 - DNA, 18 bp, Homo sapiens
cccagtacctccaagcaa

SEQ ID NO: 4133909 - DNA, 14 bp, Homo sapiens
cccagtcacctccc

SEQ ID NO: 4133910 - DNA, 19 bp, Homo sapiens
cccagtcacctccccacat

SEQ ID NO: 4133911 - DNA, 19 bp, Homo sapiens
cccagtccaaatgtcctcc

SEQ ID NO: 4133912 - DNA, 18 bp, Homo sapiens
cccagtccccacccctgc

SEQ ID NO: 4133913 - DNA, 19 bp, Homo sapiens
cccagtccccacccctgcc

SEQ ID NO: 4133914 - DNA, 20 bp, Homo sapiens
cccagtccccacccctgccc

SEQ ID NO: 4133915 - DNA, 21 bp, Homo sapiens
cccagtccccacccctgcccc

SEQ ID NO: 4133916 - DNA, 18 bp, Homo sapiens
cccagtcggccccatctc

SEQ ID NO: 4133917 - DNA, 20 bp, Homo sapiens
cccagtgaactcctgccagg

SEQ ID NO: 4133918 - DNA, 17 bp, Homo sapiens
cccagtgaagcctctga

SEQ ID NO: 4133919 - DNA, 18 bp, Homo sapiens
cccagtgagactgcccca

SEQ ID NO: 4133920 - DNA, 21 bp, Homo sapiens
cccagtgcggttcctcatctg

SEQ ID NO: 4133921 - DNA, 14 bp, Homo sapiens
cccagtgctcacca

SEQ ID NO: 4133922 - DNA, 16 bp, Homo sapiens
cccagtgctcaccagc

SEQ ID NO: 4133923 - DNA, 17 bp, Homo sapiens
cccagtgctcaccagcc

SEQ ID NO: 4133924 - DNA, 22 bp, Homo sapiens
cccagtgggaccacatgccact

SEQ ID NO: 4133925 - DNA, 21 bp, Homo sapiens
cccagtgttgtttgtaaataa

SEQ ID NO: 4133926 - DNA, 17 bp, Homo sapiens
cccagttgccatctgcg

SEQ ID NO: 4133927 - DNA, 24 bp, Homo sapiens
cccagttggggaagccaggtgagc

SEQ ID NO: 4133928 - DNA, 14 bp, Homo sapiens
cccataactcaatg

SEQ ID NO: 4133929 - DNA, 12 bp, Homo sapiens
cccataataaag

SEQ ID NO: 4133930 - DNA, 15 bp, Homo sapiens
cccataataaagcaa

SEQ ID NO: 4133931 - DNA, 13 bp, Homo sapiens
cccatactcagcc

SEQ ID NO: 4133932 - DNA, 14 bp, Homo sapiens
cccatactcagcct

SEQ ID NO: 4133933 - DNA, 15 bp, Homo sapiens
cccatactcagcctg

SEQ ID NO: 4133934 - DNA, 18 bp, Homo sapiens
cccatacttttggctcct

SEQ ID NO: 4133935 - DNA, 21 bp, Homo sapiens
cccatcacagggttgggccca

SEQ ID NO: 4133936 - DNA, 22 bp, Homo sapiens
cccatcattacccttccctgca

SEQ ID NO: 4133937 - DNA, 17 bp, Homo sapiens
cccatccagacctggct

SEQ ID NO: 4133938 - DNA, 18 bp, Homo sapiens
cccatccagacctggctc

SEQ ID NO: 4133939 - DNA, 14 bp, Homo sapiens
cccatccatcagct

SEQ ID NO: 4133940 - DNA, 18 bp, Homo sapiens
cccatccatcagctccct

SEQ ID NO: 4133941 - DNA, 14 bp, Homo sapiens
cccatcccacccct

SEQ ID NO: 4133942 - DNA, 18 bp, Homo sapiens
cccatcccacccctccat

SEQ ID NO: 4133943 - DNA, 12 bp, Homo sapiens
cccatccccacc

SEQ ID NO: 4133944 - DNA, 15 bp, Homo sapiens
cccatccctccccag

SEQ ID NO: 4133945 - DNA, 22 bp, Homo sapiens
cccatccctcgggaagcagcca

SEQ ID NO: 4133946 - DNA, 23 bp, Homo sapiens
cccatccctcgggaagcagccag

SEQ ID NO: 4133947 - DNA, 18 bp, Homo sapiens
cccatcctcatccctgac

SEQ ID NO: 4133948 - DNA, 16 bp, Homo sapiens
cccatctcagcctcct

SEQ ID NO: 4133949 - DNA, 17 bp, Homo sapiens
cccatctccctgcctgg

SEQ ID NO: 4133950 - DNA, 21 bp, Homo sapiens
cccatctctccctcccctgcc

SEQ ID NO: 4133951 - DNA, 18 bp, Homo sapiens
cccatctcttcctaccca

SEQ ID NO: 4133952 - DNA, 13 bp, Homo sapiens
cccatctgcaccc

SEQ ID NO: 4133953 - DNA, 22 bp, Homo sapiens
cccatctgggtccttgcacccc

SEQ ID NO: 4133954 - DNA, 13 bp, Homo sapiens
cccatctgtccag

SEQ ID NO: 4133955 - DNA, 22 bp, Homo sapiens
cccatctgtccagctggggcca

SEQ ID NO: 4133956 - DNA, 19 bp, Homo sapiens
cccatgaccatactgaggg

SEQ ID NO: 4133957 - DNA, 13 bp, Homo sapiens
cccatgactgcac

SEQ ID NO: 4133958 - DNA, 19 bp, Homo sapiens
cccatgactgcacccagct

SEQ ID NO: 4133959 - DNA, 22 bp, Homo sapiens
cccatgactttatatggatgat

SEQ ID NO: 4133960 - DNA, 16 bp, Homo sapiens
cccatgagcctgcccg

SEQ ID NO: 4133961 - DNA, 23 bp, Homo sapiens
cccatgagttggggtctggcagc

SEQ ID NO: 4133962 - DNA, 16 bp, Homo sapiens
cccatgcactgtgaag

SEQ ID NO: 4133963 - DNA, 20 bp, Homo sapiens
cccatgcactgtgaaggacc

SEQ ID NO: 4133964 - DNA, 21 bp, Homo sapiens
cccatgccaaagctagggtgg

SEQ ID NO: 4133965 - DNA, 19 bp, Homo sapiens
cccatgccaaggcctccct

SEQ ID NO: 4133966 - DNA, 14 bp, Homo sapiens
cccatgccccagtc

SEQ ID NO: 4133967 - DNA, 19 bp, Homo sapiens
cccatgctcaaccactgtg

SEQ ID NO: 4133968 - DNA, 17 bp, Homo sapiens
cccatggaatatttcca

SEQ ID NO: 4133969 - DNA, 21 bp, Homo sapiens
cccatggacactccagtgcca

SEQ ID NO: 4133970 - DNA, 22 bp, Homo sapiens
cccatggacactccagtgccag

SEQ ID NO: 4133971 - DNA, 15 bp, Homo sapiens
cccatggacaggctg

SEQ ID NO: 4133972 - DNA, 17 bp, Homo sapiens
cccatgggctcctgccc

SEQ ID NO: 4133973 - DNA, 18 bp, Homo sapiens
cccatgggctcctgcccc

SEQ ID NO: 4133974 - DNA, 17 bp, Homo sapiens
cccatgggctctgacag

SEQ ID NO: 4133975 - DNA, 22 bp, Homo sapiens
cccatgtctttctccaaagtta

SEQ ID NO: 4133976 - DNA, 14 bp, Homo sapiens
cccatgtgagctgc

SEQ ID NO: 4133977 - DNA, 16 bp, Homo sapiens
cccatgtgagctgctg

SEQ ID NO: 4133978 - DNA, 13 bp, Homo sapiens
cccatgtgccaag

SEQ ID NO: 4133979 - DNA, 19 bp, Homo sapiens
cccatgtggagtcagcctc

SEQ ID NO: 4133980 - DNA, 23 bp, Homo sapiens
cccatgttagctacacagtgcag

SEQ ID NO: 4133981 - DNA, 13 bp, Homo sapiens
cccattcctgaag

SEQ ID NO: 4133982 - DNA, 21 bp, Homo sapiens
cccatttcaggaatttaaaat

SEQ ID NO: 4133983 - DNA, 15 bp, Homo sapiens
cccatttcccatctg

SEQ ID NO: 4133984 - DNA, 19 bp, Homo sapiens
cccatttcccatctgcacc

SEQ ID NO: 4133985 - DNA, 11 bp, Homo sapiens
cccatttcctt

SEQ ID NO: 4133986 - DNA, 14 bp, Homo sapiens
cccatttgtcccag

SEQ ID NO: 4133987 - DNA, 15 bp, Homo sapiens
cccatttgtcccaga

SEQ ID NO: 4133988 - DNA, 19 bp, Homo sapiens
cccattttcaactgctttg

SEQ ID NO: 4133989 - DNA, 17 bp, Homo sapiens
cccattttgagtgactc

SEQ ID NO: 4133990 - DNA, 17 bp, Homo sapiens
ccccaaacatagcccct

SEQ ID NO: 4133991 - DNA, 20 bp, Homo sapiens
ccccaaaggacgcctgcagg

SEQ ID NO: 4133992 - DNA, 22 bp, Homo sapiens
ccccaacaaaccatccagtgac

SEQ ID NO: 4133993 - DNA, 13 bp, Homo sapiens
ccccaacctcagg

SEQ ID NO: 4133994 - DNA, 14 bp, Homo sapiens
ccccaacctcaggg

SEQ ID NO: 4133995 - DNA, 13 bp, Homo sapiens
ccccaaggacaag

SEQ ID NO: 4133996 - DNA, 22 bp, Homo sapiens
ccccaattactattccctttga

SEQ ID NO: 4133997 - DNA, 13 bp, Homo sapiens
ccccaattctccc

SEQ ID NO: 4133998 - DNA, 17 bp, Homo sapiens
ccccacacagctacagc

SEQ ID NO: 4133999 - DNA, 17 bp, Homo sapiens
ccccacaccccagccca

SEQ ID NO: 4134000 - DNA, 18 bp, Homo sapiens
ccccacaccccagcccac

SEQ ID NO: 4134001 - DNA, 19 bp, Homo sapiens
ccccacaccccagcccacc

SEQ ID NO: 4134002 - DNA, 20 bp, Homo sapiens
ccccacacggactcccgggc

SEQ ID NO: 4134003 - DNA, 23 bp, Homo sapiens
ccccacacttgttccagctcttt

SEQ ID NO: 4134004 - DNA, 14 bp, Homo sapiens
ccccacagctacct

SEQ ID NO: 4134005 - DNA, 14 bp, Homo sapiens
ccccacagctggct

SEQ ID NO: 4134006 - DNA, 18 bp, Homo sapiens
ccccacatcgcacactgg

SEQ ID NO: 4134007 - DNA, 13 bp, Homo sapiens
ccccaccagctgc

SEQ ID NO: 4134008 - DNA, 17 bp, Homo sapiens
ccccaccagctgcagcc

SEQ ID NO: 4134009 - DNA, 20 bp, Homo sapiens
ccccacccacctccacccag

SEQ ID NO: 4134010 - DNA, 12 bp, Homo sapiens
ccccacccagga

SEQ ID NO: 4134011 - DNA, 16 bp, Homo sapiens
ccccaccccacacttg

SEQ ID NO: 4134012 - DNA, 13 bp, Homo sapiens
ccccacccccagc

SEQ ID NO: 4134013 - DNA, 23 bp, Homo sapiens
ccccaccccggggaccctgtgac

SEQ ID NO: 4134014 - DNA, 14 bp, Homo sapiens
ccccacccctccag

SEQ ID NO: 4134015 - DNA, 13 bp, Homo sapiens
ccccacccctgcc

SEQ ID NO: 4134016 - DNA, 23 bp, Homo sapiens
ccccacccctggaagagcccagt

SEQ ID NO: 4134017 - DNA, 18 bp, Homo sapiens
ccccaccctccctggagt

SEQ ID NO: 4134018 - DNA, 10 bp, Homo sapiens
ccccaccctg

SEQ ID NO: 4134019 - DNA, 11 bp, Homo sapiens
ccccaccctgc

SEQ ID NO: 4134020 - DNA, 20 bp, Homo sapiens
ccccaccctggtgggccaac

SEQ ID NO: 4134021 - DNA, 16 bp, Homo sapiens
ccccaccgagctggag

SEQ ID NO: 4134022 - DNA, 13 bp, Homo sapiens
ccccacctctcca

SEQ ID NO: 4134023 - DNA, 16 bp, Homo sapiens
ccccacgagggctggc

SEQ ID NO: 4134024 - DNA, 17 bp, Homo sapiens
ccccacgagggctggct

SEQ ID NO: 4134025 - DNA, 18 bp, Homo sapiens
ccccacgagggctggctg

SEQ ID NO: 4134026 - DNA, 21 bp, Homo sapiens
ccccacggggcctcgggacct

SEQ ID NO: 4134027 - DNA, 14 bp, Homo sapiens
ccccactactgcag

SEQ ID NO: 4134028 - DNA, 15 bp, Homo sapiens
ccccactgaccagaa

SEQ ID NO: 4134029 - DNA, 11 bp, Homo sapiens
ccccactgatg

SEQ ID NO: 4134030 - DNA, 13 bp, Homo sapiens
ccccactgatgct

SEQ ID NO: 4134031 - DNA, 19 bp, Homo sapiens
ccccactgatgctgttctc

SEQ ID NO: 4134032 - DNA, 17 bp, Homo sapiens
ccccactgccaagtggg

SEQ ID NO: 4134033 - DNA, 23 bp, Homo sapiens
ccccactgggccagccctgcagc

SEQ ID NO: 4134034 - DNA, 17 bp, Homo sapiens
ccccagaactctgcctg

SEQ ID NO: 4134035 - DNA, 10 bp, Homo sapiens
ccccagagag

SEQ ID NO: 4134036 - DNA, 18 bp, Homo sapiens
ccccagagaggcactcag

SEQ ID NO: 4134037 - DNA, 19 bp, Homo sapiens
ccccagagcccctcctcca

SEQ ID NO: 4134038 - DNA, 21 bp, Homo sapiens
ccccagagcccctcctccagc

SEQ ID NO: 4134039 - DNA, 11 bp, Homo sapiens
ccccagagctg

SEQ ID NO: 4134040 - DNA, 12 bp, Homo sapiens
ccccagagctgt

SEQ ID NO: 4134041 - DNA, 16 bp, Homo sapiens
ccccagatagagctgg

SEQ ID NO: 4134042 - DNA, 22 bp, Homo sapiens
ccccagatctcccactgcgggg

SEQ ID NO: 4134043 - DNA, 22 bp, Homo sapiens
ccccagcaacgcccctccaaac

SEQ ID NO: 4134044 - DNA, 22 bp, Homo sapiens
ccccagcaagcgggagcccgtg

SEQ ID NO: 4134045 - DNA, 11 bp, Homo sapiens
ccccagcactt

SEQ ID NO: 4134046 - DNA, 15 bp, Homo sapiens
ccccagcagaggcag

SEQ ID NO: 4134047 - DNA, 18 bp, Homo sapiens
ccccagcaggtgctgact

SEQ ID NO: 4134048 - DNA, 13 bp, Homo sapiens
ccccagcccagag

SEQ ID NO: 4134049 - DNA, 15 bp, Homo sapiens
ccccagcccagagac

SEQ ID NO: 4134050 - DNA, 16 bp, Homo sapiens
ccccagcccagagaca

SEQ ID NO: 4134051 - DNA, 23 bp, Homo sapiens
ccccagccccggtggctgggcag

SEQ ID NO: 4134052 - DNA, 20 bp, Homo sapiens
ccccagcccctcccccatct

SEQ ID NO: 4134053 - DNA, 20 bp, Homo sapiens
ccccagccctaatctcaccc

SEQ ID NO: 4134054 - DNA, 13 bp, Homo sapiens
ccccagccctggc

SEQ ID NO: 4134055 - DNA, 19 bp, Homo sapiens
ccccagccctggctctgca

SEQ ID NO: 4134056 - DNA, 15 bp, Homo sapiens
ccccagcctccctga

SEQ ID NO: 4134057 - DNA, 13 bp, Homo sapiens
ccccagcctcgcc

SEQ ID NO: 4134058 - DNA, 22 bp, Homo sapiens
ccccagcctcgcctgtcacccc

SEQ ID NO: 4134059 - DNA, 20 bp, Homo sapiens
ccccagcctgacctgagact

SEQ ID NO: 4134060 - DNA, 20 bp, Homo sapiens
ccccagcgctgacgtgtcag

SEQ ID NO: 4134061 - DNA, 23 bp, Homo sapiens
ccccagcggctgttccccctgcc

SEQ ID NO: 4134062 - DNA, 11 bp, Homo sapiens
ccccagctacc

SEQ ID NO: 4134063 - DNA, 11 bp, Homo sapiens
ccccagctccc

SEQ ID NO: 4134064 - DNA, 18 bp, Homo sapiens
ccccaggaccagctcagg

SEQ ID NO: 4134065 - DNA, 21 bp, Homo sapiens
ccccaggaccagctcaggaca

SEQ ID NO: 4134066 - DNA, 17 bp, Homo sapiens
ccccaggacctggctgc

SEQ ID NO: 4134067 - DNA, 13 bp, Homo sapiens
ccccaggccaggc

SEQ ID NO: 4134068 - DNA, 18 bp, Homo sapiens
ccccaggccccagacagg

SEQ ID NO: 4134069 - DNA, 15 bp, Homo sapiens
ccccaggccctccct

SEQ ID NO: 4134070 - DNA, 13 bp, Homo sapiens
ccccaggcccttc

SEQ ID NO: 4134071 - DNA, 17 bp, Homo sapiens
ccccaggcctctgtgtc

SEQ ID NO: 4134072 - DNA, 21 bp, Homo sapiens
ccccaggcctgaaagaggctg

SEQ ID NO: 4134073 - DNA, 23 bp, Homo sapiens
ccccaggcctgaaagaggctgag

SEQ ID NO: 4134074 - DNA, 22 bp, Homo sapiens
ccccaggctggacatgctgact

SEQ ID NO: 4134075 - DNA, 11 bp, Homo sapiens
ccccagggcac

SEQ ID NO: 4134076 - DNA, 15 bp, Homo sapiens
ccccagggcaccctg

SEQ ID NO: 4134077 - DNA, 14 bp, Homo sapiens
ccccagggccctgg

SEQ ID NO: 4134078 - DNA, 18 bp, Homo sapiens
ccccagggccctggccag

SEQ ID NO: 4134079 - DNA, 14 bp, Homo sapiens
ccccagggcctcca

SEQ ID NO: 4134080 - DNA, 17 bp, Homo sapiens
ccccagggcctccaggg

SEQ ID NO: 4134081 - DNA, 19 bp, Homo sapiens
ccccagggcctccagggcc

SEQ ID NO: 4134082 - DNA, 14 bp, Homo sapiens
ccccaggggcagga

SEQ ID NO: 4134083 - DNA, 17 bp, Homo sapiens
ccccaggggcaggactg

SEQ ID NO: 4134084 - DNA, 17 bp, Homo sapiens
ccccaggggtcccagcc

SEQ ID NO: 4134085 - DNA, 17 bp, Homo sapiens
ccccagtccccttcccg

SEQ ID NO: 4134086 - DNA, 15 bp, Homo sapiens
ccccagtgggatggg

SEQ ID NO: 4134087 - DNA, 23 bp, Homo sapiens
ccccagttctaggggagaagagc

SEQ ID NO: 4134088 - DNA, 16 bp, Homo sapiens
ccccataactcaatgg

SEQ ID NO: 4134089 - DNA, 17 bp, Homo sapiens
ccccatatacacctgga

SEQ ID NO: 4134090 - DNA, 20 bp, Homo sapiens
ccccatatacacctggaaca

SEQ ID NO: 4134091 - DNA, 18 bp, Homo sapiens
ccccatcagttcccccag

SEQ ID NO: 4134092 - DNA, 16 bp, Homo sapiens
ccccatcccacaccct

SEQ ID NO: 4134093 - DNA, 15 bp, Homo sapiens
ccccatccccaccag

SEQ ID NO: 4134094 - DNA, 11 bp, Homo sapiens
ccccatccctg

SEQ ID NO: 4134095 - DNA, 14 bp, Homo sapiens
ccccatcctcatcc

SEQ ID NO: 4134096 - DNA, 23 bp, Homo sapiens
ccccatctcatgcccctggctgg

SEQ ID NO: 4134097 - DNA, 19 bp, Homo sapiens
ccccatctctccctcccct

SEQ ID NO: 4134098 - DNA, 19 bp, Homo sapiens
ccccatctgggtccttgca

SEQ ID NO: 4134099 - DNA, 18 bp, Homo sapiens
ccccatgaggaaggaaca

SEQ ID NO: 4134100 - DNA, 12 bp, Homo sapiens
ccccatgcctgt

SEQ ID NO: 4134101 - DNA, 18 bp, Homo sapiens
ccccatgcctgtccagcc

SEQ ID NO: 4134102 - DNA, 19 bp, Homo sapiens
ccccatgcctgtccagcct

SEQ ID NO: 4134103 - DNA, 20 bp, Homo sapiens
ccccatgcctgtccagcctg

SEQ ID NO: 4134104 - DNA, 24 bp, Homo sapiens
ccccatgcctgtccagcctgggca

SEQ ID NO: 4134105 - DNA, 20 bp, Homo sapiens
ccccattcctgatcccatgg

SEQ ID NO: 4134106 - DNA, 22 bp, Homo sapiens
ccccattccttgcgcctcagcc

SEQ ID NO: 4134107 - DNA, 19 bp, Homo sapiens
ccccatttcccatctgcac

SEQ ID NO: 4134108 - DNA, 17 bp, Homo sapiens
ccccatttctatttatt

SEQ ID NO: 4134109 - DNA, 20 bp, Homo sapiens
ccccatttctatttatttac

SEQ ID NO: 4134110 - DNA, 14 bp, Homo sapiens
ccccatttgtccca

SEQ ID NO: 4134111 - DNA, 16 bp, Homo sapiens
ccccatttgtcccaga

SEQ ID NO: 4134112 - DNA, 22 bp, Homo sapiens
cccccaaacatagcccctgccc

SEQ ID NO: 4134113 - DNA, 14 bp, Homo sapiens
cccccaacctcagg

SEQ ID NO: 4134114 - DNA, 17 bp, Homo sapiens
cccccacacctcagttc

SEQ ID NO: 4134115 - DNA, 11 bp, Homo sapiens
cccccacccac

SEQ ID NO: 4134116 - DNA, 17 bp, Homo sapiens
cccccacccccagctca

SEQ ID NO: 4134117 - DNA, 13 bp, Homo sapiens
cccccaccctcca

SEQ ID NO: 4134118 - DNA, 16 bp, Homo sapiens
cccccagatagagctg

SEQ ID NO: 4134119 - DNA, 20 bp, Homo sapiens
cccccagatagagctgggtg

SEQ ID NO: 4134120 - DNA, 20 bp, Homo sapiens
cccccagcaacgcccctcca

SEQ ID NO: 4134121 - DNA, 13 bp, Homo sapiens
cccccagccccgg

SEQ ID NO: 4134122 - DNA, 15 bp, Homo sapiens
cccccagcctctggc

SEQ ID NO: 4134123 - DNA, 21 bp, Homo sapiens
cccccagctaagaacctggaa

SEQ ID NO: 4134124 - DNA, 14 bp, Homo sapiens
cccccagctgggtc

SEQ ID NO: 4134125 - DNA, 22 bp, Homo sapiens
cccccagtccccacccctgccc

SEQ ID NO: 4134126 - DNA, 19 bp, Homo sapiens
cccccagtgggatgggaca

SEQ ID NO: 4134127 - DNA, 19 bp, Homo sapiens
cccccatgggctcctgccc

SEQ ID NO: 4134128 - DNA, 11 bp, Homo sapiens
ccccccactct

SEQ ID NO: 4134129 - DNA, 12 bp, Homo sapiens
ccccccagcact

SEQ ID NO: 4134130 - DNA, 12 bp, Homo sapiens
ccccccagcctc

SEQ ID NO: 4134131 - DNA, 12 bp, Homo sapiens
ccccccagcttc

SEQ ID NO: 4134132 - DNA, 14 bp, Homo sapiens
ccccccatgcactg

SEQ ID NO: 4134133 - DNA, 21 bp, Homo sapiens
ccccctcatctcattcaaacc

SEQ ID NO: 4134134 - DNA, 16 bp, Homo sapiens
ccccctctgtcttgtg

SEQ ID NO: 4134135 - DNA, 22 bp, Homo sapiens
ccccctgccccccagcctctgg

SEQ ID NO: 4134136 - DNA, 13 bp, Homo sapiens
ccccctgccctgc

SEQ ID NO: 4134137 - DNA, 12 bp, Homo sapiens
ccccctgctggc

SEQ ID NO: 4134138 - DNA, 18 bp, Homo sapiens
ccccctgctggctcttct

SEQ ID NO: 4134139 - DNA, 16 bp, Homo sapiens
ccccctggtctctggt

SEQ ID NO: 4134140 - DNA, 12 bp, Homo sapiens
ccccctgtgcat

SEQ ID NO: 4134141 - DNA, 16 bp, Homo sapiens
cccccttccccttctg

SEQ ID NO: 4134142 - DNA, 22 bp, Homo sapiens
cccccttctctgctccaccaca

SEQ ID NO: 4134143 - DNA, 12 bp, Homo sapiens
ccccctttcctg

SEQ ID NO: 4134144 - DNA, 20 bp, Homo sapiens
ccccctttcctggacactca

SEQ ID NO: 4134145 - DNA, 16 bp, Homo sapiens
ccccctttcttcctca

SEQ ID NO: 4134146 - DNA, 22 bp, Homo sapiens
cccccttttcagctgagccctg

SEQ ID NO: 4134147 - DNA, 15 bp, Homo sapiens
ccccgagctgggggg

SEQ ID NO: 4134148 - DNA, 17 bp, Homo sapiens
ccccgaggtaggggtgg

SEQ ID NO: 4134149 - DNA, 16 bp, Homo sapiens
ccccgccagggctggg

SEQ ID NO: 4134150 - DNA, 13 bp, Homo sapiens
ccccgccatcctt

SEQ ID NO: 4134151 - DNA, 21 bp, Homo sapiens
ccccggacatactctctgcct

SEQ ID NO: 4134152 - DNA, 21 bp, Homo sapiens
ccccggccctgggctcggagg

SEQ ID NO: 4134153 - DNA, 16 bp, Homo sapiens
ccccgggctctctgct

SEQ ID NO: 4134154 - DNA, 17 bp, Homo sapiens
ccccgggctctctgctg

SEQ ID NO: 4134155 - DNA, 18 bp, Homo sapiens
ccccgggctctctgctgt

SEQ ID NO: 4134156 - DNA, 20 bp, Homo sapiens
ccccggtcacctagcaagct

SEQ ID NO: 4134157 - DNA, 17 bp, Homo sapiens
ccccggtggctgggcag

SEQ ID NO: 4134158 - DNA, 14 bp, Homo sapiens
ccccgtctgcccac

SEQ ID NO: 4134159 - DNA, 17 bp, Homo sapiens
cccctaaacccctgtcc

SEQ ID NO: 4134160 - DNA, 17 bp, Homo sapiens
cccctacacacacactc

SEQ ID NO: 4134161 - DNA, 13 bp, Homo sapiens
cccctacccaccg

SEQ ID NO: 4134162 - DNA, 14 bp, Homo sapiens
cccctactgctgtg

SEQ ID NO: 4134163 - DNA, 18 bp, Homo sapiens
cccctcaaatcgtccagc

SEQ ID NO: 4134164 - DNA, 23 bp, Homo sapiens
cccctcaagccccagcagccctc

SEQ ID NO: 4134165 - DNA, 13 bp, Homo sapiens
cccctcaccctgc

SEQ ID NO: 4134166 - DNA, 12 bp, Homo sapiens
cccctcacctcc

SEQ ID NO: 4134167 - DNA, 13 bp, Homo sapiens
cccctcacctcct

SEQ ID NO: 4134168 - DNA, 16 bp, Homo sapiens
cccctcactccccagg

SEQ ID NO: 4134169 - DNA, 21 bp, Homo sapiens
cccctcactccccagggagct

SEQ ID NO: 4134170 - DNA, 21 bp, Homo sapiens
cccctcactctgtcagccagc

SEQ ID NO: 4134171 - DNA, 21 bp, Homo sapiens
cccctcagatgatctctccac

SEQ ID NO: 4134172 - DNA, 20 bp, Homo sapiens
cccctcatctctctgcccaa

SEQ ID NO: 4134173 - DNA, 13 bp, Homo sapiens
cccctccaaacct

SEQ ID NO: 4134174 - DNA, 17 bp, Homo sapiens
cccctccaaacctccag

SEQ ID NO: 4134175 - DNA, 18 bp, Homo sapiens
cccctccaaacctccagc

SEQ ID NO: 4134176 - DNA, 23 bp, Homo sapiens
cccctccaatcccaccaaccctc

SEQ ID NO: 4134177 - DNA, 19 bp, Homo sapiens
cccctccacgcctcctggc

SEQ ID NO: 4134178 - DNA, 12 bp, Homo sapiens
cccctccactgt

SEQ ID NO: 4134179 - DNA, 14 bp, Homo sapiens
cccctccactgtca

SEQ ID NO: 4134180 - DNA, 11 bp, Homo sapiens
cccctccagga

SEQ ID NO: 4134181 - DNA, 21 bp, Homo sapiens
cccctccaggagggaccaccc

SEQ ID NO: 4134182 - DNA, 23 bp, Homo sapiens
cccctccattggctcccaagtca

SEQ ID NO: 4134183 - DNA, 21 bp, Homo sapiens
cccctcccccaacccccaccc

SEQ ID NO: 4134184 - DNA, 17 bp, Homo sapiens
cccctccggactggtgc

SEQ ID NO: 4134185 - DNA, 12 bp, Homo sapiens
cccctcctagac

SEQ ID NO: 4134186 - DNA, 17 bp, Homo sapiens
cccctcctccagcccct

SEQ ID NO: 4134187 - DNA, 21 bp, Homo sapiens
cccctcctctagctgtggggg

SEQ ID NO: 4134188 - DNA, 13 bp, Homo sapiens
cccctccttcaga

SEQ ID NO: 4134189 - DNA, 15 bp, Homo sapiens
cccctccttccctca

SEQ ID NO: 4134190 - DNA, 18 bp, Homo sapiens
cccctcgtgcgcatctca

SEQ ID NO: 4134191 - DNA, 12 bp, Homo sapiens
cccctctcacca

SEQ ID NO: 4134192 - DNA, 22 bp, Homo sapiens
cccctctgccggtcgggcagcc

SEQ ID NO: 4134193 - DNA, 18 bp, Homo sapiens
cccctcttattcctctag

SEQ ID NO: 4134194 - DNA, 15 bp, Homo sapiens
cccctgacctgtgag

SEQ ID NO: 4134195 - DNA, 20 bp, Homo sapiens
cccctgagatcccctgagcc

SEQ ID NO: 4134196 - DNA, 12 bp, Homo sapiens
cccctgccccca

SEQ ID NO: 4134197 - DNA, 12 bp, Homo sapiens
cccctgccctgc

SEQ ID NO: 4134198 - DNA, 13 bp, Homo sapiens
cccctgctcagca

SEQ ID NO: 4134199 - DNA, 19 bp, Homo sapiens
cccctgctccaccagcagc

SEQ ID NO: 4134200 - DNA, 16 bp, Homo sapiens
cccctgctcccagcct

SEQ ID NO: 4134201 - DNA, 21 bp, Homo sapiens
cccctgctcccattcctccct

SEQ ID NO: 4134202 - DNA, 14 bp, Homo sapiens
cccctgctggctct

SEQ ID NO: 4134203 - DNA, 22 bp, Homo sapiens
cccctgctggctcttctgccca

SEQ ID NO: 4134204 - DNA, 18 bp, Homo sapiens
cccctggaagagcccagt

SEQ ID NO: 4134205 - DNA, 11 bp, Homo sapiens
cccctggagcc

SEQ ID NO: 4134206 - DNA, 15 bp, Homo sapiens
cccctggcccatctc

SEQ ID NO: 4134207 - DNA, 20 bp, Homo sapiens
cccctggcccatctcagcct

SEQ ID NO: 4134208 - DNA, 17 bp, Homo sapiens
cccctggctttgcctct

SEQ ID NO: 4134209 - DNA, 21 bp, Homo sapiens
cccctggctttgcctcttctt

SEQ ID NO: 4134210 - DNA, 23 bp, Homo sapiens
cccctggcttttcactgctggct

SEQ ID NO: 4134211 - DNA, 16 bp, Homo sapiens
cccctgggcttggcct

SEQ ID NO: 4134212 - DNA, 19 bp, Homo sapiens
cccctgggcttggcctgct

SEQ ID NO: 4134213 - DNA, 15 bp, Homo sapiens
cccctggtctctggt

SEQ ID NO: 4134214 - DNA, 20 bp, Homo sapiens
cccctgtagactagtgccgt

SEQ ID NO: 4134215 - DNA, 22 bp, Homo sapiens
cccctgtccagattattggctg

SEQ ID NO: 4134216 - DNA, 20 bp, Homo sapiens
cccctgtcccacccacacag

SEQ ID NO: 4134217 - DNA, 22 bp, Homo sapiens
cccctgtcccatgcaggccctt

SEQ ID NO: 4134218 - DNA, 23 bp, Homo sapiens
cccctgtctccttattcggcagc

SEQ ID NO: 4134219 - DNA, 19 bp, Homo sapiens
cccctgtgtattcaccacc

SEQ ID NO: 4134220 - DNA, 15 bp, Homo sapiens
cccctgttcactcta

SEQ ID NO: 4134221 - DNA, 13 bp, Homo sapiens
ccccttcccattt

SEQ ID NO: 4134222 - DNA, 15 bp, Homo sapiens
ccccttcctgtttca

SEQ ID NO: 4134223 - DNA, 21 bp, Homo sapiens
ccccttctctccctgccagag

SEQ ID NO: 4134224 - DNA, 14 bp, Homo sapiens
ccccttctctcctc

SEQ ID NO: 4134225 - DNA, 15 bp, Homo sapiens
ccccttctctcctcc

SEQ ID NO: 4134226 - DNA, 12 bp, Homo sapiens
ccccttctctgc

SEQ ID NO: 4134227 - DNA, 16 bp, Homo sapiens
ccccttctctgctcca

SEQ ID NO: 4134228 - DNA, 14 bp, Homo sapiens
ccccttctgtgtca

SEQ ID NO: 4134229 - DNA, 13 bp, Homo sapiens
ccccttcttgggc

SEQ ID NO: 4134230 - DNA, 15 bp, Homo sapiens
ccccttcttgggccc

SEQ ID NO: 4134231 - DNA, 21 bp, Homo sapiens
ccccttgatttaaacacacag

SEQ ID NO: 4134232 - DNA, 20 bp, Homo sapiens
ccccttgccaccccaccctc

SEQ ID NO: 4134233 - DNA, 22 bp, Homo sapiens
cccctttcctggacactcagac

SEQ ID NO: 4134234 - DNA, 15 bp, Homo sapiens
cccctttcttcctca

SEQ ID NO: 4134235 - DNA, 20 bp, Homo sapiens
cccctttgatgattaattca

SEQ ID NO: 4134236 - DNA, 21 bp, Homo sapiens
cccgaagaatgaacccaagag

SEQ ID NO: 4134237 - DNA, 14 bp, Homo sapiens
cccgacagcctggc

SEQ ID NO: 4134238 - DNA, 15 bp, Homo sapiens
cccgacagcctggca

SEQ ID NO: 4134239 - DNA, 18 bp, Homo sapiens
cccgacagcctggcacag

SEQ ID NO: 4134240 - DNA, 12 bp, Homo sapiens
cccgactcctca

SEQ ID NO: 4134241 - DNA, 14 bp, Homo sapiens
cccgactcctcaaa

SEQ ID NO: 4134242 - DNA, 14 bp, Homo sapiens
cccgagaagtgctc

SEQ ID NO: 4134243 - DNA, 19 bp, Homo sapiens
cccgagaagtgctcttggc

SEQ ID NO: 4134244 - DNA, 18 bp, Homo sapiens
cccgagacacaggcacgg

SEQ ID NO: 4134245 - DNA, 18 bp, Homo sapiens
cccgagcaatggcgcctg

SEQ ID NO: 4134246 - DNA, 21 bp, Homo sapiens
cccgagcaatggcgcctgctc

SEQ ID NO: 4134247 - DNA, 23 bp, Homo sapiens
cccgagcaatggcgcctgctccc

SEQ ID NO: 4134248 - DNA, 13 bp, Homo sapiens
cccgagctcttgg

SEQ ID NO: 4134249 - DNA, 14 bp, Homo sapiens
cccgagctggtgca

SEQ ID NO: 4134250 - DNA, 22 bp, Homo sapiens
cccgagctggtgcattacagag

SEQ ID NO: 4134251 - DNA, 14 bp, Homo sapiens
cccgagctgtcccc

SEQ ID NO: 4134252 - DNA, 15 bp, Homo sapiens
cccgaggggagggca

SEQ ID NO: 4134253 - DNA, 12 bp, Homo sapiens
cccgcagtgctg

SEQ ID NO: 4134254 - DNA, 15 bp, Homo sapiens
cccgcagtgctggga

SEQ ID NO: 4134255 - DNA, 11 bp, Homo sapiens
cccgccagggc

SEQ ID NO: 4134256 - DNA, 15 bp, Homo sapiens
cccgccagggctggg

SEQ ID NO: 4134257 - DNA, 17 bp, Homo sapiens
cccgccagggctgggga

SEQ ID NO: 4134258 - DNA, 20 bp, Homo sapiens
cccgcccccacgtcgtgggg

SEQ ID NO: 4134259 - DNA, 17 bp, Homo sapiens
cccgcctcagggccagg

SEQ ID NO: 4134260 - DNA, 23 bp, Homo sapiens
cccgcctgagctcctgctgcgga

SEQ ID NO: 4134261 - DNA, 21 bp, Homo sapiens
cccgcctttagttctccactg

SEQ ID NO: 4134262 - DNA, 21 bp, Homo sapiens
cccgctcacaacttgggttct

SEQ ID NO: 4134263 - DNA, 12 bp, Homo sapiens
cccgctcagccc

SEQ ID NO: 4134264 - DNA, 14 bp, Homo sapiens
cccgctcagccctc

SEQ ID NO: 4134265 - DNA, 19 bp, Homo sapiens
cccgctcagccctccctgc

SEQ ID NO: 4134266 - DNA, 23 bp, Homo sapiens
cccgctcagccctccctgcccct

SEQ ID NO: 4134267 - DNA, 18 bp, Homo sapiens
cccgctccatggaaaagc

SEQ ID NO: 4134268 - DNA, 23 bp, Homo sapiens
cccgctcctgccgcagacgggca

SEQ ID NO: 4134269 - DNA, 19 bp, Homo sapiens
cccgctgcaatgcctagac

SEQ ID NO: 4134270 - DNA, 20 bp, Homo sapiens
cccggacatactctctgcct

SEQ ID NO: 4134271 - DNA, 19 bp, Homo sapiens
cccggagattggacggcct

SEQ ID NO: 4134272 - DNA, 17 bp, Homo sapiens
cccggaggggcctggca

SEQ ID NO: 4134273 - DNA, 18 bp, Homo sapiens
cccggaggggcctggcag

SEQ ID NO: 4134274 - DNA, 13 bp, Homo sapiens
cccggatgctgct

SEQ ID NO: 4134275 - DNA, 14 bp, Homo sapiens
cccggcagggcggg

SEQ ID NO: 4134276 - DNA, 16 bp, Homo sapiens
cccggccagcgggcac

SEQ ID NO: 4134277 - DNA, 19 bp, Homo sapiens
cccggccagcgggcacagg

SEQ ID NO: 4134278 - DNA, 23 bp, Homo sapiens
cccggccagcgggcacagggcac

SEQ ID NO: 4134279 - DNA, 24 bp, Homo sapiens
cccggccagcgggcacagggcacc

SEQ ID NO: 4134280 - DNA, 14 bp, Homo sapiens
cccggccggcctgg

SEQ ID NO: 4134281 - DNA, 16 bp, Homo sapiens
cccggccggcctggca

SEQ ID NO: 4134282 - DNA, 16 bp, Homo sapiens
cccggcctcagggcgc

SEQ ID NO: 4134283 - DNA, 21 bp, Homo sapiens
cccggcctgctcccagcagcc

SEQ ID NO: 4134284 - DNA, 17 bp, Homo sapiens
cccggctaatttttgta

SEQ ID NO: 4134285 - DNA, 21 bp, Homo sapiens
cccggctgggtcggccctgcc

SEQ ID NO: 4134286 - DNA, 15 bp, Homo sapiens
cccgggagggcggca

SEQ ID NO: 4134287 - DNA, 14 bp, Homo sapiens
cccgggccacgccc

SEQ ID NO: 4134288 - DNA, 16 bp, Homo sapiens
cccgggccacgcccca

SEQ ID NO: 4134289 - DNA, 16 bp, Homo sapiens
cccggggaccctgtga

SEQ ID NO: 4134290 - DNA, 18 bp, Homo sapiens
cccggggaccctgtgaca

SEQ ID NO: 4134291 - DNA, 18 bp, Homo sapiens
cccggttcagacccctgc

SEQ ID NO: 4134292 - DNA, 21 bp, Homo sapiens
cccgtacctcttcccatgact

SEQ ID NO: 4134293 - DNA, 20 bp, Homo sapiens
cccgtctgcccaccattccc

SEQ ID NO: 4134294 - DNA, 20 bp, Homo sapiens
cccgtgcatcccccctgctc

SEQ ID NO: 4134295 - DNA, 13 bp, Homo sapiens
cccgtgccctggt

SEQ ID NO: 4134296 - DNA, 21 bp, Homo sapiens
cccgtggtggcggtggctgcc

SEQ ID NO: 4134297 - DNA, 19 bp, Homo sapiens
ccctaaggatctctcagga

SEQ ID NO: 4134298 - DNA, 12 bp, Homo sapiens
ccctacacacac

SEQ ID NO: 4134299 - DNA, 13 bp, Homo sapiens
ccctacacacacc

SEQ ID NO: 4134300 - DNA, 13 bp, Homo sapiens
ccctacagcattg

SEQ ID NO: 4134301 - DNA, 12 bp, Homo sapiens
ccctacccaccg

SEQ ID NO: 4134302 - DNA, 18 bp, Homo sapiens
ccctaccgagtctcttct

SEQ ID NO: 4134303 - DNA, 22 bp, Homo sapiens
ccctacctgattggtgcaaccc

SEQ ID NO: 4134304 - DNA, 23 bp, Homo sapiens
ccctactattcagtggcgagaaa

SEQ ID NO: 4134305 - DNA, 22 bp, Homo sapiens
ccctactcattggggttccgca

SEQ ID NO: 4134306 - DNA, 14 bp, Homo sapiens
ccctactgctgtga

SEQ ID NO: 4134307 - DNA, 17 bp, Homo sapiens
ccctactgctgtgaacc

SEQ ID NO: 4134308 - DNA, 13 bp, Homo sapiens
ccctagactgcat

SEQ ID NO: 4134309 - DNA, 15 bp, Homo sapiens
ccctagagcctgcct

SEQ ID NO: 4134310 - DNA, 19 bp, Homo sapiens
ccctagctttagaccctgg

SEQ ID NO: 4134311 - DNA, 14 bp, Homo sapiens
ccctaggagaccaa

SEQ ID NO: 4134312 - DNA, 23 bp, Homo sapiens
ccctagggatttaaagggacacc

SEQ ID NO: 4134313 - DNA, 22 bp, Homo sapiens
ccctagtcccttcccctccctg

SEQ ID NO: 4134314 - DNA, 23 bp, Homo sapiens
ccctagttccctctgctcagcca

SEQ ID NO: 4134315 - DNA, 18 bp, Homo sapiens
ccctatagcactgagctc

SEQ ID NO: 4134316 - DNA, 22 bp, Homo sapiens
ccctatctattaaagtgacttt

SEQ ID NO: 4134317 - DNA, 20 bp, Homo sapiens
ccctatctccttcccacccc

SEQ ID NO: 4134318 - DNA, 14 bp, Homo sapiens
ccctatcttgtgaa

SEQ ID NO: 4134319 - DNA, 14 bp, Homo sapiens
ccctatgggcctgc

SEQ ID NO: 4134320 - DNA, 18 bp, Homo sapiens
ccctatggggatggtcca

SEQ ID NO: 4134321 - DNA, 20 bp, Homo sapiens
ccctatttagatgataaaga

SEQ ID NO: 4134322 - DNA, 15 bp, Homo sapiens
ccctcaaagaggcag

SEQ ID NO: 4134323 - DNA, 17 bp, Homo sapiens
ccctcaacaggcccagg

SEQ ID NO: 4134324 - DNA, 19 bp, Homo sapiens
ccctcaacaggcccaggga

SEQ ID NO: 4134325 - DNA, 21 bp, Homo sapiens
ccctcaacaggcccagggagg

SEQ ID NO: 4134326 - DNA, 23 bp, Homo sapiens
ccctcaagccccagcagccctca

SEQ ID NO: 4134327 - DNA, 17 bp, Homo sapiens
ccctcaatccaccttca

SEQ ID NO: 4134328 - DNA, 14 bp, Homo sapiens
ccctcacacacaca

SEQ ID NO: 4134329 - DNA, 20 bp, Homo sapiens
ccctcaccttggcaccagac

SEQ ID NO: 4134330 - DNA, 21 bp, Homo sapiens
ccctcaccttggcaccagaca

SEQ ID NO: 4134331 - DNA, 15 bp, Homo sapiens
ccctcactccccagg

SEQ ID NO: 4134332 - DNA, 9 bp, Homo sapiens
ccctcagaa

SEQ ID NO: 4134333 - DNA, 13 bp, Homo sapiens
ccctcagagccac

SEQ ID NO: 4134334 - DNA, 12 bp, Homo sapiens
ccctcagcctca

SEQ ID NO: 4134335 - DNA, 15 bp, Homo sapiens
ccctcagcctcagag

SEQ ID NO: 4134336 - DNA, 17 bp, Homo sapiens
ccctcagcctcagagga

SEQ ID NO: 4134337 - DNA, 20 bp, Homo sapiens
ccctcagcctcagaggagct

SEQ ID NO: 4134338 - DNA, 13 bp, Homo sapiens
ccctcaggactgc

SEQ ID NO: 4134339 - DNA, 20 bp, Homo sapiens
ccctcaggcataggcctggg

SEQ ID NO: 4134340 - DNA, 23 bp, Homo sapiens
ccctcaggcataggcctgggtgc

SEQ ID NO: 4134341 - DNA, 14 bp, Homo sapiens
ccctcagggagcct

SEQ ID NO: 4134342 - DNA, 17 bp, Homo sapiens
ccctcagggagcctccc

SEQ ID NO: 4134343 - DNA, 19 bp, Homo sapiens
ccctcaggttctattttct

SEQ ID NO: 4134344 - DNA, 18 bp, Homo sapiens
ccctcatgcccgccagtg

SEQ ID NO: 4134345 - DNA, 13 bp, Homo sapiens
ccctcatggcccc

SEQ ID NO: 4134346 - DNA, 21 bp, Homo sapiens
ccctcatggcccctctgacct

SEQ ID NO: 4134347 - DNA, 15 bp, Homo sapiens
ccctcatggctctgg

SEQ ID NO: 4134348 - DNA, 18 bp, Homo sapiens
ccctcattactgggcctt

SEQ ID NO: 4134349 - DNA, 19 bp, Homo sapiens
ccctccaaacctccagcct

SEQ ID NO: 4134350 - DNA, 12 bp, Homo sapiens
ccctccacacca

SEQ ID NO: 4134351 - DNA, 17 bp, Homo sapiens
ccctccacaccagtggc

SEQ ID NO: 4134352 - DNA, 19 bp, Homo sapiens
ccctccacatcccagcagc

SEQ ID NO: 4134353 - DNA, 15 bp, Homo sapiens
ccctccaccccacag

SEQ ID NO: 4134354 - DNA, 13 bp, Homo sapiens
ccctccacctcaa

SEQ ID NO: 4134355 - DNA, 12 bp, Homo sapiens
ccctccaccttc

SEQ ID NO: 4134356 - DNA, 12 bp, Homo sapiens
ccctccactgtc

SEQ ID NO: 4134357 - DNA, 12 bp, Homo sapiens
ccctccagcctt

SEQ ID NO: 4134358 - DNA, 13 bp, Homo sapiens
ccctccaggaaga

SEQ ID NO: 4134359 - DNA, 12 bp, Homo sapiens
ccctccaggagt

SEQ ID NO: 4134360 - DNA, 23 bp, Homo sapiens
ccctccattgggcacagtccaga

SEQ ID NO: 4134361 - DNA, 18 bp, Homo sapiens
ccctcccacactcgccat

SEQ ID NO: 4134362 - DNA, 12 bp, Homo sapiens
ccctcccacccc

SEQ ID NO: 4134363 - DNA, 21 bp, Homo sapiens
ccctcccagtcctccagacca

SEQ ID NO: 4134364 - DNA, 11 bp, Homo sapiens
ccctccccaga

SEQ ID NO: 4134365 - DNA, 12 bp, Homo sapiens
ccctccccagaa

SEQ ID NO: 4134366 - DNA, 14 bp, Homo sapiens
ccctccccatggag

SEQ ID NO: 4134367 - DNA, 21 bp, Homo sapiens
ccctcccccattccctccatt

SEQ ID NO: 4134368 - DNA, 18 bp, Homo sapiens
ccctcccccccatgcact

SEQ ID NO: 4134369 - DNA, 12 bp, Homo sapiens
ccctccccctca

SEQ ID NO: 4134370 - DNA, 15 bp, Homo sapiens
ccctcccccttcccc

SEQ ID NO: 4134371 - DNA, 15 bp, Homo sapiens
ccctcccccttgtcc

SEQ ID NO: 4134372 - DNA, 20 bp, Homo sapiens
ccctccctgactccctgtgg

SEQ ID NO: 4134373 - DNA, 21 bp, Homo sapiens
ccctccctgactccctgtggg

SEQ ID NO: 4134374 - DNA, 13 bp, Homo sapiens
ccctccctgactg

SEQ ID NO: 4134375 - DNA, 13 bp, Homo sapiens
ccctccctggagt

SEQ ID NO: 4134376 - DNA, 14 bp, Homo sapiens
ccctccctggctcc

SEQ ID NO: 4134377 - DNA, 17 bp, Homo sapiens
ccctcccttgctgaaca

SEQ ID NO: 4134378 - DNA, 21 bp, Homo sapiens
ccctccgaccacttccagggg

SEQ ID NO: 4134379 - DNA, 17 bp, Homo sapiens
ccctccgggtcttccta

SEQ ID NO: 4134380 - DNA, 16 bp, Homo sapiens
ccctcctagacccagg

SEQ ID NO: 4134381 - DNA, 19 bp, Homo sapiens
ccctcctagacccaggtgg

SEQ ID NO: 4134382 - DNA, 22 bp, Homo sapiens
ccctcctagacccaggtggagg

SEQ ID NO: 4134383 - DNA, 12 bp, Homo sapiens
ccctcctagctc

SEQ ID NO: 4134384 - DNA, 19 bp, Homo sapiens
ccctcctagctctcccagt

SEQ ID NO: 4134385 - DNA, 21 bp, Homo sapiens
ccctcctagctctcccagtga

SEQ ID NO: 4134386 - DNA, 17 bp, Homo sapiens
ccctcctcacctctgga

SEQ ID NO: 4134387 - DNA, 18 bp, Homo sapiens
ccctcctcacctctggac

SEQ ID NO: 4134388 - DNA, 23 bp, Homo sapiens
ccctcctcacctctggactggct

SEQ ID NO: 4134389 - DNA, 13 bp, Homo sapiens
ccctcctcctctt

SEQ ID NO: 4134390 - DNA, 12 bp, Homo sapiens
ccctcctcgggc

SEQ ID NO: 4134391 - DNA, 13 bp, Homo sapiens
ccctcctggctct

SEQ ID NO: 4134392 - DNA, 12 bp, Homo sapiens
ccctccttcaga

SEQ ID NO: 4134393 - DNA, 22 bp, Homo sapiens
ccctccttccctcacccccagc

SEQ ID NO: 4134394 - DNA, 14 bp, Homo sapiens
ccctccttctcctt

SEQ ID NO: 4134395 - DNA, 22 bp, Homo sapiens
ccctcgacagcgcccctgctgt

SEQ ID NO: 4134396 - DNA, 24 bp, Homo sapiens
ccctcgacagcgcccctgctgtct

SEQ ID NO: 4134397 - DNA, 12 bp, Homo sapiens
ccctcgcctgtg

SEQ ID NO: 4134398 - DNA, 14 bp, Homo sapiens
ccctcgtctttccc

SEQ ID NO: 4134399 - DNA, 15 bp, Homo sapiens
ccctcgtctttccca

SEQ ID NO: 4134400 - DNA, 17 bp, Homo sapiens
ccctctcagctccaggt

SEQ ID NO: 4134401 - DNA, 15 bp, Homo sapiens
ccctctcatctcagg

SEQ ID NO: 4134402 - DNA, 11 bp, Homo sapiens
ccctctccctg

SEQ ID NO: 4134403 - DNA, 19 bp, Homo sapiens
ccctctcctgcccagatgc

SEQ ID NO: 4134404 - DNA, 13 bp, Homo sapiens
ccctctcctgggg

SEQ ID NO: 4134405 - DNA, 12 bp, Homo sapiens
ccctctctcagc

SEQ ID NO: 4134406 - DNA, 13 bp, Homo sapiens
ccctctctctggg

SEQ ID NO: 4134407 - DNA, 20 bp, Homo sapiens
ccctctctgcagacttccca

SEQ ID NO: 4134408 - DNA, 17 bp, Homo sapiens
ccctctgacctgcactg

SEQ ID NO: 4134409 - DNA, 22 bp, Homo sapiens
ccctctgccggtcgggcagcca

SEQ ID NO: 4134410 - DNA, 23 bp, Homo sapiens
ccctctgccggtcgggcagccag

SEQ ID NO: 4134411 - DNA, 13 bp, Homo sapiens
ccctctgccttca

SEQ ID NO: 4134412 - DNA, 13 bp, Homo sapiens
ccctctgctcagc

SEQ ID NO: 4134413 - DNA, 19 bp, Homo sapiens
ccctctggattctgaatct

SEQ ID NO: 4134414 - DNA, 23 bp, Homo sapiens
ccctctgggcacgcctgctggcc

SEQ ID NO: 4134415 - DNA, 22 bp, Homo sapiens
ccctcttccctggtaagaaaaa

SEQ ID NO: 4134416 - DNA, 22 bp, Homo sapiens
ccctcttgacccatctccccct

SEQ ID NO: 4134417 - DNA, 16 bp, Homo sapiens
ccctcttgcccatcct

SEQ ID NO: 4134418 - DNA, 23 bp, Homo sapiens
ccctcttggtgtgattgcacaga

SEQ ID NO: 4134419 - DNA, 12 bp, Homo sapiens
ccctcttgtaag

SEQ ID NO: 4134420 - DNA, 11 bp, Homo sapiens
ccctctttccc

SEQ ID NO: 4134421 - DNA, 16 bp, Homo sapiens
ccctctttccctgcga

SEQ ID NO: 4134422 - DNA, 15 bp, Homo sapiens
ccctctttgctgcag

SEQ ID NO: 4134423 - DNA, 23 bp, Homo sapiens
ccctgaaaatgtttttctgccag

SEQ ID NO: 4134424 - DNA, 22 bp, Homo sapiens
ccctgacctccgcccctgcccc

SEQ ID NO: 4134425 - DNA, 16 bp, Homo sapiens
ccctgacctgtgagcc

SEQ ID NO: 4134426 - DNA, 16 bp, Homo sapiens
ccctgactccctgtgg

SEQ ID NO: 4134427 - DNA, 14 bp, Homo sapiens
ccctgactggcctg

SEQ ID NO: 4134428 - DNA, 14 bp, Homo sapiens
ccctgactggtgct

SEQ ID NO: 4134429 - DNA, 23 bp, Homo sapiens
ccctgagagtctggtctgcgcct

SEQ ID NO: 4134430 - DNA, 15 bp, Homo sapiens
ccctgagccagcagg

SEQ ID NO: 4134431 - DNA, 16 bp, Homo sapiens
ccctgagccagcaggg

SEQ ID NO: 4134432 - DNA, 19 bp, Homo sapiens
ccctgaggagccaggccgg

SEQ ID NO: 4134433 - DNA, 13 bp, Homo sapiens
ccctgaggccctg

SEQ ID NO: 4134434 - DNA, 16 bp, Homo sapiens
ccctgaggccctgggc

SEQ ID NO: 4134435 - DNA, 21 bp, Homo sapiens
ccctgaggccctgggctgggt

SEQ ID NO: 4134436 - DNA, 17 bp, Homo sapiens
ccctgaggcggaggctg

SEQ ID NO: 4134437 - DNA, 23 bp, Homo sapiens
ccctgaggcggaggctgtgctcc

SEQ ID NO: 4134438 - DNA, 21 bp, Homo sapiens
ccctgaggtcagggagtgctg

SEQ ID NO: 4134439 - DNA, 23 bp, Homo sapiens
ccctgagtgcgggctgaggccag

SEQ ID NO: 4134440 - DNA, 19 bp, Homo sapiens
ccctgagtggatctccaag

SEQ ID NO: 4134441 - DNA, 20 bp, Homo sapiens
ccctgagtggatctccaagg

SEQ ID NO: 4134442 - DNA, 22 bp, Homo sapiens
ccctgagtggatctccaaggac

SEQ ID NO: 4134443 - DNA, 16 bp, Homo sapiens
ccctgatcccattttc

SEQ ID NO: 4134444 - DNA, 17 bp, Homo sapiens
ccctgatgacacccacc

SEQ ID NO: 4134445 - DNA, 22 bp, Homo sapiens
ccctgatggcagaactcccaca

SEQ ID NO: 4134446 - DNA, 23 bp, Homo sapiens
ccctgatggcagaactcccacaa

SEQ ID NO: 4134447 - DNA, 16 bp, Homo sapiens
ccctgattgacctgct

SEQ ID NO: 4134448 - DNA, 17 bp, Homo sapiens
ccctgattgacctgctc

SEQ ID NO: 4134449 - DNA, 23 bp, Homo sapiens
ccctgattgacctgctccgctgc

SEQ ID NO: 4134450 - DNA, 23 bp, Homo sapiens
ccctgcaaaatttgatgccagga

SEQ ID NO: 4134451 - DNA, 22 bp, Homo sapiens
ccctgcaaacagaacagggtca

SEQ ID NO: 4134452 - DNA, 13 bp, Homo sapiens
ccctgcacagttg

SEQ ID NO: 4134453 - DNA, 19 bp, Homo sapiens
ccctgcactaaagccagcc

SEQ ID NO: 4134454 - DNA, 20 bp, Homo sapiens
ccctgcactaaagccagcct

SEQ ID NO: 4134455 - DNA, 12 bp, Homo sapiens
ccctgcagacct

SEQ ID NO: 4134456 - DNA, 13 bp, Homo sapiens
ccctgcagacctc

SEQ ID NO: 4134457 - DNA, 14 bp, Homo sapiens
ccctgcagacctca

SEQ ID NO: 4134458 - DNA, 17 bp, Homo sapiens
ccctgcagacctcaagc

SEQ ID NO: 4134459 - DNA, 23 bp, Homo sapiens
ccctgcagcccaaaacccagggc

SEQ ID NO: 4134460 - DNA, 13 bp, Homo sapiens
ccctgcatcccct

SEQ ID NO: 4134461 - DNA, 16 bp, Homo sapiens
ccctgccagaggggaa

SEQ ID NO: 4134462 - DNA, 10 bp, Homo sapiens
ccctgcccaa

SEQ ID NO: 4134463 - DNA, 16 bp, Homo sapiens
ccctgcccaagggcct

SEQ ID NO: 4134464 - DNA, 20 bp, Homo sapiens
ccctgcccaagggcctccca

SEQ ID NO: 4134465 - DNA, 21 bp, Homo sapiens
ccctgcccagatcagccagaa

SEQ ID NO: 4134466 - DNA, 18 bp, Homo sapiens
ccctgcccccagccccgg

SEQ ID NO: 4134467 - DNA, 17 bp, Homo sapiens
ccctgcccctcccttca

SEQ ID NO: 4134468 - DNA, 18 bp, Homo sapiens
ccctgcccctcccttcaa

SEQ ID NO: 4134469 - DNA, 18 bp, Homo sapiens
ccctgccctggtccaggg

SEQ ID NO: 4134470 - DNA, 17 bp, Homo sapiens
ccctgcctcagctgacc

SEQ ID NO: 4134471 - DNA, 13 bp, Homo sapiens
ccctgcctgaggg

SEQ ID NO: 4134472 - DNA, 13 bp, Homo sapiens
ccctgcctggccc

SEQ ID NO: 4134473 - DNA, 24 bp, Homo sapiens
ccctgccttgggccttgctgctgc

SEQ ID NO: 4134474 - DNA, 16 bp, Homo sapiens
ccctgcgcctccagag

SEQ ID NO: 4134475 - DNA, 13 bp, Homo sapiens
ccctgcggcctcc

SEQ ID NO: 4134476 - DNA, 17 bp, Homo sapiens
ccctgcggtagatggga

SEQ ID NO: 4134477 - DNA, 15 bp, Homo sapiens
ccctgcggtcaggct

SEQ ID NO: 4134478 - DNA, 22 bp, Homo sapiens
ccctgcgtgggggccagtcagg

SEQ ID NO: 4134479 - DNA, 15 bp, Homo sapiens
ccctgctcccagcct

SEQ ID NO: 4134480 - DNA, 21 bp, Homo sapiens
ccctgctcccattcctccctc

SEQ ID NO: 4134481 - DNA, 14 bp, Homo sapiens
ccctgctccctgct

SEQ ID NO: 4134482 - DNA, 18 bp, Homo sapiens
ccctgctccctgctttgg

SEQ ID NO: 4134483 - DNA, 14 bp, Homo sapiens
ccctgctcctcctg

SEQ ID NO: 4134484 - DNA, 21 bp, Homo sapiens
ccctgctctacccatgagcct

SEQ ID NO: 4134485 - DNA, 12 bp, Homo sapiens
ccctgctgccca

SEQ ID NO: 4134486 - DNA, 21 bp, Homo sapiens
ccctgctgcccaatctccatc

SEQ ID NO: 4134487 - DNA, 21 bp, Homo sapiens
ccctgctggctcttctgccca

SEQ ID NO: 4134488 - DNA, 17 bp, Homo sapiens
ccctgctgtgccatgct

SEQ ID NO: 4134489 - DNA, 14 bp, Homo sapiens
ccctgcttgcagga

SEQ ID NO: 4134490 - DNA, 17 bp, Homo sapiens
ccctgcttgcaggaggc

SEQ ID NO: 4134491 - DNA, 20 bp, Homo sapiens
ccctgcttgcaggaggccaa

SEQ ID NO: 4134492 - DNA, 16 bp, Homo sapiens
ccctgctttgcatctt

SEQ ID NO: 4134493 - DNA, 18 bp, Homo sapiens
ccctgctttggctgaggg

SEQ ID NO: 4134494 - DNA, 18 bp, Homo sapiens
ccctgctttgggctgccc

SEQ ID NO: 4134495 - DNA, 20 bp, Homo sapiens
ccctgctttgggctgccctg

SEQ ID NO: 4134496 - DNA, 18 bp, Homo sapiens
ccctggaagagcccagtc

SEQ ID NO: 4134497 - DNA, 21 bp, Homo sapiens
ccctggaaggacatccatgtt

SEQ ID NO: 4134498 - DNA, 13 bp, Homo sapiens
ccctggagcccct

SEQ ID NO: 4134499 - DNA, 15 bp, Homo sapiens
ccctggagccccttc

SEQ ID NO: 4134500 - DNA, 18 bp, Homo sapiens
ccctggagcctccactgc

SEQ ID NO: 4134501 - DNA, 21 bp, Homo sapiens
ccctggagtgtggctgaggag

SEQ ID NO: 4134502 - DNA, 22 bp, Homo sapiens
ccctggatcacgacgctgcaga

SEQ ID NO: 4134503 - DNA, 15 bp, Homo sapiens
ccctggcaggcaggg

SEQ ID NO: 4134504 - DNA, 22 bp, Homo sapiens
ccctggccactaaagcttcaga

SEQ ID NO: 4134505 - DNA, 22 bp, Homo sapiens
ccctggcccatctcagcctcct

SEQ ID NO: 4134506 - DNA, 13 bp, Homo sapiens
ccctggccccagg

SEQ ID NO: 4134507 - DNA, 14 bp, Homo sapiens
ccctggccccagga

SEQ ID NO: 4134508 - DNA, 20 bp, Homo sapiens
ccctggccgagtccaagctg

SEQ ID NO: 4134509 - DNA, 15 bp, Homo sapiens
ccctggcctctgtgc

SEQ ID NO: 4134510 - DNA, 18 bp, Homo sapiens
ccctggcctctgtgcctt

SEQ ID NO: 4134511 - DNA, 14 bp, Homo sapiens
ccctggcctgaact

SEQ ID NO: 4134512 - DNA, 19 bp, Homo sapiens
ccctggctcccacaggccc

SEQ ID NO: 4134513 - DNA, 20 bp, Homo sapiens
ccctggctcccacaggccct

SEQ ID NO: 4134514 - DNA, 23 bp, Homo sapiens
ccctggctcccatgaccatactg

SEQ ID NO: 4134515 - DNA, 12 bp, Homo sapiens
ccctggctccct

SEQ ID NO: 4134516 - DNA, 15 bp, Homo sapiens
ccctggctccctcct

SEQ ID NO: 4134517 - DNA, 19 bp, Homo sapiens
ccctggctctcagaaggta

SEQ ID NO: 4134518 - DNA, 13 bp, Homo sapiens
ccctggctttgcc

SEQ ID NO: 4134519 - DNA, 17 bp, Homo sapiens
ccctggctttgcctctt

SEQ ID NO: 4134520 - DNA, 18 bp, Homo sapiens
ccctggctttgcctcttc

SEQ ID NO: 4134521 - DNA, 20 bp, Homo sapiens
ccctggctttgcctcttctt

SEQ ID NO: 4134522 - DNA, 17 bp, Homo sapiens
ccctggcttttcactgc

SEQ ID NO: 4134523 - DNA, 19 bp, Homo sapiens
ccctggcttttcactgctg

SEQ ID NO: 4134524 - DNA, 14 bp, Homo sapiens
ccctgggagacaga

SEQ ID NO: 4134525 - DNA, 20 bp, Homo sapiens
ccctgggatgggaccaggga

SEQ ID NO: 4134526 - DNA, 15 bp, Homo sapiens
ccctgggcaggcggt

SEQ ID NO: 4134527 - DNA, 22 bp, Homo sapiens
ccctgggcaggcggtccccatc

SEQ ID NO: 4134528 - DNA, 12 bp, Homo sapiens
ccctgggccagg

SEQ ID NO: 4134529 - DNA, 16 bp, Homo sapiens
ccctgggccagggtct

SEQ ID NO: 4134530 - DNA, 19 bp, Homo sapiens
ccctgggcccctccacgcc

SEQ ID NO: 4134531 - DNA, 22 bp, Homo sapiens
ccctgggcccctccacgcctcc

SEQ ID NO: 4134532 - DNA, 17 bp, Homo sapiens
ccctgggctcggaggct

SEQ ID NO: 4134533 - DNA, 11 bp, Homo sapiens
ccctgggctgg

SEQ ID NO: 4134534 - DNA, 17 bp, Homo sapiens
ccctgggctggactgga

SEQ ID NO: 4134535 - DNA, 20 bp, Homo sapiens
ccctgggctggactggaggt

SEQ ID NO: 4134536 - DNA, 18 bp, Homo sapiens
ccctgggctgtctgtcac

SEQ ID NO: 4134537 - DNA, 21 bp, Homo sapiens
ccctgggcttggcctgctgtg

SEQ ID NO: 4134538 - DNA, 18 bp, Homo sapiens
ccctggggaaggagccag

SEQ ID NO: 4134539 - DNA, 17 bp, Homo sapiens
ccctggggacccccacg

SEQ ID NO: 4134540 - DNA, 17 bp, Homo sapiens
ccctggggcccagcccc

SEQ ID NO: 4134541 - DNA, 20 bp, Homo sapiens
ccctggggcctgactgctca

SEQ ID NO: 4134542 - DNA, 14 bp, Homo sapiens
ccctggggctgtgc

SEQ ID NO: 4134543 - DNA, 20 bp, Homo sapiens
ccctgggtgggctctgtgca

SEQ ID NO: 4134544 - DNA, 20 bp, Homo sapiens
ccctggtaagaaaaagcaaa

SEQ ID NO: 4134545 - DNA, 18 bp, Homo sapiens
ccctggtccagggaagct

SEQ ID NO: 4134546 - DNA, 14 bp, Homo sapiens
ccctggtctctggt

SEQ ID NO: 4134547 - DNA, 15 bp, Homo sapiens
ccctggtgaatcacc

SEQ ID NO: 4134548 - DNA, 17 bp, Homo sapiens
ccctggtgaatcacctg

SEQ ID NO: 4134549 - DNA, 20 bp, Homo sapiens
ccctggtgaatcacctggct

SEQ ID NO: 4134550 - DNA, 21 bp, Homo sapiens
ccctggtgaatcacctggctg

SEQ ID NO: 4134551 - DNA, 22 bp, Homo sapiens
ccctggtgaatcacctggctga

SEQ ID NO: 4134552 - DNA, 17 bp, Homo sapiens
ccctggtgctgccacac

SEQ ID NO: 4134553 - DNA, 20 bp, Homo sapiens
ccctgtacagtgttaccatc

SEQ ID NO: 4134554 - DNA, 20 bp, Homo sapiens
ccctgtacctcatcccatga

SEQ ID NO: 4134555 - DNA, 22 bp, Homo sapiens
ccctgtacctcatcccatgaga

SEQ ID NO: 4134556 - DNA, 19 bp, Homo sapiens
ccctgtaccttttgaggag

SEQ ID NO: 4134557 - DNA, 16 bp, Homo sapiens
ccctgtatcaccccct

SEQ ID NO: 4134558 - DNA, 19 bp, Homo sapiens
ccctgtcatttgaacctgg

SEQ ID NO: 4134559 - DNA, 22 bp, Homo sapiens
ccctgtcccacccccttccccc

SEQ ID NO: 4134560 - DNA, 17 bp, Homo sapiens
ccctgtcccatgcaggc

SEQ ID NO: 4134561 - DNA, 20 bp, Homo sapiens
ccctgtcccatgcaggccct

SEQ ID NO: 4134562 - DNA, 22 bp, Homo sapiens
ccctgtccctctagtgccttct

SEQ ID NO: 4134563 - DNA, 16 bp, Homo sapiens
ccctgtccctgtcccc

SEQ ID NO: 4134564 - DNA, 14 bp, Homo sapiens
ccctgtcctcatga

SEQ ID NO: 4134565 - DNA, 14 bp, Homo sapiens
ccctgtctctacta

SEQ ID NO: 4134566 - DNA, 19 bp, Homo sapiens
ccctgtcttctgggcacag

SEQ ID NO: 4134567 - DNA, 19 bp, Homo sapiens
ccctgtgacatggtgcctg

SEQ ID NO: 4134568 - DNA, 21 bp, Homo sapiens
ccctgtgacatggtgcctgag

SEQ ID NO: 4134569 - DNA, 24 bp, Homo sapiens
ccctgtgacatggtgcctgagagg

SEQ ID NO: 4134570 - DNA, 22 bp, Homo sapiens
ccctgtgcaacctcttggcctg

SEQ ID NO: 4134571 - DNA, 16 bp, Homo sapiens
ccctgtgtcatttcaa

SEQ ID NO: 4134572 - DNA, 20 bp, Homo sapiens
ccctgtgtgtaggctggggc

SEQ ID NO: 4134573 - DNA, 15 bp, Homo sapiens
ccctgtgttgtctct

SEQ ID NO: 4134574 - DNA, 16 bp, Homo sapiens
ccctgttcacgctcac

SEQ ID NO: 4134575 - DNA, 22 bp, Homo sapiens
ccctgttcacgctcacccagtc

SEQ ID NO: 4134576 - DNA, 14 bp, Homo sapiens
ccctgttcactcta

SEQ ID NO: 4134577 - DNA, 17 bp, Homo sapiens
ccctgttccccagagaa

SEQ ID NO: 4134578 - DNA, 14 bp, Homo sapiens
ccctgttcttcctc

SEQ ID NO: 4134579 - DNA, 21 bp, Homo sapiens
ccctgttcttcctccagctgc

SEQ ID NO: 4134580 - DNA, 16 bp, Homo sapiens
ccctgtttaatattta

SEQ ID NO: 4134581 - DNA, 19 bp, Homo sapiens
ccctgtttaatatttaaac

SEQ ID NO: 4134582 - DNA, 14 bp, Homo sapiens
ccctgttttatact

SEQ ID NO: 4134583 - DNA, 18 bp, Homo sapiens
ccctgttttctgtttctt

SEQ ID NO: 4134584 - DNA, 11 bp, Homo sapiens
cccttaaaatt

SEQ ID NO: 4134585 - DNA, 14 bp, Homo sapiens
cccttacacactca

SEQ ID NO: 4134586 - DNA, 19 bp, Homo sapiens
cccttacacactcaggcct

SEQ ID NO: 4134587 - DNA, 21 bp, Homo sapiens
cccttaccctttcctccttta

SEQ ID NO: 4134588 - DNA, 13 bp, Homo sapiens
cccttaccttccc

SEQ ID NO: 4134589 - DNA, 20 bp, Homo sapiens
cccttacttgcttctctagc

SEQ ID NO: 4134590 - DNA, 16 bp, Homo sapiens
cccttagaaaatgtgt

SEQ ID NO: 4134591 - DNA, 16 bp, Homo sapiens
cccttagcaccttcag

SEQ ID NO: 4134592 - DNA, 19 bp, Homo sapiens
cccttagcaccttcagggc

SEQ ID NO: 4134593 - DNA, 16 bp, Homo sapiens
cccttatccaggactc

SEQ ID NO: 4134594 - DNA, 18 bp, Homo sapiens
cccttattcctaatggct

SEQ ID NO: 4134595 - DNA, 16 bp, Homo sapiens
cccttcacagtgtttc

SEQ ID NO: 4134596 - DNA, 15 bp, Homo sapiens
cccttcagaccccag

SEQ ID NO: 4134597 - DNA, 21 bp, Homo sapiens
cccttcagtaccctctcagct

SEQ ID NO: 4134598 - DNA, 17 bp, Homo sapiens
cccttccacctgctctg

SEQ ID NO: 4134599 - DNA, 21 bp, Homo sapiens
cccttccatgtgcctttcttt

SEQ ID NO: 4134600 - DNA, 18 bp, Homo sapiens
cccttccatttctgcctt

SEQ ID NO: 4134601 - DNA, 15 bp, Homo sapiens
cccttcccctccctg

SEQ ID NO: 4134602 - DNA, 17 bp, Homo sapiens
cccttcccctccctggc

SEQ ID NO: 4134603 - DNA, 22 bp, Homo sapiens
cccttcccctccctggctccca

SEQ ID NO: 4134604 - DNA, 15 bp, Homo sapiens
cccttccccttcctt

SEQ ID NO: 4134605 - DNA, 13 bp, Homo sapiens
cccttccccttct

SEQ ID NO: 4134606 - DNA, 13 bp, Homo sapiens
cccttccctcacc

SEQ ID NO: 4134607 - DNA, 16 bp, Homo sapiens
cccttccctctgggca

SEQ ID NO: 4134608 - DNA, 13 bp, Homo sapiens
cccttccctgagt

SEQ ID NO: 4134609 - DNA, 14 bp, Homo sapiens
cccttccctgagtg

SEQ ID NO: 4134610 - DNA, 15 bp, Homo sapiens
cccttcctccatcct

SEQ ID NO: 4134611 - DNA, 13 bp, Homo sapiens
cccttcctctgct

SEQ ID NO: 4134612 - DNA, 19 bp, Homo sapiens
cccttcctggaggctgcct

SEQ ID NO: 4134613 - DNA, 11 bp, Homo sapiens
cccttccttta

SEQ ID NO: 4134614 - DNA, 15 bp, Homo sapiens
cccttctctgctcca

SEQ ID NO: 4134615 - DNA, 20 bp, Homo sapiens
cccttctctgctccaccaca

SEQ ID NO: 4134616 - DNA, 12 bp, Homo sapiens
cccttctcttcc

SEQ ID NO: 4134617 - DNA, 15 bp, Homo sapiens
cccttctcttccagg

SEQ ID NO: 4134618 - DNA, 12 bp, Homo sapiens
cccttctgtgtc

SEQ ID NO: 4134619 - DNA, 21 bp, Homo sapiens
cccttcttgggccccagaccc

SEQ ID NO: 4134620 - DNA, 21 bp, Homo sapiens
cccttcttggtgcttacacat

SEQ ID NO: 4134621 - DNA, 19 bp, Homo sapiens
cccttgcagctagttttct

SEQ ID NO: 4134622 - DNA, 15 bp, Homo sapiens
cccttgcctccccat

SEQ ID NO: 4134623 - DNA, 19 bp, Homo sapiens
cccttgcctccccatttcc

SEQ ID NO: 4134624 - DNA, 11 bp, Homo sapiens
cccttgcctct

SEQ ID NO: 4134625 - DNA, 13 bp, Homo sapiens
cccttgccttcct

SEQ ID NO: 4134626 - DNA, 22 bp, Homo sapiens
cccttgccttcctcagctgcct

SEQ ID NO: 4134627 - DNA, 21 bp, Homo sapiens
cccttgcctttcgaggcctga

SEQ ID NO: 4134628 - DNA, 14 bp, Homo sapiens
cccttgctctcagc

SEQ ID NO: 4134629 - DNA, 18 bp, Homo sapiens
cccttgctctcagctgcc

SEQ ID NO: 4134630 - DNA, 17 bp, Homo sapiens
cccttgctgaacacaca

SEQ ID NO: 4134631 - DNA, 14 bp, Homo sapiens
cccttgctgtatgc

SEQ ID NO: 4134632 - DNA, 13 bp, Homo sapiens
cccttgctttcct

SEQ ID NO: 4134633 - DNA, 12 bp, Homo sapiens
cccttggcccct

SEQ ID NO: 4134634 - DNA, 13 bp, Homo sapiens
cccttggcctcag

SEQ ID NO: 4134635 - DNA, 16 bp, Homo sapiens
cccttggcctgtctca

SEQ ID NO: 4134636 - DNA, 20 bp, Homo sapiens
cccttgggcagttctcactc

SEQ ID NO: 4134637 - DNA, 22 bp, Homo sapiens
cccttgtacagtgtctgtgcca

SEQ ID NO: 4134638 - DNA, 12 bp, Homo sapiens
cccttgttccag

SEQ ID NO: 4134639 - DNA, 13 bp, Homo sapiens
ccctttaccctct

SEQ ID NO: 4134640 - DNA, 23 bp, Homo sapiens
ccctttacttgtctttctggggt

SEQ ID NO: 4134641 - DNA, 16 bp, Homo sapiens
ccctttcagagacagc

SEQ ID NO: 4134642 - DNA, 9 bp, Homo sapiens
ccctttcct

SEQ ID NO: 4134643 - DNA, 14 bp, Homo sapiens
ccctttcctcctca

SEQ ID NO: 4134644 - DNA, 15 bp, Homo sapiens
ccctttccttccatc

SEQ ID NO: 4134645 - DNA, 18 bp, Homo sapiens
ccctttccttccatccct

SEQ ID NO: 4134646 - DNA, 14 bp, Homo sapiens
ccctttcttggcca

SEQ ID NO: 4134647 - DNA, 15 bp, Homo sapiens
ccctttgaagcctca

SEQ ID NO: 4134648 - DNA, 21 bp, Homo sapiens
ccctttgaagcctcagctacc

SEQ ID NO: 4134649 - DNA, 15 bp, Homo sapiens
ccctttgacttcagc

SEQ ID NO: 4134650 - DNA, 22 bp, Homo sapiens
ccctttgcctttcttctgccct

SEQ ID NO: 4134651 - DNA, 23 bp, Homo sapiens
ccctttgctgtgaggctgtcctg

SEQ ID NO: 4134652 - DNA, 24 bp, Homo sapiens
ccctttggagaacgccagtctccc

SEQ ID NO: 4134653 - DNA, 23 bp, Homo sapiens
ccctttggagatgctgagggtgt

SEQ ID NO: 4134654 - DNA, 20 bp, Homo sapiens
ccctttggtttttttcttct

SEQ ID NO: 4134655 - DNA, 12 bp, Homo sapiens
cccttttctcag

SEQ ID NO: 4134656 - DNA, 23 bp, Homo sapiens
ccctttttttcctttttctgatt

SEQ ID NO: 4134657 - DNA, 21 bp, Homo sapiens
ccgaagtggactggcccctgg

SEQ ID NO: 4134658 - DNA, 16 bp, Homo sapiens
ccgaatcccctccctg

SEQ ID NO: 4134659 - DNA, 19 bp, Homo sapiens
ccgaatcccctccctgtca

SEQ ID NO: 4134660 - DNA, 13 bp, Homo sapiens
ccgaatgtgcagg

SEQ ID NO: 4134661 - DNA, 22 bp, Homo sapiens
ccgacagcctggcacagggcag

SEQ ID NO: 4134662 - DNA, 13 bp, Homo sapiens
ccgaccaactgcc

SEQ ID NO: 4134663 - DNA, 14 bp, Homo sapiens
ccgaccaactgccc

SEQ ID NO: 4134664 - DNA, 13 bp, Homo sapiens
ccgacctggctgc

SEQ ID NO: 4134665 - DNA, 14 bp, Homo sapiens
ccgactctggccct

SEQ ID NO: 4134666 - DNA, 13 bp, Homo sapiens
ccgagacacaggc

SEQ ID NO: 4134667 - DNA, 13 bp, Homo sapiens
ccgagagggagag

SEQ ID NO: 4134668 - DNA, 22 bp, Homo sapiens
ccgagcgctggtcccctccctc

SEQ ID NO: 4134669 - DNA, 19 bp, Homo sapiens
ccgagcgctttctggaaaa

SEQ ID NO: 4134670 - DNA, 15 bp, Homo sapiens
ccgagctcttggcct

SEQ ID NO: 4134671 - DNA, 16 bp, Homo sapiens
ccgagctcttggcctt

SEQ ID NO: 4134672 - DNA, 20 bp, Homo sapiens
ccgagctcttggcctttgca

SEQ ID NO: 4134673 - DNA, 18 bp, Homo sapiens
ccgaggcgatgccacgct

SEQ ID NO: 4134674 - DNA, 16 bp, Homo sapiens
ccgagtctcttctcca

SEQ ID NO: 4134675 - DNA, 19 bp, Homo sapiens
ccgagtctcttctccactg

SEQ ID NO: 4134676 - DNA, 15 bp, Homo sapiens
ccgataatgcatgaa

SEQ ID NO: 4134677 - DNA, 18 bp, Homo sapiens
ccgataatgcatgaagca

SEQ ID NO: 4134678 - DNA, 20 bp, Homo sapiens
ccgcacatggtgtggggggc

SEQ ID NO: 4134679 - DNA, 17 bp, Homo sapiens
ccgcaccaggccgggct

SEQ ID NO: 4134680 - DNA, 17 bp, Homo sapiens
ccgcaccccggcctcag

SEQ ID NO: 4134681 - DNA, 19 bp, Homo sapiens
ccgcaccccggcctcaggg

SEQ ID NO: 4134682 - DNA, 14 bp, Homo sapiens
ccgcactaggggat

SEQ ID NO: 4134683 - DNA, 15 bp, Homo sapiens
ccgcagacgggcaca

SEQ ID NO: 4134684 - DNA, 17 bp, Homo sapiens
ccgcagacgggcacaga

SEQ ID NO: 4134685 - DNA, 20 bp, Homo sapiens
ccgcaggtgggtgctgccct

SEQ ID NO: 4134686 - DNA, 22 bp, Homo sapiens
ccgcaggtgggtgctgccctgt

SEQ ID NO: 4134687 - DNA, 16 bp, Homo sapiens
ccgcagtgctgggacc

SEQ ID NO: 4134688 - DNA, 17 bp, Homo sapiens
ccgcagtgctgggacca

SEQ ID NO: 4134689 - DNA, 19 bp, Homo sapiens
ccgcagtgctgggaccaga

SEQ ID NO: 4134690 - DNA, 11 bp, Homo sapiens
ccgccacagcc

SEQ ID NO: 4134691 - DNA, 14 bp, Homo sapiens
ccgccacagccttc

SEQ ID NO: 4134692 - DNA, 14 bp, Homo sapiens
ccgccacctcaggg

SEQ ID NO: 4134693 - DNA, 16 bp, Homo sapiens
ccgccacgtcccagca

SEQ ID NO: 4134694 - DNA, 11 bp, Homo sapiens
ccgccagcctc

SEQ ID NO: 4134695 - DNA, 13 bp, Homo sapiens
ccgccagcctcct

SEQ ID NO: 4134696 - DNA, 14 bp, Homo sapiens
ccgccagcctcctc

SEQ ID NO: 4134697 - DNA, 23 bp, Homo sapiens
ccgccagcctcctctggacggca

SEQ ID NO: 4134698 - DNA, 13 bp, Homo sapiens
ccgccagggctgg

SEQ ID NO: 4134699 - DNA, 16 bp, Homo sapiens
ccgccatggtgtcccg

SEQ ID NO: 4134700 - DNA, 14 bp, Homo sapiens
ccgccattgccacc

SEQ ID NO: 4134701 - DNA, 16 bp, Homo sapiens
ccgccattgccaccag

SEQ ID NO: 4134702 - DNA, 18 bp, Homo sapiens
ccgcccaaacctttcccc

SEQ ID NO: 4134703 - DNA, 12 bp, Homo sapiens
ccgccccagagt

SEQ ID NO: 4134704 - DNA, 17 bp, Homo sapiens
ccgccccgcgcacccca

SEQ ID NO: 4134705 - DNA, 13 bp, Homo sapiens
ccgccctgggctg

SEQ ID NO: 4134706 - DNA, 19 bp, Homo sapiens
ccgccctgggctggactgg

SEQ ID NO: 4134707 - DNA, 22 bp, Homo sapiens
ccgccctgggctggactggagg

SEQ ID NO: 4134708 - DNA, 18 bp, Homo sapiens
ccgcctagtttactgttt

SEQ ID NO: 4134709 - DNA, 14 bp, Homo sapiens
ccgcctcaaaatgt

SEQ ID NO: 4134710 - DNA, 21 bp, Homo sapiens
ccgcctcagggccaggcccag

SEQ ID NO: 4134711 - DNA, 16 bp, Homo sapiens
ccgcctgaatcattct

SEQ ID NO: 4134712 - DNA, 16 bp, Homo sapiens
ccgcctgccctcatgg

SEQ ID NO: 4134713 - DNA, 16 bp, Homo sapiens
ccgccttctcccacat

SEQ ID NO: 4134714 - DNA, 17 bp, Homo sapiens
ccgcgcaccccacgccc

SEQ ID NO: 4134715 - DNA, 20 bp, Homo sapiens
ccgcgcaccccacgccctgt

SEQ ID NO: 4134716 - DNA, 23 bp, Homo sapiens
ccgcgcctacccttcccgcctcc

SEQ ID NO: 4134717 - DNA, 16 bp, Homo sapiens
ccgcgctcgcccagca

SEQ ID NO: 4134718 - DNA, 18 bp, Homo sapiens
ccgcgctcgcccagcagg

SEQ ID NO: 4134719 - DNA, 19 bp, Homo sapiens
ccgcgctcgcccagcagga

SEQ ID NO: 4134720 - DNA, 11 bp, Homo sapiens
ccgctccagag

SEQ ID NO: 4134721 - DNA, 15 bp, Homo sapiens
ccgctccagagtcag

SEQ ID NO: 4134722 - DNA, 19 bp, Homo sapiens
ccgctctacatcttctgcc

SEQ ID NO: 4134723 - DNA, 20 bp, Homo sapiens
ccgctctacatcttctgcct

SEQ ID NO: 4134724 - DNA, 16 bp, Homo sapiens
ccgctgcaatgcctag

SEQ ID NO: 4134725 - DNA, 15 bp, Homo sapiens
ccgctgccagcacag

SEQ ID NO: 4134726 - DNA, 18 bp, Homo sapiens
ccgctgccagcacagagc

SEQ ID NO: 4134727 - DNA, 18 bp, Homo sapiens
ccgctgctccttggctta

SEQ ID NO: 4134728 - DNA, 11 bp, Homo sapiens
ccgctgctgct

SEQ ID NO: 4134729 - DNA, 22 bp, Homo sapiens
ccgctggcccttagagaccccg

SEQ ID NO: 4134730 - DNA, 20 bp, Homo sapiens
ccgctggccgggggaggtgg

SEQ ID NO: 4134731 - DNA, 15 bp, Homo sapiens
ccgctgtcgccccag

SEQ ID NO: 4134732 - DNA, 16 bp, Homo sapiens
ccgctgtcgccccagg

SEQ ID NO: 4134733 - DNA, 18 bp, Homo sapiens
ccgctgtcgccccaggcc

SEQ ID NO: 4134734 - DNA, 21 bp, Homo sapiens
ccgctgtcgccccaggccctc

SEQ ID NO: 4134735 - DNA, 15 bp, Homo sapiens
ccgcttctgcctgca

SEQ ID NO: 4134736 - DNA, 15 bp, Homo sapiens
ccggaaccacagggc

SEQ ID NO: 4134737 - DNA, 16 bp, Homo sapiens
ccggacactcctagag

SEQ ID NO: 4134738 - DNA, 23 bp, Homo sapiens
ccggacatactctctgcctggtg

SEQ ID NO: 4134739 - DNA, 16 bp, Homo sapiens
ccggactggtgccctc

SEQ ID NO: 4134740 - DNA, 17 bp, Homo sapiens
ccggagagggagtcagt

SEQ ID NO: 4134741 - DNA, 14 bp, Homo sapiens
ccggagatgtagca

SEQ ID NO: 4134742 - DNA, 15 bp, Homo sapiens
ccggaggggcctggc

SEQ ID NO: 4134743 - DNA, 17 bp, Homo sapiens
ccggaggggcctggcag

SEQ ID NO: 4134744 - DNA, 16 bp, Homo sapiens
ccggcagccagatggc

SEQ ID NO: 4134745 - DNA, 20 bp, Homo sapiens
ccggcagccagatggccccg

SEQ ID NO: 4134746 - DNA, 15 bp, Homo sapiens
ccggccagcgggcac

SEQ ID NO: 4134747 - DNA, 14 bp, Homo sapiens
ccggcccagttttg

SEQ ID NO: 4134748 - DNA, 14 bp, Homo sapiens
ccggcccccaggac

SEQ ID NO: 4134749 - DNA, 21 bp, Homo sapiens
ccggccccccgcgctcgccca

SEQ ID NO: 4134750 - DNA, 13 bp, Homo sapiens
ccggccccctggt

SEQ ID NO: 4134751 - DNA, 20 bp, Homo sapiens
ccggccccctggtctctggt

SEQ ID NO: 4134752 - DNA, 15 bp, Homo sapiens
ccggccggcctggca

SEQ ID NO: 4134753 - DNA, 19 bp, Homo sapiens
ccggcctctctgccccacc

SEQ ID NO: 4134754 - DNA, 16 bp, Homo sapiens
ccggcctgctcccagc

SEQ ID NO: 4134755 - DNA, 20 bp, Homo sapiens
ccggcctggatgccagctgt

SEQ ID NO: 4134756 - DNA, 22 bp, Homo sapiens
ccggcctggatgccagctgtgt

SEQ ID NO: 4134757 - DNA, 20 bp, Homo sapiens
ccggctgggtcggccctgcc

SEQ ID NO: 4134758 - DNA, 13 bp, Homo sapiens
ccggctgtggagc

SEQ ID NO: 4134759 - DNA, 15 bp, Homo sapiens
ccgggacagacctgg

SEQ ID NO: 4134760 - DNA, 17 bp, Homo sapiens
ccgggagaaggcatgag

SEQ ID NO: 4134761 - DNA, 20 bp, Homo sapiens
ccgggagcctccccctcaga

SEQ ID NO: 4134762 - DNA, 22 bp, Homo sapiens
ccgggcacggtcacacggccac

SEQ ID NO: 4134763 - DNA, 13 bp, Homo sapiens
ccgggcagagcac

SEQ ID NO: 4134764 - DNA, 17 bp, Homo sapiens
ccgggcatgtctgcctg

SEQ ID NO: 4134765 - DNA, 18 bp, Homo sapiens
ccgggccacgccccagcc

SEQ ID NO: 4134766 - DNA, 15 bp, Homo sapiens
ccgggccagggctgc

SEQ ID NO: 4134767 - DNA, 23 bp, Homo sapiens
ccgggccgaatcccctccctgtc

SEQ ID NO: 4134768 - DNA, 19 bp, Homo sapiens
ccgggcctggagaactaga

SEQ ID NO: 4134769 - DNA, 19 bp, Homo sapiens
ccgggcgcggccagccccg

SEQ ID NO: 4134770 - DNA, 20 bp, Homo sapiens
ccgggctacccgtgagccct

SEQ ID NO: 4134771 - DNA, 14 bp, Homo sapiens
ccgggctctctgct

SEQ ID NO: 4134772 - DNA, 12 bp, Homo sapiens
ccgggctctgca

SEQ ID NO: 4134773 - DNA, 15 bp, Homo sapiens
ccgggctgagggcct

SEQ ID NO: 4134774 - DNA, 16 bp, Homo sapiens
ccgggctgagggcctg

SEQ ID NO: 4134775 - DNA, 12 bp, Homo sapiens
ccgggcttgggc

SEQ ID NO: 4134776 - DNA, 18 bp, Homo sapiens
ccggggaagctgccagcc

SEQ ID NO: 4134777 - DNA, 22 bp, Homo sapiens
ccggggaagctgccagcccaga

SEQ ID NO: 4134778 - DNA, 16 bp, Homo sapiens
ccgggtgtggcctcag

SEQ ID NO: 4134779 - DNA, 17 bp, Homo sapiens
ccgggtgtggcctcagc

SEQ ID NO: 4134780 - DNA, 18 bp, Homo sapiens
ccgggtgtggcctcagcc

SEQ ID NO: 4134781 - DNA, 19 bp, Homo sapiens
ccgggttcagcctggcctg

SEQ ID NO: 4134782 - DNA, 20 bp, Homo sapiens
ccgggttcagcctggcctgc

SEQ ID NO: 4134783 - DNA, 21 bp, Homo sapiens
ccggtaactgtcctgtcctgc

SEQ ID NO: 4134784 - DNA, 19 bp, Homo sapiens
ccggtcacctagcaagctg

SEQ ID NO: 4134785 - DNA, 13 bp, Homo sapiens
ccggtcagtgcct

SEQ ID NO: 4134786 - DNA, 18 bp, Homo sapiens
ccggtcgggcagccagca

SEQ ID NO: 4134787 - DNA, 18 bp, Homo sapiens
ccggtggcctattccagg

SEQ ID NO: 4134788 - DNA, 18 bp, Homo sapiens
ccgtacattcaatgttta

SEQ ID NO: 4134789 - DNA, 15 bp, Homo sapiens
ccgtagggtctttct

SEQ ID NO: 4134790 - DNA, 21 bp, Homo sapiens
ccgtcaccacgactggccagg

SEQ ID NO: 4134791 - DNA, 17 bp, Homo sapiens
ccgtcatgttcctcaaa

SEQ ID NO: 4134792 - DNA, 23 bp, Homo sapiens
ccgtcccctccttccctcacccc

SEQ ID NO: 4134793 - DNA, 15 bp, Homo sapiens
ccgtctacagctccc

SEQ ID NO: 4134794 - DNA, 17 bp, Homo sapiens
ccgtctggacctgggga

SEQ ID NO: 4134795 - DNA, 17 bp, Homo sapiens
ccgtgaaaacggagctg

SEQ ID NO: 4134796 - DNA, 15 bp, Homo sapiens
ccgtgaaccagaggg

SEQ ID NO: 4134797 - DNA, 21 bp, Homo sapiens
ccgtgaactctggtgctcctg

SEQ ID NO: 4134798 - DNA, 17 bp, Homo sapiens
ccgtgatgctcaggctt

SEQ ID NO: 4134799 - DNA, 20 bp, Homo sapiens
ccgtgcatcccccctgctca

SEQ ID NO: 4134800 - DNA, 23 bp, Homo sapiens
ccgtgccaggagcaatgggactg

SEQ ID NO: 4134801 - DNA, 12 bp, Homo sapiens
ccgtgcccaggg

SEQ ID NO: 4134802 - DNA, 20 bp, Homo sapiens
ccgtgcccaggggcccacag

SEQ ID NO: 4134803 - DNA, 16 bp, Homo sapiens
ccgtgcctggccagat

SEQ ID NO: 4134804 - DNA, 13 bp, Homo sapiens
ccgtgcctggcta

SEQ ID NO: 4134805 - DNA, 16 bp, Homo sapiens
ccgtgctcgccccagc

SEQ ID NO: 4134806 - DNA, 17 bp, Homo sapiens
ccgtgctcgccccagca

SEQ ID NO: 4134807 - DNA, 13 bp, Homo sapiens
ccgtggacaggcc

SEQ ID NO: 4134808 - DNA, 17 bp, Homo sapiens
ccgtggacaggcccagc

SEQ ID NO: 4134809 - DNA, 21 bp, Homo sapiens
ccgtggacaggcccagcgcgg

SEQ ID NO: 4134810 - DNA, 11 bp, Homo sapiens
ccgtggatgcg

SEQ ID NO: 4134811 - DNA, 21 bp, Homo sapiens
ccgtggcttcccgctcagccc

SEQ ID NO: 4134812 - DNA, 11 bp, Homo sapiens
ccgtggtccaa

SEQ ID NO: 4134813 - DNA, 14 bp, Homo sapiens
ccgtggtccagctc

SEQ ID NO: 4134814 - DNA, 16 bp, Homo sapiens
ccgtggtccagctctt

SEQ ID NO: 4134815 - DNA, 13 bp, Homo sapiens
ccgtggtccctga

SEQ ID NO: 4134816 - DNA, 16 bp, Homo sapiens
ccgtgtctctgaggac

SEQ ID NO: 4134817 - DNA, 17 bp, Homo sapiens
ccgtgtctgtctggcac

SEQ ID NO: 4134818 - DNA, 18 bp, Homo sapiens
ccgtgtgagtgtgacagg

SEQ ID NO: 4134819 - DNA, 20 bp, Homo sapiens
ccgtgtgagtgtgacagggc

SEQ ID NO: 4134820 - DNA, 23 bp, Homo sapiens
ccgttacatctgtgcagggctgg

SEQ ID NO: 4134821 - DNA, 18 bp, Homo sapiens
ccgttctgctggcctgga

SEQ ID NO: 4134822 - DNA, 20 bp, Homo sapiens
ccgttctgttctgctgggag

SEQ ID NO: 4134823 - DNA, 21 bp, Homo sapiens
ccgtttgatttgtcactgctt

SEQ ID NO: 4134824 - DNA, 23 bp, Homo sapiens
ccgtttgatttgtcactgcttca

SEQ ID NO: 4134825 - DNA, 13 bp, Homo sapiens
ccgtttgcttttg

SEQ ID NO: 4134826 - DNA, 14 bp, Homo sapiens
cctaaaagtaaaca

SEQ ID NO: 4134827 - DNA, 18 bp, Homo sapiens
cctaaaataattggttct

SEQ ID NO: 4134828 - DNA, 20 bp, Homo sapiens
cctaaaatataatttttaat

SEQ ID NO: 4134829 - DNA, 18 bp, Homo sapiens
cctaaagacgtctctttt

SEQ ID NO: 4134830 - DNA, 19 bp, Homo sapiens
cctaaatagcagaaagaag

SEQ ID NO: 4134831 - DNA, 17 bp, Homo sapiens
cctaacattcgatctca

SEQ ID NO: 4134832 - DNA, 14 bp, Homo sapiens
cctaacttttcaat

SEQ ID NO: 4134833 - DNA, 15 bp, Homo sapiens
cctaagaaatatgtg

SEQ ID NO: 4134834 - DNA, 19 bp, Homo sapiens
cctaagaaatatgtgagat

SEQ ID NO: 4134835 - DNA, 13 bp, Homo sapiens
cctaagcccccag

SEQ ID NO: 4134836 - DNA, 16 bp, Homo sapiens
cctaagcccccagggc

SEQ ID NO: 4134837 - DNA, 17 bp, Homo sapiens
cctaagcccccagggcc

SEQ ID NO: 4134838 - DNA, 13 bp, Homo sapiens
cctaaggaacctt

SEQ ID NO: 4134839 - DNA, 16 bp, Homo sapiens
cctaaggaaccttcct

SEQ ID NO: 4134840 - DNA, 15 bp, Homo sapiens
cctaaggacacacta

SEQ ID NO: 4134841 - DNA, 17 bp, Homo sapiens
cctaaggatctctcagg

SEQ ID NO: 4134842 - DNA, 19 bp, Homo sapiens
cctaaggatctctcaggag

SEQ ID NO: 4134843 - DNA, 22 bp, Homo sapiens
cctaaggatctctcaggagcac

SEQ ID NO: 4134844 - DNA, 24 bp, Homo sapiens
cctaaggatctctcaggagcacag

SEQ ID NO: 4134845 - DNA, 19 bp, Homo sapiens
cctaagtggctgccttctt

SEQ ID NO: 4134846 - DNA, 23 bp, Homo sapiens
cctaagtgtttactatgtgccag

SEQ ID NO: 4134847 - DNA, 15 bp, Homo sapiens
cctaatccaggcaga

SEQ ID NO: 4134848 - DNA, 18 bp, Homo sapiens
cctaatccaggcagatcc

SEQ ID NO: 4134849 - DNA, 21 bp, Homo sapiens
cctaatccaggcagatccagg

SEQ ID NO: 4134850 - DNA, 15 bp, Homo sapiens
cctaatgagggtgtg

SEQ ID NO: 4134851 - DNA, 19 bp, Homo sapiens
cctaatggctatttttgaa

SEQ ID NO: 4134852 - DNA, 23 bp, Homo sapiens
cctaatgtctcactgttctgcaa

SEQ ID NO: 4134853 - DNA, 17 bp, Homo sapiens
cctaatgtcttcataaa

SEQ ID NO: 4134854 - DNA, 18 bp, Homo sapiens
cctaatgtttatgagcca

SEQ ID NO: 4134855 - DNA, 17 bp, Homo sapiens
cctaatttctcctccct

SEQ ID NO: 4134856 - DNA, 23 bp, Homo sapiens
cctaatttctcctcccttccttt

SEQ ID NO: 4134857 - DNA, 17 bp, Homo sapiens
cctacaaccatccctgc

SEQ ID NO: 4134858 - DNA, 19 bp, Homo sapiens
cctacaaccatccctgcca

SEQ ID NO: 4134859 - DNA, 12 bp, Homo sapiens
cctacacacaca

SEQ ID NO: 4134860 - DNA, 21 bp, Homo sapiens
cctacacacacactccctgct

SEQ ID NO: 4134861 - DNA, 20 bp, Homo sapiens
cctacagaacttcagaaaga

SEQ ID NO: 4134862 - DNA, 15 bp, Homo sapiens
cctacagcactactg

SEQ ID NO: 4134863 - DNA, 19 bp, Homo sapiens
cctacagcactactgggtg

SEQ ID NO: 4134864 - DNA, 21 bp, Homo sapiens
cctacagcactactgggtgtc

SEQ ID NO: 4134865 - DNA, 12 bp, Homo sapiens
cctacagcattg

SEQ ID NO: 4134866 - DNA, 21 bp, Homo sapiens
cctacagctttgatccctgac

SEQ ID NO: 4134867 - DNA, 16 bp, Homo sapiens
cctacattccctctcc

SEQ ID NO: 4134868 - DNA, 18 bp, Homo sapiens
cctacattccctctcctg

SEQ ID NO: 4134869 - DNA, 14 bp, Homo sapiens
cctaccacagtgtc

SEQ ID NO: 4134870 - DNA, 15 bp, Homo sapiens
cctacccaaccactc

SEQ ID NO: 4134871 - DNA, 18 bp, Homo sapiens
cctacccaccgatggagc

SEQ ID NO: 4134872 - DNA, 22 bp, Homo sapiens
cctaccccagggccctggccag

SEQ ID NO: 4134873 - DNA, 12 bp, Homo sapiens
cctaccccatag

SEQ ID NO: 4134874 - DNA, 16 bp, Homo sapiens
cctacgtccaaggtgg

SEQ ID NO: 4134875 - DNA, 19 bp, Homo sapiens
cctactatgtgctgggtgc

SEQ ID NO: 4134876 - DNA, 21 bp, Homo sapiens
cctactatgtgctgggtgcct

SEQ ID NO: 4134877 - DNA, 20 bp, Homo sapiens
cctactcctgactcctacct

SEQ ID NO: 4134878 - DNA, 13 bp, Homo sapiens
cctactcttctct

SEQ ID NO: 4134879 - DNA, 13 bp, Homo sapiens
cctactgaatgct

SEQ ID NO: 4134880 - DNA, 17 bp, Homo sapiens
cctactgggagactggg

SEQ ID NO: 4134881 - DNA, 21 bp, Homo sapiens
cctagacatggacgcaccggc

SEQ ID NO: 4134882 - DNA, 20 bp, Homo sapiens
cctagacttcccaacagcct

SEQ ID NO: 4134883 - DNA, 21 bp, Homo sapiens
cctagagaagataattgttga

SEQ ID NO: 4134884 - DNA, 17 bp, Homo sapiens
cctagagcctgcctgga

SEQ ID NO: 4134885 - DNA, 17 bp, Homo sapiens
cctagataaaaagatgg

SEQ ID NO: 4134886 - DNA, 16 bp, Homo sapiens
cctagcaagctggcct

SEQ ID NO: 4134887 - DNA, 17 bp, Homo sapiens
cctagcaagctggcctc

SEQ ID NO: 4134888 - DNA, 18 bp, Homo sapiens
cctagcaagctggcctct

SEQ ID NO: 4134889 - DNA, 21 bp, Homo sapiens
cctagcagagtgctggcactt

SEQ ID NO: 4134890 - DNA, 19 bp, Homo sapiens
cctagccaccagtgtcctc

SEQ ID NO: 4134891 - DNA, 15 bp, Homo sapiens
cctagcccttccctg

SEQ ID NO: 4134892 - DNA, 17 bp, Homo sapiens
cctagcccttccctgag

SEQ ID NO: 4134893 - DNA, 23 bp, Homo sapiens
cctagcctgtgcctctgggactg

SEQ ID NO: 4134894 - DNA, 15 bp, Homo sapiens
cctagccttgcttgt

SEQ ID NO: 4134895 - DNA, 19 bp, Homo sapiens
cctagcgatctctcctggc

SEQ ID NO: 4134896 - DNA, 22 bp, Homo sapiens
cctagcgatctctcctggccta

SEQ ID NO: 4134897 - DNA, 19 bp, Homo sapiens
cctagcggagcccagcctg

SEQ ID NO: 4134898 - DNA, 16 bp, Homo sapiens
cctagctctcccagtg

SEQ ID NO: 4134899 - DNA, 18 bp, Homo sapiens
cctagctctcccagtgaa

SEQ ID NO: 4134900 - DNA, 20 bp, Homo sapiens
cctagcttgggaggcttccc

SEQ ID NO: 4134901 - DNA, 23 bp, Homo sapiens
cctagctttagaccctgggtggg

SEQ ID NO: 4134902 - DNA, 20 bp, Homo sapiens
cctaggatgtcatgtctgct

SEQ ID NO: 4134903 - DNA, 15 bp, Homo sapiens
cctaggcccaggcct

SEQ ID NO: 4134904 - DNA, 18 bp, Homo sapiens
cctaggcccctcctagac

SEQ ID NO: 4134905 - DNA, 21 bp, Homo sapiens
cctaggcccctcctagaccca

SEQ ID NO: 4134906 - DNA, 22 bp, Homo sapiens
cctaggcccctcctagacccag

SEQ ID NO: 4134907 - DNA, 23 bp, Homo sapiens
cctaggcccctcctagacccagg

SEQ ID NO: 4134908 - DNA, 14 bp, Homo sapiens
cctagggaaaagtt

SEQ ID NO: 4134909 - DNA, 22 bp, Homo sapiens
cctaggggaacagaccagtgac

SEQ ID NO: 4134910 - DNA, 23 bp, Homo sapiens
cctaggggaacagaccagtgacc

SEQ ID NO: 4134911 - DNA, 20 bp, Homo sapiens
cctaggtagccccctcttcc

SEQ ID NO: 4134912 - DNA, 14 bp, Homo sapiens
cctaggtccaagcc

SEQ ID NO: 4134913 - DNA, 22 bp, Homo sapiens
cctaggttccctgttcttcctc

SEQ ID NO: 4134914 - DNA, 13 bp, Homo sapiens
cctagtactgccc

SEQ ID NO: 4134915 - DNA, 17 bp, Homo sapiens
cctagttccctctgctc

SEQ ID NO: 4134916 - DNA, 17 bp, Homo sapiens
cctatagcactgagctc

SEQ ID NO: 4134917 - DNA, 18 bp, Homo sapiens
cctatataataaagctac

SEQ ID NO: 4134918 - DNA, 16 bp, Homo sapiens
cctatatcctgtgact

SEQ ID NO: 4134919 - DNA, 19 bp, Homo sapiens
cctatattatcataagaat

SEQ ID NO: 4134920 - DNA, 16 bp, Homo sapiens
cctatcacctatttcc

SEQ ID NO: 4134921 - DNA, 17 bp, Homo sapiens
cctatccactgggcaca

SEQ ID NO: 4134922 - DNA, 18 bp, Homo sapiens
cctatccgctgccagcct

SEQ ID NO: 4134923 - DNA, 17 bp, Homo sapiens
cctatctcgtgggagag

SEQ ID NO: 4134924 - DNA, 18 bp, Homo sapiens
cctatctcgtgggagagc

SEQ ID NO: 4134925 - DNA, 18 bp, Homo sapiens
cctatcttttagttttag

SEQ ID NO: 4134926 - DNA, 16 bp, Homo sapiens
cctatgcccaggtacc

SEQ ID NO: 4134927 - DNA, 15 bp, Homo sapiens
cctatgtcctaagga

SEQ ID NO: 4134928 - DNA, 12 bp, Homo sapiens
cctatgttattt

SEQ ID NO: 4134929 - DNA, 22 bp, Homo sapiens
cctatgttgggggggaccctgc

SEQ ID NO: 4134930 - DNA, 15 bp, Homo sapiens
cctattctcaccagg

SEQ ID NO: 4134931 - DNA, 16 bp, Homo sapiens
cctattctcaccagga

SEQ ID NO: 4134932 - DNA, 19 bp, Homo sapiens
cctattctcaccaggaagg

SEQ ID NO: 4134933 - DNA, 22 bp, Homo sapiens
cctatttattaatattttacag

SEQ ID NO: 4134934 - DNA, 19 bp, Homo sapiens
cctatttcagtgttacctg

SEQ ID NO: 4134935 - DNA, 17 bp, Homo sapiens
cctatttgccatgggct

SEQ ID NO: 4134936 - DNA, 18 bp, Homo sapiens
cctcaaacgacagaggag

SEQ ID NO: 4134937 - DNA, 15 bp, Homo sapiens
cctcaaattttttga

SEQ ID NO: 4134938 - DNA, 16 bp, Homo sapiens
cctcaaattttttgac

SEQ ID NO: 4134939 - DNA, 22 bp, Homo sapiens
cctcaacaagggagagacctca

SEQ ID NO: 4134940 - DNA, 18 bp, Homo sapiens
cctcaacaggcccaggga

SEQ ID NO: 4134941 - DNA, 12 bp, Homo sapiens
cctcaacctctt

SEQ ID NO: 4134942 - DNA, 21 bp, Homo sapiens
cctcaactcacctaatgttta

SEQ ID NO: 4134943 - DNA, 20 bp, Homo sapiens
cctcaagccccagcagccct

SEQ ID NO: 4134944 - DNA, 18 bp, Homo sapiens
cctcaagccccatttcct

SEQ ID NO: 4134945 - DNA, 23 bp, Homo sapiens
cctcaaggacttgaaagcatcca

SEQ ID NO: 4134946 - DNA, 12 bp, Homo sapiens
cctcaataaata

SEQ ID NO: 4134947 - DNA, 18 bp, Homo sapiens
cctcaatagatctccagc

SEQ ID NO: 4134948 - DNA, 16 bp, Homo sapiens
cctcaatgtgaccagg

SEQ ID NO: 4134949 - DNA, 19 bp, Homo sapiens
cctcaatttttgtctcaga

SEQ ID NO: 4134950 - DNA, 17 bp, Homo sapiens
cctcacacaccctgagg

SEQ ID NO: 4134951 - DNA, 14 bp, Homo sapiens
cctcacacccctgt

SEQ ID NO: 4134952 - DNA, 12 bp, Homo sapiens
cctcacctcatg

SEQ ID NO: 4134953 - DNA, 15 bp, Homo sapiens
cctcacctcatgccc

SEQ ID NO: 4134954 - DNA, 22 bp, Homo sapiens
cctcacctcatgcccaccccct

SEQ ID NO: 4134955 - DNA, 13 bp, Homo sapiens
cctcacctcctct

SEQ ID NO: 4134956 - DNA, 14 bp, Homo sapiens
cctcacctcctcta

SEQ ID NO: 4134957 - DNA, 16 bp, Homo sapiens
cctcaccttggcacca

SEQ ID NO: 4134958 - DNA, 23 bp, Homo sapiens
cctcactatgacactgagcaaga

SEQ ID NO: 4134959 - DNA, 20 bp, Homo sapiens
cctcactatggtatgctggc

SEQ ID NO: 4134960 - DNA, 23 bp, Homo sapiens
cctcactatggtatgctggccag

SEQ ID NO: 4134961 - DNA, 13 bp, Homo sapiens
cctcactccacag

SEQ ID NO: 4134962 - DNA, 13 bp, Homo sapiens
cctcactccccag

SEQ ID NO: 4134963 - DNA, 15 bp, Homo sapiens
cctcactctgtcagc

SEQ ID NO: 4134964 - DNA, 17 bp, Homo sapiens
cctcactctgtcagcca

SEQ ID NO: 4134965 - DNA, 16 bp, Homo sapiens
cctcactgaaggacct

SEQ ID NO: 4134966 - DNA, 20 bp, Homo sapiens
cctcactgaaggacctgagc

SEQ ID NO: 4134967 - DNA, 14 bp, Homo sapiens
cctcactggatgaa

SEQ ID NO: 4134968 - DNA, 21 bp, Homo sapiens
cctcacttccatacagctcta

SEQ ID NO: 4134969 - DNA, 14 bp, Homo sapiens
cctcacttgaatgt

SEQ ID NO: 4134970 - DNA, 19 bp, Homo sapiens
cctcagaaagtcaccagga

SEQ ID NO: 4134971 - DNA, 20 bp, Homo sapiens
cctcagaccaactctctcct

SEQ ID NO: 4134972 - DNA, 17 bp, Homo sapiens
cctcagagccctgccct

SEQ ID NO: 4134973 - DNA, 20 bp, Homo sapiens
cctcagagccctgccctgca

SEQ ID NO: 4134974 - DNA, 15 bp, Homo sapiens
cctcagagcgccagg

SEQ ID NO: 4134975 - DNA, 19 bp, Homo sapiens
cctcagagcgccaggaagc

SEQ ID NO: 4134976 - DNA, 13 bp, Homo sapiens
cctcagaggcagc

SEQ ID NO: 4134977 - DNA, 21 bp, Homo sapiens
cctcagatgatctctccacgg

SEQ ID NO: 4134978 - DNA, 18 bp, Homo sapiens
cctcagcatttccttcca

SEQ ID NO: 4134979 - DNA, 20 bp, Homo sapiens
cctcagcatttccttccagc

SEQ ID NO: 4134980 - DNA, 21 bp, Homo sapiens
cctcagcatttccttccagcc

SEQ ID NO: 4134981 - DNA, 19 bp, Homo sapiens
cctcagccacacccaggca

SEQ ID NO: 4134982 - DNA, 15 bp, Homo sapiens
cctcagccctcagtt

SEQ ID NO: 4134983 - DNA, 15 bp, Homo sapiens
cctcagcctcagagg

SEQ ID NO: 4134984 - DNA, 21 bp, Homo sapiens
cctcagcctggccagacacag

SEQ ID NO: 4134985 - DNA, 17 bp, Homo sapiens
cctcagccttgccagag

SEQ ID NO: 4134986 - DNA, 13 bp, Homo sapiens
cctcagctaccca

SEQ ID NO: 4134987 - DNA, 20 bp, Homo sapiens
cctcagctacccactatcct

SEQ ID NO: 4134988 - DNA, 11 bp, Homo sapiens
cctcagctctg

SEQ ID NO: 4134989 - DNA, 13 bp, Homo sapiens
cctcagctctggg

SEQ ID NO: 4134990 - DNA, 15 bp, Homo sapiens
cctcagctctgggag

SEQ ID NO: 4134991 - DNA, 16 bp, Homo sapiens
cctcagctctgggaga

SEQ ID NO: 4134992 - DNA, 17 bp, Homo sapiens
cctcagctgacccggcc

SEQ ID NO: 4134993 - DNA, 20 bp, Homo sapiens
cctcagctggttactcaggg

SEQ ID NO: 4134994 - DNA, 13 bp, Homo sapiens
cctcaggactgca

SEQ ID NO: 4134995 - DNA, 18 bp, Homo sapiens
cctcaggactgcaacagg

SEQ ID NO: 4134996 - DNA, 17 bp, Homo sapiens
cctcaggcacacagcta

SEQ ID NO: 4134997 - DNA, 13 bp, Homo sapiens
cctcaggcagctc

SEQ ID NO: 4134998 - DNA, 19 bp, Homo sapiens
cctcaggcaggaagggcag

SEQ ID NO: 4134999 - DNA, 18 bp, Homo sapiens
cctcaggcataggcctgg

SEQ ID NO: 4135000 - DNA, 17 bp, Homo sapiens
cctcagggagcagggaa

SEQ ID NO: 4135001 - DNA, 19 bp, Homo sapiens
cctcagggagcagggaagg

SEQ ID NO: 4135002 - DNA, 20 bp, Homo sapiens
cctcagggagcagggaaggc

SEQ ID NO: 4135003 - DNA, 15 bp, Homo sapiens
cctcagggccaggcc

SEQ ID NO: 4135004 - DNA, 18 bp, Homo sapiens
cctcagggccaggcccag

SEQ ID NO: 4135005 - DNA, 22 bp, Homo sapiens
cctcagggccaggcccaggcct

SEQ ID NO: 4135006 - DNA, 21 bp, Homo sapiens
cctcaggggaaaactgttacc

SEQ ID NO: 4135007 - DNA, 13 bp, Homo sapiens
cctcagggtgggg

SEQ ID NO: 4135008 - DNA, 18 bp, Homo sapiens
cctcaggttctattttct

SEQ ID NO: 4135009 - DNA, 11 bp, Homo sapiens
cctcagtgtca

SEQ ID NO: 4135010 - DNA, 23 bp, Homo sapiens
cctcagttttatgccccattgga

SEQ ID NO: 4135011 - DNA, 19 bp, Homo sapiens
cctcatcaggatgaaccca

SEQ ID NO: 4135012 - DNA, 23 bp, Homo sapiens
cctcatcaggatgaacccaggac

SEQ ID NO: 4135013 - DNA, 16 bp, Homo sapiens
cctcatctatgaggaa

SEQ ID NO: 4135014 - DNA, 15 bp, Homo sapiens
cctcatctcccgagc

SEQ ID NO: 4135015 - DNA, 24 bp, Homo sapiens
cctcatctgagaggctctccgtgc

SEQ ID NO: 4135016 - DNA, 19 bp, Homo sapiens
cctcatgccaaccctgggc

SEQ ID NO: 4135017 - DNA, 21 bp, Homo sapiens
cctcatgcccaccccctgccc

SEQ ID NO: 4135018 - DNA, 24 bp, Homo sapiens
cctcatgcccaccccctgccctgc

SEQ ID NO: 4135019 - DNA, 17 bp, Homo sapiens
cctcatggcccccaggg

SEQ ID NO: 4135020 - DNA, 18 bp, Homo sapiens
cctcatggcccccagggg

SEQ ID NO: 4135021 - DNA, 19 bp, Homo sapiens
cctcatggcccccaggggc

SEQ ID NO: 4135022 - DNA, 18 bp, Homo sapiens
cctcatggcccctctgac

SEQ ID NO: 4135023 - DNA, 21 bp, Homo sapiens
cctcatgtacataccctggcc

SEQ ID NO: 4135024 - DNA, 18 bp, Homo sapiens
cctcatgttactcagtgt

SEQ ID NO: 4135025 - DNA, 22 bp, Homo sapiens
cctcattccctcgtctttccca

SEQ ID NO: 4135026 - DNA, 19 bp, Homo sapiens
cctccaaacctccagcctc

SEQ ID NO: 4135027 - DNA, 20 bp, Homo sapiens
cctccaaacctccagcctcc

SEQ ID NO: 4135028 - DNA, 17 bp, Homo sapiens
cctccaaaggcccccta

SEQ ID NO: 4135029 - DNA, 13 bp, Homo sapiens
cctccaagcacag

SEQ ID NO: 4135030 - DNA, 14 bp, Homo sapiens
cctccaagcacaga

SEQ ID NO: 4135031 - DNA, 23 bp, Homo sapiens
cctccaagcacagagcctggccc

SEQ ID NO: 4135032 - DNA, 21 bp, Homo sapiens
cctccaagtgccccctcacct

SEQ ID NO: 4135033 - DNA, 22 bp, Homo sapiens
cctccaagtgccccctcacctc

SEQ ID NO: 4135034 - DNA, 16 bp, Homo sapiens
cctccacacctgaact

SEQ ID NO: 4135035 - DNA, 11 bp, Homo sapiens
cctccacccag

SEQ ID NO: 4135036 - DNA, 19 bp, Homo sapiens
cctccacccagcccctggc

SEQ ID NO: 4135037 - DNA, 21 bp, Homo sapiens
cctccaccctcctcctcttca

SEQ ID NO: 4135038 - DNA, 19 bp, Homo sapiens
cctccacgcctcctggcca

SEQ ID NO: 4135039 - DNA, 19 bp, Homo sapiens
cctccactcccacctcacc

SEQ ID NO: 4135040 - DNA, 12 bp, Homo sapiens
cctccagaactc

SEQ ID NO: 4135041 - DNA, 12 bp, Homo sapiens
cctccagaagcc

SEQ ID NO: 4135042 - DNA, 13 bp, Homo sapiens
cctccagaagcct

SEQ ID NO: 4135043 - DNA, 20 bp, Homo sapiens
cctccagaagcctctggcta

SEQ ID NO: 4135044 - DNA, 21 bp, Homo sapiens
cctccagaagcctctggctag

SEQ ID NO: 4135045 - DNA, 22 bp, Homo sapiens
cctccagaatggaactcaagct

SEQ ID NO: 4135046 - DNA, 18 bp, Homo sapiens
cctccagcccctgtccca

SEQ ID NO: 4135047 - DNA, 15 bp, Homo sapiens
cctccagcctccctg

SEQ ID NO: 4135048 - DNA, 16 bp, Homo sapiens
cctccagcctccctgt

SEQ ID NO: 4135049 - DNA, 23 bp, Homo sapiens
cctccagcctgcccaagcccagg

SEQ ID NO: 4135050 - DNA, 22 bp, Homo sapiens
cctccagcctttggccttggct

SEQ ID NO: 4135051 - DNA, 17 bp, Homo sapiens
cctccaggaagaagcag

SEQ ID NO: 4135052 - DNA, 19 bp, Homo sapiens
cctccaggagcttcttgtt

SEQ ID NO: 4135053 - DNA, 16 bp, Homo sapiens
cctccaggagggacca

SEQ ID NO: 4135054 - DNA, 12 bp, Homo sapiens
cctccaggcctg

SEQ ID NO: 4135055 - DNA, 15 bp, Homo sapiens
cctccaggcctgcct

SEQ ID NO: 4135056 - DNA, 20 bp, Homo sapiens
cctccaggcctgcctcccac

SEQ ID NO: 4135057 - DNA, 17 bp, Homo sapiens
cctccaggcctgttgct

SEQ ID NO: 4135058 - DNA, 17 bp, Homo sapiens
cctccatccatccttcc

SEQ ID NO: 4135059 - DNA, 14 bp, Homo sapiens
cctccatgctcctc

SEQ ID NO: 4135060 - DNA, 19 bp, Homo sapiens
cctccatgctcctcacctg

SEQ ID NO: 4135061 - DNA, 20 bp, Homo sapiens
cctccatgctcctcacctgt

SEQ ID NO: 4135062 - DNA, 20 bp, Homo sapiens
cctccattctattttagaat

SEQ ID NO: 4135063 - DNA, 20 bp, Homo sapiens
cctccattggctcccaagtc

SEQ ID NO: 4135064 - DNA, 21 bp, Homo sapiens
cctccattgggcacagtccag

SEQ ID NO: 4135065 - DNA, 20 bp, Homo sapiens
cctcccaaagtgctgagatt

SEQ ID NO: 4135066 - DNA, 19 bp, Homo sapiens
cctcccaaggtcctctcag

SEQ ID NO: 4135067 - DNA, 15 bp, Homo sapiens
cctcccacactccca

SEQ ID NO: 4135068 - DNA, 16 bp, Homo sapiens
cctcccacactcccaa

SEQ ID NO: 4135069 - DNA, 13 bp, Homo sapiens
cctcccaccccca

SEQ ID NO: 4135070 - DNA, 13 bp, Homo sapiens
cctcccagtcctc

SEQ ID NO: 4135071 - DNA, 21 bp, Homo sapiens
cctcccagtgagactgcccca

SEQ ID NO: 4135072 - DNA, 19 bp, Homo sapiens
cctcccatccttccctcat

SEQ ID NO: 4135073 - DNA, 12 bp, Homo sapiens
cctccccagaat

SEQ ID NO: 4135074 - DNA, 21 bp, Homo sapiens
cctccccatctgtccagctgg

SEQ ID NO: 4135075 - DNA, 14 bp, Homo sapiens
cctccccatttccc

SEQ ID NO: 4135076 - DNA, 20 bp, Homo sapiens
cctccccatttcccatctgc

SEQ ID NO: 4135077 - DNA, 19 bp, Homo sapiens
cctcccccatctcccaccc

SEQ ID NO: 4135078 - DNA, 17 bp, Homo sapiens
cctcccccattccctcc

SEQ ID NO: 4135079 - DNA, 17 bp, Homo sapiens
cctcccccccatgcact

SEQ ID NO: 4135080 - DNA, 19 bp, Homo sapiens
cctcccccccatgcactgt

SEQ ID NO: 4135081 - DNA, 11 bp, Homo sapiens
cctccccctgc

SEQ ID NO: 4135082 - DNA, 13 bp, Homo sapiens
cctccccctgcaa

SEQ ID NO: 4135083 - DNA, 12 bp, Homo sapiens
cctccccgcccc

SEQ ID NO: 4135084 - DNA, 14 bp, Homo sapiens
cctccccgcccctg

SEQ ID NO: 4135085 - DNA, 15 bp, Homo sapiens
cctccccgcccctgt

SEQ ID NO: 4135086 - DNA, 14 bp, Homo sapiens
cctcccctcccagt

SEQ ID NO: 4135087 - DNA, 13 bp, Homo sapiens
cctcccctgccct

SEQ ID NO: 4135088 - DNA, 14 bp, Homo sapiens
cctccccttcccag

SEQ ID NO: 4135089 - DNA, 14 bp, Homo sapiens
cctcccggccctgc

SEQ ID NO: 4135090 - DNA, 16 bp, Homo sapiens
cctcccggtgcccaag

SEQ ID NO: 4135091 - DNA, 14 bp, Homo sapiens
cctccctacacaca

SEQ ID NO: 4135092 - DNA, 16 bp, Homo sapiens
cctccctacacacaca

SEQ ID NO: 4135093 - DNA, 12 bp, Homo sapiens
cctccctccttg

SEQ ID NO: 4135094 - DNA, 13 bp, Homo sapiens
cctccctccttgg

SEQ ID NO: 4135095 - DNA, 15 bp, Homo sapiens
cctccctccttgggt

SEQ ID NO: 4135096 - DNA, 13 bp, Homo sapiens
cctccctctaatt

SEQ ID NO: 4135097 - DNA, 19 bp, Homo sapiens
cctccctgaagcctttgca

SEQ ID NO: 4135098 - DNA, 18 bp, Homo sapiens
cctccctgactccctgtg

SEQ ID NO: 4135099 - DNA, 12 bp, Homo sapiens
cctccctgcctg

SEQ ID NO: 4135100 - DNA, 12 bp, Homo sapiens
cctccctgctgt

SEQ ID NO: 4135101 - DNA, 23 bp, Homo sapiens
cctccctggagtgtggctgagga

SEQ ID NO: 4135102 - DNA, 14 bp, Homo sapiens
cctccctggctccc

SEQ ID NO: 4135103 - DNA, 18 bp, Homo sapiens
cctccctggctcccatga

SEQ ID NO: 4135104 - DNA, 19 bp, Homo sapiens
cctccctgtatcaccccct

SEQ ID NO: 4135105 - DNA, 12 bp, Homo sapiens
cctccctgtcaa

SEQ ID NO: 4135106 - DNA, 18 bp, Homo sapiens
cctccctgttccccagag

SEQ ID NO: 4135107 - DNA, 19 bp, Homo sapiens
cctccctgttccccagaga

SEQ ID NO: 4135108 - DNA, 20 bp, Homo sapiens
cctccctgttccccagagaa

SEQ ID NO: 4135109 - DNA, 13 bp, Homo sapiens
cctcccttacaga

SEQ ID NO: 4135110 - DNA, 13 bp, Homo sapiens
cctcccttccttt

SEQ ID NO: 4135111 - DNA, 17 bp, Homo sapiens
cctcccttccttttccc

SEQ ID NO: 4135112 - DNA, 22 bp, Homo sapiens
cctcccttccttttccctgctt

SEQ ID NO: 4135113 - DNA, 13 bp, Homo sapiens
cctcccttgctga

SEQ ID NO: 4135114 - DNA, 20 bp, Homo sapiens
cctcccttgctgaacacaca

SEQ ID NO: 4135115 - DNA, 19 bp, Homo sapiens
cctcccttgggttctgata

SEQ ID NO: 4135116 - DNA, 20 bp, Homo sapiens
cctccgaccacttccagggg

SEQ ID NO: 4135117 - DNA, 22 bp, Homo sapiens
cctccgaccctcatggccccca

SEQ ID NO: 4135118 - DNA, 14 bp, Homo sapiens
cctccgagagggag

SEQ ID NO: 4135119 - DNA, 19 bp, Homo sapiens
cctccgagagggagagaga

SEQ ID NO: 4135120 - DNA, 23 bp, Homo sapiens
cctccgtagggtctttcttggga

SEQ ID NO: 4135121 - DNA, 17 bp, Homo sapiens
cctccgtgatccatcca

SEQ ID NO: 4135122 - DNA, 20 bp, Homo sapiens
cctcctagggaaaagttcat

SEQ ID NO: 4135123 - DNA, 13 bp, Homo sapiens
cctcctcacctca

SEQ ID NO: 4135124 - DNA, 15 bp, Homo sapiens
cctcctcacctcatg

SEQ ID NO: 4135125 - DNA, 14 bp, Homo sapiens
cctcctcacctctg

SEQ ID NO: 4135126 - DNA, 15 bp, Homo sapiens
cctcctcacctctgg

SEQ ID NO: 4135127 - DNA, 19 bp, Homo sapiens
cctcctcaggcacacagct

SEQ ID NO: 4135128 - DNA, 21 bp, Homo sapiens
cctcctcaggcacacagctac

SEQ ID NO: 4135129 - DNA, 13 bp, Homo sapiens
cctcctcatcccg

SEQ ID NO: 4135130 - DNA, 20 bp, Homo sapiens
cctcctcatgtacataccct

SEQ ID NO: 4135131 - DNA, 18 bp, Homo sapiens
cctcctccagcccctgtc

SEQ ID NO: 4135132 - DNA, 14 bp, Homo sapiens
cctcctcctcttca

SEQ ID NO: 4135133 - DNA, 17 bp, Homo sapiens
cctcctcctcttcacca

SEQ ID NO: 4135134 - DNA, 18 bp, Homo sapiens
cctcctcggagagcagca

SEQ ID NO: 4135135 - DNA, 17 bp, Homo sapiens
cctcctcgggccgaggc

SEQ ID NO: 4135136 - DNA, 18 bp, Homo sapiens
cctcctcgggccgaggcc

SEQ ID NO: 4135137 - DNA, 21 bp, Homo sapiens
cctcctcgggccgaggcccag

SEQ ID NO: 4135138 - DNA, 17 bp, Homo sapiens
cctcctctgcctacagc

SEQ ID NO: 4135139 - DNA, 18 bp, Homo sapiens
cctcctctgcctacagcc

SEQ ID NO: 4135140 - DNA, 17 bp, Homo sapiens
cctcctctgtctgccct

SEQ ID NO: 4135141 - DNA, 16 bp, Homo sapiens
cctcctgccccacact

SEQ ID NO: 4135142 - DNA, 12 bp, Homo sapiens
cctcctgcctca

SEQ ID NO: 4135143 - DNA, 18 bp, Homo sapiens
cctcctgcctcagccttc

SEQ ID NO: 4135144 - DNA, 14 bp, Homo sapiens
cctcctgctgccag

SEQ ID NO: 4135145 - DNA, 16 bp, Homo sapiens
cctcctgctgccagta

SEQ ID NO: 4135146 - DNA, 19 bp, Homo sapiens
cctcctgctgccagtacca

SEQ ID NO: 4135147 - DNA, 13 bp, Homo sapiens
cctcctggccaga

SEQ ID NO: 4135148 - DNA, 14 bp, Homo sapiens
cctcctggccagac

SEQ ID NO: 4135149 - DNA, 23 bp, Homo sapiens
cctcctgggaagatgaggttctg

SEQ ID NO: 4135150 - DNA, 12 bp, Homo sapiens
cctcctgtgcct

SEQ ID NO: 4135151 - DNA, 13 bp, Homo sapiens
cctcctgtgcctg

SEQ ID NO: 4135152 - DNA, 14 bp, Homo sapiens
cctcctgtgcctgg

SEQ ID NO: 4135153 - DNA, 17 bp, Homo sapiens
cctcctgtgcctggccc

SEQ ID NO: 4135154 - DNA, 14 bp, Homo sapiens
cctcctgtggcctg

SEQ ID NO: 4135155 - DNA, 13 bp, Homo sapiens
cctccttcagaca

SEQ ID NO: 4135156 - DNA, 18 bp, Homo sapiens
cctccttccacctccctc

SEQ ID NO: 4135157 - DNA, 15 bp, Homo sapiens
cctccttccctcacc

SEQ ID NO: 4135158 - DNA, 17 bp, Homo sapiens
cctccttccctcacccc

SEQ ID NO: 4135159 - DNA, 23 bp, Homo sapiens
cctccttccctcacccccagcac

SEQ ID NO: 4135160 - DNA, 17 bp, Homo sapiens
cctccttctcccttttt

SEQ ID NO: 4135161 - DNA, 17 bp, Homo sapiens
cctccttgcccagacta

SEQ ID NO: 4135162 - DNA, 19 bp, Homo sapiens
cctcctttcatcacactgg

SEQ ID NO: 4135163 - DNA, 13 bp, Homo sapiens
cctcctttctgtg

SEQ ID NO: 4135164 - DNA, 14 bp, Homo sapiens
cctcctttctgtgc

SEQ ID NO: 4135165 - DNA, 16 bp, Homo sapiens
cctcctttctgtgccc

SEQ ID NO: 4135166 - DNA, 22 bp, Homo sapiens
cctcctttctgtgccctactca

SEQ ID NO: 4135167 - DNA, 16 bp, Homo sapiens
cctcgaaacacagaaa

SEQ ID NO: 4135168 - DNA, 22 bp, Homo sapiens
cctcgacagggcctggagcccc

SEQ ID NO: 4135169 - DNA, 13 bp, Homo sapiens
cctcgcctgtcac

SEQ ID NO: 4135170 - DNA, 14 bp, Homo sapiens
cctcgcctgtcacc

SEQ ID NO: 4135171 - DNA, 22 bp, Homo sapiens
cctcgcctgtggagctcagccc

SEQ ID NO: 4135172 - DNA, 18 bp, Homo sapiens
cctcgctcaccgctggcc

SEQ ID NO: 4135173 - DNA, 19 bp, Homo sapiens
cctcgctcaccgctggccc

SEQ ID NO: 4135174 - DNA, 12 bp, Homo sapiens
cctcgctgcttc

SEQ ID NO: 4135175 - DNA, 14 bp, Homo sapiens
cctcggagagcagc

SEQ ID NO: 4135176 - DNA, 15 bp, Homo sapiens
cctcggagagcagca

SEQ ID NO: 4135177 - DNA, 17 bp, Homo sapiens
cctcggagagcagcagc

SEQ ID NO: 4135178 - DNA, 19 bp, Homo sapiens
cctcggagagcagcagcac

SEQ ID NO: 4135179 - DNA, 21 bp, Homo sapiens
cctcggagagcagcagcacca

SEQ ID NO: 4135180 - DNA, 15 bp, Homo sapiens
cctcggcttgtgggc

SEQ ID NO: 4135181 - DNA, 17 bp, Homo sapiens
cctcggcttgtgggctg

SEQ ID NO: 4135182 - DNA, 19 bp, Homo sapiens
cctcggcttgtgggctggt

SEQ ID NO: 4135183 - DNA, 16 bp, Homo sapiens
cctcgggaagcagcca

SEQ ID NO: 4135184 - DNA, 18 bp, Homo sapiens
cctcgggaagcagccagc

SEQ ID NO: 4135185 - DNA, 19 bp, Homo sapiens
cctcgggccgaggcccagc

SEQ ID NO: 4135186 - DNA, 20 bp, Homo sapiens
cctcgggccgaggcccagcg

SEQ ID NO: 4135187 - DNA, 12 bp, Homo sapiens
cctcgtccaccc

SEQ ID NO: 4135188 - DNA, 17 bp, Homo sapiens
cctcgtgcctgggggag

SEQ ID NO: 4135189 - DNA, 19 bp, Homo sapiens
cctcgtgcctgggggagag

SEQ ID NO: 4135190 - DNA, 20 bp, Homo sapiens
cctcgtgcctgggggagaga

SEQ ID NO: 4135191 - DNA, 22 bp, Homo sapiens
cctcgtggttattagcaaggct

SEQ ID NO: 4135192 - DNA, 21 bp, Homo sapiens
cctcgttcctttctcctgttt

SEQ ID NO: 4135193 - DNA, 14 bp, Homo sapiens
cctctaaagcagag

SEQ ID NO: 4135194 - DNA, 18 bp, Homo sapiens
cctctaaagcagaggcaa

SEQ ID NO: 4135195 - DNA, 14 bp, Homo sapiens
cctctaagccactc

SEQ ID NO: 4135196 - DNA, 19 bp, Homo sapiens
cctctaagccactcttcca

SEQ ID NO: 4135197 - DNA, 21 bp, Homo sapiens
cctctaatctgagctgcagcc

SEQ ID NO: 4135198 - DNA, 19 bp, Homo sapiens
cctctagaaatttttcaga

SEQ ID NO: 4135199 - DNA, 16 bp, Homo sapiens
cctctagaagccaagg

SEQ ID NO: 4135200 - DNA, 18 bp, Homo sapiens
cctctagaagccaaggga

SEQ ID NO: 4135201 - DNA, 22 bp, Homo sapiens
cctctagctgtgggggtgaggg

SEQ ID NO: 4135202 - DNA, 21 bp, Homo sapiens
cctctagtaagatgcactgaa

SEQ ID NO: 4135203 - DNA, 13 bp, Homo sapiens
cctctagtgcctt

SEQ ID NO: 4135204 - DNA, 20 bp, Homo sapiens
cctctatacatctctcccca

SEQ ID NO: 4135205 - DNA, 16 bp, Homo sapiens
cctctcactagtgcca

SEQ ID NO: 4135206 - DNA, 17 bp, Homo sapiens
cctctcactagtgccaa

SEQ ID NO: 4135207 - DNA, 19 bp, Homo sapiens
cctctcactagtgccaatg

SEQ ID NO: 4135208 - DNA, 12 bp, Homo sapiens
cctctcactgcc

SEQ ID NO: 4135209 - DNA, 17 bp, Homo sapiens
cctctcagaggcctgct

SEQ ID NO: 4135210 - DNA, 19 bp, Homo sapiens
cctctcagaggcctgctgc

SEQ ID NO: 4135211 - DNA, 15 bp, Homo sapiens
cctctcagggcctgg

SEQ ID NO: 4135212 - DNA, 16 bp, Homo sapiens
cctctccaagtctctc

SEQ ID NO: 4135213 - DNA, 22 bp, Homo sapiens
cctctccaagtctctctgtgaa

SEQ ID NO: 4135214 - DNA, 13 bp, Homo sapiens
cctctccactgcc

SEQ ID NO: 4135215 - DNA, 19 bp, Homo sapiens
cctctccccagcccagaga

SEQ ID NO: 4135216 - DNA, 18 bp, Homo sapiens
cctctccccctcctccag

SEQ ID NO: 4135217 - DNA, 20 bp, Homo sapiens
cctctccccctcctccaggg

SEQ ID NO: 4135218 - DNA, 22 bp, Homo sapiens
cctctccccctcctccagggaa

SEQ ID NO: 4135219 - DNA, 12 bp, Homo sapiens
cctctcccctcc

SEQ ID NO: 4135220 - DNA, 17 bp, Homo sapiens
cctctcccctccagcct

SEQ ID NO: 4135221 - DNA, 17 bp, Homo sapiens
cctctcccgcaccaggc

SEQ ID NO: 4135222 - DNA, 22 bp, Homo sapiens
cctctcccgccagactgttaga

SEQ ID NO: 4135223 - DNA, 13 bp, Homo sapiens
cctctccctgttg

SEQ ID NO: 4135224 - DNA, 13 bp, Homo sapiens
cctctcctgccca

SEQ ID NO: 4135225 - DNA, 14 bp, Homo sapiens
cctctcctgcccag

SEQ ID NO: 4135226 - DNA, 16 bp, Homo sapiens
cctctcctgcccagat

SEQ ID NO: 4135227 - DNA, 14 bp, Homo sapiens
cctctcctgccctg

SEQ ID NO: 4135228 - DNA, 14 bp, Homo sapiens
cctctcgagcccag

SEQ ID NO: 4135229 - DNA, 19 bp, Homo sapiens
cctctctactggagtggaa

SEQ ID NO: 4135230 - DNA, 13 bp, Homo sapiens
cctctctcagcac

SEQ ID NO: 4135231 - DNA, 16 bp, Homo sapiens
cctctctcagcacagc

SEQ ID NO: 4135232 - DNA, 18 bp, Homo sapiens
cctctctcagcacagcct

SEQ ID NO: 4135233 - DNA, 13 bp, Homo sapiens
cctctctctgggc

SEQ ID NO: 4135234 - DNA, 20 bp, Homo sapiens
cctctctcttctgctccacc

SEQ ID NO: 4135235 - DNA, 23 bp, Homo sapiens
cctctctctttcctccacccata

SEQ ID NO: 4135236 - DNA, 19 bp, Homo sapiens
cctctctgagtctggactt

SEQ ID NO: 4135237 - DNA, 16 bp, Homo sapiens
cctctctgatgtccca

SEQ ID NO: 4135238 - DNA, 19 bp, Homo sapiens
cctctctgatgtcccagtg

SEQ ID NO: 4135239 - DNA, 20 bp, Homo sapiens
cctctctgatgtcccagtgc

SEQ ID NO: 4135240 - DNA, 17 bp, Homo sapiens
cctctctgcagacttcc

SEQ ID NO: 4135241 - DNA, 14 bp, Homo sapiens
cctctctgccccac

SEQ ID NO: 4135242 - DNA, 16 bp, Homo sapiens
cctctctgccccaccc

SEQ ID NO: 4135243 - DNA, 13 bp, Homo sapiens
cctctctgggcct

SEQ ID NO: 4135244 - DNA, 23 bp, Homo sapiens
cctctctgtagtttatggcagaa

SEQ ID NO: 4135245 - DNA, 12 bp, Homo sapiens
cctctctgtccc

SEQ ID NO: 4135246 - DNA, 17 bp, Homo sapiens
cctctctgtcccttgct

SEQ ID NO: 4135247 - DNA, 20 bp, Homo sapiens
cctctcttatagaatattta

SEQ ID NO: 4135248 - DNA, 17 bp, Homo sapiens
cctctcttccccttccc

SEQ ID NO: 4135249 - DNA, 14 bp, Homo sapiens
cctctgacctgcac

SEQ ID NO: 4135250 - DNA, 24 bp, Homo sapiens
cctctgactctgagtccactgctc

SEQ ID NO: 4135251 - DNA, 12 bp, Homo sapiens
cctctgagccca

SEQ ID NO: 4135252 - DNA, 13 bp, Homo sapiens
cctctgagcccag

SEQ ID NO: 4135253 - DNA, 16 bp, Homo sapiens
cctctgagcccagctg

SEQ ID NO: 4135254 - DNA, 19 bp, Homo sapiens
cctctgagcccagctgcct

SEQ ID NO: 4135255 - DNA, 20 bp, Homo sapiens
cctctgagcccagctgcctg

SEQ ID NO: 4135256 - DNA, 22 bp, Homo sapiens
cctctgagcccagctgcctgga

SEQ ID NO: 4135257 - DNA, 15 bp, Homo sapiens
cctctgatacctcaa

SEQ ID NO: 4135258 - DNA, 20 bp, Homo sapiens
cctctgcactactgacatgt

SEQ ID NO: 4135259 - DNA, 21 bp, Homo sapiens
cctctgcactactgacatgtg

SEQ ID NO: 4135260 - DNA, 16 bp, Homo sapiens
cctctgcagtctcatt

SEQ ID NO: 4135261 - DNA, 19 bp, Homo sapiens
cctctgccaaaggatgtga

SEQ ID NO: 4135262 - DNA, 19 bp, Homo sapiens
cctctgcccctcccaaccc

SEQ ID NO: 4135263 - DNA, 13 bp, Homo sapiens
cctctgccctgga

SEQ ID NO: 4135264 - DNA, 14 bp, Homo sapiens
cctctgcctccacc

SEQ ID NO: 4135265 - DNA, 21 bp, Homo sapiens
cctctgcctgccccgccccca

SEQ ID NO: 4135266 - DNA, 21 bp, Homo sapiens
cctctgctacgttcctattgt

SEQ ID NO: 4135267 - DNA, 18 bp, Homo sapiens
cctctgctcaccgcccat

SEQ ID NO: 4135268 - DNA, 13 bp, Homo sapiens
cctctgctcagcc

SEQ ID NO: 4135269 - DNA, 15 bp, Homo sapiens
cctctgctcagccaa

SEQ ID NO: 4135270 - DNA, 18 bp, Homo sapiens
cctctgctcctggagcct

SEQ ID NO: 4135271 - DNA, 15 bp, Homo sapiens
cctctggacagccag

SEQ ID NO: 4135272 - DNA, 15 bp, Homo sapiens
cctctggacggcagg

SEQ ID NO: 4135273 - DNA, 22 bp, Homo sapiens
cctctggaggggtgtggctcct

SEQ ID NO: 4135274 - DNA, 21 bp, Homo sapiens
cctctggcattagaattattt

SEQ ID NO: 4135275 - DNA, 15 bp, Homo sapiens
cctctggccgcagag

SEQ ID NO: 4135276 - DNA, 12 bp, Homo sapiens
cctctggctaga

SEQ ID NO: 4135277 - DNA, 24 bp, Homo sapiens
cctctggctagaggccagccccac

SEQ ID NO: 4135278 - DNA, 20 bp, Homo sapiens
cctctggctttcccaggaga

SEQ ID NO: 4135279 - DNA, 22 bp, Homo sapiens
cctctgggcacgcctgctggcc

SEQ ID NO: 4135280 - DNA, 23 bp, Homo sapiens
cctctgggcacgcctgctggccg

SEQ ID NO: 4135281 - DNA, 12 bp, Homo sapiens
cctctgggccat

SEQ ID NO: 4135282 - DNA, 14 bp, Homo sapiens
cctctgtcccaccc

SEQ ID NO: 4135283 - DNA, 17 bp, Homo sapiens
cctctgtcccaccccta

SEQ ID NO: 4135284 - DNA, 11 bp, Homo sapiens
cctctgtccta

SEQ ID NO: 4135285 - DNA, 11 bp, Homo sapiens
cctctgtctca

SEQ ID NO: 4135286 - DNA, 22 bp, Homo sapiens
cctctgtctcatcctcctggaa

SEQ ID NO: 4135287 - DNA, 24 bp, Homo sapiens
cctctgtctcatcctcctggaacc

SEQ ID NO: 4135288 - DNA, 16 bp, Homo sapiens
cctctgtctgcccttc

SEQ ID NO: 4135289 - DNA, 22 bp, Homo sapiens
cctctgtctgcccttcacccca

SEQ ID NO: 4135290 - DNA, 17 bp, Homo sapiens
cctctgtgccagggcag

SEQ ID NO: 4135291 - DNA, 21 bp, Homo sapiens
cctctgtgccttcttttgatt

SEQ ID NO: 4135292 - DNA, 20 bp, Homo sapiens
cctctgtgtccttccctgca

SEQ ID NO: 4135293 - DNA, 21 bp, Homo sapiens
cctcttaatgtatgattacat

SEQ ID NO: 4135294 - DNA, 14 bp, Homo sapiens
cctcttcaccaggt

SEQ ID NO: 4135295 - DNA, 14 bp, Homo sapiens
cctcttcagaactt

SEQ ID NO: 4135296 - DNA, 18 bp, Homo sapiens
cctcttcatggatggggg

SEQ ID NO: 4135297 - DNA, 23 bp, Homo sapiens
cctcttcccatgactgcacccag

SEQ ID NO: 4135298 - DNA, 11 bp, Homo sapiens
cctcttcccca

SEQ ID NO: 4135299 - DNA, 19 bp, Homo sapiens
cctcttccggagatgtagc

SEQ ID NO: 4135300 - DNA, 20 bp, Homo sapiens
cctcttccggagatgtagca

SEQ ID NO: 4135301 - DNA, 23 bp, Homo sapiens
cctcttctaacccaactgacttg

SEQ ID NO: 4135302 - DNA, 19 bp, Homo sapiens
cctcttctcgtgcctcccc

SEQ ID NO: 4135303 - DNA, 16 bp, Homo sapiens
cctcttctgctctttt

SEQ ID NO: 4135304 - DNA, 21 bp, Homo sapiens
cctcttctgctcttttcctgg

SEQ ID NO: 4135305 - DNA, 20 bp, Homo sapiens
cctcttctgcttaggagaga

SEQ ID NO: 4135306 - DNA, 19 bp, Homo sapiens
cctcttctttgtgcctttg

SEQ ID NO: 4135307 - DNA, 16 bp, Homo sapiens
cctcttgagcagtggc

SEQ ID NO: 4135308 - DNA, 16 bp, Homo sapiens
cctcttgattcctggt

SEQ ID NO: 4135309 - DNA, 13 bp, Homo sapiens
cctcttgcccatc

SEQ ID NO: 4135310 - DNA, 23 bp, Homo sapiens
cctcttgctgtctctgctcgccc

SEQ ID NO: 4135311 - DNA, 13 bp, Homo sapiens
cctcttggcctga

SEQ ID NO: 4135312 - DNA, 20 bp, Homo sapiens
cctcttgggggcactgctcc

SEQ ID NO: 4135313 - DNA, 23 bp, Homo sapiens
cctcttggtgtgattgcacagaa

SEQ ID NO: 4135314 - DNA, 13 bp, Homo sapiens
cctcttgtctgag

SEQ ID NO: 4135315 - DNA, 22 bp, Homo sapiens
cctcttgtgcaaggtggccttt

SEQ ID NO: 4135316 - DNA, 12 bp, Homo sapiens
cctctttaagag

SEQ ID NO: 4135317 - DNA, 11 bp, Homo sapiens
cctctttcagt

SEQ ID NO: 4135318 - DNA, 15 bp, Homo sapiens
cctctttccctgcga

SEQ ID NO: 4135319 - DNA, 15 bp, Homo sapiens
cctctttcccttcca

SEQ ID NO: 4135320 - DNA, 11 bp, Homo sapiens
cctctttgctc

SEQ ID NO: 4135321 - DNA, 18 bp, Homo sapiens
cctctttggcagttgcat

SEQ ID NO: 4135322 - DNA, 18 bp, Homo sapiens
cctctttggctcccctgt

SEQ ID NO: 4135323 - DNA, 19 bp, Homo sapiens
cctctttggctcccctgta

SEQ ID NO: 4135324 - DNA, 16 bp, Homo sapiens
cctcttttccccatga

SEQ ID NO: 4135325 - DNA, 13 bp, Homo sapiens
cctctttttcctc

SEQ ID NO: 4135326 - DNA, 17 bp, Homo sapiens
cctctttttcctcctgg

SEQ ID NO: 4135327 - DNA, 21 bp, Homo sapiens
cctctttttcctcctggacac

SEQ ID NO: 4135328 - DNA, 21 bp, Homo sapiens
cctgaaaatgtttttctgcca

SEQ ID NO: 4135329 - DNA, 16 bp, Homo sapiens
cctgaaacagccatgt

SEQ ID NO: 4135330 - DNA, 21 bp, Homo sapiens
cctgaaacgctcctttgtgtg

SEQ ID NO: 4135331 - DNA, 22 bp, Homo sapiens
cctgaaagaggctgaggcctgg

SEQ ID NO: 4135332 - DNA, 14 bp, Homo sapiens
cctgaagccagctg

SEQ ID NO: 4135333 - DNA, 16 bp, Homo sapiens
cctgaatcatgagcct

SEQ ID NO: 4135334 - DNA, 21 bp, Homo sapiens
cctgaatcatgagcctgctgg

SEQ ID NO: 4135335 - DNA, 19 bp, Homo sapiens
cctgaatcccccttgccac

SEQ ID NO: 4135336 - DNA, 20 bp, Homo sapiens
cctgaatcccccttgccacc

SEQ ID NO: 4135337 - DNA, 15 bp, Homo sapiens
cctgaattctttttc

SEQ ID NO: 4135338 - DNA, 20 bp, Homo sapiens
cctgacacactaaccaagct

SEQ ID NO: 4135339 - DNA, 14 bp, Homo sapiens
cctgacaccccctc

SEQ ID NO: 4135340 - DNA, 16 bp, Homo sapiens
cctgacaccccctccc

SEQ ID NO: 4135341 - DNA, 19 bp, Homo sapiens
cctgacactgagccccacc

SEQ ID NO: 4135342 - DNA, 21 bp, Homo sapiens
cctgacagatgtcagccgagc

SEQ ID NO: 4135343 - DNA, 14 bp, Homo sapiens
cctgacagccagaa

SEQ ID NO: 4135344 - DNA, 22 bp, Homo sapiens
cctgacaggtgaggtctgttcc

SEQ ID NO: 4135345 - DNA, 17 bp, Homo sapiens
cctgacatcacagcagc

SEQ ID NO: 4135346 - DNA, 21 bp, Homo sapiens
cctgacccccttcctgtcccc

SEQ ID NO: 4135347 - DNA, 12 bp, Homo sapiens
cctgacccgtct

SEQ ID NO: 4135348 - DNA, 17 bp, Homo sapiens
cctgacctcttgctgtc

SEQ ID NO: 4135349 - DNA, 18 bp, Homo sapiens
cctgacctcttgctgtct

SEQ ID NO: 4135350 - DNA, 18 bp, Homo sapiens
cctgacctgtgagcccag

SEQ ID NO: 4135351 - DNA, 20 bp, Homo sapiens
cctgacctgtgagcccagct

SEQ ID NO: 4135352 - DNA, 22 bp, Homo sapiens
cctgacctgtgagcccagctgg

SEQ ID NO: 4135353 - DNA, 17 bp, Homo sapiens
cctgactcaattatttg

SEQ ID NO: 4135354 - DNA, 15 bp, Homo sapiens
cctgactccctgtgg

SEQ ID NO: 4135355 - DNA, 21 bp, Homo sapiens
cctgactccctgtgggggtgg

SEQ ID NO: 4135356 - DNA, 17 bp, Homo sapiens
cctgactctgccccctg

SEQ ID NO: 4135357 - DNA, 22 bp, Homo sapiens
cctgactctgccccctgctggc

SEQ ID NO: 4135358 - DNA, 14 bp, Homo sapiens
cctgactgctcaga

SEQ ID NO: 4135359 - DNA, 16 bp, Homo sapiens
cctgactggcctggga

SEQ ID NO: 4135360 - DNA, 14 bp, Homo sapiens
cctgactgggctgg

SEQ ID NO: 4135361 - DNA, 21 bp, Homo sapiens
cctgactggtgctataggctg

SEQ ID NO: 4135362 - DNA, 14 bp, Homo sapiens
cctgacttgcttta

SEQ ID NO: 4135363 - DNA, 19 bp, Homo sapiens
cctgagaagaagtggctgc

SEQ ID NO: 4135364 - DNA, 20 bp, Homo sapiens
cctgagaagaagtggctgcc

SEQ ID NO: 4135365 - DNA, 21 bp, Homo sapiens
cctgagaagaagtggctgcca

SEQ ID NO: 4135366 - DNA, 23 bp, Homo sapiens
cctgagaagctgctccaggcctg

SEQ ID NO: 4135367 - DNA, 21 bp, Homo sapiens
cctgagaccagttgggagcac

SEQ ID NO: 4135368 - DNA, 20 bp, Homo sapiens
cctgagacgggcatcgcagg

SEQ ID NO: 4135369 - DNA, 22 bp, Homo sapiens
cctgagacgggcatcgcaggag

SEQ ID NO: 4135370 - DNA, 14 bp, Homo sapiens
cctgagcaactctt

SEQ ID NO: 4135371 - DNA, 23 bp, Homo sapiens
cctgagcaactcttgattatcca

SEQ ID NO: 4135372 - DNA, 14 bp, Homo sapiens
cctgagccaatggg

SEQ ID NO: 4135373 - DNA, 15 bp, Homo sapiens
cctgagccagcaggg

SEQ ID NO: 4135374 - DNA, 17 bp, Homo sapiens
cctgagctattttcctc

SEQ ID NO: 4135375 - DNA, 20 bp, Homo sapiens
cctgagctattttcctctgg

SEQ ID NO: 4135376 - DNA, 13 bp, Homo sapiens
cctgagctggcca

SEQ ID NO: 4135377 - DNA, 15 bp, Homo sapiens
cctgagctggggaag

SEQ ID NO: 4135378 - DNA, 13 bp, Homo sapiens
cctgaggagagga

SEQ ID NO: 4135379 - DNA, 19 bp, Homo sapiens
cctgaggatgggtcagagc

SEQ ID NO: 4135380 - DNA, 15 bp, Homo sapiens
cctgaggccctgggc

SEQ ID NO: 4135381 - DNA, 23 bp, Homo sapiens
cctgaggccctgggctgggtgct

SEQ ID NO: 4135382 - DNA, 17 bp, Homo sapiens
cctgaggcggaggctgt

SEQ ID NO: 4135383 - DNA, 21 bp, Homo sapiens
cctgaggcggaggctgtgctc

SEQ ID NO: 4135384 - DNA, 20 bp, Homo sapiens
cctgaggctttggatttgac

SEQ ID NO: 4135385 - DNA, 23 bp, Homo sapiens
cctgagggcagaaaggttctgcc

SEQ ID NO: 4135386 - DNA, 21 bp, Homo sapiens
cctgaggggcagcctgccttg

SEQ ID NO: 4135387 - DNA, 18 bp, Homo sapiens
cctgaggggcatctgccc

SEQ ID NO: 4135388 - DNA, 20 bp, Homo sapiens
cctgaggggcatctgcccct

SEQ ID NO: 4135389 - DNA, 14 bp, Homo sapiens
cctgaggtcaggga

SEQ ID NO: 4135390 - DNA, 15 bp, Homo sapiens
cctgagtctcctgtg

SEQ ID NO: 4135391 - DNA, 17 bp, Homo sapiens
cctgagtgcgggctgag

SEQ ID NO: 4135392 - DNA, 19 bp, Homo sapiens
cctgagtgcgggctgaggc

SEQ ID NO: 4135393 - DNA, 23 bp, Homo sapiens
cctgagtgcgggctgaggccaga

SEQ ID NO: 4135394 - DNA, 13 bp, Homo sapiens
cctgagtggatct

SEQ ID NO: 4135395 - DNA, 23 bp, Homo sapiens
cctgagtggatctccaaggacca

SEQ ID NO: 4135396 - DNA, 14 bp, Homo sapiens
cctgagtggtgcca

SEQ ID NO: 4135397 - DNA, 16 bp, Homo sapiens
cctgagtggtgccaaa

SEQ ID NO: 4135398 - DNA, 17 bp, Homo sapiens
cctgataaagcacagct

SEQ ID NO: 4135399 - DNA, 14 bp, Homo sapiens
cctgatcagaccac

SEQ ID NO: 4135400 - DNA, 18 bp, Homo sapiens
cctgatcagaccacggct

SEQ ID NO: 4135401 - DNA, 21 bp, Homo sapiens
cctgatcccattttcctctga

SEQ ID NO: 4135402 - DNA, 23 bp, Homo sapiens
cctgatcccttccacctgctctg

SEQ ID NO: 4135403 - DNA, 13 bp, Homo sapiens
cctgatgacagag

SEQ ID NO: 4135404 - DNA, 16 bp, Homo sapiens
cctgatggggaaggga

SEQ ID NO: 4135405 - DNA, 21 bp, Homo sapiens
cctgatgtgtcctcagggagc

SEQ ID NO: 4135406 - DNA, 17 bp, Homo sapiens
cctgatgttaaaattcc

SEQ ID NO: 4135407 - DNA, 13 bp, Homo sapiens
cctgattgacctg

SEQ ID NO: 4135408 - DNA, 18 bp, Homo sapiens
cctgattggtttctcttc

SEQ ID NO: 4135409 - DNA, 18 bp, Homo sapiens
cctgatttaggagaagcc

SEQ ID NO: 4135410 - DNA, 16 bp, Homo sapiens
cctgcaaactcactgc

SEQ ID NO: 4135411 - DNA, 20 bp, Homo sapiens
cctgcaaccaaactcccatc

SEQ ID NO: 4135412 - DNA, 17 bp, Homo sapiens
cctgcaactcaaggact

SEQ ID NO: 4135413 - DNA, 17 bp, Homo sapiens
cctgcaacttccgctga

SEQ ID NO: 4135414 - DNA, 21 bp, Homo sapiens
cctgcaagcctgtctgagact

SEQ ID NO: 4135415 - DNA, 17 bp, Homo sapiens
cctgcacactccatctc

SEQ ID NO: 4135416 - DNA, 18 bp, Homo sapiens
cctgcacactccatctcc

SEQ ID NO: 4135417 - DNA, 14 bp, Homo sapiens
cctgcactaaagcc

SEQ ID NO: 4135418 - DNA, 22 bp, Homo sapiens
cctgcactttcctccacctccc

SEQ ID NO: 4135419 - DNA, 18 bp, Homo sapiens
cctgcagacctcaagcca

SEQ ID NO: 4135420 - DNA, 20 bp, Homo sapiens
cctgcagacctcaagccatc

SEQ ID NO: 4135421 - DNA, 19 bp, Homo sapiens
cctgcagcaaacactccac

SEQ ID NO: 4135422 - DNA, 23 bp, Homo sapiens
cctgcagcaggaatatatgtgtg

SEQ ID NO: 4135423 - DNA, 14 bp, Homo sapiens
cctgcagcaggcag

SEQ ID NO: 4135424 - DNA, 17 bp, Homo sapiens
cctgcagcatggtccct

SEQ ID NO: 4135425 - DNA, 19 bp, Homo sapiens
cctgcagcatggtccctgc

SEQ ID NO: 4135426 - DNA, 23 bp, Homo sapiens
cctgcagcatggtccctgcctta

SEQ ID NO: 4135427 - DNA, 21 bp, Homo sapiens
cctgcagcccaaaacccaggg

SEQ ID NO: 4135428 - DNA, 20 bp, Homo sapiens
cctgcagcccaccagacgtc

SEQ ID NO: 4135429 - DNA, 19 bp, Homo sapiens
cctgcagccccagaagaaa

SEQ ID NO: 4135430 - DNA, 17 bp, Homo sapiens
cctgcagcccccactca

SEQ ID NO: 4135431 - DNA, 12 bp, Homo sapiens
cctgcagctccc

SEQ ID NO: 4135432 - DNA, 17 bp, Homo sapiens
cctgcaggagagagcag

SEQ ID NO: 4135433 - DNA, 15 bp, Homo sapiens
cctgcaggcagagct

SEQ ID NO: 4135434 - DNA, 17 bp, Homo sapiens
cctgcaggcagagctgg

SEQ ID NO: 4135435 - DNA, 20 bp, Homo sapiens
cctgcaggcagagctggagc

SEQ ID NO: 4135436 - DNA, 18 bp, Homo sapiens
cctgcatccccttggctg

SEQ ID NO: 4135437 - DNA, 24 bp, Homo sapiens
cctgcatccccttggctgtgaggc

SEQ ID NO: 4135438 - DNA, 22 bp, Homo sapiens
cctgcatctatcgagtttgcaa

SEQ ID NO: 4135439 - DNA, 16 bp, Homo sapiens
cctgcatttctgagtt

SEQ ID NO: 4135440 - DNA, 12 bp, Homo sapiens
cctgccacagcc

SEQ ID NO: 4135441 - DNA, 13 bp, Homo sapiens
cctgccacagcca

SEQ ID NO: 4135442 - DNA, 14 bp, Homo sapiens
cctgccacagccag

SEQ ID NO: 4135443 - DNA, 17 bp, Homo sapiens
cctgccacagccagagg

SEQ ID NO: 4135444 - DNA, 19 bp, Homo sapiens
cctgccacatacaggtgct

SEQ ID NO: 4135445 - DNA, 16 bp, Homo sapiens
cctgccacatggagcc

SEQ ID NO: 4135446 - DNA, 13 bp, Homo sapiens
cctgccagctgca

SEQ ID NO: 4135447 - DNA, 19 bp, Homo sapiens
cctgccaggcacacacagc

SEQ ID NO: 4135448 - DNA, 21 bp, Homo sapiens
cctgccaggcacacacagccc

SEQ ID NO: 4135449 - DNA, 14 bp, Homo sapiens
cctgccaggcaggg

SEQ ID NO: 4135450 - DNA, 22 bp, Homo sapiens
cctgccaggcaggggtgggggt

SEQ ID NO: 4135451 - DNA, 13 bp, Homo sapiens
cctgccatcctca

SEQ ID NO: 4135452 - DNA, 18 bp, Homo sapiens
cctgccatttaaaaagtt

SEQ ID NO: 4135453 - DNA, 16 bp, Homo sapiens
cctgcccaagcccagg

SEQ ID NO: 4135454 - DNA, 18 bp, Homo sapiens
cctgcccaagcccaggcc

SEQ ID NO: 4135455 - DNA, 15 bp, Homo sapiens
cctgcccaagggcct

SEQ ID NO: 4135456 - DNA, 14 bp, Homo sapiens
cctgcccagatcag

SEQ ID NO: 4135457 - DNA, 14 bp, Homo sapiens
cctgcccagatgcc

SEQ ID NO: 4135458 - DNA, 12 bp, Homo sapiens
cctgcccagtgt

SEQ ID NO: 4135459 - DNA, 12 bp, Homo sapiens
cctgcccatgtg

SEQ ID NO: 4135460 - DNA, 21 bp, Homo sapiens
cctgccccaactctcccctga

SEQ ID NO: 4135461 - DNA, 12 bp, Homo sapiens
cctgccccacac

SEQ ID NO: 4135462 - DNA, 14 bp, Homo sapiens
cctgccccagcgct

SEQ ID NO: 4135463 - DNA, 14 bp, Homo sapiens
cctgccccaggcct

SEQ ID NO: 4135464 - DNA, 15 bp, Homo sapiens
cctgcccccagcccc

SEQ ID NO: 4135465 - DNA, 17 bp, Homo sapiens
cctgcccccagccccgg

SEQ ID NO: 4135466 - DNA, 18 bp, Homo sapiens
cctgcccccagccccggg

SEQ ID NO: 4135467 - DNA, 15 bp, Homo sapiens
cctgccccccagcct

SEQ ID NO: 4135468 - DNA, 18 bp, Homo sapiens
cctgcccctagacatgga

SEQ ID NO: 4135469 - DNA, 15 bp, Homo sapiens
cctgcccctcccttc

SEQ ID NO: 4135470 - DNA, 18 bp, Homo sapiens
cctgcccctcccttcaac

SEQ ID NO: 4135471 - DNA, 19 bp, Homo sapiens
cctgcccctttcaggccta

SEQ ID NO: 4135472 - DNA, 10 bp, Homo sapiens
cctgcccggg

SEQ ID NO: 4135473 - DNA, 13 bp, Homo sapiens
cctgccctcaagg

SEQ ID NO: 4135474 - DNA, 14 bp, Homo sapiens
cctgccctcaaggg

SEQ ID NO: 4135475 - DNA, 12 bp, Homo sapiens
cctgccctgcac

SEQ ID NO: 4135476 - DNA, 13 bp, Homo sapiens
cctgccctgcacg

SEQ ID NO: 4135477 - DNA, 12 bp, Homo sapiens
cctgccctggaa

SEQ ID NO: 4135478 - DNA, 18 bp, Homo sapiens
cctgccctgtcaggaggc

SEQ ID NO: 4135479 - DNA, 13 bp, Homo sapiens
cctgccctgtcca

SEQ ID NO: 4135480 - DNA, 21 bp, Homo sapiens
cctgccctgtgatatgtctgc

SEQ ID NO: 4135481 - DNA, 13 bp, Homo sapiens
cctgcccttccct

SEQ ID NO: 4135482 - DNA, 15 bp, Homo sapiens
cctgcccttccctct

SEQ ID NO: 4135483 - DNA, 18 bp, Homo sapiens
cctgcccttccctctggg

SEQ ID NO: 4135484 - DNA, 20 bp, Homo sapiens
cctgccgcagacgggcacag

SEQ ID NO: 4135485 - DNA, 14 bp, Homo sapiens
cctgcctcagcctc

SEQ ID NO: 4135486 - DNA, 16 bp, Homo sapiens
cctgcctcagcctccc

SEQ ID NO: 4135487 - DNA, 13 bp, Homo sapiens
cctgcctcagctg

SEQ ID NO: 4135488 - DNA, 14 bp, Homo sapiens
cctgcctcagctga

SEQ ID NO: 4135489 - DNA, 13 bp, Homo sapiens
cctgcctcctgcc

SEQ ID NO: 4135490 - DNA, 20 bp, Homo sapiens
cctgcctcctgcctgcccct

SEQ ID NO: 4135491 - DNA, 17 bp, Homo sapiens
cctgcctcctgggaaga

SEQ ID NO: 4135492 - DNA, 20 bp, Homo sapiens
cctgcctctaatctgagctg

SEQ ID NO: 4135493 - DNA, 16 bp, Homo sapiens
cctgcctgagggcagt

SEQ ID NO: 4135494 - DNA, 19 bp, Homo sapiens
cctgcctgccctgtcagga

SEQ ID NO: 4135495 - DNA, 11 bp, Homo sapiens
cctgcctggca

SEQ ID NO: 4135496 - DNA, 14 bp, Homo sapiens
cctgcctggccagg

SEQ ID NO: 4135497 - DNA, 15 bp, Homo sapiens
cctgcctggcccctc

SEQ ID NO: 4135498 - DNA, 16 bp, Homo sapiens
cctgcctgtctgcccc

SEQ ID NO: 4135499 - DNA, 14 bp, Homo sapiens
cctgccttcgttaa

SEQ ID NO: 4135500 - DNA, 12 bp, Homo sapiens
cctgccttggag

SEQ ID NO: 4135501 - DNA, 23 bp, Homo sapiens
cctgccttgggccttgctgctgc

SEQ ID NO: 4135502 - DNA, 17 bp, Homo sapiens
cctgcgccagtcctgct

SEQ ID NO: 4135503 - DNA, 15 bp, Homo sapiens
cctgcgcctccagag

SEQ ID NO: 4135504 - DNA, 16 bp, Homo sapiens
cctgcgcctccagagg

SEQ ID NO: 4135505 - DNA, 17 bp, Homo sapiens
cctgcgcctccagaggt

SEQ ID NO: 4135506 - DNA, 15 bp, Homo sapiens
cctgcgcctgctgcc

SEQ ID NO: 4135507 - DNA, 14 bp, Homo sapiens
cctgcgcctgtgat

SEQ ID NO: 4135508 - DNA, 22 bp, Homo sapiens
cctgcgggctgccccgctttgc

SEQ ID NO: 4135509 - DNA, 23 bp, Homo sapiens
cctgcgggtgaacaaagcagcca

SEQ ID NO: 4135510 - DNA, 15 bp, Homo sapiens
cctgcggtcaggctg

SEQ ID NO: 4135511 - DNA, 22 bp, Homo sapiens
cctgcggtcaggctgggcagcc

SEQ ID NO: 4135512 - DNA, 23 bp, Homo sapiens
cctgcggtcaggctgggcagccc

SEQ ID NO: 4135513 - DNA, 16 bp, Homo sapiens
cctgcgtcctcctcac

SEQ ID NO: 4135514 - DNA, 18 bp, Homo sapiens
cctgcgtcctcctcacct

SEQ ID NO: 4135515 - DNA, 22 bp, Homo sapiens
cctgcgtcctcctcacctcatg

SEQ ID NO: 4135516 - DNA, 19 bp, Homo sapiens
cctgcgttggtccagagcg

SEQ ID NO: 4135517 - DNA, 19 bp, Homo sapiens
cctgctaaggctcctcctt

SEQ ID NO: 4135518 - DNA, 15 bp, Homo sapiens
cctgctacaggaggg

SEQ ID NO: 4135519 - DNA, 19 bp, Homo sapiens
cctgctacaggaggggtct

SEQ ID NO: 4135520 - DNA, 21 bp, Homo sapiens
cctgctcaactctacccctgc

SEQ ID NO: 4135521 - DNA, 13 bp, Homo sapiens
cctgctcaccacc

SEQ ID NO: 4135522 - DNA, 16 bp, Homo sapiens
cctgctcaccacctgc

SEQ ID NO: 4135523 - DNA, 22 bp, Homo sapiens
cctgctcagcagtgagagcaga

SEQ ID NO: 4135524 - DNA, 22 bp, Homo sapiens
cctgctccaccagcagcatggc

SEQ ID NO: 4135525 - DNA, 19 bp, Homo sapiens
cctgctccacgaagcctta

SEQ ID NO: 4135526 - DNA, 16 bp, Homo sapiens
cctgctccagaagatg

SEQ ID NO: 4135527 - DNA, 13 bp, Homo sapiens
cctgctccagacc

SEQ ID NO: 4135528 - DNA, 15 bp, Homo sapiens
cctgctcccagcagc

SEQ ID NO: 4135529 - DNA, 16 bp, Homo sapiens
cctgctcccagcctgc

SEQ ID NO: 4135530 - DNA, 22 bp, Homo sapiens
cctgctccctccgggtcttcct

SEQ ID NO: 4135531 - DNA, 17 bp, Homo sapiens
cctgctccctgctttgg

SEQ ID NO: 4135532 - DNA, 13 bp, Homo sapiens
cctgctcctcctg

SEQ ID NO: 4135533 - DNA, 16 bp, Homo sapiens
cctgctcctcctgccc

SEQ ID NO: 4135534 - DNA, 17 bp, Homo sapiens
cctgctcctcctgccct

SEQ ID NO: 4135535 - DNA, 21 bp, Homo sapiens
cctgctcctcctgccctgtcc

SEQ ID NO: 4135536 - DNA, 14 bp, Homo sapiens
cctgctcctgcagc

SEQ ID NO: 4135537 - DNA, 13 bp, Homo sapiens
cctgctccttccc

SEQ ID NO: 4135538 - DNA, 17 bp, Homo sapiens
cctgctctacccatgag

SEQ ID NO: 4135539 - DNA, 20 bp, Homo sapiens
cctgctctacccatgagcct

SEQ ID NO: 4135540 - DNA, 22 bp, Homo sapiens
cctgctctacccatgagcctgc

SEQ ID NO: 4135541 - DNA, 17 bp, Homo sapiens
cctgctctagtgggaca

SEQ ID NO: 4135542 - DNA, 22 bp, Homo sapiens
cctgctctccaagtctcagtgg

SEQ ID NO: 4135543 - DNA, 23 bp, Homo sapiens
cctgctctccaagtctcagtggc

SEQ ID NO: 4135544 - DNA, 12 bp, Homo sapiens
cctgctctgctc

SEQ ID NO: 4135545 - DNA, 18 bp, Homo sapiens
cctgctctgtccccaaag

SEQ ID NO: 4135546 - DNA, 20 bp, Homo sapiens
cctgctgcaccctgcgcctc

SEQ ID NO: 4135547 - DNA, 20 bp, Homo sapiens
cctgctgccagtgcagccac

SEQ ID NO: 4135548 - DNA, 22 bp, Homo sapiens
cctgctgcccaatctccatctg

SEQ ID NO: 4135549 - DNA, 22 bp, Homo sapiens
cctgctgcccaggctgtgcagc

SEQ ID NO: 4135550 - DNA, 15 bp, Homo sapiens
cctgctgcctgctga

SEQ ID NO: 4135551 - DNA, 14 bp, Homo sapiens
cctgctgcggcaga

SEQ ID NO: 4135552 - DNA, 12 bp, Homo sapiens
cctgctggaagc

SEQ ID NO: 4135553 - DNA, 14 bp, Homo sapiens
cctgctggaagccc

SEQ ID NO: 4135554 - DNA, 16 bp, Homo sapiens
cctgctggaagcccag

SEQ ID NO: 4135555 - DNA, 17 bp, Homo sapiens
cctgctggaagcccagc

SEQ ID NO: 4135556 - DNA, 13 bp, Homo sapiens
cctgctggaggcc

SEQ ID NO: 4135557 - DNA, 14 bp, Homo sapiens
cctgctggaggcct

SEQ ID NO: 4135558 - DNA, 18 bp, Homo sapiens
cctgctggaggcctcagg

SEQ ID NO: 4135559 - DNA, 21 bp, Homo sapiens
cctgctggaggcctcaggtgc

SEQ ID NO: 4135560 - DNA, 17 bp, Homo sapiens
cctgctggctcttctgc

SEQ ID NO: 4135561 - DNA, 15 bp, Homo sapiens
cctgctggcttccag

SEQ ID NO: 4135562 - DNA, 20 bp, Homo sapiens
cctgctggcttccagcttca

SEQ ID NO: 4135563 - DNA, 17 bp, Homo sapiens
cctgctggtcacagcct

SEQ ID NO: 4135564 - DNA, 20 bp, Homo sapiens
cctgctgtcattgcttcttc

SEQ ID NO: 4135565 - DNA, 22 bp, Homo sapiens
cctgctgtgccatgctgggcca

SEQ ID NO: 4135566 - DNA, 14 bp, Homo sapiens
cctgcttcaaatat

SEQ ID NO: 4135567 - DNA, 14 bp, Homo sapiens
cctgcttcatgctc

SEQ ID NO: 4135568 - DNA, 15 bp, Homo sapiens
cctgctttgcatctt

SEQ ID NO: 4135569 - DNA, 18 bp, Homo sapiens
cctgctttgcatctttgt

SEQ ID NO: 4135570 - DNA, 17 bp, Homo sapiens
cctgctttgggctgccc

SEQ ID NO: 4135571 - DNA, 20 bp, Homo sapiens
cctgctttgggctgccctgg

SEQ ID NO: 4135572 - DNA, 14 bp, Homo sapiens
cctgcttttctgtc

SEQ ID NO: 4135573 - DNA, 15 bp, Homo sapiens
cctgcttttctgtcc

SEQ ID NO: 4135574 - DNA, 18 bp, Homo sapiens
cctgcttttctgtcctgg

SEQ ID NO: 4135575 - DNA, 19 bp, Homo sapiens
cctgcttttctgtcctggg

SEQ ID NO: 4135576 - DNA, 20 bp, Homo sapiens
cctgcttttctgtcctgggc

SEQ ID NO: 4135577 - DNA, 17 bp, Homo sapiens
cctggaaaaattccaga

SEQ ID NO: 4135578 - DNA, 19 bp, Homo sapiens
cctggaaagcaggatgtag

SEQ ID NO: 4135579 - DNA, 18 bp, Homo sapiens
cctggaaccttgctgtcc

SEQ ID NO: 4135580 - DNA, 17 bp, Homo sapiens
cctggaactcctggcct

SEQ ID NO: 4135581 - DNA, 18 bp, Homo sapiens
cctggaagagcccagtct

SEQ ID NO: 4135582 - DNA, 20 bp, Homo sapiens
cctggaaggacatccatgtt

SEQ ID NO: 4135583 - DNA, 17 bp, Homo sapiens
cctggaaggcccagcac

SEQ ID NO: 4135584 - DNA, 17 bp, Homo sapiens
cctggacacccctgctc

SEQ ID NO: 4135585 - DNA, 16 bp, Homo sapiens
cctggacactcagacc

SEQ ID NO: 4135586 - DNA, 17 bp, Homo sapiens
cctggacactcagacct

SEQ ID NO: 4135587 - DNA, 16 bp, Homo sapiens
cctggacctgcctcct

SEQ ID NO: 4135588 - DNA, 22 bp, Homo sapiens
cctggacctgcctcctgcctgc

SEQ ID NO: 4135589 - DNA, 18 bp, Homo sapiens
cctggactgggaggtaga

SEQ ID NO: 4135590 - DNA, 14 bp, Homo sapiens
cctggactgttttc

SEQ ID NO: 4135591 - DNA, 13 bp, Homo sapiens
cctggactttcct

SEQ ID NO: 4135592 - DNA, 15 bp, Homo sapiens
cctggactttcctgc

SEQ ID NO: 4135593 - DNA, 23 bp, Homo sapiens
cctggactttggttctctccagg

SEQ ID NO: 4135594 - DNA, 16 bp, Homo sapiens
cctggagaactagaga

SEQ ID NO: 4135595 - DNA, 23 bp, Homo sapiens
cctggagatattataagggagag

SEQ ID NO: 4135596 - DNA, 18 bp, Homo sapiens
cctggaggattgcaggtg

SEQ ID NO: 4135597 - DNA, 16 bp, Homo sapiens
cctggaggatttcatc

SEQ ID NO: 4135598 - DNA, 13 bp, Homo sapiens
cctggaggcccag

SEQ ID NO: 4135599 - DNA, 16 bp, Homo sapiens
cctggaggcccagttc

SEQ ID NO: 4135600 - DNA, 14 bp, Homo sapiens
cctggaggctgcct

SEQ ID NO: 4135601 - DNA, 18 bp, Homo sapiens
cctggaggctgcctatgt

SEQ ID NO: 4135602 - DNA, 19 bp, Homo sapiens
cctggagtgcccaccctgg

SEQ ID NO: 4135603 - DNA, 21 bp, Homo sapiens
cctggagtgctgtgctgtgtt

SEQ ID NO: 4135604 - DNA, 19 bp, Homo sapiens
cctggagtgtggctgagga

SEQ ID NO: 4135605 - DNA, 20 bp, Homo sapiens
cctggagtgtggctgaggag

SEQ ID NO: 4135606 - DNA, 15 bp, Homo sapiens
cctggatgccagctg

SEQ ID NO: 4135607 - DNA, 17 bp, Homo sapiens
cctggatgccagctgtg

SEQ ID NO: 4135608 - DNA, 18 bp, Homo sapiens
cctggatgccagctgtgt

SEQ ID NO: 4135609 - DNA, 21 bp, Homo sapiens
cctggatgccagctgtgtcct

SEQ ID NO: 4135610 - DNA, 16 bp, Homo sapiens
cctggcaaaaatgcaa

SEQ ID NO: 4135611 - DNA, 23 bp, Homo sapiens
cctggcaaaaatgcaacaaatga

SEQ ID NO: 4135612 - DNA, 12 bp, Homo sapiens
cctggcaatagt

SEQ ID NO: 4135613 - DNA, 16 bp, Homo sapiens
cctggcacagggcagt

SEQ ID NO: 4135614 - DNA, 22 bp, Homo sapiens
cctggcactataatgtaagctc

SEQ ID NO: 4135615 - DNA, 19 bp, Homo sapiens
cctggcactgggaggcagg

SEQ ID NO: 4135616 - DNA, 22 bp, Homo sapiens
cctggcagacttgcccaggtca

SEQ ID NO: 4135617 - DNA, 20 bp, Homo sapiens
cctggcagctctggacagcc

SEQ ID NO: 4135618 - DNA, 23 bp, Homo sapiens
cctggcagctctggacagcccca

SEQ ID NO: 4135619 - DNA, 12 bp, Homo sapiens
cctggcaggcag

SEQ ID NO: 4135620 - DNA, 14 bp, Homo sapiens
cctggcaggcaggg

SEQ ID NO: 4135621 - DNA, 21 bp, Homo sapiens
cctggcaggcaggggccctgc

SEQ ID NO: 4135622 - DNA, 23 bp, Homo sapiens
cctggcaggcaggggccctgcag

SEQ ID NO: 4135623 - DNA, 14 bp, Homo sapiens
cctggcaggccagt

SEQ ID NO: 4135624 - DNA, 16 bp, Homo sapiens
cctggcaggccagtgt

SEQ ID NO: 4135625 - DNA, 19 bp, Homo sapiens
cctggccaccagccatcct

SEQ ID NO: 4135626 - DNA, 15 bp, Homo sapiens
cctggccacctctct

SEQ ID NO: 4135627 - DNA, 12 bp, Homo sapiens
cctggccagaca

SEQ ID NO: 4135628 - DNA, 14 bp, Homo sapiens
cctggccagacaca

SEQ ID NO: 4135629 - DNA, 23 bp, Homo sapiens
cctggccagacacaggccctccc

SEQ ID NO: 4135630 - DNA, 13 bp, Homo sapiens
cctggccagacgc

SEQ ID NO: 4135631 - DNA, 14 bp, Homo sapiens
cctggccagccggg

SEQ ID NO: 4135632 - DNA, 21 bp, Homo sapiens
cctggccagccgggagcttgg

SEQ ID NO: 4135633 - DNA, 15 bp, Homo sapiens
cctggccaggagctc

SEQ ID NO: 4135634 - DNA, 16 bp, Homo sapiens
cctggccaggagctct

SEQ ID NO: 4135635 - DNA, 20 bp, Homo sapiens
cctggccaggagctcttcag

SEQ ID NO: 4135636 - DNA, 13 bp, Homo sapiens
cctggccaggcac

SEQ ID NO: 4135637 - DNA, 14 bp, Homo sapiens
cctggccatttcca

SEQ ID NO: 4135638 - DNA, 14 bp, Homo sapiens
cctggcccatctca

SEQ ID NO: 4135639 - DNA, 18 bp, Homo sapiens
cctggcccatctcagcct

SEQ ID NO: 4135640 - DNA, 19 bp, Homo sapiens
cctggccccagcctgggcc

SEQ ID NO: 4135641 - DNA, 12 bp, Homo sapiens
cctggccccagg

SEQ ID NO: 4135642 - DNA, 16 bp, Homo sapiens
cctggcccccaacctc

SEQ ID NO: 4135643 - DNA, 23 bp, Homo sapiens
cctggcccccaacctcagggctc

SEQ ID NO: 4135644 - DNA, 14 bp, Homo sapiens
cctggcccctcgcc

SEQ ID NO: 4135645 - DNA, 12 bp, Homo sapiens
cctggcctctgc

SEQ ID NO: 4135646 - DNA, 18 bp, Homo sapiens
cctggcctgaactgagga

SEQ ID NO: 4135647 - DNA, 19 bp, Homo sapiens
cctggcctgaactgaggag

SEQ ID NO: 4135648 - DNA, 12 bp, Homo sapiens
cctggcctgccc

SEQ ID NO: 4135649 - DNA, 14 bp, Homo sapiens
cctggcctgcccgt

SEQ ID NO: 4135650 - DNA, 15 bp, Homo sapiens
cctggcgcaggtggg

SEQ ID NO: 4135651 - DNA, 14 bp, Homo sapiens
cctggctccactct

SEQ ID NO: 4135652 - DNA, 22 bp, Homo sapiens
cctggctccactcttgatctct

SEQ ID NO: 4135653 - DNA, 17 bp, Homo sapiens
cctggctcccacaggcc

SEQ ID NO: 4135654 - DNA, 15 bp, Homo sapiens
cctggctcccatgac

SEQ ID NO: 4135655 - DNA, 14 bp, Homo sapiens
cctggctccctcct

SEQ ID NO: 4135656 - DNA, 20 bp, Homo sapiens
cctggctccctcctccaggc

SEQ ID NO: 4135657 - DNA, 22 bp, Homo sapiens
cctggctccctcctccaggcct

SEQ ID NO: 4135658 - DNA, 15 bp, Homo sapiens
cctggctctgctgtc

SEQ ID NO: 4135659 - DNA, 17 bp, Homo sapiens
cctggctctgctgtccc

SEQ ID NO: 4135660 - DNA, 22 bp, Homo sapiens
cctggctctttcgtcacccttg

SEQ ID NO: 4135661 - DNA, 23 bp, Homo sapiens
cctggctctttcgtcacccttgg

SEQ ID NO: 4135662 - DNA, 22 bp, Homo sapiens
cctggctgaccccaaagagcct

SEQ ID NO: 4135663 - DNA, 22 bp, Homo sapiens
cctggctgagcagttcccctgg

SEQ ID NO: 4135664 - DNA, 21 bp, Homo sapiens
cctggctgaggttcctctgcc

SEQ ID NO: 4135665 - DNA, 22 bp, Homo sapiens
cctggctgaggttcctctgcct

SEQ ID NO: 4135666 - DNA, 13 bp, Homo sapiens
cctggctgcccct

SEQ ID NO: 4135667 - DNA, 14 bp, Homo sapiens
cctggctgcccctc

SEQ ID NO: 4135668 - DNA, 15 bp, Homo sapiens
cctggctgctgcccc

SEQ ID NO: 4135669 - DNA, 11 bp, Homo sapiens
cctggctggaa

SEQ ID NO: 4135670 - DNA, 22 bp, Homo sapiens
cctggctggaggagcagcagct

SEQ ID NO: 4135671 - DNA, 20 bp, Homo sapiens
cctggctgggacgtggctca

SEQ ID NO: 4135672 - DNA, 22 bp, Homo sapiens
cctggctgggacgtggctcagc

SEQ ID NO: 4135673 - DNA, 14 bp, Homo sapiens
cctggctgggccat

SEQ ID NO: 4135674 - DNA, 16 bp, Homo sapiens
cctggctgggccatcc

SEQ ID NO: 4135675 - DNA, 13 bp, Homo sapiens
cctggctggtcct

SEQ ID NO: 4135676 - DNA, 16 bp, Homo sapiens
cctggctggtcctccc

SEQ ID NO: 4135677 - DNA, 21 bp, Homo sapiens
cctggctgttctgtggttcct

SEQ ID NO: 4135678 - DNA, 22 bp, Homo sapiens
cctggcttctttctctcagcct

SEQ ID NO: 4135679 - DNA, 12 bp, Homo sapiens
cctggctttgcc

SEQ ID NO: 4135680 - DNA, 18 bp, Homo sapiens
cctggctttgcctcttct

SEQ ID NO: 4135681 - DNA, 15 bp, Homo sapiens
cctggcttttacttt

SEQ ID NO: 4135682 - DNA, 17 bp, Homo sapiens
cctggcttttcactgct

SEQ ID NO: 4135683 - DNA, 22 bp, Homo sapiens
cctggcttttcactgctggctg

SEQ ID NO: 4135684 - DNA, 23 bp, Homo sapiens
cctggcttttcactgctggctgc

SEQ ID NO: 4135685 - DNA, 14 bp, Homo sapiens
cctgggaatgtatt

SEQ ID NO: 4135686 - DNA, 20 bp, Homo sapiens
cctgggacacagacccagga

SEQ ID NO: 4135687 - DNA, 19 bp, Homo sapiens
cctgggacagggagcagcc

SEQ ID NO: 4135688 - DNA, 14 bp, Homo sapiens
cctgggagccagtc

SEQ ID NO: 4135689 - DNA, 21 bp, Homo sapiens
cctgggagccagtcctccact

SEQ ID NO: 4135690 - DNA, 14 bp, Homo sapiens
cctgggagcccaga

SEQ ID NO: 4135691 - DNA, 23 bp, Homo sapiens
cctgggataggggcagaggaggc

SEQ ID NO: 4135692 - DNA, 13 bp, Homo sapiens
cctgggcagaaag

SEQ ID NO: 4135693 - DNA, 18 bp, Homo sapiens
cctgggcagccaggctgc

SEQ ID NO: 4135694 - DNA, 10 bp, Homo sapiens
cctgggcagg

SEQ ID NO: 4135695 - DNA, 14 bp, Homo sapiens
cctgggcaggcggt

SEQ ID NO: 4135696 - DNA, 17 bp, Homo sapiens
cctgggcaggtgtgtgt

SEQ ID NO: 4135697 - DNA, 18 bp, Homo sapiens
cctgggcatgggtccagg

SEQ ID NO: 4135698 - DNA, 22 bp, Homo sapiens
cctgggcatgggtccagggcct

SEQ ID NO: 4135699 - DNA, 15 bp, Homo sapiens
cctgggcattgcttt

SEQ ID NO: 4135700 - DNA, 12 bp, Homo sapiens
cctgggcccctc

SEQ ID NO: 4135701 - DNA, 21 bp, Homo sapiens
cctgggcccctccacgcctcc

SEQ ID NO: 4135702 - DNA, 23 bp, Homo sapiens
cctgggccgttacatctgtgcag

SEQ ID NO: 4135703 - DNA, 14 bp, Homo sapiens
cctgggcctcagtt

SEQ ID NO: 4135704 - DNA, 12 bp, Homo sapiens
cctgggcctctg

SEQ ID NO: 4135705 - DNA, 17 bp, Homo sapiens
cctgggcctgcccctgt

SEQ ID NO: 4135706 - DNA, 15 bp, Homo sapiens
cctgggctcggaggc

SEQ ID NO: 4135707 - DNA, 19 bp, Homo sapiens
cctgggctcggaggctgcc

SEQ ID NO: 4135708 - DNA, 22 bp, Homo sapiens
cctgggctcggaggctgccccc

SEQ ID NO: 4135709 - DNA, 18 bp, Homo sapiens
cctgggctggactggagg

SEQ ID NO: 4135710 - DNA, 20 bp, Homo sapiens
cctgggctggggccaccatc

SEQ ID NO: 4135711 - DNA, 19 bp, Homo sapiens
cctgggctgtctgtcacca

SEQ ID NO: 4135712 - DNA, 22 bp, Homo sapiens
cctgggcttttgttttgctttt

SEQ ID NO: 4135713 - DNA, 13 bp, Homo sapiens
cctggggaaggag

SEQ ID NO: 4135714 - DNA, 22 bp, Homo sapiens
cctggggactgttccaaagcca

SEQ ID NO: 4135715 - DNA, 23 bp, Homo sapiens
cctggggactgttccaaagccag

SEQ ID NO: 4135716 - DNA, 17 bp, Homo sapiens
cctggggcccagcccct

SEQ ID NO: 4135717 - DNA, 19 bp, Homo sapiens
cctggggcccagcccctgt

SEQ ID NO: 4135718 - DNA, 16 bp, Homo sapiens
cctggggcctgactgc

SEQ ID NO: 4135719 - DNA, 13 bp, Homo sapiens
cctggggcctgag

SEQ ID NO: 4135720 - DNA, 14 bp, Homo sapiens
cctggggcctgaga

SEQ ID NO: 4135721 - DNA, 17 bp, Homo sapiens
cctggggcctggacctg

SEQ ID NO: 4135722 - DNA, 19 bp, Homo sapiens
cctggggcctggacctgcc

SEQ ID NO: 4135723 - DNA, 20 bp, Homo sapiens
cctggggctcctttctccag

SEQ ID NO: 4135724 - DNA, 15 bp, Homo sapiens
cctggggctggcctc

SEQ ID NO: 4135725 - DNA, 16 bp, Homo sapiens
cctggggctggcctcc

SEQ ID NO: 4135726 - DNA, 18 bp, Homo sapiens
cctgggggtggcaggcac

SEQ ID NO: 4135727 - DNA, 20 bp, Homo sapiens
cctgggggtttcacctgggc

SEQ ID NO: 4135728 - DNA, 22 bp, Homo sapiens
cctggggtataaaactttcctc

SEQ ID NO: 4135729 - DNA, 18 bp, Homo sapiens
cctggggtgcatctcctc

SEQ ID NO: 4135730 - DNA, 14 bp, Homo sapiens
cctgggtctgtgtc

SEQ ID NO: 4135731 - DNA, 21 bp, Homo sapiens
cctgggtctgtgtctcttttc

SEQ ID NO: 4135732 - DNA, 13 bp, Homo sapiens
cctgggtgacatt

SEQ ID NO: 4135733 - DNA, 19 bp, Homo sapiens
cctggtaggagtgtgtgat

SEQ ID NO: 4135734 - DNA, 21 bp, Homo sapiens
cctggtcgccttccacctctg

SEQ ID NO: 4135735 - DNA, 18 bp, Homo sapiens
cctggtgaatcacctggc

SEQ ID NO: 4135736 - DNA, 20 bp, Homo sapiens
cctggtgaatcacctggctg

SEQ ID NO: 4135737 - DNA, 16 bp, Homo sapiens
cctggtgaatggcctt

SEQ ID NO: 4135738 - DNA, 20 bp, Homo sapiens
cctggtgaatggccttcctt

SEQ ID NO: 4135739 - DNA, 21 bp, Homo sapiens
cctggtgctgccacacttcag

SEQ ID NO: 4135740 - DNA, 15 bp, Homo sapiens
cctggtggcaccaga

SEQ ID NO: 4135741 - DNA, 13 bp, Homo sapiens
cctggttcccgtt

SEQ ID NO: 4135742 - DNA, 19 bp, Homo sapiens
cctggtttaattcagcaga

SEQ ID NO: 4135743 - DNA, 22 bp, Homo sapiens
cctggtttgactcagttccagg

SEQ ID NO: 4135744 - DNA, 18 bp, Homo sapiens
cctgtaacttgagagtag

SEQ ID NO: 4135745 - DNA, 16 bp, Homo sapiens
cctgtaagaaacagag

SEQ ID NO: 4135746 - DNA, 14 bp, Homo sapiens
cctgtaagcctgca

SEQ ID NO: 4135747 - DNA, 16 bp, Homo sapiens
cctgtaagcctgcaag

SEQ ID NO: 4135748 - DNA, 16 bp, Homo sapiens
cctgtaatcccagcac

SEQ ID NO: 4135749 - DNA, 17 bp, Homo sapiens
cctgtaatcccagcact

SEQ ID NO: 4135750 - DNA, 21 bp, Homo sapiens
cctgtaatcccagcactttgg

SEQ ID NO: 4135751 - DNA, 23 bp, Homo sapiens
cctgtaatcccagcactttggga

SEQ ID NO: 4135752 - DNA, 22 bp, Homo sapiens
cctgtacacattcctgcattca

SEQ ID NO: 4135753 - DNA, 18 bp, Homo sapiens
cctgtaccaaatctgaca

SEQ ID NO: 4135754 - DNA, 23 bp, Homo sapiens
cctgtaccttttgaggagcccca

SEQ ID NO: 4135755 - DNA, 23 bp, Homo sapiens
cctgtactgtatggaaacactga

SEQ ID NO: 4135756 - DNA, 17 bp, Homo sapiens
cctgtactgttctgtgt

SEQ ID NO: 4135757 - DNA, 13 bp, Homo sapiens
cctgtagacctag

SEQ ID NO: 4135758 - DNA, 23 bp, Homo sapiens
cctgtagacctagggaggacctt

SEQ ID NO: 4135759 - DNA, 17 bp, Homo sapiens
cctgtagagttgctgag

SEQ ID NO: 4135760 - DNA, 15 bp, Homo sapiens
cctgtagatgcagaa

SEQ ID NO: 4135761 - DNA, 21 bp, Homo sapiens
cctgtagcagtgagaaaaagc

SEQ ID NO: 4135762 - DNA, 17 bp, Homo sapiens
cctgtagccatctgcac

SEQ ID NO: 4135763 - DNA, 19 bp, Homo sapiens
cctgtagtcccagccactc

SEQ ID NO: 4135764 - DNA, 16 bp, Homo sapiens
cctgtataaccccacc

SEQ ID NO: 4135765 - DNA, 17 bp, Homo sapiens
cctgtataaccccacct

SEQ ID NO: 4135766 - DNA, 23 bp, Homo sapiens
cctgtataagtggaggcacttta

SEQ ID NO: 4135767 - DNA, 20 bp, Homo sapiens
cctgtataatctctctcctg

SEQ ID NO: 4135768 - DNA, 19 bp, Homo sapiens
cctgtcaagttaacaagga

SEQ ID NO: 4135769 - DNA, 20 bp, Homo sapiens
cctgtcacattgcattctat

SEQ ID NO: 4135770 - DNA, 14 bp, Homo sapiens
cctgtcacccccac

SEQ ID NO: 4135771 - DNA, 16 bp, Homo sapiens
cctgtcacccccactc

SEQ ID NO: 4135772 - DNA, 16 bp, Homo sapiens
cctgtcaggaggcaga

SEQ ID NO: 4135773 - DNA, 13 bp, Homo sapiens
cctgtccagctcc

SEQ ID NO: 4135774 - DNA, 19 bp, Homo sapiens
cctgtccagctccaacctg

SEQ ID NO: 4135775 - DNA, 21 bp, Homo sapiens
cctgtcccaattctgcccgct

SEQ ID NO: 4135776 - DNA, 11 bp, Homo sapiens
cctgtcccacc

SEQ ID NO: 4135777 - DNA, 15 bp, Homo sapiens
cctgtcccaccccca

SEQ ID NO: 4135778 - DNA, 14 bp, Homo sapiens
cctgtcccaggccg

SEQ ID NO: 4135779 - DNA, 16 bp, Homo sapiens
cctgtcccaggccggc

SEQ ID NO: 4135780 - DNA, 19 bp, Homo sapiens
cctgtcccatggacactcc

SEQ ID NO: 4135781 - DNA, 23 bp, Homo sapiens
cctgtcccatggacactccagtg

SEQ ID NO: 4135782 - DNA, 20 bp, Homo sapiens
cctgtccccaaaatgtgatg

SEQ ID NO: 4135783 - DNA, 13 bp, Homo sapiens
cctgtccccaccc

SEQ ID NO: 4135784 - DNA, 14 bp, Homo sapiens
cctgtccccaccct

SEQ ID NO: 4135785 - DNA, 17 bp, Homo sapiens
cctgtccccaccctcca

SEQ ID NO: 4135786 - DNA, 16 bp, Homo sapiens
cctgtccccctcccct

SEQ ID NO: 4135787 - DNA, 21 bp, Homo sapiens
cctgtccccctcccctcccag

SEQ ID NO: 4135788 - DNA, 14 bp, Homo sapiens
cctgtccctctagt

SEQ ID NO: 4135789 - DNA, 23 bp, Homo sapiens
cctgtcccttctcttaatttaat

SEQ ID NO: 4135790 - DNA, 16 bp, Homo sapiens
cctgtcccttgcctct

SEQ ID NO: 4135791 - DNA, 18 bp, Homo sapiens
cctgtcccttgcctctgc

SEQ ID NO: 4135792 - DNA, 23 bp, Homo sapiens
cctgtcccttgcctctgccctgg

SEQ ID NO: 4135793 - DNA, 18 bp, Homo sapiens
cctgtcccttttccctta

SEQ ID NO: 4135794 - DNA, 14 bp, Homo sapiens
cctgtcctggttcc

SEQ ID NO: 4135795 - DNA, 17 bp, Homo sapiens
cctgtcgagacacttgc

SEQ ID NO: 4135796 - DNA, 18 bp, Homo sapiens
cctgtctcatccccaggg

SEQ ID NO: 4135797 - DNA, 18 bp, Homo sapiens
cctgtctccagctgcctg

SEQ ID NO: 4135798 - DNA, 12 bp, Homo sapiens
cctgtctgcccc

SEQ ID NO: 4135799 - DNA, 14 bp, Homo sapiens
cctgtctgccccag

SEQ ID NO: 4135800 - DNA, 13 bp, Homo sapiens
cctgtctgctcca

SEQ ID NO: 4135801 - DNA, 14 bp, Homo sapiens
cctgtctggctcag

SEQ ID NO: 4135802 - DNA, 19 bp, Homo sapiens
cctgtcttatggtccagaa

SEQ ID NO: 4135803 - DNA, 22 bp, Homo sapiens
cctgtcttatggtccagaaact

SEQ ID NO: 4135804 - DNA, 22 bp, Homo sapiens
cctgtgacatggtgcctgagag

SEQ ID NO: 4135805 - DNA, 23 bp, Homo sapiens
cctgtgacatggtgcctgagagg

SEQ ID NO: 4135806 - DNA, 15 bp, Homo sapiens
cctgtgagcccagct

SEQ ID NO: 4135807 - DNA, 17 bp, Homo sapiens
cctgtgagcccagctgg

SEQ ID NO: 4135808 - DNA, 15 bp, Homo sapiens
cctgtgagtaaatat

SEQ ID NO: 4135809 - DNA, 16 bp, Homo sapiens
cctgtgatatgtctgc

SEQ ID NO: 4135810 - DNA, 19 bp, Homo sapiens
cctgtgccacccaccaggg

SEQ ID NO: 4135811 - DNA, 21 bp, Homo sapiens
cctgtgccacccaccagggcg

SEQ ID NO: 4135812 - DNA, 14 bp, Homo sapiens
cctgtgccagccca

SEQ ID NO: 4135813 - DNA, 23 bp, Homo sapiens
cctgtgcccacatcccaggcttc

SEQ ID NO: 4135814 - DNA, 12 bp, Homo sapiens
cctgtgcccact

SEQ ID NO: 4135815 - DNA, 20 bp, Homo sapiens
cctgtgcccgactgactgga

SEQ ID NO: 4135816 - DNA, 15 bp, Homo sapiens
cctgtgcctcccagc

SEQ ID NO: 4135817 - DNA, 17 bp, Homo sapiens
cctgtgcctctgggact

SEQ ID NO: 4135818 - DNA, 20 bp, Homo sapiens
cctgtgcctctgggactgga

SEQ ID NO: 4135819 - DNA, 21 bp, Homo sapiens
cctgtggctttgttttcttag

SEQ ID NO: 4135820 - DNA, 17 bp, Homo sapiens
cctgtgggggtggccat

SEQ ID NO: 4135821 - DNA, 21 bp, Homo sapiens
cctgtgggggtggccatccct

SEQ ID NO: 4135822 - DNA, 20 bp, Homo sapiens
cctgtgggtgttctttcctg

SEQ ID NO: 4135823 - DNA, 23 bp, Homo sapiens
cctgtgggtgttctttcctgccc

SEQ ID NO: 4135824 - DNA, 22 bp, Homo sapiens
cctgtggttacagtgcagacag

SEQ ID NO: 4135825 - DNA, 17 bp, Homo sapiens
cctgtgtccacctgtgg

SEQ ID NO: 4135826 - DNA, 17 bp, Homo sapiens
cctgtgtggtactctga

SEQ ID NO: 4135827 - DNA, 19 bp, Homo sapiens
cctgtgtggtactctgaaa

SEQ ID NO: 4135828 - DNA, 18 bp, Homo sapiens
cctgtgtgtactctgtcc

SEQ ID NO: 4135829 - DNA, 17 bp, Homo sapiens
cctgtgtgtaggctggg

SEQ ID NO: 4135830 - DNA, 16 bp, Homo sapiens
cctgtgttgtctctag

SEQ ID NO: 4135831 - DNA, 20 bp, Homo sapiens
cctgtgttgtctctagagca

SEQ ID NO: 4135832 - DNA, 20 bp, Homo sapiens
cctgttaagagataattctt

SEQ ID NO: 4135833 - DNA, 17 bp, Homo sapiens
cctgttcacgctcaccc

SEQ ID NO: 4135834 - DNA, 20 bp, Homo sapiens
cctgttcacgctcacccagt

SEQ ID NO: 4135835 - DNA, 23 bp, Homo sapiens
cctgttcacgctcacccagtcac

SEQ ID NO: 4135836 - DNA, 15 bp, Homo sapiens
cctgttcatgtgcct

SEQ ID NO: 4135837 - DNA, 13 bp, Homo sapiens
cctgttccccaga

SEQ ID NO: 4135838 - DNA, 16 bp, Homo sapiens
cctgttctaaggggga

SEQ ID NO: 4135839 - DNA, 20 bp, Homo sapiens
cctgttctgaaatgttctta

SEQ ID NO: 4135840 - DNA, 24 bp, Homo sapiens
cctgttcttcctccagctgcacca

SEQ ID NO: 4135841 - DNA, 22 bp, Homo sapiens
cctgttgctgtgtttaatttga

SEQ ID NO: 4135842 - DNA, 16 bp, Homo sapiens
cctgtttaatatttaa

SEQ ID NO: 4135843 - DNA, 21 bp, Homo sapiens
cctgtttaatatttaaacagc

SEQ ID NO: 4135844 - DNA, 19 bp, Homo sapiens
cctgtttataatctgaaga

SEQ ID NO: 4135845 - DNA, 19 bp, Homo sapiens
cctgtttcagaccccccca

SEQ ID NO: 4135846 - DNA, 13 bp, Homo sapiens
cctgtttctctgc

SEQ ID NO: 4135847 - DNA, 23 bp, Homo sapiens
cctgttttcccacgaggaatctg

SEQ ID NO: 4135848 - DNA, 16 bp, Homo sapiens
cctgttttgagccctg

SEQ ID NO: 4135849 - DNA, 17 bp, Homo sapiens
cctgttttgttggaagg

SEQ ID NO: 4135850 - DNA, 17 bp, Homo sapiens
ccttaaacacaggctgt

SEQ ID NO: 4135851 - DNA, 11 bp, Homo sapiens
ccttaaactgt

SEQ ID NO: 4135852 - DNA, 22 bp, Homo sapiens
ccttaaactgtacagaatttcc

SEQ ID NO: 4135853 - DNA, 14 bp, Homo sapiens
ccttaacccacctc

SEQ ID NO: 4135854 - DNA, 15 bp, Homo sapiens
ccttaacccacctct

SEQ ID NO: 4135855 - DNA, 20 bp, Homo sapiens
ccttaacccacctctcctgc

SEQ ID NO: 4135856 - DNA, 22 bp, Homo sapiens
ccttaagccataggcccaggat

SEQ ID NO: 4135857 - DNA, 15 bp, Homo sapiens
ccttaagctgcagga

SEQ ID NO: 4135858 - DNA, 15 bp, Homo sapiens
ccttaatttcctttt

SEQ ID NO: 4135859 - DNA, 18 bp, Homo sapiens
ccttaatttcctttttga

SEQ ID NO: 4135860 - DNA, 20 bp, Homo sapiens
ccttaatttcctttttgaca

SEQ ID NO: 4135861 - DNA, 22 bp, Homo sapiens
ccttaatttcctttttgacact

SEQ ID NO: 4135862 - DNA, 15 bp, Homo sapiens
ccttacacactcagg

SEQ ID NO: 4135863 - DNA, 13 bp, Homo sapiens
ccttacagagcat

SEQ ID NO: 4135864 - DNA, 19 bp, Homo sapiens
ccttacatttgtgagattc

SEQ ID NO: 4135865 - DNA, 21 bp, Homo sapiens
ccttaccagagacgcccagcc

SEQ ID NO: 4135866 - DNA, 20 bp, Homo sapiens
ccttacttgcttctctagct

SEQ ID NO: 4135867 - DNA, 14 bp, Homo sapiens
ccttagaacctttc

SEQ ID NO: 4135868 - DNA, 18 bp, Homo sapiens
ccttagaacctttcttac

SEQ ID NO: 4135869 - DNA, 20 bp, Homo sapiens
ccttagactcttttccttcc

SEQ ID NO: 4135870 - DNA, 13 bp, Homo sapiens
ccttagagcctcg

SEQ ID NO: 4135871 - DNA, 15 bp, Homo sapiens
ccttagcaccttcag

SEQ ID NO: 4135872 - DNA, 16 bp, Homo sapiens
ccttagcctccctgaa

SEQ ID NO: 4135873 - DNA, 23 bp, Homo sapiens
ccttagctgccagtgctggtcac

SEQ ID NO: 4135874 - DNA, 23 bp, Homo sapiens
ccttaggccttcctctctccaga

SEQ ID NO: 4135875 - DNA, 16 bp, Homo sapiens
ccttagggttttctct

SEQ ID NO: 4135876 - DNA, 13 bp, Homo sapiens
ccttagtcttctc

SEQ ID NO: 4135877 - DNA, 15 bp, Homo sapiens
ccttagtgggccagg

SEQ ID NO: 4135878 - DNA, 22 bp, Homo sapiens
ccttagtgggccagggctgccc

SEQ ID NO: 4135879 - DNA, 14 bp, Homo sapiens
ccttatccaggact

SEQ ID NO: 4135880 - DNA, 15 bp, Homo sapiens
ccttatccaggactc

SEQ ID NO: 4135881 - DNA, 14 bp, Homo sapiens
ccttatccctctct

SEQ ID NO: 4135882 - DNA, 15 bp, Homo sapiens
ccttatctagctgca

SEQ ID NO: 4135883 - DNA, 21 bp, Homo sapiens
ccttatctgtgcgtgaaacac

SEQ ID NO: 4135884 - DNA, 16 bp, Homo sapiens
ccttattgtacctctc

SEQ ID NO: 4135885 - DNA, 15 bp, Homo sapiens
ccttatttgccttct

SEQ ID NO: 4135886 - DNA, 23 bp, Homo sapiens
ccttcaacaaggcttgctgcaga

SEQ ID NO: 4135887 - DNA, 15 bp, Homo sapiens
ccttcaacccagtgg

SEQ ID NO: 4135888 - DNA, 20 bp, Homo sapiens
ccttcacaccccaggccctt

SEQ ID NO: 4135889 - DNA, 12 bp, Homo sapiens
ccttcacagtgt

SEQ ID NO: 4135890 - DNA, 13 bp, Homo sapiens
ccttcaccagagc

SEQ ID NO: 4135891 - DNA, 15 bp, Homo sapiens
ccttcaccagagccc

SEQ ID NO: 4135892 - DNA, 16 bp, Homo sapiens
ccttcagatggaaact

SEQ ID NO: 4135893 - DNA, 19 bp, Homo sapiens
ccttcagcccccagcccct

SEQ ID NO: 4135894 - DNA, 18 bp, Homo sapiens
ccttcaggaactggggct

SEQ ID NO: 4135895 - DNA, 20 bp, Homo sapiens
ccttcagtaccctctcagct

SEQ ID NO: 4135896 - DNA, 20 bp, Homo sapiens
ccttcagtcttgaatttcta

SEQ ID NO: 4135897 - DNA, 17 bp, Homo sapiens
ccttcagtttttgtgtt

SEQ ID NO: 4135898 - DNA, 18 bp, Homo sapiens
ccttcatcttcctgtgtc

SEQ ID NO: 4135899 - DNA, 22 bp, Homo sapiens
ccttcatcttcctgtgtcctga

SEQ ID NO: 4135900 - DNA, 18 bp, Homo sapiens
ccttcatttcaggaggga

SEQ ID NO: 4135901 - DNA, 18 bp, Homo sapiens
ccttccaaaaattattat

SEQ ID NO: 4135902 - DNA, 19 bp, Homo sapiens
ccttccacctgctctgctg

SEQ ID NO: 4135903 - DNA, 14 bp, Homo sapiens
ccttccagcccatc

SEQ ID NO: 4135904 - DNA, 15 bp, Homo sapiens
ccttccagctcctgt

SEQ ID NO: 4135905 - DNA, 16 bp, Homo sapiens
ccttccagctcctgta

SEQ ID NO: 4135906 - DNA, 16 bp, Homo sapiens
ccttccagctgctgtc

SEQ ID NO: 4135907 - DNA, 11 bp, Homo sapiens
ccttccataat

SEQ ID NO: 4135908 - DNA, 12 bp, Homo sapiens
ccttccataatt

SEQ ID NO: 4135909 - DNA, 15 bp, Homo sapiens
ccttccataattatg

SEQ ID NO: 4135910 - DNA, 19 bp, Homo sapiens
ccttccatacacagaggag

SEQ ID NO: 4135911 - DNA, 22 bp, Homo sapiens
ccttccatgtgcctttctttgc

SEQ ID NO: 4135912 - DNA, 17 bp, Homo sapiens
ccttccatttctgcctt

SEQ ID NO: 4135913 - DNA, 17 bp, Homo sapiens
ccttccattttccccca

SEQ ID NO: 4135914 - DNA, 20 bp, Homo sapiens
ccttccattttcccccacta

SEQ ID NO: 4135915 - DNA, 13 bp, Homo sapiens
ccttcccacatgc

SEQ ID NO: 4135916 - DNA, 16 bp, Homo sapiens
ccttcccacatgcctg

SEQ ID NO: 4135917 - DNA, 20 bp, Homo sapiens
ccttcccacatgcctgcgcc

SEQ ID NO: 4135918 - DNA, 15 bp, Homo sapiens
ccttcccacccctac

SEQ ID NO: 4135919 - DNA, 16 bp, Homo sapiens
ccttcccacccctaca

SEQ ID NO: 4135920 - DNA, 17 bp, Homo sapiens
ccttcccacccctacac

SEQ ID NO: 4135921 - DNA, 18 bp, Homo sapiens
ccttcccacccctacaca

SEQ ID NO: 4135922 - DNA, 17 bp, Homo sapiens
ccttcccactcaccccg

SEQ ID NO: 4135923 - DNA, 22 bp, Homo sapiens
ccttcccactctgtcgagcctg

SEQ ID NO: 4135924 - DNA, 17 bp, Homo sapiens
ccttcccatttctctac

SEQ ID NO: 4135925 - DNA, 14 bp, Homo sapiens
ccttcccatttctt

SEQ ID NO: 4135926 - DNA, 22 bp, Homo sapiens
ccttccccagctttgctgcctg

SEQ ID NO: 4135927 - DNA, 11 bp, Homo sapiens
ccttccccagg

SEQ ID NO: 4135928 - DNA, 13 bp, Homo sapiens
ccttccccaggat

SEQ ID NO: 4135929 - DNA, 19 bp, Homo sapiens
ccttccccctccaatccca

SEQ ID NO: 4135930 - DNA, 17 bp, Homo sapiens
ccttcccctccctggct

SEQ ID NO: 4135931 - DNA, 15 bp, Homo sapiens
ccttccccttccttc

SEQ ID NO: 4135932 - DNA, 16 bp, Homo sapiens
ccttccccttccttct

SEQ ID NO: 4135933 - DNA, 17 bp, Homo sapiens
ccttccccttctgtgtc

SEQ ID NO: 4135934 - DNA, 15 bp, Homo sapiens
ccttccctcaccccc

SEQ ID NO: 4135935 - DNA, 21 bp, Homo sapiens
ccttccctcacccccagcaca

SEQ ID NO: 4135936 - DNA, 24 bp, Homo sapiens
ccttccctcaccttggcaccagac

SEQ ID NO: 4135937 - DNA, 12 bp, Homo sapiens
ccttccctccaa

SEQ ID NO: 4135938 - DNA, 11 bp, Homo sapiens
ccttccctctc

SEQ ID NO: 4135939 - DNA, 16 bp, Homo sapiens
ccttcctatgcccagg

SEQ ID NO: 4135940 - DNA, 16 bp, Homo sapiens
ccttcctcagctgcct

SEQ ID NO: 4135941 - DNA, 16 bp, Homo sapiens
ccttcctcatccaccc

SEQ ID NO: 4135942 - DNA, 19 bp, Homo sapiens
ccttcctcatccaccccat

SEQ ID NO: 4135943 - DNA, 14 bp, Homo sapiens
ccttcctccatcct

SEQ ID NO: 4135944 - DNA, 14 bp, Homo sapiens
ccttcctctccact

SEQ ID NO: 4135945 - DNA, 17 bp, Homo sapiens
ccttcctctccactgcc

SEQ ID NO: 4135946 - DNA, 21 bp, Homo sapiens
ccttcctctccactgccttcg

SEQ ID NO: 4135947 - DNA, 13 bp, Homo sapiens
ccttcctggcctg

SEQ ID NO: 4135948 - DNA, 13 bp, Homo sapiens
ccttcctgtccct

SEQ ID NO: 4135949 - DNA, 18 bp, Homo sapiens
ccttcctgtccctgaggt

SEQ ID NO: 4135950 - DNA, 16 bp, Homo sapiens
ccttcctgtttcagac

SEQ ID NO: 4135951 - DNA, 21 bp, Homo sapiens
ccttcctgtttcagacccccc

SEQ ID NO: 4135952 - DNA, 15 bp, Homo sapiens
ccttccttttccctg

SEQ ID NO: 4135953 - DNA, 18 bp, Homo sapiens
ccttccttttccctgctt

SEQ ID NO: 4135954 - DNA, 20 bp, Homo sapiens
ccttccttttccctgcttcc

SEQ ID NO: 4135955 - DNA, 23 bp, Homo sapiens
ccttccttttccctgcttccagg

SEQ ID NO: 4135956 - DNA, 15 bp, Homo sapiens
ccttcgatacaccgg

SEQ ID NO: 4135957 - DNA, 15 bp, Homo sapiens
ccttcgggagcaggg

SEQ ID NO: 4135958 - DNA, 21 bp, Homo sapiens
ccttcggggcgatgctccctc

SEQ ID NO: 4135959 - DNA, 14 bp, Homo sapiens
ccttctactgagcc

SEQ ID NO: 4135960 - DNA, 22 bp, Homo sapiens
ccttctagtcttggccagccaa

SEQ ID NO: 4135961 - DNA, 22 bp, Homo sapiens
ccttctcacacacaactgtcca

SEQ ID NO: 4135962 - DNA, 14 bp, Homo sapiens
ccttctcccagcac

SEQ ID NO: 4135963 - DNA, 12 bp, Homo sapiens
ccttctcctctc

SEQ ID NO: 4135964 - DNA, 17 bp, Homo sapiens
ccttctcctctctgggc

SEQ ID NO: 4135965 - DNA, 16 bp, Homo sapiens
ccttctctcctcccca

SEQ ID NO: 4135966 - DNA, 20 bp, Homo sapiens
ccttctctcctccccaaatc

SEQ ID NO: 4135967 - DNA, 20 bp, Homo sapiens
ccttctctgaacacaggcag

SEQ ID NO: 4135968 - DNA, 22 bp, Homo sapiens
ccttctctgaacacaggcagct

SEQ ID NO: 4135969 - DNA, 13 bp, Homo sapiens
ccttctctgctcc

SEQ ID NO: 4135970 - DNA, 20 bp, Homo sapiens
ccttctctgggtctgatttt

SEQ ID NO: 4135971 - DNA, 14 bp, Homo sapiens
ccttctcttaattt

SEQ ID NO: 4135972 - DNA, 13 bp, Homo sapiens
ccttctcttccag

SEQ ID NO: 4135973 - DNA, 14 bp, Homo sapiens
ccttctcttccagg

SEQ ID NO: 4135974 - DNA, 19 bp, Homo sapiens
ccttctcttccaggcagcc

SEQ ID NO: 4135975 - DNA, 13 bp, Homo sapiens
ccttctgaaatgt

SEQ ID NO: 4135976 - DNA, 17 bp, Homo sapiens
ccttctgaaatgtgacc

SEQ ID NO: 4135977 - DNA, 18 bp, Homo sapiens
ccttctgaaatgtgaccc

SEQ ID NO: 4135978 - DNA, 19 bp, Homo sapiens
ccttctgagctggcctctc

SEQ ID NO: 4135979 - DNA, 20 bp, Homo sapiens
ccttctgagctggcctctca

SEQ ID NO: 4135980 - DNA, 12 bp, Homo sapiens
ccttctgctcag

SEQ ID NO: 4135981 - DNA, 21 bp, Homo sapiens
ccttctggctgtagataaata

SEQ ID NO: 4135982 - DNA, 15 bp, Homo sapiens
ccttctgtgaaagta

SEQ ID NO: 4135983 - DNA, 21 bp, Homo sapiens
ccttctgtggctcacagaacc

SEQ ID NO: 4135984 - DNA, 12 bp, Homo sapiens
ccttctgtgtca

SEQ ID NO: 4135985 - DNA, 17 bp, Homo sapiens
ccttctgttgatgctgt

SEQ ID NO: 4135986 - DNA, 15 bp, Homo sapiens
ccttcttgcctgctg

SEQ ID NO: 4135987 - DNA, 18 bp, Homo sapiens
ccttcttgcctgctgggc

SEQ ID NO: 4135988 - DNA, 13 bp, Homo sapiens
ccttcttgggccc

SEQ ID NO: 4135989 - DNA, 15 bp, Homo sapiens
ccttcttgggcccca

SEQ ID NO: 4135990 - DNA, 18 bp, Homo sapiens
ccttcttgggccccagac

SEQ ID NO: 4135991 - DNA, 13 bp, Homo sapiens
ccttcttggtgct

SEQ ID NO: 4135992 - DNA, 12 bp, Homo sapiens
ccttcttgtagt

SEQ ID NO: 4135993 - DNA, 13 bp, Homo sapiens
ccttctttgataa

SEQ ID NO: 4135994 - DNA, 16 bp, Homo sapiens
ccttctttgcagggct

SEQ ID NO: 4135995 - DNA, 16 bp, Homo sapiens
ccttctttgcccttta

SEQ ID NO: 4135996 - DNA, 15 bp, Homo sapiens
ccttgaacctgtgag

SEQ ID NO: 4135997 - DNA, 14 bp, Homo sapiens
ccttgaatgctgcc

SEQ ID NO: 4135998 - DNA, 12 bp, Homo sapiens
ccttgaatgtgg

SEQ ID NO: 4135999 - DNA, 15 bp, Homo sapiens
ccttgacatcagttc

SEQ ID NO: 4136000 - DNA, 19 bp, Homo sapiens
ccttgagaaaccttattgt

SEQ ID NO: 4136001 - DNA, 16 bp, Homo sapiens
ccttgagaccacaggg

SEQ ID NO: 4136002 - DNA, 13 bp, Homo sapiens
ccttgagccctgg

SEQ ID NO: 4136003 - DNA, 16 bp, Homo sapiens
ccttgagccctggctg

SEQ ID NO: 4136004 - DNA, 17 bp, Homo sapiens
ccttgagccctggctgt

SEQ ID NO: 4136005 - DNA, 22 bp, Homo sapiens
ccttgaggggagccaggagggg

SEQ ID NO: 4136006 - DNA, 13 bp, Homo sapiens
ccttgaggtcttt

SEQ ID NO: 4136007 - DNA, 23 bp, Homo sapiens
ccttgagtggggttatctctgtg

SEQ ID NO: 4136008 - DNA, 23 bp, Homo sapiens
ccttgattgttcgggtgtgcaat

SEQ ID NO: 4136009 - DNA, 21 bp, Homo sapiens
ccttgcaacctcaccttcctg

SEQ ID NO: 4136010 - DNA, 17 bp, Homo sapiens
ccttgcacccctcactc

SEQ ID NO: 4136011 - DNA, 18 bp, Homo sapiens
ccttgcaggggtcccccc

SEQ ID NO: 4136012 - DNA, 17 bp, Homo sapiens
ccttgcagttcagcacc

SEQ ID NO: 4136013 - DNA, 22 bp, Homo sapiens
ccttgcagttcagcaccaccct

SEQ ID NO: 4136014 - DNA, 18 bp, Homo sapiens
ccttgccaagctttcttc

SEQ ID NO: 4136015 - DNA, 19 bp, Homo sapiens
ccttgccaagctttcttct

SEQ ID NO: 4136016 - DNA, 12 bp, Homo sapiens
ccttgccagaga

SEQ ID NO: 4136017 - DNA, 12 bp, Homo sapiens
ccttgccagtct

SEQ ID NO: 4136018 - DNA, 17 bp, Homo sapiens
ccttgcccactcctgct

SEQ ID NO: 4136019 - DNA, 18 bp, Homo sapiens
ccttgcccactcctgctc

SEQ ID NO: 4136020 - DNA, 23 bp, Homo sapiens
ccttgcccactcctgctctgctc

SEQ ID NO: 4136021 - DNA, 20 bp, Homo sapiens
ccttgccccccgccctcatg

SEQ ID NO: 4136022 - DNA, 19 bp, Homo sapiens
ccttgcctcaatgccagta

SEQ ID NO: 4136023 - DNA, 12 bp, Homo sapiens
ccttgcctcccc

SEQ ID NO: 4136024 - DNA, 22 bp, Homo sapiens
ccttgcctccccatttcccatc

SEQ ID NO: 4136025 - DNA, 23 bp, Homo sapiens
ccttgcctccccatttcccatct

SEQ ID NO: 4136026 - DNA, 11 bp, Homo sapiens
ccttgcctctg

SEQ ID NO: 4136027 - DNA, 18 bp, Homo sapiens
ccttgcctttcgaggcct

SEQ ID NO: 4136028 - DNA, 13 bp, Homo sapiens
ccttgcgcctcag

SEQ ID NO: 4136029 - DNA, 14 bp, Homo sapiens
ccttgcgcctcagc

SEQ ID NO: 4136030 - DNA, 23 bp, Homo sapiens
ccttgctaccacggcctcctttc

SEQ ID NO: 4136031 - DNA, 17 bp, Homo sapiens
ccttgctacctcaaggg

SEQ ID NO: 4136032 - DNA, 14 bp, Homo sapiens
ccttgctcattctt

SEQ ID NO: 4136033 - DNA, 15 bp, Homo sapiens
ccttgctcattcttg

SEQ ID NO: 4136034 - DNA, 14 bp, Homo sapiens
ccttgctctcctca

SEQ ID NO: 4136035 - DNA, 15 bp, Homo sapiens
ccttgctctcctcat

SEQ ID NO: 4136036 - DNA, 18 bp, Homo sapiens
ccttgctctcctcatctc

SEQ ID NO: 4136037 - DNA, 18 bp, Homo sapiens
ccttgctgaacacacaca

SEQ ID NO: 4136038 - DNA, 21 bp, Homo sapiens
ccttgctgagtggcgcaaggc

SEQ ID NO: 4136039 - DNA, 22 bp, Homo sapiens
ccttgctgagtggcgcaaggcc

SEQ ID NO: 4136040 - DNA, 17 bp, Homo sapiens
ccttgctgatggcttga

SEQ ID NO: 4136041 - DNA, 13 bp, Homo sapiens
ccttgctgctgct

SEQ ID NO: 4136042 - DNA, 16 bp, Homo sapiens
ccttgctgctgctgca

SEQ ID NO: 4136043 - DNA, 18 bp, Homo sapiens
ccttgctgctgctgcacc

SEQ ID NO: 4136044 - DNA, 17 bp, Homo sapiens
ccttgctgtcctgatct

SEQ ID NO: 4136045 - DNA, 20 bp, Homo sapiens
ccttgcttcttactgataat

SEQ ID NO: 4136046 - DNA, 13 bp, Homo sapiens
ccttgctttcctg

SEQ ID NO: 4136047 - DNA, 17 bp, Homo sapiens
ccttgctttcctgggcc

SEQ ID NO: 4136048 - DNA, 19 bp, Homo sapiens
ccttgctttcctgggcctt

SEQ ID NO: 4136049 - DNA, 18 bp, Homo sapiens
ccttggaaatagaaagaa

SEQ ID NO: 4136050 - DNA, 16 bp, Homo sapiens
ccttggaaccagcccc

SEQ ID NO: 4136051 - DNA, 15 bp, Homo sapiens
ccttggcaccagaca

SEQ ID NO: 4136052 - DNA, 20 bp, Homo sapiens
ccttggcaccagacacccag

SEQ ID NO: 4136053 - DNA, 22 bp, Homo sapiens
ccttggcaccagacacccagga

SEQ ID NO: 4136054 - DNA, 21 bp, Homo sapiens
ccttggccaagagaagggctt

SEQ ID NO: 4136055 - DNA, 11 bp, Homo sapiens
ccttggcctca

SEQ ID NO: 4136056 - DNA, 15 bp, Homo sapiens
ccttggcctgtctca

SEQ ID NO: 4136057 - DNA, 22 bp, Homo sapiens
ccttggctcaatcctctaagct

SEQ ID NO: 4136058 - DNA, 18 bp, Homo sapiens
ccttggcttacctgacct

SEQ ID NO: 4136059 - DNA, 12 bp, Homo sapiens
ccttgggacagc

SEQ ID NO: 4136060 - DNA, 11 bp, Homo sapiens
ccttgggcagt

SEQ ID NO: 4136061 - DNA, 22 bp, Homo sapiens
ccttgggcctgggcctctgccc

SEQ ID NO: 4136062 - DNA, 17 bp, Homo sapiens
ccttgggccttgctgct

SEQ ID NO: 4136063 - DNA, 18 bp, Homo sapiens
ccttgggctgctcctcat

SEQ ID NO: 4136064 - DNA, 21 bp, Homo sapiens
ccttggggaaccccgagctgg

SEQ ID NO: 4136065 - DNA, 13 bp, Homo sapiens
ccttggggctggg

SEQ ID NO: 4136066 - DNA, 19 bp, Homo sapiens
ccttggggtccctccaccc

SEQ ID NO: 4136067 - DNA, 18 bp, Homo sapiens
ccttgggtcattgacctc

SEQ ID NO: 4136068 - DNA, 19 bp, Homo sapiens
ccttgggttccaaccaggc

SEQ ID NO: 4136069 - DNA, 16 bp, Homo sapiens
ccttggtctttgtatc

SEQ ID NO: 4136070 - DNA, 17 bp, Homo sapiens
ccttggtctttgtatct

SEQ ID NO: 4136071 - DNA, 15 bp, Homo sapiens
ccttggtggcaagag

SEQ ID NO: 4136072 - DNA, 19 bp, Homo sapiens
ccttgtaattctaaatgaa

SEQ ID NO: 4136073 - DNA, 16 bp, Homo sapiens
ccttgtgagagcccat

SEQ ID NO: 4136074 - DNA, 12 bp, Homo sapiens
ccttgtgaggat

SEQ ID NO: 4136075 - DNA, 12 bp, Homo sapiens
ccttgtggcttc

SEQ ID NO: 4136076 - DNA, 15 bp, Homo sapiens
ccttgtgtatatttg

SEQ ID NO: 4136077 - DNA, 18 bp, Homo sapiens
ccttgtgtatatttgtat

SEQ ID NO: 4136078 - DNA, 16 bp, Homo sapiens
ccttgttggtcagagg

SEQ ID NO: 4136079 - DNA, 17 bp, Homo sapiens
ccttgttggtcagagga

SEQ ID NO: 4136080 - DNA, 17 bp, Homo sapiens
ccttgttgtttgctttg

SEQ ID NO: 4136081 - DNA, 22 bp, Homo sapiens
ccttgtttatcagatacatcac

SEQ ID NO: 4136082 - DNA, 15 bp, Homo sapiens
cctttaaaaaagaaa

SEQ ID NO: 4136083 - DNA, 18 bp, Homo sapiens
cctttaacttttttttct

SEQ ID NO: 4136084 - DNA, 20 bp, Homo sapiens
cctttaatcaggtcctgctc

SEQ ID NO: 4136085 - DNA, 13 bp, Homo sapiens
cctttaatgcatc

SEQ ID NO: 4136086 - DNA, 21 bp, Homo sapiens
cctttaccctctttgctgcag

SEQ ID NO: 4136087 - DNA, 22 bp, Homo sapiens
cctttaccctctttgctgcaga

SEQ ID NO: 4136088 - DNA, 15 bp, Homo sapiens
cctttacgtgtttaa

SEQ ID NO: 4136089 - DNA, 18 bp, Homo sapiens
cctttacttgtctttctg

SEQ ID NO: 4136090 - DNA, 22 bp, Homo sapiens
cctttatcaaaaaaagactcag

SEQ ID NO: 4136091 - DNA, 22 bp, Homo sapiens
cctttcacttctttcccttcct

SEQ ID NO: 4136092 - DNA, 20 bp, Homo sapiens
cctttcccaccctcctgccc

SEQ ID NO: 4136093 - DNA, 22 bp, Homo sapiens
cctttccccagcatcactcccc

SEQ ID NO: 4136094 - DNA, 23 bp, Homo sapiens
cctttccccagcatcactcccca

SEQ ID NO: 4136095 - DNA, 16 bp, Homo sapiens
cctttccgctgtcgcc

SEQ ID NO: 4136096 - DNA, 21 bp, Homo sapiens
cctttccgctgtcgccccagg

SEQ ID NO: 4136097 - DNA, 22 bp, Homo sapiens
cctttcctggacactcagacct

SEQ ID NO: 4136098 - DNA, 15 bp, Homo sapiens
cctttcctgtcccac

SEQ ID NO: 4136099 - DNA, 24 bp, Homo sapiens
cctttcctgtgtgtactctgtcca

SEQ ID NO: 4136100 - DNA, 17 bp, Homo sapiens
cctttccttccctctct

SEQ ID NO: 4136101 - DNA, 13 bp, Homo sapiens
cctttcgaggcct

SEQ ID NO: 4136102 - DNA, 14 bp, Homo sapiens
cctttcgaggcctg

SEQ ID NO: 4136103 - DNA, 15 bp, Homo sapiens
cctttctccagccag

SEQ ID NO: 4136104 - DNA, 22 bp, Homo sapiens
cctttctccagccagcaatgat

SEQ ID NO: 4136105 - DNA, 12 bp, Homo sapiens
cctttctctttc

SEQ ID NO: 4136106 - DNA, 17 bp, Homo sapiens
cctttctctttctctct

SEQ ID NO: 4136107 - DNA, 22 bp, Homo sapiens
cctttctctttctctcttccct

SEQ ID NO: 4136108 - DNA, 22 bp, Homo sapiens
cctttctcttttcccctttcct

SEQ ID NO: 4136109 - DNA, 18 bp, Homo sapiens
cctttctgggagcagaaa

SEQ ID NO: 4136110 - DNA, 13 bp, Homo sapiens
cctttctgtccca

SEQ ID NO: 4136111 - DNA, 12 bp, Homo sapiens
cctttctgtgcc

SEQ ID NO: 4136112 - DNA, 11 bp, Homo sapiens
cctttcttcct

SEQ ID NO: 4136113 - DNA, 13 bp, Homo sapiens
cctttcttcctca

SEQ ID NO: 4136114 - DNA, 15 bp, Homo sapiens
cctttcttcctcatt

SEQ ID NO: 4136115 - DNA, 12 bp, Homo sapiens
cctttcttctcc

SEQ ID NO: 4136116 - DNA, 15 bp, Homo sapiens
cctttcttctgccct

SEQ ID NO: 4136117 - DNA, 16 bp, Homo sapiens
cctttcttctgccctt

SEQ ID NO: 4136118 - DNA, 13 bp, Homo sapiens
cctttcttggcca

SEQ ID NO: 4136119 - DNA, 15 bp, Homo sapiens
cctttcttggccagt

SEQ ID NO: 4136120 - DNA, 20 bp, Homo sapiens
cctttgaagcctcagctacc

SEQ ID NO: 4136121 - DNA, 16 bp, Homo sapiens
cctttgacatttaatt

SEQ ID NO: 4136122 - DNA, 18 bp, Homo sapiens
cctttgcaagatgcttgg

SEQ ID NO: 4136123 - DNA, 14 bp, Homo sapiens
cctttgcacaggat

SEQ ID NO: 4136124 - DNA, 13 bp, Homo sapiens
cctttgcagggca

SEQ ID NO: 4136125 - DNA, 18 bp, Homo sapiens
cctttgcagttggactct

SEQ ID NO: 4136126 - DNA, 23 bp, Homo sapiens
cctttgcagttggactctcaggg

SEQ ID NO: 4136127 - DNA, 12 bp, Homo sapiens
cctttgcattta

SEQ ID NO: 4136128 - DNA, 16 bp, Homo sapiens
cctttgcgcctgtgac

SEQ ID NO: 4136129 - DNA, 19 bp, Homo sapiens
cctttgcttatgaatattt

SEQ ID NO: 4136130 - DNA, 12 bp, Homo sapiens
cctttggcctgg

SEQ ID NO: 4136131 - DNA, 23 bp, Homo sapiens
cctttggcctggggtgcatctcc

SEQ ID NO: 4136132 - DNA, 20 bp, Homo sapiens
cctttggttctggccagaat

SEQ ID NO: 4136133 - DNA, 15 bp, Homo sapiens
cctttgtaagttatt

SEQ ID NO: 4136134 - DNA, 14 bp, Homo sapiens
cctttgtagctact

SEQ ID NO: 4136135 - DNA, 13 bp, Homo sapiens
cctttgtcctcct

SEQ ID NO: 4136136 - DNA, 12 bp, Homo sapiens
cctttgtgctgc

SEQ ID NO: 4136137 - DNA, 20 bp, Homo sapiens
cctttgtgtgtactcactga

SEQ ID NO: 4136138 - DNA, 23 bp, Homo sapiens
cctttgttttgatgtttgtggcc

SEQ ID NO: 4136139 - DNA, 19 bp, Homo sapiens
ccttttaaagtgtttcagc

SEQ ID NO: 4136140 - DNA, 15 bp, Homo sapiens
ccttttattgacaca

SEQ ID NO: 4136141 - DNA, 20 bp, Homo sapiens
ccttttcacccttctactct

SEQ ID NO: 4136142 - DNA, 19 bp, Homo sapiens
ccttttcagctgagccctg

SEQ ID NO: 4136143 - DNA, 21 bp, Homo sapiens
ccttttcagctgagccctggg

SEQ ID NO: 4136144 - DNA, 12 bp, Homo sapiens
ccttttccatgc

SEQ ID NO: 4136145 - DNA, 19 bp, Homo sapiens
ccttttcccctacagaatt

SEQ ID NO: 4136146 - DNA, 19 bp, Homo sapiens
ccttttccctgcttccagg

SEQ ID NO: 4136147 - DNA, 13 bp, Homo sapiens
ccttttcctatcc

SEQ ID NO: 4136148 - DNA, 17 bp, Homo sapiens
ccttttcctatccttat

SEQ ID NO: 4136149 - DNA, 10 bp, Homo sapiens
ccttttcctt

SEQ ID NO: 4136150 - DNA, 12 bp, Homo sapiens
ccttttctcagg

SEQ ID NO: 4136151 - DNA, 14 bp, Homo sapiens
ccttttctctgccc

SEQ ID NO: 4136152 - DNA, 14 bp, Homo sapiens
ccttttctcttttc

SEQ ID NO: 4136153 - DNA, 14 bp, Homo sapiens
ccttttctgcattt

SEQ ID NO: 4136154 - DNA, 19 bp, Homo sapiens
ccttttctgtggctggctc

SEQ ID NO: 4136155 - DNA, 20 bp, Homo sapiens
ccttttctttttcccttgaa

SEQ ID NO: 4136156 - DNA, 11 bp, Homo sapiens
ccttttggaac

SEQ ID NO: 4136157 - DNA, 12 bp, Homo sapiens
ccttttggcact

SEQ ID NO: 4136158 - DNA, 21 bp, Homo sapiens
ccttttgtgtgatgcgccttg

SEQ ID NO: 4136159 - DNA, 19 bp, Homo sapiens
ccttttgttcatttcatcc

SEQ ID NO: 4136160 - DNA, 13 bp, Homo sapiens
cctttttccatca

SEQ ID NO: 4136161 - DNA, 17 bp, Homo sapiens
cctttttccatcatttt

SEQ ID NO: 4136162 - DNA, 16 bp, Homo sapiens
cctttttctccagctg

SEQ ID NO: 4136163 - DNA, 14 bp, Homo sapiens
cctttttgacactg

SEQ ID NO: 4136164 - DNA, 17 bp, Homo sapiens
cctttttgtaaatactg

SEQ ID NO: 4136165 - DNA, 20 bp, Homo sapiens
ccttttttaagatttttctc

SEQ ID NO: 4136166 - DNA, 21 bp, Homo sapiens
ccttttttaagatttttctca

SEQ ID NO: 4136167 - DNA, 14 bp, Homo sapiens
ccttttttgtagtt

SEQ ID NO: 4136168 - DNA, 18 bp, Homo sapiens
cctttttttccatcttta

SEQ ID NO: 4136169 - DNA, 13 bp, Homo sapiens
cctttttttttga

SEQ ID NO: 4136170 - DNA, 16 bp, Homo sapiens
cctttttttttgaaac

SEQ ID NO: 4136171 - DNA, 15 bp, Homo sapiens
cgaaactaagccagg

SEQ ID NO: 4136172 - DNA, 19 bp, Homo sapiens
cgaaataaaaatggcaaat

SEQ ID NO: 4136173 - DNA, 22 bp, Homo sapiens
cgaacccaatctgcacactcca

SEQ ID NO: 4136174 - DNA, 19 bp, Homo sapiens
cgaagaaaaaaaataacac

SEQ ID NO: 4136175 - DNA, 16 bp, Homo sapiens
cgaaggtgcctcagac

SEQ ID NO: 4136176 - DNA, 19 bp, Homo sapiens
cgaagtctttgccttctct

SEQ ID NO: 4136177 - DNA, 22 bp, Homo sapiens
cgaagtggactggcccctgggt

SEQ ID NO: 4136178 - DNA, 16 bp, Homo sapiens
cgacaaatctgtctgc

SEQ ID NO: 4136179 - DNA, 16 bp, Homo sapiens
cgacaagcacagtcag

SEQ ID NO: 4136180 - DNA, 17 bp, Homo sapiens
cgacactctctggaagc

SEQ ID NO: 4136181 - DNA, 11 bp, Homo sapiens
cgacagagcag

SEQ ID NO: 4136182 - DNA, 15 bp, Homo sapiens
cgacagcgcccctgc

SEQ ID NO: 4136183 - DNA, 16 bp, Homo sapiens
cgacagcgcccctgct

SEQ ID NO: 4136184 - DNA, 18 bp, Homo sapiens
cgacagcgcccctgctgt

SEQ ID NO: 4136185 - DNA, 14 bp, Homo sapiens
cgacaggccctggc

SEQ ID NO: 4136186 - DNA, 17 bp, Homo sapiens
cgacaggcgagagagga

SEQ ID NO: 4136187 - DNA, 14 bp, Homo sapiens
cgaccacttccagg

SEQ ID NO: 4136188 - DNA, 19 bp, Homo sapiens
cgaccctcatggcccccag

SEQ ID NO: 4136189 - DNA, 23 bp, Homo sapiens
cgacctgaggacatggcttctga

SEQ ID NO: 4136190 - DNA, 11 bp, Homo sapiens
cgacctggctg

SEQ ID NO: 4136191 - DNA, 12 bp, Homo sapiens
cgacctggctgc

SEQ ID NO: 4136192 - DNA, 13 bp, Homo sapiens
cgacgctgcagag

SEQ ID NO: 4136193 - DNA, 22 bp, Homo sapiens
cgacggtgggcatttgtgaggc

SEQ ID NO: 4136194 - DNA, 18 bp, Homo sapiens
cgactctatagactctag

SEQ ID NO: 4136195 - DNA, 18 bp, Homo sapiens
cgactctggccctggccc

SEQ ID NO: 4136196 - DNA, 20 bp, Homo sapiens
cgactgcacagcggcccctg

SEQ ID NO: 4136197 - DNA, 13 bp, Homo sapiens
cgactggactgtc

SEQ ID NO: 4136198 - DNA, 17 bp, Homo sapiens
cgactggccagggccac

SEQ ID NO: 4136199 - DNA, 14 bp, Homo sapiens
cgagacacttgcct

SEQ ID NO: 4136200 - DNA, 12 bp, Homo sapiens
cgagacagtcca

SEQ ID NO: 4136201 - DNA, 13 bp, Homo sapiens
cgagaccatcctg

SEQ ID NO: 4136202 - DNA, 16 bp, Homo sapiens
cgagaccatcctggct

SEQ ID NO: 4136203 - DNA, 21 bp, Homo sapiens
cgagacgcacacagctgagca

SEQ ID NO: 4136204 - DNA, 15 bp, Homo sapiens
cgagagaggagccag

SEQ ID NO: 4136205 - DNA, 14 bp, Homo sapiens
cgagaggcagagaa

SEQ ID NO: 4136206 - DNA, 16 bp, Homo sapiens
cgagagggagagagag

SEQ ID NO: 4136207 - DNA, 18 bp, Homo sapiens
cgagatccccagggcagc

SEQ ID NO: 4136208 - DNA, 14 bp, Homo sapiens
cgagcaaagatcaa

SEQ ID NO: 4136209 - DNA, 20 bp, Homo sapiens
cgagcaatatttatggatgc

SEQ ID NO: 4136210 - DNA, 18 bp, Homo sapiens
cgagcacctccagcctga

SEQ ID NO: 4136211 - DNA, 15 bp, Homo sapiens
cgagcctccagtcca

SEQ ID NO: 4136212 - DNA, 18 bp, Homo sapiens
cgagcgttcccagcaggg

SEQ ID NO: 4136213 - DNA, 17 bp, Homo sapiens
cgagctcttggcctttg

SEQ ID NO: 4136214 - DNA, 24 bp, Homo sapiens
cgagctgggaccagtacctgggtc

SEQ ID NO: 4136215 - DNA, 23 bp, Homo sapiens
cgagctggggggttggcagccca

SEQ ID NO: 4136216 - DNA, 12 bp, Homo sapiens
cgagctgtcccc

SEQ ID NO: 4136217 - DNA, 15 bp, Homo sapiens
cgaggcgatgccacg

SEQ ID NO: 4136218 - DNA, 15 bp, Homo sapiens
cgagggctggctggc

SEQ ID NO: 4136219 - DNA, 23 bp, Homo sapiens
cgagggctggctggcctcaccca

SEQ ID NO: 4136220 - DNA, 12 bp, Homo sapiens
cgaggggagggc

SEQ ID NO: 4136221 - DNA, 14 bp, Homo sapiens
cgaggggagggcag

SEQ ID NO: 4136222 - DNA, 22 bp, Homo sapiens
cgaggggccggggaagctgcca

SEQ ID NO: 4136223 - DNA, 14 bp, Homo sapiens
cgaggtagagtttg

SEQ ID NO: 4136224 - DNA, 16 bp, Homo sapiens
cgaggtcagccaggct

SEQ ID NO: 4136225 - DNA, 19 bp, Homo sapiens
cgagtcattcgttctgtgg

SEQ ID NO: 4136226 - DNA, 13 bp, Homo sapiens
cgagtctggggac

SEQ ID NO: 4136227 - DNA, 20 bp, Homo sapiens
cgagtggattgtaggtgcaa

SEQ ID NO: 4136228 - DNA, 21 bp, Homo sapiens
cgagtgtgtttcatccttccc

SEQ ID NO: 4136229 - DNA, 13 bp, Homo sapiens
cgataatgcatga

SEQ ID NO: 4136230 - DNA, 17 bp, Homo sapiens
cgataatgcatgaagca

SEQ ID NO: 4136231 - DNA, 19 bp, Homo sapiens
cgataatgcatgaagcaac

SEQ ID NO: 4136232 - DNA, 23 bp, Homo sapiens
cgatacccaggaccaagccacag

SEQ ID NO: 4136233 - DNA, 16 bp, Homo sapiens
cgatatttttaaagat

SEQ ID NO: 4136234 - DNA, 15 bp, Homo sapiens
cgatccacctgtctc

SEQ ID NO: 4136235 - DNA, 11 bp, Homo sapiens
cgatctcctga

SEQ ID NO: 4136236 - DNA, 13 bp, Homo sapiens
cgatctctcctgg

SEQ ID NO: 4136237 - DNA, 17 bp, Homo sapiens
cgatctcttattttaca

SEQ ID NO: 4136238 - DNA, 20 bp, Homo sapiens
cgatcttggttcactgcaac

SEQ ID NO: 4136239 - DNA, 14 bp, Homo sapiens
cgatgaaggctgcc

SEQ ID NO: 4136240 - DNA, 11 bp, Homo sapiens
cgatgcacagt

SEQ ID NO: 4136241 - DNA, 16 bp, Homo sapiens
cgatgctccctcagcc

SEQ ID NO: 4136242 - DNA, 16 bp, Homo sapiens
cgatggagcccccaga

SEQ ID NO: 4136243 - DNA, 17 bp, Homo sapiens
cgattggagaatacttt

SEQ ID NO: 4136244 - DNA, 12 bp, Homo sapiens
cgatttttgtat

SEQ ID NO: 4136245 - DNA, 13 bp, Homo sapiens
cgatttttgtatg

SEQ ID NO: 4136246 - DNA, 10 bp, Homo sapiens
cgcacactgg

SEQ ID NO: 4136247 - DNA, 14 bp, Homo sapiens
cgcacccccctgtt

SEQ ID NO: 4136248 - DNA, 18 bp, Homo sapiens
cgcacccccctgttctaa

SEQ ID NO: 4136249 - DNA, 21 bp, Homo sapiens
cgcaccccggcctcagggcgc

SEQ ID NO: 4136250 - DNA, 11 bp, Homo sapiens
cgcacgcacac

SEQ ID NO: 4136251 - DNA, 17 bp, Homo sapiens
cgcactccatgagcacc

SEQ ID NO: 4136252 - DNA, 22 bp, Homo sapiens
cgcactgtgacccccagctccg

SEQ ID NO: 4136253 - DNA, 17 bp, Homo sapiens
cgcagacgggcacagac

SEQ ID NO: 4136254 - DNA, 18 bp, Homo sapiens
cgcagcatccgaccaggt

SEQ ID NO: 4136255 - DNA, 22 bp, Homo sapiens
cgcagccctagagcctgcctgg

SEQ ID NO: 4136256 - DNA, 18 bp, Homo sapiens
cgcaggaactcccagcaa

SEQ ID NO: 4136257 - DNA, 11 bp, Homo sapiens
cgcaggaatgg

SEQ ID NO: 4136258 - DNA, 16 bp, Homo sapiens
cgcaggcctccctgcc

SEQ ID NO: 4136259 - DNA, 18 bp, Homo sapiens
cgcaggtgggctggactt

SEQ ID NO: 4136260 - DNA, 20 bp, Homo sapiens
cgcaggtgggtgctgccctg

SEQ ID NO: 4136261 - DNA, 15 bp, Homo sapiens
cgcagtgctgggacc

SEQ ID NO: 4136262 - DNA, 19 bp, Homo sapiens
cgcagtgctgggaccagag

SEQ ID NO: 4136263 - DNA, 16 bp, Homo sapiens
cgcataggcctgcttt

SEQ ID NO: 4136264 - DNA, 12 bp, Homo sapiens
cgcatccagcaa

SEQ ID NO: 4136265 - DNA, 23 bp, Homo sapiens
cgcatggagtgtgtattgttccc

SEQ ID NO: 4136266 - DNA, 16 bp, Homo sapiens
cgcatggtcacacact

SEQ ID NO: 4136267 - DNA, 19 bp, Homo sapiens
cgcatggtcacacactgat

SEQ ID NO: 4136268 - DNA, 14 bp, Homo sapiens
cgccaatctggccc

SEQ ID NO: 4136269 - DNA, 13 bp, Homo sapiens
cgccacccgcagc

SEQ ID NO: 4136270 - DNA, 18 bp, Homo sapiens
cgccaccgccacccgcag

SEQ ID NO: 4136271 - DNA, 14 bp, Homo sapiens
cgccacctcagggc

SEQ ID NO: 4136272 - DNA, 15 bp, Homo sapiens
cgccacctcagggca

SEQ ID NO: 4136273 - DNA, 16 bp, Homo sapiens
cgccacctcagggcac

SEQ ID NO: 4136274 - DNA, 23 bp, Homo sapiens
cgccacctcagggcacgcaggac

SEQ ID NO: 4136275 - DNA, 15 bp, Homo sapiens
cgccacgtcccagca

SEQ ID NO: 4136276 - DNA, 12 bp, Homo sapiens
cgccactccaca

SEQ ID NO: 4136277 - DNA, 20 bp, Homo sapiens
cgccactgcactccggcctg

SEQ ID NO: 4136278 - DNA, 13 bp, Homo sapiens
cgccagcctcctc

SEQ ID NO: 4136279 - DNA, 14 bp, Homo sapiens
cgccagcctcctct

SEQ ID NO: 4136280 - DNA, 15 bp, Homo sapiens
cgccagcctcctctg

SEQ ID NO: 4136281 - DNA, 16 bp, Homo sapiens
cgccagcctcctctgg

SEQ ID NO: 4136282 - DNA, 15 bp, Homo sapiens
cgccaggaagccaga

SEQ ID NO: 4136283 - DNA, 20 bp, Homo sapiens
cgccaggctgaccacagcac

SEQ ID NO: 4136284 - DNA, 16 bp, Homo sapiens
cgccagggaccccaga

SEQ ID NO: 4136285 - DNA, 12 bp, Homo sapiens
cgccagggctgg

SEQ ID NO: 4136286 - DNA, 14 bp, Homo sapiens
cgccagggctgggg

SEQ ID NO: 4136287 - DNA, 16 bp, Homo sapiens
cgccagggctggggac

SEQ ID NO: 4136288 - DNA, 21 bp, Homo sapiens
cgccagggctggggacagagg

SEQ ID NO: 4136289 - DNA, 16 bp, Homo sapiens
cgccagtgcacaggga

SEQ ID NO: 4136290 - DNA, 14 bp, Homo sapiens
cgccatggtgtccc

SEQ ID NO: 4136291 - DNA, 16 bp, Homo sapiens
cgccattgccaccagg

SEQ ID NO: 4136292 - DNA, 18 bp, Homo sapiens
cgccattgccaccaggag

SEQ ID NO: 4136293 - DNA, 19 bp, Homo sapiens
cgccattggttggaagcta

SEQ ID NO: 4136294 - DNA, 20 bp, Homo sapiens
cgcccaaacctttcccccat

SEQ ID NO: 4136295 - DNA, 20 bp, Homo sapiens
cgcccaccaccccctcaagc

SEQ ID NO: 4136296 - DNA, 16 bp, Homo sapiens
cgcccagccccatccc

SEQ ID NO: 4136297 - DNA, 18 bp, Homo sapiens
cgcccagccccatccctg

SEQ ID NO: 4136298 - DNA, 13 bp, Homo sapiens
cgcccagtggagt

SEQ ID NO: 4136299 - DNA, 21 bp, Homo sapiens
cgccccagatcaccagcccgg

SEQ ID NO: 4136300 - DNA, 14 bp, Homo sapiens
cgccccaggccctc

SEQ ID NO: 4136301 - DNA, 22 bp, Homo sapiens
cgcccccagtccccacccctgc

SEQ ID NO: 4136302 - DNA, 14 bp, Homo sapiens
cgccccctcctcta

SEQ ID NO: 4136303 - DNA, 18 bp, Homo sapiens
cgcccctccaaacctcca

SEQ ID NO: 4136304 - DNA, 19 bp, Homo sapiens
cgcccctccaaacctccag

SEQ ID NO: 4136305 - DNA, 20 bp, Homo sapiens
cgcccctccaaacctccagc

SEQ ID NO: 4136306 - DNA, 23 bp, Homo sapiens
cgcccctccaaacctccagcctc

SEQ ID NO: 4136307 - DNA, 10 bp, Homo sapiens
cgcccctccc

SEQ ID NO: 4136308 - DNA, 14 bp, Homo sapiens
cgcccctgccacct

SEQ ID NO: 4136309 - DNA, 18 bp, Homo sapiens
cgcccctgctgtcttccc

SEQ ID NO: 4136310 - DNA, 21 bp, Homo sapiens
cgcccctgtggccctggccac

SEQ ID NO: 4136311 - DNA, 14 bp, Homo sapiens
cgcccgctgagctg

SEQ ID NO: 4136312 - DNA, 19 bp, Homo sapiens
cgccctcctcgggccgagg

SEQ ID NO: 4136313 - DNA, 12 bp, Homo sapiens
cgccctgggctg

SEQ ID NO: 4136314 - DNA, 18 bp, Homo sapiens
cgccctgggctgtctgtc

SEQ ID NO: 4136315 - DNA, 22 bp, Homo sapiens
cgccctgttcacgctcacccag

SEQ ID NO: 4136316 - DNA, 15 bp, Homo sapiens
cgcccttccatgtgc

SEQ ID NO: 4136317 - DNA, 20 bp, Homo sapiens
cgcccttccatgtgcctttc

SEQ ID NO: 4136318 - DNA, 17 bp, Homo sapiens
cgccctttcctcctcag

SEQ ID NO: 4136319 - DNA, 16 bp, Homo sapiens
cgccggggacagaggc

SEQ ID NO: 4136320 - DNA, 19 bp, Homo sapiens
cgccggggacagaggcctg

SEQ ID NO: 4136321 - DNA, 20 bp, Homo sapiens
cgcctaaggtcacagctagt

SEQ ID NO: 4136322 - DNA, 13 bp, Homo sapiens
cgcctcaaaatgt

SEQ ID NO: 4136323 - DNA, 17 bp, Homo sapiens
cgcctcagccctcagtt

SEQ ID NO: 4136324 - DNA, 16 bp, Homo sapiens
cgcctcagggccaggc

SEQ ID NO: 4136325 - DNA, 23 bp, Homo sapiens
cgcctgacaaccactggtctgta

SEQ ID NO: 4136326 - DNA, 16 bp, Homo sapiens
cgcctgagctcactcg

SEQ ID NO: 4136327 - DNA, 23 bp, Homo sapiens
cgcctgcaggcagagctggagcc

SEQ ID NO: 4136328 - DNA, 22 bp, Homo sapiens
cgcctgccctcatggcccctct

SEQ ID NO: 4136329 - DNA, 18 bp, Homo sapiens
cgcctgctccctccagaa

SEQ ID NO: 4136330 - DNA, 17 bp, Homo sapiens
cgcctgtaatcccagct

SEQ ID NO: 4136331 - DNA, 15 bp, Homo sapiens
cgcctgtagtcccag

SEQ ID NO: 4136332 - DNA, 20 bp, Homo sapiens
cgcctgtcacccccactccc

SEQ ID NO: 4136333 - DNA, 18 bp, Homo sapiens
cgcctgtggagctcagcc

SEQ ID NO: 4136334 - DNA, 19 bp, Homo sapiens
cgcctgtggagctcagccc

SEQ ID NO: 4136335 - DNA, 20 bp, Homo sapiens
cgccttctcccacatgaggc

SEQ ID NO: 4136336 - DNA, 21 bp, Homo sapiens
cgccttgtctcctactcctga

SEQ ID NO: 4136337 - DNA, 22 bp, Homo sapiens
cgcctttcccaccctcctgccc

SEQ ID NO: 4136338 - DNA, 22 bp, Homo sapiens
cgcgactaatttcaaaatgctt

SEQ ID NO: 4136339 - DNA, 14 bp, Homo sapiens
cgcgatcccacaca

SEQ ID NO: 4136340 - DNA, 14 bp, Homo sapiens
cgcgcaccccacgc

SEQ ID NO: 4136341 - DNA, 15 bp, Homo sapiens
cgcgctcgcccagca

SEQ ID NO: 4136342 - DNA, 16 bp, Homo sapiens
cgcgctcgcccagcag

SEQ ID NO: 4136343 - DNA, 15 bp, Homo sapiens
cgcgggcagcgggcc

SEQ ID NO: 4136344 - DNA, 17 bp, Homo sapiens
cgcgggcagcgggccag

SEQ ID NO: 4136345 - DNA, 22 bp, Homo sapiens
cgcgggcagcgggccaggcccg

SEQ ID NO: 4136346 - DNA, 17 bp, Homo sapiens
cgcggggaagctggctt

SEQ ID NO: 4136347 - DNA, 14 bp, Homo sapiens
cgcgtcttcctgag

SEQ ID NO: 4136348 - DNA, 16 bp, Homo sapiens
cgctactataaagaga

SEQ ID NO: 4136349 - DNA, 18 bp, Homo sapiens
cgctcagacggcggccag

SEQ ID NO: 4136350 - DNA, 19 bp, Homo sapiens
cgctcagacggcggccagg

SEQ ID NO: 4136351 - DNA, 22 bp, Homo sapiens
cgctcagacggcggccaggcac

SEQ ID NO: 4136352 - DNA, 16 bp, Homo sapiens
cgctcagccctccctg

SEQ ID NO: 4136353 - DNA, 13 bp, Homo sapiens
cgctccagctgcc

SEQ ID NO: 4136354 - DNA, 20 bp, Homo sapiens
cgctcccaggttcccccagc

SEQ ID NO: 4136355 - DNA, 22 bp, Homo sapiens
cgctcccaggttcccccagcaa

SEQ ID NO: 4136356 - DNA, 16 bp, Homo sapiens
cgctcccgctcccagg

SEQ ID NO: 4136357 - DNA, 16 bp, Homo sapiens
cgctcccttgacctgc

SEQ ID NO: 4136358 - DNA, 18 bp, Homo sapiens
cgctcctgccgcagacgg

SEQ ID NO: 4136359 - DNA, 13 bp, Homo sapiens
cgctcgcccagca

SEQ ID NO: 4136360 - DNA, 20 bp, Homo sapiens
cgctcgcccagcaggagaga

SEQ ID NO: 4136361 - DNA, 15 bp, Homo sapiens
cgctcgcgggcagcg

SEQ ID NO: 4136362 - DNA, 16 bp, Homo sapiens
cgctgacttcatggaa

SEQ ID NO: 4136363 - DNA, 16 bp, Homo sapiens
cgctgagctgagtggc

SEQ ID NO: 4136364 - DNA, 15 bp, Homo sapiens
cgctgaggtgtctgg

SEQ ID NO: 4136365 - DNA, 19 bp, Homo sapiens
cgctgaggtgtctggcctg

SEQ ID NO: 4136366 - DNA, 20 bp, Homo sapiens
cgctgagtgggagaaggcag

SEQ ID NO: 4136367 - DNA, 14 bp, Homo sapiens
cgctgcaccacggc

SEQ ID NO: 4136368 - DNA, 21 bp, Homo sapiens
cgctgccagccttgagccctg

SEQ ID NO: 4136369 - DNA, 15 bp, Homo sapiens
cgctgccgctgcacc

SEQ ID NO: 4136370 - DNA, 12 bp, Homo sapiens
cgctgctccttg

SEQ ID NO: 4136371 - DNA, 14 bp, Homo sapiens
cgctgcttccagga

SEQ ID NO: 4136372 - DNA, 20 bp, Homo sapiens
cgctggggctctctgagact

SEQ ID NO: 4136373 - DNA, 19 bp, Homo sapiens
cgctgggtggtaccctctg

SEQ ID NO: 4136374 - DNA, 22 bp, Homo sapiens
cgctgggtggtaccctctggag

SEQ ID NO: 4136375 - DNA, 13 bp, Homo sapiens
cgctggtggacca

SEQ ID NO: 4136376 - DNA, 18 bp, Homo sapiens
cgctgtaccctttaagat

SEQ ID NO: 4136377 - DNA, 21 bp, Homo sapiens
cgctgtaccctttaagatatc

SEQ ID NO: 4136378 - DNA, 13 bp, Homo sapiens
cgctgtcacaggc

SEQ ID NO: 4136379 - DNA, 18 bp, Homo sapiens
cgctgtcactggctggct

SEQ ID NO: 4136380 - DNA, 19 bp, Homo sapiens
cgctgtcactggctggctc

SEQ ID NO: 4136381 - DNA, 23 bp, Homo sapiens
cgctgtcctctcgagcccagatg

SEQ ID NO: 4136382 - DNA, 15 bp, Homo sapiens
cgctgtcctgagatg

SEQ ID NO: 4136383 - DNA, 11 bp, Homo sapiens
cgcttcacagg

SEQ ID NO: 4136384 - DNA, 21 bp, Homo sapiens
cgcttgtagaactcactctgg

SEQ ID NO: 4136385 - DNA, 22 bp, Homo sapiens
cgctttattgcccatgggatat

SEQ ID NO: 4136386 - DNA, 14 bp, Homo sapiens
cggaaccacagggc

SEQ ID NO: 4136387 - DNA, 19 bp, Homo sapiens
cggaaccacagggccagag

SEQ ID NO: 4136388 - DNA, 19 bp, Homo sapiens
cggaacccaagcttagaac

SEQ ID NO: 4136389 - DNA, 16 bp, Homo sapiens
cggaacgttggacttt

SEQ ID NO: 4136390 - DNA, 17 bp, Homo sapiens
cggaactgtcctttcct

SEQ ID NO: 4136391 - DNA, 21 bp, Homo sapiens
cggaagggctttggttccttc

SEQ ID NO: 4136392 - DNA, 19 bp, Homo sapiens
cggaataaactagagaagg

SEQ ID NO: 4136393 - DNA, 13 bp, Homo sapiens
cggacaagtttta

SEQ ID NO: 4136394 - DNA, 15 bp, Homo sapiens
cggacactcctagag

SEQ ID NO: 4136395 - DNA, 16 bp, Homo sapiens
cggacatactctctgc

SEQ ID NO: 4136396 - DNA, 15 bp, Homo sapiens
cggactcccgggcca

SEQ ID NO: 4136397 - DNA, 14 bp, Homo sapiens
cggactctgcccct

SEQ ID NO: 4136398 - DNA, 21 bp, Homo sapiens
cggagacagaggaaagggctg

SEQ ID NO: 4136399 - DNA, 14 bp, Homo sapiens
cggagagaaaaaag

SEQ ID NO: 4136400 - DNA, 18 bp, Homo sapiens
cggagaggaagccagctg

SEQ ID NO: 4136401 - DNA, 19 bp, Homo sapiens
cggagaggaagccagctgg

SEQ ID NO: 4136402 - DNA, 12 bp, Homo sapiens
cggagaggctgt

SEQ ID NO: 4136403 - DNA, 16 bp, Homo sapiens
cggagaggctgtctgg

SEQ ID NO: 4136404 - DNA, 17 bp, Homo sapiens
cggagagtacagtgagc

SEQ ID NO: 4136405 - DNA, 18 bp, Homo sapiens
cggagagtacagtgagcc

SEQ ID NO: 4136406 - DNA, 22 bp, Homo sapiens
cggagccccaggcctctgtgtc

SEQ ID NO: 4136407 - DNA, 17 bp, Homo sapiens
cggagcccttggcccct

SEQ ID NO: 4136408 - DNA, 18 bp, Homo sapiens
cggaggagaccagctcag

SEQ ID NO: 4136409 - DNA, 22 bp, Homo sapiens
cggaggagaccagctcagaggc

SEQ ID NO: 4136410 - DNA, 13 bp, Homo sapiens
cggaggagctgcc

SEQ ID NO: 4136411 - DNA, 17 bp, Homo sapiens
cggaggagggatgctgc

SEQ ID NO: 4136412 - DNA, 19 bp, Homo sapiens
cggaggctgcccccggccc

SEQ ID NO: 4136413 - DNA, 21 bp, Homo sapiens
cggaggctgtgctccgccatg

SEQ ID NO: 4136414 - DNA, 17 bp, Homo sapiens
cggagggattcccctaa

SEQ ID NO: 4136415 - DNA, 22 bp, Homo sapiens
cggagggcccctgcgtgggggc

SEQ ID NO: 4136416 - DNA, 11 bp, Homo sapiens
cggaggggagt

SEQ ID NO: 4136417 - DNA, 22 bp, Homo sapiens
cggaggttgggtgggccggctt

SEQ ID NO: 4136418 - DNA, 20 bp, Homo sapiens
cggagttcctaacaggatga

SEQ ID NO: 4136419 - DNA, 15 bp, Homo sapiens
cggatgacaccctgg

SEQ ID NO: 4136420 - DNA, 17 bp, Homo sapiens
cggatgacaccctggcc

SEQ ID NO: 4136421 - DNA, 19 bp, Homo sapiens
cggatgacaccctggcctg

SEQ ID NO: 4136422 - DNA, 14 bp, Homo sapiens
cggatgctgcttcc

SEQ ID NO: 4136423 - DNA, 20 bp, Homo sapiens
cggatggaccaacctgctct

SEQ ID NO: 4136424 - DNA, 22 bp, Homo sapiens
cggatggaccaacctgctctgt

SEQ ID NO: 4136425 - DNA, 16 bp, Homo sapiens
cggattccagcccaca

SEQ ID NO: 4136426 - DNA, 17 bp, Homo sapiens
cggattttttccaaaat

SEQ ID NO: 4136427 - DNA, 15 bp, Homo sapiens
cggcaaacctttccc

SEQ ID NO: 4136428 - DNA, 16 bp, Homo sapiens
cggcaaacctttcccc

SEQ ID NO: 4136429 - DNA, 12 bp, Homo sapiens
cggcaacatcaa

SEQ ID NO: 4136430 - DNA, 14 bp, Homo sapiens
cggcacagggtctg

SEQ ID NO: 4136431 - DNA, 19 bp, Homo sapiens
cggcacagggtctgctctt

SEQ ID NO: 4136432 - DNA, 20 bp, Homo sapiens
cggcagaggaacccccacca

SEQ ID NO: 4136433 - DNA, 21 bp, Homo sapiens
cggcagaggaacccccaccag

SEQ ID NO: 4136434 - DNA, 14 bp, Homo sapiens
cggcaggctcactg

SEQ ID NO: 4136435 - DNA, 17 bp, Homo sapiens
cggcaggctcactgcca

SEQ ID NO: 4136436 - DNA, 22 bp, Homo sapiens
cggcagggcgggcagagggctg

SEQ ID NO: 4136437 - DNA, 17 bp, Homo sapiens
cggccacgcactgggcc

SEQ ID NO: 4136438 - DNA, 18 bp, Homo sapiens
cggccacgcactgggcca

SEQ ID NO: 4136439 - DNA, 22 bp, Homo sapiens
cggccagccccggccctgggct

SEQ ID NO: 4136440 - DNA, 22 bp, Homo sapiens
cggccagcccctggccccagga

SEQ ID NO: 4136441 - DNA, 15 bp, Homo sapiens
cggccagcgggcaca

SEQ ID NO: 4136442 - DNA, 16 bp, Homo sapiens
cggccagcgggcacag

SEQ ID NO: 4136443 - DNA, 19 bp, Homo sapiens
cggccagcgggcacagggc

SEQ ID NO: 4136444 - DNA, 20 bp, Homo sapiens
cggccagcgggcacagggca

SEQ ID NO: 4136445 - DNA, 21 bp, Homo sapiens
cggccagcgggcacagggcac

SEQ ID NO: 4136446 - DNA, 11 bp, Homo sapiens
cggccaggcac

SEQ ID NO: 4136447 - DNA, 15 bp, Homo sapiens
cggccaggcacaggg

SEQ ID NO: 4136448 - DNA, 18 bp, Homo sapiens
cggccaggcacagggccc

SEQ ID NO: 4136449 - DNA, 19 bp, Homo sapiens
cggccaggcacagggcccg

SEQ ID NO: 4136450 - DNA, 17 bp, Homo sapiens
cggccagggagaagctc

SEQ ID NO: 4136451 - DNA, 18 bp, Homo sapiens
cggcccagatgtgtcccc

SEQ ID NO: 4136452 - DNA, 12 bp, Homo sapiens
cggccccaggag

SEQ ID NO: 4136453 - DNA, 13 bp, Homo sapiens
cggccccaggagg

SEQ ID NO: 4136454 - DNA, 13 bp, Homo sapiens
cggccccatctct

SEQ ID NO: 4136455 - DNA, 15 bp, Homo sapiens
cggcccctcccgccc

SEQ ID NO: 4136456 - DNA, 13 bp, Homo sapiens
cggcccggccagc

SEQ ID NO: 4136457 - DNA, 20 bp, Homo sapiens
cggcccggccagcgggcaca

SEQ ID NO: 4136458 - DNA, 22 bp, Homo sapiens
cggcccggccagcgggcacagg

SEQ ID NO: 4136459 - DNA, 17 bp, Homo sapiens
cggccctgcagccagct

SEQ ID NO: 4136460 - DNA, 19 bp, Homo sapiens
cggcctcagggcgctcaga

SEQ ID NO: 4136461 - DNA, 21 bp, Homo sapiens
cggcctcagggcgctcagacg

SEQ ID NO: 4136462 - DNA, 15 bp, Homo sapiens
cggcctcccaaagtg

SEQ ID NO: 4136463 - DNA, 22 bp, Homo sapiens
cggcctcctcggagagcagcag

SEQ ID NO: 4136464 - DNA, 23 bp, Homo sapiens
cggcctcctcggagagcagcagc

SEQ ID NO: 4136465 - DNA, 19 bp, Homo sapiens
cggcctcgtgccatgatct

SEQ ID NO: 4136466 - DNA, 16 bp, Homo sapiens
cggcctgatgctccct

SEQ ID NO: 4136467 - DNA, 17 bp, Homo sapiens
cggcctgatgctccctc

SEQ ID NO: 4136468 - DNA, 23 bp, Homo sapiens
cggcctgatgctccctcccctgc

SEQ ID NO: 4136469 - DNA, 14 bp, Homo sapiens
cggcctgctcccag

SEQ ID NO: 4136470 - DNA, 15 bp, Homo sapiens
cggcctgctcccagc

SEQ ID NO: 4136471 - DNA, 15 bp, Homo sapiens
cggcctggatgccag

SEQ ID NO: 4136472 - DNA, 21 bp, Homo sapiens
cggcctggatgccagctgtgt

SEQ ID NO: 4136473 - DNA, 21 bp, Homo sapiens
cggcctgtcctccaacaccaa

SEQ ID NO: 4136474 - DNA, 16 bp, Homo sapiens
cggcgcttcccagcac

SEQ ID NO: 4136475 - DNA, 12 bp, Homo sapiens
cggcggccacgc

SEQ ID NO: 4136476 - DNA, 15 bp, Homo sapiens
cggcggccacgcact

SEQ ID NO: 4136477 - DNA, 17 bp, Homo sapiens
cggcggccaggcacagg

SEQ ID NO: 4136478 - DNA, 18 bp, Homo sapiens
cggcggccaggcacaggg

SEQ ID NO: 4136479 - DNA, 19 bp, Homo sapiens
cggcggccaggcacagggc

SEQ ID NO: 4136480 - DNA, 20 bp, Homo sapiens
cggcggccaggcacagggcc

SEQ ID NO: 4136481 - DNA, 16 bp, Homo sapiens
cggctcaagcccagga

SEQ ID NO: 4136482 - DNA, 17 bp, Homo sapiens
cggctcaagcccaggag

SEQ ID NO: 4136483 - DNA, 18 bp, Homo sapiens
cggctcaggctctgctgg

SEQ ID NO: 4136484 - DNA, 18 bp, Homo sapiens
cggctcccctctgcttct

SEQ ID NO: 4136485 - DNA, 14 bp, Homo sapiens
cggctcctcagagc

SEQ ID NO: 4136486 - DNA, 23 bp, Homo sapiens
cggctcctcagagcgccaggaag

SEQ ID NO: 4136487 - DNA, 13 bp, Homo sapiens
cggctgagccttc

SEQ ID NO: 4136488 - DNA, 15 bp, Homo sapiens
cggctgcctgacact

SEQ ID NO: 4136489 - DNA, 21 bp, Homo sapiens
cggctgcctgacactgagccc

SEQ ID NO: 4136490 - DNA, 21 bp, Homo sapiens
cggctgggtcggccctgccca

SEQ ID NO: 4136491 - DNA, 22 bp, Homo sapiens
cggctgggtcggccctgcccaa

SEQ ID NO: 4136492 - DNA, 17 bp, Homo sapiens
cggcttaccatctctac

SEQ ID NO: 4136493 - DNA, 23 bp, Homo sapiens
cggcttagacttcgactcaggat

SEQ ID NO: 4136494 - DNA, 14 bp, Homo sapiens
cggcttgtgggctg

SEQ ID NO: 4136495 - DNA, 15 bp, Homo sapiens
cggcttgtgggctgg

SEQ ID NO: 4136496 - DNA, 14 bp, Homo sapiens
cgggaaccaagcag

SEQ ID NO: 4136497 - DNA, 16 bp, Homo sapiens
cgggaaccaagcagga

SEQ ID NO: 4136498 - DNA, 13 bp, Homo sapiens
cgggaagcagcca

SEQ ID NO: 4136499 - DNA, 14 bp, Homo sapiens
cgggaagcagccag

SEQ ID NO: 4136500 - DNA, 15 bp, Homo sapiens
cgggaagcagccagc

SEQ ID NO: 4136501 - DNA, 20 bp, Homo sapiens
cgggaaggtcaccagcacca

SEQ ID NO: 4136502 - DNA, 13 bp, Homo sapiens
cgggacagacctg

SEQ ID NO: 4136503 - DNA, 12 bp, Homo sapiens
cgggagcctccc

SEQ ID NO: 4136504 - DNA, 22 bp, Homo sapiens
cgggaggcagaggttgcagtgt

SEQ ID NO: 4136505 - DNA, 19 bp, Homo sapiens
cgggaggctgagacaggag

SEQ ID NO: 4136506 - DNA, 20 bp, Homo sapiens
cgggaggctgagacaggaga

SEQ ID NO: 4136507 - DNA, 14 bp, Homo sapiens
cgggaggctgggca

SEQ ID NO: 4136508 - DNA, 16 bp, Homo sapiens
cgggaggctgggcaca

SEQ ID NO: 4136509 - DNA, 16 bp, Homo sapiens
cgggagggcggcacag

SEQ ID NO: 4136510 - DNA, 17 bp, Homo sapiens
cgggaggggaaaggctg

SEQ ID NO: 4136511 - DNA, 20 bp, Homo sapiens
cgggagtcctctagcaggcc

SEQ ID NO: 4136512 - DNA, 16 bp, Homo sapiens
cgggatgtcagcagac

SEQ ID NO: 4136513 - DNA, 22 bp, Homo sapiens
cgggcacagggcaccagaggcc

SEQ ID NO: 4136514 - DNA, 14 bp, Homo sapiens
cgggcagagggctg

SEQ ID NO: 4136515 - DNA, 22 bp, Homo sapiens
cgggcagagggctggaggccca

SEQ ID NO: 4136516 - DNA, 17 bp, Homo sapiens
cgggcagcgggccaggc

SEQ ID NO: 4136517 - DNA, 18 bp, Homo sapiens
cgggcagcgggccaggcc

SEQ ID NO: 4136518 - DNA, 23 bp, Homo sapiens
cgggcaggtcctgcccatgtgtc

SEQ ID NO: 4136519 - DNA, 18 bp, Homo sapiens
cgggcatgtctgcctgga

SEQ ID NO: 4136520 - DNA, 16 bp, Homo sapiens
cgggccacgccccagc

SEQ ID NO: 4136521 - DNA, 18 bp, Homo sapiens
cgggccacgccccagccc

SEQ ID NO: 4136522 - DNA, 23 bp, Homo sapiens
cgggccacgccccagcccgacaa

SEQ ID NO: 4136523 - DNA, 14 bp, Homo sapiens
cgggccaggcccgc

SEQ ID NO: 4136524 - DNA, 18 bp, Homo sapiens
cgggccatgagggacagg

SEQ ID NO: 4136525 - DNA, 19 bp, Homo sapiens
cgggccccatcctcatccc

SEQ ID NO: 4136526 - DNA, 23 bp, Homo sapiens
cgggccgaggcccagcgggcaga

SEQ ID NO: 4136527 - DNA, 16 bp, Homo sapiens
cgggcctggagaacta

SEQ ID NO: 4136528 - DNA, 23 bp, Homo sapiens
cgggcgcctgtagtcccagccac

SEQ ID NO: 4136529 - DNA, 16 bp, Homo sapiens
cgggcgcggccagccc

SEQ ID NO: 4136530 - DNA, 21 bp, Homo sapiens
cgggcggtcaggggttcgaga

SEQ ID NO: 4136531 - DNA, 17 bp, Homo sapiens
cgggcgtggtggcgggc

SEQ ID NO: 4136532 - DNA, 20 bp, Homo sapiens
cgggctaacgggaggctggg

SEQ ID NO: 4136533 - DNA, 14 bp, Homo sapiens
cgggctgagggcct

SEQ ID NO: 4136534 - DNA, 16 bp, Homo sapiens
cgggctgagggcctgc

SEQ ID NO: 4136535 - DNA, 19 bp, Homo sapiens
cgggcttgactttggctga

SEQ ID NO: 4136536 - DNA, 20 bp, Homo sapiens
cgggcttgggccctgcacag

SEQ ID NO: 4136537 - DNA, 19 bp, Homo sapiens
cggggaagctgccagccca

SEQ ID NO: 4136538 - DNA, 22 bp, Homo sapiens
cggggaagctgccagcccagaa

SEQ ID NO: 4136539 - DNA, 16 bp, Homo sapiens
cggggaagctggcttt

SEQ ID NO: 4136540 - DNA, 18 bp, Homo sapiens
cggggacagaggcctgcc

SEQ ID NO: 4136541 - DNA, 12 bp, Homo sapiens
cggggcccagga

SEQ ID NO: 4136542 - DNA, 17 bp, Homo sapiens
cggggcctcgggacctc

SEQ ID NO: 4136543 - DNA, 18 bp, Homo sapiens
cggggcctcgggacctca

SEQ ID NO: 4136544 - DNA, 19 bp, Homo sapiens
cggggcgatgctccctcag

SEQ ID NO: 4136545 - DNA, 15 bp, Homo sapiens
cgggggaggtgggtg

SEQ ID NO: 4136546 - DNA, 23 bp, Homo sapiens
cgggggaggtgggtgtgggtgga

SEQ ID NO: 4136547 - DNA, 22 bp, Homo sapiens
cggggggagggttggggagggg

SEQ ID NO: 4136548 - DNA, 19 bp, Homo sapiens
cggggtggtgggaaccatg

SEQ ID NO: 4136549 - DNA, 18 bp, Homo sapiens
cggggtgtaacttcctgc

SEQ ID NO: 4136550 - DNA, 19 bp, Homo sapiens
cggggtgtaacttcctgct

SEQ ID NO: 4136551 - DNA, 13 bp, Homo sapiens
cggggttccctcc

SEQ ID NO: 4136552 - DNA, 16 bp, Homo sapiens
cgggtcttcctactct

SEQ ID NO: 4136553 - DNA, 22 bp, Homo sapiens
cgggtgcatttgagagaagcca

SEQ ID NO: 4136554 - DNA, 23 bp, Homo sapiens
cgggtgctggaagtctccatgaa

SEQ ID NO: 4136555 - DNA, 15 bp, Homo sapiens
cgggtgtggcctcag

SEQ ID NO: 4136556 - DNA, 19 bp, Homo sapiens
cgggtgtggcctcagccct

SEQ ID NO: 4136557 - DNA, 13 bp, Homo sapiens
cgggttcagcctg

SEQ ID NO: 4136558 - DNA, 15 bp, Homo sapiens
cgggttcagcctggc

SEQ ID NO: 4136559 - DNA, 17 bp, Homo sapiens
cggtaactgtcctgtcc

SEQ ID NO: 4136560 - DNA, 18 bp, Homo sapiens
cggtaactgtcctgtcct

SEQ ID NO: 4136561 - DNA, 22 bp, Homo sapiens
cggtaccttccatacacagagg

SEQ ID NO: 4136562 - DNA, 15 bp, Homo sapiens
cggtagccagcacac

SEQ ID NO: 4136563 - DNA, 20 bp, Homo sapiens
cggtcaggctgggcagcccc

SEQ ID NO: 4136564 - DNA, 13 bp, Homo sapiens
cggtcagtgcctt

SEQ ID NO: 4136565 - DNA, 21 bp, Homo sapiens
cggtcccagttttgttgcccc

SEQ ID NO: 4136566 - DNA, 14 bp, Homo sapiens
cggtccccatcccc

SEQ ID NO: 4136567 - DNA, 15 bp, Homo sapiens
cggtccccatcccca

SEQ ID NO: 4136568 - DNA, 17 bp, Homo sapiens
cggtccccatccccacc

SEQ ID NO: 4136569 - DNA, 18 bp, Homo sapiens
cggtccccatccccacca

SEQ ID NO: 4136570 - DNA, 19 bp, Homo sapiens
cggtccccatccccaccag

SEQ ID NO: 4136571 - DNA, 13 bp, Homo sapiens
cggtccctgtccc

SEQ ID NO: 4136572 - DNA, 16 bp, Homo sapiens
cggtcgggcagccagc

SEQ ID NO: 4136573 - DNA, 16 bp, Homo sapiens
cggtctgacagtcctt

SEQ ID NO: 4136574 - DNA, 21 bp, Homo sapiens
cggtcttcaacatcctgccag

SEQ ID NO: 4136575 - DNA, 19 bp, Homo sapiens
cggtgacctctagccctgc

SEQ ID NO: 4136576 - DNA, 13 bp, Homo sapiens
cggtgctgcagga

SEQ ID NO: 4136577 - DNA, 18 bp, Homo sapiens
cggtgctgtgagggaggg

SEQ ID NO: 4136578 - DNA, 20 bp, Homo sapiens
cggtggctcacgcctgtaat

SEQ ID NO: 4136579 - DNA, 20 bp, Homo sapiens
cggtggctcaggcctataac

SEQ ID NO: 4136580 - DNA, 14 bp, Homo sapiens
cggtggctgccccg

SEQ ID NO: 4136581 - DNA, 13 bp, Homo sapiens
cggtggctgggca

SEQ ID NO: 4136582 - DNA, 19 bp, Homo sapiens
cggtgggcatttgtgaggc

SEQ ID NO: 4136583 - DNA, 14 bp, Homo sapiens
cggtgtccccagag

SEQ ID NO: 4136584 - DNA, 19 bp, Homo sapiens
cggttcagtgtttctgggg

SEQ ID NO: 4136585 - DNA, 14 bp, Homo sapiens
cggttcctcatctg

SEQ ID NO: 4136586 - DNA, 19 bp, Homo sapiens
cggttctccagaatgtaag

SEQ ID NO: 4136587 - DNA, 12 bp, Homo sapiens
cgtaaaatggtg

SEQ ID NO: 4136588 - DNA, 20 bp, Homo sapiens
cgtaaatcatattttagctg

SEQ ID NO: 4136589 - DNA, 15 bp, Homo sapiens
cgtaaccacggaaaa

SEQ ID NO: 4136590 - DNA, 23 bp, Homo sapiens
cgtaaccagccagatcctcttgg

SEQ ID NO: 4136591 - DNA, 16 bp, Homo sapiens
cgtaattttgccaaat

SEQ ID NO: 4136592 - DNA, 20 bp, Homo sapiens
cgtacatctgcaatatgaat

SEQ ID NO: 4136593 - DNA, 20 bp, Homo sapiens
cgtagggagtacctgctgcc

SEQ ID NO: 4136594 - DNA, 21 bp, Homo sapiens
cgtagtcggcacagcctggtc

SEQ ID NO: 4136595 - DNA, 15 bp, Homo sapiens
cgtagtgcagcaggg

SEQ ID NO: 4136596 - DNA, 16 bp, Homo sapiens
cgtatgtctgttacca

SEQ ID NO: 4136597 - DNA, 17 bp, Homo sapiens
cgtcagaagcacccagg

SEQ ID NO: 4136598 - DNA, 19 bp, Homo sapiens
cgtcatggcttaatgttta

SEQ ID NO: 4136599 - DNA, 20 bp, Homo sapiens
cgtcatggcttaatgtttat

SEQ ID NO: 4136600 - DNA, 22 bp, Homo sapiens
cgtccacgtgcgtgttttctga

SEQ ID NO: 4136601 - DNA, 21 bp, Homo sapiens
cgtccagccgccattgccacc

SEQ ID NO: 4136602 - DNA, 13 bp, Homo sapiens
cgtcccaccagct

SEQ ID NO: 4136603 - DNA, 16 bp, Homo sapiens
cgtcccctccttccct

SEQ ID NO: 4136604 - DNA, 23 bp, Homo sapiens
cgtcctgacggcgcccccagtgt

SEQ ID NO: 4136605 - DNA, 16 bp, Homo sapiens
cgtcctgcctggcact

SEQ ID NO: 4136606 - DNA, 18 bp, Homo sapiens
cgtcctgctttggcagtg

SEQ ID NO: 4136607 - DNA, 21 bp, Homo sapiens
cgtcggggaggctcctgcctg

SEQ ID NO: 4136608 - DNA, 19 bp, Homo sapiens
cgtctaaccacagctcctt

SEQ ID NO: 4136609 - DNA, 15 bp, Homo sapiens
cgtctggaagtccaa

SEQ ID NO: 4136610 - DNA, 17 bp, Homo sapiens
cgtcttcttgctgcagc

SEQ ID NO: 4136611 - DNA, 12 bp, Homo sapiens
cgtgaaacacac

SEQ ID NO: 4136612 - DNA, 13 bp, Homo sapiens
cgtgaaaccctgt

SEQ ID NO: 4136613 - DNA, 17 bp, Homo sapiens
cgtgacagtgcctggga

SEQ ID NO: 4136614 - DNA, 15 bp, Homo sapiens
cgtgagctggggact

SEQ ID NO: 4136615 - DNA, 23 bp, Homo sapiens
cgtgagctggggactcagggacc

SEQ ID NO: 4136616 - DNA, 15 bp, Homo sapiens
cgtgaggtcccagga

SEQ ID NO: 4136617 - DNA, 18 bp, Homo sapiens
cgtgatccacccacctcg

SEQ ID NO: 4136618 - DNA, 21 bp, Homo sapiens
cgtgatccatccatctccagg

SEQ ID NO: 4136619 - DNA, 20 bp, Homo sapiens
cgtgcacgtggagagctggt

SEQ ID NO: 4136620 - DNA, 17 bp, Homo sapiens
cgtgcactctgctaatc

SEQ ID NO: 4136621 - DNA, 14 bp, Homo sapiens
cgtgccaggagcaa

SEQ ID NO: 4136622 - DNA, 16 bp, Homo sapiens
cgtgccatgatctgta

SEQ ID NO: 4136623 - DNA, 20 bp, Homo sapiens
cgtgccctggtgaatcacct

SEQ ID NO: 4136624 - DNA, 22 bp, Homo sapiens
cgtgccgtgtgagtgtgacagg

SEQ ID NO: 4136625 - DNA, 20 bp, Homo sapiens
cgtgcctccttccacctccc

SEQ ID NO: 4136626 - DNA, 23 bp, Homo sapiens
cgtgcctccttccacctccctcc

SEQ ID NO: 4136627 - DNA, 14 bp, Homo sapiens
cgtgcctggccaga

SEQ ID NO: 4136628 - DNA, 15 bp, Homo sapiens
cgtgcctggccagat

SEQ ID NO: 4136629 - DNA, 17 bp, Homo sapiens
cgtgcctgggggagaga

SEQ ID NO: 4136630 - DNA, 18 bp, Homo sapiens
cgtgccttcagctctaca

SEQ ID NO: 4136631 - DNA, 14 bp, Homo sapiens
cgtgctaaattttc

SEQ ID NO: 4136632 - DNA, 15 bp, Homo sapiens
cgtgctactgcactc

SEQ ID NO: 4136633 - DNA, 23 bp, Homo sapiens
cgtggaaaaagacgatgtttatg

SEQ ID NO: 4136634 - DNA, 11 bp, Homo sapiens
cgtggacaggc

SEQ ID NO: 4136635 - DNA, 20 bp, Homo sapiens
cgtggagcggggtatgaaga

SEQ ID NO: 4136636 - DNA, 20 bp, Homo sapiens
cgtggctcgactatagaaaa

SEQ ID NO: 4136637 - DNA, 14 bp, Homo sapiens
cgtggcttttccta

SEQ ID NO: 4136638 - DNA, 16 bp, Homo sapiens
cgtgggctgaccaggc

SEQ ID NO: 4136639 - DNA, 18 bp, Homo sapiens
cgtggtcactgtgcactg

SEQ ID NO: 4136640 - DNA, 13 bp, Homo sapiens
cgtggtccagctc

SEQ ID NO: 4136641 - DNA, 15 bp, Homo sapiens
cgtggtccagctctt

SEQ ID NO: 4136642 - DNA, 14 bp, Homo sapiens
cgtggtcttttcct

SEQ ID NO: 4136643 - DNA, 21 bp, Homo sapiens
cgtggtgatcaattaaatgta

SEQ ID NO: 4136644 - DNA, 21 bp, Homo sapiens
cgtggttgggaacacagcatt

SEQ ID NO: 4136645 - DNA, 12 bp, Homo sapiens
cgtgtaaaccaa

SEQ ID NO: 4136646 - DNA, 15 bp, Homo sapiens
cgtgtaactgtagtg

SEQ ID NO: 4136647 - DNA, 17 bp, Homo sapiens
cgtgtattgagatttct

SEQ ID NO: 4136648 - DNA, 22 bp, Homo sapiens
cgtgtattgagatttcttaaat

SEQ ID NO: 4136649 - DNA, 16 bp, Homo sapiens
cgtgtccagcacagaa

SEQ ID NO: 4136650 - DNA, 21 bp, Homo sapiens
cgtgtccagcacagaaggaat

SEQ ID NO: 4136651 - DNA, 14 bp, Homo sapiens
cgtgtctgtattta

SEQ ID NO: 4136652 - DNA, 14 bp, Homo sapiens
cgtgtcttccactt

SEQ ID NO: 4136653 - DNA, 14 bp, Homo sapiens
cgtgtgctgtgttt

SEQ ID NO: 4136654 - DNA, 23 bp, Homo sapiens
cgtgtgtaaatatgtacatttgt

SEQ ID NO: 4136655 - DNA, 15 bp, Homo sapiens
cgtgtgtagagttaa

SEQ ID NO: 4136656 - DNA, 16 bp, Homo sapiens
cgtgttctccttttcc

SEQ ID NO: 4136657 - DNA, 16 bp, Homo sapiens
cgtgtttgtctcttct

SEQ ID NO: 4136658 - DNA, 11 bp, Homo sapiens
cgttaacattg

SEQ ID NO: 4136659 - DNA, 20 bp, Homo sapiens
cgttaggaaaaccagagcct

SEQ ID NO: 4136660 - DNA, 16 bp, Homo sapiens
cgttattataaatgtt

SEQ ID NO: 4136661 - DNA, 19 bp, Homo sapiens
cgttccacagttgccacca

SEQ ID NO: 4136662 - DNA, 20 bp, Homo sapiens
cgttccacagttgccaccac

SEQ ID NO: 4136663 - DNA, 18 bp, Homo sapiens
cgttctgctgcccctgca

SEQ ID NO: 4136664 - DNA, 20 bp, Homo sapiens
cgttctgctgcccctgcagt

SEQ ID NO: 4136665 - DNA, 17 bp, Homo sapiens
cgttctgctggcctgga

SEQ ID NO: 4136666 - DNA, 16 bp, Homo sapiens
cgttctgttctgctgg

SEQ ID NO: 4136667 - DNA, 23 bp, Homo sapiens
cgttggacttttcgttaacattg

SEQ ID NO: 4136668 - DNA, 15 bp, Homo sapiens
cgttgggagcctagc

SEQ ID NO: 4136669 - DNA, 20 bp, Homo sapiens
cgttgttgcatgtttgaaat

SEQ ID NO: 4136670 - DNA, 18 bp, Homo sapiens
cgtttattaatgcctctc

SEQ ID NO: 4136671 - DNA, 12 bp, Homo sapiens
cgtttctccttt

SEQ ID NO: 4136672 - DNA, 13 bp, Homo sapiens
cgtttctcctttt

SEQ ID NO: 4136673 - DNA, 14 bp, Homo sapiens
cgttttattgtgtt

SEQ ID NO: 4136674 - DNA, 13 bp, Homo sapiens
cgttttgaagcta

SEQ ID NO: 4136675 - DNA, 23 bp, Homo sapiens
cgtttttcagcacccccacccac

SEQ ID NO: 4136676 - DNA, 13 bp, Homo sapiens
cgtttttgtgctg

SEQ ID NO: 4136677 - DNA, 15 bp, Homo sapiens
cgtttttgtgctgtg

SEQ ID NO: 4136678 - DNA, 19 bp, Homo sapiens
cgtttttgtgctgtgggca

SEQ ID NO: 4136679 - DNA, 11 bp, Homo sapiens
ctaaaaaacag

SEQ ID NO: 4136680 - DNA, 22 bp, Homo sapiens
ctaaaaaacataaatttcttta

SEQ ID NO: 4136681 - DNA, 15 bp, Homo sapiens
ctaaaaaacattttt

SEQ ID NO: 4136682 - DNA, 20 bp, Homo sapiens
ctaaaaatattcctccaaat

SEQ ID NO: 4136683 - DNA, 14 bp, Homo sapiens
ctaaaaatattgtt

SEQ ID NO: 4136684 - DNA, 17 bp, Homo sapiens
ctaaaacaaaatctgaa

SEQ ID NO: 4136685 - DNA, 11 bp, Homo sapiens
ctaaaaccatt

SEQ ID NO: 4136686 - DNA, 23 bp, Homo sapiens
ctaaaaggtatgcaatcaaatct

SEQ ID NO: 4136687 - DNA, 14 bp, Homo sapiens
ctaaaagtaaacat

SEQ ID NO: 4136688 - DNA, 18 bp, Homo sapiens
ctaaaatatataatttat

SEQ ID NO: 4136689 - DNA, 14 bp, Homo sapiens
ctaaaatcttggaa

SEQ ID NO: 4136690 - DNA, 14 bp, Homo sapiens
ctaaaatgatttta

SEQ ID NO: 4136691 - DNA, 17 bp, Homo sapiens
ctaaaattaggactgta

SEQ ID NO: 4136692 - DNA, 12 bp, Homo sapiens
ctaaacagatat

SEQ ID NO: 4136693 - DNA, 17 bp, Homo sapiens
ctaaaccaaggactgag

SEQ ID NO: 4136694 - DNA, 23 bp, Homo sapiens
ctaaaccaaggactgagcaccct

SEQ ID NO: 4136695 - DNA, 16 bp, Homo sapiens
ctaaacccctgtccca

SEQ ID NO: 4136696 - DNA, 14 bp, Homo sapiens
ctaaactccttcct

SEQ ID NO: 4136697 - DNA, 12 bp, Homo sapiens
ctaaactgcaaa

SEQ ID NO: 4136698 - DNA, 19 bp, Homo sapiens
ctaaactggtgtttttccc

SEQ ID NO: 4136699 - DNA, 17 bp, Homo sapiens
ctaaactttggcctttg

SEQ ID NO: 4136700 - DNA, 16 bp, Homo sapiens
ctaaagagagaatgta

SEQ ID NO: 4136701 - DNA, 17 bp, Homo sapiens
ctaaagagcccttgcct

SEQ ID NO: 4136702 - DNA, 21 bp, Homo sapiens
ctaaagagcccttgcctcccc

SEQ ID NO: 4136703 - DNA, 23 bp, Homo sapiens
ctaaagagcccttgcctccccat

SEQ ID NO: 4136704 - DNA, 18 bp, Homo sapiens
ctaaagaggctgaaagag

SEQ ID NO: 4136705 - DNA, 14 bp, Homo sapiens
ctaaagcagaggca

SEQ ID NO: 4136706 - DNA, 14 bp, Homo sapiens
ctaaagccagcctg

SEQ ID NO: 4136707 - DNA, 16 bp, Homo sapiens
ctaaaggatccagaga

SEQ ID NO: 4136708 - DNA, 18 bp, Homo sapiens
ctaaaggatccagagagc

SEQ ID NO: 4136709 - DNA, 16 bp, Homo sapiens
ctaaaggtgtatttaa

SEQ ID NO: 4136710 - DNA, 17 bp, Homo sapiens
ctaaaggtgtatttaaa

SEQ ID NO: 4136711 - DNA, 17 bp, Homo sapiens
ctaaagtacagcctgga

SEQ ID NO: 4136712 - DNA, 19 bp, Homo sapiens
ctaaagtatttttataaat

SEQ ID NO: 4136713 - DNA, 15 bp, Homo sapiens
ctaaagttacctgtt

SEQ ID NO: 4136714 - DNA, 22 bp, Homo sapiens
ctaaataatgaataaactgaat

SEQ ID NO: 4136715 - DNA, 14 bp, Homo sapiens
ctaaatatttcctt

SEQ ID NO: 4136716 - DNA, 15 bp, Homo sapiens
ctaaatatttcctta

SEQ ID NO: 4136717 - DNA, 14 bp, Homo sapiens
ctaaatctatttat

SEQ ID NO: 4136718 - DNA, 15 bp, Homo sapiens
ctaaatcttccttgt

SEQ ID NO: 4136719 - DNA, 12 bp, Homo sapiens
ctaaatgaatgt

SEQ ID NO: 4136720 - DNA, 14 bp, Homo sapiens
ctaaatgaatgttt

SEQ ID NO: 4136721 - DNA, 16 bp, Homo sapiens
ctaaatgaatgtttac

SEQ ID NO: 4136722 - DNA, 16 bp, Homo sapiens
ctaaatgagctcctgc

SEQ ID NO: 4136723 - DNA, 20 bp, Homo sapiens
ctaaatgcaccaagaaagct

SEQ ID NO: 4136724 - DNA, 21 bp, Homo sapiens
ctaaatgcatatcctgagcca

SEQ ID NO: 4136725 - DNA, 19 bp, Homo sapiens
ctaaatgcctaataaacaa

SEQ ID NO: 4136726 - DNA, 20 bp, Homo sapiens
ctaaatggtcgcccaggaga

SEQ ID NO: 4136727 - DNA, 15 bp, Homo sapiens
ctaaattagataaat

SEQ ID NO: 4136728 - DNA, 14 bp, Homo sapiens
ctaaatttaaattt

SEQ ID NO: 4136729 - DNA, 23 bp, Homo sapiens
ctaaatttgaatgttaagcagat

SEQ ID NO: 4136730 - DNA, 20 bp, Homo sapiens
ctaacaaaagatgaaagcag

SEQ ID NO: 4136731 - DNA, 17 bp, Homo sapiens
ctaacacacacagaaaa

SEQ ID NO: 4136732 - DNA, 14 bp, Homo sapiens
ctaacacagcatgt

SEQ ID NO: 4136733 - DNA, 14 bp, Homo sapiens
ctaacacccagtct

SEQ ID NO: 4136734 - DNA, 22 bp, Homo sapiens
ctaacatggtgaaaccccgtct

SEQ ID NO: 4136735 - DNA, 19 bp, Homo sapiens
ctaaccagtacctctgtat

SEQ ID NO: 4136736 - DNA, 12 bp, Homo sapiens
ctaaccttgaat

SEQ ID NO: 4136737 - DNA, 14 bp, Homo sapiens
ctaacgccagcaca

SEQ ID NO: 4136738 - DNA, 15 bp, Homo sapiens
ctaacgggaggctgg

SEQ ID NO: 4136739 - DNA, 20 bp, Homo sapiens
ctaacgggaggctgggcaca

SEQ ID NO: 4136740 - DNA, 22 bp, Homo sapiens
ctaacgttgagcccctggaggc

SEQ ID NO: 4136741 - DNA, 19 bp, Homo sapiens
ctaacttattttatttcca

SEQ ID NO: 4136742 - DNA, 22 bp, Homo sapiens
ctaacttattttatttccatca

SEQ ID NO: 4136743 - DNA, 20 bp, Homo sapiens
ctaactttagaagtgcattt

SEQ ID NO: 4136744 - DNA, 22 bp, Homo sapiens
ctaagaaaagatacgactttat

SEQ ID NO: 4136745 - DNA, 14 bp, Homo sapiens
ctaagaaaagattt

SEQ ID NO: 4136746 - DNA, 16 bp, Homo sapiens
ctaagaaacttaaatt

SEQ ID NO: 4136747 - DNA, 15 bp, Homo sapiens
ctaagaaatatgtga

SEQ ID NO: 4136748 - DNA, 17 bp, Homo sapiens
ctaagaaatatgtgaga

SEQ ID NO: 4136749 - DNA, 14 bp, Homo sapiens
ctaagaacctggaa

SEQ ID NO: 4136750 - DNA, 20 bp, Homo sapiens
ctaagagaaaattgcactaa

SEQ ID NO: 4136751 - DNA, 15 bp, Homo sapiens
ctaagagaatgaatt

SEQ ID NO: 4136752 - DNA, 22 bp, Homo sapiens
ctaagagtgctgggcattttta

SEQ ID NO: 4136753 - DNA, 15 bp, Homo sapiens
ctaagcaatttcttg

SEQ ID NO: 4136754 - DNA, 20 bp, Homo sapiens
ctaagccactcttccaaagg

SEQ ID NO: 4136755 - DNA, 13 bp, Homo sapiens
ctaagccaggcct

SEQ ID NO: 4136756 - DNA, 15 bp, Homo sapiens
ctaagccaggcctgg

SEQ ID NO: 4136757 - DNA, 18 bp, Homo sapiens
ctaagccaggcctggctg

SEQ ID NO: 4136758 - DNA, 12 bp, Homo sapiens
ctaagcccccag

SEQ ID NO: 4136759 - DNA, 14 bp, Homo sapiens
ctaagcccccaggg

SEQ ID NO: 4136760 - DNA, 15 bp, Homo sapiens
ctaagcccccagggc

SEQ ID NO: 4136761 - DNA, 20 bp, Homo sapiens
ctaagcccccagggcctcca

SEQ ID NO: 4136762 - DNA, 20 bp, Homo sapiens
ctaagccctgtcgagacact

SEQ ID NO: 4136763 - DNA, 11 bp, Homo sapiens
ctaagcccttt

SEQ ID NO: 4136764 - DNA, 16 bp, Homo sapiens
ctaagccctttgccat

SEQ ID NO: 4136765 - DNA, 17 bp, Homo sapiens
ctaagccctttgccatc

SEQ ID NO: 4136766 - DNA, 23 bp, Homo sapiens
ctaagcctacctgctctccaagt

SEQ ID NO: 4136767 - DNA, 14 bp, Homo sapiens
ctaagcctcctttt

SEQ ID NO: 4136768 - DNA, 22 bp, Homo sapiens
ctaagcgcacattcatgtgggc

SEQ ID NO: 4136769 - DNA, 22 bp, Homo sapiens
ctaagctattcagtaataactc

SEQ ID NO: 4136770 - DNA, 15 bp, Homo sapiens
ctaagctctttgaga

SEQ ID NO: 4136771 - DNA, 18 bp, Homo sapiens
ctaagctggctctgtttg

SEQ ID NO: 4136772 - DNA, 15 bp, Homo sapiens
ctaaggaaccttcct

SEQ ID NO: 4136773 - DNA, 12 bp, Homo sapiens
ctaaggacacac

SEQ ID NO: 4136774 - DNA, 13 bp, Homo sapiens
ctaaggacacact

SEQ ID NO: 4136775 - DNA, 16 bp, Homo sapiens
ctaaggacatttccca

SEQ ID NO: 4136776 - DNA, 19 bp, Homo sapiens
ctaaggacatttcccaggg

SEQ ID NO: 4136777 - DNA, 20 bp, Homo sapiens
ctaaggatagcaccgctttt

SEQ ID NO: 4136778 - DNA, 23 bp, Homo sapiens
ctaaggatctctcaggagcacag

SEQ ID NO: 4136779 - DNA, 20 bp, Homo sapiens
ctaaggatgtcacagggcca

SEQ ID NO: 4136780 - DNA, 13 bp, Homo sapiens
ctaaggcccccaa

SEQ ID NO: 4136781 - DNA, 22 bp, Homo sapiens
ctaaggcccccaaacatagccc

SEQ ID NO: 4136782 - DNA, 14 bp, Homo sapiens
ctaaggctcctcct

SEQ ID NO: 4136783 - DNA, 15 bp, Homo sapiens
ctaagggaagacatt

SEQ ID NO: 4136784 - DNA, 18 bp, Homo sapiens
ctaagggaagacatttct

SEQ ID NO: 4136785 - DNA, 11 bp, Homo sapiens
ctaagggggag

SEQ ID NO: 4136786 - DNA, 21 bp, Homo sapiens
ctaagggtgggtgctcagaat

SEQ ID NO: 4136787 - DNA, 19 bp, Homo sapiens
ctaagtaaatctcttctgt

SEQ ID NO: 4136788 - DNA, 23 bp, Homo sapiens
ctaagtaaatctcttctgtgttt

SEQ ID NO: 4136789 - DNA, 13 bp, Homo sapiens
ctaagtgatataa

SEQ ID NO: 4136790 - DNA, 14 bp, Homo sapiens
ctaagtgatataaa

SEQ ID NO: 4136791 - DNA, 14 bp, Homo sapiens
ctaagtggctgcct

SEQ ID NO: 4136792 - DNA, 17 bp, Homo sapiens
ctaagtggctgccttct

SEQ ID NO: 4136793 - DNA, 19 bp, Homo sapiens
ctaagtggctgccttcttt

SEQ ID NO: 4136794 - DNA, 17 bp, Homo sapiens
ctaagttatttactttt

SEQ ID NO: 4136795 - DNA, 21 bp, Homo sapiens
ctaataaaattcgctttctaa

SEQ ID NO: 4136796 - DNA, 11 bp, Homo sapiens
ctaataaactg

SEQ ID NO: 4136797 - DNA, 13 bp, Homo sapiens
ctaatagaactca

SEQ ID NO: 4136798 - DNA, 20 bp, Homo sapiens
ctaatagaactcagttttaa

SEQ ID NO: 4136799 - DNA, 18 bp, Homo sapiens
ctaatatatatgaataaa

SEQ ID NO: 4136800 - DNA, 19 bp, Homo sapiens
ctaatcaaagccagggtct

SEQ ID NO: 4136801 - DNA, 18 bp, Homo sapiens
ctaatcaccatgtaagca

SEQ ID NO: 4136802 - DNA, 20 bp, Homo sapiens
ctaatcagcattctcactcc

SEQ ID NO: 4136803 - DNA, 20 bp, Homo sapiens
ctaatcaggctgaggtgtct

SEQ ID NO: 4136804 - DNA, 20 bp, Homo sapiens
ctaatcagggaggtcatttt

SEQ ID NO: 4136805 - DNA, 19 bp, Homo sapiens
ctaatccaggcagatccag

SEQ ID NO: 4136806 - DNA, 20 bp, Homo sapiens
ctaatccaggcagatccagg

SEQ ID NO: 4136807 - DNA, 16 bp, Homo sapiens
ctaatccttttcctta

SEQ ID NO: 4136808 - DNA, 17 bp, Homo sapiens
ctaatctattgggttca

SEQ ID NO: 4136809 - DNA, 18 bp, Homo sapiens
ctaatctattgggttcat

SEQ ID NO: 4136810 - DNA, 19 bp, Homo sapiens
ctaatctattgggttcatt

SEQ ID NO: 4136811 - DNA, 20 bp, Homo sapiens
ctaatctattgggttcatta

SEQ ID NO: 4136812 - DNA, 13 bp, Homo sapiens
ctaatctgagctg

SEQ ID NO: 4136813 - DNA, 21 bp, Homo sapiens
ctaatctgagctgcagcctgg

SEQ ID NO: 4136814 - DNA, 23 bp, Homo sapiens
ctaatctgagctgcagcctggct

SEQ ID NO: 4136815 - DNA, 18 bp, Homo sapiens
ctaatctgtagggctgga

SEQ ID NO: 4136816 - DNA, 21 bp, Homo sapiens
ctaatcttaaatcagaataaa

SEQ ID NO: 4136817 - DNA, 23 bp, Homo sapiens
ctaatcttaaatcagaataaatt

SEQ ID NO: 4136818 - DNA, 19 bp, Homo sapiens
ctaatctttcacttgaaag

SEQ ID NO: 4136819 - DNA, 22 bp, Homo sapiens
ctaatctttcacttgaaagatt

SEQ ID NO: 4136820 - DNA, 14 bp, Homo sapiens
ctaatgaagacaat

SEQ ID NO: 4136821 - DNA, 16 bp, Homo sapiens
ctaatgaagacaatga

SEQ ID NO: 4136822 - DNA, 19 bp, Homo sapiens
ctaatgggtatttaaacaa

SEQ ID NO: 4136823 - DNA, 16 bp, Homo sapiens
ctaatgtaaaatgatt

SEQ ID NO: 4136824 - DNA, 19 bp, Homo sapiens
ctaatgtaaactttgtcat

SEQ ID NO: 4136825 - DNA, 19 bp, Homo sapiens
ctaatgtaataactgtgaa

SEQ ID NO: 4136826 - DNA, 19 bp, Homo sapiens
ctaatgtctcactgttctg

SEQ ID NO: 4136827 - DNA, 22 bp, Homo sapiens
ctaatgtctcactgttctgcaa

SEQ ID NO: 4136828 - DNA, 17 bp, Homo sapiens
ctaatgtcttcataaag

SEQ ID NO: 4136829 - DNA, 20 bp, Homo sapiens
ctaatgtttatgagccagac

SEQ ID NO: 4136830 - DNA, 15 bp, Homo sapiens
ctaattaaaaagtta

SEQ ID NO: 4136831 - DNA, 19 bp, Homo sapiens
ctaattagggtacatttat

SEQ ID NO: 4136832 - DNA, 20 bp, Homo sapiens
ctaattagggtacatttata

SEQ ID NO: 4136833 - DNA, 13 bp, Homo sapiens
ctaattatttaaa

SEQ ID NO: 4136834 - DNA, 16 bp, Homo sapiens
ctaattcccagagtgt

SEQ ID NO: 4136835 - DNA, 18 bp, Homo sapiens
ctaattcccattttgcaa

SEQ ID NO: 4136836 - DNA, 21 bp, Homo sapiens
ctaattcccattttgcaaaat

SEQ ID NO: 4136837 - DNA, 14 bp, Homo sapiens
ctaattctaatgtg

SEQ ID NO: 4136838 - DNA, 16 bp, Homo sapiens
ctaattcttctgtcct

SEQ ID NO: 4136839 - DNA, 18 bp, Homo sapiens
ctaattcttctgtcctga

SEQ ID NO: 4136840 - DNA, 16 bp, Homo sapiens
ctaattgcatctcaaa

SEQ ID NO: 4136841 - DNA, 19 bp, Homo sapiens
ctaattgcatctcaaaatt

SEQ ID NO: 4136842 - DNA, 19 bp, Homo sapiens
ctaattggcctctttaaga

SEQ ID NO: 4136843 - DNA, 14 bp, Homo sapiens
ctaatttaaagaga

SEQ ID NO: 4136844 - DNA, 21 bp, Homo sapiens
ctaatttatcttgtctctggg

SEQ ID NO: 4136845 - DNA, 18 bp, Homo sapiens
ctaatttcaaaatgcttt

SEQ ID NO: 4136846 - DNA, 22 bp, Homo sapiens
ctaatttcaaaatgctttttat

SEQ ID NO: 4136847 - DNA, 14 bp, Homo sapiens
ctaatttctcctcc

SEQ ID NO: 4136848 - DNA, 19 bp, Homo sapiens
ctaatttctcctcccttcc

SEQ ID NO: 4136849 - DNA, 16 bp, Homo sapiens
ctaatttgaggctcag

SEQ ID NO: 4136850 - DNA, 15 bp, Homo sapiens
ctaatttgatgttta

SEQ ID NO: 4136851 - DNA, 14 bp, Homo sapiens
ctaatttgcattaa

SEQ ID NO: 4136852 - DNA, 15 bp, Homo sapiens
ctaattttaaataat

SEQ ID NO: 4136853 - DNA, 19 bp, Homo sapiens
ctaattttaaataatttct

SEQ ID NO: 4136854 - DNA, 13 bp, Homo sapiens
ctaattttctcaa

SEQ ID NO: 4136855 - DNA, 17 bp, Homo sapiens
ctaattttttgtacttt

SEQ ID NO: 4136856 - DNA, 12 bp, Homo sapiens
ctacaaccaatt

SEQ ID NO: 4136857 - DNA, 19 bp, Homo sapiens
ctacaaccagagcccccca

SEQ ID NO: 4136858 - DNA, 19 bp, Homo sapiens
ctacaaccatccctgccac

SEQ ID NO: 4136859 - DNA, 16 bp, Homo sapiens
ctacaactgattgcaa

SEQ ID NO: 4136860 - DNA, 15 bp, Homo sapiens
ctacaagagcagcct

SEQ ID NO: 4136861 - DNA, 21 bp, Homo sapiens
ctacaagagcagcctgtggca

SEQ ID NO: 4136862 - DNA, 19 bp, Homo sapiens
ctacaatcagttgacttta

SEQ ID NO: 4136863 - DNA, 21 bp, Homo sapiens
ctacaatcagttgactttaag

SEQ ID NO: 4136864 - DNA, 13 bp, Homo sapiens
ctacaatgtgaac

SEQ ID NO: 4136865 - DNA, 17 bp, Homo sapiens
ctacaatgtgaacttta

SEQ ID NO: 4136866 - DNA, 13 bp, Homo sapiens
ctacacacacaca

SEQ ID NO: 4136867 - DNA, 15 bp, Homo sapiens
ctacacacacactcc

SEQ ID NO: 4136868 - DNA, 13 bp, Homo sapiens
ctacacacaccca

SEQ ID NO: 4136869 - DNA, 12 bp, Homo sapiens
ctacacagcctg

SEQ ID NO: 4136870 - DNA, 16 bp, Homo sapiens
ctacacagcctggact

SEQ ID NO: 4136871 - DNA, 13 bp, Homo sapiens
ctacagaataatc

SEQ ID NO: 4136872 - DNA, 17 bp, Homo sapiens
ctacagactccatctct

SEQ ID NO: 4136873 - DNA, 23 bp, Homo sapiens
ctacagactccatctcttctgca

SEQ ID NO: 4136874 - DNA, 16 bp, Homo sapiens
ctacagacttctccag

SEQ ID NO: 4136875 - DNA, 23 bp, Homo sapiens
ctacagagccgagcaatatttat

SEQ ID NO: 4136876 - DNA, 22 bp, Homo sapiens
ctacagatcctttttccatcat

SEQ ID NO: 4136877 - DNA, 23 bp, Homo sapiens
ctacagatgatagaggattttat

SEQ ID NO: 4136878 - DNA, 21 bp, Homo sapiens
ctacagcactactgggtgtca

SEQ ID NO: 4136879 - DNA, 14 bp, Homo sapiens
ctacagccacatcc

SEQ ID NO: 4136880 - DNA, 22 bp, Homo sapiens
ctacagccacatccccaagccc

SEQ ID NO: 4136881 - DNA, 19 bp, Homo sapiens
ctacagccttgtccccctc

SEQ ID NO: 4136882 - DNA, 20 bp, Homo sapiens
ctacagctttcttgctccct

SEQ ID NO: 4136883 - DNA, 23 bp, Homo sapiens
ctacagctttcttgctcccttca

SEQ ID NO: 4136884 - DNA, 18 bp, Homo sapiens
ctacaggaagcaccccat

SEQ ID NO: 4136885 - DNA, 20 bp, Homo sapiens
ctacaggaagcaccccatgc

SEQ ID NO: 4136886 - DNA, 22 bp, Homo sapiens
ctacaggaagcaccccatgcca

SEQ ID NO: 4136887 - DNA, 20 bp, Homo sapiens
ctacagtcgtaaaagagata

SEQ ID NO: 4136888 - DNA, 21 bp, Homo sapiens
ctacagtcgtaaaagagataa

SEQ ID NO: 4136889 - DNA, 20 bp, Homo sapiens
ctacagtgccaactcctcac

SEQ ID NO: 4136890 - DNA, 14 bp, Homo sapiens
ctacagtggtttta

SEQ ID NO: 4136891 - DNA, 21 bp, Homo sapiens
ctacagtggttttatactgaa

SEQ ID NO: 4136892 - DNA, 23 bp, Homo sapiens
ctacagttagggttgagttactt

SEQ ID NO: 4136893 - DNA, 21 bp, Homo sapiens
ctacagttatgttcagtcaca

SEQ ID NO: 4136894 - DNA, 22 bp, Homo sapiens
ctacagttgtgttagcctcttg

SEQ ID NO: 4136895 - DNA, 22 bp, Homo sapiens
ctacagttgttttttgaaaaca

SEQ ID NO: 4136896 - DNA, 12 bp, Homo sapiens
ctacataaactg

SEQ ID NO: 4136897 - DNA, 23 bp, Homo sapiens
ctacataagtaattcaagaaaac

SEQ ID NO: 4136898 - DNA, 23 bp, Homo sapiens
ctacatactttcatcctgactct

SEQ ID NO: 4136899 - DNA, 14 bp, Homo sapiens
ctacatcccagcct

SEQ ID NO: 4136900 - DNA, 17 bp, Homo sapiens
ctacatcccagcctgtg

SEQ ID NO: 4136901 - DNA, 15 bp, Homo sapiens
ctacatcttctgcct

SEQ ID NO: 4136902 - DNA, 15 bp, Homo sapiens
ctacatgcagcccat

SEQ ID NO: 4136903 - DNA, 21 bp, Homo sapiens
ctacatgcagcccatgcccac

SEQ ID NO: 4136904 - DNA, 15 bp, Homo sapiens
ctacatgctggggtc

SEQ ID NO: 4136905 - DNA, 18 bp, Homo sapiens
ctacatggagtatatgtc

SEQ ID NO: 4136906 - DNA, 17 bp, Homo sapiens
ctacattataaacgctt

SEQ ID NO: 4136907 - DNA, 15 bp, Homo sapiens
ctacattccctctcc

SEQ ID NO: 4136908 - DNA, 15 bp, Homo sapiens
ctaccacagtgtctg

SEQ ID NO: 4136909 - DNA, 20 bp, Homo sapiens
ctaccaggtgtgcctggaag

SEQ ID NO: 4136910 - DNA, 20 bp, Homo sapiens
ctaccagttggcagacagcc

SEQ ID NO: 4136911 - DNA, 14 bp, Homo sapiens
ctaccatcagggac

SEQ ID NO: 4136912 - DNA, 19 bp, Homo sapiens
ctacccacacctctgccag

SEQ ID NO: 4136913 - DNA, 17 bp, Homo sapiens
ctacccatgagcctgcc

SEQ ID NO: 4136914 - DNA, 18 bp, Homo sapiens
ctacccatgagcctgccc

SEQ ID NO: 4136915 - DNA, 15 bp, Homo sapiens
ctaccccacaccagc

SEQ ID NO: 4136916 - DNA, 17 bp, Homo sapiens
ctaccccagggccctgg

SEQ ID NO: 4136917 - DNA, 18 bp, Homo sapiens
ctaccccagggccctggc

SEQ ID NO: 4136918 - DNA, 23 bp, Homo sapiens
ctaccccatatacacctggaaca

SEQ ID NO: 4136919 - DNA, 18 bp, Homo sapiens
ctacccccttttcagctg

SEQ ID NO: 4136920 - DNA, 21 bp, Homo sapiens
ctacccctcccggccctgcct

SEQ ID NO: 4136921 - DNA, 15 bp, Homo sapiens
ctaccctgctccctg

SEQ ID NO: 4136922 - DNA, 16 bp, Homo sapiens
ctaccctttttctcca

SEQ ID NO: 4136923 - DNA, 18 bp, Homo sapiens
ctaccctttttctccagc

SEQ ID NO: 4136924 - DNA, 11 bp, Homo sapiens
ctacctccctc

SEQ ID NO: 4136925 - DNA, 16 bp, Homo sapiens
ctacctctctgtccct

SEQ ID NO: 4136926 - DNA, 16 bp, Homo sapiens
ctacctgccctcaagg

SEQ ID NO: 4136927 - DNA, 14 bp, Homo sapiens
ctaccttcctgtcc

SEQ ID NO: 4136928 - DNA, 14 bp, Homo sapiens
ctaccttgaaaata

SEQ ID NO: 4136929 - DNA, 22 bp, Homo sapiens
ctaccttgaggtcttttgacat

SEQ ID NO: 4136930 - DNA, 23 bp, Homo sapiens
ctacctttatatttggggtcctt

SEQ ID NO: 4136931 - DNA, 20 bp, Homo sapiens
ctacgccactccacaaatga

SEQ ID NO: 4136932 - DNA, 17 bp, Homo sapiens
ctactaccacaaggaaa

SEQ ID NO: 4136933 - DNA, 18 bp, Homo sapiens
ctactaggagaggggggc

SEQ ID NO: 4136934 - DNA, 20 bp, Homo sapiens
ctactatgtgctgggtgcct

SEQ ID NO: 4136935 - DNA, 18 bp, Homo sapiens
ctactcacacttcagctg

SEQ ID NO: 4136936 - DNA, 12 bp, Homo sapiens
ctactcctgact

SEQ ID NO: 4136937 - DNA, 11 bp, Homo sapiens
ctactcctgcc

SEQ ID NO: 4136938 - DNA, 22 bp, Homo sapiens
ctactctcaggatcaagaaagt

SEQ ID NO: 4136939 - DNA, 22 bp, Homo sapiens
ctactctccccacgagggctgg

SEQ ID NO: 4136940 - DNA, 11 bp, Homo sapiens
ctactcttctc

SEQ ID NO: 4136941 - DNA, 17 bp, Homo sapiens
ctactcttctctctgct

SEQ ID NO: 4136942 - DNA, 18 bp, Homo sapiens
ctactcttctctctgctc

SEQ ID NO: 4136943 - DNA, 19 bp, Homo sapiens
ctactcttctctctgctct

SEQ ID NO: 4136944 - DNA, 12 bp, Homo sapiens
ctactctttgat

SEQ ID NO: 4136945 - DNA, 13 bp, Homo sapiens
ctactgaaacaga

SEQ ID NO: 4136946 - DNA, 18 bp, Homo sapiens
ctactgaccagacaagct

SEQ ID NO: 4136947 - DNA, 14 bp, Homo sapiens
ctactgaggtgcta

SEQ ID NO: 4136948 - DNA, 13 bp, Homo sapiens
ctactgagtaggc

SEQ ID NO: 4136949 - DNA, 23 bp, Homo sapiens
ctactgatgaaatctgctagaaa

SEQ ID NO: 4136950 - DNA, 16 bp, Homo sapiens
ctactgatttcctttg

SEQ ID NO: 4136951 - DNA, 17 bp, Homo sapiens
ctactgcactccagcct

SEQ ID NO: 4136952 - DNA, 18 bp, Homo sapiens
ctactgcactccagcctg

SEQ ID NO: 4136953 - DNA, 23 bp, Homo sapiens
ctactgcactccagcctggggga

SEQ ID NO: 4136954 - DNA, 13 bp, Homo sapiens
ctactgcagcacc

SEQ ID NO: 4136955 - DNA, 21 bp, Homo sapiens
ctactgggagactgggacacc

SEQ ID NO: 4136956 - DNA, 18 bp, Homo sapiens
ctactgggtgtcatttca

SEQ ID NO: 4136957 - DNA, 19 bp, Homo sapiens
ctactgggtgtcatttcat

SEQ ID NO: 4136958 - DNA, 19 bp, Homo sapiens
ctactggtcctcttaactg

SEQ ID NO: 4136959 - DNA, 15 bp, Homo sapiens
ctactgtgtgccagg

SEQ ID NO: 4136960 - DNA, 20 bp, Homo sapiens
ctactgtgtgtgtgaatgaa

SEQ ID NO: 4136961 - DNA, 14 bp, Homo sapiens
ctactgtgttcctg

SEQ ID NO: 4136962 - DNA, 15 bp, Homo sapiens
ctactgtgttcctgg

SEQ ID NO: 4136963 - DNA, 19 bp, Homo sapiens
ctactgtgttcctggcaat

SEQ ID NO: 4136964 - DNA, 23 bp, Homo sapiens
ctactgttaggaacagcagtgtt

SEQ ID NO: 4136965 - DNA, 22 bp, Homo sapiens
ctacttcatagctccttggagc

SEQ ID NO: 4136966 - DNA, 17 bp, Homo sapiens
ctacttcctcctcccca

SEQ ID NO: 4136967 - DNA, 19 bp, Homo sapiens
ctacttcctcctccccact

SEQ ID NO: 4136968 - DNA, 23 bp, Homo sapiens
ctacttcttttttcaaaagaaag

SEQ ID NO: 4136969 - DNA, 15 bp, Homo sapiens
ctacttgagaggctg

SEQ ID NO: 4136970 - DNA, 20 bp, Homo sapiens
ctacttgggaggctgaggca

SEQ ID NO: 4136971 - DNA, 13 bp, Homo sapiens
ctacttggtttgt

SEQ ID NO: 4136972 - DNA, 14 bp, Homo sapiens
ctacttggtttgtg

SEQ ID NO: 4136973 - DNA, 17 bp, Homo sapiens
ctacttggtttgtgttc

SEQ ID NO: 4136974 - DNA, 20 bp, Homo sapiens
ctactttggtttctgtctgt

SEQ ID NO: 4136975 - DNA, 16 bp, Homo sapiens
ctagaaaacatttttt

SEQ ID NO: 4136976 - DNA, 21 bp, Homo sapiens
ctagaaaatttagccctttaa

SEQ ID NO: 4136977 - DNA, 22 bp, Homo sapiens
ctagaaagcctgttcccctcac

SEQ ID NO: 4136978 - DNA, 20 bp, Homo sapiens
ctagaaagttagggggttct

SEQ ID NO: 4136979 - DNA, 19 bp, Homo sapiens
ctagaaatgtgaatgagga

SEQ ID NO: 4136980 - DNA, 13 bp, Homo sapiens
ctagaaatttttc

SEQ ID NO: 4136981 - DNA, 23 bp, Homo sapiens
ctagaaatttttcagatgcttct

SEQ ID NO: 4136982 - DNA, 18 bp, Homo sapiens
ctagaactctccatctta

SEQ ID NO: 4136983 - DNA, 17 bp, Homo sapiens
ctagaagaaaagcccat

SEQ ID NO: 4136984 - DNA, 18 bp, Homo sapiens
ctagaagattagaaacta

SEQ ID NO: 4136985 - DNA, 13 bp, Homo sapiens
ctagaagcacatg

SEQ ID NO: 4136986 - DNA, 16 bp, Homo sapiens
ctagaagcacatgtgt

SEQ ID NO: 4136987 - DNA, 20 bp, Homo sapiens
ctagaagggccagtcctgcc

SEQ ID NO: 4136988 - DNA, 12 bp, Homo sapiens
ctagaatggata

SEQ ID NO: 4136989 - DNA, 15 bp, Homo sapiens
ctagaatgtggattt

SEQ ID NO: 4136990 - DNA, 21 bp, Homo sapiens
ctagaatttatcacacttctg

SEQ ID NO: 4136991 - DNA, 13 bp, Homo sapiens
ctagaatttattc

SEQ ID NO: 4136992 - DNA, 15 bp, Homo sapiens
ctagaatttattcaa

SEQ ID NO: 4136993 - DNA, 22 bp, Homo sapiens
ctagaatttattcaattcctct

SEQ ID NO: 4136994 - DNA, 13 bp, Homo sapiens
ctagacacacaaa

SEQ ID NO: 4136995 - DNA, 13 bp, Homo sapiens
ctagacacagata

SEQ ID NO: 4136996 - DNA, 21 bp, Homo sapiens
ctagacttcccaacagcctta

SEQ ID NO: 4136997 - DNA, 23 bp, Homo sapiens
ctagactttgggatcaaataact

SEQ ID NO: 4136998 - DNA, 15 bp, Homo sapiens
ctagagaacgcagcc

SEQ ID NO: 4136999 - DNA, 15 bp, Homo sapiens
ctagagaagaggctg

SEQ ID NO: 4137000 - DNA, 17 bp, Homo sapiens
ctagagaagaggctggt

SEQ ID NO: 4137001 - DNA, 19 bp, Homo sapiens
ctagagaagaggctggtgc

SEQ ID NO: 4137002 - DNA, 17 bp, Homo sapiens
ctagagaagataattgt

SEQ ID NO: 4137003 - DNA, 10 bp, Homo sapiens
ctagagaagg

SEQ ID NO: 4137004 - DNA, 11 bp, Homo sapiens
ctagagcctgc

SEQ ID NO: 4137005 - DNA, 15 bp, Homo sapiens
ctagagcctgcctgg

SEQ ID NO: 4137006 - DNA, 19 bp, Homo sapiens
ctagaggccagccccaccc

SEQ ID NO: 4137007 - DNA, 20 bp, Homo sapiens
ctagaggtcaggacggctcc

SEQ ID NO: 4137008 - DNA, 23 bp, Homo sapiens
ctagagttcggtctgacagtcct

SEQ ID NO: 4137009 - DNA, 13 bp, Homo sapiens
ctagataaaaaga

SEQ ID NO: 4137010 - DNA, 23 bp, Homo sapiens
ctagataaaaagatggcctttgc

SEQ ID NO: 4137011 - DNA, 16 bp, Homo sapiens
ctagatgcatcactgg

SEQ ID NO: 4137012 - DNA, 21 bp, Homo sapiens
ctagattaccccctcattgtt

SEQ ID NO: 4137013 - DNA, 21 bp, Homo sapiens
ctagattaggtagactttgct

SEQ ID NO: 4137014 - DNA, 15 bp, Homo sapiens
ctagcaagctggcct

SEQ ID NO: 4137015 - DNA, 20 bp, Homo sapiens
ctagcaatcacaacactggc

SEQ ID NO: 4137016 - DNA, 16 bp, Homo sapiens
ctagcacagctccctt

SEQ ID NO: 4137017 - DNA, 17 bp, Homo sapiens
ctagcacagctcccttc

SEQ ID NO: 4137018 - DNA, 13 bp, Homo sapiens
ctagcacttcctt

SEQ ID NO: 4137019 - DNA, 14 bp, Homo sapiens
ctagcacttccttg

SEQ ID NO: 4137020 - DNA, 12 bp, Homo sapiens
ctagcagacaga

SEQ ID NO: 4137021 - DNA, 17 bp, Homo sapiens
ctagcagacagaaactg

SEQ ID NO: 4137022 - DNA, 21 bp, Homo sapiens
ctagcagacagaaactggatt

SEQ ID NO: 4137023 - DNA, 12 bp, Homo sapiens
ctagcagagtgc

SEQ ID NO: 4137024 - DNA, 18 bp, Homo sapiens
ctagcagagtgctggcac

SEQ ID NO: 4137025 - DNA, 21 bp, Homo sapiens
ctagcagagtgctggcactta

SEQ ID NO: 4137026 - DNA, 14 bp, Homo sapiens
ctagcaggcctaag

SEQ ID NO: 4137027 - DNA, 16 bp, Homo sapiens
ctagcaggctgttcca

SEQ ID NO: 4137028 - DNA, 15 bp, Homo sapiens
ctagcatatatgtgt

SEQ ID NO: 4137029 - DNA, 12 bp, Homo sapiens
ctagccaccagt

SEQ ID NO: 4137030 - DNA, 13 bp, Homo sapiens
ctagccaccagtg

SEQ ID NO: 4137031 - DNA, 16 bp, Homo sapiens
ctagccaccagtgtcc

SEQ ID NO: 4137032 - DNA, 18 bp, Homo sapiens
ctagccaccagtgtcctc

SEQ ID NO: 4137033 - DNA, 19 bp, Homo sapiens
ctagccagtgctccaggca

SEQ ID NO: 4137034 - DNA, 12 bp, Homo sapiens
ctagcccttccc

SEQ ID NO: 4137035 - DNA, 17 bp, Homo sapiens
ctagcccttccctgagt

SEQ ID NO: 4137036 - DNA, 19 bp, Homo sapiens
ctagcccttccctgagtgc

SEQ ID NO: 4137037 - DNA, 18 bp, Homo sapiens
ctagccggaaggccgagg

SEQ ID NO: 4137038 - DNA, 23 bp, Homo sapiens
ctagcctatttacctgcaggctg

SEQ ID NO: 4137039 - DNA, 13 bp, Homo sapiens
ctagcctctccag

SEQ ID NO: 4137040 - DNA, 19 bp, Homo sapiens
ctagcctgtgcctctggga

SEQ ID NO: 4137041 - DNA, 19 bp, Homo sapiens
ctagcgatctctcctggcc

SEQ ID NO: 4137042 - DNA, 20 bp, Homo sapiens
ctagcgatctctcctggcct

SEQ ID NO: 4137043 - DNA, 14 bp, Homo sapiens
ctagcggagcccag

SEQ ID NO: 4137044 - DNA, 20 bp, Homo sapiens
ctagcgtagtgcagcagggc

SEQ ID NO: 4137045 - DNA, 22 bp, Homo sapiens
ctagctaatgtaataactgtga

SEQ ID NO: 4137046 - DNA, 21 bp, Homo sapiens
ctagctagaaatatgatttta

SEQ ID NO: 4137047 - DNA, 17 bp, Homo sapiens
ctagctcctgccacatg

SEQ ID NO: 4137048 - DNA, 20 bp, Homo sapiens
ctagctctatttacttctaa

SEQ ID NO: 4137049 - DNA, 15 bp, Homo sapiens
ctagctctcccagtg

SEQ ID NO: 4137050 - DNA, 21 bp, Homo sapiens
ctagctctctaggcctctcca

SEQ ID NO: 4137051 - DNA, 22 bp, Homo sapiens
ctagctctctaggcctctccag

SEQ ID NO: 4137052 - DNA, 22 bp, Homo sapiens
ctagctgaccccgagaagtgct

SEQ ID NO: 4137053 - DNA, 20 bp, Homo sapiens
ctagctgcctagcaagctgg

SEQ ID NO: 4137054 - DNA, 17 bp, Homo sapiens
ctagctgtatgatttgt

SEQ ID NO: 4137055 - DNA, 20 bp, Homo sapiens
ctaggagaccaaggcgggag

SEQ ID NO: 4137056 - DNA, 14 bp, Homo sapiens
ctaggatgtggagc

SEQ ID NO: 4137057 - DNA, 12 bp, Homo sapiens
ctaggcaagcag

SEQ ID NO: 4137058 - DNA, 15 bp, Homo sapiens
ctaggcaagcaggac

SEQ ID NO: 4137059 - DNA, 21 bp, Homo sapiens
ctaggcaagcaggacctggca

SEQ ID NO: 4137060 - DNA, 23 bp, Homo sapiens
ctaggcaagcaggacctggcatc

SEQ ID NO: 4137061 - DNA, 15 bp, Homo sapiens
ctaggcctctccagt

SEQ ID NO: 4137062 - DNA, 15 bp, Homo sapiens
ctaggcgagtgccag

SEQ ID NO: 4137063 - DNA, 15 bp, Homo sapiens
ctaggctcagagatg

SEQ ID NO: 4137064 - DNA, 22 bp, Homo sapiens
ctaggctcagagatgtgcaccc

SEQ ID NO: 4137065 - DNA, 22 bp, Homo sapiens
ctaggctcttatgtgtgccttt

SEQ ID NO: 4137066 - DNA, 23 bp, Homo sapiens
ctaggcttcagcatatttatagc

SEQ ID NO: 4137067 - DNA, 17 bp, Homo sapiens
ctagggattcaggctgc

SEQ ID NO: 4137068 - DNA, 18 bp, Homo sapiens
ctagggattcaggctgct

SEQ ID NO: 4137069 - DNA, 16 bp, Homo sapiens
ctaggggaacagacca

SEQ ID NO: 4137070 - DNA, 16 bp, Homo sapiens
ctaggggaagggcttt

SEQ ID NO: 4137071 - DNA, 17 bp, Homo sapiens
ctaggggaagggctttg

SEQ ID NO: 4137072 - DNA, 16 bp, Homo sapiens
ctaggggtcaggctcc

SEQ ID NO: 4137073 - DNA, 22 bp, Homo sapiens
ctaggtaatgttttgtatatac

SEQ ID NO: 4137074 - DNA, 22 bp, Homo sapiens
ctaggtatcattcaactctcca

SEQ ID NO: 4137075 - DNA, 22 bp, Homo sapiens
ctaggtccgtccggtgtgtcag

SEQ ID NO: 4137076 - DNA, 13 bp, Homo sapiens
ctaggtctccagt

SEQ ID NO: 4137077 - DNA, 17 bp, Homo sapiens
ctaggtctcctcagggt

SEQ ID NO: 4137078 - DNA, 14 bp, Homo sapiens
ctaggtgtggctgt

SEQ ID NO: 4137079 - DNA, 18 bp, Homo sapiens
ctaggtgtggctgtgaag

SEQ ID NO: 4137080 - DNA, 16 bp, Homo sapiens
ctaggttccctgttct

SEQ ID NO: 4137081 - DNA, 16 bp, Homo sapiens
ctagtacttgaaaaag

SEQ ID NO: 4137082 - DNA, 12 bp, Homo sapiens
ctagtatttgaa

SEQ ID NO: 4137083 - DNA, 14 bp, Homo sapiens
ctagtatttgaatt

SEQ ID NO: 4137084 - DNA, 18 bp, Homo sapiens
ctagtatttgaattaaaa

SEQ ID NO: 4137085 - DNA, 21 bp, Homo sapiens
ctagtatttgaattaaaactt

SEQ ID NO: 4137086 - DNA, 21 bp, Homo sapiens
ctagtccccctgttttctgtt

SEQ ID NO: 4137087 - DNA, 14 bp, Homo sapiens
ctagtcccttcccc

SEQ ID NO: 4137088 - DNA, 17 bp, Homo sapiens
ctagtcccttcccctcc

SEQ ID NO: 4137089 - DNA, 20 bp, Homo sapiens
ctagtcccttcccctccctg

SEQ ID NO: 4137090 - DNA, 22 bp, Homo sapiens
ctagtcccttcccctccctggc

SEQ ID NO: 4137091 - DNA, 12 bp, Homo sapiens
ctagtccttgtt

SEQ ID NO: 4137092 - DNA, 15 bp, Homo sapiens
ctagtctcctttgca

SEQ ID NO: 4137093 - DNA, 16 bp, Homo sapiens
ctagtcttgaatttct

SEQ ID NO: 4137094 - DNA, 14 bp, Homo sapiens
ctagtgaagaccag

SEQ ID NO: 4137095 - DNA, 22 bp, Homo sapiens
ctagtgaagaccagagcagttt

SEQ ID NO: 4137096 - DNA, 20 bp, Homo sapiens
ctagtgacttgtgtcccatg

SEQ ID NO: 4137097 - DNA, 22 bp, Homo sapiens
ctagtgagcaaaatatgcccct

SEQ ID NO: 4137098 - DNA, 19 bp, Homo sapiens
ctagtgcagctgattttaa

SEQ ID NO: 4137099 - DNA, 20 bp, Homo sapiens
ctagtgcagctgattttaac

SEQ ID NO: 4137100 - DNA, 19 bp, Homo sapiens
ctagtggatgactgttgat

SEQ ID NO: 4137101 - DNA, 13 bp, Homo sapiens
ctagtgggacagc

SEQ ID NO: 4137102 - DNA, 17 bp, Homo sapiens
ctagtgggacagcccag

SEQ ID NO: 4137103 - DNA, 22 bp, Homo sapiens
ctagtgggacagcccagagcct

SEQ ID NO: 4137104 - DNA, 15 bp, Homo sapiens
ctagtggtctttgta

SEQ ID NO: 4137105 - DNA, 20 bp, Homo sapiens
ctagttaacctagaagtatt

SEQ ID NO: 4137106 - DNA, 22 bp, Homo sapiens
ctagttatttacaggaacttca

SEQ ID NO: 4137107 - DNA, 15 bp, Homo sapiens
ctagttcagagccaa

SEQ ID NO: 4137108 - DNA, 12 bp, Homo sapiens
ctagttcatcca

SEQ ID NO: 4137109 - DNA, 19 bp, Homo sapiens
ctagttcatccaatcctca

SEQ ID NO: 4137110 - DNA, 22 bp, Homo sapiens
ctagttcatccaatcctcactg

SEQ ID NO: 4137111 - DNA, 24 bp, Homo sapiens
ctagttcatccaatcctcactggg

SEQ ID NO: 4137112 - DNA, 21 bp, Homo sapiens
ctagttccctctgctcagcca

SEQ ID NO: 4137113 - DNA, 16 bp, Homo sapiens
ctagtttactgttttg

SEQ ID NO: 4137114 - DNA, 17 bp, Homo sapiens
ctagtttactgttttga

SEQ ID NO: 4137115 - DNA, 15 bp, Homo sapiens
ctataaaagaaacac

SEQ ID NO: 4137116 - DNA, 13 bp, Homo sapiens
ctataaagagaag

SEQ ID NO: 4137117 - DNA, 16 bp, Homo sapiens
ctataaagtaaagcta

SEQ ID NO: 4137118 - DNA, 17 bp, Homo sapiens
ctataaagtaaagctaa

SEQ ID NO: 4137119 - DNA, 18 bp, Homo sapiens
ctataaatacaaatctgt

SEQ ID NO: 4137120 - DNA, 18 bp, Homo sapiens
ctataaatggtgtttttt

SEQ ID NO: 4137121 - DNA, 21 bp, Homo sapiens
ctataacatatgtacataaat

SEQ ID NO: 4137122 - DNA, 22 bp, Homo sapiens
ctataagagaattatatatttc

SEQ ID NO: 4137123 - DNA, 22 bp, Homo sapiens
ctataagaggaatttcttttcc

SEQ ID NO: 4137124 - DNA, 16 bp, Homo sapiens
ctataaggctgagggc

SEQ ID NO: 4137125 - DNA, 22 bp, Homo sapiens
ctataaggctgagggctgccag

SEQ ID NO: 4137126 - DNA, 14 bp, Homo sapiens
ctataatcattagt

SEQ ID NO: 4137127 - DNA, 14 bp, Homo sapiens
ctatacatagagct

SEQ ID NO: 4137128 - DNA, 15 bp, Homo sapiens
ctatacatatcttta

SEQ ID NO: 4137129 - DNA, 14 bp, Homo sapiens
ctatacatctctcc

SEQ ID NO: 4137130 - DNA, 18 bp, Homo sapiens
ctatacatctctccccaa

SEQ ID NO: 4137131 - DNA, 12 bp, Homo sapiens
ctatagactcta

SEQ ID NO: 4137132 - DNA, 16 bp, Homo sapiens
ctatagagcctacctg

SEQ ID NO: 4137133 - DNA, 19 bp, Homo sapiens
ctatataagacaagaactc

SEQ ID NO: 4137134 - DNA, 17 bp, Homo sapiens
ctatatagaatgctgca

SEQ ID NO: 4137135 - DNA, 15 bp, Homo sapiens
ctatatataaaacgg

SEQ ID NO: 4137136 - DNA, 12 bp, Homo sapiens
ctatatccatgt

SEQ ID NO: 4137137 - DNA, 21 bp, Homo sapiens
ctatatccatgtactgtagtt

SEQ ID NO: 4137138 - DNA, 15 bp, Homo sapiens
ctatatcctgtgact

SEQ ID NO: 4137139 - DNA, 23 bp, Homo sapiens
ctatatgaatttaaatataattc

SEQ ID NO: 4137140 - DNA, 16 bp, Homo sapiens
ctatatggaattgctt

SEQ ID NO: 4137141 - DNA, 22 bp, Homo sapiens
ctatatttgggcctgctccaga

SEQ ID NO: 4137142 - DNA, 16 bp, Homo sapiens
ctatattttaatagaa

SEQ ID NO: 4137143 - DNA, 15 bp, Homo sapiens
ctatcaagcccaggt

SEQ ID NO: 4137144 - DNA, 17 bp, Homo sapiens
ctatcaagtcaatcatt

SEQ ID NO: 4137145 - DNA, 19 bp, Homo sapiens
ctatcaagtcaatcatttc

SEQ ID NO: 4137146 - DNA, 11 bp, Homo sapiens
ctatcaatgag

SEQ ID NO: 4137147 - DNA, 17 bp, Homo sapiens
ctatcaatgagttcttc

SEQ ID NO: 4137148 - DNA, 16 bp, Homo sapiens
ctatcacctatttcca

SEQ ID NO: 4137149 - DNA, 17 bp, Homo sapiens
ctatcacctatttccat

SEQ ID NO: 4137150 - DNA, 16 bp, Homo sapiens
ctatcagtacttttat

SEQ ID NO: 4137151 - DNA, 22 bp, Homo sapiens
ctatcatactactgaaacagat

SEQ ID NO: 4137152 - DNA, 21 bp, Homo sapiens
ctatccactgggcacaactgc

SEQ ID NO: 4137153 - DNA, 18 bp, Homo sapiens
ctatccccatctccctgc

SEQ ID NO: 4137154 - DNA, 21 bp, Homo sapiens
ctatccccatctccctgcctg

SEQ ID NO: 4137155 - DNA, 22 bp, Homo sapiens
ctatccccatctccctgcctgg

SEQ ID NO: 4137156 - DNA, 15 bp, Homo sapiens
ctatccgctgccagc

SEQ ID NO: 4137157 - DNA, 17 bp, Homo sapiens
ctatcctaaataaaaaa

SEQ ID NO: 4137158 - DNA, 22 bp, Homo sapiens
ctatccttataggcctgtccct

SEQ ID NO: 4137159 - DNA, 12 bp, Homo sapiens
ctatccttcgtg

SEQ ID NO: 4137160 - DNA, 13 bp, Homo sapiens
ctatccttcgtga

SEQ ID NO: 4137161 - DNA, 14 bp, Homo sapiens
ctatcgttattata

SEQ ID NO: 4137162 - DNA, 19 bp, Homo sapiens
ctatcgttattataaatgt

SEQ ID NO: 4137163 - DNA, 20 bp, Homo sapiens
ctatcgttattataaatgtt

SEQ ID NO: 4137164 - DNA, 21 bp, Homo sapiens
ctatcgttattataaatgtta

SEQ ID NO: 4137165 - DNA, 14 bp, Homo sapiens
ctatctaaagtttg

SEQ ID NO: 4137166 - DNA, 14 bp, Homo sapiens
ctatctaaatgttg

SEQ ID NO: 4137167 - DNA, 15 bp, Homo sapiens
ctatctatcttccaa

SEQ ID NO: 4137168 - DNA, 18 bp, Homo sapiens
ctatctattaaagtgact

SEQ ID NO: 4137169 - DNA, 19 bp, Homo sapiens
ctatctattaaagtgactt

SEQ ID NO: 4137170 - DNA, 18 bp, Homo sapiens
ctatctcaatcctaattt

SEQ ID NO: 4137171 - DNA, 20 bp, Homo sapiens
ctatctggaggccttccagc

SEQ ID NO: 4137172 - DNA, 24 bp, Homo sapiens
ctatctggccatatttactacctt

SEQ ID NO: 4137173 - DNA, 14 bp, Homo sapiens
ctatctttgctgca

SEQ ID NO: 4137174 - DNA, 21 bp, Homo sapiens
ctatgagaattgggattacat

SEQ ID NO: 4137175 - DNA, 13 bp, Homo sapiens
ctatgaggaaagg

SEQ ID NO: 4137176 - DNA, 14 bp, Homo sapiens
ctatgaggaaaggt

SEQ ID NO: 4137177 - DNA, 21 bp, Homo sapiens
ctatgcagcatggggttttta

SEQ ID NO: 4137178 - DNA, 15 bp, Homo sapiens
ctatgcccaggtacc

SEQ ID NO: 4137179 - DNA, 22 bp, Homo sapiens
ctatgcccaggtaccacccttc

SEQ ID NO: 4137180 - DNA, 22 bp, Homo sapiens
ctatgctgttcactggacactt

SEQ ID NO: 4137181 - DNA, 18 bp, Homo sapiens
ctatgctgtttgtagtga

SEQ ID NO: 4137182 - DNA, 16 bp, Homo sapiens
ctatggaagtggttct

SEQ ID NO: 4137183 - DNA, 19 bp, Homo sapiens
ctatggagggtcctcctcc

SEQ ID NO: 4137184 - DNA, 16 bp, Homo sapiens
ctatggatggcttcta

SEQ ID NO: 4137185 - DNA, 17 bp, Homo sapiens
ctatggctgagttctgg

SEQ ID NO: 4137186 - DNA, 18 bp, Homo sapiens
ctatggggatggtccact

SEQ ID NO: 4137187 - DNA, 16 bp, Homo sapiens
ctatggggtggggtgg

SEQ ID NO: 4137188 - DNA, 22 bp, Homo sapiens
ctatggtgtaatcatgaaggag

SEQ ID NO: 4137189 - DNA, 18 bp, Homo sapiens
ctatggttcccaataaaa

SEQ ID NO: 4137190 - DNA, 20 bp, Homo sapiens
ctatggttcccaataaaagt

SEQ ID NO: 4137191 - DNA, 13 bp, Homo sapiens
ctatgtaaactac

SEQ ID NO: 4137192 - DNA, 14 bp, Homo sapiens
ctatgtatatacat

SEQ ID NO: 4137193 - DNA, 19 bp, Homo sapiens
ctatgtatcaatgagtaac

SEQ ID NO: 4137194 - DNA, 22 bp, Homo sapiens
ctatgtatggaatacagtgtta

SEQ ID NO: 4137195 - DNA, 20 bp, Homo sapiens
ctatgtcctaaggacacact

SEQ ID NO: 4137196 - DNA, 21 bp, Homo sapiens
ctatgtcctaaggacacacta

SEQ ID NO: 4137197 - DNA, 22 bp, Homo sapiens
ctatgtcctaaggacacactaa

SEQ ID NO: 4137198 - DNA, 17 bp, Homo sapiens
ctatgtcgatgcacagt

SEQ ID NO: 4137199 - DNA, 17 bp, Homo sapiens
ctatgttaaatactgtg

SEQ ID NO: 4137200 - DNA, 23 bp, Homo sapiens
ctatgttaaatactgtgcagaat

SEQ ID NO: 4137201 - DNA, 18 bp, Homo sapiens
ctatgttactattttcta

SEQ ID NO: 4137202 - DNA, 14 bp, Homo sapiens
ctatgttccccagg

SEQ ID NO: 4137203 - DNA, 21 bp, Homo sapiens
ctatgttgggggggaccctgc

SEQ ID NO: 4137204 - DNA, 23 bp, Homo sapiens
ctatgttgggggggaccctgcct

SEQ ID NO: 4137205 - DNA, 18 bp, Homo sapiens
ctatgttgtggtccatca

SEQ ID NO: 4137206 - DNA, 14 bp, Homo sapiens
ctattaaagtgact

SEQ ID NO: 4137207 - DNA, 20 bp, Homo sapiens
ctattaagcagtaaaaactg

SEQ ID NO: 4137208 - DNA, 11 bp, Homo sapiens
ctattaatata

SEQ ID NO: 4137209 - DNA, 17 bp, Homo sapiens
ctattaatatatgtatt

SEQ ID NO: 4137210 - DNA, 12 bp, Homo sapiens
ctattacaaata

SEQ ID NO: 4137211 - DNA, 20 bp, Homo sapiens
ctattagactttagaaataa

SEQ ID NO: 4137212 - DNA, 16 bp, Homo sapiens
ctattagccaggatca

SEQ ID NO: 4137213 - DNA, 22 bp, Homo sapiens
ctattagccaggatcatggtgt

SEQ ID NO: 4137214 - DNA, 14 bp, Homo sapiens
ctattatattaaaa

SEQ ID NO: 4137215 - DNA, 15 bp, Homo sapiens
ctattatggaaaact

SEQ ID NO: 4137216 - DNA, 17 bp, Homo sapiens
ctattatggaaaactgt

SEQ ID NO: 4137217 - DNA, 18 bp, Homo sapiens
ctattatggaaaactgtg

SEQ ID NO: 4137218 - DNA, 22 bp, Homo sapiens
ctattcaagaggaaatgtcaca

SEQ ID NO: 4137219 - DNA, 19 bp, Homo sapiens
ctattcagtggcgagaaat

SEQ ID NO: 4137220 - DNA, 16 bp, Homo sapiens
ctattccctttgactt

SEQ ID NO: 4137221 - DNA, 21 bp, Homo sapiens
ctattccctttgacttcagct

SEQ ID NO: 4137222 - DNA, 18 bp, Homo sapiens
ctattctgccactcctga

SEQ ID NO: 4137223 - DNA, 12 bp, Homo sapiens
ctattctgtcag

SEQ ID NO: 4137224 - DNA, 21 bp, Homo sapiens
ctattcttggaccatgccaga

SEQ ID NO: 4137225 - DNA, 22 bp, Homo sapiens
ctattcttggaccatgccagat

SEQ ID NO: 4137226 - DNA, 16 bp, Homo sapiens
ctattgacaagtcatt

SEQ ID NO: 4137227 - DNA, 17 bp, Homo sapiens
ctattgacaagtcattt

SEQ ID NO: 4137228 - DNA, 17 bp, Homo sapiens
ctattgagtcttcatgt

SEQ ID NO: 4137229 - DNA, 14 bp, Homo sapiens
ctattgcatttata

SEQ ID NO: 4137230 - DNA, 21 bp, Homo sapiens
ctattggaggatcagtttttt

SEQ ID NO: 4137231 - DNA, 23 bp, Homo sapiens
ctattggccaacaatcctttctg

SEQ ID NO: 4137232 - DNA, 17 bp, Homo sapiens
ctattgtaaatatgttt

SEQ ID NO: 4137233 - DNA, 15 bp, Homo sapiens
ctattgtcattaaag

SEQ ID NO: 4137234 - DNA, 16 bp, Homo sapiens
ctattgttactctggt

SEQ ID NO: 4137235 - DNA, 17 bp, Homo sapiens
ctatttaaaacttgtaa

SEQ ID NO: 4137236 - DNA, 12 bp, Homo sapiens
ctatttaatatt

SEQ ID NO: 4137237 - DNA, 18 bp, Homo sapiens
ctatttacttctaatctt

SEQ ID NO: 4137238 - DNA, 19 bp, Homo sapiens
ctatttatctgtgtttttg

SEQ ID NO: 4137239 - DNA, 14 bp, Homo sapiens
ctatttatttactg

SEQ ID NO: 4137240 - DNA, 15 bp, Homo sapiens
ctatttatttactga

SEQ ID NO: 4137241 - DNA, 18 bp, Homo sapiens
ctatttatttactgagct

SEQ ID NO: 4137242 - DNA, 14 bp, Homo sapiens
ctatttatttttac

SEQ ID NO: 4137243 - DNA, 15 bp, Homo sapiens
ctatttcatgttttt

SEQ ID NO: 4137244 - DNA, 22 bp, Homo sapiens
ctatttccccaggggaaaatga

SEQ ID NO: 4137245 - DNA, 16 bp, Homo sapiens
ctatttccccctttct

SEQ ID NO: 4137246 - DNA, 14 bp, Homo sapiens
ctatttgaaatact

SEQ ID NO: 4137247 - DNA, 21 bp, Homo sapiens
ctatttgaaatactaaaagca

SEQ ID NO: 4137248 - DNA, 14 bp, Homo sapiens
ctatttgtaaatct

SEQ ID NO: 4137249 - DNA, 19 bp, Homo sapiens
ctatttgtaaatctgccac

SEQ ID NO: 4137250 - DNA, 21 bp, Homo sapiens
ctatttgtaaatctgccacaa

SEQ ID NO: 4137251 - DNA, 13 bp, Homo sapiens
ctattttaaaata

SEQ ID NO: 4137252 - DNA, 16 bp, Homo sapiens
ctattttaaagtaaaa

SEQ ID NO: 4137253 - DNA, 14 bp, Homo sapiens
ctattttactttgt

SEQ ID NO: 4137254 - DNA, 16 bp, Homo sapiens
ctattttactttgtac

SEQ ID NO: 4137255 - DNA, 12 bp, Homo sapiens
ctattttcctct

SEQ ID NO: 4137256 - DNA, 15 bp, Homo sapiens
ctattttcctctggc

SEQ ID NO: 4137257 - DNA, 16 bp, Homo sapiens
ctattttgtgatgatg

SEQ ID NO: 4137258 - DNA, 13 bp, Homo sapiens
ctatttttatcat

SEQ ID NO: 4137259 - DNA, 19 bp, Homo sapiens
ctatttttatcatgaattc

SEQ ID NO: 4137260 - DNA, 22 bp, Homo sapiens
ctatttttgtcttatatatatt

SEQ ID NO: 4137261 - DNA, 18 bp, Homo sapiens
ctatttttttaactgaaa

SEQ ID NO: 4137262 - DNA, 14 bp, Homo sapiens
ctcaaaaggaaacc

SEQ ID NO: 4137263 - DNA, 23 bp, Homo sapiens
ctcaaaaggaaaccaagtggtca

SEQ ID NO: 4137264 - DNA, 15 bp, Homo sapiens
ctcaaaagtctattt

SEQ ID NO: 4137265 - DNA, 18 bp, Homo sapiens
ctcaaaataaagaagtat

SEQ ID NO: 4137266 - DNA, 16 bp, Homo sapiens
ctcaaacaacactggt

SEQ ID NO: 4137267 - DNA, 16 bp, Homo sapiens
ctcaaacttgtggcct

SEQ ID NO: 4137268 - DNA, 16 bp, Homo sapiens
ctcaaagatctgaatt

SEQ ID NO: 4137269 - DNA, 20 bp, Homo sapiens
ctcaaagttaattcacctat

SEQ ID NO: 4137270 - DNA, 23 bp, Homo sapiens
ctcaaagttaattcacctatgtt

SEQ ID NO: 4137271 - DNA, 12 bp, Homo sapiens
ctcaaagttttg

SEQ ID NO: 4137272 - DNA, 15 bp, Homo sapiens
ctcaaagttttgaaa

SEQ ID NO: 4137273 - DNA, 12 bp, Homo sapiens
ctcaaataacta

SEQ ID NO: 4137274 - DNA, 21 bp, Homo sapiens
ctcaaatgagtaacatttgct

SEQ ID NO: 4137275 - DNA, 16 bp, Homo sapiens
ctcaaatggggccaga

SEQ ID NO: 4137276 - DNA, 19 bp, Homo sapiens
ctcaaatggggccagatcc

SEQ ID NO: 4137277 - DNA, 20 bp, Homo sapiens
ctcaaatggggccagatcca

SEQ ID NO: 4137278 - DNA, 23 bp, Homo sapiens
ctcaaattaatctttctttacct

SEQ ID NO: 4137279 - DNA, 13 bp, Homo sapiens
ctcaaattttttg

SEQ ID NO: 4137280 - DNA, 19 bp, Homo sapiens
ctcaacaagggagagacct

SEQ ID NO: 4137281 - DNA, 23 bp, Homo sapiens
ctcaacaagggagagacctcatc

SEQ ID NO: 4137282 - DNA, 17 bp, Homo sapiens
ctcaacaggcccaggga

SEQ ID NO: 4137283 - DNA, 20 bp, Homo sapiens
ctcaacaggcccagggaggg

SEQ ID NO: 4137284 - DNA, 21 bp, Homo sapiens
ctcaacaggcccagggaggga

SEQ ID NO: 4137285 - DNA, 21 bp, Homo sapiens
ctcaaccccaccatatgaatt

SEQ ID NO: 4137286 - DNA, 12 bp, Homo sapiens
ctcaacctcttc

SEQ ID NO: 4137287 - DNA, 20 bp, Homo sapiens
ctcaacctcttctggctcaa

SEQ ID NO: 4137288 - DNA, 18 bp, Homo sapiens
ctcaacgttgctccccat

SEQ ID NO: 4137289 - DNA, 13 bp, Homo sapiens
ctcaactctgagc

SEQ ID NO: 4137290 - DNA, 22 bp, Homo sapiens
ctcaagaaataaaaggaagcca

SEQ ID NO: 4137291 - DNA, 22 bp, Homo sapiens
ctcaagactttagcttttcctt

SEQ ID NO: 4137292 - DNA, 17 bp, Homo sapiens
ctcaagaggcagagttc

SEQ ID NO: 4137293 - DNA, 19 bp, Homo sapiens
ctcaagcaatccacctgcc

SEQ ID NO: 4137294 - DNA, 21 bp, Homo sapiens
ctcaagcaatccacctgcctt

SEQ ID NO: 4137295 - DNA, 17 bp, Homo sapiens
ctcaagcaatcctcctg

SEQ ID NO: 4137296 - DNA, 12 bp, Homo sapiens
ctcaagcactga

SEQ ID NO: 4137297 - DNA, 14 bp, Homo sapiens
ctcaagcactgata

SEQ ID NO: 4137298 - DNA, 13 bp, Homo sapiens
ctcaagccaccag

SEQ ID NO: 4137299 - DNA, 21 bp, Homo sapiens
ctcaagccaccagatgtgaca

SEQ ID NO: 4137300 - DNA, 13 bp, Homo sapiens
ctcaagccccagc

SEQ ID NO: 4137301 - DNA, 17 bp, Homo sapiens
ctcaagccccagcagcc

SEQ ID NO: 4137302 - DNA, 18 bp, Homo sapiens
ctcaagccccagcagccc

SEQ ID NO: 4137303 - DNA, 19 bp, Homo sapiens
ctcaagctagtgtttctag

SEQ ID NO: 4137304 - DNA, 20 bp, Homo sapiens
ctcaagctagtgtttctagc

SEQ ID NO: 4137305 - DNA, 10 bp, Homo sapiens
ctcaaggact

SEQ ID NO: 4137306 - DNA, 15 bp, Homo sapiens
ctcaaggacttgaaa

SEQ ID NO: 4137307 - DNA, 19 bp, Homo sapiens
ctcaaggacttgaaagcat

SEQ ID NO: 4137308 - DNA, 15 bp, Homo sapiens
ctcaagtctggcaga

SEQ ID NO: 4137309 - DNA, 13 bp, Homo sapiens
ctcaataaagatt

SEQ ID NO: 4137310 - DNA, 18 bp, Homo sapiens
ctcaatattcctgaatga

SEQ ID NO: 4137311 - DNA, 14 bp, Homo sapiens
ctcaatcctaattt

SEQ ID NO: 4137312 - DNA, 16 bp, Homo sapiens
ctcaatgcctggagac

SEQ ID NO: 4137313 - DNA, 14 bp, Homo sapiens
ctcaatggactgga

SEQ ID NO: 4137314 - DNA, 23 bp, Homo sapiens
ctcaatggcctaaaactggcctg

SEQ ID NO: 4137315 - DNA, 21 bp, Homo sapiens
ctcaatgtgtgccgagccctt

SEQ ID NO: 4137316 - DNA, 18 bp, Homo sapiens
ctcaatttttgtctcaga

SEQ ID NO: 4137317 - DNA, 22 bp, Homo sapiens
ctcacacattcccccaccagct

SEQ ID NO: 4137318 - DNA, 19 bp, Homo sapiens
ctcacacccctgtcccacc

SEQ ID NO: 4137319 - DNA, 19 bp, Homo sapiens
ctcacactccagtggcaga

SEQ ID NO: 4137320 - DNA, 19 bp, Homo sapiens
ctcacactggtctgctgtc

SEQ ID NO: 4137321 - DNA, 17 bp, Homo sapiens
ctcacagaacccttgga

SEQ ID NO: 4137322 - DNA, 21 bp, Homo sapiens
ctcacagattgaggtaataat

SEQ ID NO: 4137323 - DNA, 17 bp, Homo sapiens
ctcacaggccctggaga

SEQ ID NO: 4137324 - DNA, 13 bp, Homo sapiens
ctcacagtacagc

SEQ ID NO: 4137325 - DNA, 20 bp, Homo sapiens
ctcacagtacagcatgtgcc

SEQ ID NO: 4137326 - DNA, 20 bp, Homo sapiens
ctcacagtctctttaatctt

SEQ ID NO: 4137327 - DNA, 17 bp, Homo sapiens
ctcacagtgttgcccag

SEQ ID NO: 4137328 - DNA, 13 bp, Homo sapiens
ctcacatgggact

SEQ ID NO: 4137329 - DNA, 15 bp, Homo sapiens
ctcaccacctgcctc

SEQ ID NO: 4137330 - DNA, 19 bp, Homo sapiens
ctcacccagtcacctcccc

SEQ ID NO: 4137331 - DNA, 13 bp, Homo sapiens
ctcacccatccca

SEQ ID NO: 4137332 - DNA, 21 bp, Homo sapiens
ctcaccccatcccacaccctg

SEQ ID NO: 4137333 - DNA, 15 bp, Homo sapiens
ctcaccccctttgct

SEQ ID NO: 4137334 - DNA, 15 bp, Homo sapiens
ctcaccctgggagcc

SEQ ID NO: 4137335 - DNA, 23 bp, Homo sapiens
ctcaccctgggagccagtcctcc

SEQ ID NO: 4137336 - DNA, 13 bp, Homo sapiens
ctcaccgcccatc

SEQ ID NO: 4137337 - DNA, 17 bp, Homo sapiens
ctcaccgcccatcaggg

SEQ ID NO: 4137338 - DNA, 14 bp, Homo sapiens
ctcaccgctggccc

SEQ ID NO: 4137339 - DNA, 16 bp, Homo sapiens
ctcaccgctggccctt

SEQ ID NO: 4137340 - DNA, 19 bp, Homo sapiens
ctcaccgctggcccttaga

SEQ ID NO: 4137341 - DNA, 23 bp, Homo sapiens
ctcacctcatgcccaccccctgc

SEQ ID NO: 4137342 - DNA, 18 bp, Homo sapiens
ctcacctctccaggtgct

SEQ ID NO: 4137343 - DNA, 17 bp, Homo sapiens
ctcaccttcctgtgggt

SEQ ID NO: 4137344 - DNA, 13 bp, Homo sapiens
ctcaccttgggct

SEQ ID NO: 4137345 - DNA, 17 bp, Homo sapiens
ctcacctttcccatctt

SEQ ID NO: 4137346 - DNA, 16 bp, Homo sapiens
ctcacgtccaggttca

SEQ ID NO: 4137347 - DNA, 21 bp, Homo sapiens
ctcacgtgtcagaagcctcca

SEQ ID NO: 4137348 - DNA, 20 bp, Homo sapiens
ctcactaccctattctctct

SEQ ID NO: 4137349 - DNA, 15 bp, Homo sapiens
ctcactagtgccaat

SEQ ID NO: 4137350 - DNA, 19 bp, Homo sapiens
ctcactagtgtcaggcccc

SEQ ID NO: 4137351 - DNA, 21 bp, Homo sapiens
ctcactagtgtcaggccccca

SEQ ID NO: 4137352 - DNA, 20 bp, Homo sapiens
ctcactatggtatgctggcc

SEQ ID NO: 4137353 - DNA, 24 bp, Homo sapiens
ctcactatggtatgctggccagca

SEQ ID NO: 4137354 - DNA, 22 bp, Homo sapiens
ctcactattcttggaccatgcc

SEQ ID NO: 4137355 - DNA, 14 bp, Homo sapiens
ctcactccacagag

SEQ ID NO: 4137356 - DNA, 12 bp, Homo sapiens
ctcactccccag

SEQ ID NO: 4137357 - DNA, 14 bp, Homo sapiens
ctcactccccaggg

SEQ ID NO: 4137358 - DNA, 16 bp, Homo sapiens
ctcactccccagggag

SEQ ID NO: 4137359 - DNA, 19 bp, Homo sapiens
ctcactccccagggagctc

SEQ ID NO: 4137360 - DNA, 23 bp, Homo sapiens
ctcactccccagggagctctggg

SEQ ID NO: 4137361 - DNA, 12 bp, Homo sapiens
ctcactccccat

SEQ ID NO: 4137362 - DNA, 19 bp, Homo sapiens
ctcactccccatgccacgt

SEQ ID NO: 4137363 - DNA, 17 bp, Homo sapiens
ctcactcctacctggta

SEQ ID NO: 4137364 - DNA, 13 bp, Homo sapiens
ctcactcctagga

SEQ ID NO: 4137365 - DNA, 23 bp, Homo sapiens
ctcactcctaggagagccaacct

SEQ ID NO: 4137366 - DNA, 12 bp, Homo sapiens
ctcactctgggc

SEQ ID NO: 4137367 - DNA, 15 bp, Homo sapiens
ctcactctgggctgt

SEQ ID NO: 4137368 - DNA, 13 bp, Homo sapiens
ctcactctgtcag

SEQ ID NO: 4137369 - DNA, 14 bp, Homo sapiens
ctcactctgtcagc

SEQ ID NO: 4137370 - DNA, 15 bp, Homo sapiens
ctcactgaactccac

SEQ ID NO: 4137371 - DNA, 16 bp, Homo sapiens
ctcactgaactccacc

SEQ ID NO: 4137372 - DNA, 18 bp, Homo sapiens
ctcactgaactccaccga

SEQ ID NO: 4137373 - DNA, 15 bp, Homo sapiens
ctcactgaaggacct

SEQ ID NO: 4137374 - DNA, 20 bp, Homo sapiens
ctcactgaaggacctgagct

SEQ ID NO: 4137375 - DNA, 22 bp, Homo sapiens
ctcactgatatattttccaggg

SEQ ID NO: 4137376 - DNA, 15 bp, Homo sapiens
ctcactgcagcctca

SEQ ID NO: 4137377 - DNA, 15 bp, Homo sapiens
ctcactgcagtctta

SEQ ID NO: 4137378 - DNA, 18 bp, Homo sapiens
ctcactgcagtcttattt

SEQ ID NO: 4137379 - DNA, 12 bp, Homo sapiens
ctcactgccagg

SEQ ID NO: 4137380 - DNA, 15 bp, Homo sapiens
ctcactgccaggcca

SEQ ID NO: 4137381 - DNA, 18 bp, Homo sapiens
ctcactgccaggccagcc

SEQ ID NO: 4137382 - DNA, 22 bp, Homo sapiens
ctcactgccaggccagcctccg

SEQ ID NO: 4137383 - DNA, 14 bp, Homo sapiens
ctcactgctcaaga

SEQ ID NO: 4137384 - DNA, 16 bp, Homo sapiens
ctcactggggcctaca

SEQ ID NO: 4137385 - DNA, 18 bp, Homo sapiens
ctcactggggcctacagc

SEQ ID NO: 4137386 - DNA, 14 bp, Homo sapiens
ctcactgttctgca

SEQ ID NO: 4137387 - DNA, 15 bp, Homo sapiens
ctcacttagtccttt

SEQ ID NO: 4137388 - DNA, 21 bp, Homo sapiens
ctcacttatcccaagagaatg

SEQ ID NO: 4137389 - DNA, 19 bp, Homo sapiens
ctcagaaaaaggcagtggc

SEQ ID NO: 4137390 - DNA, 21 bp, Homo sapiens
ctcagaaatttttatttttct

SEQ ID NO: 4137391 - DNA, 14 bp, Homo sapiens
ctcagaacttgctg

SEQ ID NO: 4137392 - DNA, 19 bp, Homo sapiens
ctcagaacttgctgctgtc

SEQ ID NO: 4137393 - DNA, 13 bp, Homo sapiens
ctcagaagaaaga

SEQ ID NO: 4137394 - DNA, 16 bp, Homo sapiens
ctcagaaggtattcct

SEQ ID NO: 4137395 - DNA, 19 bp, Homo sapiens
ctcagaaggtattcctttt

SEQ ID NO: 4137396 - DNA, 21 bp, Homo sapiens
ctcagaccaactctctcctgt

SEQ ID NO: 4137397 - DNA, 20 bp, Homo sapiens
ctcagacggcggccaggcac

SEQ ID NO: 4137398 - DNA, 17 bp, Homo sapiens
ctcagacgttgcctgag

SEQ ID NO: 4137399 - DNA, 20 bp, Homo sapiens
ctcagagatgtgcacccatg

SEQ ID NO: 4137400 - DNA, 14 bp, Homo sapiens
ctcagagccctgcc

SEQ ID NO: 4137401 - DNA, 15 bp, Homo sapiens
ctcagagccctgccc

SEQ ID NO: 4137402 - DNA, 18 bp, Homo sapiens
ctcagagccctgccctgc

SEQ ID NO: 4137403 - DNA, 15 bp, Homo sapiens
ctcagagcttgaaga

SEQ ID NO: 4137404 - DNA, 16 bp, Homo sapiens
ctcagaggcagcttca

SEQ ID NO: 4137405 - DNA, 17 bp, Homo sapiens
ctcagaggcagcttcaa

SEQ ID NO: 4137406 - DNA, 12 bp, Homo sapiens
ctcagaggccca

SEQ ID NO: 4137407 - DNA, 14 bp, Homo sapiens
ctcagaggcccagg

SEQ ID NO: 4137408 - DNA, 20 bp, Homo sapiens
ctcagaggctcagagactgc

SEQ ID NO: 4137409 - DNA, 13 bp, Homo sapiens
ctcagatccaggg

SEQ ID NO: 4137410 - DNA, 14 bp, Homo sapiens
ctcagatccaggga

SEQ ID NO: 4137411 - DNA, 13 bp, Homo sapiens
ctcagatgatctc

SEQ ID NO: 4137412 - DNA, 17 bp, Homo sapiens
ctcagatgatctctcca

SEQ ID NO: 4137413 - DNA, 16 bp, Homo sapiens
ctcagatggactggga

SEQ ID NO: 4137414 - DNA, 19 bp, Homo sapiens
ctcagatggactgggagga

SEQ ID NO: 4137415 - DNA, 13 bp, Homo sapiens
ctcagattagatg

SEQ ID NO: 4137416 - DNA, 19 bp, Homo sapiens
ctcagattagatgtgccaa

SEQ ID NO: 4137417 - DNA, 23 bp, Homo sapiens
ctcagattcttcattgaggattg

SEQ ID NO: 4137418 - DNA, 14 bp, Homo sapiens
ctcagcacaaggcc

SEQ ID NO: 4137419 - DNA, 14 bp, Homo sapiens
ctcagcacagcctg

SEQ ID NO: 4137420 - DNA, 15 bp, Homo sapiens
ctcagcacagcctgg

SEQ ID NO: 4137421 - DNA, 23 bp, Homo sapiens
ctcagcagccgccttaagctgat

SEQ ID NO: 4137422 - DNA, 18 bp, Homo sapiens
ctcagccaagacaaggag

SEQ ID NO: 4137423 - DNA, 20 bp, Homo sapiens
ctcagccacaaaccctgcct

SEQ ID NO: 4137424 - DNA, 21 bp, Homo sapiens
ctcagccctccctgcccctcc

SEQ ID NO: 4137425 - DNA, 13 bp, Homo sapiens
ctcagccctgact

SEQ ID NO: 4137426 - DNA, 19 bp, Homo sapiens
ctcagccctgactggtgct

SEQ ID NO: 4137427 - DNA, 13 bp, Homo sapiens
ctcagccctgagg

SEQ ID NO: 4137428 - DNA, 14 bp, Homo sapiens
ctcagccctgaggt

SEQ ID NO: 4137429 - DNA, 13 bp, Homo sapiens
ctcagcctcagag

SEQ ID NO: 4137430 - DNA, 21 bp, Homo sapiens
ctcagcctcagaggagctcta

SEQ ID NO: 4137431 - DNA, 18 bp, Homo sapiens
ctcagcctcccaagtaac

SEQ ID NO: 4137432 - DNA, 13 bp, Homo sapiens
ctcagcctcccag

SEQ ID NO: 4137433 - DNA, 14 bp, Homo sapiens
ctcagcctcctgag

SEQ ID NO: 4137434 - DNA, 15 bp, Homo sapiens
ctcagcctcctgagc

SEQ ID NO: 4137435 - DNA, 17 bp, Homo sapiens
ctcagcctcctgagcct

SEQ ID NO: 4137436 - DNA, 19 bp, Homo sapiens
ctcagcctgctgcccaggc

SEQ ID NO: 4137437 - DNA, 20 bp, Homo sapiens
ctcagcctggccagacacag

SEQ ID NO: 4137438 - DNA, 18 bp, Homo sapiens
ctcagccttacatttgtg

SEQ ID NO: 4137439 - DNA, 22 bp, Homo sapiens
ctcagccttccaactagctggg

SEQ ID NO: 4137440 - DNA, 19 bp, Homo sapiens
ctcagccttgccagagatc

SEQ ID NO: 4137441 - DNA, 13 bp, Homo sapiens
ctcagctcagcgc

SEQ ID NO: 4137442 - DNA, 19 bp, Homo sapiens
ctcagctccaggtggctct

SEQ ID NO: 4137443 - DNA, 12 bp, Homo sapiens
ctcagctccggg

SEQ ID NO: 4137444 - DNA, 13 bp, Homo sapiens
ctcagctctctgg

SEQ ID NO: 4137445 - DNA, 15 bp, Homo sapiens
ctcagctctgggaga

SEQ ID NO: 4137446 - DNA, 22 bp, Homo sapiens
ctcagctctgggagaggatttt

SEQ ID NO: 4137447 - DNA, 23 bp, Homo sapiens
ctcagctgaatgcctcctgtggg

SEQ ID NO: 4137448 - DNA, 13 bp, Homo sapiens
ctcagctgacccg

SEQ ID NO: 4137449 - DNA, 18 bp, Homo sapiens
ctcagctgacccggcctc

SEQ ID NO: 4137450 - DNA, 19 bp, Homo sapiens
ctcagctgacccggcctct

SEQ ID NO: 4137451 - DNA, 20 bp, Homo sapiens
ctcagctgacccggcctctc

SEQ ID NO: 4137452 - DNA, 12 bp, Homo sapiens
ctcagctgcctc

SEQ ID NO: 4137453 - DNA, 14 bp, Homo sapiens
ctcagctgcctcac

SEQ ID NO: 4137454 - DNA, 18 bp, Homo sapiens
ctcagctgcctcacttcc

SEQ ID NO: 4137455 - DNA, 21 bp, Homo sapiens
ctcagctggttactcagggtt

SEQ ID NO: 4137456 - DNA, 16 bp, Homo sapiens
ctcagctgtcctgcag

SEQ ID NO: 4137457 - DNA, 18 bp, Homo sapiens
ctcagctgtcctgcagca

SEQ ID NO: 4137458 - DNA, 19 bp, Homo sapiens
ctcagctgtcctgcagcaa

SEQ ID NO: 4137459 - DNA, 16 bp, Homo sapiens
ctcagctgtctgtggc

SEQ ID NO: 4137460 - DNA, 12 bp, Homo sapiens
ctcaggacagat

SEQ ID NO: 4137461 - DNA, 14 bp, Homo sapiens
ctcaggacagatgc

SEQ ID NO: 4137462 - DNA, 19 bp, Homo sapiens
ctcaggacagcatcccttc

SEQ ID NO: 4137463 - DNA, 21 bp, Homo sapiens
ctcaggacagcatcccttccc

SEQ ID NO: 4137464 - DNA, 14 bp, Homo sapiens
ctcaggacctctgt

SEQ ID NO: 4137465 - DNA, 21 bp, Homo sapiens
ctcaggacctctgtaggcagc

SEQ ID NO: 4137466 - DNA, 16 bp, Homo sapiens
ctcaggactgcaacag

SEQ ID NO: 4137467 - DNA, 17 bp, Homo sapiens
ctcaggactgcaacagg

SEQ ID NO: 4137468 - DNA, 19 bp, Homo sapiens
ctcaggactgcaacaggct

SEQ ID NO: 4137469 - DNA, 14 bp, Homo sapiens
ctcaggactgcgac

SEQ ID NO: 4137470 - DNA, 18 bp, Homo sapiens
ctcaggagatggagggct

SEQ ID NO: 4137471 - DNA, 19 bp, Homo sapiens
ctcaggagatggagggctt

SEQ ID NO: 4137472 - DNA, 22 bp, Homo sapiens
ctcaggagatggagggcttggc

SEQ ID NO: 4137473 - DNA, 20 bp, Homo sapiens
ctcaggaggctgaggcagga

SEQ ID NO: 4137474 - DNA, 14 bp, Homo sapiens
ctcaggcacacagc

SEQ ID NO: 4137475 - DNA, 18 bp, Homo sapiens
ctcaggcacacagctact

SEQ ID NO: 4137476 - DNA, 21 bp, Homo sapiens
ctcaggcataggcctgggtgc

SEQ ID NO: 4137477 - DNA, 16 bp, Homo sapiens
ctcaggcctgtgccca

SEQ ID NO: 4137478 - DNA, 22 bp, Homo sapiens
ctcaggcctgtgcccactccct

SEQ ID NO: 4137479 - DNA, 16 bp, Homo sapiens
ctcaggctctgctggt

SEQ ID NO: 4137480 - DNA, 12 bp, Homo sapiens
ctcaggctcttg

SEQ ID NO: 4137481 - DNA, 15 bp, Homo sapiens
ctcaggcttgaaatg

SEQ ID NO: 4137482 - DNA, 16 bp, Homo sapiens
ctcagggacagagcca

SEQ ID NO: 4137483 - DNA, 18 bp, Homo sapiens
ctcagggacagagccatg

SEQ ID NO: 4137484 - DNA, 11 bp, Homo sapiens
ctcagggaccg

SEQ ID NO: 4137485 - DNA, 22 bp, Homo sapiens
ctcagggaccggtgctgcagga

SEQ ID NO: 4137486 - DNA, 17 bp, Homo sapiens
ctcagggagcctcccca

SEQ ID NO: 4137487 - DNA, 22 bp, Homo sapiens
ctcagggagggagggcggtgga

SEQ ID NO: 4137488 - DNA, 16 bp, Homo sapiens
ctcagggcacgcagga

SEQ ID NO: 4137489 - DNA, 19 bp, Homo sapiens
ctcagggcacgcaggacca

SEQ ID NO: 4137490 - DNA, 14 bp, Homo sapiens
ctcagggcagacag

SEQ ID NO: 4137491 - DNA, 20 bp, Homo sapiens
ctcagggccatgcctgcccc

SEQ ID NO: 4137492 - DNA, 15 bp, Homo sapiens
ctcagggcctggcag

SEQ ID NO: 4137493 - DNA, 19 bp, Homo sapiens
ctcagggcctggcaggcca

SEQ ID NO: 4137494 - DNA, 14 bp, Homo sapiens
ctcagggcgctcag

SEQ ID NO: 4137495 - DNA, 13 bp, Homo sapiens
ctcagggctccca

SEQ ID NO: 4137496 - DNA, 16 bp, Homo sapiens
ctcagggctcccaggg

SEQ ID NO: 4137497 - DNA, 16 bp, Homo sapiens
ctcagggctgtcccag

SEQ ID NO: 4137498 - DNA, 19 bp, Homo sapiens
ctcagggctgtcccagccc

SEQ ID NO: 4137499 - DNA, 20 bp, Homo sapiens
ctcagggctgtcccagcccc

SEQ ID NO: 4137500 - DNA, 22 bp, Homo sapiens
ctcagggctgtcccagccccgg

SEQ ID NO: 4137501 - DNA, 19 bp, Homo sapiens
ctcaggggaaaactgttac

SEQ ID NO: 4137502 - DNA, 13 bp, Homo sapiens
ctcaggggccaga

SEQ ID NO: 4137503 - DNA, 22 bp, Homo sapiens
ctcagggtcaaagacagaatgg

SEQ ID NO: 4137504 - DNA, 15 bp, Homo sapiens
ctcagggtgcagagg

SEQ ID NO: 4137505 - DNA, 13 bp, Homo sapiens
ctcagggtggggg

SEQ ID NO: 4137506 - DNA, 17 bp, Homo sapiens
ctcagggtggggggtga

SEQ ID NO: 4137507 - DNA, 21 bp, Homo sapiens
ctcagggttttggggtcctgg

SEQ ID NO: 4137508 - DNA, 22 bp, Homo sapiens
ctcagggttttggggtcctggg

SEQ ID NO: 4137509 - DNA, 20 bp, Homo sapiens
ctcaggttctattttcttaa

SEQ ID NO: 4137510 - DNA, 14 bp, Homo sapiens
ctcaggttgtctga

SEQ ID NO: 4137511 - DNA, 15 bp, Homo sapiens
ctcagtcatgcataa

SEQ ID NO: 4137512 - DNA, 18 bp, Homo sapiens
ctcagtcattagactcct

SEQ ID NO: 4137513 - DNA, 15 bp, Homo sapiens
ctcagtccatttata

SEQ ID NO: 4137514 - DNA, 19 bp, Homo sapiens
ctcagtccatttatatatg

SEQ ID NO: 4137515 - DNA, 15 bp, Homo sapiens
ctcagtgagcctcct

SEQ ID NO: 4137516 - DNA, 20 bp, Homo sapiens
ctcagtgagcctcctgtgcc

SEQ ID NO: 4137517 - DNA, 22 bp, Homo sapiens
ctcagtgagcctcctgtgcctg

SEQ ID NO: 4137518 - DNA, 23 bp, Homo sapiens
ctcagtgagcctcctgtgcctgg

SEQ ID NO: 4137519 - DNA, 23 bp, Homo sapiens
ctcagtgtgtgtgtgtggtccat

SEQ ID NO: 4137520 - DNA, 16 bp, Homo sapiens
ctcagtgttagagaaa

SEQ ID NO: 4137521 - DNA, 17 bp, Homo sapiens
ctcagtgttagagaaat

SEQ ID NO: 4137522 - DNA, 17 bp, Homo sapiens
ctcagtgttttggactc

SEQ ID NO: 4137523 - DNA, 23 bp, Homo sapiens
ctcagttcaacctggtggcacca

SEQ ID NO: 4137524 - DNA, 12 bp, Homo sapiens
ctcagttccagg

SEQ ID NO: 4137525 - DNA, 16 bp, Homo sapiens
ctcagttccaggcctg

SEQ ID NO: 4137526 - DNA, 17 bp, Homo sapiens
ctcagttcccttggcct

SEQ ID NO: 4137527 - DNA, 21 bp, Homo sapiens
ctcagttcccttggcctcaga

SEQ ID NO: 4137528 - DNA, 22 bp, Homo sapiens
ctcagttcccttggcctcagaa

SEQ ID NO: 4137529 - DNA, 22 bp, Homo sapiens
ctcagtttgtgtgtcttaatta

SEQ ID NO: 4137530 - DNA, 18 bp, Homo sapiens
ctcagttttatcattttc

SEQ ID NO: 4137531 - DNA, 12 bp, Homo sapiens
ctcataattcct

SEQ ID NO: 4137532 - DNA, 18 bp, Homo sapiens
ctcatacctttaaaggaa

SEQ ID NO: 4137533 - DNA, 12 bp, Homo sapiens
ctcatagcatta

SEQ ID NO: 4137534 - DNA, 21 bp, Homo sapiens
ctcataggaaaagtacattta

SEQ ID NO: 4137535 - DNA, 23 bp, Homo sapiens
ctcataggaaaagtacatttaat

SEQ ID NO: 4137536 - DNA, 13 bp, Homo sapiens
ctcatatttaaag

SEQ ID NO: 4137537 - DNA, 14 bp, Homo sapiens
ctcatcaacaaaga

SEQ ID NO: 4137538 - DNA, 15 bp, Homo sapiens
ctcatcaacaaagaa

SEQ ID NO: 4137539 - DNA, 12 bp, Homo sapiens
ctcatcaggatg

SEQ ID NO: 4137540 - DNA, 20 bp, Homo sapiens
ctcatcaggatgaacccagg

SEQ ID NO: 4137541 - DNA, 22 bp, Homo sapiens
ctcatcaggatgaacccaggac

SEQ ID NO: 4137542 - DNA, 15 bp, Homo sapiens
ctcatccaccccatc

SEQ ID NO: 4137543 - DNA, 16 bp, Homo sapiens
ctcatcccaacctctt

SEQ ID NO: 4137544 - DNA, 21 bp, Homo sapiens
ctcatcccatgagaccctggt

SEQ ID NO: 4137545 - DNA, 14 bp, Homo sapiens
ctcatccccagggg

SEQ ID NO: 4137546 - DNA, 16 bp, Homo sapiens
ctcatcccgtgttctc

SEQ ID NO: 4137547 - DNA, 23 bp, Homo sapiens
ctcatcctccagtaccttgcttc

SEQ ID NO: 4137548 - DNA, 13 bp, Homo sapiens
ctcatcctcctgg

SEQ ID NO: 4137549 - DNA, 18 bp, Homo sapiens
ctcatctatctcaatcct

SEQ ID NO: 4137550 - DNA, 12 bp, Homo sapiens
ctcatctcaggt

SEQ ID NO: 4137551 - DNA, 20 bp, Homo sapiens
ctcatctccaaggatcctct

SEQ ID NO: 4137552 - DNA, 23 bp, Homo sapiens
ctcatctccaaggatcctctcca

SEQ ID NO: 4137553 - DNA, 16 bp, Homo sapiens
ctcatctctctgccca

SEQ ID NO: 4137554 - DNA, 21 bp, Homo sapiens
ctcatctgccggcccccagga

SEQ ID NO: 4137555 - DNA, 16 bp, Homo sapiens
ctcatgagtgtgcccc

SEQ ID NO: 4137556 - DNA, 16 bp, Homo sapiens
ctcatgcatttcaagc

SEQ ID NO: 4137557 - DNA, 16 bp, Homo sapiens
ctcatgcccaccccct

SEQ ID NO: 4137558 - DNA, 19 bp, Homo sapiens
ctcatgcccaccccctgcc

SEQ ID NO: 4137559 - DNA, 23 bp, Homo sapiens
ctcatgcccaccccctgccctgc

SEQ ID NO: 4137560 - DNA, 15 bp, Homo sapiens
ctcatgcccgccagt

SEQ ID NO: 4137561 - DNA, 12 bp, Homo sapiens
ctcatgctgccc

SEQ ID NO: 4137562 - DNA, 14 bp, Homo sapiens
ctcatggcagctgt

SEQ ID NO: 4137563 - DNA, 16 bp, Homo sapiens
ctcatggggtccaagt

SEQ ID NO: 4137564 - DNA, 14 bp, Homo sapiens
ctcatgtaacacat

SEQ ID NO: 4137565 - DNA, 21 bp, Homo sapiens
ctcatgtaacacataaacaat

SEQ ID NO: 4137566 - DNA, 17 bp, Homo sapiens
ctcatgtatcatctgga

SEQ ID NO: 4137567 - DNA, 19 bp, Homo sapiens
ctcatgtatcatctggata

SEQ ID NO: 4137568 - DNA, 14 bp, Homo sapiens
ctcatgtcctgctg

SEQ ID NO: 4137569 - DNA, 22 bp, Homo sapiens
ctcatgtcctgctggcttccag

SEQ ID NO: 4137570 - DNA, 17 bp, Homo sapiens
ctcatgttactcagtgt

SEQ ID NO: 4137571 - DNA, 15 bp, Homo sapiens
ctcattaaacttttt

SEQ ID NO: 4137572 - DNA, 17 bp, Homo sapiens
ctcattacttttgaagt

SEQ ID NO: 4137573 - DNA, 14 bp, Homo sapiens
ctcattcagtatta

SEQ ID NO: 4137574 - DNA, 21 bp, Homo sapiens
ctcattccctcgtctttccca

SEQ ID NO: 4137575 - DNA, 17 bp, Homo sapiens
ctcattctatccccaat

SEQ ID NO: 4137576 - DNA, 21 bp, Homo sapiens
ctcattctatccccaatcagc

SEQ ID NO: 4137577 - DNA, 19 bp, Homo sapiens
ctcattgcttacaagccta

SEQ ID NO: 4137578 - DNA, 20 bp, Homo sapiens
ctcattgtaaccatttctca

SEQ ID NO: 4137579 - DNA, 20 bp, Homo sapiens
ctcattttctataacagata

SEQ ID NO: 4137580 - DNA, 23 bp, Homo sapiens
ctcatttttgccatacatcagtt

SEQ ID NO: 4137581 - DNA, 16 bp, Homo sapiens
ctccaaacctccagcc

SEQ ID NO: 4137582 - DNA, 16 bp, Homo sapiens
ctccaaagttatccag

SEQ ID NO: 4137583 - DNA, 15 bp, Homo sapiens
ctccaacaccaagca

SEQ ID NO: 4137584 - DNA, 16 bp, Homo sapiens
ctccaacaccaagcac

SEQ ID NO: 4137585 - DNA, 18 bp, Homo sapiens
ctccaactggattataaa

SEQ ID NO: 4137586 - DNA, 14 bp, Homo sapiens
ctccaagacctagg

SEQ ID NO: 4137587 - DNA, 23 bp, Homo sapiens
ctccaagcaagtagctttccaca

SEQ ID NO: 4137588 - DNA, 13 bp, Homo sapiens
ctccaagcacaga

SEQ ID NO: 4137589 - DNA, 17 bp, Homo sapiens
ctccaagcacagagcct

SEQ ID NO: 4137590 - DNA, 19 bp, Homo sapiens
ctccaagcacagagcctgg

SEQ ID NO: 4137591 - DNA, 15 bp, Homo sapiens
ctccaagccagcaag

SEQ ID NO: 4137592 - DNA, 16 bp, Homo sapiens
ctccaagccagcaagc

SEQ ID NO: 4137593 - DNA, 14 bp, Homo sapiens
ctccaagcctgcct

SEQ ID NO: 4137594 - DNA, 18 bp, Homo sapiens
ctccaagcctgcctccca

SEQ ID NO: 4137595 - DNA, 19 bp, Homo sapiens
ctccaagcctgcctcccaa

SEQ ID NO: 4137596 - DNA, 15 bp, Homo sapiens
ctccaaggaccaggt

SEQ ID NO: 4137597 - DNA, 18 bp, Homo sapiens
ctccaaggatcctctcca

SEQ ID NO: 4137598 - DNA, 19 bp, Homo sapiens
ctccaagggaccctttgcc

SEQ ID NO: 4137599 - DNA, 20 bp, Homo sapiens
ctccaaggggaatcagaact

SEQ ID NO: 4137600 - DNA, 15 bp, Homo sapiens
ctccaagtctcagtg

SEQ ID NO: 4137601 - DNA, 21 bp, Homo sapiens
ctccaagtctcagtggcttca

SEQ ID NO: 4137602 - DNA, 20 bp, Homo sapiens
ctccaagtctctctgtgaat

SEQ ID NO: 4137603 - DNA, 21 bp, Homo sapiens
ctccaagtctctctgtgaata

SEQ ID NO: 4137604 - DNA, 20 bp, Homo sapiens
ctccaagtgccccctcacct

SEQ ID NO: 4137605 - DNA, 21 bp, Homo sapiens
ctccaagtgccccctcacctc

SEQ ID NO: 4137606 - DNA, 17 bp, Homo sapiens
ctccaatgtctgctgag

SEQ ID NO: 4137607 - DNA, 20 bp, Homo sapiens
ctccaatgtctgctgaggag

SEQ ID NO: 4137608 - DNA, 15 bp, Homo sapiens
ctccacacacacaaa

SEQ ID NO: 4137609 - DNA, 15 bp, Homo sapiens
ctccacatctgcctt

SEQ ID NO: 4137610 - DNA, 16 bp, Homo sapiens
ctccacatctgcctta

SEQ ID NO: 4137611 - DNA, 14 bp, Homo sapiens
ctccaccagcagca

SEQ ID NO: 4137612 - DNA, 15 bp, Homo sapiens
ctccaccagcagcat

SEQ ID NO: 4137613 - DNA, 15 bp, Homo sapiens
ctccaccctccacct

SEQ ID NO: 4137614 - DNA, 16 bp, Homo sapiens
ctccaccctccacctt

SEQ ID NO: 4137615 - DNA, 15 bp, Homo sapiens
ctccaccctggccga

SEQ ID NO: 4137616 - DNA, 15 bp, Homo sapiens
ctccacccttggcct

SEQ ID NO: 4137617 - DNA, 15 bp, Homo sapiens
ctccacctagactgt

SEQ ID NO: 4137618 - DNA, 16 bp, Homo sapiens
ctccacgcctcctggc

SEQ ID NO: 4137619 - DNA, 17 bp, Homo sapiens
ctccactaaatgagctc

SEQ ID NO: 4137620 - DNA, 22 bp, Homo sapiens
ctccactaaatgagctcctgcg

SEQ ID NO: 4137621 - DNA, 19 bp, Homo sapiens
ctccactaccccacaccag

SEQ ID NO: 4137622 - DNA, 9 bp, Homo sapiens
ctccactgt

SEQ ID NO: 4137623 - DNA, 11 bp, Homo sapiens
ctccactgtca

SEQ ID NO: 4137624 - DNA, 12 bp, Homo sapiens
ctccactgtcac

SEQ ID NO: 4137625 - DNA, 13 bp, Homo sapiens
ctccactgtcacc

SEQ ID NO: 4137626 - DNA, 21 bp, Homo sapiens
ctccacttcttgttccccact

SEQ ID NO: 4137627 - DNA, 16 bp, Homo sapiens
ctccagaactcttcct

SEQ ID NO: 4137628 - DNA, 17 bp, Homo sapiens
ctccagaactcttcctc

SEQ ID NO: 4137629 - DNA, 19 bp, Homo sapiens
ctccagaactcttcctcca

SEQ ID NO: 4137630 - DNA, 20 bp, Homo sapiens
ctccagaagatgccagcttc

SEQ ID NO: 4137631 - DNA, 15 bp, Homo sapiens
ctccagaagcctctg

SEQ ID NO: 4137632 - DNA, 17 bp, Homo sapiens
ctccagaagcctctggc

SEQ ID NO: 4137633 - DNA, 20 bp, Homo sapiens
ctccagaagcctctggctag

SEQ ID NO: 4137634 - DNA, 13 bp, Homo sapiens
ctccagaatgtaa

SEQ ID NO: 4137635 - DNA, 23 bp, Homo sapiens
ctccagaatgtaagaaaacaaaa

SEQ ID NO: 4137636 - DNA, 17 bp, Homo sapiens
ctccagacccctggctt

SEQ ID NO: 4137637 - DNA, 18 bp, Homo sapiens
ctccagacccctggcttt

SEQ ID NO: 4137638 - DNA, 20 bp, Homo sapiens
ctccagacccctggcttttc

SEQ ID NO: 4137639 - DNA, 14 bp, Homo sapiens
ctccagacctgatc

SEQ ID NO: 4137640 - DNA, 20 bp, Homo sapiens
ctccagagaaacccagggag

SEQ ID NO: 4137641 - DNA, 16 bp, Homo sapiens
ctccagatagagaaat

SEQ ID NO: 4137642 - DNA, 21 bp, Homo sapiens
ctccagatagagaaatagtga

SEQ ID NO: 4137643 - DNA, 17 bp, Homo sapiens
ctccagatgcagggcag

SEQ ID NO: 4137644 - DNA, 18 bp, Homo sapiens
ctccagatgcagggcagt

SEQ ID NO: 4137645 - DNA, 20 bp, Homo sapiens
ctccagatttttcggaggcc

SEQ ID NO: 4137646 - DNA, 23 bp, Homo sapiens
ctccagatttttcggaggcccca

SEQ ID NO: 4137647 - DNA, 11 bp, Homo sapiens
ctccagccagc

SEQ ID NO: 4137648 - DNA, 14 bp, Homo sapiens
ctccagcccctgtc

SEQ ID NO: 4137649 - DNA, 16 bp, Homo sapiens
ctccagcccctgtccc

SEQ ID NO: 4137650 - DNA, 16 bp, Homo sapiens
ctccagcctccctgtc

SEQ ID NO: 4137651 - DNA, 17 bp, Homo sapiens
ctccagcctccctgtct

SEQ ID NO: 4137652 - DNA, 22 bp, Homo sapiens
ctccagcctccctgtctccagc

SEQ ID NO: 4137653 - DNA, 24 bp, Homo sapiens
ctccagcctccctgtctccagctg

SEQ ID NO: 4137654 - DNA, 21 bp, Homo sapiens
ctccagcctgcccaagcccag

SEQ ID NO: 4137655 - DNA, 23 bp, Homo sapiens
ctccagcctggaaacctgtctga

SEQ ID NO: 4137656 - DNA, 13 bp, Homo sapiens
ctccagcgctgag

SEQ ID NO: 4137657 - DNA, 19 bp, Homo sapiens
ctccagcgtcagctgctcc

SEQ ID NO: 4137658 - DNA, 16 bp, Homo sapiens
ctccagctctggcatg

SEQ ID NO: 4137659 - DNA, 11 bp, Homo sapiens
ctccagctgcc

SEQ ID NO: 4137660 - DNA, 14 bp, Homo sapiens
ctccagctgccccg

SEQ ID NO: 4137661 - DNA, 12 bp, Homo sapiens
ctccagctgcct

SEQ ID NO: 4137662 - DNA, 17 bp, Homo sapiens
ctccagctgcctgggcc

SEQ ID NO: 4137663 - DNA, 21 bp, Homo sapiens
ctccagctgcctgggcccgga

SEQ ID NO: 4137664 - DNA, 19 bp, Homo sapiens
ctccagctgggctctgcaa

SEQ ID NO: 4137665 - DNA, 16 bp, Homo sapiens
ctccaggaaagagcag

SEQ ID NO: 4137666 - DNA, 11 bp, Homo sapiens
ctccaggaagg

SEQ ID NO: 4137667 - DNA, 23 bp, Homo sapiens
ctccaggaaggtagcccagcact

SEQ ID NO: 4137668 - DNA, 12 bp, Homo sapiens
ctccaggcccaa

SEQ ID NO: 4137669 - DNA, 17 bp, Homo sapiens
ctccaggcccaaggctc

SEQ ID NO: 4137670 - DNA, 20 bp, Homo sapiens
ctccaggcctgttgctatag

SEQ ID NO: 4137671 - DNA, 15 bp, Homo sapiens
ctccagggagcaaga

SEQ ID NO: 4137672 - DNA, 22 bp, Homo sapiens
ctccagggagcaagacagagac

SEQ ID NO: 4137673 - DNA, 10 bp, Homo sapiens
ctccagggct

SEQ ID NO: 4137674 - DNA, 21 bp, Homo sapiens
ctccagggctcaacactgtga

SEQ ID NO: 4137675 - DNA, 21 bp, Homo sapiens
ctccagtgtacatagtgtaat

SEQ ID NO: 4137676 - DNA, 21 bp, Homo sapiens
ctccagttgggactcaggata

SEQ ID NO: 4137677 - DNA, 21 bp, Homo sapiens
ctccagtttgcacctgtcccc

SEQ ID NO: 4137678 - DNA, 20 bp, Homo sapiens
ctccatcctatccactgggc

SEQ ID NO: 4137679 - DNA, 16 bp, Homo sapiens
ctccatcctcctcctt

SEQ ID NO: 4137680 - DNA, 17 bp, Homo sapiens
ctccatcctcctccttc

SEQ ID NO: 4137681 - DNA, 19 bp, Homo sapiens
ctccatctctcatcctcca

SEQ ID NO: 4137682 - DNA, 16 bp, Homo sapiens
ctccatctttctacag

SEQ ID NO: 4137683 - DNA, 21 bp, Homo sapiens
ctccatgaagagcttgtgtcc

SEQ ID NO: 4137684 - DNA, 14 bp, Homo sapiens
ctccatgctcctca

SEQ ID NO: 4137685 - DNA, 17 bp, Homo sapiens
ctccatgctcctcacct

SEQ ID NO: 4137686 - DNA, 13 bp, Homo sapiens
ctccatggaaaag

SEQ ID NO: 4137687 - DNA, 18 bp, Homo sapiens
ctccatggccctgtccca

SEQ ID NO: 4137688 - DNA, 14 bp, Homo sapiens
ctccattaaagtct

SEQ ID NO: 4137689 - DNA, 13 bp, Homo sapiens
ctccattctattt

SEQ ID NO: 4137690 - DNA, 20 bp, Homo sapiens
ctccattggctcccaagtca

SEQ ID NO: 4137691 - DNA, 20 bp, Homo sapiens
ctccattgggcacagtccag

SEQ ID NO: 4137692 - DNA, 15 bp, Homo sapiens
ctccatttagttctt

SEQ ID NO: 4137693 - DNA, 16 bp, Homo sapiens
ctccattttcaagctg

SEQ ID NO: 4137694 - DNA, 16 bp, Homo sapiens
ctccatttttctccca

SEQ ID NO: 4137695 - DNA, 18 bp, Homo sapiens
ctcccaaacgccctttcc

SEQ ID NO: 4137696 - DNA, 15 bp, Homo sapiens
ctcccaaagtgctgg

SEQ ID NO: 4137697 - DNA, 15 bp, Homo sapiens
ctcccaacccattca

SEQ ID NO: 4137698 - DNA, 17 bp, Homo sapiens
ctcccaacttcttcctg

SEQ ID NO: 4137699 - DNA, 22 bp, Homo sapiens
ctcccaagacttcattgtccct

SEQ ID NO: 4137700 - DNA, 19 bp, Homo sapiens
ctcccaaggtcctctcagt

SEQ ID NO: 4137701 - DNA, 21 bp, Homo sapiens
ctcccaaggttggagcccagg

SEQ ID NO: 4137702 - DNA, 15 bp, Homo sapiens
ctcccacactcccaa

SEQ ID NO: 4137703 - DNA, 19 bp, Homo sapiens
ctcccacacttgctggggc

SEQ ID NO: 4137704 - DNA, 15 bp, Homo sapiens
ctcccacaggccctt

SEQ ID NO: 4137705 - DNA, 21 bp, Homo sapiens
ctcccacaggcccttcctctc

SEQ ID NO: 4137706 - DNA, 14 bp, Homo sapiens
ctcccaccagagac

SEQ ID NO: 4137707 - DNA, 20 bp, Homo sapiens
ctcccacccccatctctccc

SEQ ID NO: 4137708 - DNA, 18 bp, Homo sapiens
ctcccacctagcagcacc

SEQ ID NO: 4137709 - DNA, 21 bp, Homo sapiens
ctcccacctcacccggcctct

SEQ ID NO: 4137710 - DNA, 15 bp, Homo sapiens
ctcccacgtgggaga

SEQ ID NO: 4137711 - DNA, 21 bp, Homo sapiens
ctcccagatcagtcagagccc

SEQ ID NO: 4137712 - DNA, 21 bp, Homo sapiens
ctcccagcaacacaagctgga

SEQ ID NO: 4137713 - DNA, 15 bp, Homo sapiens
ctcccagcctgctga

SEQ ID NO: 4137714 - DNA, 16 bp, Homo sapiens
ctcccagcctgctgag

SEQ ID NO: 4137715 - DNA, 18 bp, Homo sapiens
ctcccaggggtctccctg

SEQ ID NO: 4137716 - DNA, 16 bp, Homo sapiens
ctcccaggtaccagct

SEQ ID NO: 4137717 - DNA, 22 bp, Homo sapiens
ctcccaggtaccagctgcgctt

SEQ ID NO: 4137718 - DNA, 21 bp, Homo sapiens
ctcccaggttcccccagcaag

SEQ ID NO: 4137719 - DNA, 20 bp, Homo sapiens
ctcccagtccaaatgtcctc

SEQ ID NO: 4137720 - DNA, 23 bp, Homo sapiens
ctcccatcattacccttccctgc

SEQ ID NO: 4137721 - DNA, 22 bp, Homo sapiens
ctcccatccagggcccccatct

SEQ ID NO: 4137722 - DNA, 15 bp, Homo sapiens
ctcccattcctccct

SEQ ID NO: 4137723 - DNA, 16 bp, Homo sapiens
ctcccattcctgaaga

SEQ ID NO: 4137724 - DNA, 19 bp, Homo sapiens
ctcccattcctgaagaacc

SEQ ID NO: 4137725 - DNA, 21 bp, Homo sapiens
ctcccatttcaggaatttaaa

SEQ ID NO: 4137726 - DNA, 16 bp, Homo sapiens
ctcccattttggaatt

SEQ ID NO: 4137727 - DNA, 23 bp, Homo sapiens
ctccccaaccctaggttccctgt

SEQ ID NO: 4137728 - DNA, 18 bp, Homo sapiens
ctccccaaggaagagcca

SEQ ID NO: 4137729 - DNA, 12 bp, Homo sapiens
ctccccacacct

SEQ ID NO: 4137730 - DNA, 21 bp, Homo sapiens
ctccccacaccttccagggcc

SEQ ID NO: 4137731 - DNA, 11 bp, Homo sapiens
ctccccacagc

SEQ ID NO: 4137732 - DNA, 17 bp, Homo sapiens
ctccccacatcgcacac

SEQ ID NO: 4137733 - DNA, 16 bp, Homo sapiens
ctccccacgagggctg

SEQ ID NO: 4137734 - DNA, 18 bp, Homo sapiens
ctccccacgagggctggc

SEQ ID NO: 4137735 - DNA, 13 bp, Homo sapiens
ctccccactctag

SEQ ID NO: 4137736 - DNA, 13 bp, Homo sapiens
ctccccagatctc

SEQ ID NO: 4137737 - DNA, 14 bp, Homo sapiens
ctccccagcccaga

SEQ ID NO: 4137738 - DNA, 18 bp, Homo sapiens
ctccccagcccagagaca

SEQ ID NO: 4137739 - DNA, 13 bp, Homo sapiens
ctccccagccctg

SEQ ID NO: 4137740 - DNA, 15 bp, Homo sapiens
ctccccaggagctca

SEQ ID NO: 4137741 - DNA, 19 bp, Homo sapiens
ctccccagggagctctggg

SEQ ID NO: 4137742 - DNA, 21 bp, Homo sapiens
ctccccagggagctctgggga

SEQ ID NO: 4137743 - DNA, 14 bp, Homo sapiens
ctccccatcccatg

SEQ ID NO: 4137744 - DNA, 15 bp, Homo sapiens
ctccccatcccatgt

SEQ ID NO: 4137745 - DNA, 15 bp, Homo sapiens
ctccccatgccacgt

SEQ ID NO: 4137746 - DNA, 17 bp, Homo sapiens
ctccccatttcccatct

SEQ ID NO: 4137747 - DNA, 21 bp, Homo sapiens
ctccccatttcccatctgcac

SEQ ID NO: 4137748 - DNA, 23 bp, Homo sapiens
ctcccccaacccccaccccacac

SEQ ID NO: 4137749 - DNA, 12 bp, Homo sapiens
ctcccccgccac

SEQ ID NO: 4137750 - DNA, 22 bp, Homo sapiens
ctcccccgtttctccttttcct

SEQ ID NO: 4137751 - DNA, 21 bp, Homo sapiens
ctccccctaaacccctgtccc

SEQ ID NO: 4137752 - DNA, 22 bp, Homo sapiens
ctccccctaaacccctgtccca

SEQ ID NO: 4137753 - DNA, 16 bp, Homo sapiens
ctccccctcctccagg

SEQ ID NO: 4137754 - DNA, 23 bp, Homo sapiens
ctccccctgcaacttccgctgag

SEQ ID NO: 4137755 - DNA, 13 bp, Homo sapiens
ctccccgcccctg

SEQ ID NO: 4137756 - DNA, 17 bp, Homo sapiens
ctccccgcccctgtggc

SEQ ID NO: 4137757 - DNA, 20 bp, Homo sapiens
ctccccggacatactctctg

SEQ ID NO: 4137758 - DNA, 14 bp, Homo sapiens
ctccccggctcgag

SEQ ID NO: 4137759 - DNA, 12 bp, Homo sapiens
ctcccctccagc

SEQ ID NO: 4137760 - DNA, 16 bp, Homo sapiens
ctcccctcccagtcct

SEQ ID NO: 4137761 - DNA, 24 bp, Homo sapiens
ctcccctccggactggtgccctcc

SEQ ID NO: 4137762 - DNA, 14 bp, Homo sapiens
ctcccctctgcttc

SEQ ID NO: 4137763 - DNA, 16 bp, Homo sapiens
ctcccctgacctgtga

SEQ ID NO: 4137764 - DNA, 14 bp, Homo sapiens
ctcccctgtacctt

SEQ ID NO: 4137765 - DNA, 18 bp, Homo sapiens
ctcccctgtgccagccca

SEQ ID NO: 4137766 - DNA, 12 bp, Homo sapiens
ctccccttccca

SEQ ID NO: 4137767 - DNA, 19 bp, Homo sapiens
ctccccttccccttccttc

SEQ ID NO: 4137768 - DNA, 23 bp, Homo sapiens
ctccccttccccttccttctttg

SEQ ID NO: 4137769 - DNA, 23 bp, Homo sapiens
ctcccgaagaatgaacccaagag

SEQ ID NO: 4137770 - DNA, 24 bp, Homo sapiens
ctcccgaagaatgaacccaagagc

SEQ ID NO: 4137771 - DNA, 17 bp, Homo sapiens
ctcccgattcccaactg

SEQ ID NO: 4137772 - DNA, 14 bp, Homo sapiens
ctcccgcaccaggc

SEQ ID NO: 4137773 - DNA, 21 bp, Homo sapiens
ctcccgcccaaacctttcccc

SEQ ID NO: 4137774 - DNA, 16 bp, Homo sapiens
ctcccgccccttccca

SEQ ID NO: 4137775 - DNA, 19 bp, Homo sapiens
ctcccgcccttccatgtgc

SEQ ID NO: 4137776 - DNA, 13 bp, Homo sapiens
ctcccgcctcagg

SEQ ID NO: 4137777 - DNA, 13 bp, Homo sapiens
ctcccgctcccag

SEQ ID NO: 4137778 - DNA, 13 bp, Homo sapiens
ctcccgctgctgc

SEQ ID NO: 4137779 - DNA, 22 bp, Homo sapiens
ctcccggaattccgtcaccacg

SEQ ID NO: 4137780 - DNA, 13 bp, Homo sapiens
ctcccggagcctg

SEQ ID NO: 4137781 - DNA, 19 bp, Homo sapiens
ctcccggcatgggaaagcc

SEQ ID NO: 4137782 - DNA, 15 bp, Homo sapiens
ctcccgggccacgcc

SEQ ID NO: 4137783 - DNA, 16 bp, Homo sapiens
ctcccgggccacgccc

SEQ ID NO: 4137784 - DNA, 19 bp, Homo sapiens
ctcccgggccacgccccag

SEQ ID NO: 4137785 - DNA, 19 bp, Homo sapiens
ctcccgggttcaagtgatt

SEQ ID NO: 4137786 - DNA, 21 bp, Homo sapiens
ctcccgtgtatctggacactg

SEQ ID NO: 4137787 - DNA, 19 bp, Homo sapiens
ctccctaaactttggcctt

SEQ ID NO: 4137788 - DNA, 15 bp, Homo sapiens
ctccctacacacaca

SEQ ID NO: 4137789 - DNA, 23 bp, Homo sapiens
ctccctaccccagggccctggcc

SEQ ID NO: 4137790 - DNA, 17 bp, Homo sapiens
ctccctagactgcatcc

SEQ ID NO: 4137791 - DNA, 18 bp, Homo sapiens
ctccctatccctcacaca

SEQ ID NO: 4137792 - DNA, 18 bp, Homo sapiens
ctccctcagcctcagagg

SEQ ID NO: 4137793 - DNA, 14 bp, Homo sapiens
ctccctcaggctct

SEQ ID NO: 4137794 - DNA, 15 bp, Homo sapiens
ctccctccacctcaa

SEQ ID NO: 4137795 - DNA, 14 bp, Homo sapiens
ctccctcccctgcc

SEQ ID NO: 4137796 - DNA, 18 bp, Homo sapiens
ctccctccgggtcttcct

SEQ ID NO: 4137797 - DNA, 15 bp, Homo sapiens
ctccctcctccaggc

SEQ ID NO: 4137798 - DNA, 12 bp, Homo sapiens
ctccctccttgg

SEQ ID NO: 4137799 - DNA, 17 bp, Homo sapiens
ctccctctctcttctgc

SEQ ID NO: 4137800 - DNA, 21 bp, Homo sapiens
ctccctctctcttctgctcca

SEQ ID NO: 4137801 - DNA, 16 bp, Homo sapiens
ctccctgactccctgt

SEQ ID NO: 4137802 - DNA, 16 bp, Homo sapiens
ctccctgactggcctg

SEQ ID NO: 4137803 - DNA, 17 bp, Homo sapiens
ctccctgactggcctgg

SEQ ID NO: 4137804 - DNA, 13 bp, Homo sapiens
ctccctgccagag

SEQ ID NO: 4137805 - DNA, 14 bp, Homo sapiens
ctccctgccagagg

SEQ ID NO: 4137806 - DNA, 13 bp, Homo sapiens
ctccctgcccctc

SEQ ID NO: 4137807 - DNA, 18 bp, Homo sapiens
ctccctgcccctcccttc

SEQ ID NO: 4137808 - DNA, 12 bp, Homo sapiens
ctccctgcctgg

SEQ ID NO: 4137809 - DNA, 14 bp, Homo sapiens
ctccctgctccacg

SEQ ID NO: 4137810 - DNA, 13 bp, Homo sapiens
ctccctgctgtgc

SEQ ID NO: 4137811 - DNA, 15 bp, Homo sapiens
ctccctgctgtgcca

SEQ ID NO: 4137812 - DNA, 22 bp, Homo sapiens
ctccctgctgtgccatgctggg

SEQ ID NO: 4137813 - DNA, 21 bp, Homo sapiens
ctccctgcttgcaggaggcca

SEQ ID NO: 4137814 - DNA, 20 bp, Homo sapiens
ctccctgctttggctgaggg

SEQ ID NO: 4137815 - DNA, 11 bp, Homo sapiens
ctccctggctc

SEQ ID NO: 4137816 - DNA, 14 bp, Homo sapiens
ctccctggctccct

SEQ ID NO: 4137817 - DNA, 15 bp, Homo sapiens
ctccctggctctcag

SEQ ID NO: 4137818 - DNA, 16 bp, Homo sapiens
ctccctgggacacaga

SEQ ID NO: 4137819 - DNA, 15 bp, Homo sapiens
ctccctgtacagtgt

SEQ ID NO: 4137820 - DNA, 18 bp, Homo sapiens
ctccctgtacagtgttac

SEQ ID NO: 4137821 - DNA, 15 bp, Homo sapiens
ctccctgtctccagc

SEQ ID NO: 4137822 - DNA, 16 bp, Homo sapiens
ctccctgtctccagct

SEQ ID NO: 4137823 - DNA, 21 bp, Homo sapiens
ctccctgtctccagctgcctg

SEQ ID NO: 4137824 - DNA, 22 bp, Homo sapiens
ctccctgtggcactcagggagc

SEQ ID NO: 4137825 - DNA, 21 bp, Homo sapiens
ctccctgtgggggtggccatc

SEQ ID NO: 4137826 - DNA, 22 bp, Homo sapiens
ctccctgtgggggtggccatcc

SEQ ID NO: 4137827 - DNA, 13 bp, Homo sapiens
ctccctgtgtcca

SEQ ID NO: 4137828 - DNA, 18 bp, Homo sapiens
ctcccttcaaccattccc

SEQ ID NO: 4137829 - DNA, 20 bp, Homo sapiens
ctcccttcaaccattcccca

SEQ ID NO: 4137830 - DNA, 21 bp, Homo sapiens
ctcccttcaaccattccccat

SEQ ID NO: 4137831 - DNA, 19 bp, Homo sapiens
ctcccttcaatgctagaaa

SEQ ID NO: 4137832 - DNA, 16 bp, Homo sapiens
ctcccttcagccccca

SEQ ID NO: 4137833 - DNA, 17 bp, Homo sapiens
ctcccttcctctctcct

SEQ ID NO: 4137834 - DNA, 19 bp, Homo sapiens
ctcccttccttttccctgc

SEQ ID NO: 4137835 - DNA, 15 bp, Homo sapiens
ctcccttgacctgct

SEQ ID NO: 4137836 - DNA, 21 bp, Homo sapiens
ctcccttgcctttcgaggcct

SEQ ID NO: 4137837 - DNA, 22 bp, Homo sapiens
ctcccttgcctttcgaggcctg

SEQ ID NO: 4137838 - DNA, 23 bp, Homo sapiens
ctcccttgcctttcgaggcctga

SEQ ID NO: 4137839 - DNA, 18 bp, Homo sapiens
ctcccttgctgaacacac

SEQ ID NO: 4137840 - DNA, 21 bp, Homo sapiens
ctcccttgctgaacacacaca

SEQ ID NO: 4137841 - DNA, 14 bp, Homo sapiens
ctccctttcccttc

SEQ ID NO: 4137842 - DNA, 18 bp, Homo sapiens
ctcccttttctttttccc

SEQ ID NO: 4137843 - DNA, 15 bp, Homo sapiens
ctccgagacagtcca

SEQ ID NO: 4137844 - DNA, 17 bp, Homo sapiens
ctccgagacagtccagt

SEQ ID NO: 4137845 - DNA, 18 bp, Homo sapiens
ctccgagacagtccagtg

SEQ ID NO: 4137846 - DNA, 21 bp, Homo sapiens
ctccgccagcctcctctggac

SEQ ID NO: 4137847 - DNA, 16 bp, Homo sapiens
ctccgcccgctcctgc

SEQ ID NO: 4137848 - DNA, 20 bp, Homo sapiens
ctccgccctcctcgggccga

SEQ ID NO: 4137849 - DNA, 19 bp, Homo sapiens
ctccggccatactgccttt

SEQ ID NO: 4137850 - DNA, 17 bp, Homo sapiens
ctccgggtgtggcctca

SEQ ID NO: 4137851 - DNA, 14 bp, Homo sapiens
ctccgttccatctg

SEQ ID NO: 4137852 - DNA, 22 bp, Homo sapiens
ctccgtttattataaactgtat

SEQ ID NO: 4137853 - DNA, 13 bp, Homo sapiens
ctcctacctctgt

SEQ ID NO: 4137854 - DNA, 14 bp, Homo sapiens
ctcctacctctgtg

SEQ ID NO: 4137855 - DNA, 13 bp, Homo sapiens
ctcctacctggta

SEQ ID NO: 4137856 - DNA, 18 bp, Homo sapiens
ctcctagagaacgcagcc

SEQ ID NO: 4137857 - DNA, 20 bp, Homo sapiens
ctcctagagaacgcagccct

SEQ ID NO: 4137858 - DNA, 16 bp, Homo sapiens
ctcctagcagacagaa

SEQ ID NO: 4137859 - DNA, 21 bp, Homo sapiens
ctcctagcagacagaaactgg

SEQ ID NO: 4137860 - DNA, 22 bp, Homo sapiens
ctcctagcctgtgcctctggga

SEQ ID NO: 4137861 - DNA, 12 bp, Homo sapiens
ctcctagctctc

SEQ ID NO: 4137862 - DNA, 16 bp, Homo sapiens
ctcctagctctcccag

SEQ ID NO: 4137863 - DNA, 18 bp, Homo sapiens
ctcctagctctcccagtg

SEQ ID NO: 4137864 - DNA, 20 bp, Homo sapiens
ctcctaggggaacagaccag

SEQ ID NO: 4137865 - DNA, 22 bp, Homo sapiens
ctcctaggggaacagaccagtg

SEQ ID NO: 4137866 - DNA, 14 bp, Homo sapiens
ctcctcacctcatg

SEQ ID NO: 4137867 - DNA, 16 bp, Homo sapiens
ctcctcacctcatgcc

SEQ ID NO: 4137868 - DNA, 18 bp, Homo sapiens
ctcctcacctctggactg

SEQ ID NO: 4137869 - DNA, 17 bp, Homo sapiens
ctcctcagagcgccagg

SEQ ID NO: 4137870 - DNA, 21 bp, Homo sapiens
ctcctcaggcacacagctact

SEQ ID NO: 4137871 - DNA, 11 bp, Homo sapiens
ctcctcagggt

SEQ ID NO: 4137872 - DNA, 13 bp, Homo sapiens
ctcctcagggtgg

SEQ ID NO: 4137873 - DNA, 12 bp, Homo sapiens
ctcctcatcccg

SEQ ID NO: 4137874 - DNA, 15 bp, Homo sapiens
ctcctcatcccgtgt

SEQ ID NO: 4137875 - DNA, 14 bp, Homo sapiens
ctcctccaaaggcc

SEQ ID NO: 4137876 - DNA, 16 bp, Homo sapiens
ctcctccagcccctgt

SEQ ID NO: 4137877 - DNA, 20 bp, Homo sapiens
ctcctccagcccctgtccca

SEQ ID NO: 4137878 - DNA, 13 bp, Homo sapiens
ctcctccaggcct

SEQ ID NO: 4137879 - DNA, 18 bp, Homo sapiens
ctcctccaggcctgcctc

SEQ ID NO: 4137880 - DNA, 23 bp, Homo sapiens
ctcctccaggcctgcctcccact

SEQ ID NO: 4137881 - DNA, 17 bp, Homo sapiens
ctcctccagtgtgggct

SEQ ID NO: 4137882 - DNA, 17 bp, Homo sapiens
ctcctcccaggcgcccc

SEQ ID NO: 4137883 - DNA, 14 bp, Homo sapiens
ctcctccccaaatc

SEQ ID NO: 4137884 - DNA, 17 bp, Homo sapiens
ctcctccccaaatcaat

SEQ ID NO: 4137885 - DNA, 15 bp, Homo sapiens
ctcctcccgcccttc

SEQ ID NO: 4137886 - DNA, 16 bp, Homo sapiens
ctcctcccgcccttcc

SEQ ID NO: 4137887 - DNA, 15 bp, Homo sapiens
ctcctcccggtgccc

SEQ ID NO: 4137888 - DNA, 17 bp, Homo sapiens
ctcctcccggtgcccaa

SEQ ID NO: 4137889 - DNA, 22 bp, Homo sapiens
ctcctcccttccttttccctgc

SEQ ID NO: 4137890 - DNA, 14 bp, Homo sapiens
ctcctcctgccctg

SEQ ID NO: 4137891 - DNA, 15 bp, Homo sapiens
ctcctcctgccctgt

SEQ ID NO: 4137892 - DNA, 16 bp, Homo sapiens
ctcctcctgccctgtc

SEQ ID NO: 4137893 - DNA, 15 bp, Homo sapiens
ctcctccttcctagt

SEQ ID NO: 4137894 - DNA, 15 bp, Homo sapiens
ctcctcctttttcca

SEQ ID NO: 4137895 - DNA, 19 bp, Homo sapiens
ctcctcgggccgaggccca

SEQ ID NO: 4137896 - DNA, 15 bp, Homo sapiens
ctcctcgtccatcag

SEQ ID NO: 4137897 - DNA, 13 bp, Homo sapiens
ctcctcgttcctt

SEQ ID NO: 4137898 - DNA, 18 bp, Homo sapiens
ctcctctagctgtggggg

SEQ ID NO: 4137899 - DNA, 15 bp, Homo sapiens
ctcctctcagtgttt

SEQ ID NO: 4137900 - DNA, 18 bp, Homo sapiens
ctcctctccccagcccag

SEQ ID NO: 4137901 - DNA, 19 bp, Homo sapiens
ctcctctccccagcccaga

SEQ ID NO: 4137902 - DNA, 21 bp, Homo sapiens
ctcctctcctgacaatactgt

SEQ ID NO: 4137903 - DNA, 15 bp, Homo sapiens
ctcctctcctggagg

SEQ ID NO: 4137904 - DNA, 20 bp, Homo sapiens
ctcctctcctggaggattgc

SEQ ID NO: 4137905 - DNA, 15 bp, Homo sapiens
ctcctctctctttcc

SEQ ID NO: 4137906 - DNA, 23 bp, Homo sapiens
ctcctctctctttcctccaccca

SEQ ID NO: 4137907 - DNA, 14 bp, Homo sapiens
ctcctctctgggcc

SEQ ID NO: 4137908 - DNA, 15 bp, Homo sapiens
ctcctctctgggcct

SEQ ID NO: 4137909 - DNA, 13 bp, Homo sapiens
ctcctctgcctac

SEQ ID NO: 4137910 - DNA, 18 bp, Homo sapiens
ctcctctgcctacagcca

SEQ ID NO: 4137911 - DNA, 14 bp, Homo sapiens
ctcctctggctttc

SEQ ID NO: 4137912 - DNA, 17 bp, Homo sapiens
ctcctctggctttccca

SEQ ID NO: 4137913 - DNA, 19 bp, Homo sapiens
ctcctgacctcaggtgatt

SEQ ID NO: 4137914 - DNA, 16 bp, Homo sapiens
ctcctgacctgtcacc

SEQ ID NO: 4137915 - DNA, 15 bp, Homo sapiens
ctcctgactgtaaca

SEQ ID NO: 4137916 - DNA, 13 bp, Homo sapiens
ctcctgagcctgt

SEQ ID NO: 4137917 - DNA, 14 bp, Homo sapiens
ctcctgagcctgtg

SEQ ID NO: 4137918 - DNA, 16 bp, Homo sapiens
ctcctgaggctttgga

SEQ ID NO: 4137919 - DNA, 22 bp, Homo sapiens
ctcctgagttgaagtcatgctc

SEQ ID NO: 4137920 - DNA, 15 bp, Homo sapiens
ctcctgccccacact

SEQ ID NO: 4137921 - DNA, 12 bp, Homo sapiens
ctcctgccctgt

SEQ ID NO: 4137922 - DNA, 13 bp, Homo sapiens
ctcctgccctgtt

SEQ ID NO: 4137923 - DNA, 14 bp, Homo sapiens
ctcctgcctcagcc

SEQ ID NO: 4137924 - DNA, 15 bp, Homo sapiens
ctcctgcctcagcct

SEQ ID NO: 4137925 - DNA, 12 bp, Homo sapiens
ctcctgcctgag

SEQ ID NO: 4137926 - DNA, 21 bp, Homo sapiens
ctcctgcctgagtttccagcc

SEQ ID NO: 4137927 - DNA, 22 bp, Homo sapiens
ctcctgcctgagtttccagcct

SEQ ID NO: 4137928 - DNA, 17 bp, Homo sapiens
ctcctgcctgcccctct

SEQ ID NO: 4137929 - DNA, 12 bp, Homo sapiens
ctcctgctcacc

SEQ ID NO: 4137930 - DNA, 14 bp, Homo sapiens
ctcctgctcaccac

SEQ ID NO: 4137931 - DNA, 18 bp, Homo sapiens
ctcctgctcaccacctgc

SEQ ID NO: 4137932 - DNA, 12 bp, Homo sapiens
ctcctgctgcca

SEQ ID NO: 4137933 - DNA, 13 bp, Homo sapiens
ctcctgcttttct

SEQ ID NO: 4137934 - DNA, 22 bp, Homo sapiens
ctcctgcttttctgtcctgggc

SEQ ID NO: 4137935 - DNA, 18 bp, Homo sapiens
ctcctggaaccttgctgt

SEQ ID NO: 4137936 - DNA, 23 bp, Homo sapiens
ctcctggaaccttgctgtcctga

SEQ ID NO: 4137937 - DNA, 19 bp, Homo sapiens
ctcctggagcctttgaata

SEQ ID NO: 4137938 - DNA, 12 bp, Homo sapiens
ctcctggccaga

SEQ ID NO: 4137939 - DNA, 23 bp, Homo sapiens
ctcctggccagacgctgccgctg

SEQ ID NO: 4137940 - DNA, 22 bp, Homo sapiens
ctcctggcctatccgctgccag

SEQ ID NO: 4137941 - DNA, 23 bp, Homo sapiens
ctcctggcctttcctggttttca

SEQ ID NO: 4137942 - DNA, 14 bp, Homo sapiens
ctcctggccttttg

SEQ ID NO: 4137943 - DNA, 12 bp, Homo sapiens
ctcctggctggg

SEQ ID NO: 4137944 - DNA, 13 bp, Homo sapiens
ctcctggctgggc

SEQ ID NO: 4137945 - DNA, 21 bp, Homo sapiens
ctcctggctgggccatccttc

SEQ ID NO: 4137946 - DNA, 20 bp, Homo sapiens
ctcctgggagcccccaccac

SEQ ID NO: 4137947 - DNA, 14 bp, Homo sapiens
ctcctgggggtggc

SEQ ID NO: 4137948 - DNA, 20 bp, Homo sapiens
ctcctgtaacatactggcct

SEQ ID NO: 4137949 - DNA, 22 bp, Homo sapiens
ctcctgtaacatactggcctgg

SEQ ID NO: 4137950 - DNA, 23 bp, Homo sapiens
ctcctgtaacatactggcctgga

SEQ ID NO: 4137951 - DNA, 13 bp, Homo sapiens
ctcctgtcccttt

SEQ ID NO: 4137952 - DNA, 15 bp, Homo sapiens
ctcctgtcccttttc

SEQ ID NO: 4137953 - DNA, 18 bp, Homo sapiens
ctcctgtcccttttccct

SEQ ID NO: 4137954 - DNA, 16 bp, Homo sapiens
ctcctgtgcatgggtg

SEQ ID NO: 4137955 - DNA, 20 bp, Homo sapiens
ctcctgtgcatgggtgaagg

SEQ ID NO: 4137956 - DNA, 22 bp, Homo sapiens
ctcctgtgcccacatcccaggc

SEQ ID NO: 4137957 - DNA, 17 bp, Homo sapiens
ctcctgtgcctggcccc

SEQ ID NO: 4137958 - DNA, 18 bp, Homo sapiens
ctcctgtgcctggcccca

SEQ ID NO: 4137959 - DNA, 19 bp, Homo sapiens
ctcctgtgcctggccccag

SEQ ID NO: 4137960 - DNA, 16 bp, Homo sapiens
ctcctgtggggaaagg

SEQ ID NO: 4137961 - DNA, 17 bp, Homo sapiens
ctccttaaaaactggcc

SEQ ID NO: 4137962 - DNA, 17 bp, Homo sapiens
ctccttagccctgtctg

SEQ ID NO: 4137963 - DNA, 22 bp, Homo sapiens
ctccttagccctgtctgctagg

SEQ ID NO: 4137964 - DNA, 19 bp, Homo sapiens
ctccttagtcttctcatag

SEQ ID NO: 4137965 - DNA, 19 bp, Homo sapiens
ctccttatagacacttgct

SEQ ID NO: 4137966 - DNA, 21 bp, Homo sapiens
ctccttatagacacttgctcc

SEQ ID NO: 4137967 - DNA, 13 bp, Homo sapiens
ctccttcagacac

SEQ ID NO: 4137968 - DNA, 18 bp, Homo sapiens
ctccttccacctccctcc

SEQ ID NO: 4137969 - DNA, 21 bp, Homo sapiens
ctccttcccacccctacacac

SEQ ID NO: 4137970 - DNA, 20 bp, Homo sapiens
ctccttcccactcttctcat

SEQ ID NO: 4137971 - DNA, 17 bp, Homo sapiens
ctccttcccatcgctgt

SEQ ID NO: 4137972 - DNA, 20 bp, Homo sapiens
ctccttcccatttctctaca

SEQ ID NO: 4137973 - DNA, 17 bp, Homo sapiens
ctccttcccttgctacc

SEQ ID NO: 4137974 - DNA, 12 bp, Homo sapiens
ctccttcctggc

SEQ ID NO: 4137975 - DNA, 17 bp, Homo sapiens
ctccttcctggcctgag

SEQ ID NO: 4137976 - DNA, 18 bp, Homo sapiens
ctccttcctggcctgaga

SEQ ID NO: 4137977 - DNA, 12 bp, Homo sapiens
ctccttctcctt

SEQ ID NO: 4137978 - DNA, 20 bp, Homo sapiens
ctccttgaatatctttcgat

SEQ ID NO: 4137979 - DNA, 20 bp, Homo sapiens
ctccttgccccccgccctca

SEQ ID NO: 4137980 - DNA, 21 bp, Homo sapiens
ctccttgccccccgccctcat

SEQ ID NO: 4137981 - DNA, 15 bp, Homo sapiens
ctccttgcttcctga

SEQ ID NO: 4137982 - DNA, 16 bp, Homo sapiens
ctccttgttagccctt

SEQ ID NO: 4137983 - DNA, 22 bp, Homo sapiens
ctcctttacaaaagaaatacct

SEQ ID NO: 4137984 - DNA, 17 bp, Homo sapiens
ctcctttagggacagct

SEQ ID NO: 4137985 - DNA, 13 bp, Homo sapiens
ctcctttcacaac

SEQ ID NO: 4137986 - DNA, 16 bp, Homo sapiens
ctcctttcacaacctt

SEQ ID NO: 4137987 - DNA, 17 bp, Homo sapiens
ctcctttcacaaccttc

SEQ ID NO: 4137988 - DNA, 19 bp, Homo sapiens
ctcctttctccagccagca

SEQ ID NO: 4137989 - DNA, 14 bp, Homo sapiens
ctcctttctgtgcc

SEQ ID NO: 4137990 - DNA, 17 bp, Homo sapiens
ctcctttctgtgcccta

SEQ ID NO: 4137991 - DNA, 19 bp, Homo sapiens
ctcctttcttattaatttc

SEQ ID NO: 4137992 - DNA, 21 bp, Homo sapiens
ctcctttgcactgagggccac

SEQ ID NO: 4137993 - DNA, 19 bp, Homo sapiens
ctccttttccagagcattc

SEQ ID NO: 4137994 - DNA, 17 bp, Homo sapiens
ctccttttgtgttccaa

SEQ ID NO: 4137995 - DNA, 15 bp, Homo sapiens
ctcgaaacacagaaa

SEQ ID NO: 4137996 - DNA, 19 bp, Homo sapiens
ctcgaaacacagaaacctt

SEQ ID NO: 4137997 - DNA, 14 bp, Homo sapiens
ctcgaatctgtgtg

SEQ ID NO: 4137998 - DNA, 19 bp, Homo sapiens
ctcgacagcgcccctgctg

SEQ ID NO: 4137999 - DNA, 19 bp, Homo sapiens
ctcgacagggcctggagcc

SEQ ID NO: 4138000 - DNA, 19 bp, Homo sapiens
ctcgacccagaatggagcc

SEQ ID NO: 4138001 - DNA, 15 bp, Homo sapiens
ctcgagcccagatgg

SEQ ID NO: 4138002 - DNA, 17 bp, Homo sapiens
ctcgagcccagatggaa

SEQ ID NO: 4138003 - DNA, 13 bp, Homo sapiens
ctcgatctcctga

SEQ ID NO: 4138004 - DNA, 17 bp, Homo sapiens
ctcgcacctgtgctgga

SEQ ID NO: 4138005 - DNA, 18 bp, Homo sapiens
ctcgcaggcctccctgcc

SEQ ID NO: 4138006 - DNA, 18 bp, Homo sapiens
ctcgccatctcctgggcc

SEQ ID NO: 4138007 - DNA, 12 bp, Homo sapiens
ctcgcccagcag

SEQ ID NO: 4138008 - DNA, 13 bp, Homo sapiens
ctcgcccagcagg

SEQ ID NO: 4138009 - DNA, 16 bp, Homo sapiens
ctcgcctgtcaccccc

SEQ ID NO: 4138010 - DNA, 21 bp, Homo sapiens
ctcgctgtcactggctggctc

SEQ ID NO: 4138011 - DNA, 22 bp, Homo sapiens
ctcgctgtcactggctggctcc

SEQ ID NO: 4138012 - DNA, 11 bp, Homo sapiens
ctcgcttcttt

SEQ ID NO: 4138013 - DNA, 18 bp, Homo sapiens
ctcggactaagcctacct

SEQ ID NO: 4138014 - DNA, 22 bp, Homo sapiens
ctcggactaagcctacctgctc

SEQ ID NO: 4138015 - DNA, 17 bp, Homo sapiens
ctcggagagcagcagca

SEQ ID NO: 4138016 - DNA, 12 bp, Homo sapiens
ctcggaggctgc

SEQ ID NO: 4138017 - DNA, 17 bp, Homo sapiens
ctcggagggattcccct

SEQ ID NO: 4138018 - DNA, 15 bp, Homo sapiens
ctcggagttcttctt

SEQ ID NO: 4138019 - DNA, 20 bp, Homo sapiens
ctcggatgacaccctggcct

SEQ ID NO: 4138020 - DNA, 18 bp, Homo sapiens
ctcggcctcccaaagtgc

SEQ ID NO: 4138021 - DNA, 22 bp, Homo sapiens
ctcggctccccatgtgtcctgg

SEQ ID NO: 4138022 - DNA, 15 bp, Homo sapiens
ctcgggaagcagcca

SEQ ID NO: 4138023 - DNA, 16 bp, Homo sapiens
ctcgggaagcagccag

SEQ ID NO: 4138024 - DNA, 17 bp, Homo sapiens
ctcgggaagcagccagc

SEQ ID NO: 4138025 - DNA, 13 bp, Homo sapiens
ctcgggccgaggc

SEQ ID NO: 4138026 - DNA, 18 bp, Homo sapiens
ctcgggccgaggcccagc

SEQ ID NO: 4138027 - DNA, 18 bp, Homo sapiens
ctcgtccaccccccacac

SEQ ID NO: 4138028 - DNA, 19 bp, Homo sapiens
ctcgtccaccccccacaca

SEQ ID NO: 4138029 - DNA, 13 bp, Homo sapiens
ctcgtccctccct

SEQ ID NO: 4138030 - DNA, 13 bp, Homo sapiens
ctcgtctttccca

SEQ ID NO: 4138031 - DNA, 15 bp, Homo sapiens
ctcgtgagtcattta

SEQ ID NO: 4138032 - DNA, 17 bp, Homo sapiens
ctcgtgccatgatctgt

SEQ ID NO: 4138033 - DNA, 21 bp, Homo sapiens
ctcgtggttattagcaaggct

SEQ ID NO: 4138034 - DNA, 14 bp, Homo sapiens
ctcgttcccaaaga

SEQ ID NO: 4138035 - DNA, 15 bp, Homo sapiens
ctcgttcctttctcc

SEQ ID NO: 4138036 - DNA, 18 bp, Homo sapiens
ctcgttggaagaggaaca

SEQ ID NO: 4138037 - DNA, 19 bp, Homo sapiens
ctcgtttttcagcaccccc

SEQ ID NO: 4138038 - DNA, 20 bp, Homo sapiens
ctcgtttttcagcaccccca

SEQ ID NO: 4138039 - DNA, 18 bp, Homo sapiens
ctctaaaaaacattttta

SEQ ID NO: 4138040 - DNA, 14 bp, Homo sapiens
ctctaaactgcaaa

SEQ ID NO: 4138041 - DNA, 22 bp, Homo sapiens
ctctaaactgcaaacagaaatc

SEQ ID NO: 4138042 - DNA, 15 bp, Homo sapiens
ctctaaatcttcctt

SEQ ID NO: 4138043 - DNA, 13 bp, Homo sapiens
ctctaagccactc

SEQ ID NO: 4138044 - DNA, 16 bp, Homo sapiens
ctctaagctcagtgct

SEQ ID NO: 4138045 - DNA, 17 bp, Homo sapiens
ctctaagctcagtgctc

SEQ ID NO: 4138046 - DNA, 14 bp, Homo sapiens
ctctaaggttgggc

SEQ ID NO: 4138047 - DNA, 17 bp, Homo sapiens
ctctaatcgaaagaaaa

SEQ ID NO: 4138048 - DNA, 20 bp, Homo sapiens
ctctaattcccattttgcaa

SEQ ID NO: 4138049 - DNA, 17 bp, Homo sapiens
ctctacaattggaagat

SEQ ID NO: 4138050 - DNA, 17 bp, Homo sapiens
ctctacatcttctgcct

SEQ ID NO: 4138051 - DNA, 14 bp, Homo sapiens
ctctaccaaataat

SEQ ID NO: 4138052 - DNA, 15 bp, Homo sapiens
ctctaccagttggca

SEQ ID NO: 4138053 - DNA, 14 bp, Homo sapiens
ctctaccccaattt

SEQ ID NO: 4138054 - DNA, 14 bp, Homo sapiens
ctctaccctcccac

SEQ ID NO: 4138055 - DNA, 13 bp, Homo sapiens
ctctaccctgctc

SEQ ID NO: 4138056 - DNA, 16 bp, Homo sapiens
ctctaccctgctccct

SEQ ID NO: 4138057 - DNA, 22 bp, Homo sapiens
ctctacctaatgtctcactgtt

SEQ ID NO: 4138058 - DNA, 19 bp, Homo sapiens
ctctaccttcctgtccctg

SEQ ID NO: 4138059 - DNA, 20 bp, Homo sapiens
ctctacgtggcaaattaact

SEQ ID NO: 4138060 - DNA, 18 bp, Homo sapiens
ctctactaccacaaggaa

SEQ ID NO: 4138061 - DNA, 19 bp, Homo sapiens
ctctactaccacaaggaaa

SEQ ID NO: 4138062 - DNA, 20 bp, Homo sapiens
ctctactaccacaaggaaaa

SEQ ID NO: 4138063 - DNA, 17 bp, Homo sapiens
ctctacttagcatgtcc

SEQ ID NO: 4138064 - DNA, 15 bp, Homo sapiens
ctctagaagccaagg

SEQ ID NO: 4138065 - DNA, 23 bp, Homo sapiens
ctctagagaagtggactggagga

SEQ ID NO: 4138066 - DNA, 14 bp, Homo sapiens
ctctagccctgccc

SEQ ID NO: 4138067 - DNA, 16 bp, Homo sapiens
ctctagccctgcccgg

SEQ ID NO: 4138068 - DNA, 16 bp, Homo sapiens
ctctagctgtgggggt

SEQ ID NO: 4138069 - DNA, 20 bp, Homo sapiens
ctctaggcaagcaggacctg

SEQ ID NO: 4138070 - DNA, 17 bp, Homo sapiens
ctctaggggtcaggctc

SEQ ID NO: 4138071 - DNA, 19 bp, Homo sapiens
ctctagtgggacagcccag

SEQ ID NO: 4138072 - DNA, 23 bp, Homo sapiens
ctctatccaaagaacttgatttg

SEQ ID NO: 4138073 - DNA, 17 bp, Homo sapiens
ctctatgccagctcagt

SEQ ID NO: 4138074 - DNA, 15 bp, Homo sapiens
ctctatttaatattt

SEQ ID NO: 4138075 - DNA, 16 bp, Homo sapiens
ctctatttaatattta

SEQ ID NO: 4138076 - DNA, 12 bp, Homo sapiens
ctctatttactt

SEQ ID NO: 4138077 - DNA, 16 bp, Homo sapiens
ctctatttatgtttgc

SEQ ID NO: 4138078 - DNA, 23 bp, Homo sapiens
ctctatttccccctttcttcctc

SEQ ID NO: 4138079 - DNA, 11 bp, Homo sapiens
ctctattttgt

SEQ ID NO: 4138080 - DNA, 23 bp, Homo sapiens
ctctcaaaacttggtatttttca

SEQ ID NO: 4138081 - DNA, 17 bp, Homo sapiens
ctctcaagaccagagac

SEQ ID NO: 4138082 - DNA, 18 bp, Homo sapiens
ctctcaagctagtgtttc

SEQ ID NO: 4138083 - DNA, 22 bp, Homo sapiens
ctctcaagtcaaggaagctggg

SEQ ID NO: 4138084 - DNA, 13 bp, Homo sapiens
ctctcacatgtgg

SEQ ID NO: 4138085 - DNA, 14 bp, Homo sapiens
ctctcacccatccc

SEQ ID NO: 4138086 - DNA, 16 bp, Homo sapiens
ctctcacccccatccc

SEQ ID NO: 4138087 - DNA, 12 bp, Homo sapiens
ctctcactcccc

SEQ ID NO: 4138088 - DNA, 14 bp, Homo sapiens
ctctcactccccat

SEQ ID NO: 4138089 - DNA, 16 bp, Homo sapiens
ctctcagaaggtattc

SEQ ID NO: 4138090 - DNA, 22 bp, Homo sapiens
ctctcagaggcctgctgccagt

SEQ ID NO: 4138091 - DNA, 12 bp, Homo sapiens
ctctcagcacag

SEQ ID NO: 4138092 - DNA, 13 bp, Homo sapiens
ctctcagcacagc

SEQ ID NO: 4138093 - DNA, 14 bp, Homo sapiens
ctctcagcacagcc

SEQ ID NO: 4138094 - DNA, 23 bp, Homo sapiens
ctctcagcatttccttgtcccgt

SEQ ID NO: 4138095 - DNA, 17 bp, Homo sapiens
ctctcagctcagcgcca

SEQ ID NO: 4138096 - DNA, 13 bp, Homo sapiens
ctctcagctccgg

SEQ ID NO: 4138097 - DNA, 17 bp, Homo sapiens
ctctcaggagcacaggc

SEQ ID NO: 4138098 - DNA, 19 bp, Homo sapiens
ctctcaggagcacaggcag

SEQ ID NO: 4138099 - DNA, 14 bp, Homo sapiens
ctctcaggatcaag

SEQ ID NO: 4138100 - DNA, 13 bp, Homo sapiens
ctctcagggcctg

SEQ ID NO: 4138101 - DNA, 16 bp, Homo sapiens
ctctcagggcctggca

SEQ ID NO: 4138102 - DNA, 19 bp, Homo sapiens
ctctcagggcctggcaggc

SEQ ID NO: 4138103 - DNA, 20 bp, Homo sapiens
ctctcagggcctggcaggcc

SEQ ID NO: 4138104 - DNA, 24 bp, Homo sapiens
ctctcagggcctggcaggccagtg

SEQ ID NO: 4138105 - DNA, 12 bp, Homo sapiens
ctctcagtgttt

SEQ ID NO: 4138106 - DNA, 22 bp, Homo sapiens
ctctcagtgttttggactccat

SEQ ID NO: 4138107 - DNA, 21 bp, Homo sapiens
ctctcagttctctcccttcct

SEQ ID NO: 4138108 - DNA, 19 bp, Homo sapiens
ctctcatcctccagtacct

SEQ ID NO: 4138109 - DNA, 16 bp, Homo sapiens
ctctcatgctgcccct

SEQ ID NO: 4138110 - DNA, 21 bp, Homo sapiens
ctctcatgctgcccctgcctt

SEQ ID NO: 4138111 - DNA, 13 bp, Homo sapiens
ctctccaagtctc

SEQ ID NO: 4138112 - DNA, 22 bp, Homo sapiens
ctctccaagtctctctgtgaat

SEQ ID NO: 4138113 - DNA, 17 bp, Homo sapiens
ctctccaatgttctatt

SEQ ID NO: 4138114 - DNA, 13 bp, Homo sapiens
ctctccacggtag

SEQ ID NO: 4138115 - DNA, 24 bp, Homo sapiens
ctctccactaccccacaccagcct

SEQ ID NO: 4138116 - DNA, 11 bp, Homo sapiens
ctctccactgc

SEQ ID NO: 4138117 - DNA, 16 bp, Homo sapiens
ctctccactgccttcg

SEQ ID NO: 4138118 - DNA, 20 bp, Homo sapiens
ctctccagatgtttccagac

SEQ ID NO: 4138119 - DNA, 21 bp, Homo sapiens
ctctccaggaaggtagcccag

SEQ ID NO: 4138120 - DNA, 14 bp, Homo sapiens
ctctccagggtgct

SEQ ID NO: 4138121 - DNA, 15 bp, Homo sapiens
ctctccagggtgctt

SEQ ID NO: 4138122 - DNA, 20 bp, Homo sapiens
ctctccagtttgcacctgtc

SEQ ID NO: 4138123 - DNA, 22 bp, Homo sapiens
ctctccagtttgcacctgtccc

SEQ ID NO: 4138124 - DNA, 11 bp, Homo sapiens
ctctccatatc

SEQ ID NO: 4138125 - DNA, 13 bp, Homo sapiens
ctctccatctcta

SEQ ID NO: 4138126 - DNA, 13 bp, Homo sapiens
ctctcccaaaaaa

SEQ ID NO: 4138127 - DNA, 13 bp, Homo sapiens
ctctcccagtgaa

SEQ ID NO: 4138128 - DNA, 16 bp, Homo sapiens
ctctcccatttcagga

SEQ ID NO: 4138129 - DNA, 13 bp, Homo sapiens
ctctccccacact

SEQ ID NO: 4138130 - DNA, 15 bp, Homo sapiens
ctctccccacactaa

SEQ ID NO: 4138131 - DNA, 19 bp, Homo sapiens
ctctccccacgagggctgg

SEQ ID NO: 4138132 - DNA, 21 bp, Homo sapiens
ctctccccacgagggctggct

SEQ ID NO: 4138133 - DNA, 16 bp, Homo sapiens
ctctccccagcccaga

SEQ ID NO: 4138134 - DNA, 18 bp, Homo sapiens
ctctccccagcccagaga

SEQ ID NO: 4138135 - DNA, 20 bp, Homo sapiens
ctctccccagcccagagaca

SEQ ID NO: 4138136 - DNA, 18 bp, Homo sapiens
ctctccccctcctccagg

SEQ ID NO: 4138137 - DNA, 22 bp, Homo sapiens
ctctccccgcagtgtttgtgtg

SEQ ID NO: 4138138 - DNA, 13 bp, Homo sapiens
ctctcccctccag

SEQ ID NO: 4138139 - DNA, 14 bp, Homo sapiens
ctctcccctccagc

SEQ ID NO: 4138140 - DNA, 18 bp, Homo sapiens
ctctcctcatctccaagg

SEQ ID NO: 4138141 - DNA, 19 bp, Homo sapiens
ctctcctcatctccaaggc

SEQ ID NO: 4138142 - DNA, 21 bp, Homo sapiens
ctctcctgatagtctttcagt

SEQ ID NO: 4138143 - DNA, 11 bp, Homo sapiens
ctctcctggct

SEQ ID NO: 4138144 - DNA, 22 bp, Homo sapiens
ctctcctggctgggccatcctt

SEQ ID NO: 4138145 - DNA, 20 bp, Homo sapiens
ctctcctgggggtggcaggc

SEQ ID NO: 4138146 - DNA, 16 bp, Homo sapiens
ctctccttttgaggct

SEQ ID NO: 4138147 - DNA, 16 bp, Homo sapiens
ctctcgtaactggttt

SEQ ID NO: 4138148 - DNA, 22 bp, Homo sapiens
ctctctaaatcttccttgtgag

SEQ ID NO: 4138149 - DNA, 13 bp, Homo sapiens
ctctctacagtgc

SEQ ID NO: 4138150 - DNA, 14 bp, Homo sapiens
ctctctattgtcat

SEQ ID NO: 4138151 - DNA, 12 bp, Homo sapiens
ctctctcagagc

SEQ ID NO: 4138152 - DNA, 13 bp, Homo sapiens
ctctctcagagca

SEQ ID NO: 4138153 - DNA, 16 bp, Homo sapiens
ctctctcagcacagcc

SEQ ID NO: 4138154 - DNA, 18 bp, Homo sapiens
ctctctcagcacagcctg

SEQ ID NO: 4138155 - DNA, 12 bp, Homo sapiens
ctctctccagat

SEQ ID NO: 4138156 - DNA, 17 bp, Homo sapiens
ctctctccagatgtttc

SEQ ID NO: 4138157 - DNA, 15 bp, Homo sapiens
ctctctccagggtgc

SEQ ID NO: 4138158 - DNA, 15 bp, Homo sapiens
ctctctcctttgctg

SEQ ID NO: 4138159 - DNA, 15 bp, Homo sapiens
ctctctgatgtccca

SEQ ID NO: 4138160 - DNA, 16 bp, Homo sapiens
ctctctgatgtcccag

SEQ ID NO: 4138161 - DNA, 16 bp, Homo sapiens
ctctctgccccaccca

SEQ ID NO: 4138162 - DNA, 20 bp, Homo sapiens
ctctctgccccacccaagcc

SEQ ID NO: 4138163 - DNA, 13 bp, Homo sapiens
ctctctgctgtac

SEQ ID NO: 4138164 - DNA, 20 bp, Homo sapiens
ctctctggaagccctggaga

SEQ ID NO: 4138165 - DNA, 15 bp, Homo sapiens
ctctctgggcccagg

SEQ ID NO: 4138166 - DNA, 12 bp, Homo sapiens
ctctctgggcct

SEQ ID NO: 4138167 - DNA, 13 bp, Homo sapiens
ctctctgggcctt

SEQ ID NO: 4138168 - DNA, 21 bp, Homo sapiens
ctctctgggctgactgggcca

SEQ ID NO: 4138169 - DNA, 18 bp, Homo sapiens
ctctctggggccctgggc

SEQ ID NO: 4138170 - DNA, 23 bp, Homo sapiens
ctctctggggccctgggcctcag

SEQ ID NO: 4138171 - DNA, 19 bp, Homo sapiens
ctctctgtcccttgctgta

SEQ ID NO: 4138172 - DNA, 14 bp, Homo sapiens
ctctctgtgaatac

SEQ ID NO: 4138173 - DNA, 20 bp, Homo sapiens
ctctcttaaagttggaattt

SEQ ID NO: 4138174 - DNA, 14 bp, Homo sapiens
ctctcttccccttc

SEQ ID NO: 4138175 - DNA, 12 bp, Homo sapiens
ctctcttccctc

SEQ ID NO: 4138176 - DNA, 14 bp, Homo sapiens
ctctcttctgctcc

SEQ ID NO: 4138177 - DNA, 18 bp, Homo sapiens
ctctcttctgctccaccc

SEQ ID NO: 4138178 - DNA, 23 bp, Homo sapiens
ctctcttgtcctcttctgctctt

SEQ ID NO: 4138179 - DNA, 12 bp, Homo sapiens
ctctcttttgtt

SEQ ID NO: 4138180 - DNA, 15 bp, Homo sapiens
ctctgaacttgcctt

SEQ ID NO: 4138181 - DNA, 16 bp, Homo sapiens
ctctgaactttggaga

SEQ ID NO: 4138182 - DNA, 16 bp, Homo sapiens
ctctgaagcctctggg

SEQ ID NO: 4138183 - DNA, 13 bp, Homo sapiens
ctctgaagtcaca

SEQ ID NO: 4138184 - DNA, 14 bp, Homo sapiens
ctctgaattttaaa

SEQ ID NO: 4138185 - DNA, 24 bp, Homo sapiens
ctctgacccttgggcctgggcctc

SEQ ID NO: 4138186 - DNA, 14 bp, Homo sapiens
ctctgacctgcact

SEQ ID NO: 4138187 - DNA, 16 bp, Homo sapiens
ctctgacgtagaaaga

SEQ ID NO: 4138188 - DNA, 21 bp, Homo sapiens
ctctgacgtagaaagatcctt

SEQ ID NO: 4138189 - DNA, 13 bp, Homo sapiens
ctctgactctgag

SEQ ID NO: 4138190 - DNA, 14 bp, Homo sapiens
ctctgactctgagt

SEQ ID NO: 4138191 - DNA, 20 bp, Homo sapiens
ctctgacttaagcaaaagaa

SEQ ID NO: 4138192 - DNA, 22 bp, Homo sapiens
ctctgacttaagcaaaagaaaa

SEQ ID NO: 4138193 - DNA, 21 bp, Homo sapiens
ctctgagactctttagagcag

SEQ ID NO: 4138194 - DNA, 16 bp, Homo sapiens
ctctgagccacagtgg

SEQ ID NO: 4138195 - DNA, 12 bp, Homo sapiens
ctctgagcccag

SEQ ID NO: 4138196 - DNA, 16 bp, Homo sapiens
ctctgagcccagctgc

SEQ ID NO: 4138197 - DNA, 17 bp, Homo sapiens
ctctgagcccagctgcc

SEQ ID NO: 4138198 - DNA, 21 bp, Homo sapiens
ctctgagcccagctgcctgga

SEQ ID NO: 4138199 - DNA, 14 bp, Homo sapiens
ctctgagctgctca

SEQ ID NO: 4138200 - DNA, 17 bp, Homo sapiens
ctctgagtccactgctc

SEQ ID NO: 4138201 - DNA, 19 bp, Homo sapiens
ctctgagtccactgctcca

SEQ ID NO: 4138202 - DNA, 15 bp, Homo sapiens
ctctgagtctggact

SEQ ID NO: 4138203 - DNA, 18 bp, Homo sapiens
ctctgagtctggactttg

SEQ ID NO: 4138204 - DNA, 12 bp, Homo sapiens
ctctgagtgtga

SEQ ID NO: 4138205 - DNA, 13 bp, Homo sapiens
ctctgatcttgtg

SEQ ID NO: 4138206 - DNA, 20 bp, Homo sapiens
ctctgatcttgtgctcagca

SEQ ID NO: 4138207 - DNA, 22 bp, Homo sapiens
ctctgatggttcttcacctcct

SEQ ID NO: 4138208 - DNA, 14 bp, Homo sapiens
ctctgatttgcaaa

SEQ ID NO: 4138209 - DNA, 16 bp, Homo sapiens
ctctgcaattcccctc

SEQ ID NO: 4138210 - DNA, 20 bp, Homo sapiens
ctctgcaattcccctctgct

SEQ ID NO: 4138211 - DNA, 10 bp, Homo sapiens
ctctgcacag

SEQ ID NO: 4138212 - DNA, 16 bp, Homo sapiens
ctctgcactactgaca

SEQ ID NO: 4138213 - DNA, 18 bp, Homo sapiens
ctctgcactactgacatg

SEQ ID NO: 4138214 - DNA, 20 bp, Homo sapiens
ctctgcactactgacatgtg

SEQ ID NO: 4138215 - DNA, 22 bp, Homo sapiens
ctctgcactactgacatgtggg

SEQ ID NO: 4138216 - DNA, 17 bp, Homo sapiens
ctctgcatcccagcacc

SEQ ID NO: 4138217 - DNA, 14 bp, Homo sapiens
ctctgcattctagt

SEQ ID NO: 4138218 - DNA, 12 bp, Homo sapiens
ctctgccaccca

SEQ ID NO: 4138219 - DNA, 22 bp, Homo sapiens
ctctgccagaagatcccctcag

SEQ ID NO: 4138220 - DNA, 15 bp, Homo sapiens
ctctgccagtgacag

SEQ ID NO: 4138221 - DNA, 14 bp, Homo sapiens
ctctgcccaaccct

SEQ ID NO: 4138222 - DNA, 14 bp, Homo sapiens
ctctgcccagcttt

SEQ ID NO: 4138223 - DNA, 22 bp, Homo sapiens
ctctgcccagcttttcattgct

SEQ ID NO: 4138224 - DNA, 19 bp, Homo sapiens
ctctgccccacccaagccc

SEQ ID NO: 4138225 - DNA, 22 bp, Homo sapiens
ctctgccccacccaagcccaaa

SEQ ID NO: 4138226 - DNA, 12 bp, Homo sapiens
ctctgccccctg

SEQ ID NO: 4138227 - DNA, 18 bp, Homo sapiens
ctctgcccctcccaaccc

SEQ ID NO: 4138228 - DNA, 22 bp, Homo sapiens
ctctgcccctcccaacccagcc

SEQ ID NO: 4138229 - DNA, 22 bp, Homo sapiens
ctctgccctcattactgggcct

SEQ ID NO: 4138230 - DNA, 11 bp, Homo sapiens
ctctgccctgg

SEQ ID NO: 4138231 - DNA, 16 bp, Homo sapiens
ctctgccctggattgg

SEQ ID NO: 4138232 - DNA, 14 bp, Homo sapiens
ctctgccgctacct

SEQ ID NO: 4138233 - DNA, 15 bp, Homo sapiens
ctctgccgctacctc

SEQ ID NO: 4138234 - DNA, 21 bp, Homo sapiens
ctctgccggtcgggcagccag

SEQ ID NO: 4138235 - DNA, 15 bp, Homo sapiens
ctctgcctacagaac

SEQ ID NO: 4138236 - DNA, 17 bp, Homo sapiens
ctctgcctacagccagg

SEQ ID NO: 4138237 - DNA, 12 bp, Homo sapiens
ctctgcctcaga

SEQ ID NO: 4138238 - DNA, 21 bp, Homo sapiens
ctctgcctccaccctcctcct

SEQ ID NO: 4138239 - DNA, 13 bp, Homo sapiens
ctctgcctgcccc

SEQ ID NO: 4138240 - DNA, 21 bp, Homo sapiens
ctctgcctggtggtcagatgc

SEQ ID NO: 4138241 - DNA, 14 bp, Homo sapiens
ctctgcggggcagg

SEQ ID NO: 4138242 - DNA, 18 bp, Homo sapiens
ctctgcggggcagggcct

SEQ ID NO: 4138243 - DNA, 19 bp, Homo sapiens
ctctgcggggcagggcctt

SEQ ID NO: 4138244 - DNA, 16 bp, Homo sapiens
ctctgctaatcatgtg

SEQ ID NO: 4138245 - DNA, 21 bp, Homo sapiens
ctctgctcaccgcccatcagg

SEQ ID NO: 4138246 - DNA, 12 bp, Homo sapiens
ctctgctccacc

SEQ ID NO: 4138247 - DNA, 18 bp, Homo sapiens
ctctgctccaccacatcc

SEQ ID NO: 4138248 - DNA, 12 bp, Homo sapiens
ctctgctccccc

SEQ ID NO: 4138249 - DNA, 14 bp, Homo sapiens
ctctgctcctggag

SEQ ID NO: 4138250 - DNA, 22 bp, Homo sapiens
ctctgctcctggagcctttgaa

SEQ ID NO: 4138251 - DNA, 20 bp, Homo sapiens
ctctgctcgccctcctttct

SEQ ID NO: 4138252 - DNA, 21 bp, Homo sapiens
ctctgctcgccctcctttctg

SEQ ID NO: 4138253 - DNA, 14 bp, Homo sapiens
ctctgctgaaggtt

SEQ ID NO: 4138254 - DNA, 21 bp, Homo sapiens
ctctgctgatgacccccccag

SEQ ID NO: 4138255 - DNA, 23 bp, Homo sapiens
ctctgctgtacatatttgagact

SEQ ID NO: 4138256 - DNA, 22 bp, Homo sapiens
ctctgctgtgggcacaggtcag

SEQ ID NO: 4138257 - DNA, 16 bp, Homo sapiens
ctctgcttcagtccac

SEQ ID NO: 4138258 - DNA, 16 bp, Homo sapiens
ctctgcttctcatccc

SEQ ID NO: 4138259 - DNA, 19 bp, Homo sapiens
ctctggaataaagttgcag

SEQ ID NO: 4138260 - DNA, 13 bp, Homo sapiens
ctctggaatgcac

SEQ ID NO: 4138261 - DNA, 17 bp, Homo sapiens
ctctggaatgtttttcc

SEQ ID NO: 4138262 - DNA, 16 bp, Homo sapiens
ctctggacaaagcgtt

SEQ ID NO: 4138263 - DNA, 21 bp, Homo sapiens
ctctggacagcagaagcctcc

SEQ ID NO: 4138264 - DNA, 22 bp, Homo sapiens
ctctggacagcagaagcctcca

SEQ ID NO: 4138265 - DNA, 17 bp, Homo sapiens
ctctggacagccagtga

SEQ ID NO: 4138266 - DNA, 15 bp, Homo sapiens
ctctggactggctag

SEQ ID NO: 4138267 - DNA, 20 bp, Homo sapiens
ctctggaggggtgtggctcc

SEQ ID NO: 4138268 - DNA, 21 bp, Homo sapiens
ctctggatgatggattccaca

SEQ ID NO: 4138269 - DNA, 18 bp, Homo sapiens
ctctggcattagaattat

SEQ ID NO: 4138270 - DNA, 23 bp, Homo sapiens
ctctggcattagaattatttaaa

SEQ ID NO: 4138271 - DNA, 20 bp, Homo sapiens
ctctggccctggcccttact

SEQ ID NO: 4138272 - DNA, 18 bp, Homo sapiens
ctctggcctcagccgact

SEQ ID NO: 4138273 - DNA, 16 bp, Homo sapiens
ctctggctagaggcca

SEQ ID NO: 4138274 - DNA, 20 bp, Homo sapiens
ctctggctagaggccagccc

SEQ ID NO: 4138275 - DNA, 12 bp, Homo sapiens
ctctggcttcca

SEQ ID NO: 4138276 - DNA, 14 bp, Homo sapiens
ctctggcttccagg

SEQ ID NO: 4138277 - DNA, 19 bp, Homo sapiens
ctctggcttgacagcatga

SEQ ID NO: 4138278 - DNA, 17 bp, Homo sapiens
ctctgggcacgcctgct

SEQ ID NO: 4138279 - DNA, 23 bp, Homo sapiens
ctctgggccatgccaggccagag

SEQ ID NO: 4138280 - DNA, 21 bp, Homo sapiens
ctctgggcctttgtttccttg

SEQ ID NO: 4138281 - DNA, 11 bp, Homo sapiens
ctctgggctgt

SEQ ID NO: 4138282 - DNA, 18 bp, Homo sapiens
ctctggggacagcttcct

SEQ ID NO: 4138283 - DNA, 16 bp, Homo sapiens
ctctggggccctgggc

SEQ ID NO: 4138284 - DNA, 17 bp, Homo sapiens
ctctggggccctgggcc

SEQ ID NO: 4138285 - DNA, 18 bp, Homo sapiens
ctctggggccctgggcct

SEQ ID NO: 4138286 - DNA, 22 bp, Homo sapiens
ctctggtccggacactcctaga

SEQ ID NO: 4138287 - DNA, 23 bp, Homo sapiens
ctctggtgtgtggtgaggggctt

SEQ ID NO: 4138288 - DNA, 18 bp, Homo sapiens
ctctggttgtttctgttc

SEQ ID NO: 4138289 - DNA, 14 bp, Homo sapiens
ctctgtagtttatg

SEQ ID NO: 4138290 - DNA, 20 bp, Homo sapiens
ctctgtatagaaatctaaaa

SEQ ID NO: 4138291 - DNA, 19 bp, Homo sapiens
ctctgtcacccttgtcctt

SEQ ID NO: 4138292 - DNA, 14 bp, Homo sapiens
ctctgtcagccagc

SEQ ID NO: 4138293 - DNA, 20 bp, Homo sapiens
ctctgtcagccagccgccct

SEQ ID NO: 4138294 - DNA, 16 bp, Homo sapiens
ctctgtcagtcacagc

SEQ ID NO: 4138295 - DNA, 19 bp, Homo sapiens
ctctgtcagtcacagccac

SEQ ID NO: 4138296 - DNA, 17 bp, Homo sapiens
ctctgtcccacccctag

SEQ ID NO: 4138297 - DNA, 18 bp, Homo sapiens
ctctgtcccccaggctgg

SEQ ID NO: 4138298 - DNA, 16 bp, Homo sapiens
ctctgtcgagcctggg

SEQ ID NO: 4138299 - DNA, 14 bp, Homo sapiens
ctctgtctcatcct

SEQ ID NO: 4138300 - DNA, 22 bp, Homo sapiens
ctctgtctcatcctcctggaac

SEQ ID NO: 4138301 - DNA, 22 bp, Homo sapiens
ctctgtctgagtaagaaacaga

SEQ ID NO: 4138302 - DNA, 21 bp, Homo sapiens
ctctgtgaacgatttagaaag

SEQ ID NO: 4138303 - DNA, 17 bp, Homo sapiens
ctctgtgaatacaatta

SEQ ID NO: 4138304 - DNA, 19 bp, Homo sapiens
ctctgtgaatacaattaaa

SEQ ID NO: 4138305 - DNA, 15 bp, Homo sapiens
ctctgtgctgtggaa

SEQ ID NO: 4138306 - DNA, 14 bp, Homo sapiens
ctctgtgtccttcc

SEQ ID NO: 4138307 - DNA, 13 bp, Homo sapiens
ctctgtgtttaaa

SEQ ID NO: 4138308 - DNA, 19 bp, Homo sapiens
ctctgttaaggttgaactt

SEQ ID NO: 4138309 - DNA, 16 bp, Homo sapiens
ctctgttcccccaccc

SEQ ID NO: 4138310 - DNA, 21 bp, Homo sapiens
ctctgttcccccaccctccat

SEQ ID NO: 4138311 - DNA, 21 bp, Homo sapiens
ctctgttgtttggttcaggga

SEQ ID NO: 4138312 - DNA, 15 bp, Homo sapiens
ctcttaagcagcatg

SEQ ID NO: 4138313 - DNA, 13 bp, Homo sapiens
ctcttaatctgtg

SEQ ID NO: 4138314 - DNA, 14 bp, Homo sapiens
ctcttactgctaac

SEQ ID NO: 4138315 - DNA, 15 bp, Homo sapiens
ctcttagaacattgt

SEQ ID NO: 4138316 - DNA, 18 bp, Homo sapiens
ctcttagcagcttccaga

SEQ ID NO: 4138317 - DNA, 12 bp, Homo sapiens
ctcttaggtcag

SEQ ID NO: 4138318 - DNA, 14 bp, Homo sapiens
ctcttagtcccaag

SEQ ID NO: 4138319 - DNA, 16 bp, Homo sapiens
ctcttagtcccaagct

SEQ ID NO: 4138320 - DNA, 21 bp, Homo sapiens
ctcttatagaatatttattac

SEQ ID NO: 4138321 - DNA, 22 bp, Homo sapiens
ctcttatagaatatttattacc

SEQ ID NO: 4138322 - DNA, 22 bp, Homo sapiens
ctcttatatctaaatctgtcca

SEQ ID NO: 4138323 - DNA, 11 bp, Homo sapiens
ctcttatctca

SEQ ID NO: 4138324 - DNA, 16 bp, Homo sapiens
ctcttatgtgtgcctt

SEQ ID NO: 4138325 - DNA, 15 bp, Homo sapiens
ctcttattttacaat

SEQ ID NO: 4138326 - DNA, 16 bp, Homo sapiens
ctcttcaccccccact

SEQ ID NO: 4138327 - DNA, 14 bp, Homo sapiens
ctcttcaggcctcc

SEQ ID NO: 4138328 - DNA, 13 bp, Homo sapiens
ctcttccaggcag

SEQ ID NO: 4138329 - DNA, 15 bp, Homo sapiens
ctcttccagtttctg

SEQ ID NO: 4138330 - DNA, 16 bp, Homo sapiens
ctcttccccagagagg

SEQ ID NO: 4138331 - DNA, 19 bp, Homo sapiens
ctcttccccagagaggcac

SEQ ID NO: 4138332 - DNA, 15 bp, Homo sapiens
ctcttccccttagaa

SEQ ID NO: 4138333 - DNA, 13 bp, Homo sapiens
ctcttccccttcc

SEQ ID NO: 4138334 - DNA, 15 bp, Homo sapiens
ctcttccccttcctg

SEQ ID NO: 4138335 - DNA, 21 bp, Homo sapiens
ctcttccccttcctgtttcag

SEQ ID NO: 4138336 - DNA, 22 bp, Homo sapiens
ctcttccctgcgcctgtgatgc

SEQ ID NO: 4138337 - DNA, 21 bp, Homo sapiens
ctcttccctggtaagaaaaag

SEQ ID NO: 4138338 - DNA, 17 bp, Homo sapiens
ctcttccctttccccag

SEQ ID NO: 4138339 - DNA, 14 bp, Homo sapiens
ctcttcctgcaagg

SEQ ID NO: 4138340 - DNA, 13 bp, Homo sapiens
ctcttcgcctttc

SEQ ID NO: 4138341 - DNA, 21 bp, Homo sapiens
ctcttcgcctttcccaccctc

SEQ ID NO: 4138342 - DNA, 22 bp, Homo sapiens
ctcttcgcctttcccaccctcc

SEQ ID NO: 4138343 - DNA, 15 bp, Homo sapiens
ctcttctccactgga

SEQ ID NO: 4138344 - DNA, 17 bp, Homo sapiens
ctcttctccactggatg

SEQ ID NO: 4138345 - DNA, 16 bp, Homo sapiens
ctcttctccccttcca

SEQ ID NO: 4138346 - DNA, 17 bp, Homo sapiens
ctcttctccccttccat

SEQ ID NO: 4138347 - DNA, 15 bp, Homo sapiens
ctcttctcctttcac

SEQ ID NO: 4138348 - DNA, 16 bp, Homo sapiens
ctcttctcctttcaca

SEQ ID NO: 4138349 - DNA, 13 bp, Homo sapiens
ctcttctcggctc

SEQ ID NO: 4138350 - DNA, 14 bp, Homo sapiens
ctcttctcggctca

SEQ ID NO: 4138351 - DNA, 15 bp, Homo sapiens
ctcttctcggctcag

SEQ ID NO: 4138352 - DNA, 18 bp, Homo sapiens
ctcttctcggctcaggct

SEQ ID NO: 4138353 - DNA, 17 bp, Homo sapiens
ctcttctctctgctctg

SEQ ID NO: 4138354 - DNA, 19 bp, Homo sapiens
ctcttctctctgctctgac

SEQ ID NO: 4138355 - DNA, 14 bp, Homo sapiens
ctcttctgcaagcc

SEQ ID NO: 4138356 - DNA, 19 bp, Homo sapiens
ctcttctgcaagcctcatg

SEQ ID NO: 4138357 - DNA, 14 bp, Homo sapiens
ctcttctgctccac

SEQ ID NO: 4138358 - DNA, 15 bp, Homo sapiens
ctcttctgctctttt

SEQ ID NO: 4138359 - DNA, 20 bp, Homo sapiens
ctcttctgcttaggagagac

SEQ ID NO: 4138360 - DNA, 21 bp, Homo sapiens
ctcttctggggcaggctgggc

SEQ ID NO: 4138361 - DNA, 13 bp, Homo sapiens
ctcttctggtgtt

SEQ ID NO: 4138362 - DNA, 12 bp, Homo sapiens
ctcttctgtgtt

SEQ ID NO: 4138363 - DNA, 17 bp, Homo sapiens
ctcttctttaagccata

SEQ ID NO: 4138364 - DNA, 18 bp, Homo sapiens
ctcttctttaagccatag

SEQ ID NO: 4138365 - DNA, 14 bp, Homo sapiens
ctcttgaggccagg

SEQ ID NO: 4138366 - DNA, 18 bp, Homo sapiens
ctcttgatacccccctct

SEQ ID NO: 4138367 - DNA, 21 bp, Homo sapiens
ctcttgatggtggactaagca

SEQ ID NO: 4138368 - DNA, 16 bp, Homo sapiens
ctcttgattcctggtt

SEQ ID NO: 4138369 - DNA, 21 bp, Homo sapiens
ctcttgattcctggtttgact

SEQ ID NO: 4138370 - DNA, 16 bp, Homo sapiens
ctcttgcagttgctct

SEQ ID NO: 4138371 - DNA, 22 bp, Homo sapiens
ctcttgcgtgtcaatttccctc

SEQ ID NO: 4138372 - DNA, 12 bp, Homo sapiens
ctcttgctcaaa

SEQ ID NO: 4138373 - DNA, 20 bp, Homo sapiens
ctcttgctcaaaaatctgtt

SEQ ID NO: 4138374 - DNA, 12 bp, Homo sapiens
ctcttgctgtct

SEQ ID NO: 4138375 - DNA, 18 bp, Homo sapiens
ctcttgctgtctctgctc

SEQ ID NO: 4138376 - DNA, 19 bp, Homo sapiens
ctcttgctgtctctgctcg

SEQ ID NO: 4138377 - DNA, 13 bp, Homo sapiens
ctcttgcttgtca

SEQ ID NO: 4138378 - DNA, 14 bp, Homo sapiens
ctcttggctgaccc

SEQ ID NO: 4138379 - DNA, 22 bp, Homo sapiens
ctcttggctgacccctctggtg

SEQ ID NO: 4138380 - DNA, 21 bp, Homo sapiens
ctcttgggaactgaactcact

SEQ ID NO: 4138381 - DNA, 22 bp, Homo sapiens
ctcttggtgtgattgcacagaa

SEQ ID NO: 4138382 - DNA, 20 bp, Homo sapiens
ctcttggttcgatacctgga

SEQ ID NO: 4138383 - DNA, 13 bp, Homo sapiens
ctcttgtaagtca

SEQ ID NO: 4138384 - DNA, 14 bp, Homo sapiens
ctcttgtcccacgt

SEQ ID NO: 4138385 - DNA, 18 bp, Homo sapiens
ctcttgtccctttcccta

SEQ ID NO: 4138386 - DNA, 14 bp, Homo sapiens
ctcttgtcctcttc

SEQ ID NO: 4138387 - DNA, 15 bp, Homo sapiens
ctcttgtcctcttct

SEQ ID NO: 4138388 - DNA, 24 bp, Homo sapiens
ctcttgtcctcttctgctcttttc

SEQ ID NO: 4138389 - DNA, 12 bp, Homo sapiens
ctcttgtgattt

SEQ ID NO: 4138390 - DNA, 14 bp, Homo sapiens
ctcttgtgatttct

SEQ ID NO: 4138391 - DNA, 23 bp, Homo sapiens
ctcttgtggtgcattgaaagaag

SEQ ID NO: 4138392 - DNA, 19 bp, Homo sapiens
ctcttgtttttattaattt

SEQ ID NO: 4138393 - DNA, 19 bp, Homo sapiens
ctctttaaaaggaaagaaa

SEQ ID NO: 4138394 - DNA, 23 bp, Homo sapiens
ctctttaaaaggaaagaaaacat

SEQ ID NO: 4138395 - DNA, 22 bp, Homo sapiens
ctctttaagggcatgccttgtg

SEQ ID NO: 4138396 - DNA, 21 bp, Homo sapiens
ctctttagagcagctttggga

SEQ ID NO: 4138397 - DNA, 15 bp, Homo sapiens
ctctttcacattgtt

SEQ ID NO: 4138398 - DNA, 19 bp, Homo sapiens
ctctttcccacccagcctg

SEQ ID NO: 4138399 - DNA, 16 bp, Homo sapiens
ctctttccctaggaaa

SEQ ID NO: 4138400 - DNA, 20 bp, Homo sapiens
ctctttccctgcgagacgca

SEQ ID NO: 4138401 - DNA, 22 bp, Homo sapiens
ctctttcctgttgttgttaatg

SEQ ID NO: 4138402 - DNA, 15 bp, Homo sapiens
ctctttcgtcaccct

SEQ ID NO: 4138403 - DNA, 21 bp, Homo sapiens
ctctttctacatgactgggcc

SEQ ID NO: 4138404 - DNA, 22 bp, Homo sapiens
ctctttctacatgactgggcct

SEQ ID NO: 4138405 - DNA, 13 bp, Homo sapiens
ctctttctctctt

SEQ ID NO: 4138406 - DNA, 17 bp, Homo sapiens
ctctttctctcttccct

SEQ ID NO: 4138407 - DNA, 12 bp, Homo sapiens
ctctttctctgc

SEQ ID NO: 4138408 - DNA, 11 bp, Homo sapiens
ctctttctgta

SEQ ID NO: 4138409 - DNA, 14 bp, Homo sapiens
ctctttctgtatat

SEQ ID NO: 4138410 - DNA, 15 bp, Homo sapiens
ctctttctgtatata

SEQ ID NO: 4138411 - DNA, 22 bp, Homo sapiens
ctctttgaaatagtctgtgtga

SEQ ID NO: 4138412 - DNA, 17 bp, Homo sapiens
ctctttgctgcagagaa

SEQ ID NO: 4138413 - DNA, 12 bp, Homo sapiens
ctctttgtaaga

SEQ ID NO: 4138414 - DNA, 18 bp, Homo sapiens
ctctttgttatttgaaaa

SEQ ID NO: 4138415 - DNA, 15 bp, Homo sapiens
ctcttttatatttgt

SEQ ID NO: 4138416 - DNA, 20 bp, Homo sapiens
ctcttttcccctttcctgtc

SEQ ID NO: 4138417 - DNA, 19 bp, Homo sapiens
ctcttttcctggtgctctt

SEQ ID NO: 4138418 - DNA, 22 bp, Homo sapiens
ctcttttcctggtgctcttttt

SEQ ID NO: 4138419 - DNA, 14 bp, Homo sapiens
ctcttttctctgtg

SEQ ID NO: 4138420 - DNA, 15 bp, Homo sapiens
ctcttttctgcatca

SEQ ID NO: 4138421 - DNA, 12 bp, Homo sapiens
ctcttttctttc

SEQ ID NO: 4138422 - DNA, 15 bp, Homo sapiens
ctcttttgtaaatta

SEQ ID NO: 4138423 - DNA, 14 bp, Homo sapiens
ctctttttcctcct

SEQ ID NO: 4138424 - DNA, 15 bp, Homo sapiens
ctctttttcctcctg

SEQ ID NO: 4138425 - DNA, 17 bp, Homo sapiens
ctcttttttgtttgttt

SEQ ID NO: 4138426 - DNA, 19 bp, Homo sapiens
ctgaaaaatctaagtgata

SEQ ID NO: 4138427 - DNA, 22 bp, Homo sapiens
ctgaaaaatctaagtgatataa

SEQ ID NO: 4138428 - DNA, 18 bp, Homo sapiens
ctgaaaagactcagtgtt

SEQ ID NO: 4138429 - DNA, 19 bp, Homo sapiens
ctgaaaagactcagtgttc

SEQ ID NO: 4138430 - DNA, 22 bp, Homo sapiens
ctgaaaatataaccagccattg

SEQ ID NO: 4138431 - DNA, 16 bp, Homo sapiens
ctgaaaatgtatgtgt

SEQ ID NO: 4138432 - DNA, 17 bp, Homo sapiens
ctgaaaatgtcacattc

SEQ ID NO: 4138433 - DNA, 13 bp, Homo sapiens
ctgaaaccatttt

SEQ ID NO: 4138434 - DNA, 15 bp, Homo sapiens
ctgaaaccattttcc

SEQ ID NO: 4138435 - DNA, 15 bp, Homo sapiens
ctgaaagaaacagtt

SEQ ID NO: 4138436 - DNA, 16 bp, Homo sapiens
ctgaaagaaacagtta

SEQ ID NO: 4138437 - DNA, 20 bp, Homo sapiens
ctgaaagaaacagttaactt

SEQ ID NO: 4138438 - DNA, 19 bp, Homo sapiens
ctgaaagaacatggacttg

SEQ ID NO: 4138439 - DNA, 22 bp, Homo sapiens
ctgaaagaggctgaggcctgga

SEQ ID NO: 4138440 - DNA, 20 bp, Homo sapiens
ctgaaagccttagggaagct

SEQ ID NO: 4138441 - DNA, 16 bp, Homo sapiens
ctgaaagtagggggct

SEQ ID NO: 4138442 - DNA, 16 bp, Homo sapiens
ctgaaagttttgtaaa

SEQ ID NO: 4138443 - DNA, 22 bp, Homo sapiens
ctgaaagttttgtaaaagaaat

SEQ ID NO: 4138444 - DNA, 13 bp, Homo sapiens
ctgaaatgtttgg

SEQ ID NO: 4138445 - DNA, 20 bp, Homo sapiens
ctgaaattcacagaagccta

SEQ ID NO: 4138446 - DNA, 22 bp, Homo sapiens
ctgaaattcacagaagcctagg

SEQ ID NO: 4138447 - DNA, 14 bp, Homo sapiens
ctgaacacacacac

SEQ ID NO: 4138448 - DNA, 19 bp, Homo sapiens
ctgaacacttttgttgtaa

SEQ ID NO: 4138449 - DNA, 12 bp, Homo sapiens
ctgaacagtgga

SEQ ID NO: 4138450 - DNA, 18 bp, Homo sapiens
ctgaactcaagctgcgtt

SEQ ID NO: 4138451 - DNA, 13 bp, Homo sapiens
ctgaactctcaaa

SEQ ID NO: 4138452 - DNA, 18 bp, Homo sapiens
ctgaactctcaaaagtct

SEQ ID NO: 4138453 - DNA, 13 bp, Homo sapiens
ctgaactgaggag

SEQ ID NO: 4138454 - DNA, 16 bp, Homo sapiens
ctgaacttcagagcat

SEQ ID NO: 4138455 - DNA, 17 bp, Homo sapiens
ctgaacttgcattgtga

SEQ ID NO: 4138456 - DNA, 21 bp, Homo sapiens
ctgaagaaaaaatcagaacta

SEQ ID NO: 4138457 - DNA, 20 bp, Homo sapiens
ctgaagaattaagatacaaa

SEQ ID NO: 4138458 - DNA, 19 bp, Homo sapiens
ctgaagacctaaagtgctt

SEQ ID NO: 4138459 - DNA, 15 bp, Homo sapiens
ctgaagatgcagctc

SEQ ID NO: 4138460 - DNA, 16 bp, Homo sapiens
ctgaagatgcagctca

SEQ ID NO: 4138461 - DNA, 16 bp, Homo sapiens
ctgaagcaacatttta

SEQ ID NO: 4138462 - DNA, 13 bp, Homo sapiens
ctgaagcctctgg

SEQ ID NO: 4138463 - DNA, 14 bp, Homo sapiens
ctgaagcttgactc

SEQ ID NO: 4138464 - DNA, 14 bp, Homo sapiens
ctgaaggaaaaaca

SEQ ID NO: 4138465 - DNA, 21 bp, Homo sapiens
ctgaaggaaaaacacaagcaa

SEQ ID NO: 4138466 - DNA, 22 bp, Homo sapiens
ctgaaggaaaaacacaagcaaa

SEQ ID NO: 4138467 - DNA, 14 bp, Homo sapiens
ctgaaggacctgag

SEQ ID NO: 4138468 - DNA, 17 bp, Homo sapiens
ctgaaggacctgagctg

SEQ ID NO: 4138469 - DNA, 23 bp, Homo sapiens
ctgaaggacctgagctggccagg

SEQ ID NO: 4138470 - DNA, 15 bp, Homo sapiens
ctgaaggggccatga

SEQ ID NO: 4138471 - DNA, 23 bp, Homo sapiens
ctgaaggggccatgatggcaaca

SEQ ID NO: 4138472 - DNA, 16 bp, Homo sapiens
ctgaagtcactgcaca

SEQ ID NO: 4138473 - DNA, 14 bp, Homo sapiens
ctgaagtcagttct

SEQ ID NO: 4138474 - DNA, 16 bp, Homo sapiens
ctgaagtcttttctgt

SEQ ID NO: 4138475 - DNA, 16 bp, Homo sapiens
ctgaagttaacagaga

SEQ ID NO: 4138476 - DNA, 17 bp, Homo sapiens
ctgaagtttttttgctg

SEQ ID NO: 4138477 - DNA, 20 bp, Homo sapiens
ctgaataacatttgtgtggt

SEQ ID NO: 4138478 - DNA, 15 bp, Homo sapiens
ctgaatagaaatggg

SEQ ID NO: 4138479 - DNA, 16 bp, Homo sapiens
ctgaatagaaatggga

SEQ ID NO: 4138480 - DNA, 21 bp, Homo sapiens
ctgaatataaaaacatttgta

SEQ ID NO: 4138481 - DNA, 16 bp, Homo sapiens
ctgaatataaagctta

SEQ ID NO: 4138482 - DNA, 20 bp, Homo sapiens
ctgaatatttatatttcact

SEQ ID NO: 4138483 - DNA, 14 bp, Homo sapiens
ctgaatattttgga

SEQ ID NO: 4138484 - DNA, 15 bp, Homo sapiens
ctgaatattttggaa

SEQ ID NO: 4138485 - DNA, 20 bp, Homo sapiens
ctgaatcatgagcctgctgg

SEQ ID NO: 4138486 - DNA, 15 bp, Homo sapiens
ctgaatctgtgcctg

SEQ ID NO: 4138487 - DNA, 23 bp, Homo sapiens
ctgaatctgtgcctgcactgaga

SEQ ID NO: 4138488 - DNA, 23 bp, Homo sapiens
ctgaatgcagggaatgcaatcct

SEQ ID NO: 4138489 - DNA, 23 bp, Homo sapiens
ctgaatgcctcaatgtgaccagg

SEQ ID NO: 4138490 - DNA, 15 bp, Homo sapiens
ctgaatgcctcctgt

SEQ ID NO: 4138491 - DNA, 17 bp, Homo sapiens
ctgaatgcctcctgtgg

SEQ ID NO: 4138492 - DNA, 15 bp, Homo sapiens
ctgaatggtccaggg

SEQ ID NO: 4138493 - DNA, 16 bp, Homo sapiens
ctgaatggtccagggt

SEQ ID NO: 4138494 - DNA, 18 bp, Homo sapiens
ctgaatggtccagggttg

SEQ ID NO: 4138495 - DNA, 19 bp, Homo sapiens
ctgaatggttttcaaaata

SEQ ID NO: 4138496 - DNA, 20 bp, Homo sapiens
ctgaatgtcaaacagtgcca

SEQ ID NO: 4138497 - DNA, 23 bp, Homo sapiens
ctgaatgtggtttcaatctaatt

SEQ ID NO: 4138498 - DNA, 13 bp, Homo sapiens
ctgaatgttctga

SEQ ID NO: 4138499 - DNA, 12 bp, Homo sapiens
ctgaatgtttta

SEQ ID NO: 4138500 - DNA, 14 bp, Homo sapiens
ctgaatttttttgt

SEQ ID NO: 4138501 - DNA, 15 bp, Homo sapiens
ctgaatttttttgta

SEQ ID NO: 4138502 - DNA, 16 bp, Homo sapiens
ctgaatttttttgtaa

SEQ ID NO: 4138503 - DNA, 17 bp, Homo sapiens
ctgaatttttttgtaat

SEQ ID NO: 4138504 - DNA, 18 bp, Homo sapiens
ctgacaaaaagtttccat

SEQ ID NO: 4138505 - DNA, 17 bp, Homo sapiens
ctgacaatactgtatgt

SEQ ID NO: 4138506 - DNA, 13 bp, Homo sapiens
ctgacaatcaact

SEQ ID NO: 4138507 - DNA, 21 bp, Homo sapiens
ctgacaatcaactctaatagt

SEQ ID NO: 4138508 - DNA, 20 bp, Homo sapiens
ctgacacactaaccaagctg

SEQ ID NO: 4138509 - DNA, 13 bp, Homo sapiens
ctgacaccccctc

SEQ ID NO: 4138510 - DNA, 15 bp, Homo sapiens
ctgacaccccctccc

SEQ ID NO: 4138511 - DNA, 16 bp, Homo sapiens
ctgacactgagcccca

SEQ ID NO: 4138512 - DNA, 14 bp, Homo sapiens
ctgacagaaagcag

SEQ ID NO: 4138513 - DNA, 14 bp, Homo sapiens
ctgacagaaggact

SEQ ID NO: 4138514 - DNA, 18 bp, Homo sapiens
ctgacagaatctctgaat

SEQ ID NO: 4138515 - DNA, 17 bp, Homo sapiens
ctgacagagctctgggt

SEQ ID NO: 4138516 - DNA, 17 bp, Homo sapiens
ctgacagcctcccaccc

SEQ ID NO: 4138517 - DNA, 15 bp, Homo sapiens
ctgacagtttttctg

SEQ ID NO: 4138518 - DNA, 16 bp, Homo sapiens
ctgacagtttttctgt

SEQ ID NO: 4138519 - DNA, 16 bp, Homo sapiens
ctgacatattatgcct

SEQ ID NO: 4138520 - DNA, 22 bp, Homo sapiens
ctgacatattatgcctgaatga

SEQ ID NO: 4138521 - DNA, 14 bp, Homo sapiens
ctgacatcacagca

SEQ ID NO: 4138522 - DNA, 15 bp, Homo sapiens
ctgacatgcattgtt

SEQ ID NO: 4138523 - DNA, 19 bp, Homo sapiens
ctgacatgtggggccaggt

SEQ ID NO: 4138524 - DNA, 18 bp, Homo sapiens
ctgacattaacagttttc

SEQ ID NO: 4138525 - DNA, 20 bp, Homo sapiens
ctgacattaacagttttcca

SEQ ID NO: 4138526 - DNA, 16 bp, Homo sapiens
ctgacattcacctgcc

SEQ ID NO: 4138527 - DNA, 17 bp, Homo sapiens
ctgacattcacctgccc

SEQ ID NO: 4138528 - DNA, 21 bp, Homo sapiens
ctgacattttctttcatgggc

SEQ ID NO: 4138529 - DNA, 15 bp, Homo sapiens
ctgaccaaacagcca

SEQ ID NO: 4138530 - DNA, 14 bp, Homo sapiens
ctgaccaattgtgc

SEQ ID NO: 4138531 - DNA, 16 bp, Homo sapiens
ctgaccaattgtgctg

SEQ ID NO: 4138532 - DNA, 18 bp, Homo sapiens
ctgaccaattgtgctgcc

SEQ ID NO: 4138533 - DNA, 14 bp, Homo sapiens
ctgaccacagcaca

SEQ ID NO: 4138534 - DNA, 18 bp, Homo sapiens
ctgaccacagcacagcca

SEQ ID NO: 4138535 - DNA, 22 bp, Homo sapiens
ctgaccacgctttctagctgtt

SEQ ID NO: 4138536 - DNA, 12 bp, Homo sapiens
ctgaccaggctt

SEQ ID NO: 4138537 - DNA, 16 bp, Homo sapiens
ctgaccatccactcta

SEQ ID NO: 4138538 - DNA, 10 bp, Homo sapiens
ctgacccagt

SEQ ID NO: 4138539 - DNA, 21 bp, Homo sapiens
ctgacccagtgcccccactga

SEQ ID NO: 4138540 - DNA, 23 bp, Homo sapiens
ctgacccagtgcccccactgacc

SEQ ID NO: 4138541 - DNA, 20 bp, Homo sapiens
ctgaccccaaacaccttcca

SEQ ID NO: 4138542 - DNA, 23 bp, Homo sapiens
ctgaccccaaagagcctggagaa

SEQ ID NO: 4138543 - DNA, 21 bp, Homo sapiens
ctgacccccttcctgtcccca

SEQ ID NO: 4138544 - DNA, 20 bp, Homo sapiens
ctgaccccgagaagtgctct

SEQ ID NO: 4138545 - DNA, 14 bp, Homo sapiens
ctgacccctctggt

SEQ ID NO: 4138546 - DNA, 23 bp, Homo sapiens
ctgaccctgcttcaaatatttcc

SEQ ID NO: 4138547 - DNA, 14 bp, Homo sapiens
ctgacctcttgctg

SEQ ID NO: 4138548 - DNA, 18 bp, Homo sapiens
ctgacctcttgctgtctc

SEQ ID NO: 4138549 - DNA, 19 bp, Homo sapiens
ctgacctcttgctgtctct

SEQ ID NO: 4138550 - DNA, 22 bp, Homo sapiens
ctgacctcttgctgtctctgct

SEQ ID NO: 4138551 - DNA, 21 bp, Homo sapiens
ctgacctgtgagcccagctgg

SEQ ID NO: 4138552 - DNA, 13 bp, Homo sapiens
ctgaccttccttc

SEQ ID NO: 4138553 - DNA, 15 bp, Homo sapiens
ctgaccttccttcct

SEQ ID NO: 4138554 - DNA, 16 bp, Homo sapiens
ctgaccttccttcctg

SEQ ID NO: 4138555 - DNA, 18 bp, Homo sapiens
ctgaccttggctgactgg

SEQ ID NO: 4138556 - DNA, 19 bp, Homo sapiens
ctgacggccagggagaagc

SEQ ID NO: 4138557 - DNA, 19 bp, Homo sapiens
ctgacggcgcccccagtgt

SEQ ID NO: 4138558 - DNA, 15 bp, Homo sapiens
ctgactaaaatgttt

SEQ ID NO: 4138559 - DNA, 14 bp, Homo sapiens
ctgactaagaaatt

SEQ ID NO: 4138560 - DNA, 18 bp, Homo sapiens
ctgactcaattatttgca

SEQ ID NO: 4138561 - DNA, 21 bp, Homo sapiens
ctgactcaattatttgcatat

SEQ ID NO: 4138562 - DNA, 19 bp, Homo sapiens
ctgactcatccccacagct

SEQ ID NO: 4138563 - DNA, 23 bp, Homo sapiens
ctgactccctgtgggggtggcca

SEQ ID NO: 4138564 - DNA, 12 bp, Homo sapiens
ctgactcctctg

SEQ ID NO: 4138565 - DNA, 14 bp, Homo sapiens
ctgactcctctggc

SEQ ID NO: 4138566 - DNA, 17 bp, Homo sapiens
ctgactcctctggcttt

SEQ ID NO: 4138567 - DNA, 21 bp, Homo sapiens
ctgactcctctggctttccca

SEQ ID NO: 4138568 - DNA, 22 bp, Homo sapiens
ctgactcctctggctttcccag

SEQ ID NO: 4138569 - DNA, 15 bp, Homo sapiens
ctgactctgccccct

SEQ ID NO: 4138570 - DNA, 21 bp, Homo sapiens
ctgactctgccccctgctggc

SEQ ID NO: 4138571 - DNA, 14 bp, Homo sapiens
ctgactcttcccca

SEQ ID NO: 4138572 - DNA, 14 bp, Homo sapiens
ctgactgctcagaa

SEQ ID NO: 4138573 - DNA, 20 bp, Homo sapiens
ctgactggattcattctcat

SEQ ID NO: 4138574 - DNA, 15 bp, Homo sapiens
ctgactggcctggga

SEQ ID NO: 4138575 - DNA, 14 bp, Homo sapiens
ctgactgggccagg

SEQ ID NO: 4138576 - DNA, 18 bp, Homo sapiens
ctgactgggctgggtttg

SEQ ID NO: 4138577 - DNA, 16 bp, Homo sapiens
ctgactggggctgggg

SEQ ID NO: 4138578 - DNA, 18 bp, Homo sapiens
ctgactggggctggggtg

SEQ ID NO: 4138579 - DNA, 19 bp, Homo sapiens
ctgactgtaacatattctg

SEQ ID NO: 4138580 - DNA, 22 bp, Homo sapiens
ctgactgtcctctcccctccag

SEQ ID NO: 4138581 - DNA, 13 bp, Homo sapiens
ctgactgtggccc

SEQ ID NO: 4138582 - DNA, 16 bp, Homo sapiens
ctgactgtggccccct

SEQ ID NO: 4138583 - DNA, 17 bp, Homo sapiens
ctgactgtggccccctc

SEQ ID NO: 4138584 - DNA, 18 bp, Homo sapiens
ctgacttaagcaaaagaa

SEQ ID NO: 4138585 - DNA, 20 bp, Homo sapiens
ctgacttaagcaaaagaaaa

SEQ ID NO: 4138586 - DNA, 24 bp, Homo sapiens
ctgacttaagcaaaagaaaaagat

SEQ ID NO: 4138587 - DNA, 15 bp, Homo sapiens
ctgacttgagtgttc

SEQ ID NO: 4138588 - DNA, 20 bp, Homo sapiens
ctgactttccgagcctccag

SEQ ID NO: 4138589 - DNA, 16 bp, Homo sapiens
ctgactttgcttgctt

SEQ ID NO: 4138590 - DNA, 19 bp, Homo sapiens
ctgactttgcttgctttga

SEQ ID NO: 4138591 - DNA, 17 bp, Homo sapiens
ctgactttttgtttctt

SEQ ID NO: 4138592 - DNA, 18 bp, Homo sapiens
ctgactttttgtttcttt

SEQ ID NO: 4138593 - DNA, 20 bp, Homo sapiens
ctgagaagaagtggctgcca

SEQ ID NO: 4138594 - DNA, 11 bp, Homo sapiens
ctgagaagaat

SEQ ID NO: 4138595 - DNA, 15 bp, Homo sapiens
ctgagaagctgctcc

SEQ ID NO: 4138596 - DNA, 18 bp, Homo sapiens
ctgagaagctgctccagg

SEQ ID NO: 4138597 - DNA, 18 bp, Homo sapiens
ctgagaagtcaaacattt

SEQ ID NO: 4138598 - DNA, 16 bp, Homo sapiens
ctgagaattccaagga

SEQ ID NO: 4138599 - DNA, 15 bp, Homo sapiens
ctgagaccactgagt

SEQ ID NO: 4138600 - DNA, 13 bp, Homo sapiens
ctgagaccagtgt

SEQ ID NO: 4138601 - DNA, 14 bp, Homo sapiens
ctgagaccagtgta

SEQ ID NO: 4138602 - DNA, 17 bp, Homo sapiens
ctgagacgggcatcgca

SEQ ID NO: 4138603 - DNA, 21 bp, Homo sapiens
ctgagacgggcatcgcaggag

SEQ ID NO: 4138604 - DNA, 22 bp, Homo sapiens
ctgagacgggcatcgcaggagt

SEQ ID NO: 4138605 - DNA, 16 bp, Homo sapiens
ctgagactgctaagta

SEQ ID NO: 4138606 - DNA, 18 bp, Homo sapiens
ctgagagaattggctcaa

SEQ ID NO: 4138607 - DNA, 11 bp, Homo sapiens
ctgagagcaaa

SEQ ID NO: 4138608 - DNA, 17 bp, Homo sapiens
ctgagaggcaggcatag

SEQ ID NO: 4138609 - DNA, 18 bp, Homo sapiens
ctgagagggcaaggaagt

SEQ ID NO: 4138610 - DNA, 17 bp, Homo sapiens
ctgagagggctcgaggg

SEQ ID NO: 4138611 - DNA, 14 bp, Homo sapiens
ctgagaggggaagc

SEQ ID NO: 4138612 - DNA, 15 bp, Homo sapiens
ctgagagtgaaacca

SEQ ID NO: 4138613 - DNA, 14 bp, Homo sapiens
ctgagatcccctga

SEQ ID NO: 4138614 - DNA, 18 bp, Homo sapiens
ctgagatcccctgagccc

SEQ ID NO: 4138615 - DNA, 14 bp, Homo sapiens
ctgagatgctcact

SEQ ID NO: 4138616 - DNA, 16 bp, Homo sapiens
ctgagatgtggagact

SEQ ID NO: 4138617 - DNA, 20 bp, Homo sapiens
ctgagatttttttgtgtatg

SEQ ID NO: 4138618 - DNA, 20 bp, Homo sapiens
ctgagcaactcttgattatc

SEQ ID NO: 4138619 - DNA, 16 bp, Homo sapiens
ctgagcaagatcttgt

SEQ ID NO: 4138620 - DNA, 15 bp, Homo sapiens
ctgagcaccctctgg

SEQ ID NO: 4138621 - DNA, 17 bp, Homo sapiens
ctgagcaccctctggat

SEQ ID NO: 4138622 - DNA, 23 bp, Homo sapiens
ctgagcaccgtgtcaagctgctc

SEQ ID NO: 4138623 - DNA, 17 bp, Homo sapiens
ctgagcacctgcttcat

SEQ ID NO: 4138624 - DNA, 11 bp, Homo sapiens
ctgagcagccg

SEQ ID NO: 4138625 - DNA, 14 bp, Homo sapiens
ctgagcagccgcca

SEQ ID NO: 4138626 - DNA, 17 bp, Homo sapiens
ctgagcagccgccagct

SEQ ID NO: 4138627 - DNA, 18 bp, Homo sapiens
ctgagcagccgccagctg

SEQ ID NO: 4138628 - DNA, 14 bp, Homo sapiens
ctgagcagcctctg

SEQ ID NO: 4138629 - DNA, 19 bp, Homo sapiens
ctgagcagcctctggacag

SEQ ID NO: 4138630 - DNA, 16 bp, Homo sapiens
ctgagcagtgcctctt

SEQ ID NO: 4138631 - DNA, 19 bp, Homo sapiens
ctgagcagttcccctggag

SEQ ID NO: 4138632 - DNA, 22 bp, Homo sapiens
ctgagcattcgctgtacccttt

SEQ ID NO: 4138633 - DNA, 15 bp, Homo sapiens
ctgagccagcagggc

SEQ ID NO: 4138634 - DNA, 14 bp, Homo sapiens
ctgagcccagctgc

SEQ ID NO: 4138635 - DNA, 23 bp, Homo sapiens
ctgagcccagctgcctggagagg

SEQ ID NO: 4138636 - DNA, 21 bp, Homo sapiens
ctgagccccagggtgcccaga

SEQ ID NO: 4138637 - DNA, 13 bp, Homo sapiens
ctgagccctgggg

SEQ ID NO: 4138638 - DNA, 14 bp, Homo sapiens
ctgagccctgggga

SEQ ID NO: 4138639 - DNA, 18 bp, Homo sapiens
ctgagccctggggactgt

SEQ ID NO: 4138640 - DNA, 12 bp, Homo sapiens
ctgagcctctgc

SEQ ID NO: 4138641 - DNA, 14 bp, Homo sapiens
ctgagcctctgctc

SEQ ID NO: 4138642 - DNA, 11 bp, Homo sapiens
ctgagcctgtg

SEQ ID NO: 4138643 - DNA, 14 bp, Homo sapiens
ctgagcctgtgggt

SEQ ID NO: 4138644 - DNA, 12 bp, Homo sapiens
ctgagccttcag

SEQ ID NO: 4138645 - DNA, 15 bp, Homo sapiens
ctgagcgggaggcag

SEQ ID NO: 4138646 - DNA, 20 bp, Homo sapiens
ctgagctcacatgggactgg

SEQ ID NO: 4138647 - DNA, 19 bp, Homo sapiens
ctgagctccccagatctcc

SEQ ID NO: 4138648 - DNA, 23 bp, Homo sapiens
ctgagctccccagatctcccact

SEQ ID NO: 4138649 - DNA, 22 bp, Homo sapiens
ctgagctcctgctgcggaggag

SEQ ID NO: 4138650 - DNA, 19 bp, Homo sapiens
ctgagctgagtggccagcc

SEQ ID NO: 4138651 - DNA, 16 bp, Homo sapiens
ctgagctgcagcctgg

SEQ ID NO: 4138652 - DNA, 19 bp, Homo sapiens
ctgagctgcagcctggctg

SEQ ID NO: 4138653 - DNA, 20 bp, Homo sapiens
ctgagctgcagcctggctgg

SEQ ID NO: 4138654 - DNA, 22 bp, Homo sapiens
ctgagctgcagcctggctggtc

SEQ ID NO: 4138655 - DNA, 18 bp, Homo sapiens
ctgagctggccaggccct

SEQ ID NO: 4138656 - DNA, 17 bp, Homo sapiens
ctgagctggcctctcac

SEQ ID NO: 4138657 - DNA, 21 bp, Homo sapiens
ctgagcttcggttctccagaa

SEQ ID NO: 4138658 - DNA, 23 bp, Homo sapiens
ctgagcttcggttctccagaatg

SEQ ID NO: 4138659 - DNA, 17 bp, Homo sapiens
ctgaggacacaccccac

SEQ ID NO: 4138660 - DNA, 20 bp, Homo sapiens
ctgaggagatgaccagggat

SEQ ID NO: 4138661 - DNA, 21 bp, Homo sapiens
ctgaggagatgaccagggatg

SEQ ID NO: 4138662 - DNA, 13 bp, Homo sapiens
ctgaggaggcctc

SEQ ID NO: 4138663 - DNA, 19 bp, Homo sapiens
ctgaggaggcctccatctc

SEQ ID NO: 4138664 - DNA, 23 bp, Homo sapiens
ctgaggaggccttgggctctgct

SEQ ID NO: 4138665 - DNA, 19 bp, Homo sapiens
ctgaggatgggtcagagct

SEQ ID NO: 4138666 - DNA, 22 bp, Homo sapiens
ctgaggatttaagggatggaaa

SEQ ID NO: 4138667 - DNA, 15 bp, Homo sapiens
ctgaggcagccttgg

SEQ ID NO: 4138668 - DNA, 21 bp, Homo sapiens
ctgaggccacactcagcacaa

SEQ ID NO: 4138669 - DNA, 12 bp, Homo sapiens
ctgaggccagag

SEQ ID NO: 4138670 - DNA, 17 bp, Homo sapiens
ctgaggccagagtcacc

SEQ ID NO: 4138671 - DNA, 21 bp, Homo sapiens
ctgaggccaggacgtctgggg

SEQ ID NO: 4138672 - DNA, 19 bp, Homo sapiens
ctgaggcggaggctgtgct

SEQ ID NO: 4138673 - DNA, 17 bp, Homo sapiens
ctgaggcgggagaatca

SEQ ID NO: 4138674 - DNA, 19 bp, Homo sapiens
ctgaggcttagagagagga

SEQ ID NO: 4138675 - DNA, 20 bp, Homo sapiens
ctgaggcttagagagaggag

SEQ ID NO: 4138676 - DNA, 15 bp, Homo sapiens
ctgaggctttggatt

SEQ ID NO: 4138677 - DNA, 20 bp, Homo sapiens
ctgagggaccaactgggccc

SEQ ID NO: 4138678 - DNA, 20 bp, Homo sapiens
ctgagggactctgaagcctc

SEQ ID NO: 4138679 - DNA, 18 bp, Homo sapiens
ctgagggattgaggggcc

SEQ ID NO: 4138680 - DNA, 15 bp, Homo sapiens
ctgagggcagtaccc

SEQ ID NO: 4138681 - DNA, 14 bp, Homo sapiens
ctgagggccacact

SEQ ID NO: 4138682 - DNA, 19 bp, Homo sapiens
ctgagggcctgctggaggc

SEQ ID NO: 4138683 - DNA, 14 bp, Homo sapiens
ctgagggctgccag

SEQ ID NO: 4138684 - DNA, 15 bp, Homo sapiens
ctgagggctgccagc

SEQ ID NO: 4138685 - DNA, 16 bp, Homo sapiens
ctgagggctgccagca

SEQ ID NO: 4138686 - DNA, 22 bp, Homo sapiens
ctgagggctgccagcagccccg

SEQ ID NO: 4138687 - DNA, 22 bp, Homo sapiens
ctgaggggcaacgaagaaaaaa

SEQ ID NO: 4138688 - DNA, 15 bp, Homo sapiens
ctgaggggcagcctg

SEQ ID NO: 4138689 - DNA, 16 bp, Homo sapiens
ctgaggggcagcctgc

SEQ ID NO: 4138690 - DNA, 23 bp, Homo sapiens
ctgaggggcagcctgccttgccc

SEQ ID NO: 4138691 - DNA, 16 bp, Homo sapiens
ctgaggggcatctgcc

SEQ ID NO: 4138692 - DNA, 20 bp, Homo sapiens
ctgaggggcatctgcccctc

SEQ ID NO: 4138693 - DNA, 15 bp, Homo sapiens
ctgaggggcttggga

SEQ ID NO: 4138694 - DNA, 21 bp, Homo sapiens
ctgaggggggccgtgcccagg

SEQ ID NO: 4138695 - DNA, 21 bp, Homo sapiens
ctgagggtccccacctgggac

SEQ ID NO: 4138696 - DNA, 16 bp, Homo sapiens
ctgagggtctgggcgg

SEQ ID NO: 4138697 - DNA, 17 bp, Homo sapiens
ctgaggtgaaagggagc

SEQ ID NO: 4138698 - DNA, 22 bp, Homo sapiens
ctgaggttaaacggtgcccatc

SEQ ID NO: 4138699 - DNA, 14 bp, Homo sapiens
ctgaggttcctctg

SEQ ID NO: 4138700 - DNA, 21 bp, Homo sapiens
ctgaggttcctctgcctgccc

SEQ ID NO: 4138701 - DNA, 23 bp, Homo sapiens
ctgaggttcctctgcctgccccg

SEQ ID NO: 4138702 - DNA, 15 bp, Homo sapiens
ctgagtaccaggggc

SEQ ID NO: 4138703 - DNA, 16 bp, Homo sapiens
ctgagtaccaggggct

SEQ ID NO: 4138704 - DNA, 17 bp, Homo sapiens
ctgagtaccaggggctg

SEQ ID NO: 4138705 - DNA, 19 bp, Homo sapiens
ctgagtagctctcctgact

SEQ ID NO: 4138706 - DNA, 13 bp, Homo sapiens
ctgagtctcctgt

SEQ ID NO: 4138707 - DNA, 14 bp, Homo sapiens
ctgagtctcctgtg

SEQ ID NO: 4138708 - DNA, 15 bp, Homo sapiens
ctgagtctcctgtgc

SEQ ID NO: 4138709 - DNA, 15 bp, Homo sapiens
ctgagtctggacttt

SEQ ID NO: 4138710 - DNA, 23 bp, Homo sapiens
ctgagtgagccacagaccacctg

SEQ ID NO: 4138711 - DNA, 18 bp, Homo sapiens
ctgagtggatctccaagg

SEQ ID NO: 4138712 - DNA, 14 bp, Homo sapiens
ctgagtggccagcc

SEQ ID NO: 4138713 - DNA, 15 bp, Homo sapiens
ctgagtggccagcca

SEQ ID NO: 4138714 - DNA, 15 bp, Homo sapiens
ctgagtggcgcaagg

SEQ ID NO: 4138715 - DNA, 13 bp, Homo sapiens
ctgagttatgatg

SEQ ID NO: 4138716 - DNA, 23 bp, Homo sapiens
ctgagttctgggtttctagaggt

SEQ ID NO: 4138717 - DNA, 19 bp, Homo sapiens
ctgagttctggtcaaagaa

SEQ ID NO: 4138718 - DNA, 22 bp, Homo sapiens
ctgagttgaagtcatgctcccc

SEQ ID NO: 4138719 - DNA, 15 bp, Homo sapiens
ctgagtttaccattt

SEQ ID NO: 4138720 - DNA, 22 bp, Homo sapiens
ctgagtttaccatttgtaataa

SEQ ID NO: 4138721 - DNA, 18 bp, Homo sapiens
ctgagtttcattctcctg

SEQ ID NO: 4138722 - DNA, 12 bp, Homo sapiens
ctgagtttccta

SEQ ID NO: 4138723 - DNA, 18 bp, Homo sapiens
ctgataaagcacagctgt

SEQ ID NO: 4138724 - DNA, 17 bp, Homo sapiens
ctgatataaattctgtg

SEQ ID NO: 4138725 - DNA, 18 bp, Homo sapiens
ctgatataaattctgtgg

SEQ ID NO: 4138726 - DNA, 23 bp, Homo sapiens
ctgatatctggcctaaaatcttg

SEQ ID NO: 4138727 - DNA, 19 bp, Homo sapiens
ctgatattccatgaatgta

SEQ ID NO: 4138728 - DNA, 22 bp, Homo sapiens
ctgatcactagcctgtcatcct

SEQ ID NO: 4138729 - DNA, 17 bp, Homo sapiens
ctgatcagaccacggct

SEQ ID NO: 4138730 - DNA, 12 bp, Homo sapiens
ctgatcagaggt

SEQ ID NO: 4138731 - DNA, 17 bp, Homo sapiens
ctgatcagaggtgtaca

SEQ ID NO: 4138732 - DNA, 22 bp, Homo sapiens
ctgatcagaggtgtacactaac

SEQ ID NO: 4138733 - DNA, 19 bp, Homo sapiens
ctgatcatcgccagaggtg

SEQ ID NO: 4138734 - DNA, 16 bp, Homo sapiens
ctgatcatgcattgtt

SEQ ID NO: 4138735 - DNA, 16 bp, Homo sapiens
ctgatcccatggccag

SEQ ID NO: 4138736 - DNA, 15 bp, Homo sapiens
ctgatccccatgcct

SEQ ID NO: 4138737 - DNA, 16 bp, Homo sapiens
ctgatccccatgccta

SEQ ID NO: 4138738 - DNA, 19 bp, Homo sapiens
ctgatccccatgcctagca

SEQ ID NO: 4138739 - DNA, 21 bp, Homo sapiens
ctgatcctggaggcccagttc

SEQ ID NO: 4138740 - DNA, 15 bp, Homo sapiens
ctgatcgtgctaaat

SEQ ID NO: 4138741 - DNA, 23 bp, Homo sapiens
ctgatctctactaccacaaggaa

SEQ ID NO: 4138742 - DNA, 16 bp, Homo sapiens
ctgatcttgtgctcag

SEQ ID NO: 4138743 - DNA, 12 bp, Homo sapiens
ctgatgaaaaca

SEQ ID NO: 4138744 - DNA, 19 bp, Homo sapiens
ctgatgaaatctgctagaa

SEQ ID NO: 4138745 - DNA, 21 bp, Homo sapiens
ctgatgaactcttaatcaaat

SEQ ID NO: 4138746 - DNA, 18 bp, Homo sapiens
ctgatgacacccaccctg

SEQ ID NO: 4138747 - DNA, 22 bp, Homo sapiens
ctgatgacacccaccctgtgcc

SEQ ID NO: 4138748 - DNA, 16 bp, Homo sapiens
ctgatgacagagcgag

SEQ ID NO: 4138749 - DNA, 22 bp, Homo sapiens
ctgatgacccccccagcttcac

SEQ ID NO: 4138750 - DNA, 16 bp, Homo sapiens
ctgatgatccagaaca

SEQ ID NO: 4138751 - DNA, 17 bp, Homo sapiens
ctgatgatccagaacag

SEQ ID NO: 4138752 - DNA, 14 bp, Homo sapiens
ctgatgattttcct

SEQ ID NO: 4138753 - DNA, 22 bp, Homo sapiens
ctgatgattttcctttttcttc

SEQ ID NO: 4138754 - DNA, 21 bp, Homo sapiens
ctgatgctccctcccctgccc

SEQ ID NO: 4138755 - DNA, 23 bp, Homo sapiens
ctgatgctccctcccctgccctg

SEQ ID NO: 4138756 - DNA, 24 bp, Homo sapiens
ctgatgctccctcccctgccctgg

SEQ ID NO: 4138757 - DNA, 22 bp, Homo sapiens
ctgatgctttgcttcaaatcca

SEQ ID NO: 4138758 - DNA, 14 bp, Homo sapiens
ctgatggaggaaaa

SEQ ID NO: 4138759 - DNA, 19 bp, Homo sapiens
ctgatggcagaactcccac

SEQ ID NO: 4138760 - DNA, 12 bp, Homo sapiens
ctgatggcagct

SEQ ID NO: 4138761 - DNA, 14 bp, Homo sapiens
ctgatggcttgaca

SEQ ID NO: 4138762 - DNA, 21 bp, Homo sapiens
ctgatggcttgacatgtgcaa

SEQ ID NO: 4138763 - DNA, 12 bp, Homo sapiens
ctgatgtcccag

SEQ ID NO: 4138764 - DNA, 15 bp, Homo sapiens
ctgatgtcccagtgc

SEQ ID NO: 4138765 - DNA, 17 bp, Homo sapiens
ctgatgtcccagtgctc

SEQ ID NO: 4138766 - DNA, 19 bp, Homo sapiens
ctgatgtctctaaagcact

SEQ ID NO: 4138767 - DNA, 20 bp, Homo sapiens
ctgatgttacatcacagtgt

SEQ ID NO: 4138768 - DNA, 15 bp, Homo sapiens
ctgatgttggaagag

SEQ ID NO: 4138769 - DNA, 11 bp, Homo sapiens
ctgattagaaa

SEQ ID NO: 4138770 - DNA, 20 bp, Homo sapiens
ctgattcagcatcactaaac

SEQ ID NO: 4138771 - DNA, 23 bp, Homo sapiens
ctgattcagcatcactaaaccga

SEQ ID NO: 4138772 - DNA, 17 bp, Homo sapiens
ctgattgacctgctccg

SEQ ID NO: 4138773 - DNA, 14 bp, Homo sapiens
ctgattggctcacc

SEQ ID NO: 4138774 - DNA, 16 bp, Homo sapiens
ctgattggctcaccca

SEQ ID NO: 4138775 - DNA, 15 bp, Homo sapiens
ctgattggtgattca

SEQ ID NO: 4138776 - DNA, 16 bp, Homo sapiens
ctgatttaaaaagtga

SEQ ID NO: 4138777 - DNA, 18 bp, Homo sapiens
ctgatttaggagaagcca

SEQ ID NO: 4138778 - DNA, 22 bp, Homo sapiens
ctgatttaggagaagccaggaa

SEQ ID NO: 4138779 - DNA, 13 bp, Homo sapiens
ctgatttcacaac

SEQ ID NO: 4138780 - DNA, 12 bp, Homo sapiens
ctgatttcagga

SEQ ID NO: 4138781 - DNA, 14 bp, Homo sapiens
ctgatttggtactt

SEQ ID NO: 4138782 - DNA, 23 bp, Homo sapiens
ctgatttggtacttttgagtgtg

SEQ ID NO: 4138783 - DNA, 17 bp, Homo sapiens
ctgattttaacaataac

SEQ ID NO: 4138784 - DNA, 22 bp, Homo sapiens
ctgattttaacaataactactg

SEQ ID NO: 4138785 - DNA, 14 bp, Homo sapiens
ctgcaaaaccaggt

SEQ ID NO: 4138786 - DNA, 16 bp, Homo sapiens
ctgcaaacagaacagg

SEQ ID NO: 4138787 - DNA, 16 bp, Homo sapiens
ctgcaaactcactgct

SEQ ID NO: 4138788 - DNA, 22 bp, Homo sapiens
ctgcaaagatctgtcctcagcc

SEQ ID NO: 4138789 - DNA, 23 bp, Homo sapiens
ctgcaaagatctgtcctcagcct

SEQ ID NO: 4138790 - DNA, 20 bp, Homo sapiens
ctgcaaatctgatggcctta

SEQ ID NO: 4138791 - DNA, 17 bp, Homo sapiens
ctgcaacatttgacaaa

SEQ ID NO: 4138792 - DNA, 15 bp, Homo sapiens
ctgcaacctctgcct

SEQ ID NO: 4138793 - DNA, 16 bp, Homo sapiens
ctgcaacctctgcctc

SEQ ID NO: 4138794 - DNA, 19 bp, Homo sapiens
ctgcaacttccgctgaggg

SEQ ID NO: 4138795 - DNA, 21 bp, Homo sapiens
ctgcaatagagactgtagatt

SEQ ID NO: 4138796 - DNA, 19 bp, Homo sapiens
ctgcaatatttgaatttta

SEQ ID NO: 4138797 - DNA, 16 bp, Homo sapiens
ctgcaatgcctagact

SEQ ID NO: 4138798 - DNA, 17 bp, Homo sapiens
ctgcaatgggcactggg

SEQ ID NO: 4138799 - DNA, 17 bp, Homo sapiens
ctgcaattcccctctgc

SEQ ID NO: 4138800 - DNA, 19 bp, Homo sapiens
ctgcaattctacagtttct

SEQ ID NO: 4138801 - DNA, 15 bp, Homo sapiens
ctgcaattgcttagg

SEQ ID NO: 4138802 - DNA, 20 bp, Homo sapiens
ctgcaattgcttaggatgtt

SEQ ID NO: 4138803 - DNA, 14 bp, Homo sapiens
ctgcaattttctaa

SEQ ID NO: 4138804 - DNA, 18 bp, Homo sapiens
ctgcacacacctccgaga

SEQ ID NO: 4138805 - DNA, 16 bp, Homo sapiens
ctgcacactccaggcc

SEQ ID NO: 4138806 - DNA, 17 bp, Homo sapiens
ctgcacactccatctcc

SEQ ID NO: 4138807 - DNA, 12 bp, Homo sapiens
ctgcacagatgg

SEQ ID NO: 4138808 - DNA, 13 bp, Homo sapiens
ctgcacagatgga

SEQ ID NO: 4138809 - DNA, 18 bp, Homo sapiens
ctgcacagtgcatctcag

SEQ ID NO: 4138810 - DNA, 22 bp, Homo sapiens
ctgcacagtgcatctcagccca

SEQ ID NO: 4138811 - DNA, 15 bp, Homo sapiens
ctgcacagttgaagg

SEQ ID NO: 4138812 - DNA, 21 bp, Homo sapiens
ctgcacatgaaagttttgcaa

SEQ ID NO: 4138813 - DNA, 13 bp, Homo sapiens
ctgcaccagagca

SEQ ID NO: 4138814 - DNA, 22 bp, Homo sapiens
ctgcacccaactactgagctga

SEQ ID NO: 4138815 - DNA, 15 bp, Homo sapiens
ctgcacccagctcca

SEQ ID NO: 4138816 - DNA, 12 bp, Homo sapiens
ctgcacccaggg

SEQ ID NO: 4138817 - DNA, 13 bp, Homo sapiens
ctgcacccctggg

SEQ ID NO: 4138818 - DNA, 14 bp, Homo sapiens
ctgcacccctgggc

SEQ ID NO: 4138819 - DNA, 19 bp, Homo sapiens
ctgcaccccttctctcctc

SEQ ID NO: 4138820 - DNA, 21 bp, Homo sapiens
ctgcaccccttctctcctccc

SEQ ID NO: 4138821 - DNA, 15 bp, Homo sapiens
ctgcaccctgcgcct

SEQ ID NO: 4138822 - DNA, 20 bp, Homo sapiens
ctgcaccctgcgcctccaga

SEQ ID NO: 4138823 - DNA, 12 bp, Homo sapiens
ctgcacgtcatg

SEQ ID NO: 4138824 - DNA, 14 bp, Homo sapiens
ctgcacgttcataa

SEQ ID NO: 4138825 - DNA, 16 bp, Homo sapiens
ctgcacgttcataacc

SEQ ID NO: 4138826 - DNA, 18 bp, Homo sapiens
ctgcactaaagccagcct

SEQ ID NO: 4138827 - DNA, 19 bp, Homo sapiens
ctgcactaaagccagcctg

SEQ ID NO: 4138828 - DNA, 23 bp, Homo sapiens
ctgcactaagagaaaattgcact

SEQ ID NO: 4138829 - DNA, 16 bp, Homo sapiens
ctgcactaatttgatg

SEQ ID NO: 4138830 - DNA, 14 bp, Homo sapiens
ctgcactcaagctt

SEQ ID NO: 4138831 - DNA, 20 bp, Homo sapiens
ctgcactccggcctgatgac

SEQ ID NO: 4138832 - DNA, 17 bp, Homo sapiens
ctgcactctaaactgca

SEQ ID NO: 4138833 - DNA, 19 bp, Homo sapiens
ctgcactcttaagcttccg

SEQ ID NO: 4138834 - DNA, 21 bp, Homo sapiens
ctgcagaacagcatcatgtca

SEQ ID NO: 4138835 - DNA, 22 bp, Homo sapiens
ctgcagaacatcgatatgtata

SEQ ID NO: 4138836 - DNA, 22 bp, Homo sapiens
ctgcagaatttgggttctgcct

SEQ ID NO: 4138837 - DNA, 17 bp, Homo sapiens
ctgcagacctcaagcca

SEQ ID NO: 4138838 - DNA, 14 bp, Homo sapiens
ctgcagacttccca

SEQ ID NO: 4138839 - DNA, 23 bp, Homo sapiens
ctgcagattagttctttttgcca

SEQ ID NO: 4138840 - DNA, 14 bp, Homo sapiens
ctgcagatttgata

SEQ ID NO: 4138841 - DNA, 20 bp, Homo sapiens
ctgcagcaaacactccaccc

SEQ ID NO: 4138842 - DNA, 17 bp, Homo sapiens
ctgcagcacctccaggc

SEQ ID NO: 4138843 - DNA, 18 bp, Homo sapiens
ctgcagcacctccaggcc

SEQ ID NO: 4138844 - DNA, 15 bp, Homo sapiens
ctgcagcaggcagct

SEQ ID NO: 4138845 - DNA, 20 bp, Homo sapiens
ctgcagcatggtccctgcct

SEQ ID NO: 4138846 - DNA, 12 bp, Homo sapiens
ctgcagccagct

SEQ ID NO: 4138847 - DNA, 20 bp, Homo sapiens
ctgcagcccaaaacccaggg

SEQ ID NO: 4138848 - DNA, 19 bp, Homo sapiens
ctgcagccccttgctctca

SEQ ID NO: 4138849 - DNA, 21 bp, Homo sapiens
ctgcagccccttgctctcagc

SEQ ID NO: 4138850 - DNA, 13 bp, Homo sapiens
ctgcagcccttgg

SEQ ID NO: 4138851 - DNA, 17 bp, Homo sapiens
ctgcagcccttgggcag

SEQ ID NO: 4138852 - DNA, 18 bp, Homo sapiens
ctgcagcccttgggcagt

SEQ ID NO: 4138853 - DNA, 17 bp, Homo sapiens
ctgcagcctcatactcc

SEQ ID NO: 4138854 - DNA, 20 bp, Homo sapiens
ctgcagcctggctggtcctc

SEQ ID NO: 4138855 - DNA, 20 bp, Homo sapiens
ctgcagcctttgcctccccg

SEQ ID NO: 4138856 - DNA, 22 bp, Homo sapiens
ctgcagctatgcgcaatgtggc

SEQ ID NO: 4138857 - DNA, 18 bp, Homo sapiens
ctgcagctctcatgctgc

SEQ ID NO: 4138858 - DNA, 17 bp, Homo sapiens
ctgcagctgagcctgag

SEQ ID NO: 4138859 - DNA, 12 bp, Homo sapiens
ctgcagctgccg

SEQ ID NO: 4138860 - DNA, 17 bp, Homo sapiens
ctgcagctgggcagcag

SEQ ID NO: 4138861 - DNA, 22 bp, Homo sapiens
ctgcaggagagagcagcactcc

SEQ ID NO: 4138862 - DNA, 17 bp, Homo sapiens
ctgcaggagtgtcctgc

SEQ ID NO: 4138863 - DNA, 16 bp, Homo sapiens
ctgcaggctgagccac

SEQ ID NO: 4138864 - DNA, 22 bp, Homo sapiens
ctgcaggtgccagggcccaccc

SEQ ID NO: 4138865 - DNA, 14 bp, Homo sapiens
ctgcagtgtgcccc

SEQ ID NO: 4138866 - DNA, 21 bp, Homo sapiens
ctgcagtttgagacaggagac

SEQ ID NO: 4138867 - DNA, 19 bp, Homo sapiens
ctgcatagcgaaataaaaa

SEQ ID NO: 4138868 - DNA, 14 bp, Homo sapiens
ctgcatatcttcat

SEQ ID NO: 4138869 - DNA, 21 bp, Homo sapiens
ctgcatatgttgaatactttt

SEQ ID NO: 4138870 - DNA, 13 bp, Homo sapiens
ctgcatcatctgt

SEQ ID NO: 4138871 - DNA, 17 bp, Homo sapiens
ctgcatcccagcacctg

SEQ ID NO: 4138872 - DNA, 21 bp, Homo sapiens
ctgcatcccagcacctgcctc

SEQ ID NO: 4138873 - DNA, 15 bp, Homo sapiens
ctgcatccccttggc

SEQ ID NO: 4138874 - DNA, 14 bp, Homo sapiens
ctgcatctggggcc

SEQ ID NO: 4138875 - DNA, 16 bp, Homo sapiens
ctgcatggacctaaca

SEQ ID NO: 4138876 - DNA, 13 bp, Homo sapiens
ctgcattagaaaa

SEQ ID NO: 4138877 - DNA, 17 bp, Homo sapiens
ctgcattgctagataaa

SEQ ID NO: 4138878 - DNA, 19 bp, Homo sapiens
ctgcattttattctggatg

SEQ ID NO: 4138879 - DNA, 15 bp, Homo sapiens
ctgcatttttcactt

SEQ ID NO: 4138880 - DNA, 16 bp, Homo sapiens
ctgccaaaggatgtga

SEQ ID NO: 4138881 - DNA, 18 bp, Homo sapiens
ctgccaaaggatgtgata

SEQ ID NO: 4138882 - DNA, 21 bp, Homo sapiens
ctgccaaagggaaatatcatt

SEQ ID NO: 4138883 - DNA, 22 bp, Homo sapiens
ctgccaagtggggatggggcct

SEQ ID NO: 4138884 - DNA, 15 bp, Homo sapiens
ctgccacacccaggg

SEQ ID NO: 4138885 - DNA, 16 bp, Homo sapiens
ctgccacacccagggg

SEQ ID NO: 4138886 - DNA, 15 bp, Homo sapiens
ctgccacagccagag

SEQ ID NO: 4138887 - DNA, 19 bp, Homo sapiens
ctgccacatggagccccct

SEQ ID NO: 4138888 - DNA, 12 bp, Homo sapiens
ctgccacccact

SEQ ID NO: 4138889 - DNA, 16 bp, Homo sapiens
ctgccacccactcagg

SEQ ID NO: 4138890 - DNA, 13 bp, Homo sapiens
ctgccagcagccc

SEQ ID NO: 4138891 - DNA, 17 bp, Homo sapiens
ctgccagcccagaacac

SEQ ID NO: 4138892 - DNA, 15 bp, Homo sapiens
ctgccagccccacac

SEQ ID NO: 4138893 - DNA, 18 bp, Homo sapiens
ctgccagccccacacagc

SEQ ID NO: 4138894 - DNA, 15 bp, Homo sapiens
ctgccagccttgagc

SEQ ID NO: 4138895 - DNA, 21 bp, Homo sapiens
ctgccagccttgagccctggc

SEQ ID NO: 4138896 - DNA, 22 bp, Homo sapiens
ctgccagccttgagccctggct

SEQ ID NO: 4138897 - DNA, 16 bp, Homo sapiens
ctgccagctgcactga

SEQ ID NO: 4138898 - DNA, 21 bp, Homo sapiens
ctgccaggcaacttttaaagc

SEQ ID NO: 4138899 - DNA, 22 bp, Homo sapiens
ctgccaggcacacacagcccct

SEQ ID NO: 4138900 - DNA, 13 bp, Homo sapiens
ctgccaggcaggg

SEQ ID NO: 4138901 - DNA, 17 bp, Homo sapiens
ctgccaggcaggggtgg

SEQ ID NO: 4138902 - DNA, 20 bp, Homo sapiens
ctgccaggcaggggtggggg

SEQ ID NO: 4138903 - DNA, 16 bp, Homo sapiens
ctgccaggccagcctc

SEQ ID NO: 4138904 - DNA, 19 bp, Homo sapiens
ctgccaggctgcctcctgc

SEQ ID NO: 4138905 - DNA, 15 bp, Homo sapiens
ctgccataattctaa

SEQ ID NO: 4138906 - DNA, 23 bp, Homo sapiens
ctgccatgacagaggctgcaccc

SEQ ID NO: 4138907 - DNA, 16 bp, Homo sapiens
ctgccatgttgcccct

SEQ ID NO: 4138908 - DNA, 13 bp, Homo sapiens
ctgccatttccct

SEQ ID NO: 4138909 - DNA, 23 bp, Homo sapiens
ctgccatttcccttctggacact

SEQ ID NO: 4138910 - DNA, 21 bp, Homo sapiens
ctgcccaagggcctcccacca

SEQ ID NO: 4138911 - DNA, 22 bp, Homo sapiens
ctgcccaagggcctcccaccag

SEQ ID NO: 4138912 - DNA, 12 bp, Homo sapiens
ctgcccaccatt

SEQ ID NO: 4138913 - DNA, 18 bp, Homo sapiens
ctgcccagacccctctgg

SEQ ID NO: 4138914 - DNA, 18 bp, Homo sapiens
ctgcccagatcagccaga

SEQ ID NO: 4138915 - DNA, 19 bp, Homo sapiens
ctgcccagatgccctttgg

SEQ ID NO: 4138916 - DNA, 12 bp, Homo sapiens
ctgcccagtgtt

SEQ ID NO: 4138917 - DNA, 23 bp, Homo sapiens
ctgcccagtgttgtttgtaaata

SEQ ID NO: 4138918 - DNA, 18 bp, Homo sapiens
ctgcccatcatgtggccc

SEQ ID NO: 4138919 - DNA, 18 bp, Homo sapiens
ctgcccatggacaggctg

SEQ ID NO: 4138920 - DNA, 20 bp, Homo sapiens
ctgcccatgtgtcccctcac

SEQ ID NO: 4138921 - DNA, 22 bp, Homo sapiens
ctgcccatgtgtcccctcactc

SEQ ID NO: 4138922 - DNA, 13 bp, Homo sapiens
ctgccccaactct

SEQ ID NO: 4138923 - DNA, 14 bp, Homo sapiens
ctgccccacacgga

SEQ ID NO: 4138924 - DNA, 16 bp, Homo sapiens
ctgccccacacggact

SEQ ID NO: 4138925 - DNA, 22 bp, Homo sapiens
ctgccccacacggactcccggg

SEQ ID NO: 4138926 - DNA, 16 bp, Homo sapiens
ctgccccacccaagcc

SEQ ID NO: 4138927 - DNA, 14 bp, Homo sapiens
ctgccccaccccac

SEQ ID NO: 4138928 - DNA, 16 bp, Homo sapiens
ctgccccaccccacct

SEQ ID NO: 4138929 - DNA, 14 bp, Homo sapiens
ctgccccacggaga

SEQ ID NO: 4138930 - DNA, 14 bp, Homo sapiens
ctgccccagctact

SEQ ID NO: 4138931 - DNA, 12 bp, Homo sapiens
ctgccccaggcc

SEQ ID NO: 4138932 - DNA, 14 bp, Homo sapiens
ctgcccccactgtc

SEQ ID NO: 4138933 - DNA, 13 bp, Homo sapiens
ctgccccctcctg

SEQ ID NO: 4138934 - DNA, 16 bp, Homo sapiens
ctgccccgcccccagt

SEQ ID NO: 4138935 - DNA, 17 bp, Homo sapiens
ctgcccctcaccttggg

SEQ ID NO: 4138936 - DNA, 18 bp, Homo sapiens
ctgcccctcaccttgggc

SEQ ID NO: 4138937 - DNA, 23 bp, Homo sapiens
ctgcccctcaccttgggctgggg

SEQ ID NO: 4138938 - DNA, 17 bp, Homo sapiens
ctgcccctctcaccaaa

SEQ ID NO: 4138939 - DNA, 15 bp, Homo sapiens
ctgcccgagctggtg

SEQ ID NO: 4138940 - DNA, 19 bp, Homo sapiens
ctgcccgggcgcggccagc

SEQ ID NO: 4138941 - DNA, 21 bp, Homo sapiens
ctgcccggtgggggggcagag

SEQ ID NO: 4138942 - DNA, 16 bp, Homo sapiens
ctgcccgtgccctggt

SEQ ID NO: 4138943 - DNA, 18 bp, Homo sapiens
ctgcccgtgccctggtga

SEQ ID NO: 4138944 - DNA, 12 bp, Homo sapiens
ctgccctaagcc

SEQ ID NO: 4138945 - DNA, 21 bp, Homo sapiens
ctgccctaagcccccagggcc

SEQ ID NO: 4138946 - DNA, 12 bp, Homo sapiens
ctgccctagctg

SEQ ID NO: 4138947 - DNA, 17 bp, Homo sapiens
ctgccctagctgacccc

SEQ ID NO: 4138948 - DNA, 16 bp, Homo sapiens
ctgccctatgggcctg

SEQ ID NO: 4138949 - DNA, 17 bp, Homo sapiens
ctgccctatgggcctgc

SEQ ID NO: 4138950 - DNA, 21 bp, Homo sapiens
ctgccctatgggcctgccggg

SEQ ID NO: 4138951 - DNA, 13 bp, Homo sapiens
ctgccctcaggga

SEQ ID NO: 4138952 - DNA, 12 bp, Homo sapiens
ctgccctcatgg

SEQ ID NO: 4138953 - DNA, 20 bp, Homo sapiens
ctgccctcattactgggcct

SEQ ID NO: 4138954 - DNA, 18 bp, Homo sapiens
ctgccctccttgtccacc

SEQ ID NO: 4138955 - DNA, 20 bp, Homo sapiens
ctgccctccttgtccaccca

SEQ ID NO: 4138956 - DNA, 21 bp, Homo sapiens
ctgccctgagaagctgctcca

SEQ ID NO: 4138957 - DNA, 14 bp, Homo sapiens
ctgccctgcaccct

SEQ ID NO: 4138958 - DNA, 23 bp, Homo sapiens
ctgccctggaacatcctttgcag

SEQ ID NO: 4138959 - DNA, 12 bp, Homo sapiens
ctgccctggctg

SEQ ID NO: 4138960 - DNA, 14 bp, Homo sapiens
ctgccctggctgct

SEQ ID NO: 4138961 - DNA, 16 bp, Homo sapiens
ctgccctggctgctgc

SEQ ID NO: 4138962 - DNA, 18 bp, Homo sapiens
ctgccctggctgctgccc

SEQ ID NO: 4138963 - DNA, 21 bp, Homo sapiens
ctgccctggtccagggaagct

SEQ ID NO: 4138964 - DNA, 13 bp, Homo sapiens
ctgccctgtccaa

SEQ ID NO: 4138965 - DNA, 16 bp, Homo sapiens
ctgccctgtccctgtc

SEQ ID NO: 4138966 - DNA, 20 bp, Homo sapiens
ctgccctgtgatatgtctgc

SEQ ID NO: 4138967 - DNA, 22 bp, Homo sapiens
ctgccctgtgatatgtctgctg

SEQ ID NO: 4138968 - DNA, 16 bp, Homo sapiens
ctgccctgttcatgtg

SEQ ID NO: 4138969 - DNA, 22 bp, Homo sapiens
ctgccctgttcatgtgcctctg

SEQ ID NO: 4138970 - DNA, 19 bp, Homo sapiens
ctgccctgttgtgtataga

SEQ ID NO: 4138971 - DNA, 16 bp, Homo sapiens
ctgcccttcaccccag

SEQ ID NO: 4138972 - DNA, 12 bp, Homo sapiens
ctgcccttccct

SEQ ID NO: 4138973 - DNA, 16 bp, Homo sapiens
ctgcccttccctctgg

SEQ ID NO: 4138974 - DNA, 17 bp, Homo sapiens
ctgccctttcctaggcc

SEQ ID NO: 4138975 - DNA, 23 bp, Homo sapiens
ctgccctttgtcctcctgctgcc

SEQ ID NO: 4138976 - DNA, 18 bp, Homo sapiens
ctgccgcagacgggcaca

SEQ ID NO: 4138977 - DNA, 22 bp, Homo sapiens
ctgccgcagacgggcacagaca

SEQ ID NO: 4138978 - DNA, 15 bp, Homo sapiens
ctgccgctgcaccac

SEQ ID NO: 4138979 - DNA, 18 bp, Homo sapiens
ctgccgctgccgctgcac

SEQ ID NO: 4138980 - DNA, 14 bp, Homo sapiens
ctgccggcccccag

SEQ ID NO: 4138981 - DNA, 15 bp, Homo sapiens
ctgccggcccccagg

SEQ ID NO: 4138982 - DNA, 18 bp, Homo sapiens
ctgccgggctgagggcct

SEQ ID NO: 4138983 - DNA, 19 bp, Homo sapiens
ctgccgggttctagtctcc

SEQ ID NO: 4138984 - DNA, 20 bp, Homo sapiens
ctgccgggttctagtctcct

SEQ ID NO: 4138985 - DNA, 21 bp, Homo sapiens
ctgccgggttctagtctcctt

SEQ ID NO: 4138986 - DNA, 20 bp, Homo sapiens
ctgccggtcgggcagccagc

SEQ ID NO: 4138987 - DNA, 20 bp, Homo sapiens
ctgccggtttgaaaatatgc

SEQ ID NO: 4138988 - DNA, 14 bp, Homo sapiens
ctgcctacagccag

SEQ ID NO: 4138989 - DNA, 18 bp, Homo sapiens
ctgcctagcaagctggcc

SEQ ID NO: 4138990 - DNA, 14 bp, Homo sapiens
ctgcctatgttggg

SEQ ID NO: 4138991 - DNA, 18 bp, Homo sapiens
ctgcctcagacgttgcct

SEQ ID NO: 4138992 - DNA, 21 bp, Homo sapiens
ctgcctcagacgttgcctgag

SEQ ID NO: 4138993 - DNA, 12 bp, Homo sapiens
ctgcctcagcct

SEQ ID NO: 4138994 - DNA, 14 bp, Homo sapiens
ctgcctcagctgac

SEQ ID NO: 4138995 - DNA, 11 bp, Homo sapiens
ctgcctcagga

SEQ ID NO: 4138996 - DNA, 18 bp, Homo sapiens
ctgcctcccacttcactg

SEQ ID NO: 4138997 - DNA, 14 bp, Homo sapiens
ctgcctcccaggtt

SEQ ID NO: 4138998 - DNA, 11 bp, Homo sapiens
ctgcctcccat

SEQ ID NO: 4138999 - DNA, 12 bp, Homo sapiens
ctgcctcctgcc

SEQ ID NO: 4139000 - DNA, 16 bp, Homo sapiens
ctgcctcctgcctgcc

SEQ ID NO: 4139001 - DNA, 15 bp, Homo sapiens
ctgcctcctgggaag

SEQ ID NO: 4139002 - DNA, 18 bp, Homo sapiens
ctgcctcgctcaccgctg

SEQ ID NO: 4139003 - DNA, 22 bp, Homo sapiens
ctgcctcgctcaccgctggccc

SEQ ID NO: 4139004 - DNA, 15 bp, Homo sapiens
ctgcctctcccatca

SEQ ID NO: 4139005 - DNA, 23 bp, Homo sapiens
ctgcctctcccatcacttcccta

SEQ ID NO: 4139006 - DNA, 17 bp, Homo sapiens
ctgcctgaaacagccat

SEQ ID NO: 4139007 - DNA, 18 bp, Homo sapiens
ctgcctgaaacagccatg

SEQ ID NO: 4139008 - DNA, 19 bp, Homo sapiens
ctgcctgacactgagcccc

SEQ ID NO: 4139009 - DNA, 20 bp, Homo sapiens
ctgcctgacactgagcccca

SEQ ID NO: 4139010 - DNA, 21 bp, Homo sapiens
ctgcctgacactgagccccac

SEQ ID NO: 4139011 - DNA, 11 bp, Homo sapiens
ctgcctgaggg

SEQ ID NO: 4139012 - DNA, 15 bp, Homo sapiens
ctgcctgagggcagt

SEQ ID NO: 4139013 - DNA, 20 bp, Homo sapiens
ctgcctgcaatatttgaatt

SEQ ID NO: 4139014 - DNA, 14 bp, Homo sapiens
ctgcctgcagcagg

SEQ ID NO: 4139015 - DNA, 21 bp, Homo sapiens
ctgcctgccccacacggactc

SEQ ID NO: 4139016 - DNA, 18 bp, Homo sapiens
ctgcctgccccgccccca

SEQ ID NO: 4139017 - DNA, 22 bp, Homo sapiens
ctgcctgccccgcccccagtcc

SEQ ID NO: 4139018 - DNA, 16 bp, Homo sapiens
ctgcctgctgagatga

SEQ ID NO: 4139019 - DNA, 12 bp, Homo sapiens
ctgcctggactt

SEQ ID NO: 4139020 - DNA, 15 bp, Homo sapiens
ctgcctggagagggt

SEQ ID NO: 4139021 - DNA, 17 bp, Homo sapiens
ctgcctggagagggtct

SEQ ID NO: 4139022 - DNA, 16 bp, Homo sapiens
ctgcctggccaggcag

SEQ ID NO: 4139023 - DNA, 17 bp, Homo sapiens
ctgcctggccaggcaga

SEQ ID NO: 4139024 - DNA, 19 bp, Homo sapiens
ctgcctggcccccaacctc

SEQ ID NO: 4139025 - DNA, 22 bp, Homo sapiens
ctgcctgggcccggaagggctt

SEQ ID NO: 4139026 - DNA, 15 bp, Homo sapiens
ctgcctggtggtcag

SEQ ID NO: 4139027 - DNA, 12 bp, Homo sapiens
ctgcctgtctgc

SEQ ID NO: 4139028 - DNA, 13 bp, Homo sapiens
ctgcctgtctgcc

SEQ ID NO: 4139029 - DNA, 23 bp, Homo sapiens
ctgcctgtctgccccagcccaga

SEQ ID NO: 4139030 - DNA, 17 bp, Homo sapiens
ctgccttaaaaccaaag

SEQ ID NO: 4139031 - DNA, 18 bp, Homo sapiens
ctgccttaaaaccaaaga

SEQ ID NO: 4139032 - DNA, 22 bp, Homo sapiens
ctgccttaatgacattcccctc

SEQ ID NO: 4139033 - DNA, 16 bp, Homo sapiens
ctgccttagtctcagt

SEQ ID NO: 4139034 - DNA, 20 bp, Homo sapiens
ctgccttagtctcagtttgt

SEQ ID NO: 4139035 - DNA, 16 bp, Homo sapiens
ctgccttccctagctt

SEQ ID NO: 4139036 - DNA, 19 bp, Homo sapiens
ctgccttcgttaactgtgt

SEQ ID NO: 4139037 - DNA, 18 bp, Homo sapiens
ctgccttctcctctctgg

SEQ ID NO: 4139038 - DNA, 22 bp, Homo sapiens
ctgccttctcctctctgggcct

SEQ ID NO: 4139039 - DNA, 17 bp, Homo sapiens
ctgccttgaacctgtga

SEQ ID NO: 4139040 - DNA, 19 bp, Homo sapiens
ctgccttgaacctgtgagt

SEQ ID NO: 4139041 - DNA, 14 bp, Homo sapiens
ctgccttgagctaa

SEQ ID NO: 4139042 - DNA, 17 bp, Homo sapiens
ctgccttgcccactcct

SEQ ID NO: 4139043 - DNA, 18 bp, Homo sapiens
ctgccttgcccactcctg

SEQ ID NO: 4139044 - DNA, 15 bp, Homo sapiens
ctgccttggcctccc

SEQ ID NO: 4139045 - DNA, 17 bp, Homo sapiens
ctgccttggctcagaca

SEQ ID NO: 4139046 - DNA, 18 bp, Homo sapiens
ctgccttggctcagacat

SEQ ID NO: 4139047 - DNA, 22 bp, Homo sapiens
ctgccttggctcagacatgttt

SEQ ID NO: 4139048 - DNA, 17 bp, Homo sapiens
ctgccttgggccttgct

SEQ ID NO: 4139049 - DNA, 19 bp, Homo sapiens
ctgccttgggccttgctgc

SEQ ID NO: 4139050 - DNA, 19 bp, Homo sapiens
ctgccttggggtcaggttg

SEQ ID NO: 4139051 - DNA, 20 bp, Homo sapiens
ctgccttggggtcaggttga

SEQ ID NO: 4139052 - DNA, 22 bp, Homo sapiens
ctgccttggggtcaggttgaca

SEQ ID NO: 4139053 - DNA, 20 bp, Homo sapiens
ctgcctttgcagttggactc

SEQ ID NO: 4139054 - DNA, 13 bp, Homo sapiens
ctgccttttgttc

SEQ ID NO: 4139055 - DNA, 20 bp, Homo sapiens
ctgcgaagaccctcttgccc

SEQ ID NO: 4139056 - DNA, 14 bp, Homo sapiens
ctgcgatcttcaga

SEQ ID NO: 4139057 - DNA, 16 bp, Homo sapiens
ctgcgcaccaatgccc

SEQ ID NO: 4139058 - DNA, 20 bp, Homo sapiens
ctgcgcaccaatgcccagca

SEQ ID NO: 4139059 - DNA, 23 bp, Homo sapiens
ctgcgcaccaatgcccagcaggg

SEQ ID NO: 4139060 - DNA, 16 bp, Homo sapiens
ctgcgccctgtgcccg

SEQ ID NO: 4139061 - DNA, 13 bp, Homo sapiens
ctgcgcctccaga

SEQ ID NO: 4139062 - DNA, 20 bp, Homo sapiens
ctgcgcctccagaggtcctc

SEQ ID NO: 4139063 - DNA, 13 bp, Homo sapiens
ctgcgcctgcagg

SEQ ID NO: 4139064 - DNA, 17 bp, Homo sapiens
ctgcgcctgctgcctgc

SEQ ID NO: 4139065 - DNA, 15 bp, Homo sapiens
ctgcggaggagctgc

SEQ ID NO: 4139066 - DNA, 22 bp, Homo sapiens
ctgcggtttgttggatcttcaa

SEQ ID NO: 4139067 - DNA, 15 bp, Homo sapiens
ctgcgtcctcctcac

SEQ ID NO: 4139068 - DNA, 20 bp, Homo sapiens
ctgcgtgccagtcaagaaga

SEQ ID NO: 4139069 - DNA, 19 bp, Homo sapiens
ctgcgtttattaatgcctc

SEQ ID NO: 4139070 - DNA, 17 bp, Homo sapiens
ctgctaaattctatgtt

SEQ ID NO: 4139071 - DNA, 16 bp, Homo sapiens
ctgctaacctggaaag

SEQ ID NO: 4139072 - DNA, 21 bp, Homo sapiens
ctgctaatacctcttactttg

SEQ ID NO: 4139073 - DNA, 23 bp, Homo sapiens
ctgctacaaatactcttaggaag

SEQ ID NO: 4139074 - DNA, 17 bp, Homo sapiens
ctgctaccgccctgggc

SEQ ID NO: 4139075 - DNA, 19 bp, Homo sapiens
ctgctacctcccttgcctt

SEQ ID NO: 4139076 - DNA, 20 bp, Homo sapiens
ctgctacgttcctattgtca

SEQ ID NO: 4139077 - DNA, 19 bp, Homo sapiens
ctgctaggcgagtgccagg

SEQ ID NO: 4139078 - DNA, 22 bp, Homo sapiens
ctgctaggcgagtgccaggact

SEQ ID NO: 4139079 - DNA, 16 bp, Homo sapiens
ctgctatcctgccaaa

SEQ ID NO: 4139080 - DNA, 15 bp, Homo sapiens
ctgctcaccacctgc

SEQ ID NO: 4139081 - DNA, 16 bp, Homo sapiens
ctgctcaccacctgcc

SEQ ID NO: 4139082 - DNA, 20 bp, Homo sapiens
ctgctcaccacctgcctcta

SEQ ID NO: 4139083 - DNA, 14 bp, Homo sapiens
ctgctcacccacct

SEQ ID NO: 4139084 - DNA, 12 bp, Homo sapiens
ctgctcacttta

SEQ ID NO: 4139085 - DNA, 18 bp, Homo sapiens
ctgctcagaacttgctgc

SEQ ID NO: 4139086 - DNA, 19 bp, Homo sapiens
ctgctcagaacttgctgct

SEQ ID NO: 4139087 - DNA, 22 bp, Homo sapiens
ctgctcagcaattcagacccct

SEQ ID NO: 4139088 - DNA, 21 bp, Homo sapiens
ctgctcagcagtgagagcaga

SEQ ID NO: 4139089 - DNA, 23 bp, Homo sapiens
ctgctcagcagtgagagcagatg

SEQ ID NO: 4139090 - DNA, 13 bp, Homo sapiens
ctgctcagctctg

SEQ ID NO: 4139091 - DNA, 16 bp, Homo sapiens
ctgctcagctctgggc

SEQ ID NO: 4139092 - DNA, 16 bp, Homo sapiens
ctgctccaccagcagc

SEQ ID NO: 4139093 - DNA, 18 bp, Homo sapiens
ctgctccaccagcagcat

SEQ ID NO: 4139094 - DNA, 20 bp, Homo sapiens
ctgctccaccagcagcatgg

SEQ ID NO: 4139095 - DNA, 22 bp, Homo sapiens
ctgctccaccagcagcatggca

SEQ ID NO: 4139096 - DNA, 12 bp, Homo sapiens
ctgctccaccct

SEQ ID NO: 4139097 - DNA, 18 bp, Homo sapiens
ctgctccacccttggcct

SEQ ID NO: 4139098 - DNA, 15 bp, Homo sapiens
ctgctccagaagatg

SEQ ID NO: 4139099 - DNA, 14 bp, Homo sapiens
ctgctccaggcctg

SEQ ID NO: 4139100 - DNA, 15 bp, Homo sapiens
ctgctccaggcctgc

SEQ ID NO: 4139101 - DNA, 21 bp, Homo sapiens
ctgctccataccttttctctt

SEQ ID NO: 4139102 - DNA, 15 bp, Homo sapiens
ctgctcccagcctgc

SEQ ID NO: 4139103 - DNA, 22 bp, Homo sapiens
ctgctcccagcctgctgagagc

SEQ ID NO: 4139104 - DNA, 14 bp, Homo sapiens
ctgctcccattcct

SEQ ID NO: 4139105 - DNA, 16 bp, Homo sapiens
ctgctccccaggggag

SEQ ID NO: 4139106 - DNA, 18 bp, Homo sapiens
ctgctcccccttttccct

SEQ ID NO: 4139107 - DNA, 22 bp, Homo sapiens
ctgctccctccgggtcttccta

SEQ ID NO: 4139108 - DNA, 18 bp, Homo sapiens
ctgctccctgctttggct

SEQ ID NO: 4139109 - DNA, 14 bp, Homo sapiens
ctgctccgctgctc

SEQ ID NO: 4139110 - DNA, 17 bp, Homo sapiens
ctgctccgctgctcctt

SEQ ID NO: 4139111 - DNA, 11 bp, Homo sapiens
ctgctcctcca

SEQ ID NO: 4139112 - DNA, 15 bp, Homo sapiens
ctgctcctcctgccc

SEQ ID NO: 4139113 - DNA, 12 bp, Homo sapiens
ctgctcctgctt

SEQ ID NO: 4139114 - DNA, 18 bp, Homo sapiens
ctgctcctgcttttctgt

SEQ ID NO: 4139115 - DNA, 22 bp, Homo sapiens
ctgctcctgcttttctgtcctg

SEQ ID NO: 4139116 - DNA, 17 bp, Homo sapiens
ctgctccttcccttgct

SEQ ID NO: 4139117 - DNA, 20 bp, Homo sapiens
ctgctctacccatgagcctg

SEQ ID NO: 4139118 - DNA, 23 bp, Homo sapiens
ctgctctacccatgagcctgccc

SEQ ID NO: 4139119 - DNA, 21 bp, Homo sapiens
ctgctctagtgggacagccca

SEQ ID NO: 4139120 - DNA, 21 bp, Homo sapiens
ctgctctattccaaaaaggtt

SEQ ID NO: 4139121 - DNA, 20 bp, Homo sapiens
ctgctctccaagtctcagtg

SEQ ID NO: 4139122 - DNA, 12 bp, Homo sapiens
ctgctctgctga

SEQ ID NO: 4139123 - DNA, 22 bp, Homo sapiens
ctgctctggttgtttctgttcc

SEQ ID NO: 4139124 - DNA, 17 bp, Homo sapiens
ctgctctgtccccaaag

SEQ ID NO: 4139125 - DNA, 15 bp, Homo sapiens
ctgctctttctctgc

SEQ ID NO: 4139126 - DNA, 21 bp, Homo sapiens
ctgctctttctctgccagtga

SEQ ID NO: 4139127 - DNA, 14 bp, Homo sapiens
ctgctcttttcctg

SEQ ID NO: 4139128 - DNA, 16 bp, Homo sapiens
ctgctgaatgcaggga

SEQ ID NO: 4139129 - DNA, 19 bp, Homo sapiens
ctgctgaatgcagggaatg

SEQ ID NO: 4139130 - DNA, 13 bp, Homo sapiens
ctgctgagagccc

SEQ ID NO: 4139131 - DNA, 22 bp, Homo sapiens
ctgctgagatgaggaggggagc

SEQ ID NO: 4139132 - DNA, 21 bp, Homo sapiens
ctgctgagtccgacctggcct

SEQ ID NO: 4139133 - DNA, 22 bp, Homo sapiens
ctgctgagtccgacctggcctg

SEQ ID NO: 4139134 - DNA, 20 bp, Homo sapiens
ctgctgagttggcctggcca

SEQ ID NO: 4139135 - DNA, 22 bp, Homo sapiens
ctgctgagttggcctggccatt

SEQ ID NO: 4139136 - DNA, 22 bp, Homo sapiens
ctgctgatgacccccccagctt

SEQ ID NO: 4139137 - DNA, 24 bp, Homo sapiens
ctgctgcacccaactactgagctg

SEQ ID NO: 4139138 - DNA, 22 bp, Homo sapiens
ctgctgcaccctgcgcctccag

SEQ ID NO: 4139139 - DNA, 22 bp, Homo sapiens
ctgctgcaggccgtgtgtctgt

SEQ ID NO: 4139140 - DNA, 16 bp, Homo sapiens
ctgctgcatggggtgg

SEQ ID NO: 4139141 - DNA, 22 bp, Homo sapiens
ctgctgcccccaccccggggac

SEQ ID NO: 4139142 - DNA, 15 bp, Homo sapiens
ctgctgcccctgcag

SEQ ID NO: 4139143 - DNA, 17 bp, Homo sapiens
ctgctgccgcccttcct

SEQ ID NO: 4139144 - DNA, 20 bp, Homo sapiens
ctgctgcctctttccctagg

SEQ ID NO: 4139145 - DNA, 21 bp, Homo sapiens
ctgctgcgcccttaccttccc

SEQ ID NO: 4139146 - DNA, 14 bp, Homo sapiens
ctgctgcggaggag

SEQ ID NO: 4139147 - DNA, 18 bp, Homo sapiens
ctgctgcggaggagctgc

SEQ ID NO: 4139148 - DNA, 12 bp, Homo sapiens
ctgctgctgcac

SEQ ID NO: 4139149 - DNA, 13 bp, Homo sapiens
ctgctgctgcacc

SEQ ID NO: 4139150 - DNA, 16 bp, Homo sapiens
ctgctgctgcgccctt

SEQ ID NO: 4139151 - DNA, 14 bp, Homo sapiens
ctgctgctgctgtg

SEQ ID NO: 4139152 - DNA, 14 bp, Homo sapiens
ctgctggaagccca

SEQ ID NO: 4139153 - DNA, 15 bp, Homo sapiens
ctgctggaagcccag

SEQ ID NO: 4139154 - DNA, 14 bp, Homo sapiens
ctgctggaggcctc

SEQ ID NO: 4139155 - DNA, 18 bp, Homo sapiens
ctgctggaggcctcaggt

SEQ ID NO: 4139156 - DNA, 20 bp, Homo sapiens
ctgctggagtttcatgtaca

SEQ ID NO: 4139157 - DNA, 23 bp, Homo sapiens
ctgctggatcacagctgctttct

SEQ ID NO: 4139158 - DNA, 14 bp, Homo sapiens
ctgctggcacccac

SEQ ID NO: 4139159 - DNA, 16 bp, Homo sapiens
ctgctggcacccaccg

SEQ ID NO: 4139160 - DNA, 15 bp, Homo sapiens
ctgctggcccagcca

SEQ ID NO: 4139161 - DNA, 22 bp, Homo sapiens
ctgctggcccagccaaaccctg

SEQ ID NO: 4139162 - DNA, 12 bp, Homo sapiens
ctgctggcctgg

SEQ ID NO: 4139163 - DNA, 16 bp, Homo sapiens
ctgctggcctggatct

SEQ ID NO: 4139164 - DNA, 14 bp, Homo sapiens
ctgctggctgcctt

SEQ ID NO: 4139165 - DNA, 15 bp, Homo sapiens
ctgctggcttccagc

SEQ ID NO: 4139166 - DNA, 19 bp, Homo sapiens
ctgctgggagttctagaac

SEQ ID NO: 4139167 - DNA, 18 bp, Homo sapiens
ctgctgggctccccccag

SEQ ID NO: 4139168 - DNA, 19 bp, Homo sapiens
ctgctgggctccccccagt

SEQ ID NO: 4139169 - DNA, 17 bp, Homo sapiens
ctgctggtcacagcctc

SEQ ID NO: 4139170 - DNA, 23 bp, Homo sapiens
ctgctggtggaaagcgattcact

SEQ ID NO: 4139171 - DNA, 23 bp, Homo sapiens
ctgctggtgggcttgtcatagcc

SEQ ID NO: 4139172 - DNA, 17 bp, Homo sapiens
ctgctgtccctccccct

SEQ ID NO: 4139173 - DNA, 20 bp, Homo sapiens
ctgctgtccctcccccttgt

SEQ ID NO: 4139174 - DNA, 15 bp, Homo sapiens
ctgctgtgaaccctg

SEQ ID NO: 4139175 - DNA, 22 bp, Homo sapiens
ctgctgtgattccactacacct

SEQ ID NO: 4139176 - DNA, 17 bp, Homo sapiens
ctgctgtgccatgctgg

SEQ ID NO: 4139177 - DNA, 19 bp, Homo sapiens
ctgctgtgccatgctgggc

SEQ ID NO: 4139178 - DNA, 19 bp, Homo sapiens
ctgctgtgcgtggaaaaag

SEQ ID NO: 4139179 - DNA, 19 bp, Homo sapiens
ctgctgtgggcacaggtca

SEQ ID NO: 4139180 - DNA, 15 bp, Homo sapiens
ctgctgttctcagga

SEQ ID NO: 4139181 - DNA, 21 bp, Homo sapiens
ctgctgtttgacacctctttt

SEQ ID NO: 4139182 - DNA, 21 bp, Homo sapiens
ctgcttagctgccttgagcta

SEQ ID NO: 4139183 - DNA, 15 bp, Homo sapiens
ctgcttaggagagac

SEQ ID NO: 4139184 - DNA, 23 bp, Homo sapiens
ctgcttagtatctcatcaacaaa

SEQ ID NO: 4139185 - DNA, 16 bp, Homo sapiens
ctgcttcattttggag

SEQ ID NO: 4139186 - DNA, 19 bp, Homo sapiens
ctgcttccggtagggaggc

SEQ ID NO: 4139187 - DNA, 19 bp, Homo sapiens
ctgcttctgacataatcca

SEQ ID NO: 4139188 - DNA, 21 bp, Homo sapiens
ctgcttgataggaattcatct

SEQ ID NO: 4139189 - DNA, 16 bp, Homo sapiens
ctgcttgatgaagcaa

SEQ ID NO: 4139190 - DNA, 18 bp, Homo sapiens
ctgcttgatgaagcaagg

SEQ ID NO: 4139191 - DNA, 20 bp, Homo sapiens
ctgcttgatgaagcaaggaa

SEQ ID NO: 4139192 - DNA, 18 bp, Homo sapiens
ctgcttgcaggaggccaa

SEQ ID NO: 4139193 - DNA, 22 bp, Homo sapiens
ctgcttggcccggccggcctgg

SEQ ID NO: 4139194 - DNA, 17 bp, Homo sapiens
ctgctttaaagggcctg

SEQ ID NO: 4139195 - DNA, 21 bp, Homo sapiens
ctgctttaaagggcctgcctg

SEQ ID NO: 4139196 - DNA, 18 bp, Homo sapiens
ctgctttctgttccaaat

SEQ ID NO: 4139197 - DNA, 12 bp, Homo sapiens
ctgctttgcaaa

SEQ ID NO: 4139198 - DNA, 13 bp, Homo sapiens
ctgctttgcaaac

SEQ ID NO: 4139199 - DNA, 17 bp, Homo sapiens
ctgctttgcgctggtgg

SEQ ID NO: 4139200 - DNA, 18 bp, Homo sapiens
ctgctttgcgctggtgga

SEQ ID NO: 4139201 - DNA, 20 bp, Homo sapiens
ctgctttggctgaggggctt

SEQ ID NO: 4139202 - DNA, 23 bp, Homo sapiens
ctgctttgggatttaatttccag

SEQ ID NO: 4139203 - DNA, 21 bp, Homo sapiens
ctgctttgggctgccctggtg

SEQ ID NO: 4139204 - DNA, 23 bp, Homo sapiens
ctgctttgggctgccctggtgct

SEQ ID NO: 4139205 - DNA, 15 bp, Homo sapiens
ctgcttttctgccct

SEQ ID NO: 4139206 - DNA, 21 bp, Homo sapiens
ctgcttttctgccctggctgc

SEQ ID NO: 4139207 - DNA, 13 bp, Homo sapiens
ctgcttttctgtc

SEQ ID NO: 4139208 - DNA, 17 bp, Homo sapiens
ctgcttttctgtcctgg

SEQ ID NO: 4139209 - DNA, 20 bp, Homo sapiens
ctgcttttctgtcctgggca

SEQ ID NO: 4139210 - DNA, 23 bp, Homo sapiens
ctggaaaagaagaaactttgcct

SEQ ID NO: 4139211 - DNA, 15 bp, Homo sapiens
ctggaaaagaggagt

SEQ ID NO: 4139212 - DNA, 15 bp, Homo sapiens
ctggaaactaccagg

SEQ ID NO: 4139213 - DNA, 17 bp, Homo sapiens
ctggaaaggggagagcc

SEQ ID NO: 4139214 - DNA, 18 bp, Homo sapiens
ctggaaaggggagagcct

SEQ ID NO: 4139215 - DNA, 18 bp, Homo sapiens
ctggaacatcctttgcag

SEQ ID NO: 4139216 - DNA, 16 bp, Homo sapiens
ctggaacatggctagc

SEQ ID NO: 4139217 - DNA, 15 bp, Homo sapiens
ctggaacattgagga

SEQ ID NO: 4139218 - DNA, 22 bp, Homo sapiens
ctggaacccagactcagacatt

SEQ ID NO: 4139219 - DNA, 16 bp, Homo sapiens
ctggaacctcagcctg

SEQ ID NO: 4139220 - DNA, 16 bp, Homo sapiens
ctggaaccttgctgtc

SEQ ID NO: 4139221 - DNA, 14 bp, Homo sapiens
ctggaacttgggga

SEQ ID NO: 4139222 - DNA, 22 bp, Homo sapiens
ctggaagagcccagtctgttga

SEQ ID NO: 4139223 - DNA, 14 bp, Homo sapiens
ctggaagagggtga

SEQ ID NO: 4139224 - DNA, 18 bp, Homo sapiens
ctggaagatataacattc

SEQ ID NO: 4139225 - DNA, 17 bp, Homo sapiens
ctggaagcccagcccct

SEQ ID NO: 4139226 - DNA, 14 bp, Homo sapiens
ctggaagccctgga

SEQ ID NO: 4139227 - DNA, 22 bp, Homo sapiens
ctggaagctaatttgcattaaa

SEQ ID NO: 4139228 - DNA, 22 bp, Homo sapiens
ctggaaggaacatggagctgtc

SEQ ID NO: 4139229 - DNA, 19 bp, Homo sapiens
ctggaaggggaagggacac

SEQ ID NO: 4139230 - DNA, 21 bp, Homo sapiens
ctggaataagaagcaaataaa

SEQ ID NO: 4139231 - DNA, 20 bp, Homo sapiens
ctggaataatttgtaaatga

SEQ ID NO: 4139232 - DNA, 17 bp, Homo sapiens
ctggaatctggagacca

SEQ ID NO: 4139233 - DNA, 18 bp, Homo sapiens
ctggaatgtttttccctc

SEQ ID NO: 4139234 - DNA, 17 bp, Homo sapiens
ctggaattcttctgcaa

SEQ ID NO: 4139235 - DNA, 11 bp, Homo sapiens
ctggacaagcc

SEQ ID NO: 4139236 - DNA, 23 bp, Homo sapiens
ctggacaagccaacttgtaaata

SEQ ID NO: 4139237 - DNA, 13 bp, Homo sapiens
ctggacagccagt

SEQ ID NO: 4139238 - DNA, 15 bp, Homo sapiens
ctggacaggctctgc

SEQ ID NO: 4139239 - DNA, 18 bp, Homo sapiens
ctggacataacattttca

SEQ ID NO: 4139240 - DNA, 18 bp, Homo sapiens
ctggacatcctcttctgc

SEQ ID NO: 4139241 - DNA, 15 bp, Homo sapiens
ctggacatgctgact

SEQ ID NO: 4139242 - DNA, 18 bp, Homo sapiens
ctggacatttgccttgct

SEQ ID NO: 4139243 - DNA, 15 bp, Homo sapiens
ctggacctgcctcct

SEQ ID NO: 4139244 - DNA, 20 bp, Homo sapiens
ctggacctgcctcctgcctg

SEQ ID NO: 4139245 - DNA, 21 bp, Homo sapiens
ctggacctgcctcctgcctgc

SEQ ID NO: 4139246 - DNA, 12 bp, Homo sapiens
ctggacctggga

SEQ ID NO: 4139247 - DNA, 15 bp, Homo sapiens
ctggacctggtggct

SEQ ID NO: 4139248 - DNA, 19 bp, Homo sapiens
ctggacgatagcttggagg

SEQ ID NO: 4139249 - DNA, 21 bp, Homo sapiens
ctggacgatagcttggaggga

SEQ ID NO: 4139250 - DNA, 20 bp, Homo sapiens
ctggacggcaggctcactgc

SEQ ID NO: 4139251 - DNA, 18 bp, Homo sapiens
ctggacggggactgggga

SEQ ID NO: 4139252 - DNA, 23 bp, Homo sapiens
ctggacggggactggggatgtgg

SEQ ID NO: 4139253 - DNA, 24 bp, Homo sapiens
ctggactctgcatcccagcacctg

SEQ ID NO: 4139254 - DNA, 13 bp, Homo sapiens
ctggactctgccc

SEQ ID NO: 4139255 - DNA, 15 bp, Homo sapiens
ctggactggctagag

SEQ ID NO: 4139256 - DNA, 20 bp, Homo sapiens
ctggacttctacctgccctc

SEQ ID NO: 4139257 - DNA, 12 bp, Homo sapiens
ctggacttctgt

SEQ ID NO: 4139258 - DNA, 15 bp, Homo sapiens
ctggactttcctgca

SEQ ID NO: 4139259 - DNA, 16 bp, Homo sapiens
ctggactttcctgcaa

SEQ ID NO: 4139260 - DNA, 22 bp, Homo sapiens
ctggactttggttctctccagg

SEQ ID NO: 4139261 - DNA, 15 bp, Homo sapiens
ctggagaactagaga

SEQ ID NO: 4139262 - DNA, 20 bp, Homo sapiens
ctggagacccccccccaact

SEQ ID NO: 4139263 - DNA, 20 bp, Homo sapiens
ctggagacgtggaacctctg

SEQ ID NO: 4139264 - DNA, 22 bp, Homo sapiens
ctggagacgtggaacctctgtc

SEQ ID NO: 4139265 - DNA, 12 bp, Homo sapiens
ctggagagaagt

SEQ ID NO: 4139266 - DNA, 17 bp, Homo sapiens
ctggagagaagtttctg

SEQ ID NO: 4139267 - DNA, 13 bp, Homo sapiens
ctggagagggtct

SEQ ID NO: 4139268 - DNA, 16 bp, Homo sapiens
ctggagatactggtgg

SEQ ID NO: 4139269 - DNA, 13 bp, Homo sapiens
ctggagatatgaa

SEQ ID NO: 4139270 - DNA, 22 bp, Homo sapiens
ctggagcagaggaggggaaagt

SEQ ID NO: 4139271 - DNA, 23 bp, Homo sapiens
ctggagcagaggaggggaaagtc

SEQ ID NO: 4139272 - DNA, 13 bp, Homo sapiens
ctggagcaggagc

SEQ ID NO: 4139273 - DNA, 17 bp, Homo sapiens
ctggagcaggagccccg

SEQ ID NO: 4139274 - DNA, 21 bp, Homo sapiens
ctggagcatgcagaggaggtg

SEQ ID NO: 4139275 - DNA, 23 bp, Homo sapiens
ctggagcctccactgcctctgga

SEQ ID NO: 4139276 - DNA, 20 bp, Homo sapiens
ctggagctcatctgcaaaag

SEQ ID NO: 4139277 - DNA, 19 bp, Homo sapiens
ctggaggaattcagctcag

SEQ ID NO: 4139278 - DNA, 18 bp, Homo sapiens
ctggaggaggcctgtccc

SEQ ID NO: 4139279 - DNA, 19 bp, Homo sapiens
ctggaggaggcctgtccca

SEQ ID NO: 4139280 - DNA, 12 bp, Homo sapiens
ctggaggcccag

SEQ ID NO: 4139281 - DNA, 13 bp, Homo sapiens
ctggaggcccagg

SEQ ID NO: 4139282 - DNA, 15 bp, Homo sapiens
ctggaggcccagttc

SEQ ID NO: 4139283 - DNA, 13 bp, Homo sapiens
ctggaggcccctg

SEQ ID NO: 4139284 - DNA, 17 bp, Homo sapiens
ctggaggcccctggagc

SEQ ID NO: 4139285 - DNA, 13 bp, Homo sapiens
ctggaggcctcag

SEQ ID NO: 4139286 - DNA, 16 bp, Homo sapiens
ctggaggcctcaggtg

SEQ ID NO: 4139287 - DNA, 18 bp, Homo sapiens
ctggaggcctcaggtgct

SEQ ID NO: 4139288 - DNA, 19 bp, Homo sapiens
ctggaggcctcaggtgctg

SEQ ID NO: 4139289 - DNA, 21 bp, Homo sapiens
ctggaggcctcaggtgctgtc

SEQ ID NO: 4139290 - DNA, 20 bp, Homo sapiens
ctggaggccttccagctgct

SEQ ID NO: 4139291 - DNA, 22 bp, Homo sapiens
ctggaggccttccagctgctgt

SEQ ID NO: 4139292 - DNA, 16 bp, Homo sapiens
ctggagggacttttaa

SEQ ID NO: 4139293 - DNA, 23 bp, Homo sapiens
ctggaggggagagctttgtgctt

SEQ ID NO: 4139294 - DNA, 23 bp, Homo sapiens
ctggaggtgggcatgccaccctc

SEQ ID NO: 4139295 - DNA, 21 bp, Homo sapiens
ctggaggtggggcgaggcagg

SEQ ID NO: 4139296 - DNA, 14 bp, Homo sapiens
ctggagtcagatga

SEQ ID NO: 4139297 - DNA, 15 bp, Homo sapiens
ctggagtcagatgag

SEQ ID NO: 4139298 - DNA, 18 bp, Homo sapiens
ctggagtcagatgagcaa

SEQ ID NO: 4139299 - DNA, 22 bp, Homo sapiens
ctggagtcagatgagcaaggac

SEQ ID NO: 4139300 - DNA, 12 bp, Homo sapiens
ctggagtctgga

SEQ ID NO: 4139301 - DNA, 18 bp, Homo sapiens
ctggagtctggagtgggc

SEQ ID NO: 4139302 - DNA, 14 bp, Homo sapiens
ctggagtgcagtgg

SEQ ID NO: 4139303 - DNA, 13 bp, Homo sapiens
ctggagtgcagtt

SEQ ID NO: 4139304 - DNA, 22 bp, Homo sapiens
ctggagtgcccaccctgggaga

SEQ ID NO: 4139305 - DNA, 20 bp, Homo sapiens
ctggagtgctgtgctgtgtt

SEQ ID NO: 4139306 - DNA, 13 bp, Homo sapiens
ctggagtgggcag

SEQ ID NO: 4139307 - DNA, 21 bp, Homo sapiens
ctggagtgtggctgaggaggc

SEQ ID NO: 4139308 - DNA, 19 bp, Homo sapiens
ctggagttccttatccctc

SEQ ID NO: 4139309 - DNA, 16 bp, Homo sapiens
ctggagttgatctgga

SEQ ID NO: 4139310 - DNA, 20 bp, Homo sapiens
ctggagttgatctggaaccc

SEQ ID NO: 4139311 - DNA, 16 bp, Homo sapiens
ctggagttttgatttg

SEQ ID NO: 4139312 - DNA, 13 bp, Homo sapiens
ctggataggagcc

SEQ ID NO: 4139313 - DNA, 20 bp, Homo sapiens
ctggataggagcctgctggt

SEQ ID NO: 4139314 - DNA, 16 bp, Homo sapiens
ctggatattttcaaat

SEQ ID NO: 4139315 - DNA, 22 bp, Homo sapiens
ctggatcacagctgctttctgt

SEQ ID NO: 4139316 - DNA, 24 bp, Homo sapiens
ctggatcacgacgctgcagagcac

SEQ ID NO: 4139317 - DNA, 17 bp, Homo sapiens
ctggatcagtcctttga

SEQ ID NO: 4139318 - DNA, 20 bp, Homo sapiens
ctggatcagtcctttgatca

SEQ ID NO: 4139319 - DNA, 16 bp, Homo sapiens
ctggatccagcactgg

SEQ ID NO: 4139320 - DNA, 17 bp, Homo sapiens
ctggatccagcactggt

SEQ ID NO: 4139321 - DNA, 16 bp, Homo sapiens
ctggatctatccctgc

SEQ ID NO: 4139322 - DNA, 22 bp, Homo sapiens
ctggatgaaataactccttctt

SEQ ID NO: 4139323 - DNA, 17 bp, Homo sapiens
ctggatgccagctgtgt

SEQ ID NO: 4139324 - DNA, 19 bp, Homo sapiens
ctggatgccagctgtgtcc

SEQ ID NO: 4139325 - DNA, 17 bp, Homo sapiens
ctggatggaaagacaaa

SEQ ID NO: 4139326 - DNA, 20 bp, Homo sapiens
ctggatggaaagacaaactg

SEQ ID NO: 4139327 - DNA, 14 bp, Homo sapiens
ctggattaaaacaa

SEQ ID NO: 4139328 - DNA, 16 bp, Homo sapiens
ctggattcattgtctc

SEQ ID NO: 4139329 - DNA, 22 bp, Homo sapiens
ctggcaaaaatgcaacaaatga

SEQ ID NO: 4139330 - DNA, 23 bp, Homo sapiens
ctggcaaaaatgcaacaaatgaa

SEQ ID NO: 4139331 - DNA, 19 bp, Homo sapiens
ctggcaaagcttttagaaa

SEQ ID NO: 4139332 - DNA, 20 bp, Homo sapiens
ctggcaaagcttttagaaat

SEQ ID NO: 4139333 - DNA, 22 bp, Homo sapiens
ctggcaaaggtggctctccagt

SEQ ID NO: 4139334 - DNA, 19 bp, Homo sapiens
ctggcaatagtgtgttctg

SEQ ID NO: 4139335 - DNA, 21 bp, Homo sapiens
ctggcaatgaaaaattctcag

SEQ ID NO: 4139336 - DNA, 19 bp, Homo sapiens
ctggcaattgtctatttat

SEQ ID NO: 4139337 - DNA, 15 bp, Homo sapiens
ctggcacagggcagt

SEQ ID NO: 4139338 - DNA, 19 bp, Homo sapiens
ctggcacccaccgtggagg

SEQ ID NO: 4139339 - DNA, 22 bp, Homo sapiens
ctggcactataatgtaagctct

SEQ ID NO: 4139340 - DNA, 21 bp, Homo sapiens
ctggcacttagtaggtcctca

SEQ ID NO: 4139341 - DNA, 17 bp, Homo sapiens
ctggcagccgtgccttc

SEQ ID NO: 4139342 - DNA, 20 bp, Homo sapiens
ctggcagcctcccatccagg

SEQ ID NO: 4139343 - DNA, 17 bp, Homo sapiens
ctggcagctctggacag

SEQ ID NO: 4139344 - DNA, 23 bp, Homo sapiens
ctggcaggcaggggccctgcagc

SEQ ID NO: 4139345 - DNA, 20 bp, Homo sapiens
ctggcaggccagtgtctggg

SEQ ID NO: 4139346 - DNA, 23 bp, Homo sapiens
ctggcaggggagacaggagccta

SEQ ID NO: 4139347 - DNA, 22 bp, Homo sapiens
ctggcatcaagaggtgggaggg

SEQ ID NO: 4139348 - DNA, 18 bp, Homo sapiens
ctggcatcatggtggata

SEQ ID NO: 4139349 - DNA, 17 bp, Homo sapiens
ctggcattaagggcatt

SEQ ID NO: 4139350 - DNA, 18 bp, Homo sapiens
ctggccaaacccttgctt

SEQ ID NO: 4139351 - DNA, 18 bp, Homo sapiens
ctggccaaatagcaaaga

SEQ ID NO: 4139352 - DNA, 23 bp, Homo sapiens
ctggccaaggggtgggcctgtga

SEQ ID NO: 4139353 - DNA, 18 bp, Homo sapiens
ctggccacctctctcctt

SEQ ID NO: 4139354 - DNA, 17 bp, Homo sapiens
ctggccactaaagcttc

SEQ ID NO: 4139355 - DNA, 20 bp, Homo sapiens
ctggccactaaagcttcaga

SEQ ID NO: 4139356 - DNA, 17 bp, Homo sapiens
ctggccagacacaggcc

SEQ ID NO: 4139357 - DNA, 18 bp, Homo sapiens
ctggccagacacaggccc

SEQ ID NO: 4139358 - DNA, 17 bp, Homo sapiens
ctggccagcaaggcagg

SEQ ID NO: 4139359 - DNA, 20 bp, Homo sapiens
ctggccagcaccctctcctg

SEQ ID NO: 4139360 - DNA, 21 bp, Homo sapiens
ctggccagcaccctctcctgg

SEQ ID NO: 4139361 - DNA, 13 bp, Homo sapiens
ctggccaggagct

SEQ ID NO: 4139362 - DNA, 20 bp, Homo sapiens
ctggccaggagctcttcagg

SEQ ID NO: 4139363 - DNA, 22 bp, Homo sapiens
ctggccaggagctcttcaggcc

SEQ ID NO: 4139364 - DNA, 12 bp, Homo sapiens
ctggccaggccc

SEQ ID NO: 4139365 - DNA, 20 bp, Homo sapiens
ctggccatggggccctccca

SEQ ID NO: 4139366 - DNA, 21 bp, Homo sapiens
ctggccatttccaagaggctg

SEQ ID NO: 4139367 - DNA, 23 bp, Homo sapiens
ctggccatttccaagaggctgta

SEQ ID NO: 4139368 - DNA, 20 bp, Homo sapiens
ctggcccagccaaaccctgt

SEQ ID NO: 4139369 - DNA, 18 bp, Homo sapiens
ctggcccagggcccagag

SEQ ID NO: 4139370 - DNA, 20 bp, Homo sapiens
ctggcccagggcccagagcc

SEQ ID NO: 4139371 - DNA, 17 bp, Homo sapiens
ctggcccatctcagcct

SEQ ID NO: 4139372 - DNA, 19 bp, Homo sapiens
ctggcccatctcagcctcc

SEQ ID NO: 4139373 - DNA, 22 bp, Homo sapiens
ctggcccatctcagcctcctga

SEQ ID NO: 4139374 - DNA, 17 bp, Homo sapiens
ctggccccacaccagcc

SEQ ID NO: 4139375 - DNA, 16 bp, Homo sapiens
ctggccccagcctggg

SEQ ID NO: 4139376 - DNA, 17 bp, Homo sapiens
ctggccccaggccccag

SEQ ID NO: 4139377 - DNA, 18 bp, Homo sapiens
ctggccccaggccccaga

SEQ ID NO: 4139378 - DNA, 19 bp, Homo sapiens
ctggccccaggccccagac

SEQ ID NO: 4139379 - DNA, 14 bp, Homo sapiens
ctggccccagggca

SEQ ID NO: 4139380 - DNA, 18 bp, Homo sapiens
ctggcccccaacctcagg

SEQ ID NO: 4139381 - DNA, 22 bp, Homo sapiens
ctggcccccaacctcagggctc

SEQ ID NO: 4139382 - DNA, 23 bp, Homo sapiens
ctggcccccaacctcagggctcc

SEQ ID NO: 4139383 - DNA, 18 bp, Homo sapiens
ctggcccgtcatgttcct

SEQ ID NO: 4139384 - DNA, 21 bp, Homo sapiens
ctggcccgtcatgttcctcaa

SEQ ID NO: 4139385 - DNA, 22 bp, Homo sapiens
ctggcccgtcatgttcctcaaa

SEQ ID NO: 4139386 - DNA, 19 bp, Homo sapiens
ctggccctcgacactcacc

SEQ ID NO: 4139387 - DNA, 11 bp, Homo sapiens
ctggccctgcc

SEQ ID NO: 4139388 - DNA, 15 bp, Homo sapiens
ctggccctgcctcct

SEQ ID NO: 4139389 - DNA, 16 bp, Homo sapiens
ctggccctgcctcctg

SEQ ID NO: 4139390 - DNA, 19 bp, Homo sapiens
ctggccctgcctcctggga

SEQ ID NO: 4139391 - DNA, 21 bp, Homo sapiens
ctggccctgcctcctgggaag

SEQ ID NO: 4139392 - DNA, 24 bp, Homo sapiens
ctggcccttacacactcaggcctg

SEQ ID NO: 4139393 - DNA, 19 bp, Homo sapiens
ctggcccttacttgcttct

SEQ ID NO: 4139394 - DNA, 15 bp, Homo sapiens
ctggccgacccactg

SEQ ID NO: 4139395 - DNA, 13 bp, Homo sapiens
ctggccgcagagg

SEQ ID NO: 4139396 - DNA, 15 bp, Homo sapiens
ctggccgcagaggtg

SEQ ID NO: 4139397 - DNA, 21 bp, Homo sapiens
ctggcctaaaatcttggaagt

SEQ ID NO: 4139398 - DNA, 22 bp, Homo sapiens
ctggcctatccgctgccagcct

SEQ ID NO: 4139399 - DNA, 22 bp, Homo sapiens
ctggcctcacccacccctgcac

SEQ ID NO: 4139400 - DNA, 14 bp, Homo sapiens
ctggcctcccaaat

SEQ ID NO: 4139401 - DNA, 20 bp, Homo sapiens
ctggcctctcactgcctccc

SEQ ID NO: 4139402 - DNA, 14 bp, Homo sapiens
ctggcctctgcctc

SEQ ID NO: 4139403 - DNA, 11 bp, Homo sapiens
ctggcctctgt

SEQ ID NO: 4139404 - DNA, 14 bp, Homo sapiens
ctggcctctgtgcc

SEQ ID NO: 4139405 - DNA, 17 bp, Homo sapiens
ctggcctgaactgagga

SEQ ID NO: 4139406 - DNA, 18 bp, Homo sapiens
ctggcctgaactgaggag

SEQ ID NO: 4139407 - DNA, 12 bp, Homo sapiens
ctggcctgactt

SEQ ID NO: 4139408 - DNA, 13 bp, Homo sapiens
ctggcctgagcaa

SEQ ID NO: 4139409 - DNA, 11 bp, Homo sapiens
ctggcctgagg

SEQ ID NO: 4139410 - DNA, 20 bp, Homo sapiens
ctggcctgcccgtgccctgg

SEQ ID NO: 4139411 - DNA, 22 bp, Homo sapiens
ctggcctggatctccccactct

SEQ ID NO: 4139412 - DNA, 13 bp, Homo sapiens
ctggcctgtctgt

SEQ ID NO: 4139413 - DNA, 14 bp, Homo sapiens
ctggcgcaggtggg

SEQ ID NO: 4139414 - DNA, 16 bp, Homo sapiens
ctggcgcaggtgggct

SEQ ID NO: 4139415 - DNA, 16 bp, Homo sapiens
ctggctacatcccagc

SEQ ID NO: 4139416 - DNA, 20 bp, Homo sapiens
ctggctagaggccagcccca

SEQ ID NO: 4139417 - DNA, 16 bp, Homo sapiens
ctggctcacagtacag

SEQ ID NO: 4139418 - DNA, 17 bp, Homo sapiens
ctggctcacagtacagc

SEQ ID NO: 4139419 - DNA, 14 bp, Homo sapiens
ctggctccactctt

SEQ ID NO: 4139420 - DNA, 15 bp, Homo sapiens
ctggctccagcctgg

SEQ ID NO: 4139421 - DNA, 22 bp, Homo sapiens
ctggctcccacaggcccttcct

SEQ ID NO: 4139422 - DNA, 17 bp, Homo sapiens
ctggctccccctcccca

SEQ ID NO: 4139423 - DNA, 24 bp, Homo sapiens
ctggctccccctccccaggctgga

SEQ ID NO: 4139424 - DNA, 12 bp, Homo sapiens
ctggctcctagg

SEQ ID NO: 4139425 - DNA, 14 bp, Homo sapiens
ctggctcctgaggg

SEQ ID NO: 4139426 - DNA, 16 bp, Homo sapiens
ctggctcctgaggggc

SEQ ID NO: 4139427 - DNA, 16 bp, Homo sapiens
ctggctctaccttcct

SEQ ID NO: 4139428 - DNA, 24 bp, Homo sapiens
ctggctctgcaatgggcactggga

SEQ ID NO: 4139429 - DNA, 14 bp, Homo sapiens
ctggctctgctgtc

SEQ ID NO: 4139430 - DNA, 21 bp, Homo sapiens
ctggctcttgatacccccctc

SEQ ID NO: 4139431 - DNA, 22 bp, Homo sapiens
ctggctcttgatacccccctct

SEQ ID NO: 4139432 - DNA, 19 bp, Homo sapiens
ctggctgaccccaaagagc

SEQ ID NO: 4139433 - DNA, 22 bp, Homo sapiens
ctggctgaccccaaagagcctg

SEQ ID NO: 4139434 - DNA, 23 bp, Homo sapiens
ctggctgagcagttcccctggag

SEQ ID NO: 4139435 - DNA, 13 bp, Homo sapiens
ctggctgagctga

SEQ ID NO: 4139436 - DNA, 20 bp, Homo sapiens
ctggctgaggttcctctgcc

SEQ ID NO: 4139437 - DNA, 22 bp, Homo sapiens
ctggctgaggttcctctgcctg

SEQ ID NO: 4139438 - DNA, 23 bp, Homo sapiens
ctggctgaggttcctctgcctgc

SEQ ID NO: 4139439 - DNA, 16 bp, Homo sapiens
ctggctgccccaacct

SEQ ID NO: 4139440 - DNA, 21 bp, Homo sapiens
ctggctgccccaacctgctga

SEQ ID NO: 4139441 - DNA, 12 bp, Homo sapiens
ctggctgcccct

SEQ ID NO: 4139442 - DNA, 18 bp, Homo sapiens
ctggctgcccctcacctt

SEQ ID NO: 4139443 - DNA, 17 bp, Homo sapiens
ctggctgctgcccccac

SEQ ID NO: 4139444 - DNA, 20 bp, Homo sapiens
ctggctggaggagcagcagc

SEQ ID NO: 4139445 - DNA, 15 bp, Homo sapiens
ctggctggctcctag

SEQ ID NO: 4139446 - DNA, 21 bp, Homo sapiens
ctggctgggacgtggctcagc

SEQ ID NO: 4139447 - DNA, 11 bp, Homo sapiens
ctggctgggcc

SEQ ID NO: 4139448 - DNA, 13 bp, Homo sapiens
ctggctgggccat

SEQ ID NO: 4139449 - DNA, 19 bp, Homo sapiens
ctggctgtcagtatgacat

SEQ ID NO: 4139450 - DNA, 15 bp, Homo sapiens
ctggctgtctagaat

SEQ ID NO: 4139451 - DNA, 23 bp, Homo sapiens
ctggctgttctgtggttcctctg

SEQ ID NO: 4139452 - DNA, 19 bp, Homo sapiens
ctggcttccagcttcaggc

SEQ ID NO: 4139453 - DNA, 22 bp, Homo sapiens
ctggcttccagcttcaggcacc

SEQ ID NO: 4139454 - DNA, 15 bp, Homo sapiens
ctggcttccaggtat

SEQ ID NO: 4139455 - DNA, 19 bp, Homo sapiens
ctggcttttcactgctggc

SEQ ID NO: 4139456 - DNA, 22 bp, Homo sapiens
ctggcttttcactgctggctgc

SEQ ID NO: 4139457 - DNA, 21 bp, Homo sapiens
ctgggaaatgagaaggcagcc

SEQ ID NO: 4139458 - DNA, 19 bp, Homo sapiens
ctgggaagacgcctgagct

SEQ ID NO: 4139459 - DNA, 21 bp, Homo sapiens
ctgggaagataggctctgcac

SEQ ID NO: 4139460 - DNA, 24 bp, Homo sapiens
ctgggaagataggctctgcacaga

SEQ ID NO: 4139461 - DNA, 13 bp, Homo sapiens
ctgggaatgtatt

SEQ ID NO: 4139462 - DNA, 19 bp, Homo sapiens
ctgggaatgtattattctg

SEQ ID NO: 4139463 - DNA, 13 bp, Homo sapiens
ctgggaccagagc

SEQ ID NO: 4139464 - DNA, 14 bp, Homo sapiens
ctgggaccagagcc

SEQ ID NO: 4139465 - DNA, 19 bp, Homo sapiens
ctgggaccagagccagatg

SEQ ID NO: 4139466 - DNA, 17 bp, Homo sapiens
ctgggacctgccaggca

SEQ ID NO: 4139467 - DNA, 18 bp, Homo sapiens
ctgggacctgccaggcag

SEQ ID NO: 4139468 - DNA, 16 bp, Homo sapiens
ctgggacgctctgctg

SEQ ID NO: 4139469 - DNA, 17 bp, Homo sapiens
ctgggacgctctgctgt

SEQ ID NO: 4139470 - DNA, 22 bp, Homo sapiens
ctgggacggaccagcatctgga

SEQ ID NO: 4139471 - DNA, 18 bp, Homo sapiens
ctgggacgtggctcagcc

SEQ ID NO: 4139472 - DNA, 16 bp, Homo sapiens
ctgggagactgggaca

SEQ ID NO: 4139473 - DNA, 19 bp, Homo sapiens
ctgggagattcaagggacc

SEQ ID NO: 4139474 - DNA, 13 bp, Homo sapiens
ctgggagcagaaa

SEQ ID NO: 4139475 - DNA, 16 bp, Homo sapiens
ctgggagcagaaacag

SEQ ID NO: 4139476 - DNA, 21 bp, Homo sapiens
ctgggagcagaaacagccatt

SEQ ID NO: 4139477 - DNA, 17 bp, Homo sapiens
ctgggagccacttctcc

SEQ ID NO: 4139478 - DNA, 19 bp, Homo sapiens
ctgggagccacttctcccc

SEQ ID NO: 4139479 - DNA, 22 bp, Homo sapiens
ctgggagccacttctccccaga

SEQ ID NO: 4139480 - DNA, 13 bp, Homo sapiens
ctgggagccagtc

SEQ ID NO: 4139481 - DNA, 14 bp, Homo sapiens
ctgggagccagtcc

SEQ ID NO: 4139482 - DNA, 22 bp, Homo sapiens
ctgggagcccccaccacaaact

SEQ ID NO: 4139483 - DNA, 19 bp, Homo sapiens
ctgggaggagggagaggga

SEQ ID NO: 4139484 - DNA, 20 bp, Homo sapiens
ctgggaggagggagagggag

SEQ ID NO: 4139485 - DNA, 23 bp, Homo sapiens
ctgggaggagggagagggaggtc

SEQ ID NO: 4139486 - DNA, 18 bp, Homo sapiens
ctgggaggcaagaaaagg

SEQ ID NO: 4139487 - DNA, 16 bp, Homo sapiens
ctgggaggcagggctc

SEQ ID NO: 4139488 - DNA, 19 bp, Homo sapiens
ctgggaggcatggccctgg

SEQ ID NO: 4139489 - DNA, 21 bp, Homo sapiens
ctgggagtagttgtctttcct

SEQ ID NO: 4139490 - DNA, 14 bp, Homo sapiens
ctgggagtcacaca

SEQ ID NO: 4139491 - DNA, 16 bp, Homo sapiens
ctgggagtcagagccc

SEQ ID NO: 4139492 - DNA, 17 bp, Homo sapiens
ctgggagtcagagccct

SEQ ID NO: 4139493 - DNA, 18 bp, Homo sapiens
ctgggagtcagagccctg

SEQ ID NO: 4139494 - DNA, 20 bp, Homo sapiens
ctgggagtccctacctgctt

SEQ ID NO: 4139495 - DNA, 15 bp, Homo sapiens
ctgggatgaggggtg

SEQ ID NO: 4139496 - DNA, 21 bp, Homo sapiens
ctgggatgaggggtgctgggt

SEQ ID NO: 4139497 - DNA, 19 bp, Homo sapiens
ctgggatgggaccagggat

SEQ ID NO: 4139498 - DNA, 20 bp, Homo sapiens
ctgggatgggaccagggatg

SEQ ID NO: 4139499 - DNA, 19 bp, Homo sapiens
ctgggattaagaaaccttg

SEQ ID NO: 4139500 - DNA, 20 bp, Homo sapiens
ctgggattaagaaaccttgc

SEQ ID NO: 4139501 - DNA, 23 bp, Homo sapiens
ctgggattccttagactcttttc

SEQ ID NO: 4139502 - DNA, 21 bp, Homo sapiens
ctgggattctactttaagcac

SEQ ID NO: 4139503 - DNA, 23 bp, Homo sapiens
ctgggattctactttaagcacta

SEQ ID NO: 4139504 - DNA, 23 bp, Homo sapiens
ctgggcaaagccacaaggctggc

SEQ ID NO: 4139505 - DNA, 15 bp, Homo sapiens
ctgggcaacagagca

SEQ ID NO: 4139506 - DNA, 21 bp, Homo sapiens
ctgggcaatgaggcagatagc

SEQ ID NO: 4139507 - DNA, 23 bp, Homo sapiens
ctgggcacacgcacaaacacaca

SEQ ID NO: 4139508 - DNA, 21 bp, Homo sapiens
ctgggcacagctcttcacacc

SEQ ID NO: 4139509 - DNA, 13 bp, Homo sapiens
ctgggcagcccca

SEQ ID NO: 4139510 - DNA, 17 bp, Homo sapiens
ctgggcagccccagaga

SEQ ID NO: 4139511 - DNA, 19 bp, Homo sapiens
ctgggcagccccagagaga

SEQ ID NO: 4139512 - DNA, 22 bp, Homo sapiens
ctgggcagccccagagagagga

SEQ ID NO: 4139513 - DNA, 21 bp, Homo sapiens
ctgggcaggcggtccccatcc

SEQ ID NO: 4139514 - DNA, 16 bp, Homo sapiens
ctgggcatgacatcct

SEQ ID NO: 4139515 - DNA, 19 bp, Homo sapiens
ctgggcatgggtccagggc

SEQ ID NO: 4139516 - DNA, 20 bp, Homo sapiens
ctgggcatgggtccagggcc

SEQ ID NO: 4139517 - DNA, 12 bp, Homo sapiens
ctgggcattgct

SEQ ID NO: 4139518 - DNA, 19 bp, Homo sapiens
ctgggcattttcctcctct

SEQ ID NO: 4139519 - DNA, 15 bp, Homo sapiens
ctgggccactgggga

SEQ ID NO: 4139520 - DNA, 19 bp, Homo sapiens
ctgggccagcggggctgct

SEQ ID NO: 4139521 - DNA, 20 bp, Homo sapiens
ctgggccaggggaggttaca

SEQ ID NO: 4139522 - DNA, 17 bp, Homo sapiens
ctgggccagggtctgtg

SEQ ID NO: 4139523 - DNA, 18 bp, Homo sapiens
ctgggccatgtccaaaga

SEQ ID NO: 4139524 - DNA, 19 bp, Homo sapiens
ctgggccatgtccaaagag

SEQ ID NO: 4139525 - DNA, 23 bp, Homo sapiens
ctgggccatgtccaaagaggctg

SEQ ID NO: 4139526 - DNA, 21 bp, Homo sapiens
ctgggcccacccaagcaggag

SEQ ID NO: 4139527 - DNA, 15 bp, Homo sapiens
ctgggcccctccacg

SEQ ID NO: 4139528 - DNA, 16 bp, Homo sapiens
ctgggcccctccacgc

SEQ ID NO: 4139529 - DNA, 17 bp, Homo sapiens
ctgggcccctccacgcc

SEQ ID NO: 4139530 - DNA, 20 bp, Homo sapiens
ctgggcccctccacgcctcc

SEQ ID NO: 4139531 - DNA, 12 bp, Homo sapiens
ctgggcccctgg

SEQ ID NO: 4139532 - DNA, 17 bp, Homo sapiens
ctgggcccgatttggta

SEQ ID NO: 4139533 - DNA, 22 bp, Homo sapiens
ctgggcccggaagggctttggt

SEQ ID NO: 4139534 - DNA, 18 bp, Homo sapiens
ctgggccctctttccctg

SEQ ID NO: 4139535 - DNA, 13 bp, Homo sapiens
ctgggccctggag

SEQ ID NO: 4139536 - DNA, 21 bp, Homo sapiens
ctgggccgttacatctgtgca

SEQ ID NO: 4139537 - DNA, 20 bp, Homo sapiens
ctgggcctcagttcaacctg

SEQ ID NO: 4139538 - DNA, 20 bp, Homo sapiens
ctgggcctctgactctgagt

SEQ ID NO: 4139539 - DNA, 13 bp, Homo sapiens
ctgggcctctgcc

SEQ ID NO: 4139540 - DNA, 14 bp, Homo sapiens
ctgggcctctgccc

SEQ ID NO: 4139541 - DNA, 20 bp, Homo sapiens
ctgggcctgaccaaacagcc

SEQ ID NO: 4139542 - DNA, 17 bp, Homo sapiens
ctgggcctttgcaagat

SEQ ID NO: 4139543 - DNA, 16 bp, Homo sapiens
ctgggctattgctgct

SEQ ID NO: 4139544 - DNA, 22 bp, Homo sapiens
ctgggctattgctgctgcccct

SEQ ID NO: 4139545 - DNA, 23 bp, Homo sapiens
ctgggctattgctgctgcccctt

SEQ ID NO: 4139546 - DNA, 21 bp, Homo sapiens
ctgggctcaagcaatcctcct

SEQ ID NO: 4139547 - DNA, 14 bp, Homo sapiens
ctgggctcctccag

SEQ ID NO: 4139548 - DNA, 16 bp, Homo sapiens
ctgggctcggaggctg

SEQ ID NO: 4139549 - DNA, 17 bp, Homo sapiens
ctgggctcggaggctgc

SEQ ID NO: 4139550 - DNA, 16 bp, Homo sapiens
ctgggctgagtgacac

SEQ ID NO: 4139551 - DNA, 13 bp, Homo sapiens
ctgggctggactg

SEQ ID NO: 4139552 - DNA, 21 bp, Homo sapiens
ctgggctgggccctctttccc

SEQ ID NO: 4139553 - DNA, 18 bp, Homo sapiens
ctgggctggggaggacct

SEQ ID NO: 4139554 - DNA, 18 bp, Homo sapiens
ctgggctgggtgctggga

SEQ ID NO: 4139555 - DNA, 13 bp, Homo sapiens
ctgggctgggttt

SEQ ID NO: 4139556 - DNA, 16 bp, Homo sapiens
ctgggctgggtttgct

SEQ ID NO: 4139557 - DNA, 23 bp, Homo sapiens
ctgggctgtaacgtggcactggt

SEQ ID NO: 4139558 - DNA, 21 bp, Homo sapiens
ctgggctgtctgtcaccagct

SEQ ID NO: 4139559 - DNA, 14 bp, Homo sapiens
ctgggctgttgttc

SEQ ID NO: 4139560 - DNA, 19 bp, Homo sapiens
ctgggcttggggcttccta

SEQ ID NO: 4139561 - DNA, 12 bp, Homo sapiens
ctggggaaggag

SEQ ID NO: 4139562 - DNA, 15 bp, Homo sapiens
ctggggaaggagcca

SEQ ID NO: 4139563 - DNA, 16 bp, Homo sapiens
ctggggacagcttcct

SEQ ID NO: 4139564 - DNA, 18 bp, Homo sapiens
ctggggacagcttcctca

SEQ ID NO: 4139565 - DNA, 23 bp, Homo sapiens
ctggggaccccaacctcagaggc

SEQ ID NO: 4139566 - DNA, 24 bp, Homo sapiens
ctggggaccccaacctcagaggca

SEQ ID NO: 4139567 - DNA, 20 bp, Homo sapiens
ctggggacctggcactggga

SEQ ID NO: 4139568 - DNA, 14 bp, Homo sapiens
ctggggactcaggg

SEQ ID NO: 4139569 - DNA, 15 bp, Homo sapiens
ctggggactcaggga

SEQ ID NO: 4139570 - DNA, 19 bp, Homo sapiens
ctggggactgttccaaagc

SEQ ID NO: 4139571 - DNA, 23 bp, Homo sapiens
ctggggactgttccaaagccagt

SEQ ID NO: 4139572 - DNA, 23 bp, Homo sapiens
ctggggactttatttatttctag

SEQ ID NO: 4139573 - DNA, 23 bp, Homo sapiens
ctggggagaatggggctgggccc

SEQ ID NO: 4139574 - DNA, 12 bp, Homo sapiens
ctggggagcccg

SEQ ID NO: 4139575 - DNA, 21 bp, Homo sapiens
ctggggaggaatcctggacca

SEQ ID NO: 4139576 - DNA, 19 bp, Homo sapiens
ctggggagtggttaggcag

SEQ ID NO: 4139577 - DNA, 14 bp, Homo sapiens
ctggggcaggctgg

SEQ ID NO: 4139578 - DNA, 16 bp, Homo sapiens
ctggggcaggctgggc

SEQ ID NO: 4139579 - DNA, 19 bp, Homo sapiens
ctggggcaggctgggccat

SEQ ID NO: 4139580 - DNA, 15 bp, Homo sapiens
ctggggcagggggtg

SEQ ID NO: 4139581 - DNA, 18 bp, Homo sapiens
ctggggcatcctgtgcca

SEQ ID NO: 4139582 - DNA, 16 bp, Homo sapiens
ctggggccaccatccc

SEQ ID NO: 4139583 - DNA, 13 bp, Homo sapiens
ctggggccagagg

SEQ ID NO: 4139584 - DNA, 17 bp, Homo sapiens
ctggggccagaggctgg

SEQ ID NO: 4139585 - DNA, 13 bp, Homo sapiens
ctggggcccagcc

SEQ ID NO: 4139586 - DNA, 24 bp, Homo sapiens
ctggggccccgggttcagcctggc

SEQ ID NO: 4139587 - DNA, 13 bp, Homo sapiens
ctggggccctggg

SEQ ID NO: 4139588 - DNA, 15 bp, Homo sapiens
ctggggccctgggcc

SEQ ID NO: 4139589 - DNA, 20 bp, Homo sapiens
ctggggccctgggcctcagt

SEQ ID NO: 4139590 - DNA, 23 bp, Homo sapiens
ctggggcctagcgatctctcctg

SEQ ID NO: 4139591 - DNA, 24 bp, Homo sapiens
ctggggcctagcgatctctcctgg

SEQ ID NO: 4139592 - DNA, 16 bp, Homo sapiens
ctggggcctgactgct

SEQ ID NO: 4139593 - DNA, 20 bp, Homo sapiens
ctggggcctgactgctcaga

SEQ ID NO: 4139594 - DNA, 12 bp, Homo sapiens
ctggggcctgag

SEQ ID NO: 4139595 - DNA, 14 bp, Homo sapiens
ctggggcctgagag

SEQ ID NO: 4139596 - DNA, 17 bp, Homo sapiens
ctggggcctgagagaat

SEQ ID NO: 4139597 - DNA, 19 bp, Homo sapiens
ctggggcggggcccaggag

SEQ ID NO: 4139598 - DNA, 18 bp, Homo sapiens
ctggggctagggggagcc

SEQ ID NO: 4139599 - DNA, 15 bp, Homo sapiens
ctggggctctctgag

SEQ ID NO: 4139600 - DNA, 15 bp, Homo sapiens
ctggggctctgggat

SEQ ID NO: 4139601 - DNA, 15 bp, Homo sapiens
ctggggctggcctcc

SEQ ID NO: 4139602 - DNA, 13 bp, Homo sapiens
ctggggctttgcc

SEQ ID NO: 4139603 - DNA, 21 bp, Homo sapiens
ctggggctttgccttgcagcc

SEQ ID NO: 4139604 - DNA, 20 bp, Homo sapiens
ctgggggaatgagcccagag

SEQ ID NO: 4139605 - DNA, 21 bp, Homo sapiens
ctgggggaatgagcccagaga

SEQ ID NO: 4139606 - DNA, 15 bp, Homo sapiens
ctgggggactgggag

SEQ ID NO: 4139607 - DNA, 16 bp, Homo sapiens
ctgggggactgggagt

SEQ ID NO: 4139608 - DNA, 14 bp, Homo sapiens
ctgggggagagccg

SEQ ID NO: 4139609 - DNA, 14 bp, Homo sapiens
ctgggggcaggagg

SEQ ID NO: 4139610 - DNA, 19 bp, Homo sapiens
ctggggggttggcagccca

SEQ ID NO: 4139611 - DNA, 15 bp, Homo sapiens
ctgggggtgctggat

SEQ ID NO: 4139612 - DNA, 17 bp, Homo sapiens
ctgggggtgctggatgg

SEQ ID NO: 4139613 - DNA, 13 bp, Homo sapiens
ctgggggtggcag

SEQ ID NO: 4139614 - DNA, 20 bp, Homo sapiens
ctggggtaagcggaataaac

SEQ ID NO: 4139615 - DNA, 14 bp, Homo sapiens
ctggggtctgagca

SEQ ID NO: 4139616 - DNA, 13 bp, Homo sapiens
ctggggtctggag

SEQ ID NO: 4139617 - DNA, 19 bp, Homo sapiens
ctggggtgagagaggaaag

SEQ ID NO: 4139618 - DNA, 18 bp, Homo sapiens
ctggggtgcatctcctcc

SEQ ID NO: 4139619 - DNA, 20 bp, Homo sapiens
ctggggtgggaggtcttgct

SEQ ID NO: 4139620 - DNA, 21 bp, Homo sapiens
ctggggtgggaggtcttgcta

SEQ ID NO: 4139621 - DNA, 17 bp, Homo sapiens
ctggggttggcaacagg

SEQ ID NO: 4139622 - DNA, 15 bp, Homo sapiens
ctgggtaatgtgaag

SEQ ID NO: 4139623 - DNA, 18 bp, Homo sapiens
ctgggtactgaaagcctt

SEQ ID NO: 4139624 - DNA, 23 bp, Homo sapiens
ctgggtacttcttgaaggtgctg

SEQ ID NO: 4139625 - DNA, 14 bp, Homo sapiens
ctgggtaggaaaga

SEQ ID NO: 4139626 - DNA, 17 bp, Homo sapiens
ctgggtcacatccatcc

SEQ ID NO: 4139627 - DNA, 21 bp, Homo sapiens
ctgggtcagtctggtgggagg

SEQ ID NO: 4139628 - DNA, 17 bp, Homo sapiens
ctgggtcggccctgccc

SEQ ID NO: 4139629 - DNA, 16 bp, Homo sapiens
ctgggtctgtgtctct

SEQ ID NO: 4139630 - DNA, 23 bp, Homo sapiens
ctgggtgacagagcaagactctg

SEQ ID NO: 4139631 - DNA, 13 bp, Homo sapiens
ctgggtgcaggag

SEQ ID NO: 4139632 - DNA, 16 bp, Homo sapiens
ctgggtggcctcggga

SEQ ID NO: 4139633 - DNA, 13 bp, Homo sapiens
ctgggtgggccca

SEQ ID NO: 4139634 - DNA, 17 bp, Homo sapiens
ctgggtgggcccagaac

SEQ ID NO: 4139635 - DNA, 13 bp, Homo sapiens
ctgggtggggaca

SEQ ID NO: 4139636 - DNA, 17 bp, Homo sapiens
ctgggtttctagaggtc

SEQ ID NO: 4139637 - DNA, 13 bp, Homo sapiens
ctgggtttgctgt

SEQ ID NO: 4139638 - DNA, 14 bp, Homo sapiens
ctggtaccctcctg

SEQ ID NO: 4139639 - DNA, 16 bp, Homo sapiens
ctggtaccctcctggc

SEQ ID NO: 4139640 - DNA, 16 bp, Homo sapiens
ctggtacttcctttct

SEQ ID NO: 4139641 - DNA, 19 bp, Homo sapiens
ctggtacttcctttctccc

SEQ ID NO: 4139642 - DNA, 14 bp, Homo sapiens
ctggtatctcagaa

SEQ ID NO: 4139643 - DNA, 22 bp, Homo sapiens
ctggtatctcagaaagtgcctg

SEQ ID NO: 4139644 - DNA, 22 bp, Homo sapiens
ctggtatgtaaaagaaaatcca

SEQ ID NO: 4139645 - DNA, 15 bp, Homo sapiens
ctggtattgttctca

SEQ ID NO: 4139646 - DNA, 17 bp, Homo sapiens
ctggtattgttctcaca

SEQ ID NO: 4139647 - DNA, 15 bp, Homo sapiens
ctggtcacagcctcc

SEQ ID NO: 4139648 - DNA, 17 bp, Homo sapiens
ctggtcacttcttctgt

SEQ ID NO: 4139649 - DNA, 17 bp, Homo sapiens
ctggtcccttgcagcta

SEQ ID NO: 4139650 - DNA, 19 bp, Homo sapiens
ctggtcctggccgtcccta

SEQ ID NO: 4139651 - DNA, 15 bp, Homo sapiens
ctggtccttaccaga

SEQ ID NO: 4139652 - DNA, 19 bp, Homo sapiens
ctggtccttaccagagacg

SEQ ID NO: 4139653 - DNA, 22 bp, Homo sapiens
ctggtcctttttggtcgaggag

SEQ ID NO: 4139654 - DNA, 12 bp, Homo sapiens
ctggtctctggt

SEQ ID NO: 4139655 - DNA, 19 bp, Homo sapiens
ctggtcttgttagaaaaca

SEQ ID NO: 4139656 - DNA, 18 bp, Homo sapiens
ctggtgaatcacctggct

SEQ ID NO: 4139657 - DNA, 12 bp, Homo sapiens
ctggtgcagtgg

SEQ ID NO: 4139658 - DNA, 14 bp, Homo sapiens
ctggtgcattacag

SEQ ID NO: 4139659 - DNA, 16 bp, Homo sapiens
ctggtgcattacagag

SEQ ID NO: 4139660 - DNA, 18 bp, Homo sapiens
ctggtgcattacagagag

SEQ ID NO: 4139661 - DNA, 21 bp, Homo sapiens
ctggtgccaaaaccaggcctc

SEQ ID NO: 4139662 - DNA, 22 bp, Homo sapiens
ctggtgccagggtgggtgtcca

SEQ ID NO: 4139663 - DNA, 13 bp, Homo sapiens
ctggtgccccaca

SEQ ID NO: 4139664 - DNA, 17 bp, Homo sapiens
ctggtgccccacagcta

SEQ ID NO: 4139665 - DNA, 16 bp, Homo sapiens
ctggtgcctggctctt

SEQ ID NO: 4139666 - DNA, 15 bp, Homo sapiens
ctggtgcggatggac

SEQ ID NO: 4139667 - DNA, 20 bp, Homo sapiens
ctggtgctataggctggaga

SEQ ID NO: 4139668 - DNA, 21 bp, Homo sapiens
ctggtgctataggctggagaa

SEQ ID NO: 4139669 - DNA, 22 bp, Homo sapiens
ctggtgctataggctggagaag

SEQ ID NO: 4139670 - DNA, 17 bp, Homo sapiens
ctggtgctcctgcatct

SEQ ID NO: 4139671 - DNA, 12 bp, Homo sapiens
ctggtgctgcca

SEQ ID NO: 4139672 - DNA, 20 bp, Homo sapiens
ctggtgctgccacacttcag

SEQ ID NO: 4139673 - DNA, 12 bp, Homo sapiens
ctggtgctgtgg

SEQ ID NO: 4139674 - DNA, 17 bp, Homo sapiens
ctggtgctgtggccagg

SEQ ID NO: 4139675 - DNA, 23 bp, Homo sapiens
ctggtgctgtggccagggtgaga

SEQ ID NO: 4139676 - DNA, 16 bp, Homo sapiens
ctggtggaccacaggc

SEQ ID NO: 4139677 - DNA, 19 bp, Homo sapiens
ctggtggcaccagatgcaa

SEQ ID NO: 4139678 - DNA, 16 bp, Homo sapiens
ctggtgggcagctgag

SEQ ID NO: 4139679 - DNA, 17 bp, Homo sapiens
ctggtgggcagctgagg

SEQ ID NO: 4139680 - DNA, 16 bp, Homo sapiens
ctggtggtcagatgca

SEQ ID NO: 4139681 - DNA, 17 bp, Homo sapiens
ctggtggtttttgctct

SEQ ID NO: 4139682 - DNA, 22 bp, Homo sapiens
ctggtgtgaactcaccctggga

SEQ ID NO: 4139683 - DNA, 18 bp, Homo sapiens
ctggtgtgacctgagggc

SEQ ID NO: 4139684 - DNA, 14 bp, Homo sapiens
ctggtgtgtggtga

SEQ ID NO: 4139685 - DNA, 20 bp, Homo sapiens
ctggttaacagcagtccttt

SEQ ID NO: 4139686 - DNA, 13 bp, Homo sapiens
ctggttactcagg

SEQ ID NO: 4139687 - DNA, 14 bp, Homo sapiens
ctggttactcaggg

SEQ ID NO: 4139688 - DNA, 17 bp, Homo sapiens
ctggttactcagggttc

SEQ ID NO: 4139689 - DNA, 19 bp, Homo sapiens
ctggttccttcctatgccc

SEQ ID NO: 4139690 - DNA, 12 bp, Homo sapiens
ctggttgatttg

SEQ ID NO: 4139691 - DNA, 21 bp, Homo sapiens
ctggttgatttgtaacacagt

SEQ ID NO: 4139692 - DNA, 19 bp, Homo sapiens
ctggttgtttctgttccaa

SEQ ID NO: 4139693 - DNA, 17 bp, Homo sapiens
ctggtttacaggccctg

SEQ ID NO: 4139694 - DNA, 18 bp, Homo sapiens
ctggtttacaggccctgc

SEQ ID NO: 4139695 - DNA, 22 bp, Homo sapiens
ctggtttacaggccctgctcct

SEQ ID NO: 4139696 - DNA, 16 bp, Homo sapiens
ctggtttctcattctt

SEQ ID NO: 4139697 - DNA, 16 bp, Homo sapiens
ctggtttgttccctgt

SEQ ID NO: 4139698 - DNA, 17 bp, Homo sapiens
ctggttttgtacactgc

SEQ ID NO: 4139699 - DNA, 23 bp, Homo sapiens
ctggttttgtacactgctgtacc

SEQ ID NO: 4139700 - DNA, 13 bp, Homo sapiens
ctggtttttctca

SEQ ID NO: 4139701 - DNA, 20 bp, Homo sapiens
ctgtaaaaacactgaaaaat

SEQ ID NO: 4139702 - DNA, 19 bp, Homo sapiens
ctgtaaaagcaagtcctgc

SEQ ID NO: 4139703 - DNA, 15 bp, Homo sapiens
ctgtaaaatgaaatt

SEQ ID NO: 4139704 - DNA, 20 bp, Homo sapiens
ctgtaaacctctcgagggca

SEQ ID NO: 4139705 - DNA, 11 bp, Homo sapiens
ctgtaaataac

SEQ ID NO: 4139706 - DNA, 18 bp, Homo sapiens
ctgtaaatggtgtacata

SEQ ID NO: 4139707 - DNA, 16 bp, Homo sapiens
ctgtaacttaaaatag

SEQ ID NO: 4139708 - DNA, 20 bp, Homo sapiens
ctgtaagaagagactgggaa

SEQ ID NO: 4139709 - DNA, 23 bp, Homo sapiens
ctgtaagaagagactgggaagat

SEQ ID NO: 4139710 - DNA, 16 bp, Homo sapiens
ctgtaagaagagccat

SEQ ID NO: 4139711 - DNA, 13 bp, Homo sapiens
ctgtaagcctgca

SEQ ID NO: 4139712 - DNA, 21 bp, Homo sapiens
ctgtaagttacatgaaggcag

SEQ ID NO: 4139713 - DNA, 15 bp, Homo sapiens
ctgtaatatttagct

SEQ ID NO: 4139714 - DNA, 15 bp, Homo sapiens
ctgtaatcccagcac

SEQ ID NO: 4139715 - DNA, 20 bp, Homo sapiens
ctgtaatcccagcactttgg

SEQ ID NO: 4139716 - DNA, 20 bp, Homo sapiens
ctgtaatcgccctactattc

SEQ ID NO: 4139717 - DNA, 13 bp, Homo sapiens
ctgtaattttata

SEQ ID NO: 4139718 - DNA, 13 bp, Homo sapiens
ctgtacaaagtag

SEQ ID NO: 4139719 - DNA, 23 bp, Homo sapiens
ctgtacacattcctgcattcatg

SEQ ID NO: 4139720 - DNA, 21 bp, Homo sapiens
ctgtacagaaagtatcacaaa

SEQ ID NO: 4139721 - DNA, 17 bp, Homo sapiens
ctgtacagaatttccac

SEQ ID NO: 4139722 - DNA, 15 bp, Homo sapiens
ctgtacagtgttacc

SEQ ID NO: 4139723 - DNA, 19 bp, Homo sapiens
ctgtacatattactgttgc

SEQ ID NO: 4139724 - DNA, 20 bp, Homo sapiens
ctgtacatatttgagactag

SEQ ID NO: 4139725 - DNA, 14 bp, Homo sapiens
ctgtacatctattt

SEQ ID NO: 4139726 - DNA, 20 bp, Homo sapiens
ctgtaccaaatctgacatat

SEQ ID NO: 4139727 - DNA, 14 bp, Homo sapiens
ctgtacccagatgc

SEQ ID NO: 4139728 - DNA, 15 bp, Homo sapiens
ctgtacccagatgcc

SEQ ID NO: 4139729 - DNA, 17 bp, Homo sapiens
ctgtacccagatgccta

SEQ ID NO: 4139730 - DNA, 21 bp, Homo sapiens
ctgtactcctcccaggcgccc

SEQ ID NO: 4139731 - DNA, 16 bp, Homo sapiens
ctgtactgacttgagg

SEQ ID NO: 4139732 - DNA, 18 bp, Homo sapiens
ctgtacttaataaattca

SEQ ID NO: 4139733 - DNA, 20 bp, Homo sapiens
ctgtacttcaagttaaagtg

SEQ ID NO: 4139734 - DNA, 18 bp, Homo sapiens
ctgtagagccttctgatg

SEQ ID NO: 4139735 - DNA, 17 bp, Homo sapiens
ctgtagagttgctgaga

SEQ ID NO: 4139736 - DNA, 14 bp, Homo sapiens
ctgtagataaataa

SEQ ID NO: 4139737 - DNA, 17 bp, Homo sapiens
ctgtagatgcagaaaaa

SEQ ID NO: 4139738 - DNA, 22 bp, Homo sapiens
ctgtagatgcagaaaaagaaaa

SEQ ID NO: 4139739 - DNA, 21 bp, Homo sapiens
ctgtagattgcttctgtagta

SEQ ID NO: 4139740 - DNA, 21 bp, Homo sapiens
ctgtagcagtgagaaaaagct

SEQ ID NO: 4139741 - DNA, 15 bp, Homo sapiens
ctgtagccacagctg

SEQ ID NO: 4139742 - DNA, 15 bp, Homo sapiens
ctgtagccagcacct

SEQ ID NO: 4139743 - DNA, 13 bp, Homo sapiens
ctgtagccatctg

SEQ ID NO: 4139744 - DNA, 14 bp, Homo sapiens
ctgtagccatctgc

SEQ ID NO: 4139745 - DNA, 16 bp, Homo sapiens
ctgtagcttttaggaa

SEQ ID NO: 4139746 - DNA, 17 bp, Homo sapiens
ctgtagggctggaccta

SEQ ID NO: 4139747 - DNA, 18 bp, Homo sapiens
ctgtagtaaactatttat

SEQ ID NO: 4139748 - DNA, 19 bp, Homo sapiens
ctgtagtaaactatttatc

SEQ ID NO: 4139749 - DNA, 23 bp, Homo sapiens
ctgtagtactccttaagaacaca

SEQ ID NO: 4139750 - DNA, 16 bp, Homo sapiens
ctgtagtcatttacta

SEQ ID NO: 4139751 - DNA, 15 bp, Homo sapiens
ctgtagtcccagcca

SEQ ID NO: 4139752 - DNA, 23 bp, Homo sapiens
ctgtagtcccagccactcgggag

SEQ ID NO: 4139753 - DNA, 22 bp, Homo sapiens
ctgtagtcccagctactcggga

SEQ ID NO: 4139754 - DNA, 22 bp, Homo sapiens
ctgtagtcctagccactcagga

SEQ ID NO: 4139755 - DNA, 23 bp, Homo sapiens
ctgtagtcctagccactcaggag

SEQ ID NO: 4139756 - DNA, 12 bp, Homo sapiens
ctgtagtgtagt

SEQ ID NO: 4139757 - DNA, 23 bp, Homo sapiens
ctgtagtttatggcagaagggaa

SEQ ID NO: 4139758 - DNA, 15 bp, Homo sapiens
ctgtataaataggag

SEQ ID NO: 4139759 - DNA, 12 bp, Homo sapiens
ctgtataaatgt

SEQ ID NO: 4139760 - DNA, 14 bp, Homo sapiens
ctgtataaatgtct

SEQ ID NO: 4139761 - DNA, 15 bp, Homo sapiens
ctgtataaatgtcta

SEQ ID NO: 4139762 - DNA, 20 bp, Homo sapiens
ctgtataaatgtctattatt

SEQ ID NO: 4139763 - DNA, 14 bp, Homo sapiens
ctgtataagcactg

SEQ ID NO: 4139764 - DNA, 21 bp, Homo sapiens
ctgtatacagtgcagagcctt

SEQ ID NO: 4139765 - DNA, 22 bp, Homo sapiens
ctgtatacagtgcagagccttc

SEQ ID NO: 4139766 - DNA, 17 bp, Homo sapiens
ctgtatagaaatctaaa

SEQ ID NO: 4139767 - DNA, 15 bp, Homo sapiens
ctgtatataaatgtg

SEQ ID NO: 4139768 - DNA, 22 bp, Homo sapiens
ctgtatattacagatatttgtc

SEQ ID NO: 4139769 - DNA, 15 bp, Homo sapiens
ctgtatttcatgtgg

SEQ ID NO: 4139770 - DNA, 15 bp, Homo sapiens
ctgtatttctaggca

SEQ ID NO: 4139771 - DNA, 18 bp, Homo sapiens
ctgtatttttttttctaa

SEQ ID NO: 4139772 - DNA, 20 bp, Homo sapiens
ctgtcaagttaacaaggaat

SEQ ID NO: 4139773 - DNA, 22 bp, Homo sapiens
ctgtcaagttaacaaggaatgc

SEQ ID NO: 4139774 - DNA, 13 bp, Homo sapiens
ctgtcaataaaca

SEQ ID NO: 4139775 - DNA, 15 bp, Homo sapiens
ctgtcacaccagcca

SEQ ID NO: 4139776 - DNA, 16 bp, Homo sapiens
ctgtcacaccagccat

SEQ ID NO: 4139777 - DNA, 13 bp, Homo sapiens
ctgtcaccaaatt

SEQ ID NO: 4139778 - DNA, 15 bp, Homo sapiens
ctgtcaccaaggaaa

SEQ ID NO: 4139779 - DNA, 16 bp, Homo sapiens
ctgtcaccaaggaaac

SEQ ID NO: 4139780 - DNA, 15 bp, Homo sapiens
ctgtcacccccactc

SEQ ID NO: 4139781 - DNA, 17 bp, Homo sapiens
ctgtcacccccactccc

SEQ ID NO: 4139782 - DNA, 19 bp, Homo sapiens
ctgtcacccgatcgccagc

SEQ ID NO: 4139783 - DNA, 16 bp, Homo sapiens
ctgtcaccctccacct

SEQ ID NO: 4139784 - DNA, 18 bp, Homo sapiens
ctgtcacggggttccctc

SEQ ID NO: 4139785 - DNA, 22 bp, Homo sapiens
ctgtcacggggttccctcctag

SEQ ID NO: 4139786 - DNA, 21 bp, Homo sapiens
ctgtcactcattgctgagcct

SEQ ID NO: 4139787 - DNA, 15 bp, Homo sapiens
ctgtcactggctggc

SEQ ID NO: 4139788 - DNA, 19 bp, Homo sapiens
ctgtcactggctggctcct

SEQ ID NO: 4139789 - DNA, 19 bp, Homo sapiens
ctgtcactgtttctctgct

SEQ ID NO: 4139790 - DNA, 20 bp, Homo sapiens
ctgtcactgtttctctgctg

SEQ ID NO: 4139791 - DNA, 17 bp, Homo sapiens
ctgtcactttgctctgg

SEQ ID NO: 4139792 - DNA, 19 bp, Homo sapiens
ctgtcactttgctctgggt

SEQ ID NO: 4139793 - DNA, 20 bp, Homo sapiens
ctgtcagccagccgccctgg

SEQ ID NO: 4139794 - DNA, 16 bp, Homo sapiens
ctgtcatctctctggg

SEQ ID NO: 4139795 - DNA, 14 bp, Homo sapiens
ctgtcattgcttct

SEQ ID NO: 4139796 - DNA, 18 bp, Homo sapiens
ctgtcattgcttcttctg

SEQ ID NO: 4139797 - DNA, 15 bp, Homo sapiens
ctgtcatttgaacct

SEQ ID NO: 4139798 - DNA, 17 bp, Homo sapiens
ctgtcatttgaacctgg

SEQ ID NO: 4139799 - DNA, 20 bp, Homo sapiens
ctgtccaaaggaggctggca

SEQ ID NO: 4139800 - DNA, 15 bp, Homo sapiens
ctgtccaagcagatt

SEQ ID NO: 4139801 - DNA, 22 bp, Homo sapiens
ctgtccagattattggctgctt

SEQ ID NO: 4139802 - DNA, 13 bp, Homo sapiens
ctgtccagctcca

SEQ ID NO: 4139803 - DNA, 14 bp, Homo sapiens
ctgtccagctccaa

SEQ ID NO: 4139804 - DNA, 17 bp, Homo sapiens
ctgtccagctccaacct

SEQ ID NO: 4139805 - DNA, 13 bp, Homo sapiens
ctgtccagctggg

SEQ ID NO: 4139806 - DNA, 15 bp, Homo sapiens
ctgtccagctggggc

SEQ ID NO: 4139807 - DNA, 21 bp, Homo sapiens
ctgtccagctggggccagagg

SEQ ID NO: 4139808 - DNA, 14 bp, Homo sapiens
ctgtccatggcctt

SEQ ID NO: 4139809 - DNA, 21 bp, Homo sapiens
ctgtccatttatccacaggaa

SEQ ID NO: 4139810 - DNA, 23 bp, Homo sapiens
ctgtcccacccacacagctgccc

SEQ ID NO: 4139811 - DNA, 14 bp, Homo sapiens
ctgtcccaccccta

SEQ ID NO: 4139812 - DNA, 17 bp, Homo sapiens
ctgtcccatggacactc

SEQ ID NO: 4139813 - DNA, 12 bp, Homo sapiens
ctgtccccaccc

SEQ ID NO: 4139814 - DNA, 19 bp, Homo sapiens
ctgtccccagccctgtcct

SEQ ID NO: 4139815 - DNA, 20 bp, Homo sapiens
ctgtccccagccctgtcctg

SEQ ID NO: 4139816 - DNA, 23 bp, Homo sapiens
ctgtccccctcccctcccagtcc

SEQ ID NO: 4139817 - DNA, 23 bp, Homo sapiens
ctgtccctatctattaaagtgac

SEQ ID NO: 4139818 - DNA, 12 bp, Homo sapiens
ctgtccctcact

SEQ ID NO: 4139819 - DNA, 17 bp, Homo sapiens
ctgtccctctagtgcct

SEQ ID NO: 4139820 - DNA, 19 bp, Homo sapiens
ctgtccctctagtgccttc

SEQ ID NO: 4139821 - DNA, 11 bp, Homo sapiens
ctgtccctctt

SEQ ID NO: 4139822 - DNA, 12 bp, Homo sapiens
ctgtccctgagg

SEQ ID NO: 4139823 - DNA, 16 bp, Homo sapiens
ctgtcccttctcttaa

SEQ ID NO: 4139824 - DNA, 21 bp, Homo sapiens
ctgtcccttctcttaatttaa

SEQ ID NO: 4139825 - DNA, 14 bp, Homo sapiens
ctgtcccttgcctc

SEQ ID NO: 4139826 - DNA, 15 bp, Homo sapiens
ctgtcccttgcctct

SEQ ID NO: 4139827 - DNA, 16 bp, Homo sapiens
ctgtcccttgcctctg

SEQ ID NO: 4139828 - DNA, 18 bp, Homo sapiens
ctgtcccttgctgtatgc

SEQ ID NO: 4139829 - DNA, 20 bp, Homo sapiens
ctgtcctaaggaaccttcct

SEQ ID NO: 4139830 - DNA, 19 bp, Homo sapiens
ctgtcctaccagttgccct

SEQ ID NO: 4139831 - DNA, 15 bp, Homo sapiens
ctgtcctcatgaccc

SEQ ID NO: 4139832 - DNA, 19 bp, Homo sapiens
ctgtcctcccatcccctgg

SEQ ID NO: 4139833 - DNA, 18 bp, Homo sapiens
ctgtcctctcccctccag

SEQ ID NO: 4139834 - DNA, 18 bp, Homo sapiens
ctgtcctctcgagcccag

SEQ ID NO: 4139835 - DNA, 16 bp, Homo sapiens
ctgtcctgatctgtga

SEQ ID NO: 4139836 - DNA, 14 bp, Homo sapiens
ctgtcctgcagcaa

SEQ ID NO: 4139837 - DNA, 23 bp, Homo sapiens
ctgtcctgggcatgggtccaggg

SEQ ID NO: 4139838 - DNA, 14 bp, Homo sapiens
ctgtcctgggcctg

SEQ ID NO: 4139839 - DNA, 14 bp, Homo sapiens
ctgtcctgtacatt

SEQ ID NO: 4139840 - DNA, 22 bp, Homo sapiens
ctgtcctgtacattgtgggatg

SEQ ID NO: 4139841 - DNA, 12 bp, Homo sapiens
ctgtcctgtcct

SEQ ID NO: 4139842 - DNA, 14 bp, Homo sapiens
ctgtccttcagatg

SEQ ID NO: 4139843 - DNA, 13 bp, Homo sapiens
ctgtcgagacact

SEQ ID NO: 4139844 - DNA, 14 bp, Homo sapiens
ctgtcgagcctggg

SEQ ID NO: 4139845 - DNA, 13 bp, Homo sapiens
ctgtcgccccagg

SEQ ID NO: 4139846 - DNA, 14 bp, Homo sapiens
ctgtcggagaggct

SEQ ID NO: 4139847 - DNA, 13 bp, Homo sapiens
ctgtctaaaaaac

SEQ ID NO: 4139848 - DNA, 14 bp, Homo sapiens
ctgtctaaccccca

SEQ ID NO: 4139849 - DNA, 18 bp, Homo sapiens
ctgtctaacccccagctg

SEQ ID NO: 4139850 - DNA, 13 bp, Homo sapiens
ctgtctacaaata

SEQ ID NO: 4139851 - DNA, 14 bp, Homo sapiens
ctgtctagaatgtg

SEQ ID NO: 4139852 - DNA, 18 bp, Homo sapiens
ctgtctagcacttccttg

SEQ ID NO: 4139853 - DNA, 20 bp, Homo sapiens
ctgtctagcacttccttgcc

SEQ ID NO: 4139854 - DNA, 23 bp, Homo sapiens
ctgtctagcacttccttgccagt

SEQ ID NO: 4139855 - DNA, 21 bp, Homo sapiens
ctgtctcaagagggcactggt

SEQ ID NO: 4139856 - DNA, 17 bp, Homo sapiens
ctgtctcagcctcccag

SEQ ID NO: 4139857 - DNA, 17 bp, Homo sapiens
ctgtctcatccccaggg

SEQ ID NO: 4139858 - DNA, 14 bp, Homo sapiens
ctgtctcatcctcc

SEQ ID NO: 4139859 - DNA, 18 bp, Homo sapiens
ctgtctcatcctcctgga

SEQ ID NO: 4139860 - DNA, 17 bp, Homo sapiens
ctgtctccagctgcctg

SEQ ID NO: 4139861 - DNA, 19 bp, Homo sapiens
ctgtctccagctgcctggg

SEQ ID NO: 4139862 - DNA, 21 bp, Homo sapiens
ctgtctccagctgcctgggcc

SEQ ID NO: 4139863 - DNA, 20 bp, Homo sapiens
ctgtctctaacttattttat

SEQ ID NO: 4139864 - DNA, 19 bp, Homo sapiens
ctgtctctttaagggcatg

SEQ ID NO: 4139865 - DNA, 21 bp, Homo sapiens
ctgtctgaaccacgcgggggc

SEQ ID NO: 4139866 - DNA, 20 bp, Homo sapiens
ctgtctgacaacctcttggt

SEQ ID NO: 4139867 - DNA, 22 bp, Homo sapiens
ctgtctgagactcacaggaagg

SEQ ID NO: 4139868 - DNA, 18 bp, Homo sapiens
ctgtctgccccagcccag

SEQ ID NO: 4139869 - DNA, 12 bp, Homo sapiens
ctgtctgctcca

SEQ ID NO: 4139870 - DNA, 14 bp, Homo sapiens
ctgtctggggcctt

SEQ ID NO: 4139871 - DNA, 13 bp, Homo sapiens
ctgtctgtcacca

SEQ ID NO: 4139872 - DNA, 22 bp, Homo sapiens
ctgtctgtcaccagctatctgt

SEQ ID NO: 4139873 - DNA, 17 bp, Homo sapiens
ctgtctgttatgatttc

SEQ ID NO: 4139874 - DNA, 20 bp, Homo sapiens
ctgtcttcaggctctgccca

SEQ ID NO: 4139875 - DNA, 14 bp, Homo sapiens
ctgtcttccaagga

SEQ ID NO: 4139876 - DNA, 15 bp, Homo sapiens
ctgtcttccaaggag

SEQ ID NO: 4139877 - DNA, 17 bp, Homo sapiens
ctgtcttcggccgagct

SEQ ID NO: 4139878 - DNA, 23 bp, Homo sapiens
ctgtcttcggccgagctggtttc

SEQ ID NO: 4139879 - DNA, 18 bp, Homo sapiens
ctgtcttgttaatgcttt

SEQ ID NO: 4139880 - DNA, 16 bp, Homo sapiens
ctgtctttaaggaaaa

SEQ ID NO: 4139881 - DNA, 16 bp, Homo sapiens
ctgtctttaattctgt

SEQ ID NO: 4139882 - DNA, 21 bp, Homo sapiens
ctgtcttttcaggtttgtcat

SEQ ID NO: 4139883 - DNA, 15 bp, Homo sapiens
ctgtgaaatataatt

SEQ ID NO: 4139884 - DNA, 19 bp, Homo sapiens
ctgtgaacagagagaccct

SEQ ID NO: 4139885 - DNA, 15 bp, Homo sapiens
ctgtgaacaggctgg

SEQ ID NO: 4139886 - DNA, 17 bp, Homo sapiens
ctgtgaacttgactggg

SEQ ID NO: 4139887 - DNA, 19 bp, Homo sapiens
ctgtgaacttgactgggtg

SEQ ID NO: 4139888 - DNA, 17 bp, Homo sapiens
ctgtgaagacccagcag

SEQ ID NO: 4139889 - DNA, 21 bp, Homo sapiens
ctgtgaagacccagcaggaag

SEQ ID NO: 4139890 - DNA, 14 bp, Homo sapiens
ctgtgaaggaccct

SEQ ID NO: 4139891 - DNA, 13 bp, Homo sapiens
ctgtgaagttaca

SEQ ID NO: 4139892 - DNA, 23 bp, Homo sapiens
ctgtgaagttacatgcataaaag

SEQ ID NO: 4139893 - DNA, 18 bp, Homo sapiens
ctgtgaagtttacattgt

SEQ ID NO: 4139894 - DNA, 16 bp, Homo sapiens
ctgtgaatacaattaa

SEQ ID NO: 4139895 - DNA, 15 bp, Homo sapiens
ctgtgaatacttgaa

SEQ ID NO: 4139896 - DNA, 15 bp, Homo sapiens
ctgtgaatcaatcct

SEQ ID NO: 4139897 - DNA, 16 bp, Homo sapiens
ctgtgacatggtgcct

SEQ ID NO: 4139898 - DNA, 18 bp, Homo sapiens
ctgtgacatggtgcctga

SEQ ID NO: 4139899 - DNA, 19 bp, Homo sapiens
ctgtgacatggtgcctgag

SEQ ID NO: 4139900 - DNA, 21 bp, Homo sapiens
ctgtgacatggtgcctgagag

SEQ ID NO: 4139901 - DNA, 24 bp, Homo sapiens
ctgtgacatggtgcctgagaggca

SEQ ID NO: 4139902 - DNA, 13 bp, Homo sapiens
ctgtgacatgtaa

SEQ ID NO: 4139903 - DNA, 17 bp, Homo sapiens
ctgtgaccaccttctgt

SEQ ID NO: 4139904 - DNA, 22 bp, Homo sapiens
ctgtgaccaccttctgtcccca

SEQ ID NO: 4139905 - DNA, 18 bp, Homo sapiens
ctgtgaccaggaaggaag

SEQ ID NO: 4139906 - DNA, 19 bp, Homo sapiens
ctgtgaccatttataatgt

SEQ ID NO: 4139907 - DNA, 13 bp, Homo sapiens
ctgtgacccccag

SEQ ID NO: 4139908 - DNA, 16 bp, Homo sapiens
ctgtgacccccagctc

SEQ ID NO: 4139909 - DNA, 18 bp, Homo sapiens
ctgtgacccccagctccg

SEQ ID NO: 4139910 - DNA, 15 bp, Homo sapiens
ctgtgagacccccac

SEQ ID NO: 4139911 - DNA, 17 bp, Homo sapiens
ctgtgagacccccacac

SEQ ID NO: 4139912 - DNA, 20 bp, Homo sapiens
ctgtgagacccccacacctc

SEQ ID NO: 4139913 - DNA, 14 bp, Homo sapiens
ctgtgagaggcagc

SEQ ID NO: 4139914 - DNA, 21 bp, Homo sapiens
ctgtgagcccctggtcctgag

SEQ ID NO: 4139915 - DNA, 17 bp, Homo sapiens
ctgtgaggaatgctctg

SEQ ID NO: 4139916 - DNA, 19 bp, Homo sapiens
ctgtgaggaatgctctgtg

SEQ ID NO: 4139917 - DNA, 18 bp, Homo sapiens
ctgtgaggcccctggaca

SEQ ID NO: 4139918 - DNA, 17 bp, Homo sapiens
ctgtgaggctgtcctgt

SEQ ID NO: 4139919 - DNA, 16 bp, Homo sapiens
ctgtgaggtgctgatg

SEQ ID NO: 4139920 - DNA, 17 bp, Homo sapiens
ctgtgagtaaatattga

SEQ ID NO: 4139921 - DNA, 19 bp, Homo sapiens
ctgtgatagttcaccccct

SEQ ID NO: 4139922 - DNA, 16 bp, Homo sapiens
ctgtgatatgtctgct

SEQ ID NO: 4139923 - DNA, 20 bp, Homo sapiens
ctgtgatatgtctgctgagt

SEQ ID NO: 4139924 - DNA, 13 bp, Homo sapiens
ctgtgatcattta

SEQ ID NO: 4139925 - DNA, 19 bp, Homo sapiens
ctgtgatcatttattttaa

SEQ ID NO: 4139926 - DNA, 14 bp, Homo sapiens
ctgtgatgccacac

SEQ ID NO: 4139927 - DNA, 13 bp, Homo sapiens
ctgtgattcagaa

SEQ ID NO: 4139928 - DNA, 20 bp, Homo sapiens
ctgtgcacaaaacccagacc

SEQ ID NO: 4139929 - DNA, 13 bp, Homo sapiens
ctgtgcactgccc

SEQ ID NO: 4139930 - DNA, 14 bp, Homo sapiens
ctgtgcactgccct

SEQ ID NO: 4139931 - DNA, 16 bp, Homo sapiens
ctgtgcactgccctgt

SEQ ID NO: 4139932 - DNA, 13 bp, Homo sapiens
ctgtgcagaataa

SEQ ID NO: 4139933 - DNA, 15 bp, Homo sapiens
ctgtgcagaataatg

SEQ ID NO: 4139934 - DNA, 17 bp, Homo sapiens
ctgtgcagatgagcagt

SEQ ID NO: 4139935 - DNA, 17 bp, Homo sapiens
ctgtgcagcgcagctgg

SEQ ID NO: 4139936 - DNA, 16 bp, Homo sapiens
ctgtgcagtcactgga

SEQ ID NO: 4139937 - DNA, 21 bp, Homo sapiens
ctgtgcatctagcctcaagct

SEQ ID NO: 4139938 - DNA, 16 bp, Homo sapiens
ctgtgccagcccagag

SEQ ID NO: 4139939 - DNA, 15 bp, Homo sapiens
ctgtgccagggcagc

SEQ ID NO: 4139940 - DNA, 16 bp, Homo sapiens
ctgtgccatgctgggc

SEQ ID NO: 4139941 - DNA, 22 bp, Homo sapiens
ctgtgcccacatcccaggcttc

SEQ ID NO: 4139942 - DNA, 23 bp, Homo sapiens
ctgtgcccacatcccaggcttca

SEQ ID NO: 4139943 - DNA, 14 bp, Homo sapiens
ctgtgcctctggga

SEQ ID NO: 4139944 - DNA, 15 bp, Homo sapiens
ctgtgcctgcactga

SEQ ID NO: 4139945 - DNA, 15 bp, Homo sapiens
ctgtgcctggcccca

SEQ ID NO: 4139946 - DNA, 19 bp, Homo sapiens
ctgtgcctggccccagcct

SEQ ID NO: 4139947 - DNA, 17 bp, Homo sapiens
ctgtgcgtggaaaaaga

SEQ ID NO: 4139948 - DNA, 13 bp, Homo sapiens
ctgtgctatgaat

SEQ ID NO: 4139949 - DNA, 22 bp, Homo sapiens
ctgtgctccgccatggtgtccc

SEQ ID NO: 4139950 - DNA, 23 bp, Homo sapiens
ctgtgctccgccatggtgtcccg

SEQ ID NO: 4139951 - DNA, 14 bp, Homo sapiens
ctgtgctgaatgct

SEQ ID NO: 4139952 - DNA, 20 bp, Homo sapiens
ctgtgctgctgttactgtta

SEQ ID NO: 4139953 - DNA, 13 bp, Homo sapiens
ctgtgctggggga

SEQ ID NO: 4139954 - DNA, 15 bp, Homo sapiens
ctgtgctgtggaagc

SEQ ID NO: 4139955 - DNA, 18 bp, Homo sapiens
ctgtgctgtgtttaatca

SEQ ID NO: 4139956 - DNA, 16 bp, Homo sapiens
ctgtgcttgaaggccc

SEQ ID NO: 4139957 - DNA, 18 bp, Homo sapiens
ctgtggaacataaaaagg

SEQ ID NO: 4139958 - DNA, 19 bp, Homo sapiens
ctgtggaatgagtgtgcat

SEQ ID NO: 4139959 - DNA, 22 bp, Homo sapiens
ctgtggaccgtggacaggccca

SEQ ID NO: 4139960 - DNA, 20 bp, Homo sapiens
ctgtggagcaaaaggcagct

SEQ ID NO: 4139961 - DNA, 17 bp, Homo sapiens
ctgtggagctcagcccc

SEQ ID NO: 4139962 - DNA, 16 bp, Homo sapiens
ctgtggaggaaggatt

SEQ ID NO: 4139963 - DNA, 19 bp, Homo sapiens
ctgtggaggaaggattgta

SEQ ID NO: 4139964 - DNA, 17 bp, Homo sapiens
ctgtggaggattgctat

SEQ ID NO: 4139965 - DNA, 20 bp, Homo sapiens
ctgtggatacccttaccctt

SEQ ID NO: 4139966 - DNA, 14 bp, Homo sapiens
ctgtggccctggag

SEQ ID NO: 4139967 - DNA, 16 bp, Homo sapiens
ctgtggccctggccac

SEQ ID NO: 4139968 - DNA, 22 bp, Homo sapiens
ctgtggccctggccactaaagc

SEQ ID NO: 4139969 - DNA, 19 bp, Homo sapiens
ctgtggccgtctcctccct

SEQ ID NO: 4139970 - DNA, 18 bp, Homo sapiens
ctgtggcgttctgctgcc

SEQ ID NO: 4139971 - DNA, 14 bp, Homo sapiens
ctgtggctctgcat

SEQ ID NO: 4139972 - DNA, 21 bp, Homo sapiens
ctgtgggcacaggtcaggcta

SEQ ID NO: 4139973 - DNA, 19 bp, Homo sapiens
ctgtgggcagcaccctccc

SEQ ID NO: 4139974 - DNA, 17 bp, Homo sapiens
ctgtgggcccctcaaca

SEQ ID NO: 4139975 - DNA, 23 bp, Homo sapiens
ctgtgggggtgagggtcccatgt

SEQ ID NO: 4139976 - DNA, 14 bp, Homo sapiens
ctgtgggggtggcc

SEQ ID NO: 4139977 - DNA, 17 bp, Homo sapiens
ctgtgggggtggccatc

SEQ ID NO: 4139978 - DNA, 20 bp, Homo sapiens
ctgtgggggtggccatccct

SEQ ID NO: 4139979 - DNA, 23 bp, Homo sapiens
ctgtgggggtggccatccctggg

SEQ ID NO: 4139980 - DNA, 22 bp, Homo sapiens
ctgtgggtctgggagtcacaca

SEQ ID NO: 4139981 - DNA, 17 bp, Homo sapiens
ctgtggttacagtgcag

SEQ ID NO: 4139982 - DNA, 22 bp, Homo sapiens
ctgtggttacagtgcagacagg

SEQ ID NO: 4139983 - DNA, 23 bp, Homo sapiens
ctgtggttacagtgcagacaggc

SEQ ID NO: 4139984 - DNA, 13 bp, Homo sapiens
ctgtgtactgttc

SEQ ID NO: 4139985 - DNA, 19 bp, Homo sapiens
ctgtgtatggaaaaaccat

SEQ ID NO: 4139986 - DNA, 13 bp, Homo sapiens
ctgtgtatgtaca

SEQ ID NO: 4139987 - DNA, 18 bp, Homo sapiens
ctgtgtcatttcttcact

SEQ ID NO: 4139988 - DNA, 17 bp, Homo sapiens
ctgtgtccacctgtggg

SEQ ID NO: 4139989 - DNA, 13 bp, Homo sapiens
ctgtgtcccagat

SEQ ID NO: 4139990 - DNA, 15 bp, Homo sapiens
ctgtgtccggcccag

SEQ ID NO: 4139991 - DNA, 23 bp, Homo sapiens
ctgtgtcctgaaacgctcctttg

SEQ ID NO: 4139992 - DNA, 16 bp, Homo sapiens
ctgtgtccttccctgc

SEQ ID NO: 4139993 - DNA, 17 bp, Homo sapiens
ctgtgtctcttttctct

SEQ ID NO: 4139994 - DNA, 20 bp, Homo sapiens
ctgtgtctttcacagctcct

SEQ ID NO: 4139995 - DNA, 20 bp, Homo sapiens
ctgtgtgaaactttcattcc

SEQ ID NO: 4139996 - DNA, 14 bp, Homo sapiens
ctgtgtgaatgtgg

SEQ ID NO: 4139997 - DNA, 18 bp, Homo sapiens
ctgtgtggactgtgatgc

SEQ ID NO: 4139998 - DNA, 19 bp, Homo sapiens
ctgtgtgtatattgagaat

SEQ ID NO: 4139999 - DNA, 23 bp, Homo sapiens
ctgtgtgtgtgaatgaacactct

SEQ ID NO: 4140000 - DNA, 18 bp, Homo sapiens
ctgtgtgttttcataata

SEQ ID NO: 4140001 - DNA, 21 bp, Homo sapiens
ctgtgttcccagaggcaggcg

SEQ ID NO: 4140002 - DNA, 13 bp, Homo sapiens
ctgtgttcctggc

SEQ ID NO: 4140003 - DNA, 14 bp, Homo sapiens
ctgtgttgtctcta

SEQ ID NO: 4140004 - DNA, 16 bp, Homo sapiens
ctgtgtttaaaaagta

SEQ ID NO: 4140005 - DNA, 16 bp, Homo sapiens
ctgtgtttaatttgac

SEQ ID NO: 4140006 - DNA, 15 bp, Homo sapiens
ctgtgtttttgaaat

SEQ ID NO: 4140007 - DNA, 12 bp, Homo sapiens
ctgttaaccatt

SEQ ID NO: 4140008 - DNA, 18 bp, Homo sapiens
ctgttacccagagaatat

SEQ ID NO: 4140009 - DNA, 17 bp, Homo sapiens
ctgttacccaggctgga

SEQ ID NO: 4140010 - DNA, 13 bp, Homo sapiens
ctgttactccaca

SEQ ID NO: 4140011 - DNA, 15 bp, Homo sapiens
ctgttactccacagc

SEQ ID NO: 4140012 - DNA, 17 bp, Homo sapiens
ctgttactccacagcgg

SEQ ID NO: 4140013 - DNA, 23 bp, Homo sapiens
ctgttaggaacagcagtgttctc

SEQ ID NO: 4140014 - DNA, 14 bp, Homo sapiens
ctgttagtcatttg

SEQ ID NO: 4140015 - DNA, 21 bp, Homo sapiens
ctgttatgtctgtttaagaaa

SEQ ID NO: 4140016 - DNA, 22 bp, Homo sapiens
ctgttatgtctgtttaagaaaa

SEQ ID NO: 4140017 - DNA, 22 bp, Homo sapiens
ctgttatttcttccctgctttg

SEQ ID NO: 4140018 - DNA, 23 bp, Homo sapiens
ctgttatttcttccctgctttgc

SEQ ID NO: 4140019 - DNA, 16 bp, Homo sapiens
ctgttcaagtgtcccc

SEQ ID NO: 4140020 - DNA, 17 bp, Homo sapiens
ctgttcaatgtttaatg

SEQ ID NO: 4140021 - DNA, 23 bp, Homo sapiens
ctgttcacgctcacccagtcacc

SEQ ID NO: 4140022 - DNA, 20 bp, Homo sapiens
ctgttccaaattcagtttca

SEQ ID NO: 4140023 - DNA, 15 bp, Homo sapiens
ctgttccatgcaact

SEQ ID NO: 4140024 - DNA, 14 bp, Homo sapiens
ctgttccccagaga

SEQ ID NO: 4140025 - DNA, 19 bp, Homo sapiens
ctgttccccctgccgcagg

SEQ ID NO: 4140026 - DNA, 15 bp, Homo sapiens
ctgttcccctcactg

SEQ ID NO: 4140027 - DNA, 21 bp, Homo sapiens
ctgttcctctcttttcctgtt

SEQ ID NO: 4140028 - DNA, 18 bp, Homo sapiens
ctgttcggaaggggttcc

SEQ ID NO: 4140029 - DNA, 23 bp, Homo sapiens
ctgttcggaaggggttcctcaaa

SEQ ID NO: 4140030 - DNA, 12 bp, Homo sapiens
ctgttctaaggg

SEQ ID NO: 4140031 - DNA, 22 bp, Homo sapiens
ctgttctaagggggaggggaag

SEQ ID NO: 4140032 - DNA, 19 bp, Homo sapiens
ctgttctagttttttactt

SEQ ID NO: 4140033 - DNA, 19 bp, Homo sapiens
ctgttctcaggacagcatc

SEQ ID NO: 4140034 - DNA, 15 bp, Homo sapiens
ctgttctcttgggaa

SEQ ID NO: 4140035 - DNA, 20 bp, Homo sapiens
ctgttctgcaaaggtggcaa

SEQ ID NO: 4140036 - DNA, 14 bp, Homo sapiens
ctgttctgcagaca

SEQ ID NO: 4140037 - DNA, 13 bp, Homo sapiens
ctgttctgctggg

SEQ ID NO: 4140038 - DNA, 14 bp, Homo sapiens
ctgttctgggctct

SEQ ID NO: 4140039 - DNA, 20 bp, Homo sapiens
ctgttctgggggacagagaa

SEQ ID NO: 4140040 - DNA, 21 bp, Homo sapiens
ctgttctgtggttcctctgct

SEQ ID NO: 4140041 - DNA, 13 bp, Homo sapiens
ctgttctgtgtct

SEQ ID NO: 4140042 - DNA, 14 bp, Homo sapiens
ctgttcttcctcca

SEQ ID NO: 4140043 - DNA, 16 bp, Homo sapiens
ctgttcttgcataggc

SEQ ID NO: 4140044 - DNA, 17 bp, Homo sapiens
ctgttgaccaggcacct

SEQ ID NO: 4140045 - DNA, 20 bp, Homo sapiens
ctgttgagctgttttccctg

SEQ ID NO: 4140046 - DNA, 22 bp, Homo sapiens
ctgttgaggggtcccctctgga

SEQ ID NO: 4140047 - DNA, 20 bp, Homo sapiens
ctgttgatgaagtatacttt

SEQ ID NO: 4140048 - DNA, 15 bp, Homo sapiens
ctgttgattgcagga

SEQ ID NO: 4140049 - DNA, 17 bp, Homo sapiens
ctgttgcagatgaaatg

SEQ ID NO: 4140050 - DNA, 15 bp, Homo sapiens
ctgttgcatttactt

SEQ ID NO: 4140051 - DNA, 19 bp, Homo sapiens
ctgttgcatttacttttaa

SEQ ID NO: 4140052 - DNA, 13 bp, Homo sapiens
ctgttgccacaac

SEQ ID NO: 4140053 - DNA, 20 bp, Homo sapiens
ctgttgccaccatgtattca

SEQ ID NO: 4140054 - DNA, 23 bp, Homo sapiens
ctgttgctatagagcctacctgt

SEQ ID NO: 4140055 - DNA, 22 bp, Homo sapiens
ctgttgctcaaatctattcaga

SEQ ID NO: 4140056 - DNA, 20 bp, Homo sapiens
ctgttgctgtgtttaatttg

SEQ ID NO: 4140057 - DNA, 16 bp, Homo sapiens
ctgttgtaactaggct

SEQ ID NO: 4140058 - DNA, 14 bp, Homo sapiens
ctgttgtacattta

SEQ ID NO: 4140059 - DNA, 15 bp, Homo sapiens
ctgttgtacatttat

SEQ ID NO: 4140060 - DNA, 22 bp, Homo sapiens
ctgttgtacatttatgatttaa

SEQ ID NO: 4140061 - DNA, 17 bp, Homo sapiens
ctgttgtcattgctgtt

SEQ ID NO: 4140062 - DNA, 15 bp, Homo sapiens
ctgttgtctcttctc

SEQ ID NO: 4140063 - DNA, 14 bp, Homo sapiens
ctgttgtgggcgct

SEQ ID NO: 4140064 - DNA, 21 bp, Homo sapiens
ctgttgtgtatagatgcaaga

SEQ ID NO: 4140065 - DNA, 23 bp, Homo sapiens
ctgttgttgttaatgaaaatgtc

SEQ ID NO: 4140066 - DNA, 19 bp, Homo sapiens
ctgttgtttggttcaggga

SEQ ID NO: 4140067 - DNA, 18 bp, Homo sapiens
ctgtttaagacacttccg

SEQ ID NO: 4140068 - DNA, 18 bp, Homo sapiens
ctgtttaatatttaaaca

SEQ ID NO: 4140069 - DNA, 20 bp, Homo sapiens
ctgtttaatatttaaacagc

SEQ ID NO: 4140070 - DNA, 14 bp, Homo sapiens
ctgtttagcagaac

SEQ ID NO: 4140071 - DNA, 20 bp, Homo sapiens
ctgtttagcagcagccttta

SEQ ID NO: 4140072 - DNA, 18 bp, Homo sapiens
ctgtttaggttcccctgt

SEQ ID NO: 4140073 - DNA, 19 bp, Homo sapiens
ctgtttaggttcccctgtc

SEQ ID NO: 4140074 - DNA, 20 bp, Homo sapiens
ctgtttaggttcccctgtca

SEQ ID NO: 4140075 - DNA, 11 bp, Homo sapiens
ctgtttataat

SEQ ID NO: 4140076 - DNA, 14 bp, Homo sapiens
ctgtttatggcctc

SEQ ID NO: 4140077 - DNA, 15 bp, Homo sapiens
ctgtttatggcctca

SEQ ID NO: 4140078 - DNA, 18 bp, Homo sapiens
ctgtttatggcctcagct

SEQ ID NO: 4140079 - DNA, 22 bp, Homo sapiens
ctgtttatggcctcagctgcct

SEQ ID NO: 4140080 - DNA, 21 bp, Homo sapiens
ctgtttcaagttcacacctgc

SEQ ID NO: 4140081 - DNA, 20 bp, Homo sapiens
ctgtttcactgaaatgtttg

SEQ ID NO: 4140082 - DNA, 18 bp, Homo sapiens
ctgtttcagaccccccca

SEQ ID NO: 4140083 - DNA, 20 bp, Homo sapiens
ctgtttctcatgaagctaat

SEQ ID NO: 4140084 - DNA, 17 bp, Homo sapiens
ctgtttctgcagccctt

SEQ ID NO: 4140085 - DNA, 20 bp, Homo sapiens
ctgtttgatgctatttatgc

SEQ ID NO: 4140086 - DNA, 13 bp, Homo sapiens
ctgtttgattctt

SEQ ID NO: 4140087 - DNA, 14 bp, Homo sapiens
ctgtttgattcttt

SEQ ID NO: 4140088 - DNA, 12 bp, Homo sapiens
ctgtttggactg

SEQ ID NO: 4140089 - DNA, 18 bp, Homo sapiens
ctgtttggcttataaaca

SEQ ID NO: 4140090 - DNA, 14 bp, Homo sapiens
ctgtttgtaaatta

SEQ ID NO: 4140091 - DNA, 17 bp, Homo sapiens
ctgtttgtagtgaaata

SEQ ID NO: 4140092 - DNA, 11 bp, Homo sapiens
ctgtttgtcat

SEQ ID NO: 4140093 - DNA, 13 bp, Homo sapiens
ctgtttgttattg

SEQ ID NO: 4140094 - DNA, 20 bp, Homo sapiens
ctgtttgtttcaagaacctg

SEQ ID NO: 4140095 - DNA, 16 bp, Homo sapiens
ctgttttcccacgagg

SEQ ID NO: 4140096 - DNA, 13 bp, Homo sapiens
ctgttttccctga

SEQ ID NO: 4140097 - DNA, 19 bp, Homo sapiens
ctgttttctgtttgtaaat

SEQ ID NO: 4140098 - DNA, 17 bp, Homo sapiens
ctgttttgaaggcaaaa

SEQ ID NO: 4140099 - DNA, 23 bp, Homo sapiens
ctgttttgtatcaaaatcactat

SEQ ID NO: 4140100 - DNA, 17 bp, Homo sapiens
ctgtttttaagctgttt

SEQ ID NO: 4140101 - DNA, 23 bp, Homo sapiens
ctgtttttaagctgtttccatag

SEQ ID NO: 4140102 - DNA, 13 bp, Homo sapiens
ctgtttttgttgt

SEQ ID NO: 4140103 - DNA, 14 bp, Homo sapiens
ctgtttttgttgtg

SEQ ID NO: 4140104 - DNA, 15 bp, Homo sapiens
cttaaaaaaatgaca

SEQ ID NO: 4140105 - DNA, 12 bp, Homo sapiens
cttaaaaaactt

SEQ ID NO: 4140106 - DNA, 15 bp, Homo sapiens
cttaaaaatgtaaat

SEQ ID NO: 4140107 - DNA, 16 bp, Homo sapiens
cttaaaaatgtaaata

SEQ ID NO: 4140108 - DNA, 17 bp, Homo sapiens
cttaaaaatgtaaatat

SEQ ID NO: 4140109 - DNA, 17 bp, Homo sapiens
cttaaaataaacagttg

SEQ ID NO: 4140110 - DNA, 20 bp, Homo sapiens
cttaaaataaacagttgtga

SEQ ID NO: 4140111 - DNA, 22 bp, Homo sapiens
cttaaaataggggatatttaag

SEQ ID NO: 4140112 - DNA, 22 bp, Homo sapiens
cttaaaatcactcagcactcca

SEQ ID NO: 4140113 - DNA, 11 bp, Homo sapiens
cttaaaatgga

SEQ ID NO: 4140114 - DNA, 18 bp, Homo sapiens
cttaaaattaccagacaa

SEQ ID NO: 4140115 - DNA, 18 bp, Homo sapiens
cttaaacacaggctgtcc

SEQ ID NO: 4140116 - DNA, 19 bp, Homo sapiens
cttaaacactcaccttcta

SEQ ID NO: 4140117 - DNA, 17 bp, Homo sapiens
cttaaactaaataatga

SEQ ID NO: 4140118 - DNA, 11 bp, Homo sapiens
cttaaactgta

SEQ ID NO: 4140119 - DNA, 15 bp, Homo sapiens
cttaaactgtacaga

SEQ ID NO: 4140120 - DNA, 23 bp, Homo sapiens
cttaaactgtgtggactgtgatg

SEQ ID NO: 4140121 - DNA, 17 bp, Homo sapiens
cttaaaggacaggagga

SEQ ID NO: 4140122 - DNA, 23 bp, Homo sapiens
cttaaaggctgtggtagtactcc

SEQ ID NO: 4140123 - DNA, 21 bp, Homo sapiens
cttaaataataaacagtggaa

SEQ ID NO: 4140124 - DNA, 21 bp, Homo sapiens
cttaaataatgcttcagatat

SEQ ID NO: 4140125 - DNA, 15 bp, Homo sapiens
cttaaatatctttta

SEQ ID NO: 4140126 - DNA, 22 bp, Homo sapiens
cttaaatatcttttatgtttga

SEQ ID NO: 4140127 - DNA, 12 bp, Homo sapiens
cttaaatatgta

SEQ ID NO: 4140128 - DNA, 13 bp, Homo sapiens
cttaaatcagaat

SEQ ID NO: 4140129 - DNA, 16 bp, Homo sapiens
cttaaatcagaataaa

SEQ ID NO: 4140130 - DNA, 17 bp, Homo sapiens
cttaaatcagaataaat

SEQ ID NO: 4140131 - DNA, 18 bp, Homo sapiens
cttaaatcagaataaatt

SEQ ID NO: 4140132 - DNA, 21 bp, Homo sapiens
cttaaatgtagcaatggcact

SEQ ID NO: 4140133 - DNA, 13 bp, Homo sapiens
cttaaatttctta

SEQ ID NO: 4140134 - DNA, 20 bp, Homo sapiens
cttaaatttcttatgtgaca

SEQ ID NO: 4140135 - DNA, 19 bp, Homo sapiens
cttaacaaaccaacatctt

SEQ ID NO: 4140136 - DNA, 17 bp, Homo sapiens
cttaacattctgtaaaa

SEQ ID NO: 4140137 - DNA, 16 bp, Homo sapiens
cttaacccacctctcc

SEQ ID NO: 4140138 - DNA, 18 bp, Homo sapiens
cttaacctttccgctgtc

SEQ ID NO: 4140139 - DNA, 12 bp, Homo sapiens
cttaactaattt

SEQ ID NO: 4140140 - DNA, 15 bp, Homo sapiens
cttaactactttgtt

SEQ ID NO: 4140141 - DNA, 17 bp, Homo sapiens
cttaactccttccagtg

SEQ ID NO: 4140142 - DNA, 12 bp, Homo sapiens
cttaacttgttt

SEQ ID NO: 4140143 - DNA, 11 bp, Homo sapiens
cttaactttat

SEQ ID NO: 4140144 - DNA, 12 bp, Homo sapiens
cttaactttata

SEQ ID NO: 4140145 - DNA, 13 bp, Homo sapiens
cttaactttataa

SEQ ID NO: 4140146 - DNA, 12 bp, Homo sapiens
cttaagaaacta

SEQ ID NO: 4140147 - DNA, 22 bp, Homo sapiens
cttaagcaaaggggacagctgt

SEQ ID NO: 4140148 - DNA, 18 bp, Homo sapiens
cttaagcagcatggaaaa

SEQ ID NO: 4140149 - DNA, 20 bp, Homo sapiens
cttaagcagcatggaaaaat

SEQ ID NO: 4140150 - DNA, 18 bp, Homo sapiens
cttaagccataggcccag

SEQ ID NO: 4140151 - DNA, 20 bp, Homo sapiens
cttaagccttttgctcacaa

SEQ ID NO: 4140152 - DNA, 23 bp, Homo sapiens
cttaagcgaagtctttgccttct

SEQ ID NO: 4140153 - DNA, 13 bp, Homo sapiens
cttaagctgcagg

SEQ ID NO: 4140154 - DNA, 22 bp, Homo sapiens
cttaagctgcaggattctcacc

SEQ ID NO: 4140155 - DNA, 12 bp, Homo sapiens
cttaagcttccg

SEQ ID NO: 4140156 - DNA, 20 bp, Homo sapiens
cttaaggattgtgatatttt

SEQ ID NO: 4140157 - DNA, 19 bp, Homo sapiens
cttaagtatatcatgtaaa

SEQ ID NO: 4140158 - DNA, 20 bp, Homo sapiens
cttaagtatatcatgtaaag

SEQ ID NO: 4140159 - DNA, 17 bp, Homo sapiens
cttaagttctatgaaga

SEQ ID NO: 4140160 - DNA, 18 bp, Homo sapiens
cttaatactaccttgaaa

SEQ ID NO: 4140161 - DNA, 17 bp, Homo sapiens
cttaatagtatttatga

SEQ ID NO: 4140162 - DNA, 18 bp, Homo sapiens
cttaatgacattcccctc

SEQ ID NO: 4140163 - DNA, 12 bp, Homo sapiens
cttaatgagata

SEQ ID NO: 4140164 - DNA, 14 bp, Homo sapiens
cttaatgagatagt

SEQ ID NO: 4140165 - DNA, 20 bp, Homo sapiens
cttaatgagcaatatctgct

SEQ ID NO: 4140166 - DNA, 17 bp, Homo sapiens
cttaatgcttgtaattt

SEQ ID NO: 4140167 - DNA, 14 bp, Homo sapiens
cttaatgttcacat

SEQ ID NO: 4140168 - DNA, 14 bp, Homo sapiens
cttaatgtttattc

SEQ ID NO: 4140169 - DNA, 23 bp, Homo sapiens
cttaatgtttattcctgataata

SEQ ID NO: 4140170 - DNA, 15 bp, Homo sapiens
cttaattaatttgat

SEQ ID NO: 4140171 - DNA, 17 bp, Homo sapiens
cttaattaatttgatta

SEQ ID NO: 4140172 - DNA, 15 bp, Homo sapiens
cttaattattatttg

SEQ ID NO: 4140173 - DNA, 18 bp, Homo sapiens
cttaattattatttgtgt

SEQ ID NO: 4140174 - DNA, 17 bp, Homo sapiens
cttaattcctttctcat

SEQ ID NO: 4140175 - DNA, 17 bp, Homo sapiens
cttaatttcctttttga

SEQ ID NO: 4140176 - DNA, 22 bp, Homo sapiens
cttaatttcctttttgacactg

SEQ ID NO: 4140177 - DNA, 23 bp, Homo sapiens
cttaatttcctttttgacactga

SEQ ID NO: 4140178 - DNA, 12 bp, Homo sapiens
cttaatttctaa

SEQ ID NO: 4140179 - DNA, 19 bp, Homo sapiens
cttaatttttttttcatag

SEQ ID NO: 4140180 - DNA, 18 bp, Homo sapiens
cttacaaagccttacaca

SEQ ID NO: 4140181 - DNA, 20 bp, Homo sapiens
cttacaaagccttacacagg

SEQ ID NO: 4140182 - DNA, 21 bp, Homo sapiens
cttacaatcgcaaatcaaaac

SEQ ID NO: 4140183 - DNA, 20 bp, Homo sapiens
cttacacactcaggcctgtg

SEQ ID NO: 4140184 - DNA, 21 bp, Homo sapiens
cttacacactcaggcctgtgc

SEQ ID NO: 4140185 - DNA, 22 bp, Homo sapiens
cttacagccctaagtggctgcc

SEQ ID NO: 4140186 - DNA, 15 bp, Homo sapiens
cttacatgtgtaaag

SEQ ID NO: 4140187 - DNA, 20 bp, Homo sapiens
cttacatgtgtaaaggtttc

SEQ ID NO: 4140188 - DNA, 21 bp, Homo sapiens
cttacattagcagtttgcttt

SEQ ID NO: 4140189 - DNA, 21 bp, Homo sapiens
cttacattgcctgactaaaat

SEQ ID NO: 4140190 - DNA, 20 bp, Homo sapiens
cttacatttgtgagattcct

SEQ ID NO: 4140191 - DNA, 15 bp, Homo sapiens
cttaccaaaggatag

SEQ ID NO: 4140192 - DNA, 23 bp, Homo sapiens
cttaccatctctaccatcatccg

SEQ ID NO: 4140193 - DNA, 22 bp, Homo sapiens
cttaccctttcctcctttatca

SEQ ID NO: 4140194 - DNA, 18 bp, Homo sapiens
cttacctaaacagatata

SEQ ID NO: 4140195 - DNA, 21 bp, Homo sapiens
cttacctgacctcttgctgtc

SEQ ID NO: 4140196 - DNA, 14 bp, Homo sapiens
cttacgctttgtca

SEQ ID NO: 4140197 - DNA, 18 bp, Homo sapiens
cttacggccatctctttg

SEQ ID NO: 4140198 - DNA, 21 bp, Homo sapiens
cttactaagctttgccagctg

SEQ ID NO: 4140199 - DNA, 18 bp, Homo sapiens
cttactaatgtaaaatga

SEQ ID NO: 4140200 - DNA, 14 bp, Homo sapiens
cttactctttccta

SEQ ID NO: 4140201 - DNA, 16 bp, Homo sapiens
cttactgtggaggaag

SEQ ID NO: 4140202 - DNA, 19 bp, Homo sapiens
cttactgtggaggaaggat

SEQ ID NO: 4140203 - DNA, 22 bp, Homo sapiens
cttacttgccaagaaaatgaag

SEQ ID NO: 4140204 - DNA, 17 bp, Homo sapiens
cttagaaattgcatttc

SEQ ID NO: 4140205 - DNA, 16 bp, Homo sapiens
cttagaacattttaat

SEQ ID NO: 4140206 - DNA, 13 bp, Homo sapiens
cttagagaccccg

SEQ ID NO: 4140207 - DNA, 22 bp, Homo sapiens
cttagagccttttatctgcaga

SEQ ID NO: 4140208 - DNA, 13 bp, Homo sapiens
cttagaggaaaat

SEQ ID NO: 4140209 - DNA, 19 bp, Homo sapiens
cttagatgtatatatttcc

SEQ ID NO: 4140210 - DNA, 16 bp, Homo sapiens
cttagatgtttcacac

SEQ ID NO: 4140211 - DNA, 14 bp, Homo sapiens
cttagattcttaat

SEQ ID NO: 4140212 - DNA, 16 bp, Homo sapiens
cttagattcttaattc

SEQ ID NO: 4140213 - DNA, 15 bp, Homo sapiens
cttagcaccttcagg

SEQ ID NO: 4140214 - DNA, 17 bp, Homo sapiens
cttagcaccttcagggc

SEQ ID NO: 4140215 - DNA, 16 bp, Homo sapiens
cttagcagcttccaga

SEQ ID NO: 4140216 - DNA, 15 bp, Homo sapiens
cttagcaggggtgac

SEQ ID NO: 4140217 - DNA, 20 bp, Homo sapiens
cttagcatcctaagaaatat

SEQ ID NO: 4140218 - DNA, 11 bp, Homo sapiens
cttagcctccc

SEQ ID NO: 4140219 - DNA, 15 bp, Homo sapiens
cttagcctccctgaa

SEQ ID NO: 4140220 - DNA, 16 bp, Homo sapiens
cttagctgccagtgct

SEQ ID NO: 4140221 - DNA, 14 bp, Homo sapiens
cttagctgccttga

SEQ ID NO: 4140222 - DNA, 13 bp, Homo sapiens
cttagggcactgg

SEQ ID NO: 4140223 - DNA, 22 bp, Homo sapiens
cttagggtgaaccacttcattc

SEQ ID NO: 4140224 - DNA, 16 bp, Homo sapiens
cttagggtttggagct

SEQ ID NO: 4140225 - DNA, 20 bp, Homo sapiens
cttaggtaattgtagggcga

SEQ ID NO: 4140226 - DNA, 22 bp, Homo sapiens
cttaggtgagacagttgcccga

SEQ ID NO: 4140227 - DNA, 13 bp, Homo sapiens
cttagtatctcat

SEQ ID NO: 4140228 - DNA, 19 bp, Homo sapiens
cttagtatctcatcaacaa

SEQ ID NO: 4140229 - DNA, 12 bp, Homo sapiens
cttagtctcagt

SEQ ID NO: 4140230 - DNA, 15 bp, Homo sapiens
cttagtcttctcata

SEQ ID NO: 4140231 - DNA, 16 bp, Homo sapiens
cttagtcttctcatag

SEQ ID NO: 4140232 - DNA, 12 bp, Homo sapiens
cttagtggacag

SEQ ID NO: 4140233 - DNA, 17 bp, Homo sapiens
cttagtgggccagggct

SEQ ID NO: 4140234 - DNA, 21 bp, Homo sapiens
cttagtgggccagggctgccc

SEQ ID NO: 4140235 - DNA, 16 bp, Homo sapiens
cttagttatcagcttt

SEQ ID NO: 4140236 - DNA, 16 bp, Homo sapiens
cttagttctcactgtt

SEQ ID NO: 4140237 - DNA, 20 bp, Homo sapiens
cttagttggctttgcccacc

SEQ ID NO: 4140238 - DNA, 18 bp, Homo sapiens
cttataaaccaatcttaa

SEQ ID NO: 4140239 - DNA, 22 bp, Homo sapiens
cttataaatcatattgatgaaa

SEQ ID NO: 4140240 - DNA, 14 bp, Homo sapiens
cttataataaagga

SEQ ID NO: 4140241 - DNA, 16 bp, Homo sapiens
cttataataaaggact

SEQ ID NO: 4140242 - DNA, 17 bp, Homo sapiens
cttataataaaggactg

SEQ ID NO: 4140243 - DNA, 12 bp, Homo sapiens
cttatagaataa

SEQ ID NO: 4140244 - DNA, 20 bp, Homo sapiens
cttatagaataaaagctgtg

SEQ ID NO: 4140245 - DNA, 13 bp, Homo sapiens
cttatagaatatt

SEQ ID NO: 4140246 - DNA, 16 bp, Homo sapiens
cttataggcctgtccc

SEQ ID NO: 4140247 - DNA, 13 bp, Homo sapiens
cttatagtacatg

SEQ ID NO: 4140248 - DNA, 17 bp, Homo sapiens
cttatagtacatgataa

SEQ ID NO: 4140249 - DNA, 16 bp, Homo sapiens
cttatattgaagacaa

SEQ ID NO: 4140250 - DNA, 19 bp, Homo sapiens
cttatatttacaataaatg

SEQ ID NO: 4140251 - DNA, 23 bp, Homo sapiens
cttatatttacaataaatgaaga

SEQ ID NO: 4140252 - DNA, 14 bp, Homo sapiens
cttatatttgtgta

SEQ ID NO: 4140253 - DNA, 20 bp, Homo sapiens
cttatcaactggttgtatat

SEQ ID NO: 4140254 - DNA, 12 bp, Homo sapiens
cttatcagagct

SEQ ID NO: 4140255 - DNA, 13 bp, Homo sapiens
cttatcagagcta

SEQ ID NO: 4140256 - DNA, 20 bp, Homo sapiens
cttatccacgagagcgcagc

SEQ ID NO: 4140257 - DNA, 21 bp, Homo sapiens
cttatccacgagagcgcagca

SEQ ID NO: 4140258 - DNA, 12 bp, Homo sapiens
cttatccaggac

SEQ ID NO: 4140259 - DNA, 15 bp, Homo sapiens
cttatccctctcttc

SEQ ID NO: 4140260 - DNA, 17 bp, Homo sapiens
cttatccctctcttccc

SEQ ID NO: 4140261 - DNA, 20 bp, Homo sapiens
cttatctagctgcatatctt

SEQ ID NO: 4140262 - DNA, 20 bp, Homo sapiens
cttatctcagtcatgcataa

SEQ ID NO: 4140263 - DNA, 12 bp, Homo sapiens
cttatctctctg

SEQ ID NO: 4140264 - DNA, 15 bp, Homo sapiens
cttatctctctgtgc

SEQ ID NO: 4140265 - DNA, 21 bp, Homo sapiens
cttatctctctgtgctgtgga

SEQ ID NO: 4140266 - DNA, 12 bp, Homo sapiens
cttatctctttt

SEQ ID NO: 4140267 - DNA, 21 bp, Homo sapiens
cttatctcttttatatttgta

SEQ ID NO: 4140268 - DNA, 14 bp, Homo sapiens
cttatcttgtttca

SEQ ID NO: 4140269 - DNA, 18 bp, Homo sapiens
cttatgaatatttataac

SEQ ID NO: 4140270 - DNA, 18 bp, Homo sapiens
cttatgacttgctacttt

SEQ ID NO: 4140271 - DNA, 14 bp, Homo sapiens
cttatgcttaaatt

SEQ ID NO: 4140272 - DNA, 13 bp, Homo sapiens
cttatgcttccag

SEQ ID NO: 4140273 - DNA, 16 bp, Homo sapiens
cttatgcttccagaaa

SEQ ID NO: 4140274 - DNA, 14 bp, Homo sapiens
cttatggaattgat

SEQ ID NO: 4140275 - DNA, 20 bp, Homo sapiens
cttatggaattgatttgcat

SEQ ID NO: 4140276 - DNA, 23 bp, Homo sapiens
cttatggaattgatttgcattga

SEQ ID NO: 4140277 - DNA, 21 bp, Homo sapiens
cttatggtatgtagccagctg

SEQ ID NO: 4140278 - DNA, 12 bp, Homo sapiens
cttatggtccag

SEQ ID NO: 4140279 - DNA, 15 bp, Homo sapiens
cttatggtccagaaa

SEQ ID NO: 4140280 - DNA, 19 bp, Homo sapiens
cttatgtatcagtgtcctt

SEQ ID NO: 4140281 - DNA, 13 bp, Homo sapiens
cttatgtgacatt

SEQ ID NO: 4140282 - DNA, 23 bp, Homo sapiens
cttatgtgacattaacaaataaa

SEQ ID NO: 4140283 - DNA, 20 bp, Homo sapiens
cttatgtgggttgcctggtg

SEQ ID NO: 4140284 - DNA, 12 bp, Homo sapiens
cttattaattct

SEQ ID NO: 4140285 - DNA, 23 bp, Homo sapiens
cttattcctctaggcaagcagga

SEQ ID NO: 4140286 - DNA, 12 bp, Homo sapiens
cttattctgtat

SEQ ID NO: 4140287 - DNA, 16 bp, Homo sapiens
cttattctttgagtaa

SEQ ID NO: 4140288 - DNA, 13 bp, Homo sapiens
cttattgtacctc

SEQ ID NO: 4140289 - DNA, 19 bp, Homo sapiens
cttattgttccaagacatt

SEQ ID NO: 4140290 - DNA, 16 bp, Homo sapiens
cttatttaaaaatatt

SEQ ID NO: 4140291 - DNA, 19 bp, Homo sapiens
cttatttaaaaatatttca

SEQ ID NO: 4140292 - DNA, 16 bp, Homo sapiens
cttatttacccttttc

SEQ ID NO: 4140293 - DNA, 23 bp, Homo sapiens
cttatttcactatcttcttcaaa

SEQ ID NO: 4140294 - DNA, 18 bp, Homo sapiens
cttatttctgctctggaa

SEQ ID NO: 4140295 - DNA, 17 bp, Homo sapiens
cttatttgcttcattgt

SEQ ID NO: 4140296 - DNA, 20 bp, Homo sapiens
cttattttatttccatcatg

SEQ ID NO: 4140297 - DNA, 15 bp, Homo sapiens
cttattttctctgtg

SEQ ID NO: 4140298 - DNA, 14 bp, Homo sapiens
cttcaaaaataatg

SEQ ID NO: 4140299 - DNA, 15 bp, Homo sapiens
cttcaaaaataatgt

SEQ ID NO: 4140300 - DNA, 22 bp, Homo sapiens
cttcaaacagaactgcagtcag

SEQ ID NO: 4140301 - DNA, 17 bp, Homo sapiens
cttcaaactttcacttt

SEQ ID NO: 4140302 - DNA, 16 bp, Homo sapiens
cttcaaagcttgaaga

SEQ ID NO: 4140303 - DNA, 18 bp, Homo sapiens
cttcaaagcttgaagatc

SEQ ID NO: 4140304 - DNA, 14 bp, Homo sapiens
cttcaaatccatcc

SEQ ID NO: 4140305 - DNA, 16 bp, Homo sapiens
cttcaaatccatccag

SEQ ID NO: 4140306 - DNA, 17 bp, Homo sapiens
cttcaaatccatccaga

SEQ ID NO: 4140307 - DNA, 22 bp, Homo sapiens
cttcaaattcttcacatgttta

SEQ ID NO: 4140308 - DNA, 19 bp, Homo sapiens
cttcaacaaggcttgctgc

SEQ ID NO: 4140309 - DNA, 21 bp, Homo sapiens
cttcaacaaggcttgctgcag

SEQ ID NO: 4140310 - DNA, 17 bp, Homo sapiens
cttcaacatcctgccag

SEQ ID NO: 4140311 - DNA, 15 bp, Homo sapiens
cttcaacatgctcca

SEQ ID NO: 4140312 - DNA, 22 bp, Homo sapiens
cttcaagctgttatttcttccc

SEQ ID NO: 4140313 - DNA, 16 bp, Homo sapiens
cttcaaggcttccact

SEQ ID NO: 4140314 - DNA, 12 bp, Homo sapiens
cttcaagtgcct

SEQ ID NO: 4140315 - DNA, 14 bp, Homo sapiens
cttcaagtgccttt

SEQ ID NO: 4140316 - DNA, 18 bp, Homo sapiens
cttcaagttaaagtgaat

SEQ ID NO: 4140317 - DNA, 20 bp, Homo sapiens
cttcaatcaataacagccgc

SEQ ID NO: 4140318 - DNA, 23 bp, Homo sapiens
cttcaatcaataacagccgctcc

SEQ ID NO: 4140319 - DNA, 14 bp, Homo sapiens
cttcacagtgtttc

SEQ ID NO: 4140320 - DNA, 16 bp, Homo sapiens
cttcacatgtttaact

SEQ ID NO: 4140321 - DNA, 16 bp, Homo sapiens
cttcaccagagcccat

SEQ ID NO: 4140322 - DNA, 18 bp, Homo sapiens
cttcaccaggtgcatgca

SEQ ID NO: 4140323 - DNA, 20 bp, Homo sapiens
cttcaccaggtgcatgcatg

SEQ ID NO: 4140324 - DNA, 21 bp, Homo sapiens
cttcaccaggtgcatgcatgc

SEQ ID NO: 4140325 - DNA, 19 bp, Homo sapiens
cttcaccatggccttatga

SEQ ID NO: 4140326 - DNA, 24 bp, Homo sapiens
cttcacccagctaatctgtagggc

SEQ ID NO: 4140327 - DNA, 15 bp, Homo sapiens
cttcaccccccactc

SEQ ID NO: 4140328 - DNA, 13 bp, Homo sapiens
cttcaccctgtca

SEQ ID NO: 4140329 - DNA, 14 bp, Homo sapiens
cttcaccctgtcaa

SEQ ID NO: 4140330 - DNA, 21 bp, Homo sapiens
cttcaccctgtcaagttaaca

SEQ ID NO: 4140331 - DNA, 20 bp, Homo sapiens
cttcactccagcctgggtga

SEQ ID NO: 4140332 - DNA, 19 bp, Homo sapiens
cttcactgcaattttgtgt

SEQ ID NO: 4140333 - DNA, 17 bp, Homo sapiens
cttcactgtataaatag

SEQ ID NO: 4140334 - DNA, 14 bp, Homo sapiens
cttcacttcaagct

SEQ ID NO: 4140335 - DNA, 13 bp, Homo sapiens
cttcacttctgac

SEQ ID NO: 4140336 - DNA, 21 bp, Homo sapiens
cttcacttctgactcttcccc

SEQ ID NO: 4140337 - DNA, 12 bp, Homo sapiens
cttcagaaagac

SEQ ID NO: 4140338 - DNA, 15 bp, Homo sapiens
cttcagaacttgtca

SEQ ID NO: 4140339 - DNA, 17 bp, Homo sapiens
cttcagaagacactgca

SEQ ID NO: 4140340 - DNA, 15 bp, Homo sapiens
cttcagaattagatg

SEQ ID NO: 4140341 - DNA, 16 bp, Homo sapiens
cttcagagagctggta

SEQ ID NO: 4140342 - DNA, 18 bp, Homo sapiens
cttcagcatatttatagc

SEQ ID NO: 4140343 - DNA, 14 bp, Homo sapiens
cttcagccatcaac

SEQ ID NO: 4140344 - DNA, 14 bp, Homo sapiens
cttcagcccccagc

SEQ ID NO: 4140345 - DNA, 17 bp, Homo sapiens
cttcagcgtaaaatggt

SEQ ID NO: 4140346 - DNA, 21 bp, Homo sapiens
cttcagctagcttttaggaaa

SEQ ID NO: 4140347 - DNA, 19 bp, Homo sapiens
cttcagctgcctgaaacag

SEQ ID NO: 4140348 - DNA, 19 bp, Homo sapiens
cttcagctgtacttcgtct

SEQ ID NO: 4140349 - DNA, 17 bp, Homo sapiens
cttcaggaactggggct

SEQ ID NO: 4140350 - DNA, 15 bp, Homo sapiens
cttcaggcaccagca

SEQ ID NO: 4140351 - DNA, 16 bp, Homo sapiens
cttcaggcaccagcat

SEQ ID NO: 4140352 - DNA, 15 bp, Homo sapiens
cttcaggctcttctc

SEQ ID NO: 4140353 - DNA, 17 bp, Homo sapiens
cttcaggctcttctcct

SEQ ID NO: 4140354 - DNA, 18 bp, Homo sapiens
cttcaggctcttctcctt

SEQ ID NO: 4140355 - DNA, 16 bp, Homo sapiens
cttcaggcttctgtca

SEQ ID NO: 4140356 - DNA, 18 bp, Homo sapiens
cttcagggagtcagctgt

SEQ ID NO: 4140357 - DNA, 17 bp, Homo sapiens
cttcagggcagggctct

SEQ ID NO: 4140358 - DNA, 20 bp, Homo sapiens
cttcaggttatcgaaataac

SEQ ID NO: 4140359 - DNA, 19 bp, Homo sapiens
cttcaggttcttagtgtca

SEQ ID NO: 4140360 - DNA, 14 bp, Homo sapiens
cttcagttggttgt

SEQ ID NO: 4140361 - DNA, 19 bp, Homo sapiens
cttcataacaattttagga

SEQ ID NO: 4140362 - DNA, 14 bp, Homo sapiens
cttcatagctcctt

SEQ ID NO: 4140363 - DNA, 18 bp, Homo sapiens
cttcatcattccctctca

SEQ ID NO: 4140364 - DNA, 16 bp, Homo sapiens
cttcatcttcctgtgt

SEQ ID NO: 4140365 - DNA, 16 bp, Homo sapiens
cttcatgaaactgtcc

SEQ ID NO: 4140366 - DNA, 17 bp, Homo sapiens
cttcatgagcattcata

SEQ ID NO: 4140367 - DNA, 17 bp, Homo sapiens
cttcatgcaatgacatc

SEQ ID NO: 4140368 - DNA, 22 bp, Homo sapiens
cttcatgcaatgacatcttcaa

SEQ ID NO: 4140369 - DNA, 14 bp, Homo sapiens
cttcatgcctttgt

SEQ ID NO: 4140370 - DNA, 15 bp, Homo sapiens
cttcatgcctttgta

SEQ ID NO: 4140371 - DNA, 16 bp, Homo sapiens
cttcatgcctttgtaa

SEQ ID NO: 4140372 - DNA, 19 bp, Homo sapiens
cttcatgcctttgtaagtt

SEQ ID NO: 4140373 - DNA, 18 bp, Homo sapiens
cttcatggaatggacatc

SEQ ID NO: 4140374 - DNA, 18 bp, Homo sapiens
cttcattattttaaaaat

SEQ ID NO: 4140375 - DNA, 20 bp, Homo sapiens
cttcattcaatattgacatt

SEQ ID NO: 4140376 - DNA, 18 bp, Homo sapiens
cttcattctatcaagccc

SEQ ID NO: 4140377 - DNA, 16 bp, Homo sapiens
cttcattgtccctctt

SEQ ID NO: 4140378 - DNA, 19 bp, Homo sapiens
cttcattgtccctcttcac

SEQ ID NO: 4140379 - DNA, 21 bp, Homo sapiens
cttcattgtccctcttcactc

SEQ ID NO: 4140380 - DNA, 13 bp, Homo sapiens
cttcatttaaaaa

SEQ ID NO: 4140381 - DNA, 19 bp, Homo sapiens
cttcatttaaaaaaatcac

SEQ ID NO: 4140382 - DNA, 16 bp, Homo sapiens
cttccaaaaattatta

SEQ ID NO: 4140383 - DNA, 19 bp, Homo sapiens
cttccaaaaattattataa

SEQ ID NO: 4140384 - DNA, 17 bp, Homo sapiens
cttccaaaattcttatt

SEQ ID NO: 4140385 - DNA, 17 bp, Homo sapiens
cttccaaagaattctta

SEQ ID NO: 4140386 - DNA, 12 bp, Homo sapiens
cttccaaagcag

SEQ ID NO: 4140387 - DNA, 17 bp, Homo sapiens
cttccaaggagaccaag

SEQ ID NO: 4140388 - DNA, 23 bp, Homo sapiens
cttccaccaagttggaacatcct

SEQ ID NO: 4140389 - DNA, 17 bp, Homo sapiens
cttccacctgctctgct

SEQ ID NO: 4140390 - DNA, 15 bp, Homo sapiens
cttccagaatgctga

SEQ ID NO: 4140391 - DNA, 16 bp, Homo sapiens
cttccagaatgctgaa

SEQ ID NO: 4140392 - DNA, 11 bp, Homo sapiens
cttccagccca

SEQ ID NO: 4140393 - DNA, 14 bp, Homo sapiens
cttccagcccatcc

SEQ ID NO: 4140394 - DNA, 16 bp, Homo sapiens
cttccagcccatccaa

SEQ ID NO: 4140395 - DNA, 13 bp, Homo sapiens
cttccagctcctg

SEQ ID NO: 4140396 - DNA, 15 bp, Homo sapiens
cttccagctcctgta

SEQ ID NO: 4140397 - DNA, 14 bp, Homo sapiens
cttccagctgctgt

SEQ ID NO: 4140398 - DNA, 16 bp, Homo sapiens
cttccagctgctgtct

SEQ ID NO: 4140399 - DNA, 21 bp, Homo sapiens
cttccagctgctgtcttctgg

SEQ ID NO: 4140400 - DNA, 18 bp, Homo sapiens
cttccagcttcaggcacc

SEQ ID NO: 4140401 - DNA, 22 bp, Homo sapiens
cttccagcttcaggcaccagca

SEQ ID NO: 4140402 - DNA, 12 bp, Homo sapiens
cttccaggcagc

SEQ ID NO: 4140403 - DNA, 20 bp, Homo sapiens
cttccaggtgttactgtaat

SEQ ID NO: 4140404 - DNA, 22 bp, Homo sapiens
cttccaggtgttactgtaattc

SEQ ID NO: 4140405 - DNA, 16 bp, Homo sapiens
cttccagttactttcc

SEQ ID NO: 4140406 - DNA, 19 bp, Homo sapiens
cttccagttactttccaat

SEQ ID NO: 4140407 - DNA, 19 bp, Homo sapiens
cttccagtttctgtaaggt

SEQ ID NO: 4140408 - DNA, 23 bp, Homo sapiens
cttccataatgtataaagaacaa

SEQ ID NO: 4140409 - DNA, 12 bp, Homo sapiens
cttccatcccta

SEQ ID NO: 4140410 - DNA, 15 bp, Homo sapiens
cttccatccctaccc

SEQ ID NO: 4140411 - DNA, 13 bp, Homo sapiens
cttccatgtgcct

SEQ ID NO: 4140412 - DNA, 22 bp, Homo sapiens
cttccattttcccccactactg

SEQ ID NO: 4140413 - DNA, 19 bp, Homo sapiens
cttcccaacagccttagct

SEQ ID NO: 4140414 - DNA, 20 bp, Homo sapiens
cttcccacatgcctgcgcct

SEQ ID NO: 4140415 - DNA, 13 bp, Homo sapiens
cttcccactctgt

SEQ ID NO: 4140416 - DNA, 14 bp, Homo sapiens
cttcccactcttct

SEQ ID NO: 4140417 - DNA, 15 bp, Homo sapiens
cttcccagagggagc

SEQ ID NO: 4140418 - DNA, 16 bp, Homo sapiens
cttcccagagggagca

SEQ ID NO: 4140419 - DNA, 17 bp, Homo sapiens
cttcccagagggagcag

SEQ ID NO: 4140420 - DNA, 12 bp, Homo sapiens
cttcccagggca

SEQ ID NO: 4140421 - DNA, 21 bp, Homo sapiens
cttcccagtaagtttcccctc

SEQ ID NO: 4140422 - DNA, 22 bp, Homo sapiens
cttcccagttcaggagtcccaa

SEQ ID NO: 4140423 - DNA, 19 bp, Homo sapiens
cttcccataataaagcaat

SEQ ID NO: 4140424 - DNA, 15 bp, Homo sapiens
cttcccatcgctgtc

SEQ ID NO: 4140425 - DNA, 21 bp, Homo sapiens
cttcccatgactgcacccagc

SEQ ID NO: 4140426 - DNA, 21 bp, Homo sapiens
cttcccatgtctttctccaaa

SEQ ID NO: 4140427 - DNA, 16 bp, Homo sapiens
cttcccattccatggc

SEQ ID NO: 4140428 - DNA, 22 bp, Homo sapiens
cttcccatttctctacactaag

SEQ ID NO: 4140429 - DNA, 13 bp, Homo sapiens
cttcccatttctt

SEQ ID NO: 4140430 - DNA, 15 bp, Homo sapiens
cttcccatttcttcc

SEQ ID NO: 4140431 - DNA, 17 bp, Homo sapiens
cttcccatttcttccca

SEQ ID NO: 4140432 - DNA, 14 bp, Homo sapiens
cttccccagcgtcc

SEQ ID NO: 4140433 - DNA, 18 bp, Homo sapiens
cttccccatcttctaaac

SEQ ID NO: 4140434 - DNA, 14 bp, Homo sapiens
cttcccccagccca

SEQ ID NO: 4140435 - DNA, 16 bp, Homo sapiens
cttcccccagcccatc

SEQ ID NO: 4140436 - DNA, 12 bp, Homo sapiens
cttcccctcact

SEQ ID NO: 4140437 - DNA, 20 bp, Homo sapiens
cttcccctccctggctccca

SEQ ID NO: 4140438 - DNA, 13 bp, Homo sapiens
cttccccttccct

SEQ ID NO: 4140439 - DNA, 15 bp, Homo sapiens
cttccccttccctta

SEQ ID NO: 4140440 - DNA, 14 bp, Homo sapiens
cttccccttcctgt

SEQ ID NO: 4140441 - DNA, 17 bp, Homo sapiens
cttccccttcctgtttc

SEQ ID NO: 4140442 - DNA, 14 bp, Homo sapiens
cttccccttctgtg

SEQ ID NO: 4140443 - DNA, 19 bp, Homo sapiens
cttcccgagcgctggtccc

SEQ ID NO: 4140444 - DNA, 15 bp, Homo sapiens
cttcccgccagaggg

SEQ ID NO: 4140445 - DNA, 17 bp, Homo sapiens
cttcccgggccagggct

SEQ ID NO: 4140446 - DNA, 21 bp, Homo sapiens
cttccctagctttagaccctg

SEQ ID NO: 4140447 - DNA, 22 bp, Homo sapiens
cttccctagctttagaccctgg

SEQ ID NO: 4140448 - DNA, 21 bp, Homo sapiens
cttccctctctgatgtcccag

SEQ ID NO: 4140449 - DNA, 17 bp, Homo sapiens
cttccctgacttgcttt

SEQ ID NO: 4140450 - DNA, 18 bp, Homo sapiens
cttccctgattgacctgc

SEQ ID NO: 4140451 - DNA, 13 bp, Homo sapiens
cttccctgcacta

SEQ ID NO: 4140452 - DNA, 18 bp, Homo sapiens
cttccctgcgcctgtgat

SEQ ID NO: 4140453 - DNA, 18 bp, Homo sapiens
cttccctgctttgcatct

SEQ ID NO: 4140454 - DNA, 18 bp, Homo sapiens
cttccctggtaagaaaaa

SEQ ID NO: 4140455 - DNA, 16 bp, Homo sapiens
cttcccttttctgttc

SEQ ID NO: 4140456 - DNA, 22 bp, Homo sapiens
cttccgagatccccagggcagc

SEQ ID NO: 4140457 - DNA, 12 bp, Homo sapiens
cttccgctgagg

SEQ ID NO: 4140458 - DNA, 14 bp, Homo sapiens
cttccgctgagggg

SEQ ID NO: 4140459 - DNA, 21 bp, Homo sapiens
cttccgctgaggggtctcgga

SEQ ID NO: 4140460 - DNA, 15 bp, Homo sapiens
cttccggagatgtag

SEQ ID NO: 4140461 - DNA, 16 bp, Homo sapiens
cttccggtagggaggc

SEQ ID NO: 4140462 - DNA, 19 bp, Homo sapiens
cttccggtagggaggcagc

SEQ ID NO: 4140463 - DNA, 20 bp, Homo sapiens
cttccggtagggaggcagcc

SEQ ID NO: 4140464 - DNA, 22 bp, Homo sapiens
cttccggtagggaggcagcctc

SEQ ID NO: 4140465 - DNA, 17 bp, Homo sapiens
cttcctacatcttcttc

SEQ ID NO: 4140466 - DNA, 17 bp, Homo sapiens
cttcctaccaagtcaaa

SEQ ID NO: 4140467 - DNA, 23 bp, Homo sapiens
cttcctactcttctctctgctct

SEQ ID NO: 4140468 - DNA, 15 bp, Homo sapiens
cttcctatgcccagg

SEQ ID NO: 4140469 - DNA, 17 bp, Homo sapiens
cttcctcacacccctgt

SEQ ID NO: 4140470 - DNA, 22 bp, Homo sapiens
cttcctcacacccctgtcccac

SEQ ID NO: 4140471 - DNA, 19 bp, Homo sapiens
cttcctcactatgacactg

SEQ ID NO: 4140472 - DNA, 22 bp, Homo sapiens
cttcctcactatgacactgagc

SEQ ID NO: 4140473 - DNA, 15 bp, Homo sapiens
cttcctcagctgcct

SEQ ID NO: 4140474 - DNA, 20 bp, Homo sapiens
cttcctcagctgcctcctgc

SEQ ID NO: 4140475 - DNA, 14 bp, Homo sapiens
cttcctcagctggt

SEQ ID NO: 4140476 - DNA, 22 bp, Homo sapiens
cttcctcatccaccccatccct

SEQ ID NO: 4140477 - DNA, 23 bp, Homo sapiens
cttcctcattccctcgtctttcc

SEQ ID NO: 4140478 - DNA, 13 bp, Homo sapiens
cttcctccagctg

SEQ ID NO: 4140479 - DNA, 18 bp, Homo sapiens
cttcctccagctgcacca

SEQ ID NO: 4140480 - DNA, 20 bp, Homo sapiens
cttcctccagctgcaccaga

SEQ ID NO: 4140481 - DNA, 17 bp, Homo sapiens
cttcctccatcctcctc

SEQ ID NO: 4140482 - DNA, 14 bp, Homo sapiens
cttcctctccactg

SEQ ID NO: 4140483 - DNA, 15 bp, Homo sapiens
cttcctctccactgc

SEQ ID NO: 4140484 - DNA, 13 bp, Homo sapiens
cttcctctgctcc

SEQ ID NO: 4140485 - DNA, 19 bp, Homo sapiens
cttcctgattggtttctct

SEQ ID NO: 4140486 - DNA, 13 bp, Homo sapiens
cttcctgcccttc

SEQ ID NO: 4140487 - DNA, 19 bp, Homo sapiens
cttcctgcccttccctctg

SEQ ID NO: 4140488 - DNA, 16 bp, Homo sapiens
cttcctgcgtcctcct

SEQ ID NO: 4140489 - DNA, 21 bp, Homo sapiens
cttcctgcgtcctcctcacct

SEQ ID NO: 4140490 - DNA, 18 bp, Homo sapiens
cttcctgctacaggaggg

SEQ ID NO: 4140491 - DNA, 23 bp, Homo sapiens
cttcctgctgcaccctgcgcctc

SEQ ID NO: 4140492 - DNA, 12 bp, Homo sapiens
cttcctggcctg

SEQ ID NO: 4140493 - DNA, 22 bp, Homo sapiens
cttcctggttttgtacactgct

SEQ ID NO: 4140494 - DNA, 19 bp, Homo sapiens
cttcctgtccccaaaatgt

SEQ ID NO: 4140495 - DNA, 21 bp, Homo sapiens
cttcctgtgaagtttaattgt

SEQ ID NO: 4140496 - DNA, 15 bp, Homo sapiens
cttccttctttgccc

SEQ ID NO: 4140497 - DNA, 16 bp, Homo sapiens
cttccttctttgccct

SEQ ID NO: 4140498 - DNA, 20 bp, Homo sapiens
cttccttggccaagagaagg

SEQ ID NO: 4140499 - DNA, 19 bp, Homo sapiens
cttccttgttgtttgcttt

SEQ ID NO: 4140500 - DNA, 21 bp, Homo sapiens
cttcctttctctttctctctt

SEQ ID NO: 4140501 - DNA, 13 bp, Homo sapiens
cttccttttaact

SEQ ID NO: 4140502 - DNA, 14 bp, Homo sapiens
cttccttttaactg

SEQ ID NO: 4140503 - DNA, 21 bp, Homo sapiens
cttccttttagcctagttcat

SEQ ID NO: 4140504 - DNA, 17 bp, Homo sapiens
cttccttttccctgctt

SEQ ID NO: 4140505 - DNA, 15 bp, Homo sapiens
cttcgactcaggatc

SEQ ID NO: 4140506 - DNA, 17 bp, Homo sapiens
cttcgagcactgtccag

SEQ ID NO: 4140507 - DNA, 16 bp, Homo sapiens
cttcgatacaccgggc

SEQ ID NO: 4140508 - DNA, 21 bp, Homo sapiens
cttcgatacaccgggcctgga

SEQ ID NO: 4140509 - DNA, 18 bp, Homo sapiens
cttcgcctttcccaccct

SEQ ID NO: 4140510 - DNA, 19 bp, Homo sapiens
cttcgcgtgccctcgctgc

SEQ ID NO: 4140511 - DNA, 17 bp, Homo sapiens
cttcggaggaccagggc

SEQ ID NO: 4140512 - DNA, 16 bp, Homo sapiens
cttcggccaggtcaca

SEQ ID NO: 4140513 - DNA, 18 bp, Homo sapiens
cttcggccgagctggttt

SEQ ID NO: 4140514 - DNA, 20 bp, Homo sapiens
cttcgttaactgtgtatgta

SEQ ID NO: 4140515 - DNA, 18 bp, Homo sapiens
cttctaaacttccccatc

SEQ ID NO: 4140516 - DNA, 16 bp, Homo sapiens
cttctaatatcattca

SEQ ID NO: 4140517 - DNA, 12 bp, Homo sapiens
cttctaatctta

SEQ ID NO: 4140518 - DNA, 14 bp, Homo sapiens
cttctaatcttaaa

SEQ ID NO: 4140519 - DNA, 18 bp, Homo sapiens
cttctacaaccagagccc

SEQ ID NO: 4140520 - DNA, 13 bp, Homo sapiens
cttctactcccct

SEQ ID NO: 4140521 - DNA, 16 bp, Homo sapiens
cttctactcctgcctc

SEQ ID NO: 4140522 - DNA, 13 bp, Homo sapiens
cttctacttttaa

SEQ ID NO: 4140523 - DNA, 19 bp, Homo sapiens
cttctatttttatcatgaa

SEQ ID NO: 4140524 - DNA, 20 bp, Homo sapiens
cttctcaaaaaataattagt

SEQ ID NO: 4140525 - DNA, 16 bp, Homo sapiens
cttctcagaagcacag

SEQ ID NO: 4140526 - DNA, 20 bp, Homo sapiens
cttctcagccacaaaccctg

SEQ ID NO: 4140527 - DNA, 14 bp, Homo sapiens
cttctccaaggaaa

SEQ ID NO: 4140528 - DNA, 12 bp, Homo sapiens
cttctccagtgg

SEQ ID NO: 4140529 - DNA, 12 bp, Homo sapiens
cttctccgccag

SEQ ID NO: 4140530 - DNA, 13 bp, Homo sapiens
cttctccgccagc

SEQ ID NO: 4140531 - DNA, 16 bp, Homo sapiens
cttctccgccagcctc

SEQ ID NO: 4140532 - DNA, 19 bp, Homo sapiens
cttctccgccagcctcctc

SEQ ID NO: 4140533 - DNA, 21 bp, Homo sapiens
cttctccgccagcctcctctg

SEQ ID NO: 4140534 - DNA, 18 bp, Homo sapiens
cttctcctctctgggcct

SEQ ID NO: 4140535 - DNA, 17 bp, Homo sapiens
cttctcggctcaggctc

SEQ ID NO: 4140536 - DNA, 23 bp, Homo sapiens
cttctcggctcaggctctgctgg

SEQ ID NO: 4140537 - DNA, 15 bp, Homo sapiens
cttctctacagactt

SEQ ID NO: 4140538 - DNA, 15 bp, Homo sapiens
cttctctcctcccca

SEQ ID NO: 4140539 - DNA, 13 bp, Homo sapiens
cttctctccttgc

SEQ ID NO: 4140540 - DNA, 15 bp, Homo sapiens
cttctctccttgccc

SEQ ID NO: 4140541 - DNA, 13 bp, Homo sapiens
cttctctctccag

SEQ ID NO: 4140542 - DNA, 15 bp, Homo sapiens
cttctctctccaggg

SEQ ID NO: 4140543 - DNA, 20 bp, Homo sapiens
cttctctgaacacaggcagc

SEQ ID NO: 4140544 - DNA, 23 bp, Homo sapiens
cttctctgaacacaggcagcttt

SEQ ID NO: 4140545 - DNA, 23 bp, Homo sapiens
cttctctgcctttgacatttaat

SEQ ID NO: 4140546 - DNA, 14 bp, Homo sapiens
cttctctgctccac

SEQ ID NO: 4140547 - DNA, 15 bp, Homo sapiens
cttctctgctccacc

SEQ ID NO: 4140548 - DNA, 21 bp, Homo sapiens
cttctctgtgaacgatttaga

SEQ ID NO: 4140549 - DNA, 14 bp, Homo sapiens
cttctcttaattta

SEQ ID NO: 4140550 - DNA, 21 bp, Homo sapiens
cttctcttgaaaagttcaggg

SEQ ID NO: 4140551 - DNA, 12 bp, Homo sapiens
cttctgaaatgt

SEQ ID NO: 4140552 - DNA, 21 bp, Homo sapiens
cttctgaccacagcatcattt

SEQ ID NO: 4140553 - DNA, 22 bp, Homo sapiens
cttctgaccttttggtgaaagc

SEQ ID NO: 4140554 - DNA, 23 bp, Homo sapiens
cttctgactcttccccaggaagg

SEQ ID NO: 4140555 - DNA, 23 bp, Homo sapiens
cttctgaggaccgctgataagca

SEQ ID NO: 4140556 - DNA, 19 bp, Homo sapiens
cttctgcaattgcttagga

SEQ ID NO: 4140557 - DNA, 23 bp, Homo sapiens
cttctgcccaattggaggaaagc

SEQ ID NO: 4140558 - DNA, 19 bp, Homo sapiens
cttctgccctttcctaggc

SEQ ID NO: 4140559 - DNA, 16 bp, Homo sapiens
cttctgctcagctctg

SEQ ID NO: 4140560 - DNA, 19 bp, Homo sapiens
cttctgctccacccttggc

SEQ ID NO: 4140561 - DNA, 16 bp, Homo sapiens
cttctgctcttttcct

SEQ ID NO: 4140562 - DNA, 16 bp, Homo sapiens
cttctgcttttctgcc

SEQ ID NO: 4140563 - DNA, 18 bp, Homo sapiens
cttctgcttttctgccct

SEQ ID NO: 4140564 - DNA, 19 bp, Homo sapiens
cttctgcttttctgccctg

SEQ ID NO: 4140565 - DNA, 21 bp, Homo sapiens
cttctgcttttctgccctggc

SEQ ID NO: 4140566 - DNA, 18 bp, Homo sapiens
cttctggacaggctctgc

SEQ ID NO: 4140567 - DNA, 21 bp, Homo sapiens
cttctggacaggctctgcttc

SEQ ID NO: 4140568 - DNA, 19 bp, Homo sapiens
cttctggcctctgctgaat

SEQ ID NO: 4140569 - DNA, 20 bp, Homo sapiens
cttctggggcaggctgggcc

SEQ ID NO: 4140570 - DNA, 21 bp, Homo sapiens
cttctggggcaggctgggcca

SEQ ID NO: 4140571 - DNA, 15 bp, Homo sapiens
cttctggtgttgact

SEQ ID NO: 4140572 - DNA, 21 bp, Homo sapiens
cttctggtgttgactggactg

SEQ ID NO: 4140573 - DNA, 15 bp, Homo sapiens
cttctgtagtactcc

SEQ ID NO: 4140574 - DNA, 18 bp, Homo sapiens
cttctgtagtactcctta

SEQ ID NO: 4140575 - DNA, 20 bp, Homo sapiens
cttctgtatttttttttcta

SEQ ID NO: 4140576 - DNA, 15 bp, Homo sapiens
cttctgtccaagcag

SEQ ID NO: 4140577 - DNA, 14 bp, Homo sapiens
cttctgtgaaatat

SEQ ID NO: 4140578 - DNA, 20 bp, Homo sapiens
cttctgtgagacccccacac

SEQ ID NO: 4140579 - DNA, 21 bp, Homo sapiens
cttctgtgagacccccacacc

SEQ ID NO: 4140580 - DNA, 22 bp, Homo sapiens
cttctgtgtatctctttcacat

SEQ ID NO: 4140581 - DNA, 18 bp, Homo sapiens
cttcttaaatatctttta

SEQ ID NO: 4140582 - DNA, 22 bp, Homo sapiens
cttcttaaatatcttttatgtt

SEQ ID NO: 4140583 - DNA, 14 bp, Homo sapiens
cttcttaattaatt

SEQ ID NO: 4140584 - DNA, 16 bp, Homo sapiens
cttcttaattaatttg

SEQ ID NO: 4140585 - DNA, 22 bp, Homo sapiens
cttcttaattaatttgattaac

SEQ ID NO: 4140586 - DNA, 14 bp, Homo sapiens
cttcttacatgcat

SEQ ID NO: 4140587 - DNA, 13 bp, Homo sapiens
cttcttatacatt

SEQ ID NO: 4140588 - DNA, 19 bp, Homo sapiens
cttcttatggaattgattt

SEQ ID NO: 4140589 - DNA, 18 bp, Homo sapiens
cttcttcaaatacaaagt

SEQ ID NO: 4140590 - DNA, 20 bp, Homo sapiens
cttcttcagaagacactgca

SEQ ID NO: 4140591 - DNA, 16 bp, Homo sapiens
cttcttcatattctaa

SEQ ID NO: 4140592 - DNA, 22 bp, Homo sapiens
cttcttcatccaacttccaaga

SEQ ID NO: 4140593 - DNA, 24 bp, Homo sapiens
cttcttcctacatcttcttcccag

SEQ ID NO: 4140594 - DNA, 13 bp, Homo sapiens
cttcttctgtcca

SEQ ID NO: 4140595 - DNA, 13 bp, Homo sapiens
cttcttcttcaga

SEQ ID NO: 4140596 - DNA, 22 bp, Homo sapiens
cttcttgaatggcaatgttttg

SEQ ID NO: 4140597 - DNA, 15 bp, Homo sapiens
cttcttgggccccag

SEQ ID NO: 4140598 - DNA, 17 bp, Homo sapiens
cttcttgggccccagac

SEQ ID NO: 4140599 - DNA, 21 bp, Homo sapiens
cttcttgtgattgctgccata

SEQ ID NO: 4140600 - DNA, 21 bp, Homo sapiens
cttctttagaccctcgggccc

SEQ ID NO: 4140601 - DNA, 23 bp, Homo sapiens
cttctttccatcaactcccaact

SEQ ID NO: 4140602 - DNA, 14 bp, Homo sapiens
cttctttcccttcc

SEQ ID NO: 4140603 - DNA, 16 bp, Homo sapiens
cttctttcccttcctc

SEQ ID NO: 4140604 - DNA, 19 bp, Homo sapiens
cttctttcccttcctccat

SEQ ID NO: 4140605 - DNA, 14 bp, Homo sapiens
cttctttgataatg

SEQ ID NO: 4140606 - DNA, 15 bp, Homo sapiens
cttctttgcagggct

SEQ ID NO: 4140607 - DNA, 13 bp, Homo sapiens
cttctttgtgcct

SEQ ID NO: 4140608 - DNA, 18 bp, Homo sapiens
cttctttgtgcctttggc

SEQ ID NO: 4140609 - DNA, 13 bp, Homo sapiens
cttcttttacttg

SEQ ID NO: 4140610 - DNA, 23 bp, Homo sapiens
cttcttttacttgaaaagaaagt

SEQ ID NO: 4140611 - DNA, 16 bp, Homo sapiens
cttcttttgattatgt

SEQ ID NO: 4140612 - DNA, 16 bp, Homo sapiens
cttgaaaataagaata

SEQ ID NO: 4140613 - DNA, 22 bp, Homo sapiens
cttgaaaataagaatagaaata

SEQ ID NO: 4140614 - DNA, 21 bp, Homo sapiens
cttgaaacagattcaggccag

SEQ ID NO: 4140615 - DNA, 23 bp, Homo sapiens
cttgaaacagattcaggccagcc

SEQ ID NO: 4140616 - DNA, 13 bp, Homo sapiens
cttgaaagatttt

SEQ ID NO: 4140617 - DNA, 17 bp, Homo sapiens
cttgaaagcatccatgt

SEQ ID NO: 4140618 - DNA, 18 bp, Homo sapiens
cttgaaagcatccatgtg

SEQ ID NO: 4140619 - DNA, 20 bp, Homo sapiens
cttgaaagcatccatgtgtg

SEQ ID NO: 4140620 - DNA, 21 bp, Homo sapiens
cttgaaattaagaaggcaaaa

SEQ ID NO: 4140621 - DNA, 18 bp, Homo sapiens
cttgaaattactgtgtaa

SEQ ID NO: 4140622 - DNA, 24 bp, Homo sapiens
cttgaaattatatctgtggtcttc

SEQ ID NO: 4140623 - DNA, 23 bp, Homo sapiens
cttgaactgttctggcctcagac

SEQ ID NO: 4140624 - DNA, 22 bp, Homo sapiens
cttgaagaaacagagtggcctc

SEQ ID NO: 4140625 - DNA, 13 bp, Homo sapiens
cttgaagatcgtt

SEQ ID NO: 4140626 - DNA, 12 bp, Homo sapiens
cttgaagcagtc

SEQ ID NO: 4140627 - DNA, 13 bp, Homo sapiens
cttgaagccaaag

SEQ ID NO: 4140628 - DNA, 14 bp, Homo sapiens
cttgaagccaaaga

SEQ ID NO: 4140629 - DNA, 20 bp, Homo sapiens
cttgaagcctgctccttccc

SEQ ID NO: 4140630 - DNA, 21 bp, Homo sapiens
cttgaaggccctgctgagtca

SEQ ID NO: 4140631 - DNA, 14 bp, Homo sapiens
cttgaagggccaga

SEQ ID NO: 4140632 - DNA, 18 bp, Homo sapiens
cttgaagggccagagcca

SEQ ID NO: 4140633 - DNA, 19 bp, Homo sapiens
cttgaagggccagagccag

SEQ ID NO: 4140634 - DNA, 20 bp, Homo sapiens
cttgaagggccagagccagg

SEQ ID NO: 4140635 - DNA, 14 bp, Homo sapiens
cttgaagggttact

SEQ ID NO: 4140636 - DNA, 22 bp, Homo sapiens
cttgaaggtgctgacggccagg

SEQ ID NO: 4140637 - DNA, 18 bp, Homo sapiens
cttgaagtacttaacata

SEQ ID NO: 4140638 - DNA, 14 bp, Homo sapiens
cttgaatcagtttt

SEQ ID NO: 4140639 - DNA, 22 bp, Homo sapiens
cttgaatcagtttttaaaatat

SEQ ID NO: 4140640 - DNA, 14 bp, Homo sapiens
cttgaatgctgcca

SEQ ID NO: 4140641 - DNA, 16 bp, Homo sapiens
cttgaatgtagcagcc

SEQ ID NO: 4140642 - DNA, 17 bp, Homo sapiens
cttgaatgtggtctcag

SEQ ID NO: 4140643 - DNA, 20 bp, Homo sapiens
cttgaatgtggtctcaggat

SEQ ID NO: 4140644 - DNA, 13 bp, Homo sapiens
cttgaatttcaaa

SEQ ID NO: 4140645 - DNA, 13 bp, Homo sapiens
cttgaatttctga

SEQ ID NO: 4140646 - DNA, 16 bp, Homo sapiens
cttgacacagtcagca

SEQ ID NO: 4140647 - DNA, 17 bp, Homo sapiens
cttgacacagtcagcat

SEQ ID NO: 4140648 - DNA, 19 bp, Homo sapiens
cttgacagagcctgcccca

SEQ ID NO: 4140649 - DNA, 22 bp, Homo sapiens
cttgacagcatgaggtgttgtg

SEQ ID NO: 4140650 - DNA, 14 bp, Homo sapiens
cttgacatgtagct

SEQ ID NO: 4140651 - DNA, 20 bp, Homo sapiens
cttgacatgtagcttcttct

SEQ ID NO: 4140652 - DNA, 13 bp, Homo sapiens
cttgacatgtgca

SEQ ID NO: 4140653 - DNA, 14 bp, Homo sapiens
cttgacattcaagg

SEQ ID NO: 4140654 - DNA, 13 bp, Homo sapiens
cttgacccatctc

SEQ ID NO: 4140655 - DNA, 16 bp, Homo sapiens
cttgacccatctcccc

SEQ ID NO: 4140656 - DNA, 23 bp, Homo sapiens
cttgaccgtactctcacatgtgg

SEQ ID NO: 4140657 - DNA, 12 bp, Homo sapiens
cttgacctccta

SEQ ID NO: 4140658 - DNA, 18 bp, Homo sapiens
cttgacctgtttctctgc

SEQ ID NO: 4140659 - DNA, 18 bp, Homo sapiens
cttgaccttttcgacgct

SEQ ID NO: 4140660 - DNA, 16 bp, Homo sapiens
cttgactcatggcagc

SEQ ID NO: 4140661 - DNA, 17 bp, Homo sapiens
cttgactctaaatgcag

SEQ ID NO: 4140662 - DNA, 14 bp, Homo sapiens
cttgactttctgat

SEQ ID NO: 4140663 - DNA, 17 bp, Homo sapiens
cttgactttggctgatt

SEQ ID NO: 4140664 - DNA, 11 bp, Homo sapiens
cttgagaactt

SEQ ID NO: 4140665 - DNA, 19 bp, Homo sapiens
cttgagaatcctctccttt

SEQ ID NO: 4140666 - DNA, 21 bp, Homo sapiens
cttgagcagtggctggtccag

SEQ ID NO: 4140667 - DNA, 16 bp, Homo sapiens
cttgagccagtaattg

SEQ ID NO: 4140668 - DNA, 12 bp, Homo sapiens
cttgagcccagg

SEQ ID NO: 4140669 - DNA, 12 bp, Homo sapiens
cttgagccctgg

SEQ ID NO: 4140670 - DNA, 13 bp, Homo sapiens
cttgagccctggc

SEQ ID NO: 4140671 - DNA, 14 bp, Homo sapiens
cttgagccctggct

SEQ ID NO: 4140672 - DNA, 22 bp, Homo sapiens
cttgaggagtgtgagaatcaaa

SEQ ID NO: 4140673 - DNA, 16 bp, Homo sapiens
cttgagggagcttagc

SEQ ID NO: 4140674 - DNA, 17 bp, Homo sapiens
cttgaggggagccagga

SEQ ID NO: 4140675 - DNA, 14 bp, Homo sapiens
cttgaggtcttttg

SEQ ID NO: 4140676 - DNA, 23 bp, Homo sapiens
cttgaggtcttttgacatgtgga

SEQ ID NO: 4140677 - DNA, 15 bp, Homo sapiens
cttgagtaaaaaggt

SEQ ID NO: 4140678 - DNA, 18 bp, Homo sapiens
cttgagtataagaaatgc

SEQ ID NO: 4140679 - DNA, 23 bp, Homo sapiens
cttgagtggggttatctctgtgt

SEQ ID NO: 4140680 - DNA, 22 bp, Homo sapiens
cttgagtgtcaagctgaccttg

SEQ ID NO: 4140681 - DNA, 13 bp, Homo sapiens
cttgagtgttcct

SEQ ID NO: 4140682 - DNA, 23 bp, Homo sapiens
cttgagtgttcctttttaaatgt

SEQ ID NO: 4140683 - DNA, 16 bp, Homo sapiens
cttgatacccccctct

SEQ ID NO: 4140684 - DNA, 20 bp, Homo sapiens
cttgatacccccctctgtct

SEQ ID NO: 4140685 - DNA, 16 bp, Homo sapiens
cttgatcattttggga

SEQ ID NO: 4140686 - DNA, 15 bp, Homo sapiens
cttgatctctcttgt

SEQ ID NO: 4140687 - DNA, 16 bp, Homo sapiens
cttgatctctcttgtc

SEQ ID NO: 4140688 - DNA, 23 bp, Homo sapiens
cttgatctctcttgtcctcttct

SEQ ID NO: 4140689 - DNA, 13 bp, Homo sapiens
cttgatgaagcaa

SEQ ID NO: 4140690 - DNA, 22 bp, Homo sapiens
cttgatgtacataactcctgtc

SEQ ID NO: 4140691 - DNA, 12 bp, Homo sapiens
cttgatgtgaag

SEQ ID NO: 4140692 - DNA, 17 bp, Homo sapiens
cttgatgtgaagataat

SEQ ID NO: 4140693 - DNA, 15 bp, Homo sapiens
cttgatgtgccattt

SEQ ID NO: 4140694 - DNA, 20 bp, Homo sapiens
cttgattaagattttacaaa

SEQ ID NO: 4140695 - DNA, 19 bp, Homo sapiens
cttgatttaaacacacaga

SEQ ID NO: 4140696 - DNA, 20 bp, Homo sapiens
cttgatttgatgtgactttt

SEQ ID NO: 4140697 - DNA, 14 bp, Homo sapiens
cttgattttttcaa

SEQ ID NO: 4140698 - DNA, 19 bp, Homo sapiens
cttgatttttttaaacata

SEQ ID NO: 4140699 - DNA, 19 bp, Homo sapiens
cttgcacatgaatgcagtc

SEQ ID NO: 4140700 - DNA, 13 bp, Homo sapiens
cttgcactggggg

SEQ ID NO: 4140701 - DNA, 17 bp, Homo sapiens
cttgcactgggggaaca

SEQ ID NO: 4140702 - DNA, 17 bp, Homo sapiens
cttgcagccacatggcc

SEQ ID NO: 4140703 - DNA, 14 bp, Homo sapiens
cttgcaggaggcca

SEQ ID NO: 4140704 - DNA, 19 bp, Homo sapiens
cttgcaggaggccaaactg

SEQ ID NO: 4140705 - DNA, 23 bp, Homo sapiens
cttgcaggggtcccccctcaaga

SEQ ID NO: 4140706 - DNA, 16 bp, Homo sapiens
cttgcagtcatcagaa

SEQ ID NO: 4140707 - DNA, 20 bp, Homo sapiens
cttgcataggctcttaagca

SEQ ID NO: 4140708 - DNA, 20 bp, Homo sapiens
cttgcatgaagagaagcaat

SEQ ID NO: 4140709 - DNA, 13 bp, Homo sapiens
cttgcattcattt

SEQ ID NO: 4140710 - DNA, 20 bp, Homo sapiens
cttgcattcattttctgaca

SEQ ID NO: 4140711 - DNA, 17 bp, Homo sapiens
cttgccaagaaaatgaa

SEQ ID NO: 4140712 - DNA, 16 bp, Homo sapiens
cttgccacatttctga

SEQ ID NO: 4140713 - DNA, 21 bp, Homo sapiens
cttgccaccccaccctccctg

SEQ ID NO: 4140714 - DNA, 18 bp, Homo sapiens
cttgcccaagtcacacag

SEQ ID NO: 4140715 - DNA, 22 bp, Homo sapiens
cttgcccaagtcacacagctag

SEQ ID NO: 4140716 - DNA, 17 bp, Homo sapiens
cttgcccagactacagg

SEQ ID NO: 4140717 - DNA, 13 bp, Homo sapiens
cttgcccatcctg

SEQ ID NO: 4140718 - DNA, 21 bp, Homo sapiens
cttgcccatgctgggctcccg

SEQ ID NO: 4140719 - DNA, 18 bp, Homo sapiens
cttgccccccgccctcat

SEQ ID NO: 4140720 - DNA, 14 bp, Homo sapiens
cttgcctccccatt

SEQ ID NO: 4140721 - DNA, 19 bp, Homo sapiens
cttgcctctgccctggatt

SEQ ID NO: 4140722 - DNA, 13 bp, Homo sapiens
cttgcctgctggg

SEQ ID NO: 4140723 - DNA, 18 bp, Homo sapiens
cttgcctttcgaggcctg

SEQ ID NO: 4140724 - DNA, 16 bp, Homo sapiens
cttgcgagtccaaggc

SEQ ID NO: 4140725 - DNA, 17 bp, Homo sapiens
cttgcgagtccaaggcc

SEQ ID NO: 4140726 - DNA, 13 bp, Homo sapiens
cttgcgcctcagc

SEQ ID NO: 4140727 - DNA, 18 bp, Homo sapiens
cttgctcccttcagcccc

SEQ ID NO: 4140728 - DNA, 14 bp, Homo sapiens
cttgctctgtcccc

SEQ ID NO: 4140729 - DNA, 22 bp, Homo sapiens
cttgctctgtcccccaggctgg

SEQ ID NO: 4140730 - DNA, 19 bp, Homo sapiens
cttgctctgttacccaggc

SEQ ID NO: 4140731 - DNA, 16 bp, Homo sapiens
cttgctgaacacacac

SEQ ID NO: 4140732 - DNA, 22 bp, Homo sapiens
cttgctgagtggcgcaaggccg

SEQ ID NO: 4140733 - DNA, 20 bp, Homo sapiens
cttgctgatggcttgacatg

SEQ ID NO: 4140734 - DNA, 11 bp, Homo sapiens
cttgctgcagc

SEQ ID NO: 4140735 - DNA, 12 bp, Homo sapiens
cttgctgcagcc

SEQ ID NO: 4140736 - DNA, 15 bp, Homo sapiens
cttgctgctgctgca

SEQ ID NO: 4140737 - DNA, 18 bp, Homo sapiens
cttgctgctgctgcaccc

SEQ ID NO: 4140738 - DNA, 13 bp, Homo sapiens
cttgctgctgtct

SEQ ID NO: 4140739 - DNA, 17 bp, Homo sapiens
cttgctggacggggact

SEQ ID NO: 4140740 - DNA, 13 bp, Homo sapiens
cttgctggtgcct

SEQ ID NO: 4140741 - DNA, 22 bp, Homo sapiens
cttgctggtgcctgccaccttc

SEQ ID NO: 4140742 - DNA, 12 bp, Homo sapiens
cttgctgtctct

SEQ ID NO: 4140743 - DNA, 14 bp, Homo sapiens
cttgctgtctctgc

SEQ ID NO: 4140744 - DNA, 15 bp, Homo sapiens
cttgctgtctctgct

SEQ ID NO: 4140745 - DNA, 21 bp, Homo sapiens
cttgctgtctctgctcgccct

SEQ ID NO: 4140746 - DNA, 19 bp, Homo sapiens
cttgctgtttgtcctgaga

SEQ ID NO: 4140747 - DNA, 22 bp, Homo sapiens
cttgcttaaatttcttatgtga

SEQ ID NO: 4140748 - DNA, 12 bp, Homo sapiens
cttgcttcctga

SEQ ID NO: 4140749 - DNA, 19 bp, Homo sapiens
cttgcttctgtatttcctt

SEQ ID NO: 4140750 - DNA, 14 bp, Homo sapiens
cttgcttcttactg

SEQ ID NO: 4140751 - DNA, 12 bp, Homo sapiens
cttgctttcctg

SEQ ID NO: 4140752 - DNA, 17 bp, Homo sapiens
cttgctttcctgggcct

SEQ ID NO: 4140753 - DNA, 19 bp, Homo sapiens
cttgctttcctgggccttt

SEQ ID NO: 4140754 - DNA, 14 bp, Homo sapiens
cttgctttgattta

SEQ ID NO: 4140755 - DNA, 17 bp, Homo sapiens
cttgcttttctgtattt

SEQ ID NO: 4140756 - DNA, 16 bp, Homo sapiens
cttgctttttgcccgt

SEQ ID NO: 4140757 - DNA, 16 bp, Homo sapiens
cttggaacaccttggg

SEQ ID NO: 4140758 - DNA, 16 bp, Homo sapiens
cttggaaccagcccca

SEQ ID NO: 4140759 - DNA, 20 bp, Homo sapiens
cttggaatttgtaacctcag

SEQ ID NO: 4140760 - DNA, 18 bp, Homo sapiens
cttggaccatgccagatt

SEQ ID NO: 4140761 - DNA, 15 bp, Homo sapiens
cttggagagaatcat

SEQ ID NO: 4140762 - DNA, 18 bp, Homo sapiens
cttggagagggcccaggt

SEQ ID NO: 4140763 - DNA, 13 bp, Homo sapiens
cttggagggatgg

SEQ ID NO: 4140764 - DNA, 19 bp, Homo sapiens
cttggaggtcacagctgga

SEQ ID NO: 4140765 - DNA, 18 bp, Homo sapiens
cttggagtattggggtct

SEQ ID NO: 4140766 - DNA, 22 bp, Homo sapiens
cttggagtattggggtctgacc

SEQ ID NO: 4140767 - DNA, 16 bp, Homo sapiens
cttggatacttggatt

SEQ ID NO: 4140768 - DNA, 14 bp, Homo sapiens
cttggattctctaa

SEQ ID NO: 4140769 - DNA, 15 bp, Homo sapiens
cttggattttcctga

SEQ ID NO: 4140770 - DNA, 16 bp, Homo sapiens
cttggattttcctgaa

SEQ ID NO: 4140771 - DNA, 20 bp, Homo sapiens
cttggcaaaagccttgtgta

SEQ ID NO: 4140772 - DNA, 11 bp, Homo sapiens
cttggcacttt

SEQ ID NO: 4140773 - DNA, 12 bp, Homo sapiens
cttggcactttt

SEQ ID NO: 4140774 - DNA, 14 bp, Homo sapiens
cttggccagcgctg

SEQ ID NO: 4140775 - DNA, 16 bp, Homo sapiens
cttggccagcgctgtt

SEQ ID NO: 4140776 - DNA, 18 bp, Homo sapiens
cttggccagcgctgttga

SEQ ID NO: 4140777 - DNA, 18 bp, Homo sapiens
cttggccagttatccctt

SEQ ID NO: 4140778 - DNA, 12 bp, Homo sapiens
cttggcctcaga

SEQ ID NO: 4140779 - DNA, 17 bp, Homo sapiens
cttggcctgatcagacc

SEQ ID NO: 4140780 - DNA, 12 bp, Homo sapiens
cttggcctgctg

SEQ ID NO: 4140781 - DNA, 17 bp, Homo sapiens
cttggcctgtctcatcc

SEQ ID NO: 4140782 - DNA, 23 bp, Homo sapiens
cttggcctgtctcatccccaggg

SEQ ID NO: 4140783 - DNA, 14 bp, Homo sapiens
cttggcgtggagcc

SEQ ID NO: 4140784 - DNA, 21 bp, Homo sapiens
cttggctcaatcctctaagct

SEQ ID NO: 4140785 - DNA, 23 bp, Homo sapiens
cttggctcgatgctgtgggggac

SEQ ID NO: 4140786 - DNA, 20 bp, Homo sapiens
cttggctctcctctggctag

SEQ ID NO: 4140787 - DNA, 18 bp, Homo sapiens
cttggctctgccagtgga

SEQ ID NO: 4140788 - DNA, 13 bp, Homo sapiens
cttggctgacccc

SEQ ID NO: 4140789 - DNA, 13 bp, Homo sapiens
cttggctgtgagg

SEQ ID NO: 4140790 - DNA, 19 bp, Homo sapiens
cttggcttacctgacctct

SEQ ID NO: 4140791 - DNA, 19 bp, Homo sapiens
cttgggacccccactaaga

SEQ ID NO: 4140792 - DNA, 16 bp, Homo sapiens
cttgggaggctgaggc

SEQ ID NO: 4140793 - DNA, 16 bp, Homo sapiens
cttgggaggcttcccc

SEQ ID NO: 4140794 - DNA, 13 bp, Homo sapiens
cttgggccctgca

SEQ ID NO: 4140795 - DNA, 16 bp, Homo sapiens
cttgggccctgcacag

SEQ ID NO: 4140796 - DNA, 19 bp, Homo sapiens
cttgggccctgcacagata

SEQ ID NO: 4140797 - DNA, 14 bp, Homo sapiens
cttgggctctgctg

SEQ ID NO: 4140798 - DNA, 13 bp, Homo sapiens
cttgggctggggg

SEQ ID NO: 4140799 - DNA, 20 bp, Homo sapiens
cttggggagttaagacctgg

SEQ ID NO: 4140800 - DNA, 23 bp, Homo sapiens
cttggggagttaagacctggcag

SEQ ID NO: 4140801 - DNA, 16 bp, Homo sapiens
cttgggggcactgctc

SEQ ID NO: 4140802 - DNA, 21 bp, Homo sapiens
cttggggtactcttgatgtga

SEQ ID NO: 4140803 - DNA, 15 bp, Homo sapiens
cttggggtcaagaaa

SEQ ID NO: 4140804 - DNA, 13 bp, Homo sapiens
cttggggtcccac

SEQ ID NO: 4140805 - DNA, 16 bp, Homo sapiens
cttggggtgtggggtg

SEQ ID NO: 4140806 - DNA, 19 bp, Homo sapiens
cttggggtgtggggtgggg

SEQ ID NO: 4140807 - DNA, 23 bp, Homo sapiens
cttgggtcattgacctctcaggg

SEQ ID NO: 4140808 - DNA, 21 bp, Homo sapiens
cttgggtgggtgaaggcctgg

SEQ ID NO: 4140809 - DNA, 17 bp, Homo sapiens
cttgggtttttgttacc

SEQ ID NO: 4140810 - DNA, 19 bp, Homo sapiens
cttggtattattctgtttt

SEQ ID NO: 4140811 - DNA, 21 bp, Homo sapiens
cttggtattattctgttttgc

SEQ ID NO: 4140812 - DNA, 17 bp, Homo sapiens
cttggtcacagccaggc

SEQ ID NO: 4140813 - DNA, 19 bp, Homo sapiens
cttggtgccttttgtgtga

SEQ ID NO: 4140814 - DNA, 17 bp, Homo sapiens
cttggtgctggtttatt

SEQ ID NO: 4140815 - DNA, 16 bp, Homo sapiens
cttggttcataaatga

SEQ ID NO: 4140816 - DNA, 22 bp, Homo sapiens
cttggttcataaatgaatttta

SEQ ID NO: 4140817 - DNA, 19 bp, Homo sapiens
cttggttggtagggtggga

SEQ ID NO: 4140818 - DNA, 23 bp, Homo sapiens
cttggtttgtggcgtctccctcg

SEQ ID NO: 4140819 - DNA, 14 bp, Homo sapiens
cttggttttatggt

SEQ ID NO: 4140820 - DNA, 12 bp, Homo sapiens
cttgtaaagact

SEQ ID NO: 4140821 - DNA, 15 bp, Homo sapiens
cttgtaaagactggt

SEQ ID NO: 4140822 - DNA, 12 bp, Homo sapiens
cttgtaaataca

SEQ ID NO: 4140823 - DNA, 23 bp, Homo sapiens
cttgtaattctaaatgaatgttt

SEQ ID NO: 4140824 - DNA, 20 bp, Homo sapiens
cttgtacagtgtctgtgcca

SEQ ID NO: 4140825 - DNA, 17 bp, Homo sapiens
cttgtagaactcactct

SEQ ID NO: 4140826 - DNA, 18 bp, Homo sapiens
cttgtagaactcactctg

SEQ ID NO: 4140827 - DNA, 20 bp, Homo sapiens
cttgtagaactcactctggg

SEQ ID NO: 4140828 - DNA, 22 bp, Homo sapiens
cttgtatatagagattgtacat

SEQ ID NO: 4140829 - DNA, 12 bp, Homo sapiens
cttgtatatttg

SEQ ID NO: 4140830 - DNA, 18 bp, Homo sapiens
cttgtatatttgtacaaa

SEQ ID NO: 4140831 - DNA, 19 bp, Homo sapiens
cttgtatcaacactgttac

SEQ ID NO: 4140832 - DNA, 13 bp, Homo sapiens
cttgtattaaact

SEQ ID NO: 4140833 - DNA, 22 bp, Homo sapiens
cttgtcaatatttaaacatggt

SEQ ID NO: 4140834 - DNA, 18 bp, Homo sapiens
cttgtcaggcatggctca

SEQ ID NO: 4140835 - DNA, 16 bp, Homo sapiens
cttgtcatagccagtg

SEQ ID NO: 4140836 - DNA, 13 bp, Homo sapiens
cttgtccagctga

SEQ ID NO: 4140837 - DNA, 21 bp, Homo sapiens
cttgtcccgtctggacctggg

SEQ ID NO: 4140838 - DNA, 18 bp, Homo sapiens
cttgtccctttccctacc

SEQ ID NO: 4140839 - DNA, 21 bp, Homo sapiens
cttgtccctttccctaccttt

SEQ ID NO: 4140840 - DNA, 16 bp, Homo sapiens
cttgtcctcttctgct

SEQ ID NO: 4140841 - DNA, 17 bp, Homo sapiens
cttgtcctcttctgctc

SEQ ID NO: 4140842 - DNA, 23 bp, Homo sapiens
cttgtctccactaaatgagctcc

SEQ ID NO: 4140843 - DNA, 13 bp, Homo sapiens
cttgtctctgggc

SEQ ID NO: 4140844 - DNA, 16 bp, Homo sapiens
cttgtctttctggggt

SEQ ID NO: 4140845 - DNA, 17 bp, Homo sapiens
cttgtcttttcaaaata

SEQ ID NO: 4140846 - DNA, 18 bp, Homo sapiens
cttgtcttttcaaaatat

SEQ ID NO: 4140847 - DNA, 18 bp, Homo sapiens
cttgtcttttcagaagca

SEQ ID NO: 4140848 - DNA, 18 bp, Homo sapiens
cttgtgaaacacagctgt

SEQ ID NO: 4140849 - DNA, 20 bp, Homo sapiens
cttgtgaaacacagctgttc

SEQ ID NO: 4140850 - DNA, 12 bp, Homo sapiens
cttgtgaagttg

SEQ ID NO: 4140851 - DNA, 15 bp, Homo sapiens
cttgtgagagcccat

SEQ ID NO: 4140852 - DNA, 23 bp, Homo sapiens
cttgtgagagcccattcccacca

SEQ ID NO: 4140853 - DNA, 22 bp, Homo sapiens
cttgtgaggattatgggtcctg

SEQ ID NO: 4140854 - DNA, 21 bp, Homo sapiens
cttgtgatttctttaaaagaa

SEQ ID NO: 4140855 - DNA, 16 bp, Homo sapiens
cttgtgcacaggcaga

SEQ ID NO: 4140856 - DNA, 17 bp, Homo sapiens
cttgtgccacaccctcc

SEQ ID NO: 4140857 - DNA, 22 bp, Homo sapiens
cttgtgctcctcttgattcctg

SEQ ID NO: 4140858 - DNA, 20 bp, Homo sapiens
cttgtgctgatcgtgctaaa

SEQ ID NO: 4140859 - DNA, 14 bp, Homo sapiens
cttgtgctttgctc

SEQ ID NO: 4140860 - DNA, 22 bp, Homo sapiens
cttgtggctccacacacacaaa

SEQ ID NO: 4140861 - DNA, 12 bp, Homo sapiens
cttgtgggctgg

SEQ ID NO: 4140862 - DNA, 21 bp, Homo sapiens
cttgtgggctggtgccccaca

SEQ ID NO: 4140863 - DNA, 15 bp, Homo sapiens
cttgtggtgtaaagc

SEQ ID NO: 4140864 - DNA, 23 bp, Homo sapiens
cttgtggtgtaaagctggccctg

SEQ ID NO: 4140865 - DNA, 14 bp, Homo sapiens
cttgtgtcccatga

SEQ ID NO: 4140866 - DNA, 21 bp, Homo sapiens
cttgtgtcctgtcctttcttg

SEQ ID NO: 4140867 - DNA, 19 bp, Homo sapiens
cttgtgttaagtatgtgta

SEQ ID NO: 4140868 - DNA, 15 bp, Homo sapiens
cttgtgttctgagta

SEQ ID NO: 4140869 - DNA, 17 bp, Homo sapiens
cttgtgtttgcttaaac

SEQ ID NO: 4140870 - DNA, 20 bp, Homo sapiens
cttgttccagccctattctg

SEQ ID NO: 4140871 - DNA, 18 bp, Homo sapiens
cttgttgcatttccagct

SEQ ID NO: 4140872 - DNA, 20 bp, Homo sapiens
cttgttgctcaaaaaatgag

SEQ ID NO: 4140873 - DNA, 15 bp, Homo sapiens
cttgttggtcagagg

SEQ ID NO: 4140874 - DNA, 19 bp, Homo sapiens
cttgtttatgatatttctt

SEQ ID NO: 4140875 - DNA, 23 bp, Homo sapiens
cttgtttatgatatttcttgctt

SEQ ID NO: 4140876 - DNA, 16 bp, Homo sapiens
cttgtttcatctggtt

SEQ ID NO: 4140877 - DNA, 12 bp, Homo sapiens
cttgtttctccc

SEQ ID NO: 4140878 - DNA, 19 bp, Homo sapiens
cttgtttgagtttttcctc

SEQ ID NO: 4140879 - DNA, 21 bp, Homo sapiens
cttgtttggtttggtttgctt

SEQ ID NO: 4140880 - DNA, 19 bp, Homo sapiens
cttgttttaagcaaatgca

SEQ ID NO: 4140881 - DNA, 22 bp, Homo sapiens
cttgttttataaaattttgctt

SEQ ID NO: 4140882 - DNA, 13 bp, Homo sapiens
cttgttttgcttc

SEQ ID NO: 4140883 - DNA, 15 bp, Homo sapiens
cttgttttgcttccc

SEQ ID NO: 4140884 - DNA, 23 bp, Homo sapiens
cttgttttgcttcccctcccccc

SEQ ID NO: 4140885 - DNA, 17 bp, Homo sapiens
ctttaaaaaaatttaag

SEQ ID NO: 4140886 - DNA, 18 bp, Homo sapiens
ctttaaaaaaatttaagt

SEQ ID NO: 4140887 - DNA, 17 bp, Homo sapiens
ctttaaaaaatatttat

SEQ ID NO: 4140888 - DNA, 13 bp, Homo sapiens
ctttaaaaagaaa

SEQ ID NO: 4140889 - DNA, 15 bp, Homo sapiens
ctttaaaagaaaata

SEQ ID NO: 4140890 - DNA, 18 bp, Homo sapiens
ctttaaaaggaaagaaaa

SEQ ID NO: 4140891 - DNA, 22 bp, Homo sapiens
ctttaaacctgtttttttttca

SEQ ID NO: 4140892 - DNA, 15 bp, Homo sapiens
ctttaaactcaggga

SEQ ID NO: 4140893 - DNA, 22 bp, Homo sapiens
ctttaaactcagggacagagcc

SEQ ID NO: 4140894 - DNA, 10 bp, Homo sapiens
ctttaaagaa

SEQ ID NO: 4140895 - DNA, 21 bp, Homo sapiens
ctttaaaggcatctacacaat

SEQ ID NO: 4140896 - DNA, 18 bp, Homo sapiens
ctttaaagggcctgcctg

SEQ ID NO: 4140897 - DNA, 21 bp, Homo sapiens
ctttaaaggtttttaaattgt

SEQ ID NO: 4140898 - DNA, 15 bp, Homo sapiens
ctttaaatacttcat

SEQ ID NO: 4140899 - DNA, 18 bp, Homo sapiens
ctttaaatacttcatgag

SEQ ID NO: 4140900 - DNA, 20 bp, Homo sapiens
ctttaagatatccatctttt

SEQ ID NO: 4140901 - DNA, 19 bp, Homo sapiens
ctttaagcactacataaac

SEQ ID NO: 4140902 - DNA, 19 bp, Homo sapiens
ctttaagccatagaccctg

SEQ ID NO: 4140903 - DNA, 23 bp, Homo sapiens
ctttaagccatagaccctgaggc

SEQ ID NO: 4140904 - DNA, 13 bp, Homo sapiens
ctttaagctcctt

SEQ ID NO: 4140905 - DNA, 20 bp, Homo sapiens
ctttaaggatttgaaccatg

SEQ ID NO: 4140906 - DNA, 17 bp, Homo sapiens
ctttaagtttcaggata

SEQ ID NO: 4140907 - DNA, 17 bp, Homo sapiens
ctttaatcttcagtttt

SEQ ID NO: 4140908 - DNA, 22 bp, Homo sapiens
ctttaatcttcagttttatctt

SEQ ID NO: 4140909 - DNA, 23 bp, Homo sapiens
ctttaatgcatctagattatgga

SEQ ID NO: 4140910 - DNA, 17 bp, Homo sapiens
ctttaatgttttttgcc

SEQ ID NO: 4140911 - DNA, 19 bp, Homo sapiens
ctttaattctctttcaaag

SEQ ID NO: 4140912 - DNA, 21 bp, Homo sapiens
ctttacaagcaggcactgtat

SEQ ID NO: 4140913 - DNA, 23 bp, Homo sapiens
ctttacacggagcggattgcaaa

SEQ ID NO: 4140914 - DNA, 17 bp, Homo sapiens
ctttaccctctttgctg

SEQ ID NO: 4140915 - DNA, 16 bp, Homo sapiens
ctttacctgagaccag

SEQ ID NO: 4140916 - DNA, 14 bp, Homo sapiens
ctttacctgtatac

SEQ ID NO: 4140917 - DNA, 16 bp, Homo sapiens
ctttacgcccatctca

SEQ ID NO: 4140918 - DNA, 22 bp, Homo sapiens
ctttacgcccatctcaggacac

SEQ ID NO: 4140919 - DNA, 22 bp, Homo sapiens
ctttacgtgtttaaaaaaaagc

SEQ ID NO: 4140920 - DNA, 22 bp, Homo sapiens
ctttactcccaagacttcattg

SEQ ID NO: 4140921 - DNA, 15 bp, Homo sapiens
ctttactcgtgcatt

SEQ ID NO: 4140922 - DNA, 17 bp, Homo sapiens
ctttactctgtgtttaa

SEQ ID NO: 4140923 - DNA, 16 bp, Homo sapiens
ctttacttgtctttct

SEQ ID NO: 4140924 - DNA, 18 bp, Homo sapiens
ctttacttgtctttctgg

SEQ ID NO: 4140925 - DNA, 15 bp, Homo sapiens
ctttagaaataaatg

SEQ ID NO: 4140926 - DNA, 14 bp, Homo sapiens
ctttagaccctggg

SEQ ID NO: 4140927 - DNA, 16 bp, Homo sapiens
ctttagaccctgggtg

SEQ ID NO: 4140928 - DNA, 19 bp, Homo sapiens
ctttagagaagtatacata

SEQ ID NO: 4140929 - DNA, 22 bp, Homo sapiens
ctttagagaagtatacataagt

SEQ ID NO: 4140930 - DNA, 12 bp, Homo sapiens
ctttagattaaa

SEQ ID NO: 4140931 - DNA, 15 bp, Homo sapiens
ctttagccaaaccct

SEQ ID NO: 4140932 - DNA, 21 bp, Homo sapiens
ctttaggagggagttatctaa

SEQ ID NO: 4140933 - DNA, 13 bp, Homo sapiens
ctttagtataatt

SEQ ID NO: 4140934 - DNA, 18 bp, Homo sapiens
ctttagtgccggctgtgg

SEQ ID NO: 4140935 - DNA, 20 bp, Homo sapiens
ctttataagtcattgtatgt

SEQ ID NO: 4140936 - DNA, 19 bp, Homo sapiens
ctttataattctactttga

SEQ ID NO: 4140937 - DNA, 12 bp, Homo sapiens
ctttatacatta

SEQ ID NO: 4140938 - DNA, 14 bp, Homo sapiens
ctttatactgtgaa

SEQ ID NO: 4140939 - DNA, 15 bp, Homo sapiens
ctttatactgtgaag

SEQ ID NO: 4140940 - DNA, 17 bp, Homo sapiens
ctttatactgtgaagtt

SEQ ID NO: 4140941 - DNA, 21 bp, Homo sapiens
ctttatcaaaaaaagactcag

SEQ ID NO: 4140942 - DNA, 15 bp, Homo sapiens
ctttatcattgctaa

SEQ ID NO: 4140943 - DNA, 16 bp, Homo sapiens
ctttatctcctgctct

SEQ ID NO: 4140944 - DNA, 13 bp, Homo sapiens
ctttatctgttct

SEQ ID NO: 4140945 - DNA, 18 bp, Homo sapiens
ctttatctgttcttgcta

SEQ ID NO: 4140946 - DNA, 22 bp, Homo sapiens
ctttatgaatgaaaaaacagtc

SEQ ID NO: 4140947 - DNA, 13 bp, Homo sapiens
ctttatggctgct

SEQ ID NO: 4140948 - DNA, 12 bp, Homo sapiens
ctttatgtgaat

SEQ ID NO: 4140949 - DNA, 14 bp, Homo sapiens
ctttatgtgaattt

SEQ ID NO: 4140950 - DNA, 13 bp, Homo sapiens
ctttattaccagt

SEQ ID NO: 4140951 - DNA, 20 bp, Homo sapiens
ctttattaccccctccttca

SEQ ID NO: 4140952 - DNA, 22 bp, Homo sapiens
ctttattaccccctccttcaga

SEQ ID NO: 4140953 - DNA, 20 bp, Homo sapiens
ctttattccagaatgctgta

SEQ ID NO: 4140954 - DNA, 19 bp, Homo sapiens
ctttattgcccatgggata

SEQ ID NO: 4140955 - DNA, 18 bp, Homo sapiens
ctttattgcttttttgta

SEQ ID NO: 4140956 - DNA, 19 bp, Homo sapiens
ctttattgcttttttgtat

SEQ ID NO: 4140957 - DNA, 21 bp, Homo sapiens
ctttattttcccctatcattt

SEQ ID NO: 4140958 - DNA, 21 bp, Homo sapiens
ctttattttttaagtatttat

SEQ ID NO: 4140959 - DNA, 19 bp, Homo sapiens
ctttcactacatattaaat

SEQ ID NO: 4140960 - DNA, 15 bp, Homo sapiens
ctttcacttctttcc

SEQ ID NO: 4140961 - DNA, 16 bp, Homo sapiens
ctttcacttctttccc

SEQ ID NO: 4140962 - DNA, 14 bp, Homo sapiens
ctttcagagacagc

SEQ ID NO: 4140963 - DNA, 21 bp, Homo sapiens
ctttcaggggggttgtgaggc

SEQ ID NO: 4140964 - DNA, 18 bp, Homo sapiens
ctttcatcacactgggtg

SEQ ID NO: 4140965 - DNA, 19 bp, Homo sapiens
ctttcatcctgactctgcc

SEQ ID NO: 4140966 - DNA, 18 bp, Homo sapiens
ctttcattccttcagatt

SEQ ID NO: 4140967 - DNA, 14 bp, Homo sapiens
ctttccaagcttgg

SEQ ID NO: 4140968 - DNA, 16 bp, Homo sapiens
ctttccaattctcctt

SEQ ID NO: 4140969 - DNA, 21 bp, Homo sapiens
ctttccacatttgtcacagaa

SEQ ID NO: 4140970 - DNA, 22 bp, Homo sapiens
ctttccatccattacctccatc

SEQ ID NO: 4140971 - DNA, 24 bp, Homo sapiens
ctttccatgggagccagctgcttt

SEQ ID NO: 4140972 - DNA, 17 bp, Homo sapiens
ctttcccagaagtggct

SEQ ID NO: 4140973 - DNA, 12 bp, Homo sapiens
ctttcccttggt

SEQ ID NO: 4140974 - DNA, 15 bp, Homo sapiens
ctttccgctgtcgcc

SEQ ID NO: 4140975 - DNA, 20 bp, Homo sapiens
ctttccgctgtcgccccagg

SEQ ID NO: 4140976 - DNA, 19 bp, Homo sapiens
ctttcctaggcccaggcct

SEQ ID NO: 4140977 - DNA, 12 bp, Homo sapiens
ctttcctccacc

SEQ ID NO: 4140978 - DNA, 22 bp, Homo sapiens
ctttcctcctcaggcacacagc

SEQ ID NO: 4140979 - DNA, 17 bp, Homo sapiens
ctttcctcctttatcac

SEQ ID NO: 4140980 - DNA, 13 bp, Homo sapiens
ctttcctcgcctg

SEQ ID NO: 4140981 - DNA, 19 bp, Homo sapiens
ctttcctgccccaggcctg

SEQ ID NO: 4140982 - DNA, 22 bp, Homo sapiens
ctttcctgccctgtccaaaagc

SEQ ID NO: 4140983 - DNA, 13 bp, Homo sapiens
ctttcctgggcct

SEQ ID NO: 4140984 - DNA, 10 bp, Homo sapiens
ctttcctgtc

SEQ ID NO: 4140985 - DNA, 13 bp, Homo sapiens
ctttcctgtgcca

SEQ ID NO: 4140986 - DNA, 14 bp, Homo sapiens
ctttcctgtgccag

SEQ ID NO: 4140987 - DNA, 18 bp, Homo sapiens
ctttccttccctctctga

SEQ ID NO: 4140988 - DNA, 20 bp, Homo sapiens
ctttcgaggcctgaagccag

SEQ ID NO: 4140989 - DNA, 15 bp, Homo sapiens
ctttcgtacattggc

SEQ ID NO: 4140990 - DNA, 17 bp, Homo sapiens
ctttctaagagaagcaa

SEQ ID NO: 4140991 - DNA, 19 bp, Homo sapiens
ctttctacaactgattgca

SEQ ID NO: 4140992 - DNA, 18 bp, Homo sapiens
ctttctacaatgtgaact

SEQ ID NO: 4140993 - DNA, 20 bp, Homo sapiens
ctttctacaatgtgaacttt

SEQ ID NO: 4140994 - DNA, 18 bp, Homo sapiens
ctttctacttttttcatt

SEQ ID NO: 4140995 - DNA, 20 bp, Homo sapiens
ctttctagtggtctttgtaa

SEQ ID NO: 4140996 - DNA, 21 bp, Homo sapiens
ctttctagtggtctttgtaag

SEQ ID NO: 4140997 - DNA, 14 bp, Homo sapiens
ctttctatgtgaca

SEQ ID NO: 4140998 - DNA, 22 bp, Homo sapiens
ctttctcagccgcttctgactg

SEQ ID NO: 4140999 - DNA, 15 bp, Homo sapiens
ctttctccaaagtta

SEQ ID NO: 4141000 - DNA, 16 bp, Homo sapiens
ctttctccagccagca

SEQ ID NO: 4141001 - DNA, 20 bp, Homo sapiens
ctttctccagccagcaatga

SEQ ID NO: 4141002 - DNA, 12 bp, Homo sapiens
ctttctcctgtt

SEQ ID NO: 4141003 - DNA, 22 bp, Homo sapiens
ctttctcctgtttattcccatc

SEQ ID NO: 4141004 - DNA, 13 bp, Homo sapiens
ctttctctgccag

SEQ ID NO: 4141005 - DNA, 18 bp, Homo sapiens
ctttctctgccagtgaca

SEQ ID NO: 4141006 - DNA, 9 bp, Homo sapiens
ctttctctt

SEQ ID NO: 4141007 - DNA, 17 bp, Homo sapiens
ctttctcttccccttcc

SEQ ID NO: 4141008 - DNA, 21 bp, Homo sapiens
ctttctcttttcccctttcct

SEQ ID NO: 4141009 - DNA, 21 bp, Homo sapiens
ctttctgccatctagccagcc

SEQ ID NO: 4141010 - DNA, 17 bp, Homo sapiens
ctttctggcctgccttc

SEQ ID NO: 4141011 - DNA, 19 bp, Homo sapiens
ctttctggggtttttctgt

SEQ ID NO: 4141012 - DNA, 18 bp, Homo sapiens
ctttctgtatatactttt

SEQ ID NO: 4141013 - DNA, 13 bp, Homo sapiens
ctttctgtcccac

SEQ ID NO: 4141014 - DNA, 15 bp, Homo sapiens
ctttctgttccaaat

SEQ ID NO: 4141015 - DNA, 14 bp, Homo sapiens
ctttctgttgtcat

SEQ ID NO: 4141016 - DNA, 15 bp, Homo sapiens
ctttctgttgtcatt

SEQ ID NO: 4141017 - DNA, 21 bp, Homo sapiens
ctttctgttttctgtttgtaa

SEQ ID NO: 4141018 - DNA, 22 bp, Homo sapiens
ctttctgttttctgtttgtaaa

SEQ ID NO: 4141019 - DNA, 23 bp, Homo sapiens
ctttcttacctactattggccct

SEQ ID NO: 4141020 - DNA, 15 bp, Homo sapiens
ctttcttctgccctt

SEQ ID NO: 4141021 - DNA, 20 bp, Homo sapiens
ctttcttgctcccttcagcc

SEQ ID NO: 4141022 - DNA, 16 bp, Homo sapiens
ctttcttgctggttgt

SEQ ID NO: 4141023 - DNA, 21 bp, Homo sapiens
ctttcttgctggttgtcattt

SEQ ID NO: 4141024 - DNA, 14 bp, Homo sapiens
ctttcttggccagt

SEQ ID NO: 4141025 - DNA, 21 bp, Homo sapiens
ctttcttgtcttttcagaagc

SEQ ID NO: 4141026 - DNA, 15 bp, Homo sapiens
ctttctttaaatgtt

SEQ ID NO: 4141027 - DNA, 15 bp, Homo sapiens
ctttctttacctgag

SEQ ID NO: 4141028 - DNA, 18 bp, Homo sapiens
ctttctttacctgagacc

SEQ ID NO: 4141029 - DNA, 16 bp, Homo sapiens
ctttctttgcctctgc

SEQ ID NO: 4141030 - DNA, 17 bp, Homo sapiens
ctttctttgcctctgca

SEQ ID NO: 4141031 - DNA, 18 bp, Homo sapiens
ctttctttgcctctgcag

SEQ ID NO: 4141032 - DNA, 21 bp, Homo sapiens
ctttctttgcctctgcagtct

SEQ ID NO: 4141033 - DNA, 16 bp, Homo sapiens
ctttgaaacctcaggg

SEQ ID NO: 4141034 - DNA, 17 bp, Homo sapiens
ctttgaaacctcagggc

SEQ ID NO: 4141035 - DNA, 19 bp, Homo sapiens
ctttgaaatagtctgtgtg

SEQ ID NO: 4141036 - DNA, 21 bp, Homo sapiens
ctttgaaatagtctgtgtgaa

SEQ ID NO: 4141037 - DNA, 13 bp, Homo sapiens
ctttgaagcctca

SEQ ID NO: 4141038 - DNA, 13 bp, Homo sapiens
ctttgaagtagct

SEQ ID NO: 4141039 - DNA, 18 bp, Homo sapiens
ctttgaataaaaatgcac

SEQ ID NO: 4141040 - DNA, 16 bp, Homo sapiens
ctttgacaactaaaat

SEQ ID NO: 4141041 - DNA, 21 bp, Homo sapiens
ctttgactgatgctgagattc

SEQ ID NO: 4141042 - DNA, 22 bp, Homo sapiens
ctttgacttcagctgcctgaaa

SEQ ID NO: 4141043 - DNA, 21 bp, Homo sapiens
ctttgactttatctcctgctc

SEQ ID NO: 4141044 - DNA, 14 bp, Homo sapiens
ctttgactttcttc

SEQ ID NO: 4141045 - DNA, 13 bp, Homo sapiens
ctttgagacagtt

SEQ ID NO: 4141046 - DNA, 18 bp, Homo sapiens
ctttgagacagtttctta

SEQ ID NO: 4141047 - DNA, 21 bp, Homo sapiens
ctttgataatgttaaatttgt

SEQ ID NO: 4141048 - DNA, 22 bp, Homo sapiens
ctttgataatgttaaatttgta

SEQ ID NO: 4141049 - DNA, 16 bp, Homo sapiens
ctttgatctggacaga

SEQ ID NO: 4141050 - DNA, 23 bp, Homo sapiens
ctttgatctggacagaacattta

SEQ ID NO: 4141051 - DNA, 17 bp, Homo sapiens
ctttgcacaggaaagag

SEQ ID NO: 4141052 - DNA, 20 bp, Homo sapiens
ctttgcacaggatgctggcc

SEQ ID NO: 4141053 - DNA, 13 bp, Homo sapiens
ctttgcactgagg

SEQ ID NO: 4141054 - DNA, 14 bp, Homo sapiens
ctttgcactgaggg

SEQ ID NO: 4141055 - DNA, 18 bp, Homo sapiens
ctttgcactgagggccac

SEQ ID NO: 4141056 - DNA, 22 bp, Homo sapiens
ctttgcactgagggccacacta

SEQ ID NO: 4141057 - DNA, 23 bp, Homo sapiens
ctttgcactgagggccacactat

SEQ ID NO: 4141058 - DNA, 13 bp, Homo sapiens
ctttgcagggcag

SEQ ID NO: 4141059 - DNA, 12 bp, Homo sapiens
ctttgcagggct

SEQ ID NO: 4141060 - DNA, 23 bp, Homo sapiens
ctttgcagttggactctcaggga

SEQ ID NO: 4141061 - DNA, 18 bp, Homo sapiens
ctttgcatatgagccgtg

SEQ ID NO: 4141062 - DNA, 12 bp, Homo sapiens
ctttgcatttat

SEQ ID NO: 4141063 - DNA, 14 bp, Homo sapiens
ctttgccaaaaaaa

SEQ ID NO: 4141064 - DNA, 21 bp, Homo sapiens
ctttgccatcaatgatcatat

SEQ ID NO: 4141065 - DNA, 14 bp, Homo sapiens
ctttgcccacccct

SEQ ID NO: 4141066 - DNA, 15 bp, Homo sapiens
ctttgcccacccctc

SEQ ID NO: 4141067 - DNA, 17 bp, Homo sapiens
ctttgcccacccctcac

SEQ ID NO: 4141068 - DNA, 19 bp, Homo sapiens
ctttgcccacccctcactc

SEQ ID NO: 4141069 - DNA, 21 bp, Homo sapiens
ctttgccctttacttgtcttt

SEQ ID NO: 4141070 - DNA, 14 bp, Homo sapiens
ctttgcctcaagac

SEQ ID NO: 4141071 - DNA, 15 bp, Homo sapiens
ctttgcctctaccag

SEQ ID NO: 4141072 - DNA, 21 bp, Homo sapiens
ctttgcctctaccagttggca

SEQ ID NO: 4141073 - DNA, 17 bp, Homo sapiens
ctttgcctcttctttgt

SEQ ID NO: 4141074 - DNA, 13 bp, Homo sapiens
ctttgccttctct

SEQ ID NO: 4141075 - DNA, 15 bp, Homo sapiens
ctttgccttcttttg

SEQ ID NO: 4141076 - DNA, 12 bp, Homo sapiens
ctttgccttgca

SEQ ID NO: 4141077 - DNA, 13 bp, Homo sapiens
ctttgccttgggc

SEQ ID NO: 4141078 - DNA, 16 bp, Homo sapiens
ctttgccttgggctgc

SEQ ID NO: 4141079 - DNA, 15 bp, Homo sapiens
ctttgcgcctgtgac

SEQ ID NO: 4141080 - DNA, 22 bp, Homo sapiens
ctttgctgcagagatcaagggt

SEQ ID NO: 4141081 - DNA, 23 bp, Homo sapiens
ctttgctgtgaggaatgctctgt

SEQ ID NO: 4141082 - DNA, 13 bp, Homo sapiens
ctttgcttcatag

SEQ ID NO: 4141083 - DNA, 19 bp, Homo sapiens
ctttgcttcccctccagga

SEQ ID NO: 4141084 - DNA, 13 bp, Homo sapiens
ctttgcttgcttt

SEQ ID NO: 4141085 - DNA, 23 bp, Homo sapiens
ctttggaaagtacactctgctgt

SEQ ID NO: 4141086 - DNA, 11 bp, Homo sapiens
ctttggaagga

SEQ ID NO: 4141087 - DNA, 23 bp, Homo sapiens
ctttggagcttttttctttaaga

SEQ ID NO: 4141088 - DNA, 16 bp, Homo sapiens
ctttggatttgacatt

SEQ ID NO: 4141089 - DNA, 17 bp, Homo sapiens
ctttggcagtgttttgg

SEQ ID NO: 4141090 - DNA, 13 bp, Homo sapiens
ctttggctcccct

SEQ ID NO: 4141091 - DNA, 17 bp, Homo sapiens
ctttggctgaggggctt

SEQ ID NO: 4141092 - DNA, 17 bp, Homo sapiens
ctttgggaggctgaggc

SEQ ID NO: 4141093 - DNA, 18 bp, Homo sapiens
ctttgggcctctgcttct

SEQ ID NO: 4141094 - DNA, 21 bp, Homo sapiens
ctttgggctgccctggtgctg

SEQ ID NO: 4141095 - DNA, 20 bp, Homo sapiens
ctttggggagcaggaggcca

SEQ ID NO: 4141096 - DNA, 17 bp, Homo sapiens
ctttggggtcagccagg

SEQ ID NO: 4141097 - DNA, 21 bp, Homo sapiens
ctttggggtcagccagggcca

SEQ ID NO: 4141098 - DNA, 23 bp, Homo sapiens
ctttgggtctacaagtatatgtg

SEQ ID NO: 4141099 - DNA, 20 bp, Homo sapiens
ctttgggttaagcattacca

SEQ ID NO: 4141100 - DNA, 15 bp, Homo sapiens
ctttggttctctcca

SEQ ID NO: 4141101 - DNA, 16 bp, Homo sapiens
ctttggtttctgtctg

SEQ ID NO: 4141102 - DNA, 19 bp, Homo sapiens
ctttggtttttttcttctg

SEQ ID NO: 4141103 - DNA, 21 bp, Homo sapiens
ctttgtaaaatatcgtgtgtg

SEQ ID NO: 4141104 - DNA, 13 bp, Homo sapiens
ctttgtaaattgt

SEQ ID NO: 4141105 - DNA, 19 bp, Homo sapiens
ctttgtaagagtgtagaag

SEQ ID NO: 4141106 - DNA, 21 bp, Homo sapiens
ctttgtaagagtgtagaagca

SEQ ID NO: 4141107 - DNA, 21 bp, Homo sapiens
ctttgtaagtcagtgttgaga

SEQ ID NO: 4141108 - DNA, 15 bp, Homo sapiens
ctttgtacagagtgc

SEQ ID NO: 4141109 - DNA, 12 bp, Homo sapiens
ctttgtatgcac

SEQ ID NO: 4141110 - DNA, 15 bp, Homo sapiens
ctttgtcccggggct

SEQ ID NO: 4141111 - DNA, 17 bp, Homo sapiens
ctttgtcctcctgctgc

SEQ ID NO: 4141112 - DNA, 13 bp, Homo sapiens
ctttgtctctcct

SEQ ID NO: 4141113 - DNA, 19 bp, Homo sapiens
ctttgtctctcctggctgg

SEQ ID NO: 4141114 - DNA, 22 bp, Homo sapiens
ctttgtgacaggaaagccctcc

SEQ ID NO: 4141115 - DNA, 16 bp, Homo sapiens
ctttgtgcacatttat

SEQ ID NO: 4141116 - DNA, 23 bp, Homo sapiens
ctttgtgcacatttatttcctcc

SEQ ID NO: 4141117 - DNA, 20 bp, Homo sapiens
ctttgtggattctgaggccc

SEQ ID NO: 4141118 - DNA, 18 bp, Homo sapiens
ctttgtgtgtactcactg

SEQ ID NO: 4141119 - DNA, 20 bp, Homo sapiens
ctttgtgttgggagggatta

SEQ ID NO: 4141120 - DNA, 13 bp, Homo sapiens
ctttgtgttgtaa

SEQ ID NO: 4141121 - DNA, 14 bp, Homo sapiens
ctttgtgttgtaat

SEQ ID NO: 4141122 - DNA, 22 bp, Homo sapiens
ctttgtgttgtaattcttcagt

SEQ ID NO: 4141123 - DNA, 20 bp, Homo sapiens
ctttgtgtttggtttacatt

SEQ ID NO: 4141124 - DNA, 22 bp, Homo sapiens
ctttgtgtttggtttacattta

SEQ ID NO: 4141125 - DNA, 22 bp, Homo sapiens
ctttgttatttttgtttcttcc

SEQ ID NO: 4141126 - DNA, 15 bp, Homo sapiens
ctttgttctgagcat

SEQ ID NO: 4141127 - DNA, 23 bp, Homo sapiens
ctttgttctgagcattcgctgta

SEQ ID NO: 4141128 - DNA, 18 bp, Homo sapiens
ctttgttgcaagatgtga

SEQ ID NO: 4141129 - DNA, 20 bp, Homo sapiens
ctttgttgcaagatgtgaat

SEQ ID NO: 4141130 - DNA, 21 bp, Homo sapiens
ctttgttgcaagatgtgaatt

SEQ ID NO: 4141131 - DNA, 21 bp, Homo sapiens
ctttgtttggatgtaatttag

SEQ ID NO: 4141132 - DNA, 22 bp, Homo sapiens
ctttgtttgtcacaagtggtgt

SEQ ID NO: 4141133 - DNA, 14 bp, Homo sapiens
ctttgttttaataa

SEQ ID NO: 4141134 - DNA, 20 bp, Homo sapiens
ctttgttttctgactaatta

SEQ ID NO: 4141135 - DNA, 19 bp, Homo sapiens
ctttgttttcttagttact

SEQ ID NO: 4141136 - DNA, 19 bp, Homo sapiens
ctttgttttgatgtttgtg

SEQ ID NO: 4141137 - DNA, 23 bp, Homo sapiens
ctttgttttgatgtttgtggcct

SEQ ID NO: 4141138 - DNA, 24 bp, Homo sapiens
ctttgttttgatgtttgtggcctc

SEQ ID NO: 4141139 - DNA, 22 bp, Homo sapiens
cttttaaatgattgaattatat

SEQ ID NO: 4141140 - DNA, 22 bp, Homo sapiens
cttttaactgttgtagaagaca

SEQ ID NO: 4141141 - DNA, 16 bp, Homo sapiens
cttttaatacagggta

SEQ ID NO: 4141142 - DNA, 17 bp, Homo sapiens
cttttaatgcttcattc

SEQ ID NO: 4141143 - DNA, 19 bp, Homo sapiens
cttttaccactatttaagt

SEQ ID NO: 4141144 - DNA, 13 bp, Homo sapiens
cttttagcctagt

SEQ ID NO: 4141145 - DNA, 14 bp, Homo sapiens
cttttaggaaaatc

SEQ ID NO: 4141146 - DNA, 18 bp, Homo sapiens
cttttagttgactcacag

SEQ ID NO: 4141147 - DNA, 14 bp, Homo sapiens
cttttagtttttct

SEQ ID NO: 4141148 - DNA, 18 bp, Homo sapiens
cttttagtttttctgtcc

SEQ ID NO: 4141149 - DNA, 20 bp, Homo sapiens
cttttagtttttctgtccct

SEQ ID NO: 4141150 - DNA, 21 bp, Homo sapiens
cttttataggtgagaaaaaaa

SEQ ID NO: 4141151 - DNA, 20 bp, Homo sapiens
cttttatatggcccagcctt

SEQ ID NO: 4141152 - DNA, 21 bp, Homo sapiens
cttttatatggcccagccttg

SEQ ID NO: 4141153 - DNA, 14 bp, Homo sapiens
cttttatatttgta

SEQ ID NO: 4141154 - DNA, 22 bp, Homo sapiens
cttttatctgtttaaagcatat

SEQ ID NO: 4141155 - DNA, 13 bp, Homo sapiens
cttttatgtagca

SEQ ID NO: 4141156 - DNA, 15 bp, Homo sapiens
cttttatgtagtaat

SEQ ID NO: 4141157 - DNA, 22 bp, Homo sapiens
cttttatgtagtaattgacatg

SEQ ID NO: 4141158 - DNA, 18 bp, Homo sapiens
cttttattcttctttctt

SEQ ID NO: 4141159 - DNA, 19 bp, Homo sapiens
cttttatttgcaacattta

SEQ ID NO: 4141160 - DNA, 19 bp, Homo sapiens
cttttattttgaaaagctt

SEQ ID NO: 4141161 - DNA, 21 bp, Homo sapiens
cttttattttttcttttgtaa

SEQ ID NO: 4141162 - DNA, 14 bp, Homo sapiens
cttttcacccttct

SEQ ID NO: 4141163 - DNA, 18 bp, Homo sapiens
cttttcacccttctactc

SEQ ID NO: 4141164 - DNA, 22 bp, Homo sapiens
cttttcacttcgggctgtgtaa

SEQ ID NO: 4141165 - DNA, 20 bp, Homo sapiens
cttttcataaagggttgaaa

SEQ ID NO: 4141166 - DNA, 15 bp, Homo sapiens
cttttcattctcatt

SEQ ID NO: 4141167 - DNA, 21 bp, Homo sapiens
cttttccagagcattccagtc

SEQ ID NO: 4141168 - DNA, 16 bp, Homo sapiens
cttttcccccttccca

SEQ ID NO: 4141169 - DNA, 16 bp, Homo sapiens
cttttcccctgttaaa

SEQ ID NO: 4141170 - DNA, 20 bp, Homo sapiens
cttttccctctttggctccc

SEQ ID NO: 4141171 - DNA, 14 bp, Homo sapiens
cttttccctgcttc

SEQ ID NO: 4141172 - DNA, 22 bp, Homo sapiens
cttttcccttacaaggtgggga

SEQ ID NO: 4141173 - DNA, 17 bp, Homo sapiens
cttttccgttctgttct

SEQ ID NO: 4141174 - DNA, 22 bp, Homo sapiens
cttttccgttctgttctgctgg

SEQ ID NO: 4141175 - DNA, 23 bp, Homo sapiens
cttttccgttctgttctgctggg

SEQ ID NO: 4141176 - DNA, 18 bp, Homo sapiens
cttttcctcgcttctttc

SEQ ID NO: 4141177 - DNA, 20 bp, Homo sapiens
cttttcctcgcttctttcaa

SEQ ID NO: 4141178 - DNA, 22 bp, Homo sapiens
cttttcctgataaagcacagct

SEQ ID NO: 4141179 - DNA, 15 bp, Homo sapiens
cttttcctggtgctc

SEQ ID NO: 4141180 - DNA, 20 bp, Homo sapiens
cttttccttatttgccttct

SEQ ID NO: 4141181 - DNA, 23 bp, Homo sapiens
cttttccttatttgccttctact

SEQ ID NO: 4141182 - DNA, 15 bp, Homo sapiens
cttttccttcattca

SEQ ID NO: 4141183 - DNA, 16 bp, Homo sapiens
cttttcgttaacattg

SEQ ID NO: 4141184 - DNA, 16 bp, Homo sapiens
cttttctaacagaaag

SEQ ID NO: 4141185 - DNA, 13 bp, Homo sapiens
cttttctcaggac

SEQ ID NO: 4141186 - DNA, 13 bp, Homo sapiens
cttttctctttct

SEQ ID NO: 4141187 - DNA, 20 bp, Homo sapiens
cttttctgcattttgctatt

SEQ ID NO: 4141188 - DNA, 19 bp, Homo sapiens
cttttctgccctggctgct

SEQ ID NO: 4141189 - DNA, 15 bp, Homo sapiens
cttttctgtcaccaa

SEQ ID NO: 4141190 - DNA, 18 bp, Homo sapiens
cttttctttaaagaagtt

SEQ ID NO: 4141191 - DNA, 14 bp, Homo sapiens
cttttctttttaca

SEQ ID NO: 4141192 - DNA, 13 bp, Homo sapiens
cttttgacatgtg

SEQ ID NO: 4141193 - DNA, 16 bp, Homo sapiens
cttttgaggcatgcac

SEQ ID NO: 4141194 - DNA, 17 bp, Homo sapiens
cttttgaggcttctgtt

SEQ ID NO: 4141195 - DNA, 14 bp, Homo sapiens
cttttgcagaagag

SEQ ID NO: 4141196 - DNA, 23 bp, Homo sapiens
cttttgcagaagagggtgtgttt

SEQ ID NO: 4141197 - DNA, 18 bp, Homo sapiens
cttttgccactgctgtgt

SEQ ID NO: 4141198 - DNA, 15 bp, Homo sapiens
cttttgctactaagt

SEQ ID NO: 4141199 - DNA, 23 bp, Homo sapiens
cttttgctactaagttcacatta

SEQ ID NO: 4141200 - DNA, 17 bp, Homo sapiens
cttttggggagggaggg

SEQ ID NO: 4141201 - DNA, 14 bp, Homo sapiens
cttttgtaaattaa

SEQ ID NO: 4141202 - DNA, 16 bp, Homo sapiens
cttttgtaattgtgta

SEQ ID NO: 4141203 - DNA, 22 bp, Homo sapiens
cttttgtaattgtgtaaaaaat

SEQ ID NO: 4141204 - DNA, 23 bp, Homo sapiens
cttttgtactgaatttttttgta

SEQ ID NO: 4141205 - DNA, 16 bp, Homo sapiens
cttttgtgtaatgaaa

SEQ ID NO: 4141206 - DNA, 14 bp, Homo sapiens
cttttgtgttccaa

SEQ ID NO: 4141207 - DNA, 19 bp, Homo sapiens
cttttgttcatttcatcct

SEQ ID NO: 4141208 - DNA, 14 bp, Homo sapiens
cttttgttgtttat

SEQ ID NO: 4141209 - DNA, 13 bp, Homo sapiens
cttttgtttccat

SEQ ID NO: 4141210 - DNA, 15 bp, Homo sapiens
cttttgttttgcttt

SEQ ID NO: 4141211 - DNA, 19 bp, Homo sapiens
ctttttaaaaatagacact

SEQ ID NO: 4141212 - DNA, 15 bp, Homo sapiens
ctttttaacctctgt

SEQ ID NO: 4141213 - DNA, 16 bp, Homo sapiens
ctttttaacctctgtt

SEQ ID NO: 4141214 - DNA, 15 bp, Homo sapiens
ctttttaatatgctt

SEQ ID NO: 4141215 - DNA, 14 bp, Homo sapiens
ctttttaattattt

SEQ ID NO: 4141216 - DNA, 22 bp, Homo sapiens
ctttttaattgttgtttctttc

SEQ ID NO: 4141217 - DNA, 23 bp, Homo sapiens
ctttttaattgttgtttctttct

SEQ ID NO: 4141218 - DNA, 18 bp, Homo sapiens
ctttttacataactgcct

SEQ ID NO: 4141219 - DNA, 17 bp, Homo sapiens
ctttttacctttcatac

SEQ ID NO: 4141220 - DNA, 19 bp, Homo sapiens
ctttttagggccaggcagg

SEQ ID NO: 4141221 - DNA, 15 bp, Homo sapiens
ctttttatgctattt

SEQ ID NO: 4141222 - DNA, 15 bp, Homo sapiens
ctttttcagagtcat

SEQ ID NO: 4141223 - DNA, 12 bp, Homo sapiens
ctttttccatca

SEQ ID NO: 4141224 - DNA, 12 bp, Homo sapiens
ctttttcctcct

SEQ ID NO: 4141225 - DNA, 20 bp, Homo sapiens
ctttttcctctgagcccagc

SEQ ID NO: 4141226 - DNA, 21 bp, Homo sapiens
ctttttcctctgagcccagct

SEQ ID NO: 4141227 - DNA, 21 bp, Homo sapiens
ctttttctccagctgggctct

SEQ ID NO: 4141228 - DNA, 14 bp, Homo sapiens
ctttttcttgatct

SEQ ID NO: 4141229 - DNA, 16 bp, Homo sapiens
ctttttctttataaac

SEQ ID NO: 4141230 - DNA, 14 bp, Homo sapiens
ctttttctttttaa

SEQ ID NO: 4141231 - DNA, 14 bp, Homo sapiens
ctttttgacactga

SEQ ID NO: 4141232 - DNA, 21 bp, Homo sapiens
ctttttgccagttttccctgg

SEQ ID NO: 4141233 - DNA, 22 bp, Homo sapiens
ctttttggctgacttcatctgg

SEQ ID NO: 4141234 - DNA, 11 bp, Homo sapiens
ctttttgtagg

SEQ ID NO: 4141235 - DNA, 20 bp, Homo sapiens
cttttttaagatttttctca

SEQ ID NO: 4141236 - DNA, 16 bp, Homo sapiens
cttttttaataaacta

SEQ ID NO: 4141237 - DNA, 12 bp, Homo sapiens
cttttttcaaaa

SEQ ID NO: 4141238 - DNA, 16 bp, Homo sapiens
cttttttcttatttaa

SEQ ID NO: 4141239 - DNA, 15 bp, Homo sapiens
cttttttgctttctt

SEQ ID NO: 4141240 - DNA, 19 bp, Homo sapiens
ctttttttccatctttaca

SEQ ID NO: 4141241 - DNA, 15 bp, Homo sapiens
cttttttttatgaaa

SEQ ID NO: 4141242 - DNA, 15 bp, Homo sapiens
cttttttttctttaa

SEQ ID NO: 4141243 - DNA, 15 bp, Homo sapiens
ctttttttttgaaac

SEQ ID NO: 4141244 - DNA, 13 bp, Homo sapiens
gaaaaaaaattat

SEQ ID NO: 4141245 - DNA, 16 bp, Homo sapiens
gaaaaaaaccacacaa

SEQ ID NO: 4141246 - DNA, 14 bp, Homo sapiens
gaaaaaaacttcat

SEQ ID NO: 4141247 - DNA, 18 bp, Homo sapiens
gaaaaaaacttggcactt

SEQ ID NO: 4141248 - DNA, 13 bp, Homo sapiens
gaaaaaaatgact

SEQ ID NO: 4141249 - DNA, 17 bp, Homo sapiens
gaaaaaaatgagactta

SEQ ID NO: 4141250 - DNA, 11 bp, Homo sapiens
gaaaaaagcac

SEQ ID NO: 4141251 - DNA, 22 bp, Homo sapiens
gaaaaaagcacatacattaaaa

SEQ ID NO: 4141252 - DNA, 17 bp, Homo sapiens
gaaaaaagttccttcct

SEQ ID NO: 4141253 - DNA, 17 bp, Homo sapiens
gaaaaaataacacacat

SEQ ID NO: 4141254 - DNA, 21 bp, Homo sapiens
gaaaaaatgttggatttataa

SEQ ID NO: 4141255 - DNA, 17 bp, Homo sapiens
gaaaaacacaagcaaaa

SEQ ID NO: 4141256 - DNA, 15 bp, Homo sapiens
gaaaaaccatttgaa

SEQ ID NO: 4141257 - DNA, 19 bp, Homo sapiens
gaaaaactctttattttcc

SEQ ID NO: 4141258 - DNA, 18 bp, Homo sapiens
gaaaaagacgatgtttat

SEQ ID NO: 4141259 - DNA, 21 bp, Homo sapiens
gaaaaagcatgatgggaaaat

SEQ ID NO: 4141260 - DNA, 15 bp, Homo sapiens
gaaaaagccatatca

SEQ ID NO: 4141261 - DNA, 12 bp, Homo sapiens
gaaaaaggcagt

SEQ ID NO: 4141262 - DNA, 13 bp, Homo sapiens
gaaaaaggcagtg

SEQ ID NO: 4141263 - DNA, 13 bp, Homo sapiens
gaaaaataatcaa

SEQ ID NO: 4141264 - DNA, 19 bp, Homo sapiens
gaaaaatatatattttaag

SEQ ID NO: 4141265 - DNA, 16 bp, Homo sapiens
gaaaaatctaagtgat

SEQ ID NO: 4141266 - DNA, 16 bp, Homo sapiens
gaaaaatgctccccac

SEQ ID NO: 4141267 - DNA, 20 bp, Homo sapiens
gaaaaatgggagacagcctc

SEQ ID NO: 4141268 - DNA, 16 bp, Homo sapiens
gaaaaattacagcttc

SEQ ID NO: 4141269 - DNA, 22 bp, Homo sapiens
gaaaaatttaagcattgtttgc

SEQ ID NO: 4141270 - DNA, 15 bp, Homo sapiens
gaaaacaaaatctaa

SEQ ID NO: 4141271 - DNA, 14 bp, Homo sapiens
gaaaacatctcctt

SEQ ID NO: 4141272 - DNA, 14 bp, Homo sapiens
gaaaacgttttatt

SEQ ID NO: 4141273 - DNA, 13 bp, Homo sapiens
gaaaactatacaa

SEQ ID NO: 4141274 - DNA, 13 bp, Homo sapiens
gaaaacttagcca

SEQ ID NO: 4141275 - DNA, 13 bp, Homo sapiens
gaaaactttaaaa

SEQ ID NO: 4141276 - DNA, 22 bp, Homo sapiens
gaaaactttaaaaaatatttat

SEQ ID NO: 4141277 - DNA, 12 bp, Homo sapiens
gaaaagagaaac

SEQ ID NO: 4141278 - DNA, 15 bp, Homo sapiens
gaaaagagatatttt

SEQ ID NO: 4141279 - DNA, 19 bp, Homo sapiens
gaaaagagatattttaaaa

SEQ ID NO: 4141280 - DNA, 20 bp, Homo sapiens
gaaaagaggagtttcgaggt

SEQ ID NO: 4141281 - DNA, 21 bp, Homo sapiens
gaaaagaggagtttcgaggta

SEQ ID NO: 4141282 - DNA, 20 bp, Homo sapiens
gaaaagatgtacctggtgga

SEQ ID NO: 4141283 - DNA, 15 bp, Homo sapiens
gaaaagcacttttgt

SEQ ID NO: 4141284 - DNA, 20 bp, Homo sapiens
gaaaagcacttttgttattc

SEQ ID NO: 4141285 - DNA, 16 bp, Homo sapiens
gaaaagcatttttcaa

SEQ ID NO: 4141286 - DNA, 11 bp, Homo sapiens
gaaaagctatt

SEQ ID NO: 4141287 - DNA, 16 bp, Homo sapiens
gaaaagcttcttaatt

SEQ ID NO: 4141288 - DNA, 18 bp, Homo sapiens
gaaaagcttcttaattaa

SEQ ID NO: 4141289 - DNA, 16 bp, Homo sapiens
gaaaaggccaagaggt

SEQ ID NO: 4141290 - DNA, 17 bp, Homo sapiens
gaaaagggagaaaaaga

SEQ ID NO: 4141291 - DNA, 16 bp, Homo sapiens
gaaaagtacatttaat

SEQ ID NO: 4141292 - DNA, 12 bp, Homo sapiens
gaaaagtatttt

SEQ ID NO: 4141293 - DNA, 19 bp, Homo sapiens
gaaaagtattttgaagttt

SEQ ID NO: 4141294 - DNA, 20 bp, Homo sapiens
gaaaagtgcatatttatcca

SEQ ID NO: 4141295 - DNA, 11 bp, Homo sapiens
gaaaagtgcct

SEQ ID NO: 4141296 - DNA, 10 bp, Homo sapiens
gaaaagttca

SEQ ID NO: 4141297 - DNA, 16 bp, Homo sapiens
gaaaagttcagggacc

SEQ ID NO: 4141298 - DNA, 14 bp, Homo sapiens
gaaaagttgcagat

SEQ ID NO: 4141299 - DNA, 19 bp, Homo sapiens
gaaaataaaaaaagaaaaa

SEQ ID NO: 4141300 - DNA, 17 bp, Homo sapiens
gaaaataaacatcagtt

SEQ ID NO: 4141301 - DNA, 11 bp, Homo sapiens
gaaaataaagt

SEQ ID NO: 4141302 - DNA, 13 bp, Homo sapiens
gaaaatacaataa

SEQ ID NO: 4141303 - DNA, 17 bp, Homo sapiens
gaaaatacgctcaggtg

SEQ ID NO: 4141304 - DNA, 14 bp, Homo sapiens
gaaaatagtgttcc

SEQ ID NO: 4141305 - DNA, 17 bp, Homo sapiens
gaaaatattatgtgttt

SEQ ID NO: 4141306 - DNA, 17 bp, Homo sapiens
gaaaatcactttgtcta

SEQ ID NO: 4141307 - DNA, 14 bp, Homo sapiens
gaaaatgaagggat

SEQ ID NO: 4141308 - DNA, 12 bp, Homo sapiens
gaaaatgactta

SEQ ID NO: 4141309 - DNA, 15 bp, Homo sapiens
gaaaatgacttattt

SEQ ID NO: 4141310 - DNA, 16 bp, Homo sapiens
gaaaatgacttatttc

SEQ ID NO: 4141311 - DNA, 11 bp, Homo sapiens
gaaaatgtaaa

SEQ ID NO: 4141312 - DNA, 21 bp, Homo sapiens
gaaaatgttctgtttgctgtg

SEQ ID NO: 4141313 - DNA, 13 bp, Homo sapiens
gaaaattctgtgc

SEQ ID NO: 4141314 - DNA, 16 bp, Homo sapiens
gaaaattgcactaaat

SEQ ID NO: 4141315 - DNA, 12 bp, Homo sapiens
gaaaattgcccc

SEQ ID NO: 4141316 - DNA, 12 bp, Homo sapiens
gaaaattgtatt

SEQ ID NO: 4141317 - DNA, 20 bp, Homo sapiens
gaaaatttagccctttaaaa

SEQ ID NO: 4141318 - DNA, 19 bp, Homo sapiens
gaaaattttaaaaatacat

SEQ ID NO: 4141319 - DNA, 16 bp, Homo sapiens
gaaaatttttgtagta

SEQ ID NO: 4141320 - DNA, 9 bp, Homo sapiens
gaaacacaa

SEQ ID NO: 4141321 - DNA, 22 bp, Homo sapiens
gaaacacaagagacttaaagga

SEQ ID NO: 4141322 - DNA, 15 bp, Homo sapiens
gaaacacaatatttt

SEQ ID NO: 4141323 - DNA, 14 bp, Homo sapiens
gaaacacagaaacc

SEQ ID NO: 4141324 - DNA, 23 bp, Homo sapiens
gaaacacagctgttcttctgttc

SEQ ID NO: 4141325 - DNA, 22 bp, Homo sapiens
gaaacacagcttacaatcgcaa

SEQ ID NO: 4141326 - DNA, 20 bp, Homo sapiens
gaaacagagtggcctccctg

SEQ ID NO: 4141327 - DNA, 21 bp, Homo sapiens
gaaacagagtggcctccctgc

SEQ ID NO: 4141328 - DNA, 23 bp, Homo sapiens
gaaacagattcaggccagcccag

SEQ ID NO: 4141329 - DNA, 15 bp, Homo sapiens
gaaacatcatagaaa

SEQ ID NO: 4141330 - DNA, 22 bp, Homo sapiens
gaaaccagcttttactgttttt

SEQ ID NO: 4141331 - DNA, 17 bp, Homo sapiens
gaaaccaggacattaaa

SEQ ID NO: 4141332 - DNA, 22 bp, Homo sapiens
gaaaccatgactgtgaccacct

SEQ ID NO: 4141333 - DNA, 23 bp, Homo sapiens
gaaacccacagatgtctctgggg

SEQ ID NO: 4141334 - DNA, 19 bp, Homo sapiens
gaaacccttcacaccccag

SEQ ID NO: 4141335 - DNA, 21 bp, Homo sapiens
gaaaccgggagaaggcatgag

SEQ ID NO: 4141336 - DNA, 21 bp, Homo sapiens
gaaacctcagggctgtcccag

SEQ ID NO: 4141337 - DNA, 17 bp, Homo sapiens
gaaaccttattgtacct

SEQ ID NO: 4141338 - DNA, 20 bp, Homo sapiens
gaaaccttattgtacctctc

SEQ ID NO: 4141339 - DNA, 18 bp, Homo sapiens
gaaacgctacctctctgt

SEQ ID NO: 4141340 - DNA, 21 bp, Homo sapiens
gaaacgctacctctctgtccc

SEQ ID NO: 4141341 - DNA, 23 bp, Homo sapiens
gaaacgctacctctctgtccctt

SEQ ID NO: 4141342 - DNA, 13 bp, Homo sapiens
gaaactaagccag

SEQ ID NO: 4141343 - DNA, 15 bp, Homo sapiens
gaaactaagccaggc

SEQ ID NO: 4141344 - DNA, 17 bp, Homo sapiens
gaaactcaccatgtaaa

SEQ ID NO: 4141345 - DNA, 18 bp, Homo sapiens
gaaactccacatctgcct

SEQ ID NO: 4141346 - DNA, 17 bp, Homo sapiens
gaaactcccctgggggt

SEQ ID NO: 4141347 - DNA, 19 bp, Homo sapiens
gaaactcctgtttctcctt

SEQ ID NO: 4141348 - DNA, 14 bp, Homo sapiens
gaaactcttatctc

SEQ ID NO: 4141349 - DNA, 14 bp, Homo sapiens
gaaactgatttctt

SEQ ID NO: 4141350 - DNA, 15 bp, Homo sapiens
gaaactgatttcttc

SEQ ID NO: 4141351 - DNA, 16 bp, Homo sapiens
gaaactgatttcttca

SEQ ID NO: 4141352 - DNA, 11 bp, Homo sapiens
gaaactgccaa

SEQ ID NO: 4141353 - DNA, 14 bp, Homo sapiens
gaaactgctaaatt

SEQ ID NO: 4141354 - DNA, 15 bp, Homo sapiens
gaaactgctgcagat

SEQ ID NO: 4141355 - DNA, 20 bp, Homo sapiens
gaaactggattaaaacaatt

SEQ ID NO: 4141356 - DNA, 17 bp, Homo sapiens
gaaactggcactgaatt

SEQ ID NO: 4141357 - DNA, 19 bp, Homo sapiens
gaaacttcagttgatcttc

SEQ ID NO: 4141358 - DNA, 22 bp, Homo sapiens
gaaacttgttcttccaaagcag

SEQ ID NO: 4141359 - DNA, 12 bp, Homo sapiens
gaaactttatac

SEQ ID NO: 4141360 - DNA, 17 bp, Homo sapiens
gaaactttatacattag

SEQ ID NO: 4141361 - DNA, 18 bp, Homo sapiens
gaaactttatacattagt

SEQ ID NO: 4141362 - DNA, 19 bp, Homo sapiens
gaaagaacatggacttgta

SEQ ID NO: 4141363 - DNA, 15 bp, Homo sapiens
gaaagaagagacagg

SEQ ID NO: 4141364 - DNA, 20 bp, Homo sapiens
gaaagaagtgtggggatttt

SEQ ID NO: 4141365 - DNA, 21 bp, Homo sapiens
gaaagaattatttttgtgttt

SEQ ID NO: 4141366 - DNA, 13 bp, Homo sapiens
gaaagacaaactg

SEQ ID NO: 4141367 - DNA, 21 bp, Homo sapiens
gaaagacggattgcattagaa

SEQ ID NO: 4141368 - DNA, 20 bp, Homo sapiens
gaaagacgtttttgtgctgt

SEQ ID NO: 4141369 - DNA, 18 bp, Homo sapiens
gaaagactatctaaatgt

SEQ ID NO: 4141370 - DNA, 17 bp, Homo sapiens
gaaagactgtacaaagt

SEQ ID NO: 4141371 - DNA, 16 bp, Homo sapiens
gaaagagatacagagg

SEQ ID NO: 4141372 - DNA, 20 bp, Homo sapiens
gaaagaggctgaggcctgga

SEQ ID NO: 4141373 - DNA, 18 bp, Homo sapiens
gaaagaggttaggagtag

SEQ ID NO: 4141374 - DNA, 14 bp, Homo sapiens
gaaagatggataaa

SEQ ID NO: 4141375 - DNA, 15 bp, Homo sapiens
gaaagcactttttgg

SEQ ID NO: 4141376 - DNA, 15 bp, Homo sapiens
gaaagcatccatgtg

SEQ ID NO: 4141377 - DNA, 20 bp, Homo sapiens
gaaagccacctctccctcaa

SEQ ID NO: 4141378 - DNA, 14 bp, Homo sapiens
gaaagccatttgtt

SEQ ID NO: 4141379 - DNA, 18 bp, Homo sapiens
gaaagccccagcactaac

SEQ ID NO: 4141380 - DNA, 18 bp, Homo sapiens
gaaagccctcccccttcc

SEQ ID NO: 4141381 - DNA, 18 bp, Homo sapiens
gaaagcctgttcccctca

SEQ ID NO: 4141382 - DNA, 21 bp, Homo sapiens
gaaagcctgttcccctcactg

SEQ ID NO: 4141383 - DNA, 16 bp, Homo sapiens
gaaagccttagggaag

SEQ ID NO: 4141384 - DNA, 21 bp, Homo sapiens
gaaagctgagaactcctgact

SEQ ID NO: 4141385 - DNA, 24 bp, Homo sapiens
gaaagctgtgaacaggctgggctg

SEQ ID NO: 4141386 - DNA, 18 bp, Homo sapiens
gaaaggaaaacctgaaga

SEQ ID NO: 4141387 - DNA, 22 bp, Homo sapiens
gaaaggaagctccactgtcacc

SEQ ID NO: 4141388 - DNA, 14 bp, Homo sapiens
gaaaggatatttaa

SEQ ID NO: 4141389 - DNA, 20 bp, Homo sapiens
gaaaggatatttaagaaaat

SEQ ID NO: 4141390 - DNA, 22 bp, Homo sapiens
gaaaggcatcagtccccctgtg

SEQ ID NO: 4141391 - DNA, 18 bp, Homo sapiens
gaaaggcctcaagaacaa

SEQ ID NO: 4141392 - DNA, 20 bp, Homo sapiens
gaaaggctgccgaggaccct

SEQ ID NO: 4141393 - DNA, 22 bp, Homo sapiens
gaaagggagctatcaggaacag

SEQ ID NO: 4141394 - DNA, 18 bp, Homo sapiens
gaaaggggaaagaaaggg

SEQ ID NO: 4141395 - DNA, 14 bp, Homo sapiens
gaaaggggttgggg

SEQ ID NO: 4141396 - DNA, 16 bp, Homo sapiens
gaaaggggttggggtg

SEQ ID NO: 4141397 - DNA, 18 bp, Homo sapiens
gaaaggtctcagcttgta

SEQ ID NO: 4141398 - DNA, 22 bp, Homo sapiens
gaaaggtgagtttgagctgcct

SEQ ID NO: 4141399 - DNA, 14 bp, Homo sapiens
gaaaggttctgccc

SEQ ID NO: 4141400 - DNA, 23 bp, Homo sapiens
gaaaggttttgtattttttaaaa

SEQ ID NO: 4141401 - DNA, 22 bp, Homo sapiens
gaaagtacactctgctgtttga

SEQ ID NO: 4141402 - DNA, 17 bp, Homo sapiens
gaaagtcaccaggactt

SEQ ID NO: 4141403 - DNA, 17 bp, Homo sapiens
gaaagtgaatttgaatg

SEQ ID NO: 4141404 - DNA, 19 bp, Homo sapiens
gaaagtgaatttgaatgaa

SEQ ID NO: 4141405 - DNA, 18 bp, Homo sapiens
gaaagtgactttaaaaga

SEQ ID NO: 4141406 - DNA, 13 bp, Homo sapiens
gaaagtgcctgac

SEQ ID NO: 4141407 - DNA, 21 bp, Homo sapiens
gaaagtggccatgccaccctg

SEQ ID NO: 4141408 - DNA, 15 bp, Homo sapiens
gaaagtgtgagctct

SEQ ID NO: 4141409 - DNA, 17 bp, Homo sapiens
gaaagtgttatttttca

SEQ ID NO: 4141410 - DNA, 13 bp, Homo sapiens
gaaagttttgtaa

SEQ ID NO: 4141411 - DNA, 17 bp, Homo sapiens
gaaagttttgtaaaaga

SEQ ID NO: 4141412 - DNA, 21 bp, Homo sapiens
gaaagttttgtaaaagaaatc

SEQ ID NO: 4141413 - DNA, 17 bp, Homo sapiens
gaaataaaaggaagcca

SEQ ID NO: 4141414 - DNA, 23 bp, Homo sapiens
gaaataaaaggaagccaaagagt

SEQ ID NO: 4141415 - DNA, 21 bp, Homo sapiens
gaaataaaagtgaatgaaaga

SEQ ID NO: 4141416 - DNA, 14 bp, Homo sapiens
gaaataaatagcta

SEQ ID NO: 4141417 - DNA, 23 bp, Homo sapiens
gaaataaatcagagagcaaggca

SEQ ID NO: 4141418 - DNA, 12 bp, Homo sapiens
gaaataaatgta

SEQ ID NO: 4141419 - DNA, 20 bp, Homo sapiens
gaaataaatgtacctgatgt

SEQ ID NO: 4141420 - DNA, 16 bp, Homo sapiens
gaaataacaaaatgga

SEQ ID NO: 4141421 - DNA, 18 bp, Homo sapiens
gaaataacaaaatggaca

SEQ ID NO: 4141422 - DNA, 16 bp, Homo sapiens
gaaataacaatgttaa

SEQ ID NO: 4141423 - DNA, 17 bp, Homo sapiens
gaaataacaatgttaag

SEQ ID NO: 4141424 - DNA, 22 bp, Homo sapiens
gaaataactccttcttgtagta

SEQ ID NO: 4141425 - DNA, 13 bp, Homo sapiens
gaaataatatgca

SEQ ID NO: 4141426 - DNA, 15 bp, Homo sapiens
gaaataatatgcatt

SEQ ID NO: 4141427 - DNA, 17 bp, Homo sapiens
gaaatacagttctgctc

SEQ ID NO: 4141428 - DNA, 15 bp, Homo sapiens
gaaatactaaaagca

SEQ ID NO: 4141429 - DNA, 14 bp, Homo sapiens
gaaatactatttaa

SEQ ID NO: 4141430 - DNA, 16 bp, Homo sapiens
gaaatagaaagaagcc

SEQ ID NO: 4141431 - DNA, 22 bp, Homo sapiens
gaaatagatatcctctccccct

SEQ ID NO: 4141432 - DNA, 17 bp, Homo sapiens
gaaatatatatgtgtgt

SEQ ID NO: 4141433 - DNA, 17 bp, Homo sapiens
gaaatatgcacaatagc

SEQ ID NO: 4141434 - DNA, 19 bp, Homo sapiens
gaaatattaaaccctggat

SEQ ID NO: 4141435 - DNA, 15 bp, Homo sapiens
gaaatatttacctaa

SEQ ID NO: 4141436 - DNA, 19 bp, Homo sapiens
gaaatatttatttttttaa

SEQ ID NO: 4141437 - DNA, 21 bp, Homo sapiens
gaaatcaatcctgttaagaga

SEQ ID NO: 4141438 - DNA, 17 bp, Homo sapiens
gaaatcatgtccataca

SEQ ID NO: 4141439 - DNA, 16 bp, Homo sapiens
gaaatccattgtttaa

SEQ ID NO: 4141440 - DNA, 23 bp, Homo sapiens
gaaatccctgtttaatatttaaa

SEQ ID NO: 4141441 - DNA, 17 bp, Homo sapiens
gaaatctgctagaaagt

SEQ ID NO: 4141442 - DNA, 14 bp, Homo sapiens
gaaatcttttaaaa

SEQ ID NO: 4141443 - DNA, 21 bp, Homo sapiens
gaaatgaaatattgtttccaa

SEQ ID NO: 4141444 - DNA, 13 bp, Homo sapiens
gaaatgaataatt

SEQ ID NO: 4141445 - DNA, 14 bp, Homo sapiens
gaaatgaataattt

SEQ ID NO: 4141446 - DNA, 18 bp, Homo sapiens
gaaatgaataatttccca

SEQ ID NO: 4141447 - DNA, 15 bp, Homo sapiens
gaaatgagaaggcag

SEQ ID NO: 4141448 - DNA, 21 bp, Homo sapiens
gaaatgaggtctgtttaaagt

SEQ ID NO: 4141449 - DNA, 19 bp, Homo sapiens
gaaatgcattttattcttt

SEQ ID NO: 4141450 - DNA, 21 bp, Homo sapiens
gaaatggatactacatcttta

SEQ ID NO: 4141451 - DNA, 19 bp, Homo sapiens
gaaatgggacttaactcct

SEQ ID NO: 4141452 - DNA, 17 bp, Homo sapiens
gaaatggtatgagctga

SEQ ID NO: 4141453 - DNA, 17 bp, Homo sapiens
gaaatgtaatactggaa

SEQ ID NO: 4141454 - DNA, 15 bp, Homo sapiens
gaaatgtcatctaac

SEQ ID NO: 4141455 - DNA, 18 bp, Homo sapiens
gaaatgtccctttcttct

SEQ ID NO: 4141456 - DNA, 13 bp, Homo sapiens
gaaatgtggagaa

SEQ ID NO: 4141457 - DNA, 21 bp, Homo sapiens
gaaatgttaaaggttcacagg

SEQ ID NO: 4141458 - DNA, 22 bp, Homo sapiens
gaaatgttattttttaattatt

SEQ ID NO: 4141459 - DNA, 15 bp, Homo sapiens
gaaatgttctgttca

SEQ ID NO: 4141460 - DNA, 18 bp, Homo sapiens
gaaattaagaaggcaaaa

SEQ ID NO: 4141461 - DNA, 22 bp, Homo sapiens
gaaattaagaaggcaaaaatgt

SEQ ID NO: 4141462 - DNA, 13 bp, Homo sapiens
gaaattactgtgt

SEQ ID NO: 4141463 - DNA, 20 bp, Homo sapiens
gaaattaggggttaaagcag

SEQ ID NO: 4141464 - DNA, 19 bp, Homo sapiens
gaaattatatctgtggtct

SEQ ID NO: 4141465 - DNA, 18 bp, Homo sapiens
gaaattatgtatgtttac

SEQ ID NO: 4141466 - DNA, 22 bp, Homo sapiens
gaaattgactgatgattttcct

SEQ ID NO: 4141467 - DNA, 16 bp, Homo sapiens
gaaattggaagagcac

SEQ ID NO: 4141468 - DNA, 13 bp, Homo sapiens
gaaattgtgaact

SEQ ID NO: 4141469 - DNA, 18 bp, Homo sapiens
gaaattgtgaactcattg

SEQ ID NO: 4141470 - DNA, 17 bp, Homo sapiens
gaaatttctcatcacag

SEQ ID NO: 4141471 - DNA, 11 bp, Homo sapiens
gaaatttgaat

SEQ ID NO: 4141472 - DNA, 13 bp, Homo sapiens
gaaatttgcaaaa

SEQ ID NO: 4141473 - DNA, 14 bp, Homo sapiens
gaaatttgcaaaat

SEQ ID NO: 4141474 - DNA, 18 bp, Homo sapiens
gaaatttgcaaaatcact

SEQ ID NO: 4141475 - DNA, 17 bp, Homo sapiens
gaaatttgttataatga

SEQ ID NO: 4141476 - DNA, 14 bp, Homo sapiens
gaaattttgtaaga

SEQ ID NO: 4141477 - DNA, 19 bp, Homo sapiens
gaaattttgtaagaaggca

SEQ ID NO: 4141478 - DNA, 20 bp, Homo sapiens
gaaattttgtaagaaggcaa

SEQ ID NO: 4141479 - DNA, 19 bp, Homo sapiens
gaaatttttattaaattat

SEQ ID NO: 4141480 - DNA, 17 bp, Homo sapiens
gaaatttttatttttct

SEQ ID NO: 4141481 - DNA, 15 bp, Homo sapiens
gaacaaagcagccac

SEQ ID NO: 4141482 - DNA, 16 bp, Homo sapiens
gaacaaagcagccacg

SEQ ID NO: 4141483 - DNA, 13 bp, Homo sapiens
gaacaattgaagt

SEQ ID NO: 4141484 - DNA, 19 bp, Homo sapiens
gaacacaaactgtaaataa

SEQ ID NO: 4141485 - DNA, 22 bp, Homo sapiens
gaacacaaagcggggggagggt

SEQ ID NO: 4141486 - DNA, 11 bp, Homo sapiens
gaacacaggca

SEQ ID NO: 4141487 - DNA, 13 bp, Homo sapiens
gaacacccttaga

SEQ ID NO: 4141488 - DNA, 23 bp, Homo sapiens
gaacacccttagaaaatgtgtcc

SEQ ID NO: 4141489 - DNA, 23 bp, Homo sapiens
gaacaccttggggtccctccacc

SEQ ID NO: 4141490 - DNA, 22 bp, Homo sapiens
gaacacggccacatcaaagagg

SEQ ID NO: 4141491 - DNA, 16 bp, Homo sapiens
gaacactcttttgctt

SEQ ID NO: 4141492 - DNA, 23 bp, Homo sapiens
gaacactgcactcttaagcttcc

SEQ ID NO: 4141493 - DNA, 19 bp, Homo sapiens
gaacagaaggatgaatgag

SEQ ID NO: 4141494 - DNA, 17 bp, Homo sapiens
gaacagacaacagaagt

SEQ ID NO: 4141495 - DNA, 19 bp, Homo sapiens
gaacagacaacagaagtca

SEQ ID NO: 4141496 - DNA, 19 bp, Homo sapiens
gaacagaccggagaggaca

SEQ ID NO: 4141497 - DNA, 21 bp, Homo sapiens
gaacagagagacccttgtggg

SEQ ID NO: 4141498 - DNA, 17 bp, Homo sapiens
gaacagataatccctgt

SEQ ID NO: 4141499 - DNA, 18 bp, Homo sapiens
gaacagataatccctgta

SEQ ID NO: 4141500 - DNA, 13 bp, Homo sapiens
gaacagcagtgtt

SEQ ID NO: 4141501 - DNA, 22 bp, Homo sapiens
gaacagccaaatgcatggtgca

SEQ ID NO: 4141502 - DNA, 23 bp, Homo sapiens
gaacagccaaatgcatggtgcag

SEQ ID NO: 4141503 - DNA, 14 bp, Homo sapiens
gaacagcgggagac

SEQ ID NO: 4141504 - DNA, 16 bp, Homo sapiens
gaacagcgggagacct

SEQ ID NO: 4141505 - DNA, 21 bp, Homo sapiens
gaacagctatgggagccccag

SEQ ID NO: 4141506 - DNA, 17 bp, Homo sapiens
gaacagcttcaggttat

SEQ ID NO: 4141507 - DNA, 16 bp, Homo sapiens
gaacaggtggttttta

SEQ ID NO: 4141508 - DNA, 14 bp, Homo sapiens
gaacagtgtttccc

SEQ ID NO: 4141509 - DNA, 16 bp, Homo sapiens
gaacagtgtttcccat

SEQ ID NO: 4141510 - DNA, 21 bp, Homo sapiens
gaacagtgtttcccataattt

SEQ ID NO: 4141511 - DNA, 18 bp, Homo sapiens
gaacatccaaccttccca

SEQ ID NO: 4141512 - DNA, 22 bp, Homo sapiens
gaacatcctttgcagggcagcc

SEQ ID NO: 4141513 - DNA, 23 bp, Homo sapiens
gaacatgcagttcattattttgt

SEQ ID NO: 4141514 - DNA, 21 bp, Homo sapiens
gaacattggaatgttctcaga

SEQ ID NO: 4141515 - DNA, 23 bp, Homo sapiens
gaaccaagtggaccttgagacca

SEQ ID NO: 4141516 - DNA, 17 bp, Homo sapiens
gaaccacagggccagag

SEQ ID NO: 4141517 - DNA, 18 bp, Homo sapiens
gaaccacagggccagagg

SEQ ID NO: 4141518 - DNA, 15 bp, Homo sapiens
gaaccagctcatctc

SEQ ID NO: 4141519 - DNA, 20 bp, Homo sapiens
gaaccatcattataaacgtg

SEQ ID NO: 4141520 - DNA, 16 bp, Homo sapiens
gaaccatgaagacagg

SEQ ID NO: 4141521 - DNA, 15 bp, Homo sapiens
gaacccaatctgcac

SEQ ID NO: 4141522 - DNA, 20 bp, Homo sapiens
gaacccaatctgcacactcc

SEQ ID NO: 4141523 - DNA, 19 bp, Homo sapiens
gaacccagactcagacatt

SEQ ID NO: 4141524 - DNA, 15 bp, Homo sapiens
gaacccaggacgctt

SEQ ID NO: 4141525 - DNA, 17 bp, Homo sapiens
gaacccaggacgcttct

SEQ ID NO: 4141526 - DNA, 14 bp, Homo sapiens
gaacccccaccaga

SEQ ID NO: 4141527 - DNA, 17 bp, Homo sapiens
gaaccccgagctggggg

SEQ ID NO: 4141528 - DNA, 19 bp, Homo sapiens
gaaccccgtcgaggggctc

SEQ ID NO: 4141529 - DNA, 17 bp, Homo sapiens
gaaccccttcatcctct

SEQ ID NO: 4141530 - DNA, 20 bp, Homo sapiens
gaacccgggagcggaggttg

SEQ ID NO: 4141531 - DNA, 21 bp, Homo sapiens
gaaccctctgtcccaccccta

SEQ ID NO: 4141532 - DNA, 12 bp, Homo sapiens
gaacctcagcct

SEQ ID NO: 4141533 - DNA, 13 bp, Homo sapiens
gaacctcagcctg

SEQ ID NO: 4141534 - DNA, 15 bp, Homo sapiens
gaacctcagcctggc

SEQ ID NO: 4141535 - DNA, 19 bp, Homo sapiens
gaacctcagcctggccaga

SEQ ID NO: 4141536 - DNA, 14 bp, Homo sapiens
gaacctctgtctca

SEQ ID NO: 4141537 - DNA, 15 bp, Homo sapiens
gaacctctgtctcat

SEQ ID NO: 4141538 - DNA, 22 bp, Homo sapiens
gaacctctgtctcatcctcctg

SEQ ID NO: 4141539 - DNA, 13 bp, Homo sapiens
gaacctcttcccc

SEQ ID NO: 4141540 - DNA, 16 bp, Homo sapiens
gaacctggaacttggg

SEQ ID NO: 4141541 - DNA, 17 bp, Homo sapiens
gaacctggatccagcac

SEQ ID NO: 4141542 - DNA, 19 bp, Homo sapiens
gaacctgtgagctgcacca

SEQ ID NO: 4141543 - DNA, 13 bp, Homo sapiens
gaaccttgctgtc

SEQ ID NO: 4141544 - DNA, 20 bp, Homo sapiens
gaacgcagccctagagcctg

SEQ ID NO: 4141545 - DNA, 21 bp, Homo sapiens
gaacgcagccctagagcctgc

SEQ ID NO: 4141546 - DNA, 19 bp, Homo sapiens
gaacggaacgttggacttt

SEQ ID NO: 4141547 - DNA, 13 bp, Homo sapiens
gaactaaagcaaa

SEQ ID NO: 4141548 - DNA, 20 bp, Homo sapiens
gaactatgtcgatgcacagt

SEQ ID NO: 4141549 - DNA, 16 bp, Homo sapiens
gaactcaaatggggcc

SEQ ID NO: 4141550 - DNA, 20 bp, Homo sapiens
gaactcaaatggggccagat

SEQ ID NO: 4141551 - DNA, 22 bp, Homo sapiens
gaactcaaatggggccagatcc

SEQ ID NO: 4141552 - DNA, 21 bp, Homo sapiens
gaactcaccctgggagccagt

SEQ ID NO: 4141553 - DNA, 22 bp, Homo sapiens
gaactcaccctgggagccagtc

SEQ ID NO: 4141554 - DNA, 14 bp, Homo sapiens
gaactcactctggg

SEQ ID NO: 4141555 - DNA, 15 bp, Homo sapiens
gaactcactctgggc

SEQ ID NO: 4141556 - DNA, 15 bp, Homo sapiens
gaactcagatccagg

SEQ ID NO: 4141557 - DNA, 18 bp, Homo sapiens
gaactcagatctgtctga

SEQ ID NO: 4141558 - DNA, 23 bp, Homo sapiens
gaactccaggccctcctctccca

SEQ ID NO: 4141559 - DNA, 19 bp, Homo sapiens
gaactcccagcaacacaag

SEQ ID NO: 4141560 - DNA, 13 bp, Homo sapiens
gaactcctgccag

SEQ ID NO: 4141561 - DNA, 15 bp, Homo sapiens
gaactcgcacctgtg

SEQ ID NO: 4141562 - DNA, 20 bp, Homo sapiens
gaactcgcacctgtgctgga

SEQ ID NO: 4141563 - DNA, 21 bp, Homo sapiens
gaactcgcacctgtgctggag

SEQ ID NO: 4141564 - DNA, 17 bp, Homo sapiens
gaactctgaactttgga

SEQ ID NO: 4141565 - DNA, 16 bp, Homo sapiens
gaactctgcctgccct

SEQ ID NO: 4141566 - DNA, 18 bp, Homo sapiens
gaactctggtggcacagg

SEQ ID NO: 4141567 - DNA, 16 bp, Homo sapiens
gaactctgttccccca

SEQ ID NO: 4141568 - DNA, 22 bp, Homo sapiens
gaactctttctggcctgccttc

SEQ ID NO: 4141569 - DNA, 17 bp, Homo sapiens
gaactgagctgggcagg

SEQ ID NO: 4141570 - DNA, 21 bp, Homo sapiens
gaactgaggagatgaccaggg

SEQ ID NO: 4141571 - DNA, 16 bp, Homo sapiens
gaactgagggcaaggg

SEQ ID NO: 4141572 - DNA, 13 bp, Homo sapiens
gaactgagtcacg

SEQ ID NO: 4141573 - DNA, 22 bp, Homo sapiens
gaactgcatggacctaacattc

SEQ ID NO: 4141574 - DNA, 15 bp, Homo sapiens
gaactgcccccactg

SEQ ID NO: 4141575 - DNA, 15 bp, Homo sapiens
gaactgtccagagag

SEQ ID NO: 4141576 - DNA, 19 bp, Homo sapiens
gaactgtgcatagtgctgg

SEQ ID NO: 4141577 - DNA, 14 bp, Homo sapiens
gaactgtgccacaa

SEQ ID NO: 4141578 - DNA, 21 bp, Homo sapiens
gaactgttcaagtgtccccag

SEQ ID NO: 4141579 - DNA, 20 bp, Homo sapiens
gaacttaaattatgttttaa

SEQ ID NO: 4141580 - DNA, 13 bp, Homo sapiens
gaacttcattttt

SEQ ID NO: 4141581 - DNA, 22 bp, Homo sapiens
gaacttgaagcctgctccttcc

SEQ ID NO: 4141582 - DNA, 14 bp, Homo sapiens
gaacttgaatgtgt

SEQ ID NO: 4141583 - DNA, 17 bp, Homo sapiens
gaacttgaatgtgtcag

SEQ ID NO: 4141584 - DNA, 18 bp, Homo sapiens
gaacttgatttgcatgga

SEQ ID NO: 4141585 - DNA, 19 bp, Homo sapiens
gaacttgcgagtccaaggc

SEQ ID NO: 4141586 - DNA, 22 bp, Homo sapiens
gaacttggggagttaagacctg

SEQ ID NO: 4141587 - DNA, 22 bp, Homo sapiens
gaacttttcctctgtatcactg

SEQ ID NO: 4141588 - DNA, 20 bp, Homo sapiens
gaacttttgtactgaatttt

SEQ ID NO: 4141589 - DNA, 21 bp, Homo sapiens
gaacttttgtactgaattttt

SEQ ID NO: 4141590 - DNA, 16 bp, Homo sapiens
gaagaaaaaaaataac

SEQ ID NO: 4141591 - DNA, 17 bp, Homo sapiens
gaagaaaaaaaataaca

SEQ ID NO: 4141592 - DNA, 13 bp, Homo sapiens
gaagaaaacctgt

SEQ ID NO: 4141593 - DNA, 13 bp, Homo sapiens
gaagaacatagaa

SEQ ID NO: 4141594 - DNA, 16 bp, Homo sapiens
gaagaagagaagctgc

SEQ ID NO: 4141595 - DNA, 19 bp, Homo sapiens
gaagaagggagaagaaagg

SEQ ID NO: 4141596 - DNA, 19 bp, Homo sapiens
gaagaagtgagcagtgttg

SEQ ID NO: 4141597 - DNA, 17 bp, Homo sapiens
gaagaatattcaggact

SEQ ID NO: 4141598 - DNA, 15 bp, Homo sapiens
gaagaatatttaaga

SEQ ID NO: 4141599 - DNA, 15 bp, Homo sapiens
gaagaatgaacccaa

SEQ ID NO: 4141600 - DNA, 20 bp, Homo sapiens
gaagaatgcacaagaatgga

SEQ ID NO: 4141601 - DNA, 23 bp, Homo sapiens
gaagaatgcacaagaatggatca

SEQ ID NO: 4141602 - DNA, 18 bp, Homo sapiens
gaagacaagcatttttaa

SEQ ID NO: 4141603 - DNA, 22 bp, Homo sapiens
gaagacaccagagcagatgcag

SEQ ID NO: 4141604 - DNA, 19 bp, Homo sapiens
gaagacatttctgctctca

SEQ ID NO: 4141605 - DNA, 21 bp, Homo sapiens
gaagacatttctgctctcagc

SEQ ID NO: 4141606 - DNA, 23 bp, Homo sapiens
gaagacatttctgctctcagctc

SEQ ID NO: 4141607 - DNA, 20 bp, Homo sapiens
gaagacattttttgctataa

SEQ ID NO: 4141608 - DNA, 22 bp, Homo sapiens
gaagaccacatccacacacgca

SEQ ID NO: 4141609 - DNA, 14 bp, Homo sapiens
gaagacccagcagg

SEQ ID NO: 4141610 - DNA, 15 bp, Homo sapiens
gaagacgcctgagct

SEQ ID NO: 4141611 - DNA, 14 bp, Homo sapiens
gaagactccagaaa

SEQ ID NO: 4141612 - DNA, 19 bp, Homo sapiens
gaagagaagagggcccagc

SEQ ID NO: 4141613 - DNA, 14 bp, Homo sapiens
gaagagaagctgct

SEQ ID NO: 4141614 - DNA, 16 bp, Homo sapiens
gaagagaagctgctga

SEQ ID NO: 4141615 - DNA, 17 bp, Homo sapiens
gaagagaagctgctgac

SEQ ID NO: 4141616 - DNA, 16 bp, Homo sapiens
gaagagactgggaaga

SEQ ID NO: 4141617 - DNA, 14 bp, Homo sapiens
gaagagcccagtct

SEQ ID NO: 4141618 - DNA, 15 bp, Homo sapiens
gaagagccctggaca

SEQ ID NO: 4141619 - DNA, 15 bp, Homo sapiens
gaagagctggggaga

SEQ ID NO: 4141620 - DNA, 22 bp, Homo sapiens
gaagagcttgtgtcctgtcctt

SEQ ID NO: 4141621 - DNA, 16 bp, Homo sapiens
gaagaggaacagtgtg

SEQ ID NO: 4141622 - DNA, 18 bp, Homo sapiens
gaagagggcccagcccag

SEQ ID NO: 4141623 - DNA, 16 bp, Homo sapiens
gaagagggctgagctg

SEQ ID NO: 4141624 - DNA, 18 bp, Homo sapiens
gaagagggggctggccat

SEQ ID NO: 4141625 - DNA, 20 bp, Homo sapiens
gaagagggtgaaaggcaggg

SEQ ID NO: 4141626 - DNA, 22 bp, Homo sapiens
gaagagtcttggtttctctcta

SEQ ID NO: 4141627 - DNA, 22 bp, Homo sapiens
gaagagtgccctgctttgcaaa

SEQ ID NO: 4141628 - DNA, 21 bp, Homo sapiens
gaagataagtgtatttttcaa

SEQ ID NO: 4141629 - DNA, 13 bp, Homo sapiens
gaagataattgtt

SEQ ID NO: 4141630 - DNA, 16 bp, Homo sapiens
gaagatcccctcagga

SEQ ID NO: 4141631 - DNA, 18 bp, Homo sapiens
gaagatcgttagtatcta

SEQ ID NO: 4141632 - DNA, 16 bp, Homo sapiens
gaagatgccagcttct

SEQ ID NO: 4141633 - DNA, 17 bp, Homo sapiens
gaagatgccagcttctc

SEQ ID NO: 4141634 - DNA, 19 bp, Homo sapiens
gaagatgccagcttctctc

SEQ ID NO: 4141635 - DNA, 20 bp, Homo sapiens
gaagatgccagcttctctct

SEQ ID NO: 4141636 - DNA, 18 bp, Homo sapiens
gaagatggatatgaccag

SEQ ID NO: 4141637 - DNA, 20 bp, Homo sapiens
gaagattaccctcaaatgct

SEQ ID NO: 4141638 - DNA, 17 bp, Homo sapiens
gaagattctcctgtgct

SEQ ID NO: 4141639 - DNA, 15 bp, Homo sapiens
gaagattttcagtct

SEQ ID NO: 4141640 - DNA, 16 bp, Homo sapiens
gaagcaagccagacct

SEQ ID NO: 4141641 - DNA, 17 bp, Homo sapiens
gaagcaagccagaccta

SEQ ID NO: 4141642 - DNA, 20 bp, Homo sapiens
gaagcaaggaagatatacat

SEQ ID NO: 4141643 - DNA, 20 bp, Homo sapiens
gaagcaagtaaaaaggctaa

SEQ ID NO: 4141644 - DNA, 15 bp, Homo sapiens
gaagcacagaatatt

SEQ ID NO: 4141645 - DNA, 13 bp, Homo sapiens
gaagcacatgtgt

SEQ ID NO: 4141646 - DNA, 22 bp, Homo sapiens
gaagcaggggtggggggtgcag

SEQ ID NO: 4141647 - DNA, 19 bp, Homo sapiens
gaagcaggttcccaagctc

SEQ ID NO: 4141648 - DNA, 17 bp, Homo sapiens
gaagcagtgccttccat

SEQ ID NO: 4141649 - DNA, 13 bp, Homo sapiens
gaagcatgaaaaa

SEQ ID NO: 4141650 - DNA, 18 bp, Homo sapiens
gaagcatgaacagtgcac

SEQ ID NO: 4141651 - DNA, 10 bp, Homo sapiens
gaagcatgta

SEQ ID NO: 4141652 - DNA, 15 bp, Homo sapiens
gaagcattcagagag

SEQ ID NO: 4141653 - DNA, 15 bp, Homo sapiens
gaagcattccttctt

SEQ ID NO: 4141654 - DNA, 15 bp, Homo sapiens
gaagcattctcccca

SEQ ID NO: 4141655 - DNA, 18 bp, Homo sapiens
gaagcatttgatattatc

SEQ ID NO: 4141656 - DNA, 13 bp, Homo sapiens
gaagccaaagagt

SEQ ID NO: 4141657 - DNA, 14 bp, Homo sapiens
gaagccaagggaaa

SEQ ID NO: 4141658 - DNA, 16 bp, Homo sapiens
gaagccaagggaaagg

SEQ ID NO: 4141659 - DNA, 20 bp, Homo sapiens
gaagccaattcagacaggca

SEQ ID NO: 4141660 - DNA, 18 bp, Homo sapiens
gaagccagagccccaagc

SEQ ID NO: 4141661 - DNA, 12 bp, Homo sapiens
gaagccagctgg

SEQ ID NO: 4141662 - DNA, 23 bp, Homo sapiens
gaagccatatatgaccagaagcc

SEQ ID NO: 4141663 - DNA, 16 bp, Homo sapiens
gaagcccaagtgaaat

SEQ ID NO: 4141664 - DNA, 22 bp, Homo sapiens
gaagcccagcccctactgctgt

SEQ ID NO: 4141665 - DNA, 23 bp, Homo sapiens
gaagcccagcccctactgctgtg

SEQ ID NO: 4141666 - DNA, 22 bp, Homo sapiens
gaagcccccagctaagaacctg

SEQ ID NO: 4141667 - DNA, 15 bp, Homo sapiens
gaagccgactctggc

SEQ ID NO: 4141668 - DNA, 16 bp, Homo sapiens
gaagccgactctggcc

SEQ ID NO: 4141669 - DNA, 21 bp, Homo sapiens
gaagccggggtgtaacttcct

SEQ ID NO: 4141670 - DNA, 22 bp, Homo sapiens
gaagccggggtgtaacttcctg

SEQ ID NO: 4141671 - DNA, 18 bp, Homo sapiens
gaagcctaggaggactgg

SEQ ID NO: 4141672 - DNA, 22 bp, Homo sapiens
gaagcctaggaggactggggta

SEQ ID NO: 4141673 - DNA, 17 bp, Homo sapiens
gaagcctcagctaccca

SEQ ID NO: 4141674 - DNA, 22 bp, Homo sapiens
gaagcctccaagcctgcctccc

SEQ ID NO: 4141675 - DNA, 19 bp, Homo sapiens
gaagcctccttagaaaaaa

SEQ ID NO: 4141676 - DNA, 13 bp, Homo sapiens
gaagcctctggct

SEQ ID NO: 4141677 - DNA, 18 bp, Homo sapiens
gaagcctggactctgccc

SEQ ID NO: 4141678 - DNA, 15 bp, Homo sapiens
gaagccttaagccat

SEQ ID NO: 4141679 - DNA, 16 bp, Homo sapiens
gaagccttggaaccag

SEQ ID NO: 4141680 - DNA, 19 bp, Homo sapiens
gaagccttggaaccagccc

SEQ ID NO: 4141681 - DNA, 20 bp, Homo sapiens
gaagcggccctaagggagtg

SEQ ID NO: 4141682 - DNA, 15 bp, Homo sapiens
gaagctactgtgtgt

SEQ ID NO: 4141683 - DNA, 15 bp, Homo sapiens
gaagctacttctcca

SEQ ID NO: 4141684 - DNA, 15 bp, Homo sapiens
gaagctccactgtca

SEQ ID NO: 4141685 - DNA, 23 bp, Homo sapiens
gaagctcctctccccagcccaga

SEQ ID NO: 4141686 - DNA, 17 bp, Homo sapiens
gaagctctcttaaaata

SEQ ID NO: 4141687 - DNA, 16 bp, Homo sapiens
gaagctctgaagtcac

SEQ ID NO: 4141688 - DNA, 20 bp, Homo sapiens
gaagctctgaagtcacatca

SEQ ID NO: 4141689 - DNA, 23 bp, Homo sapiens
gaagctgaagtgcatccaaaggt

SEQ ID NO: 4141690 - DNA, 11 bp, Homo sapiens
gaagctgctga

SEQ ID NO: 4141691 - DNA, 14 bp, Homo sapiens
gaagctggcctgag

SEQ ID NO: 4141692 - DNA, 14 bp, Homo sapiens
gaaggaaaatgata

SEQ ID NO: 4141693 - DNA, 23 bp, Homo sapiens
gaaggaactctggcttccaggta

SEQ ID NO: 4141694 - DNA, 20 bp, Homo sapiens
gaaggaccacattttatatt

SEQ ID NO: 4141695 - DNA, 22 bp, Homo sapiens
gaaggacccggaggggcctggc

SEQ ID NO: 4141696 - DNA, 23 bp, Homo sapiens
gaaggacccggaggggcctggca

SEQ ID NO: 4141697 - DNA, 20 bp, Homo sapiens
gaaggacgggttggggccgg

SEQ ID NO: 4141698 - DNA, 15 bp, Homo sapiens
gaaggagagcctgct

SEQ ID NO: 4141699 - DNA, 20 bp, Homo sapiens
gaaggaggaatgctggactg

SEQ ID NO: 4141700 - DNA, 13 bp, Homo sapiens
gaaggaggtgagg

SEQ ID NO: 4141701 - DNA, 18 bp, Homo sapiens
gaaggagttacagggaag

SEQ ID NO: 4141702 - DNA, 14 bp, Homo sapiens
gaaggcaagagggg

SEQ ID NO: 4141703 - DNA, 22 bp, Homo sapiens
gaaggcaagagggggtggaggg

SEQ ID NO: 4141704 - DNA, 13 bp, Homo sapiens
gaaggcagacagc

SEQ ID NO: 4141705 - DNA, 14 bp, Homo sapiens
gaaggcagacagca

SEQ ID NO: 4141706 - DNA, 16 bp, Homo sapiens
gaaggcatgagaaaga

SEQ ID NO: 4141707 - DNA, 23 bp, Homo sapiens
gaaggcccaagagcagagtctgg

SEQ ID NO: 4141708 - DNA, 14 bp, Homo sapiens
gaaggcccagcacc

SEQ ID NO: 4141709 - DNA, 23 bp, Homo sapiens
gaaggcccagcaccaccctcctt

SEQ ID NO: 4141710 - DNA, 18 bp, Homo sapiens
gaaggccctgctgagtca

SEQ ID NO: 4141711 - DNA, 13 bp, Homo sapiens
gaaggctgccaac

SEQ ID NO: 4141712 - DNA, 15 bp, Homo sapiens
gaaggcttgggattt

SEQ ID NO: 4141713 - DNA, 17 bp, Homo sapiens
gaaggcttgggatttgc

SEQ ID NO: 4141714 - DNA, 21 bp, Homo sapiens
gaaggcttgggatttgctgtg

SEQ ID NO: 4141715 - DNA, 19 bp, Homo sapiens
gaagggaatcctcctccag

SEQ ID NO: 4141716 - DNA, 13 bp, Homo sapiens
gaagggaggtggc

SEQ ID NO: 4141717 - DNA, 22 bp, Homo sapiens
gaagggcaggaaggagagcctg

SEQ ID NO: 4141718 - DNA, 16 bp, Homo sapiens
gaagggccagagccag

SEQ ID NO: 4141719 - DNA, 13 bp, Homo sapiens
gaagggctgggtg

SEQ ID NO: 4141720 - DNA, 23 bp, Homo sapiens
gaagggctttgagggtggaagga

SEQ ID NO: 4141721 - DNA, 21 bp, Homo sapiens
gaagggctttggttccttctc

SEQ ID NO: 4141722 - DNA, 22 bp, Homo sapiens
gaaggggcctcaccgagtgggg

SEQ ID NO: 4141723 - DNA, 13 bp, Homo sapiens
gaaggggccttgc

SEQ ID NO: 4141724 - DNA, 15 bp, Homo sapiens
gaagggggacactcc

SEQ ID NO: 4141725 - DNA, 20 bp, Homo sapiens
gaagggggggctacattata

SEQ ID NO: 4141726 - DNA, 23 bp, Homo sapiens
gaaggggggttgcagtggagagg

SEQ ID NO: 4141727 - DNA, 17 bp, Homo sapiens
gaagggggtccacccag

SEQ ID NO: 4141728 - DNA, 13 bp, Homo sapiens
gaagggtaaagaa

SEQ ID NO: 4141729 - DNA, 16 bp, Homo sapiens
gaagggtttctctatt

SEQ ID NO: 4141730 - DNA, 18 bp, Homo sapiens
gaaggtagcccagcactg

SEQ ID NO: 4141731 - DNA, 15 bp, Homo sapiens
gaaggtctcattctt

SEQ ID NO: 4141732 - DNA, 14 bp, Homo sapiens
gaaggtgcctcaga

SEQ ID NO: 4141733 - DNA, 15 bp, Homo sapiens
gaaggtgcctcagac

SEQ ID NO: 4141734 - DNA, 16 bp, Homo sapiens
gaaggtgcctcagact

SEQ ID NO: 4141735 - DNA, 21 bp, Homo sapiens
gaaggtgcctcagactccgcc

SEQ ID NO: 4141736 - DNA, 20 bp, Homo sapiens
gaaggttaggatttaacagt

SEQ ID NO: 4141737 - DNA, 16 bp, Homo sapiens
gaaggttcttcatgat

SEQ ID NO: 4141738 - DNA, 12 bp, Homo sapiens
gaaggttgtaag

SEQ ID NO: 4141739 - DNA, 17 bp, Homo sapiens
gaagtaagtggggttgc

SEQ ID NO: 4141740 - DNA, 16 bp, Homo sapiens
gaagtaccttatcaaa

SEQ ID NO: 4141741 - DNA, 22 bp, Homo sapiens
gaagtcaataggcctatttatt

SEQ ID NO: 4141742 - DNA, 14 bp, Homo sapiens
gaagtccaatgtgg

SEQ ID NO: 4141743 - DNA, 18 bp, Homo sapiens
gaagtcttagatgtatat

SEQ ID NO: 4141744 - DNA, 18 bp, Homo sapiens
gaagtctttgccttctct

SEQ ID NO: 4141745 - DNA, 21 bp, Homo sapiens
gaagtgagcagtcgcctgcct

SEQ ID NO: 4141746 - DNA, 16 bp, Homo sapiens
gaagtgagggaggaag

SEQ ID NO: 4141747 - DNA, 23 bp, Homo sapiens
gaagtgcatttctgaatagaaat

SEQ ID NO: 4141748 - DNA, 16 bp, Homo sapiens
gaagtgcgtgaatgta

SEQ ID NO: 4141749 - DNA, 22 bp, Homo sapiens
gaagtgctcttggctgacccct

SEQ ID NO: 4141750 - DNA, 17 bp, Homo sapiens
gaagtggactggcccct

SEQ ID NO: 4141751 - DNA, 20 bp, Homo sapiens
gaagtggactggcccctggg

SEQ ID NO: 4141752 - DNA, 15 bp, Homo sapiens
gaagtggggtgttct

SEQ ID NO: 4141753 - DNA, 18 bp, Homo sapiens
gaagtggtaggaaagcct

SEQ ID NO: 4141754 - DNA, 15 bp, Homo sapiens
gaagtgtaacagctg

SEQ ID NO: 4141755 - DNA, 15 bp, Homo sapiens
gaagtgtgagcgcct

SEQ ID NO: 4141756 - DNA, 23 bp, Homo sapiens
gaagttacacagaaatgctgctg

SEQ ID NO: 4141757 - DNA, 17 bp, Homo sapiens
gaagttacatgcataaa

SEQ ID NO: 4141758 - DNA, 13 bp, Homo sapiens
gaagttactttgt

SEQ ID NO: 4141759 - DNA, 17 bp, Homo sapiens
gaagttactttgtaatt

SEQ ID NO: 4141760 - DNA, 21 bp, Homo sapiens
gaagttattttctacagtggt

SEQ ID NO: 4141761 - DNA, 17 bp, Homo sapiens
gaagttgaagtttagga

SEQ ID NO: 4141762 - DNA, 21 bp, Homo sapiens
gaagttgacttatagtacatg

SEQ ID NO: 4141763 - DNA, 20 bp, Homo sapiens
gaagttggaagccattttct

SEQ ID NO: 4141764 - DNA, 14 bp, Homo sapiens
gaagttgttttttt

SEQ ID NO: 4141765 - DNA, 19 bp, Homo sapiens
gaagtttaaaacagtattt

SEQ ID NO: 4141766 - DNA, 16 bp, Homo sapiens
gaagtttacattgtaa

SEQ ID NO: 4141767 - DNA, 13 bp, Homo sapiens
gaagttttacatt

SEQ ID NO: 4141768 - DNA, 23 bp, Homo sapiens
gaagttttcaggacttggtctga

SEQ ID NO: 4141769 - DNA, 22 bp, Homo sapiens
gaataaactgaatattttggaa

SEQ ID NO: 4141770 - DNA, 16 bp, Homo sapiens
gaataaagcacgtgca

SEQ ID NO: 4141771 - DNA, 13 bp, Homo sapiens
gaataaagttctg

SEQ ID NO: 4141772 - DNA, 14 bp, Homo sapiens
gaataaagttctga

SEQ ID NO: 4141773 - DNA, 16 bp, Homo sapiens
gaataaagttgaagct

SEQ ID NO: 4141774 - DNA, 23 bp, Homo sapiens
gaataaccacttaaaaaatgtcc

SEQ ID NO: 4141775 - DNA, 20 bp, Homo sapiens
gaataactcagaatattgtc

SEQ ID NO: 4141776 - DNA, 21 bp, Homo sapiens
gaataactctgtggcattatt

SEQ ID NO: 4141777 - DNA, 12 bp, Homo sapiens
gaataaggccca

SEQ ID NO: 4141778 - DNA, 22 bp, Homo sapiens
gaataataattatccagagttt

SEQ ID NO: 4141779 - DNA, 13 bp, Homo sapiens
gaataatggaaac

SEQ ID NO: 4141780 - DNA, 15 bp, Homo sapiens
gaataatggaaacat

SEQ ID NO: 4141781 - DNA, 20 bp, Homo sapiens
gaataatggaaacattacag

SEQ ID NO: 4141782 - DNA, 13 bp, Homo sapiens
gaataatttgtaa

SEQ ID NO: 4141783 - DNA, 16 bp, Homo sapiens
gaataatttgtaaatg

SEQ ID NO: 4141784 - DNA, 18 bp, Homo sapiens
gaataatttgtaaatgat

SEQ ID NO: 4141785 - DNA, 14 bp, Homo sapiens
gaatacagaaagat

SEQ ID NO: 4141786 - DNA, 13 bp, Homo sapiens
gaatacagtgtta

SEQ ID NO: 4141787 - DNA, 17 bp, Homo sapiens
gaatacttactataatt

SEQ ID NO: 4141788 - DNA, 13 bp, Homo sapiens
gaatactttgctt

SEQ ID NO: 4141789 - DNA, 14 bp, Homo sapiens
gaatactttgcttc

SEQ ID NO: 4141790 - DNA, 17 bp, Homo sapiens
gaatactttgcttcata

SEQ ID NO: 4141791 - DNA, 20 bp, Homo sapiens
gaatactttttacaattaaa

SEQ ID NO: 4141792 - DNA, 15 bp, Homo sapiens
gaatagccacatttg

SEQ ID NO: 4141793 - DNA, 12 bp, Homo sapiens
gaatagcctggc

SEQ ID NO: 4141794 - DNA, 13 bp, Homo sapiens
gaatagcctggcc

SEQ ID NO: 4141795 - DNA, 21 bp, Homo sapiens
gaatagttggtcatctagcaa

SEQ ID NO: 4141796 - DNA, 17 bp, Homo sapiens
gaatataaacatataca

SEQ ID NO: 4141797 - DNA, 21 bp, Homo sapiens
gaatataaacatatacagaaa

SEQ ID NO: 4141798 - DNA, 18 bp, Homo sapiens
gaatataaagcttaataa

SEQ ID NO: 4141799 - DNA, 12 bp, Homo sapiens
gaatataattat

SEQ ID NO: 4141800 - DNA, 13 bp, Homo sapiens
gaatataattatc

SEQ ID NO: 4141801 - DNA, 12 bp, Homo sapiens
gaatatattata

SEQ ID NO: 4141802 - DNA, 16 bp, Homo sapiens
gaatatatttatttaa

SEQ ID NO: 4141803 - DNA, 21 bp, Homo sapiens
gaatatatttatttaaagcat

SEQ ID NO: 4141804 - DNA, 16 bp, Homo sapiens
gaatatccatgtactt

SEQ ID NO: 4141805 - DNA, 19 bp, Homo sapiens
gaatatgacggaagaacat

SEQ ID NO: 4141806 - DNA, 11 bp, Homo sapiens
gaatattcagg

SEQ ID NO: 4141807 - DNA, 12 bp, Homo sapiens
gaatattcagga

SEQ ID NO: 4141808 - DNA, 15 bp, Homo sapiens
gaatattcaggactt

SEQ ID NO: 4141809 - DNA, 17 bp, Homo sapiens
gaatattgtgattctgt

SEQ ID NO: 4141810 - DNA, 18 bp, Homo sapiens
gaatattgtgattctgtt

SEQ ID NO: 4141811 - DNA, 10 bp, Homo sapiens
gaatatttat

SEQ ID NO: 4141812 - DNA, 16 bp, Homo sapiens
gaatatttataacagc

SEQ ID NO: 4141813 - DNA, 13 bp, Homo sapiens
gaatatttattac

SEQ ID NO: 4141814 - DNA, 18 bp, Homo sapiens
gaatatttattacctctg

SEQ ID NO: 4141815 - DNA, 19 bp, Homo sapiens
gaatatttattacctctga

SEQ ID NO: 4141816 - DNA, 15 bp, Homo sapiens
gaatattttggaaac

SEQ ID NO: 4141817 - DNA, 19 bp, Homo sapiens
gaatattttggaaactgct

SEQ ID NO: 4141818 - DNA, 15 bp, Homo sapiens
gaatcaaaaattgaa

SEQ ID NO: 4141819 - DNA, 14 bp, Homo sapiens
gaatcaagagctgc

SEQ ID NO: 4141820 - DNA, 15 bp, Homo sapiens
gaatcaagagctgcc

SEQ ID NO: 4141821 - DNA, 14 bp, Homo sapiens
gaatcacctggctg

SEQ ID NO: 4141822 - DNA, 13 bp, Homo sapiens
gaatcagaactca

SEQ ID NO: 4141823 - DNA, 18 bp, Homo sapiens
gaatcagaatcatggaga

SEQ ID NO: 4141824 - DNA, 23 bp, Homo sapiens
gaatcagaatcatggagaaaatg

SEQ ID NO: 4141825 - DNA, 13 bp, Homo sapiens
gaatcagttttta

SEQ ID NO: 4141826 - DNA, 15 bp, Homo sapiens
gaatcatgagcctgc

SEQ ID NO: 4141827 - DNA, 16 bp, Homo sapiens
gaatcatgagcctgct

SEQ ID NO: 4141828 - DNA, 19 bp, Homo sapiens
gaatcatgagcctgctgga

SEQ ID NO: 4141829 - DNA, 16 bp, Homo sapiens
gaatcatggagaaaat

SEQ ID NO: 4141830 - DNA, 21 bp, Homo sapiens
gaatcatgtgcgtcagtccaa

SEQ ID NO: 4141831 - DNA, 13 bp, Homo sapiens
gaatccaaacttg

SEQ ID NO: 4141832 - DNA, 21 bp, Homo sapiens
gaatccaagggttgagagcca

SEQ ID NO: 4141833 - DNA, 17 bp, Homo sapiens
gaatcccaaatttgatt

SEQ ID NO: 4141834 - DNA, 14 bp, Homo sapiens
gaatcccccttgcc

SEQ ID NO: 4141835 - DNA, 15 bp, Homo sapiens
gaatcccttaaaatt

SEQ ID NO: 4141836 - DNA, 20 bp, Homo sapiens
gaatcctgctcacaaaatca

SEQ ID NO: 4141837 - DNA, 15 bp, Homo sapiens
gaatctacaagccaa

SEQ ID NO: 4141838 - DNA, 17 bp, Homo sapiens
gaatctcccactccagc

SEQ ID NO: 4141839 - DNA, 15 bp, Homo sapiens
gaatctgctcacttt

SEQ ID NO: 4141840 - DNA, 12 bp, Homo sapiens
gaatctggagac

SEQ ID NO: 4141841 - DNA, 20 bp, Homo sapiens
gaatctgtgggtctgggagt

SEQ ID NO: 4141842 - DNA, 20 bp, Homo sapiens
gaatcttaatgcttgtaatt

SEQ ID NO: 4141843 - DNA, 16 bp, Homo sapiens
gaatcttaatttatta

SEQ ID NO: 4141844 - DNA, 15 bp, Homo sapiens
gaatcttcactagaa

SEQ ID NO: 4141845 - DNA, 23 bp, Homo sapiens
gaatctttagagaagtatacata

SEQ ID NO: 4141846 - DNA, 20 bp, Homo sapiens
gaatctttccaataaaccag

SEQ ID NO: 4141847 - DNA, 22 bp, Homo sapiens
gaatgaaaatgcagtcctgagg

SEQ ID NO: 4141848 - DNA, 12 bp, Homo sapiens
gaatgagcccag

SEQ ID NO: 4141849 - DNA, 20 bp, Homo sapiens
gaatgagcccagagaacagc

SEQ ID NO: 4141850 - DNA, 14 bp, Homo sapiens
gaatgaggtcccag

SEQ ID NO: 4141851 - DNA, 14 bp, Homo sapiens
gaatgaggtgggag

SEQ ID NO: 4141852 - DNA, 15 bp, Homo sapiens
gaatgaggtgggagg

SEQ ID NO: 4141853 - DNA, 13 bp, Homo sapiens
gaatgattaatca

SEQ ID NO: 4141854 - DNA, 23 bp, Homo sapiens
gaatgattctaatttttaagcaa

SEQ ID NO: 4141855 - DNA, 18 bp, Homo sapiens
gaatgcacaagaatggat

SEQ ID NO: 4141856 - DNA, 19 bp, Homo sapiens
gaatgcacaagaatggatc

SEQ ID NO: 4141857 - DNA, 22 bp, Homo sapiens
gaatgcacactagcctctccag

SEQ ID NO: 4141858 - DNA, 19 bp, Homo sapiens
gaatgcattccctgaatct

SEQ ID NO: 4141859 - DNA, 14 bp, Homo sapiens
gaatgcctcctgtg

SEQ ID NO: 4141860 - DNA, 17 bp, Homo sapiens
gaatgcctcctgtgggg

SEQ ID NO: 4141861 - DNA, 15 bp, Homo sapiens
gaatgctctgtgcca

SEQ ID NO: 4141862 - DNA, 13 bp, Homo sapiens
gaatgctgccagt

SEQ ID NO: 4141863 - DNA, 23 bp, Homo sapiens
gaatgctggactggaggcccctg

SEQ ID NO: 4141864 - DNA, 18 bp, Homo sapiens
gaatgctggttttcctaa

SEQ ID NO: 4141865 - DNA, 22 bp, Homo sapiens
gaatgctggttttcctaaatgc

SEQ ID NO: 4141866 - DNA, 13 bp, Homo sapiens
gaatgctgtgtta

SEQ ID NO: 4141867 - DNA, 16 bp, Homo sapiens
gaatggaaagcggagt

SEQ ID NO: 4141868 - DNA, 22 bp, Homo sapiens
gaatggaagggttctggctgcc

SEQ ID NO: 4141869 - DNA, 14 bp, Homo sapiens
gaatggagcctgct

SEQ ID NO: 4141870 - DNA, 20 bp, Homo sapiens
gaatggattggattatttaa

SEQ ID NO: 4141871 - DNA, 18 bp, Homo sapiens
gaatggcaatgttttgct

SEQ ID NO: 4141872 - DNA, 13 bp, Homo sapiens
gaatggtccaggg

SEQ ID NO: 4141873 - DNA, 19 bp, Homo sapiens
gaatggtgtgaacccggga

SEQ ID NO: 4141874 - DNA, 19 bp, Homo sapiens
gaatggttccatgcctgag

SEQ ID NO: 4141875 - DNA, 20 bp, Homo sapiens
gaatggttccatgcctgagg

SEQ ID NO: 4141876 - DNA, 22 bp, Homo sapiens
gaatggttttcaaaataaaaat

SEQ ID NO: 4141877 - DNA, 13 bp, Homo sapiens
gaatgtaatcaat

SEQ ID NO: 4141878 - DNA, 19 bp, Homo sapiens
gaatgtaatcaatgtttct

SEQ ID NO: 4141879 - DNA, 17 bp, Homo sapiens
gaatgtatcaggaaata

SEQ ID NO: 4141880 - DNA, 14 bp, Homo sapiens
gaatgtatgtaatg

SEQ ID NO: 4141881 - DNA, 16 bp, Homo sapiens
gaatgtattattctgc

SEQ ID NO: 4141882 - DNA, 14 bp, Homo sapiens
gaatgtgaaagcac

SEQ ID NO: 4141883 - DNA, 15 bp, Homo sapiens
gaatgtgcaggtttg

SEQ ID NO: 4141884 - DNA, 21 bp, Homo sapiens
gaatgtgcaggtttgttacat

SEQ ID NO: 4141885 - DNA, 18 bp, Homo sapiens
gaatgtgcccctggccca

SEQ ID NO: 4141886 - DNA, 19 bp, Homo sapiens
gaatgtgcccctggcccat

SEQ ID NO: 4141887 - DNA, 20 bp, Homo sapiens
gaatgtggatttgattcatt

SEQ ID NO: 4141888 - DNA, 18 bp, Homo sapiens
gaatgtggcttgagaaat

SEQ ID NO: 4141889 - DNA, 20 bp, Homo sapiens
gaatgtgggcactggcccag

SEQ ID NO: 4141890 - DNA, 13 bp, Homo sapiens
gaatgtggtctca

SEQ ID NO: 4141891 - DNA, 14 bp, Homo sapiens
gaatgtggtctcag

SEQ ID NO: 4141892 - DNA, 12 bp, Homo sapiens
gaatgtgtcagg

SEQ ID NO: 4141893 - DNA, 19 bp, Homo sapiens
gaatgttaagaattgacca

SEQ ID NO: 4141894 - DNA, 14 bp, Homo sapiens
gaatgttaagcaga

SEQ ID NO: 4141895 - DNA, 15 bp, Homo sapiens
gaatgttaagcagat

SEQ ID NO: 4141896 - DNA, 20 bp, Homo sapiens
gaatgttacattgtttgtct

SEQ ID NO: 4141897 - DNA, 17 bp, Homo sapiens
gaatgttctgacattaa

SEQ ID NO: 4141898 - DNA, 21 bp, Homo sapiens
gaatgtttacactctttgtaa

SEQ ID NO: 4141899 - DNA, 16 bp, Homo sapiens
gaatgtttatagcaaa

SEQ ID NO: 4141900 - DNA, 15 bp, Homo sapiens
gaatgtttttccctc

SEQ ID NO: 4141901 - DNA, 16 bp, Homo sapiens
gaatgtttttccctcc

SEQ ID NO: 4141902 - DNA, 11 bp, Homo sapiens
gaattaaaact

SEQ ID NO: 4141903 - DNA, 17 bp, Homo sapiens
gaattaaaacttcttaa

SEQ ID NO: 4141904 - DNA, 13 bp, Homo sapiens
gaattaaactttt

SEQ ID NO: 4141905 - DNA, 20 bp, Homo sapiens
gaattaaattaggaataaat

SEQ ID NO: 4141906 - DNA, 19 bp, Homo sapiens
gaattaaccatttaataaa

SEQ ID NO: 4141907 - DNA, 23 bp, Homo sapiens
gaattaaccatttaataaagaaa

SEQ ID NO: 4141908 - DNA, 16 bp, Homo sapiens
gaattaacctggtgct

SEQ ID NO: 4141909 - DNA, 13 bp, Homo sapiens
gaattaagaatat

SEQ ID NO: 4141910 - DNA, 21 bp, Homo sapiens
gaattaatatccctacatgta

SEQ ID NO: 4141911 - DNA, 15 bp, Homo sapiens
gaattattgacactg

SEQ ID NO: 4141912 - DNA, 17 bp, Homo sapiens
gaattattgacactgaa

SEQ ID NO: 4141913 - DNA, 20 bp, Homo sapiens
gaattatttgccttctgaaa

SEQ ID NO: 4141914 - DNA, 20 bp, Homo sapiens
gaattatttttgtgtttcta

SEQ ID NO: 4141915 - DNA, 18 bp, Homo sapiens
gaattcaaactggggcct

SEQ ID NO: 4141916 - DNA, 16 bp, Homo sapiens
gaattcagattttaaa

SEQ ID NO: 4141917 - DNA, 16 bp, Homo sapiens
gaattccaaggagttc

SEQ ID NO: 4141918 - DNA, 22 bp, Homo sapiens
gaattcgaaggctctctctttc

SEQ ID NO: 4141919 - DNA, 11 bp, Homo sapiens
gaattcttcct

SEQ ID NO: 4141920 - DNA, 13 bp, Homo sapiens
gaattcttctgca

SEQ ID NO: 4141921 - DNA, 16 bp, Homo sapiens
gaattgagtaatggtg

SEQ ID NO: 4141922 - DNA, 12 bp, Homo sapiens
gaattgcattga

SEQ ID NO: 4141923 - DNA, 16 bp, Homo sapiens
gaattgcctgcagaga

SEQ ID NO: 4141924 - DNA, 22 bp, Homo sapiens
gaattgcctgcagagagaagcc

SEQ ID NO: 4141925 - DNA, 14 bp, Homo sapiens
gaattgtatcattt

SEQ ID NO: 4141926 - DNA, 18 bp, Homo sapiens
gaatttaaaattaagtag

SEQ ID NO: 4141927 - DNA, 21 bp, Homo sapiens
gaatttaaaattaagtagaac

SEQ ID NO: 4141928 - DNA, 16 bp, Homo sapiens
gaatttaaataaagtt

SEQ ID NO: 4141929 - DNA, 20 bp, Homo sapiens
gaatttaaatataattctgt

SEQ ID NO: 4141930 - DNA, 22 bp, Homo sapiens
gaatttaaatataattctgtaa

SEQ ID NO: 4141931 - DNA, 19 bp, Homo sapiens
gaatttaggtttttattag

SEQ ID NO: 4141932 - DNA, 13 bp, Homo sapiens
gaatttattcaat

SEQ ID NO: 4141933 - DNA, 14 bp, Homo sapiens
gaatttcccaggac

SEQ ID NO: 4141934 - DNA, 22 bp, Homo sapiens
gaatttcccaggaccctgaagg

SEQ ID NO: 4141935 - DNA, 18 bp, Homo sapiens
gaatttccttactcttga

SEQ ID NO: 4141936 - DNA, 12 bp, Homo sapiens
gaatttcttggt

SEQ ID NO: 4141937 - DNA, 14 bp, Homo sapiens
gaatttgaatgaaa

SEQ ID NO: 4141938 - DNA, 17 bp, Homo sapiens
gaatttgaatgaaaaat

SEQ ID NO: 4141939 - DNA, 23 bp, Homo sapiens
gaatttgatcgttccagttccca

SEQ ID NO: 4141940 - DNA, 20 bp, Homo sapiens
gaatttgcctgctgggattc

SEQ ID NO: 4141941 - DNA, 19 bp, Homo sapiens
gaatttggcctgcactaat

SEQ ID NO: 4141942 - DNA, 19 bp, Homo sapiens
gaatttgtaacctcagctc

SEQ ID NO: 4141943 - DNA, 21 bp, Homo sapiens
gaatttgtaacctcagctctg

SEQ ID NO: 4141944 - DNA, 17 bp, Homo sapiens
gaatttgtgaacagcag

SEQ ID NO: 4141945 - DNA, 15 bp, Homo sapiens
gaattttaagtgctt

SEQ ID NO: 4141946 - DNA, 15 bp, Homo sapiens
gaattttacatggta

SEQ ID NO: 4141947 - DNA, 15 bp, Homo sapiens
gaattttacttccat

SEQ ID NO: 4141948 - DNA, 14 bp, Homo sapiens
gaattttaggaact

SEQ ID NO: 4141949 - DNA, 16 bp, Homo sapiens
gacaaaaagtttccat

SEQ ID NO: 4141950 - DNA, 21 bp, Homo sapiens
gacaaaaatgaactgaagttt

SEQ ID NO: 4141951 - DNA, 14 bp, Homo sapiens
gacaaaagtctgtc

SEQ ID NO: 4141952 - DNA, 17 bp, Homo sapiens
gacaaacaagggagaag

SEQ ID NO: 4141953 - DNA, 18 bp, Homo sapiens
gacaaactggagtctgga

SEQ ID NO: 4141954 - DNA, 17 bp, Homo sapiens
gacaaaggacatttgtt

SEQ ID NO: 4141955 - DNA, 19 bp, Homo sapiens
gacaaagtggaggagggcc

SEQ ID NO: 4141956 - DNA, 17 bp, Homo sapiens
gacaaatagaaaatggt

SEQ ID NO: 4141957 - DNA, 18 bp, Homo sapiens
gacaaatagaaaatggtc

SEQ ID NO: 4141958 - DNA, 14 bp, Homo sapiens
gacaacagaagtca

SEQ ID NO: 4141959 - DNA, 15 bp, Homo sapiens
gacaacctagaatgt

SEQ ID NO: 4141960 - DNA, 16 bp, Homo sapiens
gacaacctagaatgtc

SEQ ID NO: 4141961 - DNA, 14 bp, Homo sapiens
gacaacgatgaatt

SEQ ID NO: 4141962 - DNA, 13 bp, Homo sapiens
gacaactgtgact

SEQ ID NO: 4141963 - DNA, 16 bp, Homo sapiens
gacaacttatttaaaa

SEQ ID NO: 4141964 - DNA, 17 bp, Homo sapiens
gacaacttatttaaaaa

SEQ ID NO: 4141965 - DNA, 15 bp, Homo sapiens
gacaagaaatccctg

SEQ ID NO: 4141966 - DNA, 18 bp, Homo sapiens
gacaagagatgggaatga

SEQ ID NO: 4141967 - DNA, 14 bp, Homo sapiens
gacaagatattgta

SEQ ID NO: 4141968 - DNA, 15 bp, Homo sapiens
gacaagcacagtcag

SEQ ID NO: 4141969 - DNA, 15 bp, Homo sapiens
gacaaggaggtagag

SEQ ID NO: 4141970 - DNA, 15 bp, Homo sapiens
gacaagtggactcag

SEQ ID NO: 4141971 - DNA, 22 bp, Homo sapiens
gacaagttggaaaaacaacagc

SEQ ID NO: 4141972 - DNA, 15 bp, Homo sapiens
gacaatactggggtt

SEQ ID NO: 4141973 - DNA, 19 bp, Homo sapiens
gacaatatgtgagtgcctt

SEQ ID NO: 4141974 - DNA, 19 bp, Homo sapiens
gacaatcatgaaatatgca

SEQ ID NO: 4141975 - DNA, 20 bp, Homo sapiens
gacaatcatgaaatatgcat

SEQ ID NO: 4141976 - DNA, 21 bp, Homo sapiens
gacaatgtcgagtatattatt

SEQ ID NO: 4141977 - DNA, 18 bp, Homo sapiens
gacaatgttttcttcaac

SEQ ID NO: 4141978 - DNA, 17 bp, Homo sapiens
gacaatttgatacataa

SEQ ID NO: 4141979 - DNA, 22 bp, Homo sapiens
gacacaagtggaccttaggcct

SEQ ID NO: 4141980 - DNA, 20 bp, Homo sapiens
gacacaatatgtatgctttt

SEQ ID NO: 4141981 - DNA, 21 bp, Homo sapiens
gacacaatatgtatgcttttt

SEQ ID NO: 4141982 - DNA, 12 bp, Homo sapiens
gacacacacacg

SEQ ID NO: 4141983 - DNA, 13 bp, Homo sapiens
gacacacacacgc

SEQ ID NO: 4141984 - DNA, 15 bp, Homo sapiens
gacacacacacgcac

SEQ ID NO: 4141985 - DNA, 19 bp, Homo sapiens
gacacacacacgcacgcac

SEQ ID NO: 4141986 - DNA, 20 bp, Homo sapiens
gacacacacacgcacgcaca

SEQ ID NO: 4141987 - DNA, 23 bp, Homo sapiens
gacacacacacgcacgcacacac

SEQ ID NO: 4141988 - DNA, 16 bp, Homo sapiens
gacacagaaaatgttg

SEQ ID NO: 4141989 - DNA, 18 bp, Homo sapiens
gacacagaaaatgttgag

SEQ ID NO: 4141990 - DNA, 21 bp, Homo sapiens
gacacagaaaatgttgagaat

SEQ ID NO: 4141991 - DNA, 16 bp, Homo sapiens
gacacagacccaggac

SEQ ID NO: 4141992 - DNA, 11 bp, Homo sapiens
gacacagcagc

SEQ ID NO: 4141993 - DNA, 18 bp, Homo sapiens
gacacagcagcttcacca

SEQ ID NO: 4141994 - DNA, 20 bp, Homo sapiens
gacacagcagcttcaccaga

SEQ ID NO: 4141995 - DNA, 22 bp, Homo sapiens
gacacagcagcttcaccagagc

SEQ ID NO: 4141996 - DNA, 22 bp, Homo sapiens
gacacaggggacacccagaaac

SEQ ID NO: 4141997 - DNA, 15 bp, Homo sapiens
gacacagtcagcatg

SEQ ID NO: 4141998 - DNA, 17 bp, Homo sapiens
gacaccagaaagccctc

SEQ ID NO: 4141999 - DNA, 12 bp, Homo sapiens
gacaccagagca

SEQ ID NO: 4142000 - DNA, 15 bp, Homo sapiens
gacaccagagcagat

SEQ ID NO: 4142001 - DNA, 19 bp, Homo sapiens
gacaccagagcagatgcag

SEQ ID NO: 4142002 - DNA, 22 bp, Homo sapiens
gacaccagagcagatgcagaga

SEQ ID NO: 4142003 - DNA, 14 bp, Homo sapiens
gacacccaaagggt

SEQ ID NO: 4142004 - DNA, 14 bp, Homo sapiens
gacacccaggactt

SEQ ID NO: 4142005 - DNA, 21 bp, Homo sapiens
gacaccccctccccgcccctg

SEQ ID NO: 4142006 - DNA, 18 bp, Homo sapiens
gacaccccttatccagga

SEQ ID NO: 4142007 - DNA, 19 bp, Homo sapiens
gacaccccttatccaggac

SEQ ID NO: 4142008 - DNA, 20 bp, Homo sapiens
gacaccccttatccaggact

SEQ ID NO: 4142009 - DNA, 13 bp, Homo sapiens
gacaccctcaacc

SEQ ID NO: 4142010 - DNA, 14 bp, Homo sapiens
gacaccctggcctg

SEQ ID NO: 4142011 - DNA, 23 bp, Homo sapiens
gacaccctggcctgaactgagga

SEQ ID NO: 4142012 - DNA, 19 bp, Homo sapiens
gacaccggctggcagggct

SEQ ID NO: 4142013 - DNA, 13 bp, Homo sapiens
gacacctgccctg

SEQ ID NO: 4142014 - DNA, 14 bp, Homo sapiens
gacacctgccctgc

SEQ ID NO: 4142015 - DNA, 17 bp, Homo sapiens
gacacgccttcccctca

SEQ ID NO: 4142016 - DNA, 23 bp, Homo sapiens
gacacgctcgcgggcagcgggcc

SEQ ID NO: 4142017 - DNA, 15 bp, Homo sapiens
gacacggagcccagc

SEQ ID NO: 4142018 - DNA, 18 bp, Homo sapiens
gacactaagttatagtat

SEQ ID NO: 4142019 - DNA, 15 bp, Homo sapiens
gacactaatgcagcc

SEQ ID NO: 4142020 - DNA, 13 bp, Homo sapiens
gacactaccccat

SEQ ID NO: 4142021 - DNA, 14 bp, Homo sapiens
gacactagaaaact

SEQ ID NO: 4142022 - DNA, 13 bp, Homo sapiens
gacactcagacct

SEQ ID NO: 4142023 - DNA, 17 bp, Homo sapiens
gacactccatgagtgtc

SEQ ID NO: 4142024 - DNA, 14 bp, Homo sapiens
gacactcctagact

SEQ ID NO: 4142025 - DNA, 21 bp, Homo sapiens
gacactcctagagaacgcagc

SEQ ID NO: 4142026 - DNA, 20 bp, Homo sapiens
gacactgaaagttttgtaaa

SEQ ID NO: 4142027 - DNA, 16 bp, Homo sapiens
gacactgagccccacc

SEQ ID NO: 4142028 - DNA, 16 bp, Homo sapiens
gacactgtgcccagcc

SEQ ID NO: 4142029 - DNA, 23 bp, Homo sapiens
gacactgtgcccagcccggacct

SEQ ID NO: 4142030 - DNA, 23 bp, Homo sapiens
gacacttcagagagctggtagtt

SEQ ID NO: 4142031 - DNA, 18 bp, Homo sapiens
gacagaaaagtgcctgag

SEQ ID NO: 4142032 - DNA, 13 bp, Homo sapiens
gacagaacattta

SEQ ID NO: 4142033 - DNA, 21 bp, Homo sapiens
gacagaagcctggactctgcc

SEQ ID NO: 4142034 - DNA, 15 bp, Homo sapiens
gacagaagtctcctc

SEQ ID NO: 4142035 - DNA, 14 bp, Homo sapiens
gacagacaggctct

SEQ ID NO: 4142036 - DNA, 15 bp, Homo sapiens
gacagaccacttgcc

SEQ ID NO: 4142037 - DNA, 19 bp, Homo sapiens
gacagaccacttgccacgc

SEQ ID NO: 4142038 - DNA, 15 bp, Homo sapiens
gacagacttgagaac

SEQ ID NO: 4142039 - DNA, 17 bp, Homo sapiens
gacagagcgacagagca

SEQ ID NO: 4142040 - DNA, 17 bp, Homo sapiens
gacagagttcacaggag

SEQ ID NO: 4142041 - DNA, 16 bp, Homo sapiens
gacagagttgattttt

SEQ ID NO: 4142042 - DNA, 19 bp, Homo sapiens
gacagatgaatgccgtgga

SEQ ID NO: 4142043 - DNA, 19 bp, Homo sapiens
gacagatgccccagagctg

SEQ ID NO: 4142044 - DNA, 12 bp, Homo sapiens
gacagcaggcag

SEQ ID NO: 4142045 - DNA, 17 bp, Homo sapiens
gacagcatcccttccca

SEQ ID NO: 4142046 - DNA, 20 bp, Homo sapiens
gacagcatgccccttggctg

SEQ ID NO: 4142047 - DNA, 15 bp, Homo sapiens
gacagccagagctgg

SEQ ID NO: 4142048 - DNA, 17 bp, Homo sapiens
gacagcccactgagaag

SEQ ID NO: 4142049 - DNA, 17 bp, Homo sapiens
gacagcccctccctcct

SEQ ID NO: 4142050 - DNA, 20 bp, Homo sapiens
gacagcctccccctgtcccc

SEQ ID NO: 4142051 - DNA, 13 bp, Homo sapiens
gacagcctggcac

SEQ ID NO: 4142052 - DNA, 13 bp, Homo sapiens
gacagcgcccctg

SEQ ID NO: 4142053 - DNA, 17 bp, Homo sapiens
gacagcgcccctgctgt

SEQ ID NO: 4142054 - DNA, 18 bp, Homo sapiens
gacagctgataaatttaa

SEQ ID NO: 4142055 - DNA, 19 bp, Homo sapiens
gacagctgcaagccaggga

SEQ ID NO: 4142056 - DNA, 20 bp, Homo sapiens
gacagctgcaagccagggat

SEQ ID NO: 4142057 - DNA, 22 bp, Homo sapiens
gacagctgcaagccagggatga

SEQ ID NO: 4142058 - DNA, 22 bp, Homo sapiens
gacagcttgagccgggcccctg

SEQ ID NO: 4142059 - DNA, 17 bp, Homo sapiens
gacaggaaagccctccc

SEQ ID NO: 4142060 - DNA, 17 bp, Homo sapiens
gacaggaagctggcaga

SEQ ID NO: 4142061 - DNA, 18 bp, Homo sapiens
gacaggagacctggcact

SEQ ID NO: 4142062 - DNA, 19 bp, Homo sapiens
gacaggagcctagcggagc

SEQ ID NO: 4142063 - DNA, 14 bp, Homo sapiens
gacaggaggaggag

SEQ ID NO: 4142064 - DNA, 23 bp, Homo sapiens
gacaggaggaggagatggccata

SEQ ID NO: 4142065 - DNA, 17 bp, Homo sapiens
gacaggaggcggcccgg

SEQ ID NO: 4142066 - DNA, 21 bp, Homo sapiens
gacaggaggcggcccggccag

SEQ ID NO: 4142067 - DNA, 16 bp, Homo sapiens
gacaggatgggggctg

SEQ ID NO: 4142068 - DNA, 10 bp, Homo sapiens
gacaggcagc

SEQ ID NO: 4142069 - DNA, 15 bp, Homo sapiens
gacaggcagcccagc

SEQ ID NO: 4142070 - DNA, 20 bp, Homo sapiens
gacaggccatgtgagccacc

SEQ ID NO: 4142071 - DNA, 13 bp, Homo sapiens
gacaggccctggc

SEQ ID NO: 4142072 - DNA, 18 bp, Homo sapiens
gacaggctcttagcagct

SEQ ID NO: 4142073 - DNA, 19 bp, Homo sapiens
gacaggctcttagcagctt

SEQ ID NO: 4142074 - DNA, 14 bp, Homo sapiens
gacagggaggccac

SEQ ID NO: 4142075 - DNA, 17 bp, Homo sapiens
gacagggaggccacacg

SEQ ID NO: 4142076 - DNA, 14 bp, Homo sapiens
gacagggcatggcc

SEQ ID NO: 4142077 - DNA, 12 bp, Homo sapiens
gacagggccagt

SEQ ID NO: 4142078 - DNA, 16 bp, Homo sapiens
gacagggccagtgggg

SEQ ID NO: 4142079 - DNA, 15 bp, Homo sapiens
gacagggtaggaaag

SEQ ID NO: 4142080 - DNA, 20 bp, Homo sapiens
gacagggtcttgctctgtcc

SEQ ID NO: 4142081 - DNA, 21 bp, Homo sapiens
gacagggtcttgctctgtccc

SEQ ID NO: 4142082 - DNA, 22 bp, Homo sapiens
gacagggtcttgctctgtcccc

SEQ ID NO: 4142083 - DNA, 16 bp, Homo sapiens
gacagggtgggcttcc

SEQ ID NO: 4142084 - DNA, 20 bp, Homo sapiens
gacagtcatcatcagggcct

SEQ ID NO: 4142085 - DNA, 17 bp, Homo sapiens
gacagtccagtgtcacc

SEQ ID NO: 4142086 - DNA, 22 bp, Homo sapiens
gacagtccttggggttaagtct

SEQ ID NO: 4142087 - DNA, 21 bp, Homo sapiens
gacagtgatctccatatgtta

SEQ ID NO: 4142088 - DNA, 22 bp, Homo sapiens
gacagtgcctgggaatgtatta

SEQ ID NO: 4142089 - DNA, 13 bp, Homo sapiens
gacagtgccttct

SEQ ID NO: 4142090 - DNA, 19 bp, Homo sapiens
gacagttcattcagggccg

SEQ ID NO: 4142091 - DNA, 18 bp, Homo sapiens
gacagttgtctagagata

SEQ ID NO: 4142092 - DNA, 14 bp, Homo sapiens
gacagtttcttagc

SEQ ID NO: 4142093 - DNA, 20 bp, Homo sapiens
gacagtttcttagcttttta

SEQ ID NO: 4142094 - DNA, 23 bp, Homo sapiens
gacataatatattctatttttat

SEQ ID NO: 4142095 - DNA, 17 bp, Homo sapiens
gacataccccactgggc

SEQ ID NO: 4142096 - DNA, 18 bp, Homo sapiens
gacataccccactgggca

SEQ ID NO: 4142097 - DNA, 22 bp, Homo sapiens
gacatactccttccatcaaata

SEQ ID NO: 4142098 - DNA, 15 bp, Homo sapiens
gacatactctctgcc

SEQ ID NO: 4142099 - DNA, 16 bp, Homo sapiens
gacatactctctgcct

SEQ ID NO: 4142100 - DNA, 21 bp, Homo sapiens
gacatactctctgcctggtgg

SEQ ID NO: 4142101 - DNA, 14 bp, Homo sapiens
gacatacttgaagg

SEQ ID NO: 4142102 - DNA, 20 bp, Homo sapiens
gacatacttgaagggccaga

SEQ ID NO: 4142103 - DNA, 15 bp, Homo sapiens
gacatcacagcagcc

SEQ ID NO: 4142104 - DNA, 21 bp, Homo sapiens
gacatcagttcctttgtgtgt

SEQ ID NO: 4142105 - DNA, 23 bp, Homo sapiens
gacatcctcttctgcttaggaga

SEQ ID NO: 4142106 - DNA, 13 bp, Homo sapiens
gacatctcagggg

SEQ ID NO: 4142107 - DNA, 17 bp, Homo sapiens
gacatctcaggggccag

SEQ ID NO: 4142108 - DNA, 22 bp, Homo sapiens
gacatctcaggggccagaggaa

SEQ ID NO: 4142109 - DNA, 19 bp, Homo sapiens
gacatgcattgttggctat

SEQ ID NO: 4142110 - DNA, 16 bp, Homo sapiens
gacatgcggtagccag

SEQ ID NO: 4142111 - DNA, 17 bp, Homo sapiens
gacatgcggtagccagc

SEQ ID NO: 4142112 - DNA, 19 bp, Homo sapiens
gacatgcggtagccagcac

SEQ ID NO: 4142113 - DNA, 23 bp, Homo sapiens
gacatgcggtagccagcacacag

SEQ ID NO: 4142114 - DNA, 20 bp, Homo sapiens
gacatgctcacctctagcct

SEQ ID NO: 4142115 - DNA, 15 bp, Homo sapiens
gacatgctgactgtc

SEQ ID NO: 4142116 - DNA, 17 bp, Homo sapiens
gacatggagactcctgc

SEQ ID NO: 4142117 - DNA, 16 bp, Homo sapiens
gacatggtgcctgaga

SEQ ID NO: 4142118 - DNA, 22 bp, Homo sapiens
gacatggtgcctgagaggcagg

SEQ ID NO: 4142119 - DNA, 12 bp, Homo sapiens
gacatgtagctt

SEQ ID NO: 4142120 - DNA, 15 bp, Homo sapiens
gacatgtagcttctt

SEQ ID NO: 4142121 - DNA, 12 bp, Homo sapiens
gacatgtgaaac

SEQ ID NO: 4142122 - DNA, 18 bp, Homo sapiens
gacatgtgaaaccttttt

SEQ ID NO: 4142123 - DNA, 23 bp, Homo sapiens
gacatgtgaaaccttttttaaga

SEQ ID NO: 4142124 - DNA, 16 bp, Homo sapiens
gacatgtgacatttat

SEQ ID NO: 4142125 - DNA, 17 bp, Homo sapiens
gacatgtgaggaggaaa

SEQ ID NO: 4142126 - DNA, 13 bp, Homo sapiens
gacatgtggaaag

SEQ ID NO: 4142127 - DNA, 18 bp, Homo sapiens
gacatgtggaaagtgaat

SEQ ID NO: 4142128 - DNA, 23 bp, Homo sapiens
gacatgtggaaagtgaatttgaa

SEQ ID NO: 4142129 - DNA, 17 bp, Homo sapiens
gacatgttttccgtgaa

SEQ ID NO: 4142130 - DNA, 23 bp, Homo sapiens
gacattaaaaatgttagtatttt

SEQ ID NO: 4142131 - DNA, 19 bp, Homo sapiens
gacattaacaaataaaaaa

SEQ ID NO: 4142132 - DNA, 22 bp, Homo sapiens
gacattaacagttttccatgaa

SEQ ID NO: 4142133 - DNA, 14 bp, Homo sapiens
gacattgccccaag

SEQ ID NO: 4142134 - DNA, 16 bp, Homo sapiens
gacattgccccaagat

SEQ ID NO: 4142135 - DNA, 14 bp, Homo sapiens
gacattgcgtttga

SEQ ID NO: 4142136 - DNA, 23 bp, Homo sapiens
gacattggcacctaatccaggca

SEQ ID NO: 4142137 - DNA, 15 bp, Homo sapiens
gacatttagaacttt

SEQ ID NO: 4142138 - DNA, 11 bp, Homo sapiens
gacatttccca

SEQ ID NO: 4142139 - DNA, 18 bp, Homo sapiens
gacatttctgctctcagc

SEQ ID NO: 4142140 - DNA, 19 bp, Homo sapiens
gacatttcttttcttttta

SEQ ID NO: 4142141 - DNA, 23 bp, Homo sapiens
gacatttcttttctttttacata

SEQ ID NO: 4142142 - DNA, 17 bp, Homo sapiens
gacatttgtttgctgta

SEQ ID NO: 4142143 - DNA, 13 bp, Homo sapiens
gacattttacatt

SEQ ID NO: 4142144 - DNA, 20 bp, Homo sapiens
gaccaaagcaaagaaaataa

SEQ ID NO: 4142145 - DNA, 14 bp, Homo sapiens
gaccaacctgctct

SEQ ID NO: 4142146 - DNA, 18 bp, Homo sapiens
gaccaacctgctctgtcc

SEQ ID NO: 4142147 - DNA, 13 bp, Homo sapiens
gaccaactgccct

SEQ ID NO: 4142148 - DNA, 17 bp, Homo sapiens
gaccaactgccctaagc

SEQ ID NO: 4142149 - DNA, 13 bp, Homo sapiens
gaccaactgggcc

SEQ ID NO: 4142150 - DNA, 19 bp, Homo sapiens
gaccaactgggcccaagac

SEQ ID NO: 4142151 - DNA, 14 bp, Homo sapiens
gaccaactgtcact

SEQ ID NO: 4142152 - DNA, 14 bp, Homo sapiens
gaccaagttataaa

SEQ ID NO: 4142153 - DNA, 21 bp, Homo sapiens
gaccaagttataaatcaatgt

SEQ ID NO: 4142154 - DNA, 17 bp, Homo sapiens
gaccaattgtgctgcca

SEQ ID NO: 4142155 - DNA, 16 bp, Homo sapiens
gaccacagcacagcca

SEQ ID NO: 4142156 - DNA, 23 bp, Homo sapiens
gaccacagggttcaaaatgtctg

SEQ ID NO: 4142157 - DNA, 23 bp, Homo sapiens
gaccacatctttatctgttcttg

SEQ ID NO: 4142158 - DNA, 22 bp, Homo sapiens
gaccaccagccgccccagcccc

SEQ ID NO: 4142159 - DNA, 19 bp, Homo sapiens
gaccacctgcttctgaact

SEQ ID NO: 4142160 - DNA, 20 bp, Homo sapiens
gaccacctgcttctgaactc

SEQ ID NO: 4142161 - DNA, 21 bp, Homo sapiens
gaccacctgcttctgaactca

SEQ ID NO: 4142162 - DNA, 15 bp, Homo sapiens
gaccactcttcttta

SEQ ID NO: 4142163 - DNA, 22 bp, Homo sapiens
gaccactcttctttaagccata

SEQ ID NO: 4142164 - DNA, 20 bp, Homo sapiens
gaccactgagtaccaggggc

SEQ ID NO: 4142165 - DNA, 16 bp, Homo sapiens
gaccacttgccacgct

SEQ ID NO: 4142166 - DNA, 12 bp, Homo sapiens
gaccagaagcct

SEQ ID NO: 4142167 - DNA, 17 bp, Homo sapiens
gaccagaagccttggaa

SEQ ID NO: 4142168 - DNA, 21 bp, Homo sapiens
gaccagagacccaacagcagt

SEQ ID NO: 4142169 - DNA, 13 bp, Homo sapiens
gaccagagccaga

SEQ ID NO: 4142170 - DNA, 21 bp, Homo sapiens
gaccagataaatagaactatc

SEQ ID NO: 4142171 - DNA, 12 bp, Homo sapiens
gaccagcctggg

SEQ ID NO: 4142172 - DNA, 21 bp, Homo sapiens
gaccagctcagaggcccagga

SEQ ID NO: 4142173 - DNA, 22 bp, Homo sapiens
gaccagctcaggacagatgcca

SEQ ID NO: 4142174 - DNA, 14 bp, Homo sapiens
gaccaggactatag

SEQ ID NO: 4142175 - DNA, 22 bp, Homo sapiens
gaccaggactatagcccaggtc

SEQ ID NO: 4142176 - DNA, 14 bp, Homo sapiens
gaccaggactccct

SEQ ID NO: 4142177 - DNA, 22 bp, Homo sapiens
gaccaggatcccaagcctcctg

SEQ ID NO: 4142178 - DNA, 15 bp, Homo sapiens
gaccaggatttctaa

SEQ ID NO: 4142179 - DNA, 15 bp, Homo sapiens
gaccaggctgtagga

SEQ ID NO: 4142180 - DNA, 23 bp, Homo sapiens
gaccaggctgtgggtagatgtgc

SEQ ID NO: 4142181 - DNA, 14 bp, Homo sapiens
gaccaggctgtgtc

SEQ ID NO: 4142182 - DNA, 15 bp, Homo sapiens
gaccaggctgtgtcc

SEQ ID NO: 4142183 - DNA, 22 bp, Homo sapiens
gaccagggagcctttggttctg

SEQ ID NO: 4142184 - DNA, 17 bp, Homo sapiens
gaccagggatgctgggc

SEQ ID NO: 4142185 - DNA, 19 bp, Homo sapiens
gaccagggatgctgggctg

SEQ ID NO: 4142186 - DNA, 22 bp, Homo sapiens
gaccagggatgctgggctgggc

SEQ ID NO: 4142187 - DNA, 22 bp, Homo sapiens
gaccagggatgggggatgggcc

SEQ ID NO: 4142188 - DNA, 19 bp, Homo sapiens
gaccagggccgaggaggtg

SEQ ID NO: 4142189 - DNA, 21 bp, Homo sapiens
gaccagggccgaggaggtgcc

SEQ ID NO: 4142190 - DNA, 19 bp, Homo sapiens
gaccagggctggggcagcc

SEQ ID NO: 4142191 - DNA, 22 bp, Homo sapiens
gaccagggctggggcagcctct

SEQ ID NO: 4142192 - DNA, 18 bp, Homo sapiens
gaccagtgaccccagaaa

SEQ ID NO: 4142193 - DNA, 22 bp, Homo sapiens
gaccagtgataatgccccaagg

SEQ ID NO: 4142194 - DNA, 23 bp, Homo sapiens
gaccagtgataatgccccaagga

SEQ ID NO: 4142195 - DNA, 22 bp, Homo sapiens
gaccagtgtatcaggtcaggga

SEQ ID NO: 4142196 - DNA, 18 bp, Homo sapiens
gaccatattacctggatt

SEQ ID NO: 4142197 - DNA, 15 bp, Homo sapiens
gaccatctgctttta

SEQ ID NO: 4142198 - DNA, 19 bp, Homo sapiens
gaccatctggaattggttt

SEQ ID NO: 4142199 - DNA, 13 bp, Homo sapiens
gaccatgccagat

SEQ ID NO: 4142200 - DNA, 23 bp, Homo sapiens
gaccatgccagattctgcctctc

SEQ ID NO: 4142201 - DNA, 20 bp, Homo sapiens
gaccatgtgtcacttgtgct

SEQ ID NO: 4142202 - DNA, 21 bp, Homo sapiens
gaccatgtgtcacttgtgctt

SEQ ID NO: 4142203 - DNA, 21 bp, Homo sapiens
gaccatttataatgttagtag

SEQ ID NO: 4142204 - DNA, 17 bp, Homo sapiens
gacccaacagcagtgat

SEQ ID NO: 4142205 - DNA, 18 bp, Homo sapiens
gacccacgggctcatgca

SEQ ID NO: 4142206 - DNA, 20 bp, Homo sapiens
gacccagaatggagcctgct

SEQ ID NO: 4142207 - DNA, 15 bp, Homo sapiens
gacccagatcctcac

SEQ ID NO: 4142208 - DNA, 20 bp, Homo sapiens
gacccagatcctcacaacca

SEQ ID NO: 4142209 - DNA, 15 bp, Homo sapiens
gacccagcaggaagc

SEQ ID NO: 4142210 - DNA, 23 bp, Homo sapiens
gacccagcaggaagccaggctga

SEQ ID NO: 4142211 - DNA, 23 bp, Homo sapiens
gacccagccccttgagaaacctt

SEQ ID NO: 4142212 - DNA, 15 bp, Homo sapiens
gacccaggcctgtgg

SEQ ID NO: 4142213 - DNA, 20 bp, Homo sapiens
gacccaggtggagggcacag

SEQ ID NO: 4142214 - DNA, 22 bp, Homo sapiens
gacccaggtggagggcacagcc

SEQ ID NO: 4142215 - DNA, 23 bp, Homo sapiens
gacccaggtggagggcacagccc

SEQ ID NO: 4142216 - DNA, 20 bp, Homo sapiens
gacccagtgcccccactgac

SEQ ID NO: 4142217 - DNA, 16 bp, Homo sapiens
gaccccaaagagcctg

SEQ ID NO: 4142218 - DNA, 20 bp, Homo sapiens
gaccccaaagagcctggaga

SEQ ID NO: 4142219 - DNA, 19 bp, Homo sapiens
gaccccaatccaacccggg

SEQ ID NO: 4142220 - DNA, 11 bp, Homo sapiens
gaccccagaat

SEQ ID NO: 4142221 - DNA, 15 bp, Homo sapiens
gaccccattcctgat

SEQ ID NO: 4142222 - DNA, 13 bp, Homo sapiens
gacccccacacct

SEQ ID NO: 4142223 - DNA, 18 bp, Homo sapiens
gacccccacgattggcca

SEQ ID NO: 4142224 - DNA, 13 bp, Homo sapiens
gacccccagctcc

SEQ ID NO: 4142225 - DNA, 23 bp, Homo sapiens
gacccccagctccggcctgtcct

SEQ ID NO: 4142226 - DNA, 21 bp, Homo sapiens
gacccccccccaactccagga

SEQ ID NO: 4142227 - DNA, 16 bp, Homo sapiens
gacccccttcctgtcc

SEQ ID NO: 4142228 - DNA, 13 bp, Homo sapiens
gacccctctggcc

SEQ ID NO: 4142229 - DNA, 16 bp, Homo sapiens
gacccctctggccagg

SEQ ID NO: 4142230 - DNA, 12 bp, Homo sapiens
gacccctgccca

SEQ ID NO: 4142231 - DNA, 23 bp, Homo sapiens
gacccctgcccagatcagccaga

SEQ ID NO: 4142232 - DNA, 13 bp, Homo sapiens
gacccctgcctgg

SEQ ID NO: 4142233 - DNA, 20 bp, Homo sapiens
gacccctgctcccagcctgc

SEQ ID NO: 4142234 - DNA, 23 bp, Homo sapiens
gacccctgctcccagcctgctga

SEQ ID NO: 4142235 - DNA, 11 bp, Homo sapiens
gaccccttgct

SEQ ID NO: 4142236 - DNA, 15 bp, Homo sapiens
gaccccttgctccct

SEQ ID NO: 4142237 - DNA, 20 bp, Homo sapiens
gacccctttgagagacgcca

SEQ ID NO: 4142238 - DNA, 21 bp, Homo sapiens
gacccctttgagagacgccac

SEQ ID NO: 4142239 - DNA, 18 bp, Homo sapiens
gacccggaggggcctggc

SEQ ID NO: 4142240 - DNA, 19 bp, Homo sapiens
gacccggaggggcctggca

SEQ ID NO: 4142241 - DNA, 20 bp, Homo sapiens
gacccggaggggcctggcag

SEQ ID NO: 4142242 - DNA, 16 bp, Homo sapiens
gacccggcctctctgc

SEQ ID NO: 4142243 - DNA, 20 bp, Homo sapiens
gacccggcctctctgcccca

SEQ ID NO: 4142244 - DNA, 23 bp, Homo sapiens
gacccggcctctctgccccaccc

SEQ ID NO: 4142245 - DNA, 22 bp, Homo sapiens
gaccctactcccttgccctaga

SEQ ID NO: 4142246 - DNA, 24 bp, Homo sapiens
gaccctcatggcccccaggggcag

SEQ ID NO: 4142247 - DNA, 13 bp, Homo sapiens
gaccctcccatgg

SEQ ID NO: 4142248 - DNA, 19 bp, Homo sapiens
gaccctcttgcccatcctg

SEQ ID NO: 4142249 - DNA, 21 bp, Homo sapiens
gaccctgaaaagaaggacggg

SEQ ID NO: 4142250 - DNA, 14 bp, Homo sapiens
gaccctgaggccct

SEQ ID NO: 4142251 - DNA, 17 bp, Homo sapiens
gaccctgaggccctggg

SEQ ID NO: 4142252 - DNA, 20 bp, Homo sapiens
gaccctgaggccctgggctg

SEQ ID NO: 4142253 - DNA, 19 bp, Homo sapiens
gaccctgcaaacagaacag

SEQ ID NO: 4142254 - DNA, 22 bp, Homo sapiens
gaccctgcaaacagaacagggt

SEQ ID NO: 4142255 - DNA, 12 bp, Homo sapiens
gaccctgccaca

SEQ ID NO: 4142256 - DNA, 19 bp, Homo sapiens
gaccctgccacagccagag

SEQ ID NO: 4142257 - DNA, 20 bp, Homo sapiens
gaccctgccacagccagagg

SEQ ID NO: 4142258 - DNA, 17 bp, Homo sapiens
gaccctgggtgggctct

SEQ ID NO: 4142259 - DNA, 18 bp, Homo sapiens
gaccctgggtgggctctg

SEQ ID NO: 4142260 - DNA, 19 bp, Homo sapiens
gaccctgggtgggctctgt

SEQ ID NO: 4142261 - DNA, 21 bp, Homo sapiens
gaccctgtgacatggtgcctg

SEQ ID NO: 4142262 - DNA, 22 bp, Homo sapiens
gaccctgtgacatggtgcctga

SEQ ID NO: 4142263 - DNA, 18 bp, Homo sapiens
gacccttcttgcctgctg

SEQ ID NO: 4142264 - DNA, 20 bp, Homo sapiens
gacccttcttgcctgctggg

SEQ ID NO: 4142265 - DNA, 17 bp, Homo sapiens
gacccttgacacctgct

SEQ ID NO: 4142266 - DNA, 15 bp, Homo sapiens
gaccgccccctcctc

SEQ ID NO: 4142267 - DNA, 16 bp, Homo sapiens
gaccgctgataagcat

SEQ ID NO: 4142268 - DNA, 17 bp, Homo sapiens
gaccggtgctgcaggag

SEQ ID NO: 4142269 - DNA, 20 bp, Homo sapiens
gaccgtactctcacatgtgg

SEQ ID NO: 4142270 - DNA, 14 bp, Homo sapiens
gaccgtggacaggc

SEQ ID NO: 4142271 - DNA, 16 bp, Homo sapiens
gaccgtggacaggccc

SEQ ID NO: 4142272 - DNA, 21 bp, Homo sapiens
gacctaaagtgcttgcttttt

SEQ ID NO: 4142273 - DNA, 17 bp, Homo sapiens
gacctaaattagataaa

SEQ ID NO: 4142274 - DNA, 17 bp, Homo sapiens
gacctaacattcgatct

SEQ ID NO: 4142275 - DNA, 16 bp, Homo sapiens
gacctacattccctct

SEQ ID NO: 4142276 - DNA, 14 bp, Homo sapiens
gacctagcaggctg

SEQ ID NO: 4142277 - DNA, 17 bp, Homo sapiens
gacctagggaggacctt

SEQ ID NO: 4142278 - DNA, 23 bp, Homo sapiens
gacctatgtcctaaggacacact

SEQ ID NO: 4142279 - DNA, 13 bp, Homo sapiens
gacctcaagccat

SEQ ID NO: 4142280 - DNA, 14 bp, Homo sapiens
gacctcaagccatc

SEQ ID NO: 4142281 - DNA, 16 bp, Homo sapiens
gacctcactgtgacct

SEQ ID NO: 4142282 - DNA, 20 bp, Homo sapiens
gacctcagttttatcatttt

SEQ ID NO: 4142283 - DNA, 21 bp, Homo sapiens
gacctcagttttatcattttc

SEQ ID NO: 4142284 - DNA, 19 bp, Homo sapiens
gacctcagttttatgcccc

SEQ ID NO: 4142285 - DNA, 21 bp, Homo sapiens
gacctcggtgaccactcttct

SEQ ID NO: 4142286 - DNA, 14 bp, Homo sapiens
gacctctcagggcc

SEQ ID NO: 4142287 - DNA, 16 bp, Homo sapiens
gacctctcagggcctg

SEQ ID NO: 4142288 - DNA, 20 bp, Homo sapiens
gacctctcagggcctggcag

SEQ ID NO: 4142289 - DNA, 22 bp, Homo sapiens
gacctctgtaggcagcagagag

SEQ ID NO: 4142290 - DNA, 19 bp, Homo sapiens
gacctgaccccattcctga

SEQ ID NO: 4142291 - DNA, 22 bp, Homo sapiens
gacctgagctggccaggccctg

SEQ ID NO: 4142292 - DNA, 19 bp, Homo sapiens
gacctgaggacatggcttc

SEQ ID NO: 4142293 - DNA, 22 bp, Homo sapiens
gacctgaggacatggcttctga

SEQ ID NO: 4142294 - DNA, 14 bp, Homo sapiens
gacctgatcctgga

SEQ ID NO: 4142295 - DNA, 18 bp, Homo sapiens
gacctgatcctggaggcc

SEQ ID NO: 4142296 - DNA, 16 bp, Homo sapiens
gacctgccaggcaggg

SEQ ID NO: 4142297 - DNA, 20 bp, Homo sapiens
gacctgcctcctgcctgccc

SEQ ID NO: 4142298 - DNA, 23 bp, Homo sapiens
gacctgcctcctgcctgcccctc

SEQ ID NO: 4142299 - DNA, 17 bp, Homo sapiens
gacctggataacttagg

SEQ ID NO: 4142300 - DNA, 10 bp, Homo sapiens
gacctggcag

SEQ ID NO: 4142301 - DNA, 15 bp, Homo sapiens
gacctggcagctctg

SEQ ID NO: 4142302 - DNA, 16 bp, Homo sapiens
gacctggctgcccctc

SEQ ID NO: 4142303 - DNA, 20 bp, Homo sapiens
gacctggctgcccctcacct

SEQ ID NO: 4142304 - DNA, 18 bp, Homo sapiens
gacctgggaacgactgga

SEQ ID NO: 4142305 - DNA, 13 bp, Homo sapiens
gacctgtcttcca

SEQ ID NO: 4142306 - DNA, 17 bp, Homo sapiens
gacctgtttatgagatg

SEQ ID NO: 4142307 - DNA, 13 bp, Homo sapiens
gaccttaggcctt

SEQ ID NO: 4142308 - DNA, 16 bp, Homo sapiens
gaccttccctccgcct

SEQ ID NO: 4142309 - DNA, 19 bp, Homo sapiens
gaccttgaagggtaaagaa

SEQ ID NO: 4142310 - DNA, 23 bp, Homo sapiens
gaccttgaccattaataaagaca

SEQ ID NO: 4142311 - DNA, 23 bp, Homo sapiens
gaccttgcaacttcatgtcaact

SEQ ID NO: 4142312 - DNA, 13 bp, Homo sapiens
gaccttttaaagt

SEQ ID NO: 4142313 - DNA, 14 bp, Homo sapiens
gaccttttaaagtg

SEQ ID NO: 4142314 - DNA, 22 bp, Homo sapiens
gaccttttaaagtgtttcagct

SEQ ID NO: 4142315 - DNA, 17 bp, Homo sapiens
gaccttttcttcatttt

SEQ ID NO: 4142316 - DNA, 17 bp, Homo sapiens
gacgattccttctctga

SEQ ID NO: 4142317 - DNA, 16 bp, Homo sapiens
gacgcacacagctgag

SEQ ID NO: 4142318 - DNA, 17 bp, Homo sapiens
gacgccactccctggga

SEQ ID NO: 4142319 - DNA, 17 bp, Homo sapiens
gacgcccagccccatcc

SEQ ID NO: 4142320 - DNA, 17 bp, Homo sapiens
gacgcctgagctcactc

SEQ ID NO: 4142321 - DNA, 21 bp, Homo sapiens
gacggaggggagtagagaagt

SEQ ID NO: 4142322 - DNA, 22 bp, Homo sapiens
gacggcctgatgctccctcccc

SEQ ID NO: 4142323 - DNA, 23 bp, Homo sapiens
gacggcctgatgctccctcccct

SEQ ID NO: 4142324 - DNA, 17 bp, Homo sapiens
gacggcgcccccagtgt

SEQ ID NO: 4142325 - DNA, 18 bp, Homo sapiens
gacggcggccaggcacag

SEQ ID NO: 4142326 - DNA, 19 bp, Homo sapiens
gacggcggccaggcacagg

SEQ ID NO: 4142327 - DNA, 21 bp, Homo sapiens
gacggcggccaggcacagggc

SEQ ID NO: 4142328 - DNA, 17 bp, Homo sapiens
gacggcgtttcaccatg

SEQ ID NO: 4142329 - DNA, 23 bp, Homo sapiens
gacggctcctcagagcgccagga

SEQ ID NO: 4142330 - DNA, 22 bp, Homo sapiens
gacggctgtggaccgtggacag

SEQ ID NO: 4142331 - DNA, 13 bp, Homo sapiens
gacggggctcagc

SEQ ID NO: 4142332 - DNA, 19 bp, Homo sapiens
gacgggttggggccgggca

SEQ ID NO: 4142333 - DNA, 19 bp, Homo sapiens
gacgtcatcggaggctggg

SEQ ID NO: 4142334 - DNA, 22 bp, Homo sapiens
gacgtcatcggaggctgggccc

SEQ ID NO: 4142335 - DNA, 23 bp, Homo sapiens
gacgtcatcggaggctgggcccc

SEQ ID NO: 4142336 - DNA, 18 bp, Homo sapiens
gacgtggaacctctgtct

SEQ ID NO: 4142337 - DNA, 14 bp, Homo sapiens
gacgtggctcagcc

SEQ ID NO: 4142338 - DNA, 15 bp, Homo sapiens
gacgtggctcagcca

SEQ ID NO: 4142339 - DNA, 13 bp, Homo sapiens
gacgttgcctgag

SEQ ID NO: 4142340 - DNA, 18 bp, Homo sapiens
gactaaaatgtttcattt

SEQ ID NO: 4142341 - DNA, 13 bp, Homo sapiens
gactaaagagaga

SEQ ID NO: 4142342 - DNA, 19 bp, Homo sapiens
gactaaaggatccagagag

SEQ ID NO: 4142343 - DNA, 14 bp, Homo sapiens
gactaagccctgtc

SEQ ID NO: 4142344 - DNA, 15 bp, Homo sapiens
gactaagcctacctg

SEQ ID NO: 4142345 - DNA, 18 bp, Homo sapiens
gactaagcctacctgctc

SEQ ID NO: 4142346 - DNA, 15 bp, Homo sapiens
gactaattaggcaag

SEQ ID NO: 4142347 - DNA, 22 bp, Homo sapiens
gactaatttcaaaatgcttttt

SEQ ID NO: 4142348 - DNA, 23 bp, Homo sapiens
gactagaagggccagtcctgcct

SEQ ID NO: 4142349 - DNA, 16 bp, Homo sapiens
gactagacacacaaag

SEQ ID NO: 4142350 - DNA, 16 bp, Homo sapiens
gactagatgatggatg

SEQ ID NO: 4142351 - DNA, 24 bp, Homo sapiens
gactaggacctgagcctggtcctg

SEQ ID NO: 4142352 - DNA, 17 bp, Homo sapiens
gactagggattcaggct

SEQ ID NO: 4142353 - DNA, 19 bp, Homo sapiens
gactagggattcaggctgc

SEQ ID NO: 4142354 - DNA, 21 bp, Homo sapiens
gactagggattcaggctgctt

SEQ ID NO: 4142355 - DNA, 13 bp, Homo sapiens
gactagtacaaat

SEQ ID NO: 4142356 - DNA, 19 bp, Homo sapiens
gactatatttgggcctgct

SEQ ID NO: 4142357 - DNA, 22 bp, Homo sapiens
gactatatttgggcctgctcca

SEQ ID NO: 4142358 - DNA, 22 bp, Homo sapiens
gactatctaaatgttgaaagat

SEQ ID NO: 4142359 - DNA, 18 bp, Homo sapiens
gactattccttttctgta

SEQ ID NO: 4142360 - DNA, 20 bp, Homo sapiens
gactattgtgccaactgcca

SEQ ID NO: 4142361 - DNA, 22 bp, Homo sapiens
gactcaacatgttactgaccag

SEQ ID NO: 4142362 - DNA, 17 bp, Homo sapiens
gactcaagtccttacct

SEQ ID NO: 4142363 - DNA, 14 bp, Homo sapiens
gactcacaggaagg

SEQ ID NO: 4142364 - DNA, 18 bp, Homo sapiens
gactcagacattggcacc

SEQ ID NO: 4142365 - DNA, 16 bp, Homo sapiens
gactcagccctgaggt

SEQ ID NO: 4142366 - DNA, 18 bp, Homo sapiens
gactcagggcagcgccag

SEQ ID NO: 4142367 - DNA, 21 bp, Homo sapiens
gactcagggccatgcctgccc

SEQ ID NO: 4142368 - DNA, 20 bp, Homo sapiens
gactcaggtgggccctctga

SEQ ID NO: 4142369 - DNA, 12 bp, Homo sapiens
gactcagtgttc

SEQ ID NO: 4142370 - DNA, 19 bp, Homo sapiens
gactcagttccaggcctga

SEQ ID NO: 4142371 - DNA, 17 bp, Homo sapiens
gactcatccccacagct

SEQ ID NO: 4142372 - DNA, 14 bp, Homo sapiens
gactcatggcagct

SEQ ID NO: 4142373 - DNA, 12 bp, Homo sapiens
gactccaggccc

SEQ ID NO: 4142374 - DNA, 18 bp, Homo sapiens
gactccaggcccaaggct

SEQ ID NO: 4142375 - DNA, 15 bp, Homo sapiens
gactcccaaccctgg

SEQ ID NO: 4142376 - DNA, 17 bp, Homo sapiens
gactcccaagtttccat

SEQ ID NO: 4142377 - DNA, 21 bp, Homo sapiens
gactcccaagtttccatagca

SEQ ID NO: 4142378 - DNA, 23 bp, Homo sapiens
gactcccattcctgaagaaccag

SEQ ID NO: 4142379 - DNA, 22 bp, Homo sapiens
gactcccccagtccccttcccg

SEQ ID NO: 4142380 - DNA, 15 bp, Homo sapiens
gactcccggagcctg

SEQ ID NO: 4142381 - DNA, 22 bp, Homo sapiens
gactcccgggccacgccccagc

SEQ ID NO: 4142382 - DNA, 23 bp, Homo sapiens
gactcccgggccacgccccagcc

SEQ ID NO: 4142383 - DNA, 12 bp, Homo sapiens
gactccctcctc

SEQ ID NO: 4142384 - DNA, 14 bp, Homo sapiens
gactccctcctcac

SEQ ID NO: 4142385 - DNA, 16 bp, Homo sapiens
gactccctcctcacct

SEQ ID NO: 4142386 - DNA, 20 bp, Homo sapiens
gactccctcctcacctctgg

SEQ ID NO: 4142387 - DNA, 24 bp, Homo sapiens
gactccctcctcacctctggactg

SEQ ID NO: 4142388 - DNA, 16 bp, Homo sapiens
gactcctacctgccct

SEQ ID NO: 4142389 - DNA, 17 bp, Homo sapiens
gactcctacctgccctg

SEQ ID NO: 4142390 - DNA, 13 bp, Homo sapiens
gactcctgccctg

SEQ ID NO: 4142391 - DNA, 14 bp, Homo sapiens
gactcctgccctgt

SEQ ID NO: 4142392 - DNA, 21 bp, Homo sapiens
gactcctgcctgagtttccag

SEQ ID NO: 4142393 - DNA, 22 bp, Homo sapiens
gactctaaatgcagttttaaga

SEQ ID NO: 4142394 - DNA, 18 bp, Homo sapiens
gactctaagctcagtgct

SEQ ID NO: 4142395 - DNA, 12 bp, Homo sapiens
gactctcaggga

SEQ ID NO: 4142396 - DNA, 17 bp, Homo sapiens
gactctgaagcctctgg

SEQ ID NO: 4142397 - DNA, 21 bp, Homo sapiens
gactctgagatgtggagactg

SEQ ID NO: 4142398 - DNA, 17 bp, Homo sapiens
gactctgagcgggaggc

SEQ ID NO: 4142399 - DNA, 21 bp, Homo sapiens
gactctgagcgggaggcagag

SEQ ID NO: 4142400 - DNA, 10 bp, Homo sapiens
gactctgccc

SEQ ID NO: 4142401 - DNA, 15 bp, Homo sapiens
gactctgccccctgc

SEQ ID NO: 4142402 - DNA, 17 bp, Homo sapiens
gactctgccccctgctg

SEQ ID NO: 4142403 - DNA, 19 bp, Homo sapiens
gactctggtttctcattct

SEQ ID NO: 4142404 - DNA, 22 bp, Homo sapiens
gactctgtcaatttccctgact

SEQ ID NO: 4142405 - DNA, 10 bp, Homo sapiens
gactcttccc

SEQ ID NO: 4142406 - DNA, 19 bp, Homo sapiens
gactcttctcggctcaggc

SEQ ID NO: 4142407 - DNA, 20 bp, Homo sapiens
gactcttctcggctcaggct

SEQ ID NO: 4142408 - DNA, 21 bp, Homo sapiens
gactcttctcggctcaggctc

SEQ ID NO: 4142409 - DNA, 15 bp, Homo sapiens
gactctttagagcag

SEQ ID NO: 4142410 - DNA, 22 bp, Homo sapiens
gactctttttagggccaggcag

SEQ ID NO: 4142411 - DNA, 19 bp, Homo sapiens
gactgaatgttttatttat

SEQ ID NO: 4142412 - DNA, 21 bp, Homo sapiens
gactgaatgttttatttatca

SEQ ID NO: 4142413 - DNA, 13 bp, Homo sapiens
gactgagcagccg

SEQ ID NO: 4142414 - DNA, 16 bp, Homo sapiens
gactgagcagccgcca

SEQ ID NO: 4142415 - DNA, 19 bp, Homo sapiens
gactgagcagccgccagct

SEQ ID NO: 4142416 - DNA, 20 bp, Homo sapiens
gactgagcagccgccagctg

SEQ ID NO: 4142417 - DNA, 21 bp, Homo sapiens
gactgagcagccgccagctgg

SEQ ID NO: 4142418 - DNA, 12 bp, Homo sapiens
gactgaggacaa

SEQ ID NO: 4142419 - DNA, 21 bp, Homo sapiens
gactgagggactctgaagcct

SEQ ID NO: 4142420 - DNA, 14 bp, Homo sapiens
gactgatggccagg

SEQ ID NO: 4142421 - DNA, 16 bp, Homo sapiens
gactgcaaactttttt

SEQ ID NO: 4142422 - DNA, 22 bp, Homo sapiens
gactgcaaacttttttatatct

SEQ ID NO: 4142423 - DNA, 21 bp, Homo sapiens
gactgcacccagctccagggg

SEQ ID NO: 4142424 - DNA, 20 bp, Homo sapiens
gactgcgatcttcagagcag

SEQ ID NO: 4142425 - DNA, 15 bp, Homo sapiens
gactgctagggagtg

SEQ ID NO: 4142426 - DNA, 19 bp, Homo sapiens
gactgctccccagccctgg

SEQ ID NO: 4142427 - DNA, 15 bp, Homo sapiens
gactggaggaggcct

SEQ ID NO: 4142428 - DNA, 15 bp, Homo sapiens
gactggaggcccctg

SEQ ID NO: 4142429 - DNA, 20 bp, Homo sapiens
gactggaggcccctggagcc

SEQ ID NO: 4142430 - DNA, 12 bp, Homo sapiens
gactggccaggg

SEQ ID NO: 4142431 - DNA, 15 bp, Homo sapiens
gactggccagggcca

SEQ ID NO: 4142432 - DNA, 22 bp, Homo sapiens
gactggcccctgggtcagtctg

SEQ ID NO: 4142433 - DNA, 21 bp, Homo sapiens
gactggctagagtcctcactc

SEQ ID NO: 4142434 - DNA, 23 bp, Homo sapiens
gactggctagagtcctcactccc

SEQ ID NO: 4142435 - DNA, 19 bp, Homo sapiens
gactgggagccacttctcc

SEQ ID NO: 4142436 - DNA, 21 bp, Homo sapiens
gactgggagccacttctcccc

SEQ ID NO: 4142437 - DNA, 22 bp, Homo sapiens
gactgggagccacttctcccca

SEQ ID NO: 4142438 - DNA, 21 bp, Homo sapiens
gactgggaggagggggagggt

SEQ ID NO: 4142439 - DNA, 19 bp, Homo sapiens
gactgggagtcagagccct

SEQ ID NO: 4142440 - DNA, 17 bp, Homo sapiens
gactgggcctcccttgg

SEQ ID NO: 4142441 - DNA, 20 bp, Homo sapiens
gactgggcctcccttgggct

SEQ ID NO: 4142442 - DNA, 21 bp, Homo sapiens
gactgggcctcccttgggctg

SEQ ID NO: 4142443 - DNA, 12 bp, Homo sapiens
gactgggctggg

SEQ ID NO: 4142444 - DNA, 16 bp, Homo sapiens
gactgggctgggtttg

SEQ ID NO: 4142445 - DNA, 19 bp, Homo sapiens
gactgggctgggtttgctg

SEQ ID NO: 4142446 - DNA, 16 bp, Homo sapiens
gactggggatgtggga

SEQ ID NO: 4142447 - DNA, 17 bp, Homo sapiens
gactggggatgtgggag

SEQ ID NO: 4142448 - DNA, 23 bp, Homo sapiens
gactggggatgtgggagggagca

SEQ ID NO: 4142449 - DNA, 16 bp, Homo sapiens
gactggtgccctcctc

SEQ ID NO: 4142450 - DNA, 20 bp, Homo sapiens
gactggtgctataggctgga

SEQ ID NO: 4142451 - DNA, 23 bp, Homo sapiens
gactggtgctataggctggagaa

SEQ ID NO: 4142452 - DNA, 19 bp, Homo sapiens
gactggtttacaggccctg

SEQ ID NO: 4142453 - DNA, 16 bp, Homo sapiens
gactgtagccacagct

SEQ ID NO: 4142454 - DNA, 23 bp, Homo sapiens
gactgtcacggggttccctccta

SEQ ID NO: 4142455 - DNA, 11 bp, Homo sapiens
gactgtcccac

SEQ ID NO: 4142456 - DNA, 23 bp, Homo sapiens
gactgtcccaccgggagcctccc

SEQ ID NO: 4142457 - DNA, 22 bp, Homo sapiens
gactgtcctctcccctccagcc

SEQ ID NO: 4142458 - DNA, 22 bp, Homo sapiens
gactgtcggagaggctgtctgg

SEQ ID NO: 4142459 - DNA, 21 bp, Homo sapiens
gactgtgaacttgactgggtg

SEQ ID NO: 4142460 - DNA, 17 bp, Homo sapiens
gactgtgaccaccttct

SEQ ID NO: 4142461 - DNA, 19 bp, Homo sapiens
gactgtgatgccacacaga

SEQ ID NO: 4142462 - DNA, 14 bp, Homo sapiens
gactgtgccagagg

SEQ ID NO: 4142463 - DNA, 16 bp, Homo sapiens
gactgtgccagaggcc

SEQ ID NO: 4142464 - DNA, 22 bp, Homo sapiens
gactgttagaaaatggacactg

SEQ ID NO: 4142465 - DNA, 23 bp, Homo sapiens
gactgttccaaagccagtgaaat

SEQ ID NO: 4142466 - DNA, 14 bp, Homo sapiens
gactgttgccacca

SEQ ID NO: 4142467 - DNA, 13 bp, Homo sapiens
gactgtttggctt

SEQ ID NO: 4142468 - DNA, 22 bp, Homo sapiens
gactgtttggcttataaacaca

SEQ ID NO: 4142469 - DNA, 21 bp, Homo sapiens
gactgttttctctcggctccc

SEQ ID NO: 4142470 - DNA, 14 bp, Homo sapiens
gacttaacggctcc

SEQ ID NO: 4142471 - DNA, 14 bp, Homo sapiens
gacttaatgtgatt

SEQ ID NO: 4142472 - DNA, 21 bp, Homo sapiens
gacttactttaattactggaa

SEQ ID NO: 4142473 - DNA, 17 bp, Homo sapiens
gacttagtatattttct

SEQ ID NO: 4142474 - DNA, 19 bp, Homo sapiens
gacttagtggacaggggag

SEQ ID NO: 4142475 - DNA, 13 bp, Homo sapiens
gacttatttctgc

SEQ ID NO: 4142476 - DNA, 20 bp, Homo sapiens
gacttatttctgctctggaa

SEQ ID NO: 4142477 - DNA, 15 bp, Homo sapiens
gacttattttctctg

SEQ ID NO: 4142478 - DNA, 15 bp, Homo sapiens
gacttcagctgcctg

SEQ ID NO: 4142479 - DNA, 22 bp, Homo sapiens
gacttcagggagtcagctgttt

SEQ ID NO: 4142480 - DNA, 18 bp, Homo sapiens
gacttcagggcagggctc

SEQ ID NO: 4142481 - DNA, 12 bp, Homo sapiens
gacttcccagct

SEQ ID NO: 4142482 - DNA, 18 bp, Homo sapiens
gacttcctgtccagctcc

SEQ ID NO: 4142483 - DNA, 19 bp, Homo sapiens
gacttcctgtccagctcca

SEQ ID NO: 4142484 - DNA, 20 bp, Homo sapiens
gacttcctgtccagctccaa

SEQ ID NO: 4142485 - DNA, 21 bp, Homo sapiens
gacttcctgtccagctccaac

SEQ ID NO: 4142486 - DNA, 15 bp, Homo sapiens
gacttccttgagaca

SEQ ID NO: 4142487 - DNA, 16 bp, Homo sapiens
gacttcgactcaggat

SEQ ID NO: 4142488 - DNA, 16 bp, Homo sapiens
gacttcttcctctaga

SEQ ID NO: 4142489 - DNA, 16 bp, Homo sapiens
gacttgaaagcatcca

SEQ ID NO: 4142490 - DNA, 18 bp, Homo sapiens
gacttgcatgaagagaag

SEQ ID NO: 4142491 - DNA, 14 bp, Homo sapiens
gacttggcaggtgc

SEQ ID NO: 4142492 - DNA, 22 bp, Homo sapiens
gacttgggggaacgatgtgtct

SEQ ID NO: 4142493 - DNA, 20 bp, Homo sapiens
gacttggttggtagggtggg

SEQ ID NO: 4142494 - DNA, 18 bp, Homo sapiens
gacttgtatatttgtaca

SEQ ID NO: 4142495 - DNA, 18 bp, Homo sapiens
gacttgtgtcccatgatc

SEQ ID NO: 4142496 - DNA, 18 bp, Homo sapiens
gacttgttttatgctcag

SEQ ID NO: 4142497 - DNA, 16 bp, Homo sapiens
gactttatttatttct

SEQ ID NO: 4142498 - DNA, 19 bp, Homo sapiens
gactttatttatttctagt

SEQ ID NO: 4142499 - DNA, 17 bp, Homo sapiens
gactttcagtaaacata

SEQ ID NO: 4142500 - DNA, 12 bp, Homo sapiens
gactttcctgca

SEQ ID NO: 4142501 - DNA, 14 bp, Homo sapiens
gactttctctgtgt

SEQ ID NO: 4142502 - DNA, 17 bp, Homo sapiens
gactttctgttttctgt

SEQ ID NO: 4142503 - DNA, 14 bp, Homo sapiens
gactttgcttgctt

SEQ ID NO: 4142504 - DNA, 15 bp, Homo sapiens
gactttgcttgcttt

SEQ ID NO: 4142505 - DNA, 15 bp, Homo sapiens
gactttgtctctcct

SEQ ID NO: 4142506 - DNA, 16 bp, Homo sapiens
gactttgtctctcctg

SEQ ID NO: 4142507 - DNA, 21 bp, Homo sapiens
gactttgtctctcctggctgg

SEQ ID NO: 4142508 - DNA, 17 bp, Homo sapiens
gactttgtttttaaaat

SEQ ID NO: 4142509 - DNA, 20 bp, Homo sapiens
gactttttgtttctttgtgt

SEQ ID NO: 4142510 - DNA, 16 bp, Homo sapiens
gagaaaaaaaaaatag

SEQ ID NO: 4142511 - DNA, 14 bp, Homo sapiens
gagaaaaaagaagt

SEQ ID NO: 4142512 - DNA, 18 bp, Homo sapiens
gagaaaaatgctccccac

SEQ ID NO: 4142513 - DNA, 15 bp, Homo sapiens
gagaaaatgcctcaa

SEQ ID NO: 4142514 - DNA, 23 bp, Homo sapiens
gagaaaatgcctcaattcacata

SEQ ID NO: 4142515 - DNA, 21 bp, Homo sapiens
gagaaaccttattgtacctct

SEQ ID NO: 4142516 - DNA, 19 bp, Homo sapiens
gagaaagaatttgagacgc

SEQ ID NO: 4142517 - DNA, 18 bp, Homo sapiens
gagaaagtgtgagcaaac

SEQ ID NO: 4142518 - DNA, 23 bp, Homo sapiens
gagaaataaagtttgcttagaaa

SEQ ID NO: 4142519 - DNA, 20 bp, Homo sapiens
gagaaatatggacacttaat

SEQ ID NO: 4142520 - DNA, 22 bp, Homo sapiens
gagaaccgagcaaagatcaaaa

SEQ ID NO: 4142521 - DNA, 23 bp, Homo sapiens
gagaaccgagcaaagatcaaaat

SEQ ID NO: 4142522 - DNA, 17 bp, Homo sapiens
gagaacctcagattctt

SEQ ID NO: 4142523 - DNA, 14 bp, Homo sapiens
gagaacgcagccct

SEQ ID NO: 4142524 - DNA, 14 bp, Homo sapiens
gagaactacttgaa

SEQ ID NO: 4142525 - DNA, 17 bp, Homo sapiens
gagaactgcttctaaga

SEQ ID NO: 4142526 - DNA, 14 bp, Homo sapiens
gagaagagccctgg

SEQ ID NO: 4142527 - DNA, 18 bp, Homo sapiens
gagaagagggcccagccc

SEQ ID NO: 4142528 - DNA, 19 bp, Homo sapiens
gagaagagggcccagccca

SEQ ID NO: 4142529 - DNA, 19 bp, Homo sapiens
gagaagagggcctgtggga

SEQ ID NO: 4142530 - DNA, 20 bp, Homo sapiens
gagaagatggatatgaccag

SEQ ID NO: 4142531 - DNA, 19 bp, Homo sapiens
gagaagctcctctccccag

SEQ ID NO: 4142532 - DNA, 13 bp, Homo sapiens
gagaagctcttca

SEQ ID NO: 4142533 - DNA, 19 bp, Homo sapiens
gagaagctgctccaggcct

SEQ ID NO: 4142534 - DNA, 13 bp, Homo sapiens
gagaagctgctga

SEQ ID NO: 4142535 - DNA, 17 bp, Homo sapiens
gagaagctgctgaccaa

SEQ ID NO: 4142536 - DNA, 17 bp, Homo sapiens
gagaaggatctagaatg

SEQ ID NO: 4142537 - DNA, 17 bp, Homo sapiens
gagaaggggacttctct

SEQ ID NO: 4142538 - DNA, 23 bp, Homo sapiens
gagaagggtggatgacagggcag

SEQ ID NO: 4142539 - DNA, 14 bp, Homo sapiens
gagaagtacttggt

SEQ ID NO: 4142540 - DNA, 21 bp, Homo sapiens
gagaagtgctcttggctgacc

SEQ ID NO: 4142541 - DNA, 19 bp, Homo sapiens
gagaataactcagaatatt

SEQ ID NO: 4142542 - DNA, 22 bp, Homo sapiens
gagaataagagaaagaaaatga

SEQ ID NO: 4142543 - DNA, 15 bp, Homo sapiens
gagaatagtggagga

SEQ ID NO: 4142544 - DNA, 18 bp, Homo sapiens
gagaatcctctcctttct

SEQ ID NO: 4142545 - DNA, 21 bp, Homo sapiens
gagaatcctctcctttcttat

SEQ ID NO: 4142546 - DNA, 23 bp, Homo sapiens
gagaatggtgtgaacccgggagc

SEQ ID NO: 4142547 - DNA, 21 bp, Homo sapiens
gagaatgtagatattgtgaag

SEQ ID NO: 4142548 - DNA, 21 bp, Homo sapiens
gagaattgtatcatttgaaca

SEQ ID NO: 4142549 - DNA, 21 bp, Homo sapiens
gagacagaagcctggactctg

SEQ ID NO: 4142550 - DNA, 21 bp, Homo sapiens
gagacagctgatacttcattt

SEQ ID NO: 4142551 - DNA, 12 bp, Homo sapiens
gagacaggcagc

SEQ ID NO: 4142552 - DNA, 18 bp, Homo sapiens
gagacagggtaggaaagg

SEQ ID NO: 4142553 - DNA, 18 bp, Homo sapiens
gagacagggtcttgctct

SEQ ID NO: 4142554 - DNA, 19 bp, Homo sapiens
gagacagtccagtgtcacc

SEQ ID NO: 4142555 - DNA, 13 bp, Homo sapiens
gagacatgtgaca

SEQ ID NO: 4142556 - DNA, 14 bp, Homo sapiens
gagacatgtgacat

SEQ ID NO: 4142557 - DNA, 23 bp, Homo sapiens
gagaccaagactctgaaatctca

SEQ ID NO: 4142558 - DNA, 15 bp, Homo sapiens
gagaccagctcagag

SEQ ID NO: 4142559 - DNA, 16 bp, Homo sapiens
gagaccagctcagagg

SEQ ID NO: 4142560 - DNA, 21 bp, Homo sapiens
gagaccagctcagaggcccag

SEQ ID NO: 4142561 - DNA, 21 bp, Homo sapiens
gagaccagttgggagcactgg

SEQ ID NO: 4142562 - DNA, 12 bp, Homo sapiens
gagaccatcctg

SEQ ID NO: 4142563 - DNA, 17 bp, Homo sapiens
gagacccaacagcagtg

SEQ ID NO: 4142564 - DNA, 18 bp, Homo sapiens
gagacccaggcctgtggc

SEQ ID NO: 4142565 - DNA, 14 bp, Homo sapiens
gagacccccacacc

SEQ ID NO: 4142566 - DNA, 22 bp, Homo sapiens
gagaccctgcaaacagaacagg

SEQ ID NO: 4142567 - DNA, 13 bp, Homo sapiens
gagacccttttct

SEQ ID NO: 4142568 - DNA, 16 bp, Homo sapiens
gagacccttttctcag

SEQ ID NO: 4142569 - DNA, 18 bp, Homo sapiens
gagacccttttctcagga

SEQ ID NO: 4142570 - DNA, 16 bp, Homo sapiens
gagacctatgtaagaa

SEQ ID NO: 4142571 - DNA, 19 bp, Homo sapiens
gagacctgacaagcactgc

SEQ ID NO: 4142572 - DNA, 21 bp, Homo sapiens
gagacgcacacagctgagcac

SEQ ID NO: 4142573 - DNA, 20 bp, Homo sapiens
gagacgccactccctgggac

SEQ ID NO: 4142574 - DNA, 13 bp, Homo sapiens
gagacgggcatcg

SEQ ID NO: 4142575 - DNA, 19 bp, Homo sapiens
gagacgggcatcgcaggag

SEQ ID NO: 4142576 - DNA, 14 bp, Homo sapiens
gagactaagccctg

SEQ ID NO: 4142577 - DNA, 16 bp, Homo sapiens
gagactaagccctgtc

SEQ ID NO: 4142578 - DNA, 13 bp, Homo sapiens
gagactatttaaa

SEQ ID NO: 4142579 - DNA, 15 bp, Homo sapiens
gagactcacaggaag

SEQ ID NO: 4142580 - DNA, 19 bp, Homo sapiens
gagactctagggtccagtg

SEQ ID NO: 4142581 - DNA, 20 bp, Homo sapiens
gagactctagggtccagtgg

SEQ ID NO: 4142582 - DNA, 17 bp, Homo sapiens
gagactgcaagctgctt

SEQ ID NO: 4142583 - DNA, 18 bp, Homo sapiens
gagactgcaagctgcttg

SEQ ID NO: 4142584 - DNA, 17 bp, Homo sapiens
gagactgggaaggcttg

SEQ ID NO: 4142585 - DNA, 13 bp, Homo sapiens
gagactgtccctg

SEQ ID NO: 4142586 - DNA, 15 bp, Homo sapiens
gagacttactgggtg

SEQ ID NO: 4142587 - DNA, 13 bp, Homo sapiens
gagagaaattctg

SEQ ID NO: 4142588 - DNA, 20 bp, Homo sapiens
gagagaagccacgctgtcct

SEQ ID NO: 4142589 - DNA, 16 bp, Homo sapiens
gagagaattggctcaa

SEQ ID NO: 4142590 - DNA, 15 bp, Homo sapiens
gagagactgagcagc

SEQ ID NO: 4142591 - DNA, 17 bp, Homo sapiens
gagagactgagcagccg

SEQ ID NO: 4142592 - DNA, 13 bp, Homo sapiens
gagagagaaaaaa

SEQ ID NO: 4142593 - DNA, 9 bp, Homo sapiens
gagagagag

SEQ ID NO: 4142594 - DNA, 14 bp, Homo sapiens
gagagagagaaatt

SEQ ID NO: 4142595 - DNA, 11 bp, Homo sapiens
gagagagagag

SEQ ID NO: 4142596 - DNA, 13 bp, Homo sapiens
gagagagagagaa

SEQ ID NO: 4142597 - DNA, 14 bp, Homo sapiens
gagagagagagaga

SEQ ID NO: 4142598 - DNA, 15 bp, Homo sapiens
gagagaggctctggg

SEQ ID NO: 4142599 - DNA, 17 bp, Homo sapiens
gagagatatatctgaaa

SEQ ID NO: 4142600 - DNA, 17 bp, Homo sapiens
gagagcaactctgagat

SEQ ID NO: 4142601 - DNA, 16 bp, Homo sapiens
gagagcagaggtctcc

SEQ ID NO: 4142602 - DNA, 14 bp, Homo sapiens
gagagcagcactcc

SEQ ID NO: 4142603 - DNA, 17 bp, Homo sapiens
gagagcagcagcaccaa

SEQ ID NO: 4142604 - DNA, 21 bp, Homo sapiens
gagagccaacctcggcttgtg

SEQ ID NO: 4142605 - DNA, 17 bp, Homo sapiens
gagagccattttgtgaa

SEQ ID NO: 4142606 - DNA, 14 bp, Homo sapiens
gagagcccagaggt

SEQ ID NO: 4142607 - DNA, 21 bp, Homo sapiens
gagagccgtggtccctgagga

SEQ ID NO: 4142608 - DNA, 14 bp, Homo sapiens
gagagcctgctgca

SEQ ID NO: 4142609 - DNA, 15 bp, Homo sapiens
gagagcctgctggca

SEQ ID NO: 4142610 - DNA, 13 bp, Homo sapiens
gagagcctggtgc

SEQ ID NO: 4142611 - DNA, 23 bp, Homo sapiens
gagagctatggacagcattgcca

SEQ ID NO: 4142612 - DNA, 23 bp, Homo sapiens
gagagctttctgtccttttggca

SEQ ID NO: 4142613 - DNA, 15 bp, Homo sapiens
gagagctttgtgctt

SEQ ID NO: 4142614 - DNA, 18 bp, Homo sapiens
gagaggacagcttgagcc

SEQ ID NO: 4142615 - DNA, 19 bp, Homo sapiens
gagaggagccagacagacc

SEQ ID NO: 4142616 - DNA, 21 bp, Homo sapiens
gagaggaggcagccccctcca

SEQ ID NO: 4142617 - DNA, 13 bp, Homo sapiens
gagaggagggttc

SEQ ID NO: 4142618 - DNA, 12 bp, Homo sapiens
gagaggatgaat

SEQ ID NO: 4142619 - DNA, 14 bp, Homo sapiens
gagaggatgaatgt

SEQ ID NO: 4142620 - DNA, 21 bp, Homo sapiens
gagaggatgtggaaagcactt

SEQ ID NO: 4142621 - DNA, 15 bp, Homo sapiens
gagaggcaatggcca

SEQ ID NO: 4142622 - DNA, 11 bp, Homo sapiens
gagaggcaggc

SEQ ID NO: 4142623 - DNA, 13 bp, Homo sapiens
gagaggcggcctc

SEQ ID NO: 4142624 - DNA, 14 bp, Homo sapiens
gagaggctctccgt

SEQ ID NO: 4142625 - DNA, 21 bp, Homo sapiens
gagagggcaatctttgccttt

SEQ ID NO: 4142626 - DNA, 20 bp, Homo sapiens
gagagggctcgaggggtggg

SEQ ID NO: 4142627 - DNA, 21 bp, Homo sapiens
gagagggctcgaggggtgggc

SEQ ID NO: 4142628 - DNA, 19 bp, Homo sapiens
gagagggggcctgggactt

SEQ ID NO: 4142629 - DNA, 23 bp, Homo sapiens
gagagggggcctgggacttccat

SEQ ID NO: 4142630 - DNA, 21 bp, Homo sapiens
gagaggtggagaactgggatt

SEQ ID NO: 4142631 - DNA, 16 bp, Homo sapiens
gagaggttaaggtgca

SEQ ID NO: 4142632 - DNA, 19 bp, Homo sapiens
gagaggttataggtcactc

SEQ ID NO: 4142633 - DNA, 16 bp, Homo sapiens
gagagtacagtgagcc

SEQ ID NO: 4142634 - DNA, 15 bp, Homo sapiens
gagagtagaacagat

SEQ ID NO: 4142635 - DNA, 19 bp, Homo sapiens
gagataaaccaataaatcc

SEQ ID NO: 4142636 - DNA, 15 bp, Homo sapiens
gagatactggtggaa

SEQ ID NO: 4142637 - DNA, 22 bp, Homo sapiens
gagatatttacatgaattgcat

SEQ ID NO: 4142638 - DNA, 20 bp, Homo sapiens
gagatcacagcctccagggc

SEQ ID NO: 4142639 - DNA, 22 bp, Homo sapiens
gagatccaaaagaagcccccag

SEQ ID NO: 4142640 - DNA, 11 bp, Homo sapiens
gagatccccag

SEQ ID NO: 4142641 - DNA, 14 bp, Homo sapiens
gagatccccagggc

SEQ ID NO: 4142642 - DNA, 16 bp, Homo sapiens
gagatccccagggcag

SEQ ID NO: 4142643 - DNA, 23 bp, Homo sapiens
gagatctaaggatgtcacagggc

SEQ ID NO: 4142644 - DNA, 16 bp, Homo sapiens
gagatgaattaaattt

SEQ ID NO: 4142645 - DNA, 16 bp, Homo sapiens
gagatgaccagggatg

SEQ ID NO: 4142646 - DNA, 18 bp, Homo sapiens
gagatgaccagggatgct

SEQ ID NO: 4142647 - DNA, 14 bp, Homo sapiens
gagatgagaaatga

SEQ ID NO: 4142648 - DNA, 17 bp, Homo sapiens
gagatgagaggggagag

SEQ ID NO: 4142649 - DNA, 14 bp, Homo sapiens
gagatgaggagggg

SEQ ID NO: 4142650 - DNA, 12 bp, Homo sapiens
gagatgcagagg

SEQ ID NO: 4142651 - DNA, 16 bp, Homo sapiens
gagatgcagaggtaaa

SEQ ID NO: 4142652 - DNA, 15 bp, Homo sapiens
gagatggagggcttg

SEQ ID NO: 4142653 - DNA, 16 bp, Homo sapiens
gagatgggaaggcaca

SEQ ID NO: 4142654 - DNA, 21 bp, Homo sapiens
gagatgggaatgaggtgggag

SEQ ID NO: 4142655 - DNA, 23 bp, Homo sapiens
gagatgggagctcctctcctgga

SEQ ID NO: 4142656 - DNA, 18 bp, Homo sapiens
gagatgggcttgttttct

SEQ ID NO: 4142657 - DNA, 15 bp, Homo sapiens
gagatgtagcaaaac

SEQ ID NO: 4142658 - DNA, 16 bp, Homo sapiens
gagattcccgcgggtt

SEQ ID NO: 4142659 - DNA, 15 bp, Homo sapiens
gagattctgtgatct

SEQ ID NO: 4142660 - DNA, 17 bp, Homo sapiens
gagattggacggcctga

SEQ ID NO: 4142661 - DNA, 14 bp, Homo sapiens
gagatttatataaa

SEQ ID NO: 4142662 - DNA, 14 bp, Homo sapiens
gagatttttaagaa

SEQ ID NO: 4142663 - DNA, 16 bp, Homo sapiens
gagattttttattgct

SEQ ID NO: 4142664 - DNA, 22 bp, Homo sapiens
gagcaaaaggcagctcacccct

SEQ ID NO: 4142665 - DNA, 14 bp, Homo sapiens
gagcaaagatcaaa

SEQ ID NO: 4142666 - DNA, 13 bp, Homo sapiens
gagcaagagctgg

SEQ ID NO: 4142667 - DNA, 14 bp, Homo sapiens
gagcaagagctggc

SEQ ID NO: 4142668 - DNA, 21 bp, Homo sapiens
gagcaaggacattgccccaag

SEQ ID NO: 4142669 - DNA, 23 bp, Homo sapiens
gagcaaggacattgccccaagat

SEQ ID NO: 4142670 - DNA, 12 bp, Homo sapiens
gagcaatgggac

SEQ ID NO: 4142671 - DNA, 14 bp, Homo sapiens
gagcaatgggactg

SEQ ID NO: 4142672 - DNA, 22 bp, Homo sapiens
gagcaatgggactggagtcaga

SEQ ID NO: 4142673 - DNA, 14 bp, Homo sapiens
gagcacccagagca

SEQ ID NO: 4142674 - DNA, 17 bp, Homo sapiens
gagcacccagagcaccc

SEQ ID NO: 4142675 - DNA, 15 bp, Homo sapiens
gagcaccctctggat

SEQ ID NO: 4142676 - DNA, 21 bp, Homo sapiens
gagcaccgtgtcaagctgctc

SEQ ID NO: 4142677 - DNA, 22 bp, Homo sapiens
gagcaccgtgtcaagctgctct

SEQ ID NO: 4142678 - DNA, 17 bp, Homo sapiens
gagcacctccagcctga

SEQ ID NO: 4142679 - DNA, 16 bp, Homo sapiens
gagcaccttcctcact

SEQ ID NO: 4142680 - DNA, 15 bp, Homo sapiens
gagcacttactgtaa

SEQ ID NO: 4142681 - DNA, 15 bp, Homo sapiens
gagcagaaacagcca

SEQ ID NO: 4142682 - DNA, 22 bp, Homo sapiens
gagcagaaatttatctttcaaa

SEQ ID NO: 4142683 - DNA, 12 bp, Homo sapiens
gagcagagacac

SEQ ID NO: 4142684 - DNA, 13 bp, Homo sapiens
gagcagagacact

SEQ ID NO: 4142685 - DNA, 19 bp, Homo sapiens
gagcagagtctgggcctct

SEQ ID NO: 4142686 - DNA, 22 bp, Homo sapiens
gagcagatgaggtgaaaaggcc

SEQ ID NO: 4142687 - DNA, 16 bp, Homo sapiens
gagcagatgcagagag

SEQ ID NO: 4142688 - DNA, 19 bp, Homo sapiens
gagcagatgcagagagcca

SEQ ID NO: 4142689 - DNA, 21 bp, Homo sapiens
gagcagatgcagagagccatt

SEQ ID NO: 4142690 - DNA, 15 bp, Homo sapiens
gagcagatggacagc

SEQ ID NO: 4142691 - DNA, 21 bp, Homo sapiens
gagcagcaaggtcttgctctc

SEQ ID NO: 4142692 - DNA, 17 bp, Homo sapiens
gagcagcagcttgggga

SEQ ID NO: 4142693 - DNA, 15 bp, Homo sapiens
gagcagcctgtggca

SEQ ID NO: 4142694 - DNA, 12 bp, Homo sapiens
gagcagctcccc

SEQ ID NO: 4142695 - DNA, 20 bp, Homo sapiens
gagcagctccccaggagctc

SEQ ID NO: 4142696 - DNA, 16 bp, Homo sapiens
gagcagctccctttct

SEQ ID NO: 4142697 - DNA, 20 bp, Homo sapiens
gagcagctccctttctcagg

SEQ ID NO: 4142698 - DNA, 17 bp, Homo sapiens
gagcagctttaaactca

SEQ ID NO: 4142699 - DNA, 23 bp, Homo sapiens
gagcagctttaaactcagggaca

SEQ ID NO: 4142700 - DNA, 17 bp, Homo sapiens
gagcagctttgggatcc

SEQ ID NO: 4142701 - DNA, 15 bp, Homo sapiens
gagcaggactccagg

SEQ ID NO: 4142702 - DNA, 19 bp, Homo sapiens
gagcaggactctattttaa

SEQ ID NO: 4142703 - DNA, 11 bp, Homo sapiens
gagcaggagcc

SEQ ID NO: 4142704 - DNA, 21 bp, Homo sapiens
gagcagggattaacctctgca

SEQ ID NO: 4142705 - DNA, 20 bp, Homo sapiens
gagcaggggtccttggtgtg

SEQ ID NO: 4142706 - DNA, 19 bp, Homo sapiens
gagcagtcgcctgcctgca

SEQ ID NO: 4142707 - DNA, 11 bp, Homo sapiens
gagcagtgtct

SEQ ID NO: 4142708 - DNA, 14 bp, Homo sapiens
gagcagtttgccac

SEQ ID NO: 4142709 - DNA, 20 bp, Homo sapiens
gagcatctcttgaggccagg

SEQ ID NO: 4142710 - DNA, 23 bp, Homo sapiens
gagcatctcttgaggccaggagt

SEQ ID NO: 4142711 - DNA, 21 bp, Homo sapiens
gagcattacgtgagccaggta

SEQ ID NO: 4142712 - DNA, 21 bp, Homo sapiens
gagcattggggatgtttttct

SEQ ID NO: 4142713 - DNA, 17 bp, Homo sapiens
gagcatttaatggcagc

SEQ ID NO: 4142714 - DNA, 22 bp, Homo sapiens
gagcatttaatggcagctagtg

SEQ ID NO: 4142715 - DNA, 20 bp, Homo sapiens
gagcattttgataccagaag

SEQ ID NO: 4142716 - DNA, 18 bp, Homo sapiens
gagcatttttttattcag

SEQ ID NO: 4142717 - DNA, 20 bp, Homo sapiens
gagccaacagaagcttccat

SEQ ID NO: 4142718 - DNA, 16 bp, Homo sapiens
gagccaacctcggctt

SEQ ID NO: 4142719 - DNA, 19 bp, Homo sapiens
gagccaacctcggcttgtg

SEQ ID NO: 4142720 - DNA, 18 bp, Homo sapiens
gagccacagaccacctgc

SEQ ID NO: 4142721 - DNA, 19 bp, Homo sapiens
gagccacagaccacctgct

SEQ ID NO: 4142722 - DNA, 15 bp, Homo sapiens
gagccaccgctgcca

SEQ ID NO: 4142723 - DNA, 16 bp, Homo sapiens
gagccaccgctgccag

SEQ ID NO: 4142724 - DNA, 23 bp, Homo sapiens
gagccaccgtgcctggccagatt

SEQ ID NO: 4142725 - DNA, 14 bp, Homo sapiens
gagccacttctccc

SEQ ID NO: 4142726 - DNA, 19 bp, Homo sapiens
gagccacttctccccagaa

SEQ ID NO: 4142727 - DNA, 14 bp, Homo sapiens
gagccagacagacc

SEQ ID NO: 4142728 - DNA, 17 bp, Homo sapiens
gagccagatgcaggaca

SEQ ID NO: 4142729 - DNA, 19 bp, Homo sapiens
gagccagatgcaggacagg

SEQ ID NO: 4142730 - DNA, 23 bp, Homo sapiens
gagccagatgcaggacaggaggc

SEQ ID NO: 4142731 - DNA, 13 bp, Homo sapiens
gagccagctccct

SEQ ID NO: 4142732 - DNA, 18 bp, Homo sapiens
gagccaggtaatgaggga

SEQ ID NO: 4142733 - DNA, 17 bp, Homo sapiens
gagccagtttgccggat

SEQ ID NO: 4142734 - DNA, 14 bp, Homo sapiens
gagccattttgtga

SEQ ID NO: 4142735 - DNA, 16 bp, Homo sapiens
gagcccagagaacagc

SEQ ID NO: 4142736 - DNA, 13 bp, Homo sapiens
gagcccagctcca

SEQ ID NO: 4142737 - DNA, 15 bp, Homo sapiens
gagcccagctgcctg

SEQ ID NO: 4142738 - DNA, 21 bp, Homo sapiens
gagcccaggagtcccactcca

SEQ ID NO: 4142739 - DNA, 20 bp, Homo sapiens
gagcccatactcagcctgct

SEQ ID NO: 4142740 - DNA, 13 bp, Homo sapiens
gagcccatgctca

SEQ ID NO: 4142741 - DNA, 14 bp, Homo sapiens
gagcccatgctcaa

SEQ ID NO: 4142742 - DNA, 23 bp, Homo sapiens
gagcccatgctcaaccactgtgg

SEQ ID NO: 4142743 - DNA, 13 bp, Homo sapiens
gagccccaagcag

SEQ ID NO: 4142744 - DNA, 12 bp, Homo sapiens
gagccccagggt

SEQ ID NO: 4142745 - DNA, 14 bp, Homo sapiens
gagccccagggtct

SEQ ID NO: 4142746 - DNA, 12 bp, Homo sapiens
gagcccccagat

SEQ ID NO: 4142747 - DNA, 22 bp, Homo sapiens
gagcccccagatagagctgggt

SEQ ID NO: 4142748 - DNA, 15 bp, Homo sapiens
gagcccccagcagag

SEQ ID NO: 4142749 - DNA, 20 bp, Homo sapiens
gagcccctcctccagcccct

SEQ ID NO: 4142750 - DNA, 22 bp, Homo sapiens
gagcccctcctccagcccctgt

SEQ ID NO: 4142751 - DNA, 13 bp, Homo sapiens
gagccctggctgg

SEQ ID NO: 4142752 - DNA, 11 bp, Homo sapiens
gagccctgggg

SEQ ID NO: 4142753 - DNA, 13 bp, Homo sapiens
gagccctggggac

SEQ ID NO: 4142754 - DNA, 22 bp, Homo sapiens
gagccctggggactgttccaaa

SEQ ID NO: 4142755 - DNA, 18 bp, Homo sapiens
gagcccttgcccatgctg

SEQ ID NO: 4142756 - DNA, 15 bp, Homo sapiens
gagcccttgcctccc

SEQ ID NO: 4142757 - DNA, 12 bp, Homo sapiens
gagcccttggcc

SEQ ID NO: 4142758 - DNA, 15 bp, Homo sapiens
gagcccttggcccct

SEQ ID NO: 4142759 - DNA, 20 bp, Homo sapiens
gagccgagatcgcgccactg

SEQ ID NO: 4142760 - DNA, 14 bp, Homo sapiens
gagccgccaccggg

SEQ ID NO: 4142761 - DNA, 17 bp, Homo sapiens
gagccgcggggaagctg

SEQ ID NO: 4142762 - DNA, 21 bp, Homo sapiens
gagccgcggggaagctggctt

SEQ ID NO: 4142763 - DNA, 19 bp, Homo sapiens
gagccggtaactgtcctgt

SEQ ID NO: 4142764 - DNA, 17 bp, Homo sapiens
gagccgtgaactgtgca

SEQ ID NO: 4142765 - DNA, 16 bp, Homo sapiens
gagccgtggtccctga

SEQ ID NO: 4142766 - DNA, 20 bp, Homo sapiens
gagcctagcggagcccagcc

SEQ ID NO: 4142767 - DNA, 21 bp, Homo sapiens
gagcctagcggagcccagcct

SEQ ID NO: 4142768 - DNA, 23 bp, Homo sapiens
gagcctagcggagcccagcctgg

SEQ ID NO: 4142769 - DNA, 14 bp, Homo sapiens
gagcctagctcctg

SEQ ID NO: 4142770 - DNA, 15 bp, Homo sapiens
gagcctagctcctgc

SEQ ID NO: 4142771 - DNA, 15 bp, Homo sapiens
gagcctccccctcag

SEQ ID NO: 4142772 - DNA, 17 bp, Homo sapiens
gagcctcgtccctccct

SEQ ID NO: 4142773 - DNA, 22 bp, Homo sapiens
gagcctcgtccctccctcactg

SEQ ID NO: 4142774 - DNA, 16 bp, Homo sapiens
gagcctctgctcccca

SEQ ID NO: 4142775 - DNA, 17 bp, Homo sapiens
gagcctctgctccccag

SEQ ID NO: 4142776 - DNA, 15 bp, Homo sapiens
gagcctgacagccag

SEQ ID NO: 4142777 - DNA, 16 bp, Homo sapiens
gagcctgacagccaga

SEQ ID NO: 4142778 - DNA, 21 bp, Homo sapiens
gagcctgcaaactcactgctc

SEQ ID NO: 4142779 - DNA, 17 bp, Homo sapiens
gagcctgccccagcgct

SEQ ID NO: 4142780 - DNA, 18 bp, Homo sapiens
gagcctgccccagcgctg

SEQ ID NO: 4142781 - DNA, 14 bp, Homo sapiens
gagcctgcctggag

SEQ ID NO: 4142782 - DNA, 15 bp, Homo sapiens
gagcctgcctggagc

SEQ ID NO: 4142783 - DNA, 16 bp, Homo sapiens
gagcctgctggaagcc

SEQ ID NO: 4142784 - DNA, 13 bp, Homo sapiens
gagcctgctggca

SEQ ID NO: 4142785 - DNA, 15 bp, Homo sapiens
gagcctgctggcacc

SEQ ID NO: 4142786 - DNA, 12 bp, Homo sapiens
gagcctgctggt

SEQ ID NO: 4142787 - DNA, 23 bp, Homo sapiens
gagcctgctggtcacagcctcct

SEQ ID NO: 4142788 - DNA, 15 bp, Homo sapiens
gagcctggagaagct

SEQ ID NO: 4142789 - DNA, 12 bp, Homo sapiens
gagcctgtgcag

SEQ ID NO: 4142790 - DNA, 15 bp, Homo sapiens
gagcctgtgcagcct

SEQ ID NO: 4142791 - DNA, 18 bp, Homo sapiens
gagccttctcagaagcac

SEQ ID NO: 4142792 - DNA, 13 bp, Homo sapiens
gagccttttgctc

SEQ ID NO: 4142793 - DNA, 14 bp, Homo sapiens
gagcgccaggaagc

SEQ ID NO: 4142794 - DNA, 19 bp, Homo sapiens
gagcgccaggaagccagag

SEQ ID NO: 4142795 - DNA, 18 bp, Homo sapiens
gagcgctttctggaaaag

SEQ ID NO: 4142796 - DNA, 20 bp, Homo sapiens
gagcggagacgggaggcctg

SEQ ID NO: 4142797 - DNA, 21 bp, Homo sapiens
gagcggagaggaagccagctg

SEQ ID NO: 4142798 - DNA, 16 bp, Homo sapiens
gagcggattgcaaagc

SEQ ID NO: 4142799 - DNA, 16 bp, Homo sapiens
gagcggggtatgaaga

SEQ ID NO: 4142800 - DNA, 23 bp, Homo sapiens
gagcgtcagggttggtgtgctga

SEQ ID NO: 4142801 - DNA, 16 bp, Homo sapiens
gagcgttcccagcagg

SEQ ID NO: 4142802 - DNA, 20 bp, Homo sapiens
gagctaaactccttcctggc

SEQ ID NO: 4142803 - DNA, 19 bp, Homo sapiens
gagctaaccccaagctgcc

SEQ ID NO: 4142804 - DNA, 23 bp, Homo sapiens
gagctaaccccaagctgcctctg

SEQ ID NO: 4142805 - DNA, 19 bp, Homo sapiens
gagctatttccattccaga

SEQ ID NO: 4142806 - DNA, 22 bp, Homo sapiens
gagctcacactccagtggcaga

SEQ ID NO: 4142807 - DNA, 16 bp, Homo sapiens
gagctcactcggcacc

SEQ ID NO: 4142808 - DNA, 23 bp, Homo sapiens
gagctcagccccgagctgtcccc

SEQ ID NO: 4142809 - DNA, 17 bp, Homo sapiens
gagctccccagatctcc

SEQ ID NO: 4142810 - DNA, 20 bp, Homo sapiens
gagctccccagatctcccac

SEQ ID NO: 4142811 - DNA, 15 bp, Homo sapiens
gagctcctctcctgg

SEQ ID NO: 4142812 - DNA, 16 bp, Homo sapiens
gagctcctctcctgga

SEQ ID NO: 4142813 - DNA, 18 bp, Homo sapiens
gagctcctctcctggagg

SEQ ID NO: 4142814 - DNA, 19 bp, Homo sapiens
gagctcctctcctggagga

SEQ ID NO: 4142815 - DNA, 14 bp, Homo sapiens
gagctcctgctgcg

SEQ ID NO: 4142816 - DNA, 16 bp, Homo sapiens
gagctctaccctgctc

SEQ ID NO: 4142817 - DNA, 19 bp, Homo sapiens
gagctctaccctgctccct

SEQ ID NO: 4142818 - DNA, 19 bp, Homo sapiens
gagctctggggacagcttc

SEQ ID NO: 4142819 - DNA, 20 bp, Homo sapiens
gagctctggggacagcttcc

SEQ ID NO: 4142820 - DNA, 21 bp, Homo sapiens
gagctctggggacagcttcct

SEQ ID NO: 4142821 - DNA, 22 bp, Homo sapiens
gagctcttcccttattcctaat

SEQ ID NO: 4142822 - DNA, 17 bp, Homo sapiens
gagctcttggcctttgc

SEQ ID NO: 4142823 - DNA, 13 bp, Homo sapiens
gagctgaagacct

SEQ ID NO: 4142824 - DNA, 14 bp, Homo sapiens
gagctgagcagcct

SEQ ID NO: 4142825 - DNA, 23 bp, Homo sapiens
gagctgaggggggccgtgcccag

SEQ ID NO: 4142826 - DNA, 16 bp, Homo sapiens
gagctgatataaattc

SEQ ID NO: 4142827 - DNA, 14 bp, Homo sapiens
gagctgatgaaact

SEQ ID NO: 4142828 - DNA, 14 bp, Homo sapiens
gagctgatggcagc

SEQ ID NO: 4142829 - DNA, 15 bp, Homo sapiens
gagctgatggcagct

SEQ ID NO: 4142830 - DNA, 18 bp, Homo sapiens
gagctgatggcagctggg

SEQ ID NO: 4142831 - DNA, 11 bp, Homo sapiens
gagctgccttc

SEQ ID NO: 4142832 - DNA, 23 bp, Homo sapiens
gagctgccttccctagctttaga

SEQ ID NO: 4142833 - DNA, 21 bp, Homo sapiens
gagctgctggcttgcagtgcg

SEQ ID NO: 4142834 - DNA, 21 bp, Homo sapiens
gagctggacagtggagtgcaa

SEQ ID NO: 4142835 - DNA, 15 bp, Homo sapiens
gagctggagccccca

SEQ ID NO: 4142836 - DNA, 18 bp, Homo sapiens
gagctggagcccccagca

SEQ ID NO: 4142837 - DNA, 16 bp, Homo sapiens
gagctgggcaggaagg

SEQ ID NO: 4142838 - DNA, 13 bp, Homo sapiens
gagctggggacct

SEQ ID NO: 4142839 - DNA, 15 bp, Homo sapiens
gagctggggacctgg

SEQ ID NO: 4142840 - DNA, 16 bp, Homo sapiens
gagctggggactcagg

SEQ ID NO: 4142841 - DNA, 19 bp, Homo sapiens
gagctggggggttggcagc

SEQ ID NO: 4142842 - DNA, 21 bp, Homo sapiens
gagctggggggttggcagccc

SEQ ID NO: 4142843 - DNA, 17 bp, Homo sapiens
gagctggtgcattacag

SEQ ID NO: 4142844 - DNA, 15 bp, Homo sapiens
gagctggtgcccgga

SEQ ID NO: 4142845 - DNA, 14 bp, Homo sapiens
gagctggtgtctga

SEQ ID NO: 4142846 - DNA, 20 bp, Homo sapiens
gagctgtgagttctccctgt

SEQ ID NO: 4142847 - DNA, 16 bp, Homo sapiens
gagctgtttatggcct

SEQ ID NO: 4142848 - DNA, 15 bp, Homo sapiens
gagcttaaattgtca

SEQ ID NO: 4142849 - DNA, 17 bp, Homo sapiens
gagcttagccaatgtgg

SEQ ID NO: 4142850 - DNA, 23 bp, Homo sapiens
gagcttcctcggtagcagaggcc

SEQ ID NO: 4142851 - DNA, 18 bp, Homo sapiens
gagcttcggttctccaga

SEQ ID NO: 4142852 - DNA, 20 bp, Homo sapiens
gagcttcggttctccagaat

SEQ ID NO: 4142853 - DNA, 14 bp, Homo sapiens
gagcttctctgtga

SEQ ID NO: 4142854 - DNA, 16 bp, Homo sapiens
gagcttctctgtgaac

SEQ ID NO: 4142855 - DNA, 22 bp, Homo sapiens
gagcttgggcagtgccccaggg

SEQ ID NO: 4142856 - DNA, 16 bp, Homo sapiens
gagcttgtaataaata

SEQ ID NO: 4142857 - DNA, 20 bp, Homo sapiens
gaggaaaaccaagccgtggc

SEQ ID NO: 4142858 - DNA, 15 bp, Homo sapiens
gaggaaaaggaaaaa

SEQ ID NO: 4142859 - DNA, 14 bp, Homo sapiens
gaggaaaatgagta

SEQ ID NO: 4142860 - DNA, 16 bp, Homo sapiens
gaggaaaatgagtatt

SEQ ID NO: 4142861 - DNA, 20 bp, Homo sapiens
gaggaaagcacagaggcctc

SEQ ID NO: 4142862 - DNA, 18 bp, Homo sapiens
gaggaaccagaggcactt

SEQ ID NO: 4142863 - DNA, 14 bp, Homo sapiens
gaggaaggattgta

SEQ ID NO: 4142864 - DNA, 21 bp, Homo sapiens
gaggaaggcaagagggggtgg

SEQ ID NO: 4142865 - DNA, 16 bp, Homo sapiens
gaggaagtgagcagtc

SEQ ID NO: 4142866 - DNA, 23 bp, Homo sapiens
gaggaatatgacggaagaacata

SEQ ID NO: 4142867 - DNA, 22 bp, Homo sapiens
gaggaatcatgtcaggcctgtg

SEQ ID NO: 4142868 - DNA, 14 bp, Homo sapiens
gaggacaggcggga

SEQ ID NO: 4142869 - DNA, 16 bp, Homo sapiens
gaggacatggcttctg

SEQ ID NO: 4142870 - DNA, 23 bp, Homo sapiens
gaggacgtcatcggaggctgggc

SEQ ID NO: 4142871 - DNA, 21 bp, Homo sapiens
gaggactcccaaccctggctt

SEQ ID NO: 4142872 - DNA, 13 bp, Homo sapiens
gaggagaaacaca

SEQ ID NO: 4142873 - DNA, 14 bp, Homo sapiens
gaggagccagacag

SEQ ID NO: 4142874 - DNA, 16 bp, Homo sapiens
gaggagccagacagac

SEQ ID NO: 4142875 - DNA, 13 bp, Homo sapiens
gaggagctgctgg

SEQ ID NO: 4142876 - DNA, 15 bp, Homo sapiens
gaggagctgctggct

SEQ ID NO: 4142877 - DNA, 21 bp, Homo sapiens
gaggaggatgtccctgggcca

SEQ ID NO: 4142878 - DNA, 22 bp, Homo sapiens
gaggaggatgtccctgggccag

SEQ ID NO: 4142879 - DNA, 23 bp, Homo sapiens
gaggaggatgtccctgggccagg

SEQ ID NO: 4142880 - DNA, 13 bp, Homo sapiens
gaggagggggagg

SEQ ID NO: 4142881 - DNA, 17 bp, Homo sapiens
gaggagggtgggggagg

SEQ ID NO: 4142882 - DNA, 15 bp, Homo sapiens
gaggaggtgtgagga

SEQ ID NO: 4142883 - DNA, 20 bp, Homo sapiens
gaggaggtttggggtctgcc

SEQ ID NO: 4142884 - DNA, 11 bp, Homo sapiens
gaggagtaaca

SEQ ID NO: 4142885 - DNA, 14 bp, Homo sapiens
gaggatcagttttt

SEQ ID NO: 4142886 - DNA, 19 bp, Homo sapiens
gaggatgtccctgggccag

SEQ ID NO: 4142887 - DNA, 16 bp, Homo sapiens
gaggattataaatgaa

SEQ ID NO: 4142888 - DNA, 19 bp, Homo sapiens
gaggattatgggtcctgca

SEQ ID NO: 4142889 - DNA, 14 bp, Homo sapiens
gaggattattgata

SEQ ID NO: 4142890 - DNA, 19 bp, Homo sapiens
gaggattgcttgagcccag

SEQ ID NO: 4142891 - DNA, 13 bp, Homo sapiens
gaggcaagaaaag

SEQ ID NO: 4142892 - DNA, 23 bp, Homo sapiens
gaggcaatgtcaggaacagaagg

SEQ ID NO: 4142893 - DNA, 22 bp, Homo sapiens
gaggcactcagtgagcctcctg

SEQ ID NO: 4142894 - DNA, 15 bp, Homo sapiens
gaggcacttccacct

SEQ ID NO: 4142895 - DNA, 17 bp, Homo sapiens
gaggcagagaaagaaga

SEQ ID NO: 4142896 - DNA, 15 bp, Homo sapiens
gaggcagccccctcc

SEQ ID NO: 4142897 - DNA, 14 bp, Homo sapiens
gaggcagccttggg

SEQ ID NO: 4142898 - DNA, 20 bp, Homo sapiens
gaggcagcttcaagtgcctt

SEQ ID NO: 4142899 - DNA, 22 bp, Homo sapiens
gaggcaggccgactgtactaaa

SEQ ID NO: 4142900 - DNA, 15 bp, Homo sapiens
gaggcaggtgagaga

SEQ ID NO: 4142901 - DNA, 13 bp, Homo sapiens
gaggcatggccct

SEQ ID NO: 4142902 - DNA, 15 bp, Homo sapiens
gaggcatggctgggg

SEQ ID NO: 4142903 - DNA, 17 bp, Homo sapiens
gaggccaaactgtccct

SEQ ID NO: 4142904 - DNA, 20 bp, Homo sapiens
gaggccaaactgtccctccc

SEQ ID NO: 4142905 - DNA, 12 bp, Homo sapiens
gaggccaataaa

SEQ ID NO: 4142906 - DNA, 13 bp, Homo sapiens
gaggccaataaaa

SEQ ID NO: 4142907 - DNA, 22 bp, Homo sapiens
gaggccacacgcactggtgcca

SEQ ID NO: 4142908 - DNA, 13 bp, Homo sapiens
gaggccagcccca

SEQ ID NO: 4142909 - DNA, 18 bp, Homo sapiens
gaggccagccccacccag

SEQ ID NO: 4142910 - DNA, 20 bp, Homo sapiens
gaggccagccccacccagga

SEQ ID NO: 4142911 - DNA, 22 bp, Homo sapiens
gaggccagccccacccaggagg

SEQ ID NO: 4142912 - DNA, 22 bp, Homo sapiens
gaggccaggagtttgagaccag

SEQ ID NO: 4142913 - DNA, 13 bp, Homo sapiens
gaggccagtgggc

SEQ ID NO: 4142914 - DNA, 15 bp, Homo sapiens
gaggcccagcgggca

SEQ ID NO: 4142915 - DNA, 16 bp, Homo sapiens
gaggcccagcgggcag

SEQ ID NO: 4142916 - DNA, 20 bp, Homo sapiens
gaggcccagttcaccctgat

SEQ ID NO: 4142917 - DNA, 13 bp, Homo sapiens
gaggcccctggac

SEQ ID NO: 4142918 - DNA, 17 bp, Homo sapiens
gaggcccctggagccag

SEQ ID NO: 4142919 - DNA, 18 bp, Homo sapiens
gaggccctcaatccacct

SEQ ID NO: 4142920 - DNA, 16 bp, Homo sapiens
gaggccctcctgtgct

SEQ ID NO: 4142921 - DNA, 17 bp, Homo sapiens
gaggccctcctgtgctg

SEQ ID NO: 4142922 - DNA, 18 bp, Homo sapiens
gaggccctgggctgggtg

SEQ ID NO: 4142923 - DNA, 15 bp, Homo sapiens
gaggccgaaggtgcc

SEQ ID NO: 4142924 - DNA, 14 bp, Homo sapiens
gaggcctcaggtgc

SEQ ID NO: 4142925 - DNA, 20 bp, Homo sapiens
gaggcctcaggtgctgtcca

SEQ ID NO: 4142926 - DNA, 23 bp, Homo sapiens
gaggcctcctgtggcctgccagt

SEQ ID NO: 4142927 - DNA, 18 bp, Homo sapiens
gaggcctgaagccagctg

SEQ ID NO: 4142928 - DNA, 20 bp, Homo sapiens
gaggcctgctgccagtgcag

SEQ ID NO: 4142929 - DNA, 20 bp, Homo sapiens
gaggcctggactttcctgca

SEQ ID NO: 4142930 - DNA, 13 bp, Homo sapiens
gaggcctggccag

SEQ ID NO: 4142931 - DNA, 14 bp, Homo sapiens
gaggcctggccagg

SEQ ID NO: 4142932 - DNA, 15 bp, Homo sapiens
gaggcctggccaggc

SEQ ID NO: 4142933 - DNA, 14 bp, Homo sapiens
gaggcctgtcccaa

SEQ ID NO: 4142934 - DNA, 17 bp, Homo sapiens
gaggccttccagctgct

SEQ ID NO: 4142935 - DNA, 18 bp, Homo sapiens
gaggccttccagctgctg

SEQ ID NO: 4142936 - DNA, 19 bp, Homo sapiens
gaggccttgggctctgctg

SEQ ID NO: 4142937 - DNA, 20 bp, Homo sapiens
gaggccttgggctctgctga

SEQ ID NO: 4142938 - DNA, 21 bp, Homo sapiens
gaggcgcacagtgtgagcccg

SEQ ID NO: 4142939 - DNA, 13 bp, Homo sapiens
gaggcggaggctg

SEQ ID NO: 4142940 - DNA, 19 bp, Homo sapiens
gaggcggaggctgtgctcc

SEQ ID NO: 4142941 - DNA, 12 bp, Homo sapiens
gaggctcaggtc

SEQ ID NO: 4142942 - DNA, 14 bp, Homo sapiens
gaggctccaggcag

SEQ ID NO: 4142943 - DNA, 16 bp, Homo sapiens
gaggctccaggcagca

SEQ ID NO: 4142944 - DNA, 15 bp, Homo sapiens
gaggctctccgtgca

SEQ ID NO: 4142945 - DNA, 23 bp, Homo sapiens
gaggctctggacagcagaagcct

SEQ ID NO: 4142946 - DNA, 20 bp, Homo sapiens
gaggctgaaagaggccaatg

SEQ ID NO: 4142947 - DNA, 16 bp, Homo sapiens
gaggctgagacaggag

SEQ ID NO: 4142948 - DNA, 14 bp, Homo sapiens
gaggctgaggcctg

SEQ ID NO: 4142949 - DNA, 21 bp, Homo sapiens
gaggctgcacccctgggccag

SEQ ID NO: 4142950 - DNA, 15 bp, Homo sapiens
gaggctggaggaagg

SEQ ID NO: 4142951 - DNA, 16 bp, Homo sapiens
gaggctgggcccctgg

SEQ ID NO: 4142952 - DNA, 19 bp, Homo sapiens
gaggctgggcccctgggat

SEQ ID NO: 4142953 - DNA, 17 bp, Homo sapiens
gaggctgtcacagtcct

SEQ ID NO: 4142954 - DNA, 17 bp, Homo sapiens
gaggctgtctggggcct

SEQ ID NO: 4142955 - DNA, 13 bp, Homo sapiens
gaggctgtgctcc

SEQ ID NO: 4142956 - DNA, 14 bp, Homo sapiens
gaggctgtgctccg

SEQ ID NO: 4142957 - DNA, 22 bp, Homo sapiens
gaggctgtgtgcctgggggagt

SEQ ID NO: 4142958 - DNA, 16 bp, Homo sapiens
gaggcttagagagagg

SEQ ID NO: 4142959 - DNA, 22 bp, Homo sapiens
gaggcttagagagaggaggcag

SEQ ID NO: 4142960 - DNA, 17 bp, Homo sapiens
gaggcttatatttgtgt

SEQ ID NO: 4142961 - DNA, 21 bp, Homo sapiens
gaggcttcctgcgtcctcctc

SEQ ID NO: 4142962 - DNA, 18 bp, Homo sapiens
gaggcttctccgccagcc

SEQ ID NO: 4142963 - DNA, 10 bp, Homo sapiens
gagggaaaag

SEQ ID NO: 4142964 - DNA, 15 bp, Homo sapiens
gagggaaaagggaag

SEQ ID NO: 4142965 - DNA, 15 bp, Homo sapiens
gagggaaagtgcata

SEQ ID NO: 4142966 - DNA, 19 bp, Homo sapiens
gagggaagggtttctctat

SEQ ID NO: 4142967 - DNA, 16 bp, Homo sapiens
gagggaagtgtgagcg

SEQ ID NO: 4142968 - DNA, 22 bp, Homo sapiens
gagggaagtgtgagcgccttgg

SEQ ID NO: 4142969 - DNA, 17 bp, Homo sapiens
gagggacatgctcacct

SEQ ID NO: 4142970 - DNA, 19 bp, Homo sapiens
gagggacatgctcacctct

SEQ ID NO: 4142971 - DNA, 21 bp, Homo sapiens
gagggaccatgtgtcacttgt

SEQ ID NO: 4142972 - DNA, 19 bp, Homo sapiens
gagggactctgaagcctct

SEQ ID NO: 4142973 - DNA, 22 bp, Homo sapiens
gagggactctgaagcctctggg

SEQ ID NO: 4142974 - DNA, 23 bp, Homo sapiens
gagggactctgaagcctctggga

SEQ ID NO: 4142975 - DNA, 14 bp, Homo sapiens
gagggagaagcatg

SEQ ID NO: 4142976 - DNA, 13 bp, Homo sapiens
gagggagaaggga

SEQ ID NO: 4142977 - DNA, 17 bp, Homo sapiens
gagggagcacaaccccc

SEQ ID NO: 4142978 - DNA, 13 bp, Homo sapiens
gagggagggggct

SEQ ID NO: 4142979 - DNA, 15 bp, Homo sapiens
gagggatgctgctcc

SEQ ID NO: 4142980 - DNA, 18 bp, Homo sapiens
gagggatgctgctccgcc

SEQ ID NO: 4142981 - DNA, 13 bp, Homo sapiens
gagggatggagag

SEQ ID NO: 4142982 - DNA, 19 bp, Homo sapiens
gagggattggccgcttggc

SEQ ID NO: 4142983 - DNA, 15 bp, Homo sapiens
gagggatttccctgc

SEQ ID NO: 4142984 - DNA, 22 bp, Homo sapiens
gagggcaagggccatgctgaag

SEQ ID NO: 4142985 - DNA, 13 bp, Homo sapiens
gagggcacagccc

SEQ ID NO: 4142986 - DNA, 16 bp, Homo sapiens
gagggcacagccctcc

SEQ ID NO: 4142987 - DNA, 21 bp, Homo sapiens
gagggcagaaaggttctgccc

SEQ ID NO: 4142988 - DNA, 17 bp, Homo sapiens
gagggcagactggggca

SEQ ID NO: 4142989 - DNA, 23 bp, Homo sapiens
gagggcagactggggcatcctgt

SEQ ID NO: 4142990 - DNA, 15 bp, Homo sapiens
gagggcagagggaga

SEQ ID NO: 4142991 - DNA, 20 bp, Homo sapiens
gagggcagagggagaatcca

SEQ ID NO: 4142992 - DNA, 16 bp, Homo sapiens
gagggcagtaccctcc

SEQ ID NO: 4142993 - DNA, 15 bp, Homo sapiens
gagggcccagagcag

SEQ ID NO: 4142994 - DNA, 16 bp, Homo sapiens
gagggcccagagcagg

SEQ ID NO: 4142995 - DNA, 15 bp, Homo sapiens
gagggcccagcccag

SEQ ID NO: 4142996 - DNA, 19 bp, Homo sapiens
gagggcccctgcgtggggg

SEQ ID NO: 4142997 - DNA, 21 bp, Homo sapiens
gagggctcgaggggtgggctg

SEQ ID NO: 4142998 - DNA, 18 bp, Homo sapiens
gagggctgatggaggaaa

SEQ ID NO: 4142999 - DNA, 13 bp, Homo sapiens
gagggctgccagc

SEQ ID NO: 4143000 - DNA, 16 bp, Homo sapiens
gagggctggaggccca

SEQ ID NO: 4143001 - DNA, 23 bp, Homo sapiens
gagggctggaggcccaggctggg

SEQ ID NO: 4143002 - DNA, 19 bp, Homo sapiens
gagggcttcctctagaagc

SEQ ID NO: 4143003 - DNA, 20 bp, Homo sapiens
gaggggaaatgtaatactgg

SEQ ID NO: 4143004 - DNA, 21 bp, Homo sapiens
gaggggaactgagtcacgctg

SEQ ID NO: 4143005 - DNA, 17 bp, Homo sapiens
gaggggagccaggaggg

SEQ ID NO: 4143006 - DNA, 20 bp, Homo sapiens
gaggggcaacgaagaaaaaa

SEQ ID NO: 4143007 - DNA, 19 bp, Homo sapiens
gaggggccctggccaggac

SEQ ID NO: 4143008 - DNA, 14 bp, Homo sapiens
gaggggcctggcag

SEQ ID NO: 4143009 - DNA, 18 bp, Homo sapiens
gaggggcctggcagccgt

SEQ ID NO: 4143010 - DNA, 20 bp, Homo sapiens
gaggggcctggcagccgtgc

SEQ ID NO: 4143011 - DNA, 21 bp, Homo sapiens
gaggggcggcaggagggaggt

SEQ ID NO: 4143012 - DNA, 11 bp, Homo sapiens
gaggggctctc

SEQ ID NO: 4143013 - DNA, 17 bp, Homo sapiens
gaggggctgcagggcca

SEQ ID NO: 4143014 - DNA, 14 bp, Homo sapiens
gagggggagtagcc

SEQ ID NO: 4143015 - DNA, 15 bp, Homo sapiens
gagggggagtagcca

SEQ ID NO: 4143016 - DNA, 13 bp, Homo sapiens
gagggggcaaagg

SEQ ID NO: 4143017 - DNA, 21 bp, Homo sapiens
gagggggccgggcgcggtggc

SEQ ID NO: 4143018 - DNA, 13 bp, Homo sapiens
gagggggctggcc

SEQ ID NO: 4143019 - DNA, 14 bp, Homo sapiens
gagggggtggaggg

SEQ ID NO: 4143020 - DNA, 15 bp, Homo sapiens
gagggggttacaaac

SEQ ID NO: 4143021 - DNA, 19 bp, Homo sapiens
gagggggttacaaactgca

SEQ ID NO: 4143022 - DNA, 16 bp, Homo sapiens
gaggggtcccctctgg

SEQ ID NO: 4143023 - DNA, 23 bp, Homo sapiens
gaggggtctcggatgacaccctg

SEQ ID NO: 4143024 - DNA, 18 bp, Homo sapiens
gaggggtgtggcagtggt

SEQ ID NO: 4143025 - DNA, 17 bp, Homo sapiens
gaggggttgagggaagg

SEQ ID NO: 4143026 - DNA, 19 bp, Homo sapiens
gagggtaataaccagacac

SEQ ID NO: 4143027 - DNA, 19 bp, Homo sapiens
gagggtccccacctgggac

SEQ ID NO: 4143028 - DNA, 21 bp, Homo sapiens
gagggtcctggctcctgaggg

SEQ ID NO: 4143029 - DNA, 18 bp, Homo sapiens
gagggtgacagcttcctt

SEQ ID NO: 4143030 - DNA, 19 bp, Homo sapiens
gagggtgagtcctccagaa

SEQ ID NO: 4143031 - DNA, 13 bp, Homo sapiens
gagggtggagact

SEQ ID NO: 4143032 - DNA, 15 bp, Homo sapiens
gagggtgggggaggg

SEQ ID NO: 4143033 - DNA, 17 bp, Homo sapiens
gagggttggcacctgca

SEQ ID NO: 4143034 - DNA, 13 bp, Homo sapiens
gagggttgtgcta

SEQ ID NO: 4143035 - DNA, 21 bp, Homo sapiens
gagggttttaggtagaaaaac

SEQ ID NO: 4143036 - DNA, 13 bp, Homo sapiens
gaggtaacagaac

SEQ ID NO: 4143037 - DNA, 14 bp, Homo sapiens
gaggtaacagaaca

SEQ ID NO: 4143038 - DNA, 16 bp, Homo sapiens
gaggtaacagaacagc

SEQ ID NO: 4143039 - DNA, 17 bp, Homo sapiens
gaggtaacagaacagct

SEQ ID NO: 4143040 - DNA, 21 bp, Homo sapiens
gaggtaacagaacagcttcag

SEQ ID NO: 4143041 - DNA, 17 bp, Homo sapiens
gaggtactagaatgctt

SEQ ID NO: 4143042 - DNA, 21 bp, Homo sapiens
gaggtagaccaggatttctaa

SEQ ID NO: 4143043 - DNA, 14 bp, Homo sapiens
gaggtagagagggg

SEQ ID NO: 4143044 - DNA, 18 bp, Homo sapiens
gaggtagagtttgaagga

SEQ ID NO: 4143045 - DNA, 19 bp, Homo sapiens
gaggtagagtttgaaggag

SEQ ID NO: 4143046 - DNA, 20 bp, Homo sapiens
gaggtcaaagctgcagtcag

SEQ ID NO: 4143047 - DNA, 14 bp, Homo sapiens
gaggtcagggagtg

SEQ ID NO: 4143048 - DNA, 22 bp, Homo sapiens
gaggtcagggagtgctggctca

SEQ ID NO: 4143049 - DNA, 12 bp, Homo sapiens
gaggtcccaggc

SEQ ID NO: 4143050 - DNA, 23 bp, Homo sapiens
gaggtccctgtgtgtaggctggg

SEQ ID NO: 4143051 - DNA, 15 bp, Homo sapiens
gaggtctcttgaggg

SEQ ID NO: 4143052 - DNA, 18 bp, Homo sapiens
gaggtctcttgagggagc

SEQ ID NO: 4143053 - DNA, 13 bp, Homo sapiens
gaggtctgtttaa

SEQ ID NO: 4143054 - DNA, 19 bp, Homo sapiens
gaggtcttttgacatgtgg

SEQ ID NO: 4143055 - DNA, 15 bp, Homo sapiens
gaggtgaaaaggcca

SEQ ID NO: 4143056 - DNA, 13 bp, Homo sapiens
gaggtgagggggg

SEQ ID NO: 4143057 - DNA, 13 bp, Homo sapiens
gaggtgcctgtcc

SEQ ID NO: 4143058 - DNA, 11 bp, Homo sapiens
gaggtgctgat

SEQ ID NO: 4143059 - DNA, 13 bp, Homo sapiens
gaggtgctgatga

SEQ ID NO: 4143060 - DNA, 15 bp, Homo sapiens
gaggtggaagaaggg

SEQ ID NO: 4143061 - DNA, 18 bp, Homo sapiens
gaggtggagggagggaag

SEQ ID NO: 4143062 - DNA, 22 bp, Homo sapiens
gaggtggccagagctgggaggc

SEQ ID NO: 4143063 - DNA, 23 bp, Homo sapiens
gaggtggccagagctgggaggca

SEQ ID NO: 4143064 - DNA, 19 bp, Homo sapiens
gaggtggggcgaggcaggc

SEQ ID NO: 4143065 - DNA, 16 bp, Homo sapiens
gaggtggtctgaatgt

SEQ ID NO: 4143066 - DNA, 19 bp, Homo sapiens
gaggtgtgcctggcctctg

SEQ ID NO: 4143067 - DNA, 19 bp, Homo sapiens
gaggtgtttaaagagaggt

SEQ ID NO: 4143068 - DNA, 21 bp, Homo sapiens
gaggtgtttaaagagaggtta

SEQ ID NO: 4143069 - DNA, 17 bp, Homo sapiens
gaggttcctctgcctgc

SEQ ID NO: 4143070 - DNA, 13 bp, Homo sapiens
gaggttgaagcca

SEQ ID NO: 4143071 - DNA, 16 bp, Homo sapiens
gaggttgcagcatgag

SEQ ID NO: 4143072 - DNA, 13 bp, Homo sapiens
gaggttgcagtga

SEQ ID NO: 4143073 - DNA, 15 bp, Homo sapiens
gaggttgcagtgagc

SEQ ID NO: 4143074 - DNA, 13 bp, Homo sapiens
gaggttgcagtgt

SEQ ID NO: 4143075 - DNA, 17 bp, Homo sapiens
gaggttggggtgtacta

SEQ ID NO: 4143076 - DNA, 22 bp, Homo sapiens
gaggtttttaaatatatatttt

SEQ ID NO: 4143077 - DNA, 19 bp, Homo sapiens
gagtaacaatacaaatgga

SEQ ID NO: 4143078 - DNA, 16 bp, Homo sapiens
gagtaacatttgctgt

SEQ ID NO: 4143079 - DNA, 17 bp, Homo sapiens
gagtaacatttgctgtt

SEQ ID NO: 4143080 - DNA, 23 bp, Homo sapiens
gagtaatcaatacagacaaggtt

SEQ ID NO: 4143081 - DNA, 17 bp, Homo sapiens
gagtaatggtgtagaac

SEQ ID NO: 4143082 - DNA, 16 bp, Homo sapiens
gagtaccaggggctgg

SEQ ID NO: 4143083 - DNA, 18 bp, Homo sapiens
gagtaccaggggctgggc

SEQ ID NO: 4143084 - DNA, 19 bp, Homo sapiens
gagtacctactgtgtgcca

SEQ ID NO: 4143085 - DNA, 18 bp, Homo sapiens
gagtacctgctgccccag

SEQ ID NO: 4143086 - DNA, 16 bp, Homo sapiens
gagtacgtcctgcctg

SEQ ID NO: 4143087 - DNA, 19 bp, Homo sapiens
gagtacgtcctgcctggca

SEQ ID NO: 4143088 - DNA, 20 bp, Homo sapiens
gagtagttgatgttgcattt

SEQ ID NO: 4143089 - DNA, 14 bp, Homo sapiens
gagtatatgcactt

SEQ ID NO: 4143090 - DNA, 12 bp, Homo sapiens
gagtattttaag

SEQ ID NO: 4143091 - DNA, 16 bp, Homo sapiens
gagtcacctgctccag

SEQ ID NO: 4143092 - DNA, 17 bp, Homo sapiens
gagtcacctgctccaga

SEQ ID NO: 4143093 - DNA, 22 bp, Homo sapiens
gagtcaccttttctgtggctgg

SEQ ID NO: 4143094 - DNA, 22 bp, Homo sapiens
gagtcagacattttaagatggt

SEQ ID NO: 4143095 - DNA, 12 bp, Homo sapiens
gagtcagagccc

SEQ ID NO: 4143096 - DNA, 14 bp, Homo sapiens
gagtcagccaggag

SEQ ID NO: 4143097 - DNA, 14 bp, Homo sapiens
gagtcagctctctg

SEQ ID NO: 4143098 - DNA, 17 bp, Homo sapiens
gagtcagctctctgccc

SEQ ID NO: 4143099 - DNA, 18 bp, Homo sapiens
gagtcattcgttctgtgg

SEQ ID NO: 4143100 - DNA, 16 bp, Homo sapiens
gagtcatttaaatgtg

SEQ ID NO: 4143101 - DNA, 20 bp, Homo sapiens
gagtcatttaaatgtgtaca

SEQ ID NO: 4143102 - DNA, 14 bp, Homo sapiens
gagtccaagctggg

SEQ ID NO: 4143103 - DNA, 16 bp, Homo sapiens
gagtccagtgctctgc

SEQ ID NO: 4143104 - DNA, 22 bp, Homo sapiens
gagtccagtgctctgcctcaga

SEQ ID NO: 4143105 - DNA, 18 bp, Homo sapiens
gagtccatttcccacatc

SEQ ID NO: 4143106 - DNA, 21 bp, Homo sapiens
gagtccatttcccacatcttt

SEQ ID NO: 4143107 - DNA, 12 bp, Homo sapiens
gagtcccaaagc

SEQ ID NO: 4143108 - DNA, 14 bp, Homo sapiens
gagtcccaaggaaa

SEQ ID NO: 4143109 - DNA, 18 bp, Homo sapiens
gagtcccaaggaaagccc

SEQ ID NO: 4143110 - DNA, 16 bp, Homo sapiens
gagtcccctccaggaa

SEQ ID NO: 4143111 - DNA, 22 bp, Homo sapiens
gagtccgacctggcctgtctgt

SEQ ID NO: 4143112 - DNA, 15 bp, Homo sapiens
gagtcctccagaact

SEQ ID NO: 4143113 - DNA, 16 bp, Homo sapiens
gagtctagcactcatt

SEQ ID NO: 4143114 - DNA, 16 bp, Homo sapiens
gagtctcctctctgag

SEQ ID NO: 4143115 - DNA, 12 bp, Homo sapiens
gagtctcctgtg

SEQ ID NO: 4143116 - DNA, 19 bp, Homo sapiens
gagtctctgccacccactc

SEQ ID NO: 4143117 - DNA, 14 bp, Homo sapiens
gagtctcttctcca

SEQ ID NO: 4143118 - DNA, 16 bp, Homo sapiens
gagtctcttctccact

SEQ ID NO: 4143119 - DNA, 14 bp, Homo sapiens
gagtctggagtggg

SEQ ID NO: 4143120 - DNA, 17 bp, Homo sapiens
gagtctggagtgggcag

SEQ ID NO: 4143121 - DNA, 13 bp, Homo sapiens
gagtctgggcctc

SEQ ID NO: 4143122 - DNA, 16 bp, Homo sapiens
gagtctgggcctctga

SEQ ID NO: 4143123 - DNA, 22 bp, Homo sapiens
gagtcttggtttctctctacag

SEQ ID NO: 4143124 - DNA, 15 bp, Homo sapiens
gagtgaaaaagagaa

SEQ ID NO: 4143125 - DNA, 22 bp, Homo sapiens
gagtgaaaccatgactgtgacc

SEQ ID NO: 4143126 - DNA, 14 bp, Homo sapiens
gagtgaataaatgt

SEQ ID NO: 4143127 - DNA, 15 bp, Homo sapiens
gagtgactcaagaag

SEQ ID NO: 4143128 - DNA, 18 bp, Homo sapiens
gagtgactcgagggttgg

SEQ ID NO: 4143129 - DNA, 13 bp, Homo sapiens
gagtgagccacag

SEQ ID NO: 4143130 - DNA, 21 bp, Homo sapiens
gagtgagccacagaccacctg

SEQ ID NO: 4143131 - DNA, 13 bp, Homo sapiens
gagtgagccagtg

SEQ ID NO: 4143132 - DNA, 19 bp, Homo sapiens
gagtgagtcacctgctcca

SEQ ID NO: 4143133 - DNA, 22 bp, Homo sapiens
gagtgagtcacctgctccagaa

SEQ ID NO: 4143134 - DNA, 14 bp, Homo sapiens
gagtgatgatttgg

SEQ ID NO: 4143135 - DNA, 12 bp, Homo sapiens
gagtgcagcctt

SEQ ID NO: 4143136 - DNA, 15 bp, Homo sapiens
gagtgcagccttctc

SEQ ID NO: 4143137 - DNA, 12 bp, Homo sapiens
gagtgccaggac

SEQ ID NO: 4143138 - DNA, 19 bp, Homo sapiens
gagtgccaggactccccag

SEQ ID NO: 4143139 - DNA, 20 bp, Homo sapiens
gagtgccctgctttgcaaac

SEQ ID NO: 4143140 - DNA, 13 bp, Homo sapiens
gagtgctggcact

SEQ ID NO: 4143141 - DNA, 19 bp, Homo sapiens
gagtgctgtgctgtgttta

SEQ ID NO: 4143142 - DNA, 19 bp, Homo sapiens
gagtggagagaagctcttc

SEQ ID NO: 4143143 - DNA, 16 bp, Homo sapiens
gagtggatctccaagg

SEQ ID NO: 4143144 - DNA, 19 bp, Homo sapiens
gagtggccagccagtgcca

SEQ ID NO: 4143145 - DNA, 14 bp, Homo sapiens
gagtggcctccctg

SEQ ID NO: 4143146 - DNA, 16 bp, Homo sapiens
gagtggcctccctgct

SEQ ID NO: 4143147 - DNA, 15 bp, Homo sapiens
gagtggcctggccag

SEQ ID NO: 4143148 - DNA, 18 bp, Homo sapiens
gagtggcctggccaggag

SEQ ID NO: 4143149 - DNA, 19 bp, Homo sapiens
gagtggcctggccaggagc

SEQ ID NO: 4143150 - DNA, 23 bp, Homo sapiens
gagtgggcagagcccccaggaag

SEQ ID NO: 4143151 - DNA, 14 bp, Homo sapiens
gagtgggtgggatg

SEQ ID NO: 4143152 - DNA, 13 bp, Homo sapiens
gagtggttaggca

SEQ ID NO: 4143153 - DNA, 11 bp, Homo sapiens
gagtgtagaag

SEQ ID NO: 4143154 - DNA, 16 bp, Homo sapiens
gagtgtcctgcccatg

SEQ ID NO: 4143155 - DNA, 11 bp, Homo sapiens
gagtgtgaatg

SEQ ID NO: 4143156 - DNA, 14 bp, Homo sapiens
gagtgtgacagggc

SEQ ID NO: 4143157 - DNA, 15 bp, Homo sapiens
gagtgtgacagggcc

SEQ ID NO: 4143158 - DNA, 16 bp, Homo sapiens
gagtgtggctgaggag

SEQ ID NO: 4143159 - DNA, 10 bp, Homo sapiens
gagtgtgtgt

SEQ ID NO: 4143160 - DNA, 15 bp, Homo sapiens
gagtgtgtgtgtgca

SEQ ID NO: 4143161 - DNA, 17 bp, Homo sapiens
gagttaagacctggcag

SEQ ID NO: 4143162 - DNA, 21 bp, Homo sapiens
gagttaagacctggcagctct

SEQ ID NO: 4143163 - DNA, 19 bp, Homo sapiens
gagttacagcgagaggcag

SEQ ID NO: 4143164 - DNA, 20 bp, Homo sapiens
gagttacagcgagaggcaga

SEQ ID NO: 4143165 - DNA, 17 bp, Homo sapiens
gagttacattaatgtta

SEQ ID NO: 4143166 - DNA, 18 bp, Homo sapiens
gagttaggggccttaggg

SEQ ID NO: 4143167 - DNA, 18 bp, Homo sapiens
gagttcacaggaggccag

SEQ ID NO: 4143168 - DNA, 20 bp, Homo sapiens
gagttcacaggaggccagtg

SEQ ID NO: 4143169 - DNA, 14 bp, Homo sapiens
gagttcatccaggc

SEQ ID NO: 4143170 - DNA, 21 bp, Homo sapiens
gagttccctcttctaacccaa

SEQ ID NO: 4143171 - DNA, 19 bp, Homo sapiens
gagttccttatccctctct

SEQ ID NO: 4143172 - DNA, 22 bp, Homo sapiens
gagttccttatccctctcttcc

SEQ ID NO: 4143173 - DNA, 19 bp, Homo sapiens
gagttcgaggctgcagtca

SEQ ID NO: 4143174 - DNA, 13 bp, Homo sapiens
gagttctggaaaa

SEQ ID NO: 4143175 - DNA, 14 bp, Homo sapiens
gagttctgtgaaga

SEQ ID NO: 4143176 - DNA, 15 bp, Homo sapiens
gagttcttaaagttt

SEQ ID NO: 4143177 - DNA, 17 bp, Homo sapiens
gagttgagtctcctctc

SEQ ID NO: 4143178 - DNA, 16 bp, Homo sapiens
gagttgatctggaacc

SEQ ID NO: 4143179 - DNA, 19 bp, Homo sapiens
gagttgatctggaacccag

SEQ ID NO: 4143180 - DNA, 21 bp, Homo sapiens
gagttgatctggaacccagac

SEQ ID NO: 4143181 - DNA, 17 bp, Homo sapiens
gagttggagtactatat

SEQ ID NO: 4143182 - DNA, 15 bp, Homo sapiens
gagttgtgatgaatc

SEQ ID NO: 4143183 - DNA, 15 bp, Homo sapiens
gagtttcatgtacaa

SEQ ID NO: 4143184 - DNA, 18 bp, Homo sapiens
gagtttcatgtacaagat

SEQ ID NO: 4143185 - DNA, 15 bp, Homo sapiens
gagtttcgaggtaga

SEQ ID NO: 4143186 - DNA, 12 bp, Homo sapiens
gagtttctctgt

SEQ ID NO: 4143187 - DNA, 13 bp, Homo sapiens
gagtttctgtttg

SEQ ID NO: 4143188 - DNA, 23 bp, Homo sapiens
gagtttgccccgttctgtttgta

SEQ ID NO: 4143189 - DNA, 22 bp, Homo sapiens
gagtttgttctgttctggggga

SEQ ID NO: 4143190 - DNA, 23 bp, Homo sapiens
gagttttcctctatacatctctc

SEQ ID NO: 4143191 - DNA, 13 bp, Homo sapiens
gagttttgatttg

SEQ ID NO: 4143192 - DNA, 12 bp, Homo sapiens
gagtttttcctc

SEQ ID NO: 4143193 - DNA, 13 bp, Homo sapiens
gagtttttcctcc

SEQ ID NO: 4143194 - DNA, 19 bp, Homo sapiens
gagtttttgtttggagagc

SEQ ID NO: 4143195 - DNA, 17 bp, Homo sapiens
gataaaataaataattt

SEQ ID NO: 4143196 - DNA, 15 bp, Homo sapiens
gataaagatatcaat

SEQ ID NO: 4143197 - DNA, 22 bp, Homo sapiens
gataaagatgcaaggaccagga

SEQ ID NO: 4143198 - DNA, 13 bp, Homo sapiens
gataaatatttga

SEQ ID NO: 4143199 - DNA, 15 bp, Homo sapiens
gataaatcatttcag

SEQ ID NO: 4143200 - DNA, 14 bp, Homo sapiens
gataacacttaaaa

SEQ ID NO: 4143201 - DNA, 23 bp, Homo sapiens
gataagccactctgtcccttcct

SEQ ID NO: 4143202 - DNA, 16 bp, Homo sapiens
gataagtgtatttttc

SEQ ID NO: 4143203 - DNA, 23 bp, Homo sapiens
gataatatctttgtgataattta

SEQ ID NO: 4143204 - DNA, 23 bp, Homo sapiens
gataatgaaataatcagtgactg

SEQ ID NO: 4143205 - DNA, 18 bp, Homo sapiens
gataatgccccaaggaca

SEQ ID NO: 4143206 - DNA, 13 bp, Homo sapiens
gataatgttaaat

SEQ ID NO: 4143207 - DNA, 21 bp, Homo sapiens
gataatgttaaatttgtaagt

SEQ ID NO: 4143208 - DNA, 16 bp, Homo sapiens
gataattgctatttat

SEQ ID NO: 4143209 - DNA, 16 bp, Homo sapiens
gataattgttgaaatt

SEQ ID NO: 4143210 - DNA, 12 bp, Homo sapiens
gataatttgcat

SEQ ID NO: 4143211 - DNA, 22 bp, Homo sapiens
gataatttgcatattctattgt

SEQ ID NO: 4143212 - DNA, 19 bp, Homo sapiens
gatacaagtttcagacagg

SEQ ID NO: 4143213 - DNA, 19 bp, Homo sapiens
gatacaccgggcctggaga

SEQ ID NO: 4143214 - DNA, 20 bp, Homo sapiens
gatacactgaagttaacaga

SEQ ID NO: 4143215 - DNA, 21 bp, Homo sapiens
gatacaggcccctgggtttct

SEQ ID NO: 4143216 - DNA, 18 bp, Homo sapiens
gatacatatgagtgtgga

SEQ ID NO: 4143217 - DNA, 13 bp, Homo sapiens
gatacatcactgc

SEQ ID NO: 4143218 - DNA, 16 bp, Homo sapiens
gatacatcactgcttg

SEQ ID NO: 4143219 - DNA, 12 bp, Homo sapiens
gatacatgtgcc

SEQ ID NO: 4143220 - DNA, 18 bp, Homo sapiens
gataccagttcagacact

SEQ ID NO: 4143221 - DNA, 13 bp, Homo sapiens
gatacccccctct

SEQ ID NO: 4143222 - DNA, 17 bp, Homo sapiens
gatactctgtcagatgg

SEQ ID NO: 4143223 - DNA, 17 bp, Homo sapiens
gatactgcctcccccag

SEQ ID NO: 4143224 - DNA, 19 bp, Homo sapiens
gatactggaagttttgcat

SEQ ID NO: 4143225 - DNA, 20 bp, Homo sapiens
gatactggaagttttgcatt

SEQ ID NO: 4143226 - DNA, 22 bp, Homo sapiens
gatacttctgaaataaatgttc

SEQ ID NO: 4143227 - DNA, 23 bp, Homo sapiens
gatacttggatttagtttcagta

SEQ ID NO: 4143228 - DNA, 14 bp, Homo sapiens
gatagaaataaata

SEQ ID NO: 4143229 - DNA, 14 bp, Homo sapiens
gatagaggggctgc

SEQ ID NO: 4143230 - DNA, 21 bp, Homo sapiens
gatagatgcacttatgcagta

SEQ ID NO: 4143231 - DNA, 20 bp, Homo sapiens
gatagatgctggcccagggc

SEQ ID NO: 4143232 - DNA, 12 bp, Homo sapiens
gatagcactttc

SEQ ID NO: 4143233 - DNA, 14 bp, Homo sapiens
gatagcactttcta

SEQ ID NO: 4143234 - DNA, 13 bp, Homo sapiens
gatagctgcatgt

SEQ ID NO: 4143235 - DNA, 22 bp, Homo sapiens
gataggcccaaggtcccctcca

SEQ ID NO: 4143236 - DNA, 17 bp, Homo sapiens
gataggctctgcacaga

SEQ ID NO: 4143237 - DNA, 13 bp, Homo sapiens
gataggggcagag

SEQ ID NO: 4143238 - DNA, 14 bp, Homo sapiens
gatagtctttcagt

SEQ ID NO: 4143239 - DNA, 17 bp, Homo sapiens
gatagtgttctgctcct

SEQ ID NO: 4143240 - DNA, 14 bp, Homo sapiens
gatagttttctcct

SEQ ID NO: 4143241 - DNA, 12 bp, Homo sapiens
gatataaattct

SEQ ID NO: 4143242 - DNA, 13 bp, Homo sapiens
gatataaattctg

SEQ ID NO: 4143243 - DNA, 14 bp, Homo sapiens
gatatacagatgaa

SEQ ID NO: 4143244 - DNA, 17 bp, Homo sapiens
gatatacatgaaaattt

SEQ ID NO: 4143245 - DNA, 17 bp, Homo sapiens
gatatactctagatgaa

SEQ ID NO: 4143246 - DNA, 20 bp, Homo sapiens
gatatagacagtccttaaaa

SEQ ID NO: 4143247 - DNA, 17 bp, Homo sapiens
gatatataagtgtacat

SEQ ID NO: 4143248 - DNA, 14 bp, Homo sapiens
gatatatctgaaaa

SEQ ID NO: 4143249 - DNA, 23 bp, Homo sapiens
gatatatgctctgcatgttacat

SEQ ID NO: 4143250 - DNA, 17 bp, Homo sapiens
gatatattattgtaagt

SEQ ID NO: 4143251 - DNA, 22 bp, Homo sapiens
gatatattattgtaagttgtac

SEQ ID NO: 4143252 - DNA, 23 bp, Homo sapiens
gatatatttcacttttgttctgc

SEQ ID NO: 4143253 - DNA, 15 bp, Homo sapiens
gatatatttttcaca

SEQ ID NO: 4143254 - DNA, 12 bp, Homo sapiens
gatatcaaaatt

SEQ ID NO: 4143255 - DNA, 14 bp, Homo sapiens
gatatcaaaattct

SEQ ID NO: 4143256 - DNA, 16 bp, Homo sapiens
gatatcatgcaaattt

SEQ ID NO: 4143257 - DNA, 18 bp, Homo sapiens
gatatccttatcagagct

SEQ ID NO: 4143258 - DNA, 21 bp, Homo sapiens
gatatctggcctaaaatcttg

SEQ ID NO: 4143259 - DNA, 23 bp, Homo sapiens
gatatgattgtttctcaaatctt

SEQ ID NO: 4143260 - DNA, 21 bp, Homo sapiens
gatatggagtgagtcacctgc

SEQ ID NO: 4143261 - DNA, 22 bp, Homo sapiens
gatatggagtgagtcacctgct

SEQ ID NO: 4143262 - DNA, 23 bp, Homo sapiens
gatatggagtgagtcacctgctc

SEQ ID NO: 4143263 - DNA, 14 bp, Homo sapiens
gatatggcagaaga

SEQ ID NO: 4143264 - DNA, 17 bp, Homo sapiens
gatatggcagaagacac

SEQ ID NO: 4143265 - DNA, 18 bp, Homo sapiens
gatatggctgcccaggag

SEQ ID NO: 4143266 - DNA, 19 bp, Homo sapiens
gatatggctgcccaggaga

SEQ ID NO: 4143267 - DNA, 14 bp, Homo sapiens
gatatgtggtgtat

SEQ ID NO: 4143268 - DNA, 12 bp, Homo sapiens
gatattaatcaa

SEQ ID NO: 4143269 - DNA, 23 bp, Homo sapiens
gatattattagaaattagaaaaa

SEQ ID NO: 4143270 - DNA, 24 bp, Homo sapiens
gatattgatgataacacttaaaat

SEQ ID NO: 4143271 - DNA, 15 bp, Homo sapiens
gatattgtacataaa

SEQ ID NO: 4143272 - DNA, 16 bp, Homo sapiens
gatattgtacataaaa

SEQ ID NO: 4143273 - DNA, 19 bp, Homo sapiens
gatattgtcctaagtgtca

SEQ ID NO: 4143274 - DNA, 16 bp, Homo sapiens
gatattgtgaagtaca

SEQ ID NO: 4143275 - DNA, 22 bp, Homo sapiens
gatattgttcaaacaatatcat

SEQ ID NO: 4143276 - DNA, 13 bp, Homo sapiens
gatattgtttaaa

SEQ ID NO: 4143277 - DNA, 16 bp, Homo sapiens
gatattgtttaaaatt

SEQ ID NO: 4143278 - DNA, 17 bp, Homo sapiens
gatattgtttaaaattc

SEQ ID NO: 4143279 - DNA, 19 bp, Homo sapiens
gatattgtttaaaattcag

SEQ ID NO: 4143280 - DNA, 21 bp, Homo sapiens
gatattgtttaaaattcagtt

SEQ ID NO: 4143281 - DNA, 20 bp, Homo sapiens
gatattgttttctgtaaata

SEQ ID NO: 4143282 - DNA, 20 bp, Homo sapiens
gatatttaagaaaatacaat

SEQ ID NO: 4143283 - DNA, 23 bp, Homo sapiens
gatatttaagaaaatacaataaa

SEQ ID NO: 4143284 - DNA, 22 bp, Homo sapiens
gatatttaggagtgtgtgacat

SEQ ID NO: 4143285 - DNA, 13 bp, Homo sapiens
gatatttatatat

SEQ ID NO: 4143286 - DNA, 16 bp, Homo sapiens
gatatttcttgctttc

SEQ ID NO: 4143287 - DNA, 17 bp, Homo sapiens
gatatttcttgctttca

SEQ ID NO: 4143288 - DNA, 22 bp, Homo sapiens
gatatttgcattgaggaaatat

SEQ ID NO: 4143289 - DNA, 19 bp, Homo sapiens
gatattttcaaattgtatc

SEQ ID NO: 4143290 - DNA, 20 bp, Homo sapiens
gatattttcaaattgtatct

SEQ ID NO: 4143291 - DNA, 21 bp, Homo sapiens
gatattttcaacgcagccctg

SEQ ID NO: 4143292 - DNA, 20 bp, Homo sapiens
gatattttcttccaagcaaa

SEQ ID NO: 4143293 - DNA, 16 bp, Homo sapiens
gatcaaaaactatttg

SEQ ID NO: 4143294 - DNA, 23 bp, Homo sapiens
gatcaaataacttagggccaagt

SEQ ID NO: 4143295 - DNA, 14 bp, Homo sapiens
gatcaagaaagtgt

SEQ ID NO: 4143296 - DNA, 14 bp, Homo sapiens
gatcaataaaatgt

SEQ ID NO: 4143297 - DNA, 18 bp, Homo sapiens
gatcaataaaatgtgatt

SEQ ID NO: 4143298 - DNA, 15 bp, Homo sapiens
gatcaattaaatgta

SEQ ID NO: 4143299 - DNA, 16 bp, Homo sapiens
gatcaattaaatgtag

SEQ ID NO: 4143300 - DNA, 21 bp, Homo sapiens
gatcaattccctctctcagca

SEQ ID NO: 4143301 - DNA, 17 bp, Homo sapiens
gatcacaagatggaatt

SEQ ID NO: 4143302 - DNA, 13 bp, Homo sapiens
gatcacagcctcc

SEQ ID NO: 4143303 - DNA, 16 bp, Homo sapiens
gatcacagcctccagg

SEQ ID NO: 4143304 - DNA, 17 bp, Homo sapiens
gatcacagctgctttct

SEQ ID NO: 4143305 - DNA, 20 bp, Homo sapiens
gatcaccagcccggcctgct

SEQ ID NO: 4143306 - DNA, 12 bp, Homo sapiens
gatcacctgcat

SEQ ID NO: 4143307 - DNA, 20 bp, Homo sapiens
gatcactgactctgactcat

SEQ ID NO: 4143308 - DNA, 21 bp, Homo sapiens
gatcactggctggcctgagca

SEQ ID NO: 4143309 - DNA, 14 bp, Homo sapiens
gatcagaggtgtac

SEQ ID NO: 4143310 - DNA, 19 bp, Homo sapiens
gatcagaggtgtacactaa

SEQ ID NO: 4143311 - DNA, 17 bp, Homo sapiens
gatcagctgtttgtcat

SEQ ID NO: 4143312 - DNA, 17 bp, Homo sapiens
gatcagggaatccagct

SEQ ID NO: 4143313 - DNA, 20 bp, Homo sapiens
gatcagtgtaccatttgcct

SEQ ID NO: 4143314 - DNA, 24 bp, Homo sapiens
gatcagttattaaataatgttcat

SEQ ID NO: 4143315 - DNA, 14 bp, Homo sapiens
gatcatgcattgtt

SEQ ID NO: 4143316 - DNA, 14 bp, Homo sapiens
gatcatggtgtaat

SEQ ID NO: 4143317 - DNA, 23 bp, Homo sapiens
gatcatggtgtaataagacataa

SEQ ID NO: 4143318 - DNA, 15 bp, Homo sapiens
gatcatgtgtggaag

SEQ ID NO: 4143319 - DNA, 22 bp, Homo sapiens
gatcatttattttaagcactct

SEQ ID NO: 4143320 - DNA, 15 bp, Homo sapiens
gatcattttcccccc

SEQ ID NO: 4143321 - DNA, 23 bp, Homo sapiens
gatcattttccccccactctccc

SEQ ID NO: 4143322 - DNA, 13 bp, Homo sapiens
gatccaaaagaag

SEQ ID NO: 4143323 - DNA, 22 bp, Homo sapiens
gatccaaaagaagcccccagct

SEQ ID NO: 4143324 - DNA, 14 bp, Homo sapiens
gatccagaacagtg

SEQ ID NO: 4143325 - DNA, 12 bp, Homo sapiens
gatccagcctgg

SEQ ID NO: 4143326 - DNA, 21 bp, Homo sapiens
gatccagcctggggtctggag

SEQ ID NO: 4143327 - DNA, 12 bp, Homo sapiens
gatccagggaca

SEQ ID NO: 4143328 - DNA, 15 bp, Homo sapiens
gatccagggacagag

SEQ ID NO: 4143329 - DNA, 12 bp, Homo sapiens
gatccatttgcc

SEQ ID NO: 4143330 - DNA, 17 bp, Homo sapiens
gatccatttgcctttct

SEQ ID NO: 4143331 - DNA, 15 bp, Homo sapiens
gatcccacacaggct

SEQ ID NO: 4143332 - DNA, 20 bp, Homo sapiens
gatcccaccctggggacccc

SEQ ID NO: 4143333 - DNA, 21 bp, Homo sapiens
gatccccagggcagcctggat

SEQ ID NO: 4143334 - DNA, 14 bp, Homo sapiens
gatcccctcaggac

SEQ ID NO: 4143335 - DNA, 13 bp, Homo sapiens
gatccctcccccc

SEQ ID NO: 4143336 - DNA, 21 bp, Homo sapiens
gatccctcccccccatgcact

SEQ ID NO: 4143337 - DNA, 19 bp, Homo sapiens
gatccctgtgttgtctcta

SEQ ID NO: 4143338 - DNA, 18 bp, Homo sapiens
gatccctgttacccagag

SEQ ID NO: 4143339 - DNA, 20 bp, Homo sapiens
gatccctgttacccagagaa

SEQ ID NO: 4143340 - DNA, 13 bp, Homo sapiens
gatcccttccacc

SEQ ID NO: 4143341 - DNA, 19 bp, Homo sapiens
gatcccttccacctgctct

SEQ ID NO: 4143342 - DNA, 21 bp, Homo sapiens
gatccgcctacctcagcctcc

SEQ ID NO: 4143343 - DNA, 18 bp, Homo sapiens
gatcctattctcaccagg

SEQ ID NO: 4143344 - DNA, 19 bp, Homo sapiens
gatcctcacaaccacctaa

SEQ ID NO: 4143345 - DNA, 19 bp, Homo sapiens
gatcctctattttgtgatg

SEQ ID NO: 4143346 - DNA, 19 bp, Homo sapiens
gatcctctccactccatgt

SEQ ID NO: 4143347 - DNA, 17 bp, Homo sapiens
gatcctggaggcccagt

SEQ ID NO: 4143348 - DNA, 14 bp, Homo sapiens
gatcctttttccat

SEQ ID NO: 4143349 - DNA, 20 bp, Homo sapiens
gatcctttttccatcatttt

SEQ ID NO: 4143350 - DNA, 16 bp, Homo sapiens
gatcgagaccatcctg

SEQ ID NO: 4143351 - DNA, 18 bp, Homo sapiens
gatcgcagtttgcctggt

SEQ ID NO: 4143352 - DNA, 16 bp, Homo sapiens
gatcgctaagctggct

SEQ ID NO: 4143353 - DNA, 17 bp, Homo sapiens
gatcggagcctcctctc

SEQ ID NO: 4143354 - DNA, 14 bp, Homo sapiens
gatctatttcatgt

SEQ ID NO: 4143355 - DNA, 19 bp, Homo sapiens
gatctcagaggctcagaga

SEQ ID NO: 4143356 - DNA, 21 bp, Homo sapiens
gatctcagaggctcagagact

SEQ ID NO: 4143357 - DNA, 19 bp, Homo sapiens
gatctcagggcagacagcc

SEQ ID NO: 4143358 - DNA, 13 bp, Homo sapiens
gatctccaaggac

SEQ ID NO: 4143359 - DNA, 12 bp, Homo sapiens
gatctccactga

SEQ ID NO: 4143360 - DNA, 22 bp, Homo sapiens
gatctccactgataagactgtt

SEQ ID NO: 4143361 - DNA, 13 bp, Homo sapiens
gatctcctgacct

SEQ ID NO: 4143362 - DNA, 14 bp, Homo sapiens
gatctctcaggagc

SEQ ID NO: 4143363 - DNA, 19 bp, Homo sapiens
gatctctcaggagcacagg

SEQ ID NO: 4143364 - DNA, 21 bp, Homo sapiens
gatctctcaggagcacaggca

SEQ ID NO: 4143365 - DNA, 24 bp, Homo sapiens
gatctctcaggagcacaggcagct

SEQ ID NO: 4143366 - DNA, 16 bp, Homo sapiens
gatctctcctggccta

SEQ ID NO: 4143367 - DNA, 19 bp, Homo sapiens
gatctctctagctttgtca

SEQ ID NO: 4143368 - DNA, 13 bp, Homo sapiens
gatctctcttgtc

SEQ ID NO: 4143369 - DNA, 21 bp, Homo sapiens
gatctctcttgtcctcttctg

SEQ ID NO: 4143370 - DNA, 19 bp, Homo sapiens
gatctgcttgttgcatttc

SEQ ID NO: 4143371 - DNA, 19 bp, Homo sapiens
gatctggaacctcagcctg

SEQ ID NO: 4143372 - DNA, 21 bp, Homo sapiens
gatctggaacctcagcctggc

SEQ ID NO: 4143373 - DNA, 18 bp, Homo sapiens
gatctggacagaacattt

SEQ ID NO: 4143374 - DNA, 19 bp, Homo sapiens
gatctgggcattttcctcc

SEQ ID NO: 4143375 - DNA, 20 bp, Homo sapiens
gatctgggcattttcctcct

SEQ ID NO: 4143376 - DNA, 21 bp, Homo sapiens
gatctgggcattttcctcctc

SEQ ID NO: 4143377 - DNA, 22 bp, Homo sapiens
gatctgggcattttcctcctct

SEQ ID NO: 4143378 - DNA, 23 bp, Homo sapiens
gatctgggcattttcctcctctg

SEQ ID NO: 4143379 - DNA, 19 bp, Homo sapiens
gatctgtcacaccagccat

SEQ ID NO: 4143380 - DNA, 14 bp, Homo sapiens
gatctgtcctcagc

SEQ ID NO: 4143381 - DNA, 14 bp, Homo sapiens
gatctgtgccccat

SEQ ID NO: 4143382 - DNA, 18 bp, Homo sapiens
gatctgttttgaaggcaa

SEQ ID NO: 4143383 - DNA, 19 bp, Homo sapiens
gatcttagggtgaaccact

SEQ ID NO: 4143384 - DNA, 16 bp, Homo sapiens
gatcttcaatggcttt

SEQ ID NO: 4143385 - DNA, 20 bp, Homo sapiens
gatcttctgggagcaggaac

SEQ ID NO: 4143386 - DNA, 19 bp, Homo sapiens
gatcttctttataattcta

SEQ ID NO: 4143387 - DNA, 19 bp, Homo sapiens
gatcttgcattcattttct

SEQ ID NO: 4143388 - DNA, 17 bp, Homo sapiens
gatcttgccactgtact

SEQ ID NO: 4143389 - DNA, 11 bp, Homo sapiens
gatctttcagg

SEQ ID NO: 4143390 - DNA, 12 bp, Homo sapiens
gatctttcagga

SEQ ID NO: 4143391 - DNA, 14 bp, Homo sapiens
gatgaaaacatagc

SEQ ID NO: 4143392 - DNA, 19 bp, Homo sapiens
gatgaactctttctggcct

SEQ ID NO: 4143393 - DNA, 20 bp, Homo sapiens
gatgaagtcacccctttctg

SEQ ID NO: 4143394 - DNA, 22 bp, Homo sapiens
gatgaagtttgtagttgtttta

SEQ ID NO: 4143395 - DNA, 17 bp, Homo sapiens
gatgaagttttacattg

SEQ ID NO: 4143396 - DNA, 16 bp, Homo sapiens
gatgaatcaatgaaaa

SEQ ID NO: 4143397 - DNA, 13 bp, Homo sapiens
gatgaatgagaat

SEQ ID NO: 4143398 - DNA, 19 bp, Homo sapiens
gatgaatgaggtcccaggc

SEQ ID NO: 4143399 - DNA, 23 bp, Homo sapiens
gatgaatgaggtcccaggcagag

SEQ ID NO: 4143400 - DNA, 20 bp, Homo sapiens
gatgacacccaccctgtgcc

SEQ ID NO: 4143401 - DNA, 18 bp, Homo sapiens
gatgacaccctggcctga

SEQ ID NO: 4143402 - DNA, 19 bp, Homo sapiens
gatgacaggcgcctgccat

SEQ ID NO: 4143403 - DNA, 20 bp, Homo sapiens
gatgacaggcgcctgccatc

SEQ ID NO: 4143404 - DNA, 22 bp, Homo sapiens
gatgaccagggatgctgggctg

SEQ ID NO: 4143405 - DNA, 14 bp, Homo sapiens
gatgagcaaggaca

SEQ ID NO: 4143406 - DNA, 20 bp, Homo sapiens
gatgagcagtcacactgtta

SEQ ID NO: 4143407 - DNA, 18 bp, Homo sapiens
gatgataaatatggttaa

SEQ ID NO: 4143408 - DNA, 12 bp, Homo sapiens
gatgatgctgtg

SEQ ID NO: 4143409 - DNA, 16 bp, Homo sapiens
gatgatgctgtgacaa

SEQ ID NO: 4143410 - DNA, 14 bp, Homo sapiens
gatgattaaacacc

SEQ ID NO: 4143411 - DNA, 14 bp, Homo sapiens
gatgcaaagaaaat

SEQ ID NO: 4143412 - DNA, 17 bp, Homo sapiens
gatgcaagatatttata

SEQ ID NO: 4143413 - DNA, 19 bp, Homo sapiens
gatgcaaggaccaggactc

SEQ ID NO: 4143414 - DNA, 18 bp, Homo sapiens
gatgcacagtatcttttc

SEQ ID NO: 4143415 - DNA, 15 bp, Homo sapiens
gatgcacatccctgg

SEQ ID NO: 4143416 - DNA, 20 bp, Homo sapiens
gatgcagacagggggccaga

SEQ ID NO: 4143417 - DNA, 23 bp, Homo sapiens
gatgcagacagggggccagaaca

SEQ ID NO: 4143418 - DNA, 23 bp, Homo sapiens
gatgcagagagccattttgtgaa

SEQ ID NO: 4143419 - DNA, 20 bp, Homo sapiens
gatgcaggacaggaggcggc

SEQ ID NO: 4143420 - DNA, 15 bp, Homo sapiens
gatgcagggcagtca

SEQ ID NO: 4143421 - DNA, 21 bp, Homo sapiens
gatgcaggttggaaggggcct

SEQ ID NO: 4143422 - DNA, 16 bp, Homo sapiens
gatgcatcactgggtg

SEQ ID NO: 4143423 - DNA, 19 bp, Homo sapiens
gatgccactcctccctccg

SEQ ID NO: 4143424 - DNA, 14 bp, Homo sapiens
gatgccagcttctc

SEQ ID NO: 4143425 - DNA, 21 bp, Homo sapiens
gatgccctttggaaagccatt

SEQ ID NO: 4143426 - DNA, 21 bp, Homo sapiens
gatgcctacaaccatccctgc

SEQ ID NO: 4143427 - DNA, 18 bp, Homo sapiens
gatgccttttttgtagtt

SEQ ID NO: 4143428 - DNA, 13 bp, Homo sapiens
gatgcgccttgct

SEQ ID NO: 4143429 - DNA, 21 bp, Homo sapiens
gatgcggtggctcacgcctgt

SEQ ID NO: 4143430 - DNA, 13 bp, Homo sapiens
gatgctaataaac

SEQ ID NO: 4143431 - DNA, 15 bp, Homo sapiens
gatgctaataaactg

SEQ ID NO: 4143432 - DNA, 16 bp, Homo sapiens
gatgctaataaactgt

SEQ ID NO: 4143433 - DNA, 18 bp, Homo sapiens
gatgctatggtcaggtta

SEQ ID NO: 4143434 - DNA, 15 bp, Homo sapiens
gatgctatttatgca

SEQ ID NO: 4143435 - DNA, 14 bp, Homo sapiens
gatgctccctcagc

SEQ ID NO: 4143436 - DNA, 20 bp, Homo sapiens
gatgctccctcagcctcaga

SEQ ID NO: 4143437 - DNA, 21 bp, Homo sapiens
gatgctccctcagcctcagag

SEQ ID NO: 4143438 - DNA, 23 bp, Homo sapiens
gatgctccctcccctgccctggt

SEQ ID NO: 4143439 - DNA, 14 bp, Homo sapiens
gatgctctttccca

SEQ ID NO: 4143440 - DNA, 17 bp, Homo sapiens
gatgctgactgtactcc

SEQ ID NO: 4143441 - DNA, 11 bp, Homo sapiens
gatgctgctcc

SEQ ID NO: 4143442 - DNA, 14 bp, Homo sapiens
gatgctgctccgcc

SEQ ID NO: 4143443 - DNA, 15 bp, Homo sapiens
gatgctgctccgccc

SEQ ID NO: 4143444 - DNA, 14 bp, Homo sapiens
gatgctggagaggt

SEQ ID NO: 4143445 - DNA, 12 bp, Homo sapiens
gatgctggccca

SEQ ID NO: 4143446 - DNA, 16 bp, Homo sapiens
gatgctggcccagggc

SEQ ID NO: 4143447 - DNA, 17 bp, Homo sapiens
gatgctggcccagggcc

SEQ ID NO: 4143448 - DNA, 21 bp, Homo sapiens
gatgctgggcaatgaggcaga

SEQ ID NO: 4143449 - DNA, 12 bp, Homo sapiens
gatgctgggctg

SEQ ID NO: 4143450 - DNA, 16 bp, Homo sapiens
gatgctgtgctatgaa

SEQ ID NO: 4143451 - DNA, 16 bp, Homo sapiens
gatgcttctctccttg

SEQ ID NO: 4143452 - DNA, 12 bp, Homo sapiens
gatggaaaataa

SEQ ID NO: 4143453 - DNA, 13 bp, Homo sapiens
gatggaaaataaa

SEQ ID NO: 4143454 - DNA, 23 bp, Homo sapiens
gatggaaaggattgtaggtgcaa

SEQ ID NO: 4143455 - DNA, 18 bp, Homo sapiens
gatggaccaacctgctct

SEQ ID NO: 4143456 - DNA, 16 bp, Homo sapiens
gatggactgggaggag

SEQ ID NO: 4143457 - DNA, 18 bp, Homo sapiens
gatggacttacctggcag

SEQ ID NO: 4143458 - DNA, 20 bp, Homo sapiens
gatggagccagctctgcatt

SEQ ID NO: 4143459 - DNA, 14 bp, Homo sapiens
gatggagcccccag

SEQ ID NO: 4143460 - DNA, 18 bp, Homo sapiens
gatggagcccccagatag

SEQ ID NO: 4143461 - DNA, 23 bp, Homo sapiens
gatggagcccccagatagagctg

SEQ ID NO: 4143462 - DNA, 17 bp, Homo sapiens
gatggaggttctcagag

SEQ ID NO: 4143463 - DNA, 18 bp, Homo sapiens
gatggagtccagggaaga

SEQ ID NO: 4143464 - DNA, 17 bp, Homo sapiens
gatggataaactgagcc

SEQ ID NO: 4143465 - DNA, 23 bp, Homo sapiens
gatggatgccaatattaaatctg

SEQ ID NO: 4143466 - DNA, 18 bp, Homo sapiens
gatggattctcagatatt

SEQ ID NO: 4143467 - DNA, 16 bp, Homo sapiens
gatggccagcccctgg

SEQ ID NO: 4143468 - DNA, 23 bp, Homo sapiens
gatggccagtttgaagcctgtgc

SEQ ID NO: 4143469 - DNA, 17 bp, Homo sapiens
gatggccccgcaaggcc

SEQ ID NO: 4143470 - DNA, 18 bp, Homo sapiens
gatggccggagaggaccg

SEQ ID NO: 4143471 - DNA, 17 bp, Homo sapiens
gatggccttaatttcct

SEQ ID NO: 4143472 - DNA, 20 bp, Homo sapiens
gatggcctttccttccctct

SEQ ID NO: 4143473 - DNA, 17 bp, Homo sapiens
gatggctgaggcaggag

SEQ ID NO: 4143474 - DNA, 20 bp, Homo sapiens
gatgggaatagggagacagg

SEQ ID NO: 4143475 - DNA, 16 bp, Homo sapiens
gatgggacagggaggc

SEQ ID NO: 4143476 - DNA, 17 bp, Homo sapiens
gatgggacagggaggcc

SEQ ID NO: 4143477 - DNA, 18 bp, Homo sapiens
gatgggacagggaggcca

SEQ ID NO: 4143478 - DNA, 20 bp, Homo sapiens
gatgggaccagggatggggg

SEQ ID NO: 4143479 - DNA, 16 bp, Homo sapiens
gatgggactcattgta

SEQ ID NO: 4143480 - DNA, 23 bp, Homo sapiens
gatgggagctcctctcctggagg

SEQ ID NO: 4143481 - DNA, 20 bp, Homo sapiens
gatgggagggaggctcaggt

SEQ ID NO: 4143482 - DNA, 18 bp, Homo sapiens
gatgggagtgggcacctc

SEQ ID NO: 4143483 - DNA, 21 bp, Homo sapiens
gatgggccacggctgagcctt

SEQ ID NO: 4143484 - DNA, 22 bp, Homo sapiens
gatggggataaaatgactactt
